United States Patent 7,618,814 (MICRORNA-RELATED NUCLEIC ACIDS AND USES THEREOF) - sequence listing, part 9

SEQ ID NO: 318947 - RNA, 24 nt, Human
agcuccaacugaggaccucuccaa

SEQ ID NO: 318948 - RNA, 31 nt, Human
agcuccaagagagucaguguagcugaaacuu

SEQ ID NO: 318949 - RNA, 24 nt, Human
agcuccaagauauaagcccuccaa

SEQ ID NO: 318950 - RNA, 32 nt, Human
agcuccaagcccuucaggaguuccaagggaac

SEQ ID NO: 318951 - RNA, 32 nt, Human
agcuccaagggugcuaccaggggaagauggga

SEQ ID NO: 318952 - RNA, 32 nt, Human
agcuccaaguauuccuccucaaggcaccagug

SEQ ID NO: 318953 - RNA, 32 nt, Human
agcuccaaugagguaaccagcaucccccucca

SEQ ID NO: 318954 - RNA, 32 nt, Human
agcuccacaaccaccuccagccugggagauag

SEQ ID NO: 318955 - RNA, 32 nt, Human
agcuccacaccugucaggauucuguuacuucu

SEQ ID NO: 318956 - RNA, 32 nt, Human
agcuccacacuaucucuuagcugaguuuuugc

SEQ ID NO: 318957 - RNA, 32 nt, Human
agcuccacagccuuucccuauaccucacccua

SEQ ID NO: 318958 - RNA, 32 nt, Human
agcuccacaggccugcacucggagucuggggc

SEQ ID NO: 318959 - RNA, 32 nt, Human
agcuccaccacugagcacccgugugacucuuu

SEQ ID NO: 318960 - RNA, 32 nt, Human
agcuccaccucccagguucacaccauucuccc

SEQ ID NO: 318961 - RNA, 32 nt, Human
agcuccaccucccagguucacaccauucucuu

SEQ ID NO: 318962 - RNA, 32 nt, Human
agcuccaccucccagguucacgccauucuccu

SEQ ID NO: 318963 - RNA, 32 nt, Human
agcuccaccucccagguucaugccauucuccu

SEQ ID NO: 318964 - RNA, 32 nt, Human
agcuccaccuccuggguucaagcgauucucuu

SEQ ID NO: 318965 - RNA, 32 nt, Human
agcuccaccugacauugcaggauccaugggga

SEQ ID NO: 318966 - RNA, 32 nt, Human
agcuccaccugcccucuccugcugcuuccucu

SEQ ID NO: 318967 - RNA, 32 nt, Human
agcuccaccugcugccccagugcuggauccac

SEQ ID NO: 318968 - RNA, 32 nt, Human
agcuccacucaucugcggcaucugucaucauc

SEQ ID NO: 318969 - RNA, 32 nt, Human
agcuccacuccuuggcuggaggcagugcugag

SEQ ID NO: 318970 - RNA, 18 nt, Human
agcuccacucuccugccc

SEQ ID NO: 318971 - RNA, 32 nt, Human
agcuccacugucacccuccaccucuucacccc

SEQ ID NO: 318972 - RNA, 32 nt, Human
agcuccacuguggccacgagaccucagaaggc

SEQ ID NO: 318973 - RNA, 21 nt, Human
agcuccagagaaaagauucaa

SEQ ID NO: 318974 - RNA, 32 nt, Human
agcuccagaguaugaugaccccagccccaucc

SEQ ID NO: 318975 - RNA, 32 nt, Human
agcuccagaguccuugguuucugucugagaac

SEQ ID NO: 318976 - RNA, 18 nt, Human
agcuccagcagcuggacg

SEQ ID NO: 318977 - RNA, 32 nt, Human
agcuccagcccagccuucuacuuugugucccu

SEQ ID NO: 318978 - RNA, 32 nt, Human
agcuccagcccgcugaaaacagacuggaccca

SEQ ID NO: 318979 - RNA, 28 nt, Human
agcuccagccucccgguggccucugcag

SEQ ID NO: 318980 - RNA, 32 nt, Human
agcuccagcuacucaggaggcugaggcgggag

SEQ ID NO: 318981 - RNA, 21 nt, Human
agcuccagcuccagcccgggc

SEQ ID NO: 318982 - RNA, 32 nt, Human
agcuccaggacugagagccccaggaagcuugg

SEQ ID NO: 318983 - RNA, 32 nt, Human
agcuccaggauguggaggaaggaagaugagaa

SEQ ID NO: 318984 - RNA, 21 nt, Human
agcuccaggccucccuuccag

SEQ ID NO: 318985 - RNA, 32 nt, Human
agcuccaggccucccuuccagucagaacaguu

SEQ ID NO: 318986 - RNA, 32 nt, Human
agcuccaggcuggagccagugaagggugcacc

SEQ ID NO: 318987 - RNA, 32 nt, Human
agcuccagggagcagagugucggggauggagg

SEQ ID NO: 318988 - RNA, 32 nt, Human
agcuccaggggauuccaccaccucggacgccu

SEQ ID NO: 318989 - RNA, 32 nt, Human
agcuccaggugcucaguguggugaccugcuca

SEQ ID NO: 318990 - RNA, 32 nt, Human
agcuccagucucccucauuugagcaauacucu

SEQ ID NO: 318991 - RNA, 32 nt, Human
agcuccaguuaaggauucggauucaagacuau

SEQ ID NO: 318992 - RNA, 32 nt, Human
agcuccaucaagaggaauugugucuaagagga

SEQ ID NO: 318993 - RNA, 32 nt, Human
agcuccaucauuuaccaacugugugaccuuac

SEQ ID NO: 318994 - RNA, 24 nt, Human
agcuccaucccacaacggccucaa

SEQ ID NO: 318995 - RNA, 32 nt, Human
agcuccaucccccacaguccaucuccauucgg

SEQ ID NO: 318996 - RNA, 32 nt, Human
agcuccaucucccagguucacgccauucuccc

SEQ ID NO: 318997 - RNA, 32 nt, Human
agcuccaugcaaccucugccuccuggguucaa

SEQ ID NO: 318998 - RNA, 32 nt, Human
agcuccaugccagagcaggagccccggucaau

SEQ ID NO: 318999 - RNA, 32 nt, Human
agcuccaugcuccagggcuuugcuccagaaca

SEQ ID NO: 319000 - RNA, 32 nt, Human
agcuccauggcuuagcggaggaggcggcagug

SEQ ID NO: 319001 - RNA, 32 nt, Human
agcuccauggugagcacucacagucuaaggcu

SEQ ID NO: 319002 - RNA, 32 nt, Human
agcuccauguuccuccuccucucuccccacuu

SEQ ID NO: 319003 - RNA, 23 nt, Human
agcuccauuccgcucccacccca

SEQ ID NO: 319004 - RNA, 32 nt, Human
agcuccauucuggccuccuccaccaccugccu

SEQ ID NO: 319005 - RNA, 32 nt, Human
agcucccaaaggacuggguucagagagcuucu

SEQ ID NO: 319006 - RNA, 32 nt, Human
agcucccaacccagccugauguuagcccagaa

SEQ ID NO: 319007 - RNA, 32 nt, Human
agcucccaccacugcacuccagccugggcgac

SEQ ID NO: 319008 - RNA, 32 nt, Human
agcucccaccauuuucuuuugaugugguuuua

SEQ ID NO: 319009 - RNA, 32 nt, Human
agcucccacccugcccuggccuggguggagga

SEQ ID NO: 319010 - RNA, 32 nt, Human
agcucccaccuacagacccagggagagaucug

SEQ ID NO: 319011 - RNA, 32 nt, Human
agcucccacgauccugaaauucuguuaacgaa

SEQ ID NO: 319012 - RNA, 32 nt, Human
agcucccacugcagaagggccucuugagugcg

SEQ ID NO: 319013 - RNA, 32 nt, Human
agcucccacugcaguaccaccauacggggccc

SEQ ID NO: 319014 - RNA, 32 nt, Human
agcucccagaaaccaccuuccuucauguggag

SEQ ID NO: 319015 - RNA, 19 nt, Human
agcucccagccuuccaugg

SEQ ID NO: 319016 - RNA, 19 nt, Human
agcucccagccuuuucagg

SEQ ID NO: 319017 - RNA, 32 nt, Human
agcucccaggacgcagggagacccugggagag

SEQ ID NO: 319018 - RNA, 32 nt, Human
agcucccaggaugaacugguugcaguggcugc

SEQ ID NO: 319019 - RNA, 23 nt, Human
agcucccaggccaacgcccaaag

SEQ ID NO: 319020 - RNA, 32 nt, Human
agcucccaggggacagagguguagcuccaauc

SEQ ID NO: 319021 - RNA, 21 nt, Human
agcucccagguauuuucuaca

SEQ ID NO: 319022 - RNA, 32 nt, Human
agcucccaguccagagagaagccagacaauua

SEQ ID NO: 319023 - RNA, 32 nt, Human
agcucccaucccuccuuccucuccuucuccaa

SEQ ID NO: 319024 - RNA, 32 nt, Human
agcucccaucccucgggaugcccaggagaggc

SEQ ID NO: 319025 - RNA, 32 nt, Human
agcucccaugagcaugcauaguucaccagacc

SEQ ID NO: 319026 - RNA, 32 nt, Human
agcuccccaagccugugcgccucguccucagc

SEQ ID NO: 319027 - RNA, 32 nt, Human
agcuccccaagcucccugccuauucccccacc

SEQ ID NO: 319028 - RNA, 32 nt, Human
agcuccccaaguagcugggacuagaggcaugc

SEQ ID NO: 319029 - RNA, 28 nt, Human
agcuccccaagugauucuacguucccca

SEQ ID NO: 319030 - RNA, 32 nt, Human
agcuccccacacagcgcugggccagagaggca

SEQ ID NO: 319031 - RNA, 32 nt, Human
agcuccccacacugcaccaugagcucaguugg

SEQ ID NO: 319032 - RNA, 20 nt, Human
agcuccccacauccccugca

SEQ ID NO: 319033 - RNA, 29 nt, Human
agcuccccacgucgucgccgccgccgccg

SEQ ID NO: 319034 - RNA, 32 nt, Human
agcuccccagaacacugcucgacauggaaacc

SEQ ID NO: 319035 - RNA, 21 nt, Human
agcuccccagacuggaggcug

SEQ ID NO: 319036 - RNA, 32 nt, Human
agcuccccagaggcggugguccccgugcuugu

SEQ ID NO: 319037 - RNA, 32 nt, Human
agcuccccaggaaaucccaugacaaacuggcc

SEQ ID NO: 319038 - RNA, 32 nt, Human
agcuccccaggaguucagugcagguguuucua

SEQ ID NO: 319039 - RNA, 32 nt, Human
agcuccccaguguucagccuccuucacucccu

SEQ ID NO: 319040 - RNA, 32 nt, Human
agcuccccaucuucccuagaggcugccugcgc

SEQ ID NO: 319041 - RNA, 32 nt, Human
agcuccccauuuccuuucucaccuccuccucc

SEQ ID NO: 319042 - RNA, 32 nt, Human
agcucccccagccuccugcagaguugccugca

SEQ ID NO: 319043 - RNA, 32 nt, Human
agcucccccgcggccuggaguggugcgccccg

SEQ ID NO: 319044 - RNA, 32 nt, Human
agcucccccucccuccccuugccugugccagg

SEQ ID NO: 319045 - RNA, 32 nt, Human
agcucccccuuccucucggucucccucucggc

SEQ ID NO: 319046 - RNA, 32 nt, Human
agcuccccgccuggccuggcccuccccaggcg

SEQ ID NO: 319047 - RNA, 25 nt, Human
agcuccccuccccacccuccucuuc

SEQ ID NO: 319048 - RNA, 32 nt, Human
agcuccccuccccaguccacagagccaucucc

SEQ ID NO: 319049 - RNA, 32 nt, Human
agcuccccuccucuccccuccacugucuucuu

SEQ ID NO: 319050 - RNA, 32 nt, Human
agcuccccugcacccaccagggagcuugagca

SEQ ID NO: 319051 - RNA, 32 nt, Human
agcuccccugccacccagccucugaggccggc

SEQ ID NO: 319052 - RNA, 32 nt, Human
agcuccccugucggccagcuaagagagcuggg

SEQ ID NO: 319053 - RNA, 32 nt, Human
agcuccccuguggucuucaggaaagguuuuga

SEQ ID NO: 319054 - RNA, 32 nt, Human
agcuccccuucccagguucaagcaauucuccu

SEQ ID NO: 319055 - RNA, 32 nt, Human
agcucccgagcacagccgcacuccuguugacc

SEQ ID NO: 319056 - RNA, 22 nt, Human
agcucccgccagccgcucccca

SEQ ID NO: 319057 - RNA, 19 nt, Human
agcucccgcccccugcgcc

SEQ ID NO: 319058 - RNA, 22 nt, Human
agcucccgccccucgcccccca

SEQ ID NO: 319059 - RNA, 19 nt, Human
agcucccgcccugccugcc

SEQ ID NO: 319060 - RNA, 19 nt, Human
agcucccgccugcauguca

SEQ ID NO: 319061 - RNA, 20 nt, Human
agcucccgccugggucgcca

SEQ ID NO: 319062 - RNA, 18 nt, Human
agcucccggccgggcuga

SEQ ID NO: 319063 - RNA, 32 nt, Human
agcucccgggccugccaugagcucuccgccgc

SEQ ID NO: 319064 - RNA, 32 nt, Human
agcucccgucuguguccccuuccaaaucucau

SEQ ID NO: 319065 - RNA, 28 nt, Human
agcucccgugcaucugccucaucucucc

SEQ ID NO: 319066 - RNA, 32 nt, Human
agcucccuaguggcuuccuccgucugcaaugu

SEQ ID NO: 319067 - RNA, 32 nt, Human
agcucccucugaguugcgcugggcuuggcugc

SEQ ID NO: 319068 - RNA, 32 nt, Human
agcucccucuguccucugucagccuggccuga

SEQ ID NO: 319069 - RNA, 32 nt, Human
agcucccugagaagcugggaccacaggccugg

SEQ ID NO: 319070 - RNA, 32 nt, Human
agcucccugauuacaccugccaccuuggaauc

SEQ ID NO: 319071 - RNA, 32 nt, Human
agcucccugauucaaagaaauauuucucaugu

SEQ ID NO: 319072 - RNA, 24 nt, Human
agcucccugcaaccuccaccuccu

SEQ ID NO: 319073 - RNA, 32 nt, Human
agcucccugcaaccuccaccuccuggguucaa

SEQ ID NO: 319074 - RNA, 32 nt, Human
agcucccugcaaccuccgccucccggguucau

SEQ ID NO: 319075 - RNA, 32 nt, Human
agcucccugcaaccuccgccuccuggguucaa

SEQ ID NO: 319076 - RNA, 32 nt, Human
agcucccugcaagccccucagguugggccuug

SEQ ID NO: 319077 - RNA, 32 nt, Human
agcucccugcaaggaggguuuuccugcggugg

SEQ ID NO: 319078 - RNA, 18 nt, Human
agcucccugcgggcacag

SEQ ID NO: 319079 - RNA, 32 nt, Human
agcucccugcuuggcucugucucuccacaccc

SEQ ID NO: 319080 - RNA, 22 nt, Human
agcucccuggaagcccagaggc

SEQ ID NO: 319081 - RNA, 32 nt, Human
agcucccuggcaggcaggcugugggcuggugg

SEQ ID NO: 319082 - RNA, 32 nt, Human
agcucccuggcuccaggcagugcuugcucccc

SEQ ID NO: 319083 - RNA, 19 nt, Human
agcucccuggcuucuggcu

SEQ ID NO: 319084 - RNA, 23 nt, Human
agcucccuguaaccucaaacucc

SEQ ID NO: 319085 - RNA, 32 nt, Human
agcucccuguaaccucaaacucccaggcucaa

SEQ ID NO: 319086 - RNA, 20 nt, Human
agcucccuguggccuggaga

SEQ ID NO: 319087 - RNA, 32 nt, Human
agcucccuguucuuggaucugccauggaggga

SEQ ID NO: 319088 - RNA, 32 nt, Human
agcucccuuccgaggcugcagggccaggcgcg

SEQ ID NO: 319089 - RNA, 32 nt, Human
agcucccuugucauucugacuccugggcuuac

SEQ ID NO: 319090 - RNA, 32 nt, Human
agcucccuuuaaccuccagcuccuggguucaa

SEQ ID NO: 319091 - RNA, 32 nt, Human
agcucccuuuguggggaacuugcccucuucug

SEQ ID NO: 319092 - RNA, 32 nt, Human
agcuccgaaagggagagcagagauggcagcug

SEQ ID NO: 319093 - RNA, 31 nt, Human
agcuccgaacaaugguucucauuuggcuaag

SEQ ID NO: 319094 - RNA, 32 nt, Human
agcuccgagacaccugaagagcccuccagccc

SEQ ID NO: 319095 - RNA, 32 nt, Human
agcuccgagggcaggugcacauagccaaccaa

SEQ ID NO: 319096 - RNA, 32 nt, Human
agcuccgauuacaggcacccaccaccacgucc

SEQ ID NO: 319097 - RNA, 32 nt, Human
agcuccgccaucuggguucaagcgauucuccu

SEQ ID NO: 319098 - RNA, 22 nt, Human
agcuccgcccgagaccccggca

SEQ ID NO: 319099 - RNA, 22 nt, Human
agcuccgccgggcguccuggca

SEQ ID NO: 319100 - RNA, 32 nt, Human
agcuccgccucccagauucacgccauucuccu

SEQ ID NO: 319101 - RNA, 32 nt, Human
agcuccgccucccagguucacaccauucuccu

SEQ ID NO: 319102 - RNA, 32 nt, Human
agcuccgccucccagguucacgccauucuccc

SEQ ID NO: 319103 - RNA, 32 nt, Human
agcuccgccucccagguucacgccauucuccu

SEQ ID NO: 319104 - RNA, 32 nt, Human
agcuccgccucccagguucaugccauucuccu

SEQ ID NO: 319105 - RNA, 32 nt, Human
agcuccgccucccagguucccgccauucuccu

SEQ ID NO: 319106 - RNA, 32 nt, Human
agcuccgccucccgaguucaagcaauucuccu

SEQ ID NO: 319107 - RNA, 32 nt, Human
agcuccgccuccuggguucaagcgauucuccu

SEQ ID NO: 319108 - RNA, 32 nt, Human
agcuccgccuccuggguucacgucauuuuccu

SEQ ID NO: 319109 - RNA, 32 nt, Human
agcuccgccuccuggguucacgugauucucau

SEQ ID NO: 319110 - RNA, 22 nt, Human
agcuccgcgagcugcccgagca

SEQ ID NO: 319111 - RNA, 32 nt, Human
agcuccgcguagcaccugcccaaccaaacuca

SEQ ID NO: 319112 - RNA, 23 nt, Human
agcuccgcugccggcccuggaca

SEQ ID NO: 319113 - RNA, 24 nt, Human
agcuccgcugcggaaaacccgagc

SEQ ID NO: 319114 - RNA, 32 nt, Human
agcuccggaaggcagguggguaauggaugaug

SEQ ID NO: 319115 - RNA, 32 nt, Human
agcuccggcagggaggaugauacagucagaca

SEQ ID NO: 319116 - RNA, 17 nt, Human
agcuccggccgcugccc

SEQ ID NO: 319117 - RNA, 32 nt, Human
agcuccggcugaagcaagaaguccuccagcug

SEQ ID NO: 319118 - RNA, 32 nt, Human
agcuccgggaggcugcaguggcggcagcugag

SEQ ID NO: 319119 - RNA, 32 nt, Human
agcuccgggccugcucgcuaggcccgggaggc

SEQ ID NO: 319120 - RNA, 32 nt, Human
agcuccgucagcccugacucggcccggagcug

SEQ ID NO: 319121 - RNA, 32 nt, Human
agcuccgucggucuuucucuucucuuuuaaga

SEQ ID NO: 319122 - RNA, 32 nt, Human
agcuccgugacccaggcuggaaugcaauggcu

SEQ ID NO: 319123 - RNA, 32 nt, Human
agcuccgugcgcgggcugcagaugucugaccu

SEQ ID NO: 319124 - RNA, 32 nt, Human
agcuccguggguggcaggacugaacuugaaca

SEQ ID NO: 319125 - RNA, 32 nt, Human
agcuccuaaaaaugguagaauacacaugaaaa

SEQ ID NO: 319126 - RNA, 32 nt, Human
agcuccuaagaccugaaaacucuucucaagaa

SEQ ID NO: 319127 - RNA, 32 nt, Human
agcuccuacagcuaccuggccugagaagccaa

SEQ ID NO: 319128 - RNA, 32 nt, Human
agcuccuacccacuccccuugaggacugcugc

SEQ ID NO: 319129 - RNA, 32 nt, Human
agcuccuacucugucuaaagagggccacagug

SEQ ID NO: 319130 - RNA, 32 nt, Human
agcuccuaggccuggacugagcucucaggggg

SEQ ID NO: 319131 - RNA, 32 nt, Human
agcuccuaggucucagagaacucccccaccug

SEQ ID NO: 319132 - RNA, 32 nt, Human
agcuccuagguuucccugucuacgccucccga

SEQ ID NO: 319133 - RNA, 32 nt, Human
agcuccuaucucagaaaacaaaaacaacaaaa

SEQ ID NO: 319134 - RNA, 32 nt, Human
agcuccuauuacugcuggguuuuggaggcugc

SEQ ID NO: 319135 - RNA, 32 nt, Human
agcuccucacacuuauggcuauuucugacgua

SEQ ID NO: 319136 - RNA, 32 nt, Human
agcuccucacugcuacagccuagaaggugaga

SEQ ID NO: 319137 - RNA, 32 nt, Human
agcuccucagccccaaagagcagagagagggg

SEQ ID NO: 319138 - RNA, 22 nt, Human
agcuccucagugcuucuuacca

SEQ ID NO: 319139 - RNA, 32 nt, Human
agcuccucaguuacccaggcugcaggccccgg

SEQ ID NO: 319140 - RNA, 32 nt, Human
agcuccucaugcuugaggcuguggugaugcac

SEQ ID NO: 319141 - RNA, 32 nt, Human
agcuccucauuuccucccccaucagccccugg

SEQ ID NO: 319142 - RNA, 32 nt, Human
agcuccuccaaagccuguucaagcucuaagcg

SEQ ID NO: 319143 - RNA, 18 nt, Human
agcuccucccacccaaau

SEQ ID NO: 319144 - RNA, 32 nt, Human
agcuccucccuuucuuucuuuuuccaccugag

SEQ ID NO: 319145 - RNA, 32 nt, Human
agcuccucgaguagcugggaccacacagacag

SEQ ID NO: 319146 - RNA, 32 nt, Human
agcuccucgaugucagcuuuuugugcuggacu

SEQ ID NO: 319147 - RNA, 32 nt, Human
agcuccucgggaggcaggagaaucgcuugaac

SEQ ID NO: 319148 - RNA, 32 nt, Human
agcuccucuaaccccuguucugaugggggagg

SEQ ID NO: 319149 - RNA, 32 nt, Human
agcuccucucgcacccagaggagcuccuuucc

SEQ ID NO: 319150 - RNA, 32 nt, Human
agcuccucugcagcuuccuccucagccucccu

SEQ ID NO: 319151 - RNA, 32 nt, Human
agcuccucugcaugugggugcaauggcgucuu

SEQ ID NO: 319152 - RNA, 32 nt, Human
agcuccucugccauauaaacaaaaagaggaaa

SEQ ID NO: 319153 - RNA, 32 nt, Human
agcuccucugggcucuggccucaggcccacua

SEQ ID NO: 319154 - RNA, 32 nt, Human
agcuccugacauaccugguaaaaguucucaag

SEQ ID NO: 319155 - RNA, 23 nt, Human
agcuccugaccucagaugaucua

SEQ ID NO: 319156 - RNA, 19 nt, Human
agcuccugaccucggguga

SEQ ID NO: 319157 - RNA, 23 nt, Human
agcuccugaccucgggugaucca

SEQ ID NO: 319158 - RNA, 23 nt, Human
agcuccugagagccucugccaca

SEQ ID NO: 319159 - RNA, 31 nt, Human
agcuccugaguagcugggccugugcacuggg

SEQ ID NO: 319160 - RNA, 32 nt, Human
agcuccugcaccucauccuccacccaccagag

SEQ ID NO: 319161 - RNA, 23 nt, Human
agcuccugcagccgccgccgcug

SEQ ID NO: 319162 - RNA, 21 nt, Human
agcuccugccuccaagugcug

SEQ ID NO: 319163 - RNA, 32 nt, Human
agcuccugccucccagccuucucuccaggccc

SEQ ID NO: 319164 - RNA, 18 nt, Human
agcuccugccuccugccc

SEQ ID NO: 319165 - RNA, 32 nt, Human
agcuccugccuccugguggccucugaagaccc

SEQ ID NO: 319166 - RNA, 31 nt, Human
agcuccugccucuaauggccugguuaggcuc

SEQ ID NO: 319167 - RNA, 32 nt, Human
agcuccugccuggauucccagcacuuugggag

SEQ ID NO: 319168 - RNA, 24 nt, Human
agcuccugccuguacccucccaua

SEQ ID NO: 319169 - RNA, 32 nt, Human
agcuccugccuucucuaugcagccugcccucc

SEQ ID NO: 319170 - RNA, 32 nt, Human
agcuccugccuugccagccugcucuccauugc

SEQ ID NO: 319171 - RNA, 32 nt, Human
agcuccugcugacuccccuuauggaucucagu

SEQ ID NO: 319172 - RNA, 32 nt, Human
agcuccugcugggcuccagccagaguagucac

SEQ ID NO: 319173 - RNA, 23 nt, Human
agcuccuggaccggcccuuccca

SEQ ID NO: 319174 - RNA, 32 nt, Human
agcuccuggacucaccugaggcucccuggggg

SEQ ID NO: 319175 - RNA, 29 nt, Human
agcuccuggcagcuuucauccccagcagc

SEQ ID NO: 319176 - RNA, 32 nt, Human
agcuccuggcaugggggugcucugucuucgcc

SEQ ID NO: 319177 - RNA, 32 nt, Human
agcuccuggccagcugauucaggucauccggg

SEQ ID NO: 319178 - RNA, 32 nt, Human
agcuccuggccaggcugcugccaaggucaagc

SEQ ID NO: 319179 - RNA, 19 nt, Human
agcuccuggcccccgagga

SEQ ID NO: 319180 - RNA, 32 nt, Human
agcuccugggaaugagauuaaaggaggcaggg

SEQ ID NO: 319181 - RNA, 22 nt, Human
agcuccugggccggcccucaca

SEQ ID NO: 319182 - RNA, 21 nt, Human
agcuccugggcgaaucccaca

SEQ ID NO: 319183 - RNA, 32 nt, Human
agcuccuggguuucagcaauucuccugccuca

SEQ ID NO: 319184 - RNA, 32 nt, Human
agcuccuggucaggaagccaaucugaaaacag

SEQ ID NO: 319185 - RNA, 32 nt, Human
agcuccuggucugguggguagagccagagcug

SEQ ID NO: 319186 - RNA, 32 nt, Human
agcuccuguauccuucucauccuugucucucc

SEQ ID NO: 319187 - RNA, 21 nt, Human
agcuccuguccaugccugcca

SEQ ID NO: 319188 - RNA, 32 nt, Human
agcuccuguggaauguuugguugcucugaagu

SEQ ID NO: 319189 - RNA, 32 nt, Human
agcuccuguuuggaaauggggagcuggccuag

SEQ ID NO: 319190 - RNA, 32 nt, Human
agcuccuuccaccagaaggcacugccugcagg

SEQ ID NO: 319191 - RNA, 32 nt, Human
agcuccuucccaggaccccucagcuccccggc

SEQ ID NO: 319192 - RNA, 32 nt, Human
agcuccuucccccucgcaaugcacugaaaggc

SEQ ID NO: 319193 - RNA, 32 nt, Human
agcuccuucccuuccugugaguucuccaguua

SEQ ID NO: 319194 - RNA, 32 nt, Human
agcuccuuccuccuccuccuccuccucuggua

SEQ ID NO: 319195 - RNA, 32 nt, Human
agcuccuuccuugcuccacuuuccccagagua

SEQ ID NO: 319196 - RNA, 32 nt, Human
agcuccuucugggaccagagggugggacggcc

SEQ ID NO: 319197 - RNA, 32 nt, Human
agcuccuugaaggcagggagaaaagacagacu

SEQ ID NO: 319198 - RNA, 19 nt, Human
agcuccuugaccucugagg

SEQ ID NO: 319199 - RNA, 22 nt, Human
agcuccuugcugcucuucaaca

SEQ ID NO: 319200 - RNA, 32 nt, Human
agcuccuuuacuugcugcuccaacugcagugc

SEQ ID NO: 319201 - RNA, 32 nt, Human
agcuccuuucaugcuccauuuuuaaccacuug

SEQ ID NO: 319202 - RNA, 32 nt, Human
agcuccuuucucuuggcugagugacagguggc

SEQ ID NO: 319203 - RNA, 32 nt, Human
agcuccuuucuucucccacaucugcccacuga

SEQ ID NO: 319204 - RNA, 32 nt, Human
agcuccuuucuuuuccucuggucuuuguggga

SEQ ID NO: 319205 - RNA, 32 nt, Human
agcuccuuuggugugugggugcucugaccuca

SEQ ID NO: 319206 - RNA, 32 nt, Human
agcucgaaggagauggaucuguuucucaggac

SEQ ID NO: 319207 - RNA, 32 nt, Human
agcucgaaggggccauaugacacuccucccgg

SEQ ID NO: 319208 - RNA, 19 nt, Human
agcucgagaguaugugcug

SEQ ID NO: 319209 - RNA, 32 nt, Human
agcucgagccugugaccaccugugcuguggag

SEQ ID NO: 319210 - RNA, 32 nt, Human
agcucgaggcugucuucaccagcugggcuggg

SEQ ID NO: 319211 - RNA, 32 nt, Human
agcucgaugucaggcaucagaugcugaagacu

SEQ ID NO: 319212 - RNA, 32 nt, Human
agcucgcacucuuugucuucuggucacuccuc

SEQ ID NO: 319213 - RNA, 32 nt, Human
agcucgcagugagccgagaucacgccacugca

SEQ ID NO: 319214 - RNA, 32 nt, Human
agcucgccagagagucuauguaugggauugaa

SEQ ID NO: 319215 - RNA, 32 nt, Human
agcucgccccugagccugaggagaccugggua

SEQ ID NO: 319216 - RNA, 32 nt, Human
agcucgccgcaaccuccgccucccagguucaa

SEQ ID NO: 319217 - RNA, 32 nt, Human
agcucgcgccauugcacuccagccuuggaaca

SEQ ID NO: 319218 - RNA, 32 nt, Human
agcucgcuacaaccucuaccucccagccaccu

SEQ ID NO: 319219 - RNA, 32 nt, Human
agcucgcuccuguaaucccagcacuuugggag

SEQ ID NO: 319220 - RNA, 32 nt, Human
agcucgcucuuuccuuccuuccuaagcuaucc

SEQ ID NO: 319221 - RNA, 23 nt, Human
agcucgcugcaacccccaccucc

SEQ ID NO: 319222 - RNA, 32 nt, Human
agcucgcugcaacccccaccucccagguucaa

SEQ ID NO: 319223 - RNA, 32 nt, Human
agcucgcugcaaccuccaccuccugggcucac

SEQ ID NO: 319224 - RNA, 32 nt, Human
agcucgcugcaaccuccaccuccuggguucaa

SEQ ID NO: 319225 - RNA, 32 nt, Human
agcucgcugcaaccuccaccuuccggguucaa

SEQ ID NO: 319226 - RNA, 32 nt, Human
agcucgcugcaagcuccgccucccaaguucac

SEQ ID NO: 319227 - RNA, 32 nt, Human
agcucgcugcagccuccaccucccggacucca

SEQ ID NO: 319228 - RNA, 32 nt, Human
agcucgcugccuggugcuugucuuggcgagau

SEQ ID NO: 319229 - RNA, 16 nt, Human
agcucgcuucuaacug

SEQ ID NO: 319230 - RNA, 32 nt, Human
agcucgcuucuaacuggacugcacguugguga

SEQ ID NO: 319231 - RNA, 32 nt, Human
agcucggaagauggaggcugcagugagccaug

SEQ ID NO: 319232 - RNA, 32 nt, Human
agcucggacuacaggcacgagccaccaugccc

SEQ ID NO: 319233 - RNA, 32 nt, Human
agcucggagcagagaaggccagagcagagagg

SEQ ID NO: 319234 - RNA, 32 nt, Human
agcucggagcagucccagaagggagggcuguc

SEQ ID NO: 319235 - RNA, 32 nt, Human
agcucggccacggguggcgaggcugcggugag

SEQ ID NO: 319236 - RNA, 32 nt, Human
agcucggccuccuggguucaaaugauucuccu

SEQ ID NO: 319237 - RNA, 32 nt, Human
agcucggcgaccaugcccuccaugcagugcaa

SEQ ID NO: 319238 - RNA, 32 nt, Human
agcucggcggaggcacgccccucgccuccccg

SEQ ID NO: 319239 - RNA, 32 nt, Human
agcucggcucacugcaaccucugccacacggg

SEQ ID NO: 319240 - RNA, 32 nt, Human
agcucgggaggcacagcucacagacacaggaa

SEQ ID NO: 319241 - RNA, 32 nt, Human
agcucggggaugggugccauuugagcccagcu

SEQ ID NO: 319242 - RNA, 32 nt, Human
agcucggggccuugccucuugcagcuacucug

SEQ ID NO: 319243 - RNA, 32 nt, Human
agcucgggugguggagaugacaaggacacugu

SEQ ID NO: 319244 - RNA, 32 nt, Human
agcucggucaccaaggaaugcccaacaucccu

SEQ ID NO: 319245 - RNA, 32 nt, Human
agcucggugacuuuucuuucugccaccauuua

SEQ ID NO: 319246 - RNA, 32 nt, Human
agcucgucggucuccgaggauggagauagcuc

SEQ ID NO: 319247 - RNA, 32 nt, Human
agcucgucucaaacuccuggccucaagugauc

SEQ ID NO: 319248 - RNA, 32 nt, Human
agcucgugccuguaauaccaacauuuugggag

SEQ ID NO: 319249 - RNA, 20 nt, Human
agcucgugccuucucugggg

SEQ ID NO: 319250 - RNA, 32 nt, Human
agcucgugcuuccguuugugcacucuggcugc

SEQ ID NO: 319251 - RNA, 32 nt, Human
agcucguggaaagacgcgcgagagggggccgg

SEQ ID NO: 319252 - RNA, 32 nt, Human
agcucguggagguggugguugaaaggugagaa

SEQ ID NO: 319253 - RNA, 32 nt, Human
agcucguuauacugcauucucuuuaucacaua

SEQ ID NO: 319254 - RNA, 32 nt, Human
agcucguuguuuugaucuauguaggggccguu

SEQ ID NO: 319255 - RNA, 32 nt, Human
agcucguuuuaacugaagugugagaaggaggu

SEQ ID NO: 319256 - RNA, 32 nt, Human
agcucuaacugauucagggccccugaagugac

SEQ ID NO: 319257 - RNA, 32 nt, Human
agcucuaagucucaacugcucuuuuauacugu

SEQ ID NO: 319258 - RNA, 32 nt, Human
agcucuaauggcagcauaaaucaaagaauuuc

SEQ ID NO: 319259 - RNA, 32 nt, Human
agcucuacggccgccucuacuccgagagcuca

SEQ ID NO: 319260 - RNA, 32 nt, Human
agcucuagaaacacuucugaugcaugaaaaau

SEQ ID NO: 319261 - RNA, 32 nt, Human
agcucuagaagcagcuggacuugaacccacaa

SEQ ID NO: 319262 - RNA, 32 nt, Human
agcucuagaggcacccugcaucaugcccacca

SEQ ID NO: 319263 - RNA, 32 nt, Human
agcucuagagugagggguggguggaaccuggg

SEQ ID NO: 319264 - RNA, 32 nt, Human
agcucuagccaccgucccuugaucucucauac

SEQ ID NO: 319265 - RNA, 32 nt, Human
agcucuagcugcaggcugccuggguggccuuc

SEQ ID NO: 319266 - RNA, 32 nt, Human
agcucuagcugcauauuugauguaaaugacaa

SEQ ID NO: 319267 - RNA, 31 nt, Human
agcucuaggaaacuaauacagcugcuaaaau

SEQ ID NO: 319268 - RNA, 23 nt, Human
agcucuauaugcacagcccagca

SEQ ID NO: 319269 - RNA, 32 nt, Human
agcucuaucacccaggcugaagugcaguggua

SEQ ID NO: 319270 - RNA, 32 nt, Human
agcucucaaaucccucuccaacugccuaaggc

SEQ ID NO: 319271 - RNA, 32 nt, Human
agcucucacacaugacuggagagaagugagaa

SEQ ID NO: 319272 - RNA, 32 nt, Human
agcucucacauuuuguuaaauucauguauuua

SEQ ID NO: 319273 - RNA, 32 nt, Human
agcucucacccagagcgucagugaguuggugc

SEQ ID NO: 319274 - RNA, 21 nt, Human
agcucucacccuaacacuaua

SEQ ID NO: 319275 - RNA, 32 nt, Human
agcucucagcuuccacugcuccccuuguuccc

SEQ ID NO: 319276 - RNA, 32 nt, Human
agcucucaguccauugcgacaguugccaugau

SEQ ID NO: 319277 - RNA, 32 nt, Human
agcucucagucccacagcucucaggccccucu

SEQ ID NO: 319278 - RNA, 32 nt, Human
agcucucaucacuccuucacuuggucugucug

SEQ ID NO: 319279 - RNA, 32 nt, Human
agcucucauccagaccacgugcaaccaaugau

SEQ ID NO: 319280 - RNA, 32 nt, Human
agcucucaugagggguaguggaggagacaggc

SEQ ID NO: 319281 - RNA, 32 nt, Human
agcucucaugccaagaccugcgccuaacggca

SEQ ID NO: 319282 - RNA, 32 nt, Human
agcucuccagaagggaugcaagcucuccagaa

SEQ ID NO: 319283 - RNA, 32 nt, Human
agcucuccagaauaugcuuguuggagauccuu

SEQ ID NO: 319284 - RNA, 32 nt, Human
agcucuccagccugggcgacagagugagacuc

SEQ ID NO: 319285 - RNA, 32 nt, Human
agcucuccaucuuuagcccuuuccccugugug

SEQ ID NO: 319286 - RNA, 21 nt, Human
agcucuccauuugccaugauu

SEQ ID NO: 319287 - RNA, 32 nt, Human
agcucucccaauguuucuccucuccuucccau

SEQ ID NO: 319288 - RNA, 32 nt, Human
agcucucccagaugugugcccaccccaccacu

SEQ ID NO: 319289 - RNA, 32 nt, Human
agcucuccccaccuucccaguguggaaguaga

SEQ ID NO: 319290 - RNA, 32 nt, Human
agcucuccccagccccguggguggugacuuug

SEQ ID NO: 319291 - RNA, 26 nt, Human
agcucucccgcugggggcacugcggg

SEQ ID NO: 319292 - RNA, 32 nt, Human
agcucucccuagccugccucucuagguuuuuc

SEQ ID NO: 319293 - RNA, 32 nt, Human
agcucucccucuggcccugcuucuucggggaa

SEQ ID NO: 319294 - RNA, 32 nt, Human
agcucucccugcuguuguaugugugcauucac

SEQ ID NO: 319295 - RNA, 32 nt, Human
agcucucccuggcagagaaagacacuuccccc

SEQ ID NO: 319296 - RNA, 32 nt, Human
agcucuccucagagagccaggucuaaugccca

SEQ ID NO: 319297 - RNA, 32 nt, Human
agcucuccuuuccuugcugaggugcucucgga

SEQ ID NO: 319298 - RNA, 32 nt, Human
agcucuccuuucucaucuccuguuucagaugc

SEQ ID NO: 319299 - RNA, 32 nt, Human
agcucucgacuuagagguaauaugaacagaug

SEQ ID NO: 319300 - RNA, 32 nt, Human
agcucucgccuguaaucccagcacuuugggag

SEQ ID NO: 319301 - RNA, 32 nt, Human
agcucucgucugacaagugcuuuugcuuucuu

SEQ ID NO: 319302 - RNA, 32 nt, Human
agcucucuacaucacgguaaucaugccuaugc

SEQ ID NO: 319303 - RNA, 24 nt, Human
agcucucucagacccuugaagaug

SEQ ID NO: 319304 - RNA, 32 nt, Human
agcucucucaucuccuggaaccauggccagca

SEQ ID NO: 319305 - RNA, 32 nt, Human
agcucucucuuauuccaguacuauaucacuuu

SEQ ID NO: 319306 - RNA, 32 nt, Human
agcucucugaaacuuauugauggaaaccugug

SEQ ID NO: 319307 - RNA, 32 nt, Human
agcucucugaaggcugaugaccaccuguuucu

SEQ ID NO: 319308 - RNA, 32 nt, Human
agcucucugagcgggagguggaagaaaggaug

SEQ ID NO: 319309 - RNA, 32 nt, Human
agcucucugcaaccuccaccuccuggguucaa

SEQ ID NO: 319310 - RNA, 32 nt, Human
agcucucugcaaccucugccucccagguucaa

SEQ ID NO: 319311 - RNA, 32 nt, Human
agcucucugcaagugagagaauucuuugggaa

SEQ ID NO: 319312 - RNA, 32 nt, Human
agcucucugccuccaugucaccaccuuugaag

SEQ ID NO: 319313 - RNA, 32 nt, Human
agcucucugccuccuccucccuuucucccuug

SEQ ID NO: 319314 - RNA, 32 nt, Human
agcucucugcuguccaguaggcugcuucucug

SEQ ID NO: 319315 - RNA, 32 nt, Human
agcucucuggaaaauccugaguguaggggaga

SEQ ID NO: 319316 - RNA, 32 nt, Human
agcucucuguucugcucugugcccaacugcga

SEQ ID NO: 319317 - RNA, 18 nt, Human
agcucucuuggccuuaca

SEQ ID NO: 319318 - RNA, 32 nt, Human
agcucugaaccaaagaaaucauuugauucaag

SEQ ID NO: 319319 - RNA, 31 nt, Human
agcucugaacuucuccuucauccagggaugg

SEQ ID NO: 319320 - RNA, 32 nt, Human
agcucugaagagagaaaagcggcgguguccug

SEQ ID NO: 319321 - RNA, 32 nt, Human
agcucugacauuguuuuugucuuguaggauuu

SEQ ID NO: 319322 - RNA, 32 nt, Human
agcucugaccccuauggugguggaggccaaua

SEQ ID NO: 319323 - RNA, 32 nt, Human
agcucugacuccaggcccuguccccugagcuc

SEQ ID NO: 319324 - RNA, 32 nt, Human
agcucugagacacagcacccagccuucucgca

SEQ ID NO: 319325 - RNA, 32 nt, Human
agcucugaggccacugcucucccuucaacccu

SEQ ID NO: 319326 - RNA, 32 nt, Human
agcucugaguagcugggauuauaggcaugcac

SEQ ID NO: 319327 - RNA, 32 nt, Human
agcucugaugguaccacugcacuccagccugg

SEQ ID NO: 319328 - RNA, 32 nt, Human
agcucugcacacacagcauuuucaaagcuugu

SEQ ID NO: 319329 - RNA, 32 nt, Human
agcucugcagagccaugggccagguggggcug

SEQ ID NO: 319330 - RNA, 32 nt, Human
agcucugcagugucccauccacccucacaccg

SEQ ID NO: 319331 - RNA, 22 nt, Human
agcucugcaugcagccccagca

SEQ ID NO: 319332 - RNA, 32 nt, Human
agcucugccacugggccggcugagguggcugc

SEQ ID NO: 319333 - RNA, 32 nt, Human
agcucugccaucaucagcaccaggagagccga

SEQ ID NO: 319334 - RNA, 32 nt, Human
agcucugccaucuuggagccagcagcuccaga

SEQ ID NO: 319335 - RNA, 32 nt, Human
agcucugccccaggggcugagcugccaccaga

SEQ ID NO: 319336 - RNA, 18 nt, Human
agcucugccccuccgccc

SEQ ID NO: 319337 - RNA, 18 nt, Human
agcucugccccucugccc

SEQ ID NO: 319338 - RNA, 32 nt, Human
agcucugcccugcaaguucacacuagagaaag

SEQ ID NO: 319339 - RNA, 23 nt, Human
agcucugccgcgcccccacccca

SEQ ID NO: 319340 - RNA, 32 nt, Human
agcucugccucccagguucacaccauucuccu

SEQ ID NO: 319341 - RNA, 32 nt, Human
agcucugccucccagguucacgccauucuccu

SEQ ID NO: 319342 - RNA, 32 nt, Human
agcucugccuccuggguucaagcgauuccccu

SEQ ID NO: 319343 - RNA, 32 nt, Human
agcucugccuccuggguucaagcgauucucuu

SEQ ID NO: 319344 - RNA, 32 nt, Human
agcucugcgaggccgggcgccgccauggaacu

SEQ ID NO: 319345 - RNA, 32 nt, Human
agcucugcgucgguccuggugcccuggaugcc

SEQ ID NO: 319346 - RNA, 32 nt, Human
agcucugcucagaacaaagagaagucuuuugc

SEQ ID NO: 319347 - RNA, 21 nt, Human
agcucugcugcccccacccca

SEQ ID NO: 319348 - RNA, 32 nt, Human
agcucugcugcgaugccucugccucaucucac

SEQ ID NO: 319349 - RNA, 32 nt, Human
agcucugcuguucacugguuguaugaucuugg

SEQ ID NO: 319350 - RNA, 32 nt, Human
agcucugcuucucucuuccucaucucccaaua

SEQ ID NO: 319351 - RNA, 32 nt, Human
agcucuggacagguggggcacugaggcagccc

SEQ ID NO: 319352 - RNA, 32 nt, Human
agcucuggacugccucugcaaggucagaaggg

SEQ ID NO: 319353 - RNA, 31 nt, Human
agcucuggacuucucacuucuagggcagagg

SEQ ID NO: 319354 - RNA, 32 nt, Human
agcucuggagguggaggcugccaugagccaug

SEQ ID NO: 319355 - RNA, 32 nt, Human
agcucuggaguuucugcuggaaguguuuaaug

SEQ ID NO: 319356 - RNA, 32 nt, Human
agcucuggaugcuggguaacccagagguaaug

SEQ ID NO: 319357 - RNA, 32 nt, Human
agcucuggccaaagcgcguaccaccuuucauc

SEQ ID NO: 319358 - RNA, 32 nt, Human
agcucuggccccggugcugccugcaugccaag

SEQ ID NO: 319359 - RNA, 32 nt, Human
agcucuggccccuaugaugguggaggccaaua

SEQ ID NO: 319360 - RNA, 32 nt, Human
agcucuggccgcugccuuccagggcucccgag

SEQ ID NO: 319361 - RNA, 21 nt, Human
agcucuggcucauggaucuca

SEQ ID NO: 319362 - RNA, 32 nt, Human
agcucuggcugaacccugugcugguguccuga

SEQ ID NO: 319363 - RNA, 32 nt, Human
agcucuggcuuccagaaaaccccagcauccuu

SEQ ID NO: 319364 - RNA, 32 nt, Human
agcucuggcuuuagauuucuucaucauaagga

SEQ ID NO: 319365 - RNA, 32 nt, Human
agcucuggcuuugccuuggcuuugccagggcu

SEQ ID NO: 319366 - RNA, 19 nt, Human
agcucugggaaaguaggau

SEQ ID NO: 319367 - RNA, 19 nt, Human
agcucugggaaauggagga

SEQ ID NO: 319368 - RNA, 20 nt, Human
agcucugggaggcaggcgca

SEQ ID NO: 319369 - RNA, 32 nt, Human
agcucugggagguggaagcauggggugggauc

SEQ ID NO: 319370 - RNA, 32 nt, Human
agcucugggaugacaggcgugagccacagcac

SEQ ID NO: 319371 - RNA, 32 nt, Human
agcucugggcccucuuugcucacuuuucugac

SEQ ID NO: 319372 - RNA, 32 nt, Human
agcucugggcugaccgccaaggcuccggcccg

SEQ ID NO: 319373 - RNA, 18 nt, Human
agcucugggcuucagaga

SEQ ID NO: 319374 - RNA, 32 nt, Human
agcucugggcuuccucuucgcccggguggcgu

SEQ ID NO: 319375 - RNA, 32 nt, Human
agcucuggggcuugcaccuccacaaaguaagg

SEQ ID NO: 319376 - RNA, 32 nt, Human
agcucugggggaggaggaggaugggaccuccu

SEQ ID NO: 319377 - RNA, 22 nt, Human
agcucugggugugccagaggac

SEQ ID NO: 319378 - RNA, 21 nt, Human
agcucuggucccucagccgca

SEQ ID NO: 319379 - RNA, 21 nt, Human
agcucuggucugucaaucuca

SEQ ID NO: 319380 - RNA, 22 nt, Human
agcucuggucugugcagacuca

SEQ ID NO: 319381 - RNA, 32 nt, Human
agcucuggugcagcuuaagccucuccacggug

SEQ ID NO: 319382 - RNA, 32 nt, Human
agcucuggugcugguggacagugccccuccca

SEQ ID NO: 319383 - RNA, 32 nt, Human
agcucugguguucaaagaguccuggucaauuc

SEQ ID NO: 319384 - RNA, 22 nt, Human
agcucugguuugaaaguagcca

SEQ ID NO: 319385 - RNA, 32 nt, Human
agcucuguaacugucacacugcaccugagcug

SEQ ID NO: 319386 - RNA, 18 nt, Human
agcucuguaccccugccc

SEQ ID NO: 319387 - RNA, 19 nt, Human
agcucuguauuuuuuggca

SEQ ID NO: 319388 - RNA, 32 nt, Human
agcucugucaccaggcuggagugcaguggugc

SEQ ID NO: 319389 - RNA, 32 nt, Human
agcucugucacccaggcuggagugcaguggug

SEQ ID NO: 319390 - RNA, 32 nt, Human
agcucugucacccaggcuggagugccauagug

SEQ ID NO: 319391 - RNA, 32 nt, Human
agcucugucagugacaaacacuccuuuggccu

SEQ ID NO: 319392 - RNA, 32 nt, Human
agcucuguccccugggcuggagugcaauggug

SEQ ID NO: 319393 - RNA, 32 nt, Human
agcucugucguccaggcuggagugcagugacu

SEQ ID NO: 319394 - RNA, 21 nt, Human
agcucugucugccuuguucuu

SEQ ID NO: 319395 - RNA, 32 nt, Human
agcucugucugcucaaugccauugugcagaga

SEQ ID NO: 319396 - RNA, 32 nt, Human
agcucugugaugucagagcaucuacugggacu

SEQ ID NO: 319397 - RNA, 32 nt, Human
agcucugugcaauugaaaucauuuuucuucau

SEQ ID NO: 319398 - RNA, 32 nt, Human
agcucugugccccucacccugcucccucucgc

SEQ ID NO: 319399 - RNA, 32 nt, Human
agcucuguggcccaggcuggcgugcagugggc

SEQ ID NO: 319400 - RNA, 32 nt, Human
agcucuguggccucuuuuggggugggggcggg

SEQ ID NO: 319401 - RNA, 32 nt, Human
agcucugugggugggagugagacaaaacacag

SEQ ID NO: 319402 - RNA, 32 nt, Human
agcucuguuaccacuuguuagaaggcagguca

SEQ ID NO: 319403 - RNA, 23 nt, Human
agcucuguucccuccugcuuugg

SEQ ID NO: 319404 - RNA, 32 nt, Human
agcucuguuccuuggcuuguccuuccuucccg

SEQ ID NO: 319405 - RNA, 32 nt, Human
agcucuguucucgcuccugagcagcugcuagg

SEQ ID NO: 319406 - RNA, 32 nt, Human
agcucuguucucuccagcaccucccaacccac

SEQ ID NO: 319407 - RNA, 32 nt, Human
agcucuguucucuucggaagaccucguuuucu

SEQ ID NO: 319408 - RNA, 32 nt, Human
agcucuguugcccaggcuggagugcaguggug

SEQ ID NO: 319409 - RNA, 32 nt, Human
agcucuguuucccccucuccccaaagccuuca

SEQ ID NO: 319410 - RNA, 22 nt, Human
agcucuuacagcaagcccauca

SEQ ID NO: 319411 - RNA, 32 nt, Human
agcucuuacgaaaaacccagguuagaccgcau

SEQ ID NO: 319412 - RNA, 32 nt, Human
agcucuuaggacacauucccagaagagcggaa

SEQ ID NO: 319413 - RNA, 32 nt, Human
agcucuuagggaggcagaggcaggaggauagc

SEQ ID NO: 319414 - RNA, 32 nt, Human
agcucuucaaagaaaaccuuugaaagauuuau

SEQ ID NO: 319415 - RNA, 32 nt, Human
agcucuucacaguccuggacuccugccaccag

SEQ ID NO: 319416 - RNA, 32 nt, Human
agcucuucaccguguuuccagccugggaccaa

SEQ ID NO: 319417 - RNA, 32 nt, Human
agcucuucacuccagcaugcacaugcccucuu

SEQ ID NO: 319418 - RNA, 32 nt, Human
agcucuucagcacaaagacacagacuugggga

SEQ ID NO: 319419 - RNA, 32 nt, Human
agcucuucaggaacccacaucucuccagagcu

SEQ ID NO: 319420 - RNA, 32 nt, Human
agcucuucaggaauccacaucucuccagagcu

SEQ ID NO: 319421 - RNA, 32 nt, Human
agcucuucaggccaagucagagcugcuguugc

SEQ ID NO: 319422 - RNA, 32 nt, Human
agcucuucaucagccugcugucuacucagacg

SEQ ID NO: 319423 - RNA, 32 nt, Human
agcucuucauguuucaggagagaguugaaccu

SEQ ID NO: 319424 - RNA, 32 nt, Human
agcucuucauuuauaaagcuauuugaaggggu

SEQ ID NO: 319425 - RNA, 32 nt, Human
agcucuucauuucuugaacuaccuuccuuuuc

SEQ ID NO: 319426 - RNA, 32 nt, Human
agcucuucccacccucacugcgggccucugcu

SEQ ID NO: 319427 - RNA, 21 nt, Human
agcucuuccuacccuccuccc

SEQ ID NO: 319428 - RNA, 32 nt, Human
agcucuuccugcuucucuccccaucaccaugc

SEQ ID NO: 319429 - RNA, 32 nt, Human
agcucuucuacuccacugcugucuaucuugcc

SEQ ID NO: 319430 - RNA, 32 nt, Human
agcucuucucaccuccucuuagcccaacucaa

SEQ ID NO: 319431 - RNA, 32 nt, Human
agcucuucuccucucuucaucccaucucuacc

SEQ ID NO: 319432 - RNA, 32 nt, Human
agcucuucuuuugacagggcaggccuuguucu

SEQ ID NO: 319433 - RNA, 32 nt, Human
agcucuugauauucuucuguucccacccacuu

SEQ ID NO: 319434 - RNA, 32 nt, Human
agcucuugcccagagcugugcagugcaguggc

SEQ ID NO: 319435 - RNA, 32 nt, Human
agcucuugccuuuucuuccucccgcaagucuc

SEQ ID NO: 319436 - RNA, 32 nt, Human
agcucuuggcaggagugggcucugagcaguug

SEQ ID NO: 319437 - RNA, 32 nt, Human
agcucuuggggucccuggcgaggcagacgcug

SEQ ID NO: 319438 - RNA, 32 nt, Human
agcucuugucuguaaguggccucugcaggagc

SEQ ID NO: 319439 - RNA, 22 nt, Human
agcucuuuagcaauaucagcua

SEQ ID NO: 319440 - RNA, 32 nt, Human
agcucuuuccauacagucuucacucaaguguu

SEQ ID NO: 319441 - RNA, 32 nt, Human
agcucuuucccuccucccauuuccuuuaguag

SEQ ID NO: 319442 - RNA, 32 nt, Human
agcucuuucuaaggaaucugagcuguucacug

SEQ ID NO: 319443 - RNA, 32 nt, Human
agcucuuugcccagcuccuggggugggagugg

SEQ ID NO: 319444 - RNA, 32 nt, Human
agcucuuugccgucggagcgcuuguuugcugc

SEQ ID NO: 319445 - RNA, 32 nt, Human
agcucuuugcucauucuagggccaguggagga

SEQ ID NO: 319446 - RNA, 21 nt, Human
agcucuuuggaggguuggaga

SEQ ID NO: 319447 - RNA, 23 nt, Human
agcucuuugguuguuuuuggaua

SEQ ID NO: 319448 - RNA, 32 nt, Human
agcucuuugucauuccaccuccucuggucagg

SEQ ID NO: 319449 - RNA, 32 nt, Human
agcucuuuguguacugguguccaggcucugcc

SEQ ID NO: 319450 - RNA, 32 nt, Human
agcucuuuucauccaacucaguuuacaggcgu

SEQ ID NO: 319451 - RNA, 32 nt, Human
agcucuuuuggcucaacuccugcccagcuccc

SEQ ID NO: 319452 - RNA, 32 nt, Human
agcucuuuuugaaagaacuaguuucuuuuuaa

SEQ ID NO: 319453 - RNA, 32 nt, Human
agcugaaaaaggaaggcugcuucuuguguggc

SEQ ID NO: 319454 - RNA, 32 nt, Human
agcugaaaacaggcacccagcgcagacucaag

SEQ ID NO: 319455 - RNA, 32 nt, Human
agcugaaaagcuucaagagaucuaggaaaaga

SEQ ID NO: 319456 - RNA, 32 nt, Human
agcugaaaaucugaaucagaaagcuuucucaa

SEQ ID NO: 319457 - RNA, 32 nt, Human
agcugaaacuauguauccucugacccccaucu

SEQ ID NO: 319458 - RNA, 32 nt, Human
agcugaaagagaaaguagaaggaugugcauug

SEQ ID NO: 319459 - RNA, 32 nt, Human
agcugaaagagacucuggggcacuaauucaga

SEQ ID NO: 319460 - RNA, 32 nt, Human
agcugaaagccaaaggaauugaguagacaacu

SEQ ID NO: 319461 - RNA, 27 nt, Human
agcugaaagucccacuggcuggccuca

SEQ ID NO: 319462 - RNA, 32 nt, Human
agcugaaaguugggacucuggagagcggagga

SEQ ID NO: 319463 - RNA, 32 nt, Human
agcugaacagcuucgguuucuacaccaauggc

SEQ ID NO: 319464 - RNA, 32 nt, Human
agcugaacaugcccacuggcccccaggccaca

SEQ ID NO: 319465 - RNA, 32 nt, Human
agcugaacauuugcuucaggaugccauuaaga

SEQ ID NO: 319466 - RNA, 32 nt, Human
agcugaacccagguuaggggcagaucagaagg

SEQ ID NO: 319467 - RNA, 32 nt, Human
agcugaaccugccucuucaccuccaggcacua

SEQ ID NO: 319468 - RNA, 32 nt, Human
agcugaagagucaagcacagagagaucaagaa

SEQ ID NO: 319469 - RNA, 32 nt, Human
agcugaagcccgaggcaggguuggugugaugc

SEQ ID NO: 319470 - RNA, 32 nt, Human
agcugaagcggggagacucacucuccaucuca

SEQ ID NO: 319471 - RNA, 32 nt, Human
agcugaaggaagaggaucaccuuccaagacaa

SEQ ID NO: 319472 - RNA, 32 nt, Human
agcugaaggaaguaugcuuuggugagucaauu

SEQ ID NO: 319473 - RNA, 32 nt, Human
agcugaaggaccucuggaaggacugugccaac

SEQ ID NO: 319474 - RNA, 32 nt, Human
agcugaaggcaaagggagagcugguggauugc

SEQ ID NO: 319475 - RNA, 23 nt, Human
agcugaaggcacagucugcccca

SEQ ID NO: 319476 - RNA, 32 nt, Human
agcugaaggcuggagaguaacuugcauaguag

SEQ ID NO: 319477 - RNA, 32 nt, Human
agcugaaggucaggccaggacagugagaccug

SEQ ID NO: 319478 - RNA, 32 nt, Human
agcugaaguccuggugacagaguuugugagaa

SEQ ID NO: 319479 - RNA, 30 nt, Human
agcugaagucucuccauuuuucucaaagac

SEQ ID NO: 319480 - RNA, 32 nt, Human
agcugaagugcuaggucaaaauaagcagugcc

SEQ ID NO: 319481 - RNA, 32 nt, Human
agcugaaguugccugaaugauccuccuguugc

SEQ ID NO: 319482 - RNA, 32 nt, Human
agcugaaguuucagagagguuaagcaauuugc

SEQ ID NO: 319483 - RNA, 31 nt, Human
agcugaauacugcguguucucacuuauaagu

SEQ ID NO: 319484 - RNA, 32 nt, Human
agcugaaugagucugcuuucacugugacuggg

SEQ ID NO: 319485 - RNA, 31 nt, Human
agcugaaugagugccaggaagcugcgaaauc

SEQ ID NO: 319486 - RNA, 32 nt, Human
agcugaaugccuccuguggggaaagggguugg

SEQ ID NO: 319487 - RNA, 19 nt, Human
agcugaaugcucuuuggga

SEQ ID NO: 319488 - RNA, 22 nt, Human
agcugacaaugccacucuggga

SEQ ID NO: 319489 - RNA, 32 nt, Human
agcugacacauuuugaucacuauaaucaguau

SEQ ID NO: 319490 - RNA, 32 nt, Human
agcugacaccagccccucagaggaccagugcg

SEQ ID NO: 319491 - RNA, 16 nt, Human
agcugacacugauaga

SEQ ID NO: 319492 - RNA, 32 nt, Human
agcugacagaagcagcguuccugaaguggccg

SEQ ID NO: 319493 - RNA, 32 nt, Human
agcugacagacagcacugccugugcuggguuu

SEQ ID NO: 319494 - RNA, 32 nt, Human
agcugacagccugucucuauggcgcuuccuug

SEQ ID NO: 319495 - RNA, 21 nt, Human
agcugacaguaaaucucuggg

SEQ ID NO: 319496 - RNA, 32 nt, Human
agcugacauggagcugaccacagcucuuggag

SEQ ID NO: 319497 - RNA, 32 nt, Human
agcugacauucugcagccuggacggccauggc

SEQ ID NO: 319498 - RNA, 22 nt, Human
agcugaccaagacaccugagga

SEQ ID NO: 319499 - RNA, 20 nt, Human
agcugaccacagcucuugga

SEQ ID NO: 319500 - RNA, 21 nt, Human
agcugaccagaaucucuugga

SEQ ID NO: 319501 - RNA, 32 nt, Human
agcugaccagccugcucuguacagugacaaug

SEQ ID NO: 319502 - RNA, 32 nt, Human
agcugaccauccuguuuuccaucccagagccu

SEQ ID NO: 319503 - RNA, 32 nt, Human
agcugaccaucuuuaccugguccuggaacuga

SEQ ID NO: 319504 - RNA, 22 nt, Human
agcugaccauggaucccugggg

SEQ ID NO: 319505 - RNA, 21 nt, Human
agcugaccauucauucugaga

SEQ ID NO: 319506 - RNA, 32 nt, Human
agcugacccaacaagagcucucugccuccggu

SEQ ID NO: 319507 - RNA, 19 nt, Human
agcugacccacucccuggg

SEQ ID NO: 319508 - RNA, 19 nt, Human
agcugaccccacucugaga

SEQ ID NO: 319509 - RNA, 32 nt, Human
agcugaccccuucaccucucccccucccuuuu

SEQ ID NO: 319510 - RNA, 32 nt, Human
agcugacccucaacauuuccaggaugaucccc

SEQ ID NO: 319511 - RNA, 19 nt, Human
agcugaccgacaucuggga

SEQ ID NO: 319512 - RNA, 19 nt, Human
agcugaccgacuuccagga

SEQ ID NO: 319513 - RNA, 17 nt, Human
agcugaccgagcucugg

SEQ ID NO: 319514 - RNA, 32 nt, Human
agcugaccgcaugggugugagccagcuugaga

SEQ ID NO: 319515 - RNA, 21 nt, Human
agcugaccggaugcucugaga

SEQ ID NO: 319516 - RNA, 32 nt, Human
agcugaccuagaagcagcaucuucccauuucc

SEQ ID NO: 319517 - RNA, 20 nt, Human
agcugaccugacuucugugg

SEQ ID NO: 319518 - RNA, 32 nt, Human
agcugaccuuuagcucccuccugcccuugcua

SEQ ID NO: 319519 - RNA, 32 nt, Human
agcugacgacuggcccugcuucugcuggggcu

SEQ ID NO: 319520 - RNA, 32 nt, Human
agcugacgcgacuaucauucucucacaagaac

SEQ ID NO: 319521 - RNA, 32 nt, Human
agcugacgucugggugacagugaaacggggua

SEQ ID NO: 319522 - RNA, 18 nt, Human
agcugacuagaucucugg

SEQ ID NO: 319523 - RNA, 32 nt, Human
agcugacucacagagcugcagagccaggcugg

SEQ ID NO: 319524 - RNA, 22 nt, Human
agcugacucagucccucugagc

SEQ ID NO: 319525 - RNA, 32 nt, Human
agcugacuccaggagagccccaguacugccag

SEQ ID NO: 319526 - RNA, 32 nt, Human
agcugacucccagcacaucaaagaaugcaauu

SEQ ID NO: 319527 - RNA, 32 nt, Human
agcugacucccagcacauccaagaaugcgauu

SEQ ID NO: 319528 - RNA, 22 nt, Human
agcugacucgguacucucugaa

SEQ ID NO: 319529 - RNA, 24 nt, Human
agcugacucuagaggggaaggcag

SEQ ID NO: 319530 - RNA, 32 nt, Human
agcugacucucauguucucucgucucacauuu

SEQ ID NO: 319531 - RNA, 19 nt, Human
agcugacucuccucugggg

SEQ ID NO: 319532 - RNA, 32 nt, Human
agcugacucugucacacugugccuagaacucc

SEQ ID NO: 319533 - RNA, 22 nt, Human
agcugacugaacucuaccgaac

SEQ ID NO: 319534 - RNA, 32 nt, Human
agcugacugaguacaccggugaggcugggguc

SEQ ID NO: 319535 - RNA, 32 nt, Human
agcugacugcaccaccccaacccuugcacaac

SEQ ID NO: 319536 - RNA, 32 nt, Human
agcugacugcagccuugaccuccagggcucaa

SEQ ID NO: 319537 - RNA, 32 nt, Human
agcugacugccuggcuuguuucagaugcagcc

SEQ ID NO: 319538 - RNA, 32 nt, Human
agcugacugcugguccggcuucugaccggccu

SEQ ID NO: 319539 - RNA, 26 nt, Human
agcugacugcuguucacccuuugaac

SEQ ID NO: 319540 - RNA, 32 nt, Human
agcugacuguaaaaaugggaagaggcaacgga

SEQ ID NO: 319541 - RNA, 32 nt, Human
agcugacuguguacucagguauuuuauugguc

SEQ ID NO: 319542 - RNA, 32 nt, Human
agcugacuguucacacugauugcccagcacau

SEQ ID NO: 319543 - RNA, 21 nt, Human
agcugacuguuggcucucuga

SEQ ID NO: 319544 - RNA, 32 nt, Human
agcugacuucuugccuuggacccaguuuuuaa

SEQ ID NO: 319545 - RNA, 32 nt, Human
agcugacuuggaggcccuggcucaggagcuca

SEQ ID NO: 319546 - RNA, 32 nt, Human
agcugacuuucacugugagucauuccaucauu

SEQ ID NO: 319547 - RNA, 32 nt, Human
agcugagaagucagggugaggcuggaggggac

SEQ ID NO: 319548 - RNA, 32 nt, Human
agcugagaaguggucuggagaggcagaagcug

SEQ ID NO: 319549 - RNA, 32 nt, Human
agcugagaccacaggcgugugccaccacgccu

SEQ ID NO: 319550 - RNA, 32 nt, Human
agcugagaccacaggugcgugccaccacaccc

SEQ ID NO: 319551 - RNA, 32 nt, Human
agcugagacccccauccccagcugcucugagu

SEQ ID NO: 319552 - RNA, 32 nt, Human
agcugagacuacaagcacccaccaccacaccc

SEQ ID NO: 319553 - RNA, 32 nt, Human
agcugagacuacaagugugugccaccaugccu

SEQ ID NO: 319554 - RNA, 32 nt, Human
agcugagacuacaggcacacaccaccacgccc

SEQ ID NO: 319555 - RNA, 32 nt, Human
agcugagacuacaggcacacaccaccacgccu

SEQ ID NO: 319556 - RNA, 32 nt, Human
agcugagacuacaggcacaugccacuacaccc

SEQ ID NO: 319557 - RNA, 32 nt, Human
agcugagacuacaggcaccugccaccaggccc

SEQ ID NO: 319558 - RNA, 32 nt, Human
agcugagacuacaggcaccugccaccauaccc

SEQ ID NO: 319559 - RNA, 32 nt, Human
agcugagacuacaggcacgcaccaccaugccu

SEQ ID NO: 319560 - RNA, 32 nt, Human
agcugagacuacaggcaugcaccaccacgccc

SEQ ID NO: 319561 - RNA, 32 nt, Human
agcugagacuacaggccugugccaccacaccc

SEQ ID NO: 319562 - RNA, 32 nt, Human
agcugagacuacaggcgugcaccaccaugccc

SEQ ID NO: 319563 - RNA, 32 nt, Human
agcugagacuacaggcgugugccaccacaccc

SEQ ID NO: 319564 - RNA, 32 nt, Human
agcugagacuacagggguaugccaccaugccc

SEQ ID NO: 319565 - RNA, 32 nt, Human
agcugagacuacaggugagugccaccacacuc

SEQ ID NO: 319566 - RNA, 32 nt, Human
agcugagacuacaggugcaugccaccaugccu

SEQ ID NO: 319567 - RNA, 32 nt, Human
agcugagacuacaggugcgcaccaccaugccc

SEQ ID NO: 319568 - RNA, 32 nt, Human
agcugagacuccagguauaugccaccaugacc

SEQ ID NO: 319569 - RNA, 32 nt, Human
agcugagacugcacuagggucuggggacacag

SEQ ID NO: 319570 - RNA, 32 nt, Human
agcugagacuucaggugcauuccaccacacau

SEQ ID NO: 319571 - RNA, 31 nt, Human
agcugagagaacaauguuucacuuaauagga

SEQ ID NO: 319572 - RNA, 32 nt, Human
agcugagagaagaggaaaagaggaguggccag

SEQ ID NO: 319573 - RNA, 32 nt, Human
agcugagagcaggagcaggaaaaggaggcuca

SEQ ID NO: 319574 - RNA, 32 nt, Human
agcugagaucacacuacuguacuacuguacuc

SEQ ID NO: 319575 - RNA, 32 nt, Human
agcugagaucagaagagaccagcuggagacca

SEQ ID NO: 319576 - RNA, 32 nt, Human
agcugagaucagaagggaccagcuggagguag

SEQ ID NO: 319577 - RNA, 32 nt, Human
agcugagaucaggcacuucagccugggcgaca

SEQ ID NO: 319578 - RNA, 32 nt, Human
agcugagaucaugccacugaacuccagccugg

SEQ ID NO: 319579 - RNA, 32 nt, Human
agcugagauccggccaacagagcgagacucug

SEQ ID NO: 319580 - RNA, 32 nt, Human
agcugagaucgcaccaccacacuccagccugg

SEQ ID NO: 319581 - RNA, 32 nt, Human
agcugagaucgcaucauugcacugcagucuga

SEQ ID NO: 319582 - RNA, 32 nt, Human
agcugagaucgcugcacuccagccugggcgac

SEQ ID NO: 319583 - RNA, 32 nt, Human
agcugagaugguaccacugcacuccagccugg

SEQ ID NO: 319584 - RNA, 32 nt, Human
agcugagauggugccauugaacuccagucugg

SEQ ID NO: 319585 - RNA, 32 nt, Human
agcugagauuacaggcacacaccaccacgccc

SEQ ID NO: 319586 - RNA, 32 nt, Human
agcugagauuacaggcacaugccaccacaccu

SEQ ID NO: 319587 - RNA, 32 nt, Human
agcugagauuacaggcauccgccaccacgccu

SEQ ID NO: 319588 - RNA, 32 nt, Human
agcugagauuacaggcaugcaccaccacgccc

SEQ ID NO: 319589 - RNA, 32 nt, Human
agcugagauuacaggcaugcaccaccaugccc

SEQ ID NO: 319590 - RNA, 32 nt, Human
agcugagauuacaggcaugcgccaccacaccc

SEQ ID NO: 319591 - RNA, 32 nt, Human
agcugagauuacaggcaugugccaccacacuc

SEQ ID NO: 319592 - RNA, 32 nt, Human
agcugagauuacaggccucugccaccaugcuc

SEQ ID NO: 319593 - RNA, 32 nt, Human
agcugagauuacaggcgcacaccaccacgccc

SEQ ID NO: 319594 - RNA, 32 nt, Human
agcugagauuacagguacgcaccaccaugccc

SEQ ID NO: 319595 - RNA, 32 nt, Human
agcugagauuacaggugcacaccaccacaucu

SEQ ID NO: 319596 - RNA, 32 nt, Human
agcugagauuacaggugcaugccaccacugcc

SEQ ID NO: 319597 - RNA, 32 nt, Human
agcugagauuacaggugcccgccaccaugccc

SEQ ID NO: 319598 - RNA, 32 nt, Human
agcugagauuacaggugcgcgccaccacacuu

SEQ ID NO: 319599 - RNA, 32 nt, Human
agcugagauuacaggugugcaccaccacgccc

SEQ ID NO: 319600 - RNA, 32 nt, Human
agcugagauuacaggugugugccaccacacgg

SEQ ID NO: 319601 - RNA, 23 nt, Human
agcugagauuacgccacugcacu

SEQ ID NO: 319602 - RNA, 32 nt, Human
agcugagauuauaggcgugcaccaccacaccu

SEQ ID NO: 319603 - RNA, 32 nt, Human
agcugagauugcacuccagccugggcgacagg

SEQ ID NO: 319604 - RNA, 32 nt, Human
agcugagauugcaggcacaugccaccacgccc

SEQ ID NO: 319605 - RNA, 32 nt, Human
agcugagauugcgucacugaacuccggccugg

SEQ ID NO: 319606 - RNA, 32 nt, Human
agcugagauuuaugguaacuuauuuaauuaau

SEQ ID NO: 319607 - RNA, 32 nt, Human
agcugagcacuuccacaagggcauaccccugg

SEQ ID NO: 319608 - RNA, 32 nt, Human
agcugagcagaguggcaccaggcugaguuaag

SEQ ID NO: 319609 - RNA, 32 nt, Human
agcugagcagaugccagcaucaugcuugcugu

SEQ ID NO: 319610 - RNA, 32 nt, Human
agcugagcagccaucccaagcccagcccaccu

SEQ ID NO: 319611 - RNA, 32 nt, Human
agcugagccacagcuuaacuccuacagaguga

SEQ ID NO: 319612 - RNA, 32 nt, Human
agcugagccaugcacacaggugcagacacccc

SEQ ID NO: 319613 - RNA, 32 nt, Human
agcugagcccagggcugggggcugcuugucug

SEQ ID NO: 319614 - RNA, 32 nt, Human
agcugagcccucugcugacuugcccccagcuc

SEQ ID NO: 319615 - RNA, 32 nt, Human
agcugagccuccaggagcugccagaggacagg

SEQ ID NO: 319616 - RNA, 32 nt, Human
agcugagccuccuuaccucccuucagccaagc

SEQ ID NO: 319617 - RNA, 32 nt, Human
agcugagcgcaaagcuaacauccugccagcua

SEQ ID NO: 319618 - RNA, 32 nt, Human
agcugagcgugaggcccugaccuggagccugc

SEQ ID NO: 319619 - RNA, 32 nt, Human
agcugagcucuucaccugcauccuggcugccg

SEQ ID NO: 319620 - RNA, 32 nt, Human
agcugaggacacaccccacaccccagcccacc

SEQ ID NO: 319621 - RNA, 32 nt, Human
agcugaggacgaacagcaucuuagccaagacc

SEQ ID NO: 319622 - RNA, 32 nt, Human
agcugaggaggaggcaggagagagggaaaaag

SEQ ID NO: 319623 - RNA, 32 nt, Human
agcugaggagucacagagagaccucccuacug

SEQ ID NO: 319624 - RNA, 32 nt, Human
agcugaggagugccuucaggccagugcugagc

SEQ ID NO: 319625 - RNA, 32 nt, Human
agcugaggauuuagacuuagagcuguguaacu

SEQ ID NO: 319626 - RNA, 32 nt, Human
agcugaggcagcagugugaggccagggcagag

SEQ ID NO: 319627 - RNA, 32 nt, Human
agcugaggcaggcggcaggcgcggugcacagg

SEQ ID NO: 319628 - RNA, 32 nt, Human
agcugaggcccggcuauacccaggagggagca

SEQ ID NO: 319629 - RNA, 32 nt, Human
agcugaggcccucucagggaggagacauccaa

SEQ ID NO: 319630 - RNA, 32 nt, Human
agcugaggccucccuugaguaggcccugcuuu

SEQ ID NO: 319631 - RNA, 32 nt, Human
agcugaggcgaaguggacuccaggcagggaau

SEQ ID NO: 319632 - RNA, 32 nt, Human
agcugaggcugaggccccgggagaggcggccc

SEQ ID NO: 319633 - RNA, 32 nt, Human
agcugagggcaagcucagagcccagggugagu

SEQ ID NO: 319634 - RNA, 32 nt, Human
agcugagggcagggugccugaccugugugccg

SEQ ID NO: 319635 - RNA, 32 nt, Human
agcugagggucugaggacgcagggagggugga

SEQ ID NO: 319636 - RNA, 32 nt, Human
agcugagggugucauguguggaaaaaucuguu

SEQ ID NO: 319637 - RNA, 19 nt, Human
agcugaggugcccaggaga

SEQ ID NO: 319638 - RNA, 32 nt, Human
agcugagguggaggcaggcugcggcagacggc

SEQ ID NO: 319639 - RNA, 32 nt, Human
agcugagguggcagugguuccaccaacaugga

SEQ ID NO: 319640 - RNA, 32 nt, Human
agcugagguggguggaucaugaggucaggaga

SEQ ID NO: 319641 - RNA, 23 nt, Human
agcugagucagaauuaaaggagg

SEQ ID NO: 319642 - RNA, 32 nt, Human
agcugaguccagugggagcugacgccaugacc

SEQ ID NO: 319643 - RNA, 32 nt, Human
agcugagucugcagguggagaggugcagggac

SEQ ID NO: 319644 - RNA, 32 nt, Human
agcugagugaagaugaggaagaagguguuaaa

SEQ ID NO: 319645 - RNA, 32 nt, Human
agcugagugcccuguccucagauggggaggga

SEQ ID NO: 319646 - RNA, 32 nt, Human
agcugagugccuggggguccagaagcuucgag

SEQ ID NO: 319647 - RNA, 32 nt, Human
agcugagugugggaacaguccagcccuggcau

SEQ ID NO: 319648 - RNA, 32 nt, Human
agcugaguucaagaccagccugggcaacgugg

SEQ ID NO: 319649 - RNA, 32 nt, Human
agcugaguugacugagggccauuuaaagauuc

SEQ ID NO: 319650 - RNA, 32 nt, Human
agcugaguuugaagaaaaaguuaaaaggaagg

SEQ ID NO: 319651 - RNA, 32 nt, Human
agcugauacuacaggcacccaccaccacgccc

SEQ ID NO: 319652 - RNA, 32 nt, Human
agcugaucauacaguugaccaguucagggugc

SEQ ID NO: 319653 - RNA, 32 nt, Human
agcugauccacaaacaagaggagcaccagacc

SEQ ID NO: 319654 - RNA, 19 nt, Human
agcugauccuucucugagg

SEQ ID NO: 319655 - RNA, 32 nt, Human
agcugaucucugaggaggaggcacugcacagg

SEQ ID NO: 319656 - RNA, 22 nt, Human
agcugaugacaauggcugaaag

SEQ ID NO: 319657 - RNA, 24 nt, Human
agcugaugcaacuaacaaguacug

SEQ ID NO: 319658 - RNA, 32 nt, Human
agcugaugcagccggugcuccacccauggaag

SEQ ID NO: 319659 - RNA, 32 nt, Human
agcugaugccaaacaucuuuacagaggaacug

SEQ ID NO: 319660 - RNA, 32 nt, Human
agcugauggcagggguuugaugaauccaaaug

SEQ ID NO: 319661 - RNA, 32 nt, Human
agcugauggcuucccagagaugccucacaguc

SEQ ID NO: 319662 - RNA, 32 nt, Human
agcugaugggccaugaggcaacaggcaagugg

SEQ ID NO: 319663 - RNA, 32 nt, Human
agcugaugguauuaggaaguggggcuugggga

SEQ ID NO: 319664 - RNA, 32 nt, Human
agcugaugguguccagaggccccugguccuua

SEQ ID NO: 319665 - RNA, 30 nt, Human
agcugaugguuauuuguaacaacacauuuc

SEQ ID NO: 319666 - RNA, 32 nt, Human
agcugaugugcccaccaccgugucaugagaga

SEQ ID NO: 319667 - RNA, 32 nt, Human
agcugauguucuuuggguauuacuugaguagu

SEQ ID NO: 319668 - RNA, 32 nt, Human
agcugauucaaucaaguggaagaaaagguauc

SEQ ID NO: 319669 - RNA, 32 nt, Human
agcugauucagagguaaacacagaucaagaua

SEQ ID NO: 319670 - RNA, 32 nt, Human
agcugauuggagaauguggaaugcagagugau

SEQ ID NO: 319671 - RNA, 32 nt, Human
agcugauuugggcuccuaagcucacgggagug

SEQ ID NO: 319672 - RNA, 32 nt, Human
agcugauuuggucaccuuccucugccuuuguu

SEQ ID NO: 319673 - RNA, 32 nt, Human
agcugcaaaacacacacaugcguauagacaua

SEQ ID NO: 319674 - RNA, 32 nt, Human
agcugcaacaacaggcacacaccaccaugcuc

SEQ ID NO: 319675 - RNA, 32 nt, Human
agcugcaaccacaggugcacaccaccacgccc

SEQ ID NO: 319676 - RNA, 32 nt, Human
agcugcaaggcaaacuccauuccucauauuaa

SEQ ID NO: 319677 - RNA, 32 nt, Human
agcugcaagguuguuuccagcacuuugggaac

SEQ ID NO: 319678 - RNA, 32 nt, Human
agcugcaauuacaggagccugccaccaugccc

SEQ ID NO: 319679 - RNA, 32 nt, Human
agcugcacacuccuaacccuucucccagggug

SEQ ID NO: 319680 - RNA, 32 nt, Human
agcugcacagaagcucugccgccucuugggac

SEQ ID NO: 319681 - RNA, 32 nt, Human
agcugcacagggcuaggggcagcagcugggcc

SEQ ID NO: 319682 - RNA, 32 nt, Human
agcugcaccacuaacaaauuggugccuguaga

SEQ ID NO: 319683 - RNA, 32 nt, Human
agcugcacccucccuccgauccuuccucccac

SEQ ID NO: 319684 - RNA, 32 nt, Human
agcugcacgcuggagucagcuggaguugccca

SEQ ID NO: 319685 - RNA, 32 nt, Human
agcugcacugaagacgagccugggguggagag

SEQ ID NO: 319686 - RNA, 32 nt, Human
agcugcacugcacaccuguggggagacuuuuc

SEQ ID NO: 319687 - RNA, 32 nt, Human
agcugcacugcaggguccugaguaaauguguu

SEQ ID NO: 319688 - RNA, 32 nt, Human
agcugcacugcauuccagccugggugacagag

SEQ ID NO: 319689 - RNA, 32 nt, Human
agcugcagaaaaggagggaggacuggcugggg

SEQ ID NO: 319690 - RNA, 32 nt, Human
agcugcagacauagacaagcaagcuggaagcu

SEQ ID NO: 319691 - RNA, 18 nt, Human
agcugcagaccccugccu

SEQ ID NO: 319692 - RNA, 32 nt, Human
agcugcagacuggacaacaacuuccgcagcgg

SEQ ID NO: 319693 - RNA, 32 nt, Human
agcugcagagccacaggccgucucagacauuu

SEQ ID NO: 319694 - RNA, 21 nt, Human
agcugcagagggccugggcca

SEQ ID NO: 319695 - RNA, 32 nt, Human
agcugcagauucugaccccacagcugccuuag

SEQ ID NO: 319696 - RNA, 24 nt, Human
agcugcagcacagccuucccuaac

SEQ ID NO: 319697 - RNA, 18 nt, Human
agcugcagcagugccuga

SEQ ID NO: 319698 - RNA, 24 nt, Human
agcugcagccaaggccgcuacgag

SEQ ID NO: 319699 - RNA, 32 nt, Human
agcugcagccacccuucucaucuggaucgggc

SEQ ID NO: 319700 - RNA, 32 nt, Human
agcugcagccagcauccuuaucugccacugac

SEQ ID NO: 319701 - RNA, 22 nt, Human
agcugcagccccuccccuugcc

SEQ ID NO: 319702 - RNA, 32 nt, Human
agcugcagcccggggagccaggugcagaaacg

SEQ ID NO: 319703 - RNA, 32 nt, Human
agcugcagccugacaggaugcagugggggcgu

SEQ ID NO: 319704 - RNA, 32 nt, Human
agcugcagccuggacaguagagcgagacccca

SEQ ID NO: 319705 - RNA, 32 nt, Human
agcugcagccuucaucagaacucuuccuccuc

SEQ ID NO: 319706 - RNA, 32 nt, Human
agcugcagcgggcuuggcuuugugaggaaccg

SEQ ID NO: 319707 - RNA, 32 nt, Human
agcugcagcugcagcaguggcaguggugaggc

SEQ ID NO: 319708 - RNA, 32 nt, Human
agcugcagcugucccaucauccccagcaaauc

SEQ ID NO: 319709 - RNA, 32 nt, Human
agcugcaggagagccugcuagagcagaagcgg

SEQ ID NO: 319710 - RNA, 32 nt, Human
agcugcaggagaggcugcuagagcagaagcgg

SEQ ID NO: 319711 - RNA, 32 nt, Human
agcugcaggagggccaggagggcagaugcucc

SEQ ID NO: 319712 - RNA, 32 nt, Human
agcugcaggauacaccagcccagaucaagaag

SEQ ID NO: 319713 - RNA, 32 nt, Human
agcugcaggccuggugagacaauuggguguuu

SEQ ID NO: 319714 - RNA, 19 nt, Human
agcugcagggaccucugcc

SEQ ID NO: 319715 - RNA, 32 nt, Human
agcugcagggagggccagggagguugggggug

SEQ ID NO: 319716 - RNA, 32 nt, Human
agcugcagggccaggugcauggccccucugca

SEQ ID NO: 319717 - RNA, 32 nt, Human
agcugcaggggcggggcuccugugcugcugcg

SEQ ID NO: 319718 - RNA, 32 nt, Human
agcugcaggggucggggauugcagcgggccuc

SEQ ID NO: 319719 - RNA, 32 nt, Human
agcugcaguaggcauugcuggggaagaaacaa

SEQ ID NO: 319720 - RNA, 32 nt, Human
agcugcagucugggagucuuuggaguaagaau

SEQ ID NO: 319721 - RNA, 19 nt, Human
agcugcagugcacuauaga

SEQ ID NO: 319722 - RNA, 32 nt, Human
agcugcagugcccugugguugcaccugugaau

SEQ ID NO: 319723 - RNA, 23 nt, Human
agcugcaguggcuuccucugggg

SEQ ID NO: 319724 - RNA, 32 nt, Human
agcugcaguggcuucuccuuucccaggcuucc

SEQ ID NO: 319725 - RNA, 32 nt, Human
agcugcagugucuaaguguuccucacugacag

SEQ ID NO: 319726 - RNA, 32 nt, Human
agcugcaucgugcuccuccagccugcacuggg

SEQ ID NO: 319727 - RNA, 32 nt, Human
agcugcaucuccagguuuugagucuagaaaug

SEQ ID NO: 319728 - RNA, 32 nt, Human
agcugcauggacgccuggcuccaggcuccagg

SEQ ID NO: 319729 - RNA, 32 nt, Human
agcugcauggaucucaaaugggccaagggccc

SEQ ID NO: 319730 - RNA, 32 nt, Human
agcugcauguucaagaaguggccggagaguuc

SEQ ID NO: 319731 - RNA, 32 nt, Human
agcugcauucgagacugguggagggugggcug

SEQ ID NO: 319732 - RNA, 32 nt, Human
agcugccaaacaggaacuaguaaacauauguu

SEQ ID NO: 319733 - RNA, 32 nt, Human
agcugccaacucagcuucuucuaccuccuaga

SEQ ID NO: 319734 - RNA, 22 nt, Human
agcugccacacccuuucuggga

SEQ ID NO: 319735 - RNA, 32 nt, Human
agcugccaccccugcaaccucuugcugauccu

SEQ ID NO: 319736 - RNA, 32 nt, Human
agcugccaccugcugggcggacgugggccuag

SEQ ID NO: 319737 - RNA, 32 nt, Human
agcugccaccuugcugccauccgcccgaccca

SEQ ID NO: 319738 - RNA, 24 nt, Human
agcugccacucuuggagcacauug

SEQ ID NO: 319739 - RNA, 32 nt, Human
agcugccacugcagagccccgccauggaagac

SEQ ID NO: 319740 - RNA, 15 nt, Human
agcugccacugggca

SEQ ID NO: 319741 - RNA, 18 nt, Human
agcugccacuguguggua

SEQ ID NO: 319742 - RNA, 32 nt, Human
agcugccacuucacacugaccugggcauacgc

SEQ ID NO: 319743 - RNA, 32 nt, Human
agcugccagaggacaggagcggggaaggcuca

SEQ ID NO: 319744 - RNA, 32 nt, Human
agcugccagcugcaggacugaggucccaucuc

SEQ ID NO: 319745 - RNA, 32 nt, Human
agcugccaggcccuucccugugccccacccug

SEQ ID NO: 319746 - RNA, 32 nt, Human
agcugccagggugagggcagcccucagggucg

SEQ ID NO: 319747 - RNA, 32 nt, Human
agcugccagucaagggcagugggaucucgaug

SEQ ID NO: 319748 - RNA, 32 nt, Human
agcugccagugggggaggaggcugcgguucau

SEQ ID NO: 319749 - RNA, 32 nt, Human
agcugccaucagagauggugucugcaggcagu

SEQ ID NO: 319750 - RNA, 20 nt, Human
agcugccaucugcucuggga

SEQ ID NO: 319751 - RNA, 32 nt, Human
agcugccaugaauaugccagagcugcuggcua

SEQ ID NO: 319752 - RNA, 32 nt, Human
agcugccauggugguuaggaaugugauacaug

SEQ ID NO: 319753 - RNA, 32 nt, Human
agcugccaugucuggggcaucuuccucagaac

SEQ ID NO: 319754 - RNA, 23 nt, Human
agcugcccaaggugccggccugc

SEQ ID NO: 319755 - RNA, 32 nt, Human
agcugcccacagaaaggcgacagggaacccca

SEQ ID NO: 319756 - RNA, 32 nt, Human
agcugcccagccuguucacaugcuggggacca

SEQ ID NO: 319757 - RNA, 17 nt, Human
agcugcccagcgugggc

SEQ ID NO: 319758 - RNA, 21 nt, Human
agcugcccagcugcagagcag

SEQ ID NO: 319759 - RNA, 32 nt, Human
agcugcccaggaaagguggaaagugguagaag

SEQ ID NO: 319760 - RNA, 24 nt, Human
agcugcccauccacucccacccca

SEQ ID NO: 319761 - RNA, 32 nt, Human
agcugcccaucgggggcccuagcucagcccca

SEQ ID NO: 319762 - RNA, 32 nt, Human
agcugcccaucuucugcuagcugauccugaga

SEQ ID NO: 319763 - RNA, 32 nt, Human
agcugcccaucuugucccuccuggagaccuaa

SEQ ID NO: 319764 - RNA, 32 nt, Human
agcugcccaugccaccuccuccuucucugccc

SEQ ID NO: 319765 - RNA, 32 nt, Human
agcugccccagagugaggguguagaugucugu

SEQ ID NO: 319766 - RNA, 32 nt, Human
agcugccccaggcuuuagugcagcugccaacc

SEQ ID NO: 319767 - RNA, 32 nt, Human
agcugccccaggcuuuagugcagcugccaacg

SEQ ID NO: 319768 - RNA, 32 nt, Human
agcugcccccaaacccuaucccuucuccuuuu

SEQ ID NO: 319769 - RNA, 32 nt, Human
agcugcccccggcugcagcccaggccauggac

SEQ ID NO: 319770 - RNA, 32 nt, Human
agcugccccgucugccauucaccaggaaaaau

SEQ ID NO: 319771 - RNA, 32 nt, Human
agcugccccuagugugagggcugccucauaag

SEQ ID NO: 319772 - RNA, 19 nt, Human
agcugccccuccccgagga

SEQ ID NO: 319773 - RNA, 32 nt, Human
agcugccccucuccaccaggguacccugucuu

SEQ ID NO: 319774 - RNA, 32 nt, Human
agcugccccucucuggccuggccggcaggcgu

SEQ ID NO: 319775 - RNA, 32 nt, Human
agcugccccugcccugugccgugcugcgcuca

SEQ ID NO: 319776 - RNA, 21 nt, Human
agcugcccgagaucacuggag

SEQ ID NO: 319777 - RNA, 20 nt, Human
agcugcccgccgguauugag

SEQ ID NO: 319778 - RNA, 18 nt, Human
agcugcccggcgggcugg

SEQ ID NO: 319779 - RNA, 32 nt, Human
agcugcccuccccuacuucucccuugcuccca

SEQ ID NO: 319780 - RNA, 32 nt, Human
agcugcccuccccuccggacuggugcccuccu

SEQ ID NO: 319781 - RNA, 32 nt, Human
agcugcccuccccuuucagccuucucaacuca

SEQ ID NO: 319782 - RNA, 32 nt, Human
agcugcccucuugagucuuucuguccauccca

SEQ ID NO: 319783 - RNA, 21 nt, Human
agcugcccugacacauuggag

SEQ ID NO: 319784 - RNA, 32 nt, Human
agcugcccugcuccacccuggccgauccauca

SEQ ID NO: 319785 - RNA, 32 nt, Human
agcugcccugugacucuuaggaagaugccgua

SEQ ID NO: 319786 - RNA, 32 nt, Human
agcugcccuuccugucuccaccucucaguccc

SEQ ID NO: 319787 - RNA, 32 nt, Human
agcugcccuuucuccccuccacucauguuccc

SEQ ID NO: 319788 - RNA, 32 nt, Human
agcugcccuuucuccuuccuggcccuguguac

SEQ ID NO: 319789 - RNA, 32 nt, Human
agcugccgacugugcaugacugcucugaacgu

SEQ ID NO: 319790 - RNA, 32 nt, Human
agcugccgcagcccugguuuuuggcgcaucuu

SEQ ID NO: 319791 - RNA, 32 nt, Human
agcugccggccccuaggacagagcagggaccu

SEQ ID NO: 319792 - RNA, 32 nt, Human
agcugccgggaggcgggagggagugcccugaa

SEQ ID NO: 319793 - RNA, 32 nt, Human
agcugccucaaaccuuugggauuuucagaaug

SEQ ID NO: 319794 - RNA, 32 nt, Human
agcugccuccccugcccuuucucagcugccuc

SEQ ID NO: 319795 - RNA, 32 nt, Human
agcugccuccgcgugaucaaagccacacucug

SEQ ID NO: 319796 - RNA, 32 nt, Human
agcugccucugugcccuggccucuuucccugu

SEQ ID NO: 319797 - RNA, 32 nt, Human
agcugccugaacuuuuaaaacucccagacacg

SEQ ID NO: 319798 - RNA, 22 nt, Human
agcugccugaugggcacuagag

SEQ ID NO: 319799 - RNA, 31 nt, Human
agcugccugccccugagcccugugucgggau

SEQ ID NO: 319800 - RNA, 23 nt, Human
agcugccugccgggccugaggag

SEQ ID NO: 319801 - RNA, 32 nt, Human
agcugccugccugcugcugcugcugcuuccug

SEQ ID NO: 319802 - RNA, 32 nt, Human
agcugccugccuguuugcuguguugaacucuu

SEQ ID NO: 319803 - RNA, 32 nt, Human
agcugccugccuugcuuccucuugcuuacuca

SEQ ID NO: 319804 - RNA, 32 nt, Human
agcugccugcucccggcccacccucuaggagg

SEQ ID NO: 319805 - RNA, 32 nt, Human
agcugccugcucuccagccucuggaggaacuc

SEQ ID NO: 319806 - RNA, 32 nt, Human
agcugccugcuucucgccugccugugucugcu

SEQ ID NO: 319807 - RNA, 32 nt, Human
agcugccuggacccguucaugggggagggggc

SEQ ID NO: 319808 - RNA, 32 nt, Human
agcugccuggcauucaggcccagaugccugca

SEQ ID NO: 319809 - RNA, 32 nt, Human
agcugccuggggcagggcucuaccuccccugc

SEQ ID NO: 319810 - RNA, 32 nt, Human
agcugccuggggcccaaguugcagugagcagg

SEQ ID NO: 319811 - RNA, 32 nt, Human
agcugccugguauccaggaggggaaugcuggu

SEQ ID NO: 319812 - RNA, 32 nt, Human
agcugccugucucuuagaugcacuuucuuuuu

SEQ ID NO: 319813 - RNA, 32 nt, Human
agcugccugugcacuggcccugcggggcccag

SEQ ID NO: 319814 - RNA, 32 nt, Human
agcugccugugugggacugagaugcaggauuu

SEQ ID NO: 319815 - RNA, 16 nt, Human
agcugccuguuuucuu

SEQ ID NO: 319816 - RNA, 32 nt, Human
agcugccuucaaggacuguuucagugugaguc

SEQ ID NO: 319817 - RNA, 25 nt, Human
agcugccuuccacaagaccagcaga

SEQ ID NO: 319818 - RNA, 20 nt, Human
agcugccuuuucugccauca

SEQ ID NO: 319819 - RNA, 32 nt, Human
agcugcgacuacaggcgcgcaccaccacgccc

SEQ ID NO: 319820 - RNA, 18 nt, Human
agcugcgacuacaggugc

SEQ ID NO: 319821 - RNA, 32 nt, Human
agcugcgacuacaggugcaugccaacacgccu

SEQ ID NO: 319822 - RNA, 32 nt, Human
agcugcgacuacaggugcccaccaccacaccu

SEQ ID NO: 319823 - RNA, 24 nt, Human
agcugcgacuugcgauuugaaugc

SEQ ID NO: 319824 - RNA, 32 nt, Human
agcugcgagagaagaaaugucuguugcuuuaa

SEQ ID NO: 319825 - RNA, 32 nt, Human
agcugcgaggucaucucugcucuggcuuuucu

SEQ ID NO: 319826 - RNA, 32 nt, Human
agcugcgaucucugugguaggcccagaagugu

SEQ ID NO: 319827 - RNA, 32 nt, Human
agcugcgcaaagugcggaguguggagcuggac

SEQ ID NO: 319828 - RNA, 32 nt, Human
agcugcgcaacagccuggguucuugagcagag

SEQ ID NO: 319829 - RNA, 32 nt, Human
agcugcgcaccugugucccccaccuccacccu

SEQ ID NO: 319830 - RNA, 32 nt, Human
agcugcgcaggcugguggagaccaugcgcuuc

SEQ ID NO: 319831 - RNA, 22 nt, Human
agcugcgcccagggcgcacgag

SEQ ID NO: 319832 - RNA, 32 nt, Human
agcugcgcccucccugaccucccaggcugcgg

SEQ ID NO: 319833 - RNA, 32 nt, Human
agcugcgccuauuccucccucgccaaacgcgu

SEQ ID NO: 319834 - RNA, 19 nt, Human
agcugcgccugggucccgg

SEQ ID NO: 319835 - RNA, 32 nt, Human
agcugcgcggucuuacuccccuucccugccua

SEQ ID NO: 319836 - RNA, 23 nt, Human
agcugcgcguccugccucuggga

SEQ ID NO: 319837 - RNA, 19 nt, Human
agcugcgcuuuuugaacug

SEQ ID NO: 319838 - RNA, 32 nt, Human
agcugcggagagcugccagcugcaccgggcgu

SEQ ID NO: 319839 - RNA, 32 nt, Human
agcugcggagcuggucgacauaaucucuguau

SEQ ID NO: 319840 - RNA, 32 nt, Human
agcugcggccgagggaagggugcaugugcgcg

SEQ ID NO: 319841 - RNA, 32 nt, Human
agcugcgggaggccgaguggguggccgcgcuc

SEQ ID NO: 319842 - RNA, 32 nt, Human
agcugcggggcccuggcaugaaaggcaugagc

SEQ ID NO: 319843 - RNA, 32 nt, Human
agcugcgggucggggagagggaccgggggucc

SEQ ID NO: 319844 - RNA, 32 nt, Human
agcugcgucagacaacgacccaccucaucccc

SEQ ID NO: 319845 - RNA, 32 nt, Human
agcugcgugacugucugucucugccaugucuc

SEQ ID NO: 319846 - RNA, 32 nt, Human
agcugcgugccacaucgcuacgcccaggaggu

SEQ ID NO: 319847 - RNA, 32 nt, Human
agcugcgugcugcugcacucaccggcuucuuc

SEQ ID NO: 319848 - RNA, 21 nt, Human
agcugcguggagacccaggag

SEQ ID NO: 319849 - RNA, 32 nt, Human
agcugcuaaagugggaagaaggagaacuugaa

SEQ ID NO: 319850 - RNA, 32 nt, Human
agcugcuaaccugcuuaguuacacucccaccu

SEQ ID NO: 319851 - RNA, 32 nt, Human
agcugcuacccccucccuucccaugggagugg

SEQ ID NO: 319852 - RNA, 32 nt, Human
agcugcuagguugugccccugccccuccugaa

SEQ ID NO: 319853 - RNA, 32 nt, Human
agcugcuaucaacccucucucccuucaucucu

SEQ ID NO: 319854 - RNA, 31 nt, Human
agcugcucaauaaaggcuguguguguggaau

SEQ ID NO: 319855 - RNA, 31 nt, Human
agcugcucaauaaauguuuguugaacgaaug

SEQ ID NO: 319856 - RNA, 32 nt, Human
agcugcucacuauuaucugcaguauugauaag

SEQ ID NO: 319857 - RNA, 32 nt, Human
agcugcucacugcucacacgcugccuccucag

SEQ ID NO: 319858 - RNA, 32 nt, Human
agcugcucagaaugccgcaugacaacugaagg

SEQ ID NO: 319859 - RNA, 23 nt, Human
agcugcucagcaacuccaccugc

SEQ ID NO: 319860 - RNA, 32 nt, Human
agcugcucagcaggcaggcagcagccucccgc

SEQ ID NO: 319861 - RNA, 32 nt, Human
agcugcucaguuauugcagcaagaacagaaga

SEQ ID NO: 319862 - RNA, 32 nt, Human
agcugcucauuacaguucuuuccucuuucugc

SEQ ID NO: 319863 - RNA, 32 nt, Human
agcugcucccccuccaccugaguugggguggg

SEQ ID NO: 319864 - RNA, 22 nt, Human
agcugcucccgccaccaccugc

SEQ ID NO: 319865 - RNA, 24 nt, Human
agcugcucccgcuaccgauccugc

SEQ ID NO: 319866 - RNA, 32 nt, Human
agcugcuccuugggcagaguuggcaauguuuu

SEQ ID NO: 319867 - RNA, 32 nt, Human
agcugcucgggaggcagaggcaggagaauggc

SEQ ID NO: 319868 - RNA, 32 nt, Human
agcugcucucuagccuacuucauugacagcac

SEQ ID NO: 319869 - RNA, 32 nt, Human
agcugcucugcucugugcugggcuuguggggu

SEQ ID NO: 319870 - RNA, 32 nt, Human
agcugcucugguggaguugggaagggauagga

SEQ ID NO: 319871 - RNA, 18 nt, Human
agcugcucuucugaauug

SEQ ID NO: 319872 - RNA, 32 nt, Human
agcugcucuuucugguccuccccaccacccca

SEQ ID NO: 319873 - RNA, 32 nt, Human
agcugcucuuucugguucuccccaccacccca

SEQ ID NO: 319874 - RNA, 32 nt, Human
agcugcugaacuugaacccagagccuucaggu

SEQ ID NO: 319875 - RNA, 32 nt, Human
aggaauggaagaggcagcaggagcuacaaugc

SEQ ID NO: 319876 - RNA, 32 nt, Human
aggaauggaaguggacccuaguuaggugcugg

SEQ ID NO: 319877 - RNA, 19 nt, Human
aggaauggacaagaagcca

SEQ ID NO: 319878 - RNA, 32 nt, Human
aggaauggaccaugcagaucacugucagugga

SEQ ID NO: 319879 - RNA, 21 nt, Human
aggaauggacgagcccuggga

SEQ ID NO: 319880 - RNA, 21 nt, Human
aggaauggcagaaaagucuga

SEQ ID NO: 319881 - RNA, 32 nt, Human
aggaauggcagcuguauccaaccacaaacaac

SEQ ID NO: 319882 - RNA, 32 nt, Human
aggaauggccacagguuuacacugccuuccca

SEQ ID NO: 319883 - RNA, 32 nt, Human
aggaauggcccaacaguggccccuucagggug

SEQ ID NO: 319884 - RNA, 29 nt, Human
aggaauggccgcagagguggcccugagug

SEQ ID NO: 319885 - RNA, 32 nt, Human
aggaauggccugaugguaguagugccuuuugc

SEQ ID NO: 319886 - RNA, 32 nt, Human
aggaauggcugaggauggcugggcagggggac

SEQ ID NO: 319887 - RNA, 32 nt, Human
aggaaugggaggagcaggcuugaggcuugggc

SEQ ID NO: 319888 - RNA, 32 nt, Human
aggaauggggcagacgcgauucaggugaacag

SEQ ID NO: 319889 - RNA, 32 nt, Human
aggaauggggcagagcugggcauucaggaccu

SEQ ID NO: 319890 - RNA, 32 nt, Human
aggaaugggguacuaugggucaucucaguggg

SEQ ID NO: 319891 - RNA, 32 nt, Human
aggaaugguaccuucugaaacugccuuuccag

SEQ ID NO: 319892 - RNA, 19 nt, Human
aggaaugguauguggggga

SEQ ID NO: 319893 - RNA, 32 nt, Human
aggaaugguucuuucugggccuccugggacag

SEQ ID NO: 319894 - RNA, 32 nt, Human
aggaauguaaauuaccuuaaacuucgaugauc

SEQ ID NO: 319895 - RNA, 19 nt, Human
aggaauguagaacuugaca

SEQ ID NO: 319896 - RNA, 32 nt, Human
aggaauguagacugaauggugacccagggaga

SEQ ID NO: 319897 - RNA, 20 nt, Human
aggaauguagcaacuugaca

SEQ ID NO: 319898 - RNA, 32 nt, Human
aggaauguaugccugggaaagacagcaggaga

SEQ ID NO: 319899 - RNA, 21 nt, Human
aggaaugucagggacuaguga

SEQ ID NO: 319900 - RNA, 32 nt, Human
aggaaugucugacaggcuuaagcuuucguccc

SEQ ID NO: 319901 - RNA, 19 nt, Human
aggaaugucuggaguggua

SEQ ID NO: 319902 - RNA, 32 nt, Human
aggaaugugaggaagaaagaaaggcagggcau

SEQ ID NO: 319903 - RNA, 32 nt, Human
aggaaugugguguucuggcuucacaaaugaaa

SEQ ID NO: 319904 - RNA, 32 nt, Human
aggaaugugucacuacuggucaagcaauacuc

SEQ ID NO: 319905 - RNA, 32 nt, Human
aggaauguguccaagacacaugcugagguuuu

SEQ ID NO: 319906 - RNA, 23 nt, Human
aggaauuaaaaguguuucuggaa

SEQ ID NO: 319907 - RNA, 32 nt, Human
aggaauuaaaauaucuguagaagccauggcuu

SEQ ID NO: 319908 - RNA, 32 nt, Human
aggaauuaaggagacuuccuguaauauuucuu

SEQ ID NO: 319909 - RNA, 32 nt, Human
aggaauucaaaaccagccuggccaacaugcaa

SEQ ID NO: 319910 - RNA, 32 nt, Human
aggaauucaacaccagccuggccaacauagug

SEQ ID NO: 319911 - RNA, 32 nt, Human
aggaauucaagaccagccuagguaacauagug

SEQ ID NO: 319912 - RNA, 32 nt, Human
aggaauucaagaccagccugaguaacaugaug

SEQ ID NO: 319913 - RNA, 32 nt, Human
aggaauucaagaccagccuggccaacauggca

SEQ ID NO: 319914 - RNA, 32 nt, Human
aggaauucaagaccagccuggccaacauggcg

SEQ ID NO: 319915 - RNA, 32 nt, Human
aggaauucaagaccagccuggccaacauggug

SEQ ID NO: 319916 - RNA, 32 nt, Human
aggaauucaagaccagccuggccaacauguga

SEQ ID NO: 319917 - RNA, 32 nt, Human
aggaauucaagaccagccugggcaacacagca

SEQ ID NO: 319918 - RNA, 32 nt, Human
aggaauucaagaccagccugggcaacacagug

SEQ ID NO: 319919 - RNA, 32 nt, Human
aggaauucaagaccagccugggcaacauggug

SEQ ID NO: 319920 - RNA, 32 nt, Human
aggaauucaagaccagccugggcaacucagga

SEQ ID NO: 319921 - RNA, 32 nt, Human
aggaauucaaggccagccugggcaacauagac

SEQ ID NO: 319922 - RNA, 32 nt, Human
aggaauucacccaggcagccuggagucagcca

SEQ ID NO: 319923 - RNA, 32 nt, Human
aggaauucagcccgaugggaguccgaguucau

SEQ ID NO: 319924 - RNA, 32 nt, Human
aggaauucccgguucucagaauuguuaucacu

SEQ ID NO: 319925 - RNA, 32 nt, Human
aggaauuccgcugcggcccaaggcuugccguu

SEQ ID NO: 319926 - RNA, 32 nt, Human
aggaauucgagaccagccugaccaacauggag

SEQ ID NO: 319927 - RNA, 32 nt, Human
aggaauucgagaccagccuggcaacauggcaa

SEQ ID NO: 319928 - RNA, 32 nt, Human
aggaauucgagaccagccuggccaacauggca

SEQ ID NO: 319929 - RNA, 32 nt, Human
aggaauucgagaccagccuggccaacauggcg

SEQ ID NO: 319930 - RNA, 32 nt, Human
aggaauucgagaccagccuggccaacaugguc

SEQ ID NO: 319931 - RNA, 32 nt, Human
aggaauucgagaccagccuggccaacauggug

SEQ ID NO: 319932 - RNA, 32 nt, Human
aggaauucgagaccagccuggccagcauggug

SEQ ID NO: 319933 - RNA, 32 nt, Human
aggaauucgagaccagccugggcaacauagug

SEQ ID NO: 319934 - RNA, 32 nt, Human
aggaauucgagaccagccugggcagcauagca

SEQ ID NO: 319935 - RNA, 32 nt, Human
aggaauucgagaccagccugggccacaugaca

SEQ ID NO: 319936 - RNA, 32 nt, Human
aggaauucgagaccagccugggcuacauagug

SEQ ID NO: 319937 - RNA, 32 nt, Human
aggaauucuaaccuggcuuccagggagaggug

SEQ ID NO: 319938 - RNA, 32 nt, Human
aggaauucuagaccagccugggcaacauagug

SEQ ID NO: 319939 - RNA, 32 nt, Human
aggaauucucaugugggauuccccuugccagg

SEQ ID NO: 319940 - RNA, 32 nt, Human
aggaauucucuucuuccgaaucaugcugcucg

SEQ ID NO: 319941 - RNA, 32 nt, Human
aggaauucugaagccauugucuccuugaguac

SEQ ID NO: 319942 - RNA, 32 nt, Human
aggaauucuggaacugcuugaaaacuaggacg

SEQ ID NO: 319943 - RNA, 32 nt, Human
aggaauucugggaacuaaguuuuucuucuccu

SEQ ID NO: 319944 - RNA, 32 nt, Human
aggaauucuuugcuuuggcuucugucuguucc

SEQ ID NO: 319945 - RNA, 32 nt, Human
aggaauugcaauugacucagaaugacacauuu

SEQ ID NO: 319946 - RNA, 32 nt, Human
aggaauugccaaggacccagagcccagcccug

SEQ ID NO: 319947 - RNA, 32 nt, Human
aggaauugcccagcagacguugggugagucug

SEQ ID NO: 319948 - RNA, 32 nt, Human
aggaauugcuugaacccaagaggcagaggaug

SEQ ID NO: 319949 - RNA, 32 nt, Human
aggaauugugaaacauuggcuguuguguguug

SEQ ID NO: 319950 - RNA, 32 nt, Human
aggaauugugcuaguuaaaaaucaggaauagg

SEQ ID NO: 319951 - RNA, 32 nt, Human
aggaauuuauucacaucuuuauugauccuaaa

SEQ ID NO: 319952 - RNA, 32 nt, Human
aggaauuucacauuauugaacuccucaaaaag

SEQ ID NO: 319953 - RNA, 32 nt, Human
aggaauuucaggcagagagugaagugaucaga

SEQ ID NO: 319954 - RNA, 32 nt, Human
aggaauuucccaggaccugaaggggccaugau

SEQ ID NO: 319955 - RNA, 32 nt, Human
aggaauuucucuuccuucuucuccugccucua

SEQ ID NO: 319956 - RNA, 32 nt, Human
aggaauuucuggcacgguguagagaugauuua

SEQ ID NO: 319957 - RNA, 32 nt, Human
aggaauuugagaccagccuggacaacacagug

SEQ ID NO: 319958 - RNA, 32 nt, Human
aggaauuugagaccagccuggacaacauggga

SEQ ID NO: 319959 - RNA, 32 nt, Human
aggaauuugagaccagccuggccaauauggug

SEQ ID NO: 319960 - RNA, 32 nt, Human
aggaauuugagaccagccugggcaacauagug

SEQ ID NO: 319961 - RNA, 32 nt, Human
aggaauuugagaccagccugggcaacauggcg

SEQ ID NO: 319962 - RNA, 19 nt, Human
aggaauuuucucuccuccu

SEQ ID NO: 319963 - RNA, 21 nt, Human
aggaauuuuuuccuccucaug

SEQ ID NO: 319964 - RNA, 32 nt, Human
aggacaaaacuuagaagguauuggauaccauu

SEQ ID NO: 319965 - RNA, 32 nt, Human
aggacaaacagcugccuuugguguuuuaaugu

SEQ ID NO: 319966 - RNA, 32 nt, Human
aggacaaagacaaacaccaaucgcagggaauc

SEQ ID NO: 319967 - RNA, 32 nt, Human
aggacaaagcaaguuggaagcugcagguguca

SEQ ID NO: 319968 - RNA, 32 nt, Human
aggacaaagguugugucuugcuuuugucucuc

SEQ ID NO: 319969 - RNA, 32 nt, Human
aggacaacauggcaagaaggagccuuuggauu

SEQ ID NO: 319970 - RNA, 29 nt, Human
aggacaagacgcaggaggcagaaugccgc

SEQ ID NO: 319971 - RNA, 32 nt, Human
aggacaagagcacucccaggccccagagucua

SEQ ID NO: 319972 - RNA, 32 nt, Human
aggacaagcccacugucuuaagccacuuugac

SEQ ID NO: 319973 - RNA, 32 nt, Human
aggacaagcccaggcagggcugcauggagagg

SEQ ID NO: 319974 - RNA, 32 nt, Human
aggacaagcccugccucuucucccucuauugg

SEQ ID NO: 319975 - RNA, 32 nt, Human
aggacaagccugggcaacauaggaagacccug

SEQ ID NO: 319976 - RNA, 32 nt, Human
aggacaaggaagagaagagagagaggaggaau

SEQ ID NO: 319977 - RNA, 32 nt, Human
aggacaaggaagcagagggaaaugggaggucu

SEQ ID NO: 319978 - RNA, 32 nt, Human
aggacaaggagaggagacaagugacgacagcc

SEQ ID NO: 319979 - RNA, 32 nt, Human
aggacaaggaugagggcuuuccacuugagucu

SEQ ID NO: 319980 - RNA, 32 nt, Human
aggacaagggccugggauuugguucguuugcu

SEQ ID NO: 319981 - RNA, 32 nt, Human
aggacaagguccugccuuuggcuccacauugc

SEQ ID NO: 319982 - RNA, 32 nt, Human
aggacaagucagggaccacuugcugaagcacg

SEQ ID NO: 319983 - RNA, 21 nt, Human
aggacaagugagcugguguca

SEQ ID NO: 319984 - RNA, 32 nt, Human
aggacaauaaauucugucaugaacaguucuau

SEQ ID NO: 319985 - RNA, 32 nt, Human
aggacaauccagccucugcccuggaacugcug

SEQ ID NO: 319986 - RNA, 32 nt, Human
aggacacaaaggcauaagagugauauaaugga

SEQ ID NO: 319987 - RNA, 32 nt, Human
aggacacaaguugggcuugcuuagguguuuug

SEQ ID NO: 319988 - RNA, 32 nt, Human
aggacacaaucagaaaugcugaugccacugug

SEQ ID NO: 319989 - RNA, 32 nt, Human
aggacacacagcaaguuaguggcugcaccaga

SEQ ID NO: 319990 - RNA, 32 nt, Human
aggacacacagcaaguuauggcugcaccagaa

SEQ ID NO: 319991 - RNA, 21 nt, Human
aggacacagacccaaaagcca

SEQ ID NO: 319992 - RNA, 32 nt, Human
aggacacagagagguggcuggggcagccugcg

SEQ ID NO: 319993 - RNA, 32 nt, Human
aggacacagaucagaagaaagaaagacaacuu

SEQ ID NO: 319994 - RNA, 32 nt, Human
aggacacagcagaccuguuucucagggauaug

SEQ ID NO: 319995 - RNA, 32 nt, Human
aggacacagcgugggcggccugggcagaaggg

SEQ ID NO: 319996 - RNA, 32 nt, Human
aggacacaggcagagauacgagggaaccgucg

SEQ ID NO: 319997 - RNA, 32 nt, Human
aggacacaggggaugacugagagacagagaga

SEQ ID NO: 319998 - RNA, 32 nt, Human
aggacacaguggugagcaagacuuucaguuau

SEQ ID NO: 319999 - RNA, 31 nt, Human
aggacacauuuucagcaccucaccuucuuuu

SEQ ID NO: 320000 - RNA, 23 nt, Human
aggacaccacaccguccagggcg

SEQ ID NO: 320001 - RNA, 32 nt, Human
aggacaccacagauucaucucagacagugauc

SEQ ID NO: 320002 - RNA, 32 nt, Human
aggacaccaggaggccagggaaagcaucucug

SEQ ID NO: 320003 - RNA, 32 nt, Human
aggacaccauagcggagaacuccugacgccca

SEQ ID NO: 320004 - RNA, 32 nt, Human
aggacacccaagaggaaccaccagccuauccc

SEQ ID NO: 320005 - RNA, 32 nt, Human
aggacaccuaugucaacaggccaaacagccau

SEQ ID NO: 320006 - RNA, 23 nt, Human
aggacaccuggccgccuccagga

SEQ ID NO: 320007 - RNA, 32 nt, Human
aggacaccuuucucugccgccugcugcaucag

SEQ ID NO: 320008 - RNA, 32 nt, Human
aggacacgaguuggccaugaugacauaccaug

SEQ ID NO: 320009 - RNA, 32 nt, Human
aggacacgccccagagcuguggcagauugcag

SEQ ID NO: 320010 - RNA, 32 nt, Human
aggacacgcuggucugagaugagggggagccc

SEQ ID NO: 320011 - RNA, 32 nt, Human
aggacacgugaacacccagacacccacucagg

SEQ ID NO: 320012 - RNA, 32 nt, Human
aggacacuaugggagacuuuuucagaagccuu

SEQ ID NO: 320013 - RNA, 32 nt, Human
aggacacucaguguccaguugcagcuggacuu

SEQ ID NO: 320014 - RNA, 17 nt, Human
aggacacucccaucaga

SEQ ID NO: 320015 - RNA, 32 nt, Human
aggacacuccuuucuaauugcaucaccuucuc

SEQ ID NO: 320016 - RNA, 32 nt, Human
aggacacugacagccuuugauggaggaaccca

SEQ ID NO: 320017 - RNA, 32 nt, Human
aggacacugccuggaacgccuggagcgccucc

SEQ ID NO: 320018 - RNA, 25 nt, Human
aggacacuggcccuuacccagggcg

SEQ ID NO: 320019 - RNA, 32 nt, Human
aggacacuguggccaugccacggagggggcag

SEQ ID NO: 320020 - RNA, 32 nt, Human
aggacagaaagccaccagccaauggagaacaa

SEQ ID NO: 320021 - RNA, 23 nt, Human
aggacagaaaggagacccaggag

SEQ ID NO: 320022 - RNA, 32 nt, Human
aggacagaaccacggugcccagagccaggaag

SEQ ID NO: 320023 - RNA, 18 nt, Human
aggacagaacccaaggag

SEQ ID NO: 320024 - RNA, 32 nt, Human
aggacagaaccgagaagaguuuaggggcaggu

SEQ ID NO: 320025 - RNA, 32 nt, Human
aggacagaacuuugcccucccuucuuccuguc

SEQ ID NO: 320026 - RNA, 32 nt, Human
aggacagaaggugggaccuggcugggauccaa

SEQ ID NO: 320027 - RNA, 32 nt, Human
aggacagaaugaaaaucccuaccuucagagac

SEQ ID NO: 320028 - RNA, 32 nt, Human
aggacagacacagugccucaccuguaauccaa

SEQ ID NO: 320029 - RNA, 32 nt, Human
aggacagacagacagacagacaggggguugua

SEQ ID NO: 320030 - RNA, 32 nt, Human
aggacagacugauucugaguccugggugccgu

SEQ ID NO: 320031 - RNA, 32 nt, Human
aggacagagacacagcaagaugcccagggagu

SEQ ID NO: 320032 - RNA, 32 nt, Human
aggacagagaugaccacaucccugcuggaugc

SEQ ID NO: 320033 - RNA, 32 nt, Human
aggacagagcccaggcgaccuagggcacuauc

SEQ ID NO: 320034 - RNA, 32 nt, Human
aggacagagcucagugccugacugccuagggu

SEQ ID NO: 320035 - RNA, 22 nt, Human
aggacagaucugccgggcugcu

SEQ ID NO: 320036 - RNA, 32 nt, Human
aggacagaugcuggagucagcaugggagcugu

SEQ ID NO: 320037 - RNA, 32 nt, Human
aggacagcaaggcugaggagaauggcucccac

SEQ ID NO: 320038 - RNA, 32 nt, Human
aggacagcaccguccugaucgaugugagcccc

SEQ ID NO: 320039 - RNA, 32 nt, Human
aggacagcagguggaguaggcacagauggaaa

SEQ ID NO: 320040 - RNA, 32 nt, Human
aggacagcaucggagaucacacugcuucacag

SEQ ID NO: 320041 - RNA, 32 nt, Human
aggacagcauggaaagaaggaggcagaagugg

SEQ ID NO: 320042 - RNA, 32 nt, Human
aggacagcauuccugugaccucugccuaccau

SEQ ID NO: 320043 - RNA, 32 nt, Human
aggacagccauggagagaacugagacccacuu

SEQ ID NO: 320044 - RNA, 20 nt, Human
aggacagcccugaggcccag

SEQ ID NO: 320045 - RNA, 32 nt, Human
aggacagccgccagccuccugucugcagaaag

SEQ ID NO: 320046 - RNA, 32 nt, Human
aggacagccugccucugccacagcaaggcugu

SEQ ID NO: 320047 - RNA, 23 nt, Human
aggacagccuucaacugucacca

SEQ ID NO: 320048 - RNA, 32 nt, Human
aggacagcgagaagaaaggaagagaaaugcaa

SEQ ID NO: 320049 - RNA, 32 nt, Human
aggacagcgauucugaccuggaguggacugca

SEQ ID NO: 320050 - RNA, 20 nt, Human
aggacagcuacucucuggcu

SEQ ID NO: 320051 - RNA, 32 nt, Human
aggacagcucagcugcuggcagccugccuggc

SEQ ID NO: 320052 - RNA, 32 nt, Human
aggacagcugcagagguggcaguguguggaca

SEQ ID NO: 320053 - RNA, 32 nt, Human
aggacagcugccaagacagagcugguagaauu

SEQ ID NO: 320054 - RNA, 32 nt, Human
aggacagcugugguuugucacucugaaaccug

SEQ ID NO: 320055 - RNA, 32 nt, Human
aggacagcuuccuauggggaagacagaggcuu

SEQ ID NO: 320056 - RNA, 32 nt, Human
aggacagcuugccucccaggccccuuguggac

SEQ ID NO: 320057 - RNA, 32 nt, Human
aggacaggaacacaaccaaaucaguugcacaa

SEQ ID NO: 320058 - RNA, 32 nt, Human
aggacaggaagugaggagagugagucaaugua

SEQ ID NO: 320059 - RNA, 32 nt, Human
aggacaggacagaucacuugaggucaggaguu

SEQ ID NO: 320060 - RNA, 32 nt, Human
aggacaggacccuggggcuacacuccugcauu

SEQ ID NO: 320061 - RNA, 32 nt, Human
aggacaggacuggcccacuuaguccucaagcu

SEQ ID NO: 320062 - RNA, 32 nt, Human
aggacaggagucuccccaggagauguaucaga

SEQ ID NO: 320063 - RNA, 32 nt, Human
aggacaggaugcgagagcagguuggcggcugg

SEQ ID NO: 320064 - RNA, 32 nt, Human
aggacaggcauccuauccccagccucuuccug

SEQ ID NO: 320065 - RNA, 32 nt, Human
aggacaggccagagaggaggccagcaggccca

SEQ ID NO: 320066 - RNA, 32 nt, Human
aggacaggccugggccuggugcccgaggcccc

SEQ ID NO: 320067 - RNA, 32 nt, Human
aggacaggcggagacgccgggagccaguggcg

SEQ ID NO: 320068 - RNA, 32 nt, Human
aggacaggcugagcuccugggaccagaacccc

SEQ ID NO: 320069 - RNA, 32 nt, Human
aggacaggcuggcugcucagucauucugcagg

SEQ ID NO: 320070 - RNA, 32 nt, Human
aggacagggaggaggaaaaggaggaagaggag

SEQ ID NO: 320071 - RNA, 32 nt, Human
aggacagggauuuuuguucuuguuguucucgu

SEQ ID NO: 320072 - RNA, 32 nt, Human
aggacagggcuaggcaggagaccugcugcucc

SEQ ID NO: 320073 - RNA, 32 nt, Human
aggacagggcucagacgcugaggucccuccga

SEQ ID NO: 320074 - RNA, 32 nt, Human
aggacagggcugagcguggaagggggaggagu

SEQ ID NO: 320075 - RNA, 18 nt, Human
aggacagggcuggcuccu

SEQ ID NO: 320076 - RNA, 32 nt, Human
aggacagggcuguggcuggagaaccugcugcu

SEQ ID NO: 320077 - RNA, 32 nt, Human
aggacagguagguaaagaacagaggaaauaga

SEQ ID NO: 320078 - RNA, 19 nt, Human
aggacagguggccugggca

SEQ ID NO: 320079 - RNA, 32 nt, Human
aggacaggugugagcugccgcacccagccugu

SEQ ID NO: 320080 - RNA, 32 nt, Human
aggacaguaacugccagcugaggaaggagcac

SEQ ID NO: 320081 - RNA, 32 nt, Human
aggacagucacugcaaucucuuuaccaccucc

SEQ ID NO: 320082 - RNA, 22 nt, Human
aggacagugauuagacacgaag

SEQ ID NO: 320083 - RNA, 32 nt, Human
aggacaguggaaaggcaggcagagggagaggc

SEQ ID NO: 320084 - RNA, 31 nt, Human
aggacaguggagagagaaaggcuuccccacc

SEQ ID NO: 320085 - RNA, 32 nt, Human
aggacaguggaugcugcugggccucugccuug

SEQ ID NO: 320086 - RNA, 32 nt, Human
aggacagugggauccuugcaugggggugaugg

SEQ ID NO: 320087 - RNA, 20 nt, Human
aggacaguggggguugggga

SEQ ID NO: 320088 - RNA, 31 nt, Human
aggacaguucuuuuggagguuggaggggcca

SEQ ID NO: 320089 - RNA, 32 nt, Human
aggacauaauuuuaugaaaaaggaggcaucug

SEQ ID NO: 320090 - RNA, 32 nt, Human
aggacauagccaggccaggugcagugacucac

SEQ ID NO: 320091 - RNA, 32 nt, Human
aggacauauagugaugaacauguaaaguuuuu

SEQ ID NO: 320092 - RNA, 21 nt, Human
aggacauauauuuggcugcug

SEQ ID NO: 320093 - RNA, 32 nt, Human
aggacaucauagccacugagaucugggggcug

SEQ ID NO: 320094 - RNA, 32 nt, Human
aggacauccucuccauguucucagcuauccgu

SEQ ID NO: 320095 - RNA, 32 nt, Human
aggacaucgacaccaucuccccaacgcugggc

SEQ ID NO: 320096 - RNA, 19 nt, Human
aggacaucgccaggcucug

SEQ ID NO: 320097 - RNA, 21 nt, Human
aggacaucucugcuuccgcca

SEQ ID NO: 320098 - RNA, 32 nt, Human
aggacaucugcauauaacacacagccgaaguc

SEQ ID NO: 320099 - RNA, 32 nt, Human
aggacaucugguuggauggcucugaugugggg

SEQ ID NO: 320100 - RNA, 32 nt, Human
aggacaucugucucucuggagugucugucugu

SEQ ID NO: 320101 - RNA, 22 nt, Human
aggacaugaagccauuauuaua

SEQ ID NO: 320102 - RNA, 32 nt, Human
aggacaugagaugugggaggggcugggggugg

SEQ ID NO: 320103 - RNA, 32 nt, Human
aggacaugcuccauuuauuuuccauggaagac

SEQ ID NO: 320104 - RNA, 32 nt, Human
aggacaugcuccugcauacuccuggguguccc

SEQ ID NO: 320105 - RNA, 17 nt, Human
aggacaugcugccugaa

SEQ ID NO: 320106 - RNA, 32 nt, Human
aggacaugcuguggaugaagauaaagauggug

SEQ ID NO: 320107 - RNA, 32 nt, Human
aggacauggaagaucuguuucaaggagauuua

SEQ ID NO: 320108 - RNA, 32 nt, Human
aggacauggacaccaaaccaccugccagugac

SEQ ID NO: 320109 - RNA, 30 nt, Human
aggacauggagaaagagcgagagacucugc

SEQ ID NO: 320110 - RNA, 32 nt, Human
aggacauggccguggagggaggcaucaugggc

SEQ ID NO: 320111 - RNA, 32 nt, Human
aggacauggccuuccccgcgaguccauggcca

SEQ ID NO: 320112 - RNA, 30 nt, Human
aggacauggcggaggcaggaaaagugcccu

SEQ ID NO: 320113 - RNA, 32 nt, Human
aggacauguaguccaagguugcauggugaguu

SEQ ID NO: 320114 - RNA, 32 nt, Human
aggacauguccagcauggacagagccagaguu

SEQ ID NO: 320115 - RNA, 18 nt, Human
aggacauucaaaugugaa

SEQ ID NO: 320116 - RNA, 22 nt, Human
aggacauucaucacccagggaa

SEQ ID NO: 320117 - RNA, 32 nt, Human
aggacauugacaaugugcacacugcagguuga

SEQ ID NO: 320118 - RNA, 32 nt, Human
aggacauugagagggaaaaggccucaucgaca

SEQ ID NO: 320119 - RNA, 18 nt, Human
aggacauuggcugggaga

SEQ ID NO: 320120 - RNA, 32 nt, Human
aggacauuggugagaguccaacagacacaauu

SEQ ID NO: 320121 - RNA, 32 nt, Human
aggacauuuuccaggaucucagugugaguauc

SEQ ID NO: 320122 - RNA, 32 nt, Human
aggacauuuucucuuuaaaagaaaguuagguu

SEQ ID NO: 320123 - RNA, 32 nt, Human
aggaccaaacagcaacuuccugccacacacuu

SEQ ID NO: 320124 - RNA, 32 nt, Human
aggaccaaagugcuggauuacaggcgugagcc

SEQ ID NO: 320125 - RNA, 32 nt, Human
aggaccaacauggugaaaccccaucucuacua

SEQ ID NO: 320126 - RNA, 18 nt, Human
aggaccaacuggcuucug

SEQ ID NO: 320127 - RNA, 32 nt, Human
aggaccaaugcagggcugguucuuuuaccccu

SEQ ID NO: 320128 - RNA, 19 nt, Human
aggaccaauuccucauccu

SEQ ID NO: 320129 - RNA, 32 nt, Human
aggaccacacugaugcagcuguccugaaggac

SEQ ID NO: 320130 - RNA, 32 nt, Human
aggaccaccgcuacaccucuugccaggcugca

SEQ ID NO: 320131 - RNA, 32 nt, Human
aggaccacgggaggagguguaggagagaagcg

SEQ ID NO: 320132 - RNA, 32 nt, Human
aggaccacucacugagcaaaucucagccccga

SEQ ID NO: 320133 - RNA, 32 nt, Human
aggaccagaauaaauaauccugccugucauaa

SEQ ID NO: 320134 - RNA, 32 nt, Human
aggaccagaauccucagaaaucugucuucagu

SEQ ID NO: 320135 - RNA, 32 nt, Human
aggaccagacacauccacagccaggcucaugg

SEQ ID NO: 320136 - RNA, 32 nt, Human
aggaccagaguccgucccaggucugucugaca

SEQ ID NO: 320137 - RNA, 18 nt, Human
aggaccagaucccaggag

SEQ ID NO: 320138 - RNA, 32 nt, Human
aggaccagcaucaucuggaggcuggagcaggg

SEQ ID NO: 320139 - RNA, 32 nt, Human
aggaccagcccuggcccugccccgccaucugc

SEQ ID NO: 320140 - RNA, 22 nt, Human
aggaccagccuccgccaccccc

SEQ ID NO: 320141 - RNA, 32 nt, Human
aggaccagccuggacaacauggugagaccucg

SEQ ID NO: 320142 - RNA, 32 nt, Human
aggaccagccugggcaacauagcgagaccccc

SEQ ID NO: 320143 - RNA, 32 nt, Human
aggaccagcuuuggggccuccaccugccaucc

SEQ ID NO: 320144 - RNA, 32 nt, Human
aggaccagcuuuggggccuccaccugccgucc

SEQ ID NO: 320145 - RNA, 32 nt, Human
aggaccaggaaaugguacauggagcuuugagg

SEQ ID NO: 320146 - RNA, 19 nt, Human
aggaccaggacucccuccu

SEQ ID NO: 320147 - RNA, 18 nt, Human
aggaccaggccuucuccu

SEQ ID NO: 320148 - RNA, 32 nt, Human
aggaccagggccuucuggaggaguggcacuac

SEQ ID NO: 320149 - RNA, 32 nt, Human
aggaccagucugggcagcagggccagacacug

SEQ ID NO: 320150 - RNA, 32 nt, Human
aggaccaguuccagagaggaugucaccagucu

SEQ ID NO: 320151 - RNA, 32 nt, Human
aggaccaguuuuuacccaaauauauggguagc

SEQ ID NO: 320152 - RNA, 22 nt, Human
aggaccauauccaccacccucu

SEQ ID NO: 320153 - RNA, 24 nt, Human
aggaccaucuccugguuuccugaa

SEQ ID NO: 320154 - RNA, 32 nt, Human
aggaccaucucucauggcaccuggaggcuugu

SEQ ID NO: 320155 - RNA, 31 nt, Human
aggaccauggcugaggccaucaccuaugcag

SEQ ID NO: 320156 - RNA, 18 nt, Human
aggacccaccgaaccccg

SEQ ID NO: 320157 - RNA, 32 nt, Human
aggacccacugcaccacccuccgcuggcucgg

SEQ ID NO: 320158 - RNA, 32 nt, Human
aggacccacugccgcggggcugggcgagagca

SEQ ID NO: 320159 - RNA, 32 nt, Human
aggacccacugugagcacuccacccacugugg

SEQ ID NO: 320160 - RNA, 32 nt, Human
aggacccagaagcacaagacacaguaauccug

SEQ ID NO: 320161 - RNA, 32 nt, Human
aggacccagagcaggccuguccaugccauucc

SEQ ID NO: 320162 - RNA, 32 nt, Human
aggacccagagggaggcaggcacagccagccu

SEQ ID NO: 320163 - RNA, 21 nt, Human
aggacccagcuggccccaggg

SEQ ID NO: 320164 - RNA, 32 nt, Human
aggacccaggauuugaacccagcuucagugug

SEQ ID NO: 320165 - RNA, 32 nt, Human
aggacccaggccucccaccccacuacggaccg

SEQ ID NO: 320166 - RNA, 32 nt, Human
aggacccaggcucugccaacauuguggacauc

SEQ ID NO: 320167 - RNA, 20 nt, Human
aggacccaggggaaccgcga

SEQ ID NO: 320168 - RNA, 23 nt, Human
aggacccaggucugcugcccagg

SEQ ID NO: 320169 - RNA, 32 nt, Human
aggacccagguggcaccagcaguaguggaauc

SEQ ID NO: 320170 - RNA, 32 nt, Human
aggacccagugagggaaaugggaacauaccag

SEQ ID NO: 320171 - RNA, 32 nt, Human
aggacccaucaaugauggugacuuuagcagaa

SEQ ID NO: 320172 - RNA, 32 nt, Human
aggaccccaccacugcacuccagccuggauga

SEQ ID NO: 320173 - RNA, 32 nt, Human
aggaccccagccugccuacauuugcagacaga

SEQ ID NO: 320174 - RNA, 21 nt, Human
aggaccccaggcccaccuccu

SEQ ID NO: 320175 - RNA, 18 nt, Human
aggacccccaggaccccg

SEQ ID NO: 320176 - RNA, 32 nt, Human
aggacccccaggcuuggccugugauugcgcaa

SEQ ID NO: 320177 - RNA, 32 nt, Human
aggacccccaugcuguggugacuuuaaugaau

SEQ ID NO: 320178 - RNA, 21 nt, Human
aggaccccccaugucacggca

SEQ ID NO: 320179 - RNA, 18 nt, Human
aggacccccucuccucuu

SEQ ID NO: 320180 - RNA, 32 nt, Human
aggacccccugccuagcuugacggcugcucag

SEQ ID NO: 320181 - RNA, 23 nt, Human
aggaccccgggacagaaccccgg

SEQ ID NO: 320182 - RNA, 32 nt, Human
aggaccccuccaggccccucucuccuggaagu

SEQ ID NO: 320183 - RNA, 32 nt, Human
aggaccccuuccugccauacccaccaaggucc

SEQ ID NO: 320184 - RNA, 32 nt, Human
aggacccgaaaucacagacauuagcaaugaug

SEQ ID NO: 320185 - RNA, 32 nt, Human
aggacccgcuggccccugggcccagccugggc

SEQ ID NO: 320186 - RNA, 32 nt, Human
aggacccgggcagggcuggagcugggcuggga

SEQ ID NO: 320187 - RNA, 32 nt, Human
aggacccggggaggggucccgagaggcucccc

SEQ ID NO: 320188 - RNA, 32 nt, Human
aggacccucagcaccuucugcuggagagaggu

SEQ ID NO: 320189 - RNA, 32 nt, Human
aggacccuccacccucucucucugucucagau

SEQ ID NO: 320190 - RNA, 21 nt, Human
aggacccucccaccauccccu

SEQ ID NO: 320191 - RNA, 23 nt, Human
aggacccuccccugcuccaugug

SEQ ID NO: 320192 - RNA, 23 nt, Human
aggacccucccugcccacccccu

SEQ ID NO: 320193 - RNA, 32 nt, Human
aggacccuccgagccagucuuuuucuggagga

SEQ ID NO: 320194 - RNA, 32 nt, Human
aggacccucucuuccuucuuucaaccuuccgg

SEQ ID NO: 320195 - RNA, 32 nt, Human
aggacccugcagccuuccgcaguguuuguguc

SEQ ID NO: 320196 - RNA, 32 nt, Human
aggacccugcagcugugcugccgccaccucug

SEQ ID NO: 320197 - RNA, 25 nt, Human
aggacccuggacucugcucaccccc

SEQ ID NO: 320198 - RNA, 32 nt, Human
aggacccuggcagaaucagagacaaaucugag

SEQ ID NO: 320199 - RNA, 32 nt, Human
aggacccugggcaggguguggggcauccggua

SEQ ID NO: 320200 - RNA, 32 nt, Human
aggacccugugcaagguuauuugcaggcaggg

SEQ ID NO: 320201 - RNA, 32 nt, Human
aggacccuuuccaggcccacccccucugugau

SEQ ID NO: 320202 - RNA, 32 nt, Human
aggaccgacgcgacgcaugccucccggccacc

SEQ ID NO: 320203 - RNA, 32 nt, Human
aggaccgagauacauggccacccaugacccgg

SEQ ID NO: 320204 - RNA, 32 nt, Human
aggaccgaggccacauacuccccauucucucg

SEQ ID NO: 320205 - RNA, 27 nt, Human
aggaccggcgugacagccuccagaaug

SEQ ID NO: 320206 - RNA, 32 nt, Human
aggaccggggcugaggccacacagauaggagc

SEQ ID NO: 320207 - RNA, 21 nt, Human
aggaccgggggucucccuccu

SEQ ID NO: 320208 - RNA, 32 nt, Human
aggaccguagcucuccuggccuggagagugug

SEQ ID NO: 320209 - RNA, 19 nt, Human
aggaccgucccacccugcu

SEQ ID NO: 320210 - RNA, 32 nt, Human
aggaccgucggugggcgauggcugcaacggug

SEQ ID NO: 320211 - RNA, 22 nt, Human
aggaccgugaugacaaccccga

SEQ ID NO: 320212 - RNA, 32 nt, Human
aggaccuaaauaaacugugagccaccuuuucu

SEQ ID NO: 320213 - RNA, 32 nt, Human
aggaccuaggcagggaugaggaagcacacaaa

SEQ ID NO: 320214 - RNA, 32 nt, Human
aggaccuaggguggggaagggagggucucuug

SEQ ID NO: 320215 - RNA, 32 nt, Human
aggaccucacccaggauggacugauggaccug

SEQ ID NO: 320216 - RNA, 32 nt, Human
aggaccucacuuggcccugcaagccgcuuuuc

SEQ ID NO: 320217 - RNA, 20 nt, Human
aggaccucagaacccaggag

SEQ ID NO: 320218 - RNA, 32 nt, Human
aggaccucagaccuccccagcccuggguuucu

SEQ ID NO: 320219 - RNA, 32 nt, Human
aggaccucaggcugcugucauauaucacccgu

SEQ ID NO: 320220 - RNA, 32 nt, Human
aggaccucauuucuuauagccucuccugugau

SEQ ID NO: 320221 - RNA, 32 nt, Human
aggaccuccaaccugcuggugaucagggugcu

SEQ ID NO: 320222 - RNA, 32 nt, Human
aggaccucccagaguuaugagcccugauuuug

SEQ ID NO: 320223 - RNA, 19 nt, Human
aggaccucccagauaagac

SEQ ID NO: 320224 - RNA, 32 nt, Human
aggaccuccucuucccccuuccaaauaauaaa

SEQ ID NO: 320225 - RNA, 32 nt, Human
aggaccucuaggcuguggcuggccuugugcag

SEQ ID NO: 320226 - RNA, 32 nt, Human
aggaccucuggcccuacuaggcuguagacuca

SEQ ID NO: 320227 - RNA, 32 nt, Human
aggaccucuucuagcuccuuuuuaucgcauuu

SEQ ID NO: 320228 - RNA, 32 nt, Human
aggaccugacagaagucagggaagagucccug

SEQ ID NO: 320229 - RNA, 32 nt, Human
aggaccugacccagaaauugagguccccgcug

SEQ ID NO: 320230 - RNA, 32 nt, Human
aggaccugacucuguguggacgcaaagauagg

SEQ ID NO: 320231 - RNA, 32 nt, Human
aggaccugagccaggaaugcaggauggcggcg

SEQ ID NO: 320232 - RNA, 32 nt, Human
aggaccugcaacuucagugcuucugggauaac

SEQ ID NO: 320233 - RNA, 32 nt, Human
aggaccugccagcugcuucaugaacaaguccc

SEQ ID NO: 320234 - RNA, 32 nt, Human
aggaccugcccagguaugccuuccagugaugc

SEQ ID NO: 320235 - RNA, 32 nt, Human
aggaccuggaaacugcuguuugcccugguauu

SEQ ID NO: 320236 - RNA, 32 nt, Human
aggaccuggaggggugcucuguggaaacugcu

SEQ ID NO: 320237 - RNA, 19 nt, Human
aggaccuggcaacccagga

SEQ ID NO: 320238 - RNA, 32 nt, Human
aggaccugguggcugagccaggagaugcacac

SEQ ID NO: 320239 - RNA, 32 nt, Human
aggaccuguaagaacugaaaacucuuccacuu

SEQ ID NO: 320240 - RNA, 21 nt, Human
aggaccugucaggcccagggg

SEQ ID NO: 320241 - RNA, 32 nt, Human
aggaccuguccacuucugugacaaaucaacgg

SEQ ID NO: 320242 - RNA, 32 nt, Human
aggaccuucccaagucucccuuucccugucug

SEQ ID NO: 320243 - RNA, 32 nt, Human
aggaccuuuggaaaucagcaauguggugaugg

SEQ ID NO: 320244 - RNA, 32 nt, Human
aggacgaagacugagacugacacuucugcucc

SEQ ID NO: 320245 - RNA, 32 nt, Human
aggacgaagaggaggaggaugaggaggacaca

SEQ ID NO: 320246 - RNA, 32 nt, Human
aggacgaagcucaacagaaaaccuacagcaca

SEQ ID NO: 320247 - RNA, 32 nt, Human
aggacgacgagcaggagcugcucugcgccagg

SEQ ID NO: 320248 - RNA, 32 nt, Human
aggacgacuucugcuuuuguuguuguuguugu

SEQ ID NO: 320249 - RNA, 32 nt, Human
aggacgagaggacgaccuucucugauagagga

SEQ ID NO: 320250 - RNA, 32 nt, Human
aggacgaggaggcagcaggagcagugacggug

SEQ ID NO: 320251 - RNA, 32 nt, Human
aggacgaggagugagggguccagagggugggg

SEQ ID NO: 320252 - RNA, 32 nt, Human
aggacgaggagugggaugacugagggacgugg

SEQ ID NO: 320253 - RNA, 32 nt, Human
aggacgaggaugagggagaagaauaagcagcu

SEQ ID NO: 320254 - RNA, 32 nt, Human
aggacgaggugcuguuggcaauugcagcugcg

SEQ ID NO: 320255 - RNA, 32 nt, Human
aggacgaugaugaagagacugccccucccauu

SEQ ID NO: 320256 - RNA, 22 nt, Human
aggacgauggggcaugaccuca

SEQ ID NO: 320257 - RNA, 32 nt, Human
aggacgauguaauccuugccaucguaagcaag

SEQ ID NO: 320258 - RNA, 21 nt, Human
aggacgauguggagagcaaga

SEQ ID NO: 320259 - RNA, 32 nt, Human
aggacgcacaugcagacccgcacgcacgcacg

SEQ ID NO: 320260 - RNA, 32 nt, Human
aggacgcaggagguggagccggccgggugcuc

SEQ ID NO: 320261 - RNA, 32 nt, Human
aggacgcauguggagcgcauggggagggaagg

SEQ ID NO: 320262 - RNA, 32 nt, Human
aggacgccagcagcagcagcaagcucuucagu

SEQ ID NO: 320263 - RNA, 20 nt, Human
aggacgccgacccugccugg

SEQ ID NO: 320264 - RNA, 32 nt, Human
aggacgccgcccccggccgggucuccacuucu

SEQ ID NO: 320265 - RNA, 20 nt, Human
aggacgccgggguuccagga

SEQ ID NO: 320266 - RNA, 32 nt, Human
aggacgcgcacagcccgaggaggcagagccaa

SEQ ID NO: 320267 - RNA, 32 nt, Human
aggacgcgccuuguuaaccaaauguuuacgag

SEQ ID NO: 320268 - RNA, 32 nt, Human
aggacgcggccaccccaggccuuuccagagca

SEQ ID NO: 320269 - RNA, 21 nt, Human
aggacgcgggaggcgcacuug

SEQ ID NO: 320270 - RNA, 32 nt, Human
aggacgcgucugggcuccccuaggcaaagguc

SEQ ID NO: 320271 - RNA, 21 nt, Human
aggacgcuacagcuccaggcg

SEQ ID NO: 320272 - RNA, 32 nt, Human
aggacgcucccagggccccagaggggcgaauu

SEQ ID NO: 320273 - RNA, 22 nt, Human
aggacgcuccgaaacacugugu

SEQ ID NO: 320274 - RNA, 32 nt, Human
aggacgcugagcucgguucaugcagcaggcug

SEQ ID NO: 320275 - RNA, 32 nt, Human
aggacgcugcagcucucuccagcccuguuggc

SEQ ID NO: 320276 - RNA, 32 nt, Human
aggacgcugcagcugaaacguuccggcuccgg

SEQ ID NO: 320277 - RNA, 32 nt, Human
aggacgcugggagccugucaguuuaugaucug

SEQ ID NO: 320278 - RNA, 32 nt, Human
aggacgcugugaucuccaccuugaagccaggc

SEQ ID NO: 320279 - RNA, 32 nt, Human
aggacgcugugguguggaggcagcagccuggg

SEQ ID NO: 320280 - RNA, 32 nt, Human
aggacgcuuccucauuucucuucaccaaaacc

SEQ ID NO: 320281 - RNA, 32 nt, Human
aggacggaaggaaggaaggaaggaaggaagga

SEQ ID NO: 320282 - RNA, 32 nt, Human
aggacggagagcucucccuugguucggaguca

SEQ ID NO: 320283 - RNA, 32 nt, Human
aggacggaggcugcaugcccgaggaccaggcc

SEQ ID NO: 320284 - RNA, 21 nt, Human
aggacggccggccggccgguc

SEQ ID NO: 320285 - RNA, 32 nt, Human
aggacggccuguguccucacuacgccugaggc

SEQ ID NO: 320286 - RNA, 32 nt, Human
aggacgggaggcagagccggcucagagcaggu

SEQ ID NO: 320287 - RNA, 20 nt, Human
aggacgggcacacccaggga

SEQ ID NO: 320288 - RNA, 32 nt, Human
aggacggggaggacgcgccgcggccgggcagg

SEQ ID NO: 320289 - RNA, 32 nt, Human
aggacggggcaggcagcaccugguaggcacag

SEQ ID NO: 320290 - RNA, 32 nt, Human
aggacggucccuggucggguccuggcugaagc

SEQ ID NO: 320291 - RNA, 18 nt, Human
aggacgguggcugggagg

SEQ ID NO: 320292 - RNA, 32 nt, Human
aggacguagaguuauugaaaaugcagaugguu

SEQ ID NO: 320293 - RNA, 32 nt, Human
aggacguccgggacauccaggaccgcaguauu

SEQ ID NO: 320294 - RNA, 32 nt, Human
aggacgugagagaagggagaugggagagagau

SEQ ID NO: 320295 - RNA, 32 nt, Human
aggacgugagcgcagagcagagccuggagaag

SEQ ID NO: 320296 - RNA, 32 nt, Human
aggacgugcagagggugcaggagcuggccgag

SEQ ID NO: 320297 - RNA, 32 nt, Human
aggacgugccuuguuaaccaaauguuuacaag

SEQ ID NO: 320298 - RNA, 32 nt, Human
aggacgugccuuguuaaccaaauguuugcaag

SEQ ID NO: 320299 - RNA, 32 nt, Human
aggacgugggacuucucagacgucaggagagu

SEQ ID NO: 320300 - RNA, 32 nt, Human
aggacguuaugacuuuucuccuuugcaagacu

SEQ ID NO: 320301 - RNA, 31 nt, Human
aggacguuccucaaggaggugaaggucaugc

SEQ ID NO: 320302 - RNA, 31 nt, Human
aggacuaacagcugacugaccaaagcagccc

SEQ ID NO: 320303 - RNA, 32 nt, Human
aggacuacaaggcacaccaccaugccuggcua

SEQ ID NO: 320304 - RNA, 32 nt, Human
aggacuacagaacauccaugauagcagucuuc

SEQ ID NO: 320305 - RNA, 23 nt, Human
aggacuagccccacucccccaug

SEQ ID NO: 320306 - RNA, 32 nt, Human
aggacuagccugggcaacauagcaagauccca

SEQ ID NO: 320307 - RNA, 32 nt, Human
aggacuaggaaagagcaguggcaggggccaga

SEQ ID NO: 320308 - RNA, 32 nt, Human
aggacuaguauggggugggaggccccacccuu

SEQ ID NO: 320309 - RNA, 32 nt, Human
aggacuauaacuuauucaaaggccaaugauac

SEQ ID NO: 320310 - RNA, 32 nt, Human
aggacuaucacacccagcccauguggcuaaaa

SEQ ID NO: 320311 - RNA, 32 nt, Human
aggacuaucuuugaacauaaguuaauuaacua

SEQ ID NO: 320312 - RNA, 32 nt, Human
aggacuauguagaaguagaaagaaaagaaaaa

SEQ ID NO: 320313 - RNA, 32 nt, Human
aggacucaaguccuggaauguccuccacuggu

SEQ ID NO: 320314 - RNA, 32 nt, Human
aggacucacacacggugagaaacccuauaaau

SEQ ID NO: 320315 - RNA, 32 nt, Human
aggacucacagucugccagacacugcuaggua

SEQ ID NO: 320316 - RNA, 32 nt, Human
aggacucacccaguuggaauucugggugggcu

SEQ ID NO: 320317 - RNA, 32 nt, Human
aggacucacuguauggugcccucuccaaaggg

SEQ ID NO: 320318 - RNA, 32 nt, Human
aggacucagagaccccagcagaggaggacagu

SEQ ID NO: 320319 - RNA, 32 nt, Human
aggacucagcacaccggcauccccaccugcug

SEQ ID NO: 320320 - RNA, 23 nt, Human
aggacucagcaguggccuggaca

SEQ ID NO: 320321 - RNA, 32 nt, Human
aggacucagccugaaggagcugcuccugaggc

SEQ ID NO: 320322 - RNA, 32 nt, Human
aggacucagccuggccucugccuggccuguuu

SEQ ID NO: 320323 - RNA, 32 nt, Human
aggacucaggaaaauaaaaagcauuuucuauu

SEQ ID NO: 320324 - RNA, 32 nt, Human
aggacucaggcagagggacucagggaugggga

SEQ ID NO: 320325 - RNA, 32 nt, Human
aggacucaguaccuccagcacacccuucucau

SEQ ID NO: 320326 - RNA, 32 nt, Human
aggacucagucaccuccagcuucuccaugacc

SEQ ID NO: 320327 - RNA, 32 nt, Human
aggacucaucacaucuauucggauauucuguu

SEQ ID NO: 320328 - RNA, 32 nt, Human
aggacucauccagcaaaguugccugggauuca

SEQ ID NO: 320329 - RNA, 32 nt, Human
aggacucauccagguucccagcgaggcacuga

SEQ ID NO: 320330 - RNA, 32 nt, Human
aggacucauucaacccaguaccauguggcuug

SEQ ID NO: 320331 - RNA, 19 nt, Human
aggacucauucuuuccucc

SEQ ID NO: 320332 - RNA, 32 nt, Human
aggacucauuguuccacccccaaccaauuuga

SEQ ID NO: 320333 - RNA, 32 nt, Human
aggacucauuucuugccuugaauaaccauuuu

SEQ ID NO: 320334 - RNA, 32 nt, Human
aggacuccagagagucaggucaaccccgagga

SEQ ID NO: 320335 - RNA, 32 nt, Human
aggacucccaaaaccagagacaccaggagccu

SEQ ID NO: 320336 - RNA, 25 nt, Human
aggacucccaccucugccccaaggg

SEQ ID NO: 320337 - RNA, 32 nt, Human
aggacuccccagccaaggggucccccaaaggc

SEQ ID NO: 320338 - RNA, 32 nt, Human
aggacucccggagccugugcagccuugguggc

SEQ ID NO: 320339 - RNA, 32 nt, Human
aggacuccuccugggccuggugcuucgagguc

SEQ ID NO: 320340 - RNA, 32 nt, Human
aggacuccucgcugcugaccaggcucuaugaa

SEQ ID NO: 320341 - RNA, 32 nt, Human
aggacuccugcacugacuccugaggacuuuug

SEQ ID NO: 320342 - RNA, 32 nt, Human
aggacucggcguauccgccaccagggacauua

SEQ ID NO: 320343 - RNA, 19 nt, Human
aggacucuacccuccuccc

SEQ ID NO: 320344 - RNA, 32 nt, Human
aggacucuaucucauccuccccucgacaagcc

SEQ ID NO: 320345 - RNA, 32 nt, Human
aggacucuccauugcuaccaaacuccuccugc

SEQ ID NO: 320346 - RNA, 32 nt, Human
aggacucucccaguggagcucugcaggccagg

SEQ ID NO: 320347 - RNA, 32 nt, Human
aggacucuccccugccucuggggagggggcca

SEQ ID NO: 320348 - RNA, 32 nt, Human
aggacucucucccaccacauacagcacagcac

SEQ ID NO: 320349 - RNA, 32 nt, Human
aggacucugaccccagcauucucaggcaccag

SEQ ID NO: 320350 - RNA, 32 nt, Human
aggacucugcauuuccaacaagcucccagaug

SEQ ID NO: 320351 - RNA, 32 nt, Human
aggacucugcauuucuuacagauucccaggug

SEQ ID NO: 320352 - RNA, 21 nt, Human
aggacucugccacucuaggca

SEQ ID NO: 320353 - RNA, 32 nt, Human
aggacucugcucccuggggcugcuucuagcuc

SEQ ID NO: 320354 - RNA, 32 nt, Human
aggacucuguccugugucaccucucuccaggu

SEQ ID NO: 320355 - RNA, 32 nt, Human
aggacucuuaaaggaguauguuucuuggcuuu

SEQ ID NO: 320356 - RNA, 19 nt, Human
aggacucuucaguguuuau

SEQ ID NO: 320357 - RNA, 32 nt, Human
aggacucuugccguagauuaagccagucaguu

SEQ ID NO: 320358 - RNA, 32 nt, Human
aggacucuugugaaaagagaggauauguucac

SEQ ID NO: 320359 - RNA, 22 nt, Human
aggacucuuugcugucccgcaa

SEQ ID NO: 320360 - RNA, 32 nt, Human
aggacucuuuuggugugacuucccucuguauu

SEQ ID NO: 320361 - RNA, 32 nt, Human
aggacugaaaccagaaucgcugaaagcccuug

SEQ ID NO: 320362 - RNA, 32 nt, Human
aggacugaaaccuccacugcaggcugguuuua

SEQ ID NO: 320363 - RNA, 32 nt, Human
aggacugaaagagaccucagaggucucuaucc

SEQ ID NO: 320364 - RNA, 32 nt, Human
aggacugaagacaguugugggauaucugucau

SEQ ID NO: 320365 - RNA, 32 nt, Human
aggacugaagcagccuuuguuaaagggaagca

SEQ ID NO: 320366 - RNA, 32 nt, Human
aggacugaaguccaaaugcaucucacggggcu

SEQ ID NO: 320367 - RNA, 32 nt, Human
aggacugaaucgccacuacagccugggugcaa

SEQ ID NO: 320368 - RNA, 32 nt, Human
aggacugacaggcagagaauaggaauaugcag

SEQ ID NO: 320369 - RNA, 32 nt, Human
aggacugagaagcagauaacaagagugacgcu

SEQ ID NO: 320370 - RNA, 18 nt, Human
aggacugagacccaggag

SEQ ID NO: 320371 - RNA, 32 nt, Human
aggacugagcacacaggugaacuccagaaaga

SEQ ID NO: 320372 - RNA, 32 nt, Human
aggacugagcagcuaggcgcgagcgaaaacaa

SEQ ID NO: 320373 - RNA, 32 nt, Human
aggacugagcccaggagagcggggacagucau

SEQ ID NO: 320374 - RNA, 32 nt, Human
aggacugaucacuguccuugccucuaggaggg

SEQ ID NO: 320375 - RNA, 32 nt, Human
aggacugaugguuuuuauuauuacuaacccuc

SEQ ID NO: 320376 - RNA, 32 nt, Human
aggacugcauugcucaggcauuuucuaaacuc

SEQ ID NO: 320377 - RNA, 32 nt, Human
aggacugcccucuccccugcuccuggcacucu

SEQ ID NO: 320378 - RNA, 32 nt, Human
aggacugccugggcagggucugccccucccac

SEQ ID NO: 320379 - RNA, 32 nt, Human
aggacugcgggaaggcgcgggagccaggggcc

SEQ ID NO: 320380 - RNA, 32 nt, Human
aggacugcuccccuugcacagccuacccuucc

SEQ ID NO: 320381 - RNA, 32 nt, Human
aggacugcuguguguggguguguuccucagac

SEQ ID NO: 320382 - RNA, 32 nt, Human
aggacugcuugggcccaggaauucaggaccag

SEQ ID NO: 320383 - RNA, 32 nt, Human
aggacuggaaccuuggggagccuugggugagg

SEQ ID NO: 320384 - RNA, 32 nt, Human
aggacuggaaggaaaaagagacagguuagagg

SEQ ID NO: 320385 - RNA, 32 nt, Human
aggacuggaaggcaaggacuaaggugaaagcu

SEQ ID NO: 320386 - RNA, 20 nt, Human
aggacuggagagagguggaa

SEQ ID NO: 320387 - RNA, 32 nt, Human
aggacuggagccaagauacuggugggggagau

SEQ ID NO: 320388 - RNA, 32 nt, Human
aggacuggaugcuggggaggagccggggccac

SEQ ID NO: 320389 - RNA, 32 nt, Human
aggacuggauuuuccagauccuugugguccug

SEQ ID NO: 320390 - RNA, 32 nt, Human
aggacuggcaucgggggugcacuggcaagggc

SEQ ID NO: 320391 - RNA, 32 nt, Human
aggacuggcucuccauuuccugccucuccuuu

SEQ ID NO: 320392 - RNA, 31 nt, Human
aggacugggaaacuguguugaagcuccugac

SEQ ID NO: 320393 - RNA, 32 nt, Human
aggacugggaagggaggcaggaggcuucucug

SEQ ID NO: 320394 - RNA, 18 nt, Human
aggacugggagccaggag

SEQ ID NO: 320395 - RNA, 32 nt, Human
aggacugggagguggcggcagcgggcgaggac

SEQ ID NO: 320396 - RNA, 26 nt, Human
aggacugggaguccagagaccugggc

SEQ ID NO: 320397 - RNA, 32 nt, Human
aggacugggcugggcacuguggcucacgccug

SEQ ID NO: 320398 - RNA, 32 nt, Human
aggacugggucagagagcagggaguggcuggg

SEQ ID NO: 320399 - RNA, 24 nt, Human
aggacugguacccacaaagcaaca

SEQ ID NO: 320400 - RNA, 32 nt, Human
aggacugguucugccacacacugaauuccagc

SEQ ID NO: 320401 - RNA, 32 nt, Human
aggacugguuuggaaacagaccccuauuucag

SEQ ID NO: 320402 - RNA, 32 nt, Human
aggacuguccgcgggguugagggaaggggccg

SEQ ID NO: 320403 - RNA, 32 nt, Human
aggacugugacacugcacuccagccugggcaa

SEQ ID NO: 320404 - RNA, 32 nt, Human
aggacuguggaguccgacaaagcuacuugaag

SEQ ID NO: 320405 - RNA, 32 nt, Human
aggacuguggccauggugugugcaguggcccc

SEQ ID NO: 320406 - RNA, 32 nt, Human
aggacuguggcccuugugggggccaaggcaca

SEQ ID NO: 320407 - RNA, 32 nt, Human
aggacugugugaaccaacaaggggccaguuuu

SEQ ID NO: 320408 - RNA, 32 nt, Human
aggacuguguuuacuaaaguguguaaauguuu

SEQ ID NO: 320409 - RNA, 32 nt, Human
aggacuguuaucuaugagcaugcauggcuaua

SEQ ID NO: 320410 - RNA, 32 nt, Human
aggacuguuccuugguguuugagggaaacuuu

SEQ ID NO: 320411 - RNA, 24 nt, Human
aggacuguucuggggccagcuucc

SEQ ID NO: 320412 - RNA, 32 nt, Human
aggacuguuuucaugcugccugugccucggcu

SEQ ID NO: 320413 - RNA, 32 nt, Human
aggacuuaccacuaggaaccaccaagaccaau

SEQ ID NO: 320414 - RNA, 32 nt, Human
aggacuuacugaggcugcaggggagugagacc

SEQ ID NO: 320415 - RNA, 32 nt, Human
aggacuuagaugcccagaugaagagggaaagc

SEQ ID NO: 320416 - RNA, 32 nt, Human
aggacuuagggaggcagaguggaggaagugag

SEQ ID NO: 320417 - RNA, 32 nt, Human
aggacuucaagaccagccuaggcaacauggug

SEQ ID NO: 320418 - RNA, 32 nt, Human
aggacuucaagaccagccuggccaacauggug

SEQ ID NO: 320419 - RNA, 32 nt, Human
aggacuucagaaugccgugggcuccagcgaag

SEQ ID NO: 320420 - RNA, 32 nt, Human
aggacuuccagaccagccuggucaacauggug

SEQ ID NO: 320421 - RNA, 32 nt, Human
aggacuuccagccucccauccucugguggucu

SEQ ID NO: 320422 - RNA, 20 nt, Human
aggacuuccaggaggacccc

SEQ ID NO: 320423 - RNA, 21 nt, Human
aggacuuccaguauuuauuga

SEQ ID NO: 320424 - RNA, 32 nt, Human
aggacuuccugccaaucucuucugugaggcau

SEQ ID NO: 320425 - RNA, 32 nt, Human
aggacuucggguccccucaccccgggcggaug

SEQ ID NO: 320426 - RNA, 32 nt, Human
aggacuucuagguaggagguagacccuuuagc

SEQ ID NO: 320427 - RNA, 32 nt, Human
aggacuucuccuuuuucucucccuccagagcu

SEQ ID NO: 320428 - RNA, 32 nt, Human
aggacuucucugucuggagacagccccagacc

SEQ ID NO: 320429 - RNA, 32 nt, Human
aggacuucugcagcuuaucuucuggugucccu

SEQ ID NO: 320430 - RNA, 32 nt, Human
aggacuucugugacuccugggccacagagguc

SEQ ID NO: 320431 - RNA, 32 nt, Human
aggacuugaauagaccuuuuacagagaagaua

SEQ ID NO: 320432 - RNA, 32 nt, Human
aggacuugacuuuuguuuagucuuucuaagaa

SEQ ID NO: 320433 - RNA, 32 nt, Human
aggacuugaggcaugcugggccuggugcagug

SEQ ID NO: 320434 - RNA, 32 nt, Human
aggacuugaguguugcuguuuauucacauuug

SEQ ID NO: 320435 - RNA, 32 nt, Human
aggacuugcuggggaccagaauccaaacggcc

SEQ ID NO: 320436 - RNA, 32 nt, Human
aggacuuggaacacagucagugguagguaauc

SEQ ID NO: 320437 - RNA, 32 nt, Human
aggacuuggaagcagaguucagcagugaacuc

SEQ ID NO: 320438 - RNA, 32 nt, Human
aggacuuggaaguggggacaucaggguagcug

SEQ ID NO: 320439 - RNA, 32 nt, Human
aggacuuggaauuggggacaucaggguagcug

SEQ ID NO: 320440 - RNA, 32 nt, Human
aggacuuggaccgcuucagccugggcugggag

SEQ ID NO: 320441 - RNA, 32 nt, Human
aggacuugggagaaggauggggucuuaggaag

SEQ ID NO: 320442 - RNA, 22 nt, Human
aggacuuggggccuaucugcca

SEQ ID NO: 320443 - RNA, 32 nt, Human
aggacuuguccuugauccuuccagaaaccacc

SEQ ID NO: 320444 - RNA, 32 nt, Human
aggacuugucucugugcugaaagcaaauagca

SEQ ID NO: 320445 - RNA, 19 nt, Human
aggacuugugccauucuca

SEQ ID NO: 320446 - RNA, 22 nt, Human
aggacuuguuagucuccagaac

SEQ ID NO: 320447 - RNA, 32 nt, Human
aggacuuucagagaaagagcacuguggguggc

SEQ ID NO: 320448 - RNA, 32 nt, Human
aggacuuuccacuccuggcugagagaggaaga

SEQ ID NO: 320449 - RNA, 32 nt, Human
aggacuuucucccaggggaagcccccagcccu

SEQ ID NO: 320450 - RNA, 32 nt, Human
aggacuuugagaccagccuggccaacauggua

SEQ ID NO: 320451 - RNA, 32 nt, Human
aggacuuugcugcugcuauugcacuucaccag

SEQ ID NO: 320452 - RNA, 32 nt, Human
aggacuuuuagauuuagugaagaugguagggu

SEQ ID NO: 320453 - RNA, 32 nt, Human
aggagaaaaaccaaugacauuccacuggcaag

SEQ ID NO: 320454 - RNA, 17 nt, Human
aggagaaaaaguguagg

SEQ ID NO: 320455 - RNA, 19 nt, Human
aggagaaaaauauuuggga

SEQ ID NO: 320456 - RNA, 32 nt, Human
aggagaaaaauuagguuccaugcaaagaaaua

SEQ ID NO: 320457 - RNA, 32 nt, Human
aggagaaaacacaugaggguguggucaggguu

SEQ ID NO: 320458 - RNA, 32 nt, Human
aggagaaaagccuucuagggucacugucauuc

SEQ ID NO: 320459 - RNA, 17 nt, Human
aggagaaaagcugcagg

SEQ ID NO: 320460 - RNA, 32 nt, Human
aggagaaaaggauuuuugcauguuuagaaauc

SEQ ID NO: 320461 - RNA, 18 nt, Human
aggagaaaagggugcgga

SEQ ID NO: 320462 - RNA, 19 nt, Human
aggagaaaaguacgacaga

SEQ ID NO: 320463 - RNA, 20 nt, Human
aggagaaaaguggagguaga

SEQ ID NO: 320464 - RNA, 32 nt, Human
aggagaaaaugaggagaaagacaagaaauuuc

SEQ ID NO: 320465 - RNA, 16 nt, Human
aggagaaacauugcag

SEQ ID NO: 320466 - RNA, 18 nt, Human
aggagaaagaaucucaga

SEQ ID NO: 320467 - RNA, 32 nt, Human
aggagaaagagagguaucaaggaucucagaau

SEQ ID NO: 320468 - RNA, 32 nt, Human
aggagaaagaggaggagagagaaaaagggcac

SEQ ID NO: 320469 - RNA, 32 nt, Human
aggagaaagaggaggaucucgaagagaagaga

SEQ ID NO: 320470 - RNA, 32 nt, Human
aggagaaagagggagggagaugggagagaaau

SEQ ID NO: 320471 - RNA, 32 nt, Human
aggagaaagcaguaggcuuccuuucuaagaua

SEQ ID NO: 320472 - RNA, 32 nt, Human
aggagaaagccaaacuccucuguuugguguac

SEQ ID NO: 320473 - RNA, 32 nt, Human
aggagaaagccuuccucuucucucauaggaua

SEQ ID NO: 320474 - RNA, 32 nt, Human
aggagaaaggaaaggaaggcaggagggagaaa

SEQ ID NO: 320475 - RNA, 32 nt, Human
aggagaaaggaaaugagaaugaagacgagaac

SEQ ID NO: 320476 - RNA, 18 nt, Human
aggagaaaguccugcaga

SEQ ID NO: 320477 - RNA, 32 nt, Human
aggagaaaguggaccagcucccaugaccucac

SEQ ID NO: 320478 - RNA, 18 nt, Human
aggagaaauaucuucaga

SEQ ID NO: 320479 - RNA, 32 nt, Human
aggagaaauaugcgugugucuccguacauauu

SEQ ID NO: 320480 - RNA, 32 nt, Human
aggagaaauguccucauauuugaggaccauga

SEQ ID NO: 320481 - RNA, 18 nt, Human
aggagaaauuaauugaga

SEQ ID NO: 320482 - RNA, 19 nt, Human
aggagaacaaauauucaga

SEQ ID NO: 320483 - RNA, 32 nt, Human
aggagaacaagaugaccugggccccgagaaac

SEQ ID NO: 320484 - RNA, 32 nt, Human
aggagaacagaaguucuaacucaguacuugaa

SEQ ID NO: 320485 - RNA, 32 nt, Human
aggagaacagauaaauguggucucagccagcc

SEQ ID NO: 320486 - RNA, 32 nt, Human
aggagaacaugcacgcagcagagaucaugggg

SEQ ID NO: 320487 - RNA, 32 nt, Human
aggagaaccagagucuggaggggaggcacagu

SEQ ID NO: 320488 - RNA, 32 nt, Human
aggagaaccagcaaaaucugugguguuugaca

SEQ ID NO: 320489 - RNA, 32 nt, Human
aggagaaccagcugcccaagcucuuggcugcu

SEQ ID NO: 320490 - RNA, 32 nt, Human
aggagaacccagcgggagaacauuucaggaua

SEQ ID NO: 320491 - RNA, 16 nt, Human
aggagaacgagaauca

SEQ ID NO: 320492 - RNA, 32 nt, Human
aggagaacgcugggaccuaacucuugcugcag

SEQ ID NO: 320493 - RNA, 32 nt, Human
aggagaacuauccucgacucacggugagggaa

SEQ ID NO: 320494 - RNA, 32 nt, Human
aggagaacugccugaacccaggaggcagaggu

SEQ ID NO: 320495 - RNA, 32 nt, Human
aggagaacugcuugaacccaggaggcagaggu

SEQ ID NO: 320496 - RNA, 32 nt, Human
aggagaagaagcaggugaccauggaggcuggc

SEQ ID NO: 320497 - RNA, 32 nt, Human
aggagaagaaguacauggaggccaggccaaga

SEQ ID NO: 320498 - RNA, 32 nt, Human
aggagaagaauuugcuccaggccaggagcaca

SEQ ID NO: 320499 - RNA, 32 nt, Human
aggagaagaccugccuguggguccccaucgcc

SEQ ID NO: 320500 - RNA, 17 nt, Human
aggagaagacugcauga

SEQ ID NO: 320501 - RNA, 32 nt, Human
aggagaagaggaagguaaugguaaaaauuguc

SEQ ID NO: 320502 - RNA, 32 nt, Human
aggagaagaggaggaggaggagcggggucccc

SEQ ID NO: 320503 - RNA, 32 nt, Human
aggagaagagggagaauggagcaggaggaaaa

SEQ ID NO: 320504 - RNA, 32 nt, Human
aggagaagauaccuucucacacccuaccuccu

SEQ ID NO: 320505 - RNA, 32 nt, Human
aggagaagaugugggagcaggaagugaggcug

SEQ ID NO: 320506 - RNA, 32 nt, Human
aggagaagcaauagcagcaggaguccccagca

SEQ ID NO: 320507 - RNA, 32 nt, Human
aggagaagcagcaaggaauugagccuuguaca

SEQ ID NO: 320508 - RNA, 32 nt, Human
aggagaagcccaugaagagaugguggauucuc

SEQ ID NO: 320509 - RNA, 32 nt, Human
aggagaagcucugcuuucuuucucuccaacuu

SEQ ID NO: 320510 - RNA, 32 nt, Human
aggagaagcugcauccagaggcaaacggaggc

SEQ ID NO: 320511 - RNA, 32 nt, Human
aggagaaggaagaagagagaaggagaaggaag

SEQ ID NO: 320512 - RNA, 32 nt, Human
aggagaaggaagcaaggcagcuugcaaggcca

SEQ ID NO: 320513 - RNA, 32 nt, Human
aggagaaggaagcugcagucaugcgucaucac

SEQ ID NO: 320514 - RNA, 32 nt, Human
aggagaaggaggaggagcaggagguggagauu

SEQ ID NO: 320515 - RNA, 32 nt, Human
aggagaaggaggaggaggaagagagugugaaa

SEQ ID NO: 320516 - RNA, 32 nt, Human
aggagaaggaggaggaggaagaggaggagcgc

SEQ ID NO: 320517 - RNA, 32 nt, Human
aggagaaggaggaggaggaggucggaaagugg

SEQ ID NO: 320518 - RNA, 32 nt, Human
aggagaaggaggaggaggcgaacccagagagg

SEQ ID NO: 320519 - RNA, 32 nt, Human
aggagaaggagggagacaugagcauggcugag

SEQ ID NO: 320520 - RNA, 32 nt, Human
aggagaaggagguuuauggagcaaagaaaugg

SEQ ID NO: 320521 - RNA, 20 nt, Human
aggagaaggauccccagcca

SEQ ID NO: 320522 - RNA, 32 nt, Human
aggagaaggcagaaaugcuggggccuggaaua

SEQ ID NO: 320523 - RNA, 32 nt, Human
aggagaaggcggaguagguggggugaggcgga

SEQ ID NO: 320524 - RNA, 32 nt, Human
aggagaaggcugcaugcaagacuucucuguca

SEQ ID NO: 320525 - RNA, 32 nt, Human
aggagaagggaaagguggagggcuaaaggggc

SEQ ID NO: 320526 - RNA, 32 nt, Human
aggagaagggacgcuuuucuuccuucugccca

SEQ ID NO: 320527 - RNA, 32 nt, Human
aggagaagggagggaagagagcagaagggaag

SEQ ID NO: 320528 - RNA, 32 nt, Human
aggagaagggagggucuagaagaggcagcccu

SEQ ID NO: 320529 - RNA, 32 nt, Human
aggagaaggggcuucgaagcagccaggacucu

SEQ ID NO: 320530 - RNA, 18 nt, Human
aggagaagguugcaguga

SEQ ID NO: 320531 - RNA, 32 nt, Human
aggagaagguuguaggcauggaagagagccag

SEQ ID NO: 320532 - RNA, 32 nt, Human
aggagaagucucuaggggucaggaucaagccu

SEQ ID NO: 320533 - RNA, 32 nt, Human
aggagaauagcuugaacccaggagacagaggu

SEQ ID NO: 320534 - RNA, 32 nt, Human
aggagaauaguugugguauggugacuucugug

SEQ ID NO: 320535 - RNA, 32 nt, Human
aggagaauauagaaauacaugagaaucaggaa

SEQ ID NO: 320536 - RNA, 32 nt, Human
aggagaauauggaacucaggaggcggaggcug

SEQ ID NO: 320537 - RNA, 32 nt, Human
aggagaauauugccccacagggcuuagugggu

SEQ ID NO: 320538 - RNA, 32 nt, Human
aggagaaucccuugaacccgggaggcggaggu

SEQ ID NO: 320539 - RNA, 32 nt, Human
aggagaaucccuugaaccugggaggcggaggu

SEQ ID NO: 320540 - RNA, 32 nt, Human
aggagaauggccagaacccaggaggcagagcu

SEQ ID NO: 320541 - RNA, 32 nt, Human
aggagaauggcgugaacccaggaggaggagcu

SEQ ID NO: 320542 - RNA, 32 nt, Human
aggagaauggcuugaacccaggagacagaggu

SEQ ID NO: 320543 - RNA, 32 nt, Human
aggagaaugggauuuuucuuuugaggcaugca

SEQ ID NO: 320544 - RNA, 32 nt, Human
aggagaaugggcagaugcucagcuggaagcuu

SEQ ID NO: 320545 - RNA, 32 nt, Human
aggagaauggugcggagcuugcagugagccga

SEQ ID NO: 320546 - RNA, 32 nt, Human
aggagaaugguguggacccaggaggcagagcu

SEQ ID NO: 320547 - RNA, 32 nt, Human
aggagaauuaagagccucccucccucccucua

SEQ ID NO: 320548 - RNA, 16 nt, Human
aggagaauugccugaa

SEQ ID NO: 320549 - RNA, 32 nt, Human
aggagaauugccugaacccaggaagaggaggu

SEQ ID NO: 320550 - RNA, 16 nt, Human
aggagaauugccugag

SEQ ID NO: 320551 - RNA, 32 nt, Human
aggagaauugcuugaacccaggaggaggugga

SEQ ID NO: 320552 - RNA, 32 nt, Human
aggagacaacuugcaccaguuugaccuuuucu

SEQ ID NO: 320553 - RNA, 16 nt, Human
aggagacaaggaguuu

SEQ ID NO: 320554 - RNA, 32 nt, Human
aggagacaaggcagaagcaacuucuggccgac

SEQ ID NO: 320555 - RNA, 32 nt, Human
aggagacacaaugcuaaugacuccggcuccac

SEQ ID NO: 320556 - RNA, 32 nt, Human
aggagacacaucugggaccagaggaaacaaaa

SEQ ID NO: 320557 - RNA, 32 nt, Human
aggagacacuacugcccccaccccugacagcc

SEQ ID NO: 320558 - RNA, 32 nt, Human
aggagacacuaggagcuugcaggacucggagu

SEQ ID NO: 320559 - RNA, 32 nt, Human
aggagacagacucacccagcacgccuggcaag

SEQ ID NO: 320560 - RNA, 32 nt, Human
aggagacagcacaccaccaggcuccacacgug

SEQ ID NO: 320561 - RNA, 32 nt, Human
aggagacagcauggcagaaacgcacgugugug

SEQ ID NO: 320562 - RNA, 23 nt, Human
aggagacaggagucaccagggca

SEQ ID NO: 320563 - RNA, 32 nt, Human
aggagacaggugauuuacauccccuuugcugu

SEQ ID NO: 320564 - RNA, 32 nt, Human
aggagacauucugcauugaugaccuaccugac

SEQ ID NO: 320565 - RNA, 32 nt, Human
aggagacauugucuccccaguugguucugucc

SEQ ID NO: 320566 - RNA, 19 nt, Human
aggagaccaaggagaguuu

SEQ ID NO: 320567 - RNA, 17 nt, Human
aggagaccacagggauu

SEQ ID NO: 320568 - RNA, 32 nt, Human
aggagaccaguguucaugcaguuguaguaaug

SEQ ID NO: 320569 - RNA, 32 nt, Human
aggagacccagacaucccgaggaaguucccag

SEQ ID NO: 320570 - RNA, 32 nt, Human
aggagacccaggagggagcuuguggggcaggu

SEQ ID NO: 320571 - RNA, 32 nt, Human
aggagacccaggagucaacuuguuuuaauuaa

SEQ ID NO: 320572 - RNA, 32 nt, Human
aggagaccccaaauuugacaccacagaaagca

SEQ ID NO: 320573 - RNA, 32 nt, Human
aggagaccccaggcccuggaggcugcaacaua

SEQ ID NO: 320574 - RNA, 23 nt, Human
aggagaccccguugccacggggg

SEQ ID NO: 320575 - RNA, 18 nt, Human
aggagacccuggaggggc

SEQ ID NO: 320576 - RNA, 22 nt, Human
aggagaccgacguuguuaggga

SEQ ID NO: 320577 - RNA, 17 nt, Human
aggagaccuauagugac

SEQ ID NO: 320578 - RNA, 32 nt, Human
aggagaccucgaggcuucuggacuuaggaggu

SEQ ID NO: 320579 - RNA, 32 nt, Human
aggagaccugacuuagaaaauuggacaaauaa

SEQ ID NO: 320580 - RNA, 32 nt, Human
aggagaccugcaggaggcaagggcugcaacag

SEQ ID NO: 320581 - RNA, 32 nt, Human
aggagaccugggaggagaagguuggaauggcg

SEQ ID NO: 320582 - RNA, 32 nt, Human
aggagacggacgaagggagggagcaagggagg

SEQ ID NO: 320583 - RNA, 32 nt, Human
aggagacggaggcggacucggagccagggaac

SEQ ID NO: 320584 - RNA, 32 nt, Human
aggagacggaguuucacuguuguugcccaggc

SEQ ID NO: 320585 - RNA, 32 nt, Human
aggagacggccacgaagagaggaggcagugag

SEQ ID NO: 320586 - RNA, 32 nt, Human
aggagacgguaggggcaagggaagagagcuga

SEQ ID NO: 320587 - RNA, 32 nt, Human
aggagacuacaaggauaggcccaggaguaaug

SEQ ID NO: 320588 - RNA, 32 nt, Human
aggagacuauuggcauaugauuccaaggacuc

SEQ ID NO: 320589 - RNA, 19 nt, Human
aggagacucaccucugccu

SEQ ID NO: 320590 - RNA, 16 nt, Human
aggagacucagaaaca

SEQ ID NO: 320591 - RNA, 32 nt, Human
aggagacucagggccugccaguucucaccagc

SEQ ID NO: 320592 - RNA, 32 nt, Human
aggagacuccaggacacccucugaguccuuga

SEQ ID NO: 320593 - RNA, 15 nt, Human
aggagacugguagga

SEQ ID NO: 320594 - RNA, 32 nt, Human
aggagacuggugccccacagggauuaagugcc

SEQ ID NO: 320595 - RNA, 32 nt, Human
aggagacuguagucccagcuacucgggagguu

SEQ ID NO: 320596 - RNA, 32 nt, Human
aggagacuguggcgauggugaaugaagguccc

SEQ ID NO: 320597 - RNA, 32 nt, Human
aggagacuguuggcuucugcucuugggugaau

SEQ ID NO: 320598 - RNA, 16 nt, Human
aggagacuuccaggac

SEQ ID NO: 320599 - RNA, 32 nt, Human
aggagagaaagaaaaagagagugggaacagua

SEQ ID NO: 320600 - RNA, 32 nt, Human
aggagagaaagguggaaggaagggaaggagga

SEQ ID NO: 320601 - RNA, 32 nt, Human
aggagagaaauguauuugcagagagagcauga

SEQ ID NO: 320602 - RNA, 31 nt, Human
aggagagaacaauaugucaaccauuugcaug

SEQ ID NO: 320603 - RNA, 32 nt, Human
aggagagaacagugucuuggggaugcugaugg

SEQ ID NO: 320604 - RNA, 32 nt, Human
aggagagaacgcuuccucuaggggaaacaaua

SEQ ID NO: 320605 - RNA, 32 nt, Human
aggagagaagaaaggaaggaagaaaaggauaa

SEQ ID NO: 320606 - RNA, 32 nt, Human
aggagagaagaaauugaaaagcaggcacuuga

SEQ ID NO: 320607 - RNA, 32 nt, Human
aggagagaagcucugugaauguaagcauugug

SEQ ID NO: 320608 - RNA, 32 nt, Human
aggagagaaggggaguggaggaagcacgggac

SEQ ID NO: 320609 - RNA, 32 nt, Human
aggagagaccagccuggccagcauagugaaac

SEQ ID NO: 320610 - RNA, 32 nt, Human
aggagagacuggccuagccucccagccuacau

SEQ ID NO: 320611 - RNA, 32 nt, Human
aggagagagaaggaaaggagugagguauuucc

SEQ ID NO: 320612 - RNA, 32 nt, Human
aggagagagacacauucagcagccaaaggacu

SEQ ID NO: 320613 - RNA, 32 nt, Human
aggagagagacacucuccaugaacacuucucc

SEQ ID NO: 320614 - RNA, 32 nt, Human
aggagagagaggcaauggcuccuucacaaacc

SEQ ID NO: 320615 - RNA, 32 nt, Human
aggagagagagugaacagggagcggggcuuuu

SEQ ID NO: 320616 - RNA, 32 nt, Human
aggagagagauggauucccaagggaugaaagg

SEQ ID NO: 320617 - RNA, 20 nt, Human
aggagagaggaagaggagca

SEQ ID NO: 320618 - RNA, 32 nt, Human
aggagagaggagaaaugcuggaaaggucgaca

SEQ ID NO: 320619 - RNA, 32 nt, Human
aggagagaggaggaggaggaggcugagagagg

SEQ ID NO: 320620 - RNA, 32 nt, Human
aggagagaggcaggccaugccagcaguguggg

SEQ ID NO: 320621 - RNA, 32 nt, Human
aggagagaggcgggaggaagaaguaacaagag

SEQ ID NO: 320622 - RNA, 32 nt, Human
aggagagagggagggcggagggcggaggggcg

SEQ ID NO: 320623 - RNA, 32 nt, Human
aggagagagggcacaucuccagaaaaaugaaa

SEQ ID NO: 320624 - RNA, 32 nt, Human
aggagagaugcuggaggugggggugcuguguu

SEQ ID NO: 320625 - RNA, 32 nt, Human
aggagagauggccaggguggcagcccucaugc

SEQ ID NO: 320626 - RNA, 32 nt, Human
aggagagcaaaugucacaaaagacugagcaau

SEQ ID NO: 320627 - RNA, 32 nt, Human
aggagagcaagucccuguugggguaaugcagg

SEQ ID NO: 320628 - RNA, 32 nt, Human
aggagagcaccaggacgaggaugggaagcgac

SEQ ID NO: 320629 - RNA, 32 nt, Human
aggagagcagguuucagauccuuacuugccga

SEQ ID NO: 320630 - RNA, 32 nt, Human
aggagagccaggccugcccugcccugcuggcu

SEQ ID NO: 320631 - RNA, 32 nt, Human
aggagagcccucugcugcuuuccaacacacaa

SEQ ID NO: 320632 - RNA, 32 nt, Human
aggagagccuccauccugucuucauccucaag

SEQ ID NO: 320633 - RNA, 32 nt, Human
aggagagccugugaguuugaggcugcaaugag

SEQ ID NO: 320634 - RNA, 32 nt, Human
aggagagccuuggcccaagucuggaccaauga

SEQ ID NO: 320635 - RNA, 32 nt, Human
aggagagcgagagagagugaggacaccgaacu

SEQ ID NO: 320636 - RNA, 20 nt, Human
aggagagcgcggcccaccca

SEQ ID NO: 320637 - RNA, 32 nt, Human
aggagagcggcuggcaguccugccuggugccc

SEQ ID NO: 320638 - RNA, 32 nt, Human
aggagagcgggccgccccacagcccgagccgg

SEQ ID NO: 320639 - RNA, 32 nt, Human
aggagagcucgccgggcucugaggcgcaggaa

SEQ ID NO: 320640 - RNA, 18 nt, Human
aggagagcucuucuucaa

SEQ ID NO: 320641 - RNA, 32 nt, Human
aggagagcugcgagcccagcugcugagcaggg

SEQ ID NO: 320642 - RNA, 32 nt, Human
aggagagcuugugggagccaaggagcaccuug

SEQ ID NO: 320643 - RNA, 32 nt, Human
aggagaggaaaagguguaggccugccuuaccg

SEQ ID NO: 320644 - RNA, 32 nt, Human
aggagaggaagagagaccugcccuguagcgug

SEQ ID NO: 320645 - RNA, 32 nt, Human
aggagaggaagaggaggaagacagugggaguc

SEQ ID NO: 320646 - RNA, 32 nt, Human
aggagaggaagugggagaaggaaggggaggac

SEQ ID NO: 320647 - RNA, 32 nt, Human
aggagaggagaaagggaggaagcugggcugug

SEQ ID NO: 320648 - RNA, 32 nt, Human
aggagaggagagggaggauccuggaggacugg

SEQ ID NO: 320649 - RNA, 32 nt, Human
aggagaggagcguggggucagcuccagcaggg

SEQ ID NO: 320650 - RNA, 32 nt, Human
aggagaggagcugccuuuccacccccuucaag

SEQ ID NO: 320651 - RNA, 32 nt, Human
aggagaggaggagaaagccagguugauguuag

SEQ ID NO: 320652 - RNA, 32 nt, Human
aggagaggagggaggaagagcugggcgagagg

SEQ ID NO: 320653 - RNA, 32 nt, Human
aggagaggagucaggccgcgacugugcaggag

SEQ ID NO: 320654 - RNA, 32 nt, Human
aggagaggcaagaaaauuaugcuguccauaga

SEQ ID NO: 320655 - RNA, 32 nt, Human
aggagaggcaccugacauauguucucuaggcc

SEQ ID NO: 320656 - RNA, 32 nt, Human
aggagaggccagggaggguucuccccacgaca

SEQ ID NO: 320657 - RNA, 32 nt, Human
aggagaggccaugaaagaaccuguccuucugg

SEQ ID NO: 320658 - RNA, 32 nt, Human
aggagaggccucgggaugucucuggcagauga

SEQ ID NO: 320659 - RNA, 32 nt, Human
aggagaggcuacgugaacaggagaagcugcca

SEQ ID NO: 320660 - RNA, 32 nt, Human
aggagaggcucugaaagcugcuucugggggau

SEQ ID NO: 320661 - RNA, 32 nt, Human
aggagaggcugcaggaacaggagaggcugcug

SEQ ID NO: 320662 - RNA, 32 nt, Human
aggagaggcugcuggagagggagaggcugcug

SEQ ID NO: 320663 - RNA, 32 nt, Human
aggagaggcuguaggcugugccugucgccccc

SEQ ID NO: 320664 - RNA, 32 nt, Human
aggagaggcugugugaacaggagaagcugcca

SEQ ID NO: 320665 - RNA, 32 nt, Human
aggagaggcuucaggagcaggaugagaggcug

SEQ ID NO: 320666 - RNA, 32 nt, Human
aggagagggaagagguagaggaugagaggaug

SEQ ID NO: 320667 - RNA, 32 nt, Human
aggagagggagaaaggcccgagccccugccuu

SEQ ID NO: 320668 - RNA, 32 nt, Human
aggagagggagaaagggaagucccagggcccg

SEQ ID NO: 320669 - RNA, 32 nt, Human
aggagagggaggucacggcguaaaggugcagc

SEQ ID NO: 320670 - RNA, 32 nt, Human
aggagagggcaauagagggaagacugaggcug

SEQ ID NO: 320671 - RNA, 32 nt, Human
aggagagggccuggggcucuugcuucccgaga

SEQ ID NO: 320672 - RNA, 32 nt, Human
aggagagggccugugggcuugcuuuuggaagg

SEQ ID NO: 320673 - RNA, 32 nt, Human
aggagagggcuggggcgcuccgcugagccacu

SEQ ID NO: 320674 - RNA, 32 nt, Human
aggagagggggaggaaaaggagagggaagagg

SEQ ID NO: 320675 - RNA, 32 nt, Human
aggagagggucugaggggugggauggggguca

SEQ ID NO: 320676 - RNA, 32 nt, Human
aggagagggugaggaagaaagagaggaauacu

SEQ ID NO: 320677 - RNA, 32 nt, Human
aggagaggguuucuuuuuaagguaucuucuug

SEQ ID NO: 320678 - RNA, 32 nt, Human
aggagagguaugagcagccucucaccugugag

SEQ ID NO: 320679 - RNA, 32 nt, Human
aggagagguggauggcaugagcagcaaggggg

SEQ ID NO: 320680 - RNA, 32 nt, Human
aggagagguucagaggacaggaggagccuccc

SEQ ID NO: 320681 - RNA, 32 nt, Human
aggagaguaaaggagagcaggagcaauuggcu

SEQ ID NO: 320682 - RNA, 32 nt, Human
aggagaguacuguggcuuagaggaaagaaaug

SEQ ID NO: 320683 - RNA, 32 nt, Human
aggagagugaaagucagccugccccucucacg

SEQ ID NO: 320684 - RNA, 24 nt, Human
aggagagugaugauggagcauaua

SEQ ID NO: 320685 - RNA, 24 nt, Human
aggagagugaugauucugugaaua

SEQ ID NO: 320686 - RNA, 17 nt, Human
aggagagugauggggag

SEQ ID NO: 320687 - RNA, 32 nt, Human
aggagagugauugauuuucuuccuccaauagu

SEQ ID NO: 320688 - RNA, 20 nt, Human
aggagaguggugggggccug

SEQ ID NO: 320689 - RNA, 32 nt, Human
aggagauaccagcagagagggaguaggagaga

SEQ ID NO: 320690 - RNA, 32 nt, Human
aggagauauggaaggcagaagugaagaaagca

SEQ ID NO: 320691 - RNA, 32 nt, Human
aggagauauugcuaggaaucucuaggcuguua

SEQ ID NO: 320692 - RNA, 32 nt, Human
aggagaucaaaaccauccuggcuaacauggug

SEQ ID NO: 320693 - RNA, 32 nt, Human
aggagaucaagaccagccuggccaacauagug

SEQ ID NO: 320694 - RNA, 32 nt, Human
aggagaucacacacuaagagaacguugauugc

SEQ ID NO: 320695 - RNA, 32 nt, Human
aggagaucacaccucuguccagccugcaccgg

SEQ ID NO: 320696 - RNA, 22 nt, Human
aggagaucagcaggacgcugcg

SEQ ID NO: 320697 - RNA, 32 nt, Human
aggagauccuccugcaggagcuggagccgguc

SEQ ID NO: 320698 - RNA, 32 nt, Human
aggagaucgagaccagccugaccaacauggug

SEQ ID NO: 320699 - RNA, 32 nt, Human
aggagaucgagaccagccuggccaacauggcg

SEQ ID NO: 320700 - RNA, 32 nt, Human
aggagaucgagaccagccuggcuaacacagug

SEQ ID NO: 320701 - RNA, 32 nt, Human
aggagaucgagaccagccuggcuaacacggug

SEQ ID NO: 320702 - RNA, 32 nt, Human
aggagaucugucagcugcuuaauuauugaaac

SEQ ID NO: 320703 - RNA, 32 nt, Human
aggagaucugucucccugugccuggagaguua

SEQ ID NO: 320704 - RNA, 32 nt, Human
aggagaucuuguuaccuccucaucuacaugug

SEQ ID NO: 320705 - RNA, 32 nt, Human
aggagaucuuuccuuguggugguuucugugag

SEQ ID NO: 320706 - RNA, 18 nt, Human
aggagaugcccaaagcca

SEQ ID NO: 320707 - RNA, 32 nt, Human
aggagaugcccagguucagguguaucgugcau

SEQ ID NO: 320708 - RNA, 21 nt, Human
aggagaugccuggccucguua

SEQ ID NO: 320709 - RNA, 32 nt, Human
aggagaugcucaauagauguuuguugaaugaa

SEQ ID NO: 320710 - RNA, 32 nt, Human
aggagauggaaagaaaaagaagaaaaagaagg

SEQ ID NO: 320711 - RNA, 32 nt, Human
aggagauggaaaugacuucaaggaagacuccg

SEQ ID NO: 320712 - RNA, 32 nt, Human
aggagauggaguuucacugugucagccaggau

SEQ ID NO: 320713 - RNA, 32 nt, Human
aggagauggcaggacacagcaaacaggacaca

SEQ ID NO: 320714 - RNA, 24 nt, Human
aggagaugggguuuugccauguug

SEQ ID NO: 320715 - RNA, 32 nt, Human
aggagaugguaaguucaagaagacugauugca

SEQ ID NO: 320716 - RNA, 32 nt, Human
aggagaugucagcugagcucauucuggggcag

SEQ ID NO: 320717 - RNA, 32 nt, Human
aggagauguccagccaaugaugcccggcuucu

SEQ ID NO: 320718 - RNA, 32 nt, Human
aggagauguccaggcugaagguggugauuuga

SEQ ID NO: 320719 - RNA, 32 nt, Human
aggagaugugugagcaauuucuguaccuucua

SEQ ID NO: 320720 - RNA, 32 nt, Human
aggagauuaggucacagacaugugcgauuaca

SEQ ID NO: 320721 - RNA, 32 nt, Human
aggagauuaucgcauagaguucagagacugga

SEQ ID NO: 320722 - RNA, 32 nt, Human
aggagauucaggcagacugguggcaguggagu

SEQ ID NO: 320723 - RNA, 32 nt, Human
aggagauucccccaaacaacaauauuuaauuu

SEQ ID NO: 320724 - RNA, 32 nt, Human
aggagauugagaccagccuggccaacauggug

SEQ ID NO: 320725 - RNA, 32 nt, Human
aggagauugagaccagccugggcaacauagua

SEQ ID NO: 320726 - RNA, 32 nt, Human
aggagauugcccaggaucaagggugcgguguu

SEQ ID NO: 320727 - RNA, 32 nt, Human
aggagauugggaaccuagagcuugccugggau

SEQ ID NO: 320728 - RNA, 32 nt, Human
aggagcaaaagaugcuccauggcacaggacaa

SEQ ID NO: 320729 - RNA, 18 nt, Human
aggagcaaaaugaagcau

SEQ ID NO: 320730 - RNA, 32 nt, Human
aggagcaaacuugcaucugucugaccucaaag

SEQ ID NO: 320731 - RNA, 32 nt, Human
aggagcaaaggcugagaacacugugaaaacau

SEQ ID NO: 320732 - RNA, 32 nt, Human
aggagcaacaucaccuguguagucugguuccu

SEQ ID NO: 320733 - RNA, 17 nt, Human
aggagcaacccagaagc

SEQ ID NO: 320734 - RNA, 32 nt, Human
aggagcaagagcuucagccugaagacaaggga

SEQ ID NO: 320735 - RNA, 20 nt, Human
aggagcaagccaggaagcca

SEQ ID NO: 320736 - RNA, 32 nt, Human
aggagcaaugaccauugugcacaugcgugugg

SEQ ID NO: 320737 - RNA, 21 nt, Human
aggagcaauggcaccugggca

SEQ ID NO: 320738 - RNA, 32 nt, Human
aggagcaauugaagaaagggaggagccagauu

SEQ ID NO: 320739 - RNA, 32 nt, Human
aggagcacaagccacaagucuuccagaggaug

SEQ ID NO: 320740 - RNA, 18 nt, Human
aggagcacaccgaggcca

SEQ ID NO: 320741 - RNA, 15 nt, Human
aggagcacagaauuu

SEQ ID NO: 320742 - RNA, 32 nt, Human
aggagcacagccacaucugccucuggcugccu

SEQ ID NO: 320743 - RNA, 23 nt, Human
aggagcacagcggcccgcccucu

SEQ ID NO: 320744 - RNA, 32 nt, Human
aggagcacaggcaccagcucugacgggaguga

SEQ ID NO: 320745 - RNA, 32 nt, Human
aggagcacaggcaggucccagcucaggugagc

SEQ ID NO: 320746 - RNA, 32 nt, Human
aggagcacccagugccccaggccuugcacugu

SEQ ID NO: 320747 - RNA, 32 nt, Human
aggagcaccgccgcggacuccagcacaccgag

SEQ ID NO: 320748 - RNA, 32 nt, Human
aggagcaccggcugccccucuggguggcacua

SEQ ID NO: 320749 - RNA, 21 nt, Human
aggagcaccugguucuucucu

SEQ ID NO: 320750 - RNA, 32 nt, Human
aggagcacggcucuguccccagccugggaaag

SEQ ID NO: 320751 - RNA, 32 nt, Human
aggagcacugccucagccuuugcacaugguaa

SEQ ID NO: 320752 - RNA, 32 nt, Human
aggagcacugccuuucaguggaccgggugggg

SEQ ID NO: 320753 - RNA, 32 nt, Human
aggagcacugugagagaaaucacaaaguauua

SEQ ID NO: 320754 - RNA, 21 nt, Human
aggagcagaaggcagaggcca

SEQ ID NO: 320755 - RNA, 32 nt, Human
aggagcagaaggcaucuucucacugugcugca

SEQ ID NO: 320756 - RNA, 16 nt, Human
aggagcagaauaggac

SEQ ID NO: 320757 - RNA, 32 nt, Human
aggagcagaauccaguucaggcgcccaucucc

SEQ ID NO: 320758 - RNA, 32 nt, Human
aggagcagagaaaggaggccaagagcuggauc

SEQ ID NO: 320759 - RNA, 19 nt, Human
aggagcagaggccagacca

SEQ ID NO: 320760 - RNA, 32 nt, Human
aggagcagauggcagaaacagagagaaacgac

SEQ ID NO: 320761 - RNA, 21 nt, Human
aggagcagcacaggcagaggc

SEQ ID NO: 320762 - RNA, 32 nt, Human
aggagcagcaggaccccggaaaccacuggagg

SEQ ID NO: 320763 - RNA, 20 nt, Human
aggagcagccagcuguggca

SEQ ID NO: 320764 - RNA, 20 nt, Human
aggagcagcuucaggagcca

SEQ ID NO: 320765 - RNA, 30 nt, Human
aggagcagcuugcaaggggagccgguggag

SEQ ID NO: 320766 - RNA, 32 nt, Human
aggagcaggaaggggaaggaggccugggaccc

SEQ ID NO: 320767 - RNA, 32 nt, Human
aggagcaggagaaggagcaggucaugcucgug

SEQ ID NO: 320768 - RNA, 32 nt, Human
aggagcaggagagaaaggaggguggguggucu

SEQ ID NO: 320769 - RNA, 32 nt, Human
aggagcaggauguccuuccagggcaagaaaag

SEQ ID NO: 320770 - RNA, 32 nt, Human
aggagcaggcaacugaaccccagccuggaccc

SEQ ID NO: 320771 - RNA, 18 nt, Human
aggagcagggagaggcca

SEQ ID NO: 320772 - RNA, 32 nt, Human
aggagcagggaggagggggagcaggggcccuc

SEQ ID NO: 320773 - RNA, 32 nt, Human
aggagcagggcaacagcaccugccccacccug

SEQ ID NO: 320774 - RNA, 32 nt, Human
aggagcaggggugggaggcagguggacuccug

SEQ ID NO: 320775 - RNA, 32 nt, Human
aggagcaguacaccgagcgccuccaggccagc

SEQ ID NO: 320776 - RNA, 32 nt, Human
aggagcaguaugugcugauugccaaacagauc

SEQ ID NO: 320777 - RNA, 32 nt, Human
aggagcagugacccugcugccucccagagcca

SEQ ID NO: 320778 - RNA, 32 nt, Human
aggagcagugccugugucagccauggggcccu

SEQ ID NO: 320779 - RNA, 32 nt, Human
aggagcauaacuuggaauguacaggaauauuu

SEQ ID NO: 320780 - RNA, 32 nt, Human
aggagcauaccccaaaccagacauaugcuuag

SEQ ID NO: 320781 - RNA, 32 nt, Human
aggagcaucaccagcuccucagagccacuccg

SEQ ID NO: 320782 - RNA, 32 nt, Human
aggagcaucacuaugccugugugaaaguauau

SEQ ID NO: 320783 - RNA, 32 nt, Human
aggagcauccaccuccuucucugucucaugug

SEQ ID NO: 320784 - RNA, 24 nt, Human
aggagcauccgugaugcucagugu

SEQ ID NO: 320785 - RNA, 32 nt, Human
aggagcaucugugauuuguccucugcuuaugg

SEQ ID NO: 320786 - RNA, 20 nt, Human
aggagcaugcgcagaggcca

SEQ ID NO: 320787 - RNA, 32 nt, Human
aggagcauuaagccaggcucuagcuagagccc

SEQ ID NO: 320788 - RNA, 32 nt, Human
aggagcauuagccuggugugguggcucaugcc

SEQ ID NO: 320789 - RNA, 16 nt, Human
aggagcauugcuugaa

SEQ ID NO: 320790 - RNA, 21 nt, Human
aggagcauuucuggggggcag

SEQ ID NO: 320791 - RNA, 32 nt, Human
aggagccaacaguaaugucuuucuggaaacau

SEQ ID NO: 320792 - RNA, 20 nt, Human
aggagccaagaacuggcggg

SEQ ID NO: 320793 - RNA, 15 nt, Human
aggagccaauaggac

SEQ ID NO: 320794 - RNA, 32 nt, Human
aggagccacacagacucuucugagcccccuca

SEQ ID NO: 320795 - RNA, 32 nt, Human
aggagccacccaggugauuccaaugauaggug

SEQ ID NO: 320796 - RNA, 32 nt, Human
aggagccaccuugccacccauucuucccguuc

SEQ ID NO: 320797 - RNA, 19 nt, Human
aggagccacgugacacugc

SEQ ID NO: 320798 - RNA, 32 nt, Human
aggagccacugcacuccagccugggugacaga

SEQ ID NO: 320799 - RNA, 32 nt, Human
aggagccacugcucagugcacuucucccuucc

SEQ ID NO: 320800 - RNA, 16 nt, Human
aggagccacuguggca

SEQ ID NO: 320801 - RNA, 32 nt, Human
aggagccagaagccccggagauguaacgcccc

SEQ ID NO: 320802 - RNA, 32 nt, Human
aggagccagaaguaaggacugaaggagaaggg

SEQ ID NO: 320803 - RNA, 22 nt, Human
aggagccagaggaaccagggca

SEQ ID NO: 320804 - RNA, 32 nt, Human
aggagccagaguugaugagcagaucuguggaa

SEQ ID NO: 320805 - RNA, 32 nt, Human
aggagccagcacucagggcucucugccuucua

SEQ ID NO: 320806 - RNA, 32 nt, Human
aggagccagccuugugagugccaagucccccu

SEQ ID NO: 320807 - RNA, 18 nt, Human
aggagccagcgcugggca

SEQ ID NO: 320808 - RNA, 32 nt, Human
aggagccagcggccgacaaagcagaaacaccc

SEQ ID NO: 320809 - RNA, 21 nt, Human
aggagccagcggugggcagcg

SEQ ID NO: 320810 - RNA, 32 nt, Human
aggagccaggaagagagcugugaccagcagcg

SEQ ID NO: 320811 - RNA, 32 nt, Human
aggagccaggagaguagcuacaaugacuucac

SEQ ID NO: 320812 - RNA, 32 nt, Human
aggagccaggcagaguccagggauucuuggaa

SEQ ID NO: 320813 - RNA, 24 nt, Human
aggagccaggcugcccagaaacgu

SEQ ID NO: 320814 - RNA, 32 nt, Human
aggagccagugcaaaggccccgagguggcagu

SEQ ID NO: 320815 - RNA, 21 nt, Human
aggagccauaugccugggcug

SEQ ID NO: 320816 - RNA, 32 nt, Human
aggagccaucgcugugggaggcagcaggcccc

SEQ ID NO: 320817 - RNA, 32 nt, Human
aggagcccaacacauggugaccugagcaaaca

SEQ ID NO: 320818 - RNA, 20 nt, Human
aggagcccacuucuguggca

SEQ ID NO: 320819 - RNA, 32 nt, Human
aggagcccagaagagacacugaggacaagaga

SEQ ID NO: 320820 - RNA, 32 nt, Human
aggagcccagacaaagcccaggccugucaaga

SEQ ID NO: 320821 - RNA, 22 nt, Human
aggagcccaugcagacacuggu

SEQ ID NO: 320822 - RNA, 32 nt, Human
aggagccccaccucagcaucacugccuuaauc

SEQ ID NO: 320823 - RNA, 32 nt, Human
aggagccccacugcuuccagccucuggugcca

SEQ ID NO: 320824 - RNA, 32 nt, Human
aggagccccaggaagguggagcgccacaggaa

SEQ ID NO: 320825 - RNA, 32 nt, Human
aggagccccgggagggggcugcaguuuccuuc

SEQ ID NO: 320826 - RNA, 32 nt, Human
aggagccccugcccucccucccuguccugugc

SEQ ID NO: 320827 - RNA, 32 nt, Human
aggagccccuggcagaguccacgcugccucag

SEQ ID NO: 320828 - RNA, 32 nt, Human
aggagcccgcagcaaucuccacagccuccugg

SEQ ID NO: 320829 - RNA, 22 nt, Human
aggagcccgggccccgcggcgg

SEQ ID NO: 320830 - RNA, 32 nt, Human
aggagcccguagucccagcuacucaggaggcu

SEQ ID NO: 320831 - RNA, 19 nt, Human
aggagcccgugggcugcug

SEQ ID NO: 320832 - RNA, 32 nt, Human
aggagcccuaaaugucagugcagcagcccuaa

SEQ ID NO: 320833 - RNA, 32 nt, Human
aggagcccucaucugcugugcugaguccagga

SEQ ID NO: 320834 - RNA, 25 nt, Human
aggagcccuccucaccgcucuuccu

SEQ ID NO: 320835 - RNA, 32 nt, Human
aggagcccuccugccugggagcuuguucuuug

SEQ ID NO: 320836 - RNA, 32 nt, Human
aggagcccucugcaaacuacagaaggauggau

SEQ ID NO: 320837 - RNA, 17 nt, Human
aggagcccucuguggca

SEQ ID NO: 320838 - RNA, 21 nt, Human
aggagcccuggcccagagcca

SEQ ID NO: 320839 - RNA, 32 nt, Human
aggagcccuugaggaagcagucucguguccuc

SEQ ID NO: 320840 - RNA, 32 nt, Human
aggagccgacagcagagggggaagcugaaaag

SEQ ID NO: 320841 - RNA, 20 nt, Human
aggagccgaccuggggcugc

SEQ ID NO: 320842 - RNA, 24 nt, Human
aggagccgagagagcugagcagcg

SEQ ID NO: 320843 - RNA, 32 nt, Human
aggagccgagucaggcucucuccacugccugc

SEQ ID NO: 320844 - RNA, 20 nt, Human
aggagccgcgcggggcgcug

SEQ ID NO: 320845 - RNA, 32 nt, Human
aggagccgcggaggaggacagugagggaggaa

SEQ ID NO: 320846 - RNA, 22 nt, Human
aggagccgcggcgcgggcagcg

SEQ ID NO: 320847 - RNA, 31 nt, Human
aggagccgcggugaaagaugggggaugcugc

SEQ ID NO: 320848 - RNA, 22 nt, Human
aggagccgcugcugagcugcgu

SEQ ID NO: 320849 - RNA, 27 nt, Human
aggagccggaagggcacgcgggcagcg

SEQ ID NO: 320850 - RNA, 32 nt, Human
aggagccggaggaggaggaggaggaggaggca

SEQ ID NO: 320851 - RNA, 32 nt, Human
aggagccggcccaagcccagggucccugcuug

SEQ ID NO: 320852 - RNA, 24 nt, Human
aggagccggcccugcuggccacgc

SEQ ID NO: 320853 - RNA, 18 nt, Human
aggagccggccucgggca

SEQ ID NO: 320854 - RNA, 24 nt, Human
aggagccggccugcugggcagcgu

SEQ ID NO: 320855 - RNA, 32 nt, Human
aggagccgggacccaggagagggcugcuauuu

SEQ ID NO: 320856 - RNA, 32 nt, Human
aggagccgggagagccgagugggaggggccgc

SEQ ID NO: 320857 - RNA, 23 nt, Human
aggagccggguccugggcaaggc

SEQ ID NO: 320858 - RNA, 32 nt, Human
aggagccggucaccccagaguaucccuuucac

SEQ ID NO: 320859 - RNA, 19 nt, Human
aggagccucaccccugccu

SEQ ID NO: 320860 - RNA, 32 nt, Human
aggagccucagauaaguauuuguacuugagac

SEQ ID NO: 320861 - RNA, 32 nt, Human
aggagccuccagggaguucucuuugaggcugg

SEQ ID NO: 320862 - RNA, 31 nt, Human
aggagccuccuguuugggccugggucugggc

SEQ ID NO: 320863 - RNA, 32 nt, Human
aggagccuccuugugucugaugcacagaugug

SEQ ID NO: 320864 - RNA, 32 nt, Human
aggagccugagaacuccuccuccugggacucu

SEQ ID NO: 320865 - RNA, 32 nt, Human
aggagccugagccucaggcuguuggagaagca

SEQ ID NO: 320866 - RNA, 32 nt, Human
aggagccugccuggggccugccucugccagaa

SEQ ID NO: 320867 - RNA, 19 nt, Human
aggagccugcucuaaggca

SEQ ID NO: 320868 - RNA, 32 nt, Human
aggagccugcuggucacagccuccucugucug

SEQ ID NO: 320869 - RNA, 21 nt, Human
aggagccuggacuucugugca

SEQ ID NO: 320870 - RNA, 32 nt, Human
aggagccuggaugcuaaugucucuccaaagug

SEQ ID NO: 320871 - RNA, 23 nt, Human
aggagccugggaaagccagggca

SEQ ID NO: 320872 - RNA, 22 nt, Human
aggagccugggaccaggagcca

SEQ ID NO: 320873 - RNA, 18 nt, Human
aggagccugggcugagca

SEQ ID NO: 320874 - RNA, 22 nt, Human
aggagccugggcuuggaucuau

SEQ ID NO: 320875 - RNA, 32 nt, Human
aggagccugggguccccugggguggggugguc

SEQ ID NO: 320876 - RNA, 20 nt, Human
aggagccugggucugaagca

SEQ ID NO: 320877 - RNA, 32 nt, Human
aggagccugguucacaggcuuagugauggaga

SEQ ID NO: 320878 - RNA, 32 nt, Human
aggagccuguaaucccagcuacacaggaggcu

SEQ ID NO: 320879 - RNA, 32 nt, Human
aggagccuguaaucccagcuguucgggaggcu

SEQ ID NO: 320880 - RNA, 32 nt, Human
aggagccuguaauccuagcuacucaggaggcu

SEQ ID NO: 320881 - RNA, 32 nt, Human
aggagccugugcagauggccaugcccaaccaa

SEQ ID NO: 320882 - RNA, 32 nt, Human
aggagccuugcaggcuggagggcggcuggaga

SEQ ID NO: 320883 - RNA, 21 nt, Human
aggagccuugggcugggcagc

SEQ ID NO: 320884 - RNA, 32 nt, Human
aggagccuuguuucuuuugcuuccugaccuuc

SEQ ID NO: 320885 - RNA, 32 nt, Human
aggagcgagagggacgcgagcaagagagcgag

SEQ ID NO: 320886 - RNA, 32 nt, Human
aggagcgaguaggagagagggagcgagagcca

SEQ ID NO: 320887 - RNA, 32 nt, Human
aggagcgcccaguucauggaggcugcugcugu

SEQ ID NO: 320888 - RNA, 32 nt, Human
aggagcgcuaaguuguugggaggccugggucc

SEQ ID NO: 320889 - RNA, 32 nt, Human
aggagcgcuggacugugguggacagugagggc

SEQ ID NO: 320890 - RNA, 32 nt, Human
aggagcggaaggcagugggugugaccaaaagu

SEQ ID NO: 320891 - RNA, 32 nt, Human
aggagcggagggagccugguggcuggggcugg

SEQ ID NO: 320892 - RNA, 32 nt, Human
aggagcggagggcccuguuggggaagguuggg

SEQ ID NO: 320893 - RNA, 32 nt, Human
aggagcggaugcccuuuauccaguacugagga

SEQ ID NO: 320894 - RNA, 24 nt, Human
aggagcggcacaggcgccagggca

SEQ ID NO: 320895 - RNA, 21 nt, Human
aggagcggcagcggcaaggca

SEQ ID NO: 320896 - RNA, 32 nt, Human
aggagcggcaggccuugaggcugucgucgagg

SEQ ID NO: 320897 - RNA, 32 nt, Human
aggagcggccagggaggguucuccccaugaca

SEQ ID NO: 320898 - RNA, 22 nt, Human
aggagcggccgggagcccgccg

SEQ ID NO: 320899 - RNA, 23 nt, Human
aggagcggccuccacggaagcca

SEQ ID NO: 320900 - RNA, 32 nt, Human
aggagcggcggaaccucccuccccagcucuga

SEQ ID NO: 320901 - RNA, 32 nt, Human
aggagcggcugcggaagcaggagcagcacaug

SEQ ID NO: 320902 - RNA, 32 nt, Human
aggagcgggcccuguacccaccugcugaccug

SEQ ID NO: 320903 - RNA, 32 nt, Human
aggagcgggccgcggcgcugaggcggcggagc

SEQ ID NO: 320904 - RNA, 18 nt, Human
aggagcgggcgccuggga

SEQ ID NO: 320905 - RNA, 32 nt, Human
aggagcgggggugggagauagcaaggaaacac

SEQ ID NO: 320906 - RNA, 24 nt, Human
aggagcggggucugcagcagggca

SEQ ID NO: 320907 - RNA, 32 nt, Human
aggagcguacucacucagccuggucagccugg

SEQ ID NO: 320908 - RNA, 21 nt, Human
aggagcguaggcagggcagcg

SEQ ID NO: 320909 - RNA, 32 nt, Human
aggagcgucacccaagcuucagaagagaauuc

SEQ ID NO: 320910 - RNA, 32 nt, Human
aggagcgugaguugugcuguccuggcucgaga

SEQ ID NO: 320911 - RNA, 32 nt, Human
aggagcgugcgugcgucugguauagggaggac

SEQ ID NO: 320912 - RNA, 32 nt, Human
aggagcgugguggaggagcugcaggugggggc

SEQ ID NO: 320913 - RNA, 32 nt, Human
aggagcuaaggacuugcauuuucaguuuguuc

SEQ ID NO: 320914 - RNA, 32 nt, Human
aggagcuacaacugugagggggcugcuagagu

SEQ ID NO: 320915 - RNA, 32 nt, Human
aggagcuacccacuccaaggucucugcugaga

SEQ ID NO: 320916 - RNA, 32 nt, Human
aggagcuacccacuuccgguauccuugacucu

SEQ ID NO: 320917 - RNA, 32 nt, Human
aggagcuacugggcuggcgucccaggcauaga

SEQ ID NO: 320918 - RNA, 32 nt, Human
aggagcuagagaccagccuggucaacauggug

SEQ ID NO: 320919 - RNA, 32 nt, Human
aggagcuagcccagucccuggagcuguccuuc

SEQ ID NO: 320920 - RNA, 32 nt, Human
aggagcuaguuuaccagccugugacaacugag

SEQ ID NO: 320921 - RNA, 32 nt, Human
aggagcucaagaccagccugaccaacauggug

SEQ ID NO: 320922 - RNA, 32 nt, Human
aggagcucaagaccagccugaccaauauagug

SEQ ID NO: 320923 - RNA, 32 nt, Human
aggagcucaagaccagccuggacaacauggca

SEQ ID NO: 320924 - RNA, 32 nt, Human
aggagcucaagaccagccuggcuaacauggug

SEQ ID NO: 320925 - RNA, 32 nt, Human
aggagcucaagaccagccuggguaacaaagug

SEQ ID NO: 320926 - RNA, 32 nt, Human
aggagcucaagaccagccuggucaacauggug

SEQ ID NO: 320927 - RNA, 32 nt, Human
aggagcucacgcagccccuccaugggacagga

SEQ ID NO: 320928 - RNA, 32 nt, Human
aggagcucagcggucuucaggcauuuuuguaa

SEQ ID NO: 320929 - RNA, 32 nt, Human
aggagcucaggaagaagagaugcacuauaugu

SEQ ID NO: 320930 - RNA, 24 nt, Human
aggagcucaggaccagucuucucu

SEQ ID NO: 320931 - RNA, 32 nt, Human
aggagcucaggaggaggaccccaggggagagg

SEQ ID NO: 320932 - RNA, 32 nt, Human
aggagcucaggccacagacacagagaccacgg

SEQ ID NO: 320933 - RNA, 18 nt, Human
aggagcuccagacaggac

SEQ ID NO: 320934 - RNA, 32 nt, Human
aggagcuccagaccagccuggccaacauggcg

SEQ ID NO: 320935 - RNA, 32 nt, Human
aggagcuccagugcagccccaucccaggaugg

SEQ ID NO: 320936 - RNA, 32 nt, Human
aggagcucccagagagacugccuucccuacac

SEQ ID NO: 320937 - RNA, 32 nt, Human
aggagcuccgcgcggcugcagcgcgggcggga

SEQ ID NO: 320938 - RNA, 32 nt, Human
aggagcuccugcaccccuccccaaauguccau

SEQ ID NO: 320939 - RNA, 32 nt, Human
aggagcucgagaccagccuggccaacauggug

SEQ ID NO: 320940 - RNA, 32 nt, Human
aggagcucgagaccagccuggccgacauggcg

SEQ ID NO: 320941 - RNA, 32 nt, Human
aggagcucucgcuggcccagacgugggcccag

SEQ ID NO: 320942 - RNA, 32 nt, Human
aggagcucugagaacagucuccuucaacaguu

SEQ ID NO: 320943 - RNA, 32 nt, Human
aggagcucugcucuccccuccagaguuaauua

SEQ ID NO: 320944 - RNA, 32 nt, Human
aggagcucugcugggccaccucuugggcaaca

SEQ ID NO: 320945 - RNA, 32 nt, Human
aggagcucugggcucccaguucaggaugggcc

SEQ ID NO: 320946 - RNA, 32 nt, Human
aggagcucuggguacagggcagcaacccagag

SEQ ID NO: 320947 - RNA, 32 nt, Human
aggagcucuguaagucccugcuccuccucuuc

SEQ ID NO: 320948 - RNA, 32 nt, Human
aggagcugaaaagauugcaggauuaagccaga

SEQ ID NO: 320949 - RNA, 32 nt, Human
aggagcugaacuguuccaaccugaguauucug

SEQ ID NO: 320950 - RNA, 32 nt, Human
aggagcugaagagcgagaaggagcagcgccgg

SEQ ID NO: 320951 - RNA, 20 nt, Human
aggagcugaagccucuggga

SEQ ID NO: 320952 - RNA, 32 nt, Human
aggagcugaccgugccagagcuuguuuguacc

SEQ ID NO: 320953 - RNA, 32 nt, Human
aggagcugagaaaccgagucacugugaaaaga

SEQ ID NO: 320954 - RNA, 32 nt, Human
aggagcugaggaagaagacagacugaaggagc

SEQ ID NO: 320955 - RNA, 32 nt, Human
aggagcugaggcaggagaauugcuugaacccg

SEQ ID NO: 320956 - RNA, 32 nt, Human
aggagcugaggccggagaaucgcuugaaccug

SEQ ID NO: 320957 - RNA, 32 nt, Human
aggagcugagggcaccacccagcaaccugggc

SEQ ID NO: 320958 - RNA, 32 nt, Human
aggagcugaugugcccugaggcccagcugccu

SEQ ID NO: 320959 - RNA, 32 nt, Human
aggagcugcagacgacgagggagcugccucgc

SEQ ID NO: 320960 - RNA, 32 nt, Human
aggagcugcaggacugagguacagaggccagg

SEQ ID NO: 320961 - RNA, 32 nt, Human
aggagcugccucaacguagggguggguagucu

SEQ ID NO: 320962 - RNA, 32 nt, Human
aggagcugccuccagccccuuucuugcugagu

SEQ ID NO: 320963 - RNA, 32 nt, Human
aggagcugcuacugcugcuaccgaggcugugg

SEQ ID NO: 320964 - RNA, 32 nt, Human
aggagcugcucaauaaauguuuguugaacgaa

SEQ ID NO: 320965 - RNA, 32 nt, Human
aggagcugcuggcugucccuguggacccgcca

SEQ ID NO: 320966 - RNA, 32 nt, Human
aggagcugcugucaccuggaaaacacguggca

SEQ ID NO: 320967 - RNA, 22 nt, Human
aggagcugcuucucucuucucc

SEQ ID NO: 320968 - RNA, 32 nt, Human
aggagcuggaaccuguuaauggaaagcaguca

SEQ ID NO: 320969 - RNA, 20 nt, Human
aggagcuggagaagcuccac

SEQ ID NO: 320970 - RNA, 32 nt, Human
aggagcuggcuggaggcuaugggugcggggcg

SEQ ID NO: 320971 - RNA, 32 nt, Human
aggagcugggagaggcaggaaggacccucccc

SEQ ID NO: 320972 - RNA, 32 nt, Human
aggagcugggagaggcaggaaggauccucccc

SEQ ID NO: 320973 - RNA, 32 nt, Human
aggagcugggauuacaggcacccaccauccca

SEQ ID NO: 320974 - RNA, 32 nt, Human
aggagcugggauuacaggcacgcaccaccaug

SEQ ID NO: 320975 - RNA, 20 nt, Human
aggagcugggauuacaggcg

SEQ ID NO: 320976 - RNA, 32 nt, Human
aggagcugggauuacaggcgcccaccgccaug

SEQ ID NO: 320977 - RNA, 18 nt, Human
aggagcugggcccagaga

SEQ ID NO: 320978 - RNA, 32 nt, Human
aggagcugggcuggacccucccuaccugagca

SEQ ID NO: 320979 - RNA, 32 nt, Human
aggagcugggguggccccugagcuccaacggc

SEQ ID NO: 320980 - RNA, 32 nt, Human
aggagcugggucagccucugcagcugccucag

SEQ ID NO: 320981 - RNA, 32 nt, Human
aggagcugguaccauuccuucugaaacuauuc

SEQ ID NO: 320982 - RNA, 32 nt, Human
aggagcugguggagcucuucaaagggaccacg

SEQ ID NO: 320983 - RNA, 32 nt, Human
aggagcugguggugggagaaugacggcaggga

SEQ ID NO: 320984 - RNA, 32 nt, Human
aggagcuguaaacauucaccccuagacccugc

SEQ ID NO: 320985 - RNA, 32 nt, Human
aggagcugucuccucucuaccuggcuaguaag

SEQ ID NO: 320986 - RNA, 20 nt, Human
aggagcugugaagaggcuga

SEQ ID NO: 320987 - RNA, 32 nt, Human
aggagcugugcccggugccugcagccuucaua

SEQ ID NO: 320988 - RNA, 18 nt, Human
aggagcugugcugggaga

SEQ ID NO: 320989 - RNA, 32 nt, Human
aggagcugugguccagccugcgcggcgggaag

SEQ ID NO: 320990 - RNA, 32 nt, Human
aggagcuuaagaccagccugggcaacauaaua

SEQ ID NO: 320991 - RNA, 32 nt, Human
aggagcuuaagaccagccugggcaacauaaug

SEQ ID NO: 320992 - RNA, 25 nt, Human
aggagcuuagcuugucuucuuggca

SEQ ID NO: 320993 - RNA, 32 nt, Human
aggagcuuaggacaaaccucucugaugaaggu

SEQ ID NO: 320994 - RNA, 32 nt, Human
aggagcuuauggucuagugagggagacagagg

SEQ ID NO: 320995 - RNA, 32 nt, Human
aggagcuucaaaagagucaacuuugggacucu

SEQ ID NO: 320996 - RNA, 32 nt, Human
aggagcuuccuccuccaggccucagcccuguu

SEQ ID NO: 320997 - RNA, 32 nt, Human
aggagcuugaaaccagccuggccaacguggug

SEQ ID NO: 320998 - RNA, 32 nt, Human
aggagcuugagaccagccugagcaacacagca

SEQ ID NO: 320999 - RNA, 32 nt, Human
aggagcuugagaccagccugggcaacauggca

SEQ ID NO: 321000 - RNA, 32 nt, Human
aggagcuugagaccagccugggcaacauggug

SEQ ID NO: 321001 - RNA, 32 nt, Human
aggagcuuggacugcucuggcuaggaccccag

SEQ ID NO: 321002 - RNA, 32 nt, Human
aggagcuuggaggugagcacaggaagccccac

SEQ ID NO: 321003 - RNA, 32 nt, Human
aggagcuuguaccacagucuugcacauaagug

SEQ ID NO: 321004 - RNA, 32 nt, Human
aggagcuuuaaaagcauaccacuguggguugc

SEQ ID NO: 321005 - RNA, 32 nt, Human
aggagcuuuccaggauagcuuugaggauaagc

SEQ ID NO: 321006 - RNA, 32 nt, Human
aggagcuuucuggauagaggcagcagcgugug

SEQ ID NO: 321007 - RNA, 32 nt, Human
aggagcuuugcaggaaguuugcaaaagucuuu

SEQ ID NO: 321008 - RNA, 32 nt, Human
aggaggaaaagaacaggcagaacagcgaaaag

SEQ ID NO: 321009 - RNA, 32 nt, Human
aggaggaaaaggaggaagaggaggacaaaaag

SEQ ID NO: 321010 - RNA, 32 nt, Human
aggaggaaacaguaccggcuggaggccggucu

SEQ ID NO: 321011 - RNA, 21 nt, Human
aggaggaaacugugacugaac

SEQ ID NO: 321012 - RNA, 32 nt, Human
aggaggaaagaauugcuccaaaaaucugcacg

SEQ ID NO: 321013 - RNA, 32 nt, Human
aggaggaaagcugugauggggugcaggagugg

SEQ ID NO: 321014 - RNA, 32 nt, Human
aggaggaaagggacccucccaucauucauggg

SEQ ID NO: 321015 - RNA, 32 nt, Human
aggaggaaauaacagcuugcucucuccacccu

SEQ ID NO: 321016 - RNA, 32 nt, Human
aggaggaagaacagguuuaaaagggaagaaga

SEQ ID NO: 321017 - RNA, 32 nt, Human
aggaggaagaagaagaugaugacuagcaguac

SEQ ID NO: 321018 - RNA, 32 nt, Human
aggaggaagaauuggcaggcuaaagaagauga

SEQ ID NO: 321019 - RNA, 32 nt, Human
aggaggaagagacacaggaacacagauggagg

SEQ ID NO: 321020 - RNA, 32 nt, Human
aggaggaagaggagaauaaggaggagcaggag

SEQ ID NO: 321021 - RNA, 32 nt, Human
aggaggaagaggagaggaggaagcaaagaauc

SEQ ID NO: 321022 - RNA, 32 nt, Human
aggaggaagaggaggaagaaggaaagaaaaag

SEQ ID NO: 321023 - RNA, 32 nt, Human
aggaggaagaggaggaagaggaugaccugagu

SEQ ID NO: 321024 - RNA, 32 nt, Human
aggaggaagaggaggaggaagaggaggaagag

SEQ ID NO: 321025 - RNA, 32 nt, Human
aggaggaagaggaggaggacagcggcccucug

SEQ ID NO: 321026 - RNA, 32 nt, Human
aggaggaagaggaggaggaggaagaggggagc

SEQ ID NO: 321027 - RNA, 32 nt, Human
aggaggaagaggaggaggaggaagggagcacc

SEQ ID NO: 321028 - RNA, 32 nt, Human
aggaggaagagggagaagggagaguggcagag

SEQ ID NO: 321029 - RNA, 32 nt, Human
aggaggaagagggagucugagcaugagcugca

SEQ ID NO: 321030 - RNA, 32 nt, Human
aggaggaagagggagucuggcaugaguugcag

SEQ ID NO: 321031 - RNA, 32 nt, Human
aggaggaagauaagcuacuaauugaaaauggu

SEQ ID NO: 321032 - RNA, 32 nt, Human
aggaggaagaugaagacgaggaggaggcggcg

SEQ ID NO: 321033 - RNA, 32 nt, Human
aggaggaagauguccugaagucauaaugucuu

SEQ ID NO: 321034 - RNA, 32 nt, Human
aggaggaagcggaggaaggugaaguaggaccg

SEQ ID NO: 321035 - RNA, 32 nt, Human
aggaggaaggaagaagguaaaggguggauggc

SEQ ID NO: 321036 - RNA, 32 nt, Human
aggaggaaggcugaggaaugacuuggcuccag

SEQ ID NO: 321037 - RNA, 32 nt, Human
aggaggaaggcuuggcuccugucuucccagac

SEQ ID NO: 321038 - RNA, 32 nt, Human
aggaggaagggagggcagagggggcuguggcc

SEQ ID NO: 321039 - RNA, 32 nt, Human
aggaggaagggcaugagccgagcuugaggaau

SEQ ID NO: 321040 - RNA, 32 nt, Human
aggaggaagggccggccagaagaccuggaguu

SEQ ID NO: 321041 - RNA, 32 nt, Human
aggaggaauaaggggaaggaagagagagggag

SEQ ID NO: 321042 - RNA, 32 nt, Human
aggaggaauggacagaagcauccagcaugggg

SEQ ID NO: 321043 - RNA, 32 nt, Human
aggaggaauggucuucagcagagaagccguca

SEQ ID NO: 321044 - RNA, 32 nt, Human
aggaggaauucaaagaagaaagacugacagag

SEQ ID NO: 321045 - RNA, 32 nt, Human
aggaggaauucuuaaauuagcuguaauguuag

SEQ ID NO: 321046 - RNA, 32 nt, Human
aggaggaauuucagugggucucugugugugua

SEQ ID NO: 321047 - RNA, 32 nt, Human
aggaggacaagaggagcaugaaaguggacaag

SEQ ID NO: 321048 - RNA, 32 nt, Human
aggaggacaagcuguggggaccccaaacugug

SEQ ID NO: 321049 - RNA, 32 nt, Human
aggaggacacgcaggaugggcagucaugcugg

SEQ ID NO: 321050 - RNA, 32 nt, Human
aggaggacacguggagacagaggcagacugga

SEQ ID NO: 321051 - RNA, 32 nt, Human
aggaggacagaccggacacagagggacggagc

SEQ ID NO: 321052 - RNA, 32 nt, Human
aggaggacagagcagacagcagagaccaugga

SEQ ID NO: 321053 - RNA, 32 nt, Human
aggaggacaucgucaggcuggcccaggaccag

SEQ ID NO: 321054 - RNA, 32 nt, Human
aggaggaccagagacccacuggcuucugcucu

SEQ ID NO: 321055 - RNA, 15 nt, Human
aggaggacccgugcg

SEQ ID NO: 321056 - RNA, 32 nt, Human
aggaggaccgaagaggaggaggaggggagggg

SEQ ID NO: 321057 - RNA, 32 nt, Human
aggaggaccgccugcccugccugggccuuggc

SEQ ID NO: 321058 - RNA, 32 nt, Human
aggaggacgaggaggaagaggaggaggacagc

SEQ ID NO: 321059 - RNA, 32 nt, Human
aggaggacgcugugccuggccugggaccuccg

SEQ ID NO: 321060 - RNA, 32 nt, Human
aggaggacuacugucuagcaucagcuuauggg

SEQ ID NO: 321061 - RNA, 32 nt, Human
aggaggacuccaucucauucagaaagaaggcu

SEQ ID NO: 321062 - RNA, 17 nt, Human
aggaggacugagaauuu

SEQ ID NO: 321063 - RNA, 23 nt, Human
aggaggagaaacagggugaguca

SEQ ID NO: 321064 - RNA, 32 nt, Human
aggaggagaagcaggggcaggagcggugagga

SEQ ID NO: 321065 - RNA, 32 nt, Human
aggaggagaaggaggagagagaggggaagaga

SEQ ID NO: 321066 - RNA, 32 nt, Human
aggaggagaaggaggaggagcaggagguggag

SEQ ID NO: 321067 - RNA, 32 nt, Human
aggaggagacugaggagcaggauggcggccuc

SEQ ID NO: 321068 - RNA, 32 nt, Human
aggaggagagaaggaaggagaggugaucucca

SEQ ID NO: 321069 - RNA, 32 nt, Human
aggaggagagaagggagcaggaauccuccuuc

SEQ ID NO: 321070 - RNA, 32 nt, Human
aggaggagagagagcugggcucagcuucuuuu

SEQ ID NO: 321071 - RNA, 32 nt, Human
aggaggagagagaggggaagagacaaaguggg

SEQ ID NO: 321072 - RNA, 32 nt, Human
aggaggagagaggaaagagcggagcagccauu

SEQ ID NO: 321073 - RNA, 32 nt, Human
aggaggagaggcauuaugaggagcagugaccg

SEQ ID NO: 321074 - RNA, 32 nt, Human
aggaggagaggcugucucagcugcagaggggu

SEQ ID NO: 321075 - RNA, 32 nt, Human
aggaggagagggagaauucuguucucccagag

SEQ ID NO: 321076 - RNA, 32 nt, Human
aggaggagagguggauggcaaugugauuggug

SEQ ID NO: 321077 - RNA, 32 nt, Human
aggaggagagguggggacagcaagaagccaca

SEQ ID NO: 321078 - RNA, 32 nt, Human
aggaggagagugaaguagaggggugaggaagg

SEQ ID NO: 321079 - RNA, 16 nt, Human
aggaggagauagugac

SEQ ID NO: 321080 - RNA, 21 nt, Human
aggaggagauggggugacuca

SEQ ID NO: 321081 - RNA, 32 nt, Human
aggaggagauuagccauuuuccccagcuggcc

SEQ ID NO: 321082 - RNA, 32 nt, Human
aggaggagcaggaggaagagggggaggagaag

SEQ ID NO: 321083 - RNA, 32 nt, Human
aggaggagccuucuggaugccuuccaggcuug

SEQ ID NO: 321084 - RNA, 32 nt, Human
aggaggagcgggccguggaggcuucgccgccu

SEQ ID NO: 321085 - RNA, 32 nt, Human
aggaggagcugcagugcuaguccagccagcgu

SEQ ID NO: 321086 - RNA, 32 nt, Human
aggaggagcuggagcuauccuaccucaucagu

SEQ ID NO: 321087 - RNA, 32 nt, Human
aggaggagcuggccuaccugaagaagaaccac

SEQ ID NO: 321088 - RNA, 32 nt, Human
aggaggagcugugcauuccagcagguuuagag

SEQ ID NO: 321089 - RNA, 32 nt, Human
aggaggaggaaacugugguguuccuuucuucc

SEQ ID NO: 321090 - RNA, 32 nt, Human
aggaggaggaagaggaggaagaggaugaccug

SEQ ID NO: 321091 - RNA, 32 nt, Human
aggaggaggaagaggaggagcgcagucggagc

SEQ ID NO: 321092 - RNA, 32 nt, Human
aggaggaggaagagguauggcaugggaggaga

SEQ ID NO: 321093 - RNA, 32 nt, Human
aggaggaggaagagguauggcaugggaggagg

SEQ ID NO: 321094 - RNA, 32 nt, Human
aggaggaggaagagucugcagcauuuguucuc

SEQ ID NO: 321095 - RNA, 32 nt, Human
aggaggaggacugagcuuaucugacuccagag

SEQ ID NO: 321096 - RNA, 32 nt, Human
aggaggaggagaaaauucccccagauucgggc

SEQ ID NO: 321097 - RNA, 32 nt, Human
aggaggaggagaaggaggagagagaggggaag

SEQ ID NO: 321098 - RNA, 32 nt, Human
aggaggaggagaaggaggaggaggaagaggag

SEQ ID NO: 321099 - RNA, 32 nt, Human
aggaggaggagaagguggagaggaagagacgc

SEQ ID NO: 321100 - RNA, 32 nt, Human
aggaggaggagacacaguuggagcagcuccgu

SEQ ID NO: 321101 - RNA, 32 nt, Human
aggaggaggagagaggaaagagcggagcagcc

SEQ ID NO: 321102 - RNA, 32 nt, Human
aggaggaggagaggaggaggggaggagaagga

SEQ ID NO: 321103 - RNA, 32 nt, Human
aggaggaggaggaagagagugugaaacaggag

SEQ ID NO: 321104 - RNA, 32 nt, Human
aggaggaggaggacauugaugugcuuggugug

SEQ ID NO: 321105 - RNA, 32 nt, Human
aggaggaggaggagcuggaggaggaggucgac

SEQ ID NO: 321106 - RNA, 32 nt, Human
aggaggaggaggaggaagaagaaagaugguga

SEQ ID NO: 321107 - RNA, 32 nt, Human
aggaggaggaggaggaagaagagguagcggca

SEQ ID NO: 321108 - RNA, 32 nt, Human
aggaggaggaggaggaagaauaggaggaaaac

SEQ ID NO: 321109 - RNA, 32 nt, Human
aggaggaggaggaggaagaggaggagaaggua

SEQ ID NO: 321110 - RNA, 32 nt, Human
aggaggaggaggaggaagagggcaguggggaa

SEQ ID NO: 321111 - RNA, 32 nt, Human
aggaggaggaggaggaagaggggauggagcag

SEQ ID NO: 321112 - RNA, 32 nt, Human
aggaggaggaggaggaagagguggaggaggag

SEQ ID NO: 321113 - RNA, 32 nt, Human
aggaggaggaggaggaagcugaagacgaggag

SEQ ID NO: 321114 - RNA, 32 nt, Human
aggaggaggaggaggaaggggcuuggagcgac

SEQ ID NO: 321115 - RNA, 32 nt, Human
aggaggaggaggaggacaugggguuugauuuu

SEQ ID NO: 321116 - RNA, 32 nt, Human
aggaggaggaggaggagaaggaggagagagag

SEQ ID NO: 321117 - RNA, 32 nt, Human
aggaggaggaggaggagaaggaggaggaggaa

SEQ ID NO: 321118 - RNA, 32 nt, Human
aggaggaggaggaggagcaaagguguuggaga

SEQ ID NO: 321119 - RNA, 32 nt, Human
aggaggaggaggaggagcuggaggaggagguc

SEQ ID NO: 321120 - RNA, 32 nt, Human
aggaggaggaggaggaggaagaagagguagcg

SEQ ID NO: 321121 - RNA, 32 nt, Human
aggaggaggaggaggaggaagagggcaguggg

SEQ ID NO: 321122 - RNA, 32 nt, Human
aggaggaggaggaggaggaagagguggaggag

SEQ ID NO: 321123 - RNA, 32 nt, Human
aggaggaggaggaggaggaaggggcuuggagc

SEQ ID NO: 321124 - RNA, 32 nt, Human
aggaggaggaggaggaggagaaggcucugggc

SEQ ID NO: 321125 - RNA, 32 nt, Human
aggaggaggaggaggaggagaggggccucggg

SEQ ID NO: 321126 - RNA, 32 nt, Human
aggaggaggaggaggaggaggaagagggcagu

SEQ ID NO: 321127 - RNA, 32 nt, Human
aggaggaggaggaggaggaggacgcgggccug

SEQ ID NO: 321128 - RNA, 32 nt, Human
aggaggaggaggaggaggaggagagcgcgggc

SEQ ID NO: 321129 - RNA, 32 nt, Human
aggaggaggaggaggaggaggaggagagcgcg

SEQ ID NO: 321130 - RNA, 32 nt, Human
aggaggaggaggaggaggaggaggaggaggag

SEQ ID NO: 321131 - RNA, 32 nt, Human
aggaggaggaggaggaggaggaggaggaggcc

SEQ ID NO: 321132 - RNA, 32 nt, Human
aggaggaggaggaggaggaggaggaggccagg

SEQ ID NO: 321133 - RNA, 32 nt, Human
aggaggaggaggaggaggaggaggaggcggcg

SEQ ID NO: 321134 - RNA, 32 nt, Human
aggaggaggaggaggaggaggaggagggggcc

SEQ ID NO: 321135 - RNA, 32 nt, Human
aggaggaggaggaggaggaggaggagggggcg

SEQ ID NO: 321136 - RNA, 32 nt, Human
aggaggaggaggaggaggaggaggccaggucc

SEQ ID NO: 321137 - RNA, 32 nt, Human
aggaggaggaggaggaggaggagggggccgag

SEQ ID NO: 321138 - RNA, 32 nt, Human
aggaggaggaggaggaggaggagguggcggcg

SEQ ID NO: 321139 - RNA, 32 nt, Human
aggaggaggaggaggaggaggcaaaguuagag

SEQ ID NO: 321140 - RNA, 32 nt, Human
aggaggaggaggaggaggagggggccgagaag

SEQ ID NO: 321141 - RNA, 32 nt, Human
aggaggaggaggaggaggagggggcggccaug

SEQ ID NO: 321142 - RNA, 32 nt, Human
aggaggaggaggaggaggagguggcggcgaga

SEQ ID NO: 321143 - RNA, 32 nt, Human
aggaggaggaggaggaggaugaauaagaaacu

SEQ ID NO: 321144 - RNA, 32 nt, Human
aggaggaggaggaggaggcgagggcgagcgag

SEQ ID NO: 321145 - RNA, 32 nt, Human
aggaggaggaggaggagggaggaggggagaag

SEQ ID NO: 321146 - RNA, 32 nt, Human
aggaggaggaggaggagggggcggccaugggg

SEQ ID NO: 321147 - RNA, 32 nt, Human
aggaggaggaggaggagguggcggcgagaaga

SEQ ID NO: 321148 - RNA, 32 nt, Human
aggaggaggaggaggaggugguggaggaggag

SEQ ID NO: 321149 - RNA, 32 nt, Human
aggaggaggaggaggaugugaagauggcggag

SEQ ID NO: 321150 - RNA, 32 nt, Human
aggaggaggaggaggcugagagagggagggcg

SEQ ID NO: 321151 - RNA, 32 nt, Human
aggaggaggaggagguugcagugagccgagau

SEQ ID NO: 321152 - RNA, 32 nt, Human
aggaggaggaggcggaggaggcgguggagggg

SEQ ID NO: 321153 - RNA, 32 nt, Human
aggaggaggaggcggcggcggcggugggcccc

SEQ ID NO: 321154 - RNA, 32 nt, Human
aggaggaggagggaugcaagcuucgcuccucu

SEQ ID NO: 321155 - RNA, 32 nt, Human
aggaggaggagggugagagagaagcugggaga

SEQ ID NO: 321156 - RNA, 32 nt, Human
aggaggaggagguggcggcgagaagauggcga

SEQ ID NO: 321157 - RNA, 32 nt, Human
aggaggaggaggugggcagaggaaggaggguc

SEQ ID NO: 321158 - RNA, 32 nt, Human
aggaggaggcagcagcgagguccugcgguacc

SEQ ID NO: 321159 - RNA, 32 nt, Human
aggaggaggcaggagagagggaaaaagaaaag

SEQ ID NO: 321160 - RNA, 32 nt, Human
aggaggaggcaucuaccccuggccuugacgcu

SEQ ID NO: 321161 - RNA, 32 nt, Human
aggaggaggccucugcuccacccuccauuccu

SEQ ID NO: 321162 - RNA, 32 nt, Human
aggaggaggcgagggcgagcgagcccagcggg

SEQ ID NO: 321163 - RNA, 32 nt, Human
aggaggaggcgcccgccaugcccggccugcgg

SEQ ID NO: 321164 - RNA, 32 nt, Human
aggaggaggcggagguggagcuggcggagagc

SEQ ID NO: 321165 - RNA, 32 nt, Human
aggaggaggcuauggugguggaggugguggca

SEQ ID NO: 321166 - RNA, 32 nt, Human
aggaggaggcucggggacagcaggagcacggg

SEQ ID NO: 321167 - RNA, 32 nt, Human
aggaggaggcugaaagagccugagcugugccc

SEQ ID NO: 321168 - RNA, 19 nt, Human
aggaggaggcuguggauga

SEQ ID NO: 321169 - RNA, 32 nt, Human
aggaggagggccugagagccaggcuccaguuu

SEQ ID NO: 321170 - RNA, 32 nt, Human
aggaggagggcguucccaggaggagggaguga

SEQ ID NO: 321171 - RNA, 32 nt, Human
aggaggaggggaggagaaggaggaggaagcca

SEQ ID NO: 321172 - RNA, 32 nt, Human
aggaggaggggcuguccucuccgcaggcagcc

SEQ ID NO: 321173 - RNA, 32 nt, Human
aggaggagggggaggaagaggagguggagaag

SEQ ID NO: 321174 - RNA, 32 nt, Human
aggaggagguaguggccagggaagaggaggaa

SEQ ID NO: 321175 - RNA, 32 nt, Human
aggaggagguggagaucgcagugagcugagau

SEQ ID NO: 321176 - RNA, 32 nt, Human
aggaggaggugggggcuggaggugcugguagc

SEQ ID NO: 321177 - RNA, 32 nt, Human
aggaggaguaggaggaggcagggccucuccau

SEQ ID NO: 321178 - RNA, 32 nt, Human
aggaggagucugcagcccugugggcuucaaca

SEQ ID NO: 321179 - RNA, 32 nt, Human
aggaggaguucuucccuuugaaaauugcaaaa

SEQ ID NO: 321180 - RNA, 32 nt, Human
aggaggaguugcaucccagcaggcucagcucc

SEQ ID NO: 321181 - RNA, 32 nt, Human
aggaggaucacuugaggccaaaaguuugagac

SEQ ID NO: 321182 - RNA, 32 nt, Human
aggaggaucacuugaguccaggaguuugaaac

SEQ ID NO: 321183 - RNA, 20 nt, Human
aggaggaucgcuugaggcca

SEQ ID NO: 321184 - RNA, 19 nt, Human
aggaggaugaguccuggga

SEQ ID NO: 321185 - RNA, 32 nt, Human
aggaggaugcugggugaccaaagcuuuugaag

SEQ ID NO: 321186 - RNA, 22 nt, Human
aggaggaugggcucgcccacca

SEQ ID NO: 321187 - RNA, 32 nt, Human
aggaggaugggcuguaggggcccugaggaggu

SEQ ID NO: 321188 - RNA, 32 nt, Human
aggaggauggggaccaggaaggcuguggaccc

SEQ ID NO: 321189 - RNA, 21 nt, Human
aggaggaugguuguguaguca

SEQ ID NO: 321190 - RNA, 32 nt, Human
aggaggauuccuccuccccagaauaagacaag

SEQ ID NO: 321191 - RNA, 32 nt, Human
aggaggauucugccuuuccuccagugccauga

SEQ ID NO: 321192 - RNA, 32 nt, Human
aggaggauuggaaaggaggaguaaaggauucu

SEQ ID NO: 321193 - RNA, 17 nt, Human
aggaggcaaaagaauuu

SEQ ID NO: 321194 - RNA, 32 nt, Human
aggaggcaaaggcaggagaguugcuugaacug

SEQ ID NO: 321195 - RNA, 32 nt, Human
aggaggcaaaggggagagaggcuuccaagggg

SEQ ID NO: 321196 - RNA, 17 nt, Human
aggaggcaaaguaauuu

SEQ ID NO: 321197 - RNA, 32 nt, Human
aggaggcaaagucaccaaugcagggagguaaa

SEQ ID NO: 321198 - RNA, 17 nt, Human
aggaggcaacuguggca

SEQ ID NO: 321199 - RNA, 22 nt, Human
aggaggcaaugccaggaagcug

SEQ ID NO: 321200 - RNA, 32 nt, Human
aggaggcaccaaugcucugaggcugucgcgug

SEQ ID NO: 321201 - RNA, 32 nt, Human
aggaggcaccacugucacuggccaagggcugg

SEQ ID NO: 321202 - RNA, 32 nt, Human
aggaggcaccaugcaggagcugcaucugcucu

SEQ ID NO: 321203 - RNA, 32 nt, Human
aggaggcaccugggagcugagcuuaagaguua

SEQ ID NO: 321204 - RNA, 32 nt, Human
aggaggcacugggcucagccugggcauuaaag

SEQ ID NO: 321205 - RNA, 19 nt, Human
aggaggcagacgcccugcg

SEQ ID NO: 321206 - RNA, 32 nt, Human
aggaggcagagaagaaagaacggaagaagaga

SEQ ID NO: 321207 - RNA, 32 nt, Human
aggaggcagaggagcagauggagcagcugcug

SEQ ID NO: 321208 - RNA, 32 nt, Human
aggaggcagaggcugcagugagccgagaucgu

SEQ ID NO: 321209 - RNA, 32 nt, Human
aggaggcagagguugcagugagccaaaauugc

SEQ ID NO: 321210 - RNA, 32 nt, Human
aggaggcagaucuuuccaagguggaaagguaa

SEQ ID NO: 321211 - RNA, 32 nt, Human
aggaggcagcagaaccccaugggcuguuuugg

SEQ ID NO: 321212 - RNA, 32 nt, Human
aggaggcagcagccagaugagaaauugagucu

SEQ ID NO: 321213 - RNA, 32 nt, Human
aggaggcagcagcggcggaggacgaggaucuc

SEQ ID NO: 321214 - RNA, 32 nt, Human
aggaggcagccccuaggagcacgcacguucug

SEQ ID NO: 321215 - RNA, 32 nt, Human
aggaggcagcgcccaucucagcagcaccagga

SEQ ID NO: 321216 - RNA, 32 nt, Human
aggaggcagcuggguugcauggagagguccag

SEQ ID NO: 321217 - RNA, 32 nt, Human
aggaggcaggaaaaugugacccagaugggggu

SEQ ID NO: 321218 - RNA, 22 nt, Human
aggaggcaggaccuucgggcug

SEQ ID NO: 321219 - RNA, 32 nt, Human
aggaggcaggcccugcccugcccucuccucac

SEQ ID NO: 321220 - RNA, 32 nt, Human
aggaggcagggaggugagaggaagcacagggg

SEQ ID NO: 321221 - RNA, 32 nt, Human
aggaggcaggugcaccgggaaaaugugucuga

SEQ ID NO: 321222 - RNA, 32 nt, Human
aggaggcagguggggagggaacccgaggaccc

SEQ ID NO: 321223 - RNA, 32 nt, Human
aggaggcagugcagggcauucuggacccggag

SEQ ID NO: 321224 - RNA, 32 nt, Human
aggaggcaugucgggccccaggccuguggugc

SEQ ID NO: 321225 - RNA, 32 nt, Human
aggaggccaaccagcccgacagugccaucccc

SEQ ID NO: 321226 - RNA, 32 nt, Human
aggaggccaagccugaaaacagaggggaggga

SEQ ID NO: 321227 - RNA, 32 nt, Human
aggaggccaccaaccagacggugcugauccgc

SEQ ID NO: 321228 - RNA, 32 nt, Human
aggaggccaccugcagccuccacccggcucuc

SEQ ID NO: 321229 - RNA, 32 nt, Human
aggaggccagagaggaguauugcucaaugcgu

SEQ ID NO: 321230 - RNA, 32 nt, Human
aggaggccagggaggcaggggaggcaggagag

SEQ ID NO: 321231 - RNA, 32 nt, Human
aggaggccagggaggcaguggaggcaggagag

SEQ ID NO: 321232 - RNA, 32 nt, Human
aggaggccaguucugaaaggcgagcagaacuc

SEQ ID NO: 321233 - RNA, 32 nt, Human
aggaggcccagccuguguggcccugugaccug

SEQ ID NO: 321234 - RNA, 32 nt, Human
aggaggcccaggaguagaggcugcagcgcccg

SEQ ID NO: 321235 - RNA, 32 nt, Human
aggaggcccaggcuggagugagguggcacgau

SEQ ID NO: 321236 - RNA, 18 nt, Human
aggaggcccagggaacug

SEQ ID NO: 321237 - RNA, 32 nt, Human
aggaggcccaguuaaagcggcucgaggugaca

SEQ ID NO: 321238 - RNA, 32 nt, Human
aggaggcccgggagguggcugagggguccagg

SEQ ID NO: 321239 - RNA, 32 nt, Human
aggaggcccgggggcuccggcugagugaccug

SEQ ID NO: 321240 - RNA, 32 nt, Human
aggaggcccguggaacuuggagggcucugugu

SEQ ID NO: 321241 - RNA, 32 nt, Human
aggaggcccuccauuccugguuucuguagcuu

SEQ ID NO: 321242 - RNA, 32 nt, Human
aggaggcccugaccguggaaggggagaggaac

SEQ ID NO: 321243 - RNA, 32 nt, Human
aggaggcccuggaauaaggaagaggcuucuuu

SEQ ID NO: 321244 - RNA, 32 nt, Human
aggaggcccuggagggcuggacgggcuuccug

SEQ ID NO: 321245 - RNA, 20 nt, Human
aggaggcccugucccagcca

SEQ ID NO: 321246 - RNA, 32 nt, Human
aggaggcccuuaagggaagcuacugaauuaua

SEQ ID NO: 321247 - RNA, 22 nt, Human
aggaggccgaggcgccggagca

SEQ ID NO: 321248 - RNA, 32 nt, Human
aggaggccgccccagaggcaggagacugaccg

SEQ ID NO: 321249 - RNA, 32 nt, Human
aggaggccgugugaagacagaggcagagauug

SEQ ID NO: 321250 - RNA, 32 nt, Human
aggaggccuccaggggcaccuccagccaggcu

SEQ ID NO: 321251 - RNA, 20 nt, Human
aggaggccuccccaccuacc

SEQ ID NO: 321252 - RNA, 32 nt, Human
aggaggccuggguguccugcaaguggagcagc

SEQ ID NO: 321253 - RNA, 32 nt, Human
aggaggccuggugucuggucuuggagucaaga

SEQ ID NO: 321254 - RNA, 32 nt, Human
aggaggccugugagagcugccucugccucagu

SEQ ID NO: 321255 - RNA, 32 nt, Human
aggaggccuucaaccagacccuguccaugccc

SEQ ID NO: 321256 - RNA, 32 nt, Human
aggaggccuucacccucugcucugguucauug

SEQ ID NO: 321257 - RNA, 32 nt, Human
aggaggcgacaaguccaucagcagaaagucac

SEQ ID NO: 321258 - RNA, 22 nt, Human
aggaggcgaggaggccguugcc

SEQ ID NO: 321259 - RNA, 32 nt, Human
aggaggcgaggcggagccagccgagggaguga

SEQ ID NO: 321260 - RNA, 32 nt, Human
aggaggcgcagcccuaccuucuuucuggggaa

SEQ ID NO: 321261 - RNA, 32 nt, Human
aggaggcgcagcucccgcugcaccgcgaucga

SEQ ID NO: 321262 - RNA, 32 nt, Human
aggaggcgcuagugggagacagggggcaggcc

SEQ ID NO: 321263 - RNA, 32 nt, Human
aggaggcggagaggcagagggaggagccucgg

SEQ ID NO: 321264 - RNA, 32 nt, Human
aggaggcggaggaggagggaaggaagauggcg

SEQ ID NO: 321265 - RNA, 32 nt, Human
aggaggcggaggcagaggcugcagugacccaa

SEQ ID NO: 321266 - RNA, 32 nt, Human
aggaggcggaggcagcggcuggaggagcgcga

SEQ ID NO: 321267 - RNA, 32 nt, Human
aggaggcggaggcccgcagagcacagagcagg

SEQ ID NO: 321268 - RNA, 32 nt, Human
aggaggcggagggagagcaggagccacugaga

SEQ ID NO: 321269 - RNA, 32 nt, Human
aggaggcggagguugcagggagggagacugca

SEQ ID NO: 321270 - RNA, 32 nt, Human
aggaggcggagguugcagugagcucagaucuc

SEQ ID NO: 321271 - RNA, 32 nt, Human
aggaggcggagguugcagugagcucagauugc

SEQ ID NO: 321272 - RNA, 23 nt, Human
aggaggcggcggcuuagcugcua

SEQ ID NO: 321273 - RNA, 32 nt, Human
aggaggcggucgagccgcggagcccaggggcc

SEQ ID NO: 321274 - RNA, 18 nt, Human
aggaggcgugccugggaa

SEQ ID NO: 321275 - RNA, 32 nt, Human
aggaggcuaagcaggaggauggcuugggccca

SEQ ID NO: 321276 - RNA, 32 nt, Human
aggaggcuacaaaggccaggcuggugucggaa

SEQ ID NO: 321277 - RNA, 32 nt, Human
aggaggcuauggugguggaggugguggcagca

SEQ ID NO: 321278 - RNA, 32 nt, Human
aggaggcucacugccuccuguuccagcuccug

SEQ ID NO: 321279 - RNA, 32 nt, Human
aggaggcucagcggaaagcgacaggaaaguaa

SEQ ID NO: 321280 - RNA, 32 nt, Human
aggaggcucccaggaaccggagcuggaaaccc

SEQ ID NO: 321281 - RNA, 32 nt, Human
aggaggcucggggacagcaggagcacgggcug

SEQ ID NO: 321282 - RNA, 32 nt, Human
aggaggcucuagauggcggcugugccuuagag

SEQ ID NO: 321283 - RNA, 32 nt, Human
aggaggcucuagcccagaacagaggaagccag

SEQ ID NO: 321284 - RNA, 29 nt, Human
aggaggcucugacucuaaagcuucgacuu

SEQ ID NO: 321285 - RNA, 32 nt, Human
aggaggcucugccaucgggcuccuugcggcug

SEQ ID NO: 321286 - RNA, 32 nt, Human
aggaggcucugcccucuccagaggugccagac

SEQ ID NO: 321287 - RNA, 32 nt, Human
aggaggcucugggcggaggugcagugaccccg

SEQ ID NO: 321288 - RNA, 32 nt, Human
aggaggcucuugggaugcagcaagucccaggc

SEQ ID NO: 321289 - RNA, 32 nt, Human
aggaggcugacaggcccugcucccucugcucu

SEQ ID NO: 321290 - RNA, 32 nt, Human
aggaggcugaggcacgagacuugcuugaaccc

SEQ ID NO: 321291 - RNA, 32 nt, Human
aggaggcugaggcggagaauugcuugaacccg

SEQ ID NO: 321292 - RNA, 32 nt, Human
aggaggcugcaacgcuauaagagggcucaaga

SEQ ID NO: 321293 - RNA, 32 nt, Human
aggaggcugcagaagcaauggagugaccucug

SEQ ID NO: 321294 - RNA, 32 nt, Human
aggaggcugcagcuaccacgagggccucugag

SEQ ID NO: 321295 - RNA, 32 nt, Human
aggaggcugcagcugcuuccccaaggccacac

SEQ ID NO: 321296 - RNA, 20 nt, Human
aggaggcugcagcuggggga

SEQ ID NO: 321297 - RNA, 32 nt, Human
aggaggcugccggaacaacagcggcuuuccca

SEQ ID NO: 321298 - RNA, 18 nt, Human
aggaggcuggcagagcug

SEQ ID NO: 321299 - RNA, 32 nt, Human
aggaggcuggcguaauuaacacagcacaggga

SEQ ID NO: 321300 - RNA, 32 nt, Human
aggaggcuguaacaccccacacccaacccacg

SEQ ID NO: 321301 - RNA, 32 nt, Human
aggaggcugucgggggcgggccagccagcggg

SEQ ID NO: 321302 - RNA, 32 nt, Human
aggaggcuguggcagagaauugcuugaacccg

SEQ ID NO: 321303 - RNA, 23 nt, Human
aggaggcuguggcagcuguggca

SEQ ID NO: 321304 - RNA, 32 nt, Human
aggaggcuucuauugauaaauccagagccuca

SEQ ID NO: 321305 - RNA, 32 nt, Human
aggaggcuuugcgccucugcaggugcucucgg

SEQ ID NO: 321306 - RNA, 32 nt, Human
aggagggaaacacacuucacacaacaggcuua

SEQ ID NO: 321307 - RNA, 32 nt, Human
aggagggaaacugaggcccgaggcagauaccu

SEQ ID NO: 321308 - RNA, 32 nt, Human
aggagggaaccaggaccauguuccaguaaaug

SEQ ID NO: 321309 - RNA, 32 nt, Human
aggagggaacugcuccuucgacucugcagcuc

SEQ ID NO: 321310 - RNA, 22 nt, Human
aggagggaagagucccagugaa

SEQ ID NO: 321311 - RNA, 32 nt, Human
aggagggaagauggugggccucagggaggaug

SEQ ID NO: 321312 - RNA, 32 nt, Human
aggagggaaggagccggucaccccagaguauc

SEQ ID NO: 321313 - RNA, 32 nt, Human
aggagggaaggcggugaacacagcccccgugc

SEQ ID NO: 321314 - RNA, 32 nt, Human
aggagggaaguuugcuacaaaggggcugcaaa

SEQ ID NO: 321315 - RNA, 32 nt, Human
aggagggaauaggcaagucaagagugagagaa

SEQ ID NO: 321316 - RNA, 32 nt, Human
aggagggacagaaaugugguuucacaccugac

SEQ ID NO: 321317 - RNA, 32 nt, Human
aggagggacagagagacagggagagucagccu

SEQ ID NO: 321318 - RNA, 32 nt, Human
aggagggacagggguagagggagaagccuaga

SEQ ID NO: 321319 - RNA, 32 nt, Human
aggagggacaucuucccaugccuucccuagaa

SEQ ID NO: 321320 - RNA, 32 nt, Human
aggagggacuggagcagccaggagacucacuu

SEQ ID NO: 321321 - RNA, 32 nt, Human
aggagggacuuaguggcucugccgccagugag

SEQ ID NO: 321322 - RNA, 32 nt, Human
aggagggagaagggaaggaaggaaagaagaga

SEQ ID NO: 321323 - RNA, 32 nt, Human
aggagggagacugugguaggggcagggaggca

SEQ ID NO: 321324 - RNA, 32 nt, Human
aggagggagaggacagagccacugcagaggac

SEQ ID NO: 321325 - RNA, 32 nt, Human
aggagggagaggaggaagaggaaggggaggga

SEQ ID NO: 321326 - RNA, 32 nt, Human
aggagggagagggagucuggcaugagaugcaa

SEQ ID NO: 321327 - RNA, 32 nt, Human
aggagggagagggcagggaagacucacagcag

SEQ ID NO: 321328 - RNA, 32 nt, Human
aggagggagagggggaggggaggaguccaggg

SEQ ID NO: 321329 - RNA, 32 nt, Human
aggagggagagggucguugugagcagguugca

SEQ ID NO: 321330 - RNA, 32 nt, Human
aggagggagauuccaccuccccucccaaguga

SEQ ID NO: 321331 - RNA, 30 nt, Human
aggagggagcccugcagggcacagcaagac

SEQ ID NO: 321332 - RNA, 32 nt, Human
aggagggagccugcgugcuggggcaggguguc

SEQ ID NO: 321333 - RNA, 32 nt, Human
aggagggaggaaaggaaggaaaaagguugaga

SEQ ID NO: 321334 - RNA, 32 nt, Human
aggagggaggaggaagagagggagggaggcgg

SEQ ID NO: 321335 - RNA, 24 nt, Human
aggagggaggaucacuugaaccca

SEQ ID NO: 321336 - RNA, 24 nt, Human
aggagggaggaucgcuuaagccca

SEQ ID NO: 321337 - RNA, 32 nt, Human
aggagggagggagggacaggugccuggagccc

SEQ ID NO: 321338 - RNA, 32 nt, Human
aggagggagggagggacgauggcgguggguuu

SEQ ID NO: 321339 - RNA, 32 nt, Human
aggagggagggaggggcagaguggagugucau

SEQ ID NO: 321340 - RNA, 32 nt, Human
aggagggaggugggguagggaggaguguagga

SEQ ID NO: 321341 - RNA, 32 nt, Human
aggagggaggugggugggucaggugaguggaa

SEQ ID NO: 321342 - RNA, 32 nt, Human
aggagggagguggguguuggagccccugagac

SEQ ID NO: 321343 - RNA, 32 nt, Human
aggagggagugacaguauuggugaggaaugaa

SEQ ID NO: 321344 - RNA, 32 nt, Human
aggagggaguggagagacugacuggccgugau

SEQ ID NO: 321345 - RNA, 32 nt, Human
aggagggauagaaggaaggaaggaaggaaccc

SEQ ID NO: 321346 - RNA, 32 nt, Human
aggagggauuccggaauugaggggcacgcagg

SEQ ID NO: 321347 - RNA, 32 nt, Human
aggagggauugacucugaggaccugagcuaca

SEQ ID NO: 321348 - RNA, 32 nt, Human
aggagggauuucacucuucuucccagguucuu

SEQ ID NO: 321349 - RNA, 32 nt, Human
aggagggauuuccugacuuugacacacauggc

SEQ ID NO: 321350 - RNA, 32 nt, Human
aggagggcaagccccuugguccuggaacacag

SEQ ID NO: 321351 - RNA, 32 nt, Human
aggagggcagagaucacuugaggccaggagcu

SEQ ID NO: 321352 - RNA, 32 nt, Human
aggagggcagagcccucguggccugaccaccu

SEQ ID NO: 321353 - RNA, 24 nt, Human
aggagggcagaucacgaggucagg

SEQ ID NO: 321354 - RNA, 32 nt, Human
aggagggcagcgacaucagcuuggugggcagc

SEQ ID NO: 321355 - RNA, 32 nt, Human
aggagggcaggaguugggggagcaggagggca

SEQ ID NO: 321356 - RNA, 32 nt, Human
aggagggcagggccagcaccucaccccacaca

SEQ ID NO: 321357 - RNA, 32 nt, Human
aggagggcaggggugagagagcaagggggcag

SEQ ID NO: 321358 - RNA, 32 nt, Human
aggagggcagugagcugugauugcaccgugac

SEQ ID NO: 321359 - RNA, 32 nt, Human
aggagggcauuguugucagucuggaccgagcc

SEQ ID NO: 321360 - RNA, 32 nt, Human
aggagggcccauggggguaggagcaguugaac

SEQ ID NO: 321361 - RNA, 32 nt, Human
aggagggccgcugaaggacaaacauaaccgug

SEQ ID NO: 321362 - RNA, 32 nt, Human
aggagggccugacacgggaagagugcaguagg

SEQ ID NO: 321363 - RNA, 24 nt, Human
aggagggcggaucacaaggucagg

SEQ ID NO: 321364 - RNA, 32 nt, Human
aggagggcggggaaguuugcgucuuauugaac

SEQ ID NO: 321365 - RNA, 18 nt, Human
aggagggcuacccugggg

SEQ ID NO: 321366 - RNA, 32 nt, Human
aggagggcucucuucuuucuuccucauccuac

SEQ ID NO: 321367 - RNA, 32 nt, Human
aggagggcugcgcuggggagguuguggugcag

SEQ ID NO: 321368 - RNA, 32 nt, Human
aggagggcuucgaggguggugauuacgguggc

SEQ ID NO: 321369 - RNA, 32 nt, Human
aggaggggaaacugagcccacagugaguaugu

SEQ ID NO: 321370 - RNA, 32 nt, Human
aggaggggaaccagauguuagaucaggggagg

SEQ ID NO: 321371 - RNA, 32 nt, Human
aggaggggaagagacaaucuccagccacccgc

SEQ ID NO: 321372 - RNA, 32 nt, Human
aggaggggaagagagaggagccccacuucacu

SEQ ID NO: 321373 - RNA, 21 nt, Human
aggaggggaaggggaggcaga

SEQ ID NO: 321374 - RNA, 32 nt, Human
aggaggggacaacaauacuaccucacuacuac

SEQ ID NO: 321375 - RNA, 32 nt, Human
aggaggggacaguguugguggugcugugggcu

SEQ ID NO: 321376 - RNA, 17 nt, Human
aggaggggacccuggga

SEQ ID NO: 321377 - RNA, 32 nt, Human
aggaggggaccgugugggggaggggaccagug

SEQ ID NO: 321378 - RNA, 32 nt, Human
aggaggggacggggagaaagaagcaaugaaug

SEQ ID NO: 321379 - RNA, 32 nt, Human
aggaggggagaaaaaguucuuccaaaggcugg

SEQ ID NO: 321380 - RNA, 32 nt, Human
aggaggggagaaacaggagaggagaggccagg

SEQ ID NO: 321381 - RNA, 32 nt, Human
aggaggggagagacaggcagcccagcagugug

SEQ ID NO: 321382 - RNA, 32 nt, Human
aggaggggagaggcacggauccagguaccacg

SEQ ID NO: 321383 - RNA, 32 nt, Human
aggaggggagauuagacaugcacagaaggccg

SEQ ID NO: 321384 - RNA, 32 nt, Human
aggaggggagcgggcccaggagccaggcucag

SEQ ID NO: 321385 - RNA, 32 nt, Human
aggaggggaggaggaggaggaggaggaggucg

SEQ ID NO: 321386 - RNA, 32 nt, Human
aggaggggagggaggaagaaggaagagaggca

SEQ ID NO: 321387 - RNA, 32 nt, Human
aggaggggagggucgcuccacccuggagcggg

SEQ ID NO: 321388 - RNA, 32 nt, Human
aggaggggaguucagggugaggggagcuuuuu

SEQ ID NO: 321389 - RNA, 32 nt, Human
aggaggggauucuggaacugaauggcgcuucg

SEQ ID NO: 321390 - RNA, 32 nt, Human
aggaggggcacacaugccccaggggagcgagg

SEQ ID NO: 321391 - RNA, 32 nt, Human
aggaggggcagaagugaaggaagaauaggaag

SEQ ID NO: 321392 - RNA, 32 nt, Human
aggaggggcauggcaaauucugccauugccca

SEQ ID NO: 321393 - RNA, 18 nt, Human
aggaggggccaagaacca

SEQ ID NO: 321394 - RNA, 32 nt, Human
aggaggggccaagaaccagggggccaucaaaa

SEQ ID NO: 321395 - RNA, 20 nt, Human
aggaggggccagcagcccca

SEQ ID NO: 321396 - RNA, 32 nt, Human
aggaggggccuuucauagcuguagugaguaag

SEQ ID NO: 321397 - RNA, 32 nt, Human
aggaggggcugcagguccaugugggcagcugu

SEQ ID NO: 321398 - RNA, 32 nt, Human
aggagggggaaaccgggggaaaagagggaaaa

SEQ ID NO: 321399 - RNA, 32 nt, Human
aggagggggaagagaguccguuuugcagaaga

SEQ ID NO: 321400 - RNA, 32 nt, Human
aggagggggacugacacugauuuuucauuuga

SEQ ID NO: 321401 - RNA, 32 nt, Human
aggagggggacuggguguguccagccagaggg

SEQ ID NO: 321402 - RNA, 32 nt, Human
aggagggggagaaggagcaggaauaucgugga

SEQ ID NO: 321403 - RNA, 32 nt, Human
aggagggggaggaggagcgggaggagggacga

SEQ ID NO: 321404 - RNA, 32 nt, Human
aggagggggaugcagaggugaugcagcugggg

SEQ ID NO: 321405 - RNA, 32 nt, Human
aggagggggccaggucaggcaccaccaucaag

SEQ ID NO: 321406 - RNA, 32 nt, Human
aggagggggcccugaggcaugggaugggacag

SEQ ID NO: 321407 - RNA, 32 nt, Human
aggagggggcccuggagggaaaggccgaggcc

SEQ ID NO: 321408 - RNA, 32 nt, Human
aggagggggccgcagucgggagaggggacccc

SEQ ID NO: 321409 - RNA, 32 nt, Human
aggagggggcucugacgugcagguuggaaauc

SEQ ID NO: 321410 - RNA, 32 nt, Human
aggagggggcugggcgcugucccuucucuuuc

SEQ ID NO: 321411 - RNA, 32 nt, Human
aggagggggcugguaucccaaacucugguuuc

SEQ ID NO: 321412 - RNA, 32 nt, Human
aggaggggguuagagagucuguuuugauugau

SEQ ID NO: 321413 - RNA, 32 nt, Human
aggaggggguuggacauccugccccucacccc

SEQ ID NO: 321414 - RNA, 32 nt, Human
aggaggggucauuggccuuuuugucagcacaa

SEQ ID NO: 321415 - RNA, 32 nt, Human
aggaggggugggccauguucuauaagccauag

SEQ ID NO: 321416 - RNA, 32 nt, Human
aggagggguggguuuggggcugauggaagaaa

SEQ ID NO: 321417 - RNA, 32 nt, Human
aggagggguuaaagcugccagcacagaacuua

SEQ ID NO: 321418 - RNA, 32 nt, Human
aggagggguuucuuccugauuuuuagcagguu

SEQ ID NO: 321419 - RNA, 32 nt, Human
aggaggguacagcugggcuggggaggaccuga

SEQ ID NO: 321420 - RNA, 32 nt, Human
aggaggguagaaccuuaaaaagagaccuugaa

SEQ ID NO: 321421 - RNA, 22 nt, Human
aggaggguaggacggggucuca

SEQ ID NO: 321422 - RNA, 32 nt, Human
aggagggucauggaggauguuggggcucugac

SEQ ID NO: 321423 - RNA, 32 nt, Human
aggaggguccucugagacuccagaccugaggc

SEQ ID NO: 321424 - RNA, 32 nt, Human
aggagggucucaaacuccugaccucaggcgau

SEQ ID NO: 321425 - RNA, 20 nt, Human
aggagggucuccacacugcu

SEQ ID NO: 321426 - RNA, 32 nt, Human
aggagggucucgaacuccuggccucaagugau

SEQ ID NO: 321427 - RNA, 32 nt, Human
aggagggucuucgaaacccucuccccacagcc

SEQ ID NO: 321428 - RNA, 32 nt, Human
aggagggugaagauggugcugugcugaggaaa

SEQ ID NO: 321429 - RNA, 32 nt, Human
aggagggugaagauugaaaagcugccuauugc

SEQ ID NO: 321430 - RNA, 32 nt, Human
aggagggugccacccucucccugccaggggcc

SEQ ID NO: 321431 - RNA, 32 nt, Human
aggagggugcuaggcugcagacugccuuguac

SEQ ID NO: 321432 - RNA, 23 nt, Human
aggaggguggaucacgaggucag

SEQ ID NO: 321433 - RNA, 24 nt, Human
aggaggguggaucacgaggucagg

SEQ ID NO: 321434 - RNA, 32 nt, Human
aggaggguggcuucccucacaugaaggacacc

SEQ ID NO: 321435 - RNA, 24 nt, Human
aggagggugggcuggcgguaccca

SEQ ID NO: 321436 - RNA, 22 nt, Human
aggagggugggggaacagcuca

SEQ ID NO: 321437 - RNA, 32 nt, Human
aggaggguggguggagcagguggacuggaguu

SEQ ID NO: 321438 - RNA, 32 nt, Human
aggaggguggguggggaaggcugagcaaaggg

SEQ ID NO: 321439 - RNA, 20 nt, Human
aggaggguguccagaagcca

SEQ ID NO: 321440 - RNA, 32 nt, Human
aggagggugugagucagcucuguccauguggg

SEQ ID NO: 321441 - RNA, 25 nt, Human
aggagggugugggggagcccugagg

SEQ ID NO: 321442 - RNA, 32 nt, Human
aggagguaaagggagguuuucacugugggugu

SEQ ID NO: 321443 - RNA, 32 nt, Human
aggagguaccaugcuucccacucuggggccug

SEQ ID NO: 321444 - RNA, 32 nt, Human
aggagguacugagucaaugaugagggagguau

SEQ ID NO: 321445 - RNA, 23 nt, Human
aggagguagaaccucugcuguua

SEQ ID NO: 321446 - RNA, 32 nt, Human
aggagguagagaggagaaagagagcagcccgg

SEQ ID NO: 321447 - RNA, 32 nt, Human
aggagguagauggggaagaaauaccccagacc

SEQ ID NO: 321448 - RNA, 22 nt, Human
aggagguagccgaggccugagg

SEQ ID NO: 321449 - RNA, 32 nt, Human
aggaggucaagaccagccuggccaacguggug

SEQ ID NO: 321450 - RNA, 32 nt, Human
aggaggucaagaccagccugggcaacacggug

SEQ ID NO: 321451 - RNA, 32 nt, Human
aggaggucaagaucagccugaccaacaugaug

SEQ ID NO: 321452 - RNA, 19 nt, Human
aggaggucaaggcugcagu

SEQ ID NO: 321453 - RNA, 32 nt, Human
aggaggucaauaccagccugggcaacauagua

SEQ ID NO: 321454 - RNA, 32 nt, Human
aggaggucagcaaaggucuugaauagauuuuc

SEQ ID NO: 321455 - RNA, 32 nt, Human
aggaggucagcaggggugggcaggcccagcug

SEQ ID NO: 321456 - RNA, 32 nt, Human
aggaggucagccuggccaauauggugaaaccc

SEQ ID NO: 321457 - RNA, 32 nt, Human
aggaggucaggaguucgagaccagccuggcca

SEQ ID NO: 321458 - RNA, 32 nt, Human
aggaggucaggucaaggcugcagugagccaug

SEQ ID NO: 321459 - RNA, 32 nt, Human
aggaggucaguucucaccccuuccucgauggg

SEQ ID NO: 321460 - RNA, 32 nt, Human
aggaggucauuuuucugcagggguggagccaa

SEQ ID NO: 321461 - RNA, 32 nt, Human
aggagguccagaccagccugggcaacacagcg

SEQ ID NO: 321462 - RNA, 32 nt, Human
aggagguccucugagcccugaggcagagaucu

SEQ ID NO: 321463 - RNA, 32 nt, Human
aggagguccugaggcuacagagcugccgcggc

SEQ ID NO: 321464 - RNA, 32 nt, Human
aggaggucgagaccagccuggggaacacaucc

SEQ ID NO: 321465 - RNA, 32 nt, Human
aggaggucgcagaggugaagagcuaaaccacu

SEQ ID NO: 321466 - RNA, 32 nt, Human
aggaggucggagccacaagugaggggcuggga

SEQ ID NO: 321467 - RNA, 32 nt, Human
aggaggucucaccugcugaaccagccagcccu

SEQ ID NO: 321468 - RNA, 32 nt, Human
aggaggucucagucccagccucgggagggcac

SEQ ID NO: 321469 - RNA, 23 nt, Human
aggaggucugccucccaccagac

SEQ ID NO: 321470 - RNA, 32 nt, Human
aggaggucuucccacgcccugucauuaggcug

SEQ ID NO: 321471 - RNA, 32 nt, Human
aggaggugaacaaggagcuguggcgccagcag

SEQ ID NO: 321472 - RNA, 32 nt, Human
aggaggugaaggccacagugacccaacagggu

SEQ ID NO: 321473 - RNA, 19 nt, Human
aggaggugaagucggguca

SEQ ID NO: 321474 - RNA, 32 nt, Human
aggaggugagaggagaggaaggagaaaacugc

SEQ ID NO: 321475 - RNA, 32 nt, Human
aggaggugaggacaagccagagguccuuggug

SEQ ID NO: 321476 - RNA, 32 nt, Human
aggaggugagggaagcagcgcugucagaguuu

SEQ ID NO: 321477 - RNA, 20 nt, Human
aggaggugaggggcaccuau

SEQ ID NO: 321478 - RNA, 32 nt, Human
aggaggugaugaggucacagaggcagaaaccu

SEQ ID NO: 321479 - RNA, 32 nt, Human
aggaggugaugguggaugacaggcuagucaca

SEQ ID NO: 321480 - RNA, 32 nt, Human
aggaggugcaccuggcagcccacauuuuuguu

SEQ ID NO: 321481 - RNA, 32 nt, Human
aggaggugccccgggaccucagggcuguggcu

SEQ ID NO: 321482 - RNA, 32 nt, Human
aggaggugcucaauaaaaguugacuccgaaug

SEQ ID NO: 321483 - RNA, 32 nt, Human
aggaggugcucaauaaaaguugacucugacug

SEQ ID NO: 321484 - RNA, 32 nt, Human
aggaggugcuccagaagcacgggacuguggac

SEQ ID NO: 321485 - RNA, 32 nt, Human
aggaggugcugguguccaccuccagggccccc

SEQ ID NO: 321486 - RNA, 32 nt, Human
aggagguggagagacagcccacccccgugucc

SEQ ID NO: 321487 - RNA, 32 nt, Human
aggagguggagagacagcccacccuugugucc

SEQ ID NO: 321488 - RNA, 32 nt, Human
aggagguggaggaggagagguggcaggaggag

SEQ ID NO: 321489 - RNA, 32 nt, Human
aggagguggaggaggaggaagaggagaaggaa

SEQ ID NO: 321490 - RNA, 32 nt, Human
aggagguggaggaggaggaggaagaucaggag

SEQ ID NO: 321491 - RNA, 32 nt, Human
aggagguggaggaggaggaggaggaggaggag

SEQ ID NO: 321492 - RNA, 32 nt, Human
aggagguggaggcugcaaugagcugagauagu

SEQ ID NO: 321493 - RNA, 32 nt, Human
aggagguggagguugaaaugagcugagaucau

SEQ ID NO: 321494 - RNA, 21 nt, Human
aggagguggagguugcaguga

SEQ ID NO: 321495 - RNA, 32 nt, Human
aggagguggcaccggauauaacaugucucugu

SEQ ID NO: 321496 - RNA, 32 nt, Human
aggagguggcuccaaaggguaaagcaaacaaa

SEQ ID NO: 321497 - RNA, 32 nt, Human
aggagguggcucgugacaccacgaugggacac

SEQ ID NO: 321498 - RNA, 32 nt, Human
aggaggugggcacagggugagguagggggugg

SEQ ID NO: 321499 - RNA, 31 nt, Human
aggaggugggcauuuccuacauuccuccuug

SEQ ID NO: 321500 - RNA, 32 nt, Human
aggagguggggauccgagugcagugagagccu

SEQ ID NO: 321501 - RNA, 32 nt, Human
aggaggugggguggaaauagggugggcuccuu

SEQ ID NO: 321502 - RNA, 31 nt, Human
aggagguggguggaggcaugcaggggagacg

SEQ ID NO: 321503 - RNA, 32 nt, Human
aggagguggguggaggcaugcaggggagacga

SEQ ID NO: 321504 - RNA, 18 nt, Human
aggagguggguugggaga

SEQ ID NO: 321505 - RNA, 32 nt, Human
aggagguggugaguuggcuacaagagaaaggg

SEQ ID NO: 321506 - RNA, 32 nt, Human
aggaggugguucugaaaguggcucuucuaacc

SEQ ID NO: 321507 - RNA, 26 nt, Human
aggaggugguuggccagagaugggga

SEQ ID NO: 321508 - RNA, 32 nt, Human
aggaggugucuugcuucaccuucaccuuccac

SEQ ID NO: 321509 - RNA, 32 nt, Human
aggagguucaaccucucuggcagaucaucucu

SEQ ID NO: 321510 - RNA, 32 nt, Human
aggagguuccagccuuggcaagaggagugugg

SEQ ID NO: 321511 - RNA, 19 nt, Human
aggagguucccggaagcca

SEQ ID NO: 321512 - RNA, 20 nt, Human
aggagguugaggcugggagg

SEQ ID NO: 321513 - RNA, 31 nt, Human
aggagguuggagagagaaagggugaaagcag

SEQ ID NO: 321514 - RNA, 32 nt, Human
aggagguuggagcagcccugcccagccccgug

SEQ ID NO: 321515 - RNA, 32 nt, Human
aggagguugucagggacacagagcagggggag

SEQ ID NO: 321516 - RNA, 21 nt, Human
aggagguugucucuuccuccu

SEQ ID NO: 321517 - RNA, 32 nt, Human
aggagguugugagucagcucuguccauguggg

SEQ ID NO: 321518 - RNA, 32 nt, Human
aggagguuugccgcggcagaaaaguuuucuuc

SEQ ID NO: 321519 - RNA, 25 nt, Human
aggagguuuguuguuuugccuguua

SEQ ID NO: 321520 - RNA, 32 nt, Human
aggaguaaaucuaaauguggcuuuugucaagc

SEQ ID NO: 321521 - RNA, 32 nt, Human
aggaguaagggggaggccagagggcucagaug

SEQ ID NO: 321522 - RNA, 32 nt, Human
aggaguacaggguccugugagcuguuugacca

SEQ ID NO: 321523 - RNA, 32 nt, Human
aggaguacagucaggggucaguguggcaacua

SEQ ID NO: 321524 - RNA, 32 nt, Human
aggaguacauugaagggagauuggcacccagg

SEQ ID NO: 321525 - RNA, 32 nt, Human
aggaguacauugaagggagauuggcaccuagu

SEQ ID NO: 321526 - RNA, 32 nt, Human
aggaguacauugaagggggauuggcacccagu

SEQ ID NO: 321527 - RNA, 32 nt, Human
aggaguaccugccuccuucagcccacuaguag

SEQ ID NO: 321528 - RNA, 32 nt, Human
aggaguagaagaggaugaccagcuagacuccc

SEQ ID NO: 321529 - RNA, 32 nt, Human
aggaguagccacugccccuccucgccccauuc

SEQ ID NO: 321530 - RNA, 32 nt, Human
aggaguaggacugcagcagagagggguuuugc

SEQ ID NO: 321531 - RNA, 32 nt, Human
aggaguagggacaggaaggacaggggaugccu

SEQ ID NO: 321532 - RNA, 32 nt, Human
aggaguaucaggaggaccuggcccugcgggcu

SEQ ID NO: 321533 - RNA, 32 nt, Human
aggaguaucccuugagucugggagguggaggc

SEQ ID NO: 321534 - RNA, 32 nt, Human
aggaguauugaggagcuugaaagggaacauuc

SEQ ID NO: 321535 - RNA, 32 nt, Human
aggagucaagggagcagggcagcucuaccagg

SEQ ID NO: 321536 - RNA, 32 nt, Human
aggagucacuggauggauguugcuugacuccu

SEQ ID NO: 321537 - RNA, 32 nt, Human
aggagucagaggaggaguuagaggaggaggag

SEQ ID NO: 321538 - RNA, 32 nt, Human
aggagucagaggcaggaggcaccaccagguua

SEQ ID NO: 321539 - RNA, 32 nt, Human
aggagucagaggcuggagugcaauggcgugau

SEQ ID NO: 321540 - RNA, 32 nt, Human
aggagucagcaaggcuccugcccauugccagg

SEQ ID NO: 321541 - RNA, 32 nt, Human
aggagucaggcagggccagcacaggguggcgu

SEQ ID NO: 321542 - RNA, 32 nt, Human
aggagucaguacaggcuuuauucaccucaaag

SEQ ID NO: 321543 - RNA, 32 nt, Human
aggagucaguucucccuuucugcuauccauca

SEQ ID NO: 321544 - RNA, 18 nt, Human
aggagucaucccagaagc

SEQ ID NO: 321545 - RNA, 32 nt, Human
aggagucauguuggagguuggggaagaaccug

SEQ ID NO: 321546 - RNA, 32 nt, Human
aggagucauuagcagugaugauuuugggaccu

SEQ ID NO: 321547 - RNA, 32 nt, Human
aggaguccaaagccagccugggcaacauggug

SEQ ID NO: 321548 - RNA, 32 nt, Human
aggaguccaaccugggcaacauggugaaaccc

SEQ ID NO: 321549 - RNA, 32 nt, Human
aggaguccaagaccagccuggccaacauggug

SEQ ID NO: 321550 - RNA, 32 nt, Human
aggaguccaagaccagccugggcaacauggca

SEQ ID NO: 321551 - RNA, 32 nt, Human
aggaguccaaggaaaccucagaacagccgucc

SEQ ID NO: 321552 - RNA, 32 nt, Human
aggaguccaggccauggaggcagaauccuggc

SEQ ID NO: 321553 - RNA, 32 nt, Human
aggaguccaguuccuaaaagauuauuucagag

SEQ ID NO: 321554 - RNA, 32 nt, Human
aggaguccccuuucccugucccagccccaucu

SEQ ID NO: 321555 - RNA, 32 nt, Human
aggagucccgcaggaaggaggccuucuucugu

SEQ ID NO: 321556 - RNA, 32 nt, Human
aggagucccugccaucauguuuacagaggaca

SEQ ID NO: 321557 - RNA, 32 nt, Human
aggaguccgagaccagccugggcaacauagug

SEQ ID NO: 321558 - RNA, 32 nt, Human
aggaguccucccccuucuccugcagucucugg

SEQ ID NO: 321559 - RNA, 32 nt, Human
aggaguccucggaggaggagcagugcccaugc

SEQ ID NO: 321560 - RNA, 32 nt, Human
aggaguccucuuaaguuugauagaaaugaauu

SEQ ID NO: 321561 - RNA, 32 nt, Human
aggaguccugcccagcagccucgguggccaag

SEQ ID NO: 321562 - RNA, 32 nt, Human
aggaguccugggagcauggcuuucccugagcc

SEQ ID NO: 321563 - RNA, 32 nt, Human
aggagucgcagcggacugggaacugcagcugc

SEQ ID NO: 321564 - RNA, 32 nt, Human
aggagucggagaccagccugggcaacauggcg

SEQ ID NO: 321565 - RNA, 32 nt, Human
aggagucgugaaugguucucaccaggaccuga

SEQ ID NO: 321566 - RNA, 32 nt, Human
aggagucuaggaccagccuggacaacauggug

SEQ ID NO: 321567 - RNA, 32 nt, Human
aggagucucucuugcucuguugcccaggcugg

SEQ ID NO: 321568 - RNA, 32 nt, Human
aggagucugagaccagccuggccaacauagca

SEQ ID NO: 321569 - RNA, 32 nt, Human
aggagucugagaccagccuggccaacauggca

SEQ ID NO: 321570 - RNA, 32 nt, Human
aggagucugagaccagccugggcaacauagca

SEQ ID NO: 321571 - RNA, 32 nt, Human
aggagucugagaccagccugggcaacauggug

SEQ ID NO: 321572 - RNA, 32 nt, Human
aggagucugcacucuucagucuuugcaggcag

SEQ ID NO: 321573 - RNA, 19 nt, Human
aggagucugccaggagcca

SEQ ID NO: 321574 - RNA, 32 nt, Human
aggagucugucagcuacggaggacaaugaccu

SEQ ID NO: 321575 - RNA, 32 nt, Human
aggagucuuggugagauuuugcucugaugcau

SEQ ID NO: 321576 - RNA, 32 nt, Human
aggagugaaagaagaaaagaagacuuagaaac

SEQ ID NO: 321577 - RNA, 32 nt, Human
aggagugaagaaaggcugggaggaauagagau

SEQ ID NO: 321578 - RNA, 32 nt, Human
aggagugaagccaccacacagauggaaacaaa

SEQ ID NO: 321579 - RNA, 32 nt, Human
aggagugacagaauaucaaaauaauuuguggc

SEQ ID NO: 321580 - RNA, 32 nt, Human
aggagugagcaaaggaagcauuuaccccgaug

SEQ ID NO: 321581 - RNA, 32 nt, Human
aggagugagcaccuaaaugaacgcaguaaacc

SEQ ID NO: 321582 - RNA, 22 nt, Human
aggagugagccaccaugcccgg

SEQ ID NO: 321583 - RNA, 18 nt, Human
aggagugagcucccuggg

SEQ ID NO: 321584 - RNA, 32 nt, Human
aggagugaggcagcagccucuaugcuugauuu

SEQ ID NO: 321585 - RNA, 32 nt, Human
aggagugaggcaugucuucagcagagcuugua

SEQ ID NO: 321586 - RNA, 22 nt, Human
aggagugagggaacccuggggc

SEQ ID NO: 321587 - RNA, 32 nt, Human
aggagugcaaaagcagccugagcaacauagug

SEQ ID NO: 321588 - RNA, 32 nt, Human
aggagugcacagcuccugcugauguauuuuuc

SEQ ID NO: 321589 - RNA, 32 nt, Human
aggagugcaccacugcacuccagccugggcaa

SEQ ID NO: 321590 - RNA, 32 nt, Human
aggagugcaguggcacagucauggcucgcugc

SEQ ID NO: 321591 - RNA, 32 nt, Human
aggagugcaguggcaugcucucagcucacugc

SEQ ID NO: 321592 - RNA, 32 nt, Human
aggagugcaguggcgugaucuuggcucacugc

SEQ ID NO: 321593 - RNA, 32 nt, Human
aggagugcauagauuccugaaggccauccagu

SEQ ID NO: 321594 - RNA, 32 nt, Human
aggagugccagccuggcccaggugaaagccau

SEQ ID NO: 321595 - RNA, 32 nt, Human
aggagugccuaagccaggacccagaaacucag

SEQ ID NO: 321596 - RNA, 32 nt, Human
aggagugccuggggauuugauccccauccugg

SEQ ID NO: 321597 - RNA, 20 nt, Human
aggagugcuaaaaggagcca

SEQ ID NO: 321598 - RNA, 32 nt, Human
aggagugcucuucaucaacuaauagagcaccu

SEQ ID NO: 321599 - RNA, 32 nt, Human
aggagugcugagggcuggagugggugggcccu

SEQ ID NO: 321600 - RNA, 32 nt, Human
aggagugcugaugagaggcagaggcucuucug

SEQ ID NO: 321601 - RNA, 32 nt, Human
aggagugcugggauaggagucgggauggugag

SEQ ID NO: 321602 - RNA, 32 nt, Human
aggagugcuguuagcccaaggggaagagcuaa

SEQ ID NO: 321603 - RNA, 17 nt, Human
aggaguggaaaaagagc

SEQ ID NO: 321604 - RNA, 21 nt, Human
aggaguggaaaacaaaaccca

SEQ ID NO: 321605 - RNA, 21 nt, Human
aggaguggaacugcuggguca

SEQ ID NO: 321606 - RNA, 18 nt, Human
aggaguggaacuggggga

SEQ ID NO: 321607 - RNA, 32 nt, Human
aggaguggaagaccuucuggugugggcugggc

SEQ ID NO: 321608 - RNA, 19 nt, Human
aggaguggaagaggagaca

SEQ ID NO: 321609 - RNA, 32 nt, Human
aggaguggaagaggagacaauuugaaugaauc

SEQ ID NO: 321610 - RNA, 17 nt, Human
aggaguggaaggaaacc

SEQ ID NO: 321611 - RNA, 21 nt, Human
aggaguggaauuucuaaguca

SEQ ID NO: 321612 - RNA, 32 nt, Human
aggaguggacaagccucuugguuaaggcuccu

SEQ ID NO: 321613 - RNA, 21 nt, Human
aggaguggacguuucaagcca

SEQ ID NO: 321614 - RNA, 32 nt, Human
aggaguggagagaaugaguaggagggcagaag

SEQ ID NO: 321615 - RNA, 32 nt, Human
aggaguggagagugugcaugagugugugugag

SEQ ID NO: 321616 - RNA, 19 nt, Human
aggaguggagcaugaaaca

SEQ ID NO: 321617 - RNA, 19 nt, Human
aggaguggaguagagccca

SEQ ID NO: 321618 - RNA, 22 nt, Human
aggaguggaguagagcccaauc

SEQ ID NO: 321619 - RNA, 32 nt, Human
aggaguggcagaagaaagauagguuggagaca

SEQ ID NO: 321620 - RNA, 20 nt, Human
aggaguggcaugagaggcca

SEQ ID NO: 321621 - RNA, 19 nt, Human
aggaguggccacaaggcca

SEQ ID NO: 321622 - RNA, 19 nt, Human
aggaguggccucaaggcca

SEQ ID NO: 321623 - RNA, 32 nt, Human
aggaguggcggcuccuggaggaggggcagagg

SEQ ID NO: 321624 - RNA, 32 nt, Human
aggaguggcugaggcagggcauggagcggagc

SEQ ID NO: 321625 - RNA, 32 nt, Human
aggaguggcugcaugugucugauaauaaagac

SEQ ID NO: 321626 - RNA, 32 nt, Human
aggagugggaaagaugguagagagacagaaga

SEQ ID NO: 321627 - RNA, 32 nt, Human
aggagugggaaucucccuuggccucaucucuc

SEQ ID NO: 321628 - RNA, 32 nt, Human
aggagugggagcaggagccagggcagaacaaa

SEQ ID NO: 321629 - RNA, 32 nt, Human
aggagugggcaggccggaguggggcgcccugg

SEQ ID NO: 321630 - RNA, 32 nt, Human
aggagugggcaggccugagugagggucacuga

SEQ ID NO: 321631 - RNA, 32 nt, Human
aggagugggcgcugggagaagcucccauuuag

SEQ ID NO: 321632 - RNA, 17 nt, Human
aggagugggcggaaacc

SEQ ID NO: 321633 - RNA, 21 nt, Human
aggagugggcugucacuagga

SEQ ID NO: 321634 - RNA, 18 nt, Human
aggaguggggagaaacca

SEQ ID NO: 321635 - RNA, 32 nt, Human
aggaguggggagaagagcauacgccaggagcc

SEQ ID NO: 321636 - RNA, 32 nt, Human
aggagugggggaagaauggccauugggagaca

SEQ ID NO: 321637 - RNA, 32 nt, Human
aggaguggguuauaaaaacauucaaguugguc

SEQ ID NO: 321638 - RNA, 23 nt, Human
aggagugguggggaccagaagcc

SEQ ID NO: 321639 - RNA, 32 nt, Human
aggagugguucugcagcuugaguccucugguu

SEQ ID NO: 321640 - RNA, 20 nt, Human
aggagugguucuuagaaaca

SEQ ID NO: 321641 - RNA, 29 nt, Human
aggagugguugggcugugccugggccuag

SEQ ID NO: 321642 - RNA, 32 nt, Human
aggaguguauauguuucauaaucuuuaucaag

SEQ ID NO: 321643 - RNA, 32 nt, Human
aggaguguauugcuaaagcaugugaguaauca

SEQ ID NO: 321644 - RNA, 22 nt, Human
aggagugugacggcaggagcca

SEQ ID NO: 321645 - RNA, 32 nt, Human
aggagugugagagacacaugcccacuucaugc

SEQ ID NO: 321646 - RNA, 32 nt, Human
aggagugugagaggaugggggaagcacugugg

SEQ ID NO: 321647 - RNA, 32 nt, Human
aggagugugcuggcaguacaaugacaguuuuc

SEQ ID NO: 321648 - RNA, 32 nt, Human
aggagugugggaugugguuucugccuucuaga

SEQ ID NO: 321649 - RNA, 32 nt, Human
aggaguguuauuuauggcuuugccaagcuaca

SEQ ID NO: 321650 - RNA, 32 nt, Human
aggaguuaaacaccagccugacaaacauggag

SEQ ID NO: 321651 - RNA, 32 nt, Human
aggaguuaaagaccagccuggccaacaaggug

SEQ ID NO: 321652 - RNA, 32 nt, Human
aggaguuaaagaccagccuggccaacauggca

SEQ ID NO: 321653 - RNA, 32 nt, Human
aggaguuaaagaccagccugggcaacauaggg

SEQ ID NO: 321654 - RNA, 32 nt, Human
aggaguuaaaugaagaaagagauaaguauaga

SEQ ID NO: 321655 - RNA, 32 nt, Human
aggaguuaaugacucccucuccccagcugucc

SEQ ID NO: 321656 - RNA, 32 nt, Human
aggaguuacagucccuuuuggcccucacaucc

SEQ ID NO: 321657 - RNA, 32 nt, Human
aggaguuacccacuuugugucuccugagagcu

SEQ ID NO: 321658 - RNA, 32 nt, Human
aggaguuagagaccagccuggccaacaaggca

SEQ ID NO: 321659 - RNA, 32 nt, Human
aggaguuagagaccagccugggcaacaugaug

SEQ ID NO: 321660 - RNA, 32 nt, Human
aggaguuagagaccagccugggcaacauggug

SEQ ID NO: 321661 - RNA, 32 nt, Human
aggaguuagaggaggaggaggaggaggaagag

SEQ ID NO: 321662 - RNA, 32 nt, Human
aggaguuaggucucaggucagccuggcuccug

SEQ ID NO: 321663 - RNA, 23 nt, Human
aggaguuagguggcuugauaaua

SEQ ID NO: 321664 - RNA, 32 nt, Human
aggaguucaaaaccaaccuggucuacauggug

SEQ ID NO: 321665 - RNA, 32 nt, Human
aggaguucaaaaccagccugaccaacauggug

SEQ ID NO: 321666 - RNA, 32 nt, Human
aggaguucaaaaccagccugaccaauauggug

SEQ ID NO: 321667 - RNA, 32 nt, Human
aggaguucaaaaccagccuggacaaucuggcg

SEQ ID NO: 321668 - RNA, 32 nt, Human
aggaguucaaaaccagccuggccaacaugcug

SEQ ID NO: 321669 - RNA, 32 nt, Human
aggaguucaaaaccagccuggccaacauggug

SEQ ID NO: 321670 - RNA, 32 nt, Human
aggaguucaaaaccagccugggcaauauagug

SEQ ID NO: 321671 - RNA, 32 nt, Human
aggaguucaaaaccagccuguccaauauagug

SEQ ID NO: 321672 - RNA, 32 nt, Human
aggaguucaaaaccagcuugggcagcauggcg

SEQ ID NO: 321673 - RNA, 32 nt, Human
aggaguucaacaccagcaugaccaacauggag

SEQ ID NO: 321674 - RNA, 32 nt, Human
aggaguucaacaccagccugagcaacauggua

SEQ ID NO: 321675 - RNA, 32 nt, Human
aggaguucaacaccagccuggccaacauggug

SEQ ID NO: 321676 - RNA, 32 nt, Human
aggaguucaacgccagccuggccaacauggug

SEQ ID NO: 321677 - RNA, 32 nt, Human
aggaguucaagaacagccugaccaacauggug

SEQ ID NO: 321678 - RNA, 32 nt, Human
aggaguucaagacaaggcugaccaacauggca

SEQ ID NO: 321679 - RNA, 32 nt, Human
aggaguucaagaccacccugaccaagguggug

SEQ ID NO: 321680 - RNA, 32 nt, Human
aggaguucaagaccagccuagccaacauggug

SEQ ID NO: 321681 - RNA, 32 nt, Human
aggaguucaagaccagccuaggcaacauaggg

SEQ ID NO: 321682 - RNA, 32 nt, Human
aggaguucaagaccagccuaggcaacuaagug

SEQ ID NO: 321683 - RNA, 32 nt, Human
aggaguucaagaccagccuaggccagauggug

SEQ ID NO: 321684 - RNA, 32 nt, Human
aggaguucaagaccagccucaacauggagaaa

SEQ ID NO: 321685 - RNA, 32 nt, Human
aggaguucaagaccagccugaccaacaugaag

SEQ ID NO: 321686 - RNA, 32 nt, Human
aggaguucaagaccagccugaccaacauggau

SEQ ID NO: 321687 - RNA, 32 nt, Human
aggaguucaagaccagccugaccaacauggca

SEQ ID NO: 321688 - RNA, 32 nt, Human
aggaguucaagaccagccugaccaacauggcg

SEQ ID NO: 321689 - RNA, 32 nt, Human
aggaguucaagaccagccugaccaacaugggg

SEQ ID NO: 321690 - RNA, 32 nt, Human
aggaguucaagaccagccugaccaacauggug

SEQ ID NO: 321691 - RNA, 32 nt, Human
aggaguucaagaccagccugacccacauggag

SEQ ID NO: 321692 - RNA, 32 nt, Human
aggaguucaagaccagccugagaaacauagug

SEQ ID NO: 321693 - RNA, 32 nt, Human
aggaguucaagaccagccugagcaaaaagacc

SEQ ID NO: 321694 - RNA, 32 nt, Human
aggaguucaagaccagccugagcaacauagug

SEQ ID NO: 321695 - RNA, 32 nt, Human
aggaguucaagaccagccugagcagcguagca

SEQ ID NO: 321696 - RNA, 32 nt, Human
aggaguucaagaccagccugaucaacauggug

SEQ ID NO: 321697 - RNA, 32 nt, Human
aggaguucaagaccagccugcccaacauagug

SEQ ID NO: 321698 - RNA, 32 nt, Human
aggaguucaagaccagccugcccaacauggca

SEQ ID NO: 321699 - RNA, 32 nt, Human
aggaguucaagaccagccugcccaacauggug

SEQ ID NO: 321700 - RNA, 32 nt, Human
aggaguucaagaccagccuggacaacacagca

SEQ ID NO: 321701 - RNA, 32 nt, Human
aggaguucaagaccagccuggacaacauagug

SEQ ID NO: 321702 - RNA, 32 nt, Human
aggaguucaagaccagccuggacaacauggca

SEQ ID NO: 321703 - RNA, 32 nt, Human
aggaguucaagaccagccuggacaacauggug

SEQ ID NO: 321704 - RNA, 32 nt, Human
aggaguucaagaccagccuggacaauauagug

SEQ ID NO: 321705 - RNA, 32 nt, Human
aggaguucaagaccagccuggacagcuuagug

SEQ ID NO: 321706 - RNA, 32 nt, Human
aggaguucaagaccagccuggccaacaaggcg

SEQ ID NO: 321707 - RNA, 32 nt, Human
aggaguucaagaccagccuggccaacaaggug

SEQ ID NO: 321708 - RNA, 32 nt, Human
aggaguucaagaccagccuggccaacacagug

SEQ ID NO: 321709 - RNA, 32 nt, Human
aggaguucaagaccagccuggccaacacggug

SEQ ID NO: 321710 - RNA, 32 nt, Human
aggaguucaagaccagccuggccaacauagug

SEQ ID NO: 321711 - RNA, 32 nt, Human
aggaguucaagaccagccuggccaacaugaaa

SEQ ID NO: 321712 - RNA, 32 nt, Human
aggaguucaagaccagccuggccaacaugaca

SEQ ID NO: 321713 - RNA, 32 nt, Human
aggaguucaagaccagccuggccaacaugacg

SEQ ID NO: 321714 - RNA, 32 nt, Human
aggaguucaagaccagccuggccaacaugaua

SEQ ID NO: 321715 - RNA, 32 nt, Human
aggaguucaagaccagccuggccaacaugaug

SEQ ID NO: 321716 - RNA, 32 nt, Human
aggaguucaagaccagccuggccaacauggag

SEQ ID NO: 321717 - RNA, 32 nt, Human
aggaguucaagaccagccuggccaacauggca

SEQ ID NO: 321718 - RNA, 32 nt, Human
aggaguucaagaccagccuggccaacauggcg

SEQ ID NO: 321719 - RNA, 32 nt, Human
aggaguucaagaccagccuggccaacaugggg

SEQ ID NO: 321720 - RNA, 32 nt, Human
aggaguucaagaccagccuggccaacauggua

SEQ ID NO: 321721 - RNA, 32 nt, Human
aggaguucaagaccagccuggccaacaugguc

SEQ ID NO: 321722 - RNA, 32 nt, Human
aggaguucaagaccagccuggccaacauggug

SEQ ID NO: 321723 - RNA, 32 nt, Human
aggaguucaagaccagccuggccaaccuggug

SEQ ID NO: 321724 - RNA, 32 nt, Human
aggaguucaagaccagccuggccaacguggca

SEQ ID NO: 321725 - RNA, 32 nt, Human
aggaguucaagaccagccuggccaacguggug

SEQ ID NO: 321726 - RNA, 32 nt, Human
aggaguucaagaccagccuggccaacuuggag

SEQ ID NO: 321727 - RNA, 32 nt, Human
aggaguucaagaccagccuggccaacuuggug

SEQ ID NO: 321728 - RNA, 32 nt, Human
aggaguucaagaccagccuggccaagauggug

SEQ ID NO: 321729 - RNA, 32 nt, Human
aggaguucaagaccagccuggccaauauggca

SEQ ID NO: 321730 - RNA, 32 nt, Human
aggaguucaagaccagccuggccaauauggug

SEQ ID NO: 321731 - RNA, 32 nt, Human
aggaguucaagaccagccuggccaauguagug

SEQ ID NO: 321732 - RNA, 32 nt, Human
aggaguucaagaccagccuggccaaugugaug

SEQ ID NO: 321733 - RNA, 32 nt, Human
aggaguucaagaccagccuggccacauggugc

SEQ ID NO: 321734 - RNA, 32 nt, Human
aggaguucaagaccagccuggccgacauggcg

SEQ ID NO: 321735 - RNA, 32 nt, Human
aggaguucaagaccagccuggccgggguggug

SEQ ID NO: 321736 - RNA, 32 nt, Human
aggaguucaagaccagccuggcuaacauggca

SEQ ID NO: 321737 - RNA, 32 nt, Human
aggaguucaagaccagccuggcuaacauggug

SEQ ID NO: 321738 - RNA, 32 nt, Human
aggaguucaagaccagccuggcuaacauguga

SEQ ID NO: 321739 - RNA, 32 nt, Human
aggaguucaagaccagccuggcuaauauggug

SEQ ID NO: 321740 - RNA, 32 nt, Human
aggaguucaagaccagccuggcugacaccgug

SEQ ID NO: 321741 - RNA, 32 nt, Human
aggaguucaagaccagccugggaacacagcga

SEQ ID NO: 321742 - RNA, 32 nt, Human
aggaguucaagaccagccugggcaacacagca

SEQ ID NO: 321743 - RNA, 32 nt, Human
aggaguucaagaccagccugggcaacacagcg

SEQ ID NO: 321744 - RNA, 32 nt, Human
aggaguucaagaccagccugggcaacacagug

SEQ ID NO: 321745 - RNA, 32 nt, Human
aggaguucaagaccagccugggcaacacgaaa

SEQ ID NO: 321746 - RNA, 32 nt, Human
aggaguucaagaccagccugggcaacauaaug

SEQ ID NO: 321747 - RNA, 32 nt, Human
aggaguucaagaccagccugggcaacauacca

SEQ ID NO: 321748 - RNA, 32 nt, Human
aggaguucaagaccagccugggcaacauagca

SEQ ID NO: 321749 - RNA, 32 nt, Human
aggaguucaagaccagccugggcaacauagga

SEQ ID NO: 321750 - RNA, 32 nt, Human
aggaguucaagaccagccugggcaacauaggg

SEQ ID NO: 321751 - RNA, 32 nt, Human
aggaguucaagaccagccugggcaacauagug

SEQ ID NO: 321752 - RNA, 32 nt, Human
aggaguucaagaccagccugggcaacaugaua

SEQ ID NO: 321753 - RNA, 32 nt, Human
aggaguucaagaccagccugggcaacauggcg

SEQ ID NO: 321754 - RNA, 32 nt, Human
aggaguucaagaccagccugggcaacauggcu

SEQ ID NO: 321755 - RNA, 32 nt, Human
aggaguucaagaccagccugggcaacauggug

SEQ ID NO: 321756 - RNA, 32 nt, Human
aggaguucaagaccagccugggcaacauuccc

SEQ ID NO: 321757 - RNA, 32 nt, Human
aggaguucaagaccagccugggcaacguagca

SEQ ID NO: 321758 - RNA, 32 nt, Human
aggaguucaagaccagccugggcaacuuaggg

SEQ ID NO: 321759 - RNA, 32 nt, Human
aggaguucaagaccagccugggcaacuuagug

SEQ ID NO: 321760 - RNA, 32 nt, Human
aggaguucaagaccagccugggcaauauagug

SEQ ID NO: 321761 - RNA, 32 nt, Human
aggaguucaagaccagccugggcaaugugaug

SEQ ID NO: 321762 - RNA, 32 nt, Human
aggaguucaagaccagccugggcagcaugaca

SEQ ID NO: 321763 - RNA, 32 nt, Human
aggaguucaagaccagccugggcagcauggug

SEQ ID NO: 321764 - RNA, 32 nt, Human
aggaguucaagaccagccugggcuacagagca

SEQ ID NO: 321765 - RNA, 32 nt, Human
aggaguucaagaccagccugggcuacaugacg

SEQ ID NO: 321766 - RNA, 32 nt, Human
aggaguucaagaccagccuggggaacauagag

SEQ ID NO: 321767 - RNA, 32 nt, Human
aggaguucaagaccagccuggguaacaugggg

SEQ ID NO: 321768 - RNA, 32 nt, Human
aggaguucaagaccagccuggguaacauggug

SEQ ID NO: 321769 - RNA, 32 nt, Human
aggaguucaagaccagccuggguaucauaggg

SEQ ID NO: 321770 - RNA, 32 nt, Human
aggaguucaagaccagccuggucaacauggca

SEQ ID NO: 321771 - RNA, 32 nt, Human
aggaguucaagaccagccuggucaacauggug

SEQ ID NO: 321772 - RNA, 32 nt, Human
aggaguucaagaccagccuggucaacauguca

SEQ ID NO: 321773 - RNA, 32 nt, Human
aggaguucaagaccagccuguccaacauggug

SEQ ID NO: 321774 - RNA, 32 nt, Human
aggaguucaagaccagccuguggaacauaaca

SEQ ID NO: 321775 - RNA, 32 nt, Human
aggaguucaagaccagccuugccaacauggug

SEQ ID NO: 321776 - RNA, 32 nt, Human
aggaguucaagaccagccuugccaagauggug

SEQ ID NO: 321777 - RNA, 32 nt, Human
aggaguucaagaccagccuuggcaacauggug

SEQ ID NO: 321778 - RNA, 32 nt, Human
aggaguucaagacuagccugaccaacauggug

SEQ ID NO: 321779 - RNA, 32 nt, Human
aggaguucaagagcaaccugaccaauacggug

SEQ ID NO: 321780 - RNA, 32 nt, Human
aggaguucaagaucagccugaccaacauggag

SEQ ID NO: 321781 - RNA, 32 nt, Human
aggaguucaaggccagccuggacaacauagua

SEQ ID NO: 321782 - RNA, 32 nt, Human
aggaguucaaggccagccuggccaacauggug

SEQ ID NO: 321783 - RNA, 32 nt, Human
aggaguucaaggccagccuggccaacgugaug

SEQ ID NO: 321784 - RNA, 32 nt, Human
aggaguucaaggccagccugggcaacauagua

SEQ ID NO: 321785 - RNA, 32 nt, Human
aggaguucaaggccagccugggcaacauagug

SEQ ID NO: 321786 - RNA, 32 nt, Human
aggaguucaaggccagccugggcaacauggca

SEQ ID NO: 321787 - RNA, 32 nt, Human
aggaguucaaggccagccugggcaacauggug

SEQ ID NO: 321788 - RNA, 32 nt, Human
aggaguucaauaccagccuggccaacguggug

SEQ ID NO: 321789 - RNA, 32 nt, Human
aggaguucaauaccagccugggcaacauacgg

SEQ ID NO: 321790 - RNA, 32 nt, Human
aggaguucaauaccagccugggcaacauaggg

SEQ ID NO: 321791 - RNA, 32 nt, Human
aggaguucacaaccagccuggucaacuuggua

SEQ ID NO: 321792 - RNA, 32 nt, Human
aggaguucacgaccagccuggccaacauggug

SEQ ID NO: 321793 - RNA, 32 nt, Human
aggaguucacgaccagccuggccaacauugug

SEQ ID NO: 321794 - RNA, 32 nt, Human
aggaguucaggaccagccugaccaacauggug

SEQ ID NO: 321795 - RNA, 32 nt, Human
aggaguucaggaccagccuggaaagcaaguca

SEQ ID NO: 321796 - RNA, 32 nt, Human
aggaguucaggaccagccuggccaacaugaug

SEQ ID NO: 321797 - RNA, 32 nt, Human
aggaguucaggaccagccuggccaauauggug

SEQ ID NO: 321798 - RNA, 32 nt, Human
aggaguucaggaccagccuggccagcauggug

SEQ ID NO: 321799 - RNA, 32 nt, Human
aggaguucaggaccagccugggcaacauagcg

SEQ ID NO: 321800 - RNA, 32 nt, Human
aggaguucaggaguucaagaccagccuggcca

SEQ ID NO: 321801 - RNA, 32 nt, Human
aggaguucauaaccagccuggauuaaaacaau

SEQ ID NO: 321802 - RNA, 32 nt, Human
aggaguucaugcugagaugaucaugaguucau

SEQ ID NO: 321803 - RNA, 32 nt, Human
aggaguucauucuucuuaucaaccagauuacg

SEQ ID NO: 321804 - RNA, 32 nt, Human
aggaguuccaaaccagcccuggcaacauugug

SEQ ID NO: 321805 - RNA, 32 nt, Human
aggaguuccagaccagccugaccaaaauggug

SEQ ID NO: 321806 - RNA, 32 nt, Human
aggaguuccagaccagccugaccaacguggug

SEQ ID NO: 321807 - RNA, 32 nt, Human
aggaguuccagaccagccuggccaacauagug

SEQ ID NO: 321808 - RNA, 32 nt, Human
aggaguuccagaccagccuggccaacaugaug

SEQ ID NO: 321809 - RNA, 32 nt, Human
aggaguuccagaccagccuggccaacauggca

SEQ ID NO: 321810 - RNA, 32 nt, Human
aggaguuccagaccagccuggccaacauggcu

SEQ ID NO: 321811 - RNA, 32 nt, Human
aggaguuccagaccagccuggccaacauggug

SEQ ID NO: 321812 - RNA, 32 nt, Human
aggaguuccagaccagccuggccaucauggug

SEQ ID NO: 321813 - RNA, 32 nt, Human
aggaguuccagaccagccuggcuaauauggug

SEQ ID NO: 321814 - RNA, 32 nt, Human
aggaguuccagaccagccugggcaacauagca

SEQ ID NO: 321815 - RNA, 32 nt, Human
aggaguuccagaccagccugggcaacauagug

SEQ ID NO: 321816 - RNA, 32 nt, Human
aggaguuccagaccagccugggcaacaugcga

SEQ ID NO: 321817 - RNA, 32 nt, Human
aggaguuccagaccagccugggcaauauaggg

SEQ ID NO: 321818 - RNA, 32 nt, Human
aggaguuccagaccagccugggcagcaucgug

SEQ ID NO: 321819 - RNA, 32 nt, Human
aggaguuccagaccagccuggucaacauggug

SEQ ID NO: 321820 - RNA, 32 nt, Human
aggaguuccagaucagccugagcaacauagca

SEQ ID NO: 321821 - RNA, 32 nt, Human
aggaguuccuuuccugcacucuucuccauccu

SEQ ID NO: 321822 - RNA, 32 nt, Human
aggaguucgaaaccagccugaccaacguggag

SEQ ID NO: 321823 - RNA, 32 nt, Human
aggaguucgaaaccagccuggccaacauagug

SEQ ID NO: 321824 - RNA, 32 nt, Human
aggaguucgaaaccagccuggccaacauggag

SEQ ID NO: 321825 - RNA, 32 nt, Human
aggaguucgaaaccagccuggccaacaugggg

SEQ ID NO: 321826 - RNA, 32 nt, Human
aggaguucgaaaccagccuggccaacauggug

SEQ ID NO: 321827 - RNA, 32 nt, Human
aggaguucgaaaccagccuggccaacuugaug

SEQ ID NO: 321828 - RNA, 32 nt, Human
aggaguucgaaaccagccugggcaacauagug

SEQ ID NO: 321829 - RNA, 32 nt, Human
aggaguucgaaaccagccugugcaacacagcg

SEQ ID NO: 321830 - RNA, 32 nt, Human
aggaguucgaaaccagccuucccaacauggug

SEQ ID NO: 321831 - RNA, 32 nt, Human
aggaguucgaagccagccugggcaacaaagug

SEQ ID NO: 321832 - RNA, 32 nt, Human
aggaguucgacaccagccuggccaacacagug

SEQ ID NO: 321833 - RNA, 32 nt, Human
aggaguucgagaccagcaugaccaacauggug

SEQ ID NO: 321834 - RNA, 32 nt, Human
aggaguucgagaccagccagaccaacaugaug

SEQ ID NO: 321835 - RNA, 32 nt, Human
aggaguucgagaccagccuaaacaacauagug

SEQ ID NO: 321836 - RNA, 32 nt, Human
aggaguucgagaccagccuagccaacauggug

SEQ ID NO: 321837 - RNA, 32 nt, Human
aggaguucgagaccagccuagcuaacauggua

SEQ ID NO: 321838 - RNA, 32 nt, Human
aggaguucgagaccagccuaggcaacauggag

SEQ ID NO: 321839 - RNA, 32 nt, Human
aggaguucgagaccagccuaggcaugauaaga

SEQ ID NO: 321840 - RNA, 32 nt, Human
aggaguucgagaccagccucaacauggagaaa

SEQ ID NO: 321841 - RNA, 32 nt, Human
aggaguucgagaccagccucagcaacacagug

SEQ ID NO: 321842 - RNA, 32 nt, Human
aggaguucgagaccagccucgccaacauggcg

SEQ ID NO: 321843 - RNA, 32 nt, Human
aggaguucgagaccagccugaacaacacggug

SEQ ID NO: 321844 - RNA, 32 nt, Human
aggaguucgagaccagccugaacaacauggca

SEQ ID NO: 321845 - RNA, 32 nt, Human
aggaguucgagaccagccugaccaacacggug

SEQ ID NO: 321846 - RNA, 32 nt, Human
aggaguucgagaccagccugaccaacauagug

SEQ ID NO: 321847 - RNA, 32 nt, Human
aggaguucgagaccagccugaccaacaugacg

SEQ ID NO: 321848 - RNA, 32 nt, Human
aggaguucgagaccagccugaccaacaugaug

SEQ ID NO: 321849 - RNA, 32 nt, Human
aggaguucgagaccagccugaccaacauggag

SEQ ID NO: 321850 - RNA, 32 nt, Human
aggaguucgagaccagccugaccaacauggca

SEQ ID NO: 321851 - RNA, 32 nt, Human
aggaguucgagaccagccugaccaacauggcg

SEQ ID NO: 321852 - RNA, 32 nt, Human
aggaguucgagaccagccugaccaacauggua

SEQ ID NO: 321853 - RNA, 32 nt, Human
aggaguucgagaccagccugaccaacauggug

SEQ ID NO: 321854 - RNA, 32 nt, Human
aggaguucgagaccagccugaccaacaugucg

SEQ ID NO: 321855 - RNA, 32 nt, Human
aggaguucgagaccagccugaccaacguggag

SEQ ID NO: 321856 - RNA, 32 nt, Human
aggaguucgagaccagccugaccaacguggug

SEQ ID NO: 321857 - RNA, 32 nt, Human
aggaguucgagaccagccugaccaagaugaug

SEQ ID NO: 321858 - RNA, 32 nt, Human
aggaguucgagaccagccugaccaauauggug

SEQ ID NO: 321859 - RNA, 32 nt, Human
aggaguucgagaccagccugaccaccauggag

SEQ ID NO: 321860 - RNA, 32 nt, Human
aggaguucgagaccagccugagaaacauagug

SEQ ID NO: 321861 - RNA, 32 nt, Human
aggaguucgagaccagccugagcaacacugug

SEQ ID NO: 321862 - RNA, 32 nt, Human
aggaguucgagaccagccugaucggcauggug

SEQ ID NO: 321863 - RNA, 32 nt, Human
aggaguucgagaccagccugccaacaugguga

SEQ ID NO: 321864 - RNA, 32 nt, Human
aggaguucgagaccagccugcccaacauggug

SEQ ID NO: 321865 - RNA, 32 nt, Human
aggaguucgagaccagccugcccaauauggug

SEQ ID NO: 321866 - RNA, 32 nt, Human
aggaguucgagaccagccugccuaacauggug

SEQ ID NO: 321867 - RNA, 32 nt, Human
aggaguucgagaccagccuggacaacauagug

SEQ ID NO: 321868 - RNA, 32 nt, Human
aggaguucgagaccagccuggcaaacauggcg

SEQ ID NO: 321869 - RNA, 32 nt, Human
aggaguucgagaccagccuggccaaaauagug

SEQ ID NO: 321870 - RNA, 32 nt, Human
aggaguucgagaccagccuggccaacaaggca

SEQ ID NO: 321871 - RNA, 32 nt, Human
aggaguucgagaccagccuggccaacacaaug

SEQ ID NO: 321872 - RNA, 32 nt, Human
aggaguucgagaccagccuggccaacacggug

SEQ ID NO: 321873 - RNA, 32 nt, Human
aggaguucgagaccagccuggccaacauaaug

SEQ ID NO: 321874 - RNA, 32 nt, Human
aggaguucgagaccagccuggccaacauagug

SEQ ID NO: 321875 - RNA, 32 nt, Human
aggaguucgagaccagccuggccaacaugaug

SEQ ID NO: 321876 - RNA, 32 nt, Human
aggaguucgagaccagccuggccaacauggca

SEQ ID NO: 321877 - RNA, 32 nt, Human
aggaguucgagaccagccuggccaacauggcg

SEQ ID NO: 321878 - RNA, 32 nt, Human
aggaguucgagaccagccuggccaacaugggg

SEQ ID NO: 321879 - RNA, 32 nt, Human
aggaguucgagaccagccuggccaacauggua

SEQ ID NO: 321880 - RNA, 32 nt, Human
aggaguucgagaccagccuggccaacauggug

SEQ ID NO: 321881 - RNA, 32 nt, Human
aggaguucgagaccagccuggccaacaugguu

SEQ ID NO: 321882 - RNA, 32 nt, Human
aggaguucgagaccagccuggccaacaugucg

SEQ ID NO: 321883 - RNA, 32 nt, Human
aggaguucgagaccagccuggccaaccaacau

SEQ ID NO: 321884 - RNA, 32 nt, Human
aggaguucgagaccagccuggccaacccagcc

SEQ ID NO: 321885 - RNA, 32 nt, Human
aggaguucgagaccagccuggccaacguggug

SEQ ID NO: 321886 - RNA, 32 nt, Human
aggaguucgagaccagccuggccaacugccug

SEQ ID NO: 321887 - RNA, 32 nt, Human
aggaguucgagaccagccuggccaagagacca

SEQ ID NO: 321888 - RNA, 32 nt, Human
aggaguucgagaccagccuggccaagauggcg

SEQ ID NO: 321889 - RNA, 32 nt, Human
aggaguucgagaccagccuggccaauaaggug

SEQ ID NO: 321890 - RNA, 32 nt, Human
aggaguucgagaccagccuggccaauacggca

SEQ ID NO: 321891 - RNA, 32 nt, Human
aggaguucgagaccagccuggccaauaugcaa

SEQ ID NO: 321892 - RNA, 32 nt, Human
aggaguucgagaccagccuggccaauauggug

SEQ ID NO: 321893 - RNA, 32 nt, Human
aggaguucgagaccagccuggccacauggcaa

SEQ ID NO: 321894 - RNA, 32 nt, Human
aggaguucgagaccagccuggccagcaaggug

SEQ ID NO: 321895 - RNA, 32 nt, Human
aggaguucgagaccagccuggccagcauggca

SEQ ID NO: 321896 - RNA, 32 nt, Human
aggaguucgagaccagccuggccagcauggcg

SEQ ID NO: 321897 - RNA, 32 nt, Human
aggaguucgagaccagccuggccagcauggug

SEQ ID NO: 321898 - RNA, 32 nt, Human
aggaguucgagaccagccuggccagcgguucc

SEQ ID NO: 321899 - RNA, 32 nt, Human
aggaguucgagaccagccuggcccacauggug

SEQ ID NO: 321900 - RNA, 32 nt, Human
aggaguucgagaccagccuggcuaacauggca

SEQ ID NO: 321901 - RNA, 32 nt, Human
aggaguucgagaccagccuggcuaacauggug

SEQ ID NO: 321902 - RNA, 32 nt, Human
aggaguucgagaccagccugggagacagagca

SEQ ID NO: 321903 - RNA, 32 nt, Human
aggaguucgagaccagccugggcaacaaagug

SEQ ID NO: 321904 - RNA, 32 nt, Human
aggaguucgagaccagccugggcaacacagcg

SEQ ID NO: 321905 - RNA, 32 nt, Human
aggaguucgagaccagccugggcaacacagga

SEQ ID NO: 321906 - RNA, 32 nt, Human
aggaguucgagaccagccugggcaacagagac

SEQ ID NO: 321907 - RNA, 32 nt, Human
aggaguucgagaccagccugggcaacagcaag

SEQ ID NO: 321908 - RNA, 32 nt, Human
aggaguucgagaccagccugggcaacauagag

SEQ ID NO: 321909 - RNA, 32 nt, Human
aggaguucgagaccagccugggcaacauaugg

SEQ ID NO: 321910 - RNA, 32 nt, Human
aggaguucgagaccagccugggcaacaucggg

SEQ ID NO: 321911 - RNA, 32 nt, Human
aggaguucgagaccagccugggcaacauggcg

SEQ ID NO: 321912 - RNA, 32 nt, Human
aggaguucgagaccagccugggcaacauggug

SEQ ID NO: 321913 - RNA, 32 nt, Human
aggaguucgagaccagccugggcaaccuaaug

SEQ ID NO: 321914 - RNA, 32 nt, Human
aggaguucgagaccagccugggcaacgcagug

SEQ ID NO: 321915 - RNA, 32 nt, Human
aggaguucgagaccagccugggcaacguggcg

SEQ ID NO: 321916 - RNA, 32 nt, Human
aggaguucgagaccagccugggcaacguggug

SEQ ID NO: 321917 - RNA, 32 nt, Human
aggaguucgagaccagccugggcagcauagca

SEQ ID NO: 321918 - RNA, 32 nt, Human
aggaguucgagaccagccugggcgacacggug

SEQ ID NO: 321919 - RNA, 32 nt, Human
aggaguucgagaccagccuggguaacauagcu

SEQ ID NO: 321920 - RNA, 32 nt, Human
aggaguucgagaccagccuggucaacauggcg

SEQ ID NO: 321921 - RNA, 32 nt, Human
aggaguucgagaccagccuggucaacauggug

SEQ ID NO: 321922 - RNA, 32 nt, Human
aggaguucgagaccagccuggucaacuuggug

SEQ ID NO: 321923 - RNA, 32 nt, Human
aggaguucgagaccagccugguccacauggca

SEQ ID NO: 321924 - RNA, 32 nt, Human
aggaguucgagaccagccuguucagcauagca

SEQ ID NO: 321925 - RNA, 32 nt, Human
aggaguucgagaccagccuugccaacauagug

SEQ ID NO: 321926 - RNA, 32 nt, Human
aggaguucgagaccugccugaccaacaugcug

SEQ ID NO: 321927 - RNA, 32 nt, Human
aggaguucgagacuagccugaccaacauggug

SEQ ID NO: 321928 - RNA, 32 nt, Human
aggaguucgagaucagccugaccaacauggag

SEQ ID NO: 321929 - RNA, 32 nt, Human
aggaguucgagaucagccugagcaacauaaca

SEQ ID NO: 321930 - RNA, 32 nt, Human
aggaguucgagcccagccugaccaauaugaug

SEQ ID NO: 321931 - RNA, 32 nt, Human
aggaguucgagcccagccugaccaauauggug

SEQ ID NO: 321932 - RNA, 32 nt, Human
aggaguucgagcccagccuggccaacauggcg

SEQ ID NO: 321933 - RNA, 32 nt, Human
aggaguucgagcccagccuggccaacauggug

SEQ ID NO: 321934 - RNA, 32 nt, Human
aggaguucgaggccagccugaccaacauggug

SEQ ID NO: 321935 - RNA, 32 nt, Human
aggaguucgaggccagccuggccaacaugaug

SEQ ID NO: 321936 - RNA, 32 nt, Human
aggaguucgagggcagccugaccaacauagug

SEQ ID NO: 321937 - RNA, 32 nt, Human
aggaguucgaguccagccugaccaacaugaag

SEQ ID NO: 321938 - RNA, 32 nt, Human
aggaguucgaguccagccuggccaacauggug

SEQ ID NO: 321939 - RNA, 32 nt, Human
aggaguucgaguccagccuggccaauaugcug

SEQ ID NO: 321940 - RNA, 32 nt, Human
aggaguucgauaccagccugaccaacauggcg

SEQ ID NO: 321941 - RNA, 32 nt, Human
aggaguucgauaccagccuggccaacauggug

SEQ ID NO: 321942 - RNA, 32 nt, Human
aggaguucgauaccagccuggccaauaugcaa

SEQ ID NO: 321943 - RNA, 32 nt, Human
aggaguucgauaccagccuggccaauaugcga

SEQ ID NO: 321944 - RNA, 32 nt, Human
aggaguucgauaccagccugggcaacauagug

SEQ ID NO: 321945 - RNA, 32 nt, Human
aggaguucgcaaccagccuggccaauauggug

SEQ ID NO: 321946 - RNA, 32 nt, Human
aggaguucgcgaccagccuacccaacauggug

SEQ ID NO: 321947 - RNA, 32 nt, Human
aggaguucggagcccaggcuuucaggcgaccu

SEQ ID NO: 321948 - RNA, 32 nt, Human
aggaguucgggaccagccugggaaauauagug

SEQ ID NO: 321949 - RNA, 32 nt, Human
aggaguucgggaccagccugggcaacauggug

SEQ ID NO: 321950 - RNA, 32 nt, Human
aggaguucgugaccagccuggucaacauggug

SEQ ID NO: 321951 - RNA, 32 nt, Human
aggaguucuagaccagccugaccaacauggug

SEQ ID NO: 321952 - RNA, 32 nt, Human
aggaguucuagaccagccugaccgacauggag

SEQ ID NO: 321953 - RNA, 32 nt, Human
aggaguucuagaccagccuggccaacauauag

SEQ ID NO: 321954 - RNA, 32 nt, Human
aggaguucuagaccagccuggccaacaugacc

SEQ ID NO: 321955 - RNA, 32 nt, Human
aggaguucuagaccagccuggccagcauggug

SEQ ID NO: 321956 - RNA, 32 nt, Human
aggaguucuagaccagccuggucaacauggcg

SEQ ID NO: 321957 - RNA, 32 nt, Human
aggaguucucauucccucaccuggcuucagcg

SEQ ID NO: 321958 - RNA, 32 nt, Human
aggaguucugaggaggagagagugaggguuuu

SEQ ID NO: 321959 - RNA, 32 nt, Human
aggaguugaagaccagccuggccaacauggca

SEQ ID NO: 321960 - RNA, 32 nt, Human
aggaguugaagaccagccuggccaacauggug

SEQ ID NO: 321961 - RNA, 32 nt, Human
aggaguugaagaccagccugggcaacacagug

SEQ ID NO: 321962 - RNA, 32 nt, Human
aggaguugaagaccagccugggcaacauagug

SEQ ID NO: 321963 - RNA, 32 nt, Human
aggaguugacuucagcaugggagggaggcucg

SEQ ID NO: 321964 - RNA, 32 nt, Human
aggaguugaggcggaaggauugcuugagccca

SEQ ID NO: 321965 - RNA, 32 nt, Human
aggaguugcagaccagccuggccaacauggca

SEQ ID NO: 321966 - RNA, 32 nt, Human
aggaguugcuacuggcaucuccuggguggagg

SEQ ID NO: 321967 - RNA, 32 nt, Human
aggaguuggaauccagccugagcaacagagca

SEQ ID NO: 321968 - RNA, 32 nt, Human
aggaguuggagaccagccuaggcaacacaggg

SEQ ID NO: 321969 - RNA, 32 nt, Human
aggaguuggagaccagccugaccaacauggac

SEQ ID NO: 321970 - RNA, 32 nt, Human
aggaguuggagaccagccugcccaacaugaug

SEQ ID NO: 321971 - RNA, 32 nt, Human
aggaguuggagaccagccuggauaacaaaggg

SEQ ID NO: 321972 - RNA, 32 nt, Human
aggaguuggagaccagccuggccaacauagug

SEQ ID NO: 321973 - RNA, 32 nt, Human
aggaguuggagaccagccuggccaacauggug

SEQ ID NO: 321974 - RNA, 32 nt, Human
aggaguuggagaccagccuggccaacguggca

SEQ ID NO: 321975 - RNA, 32 nt, Human
aggaguuggagaccagccugggcaacacagug

SEQ ID NO: 321976 - RNA, 32 nt, Human
aggaguuggagaccagccugggcaacauagug

SEQ ID NO: 321977 - RNA, 32 nt, Human
aggaguuggagaccagccugggcaacauggca

SEQ ID NO: 321978 - RNA, 32 nt, Human
aggaguuggaggaggaggaggaggaggcgagg

SEQ ID NO: 321979 - RNA, 32 nt, Human
aggaguuggaggccagccugggcaacacagca

SEQ ID NO: 321980 - RNA, 32 nt, Human
aggaguuguuucugacccacugaucucuacua

SEQ ID NO: 321981 - RNA, 32 nt, Human
aggaguuuaaaaccagaaugaucaacagagug

SEQ ID NO: 321982 - RNA, 32 nt, Human
aggaguuuaaaaugagggugauccuucccuuu

SEQ ID NO: 321983 - RNA, 32 nt, Human
aggaguuuaagaccagccugaccaacauggag

SEQ ID NO: 321984 - RNA, 32 nt, Human
aggaguuuaagaccagccuggacaacauagga

SEQ ID NO: 321985 - RNA, 32 nt, Human
aggaguuuaagaccagccuggccaacauggca

SEQ ID NO: 321986 - RNA, 32 nt, Human
aggaguuuaagaccagccugggcaacaaagug

SEQ ID NO: 321987 - RNA, 32 nt, Human
aggaguuuaagaccagccugggcaacacagga

SEQ ID NO: 321988 - RNA, 32 nt, Human
aggaguuuaagaccagccugggcaacauacag

SEQ ID NO: 321989 - RNA, 32 nt, Human
aggaguuuaagaccagccugggcaacauagca

SEQ ID NO: 321990 - RNA, 32 nt, Human
aggaguuuaagaccagccugggcaacaugggg

SEQ ID NO: 321991 - RNA, 32 nt, Human
aggaguuuaagaccagccugggcaacauggug

SEQ ID NO: 321992 - RNA, 32 nt, Human
aggaguuuaagaccagccugggcaacauuggg

SEQ ID NO: 321993 - RNA, 32 nt, Human
aggaguuuaaggccagccugggcaacauagca

SEQ ID NO: 321994 - RNA, 32 nt, Human
aggaguuucagaccagccugggcaacaugaca

SEQ ID NO: 321995 - RNA, 20 nt, Human
aggaguuuccccagaaguca

SEQ ID NO: 321996 - RNA, 32 nt, Human
aggaguuugaaaccagcauggccaacagaugu

SEQ ID NO: 321997 - RNA, 32 nt, Human
aggaguuugaaaccagccugagcagcaaagca

SEQ ID NO: 321998 - RNA, 32 nt, Human
aggaguuugaaaccagccuggccaacauggcg

SEQ ID NO: 321999 - RNA, 32 nt, Human
aggaguuugaaaccagccuggccaacauggug

SEQ ID NO: 322000 - RNA, 32 nt, Human
aggaguuugaaaccagccugggcaacauaggg

SEQ ID NO: 322001 - RNA, 32 nt, Human
aggaguuugaaaccagccugggcaacauggug

SEQ ID NO: 322002 - RNA, 32 nt, Human
aggaguuugaaaccagccuggguaacauggca

SEQ ID NO: 322003 - RNA, 32 nt, Human
aggaguuugacaccagccugggcaacauagug

SEQ ID NO: 322004 - RNA, 32 nt, Human
aggaguuugacaccagccugggcaacauggua

SEQ ID NO: 322005 - RNA, 32 nt, Human
aggaguuugagaccacccugaccaacaugaaa

SEQ ID NO: 322006 - RNA, 32 nt, Human
aggaguuugagaccagacugaccaacauggag

SEQ ID NO: 322007 - RNA, 32 nt, Human
aggaguuugagaccagcaugaccaacauggcg

SEQ ID NO: 322008 - RNA, 32 nt, Human
aggaguuugagaccagccuagacaacauggug

SEQ ID NO: 322009 - RNA, 32 nt, Human
aggaguuugagaccagccuagccaacaugcug

SEQ ID NO: 322010 - RNA, 32 nt, Human
aggaguuugagaccagccuagccaacauggug

SEQ ID NO: 322011 - RNA, 32 nt, Human
aggaguuugagaccagccuaggcaacacagug

SEQ ID NO: 322012 - RNA, 32 nt, Human
aggaguuugagaccagccuaggcaacauagca

SEQ ID NO: 322013 - RNA, 32 nt, Human
aggaguuugagaccagccuagucaacaugagg

SEQ ID NO: 322014 - RNA, 32 nt, Human
aggaguuugagaccagccucaccaacauggag

SEQ ID NO: 322015 - RNA, 32 nt, Human
aggaguuugagaccagccuccuggccaacaug

SEQ ID NO: 322016 - RNA, 32 nt, Human
aggaguuugagaccagccucgccaacauggug

SEQ ID NO: 322017 - RNA, 32 nt, Human
aggaguuugagaccagccucggcaacauggca

SEQ ID NO: 322018 - RNA, 32 nt, Human
aggaguuugagaccagccugaccaaacauggc

SEQ ID NO: 322019 - RNA, 32 nt, Human
aggaguuugagaccagccugaccaacauagag

SEQ ID NO: 322020 - RNA, 32 nt, Human
aggaguuugagaccagccugaccaacauaguu

SEQ ID NO: 322021 - RNA, 32 nt, Human
aggaguuugagaccagccugaccaacauggag

SEQ ID NO: 322022 - RNA, 32 nt, Human
aggaguuugagaccagccugaccaacauggca

SEQ ID NO: 322023 - RNA, 32 nt, Human
aggaguuugagaccagccugaccaacauggug

SEQ ID NO: 322024 - RNA, 32 nt, Human
aggaguuugagaccagccugaccaacguggug

SEQ ID NO: 322025 - RNA, 32 nt, Human
aggaguuugagaccagccugaccaucauggug

SEQ ID NO: 322026 - RNA, 32 nt, Human
aggaguuugagaccagccugagcaacaaagca

SEQ ID NO: 322027 - RNA, 32 nt, Human
aggaguuugagaccagccugagcaacauagca

SEQ ID NO: 322028 - RNA, 32 nt, Human
aggaguuugagaccagccugagugacauagug

SEQ ID NO: 322029 - RNA, 32 nt, Human
aggaguuugagaccagccugaucaacauggug

SEQ ID NO: 322030 - RNA, 32 nt, Human
aggaguuugagaccagccugaucaacguggug

SEQ ID NO: 322031 - RNA, 32 nt, Human
aggaguuugagaccagccugcccaacauggug

SEQ ID NO: 322032 - RNA, 32 nt, Human
aggaguuugagaccagccuggacaacaaacau

SEQ ID NO: 322033 - RNA, 32 nt, Human
aggaguuugagaccagccuggacaacauggug

SEQ ID NO: 322034 - RNA, 32 nt, Human
aggaguuugagaccagccuggcaaacauggug

SEQ ID NO: 322035 - RNA, 32 nt, Human
aggaguuugagaccagccuggccaacacagua

SEQ ID NO: 322036 - RNA, 32 nt, Human
aggaguuugagaccagccuggccaacacgaug

SEQ ID NO: 322037 - RNA, 32 nt, Human
aggaguuugagaccagccuggccaacacggca

SEQ ID NO: 322038 - RNA, 32 nt, Human
aggaguuugagaccagccuggccaacacggug

SEQ ID NO: 322039 - RNA, 32 nt, Human
aggaguuugagaccagccuggccaacacuauc

SEQ ID NO: 322040 - RNA, 32 nt, Human
aggaguuugagaccagccuggccaacagggug

SEQ ID NO: 322041 - RNA, 32 nt, Human
aggaguuugagaccagccuggccaacauagug

SEQ ID NO: 322042 - RNA, 32 nt, Human
aggaguuugagaccagccuggccaacauauag

SEQ ID NO: 322043 - RNA, 32 nt, Human
aggaguuugagaccagccuggccaacaugaug

SEQ ID NO: 322044 - RNA, 32 nt, Human
aggaguuugagaccagccuggccaacauggag

SEQ ID NO: 322045 - RNA, 32 nt, Human
aggaguuugagaccagccuggccaacauggca

SEQ ID NO: 322046 - RNA, 32 nt, Human
aggaguuugagaccagccuggccaacauggcg

SEQ ID NO: 322047 - RNA, 32 nt, Human
aggaguuugagaccagccuggccaacauggua

SEQ ID NO: 322048 - RNA, 32 nt, Human
aggaguuugagaccagccuggccaacauggug

SEQ ID NO: 322049 - RNA, 32 nt, Human
aggaguuugagaccagccuggccaaccaacau

SEQ ID NO: 322050 - RNA, 32 nt, Human
aggaguuugagaccagccuggccaacguagug

SEQ ID NO: 322051 - RNA, 32 nt, Human
aggaguuugagaccagccuggccaacguggca

SEQ ID NO: 322052 - RNA, 32 nt, Human
aggaguuugagaccagccuggccaacguggug

SEQ ID NO: 322053 - RNA, 32 nt, Human
aggaguuugagaccagccuggccaauauggca

SEQ ID NO: 322054 - RNA, 32 nt, Human
aggaguuugagaccagccuggccaauauggug

SEQ ID NO: 322055 - RNA, 32 nt, Human
aggaguuugagaccagccuggccaccauggug

SEQ ID NO: 322056 - RNA, 32 nt, Human
aggaguuugagaccagccuggccagcauggcg

SEQ ID NO: 322057 - RNA, 32 nt, Human
aggaguuugagaccagccuggccagcauggug

SEQ ID NO: 322058 - RNA, 32 nt, Human
aggaguuugagaccagccuggccgacauggug

SEQ ID NO: 322059 - RNA, 32 nt, Human
aggaguuugagaccagccuggcuaacauggug

SEQ ID NO: 322060 - RNA, 32 nt, Human
aggaguuugagaccagccuggcugacagggua

SEQ ID NO: 322061 - RNA, 32 nt, Human
aggaguuugagaccagccugggcaacaaagug

SEQ ID NO: 322062 - RNA, 32 nt, Human
aggaguuugagaccagccugggcaacacaaga

SEQ ID NO: 322063 - RNA, 32 nt, Human
aggaguuugagaccagccugggcaacacaggg

SEQ ID NO: 322064 - RNA, 32 nt, Human
aggaguuugagaccagccugggcaacacggug

SEQ ID NO: 322065 - RNA, 32 nt, Human
aggaguuugagaccagccugggcaacagggua

SEQ ID NO: 322066 - RNA, 32 nt, Human
aggaguuugagaccagccugggcaacauagca

SEQ ID NO: 322067 - RNA, 32 nt, Human
aggaguuugagaccagccugggcaacauagcg

SEQ ID NO: 322068 - RNA, 32 nt, Human
aggaguuugagaccagccugggcaacauaggg

SEQ ID NO: 322069 - RNA, 32 nt, Human
aggaguuugagaccagccugggcaacauagua

SEQ ID NO: 322070 - RNA, 32 nt, Human
aggaguuugagaccagccugggcaacauagug

SEQ ID NO: 322071 - RNA, 32 nt, Human
aggaguuugagaccagccugggcaacaucaug

SEQ ID NO: 322072 - RNA, 32 nt, Human
aggaguuugagaccagccugggcaacaugaug

SEQ ID NO: 322073 - RNA, 32 nt, Human
aggaguuugagaccagccugggcaacauggag

SEQ ID NO: 322074 - RNA, 32 nt, Human
aggaguuugagaccagccugggcaacauggca

SEQ ID NO: 322075 - RNA, 32 nt, Human
aggaguuugagaccagccugggcaacauggcu

SEQ ID NO: 322076 - RNA, 32 nt, Human
aggaguuugagaccagccugggcaacauggug

SEQ ID NO: 322077 - RNA, 32 nt, Human
aggaguuugagaccagccugggcaauauagca

SEQ ID NO: 322078 - RNA, 32 nt, Human
aggaguuugagaccagccugggcaauauagcg

SEQ ID NO: 322079 - RNA, 32 nt, Human
aggaguuugagaccagccugggcaauauagug

SEQ ID NO: 322080 - RNA, 32 nt, Human
aggaguuugagaccagccugggcaauaucgug

SEQ ID NO: 322081 - RNA, 32 nt, Human
aggaguuugagaccagccugggcaauauggug

SEQ ID NO: 322082 - RNA, 32 nt, Human
aggaguuugagaccagccugggcaccauggug

SEQ ID NO: 322083 - RNA, 32 nt, Human
aggaguuugagaccagccugggcagcauagca

SEQ ID NO: 322084 - RNA, 32 nt, Human
aggaguuugagaccagccugggcgauauagug

SEQ ID NO: 322085 - RNA, 32 nt, Human
aggaguuugagaccagccuggguaacaugaua

SEQ ID NO: 322086 - RNA, 32 nt, Human
aggaguuugagaccagccuggguaacaugggg

SEQ ID NO: 322087 - RNA, 32 nt, Human
aggaguuugagaccagccuggguaauauggca

SEQ ID NO: 322088 - RNA, 32 nt, Human
aggaguuugagaccagccuggucaacauggcg

SEQ ID NO: 322089 - RNA, 32 nt, Human
aggaguuugagaccagccuggucaacauggua

SEQ ID NO: 322090 - RNA, 32 nt, Human
aggaguuugagaccagccugucucuacuaaca

SEQ ID NO: 322091 - RNA, 32 nt, Human
aggaguuugagaccagccugugcaacaucaug

SEQ ID NO: 322092 - RNA, 32 nt, Human
aggaguuugagaccagccuugacaacauggug

SEQ ID NO: 322093 - RNA, 32 nt, Human
aggaguuugagaccagugugaccuugucucug

SEQ ID NO: 322094 - RNA, 32 nt, Human
aggaguuugagacuagccugaccaacauggag

SEQ ID NO: 322095 - RNA, 32 nt, Human
aggaguuugagagcagccugagcaacauagac

SEQ ID NO: 322096 - RNA, 32 nt, Human
aggaguuugaggccagccuggccaacauggcg

SEQ ID NO: 322097 - RNA, 32 nt, Human
aggaguuugaggccagccugggcaacauagag

SEQ ID NO: 322098 - RNA, 32 nt, Human
aggaguuugauaccagccugaccaacauggag

SEQ ID NO: 322099 - RNA, 32 nt, Human
aggaguuugauaccagccuggccaacauggug

SEQ ID NO: 322100 - RNA, 32 nt, Human
aggaguuugcuuguuguguuugcuuggaggcg

SEQ ID NO: 322101 - RNA, 20 nt, Human
aggaguuuggccagaaguca

SEQ ID NO: 322102 - RNA, 32 nt, Human
aggaguuugggaccagccugaccaacauggug

SEQ ID NO: 322103 - RNA, 32 nt, Human
aggaguuugggaccagccuggccaacauggug

SEQ ID NO: 322104 - RNA, 32 nt, Human
aggaguuugggaccagccugggcaacauaggg

SEQ ID NO: 322105 - RNA, 32 nt, Human
aggaguuugugaccagccugaccaacauagug

SEQ ID NO: 322106 - RNA, 32 nt, Human
aggaguuuguuaccagccugggcaacauagug

SEQ ID NO: 322107 - RNA, 32 nt, Human
aggaguuuuagaccagccuggccaacaugacg

SEQ ID NO: 322108 - RNA, 32 nt, Human
aggauaaaaaggaaggagagaugaccccuacc

SEQ ID NO: 322109 - RNA, 32 nt, Human
aggauaaaaauauacacaccauugggcaggaa

SEQ ID NO: 322110 - RNA, 32 nt, Human
aggauaaacacaaauuucuccuuaaauuucca

SEQ ID NO: 322111 - RNA, 32 nt, Human
aggauaaaccuccaagcucacauuuaauauaa

SEQ ID NO: 322112 - RNA, 32 nt, Human
aggauaaagaugagcaaauucuacccuaaaaa

SEQ ID NO: 322113 - RNA, 32 nt, Human
aggauaaagcaauucauuuucucccacccucg

SEQ ID NO: 322114 - RNA, 32 nt, Human
aggauaaaggaaaugacacuuugaggaacugg

SEQ ID NO: 322115 - RNA, 18 nt, Human
aggauaagaccacaggga

SEQ ID NO: 322116 - RNA, 32 nt, Human
aggauaagccacugcaccuggccagcucuagu

SEQ ID NO: 322117 - RNA, 31 nt, Human
aggauaagccucuuuauacucacuuaaacca

SEQ ID NO: 322118 - RNA, 18 nt, Human
aggauaaggcccagcgca

SEQ ID NO: 322119 - RNA, 32 nt, Human
aggauaauuguuguuuucaccuugggacucug

SEQ ID NO: 322120 - RNA, 32 nt, Human
aggauacaagaaaaggagcaggaagaaauuug

SEQ ID NO: 322121 - RNA, 32 nt, Human
aggauacaagggccuacccagagaccagagag

SEQ ID NO: 322122 - RNA, 32 nt, Human
aggauacacaucucugccaggaguugaaccug

SEQ ID NO: 322123 - RNA, 32 nt, Human
aggauacacaugcagucauagccaucaucuca

SEQ ID NO: 322124 - RNA, 32 nt, Human
aggauacagagccacauugaaaagauaaaccu

SEQ ID NO: 322125 - RNA, 32 nt, Human
aggauacaguggugagaggagccccauuuuag

SEQ ID NO: 322126 - RNA, 32 nt, Human
aggauacauuuagugccucccacccagcucca

SEQ ID NO: 322127 - RNA, 32 nt, Human
aggauaccaacauuucuuccuaauauucuaua

SEQ ID NO: 322128 - RNA, 32 nt, Human
aggauacccacugccucuugcuccuaaagccu

SEQ ID NO: 322129 - RNA, 32 nt, Human
aggauacccgguggcuucuggcacuggcgggc

SEQ ID NO: 322130 - RNA, 30 nt, Human
aggauacccucugccaugcucuugugcugc

SEQ ID NO: 322131 - RNA, 32 nt, Human
aggauaccggacacaccucugcuccaaaggaa

SEQ ID NO: 322132 - RNA, 32 nt, Human
aggauaccugggagacagaagccucugcaccu

SEQ ID NO: 322133 - RNA, 32 nt, Human
aggauacuaccaacuacuaucaccaugaccau

SEQ ID NO: 322134 - RNA, 32 nt, Human
aggauagaaaugccaucaggaaauagcugaau

SEQ ID NO: 322135 - RNA, 32 nt, Human
aggauagacaugggauguauggagaggaugga

SEQ ID NO: 322136 - RNA, 32 nt, Human
aggauagagaggaggagggaagaacaaaagag

SEQ ID NO: 322137 - RNA, 32 nt, Human
aggauagaucuucugcaacagucuugcugaca

SEQ ID NO: 322138 - RNA, 32 nt, Human
aggauagcacauuugacaguuuuugcauuuuu

SEQ ID NO: 322139 - RNA, 32 nt, Human
aggauagcaccccaccaugccagccugacuug

SEQ ID NO: 322140 - RNA, 32 nt, Human
aggauagccucgcuucccaggugcagcucccg

SEQ ID NO: 322141 - RNA, 32 nt, Human
aggauaggaagagaaggagaugcucacagaua

SEQ ID NO: 322142 - RNA, 32 nt, Human
aggauaggagaagaggaggaggaggagcgggg

SEQ ID NO: 322143 - RNA, 32 nt, Human
aggauaggaguucacuucaucuucucagcucc

SEQ ID NO: 322144 - RNA, 32 nt, Human
aggauaggaguuugagguugcagucagcuaug

SEQ ID NO: 322145 - RNA, 32 nt, Human
aggauagggaauggggaggucagaggacgcaa

SEQ ID NO: 322146 - RNA, 32 nt, Human
aggauagucucgaucuccugaccucgugaucu

SEQ ID NO: 322147 - RNA, 32 nt, Human
aggauagucuugaucuccugaccucaugaucc

SEQ ID NO: 322148 - RNA, 32 nt, Human
aggauagucuugaucuccugaccucgugaucc

SEQ ID NO: 322149 - RNA, 25 nt, Human
aggauaguuucagugguuccuggga

SEQ ID NO: 322150 - RNA, 32 nt, Human
aggauauaugaaaagggaccagcuggaagacu

SEQ ID NO: 322151 - RNA, 32 nt, Human
aggauauaugcccacccccacuggggcgaagg

SEQ ID NO: 322152 - RNA, 32 nt, Human
aggauaucaagaaaccagacugugaugacugg

SEQ ID NO: 322153 - RNA, 32 nt, Human
aggauaucacugaacucuucugccuucauaac

SEQ ID NO: 322154 - RNA, 32 nt, Human
aggauaucagcugccugaggagcugccacgga

SEQ ID NO: 322155 - RNA, 32 nt, Human
aggauaucugagaacaucccacccucaacuca

SEQ ID NO: 322156 - RNA, 32 nt, Human
aggauauuaugcauacugagcuagaccagaag

SEQ ID NO: 322157 - RNA, 32 nt, Human
aggauauucccaagccgaccuucccuccgccu

SEQ ID NO: 322158 - RNA, 19 nt, Human
aggauauucccagauggac

SEQ ID NO: 322159 - RNA, 32 nt, Human
aggauauucugcagcgcuucugucuuuuucuu

SEQ ID NO: 322160 - RNA, 32 nt, Human
aggauauuggacucugcuuagcauuuucaagc

SEQ ID NO: 322161 - RNA, 32 nt, Human
aggauauuucaggugagucaggguuggauggu

SEQ ID NO: 322162 - RNA, 32 nt, Human
aggaucaaaugagaugcuguguggaaagcccu

SEQ ID NO: 322163 - RNA, 32 nt, Human
aggaucaacggcagggaagacagagcagaggc

SEQ ID NO: 322164 - RNA, 32 nt, Human
aggaucacaaacucacagcacagugugugaug

SEQ ID NO: 322165 - RNA, 32 nt, Human
aggaucacaccacugcacuccagccuggacaa

SEQ ID NO: 322166 - RNA, 32 nt, Human
aggaucacaccauugcuguccagccuggguga

SEQ ID NO: 322167 - RNA, 32 nt, Human
aggaucacaucuaaugcuuguguccuuauacu

SEQ ID NO: 322168 - RNA, 32 nt, Human
aggaucacuaggaggcagagguugcagugagc

SEQ ID NO: 322169 - RNA, 32 nt, Human
aggaucacucaaggccaggagugcaagaccau

SEQ ID NO: 322170 - RNA, 32 nt, Human
aggaucacucuacagccugccuccuggguuuu

SEQ ID NO: 322171 - RNA, 32 nt, Human
aggaucacugaggaaggggaagugggcaaagc

SEQ ID NO: 322172 - RNA, 32 nt, Human
aggaucacugcacccagcccaaggucuugcca

SEQ ID NO: 322173 - RNA, 32 nt, Human
aggaucacuggaguucgaggcugcagugagcu

SEQ ID NO: 322174 - RNA, 32 nt, Human
aggaucacuggguggugaaagaaagaaacacu

SEQ ID NO: 322175 - RNA, 32 nt, Human
aggaucacuucuccuuggcuuccuucuuuucu

SEQ ID NO: 322176 - RNA, 32 nt, Human
aggaucacuugaaccugggaggcggagguugc

SEQ ID NO: 322177 - RNA, 32 nt, Human
aggaucacuugagcccagggaggcagagguug

SEQ ID NO: 322178 - RNA, 32 nt, Human
aggaucagccaagaucuugcucucauugcucg

SEQ ID NO: 322179 - RNA, 32 nt, Human
aggaucagccacgggauuccagccuuggucuu

SEQ ID NO: 322180 - RNA, 23 nt, Human
aggaucagccuggacagcccucu

SEQ ID NO: 322181 - RNA, 32 nt, Human
aggaucaggccacugcacuccagccuggguaa

SEQ ID NO: 322182 - RNA, 32 nt, Human
aggaucaggggugggaggggaggccccugagg

SEQ ID NO: 322183 - RNA, 32 nt, Human
aggaucagugccuggaaggcaggugugcccgu

SEQ ID NO: 322184 - RNA, 32 nt, Human
aggaucauaccaacaugcuccagccugaguga

SEQ ID NO: 322185 - RNA, 32 nt, Human
aggaucauauggcguauaucuugguucaucuu

SEQ ID NO: 322186 - RNA, 32 nt, Human
aggaucaucucuccaaacuuccuauucaugga

SEQ ID NO: 322187 - RNA, 32 nt, Human
aggaucaucugagccugggagggugaggaugc

SEQ ID NO: 322188 - RNA, 31 nt, Human
aggaucaugaccugcggaucaggauuuggug

SEQ ID NO: 322189 - RNA, 32 nt, Human
aggaucaugaggaucagguggaucaugaggau

SEQ ID NO: 322190 - RNA, 32 nt, Human
aggaucaugccacugcacuccagcuugggcga

SEQ ID NO: 322191 - RNA, 32 nt, Human
aggaucauuucgguuucagacuucaaaguuga

SEQ ID NO: 322192 - RNA, 32 nt, Human
aggauccaaacaguuaccauuaagccccaccu

SEQ ID NO: 322193 - RNA, 32 nt, Human
aggauccaacacaggcaauauuccagcuaugg

SEQ ID NO: 322194 - RNA, 32 nt, Human
aggauccacaucagguggccacgaggacuugc

SEQ ID NO: 322195 - RNA, 32 nt, Human
aggauccagacgcucccugccugucugcguag

SEQ ID NO: 322196 - RNA, 32 nt, Human
aggauccaucagaggagacaaaggacgaggac

SEQ ID NO: 322197 - RNA, 32 nt, Human
aggauccauuucucccuuacuuucagauuauu

SEQ ID NO: 322198 - RNA, 32 nt, Human
aggaucccacuccuguagcacacacagaggcu

SEQ ID NO: 322199 - RNA, 32 nt, Human
aggauccccagccaguauagagacuugguugg

SEQ ID NO: 322200 - RNA, 20 nt, Human
aggauccccagcuggacucc

SEQ ID NO: 322201 - RNA, 21 nt, Human
aggaucccgcccuguggcccg

SEQ ID NO: 322202 - RNA, 32 nt, Human
aggaucccuccccuuccgucuucuccacugga

SEQ ID NO: 322203 - RNA, 25 nt, Human
aggauccgauuaugcgccccugggg

SEQ ID NO: 322204 - RNA, 26 nt, Human
aggauccggcccgccgccccccgggg

SEQ ID NO: 322205 - RNA, 25 nt, Human
aggauccgguguuccaacccagggg

SEQ ID NO: 322206 - RNA, 32 nt, Human
aggauccucagccauguucaagugaaguaagc

SEQ ID NO: 322207 - RNA, 32 nt, Human
aggauccuccacugaugguaaaaucugaggau

SEQ ID NO: 322208 - RNA, 32 nt, Human
aggauccucuucaaaaaggaagggauagugga

SEQ ID NO: 322209 - RNA, 32 nt, Human
aggauccugaugcugugacugaggccauuucc

SEQ ID NO: 322210 - RNA, 20 nt, Human
aggauccugauuccucuuca

SEQ ID NO: 322211 - RNA, 32 nt, Human
aggauccugcgggguggagcaggcuggagcua

SEQ ID NO: 322212 - RNA, 32 nt, Human
aggauccuguucugagcugggucaaacaaagc

SEQ ID NO: 322213 - RNA, 32 nt, Human
aggauccuuccuaucucuccaugggacuagac

SEQ ID NO: 322214 - RNA, 32 nt, Human
aggauccuugagcccaggagguugaggcugca

SEQ ID NO: 322215 - RNA, 32 nt, Human
aggaucgcagggagaggccguauuauuagccu

SEQ ID NO: 322216 - RNA, 32 nt, Human
aggaucgccugggaggugaggugugugugacc

SEQ ID NO: 322217 - RNA, 32 nt, Human
aggaucgcgccauugcacuccagccugggcaa

SEQ ID NO: 322218 - RNA, 32 nt, Human
aggaucgcuugaaccugggaggcggagguucc

SEQ ID NO: 322219 - RNA, 32 nt, Human
aggaucgcuugagaccagccuggggaacauag

SEQ ID NO: 322220 - RNA, 32 nt, Human
aggaucgcuugagcccaggagucuugagacca

SEQ ID NO: 322221 - RNA, 32 nt, Human
aggaucgcuugagccugggagguggagguugc

SEQ ID NO: 322222 - RNA, 32 nt, Human
aggaucgcuugggccugggaggcggagguugc

SEQ ID NO: 322223 - RNA, 26 nt, Human
aggaucggaaccuucugcagcaaugg

SEQ ID NO: 322224 - RNA, 25 nt, Human
aggaucggcccccaccauccaggca

SEQ ID NO: 322225 - RNA, 32 nt, Human
aggaucgucucaggucagcggagggaggagac

SEQ ID NO: 322226 - RNA, 32 nt, Human
aggaucgucuugagcccaggaguucaagacca

SEQ ID NO: 322227 - RNA, 32 nt, Human
aggaucgugccacugcacuccaaccuggguga

SEQ ID NO: 322228 - RNA, 17 nt, Human
aggaucuaaggcacaau

SEQ ID NO: 322229 - RNA, 32 nt, Human
aggaucuacugagccucgucuuaguuaaucug

SEQ ID NO: 322230 - RNA, 32 nt, Human
aggaucuacugaggaaggugcaaggcuagaga

SEQ ID NO: 322231 - RNA, 32 nt, Human
aggaucuagcagugggacuagauuuggguaga

SEQ ID NO: 322232 - RNA, 32 nt, Human
aggaucuaggagaggggcuugggagcccacuu

SEQ ID NO: 322233 - RNA, 32 nt, Human
aggaucuaggagagugacugggugugccaaaa

SEQ ID NO: 322234 - RNA, 32 nt, Human
aggaucuaguuucuuucucucuacucuggcuu

SEQ ID NO: 322235 - RNA, 32 nt, Human
aggaucucacccagugcugacagcuccucuuu

SEQ ID NO: 322236 - RNA, 23 nt, Human
aggaucucagcauauuucuggaa

SEQ ID NO: 322237 - RNA, 32 nt, Human
aggaucucagcauugcacaaugccucauggaa

SEQ ID NO: 322238 - RNA, 32 nt, Human
aggaucuccacuggacccuugauucauucuga

SEQ ID NO: 322239 - RNA, 32 nt, Human
aggaucuccaucugucacccaggcuggugugc

SEQ ID NO: 322240 - RNA, 25 nt, Human
aggaucucgcucugucacccaggca

SEQ ID NO: 322241 - RNA, 32 nt, Human
aggaucucugccugccuuccugccguccuucc

SEQ ID NO: 322242 - RNA, 32 nt, Human
aggaucucuugaggcugggaggcagagguugc

SEQ ID NO: 322243 - RNA, 22 nt, Human
aggaucugaccgcagucccggg

SEQ ID NO: 322244 - RNA, 32 nt, Human
aggaucugagagccaugucggccagcagccuc

SEQ ID NO: 322245 - RNA, 32 nt, Human
aggaucuggagagcugcuggagaacaccaugg

SEQ ID NO: 322246 - RNA, 32 nt, Human
aggaucugggaaugggguggagaggacauccu

SEQ ID NO: 322247 - RNA, 32 nt, Human
aggaucugggagggacaaguugcauugugaug

SEQ ID NO: 322248 - RNA, 32 nt, Human
aggaucugggcugguuugucuggggagacaga

SEQ ID NO: 322249 - RNA, 32 nt, Human
aggaucuggggacgaggucacccuggauugag

SEQ ID NO: 322250 - RNA, 23 nt, Human
aggaucuggggcauugcccuagg

SEQ ID NO: 322251 - RNA, 32 nt, Human
aggaucuggguucgucucugcagcugccuacc

SEQ ID NO: 322252 - RNA, 32 nt, Human
aggaucugguaguacagacagugugauggaug

SEQ ID NO: 322253 - RNA, 24 nt, Human
aggaucuggucgcugccccagggg

SEQ ID NO: 322254 - RNA, 19 nt, Human
aggaucuggugggccucag

SEQ ID NO: 322255 - RNA, 32 nt, Human
aggaucuguacgagaaaaacaaaaaggaaauc

SEQ ID NO: 322256 - RNA, 32 nt, Human
aggaucugugccaggccauucgcaccagccac

SEQ ID NO: 322257 - RNA, 32 nt, Human
aggaucuguguuuggugaaaaggagccaaauu

SEQ ID NO: 322258 - RNA, 32 nt, Human
aggaucuguucuguuucaccauguaacacaca

SEQ ID NO: 322259 - RNA, 32 nt, Human
aggaucuucugccuccgccagccugugagcug

SEQ ID NO: 322260 - RNA, 22 nt, Human
aggaucuugacuugcccagggg

SEQ ID NO: 322261 - RNA, 32 nt, Human
aggaucuugcccuaaaacgugcagugcagaga

SEQ ID NO: 322262 - RNA, 32 nt, Human
aggaucuuggauaggaucaucucuccaaacuu

SEQ ID NO: 322263 - RNA, 32 nt, Human
aggaucuuggggagguggccgggugcaguggc

SEQ ID NO: 322264 - RNA, 32 nt, Human
aggaucuuuggaugagucuccuuaauucauuu

SEQ ID NO: 322265 - RNA, 32 nt, Human
aggaugaaaagauggcacagucagugcuggua

SEQ ID NO: 322266 - RNA, 32 nt, Human
aggaugaagcagaucugcuguagacuuuucag

SEQ ID NO: 322267 - RNA, 32 nt, Human
aggaugaagggaagggagagccagugacgacu

SEQ ID NO: 322268 - RNA, 32 nt, Human
aggaugaagggcccgagaacauggccuaaggg

SEQ ID NO: 322269 - RNA, 32 nt, Human
aggaugaaugggaaaguauuuuugaaagaauu

SEQ ID NO: 322270 - RNA, 21 nt, Human
aggaugacacacuucauguca

SEQ ID NO: 322271 - RNA, 32 nt, Human
aggaugacacuggccccagagaugcuagaguc

SEQ ID NO: 322272 - RNA, 28 nt, Human
aggaugacagaacaggagacccuggccc

SEQ ID NO: 322273 - RNA, 32 nt, Human
aggaugaccucuucagcuucuggggcccgggg

SEQ ID NO: 322274 - RNA, 32 nt, Human
aggaugacgugcagaaaaaugggugaaggaua

SEQ ID NO: 322275 - RNA, 32 nt, Human
aggaugacugggccucugccccuugugggugu

SEQ ID NO: 322276 - RNA, 32 nt, Human
aggaugacuucugcucuucuauggcaauacuu

SEQ ID NO: 322277 - RNA, 32 nt, Human
aggaugagagaagcaagagcaaacacauucaa

SEQ ID NO: 322278 - RNA, 32 nt, Human
aggaugagagaaggggaaccagaagcuccgga

SEQ ID NO: 322279 - RNA, 32 nt, Human
aggaugagagcagagacucagugugugggugu

SEQ ID NO: 322280 - RNA, 32 nt, Human
aggaugagagcugucugucucuuaccugccug

SEQ ID NO: 322281 - RNA, 32 nt, Human
aggaugagauccagauguuaaaagccaauggu

SEQ ID NO: 322282 - RNA, 32 nt, Human
aggaugagccuggggucacagggggugucggg

SEQ ID NO: 322283 - RNA, 32 nt, Human
aggaugaggagcuuaggggagagcagaaaauu

SEQ ID NO: 322284 - RNA, 32 nt, Human
aggaugaggaggaggaaggugaagaggaggac

SEQ ID NO: 322285 - RNA, 32 nt, Human
aggaugaggggcuggaaaauuggggucauuga

SEQ ID NO: 322286 - RNA, 32 nt, Human
aggaugaucacauuuuucugccuguguacuuu

SEQ ID NO: 322287 - RNA, 32 nt, Human
aggaugaucaugggagggagcucagggguuaa

SEQ ID NO: 322288 - RNA, 32 nt, Human
aggaugaucucgaucuccugaccucaugaucc

SEQ ID NO: 322289 - RNA, 28 nt, Human
aggaugaugccccagcugcaguucaaag

SEQ ID NO: 322290 - RNA, 21 nt, Human
aggaugauugccgcccagggg

SEQ ID NO: 322291 - RNA, 32 nt, Human
aggaugauuuccugucaagguuggcugcagag

SEQ ID NO: 322292 - RNA, 32 nt, Human
aggaugcaacugcccaaaaaugggucuaaagu

SEQ ID NO: 322293 - RNA, 32 nt, Human
aggaugcacuguauagccaggcugugggagga

SEQ ID NO: 322294 - RNA, 21 nt, Human
aggaugcagcuggccccaggg

SEQ ID NO: 322295 - RNA, 32 nt, Human
aggaugcagggcuggugucacaggugugugac

SEQ ID NO: 322296 - RNA, 32 nt, Human
aggaugcaggggccaugcauucaucccagcac

SEQ ID NO: 322297 - RNA, 19 nt, Human
aggaugcaggucccagcca

SEQ ID NO: 322298 - RNA, 32 nt, Human
aggaugcauacagcuguaauuuaacccagagc

SEQ ID NO: 322299 - RNA, 32 nt, Human
aggaugcaugagccaugauuacgccacugcau

SEQ ID NO: 322300 - RNA, 28 nt, Human
aggaugccacagcugagccuguccucgc

SEQ ID NO: 322301 - RNA, 32 nt, Human
aggaugcccacuucccuccacccccacacccc

SEQ ID NO: 322302 - RNA, 32 nt, Human
aggaugccccaggugggggaccccaaaaccuc

SEQ ID NO: 322303 - RNA, 32 nt, Human
aggaugccccgucccccucuggcuccagcugg

SEQ ID NO: 322304 - RNA, 32 nt, Human
aggaugcccgcgcucaggugguugcagaaguc

SEQ ID NO: 322305 - RNA, 32 nt, Human
aggaugcccucucuccccuuugcccagcaaga

SEQ ID NO: 322306 - RNA, 25 nt, Human
aggaugccgcgcagaagccgugugg

SEQ ID NO: 322307 - RNA, 32 nt, Human
aggaugccucucucacacuuguauucucgaca

SEQ ID NO: 322308 - RNA, 32 nt, Human
aggaugccugauacaagaccgucugcaguguu

SEQ ID NO: 322309 - RNA, 32 nt, Human
aggaugccuggacugcagagcccuugcuccgu

SEQ ID NO: 322310 - RNA, 32 nt, Human
aggaugcggcuuucucugccucugggcagccu

SEQ ID NO: 322311 - RNA, 32 nt, Human
aggaugcggggagguguggaggugagggguua

SEQ ID NO: 322312 - RNA, 32 nt, Human
aggaugcuaagcuuccuacucacuuucuccua

SEQ ID NO: 322313 - RNA, 32 nt, Human
aggaugcucaucauaugggccuaaaaccuugg

SEQ ID NO: 322314 - RNA, 32 nt, Human
aggaugcuccaagcucuauccuccccgggucc

SEQ ID NO: 322315 - RNA, 32 nt, Human
aggaugcucucgaacuccugaccucgugaucu

SEQ ID NO: 322316 - RNA, 32 nt, Human
aggaugcugaggaagccagcgaggaggccccu

SEQ ID NO: 322317 - RNA, 28 nt, Human
aggaugcugccugggcggcugugcuggg

SEQ ID NO: 322318 - RNA, 32 nt, Human
aggaugcuucccagccucuccucaguuuccca

SEQ ID NO: 322319 - RNA, 32 nt, Human
aggaugcuucugcucucccugcucuggcaucc

SEQ ID NO: 322320 - RNA, 32 nt, Human
aggaugcuuuucugcuuaccauggcccggaua

SEQ ID NO: 322321 - RNA, 32 nt, Human
aggauggaaaaggggacucucaagaagagaaa

SEQ ID NO: 322322 - RNA, 32 nt, Human
aggauggaacucagaaugaaacugcaacccac

SEQ ID NO: 322323 - RNA, 32 nt, Human
aggauggaaggcagaggguggguguggggccu

SEQ ID NO: 322324 - RNA, 32 nt, Human
aggauggaaugaagguagaaaaggcagaauua

SEQ ID NO: 322325 - RNA, 32 nt, Human
aggauggaauucuuccuccucugcugggacuc

SEQ ID NO: 322326 - RNA, 28 nt, Human
aggauggacccaggagaucccgcuggug

SEQ ID NO: 322327 - RNA, 32 nt, Human
aggauggacccccaugauccccaccuccuggu

SEQ ID NO: 322328 - RNA, 32 nt, Human
aggauggacgagugagcuaccaggaagagggg

SEQ ID NO: 322329 - RNA, 32 nt, Human
aggauggagauggagacccagcagcccccaga

SEQ ID NO: 322330 - RNA, 32 nt, Human
aggauggagaugguuuugcccucccucucugc

SEQ ID NO: 322331 - RNA, 32 nt, Human
aggauggagcaaugguucucaaacuucagcca

SEQ ID NO: 322332 - RNA, 32 nt, Human
aggauggagcccagagugacacagaggaagag

SEQ ID NO: 322333 - RNA, 28 nt, Human
aggauggaggcagagggcagcagcgcgc

SEQ ID NO: 322334 - RNA, 32 nt, Human
aggauggaggcuggacugugugguaguuuuac

SEQ ID NO: 322335 - RNA, 28 nt, Human
aggauggaggcuguugugaacuuguacc

SEQ ID NO: 322336 - RNA, 32 nt, Human
aggauggagggcugagcccugugacaaccugc

SEQ ID NO: 322337 - RNA, 23 nt, Human
aggauggagggguccacauacua

SEQ ID NO: 322338 - RNA, 32 nt, Human
aggauggagguggaaggcuggagggcaggggu

SEQ ID NO: 322339 - RNA, 32 nt, Human
aggauggaugcagauccagagguuucuggcag

SEQ ID NO: 322340 - RNA, 32 nt, Human
aggauggcacaauugcacuccagcccgaguga

SEQ ID NO: 322341 - RNA, 32 nt, Human
aggauggcagaacugguccucugcaagaaaca

SEQ ID NO: 322342 - RNA, 32 nt, Human
aggauggcagaauucuguaaaaccacuucugg

SEQ ID NO: 322343 - RNA, 28 nt, Human
aggauggccaaggaaagaugccugaaaa

SEQ ID NO: 322344 - RNA, 28 nt, Human
aggauggccagccuguuccgguccuauc

SEQ ID NO: 322345 - RNA, 32 nt, Human
aggauggcccagcugcccuagugugugcuugc

SEQ ID NO: 322346 - RNA, 21 nt, Human
aggauggcccagggugaggug

SEQ ID NO: 322347 - RNA, 32 nt, Human
aggauggccugagaguccuuccuugcugaaaa

SEQ ID NO: 322348 - RNA, 32 nt, Human
aggauggcuggcucugcaccuguaggauauug

SEQ ID NO: 322349 - RNA, 32 nt, Human
aggauggcuuuuccugcuguacugaaccugcu

SEQ ID NO: 322350 - RNA, 28 nt, Human
aggaugggaaccggauugguugcagugu

SEQ ID NO: 322351 - RNA, 20 nt, Human
aggaugggaaggagggaggu

SEQ ID NO: 322352 - RNA, 32 nt, Human
aggaugggaagguggagugggugagcaucuug

SEQ ID NO: 322353 - RNA, 32 nt, Human
aggaugggacaacuccaucuucugcugcccau

SEQ ID NO: 322354 - RNA, 32 nt, Human
aggaugggacuuccagcuaugaauuuguacau

SEQ ID NO: 322355 - RNA, 32 nt, Human
aggaugggagaaugauuuggcccacacaagga

SEQ ID NO: 322356 - RNA, 32 nt, Human
aggaugggagagaacaggagggaagaugggaa

SEQ ID NO: 322357 - RNA, 22 nt, Human
aggaugggagaggccgcaggug

SEQ ID NO: 322358 - RNA, 22 nt, Human
aggaugggagcccuggaguggg

SEQ ID NO: 322359 - RNA, 23 nt, Human
aggaugggagcugagggggaagg

SEQ ID NO: 322360 - RNA, 24 nt, Human
aggaugggagcugggcgugaggug

SEQ ID NO: 322361 - RNA, 32 nt, Human
aggaugggagcugggcgugaggugcuuugggg

SEQ ID NO: 322362 - RNA, 32 nt, Human
aggaugggagugaaucccaggcggaggccaga

SEQ ID NO: 322363 - RNA, 22 nt, Human
aggaugggagugggcagaggug

SEQ ID NO: 322364 - RNA, 19 nt, Human
aggaugggccauccaggca

SEQ ID NO: 322365 - RNA, 28 nt, Human
aggaugggccggaaggugaccguggcca

SEQ ID NO: 322366 - RNA, 32 nt, Human
aggaugggccucaaacuccuagcuucaagcag

SEQ ID NO: 322367 - RNA, 32 nt, Human
aggaugggcugcagguugcagucagggcuuga

SEQ ID NO: 322368 - RNA, 32 nt, Human
aggaugggcugcuccugggccuggugagcuac

SEQ ID NO: 322369 - RNA, 32 nt, Human
aggauggggaggcagggcugggggcuuugagg

SEQ ID NO: 322370 - RNA, 32 nt, Human
aggauggggaggugggcagguagcugauaggg

SEQ ID NO: 322371 - RNA, 32 nt, Human
aggauggggaugggaaagaaggugugcguucu

SEQ ID NO: 322372 - RNA, 21 nt, Human
aggcgugagccacccugacug

SEQ ID NO: 322373 - RNA, 22 nt, Human
aggcgugagccaccgcacccgg

SEQ ID NO: 322374 - RNA, 22 nt, Human
aggcgugagccaccgcaccugg

SEQ ID NO: 322375 - RNA, 21 nt, Human
aggcgugagccaccgcacugg

SEQ ID NO: 322376 - RNA, 22 nt, Human
aggcgugagccaccgcaucugg

SEQ ID NO: 322377 - RNA, 19 nt, Human
aggcgugagccaccgcgcc

SEQ ID NO: 322378 - RNA, 24 nt, Human
aggcgugagccaccgcgcccccgg

SEQ ID NO: 322379 - RNA, 21 nt, Human
aggcgugagccaccgcgcccg

SEQ ID NO: 322380 - RNA, 22 nt, Human
aggcgugagccaccgcgcccgg

SEQ ID NO: 322381 - RNA, 21 nt, Human
aggcgugagccaccgcgccgg

SEQ ID NO: 322382 - RNA, 22 nt, Human
aggcgugagccaccgcgccugg

SEQ ID NO: 322383 - RNA, 23 nt, Human
aggcgugagccaccgcgccuggu

SEQ ID NO: 322384 - RNA, 24 nt, Human
aggcgugagccaccgcgccugucc

SEQ ID NO: 322385 - RNA, 20 nt, Human
aggcgugagccaccgcggcc

SEQ ID NO: 322386 - RNA, 20 nt, Human
aggcgugagccaccgcgucc

SEQ ID NO: 322387 - RNA, 22 nt, Human
aggcgugagccaccgcguccgg

SEQ ID NO: 322388 - RNA, 19 nt, Human
aggcgugagccaccgcucc

SEQ ID NO: 322389 - RNA, 22 nt, Human
aggcgugagccaccgcuccugg

SEQ ID NO: 322390 - RNA, 22 nt, Human
aggcgugagccaccguacccgg

SEQ ID NO: 322391 - RNA, 19 nt, Human
aggcgugagccaccgugcc

SEQ ID NO: 322392 - RNA, 20 nt, Human
aggcgugagccaccgugccc

SEQ ID NO: 322393 - RNA, 24 nt, Human
aggcgugagccaccgugcccccgg

SEQ ID NO: 322394 - RNA, 22 nt, Human
aggcgugagccaccgugcccgg

SEQ ID NO: 322395 - RNA, 22 nt, Human
aggcgugagccaccgugccugg

SEQ ID NO: 322396 - RNA, 20 nt, Human
aggcgugagccaccgugcuc

SEQ ID NO: 322397 - RNA, 21 nt, Human
aggcgugagccaccgugcugg

SEQ ID NO: 322398 - RNA, 22 nt, Human
aggcgugagccaccucaccagg

SEQ ID NO: 322399 - RNA, 20 nt, Human
aggcgugagccaccuugccc

SEQ ID NO: 322400 - RNA, 32 nt, Human
aggcgugagccacggcauccagccucaucuuu

SEQ ID NO: 322401 - RNA, 32 nt, Human
aggcgugagccacuacacccagccaaucaguu

SEQ ID NO: 322402 - RNA, 22 nt, Human
aggcgugagccacucugcccgg

SEQ ID NO: 322403 - RNA, 22 nt, Human
aggcgugagccacugagcccgg

SEQ ID NO: 322404 - RNA, 32 nt, Human
aggcgugagccacugcacccagccuagaaucu

SEQ ID NO: 322405 - RNA, 32 nt, Human
aggcgugagccacugcacccagccuauucuau

SEQ ID NO: 322406 - RNA, 32 nt, Human
aggcgugagccacugcacccagccucauguug

SEQ ID NO: 322407 - RNA, 32 nt, Human
aggcgugagccacugcacccagccugggagag

SEQ ID NO: 322408 - RNA, 21 nt, Human
aggcgugagccacugcacccg

SEQ ID NO: 322409 - RNA, 22 nt, Human
aggcgugagccacugcacccgg

SEQ ID NO: 322410 - RNA, 32 nt, Human
aggcgugagccacugcacccggccuaauuucu

SEQ ID NO: 322411 - RNA, 32 nt, Human
aggcgugagccacugcaccuggccugacauuc

SEQ ID NO: 322412 - RNA, 22 nt, Human
aggcgugagccacugcgcccgg

SEQ ID NO: 322413 - RNA, 20 nt, Human
aggcgugagccacugcgucc

SEQ ID NO: 322414 - RNA, 19 nt, Human
aggcgugagccacugcucc

SEQ ID NO: 322415 - RNA, 21 nt, Human
aggcgugagccacugcucgug

SEQ ID NO: 322416 - RNA, 19 nt, Human
aggcgugagccacuggcgg

SEQ ID NO: 322417 - RNA, 20 nt, Human
aggcgugagccacugugccc

SEQ ID NO: 322418 - RNA, 22 nt, Human
aggcgugagccacugugcccgg

SEQ ID NO: 322419 - RNA, 20 nt, Human
aggcgugagccacuguggcc

SEQ ID NO: 322420 - RNA, 20 nt, Human
aggcgugagccacugugucc

SEQ ID NO: 322421 - RNA, 21 nt, Human
aggcgugagccacuuacccgg

SEQ ID NO: 322422 - RNA, 22 nt, Human
aggcgugagccagugugcccgg

SEQ ID NO: 322423 - RNA, 20 nt, Human
aggcgugagccaucgugccc

SEQ ID NO: 322424 - RNA, 32 nt, Human
aggcgugagccauggcgcccagccugggccaa

SEQ ID NO: 322425 - RNA, 32 nt, Human
aggcgugagccccagcacuaggugggaaggcu

SEQ ID NO: 322426 - RNA, 20 nt, Human
aggcgugagcccccgugccc

SEQ ID NO: 322427 - RNA, 22 nt, Human
aggcgugagccccugcacccgg

SEQ ID NO: 322428 - RNA, 22 nt, Human
aggcgugagccccugcgcccgg

SEQ ID NO: 322429 - RNA, 22 nt, Human
aggcgugagccgccgugcccgg

SEQ ID NO: 322430 - RNA, 22 nt, Human
aggcgugagccuccgcgcccgg

SEQ ID NO: 322431 - RNA, 32 nt, Human
aggcgugagcuaccaccaugccuggcuuccau

SEQ ID NO: 322432 - RNA, 22 nt, Human
aggcgugagcuaccaugcccgg

SEQ ID NO: 322433 - RNA, 20 nt, Human
aggcgugagcuacugugccc

SEQ ID NO: 322434 - RNA, 22 nt, Human
aggcgugaggcaccgcgcccgg

SEQ ID NO: 322435 - RNA, 22 nt, Human
aggcgugagucaccgcgcccgg

SEQ ID NO: 322436 - RNA, 20 nt, Human
aggcgugagucaccgugccc

SEQ ID NO: 322437 - RNA, 32 nt, Human
aggcgugcaccacugaguccagccuauauucu

SEQ ID NO: 322438 - RNA, 32 nt, Human
aggcgugcaccacugcgccuagcuccaguacc

SEQ ID NO: 322439 - RNA, 32 nt, Human
aggcgugcugccgaaaauuuccacucuguuua

SEQ ID NO: 322440 - RNA, 32 nt, Human
aggcguggagaagagggagggagcgagagcga

SEQ ID NO: 322441 - RNA, 32 nt, Human
aggcguggauccuggcacgcugagccucaggc

SEQ ID NO: 322442 - RNA, 32 nt, Human
aggcguggcagaauugggcagggcaagggccc

SEQ ID NO: 322443 - RNA, 32 nt, Human
aggcguggccuuccaucacaggaacagagacu

SEQ ID NO: 322444 - RNA, 32 nt, Human
aggcgugggaggccgaguccccaguggcgagc

SEQ ID NO: 322445 - RNA, 32 nt, Human
aggcgugggucuggggcugagggccagggccc

SEQ ID NO: 322446 - RNA, 32 nt, Human
aggcguggguggccuagaagaugaggggagug

SEQ ID NO: 322447 - RNA, 32 nt, Human
aggcgugguggcucaaaugccuguaaucccag

SEQ ID NO: 322448 - RNA, 23 nt, Human
aggcgugguggcucauguaugua

SEQ ID NO: 322449 - RNA, 32 nt, Human
aggcguggugggcaccuguauucccagcuacu

SEQ ID NO: 322450 - RNA, 32 nt, Human
aggcgugguguuucugcuggauccgguuucau

SEQ ID NO: 322451 - RNA, 32 nt, Human
aggcgugguuguggccuguaaucccagcuacu

SEQ ID NO: 322452 - RNA, 24 nt, Human
aggcgugugagccaccacgcccgg

SEQ ID NO: 322453 - RNA, 32 nt, Human
aggcgugugggugcccccuuucugccagcagu

SEQ ID NO: 322454 - RNA, 32 nt, Human
aggcguucaacaccagccuggccaacauggaa

SEQ ID NO: 322455 - RNA, 32 nt, Human
aggcguucaagaccagccuggccaacauggug

SEQ ID NO: 322456 - RNA, 32 nt, Human
aggcguucaagaccagccugggcaacagaaca

SEQ ID NO: 322457 - RNA, 32 nt, Human
aggcguucaauaccagccuggccaacauggug

SEQ ID NO: 322458 - RNA, 32 nt, Human
aggcguuccagaccagccugggcaacauagug

SEQ ID NO: 322459 - RNA, 32 nt, Human
aggcguuccucagagucacagggaauggcggc

SEQ ID NO: 322460 - RNA, 32 nt, Human
aggcguucgagaccagccugggcaacauagug

SEQ ID NO: 322461 - RNA, 32 nt, Human
aggcguucgggaccagccuggccaacaugaug

SEQ ID NO: 322462 - RNA, 32 nt, Human
aggcguugcaaggagcuagagcuggauaaugg

SEQ ID NO: 322463 - RNA, 32 nt, Human
aggcguuggcugccugcccuccaggggagaca

SEQ ID NO: 322464 - RNA, 32 nt, Human
aggcguuggggagggguggcgggggaauagcg

SEQ ID NO: 322465 - RNA, 32 nt, Human
aggcguugguaucuucauuuuacaguucauua

SEQ ID NO: 322466 - RNA, 32 nt, Human
aggcguuuaagaccagcuugaccaacauggug

SEQ ID NO: 322467 - RNA, 32 nt, Human
aggcguuugaaccugggcaacuccaccuggaa

SEQ ID NO: 322468 - RNA, 32 nt, Human
aggcguuugagaccagccuggccaacauggug

SEQ ID NO: 322469 - RNA, 19 nt, Human
aggcuaaaaauauugcagg

SEQ ID NO: 322470 - RNA, 32 nt, Human
aggcuaaaagcagagucagcuugauuucaagg

SEQ ID NO: 322471 - RNA, 32 nt, Human
aggcuaaaagccuuugaacaccacgcuguagu

SEQ ID NO: 322472 - RNA, 32 nt, Human
aggcuaaagaugaagcuacaagaaauaaguug

SEQ ID NO: 322473 - RNA, 32 nt, Human
aggcuaaaggcggccagguuugcagugcggga

SEQ ID NO: 322474 - RNA, 32 nt, Human
aggcuaaaucaguuuuauuguccucugauuuu

SEQ ID NO: 322475 - RNA, 32 nt, Human
aggcuaaaucuuuguaacagcucucuuucccc

SEQ ID NO: 322476 - RNA, 32 nt, Human
aggcuaaaugugcagcucuuucuccagguggg

SEQ ID NO: 322477 - RNA, 32 nt, Human
aggcuaacauuucggaguaggugcagaauguu

SEQ ID NO: 322478 - RNA, 32 nt, Human
aggcuaaccugcucaaaggauaccaaauaaug

SEQ ID NO: 322479 - RNA, 32 nt, Human
aggcuaagaaacgccaggucugccuguucuug

SEQ ID NO: 322480 - RNA, 32 nt, Human
aggcuaagacacacuccccacuucacuuucuu

SEQ ID NO: 322481 - RNA, 32 nt, Human
aggcuaagacaggcagaucaccugagcucagg

SEQ ID NO: 322482 - RNA, 32 nt, Human
aggcuaagaggugggauuugagcugagacuug

SEQ ID NO: 322483 - RNA, 32 nt, Human
aggcuaagcccagaggagagcaauggcacauu

SEQ ID NO: 322484 - RNA, 32 nt, Human
aggcuaagcccaguucaaggcugcagugaacu

SEQ ID NO: 322485 - RNA, 32 nt, Human
aggcuaagcgugcccacuggggccugugguca

SEQ ID NO: 322486 - RNA, 23 nt, Human
aggcuaaggcaggaggauugcuu

SEQ ID NO: 322487 - RNA, 20 nt, Human
aggcuaaggcagguggauca

SEQ ID NO: 322488 - RNA, 32 nt, Human
aggcuaaggccaucccaauccccggggccaag

SEQ ID NO: 322489 - RNA, 24 nt, Human
aggcuaaggcgggagaaucacuug

SEQ ID NO: 322490 - RNA, 32 nt, Human
aggcuaaggcgggaggaugacuugaggccagg

SEQ ID NO: 322491 - RNA, 32 nt, Human
aggcuaaucuugaacuugugaccucaggugau

SEQ ID NO: 322492 - RNA, 32 nt, Human
aggcuaaucuuucucuuuccagugucuuagac

SEQ ID NO: 322493 - RNA, 32 nt, Human
aggcuacaauacucaaguaacaagguuuggga

SEQ ID NO: 322494 - RNA, 32 nt, Human
aggcuacagcacacuccaccccacucucaggg

SEQ ID NO: 322495 - RNA, 32 nt, Human
aggcuacagcacuccagccugggcaacaagag

SEQ ID NO: 322496 - RNA, 32 nt, Human
aggcuacagcugcuaucacaugccgaacuuuc

SEQ ID NO: 322497 - RNA, 32 nt, Human
aggcuacagggcacuugucuucccugguggcu

SEQ ID NO: 322498 - RNA, 32 nt, Human
aggcuacaucacccaaaguagauguuagaaaa

SEQ ID NO: 322499 - RNA, 32 nt, Human
aggcuacccugacuaagccacaggguuggcau

SEQ ID NO: 322500 - RNA, 32 nt, Human
aggcuacuccuuccuguagagcagaaauugua

SEQ ID NO: 322501 - RNA, 32 nt, Human
aggcuacucucaaacuccugaccucaggugau

SEQ ID NO: 322502 - RNA, 32 nt, Human
aggcuacugugagccaugaucaugccacugca

SEQ ID NO: 322503 - RNA, 32 nt, Human
aggcuacuucuccccuccucuugccucccucc

SEQ ID NO: 322504 - RNA, 32 nt, Human
aggcuacuuuauuuucugaaaaggagggaguu

SEQ ID NO: 322505 - RNA, 32 nt, Human
aggcuacuuucuuguuuuagaggaagguacug

SEQ ID NO: 322506 - RNA, 32 nt, Human
aggcuagaaagagcagccagagaacuuuuuaa

SEQ ID NO: 322507 - RNA, 32 nt, Human
aggcuagagaagaggcuccucuucucaguguu

SEQ ID NO: 322508 - RNA, 32 nt, Human
aggcuagagccugggaaggaagugggggcccc

SEQ ID NO: 322509 - RNA, 32 nt, Human
aggcuagaggggucuuguucaaagcauccaac

SEQ ID NO: 322510 - RNA, 32 nt, Human
aggcuagaguaagcccugaucccgccagcacc

SEQ ID NO: 322511 - RNA, 32 nt, Human
aggcuagcccaggucguggaggcuggcaggcu

SEQ ID NO: 322512 - RNA, 32 nt, Human
aggcuagccccaaacuccugggcucaagugau

SEQ ID NO: 322513 - RNA, 32 nt, Human
aggcuagccuccagagccgauuuauuugagag

SEQ ID NO: 322514 - RNA, 32 nt, Human
aggcuagccucgaacuccugaacucaggugau

SEQ ID NO: 322515 - RNA, 32 nt, Human
aggcuagcuucugcuuuucugcccuggcugcu

SEQ ID NO: 322516 - RNA, 32 nt, Human
aggcuagcuuugaggaaaacagccugggcucu

SEQ ID NO: 322517 - RNA, 27 nt, Human
aggcuaggaaaggaugucucuggggug

SEQ ID NO: 322518 - RNA, 32 nt, Human
aggcuaggaaaggggagaagagccgaagacag

SEQ ID NO: 322519 - RNA, 32 nt, Human
aggcuaggaaguggccuagugcaagaugagcu

SEQ ID NO: 322520 - RNA, 32 nt, Human
aggcuaggagagaagggacugggguuacugac

SEQ ID NO: 322521 - RNA, 32 nt, Human
aggcuaggaguuagagaccacccugggcaaug

SEQ ID NO: 322522 - RNA, 32 nt, Human
aggcuaggcacggcaccagccugggaugccag

SEQ ID NO: 322523 - RNA, 26 nt, Human
aggcuaggcugaggucacucagcaga

SEQ ID NO: 322524 - RNA, 32 nt, Human
aggcuagggcuggggacagauaucuuguacuc

SEQ ID NO: 322525 - RNA, 32 nt, Human
aggcuaguauugaacuccuggccucaagcaau

SEQ ID NO: 322526 - RNA, 32 nt, Human
aggcuagucacgaacuccuaaccucaggugau

SEQ ID NO: 322527 - RNA, 32 nt, Human
aggcuagucacgaacuccugaccucgugaucc

SEQ ID NO: 322528 - RNA, 32 nt, Human
aggcuagucagccuccaugcuuucuucauuuu

SEQ ID NO: 322529 - RNA, 32 nt, Human
aggcuagucaugaacuccuggccucaagcgau

SEQ ID NO: 322530 - RNA, 32 nt, Human
aggcuaguccacucuucucugagcugcccugg

SEQ ID NO: 322531 - RNA, 32 nt, Human
aggcuagucuaagucugugcugucuuggcaug

SEQ ID NO: 322532 - RNA, 32 nt, Human
aggcuagucucaaaccccugaccuuagguggu

SEQ ID NO: 322533 - RNA, 23 nt, Human
aggcuagucucaaacucccgacc

SEQ ID NO: 322534 - RNA, 23 nt, Human
aggcuagucucaaacuccugacc

SEQ ID NO: 322535 - RNA, 32 nt, Human
aggcuagucucaaacuccugaccucaggugau

SEQ ID NO: 322536 - RNA, 32 nt, Human
aggcuagucucaaacuccugaccucaggugcu

SEQ ID NO: 322537 - RNA, 32 nt, Human
aggcuagucucaaacuccugaccuccagugau

SEQ ID NO: 322538 - RNA, 32 nt, Human
aggcuagucucaaacuccugacgucgugaucc

SEQ ID NO: 322539 - RNA, 32 nt, Human
aggcuagucucaaacuccugggcucaagcaau

SEQ ID NO: 322540 - RNA, 32 nt, Human
aggcuagucucaaacuccugggcucaagugau

SEQ ID NO: 322541 - RNA, 32 nt, Human
aggcuagucuccaacuccugggcucagaugag

SEQ ID NO: 322542 - RNA, 32 nt, Human
aggcuagucucgaacgccugaccucaggugau

SEQ ID NO: 322543 - RNA, 32 nt, Human
aggcuagucucgaacucaugaccucaagugau

SEQ ID NO: 322544 - RNA, 32 nt, Human
aggcuagucucgaacuccugaccucaggugau

SEQ ID NO: 322545 - RNA, 32 nt, Human
aggcuagucucgaacucgugaccgcaagcgau

SEQ ID NO: 322546 - RNA, 32 nt, Human
aggcuagucucgaauuccugggcucaagugau

SEQ ID NO: 322547 - RNA, 32 nt, Human
aggcuagucucgagcucgugaccucacgugau

SEQ ID NO: 322548 - RNA, 32 nt, Human
aggcuagucucgaucuccugaccucaggugau

SEQ ID NO: 322549 - RNA, 32 nt, Human
aggcuagucuggaacuccugagcucaagcagu

SEQ ID NO: 322550 - RNA, 32 nt, Human
aggcuagucuugaacuccugaccucaaaugac

SEQ ID NO: 322551 - RNA, 32 nt, Human
aggcuagucuugaacuccugaccucaagugau

SEQ ID NO: 322552 - RNA, 32 nt, Human
aggcuagucuugaacuccugaccucaggugau

SEQ ID NO: 322553 - RNA, 32 nt, Human
aggcuagucuugaacuccugaccuugugauuc

SEQ ID NO: 322554 - RNA, 32 nt, Human
aggcuagucuugaacuccugggcccaagcaau

SEQ ID NO: 322555 - RNA, 32 nt, Human
aggcuagucuugaacuccugggcucaagcgau

SEQ ID NO: 322556 - RNA, 32 nt, Human
aggcuagucuugaacuccugggcucgaaugau

SEQ ID NO: 322557 - RNA, 32 nt, Human
aggcuagucuugaacuccuggguucaagcagu

SEQ ID NO: 322558 - RNA, 32 nt, Human
aggcuagucuugaauuccugaccuccugaccu

SEQ ID NO: 322559 - RNA, 32 nt, Human
aggcuagugccucagagagaacuguacggggu

SEQ ID NO: 322560 - RNA, 32 nt, Human
aggcuaguggacggugugcagagcagauggag

SEQ ID NO: 322561 - RNA, 32 nt, Human
aggcuaguuucaaacuccugaccuuaggugau

SEQ ID NO: 322562 - RNA, 32 nt, Human
aggcuaguuucgaacuccugaccucaagugau

SEQ ID NO: 322563 - RNA, 24 nt, Human
aggcuauaaucccagguacucggg

SEQ ID NO: 322564 - RNA, 32 nt, Human
aggcuauagggaggcgagcaggugagggccag

SEQ ID NO: 322565 - RNA, 32 nt, Human
aggcuauaguaagcugagauuacgccacugca

SEQ ID NO: 322566 - RNA, 32 nt, Human
aggcuauagugugcuaugaucaugccugugaa

SEQ ID NO: 322567 - RNA, 32 nt, Human
aggcuauccaggcugcaguggagccuggugaa

SEQ ID NO: 322568 - RNA, 32 nt, Human
aggcuaugcagcagcagucgagagguggccac

SEQ ID NO: 322569 - RNA, 23 nt, Human
aggcuaugcagcagccacagcag

SEQ ID NO: 322570 - RNA, 30 nt, Human
aggcuauggaggcugugacagaugggggug

SEQ ID NO: 322571 - RNA, 32 nt, Human
aggcuauggagguggaguagcugaggcuuaga

SEQ ID NO: 322572 - RNA, 32 nt, Human
aggcuauggcuuggcacagcugcucuggaacc

SEQ ID NO: 322573 - RNA, 32 nt, Human
aggcuauucucgaacuccugaccucgugaucc

SEQ ID NO: 322574 - RNA, 32 nt, Human
aggcuauuguuggccagcccuggguggaggug

SEQ ID NO: 322575 - RNA, 32 nt, Human
aggcuauuuauuacugaauuaauuccagagcu

SEQ ID NO: 322576 - RNA, 23 nt, Human
aggcuauuugggacaggcuguug

SEQ ID NO: 322577 - RNA, 32 nt, Human
aggcuauuuuucccccugcauucuuucuguau

SEQ ID NO: 322578 - RNA, 32 nt, Human
aggcucaaaagaugcucccaccacagccuccc

SEQ ID NO: 322579 - RNA, 32 nt, Human
aggcucaaacuccugggcucaagugucuuccu

SEQ ID NO: 322580 - RNA, 32 nt, Human
aggcucaaaugaucuccucccaccucagccuc

SEQ ID NO: 322581 - RNA, 32 nt, Human
aggcucaaccugcacuuccuaggcagcuaccu

SEQ ID NO: 322582 - RNA, 23 nt, Human
aggcucaagagauccuccugccu

SEQ ID NO: 322583 - RNA, 23 nt, Human
aggcucaagcgauccucccgccu

SEQ ID NO: 322584 - RNA, 23 nt, Human
aggcucaagcgauccuccugccu

SEQ ID NO: 322585 - RNA, 18 nt, Human
aggcucacaggcugugcc

SEQ ID NO: 322586 - RNA, 32 nt, Human
aggcucaccacaaccucugccuuccagguuca

SEQ ID NO: 322587 - RNA, 32 nt, Human
aggcucaccuccugcccucaggaucccagagg

SEQ ID NO: 322588 - RNA, 32 nt, Human
aggcucaccuguuacucggccucccagaaaga

SEQ ID NO: 322589 - RNA, 32 nt, Human
aggcucaccuguuccugggacugucugagaug

SEQ ID NO: 322590 - RNA, 32 nt, Human
aggcucacgccuguaaucccagcacuuuggga

SEQ ID NO: 322591 - RNA, 32 nt, Human
aggcucacgggacagcugcaccucucagcguc

SEQ ID NO: 322592 - RNA, 32 nt, Human
aggcucacguggcccaggcuggugcgccccgc

SEQ ID NO: 322593 - RNA, 32 nt, Human
aggcucacuccaccuacauccccagucugcca

SEQ ID NO: 322594 - RNA, 32 nt, Human
aggcucacugcaaccucaaccuucugguuuca

SEQ ID NO: 322595 - RNA, 32 nt, Human
aggcucacugcaaccucagccuccugggcuca

SEQ ID NO: 322596 - RNA, 32 nt, Human
aggcucacugcaaccuccaccucccagguuca

SEQ ID NO: 322597 - RNA, 32 nt, Human
aggcucacugcaaccuccuucucccagguuca

SEQ ID NO: 322598 - RNA, 32 nt, Human
aggcucacugcaaccucugucuccaggguuga

SEQ ID NO: 322599 - RNA, 32 nt, Human
aggcucacugcaaccuucaccgcccagguuca

SEQ ID NO: 322600 - RNA, 32 nt, Human
aggcucacugcaacuuccgccucccggguuca

SEQ ID NO: 322601 - RNA, 32 nt, Human
aggcucacugcaacuucugccucccaugcuua

SEQ ID NO: 322602 - RNA, 32 nt, Human
aggcucacuuuuguuaagaugacuguaauucu

SEQ ID NO: 322603 - RNA, 32 nt, Human
aggcucagagagaccugguguugacucuggaa

SEQ ID NO: 322604 - RNA, 32 nt, Human
aggcucagagaucgagcuucuccucugaguuc

SEQ ID NO: 322605 - RNA, 32 nt, Human
aggcucagagggcuuaaauaaauuacucuagg

SEQ ID NO: 322606 - RNA, 32 nt, Human
aggcucagaggggcaaagucaccugcauggua

SEQ ID NO: 322607 - RNA, 32 nt, Human
aggcucagaucccagagggaugcaggagcccu

SEQ ID NO: 322608 - RNA, 32 nt, Human
aggcucagcagauguuuuucugccauuaggaa

SEQ ID NO: 322609 - RNA, 32 nt, Human
aggcucagccuggccagggccagaggccccuc

SEQ ID NO: 322610 - RNA, 32 nt, Human
aggcucagcucugcaucuugaggucccucuga

SEQ ID NO: 322611 - RNA, 32 nt, Human
aggcucagcuggagagggacggguugggacgc

SEQ ID NO: 322612 - RNA, 32 nt, Human
aggcucaggaguucaagaccagccuggccaac

SEQ ID NO: 322613 - RNA, 32 nt, Human
aggcucaggcagcccagucugaaagugaacug

SEQ ID NO: 322614 - RNA, 32 nt, Human
aggcucaggcaucccuggugaccugugguucu

SEQ ID NO: 322615 - RNA, 32 nt, Human
aggcucaggccuggcucucaggggcagaguca

SEQ ID NO: 322616 - RNA, 32 nt, Human
aggcucaggcgggaagaaggaggcaucgucca

SEQ ID NO: 322617 - RNA, 20 nt, Human
aggcucagggcucugcaaca

SEQ ID NO: 322618 - RNA, 32 nt, Human
aggcucagggcugccuccucgaguucuguggg

SEQ ID NO: 322619 - RNA, 32 nt, Human
aggcucaggucugaaggccagaauucuacagu

SEQ ID NO: 322620 - RNA, 32 nt, Human
aggcucaggugcuuccaucuguggugacugga

SEQ ID NO: 322621 - RNA, 32 nt, Human
aggcucagguugucauuugcucaaaucacaca

SEQ ID NO: 322622 - RNA, 32 nt, Human
aggcucaucuguguccgccuuucacuccacua

SEQ ID NO: 322623 - RNA, 23 nt, Human
aggcucaugccacccacccacca

SEQ ID NO: 322624 - RNA, 32 nt, Human
aggcucaugccuguaaucccagcacuuuggga

SEQ ID NO: 322625 - RNA, 32 nt, Human
aggcucaugccuguaauccuagcagcuuggga

SEQ ID NO: 322626 - RNA, 32 nt, Human
aggcucauuccuguaaucccagcucuuuggga

SEQ ID NO: 322627 - RNA, 32 nt, Human
aggcuccaauuuauauucaucuggggguucac

SEQ ID NO: 322628 - RNA, 32 nt, Human
aggcuccacagcccugcuggcuggucaccugc

SEQ ID NO: 322629 - RNA, 19 nt, Human
aggcuccacccagaggcca

SEQ ID NO: 322630 - RNA, 22 nt, Human
aggcuccacuccugggcuccau

SEQ ID NO: 322631 - RNA, 32 nt, Human
aggcuccacugcacuggcucauuccugccuca

SEQ ID NO: 322632 - RNA, 21 nt, Human
aggcuccacugggaccugcug

SEQ ID NO: 322633 - RNA, 32 nt, Human
aggcuccacuuguuagagccucggugaucacu

SEQ ID NO: 322634 - RNA, 32 nt, Human
aggcuccagcuccccucagaccuccucaucuc

SEQ ID NO: 322635 - RNA, 32 nt, Human
aggcuccaggcucaccuccugcccucaggauc

SEQ ID NO: 322636 - RNA, 21 nt, Human
aggcuccaggcugacuggggg

SEQ ID NO: 322637 - RNA, 32 nt, Human
aggcuccaggggaacagacgcugcccaguguu

SEQ ID NO: 322638 - RNA, 32 nt, Human
aggcuccagugaaccauaauugugccacugca

SEQ ID NO: 322639 - RNA, 32 nt, Human
aggcuccaguuuagcuuuuguuuguggguuug

SEQ ID NO: 322640 - RNA, 32 nt, Human
aggcuccauuccaacuggaggaggaggcaucu

SEQ ID NO: 322641 - RNA, 32 nt, Human
aggcuccauucugccaucuacaucccagcgca

SEQ ID NO: 322642 - RNA, 32 nt, Human
aggcucccaaagugcugagauuacaggcauga

SEQ ID NO: 322643 - RNA, 32 nt, Human
aggcucccaaguagcuaggaccaggugcgcgc

SEQ ID NO: 322644 - RNA, 32 nt, Human
aggcucccaaguagcugggacuacaguagcug

SEQ ID NO: 322645 - RNA, 32 nt, Human
aggcucccaaguagcugggauuacaggugccc

SEQ ID NO: 322646 - RNA, 32 nt, Human
aggcucccaggccuaucagaaagugauuuucu

SEQ ID NO: 322647 - RNA, 32 nt, Human
aggcucccaucccgagcuugcguagugguucu

SEQ ID NO: 322648 - RNA, 32 nt, Human
aggcuccccacugucagccacacaccugcccc

SEQ ID NO: 322649 - RNA, 32 nt, Human
aggcuccccaggaagccugggguggagacucu

SEQ ID NO: 322650 - RNA, 32 nt, Human
aggcuccccaggaggcucaaggcugggggcuu

SEQ ID NO: 322651 - RNA, 32 nt, Human
aggcucccccgugcccugccucccucugucag

SEQ ID NO: 322652 - RNA, 18 nt, Human
aggcucccccuccucucc

SEQ ID NO: 322653 - RNA, 32 nt, Human
aggcucccccucuccaccuccuggggcccauc

SEQ ID NO: 322654 - RNA, 32 nt, Human
aggcuccccuccaggccccgcgauugccacca

SEQ ID NO: 322655 - RNA, 32 nt, Human
aggcuccccuuguuuguccucccggagccugg

SEQ ID NO: 322656 - RNA, 32 nt, Human
aggcucccgaguagcugggauuacaggcaugu

SEQ ID NO: 322657 - RNA, 32 nt, Human
aggcucccgccgcugcuccagcgcggcgcagc

SEQ ID NO: 322658 - RNA, 32 nt, Human
aggcucccgggagcaagggaagaugggagaca

SEQ ID NO: 322659 - RNA, 32 nt, Human
aggcucccuccaggcuuggggccgugguggcc

SEQ ID NO: 322660 - RNA, 32 nt, Human
aggcucccucccucccugugacauggccuggg

SEQ ID NO: 322661 - RNA, 32 nt, Human
aggcucccucugccaagaaagcagagaucugc

SEQ ID NO: 322662 - RNA, 32 nt, Human
aggcucccucuuccucuccauaccugccccug

SEQ ID NO: 322663 - RNA, 32 nt, Human
aggcucccuucuggccucuccugcugcugacc

SEQ ID NO: 322664 - RNA, 32 nt, Human
aggcucccuuucucuucuuccccagguccuuc

SEQ ID NO: 322665 - RNA, 25 nt, Human
aggcuccgccagccccuccacccca

SEQ ID NO: 322666 - RNA, 32 nt, Human
aggcuccggacgcagagguggcaguggcacca

SEQ ID NO: 322667 - RNA, 32 nt, Human
aggcuccgggccacagagacggugucaguggu

SEQ ID NO: 322668 - RNA, 32 nt, Human
aggcuccgggcgaagccucccugcugcagguu

SEQ ID NO: 322669 - RNA, 32 nt, Human
aggcuccgggguaucugccuucugcugggcuc

SEQ ID NO: 322670 - RNA, 32 nt, Human
aggcuccggggugacgaauuuggccgauggca

SEQ ID NO: 322671 - RNA, 32 nt, Human
aggcuccggucugagccuggccucgggucggu

SEQ ID NO: 322672 - RNA, 19 nt, Human
aggcuccuaucccacccca

SEQ ID NO: 322673 - RNA, 32 nt, Human
aggcuccucacucuucuccaucaggcauuaaa

SEQ ID NO: 322674 - RNA, 19 nt, Human
aggcuccucgcgccucagg

SEQ ID NO: 322675 - RNA, 32 nt, Human
aggcuccucuccccguuuucucuuuugguggg

SEQ ID NO: 322676 - RNA, 32 nt, Human
aggcuccugaagaugcugggcgguccuggcac

SEQ ID NO: 322677 - RNA, 32 nt, Human
aggcuccugaguagcuaggauuacaggcacau

SEQ ID NO: 322678 - RNA, 32 nt, Human
aggcuccugaguagcugggacuacaggauuac

SEQ ID NO: 322679 - RNA, 32 nt, Human
aggcuccugaguagcugggauuacaggcacgu

SEQ ID NO: 322680 - RNA, 32 nt, Human
aggcuccugaguagcuggggauuacaggugcc

SEQ ID NO: 322681 - RNA, 19 nt, Human
aggcuccugauuccucuuc

SEQ ID NO: 322682 - RNA, 32 nt, Human
aggcuccugcagucccagcuacuugggaggcu

SEQ ID NO: 322683 - RNA, 32 nt, Human
aggcuccugccugccccaggcccccugcccca

SEQ ID NO: 322684 - RNA, 32 nt, Human
aggcuccuggccuuggcacuugccugcaccca

SEQ ID NO: 322685 - RNA, 32 nt, Human
aggcuccuggggacaguggcccaggacuuggg

SEQ ID NO: 322686 - RNA, 28 nt, Human
aggcuccuguugccugccucaucccaca

SEQ ID NO: 322687 - RNA, 32 nt, Human
aggcuccuucccucccugucaccucccucuca

SEQ ID NO: 322688 - RNA, 32 nt, Human
aggcuccuuccuggucuggcccagcuggcuuc

SEQ ID NO: 322689 - RNA, 32 nt, Human
aggcuccuucuuggaccccaggcugugagcac

SEQ ID NO: 322690 - RNA, 32 nt, Human
aggcuccuuucaucuuaaaaugccaucaucuu

SEQ ID NO: 322691 - RNA, 32 nt, Human
aggcuccuuugggugagaacaugugaaccagg

SEQ ID NO: 322692 - RNA, 18 nt, Human
aggcucgagagguccagc

SEQ ID NO: 322693 - RNA, 32 nt, Human
aggcucgauuccaucacauguaaauaaaaaua

SEQ ID NO: 322694 - RNA, 32 nt, Human
aggcucggccccgccccacccugggccucacg

SEQ ID NO: 322695 - RNA, 32 nt, Human
aggcucggcugcagccucggggagggggucca

SEQ ID NO: 322696 - RNA, 31 nt, Human
aggcucguagauggaacugguagucagcugg

SEQ ID NO: 322697 - RNA, 32 nt, Human
aggcucguccauuccuccuguguuuuaguauu

SEQ ID NO: 322698 - RNA, 32 nt, Human
aggcucgucuagaaccucugaccucaggugau

SEQ ID NO: 322699 - RNA, 32 nt, Human
aggcucgucucaaacuccugaccucaggugau

SEQ ID NO: 322700 - RNA, 32 nt, Human
aggcucgucucgaacuccugaccucaagugau

SEQ ID NO: 322701 - RNA, 32 nt, Human
aggcucgugccuacaaucccagcacuuuggga

SEQ ID NO: 322702 - RNA, 32 nt, Human
aggcucuacaacccagaagacaacccugggua

SEQ ID NO: 322703 - RNA, 32 nt, Human
aggcucuagguuuugucuaucaucucaguuca

SEQ ID NO: 322704 - RNA, 32 nt, Human
aggcucucacugccccuucgccauccuagagu

SEQ ID NO: 322705 - RNA, 32 nt, Human
aggcucucaguccccaccuguacaacaacgga

SEQ ID NO: 322706 - RNA, 32 nt, Human
aggcucuccaucugcggccagggaaagggaua

SEQ ID NO: 322707 - RNA, 32 nt, Human
aggcucuccaucuuucccuugagagcuggcuc

SEQ ID NO: 322708 - RNA, 32 nt, Human
aggcucuccauuuugauucagaaaguuagcau

SEQ ID NO: 322709 - RNA, 31 nt, Human
aggcucucccucucugcaccugucucauagc

SEQ ID NO: 322710 - RNA, 32 nt, Human
aggcucucgccaccaugcccgguuauuuuugu

SEQ ID NO: 322711 - RNA, 32 nt, Human
aggcucucuccucccucuuucuucgggcagcc

SEQ ID NO: 322712 - RNA, 32 nt, Human
aggcucucugcaaccugggccucccggguuca

SEQ ID NO: 322713 - RNA, 32 nt, Human
aggcucugaacaccccucccugugauuaacca

SEQ ID NO: 322714 - RNA, 20 nt, Human
aggcucugaagcggcugcug

SEQ ID NO: 322715 - RNA, 32 nt, Human
aggcucugaagcggcugcugcaccgcggggcc

SEQ ID NO: 322716 - RNA, 32 nt, Human
aggcucugaccagcagccuaugaggggguuug

SEQ ID NO: 322717 - RNA, 32 nt, Human
aggcucugaccuucuuucccaggaugaggugg

SEQ ID NO: 322718 - RNA, 32 nt, Human
aggcucugacucuggcacuuugcucagcacgu

SEQ ID NO: 322719 - RNA, 32 nt, Human
aggcucugacucuucgauccucccucuuugug

SEQ ID NO: 322720 - RNA, 32 nt, Human
aggcucugagacauagcagcaguauccucucc

SEQ ID NO: 322721 - RNA, 32 nt, Human
aggcucugagacuuuacuggccuaugccugag

SEQ ID NO: 322722 - RNA, 32 nt, Human
aggcucugagagccaccugcccaccaaucugg

SEQ ID NO: 322723 - RNA, 32 nt, Human
aggcucugagaggccguguccuaaccugcccu

SEQ ID NO: 322724 - RNA, 32 nt, Human
aggcucugagcagcagugaaucagauggggga

SEQ ID NO: 322725 - RNA, 32 nt, Human
aggcucugagccagaaacacacugugggcgug

SEQ ID NO: 322726 - RNA, 32 nt, Human
aggcucugagggguucauggaggcagaugcug

SEQ ID NO: 322727 - RNA, 31 nt, Human
aggcucugaguguccaguggcagccagaaca

SEQ ID NO: 322728 - RNA, 20 nt, Human
aggcucugcgccugccccac

SEQ ID NO: 322729 - RNA, 21 nt, Human
aggcucugcuauucgagguca

SEQ ID NO: 322730 - RNA, 32 nt, Human
aggcucuggagcugggucuguuuugacgguca

SEQ ID NO: 322731 - RNA, 32 nt, Human
aggcucugggagaugggaggggaagccaaaug

SEQ ID NO: 322732 - RNA, 32 nt, Human
aggcucugggaugcaugucucuccuucucuag

SEQ ID NO: 322733 - RNA, 32 nt, Human
aggcucugggcggaggugcagugaccccgcag

SEQ ID NO: 322734 - RNA, 32 nt, Human
aggcucugguucccccucacaggaugagcaug

SEQ ID NO: 322735 - RNA, 32 nt, Human
aggcucugguuucugcugccucuucucuuaca

SEQ ID NO: 322736 - RNA, 32 nt, Human
aggcucuguggccugaugccucccuggcagca

SEQ ID NO: 322737 - RNA, 22 nt, Human
aggcucugugucuuaaaggcca

SEQ ID NO: 322738 - RNA, 32 nt, Human
aggcucuuccaacccagagaacccaucugccc

SEQ ID NO: 322739 - RNA, 32 nt, Human
aggcucuucuuccugccacccuuugggcucag

SEQ ID NO: 322740 - RNA, 32 nt, Human
aggcucuucuuuccgcugaaucuuccuucccu

SEQ ID NO: 322741 - RNA, 32 nt, Human
aggcucuuggaaguagaaagagcugcugaucu

SEQ ID NO: 322742 - RNA, 32 nt, Human
aggcucuuuaggcucaggagaagcauuuuaaa

SEQ ID NO: 322743 - RNA, 32 nt, Human
aggcucuuuccugaguguuugcuuucgguuug

SEQ ID NO: 322744 - RNA, 32 nt, Human
aggcucuuucugcagucauaccgcggacccaa

SEQ ID NO: 322745 - RNA, 32 nt, Human
aggcucuuuggaaguauauacauuauuaacau

SEQ ID NO: 322746 - RNA, 32 nt, Human
aggcucuuuucagagccacccaccuaaucacu

SEQ ID NO: 322747 - RNA, 32 nt, Human
aggcucuuuuucucccuggccuccagugccca

SEQ ID NO: 322748 - RNA, 32 nt, Human
aggcugaaaacccaugcugcuguuauacacaa

SEQ ID NO: 322749 - RNA, 19 nt, Human
aggcugaaagaacuguggu

SEQ ID NO: 322750 - RNA, 32 nt, Human
aggcugaaaguggucuaagaggugaggggaca

SEQ ID NO: 322751 - RNA, 32 nt, Human
aggcugaaaucaccccaggcacugugagggcu

SEQ ID NO: 322752 - RNA, 32 nt, Human
aggcugaaccuugagucccccugcuuuuuggc

SEQ ID NO: 322753 - RNA, 32 nt, Human
aggcugaagaaggcgaagaauacugggggagg

SEQ ID NO: 322754 - RNA, 32 nt, Human
aggcugaagaaggugaagaauacugggggagg

SEQ ID NO: 322755 - RNA, 32 nt, Human
aggcugaagugagcugucaucaugccacugca

SEQ ID NO: 322756 - RNA, 32 nt, Human
aggcugaaguggguggaucaccagaggucagg

SEQ ID NO: 322757 - RNA, 32 nt, Human
aggcugaaugucugaggcuaccagguuuauca

SEQ ID NO: 322758 - RNA, 32 nt, Human
aggcugacaauccaggccgcugcuucccagcu

SEQ ID NO: 322759 - RNA, 32 nt, Human
aggcugacagaugguaugcaacagguggugga

SEQ ID NO: 322760 - RNA, 32 nt, Human
aggcugacaguuccacucccaccccacacaac

SEQ ID NO: 322761 - RNA, 32 nt, Human
aggcugacauagugcccuugucaguuucugua

SEQ ID NO: 322762 - RNA, 32 nt, Human
aggcugacccuccuccccgggguggcgugggg

SEQ ID NO: 322763 - RNA, 23 nt, Human
aggcugaccucaaacuccugacc

SEQ ID NO: 322764 - RNA, 32 nt, Human
aggcugaccucaaacuccugaccucaggugau

SEQ ID NO: 322765 - RNA, 32 nt, Human
aggcugacucccaggggaagaggggaagcacu

SEQ ID NO: 322766 - RNA, 32 nt, Human
aggcugacucucugcuacucagcauugggagu

SEQ ID NO: 322767 - RNA, 17 nt, Human
aggcugacuugccugaa

SEQ ID NO: 322768 - RNA, 32 nt, Human
aggcugacuuggacccaaacugggcgacuagg

SEQ ID NO: 322769 - RNA, 32 nt, Human
aggcugagaaaugcaaaggcucauauuuauaa

SEQ ID NO: 322770 - RNA, 32 nt, Human
aggcugagacaggcagaucacuugaggucagg

SEQ ID NO: 322771 - RNA, 32 nt, Human
aggcugagacauucuucaccuccuuggcgcug

SEQ ID NO: 322772 - RNA, 22 nt, Human
aggcugagacuggcgcugucac

SEQ ID NO: 322773 - RNA, 32 nt, Human
aggcugagacuggcgcugucaccuccacccag

SEQ ID NO: 322774 - RNA, 32 nt, Human
aggcugagaggaacccagacuuuuacauguga

SEQ ID NO: 322775 - RNA, 32 nt, Human
aggcugagaggaguaggaagaucaggagcuag

SEQ ID NO: 322776 - RNA, 32 nt, Human
aggcugagaggucaagguugcagugagccaua

SEQ ID NO: 322777 - RNA, 32 nt, Human
aggcugagaggugggaggaugccuugagcuug

SEQ ID NO: 322778 - RNA, 32 nt, Human
aggcugagaugggguuucaccacguuggccag

SEQ ID NO: 322779 - RNA, 32 nt, Human
aggcugagcacccagggggaggcugcccugac

SEQ ID NO: 322780 - RNA, 32 nt, Human
aggcugagccaagaauggagcucaugccagaa

SEQ ID NO: 322781 - RNA, 32 nt, Human
aggcugagccagugcgagacugaacuugugca

SEQ ID NO: 322782 - RNA, 32 nt, Human
aggcugagccccgggaggagagaucaaagcuu

SEQ ID NO: 322783 - RNA, 32 nt, Human
aggcugagccuccugaaaacccaugaacgcug

SEQ ID NO: 322784 - RNA, 32 nt, Human
aggcugagccugacucugaagcuguucccagc

SEQ ID NO: 322785 - RNA, 32 nt, Human
aggcugagcggggcaggacugaguaaugccag

SEQ ID NO: 322786 - RNA, 32 nt, Human
aggcugagcgguugaggaagcggccagccaug

SEQ ID NO: 322787 - RNA, 32 nt, Human
aggcugagcuccgacagggagcagggaggagg

SEQ ID NO: 322788 - RNA, 32 nt, Human
aggcugaggaaacaggcucaaacucagcuggu

SEQ ID NO: 322789 - RNA, 32 nt, Human
aggcugaggaauuaccaaggaggcaggaggug

SEQ ID NO: 322790 - RNA, 32 nt, Human
aggcugaggagcaggagagaaugcaggacaug

SEQ ID NO: 322791 - RNA, 32 nt, Human
aggcugaggagggaagccagggcucagagacc

SEQ ID NO: 322792 - RNA, 32 nt, Human
aggcugaggagggagauggaccagcccacgcc

SEQ ID NO: 322793 - RNA, 32 nt, Human
aggcugaggcagaagacaaaagagccuggcuu

SEQ ID NO: 322794 - RNA, 32 nt, Human
aggcugaggcagcagaauugcuugaacccggg

SEQ ID NO: 322795 - RNA, 32 nt, Human
aggcugaggcagcagacuggugugaacccggg

SEQ ID NO: 322796 - RNA, 32 nt, Human
aggcugaggcaggagagaaucgcuugaaccgg

SEQ ID NO: 322797 - RNA, 20 nt, Human
aggcugaggcaggaggauca

SEQ ID NO: 322798 - RNA, 32 nt, Human
aggcugaggcaggaguggagaggcauggagag

SEQ ID NO: 322799 - RNA, 32 nt, Human
aggcugaggcaggauaauuuugcuuaaacccg

SEQ ID NO: 322800 - RNA, 24 nt, Human
aggcugaggcaggcaguucacuug

SEQ ID NO: 322801 - RNA, 20 nt, Human
aggcugaggcaggcggauca

SEQ ID NO: 322802 - RNA, 32 nt, Human
aggcugaggcagggcagauugcaugagcccag

SEQ ID NO: 322803 - RNA, 20 nt, Human
aggcugaggcagguggauca

SEQ ID NO: 322804 - RNA, 20 nt, Human
aggcugaggcgaguggauca

SEQ ID NO: 322805 - RNA, 24 nt, Human
aggcugaggcgggagaaucaccug

SEQ ID NO: 322806 - RNA, 24 nt, Human
aggcugaggcgggagaaucacuug

SEQ ID NO: 322807 - RNA, 24 nt, Human
aggcugaggcgggaggaucacuug

SEQ ID NO: 322808 - RNA, 32 nt, Human
aggcugaggcucagagaggcacagucaccuuc

SEQ ID NO: 322809 - RNA, 32 nt, Human
aggcugaggcuggagaauggugugaacccagg

SEQ ID NO: 322810 - RNA, 32 nt, Human
aggcugagggagaugaggggagcuggcaccuc

SEQ ID NO: 322811 - RNA, 32 nt, Human
aggcugaggugaggggaaucaccugagccggg

SEQ ID NO: 322812 - RNA, 32 nt, Human
aggcugagguggaaggcuugagcccaggaguu

SEQ ID NO: 322813 - RNA, 32 nt, Human
aggcugagguggcgggagagaccccucuccuc

SEQ ID NO: 322814 - RNA, 23 nt, Human
aggcugaggugggaggaucacuu

SEQ ID NO: 322815 - RNA, 23 nt, Human
aggcugaggugggaggauugcuu

SEQ ID NO: 322816 - RNA, 32 nt, Human
aggcugaggugugaggugacagcagguaaaga

SEQ ID NO: 322817 - RNA, 32 nt, Human
aggcugagguugcgccacuacacuccagccug

SEQ ID NO: 322818 - RNA, 32 nt, Human
aggcugagguugggaggaucaccugagcccaa

SEQ ID NO: 322819 - RNA, 32 nt, Human
aggcugagguuguagcucacacauaccuggau

SEQ ID NO: 322820 - RNA, 32 nt, Human
aggcugagguuuggguggugugaucuguccua

SEQ ID NO: 322821 - RNA, 32 nt, Human
aggcugaguaccaugggcuacagugucuggcc

SEQ ID NO: 322822 - RNA, 32 nt, Human
aggcugagucuccagcccaggccuccuuccgu

SEQ ID NO: 322823 - RNA, 32 nt, Human
aggcugaguggacugaggccugccccgcccag

SEQ ID NO: 322824 - RNA, 32 nt, Human
aggcugagugucuucugccucauguggguggc

SEQ ID NO: 322825 - RNA, 32 nt, Human
aggcugagugugagcugagccugccccaccac

SEQ ID NO: 322826 - RNA, 31 nt, Human
aggcugaguuucucacucaugccaaguuuua

SEQ ID NO: 322827 - RNA, 32 nt, Human
aggcugaguuugacauguugauauuacguagc

SEQ ID NO: 322828 - RNA, 32 nt, Human
aggcugaucccagaaguucccucugcccacgc

SEQ ID NO: 322829 - RNA, 23 nt, Human
aggcugaucccguccuccacuga

SEQ ID NO: 322830 - RNA, 32 nt, Human
aggcugaucucaaacaucugaccucaggaagu

SEQ ID NO: 322831 - RNA, 23 nt, Human
aggcugaucucaaacucccaacc

SEQ ID NO: 322832 - RNA, 23 nt, Human
aggcugaucucaaacuccugacc

SEQ ID NO: 322833 - RNA, 32 nt, Human
aggcugaucucaaacuccugaccucaagugau

SEQ ID NO: 322834 - RNA, 32 nt, Human
aggcugaucucaaacuccugaccucaugaucc

SEQ ID NO: 322835 - RNA, 23 nt, Human
aggcugaucucaaacuccuggcc

SEQ ID NO: 322836 - RNA, 32 nt, Human
aggcugaucucaaacuucugaccucaggugau

SEQ ID NO: 322837 - RNA, 32 nt, Human
aggcugaucucgaacuccuaaccucaagugau

SEQ ID NO: 322838 - RNA, 32 nt, Human
aggcugaucucgaacuccugaccgcaagugau

SEQ ID NO: 322839 - RNA, 32 nt, Human
aggcugaucucgaacuccugacuuuaggugau

SEQ ID NO: 322840 - RNA, 32 nt, Human
aggcugaucucgaacucuugaccucaggugau

SEQ ID NO: 322841 - RNA, 32 nt, Human
aggcugaucucgagcuccugaccucaggugau

SEQ ID NO: 322842 - RNA, 32 nt, Human
aggcugaucuggaacuccugaccucaggugau

SEQ ID NO: 322843 - RNA, 32 nt, Human
aggcugaucuggaacuucugaccucaggugau

SEQ ID NO: 322844 - RNA, 32 nt, Human
aggcugaucuugaaccucugaccucaggugau

SEQ ID NO: 322845 - RNA, 32 nt, Human
aggcugaucuugaacuccugaccucaagugau

SEQ ID NO: 322846 - RNA, 32 nt, Human
aggcugaucuugaacuccugaccucaggugau

SEQ ID NO: 322847 - RNA, 32 nt, Human
aggcugaucuugaacuccugaggucaggcaau

SEQ ID NO: 322848 - RNA, 32 nt, Human
aggcugaucuugaacucgugaccucaggugau

SEQ ID NO: 322849 - RNA, 32 nt, Human
aggcugaugaaaaggcaggagaggaaguuagg

SEQ ID NO: 322850 - RNA, 32 nt, Human
aggcugaugcaggagaauggccagcaccaaag

SEQ ID NO: 322851 - RNA, 31 nt, Human
aggcugauguccuugcccauugccaagaagu

SEQ ID NO: 322852 - RNA, 32 nt, Human
aggcugauuccaccccagccugccuggacaac

SEQ ID NO: 322853 - RNA, 32 nt, Human
aggcugauugauugauuuacucacuuaauaaa

SEQ ID NO: 322854 - RNA, 32 nt, Human
aggcugauuucgaacuccugaccucagaugac

SEQ ID NO: 322855 - RNA, 32 nt, Human
aggcugauuucuccccucuccugggccagggg

SEQ ID NO: 322856 - RNA, 32 nt, Human
aggcugauuuugaacuccugaccucaggugau

SEQ ID NO: 322857 - RNA, 32 nt, Human
aggcugcaagggguggaggcugagcuggaagg

SEQ ID NO: 322858 - RNA, 32 nt, Human
aggcugcaagugagcugagaucaugccauggc

SEQ ID NO: 322859 - RNA, 32 nt, Human
aggcugcacacacaccucgcucugggaguagc

SEQ ID NO: 322860 - RNA, 32 nt, Human
aggcugcacacagcagucccaggcccugugag

SEQ ID NO: 322861 - RNA, 32 nt, Human
aggcugcacagggaagggaaagacugggcuuu

SEQ ID NO: 322862 - RNA, 20 nt, Human
aggcugcacccaccugugcc

SEQ ID NO: 322863 - RNA, 32 nt, Human
aggcugcacccuccaaccucccauuggcucgc

SEQ ID NO: 322864 - RNA, 21 nt, Human
aggcugcacgggccucugcca

SEQ ID NO: 322865 - RNA, 32 nt, Human
aggcugcacugaggaccgugagcuccaggccc

SEQ ID NO: 322866 - RNA, 22 nt, Human
aggcugcagaugccgaggcgcc

SEQ ID NO: 322867 - RNA, 32 nt, Human
aggcugcagcacaaggucuccaccaucagaca

SEQ ID NO: 322868 - RNA, 32 nt, Human
aggcugcagccccgguccccagcggcuaaagg

SEQ ID NO: 322869 - RNA, 20 nt, Human
aggcugcaggcccugugaaa

SEQ ID NO: 322870 - RNA, 32 nt, Human
aggcugcaggcugccaggugugcuuggagagc

SEQ ID NO: 322871 - RNA, 23 nt, Human
aggcugcaggcuuccuucugugc

SEQ ID NO: 322872 - RNA, 32 nt, Human
aggcugcagggagggcccaggagccggcuggg

SEQ ID NO: 322873 - RNA, 20 nt, Human
aggcugcagggccucagccu

SEQ ID NO: 322874 - RNA, 23 nt, Human
aggcugcagggcuccccacgcca

SEQ ID NO: 322875 - RNA, 18 nt, Human
aggcugcagggggugcua

SEQ ID NO: 322876 - RNA, 32 nt, Human
aggcugcagggugaggccaggcaggccugggu

SEQ ID NO: 322877 - RNA, 18 nt, Human
aggcugcaggugaggcuu

SEQ ID NO: 322878 - RNA, 32 nt, Human
aggcugcaguaagccaagaucgcaugcuacug

SEQ ID NO: 322879 - RNA, 27 nt, Human
aggcugcagugaacaaagacugugcca

SEQ ID NO: 322880 - RNA, 32 nt, Human
aggcugcagugaauuaugauuguggcauugca

SEQ ID NO: 322881 - RNA, 32 nt, Human
aggcugcagugaauucuacaaagaggcuaugg

SEQ ID NO: 322882 - RNA, 32 nt, Human
aggcugcagugaccgaugaucaugccacugca

SEQ ID NO: 322883 - RNA, 32 nt, Human
aggcugcagugagccaugaucaugccacugca

SEQ ID NO: 322884 - RNA, 32 nt, Human
aggcugcagugagccaugaucuugccacugcu

SEQ ID NO: 322885 - RNA, 32 nt, Human
aggcugcagugagccgagaucacaccacugcg

SEQ ID NO: 322886 - RNA, 32 nt, Human
aggcugcagugagccgagaucacaccacugug

SEQ ID NO: 322887 - RNA, 32 nt, Human
aggcugcagugagccgagaucaugccacugca

SEQ ID NO: 322888 - RNA, 32 nt, Human
aggcugcagugagccgagaucaugccauuacu

SEQ ID NO: 322889 - RNA, 32 nt, Human
aggcugcagugagccgagaucgcaccacugca

SEQ ID NO: 322890 - RNA, 32 nt, Human
aggcugcagugagccgagaucgcgccacuacu

SEQ ID NO: 322891 - RNA, 32 nt, Human
aggcugcagugagccgagaucgcgccacugca

SEQ ID NO: 322892 - RNA, 32 nt, Human
aggcugcagugagccgagaucgugccaccuac

SEQ ID NO: 322893 - RNA, 32 nt, Human
aggcugcagugagccgagaucgugccacugca

SEQ ID NO: 322894 - RNA, 32 nt, Human
aggcugcagugagccgagaucgugccacugcg

SEQ ID NO: 322895 - RNA, 32 nt, Human
aggcugcagugagccgagauugcaccacugca

SEQ ID NO: 322896 - RNA, 32 nt, Human
aggcugcagugagccgagauugcgccacugca

SEQ ID NO: 322897 - RNA, 32 nt, Human
aggcugcagugagccgagauugugccacugca

SEQ ID NO: 322898 - RNA, 32 nt, Human
aggcugcagugagccgugaucaugccacugca

SEQ ID NO: 322899 - RNA, 32 nt, Human
aggcugcagugagcuaugaccauaccagugca

SEQ ID NO: 322900 - RNA, 32 nt, Human
aggcugcagugagcugugauagcaccacugcg

SEQ ID NO: 322901 - RNA, 32 nt, Human
aggcugcaguggcuaugaucaugccacugcac

SEQ ID NO: 322902 - RNA, 32 nt, Human
aggcugcaguggcuccccugcccagccugcuc

SEQ ID NO: 322903 - RNA, 32 nt, Human
aggcugcagugucuuaaggguaguggcaugag

SEQ ID NO: 322904 - RNA, 22 nt, Human
aggcugcaugacuauucagaga

SEQ ID NO: 322905 - RNA, 32 nt, Human
aggcugccaacagaggaugaagaggauacaaa

SEQ ID NO: 322906 - RNA, 31 nt, Human
aggcugccaagguccuguacagcagagaccc

SEQ ID NO: 322907 - RNA, 32 nt, Human
aggcugccaagucccaagaucugcagucagca

SEQ ID NO: 322908 - RNA, 32 nt, Human
aggcugccauaggugaaucacagcagaggccu

SEQ ID NO: 322909 - RNA, 32 nt, Human
aggcugcccaucucccccugccaggccugugu

SEQ ID NO: 322910 - RNA, 32 nt, Human
aggcugccccucucuccuccaugcugccuccc

SEQ ID NO: 322911 - RNA, 32 nt, Human
aggcugccccugccaggccugcagccucccca

SEQ ID NO: 322912 - RNA, 32 nt, Human
aggcugccccugggacaugguggugauguggg

SEQ ID NO: 322913 - RNA, 32 nt, Human
aggcugccccugggcagggccauguggccuca

SEQ ID NO: 322914 - RNA, 32 nt, Human
aggcugcccugcacuccugccucccagcccac

SEQ ID NO: 322915 - RNA, 32 nt, Human
aggcugccgaggacccuccccacccugaacaa

SEQ ID NO: 322916 - RNA, 32 nt, Human
aggcugccgaucggcucguucucucugcguug

SEQ ID NO: 322917 - RNA, 32 nt, Human
aggcugccgcggggcaggggugcagugggugu

SEQ ID NO: 322918 - RNA, 32 nt, Human
aggcugccucaccuuggugauuagauuccuaa

SEQ ID NO: 322919 - RNA, 32 nt, Human
aggcugccucccucucagccuggacagcuacc

SEQ ID NO: 322920 - RNA, 32 nt, Human
aggcugccuccgggaccccacggcuguccgga

SEQ ID NO: 322921 - RNA, 32 nt, Human
aggcugccucuagcgccacuacucgagacccu

SEQ ID NO: 322922 - RNA, 32 nt, Human
aggcugccugggagccccgccucccuaccaug

SEQ ID NO: 322923 - RNA, 32 nt, Human
aggcugccuggguuugaacccagaucuauuua

SEQ ID NO: 322924 - RNA, 32 nt, Human
aggcugccuucucaaggaguccacagucugga

SEQ ID NO: 322925 - RNA, 32 nt, Human
aggcugccuuggaggguacaagauccacugag

SEQ ID NO: 322926 - RNA, 32 nt, Human
aggcugccuuggauggccucaggccagguaac

SEQ ID NO: 322927 - RNA, 32 nt, Human
aggcugccuuucugccccuuuggugaucugcc

SEQ ID NO: 322928 - RNA, 32 nt, Human
aggcugccuuucugguuccaucuccuugggug

SEQ ID NO: 322929 - RNA, 22 nt, Human
aggcugcgaccccuuccuccca

SEQ ID NO: 322930 - RNA, 32 nt, Human
aggcugcgaggugcguaauccccagccggccc

SEQ ID NO: 322931 - RNA, 32 nt, Human
aggcugcgcagcguuaaugcgcauugcgugcg

SEQ ID NO: 322932 - RNA, 32 nt, Human
aggcugcgcagggggugcgggccacacaggua

SEQ ID NO: 322933 - RNA, 32 nt, Human
aggcugcgcccuggcccagccuggcucggcuc

SEQ ID NO: 322934 - RNA, 32 nt, Human
aggcugcgcugcacuccucugcccuggggcca

SEQ ID NO: 322935 - RNA, 20 nt, Human
aggcugcggccagugccaag

SEQ ID NO: 322936 - RNA, 32 nt, Human
aggcugcgggaggaagagaugacccaagauua

SEQ ID NO: 322937 - RNA, 32 nt, Human
aggcugcgguccgucaagggcuugccucgcuu

SEQ ID NO: 322938 - RNA, 32 nt, Human
aggcugcggugacugcacuuucccuggagugg

SEQ ID NO: 322939 - RNA, 32 nt, Human
aggcugcggugagccgagauugcgccauugca

SEQ ID NO: 322940 - RNA, 32 nt, Human
aggcugcgucaaagcacagaggcuccccggac

SEQ ID NO: 322941 - RNA, 32 nt, Human
aggcugcgugccuccgucugccugugugcugg

SEQ ID NO: 322942 - RNA, 32 nt, Human
aggcugcuaagcugagccacacaccccuccgu

SEQ ID NO: 322943 - RNA, 32 nt, Human
aggcugcucacugcgggcccuaugacccuuuc

SEQ ID NO: 322944 - RNA, 32 nt, Human
aggcugcucacuggcccgucuccucucaugac

SEQ ID NO: 322945 - RNA, 32 nt, Human
aggcugcuccaccccuacucuccucccuugcu

SEQ ID NO: 322946 - RNA, 32 nt, Human
aggcugcucccgaacugcugaccucagaucau

SEQ ID NO: 322947 - RNA, 32 nt, Human
aggcugcucucaaacuccugaccucaggugau

SEQ ID NO: 322948 - RNA, 32 nt, Human
aggcugcucucagacuccugaucucaggugac

SEQ ID NO: 322949 - RNA, 32 nt, Human
aggcugcucucgaacuccugaccucaucgucc

SEQ ID NO: 322950 - RNA, 32 nt, Human
aggcugcucucgaacuccugaccucaugaucc

SEQ ID NO: 322951 - RNA, 32 nt, Human
aggcugcucucuccaucucuccuacagcuccc

SEQ ID NO: 322952 - RNA, 32 nt, Human
aggcugcucuggagucaacagaucaucuuuuc

SEQ ID NO: 322953 - RNA, 32 nt, Human
aggcugcucuugaacuccugaccucaaaugau

SEQ ID NO: 322954 - RNA, 32 nt, Human
aggcugcucuugaacuccugaccucagguaau

SEQ ID NO: 322955 - RNA, 32 nt, Human
aggcugcucuugaacuccugaccucaggugau

SEQ ID NO: 322956 - RNA, 32 nt, Human
aggcugcugacccucagcagggccagacaagg

SEQ ID NO: 322957 - RNA, 32 nt, Human
aggcugcugaugaagugagggaaaguggagga

SEQ ID NO: 322958 - RNA, 32 nt, Human
aggcugcugcaggaggccaggcccaggccaga

SEQ ID NO: 322959 - RNA, 32 nt, Human
aggcugcugcucagcacccaggacggagagga

SEQ ID NO: 322960 - RNA, 32 nt, Human
aggcugcuggaaggagaaagaagagggugagg

SEQ ID NO: 322961 - RNA, 32 nt, Human
aggcugcuggccucucagggaugaggagagcc

SEQ ID NO: 322962 - RNA, 32 nt, Human
aggcugcugggaacagguggcagagaagugcc

SEQ ID NO: 322963 - RNA, 20 nt, Human
aggcugcugggaguccagcu

SEQ ID NO: 322964 - RNA, 32 nt, Human
aggcugcugggcuccccucuaggcagccuccc

SEQ ID NO: 322965 - RNA, 32 nt, Human
aggcugcuguaacugucaggacagugcgacgg

SEQ ID NO: 322966 - RNA, 32 nt, Human
aggcugcuuccccaagcccacagucuguaagg

SEQ ID NO: 322967 - RNA, 32 nt, Human
aggcugcuuccucugcugacuucuguccuuuu

SEQ ID NO: 322968 - RNA, 32 nt, Human
aggcugcuucguugcacacccgagaaaguuuc

SEQ ID NO: 322969 - RNA, 32 nt, Human
aggcugcuucuuccaacuccaucccaguaaug

SEQ ID NO: 322970 - RNA, 32 nt, Human
aggcugcuuuuugcuuucuucuuuccagaccc

SEQ ID NO: 322971 - RNA, 32 nt, Human
aggcuggaagaccuggcuugcaagaugaacuu

SEQ ID NO: 322972 - RNA, 32 nt, Human
aggcuggaagguggagcgagaaguggaugccc

SEQ ID NO: 322973 - RNA, 21 nt, Human
aggcuggacaacauggugaaa

SEQ ID NO: 322974 - RNA, 23 nt, Human
aggcuggacacacugggaaacag

SEQ ID NO: 322975 - RNA, 19 nt, Human
aggcuggacccagaggcca

SEQ ID NO: 322976 - RNA, 32 nt, Human
aggcuggaccugcaggcuccuccuggacagug

SEQ ID NO: 322977 - RNA, 32 nt, Human
aggcuggacuccccauugcuuuucuaaaaauc

SEQ ID NO: 322978 - RNA, 32 nt, Human
aggcuggacugaucacggcucacuacagccuc

SEQ ID NO: 322979 - RNA, 32 nt, Human
aggcuggacugcagcagcgugaucucagcuca

SEQ ID NO: 322980 - RNA, 32 nt, Human
aggcuggacugcugccaccucaugccccuccu

SEQ ID NO: 322981 - RNA, 32 nt, Human
aggcuggagaccugggcuggggccuuccucca

SEQ ID NO: 322982 - RNA, 32 nt, Human
aggcuggagagacacugcgcucagggacggcu

SEQ ID NO: 322983 - RNA, 32 nt, Human
aggcuggagagggcagggagcggcaggaugga

SEQ ID NO: 322984 - RNA, 32 nt, Human
aggcuggagaggggguugccggugguggcagg

SEQ ID NO: 322985 - RNA, 31 nt, Human
aggcuggagcuggaagggugggugaauccgg

SEQ ID NO: 322986 - RNA, 32 nt, Human
aggcuggaggcuggagguggagauggggucag

SEQ ID NO: 322987 - RNA, 32 nt, Human
aggcuggagggcaggggugaggagggagcagg

SEQ ID NO: 322988 - RNA, 32 nt, Human
aggcuggaggggcucugugacucccauuaaug

SEQ ID NO: 322989 - RNA, 32 nt, Human
aggcuggaggugccggugggccuguguugcug

SEQ ID NO: 322990 - RNA, 32 nt, Human
aggcuggaguacaguggucacugcaaccucca

SEQ ID NO: 322991 - RNA, 22 nt, Human
aggcuggaguacagugguguca

SEQ ID NO: 322992 - RNA, 32 nt, Human
aggcuggaguauaguagugcaguggugugauc

SEQ ID NO: 322993 - RNA, 32 nt, Human
aggcuggagucaggcucagcuguggggcuggg

SEQ ID NO: 322994 - RNA, 32 nt, Human
aggcuggagugaucucagcucacugcaaccuc

SEQ ID NO: 322995 - RNA, 32 nt, Human
aggcuggagugcaacgguaugaucucauguca

SEQ ID NO: 322996 - RNA, 21 nt, Human
aggcuggagugcaacggugca

SEQ ID NO: 322997 - RNA, 32 nt, Human
aggcuggagugcaguagcgugaucucagcuca

SEQ ID NO: 322998 - RNA, 21 nt, Human
aggcuggagugcagugacuca

SEQ ID NO: 322999 - RNA, 21 nt, Human
aggcuggagugcauuggcaca

SEQ ID NO: 323000 - RNA, 32 nt, Human
aggcuggaguguagugacaugaucucgguuca

SEQ ID NO: 323001 - RNA, 32 nt, Human
aggcuggagugugguagcacgaucucagcuca

SEQ ID NO: 323002 - RNA, 20 nt, Human
aggcuggauagagugacuca

SEQ ID NO: 323003 - RNA, 32 nt, Human
aggcuggauggacuucaacuuggaguugaguu

SEQ ID NO: 323004 - RNA, 26 nt, Human
aggcuggcaccuggcgcgcucggggg

SEQ ID NO: 323005 - RNA, 32 nt, Human
aggcuggcagaggggcuggugcccuggagaaa

SEQ ID NO: 323006 - RNA, 24 nt, Human
aggcuggcagaucacaaggucagg

SEQ ID NO: 323007 - RNA, 32 nt, Human
aggcuggcagcccagccaggaagagcgggcca

SEQ ID NO: 323008 - RNA, 32 nt, Human
aggcuggcagccgccggcacgcacaccuaguc

SEQ ID NO: 323009 - RNA, 32 nt, Human
aggcuggcaggaaugaggcucacaacucagcc

SEQ ID NO: 323010 - RNA, 32 nt, Human
aggcuggcagggcgaaggugggaacggagaac

SEQ ID NO: 323011 - RNA, 32 nt, Human
aggcuggcaucccaccaccaacgcgcgugacu

SEQ ID NO: 323012 - RNA, 32 nt, Human
aggcuggcaugagguucagucauuccagugag

SEQ ID NO: 323013 - RNA, 21 nt, Human
aggcuggccaacacggugaaa

SEQ ID NO: 323014 - RNA, 21 nt, Human
aggcuggccaacauggugaaa

SEQ ID NO: 323015 - RNA, 21 nt, Human
aggcuggccagcauggugaaa

SEQ ID NO: 323016 - RNA, 32 nt, Human
aggcuggccaggacccaaccccuagaucccac

SEQ ID NO: 323017 - RNA, 32 nt, Human
aggcuggcccccaggcccugaguggccugguu

SEQ ID NO: 323018 - RNA, 23 nt, Human
aggcuggccucaaacucccgacc

SEQ ID NO: 323019 - RNA, 32 nt, Human
aggcuggccucaaacucccgaccucaggugau

SEQ ID NO: 323020 - RNA, 32 nt, Human
aggcuggccucaaacuccugaccucaggugau

SEQ ID NO: 323021 - RNA, 32 nt, Human
aggcuggccucaaaguccugaccucaggugau

SEQ ID NO: 323022 - RNA, 32 nt, Human
aggcuggccucgaacucccaaccucaggugau

SEQ ID NO: 323023 - RNA, 32 nt, Human
aggcuggccucgaacuccugaccucaagugau

SEQ ID NO: 323024 - RNA, 32 nt, Human
aggcuggccucgaacuccugaccucaggugau

SEQ ID NO: 323025 - RNA, 32 nt, Human
aggcuggccuugaacuccugaccucaggugau

SEQ ID NO: 323026 - RNA, 32 nt, Human
aggcuggccuuuggaucucucuuccaagccuu

SEQ ID NO: 323027 - RNA, 24 nt, Human
aggcuggcggaucacgaggucagg

SEQ ID NO: 323028 - RNA, 24 nt, Human
aggcuggcggaucaugaggucagg

SEQ ID NO: 323029 - RNA, 32 nt, Human
aggcuggcguaucaccugagguugggaguuca

SEQ ID NO: 323030 - RNA, 32 nt, Human
aggcuggcucagaagguucugggggaggaguu

SEQ ID NO: 323031 - RNA, 32 nt, Human
aggcuggcucagagaucuccagagaagcugca

SEQ ID NO: 323032 - RNA, 32 nt, Human
aggcuggcugcucugggcagcgccuucacucu

SEQ ID NO: 323033 - RNA, 22 nt, Human
aggcuggcuggaagaggcagga

SEQ ID NO: 323034 - RNA, 32 nt, Human
aggcuggcuggcugucucucucacacagauac

SEQ ID NO: 323035 - RNA, 32 nt, Human
aggcuggcuucugggcugggcguggugauuca

SEQ ID NO: 323036 - RNA, 23 nt, Human
aggcuggcuuguccccuccucac

SEQ ID NO: 323037 - RNA, 32 nt, Human
aggcuggcuuugaacuccugaccucaggugau

SEQ ID NO: 323038 - RNA, 32 nt, Human
aggcugggaaacacugaauuaugaaauaaagc

SEQ ID NO: 323039 - RNA, 32 nt, Human
aggcugggaacacggcccaccuagcaggaagu

SEQ ID NO: 323040 - RNA, 22 nt, Human
aggcugggaaggggcuaaguga

SEQ ID NO: 323041 - RNA, 32 nt, Human
aggcugggaauggaggggcagagccaggaaga

SEQ ID NO: 323042 - RNA, 30 nt, Human
aggcugggaauugcaguggcacaaucccuc

SEQ ID NO: 323043 - RNA, 32 nt, Human
aggcugggacagugaaaggcagguuugagcug

SEQ ID NO: 323044 - RNA, 32 nt, Human
aggcugggacaguggugcaugccagucauccc

SEQ ID NO: 323045 - RNA, 32 nt, Human
aggcugggacauggugggcaucagggacuuug

SEQ ID NO: 323046 - RNA, 32 nt, Human
aggcugggaccaagcucugccuucacagugca

SEQ ID NO: 323047 - RNA, 32 nt, Human
aggcugggagacugaagacucagcccgggugg

SEQ ID NO: 323048 - RNA, 32 nt, Human
aggcugggagagaaagggugccaacagguccc

SEQ ID NO: 323049 - RNA, 32 nt, Human
aggcugggagcauagcagaggggccaggccca

SEQ ID NO: 323050 - RNA, 32 nt, Human
aggcugggagcccugcccugcccaucccuccc

SEQ ID NO: 323051 - RNA, 32 nt, Human
aggcugggaggaacaccaaccuaagccagggu

SEQ ID NO: 323052 - RNA, 25 nt, Human
aggcugggaggaucacuugagccca

SEQ ID NO: 323053 - RNA, 32 nt, Human
aggcugggaggcacaguucaggguggacugug

SEQ ID NO: 323054 - RNA, 32 nt, Human
aggcugggaggcagagguugcagugagcugag

SEQ ID NO: 323055 - RNA, 32 nt, Human
aggcugggaggcggagguugcagugagcugag

SEQ ID NO: 323056 - RNA, 32 nt, Human
aggcugggaggcggcagaaugcagccagagga

SEQ ID NO: 323057 - RNA, 32 nt, Human
aggcugggaguggcaucugaggccgggagugg

SEQ ID NO: 323058 - RNA, 32 nt, Human
aggcugggauuccaacccaggcagucugaccc

SEQ ID NO: 323059 - RNA, 20 nt, Human
aggcugggcacagugacuca

SEQ ID NO: 323060 - RNA, 32 nt, Human
aggcugggcagaagggcuguggggaaguaggg

SEQ ID NO: 323061 - RNA, 32 nt, Human
aggcugggcagaggucacacagugaguaaaug

SEQ ID NO: 323062 - RNA, 32 nt, Human
aggcugggcagccucuggauggaggccugccu

SEQ ID NO: 323063 - RNA, 32 nt, Human
aggcugggcauguccugucugugugcagaauc

SEQ ID NO: 323064 - RNA, 32 nt, Human
aggcugggccaagcccuuaagucaggagcagu

SEQ ID NO: 323065 - RNA, 32 nt, Human
aggcugggccauuauugcagagcugugcugag

SEQ ID NO: 323066 - RNA, 32 nt, Human
aggcugggccugaugaacuuugcugaugaguu

SEQ ID NO: 323067 - RNA, 20 nt, Human
aggcugggccuggagcccaa

SEQ ID NO: 323068 - RNA, 32 nt, Human
aggcugggcggaggugggcaggaugugagagg

SEQ ID NO: 323069 - RNA, 32 nt, Human
aggcugggcucccuucccaccucucucacucc

SEQ ID NO: 323070 - RNA, 32 nt, Human
aggcugggcugauucccuucugugcucccaca

SEQ ID NO: 323071 - RNA, 32 nt, Human
aggcugggcugcaggcucucggcugcagcgcu

SEQ ID NO: 323072 - RNA, 32 nt, Human
aggcugggcuguucccuucugugcucccacau

SEQ ID NO: 323073 - RNA, 32 nt, Human
aggcugggcuuccugaucccacagcaucgcag

SEQ ID NO: 323074 - RNA, 32 nt, Human
aggcugggcuugaacuccuggccucaagcagu

SEQ ID NO: 323075 - RNA, 32 nt, Human
aggcuggggaagggguuggagggggcuguuga

SEQ ID NO: 323076 - RNA, 23 nt, Human
aggcuggggaccccuccacccca

SEQ ID NO: 323077 - RNA, 21 nt, Human
aggcuggggcagacugugcca

SEQ ID NO: 323078 - RNA, 32 nt, Human
aggcuggggccucgagaaggagucacucagac

SEQ ID NO: 323079 - RNA, 32 nt, Human
aggcuggggcugcuugcccugcuccucguggc

SEQ ID NO: 323080 - RNA, 32 nt, Human
aggcuggggcuggggcugaccacaacauccuu

SEQ ID NO: 323081 - RNA, 31 nt, Human
aggcuggggguggaaggagcagggcucugga

SEQ ID NO: 323082 - RNA, 32 nt, Human
aggcuggggucccugaggguggggcugugucu

SEQ ID NO: 323083 - RNA, 32 nt, Human
aggcugggguuagaguggggagugggcuucuu

SEQ ID NO: 323084 - RNA, 32 nt, Human
aggcugggguucagaccugcagaggaaaacau

SEQ ID NO: 323085 - RNA, 23 nt, Human
aggcugggucaguccccugccca

SEQ ID NO: 323086 - RNA, 32 nt, Human
aggcugggucccauucuguccuucuugucaug

SEQ ID NO: 323087 - RNA, 32 nt, Human
aggcugggugacagagugagacuccaucucaa

SEQ ID NO: 323088 - RNA, 32 nt, Human
aggcugggugcacggccgggcaccacaguggg

SEQ ID NO: 323089 - RNA, 18 nt, Human
aggcuggguggggccuca

SEQ ID NO: 323090 - RNA, 32 nt, Human
aggcuggguggggccucagugggggcugcugc

SEQ ID NO: 323091 - RNA, 32 nt, Human
aggcuggguuccgaggcccaagcccuuggcag

SEQ ID NO: 323092 - RNA, 32 nt, Human
aggcugguagccaggggcaaguucuuagcucu

SEQ ID NO: 323093 - RNA, 32 nt, Human
aggcugguauccaacucuugaccucaggugau

SEQ ID NO: 323094 - RNA, 32 nt, Human
aggcugguaucgaccuccugaccucaagugau

SEQ ID NO: 323095 - RNA, 21 nt, Human
aggcuggucaacauggcgaaa

SEQ ID NO: 323096 - RNA, 32 nt, Human
aggcuggucaagaacuccugaccucaagugau

SEQ ID NO: 323097 - RNA, 32 nt, Human
aggcuggucacaaacuccugaccucaggugau

SEQ ID NO: 323098 - RNA, 32 nt, Human
aggcuggucacaaacuccugaccucaugugau

SEQ ID NO: 323099 - RNA, 32 nt, Human
aggcuggucacgaacuccugggcucaagccau

SEQ ID NO: 323100 - RNA, 32 nt, Human
aggcuggucaggagucagccagccugaaagag

SEQ ID NO: 323101 - RNA, 32 nt, Human
aggcuggucaugaacuccugaccucaggugau

SEQ ID NO: 323102 - RNA, 32 nt, Human
aggcugguccaguggcuuuggugagggcgccu

SEQ ID NO: 323103 - RNA, 23 nt, Human
aggcuggucccaaacuccugacc

SEQ ID NO: 323104 - RNA, 32 nt, Human
aggcuggucccaaacuccugaccucauguaau

SEQ ID NO: 323105 - RNA, 32 nt, Human
aggcuggucccaaacuccuggccucaagcagu

SEQ ID NO: 323106 - RNA, 22 nt, Human
aggcugguccccugcccuggag

SEQ ID NO: 323107 - RNA, 32 nt, Human
aggcuggucccgaacuccugaccucaggugau

SEQ ID NO: 323108 - RNA, 32 nt, Human
aggcuggucccuaugucaugucuuccauuaag

SEQ ID NO: 323109 - RNA, 32 nt, Human
aggcugguccugaaugccugaccucaagugau

SEQ ID NO: 323110 - RNA, 32 nt, Human
aggcugguccugguugaagggagaaggucaaa

SEQ ID NO: 323111 - RNA, 32 nt, Human
aggcuggucgcgaacuccugagcucaggcaau

SEQ ID NO: 323112 - RNA, 32 nt, Human
aggcuggucgugaacuccugagcucaagugau

SEQ ID NO: 323113 - RNA, 32 nt, Human
aggcuggucgugaacuccuggcuucaagcagu

SEQ ID NO: 323114 - RNA, 32 nt, Human
aggcuggucuaaaacuccugaccucaagugau

SEQ ID NO: 323115 - RNA, 32 nt, Human
aggcuggucuagaacuccugaccacaugaugu

SEQ ID NO: 323116 - RNA, 32 nt, Human
aggcuggucuagaacuccugacugcaaaugau

SEQ ID NO: 323117 - RNA, 32 nt, Human
aggcuggucucaaaauccugaccucaagucau

SEQ ID NO: 323118 - RNA, 32 nt, Human
aggcuggucucaaacaccugaccucaggugau

SEQ ID NO: 323119 - RNA, 21 nt, Human
aggcuggucucaaacccccag

SEQ ID NO: 323120 - RNA, 23 nt, Human
aggcuggucucaaaccccggacc

SEQ ID NO: 323121 - RNA, 32 nt, Human
aggcuggucucaaaccccggaccucaggugau

SEQ ID NO: 323122 - RNA, 23 nt, Human
aggcuggucucaaaccccugacc

SEQ ID NO: 323123 - RNA, 32 nt, Human
aggcuggucucaaaccccugaccucaggcaau

SEQ ID NO: 323124 - RNA, 32 nt, Human
aggcuggucucaaacgccagaccucaggugau

SEQ ID NO: 323125 - RNA, 18 nt, Human
aggcuggucucaaacucc

SEQ ID NO: 323126 - RNA, 19 nt, Human
aggcuggucucaaacucca

SEQ ID NO: 323127 - RNA, 24 nt, Human
aggcuggucucaaacuccaccaaa

SEQ ID NO: 323128 - RNA, 32 nt, Human
aggcuggucucaaacuccagaccucaugauuu

SEQ ID NO: 323129 - RNA, 23 nt, Human
aggcuggucucaaacucccaacc

SEQ ID NO: 323130 - RNA, 23 nt, Human
aggcuggucucaaacucccgacc

SEQ ID NO: 323131 - RNA, 32 nt, Human
aggcuggucucaaacucccgaccucaggugau

SEQ ID NO: 323132 - RNA, 23 nt, Human
aggcuggucucaaacucccuacc

SEQ ID NO: 323133 - RNA, 32 nt, Human
aggcuggucucaaacuccuaaccucgugaucc

SEQ ID NO: 323134 - RNA, 23 nt, Human
aggcuggucucaaacuccuagcc

SEQ ID NO: 323135 - RNA, 22 nt, Human
aggcuggucucaaacuccucca

SEQ ID NO: 323136 - RNA, 21 nt, Human
aggcuggucucaaacuccucg

SEQ ID NO: 323137 - RNA, 32 nt, Human
aggcuggucucaaacuccugaacucaagugau

SEQ ID NO: 323138 - RNA, 23 nt, Human
aggcuggucucaaacuccugacc

SEQ ID NO: 323139 - RNA, 32 nt, Human
aggcuggucucaaacuccugaccucaaaugau

SEQ ID NO: 323140 - RNA, 32 nt, Human
aggcuggucucaaacuccugaccucaagcaau

SEQ ID NO: 323141 - RNA, 32 nt, Human
aggcuggucucaaacuccugaccucaagcgau

SEQ ID NO: 323142 - RNA, 32 nt, Human
aggcuggucucaaacuccugaccucaaguaau

SEQ ID NO: 323143 - RNA, 32 nt, Human
aggcuggucucaaacuccugaccucaagugag

SEQ ID NO: 323144 - RNA, 32 nt, Human
aggcuggucucaaacuccugaccucaagugau

SEQ ID NO: 323145 - RNA, 32 nt, Human
aggcuggucucaaacuccugaccucagaugau

SEQ ID NO: 323146 - RNA, 32 nt, Human
aggcuggucucaaacuccugaccucaggcaau

SEQ ID NO: 323147 - RNA, 32 nt, Human
aggcuggucucaaacuccugaccucaggggau

SEQ ID NO: 323148 - RNA, 32 nt, Human
aggcuggucucaaacuccugaccucagguaau

SEQ ID NO: 323149 - RNA, 32 nt, Human
aggcuggucucaaacuccugaccucagguacu

SEQ ID NO: 323150 - RNA, 32 nt, Human
aggcuggucucaaacuccugaccucaggugau

SEQ ID NO: 323151 - RNA, 32 nt, Human
aggcuggucucaaacuccugaccucagguguu

SEQ ID NO: 323152 - RNA, 32 nt, Human
aggcuggucucaaacuccugaccucaugaucc

SEQ ID NO: 323153 - RNA, 32 nt, Human
aggcuggucucaaacuccugaccucaugaucu

SEQ ID NO: 323154 - RNA, 32 nt, Human
aggcuggucucaaacuccugaccucguaaucc

SEQ ID NO: 323155 - RNA, 32 nt, Human
aggcuggucucaaacuccugaccucgugauac

SEQ ID NO: 323156 - RNA, 32 nt, Human
aggcuggucucaaacuccugaccucgugaucc

SEQ ID NO: 323157 - RNA, 32 nt, Human
aggcuggucucaaacuccugaccuuaagugau

SEQ ID NO: 323158 - RNA, 32 nt, Human
aggcuggucucaaacuccugaccuugugaucc

SEQ ID NO: 323159 - RNA, 32 nt, Human
aggcuggucucaaacuccugaccuugugaucu

SEQ ID NO: 323160 - RNA, 32 nt, Human
aggcuggucucaaacuccugaccuuguggucc

SEQ ID NO: 323161 - RNA, 32 nt, Human
aggcuggucucaaacuccugacgccaggugau

SEQ ID NO: 323162 - RNA, 32 nt, Human
aggcuggucucaaacuccugacucgaagugau

SEQ ID NO: 323163 - RNA, 32 nt, Human
aggcuggucucaaacuccugacuucaaaugau

SEQ ID NO: 323164 - RNA, 32 nt, Human
aggcuggucucaaacuccugacuucaagugau

SEQ ID NO: 323165 - RNA, 32 nt, Human
aggcuggucucaaacuccugacuucaggugau

SEQ ID NO: 323166 - RNA, 32 nt, Human
aggcuggucucaaacuccugacuucgugaucu

SEQ ID NO: 323167 - RNA, 32 nt, Human
aggcuggucucaaacuccugagcacuagcaau

SEQ ID NO: 323168 - RNA, 32 nt, Human
aggcuggucucaaacuccugagcucaagcaau

SEQ ID NO: 323169 - RNA, 32 nt, Human
aggcuggucucaaacuccugagcucaagccau

SEQ ID NO: 323170 - RNA, 32 nt, Human
aggcuggucucaaacuccugagcucaagcgau

SEQ ID NO: 323171 - RNA, 32 nt, Human
aggcuggucucaaacuccugagcucaggcaau

SEQ ID NO: 323172 - RNA, 32 nt, Human
aggcuggucucaaacuccugagcucaggcaga

SEQ ID NO: 323173 - RNA, 32 nt, Human
aggcuggucucaaacuccugagcucaggccau

SEQ ID NO: 323174 - RNA, 32 nt, Human
aggcuggucucaaacuccugaucucaagagau

SEQ ID NO: 323175 - RNA, 32 nt, Human
aggcuggucucaaacuccugcccucaggugau

SEQ ID NO: 323176 - RNA, 22 nt, Human
aggcuggucucaaacuccugcu

SEQ ID NO: 323177 - RNA, 32 nt, Human
aggcuggucucaaacuccugcucucaagugau

SEQ ID NO: 323178 - RNA, 32 nt, Human
aggcuggucucaaacuccuggacccaagccau

SEQ ID NO: 323179 - RNA, 32 nt, Human
aggcuggucucaaacuccuggacucaagcaau

SEQ ID NO: 323180 - RNA, 32 nt, Human
aggcuggucucaaacuccuggacucaagggau

SEQ ID NO: 323181 - RNA, 23 nt, Human
aggcuggucucaaacuccuggcc

SEQ ID NO: 323182 - RNA, 32 nt, Human
aggcuggucucaaacuccuggccucaagcaau

SEQ ID NO: 323183 - RNA, 32 nt, Human
aggcuggucucaaacuccuggccucaagugac

SEQ ID NO: 323184 - RNA, 32 nt, Human
aggcuggucucaaacuccuggccucaagugau

SEQ ID NO: 323185 - RNA, 32 nt, Human
aggcuggucucaaacuccuggccucaggugau

SEQ ID NO: 323186 - RNA, 32 nt, Human
aggcuggucucaaacuccuggcuucaagcaau

SEQ ID NO: 323187 - RNA, 32 nt, Human
aggcuggucucaaacuccuggcuucaagugau

SEQ ID NO: 323188 - RNA, 32 nt, Human
aggcuggucucaaacuccugggcucaagcaau

SEQ ID NO: 323189 - RNA, 32 nt, Human
aggcuggucucaaacuccugggcucaagcgau

SEQ ID NO: 323190 - RNA, 32 nt, Human
aggcuggucucaaacuccugggcucaagugaa

SEQ ID NO: 323191 - RNA, 32 nt, Human
aggcuggucucaaacuccugggcucaagugau

SEQ ID NO: 323192 - RNA, 32 nt, Human
aggcuggucucaaacuccugggcucaggcgau

SEQ ID NO: 323193 - RNA, 18 nt, Human
aggcuggucucaaacucu

SEQ ID NO: 323194 - RNA, 27 nt, Human
aggcuggucucaaacucuaacgucaag

SEQ ID NO: 323195 - RNA, 32 nt, Human
aggcuggucucaaacucuugaccucaggugau

SEQ ID NO: 323196 - RNA, 21 nt, Human
aggcuggucucaaacugcuaa

SEQ ID NO: 323197 - RNA, 32 nt, Human
aggcuggucucaaacugcuaacaucaagugau

SEQ ID NO: 323198 - RNA, 21 nt, Human
aggcuggucucaaacugcuga

SEQ ID NO: 323199 - RNA, 32 nt, Human
aggcuggucucaaacugcugaccucaagugau

SEQ ID NO: 323200 - RNA, 18 nt, Human
aggcuggucucaaacuuc

SEQ ID NO: 323201 - RNA, 32 nt, Human
aggcuggucucaaacuucugaccucaaaugau

SEQ ID NO: 323202 - RNA, 32 nt, Human
aggcuggucucaaacuucugaccucaagugau

SEQ ID NO: 323203 - RNA, 32 nt, Human
aggcuggucucaaacuucugaccucaggugau

SEQ ID NO: 323204 - RNA, 32 nt, Human
aggcuggucucaaacuucugaccucgugaucc

SEQ ID NO: 323205 - RNA, 32 nt, Human
aggcuggucucaaauuccugaccccaggugau

SEQ ID NO: 323206 - RNA, 32 nt, Human
aggcuggucucaaauuccugaccucaggugau

SEQ ID NO: 323207 - RNA, 32 nt, Human
aggcuggucucaaauuccugaccuuaagugau

SEQ ID NO: 323208 - RNA, 32 nt, Human
aggcuggucucaaccuccugaccucaagugau

SEQ ID NO: 323209 - RNA, 32 nt, Human
aggcuggucucaaccucuggaccucaggugau

SEQ ID NO: 323210 - RNA, 32 nt, Human
aggcuggucucaacuccugaccucaggugauc

SEQ ID NO: 323211 - RNA, 32 nt, Human
aggcuggucucaacuccugagcucaggcaauc

SEQ ID NO: 323212 - RNA, 32 nt, Human
aggcuggucucaacuccugggcucaagcgauc

SEQ ID NO: 323213 - RNA, 32 nt, Human
aggcuggucucacacuccugaccucaggugau

SEQ ID NO: 323214 - RNA, 32 nt, Human
aggcuggucucaggagucacuccugagcucaa

SEQ ID NO: 323215 - RNA, 32 nt, Human
aggcuggucuccaacuccugaccucaagugau

SEQ ID NO: 323216 - RNA, 32 nt, Human
aggcuggucuccaacuccugaccucaggcgau

SEQ ID NO: 323217 - RNA, 32 nt, Human
aggcuggucuccaacuccugaccucaggugau

SEQ ID NO: 323218 - RNA, 32 nt, Human
aggcuggucuccaacuccugagcucaggugau

SEQ ID NO: 323219 - RNA, 32 nt, Human
aggcuggucuccaacuccugcccucaagugau

SEQ ID NO: 323220 - RNA, 32 nt, Human
aggcuggucuccaacuccuggacucaagcaau

SEQ ID NO: 323221 - RNA, 32 nt, Human
aggcuggucuccaacuccuggacucaagugau

SEQ ID NO: 323222 - RNA, 32 nt, Human
aggcuggucuccaacuccuggccucaaaugau

SEQ ID NO: 323223 - RNA, 32 nt, Human
aggcuggucuccaacuccugggcucaagcaau

SEQ ID NO: 323224 - RNA, 32 nt, Human
aggcuggucuccgauuccugaccucgggugau

SEQ ID NO: 323225 - RNA, 32 nt, Human
aggcuggucucgaacaccugaccucaggugau

SEQ ID NO: 323226 - RNA, 32 nt, Human
aggcuggucucgaacaccugaccucguggucc

SEQ ID NO: 323227 - RNA, 32 nt, Human
aggcuggucucgaacaccugggcucaacugau

SEQ ID NO: 323228 - RNA, 32 nt, Human
aggcuggucucgaaccccugagcucaggugau

SEQ ID NO: 323229 - RNA, 32 nt, Human
aggcuggucucgaacgccugaccucaugaucu

SEQ ID NO: 323230 - RNA, 32 nt, Human
aggcuggucucgaacgccugaccucgugugau

SEQ ID NO: 323231 - RNA, 32 nt, Human
aggcuggucucgaacuacugaccucgugaucc

SEQ ID NO: 323232 - RNA, 32 nt, Human
aggcuggucucgaacuacugaccucgugaucu

SEQ ID NO: 323233 - RNA, 32 nt, Human
aggcuggucucgaacucauggccucaaaugau

SEQ ID NO: 323234 - RNA, 32 nt, Human
aggcuggucucgaacuccagaccucaggugau

SEQ ID NO: 323235 - RNA, 32 nt, Human
aggcuggucucgaacucccaccucagccuccc

SEQ ID NO: 323236 - RNA, 32 nt, Human
aggcuggucucgaacucccagccucaggugau

SEQ ID NO: 323237 - RNA, 32 nt, Human
aggcuggucucgaacucccgaccucaagugau

SEQ ID NO: 323238 - RNA, 32 nt, Human
aggcuggucucgaacucccgaccucaggugau

SEQ ID NO: 323239 - RNA, 32 nt, Human
aggcuggucucgaacucccgaucucaggugau

SEQ ID NO: 323240 - RNA, 32 nt, Human
aggcuggucucgaacucccguaauccagccau

SEQ ID NO: 323241 - RNA, 32 nt, Human
aggcuggucucgaacuccgaaccucaggugau

SEQ ID NO: 323242 - RNA, 32 nt, Human
aggcuggucucgaacuccgcaucucaggugau

SEQ ID NO: 323243 - RNA, 32 nt, Human
aggcuggucucgaacuccuaaccucaggugau

SEQ ID NO: 323244 - RNA, 32 nt, Human
aggcuggucucgaacuccuaaccucgggugau

SEQ ID NO: 323245 - RNA, 32 nt, Human
aggcuggucucgaacuccuaaucucaaguuau

SEQ ID NO: 323246 - RNA, 32 nt, Human
aggcuggucucgaacuccuacacucaggugau

SEQ ID NO: 323247 - RNA, 32 nt, Human
aggcuggucucgaacuccuagccucaagugau

SEQ ID NO: 323248 - RNA, 32 nt, Human
aggcuggucucgaacuccucaccucaagugau

SEQ ID NO: 323249 - RNA, 32 nt, Human
aggcuggucucgaacuccucaccucgagugau

SEQ ID NO: 323250 - RNA, 32 nt, Human
aggcuggucucgaacuccugaacucaagugau

SEQ ID NO: 323251 - RNA, 32 nt, Human
aggcuggucucgaacuccugaacuuaggugau

SEQ ID NO: 323252 - RNA, 32 nt, Human
aggcuggucucgaacuccugacaucaagugau

SEQ ID NO: 323253 - RNA, 32 nt, Human
aggcuggucucgaacuccugacaucaggugau

SEQ ID NO: 323254 - RNA, 32 nt, Human
aggcuggucucgaacuccugaccccaggugau

SEQ ID NO: 323255 - RNA, 32 nt, Human
aggcuggucucgaacuccugaccgcaagugau

SEQ ID NO: 323256 - RNA, 32 nt, Human
aggcuggucucgaacuccugaccuagugaucu

SEQ ID NO: 323257 - RNA, 32 nt, Human
aggcuggucucgaacuccugaccucaagcagu

SEQ ID NO: 323258 - RNA, 32 nt, Human
aggcuggucucgaacuccugaccucaagcgau

SEQ ID NO: 323259 - RNA, 32 nt, Human
aggcuggucucgaacuccugaccucaaguaau

SEQ ID NO: 323260 - RNA, 32 nt, Human
aggcuggucucgaacuccugaccucaagugac

SEQ ID NO: 323261 - RNA, 32 nt, Human
aggcuggucucgaacuccugaccucaagugau

SEQ ID NO: 323262 - RNA, 32 nt, Human
aggcuggucucgaacuccugaccucaaguggu

SEQ ID NO: 323263 - RNA, 32 nt, Human
aggcuggucucgaacuccugaccucagacgau

SEQ ID NO: 323264 - RNA, 32 nt, Human
aggcuggucucgaacuccugaccucagauaau

SEQ ID NO: 323265 - RNA, 32 nt, Human
aggcuggucucgaacuccugaccucagaugau

SEQ ID NO: 323266 - RNA, 32 nt, Human
aggcuggucucgaacuccugaccucaggcaau

SEQ ID NO: 323267 - RNA, 32 nt, Human
aggcuggucucgaacuccugaccucaggcgau

SEQ ID NO: 323268 - RNA, 32 nt, Human
aggcuggucucgaacuccugaccucaggggau

SEQ ID NO: 323269 - RNA, 32 nt, Human
aggcuggucucgaacuccugaccucagguaau

SEQ ID NO: 323270 - RNA, 30 nt, Human
aggcuggucucgaacuccugaccucaggug

SEQ ID NO: 323271 - RNA, 32 nt, Human
aggcuggucucgaacuccugaccucaggugag

SEQ ID NO: 323272 - RNA, 32 nt, Human
aggcuggucucgaacuccugaccucaggugau

SEQ ID NO: 323273 - RNA, 32 nt, Human
aggcuggucucgaacuccugaccucaguugau

SEQ ID NO: 323274 - RNA, 32 nt, Human
aggcuggucucgaacuccugaccucaugagcc

SEQ ID NO: 323275 - RNA, 32 nt, Human
aggcuggucucgaacuccugaccucaugaucc

SEQ ID NO: 323276 - RNA, 32 nt, Human
aggcuggucucgaacuccugaccucaugaucu

SEQ ID NO: 323277 - RNA, 32 nt, Human
aggcuggucucgaacuccugaccucaugauuu

SEQ ID NO: 323278 - RNA, 32 nt, Human
aggcuggucucgaacuccugaccucaugugau

SEQ ID NO: 323279 - RNA, 32 nt, Human
aggcuggucucgaacuccugaccucgugaucc

SEQ ID NO: 323280 - RNA, 32 nt, Human
aggcuggucucgaacuccugaccucgugaucg

SEQ ID NO: 323281 - RNA, 32 nt, Human
aggcuggucucgaacuccugaccucgugaucu

SEQ ID NO: 323282 - RNA, 32 nt, Human
aggcuggucucgaacuccugaccucgugauug

SEQ ID NO: 323283 - RNA, 32 nt, Human
aggcuggucucgaacuccugaccucgugauuu

SEQ ID NO: 323284 - RNA, 32 nt, Human
aggcuggucucgaacuccugaccugaagugau

SEQ ID NO: 323285 - RNA, 32 nt, Human
aggcuggucucgaacuccugaccuggugaucu

SEQ ID NO: 323286 - RNA, 32 nt, Human
aggcuggucucgaacuccugaccuggugauuu

SEQ ID NO: 323287 - RNA, 32 nt, Human
aggcuggucucgaacuccugaccuuaagugau

SEQ ID NO: 323288 - RNA, 32 nt, Human
aggcuggucucgaacuccugaccuuacgugau

SEQ ID NO: 323289 - RNA, 32 nt, Human
aggcuggucucgaacuccugaccuuaggugau

SEQ ID NO: 323290 - RNA, 32 nt, Human
aggcuggucucgaacuccugaccuugaguaau

SEQ ID NO: 323291 - RNA, 32 nt, Human
aggcuggucucgaacuccugaccuuggguaau

SEQ ID NO: 323292 - RNA, 32 nt, Human
aggcuggucucgaacuccugaccuugugauac

SEQ ID NO: 323293 - RNA, 32 nt, Human
aggcuggucucgaacuccugaccuugugaucc

SEQ ID NO: 323294 - RNA, 32 nt, Human
aggcuggucucgaacuccugaccuugugaucu

SEQ ID NO: 323295 - RNA, 32 nt, Human
aggcuggucucgaacuccugaccuuguuaucc

SEQ ID NO: 323296 - RNA, 32 nt, Human
aggcuggucucgaacuccugacgucaagcaau

SEQ ID NO: 323297 - RNA, 32 nt, Human
aggcuggucucgaacuccugacucaaaugauc

SEQ ID NO: 323298 - RNA, 32 nt, Human
aggcuggucucgaacuccugacugcaagugau

SEQ ID NO: 323299 - RNA, 32 nt, Human
aggcuggucucgaacuccugacuucaagugau

SEQ ID NO: 323300 - RNA, 32 nt, Human
aggcuggucucgaacuccugagcucaagugau

SEQ ID NO: 323301 - RNA, 32 nt, Human
aggcuggucucgaacuccugagcucaggcaau

SEQ ID NO: 323302 - RNA, 32 nt, Human
aggcuggucucgaacuccugagcucaggcagu

SEQ ID NO: 323303 - RNA, 32 nt, Human
aggcuggucucgaacuccugagcucaggugau

SEQ ID NO: 323304 - RNA, 32 nt, Human
aggcuggucucgaacuccugaucucaugaucc

SEQ ID NO: 323305 - RNA, 32 nt, Human
aggcuggucucgaacuccugaucugaagugau

SEQ ID NO: 323306 - RNA, 32 nt, Human
aggcuggucucgaacuccugcccucaggugau

SEQ ID NO: 323307 - RNA, 32 nt, Human
aggcuggucucgaacuccugccucaagugauc

SEQ ID NO: 323308 - RNA, 32 nt, Human
aggcuggucucgaacuccuggacucaagcaau

SEQ ID NO: 323309 - RNA, 32 nt, Human
aggcuggucucgaacuccuggacucaagugau

SEQ ID NO: 323310 - RNA, 32 nt, Human
aggcuggucucgaacuccuggacuuaagugag

SEQ ID NO: 323311 - RNA, 32 nt, Human
aggcuggucucgaacuccuggcaucaagcgau

SEQ ID NO: 323312 - RNA, 32 nt, Human
aggcuggucucgaacuccuggccacaagugug

SEQ ID NO: 323313 - RNA, 32 nt, Human
aggcuggucucgaacuccuggccauaggugau

SEQ ID NO: 323314 - RNA, 32 nt, Human
aggcuggucucgaacuccuggccuaaugaucu

SEQ ID NO: 323315 - RNA, 32 nt, Human
aggcuggucucgaacuccuggccuaggugauc

SEQ ID NO: 323316 - RNA, 32 nt, Human
aggcuggucucgaacuccuggccucaagugau

SEQ ID NO: 323317 - RNA, 32 nt, Human
aggcuggucucgaacuccuggccucacgugau

SEQ ID NO: 323318 - RNA, 32 nt, Human
aggcuggucucgaacuccuggccucaggugug

SEQ ID NO: 323319 - RNA, 32 nt, Human
aggcuggucucgaacuccuggccucaugugau

SEQ ID NO: 323320 - RNA, 32 nt, Human
aggcuggucucgaacuccuggccucgagcagu

SEQ ID NO: 323321 - RNA, 32 nt, Human
aggcuggucucgaacuccuggccucgugaucu

SEQ ID NO: 323322 - RNA, 32 nt, Human
aggcuggucucgaacuccuggcuucaagggau

SEQ ID NO: 323323 - RNA, 32 nt, Human
aggcuggucucgaacuccugggcucaagccgu

SEQ ID NO: 323324 - RNA, 32 nt, Human
aggcuggucucgaacuccugggcucaagcgau

SEQ ID NO: 323325 - RNA, 32 nt, Human
aggcuggucucgaacuccugggcucaagcggu

SEQ ID NO: 323326 - RNA, 32 nt, Human
aggcuggucucgaacuccugggcucaagugau

SEQ ID NO: 323327 - RNA, 32 nt, Human
aggcuggucucgaacuccugggcucgggugau

SEQ ID NO: 323328 - RNA, 32 nt, Human
aggcuggucucgaacuccugggcuuaaaugac

SEQ ID NO: 323329 - RNA, 32 nt, Human
aggcuggucucgaacuccuguccucagguaau

SEQ ID NO: 323330 - RNA, 32 nt, Human
aggcuggucucgaacuccuuaccucaggugau

SEQ ID NO: 323331 - RNA, 32 nt, Human
aggcuggucucgaacuccuuggcucaagugau

SEQ ID NO: 323332 - RNA, 32 nt, Human
aggcuggucucgaacucgagacuuuaggugau

SEQ ID NO: 323333 - RNA, 32 nt, Human
aggcuggucucgaacucgugaccgcagugauc

SEQ ID NO: 323334 - RNA, 32 nt, Human
aggcuggucucgaacucuggaccucagaucuu

SEQ ID NO: 323335 - RNA, 32 nt, Human
aggcuggucucgaacucuggccucaaacgacc

SEQ ID NO: 323336 - RNA, 32 nt, Human
aggcuggucucgaacucuggguucaagaaauc

SEQ ID NO: 323337 - RNA, 32 nt, Human
aggcuggucucgaacucuugaccucaagugau

SEQ ID NO: 323338 - RNA, 32 nt, Human
aggcuggucucgaacucuugaccucaggugau

SEQ ID NO: 323339 - RNA, 32 nt, Human
aggcuggucucgaacucuugacuucagaugau

SEQ ID NO: 323340 - RNA, 32 nt, Human
aggcuggucucgaacugcugaccucaaguaau

SEQ ID NO: 323341 - RNA, 32 nt, Human
aggcuggucucgaacuuaugaccucaggugau

SEQ ID NO: 323342 - RNA, 32 nt, Human
aggcuggucucgaacuucgggccccaagccau

SEQ ID NO: 323343 - RNA, 32 nt, Human
aggcuggucucgaacuucugaccucaggugau

SEQ ID NO: 323344 - RNA, 32 nt, Human
aggcuggucucgaacuucugaccucagugauc

SEQ ID NO: 323345 - RNA, 32 nt, Human
aggcuggucucgaacuucugacgucaagugau

SEQ ID NO: 323346 - RNA, 32 nt, Human
aggcuggucucgaacuucugagcucaagcgau

SEQ ID NO: 323347 - RNA, 32 nt, Human
aggcuggucucgaacuucugagcucgagcgau

SEQ ID NO: 323348 - RNA, 32 nt, Human
aggcuggucucgaacuucugggcucaagcaau

SEQ ID NO: 323349 - RNA, 32 nt, Human
aggcuggucucgaaugccuggccucaggugau

SEQ ID NO: 323350 - RNA, 32 nt, Human
aggcuggucucgaaugucugaccucaggugau

SEQ ID NO: 323351 - RNA, 32 nt, Human
aggcuggucucgaauuccagaccucaggugau

SEQ ID NO: 323352 - RNA, 32 nt, Human
aggcuggucucgaauucccgaccucagguaau

SEQ ID NO: 323353 - RNA, 32 nt, Human
aggcuggucucgaauuccugaccucaagugau

SEQ ID NO: 323354 - RNA, 32 nt, Human
aggcuggucucgaauuccugaccucaggugau

SEQ ID NO: 323355 - RNA, 32 nt, Human
aggcuggucucgaauuccugagcucaggugau

SEQ ID NO: 323356 - RNA, 32 nt, Human
aggcuggucucgaauuccuggauucaagugau

SEQ ID NO: 323357 - RNA, 32 nt, Human
aggcuggucucgaauuccuggccucaagcgau

SEQ ID NO: 323358 - RNA, 32 nt, Human
aggcuggucucgacccugaccucagggugauc

SEQ ID NO: 323359 - RNA, 32 nt, Human
aggcuggucucgagcuccugaccucaagugau

SEQ ID NO: 323360 - RNA, 32 nt, Human
aggcuggucucgagcuccugaccucaggugau

SEQ ID NO: 323361 - RNA, 32 nt, Human
aggcuggucucgagcuccugacucaggugauc

SEQ ID NO: 323362 - RNA, 32 nt, Human
aggcuggucucgagcuccugagcucaagcgau

SEQ ID NO: 323363 - RNA, 32 nt, Human
aggcuggucucgagcuccugagcucaggcaau

SEQ ID NO: 323364 - RNA, 32 nt, Human
aggcuggucucgagcucuugaccucaaguaau

SEQ ID NO: 323365 - RNA, 32 nt, Human
aggcuggucucgaucuccugaccucaggugau

SEQ ID NO: 323366 - RNA, 32 nt, Human
aggcuggucucgaucuccugaccucgugaucc

SEQ ID NO: 323367 - RNA, 32 nt, Human
aggcuggucucgaucuccugacuucaggugau

SEQ ID NO: 323368 - RNA, 32 nt, Human
aggcuggucucgaucugaccucaugauccacc

SEQ ID NO: 323369 - RNA, 32 nt, Human
aggcuggucucgauuuccugaccucaggugau

SEQ ID NO: 323370 - RNA, 32 nt, Human
aggcuggucucuaacucccgaccucaggugau

SEQ ID NO: 323371 - RNA, 32 nt, Human
aggcuggucucuaacuccugggcucagugauc

SEQ ID NO: 323372 - RNA, 32 nt, Human
aggcuggucuggaacaccugaccuccggugau

SEQ ID NO: 323373 - RNA, 32 nt, Human
aggcuggucuggaacgccugaccucaagugau

SEQ ID NO: 323374 - RNA, 32 nt, Human
aggcuggucuggaacuccuaaccucagguuau

SEQ ID NO: 323375 - RNA, 32 nt, Human
aggcuggucuggaacuccugaccucaagugau

SEQ ID NO: 323376 - RNA, 32 nt, Human
aggcuggucuggaacuccugaccucaggugau

SEQ ID NO: 323377 - RNA, 32 nt, Human
aggcuggucuggaacuccugaccuucagguga

SEQ ID NO: 323378 - RNA, 32 nt, Human
aggcuggucuggaacuccugaccuugugaucu

SEQ ID NO: 323379 - RNA, 32 nt, Human
aggcuggucuggaacuccugagcucaagugau

SEQ ID NO: 323380 - RNA, 32 nt, Human
aggcuggucuggaacuccuggccuccagucau

SEQ ID NO: 323381 - RNA, 32 nt, Human
aggcuggucuggaacugcugaccucaacuaau

SEQ ID NO: 323382 - RNA, 32 nt, Human
aggcuggucuuaaacuccuggccucaacugau

SEQ ID NO: 323383 - RNA, 32 nt, Human
aggcuggucuuaaacucucgaccucaggugau

SEQ ID NO: 323384 - RNA, 32 nt, Human
aggcuggucuuagacuccugaccucaguugau

SEQ ID NO: 323385 - RNA, 32 nt, Human
aggcuggucuugaacaccugaccucaaaugau

SEQ ID NO: 323386 - RNA, 32 nt, Human
aggcuggucuugaaccccugaccucaagugau

SEQ ID NO: 323387 - RNA, 32 nt, Human
aggcuggucuugaaccccugaccucaggugau

SEQ ID NO: 323388 - RNA, 32 nt, Human
aggcuggucuugaacccuugaccucaggucau

SEQ ID NO: 323389 - RNA, 32 nt, Human
aggcuggucuugaacgccugaccuugugaucu

SEQ ID NO: 323390 - RNA, 32 nt, Human
aggcuggucuugaacucccgaccucagaugau

SEQ ID NO: 323391 - RNA, 32 nt, Human
aggcuggucuugaacucccgaccucaggugau

SEQ ID NO: 323392 - RNA, 32 nt, Human
aggcuggucuugaacuccuaaccucgggugau

SEQ ID NO: 323393 - RNA, 32 nt, Human
aggcuggucuugaacuccuagacucaagugau

SEQ ID NO: 323394 - RNA, 32 nt, Human
aggcuggucuugaacuccuaggcucaagagau

SEQ ID NO: 323395 - RNA, 32 nt, Human
aggcuggucuugaacuccucaccucaagcgau

SEQ ID NO: 323396 - RNA, 32 nt, Human
aggcuggucuugaacuccucaccucaggugau

SEQ ID NO: 323397 - RNA, 32 nt, Human
aggcuggucuugaacuccucggcucaagcaau

SEQ ID NO: 323398 - RNA, 32 nt, Human
aggcuggucuugaacuccugaacucaagcaau

SEQ ID NO: 323399 - RNA, 32 nt, Human
aggcuggucuugaacuccugaacucaagugau

SEQ ID NO: 323400 - RNA, 32 nt, Human
aggcuggucuugaacuccugaacucaauugau

SEQ ID NO: 323401 - RNA, 32 nt, Human
aggcuggucuugaacuccugacaucaaguggu

SEQ ID NO: 323402 - RNA, 28 nt, Human
aggcuggucuugaacuccugaccacagg

SEQ ID NO: 323403 - RNA, 32 nt, Human
aggcuggucuugaacuccugaccccaggugau

SEQ ID NO: 323404 - RNA, 32 nt, Human
aggcuggucuugaacuccugacccucaaguga

SEQ ID NO: 323405 - RNA, 32 nt, Human
aggcuggucuugaacuccugaccgcagguaau

SEQ ID NO: 323406 - RNA, 26 nt, Human
aggcuggucuugaacuccugaccuca

SEQ ID NO: 323407 - RNA, 32 nt, Human
aggcuggucuugaacuccugaccucaaacgau

SEQ ID NO: 323408 - RNA, 32 nt, Human
aggcuggucuugaacuccugaccucaaaugag

SEQ ID NO: 323409 - RNA, 32 nt, Human
aggcuggucuugaacuccugaccucaaaugau

SEQ ID NO: 323410 - RNA, 32 nt, Human
aggcuggucuugaacuccugaccucaacugau

SEQ ID NO: 323411 - RNA, 32 nt, Human
aggcuggucuugaacuccugaccucaacuggu

SEQ ID NO: 323412 - RNA, 32 nt, Human
aggcuggucuugaacuccugaccucaagcgau

SEQ ID NO: 323413 - RNA, 32 nt, Human
aggcuggucuugaacuccugaccucaaguaau

SEQ ID NO: 323414 - RNA, 32 nt, Human
aggcuggucuugaacuccugaccucaagugag

SEQ ID NO: 323415 - RNA, 32 nt, Human
aggcuggucuugaacuccugaccucaagugau

SEQ ID NO: 323416 - RNA, 32 nt, Human
aggcuggucuugaacuccugaccucaaguggu

SEQ ID NO: 323417 - RNA, 32 nt, Human
aggcuggucuugaacuccugaccucacacaau

SEQ ID NO: 323418 - RNA, 32 nt, Human
aggcuggucuugaacuccugaccucaggcgau

SEQ ID NO: 323419 - RNA, 32 nt, Human
aggcuggucuugaacuccugaccucagguaau

SEQ ID NO: 323420 - RNA, 32 nt, Human
aggcuggucuugaacuccugaccucaggugag

SEQ ID NO: 323421 - RNA, 32 nt, Human
aggcuggucuugaacuccugaccucaggugau

SEQ ID NO: 323422 - RNA, 32 nt, Human
aggcuggucuugaacuccugaccucaugaucc

SEQ ID NO: 323423 - RNA, 32 nt, Human
aggcuggucuugaacuccugaccucaugugau

SEQ ID NO: 323424 - RNA, 32 nt, Human
aggcuggucuugaacuccugaccuccugaucc

SEQ ID NO: 323425 - RNA, 32 nt, Human
aggcuggucuugaacuccugaccucgugaccc

SEQ ID NO: 323426 - RNA, 32 nt, Human
aggcuggucuugaacuccugaccucgugaucc

SEQ ID NO: 323427 - RNA, 32 nt, Human
aggcuggucuugaacuccugaccucgugaucu

SEQ ID NO: 323428 - RNA, 32 nt, Human
aggcuggucuugaacuccugaccucgugauug

SEQ ID NO: 323429 - RNA, 32 nt, Human
aggcuggucuugaacuccugaccuugugaucc

SEQ ID NO: 323430 - RNA, 32 nt, Human
aggcuggucuugaacuccugaccuugugaucu

SEQ ID NO: 323431 - RNA, 32 nt, Human
aggcuggucuugaacuccugaccuuguggucc

SEQ ID NO: 323432 - RNA, 32 nt, Human
aggcuggucuugaacuccugacgucaagugau

SEQ ID NO: 323433 - RNA, 32 nt, Human
aggcuggucuugaacuccugacuucaggugac

SEQ ID NO: 323434 - RNA, 32 nt, Human
aggcuggucuugaacuccugagccucgugagu

SEQ ID NO: 323435 - RNA, 32 nt, Human
aggcuggucuugaacuccugagccugugaucc

SEQ ID NO: 323436 - RNA, 32 nt, Human
aggcuggucuugaacuccugagcucaagggau

SEQ ID NO: 323437 - RNA, 32 nt, Human
aggcuggucuugaacuccugagcucaagugau

SEQ ID NO: 323438 - RNA, 32 nt, Human
aggcuggucuugaacuccugagcucaggugau

SEQ ID NO: 323439 - RNA, 32 nt, Human
aggcuggucuugaacuccugagcucaugccau

SEQ ID NO: 323440 - RNA, 32 nt, Human
aggcuggucuugaacuccugaguucaagcagu

SEQ ID NO: 323441 - RNA, 32 nt, Human
aggcuggucuugaacuccugaguucaagcgau

SEQ ID NO: 323442 - RNA, 32 nt, Human
aggcuggucuugaacuccuggacucaagcaac

SEQ ID NO: 323443 - RNA, 32 nt, Human
aggcuggucuugaacuccuggacucaagcgac

SEQ ID NO: 323444 - RNA, 32 nt, Human
aggcuggucuugaacuccuggacucauccuaa

SEQ ID NO: 323445 - RNA, 32 nt, Human
aggcuggucuugaacuccuggacugaagcggu

SEQ ID NO: 323446 - RNA, 32 nt, Human
aggcuggucuugaacuccuggacuuagacgau

SEQ ID NO: 323447 - RNA, 27 nt, Human
aggcuggucuugaacuccuggccucaa

SEQ ID NO: 323448 - RNA, 32 nt, Human
aggcuggucuugaacuccuggccucaaaugau

SEQ ID NO: 323449 - RNA, 32 nt, Human
aggcuggucuugaacuccuggccucaagcaac

SEQ ID NO: 323450 - RNA, 32 nt, Human
aggcuggucuugaacuccuggccucaagcaau

SEQ ID NO: 323451 - RNA, 32 nt, Human
aggcuggucuugaacuccuggccucaagcgau

SEQ ID NO: 323452 - RNA, 32 nt, Human
aggcuggucuugaacuccuggccucaagggau

SEQ ID NO: 323453 - RNA, 32 nt, Human
aggcuggucuugaacuccuggccucaagucau

SEQ ID NO: 323454 - RNA, 32 nt, Human
aggcuggucuugaacuccuggccucaagugau

SEQ ID NO: 323455 - RNA, 32 nt, Human
aggcuggucuugaacuccuggccucaaguggu

SEQ ID NO: 323456 - RNA, 32 nt, Human
aggcuggucuugaacuccuggccucauaugau

SEQ ID NO: 323457 - RNA, 32 nt, Human
aggcuggucuugaacuccuggccuuaagcaau

SEQ ID NO: 323458 - RNA, 32 nt, Human
aggcuggucuugaacuccuggccuuaugugau

SEQ ID NO: 323459 - RNA, 32 nt, Human
aggcuggucuugaacuccuggcucaagaaauc

SEQ ID NO: 323460 - RNA, 32 nt, Human
aggcuggucuugaacuccuggcuucgggugau

SEQ ID NO: 323461 - RNA, 32 nt, Human
aggcuggucuugaacuccugggcucaagcaau

SEQ ID NO: 323462 - RNA, 32 nt, Human
aggcuggucuugaacuccugggcucaagccau

SEQ ID NO: 323463 - RNA, 32 nt, Human
aggcuggucuugaacuccugggcucaagcgau

SEQ ID NO: 323464 - RNA, 32 nt, Human
aggcuggucuugaacuccugggcucaagcuau

SEQ ID NO: 323465 - RNA, 32 nt, Human
aggcuggucuugaacuccugggcucaagugau

SEQ ID NO: 323466 - RNA, 32 nt, Human
aggcuggucuugaacuccugggcucaugcaau

SEQ ID NO: 323467 - RNA, 32 nt, Human
aggcuggucuugaacuccugggcuccagugau

SEQ ID NO: 323468 - RNA, 32 nt, Human
aggcuggucuugaacuccuggucucaagugau

SEQ ID NO: 323469 - RNA, 32 nt, Human
aggcuggucuugaacuccuguccucaaguaau

SEQ ID NO: 323470 - RNA, 32 nt, Human
aggcuggucuugaacuccuugaccucagguaa

SEQ ID NO: 323471 - RNA, 32 nt, Human
aggcuggucuugaacucucgaccucaggaaac

SEQ ID NO: 323472 - RNA, 32 nt, Human
aggcuggucuugaacucuugaccucaggugau

SEQ ID NO: 323473 - RNA, 32 nt, Human
aggcuggucuugaacuucugaccucaagugau

SEQ ID NO: 323474 - RNA, 32 nt, Human
aggcuggucuugaauucccgaccucaggugau

SEQ ID NO: 323475 - RNA, 32 nt, Human
aggcuggucuugaauuccugaccucaagugau

SEQ ID NO: 323476 - RNA, 32 nt, Human
aggcuggucuugaauuccugaccucaggugau

SEQ ID NO: 323477 - RNA, 32 nt, Human
aggcuggucuugaauuccugaccucagugauc

SEQ ID NO: 323478 - RNA, 32 nt, Human
aggcuggucuugaauuccugaccucgugaucc

SEQ ID NO: 323479 - RNA, 32 nt, Human
aggcuggucuugaccuccugaccuaggugauc

SEQ ID NO: 323480 - RNA, 32 nt, Human
aggcuggucuugcacuccugaccucacgugau

SEQ ID NO: 323481 - RNA, 32 nt, Human
aggcuggucuuggacuccugaccucaugcucc

SEQ ID NO: 323482 - RNA, 32 nt, Human
aggcuggucuuggauucccgaccucaggugau

SEQ ID NO: 323483 - RNA, 32 nt, Human
aggcuggucuuguacuccugacgucaggugau

SEQ ID NO: 323484 - RNA, 32 nt, Human
aggcuggucuuuaacuccugaccucaagugau

SEQ ID NO: 323485 - RNA, 32 nt, Human
aggcuggucuuuaacuccugaccucagguguu

SEQ ID NO: 323486 - RNA, 32 nt, Human
aggcuggugacuagcagagguccaccugaccc

SEQ ID NO: 323487 - RNA, 32 nt, Human
aggcuggugacuagcagagguccaccugaccu

SEQ ID NO: 323488 - RNA, 32 nt, Human
aggcuggugcagccuacauggcacaggauauu

SEQ ID NO: 323489 - RNA, 32 nt, Human
aggcuggugcuguggccagggugagagcugcu

SEQ ID NO: 323490 - RNA, 32 nt, Human
aggcuggugcuuaguacuguuuucccugcacg

SEQ ID NO: 323491 - RNA, 24 nt, Human
aggcugguggaucacaaggucagg

SEQ ID NO: 323492 - RNA, 21 nt, Human
aggcugguggaucacgagguc

SEQ ID NO: 323493 - RNA, 22 nt, Human
aggcugguggaucacgagguca

SEQ ID NO: 323494 - RNA, 23 nt, Human
aggcugguggaucacgaggucag

SEQ ID NO: 323495 - RNA, 24 nt, Human
aggcugguggaucacgaggucagg

SEQ ID NO: 323496 - RNA, 32 nt, Human
aggcugguggccugggugccucugcacacuga

SEQ ID NO: 323497 - RNA, 17 nt, Human
aggcugguggugagcuc

SEQ ID NO: 323498 - RNA, 32 nt, Human
aggcugguggugcuggagaaggagcugcuccg

SEQ ID NO: 323499 - RNA, 32 nt, Human
aggcuggugucaaacuccugacuucaggugau

SEQ ID NO: 323500 - RNA, 32 nt, Human
aggcuggugucaaacuccugggcucagucagu

SEQ ID NO: 323501 - RNA, 32 nt, Human
aggcuggugucgaacuccugaccucaggugau

SEQ ID NO: 323502 - RNA, 32 nt, Human
aggcuggugucgaacuccugggcucaagcgau

SEQ ID NO: 323503 - RNA, 32 nt, Human
aggcugguguggaacuccugaacucaggcugu

SEQ ID NO: 323504 - RNA, 32 nt, Human
aggcugguguugaacuccugaccucaagugau

SEQ ID NO: 323505 - RNA, 32 nt, Human
aggcugguguugaacuccugaccucagguaau

SEQ ID NO: 323506 - RNA, 32 nt, Human
aggcugguguugaacucuugaccucaggugau

SEQ ID NO: 323507 - RNA, 32 nt, Human
aggcugguguugaacuucugaccucaggugau

SEQ ID NO: 323508 - RNA, 32 nt, Human
aggcugguucaucaaauaaagcaaaaccuugc

SEQ ID NO: 323509 - RNA, 32 nt, Human
aggcugguuccuggucgcacagcuggucaugg

SEQ ID NO: 323510 - RNA, 32 nt, Human
aggcugguucuugcgugcucugugcccccacc

SEQ ID NO: 323511 - RNA, 22 nt, Human
aggcugguuggcauaauaugua

SEQ ID NO: 323512 - RNA, 32 nt, Human
aggcugguuuagaacuccugaccucaggugau

SEQ ID NO: 323513 - RNA, 32 nt, Human
aggcugguuucaaacuccugaccucaagugac

SEQ ID NO: 323514 - RNA, 32 nt, Human
aggcugguuucaaacuccugaccucaagugau

SEQ ID NO: 323515 - RNA, 32 nt, Human
aggcugguuucaaacuccugaccucaggugau

SEQ ID NO: 323516 - RNA, 32 nt, Human
aggcugguuucaaacuccugaccucauaugau

SEQ ID NO: 323517 - RNA, 32 nt, Human
aggcugguuucaaacuccugagcucaaaugau

SEQ ID NO: 323518 - RNA, 32 nt, Human
aggcugguuucgaacucccgaccucaggugau

SEQ ID NO: 323519 - RNA, 32 nt, Human
aggcugguuucgaacuccuaaccuccagugau

SEQ ID NO: 323520 - RNA, 32 nt, Human
aggcugguuucgaacuccugaccucaggugau

SEQ ID NO: 323521 - RNA, 32 nt, Human
aggcugguuucgaacuccugaccucgugaucc

SEQ ID NO: 323522 - RNA, 32 nt, Human
aggcugguuucgaacuccuggacucaagcagu

SEQ ID NO: 323523 - RNA, 32 nt, Human
aggcugguuucgaacuccuggccucaggugau

SEQ ID NO: 323524 - RNA, 32 nt, Human
aggcugguuucgaacuccugggcuuaagugau

SEQ ID NO: 323525 - RNA, 32 nt, Human
aggcugguuucgaacucggcucaagugaucua

SEQ ID NO: 323526 - RNA, 32 nt, Human
aggcugguuucgaacucuguaaucccagcacu

SEQ ID NO: 323527 - RNA, 32 nt, Human
aggcugguuucuccucuuggcccuggccuaca

SEQ ID NO: 323528 - RNA, 30 nt, Human
aggcugguuucuuucaugcuccuuacccug

SEQ ID NO: 323529 - RNA, 32 nt, Human
aggcugguuuucaacuccugaccuuaggugau

SEQ ID NO: 323530 - RNA, 32 nt, Human
aggcugguuuugaacuccugaccucaggugag

SEQ ID NO: 323531 - RNA, 32 nt, Human
aggcugguuuugaacuccuggccucaagcaau

SEQ ID NO: 323532 - RNA, 32 nt, Human
aggcugguuuugaacuccuggccucaagugau

SEQ ID NO: 323533 - RNA, 32 nt, Human
aggcugguuuugaacuccuggcuucaagcgau

SEQ ID NO: 323534 - RNA, 32 nt, Human
aggcugguuuugaacuccuugccucaaguaau

SEQ ID NO: 323535 - RNA, 32 nt, Human
aggcuguaaaauugauuguggggaagacagag

SEQ ID NO: 323536 - RNA, 32 nt, Human
aggcuguaacaugcccagaagcuguuguggcc

SEQ ID NO: 323537 - RNA, 32 nt, Human
aggcuguaagcauucugagcugggcuuguugu

SEQ ID NO: 323538 - RNA, 32 nt, Human
aggcugucacagaggcuggagaaauaagcagu

SEQ ID NO: 323539 - RNA, 32 nt, Human
aggcugucagccacacuagguaucagggaucc

SEQ ID NO: 323540 - RNA, 21 nt, Human
aggcugucagcgccucaaggg

SEQ ID NO: 323541 - RNA, 32 nt, Human
aggcugucccagcugucugaguguuuguccgg

SEQ ID NO: 323542 - RNA, 32 nt, Human
aggcuguccucccagggcugccacuaccagag

SEQ ID NO: 323543 - RNA, 32 nt, Human
aggcugucucaaacuccuggccucaagugguc

SEQ ID NO: 323544 - RNA, 18 nt, Human
aggcugucucacuuguug

SEQ ID NO: 323545 - RNA, 18 nt, Human
aggcugucucuccaggca

SEQ ID NO: 323546 - RNA, 32 nt, Human
aggcugucugcauccaccuccccagccuuugu

SEQ ID NO: 323547 - RNA, 32 nt, Human
aggcugugaacaaacauacgcugcuuuauucu

SEQ ID NO: 323548 - RNA, 24 nt, Human
aggcugugaagaagcucuaugaca

SEQ ID NO: 323549 - RNA, 32 nt, Human
aggcugugaccaacacaugugagacccagucc

SEQ ID NO: 323550 - RNA, 32 nt, Human
aggcugugagggcaguucagggccagggccca

SEQ ID NO: 323551 - RNA, 32 nt, Human
aggcugugcagggugaagagugcugcuccgug

SEQ ID NO: 323552 - RNA, 32 nt, Human
aggcugugcugggugcagaaccgccagagcca

SEQ ID NO: 323553 - RNA, 32 nt, Human
aggcugugcuuccauggagcugggugucaaga

SEQ ID NO: 323554 - RNA, 32 nt, Human
aggcuguggacacccuugccaccacuggggac

SEQ ID NO: 323555 - RNA, 32 nt, Human
aggcuguggacuuacuugccaccagcuugugc

SEQ ID NO: 323556 - RNA, 23 nt, Human
aggcuguggagcagcugaggcag

SEQ ID NO: 323557 - RNA, 32 nt, Human
aggcuguggaucuguggcgguacucugaaagc

SEQ ID NO: 323558 - RNA, 29 nt, Human
aggcuguggcugcuaugaccucuuugcug

SEQ ID NO: 323559 - RNA, 29 nt, Human
aggcuguggcugcugucauggcaccucac

SEQ ID NO: 323560 - RNA, 29 nt, Human
aggcuguggcugcugugggcccucuggaa

SEQ ID NO: 323561 - RNA, 32 nt, Human
aggcugugggaucuauuacagcugcaggccgg

SEQ ID NO: 323562 - RNA, 21 nt, Human
aggcugugggcacuguauaca

SEQ ID NO: 323563 - RNA, 32 nt, Human
aggcuguggggaggggaggagaacugcucacu

SEQ ID NO: 323564 - RNA, 32 nt, Human
aggcuguggggaggggcagaugacuugcagcu

SEQ ID NO: 323565 - RNA, 32 nt, Human
aggcuguggugcacugugaucaugccuaugag

SEQ ID NO: 323566 - RNA, 32 nt, Human
aggcugugguggcaccacugagccuagaccau

SEQ ID NO: 323567 - RNA, 32 nt, Human
aggcugugguuugaaaacugagcccagagggc

SEQ ID NO: 323568 - RNA, 32 nt, Human
aggcugugucagaaacugaagcuguucucagg

SEQ ID NO: 323569 - RNA, 32 nt, Human
aggcugugucaugggcguccuuaacuuuggga

SEQ ID NO: 323570 - RNA, 32 nt, Human
aggcugugugguuaauauugagugucaacuug

SEQ ID NO: 323571 - RNA, 21 nt, Human
aggcuguuaaccugcaagugu

SEQ ID NO: 323572 - RNA, 22 nt, Human
aggcuguuagcaggagcuaugu

SEQ ID NO: 323573 - RNA, 32 nt, Human
aggcuguuagucuaauccaacaugguguccuu

SEQ ID NO: 323574 - RNA, 23 nt, Human
aggcuguuccugaggccugacca

SEQ ID NO: 323575 - RNA, 32 nt, Human
aggcuguucuaaaacuccugaacucagguaau

SEQ ID NO: 323576 - RNA, 32 nt, Human
aggcuguucucaaacuccuggccucaggcgau

SEQ ID NO: 323577 - RNA, 32 nt, Human
aggcuguucuccaacuccugaccuuggccaaa

SEQ ID NO: 323578 - RNA, 32 nt, Human
aggcuguucucgaacuccugaccucaggugau

SEQ ID NO: 323579 - RNA, 32 nt, Human
aggcuguucuuccuccuccuagaaugucugga

SEQ ID NO: 323580 - RNA, 32 nt, Human
aggcuguucuugaacuccuggccucaaaugau

SEQ ID NO: 323581 - RNA, 32 nt, Human
aggcuguucuugaacuccuggucuccagugau

SEQ ID NO: 323582 - RNA, 32 nt, Human
aggcuguugaaagcuucacaagaccauuguua

SEQ ID NO: 323583 - RNA, 32 nt, Human
aggcuguugauucaucagagucuagcaggagg

SEQ ID NO: 323584 - RNA, 32 nt, Human
aggcuguuggacgcagccuggguggcagaggg

SEQ ID NO: 323585 - RNA, 32 nt, Human
aggcuguuggggaaggaagcugagagauccuc

SEQ ID NO: 323586 - RNA, 32 nt, Human
aggcuguugucuuuuccuucugagccugccuu

SEQ ID NO: 323587 - RNA, 32 nt, Human
aggcuguuugacuucucugcugaagugauuuc

SEQ ID NO: 323588 - RNA, 32 nt, Human
aggcuuaagauuuggaauaaagucacagaauc

SEQ ID NO: 323589 - RNA, 32 nt, Human
aggcuuacacccuucguggacaggcgaggcuc

SEQ ID NO: 323590 - RNA, 32 nt, Human
aggcuuacauggugaugccugugaccuuggag

SEQ ID NO: 323591 - RNA, 32 nt, Human
aggcuuacuacagccuccaccuucagguucaa

SEQ ID NO: 323592 - RNA, 32 nt, Human
aggcuuacugagaucaggagacagggaggccc

SEQ ID NO: 323593 - RNA, 32 nt, Human
aggcuuagaacaguguguggcagaugguaggu

SEQ ID NO: 323594 - RNA, 32 nt, Human
aggcuuagccccucugcccucccuucauugua

SEQ ID NO: 323595 - RNA, 32 nt, Human
aggcuuagcgugaaggggaaucaaagaggagg

SEQ ID NO: 323596 - RNA, 24 nt, Human
aggcuuaggcgggagaaucacuug

SEQ ID NO: 323597 - RNA, 32 nt, Human
aggcuuagggacaggaccccagcucugcgucg

SEQ ID NO: 323598 - RNA, 32 nt, Human
aggcuuaucccuucaccagcaggccuucagaa

SEQ ID NO: 323599 - RNA, 32 nt, Human
aggcuuaugauauuuaaaagacuucugcaucg

SEQ ID NO: 323600 - RNA, 32 nt, Human
aggcuuaugaucugagcaaaaugugaacuuca

SEQ ID NO: 323601 - RNA, 32 nt, Human
aggcuuaugccccgagggaaacccucacacgu

SEQ ID NO: 323602 - RNA, 32 nt, Human
aggcuuauguauggggacucaccaggggccag

SEQ ID NO: 323603 - RNA, 32 nt, Human
aggcuuauuuaccuagauugugugugaacaaa

SEQ ID NO: 323604 - RNA, 32 nt, Human
aggcuucacaagucacgagauggcaguuuugg

SEQ ID NO: 323605 - RNA, 31 nt, Human
aggcuucacagcuuaaugccaaggacagcga

SEQ ID NO: 323606 - RNA, 32 nt, Human
aggcuucacccacuggaaagaaccaccaucug

SEQ ID NO: 323607 - RNA, 32 nt, Human
aggcuucaccugcugauuagaaauguggucgg

SEQ ID NO: 323608 - RNA, 32 nt, Human
aggcuucacugccucugcuuccagcugcagcc

SEQ ID NO: 323609 - RNA, 32 nt, Human
aggcuucagccaccacacccagccucauucau

SEQ ID NO: 323610 - RNA, 32 nt, Human
aggcuucagcccugggcucugaggggaaagag

SEQ ID NO: 323611 - RNA, 19 nt, Human
aggcuucaggagcccaaga

SEQ ID NO: 323612 - RNA, 32 nt, Human
aggcuucagugagccaugaucaugccacugca

SEQ ID NO: 323613 - RNA, 32 nt, Human
aggcuucauaugcacaugcacacuguccccua

SEQ ID NO: 323614 - RNA, 24 nt, Human
aggcuucauccaggaacuagguga

SEQ ID NO: 323615 - RNA, 32 nt, Human
aggcuucaucuuaggugaggaggcaggagaga

SEQ ID NO: 323616 - RNA, 32 nt, Human
aggcuucaucuucucccuguaacugagauuuc

SEQ ID NO: 323617 - RNA, 24 nt, Human
aggcuucaugcaggaacuaaguga

SEQ ID NO: 323618 - RNA, 32 nt, Human
aggcuucaugccugcauccuccagagaccacc

SEQ ID NO: 323619 - RNA, 32 nt, Human
aggcuuccaagaaccuccagaaaccuacugga

SEQ ID NO: 323620 - RNA, 32 nt, Human
aggcuuccacugcauccuggccaggggacgga

SEQ ID NO: 323621 - RNA, 32 nt, Human
aggcuuccagaugggagacccaucucucuugu

SEQ ID NO: 323622 - RNA, 32 nt, Human
aggcuuccauguccagaauccugcuuaagguu

SEQ ID NO: 323623 - RNA, 32 nt, Human
aggcuucccaggguuggggaggcugugggacc

SEQ ID NO: 323624 - RNA, 32 nt, Human
aggcuucccuugugucucccuggaccugccug

SEQ ID NO: 323625 - RNA, 32 nt, Human
aggcuuccuaagucagaccucuugucuaaauu

SEQ ID NO: 323626 - RNA, 32 nt, Human
aggcuuccuccagcggcuggguggugaaggac

SEQ ID NO: 323627 - RNA, 23 nt, Human
aggcuuccugcuuggaguccgca

SEQ ID NO: 323628 - RNA, 32 nt, Human
aggcuuccuggacaagguaguuccccagcuga

SEQ ID NO: 323629 - RNA, 32 nt, Human
aggcuuccuucuggggagaccccacacccaag

SEQ ID NO: 323630 - RNA, 32 nt, Human
aggcuucgggcgugaacugaacuccagacccc

SEQ ID NO: 323631 - RNA, 32 nt, Human
aggcuucgggggccagccgccgccaugauccu

SEQ ID NO: 323632 - RNA, 32 nt, Human
aggcuucuacagccucuucuccaccuaagcag

SEQ ID NO: 323633 - RNA, 32 nt, Human
aggcuucucaacagaugggaaguggcuguggu

SEQ ID NO: 323634 - RNA, 32 nt, Human
aggcuucucacugcucacgaccuccgugccgg

SEQ ID NO: 323635 - RNA, 19 nt, Human
aggcuucuccccucagggg

SEQ ID NO: 323636 - RNA, 32 nt, Human
aggcuucuccugcugaguccuggucuuggccu

SEQ ID NO: 323637 - RNA, 32 nt, Human
aggcuucucugaauugugcucauuccaaauua

SEQ ID NO: 323638 - RNA, 32 nt, Human
aggcuucugaccaugucugagcucuuuacccc

SEQ ID NO: 323639 - RNA, 32 nt, Human
aggcuucugagagaugaacauacacaucucua

SEQ ID NO: 323640 - RNA, 32 nt, Human
aggcuucugaguagcuaggacuauggguacau

SEQ ID NO: 323641 - RNA, 32 nt, Human
aggcuucugaguagcugggauuauaggugcgc

SEQ ID NO: 323642 - RNA, 32 nt, Human
aggcuucugcagcuuuggcugcacgucacccu

SEQ ID NO: 323643 - RNA, 32 nt, Human
aggcuucugccuggccgccgccgccuauaagc

SEQ ID NO: 323644 - RNA, 32 nt, Human
aggcuucugggagauucugcagggucagcuuu

SEQ ID NO: 323645 - RNA, 32 nt, Human
aggcuucugggaggcuggagauccuuucucuc

SEQ ID NO: 323646 - RNA, 32 nt, Human
aggcuucuguaaucccagcuacuugggaggcu

SEQ ID NO: 323647 - RNA, 32 nt, Human
aggcuucuuccuggauggggcagagcuucucc

SEQ ID NO: 323648 - RNA, 32 nt, Human
aggcuucuugacuugccccuugugacuugaaa

SEQ ID NO: 323649 - RNA, 32 nt, Human
aggcuucuuguccaccucuucuccccugccca

SEQ ID NO: 323650 - RNA, 32 nt, Human
aggcuugacccacugcgcccagccugcaucuu

SEQ ID NO: 323651 - RNA, 32 nt, Human
aggcuugacuuugaggagaggcugugauguuu

SEQ ID NO: 323652 - RNA, 32 nt, Human
aggcuugagaucuagcaaugaacaagaucucu

SEQ ID NO: 323653 - RNA, 22 nt, Human
aggcuugagccaccgcacccgg

SEQ ID NO: 323654 - RNA, 22 nt, Human
aggcuugagccaccgcgcccgg

SEQ ID NO: 323655 - RNA, 32 nt, Human
aggcuugagccacugcaccuagccucuauuug

SEQ ID NO: 323656 - RNA, 32 nt, Human
aggcuugagcccaggagguggagguugcaaug

SEQ ID NO: 323657 - RNA, 24 nt, Human
aggcuugauuagguaaacaaagca

SEQ ID NO: 323658 - RNA, 32 nt, Human
aggcuugcagugagccaugaucaugccacugu

SEQ ID NO: 323659 - RNA, 32 nt, Human
aggcuugccauggcuagucgaggggcucggca

SEQ ID NO: 323660 - RNA, 32 nt, Human
aggcuugccccucagcucagcacuguugacca

SEQ ID NO: 323661 - RNA, 32 nt, Human
aggcuugcuaaguguguuuccugcugacuaca

SEQ ID NO: 323662 - RNA, 32 nt, Human
aggcuugcugaagaagggagaaaaagaacagc

SEQ ID NO: 323663 - RNA, 24 nt, Human
aggcuugcuuagguaaacaaagca

SEQ ID NO: 323664 - RNA, 24 nt, Human
aggcuugcuuagguaaacagagca

SEQ ID NO: 323665 - RNA, 32 nt, Human
aggcuuggaaagaggcaugugaagagcuuuaa

SEQ ID NO: 323666 - RNA, 32 nt, Human
aggcuuggaacuaguaccuacuuuaaaagaug

SEQ ID NO: 323667 - RNA, 32 nt, Human
aggcuuggaagaggaugauaaagaaaaugaua

SEQ ID NO: 323668 - RNA, 32 nt, Human
aggcuuggagagugagccaacaucaagaaggc

SEQ ID NO: 323669 - RNA, 32 nt, Human
aggcuuggcuuaguacucucaucucugguucc

SEQ ID NO: 323670 - RNA, 32 nt, Human
aggcuugggaaagaucugucagaggagccuuu

SEQ ID NO: 323671 - RNA, 32 nt, Human
aggcuugggaaggcuggcugcugcccucagcu

SEQ ID NO: 323672 - RNA, 32 nt, Human
aggcuugggaauggguugggagaggcaucugu

SEQ ID NO: 323673 - RNA, 32 nt, Human
aggcuugggaggcggggcccugcaggacguca

SEQ ID NO: 323674 - RNA, 32 nt, Human
aggcuugggauuucauuuaaauaaucuaagcc

SEQ ID NO: 323675 - RNA, 32 nt, Human
aggcuugggcuccauucccaucacugcugucc

SEQ ID NO: 323676 - RNA, 32 nt, Human
aggcuuggggcugcuccaugguggcuggucac

SEQ ID NO: 323677 - RNA, 32 nt, Human
aggcuugggggugauggaggaggacucgguaa

SEQ ID NO: 323678 - RNA, 32 nt, Human
aggcuugggugcauuugcggaagaggaauuug

SEQ ID NO: 323679 - RNA, 32 nt, Human
aggcuugggugggguuuguggugcaggcaguc

SEQ ID NO: 323680 - RNA, 32 nt, Human
aggcuuggugaguuggacucuguaaggaauuu

SEQ ID NO: 323681 - RNA, 32 nt, Human
aggcuuggugaucucugaagauggcaccaacc

SEQ ID NO: 323682 - RNA, 32 nt, Human
aggcuugguggagucaguggaacagggacaug

SEQ ID NO: 323683 - RNA, 32 nt, Human
aggcuugguuuuccugaccugcccugauucca

SEQ ID NO: 323684 - RNA, 32 nt, Human
aggcuugucucaaacuccugaccucaaaucau

SEQ ID NO: 323685 - RNA, 32 nt, Human
aggcuugucucaaacuccuggccuuaagugau

SEQ ID NO: 323686 - RNA, 32 nt, Human
aggcuugucucgaacuccugaccccaaguuau

SEQ ID NO: 323687 - RNA, 32 nt, Human
aggcuugucuggaacuccugggcucaagggau

SEQ ID NO: 323688 - RNA, 32 nt, Human
aggcuugucuugaacuccugaccuugagauau

SEQ ID NO: 323689 - RNA, 32 nt, Human
aggcuuguggccuggcuguucauggccacugc

SEQ ID NO: 323690 - RNA, 32 nt, Human
aggcuuguggucaagcaaaaauucagcccuga

SEQ ID NO: 323691 - RNA, 32 nt, Human
aggcuuuaaagugccucagggguccccugaaa

SEQ ID NO: 323692 - RNA, 32 nt, Human
aggcuuuaaggagugagagagauguguacaua

SEQ ID NO: 323693 - RNA, 32 nt, Human
aggcuuuacaacagugcuacugaccccuauga

SEQ ID NO: 323694 - RNA, 32 nt, Human
aggcuuuacaguuuaagccacagggaaagaaa

SEQ ID NO: 323695 - RNA, 32 nt, Human
aggcuuuagaaauuccuguugcagagauuuau

SEQ ID NO: 323696 - RNA, 32 nt, Human
aggcuuuagcucccagauucccaugugcuaaa

SEQ ID NO: 323697 - RNA, 32 nt, Human
aggcuuuaggaucagagagcagcagauucaaa

SEQ ID NO: 323698 - RNA, 32 nt, Human
aggcuuuauccaggugcuacagacagggugaa

SEQ ID NO: 323699 - RNA, 24 nt, Human
aggcuuucaaggguuuucuucccu

SEQ ID NO: 323700 - RNA, 32 nt, Human
aggcuuucagccagcagacaugauggggagag

SEQ ID NO: 323701 - RNA, 32 nt, Human
aggcuuucagccuugaggcaacauuggauauu

SEQ ID NO: 323702 - RNA, 32 nt, Human
aggcuuucaugcccuucucagcugcacacucc

SEQ ID NO: 323703 - RNA, 32 nt, Human
aggcuuucgggcaugacucacaccuggcacaa

SEQ ID NO: 323704 - RNA, 32 nt, Human
aggcuuucguuggagaaacagaaauaaggccu

SEQ ID NO: 323705 - RNA, 32 nt, Human
aggcuuucuccaggaggauuagcuuggaguuc

SEQ ID NO: 323706 - RNA, 22 nt, Human
aggcuuucugaggccugugcca

SEQ ID NO: 323707 - RNA, 32 nt, Human
aggcuuugaagaggaggagaugcagaagauaa

SEQ ID NO: 323708 - RNA, 32 nt, Human
aggcuuugacugggcugccugccugugagguc

SEQ ID NO: 323709 - RNA, 32 nt, Human
aggcuuugagaaccaaggcuugaaggccggca

SEQ ID NO: 323710 - RNA, 32 nt, Human
aggcuuugagggcugaagucucccuuuguuac

SEQ ID NO: 323711 - RNA, 32 nt, Human
aggcuuugcaaacugugaagugcagugccuac

SEQ ID NO: 323712 - RNA, 32 nt, Human
aggcuuugcagccugggagaccccgacuuucu

SEQ ID NO: 323713 - RNA, 32 nt, Human
aggcuuugcuguuccccagcagccugcagagg

SEQ ID NO: 323714 - RNA, 32 nt, Human
aggcuuugggaagggcuucagaauucagccug

SEQ ID NO: 323715 - RNA, 32 nt, Human
aggcuuuguauaaucccacccaccucaccaaa

SEQ ID NO: 323716 - RNA, 32 nt, Human
aggcuuugucauaauucaugcauauguugggc

SEQ ID NO: 323717 - RNA, 32 nt, Human
aggcuuugugggaaaaugaucuaaauuauugu

SEQ ID NO: 323718 - RNA, 32 nt, Human
aggcuuuuaagcaugauucacaccuggcaaaa

SEQ ID NO: 323719 - RNA, 32 nt, Human
aggcuuuucaggaugggacuucagaccaagga

SEQ ID NO: 323720 - RNA, 32 nt, Human
aggcuuuuccuuccucuuguaaguaaagcucg

SEQ ID NO: 323721 - RNA, 32 nt, Human
aggcuuuugaauggucucccucuccccagccc

SEQ ID NO: 323722 - RNA, 21 nt, Human
aggcuuuugcuacucuucacu

SEQ ID NO: 323723 - RNA, 23 nt, Human
aggcuuuuucagugaucuucacu

SEQ ID NO: 323724 - RNA, 32 nt, Human
agggaaaaaguuguaucaguaccauuugaucu

SEQ ID NO: 323725 - RNA, 32 nt, Human
agggaaaaauaggcauuuccacaguacuauua

SEQ ID NO: 323726 - RNA, 32 nt, Human
agggaaaagagcuggagguggggagagaaaga

SEQ ID NO: 323727 - RNA, 32 nt, Human
agggaaaagccaccuucccaggcacagccaua

SEQ ID NO: 323728 - RNA, 32 nt, Human
agggaaaagcuaagcugggacugaggcaugca

SEQ ID NO: 323729 - RNA, 32 nt, Human
agggaaaaggagagagcaauugaggcaguuga

SEQ ID NO: 323730 - RNA, 32 nt, Human
agggaaaaggcaaggcuuccaggccaguuggc

SEQ ID NO: 323731 - RNA, 30 nt, Human
agggaaaaggcccacagggcacagauggca

SEQ ID NO: 323732 - RNA, 20 nt, Human
agggaaaauggaggcuccag

SEQ ID NO: 323733 - RNA, 32 nt, Human
agggaaaauggcgaacgacuccccugcaaaaa

SEQ ID NO: 323734 - RNA, 32 nt, Human
agggaaaauguucauucuucaucagcuuugcu

SEQ ID NO: 323735 - RNA, 32 nt, Human
agggaaaauugcuuccucuggggaggcgaaua

SEQ ID NO: 323736 - RNA, 32 nt, Human
agggaaacacucuuuccacucuucccagacug

SEQ ID NO: 323737 - RNA, 32 nt, Human
agggaaaccacuggucucugacugccuuuccc

SEQ ID NO: 323738 - RNA, 23 nt, Human
agggaaacccugucuuuacaaaa

SEQ ID NO: 323739 - RNA, 32 nt, Human
agggaaaccugacaucucauuuucucaguguc

SEQ ID NO: 323740 - RNA, 32 nt, Human
agggaaacggcgcuccagccaaggcacggggu

SEQ ID NO: 323741 - RNA, 32 nt, Human
agggaaacugauuagauggguuguguuugugu

SEQ ID NO: 323742 - RNA, 18 nt, Human
agggaaagaaacaacuuu

SEQ ID NO: 323743 - RNA, 32 nt, Human
agggaaagaagguugcuguggugaggaacgag

SEQ ID NO: 323744 - RNA, 32 nt, Human
agggaaagagagagaauaccuacauauaaggu

SEQ ID NO: 323745 - RNA, 32 nt, Human
agggaaagaggcuugggaagaaaacagcagaa

SEQ ID NO: 323746 - RNA, 32 nt, Human
agggaaagcaagaaacuagaugccuguguggu

SEQ ID NO: 323747 - RNA, 32 nt, Human
agggaaagcuuuuuccucugggccacaugccc

SEQ ID NO: 323748 - RNA, 32 nt, Human
agggaaaggaagacagucucacagaggaaggg

SEQ ID NO: 323749 - RNA, 32 nt, Human
agggaaaggaagacuguuagaggcucuuuuga

SEQ ID NO: 323750 - RNA, 32 nt, Human
agggaaaggaagaggagugggccugaggagca

SEQ ID NO: 323751 - RNA, 32 nt, Human
agggaaaggaagaggcaaagaggagcaugcaa

SEQ ID NO: 323752 - RNA, 32 nt, Human
agggaaaggagagagaaggaaaggagugaggu

SEQ ID NO: 323753 - RNA, 32 nt, Human
agggaaaggaggagggagagagauggagagga

SEQ ID NO: 323754 - RNA, 32 nt, Human
agggaaaggcagcagcggcggcagcuggagga

SEQ ID NO: 323755 - RNA, 32 nt, Human
agggaaaggcugucccgggaccccgaggagga

SEQ ID NO: 323756 - RNA, 32 nt, Human
agggaaaggggccaggguguucccgggguugg

SEQ ID NO: 323757 - RNA, 32 nt, Human
agggaaagggguuacagagagccuccucagau

SEQ ID NO: 323758 - RNA, 32 nt, Human
agggaaaggguggaugcucucaggcugaggga

SEQ ID NO: 323759 - RNA, 32 nt, Human
agggaaaggguggucagggugaggauggugag

SEQ ID NO: 323760 - RNA, 31 nt, Human
agggaaagugagaagaaaauuaauguauuag

SEQ ID NO: 323761 - RNA, 32 nt, Human
agggaaagugaguuuugagggaggagugguga

SEQ ID NO: 323762 - RNA, 32 nt, Human
agggaaagugggugaacagaggugagaaggag

SEQ ID NO: 323763 - RNA, 32 nt, Human
agggaaaguguaaaucuagaaaugagaaaccc

SEQ ID NO: 323764 - RNA, 32 nt, Human
agggaaaguuccagcaguuucaugagaugcag

SEQ ID NO: 323765 - RNA, 32 nt, Human
agggaaaguuuagacaucugcagagaggcagg

SEQ ID NO: 323766 - RNA, 32 nt, Human
agggaaauaaaucggcuggcccuacugcaauc

SEQ ID NO: 323767 - RNA, 32 nt, Human
agggaaaucacuuccuuuaggacugaaagcua

SEQ ID NO: 323768 - RNA, 32 nt, Human
agggaaaucucucccuucauuuacuuuuucuu

SEQ ID NO: 323769 - RNA, 32 nt, Human
agggaaaugugggcaacauacauauuugacaa

SEQ ID NO: 323770 - RNA, 32 nt, Human
agggaaauguugagccaaaguuaugccugcga

SEQ ID NO: 323771 - RNA, 32 nt, Human
agggaacaaaggagcggagaggggaggggaga

SEQ ID NO: 323772 - RNA, 32 nt, Human
agggaacaacuaagguggcugaagaccuuucu

SEQ ID NO: 323773 - RNA, 32 nt, Human
agggaacacaggaggagguguaguucuuaggg

SEQ ID NO: 323774 - RNA, 32 nt, Human
agggaacaccuggcauucugugguguuucgug

SEQ ID NO: 323775 - RNA, 32 nt, Human
agggaacacuaggacaaauccaaaaagugggu

SEQ ID NO: 323776 - RNA, 25 nt, Human
agggaacacugaaagacaguuuccu

SEQ ID NO: 323777 - RNA, 32 nt, Human
agggaacagaagcaccugcaguagugacagag

SEQ ID NO: 323778 - RNA, 32 nt, Human
agggaacaggcaggaagaucagggcagaauag

SEQ ID NO: 323779 - RNA, 23 nt, Human
agggaacaggugccaccugcugg

SEQ ID NO: 323780 - RNA, 32 nt, Human
agggaacauaucauaacugcacugugaugaag

SEQ ID NO: 323781 - RNA, 32 nt, Human
agggaacauggcaaaaccccagcucuacaaaa

SEQ ID NO: 323782 - RNA, 32 nt, Human
agggaaccaucucuccugcucuccuugggaug

SEQ ID NO: 323783 - RNA, 32 nt, Human
agggaacccaggaauugugagguuagcaggaa

SEQ ID NO: 323784 - RNA, 32 nt, Human
agggaacccugagcuccaagcgugcugugcgu

SEQ ID NO: 323785 - RNA, 32 nt, Human
agggaacccuuccaccaucaugugaagaagcc

SEQ ID NO: 323786 - RNA, 32 nt, Human
agggaaccgcccccaaacuagaaagcuaauuu

SEQ ID NO: 323787 - RNA, 32 nt, Human
agggaaccugaggccuucaaacaguggccgag

SEQ ID NO: 323788 - RNA, 32 nt, Human
agggaaccugggaacccuucuccccucaccuu

SEQ ID NO: 323789 - RNA, 32 nt, Human
agggaaccuuggagcugggaaggcaggaaacc

SEQ ID NO: 323790 - RNA, 32 nt, Human
agggaacuccacugugugacaguccuuucaau

SEQ ID NO: 323791 - RNA, 32 nt, Human
agggaacugcagguggauucuguugagaggca

SEQ ID NO: 323792 - RNA, 32 nt, Human
agggaacugccugggcucccuugugcgugggu

SEQ ID NO: 323793 - RNA, 32 nt, Human
agggaacuggacugucccauggccugugagca

SEQ ID NO: 323794 - RNA, 32 nt, Human
agggaacugggaagagaaggaggggaacuuaa

SEQ ID NO: 323795 - RNA, 32 nt, Human
agggaacuuggucacucggcacuuuuaagccu

SEQ ID NO: 323796 - RNA, 32 nt, Human
agggaagaaaugcagcaguauggaggcaaaag

SEQ ID NO: 323797 - RNA, 32 nt, Human
agggaagacgagaagagacaggccaggcccaa

SEQ ID NO: 323798 - RNA, 32 nt, Human
agggaagacgcugaggaggaggaggaggcgga

SEQ ID NO: 323799 - RNA, 32 nt, Human
agggaagacggccaaggcugggcccagaauau

SEQ ID NO: 323800 - RNA, 32 nt, Human
agggaagagaaagcaggcccagcuggagauuu

SEQ ID NO: 323801 - RNA, 22 nt, Human
agggaagagaaggaggcucacc

SEQ ID NO: 323802 - RNA, 32 nt, Human
agggaagagaauuggugcugcagaaguguacc

SEQ ID NO: 323803 - RNA, 19 nt, Human
agggaagagagaccagaga

SEQ ID NO: 323804 - RNA, 32 nt, Human
agggaagagaguagaguacuuucuccaagucc

SEQ ID NO: 323805 - RNA, 32 nt, Human
agggaagaggagaggaaggggagccggaccga

SEQ ID NO: 323806 - RNA, 32 nt, Human
agggaagagguagaggaugagaggaugaagag

SEQ ID NO: 323807 - RNA, 32 nt, Human
agggaagauauaugaauaucuuggccacagaa

SEQ ID NO: 323808 - RNA, 32 nt, Human
agggaagaucccggaggaagagugggaauuca

SEQ ID NO: 323809 - RNA, 32 nt, Human
agggaagcaaaagcuguuucuccucccagaga

SEQ ID NO: 323810 - RNA, 32 nt, Human
agggaagcaagaguaggguuguggaaagacca

SEQ ID NO: 323811 - RNA, 32 nt, Human
agggaagcaaucagaggaaaucuccugaaagg

SEQ ID NO: 323812 - RNA, 32 nt, Human
agggaagcaaugcagaaaucagagggcucugg

SEQ ID NO: 323813 - RNA, 32 nt, Human
agggaagcacaggccucggccucccagcuccc

SEQ ID NO: 323814 - RNA, 32 nt, Human
agggaagcagaggaugugagaggcagaggcag

SEQ ID NO: 323815 - RNA, 32 nt, Human
agggaagcagaugccagcguucucugcugaaa

SEQ ID NO: 323816 - RNA, 32 nt, Human
agggaagcaggaacucguggugccucaaggaa

SEQ ID NO: 323817 - RNA, 32 nt, Human
agggaagcaggggaggcggaaaaauagaguuu

SEQ ID NO: 323818 - RNA, 32 nt, Human
agggaagcagugaggaaagaugaggcaucgug

SEQ ID NO: 323819 - RNA, 32 nt, Human
agggaagccaucaucuaacaccucuggccacc

SEQ ID NO: 323820 - RNA, 32 nt, Human
agggaagcccagggaagagagggacuccuggu

SEQ ID NO: 323821 - RNA, 32 nt, Human
agggaagccgggcagcagaggaguacuugaag

SEQ ID NO: 323822 - RNA, 19 nt, Human
agggaagccugggggccag

SEQ ID NO: 323823 - RNA, 32 nt, Human
agggaagcguuucucaccccuuaacucacagc

SEQ ID NO: 323824 - RNA, 32 nt, Human
agggaagcugggaaguuaaggcugcaggcucc

SEQ ID NO: 323825 - RNA, 32 nt, Human
agggaagcugguugaagcccuggaccuguuug

SEQ ID NO: 323826 - RNA, 32 nt, Human
agggaagcuguacaaaacugagguggucaggu

SEQ ID NO: 323827 - RNA, 32 nt, Human
agggaagcuguggaggcaggcccuaccaagag

SEQ ID NO: 323828 - RNA, 32 nt, Human
agggaaggaaagaacuugcauguuggugaagg

SEQ ID NO: 323829 - RNA, 32 nt, Human
agggaaggaacgggaaaggugguucugaagga

SEQ ID NO: 323830 - RNA, 32 nt, Human
agggaaggaaggaagagagggaggcgggcaag

SEQ ID NO: 323831 - RNA, 32 nt, Human
agggaaggaaggagggcagguggcccuuugac

SEQ ID NO: 323832 - RNA, 32 nt, Human
agggaaggaauagaacgaggaguucaaucugu

SEQ ID NO: 323833 - RNA, 32 nt, Human
agggaaggaccucacuuguuucaucaaaugga

SEQ ID NO: 323834 - RNA, 32 nt, Human
agggaaggagagaagaguuccaggcaauccca

SEQ ID NO: 323835 - RNA, 32 nt, Human
agggaaggagaggagggauggagaagcucugc

SEQ ID NO: 323836 - RNA, 32 nt, Human
agggaaggagaggugucaggccuugucugcug

SEQ ID NO: 323837 - RNA, 32 nt, Human
agggaaggagcccggcccugccuugucagcgc

SEQ ID NO: 323838 - RNA, 32 nt, Human
agggaaggaggcaggggugcugagaaggcggc

SEQ ID NO: 323839 - RNA, 32 nt, Human
agggaaggaggcgguguucccccuggccugac

SEQ ID NO: 323840 - RNA, 32 nt, Human
agggaaggaggcuuggaggaggugagagugga

SEQ ID NO: 323841 - RNA, 32 nt, Human
agggaaggagggagaggaaggcaggggaguug

SEQ ID NO: 323842 - RNA, 32 nt, Human
agggaaggaugccucggagcugagguggggug

SEQ ID NO: 323843 - RNA, 32 nt, Human
agggaaggcccgucaugucccugcacucuguu

SEQ ID NO: 323844 - RNA, 32 nt, Human
agggaaggcgagaagagggaggagacacuggu

SEQ ID NO: 323845 - RNA, 32 nt, Human
agggaaggcgcgagugaggaaaggagguacug

SEQ ID NO: 323846 - RNA, 32 nt, Human
agggaagggaaagcacuggggugggggagcag

SEQ ID NO: 323847 - RNA, 32 nt, Human
agggaagggaaaguggcuggaaguugacuuaa

SEQ ID NO: 323848 - RNA, 32 nt, Human
agggaagggaacacaucccagccacagccagg

SEQ ID NO: 323849 - RNA, 32 nt, Human
agggaagggaggauggcuggggccaggggucu

SEQ ID NO: 323850 - RNA, 32 nt, Human
agggaagggaggugggcagcagugggucagag

SEQ ID NO: 323851 - RNA, 32 nt, Human
agggaagggaguaggaaaagaaaagcauuuuu

SEQ ID NO: 323852 - RNA, 32 nt, Human
agggaagggaguggagcaggcagugaggagag

SEQ ID NO: 323853 - RNA, 21 nt, Human
agggaagggcagaagcuuccu

SEQ ID NO: 323854 - RNA, 32 nt, Human
agggaagggccagauaggcaacuucauuuggc

SEQ ID NO: 323855 - RNA, 32 nt, Human
agggaagggcucagcuucccaccccacguaca

SEQ ID NO: 323856 - RNA, 32 nt, Human
agggaagggcuggccgcucacugcuugggccc

SEQ ID NO: 323857 - RNA, 32 nt, Human
agggaagggcugggaagagacagccuccaagg

SEQ ID NO: 323858 - RNA, 32 nt, Human
agggaagggcugggaugcugggaccuguuguu

SEQ ID NO: 323859 - RNA, 32 nt, Human
agggaagggcuggggugugaaaaagaagauug

SEQ ID NO: 323860 - RNA, 31 nt, Human
agggaaggggagagagaaggaauggggagug

SEQ ID NO: 323861 - RNA, 32 nt, Human
agggaaggggaguuggaacaaaugucuguucc

SEQ ID NO: 323862 - RNA, 32 nt, Human
agggaaggggaugucaucggggguccaggaaa

SEQ ID NO: 323863 - RNA, 22 nt, Human
agggaaggggcucccacugcuu

SEQ ID NO: 323864 - RNA, 32 nt, Human
agggaaggggcugggggaaccaggaaggaagc

SEQ ID NO: 323865 - RNA, 32 nt, Human
agggaagggggaaauggagggggaagagagga

SEQ ID NO: 323866 - RNA, 32 nt, Human
agggaagggggaggaggaggaggaucaugaag

SEQ ID NO: 323867 - RNA, 32 nt, Human
agggaagggguaggaaaggcacucugggcaga

SEQ ID NO: 323868 - RNA, 19 nt, Human
agggaaggguagccaggga

SEQ ID NO: 323869 - RNA, 32 nt, Human
agggaagggugguggagccaguaaacagagga

SEQ ID NO: 323870 - RNA, 32 nt, Human
agggaagguguuuugugcuucucagauguugc

SEQ ID NO: 323871 - RNA, 32 nt, Human
agggaagguuggcagagggauccaugugacug

SEQ ID NO: 323872 - RNA, 32 nt, Human
agggaaguaucucccggccaucuuguugcucu

SEQ ID NO: 323873 - RNA, 16 nt, Human
agggaagucuccgccc

SEQ ID NO: 323874 - RNA, 32 nt, Human
agggaagucuccgcccugauuggaugaggaaa

SEQ ID NO: 323875 - RNA, 32 nt, Human
agggaagucugccuggugaggcuggcaggugg

SEQ ID NO: 323876 - RNA, 32 nt, Human
agggaauaaaggcucagggaccggcaguucua

SEQ ID NO: 323877 - RNA, 32 nt, Human
agggaauaaauacaaagauggaaagccaguaa

SEQ ID NO: 323878 - RNA, 32 nt, Human
agggaauagaaauguacaaucaagagaauuca

SEQ ID NO: 323879 - RNA, 32 nt, Human
agggaauaguauugcagggaagacugagaaaa

SEQ ID NO: 323880 - RNA, 31 nt, Human
agggaauaguuucagugacauuaugucauug

SEQ ID NO: 323881 - RNA, 32 nt, Human
agggaaucacuacaggcugguuagccaaaaag

SEQ ID NO: 323882 - RNA, 32 nt, Human
agggaauccaaucaauaaaauugaagacuggc

SEQ ID NO: 323883 - RNA, 17 nt, Human
agggaaucgacugaaga

SEQ ID NO: 323884 - RNA, 32 nt, Human
agggaaucggaauaacuccagcaaggaaaugg

SEQ ID NO: 323885 - RNA, 32 nt, Human
agggaaucuccccagccgacuuccacugggcu

SEQ ID NO: 323886 - RNA, 32 nt, Human
agggaaucucuugccugcuccaucucauaggc

SEQ ID NO: 323887 - RNA, 32 nt, Human
agggaaugaaacacccucaccccuucaaaguc

SEQ ID NO: 323888 - RNA, 32 nt, Human
agggaaugaaauggaaagggaggcugauuccc

SEQ ID NO: 323889 - RNA, 30 nt, Human
agggaaugccccggagggcggagaacuggg

SEQ ID NO: 323890 - RNA, 32 nt, Human
agggaaugcuuugcuugaggccacacagcagg

SEQ ID NO: 323891 - RNA, 32 nt, Human
agggaauggaaaggaauggaaagauuuguugg

SEQ ID NO: 323892 - RNA, 32 nt, Human
agggaauggagcagcugccugcaccaagcuuc

SEQ ID NO: 323893 - RNA, 32 nt, Human
agggaaugggagaagaugggagcuaagaaugu

SEQ ID NO: 323894 - RNA, 32 nt, Human
agggaauggggagggggaaguagagcugagaa

SEQ ID NO: 323895 - RNA, 32 nt, Human
agggaauggggugggagaugugggggaauggu

SEQ ID NO: 323896 - RNA, 32 nt, Human
agggaauggggugggagucgggggaagugcag

SEQ ID NO: 323897 - RNA, 32 nt, Human
agggaauguaugggagauggugaggggugcca

SEQ ID NO: 323898 - RNA, 32 nt, Human
agggaaugugagacaacacaauauugcugugg

SEQ ID NO: 323899 - RNA, 32 nt, Human
agggaauuaagggcagauaauacacauagaua

SEQ ID NO: 323900 - RNA, 32 nt, Human
agggaauucacaggacccccugagaagagcca

SEQ ID NO: 323901 - RNA, 32 nt, Human
agggaauuccuauaauuguguggaauguggca

SEQ ID NO: 323902 - RNA, 32 nt, Human
agggaauugcugucuggucaucaucuauuguu

SEQ ID NO: 323903 - RNA, 32 nt, Human
agggaauuuaaguaacuugcucaauaucacuc

SEQ ID NO: 323904 - RNA, 32 nt, Human
agggacaaaaggacccagaaguagaagaaugg

SEQ ID NO: 323905 - RNA, 24 nt, Human
agggacaaaauuugguuaauuuuu

SEQ ID NO: 323906 - RNA, 32 nt, Human
agggacaaaugccucccuucccugcagcuucc

SEQ ID NO: 323907 - RNA, 32 nt, Human
agggacaagcaagcccaugucuugccagcuuc

SEQ ID NO: 323908 - RNA, 32 nt, Human
agggacaauaagcuagagacccugccagcauc

SEQ ID NO: 323909 - RNA, 32 nt, Human
agggacaaugccaagaccagaucuaagacccc

SEQ ID NO: 323910 - RNA, 23 nt, Human
agggacaauggugggcaguugcu

SEQ ID NO: 323911 - RNA, 32 nt, Human
agggacacaaggacuugggugcaucaggacgc

SEQ ID NO: 323912 - RNA, 22 nt, Human
agggacacacacgacacaggga

SEQ ID NO: 323913 - RNA, 19 nt, Human
agggacacacagccaggaa

SEQ ID NO: 323914 - RNA, 32 nt, Human
agggacacacagccuagcacagcagcuuauaa

SEQ ID NO: 323915 - RNA, 32 nt, Human
agggacaccaagcaggaggugccggguaagcu

SEQ ID NO: 323916 - RNA, 32 nt, Human
agggacacccccagugccuggauuacgggccc

SEQ ID NO: 323917 - RNA, 32 nt, Human
agggacaccucaguuguccucccgcgggcccu

SEQ ID NO: 323918 - RNA, 32 nt, Human
agggacaccucccggguucaagcaguucuccu

SEQ ID NO: 323919 - RNA, 23 nt, Human
agggacacgagggcaacccugug

SEQ ID NO: 323920 - RNA, 32 nt, Human
agggacacugaugccacagcuccugggccggc

SEQ ID NO: 323921 - RNA, 32 nt, Human
agggacacuggcagcuguggaaaugaaugagg

SEQ ID NO: 323922 - RNA, 16 nt, Human
agggacacugggcugg

SEQ ID NO: 323923 - RNA, 23 nt, Human
agggacacuuagggccacagagg

SEQ ID NO: 323924 - RNA, 32 nt, Human
agggacagaaauugugcauucaaggagcuugg

SEQ ID NO: 323925 - RNA, 32 nt, Human
agggacagagcagaggggccagggacugagug

SEQ ID NO: 323926 - RNA, 32 nt, Human
agggacagagcccgggagagacucgcucacuc

SEQ ID NO: 323927 - RNA, 32 nt, Human
agggacagagccucuuucucugagaacuacca

SEQ ID NO: 323928 - RNA, 32 nt, Human
agggacagaggccagcagaggagccagcuuac

SEQ ID NO: 323929 - RNA, 32 nt, Human
agggacagagggcuguaccuaacgcucacgca

SEQ ID NO: 323930 - RNA, 32 nt, Human
agggacagaguuucaccauguuggccaggcug

SEQ ID NO: 323931 - RNA, 32 nt, Human
agggacagaguuuugcuauguugcccagauug

SEQ ID NO: 323932 - RNA, 32 nt, Human
agggacagaugugugggagugcagggcugcag

SEQ ID NO: 323933 - RNA, 32 nt, Human
agggacagcagcaccacuccagccucagagac

SEQ ID NO: 323934 - RNA, 32 nt, Human
agggacagccuccagguagagcuguucgccgg

SEQ ID NO: 323935 - RNA, 32 nt, Human
agggacagcguccccuuccagcgggggcagcc

SEQ ID NO: 323936 - RNA, 21 nt, Human
agggacagcuggcuacaggga

SEQ ID NO: 323937 - RNA, 32 nt, Human
agggacaggaaggacaggggaugccugaccug

SEQ ID NO: 323938 - RNA, 32 nt, Human
agggacaggaguuggauggagagcagacugua

SEQ ID NO: 323939 - RNA, 32 nt, Human
agggacaggcccuuccccuccucaugucuccu

SEQ ID NO: 323940 - RNA, 32 nt, Human
agggacaggcugaagagagggacaggcacucc

SEQ ID NO: 323941 - RNA, 32 nt, Human
agggacagggaaauaaauggugccugggauga

SEQ ID NO: 323942 - RNA, 32 nt, Human
agggacagggagugggcaaggggaagaagcag

SEQ ID NO: 323943 - RNA, 32 nt, Human
agggacagggcagaggggacccugccacagcu

SEQ ID NO: 323944 - RNA, 32 nt, Human
agggacaggggcccuuccaaagagcaggacuc

SEQ ID NO: 323945 - RNA, 32 nt, Human
agggacagggucuugcucuguugccaaguuaa

SEQ ID NO: 323946 - RNA, 32 nt, Human
agggacagggucuugcucuguugcccaggcug

SEQ ID NO: 323947 - RNA, 32 nt, Human
agggacaggguucugguucuggcucaaccuug

SEQ ID NO: 323948 - RNA, 22 nt, Human
agggacagguacaaacaacuuc

SEQ ID NO: 323949 - RNA, 27 nt, Human
agggacagguccccacggccacaggga

SEQ ID NO: 323950 - RNA, 32 nt, Human
agggacaguaggcggaggaccaggugacggca

SEQ ID NO: 323951 - RNA, 32 nt, Human
agggacaguuacuuaacucaggaaaagcaacc

SEQ ID NO: 323952 - RNA, 32 nt, Human
agggacaguuaucugggagagguggaggaggg

SEQ ID NO: 323953 - RNA, 32 nt, Human
agggacaucgggggcaaguuugcaguggggcc

SEQ ID NO: 323954 - RNA, 32 nt, Human
agggacaugaugaagagguuggugagcgucug

SEQ ID NO: 323955 - RNA, 32 nt, Human
agggacaugauggggaaggaguacaaaacaau

SEQ ID NO: 323956 - RNA, 32 nt, Human
agggacaugcuguccucugcuccuggguguac

SEQ ID NO: 323957 - RNA, 32 nt, Human
agggacauggcacgggcaccugcucugucugg

SEQ ID NO: 323958 - RNA, 23 nt, Human
agggacauggcagggccugggca

SEQ ID NO: 323959 - RNA, 32 nt, Human
agggacauggguggaaugauggcagaauccag

SEQ ID NO: 323960 - RNA, 32 nt, Human
agggacauuuaagaguuggaggugcaaauaua

SEQ ID NO: 323961 - RNA, 32 nt, Human
agggaccaagaccacacucgggcugcuuggac

SEQ ID NO: 323962 - RNA, 22 nt, Human
agggaccaagugggggagccug

SEQ ID NO: 323963 - RNA, 32 nt, Human
agggaccacaaacauggaggccacgggcucua

SEQ ID NO: 323964 - RNA, 32 nt, Human
agggaccaccugcaccaggcacuuuucuccuc

SEQ ID NO: 323965 - RNA, 32 nt, Human
agggaccacucuggcuucugugcauccaccca

SEQ ID NO: 323966 - RNA, 32 nt, Human
agggaccagaagcgggagcugagcgcagggga

SEQ ID NO: 323967 - RNA, 32 nt, Human
agggaccagaccgggagguguuucugggcggg

SEQ ID NO: 323968 - RNA, 32 nt, Human
agggaccagagggagccaggcagcuguguaca

SEQ ID NO: 323969 - RNA, 32 nt, Human
agggaccagagggaggaggccgggagcagcga

SEQ ID NO: 323970 - RNA, 25 nt, Human
agggaccagauguguccugccucau

SEQ ID NO: 323971 - RNA, 32 nt, Human
agggaccagcuggaacuggacaggcugaaaga

SEQ ID NO: 323972 - RNA, 32 nt, Human
agggaccaggccaaaaccagacugccacugcc

SEQ ID NO: 323973 - RNA, 32 nt, Human
agggaccagggcaggcagaggucuuccugccu

SEQ ID NO: 323974 - RNA, 32 nt, Human
agggaccagggugggagagcugauugcagaaa

SEQ ID NO: 323975 - RNA, 31 nt, Human
agggaccaguuucacuuuuagcaccuacccu

SEQ ID NO: 323976 - RNA, 32 nt, Human
agggacccagaagagccuggagauguuggugc

SEQ ID NO: 323977 - RNA, 32 nt, Human
agggacccagggcauugggggaagggaggcga

SEQ ID NO: 323978 - RNA, 32 nt, Human
agggacccaguguacccagccucuggccucgu

SEQ ID NO: 323979 - RNA, 32 nt, Human
agggaccccugccacuguccccugcugcagca

SEQ ID NO: 323980 - RNA, 32 nt, Human
agggaccccugccccugucugccagcagaggc

SEQ ID NO: 323981 - RNA, 32 nt, Human
agggaccccugcccuugucccacucaagccaa

SEQ ID NO: 323982 - RNA, 32 nt, Human
agggacccgacucugucucuucugcuggaaac

SEQ ID NO: 323983 - RNA, 32 nt, Human
agggacccggcccugcccugccgcccgcugac

SEQ ID NO: 323984 - RNA, 32 nt, Human
agggacccucaaggaccucgagguuacugcag

SEQ ID NO: 323985 - RNA, 32 nt, Human
agggacccucagaaggcagcagugaugcggac

SEQ ID NO: 323986 - RNA, 32 nt, Human
agggacccuccaccaccucuuugggccuggcu

SEQ ID NO: 323987 - RNA, 32 nt, Human
agggacccuccagaaacacaguguuucaagag

SEQ ID NO: 323988 - RNA, 32 nt, Human
agggacccugcucuggcugugacugcuuuauc

SEQ ID NO: 323989 - RNA, 21 nt, Human
agggacccuggagcccuggga

SEQ ID NO: 323990 - RNA, 32 nt, Human
agggaccgagugagccacuccuugucccgagc

SEQ ID NO: 323991 - RNA, 32 nt, Human
agggaccgccugggugaggugaggaccuggug

SEQ ID NO: 323992 - RNA, 22 nt, Human
agggaccgcggggcagcccccu

SEQ ID NO: 323993 - RNA, 32 nt, Human
agggaccgcuugcugccgaggcugccaccuca

SEQ ID NO: 323994 - RNA, 32 nt, Human
agggaccggcagagcucuacaggccugcagcc

SEQ ID NO: 323995 - RNA, 32 nt, Human
agggaccgggccuggaaagggggugaagggaa

SEQ ID NO: 323996 - RNA, 32 nt, Human
agggaccuaccugagccaccguccuagccaag

SEQ ID NO: 323997 - RNA, 32 nt, Human
agggaccuacugaacccagagucaggaagaga

SEQ ID NO: 323998 - RNA, 32 nt, Human
agggaccucaacuacacugaucaccagcccca

SEQ ID NO: 323999 - RNA, 32 nt, Human
agggaccucaaggagcuaugaacauagaaacc

SEQ ID NO: 324000 - RNA, 32 nt, Human
agggaccucugacugcucugggccaaagaauc

SEQ ID NO: 324001 - RNA, 32 nt, Human
agggaccucugccuucucccacaccccuuaca

SEQ ID NO: 324002 - RNA, 32 nt, Human
agggaccugaguaacuggugguguguagcagg

SEQ ID NO: 324003 - RNA, 32 nt, Human
agggaccugagucaucgcacacaugagccugu

SEQ ID NO: 324004 - RNA, 32 nt, Human
agggaccugccaccccuucccucccuccgcag

SEQ ID NO: 324005 - RNA, 32 nt, Human
agggaccugcucccauuuucuuuccuagugga

SEQ ID NO: 324006 - RNA, 32 nt, Human
agggaccuggaacccucuuggccaaggggagu

SEQ ID NO: 324007 - RNA, 24 nt, Human
agggaccuuaccagauucguguca

SEQ ID NO: 324008 - RNA, 32 nt, Human
agggaccuuagcaaucaucucauccauuuccc

SEQ ID NO: 324009 - RNA, 32 nt, Human
agggaccuuuggcugcuuucucuccuuaaacu

SEQ ID NO: 324010 - RNA, 32 nt, Human
agggacgaggggcuggcucucaguccccgccu

SEQ ID NO: 324011 - RNA, 32 nt, Human
agggacgauccuuguucucugcuguaaacugu

SEQ ID NO: 324012 - RNA, 32 nt, Human
agggacgccaaagagagguugcagucagaacc

SEQ ID NO: 324013 - RNA, 32 nt, Human
agggacgccaagcagacacaccugcccucccc

SEQ ID NO: 324014 - RNA, 32 nt, Human
agggacgcccaggguggggaggaagagucugc

SEQ ID NO: 324015 - RNA, 32 nt, Human
agggacgcgaauaaguuugcuccuucauauaa

SEQ ID NO: 324016 - RNA, 19 nt, Human
agggacgcugagcggucgc

SEQ ID NO: 324017 - RNA, 32 nt, Human
agggacggaaucaaucgugugaccgaugggcu

SEQ ID NO: 324018 - RNA, 32 nt, Human
agggacggagccaagauggcggcggccgacgg

SEQ ID NO: 324019 - RNA, 32 nt, Human
agggacggaggacccaggcuggcuggggacug

SEQ ID NO: 324020 - RNA, 32 nt, Human
agggacggccucuccccuccuaccugccaccg

SEQ ID NO: 324021 - RNA, 32 nt, Human
agggacggggaggggagccaggacccaggagc

SEQ ID NO: 324022 - RNA, 32 nt, Human
agggacgggguuacaccauguuggccaggcug

SEQ ID NO: 324023 - RNA, 32 nt, Human
agggacgggguuucaccguguuagccaggaug

SEQ ID NO: 324024 - RNA, 32 nt, Human
agggacgggguuucaucauguuggccagacug

SEQ ID NO: 324025 - RNA, 32 nt, Human
agggacgguacccgcuucugccaccuccugga

SEQ ID NO: 324026 - RNA, 21 nt, Human
agggacggucaccauuccuga

SEQ ID NO: 324027 - RNA, 23 nt, Human
agggacggugacacacacagaga

SEQ ID NO: 324028 - RNA, 32 nt, Human
agggacguguggggacaggugcaccggaaacu

SEQ ID NO: 324029 - RNA, 32 nt, Human
agggacguuuuugcuuucuucccuuuuugacc

SEQ ID NO: 324030 - RNA, 32 nt, Human
agggacuaaccagaccugccacccuggcugcc

SEQ ID NO: 324031 - RNA, 32 nt, Human
agggacuaccuaaaccccuguccaucucugac

SEQ ID NO: 324032 - RNA, 32 nt, Human
agggacuagaucagaagagaucaagggcugua

SEQ ID NO: 324033 - RNA, 32 nt, Human
agggacuagggagggaggcagggaacguuuuu

SEQ ID NO: 324034 - RNA, 32 nt, Human
agggacuagggagggagggagggaaggcagag

SEQ ID NO: 324035 - RNA, 32 nt, Human
agggacuaucagagaugcaaaaauuacuucaa

SEQ ID NO: 324036 - RNA, 32 nt, Human
agggacucaaagcuguacccaaaucaagaaag

SEQ ID NO: 324037 - RNA, 22 nt, Human
agggacuccaaguucaucauca

SEQ ID NO: 324038 - RNA, 22 nt, Human
agggacuccuggggacacuccc

SEQ ID NO: 324039 - RNA, 22 nt, Human
agggacucggagguccacagca

SEQ ID NO: 324040 - RNA, 32 nt, Human
agggacucgggacugaaggucuccuggaagcu

SEQ ID NO: 324041 - RNA, 16 nt, Human
agggacucuccagccu

SEQ ID NO: 324042 - RNA, 32 nt, Human
agggacucuccccucacccccaccuuuuccuu

SEQ ID NO: 324043 - RNA, 32 nt, Human
agggacucuccucagcacaacaucucuaagug

SEQ ID NO: 324044 - RNA, 32 nt, Human
agggacucucucccguccccacccuauucuca

SEQ ID NO: 324045 - RNA, 32 nt, Human
agggacucugccucuuggaguuugguagcuac

SEQ ID NO: 324046 - RNA, 32 nt, Human
agggacucuggacuccauuccuccaggagcug

SEQ ID NO: 324047 - RNA, 32 nt, Human
agggacugaccagcuagcuaggagagcugaga

SEQ ID NO: 324048 - RNA, 32 nt, Human
agggacugacuccagcccuuggacucaggaca

SEQ ID NO: 324049 - RNA, 32 nt, Human
agggacugacucugggcgucucugaagauggc

SEQ ID NO: 324050 - RNA, 22 nt, Human
agggacugaggggaacccuggg

SEQ ID NO: 324051 - RNA, 32 nt, Human
agggacugauuuuuauaggaaaggaggaaaaa

SEQ ID NO: 324052 - RNA, 32 nt, Human
agggacugcccaggacugaguccauauggaag

SEQ ID NO: 324053 - RNA, 32 nt, Human
agggacugcuaaggaagaggcugcauggcgcg

SEQ ID NO: 324054 - RNA, 32 nt, Human
agggacuggcacacuggccuccagaagggcag

SEQ ID NO: 324055 - RNA, 32 nt, Human
agggacuggccagggcacccugugcugcaggg

SEQ ID NO: 324056 - RNA, 32 nt, Human
agggacuggggagcacucacuucacuugugug

SEQ ID NO: 324057 - RNA, 32 nt, Human
agggacuggggaggggaggggaggggcgggau

SEQ ID NO: 324058 - RNA, 32 nt, Human
agggacugguugccaugagagcagccgucuga

SEQ ID NO: 324059 - RNA, 32 nt, Human
agggacugugguggugggcaucacgccugguc

SEQ ID NO: 324060 - RNA, 32 nt, Human
agggacuguguguugccacaggacacagucag

SEQ ID NO: 324061 - RNA, 32 nt, Human
agggacuuagaaacuugccugagaugguggac

SEQ ID NO: 324062 - RNA, 32 nt, Human
agggacuucucccgcaccccacucugucccag

SEQ ID NO: 324063 - RNA, 25 nt, Human
agggacuugccuugccucagaugaa

SEQ ID NO: 324064 - RNA, 32 nt, Human
agggacuugggaccugggagaauggggcugag

SEQ ID NO: 324065 - RNA, 32 nt, Human
agggacuuugccuauuaagucuaccaaauuaa

SEQ ID NO: 324066 - RNA, 32 nt, Human
agggacuuugccugcccagucuuuggagagcu

SEQ ID NO: 324067 - RNA, 32 nt, Human
agggagaaagagggaggaagagagggagggag

SEQ ID NO: 324068 - RNA, 32 nt, Human
agggagaaaggauggccggccuggcggcgcgg

SEQ ID NO: 324069 - RNA, 32 nt, Human
agggagaacagcuucucucaccccugagccuu

SEQ ID NO: 324070 - RNA, 22 nt, Human
agggagaaggcagcacacugcu

SEQ ID NO: 324071 - RNA, 32 nt, Human
agggagaaggcaggccucaggauugugcggag

SEQ ID NO: 324072 - RNA, 32 nt, Human
agggagaagggaaggaaggaaagaagagagga

SEQ ID NO: 324073 - RNA, 32 nt, Human
agggagaagggagaggaaugaauugaggaagu

SEQ ID NO: 324074 - RNA, 32 nt, Human
agggagaagggauggagcaggagcgggcuaag

SEQ ID NO: 324075 - RNA, 32 nt, Human
agggagaagucaggcccugccucuccagggua

SEQ ID NO: 324076 - RNA, 32 nt, Human
agggagaagucugcaagaugucaagggccaag

SEQ ID NO: 324077 - RNA, 32 nt, Human
agggagaaugagaaagagagggacagagagau

SEQ ID NO: 324078 - RNA, 32 nt, Human
agggagacagaagucuaggcccagggauggcu

SEQ ID NO: 324079 - RNA, 32 nt, Human
agggagacagacagagguugcagugagccgag

SEQ ID NO: 324080 - RNA, 32 nt, Human
agggagacagcagaagaaagaaagagagagaa

SEQ ID NO: 324081 - RNA, 32 nt, Human
agggagaccacauucccucccuugguugccac

SEQ ID NO: 324082 - RNA, 32 nt, Human
agggagaccagccugaccaauauggagaaauc

SEQ ID NO: 324083 - RNA, 23 nt, Human
agggagaccccaucucuacagaa

SEQ ID NO: 324084 - RNA, 23 nt, Human
agggagaccccaucucuaugaaa

SEQ ID NO: 324085 - RNA, 24 nt, Human
agggagacccccaucucuacaaaa

SEQ ID NO: 324086 - RNA, 23 nt, Human
agggagaccccgucucuacaaaa

SEQ ID NO: 324087 - RNA, 23 nt, Human
agggagaccccgucucuauaaaa

SEQ ID NO: 324088 - RNA, 22 nt, Human
agggagacccgugucgacaaaa

SEQ ID NO: 324089 - RNA, 23 nt, Human
agggagacccugucccuacaaaa

SEQ ID NO: 324090 - RNA, 23 nt, Human
agggagacccugucucuacagaa

SEQ ID NO: 324091 - RNA, 23 nt, Human
agggagacccugucucugcaaaa

SEQ ID NO: 324092 - RNA, 32 nt, Human
agggagaccgggaggaucacagagccagcaug

SEQ ID NO: 324093 - RNA, 32 nt, Human
agggagaccguggguuccgaaaaucccuggau

SEQ ID NO: 324094 - RNA, 32 nt, Human
agggagacggaucugggcuccgggagggacgc

SEQ ID NO: 324095 - RNA, 32 nt, Human
agggagacggcuagggcagcaagugaaggaca

SEQ ID NO: 324096 - RNA, 22 nt, Human
agggagacucaucucuacaaaa

SEQ ID NO: 324097 - RNA, 22 nt, Human
agggagacucugucaugucuga

SEQ ID NO: 324098 - RNA, 32 nt, Human
agggagacuuuccuccgauguuuauuuagcug

SEQ ID NO: 324099 - RNA, 32 nt, Human
agggagacuuuggcaacagauaacuagccuca

SEQ ID NO: 324100 - RNA, 32 nt, Human
agggagagaaaagauuuugaguuaaggucauu

SEQ ID NO: 324101 - RNA, 32 nt, Human
agggagagaccccagagagcuuguucccuccc

SEQ ID NO: 324102 - RNA, 32 nt, Human
agggagagagaggaagaagggacucgauccag

SEQ ID NO: 324103 - RNA, 32 nt, Human
agggagagagggagagugacagcagcgcucgc

SEQ ID NO: 324104 - RNA, 32 nt, Human
agggagagagggagagugacagcagcgcucgg

SEQ ID NO: 324105 - RNA, 32 nt, Human
agggagagagggaggaaggaagaaggugcaaa

SEQ ID NO: 324106 - RNA, 32 nt, Human
agggagagagggagggagagagagugaaagaa

SEQ ID NO: 324107 - RNA, 32 nt, Human
agggagagagggaggggaggaaauuggagacc

SEQ ID NO: 324108 - RNA, 32 nt, Human
agggagagaggugggaggucagaggagauggg

SEQ ID NO: 324109 - RNA, 32 nt, Human
agggagagagugagacugggagaaagagaagc

SEQ ID NO: 324110 - RNA, 32 nt, Human
agggagagauccagagaguuuucaaguuuuug

SEQ ID NO: 324111 - RNA, 32 nt, Human
agggagagcaagaagaccagcugugggugagg

SEQ ID NO: 324112 - RNA, 32 nt, Human
agggagagcaagaggucaagagcugugggaca

SEQ ID NO: 324113 - RNA, 32 nt, Human
agggagagcaagcgcacagcagaggaggugug

SEQ ID NO: 324114 - RNA, 32 nt, Human
agggagagccccaggacucaggagugcugggc

SEQ ID NO: 324115 - RNA, 22 nt, Human
agggagagcgcccacacugucc

SEQ ID NO: 324116 - RNA, 32 nt, Human
agggagagcugcagaguguccugccugccuug

SEQ ID NO: 324117 - RNA, 32 nt, Human
agggagaggaagagaagcccagcucugggaac

SEQ ID NO: 324118 - RNA, 32 nt, Human
agggagaggaagcacacugcagggcugcugug

SEQ ID NO: 324119 - RNA, 32 nt, Human
agggagaggacagccaacaagguccagggccc

SEQ ID NO: 324120 - RNA, 32 nt, Human
agggagaggagaagagacgcaaaagaccggga

SEQ ID NO: 324121 - RNA, 32 nt, Human
agggagaggagagauuaaagugaggagagagc

SEQ ID NO: 324122 - RNA, 22 nt, Human
agggagaggaggccccggcaga

SEQ ID NO: 324123 - RNA, 32 nt, Human
agggagaggagggagagggggaggggaggagu

SEQ ID NO: 324124 - RNA, 32 nt, Human
agggagaggaugacaggguuaccccuuggaga

SEQ ID NO: 324125 - RNA, 32 nt, Human
agggagaggcagcagucuccucccaggugggg

SEQ ID NO: 324126 - RNA, 32 nt, Human
agggagagggaagagggagaccaaaugucggg

SEQ ID NO: 324127 - RNA, 32 nt, Human
agggagagggaagaguagguggggccgggcag

SEQ ID NO: 324128 - RNA, 32 nt, Human
agggagagggaggagguugcaaaaagccagau

SEQ ID NO: 324129 - RNA, 32 nt, Human
agggagagggugaagcagguaucagagucacu

SEQ ID NO: 324130 - RNA, 32 nt, Human
agggagaguggcagagagaggagcaguagccc

SEQ ID NO: 324131 - RNA, 32 nt, Human
agggagaguuuugcggggguuggcaguggaga

SEQ ID NO: 324132 - RNA, 32 nt, Human
agggagauacccuauucacugccugccaggca

SEQ ID NO: 324133 - RNA, 32 nt, Human
agggagaucugggggaggcaggaagcuccuca

SEQ ID NO: 324134 - RNA, 32 nt, Human
agggagaucuuuagccuccaucaccugccauc

SEQ ID NO: 324135 - RNA, 31 nt, Human
agggagauggugcuggcccaggggcugcucu

SEQ ID NO: 324136 - RNA, 32 nt, Human
agggagcaagcugcccccuccuugcccccaag

SEQ ID NO: 324137 - RNA, 32 nt, Human
agggagcaagcuguuucucuugacuacuggcu

SEQ ID NO: 324138 - RNA, 20 nt, Human
agggagcacaaacauacuga

SEQ ID NO: 324139 - RNA, 20 nt, Human
agggagcacaggaacucuga

SEQ ID NO: 324140 - RNA, 16 nt, Human
agggagcacagucugc

SEQ ID NO: 324141 - RNA, 18 nt, Human
agggagcacagugagccu

SEQ ID NO: 324142 - RNA, 32 nt, Human
agggagcacaguuagaaguuugcagaacagaa

SEQ ID NO: 324143 - RNA, 18 nt, Human
agggagcacauccccuga

SEQ ID NO: 324144 - RNA, 19 nt, Human
agggagcacauuggcguga

SEQ ID NO: 324145 - RNA, 19 nt, Human
agggagcacauuucaccug

SEQ ID NO: 324146 - RNA, 32 nt, Human
agggagcacccacaugcuuagauagcugaugu

SEQ ID NO: 324147 - RNA, 22 nt, Human
agggagcacuggggugcccuga

SEQ ID NO: 324148 - RNA, 17 nt, Human
agggagcacuggguuga

SEQ ID NO: 324149 - RNA, 32 nt, Human
agggagcagagcagcugccggcugugugccca

SEQ ID NO: 324150 - RNA, 32 nt, Human
agggagcagaggccagcugggggccagugggg

SEQ ID NO: 324151 - RNA, 21 nt, Human
agggagcagcccaccugcugg

SEQ ID NO: 324152 - RNA, 32 nt, Human
agggagcagccccgcaggccgccacauagcuc

SEQ ID NO: 324153 - RNA, 32 nt, Human
agggagcagcggggagcuugcagugaccaaga

SEQ ID NO: 324154 - RNA, 32 nt, Human
agggagcagcuuucuauccuggccacacugag

SEQ ID NO: 324155 - RNA, 32 nt, Human
agggagcaggaggguguuccuucaugugggaa

SEQ ID NO: 324156 - RNA, 32 nt, Human
agggagcaggcagagauagagugcagggcaug

SEQ ID NO: 324157 - RNA, 32 nt, Human
agggagcaggcagagggugggggaccuggcgg

SEQ ID NO: 324158 - RNA, 32 nt, Human
agggagcaggcccaagggcagagcagaggcug

SEQ ID NO: 324159 - RNA, 32 nt, Human
agggagcaggccggaaccacagggccagaggg

SEQ ID NO: 324160 - RNA, 32 nt, Human
agggagcagggagagaaagacuggaguagauu

SEQ ID NO: 324161 - RNA, 32 nt, Human
agggagcagggcucggcgaggggaagacggcg

SEQ ID NO: 324162 - RNA, 32 nt, Human
agggagcaggguggcgguugaggaacgcuuca

SEQ ID NO: 324163 - RNA, 31 nt, Human
agggagcaguuucugccccuccugccccguc

SEQ ID NO: 324164 - RNA, 32 nt, Human
agggagcauuaguaccuggugcuagagaauag

SEQ ID NO: 324165 - RNA, 32 nt, Human
agggagccaaggucacuccaauaaaacaagcu

SEQ ID NO: 324166 - RNA, 32 nt, Human
agggagccacagccgcgcucagccuggaggga

SEQ ID NO: 324167 - RNA, 32 nt, Human
agggagccacgccagccagacaccccggccag

SEQ ID NO: 324168 - RNA, 32 nt, Human
agggagccacugcauccagcacauggggugcc

SEQ ID NO: 324169 - RNA, 32 nt, Human
agggagccacuggccgcgguggcagggccagg

SEQ ID NO: 324170 - RNA, 32 nt, Human
agggagccaugcugcugaauucugguuggcau

SEQ ID NO: 324171 - RNA, 32 nt, Human
agggagccauggaaggugccagaaggaagguu

SEQ ID NO: 324172 - RNA, 32 nt, Human
agggagcccacagcagcaucagacccauccag

SEQ ID NO: 324173 - RNA, 32 nt, Human
agggagcccaggccaucgcucaugcccucugc

SEQ ID NO: 324174 - RNA, 32 nt, Human
agggagccccaaaugcaaccagccucuuguuc

SEQ ID NO: 324175 - RNA, 32 nt, Human
agggagccccuaggaaagcaguguguccuugg

SEQ ID NO: 324176 - RNA, 32 nt, Human
agggagcccugagcccuucagcugccugcaca

SEQ ID NO: 324177 - RNA, 32 nt, Human
agggagccgacaaccucuuuucugcagaaaag

SEQ ID NO: 324178 - RNA, 32 nt, Human
agggagccgaggaggccauggagccaggggaa

SEQ ID NO: 324179 - RNA, 22 nt, Human
agggagccucaggacagcuucu

SEQ ID NO: 324180 - RNA, 32 nt, Human
agggagccuccccucccuguaucacccccucc

SEQ ID NO: 324181 - RNA, 32 nt, Human
agggagccuccuggccccgcgguucugugcac

SEQ ID NO: 324182 - RNA, 21 nt, Human
agggagccugcacagcuucuu

SEQ ID NO: 324183 - RNA, 32 nt, Human
agggagccugcucucccuccccacaccccacc

SEQ ID NO: 324184 - RNA, 32 nt, Human
agggagccugcugagccaggagggagaaaaga

SEQ ID NO: 324185 - RNA, 32 nt, Human
agggagccuggcccagaagaccagcccugccg

SEQ ID NO: 324186 - RNA, 32 nt, Human
agggagccuuucucugccucuuccuccccugu

SEQ ID NO: 324187 - RNA, 32 nt, Human
agggagcgagagaauggcuccaaccuggccuu

SEQ ID NO: 324188 - RNA, 21 nt, Human
agggagcgaggggcucacacc

SEQ ID NO: 324189 - RNA, 32 nt, Human
agggagcggaugaaggauggcagcaucucaca

SEQ ID NO: 324190 - RNA, 32 nt, Human
agggagcgggcagaggccgcagggcuggcucg

SEQ ID NO: 324191 - RNA, 19 nt, Human
agggagcgggcccaccuga

SEQ ID NO: 324192 - RNA, 27 nt, Human
agggagcggggucgggaucaccugcca

SEQ ID NO: 324193 - RNA, 20 nt, Human
agggagcguagaaucugugu

SEQ ID NO: 324194 - RNA, 32 nt, Human
agggagcguggggccaucugagccaaacagaa

SEQ ID NO: 324195 - RNA, 32 nt, Human
agggagcuaaggaagacacagcccagacaaga

SEQ ID NO: 324196 - RNA, 32 nt, Human
agggagcucaggcuggauggaggaagccacgc

SEQ ID NO: 324197 - RNA, 32 nt, Human
agggagcuccaggacucacccucagcugagcc

SEQ ID NO: 324198 - RNA, 32 nt, Human
agggagcuccaggagaccucaggacggccccc

SEQ ID NO: 324199 - RNA, 24 nt, Human
agggagcuccggggacagcuuccu

SEQ ID NO: 324200 - RNA, 20 nt, Human
agggagcuccgucagcuucu

SEQ ID NO: 324201 - RNA, 32 nt, Human
agggagcucuccugcucugccaccucauuugu

SEQ ID NO: 324202 - RNA, 32 nt, Human
agggagcucugccuguuggagcucccuguccu

SEQ ID NO: 324203 - RNA, 32 nt, Human
agggagcucugggugcggccucaggcccucca

SEQ ID NO: 324204 - RNA, 32 nt, Human
agggagcugagagccugguucugugaucaugg

SEQ ID NO: 324205 - RNA, 32 nt, Human
agggagcugagcgcagcauggcuggucuggca

SEQ ID NO: 324206 - RNA, 31 nt, Human
agggagcugcagagagaacaagaccugagac

SEQ ID NO: 324207 - RNA, 32 nt, Human
agggagcugcaggaacaggaaaaagagaccuu

SEQ ID NO: 324208 - RNA, 32 nt, Human
agggagcugcccggcuggccuaggcaggcagc

SEQ ID NO: 324209 - RNA, 32 nt, Human
agggagcugccuagcaucuggccuggagugua

SEQ ID NO: 324210 - RNA, 32 nt, Human
agggagcugccuggcuucucugccuccagccu

SEQ ID NO: 324211 - RNA, 32 nt, Human
agggagcugcuuggcagugccagagcccaggc

SEQ ID NO: 324212 - RNA, 32 nt, Human
agggagcugcuuggggaagccaggggcugggg

SEQ ID NO: 324213 - RNA, 19 nt, Human
agggagcuggaacagccuc

SEQ ID NO: 324214 - RNA, 32 nt, Human
agggagcuggaccgcaguguccaggcuggaca

SEQ ID NO: 324215 - RNA, 32 nt, Human
agggagcuggcagaggacugcaagcgcccucu

SEQ ID NO: 324216 - RNA, 32 nt, Human
agggagcugggaaggaaggaagggggcgcuag

SEQ ID NO: 324217 - RNA, 32 nt, Human
agggagcugggaccccuccccuccaacacaca

SEQ ID NO: 324218 - RNA, 32 nt, Human
agggagcugggccuccccucauccucuguaac

SEQ ID NO: 324219 - RNA, 32 nt, Human
agggagcuggucuccagccaggugagcaacaa

SEQ ID NO: 324220 - RNA, 32 nt, Human
agggagcugucuaccagcugagguccucccaa

SEQ ID NO: 324221 - RNA, 22 nt, Human
agggagcugugaucacacugcu

SEQ ID NO: 324222 - RNA, 32 nt, Human
agggagcuugcucuccuucucggagggccgga

SEQ ID NO: 324223 - RNA, 32 nt, Human
agggagcuuggguaggggccaggcuagccuga

SEQ ID NO: 324224 - RNA, 32 nt, Human
agggagcuuguugccagagagugagcuugccc

SEQ ID NO: 324225 - RNA, 21 nt, Human
agggaggaaaaaugacauuca

SEQ ID NO: 324226 - RNA, 21 nt, Human
agggaggaaaacaugcgccca

SEQ ID NO: 324227 - RNA, 32 nt, Human
agggaggaaagccaucaggacuggguagccug

SEQ ID NO: 324228 - RNA, 32 nt, Human
agggaggaaagcuuccgccugcgggccggaca

SEQ ID NO: 324229 - RNA, 32 nt, Human
agggaggaagaagagggagggagcgaggaagg

SEQ ID NO: 324230 - RNA, 32 nt, Human
agggaggaagacaggaaggaaggaaggaagga

SEQ ID NO: 324231 - RNA, 22 nt, Human
agggaggaagacccucaucuca

SEQ ID NO: 324232 - RNA, 32 nt, Human
agggaggaagaguuugggggcuguggagggaa

SEQ ID NO: 324233 - RNA, 32 nt, Human
agggaggaaggaaggaaggaaggaaagaaaga

SEQ ID NO: 324234 - RNA, 26 nt, Human
agggaggaaggagcgcgacagugcca

SEQ ID NO: 324235 - RNA, 18 nt, Human
agggaggaagggcagaug

SEQ ID NO: 324236 - RNA, 21 nt, Human
agggaggaaggggauggccca

SEQ ID NO: 324237 - RNA, 23 nt, Human
agggaggaaggggcggcugcuca

SEQ ID NO: 324238 - RNA, 24 nt, Human
agggaggaagguccaugaugcuca

SEQ ID NO: 324239 - RNA, 32 nt, Human
agggaggaauauagaaugaaagacugaaucuu

SEQ ID NO: 324240 - RNA, 32 nt, Human
agggaggacacagcagaccuguuucucaggga

SEQ ID NO: 324241 - RNA, 32 nt, Human
agggaggacauggagaaaaguucuuuaaacaa

SEQ ID NO: 324242 - RNA, 19 nt, Human
agggaggacccacacugcu

SEQ ID NO: 324243 - RNA, 32 nt, Human
agggaggaccucaagagacugccuggcccagu

SEQ ID NO: 324244 - RNA, 32 nt, Human
agggaggacuccugagcucugccucuuccagu

SEQ ID NO: 324245 - RNA, 21 nt, Human
agggaggagaaagaucccugu

SEQ ID NO: 324246 - RNA, 32 nt, Human
agggaggagaggggaaggugggcgaggagggc

SEQ ID NO: 324247 - RNA, 32 nt, Human
agggaggagaggggacuggagaguguggggaa

SEQ ID NO: 324248 - RNA, 32 nt, Human
agggaggagaggggaucacagggguuucagag

SEQ ID NO: 324249 - RNA, 32 nt, Human
agggaggagagggguuggaguaggugggaagu

SEQ ID NO: 324250 - RNA, 32 nt, Human
agggaggagaugaaaauguggacacauccccc

SEQ ID NO: 324251 - RNA, 32 nt, Human
agggaggagccaagauggccgaauagaacagc

SEQ ID NO: 324252 - RNA, 32 nt, Human
agggaggagcggagguagagggccaggauggu

SEQ ID NO: 324253 - RNA, 32 nt, Human
agggaggaggaaaaggaggaagaggaggacaa

SEQ ID NO: 324254 - RNA, 19 nt, Human
agggaggaggagagccagg

SEQ ID NO: 324255 - RNA, 32 nt, Human
agggaggaggagcagacggcagaggaaauccu

SEQ ID NO: 324256 - RNA, 32 nt, Human
agggaggaggcagagcgcgccgggccgguggc

SEQ ID NO: 324257 - RNA, 32 nt, Human
agggaggaggccucaugucugaagggggauuu

SEQ ID NO: 324258 - RNA, 32 nt, Human
agggaggaggcugagcagaaggagucaucaug

SEQ ID NO: 324259 - RNA, 32 nt, Human
agggaggaggcugaggcuggagaugcagcucc

SEQ ID NO: 324260 - RNA, 32 nt, Human
agggaggagggccgagacaggagcagcccacc

SEQ ID NO: 324261 - RNA, 20 nt, Human
agggaggaggggacagcuuc

SEQ ID NO: 324262 - RNA, 32 nt, Human
agggaggaggugguagaguccggguagugagc

SEQ ID NO: 324263 - RNA, 32 nt, Human
agggaggaucacuggaguacaggaguuugggg

SEQ ID NO: 324264 - RNA, 32 nt, Human
agggaggaucuguccugugccucucucuguug

SEQ ID NO: 324265 - RNA, 32 nt, Human
agggaggcagacggcaagaccuccuuccauga

SEQ ID NO: 324266 - RNA, 32 nt, Human
agggaggcagggaaucuggcuugauuggcgug

SEQ ID NO: 324267 - RNA, 32 nt, Human
agggaggcagggaggcagggaggaacggaggg

SEQ ID NO: 324268 - RNA, 32 nt, Human
agggaggcagggaggcagggaggcagggagga

SEQ ID NO: 324269 - RNA, 32 nt, Human
agggaggcaggggagagccggucacgguggcu

SEQ ID NO: 324270 - RNA, 32 nt, Human
agggaggcaguggaggcaggagaggcugggga

SEQ ID NO: 324271 - RNA, 32 nt, Human
agggaggcauggcaagggaccucugcuguccu

SEQ ID NO: 324272 - RNA, 32 nt, Human
agggaggccacugcaacauuuuauccccauca

SEQ ID NO: 324273 - RNA, 32 nt, Human
agggaggccaggaggaagauaggcccaagcuc

SEQ ID NO: 324274 - RNA, 32 nt, Human
agggaggccccuagccuguggcccaggcucuc

SEQ ID NO: 324275 - RNA, 16 nt, Human
agggaggcccuggaaa

SEQ ID NO: 324276 - RNA, 32 nt, Human
agggaggcccugugccccuugacaacuggcag

SEQ ID NO: 324277 - RNA, 32 nt, Human
agggaggccucaggaagcuuacagucauggug

SEQ ID NO: 324278 - RNA, 32 nt, Human
agggaggccuccaucuggaaaugggaggauga

SEQ ID NO: 324279 - RNA, 23 nt, Human
agggaggccugagcacacugcuu

SEQ ID NO: 324280 - RNA, 32 nt, Human
agggaggcuacccgcucccagcugggguuggu

SEQ ID NO: 324281 - RNA, 32 nt, Human
agggaggcugugagacccacagggcuaggccc

SEQ ID NO: 324282 - RNA, 32 nt, Human
agggagggaaggaaggaagagagggaggcggg

SEQ ID NO: 324283 - RNA, 32 nt, Human
agggagggaaggcaggguuugggaaccaaggc

SEQ ID NO: 324284 - RNA, 32 nt, Human
agggagggaaggcaugggaagaagcaggauug

SEQ ID NO: 324285 - RNA, 32 nt, Human
agggagggaauagaggaauguguucggguuaa

SEQ ID NO: 324286 - RNA, 32 nt, Human
agggagggacacggaccaggaaccugagcuag

SEQ ID NO: 324287 - RNA, 32 nt, Human
agggagggacagagggacagagagauauaaaa

SEQ ID NO: 324288 - RNA, 32 nt, Human
agggagggagaaauuuauuuucuggguaggag

SEQ ID NO: 324289 - RNA, 32 nt, Human
agggagggagagaagaagggggucuuugccca

SEQ ID NO: 324290 - RNA, 32 nt, Human
agggagggagagaagagggggcuaaauuugau

SEQ ID NO: 324291 - RNA, 32 nt, Human
agggagggagagaauggcccgagggaggaggg

SEQ ID NO: 324292 - RNA, 32 nt, Human
agggagggagagagaaagacgaagggagagag

SEQ ID NO: 324293 - RNA, 32 nt, Human
agggagggagagaugaauuuucccuggaggga

SEQ ID NO: 324294 - RNA, 32 nt, Human
agggagggagagcagguuacuuggcaaccaua

SEQ ID NO: 324295 - RNA, 32 nt, Human
agggagggagagguggggagggagacagagac

SEQ ID NO: 324296 - RNA, 32 nt, Human
agggagggagcgagcgagcagugaguaagcca

SEQ ID NO: 324297 - RNA, 32 nt, Human
agggagggagcgaggaaggaagauaggagaug

SEQ ID NO: 324298 - RNA, 32 nt, Human
agggagggagcugucagccagggaaaaccgag

SEQ ID NO: 324299 - RNA, 32 nt, Human
agggagggaggaagaagagggagggagcgagg

SEQ ID NO: 324300 - RNA, 32 nt, Human
agggagggaggaagacaggaaggaaggaagga

SEQ ID NO: 324301 - RNA, 32 nt, Human
agggagggaggaaggaaggaaggaaggaaaga

SEQ ID NO: 324302 - RNA, 32 nt, Human
agggagggaggaaggaaggaagggaggaagga

SEQ ID NO: 324303 - RNA, 32 nt, Human
agggagggaggcagcugcuggggaggggcuug

SEQ ID NO: 324304 - RNA, 32 nt, Human
agggagggagggagagggagagagggagaaaa

SEQ ID NO: 324305 - RNA, 32 nt, Human
agggagggagggaggaagaagagggagggagc

SEQ ID NO: 324306 - RNA, 32 nt, Human
agggagggagggaggaaggaaggaaggaagga

SEQ ID NO: 324307 - RNA, 32 nt, Human
agggagggagggagggagagaauggcccgagg

SEQ ID NO: 324308 - RNA, 32 nt, Human
agggagggagguacccaugagcagaggguagu

SEQ ID NO: 324309 - RNA, 32 nt, Human
agggagggagguggagaaggacgggagaggca

SEQ ID NO: 324310 - RNA, 32 nt, Human
agggagggauggcaggcuucagccacuucucc

SEQ ID NO: 324311 - RNA, 32 nt, Human
agggagggauuccaugcugccuucuccggacu

SEQ ID NO: 324312 - RNA, 32 nt, Human
agggagggcagccuucugccaccugugucgcc

SEQ ID NO: 324313 - RNA, 32 nt, Human
agggagggcagggagagcaaggggcaaggucc

SEQ ID NO: 324314 - RNA, 32 nt, Human
agggagggccaaguccacccagcaucaccaca

SEQ ID NO: 324315 - RNA, 17 nt, Human
agggagggcccagcaaa

SEQ ID NO: 324316 - RNA, 32 nt, Human
agggagggccccgguuccccagacuucuccac

SEQ ID NO: 324317 - RNA, 17 nt, Human
agggagggccugagaaa

SEQ ID NO: 324318 - RNA, 21 nt, Human
agggagggcgagcccuuggga

SEQ ID NO: 324319 - RNA, 19 nt, Human
agggagggcgggccccggg

SEQ ID NO: 324320 - RNA, 16 nt, Human
agggagggcucagccc

SEQ ID NO: 324321 - RNA, 32 nt, Human
agggagggcugcugccacagacuguggugagg

SEQ ID NO: 324322 - RNA, 32 nt, Human
agggaggggaaagagaaggagaugggagaggg

SEQ ID NO: 324323 - RNA, 32 nt, Human
agggaggggaaagugaagagggaagcauaggg

SEQ ID NO: 324324 - RNA, 32 nt, Human
agggaggggagauggagaggagagguggacaa

SEQ ID NO: 324325 - RNA, 18 nt, Human
agggaggggagcgcggga

SEQ ID NO: 324326 - RNA, 18 nt, Human
agggaggggaggccagga

SEQ ID NO: 324327 - RNA, 32 nt, Human
agggaggggagggagaggguggcugaaugggg

SEQ ID NO: 324328 - RNA, 32 nt, Human
agggaggggcaggagagcagugaggagcugcu

SEQ ID NO: 324329 - RNA, 32 nt, Human
agggaggggccaggcagcugagggccaggaaa

SEQ ID NO: 324330 - RNA, 32 nt, Human
agggaggggccuugggcccacccucacagggg

SEQ ID NO: 324331 - RNA, 32 nt, Human
agggaggggcgccggggcgcugggcagccggg

SEQ ID NO: 324332 - RNA, 32 nt, Human
agggaggggcugauccugccucagcugugugg

SEQ ID NO: 324333 - RNA, 32 nt, Human
agggaggggcuggccagagggagaggcagcag

SEQ ID NO: 324334 - RNA, 32 nt, Human
agggaggggcugggaagggcuacugaaggccc

SEQ ID NO: 324335 - RNA, 32 nt, Human
agggagggggagggaggagggagcaggcaggu

SEQ ID NO: 324336 - RNA, 32 nt, Human
agggagggggcagagggcagcuugcuucugca

SEQ ID NO: 324337 - RNA, 32 nt, Human
agggagggggcccgggguuggggaagggggcc

SEQ ID NO: 324338 - RNA, 32 nt, Human
agggagggggcuaagagaggagcaaagcagga

SEQ ID NO: 324339 - RNA, 19 nt, Human
agggaggggggagcgggga

SEQ ID NO: 324340 - RNA, 32 nt, Human
agggaggggucagaaggguccacuccagggcc

SEQ ID NO: 324341 - RNA, 32 nt, Human
agggaggguaaaaccucagacuuuaugugauu

SEQ ID NO: 324342 - RNA, 32 nt, Human
agggagggugucugcacuaaggauuuagaaac

SEQ ID NO: 324343 - RNA, 32 nt, Human
agggagguaggugggggugugggugaugaggg

SEQ ID NO: 324344 - RNA, 32 nt, Human
agggagguccuggccguccacagggucggccc

SEQ ID NO: 324345 - RNA, 32 nt, Human
agggaggucuccuuggaugaaggggugccugg

SEQ ID NO: 324346 - RNA, 32 nt, Human
agggaggugagcugggggcccuggagaaucuc

SEQ ID NO: 324347 - RNA, 16 nt, Human
agggaggugccagccc

SEQ ID NO: 324348 - RNA, 32 nt, Human
agggagguggaaaugcugacaaugaggaggaa

SEQ ID NO: 324349 - RNA, 32 nt, Human
agggagguggaagagcuuuuuaaucacuugcu

SEQ ID NO: 324350 - RNA, 20 nt, Human
agggagguggaagggaaaag

SEQ ID NO: 324351 - RNA, 32 nt, Human
agggagguggggguugggggaguaguggggca

SEQ ID NO: 324352 - RNA, 32 nt, Human
agggaggugggugggucaggugaguggaaggg

SEQ ID NO: 324353 - RNA, 32 nt, Human
agggagguggguuggggugaggccacaugcgg

SEQ ID NO: 324354 - RNA, 32 nt, Human
agggaggugugggugagcugauauaaaagguu

SEQ ID NO: 324355 - RNA, 32 nt, Human
agggagguuacauuguaaaauauguccaugag

SEQ ID NO: 324356 - RNA, 32 nt, Human
agggagguuccucgcaggucucagcccgggac

SEQ ID NO: 324357 - RNA, 32 nt, Human
agggagguugaaauaggagaugaccacuaauu

SEQ ID NO: 324358 - RNA, 32 nt, Human
agggagguugggcagacaagaccugggccaug

SEQ ID NO: 324359 - RNA, 32 nt, Human
agggaguaagggagggagggaggcgagagaga

SEQ ID NO: 324360 - RNA, 21 nt, Human
agggaguacgccauguccuga

SEQ ID NO: 324361 - RNA, 32 nt, Human
agggaguagcugcugcuucacggcgucuccac

SEQ ID NO: 324362 - RNA, 32 nt, Human
agggaguagggagggagaggcaccaugcaugu

SEQ ID NO: 324363 - RNA, 32 nt, Human
agggaguauaaggcagcuccgcacuugaaauc

SEQ ID NO: 324364 - RNA, 32 nt, Human
agggaguaugucuuaaauguaaaguuucuggu

SEQ ID NO: 324365 - RNA, 32 nt, Human
agggagucacauugcauggggguugaguugac

SEQ ID NO: 324366 - RNA, 32 nt, Human
agggaguccacggagaagaugcagugaaugcu

SEQ ID NO: 324367 - RNA, 22 nt, Human
agggagucccagucagacugcu

SEQ ID NO: 324368 - RNA, 32 nt, Human
agggagucccauuucagguguggggcugggca

SEQ ID NO: 324369 - RNA, 32 nt, Human
agggagucccauuucagguguggggcugggua

SEQ ID NO: 324370 - RNA, 20 nt, Human
agggagucccucaugcuuga

SEQ ID NO: 324371 - RNA, 23 nt, Human
agggagucccuggcucauacugc

SEQ ID NO: 324372 - RNA, 32 nt, Human
agggagucgcccaggcuggagagcgguggcgc

SEQ ID NO: 324373 - RNA, 22 nt, Human
agggagucgcuggccacacucu

SEQ ID NO: 324374 - RNA, 32 nt, Human
agggagucggcagagagagagcaucaggaaga

SEQ ID NO: 324375 - RNA, 32 nt, Human
agggagucuggcuuuuacuaucuuucuuaaaa

SEQ ID NO: 324376 - RNA, 32 nt, Human
agggagucuuccucuguggcccaggcugaaga

SEQ ID NO: 324377 - RNA, 32 nt, Human
agggagugaagagagcgcgacggcggcggcgg

SEQ ID NO: 324378 - RNA, 32 nt, Human
agggagugaccguguucucaggaugcagcgac

SEQ ID NO: 324379 - RNA, 32 nt, Human
agggagugagagccaccccgugccgcccacag

SEQ ID NO: 324380 - RNA, 32 nt, Human
agggagugagauugcaucccugggcuuagaag

SEQ ID NO: 324381 - RNA, 32 nt, Human
agggagugagcagcaagacaggacacauuuug

SEQ ID NO: 324382 - RNA, 32 nt, Human
agggagugagccagcagcuuaaguccagcuca

SEQ ID NO: 324383 - RNA, 21 nt, Human
agggagugaggggccgcugcc

SEQ ID NO: 324384 - RNA, 23 nt, Human
agggagugagggggcaguguuga

SEQ ID NO: 324385 - RNA, 32 nt, Human
agggagugaugauuugggggaggcuuugggag

SEQ ID NO: 324386 - RNA, 32 nt, Human
agggagugcagcaggaaggaacaaagacaggc

SEQ ID NO: 324387 - RNA, 31 nt, Human
agggagugccucucugggacccccuguguug

SEQ ID NO: 324388 - RNA, 32 nt, Human
agggagugcgccgggagcggagauauggaggg

SEQ ID NO: 324389 - RNA, 32 nt, Human
agggagugcugacaagggaggagccagugcaa

SEQ ID NO: 324390 - RNA, 32 nt, Human
agggaguggcaugcagggccccugccaugggu

SEQ ID NO: 324391 - RNA, 32 nt, Human
agggaguggccagaugucuccagaggcagcgu

SEQ ID NO: 324392 - RNA, 31 nt, Human
agggaguggccucucccuucuccauggacuu

SEQ ID NO: 324393 - RNA, 32 nt, Human
agggaguggcgaccccagauuuauaggaaaug

SEQ ID NO: 324394 - RNA, 32 nt, Human
agggaguggguggagagcaugggagguaaagu

SEQ ID NO: 324395 - RNA, 31 nt, Human
agggagugggugggcagggguagaggagggg

SEQ ID NO: 324396 - RNA, 32 nt, Human
agggaguggugaggcccugggccuccagagcc

SEQ ID NO: 324397 - RNA, 31 nt, Human
agggaguguaaacugcccccagauguuccug

SEQ ID NO: 324398 - RNA, 23 nt, Human
agggaguucaggacaacccuccu

SEQ ID NO: 324399 - RNA, 32 nt, Human
agggaguuccaaaugagagggagcuucugugg

SEQ ID NO: 324400 - RNA, 32 nt, Human
agggaguuuaauacaggaaauugacuuacaua

SEQ ID NO: 324401 - RNA, 32 nt, Human
agggaguuuacaacccaagccauuccaccccc

SEQ ID NO: 324402 - RNA, 22 nt, Human
agggaguuucagaagagaggca

SEQ ID NO: 324403 - RNA, 32 nt, Human
agggauaaaaaggcaccuaaggcccuuuugca

SEQ ID NO: 324404 - RNA, 32 nt, Human
agggauaaaagugggcugggcgcaguggcuca

SEQ ID NO: 324405 - RNA, 20 nt, Human
agggauaaaaugaggcucca

SEQ ID NO: 324406 - RNA, 32 nt, Human
agggauaaaccagcgcaauggauugggggacg

SEQ ID NO: 324407 - RNA, 32 nt, Human
agggauaaacuagauauagcauacagagccug

SEQ ID NO: 324408 - RNA, 32 nt, Human
agggauaaagagagaauggaaaaagaauggaa

SEQ ID NO: 324409 - RNA, 32 nt, Human
agggauaaagcuuaccauuaaagcuuuugggu

SEQ ID NO: 324410 - RNA, 32 nt, Human
agggauaaggagagcugagauuggagggaauu

SEQ ID NO: 324411 - RNA, 32 nt, Human
agggauaagggauguuagcuguccugcaaagu

SEQ ID NO: 324412 - RNA, 21 nt, Human
agggauacugggauaauuuuu

SEQ ID NO: 324413 - RNA, 32 nt, Human
agggauacuuuuguaaaaguaaaaccuuguau

SEQ ID NO: 324414 - RNA, 32 nt, Human
agggauagaagaguugaaaagggaaagcaaaa

SEQ ID NO: 324415 - RNA, 32 nt, Human
agggauagagucagcugccgaacggagaucag

SEQ ID NO: 324416 - RNA, 32 nt, Human
agggauagccucugugccacuuuuugccagag

SEQ ID NO: 324417 - RNA, 32 nt, Human
agggauagccugggccauggaggccgaugaag

SEQ ID NO: 324418 - RNA, 32 nt, Human
agggauaucgagacagagucucgcucugucac

SEQ ID NO: 324419 - RNA, 22 nt, Human
agggauaugcagggcacuuuuu

SEQ ID NO: 324420 - RNA, 32 nt, Human
agggauaugucuccucuccuucucacuaagga

SEQ ID NO: 324421 - RNA, 23 nt, Human
agggauaugugaaacaauguuaa

SEQ ID NO: 324422 - RNA, 32 nt, Human
agggaucaagggcaaggcgagcuccauguggg

SEQ ID NO: 324423 - RNA, 32 nt, Human
agggaucauaaauuaugcauaucuaugaauuu

SEQ ID NO: 324424 - RNA, 32 nt, Human
agggaucauccaccaucauccuucaugucugc

SEQ ID NO: 324425 - RNA, 32 nt, Human
agggauccagagacauagaggaaguagggggu

SEQ ID NO: 324426 - RNA, 32 nt, Human
agggaucccaccccuucucuguguuuucacuc

SEQ ID NO: 324427 - RNA, 32 nt, Human
agggaucccccagcucccccagccccuggcuu

SEQ ID NO: 324428 - RNA, 32 nt, Human
agggaucccgugggaggugaucagaucauggg

SEQ ID NO: 324429 - RNA, 32 nt, Human
agggauccgagaguucugcacacugaggaaaa

SEQ ID NO: 324430 - RNA, 32 nt, Human
agggauccggaggcggcggagggagacgucau

SEQ ID NO: 324431 - RNA, 32 nt, Human
agggauccggccaggguggagugggugaggca

SEQ ID NO: 324432 - RNA, 32 nt, Human
agggauccucacccuuccacuuucaugcaaga

SEQ ID NO: 324433 - RNA, 16 nt, Human
agggauccuccagcuc

SEQ ID NO: 324434 - RNA, 32 nt, Human
agggauccuuggcugaggauuguauuucagaa

SEQ ID NO: 324435 - RNA, 32 nt, Human
agggauccuuggcugcuucauugucuuccccc

SEQ ID NO: 324436 - RNA, 32 nt, Human
agggaucgacaggcaccucuucugccuuuacu

SEQ ID NO: 324437 - RNA, 32 nt, Human
agggaucgcaccacugcacuccagccugggcu

SEQ ID NO: 324438 - RNA, 32 nt, Human
agggaucgcagggccuaggugccuggacccag

SEQ ID NO: 324439 - RNA, 32 nt, Human
agggaucguaccacugcacuccagccugggcu

SEQ ID NO: 324440 - RNA, 32 nt, Human
agggaucgugggggcggggagguggaguggag

SEQ ID NO: 324441 - RNA, 32 nt, Human
agggaucucacacccauguuacuugccauuua

SEQ ID NO: 324442 - RNA, 32 nt, Human
agggaucucuugggacccuccugguuuuaacu

SEQ ID NO: 324443 - RNA, 32 nt, Human
agggaucugacuccugaguugguugccucucc

SEQ ID NO: 324444 - RNA, 23 nt, Human
agggaucugagagcagcauaauc

SEQ ID NO: 324445 - RNA, 32 nt, Human
agggaucugcucccuccugcuucccuuaccag

SEQ ID NO: 324446 - RNA, 32 nt, Human
agggaucugcugcagccacagcuccuccagaa

SEQ ID NO: 324447 - RNA, 32 nt, Human
agggaucugcuuguuacaugaacuggaaauag

SEQ ID NO: 324448 - RNA, 32 nt, Human
agggaucugucucuuuggcucucagcucugcu

SEQ ID NO: 324449 - RNA, 32 nt, Human
agggaucuugcucucccuugaagccuugaguu

SEQ ID NO: 324450 - RNA, 32 nt, Human
agggaucuuucaccugcugugcccaguaguuc

SEQ ID NO: 324451 - RNA, 32 nt, Human
agggaucuuuguaaagacagcucuucacuuca

SEQ ID NO: 324452 - RNA, 24 nt, Human
agggaugaaacacccagaaacuca

SEQ ID NO: 324453 - RNA, 32 nt, Human
agggaugaagucaugggagauaaucugcugcu

SEQ ID NO: 324454 - RNA, 32 nt, Human
agggaugagagaaaggaggugguauggaagac

SEQ ID NO: 324455 - RNA, 32 nt, Human
agggaugagagggagggagaggagagagagug

SEQ ID NO: 324456 - RNA, 22 nt, Human
agggaugagccaccaugccugg

SEQ ID NO: 324457 - RNA, 32 nt, Human
agggaugaggauggauggguccuaaccccuga

SEQ ID NO: 324458 - RNA, 24 nt, Human
agggaugaggcacccucuugcuca

SEQ ID NO: 324459 - RNA, 32 nt, Human
agggaugagggagggaggggcauugugaugua

SEQ ID NO: 324460 - RNA, 32 nt, Human
agggaugaguccugucaagggggccacaggag

SEQ ID NO: 324461 - RNA, 32 nt, Human
agggaugaguucaccaguaccugucccaguga

SEQ ID NO: 324462 - RNA, 32 nt, Human
agggaugcacacaacuaugaacauuucugaag

SEQ ID NO: 324463 - RNA, 32 nt, Human
agggaugcacaugguuuccucugccuuuguga

SEQ ID NO: 324464 - RNA, 32 nt, Human
agggaugcagugccuuuccccauucauuccug

SEQ ID NO: 324465 - RNA, 31 nt, Human
agggaugcucuugcugggccugccucucccu

SEQ ID NO: 324466 - RNA, 32 nt, Human
agggaugcugcuucuguucccuccaggccuug

SEQ ID NO: 324467 - RNA, 17 nt, Human
agggaugcuggcucuug

SEQ ID NO: 324468 - RNA, 21 nt, Human
agggaugcugugcaugccuga

SEQ ID NO: 324469 - RNA, 32 nt, Human
agggaugcugugcugcucucccaugagccagu

SEQ ID NO: 324470 - RNA, 32 nt, Human
agggauggaaccucugggucaggaaacagcug

SEQ ID NO: 324471 - RNA, 32 nt, Human
agggauggacaaggagcugagauuuaugaccc

SEQ ID NO: 324472 - RNA, 32 nt, Human
agggauggagcaggacaacuccaaggcucccc

SEQ ID NO: 324473 - RNA, 32 nt, Human
agggauggagugagacauuuaggaagcuggac

SEQ ID NO: 324474 - RNA, 32 nt, Human
agggauggauaagagaaagcauuuggcagaca

SEQ ID NO: 324475 - RNA, 32 nt, Human
agggauggcagagcgagagggaagugcaggga

SEQ ID NO: 324476 - RNA, 29 nt, Human
agggauggccccggaagugauaaggcagg

SEQ ID NO: 324477 - RNA, 32 nt, Human
agggauggcucuccaguccuugggucccguag

SEQ ID NO: 324478 - RNA, 32 nt, Human
agggauggcugaacagacuucccacugcuggu

SEQ ID NO: 324479 - RNA, 32 nt, Human
agggaugggaacaggcugugcaucuuaguugg

SEQ ID NO: 324480 - RNA, 32 nt, Human
agggaugggaaugggaguggguaggaggggua

SEQ ID NO: 324481 - RNA, 32 nt, Human
agggaugggacuagggcugaguugugucucca

SEQ ID NO: 324482 - RNA, 32 nt, Human
agggaugggaggcggaggguagagaugaacuc

SEQ ID NO: 324483 - RNA, 32 nt, Human
agggaugggguuucaccauguuagcuaggaug

SEQ ID NO: 324484 - RNA, 32 nt, Human
agggaugggguuucccauguuggccaggcugg

SEQ ID NO: 324485 - RNA, 32 nt, Human
agggaugggguuucuccauguuggucaggcug

SEQ ID NO: 324486 - RNA, 32 nt, Human
agggaugggugagggcuaaggggcuuggcucu

SEQ ID NO: 324487 - RNA, 32 nt, Human
agggauggugccagauacaucugucccauuua

SEQ ID NO: 324488 - RNA, 32 nt, Human
agggaugguuccaaagugagaggucuccaugg

SEQ ID NO: 324489 - RNA, 32 nt, Human
agggauguaaagacagggggaaagcacgccgg

SEQ ID NO: 324490 - RNA, 23 nt, Human
agggauguacugucugggucaga

SEQ ID NO: 324491 - RNA, 32 nt, Human
agggauguagaauaugcuuuccugccaacaug

SEQ ID NO: 324492 - RNA, 22 nt, Human
agggauguagcaccaugccugg

SEQ ID NO: 324493 - RNA, 32 nt, Human
agggaugucacagaaaugucugugucugaauc

SEQ ID NO: 324494 - RNA, 32 nt, Human
agggauguccagaggucggugcagccccuauc

SEQ ID NO: 324495 - RNA, 32 nt, Human
agggaugugggucugaagagcuugguugcaga

SEQ ID NO: 324496 - RNA, 32 nt, Human
agggauguguuuuauuaaugucuaggaugaag

SEQ ID NO: 324497 - RNA, 32 nt, Human
agggauuaaaaauguacguaaaauuaguaguc

SEQ ID NO: 324498 - RNA, 32 nt, Human
agggauuacuggccuccagagucuucaagauc

SEQ ID NO: 324499 - RNA, 32 nt, Human
agggauuagcugugucaggaacuuggaguugc

SEQ ID NO: 324500 - RNA, 21 nt, Human
agggauuaggaacagcuuccu

SEQ ID NO: 324501 - RNA, 32 nt, Human
agggauuauaccugucuguucuuaaagauuuc

SEQ ID NO: 324502 - RNA, 32 nt, Human
agggauucacaccuggcacaacaucagagagu

SEQ ID NO: 324503 - RNA, 32 nt, Human
agggauucagaacucacagugcagccugacga

SEQ ID NO: 324504 - RNA, 32 nt, Human
agggauucccuuucccacucugaggcucuggc

SEQ ID NO: 324505 - RNA, 32 nt, Human
agggauuccuuucuccccucuuuguguggccc

SEQ ID NO: 324506 - RNA, 32 nt, Human
agggauucuccuccuucauccuguaaagguca

SEQ ID NO: 324507 - RNA, 32 nt, Human
agggauucucucuugcugccucaguugcuagg

SEQ ID NO: 324508 - RNA, 32 nt, Human
agggauugaaguuuauuauuuucaaaggaaaa

SEQ ID NO: 324509 - RNA, 32 nt, Human
agggauugccaagaagggaacaaucaccccaa

SEQ ID NO: 324510 - RNA, 32 nt, Human
agggauugcccgugaagacuuuggccuagcaa

SEQ ID NO: 324511 - RNA, 32 nt, Human
agggauugcucacuccagguuacugcaacccu

SEQ ID NO: 324512 - RNA, 32 nt, Human
agggauugcuuaagccugggaggcagagguug

SEQ ID NO: 324513 - RNA, 32 nt, Human
agggauuggguuuugccuuguugcccaggcug

SEQ ID NO: 324514 - RNA, 19 nt, Human
agggauugguuccaggacc

SEQ ID NO: 324515 - RNA, 32 nt, Human
agggauuuagccaagagcacagacuuggauuc

SEQ ID NO: 324516 - RNA, 32 nt, Human
agggauuuagcccucugcccuaaggugccauu

SEQ ID NO: 324517 - RNA, 32 nt, Human
agggauuugagaccagccuggccaacauggcg

SEQ ID NO: 324518 - RNA, 32 nt, Human
agggauuugccacagccccacccuugggcuga

SEQ ID NO: 324519 - RNA, 32 nt, Human
agggauuugccucaccuuggggccuugaugac

SEQ ID NO: 324520 - RNA, 32 nt, Human
agggauuuuccccaucagucugucccuugggu

SEQ ID NO: 324521 - RNA, 32 nt, Human
agggcaaacauggugaaucuaucucuccggag

SEQ ID NO: 324522 - RNA, 32 nt, Human
agggcaaagaugguggcugugucucuccccgg

SEQ ID NO: 324523 - RNA, 32 nt, Human
agggcaaaggcgaggcgggggagcagcgugug

SEQ ID NO: 324524 - RNA, 32 nt, Human
agggcaacacagcaagaccccaucucuacaaa

SEQ ID NO: 324525 - RNA, 32 nt, Human
agggcaacagagcagaggcucggagaggaacc

SEQ ID NO: 324526 - RNA, 32 nt, Human
agggcaacagcaccugccccacccuguccccg

SEQ ID NO: 324527 - RNA, 32 nt, Human
agggcaacauggugaaaccccaucucuacuaa

SEQ ID NO: 324528 - RNA, 32 nt, Human
agggcaaccuaaaagcccacuuagaaacuuuu

SEQ ID NO: 324529 - RNA, 32 nt, Human
agggcaacucacgggugcaugaaaccacugga

SEQ ID NO: 324530 - RNA, 32 nt, Human
agggcaacuuggaaauaauggugaaaagaaug

SEQ ID NO: 324531 - RNA, 23 nt, Human
agggcaagaagagugacucgaag

SEQ ID NO: 324532 - RNA, 21 nt, Human
agggcaagaaggucugagagg

SEQ ID NO: 324533 - RNA, 21 nt, Human
agggcaagaauucacacguag

SEQ ID NO: 324534 - RNA, 32 nt, Human
agggcaagagcaucucgaugcagcgcauacag

SEQ ID NO: 324535 - RNA, 22 nt, Human
agggcaagaggaaaccagggca

SEQ ID NO: 324536 - RNA, 32 nt, Human
agggcaagaggaaaggaggagaguaagggaac

SEQ ID NO: 324537 - RNA, 21 nt, Human
agggcaagaggcugcaggaag

SEQ ID NO: 324538 - RNA, 32 nt, Human
agggcaagagggcacaagacagcaagggucaa

SEQ ID NO: 324539 - RNA, 32 nt, Human
agggcaagagguggggaggaggucagaggaga

SEQ ID NO: 324540 - RNA, 32 nt, Human
agggcaagagugagcaagagauggaaguugca

SEQ ID NO: 324541 - RNA, 32 nt, Human
agggcaaggacguggccagugggagcuggugu

SEQ ID NO: 324542 - RNA, 32 nt, Human
agggcaaggagguaccucacagguggguguga

SEQ ID NO: 324543 - RNA, 32 nt, Human
agggcaaggauccugugcugcugucugguuga

SEQ ID NO: 324544 - RNA, 32 nt, Human
agggcaaggcaagaugguggacagauagagaa

SEQ ID NO: 324545 - RNA, 32 nt, Human
agggcaagggcugaccccaugggcuaguacuu

SEQ ID NO: 324546 - RNA, 32 nt, Human
agggcaaggggcuguggaguuuggugucuacu

SEQ ID NO: 324547 - RNA, 32 nt, Human
agggcaagggggcgcggcguccugguccucga

SEQ ID NO: 324548 - RNA, 32 nt, Human
agggcaaggucccucuccagcugcaggugagg

SEQ ID NO: 324549 - RNA, 31 nt, Human
agggcaagugagagccggacgggcacugggc

SEQ ID NO: 324550 - RNA, 32 nt, Human
agggcaaugaaagccaaggagagcagaggggu

SEQ ID NO: 324551 - RNA, 32 nt, Human
agggcaaugcagcaauuaaccccacaucguuu

SEQ ID NO: 324552 - RNA, 32 nt, Human
agggcaauuagaagaggaaagacugacuucau

SEQ ID NO: 324553 - RNA, 32 nt, Human
agggcaauuccuccucucucucugccuggccc

SEQ ID NO: 324554 - RNA, 32 nt, Human
agggcacaaaauccaagagaaggucugugagc

SEQ ID NO: 324555 - RNA, 32 nt, Human
agggcacaaccauaauggcauuacugacuucc

SEQ ID NO: 324556 - RNA, 32 nt, Human
agggcacaagcagaaacaggcccgacuuccuu

SEQ ID NO: 324557 - RNA, 32 nt, Human
agggcacaauacugagcaacauggacaagguc

SEQ ID NO: 324558 - RNA, 32 nt, Human
agggcacacagccggcugagccaggacccacc

SEQ ID NO: 324559 - RNA, 32 nt, Human
agggcacacccaggggaauuuaaugaggcgac

SEQ ID NO: 324560 - RNA, 32 nt, Human
agggcacacucccaugcugucacccucaggaa

SEQ ID NO: 324561 - RNA, 32 nt, Human
agggcacagaggcaaggccuccugucuacagc

SEQ ID NO: 324562 - RNA, 32 nt, Human
agggcacagauugcagagguaaugcuguggca

SEQ ID NO: 324563 - RNA, 32 nt, Human
agggcacagccaggcuggagucagugucugcc

SEQ ID NO: 324564 - RNA, 18 nt, Human
agggcacaggagcugcuc

SEQ ID NO: 324565 - RNA, 32 nt, Human
agggcacaggcuuccagccaguucuaccuggg

SEQ ID NO: 324566 - RNA, 32 nt, Human
agggcacagggcccugggggcaccuuccuccu

SEQ ID NO: 324567 - RNA, 32 nt, Human
agggcacagucucuaggucucugacaggcagg

SEQ ID NO: 324568 - RNA, 32 nt, Human
agggcaccagugcugcccaaagaccucuugcu

SEQ ID NO: 324569 - RNA, 32 nt, Human
agggcaccauuuuuaaucccagaacacauuuc

SEQ ID NO: 324570 - RNA, 32 nt, Human
agggcaccccucuccccacuuaagucuggaag

SEQ ID NO: 324571 - RNA, 32 nt, Human
agggcacccuguggcccuggcucugcuguccc

SEQ ID NO: 324572 - RNA, 22 nt, Human
agggcaccgcugucgucggcca

SEQ ID NO: 324573 - RNA, 32 nt, Human
agggcaccuccaggugggcaggagcuaccacu

SEQ ID NO: 324574 - RNA, 32 nt, Human
agggcaccuguguggagccagggaagccaggg

SEQ ID NO: 324575 - RNA, 32 nt, Human
agggcacgacucucucccagcucgggucgccg

SEQ ID NO: 324576 - RNA, 32 nt, Human
agggcacgcagcgugagggugugucuucccug

SEQ ID NO: 324577 - RNA, 32 nt, Human
agggcacgcugccagaauccaggcuggucgua

SEQ ID NO: 324578 - RNA, 32 nt, Human
agggcacggcuuccucugcuucucccaccacu

SEQ ID NO: 324579 - RNA, 32 nt, Human
agggcacgggcuguggcccgaggaggcggugg

SEQ ID NO: 324580 - RNA, 32 nt, Human
agggcacgugaagucauugaggcccugcugcg

SEQ ID NO: 324581 - RNA, 32 nt, Human
agggcacucaccaggcugcaagaacagugcug

SEQ ID NO: 324582 - RNA, 32 nt, Human
agggcacugacgcugaauggugcagugagaaa

SEQ ID NO: 324583 - RNA, 32 nt, Human
agggcacugccacugcugaaucagagcaugcc

SEQ ID NO: 324584 - RNA, 21 nt, Human
agggcacugcccugggucacu

SEQ ID NO: 324585 - RNA, 32 nt, Human
agggcacugccuggccuuggcucuuuguuccc

SEQ ID NO: 324586 - RNA, 32 nt, Human
agggcacuggacuuucuggcaugggggcugug

SEQ ID NO: 324587 - RNA, 32 nt, Human
agggcacuguguggcccccuuccaaaucucag

SEQ ID NO: 324588 - RNA, 32 nt, Human
agggcacuucucucucuuaccucucuugcacu

SEQ ID NO: 324589 - RNA, 32 nt, Human
agggcacuuggacacuuugcuucaccucagcc

SEQ ID NO: 324590 - RNA, 32 nt, Human
agggcacuuguauuccagccucgcugcauuug

SEQ ID NO: 324591 - RNA, 32 nt, Human
agggcagaaagcggcggcaggagaagcaggca

SEQ ID NO: 324592 - RNA, 32 nt, Human
agggcagaaauagucccauguauaccuuuucc

SEQ ID NO: 324593 - RNA, 32 nt, Human
agggcagaaggaaggagggaagaaaagaaagc

SEQ ID NO: 324594 - RNA, 32 nt, Human
agggcagaaggcagaguccaggcuuagacugc

SEQ ID NO: 324595 - RNA, 32 nt, Human
agggcagacacaggccaguggggcgugccaug

SEQ ID NO: 324596 - RNA, 32 nt, Human
agggcagaccacaccaccccagagccaagugc

SEQ ID NO: 324597 - RNA, 32 nt, Human
agggcagacucugcuuggguuugguuguaaga

SEQ ID NO: 324598 - RNA, 32 nt, Human
agggcagagaaggcugaggcagcuggagcuac

SEQ ID NO: 324599 - RNA, 32 nt, Human
agggcagagaaugaggcgugugcacugucugc

SEQ ID NO: 324600 - RNA, 32 nt, Human
agggcagagacacuucaacagucauugccagc

SEQ ID NO: 324601 - RNA, 32 nt, Human
agggcagagaggaggagggaggcugucaggau

SEQ ID NO: 324602 - RNA, 32 nt, Human
agggcagagaucuuguucacaucuugcucacu

SEQ ID NO: 324603 - RNA, 32 nt, Human
agggcagagcacaacucagccucccaggcugc

SEQ ID NO: 324604 - RNA, 32 nt, Human
agggcagagccuggcugcugggcagaagggca

SEQ ID NO: 324605 - RNA, 32 nt, Human
agggcagaggaagcaggguacagacaggagaa

SEQ ID NO: 324606 - RNA, 32 nt, Human
agggcagaggggucagggcugaggaggagaag

SEQ ID NO: 324607 - RNA, 32 nt, Human
agggcagaguaagagaaaagauggaaugagug

SEQ ID NO: 324608 - RNA, 32 nt, Human
agggcagagugggcggaggggagcagccgcac

SEQ ID NO: 324609 - RNA, 21 nt, Human
agggcagauaccagccuuucu

SEQ ID NO: 324610 - RNA, 32 nt, Human
agggcagauacuuccugucaauaaacagaucu

SEQ ID NO: 324611 - RNA, 32 nt, Human
agggcagaucaagcaauucucuugccucagcc

SEQ ID NO: 324612 - RNA, 32 nt, Human
agggcagaucuggacagcagaauguuauaacg

SEQ ID NO: 324613 - RNA, 24 nt, Human
agggcagcacccaaggucugggca

SEQ ID NO: 324614 - RNA, 32 nt, Human
agggcagcacuguggccagcugucugucuuua

SEQ ID NO: 324615 - RNA, 25 nt, Human
agggcagcagcagccagguguggca

SEQ ID NO: 324616 - RNA, 20 nt, Human
agggcagcagccccugggca

SEQ ID NO: 324617 - RNA, 32 nt, Human
agggcagcagccuaagggcaguagcuuaugug

SEQ ID NO: 324618 - RNA, 32 nt, Human
agggcagcagggacaggacuggaagggaccug

SEQ ID NO: 324619 - RNA, 32 nt, Human
agggcagcagggagucuugaagugaucauuuc

SEQ ID NO: 324620 - RNA, 22 nt, Human
agggcagcaggugauccgggca

SEQ ID NO: 324621 - RNA, 19 nt, Human
agggcagcagugccggggu

SEQ ID NO: 324622 - RNA, 32 nt, Human
agggcagcauugaggguguacagagcccagug

SEQ ID NO: 324623 - RNA, 32 nt, Human
agggcagccagccuccauugacggcgagccuc

SEQ ID NO: 324624 - RNA, 32 nt, Human
agggcagccaugcacucccccugggugucgcu

SEQ ID NO: 324625 - RNA, 24 nt, Human
agggcagccaugccagccugagca

SEQ ID NO: 324626 - RNA, 32 nt, Human
agggcagccccaccccauccagccugggcucc

SEQ ID NO: 324627 - RNA, 21 nt, Human
agggcagccccagcacgggca

SEQ ID NO: 324628 - RNA, 23 nt, Human
agggcagcccggcaagcccgggc

SEQ ID NO: 324629 - RNA, 32 nt, Human
agggcagccggcaggagccaggcgagaacaga

SEQ ID NO: 324630 - RNA, 32 nt, Human
agggcagccugaccaacauagugaaaccccau

SEQ ID NO: 324631 - RNA, 21 nt, Human
agggcagccugcgccugggua

SEQ ID NO: 324632 - RNA, 32 nt, Human
agggcagccuugugucccuggccacacuucca

SEQ ID NO: 324633 - RNA, 32 nt, Human
agggcagcgaagcagaauggccaacaugcagg

SEQ ID NO: 324634 - RNA, 32 nt, Human
agggcagcgaaggggccgggccccagacugag

SEQ ID NO: 324635 - RNA, 21 nt, Human
agggcagcggagggcccggca

SEQ ID NO: 324636 - RNA, 32 nt, Human
agggcagcguaugggggcagagcccgguucug

SEQ ID NO: 324637 - RNA, 32 nt, Human
agggcagcgugcagcagaauuugcauuugcuu

SEQ ID NO: 324638 - RNA, 32 nt, Human
agggcagcguucagcacacuccugggcauggc

SEQ ID NO: 324639 - RNA, 32 nt, Human
agggcagcugcaugcucccucucuccagacca

SEQ ID NO: 324640 - RNA, 21 nt, Human
agggcagcugugccugggaca

SEQ ID NO: 324641 - RNA, 21 nt, Human
agggcagcuuagcuggccugg

SEQ ID NO: 324642 - RNA, 32 nt, Human
agggcagcuuggcagagccucaggauggaccc

SEQ ID NO: 324643 - RNA, 32 nt, Human
agggcaggaaccuggucuugaaccccaguguu

SEQ ID NO: 324644 - RNA, 32 nt, Human
agggcaggaagggcacguucucaucagcauga

SEQ ID NO: 324645 - RNA, 32 nt, Human
agggcaggacagcagaggacgugcugggauua

SEQ ID NO: 324646 - RNA, 32 nt, Human
agggcaggaccacccagcuggucagacucuga

SEQ ID NO: 324647 - RNA, 18 nt, Human
agggcaggaccugagaaa

SEQ ID NO: 324648 - RNA, 32 nt, Human
agggcaggaggcucuugaccccaaacagcuga

SEQ ID NO: 324649 - RNA, 32 nt, Human
agggcaggcaggagguggaguugcagcuguug

SEQ ID NO: 324650 - RNA, 32 nt, Human
agggcaggcaggcaauggguggaaaucagggg

SEQ ID NO: 324651 - RNA, 23 nt, Human
agggcaggccagaagccugggca

SEQ ID NO: 324652 - RNA, 32 nt, Human
agggcaggccagagcugaggggcugcuccugc

SEQ ID NO: 324653 - RNA, 32 nt, Human
agggcaggcgccugggcugggggcggggacca

SEQ ID NO: 324654 - RNA, 32 nt, Human
agggcaggcuccaagggagcaggcuggccccu

SEQ ID NO: 324655 - RNA, 32 nt, Human
agggcaggcuggaccugucaagacgggaaggg

SEQ ID NO: 324656 - RNA, 32 nt, Human
agggcagggaacaggcuacuguccuucccugu

SEQ ID NO: 324657 - RNA, 32 nt, Human
agggcagggaagggaagggcggagcuggggug

SEQ ID NO: 324658 - RNA, 32 nt, Human
agggcagggaccccucuccccugcugucucuu

SEQ ID NO: 324659 - RNA, 32 nt, Human
agggcagggacccgcuaagcugaucuccugua

SEQ ID NO: 324660 - RNA, 32 nt, Human
agggcagggagugggagccaaugaacaggcau

SEQ ID NO: 324661 - RNA, 32 nt, Human
agggcagggcugggccugcauccgcuugcccu

SEQ ID NO: 324662 - RNA, 32 nt, Human
agggcagggcugggcgcgauggcucacaccug

SEQ ID NO: 324663 - RNA, 32 nt, Human
agggcagggcuggggugaugaccaugguaaca

SEQ ID NO: 324664 - RNA, 23 nt, Human
agggcagggcuggguccugggca

SEQ ID NO: 324665 - RNA, 32 nt, Human
agggcagggcuucuacccugcaucccuggcca

SEQ ID NO: 324666 - RNA, 32 nt, Human
agggcaggggagaaggagggggagcagaaaaa

SEQ ID NO: 324667 - RNA, 32 nt, Human
agggcaggggcagguugcuaagucaggugcag

SEQ ID NO: 324668 - RNA, 32 nt, Human
agggcaggggcccuuggcugagcccaccccgc

SEQ ID NO: 324669 - RNA, 32 nt, Human
agggcaggggcgcgcagagccacgguuugcuc

SEQ ID NO: 324670 - RNA, 17 nt, Human
agggcagggguuggagg

SEQ ID NO: 324671 - RNA, 32 nt, Human
agggcaggucccggggaagcuccggacuccua

SEQ ID NO: 324672 - RNA, 32 nt, Human
agggcagguggagaguccagggaggcaggaug

SEQ ID NO: 324673 - RNA, 21 nt, Human
agggcagguggggccacucug

SEQ ID NO: 324674 - RNA, 32 nt, Human
agggcagguugugcagcuggaggcagagcagu

SEQ ID NO: 324675 - RNA, 32 nt, Human
agggcagguuugcuugaccucugccucaguuc

SEQ ID NO: 324676 - RNA, 32 nt, Human
agggcaguagaucucuaauguggaggugggaa

SEQ ID NO: 324677 - RNA, 22 nt, Human
agggcagucacuaaccugccca

SEQ ID NO: 324678 - RNA, 32 nt, Human
agggcagucauccucaggccguacccagccag

SEQ ID NO: 324679 - RNA, 32 nt, Human
agggcagucccagugagaacucucaagaccuc

SEQ ID NO: 324680 - RNA, 32 nt, Human
agggcagucugaagauggccaauuacacgcug

SEQ ID NO: 324681 - RNA, 32 nt, Human
agggcagucuucuuggaggaagugaaucugga

SEQ ID NO: 324682 - RNA, 32 nt, Human
agggcagugagcugugauugcaccgugacacu

SEQ ID NO: 324683 - RNA, 21 nt, Human
agggcagugcagcacuaggca

SEQ ID NO: 324684 - RNA, 32 nt, Human
agggcagugcagcacuaggcaggugugaggag

SEQ ID NO: 324685 - RNA, 32 nt, Human
agggcagugcaugaagccaggggucaucagcc

SEQ ID NO: 324686 - RNA, 32 nt, Human
agggcagugcguggaaaggccggggaggugca

SEQ ID NO: 324687 - RNA, 32 nt, Human
agggcaguggaccaauggacagcuccaccagc

SEQ ID NO: 324688 - RNA, 32 nt, Human
agggcaguggaggcugaggcuaugauggcggc

SEQ ID NO: 324689 - RNA, 32 nt, Human
agggcaguggcaaaggccagugaggcagcugu

SEQ ID NO: 324690 - RNA, 32 nt, Human
agggcaguggcaggaucucaguucaccccaac

SEQ ID NO: 324691 - RNA, 32 nt, Human
agggcagugggacgcuggccacggccagggug

SEQ ID NO: 324692 - RNA, 32 nt, Human
agggcaguguccagauccccagagccacacau

SEQ ID NO: 324693 - RNA, 19 nt, Human
agggcaguuagccagcuca

SEQ ID NO: 324694 - RNA, 32 nt, Human
agggcaguuugguuucaacacagcagaccuga

SEQ ID NO: 324695 - RNA, 32 nt, Human
agggcauacacucuauugugggcacagaauga

SEQ ID NO: 324696 - RNA, 32 nt, Human
agggcauaccauuucuuccugacauuugucag

SEQ ID NO: 324697 - RNA, 32 nt, Human
agggcauagacucaggcagagaggauuguggg

SEQ ID NO: 324698 - RNA, 32 nt, Human
agggcaucacugggucugcuggcuucuacacu

SEQ ID NO: 324699 - RNA, 32 nt, Human
agggcaucagguguagggacccugccaagugg

SEQ ID NO: 324700 - RNA, 21 nt, Human
agggcaucccgggccugggca

SEQ ID NO: 324701 - RNA, 32 nt, Human
agggcauccugaggcccugacugccagcugaa

SEQ ID NO: 324702 - RNA, 32 nt, Human
agggcaucgaucuuccucacaccacaaaucug

SEQ ID NO: 324703 - RNA, 32 nt, Human
agggcaucuccaggaaggcggggcuucaaccu

SEQ ID NO: 324704 - RNA, 32 nt, Human
agggcaucucugaaacaaaggcagcagcccca

SEQ ID NO: 324705 - RNA, 32 nt, Human
agggcaucucugaaagaaaggcagcagcccca

SEQ ID NO: 324706 - RNA, 32 nt, Human
agggcaucuugcaucugccacugcuuuuauaa

SEQ ID NO: 324707 - RNA, 32 nt, Human
agggcaugaaaguaucugaaagcaauguagca

SEQ ID NO: 324708 - RNA, 31 nt, Human
agggcaugaacuaccuccaugccaagaauau

SEQ ID NO: 324709 - RNA, 32 nt, Human
agggcaugagaggcagagugcacaguggucaa

SEQ ID NO: 324710 - RNA, 32 nt, Human
agggcaugaggcaccuccaggaggaagaaggc

SEQ ID NO: 324711 - RNA, 32 nt, Human
agggcaugcucuggaacccagcaggaucacag

SEQ ID NO: 324712 - RNA, 32 nt, Human
agggcauggaaggcuucuccgcccauucugac

SEQ ID NO: 324713 - RNA, 32 nt, Human
agggcauggagcauguggcuguccugagguuc

SEQ ID NO: 324714 - RNA, 32 nt, Human
agggcauggagggagaggaauaaagagaaaca

SEQ ID NO: 324715 - RNA, 32 nt, Human
agggcauggcacugacaucugccuuguaacug

SEQ ID NO: 324716 - RNA, 32 nt, Human
agggcaugggagcacacagagagauggcagcc

SEQ ID NO: 324717 - RNA, 32 nt, Human
agggcauguagcaggccaggccacgggcuugc

SEQ ID NO: 324718 - RNA, 32 nt, Human
agggcauguggaauucguugaguuugcuuuua

SEQ ID NO: 324719 - RNA, 32 nt, Human
agggcauguguauguacaguaauguguauucc

SEQ ID NO: 324720 - RNA, 32 nt, Human
agggcauguguaugugucugcuaauguaaacu

SEQ ID NO: 324721 - RNA, 32 nt, Human
agggcauuacaaaaauuuagcuacuuucaaau

SEQ ID NO: 324722 - RNA, 32 nt, Human
agggcauucacuccauggugcucauuggaguu

SEQ ID NO: 324723 - RNA, 32 nt, Human
agggcauuccagcaagaggcugaugcaggaga

SEQ ID NO: 324724 - RNA, 32 nt, Human
agggcauugagaugcaucucuucaggguggag

SEQ ID NO: 324725 - RNA, 32 nt, Human
agggcauugguuacuucauagcauuuucuuuc

SEQ ID NO: 324726 - RNA, 32 nt, Human
agggcauuguaucugucuuuccacucuggauu

SEQ ID NO: 324727 - RNA, 32 nt, Human
agggcauuugucacuuaccaaaugucacauag

SEQ ID NO: 324728 - RNA, 32 nt, Human
agggccaaacagcagaguggagcugagcugug

SEQ ID NO: 324729 - RNA, 32 nt, Human
agggccaaaccaaaagacaaaaauuggaguaa

SEQ ID NO: 324730 - RNA, 32 nt, Human
agggccaaacccuccugguucccuucagaguc

SEQ ID NO: 324731 - RNA, 18 nt, Human
agggccaaaggcagugua

SEQ ID NO: 324732 - RNA, 32 nt, Human
agggccaaaggcuggcuuggccuguguuuccc

SEQ ID NO: 324733 - RNA, 24 nt, Human
agggccaaauucccaaccugcuca

SEQ ID NO: 324734 - RNA, 32 nt, Human
agggccaacaguucacaucugucuccaagcca

SEQ ID NO: 324735 - RNA, 19 nt, Human
agggccaaccacagaaugc

SEQ ID NO: 324736 - RNA, 21 nt, Human
agggccaagaccuacugcgga

SEQ ID NO: 324737 - RNA, 32 nt, Human
agggccaagagaaaggccugcacacaagccca

SEQ ID NO: 324738 - RNA, 21 nt, Human
agggccaagagggccugugga

SEQ ID NO: 324739 - RNA, 24 nt, Human
agggccaagcagaguucuuuugga

SEQ ID NO: 324740 - RNA, 32 nt, Human
agggccaagcuaccagaaaaguagaaguggag

SEQ ID NO: 324741 - RNA, 32 nt, Human
agggccaaggcauugcuguaagaaaaggucua

SEQ ID NO: 324742 - RNA, 32 nt, Human
agggccaaggccgggugcagugguucacgccu

SEQ ID NO: 324743 - RNA, 24 nt, Human
agggccaaggggaacuauugugga

SEQ ID NO: 324744 - RNA, 32 nt, Human
agggccaaguacaggcaaucacccccaucuuc

SEQ ID NO: 324745 - RNA, 22 nt, Human
agggccaaguggacaucuugga

SEQ ID NO: 324746 - RNA, 22 nt, Human
agggccaaguguuccuguucau

SEQ ID NO: 324747 - RNA, 32 nt, Human
agggccacagcccagcgagggugagguggggg

SEQ ID NO: 324748 - RNA, 19 nt, Human
agggccacaggacccggga

SEQ ID NO: 324749 - RNA, 23 nt, Human
agggccacaucgggcuguuuugc

SEQ ID NO: 324750 - RNA, 21 nt, Human
agggccacaugggaggcucac

SEQ ID NO: 324751 - RNA, 21 nt, Human
agggccaccaaccccagggaa

SEQ ID NO: 324752 - RNA, 32 nt, Human
agggccaccauccuccagaccccagaauggug

SEQ ID NO: 324753 - RNA, 32 nt, Human
agggccaccauccuccagaucccagaauguag

SEQ ID NO: 324754 - RNA, 24 nt, Human
agggccaccccgucccuccucucc

SEQ ID NO: 324755 - RNA, 32 nt, Human
agggccacguucuccuggcccuuggggaucgu

SEQ ID NO: 324756 - RNA, 32 nt, Human
agggccacuacacuccagccugggugacagag

SEQ ID NO: 324757 - RNA, 32 nt, Human
agggccacucuugcccuggagaucuuggccuu

SEQ ID NO: 324758 - RNA, 32 nt, Human
agggccacuggaaacugucccaggaacgaugg

SEQ ID NO: 324759 - RNA, 21 nt, Human
agggccacuguccuccaggca

SEQ ID NO: 324760 - RNA, 21 nt, Human
agggccacuuagagagcagua

SEQ ID NO: 324761 - RNA, 32 nt, Human
agggccacuuguugaagucugagcacuuuaug

SEQ ID NO: 324762 - RNA, 32 nt, Human
agggccagacaaggcucaguggaucuggucug

SEQ ID NO: 324763 - RNA, 23 nt, Human
agggccagaccuugccucugggc

SEQ ID NO: 324764 - RNA, 32 nt, Human
agggccagagaagggguucucaaacugggguc

SEQ ID NO: 324765 - RNA, 32 nt, Human
agggccagagaggcaccuucucaagcgcagga

SEQ ID NO: 324766 - RNA, 32 nt, Human
agggccagagcagaggacacauggccuugcgu

SEQ ID NO: 324767 - RNA, 32 nt, Human
agggccagagccaaggccagagccagggcccg

SEQ ID NO: 324768 - RNA, 23 nt, Human
agggccagagccaugcaguccca

SEQ ID NO: 324769 - RNA, 22 nt, Human
agggccagagcgagccaugcca

SEQ ID NO: 324770 - RNA, 32 nt, Human
agggccagagcggggcagacauggacaagcgg

SEQ ID NO: 324771 - RNA, 32 nt, Human
agggccagagcugagggggucucagucacuuc

SEQ ID NO: 324772 - RNA, 32 nt, Human
agggccagcacauggaauaaaauagccagggc

SEQ ID NO: 324773 - RNA, 19 nt, Human
agggccagcaggcagcgcc

SEQ ID NO: 324774 - RNA, 32 nt, Human
agggccagccccggcugagaggacaggagugu

SEQ ID NO: 324775 - RNA, 23 nt, Human
agggccagccuccagcgcugcuc

SEQ ID NO: 324776 - RNA, 32 nt, Human
agggccagccuccagcgcugcucuuucuguag

SEQ ID NO: 324777 - RNA, 32 nt, Human
agggccagcugaugccgggagcuaacuaccgc

SEQ ID NO: 324778 - RNA, 32 nt, Human
agggccagcugcagagggcucucucuaggcag

SEQ ID NO: 324779 - RNA, 32 nt, Human
agggccagcugcccucuggcucuggcuguggc

SEQ ID NO: 324780 - RNA, 32 nt, Human
agggccagcuuugauaauggagcgagaugcca

SEQ ID NO: 324781 - RNA, 21 nt, Human
agggccaggaaccaggcugcc

SEQ ID NO: 324782 - RNA, 19 nt, Human
agggccaggaagccugagc

SEQ ID NO: 324783 - RNA, 32 nt, Human
agggccaggagagagaucuagaaaguggguuc

SEQ ID NO: 324784 - RNA, 32 nt, Human
agggccaggcaaggccagagugcuaggggcag

SEQ ID NO: 324785 - RNA, 32 nt, Human
agggccaggccgcccccuccccgagaccuguc

SEQ ID NO: 324786 - RNA, 32 nt, Human
agggccaggccugggucuagaauucuugcugc

SEQ ID NO: 324787 - RNA, 32 nt, Human
agggccaggcggggccaaauuccaucugcugc

SEQ ID NO: 324788 - RNA, 32 nt, Human
agggccagggaaugacagaaucagggccugau

SEQ ID NO: 324789 - RNA, 24 nt, Human
agggccagggauguucauugugga

SEQ ID NO: 324790 - RNA, 32 nt, Human
agggccagggcgggaggagcuggggagcuggg

SEQ ID NO: 324791 - RNA, 32 nt, Human
agggccagggcugaugguacugcuggcccaac

SEQ ID NO: 324792 - RNA, 22 nt, Human
agggccaggggcuucugugaga

SEQ ID NO: 324793 - RNA, 21 nt, Human
agggccaggguacgcagcucc

SEQ ID NO: 324794 - RNA, 23 nt, Human
agggccagguccuggucugugga

SEQ ID NO: 324795 - RNA, 21 nt, Human
agggccaggucuaggggccag

SEQ ID NO: 324796 - RNA, 32 nt, Human
agggccagguggguucauauuuacagauaugc

SEQ ID NO: 324797 - RNA, 21 nt, Human
agggccagucgagccugucca

SEQ ID NO: 324798 - RNA, 32 nt, Human
agggccagugccuggcaugugucccagggaca

SEQ ID NO: 324799 - RNA, 32 nt, Human
agggccagugcucugugccacucuggagaaau

SEQ ID NO: 324800 - RNA, 32 nt, Human
agggccaguggcagcuucccagccucuuuggg

SEQ ID NO: 324801 - RNA, 32 nt, Human
agggccaguggguuuucauggugaacugaggg

SEQ ID NO: 324802 - RNA, 32 nt, Human
agggccaguguacaaaccagcaccugcuagga

SEQ ID NO: 324803 - RNA, 32 nt, Human
agggccaguucugcucccuggcuccacugagc

SEQ ID NO: 324804 - RNA, 32 nt, Human
agggccaguucugugggcucuagucggccaua

SEQ ID NO: 324805 - RNA, 24 nt, Human
agggccauaugcgauuauguuuca

SEQ ID NO: 324806 - RNA, 27 nt, Human
agggccauccaacuacggaccugccca

SEQ ID NO: 324807 - RNA, 32 nt, Human
agggccauccuugggcuaacaacugggguggg

SEQ ID NO: 324808 - RNA, 31 nt, Human
agggccaugaaacuacaggccgugauggaga

SEQ ID NO: 324809 - RNA, 19 nt, Human
agggccaugccugcuucau

SEQ ID NO: 324810 - RNA, 31 nt, Human
agggccauggagaagaggcugggagucaagc

SEQ ID NO: 324811 - RNA, 31 nt, Human
agggccauggcagagggugaggauaugcaga

SEQ ID NO: 324812 - RNA, 24 nt, Human
agggccauguaguucuugcuucgc

SEQ ID NO: 324813 - RNA, 32 nt, Human
agggccauucaccaggagcaugcggcucccug

SEQ ID NO: 324814 - RNA, 32 nt, Human
agggcccaaacccugaggccauuaggccugau

SEQ ID NO: 324815 - RNA, 32 nt, Human
agggcccacagcccggacucagccacagcaga

SEQ ID NO: 324816 - RNA, 32 nt, Human
agggcccacccuccuuuuucagccucugcaua

SEQ ID NO: 324817 - RNA, 32 nt, Human
agggcccaccuccaaauaccaucacauuggga

SEQ ID NO: 324818 - RNA, 32 nt, Human
agggcccaccugcugguuggugaaagcagugg

SEQ ID NO: 324819 - RNA, 32 nt, Human
agggcccacugcagccucagcccaggagccac

SEQ ID NO: 324820 - RNA, 32 nt, Human
agggcccacuugcccagcaccaaggcgagcuc

SEQ ID NO: 324821 - RNA, 31 nt, Human
agggcccagagaggcgguggggugggcgacc

SEQ ID NO: 324822 - RNA, 31 nt, Human
agggcccagagaguggguggagaagcucugc

SEQ ID NO: 324823 - RNA, 32 nt, Human
agggcccagagcuuuggccagagcagagaaca

SEQ ID NO: 324824 - RNA, 32 nt, Human
agggcccagcagcaaccugccgcugccgcuga

SEQ ID NO: 324825 - RNA, 32 nt, Human
agggcccagcugucuugccugcccgugggcac

SEQ ID NO: 324826 - RNA, 32 nt, Human
agggcccaggaggucaaggcuucagugagcca

SEQ ID NO: 324827 - RNA, 32 nt, Human
agggcccaggcaggccaccauauucagugcug

SEQ ID NO: 324828 - RNA, 32 nt, Human
agggcccaggcaggcggccuauccugauccuu

SEQ ID NO: 324829 - RNA, 32 nt, Human
agggcccagggcaagcagaggcagcaaugguu

SEQ ID NO: 324830 - RNA, 32 nt, Human
agggcccaggggcagagcucucccuaugcuac

SEQ ID NO: 324831 - RNA, 32 nt, Human
agggcccagggugggugucccugggagcccug

SEQ ID NO: 324832 - RNA, 28 nt, Human
agggccccaagugucugacucgcaaagg

SEQ ID NO: 324833 - RNA, 32 nt, Human
agggccccagaacgaggaaggagcggaguugg

SEQ ID NO: 324834 - RNA, 32 nt, Human
agggccccagcacggggcuggacugccacagc

SEQ ID NO: 324835 - RNA, 32 nt, Human
agggccccagccagggcagcuuucaggguggg

SEQ ID NO: 324836 - RNA, 32 nt, Human
agggccccaggcucguuuuccuuuauagcgaa

SEQ ID NO: 324837 - RNA, 32 nt, Human
agggccccagggugggaugguggggagauaag

SEQ ID NO: 324838 - RNA, 32 nt, Human
agggcccccagaggaagcccucagccucugcc

SEQ ID NO: 324839 - RNA, 21 nt, Human
agggccccccugccccaccgc

SEQ ID NO: 324840 - RNA, 32 nt, Human
agggcccccugccugcucugguccaccccguc

SEQ ID NO: 324841 - RNA, 32 nt, Human
agggccccgagcgaaggaaggaagggaggcgc

SEQ ID NO: 324842 - RNA, 19 nt, Human
agggccccgcccuccuccc

SEQ ID NO: 324843 - RNA, 32 nt, Human
agggccccuccaggacugccaagcucccaaag

SEQ ID NO: 324844 - RNA, 32 nt, Human
agggccccucccuugccugccacuuuggggac

SEQ ID NO: 324845 - RNA, 32 nt, Human
agggccccucgccuuccuccccuggaccuggg

SEQ ID NO: 324846 - RNA, 21 nt, Human
agggccccucuccccagggaa

SEQ ID NO: 324847 - RNA, 32 nt, Human
agggccccuucccucuaaaccuuuccuccauu

SEQ ID NO: 324848 - RNA, 32 nt, Human
agggcccgauggggugccuccuugucccaagu

SEQ ID NO: 324849 - RNA, 32 nt, Human
agggcccgcggcuucauucuugaagucaguga

SEQ ID NO: 324850 - RNA, 32 nt, Human
agggcccggcgccguccguggaugagccacag

SEQ ID NO: 324851 - RNA, 32 nt, Human
agggcccggcuggaggcugacaggcuuccaag

SEQ ID NO: 324852 - RNA, 24 nt, Human
agggcccgguggugucugcuucac

SEQ ID NO: 324853 - RNA, 32 nt, Human
agggcccuaagaguguggucugcagggucaag

SEQ ID NO: 324854 - RNA, 18 nt, Human
agggcccuccccucugcc

SEQ ID NO: 324855 - RNA, 22 nt, Human
agggcccuccugaaccccauca

SEQ ID NO: 324856 - RNA, 20 nt, Human
agggcccuccuuguccaugu

SEQ ID NO: 324857 - RNA, 32 nt, Human
agggcccucgaaugccauucacaggaacagcc

SEQ ID NO: 324858 - RNA, 18 nt, Human
agggcccucggccgggga

SEQ ID NO: 324859 - RNA, 32 nt, Human
agggcccugaacaccaggcucaggggcuugcu

SEQ ID NO: 324860 - RNA, 32 nt, Human
agggcccugaccaucuucuccucccagggcca

SEQ ID NO: 324861 - RNA, 32 nt, Human
agggcccugagcuugccgugaggagcacauuu

SEQ ID NO: 324862 - RNA, 32 nt, Human
agggcccugcagccuccagccagagugcccuc

SEQ ID NO: 324863 - RNA, 32 nt, Human
agggcccugcuacuguucagggauggggagug

SEQ ID NO: 324864 - RNA, 32 nt, Human
agggcccuggaaggaagggucuccugcugcca

SEQ ID NO: 324865 - RNA, 32 nt, Human
agggcccuggagcaccugguuucggggacagu

SEQ ID NO: 324866 - RNA, 32 nt, Human
agggcccuggagugagaaagccuggauuuuca

SEQ ID NO: 324867 - RNA, 24 nt, Human
agggcccugggcccugugcuguca

SEQ ID NO: 324868 - RNA, 32 nt, Human
agggcccuguaugauaggauuaaugcccuuuu

SEQ ID NO: 324869 - RNA, 32 nt, Human
agggcccugugaaaagcucuucaccuccucug

SEQ ID NO: 324870 - RNA, 32 nt, Human
agggcccuuagcauggccacacauguccccag

SEQ ID NO: 324871 - RNA, 32 nt, Human
agggcccuucagaccccagcugucugcgcguc

SEQ ID NO: 324872 - RNA, 32 nt, Human
agggcccuuccagagccugucauguccuugug

SEQ ID NO: 324873 - RNA, 32 nt, Human
agggcccuuggccuccccagugccucuuccag

SEQ ID NO: 324874 - RNA, 32 nt, Human
agggcccuugucugagaaaccccaaaccagga

SEQ ID NO: 324875 - RNA, 22 nt, Human
agggccgagaaggcgcgugcca

SEQ ID NO: 324876 - RNA, 21 nt, Human
agggccgagccggaacuccac

SEQ ID NO: 324877 - RNA, 18 nt, Human
agguggaagaaggcugcu

SEQ ID NO: 324878 - RNA, 32 nt, Human
agguggaagcagaggcccugcccccaccccuu

SEQ ID NO: 324879 - RNA, 32 nt, Human
agguggaaggaaggaggaaaggagaggggccu

SEQ ID NO: 324880 - RNA, 23 nt, Human
agguggaaggauugcucgaggcc

SEQ ID NO: 324881 - RNA, 32 nt, Human
agguggaaggauugcucgaggccagguguucg

SEQ ID NO: 324882 - RNA, 23 nt, Human
agguggaaggauugcuugagucc

SEQ ID NO: 324883 - RNA, 24 nt, Human
agguggacagaucacgaggucagg

SEQ ID NO: 324884 - RNA, 32 nt, Human
agguggaccuggcagugguggaggugggcauu

SEQ ID NO: 324885 - RNA, 22 nt, Human
agguggacgcaccugccuggag

SEQ ID NO: 324886 - RNA, 24 nt, Human
agguggacggaucacgaggucagg

SEQ ID NO: 324887 - RNA, 26 nt, Human
agguggacggaucauuugaggucagg

SEQ ID NO: 324888 - RNA, 32 nt, Human
agguggacugccucucucauucccaggagcug

SEQ ID NO: 324889 - RNA, 32 nt, Human
agguggacuugcucccccucccugagagcuaa

SEQ ID NO: 324890 - RNA, 32 nt, Human
agguggagaacagccccucuccccgcgccccc

SEQ ID NO: 324891 - RNA, 32 nt, Human
agguggagaagagguacaaaggaaaacgagag

SEQ ID NO: 324892 - RNA, 23 nt, Human
agguggagaauugcuugaaccca

SEQ ID NO: 324893 - RNA, 32 nt, Human
agguggagagaccuggaggagugaggccacag

SEQ ID NO: 324894 - RNA, 32 nt, Human
agguggagagagaagagcagaguaccaggacg

SEQ ID NO: 324895 - RNA, 32 nt, Human
agguggagagagaagagcagaguaccaggaug

SEQ ID NO: 324896 - RNA, 32 nt, Human
agguggagagugggaagcaggagcccagccag

SEQ ID NO: 324897 - RNA, 32 nt, Human
agguggagaucagaagccagggauuagagauu

SEQ ID NO: 324898 - RNA, 32 nt, Human
agguggagauccaaguggaggugggagcggag

SEQ ID NO: 324899 - RNA, 32 nt, Human
agguggagaugguggaggugguggugguggug

SEQ ID NO: 324900 - RNA, 32 nt, Human
agguggagccaccggcccggccuggauuuucc

SEQ ID NO: 324901 - RNA, 32 nt, Human
agguggagcccccauuuaaaccucuguugcaa

SEQ ID NO: 324902 - RNA, 32 nt, Human
agguggagcucccacagccagcaguaaucagg

SEQ ID NO: 324903 - RNA, 32 nt, Human
agguggagcugcugggcugcgagccagggguu

SEQ ID NO: 324904 - RNA, 30 nt, Human
agguggagcuugcaaugagccgagaucgcg

SEQ ID NO: 324905 - RNA, 19 nt, Human
agguggagcuugcagugag

SEQ ID NO: 324906 - RNA, 30 nt, Human
agguggagcuugcagugagccaagaucacg

SEQ ID NO: 324907 - RNA, 30 nt, Human
agguggagcuugcagugagccaagaucgca

SEQ ID NO: 324908 - RNA, 30 nt, Human
agguggagcuugcagugagccaagaucgcg

SEQ ID NO: 324909 - RNA, 30 nt, Human
agguggagcuugcagugagccaagaucgua

SEQ ID NO: 324910 - RNA, 30 nt, Human
agguggagcuugcagugagccgagaccgug

SEQ ID NO: 324911 - RNA, 30 nt, Human
agguggagcuugcagugagcggagaucgcg

SEQ ID NO: 324912 - RNA, 32 nt, Human
agguggaggaagaaauccagacccuagcacgc

SEQ ID NO: 324913 - RNA, 32 nt, Human
agguggaggagaaaggggaaucucccaaaauu

SEQ ID NO: 324914 - RNA, 32 nt, Human
agguggaggaggaggaagaggagaaggaaaag

SEQ ID NO: 324915 - RNA, 32 nt, Human
agguggaggaggaggaggaagagguggaggag

SEQ ID NO: 324916 - RNA, 32 nt, Human
agguggaggaggaggaggaagaucaggaggag

SEQ ID NO: 324917 - RNA, 32 nt, Human
agguggaggaggaggaggaggaggaggaggug

SEQ ID NO: 324918 - RNA, 32 nt, Human
agguggaggaggaggaggaggaggugguggag

SEQ ID NO: 324919 - RNA, 32 nt, Human
agguggaggagggaggggaggagcaggugggc

SEQ ID NO: 324920 - RNA, 32 nt, Human
agguggaggcgagaugagcugcgcagccccgc

SEQ ID NO: 324921 - RNA, 32 nt, Human
agguggagggcaagccauccugacugagcagu

SEQ ID NO: 324922 - RNA, 32 nt, Human
agguggagggucucgcucugucacacaggcug

SEQ ID NO: 324923 - RNA, 32 nt, Human
agguggagguggagguugcagugagccgagau

SEQ ID NO: 324924 - RNA, 18 nt, Human
agguggagguugcaguga

SEQ ID NO: 324925 - RNA, 19 nt, Human
agguggagguugcagugag

SEQ ID NO: 324926 - RNA, 32 nt, Human
agguggagguugcagugagucaagauggcacc

SEQ ID NO: 324927 - RNA, 32 nt, Human
agguggaguacacggcagacucgaccguggca

SEQ ID NO: 324928 - RNA, 32 nt, Human
agguggagugggcagaggugcaagagagggau

SEQ ID NO: 324929 - RNA, 32 nt, Human
agguggauaagaaggugaaaagggggucccug

SEQ ID NO: 324930 - RNA, 32 nt, Human
agguggauaauugaggccuacaagagagggga

SEQ ID NO: 324931 - RNA, 24 nt, Human
agguggauagaucacuugagguca

SEQ ID NO: 324932 - RNA, 26 nt, Human
agguggauagaucacuugaggucagg

SEQ ID NO: 324933 - RNA, 32 nt, Human
agguggaucacugaggucagggguucaagacc

SEQ ID NO: 324934 - RNA, 32 nt, Human
agguggaucccuugagcccaggaguucgagac

SEQ ID NO: 324935 - RNA, 32 nt, Human
agguggaugcagccaugaauacaaggccacac

SEQ ID NO: 324936 - RNA, 32 nt, Human
agguggauggccacuggcagugauggggaugg

SEQ ID NO: 324937 - RNA, 32 nt, Human
agguggaugguucuacccuuucugccuucugu

SEQ ID NO: 324938 - RNA, 32 nt, Human
agguggaugucccuaggucuguuuucaaagaa

SEQ ID NO: 324939 - RNA, 32 nt, Human
agguggauguugcagugagcugagaccaugcc

SEQ ID NO: 324940 - RNA, 32 nt, Human
agguggauguugcagugagcugagauugugcc

SEQ ID NO: 324941 - RNA, 26 nt, Human
agguggauugagaagagagucccaga

SEQ ID NO: 324942 - RNA, 32 nt, Human
agguggauugagaagagagucccagaggagaa

SEQ ID NO: 324943 - RNA, 32 nt, Human
agguggcaaaauggguacagggggagucaggc

SEQ ID NO: 324944 - RNA, 32 nt, Human
agguggcaagaugguguuggaaagcacuaugg

SEQ ID NO: 324945 - RNA, 32 nt, Human
agguggcaaugugugucaggugacuaucagcc

SEQ ID NO: 324946 - RNA, 32 nt, Human
agguggcacacaggcgcugucucuccagagcc

SEQ ID NO: 324947 - RNA, 32 nt, Human
agguggcaccacugccgucauuucagcuucug

SEQ ID NO: 324948 - RNA, 32 nt, Human
agguggcaccacugccuucauuucagcuuccg

SEQ ID NO: 324949 - RNA, 32 nt, Human
agguggcacccugcgggaccuggaucugggcg

SEQ ID NO: 324950 - RNA, 32 nt, Human
agguggcagauguuugaggaaaggaauuaugc

SEQ ID NO: 324951 - RNA, 32 nt, Human
agguggcagccacagaagccuaggcagaccaa

SEQ ID NO: 324952 - RNA, 32 nt, Human
agguggcagccccugcccacucccaugcuggu

SEQ ID NO: 324953 - RNA, 32 nt, Human
agguggcagcugcgaaucuauucuuuaacaau

SEQ ID NO: 324954 - RNA, 32 nt, Human
agguggcaggcagagcaggaugcagaggcaca

SEQ ID NO: 324955 - RNA, 32 nt, Human
agguggcagggcccuauggagcaccaacugcc

SEQ ID NO: 324956 - RNA, 32 nt, Human
agguggcagggccuuggggagccccagcacaa

SEQ ID NO: 324957 - RNA, 32 nt, Human
agguggcaguagaggauuccuuuugcuuuaaa

SEQ ID NO: 324958 - RNA, 32 nt, Human
agguggcagugagccgagaucacaccauugca

SEQ ID NO: 324959 - RNA, 32 nt, Human
agguggcagugagccgagaucacgccacugua

SEQ ID NO: 324960 - RNA, 32 nt, Human
agguggcagugagccgagauugcgccauugca

SEQ ID NO: 324961 - RNA, 31 nt, Human
agguggcaguuucuuuuucagccucagaacu

SEQ ID NO: 324962 - RNA, 32 nt, Human
agguggcaucccugaguccugaugccugacug

SEQ ID NO: 324963 - RNA, 32 nt, Human
agguggcaucuaagggaagaauggguuuucuu

SEQ ID NO: 324964 - RNA, 32 nt, Human
agguggcauucaaagcgucauagguaaccagg

SEQ ID NO: 324965 - RNA, 32 nt, Human
agguggccaccaacacagaggcccugcagagc

SEQ ID NO: 324966 - RNA, 32 nt, Human
agguggccaccaacacagaggcccugcagagu

SEQ ID NO: 324967 - RNA, 32 nt, Human
agguggccaguauuuugcccacaacagguaca

SEQ ID NO: 324968 - RNA, 19 nt, Human
agguggcccacccucaggg

SEQ ID NO: 324969 - RNA, 32 nt, Human
agguggcccaggaaggugccuggcccagaaua

SEQ ID NO: 324970 - RNA, 32 nt, Human
agguggccccuggagucaugccuggagauucu

SEQ ID NO: 324971 - RNA, 32 nt, Human
agguggccccuggcucuggccuggugggcgga

SEQ ID NO: 324972 - RNA, 32 nt, Human
agguggccccuugugccagcaguggcuccucu

SEQ ID NO: 324973 - RNA, 23 nt, Human
agguggcccggaagaaccagaag

SEQ ID NO: 324974 - RNA, 32 nt, Human
agguggcccuggagacagaggacggagagggg

SEQ ID NO: 324975 - RNA, 32 nt, Human
agguggcccuggagaugggaaagugucugugu

SEQ ID NO: 324976 - RNA, 32 nt, Human
agguggccguaaccuuuggccuggggcagcug

SEQ ID NO: 324977 - RNA, 32 nt, Human
agguggccuccaggaggcagcugggaaaaggg

SEQ ID NO: 324978 - RNA, 32 nt, Human
agguggccuccucauagggcgucucgcugugg

SEQ ID NO: 324979 - RNA, 32 nt, Human
agguggccucuccuuguggccugggccuccuc

SEQ ID NO: 324980 - RNA, 32 nt, Human
agguggccuuguaaccuuucuguugccggcuc

SEQ ID NO: 324981 - RNA, 23 nt, Human
agguggcuauuccaccugguuca

SEQ ID NO: 324982 - RNA, 32 nt, Human
agguggcucacaccuauaaucccagcccuuug

SEQ ID NO: 324983 - RNA, 32 nt, Human
agguggcucacaccuauaauccuaggacuuug

SEQ ID NO: 324984 - RNA, 32 nt, Human
agguggcucccagggucuaauuggaggcaccu

SEQ ID NO: 324985 - RNA, 32 nt, Human
agguggcucucauuauuuuucaugauucuaaa

SEQ ID NO: 324986 - RNA, 31 nt, Human
agguggcucuggccucccaugucagguaggg

SEQ ID NO: 324987 - RNA, 18 nt, Human
agguggcugagccccagg

SEQ ID NO: 324988 - RNA, 32 nt, Human
agguggcugcgguagcagcagcgcggcagccu

SEQ ID NO: 324989 - RNA, 23 nt, Human
agguggcugcuuucucugggcug

SEQ ID NO: 324990 - RNA, 32 nt, Human
agguggcuggacugagugucccccaggcccag

SEQ ID NO: 324991 - RNA, 22 nt, Human
agguggcuggagcaggccucug

SEQ ID NO: 324992 - RNA, 32 nt, Human
agguggcuggcagaggcacaugcagacccuac

SEQ ID NO: 324993 - RNA, 32 nt, Human
agguggcuggcagaggcacaugcagacccugc

SEQ ID NO: 324994 - RNA, 32 nt, Human
agguggcugggcuggaaaggagggcagggcua

SEQ ID NO: 324995 - RNA, 32 nt, Human
agguggcuggggacccagagggaaggcagaag

SEQ ID NO: 324996 - RNA, 32 nt, Human
agguggcuguacugugagccuagggaaggcag

SEQ ID NO: 324997 - RNA, 20 nt, Human
agguggcugugcaugccuga

SEQ ID NO: 324998 - RNA, 32 nt, Human
agguggcuuguggggacugcaccagaaagugu

SEQ ID NO: 324999 - RNA, 32 nt, Human
agguggcuuugaccccggguugcccggccagc

SEQ ID NO: 325000 - RNA, 24 nt, Human
aggugggaaaaucacuugagccca

SEQ ID NO: 325001 - RNA, 24 nt, Human
aggugggaaaaugacuugagccca

SEQ ID NO: 325002 - RNA, 32 nt, Human
aggugggaaagccacggcaggcagcgagcagc

SEQ ID NO: 325003 - RNA, 32 nt, Human
aggugggaaaggagagcacuguucuuugauug

SEQ ID NO: 325004 - RNA, 32 nt, Human
aggugggaacagaagagagaaggaggcaggga

SEQ ID NO: 325005 - RNA, 32 nt, Human
aggugggaacauucucuguggccagugaggaa

SEQ ID NO: 325006 - RNA, 24 nt, Human
aggugggaagaucacuugagccca

SEQ ID NO: 325007 - RNA, 22 nt, Human
aggugggaagaucauuguucca

SEQ ID NO: 325008 - RNA, 24 nt, Human
aggugggaagaucauuugagccca

SEQ ID NO: 325009 - RNA, 24 nt, Human
aggugggaagaucccuugagccca

SEQ ID NO: 325010 - RNA, 24 nt, Human
aggugggaagaucucuugagccca

SEQ ID NO: 325011 - RNA, 24 nt, Human
aggugggaagauggcuugagccca

SEQ ID NO: 325012 - RNA, 24 nt, Human
aggugggaagauugccugagcuca

SEQ ID NO: 325013 - RNA, 24 nt, Human
aggugggaagauugcuugaacuca

SEQ ID NO: 325014 - RNA, 24 nt, Human
aggugggaagauugcuugagccca

SEQ ID NO: 325015 - RNA, 32 nt, Human
aggugggaaggcaguuaugacaguugagaagu

SEQ ID NO: 325016 - RNA, 32 nt, Human
aggugggaagggucggauggaggacucugcca

SEQ ID NO: 325017 - RNA, 32 nt, Human
aggugggaauugagggugagggguuuggggaa

SEQ ID NO: 325018 - RNA, 32 nt, Human
aggugggaccacaggcaugcgccagccaccau

SEQ ID NO: 325019 - RNA, 32 nt, Human
aggugggaccagagcuuccagcauagauucaa

SEQ ID NO: 325020 - RNA, 32 nt, Human
aggugggacccucgaggacaggccguagcccu

SEQ ID NO: 325021 - RNA, 32 nt, Human
aggugggacggggaguguugacccuggguggc

SEQ ID NO: 325022 - RNA, 32 nt, Human
aggugggacuacagaugugugccaccaagccu

SEQ ID NO: 325023 - RNA, 32 nt, Human
aggugggacuacaggcaccugccaccacccug

SEQ ID NO: 325024 - RNA, 32 nt, Human
aggugggacuacaggcgcacaccaccaugccc

SEQ ID NO: 325025 - RNA, 32 nt, Human
aggugggacuacaggugcccgccaccacaccc

SEQ ID NO: 325026 - RNA, 32 nt, Human
aggugggacuacaggugcccgccaccacgccc

SEQ ID NO: 325027 - RNA, 32 nt, Human
aggugggacuauagguucgcaccaccacuccc

SEQ ID NO: 325028 - RNA, 32 nt, Human
aggugggacuccaggcaugcaccaccaugccu

SEQ ID NO: 325029 - RNA, 32 nt, Human
aggugggacuggcucucccuccccagccacga

SEQ ID NO: 325030 - RNA, 24 nt, Human
aggugggagaaucacaaggucagg

SEQ ID NO: 325031 - RNA, 23 nt, Human
aggugggagaaucacuugaaccc

SEQ ID NO: 325032 - RNA, 24 nt, Human
aggugggagaaucacuugaauccc

SEQ ID NO: 325033 - RNA, 24 nt, Human
aggugggagaaucacuugagccca

SEQ ID NO: 325034 - RNA, 23 nt, Human
aggugggagaaucacuuggacuc

SEQ ID NO: 325035 - RNA, 24 nt, Human
aggugggagaaucgcuuaacccca

SEQ ID NO: 325036 - RNA, 23 nt, Human
aggugggagaaucgcuugaaccc

SEQ ID NO: 325037 - RNA, 24 nt, Human
aggugggagaaucgcuugaaccca

SEQ ID NO: 325038 - RNA, 24 nt, Human
aggugggagaaucgcuugagccca

SEQ ID NO: 325039 - RNA, 23 nt, Human
aggugggagaaucgcuugagucc

SEQ ID NO: 325040 - RNA, 32 nt, Human
aggugggagaauggguguaggaggcaggcccc

SEQ ID NO: 325041 - RNA, 24 nt, Human
aggugggagaauuaccugagccca

SEQ ID NO: 325042 - RNA, 24 nt, Human
aggugggagaauugccugagccca

SEQ ID NO: 325043 - RNA, 24 nt, Human
aggugggagaauugcucaagccca

SEQ ID NO: 325044 - RNA, 20 nt, Human
aggugggagaauugcuugaa

SEQ ID NO: 325045 - RNA, 23 nt, Human
aggugggagaauugcuugaaccc

SEQ ID NO: 325046 - RNA, 24 nt, Human
aggugggagaauugcuugaaccca

SEQ ID NO: 325047 - RNA, 23 nt, Human
aggugggagaauugcuugaaccu

SEQ ID NO: 325048 - RNA, 23 nt, Human
aggugggagaauugcuugaagcc

SEQ ID NO: 325049 - RNA, 24 nt, Human
aggugggagaauugcuugagccca

SEQ ID NO: 325050 - RNA, 23 nt, Human
aggugggagaauugcuugagcuu

SEQ ID NO: 325051 - RNA, 31 nt, Human
aggugggagagagucaggcaggagccgaggc

SEQ ID NO: 325052 - RNA, 23 nt, Human
aggugggagagaugcugagccca

SEQ ID NO: 325053 - RNA, 21 nt, Human
aggugggagagcaggccccug

SEQ ID NO: 325054 - RNA, 32 nt, Human
aggugggagagggccugggggcugggaggcag

SEQ ID NO: 325055 - RNA, 32 nt, Human
aggugggagaggguagcagcaugggcuacgcg

SEQ ID NO: 325056 - RNA, 32 nt, Human
aggugggagauaagggaaguggggugagagga

SEQ ID NO: 325057 - RNA, 23 nt, Human
aggugggagaucgcuuaaaccca

SEQ ID NO: 325058 - RNA, 32 nt, Human
aggugggagccaccgcacccagccugcagguc

SEQ ID NO: 325059 - RNA, 32 nt, Human
aggugggagccacugcacccggccugaaugau

SEQ ID NO: 325060 - RNA, 23 nt, Human
aggugggagcugccuuugcccca

SEQ ID NO: 325061 - RNA, 32 nt, Human
aggugggagcugcugggugaggcagggaaccc

SEQ ID NO: 325062 - RNA, 32 nt, Human
aggugggaggaagagagaccucagggaaaaua

SEQ ID NO: 325063 - RNA, 24 nt, Human
aggugggaggacgacuugagccca

SEQ ID NO: 325064 - RNA, 21 nt, Human
aggugggaggacuaacuucca

SEQ ID NO: 325065 - RNA, 24 nt, Human
aggugggaggacugcuuaagcuca

SEQ ID NO: 325066 - RNA, 32 nt, Human
aggugggaggacugcuugaggccaggaguucg

SEQ ID NO: 325067 - RNA, 23 nt, Human
aggugggaggagaccugauccca

SEQ ID NO: 325068 - RNA, 24 nt, Human
aggugggaggaguacuugagccca

SEQ ID NO: 325069 - RNA, 32 nt, Human
aggugggaggagugcuugaggccaggaguuca

SEQ ID NO: 325070 - RNA, 24 nt, Human
aggugggaggauaguuugacccca

SEQ ID NO: 325071 - RNA, 24 nt, Human
aggugggaggaucaccugagcuca

SEQ ID NO: 325072 - RNA, 23 nt, Human
aggugggaggaucacucgagucc

SEQ ID NO: 325073 - RNA, 23 nt, Human
aggugggaggaucacugagacca

SEQ ID NO: 325074 - RNA, 23 nt, Human
aggugggaggaucacuggaaccc

SEQ ID NO: 325075 - RNA, 23 nt, Human
aggugggaggaucacuuaagccc

SEQ ID NO: 325076 - RNA, 24 nt, Human
aggugggaggaucacuucagccca

SEQ ID NO: 325077 - RNA, 23 nt, Human
aggugggaggaucacuugaaccc

SEQ ID NO: 325078 - RNA, 24 nt, Human
aggugggaggaucacuugaaccca

SEQ ID NO: 325079 - RNA, 24 nt, Human
aggugggaggaucacuugaaccua

SEQ ID NO: 325080 - RNA, 24 nt, Human
aggugggaggaucacuugaacuca

SEQ ID NO: 325081 - RNA, 23 nt, Human
aggugggaggaucacuugagccc

SEQ ID NO: 325082 - RNA, 24 nt, Human
aggugggaggaucacuugagccca

SEQ ID NO: 325083 - RNA, 23 nt, Human
aggugggaggaucacuugagccu

SEQ ID NO: 325084 - RNA, 23 nt, Human
aggugggaggaucacuugauccu

SEQ ID NO: 325085 - RNA, 23 nt, Human
aggugggaggaucacuuggacuu

SEQ ID NO: 325086 - RNA, 24 nt, Human
aggugggaggaucacuugggucca

SEQ ID NO: 325087 - RNA, 23 nt, Human
aggugggaggaucacuuguggcc

SEQ ID NO: 325088 - RNA, 23 nt, Human
aggugggaggaucaguugagccc

SEQ ID NO: 325089 - RNA, 22 nt, Human
aggugggaggaucaugagguca

SEQ ID NO: 325090 - RNA, 24 nt, Human
aggugggaggaucauuggaucuca

SEQ ID NO: 325091 - RNA, 24 nt, Human
aggugggaggaucauuugaaccca

SEQ ID NO: 325092 - RNA, 24 nt, Human
aggugggaggaucauuugagccca

SEQ ID NO: 325093 - RNA, 24 nt, Human
aggugggaggaucccuugagccca

SEQ ID NO: 325094 - RNA, 24 nt, Human
aggugggaggaucccuugauccca

SEQ ID NO: 325095 - RNA, 23 nt, Human
aggugggaggaucgccugaaccu

SEQ ID NO: 325096 - RNA, 24 nt, Human
aggugggaggaucgccugagccca

SEQ ID NO: 325097 - RNA, 23 nt, Human
aggugggaggaucgccugagccu

SEQ ID NO: 325098 - RNA, 23 nt, Human
aggugggaggaucgcuggagccu

SEQ ID NO: 325099 - RNA, 24 nt, Human
aggugggaggaucgcuuaagccca

SEQ ID NO: 325100 - RNA, 24 nt, Human
aggugggaggaucgcuugaaccca

SEQ ID NO: 325101 - RNA, 24 nt, Human
aggugggaggaucgcuugagacca

SEQ ID NO: 325102 - RNA, 23 nt, Human
aggugggaggaucgcuugagccc

SEQ ID NO: 325103 - RNA, 24 nt, Human
aggugggaggaucgcuugagccca

SEQ ID NO: 325104 - RNA, 23 nt, Human
aggugggaggaucgcuugagccu

SEQ ID NO: 325105 - RNA, 23 nt, Human
aggugggaggaucgcuugugccu

SEQ ID NO: 325106 - RNA, 24 nt, Human
aggugggaggaucgguugagccca

SEQ ID NO: 325107 - RNA, 24 nt, Human
aggugggaggaucucuugagccca

SEQ ID NO: 325108 - RNA, 24 nt, Human
aggugggaggaucuuuugaaccca

SEQ ID NO: 325109 - RNA, 24 nt, Human
aggugggaggauggcuugagccca

SEQ ID NO: 325110 - RNA, 24 nt, Human
aggugggaggauuacuggauccca

SEQ ID NO: 325111 - RNA, 24 nt, Human
aggugggaggauuacuugagacca

SEQ ID NO: 325112 - RNA, 23 nt, Human
aggugggaggauugcccgagucc

SEQ ID NO: 325113 - RNA, 24 nt, Human
aggugggaggauugccugagccca

SEQ ID NO: 325114 - RNA, 23 nt, Human
aggugggaggauugcuuaagccc

SEQ ID NO: 325115 - RNA, 23 nt, Human
aggugggaggauugcuugaaccc

SEQ ID NO: 325116 - RNA, 24 nt, Human
aggugggaggauugcuugaaccca

SEQ ID NO: 325117 - RNA, 22 nt, Human
aggugggaggauugcuugaccc

SEQ ID NO: 325118 - RNA, 24 nt, Human
aggugggaggauugcuugagacca

SEQ ID NO: 325119 - RNA, 22 nt, Human
aggugggaggauugcuugagcc

SEQ ID NO: 325120 - RNA, 23 nt, Human
aggugggaggauugcuugagccc

SEQ ID NO: 325121 - RNA, 24 nt, Human
aggugggaggauugcuugagccca

SEQ ID NO: 325122 - RNA, 23 nt, Human
aggugggaggauugcuugagccu

SEQ ID NO: 325123 - RNA, 24 nt, Human
aggugggaggauugcuugagccua

SEQ ID NO: 325124 - RNA, 24 nt, Human
aggugggaggauugcuugagcuca

SEQ ID NO: 325125 - RNA, 23 nt, Human
aggugggaggauugcuugaggcc

SEQ ID NO: 325126 - RNA, 23 nt, Human
aggugggaggauugcuugagucc

SEQ ID NO: 325127 - RNA, 23 nt, Human
aggugggaggauugcuugggccu

SEQ ID NO: 325128 - RNA, 24 nt, Human
aggugggaggauugcuugguccca

SEQ ID NO: 325129 - RNA, 23 nt, Human
aggugggaggauugcuugugccu

SEQ ID NO: 325130 - RNA, 23 nt, Human
aggugggaggauugcuuguuccc

SEQ ID NO: 325131 - RNA, 24 nt, Human
aggugggaggauugcuuuagccca

SEQ ID NO: 325132 - RNA, 24 nt, Human
aggugggaggauuguuugagccca

SEQ ID NO: 325133 - RNA, 32 nt, Human
aggugggaggggaagggagaaauccaaaacaa

SEQ ID NO: 325134 - RNA, 32 nt, Human
aggugggaggggcaggaagcagccggagugag

SEQ ID NO: 325135 - RNA, 32 nt, Human
aggugggaggggccauggagacugcaggacag

SEQ ID NO: 325136 - RNA, 32 nt, Human
aggugggaggggccucagcaggcucccagcuc

SEQ ID NO: 325137 - RNA, 24 nt, Human
aggugggagggucgcuugagccca

SEQ ID NO: 325138 - RNA, 24 nt, Human
aggugggaggguugcuugagccca

SEQ ID NO: 325139 - RNA, 32 nt, Human
aggugggaggucagaggagauggaggcuggcu

SEQ ID NO: 325140 - RNA, 32 nt, Human
aggugggaggucagaggagaugggggcuggcu

SEQ ID NO: 325141 - RNA, 32 nt, Human
aggugggaggugggagaggaagguggaguacu

SEQ ID NO: 325142 - RNA, 24 nt, Human
aggugggagguuugcuuaagccca

SEQ ID NO: 325143 - RNA, 32 nt, Human
aggugggaguagcugaggaagacaaguggcug

SEQ ID NO: 325144 - RNA, 24 nt, Human
aggugggaguaucgcuugagccca

SEQ ID NO: 325145 - RNA, 21 nt, Human
aggugggagugagccgaccca

SEQ ID NO: 325146 - RNA, 32 nt, Human
aggugggauaagggucaggcccaggugacccc

SEQ ID NO: 325147 - RNA, 32 nt, Human
aggugggaugagcccaacacagcaacaacagc

SEQ ID NO: 325148 - RNA, 32 nt, Human
aggugggaugcagagguaacagaguuuaaaug

SEQ ID NO: 325149 - RNA, 32 nt, Human
aggugggauuacaagcaugcaccaccaugccc

SEQ ID NO: 325150 - RNA, 32 nt, Human
aggugggauuacaggcaugcaccaccaugccc

SEQ ID NO: 325151 - RNA, 32 nt, Human
aggugggauuacaggcaugcgccaccacgccu

SEQ ID NO: 325152 - RNA, 32 nt, Human
aggugggauuacaggugcauaccaccacaccu

SEQ ID NO: 325153 - RNA, 32 nt, Human
aggugggauuacaggugcccaccaccaagccc

SEQ ID NO: 325154 - RNA, 24 nt, Human
aggugggcaaaucacaaggucagg

SEQ ID NO: 325155 - RNA, 24 nt, Human
aggugggcaaaucaugaggucagg

SEQ ID NO: 325156 - RNA, 24 nt, Human
aggugggcaaauuacgaggucagg

SEQ ID NO: 325157 - RNA, 32 nt, Human
aggugggcaagacugacugggcccggcuucgg

SEQ ID NO: 325158 - RNA, 25 nt, Human
aggugggcaaucauuugaggucagg

SEQ ID NO: 325159 - RNA, 32 nt, Human
aggugggcacuucaaugccaaguauauacucu

SEQ ID NO: 325160 - RNA, 32 nt, Human
aggugggcagagugggggcagugccuugcucc

SEQ ID NO: 325161 - RNA, 24 nt, Human
aggugggcagaucacaaggucagg

SEQ ID NO: 325162 - RNA, 24 nt, Human
aggugggcagaucacaagguuagg

SEQ ID NO: 325163 - RNA, 26 nt, Human
aggugggcagaucaccggaggucagg

SEQ ID NO: 325164 - RNA, 26 nt, Human
aggugggcagaucaccuaaggucagg

SEQ ID NO: 325165 - RNA, 25 nt, Human
aggugggcagaucaccugaggucag

SEQ ID NO: 325166 - RNA, 26 nt, Human
aggugggcagaucaccugaggucagg

SEQ ID NO: 325167 - RNA, 26 nt, Human
aggugggcagaucaccugagguuagg

SEQ ID NO: 325168 - RNA, 32 nt, Human
aggugggcagaucaccugagguugggaguucg

SEQ ID NO: 325169 - RNA, 23 nt, Human
aggugggcagaucacgaagucag

SEQ ID NO: 325170 - RNA, 24 nt, Human
aggugggcagaucacgaagucagg

SEQ ID NO: 325171 - RNA, 24 nt, Human
aggugggcagaucacgagcucagg

SEQ ID NO: 325172 - RNA, 22 nt, Human
aggugggcagaucacgagguca

SEQ ID NO: 325173 - RNA, 24 nt, Human
aggugggcagaucacgaggucagg

SEQ ID NO: 325174 - RNA, 24 nt, Human
aggugggcagaucacgaggugagg

SEQ ID NO: 325175 - RNA, 26 nt, Human
aggugggcagaucacucaaggucagg

SEQ ID NO: 325176 - RNA, 26 nt, Human
aggugggcagaucacuggaggucagg

SEQ ID NO: 325177 - RNA, 26 nt, Human
aggugggcagaucacuugaggucagg

SEQ ID NO: 325178 - RNA, 26 nt, Human
aggugggcagaucacuugaggucggg

SEQ ID NO: 325179 - RNA, 25 nt, Human
aggugggcagaucacuugagguuag

SEQ ID NO: 325180 - RNA, 26 nt, Human
aggugggcagaucagcugaggucagg

SEQ ID NO: 325181 - RNA, 24 nt, Human
aggugggcagaucaggaggucagg

SEQ ID NO: 325182 - RNA, 26 nt, Human
aggugggcagaucaguugaggucagg

SEQ ID NO: 325183 - RNA, 24 nt, Human
aggugggcagaucauaaggucagg

SEQ ID NO: 325184 - RNA, 23 nt, Human
aggugggcagaucaugaggucag

SEQ ID NO: 325185 - RNA, 24 nt, Human
aggugggcagaucaugaggucagg

SEQ ID NO: 325186 - RNA, 21 nt, Human
aggugggcagaucauggguca

SEQ ID NO: 325187 - RNA, 26 nt, Human
aggugggcagaucgccugaggucagg

SEQ ID NO: 325188 - RNA, 32 nt, Human
aggugggcagaucgcuugagugcaagaguuca

SEQ ID NO: 325189 - RNA, 24 nt, Human
aggugggcagaucucaaggucagg

SEQ ID NO: 325190 - RNA, 26 nt, Human
aggugggcagaucucuugaggucagg

SEQ ID NO: 325191 - RNA, 26 nt, Human
aggugggcagaucuuuuaaggucagg

SEQ ID NO: 325192 - RNA, 26 nt, Human
aggugggcagaugacuugaggucagg

SEQ ID NO: 325193 - RNA, 32 nt, Human
aggugggcagccaggguagccagugaggucag

SEQ ID NO: 325194 - RNA, 32 nt, Human
aggugggcaggcagggacuguggcagcuuaug

SEQ ID NO: 325195 - RNA, 32 nt, Human
aggugggcaucgggggcauggggccuggccuc

SEQ ID NO: 325196 - RNA, 32 nt, Human
aggugggccaggacgcagccucugggcgccgu

SEQ ID NO: 325197 - RNA, 32 nt, Human
aggugggcccucagcugagggaagguacgagc

SEQ ID NO: 325198 - RNA, 32 nt, Human
aggugggcccuggcauccccagccuccucuaa

SEQ ID NO: 325199 - RNA, 24 nt, Human
aggugggccgaucacgaggucagg

SEQ ID NO: 325200 - RNA, 24 nt, Human
aggugggcgaaucacaaggucagg

SEQ ID NO: 325201 - RNA, 26 nt, Human
aggugggcgaaucaccugaggucagg

SEQ ID NO: 325202 - RNA, 24 nt, Human
aggugggcgaaucaugagaucagg

SEQ ID NO: 325203 - RNA, 26 nt, Human
aggugggcggauaaccugaggucagg

SEQ ID NO: 325204 - RNA, 21 nt, Human
aggugggcggaucacaagguc

SEQ ID NO: 325205 - RNA, 24 nt, Human
aggugggcggaucacaaggucagg

SEQ ID NO: 325206 - RNA, 27 nt, Human
aggugggcggaucacccugagguuagg

SEQ ID NO: 325207 - RNA, 25 nt, Human
aggugggcggaucaccugaggucag

SEQ ID NO: 325208 - RNA, 26 nt, Human
aggugggcggaucaccugaggucagg

SEQ ID NO: 325209 - RNA, 26 nt, Human
aggugggcggaucaccugaggucggg

SEQ ID NO: 325210 - RNA, 24 nt, Human
aggugggcggaucacgaagucagg

SEQ ID NO: 325211 - RNA, 24 nt, Human
aggugggcggaucacgaggucagg

SEQ ID NO: 325212 - RNA, 24 nt, Human
aggugggcggaucacgaggucugg

SEQ ID NO: 325213 - RNA, 24 nt, Human
aggugggcggaucacggggucagg

SEQ ID NO: 325214 - RNA, 26 nt, Human
aggugggcggaucacgugaggucagg

SEQ ID NO: 325215 - RNA, 26 nt, Human
aggugggcggaucacuugaggucagg

SEQ ID NO: 325216 - RNA, 26 nt, Human
aggugggcggaucacuugaggucggg

SEQ ID NO: 325217 - RNA, 24 nt, Human
aggugggcggaucaugaggucagg

SEQ ID NO: 325218 - RNA, 24 nt, Human
aggugggcggaucaugagguuagg

SEQ ID NO: 325219 - RNA, 26 nt, Human
aggugggcggaucgccugaggucagg

SEQ ID NO: 325220 - RNA, 26 nt, Human
aggugggcggauugcuugaggucggg

SEQ ID NO: 325221 - RNA, 32 nt, Human
aggugggcuaagugccucccuagaggacucca

SEQ ID NO: 325222 - RNA, 16 nt, Human
aggugggcugaugcca

SEQ ID NO: 325223 - RNA, 32 nt, Human
aggugggcuggccaggugagagcugcuggcag

SEQ ID NO: 325224 - RNA, 32 nt, Human
agguggggaaaauguuguggcuucugagcuuu

SEQ ID NO: 325225 - RNA, 32 nt, Human
agguggggaagauucgggcaugugagugcccc

SEQ ID NO: 325226 - RNA, 32 nt, Human
agguggggaagcugaggcaggaagcccuuuag

SEQ ID NO: 325227 - RNA, 32 nt, Human
agguggggagagaagccaggaccccucagcug

SEQ ID NO: 325228 - RNA, 32 nt, Human
agguggggaggcacugcuggccuagaccagcu

SEQ ID NO: 325229 - RNA, 32 nt, Human
agguggggaggcugcgggaggaagagaugacc

SEQ ID NO: 325230 - RNA, 32 nt, Human
agguggggagggcagcacacagcagcucaugg

SEQ ID NO: 325231 - RNA, 32 nt, Human
agguggggcagaagagaggacugugugccuuu

SEQ ID NO: 325232 - RNA, 32 nt, Human
agguggggcaggcggagguugcaguaagccaa

SEQ ID NO: 325233 - RNA, 19 nt, Human
agguggggcaucugggcca

SEQ ID NO: 325234 - RNA, 20 nt, Human
agguggggccacgcugcagg

SEQ ID NO: 325235 - RNA, 32 nt, Human
agguggggccggacuccagggaaggagaauuu

SEQ ID NO: 325236 - RNA, 32 nt, Human
agguggggcgaggcugggggagggcggcgccg

SEQ ID NO: 325237 - RNA, 32 nt, Human
aggugggggaacacugagaaagaggcagggac

SEQ ID NO: 325238 - RNA, 20 nt, Human
aggugggggaagagcuggaa

SEQ ID NO: 325239 - RNA, 32 nt, Human
aggugggggcagcagaggccugggcugggugc

SEQ ID NO: 325240 - RNA, 32 nt, Human
aggugggggcggggaguauugaaugguggugg

SEQ ID NO: 325241 - RNA, 21 nt, Human
agguggggggaucacaagguc

SEQ ID NO: 325242 - RNA, 24 nt, Human
agguggggggaucacgaggucagg

SEQ ID NO: 325243 - RNA, 32 nt, Human
agguggggucacugccccuccuggguuagcau

SEQ ID NO: 325244 - RNA, 32 nt, Human
agguggggugcugaagcuugaagagcauuucu

SEQ ID NO: 325245 - RNA, 32 nt, Human
aggugggguggagucccagagcugcacagggu

SEQ ID NO: 325246 - RNA, 32 nt, Human
agguggggugggaagagaggaggccaggccag

SEQ ID NO: 325247 - RNA, 32 nt, Human
agguggggugggaccaggcugccccucgcccc

SEQ ID NO: 325248 - RNA, 32 nt, Human
aggugggguuaguauuaaccccagagcacuga

SEQ ID NO: 325249 - RNA, 21 nt, Human
aggugggguuucaccauauug

SEQ ID NO: 325250 - RNA, 21 nt, Human
aggugggguuucaccaugcug

SEQ ID NO: 325251 - RNA, 23 nt, Human
agguggguaaacugaggcucagg

SEQ ID NO: 325252 - RNA, 32 nt, Human
agguggguaaacugaggcucaggaaguuucca

SEQ ID NO: 325253 - RNA, 26 nt, Human
agguggguaaaucacuugaggucagg

SEQ ID NO: 325254 - RNA, 24 nt, Human
agguggguagauaccugaagucag

SEQ ID NO: 325255 - RNA, 25 nt, Human
agguggguagaucaccugaggucag

SEQ ID NO: 325256 - RNA, 26 nt, Human
agguggguagaucaccugaggucggg

SEQ ID NO: 325257 - RNA, 22 nt, Human
agguggguagaucacgagauca

SEQ ID NO: 325258 - RNA, 26 nt, Human
agguggguagaucacuugaggucagg

SEQ ID NO: 325259 - RNA, 26 nt, Human
agguggguagaucaucugaggucagg

SEQ ID NO: 325260 - RNA, 20 nt, Human
agguggguagaucauuucag

SEQ ID NO: 325261 - RNA, 26 nt, Human
agguggguagaucauuugaggucagg

SEQ ID NO: 325262 - RNA, 22 nt, Human
agguggguagcccagguucagg

SEQ ID NO: 325263 - RNA, 24 nt, Human
agguggguaggguuacagauccag

SEQ ID NO: 325264 - RNA, 32 nt, Human
agguggguauugugugugugggaaggugggga

SEQ ID NO: 325265 - RNA, 25 nt, Human
aggugggucgaucacugaggucagg

SEQ ID NO: 325266 - RNA, 26 nt, Human
aggugggugaaucacaugaggucagg

SEQ ID NO: 325267 - RNA, 26 nt, Human
aggugggugaauugcuugaggucagg

SEQ ID NO: 325268 - RNA, 32 nt, Human
aggugggugaggaucugagaaaugcuaaaggc

SEQ ID NO: 325269 - RNA, 24 nt, Human
aggugggugcucugcaaaguuagg

SEQ ID NO: 325270 - RNA, 20 nt, Human
agguggguggaagggccagg

SEQ ID NO: 325271 - RNA, 26 nt, Human
agguggguggaccacaugaggucagg

SEQ ID NO: 325272 - RNA, 26 nt, Human
agguggguggaccaccugagguuagg

SEQ ID NO: 325273 - RNA, 24 nt, Human
agguggguggaccaguacuccagg

SEQ ID NO: 325274 - RNA, 22 nt, Human
agguggguggagagagggcagg

SEQ ID NO: 325275 - RNA, 19 nt, Human
agguggguggagaggugag

SEQ ID NO: 325276 - RNA, 22 nt, Human
agguggguggaucacaagguca

SEQ ID NO: 325277 - RNA, 24 nt, Human
agguggguggaucacaaggucagg

SEQ ID NO: 325278 - RNA, 24 nt, Human
agguggguggaucacaaggucggg

SEQ ID NO: 325279 - RNA, 24 nt, Human
agguggguggaucacaagguuggg

SEQ ID NO: 325280 - RNA, 23 nt, Human
agguggguggaucacaggucagg

SEQ ID NO: 325281 - RNA, 24 nt, Human
agguggguggaucaccaggucagg

SEQ ID NO: 325282 - RNA, 21 nt, Human
agguggguggaucaccugaga

SEQ ID NO: 325283 - RNA, 21 nt, Human
agguggguggaucaccugagg

SEQ ID NO: 325284 - RNA, 24 nt, Human
agguggguggaucaccugagguca

SEQ ID NO: 325285 - RNA, 25 nt, Human
agguggguggaucaccugaggucag

SEQ ID NO: 325286 - RNA, 26 nt, Human
agguggguggaucaccugaggucagg

SEQ ID NO: 325287 - RNA, 26 nt, Human
agguggguggaucaccugaggucggg

SEQ ID NO: 325288 - RNA, 22 nt, Human
agguggguggaucacgaaguca

SEQ ID NO: 325289 - RNA, 21 nt, Human
agguggguggaucacgagguc

SEQ ID NO: 325290 - RNA, 22 nt, Human
agguggguggaucacgagguca

SEQ ID NO: 325291 - RNA, 24 nt, Human
agguggguggaucacgaggucagg

SEQ ID NO: 325292 - RNA, 24 nt, Human
agguggguggaucacugggucagg

SEQ ID NO: 325293 - RNA, 21 nt, Human
agguggguggaucacuugagg

SEQ ID NO: 325294 - RNA, 26 nt, Human
agguggguggaucacuugaggucagg

SEQ ID NO: 325295 - RNA, 26 nt, Human
agguggguggaucacuugaggucggg

SEQ ID NO: 325296 - RNA, 26 nt, Human
agguggguggaucacuuggggucagg

SEQ ID NO: 325297 - RNA, 26 nt, Human
agguggguggaucagcugaggucagg

SEQ ID NO: 325298 - RNA, 26 nt, Human
agguggguggaucaguugaggucagg

SEQ ID NO: 325299 - RNA, 26 nt, Human
agguggguggaucaucugaggucagg

SEQ ID NO: 325300 - RNA, 24 nt, Human
agguggguggaucaugaagucagg

SEQ ID NO: 325301 - RNA, 24 nt, Human
agguggguggaucaugaggucagg

SEQ ID NO: 325302 - RNA, 24 nt, Human
agguggguggaucaugcggucagg

SEQ ID NO: 325303 - RNA, 26 nt, Human
agguggguggaucauuugaggucagg

SEQ ID NO: 325304 - RNA, 26 nt, Human
agguggguggaucgccugaggucggg

SEQ ID NO: 325305 - RNA, 26 nt, Human
agguggguggauuacuugaggucagg

SEQ ID NO: 325306 - RNA, 24 nt, Human
agguggguggauugcuugagccca

SEQ ID NO: 325307 - RNA, 21 nt, Human
agguggguggcccaggccagg

SEQ ID NO: 325308 - RNA, 22 nt, Human
aggugggugggacuaugccagg

SEQ ID NO: 325309 - RNA, 26 nt, Human
aggugggugggucaucugaggucagg

SEQ ID NO: 325310 - RNA, 32 nt, Human
aggugggugucgaacuccugaccucaagugau

SEQ ID NO: 325311 - RNA, 32 nt, Human
agguggguuccccaggcuuagagcaaaacacc

SEQ ID NO: 325312 - RNA, 32 nt, Human
agguggguuccccaggcuuagagcaaaacccc

SEQ ID NO: 325313 - RNA, 32 nt, Human
agguggguuuuuaggucccuuccagugccaca

SEQ ID NO: 325314 - RNA, 32 nt, Human
aggugguaaaagugccuggcagcuuggcugcc

SEQ ID NO: 325315 - RNA, 32 nt, Human
aggugguaaauggcagaaaggacauucccccu

SEQ ID NO: 325316 - RNA, 32 nt, Human
aggugguaagucaugagagcuccacccucaug

SEQ ID NO: 325317 - RNA, 32 nt, Human
aggugguaaugaaacaccucagcugggcucuu

SEQ ID NO: 325318 - RNA, 32 nt, Human
aggugguagugagccgagauggagccacugca

SEQ ID NO: 325319 - RNA, 32 nt, Human
aggugguaucaggagcccaggucuccagcugg

SEQ ID NO: 325320 - RNA, 32 nt, Human
aggugguaucuguucuuucguagcacaguguu

SEQ ID NO: 325321 - RNA, 23 nt, Human
aggugguauugacagaggucagg

SEQ ID NO: 325322 - RNA, 32 nt, Human
aggugguauuugcauucagugccuuacuggua

SEQ ID NO: 325323 - RNA, 22 nt, Human
agguggucaacaacauuccuca

SEQ ID NO: 325324 - RNA, 21 nt, Human
agguggucaagagacacugga

SEQ ID NO: 325325 - RNA, 32 nt, Human
agguggucacccaacccgagaugucaggaaag

SEQ ID NO: 325326 - RNA, 32 nt, Human
agguggucauaguccucccgugcugugucagc

SEQ ID NO: 325327 - RNA, 32 nt, Human
agguggucauugccuuucuccauugucuagua

SEQ ID NO: 325328 - RNA, 29 nt, Human
agguggucauugcuaucauuuucuuuugg

SEQ ID NO: 325329 - RNA, 32 nt, Human
aggugguccucgcugugacacugaggugcuga

SEQ ID NO: 325330 - RNA, 24 nt, Human
agguggucggaucacgagguuagg

SEQ ID NO: 325331 - RNA, 23 nt, Human
agguggucggauccucugggcug

SEQ ID NO: 325332 - RNA, 32 nt, Human
agguggucggggaugggagaaagggaaaaguc

SEQ ID NO: 325333 - RNA, 32 nt, Human
agguggucucagauugagaugaggaauuuguu

SEQ ID NO: 325334 - RNA, 32 nt, Human
agguggucuugaacuccugaugucaggugauu

SEQ ID NO: 325335 - RNA, 32 nt, Human
agguggucuuuuccuuauuugacauuuuagag

SEQ ID NO: 325336 - RNA, 32 nt, Human
agguggugagcauguggagaagguuccauagu

SEQ ID NO: 325337 - RNA, 32 nt, Human
agguggugaucaggacaaaaguguuagguucc

SEQ ID NO: 325338 - RNA, 32 nt, Human
agguggugcaccugccaggcagcgcccacaga

SEQ ID NO: 325339 - RNA, 32 nt, Human
agguggugccacugcacuccaaccugggggac

SEQ ID NO: 325340 - RNA, 32 nt, Human
agguggugcugguggguucacuuuccaaggcc

SEQ ID NO: 325341 - RNA, 32 nt, Human
aggugguggagacagagacaggcccugaacga

SEQ ID NO: 325342 - RNA, 20 nt, Human
aggugguggagcggcugcug

SEQ ID NO: 325343 - RNA, 32 nt, Human
aggugguggaggaggaggaggaggaggaaggc

SEQ ID NO: 325344 - RNA, 32 nt, Human
aggugguggaggcggcggaggcggcggcggag

SEQ ID NO: 325345 - RNA, 32 nt, Human
aggugguggaggugggguuggagcaggaaggg

SEQ ID NO: 325346 - RNA, 32 nt, Human
aggugguggcagcagagguauuauggaggagg

SEQ ID NO: 325347 - RNA, 32 nt, Human
aggugguggccugggccgcuccaccucaccgg

SEQ ID NO: 325348 - RNA, 32 nt, Human
aggugguggggagacagauggagaagcuggca

SEQ ID NO: 325349 - RNA, 32 nt, Human
agguggugucaggagcccaggucuccagcugg

SEQ ID NO: 325350 - RNA, 32 nt, Human
aggugguguguguggacucacacucacauucu

SEQ ID NO: 325351 - RNA, 32 nt, Human
aggugguguuacugucccuccuggugucaccc

SEQ ID NO: 325352 - RNA, 32 nt, Human
aggugguguuucuaaauaauuggcugcuaugg

SEQ ID NO: 325353 - RNA, 32 nt, Human
aggugguuaugcugugacgcugcugucucuaa

SEQ ID NO: 325354 - RNA, 32 nt, Human
aggugguuauuauaacauacuagcaauggacc

SEQ ID NO: 325355 - RNA, 32 nt, Human
aggugguuccaagggugucugcuuuuggccag

SEQ ID NO: 325356 - RNA, 32 nt, Human
aggugguugaaggauguaguagaaggauggau

SEQ ID NO: 325357 - RNA, 32 nt, Human
aggugguugcccccucccucuccugagauguc

SEQ ID NO: 325358 - RNA, 32 nt, Human
aggugguugguuuucuccagagaagaacccuu

SEQ ID NO: 325359 - RNA, 32 nt, Human
aggugguuguagucugugccugaagucugugu

SEQ ID NO: 325360 - RNA, 32 nt, Human
aggugguuguccaagcccaggucccggcccug

SEQ ID NO: 325361 - RNA, 22 nt, Human
aggugguuugugaaacucacag

SEQ ID NO: 325362 - RNA, 32 nt, Human
agguguaaacuuuccagaacaggcccagaauu

SEQ ID NO: 325363 - RNA, 32 nt, Human
agguguaacucuuacaccacagccuccaucug

SEQ ID NO: 325364 - RNA, 32 nt, Human
agguguaagaucauuaagaaguagaaggcacu

SEQ ID NO: 325365 - RNA, 32 nt, Human
agguguaagcaugggggcguggggaagagggc

SEQ ID NO: 325366 - RNA, 32 nt, Human
agguguaaggauucuuucucucugguuuuggc

SEQ ID NO: 325367 - RNA, 32 nt, Human
agguguaagggcagacaaacaggugaggguga

SEQ ID NO: 325368 - RNA, 32 nt, Human
agguguaagguacauggaugugcuuuggucaa

SEQ ID NO: 325369 - RNA, 24 nt, Human
agguguacaggauggaacacgaag

SEQ ID NO: 325370 - RNA, 32 nt, Human
agguguacauauucugcguagaugcuagacca

SEQ ID NO: 325371 - RNA, 32 nt, Human
agguguagagaccuccacuguccuauauuagc

SEQ ID NO: 325372 - RNA, 31 nt, Human
agguguagcagaggaauuuguaggagagagg

SEQ ID NO: 325373 - RNA, 32 nt, Human
agguguagccuggggcaaagugaugagauguc

SEQ ID NO: 325374 - RNA, 32 nt, Human
agguguagccuuucugauuccucgguuguuuc

SEQ ID NO: 325375 - RNA, 32 nt, Human
agguguagcguguuggguucagugagugguga

SEQ ID NO: 325376 - RNA, 32 nt, Human
agguguagcuggagagacauugugggugugua

SEQ ID NO: 325377 - RNA, 32 nt, Human
agguguaggaauagcuaauaaagcacaugaaa

SEQ ID NO: 325378 - RNA, 32 nt, Human
agguguaggcaggugggcucugcuucccgauu

SEQ ID NO: 325379 - RNA, 32 nt, Human
agguguauaauuuauuacugcaaaauaaauac

SEQ ID NO: 325380 - RNA, 32 nt, Human
agguguaugcagggcccucuucugccuuagcg

SEQ ID NO: 325381 - RNA, 32 nt, Human
agguguauucaggaguccaugcagcaggaagu

SEQ ID NO: 325382 - RNA, 32 nt, Human
aggugucagcaacacugugacccaccacaacc

SEQ ID NO: 325383 - RNA, 32 nt, Human
aggugucagccaccgcacccagccuggagugg

SEQ ID NO: 325384 - RNA, 32 nt, Human
aggugucaggagaaaguuuuguugauuuagaa

SEQ ID NO: 325385 - RNA, 32 nt, Human
aggugucaucauguuuaagccuaaaacuucag

SEQ ID NO: 325386 - RNA, 32 nt, Human
aggugucaucccuuugugucagagacagaccc

SEQ ID NO: 325387 - RNA, 32 nt, Human
aggugucauuauggugcuuagccugggaacug

SEQ ID NO: 325388 - RNA, 32 nt, Human
agguguccaagaagugcuggcaccaagggcug

SEQ ID NO: 325389 - RNA, 32 nt, Human
agguguccaagucacacagagccauggaaucu

SEQ ID NO: 325390 - RNA, 21 nt, Human
agguguccacagccaggcagg

SEQ ID NO: 325391 - RNA, 32 nt, Human
agguguccagaggcggcggcagcuggcagugc

SEQ ID NO: 325392 - RNA, 32 nt, Human
agguguccagcagaggaugaaggucagcaaga

SEQ ID NO: 325393 - RNA, 32 nt, Human
agguguccaugacugcccugaggcuccuacag

SEQ ID NO: 325394 - RNA, 32 nt, Human
aggugucccucggaucuguccucuucguguac

SEQ ID NO: 325395 - RNA, 32 nt, Human
agguguccugcaggcuguaaugcaguuuaauc

SEQ ID NO: 325396 - RNA, 32 nt, Human
agguguccuuuccccucucugccccugaucac

SEQ ID NO: 325397 - RNA, 32 nt, Human
aggugucucaaagaaggguggaaguucuaaug

SEQ ID NO: 325398 - RNA, 21 nt, Human
aggugucucacgucugggcug

SEQ ID NO: 325399 - RNA, 32 nt, Human
aggugucucugcccccacaccgcuacuggggu

SEQ ID NO: 325400 - RNA, 32 nt, Human
aggugucucuggcucaccuccgucuguucauc

SEQ ID NO: 325401 - RNA, 32 nt, Human
aggugucugagaauuccuccuccugggacucu

SEQ ID NO: 325402 - RNA, 32 nt, Human
aggugucugagaauuucuccucuugggacucu

SEQ ID NO: 325403 - RNA, 19 nt, Human
aggugucugcccucagggg

SEQ ID NO: 325404 - RNA, 32 nt, Human
aggugucugcuggcuuccugcucucccugcuc

SEQ ID NO: 325405 - RNA, 32 nt, Human
aggugucuggaauccuagcuacucaggaggcu

SEQ ID NO: 325406 - RNA, 32 nt, Human
aggugucuggacuggcugggccaugccugggc

SEQ ID NO: 325407 - RNA, 32 nt, Human
aggugucuggccaggcccaccugcugcggaug

SEQ ID NO: 325408 - RNA, 32 nt, Human
aggugucugguugcccugccucuggcuccaga

SEQ ID NO: 325409 - RNA, 32 nt, Human
aggugucugucucuggcugagguuuugucuau

SEQ ID NO: 325410 - RNA, 32 nt, Human
aggugucuuauaaucuuuuaccuauuucuuac

SEQ ID NO: 325411 - RNA, 32 nt, Human
aggugucuucaccucugcauuaggcauucgau

SEQ ID NO: 325412 - RNA, 32 nt, Human
aggugucuugcuggcuugccucuugcaauuca

SEQ ID NO: 325413 - RNA, 32 nt, Human
aggugugaauccagauaugcggucuuaauucc

SEQ ID NO: 325414 - RNA, 32 nt, Human
aggugugaaugaggcaggaugaacuggacagg

SEQ ID NO: 325415 - RNA, 32 nt, Human
aggugugaauggcucccuucuccucugcaggc

SEQ ID NO: 325416 - RNA, 32 nt, Human
aggugugagaauugugugugugaaaaagcugg

SEQ ID NO: 325417 - RNA, 20 nt, Human
aggugugagaccggcuuccc

SEQ ID NO: 325418 - RNA, 32 nt, Human
aggugugagaggggcuguggcuuuugugcagc

SEQ ID NO: 325419 - RNA, 32 nt, Human
aggugugagccaccacacccagccucuauauc

SEQ ID NO: 325420 - RNA, 32 nt, Human
aggugugagccaccacacccagccucuguagu

SEQ ID NO: 325421 - RNA, 22 nt, Human
aggugugagccaccacacccgg

SEQ ID NO: 325422 - RNA, 22 nt, Human
aggugugagccaccacgcccgg

SEQ ID NO: 325423 - RNA, 23 nt, Human
aggugugagccaccacgcccggu

SEQ ID NO: 325424 - RNA, 20 nt, Human
aggugugagccaccacgucc

SEQ ID NO: 325425 - RNA, 22 nt, Human
aggugugagccaccacguccgg

SEQ ID NO: 325426 - RNA, 32 nt, Human
aggugugagccaccaugcccagccucuucaag

SEQ ID NO: 325427 - RNA, 22 nt, Human
aggugugagccaccaugcccgg

SEQ ID NO: 325428 - RNA, 32 nt, Human
aggugugagccaccgcacccagccucaauuua

SEQ ID NO: 325429 - RNA, 22 nt, Human
aggugugagccaccgcacccgg

SEQ ID NO: 325430 - RNA, 22 nt, Human
aggugugagccaccgcgcccgg

SEQ ID NO: 325431 - RNA, 20 nt, Human
aggugugagccaccgcgucc

SEQ ID NO: 325432 - RNA, 20 nt, Human
aggugugagccaccgugccc

SEQ ID NO: 325433 - RNA, 23 nt, Human
aggugugagccaccgugcccagg

SEQ ID NO: 325434 - RNA, 22 nt, Human
aggugugagccaccgugcccgg

SEQ ID NO: 325435 - RNA, 32 nt, Human
aggugugagccacugcacccagccugugaugu

SEQ ID NO: 325436 - RNA, 32 nt, Human
aggugugagccacugcacccggccugaaauuu

SEQ ID NO: 325437 - RNA, 32 nt, Human
aggugugagccacugcgcccagccugaaucau

SEQ ID NO: 325438 - RNA, 20 nt, Human
aggugugagccacugugccc

SEQ ID NO: 325439 - RNA, 32 nt, Human
aggugugagccacugugcccagccucuucucu

SEQ ID NO: 325440 - RNA, 32 nt, Human
aggugugagccacugugcccagccucuuuugc

SEQ ID NO: 325441 - RNA, 32 nt, Human
aggugugagccgcugggcccagccugguuauc

SEQ ID NO: 325442 - RNA, 32 nt, Human
aggugugaggcugaggcaggguuuuacuuuua

SEQ ID NO: 325443 - RNA, 31 nt, Human
aggugugagggcagugcaaggagggagcaca

SEQ ID NO: 325444 - RNA, 32 nt, Human
aggugugaucaggggcucagagccaggguccu

SEQ ID NO: 325445 - RNA, 32 nt, Human
aggugugaucauagcacacugcagccuggaac

SEQ ID NO: 325446 - RNA, 32 nt, Human
aggugugcaccacugcucuucuuauggaguag

SEQ ID NO: 325447 - RNA, 32 nt, Human
aggugugcagaggcagaguguguacugcucgg

SEQ ID NO: 325448 - RNA, 24 nt, Human
aggugugcagaucacaaggucagg

SEQ ID NO: 325449 - RNA, 32 nt, Human
aggugugcaucuguggcuuucucucugucugg

SEQ ID NO: 325450 - RNA, 32 nt, Human
aggugugcccagcagaagugcaauagccagga

SEQ ID NO: 325451 - RNA, 32 nt, Human
aggugugcugagugccuguccccuggacccac

SEQ ID NO: 325452 - RNA, 32 nt, Human
aggugugcugugcaccuccccuuuaaauuaaa

SEQ ID NO: 325453 - RNA, 32 nt, Human
aggugugcuugcugugguacugggugagcggc

SEQ ID NO: 325454 - RNA, 32 nt, Human
aggugugcuugguuuggccugccuucucccuu

SEQ ID NO: 325455 - RNA, 32 nt, Human
agguguggaggcagcagcuguccugaggccau

SEQ ID NO: 325456 - RNA, 32 nt, Human
agguguggcacacgccuguaaucccaguuacu

SEQ ID NO: 325457 - RNA, 32 nt, Human
agguguggccacuuguagggcagugagaggaa

SEQ ID NO: 325458 - RNA, 32 nt, Human
agguguggcccaggcaggcugagugggugggc

SEQ ID NO: 325459 - RNA, 22 nt, Human
agguguggcccccuuggccugg

SEQ ID NO: 325460 - RNA, 30 nt, Human
agguguggccucuccacuucuguggacacc

SEQ ID NO: 325461 - RNA, 32 nt, Human
agguguggcucaugccuguaaucccagcacua

SEQ ID NO: 325462 - RNA, 32 nt, Human
aggugugggaacuggguauuucccuggggucu

SEQ ID NO: 325463 - RNA, 32 nt, Human
aggugugggacagaaggggcagagggagggca

SEQ ID NO: 325464 - RNA, 32 nt, Human
aggugugggauuaugguuuguguacugaaguu

SEQ ID NO: 325465 - RNA, 32 nt, Human
aggugugggcagggcaccaagcagggagguag

SEQ ID NO: 325466 - RNA, 32 nt, Human
agguguggggugugggguguucccggccauca

SEQ ID NO: 325467 - RNA, 32 nt, Human
aggugugguggcacaugcaccuguaaucccag

SEQ ID NO: 325468 - RNA, 32 nt, Human
agguguggugggcacacagauugccugggacc

SEQ ID NO: 325469 - RNA, 32 nt, Human
agguguggugggcaccuguaaucccagcuacu

SEQ ID NO: 325470 - RNA, 32 nt, Human
aggugugucaacuuuauauguaaggaaucugu

SEQ ID NO: 325471 - RNA, 32 nt, Human
aggugugucccuagggcuucaguccuggggca

SEQ ID NO: 325472 - RNA, 32 nt, Human
agguguguccgcucuuuucacacucgcggccg

SEQ ID NO: 325473 - RNA, 32 nt, Human
aggugugucucaggaaggugguucugugcaug

SEQ ID NO: 325474 - RNA, 32 nt, Human
aggugugucucaggaaugcacggugcccuuau

SEQ ID NO: 325475 - RNA, 32 nt, Human
aggugugucucuugccucugcuugccuccuac

SEQ ID NO: 325476 - RNA, 32 nt, Human
aggugugugccacccaugccuuuuaguagaga

SEQ ID NO: 325477 - RNA, 32 nt, Human
aggugugugccuggagggggccuggacuggca

SEQ ID NO: 325478 - RNA, 32 nt, Human
aggugugugcugcuaugacaucucuccagagc

SEQ ID NO: 325479 - RNA, 32 nt, Human
aggugugugcugggacgggcacuggacuggaa

SEQ ID NO: 325480 - RNA, 23 nt, Human
agguguuaaguagggugguguca

SEQ ID NO: 325481 - RNA, 32 nt, Human
agguguuaaucuucucuaaaagccuggugaua

SEQ ID NO: 325482 - RNA, 23 nt, Human
agguguuauauccccagcaccaa

SEQ ID NO: 325483 - RNA, 32 nt, Human
agguguuauuuuuaguugcauaggguauuuga

SEQ ID NO: 325484 - RNA, 32 nt, Human
agguguucaaacacaaccuacucugcaaaccu

SEQ ID NO: 325485 - RNA, 32 nt, Human
agguguucaagaccagccucaucaacauagug

SEQ ID NO: 325486 - RNA, 32 nt, Human
agguguucaagaccagccugaccaacauggug

SEQ ID NO: 325487 - RNA, 32 nt, Human
agguguucaaggccagccugggcaacauaaca

SEQ ID NO: 325488 - RNA, 31 nt, Human
agguguucaauaaauauuuguugaaugaauu

SEQ ID NO: 325489 - RNA, 32 nt, Human
agguguuccugcucuagcuuccacgaugaggc

SEQ ID NO: 325490 - RNA, 32 nt, Human
agguguuccuugcagcccccucccucucaggu

SEQ ID NO: 325491 - RNA, 32 nt, Human
agguguucgagaccagccugggcaacauagca

SEQ ID NO: 325492 - RNA, 32 nt, Human
agguguucucuccuuguagaacaucagagaag

SEQ ID NO: 325493 - RNA, 32 nt, Human
agguguucuuuguucaugcaggcagguuucug

SEQ ID NO: 325494 - RNA, 32 nt, Human
agguguugacacccuccauccucagagcaggu

SEQ ID NO: 325495 - RNA, 23 nt, Human
agguguugggaccacaggcguga

SEQ ID NO: 325496 - RNA, 24 nt, Human
agguguugggauuacagaugugag

SEQ ID NO: 325497 - RNA, 32 nt, Human
agguguugggauuacagaugugagccaccaca

SEQ ID NO: 325498 - RNA, 32 nt, Human
agguguugggauuacaggcgugagccaccgug

SEQ ID NO: 325499 - RNA, 32 nt, Human
agguguugggauuacaggcgugagccacugca

SEQ ID NO: 325500 - RNA, 32 nt, Human
agguguugggccagggcugagguaggagggag

SEQ ID NO: 325501 - RNA, 32 nt, Human
agguguuguggacaggagcugggaccaagauc

SEQ ID NO: 325502 - RNA, 32 nt, Human
agguguuucucuuccuccuucuccuccuucac

SEQ ID NO: 325503 - RNA, 32 nt, Human
agguguuugagaccagccuggccaacauggug

SEQ ID NO: 325504 - RNA, 32 nt, Human
agguguuugagaucagccuggccagcauggcg

SEQ ID NO: 325505 - RNA, 32 nt, Human
agguguuuucauuuuccuguucuuaccuauua

SEQ ID NO: 325506 - RNA, 32 nt, Human
agguguuuuccucugcuggcacgccagaaucc

SEQ ID NO: 325507 - RNA, 32 nt, Human
agguguuuuuauaauauccauauagaaaucua

SEQ ID NO: 325508 - RNA, 32 nt, Human
agguuaaagcagcgccaggaggaagcugacag

SEQ ID NO: 325509 - RNA, 32 nt, Human
agguuaaauccucaucaagagagaccaggcgg

SEQ ID NO: 325510 - RNA, 32 nt, Human
agguuaacaaucaaguagugaaagcacuauau

SEQ ID NO: 325511 - RNA, 32 nt, Human
agguuaacaggcaaacaaggccuugagcaaag

SEQ ID NO: 325512 - RNA, 32 nt, Human
agguuaacccuugugugaaaugaaggaacugu

SEQ ID NO: 325513 - RNA, 32 nt, Human
agguuaacggcagugccucaggaaaagcaggu

SEQ ID NO: 325514 - RNA, 32 nt, Human
agguuaacuaaagucaagauuggggcugcugc

SEQ ID NO: 325515 - RNA, 32 nt, Human
agguuaagaagaggaggaagugagacggggaa

SEQ ID NO: 325516 - RNA, 32 nt, Human
agguuaaggagaguggccgugagagugccauc

SEQ ID NO: 325517 - RNA, 32 nt, Human
agguuaagugucuugcccgaggucacacagcu

SEQ ID NO: 325518 - RNA, 32 nt, Human
agguuaaucaggaaaaauagcuuuugacaggg

SEQ ID NO: 325519 - RNA, 32 nt, Human
agguuaaucugaaguuugaaagcucagauuaa

SEQ ID NO: 325520 - RNA, 32 nt, Human
agguuacaacagauuugugaacucagccaagc

SEQ ID NO: 325521 - RNA, 32 nt, Human
agguuacagugagccgagaucacaccacugca

SEQ ID NO: 325522 - RNA, 32 nt, Human
agguuacagugagccgagaucauaccacugca

SEQ ID NO: 325523 - RNA, 32 nt, Human
agguuacagugagccgagaucaugccauugca

SEQ ID NO: 325524 - RNA, 32 nt, Human
agguuacagugagccgagaucgugccacugca

SEQ ID NO: 325525 - RNA, 32 nt, Human
agguuacagugagccgagauggcgccauuuca

SEQ ID NO: 325526 - RNA, 31 nt, Human
agguuacauacuuuauuuaaaaguauaguga

SEQ ID NO: 325527 - RNA, 32 nt, Human
agguuacauucacaucagucugucuuccccug

SEQ ID NO: 325528 - RNA, 32 nt, Human
agguuaccuagauguuaugagaaauuuuaguu

SEQ ID NO: 325529 - RNA, 32 nt, Human
agguuacgacagauuugugaacucagccaagc

SEQ ID NO: 325530 - RNA, 32 nt, Human
agguuacgcaggaagugagugguugagccaga

SEQ ID NO: 325531 - RNA, 32 nt, Human
agguuacugaaagcucugccuuccggaauccc

SEQ ID NO: 325532 - RNA, 32 nt, Human
agguuacugcacugaggccaaguuaggauggc

SEQ ID NO: 325533 - RNA, 32 nt, Human
agguuagaaagggagugagggaagggacaggg

SEQ ID NO: 325534 - RNA, 32 nt, Human
agguuagaaggaaugcaggauauuuuuaacac

SEQ ID NO: 325535 - RNA, 32 nt, Human
agguuagacccugggcccuggagcuuagggau

SEQ ID NO: 325536 - RNA, 32 nt, Human
agguuagacugaagcauggcagaggcuguugu

SEQ ID NO: 325537 - RNA, 32 nt, Human
agguuagagaaauggagagaggcuuggaggcu

SEQ ID NO: 325538 - RNA, 32 nt, Human
agguuagagggaacugggaggcacuuugcugu

SEQ ID NO: 325539 - RNA, 32 nt, Human
agguuagauuuccugcaucaacagugcuuugg

SEQ ID NO: 325540 - RNA, 32 nt, Human
agguuagcacgcaacagaauuuccuaaaauca

SEQ ID NO: 325541 - RNA, 32 nt, Human
agguuaggcccagagagcuggaguuggcucag

SEQ ID NO: 325542 - RNA, 32 nt, Human
agguuaggcccugcacuccaccuggggacggc

SEQ ID NO: 325543 - RNA, 32 nt, Human
agguuaggggagaggugacccugagggacagc

SEQ ID NO: 325544 - RNA, 32 nt, Human
agguuagggguuucaccauguuggccaggaug

SEQ ID NO: 325545 - RNA, 32 nt, Human
agguuagugcuggccuggucagcaugggcugg

SEQ ID NO: 325546 - RNA, 32 nt, Human
agguuaguguuugggggccgggggaggacuga

SEQ ID NO: 325547 - RNA, 32 nt, Human
agguuaguucucuuuggugacccuagacaucu

SEQ ID NO: 325548 - RNA, 32 nt, Human
agguuaguuguuacacagcaauagauagcgaa

SEQ ID NO: 325549 - RNA, 32 nt, Human
agguuauaacugagagcagugugcaagauaau

SEQ ID NO: 325550 - RNA, 32 nt, Human
agguuauaucagacaccacuaguagauagaaa

SEQ ID NO: 325551 - RNA, 32 nt, Human
agguuauauucauggauaaccaacaagauaag

SEQ ID NO: 325552 - RNA, 32 nt, Human
agguuaucaaaccauggagugauguggagcua

SEQ ID NO: 325553 - RNA, 32 nt, Human
agguuaucuccugaacacuuuugggcagauga

SEQ ID NO: 325554 - RNA, 32 nt, Human
agguuaucuugaacaagggaaggaaagauguu

SEQ ID NO: 325555 - RNA, 32 nt, Human
agguuaugcuccuuaugagaaucuaaugccug

SEQ ID NO: 325556 - RNA, 32 nt, Human
agguuauggacauucaugcccaauauauaagg

SEQ ID NO: 325557 - RNA, 32 nt, Human
agguuaugggaguugguguugggacagggugg

SEQ ID NO: 325558 - RNA, 32 nt, Human
agguuauucacucacaagccaccgggccuuca

SEQ ID NO: 325559 - RNA, 32 nt, Human
agguuauucucgaacuccugagcucaagugau

SEQ ID NO: 325560 - RNA, 32 nt, Human
agguucaacagaggccacgagauguguuacag

SEQ ID NO: 325561 - RNA, 32 nt, Human
agguucaagaacagcaaguuugcuauuuaaac

SEQ ID NO: 325562 - RNA, 22 nt, Human
agguucaagcaauucuccugcc

SEQ ID NO: 325563 - RNA, 23 nt, Human
agguucaagcaauucuccugccu

SEQ ID NO: 325564 - RNA, 23 nt, Human
agguucaagcaauucucuugccu

SEQ ID NO: 325565 - RNA, 23 nt, Human
agguucaagcauuucuccugccu

SEQ ID NO: 325566 - RNA, 31 nt, Human
agguucaagugauucccuugcuucagccucc

SEQ ID NO: 325567 - RNA, 32 nt, Human
agguucacaggugugcgaugagacugaggacu

SEQ ID NO: 325568 - RNA, 20 nt, Human
agguucacaguuguauucca

SEQ ID NO: 325569 - RNA, 32 nt, Human
agguucacuaaaugugaacagcuuugcuuuuc

SEQ ID NO: 325570 - RNA, 32 nt, Human
agguucacugguaaucccagcacuuugggagg

SEQ ID NO: 325571 - RNA, 32 nt, Human
agguucagacugagcucccccuucccaguagc

SEQ ID NO: 325572 - RNA, 32 nt, Human
agguucagccccggggaggagguuccacagga

SEQ ID NO: 325573 - RNA, 32 nt, Human
agguucagggucuaggaaggggagacauuuca

SEQ ID NO: 325574 - RNA, 26 nt, Human
agguucagucugaaagaaaucuccua

SEQ ID NO: 325575 - RNA, 32 nt, Human
agguucauauccagaggaauggcagaucugag

SEQ ID NO: 325576 - RNA, 21 nt, Human
agguucaugccuguaauccca

SEQ ID NO: 325577 - RNA, 32 nt, Human
agguucauggggaacccagcaggaaauuagaa

SEQ ID NO: 325578 - RNA, 32 nt, Human
agguuccacagcaagagcacccagcagaccau

SEQ ID NO: 325579 - RNA, 32 nt, Human
agguuccagacagccccucuucaccagcgauu

SEQ ID NO: 325580 - RNA, 32 nt, Human
agguuccagacuuagaaacagaccccucugua

SEQ ID NO: 325581 - RNA, 32 nt, Human
agguuccagcaacugaugccacugacuaacaa

SEQ ID NO: 325582 - RNA, 21 nt, Human
agguuccagcuaucacuugua

SEQ ID NO: 325583 - RNA, 32 nt, Human
agguuccaggaggcaucagguuggugugaugc

SEQ ID NO: 325584 - RNA, 32 nt, Human
agguuccagggcagcacccuuccugcugaagc

SEQ ID NO: 325585 - RNA, 21 nt, Human
agguuccaguaaaaaugcuuu

SEQ ID NO: 325586 - RNA, 32 nt, Human
agguuccagugagccgagauggcgcuauugca

SEQ ID NO: 325587 - RNA, 32 nt, Human
agguuccaucacaaaggggcaguauuaauuag

SEQ ID NO: 325588 - RNA, 32 nt, Human
agguucccacaguucauacuccugcuucagga

SEQ ID NO: 325589 - RNA, 32 nt, Human
agguucccaggaagcuuguauuuuaagccagg

SEQ ID NO: 325590 - RNA, 32 nt, Human
agguucccaggaccggucacauggucaggcac

SEQ ID NO: 325591 - RNA, 32 nt, Human
agguucccagguacucggaggcugagaggugg

SEQ ID NO: 325592 - RNA, 32 nt, Human
agguuccccaaaaggcugcccagccuuacagc

SEQ ID NO: 325593 - RNA, 32 nt, Human
agguuccccauucuagcacugaguauuugaaa

SEQ ID NO: 325594 - RNA, 21 nt, Human
agguucccccucucacccgca

SEQ ID NO: 325595 - RNA, 32 nt, Human
agguuccccuggacuccagccaaggcuguuca

SEQ ID NO: 325596 - RNA, 32 nt, Human
agguucccgaguagcugggacuacaggcaugu

SEQ ID NO: 325597 - RNA, 32 nt, Human
agguuccgaguagugucugagacucugcucug

SEQ ID NO: 325598 - RNA, 32 nt, Human
agguuccguaucucccuggagaagcaccagca

SEQ ID NO: 325599 - RNA, 22 nt, Human
agguuccguguggccugugcca

SEQ ID NO: 325600 - RNA, 32 nt, Human
agguuccucagaggggcaacccaaagccagag

SEQ ID NO: 325601 - RNA, 32 nt, Human
agguuccucagcugugguguaacugaagcagg

SEQ ID NO: 325602 - RNA, 32 nt, Human
agguuccugacucucccaucuucaccaacagc

SEQ ID NO: 325603 - RNA, 32 nt, Human
agguuccuguaacucccugccuccuccucucu

SEQ ID NO: 325604 - RNA, 32 nt, Human
agguuccugucuugucugucaugggagccauu

SEQ ID NO: 325605 - RNA, 21 nt, Human
agguuccuguggaccucaggg

SEQ ID NO: 325606 - RNA, 32 nt, Human
agguuccuucacugaguagucuggaagauaua

SEQ ID NO: 325607 - RNA, 32 nt, Human
agguuccuugccugucacgccacccccuuccu

SEQ ID NO: 325608 - RNA, 21 nt, Human
agguucgaggcucaccuauca

SEQ ID NO: 325609 - RNA, 32 nt, Human
agguucgccugcggacucggugcaguggaagc

SEQ ID NO: 325610 - RNA, 32 nt, Human
agguucggaaggcacaggaagcagcugaaagg

SEQ ID NO: 325611 - RNA, 32 nt, Human
agguucgucucaaacuccugaacccuaguaau

SEQ ID NO: 325612 - RNA, 32 nt, Human
agguucuaaggcaugggaucguuuccagauga

SEQ ID NO: 325613 - RNA, 32 nt, Human
agguucuagaugggugaaucaguuggguuuug

SEQ ID NO: 325614 - RNA, 32 nt, Human
agguucuaguccuagcuccaucauuuaccaac

SEQ ID NO: 325615 - RNA, 32 nt, Human
agguucuagugagccgagauugugcuauuugc

SEQ ID NO: 325616 - RNA, 32 nt, Human
agguucucacacuggccugggcuugggugccc

SEQ ID NO: 325617 - RNA, 32 nt, Human
agguucucagcaaguguacaguauuuaccuuc

SEQ ID NO: 325618 - RNA, 22 nt, Human
agguucuccaacaucacagccc

SEQ ID NO: 325619 - RNA, 32 nt, Human
agguucuccugcaucugccucuuccacuccuc

SEQ ID NO: 325620 - RNA, 32 nt, Human
agguucucuccccucuuuccucucacauacau

SEQ ID NO: 325621 - RNA, 32 nt, Human
agguucucuggagcccacacaggccaggacgu

SEQ ID NO: 325622 - RNA, 31 nt, Human
agguucugccucuguggcuguguuugaaaaa

SEQ ID NO: 325623 - RNA, 32 nt, Human
agguucugcucaccuucggguccuccucgcuu

SEQ ID NO: 325624 - RNA, 32 nt, Human
agguucuggagguuggagguuccgcucaguga

SEQ ID NO: 325625 - RNA, 32 nt, Human
agguucugggccuggaacuucugccuccuucc

SEQ ID NO: 325626 - RNA, 32 nt, Human
agguucugggcuggguugugggggacugggga

SEQ ID NO: 325627 - RNA, 32 nt, Human
agguucugugauuuuucagacucugaaaauuc

SEQ ID NO: 325628 - RNA, 32 nt, Human
agguucuguggaaguuccaguguucucucuua

SEQ ID NO: 325629 - RNA, 32 nt, Human
agguucuuagcacauccucuguucucuaccug

SEQ ID NO: 325630 - RNA, 32 nt, Human
agguucuucuggaacuccuguccccuuaguca

SEQ ID NO: 325631 - RNA, 32 nt, Human
agguucuugagacucuugauauuucugucuuc

SEQ ID NO: 325632 - RNA, 32 nt, Human
agguucuuucauggacuugcuguguaccccug

SEQ ID NO: 325633 - RNA, 32 nt, Human
agguucuuugagggacugccucugccacacuc

SEQ ID NO: 325634 - RNA, 32 nt, Human
agguucuuuucucucuuccucucaccuugucc

SEQ ID NO: 325635 - RNA, 32 nt, Human
agguugaaauagugauuuauacaugaugggca

SEQ ID NO: 325636 - RNA, 32 nt, Human
agguugaaaugagacggcuugugugugaaaag

SEQ ID NO: 325637 - RNA, 32 nt, Human
agguugaaaugccaccaggaaaaugccacuuc

SEQ ID NO: 325638 - RNA, 32 nt, Human
agguugaaaugguauguuguaaaagagaagac

SEQ ID NO: 325639 - RNA, 32 nt, Human
agguugaacucgccucuuuugcacuggaaggc

SEQ ID NO: 325640 - RNA, 32 nt, Human
agguugaacuguagcgaggcccccaggccgcc

SEQ ID NO: 325641 - RNA, 32 nt, Human
agguugaagcuguggagcuagacucugcuuca

SEQ ID NO: 325642 - RNA, 32 nt, Human
agguugaaguggcauggcaaugguuagagacc

SEQ ID NO: 325643 - RNA, 32 nt, Human
agguugaaguuggaguuugagguuggaaaaua

SEQ ID NO: 325644 - RNA, 31 nt, Human
agguugaaucaaugucuucucacuuaaucag

SEQ ID NO: 325645 - RNA, 32 nt, Human
agguugacccuccccuggccagguggcugccu

SEQ ID NO: 325646 - RNA, 32 nt, Human
agguugacuagagcugaccagugauuuacaaa

SEQ ID NO: 325647 - RNA, 32 nt, Human
agguugacuauagucaauggggccaauggagc

SEQ ID NO: 325648 - RNA, 32 nt, Human
agguugaggacacacauccaugacacagccuc

SEQ ID NO: 325649 - RNA, 32 nt, Human
agguugaggcagcagaauugcuugaacccagg

SEQ ID NO: 325650 - RNA, 32 nt, Human
agguugaggcagcaggauugcuggagcccagg

SEQ ID NO: 325651 - RNA, 32 nt, Human
agguugaggcguacuggagacaacaccucaga

SEQ ID NO: 325652 - RNA, 32 nt, Human
agguugagugcugcaggaagagcugcuucugc

SEQ ID NO: 325653 - RNA, 32 nt, Human
agguugaguuugcugccaggauucagaucagc

SEQ ID NO: 325654 - RNA, 32 nt, Human
agguugaucucagacugcugugcuagcaauca

SEQ ID NO: 325655 - RNA, 32 nt, Human
agguugaucuucuauuaaaaugauuccucuuu

SEQ ID NO: 325656 - RNA, 32 nt, Human
agguugaucuuggacuccugaccccaggugau

SEQ ID NO: 325657 - RNA, 32 nt, Human
agguugaugggaagacuuccuucccaaagaaa

SEQ ID NO: 325658 - RNA, 32 nt, Human
agguugauugauaucugaucccugcaaaauac

SEQ ID NO: 325659 - RNA, 32 nt, Human
agguugcaagugagcugagaucgcaccacugc

SEQ ID NO: 325660 - RNA, 32 nt, Human
agguugcaaucagccgagauggugccaucgca

SEQ ID NO: 325661 - RNA, 32 nt, Human
agguugcaaucagcugagaucacaccacugca

SEQ ID NO: 325662 - RNA, 32 nt, Human
agguugcaaugagccgagaucgugccacagca

SEQ ID NO: 325663 - RNA, 32 nt, Human
agguugcacacaguacacaccagaagauguga

SEQ ID NO: 325664 - RNA, 31 nt, Human
agguugcacagcuaccauguggcaaaaccag

SEQ ID NO: 325665 - RNA, 32 nt, Human
agguugcaccauuguacuccagccugggcaac

SEQ ID NO: 325666 - RNA, 32 nt, Human
agguugcacccucgugugugccuguguuaaaa

SEQ ID NO: 325667 - RNA, 32 nt, Human
agguugcacugagccgagaucaugccauugua

SEQ ID NO: 325668 - RNA, 32 nt, Human
agguugcagaggcuggccgcugccuggaagug

SEQ ID NO: 325669 - RNA, 32 nt, Human
agguugcagcaagccgagauugugccacugua

SEQ ID NO: 325670 - RNA, 32 nt, Human
agguugcagggagccgagaucacgccacugca

SEQ ID NO: 325671 - RNA, 32 nt, Human
agguugcagggagccgagauccgccacugcac

SEQ ID NO: 325672 - RNA, 32 nt, Human
agguugcaguaagccaagaucgcgccauugca

SEQ ID NO: 325673 - RNA, 32 nt, Human
agguugcaguaagccaagaucgugccauugca

SEQ ID NO: 325674 - RNA, 32 nt, Human
agguugcaguaagccaagauugcgccacugca

SEQ ID NO: 325675 - RNA, 32 nt, Human
agguugcaguaagccaaggucaugccacugca

SEQ ID NO: 325676 - RNA, 32 nt, Human
agguugcaguaagcccagauugugccacugca

SEQ ID NO: 325677 - RNA, 32 nt, Human
agguugcaguaagccgagacuaugccacugca

SEQ ID NO: 325678 - RNA, 32 nt, Human
agguugcaguaagccgagaucacgccacugca

SEQ ID NO: 325679 - RNA, 32 nt, Human
agguugcaguaagccgagaucacgccacugua

SEQ ID NO: 325680 - RNA, 32 nt, Human
agguugcaguaagccuaggucgugccacugca

SEQ ID NO: 325681 - RNA, 32 nt, Human
agguugcagucagccgagaucgugucacugca

SEQ ID NO: 325682 - RNA, 32 nt, Human
agguugcagugaaccgagaucaugccaccgca

SEQ ID NO: 325683 - RNA, 32 nt, Human
agguugcagugagccaagaucaugccuacugc

SEQ ID NO: 325684 - RNA, 32 nt, Human
agguugcagugagccaagauugcagugagcca

SEQ ID NO: 325685 - RNA, 32 nt, Human
agguugcagugagccaugaucaugccacugca

SEQ ID NO: 325686 - RNA, 32 nt, Human
agguugcagugagccgagaaugccacugcacu

SEQ ID NO: 325687 - RNA, 32 nt, Human
agguugcagugagccgagaccacgccacugca

SEQ ID NO: 325688 - RNA, 32 nt, Human
agguugcagugagccgagaccacgccauugca

SEQ ID NO: 325689 - RNA, 32 nt, Human
agguugcagugagccgagaccauaccacugca

SEQ ID NO: 325690 - RNA, 32 nt, Human
agguugcagugagccgagaccaugccacugca

SEQ ID NO: 325691 - RNA, 32 nt, Human
agguugcagugagccgagaccgcgccacugca

SEQ ID NO: 325692 - RNA, 32 nt, Human
agguugcagugagccgagaccgugccacugca

SEQ ID NO: 325693 - RNA, 32 nt, Human
agguugcagugagccgagacugugcuacugca

SEQ ID NO: 325694 - RNA, 32 nt, Human
agguugcagugagccgagagcacgccacugca

SEQ ID NO: 325695 - RNA, 32 nt, Human
agguugcagugagccgagauaaugccacugca

SEQ ID NO: 325696 - RNA, 32 nt, Human
agguugcagugagccgagauagugccacagcu

SEQ ID NO: 325697 - RNA, 32 nt, Human
agguugcagugagccgagauagugccacugca

SEQ ID NO: 325698 - RNA, 32 nt, Human
agguugcagugagccgagauagugccacugug

SEQ ID NO: 325699 - RNA, 32 nt, Human
agguugcagugagccgagaucacaccaccgca

SEQ ID NO: 325700 - RNA, 32 nt, Human
agguugcagugagccgagaucacaccacugca

SEQ ID NO: 325701 - RNA, 32 nt, Human
agguugcagugagccgagaucacaccacugua

SEQ ID NO: 325702 - RNA, 32 nt, Human
agguugcagugagccgagaucacaccauugca

SEQ ID NO: 325703 - RNA, 32 nt, Human
agguugcagugagccgagaucaccccauuuca

SEQ ID NO: 325704 - RNA, 32 nt, Human
agguugcagugagccgagaucacgccacugca

SEQ ID NO: 325705 - RNA, 32 nt, Human
agguugcagugagccgagaucacgccauugca

SEQ ID NO: 325706 - RNA, 32 nt, Human
agguugcagugagccgagaucacgucacugca

SEQ ID NO: 325707 - RNA, 32 nt, Human
agguugcagugagccgagaucacgucauugcu

SEQ ID NO: 325708 - RNA, 32 nt, Human
agguugcagugagccgagaucauaccauugca

SEQ ID NO: 325709 - RNA, 32 nt, Human
agguugcagugagccgagaucaugccacugca

SEQ ID NO: 325710 - RNA, 32 nt, Human
agguugcagugagccgagaucaugccauugca

SEQ ID NO: 325711 - RNA, 32 nt, Human
agguugcagugagccgagaucaugcuacugca

SEQ ID NO: 325712 - RNA, 32 nt, Human
agguugcagugagccgagaucaugucacugca

SEQ ID NO: 325713 - RNA, 32 nt, Human
agguugcagugagccgagaucccccgaccgca

SEQ ID NO: 325714 - RNA, 32 nt, Human
agguugcagugagccgagaucccgccacucac

SEQ ID NO: 325715 - RNA, 32 nt, Human
agguugcagugagccgagaucgagccacugca

SEQ ID NO: 325716 - RNA, 32 nt, Human
agguugcagugagccgagaucgagccauugca

SEQ ID NO: 325717 - RNA, 32 nt, Human
agguugcagugagccgagaucgcaccacgcca

SEQ ID NO: 325718 - RNA, 32 nt, Human
agguugcagugagccgagaucgcaccacugca

SEQ ID NO: 325719 - RNA, 32 nt, Human
agguugcagugagccgagaucgcaccacugua

SEQ ID NO: 325720 - RNA, 32 nt, Human
agguugcagugagccgagaucgcaccagugca

SEQ ID NO: 325721 - RNA, 32 nt, Human
agguugcagugagccgagaucgcaccauugca

SEQ ID NO: 325722 - RNA, 32 nt, Human
agguugcagugagccgagaucgcgccacccac

SEQ ID NO: 325723 - RNA, 32 nt, Human
agguugcagugagccgagaucgcgccacugca

SEQ ID NO: 325724 - RNA, 32 nt, Human
agguugcagugagccgagaucgcgccauagca

SEQ ID NO: 325725 - RNA, 32 nt, Human
agguugcagugagccgagaucgcgccauuaca

SEQ ID NO: 325726 - RNA, 32 nt, Human
agguugcagugagccgagaucgcgccauugca

SEQ ID NO: 325727 - RNA, 32 nt, Human
agguugcagugagccgagaucgcgucacugca

SEQ ID NO: 325728 - RNA, 32 nt, Human
agguugcagugagccgagaucgcuccacugca

SEQ ID NO: 325729 - RNA, 32 nt, Human
agguugcagugagccgagaucgucccacugca

SEQ ID NO: 325730 - RNA, 32 nt, Human
agguugcagugagccgagaucgugccacugca

SEQ ID NO: 325731 - RNA, 32 nt, Human
agguugcagugagccgagaucgugccacugcg

SEQ ID NO: 325732 - RNA, 32 nt, Human
agguugcagugagccgagaucgugccauugca

SEQ ID NO: 325733 - RNA, 32 nt, Human
agguugcagugagccgagaucgugcuacugca

SEQ ID NO: 325734 - RNA, 32 nt, Human
agguugcagugagccgagaucucaccauuaca

SEQ ID NO: 325735 - RNA, 32 nt, Human
agguugcagugagccgagauggcgccacugca

SEQ ID NO: 325736 - RNA, 32 nt, Human
agguugcagugagccgagauggugccacugca

SEQ ID NO: 325737 - RNA, 32 nt, Human
agguugcagugagccgagauuacaccauugca

SEQ ID NO: 325738 - RNA, 32 nt, Human
agguugcagugagccgagauuaugccacugca

SEQ ID NO: 325739 - RNA, 32 nt, Human
agguugcagugagccgagauuaugccacugua

SEQ ID NO: 325740 - RNA, 32 nt, Human
agguugcagugagccgagauuaugucacucca

SEQ ID NO: 325741 - RNA, 32 nt, Human
agguugcagugagccgagauugcaccaccgca

SEQ ID NO: 325742 - RNA, 32 nt, Human
agguugcagugagccgagauugcaccacugca

SEQ ID NO: 325743 - RNA, 32 nt, Human
agguugcagugagccgagauugcaccacuuac

SEQ ID NO: 325744 - RNA, 32 nt, Human
agguugcagugagccgagauugcaccauugca

SEQ ID NO: 325745 - RNA, 32 nt, Human
agguugcagugagccgagauugccacugcacu

SEQ ID NO: 325746 - RNA, 32 nt, Human
agguugcagugagccgagauugcgccacuaca

SEQ ID NO: 325747 - RNA, 32 nt, Human
agguugcagugagccgagauugcgccacugca

SEQ ID NO: 325748 - RNA, 32 nt, Human
agguugcagugagccgagauugcgccacugga

SEQ ID NO: 325749 - RNA, 32 nt, Human
agguugcagugagccgagauugcgccacugua

SEQ ID NO: 325750 - RNA, 32 nt, Human
agguugcagugagccgagauugcgccauugca

SEQ ID NO: 325751 - RNA, 32 nt, Human
agguugcagugagccgagauugcgucacugca

SEQ ID NO: 325752 - RNA, 32 nt, Human
agguugcagugagccgagauugcuccauugca

SEQ ID NO: 325753 - RNA, 32 nt, Human
agguugcagugagccgagauuggccauugcac

SEQ ID NO: 325754 - RNA, 32 nt, Human
agguugcagugagccgagauugugccacuaca

SEQ ID NO: 325755 - RNA, 32 nt, Human
agguugcagugagccgagauugugccacugca

SEQ ID NO: 325756 - RNA, 32 nt, Human
agguugcagugagccgagauugugccacugcg

SEQ ID NO: 325757 - RNA, 32 nt, Human
agguugcagugagccgagauugugccacugua

SEQ ID NO: 325758 - RNA, 32 nt, Human
agguugcagugagccgagauugugccauugca

SEQ ID NO: 325759 - RNA, 32 nt, Human
agguugcagugagccgagauuucaccagugca

SEQ ID NO: 325760 - RNA, 32 nt, Human
agguugcagugagccgggauugcagugagcca

SEQ ID NO: 325761 - RNA, 32 nt, Human
agguugcagugagcggagaucuugccacugca

SEQ ID NO: 325762 - RNA, 32 nt, Human
agguugcagugagcugagaucuucccacugca

SEQ ID NO: 325763 - RNA, 32 nt, Human
agguugcagugagcugagaucuugccacugca

SEQ ID NO: 325764 - RNA, 32 nt, Human
agguugcagugagcugagguugcggugagcug

SEQ ID NO: 325765 - RNA, 32 nt, Human
agguugcagugggccgagaucacaccacugca

SEQ ID NO: 325766 - RNA, 32 nt, Human
agguugcccaggcuggugucgaauuccugguc

SEQ ID NO: 325767 - RNA, 32 nt, Human
agguugccccuccagaccgcucccaacgucag

SEQ ID NO: 325768 - RNA, 32 nt, Human
agguugcccgggagacgcggguacacagagaa

SEQ ID NO: 325769 - RNA, 32 nt, Human
agguugccgugagccgagaucgugccauugca

SEQ ID NO: 325770 - RNA, 32 nt, Human
agguugccuuggugcugccccagaucugucca

SEQ ID NO: 325771 - RNA, 32 nt, Human
agguugcgccacuacacuccagccugggugac

SEQ ID NO: 325772 - RNA, 32 nt, Human
agguugcgccacugcacuccagccugggcaac

SEQ ID NO: 325773 - RNA, 32 nt, Human
agguugcgccacugcacucuagccugggcuac

SEQ ID NO: 325774 - RNA, 32 nt, Human
agguugcgccacuguacuccagccugggugag

SEQ ID NO: 325775 - RNA, 32 nt, Human
agguugcgcuacugcacuccagccuggacaac

SEQ ID NO: 325776 - RNA, 32 nt, Human
agguugcgguaagccgagaucaccuccagccu

SEQ ID NO: 325777 - RNA, 32 nt, Human
agguugcgguaagccgagaucgcaccauugca

SEQ ID NO: 325778 - RNA, 32 nt, Human
agguugcggugagccgagaucacgccacugca

SEQ ID NO: 325779 - RNA, 32 nt, Human
agguugcggugagccgagaucaugccacugca

SEQ ID NO: 325780 - RNA, 32 nt, Human
agguugcggugagccgagaucaugccauggca

SEQ ID NO: 325781 - RNA, 32 nt, Human
agguugcggugagccgagaucgcaccacugca

SEQ ID NO: 325782 - RNA, 32 nt, Human
agguugcggugagccgagaucgcgccauugca

SEQ ID NO: 325783 - RNA, 32 nt, Human
agguugcggugagccgagaucgcgcuacugca

SEQ ID NO: 325784 - RNA, 32 nt, Human
agguugcggugagccgagauugugccauugca

SEQ ID NO: 325785 - RNA, 32 nt, Human
agguugcguguucuucgaguugggcuaaagua

SEQ ID NO: 325786 - RNA, 32 nt, Human
agguugcugcuucaggaacggagggagugaga

SEQ ID NO: 325787 - RNA, 32 nt, Human
agguugcugcuucaggaauggagggagugaga

SEQ ID NO: 325788 - RNA, 32 nt, Human
agguugcuggggcccaggcuggugcuaacaua

SEQ ID NO: 325789 - RNA, 32 nt, Human
agguugcugugagccgagaucgugccacugca

SEQ ID NO: 325790 - RNA, 32 nt, Human
agguugcugugagccgagaucgugccacugcg

SEQ ID NO: 325791 - RNA, 32 nt, Human
agguuggaaaggaagaaagagaagagcugaag

SEQ ID NO: 325792 - RNA, 32 nt, Human
agguuggaagaaaaauggguggaagacaagug

SEQ ID NO: 325793 - RNA, 32 nt, Human
agguuggacagguccuucuguguccuugcaaa

SEQ ID NO: 325794 - RNA, 18 nt, Human
agguuggagaggcaccug

SEQ ID NO: 325795 - RNA, 32 nt, Human
agguuggagaguggagucucuaaaaaucugcu

SEQ ID NO: 325796 - RNA, 17 nt, Human
agguuggagcacacagc

SEQ ID NO: 325797 - RNA, 24 nt, Human
agguuggaggauugcuugagccca

SEQ ID NO: 325798 - RNA, 32 nt, Human
agguuggagucccuacccucccaccucccacc

SEQ ID NO: 325799 - RNA, 19 nt, Human
agguuggaguguaauagca

SEQ ID NO: 325800 - RNA, 32 nt, Human
agguuggaugcaugguugcauggauuuggggu

SEQ ID NO: 325801 - RNA, 32 nt, Human
agguuggauuagcugcgcugaggucccaucca

SEQ ID NO: 325802 - RNA, 32 nt, Human
agguuggauucauggaggagauauaacauuuu

SEQ ID NO: 325803 - RNA, 21 nt, Human
agguuggccaacauggugaga

SEQ ID NO: 325804 - RNA, 18 nt, Human
agguuggccccugaacug

SEQ ID NO: 325805 - RNA, 32 nt, Human
agguuggcccuccucaaggucagccuucagau

SEQ ID NO: 325806 - RNA, 32 nt, Human
agguugggaaaugaggaaugagccugacaccc

SEQ ID NO: 325807 - RNA, 32 nt, Human
agguugggaagaggaugaagauugaauaacug

SEQ ID NO: 325808 - RNA, 32 nt, Human
agguugggaagguaguggcaggagggcagccu

SEQ ID NO: 325809 - RNA, 32 nt, Human
agguugggacucugucuuacauaucugggugc

SEQ ID NO: 325810 - RNA, 32 nt, Human
agguugggagaggugggaaauagcagugaauu

SEQ ID NO: 325811 - RNA, 25 nt, Human
agguugggaggaucaccugagccca

SEQ ID NO: 325812 - RNA, 32 nt, Human
agguugggagguggaggcccagcaucccgcgc

SEQ ID NO: 325813 - RNA, 32 nt, Human
agguugggccuggauggggaggcucuagcauc

SEQ ID NO: 325814 - RNA, 32 nt, Human
agguugggcucaggaacugcagggacgugaac

SEQ ID NO: 325815 - RNA, 32 nt, Human
agguugggcucaggcugggugcucugccaugg

SEQ ID NO: 325816 - RNA, 32 nt, Human
agguugggcuggcagaucaugaggucaggagu

SEQ ID NO: 325817 - RNA, 32 nt, Human
agguugggcuggcuggacugagcccaggccug

SEQ ID NO: 325818 - RNA, 32 nt, Human
agguuggggagugaaguguggggacccuuuuc

SEQ ID NO: 325819 - RNA, 32 nt, Human
agguuggggccgggguagggaggcaggagcca

SEQ ID NO: 325820 - RNA, 32 nt, Human
agguuggggcggaggaagcuggaggauagggg

SEQ ID NO: 325821 - RNA, 32 nt, Human
agguuggggcuggguccacccuguccuaugac

SEQ ID NO: 325822 - RNA, 32 nt, Human
agguuggguuugguuuucuucuuaaagaguuu

SEQ ID NO: 325823 - RNA, 32 nt, Human
agguugguaucuuucaucaaauccagaugcaa

SEQ ID NO: 325824 - RNA, 32 nt, Human
agguuggucucaaacuccugagcucaagcaau

SEQ ID NO: 325825 - RNA, 32 nt, Human
agguuggucucaaacuccugagcucaagcagu

SEQ ID NO: 325826 - RNA, 32 nt, Human
agguuggucucaaacuccuggacucaagugau

SEQ ID NO: 325827 - RNA, 32 nt, Human
agguuggucucaagcuccugaccucagaugau

SEQ ID NO: 325828 - RNA, 32 nt, Human
agguuggucucgaacgccuaggcucaagugau

SEQ ID NO: 325829 - RNA, 32 nt, Human
agguuggucucgaacuccugaccucaggugau

SEQ ID NO: 325830 - RNA, 32 nt, Human
agguuggucucgaacuccugaccuugugaugc

SEQ ID NO: 325831 - RNA, 32 nt, Human
agguuggucucgaacuccugacuucaugugau

SEQ ID NO: 325832 - RNA, 32 nt, Human
agguuggucucgaacuccugaucucaugaucc

SEQ ID NO: 325833 - RNA, 32 nt, Human
agguuggucucgaacuccuggccucaagugau

SEQ ID NO: 325834 - RNA, 32 nt, Human
agguuggucucgaacuccuggcuucaagcgau

SEQ ID NO: 325835 - RNA, 32 nt, Human
agguuggucucgaacuccugggcucaagcagu

SEQ ID NO: 325836 - RNA, 32 nt, Human
agguuggucucgaacucuugaccucaagugau

SEQ ID NO: 325837 - RNA, 32 nt, Human
agguuggucuugaacuccuagaccuugugauc

SEQ ID NO: 325838 - RNA, 32 nt, Human
agguuggucuugaacuccugaccucaggugau

SEQ ID NO: 325839 - RNA, 32 nt, Human
agguuggucuugaacuccuggccucaagcauc

SEQ ID NO: 325840 - RNA, 32 nt, Human
agguuggucuugaacucuugaccucaugaucc

SEQ ID NO: 325841 - RNA, 32 nt, Human
agguuggugaugauauugucauagaagcuuug

SEQ ID NO: 325842 - RNA, 32 nt, Human
agguugguuuugaacuccugaccucaaguaau

SEQ ID NO: 325843 - RNA, 32 nt, Human
agguugguuuugaacuccugggcucaagcgau

SEQ ID NO: 325844 - RNA, 32 nt, Human
agguugguuuugcuguugaucggucuccuagg

SEQ ID NO: 325845 - RNA, 32 nt, Human
agguuguaccacugcacuccagccuggcugac

SEQ ID NO: 325846 - RNA, 32 nt, Human
agguuguagggagcuaugaucuugccauugca

SEQ ID NO: 325847 - RNA, 32 nt, Human
agguuguaguaagcugacauugugccacugca

SEQ ID NO: 325848 - RNA, 32 nt, Human
agguuguagugagccgagaucgcgccaucgca

SEQ ID NO: 325849 - RNA, 32 nt, Human
agguuguagugagccgagaucgcgccgcugca

SEQ ID NO: 325850 - RNA, 32 nt, Human
agguuguagugagccgagauuacuccagccua

SEQ ID NO: 325851 - RNA, 32 nt, Human
agguuguagugagccgagauugcaccacugca

SEQ ID NO: 325852 - RNA, 32 nt, Human
agguuguagugagccgagauugugccacugca

SEQ ID NO: 325853 - RNA, 32 nt, Human
agguugucagcuuuaagauauguggugguuuu

SEQ ID NO: 325854 - RNA, 32 nt, Human
agguuguccuuguccuauuaagccucuucccc

SEQ ID NO: 325855 - RNA, 22 nt, Human
agguugugaaccccucccccca

SEQ ID NO: 325856 - RNA, 32 nt, Human
agguugugaauugcaccuccagcuuugaacac

SEQ ID NO: 325857 - RNA, 32 nt, Human
agguugugccacugcacuccagccugggcaaa

SEQ ID NO: 325858 - RNA, 32 nt, Human
agguugugccacugcacuccagccugggugac

SEQ ID NO: 325859 - RNA, 32 nt, Human
agguugugccacugcacugcagccugggcuac

SEQ ID NO: 325860 - RNA, 32 nt, Human
agguugugcucuggcaguaggccacgaccugc

SEQ ID NO: 325861 - RNA, 32 nt, Human
agguugugcuuccggugcggaggucauggaca

SEQ ID NO: 325862 - RNA, 32 nt, Human
agguuguggaaauguuucagauuaaaugauag

SEQ ID NO: 325863 - RNA, 32 nt, Human
agguuguggcugaugguguugaagauaaauaa

SEQ ID NO: 325864 - RNA, 18 nt, Human
agguuguggcugcaguga

SEQ ID NO: 325865 - RNA, 29 nt, Human
agguuguggcugcugguaugcuucagcuu

SEQ ID NO: 325866 - RNA, 32 nt, Human
agguugugggggacaucuugagcugaagcagg

SEQ ID NO: 325867 - RNA, 32 nt, Human
agguuguggucugaggaccacuacauggggau

SEQ ID NO: 325868 - RNA, 32 nt, Human
agguuguggugaagggcaauugggagaggcua

SEQ ID NO: 325869 - RNA, 32 nt, Human
agguuguggugagccgagaucacgccacugca

SEQ ID NO: 325870 - RNA, 32 nt, Human
agguuguggugagccgagaucgcaccauugca

SEQ ID NO: 325871 - RNA, 32 nt, Human
agguuguggugagccgagaucgcgccaguaca

SEQ ID NO: 325872 - RNA, 32 nt, Human
agguuguggugagccgagaucgcgccauugca

SEQ ID NO: 325873 - RNA, 32 nt, Human
agguuguggugagccgagaucgugccacugua

SEQ ID NO: 325874 - RNA, 32 nt, Human
agguuguggugagccgagaucgugccauugca

SEQ ID NO: 325875 - RNA, 32 nt, Human
agguuguggugagccgagauugcaccacugca

SEQ ID NO: 325876 - RNA, 32 nt, Human
agguuguggugagccgagauugcaccauugcg

SEQ ID NO: 325877 - RNA, 32 nt, Human
agguuguggugagccgagauugcuccauugca

SEQ ID NO: 325878 - RNA, 32 nt, Human
agguugugucauugcacuccagccuggggaac

SEQ ID NO: 325879 - RNA, 32 nt, Human
agguuguugcggaugcuucucucuccaggcgc

SEQ ID NO: 325880 - RNA, 32 nt, Human
agguuguuugauuauuuugcaaaagccuuuca

SEQ ID NO: 325881 - RNA, 32 nt, Human
agguuguuuggaaagucggugugacagacaca

SEQ ID NO: 325882 - RNA, 32 nt, Human
agguuuaaagggggaaagaaaagggaagaaga

SEQ ID NO: 325883 - RNA, 32 nt, Human
agguuuaauuggcucaugguuccccaggcugu

SEQ ID NO: 325884 - RNA, 32 nt, Human
agguuuaauuguuguuuauugguacaauaagg

SEQ ID NO: 325885 - RNA, 32 nt, Human
agguuuacaccacugcacuccagucuggauga

SEQ ID NO: 325886 - RNA, 32 nt, Human
agguuuacacguggguuucaguguauuugccu

SEQ ID NO: 325887 - RNA, 32 nt, Human
agguuuacauuaugugaauacaugcacauuug

SEQ ID NO: 325888 - RNA, 32 nt, Human
agguuuagaagagaaaagagcaacagauuuuc

SEQ ID NO: 325889 - RNA, 32 nt, Human
agguuuagugcccuccugagugacugcgucag

SEQ ID NO: 325890 - RNA, 32 nt, Human
agguuuagugcugcugcuuucacugcugcacc

SEQ ID NO: 325891 - RNA, 32 nt, Human
agguuuaguucuuagauccuggcuccagacau

SEQ ID NO: 325892 - RNA, 32 nt, Human
agguuuauccccaaggccccagcuuugagaag

SEQ ID NO: 325893 - RNA, 32 nt, Human
agguuuaucucuccucuucuguuuucuggaag

SEQ ID NO: 325894 - RNA, 32 nt, Human
agguuuaugaaugcugaaccucagguuucaua

SEQ ID NO: 325895 - RNA, 32 nt, Human
agguuuauggucuguucucacacugcuacgaa

SEQ ID NO: 325896 - RNA, 32 nt, Human
agguuuauguugaggauucuguuccuggaauu

SEQ ID NO: 325897 - RNA, 32 nt, Human
agguuuauuaaauuaugcuuguaaaugaaaga

SEQ ID NO: 325898 - RNA, 32 nt, Human
agguuuauucaauccuguccuggguagggcga

SEQ ID NO: 325899 - RNA, 32 nt, Human
agguuucaacccagaguuaaugucaagcaugc

SEQ ID NO: 325900 - RNA, 32 nt, Human
agguuucaccucccaaacccagccucuagaac

SEQ ID NO: 325901 - RNA, 32 nt, Human
agguuucagaccgccucacaggcagaguucca

SEQ ID NO: 325902 - RNA, 32 nt, Human
agguuucagacuccaguuucucccuugcccuu

SEQ ID NO: 325903 - RNA, 32 nt, Human
agguuucagaucccaagcuacagaucaugucu

SEQ ID NO: 325904 - RNA, 32 nt, Human
agguuucagcaacaccaguggccuacagagaa

SEQ ID NO: 325905 - RNA, 30 nt, Human
agguuucagcuucccucgcuccuguuguua

SEQ ID NO: 325906 - RNA, 32 nt, Human
agguuucaggaaggggccacagcaagccaucu

SEQ ID NO: 325907 - RNA, 32 nt, Human
agguuucaggggcaagagcaguuuucaaaagu

SEQ ID NO: 325908 - RNA, 32 nt, Human
agguuucagugagccgagaucaugccacugca

SEQ ID NO: 325909 - RNA, 32 nt, Human
agguuucagugagccgagaucgcgccacugca

SEQ ID NO: 325910 - RNA, 32 nt, Human
agguuucagugagccgagauugugccacugca

SEQ ID NO: 325911 - RNA, 32 nt, Human
agguuucauaauuuacaaaugggaauuucauu

SEQ ID NO: 325912 - RNA, 32 nt, Human
agguuucauucugcagggauuuacuggaaucu

SEQ ID NO: 325913 - RNA, 32 nt, Human
agguuuccaagauaaaaccagagcaggaaaga

SEQ ID NO: 325914 - RNA, 32 nt, Human
agguuucccugccugucacugcucgggcagag

SEQ ID NO: 325915 - RNA, 32 nt, Human
agguuuccgcaggucugcuccccaccccugcc

SEQ ID NO: 325916 - RNA, 32 nt, Human
agguuuccuucagauugcugauugcuuauaca

SEQ ID NO: 325917 - RNA, 32 nt, Human
agguuucgagagcauuccuacucacauaagug

SEQ ID NO: 325918 - RNA, 32 nt, Human
agguuucucaaggagcuggagacuucagggag

SEQ ID NO: 325919 - RNA, 32 nt, Human
agguuucucucugccagcuccacgcuucugga

SEQ ID NO: 325920 - RNA, 32 nt, Human
agguuucuggugaaaacauggagaggaggcug

SEQ ID NO: 325921 - RNA, 32 nt, Human
agguuucuguaaccccugcccuggugugagga

SEQ ID NO: 325922 - RNA, 32 nt, Human
agguuucugucccuccccagaaccuuguagga

SEQ ID NO: 325923 - RNA, 32 nt, Human
agguuucuuuuccugucccucuuccaucccca

SEQ ID NO: 325924 - RNA, 32 nt, Human
agguuugauuucagccugcccuugccagugcc

SEQ ID NO: 325925 - RNA, 32 nt, Human
agguuugcaauccagaucugauuuucuccaac

SEQ ID NO: 325926 - RNA, 32 nt, Human
agguuugcaguuucacuccugaaaucagugua

SEQ ID NO: 325927 - RNA, 32 nt, Human
agguuugccucugcuuuuguucccugccuuuc

SEQ ID NO: 325928 - RNA, 32 nt, Human
agguuugcgccgacuccgucucccagaaauca

SEQ ID NO: 325929 - RNA, 32 nt, Human
agguuugcugcaggaggaaaguuuaauccccc

SEQ ID NO: 325930 - RNA, 32 nt, Human
agguuugcuucacucuuccaagggccuucuug

SEQ ID NO: 325931 - RNA, 32 nt, Human
agguuuggaaagccaccugagaccacuucaua

SEQ ID NO: 325932 - RNA, 32 nt, Human
agguuuggagagguaaauagcuauuucacauu

SEQ ID NO: 325933 - RNA, 32 nt, Human
agguuuggagaguguaaggaacauggcugugc

SEQ ID NO: 325934 - RNA, 32 nt, Human
agguuugggaggaugcugaggccugagaucuc

SEQ ID NO: 325935 - RNA, 32 nt, Human
agguuuggggcgaauguccugaggcagagaug

SEQ ID NO: 325936 - RNA, 32 nt, Human
agguuugguucaaacaccagacccaggcuugu

SEQ ID NO: 325937 - RNA, 32 nt, Human
agguuuguaauacuugaagcccuacauuucua

SEQ ID NO: 325938 - RNA, 32 nt, Human
agguuuguacaagccugcgcacacacagcagu

SEQ ID NO: 325939 - RNA, 32 nt, Human
agguuuguaggagacugaguuguuagcaggug

SEQ ID NO: 325940 - RNA, 32 nt, Human
agguuuguauuuucaggaaggagagaauaaca

SEQ ID NO: 325941 - RNA, 32 nt, Human
agguuugugcugcgcuuccaguuccgaaaagc

SEQ ID NO: 325942 - RNA, 32 nt, Human
agguuugugggauggggguuagcgucuaugug

SEQ ID NO: 325943 - RNA, 32 nt, Human
agguuuguuacuucccucacuucaccuccaua

SEQ ID NO: 325944 - RNA, 32 nt, Human
agguuuuaaaggccaagaaggcaguguugaaa

SEQ ID NO: 325945 - RNA, 32 nt, Human
agguuuuaagccaauucuaguaagaaauuaau

SEQ ID NO: 325946 - RNA, 32 nt, Human
agguuuuacuggcugcaccacaccccuucccc

SEQ ID NO: 325947 - RNA, 32 nt, Human
agguuuuagugagccgagauugcgccacugca

SEQ ID NO: 325948 - RNA, 32 nt, Human
agguuuuauacaccugaaagaagagaauguca

SEQ ID NO: 325949 - RNA, 32 nt, Human
agguuuucaaaaaugugagaacaguacaaagu

SEQ ID NO: 325950 - RNA, 32 nt, Human
agguuuucagaucacauuucccagagugaguu

SEQ ID NO: 325951 - RNA, 32 nt, Human
agguuuucagugauuauaccucagguauuucu

SEQ ID NO: 325952 - RNA, 32 nt, Human
agguuuucaguuaaagcccuaucugcacuuuu

SEQ ID NO: 325953 - RNA, 28 nt, Human
agguuuuccaugacugccucaucagcag

SEQ ID NO: 325954 - RNA, 32 nt, Human
agguuuucccccaaggcuuggcuuuguguagc

SEQ ID NO: 325955 - RNA, 32 nt, Human
agguuuuccugccucagaguguuggcugcacu

SEQ ID NO: 325956 - RNA, 32 nt, Human
agguuuuccuucccuuccuuuuuccccaaggu

SEQ ID NO: 325957 - RNA, 32 nt, Human
agguuuucucagaacucaauugagggugggca

SEQ ID NO: 325958 - RNA, 32 nt, Human
agguuuucuuacucugaauuuagaucuccaga

SEQ ID NO: 325959 - RNA, 32 nt, Human
agguuuugccauccacaaucccuccuacaggg

SEQ ID NO: 325960 - RNA, 24 nt, Human
agguuuuggaauuacaggugugag

SEQ ID NO: 325961 - RNA, 32 nt, Human
agguuuuggauccuuugggauucccccacggg

SEQ ID NO: 325962 - RNA, 32 nt, Human
agguuuugugagaguuuugacuggauguggcc

SEQ ID NO: 325963 - RNA, 32 nt, Human
agguuuugugugugagugcaaaauguaaacac

SEQ ID NO: 325964 - RNA, 32 nt, Human
agguuuuuacaaagggcagcauaucacacugu

SEQ ID NO: 325965 - RNA, 32 nt, Human
agguuuuuaucugguaaaauguuacacuuacu

SEQ ID NO: 325966 - RNA, 32 nt, Human
agguuuuuaucuugucuuaaauuucuuucuag

SEQ ID NO: 325967 - RNA, 23 nt, Human
agguuuuuccaguuuucugcacu

SEQ ID NO: 325968 - RNA, 32 nt, Human
agguuuuucuguggaggacugcagcauuuugg

SEQ ID NO: 325969 - RNA, 32 nt, Human
aguaaaaacagacaaaugaaacaaccuagugu

SEQ ID NO: 325970 - RNA, 32 nt, Human
aguaaaaaggaaauaguugcugaagaggaaaa

SEQ ID NO: 325971 - RNA, 32 nt, Human
aguaaaacaaauucagauguuaacuggccugc

SEQ ID NO: 325972 - RNA, 32 nt, Human
aguaaaacaacaaauagcuaccacuuuugcuc

SEQ ID NO: 325973 - RNA, 32 nt, Human
aguaaaacaagaaaaguacauucuuuagaaac

SEQ ID NO: 325974 - RNA, 32 nt, Human
aguaaaaccagcugccagccugagaagccugu

SEQ ID NO: 325975 - RNA, 32 nt, Human
aguaaaaccuuugacagaggauggauuuuuaa

SEQ ID NO: 325976 - RNA, 32 nt, Human
aguaaaacugggaggcauuuaggcuggaauag

SEQ ID NO: 325977 - RNA, 32 nt, Human
aguaaaagaaauggccucucuccucugucaga

SEQ ID NO: 325978 - RNA, 32 nt, Human
aguaaaagagcccacccuggaaccuggaucuc

SEQ ID NO: 325979 - RNA, 32 nt, Human
aguaaaagauguucuuuuucccaaagcguuuu

SEQ ID NO: 325980 - RNA, 32 nt, Human
aguaaaaggaaaugcuccuccagggagucuca

SEQ ID NO: 325981 - RNA, 32 nt, Human
aguaaaaggaggaggaagggcuggggagaaga

SEQ ID NO: 325982 - RNA, 32 nt, Human
aguaaaaguacccauuguuucacuuccuggag

SEQ ID NO: 325983 - RNA, 32 nt, Human
aguaaaagucuaccccucugaagcacuauuaa

SEQ ID NO: 325984 - RNA, 31 nt, Human
aguaaaagugggacuguuucacuggagucag

SEQ ID NO: 325985 - RNA, 32 nt, Human
aguaaaaguggucucugcuggggaaggguuuu

SEQ ID NO: 325986 - RNA, 32 nt, Human
aguaaaaucccacuuucaugcaucucugggaa

SEQ ID NO: 325987 - RNA, 32 nt, Human
aguaaaauggaaggaaauugggugcauuucua

SEQ ID NO: 325988 - RNA, 32 nt, Human
aguaaaauguacagauggaggccaaucuuaua

SEQ ID NO: 325989 - RNA, 32 nt, Human
aguaaaauuaaagucaauuaagaaauagaacu

SEQ ID NO: 325990 - RNA, 32 nt, Human
aguaaaauuuuaguaccuggagguuugacucu

SEQ ID NO: 325991 - RNA, 32 nt, Human
aguaaacacccuggggacuaggaaaaggaacc

SEQ ID NO: 325992 - RNA, 32 nt, Human
aguaaacagccaccuucuuggaaagggaaugc

SEQ ID NO: 325993 - RNA, 32 nt, Human
aguaaacaggaaggaaggaggccaucuguuca

SEQ ID NO: 325994 - RNA, 32 nt, Human
aguaaacaucucugccuuugccuguguguguu

SEQ ID NO: 325995 - RNA, 21 nt, Human
aguaaacaugacagacugaua

SEQ ID NO: 325996 - RNA, 32 nt, Human
aguaaacauugugccuuuacuacuucuuuaug

SEQ ID NO: 325997 - RNA, 32 nt, Human
aguaaaccaauacaacuguggaauaauauuuu

SEQ ID NO: 325998 - RNA, 32 nt, Human
aguaaaccauaccguggggaacaucagaugca

SEQ ID NO: 325999 - RNA, 32 nt, Human
aguaaacccaaacuuggcuggggcucagauac

SEQ ID NO: 326000 - RNA, 32 nt, Human
aguaaacccagcugccugcauugccugggacu

SEQ ID NO: 326001 - RNA, 32 nt, Human
aguaaacccuagugucaacucuggacuucagu

SEQ ID NO: 326002 - RNA, 32 nt, Human
aguaaacugccaacuccaacugccuuucugga

SEQ ID NO: 326003 - RNA, 32 nt, Human
aguaaagaacgucacuuugaaacccauucauc

SEQ ID NO: 326004 - RNA, 32 nt, Human
aguaaagacagggguuucaccaucuuggccag

SEQ ID NO: 326005 - RNA, 32 nt, Human
aguaaagacauaagcaaauaaauggucuuggu

SEQ ID NO: 326006 - RNA, 32 nt, Human
aguaaagacggggguuucaccauguuggccca

SEQ ID NO: 326007 - RNA, 32 nt, Human
aguaaagagaagaggaagggaggccauaucua

SEQ ID NO: 326008 - RNA, 32 nt, Human
aguaaagaguacacucagccacugucacaggc

SEQ ID NO: 326009 - RNA, 32 nt, Human
aguaaagaugcugaaugugacuuguuaagagg

SEQ ID NO: 326010 - RNA, 32 nt, Human
aguaaagcagacuggccugacuguguguggau

SEQ ID NO: 326011 - RNA, 32 nt, Human
aguaaagcagaggaugcaacaaauguggccaa

SEQ ID NO: 326012 - RNA, 32 nt, Human
aguaaagcauuuuauaugccugugucagcgag

SEQ ID NO: 326013 - RNA, 32 nt, Human
aguaaagcauuuucaaaacucaguauuuaaac

SEQ ID NO: 326014 - RNA, 32 nt, Human
aguaaagcccuaucaguauaaaauuugaaaga

SEQ ID NO: 326015 - RNA, 32 nt, Human
aguaaagcucaggaggugagugagucucuuga

SEQ ID NO: 326016 - RNA, 32 nt, Human
aguaaaggaggaagauggcggggugcaggggg

SEQ ID NO: 326017 - RNA, 32 nt, Human
aguaaaggcaacaagauuuccugacagauuga

SEQ ID NO: 326018 - RNA, 32 nt, Human
aguaaagggaucagccuucauggccaucauag

SEQ ID NO: 326019 - RNA, 32 nt, Human
aguaaaggggccagucuucacuggcaguggcu

SEQ ID NO: 326020 - RNA, 32 nt, Human
aguaaagugguuuuguuuguuucuuugagaug

SEQ ID NO: 326021 - RNA, 32 nt, Human
aguaaauaaaacacaggaaguauucuggugga

SEQ ID NO: 326022 - RNA, 32 nt, Human
aguaaauaagagagaggaaggaggugacguuc

SEQ ID NO: 326023 - RNA, 32 nt, Human
aguaaauacaugcuuaacaaaaggaaugagcc

SEQ ID NO: 326024 - RNA, 32 nt, Human
aguaaauagcagcuaugugugugcaaaauaaa

SEQ ID NO: 326025 - RNA, 32 nt, Human
aguaaaucaaaucuguucacaugcccacaaaa

SEQ ID NO: 326026 - RNA, 32 nt, Human
aguaaaucuauauuccgucugcuccaacacac

SEQ ID NO: 326027 - RNA, 32 nt, Human
aguaaaugaauuccagguuaaauguucacuuu

SEQ ID NO: 326028 - RNA, 32 nt, Human
aguaaaugccucauuuaauaacauacuccuuu

SEQ ID NO: 326029 - RNA, 32 nt, Human
aguaaauggagcagaggaacagguguggcagc

SEQ ID NO: 326030 - RNA, 32 nt, Human
aguaaauggggguugagggugaccuaggcagc

SEQ ID NO: 326031 - RNA, 32 nt, Human
aguaaaugguucccuucuuuccuuccuacuuu

SEQ ID NO: 326032 - RNA, 32 nt, Human
aguaaauguagcuggaauucucauaaaguuag

SEQ ID NO: 326033 - RNA, 32 nt, Human
aguaaaugucuacugagcacaaucuagugaau

SEQ ID NO: 326034 - RNA, 32 nt, Human
aguaaauuauauuguaauaaaaagguagauaa

SEQ ID NO: 326035 - RNA, 32 nt, Human
aguaaauuucugauuuuccuuuauugauuaug

SEQ ID NO: 326036 - RNA, 32 nt, Human
aguaacaaacaucacagucaacaggagcuugc

SEQ ID NO: 326037 - RNA, 32 nt, Human
aguaacaaagauccuucuaggccuucauuuua

SEQ ID NO: 326038 - RNA, 32 nt, Human
aguaacaagauggugacuucuccuuggggauc

SEQ ID NO: 326039 - RNA, 32 nt, Human
aguaacacaagucguuguaccucaguugugac

SEQ ID NO: 326040 - RNA, 32 nt, Human
aguaacacacaugagucucucccucagaagcc

SEQ ID NO: 326041 - RNA, 32 nt, Human
aguaacacauaaagaugucaccagaagacaaa

SEQ ID NO: 326042 - RNA, 32 nt, Human
aguaacacucacuucucucagaaccaucuuuu

SEQ ID NO: 326043 - RNA, 32 nt, Human
aguaacagagcagaugcuaaaccgucacagcu

SEQ ID NO: 326044 - RNA, 32 nt, Human
aguaacagcauacuuaacauuuuugugugugu

SEQ ID NO: 326045 - RNA, 32 nt, Human
aguaacagccaagaugcugcggaaucugcugg

SEQ ID NO: 326046 - RNA, 19 nt, Human
aguaacaguacuuuugguu

SEQ ID NO: 326047 - RNA, 32 nt, Human
aguaacagucaucgcccagcagugucuggccu

SEQ ID NO: 326048 - RNA, 32 nt, Human
aguaacaugaugagacccccaucucuacaaaa

SEQ ID NO: 326049 - RNA, 32 nt, Human
aguaacauuagggucuaccucuaccucaauuu

SEQ ID NO: 326050 - RNA, 32 nt, Human
aguaacauuuugcaaccaaaucugcacagauu

SEQ ID NO: 326051 - RNA, 32 nt, Human
aguaaccaaaucugugaaaauauucacaugag

SEQ ID NO: 326052 - RNA, 32 nt, Human
aguaaccaaauucccccaaagacaggaggugu

SEQ ID NO: 326053 - RNA, 24 nt, Human
aguaaccaacaaaaacuuguuuua

SEQ ID NO: 326054 - RNA, 32 nt, Human
aguaaccaacacagcaugguacugguaccaac

SEQ ID NO: 326055 - RNA, 32 nt, Human
aguaaccagaagacuuucagaugguuuauuug

SEQ ID NO: 326056 - RNA, 32 nt, Human
aguaaccagaagcccaaaugcaaugaguuucu

SEQ ID NO: 326057 - RNA, 32 nt, Human
aguaaccagcaaccuaggaacauagaagguaa

SEQ ID NO: 326058 - RNA, 32 nt, Human
aguaaccagggggcggggguggcaugggaaau

SEQ ID NO: 326059 - RNA, 32 nt, Human
aguaaccagguccuaagggugcagcccucaug

SEQ ID NO: 326060 - RNA, 32 nt, Human
aguaaccaucaacacaauuaguuuacagaaug

SEQ ID NO: 326061 - RNA, 32 nt, Human
aguaaccauggggaggaagcuggaccugucug

SEQ ID NO: 326062 - RNA, 32 nt, Human
aguaacccacagaacaucugugaucuuucuac

SEQ ID NO: 326063 - RNA, 32 nt, Human
aguaaccccuaaacucagccagucccauguuu

SEQ ID NO: 326064 - RNA, 32 nt, Human
aguaaccccuuuccugcuuuuuccugccucug

SEQ ID NO: 326065 - RNA, 19 nt, Human
aguaacccucccaucccca

SEQ ID NO: 326066 - RNA, 32 nt, Human
aguaaccucccaacuucucucccugcauucac

SEQ ID NO: 326067 - RNA, 32 nt, Human
aguaaccucucacagcuacccagcacaugcca

SEQ ID NO: 326068 - RNA, 32 nt, Human
aguaaccugcuguggucagcauagcuacagga

SEQ ID NO: 326069 - RNA, 18 nt, Human
aguaacgccacuuccaca

SEQ ID NO: 326070 - RNA, 32 nt, Human
aguaacgggguuucaccauguuggccaggcug

SEQ ID NO: 326071 - RNA, 21 nt, Human
aguaacguguucauuuugguc

SEQ ID NO: 326072 - RNA, 32 nt, Human
aguaacuacagcugcaacagacauccuccaca

SEQ ID NO: 326073 - RNA, 32 nt, Human
aguaacuaugugagugacuggugggaagagua

SEQ ID NO: 326074 - RNA, 32 nt, Human
aguaacuccccagcauuucccucuuuuucucc

SEQ ID NO: 326075 - RNA, 32 nt, Human
aguaacuccucuucccauuuuccaauccaucc

SEQ ID NO: 326076 - RNA, 32 nt, Human
aguaacugacgugugcaucaccccagaaguag

SEQ ID NO: 326077 - RNA, 32 nt, Human
aguaacugagauuacaggcacccaccaccaug

SEQ ID NO: 326078 - RNA, 32 nt, Human
aguaacugcaacuuuguugcuucuguguuuga

SEQ ID NO: 326079 - RNA, 32 nt, Human
aguaacugccaagaauuguuaacacacuugug

SEQ ID NO: 326080 - RNA, 32 nt, Human
aguaacugcccacaggcucuccagaaaacuac

SEQ ID NO: 326081 - RNA, 32 nt, Human
aguaacuggaguagcugggauuuacuaguagu

SEQ ID NO: 326082 - RNA, 32 nt, Human
aguaacuggagucacccaggaagcaagaggcg

SEQ ID NO: 326083 - RNA, 32 nt, Human
aguaacugggauuacaggcacccgccaccaug

SEQ ID NO: 326084 - RNA, 32 nt, Human
aguaacugggauuacaggcaugcaccaccaug

SEQ ID NO: 326085 - RNA, 32 nt, Human
aguaacugggauuacaggcaugcgccaccaua

SEQ ID NO: 326086 - RNA, 32 nt, Human
aguaacugggauuacaggcaugcgccaccaug

SEQ ID NO: 326087 - RNA, 32 nt, Human
aguaacugggauuacaggcaugcgccacuaag

SEQ ID NO: 326088 - RNA, 32 nt, Human
aguaacugggauuacaggcaugugccaucacg

SEQ ID NO: 326089 - RNA, 32 nt, Human
aguaacugggauuacaggcaugugucaccaug

SEQ ID NO: 326090 - RNA, 32 nt, Human
aguaacugggauuacaggcuugugccaccgca

SEQ ID NO: 326091 - RNA, 32 nt, Human
aguaacugggauuacaggugugugccaccaca

SEQ ID NO: 326092 - RNA, 32 nt, Human
aguaacugggauuacagucgugugccaccacg

SEQ ID NO: 326093 - RNA, 32 nt, Human
aguaacugugugagccuugggcaaguuacuca

SEQ ID NO: 326094 - RNA, 32 nt, Human
aguaacuguuaucuccucuccuaaggagauga

SEQ ID NO: 326095 - RNA, 32 nt, Human
aguaacuucaugaauacuacaaacuuccaguc

SEQ ID NO: 326096 - RNA, 32 nt, Human
aguaacuucuuauggaauugauuugcauugaa

SEQ ID NO: 326097 - RNA, 32 nt, Human
aguaacuuuggucagggauucucacuagcagc

SEQ ID NO: 326098 - RNA, 32 nt, Human
aguaagaaaagcuuuccuaaagucccauacau

SEQ ID NO: 326099 - RNA, 32 nt, Human
aguaagaaaaugcagaggcucgggcuuguuug

SEQ ID NO: 326100 - RNA, 32 nt, Human
aguaagaaaccaggagcguuuccaguuccacc

SEQ ID NO: 326101 - RNA, 32 nt, Human
aguaagaagaaggaaaacacagcacgcuggag

SEQ ID NO: 326102 - RNA, 32 nt, Human
aguaagaagaggaggaggccaggcaggcaaaa

SEQ ID NO: 326103 - RNA, 32 nt, Human
aguaagacagcuuuaauucauccuuuuuguuu

SEQ ID NO: 326104 - RNA, 32 nt, Human
aguaagacaggcacagcuaaagugcucucugg

SEQ ID NO: 326105 - RNA, 32 nt, Human
aguaagaccaggaugucucugaaauggacguc

SEQ ID NO: 326106 - RNA, 32 nt, Human
aguaagaccuggggcuugagggguggggaaug

SEQ ID NO: 326107 - RNA, 32 nt, Human
aguaagaccuucugaucuucugaccuucugug

SEQ ID NO: 326108 - RNA, 32 nt, Human
aguaagacucgugccucccccugcugcccugg

SEQ ID NO: 326109 - RNA, 32 nt, Human
aguaagacuugugcuuguuagcagguuuuucu

SEQ ID NO: 326110 - RNA, 32 nt, Human
aguaagagaacacaaucucuguuucuucaaug

SEQ ID NO: 326111 - RNA, 32 nt, Human
aguaagagacgggguuuugccauguuggccag

SEQ ID NO: 326112 - RNA, 32 nt, Human
aguaagagggaaaggaaaagagguaucaagua

SEQ ID NO: 326113 - RNA, 32 nt, Human
aguaagaguaagaccuguuguuuuggaagguc

SEQ ID NO: 326114 - RNA, 32 nt, Human
aguaagaguucugcauuugauauccugguuua

SEQ ID NO: 326115 - RNA, 32 nt, Human
aguaagauaaacucaacuaucucuugggaaga

SEQ ID NO: 326116 - RNA, 32 nt, Human
aguaagauaaauaauauaaagcacuuagaaca

SEQ ID NO: 326117 - RNA, 32 nt, Human
aguaagaugagcuagagaaaauaaccuggucu

SEQ ID NO: 326118 - RNA, 32 nt, Human
aguaagaugcacugaaaacuuagccagaguua

SEQ ID NO: 326119 - RNA, 32 nt, Human
aguaagauuuuuaaagacagaaagccacagga

SEQ ID NO: 326120 - RNA, 32 nt, Human
aguaagcaaggucuuuguggggcaguugucga

SEQ ID NO: 326121 - RNA, 32 nt, Human
aguaagcacaccaacagaacugaguuccagaa

SEQ ID NO: 326122 - RNA, 32 nt, Human
aguaagcacagcugccccugccugagaaggag

SEQ ID NO: 326123 - RNA, 32 nt, Human
aguaagcaccagcugccucuuugcugcuuugu

SEQ ID NO: 326124 - RNA, 32 nt, Human
aguaagcacuuaaggcaaacaguggauggcac

SEQ ID NO: 326125 - RNA, 32 nt, Human
aguaagcagcuugccaaucacuccaggucuga

SEQ ID NO: 326126 - RNA, 32 nt, Human
aguaagcaggagacuuaggauuugugcuguag

SEQ ID NO: 326127 - RNA, 32 nt, Human
aguaagccacugccucuuaccuaaaggucagc

SEQ ID NO: 326128 - RNA, 32 nt, Human
aguaagcccacuguugagaccuagugcucaga

SEQ ID NO: 326129 - RNA, 32 nt, Human
aguaagcugaggacaguguuuauuaugacuau

SEQ ID NO: 326130 - RNA, 32 nt, Human
aguaagcuggacacagagguguagugugcggg

SEQ ID NO: 326131 - RNA, 32 nt, Human
aguaagcuuuagaccaggacgauucagguuau

SEQ ID NO: 326132 - RNA, 32 nt, Human
aguaagcuuuauuuguagcuucugccuuguuu

SEQ ID NO: 326133 - RNA, 32 nt, Human
aguaaggagaaauuaagaccagcuggcuguua

SEQ ID NO: 326134 - RNA, 32 nt, Human
aguaaggagcuuccaugcuucauucccuggca

SEQ ID NO: 326135 - RNA, 32 nt, Human
aguaaggccuauggggcuggaggaucacaggg

SEQ ID NO: 326136 - RNA, 18 nt, Human
aguaaggcugucuugguu

SEQ ID NO: 326137 - RNA, 32 nt, Human
aguaaggcuuugcagaagugauauugcauuag

SEQ ID NO: 326138 - RNA, 32 nt, Human
aguaagggaagaggagaggaaggggagccgga

SEQ ID NO: 326139 - RNA, 32 nt, Human
aguaaggggagaaaggacccugcccucccugu

SEQ ID NO: 326140 - RNA, 32 nt, Human
aguaagggucucaaaugcaaugucaaagagcu

SEQ ID NO: 326141 - RNA, 32 nt, Human
aguaaguacaacauuuuuaacucucauuuggc

SEQ ID NO: 326142 - RNA, 32 nt, Human
aguaaguagggagauuugauaagcauaucuuu

SEQ ID NO: 326143 - RNA, 31 nt, Human
aguaagucaguguccccaacagcagaugagg

SEQ ID NO: 326144 - RNA, 32 nt, Human
aguaagugaggaagaaaugagugaagaugaag

SEQ ID NO: 326145 - RNA, 32 nt, Human
aguaagugaugagggccucugcauuuauaugc

SEQ ID NO: 326146 - RNA, 32 nt, Human
aguaagugcucccacagcuguggcagagguuc

SEQ ID NO: 326147 - RNA, 32 nt, Human
aguaagugggcaagaggcggcaggaagugggu

SEQ ID NO: 326148 - RNA, 32 nt, Human
aguaagugucugcagaugcaaguuuggaagag

SEQ ID NO: 326149 - RNA, 32 nt, Human
aguaaguucuccccauuuuaguuuucuaggac

SEQ ID NO: 326150 - RNA, 32 nt, Human
aguaaguuguuccaaaugauccugaagaaauc

SEQ ID NO: 326151 - RNA, 32 nt, Human
aguaauaacuuagguucuauuaaaaccuaauu

SEQ ID NO: 326152 - RNA, 32 nt, Human
aguaauacuggaggcagaguagggggugguug

SEQ ID NO: 326153 - RNA, 17 nt, Human
aguaauagcauaugguu

SEQ ID NO: 326154 - RNA, 17 nt, Human
aguaauaggauuugguu

SEQ ID NO: 326155 - RNA, 32 nt, Human
aguaauaguauuagcuuuuguauucugagauu

SEQ ID NO: 326156 - RNA, 32 nt, Human
aguaauauaaggaccuguucuggacacagcac

SEQ ID NO: 326157 - RNA, 17 nt, Human
aguaauauuuuuugguc

SEQ ID NO: 326158 - RNA, 31 nt, Human
aguaaucagugcauauuuuguugaaacuccu

SEQ ID NO: 326159 - RNA, 32 nt, Human
aguaaucauucaaccaacgcuuccaugucucu

SEQ ID NO: 326160 - RNA, 32 nt, Human
aguaauccacauaaugcauaagccacaccaaa

SEQ ID NO: 326161 - RNA, 32 nt, Human
aguaaucccgccacugcacucuagccugggug

SEQ ID NO: 326162 - RNA, 32 nt, Human
aguaauccucccaccccagccucccagguagc

SEQ ID NO: 326163 - RNA, 32 nt, Human
aguaauccucuuucugcucaccccaggcagac

SEQ ID NO: 326164 - RNA, 21 nt, Human
aguaaucugggacaucuuagu

SEQ ID NO: 326165 - RNA, 32 nt, Human
aguaaucuugccaaagguaaaggggcuaguug

SEQ ID NO: 326166 - RNA, 32 nt, Human
aguaaugaagccaccauuauguccucagucag

SEQ ID NO: 326167 - RNA, 32 nt, Human
aguaaugaaggacuccacugugccccacuuuc

SEQ ID NO: 326168 - RNA, 32 nt, Human
aguaaugaaucaaugaauaaauaaugagcuag

SEQ ID NO: 326169 - RNA, 32 nt, Human
aguaaugacccugguugguugcaggagguacc

SEQ ID NO: 326170 - RNA, 32 nt, Human
aguaaugaggaaacugagcauuucuuuugccc

SEQ ID NO: 326171 - RNA, 32 nt, Human
aguaaugagggcacugaacaccaauucuuuac

SEQ ID NO: 326172 - RNA, 32 nt, Human
aguaaugauuuccuuagcagaagccguauuug

SEQ ID NO: 326173 - RNA, 32 nt, Human
aguaaugcaaagugcauuuuugucucuaagua

SEQ ID NO: 326174 - RNA, 32 nt, Human
aguaaugcugggaaggagcagcagagucuggg

SEQ ID NO: 326175 - RNA, 32 nt, Human
aguaauggaaggauaaaggaaaagaggaaguu

SEQ ID NO: 326176 - RNA, 29 nt, Human
aguaauggauucacauacagaaaaugaag

SEQ ID NO: 326177 - RNA, 19 nt, Human
aguaaugggauugcugguc

SEQ ID NO: 326178 - RNA, 17 nt, Human
aguaaugggcacuuagu

SEQ ID NO: 326179 - RNA, 32 nt, Human
aguaaugggcugggcuugguggcucacuccug

SEQ ID NO: 326180 - RNA, 32 nt, Human
aguaaugucauuguguuugaccuugaaggaaa

SEQ ID NO: 326181 - RNA, 32 nt, Human
aguaaugugcuagagagacacaugcucccuuc

SEQ ID NO: 326182 - RNA, 32 nt, Human
aguaauuagaaggggagagggagagaggggga

SEQ ID NO: 326183 - RNA, 32 nt, Human
aguaauucagcccuaucucucccagcagaggu

SEQ ID NO: 326184 - RNA, 32 nt, Human
aguaauucauacuugaggaccaugacuguggg

SEQ ID NO: 326185 - RNA, 32 nt, Human
aguaauuccuguaaugucagauuuugauuuua

SEQ ID NO: 326186 - RNA, 32 nt, Human
aguaauugcaggaagauugaagaaaaauccuc

SEQ ID NO: 326187 - RNA, 32 nt, Human
aguaauugcagguuguccagagguugguuugu

SEQ ID NO: 326188 - RNA, 32 nt, Human
aguaauugucagccuaucaacauaguguaguc

SEQ ID NO: 326189 - RNA, 32 nt, Human
aguaauuuacagagaaaucacagacuuuugcu

SEQ ID NO: 326190 - RNA, 32 nt, Human
aguaauuuagagauaagccaugcauacaaguu

SEQ ID NO: 326191 - RNA, 21 nt, Human
aguaauuucaguuucuuucca

SEQ ID NO: 326192 - RNA, 32 nt, Human
aguaauuucccuuuuugcagcuuuuccucagg

SEQ ID NO: 326193 - RNA, 32 nt, Human
aguaauuuccugaccauuuaugcaucagugua

SEQ ID NO: 326194 - RNA, 32 nt, Human
aguaauuuuaacauaaaggguuggauuuagga

SEQ ID NO: 326195 - RNA, 32 nt, Human
aguaauuuuggaccagugaacuguuagcaaca

SEQ ID NO: 326196 - RNA, 32 nt, Human
aguaauuuuguauccagugaccccugucccuu

SEQ ID NO: 326197 - RNA, 32 nt, Human
aguaauuuuguguccagugaccccugucccuu

SEQ ID NO: 326198 - RNA, 23 nt, Human
aguaauuuuucuaaaaaugagga

SEQ ID NO: 326199 - RNA, 24 nt, Human
aguaauuuuucuaaaguauuggga

SEQ ID NO: 326200 - RNA, 23 nt, Human
aguaauuuuuguaaguaaugaga

SEQ ID NO: 326201 - RNA, 31 nt, Human
aguacaaacacuucuuuacauuuaaguuuug

SEQ ID NO: 326202 - RNA, 32 nt, Human
aguacaaacucauggccaaucagcuccgggag

SEQ ID NO: 326203 - RNA, 32 nt, Human
aguacaaacugcuuugaccuccuugaacuuuu

SEQ ID NO: 326204 - RNA, 32 nt, Human
aguacaaaggcagagugagggggcuuguggcu

SEQ ID NO: 326205 - RNA, 32 nt, Human
aguacaacagaaaauuuggacagacuucaauu

SEQ ID NO: 326206 - RNA, 32 nt, Human
aguacaagaagagguacucggagcuggagcag

SEQ ID NO: 326207 - RNA, 32 nt, Human
aguacaagaccacugucuaauuuugacuucau

SEQ ID NO: 326208 - RNA, 32 nt, Human
aguacaaggaucaggccuaaaauagcuccuug

SEQ ID NO: 326209 - RNA, 32 nt, Human
aguacaagggaaggauuaugcucugcagauac

SEQ ID NO: 326210 - RNA, 32 nt, Human
aguacaagggagcugacccuggguagaacggg

SEQ ID NO: 326211 - RNA, 32 nt, Human
aguacacacuguuggcaaaaggcuaacaccug

SEQ ID NO: 326212 - RNA, 21 nt, Human
aguacacagcccaggaaucca

SEQ ID NO: 326213 - RNA, 20 nt, Human
aguacacagugacccaggag

SEQ ID NO: 326214 - RNA, 32 nt, Human
aguacacccuccucccccuugggcuagcaucc

SEQ ID NO: 326215 - RNA, 32 nt, Human
aguacaccgugccagcucuguucccucuuaca

SEQ ID NO: 326216 - RNA, 32 nt, Human
aguacaccgugcuccggcuaaugauucgacag

SEQ ID NO: 326217 - RNA, 32 nt, Human
aguacacuccaaugucucuuuugcaagaguuu

SEQ ID NO: 326218 - RNA, 19 nt, Human
aguacagacuaauuuuuaa

SEQ ID NO: 326219 - RNA, 24 nt, Human
aguacagacugaaaggaaaauaga

SEQ ID NO: 326220 - RNA, 32 nt, Human
aguacagagaggugugggaugucagaacaucc

SEQ ID NO: 326221 - RNA, 32 nt, Human
aguacagagcagucaccaucugaucuucauca

SEQ ID NO: 326222 - RNA, 32 nt, Human
aguacagaugcauguaugugaucugcagaagc

SEQ ID NO: 326223 - RNA, 32 nt, Human
aguacagauggaaaccauuuccuacaucacaa

SEQ ID NO: 326224 - RNA, 32 nt, Human
aguacagcaagaggagagaggucaagcgagaa

SEQ ID NO: 326225 - RNA, 32 nt, Human
aguacagcaagggggcagugagcuuggcccuc

SEQ ID NO: 326226 - RNA, 32 nt, Human
aguacagcauuuacucuuaucaucuagaaaug

SEQ ID NO: 326227 - RNA, 32 nt, Human
aguacagcgaagaagaaagggaaguauuucuu

SEQ ID NO: 326228 - RNA, 32 nt, Human
aguacagcuagacccagaaauuuggaaggcug

SEQ ID NO: 326229 - RNA, 20 nt, Human
aguacagcuugcauauuuaa

SEQ ID NO: 326230 - RNA, 32 nt, Human
aguacaggaagagauucuguuauagcucagcu

SEQ ID NO: 326231 - RNA, 21 nt, Human
aguacaggagcuguugcuuaa

SEQ ID NO: 326232 - RNA, 32 nt, Human
aguacaggcugugaaguaucugaccuguguua

SEQ ID NO: 326233 - RNA, 32 nt, Human
aguacagggaccuuggcagguggagaggagga

SEQ ID NO: 326234 - RNA, 32 nt, Human
aguacagggauuagaguugugagccaccgcug

SEQ ID NO: 326235 - RNA, 32 nt, Human
aguacaggggccugguccgcaaagggaagaaa

SEQ ID NO: 326236 - RNA, 32 nt, Human
aguacaggggcugagggaggaggcagggccug

SEQ ID NO: 326237 - RNA, 32 nt, Human
aguacagggucugaguucugaauggagagcau

SEQ ID NO: 326238 - RNA, 19 nt, Human
aguacagguuuugcccuga

SEQ ID NO: 326239 - RNA, 19 nt, Human
aguacagucccagcacauu

SEQ ID NO: 326240 - RNA, 22 nt, Human
aguacaguggagcaaugccuga

SEQ ID NO: 326241 - RNA, 16 nt, Human
aguacaguggcauucc

SEQ ID NO: 326242 - RNA, 32 nt, Human
aguacaguggcuucaagaguccuuacugaagc

SEQ ID NO: 326243 - RNA, 22 nt, Human
aguacaguuguuacauauuuaa

SEQ ID NO: 326244 - RNA, 32 nt, Human
aguacaguuugaaaucaaguaguguggcaucu

SEQ ID NO: 326245 - RNA, 32 nt, Human
aguacauaaauagagagaaaacauuuguauau

SEQ ID NO: 326246 - RNA, 32 nt, Human
aguacauacaguguccagcacacaggaagccc

SEQ ID NO: 326247 - RNA, 32 nt, Human
aguacaucaggaaccgcuaccugugaaagagc

SEQ ID NO: 326248 - RNA, 32 nt, Human
aguacaucauuccuccucacuaggagcacuuu

SEQ ID NO: 326249 - RNA, 32 nt, Human
aguacauccagccuuaguucuuggggugcagu

SEQ ID NO: 326250 - RNA, 32 nt, Human
aguacaucccaagcagcaggcacacaagcaaa

SEQ ID NO: 326251 - RNA, 32 nt, Human
aguacaucuaugggcugugauucccccuugcc

SEQ ID NO: 326252 - RNA, 32 nt, Human
aguacaucugcugacgaugaugauggaucaau

SEQ ID NO: 326253 - RNA, 32 nt, Human
aguacauuagauucgcuggcuguuaugaucag

SEQ ID NO: 326254 - RNA, 32 nt, Human
aguacauugauuuuacaguuauuuugaaauac

SEQ ID NO: 326255 - RNA, 32 nt, Human
aguacauuuccuuguguuaccacgcaugggga

SEQ ID NO: 326256 - RNA, 32 nt, Human
aguacauuucucaaagauuuuugagguuguau

SEQ ID NO: 326257 - RNA, 24 nt, Human
aguacauuuugagacaguauucua

SEQ ID NO: 326258 - RNA, 32 nt, Human
aguaccaaaguaacugaauuauuucaggaagg

SEQ ID NO: 326259 - RNA, 32 nt, Human
aguaccacggaaggaagggcacugugaagcag

SEQ ID NO: 326260 - RNA, 32 nt, Human
aguaccacuccauccagccuugggcaagaugc

SEQ ID NO: 326261 - RNA, 32 nt, Human
aguaccacugcacuccagccugggcaacagag

SEQ ID NO: 326262 - RNA, 32 nt, Human
aguaccacugcacuccagccugggcgacagag

SEQ ID NO: 326263 - RNA, 32 nt, Human
aguaccagaguuuacagagagggugggcgaag

SEQ ID NO: 326264 - RNA, 32 nt, Human
aguaccagcagcccuggagagcagcagggggc

SEQ ID NO: 326265 - RNA, 32 nt, Human
aguaccagcagcccuggagagcagcagggggu

SEQ ID NO: 326266 - RNA, 32 nt, Human
aguaccagcuacucgagaggcugagucaggag

SEQ ID NO: 326267 - RNA, 32 nt, Human
aguaccagcuacucuggaggcugaggcaggag

SEQ ID NO: 326268 - RNA, 32 nt, Human
aguaccaggagaacaguggccacgaggggccc

SEQ ID NO: 326269 - RNA, 32 nt, Human
aguaccaggauuauaggcaugagccacugugc

SEQ ID NO: 326270 - RNA, 32 nt, Human
aguaccaggcaaagauuuucuucaacuauagu

SEQ ID NO: 326271 - RNA, 32 nt, Human
aguaccaggcagugaauaagcccuaggcagaa

SEQ ID NO: 326272 - RNA, 32 nt, Human
aguaccaggccgcccgagccacccugcucaga

SEQ ID NO: 326273 - RNA, 20 nt, Human
aguaccagggcugauaucua

SEQ ID NO: 326274 - RNA, 22 nt, Human
aguaccauaggcgacgcugcug

SEQ ID NO: 326275 - RNA, 32 nt, Human
aguaccaugguucugacagagacugggggacc

SEQ ID NO: 326276 - RNA, 32 nt, Human
aguaccauuagcuacagugaucuuagcuuccu

SEQ ID NO: 326277 - RNA, 32 nt, Human
aguaccauuauaagcaucucccaucugcuuuu

SEQ ID NO: 326278 - RNA, 23 nt, Human
aguaccauucacuggaguugcug

SEQ ID NO: 326279 - RNA, 32 nt, Human
aguaccauuccaggcugggcguggugacucac

SEQ ID NO: 326280 - RNA, 32 nt, Human
aguacccacaccaucaccacugcuuucucuuc

SEQ ID NO: 326281 - RNA, 31 nt, Human
aguacccagauguccaucagagguagaccag

SEQ ID NO: 326282 - RNA, 32 nt, Human
aguacccaggggcuaaggauuaagaccuguca

SEQ ID NO: 326283 - RNA, 32 nt, Human
aguacccauucaucacaccugccccauagccc

SEQ ID NO: 326284 - RNA, 32 nt, Human
aguacccauuuccucacauccuugccaguacu

SEQ ID NO: 326285 - RNA, 20 nt, Human
aguaccccgcccucuucucc

SEQ ID NO: 326286 - RNA, 32 nt, Human
aguaccccggguggggcgagggccagucaugg

SEQ ID NO: 326287 - RNA, 32 nt, Human
aguacccguuuuaaguaagacaugguuuucca

SEQ ID NO: 326288 - RNA, 32 nt, Human
aguacccucucauggcauaggcugcaacccag

SEQ ID NO: 326289 - RNA, 19 nt, Human
aguacccucuuucuugcca

SEQ ID NO: 326290 - RNA, 29 nt, Human
aguaccggcagcugcucauccccugugca

SEQ ID NO: 326291 - RNA, 32 nt, Human
aguaccuaaagaggagcgaagggauuuauaca

SEQ ID NO: 326292 - RNA, 32 nt, Human
aguaccuagagcccagcugaacaacaaggcuu

SEQ ID NO: 326293 - RNA, 32 nt, Human
aguaccuauguaugagcaggcagcagcagggc

SEQ ID NO: 326294 - RNA, 25 nt, Human
aguaccucagagcaccccacugcuc

SEQ ID NO: 326295 - RNA, 32 nt, Human
aguaccucaguagcuacugccaaaaagccuga

SEQ ID NO: 326296 - RNA, 32 nt, Human
aguaccuccagccccagggcccugaccugcgc

SEQ ID NO: 326297 - RNA, 32 nt, Human
aguaccucuccaccauccuccagucguugccc

SEQ ID NO: 326298 - RNA, 32 nt, Human
aguaccucuugaguuaauuuucugccuccagu

SEQ ID NO: 326299 - RNA, 32 nt, Human
aguaccugaaaugugauuguugcaguguucag

SEQ ID NO: 326300 - RNA, 32 nt, Human
aguaccugacuaaaaaugaaguaauacccuua

SEQ ID NO: 326301 - RNA, 32 nt, Human
aguaccugagauuacaggcacccaccaccaug

SEQ ID NO: 326302 - RNA, 32 nt, Human
aguaccugaggaguggaggagugagaaagaag

SEQ ID NO: 326303 - RNA, 18 nt, Human
aguaccugcaucuugguu

SEQ ID NO: 326304 - RNA, 32 nt, Human
aguaccugggauuacaggagcucccaccaagc

SEQ ID NO: 326305 - RNA, 32 nt, Human
aguaccugggauuacaggcaugcaccaccaug

SEQ ID NO: 326306 - RNA, 32 nt, Human
aguaccugggauuacaggcaugugccaccaca

SEQ ID NO: 326307 - RNA, 32 nt, Human
aguaccugggauuacaggcaugugccaccacg

SEQ ID NO: 326308 - RNA, 32 nt, Human
aguaccugggauuacagguagacaccaucacg

SEQ ID NO: 326309 - RNA, 32 nt, Human
aguaccugggauuacaggugcacaccaccacg

SEQ ID NO: 326310 - RNA, 32 nt, Human
aguaccuguaagucccagcuacucaggaggcu

SEQ ID NO: 326311 - RNA, 32 nt, Human
aguaccuguacagcgcucggcacuuugacagc

SEQ ID NO: 326312 - RNA, 32 nt, Human
aguaccuguagucucagcuauugggaggcuga

SEQ ID NO: 326313 - RNA, 32 nt, Human
aguaccugucguaggagauuuggguagaagcc

SEQ ID NO: 326314 - RNA, 32 nt, Human
aguaccuuaacacaaaguauaacucuguagag

SEQ ID NO: 326315 - RNA, 32 nt, Human
aguaccuucugccuccuccauucuuccugggu

SEQ ID NO: 326316 - RNA, 32 nt, Human
aguaccuugcagcauuucucugccauugcuuu

SEQ ID NO: 326317 - RNA, 32 nt, Human
aguaccuugcagcuguauugcucaccugcuuu

SEQ ID NO: 326318 - RNA, 32 nt, Human
aguacgccugguccaccaucagccacggacag

SEQ ID NO: 326319 - RNA, 32 nt, Human
aguacggaagaugcguauggucucagccaagu

SEQ ID NO: 326320 - RNA, 21 nt, Human
aguacggauuuuaauagccug

SEQ ID NO: 326321 - RNA, 21 nt, Human
aguacggggagcagacuccug

SEQ ID NO: 326322 - RNA, 25 nt, Human
aguacgucuuugucuuaaugaucua

SEQ ID NO: 326323 - RNA, 32 nt, Human
aguacgugaggaagaaaaaugucugaaaagca

SEQ ID NO: 326324 - RNA, 32 nt, Human
aguacgugaguuguuccucaggaauagauuuu

SEQ ID NO: 326325 - RNA, 32 nt, Human
aguacgugggcaagacuagccugguggagcgc

SEQ ID NO: 326326 - RNA, 32 nt, Human
aguacuaaaaucaacccucagccucuucaaug

SEQ ID NO: 326327 - RNA, 32 nt, Human
aguacuaacagcuuccuucagaucuggaagcc

SEQ ID NO: 326328 - RNA, 32 nt, Human
aguacuaacucuuuggaucucccuuuaaagug

SEQ ID NO: 326329 - RNA, 32 nt, Human
aguacuaagcaaggagacagaaugcuuuguuc

SEQ ID NO: 326330 - RNA, 32 nt, Human
aguacuagaguuguuucccaaucacccuacuc

SEQ ID NO: 326331 - RNA, 32 nt, Human
aguacuaggagcauugguugcaguggaggagu

SEQ ID NO: 326332 - RNA, 32 nt, Human
aguacuaugcugcagucgggggagagguggau

SEQ ID NO: 326333 - RNA, 31 nt, Human
aguacucaacuggacaucacagcagaaugaa

SEQ ID NO: 326334 - RNA, 32 nt, Human
aguacucaaucagcugccacuaccaccaucca

SEQ ID NO: 326335 - RNA, 32 nt, Human
aguacucagcauggucuuaugcacaggaacua

SEQ ID NO: 326336 - RNA, 32 nt, Human
aguacucaggcagugcaauacucagugcggua

SEQ ID NO: 326337 - RNA, 32 nt, Human
aguacuccaaccugcaggaaaaauuuggagug

SEQ ID NO: 326338 - RNA, 21 nt, Human
aguacuccacacugcacaaua

SEQ ID NO: 326339 - RNA, 32 nt, Human
aguacuccugcucugcuaacccugcgugcacc

SEQ ID NO: 326340 - RNA, 32 nt, Human
aguacuccuggucuuucuuucugcuaugagaa

SEQ ID NO: 326341 - RNA, 32 nt, Human
aguacucggacuccugugcuaauugucagcuu

SEQ ID NO: 326342 - RNA, 24 nt, Human
aguacucuaaauagaucucauuga

SEQ ID NO: 326343 - RNA, 32 nt, Human
aguacucugcauaagggggaaaagcuuccaga

SEQ ID NO: 326344 - RNA, 32 nt, Human
aguacucuuguacagccaguucuuuuaugcaa

SEQ ID NO: 326345 - RNA, 32 nt, Human
aguacugacccuggaucccuguucacugcguu

SEQ ID NO: 326346 - RNA, 32 nt, Human
aguacugacuuuucagcaaauuuccuuucugg

SEQ ID NO: 326347 - RNA, 32 nt, Human
aguacugagguuugaggaaaaauaaauguuga

SEQ ID NO: 326348 - RNA, 32 nt, Human
aguacugcaaccugacaggaugcucagacaag

SEQ ID NO: 326349 - RNA, 32 nt, Human
aguacugcaggaauaaaccaggagagcugaga

SEQ ID NO: 326350 - RNA, 32 nt, Human
aguacugccccaggccagccagccugccugcc

SEQ ID NO: 326351 - RNA, 32 nt, Human
aguacugccugcagagggugaccgaggcccgg

SEQ ID NO: 326352 - RNA, 32 nt, Human
aguacugcgcguucuaagacuuuuggcggaga

SEQ ID NO: 326353 - RNA, 32 nt, Human
aguacugcucuucuuuuuauggggaaauugau

SEQ ID NO: 326354 - RNA, 23 nt, Human
aguacugcucuuguuucuuuuca

SEQ ID NO: 326355 - RNA, 32 nt, Human
aguacugcugcuacugcuucuacaauguaaaa

SEQ ID NO: 326356 - RNA, 32 nt, Human
aguacuggaagucucgccacagcaaucaggca

SEQ ID NO: 326357 - RNA, 32 nt, Human
aguacuggagccaggaaggaagaagagggagg

SEQ ID NO: 326358 - RNA, 32 nt, Human
aguacugggaaaggggagcccauaguacuggg

SEQ ID NO: 326359 - RNA, 32 nt, Human
aguacugggaaaggggagggcacagcacuggg

SEQ ID NO: 326360 - RNA, 32 nt, Human
aguacugggaaaugggggcucacagcacugca

SEQ ID NO: 326361 - RNA, 32 nt, Human
aguacugggauuacaagcauaagccaccgggc

SEQ ID NO: 326362 - RNA, 32 nt, Human
aguacugggauuacaggcaugaaccaccgugg

SEQ ID NO: 326363 - RNA, 32 nt, Human
aguacugggauuacaggcaugagccaccacac

SEQ ID NO: 326364 - RNA, 32 nt, Human
aguacugggauuacaggcaugagccacugcac

SEQ ID NO: 326365 - RNA, 32 nt, Human
aguacugggauuacaggccugagccaccgcgc

SEQ ID NO: 326366 - RNA, 32 nt, Human
aguacugggauuacaggcgugaaccacugccc

SEQ ID NO: 326367 - RNA, 32 nt, Human
aguacugggauuacaggcgugagccaccacgc

SEQ ID NO: 326368 - RNA, 32 nt, Human
aguacugggauuacaggcgugagccaccacuc

SEQ ID NO: 326369 - RNA, 32 nt, Human
aguacugggauuacaggcgugagccaccaugc

SEQ ID NO: 326370 - RNA, 32 nt, Human
aguacugggauuacaggcgugagccaccgugc

SEQ ID NO: 326371 - RNA, 32 nt, Human
aguacugggauuacaggcgugagccaccucgc

SEQ ID NO: 326372 - RNA, 32 nt, Human
aguacugggauuacaggcgugagccacggcac

SEQ ID NO: 326373 - RNA, 32 nt, Human
aguacugggauuacaggcgugagccacugcac

SEQ ID NO: 326374 - RNA, 32 nt, Human
aguacugggauuacaggcgugagccacugugc

SEQ ID NO: 326375 - RNA, 19 nt, Human
aguacugggauuacaggug

SEQ ID NO: 326376 - RNA, 32 nt, Human
aguacugggauuacaggugagagucacugcuc

SEQ ID NO: 326377 - RNA, 32 nt, Human
aguacugggauuauaggcaugagccaccacgc

SEQ ID NO: 326378 - RNA, 32 nt, Human
aguacugggauuauaggcgugagccacggcau

SEQ ID NO: 326379 - RNA, 32 nt, Human
aguacugggauuauaggcuugagccaccacgc

SEQ ID NO: 326380 - RNA, 19 nt, Human
aguacugggauuauaggug

SEQ ID NO: 326381 - RNA, 32 nt, Human
aguacugggauuauaggugugaaccaccauac

SEQ ID NO: 326382 - RNA, 32 nt, Human
aguacugggauuauaggugugagcuacuguac

SEQ ID NO: 326383 - RNA, 32 nt, Human
aguacugggauuauauaggcaugagccacuga

SEQ ID NO: 326384 - RNA, 32 nt, Human
aguacugggcagcugcuauccccaucucccug

SEQ ID NO: 326385 - RNA, 22 nt, Human
aguacugggcaggcugcaaaug

SEQ ID NO: 326386 - RNA, 32 nt, Human
aguacuggggucccccuggggcccucuuuacu

SEQ ID NO: 326387 - RNA, 32 nt, Human
aguacugggguuacagaugugagccacuucgc

SEQ ID NO: 326388 - RNA, 32 nt, Human
aguacugggugcuggagggagagcucggggcc

SEQ ID NO: 326389 - RNA, 32 nt, Human
aguacuggguuuacaggugugagccacugugc

SEQ ID NO: 326390 - RNA, 21 nt, Human
aguacuguacuagagcuguug

SEQ ID NO: 326391 - RNA, 32 nt, Human
aguacugucaucugcauuauaacggacuguga

SEQ ID NO: 326392 - RNA, 32 nt, Human
aguacugucaucugcauuauacggacugugau

SEQ ID NO: 326393 - RNA, 18 nt, Human
aguacugucuagcuacca

SEQ ID NO: 326394 - RNA, 32 nt, Human
aguacugugcagccccgcccucugcguccccc

SEQ ID NO: 326395 - RNA, 32 nt, Human
aguacugugugugaccuucuuccagaagcacg

SEQ ID NO: 326396 - RNA, 32 nt, Human
aguacuguuguccaggcuggagcgcaguugau

SEQ ID NO: 326397 - RNA, 32 nt, Human
aguacuuaccauuguguuacaguguccuacag

SEQ ID NO: 326398 - RNA, 32 nt, Human
aguacuuacccuucucagguuccucagugcag

SEQ ID NO: 326399 - RNA, 32 nt, Human
aguacuuagggagguuggugucagaggcagga

SEQ ID NO: 326400 - RNA, 32 nt, Human
aguacuuauguagccaaaaagcauuugaaauc

SEQ ID NO: 326401 - RNA, 27 nt, Human
aguacuucaccugcaagaugcacaaua

SEQ ID NO: 326402 - RNA, 32 nt, Human
aguacuucacuacccacuaucuuauucagucc

SEQ ID NO: 326403 - RNA, 32 nt, Human
aguacuucaggcacgcugccuccugguaacag

SEQ ID NO: 326404 - RNA, 24 nt, Human
aguacuucaggcugggcacagugg

SEQ ID NO: 326405 - RNA, 32 nt, Human
aguacuuccuguucucggcuaacccuggcgcu

SEQ ID NO: 326406 - RNA, 32 nt, Human
aguacuugaaguggccagaagggucauucggg

SEQ ID NO: 326407 - RNA, 32 nt, Human
aguacuugggaaagcgguuuucaagaguauaa

SEQ ID NO: 326408 - RNA, 32 nt, Human
aguacuugggaaagugguuuucaagaguauaa

SEQ ID NO: 326409 - RNA, 31 nt, Human
aguacuuggguggaguaaggaggguggccuu

SEQ ID NO: 326410 - RNA, 32 nt, Human
aguacuuuauccucccuuuucuaucucuuucu

SEQ ID NO: 326411 - RNA, 32 nt, Human
aguacuuucugcagggcagauguggggaucua

SEQ ID NO: 326412 - RNA, 32 nt, Human
aguacuuucuuucuguguggugaaaacauaag

SEQ ID NO: 326413 - RNA, 32 nt, Human
aguagaaaaauccugcucugucccuaauuuuu

SEQ ID NO: 326414 - RNA, 32 nt, Human
aguagaaaacaacaugguguauaucucaaauu

SEQ ID NO: 326415 - RNA, 32 nt, Human
aguagaaaagcccagcuuuuccugggacaucu

SEQ ID NO: 326416 - RNA, 32 nt, Human
aguagaaauugguaugcuuagaagcagauucu

SEQ ID NO: 326417 - RNA, 32 nt, Human
aguagaaccagaggaggaaccaaagaaguggg

SEQ ID NO: 326418 - RNA, 32 nt, Human
aguagaacccaggucugaugccaaagcugcuu

SEQ ID NO: 326419 - RNA, 21 nt, Human
aguagaaccuguguaaccuca

SEQ ID NO: 326420 - RNA, 18 nt, Human
aguagaacuucuugggac

SEQ ID NO: 326421 - RNA, 32 nt, Human
aguagaagauaaggagaaaaguacgacagaga

SEQ ID NO: 326422 - RNA, 32 nt, Human
aguagaagcuuguggccgggugcaguggcuca

SEQ ID NO: 326423 - RNA, 32 nt, Human
aguagaagggggagggagagguguuggguuuu

SEQ ID NO: 326424 - RNA, 32 nt, Human
aguagaauaaagaaaaacgguuauaaauaaaa

SEQ ID NO: 326425 - RNA, 32 nt, Human
aguagaauauggacauucuauaugacagugac

SEQ ID NO: 326426 - RNA, 32 nt, Human
aguagaaucugaaucucggaucccaggcaggg

SEQ ID NO: 326427 - RNA, 32 nt, Human
aguagacaaggaaagaggacagcagugggcau

SEQ ID NO: 326428 - RNA, 32 nt, Human
aguagacacccaggacccuggaugcugccugc

SEQ ID NO: 326429 - RNA, 32 nt, Human
aguagacauaacugagccagugaaucuaguuu

SEQ ID NO: 326430 - RNA, 32 nt, Human
aguagacauauacacacacauauauguaugua

SEQ ID NO: 326431 - RNA, 32 nt, Human
aguagacauccuuccaccccugcccucagcca

SEQ ID NO: 326432 - RNA, 31 nt, Human
aguagacaugacaagugaacagcagagcugg

SEQ ID NO: 326433 - RNA, 32 nt, Human
aguagacauucaauaaauauuugcugguugaa

SEQ ID NO: 326434 - RNA, 32 nt, Human
aguagaccaggagcuccgggaggcagggccgg

SEQ ID NO: 326435 - RNA, 32 nt, Human
aguagaccaguauuauuguucuacuaauaaca

SEQ ID NO: 326436 - RNA, 32 nt, Human
aguagaccauggccuccagcccauggggcugu

SEQ ID NO: 326437 - RNA, 32 nt, Human
aguagacccgggagaggaguugcggccaacuu

SEQ ID NO: 326438 - RNA, 32 nt, Human
aguagaccugauuuucaaaaucugcccucaga

SEQ ID NO: 326439 - RNA, 32 nt, Human
aguagacgguuuccuccacccaggguugacuc

SEQ ID NO: 326440 - RNA, 32 nt, Human
aguagacuaggaacugagcccaggaaaggggg

SEQ ID NO: 326441 - RNA, 32 nt, Human
aguagacuccagcaagaggcugguuggcgugc

SEQ ID NO: 326442 - RNA, 32 nt, Human
aguagacuccuucgaugaggugcucaaaaaug

SEQ ID NO: 326443 - RNA, 32 nt, Human
aguagacugauuacacugaggugaggcuacaa

SEQ ID NO: 326444 - RNA, 32 nt, Human
aguagacuggauccccugggguauuuggggag

SEQ ID NO: 326445 - RNA, 32 nt, Human
aguagacuucacugagccuuucucccauuagu

SEQ ID NO: 326446 - RNA, 32 nt, Human
aguagacuucacugagccuuucucccauuggu

SEQ ID NO: 326447 - RNA, 32 nt, Human
aguagacuuuaagagaucaaacucagccuauu

SEQ ID NO: 326448 - RNA, 32 nt, Human
aguagagaaauggauucaguauaaggauaagg

SEQ ID NO: 326449 - RNA, 32 nt, Human
aguagagacaagaguuucaccauguuggccag

SEQ ID NO: 326450 - RNA, 32 nt, Human
aguagagacagggguuucaccacguuggccag

SEQ ID NO: 326451 - RNA, 32 nt, Human
aguagagacagggguuucaccauauuggccag

SEQ ID NO: 326452 - RNA, 32 nt, Human
aguagagacagggguuucuuccauguugccca

SEQ ID NO: 326453 - RNA, 32 nt, Human
aguagagacaggguucuuaccauguuggccag

SEQ ID NO: 326454 - RNA, 32 nt, Human
aguagagacggggguuucaccauguuagccag

SEQ ID NO: 326455 - RNA, 32 nt, Human
aguagagacggggguuucaccauguuggccag

SEQ ID NO: 326456 - RNA, 32 nt, Human
aguagagacggggguuucaccauguuggcugg

SEQ ID NO: 326457 - RNA, 32 nt, Human
aguagagacggggguuucacuauguuggcuag

SEQ ID NO: 326458 - RNA, 32 nt, Human
aguagagacggggguuucgccguguuggccag

SEQ ID NO: 326459 - RNA, 32 nt, Human
aguagagacggggguuucuucauguuggugag

SEQ ID NO: 326460 - RNA, 32 nt, Human
aguagagacuuucaguauuuguuuucucuuga

SEQ ID NO: 326461 - RNA, 32 nt, Human
aguagagagaaagucaaagauuacagaagugc

SEQ ID NO: 326462 - RNA, 32 nt, Human
aguagagagaaauggagauagcauuaaacuaa

SEQ ID NO: 326463 - RNA, 32 nt, Human
aguagagagacacccggcacccaguccgaagc

SEQ ID NO: 326464 - RNA, 32 nt, Human
aguagagagagaaaaagagggggugccgcaca

SEQ ID NO: 326465 - RNA, 32 nt, Human
aguagagagagcucgugcuggggagaagucca

SEQ ID NO: 326466 - RNA, 32 nt, Human
aguagagagaucugaccucuugccaggaaugc

SEQ ID NO: 326467 - RNA, 32 nt, Human
aguagagagcugcucuagguucuugagguuug

SEQ ID NO: 326468 - RNA, 32 nt, Human
aguagagagguuucaccauguuggccaggcug

SEQ ID NO: 326469 - RNA, 32 nt, Human
aguagagaugggaguuucaccauguuggccag

SEQ ID NO: 326470 - RNA, 32 nt, Human
aguagagauggggguuucaccauauuggccag

SEQ ID NO: 326471 - RNA, 32 nt, Human
aguagagauggggguuucaccauauuggucag

SEQ ID NO: 326472 - RNA, 32 nt, Human
aguagagauggggguuucuccuuguuggucag

SEQ ID NO: 326473 - RNA, 32 nt, Human
aguagagauguuucaccauguuggccaggcua

SEQ ID NO: 326474 - RNA, 32 nt, Human
aguagagcaaagagccauucagcuucagucuu

SEQ ID NO: 326475 - RNA, 32 nt, Human
aguagagcuaaaguggaaaaagcauuucccug

SEQ ID NO: 326476 - RNA, 32 nt, Human
aguagagcuagcaaugacaccuugcauuucau

SEQ ID NO: 326477 - RNA, 32 nt, Human
aguagaggaaacccuuucucauccagcagacc

SEQ ID NO: 326478 - RNA, 32 nt, Human
aguagaggagccucuucucauggccaccauug

SEQ ID NO: 326479 - RNA, 32 nt, Human
aguagaggaugggguuucacuauguuggccag

SEQ ID NO: 326480 - RNA, 32 nt, Human
aguagaggcaugaacacacauggaugcacaca

SEQ ID NO: 326481 - RNA, 32 nt, Human
aguagagggcaagaggagagagcgccuccagu

SEQ ID NO: 326482 - RNA, 32 nt, Human
aguagaggggugaggaaggguaaggggcaggg

SEQ ID NO: 326483 - RNA, 32 nt, Human
aguagaggucaguggugaugccucuugcugcu

SEQ ID NO: 326484 - RNA, 32 nt, Human
aguagaggugggcaggaggagcugaggggcug

SEQ ID NO: 326485 - RNA, 32 nt, Human
aguagaguucaacccgcaggaguaaauuacug

SEQ ID NO: 326486 - RNA, 32 nt, Human
aguagaguugauuacugauacuuuaugcuaag

SEQ ID NO: 326487 - RNA, 32 nt, Human
aguagaguuggggguuucacuauguuggccag

SEQ ID NO: 326488 - RNA, 32 nt, Human
aguagaguuuugucacguuggccagguuggcc

SEQ ID NO: 326489 - RNA, 32 nt, Human
aguagauagacagaaaaucauuagguaauuua

SEQ ID NO: 326490 - RNA, 32 nt, Human
aguagaucgagaccagccuggccaauauggug

SEQ ID NO: 326491 - RNA, 32 nt, Human
aguagaucucaguucugcguuuauuguaaguu

SEQ ID NO: 326492 - RNA, 32 nt, Human
aguagaucuccuccuccuucaugcagccagga

SEQ ID NO: 326493 - RNA, 32 nt, Human
aguagaugagggaagaaucaagacugaugaua

SEQ ID NO: 326494 - RNA, 32 nt, Human
aguagaugccuggcacuccucgaugcccagug

SEQ ID NO: 326495 - RNA, 30 nt, Human
aguagaugcucaauaaacacuuguugaaug

SEQ ID NO: 326496 - RNA, 31 nt, Human
aguagaugcucaauaaauuuuugcuggcacg

SEQ ID NO: 326497 - RNA, 32 nt, Human
aguagauggaaauuauauuggccaaguuuuag

SEQ ID NO: 326498 - RNA, 32 nt, Human
aguagauggcagggggaggauuugaagccugg

SEQ ID NO: 326499 - RNA, 32 nt, Human
aguagaugggauuacaggcgccugccaccacg

SEQ ID NO: 326500 - RNA, 32 nt, Human
aguagauuuugaauccugccucugccauuucc

SEQ ID NO: 326501 - RNA, 32 nt, Human
aguagcaaaaccacuuucuacuuuccaaacac

SEQ ID NO: 326502 - RNA, 32 nt, Human
aguagcaaagagaugagcuccuggauggcauu

SEQ ID NO: 326503 - RNA, 32 nt, Human
aguagcaacagcagcaaguugccaccaguuug

SEQ ID NO: 326504 - RNA, 32 nt, Human
aguagcaagacccaccccacacugccuucacc

SEQ ID NO: 326505 - RNA, 32 nt, Human
aguagcaagacugggaaaauaugacugaauuu

SEQ ID NO: 326506 - RNA, 32 nt, Human
aguagcaaggagagaagaauggcagcugugau

SEQ ID NO: 326507 - RNA, 32 nt, Human
aguagcaaguucuagagaagaggcuggugcug

SEQ ID NO: 326508 - RNA, 32 nt, Human
aguagcacccacccucucugugcucccgucug

SEQ ID NO: 326509 - RNA, 32 nt, Human
aguagcacugcacugucaccugaugauuggcc

SEQ ID NO: 326510 - RNA, 32 nt, Human
aguagcagcacccugagcucccugccaccagg

SEQ ID NO: 326511 - RNA, 32 nt, Human
aguagcagcuacuccagaggcugaaaugggag

SEQ ID NO: 326512 - RNA, 18 nt, Human
aguagcagcuccagcagc

SEQ ID NO: 326513 - RNA, 32 nt, Human
aguagcaggaaggaacacgcaggcugggcgag

SEQ ID NO: 326514 - RNA, 32 nt, Human
aguagcagggauuacaggugugugccaccaug

SEQ ID NO: 326515 - RNA, 32 nt, Human
aguagcaguagaauagcagagcagggggacuc

SEQ ID NO: 326516 - RNA, 32 nt, Human
aguagcaguggcugagagaguccuccaggcag

SEQ ID NO: 326517 - RNA, 32 nt, Human
aguagcaugggcgggugguggggacggcagug

SEQ ID NO: 326518 - RNA, 32 nt, Human
aguagccacuacucccccugccuggcccugag

SEQ ID NO: 326519 - RNA, 32 nt, Human
aguagccacugcacuccagccugggcaacgug

SEQ ID NO: 326520 - RNA, 32 nt, Human
aguagccagcaucugccuccccuucacuccca

SEQ ID NO: 326521 - RNA, 32 nt, Human
aguagcccaacaacaaggcugcugggggccug

SEQ ID NO: 326522 - RNA, 32 nt, Human
aguagcccaucuuugggccgcagcccugaccu

SEQ ID NO: 326523 - RNA, 32 nt, Human
aguagccccaaaagcagaaccuugauuugucu

SEQ ID NO: 326524 - RNA, 32 nt, Human
aguagccccaacaguaggagagaggucugggg

SEQ ID NO: 326525 - RNA, 32 nt, Human
aguagccccacgaguccccaccucucagugcu

SEQ ID NO: 326526 - RNA, 32 nt, Human
aguagccccgcucuccccugucccgaaggauu

SEQ ID NO: 326527 - RNA, 32 nt, Human
aguagcccugucccuucccugccugcagccca

SEQ ID NO: 326528 - RNA, 32 nt, Human
aguagccgccgcugcugugagccuggggacga

SEQ ID NO: 326529 - RNA, 32 nt, Human
aguagccgggcguggugaugcgugccuguaau

SEQ ID NO: 326530 - RNA, 32 nt, Human
aguagccuaaagugucaguuucaaccagaaaa

SEQ ID NO: 326531 - RNA, 32 nt, Human
aguagccuccuguagguauuugcccauguuaa

SEQ ID NO: 326532 - RNA, 32 nt, Human
aguagcgccacaucugguuuauaaaguaagag

SEQ ID NO: 326533 - RNA, 32 nt, Human
aguagcuaaggcuuugcucuuucauacuggug

SEQ ID NO: 326534 - RNA, 32 nt, Human
aguagcuaggaccauaggcacaugucaccaca

SEQ ID NO: 326535 - RNA, 32 nt, Human
aguagcuaggauuacaggugccugccaccaca

SEQ ID NO: 326536 - RNA, 32 nt, Human
aguagcuaggauuacaggugugugccaccacg

SEQ ID NO: 326537 - RNA, 32 nt, Human
aguagcuaggauuacaggugugugccaccaug

SEQ ID NO: 326538 - RNA, 32 nt, Human
aguagcucagacccaaggagauauuuuucuaa

SEQ ID NO: 326539 - RNA, 23 nt, Human
aguagcucaugccuguaauccca

SEQ ID NO: 326540 - RNA, 32 nt, Human
aguagcuccuugcuaacgauguuucaggaggu

SEQ ID NO: 326541 - RNA, 32 nt, Human
aguagcucugggcuccuggaaccaagcucagg

SEQ ID NO: 326542 - RNA, 32 nt, Human
aguagcugagacuacaggcaccugccaccaua

SEQ ID NO: 326543 - RNA, 32 nt, Human
aguagcugagauuacagaugcaagguagagag

SEQ ID NO: 326544 - RNA, 32 nt, Human
aguagcugagauuacaggcacaugccaccaca

SEQ ID NO: 326545 - RNA, 32 nt, Human
aguagcugagauuacaggcauccgccaccacg

SEQ ID NO: 326546 - RNA, 32 nt, Human
aguagcugagauuacaggcaugcaccaccaug

SEQ ID NO: 326547 - RNA, 32 nt, Human
aguagcugagauuacaggccucugccaccaug

SEQ ID NO: 326548 - RNA, 32 nt, Human
aguagcugagauuacaggcgcacaccaccacg

SEQ ID NO: 326549 - RNA, 32 nt, Human
aguagcugagauuacaggcgcccgccaccacg

SEQ ID NO: 326550 - RNA, 32 nt, Human
aguagcugagauuacaggcgcccgccaccaug

SEQ ID NO: 326551 - RNA, 32 nt, Human
aguagcugagauuacagguacgcaccaccaug

SEQ ID NO: 326552 - RNA, 20 nt, Human
aguagcugagauuacaggug

SEQ ID NO: 326553 - RNA, 32 nt, Human
aguagcugagauuacaggugcacaccaccaca

SEQ ID NO: 326554 - RNA, 32 nt, Human
aguagcugagauuacaggugcccgccaccaug

SEQ ID NO: 326555 - RNA, 32 nt, Human
aguagcugagauuacaggugcgcgccaccaca

SEQ ID NO: 326556 - RNA, 32 nt, Human
aguagcugagauuacaggugugcaccaccacg

SEQ ID NO: 326557 - RNA, 32 nt, Human
aguagcugagauuacaggugugugccaccaca

SEQ ID NO: 326558 - RNA, 32 nt, Human
aguagcugagauuacaggugugugccacccau

SEQ ID NO: 326559 - RNA, 32 nt, Human
aguagcugagauuauaggccuaccaccaugcc

SEQ ID NO: 326560 - RNA, 32 nt, Human
aguagcugagauugcaggcacaugccaccacg

SEQ ID NO: 326561 - RNA, 32 nt, Human
aguagcugaggagugggcggaaaccccuccug

SEQ ID NO: 326562 - RNA, 32 nt, Human
aguagcugaggcaggagaaucgcuugaacccg

SEQ ID NO: 326563 - RNA, 32 nt, Human
aguagcugaguguguuuauauuacauauuguc

SEQ ID NO: 326564 - RNA, 32 nt, Human
aguagcugcagcugaggacagccacccuuucu

SEQ ID NO: 326565 - RNA, 31 nt, Human
aguagcugccucucugcuuccucaucuacac

SEQ ID NO: 326566 - RNA, 32 nt, Human
aguagcugcuccaucaucuagcuugugaaacc

SEQ ID NO: 326567 - RNA, 32 nt, Human
aguagcuggaaccacgggggugugccaccacg

SEQ ID NO: 326568 - RNA, 19 nt, Human
aguagcuggauuacaggug

SEQ ID NO: 326569 - RNA, 20 nt, Human
aguagcugggaauacaggug

SEQ ID NO: 326570 - RNA, 20 nt, Human
aguagcugggacaacaggug

SEQ ID NO: 326571 - RNA, 20 nt, Human
aguagcugggaccacaggug

SEQ ID NO: 326572 - RNA, 32 nt, Human
aguagcugggacuacaggcuugugccaccaca

SEQ ID NO: 326573 - RNA, 19 nt, Human
aguagcugggacuacaggu

SEQ ID NO: 326574 - RNA, 20 nt, Human
aguagcugggacuacaggug

SEQ ID NO: 326575 - RNA, 32 nt, Human
aguagcugggacuacaguugugcaccacaaug

SEQ ID NO: 326576 - RNA, 32 nt, Human
aguagcugggacuacaguugugcaccaccaca

SEQ ID NO: 326577 - RNA, 32 nt, Human
aguagcugggacuacaguugugccaccacguc

SEQ ID NO: 326578 - RNA, 32 nt, Human
aguagcugggacuacaguugugcucuaccaca

SEQ ID NO: 326579 - RNA, 20 nt, Human
aguagcugggacuauaggug

SEQ ID NO: 326580 - RNA, 32 nt, Human
aguagcugggaggacaggugugagcugccgca

SEQ ID NO: 326581 - RNA, 20 nt, Human
aguagcugggauuacaagug

SEQ ID NO: 326582 - RNA, 32 nt, Human
aguagcugggauuacagaaagccgccaccgug

SEQ ID NO: 326583 - RNA, 32 nt, Human
aguagcugggauuacagacacccgccauggca

SEQ ID NO: 326584 - RNA, 32 nt, Human
aguagcugggauuacagacaugcaccacaacg

SEQ ID NO: 326585 - RNA, 32 nt, Human
aguagcugggauuacagacaugccaccaugcc

SEQ ID NO: 326586 - RNA, 32 nt, Human
aguagcugggauuacagacaugugccaccacg

SEQ ID NO: 326587 - RNA, 32 nt, Human
aguagcugggauuacagacgcacgccaccaug

SEQ ID NO: 326588 - RNA, 32 nt, Human
aguagcugggauuacagacgccugccaucacg

SEQ ID NO: 326589 - RNA, 32 nt, Human
aguagcugggauuacagacucaugccaccacg

SEQ ID NO: 326590 - RNA, 32 nt, Human
aguagcugggauuacagaugcccaccaccaug

SEQ ID NO: 326591 - RNA, 32 nt, Human
aguagcugggauuacagaugccugccaccaug

SEQ ID NO: 326592 - RNA, 32 nt, Human
aguagcugggauuacagaugggaccaccuagu

SEQ ID NO: 326593 - RNA, 32 nt, Human
aguagcugggauuacagauguaugcuaccacg

SEQ ID NO: 326594 - RNA, 32 nt, Human
aguagcugggauuacagaugugagccaccgua

SEQ ID NO: 326595 - RNA, 32 nt, Human
aguagcugggauuacagaugugcaccaccacg

SEQ ID NO: 326596 - RNA, 32 nt, Human
aguagcugggauuacagaugugcaccagcaca

SEQ ID NO: 326597 - RNA, 32 nt, Human
aguagcugggauuacagaugugugccacaucu

SEQ ID NO: 326598 - RNA, 32 nt, Human
aguagcugggauuacagcacccgccaccaugc

SEQ ID NO: 326599 - RNA, 32 nt, Human
aguagcugggauuacagccaugcaccaccaca

SEQ ID NO: 326600 - RNA, 32 nt, Human
aguagcugggauuacagcucugggacaaacca

SEQ ID NO: 326601 - RNA, 18 nt, Human
aguagcugggauuacagg

SEQ ID NO: 326602 - RNA, 32 nt, Human
aguagcugggauuacaggaacgcgccaccacg

SEQ ID NO: 326603 - RNA, 32 nt, Human
aguagcugggauuacaggagcaugccacaaga

SEQ ID NO: 326604 - RNA, 32 nt, Human
aguagcugggauuacaggagcgugccaccacu

SEQ ID NO: 326605 - RNA, 32 nt, Human
aguagcugggauuacaggagugcaccaucaug

SEQ ID NO: 326606 - RNA, 32 nt, Human
aguagcugggauuacaggagugugccaccaca

SEQ ID NO: 326607 - RNA, 32 nt, Human
aguagcugggauuacaggaguuagaaauggag

SEQ ID NO: 326608 - RNA, 32 nt, Human
aguagcugggauuacaggcaacugccaccaug

SEQ ID NO: 326609 - RNA, 32 nt, Human
aguagcugggauuacaggcacacgccaccaca

SEQ ID NO: 326610 - RNA, 32 nt, Human
aguagcugggauuacaggcacacgccaccaug

SEQ ID NO: 326611 - RNA, 32 nt, Human
aguagcugggauuacaggcacaugccaccaca

SEQ ID NO: 326612 - RNA, 32 nt, Human
aguagcugggauuacaggcacaugccaccaug

SEQ ID NO: 326613 - RNA, 32 nt, Human
aguagcugggauuacaggcaccagccaccaug

SEQ ID NO: 326614 - RNA, 32 nt, Human
aguagcugggauuacaggcacccaccacaucu

SEQ ID NO: 326615 - RNA, 32 nt, Human
aguagcugggauuacaggcacccaccaccaca

SEQ ID NO: 326616 - RNA, 32 nt, Human
aguagcugggauuacaggcacccaccaccacg

SEQ ID NO: 326617 - RNA, 32 nt, Human
aguagcugggauuacaggcacccaccaccaug

SEQ ID NO: 326618 - RNA, 32 nt, Human
aguagcugggauuacaggcacccaccaccuca

SEQ ID NO: 326619 - RNA, 32 nt, Human
aguagcugggauuacaggcacccaccacuaug

SEQ ID NO: 326620 - RNA, 32 nt, Human
aguagcugggauuacaggcacccgccaccaca

SEQ ID NO: 326621 - RNA, 32 nt, Human
aguagcugggauuacaggcacccgccaccacg

SEQ ID NO: 326622 - RNA, 32 nt, Human
aguagcugggauuacaggcacccgccaccgua

SEQ ID NO: 326623 - RNA, 32 nt, Human
aguagcugggauuacaggcacccgccaccgug

SEQ ID NO: 326624 - RNA, 32 nt, Human
aguagcugggauuacaggcacccgccaucaug

SEQ ID NO: 326625 - RNA, 32 nt, Human
aguagcugggauuacaggcaccugccaccaca

SEQ ID NO: 326626 - RNA, 32 nt, Human
aguagcugggauuacaggcaccugccaccacg

SEQ ID NO: 326627 - RNA, 32 nt, Human
aguagcugggauuacaggcaccugccaccaug

SEQ ID NO: 326628 - RNA, 32 nt, Human
aguagcugggauuacaggcaccugccauuaug

SEQ ID NO: 326629 - RNA, 32 nt, Human
aguagcugggauuacaggcacgcaccaccaca

SEQ ID NO: 326630 - RNA, 32 nt, Human
aguagcugggauuacaggcacgcgccaccaca

SEQ ID NO: 326631 - RNA, 32 nt, Human
aguagcugggauuacaggcacgcgccaccacg

SEQ ID NO: 326632 - RNA, 32 nt, Human
aguagcugggauuacaggcacgcgccaccacu

SEQ ID NO: 326633 - RNA, 32 nt, Human
aguagcugggauuacaggcacgcuccaccaca

SEQ ID NO: 326634 - RNA, 32 nt, Human
aguagcugggauuacaggcacguaccaccacg

SEQ ID NO: 326635 - RNA, 32 nt, Human
aguagcugggauuacaggcacgugacaccagg

SEQ ID NO: 326636 - RNA, 32 nt, Human
aguagcugggauuacaggcacgugccaacaca

SEQ ID NO: 326637 - RNA, 32 nt, Human
aguagcugggauuacaggcacgugccaccaag

SEQ ID NO: 326638 - RNA, 32 nt, Human
aguagcugggauuacaggcacgugccaccacg

SEQ ID NO: 326639 - RNA, 32 nt, Human
aguagcugggauuacaggcacgugccaccaug

SEQ ID NO: 326640 - RNA, 32 nt, Human
aguagcugggauuacaggcacuugccaccauu

SEQ ID NO: 326641 - RNA, 32 nt, Human
aguagcugggauuacaggcagccaccacgccc

SEQ ID NO: 326642 - RNA, 32 nt, Human
aguagcugggauuacaggcaggugccaccaug

SEQ ID NO: 326643 - RNA, 32 nt, Human
aguagcugggauuacaggcauccgccaccacg

SEQ ID NO: 326644 - RNA, 32 nt, Human
aguagcugggauuacaggcaucugccaaccau

SEQ ID NO: 326645 - RNA, 32 nt, Human
aguagcugggauuacaggcaugaaucaccaca

SEQ ID NO: 326646 - RNA, 32 nt, Human
aguagcugggauuacaggcaugagccacugug

SEQ ID NO: 326647 - RNA, 32 nt, Human
aguagcugggauuacaggcaugcaccaccaug

SEQ ID NO: 326648 - RNA, 32 nt, Human
aguagcugggauuacaggcaugcgccaccaca

SEQ ID NO: 326649 - RNA, 32 nt, Human
aguagcugggauuacaggcaugcgccaccacg

SEQ ID NO: 326650 - RNA, 32 nt, Human
aguagcugggauuacaggcaugcgccaccaug

SEQ ID NO: 326651 - RNA, 32 nt, Human
aguagcugggauuacaggcaugcgccacuaug

SEQ ID NO: 326652 - RNA, 32 nt, Human
aguagcugggauuacaggcaugcgccaucaug

SEQ ID NO: 326653 - RNA, 32 nt, Human
aguagcugggauuacaggcaugcgcuaacaca

SEQ ID NO: 326654 - RNA, 32 nt, Human
aguagcugggauuacaggcaugggccaccaug

SEQ ID NO: 326655 - RNA, 32 nt, Human
aguagcugggauuacaggcaugugagaccacg

SEQ ID NO: 326656 - RNA, 32 nt, Human
aguagcugggauuacaggcaugugccacaccu

SEQ ID NO: 326657 - RNA, 32 nt, Human
aguagcugggauuacaggcaugugccaccaca

SEQ ID NO: 326658 - RNA, 32 nt, Human
aguagcugggauuacaggcaugugccaccacg

SEQ ID NO: 326659 - RNA, 32 nt, Human
aguagcugggauuacaggcaugugccaccaug

SEQ ID NO: 326660 - RNA, 32 nt, Human
aguagcugggauuacaggcaugugccacccac

SEQ ID NO: 326661 - RNA, 32 nt, Human
aguagcugggauuacaggcaugugccagcaug

SEQ ID NO: 326662 - RNA, 32 nt, Human
aguagcugggauuacaggcaugugccaucacc

SEQ ID NO: 326663 - RNA, 32 nt, Human
aguagcugggauuacaggcaugugucaccacg

SEQ ID NO: 326664 - RNA, 32 nt, Human
aguagcugggauuacaggcgcacaccaccaca

SEQ ID NO: 326665 - RNA, 32 nt, Human
aguagcugggauuacaggcgcacgccaccacg

SEQ ID NO: 326666 - RNA, 32 nt, Human
aguagcugggauuacaggcgcacgccaccaug

SEQ ID NO: 326667 - RNA, 32 nt, Human
aguagcugggauuacaggcgcacgccaccgug

SEQ ID NO: 326668 - RNA, 32 nt, Human
aguagcugggauuacaggcgcaugccaccaca

SEQ ID NO: 326669 - RNA, 32 nt, Human
aguagcugggauuacaggcgcaugccaccaug

SEQ ID NO: 326670 - RNA, 32 nt, Human
aguagcugggauuacaggcgcccaccaccaca

SEQ ID NO: 326671 - RNA, 32 nt, Human
aguagcugggauuacaggcgcccaccaccaug

SEQ ID NO: 326672 - RNA, 32 nt, Human
aguagcugggauuacaggcgcccgccaccaca

SEQ ID NO: 326673 - RNA, 32 nt, Human
aguagcugggauuacaggcgcccgccaccacg

SEQ ID NO: 326674 - RNA, 32 nt, Human
aguagcugggauuacaggcgcccgccaccaug

SEQ ID NO: 326675 - RNA, 32 nt, Human
aguagcugggauuacaggcgcccgccaccugg

SEQ ID NO: 326676 - RNA, 32 nt, Human
aguagcugggauuacaggcgcccgccaucaca

SEQ ID NO: 326677 - RNA, 32 nt, Human
aguagcugggauuacaggcgcccgccaucacg

SEQ ID NO: 326678 - RNA, 32 nt, Human
aguagcugggauuacaggcgcccgccaucgug

SEQ ID NO: 326679 - RNA, 32 nt, Human
aguagcugggauuacaggcgcccgucaccaca

SEQ ID NO: 326680 - RNA, 32 nt, Human
aguagcugggauuacaggcgccgaucaccaag

SEQ ID NO: 326681 - RNA, 32 nt, Human
aguagcugggauuacaggcgccugccaccaca

SEQ ID NO: 326682 - RNA, 32 nt, Human
aguagcugggauuacaggcgccugccaccacg

SEQ ID NO: 326683 - RNA, 32 nt, Human
aguagcugggauuacaggcgccugccaccaug

SEQ ID NO: 326684 - RNA, 32 nt, Human
aguagcugggauuacaggcgccugcuaccaca

SEQ ID NO: 326685 - RNA, 32 nt, Human
aguagcugggauuacaggcgccugcuaccucg

SEQ ID NO: 326686 - RNA, 32 nt, Human
aguagcugggauuacaggcgcguaucaccaua

SEQ ID NO: 326687 - RNA, 28 nt, Human
aguagcugggauuacaggcgcgugccac

SEQ ID NO: 326688 - RNA, 32 nt, Human
aguagcugggauuacaggcgcgugccaccaca

SEQ ID NO: 326689 - RNA, 32 nt, Human
aguagcugggauuacaggcgcgugccaccaua

SEQ ID NO: 326690 - RNA, 32 nt, Human
aguagcugggauuacaggcguacgccaccaug

SEQ ID NO: 326691 - RNA, 32 nt, Human
aguagcugggauuacaggcguccgccaccaug

SEQ ID NO: 326692 - RNA, 32 nt, Human
aguagcugggauuacaggcguccgcuaccaca

SEQ ID NO: 326693 - RNA, 32 nt, Human
aguagcugggauuacaggcgugcgccaacaug

SEQ ID NO: 326694 - RNA, 32 nt, Human
aguagcugggauuacaggcgugcgccaccaaa

SEQ ID NO: 326695 - RNA, 32 nt, Human
aguagcugggauuacaggcgugcgccaccacg

SEQ ID NO: 326696 - RNA, 32 nt, Human
aguagcugggauuacaggcgugcgccacuaug

SEQ ID NO: 326697 - RNA, 32 nt, Human
aguagcugggauuacaggcgugcgccaucgug

SEQ ID NO: 326698 - RNA, 32 nt, Human
aguagcugggauuacaggcgugggcccccaug

SEQ ID NO: 326699 - RNA, 32 nt, Human
aguagcugggauuacaggcguguaccaccaua

SEQ ID NO: 326700 - RNA, 32 nt, Human
aguagcugggauuacaggcgugugccaccaca

SEQ ID NO: 326701 - RNA, 32 nt, Human
aguagcugggauuacaggcgugugccaccacg

SEQ ID NO: 326702 - RNA, 32 nt, Human
aguagcugggauuacaggcgugugccaccaug

SEQ ID NO: 326703 - RNA, 32 nt, Human
aguagcugggauuacaggcgugugccaccgcc

SEQ ID NO: 326704 - RNA, 32 nt, Human
aguagcugggauuacaggcgugugucaccacg

SEQ ID NO: 326705 - RNA, 32 nt, Human
aguagcugggauuacaggcucaugccaccaug

SEQ ID NO: 326706 - RNA, 32 nt, Human
aguagcugggauuacaggcuccugccaccacg

SEQ ID NO: 326707 - RNA, 32 nt, Human
aguagcugggauuacagguaccugccaccaug

SEQ ID NO: 326708 - RNA, 32 nt, Human
aguagcugggauuacagguaugaaccacuaug

SEQ ID NO: 326709 - RNA, 32 nt, Human
aguagcugggauuacagguaugugccaccacg

SEQ ID NO: 326710 - RNA, 32 nt, Human
aguagcugggauuacagguaugugccaccaug

SEQ ID NO: 326711 - RNA, 20 nt, Human
aguagcugggauuacaggug

SEQ ID NO: 326712 - RNA, 32 nt, Human
aguagcugggauuacaggugcacaccaccaca

SEQ ID NO: 326713 - RNA, 32 nt, Human
aguagcugggauuacaggugcacaccaccaug

SEQ ID NO: 326714 - RNA, 32 nt, Human
aguagcugggauuacaggugcacaccaccgca

SEQ ID NO: 326715 - RNA, 32 nt, Human
aguagcugggauuacaggugcaggccaccaug

SEQ ID NO: 326716 - RNA, 32 nt, Human
aguagcugggauuacaggugcaugccaccacg

SEQ ID NO: 326717 - RNA, 32 nt, Human
aguagcugggauuacaggugcaugccaccaug

SEQ ID NO: 326718 - RNA, 32 nt, Human
aguagcugggauuacaggugcaugccaucaca

SEQ ID NO: 326719 - RNA, 27 nt, Human
aguagcugggauuacaggugcccaaca

SEQ ID NO: 326720 - RNA, 32 nt, Human
aguagcugggauuacaggugcccaccaccaca

SEQ ID NO: 326721 - RNA, 32 nt, Human
aguagcugggauuacaggugcccaccaccacc

SEQ ID NO: 326722 - RNA, 32 nt, Human
aguagcugggauuacaggugcccaccaccaug

SEQ ID NO: 326723 - RNA, 32 nt, Human
aguagcugggauuacaggugcccaccaccgcg

SEQ ID NO: 326724 - RNA, 32 nt, Human
aguagcugggauuacaggugcccaccacugcg

SEQ ID NO: 326725 - RNA, 32 nt, Human
aguagcugggauuacaggugcccaccagcacg

SEQ ID NO: 326726 - RNA, 32 nt, Human
aguagcugggauuacaggugcccgccaccaca

SEQ ID NO: 326727 - RNA, 32 nt, Human
aguagcugggauuacaggugcccgccaccacg

SEQ ID NO: 326728 - RNA, 32 nt, Human
aguagcugggauuacaggugcccgccaccaug

SEQ ID NO: 326729 - RNA, 32 nt, Human
aguagcugggauuacaggugccugccacaaca

SEQ ID NO: 326730 - RNA, 32 nt, Human
aguagcugggauuacaggugccugccaccaca

SEQ ID NO: 326731 - RNA, 32 nt, Human
aguagcugggauuacaggugccugccaccacg

SEQ ID NO: 326732 - RNA, 32 nt, Human
aguagcugggauuacaggugccugccaccaua

SEQ ID NO: 326733 - RNA, 32 nt, Human
aguagcugggauuacaggugccugccaccaug

SEQ ID NO: 326734 - RNA, 32 nt, Human
aguagcugggauuacaggugccugccaccauu

SEQ ID NO: 326735 - RNA, 32 nt, Human
aguagcugggauuacaggugccugccacugcg

SEQ ID NO: 326736 - RNA, 32 nt, Human
aguagcugggauuacaggugcgcaccaccaug

SEQ ID NO: 326737 - RNA, 32 nt, Human
aguagcugggauuacaggugcgcaccacuacg

SEQ ID NO: 326738 - RNA, 32 nt, Human
aguagcugggauuacaggugcgcaccauuaca

SEQ ID NO: 326739 - RNA, 32 nt, Human
aguagcugggauuacaggugcgcacuaccacg

SEQ ID NO: 326740 - RNA, 32 nt, Human
aguagcugggauuacaggugcgccccaccaug

SEQ ID NO: 326741 - RNA, 32 nt, Human
aguagcugggauuacaggugcgcgccaucacg

SEQ ID NO: 326742 - RNA, 32 nt, Human
aguagcugggauuacaggugcgugccaccacg

SEQ ID NO: 326743 - RNA, 32 nt, Human
aguagcugggauuacaggugcucaccaccacg

SEQ ID NO: 326744 - RNA, 32 nt, Human
aguagcugggauuacagguggugacuuccaag

SEQ ID NO: 326745 - RNA, 32 nt, Human
aguagcugggauuacagguguaugccaccacg

SEQ ID NO: 326746 - RNA, 32 nt, Human
aguagcugggauuacagguguccgccaccacg

SEQ ID NO: 326747 - RNA, 32 nt, Human
aguagcugggauuacaggugucggccaccaca

SEQ ID NO: 326748 - RNA, 32 nt, Human
aguagcugggauuacaggugugagccacugca

SEQ ID NO: 326749 - RNA, 32 nt, Human
aguagcugggauuacaggugugcaccaacaca

SEQ ID NO: 326750 - RNA, 32 nt, Human
aguagcugggauuacaggugugcaccaccaca

SEQ ID NO: 326751 - RNA, 32 nt, Human
aguagcugggauuacaggugugcaccaccacg

SEQ ID NO: 326752 - RNA, 32 nt, Human
aguagcugggauuacaggugugcaccaccauu

SEQ ID NO: 326753 - RNA, 32 nt, Human
aguagcugggauuacaggugugcaccacccgu

SEQ ID NO: 326754 - RNA, 32 nt, Human
aguagcugggauuacaggugugcaccacuacc

SEQ ID NO: 326755 - RNA, 32 nt, Human
aguagcugggauuacaggugugcacuaccaug

SEQ ID NO: 326756 - RNA, 32 nt, Human
aguagcugggauuacaggugugccccaccacg

SEQ ID NO: 326757 - RNA, 32 nt, Human
aguagcugggauuacaggugugcgccaccacg

SEQ ID NO: 326758 - RNA, 32 nt, Human
aguagcugggauuacaggugugcgccaccaug

SEQ ID NO: 326759 - RNA, 32 nt, Human
aguagcugggauuacaggugugcgccaguacg

SEQ ID NO: 326760 - RNA, 32 nt, Human
aguagcugggauuacaggugugggccaccaca

SEQ ID NO: 326761 - RNA, 32 nt, Human
aguagcugggauuacaggugugugccaaccau

SEQ ID NO: 326762 - RNA, 32 nt, Human
aguagcugggauuacaggugugugccaccaca

SEQ ID NO: 326763 - RNA, 32 nt, Human
aguagcugggauuacaggugugugccaccaug

SEQ ID NO: 326764 - RNA, 32 nt, Human
aguagcugggauuacaggugugugccacuacg

SEQ ID NO: 326765 - RNA, 32 nt, Human
aguagcugggauuacaggugugugccagcaug

SEQ ID NO: 326766 - RNA, 32 nt, Human
aguagcugggauuacaggugugugccaucaug

SEQ ID NO: 326767 - RNA, 32 nt, Human
aguagcugggauuacagguuugcaccaccaug

SEQ ID NO: 326768 - RNA, 32 nt, Human
aguagcugggauuacagugccugccaccaugc

SEQ ID NO: 326769 - RNA, 32 nt, Human
aguagcugggauuacaguuuccaucauuaucu

SEQ ID NO: 326770 - RNA, 32 nt, Human
aguagcugggauuauaggugcgagccacugcg

SEQ ID NO: 326771 - RNA, 32 nt, Human
aguagcuggggcuccaggcaugaaucaccgug

SEQ ID NO: 326772 - RNA, 20 nt, Human
aguagcugggucuacaggug

SEQ ID NO: 326773 - RNA, 32 nt, Human
aguagcugguagcugggacuauaggcacgugc

SEQ ID NO: 326774 - RNA, 32 nt, Human
aguagcuggugcuccucugcucccucuuuuuc

SEQ ID NO: 326775 - RNA, 32 nt, Human
aguagcugugauuacaggcaugcgccaccaug

SEQ ID NO: 326776 - RNA, 32 nt, Human
aguagcuguggcaguggcagaagauuuaaauu

SEQ ID NO: 326777 - RNA, 32 nt, Human
aguagcuucagaacagcuucagagccaugaag

SEQ ID NO: 326778 - RNA, 21 nt, Human
aguagcuuccccgaggacccc

SEQ ID NO: 326779 - RNA, 20 nt, Human
aguagcuuggauuacaggug

SEQ ID NO: 326780 - RNA, 32 nt, Human
aguagcuugggacaaaucaagcuucaguuucc

SEQ ID NO: 326781 - RNA, 32 nt, Human
aguagcuuuucugucuuuuggccagugccgag

SEQ ID NO: 326782 - RNA, 19 nt, Human
aguaggaaaguaggcugcu

SEQ ID NO: 326783 - RNA, 32 nt, Human
aguaggaacugaggcugugcuucagguauggu

SEQ ID NO: 326784 - RNA, 32 nt, Human
aguaggaacugauucucuaccuuucuuggagc

SEQ ID NO: 326785 - RNA, 32 nt, Human
aguaggaagcagcuucccagcugcagucugca

SEQ ID NO: 326786 - RNA, 32 nt, Human
aguaggaaggcauucuuccuugccaaaauggg

SEQ ID NO: 326787 - RNA, 32 nt, Human
aguaggaagggagccagagaggccgauggcgc

SEQ ID NO: 326788 - RNA, 32 nt, Human
aguaggaagggcccugaggaacuaauccucau

SEQ ID NO: 326789 - RNA, 32 nt, Human
aguaggaccaggccauccuuggcuccagagcu

SEQ ID NO: 326790 - RNA, 32 nt, Human
aguaggaccuccuucuccucccccucccccuc

SEQ ID NO: 326791 - RNA, 22 nt, Human
aguaggacuuucuugcacuagu

SEQ ID NO: 326792 - RNA, 31 nt, Human
aguaggagaaagccgccucagaauccgcuuc

SEQ ID NO: 326793 - RNA, 32 nt, Human
aguaggagacacgacagcacacacaguggauu

SEQ ID NO: 326794 - RNA, 32 nt, Human
aguaggagagaucacgaucucagucuuuuuag

SEQ ID NO: 326795 - RNA, 32 nt, Human
aguaggagagugaguuuuggggccagacacgc

SEQ ID NO: 326796 - RNA, 32 nt, Human
aguaggagcaaaggaggaaggaaguggguguu

SEQ ID NO: 326797 - RNA, 32 nt, Human
aguaggagcaaaggaggaaggagguggguguu

SEQ ID NO: 326798 - RNA, 32 nt, Human
aguaggagcagagggaagagagagggaugaga

SEQ ID NO: 326799 - RNA, 32 nt, Human
aguaggagcccaggcuuugggcaucaaggcag

SEQ ID NO: 326800 - RNA, 32 nt, Human
aguaggaggagaaagaguguucuaggaagagu

SEQ ID NO: 326801 - RNA, 32 nt, Human
aguaggagggguggaggugagaaggagagagg

SEQ ID NO: 326802 - RNA, 32 nt, Human
aguaggaguaacuuauuccaguucuuacccau

SEQ ID NO: 326803 - RNA, 32 nt, Human
aguaggauagaacuagcauaauacucauguua

SEQ ID NO: 326804 - RNA, 32 nt, Human
aguaggauuguuugagacugggagguugaggc

SEQ ID NO: 326805 - RNA, 32 nt, Human
aguaggauuugggcuccuaugauaaucuaaug

SEQ ID NO: 326806 - RNA, 32 nt, Human
aguaggcaacacagccagcacggugcucucca

SEQ ID NO: 326807 - RNA, 32 nt, Human
aguaggcaaccagcagucuuccggcaauaggg

SEQ ID NO: 326808 - RNA, 32 nt, Human
aguaggcaauacaguuguuaaagaagaauaaa

SEQ ID NO: 326809 - RNA, 32 nt, Human
aguaggcacacacucccuuuucucgggugugu

SEQ ID NO: 326810 - RNA, 32 nt, Human
aguaggcacagggcucccaggccaggccucau

SEQ ID NO: 326811 - RNA, 32 nt, Human
aguaggcacccaauaaauauuuguugaauuua

SEQ ID NO: 326812 - RNA, 32 nt, Human
aguaggcacucaauaaauauugaaugaguaaa

SEQ ID NO: 326813 - RNA, 32 nt, Human
aguaggccggaaggaguccagugcaaagcugu

SEQ ID NO: 326814 - RNA, 32 nt, Human
aguaggccuugaaggccaggaggugggaguga

SEQ ID NO: 326815 - RNA, 30 nt, Human
aguaggcgcucaauaaauacuuguuuguug

SEQ ID NO: 326816 - RNA, 32 nt, Human
aguaggcgcucaauaaauacuuguuuguugaa

SEQ ID NO: 326817 - RNA, 32 nt, Human
aguaggcgcucaauaaauguugaaugaaugaa

SEQ ID NO: 326818 - RNA, 32 nt, Human
aguaggcggcgcgggagggaaaagaggauuga

SEQ ID NO: 326819 - RNA, 32 nt, Human
aguaggcuggggacaucagaggaggauggggg

SEQ ID NO: 326820 - RNA, 32 nt, Human
aguagggaccugcucugugcucacaccucggc

SEQ ID NO: 326821 - RNA, 32 nt, Human
aguagggaggaaaaggaguucuggagaggcgc

SEQ ID NO: 326822 - RNA, 32 nt, Human
aguagggaggaggagguugcagugagcugaga

SEQ ID NO: 326823 - RNA, 32 nt, Human
aguagggaguugaugcugacaggaugaagauu

SEQ ID NO: 326824 - RNA, 32 nt, Human
aguagggcaaaucuguguguguaugucauuaa

SEQ ID NO: 326825 - RNA, 32 nt, Human
aguagggccccuugcucucaggagccuccagc

SEQ ID NO: 326826 - RNA, 32 nt, Human
aguagggcccggggaagcagagcccuaaggga

SEQ ID NO: 326827 - RNA, 32 nt, Human
aguagggcucaaggugcccucgcuaccuagua

SEQ ID NO: 326828 - RNA, 32 nt, Human
aguaggggagacugagacugaccgguagccag

SEQ ID NO: 326829 - RNA, 32 nt, Human
aguaggggagagagcagagaaguacaggucau

SEQ ID NO: 326830 - RNA, 32 nt, Human
aguaggggccugguccugaaugacuuggaggc

SEQ ID NO: 326831 - RNA, 32 nt, Human
aguaggggcugaagaggaagguggaaggagau

SEQ ID NO: 326832 - RNA, 32 nt, Human
aguagggggaaaguagaaaaucgaguagaauu

SEQ ID NO: 326833 - RNA, 32 nt, Human
aguagggggccugcagugugcugugacgccug

SEQ ID NO: 326834 - RNA, 32 nt, Human
aguaggggugauucagggugugcuccaugaug

SEQ ID NO: 326835 - RNA, 32 nt, Human
aguagggguggaggcccgauggaggagggagg

SEQ ID NO: 326836 - RNA, 32 nt, Human
aguagggugaagcaagagaggcccuagggugu

SEQ ID NO: 326837 - RNA, 32 nt, Human
aguaggguggagcucccaacaggcugggcaug

SEQ ID NO: 326838 - RNA, 31 nt, Human
aguagguaaagacauucuaauuuuuacuuuu

SEQ ID NO: 326839 - RNA, 19 nt, Human
aguagguaaagcaggaccu

SEQ ID NO: 326840 - RNA, 32 nt, Human
aguagguaagaguuugguuuggucacaguugc

SEQ ID NO: 326841 - RNA, 32 nt, Human
aguagguacauaaaaaccacacacaugcaugc

SEQ ID NO: 326842 - RNA, 32 nt, Human
aguagguaggcuuaaacagaagagucuuuaga

SEQ ID NO: 326843 - RNA, 32 nt, Human
aguaggucacgcuggacgccacccuaagcugg

SEQ ID NO: 326844 - RNA, 32 nt, Human
aguagguccaggcuggaugcugguaugauggg

SEQ ID NO: 326845 - RNA, 32 nt, Human
aguagguccuggaaaaguaaauucuuuauuuu

SEQ ID NO: 326846 - RNA, 32 nt, Human
aguaggucuaggggaauacucagucugaucuu

SEQ ID NO: 326847 - RNA, 32 nt, Human
aguaggucugcagcuauuucaacuuccuuccg

SEQ ID NO: 326848 - RNA, 32 nt, Human
aguaggucugggauggacaggaaagggcaaag

SEQ ID NO: 326849 - RNA, 32 nt, Human
aguaggucuugugggcauucagucuagcccag

SEQ ID NO: 326850 - RNA, 22 nt, Human
aguaggugaagaaugucuggcu

SEQ ID NO: 326851 - RNA, 23 nt, Human
aguaggugacgugaaaggcagga

SEQ ID NO: 326852 - RNA, 31 nt, Human
aguaggugcucaauaaagacuuguugaauga

SEQ ID NO: 326853 - RNA, 32 nt, Human
aguaggugcucaauaaaugcauauugaauaac

SEQ ID NO: 326854 - RNA, 32 nt, Human
aguaggugcucaauaaauguugaaaccaacug

SEQ ID NO: 326855 - RNA, 32 nt, Human
aguaggugcucaauaaguauccaaugagugga

SEQ ID NO: 326856 - RNA, 32 nt, Human
aguagguggacaaauauccucacuuucuaucu

SEQ ID NO: 326857 - RNA, 32 nt, Human
aguagguggaggggagcgccugccauugguug

SEQ ID NO: 326858 - RNA, 20 nt, Human
aguaggugggacuacaggug

SEQ ID NO: 326859 - RNA, 32 nt, Human
aguaggugggauuacagaugcccgccaccaca

SEQ ID NO: 326860 - RNA, 32 nt, Human
aguaggugggauuacaggcaugcgccaccacg

SEQ ID NO: 326861 - RNA, 32 nt, Human
aguaggugggauuacaggcgcccgccaccacg

SEQ ID NO: 326862 - RNA, 32 nt, Human
aguaggugggauuacaggugcauaccaccaca

SEQ ID NO: 326863 - RNA, 32 nt, Human
aguaggugggauuacaggugcccaccaccaag

SEQ ID NO: 326864 - RNA, 32 nt, Human
aguagguguucaauaaauauuuguugaaugaa

SEQ ID NO: 326865 - RNA, 32 nt, Human
aguagguugaggacaggagagggaagggucuu

SEQ ID NO: 326866 - RNA, 32 nt, Human
aguaguaaaucaggaacauucuccuaacuugg

SEQ ID NO: 326867 - RNA, 32 nt, Human
aguaguaacuccauuaaacaaaggcauuuaca

SEQ ID NO: 326868 - RNA, 32 nt, Human
aguaguaagcugccugccucccuucccucaga

SEQ ID NO: 326869 - RNA, 32 nt, Human
aguaguaaugauucagaagaaaaagaaaaagg

SEQ ID NO: 326870 - RNA, 32 nt, Human
aguaguaccagccccaucagguuguugugaag

SEQ ID NO: 326871 - RNA, 20 nt, Human
aguaguacuggcaggcacag

SEQ ID NO: 326872 - RNA, 32 nt, Human
aguaguaguguugcuuucuaagcuauaacagu

SEQ ID NO: 326873 - RNA, 32 nt, Human
aguaguaguuauuccucccuauggagucaugg

SEQ ID NO: 326874 - RNA, 32 nt, Human
aguaguauuccacuguacucauucauaaggua

SEQ ID NO: 326875 - RNA, 32 nt, Human
aguaguauugacuucccuugagauaugaugua

SEQ ID NO: 326876 - RNA, 32 nt, Human
aguagucaggaaagggggcuuggggcuugcca

SEQ ID NO: 326877 - RNA, 32 nt, Human
aguagucauuuccauucuuuacauugucauga

SEQ ID NO: 326878 - RNA, 32 nt, Human
aguaguccaggccauggguaagaagaaagugu

SEQ ID NO: 326879 - RNA, 32 nt, Human
aguagucccagaggggccguguucuguccugc

SEQ ID NO: 326880 - RNA, 32 nt, Human
aguagucccauguugcuucacaccucuuaagu

SEQ ID NO: 326881 - RNA, 32 nt, Human
aguaguccuagccugguaaagacccuccacca

SEQ ID NO: 326882 - RNA, 32 nt, Human
aguagugaaaggaaggaggaggaaaggaaauu

SEQ ID NO: 326883 - RNA, 32 nt, Human
aguagugaaugacacagauuugccagaugaca

SEQ ID NO: 326884 - RNA, 32 nt, Human
aguagugaggcugugagugugagccacacagc

SEQ ID NO: 326885 - RNA, 31 nt, Human
aguagugauaauggauccuguugaagguuaa

SEQ ID NO: 326886 - RNA, 32 nt, Human
aguagugcaguggugugaucauagcucacugu

SEQ ID NO: 326887 - RNA, 32 nt, Human
aguagugcccugcuucuagggcucugaauacg

SEQ ID NO: 326888 - RNA, 32 nt, Human
aguagugcuugcucccccugccuugucccacc

SEQ ID NO: 326889 - RNA, 32 nt, Human
aguaguggaccagagcaggggaguuuuuaaaa

SEQ ID NO: 326890 - RNA, 32 nt, Human
aguaguggcucacaccuguaauuccagcacuu

SEQ ID NO: 326891 - RNA, 19 nt, Human
aguagugggauuacaggug

SEQ ID NO: 326892 - RNA, 32 nt, Human
aguagugggauuucaccauguuggccaggaug

SEQ ID NO: 326893 - RNA, 32 nt, Human
aguaguguuagcaaucagcugacuccugacuc

SEQ ID NO: 326894 - RNA, 32 nt, Human
aguaguuaaauuuccaugcagaaaaauaaaug

SEQ ID NO: 326895 - RNA, 32 nt, Human
aguaguuacaauuagaaauaccuacugauggu

SEQ ID NO: 326896 - RNA, 32 nt, Human
aguaguuacccauuggauucauaugagcuaaa

SEQ ID NO: 326897 - RNA, 32 nt, Human
aguaguucaagaccagccuaggcaacauagug

SEQ ID NO: 326898 - RNA, 32 nt, Human
aguaguucaagaccagccuggccaacauggug

SEQ ID NO: 326899 - RNA, 32 nt, Human
aguaguucaagaccagccugggcaacauagua

SEQ ID NO: 326900 - RNA, 32 nt, Human
aguaguucaggcuggguggagcagugggaaca

SEQ ID NO: 326901 - RNA, 32 nt, Human
aguaguuccaucaaaauauguaauaauucaca

SEQ ID NO: 326902 - RNA, 32 nt, Human
aguaguucgagaccagccuggccaauauggug

SEQ ID NO: 326903 - RNA, 32 nt, Human
aguaguucgagaccagccuggucaauauggug

SEQ ID NO: 326904 - RNA, 32 nt, Human
aguaguucgaguccagccugggcagcauagug

SEQ ID NO: 326905 - RNA, 32 nt, Human
aguaguucugccaccucugaugcaccacugcc

SEQ ID NO: 326906 - RNA, 32 nt, Human
aguaguucugguaccagcuaucaugaacagca

SEQ ID NO: 326907 - RNA, 32 nt, Human
aguaguugcagugaggauucaacgagaugaac

SEQ ID NO: 326908 - RNA, 32 nt, Human
aguaguuggagaccagccuggccaacauggcg

SEQ ID NO: 326909 - RNA, 32 nt, Human
aguaguugggauuacagaugcccgccaccgca

SEQ ID NO: 326910 - RNA, 32 nt, Human
aguaguugggauuacaggcgccugccaccaca

SEQ ID NO: 326911 - RNA, 32 nt, Human
aguaguugggauuacaggugacugccaccgug

SEQ ID NO: 326912 - RNA, 32 nt, Human
aguaguuuaaaccaaauaaaacaauuucugag

SEQ ID NO: 326913 - RNA, 32 nt, Human
aguaguuuaaaucuggauuuucccaguagaau

SEQ ID NO: 326914 - RNA, 32 nt, Human
aguaguuuacaaaacagaaaauacuuaacuag

SEQ ID NO: 326915 - RNA, 32 nt, Human
aguaguuuccuccacauucacgaaauuaccac

SEQ ID NO: 326916 - RNA, 32 nt, Human
aguaguuucuguucugauuagaucccagcugu

SEQ ID NO: 326917 - RNA, 32 nt, Human
aguaguuugaaacucauuguuuccuuguggua

SEQ ID NO: 326918 - RNA, 32 nt, Human
aguaguuugagaccagccuggccaacauagug

SEQ ID NO: 326919 - RNA, 32 nt, Human
aguaguuugagaccagccuggccaacauggug

SEQ ID NO: 326920 - RNA, 32 nt, Human
aguaguuugagaccagccuggccaauauggug

SEQ ID NO: 326921 - RNA, 32 nt, Human
aguaguuugugcuaggaaguauguaggaucca

SEQ ID NO: 326922 - RNA, 32 nt, Human
aguaguuuguguugggauuacugcucauaacc

SEQ ID NO: 326923 - RNA, 32 nt, Human
aguaguuuucccuugugacuucagggguugug

SEQ ID NO: 326924 - RNA, 32 nt, Human
aguaguuuuugguuucuugcuguugcuuuguu

SEQ ID NO: 326925 - RNA, 31 nt, Human
aguauaaaucuucagcauaccaaaguuauga

SEQ ID NO: 326926 - RNA, 32 nt, Human
aguauaacugauuucaggcuaacuuauuacca

SEQ ID NO: 326927 - RNA, 32 nt, Human
aguauaaggugucucauuugagucuuuuucuu

SEQ ID NO: 326928 - RNA, 32 nt, Human
aguauaauaaacugugaguauucuuccagaua

SEQ ID NO: 326929 - RNA, 32 nt, Human
aguauaauaaguaaccuuugguacagcagguu

SEQ ID NO: 326930 - RNA, 32 nt, Human
aguauaaugauacaucguagccuaagaaauau

SEQ ID NO: 326931 - RNA, 32 nt, Human
aguauaaugucauuaaggaaauuaagccucug

SEQ ID NO: 326932 - RNA, 21 nt, Human
aguauacaauucagucacuaa

SEQ ID NO: 326933 - RNA, 32 nt, Human
aguauacacggucuaacucaucucuccccaga

SEQ ID NO: 326934 - RNA, 32 nt, Human
aguauacaguguaugccuuuuccuucaugcag

SEQ ID NO: 326935 - RNA, 32 nt, Human
aguauacauaugccauauguauaacaagaaau

SEQ ID NO: 326936 - RNA, 32 nt, Human
aguauacauauguacuauagacauguuaauaa

SEQ ID NO: 326937 - RNA, 32 nt, Human
aguauacauggugauguacaucuguagcaaag

SEQ ID NO: 326938 - RNA, 32 nt, Human
aguauaccugcucuccuaugaccccaaaucau

SEQ ID NO: 326939 - RNA, 32 nt, Human
aguauacuacaguuauguuuacaucugaaagu

SEQ ID NO: 326940 - RNA, 32 nt, Human
aguauacuagcuuuuugcuucucuuuuagaaa

SEQ ID NO: 326941 - RNA, 32 nt, Human
aguauacuaucuuuaccuucaguuuuucagau

SEQ ID NO: 326942 - RNA, 32 nt, Human
aguauacugagaaccaggguucccucuggggu

SEQ ID NO: 326943 - RNA, 32 nt, Human
aguauacuggacugugcaucaaagggauguaa

SEQ ID NO: 326944 - RNA, 32 nt, Human
aguauagaagucuggcaaaaacagaaacagaa

SEQ ID NO: 326945 - RNA, 32 nt, Human
aguauagagaaaaguguauuagaugugguuuu

SEQ ID NO: 326946 - RNA, 32 nt, Human
aguauagagccaagagguaagcacagaucaaa

SEQ ID NO: 326947 - RNA, 32 nt, Human
aguauagaguccauauacaaagaaguuacagc

SEQ ID NO: 326948 - RNA, 32 nt, Human
aguauagauguuaggauaaagagcagacccuu

SEQ ID NO: 326949 - RNA, 32 nt, Human
aguauagcuacacuauugacuccaaccaggug

SEQ ID NO: 326950 - RNA, 32 nt, Human
aguauagcucuguaguggaauaugucuucugu

SEQ ID NO: 326951 - RNA, 32 nt, Human
aguauagcugugcaccucugggcaaauaguuu

SEQ ID NO: 326952 - RNA, 32 nt, Human
aguauaggaggguuacuuggggccaguaaauc

SEQ ID NO: 326953 - RNA, 32 nt, Human
aguauaggcaacagguuaaacuaccacguggg

SEQ ID NO: 326954 - RNA, 32 nt, Human
aguauaggcacuggguccagccuugaucagug

SEQ ID NO: 326955 - RNA, 32 nt, Human
aguauagugacuauccguucaugagagaaauu

SEQ ID NO: 326956 - RNA, 32 nt, Human
aguauagugacuaucuguucaugagagaaauu

SEQ ID NO: 326957 - RNA, 32 nt, Human
aguauauaaaaauucaggcaggagagaugguu

SEQ ID NO: 326958 - RNA, 32 nt, Human
aguauaucaagcaauaaucucccacccaaggc

SEQ ID NO: 326959 - RNA, 32 nt, Human
aguauaucugugcuucacuggaagaguugaaa

SEQ ID NO: 326960 - RNA, 31 nt, Human
aguauaugacuucucuuucuccgugguuagu

SEQ ID NO: 326961 - RNA, 32 nt, Human
aguauaugggguaggccgggugcaguggcuca

SEQ ID NO: 326962 - RNA, 32 nt, Human
aguauaugguguuccuagaaugcagcugaaga

SEQ ID NO: 326963 - RNA, 32 nt, Human
aguauauuauuuuacuaauuguacuuuuauga

SEQ ID NO: 326964 - RNA, 32 nt, Human
aguauauuguaaagauaggacaugguauaaug

SEQ ID NO: 326965 - RNA, 32 nt, Human
aguauauuuggguaauaaugaaaguuuaauuc

SEQ ID NO: 326966 - RNA, 32 nt, Human
aguauauuuuguucugaacuggcaguuuaaga

SEQ ID NO: 326967 - RNA, 32 nt, Human
aguauauuuuugcagaacaggcagcagcaaua

SEQ ID NO: 326968 - RNA, 32 nt, Human
aguaucaacucugcccguuggcugccugagcc

SEQ ID NO: 326969 - RNA, 32 nt, Human
aguaucaacuggccaggcaggguggcucacgc

SEQ ID NO: 326970 - RNA, 30 nt, Human
aguaucaccuuccccaugcucuuguggcug

SEQ ID NO: 326971 - RNA, 32 nt, Human
aguaucacuuuugcugugaugauguguucuug

SEQ ID NO: 326972 - RNA, 32 nt, Human
aguaucagaggguggagaugucagucugucca

SEQ ID NO: 326973 - RNA, 32 nt, Human
aguaucaggaauugggaucgcuagaguguuuc

SEQ ID NO: 326974 - RNA, 32 nt, Human
aguaucagucaugacagaugaagaaggagcag

SEQ ID NO: 326975 - RNA, 32 nt, Human
aguaucagugauggcaugaauucuucagcaca

SEQ ID NO: 326976 - RNA, 32 nt, Human
aguaucaguuuuacuuuucagaggauuuguaa

SEQ ID NO: 326977 - RNA, 32 nt, Human
aguaucaguuuuugaaccacaguaaugggaag

SEQ ID NO: 326978 - RNA, 32 nt, Human
aguaucauaagaaagugccaauguuucaauga

SEQ ID NO: 326979 - RNA, 32 nt, Human
aguaucauaaugaaggcaaagagaacuaggcu

SEQ ID NO: 326980 - RNA, 24 nt, Human
aguaucaugcuguuuugguuacug

SEQ ID NO: 326981 - RNA, 32 nt, Human
aguaucauuagagcuguccaaaauggaacagc

SEQ ID NO: 326982 - RNA, 32 nt, Human
aguaucauuugagccaggagguugagguugca

SEQ ID NO: 326983 - RNA, 32 nt, Human
aguauccaaagaucagguuggcaccaacaggu

SEQ ID NO: 326984 - RNA, 32 nt, Human
aguauccaacacaggcaauauuccagcuaugg

SEQ ID NO: 326985 - RNA, 32 nt, Human
aguauccaagaagucauuugccagcagauuuc

SEQ ID NO: 326986 - RNA, 32 nt, Human
aguaucccacacacacuggugcccagagccgg

SEQ ID NO: 326987 - RNA, 32 nt, Human
aguaucccuugagucugggagguggaggcugc

SEQ ID NO: 326988 - RNA, 32 nt, Human
aguaucuacagcuucagaacuugagcuaagua

SEQ ID NO: 326989 - RNA, 32 nt, Human
aguaucuauccaggagcuaccccaccaaacug

SEQ ID NO: 326990 - RNA, 32 nt, Human
aguaucucaaagacuucacuugacuucuugau

SEQ ID NO: 326991 - RNA, 32 nt, Human
aguaucucacagucccauccuuccaaccuucu

SEQ ID NO: 326992 - RNA, 32 nt, Human
aguaucucuguaacagugucuuaaauaaaugc

SEQ ID NO: 326993 - RNA, 32 nt, Human
aguaucugaagagugagagcauucauguuuga

SEQ ID NO: 326994 - RNA, 32 nt, Human
aguaucugcugugagccagagagcagaaggaa

SEQ ID NO: 326995 - RNA, 32 nt, Human
aguaucugcuucuguagcccacggcaccccaa

SEQ ID NO: 326996 - RNA, 32 nt, Human
aguaucugggacuacaguugcaugucaccacg

SEQ ID NO: 326997 - RNA, 32 nt, Human
aguaucugggauuacaggcaugugccaccaca

SEQ ID NO: 326998 - RNA, 32 nt, Human
aguaucugggggaacaucuaucaaagaagaga

SEQ ID NO: 326999 - RNA, 32 nt, Human
aguaucugucacugcuacauaguuccuuaauu

SEQ ID NO: 327000 - RNA, 32 nt, Human
aguaucugucaggcugucaggcugucagguug

SEQ ID NO: 327001 - RNA, 32 nt, Human
aguaucugucccaggagcccacacagagggac

SEQ ID NO: 327002 - RNA, 32 nt, Human
aguaucugugauuacaggcacgugccaccaug

SEQ ID NO: 327003 - RNA, 32 nt, Human
aguaucuguuaccccuucccucccagaguaac

SEQ ID NO: 327004 - RNA, 32 nt, Human
aguaucuuaacuuccauugucuucuuguuaac

SEQ ID NO: 327005 - RNA, 32 nt, Human
aguaucuucauacuuccucauccccucauugc

SEQ ID NO: 327006 - RNA, 32 nt, Human
aguaucuuccacugccccaucuguuggccacc

SEQ ID NO: 327007 - RNA, 32 nt, Human
aguaucuucguaaaucaagaacugguaaacca

SEQ ID NO: 327008 - RNA, 32 nt, Human
aguaucuuguugaauuguauguucuguuggau

SEQ ID NO: 327009 - RNA, 23 nt, Human
aguaucuuuguugauggcugcug

SEQ ID NO: 327010 - RNA, 32 nt, Human
aguaugaagaaaagcaacccaaaacucucaau

SEQ ID NO: 327011 - RNA, 32 nt, Human
aguaugaaguauucuugcacugccauuuucuu

SEQ ID NO: 327012 - RNA, 32 nt, Human
aguaugagaagucacugucaaugaaaguuguu

SEQ ID NO: 327013 - RNA, 32 nt, Human
aguaugagauagauuuaaucuucugagacaga

SEQ ID NO: 327014 - RNA, 32 nt, Human
aguaugaggugaacggggugaaaccucccauu

SEQ ID NO: 327015 - RNA, 32 nt, Human
aguaugagucucuuugccucucugggucucua

SEQ ID NO: 327016 - RNA, 32 nt, Human
aguaugagugagacccacagugcaccagagca

SEQ ID NO: 327017 - RNA, 32 nt, Human
aguaugaguguauguacuuuugauauucugug

SEQ ID NO: 327018 - RNA, 32 nt, Human
aguaugauggcaggagaaucagccuggggccu

SEQ ID NO: 327019 - RNA, 32 nt, Human
aguaugcauuucuuagagcaguagcuugcagu

SEQ ID NO: 327020 - RNA, 32 nt, Human
aguaugccaaagacuucauaaugaauucacca

SEQ ID NO: 327021 - RNA, 32 nt, Human
aguaugccagcugucucaauggcucaccauac

SEQ ID NO: 327022 - RNA, 32 nt, Human
aguaugccgcugcacuccagccugggggacag

SEQ ID NO: 327023 - RNA, 32 nt, Human
aguaugccuaaacucucugggcucccaggacc

SEQ ID NO: 327024 - RNA, 32 nt, Human
aguaugcuaaagauuuauuucuaguuugugua

SEQ ID NO: 327025 - RNA, 32 nt, Human
aguaugcuuacugaggccaugagaaccugagg

SEQ ID NO: 327026 - RNA, 32 nt, Human
aguaugcuuggguugcuauaacauacuaccau

SEQ ID NO: 327027 - RNA, 32 nt, Human
aguauggagcucagagagggcaggcaugaagu

SEQ ID NO: 327028 - RNA, 32 nt, Human
aguauggauguggcagaguccugaugaaagau

SEQ ID NO: 327029 - RNA, 32 nt, Human
aguauggauguuuccguaaaagcuggaauucc

SEQ ID NO: 327030 - RNA, 32 nt, Human
aguauggcagaauagcuaaagacuggacucag

SEQ ID NO: 327031 - RNA, 32 nt, Human
aguauggcaugccuaauuccaguauccuggaa

SEQ ID NO: 327032 - RNA, 32 nt, Human
aguauggccagccuccagcucucagccaggag

SEQ ID NO: 327033 - RNA, 32 nt, Human
aguauggcccaaagcucuuguguccuuuguga

SEQ ID NO: 327034 - RNA, 32 nt, Human
aguauggcugaggccuugcccacccaccugcc

SEQ ID NO: 327035 - RNA, 32 nt, Human
aguaugggaugagaucaauaagccuacagaga

SEQ ID NO: 327036 - RNA, 32 nt, Human
aguauggggccaggccccagagucccuuaucc

SEQ ID NO: 327037 - RNA, 32 nt, Human
aguaugguccucagaucccccuucucuccugc

SEQ ID NO: 327038 - RNA, 32 nt, Human
aguauggucucgaucuccugaccucgugauuc

SEQ ID NO: 327039 - RNA, 32 nt, Human
aguauggugaaauagcaggugcgucuucuagu

SEQ ID NO: 327040 - RNA, 32 nt, Human
aguauggugaugaacaaccacguucugacugg

SEQ ID NO: 327041 - RNA, 32 nt, Human
aguaugguucccaauuuuuaaauccauuucau

SEQ ID NO: 327042 - RNA, 32 nt, Human
aguauguacaagagaaaacggaagagagagga

SEQ ID NO: 327043 - RNA, 32 nt, Human
aguauguacgaggaauuucaaaucaucagaug

SEQ ID NO: 327044 - RNA, 31 nt, Human
aguauguacucaauaaauauuuguuggcuuu

SEQ ID NO: 327045 - RNA, 32 nt, Human
aguauguauuaaaagcaaaaauucccaugaag

SEQ ID NO: 327046 - RNA, 32 nt, Human
aguaugucugaagaguacagugagagguuaau

SEQ ID NO: 327047 - RNA, 20 nt, Human
aguaugucuucagcuugauc

SEQ ID NO: 327048 - RNA, 20 nt, Human
aguaugugcucagcgaggaa

SEQ ID NO: 327049 - RNA, 32 nt, Human
aguauguggcaaaacauauaccaccauagugc

SEQ ID NO: 327050 - RNA, 32 nt, Human
aguauguggcaaaacauauaccacccauagug

SEQ ID NO: 327051 - RNA, 32 nt, Human
aguaugugguugcaggaggcgguuguguucga

SEQ ID NO: 327052 - RNA, 32 nt, Human
aguauguucacagccugcuuuaucucuccuug

SEQ ID NO: 327053 - RNA, 32 nt, Human
aguauguuucauuuucuuucuucuucaccucu

SEQ ID NO: 327054 - RNA, 32 nt, Human
aguauguuugaacucuccagugcccuauagcu

SEQ ID NO: 327055 - RNA, 32 nt, Human
aguauuaaagaauugaggguggaauucuuaga

SEQ ID NO: 327056 - RNA, 32 nt, Human
aguauuaaccaaggagagaggaagggagcagg

SEQ ID NO: 327057 - RNA, 32 nt, Human
aguauuaaggguaggauguugcucugaaucac

SEQ ID NO: 327058 - RNA, 32 nt, Human
aguauuaaugaugccagcugucaggauaauaa

SEQ ID NO: 327059 - RNA, 32 nt, Human
aguauuaaugcaacugaagcugugauauuucc

SEQ ID NO: 327060 - RNA, 32 nt, Human
aguauuaauguuuuugcauacucuccaucuuu

SEQ ID NO: 327061 - RNA, 32 nt, Human
aguauuacaagaucaacuucugacccugugaa

SEQ ID NO: 327062 - RNA, 32 nt, Human
aguauuacagccgccucauccaccagaagcau

SEQ ID NO: 327063 - RNA, 32 nt, Human
aguauuacccaugggacaaaauuuguacuauu

SEQ ID NO: 327064 - RNA, 32 nt, Human
aguauuaccuuccuccccuauguauuaguaaa

SEQ ID NO: 327065 - RNA, 32 nt, Human
aguauuaccuuuuggaauuaaaagccacugac

SEQ ID NO: 327066 - RNA, 32 nt, Human
aguauuauagaaagcaaagaaugaaaugugcu

SEQ ID NO: 327067 - RNA, 32 nt, Human
aguauuauugaauuuauuuucuaaaucaggau

SEQ ID NO: 327068 - RNA, 32 nt, Human
aguauuauuuuccugaauaagaaccaggaaga

SEQ ID NO: 327069 - RNA, 32 nt, Human
aguauucagcaguggcuggacucuggauucuu

SEQ ID NO: 327070 - RNA, 32 nt, Human
aguauuccagcagauacagaugugaacaguca

SEQ ID NO: 327071 - RNA, 32 nt, Human
aguauuccauuucagaaaauggagauuugguu

SEQ ID NO: 327072 - RNA, 32 nt, Human
aguauucccaagaagccccaaauauguaagua

SEQ ID NO: 327073 - RNA, 32 nt, Human
aguauuccucuccugguaccgcaaggccuccu

SEQ ID NO: 327074 - RNA, 32 nt, Human
aguauucuaguguucucucuuuguuuggcaua

SEQ ID NO: 327075 - RNA, 22 nt, Human
aguauucugaaaggagauuuga

SEQ ID NO: 327076 - RNA, 32 nt, Human
aguauucugaagauagcgacagugacucugau

SEQ ID NO: 327077 - RNA, 32 nt, Human
aguauucuucacggcagccagaaguuaauggu

SEQ ID NO: 327078 - RNA, 32 nt, Human
aguauucuucagagagcugccuucccaaggga

SEQ ID NO: 327079 - RNA, 32 nt, Human
aguauucuucauuauccuuuugaugucugcag

SEQ ID NO: 327080 - RNA, 32 nt, Human
aguauucuugaggagccuuuugcucauaggcu

SEQ ID NO: 327081 - RNA, 32 nt, Human
aguauugaauacuuacauucucuaauaagaaa

SEQ ID NO: 327082 - RNA, 32 nt, Human
aguauugacagaagacguuacagugaagugcu

SEQ ID NO: 327083 - RNA, 32 nt, Human
aguauugagaugcuaaggagcugaugccaccu

SEQ ID NO: 327084 - RNA, 32 nt, Human
aguauugagauuacaggcaugagccacugcac

SEQ ID NO: 327085 - RNA, 32 nt, Human
aguauugaguccuguuugagcuauuguucucu

SEQ ID NO: 327086 - RNA, 32 nt, Human
aguauugagugaggacauucccaaaaccaaag

SEQ ID NO: 327087 - RNA, 32 nt, Human
aguauugcccuuucugucuuucuccuugugcc

SEQ ID NO: 327088 - RNA, 21 nt, Human
aguauugcuggagccccaaca

SEQ ID NO: 327089 - RNA, 32 nt, Human
aguauuggaaacauacuagccauuugaagaca

SEQ ID NO: 327090 - RNA, 32 nt, Human
aguauuggacauguuggcaguaugaagagacc

SEQ ID NO: 327091 - RNA, 32 nt, Human
aguauuggagaaaugcuuagguccuaugauag

SEQ ID NO: 327092 - RNA, 32 nt, Human
aguauuggagguggagccuagugggaggugau

SEQ ID NO: 327093 - RNA, 32 nt, Human
aguauuggaucugaaaauaaagugucauccaa

SEQ ID NO: 327094 - RNA, 32 nt, Human
aguauugggacuacaggcgugagccacagugc

SEQ ID NO: 327095 - RNA, 32 nt, Human
aguauugggauuacagacaugagccacugcac

SEQ ID NO: 327096 - RNA, 32 nt, Human
aguauugggauuacccgcgugagccaccgcgc

SEQ ID NO: 327097 - RNA, 32 nt, Human
aguauugggguggagguugcagugagcagaga

SEQ ID NO: 327098 - RNA, 32 nt, Human
aguauugggguggagguugcagugagcggaga

SEQ ID NO: 327099 - RNA, 18 nt, Human
aguauugguacaucuugg

SEQ ID NO: 327100 - RNA, 32 nt, Human
aguauugucuaaagugagcccagaggccacug

SEQ ID NO: 327101 - RNA, 20 nt, Human
aguauuuaacauucuugguc

SEQ ID NO: 327102 - RNA, 32 nt, Human
aguauuuaagaaaaggcugggccaggcacgau

SEQ ID NO: 327103 - RNA, 32 nt, Human
aguauuuaagugcccauaaggcagcaugaaaa

SEQ ID NO: 327104 - RNA, 32 nt, Human
aguauuuaugugaaaacucucuagaagguaaa

SEQ ID NO: 327105 - RNA, 32 nt, Human
aguauuuauucuuuguauuacacaaguccagu

SEQ ID NO: 327106 - RNA, 32 nt, Human
aguauuucaagaccagccuaaaggucaacaua

SEQ ID NO: 327107 - RNA, 32 nt, Human
aguauuucagagggccaggcaagagcacuuca

SEQ ID NO: 327108 - RNA, 32 nt, Human
aguauuuccucugaacagucauugauucuuca

SEQ ID NO: 327109 - RNA, 32 nt, Human
aguauuugagccacgaguuuaugugcacaagu

SEQ ID NO: 327110 - RNA, 32 nt, Human
aguauuugaggauauaaagaggaugugcacug

SEQ ID NO: 327111 - RNA, 22 nt, Human
aguauuugccaauaaaugaucu

SEQ ID NO: 327112 - RNA, 32 nt, Human
aguauuuggcaaucacuucauccacuacugca

SEQ ID NO: 327113 - RNA, 32 nt, Human
aguauuugguugccuucugaugccacuucuuc

SEQ ID NO: 327114 - RNA, 32 nt, Human
aguauuuguaagaauaaagcagcauuugaaau

SEQ ID NO: 327115 - RNA, 32 nt, Human
aguauuuguccuucugugacuggcuuauuuca

SEQ ID NO: 327116 - RNA, 32 nt, Human
aguauuugugcaacacaagcacaacuaaguau

SEQ ID NO: 327117 - RNA, 32 nt, Human
aguauuuguuccuguuuuacaaugcuucuguc

SEQ ID NO: 327118 - RNA, 32 nt, Human
aguauuuuaccaacucuugucuuagggagcau

SEQ ID NO: 327119 - RNA, 32 nt, Human
aguauuuuacuucucccuugaguccccaugcu

SEQ ID NO: 327120 - RNA, 32 nt, Human
aguauuuucagacauggugaaugcaucgacug

SEQ ID NO: 327121 - RNA, 32 nt, Human
aguauuuucauuuuguuuauuuuugccuuaua

SEQ ID NO: 327122 - RNA, 32 nt, Human
aguauuuugaaugaguuugacacugccggcuu

SEQ ID NO: 327123 - RNA, 32 nt, Human
aguauuuuggagugcagaacauucucaauuaa

SEQ ID NO: 327124 - RNA, 32 nt, Human
aguauuuuuaagucucaccaaaaagguggaag

SEQ ID NO: 327125 - RNA, 32 nt, Human
aguauuuuuaguaguggaucacuguggacagg

SEQ ID NO: 327126 - RNA, 32 nt, Human
aguauuuuucgucaguuaaaacuguuagaucu

SEQ ID NO: 327127 - RNA, 32 nt, Human
aguauuuuucucaaaugaacauguuuauugca

SEQ ID NO: 327128 - RNA, 32 nt, Human
aguauuuuuguuguuuauuuauaagguaauug

SEQ ID NO: 327129 - RNA, 21 nt, Human
agucaaaaagccuuuucugug

SEQ ID NO: 327130 - RNA, 32 nt, Human
agucaaaaaggcugcucggacccaggucuggc

SEQ ID NO: 327131 - RNA, 32 nt, Human
agucaaaaauacacguucgggccaggcgcggu

SEQ ID NO: 327132 - RNA, 32 nt, Human
agucaaaaaugagugucagcacuacuacugau

SEQ ID NO: 327133 - RNA, 32 nt, Human
agucaaaacucauugcacaucauagaacauac

SEQ ID NO: 327134 - RNA, 32 nt, Human
agucaaaauuacggcugcaaaauggcuaaggu

SEQ ID NO: 327135 - RNA, 25 nt, Human
agucaaacaaagaagaagucccugg

SEQ ID NO: 327136 - RNA, 18 nt, Human
agucaaacaaggaagcug

SEQ ID NO: 327137 - RNA, 32 nt, Human
agucaaaccacugcaauccagccugggcaacg

SEQ ID NO: 327138 - RNA, 32 nt, Human
agucaaaccagcuccuucaagaagcuuugagc

SEQ ID NO: 327139 - RNA, 32 nt, Human
agucaaaggcauuuugcugacuuuaauauuga

SEQ ID NO: 327140 - RNA, 32 nt, Human
agucaaagggccugaggaaugacuacuucccu

SEQ ID NO: 327141 - RNA, 32 nt, Human
agucaaagucccaacaccaggcccaguuccag

SEQ ID NO: 327142 - RNA, 32 nt, Human
agucaaagugaucagauagauguggauuauca

SEQ ID NO: 327143 - RNA, 32 nt, Human
agucaaaugaaugagucugcaccugguaccua

SEQ ID NO: 327144 - RNA, 32 nt, Human
agucaaauuacccuaagagaaaugacuaucau

SEQ ID NO: 327145 - RNA, 32 nt, Human
agucaacaagaguaagacaacauaccagaucc

SEQ ID NO: 327146 - RNA, 32 nt, Human
agucaacaauuauuccuucugaaaguaagggu

SEQ ID NO: 327147 - RNA, 32 nt, Human
agucaacagcuuucaacagaucuucaaaggcu

SEQ ID NO: 327148 - RNA, 32 nt, Human
agucaacaguucaggagaagagaaggaauuug

SEQ ID NO: 327149 - RNA, 32 nt, Human
agucaacauaaauaaauacagaaugccauguu

SEQ ID NO: 327150 - RNA, 32 nt, Human
agucaacauaugcaaaauacuguacauuguga

SEQ ID NO: 327151 - RNA, 25 nt, Human
agucaacaucugcugcuuuccugug

SEQ ID NO: 327152 - RNA, 32 nt, Human
agucaacaucuucaucauugggcuuucuuuaa

SEQ ID NO: 327153 - RNA, 32 nt, Human
agucaacaugccaaagaaugaggcuggagaca

SEQ ID NO: 327154 - RNA, 32 nt, Human
agucaacauggugaaaccccgucuccauuaaa

SEQ ID NO: 327155 - RNA, 32 nt, Human
agucaacauggugaaaccucaucucugcuaaa

SEQ ID NO: 327156 - RNA, 32 nt, Human
agucaaccacuucaccucacugggcaaggaag

SEQ ID NO: 327157 - RNA, 32 nt, Human
agucaaccagcuguagaugggcuuguuccgag

SEQ ID NO: 327158 - RNA, 25 nt, Human
agucaaccagcuguggcuuccugug

SEQ ID NO: 327159 - RNA, 32 nt, Human
agucaaccggagaacccaaaaaucaggaauag

SEQ ID NO: 327160 - RNA, 32 nt, Human
agucaaccugaguuccucccuccugggaagcu

SEQ ID NO: 327161 - RNA, 32 nt, Human
agucaacuggaaaauucaaggaguuaauaaaa

SEQ ID NO: 327162 - RNA, 32 nt, Human
agucaagacaagaaaaucaacaggcuuucagc

SEQ ID NO: 327163 - RNA, 32 nt, Human
agucaagagaguacugaaagaccugcgggacu

SEQ ID NO: 327164 - RNA, 32 nt, Human
agucaagagaucaagaccauccuggccaacau

SEQ ID NO: 327165 - RNA, 32 nt, Human
agucaagagaucuggaaaucuuuuaaucaguu

SEQ ID NO: 327166 - RNA, 32 nt, Human
agucaagagauggcuccagacaccccggaucc

SEQ ID NO: 327167 - RNA, 32 nt, Human
agucaagaggcagagggacuugggaccuggga

SEQ ID NO: 327168 - RNA, 32 nt, Human
agucaagaggcugaggccagagaaucgcuuga

SEQ ID NO: 327169 - RNA, 32 nt, Human
agucaagaggggcagcucaggaugcuaccagg

SEQ ID NO: 327170 - RNA, 32 nt, Human
agucaagaucucaccacugaacuccagccugg

SEQ ID NO: 327171 - RNA, 32 nt, Human
agucaagcagggaggcacgggccacacacaca

SEQ ID NO: 327172 - RNA, 32 nt, Human
agucaagccaguuuccagaagggcugggguga

SEQ ID NO: 327173 - RNA, 32 nt, Human
agucaaggagcagcagaccuggcacuggaaca

SEQ ID NO: 327174 - RNA, 32 nt, Human
agucaaggccgaacuccagccugguggcuuug

SEQ ID NO: 327175 - RNA, 32 nt, Human
agucaaggccuugccgcccgcagcggggucag

SEQ ID NO: 327176 - RNA, 32 nt, Human
agucaaggucugggugacgcgguguccagagg

SEQ ID NO: 327177 - RNA, 32 nt, Human
agucaaggugcuggcggggcuaugucccuucu

SEQ ID NO: 327178 - RNA, 32 nt, Human
agucaaggugcugguggggcuaugucccuucu

SEQ ID NO: 327179 - RNA, 32 nt, Human
agucaagguggggucccaggagcagcugugac

SEQ ID NO: 327180 - RNA, 32 nt, Human
agucaaggugugaccgucgaccacagccagug

SEQ ID NO: 327181 - RNA, 32 nt, Human
agucaagguuuauuuucacaugaguccagcuu

SEQ ID NO: 327182 - RNA, 23 nt, Human
agucaaguaaacaucuuuccugu

SEQ ID NO: 327183 - RNA, 32 nt, Human
agucaagucggccacagacuugagcgcuuuau

SEQ ID NO: 327184 - RNA, 22 nt, Human
agucaaguuuguggcuuaugga

SEQ ID NO: 327185 - RNA, 21 nt, Human
agucaaguuuguguucagggg

SEQ ID NO: 327186 - RNA, 32 nt, Human
agucaauacaucuugcuuauucuacaaucaag

SEQ ID NO: 327187 - RNA, 32 nt, Human
agucaauacccacucaucuggaauauugucuc

SEQ ID NO: 327188 - RNA, 32 nt, Human
agucaauaucuuggacuauaguuaauuuauca

SEQ ID NO: 327189 - RNA, 32 nt, Human
agucaaucaccacuuauucucaggcaaauuau

SEQ ID NO: 327190 - RNA, 32 nt, Human
agucaaucccagcugucucggaccagggcccc

SEQ ID NO: 327191 - RNA, 32 nt, Human
agucaaucugaaauuuucauaaaagagaugua

SEQ ID NO: 327192 - RNA, 32 nt, Human
agucaauggauguugcuugggcauuuuggggg

SEQ ID NO: 327193 - RNA, 20 nt, Human
agucaauguuucuuuuauca

SEQ ID NO: 327194 - RNA, 32 nt, Human
agucaauuagaugugcaggaguaaguaguaua

SEQ ID NO: 327195 - RNA, 32 nt, Human
agucaauuauucacgccaugcacagcauaauu

SEQ ID NO: 327196 - RNA, 32 nt, Human
agucaauuauuuuucaaaauguagaauuguag

SEQ ID NO: 327197 - RNA, 32 nt, Human
agucaauuccuucuuccucaccucucagccuc

SEQ ID NO: 327198 - RNA, 32 nt, Human
agucaauucuccucacuauaacuggguguggu

SEQ ID NO: 327199 - RNA, 32 nt, Human
agucaauugaaaagauuuuaucaggaauuaca

SEQ ID NO: 327200 - RNA, 32 nt, Human
agucacaaacauguuuugcaacaaaguuuuaa

SEQ ID NO: 327201 - RNA, 32 nt, Human
agucacaaaggccaaaguuuuaaaggaagaaa

SEQ ID NO: 327202 - RNA, 32 nt, Human
agucacaacaaaaggaagacuggagaaaugcu

SEQ ID NO: 327203 - RNA, 32 nt, Human
agucacaaggacauaguagcugagggguugcg

SEQ ID NO: 327204 - RNA, 32 nt, Human
agucacaagggcccugaccucaugaccuccca

SEQ ID NO: 327205 - RNA, 27 nt, Human
agucacaagggggccugagugcagugg

SEQ ID NO: 327206 - RNA, 32 nt, Human
agucacaagggggccugagugcaguggcucac

SEQ ID NO: 327207 - RNA, 32 nt, Human
agucacacaacuaucaaggagcagagcugagg

SEQ ID NO: 327208 - RNA, 32 nt, Human
agucacacacaaaacgcucacggaccuugaac

SEQ ID NO: 327209 - RNA, 32 nt, Human
agucacacagcagccuuguaggugacuggagg

SEQ ID NO: 327210 - RNA, 32 nt, Human
agucacacagccgugacucauugcucagguga

SEQ ID NO: 327211 - RNA, 32 nt, Human
agucacaccacuggcugccagucagggccugc

SEQ ID NO: 327212 - RNA, 32 nt, Human
agucacaccccugcacuccagccugggugaca

SEQ ID NO: 327213 - RNA, 32 nt, Human
agucacaccuauagucucagcauuuugggaaa

SEQ ID NO: 327214 - RNA, 32 nt, Human
agucacacuccacucaccuccaccucccaaag

SEQ ID NO: 327215 - RNA, 32 nt, Human
agucacagacacacucugccaugucuuagcug

SEQ ID NO: 327216 - RNA, 32 nt, Human
agucacagacacacuugaacuucacuacacuc

SEQ ID NO: 327217 - RNA, 32 nt, Human
agucacagagagaccucccuacugugucagag

SEQ ID NO: 327218 - RNA, 32 nt, Human
agucacagagaggggaagagaaaacagggacg

SEQ ID NO: 327219 - RNA, 32 nt, Human
agucacagagaugggaaggcagccuccugccu

SEQ ID NO: 327220 - RNA, 32 nt, Human
agucacagaucugucagccugggaaccggccc

SEQ ID NO: 327221 - RNA, 32 nt, Human
agucacagcaaacuguacaauggcaguugagu

SEQ ID NO: 327222 - RNA, 32 nt, Human
agucacagccuccucaaaggguugugaaaauc

SEQ ID NO: 327223 - RNA, 32 nt, Human
agucacagcuacucagggagguugaggcagca

SEQ ID NO: 327224 - RNA, 32 nt, Human
agucacagcuacuccagaggcugaggcaggag

SEQ ID NO: 327225 - RNA, 32 nt, Human
agucacagcuacucgggaggccgaggugggag

SEQ ID NO: 327226 - RNA, 32 nt, Human
agucacagcuacucgggaggcggagucaggag

SEQ ID NO: 327227 - RNA, 32 nt, Human
agucacagcuacuugggagacugagguuggag

SEQ ID NO: 327228 - RNA, 32 nt, Human
agucacaggagagaugagggugagaauggagu

SEQ ID NO: 327229 - RNA, 32 nt, Human
agucacaggagggagagagaggcaguguacuu

SEQ ID NO: 327230 - RNA, 32 nt, Human
agucacaggauucugaaggcagcugugcaagu

SEQ ID NO: 327231 - RNA, 32 nt, Human
agucacaggcugcauagauugcaggaaagcga

SEQ ID NO: 327232 - RNA, 32 nt, Human
agucacagggagaagacguccacccacacauc

SEQ ID NO: 327233 - RNA, 32 nt, Human
agucacaggggaacugacauuuugucaaaaga

SEQ ID NO: 327234 - RNA, 32 nt, Human
agucacaggggcccugaccccaggccacacag

SEQ ID NO: 327235 - RNA, 32 nt, Human
agucacagggucaggggucaggugguuguagu

SEQ ID NO: 327236 - RNA, 32 nt, Human
agucacaggguugccuuggacccucggcugua

SEQ ID NO: 327237 - RNA, 32 nt, Human
agucacauaguacuauuuacagaucuguccug

SEQ ID NO: 327238 - RNA, 32 nt, Human
agucacaucccaggcuggggauggaugcucug

SEQ ID NO: 327239 - RNA, 32 nt, Human
agucacaucuuccugcuuuguccagaacacau

SEQ ID NO: 327240 - RNA, 32 nt, Human
agucacaugccaccuugucauucccauauauc

SEQ ID NO: 327241 - RNA, 32 nt, Human
agucacauguacugccauacuacuucuuugua

SEQ ID NO: 327242 - RNA, 32 nt, Human
agucacauuccagauuugaagcuguguuuuug

SEQ ID NO: 327243 - RNA, 32 nt, Human
agucacauugaugaugaugagugcaguggggu

SEQ ID NO: 327244 - RNA, 20 nt, Human
agucacauugcugaugcuua

SEQ ID NO: 327245 - RNA, 32 nt, Human
agucacauuggcagagguggggguuggcugug

SEQ ID NO: 327246 - RNA, 32 nt, Human
agucaccaacaauagagucaggguaaagaaua

SEQ ID NO: 327247 - RNA, 32 nt, Human
agucaccaagaaacuuaauuuucauuuaaaau

SEQ ID NO: 327248 - RNA, 32 nt, Human
agucaccacacuccagccugggugacagagca

SEQ ID NO: 327249 - RNA, 18 nt, Human
agucaccacaggaugccu

SEQ ID NO: 327250 - RNA, 32 nt, Human
agucaccacaggcugaaugcccacgaggagcu

SEQ ID NO: 327251 - RNA, 32 nt, Human
agucaccacauccuucugccuggguggccucu

SEQ ID NO: 327252 - RNA, 32 nt, Human
agucaccaccaccuuauucaccuuagagccag

SEQ ID NO: 327253 - RNA, 32 nt, Human
agucaccaccucaagaggccaucuaguucugg

SEQ ID NO: 327254 - RNA, 32 nt, Human
agucaccacugacuguugcccugggcauagaa

SEQ ID NO: 327255 - RNA, 32 nt, Human
agucaccaggagaugaggguuaggugugccca

SEQ ID NO: 327256 - RNA, 32 nt, Human
agucaccagugaagagccuaugugcauuuugu

SEQ ID NO: 327257 - RNA, 24 nt, Human
agucaccaugugugggcucaggga

SEQ ID NO: 327258 - RNA, 22 nt, Human
agucaccauugcaaaugcuuaa

SEQ ID NO: 327259 - RNA, 25 nt, Human
agucacccaggcuggagugcagugg

SEQ ID NO: 327260 - RNA, 32 nt, Human
agucacccauguucucaacuggaaguuggucg

SEQ ID NO: 327261 - RNA, 32 nt, Human
agucaccccagccucugcugcaggauaucacc

SEQ ID NO: 327262 - RNA, 32 nt, Human
agucaccccucauuuuccucuggggaccccag

SEQ ID NO: 327263 - RNA, 32 nt, Human
agucaccccucugucuaaccagccccagcaca

SEQ ID NO: 327264 - RNA, 32 nt, Human
agucacccgggauuggaaugcaauggcgcgau

SEQ ID NO: 327265 - RNA, 32 nt, Human
agucacccuaaaaugcuucacaugguuaaaaa

SEQ ID NO: 327266 - RNA, 32 nt, Human
agucacccuaaaucaaggggcuuuucagaagg

SEQ ID NO: 327267 - RNA, 32 nt, Human
agucacccuacaacuacuacuucuugggaccu

SEQ ID NO: 327268 - RNA, 32 nt, Human
agucacccucugcaggcccagcuccugccucc

SEQ ID NO: 327269 - RNA, 32 nt, Human
agucaccuacucagcuuccucucuccaccacc

SEQ ID NO: 327270 - RNA, 32 nt, Human
agucaccuacuuccuguccuccucggccccag

SEQ ID NO: 327271 - RNA, 32 nt, Human
agucaccuccuccagcuccgccaucuugcgug

SEQ ID NO: 327272 - RNA, 32 nt, Human
agucaccucuggccuucaaggcccaggucuuu

SEQ ID NO: 327273 - RNA, 32 nt, Human
agucaccucugucaaagccacagucuguuccu

SEQ ID NO: 327274 - RNA, 32 nt, Human
agucaccugaacccaauuccugaacuuuuaaa

SEQ ID NO: 327275 - RNA, 32 nt, Human
agucaccugcagcuggaccuagagggugccuu

SEQ ID NO: 327276 - RNA, 32 nt, Human
agucaccugcugugguguguguccucuccucu

SEQ ID NO: 327277 - RNA, 32 nt, Human
agucaccuggagaucuuggugaaaugcagacu

SEQ ID NO: 327278 - RNA, 32 nt, Human
agucaccuggagaugggggccagguugugcag

SEQ ID NO: 327279 - RNA, 32 nt, Human
agucaccuguaaucccagcuacuugggaggcu

SEQ ID NO: 327280 - RNA, 32 nt, Human
agucaccuguagucccagcuacuugggaggau

SEQ ID NO: 327281 - RNA, 32 nt, Human
agucaccuguuccaguucuuugcccauuuccu

SEQ ID NO: 327282 - RNA, 32 nt, Human
agucacgacagcagaccaacuccacccuaaga

SEQ ID NO: 327283 - RNA, 32 nt, Human
agucacgccacugcacuccagccugggugaca

SEQ ID NO: 327284 - RNA, 32 nt, Human
agucacgccacugcauucuauccugggcaaca

SEQ ID NO: 327285 - RNA, 32 nt, Human
agucacgggcuccucucacuguucccugucug

SEQ ID NO: 327286 - RNA, 32 nt, Human
agucacgggcuuccacuucacagaccuccuua

SEQ ID NO: 327287 - RNA, 32 nt, Human
agucacggugggcgccuguaaucccagcuacu

SEQ ID NO: 327288 - RNA, 32 nt, Human
agucacgugaaaccucuucuccagucauagua

SEQ ID NO: 327289 - RNA, 20 nt, Human
agucacguguccuaccguca

SEQ ID NO: 327290 - RNA, 21 nt, Human
agucacuaccucuaucaccac

SEQ ID NO: 327291 - RNA, 32 nt, Human
agucacuacugccugccugccugccugcuacg

SEQ ID NO: 327292 - RNA, 32 nt, Human
agucacuagccugucuuuugccucuagggaug

SEQ ID NO: 327293 - RNA, 32 nt, Human
agucacuagccugugaucccagcacuuuggga

SEQ ID NO: 327294 - RNA, 32 nt, Human
agucacucacaccguucguacgcccaggacag

SEQ ID NO: 327295 - RNA, 32 nt, Human
agucacucaccucacugagccaccuccauuuc

SEQ ID NO: 327296 - RNA, 32 nt, Human
agucacucacuggcugauacauuuaaagcagc

SEQ ID NO: 327297 - RNA, 32 nt, Human
agucacucagcacagcccugggcacaucgcuu

SEQ ID NO: 327298 - RNA, 32 nt, Human
agucacucauuucuuaccauuuuauuccccuc

SEQ ID NO: 327299 - RNA, 32 nt, Human
agucacuccacgcuccccacaggccaacccug

SEQ ID NO: 327300 - RNA, 32 nt, Human
agucacucccuggcuacacacacugaggugcu

SEQ ID NO: 327301 - RNA, 32 nt, Human
agucacucucccagacuugcgugggucaguuc

SEQ ID NO: 327302 - RNA, 32 nt, Human
agucacucucuucaaucccacacccauggaca

SEQ ID NO: 327303 - RNA, 32 nt, Human
agucacucucuucacauuuuucuucuauuccu

SEQ ID NO: 327304 - RNA, 32 nt, Human
agucacucuugcauggcuuccaugucugguuu

SEQ ID NO: 327305 - RNA, 32 nt, Human
agucacugaacauagcuauauguaugguuguu

SEQ ID NO: 327306 - RNA, 32 nt, Human
agucacugaaguuccuucagugcucaagacuc

SEQ ID NO: 327307 - RNA, 32 nt, Human
agucacugaaguuugaaaaacauugacucaga

SEQ ID NO: 327308 - RNA, 32 nt, Human
agucacugaaugcucacaacagcccaaucugc

SEQ ID NO: 327309 - RNA, 32 nt, Human
agucacugacccuaacugcagaccaugaagua

SEQ ID NO: 327310 - RNA, 32 nt, Human
agucacugaggugacgguaccaagucaccggc

SEQ ID NO: 327311 - RNA, 32 nt, Human
agucacugcaaucucuuuaccaccuccccacu

SEQ ID NO: 327312 - RNA, 32 nt, Human
agucacugcagccugugucuccuggguucaag

SEQ ID NO: 327313 - RNA, 31 nt, Human
agucacugccucugucccucuggucagcgug

SEQ ID NO: 327314 - RNA, 32 nt, Human
agucacugcguguucgcaucaacuuggaagug

SEQ ID NO: 327315 - RNA, 32 nt, Human
agucacugcuuugcauacgagaccauggggac

SEQ ID NO: 327316 - RNA, 32 nt, Human
agucacuggccauguuauaaauauuguuauuu

SEQ ID NO: 327317 - RNA, 32 nt, Human
agucacugggagaagggaugugggucugaaga

SEQ ID NO: 327318 - RNA, 32 nt, Human
agucacugggauuacaggcgcccaccuccaca

SEQ ID NO: 327319 - RNA, 32 nt, Human
agucacugggauuacaggugcccaccaccaca

SEQ ID NO: 327320 - RNA, 32 nt, Human
agucacugggcagaggcacgagcacguccaca

SEQ ID NO: 327321 - RNA, 32 nt, Human
agucacugggcuuuuguuuugcuuuauggaaa

SEQ ID NO: 327322 - RNA, 32 nt, Human
agucacugucccggaaccuggggcagcggagu

SEQ ID NO: 327323 - RNA, 32 nt, Human
agucacugugagcucccaggugcagccagagg

SEQ ID NO: 327324 - RNA, 32 nt, Human
agucacuguggugggggcgagaggaggacuug

SEQ ID NO: 327325 - RNA, 23 nt, Human
agucacuguugaaguugcagugg

SEQ ID NO: 327326 - RNA, 32 nt, Human
agucacuuauaauuaugcuaccuacugauaac

SEQ ID NO: 327327 - RNA, 32 nt, Human
agucacuuccaaguuuccaagacuucucaugg

SEQ ID NO: 327328 - RNA, 32 nt, Human
agucacuuccaguguuggcugugugacagaau

SEQ ID NO: 327329 - RNA, 32 nt, Human
agucacuucucccuccaaugcaccaucugugg

SEQ ID NO: 327330 - RNA, 32 nt, Human
agucacuucuccuccuccuuucuccagccagc

SEQ ID NO: 327331 - RNA, 32 nt, Human
agucacuugaaaucuuugcagcaaugaguugg

SEQ ID NO: 327332 - RNA, 32 nt, Human
agucacuugaagcagugugcugugaagaugga

SEQ ID NO: 327333 - RNA, 32 nt, Human
agucacuuuuuacuucucagugccaucuauaa

SEQ ID NO: 327334 - RNA, 32 nt, Human
agucagaaaacacaccuggaauacgaugcagc

SEQ ID NO: 327335 - RNA, 32 nt, Human
agucagaauucuuccagauuguuuccagcugu

SEQ ID NO: 327336 - RNA, 32 nt, Human
agucagacagcagccacagggagaggguggua

SEQ ID NO: 327337 - RNA, 18 nt, Human
agucagaccagaaagcua

SEQ ID NO: 327338 - RNA, 32 nt, Human
agucagaccagaacauacuuccacuacaucag

SEQ ID NO: 327339 - RNA, 32 nt, Human
agucagaccagaauuuucuuugucccaugagg

SEQ ID NO: 327340 - RNA, 32 nt, Human
agucagaccagcugggaugggauccugccucc

SEQ ID NO: 327341 - RNA, 32 nt, Human
agucagaccgcuugcccacugcucuggugcag

SEQ ID NO: 327342 - RNA, 32 nt, Human
agucagacucacuagacuuuugguucgaguac

SEQ ID NO: 327343 - RNA, 32 nt, Human
agucagacucugcuucuucaccuucuccuucc

SEQ ID NO: 327344 - RNA, 32 nt, Human
agucagacugcacucccgcccuauuucugcaa

SEQ ID NO: 327345 - RNA, 32 nt, Human
agucagacuuagcccugagccugcacuuccug

SEQ ID NO: 327346 - RNA, 32 nt, Human
agucagagagaccagcaaaaagauugaaaaug

SEQ ID NO: 327347 - RNA, 32 nt, Human
agucagagagguggggugagggugagcuuacu

SEQ ID NO: 327348 - RNA, 32 nt, Human
agucagagaucauccauccauucuuugaauuu

SEQ ID NO: 327349 - RNA, 32 nt, Human
agucagagccugagugcacugcagccugaacu

SEQ ID NO: 327350 - RNA, 32 nt, Human
agucagaggccugggcgcagcucuggacucug

SEQ ID NO: 327351 - RNA, 23 nt, Human
agucagaggcuggagugcaaugg

SEQ ID NO: 327352 - RNA, 32 nt, Human
agucagaggcuggagugcaauggcgugaucuu

SEQ ID NO: 327353 - RNA, 32 nt, Human
agucagauaacacuguaauccaccuccagguu

SEQ ID NO: 327354 - RNA, 32 nt, Human
agucagauacagugcucugcaggccugcugug

SEQ ID NO: 327355 - RNA, 32 nt, Human
agucagauagucuucugcugcugguaccuggg

SEQ ID NO: 327356 - RNA, 32 nt, Human
agucagaucucaggcuugucccccugucagcu

SEQ ID NO: 327357 - RNA, 32 nt, Human
agucagauugaggaugcacauauacugggaaa

SEQ ID NO: 327358 - RNA, 32 nt, Human
agucagauuuccagucuccaccaggaaccucu

SEQ ID NO: 327359 - RNA, 32 nt, Human
agucagcacaucacauccccauggcccauggc

SEQ ID NO: 327360 - RNA, 32 nt, Human
agucagcaccuuggcccaggagcucugcgcca

SEQ ID NO: 327361 - RNA, 32 nt, Human
agucagcacuuguuuagccugcuuucaauuuu

SEQ ID NO: 327362 - RNA, 32 nt, Human
agucagcagagcagggcugaggccugggggua

SEQ ID NO: 327363 - RNA, 32 nt, Human
agucagcagccuucacaccaucuacccuuaaa

SEQ ID NO: 327364 - RNA, 32 nt, Human
agucagcagggugggguggggccagaggagcu

SEQ ID NO: 327365 - RNA, 32 nt, Human
agucagcaggugaggagaaagacugaaaacua

SEQ ID NO: 327366 - RNA, 32 nt, Human
agucagcaguaagccuuuugcuaaaagaguuu

SEQ ID NO: 327367 - RNA, 32 nt, Human
agucagcagugcagagacucccagggaaggcc

SEQ ID NO: 327368 - RNA, 31 nt, Human
agucagcaguuucagauucuuacacuccaua

SEQ ID NO: 327369 - RNA, 31 nt, Human
agucagcaguuucugggcacuucucucagua

SEQ ID NO: 327370 - RNA, 32 nt, Human
agucagccaaccacagcuacauuucaggcuuu

SEQ ID NO: 327371 - RNA, 19 nt, Human
agucagccacaccuuccug

SEQ ID NO: 327372 - RNA, 32 nt, Human
agucagccagaaaucucacugccugcagcgca

SEQ ID NO: 327373 - RNA, 28 nt, Human
agucagccaggagcccucuuuuccugug

SEQ ID NO: 327374 - RNA, 32 nt, Human
agugcugggauuacagacgugagccaccacuc

SEQ ID NO: 327375 - RNA, 32 nt, Human
agugcugggauuacagacgugagccaccgugc

SEQ ID NO: 327376 - RNA, 32 nt, Human
agugcugggauuacagacgugagcgacugcgc

SEQ ID NO: 327377 - RNA, 32 nt, Human
agugcugggauuacagacgugagcuaccacac

SEQ ID NO: 327378 - RNA, 32 nt, Human
agugcugggauuacagacgugagcuaucaugc

SEQ ID NO: 327379 - RNA, 32 nt, Human
agugcugggauuacagagugugagccaccaca

SEQ ID NO: 327380 - RNA, 32 nt, Human
agugcugggauuacagaugugagccaccacac

SEQ ID NO: 327381 - RNA, 32 nt, Human
agugcugggauuacagaugugagccaccacgc

SEQ ID NO: 327382 - RNA, 32 nt, Human
agugcugggauuacagaugugagccaccaugc

SEQ ID NO: 327383 - RNA, 32 nt, Human
agugcugggauuacagaugugagccaccgcau

SEQ ID NO: 327384 - RNA, 32 nt, Human
agugcugggauuacagaugugagccacugcac

SEQ ID NO: 327385 - RNA, 32 nt, Human
agugcugggauuacagaugugagccauggugc

SEQ ID NO: 327386 - RNA, 32 nt, Human
agugcugggauuacagaugugagccauugugg

SEQ ID NO: 327387 - RNA, 32 nt, Human
agugcugggauuacagaugugagccgccgcgc

SEQ ID NO: 327388 - RNA, 32 nt, Human
agugcugggauuacagcccugagcgaccgcgc

SEQ ID NO: 327389 - RNA, 32 nt, Human
agugcugggauuacagccgugagccacugcac

SEQ ID NO: 327390 - RNA, 32 nt, Human
agugcugggauuacagcgaagagccacagcac

SEQ ID NO: 327391 - RNA, 32 nt, Human
agugcugggauuacagcgugagccaccgcacc

SEQ ID NO: 327392 - RNA, 32 nt, Human
agugcugggauuacagcgugagcuaccuggcc

SEQ ID NO: 327393 - RNA, 32 nt, Human
agugcugggauuacagcugugagccaccgugc

SEQ ID NO: 327394 - RNA, 32 nt, Human
agugcugggauuacagcugugagccacugcac

SEQ ID NO: 327395 - RNA, 32 nt, Human
agugcugggauuacagcugugagccauggcac

SEQ ID NO: 327396 - RNA, 32 nt, Human
agugcugggauuacaggaaugagccacugugc

SEQ ID NO: 327397 - RNA, 32 nt, Human
agugcugggauuacaggagugaaccaccaagc

SEQ ID NO: 327398 - RNA, 32 nt, Human
agugcugggauuacaggagugaaccaccaugc

SEQ ID NO: 327399 - RNA, 23 nt, Human
agugcugggauuacaggagugag

SEQ ID NO: 327400 - RNA, 32 nt, Human
agugcugggauuacaggagugagccaccaugu

SEQ ID NO: 327401 - RNA, 32 nt, Human
agugcugggauuacaggagugagccaccgugc

SEQ ID NO: 327402 - RNA, 32 nt, Human
agugcugggauuacaggagugagccacugcgc

SEQ ID NO: 327403 - RNA, 32 nt, Human
agugcugggauuacaggagugagccgcugcgc

SEQ ID NO: 327404 - RNA, 32 nt, Human
agugcugggauuacaggagugugccacugcgc

SEQ ID NO: 327405 - RNA, 32 nt, Human
agugcugggauuacaggaugagccacugagcc

SEQ ID NO: 327406 - RNA, 18 nt, Human
agugcugggauuacaggc

SEQ ID NO: 327407 - RNA, 32 nt, Human
agugcugggauuacaggcaagagccaccauac

SEQ ID NO: 327408 - RNA, 32 nt, Human
agugcugggauuacaggcacgagccaccgcac

SEQ ID NO: 327409 - RNA, 32 nt, Human
agugcugggauuacaggcaggagccaccgcgc

SEQ ID NO: 327410 - RNA, 32 nt, Human
agugcugggauuacaggcauaagccacagcac

SEQ ID NO: 327411 - RNA, 32 nt, Human
agugcugggauuacaggcauaagccacugcgc

SEQ ID NO: 327412 - RNA, 32 nt, Human
agugcugggauuacaggcauaagccacuguac

SEQ ID NO: 327413 - RNA, 32 nt, Human
agugcugggauuacaggcauaagccacugugc

SEQ ID NO: 327414 - RNA, 32 nt, Human
agugcugggauuacaggcaucagccaccacac

SEQ ID NO: 327415 - RNA, 32 nt, Human
agugcugggauuacaggcaucagccaccaugc

SEQ ID NO: 327416 - RNA, 32 nt, Human
agugcugggauuacaggcaucagccaccgcac

SEQ ID NO: 327417 - RNA, 32 nt, Human
agugcugggauuacaggcaucagccacuaugc

SEQ ID NO: 327418 - RNA, 32 nt, Human
agugcugggauuacaggcaugaaccacagcgc

SEQ ID NO: 327419 - RNA, 32 nt, Human
agugcugggauuacaggcaugaaccaccacgc

SEQ ID NO: 327420 - RNA, 32 nt, Human
agugcugggauuacaggcaugaaccaccaugc

SEQ ID NO: 327421 - RNA, 32 nt, Human
agugcugggauuacaggcaugaaccaccgcuc

SEQ ID NO: 327422 - RNA, 32 nt, Human
agugcugggauuacaggcaugaaccaccgugc

SEQ ID NO: 327423 - RNA, 32 nt, Human
agugcugggauuacaggcaugaaccacugugc

SEQ ID NO: 327424 - RNA, 32 nt, Human
agugcugggauuacaggcaugaaccaucauac

SEQ ID NO: 327425 - RNA, 32 nt, Human
agugcugggauuacaggcaugaaccauggugc

SEQ ID NO: 327426 - RNA, 32 nt, Human
agugcugggauuacaggcaugaaccgccaugc

SEQ ID NO: 327427 - RNA, 32 nt, Human
agugcugggauuacaggcaugacccaccgcuc

SEQ ID NO: 327428 - RNA, 23 nt, Human
agugcugggauuacaggcaugag

SEQ ID NO: 327429 - RNA, 32 nt, Human
agugcugggauuacaggcaugagccacagugc

SEQ ID NO: 327430 - RNA, 32 nt, Human
agugcugggauuacaggcaugagccaccaaac

SEQ ID NO: 327431 - RNA, 32 nt, Human
agugcugggauuacaggcaugagccaccacaa

SEQ ID NO: 327432 - RNA, 32 nt, Human
agugcugggauuacaggcaugagccaccacac

SEQ ID NO: 327433 - RNA, 32 nt, Human
agugcugggauuacaggcaugagccaccacag

SEQ ID NO: 327434 - RNA, 32 nt, Human
agugcugggauuacaggcaugagccaccacau

SEQ ID NO: 327435 - RNA, 32 nt, Human
agugcugggauuacaggcaugagccaccacgc

SEQ ID NO: 327436 - RNA, 32 nt, Human
agugcugggauuacaggcaugagccaccacgg

SEQ ID NO: 327437 - RNA, 32 nt, Human
agugcugggauuacaggcaugagccaccacuc

SEQ ID NO: 327438 - RNA, 32 nt, Human
agugcugggauuacaggcaugagccaccaggc

SEQ ID NO: 327439 - RNA, 32 nt, Human
agugcugggauuacaggcaugagccaccaucu

SEQ ID NO: 327440 - RNA, 32 nt, Human
agugcugggauuacaggcaugagccaccaugc

SEQ ID NO: 327441 - RNA, 32 nt, Human
agugcugggauuacaggcaugagccaccaugu

SEQ ID NO: 327442 - RNA, 32 nt, Human
agugcugggauuacaggcaugagccaccccgc

SEQ ID NO: 327443 - RNA, 29 nt, Human
agugcugggauuacaggcaugagccaccg

SEQ ID NO: 327444 - RNA, 32 nt, Human
agugcugggauuacaggcaugagccaccgagc

SEQ ID NO: 327445 - RNA, 32 nt, Human
agugcugggauuacaggcaugagccaccgcac

SEQ ID NO: 327446 - RNA, 32 nt, Human
agugcugggauuacaggcaugagccaccgcag

SEQ ID NO: 327447 - RNA, 32 nt, Human
agugcugggauuacaggcaugagccaccgcgc

SEQ ID NO: 327448 - RNA, 32 nt, Human
agugcugggauuacaggcaugagccaccgcuc

SEQ ID NO: 327449 - RNA, 32 nt, Human
agugcugggauuacaggcaugagccaccgugc

SEQ ID NO: 327450 - RNA, 32 nt, Human
agugcugggauuacaggcaugagccaccgugg

SEQ ID NO: 327451 - RNA, 32 nt, Human
agugcugggauuacaggcaugagccaccucac

SEQ ID NO: 327452 - RNA, 32 nt, Human
agugcugggauuacaggcaugagccaccucgc

SEQ ID NO: 327453 - RNA, 32 nt, Human
agugcugggauuacaggcaugagccacggcac

SEQ ID NO: 327454 - RNA, 32 nt, Human
agugcugggauuacaggcaugagccacggcgc

SEQ ID NO: 327455 - RNA, 32 nt, Human
agugcugggauuacaggcaugagccacugcac

SEQ ID NO: 327456 - RNA, 32 nt, Human
agugcugggauuacaggcaugagccacugcau

SEQ ID NO: 327457 - RNA, 32 nt, Human
agugcugggauuacaggcaugagccacugcgc

SEQ ID NO: 327458 - RNA, 32 nt, Human
agugcugggauuacaggcaugagccacugggc

SEQ ID NO: 327459 - RNA, 32 nt, Human
agugcugggauuacaggcaugagccacugugc

SEQ ID NO: 327460 - RNA, 32 nt, Human
agugcugggauuacaggcaugagccacugugu

SEQ ID NO: 327461 - RNA, 32 nt, Human
agugcugggauuacaggcaugagccaucacac

SEQ ID NO: 327462 - RNA, 32 nt, Human
agugcugggauuacaggcaugagccaucgccc

SEQ ID NO: 327463 - RNA, 32 nt, Human
agugcugggauuacaggcaugagccaucgcgc

SEQ ID NO: 327464 - RNA, 32 nt, Human
agugcugggauuacaggcaugagccauugcgc

SEQ ID NO: 327465 - RNA, 32 nt, Human
agugcugggauuacaggcaugagccauugugc

SEQ ID NO: 327466 - RNA, 32 nt, Human
agugcugggauuacaggcaugagcgaccgugu

SEQ ID NO: 327467 - RNA, 32 nt, Human
agugcugggauuacaggcaugagcuaccacgc

SEQ ID NO: 327468 - RNA, 32 nt, Human
agugcugggauuacaggcaugagcuaccgugc

SEQ ID NO: 327469 - RNA, 32 nt, Human
agugcugggauuacaggcaugagcuacugcac

SEQ ID NO: 327470 - RNA, 32 nt, Human
agugcugggauuacaggcaugagcuacugugc

SEQ ID NO: 327471 - RNA, 32 nt, Human
agugcugggauuacaggcaugagcugccgcac

SEQ ID NO: 327472 - RNA, 32 nt, Human
agugcugggauuacaggcaugagucaccauau

SEQ ID NO: 327473 - RNA, 32 nt, Human
agugcugggauuacaggcaugagucauugcuc

SEQ ID NO: 327474 - RNA, 32 nt, Human
agugcugggauuacaggcauggccaccacgcc

SEQ ID NO: 327475 - RNA, 23 nt, Human
agugcugggauuacaggcauggg

SEQ ID NO: 327476 - RNA, 32 nt, Human
agugcugggauuacaggcaugggccaccacgc

SEQ ID NO: 327477 - RNA, 32 nt, Human
agugcugggauuacaggcccgagccgccgcac

SEQ ID NO: 327478 - RNA, 23 nt, Human
agugcugggauuacaggccugag

SEQ ID NO: 327479 - RNA, 32 nt, Human
agugcugggauuacaggccugagcaacugugc

SEQ ID NO: 327480 - RNA, 32 nt, Human
agugcugggauuacaggccugagccaccauac

SEQ ID NO: 327481 - RNA, 32 nt, Human
agugcugggauuacaggccugagccaccaugc

SEQ ID NO: 327482 - RNA, 32 nt, Human
agugcugggauuacaggccugagccaccgcgc

SEQ ID NO: 327483 - RNA, 32 nt, Human
agugcugggauuacaggccugagccaccgcgu

SEQ ID NO: 327484 - RNA, 32 nt, Human
agugcugggauuacaggccugagccaccguau

SEQ ID NO: 327485 - RNA, 32 nt, Human
agugcugggauuacaggccugagccaccgugc

SEQ ID NO: 327486 - RNA, 32 nt, Human
agugcugggauuacaggccuggccccaguuug

SEQ ID NO: 327487 - RNA, 32 nt, Human
agugcugggauuacaggcgcaagccacccagc

SEQ ID NO: 327488 - RNA, 32 nt, Human
agugcugggauuacaggcgcaagccacuacac

SEQ ID NO: 327489 - RNA, 32 nt, Human
agugcugggauuacaggcgcgagccaccaugc

SEQ ID NO: 327490 - RNA, 32 nt, Human
agugcugggauuacaggcgcgagccaccgcgc

SEQ ID NO: 327491 - RNA, 32 nt, Human
agugcugggauuacaggcgcgagccacggcgc

SEQ ID NO: 327492 - RNA, 32 nt, Human
agugcugggauuacaggcgggagccaccauga

SEQ ID NO: 327493 - RNA, 32 nt, Human
agugcugggauuacaggcgggagccaccaugc

SEQ ID NO: 327494 - RNA, 32 nt, Human
agugcugggauuacaggcguaagccaccacac

SEQ ID NO: 327495 - RNA, 32 nt, Human
agugcugggauuacaggcguaagccacugcgc

SEQ ID NO: 327496 - RNA, 32 nt, Human
agugcugggauuacaggcgucagccaccaugc

SEQ ID NO: 327497 - RNA, 32 nt, Human
agugcugggauuacaggcgucagccaccgcgc

SEQ ID NO: 327498 - RNA, 32 nt, Human
agugcugggauuacaggcgucagccaccguga

SEQ ID NO: 327499 - RNA, 22 nt, Human
agugcugggauuacaggcguga

SEQ ID NO: 327500 - RNA, 32 nt, Human
agugcugggauuacaggcgugaaccaccaauu

SEQ ID NO: 327501 - RNA, 32 nt, Human
agugcugggauuacaggcgugaaccacugcac

SEQ ID NO: 327502 - RNA, 32 nt, Human
agugcugggauuacaggcgugaaccacugugc

SEQ ID NO: 327503 - RNA, 32 nt, Human
agugcugggauuacaggcgugaaccacugugu

SEQ ID NO: 327504 - RNA, 23 nt, Human
agugcugggauuacaggcgugag

SEQ ID NO: 327505 - RNA, 32 nt, Human
agugcugggauuacaggcgugagacacugcgc

SEQ ID NO: 327506 - RNA, 32 nt, Human
agugcugggauuacaggcgugagcaacugcac

SEQ ID NO: 327507 - RNA, 27 nt, Human
agugcugggauuacaggcgugagccac

SEQ ID NO: 327508 - RNA, 32 nt, Human
agugcugggauuacaggcgugagccacaaugc

SEQ ID NO: 327509 - RNA, 32 nt, Human
agugcugggauuacaggcgugagccacagcgc

SEQ ID NO: 327510 - RNA, 32 nt, Human
agugcugggauuacaggcgugagccacagugc

SEQ ID NO: 327511 - RNA, 32 nt, Human
agugcugggauuacaggcgugagccaccacaa

SEQ ID NO: 327512 - RNA, 32 nt, Human
agugcugggauuacaggcgugagccaccacac

SEQ ID NO: 327513 - RNA, 32 nt, Human
agugcugggauuacaggcgugagccaccacau

SEQ ID NO: 327514 - RNA, 32 nt, Human
agugcugggauuacaggcgugagccaccaccc

SEQ ID NO: 327515 - RNA, 32 nt, Human
agugcugggauuacaggcgugagccaccacgc

SEQ ID NO: 327516 - RNA, 32 nt, Human
agugcugggauuacaggcgugagccaccacgu

SEQ ID NO: 327517 - RNA, 32 nt, Human
agugcugggauuacaggcgugagccaccagcc

SEQ ID NO: 327518 - RNA, 32 nt, Human
agugcugggauuacaggcgugagccaccaggc

SEQ ID NO: 327519 - RNA, 32 nt, Human
agugcugggauuacaggcgugagccaccauac

SEQ ID NO: 327520 - RNA, 32 nt, Human
agugcugggauuacaggcgugagccaccauga

SEQ ID NO: 327521 - RNA, 32 nt, Human
agugcugggauuacaggcgugagccaccaugc

SEQ ID NO: 327522 - RNA, 32 nt, Human
agugcugggauuacaggcgugagccaccaugu

SEQ ID NO: 327523 - RNA, 32 nt, Human
agugcugggauuacaggcgugagccaccauuc

SEQ ID NO: 327524 - RNA, 32 nt, Human
agugcugggauuacaggcgugagccacccuga

SEQ ID NO: 327525 - RNA, 32 nt, Human
agugcugggauuacaggcgugagccaccgcac

SEQ ID NO: 327526 - RNA, 32 nt, Human
agugcugggauuacaggcgugagccaccgcau

SEQ ID NO: 327527 - RNA, 32 nt, Human
agugcugggauuacaggcgugagccaccgccc

SEQ ID NO: 327528 - RNA, 32 nt, Human
agugcugggauuacaggcgugagccaccgcga

SEQ ID NO: 327529 - RNA, 32 nt, Human
agugcugggauuacaggcgugagccaccgcgc

SEQ ID NO: 327530 - RNA, 32 nt, Human
agugcugggauuacaggcgugagccaccgcgg

SEQ ID NO: 327531 - RNA, 32 nt, Human
agugcugggauuacaggcgugagccaccgcgu

SEQ ID NO: 327532 - RNA, 32 nt, Human
agugcugggauuacaggcgugagccaccgcuc

SEQ ID NO: 327533 - RNA, 32 nt, Human
agugcugggauuacaggcgugagccaccgugc

SEQ ID NO: 327534 - RNA, 32 nt, Human
agugcugggauuacaggcgugagccaccgugu

SEQ ID NO: 327535 - RNA, 32 nt, Human
agugcugggauuacaggcgugagccaccucac

SEQ ID NO: 327536 - RNA, 32 nt, Human
agugcugggauuacaggcgugagccaccuugc

SEQ ID NO: 327537 - RNA, 32 nt, Human
agugcugggauuacaggcgugagccacggcgc

SEQ ID NO: 327538 - RNA, 32 nt, Human
agugcugggauuacaggcgugagccacuacac

SEQ ID NO: 327539 - RNA, 32 nt, Human
agugcugggauuacaggcgugagccacuccac

SEQ ID NO: 327540 - RNA, 32 nt, Human
agugcugggauuacaggcgugagccacugagc

SEQ ID NO: 327541 - RNA, 32 nt, Human
agugcugggauuacaggcgugagccacugcac

SEQ ID NO: 327542 - RNA, 32 nt, Human
agugcugggauuacaggcgugagccacugcau

SEQ ID NO: 327543 - RNA, 32 nt, Human
agugcugggauuacaggcgugagccacugccc

SEQ ID NO: 327544 - RNA, 32 nt, Human
agugcugggauuacaggcgugagccacugcgc

SEQ ID NO: 327545 - RNA, 32 nt, Human
agugcugggauuacaggcgugagccacugcgu

SEQ ID NO: 327546 - RNA, 32 nt, Human
agugcugggauuacaggcgugagccacugcuc

SEQ ID NO: 327547 - RNA, 32 nt, Human
agugcugggauuacaggcgugagccacuggcc

SEQ ID NO: 327548 - RNA, 32 nt, Human
agugcugggauuacaggcgugagccacugggc

SEQ ID NO: 327549 - RNA, 32 nt, Human
agugcugggauuacaggcgugagccacugugc

SEQ ID NO: 327550 - RNA, 32 nt, Human
agugcugggauuacaggcgugagccacugugg

SEQ ID NO: 327551 - RNA, 32 nt, Human
agugcugggauuacaggcgugagccaucgcuu

SEQ ID NO: 327552 - RNA, 32 nt, Human
agugcugggauuacaggcgugagccauggcgc

SEQ ID NO: 327553 - RNA, 32 nt, Human
agugcugggauuacaggcgugagccgccgugc

SEQ ID NO: 327554 - RNA, 32 nt, Human
agugcugggauuacaggcgugagccgcugcac

SEQ ID NO: 327555 - RNA, 32 nt, Human
agugcugggauuacaggcgugagcuaccaagc

SEQ ID NO: 327556 - RNA, 32 nt, Human
agugcugggauuacaggcgugagcuaccacca

SEQ ID NO: 327557 - RNA, 32 nt, Human
agugcugggauuacaggcgugagcuaccacgc

SEQ ID NO: 327558 - RNA, 32 nt, Human
agugcugggauuacaggcgugagcuaccgcac

SEQ ID NO: 327559 - RNA, 32 nt, Human
agugcugggauuacaggcgugagcuaccgcgc

SEQ ID NO: 327560 - RNA, 32 nt, Human
agugcugggauuacaggcgugaggcaccgcgc

SEQ ID NO: 327561 - RNA, 32 nt, Human
agugcugggauuacaggcgugaggcaucacac

SEQ ID NO: 327562 - RNA, 32 nt, Human
agugcugggauuacaggcgugagucacagccc

SEQ ID NO: 327563 - RNA, 32 nt, Human
agugcugggauuacaggcgugagucaccacac

SEQ ID NO: 327564 - RNA, 32 nt, Human
agugcugggauuacaggcgugagucaccgcgc

SEQ ID NO: 327565 - RNA, 32 nt, Human
agugcugggauuacaggcgugagucaccgcgu

SEQ ID NO: 327566 - RNA, 32 nt, Human
agugcugggauuacaggcgugagucaccgugc

SEQ ID NO: 327567 - RNA, 32 nt, Human
agugcugggauuacaggcgugagucacugcaa

SEQ ID NO: 327568 - RNA, 32 nt, Human
agugcugggauuacaggcgugagucacugcac

SEQ ID NO: 327569 - RNA, 32 nt, Human
agugcugggauuacaggcgugagucacugcgc

SEQ ID NO: 327570 - RNA, 32 nt, Human
agugcugggauuacaggcgugauccaccacac

SEQ ID NO: 327571 - RNA, 32 nt, Human
agugcugggauuacaggcgugaugcccgggcc

SEQ ID NO: 327572 - RNA, 32 nt, Human
agugcugggauuacaggcguggccaccgcacc

SEQ ID NO: 327573 - RNA, 32 nt, Human
agugcugggauuacaggcguggccaccgcgcc

SEQ ID NO: 327574 - RNA, 32 nt, Human
agugcugggauuacaggcgugggccacugcgc

SEQ ID NO: 327575 - RNA, 32 nt, Human
agugcugggauuacaggcgugggccgccgcac

SEQ ID NO: 327576 - RNA, 32 nt, Human
agugcugggauuacaggcgugugagccaccac

SEQ ID NO: 327577 - RNA, 32 nt, Human
agugcugggauuacaggcgugugccaccaccc

SEQ ID NO: 327578 - RNA, 32 nt, Human
agugcugggauuacaggcguuagccacugcgc

SEQ ID NO: 327579 - RNA, 32 nt, Human
agugcugggauuacaggcuuaagccaccacgc

SEQ ID NO: 327580 - RNA, 32 nt, Human
agugcugggauuacaggcuuacgccaccacac

SEQ ID NO: 327581 - RNA, 32 nt, Human
agugcugggauuacaggcuucagccaccacac

SEQ ID NO: 327582 - RNA, 32 nt, Human
agugcugggauuacaggcuugacccacugcgc

SEQ ID NO: 327583 - RNA, 32 nt, Human
agugcugggauuacaggcuugagccaccacac

SEQ ID NO: 327584 - RNA, 32 nt, Human
agugcugggauuacaggcuugagccaccacgc

SEQ ID NO: 327585 - RNA, 32 nt, Human
agugcugggauuacaggcuugagccaccgcac

SEQ ID NO: 327586 - RNA, 32 nt, Human
agugcugggauuacaggcuugagccaccgcgc

SEQ ID NO: 327587 - RNA, 32 nt, Human
agugcugggauuacaggcuugagccaccgggu

SEQ ID NO: 327588 - RNA, 32 nt, Human
agugcugggauuacaggcuugagccaccgugc

SEQ ID NO: 327589 - RNA, 32 nt, Human
agugcugggauuacaggcuugagccacugcuc

SEQ ID NO: 327590 - RNA, 32 nt, Human
agugcugggauuacaggcuugagccacugugc

SEQ ID NO: 327591 - RNA, 32 nt, Human
agugcugggauuacaggcuugagcuaccgcgc

SEQ ID NO: 327592 - RNA, 32 nt, Human
agugcugggauuacaggcuugggccaccgcgc

SEQ ID NO: 327593 - RNA, 32 nt, Human
agugcugggauuacagggauaagccaccacac

SEQ ID NO: 327594 - RNA, 32 nt, Human
agugcugggauuacagggaugagccaccaugc

SEQ ID NO: 327595 - RNA, 32 nt, Human
agugcugggauuacagggaugagccaccgcgc

SEQ ID NO: 327596 - RNA, 32 nt, Human
agugcugggauuacaggggagccacugcacug

SEQ ID NO: 327597 - RNA, 32 nt, Human
agugcugggauuacagggggagccacugugcc

SEQ ID NO: 327598 - RNA, 32 nt, Human
agugcugggauuacaggggugagccaccacgc

SEQ ID NO: 327599 - RNA, 32 nt, Human
agugcugggauuacaggggugagccgcugugc

SEQ ID NO: 327600 - RNA, 18 nt, Human
agugcugggauuacaggu

SEQ ID NO: 327601 - RNA, 32 nt, Human
agugcugggauuacagguacgagucaccaugu

SEQ ID NO: 327602 - RNA, 32 nt, Human
agugcugggauuacagguaucagccaccgugc

SEQ ID NO: 327603 - RNA, 32 nt, Human
agugcugggauuacagguaugagccacaacgc

SEQ ID NO: 327604 - RNA, 32 nt, Human
agugcugggauuacagguaugagccaccacgc

SEQ ID NO: 327605 - RNA, 32 nt, Human
agugcugggauuacagguaugagccaccgcac

SEQ ID NO: 327606 - RNA, 19 nt, Human
agugcugggauuacaggug

SEQ ID NO: 327607 - RNA, 32 nt, Human
agugcugggauuacaggugcgagccaccgugc

SEQ ID NO: 327608 - RNA, 32 nt, Human
agugcugggauuacaggugggagccacaacac

SEQ ID NO: 327609 - RNA, 32 nt, Human
agugcugggauuacaggugggagccaccgcac

SEQ ID NO: 327610 - RNA, 32 nt, Human
agugcugggauuacaggugggagccacuacag

SEQ ID NO: 327611 - RNA, 32 nt, Human
agugcugggauuacagguguaagccaccccgc

SEQ ID NO: 327612 - RNA, 32 nt, Human
agugcugggauuacagguguaagccaccgcac

SEQ ID NO: 327613 - RNA, 32 nt, Human
agugcugggauuacagguguaagccaccgugc

SEQ ID NO: 327614 - RNA, 32 nt, Human
agugcugggauuacagguguaagccacugcgc

SEQ ID NO: 327615 - RNA, 32 nt, Human
agugcugggauuacagguguaagccacugugc

SEQ ID NO: 327616 - RNA, 32 nt, Human
agugcugggauuacagguguaagccgccacgc

SEQ ID NO: 327617 - RNA, 32 nt, Human
agugcugggauuacagguguaagucacuguac

SEQ ID NO: 327618 - RNA, 32 nt, Human
agugcugggauuacaggugucagccaccacgc

SEQ ID NO: 327619 - RNA, 32 nt, Human
agugcugggauuacaggugucagccaccgcac

SEQ ID NO: 327620 - RNA, 32 nt, Human
agugcugggauuacaggugucagccacuacac

SEQ ID NO: 327621 - RNA, 22 nt, Human
agugcugggauuacagguguga

SEQ ID NO: 327622 - RNA, 32 nt, Human
agugcugggauuacaggugugaaccaccacac

SEQ ID NO: 327623 - RNA, 32 nt, Human
agugcugggauuacaggugugaaccacugcgc

SEQ ID NO: 327624 - RNA, 32 nt, Human
agugcugggauuacaggugugaaucaccauac

SEQ ID NO: 327625 - RNA, 32 nt, Human
agugcugggauuacaggugugacccacugcgc

SEQ ID NO: 327626 - RNA, 23 nt, Human
agugcugggauuacaggugugag

SEQ ID NO: 327627 - RNA, 32 nt, Human
agugcugggauuacaggugugagcaaccauug

SEQ ID NO: 327628 - RNA, 32 nt, Human
agugcugggauuacaggugugagccacagcac

SEQ ID NO: 327629 - RNA, 32 nt, Human
agugcugggauuacaggugugagccacagcgc

SEQ ID NO: 327630 - RNA, 32 nt, Human
agugcugggauuacaggugugagccacagugc

SEQ ID NO: 327631 - RNA, 32 nt, Human
agugcugggauuacaggugugagccaccacac

SEQ ID NO: 327632 - RNA, 32 nt, Human
agugcugggauuacaggugugagccaccacag

SEQ ID NO: 327633 - RNA, 32 nt, Human
agugcugggauuacaggugugagccaccacgc

SEQ ID NO: 327634 - RNA, 32 nt, Human
agugcugggauuacaggugugagccaccaggc

SEQ ID NO: 327635 - RNA, 32 nt, Human
agugcugggauuacaggugugagccaccaugc

SEQ ID NO: 327636 - RNA, 32 nt, Human
agugcugggauuacaggugugagccaccaugu

SEQ ID NO: 327637 - RNA, 32 nt, Human
agugcugggauuacaggugugagccaccgcac

SEQ ID NO: 327638 - RNA, 32 nt, Human
agugcugggauuacaggugugagccaccgcgc

SEQ ID NO: 327639 - RNA, 32 nt, Human
agugcugggauuacaggugugagccaccgugc

SEQ ID NO: 327640 - RNA, 32 nt, Human
agugcugggauuacaggugugagccaccucgc

SEQ ID NO: 327641 - RNA, 32 nt, Human
agugcugggauuacaggugugagccacggcac

SEQ ID NO: 327642 - RNA, 32 nt, Human
agugcugggauuacaggugugagccacuacac

SEQ ID NO: 327643 - RNA, 32 nt, Human
agugcugggauuacaggugugagccacuauac

SEQ ID NO: 327644 - RNA, 32 nt, Human
agugcugggauuacaggugugagccacuaugc

SEQ ID NO: 327645 - RNA, 32 nt, Human
agugcugggauuacaggugugagccacugagc

SEQ ID NO: 327646 - RNA, 32 nt, Human
agugcugggauuacaggugugagccacugcac

SEQ ID NO: 327647 - RNA, 32 nt, Human
agugcugggauuacaggugugagccacugccu

SEQ ID NO: 327648 - RNA, 32 nt, Human
agugcugggauuacaggugugagccacugcgc

SEQ ID NO: 327649 - RNA, 32 nt, Human
agugcugggauuacaggugugagccacugggc

SEQ ID NO: 327650 - RNA, 32 nt, Human
agugcugggauuacaggugugagccacugugc

SEQ ID NO: 327651 - RNA, 32 nt, Human
agugcugggauuacaggugugagccacugugg

SEQ ID NO: 327652 - RNA, 32 nt, Human
agugcugggauuacaggugugagccacuucac

SEQ ID NO: 327653 - RNA, 32 nt, Human
agugcugggauuacaggugugagccaucacac

SEQ ID NO: 327654 - RNA, 32 nt, Human
agugcugggauuacaggugugagccaucacgc

SEQ ID NO: 327655 - RNA, 32 nt, Human
agugcugggauuacaggugugagccauggcac

SEQ ID NO: 327656 - RNA, 32 nt, Human
agugcugggauuacaggugugagccgccaugc

SEQ ID NO: 327657 - RNA, 32 nt, Human
agugcugggauuacaggugugagccgcugcgc

SEQ ID NO: 327658 - RNA, 32 nt, Human
agugcugggauuacaggugugagccgcugggc

SEQ ID NO: 327659 - RNA, 32 nt, Human
agugcugggauuacaggugugagcuaccgcac

SEQ ID NO: 327660 - RNA, 32 nt, Human
agugcugggauuacaggugugagcuaccgcgc

SEQ ID NO: 327661 - RNA, 32 nt, Human
agugcugggauuacaggugugagcuacugcgc

SEQ ID NO: 327662 - RNA, 32 nt, Human
agugcugggauuacaggugugagcuacugugc

SEQ ID NO: 327663 - RNA, 32 nt, Human
agugcugggauuacaggugugagcugccacgc

SEQ ID NO: 327664 - RNA, 32 nt, Human
agugcugggauuacaggugugagcugccgcac

SEQ ID NO: 327665 - RNA, 32 nt, Human
agugcugggauuacaggugugaggcaccgugc

SEQ ID NO: 327666 - RNA, 32 nt, Human
agugcugggauuacaggugugaggcacggugc

SEQ ID NO: 327667 - RNA, 32 nt, Human
agugcugggauuacaggugugagucaccacac

SEQ ID NO: 327668 - RNA, 32 nt, Human
agugcugggauuacaggugugagucaccacau

SEQ ID NO: 327669 - RNA, 32 nt, Human
agugcugggauuacaggugugagucaccccgc

SEQ ID NO: 327670 - RNA, 32 nt, Human
agugcugggauuacaggugugagucaccgcgc

SEQ ID NO: 327671 - RNA, 32 nt, Human
agugcugggauuacaggugugagucaccgugc

SEQ ID NO: 327672 - RNA, 32 nt, Human
agugcugggauuacaggugugagucacugcac

SEQ ID NO: 327673 - RNA, 32 nt, Human
agugcugggauuacaggugugcgccaccaugc

SEQ ID NO: 327674 - RNA, 32 nt, Human
agugcugggauuacagguguggccaccgcgcc

SEQ ID NO: 327675 - RNA, 32 nt, Human
agugcugggauuacaggugugggagccaccau

SEQ ID NO: 327676 - RNA, 32 nt, Human
agugcugggauuacagguuugagccacugcac

SEQ ID NO: 327677 - RNA, 32 nt, Human
agugcugggauuacagucaugagccaccacuc

SEQ ID NO: 327678 - RNA, 32 nt, Human
agugcugggauuacagucaugagccaccaugc

SEQ ID NO: 327679 - RNA, 32 nt, Human
agugcugggauuacagucaugagucaccaugc

SEQ ID NO: 327680 - RNA, 32 nt, Human
agugcugggauuacagucgugagccacuguac

SEQ ID NO: 327681 - RNA, 32 nt, Human
agugcugggauuacaguugcgagccaccgcgc

SEQ ID NO: 327682 - RNA, 32 nt, Human
agugcugggauuacaguugugagccacugugc

SEQ ID NO: 327683 - RNA, 32 nt, Human
agugcugggauuacaguugugagucacugugc

SEQ ID NO: 327684 - RNA, 32 nt, Human
agugcugggauuacaugagccaccacaugcag

SEQ ID NO: 327685 - RNA, 32 nt, Human
agugcugggauuacaugcgugagccacugcgc

SEQ ID NO: 327686 - RNA, 32 nt, Human
agugcugggauuacaugugugagccaccgccc

SEQ ID NO: 327687 - RNA, 32 nt, Human
agugcugggauuaccggcaugagccacugcgc

SEQ ID NO: 327688 - RNA, 23 nt, Human
agugcugggauuaccggcgugag

SEQ ID NO: 327689 - RNA, 32 nt, Human
agugcugggauuaccggcgugagccaccaugc

SEQ ID NO: 327690 - RNA, 32 nt, Human
agugcugggauuaccggcuugagccaccacac

SEQ ID NO: 327691 - RNA, 32 nt, Human
agugcugggauuaccgguaugaaccaccacaa

SEQ ID NO: 327692 - RNA, 32 nt, Human
agugcugggauuacgagcgugagucacagcac

SEQ ID NO: 327693 - RNA, 32 nt, Human
agugcugggauuacggacgugagccaccacgc

SEQ ID NO: 327694 - RNA, 32 nt, Human
agugcugggauuacgggcaugagccacugcac

SEQ ID NO: 327695 - RNA, 32 nt, Human
agugcugggauuacgggcaugagcugcugugc

SEQ ID NO: 327696 - RNA, 32 nt, Human
agugcugggauuacgggcgugagccaccgcgc

SEQ ID NO: 327697 - RNA, 32 nt, Human
agugcugggauuacgggcgugagccaccgugc

SEQ ID NO: 327698 - RNA, 32 nt, Human
agugcugggauuacgggggugagccacugcgc

SEQ ID NO: 327699 - RNA, 32 nt, Human
agugcugggauuacgggugugagccaccgugc

SEQ ID NO: 327700 - RNA, 32 nt, Human
agugcugggauuacgguguuagccacuacacc

SEQ ID NO: 327701 - RNA, 18 nt, Human
agugcugggauuacguga

SEQ ID NO: 327702 - RNA, 32 nt, Human
agugcugggauuacuagacguaagccaccaca

SEQ ID NO: 327703 - RNA, 32 nt, Human
agugcugggauuacugacaugagccaccacac

SEQ ID NO: 327704 - RNA, 32 nt, Human
agugcugggauuacuggcaugagccacugugc

SEQ ID NO: 327705 - RNA, 32 nt, Human
agugcugggauuacuggcgucagccaccgcgc

SEQ ID NO: 327706 - RNA, 32 nt, Human
agugcugggauuacuggcgugagccaccgugc

SEQ ID NO: 327707 - RNA, 32 nt, Human
agugcugggauuacugguaugaaccaccacgc

SEQ ID NO: 327708 - RNA, 32 nt, Human
agugcugggauuacuggugugagccaccacgg

SEQ ID NO: 327709 - RNA, 32 nt, Human
agugcugggauuagaagcgugagccaccacgc

SEQ ID NO: 327710 - RNA, 23 nt, Human
agugcugggauuagaggcaugag

SEQ ID NO: 327711 - RNA, 32 nt, Human
agugcugggauuagaggcaugagccaccgugc

SEQ ID NO: 327712 - RNA, 32 nt, Human
agugcugggauuagaggcaugagccacugcgc

SEQ ID NO: 327713 - RNA, 32 nt, Human
agugcugggauuagaggcaugagccacugucc

SEQ ID NO: 327714 - RNA, 32 nt, Human
agugcugggauuagaggcgugagccacugcac

SEQ ID NO: 327715 - RNA, 32 nt, Human
agugcugggauuagaggcuugagccaccaggc

SEQ ID NO: 327716 - RNA, 32 nt, Human
agugcugggauuagaggcuugagccacugcac

SEQ ID NO: 327717 - RNA, 32 nt, Human
agugcugggauuagaggugugagccaccacgc

SEQ ID NO: 327718 - RNA, 32 nt, Human
agugcugggauuaggugugagccaccgcaccu

SEQ ID NO: 327719 - RNA, 32 nt, Human
agugcugggauuauacaugugagccaccgugc

SEQ ID NO: 327720 - RNA, 32 nt, Human
agugcugggauuauacguaugggccucugcuc

SEQ ID NO: 327721 - RNA, 32 nt, Human
agugcugggauuauagaugugagccaccgcgc

SEQ ID NO: 327722 - RNA, 32 nt, Human
agugcugggauuauaggagugagccaccgcgc

SEQ ID NO: 327723 - RNA, 32 nt, Human
agugcugggauuauaggcaagagcgauggcgc

SEQ ID NO: 327724 - RNA, 32 nt, Human
agugcugggauuauaggcacaagacaccacaa

SEQ ID NO: 327725 - RNA, 32 nt, Human
agugcugggauuauaggcaugaaccaccgugc

SEQ ID NO: 327726 - RNA, 32 nt, Human
agugcugggauuauaggcaugaaccaccgugu

SEQ ID NO: 327727 - RNA, 32 nt, Human
agugcugggauuauaggcaugaaccacugugc

SEQ ID NO: 327728 - RNA, 32 nt, Human
agugcugggauuauaggcaugagccaccacac

SEQ ID NO: 327729 - RNA, 32 nt, Human
agugcugggauuauaggcaugagccaccaugc

SEQ ID NO: 327730 - RNA, 32 nt, Human
agugcugggauuauaggcaugagccaccgugc

SEQ ID NO: 327731 - RNA, 32 nt, Human
agugcugggauuauaggcaugagccacugcac

SEQ ID NO: 327732 - RNA, 32 nt, Human
agugcugggauuauaggcaugagccacugggc

SEQ ID NO: 327733 - RNA, 32 nt, Human
agugcugggauuauaggcaugagucacuguac

SEQ ID NO: 327734 - RNA, 32 nt, Human
agugcugggauuauaggcaugcgccaccaugc

SEQ ID NO: 327735 - RNA, 32 nt, Human
agugcugggauuauaggcaugugccaccacau

SEQ ID NO: 327736 - RNA, 32 nt, Human
agugcugggauuauaggccugagcccaccgug

SEQ ID NO: 327737 - RNA, 32 nt, Human
agugcugggauuauaggcguaagccaccacac

SEQ ID NO: 327738 - RNA, 32 nt, Human
agugcugggauuauaggcguaagccaccaugc

SEQ ID NO: 327739 - RNA, 32 nt, Human
agugcugggauuauaggcguaagccacugugu

SEQ ID NO: 327740 - RNA, 32 nt, Human
agugcugggauuauaggcgugagacaccgcgc

SEQ ID NO: 327741 - RNA, 32 nt, Human
agugcugggauuauaggcgugagccaccacac

SEQ ID NO: 327742 - RNA, 32 nt, Human
agugcugggauuauaggcgugagccaccaugc

SEQ ID NO: 327743 - RNA, 32 nt, Human
agugcugggauuauaggcgugagccaccgcac

SEQ ID NO: 327744 - RNA, 32 nt, Human
agugcugggauuauaggcgugagccaccgcgc

SEQ ID NO: 327745 - RNA, 32 nt, Human
agugcugggauuauaggcgugagccaccgugc

SEQ ID NO: 327746 - RNA, 32 nt, Human
agugcugggauuauaggcgugagccacugcgc

SEQ ID NO: 327747 - RNA, 32 nt, Human
agugcugggauuauaggcgugagccucuggcc

SEQ ID NO: 327748 - RNA, 32 nt, Human
agugcugggauuauaggcgugagcucccguac

SEQ ID NO: 327749 - RNA, 32 nt, Human
agugcugggauuauaggcgugagucaccaugc

SEQ ID NO: 327750 - RNA, 32 nt, Human
agugcugggauuauaggcgugugccauggugc

SEQ ID NO: 327751 - RNA, 32 nt, Human
agugcugggauuauaggcuugagccaccacgg

SEQ ID NO: 327752 - RNA, 32 nt, Human
agugcugggauuauagggaugagucacugugc

SEQ ID NO: 327753 - RNA, 19 nt, Human
agugcugggauuauaggug

SEQ ID NO: 327754 - RNA, 32 nt, Human
agugcugggauuauaggugugagccaccacac

SEQ ID NO: 327755 - RNA, 32 nt, Human
agugcugggauuauaggugugagccaccaugc

SEQ ID NO: 327756 - RNA, 32 nt, Human
agugcugggauuauaggugugagccacccugc

SEQ ID NO: 327757 - RNA, 32 nt, Human
agugcugggauuauaggugugagccaccgcac

SEQ ID NO: 327758 - RNA, 32 nt, Human
agugcugggauuauaggugugagccaccgcgc

SEQ ID NO: 327759 - RNA, 32 nt, Human
agugcugggauuauaggugugagccacugcac

SEQ ID NO: 327760 - RNA, 32 nt, Human
agugcugggauuauaggugugagccacugcgc

SEQ ID NO: 327761 - RNA, 32 nt, Human
agugcugggauuauaggugugagccacugcuc

SEQ ID NO: 327762 - RNA, 32 nt, Human
agugcugggauuauaggugugagcccccacgc

SEQ ID NO: 327763 - RNA, 32 nt, Human
agugcugggauuauaggugugagcccccgugc

SEQ ID NO: 327764 - RNA, 32 nt, Human
agugcugggauuauaggugugcgccaccacac

SEQ ID NO: 327765 - RNA, 32 nt, Human
agugcugggauuaucaauaugagccaccaugc

SEQ ID NO: 327766 - RNA, 32 nt, Human
agugcugggauuauggacgugagccaccacac

SEQ ID NO: 327767 - RNA, 32 nt, Human
agugcugggauuccaggcgugagccacugcgc

SEQ ID NO: 327768 - RNA, 32 nt, Human
agugcugggauuccaggcgugagccacugcgg

SEQ ID NO: 327769 - RNA, 19 nt, Human
agugcugggauuccaggug

SEQ ID NO: 327770 - RNA, 32 nt, Human
agugcugggauuccaggugugagccacuucac

SEQ ID NO: 327771 - RNA, 32 nt, Human
agugcugggauucugggugugagccacuguca

SEQ ID NO: 327772 - RNA, 32 nt, Human
agugcugggauugcaggcaugagccaccaugc

SEQ ID NO: 327773 - RNA, 32 nt, Human
agugcugggauugcaggcaugagccaccgcgc

SEQ ID NO: 327774 - RNA, 32 nt, Human
agugcugggauugcaggcaugagccaccgugc

SEQ ID NO: 327775 - RNA, 32 nt, Human
agugcugggauugcaggcaugagccacugcac

SEQ ID NO: 327776 - RNA, 32 nt, Human
agugcugggauugcaggcaugagccacugcuc

SEQ ID NO: 327777 - RNA, 32 nt, Human
agugcugggauugcaggcgugagccaccacac

SEQ ID NO: 327778 - RNA, 32 nt, Human
agugcugggauugcaggcgugagccaccacgc

SEQ ID NO: 327779 - RNA, 32 nt, Human
agugcugggauugcaggcgugagccaccaggc

SEQ ID NO: 327780 - RNA, 32 nt, Human
agugcugggauugcaggcgugagccaccaugc

SEQ ID NO: 327781 - RNA, 32 nt, Human
agugcugggauugcaggcgugagccaccgugc

SEQ ID NO: 327782 - RNA, 32 nt, Human
agugcugggauugcaggcgugagccacugcac

SEQ ID NO: 327783 - RNA, 32 nt, Human
agugcugggauugcaggcgugagccacuuucc

SEQ ID NO: 327784 - RNA, 19 nt, Human
agugcugggauugcaggug

SEQ ID NO: 327785 - RNA, 32 nt, Human
agugcugggauugcaggugugagccaccacgc

SEQ ID NO: 327786 - RNA, 32 nt, Human
agugcugggauugcaggugugagccaccgcac

SEQ ID NO: 327787 - RNA, 32 nt, Human
agugcugggauugugggugugagccaccgcgc

SEQ ID NO: 327788 - RNA, 24 nt, Human
agugcugggauuuacaggcaugag

SEQ ID NO: 327789 - RNA, 32 nt, Human
agugcugggauuucaggcgugagccaccacac

SEQ ID NO: 327790 - RNA, 32 nt, Human
agugcugggcaguacuccccuaggcagaucca

SEQ ID NO: 327791 - RNA, 32 nt, Human
agugcugggcccugugccuguugcaugagccu

SEQ ID NO: 327792 - RNA, 32 nt, Human
agugcugggcuauuccgggcucaguggucuug

SEQ ID NO: 327793 - RNA, 23 nt, Human
agugcugggcucccagacaaaug

SEQ ID NO: 327794 - RNA, 32 nt, Human
agugcuggggucggggagagccugacacacuc

SEQ ID NO: 327795 - RNA, 32 nt, Human
agugcugggguuacaggcaugagccaccacac

SEQ ID NO: 327796 - RNA, 32 nt, Human
agugcugggguuacaggcgugagccaccgcac

SEQ ID NO: 327797 - RNA, 19 nt, Human
agugcugggguuacaggug

SEQ ID NO: 327798 - RNA, 32 nt, Human
agugcugggguuacaggugugagccacugcac

SEQ ID NO: 327799 - RNA, 32 nt, Human
agugcugggguuacaggugugagccacugcgc

SEQ ID NO: 327800 - RNA, 32 nt, Human
agugcugggguuaugggugugagccaccgcgc

SEQ ID NO: 327801 - RNA, 32 nt, Human
agugcuggguuuacaggcaugagccaccacac

SEQ ID NO: 327802 - RNA, 32 nt, Human
agugcugguaaauaguuugcuguaguggaaag

SEQ ID NO: 327803 - RNA, 32 nt, Human
agugcugguaaauuauuuuuaaugauuugagu

SEQ ID NO: 327804 - RNA, 32 nt, Human
agugcugguauuacaggcgugagccaccaugc

SEQ ID NO: 327805 - RNA, 32 nt, Human
agugcugguauuacaggugugagccacugugu

SEQ ID NO: 327806 - RNA, 32 nt, Human
agugcuggucgaggcaggcgcccagcuggacg

SEQ ID NO: 327807 - RNA, 32 nt, Human
agugcugguuaguucccgcccccugguaaacc

SEQ ID NO: 327808 - RNA, 32 nt, Human
agugcuguaaggagagguuggaagugaagaug

SEQ ID NO: 327809 - RNA, 32 nt, Human
agugcuguagccuggccagaccccagagcccu

SEQ ID NO: 327810 - RNA, 32 nt, Human
agugcuguccccaggcugcaguucuggucccu

SEQ ID NO: 327811 - RNA, 32 nt, Human
agugcugugauuacaggugugagccacugcac

SEQ ID NO: 327812 - RNA, 32 nt, Human
agugcugugauuaccggugugagccacugcgc

SEQ ID NO: 327813 - RNA, 32 nt, Human
agugcugugcugcugcuggucuccugauggcu

SEQ ID NO: 327814 - RNA, 32 nt, Human
agugcuguggaucuggagaagcuggaagccag

SEQ ID NO: 327815 - RNA, 32 nt, Human
agugcugugguggaguggaguggcuauucaca

SEQ ID NO: 327816 - RNA, 32 nt, Human
agugcuguuuccuggcuggagugcaguggcau

SEQ ID NO: 327817 - RNA, 16 nt, Human
agugcuguuugaacug

SEQ ID NO: 327818 - RNA, 32 nt, Human
agugcuuagcucaagaggaaagaaggaaaauc

SEQ ID NO: 327819 - RNA, 32 nt, Human
agugcuuagcucucucccuccugaccucuggg

SEQ ID NO: 327820 - RNA, 32 nt, Human
agugcuucaaccacugcucucccugcucuacu

SEQ ID NO: 327821 - RNA, 32 nt, Human
agugcuucaacgaugugacugccaucaucuuc

SEQ ID NO: 327822 - RNA, 32 nt, Human
agugcuuccaaaggagggugcauccugagaga

SEQ ID NO: 327823 - RNA, 17 nt, Human
agugcuucccugaacug

SEQ ID NO: 327824 - RNA, 32 nt, Human
agugcuuccucuggagaggcagcuccacgagg

SEQ ID NO: 327825 - RNA, 32 nt, Human
agugcuucucauauugccccaggacagauguc

SEQ ID NO: 327826 - RNA, 32 nt, Human
agugcuucugcuugcccugccccaggcagccc

SEQ ID NO: 327827 - RNA, 32 nt, Human
agugcuucugguuucagcacacauggagauau

SEQ ID NO: 327828 - RNA, 32 nt, Human
agugcuucuuucacuccaccaccuacagcugg

SEQ ID NO: 327829 - RNA, 32 nt, Human
agugcuuggauuacaggcaugagccaccgcac

SEQ ID NO: 327830 - RNA, 19 nt, Human
agugcuuggauuacaggug

SEQ ID NO: 327831 - RNA, 32 nt, Human
agugcuuggauuacaggugugagccacugugu

SEQ ID NO: 327832 - RNA, 32 nt, Human
agugcuuggauuauaggcgugagccaccgcac

SEQ ID NO: 327833 - RNA, 32 nt, Human
agugcuuggauugcaggcaugagccacuucgc

SEQ ID NO: 327834 - RNA, 32 nt, Human
agugcuuguagcagccaucccccagccccagg

SEQ ID NO: 327835 - RNA, 32 nt, Human
agugcuugucauccucuucccugccucugucu

SEQ ID NO: 327836 - RNA, 32 nt, Human
agugcuuuaccuaaguguggauugugccucuu

SEQ ID NO: 327837 - RNA, 32 nt, Human
agugcuuuaccuaaguguugauugugccuguu

SEQ ID NO: 327838 - RNA, 31 nt, Human
agugcuuucaaguggauucuguugaagaaaa

SEQ ID NO: 327839 - RNA, 32 nt, Human
agugcuuuccccagcaccccagagccagucgg

SEQ ID NO: 327840 - RNA, 32 nt, Human
agugcuuugagagagaaaggacuccugaaaaa

SEQ ID NO: 327841 - RNA, 23 nt, Human
agugcuuuguuauguuuuauuaa

SEQ ID NO: 327842 - RNA, 32 nt, Human
agugcuuuucaccaaucccacucacccccggu

SEQ ID NO: 327843 - RNA, 32 nt, Human
aguggaaaaagcaauggagaagaaaaguugcu

SEQ ID NO: 327844 - RNA, 32 nt, Human
aguggaaaaagucccugagggcgguuaggagu

SEQ ID NO: 327845 - RNA, 32 nt, Human
aguggaaaacaguuaaugaccagccacggcgu

SEQ ID NO: 327846 - RNA, 32 nt, Human
aguggaaacuauucuaucauaacuacccaagg

SEQ ID NO: 327847 - RNA, 32 nt, Human
aguggaaagaggaugggcgaggaggccgggcu

SEQ ID NO: 327848 - RNA, 32 nt, Human
aguggaaauucugccgagccucuugucccuuc

SEQ ID NO: 327849 - RNA, 32 nt, Human
aguggaacagaugaaagaggccagcagaccca

SEQ ID NO: 327850 - RNA, 32 nt, Human
aguggaaccagcugccccugcuucacaccucu

SEQ ID NO: 327851 - RNA, 32 nt, Human
aguggaaccuggcucuggggagaagccgcgug

SEQ ID NO: 327852 - RNA, 21 nt, Human
aguggaacuaagccugcucca

SEQ ID NO: 327853 - RNA, 32 nt, Human
aguggaacuucacuucaucacagagugucagg

SEQ ID NO: 327854 - RNA, 32 nt, Human
aguggaagaagagggagagauggagcaaagug

SEQ ID NO: 327855 - RNA, 32 nt, Human
aguggaagacagagauggcagagccauccacc

SEQ ID NO: 327856 - RNA, 32 nt, Human
aguggaagagguaccaggagucacucaguuug

SEQ ID NO: 327857 - RNA, 32 nt, Human
aguggaagagguggcggggaccagcugggcag

SEQ ID NO: 327858 - RNA, 32 nt, Human
aguggaagcgaggaagaaggaggaguucccuc

SEQ ID NO: 327859 - RNA, 32 nt, Human
aguggaagcugcagugagccgagaucaggcca

SEQ ID NO: 327860 - RNA, 32 nt, Human
aguggaagggagcaucaggagaggaacaaaaa

SEQ ID NO: 327861 - RNA, 32 nt, Human
aguggaaucugaagggcccaccccauggagga

SEQ ID NO: 327862 - RNA, 32 nt, Human
aguggaauguauuuaaaacuuguugaauuaga

SEQ ID NO: 327863 - RNA, 31 nt, Human
aguggaaugucaccaucgcccagguggggau

SEQ ID NO: 327864 - RNA, 32 nt, Human
aguggacaaguccgcuuugugagaugaauacu

SEQ ID NO: 327865 - RNA, 32 nt, Human
aguggacaauguuuuguauauaguugagaauu

SEQ ID NO: 327866 - RNA, 32 nt, Human
aguggacacacaccuaaucuguccucaaggac

SEQ ID NO: 327867 - RNA, 32 nt, Human
aguggacacagcuguuaauuuccacuggcuau

SEQ ID NO: 327868 - RNA, 32 nt, Human
aguggacagcgaaaggagagaaaccaccacag

SEQ ID NO: 327869 - RNA, 32 nt, Human
aguggacauauauacaaaagguugagaggaaa

SEQ ID NO: 327870 - RNA, 32 nt, Human
aguggaccaagcugcaaugcaguauugacuug

SEQ ID NO: 327871 - RNA, 21 nt, Human
aguggaccagggccccugagg

SEQ ID NO: 327872 - RNA, 32 nt, Human
aguggacccagccaagggucagggucagcacu

SEQ ID NO: 327873 - RNA, 32 nt, Human
aguggacccauguaauacuuuuauccauguuu

SEQ ID NO: 327874 - RNA, 28 nt, Human
aguggaccccagggugccucauaccagc

SEQ ID NO: 327875 - RNA, 32 nt, Human
aguggaccugugucugugucuguccugagaac

SEQ ID NO: 327876 - RNA, 32 nt, Human
aguggaccuuaggccuuccucucuccagaugu

SEQ ID NO: 327877 - RNA, 32 nt, Human
aguggacguaggauauuuucccuaccuaagaa

SEQ ID NO: 327878 - RNA, 32 nt, Human
aguggacuaaccacagcagcagccagggaugg

SEQ ID NO: 327879 - RNA, 32 nt, Human
aguggacucaaacuuguccuccgaagcgcggc

SEQ ID NO: 327880 - RNA, 32 nt, Human
aguggacucgaauccuggaggaggaaauaaag

SEQ ID NO: 327881 - RNA, 32 nt, Human
aguggacucuucuaccagagcugggcaagacc

SEQ ID NO: 327882 - RNA, 32 nt, Human
aguggacugccugcucccacagccugggcuga

SEQ ID NO: 327883 - RNA, 32 nt, Human
aguggacuguucccugaggugggagaugugga

SEQ ID NO: 327884 - RNA, 32 nt, Human
aguggacuuuccacccccucccuggccuguuc

SEQ ID NO: 327885 - RNA, 32 nt, Human
aguggagaagugagacugggaaggggaggaga

SEQ ID NO: 327886 - RNA, 32 nt, Human
aguggagaaguuagaugagugcaaggagcucc

SEQ ID NO: 327887 - RNA, 32 nt, Human
aguggagacacugccacugauucuccagugca

SEQ ID NO: 327888 - RNA, 18 nt, Human
aguggagaccuaccucca

SEQ ID NO: 327889 - RNA, 32 nt, Human
aguggagacuuggacccaggagucuugcugac

SEQ ID NO: 327890 - RNA, 32 nt, Human
aguggagagaaccucgcccuccccaggcgcua

SEQ ID NO: 327891 - RNA, 32 nt, Human
aguggagagccaggggagugugggucagauaa

SEQ ID NO: 327892 - RNA, 27 nt, Human
aguggagaggagagagagcaaauauug

SEQ ID NO: 327893 - RNA, 32 nt, Human
aguggagaggaguggggccugccccucuucuc

SEQ ID NO: 327894 - RNA, 32 nt, Human
aguggagagggaacuccucucccccauuuugu

SEQ ID NO: 327895 - RNA, 32 nt, Human
aguggagagggagagacggagccccagaaggg

SEQ ID NO: 327896 - RNA, 32 nt, Human
aguggagagggugugugaaaugccgguggagc

SEQ ID NO: 327897 - RNA, 32 nt, Human
aguggagaucgugguccccauggaaagaaaaa

SEQ ID NO: 327898 - RNA, 32 nt, Human
aguggagauguggucugucuauaaaaggccgg

SEQ ID NO: 327899 - RNA, 32 nt, Human
aguggagauuguaccacugcacuccagccugg

SEQ ID NO: 327900 - RNA, 32 nt, Human
aguggagcaaacugacucuagggagaaggcaa

SEQ ID NO: 327901 - RNA, 32 nt, Human
aguggagcagggcuuagcaggagcaguuucug

SEQ ID NO: 327902 - RNA, 32 nt, Human
aguggagcagugagcugccuccucuccuagca

SEQ ID NO: 327903 - RNA, 32 nt, Human
aguggagccauggcuagaggcaggaagauguc

SEQ ID NO: 327904 - RNA, 32 nt, Human
aguggagcccagggugcugggauggcuauauu

SEQ ID NO: 327905 - RNA, 32 nt, Human
aguggagcccucuuucccugcagccuacauug

SEQ ID NO: 327906 - RNA, 32 nt, Human
aguggagccuccugcucuccuggaccagcugc

SEQ ID NO: 327907 - RNA, 32 nt, Human
aguggagccugacaguguguauuuuauucuuu

SEQ ID NO: 327908 - RNA, 32 nt, Human
aguggagccuggcaaggugcccuccuggccug

SEQ ID NO: 327909 - RNA, 32 nt, Human
aguggagcgagggagagacggugggaugguga

SEQ ID NO: 327910 - RNA, 32 nt, Human
aguggagcuugugaguaagaaugcagauagaa

SEQ ID NO: 327911 - RNA, 32 nt, Human
aguggaggaagaaggaaggagaggcuuggaaa

SEQ ID NO: 327912 - RNA, 32 nt, Human
aguggaggaagaggagaaagagggagggagau

SEQ ID NO: 327913 - RNA, 32 nt, Human
aguggaggaaguuagacaagcauuuuaaguaa

SEQ ID NO: 327914 - RNA, 32 nt, Human
aguggaggagaaacguggcaacugccgaauaa

SEQ ID NO: 327915 - RNA, 32 nt, Human
aguggaggagcucucacucacauaucauguaa

SEQ ID NO: 327916 - RNA, 32 nt, Human
aguggaggagugagaaagaagugccagagagc

SEQ ID NO: 327917 - RNA, 32 nt, Human
aguggaggcaggaugggagagcccccugggug

SEQ ID NO: 327918 - RNA, 32 nt, Human
aguggaggcccuggugcccggcccuuggugcu

SEQ ID NO: 327919 - RNA, 32 nt, Human
aguggaggcugcaggaagaggcgggucuuuag

SEQ ID NO: 327920 - RNA, 32 nt, Human
aguggaggcugcagugagccuagguggugcca

SEQ ID NO: 327921 - RNA, 32 nt, Human
aguggagggagaagaaucaggcugccagggag

SEQ ID NO: 327922 - RNA, 32 nt, Human
aguggagggagagaggacuuaagucagaugga

SEQ ID NO: 327923 - RNA, 32 nt, Human
aguggagggcaggggucuggcacaggugcgau

SEQ ID NO: 327924 - RNA, 32 nt, Human
aguggagggcauuuuccagggcacugcuuucc

SEQ ID NO: 327925 - RNA, 32 nt, Human
aguggaggggccagggcugagccggcgggucc

SEQ ID NO: 327926 - RNA, 32 nt, Human
aguggaggggcuguggcacgugggcggagacu

SEQ ID NO: 327927 - RNA, 32 nt, Human
aguggagggggaccucagaggagcaggaccag

SEQ ID NO: 327928 - RNA, 32 nt, Human
aguggaggguaaggaaaauggcugcacuuuag

SEQ ID NO: 327929 - RNA, 32 nt, Human
aguggagggugaaaggagggagaggaucagca

SEQ ID NO: 327930 - RNA, 22 nt, Human
aguggagguaaauuaagagccu

SEQ ID NO: 327931 - RNA, 32 nt, Human
aguggagguuguaccacugcacuccagccugg

SEQ ID NO: 327932 - RNA, 32 nt, Human
aguggaguacagaaccaggagccucuuccaua

SEQ ID NO: 327933 - RNA, 32 nt, Human
aguggagucaucugaggccacugcuauuuccc

SEQ ID NO: 327934 - RNA, 32 nt, Human
aguggaguccaggaaagacucuucucauuuau

SEQ ID NO: 327935 - RNA, 32 nt, Human
aguggagucuccuuuccaacaggaugaugcau

SEQ ID NO: 327936 - RNA, 32 nt, Human
aguggagucucucacugcaugugacguggaag

SEQ ID NO: 327937 - RNA, 32 nt, Human
aguggagucugggcagugaugacaguggaaag

SEQ ID NO: 327938 - RNA, 32 nt, Human
aguggagugacuauuuggagaauagcacccau

SEQ ID NO: 327939 - RNA, 32 nt, Human
aguggaguggagaaggggccagggguucuggg

SEQ ID NO: 327940 - RNA, 32 nt, Human
aguggagugggaagaaauguuuugaaauagag

SEQ ID NO: 327941 - RNA, 32 nt, Human
aguggaguuccaggagcaccaccugagugagg

SEQ ID NO: 327942 - RNA, 32 nt, Human
aguggauaaauaaugugcacugcucugagccc

SEQ ID NO: 327943 - RNA, 32 nt, Human
aguggauaacuuuucuuuuucccaggccagag

SEQ ID NO: 327944 - RNA, 32 nt, Human
aguggauagugugagagaauuaggcuguagaa

SEQ ID NO: 327945 - RNA, 20 nt, Human
aguggauaucagaugggaua

SEQ ID NO: 327946 - RNA, 32 nt, Human
aguggaucacacacauggaaggugaugggggc

SEQ ID NO: 327947 - RNA, 32 nt, Human
aguggaucacuugaggccaggaguuugagacc

SEQ ID NO: 327948 - RNA, 19 nt, Human
aguggaucacuugagguca

SEQ ID NO: 327949 - RNA, 32 nt, Human
aguggaucagucucaagugucugguaacagca

SEQ ID NO: 327950 - RNA, 32 nt, Human
aguggaucaucucuagcaacaggucacacauu

SEQ ID NO: 327951 - RNA, 32 nt, Human
aguggaucccagcucuggcgacagcaucagcu

SEQ ID NO: 327952 - RNA, 32 nt, Human
aguggaucuuggagugggauuucuugguaaau

SEQ ID NO: 327953 - RNA, 32 nt, Human
aguggaugcagagaggaugcagaugcugggcu

SEQ ID NO: 327954 - RNA, 32 nt, Human
aguggauggcacagugcugucaucccuucucc

SEQ ID NO: 327955 - RNA, 32 nt, Human
aguggauggggagucuguguggcacccuguga

SEQ ID NO: 327956 - RNA, 32 nt, Human
aguggaugugagugaggaucaaggaaaagccg

SEQ ID NO: 327957 - RNA, 32 nt, Human
aguggaugugucauauauugccaaacauuaca

SEQ ID NO: 327958 - RNA, 32 nt, Human
aguggauucaccaaauuagccauuccauuuuc

SEQ ID NO: 327959 - RNA, 32 nt, Human
aguggauuccccgugugucugugcugcagccu

SEQ ID NO: 327960 - RNA, 32 nt, Human
aguggauucuagugcugagucuuccaggaaaa

SEQ ID NO: 327961 - RNA, 32 nt, Human
aguggauuucagcagucccccuuugucugaaa

SEQ ID NO: 327962 - RNA, 32 nt, Human
aguggcaaaaccaguuccaccugcugguaggg

SEQ ID NO: 327963 - RNA, 32 nt, Human
aguggcaaaaucauggcucacugcagccugga

SEQ ID NO: 327964 - RNA, 32 nt, Human
aguggcaaacuucagacgguuccaauggucuu

SEQ ID NO: 327965 - RNA, 32 nt, Human
aguggcaaagaauguauuugaaagaagagacc

SEQ ID NO: 327966 - RNA, 17 nt, Human
aguggcaaagaugagau

SEQ ID NO: 327967 - RNA, 32 nt, Human
aguggcaaauggaucugucaacaggcuccauu

SEQ ID NO: 327968 - RNA, 32 nt, Human
aguggcaaccagcugugggguacauaggagug

SEQ ID NO: 327969 - RNA, 32 nt, Human
aguggcaacuucugccuuuuuccaagugguuu

SEQ ID NO: 327970 - RNA, 32 nt, Human
aguggcacaagaauggcucaacucuccaaaua

SEQ ID NO: 327971 - RNA, 28 nt, Human
aguggcacaagugcuguuucuaucacua

SEQ ID NO: 327972 - RNA, 32 nt, Human
aguggcacaaucuugacucgcugcagucucca

SEQ ID NO: 327973 - RNA, 32 nt, Human
aguggcacacggugagugcuggcauggcucua

SEQ ID NO: 327974 - RNA, 32 nt, Human
aguggcacagucauggcucgcugcagccuuga

SEQ ID NO: 327975 - RNA, 32 nt, Human
aguggcacagucucuacucaggaggcugaggc

SEQ ID NO: 327976 - RNA, 32 nt, Human
aguggcacccaaugccucucaggaugagacca

SEQ ID NO: 327977 - RNA, 32 nt, Human
aguggcaccuccuucaggccuuugggguauuc

SEQ ID NO: 327978 - RNA, 31 nt, Human
aguggcacgaucucagcucacuguaccuuug

SEQ ID NO: 327979 - RNA, 31 nt, Human
aguggcacggugcuugggccuguguccccgg

SEQ ID NO: 327980 - RNA, 32 nt, Human
aguggcacuccugguccugcugucuugguuuu

SEQ ID NO: 327981 - RNA, 32 nt, Human
aguggcacuggcuucguccucccagggcccag

SEQ ID NO: 327982 - RNA, 32 nt, Human
aguggcagacagcauggcucucacagcacagg

SEQ ID NO: 327983 - RNA, 32 nt, Human
aguggcagagcugugggcucugcuguucucuc

SEQ ID NO: 327984 - RNA, 32 nt, Human
aguggcagaggugaggggauaaguuagaaugu

SEQ ID NO: 327985 - RNA, 32 nt, Human
aguggcagcaggugggggcauucuucuaagaa

SEQ ID NO: 327986 - RNA, 32 nt, Human
aguggcagcccccuccccacaccaguugaacu

SEQ ID NO: 327987 - RNA, 32 nt, Human
aguggcagccuggauggacaggagagguuucu

SEQ ID NO: 327988 - RNA, 32 nt, Human
aguggcagccugggccucggggaaggaagggc

SEQ ID NO: 327989 - RNA, 32 nt, Human
aguggcagcucuucaugaguccugcagugcua

SEQ ID NO: 327990 - RNA, 32 nt, Human
aguggcagcuguugccacacacaugcggaggg

SEQ ID NO: 327991 - RNA, 32 nt, Human
aguggcaggagaaggagucggaccuccgcaag

SEQ ID NO: 327992 - RNA, 20 nt, Human
aguggcaggaggccgugcug

SEQ ID NO: 327993 - RNA, 32 nt, Human
aguggcaggaggucuguguugucauggugaac

SEQ ID NO: 327994 - RNA, 32 nt, Human
aguggcaggcggaucacuugagcucaggaguc

SEQ ID NO: 327995 - RNA, 32 nt, Human
aguggcagggcagaggaagcaggguacagaca

SEQ ID NO: 327996 - RNA, 32 nt, Human
aguggcagucguccaaaccccaggaagagagc

SEQ ID NO: 327997 - RNA, 32 nt, Human
aguggcagugccuggacacugcacagcggaau

SEQ ID NO: 327998 - RNA, 32 nt, Human
aguggcagugggacaggagcggaaggaccaca

SEQ ID NO: 327999 - RNA, 32 nt, Human
aguggcaguguguggauuugaggaccucugca

SEQ ID NO: 328000 - RNA, 32 nt, Human
aguggcaucggcugccccaggcagaggcuuug

SEQ ID NO: 328001 - RNA, 32 nt, Human
aguggcaucuuuauggaaucacuguggauacu

SEQ ID NO: 328002 - RNA, 32 nt, Human
aguggcaugaccuuggguagguggcugagccu

SEQ ID NO: 328003 - RNA, 32 nt, Human
aguggcaugaucugcaaucucugccucccagg

SEQ ID NO: 328004 - RNA, 32 nt, Human
aguggccaaaugaaguacuuugccaaauaaaa

SEQ ID NO: 328005 - RNA, 32 nt, Human
aguggccaagggaguugagcugagcaggggga

SEQ ID NO: 328006 - RNA, 32 nt, Human
aguggccaaguccuuuaucaaaaagcugcuuu

SEQ ID NO: 328007 - RNA, 32 nt, Human
aguggccaaucggagauucguuucuuaucuau

SEQ ID NO: 328008 - RNA, 32 nt, Human
aguggccagaagcugaaaugacagcaguggua

SEQ ID NO: 328009 - RNA, 32 nt, Human
aguggccagaagcugaaaugacagcaguggug

SEQ ID NO: 328010 - RNA, 32 nt, Human
aguggccagaagcugauaugcggcaguggugc

SEQ ID NO: 328011 - RNA, 32 nt, Human
aguggccagagaggaggagaaggagggugaga

SEQ ID NO: 328012 - RNA, 32 nt, Human
aguggccagccauuugaaucagcuucagccuu

SEQ ID NO: 328013 - RNA, 32 nt, Human
aguggccagccccaguuucccauugcuccucu

SEQ ID NO: 328014 - RNA, 32 nt, Human
aguggccaggcagggagugucugcaguccugg

SEQ ID NO: 328015 - RNA, 32 nt, Human
aguggccagggaggggagugguggagccaguc

SEQ ID NO: 328016 - RNA, 32 nt, Human
aguggccagguggaugaaguuagugucuugaa

SEQ ID NO: 328017 - RNA, 32 nt, Human
aguggccaugcuccccuccaugcgucuccccu

SEQ ID NO: 328018 - RNA, 32 nt, Human
aguggccauggcugccugccugacuguagugc

SEQ ID NO: 328019 - RNA, 32 nt, Human
aguggcccacaguuuccuuucucuccacaccu

SEQ ID NO: 328020 - RNA, 32 nt, Human
aguggcccagccagagagcgcagcucccgcgc

SEQ ID NO: 328021 - RNA, 32 nt, Human
aguggcccagcccugggugucccaucaccaug

SEQ ID NO: 328022 - RNA, 24 nt, Human
aguggcccaggcuggagugcaggg

SEQ ID NO: 328023 - RNA, 32 nt, Human
aguggcccaguucugguuuucuagauuguacu

SEQ ID NO: 328024 - RNA, 23 nt, Human
aguggcccaugccuguaaucuca

SEQ ID NO: 328025 - RNA, 32 nt, Human
aguggccccucaggacccagggucccagcugc

SEQ ID NO: 328026 - RNA, 32 nt, Human
aguggcccucagcccuccaccuccggcggggg

SEQ ID NO: 328027 - RNA, 32 nt, Human
aguggcccuccaccuuguuccugcccuuuaac

SEQ ID NO: 328028 - RNA, 32 nt, Human
aguggcccuggccuggcccguggcgcauccuc

SEQ ID NO: 328029 - RNA, 32 nt, Human
aguggcccuggguuggggaaauauagaaggaa

SEQ ID NO: 328030 - RNA, 32 nt, Human
aguggccgcugccccagcuacagagacggccg

SEQ ID NO: 328031 - RNA, 32 nt, Human
aguggccgugccauccugccccuccacucccg

SEQ ID NO: 328032 - RNA, 32 nt, Human
aguggccuacuggaguuggaggucucacagca

SEQ ID NO: 328033 - RNA, 22 nt, Human
aguggccuagggucucuccucc

SEQ ID NO: 328034 - RNA, 32 nt, Human
aguggccuccaggaaguucuccaccaaggaug

SEQ ID NO: 328035 - RNA, 32 nt, Human
aguggccucuggcugcucacacccugccagag

SEQ ID NO: 328036 - RNA, 32 nt, Human
aguggccugaggucuccuggggccagguggga

SEQ ID NO: 328037 - RNA, 32 nt, Human
aguggccugcagucuccuggccagucuguaga

SEQ ID NO: 328038 - RNA, 32 nt, Human
aguggccugccuggcauccucugcuuauugaa

SEQ ID NO: 328039 - RNA, 32 nt, Human
aguggccuggcugucugucugucugucuaacc

SEQ ID NO: 328040 - RNA, 32 nt, Human
aguggccuggcuugucggagcaaguuucauca

SEQ ID NO: 328041 - RNA, 32 nt, Human
aguggccuuccucccuuccuuucacagccggu

SEQ ID NO: 328042 - RNA, 32 nt, Human
aguggccuuggcaaugucugugccaccuccug

SEQ ID NO: 328043 - RNA, 32 nt, Human
aguggccuuuuuacaaacuguucaggcucaag

SEQ ID NO: 328044 - RNA, 32 nt, Human
aguggcgacacaggcacccagcuuuggggugg

SEQ ID NO: 328045 - RNA, 32 nt, Human
aguggcgaccggagugguaggagcagcaauuu

SEQ ID NO: 328046 - RNA, 32 nt, Human
aguggcgagacgauuaaugacacuggccgagg

SEQ ID NO: 328047 - RNA, 32 nt, Human
aguggcgauuaccuccagcacagagacgugcc

SEQ ID NO: 328048 - RNA, 32 nt, Human
aguggcgcccgcagucauggugguguucguug

SEQ ID NO: 328049 - RNA, 32 nt, Human
aguggcgggucugggcuggcagagguaggggg

SEQ ID NO: 328050 - RNA, 32 nt, Human
aguggcgugaaggcaaacaggauuaagugaac

SEQ ID NO: 328051 - RNA, 32 nt, Human
aguggcguuuccgcacaggauuuccuaagacg

SEQ ID NO: 328052 - RNA, 32 nt, Human
aguggcuaagacuggucuaagcuauuaguuuu

SEQ ID NO: 328053 - RNA, 32 nt, Human
aguggcuauaguuggcuucuagugaggcuuca

SEQ ID NO: 328054 - RNA, 32 nt, Human
aguggcuaugggcaggucucuccuucccuacu

SEQ ID NO: 328055 - RNA, 23 nt, Human
aguggcucacaccuguaauccca

SEQ ID NO: 328056 - RNA, 32 nt, Human
aguggcucacaccuguaauccugcacuuuggg

SEQ ID NO: 328057 - RNA, 23 nt, Human
aguggcucacaccuguaaucuca

SEQ ID NO: 328058 - RNA, 32 nt, Human
aguggcucacaccuguaaucucagccucccag

SEQ ID NO: 328059 - RNA, 23 nt, Human
aguggcucacgccuguaauccca

SEQ ID NO: 328060 - RNA, 32 nt, Human
aguggcucacugcaaccugggugacagaacaa

SEQ ID NO: 328061 - RNA, 32 nt, Human
aguggcucagcagucucggugccugagccugc

SEQ ID NO: 328062 - RNA, 23 nt, Human
aguggcucauaccuguaauccca

SEQ ID NO: 328063 - RNA, 23 nt, Human
aguggcucaugcccguaauccca

SEQ ID NO: 328064 - RNA, 32 nt, Human
aguggcucaugccuauauucccugcacuuugg

SEQ ID NO: 328065 - RNA, 23 nt, Human
aguggcucaugccuguaauccca

SEQ ID NO: 328066 - RNA, 23 nt, Human
aguggcucaugcuuguaauccca

SEQ ID NO: 328067 - RNA, 32 nt, Human
aguggcuccaacaccauacuuaagcuuacuuc

SEQ ID NO: 328068 - RNA, 32 nt, Human
aguggcucccggccgcggccccggcugcgaga

SEQ ID NO: 328069 - RNA, 32 nt, Human
aguggcucccguggggaaggcugggagggcaa

SEQ ID NO: 328070 - RNA, 32 nt, Human
aguggcuccucuaacaagugggcagcuuggaa

SEQ ID NO: 328071 - RNA, 32 nt, Human
aguggcuccuuggcgugagcacugcucagacu

SEQ ID NO: 328072 - RNA, 32 nt, Human
aguggcucgccuguaaucccagcacuuuggga

SEQ ID NO: 328073 - RNA, 32 nt, Human
aguggcucugccauagccccagacaagcugcu

SEQ ID NO: 328074 - RNA, 23 nt, Human
aguggcucuugccuguaauccca

SEQ ID NO: 328075 - RNA, 32 nt, Human
aguggcugaacaaagagcauggcuugagaauc

SEQ ID NO: 328076 - RNA, 32 nt, Human
aguggcugaagaggcaggauggcuuggggcug

SEQ ID NO: 328077 - RNA, 32 nt, Human
aguggcugaaggcagaacuguuggagugguuc

SEQ ID NO: 328078 - RNA, 32 nt, Human
aguggcugagcuccaagugccugcugaagucu

SEQ ID NO: 328079 - RNA, 32 nt, Human
aguggcugcccagccaggaccauuggcucacc

SEQ ID NO: 328080 - RNA, 32 nt, Human
aguggcugccuccgggugaugauggcugugug

SEQ ID NO: 328081 - RNA, 32 nt, Human
aguggcugccuccuguguucucuggauuucuu

SEQ ID NO: 328082 - RNA, 29 nt, Human
aguggcugccugugugugucaggguuaga

SEQ ID NO: 328083 - RNA, 32 nt, Human
aguggcugcuucgguaucacagacacucugac

SEQ ID NO: 328084 - RNA, 32 nt, Human
aguggcugcuucugcuauagagaacauucuuc

SEQ ID NO: 328085 - RNA, 32 nt, Human
aguggcuggacuaccgagagcuuggacuacac

SEQ ID NO: 328086 - RNA, 19 nt, Human
aguggcuggccacauccca

SEQ ID NO: 328087 - RNA, 32 nt, Human
aguggcugggaugugggagcagcaucucuagg

SEQ ID NO: 328088 - RNA, 32 nt, Human
aguggcugggauuacaggcauccgccaccaug

SEQ ID NO: 328089 - RNA, 32 nt, Human
aguggcugggauuacaggcaugcaccaccaug

SEQ ID NO: 328090 - RNA, 32 nt, Human
aguggcugggauuacaggcaugugccaccaca

SEQ ID NO: 328091 - RNA, 32 nt, Human
aguggcugggauuacaggcgcaaaccaccaug

SEQ ID NO: 328092 - RNA, 32 nt, Human
aguggcugggauuacaggcgcccaccacuaug

SEQ ID NO: 328093 - RNA, 32 nt, Human
aguggcugggauuacaggcgcccgccaccaca

SEQ ID NO: 328094 - RNA, 32 nt, Human
aguggcugggauuacaggcgcccgccaccacg

SEQ ID NO: 328095 - RNA, 32 nt, Human
aguggcugggauuacaggcgccugcuaccaug

SEQ ID NO: 328096 - RNA, 32 nt, Human
aguggcugggauuacaggugugcgccaccaug

SEQ ID NO: 328097 - RNA, 20 nt, Human
aguggcugggauuauaggug

SEQ ID NO: 328098 - RNA, 20 nt, Human
aguggcugggauugcaggug

SEQ ID NO: 328099 - RNA, 32 nt, Human
aguggcugggcaugggggcucacaccuguaau

SEQ ID NO: 328100 - RNA, 26 nt, Human
aguggcuggggcauggaaggcaagau

SEQ ID NO: 328101 - RNA, 32 nt, Human
aguggcugggguccagaaaugggcaggaauga

SEQ ID NO: 328102 - RNA, 32 nt, Human
aguggcuggggucccugcaggucaugaggggc

SEQ ID NO: 328103 - RNA, 32 nt, Human
aguggcuguaagaaauuguccaugccaccaau

SEQ ID NO: 328104 - RNA, 32 nt, Human
aguggcugucauuccucaaauggcaaaaccag

SEQ ID NO: 328105 - RNA, 32 nt, Human
aguggcugugauauuucaaccaauugucauau

SEQ ID NO: 328106 - RNA, 32 nt, Human
aguggcugugauggugguauuaauaccacucc

SEQ ID NO: 328107 - RNA, 32 nt, Human
aguggcugugcuucacagcgcuuguuggguuc

SEQ ID NO: 328108 - RNA, 21 nt, Human
aguggcuguuuuccacccaaa

SEQ ID NO: 328109 - RNA, 32 nt, Human
aguggcuuaacuucucugggccuuuguuccua

SEQ ID NO: 328110 - RNA, 32 nt, Human
aguggcuucaguguccuugcguacacauucug

SEQ ID NO: 328111 - RNA, 32 nt, Human
aguggcuuccagcagaguugccugggauuucu

SEQ ID NO: 328112 - RNA, 32 nt, Human
aguggcuucccagcucugacccuucuacauuu

SEQ ID NO: 328113 - RNA, 32 nt, Human
aguggcuucuccauccuguuuucugcaacauu

SEQ ID NO: 328114 - RNA, 32 nt, Human
aguggcuucugccucuccugcccugaaaagga

SEQ ID NO: 328115 - RNA, 32 nt, Human
aguggcuuggccucaagagaauagcugguuuc

SEQ ID NO: 328116 - RNA, 32 nt, Human
aguggcuuggccucugguucugggugagguua

SEQ ID NO: 328117 - RNA, 32 nt, Human
aguggcuuucagcaaaccucagucauauucuu

SEQ ID NO: 328118 - RNA, 32 nt, Human
agugggaaaacugggguggggguggggguggg

SEQ ID NO: 328119 - RNA, 32 nt, Human
agugggaaaagcuuuuuccucuguauucuuuu

SEQ ID NO: 328120 - RNA, 32 nt, Human
agugggaaagagagggacgggucugaugaguu

SEQ ID NO: 328121 - RNA, 32 nt, Human
agugggaacgacugggcacugccaccaccaga

SEQ ID NO: 328122 - RNA, 32 nt, Human
agugggaacuggagggugagaggaaggguggg

SEQ ID NO: 328123 - RNA, 32 nt, Human
agugggaagacagugccgcuguugagacaaga

SEQ ID NO: 328124 - RNA, 18 nt, Human
agugggaagagccuggaa

SEQ ID NO: 328125 - RNA, 24 nt, Human
agugggaagagggugguucccugg

SEQ ID NO: 328126 - RNA, 32 nt, Human
agugggaagcagucucuuccuggucugaacuc

SEQ ID NO: 328127 - RNA, 32 nt, Human
agugggaaggagaggagugagugaaguagccu

SEQ ID NO: 328128 - RNA, 32 nt, Human
agugggaagucaggaggguucugcaguaucug

SEQ ID NO: 328129 - RNA, 32 nt, Human
agugggaauuagaaagcuggagugcuucuuca

SEQ ID NO: 328130 - RNA, 22 nt, Human
agugggacaagaagacugcuga

SEQ ID NO: 328131 - RNA, 32 nt, Human
agugggacacuggcccugggaaccaggcugag

SEQ ID NO: 328132 - RNA, 32 nt, Human
agugggacccuccaguccugcugggggugugu

SEQ ID NO: 328133 - RNA, 32 nt, Human
agugggaccggcuuccagccuguggcggugcc

SEQ ID NO: 328134 - RNA, 32 nt, Human
agugggaccuugacuggagaaacuccacgauc

SEQ ID NO: 328135 - RNA, 22 nt, Human
agugggacgcuggccacggcca

SEQ ID NO: 328136 - RNA, 21 nt, Human
agugggacugaggccgcacca

SEQ ID NO: 328137 - RNA, 32 nt, Human
agugggacugcuggcccugacucugcagccca

SEQ ID NO: 328138 - RNA, 32 nt, Human
agugggacuggaaacugcucaccuaugucaug

SEQ ID NO: 328139 - RNA, 32 nt, Human
agugggagagaagaggagagggcuuggauaga

SEQ ID NO: 328140 - RNA, 32 nt, Human
agugggagagaccucagaucaaagccugcugg

SEQ ID NO: 328141 - RNA, 32 nt, Human
agugggagcaauggcacugacacugcuagagg

SEQ ID NO: 328142 - RNA, 32 nt, Human
agugggagcaggagcuuggaggugagcacagg

SEQ ID NO: 328143 - RNA, 32 nt, Human
agugggagcucaggucagggaggaggcagggg

SEQ ID NO: 328144 - RNA, 32 nt, Human
agugggaggaagcagagggagggacugggcag

SEQ ID NO: 328145 - RNA, 32 nt, Human
agugggaggagaaaauucuccaggugaauggg

SEQ ID NO: 328146 - RNA, 32 nt, Human
agugggaggaggggagaaggggagacaaaacc

SEQ ID NO: 328147 - RNA, 32 nt, Human
agugggaggauagcuugggcccaggagaugga

SEQ ID NO: 328148 - RNA, 32 nt, Human
agugggagguaauggaaaguagcaaguuaugu

SEQ ID NO: 328149 - RNA, 32 nt, Human
agugggaggucaaacaugggccuucggcauug

SEQ ID NO: 328150 - RNA, 32 nt, Human
agugggagguugugcauggaggccagugaaag

SEQ ID NO: 328151 - RNA, 32 nt, Human
agugggaugaugcagugaccacacagaauguc

SEQ ID NO: 328152 - RNA, 32 nt, Human
agugggauuacaggcaccugucaccacgccug

SEQ ID NO: 328153 - RNA, 32 nt, Human
agugggauuccucucugcaaagcugcuggcuu

SEQ ID NO: 328154 - RNA, 23 nt, Human
agugggauuuguagauuugcugg

SEQ ID NO: 328155 - RNA, 32 nt, Human
agugggcaaaggcuucccauggguggaggugg

SEQ ID NO: 328156 - RNA, 32 nt, Human
agugggcaccugcacuaccacuuuuuagagga

SEQ ID NO: 328157 - RNA, 32 nt, Human
agugggcagcacauaguaggugcucaggaaac

SEQ ID NO: 328158 - RNA, 32 nt, Human
agugggcagcauaaagucacucauuucuuacc

SEQ ID NO: 328159 - RNA, 19 nt, Human
agugggcagcuaauuuuac

SEQ ID NO: 328160 - RNA, 32 nt, Human
agugggcagcugggccccagaacugugccugg

SEQ ID NO: 328161 - RNA, 32 nt, Human
agugggcagggugggcagcaggggcccucuug

SEQ ID NO: 328162 - RNA, 32 nt, Human
agugggcaguagaacccaggagaggaagaaag

SEQ ID NO: 328163 - RNA, 32 nt, Human
agugggcaguguccacguuuuuggaaaaugua

SEQ ID NO: 328164 - RNA, 32 nt, Human
agugggcaucaggccugggacacugcucuccu

SEQ ID NO: 328165 - RNA, 32 nt, Human
agugggcauggggucccaggagggauuccgga

SEQ ID NO: 328166 - RNA, 32 nt, Human
agugggccaagguuugggacagguugacugug

SEQ ID NO: 328167 - RNA, 32 nt, Human
agugggccaucuuuaagcuucucagcuuccuu

SEQ ID NO: 328168 - RNA, 32 nt, Human
agugggcccaagcagacaaccuugucccaacc

SEQ ID NO: 328169 - RNA, 32 nt, Human
agugggcccucaguaaauaccuggaggaaugu

SEQ ID NO: 328170 - RNA, 32 nt, Human
agugggcccugcccaggcugagcugcuucagg

SEQ ID NO: 328171 - RNA, 32 nt, Human
agugggcccuggaagggagggggcaagccugg

SEQ ID NO: 328172 - RNA, 32 nt, Human
agugggccuccuggggauggggugguacacug

SEQ ID NO: 328173 - RNA, 32 nt, Human
agugggccugccguucaugggucucuagggau

SEQ ID NO: 328174 - RNA, 22 nt, Human
agugggccugggcaggcagcca

SEQ ID NO: 328175 - RNA, 32 nt, Human
agugggccuucuguucaacuuacccuccaccg

SEQ ID NO: 328176 - RNA, 32 nt, Human
agugggcgacucugcucucuauuuaaaagcgu

SEQ ID NO: 328177 - RNA, 32 nt, Human
agugggcgccuguaaucccagcuacucaggag

SEQ ID NO: 328178 - RNA, 32 nt, Human
agugggcgcggaucugguguggggaaggcggc

SEQ ID NO: 328179 - RNA, 32 nt, Human
agugggcucacggaguucuagcucagguccaa

SEQ ID NO: 328180 - RNA, 32 nt, Human
agugggcucagaggaggaaagggacuuacuug

SEQ ID NO: 328181 - RNA, 32 nt, Human
agugggcucauggguucuuuaaguucccccuc

SEQ ID NO: 328182 - RNA, 32 nt, Human
agugggcucuaugggguggucugcacccaucu

SEQ ID NO: 328183 - RNA, 32 nt, Human
agugggcucugggguuccaccaaccguagcug

SEQ ID NO: 328184 - RNA, 32 nt, Human
agugggcugcacuccuuucucuccaaccaggg

SEQ ID NO: 328185 - RNA, 32 nt, Human
agugggcuggccaggccaccugcaccagggag

SEQ ID NO: 328186 - RNA, 31 nt, Human
agugggcugggcgucucagccgguguguggg

SEQ ID NO: 328187 - RNA, 32 nt, Human
agugggcuucucugggagcucuccaguggcac

SEQ ID NO: 328188 - RNA, 32 nt, Human
agugggcuugugugugaugugcagucccgaag

SEQ ID NO: 328189 - RNA, 32 nt, Human
agugggcuuuucguuguccaugggcuuuuucg

SEQ ID NO: 328190 - RNA, 32 nt, Human
aguggggaaagcgggccagggggcgggagugg

SEQ ID NO: 328191 - RNA, 32 nt, Human
aguggggaagcugaagcucaggcaucaggauc

SEQ ID NO: 328192 - RNA, 32 nt, Human
aguggggaagugaacaaaucaccacggaacuc

SEQ ID NO: 328193 - RNA, 32 nt, Human
aguggggacagcuucuuccuagugaggaaaau

SEQ ID NO: 328194 - RNA, 32 nt, Human
aguggggacuagugaaugacuugaccugugac

SEQ ID NO: 328195 - RNA, 32 nt, Human
aguggggagagacggcaggugcagugauggcu

SEQ ID NO: 328196 - RNA, 32 nt, Human
aguggggagagcaguggcagugggaggcaucu

SEQ ID NO: 328197 - RNA, 23 nt, Human
aguggggagauuuccacugugga

SEQ ID NO: 328198 - RNA, 32 nt, Human
aguggggaggaguggcuggggcugugcgcucc

SEQ ID NO: 328199 - RNA, 32 nt, Human
aguggggagggaaaaacuccuccuugaagauu

SEQ ID NO: 328200 - RNA, 32 nt, Human
aguggggaguggagggcagaggcccuuugguc

SEQ ID NO: 328201 - RNA, 23 nt, Human
aguggggaucucaagcucuugga

SEQ ID NO: 328202 - RNA, 32 nt, Human
aguggggaucuuccccaggaggguucuuacca

SEQ ID NO: 328203 - RNA, 32 nt, Human
aguggggauggagaaagggcagaggaagagac

SEQ ID NO: 328204 - RNA, 32 nt, Human
aguggggcaccaguccuguagcaaagaggcac

SEQ ID NO: 328205 - RNA, 32 nt, Human
aguggggcaucgucugucuugccuugucacuc

SEQ ID NO: 328206 - RNA, 23 nt, Human
aguggggcaugucuauacuuaga

SEQ ID NO: 328207 - RNA, 32 nt, Human
aguggggccagaccucuuuacacacacauucc

SEQ ID NO: 328208 - RNA, 32 nt, Human
aguggggcccaggggcagggagggaggaaggg

SEQ ID NO: 328209 - RNA, 32 nt, Human
aguggggccccugaucuauauucaaaguguca

SEQ ID NO: 328210 - RNA, 32 nt, Human
aguggggccucuucaucagcagccugccuggc

SEQ ID NO: 328211 - RNA, 32 nt, Human
aguggggcgaggaaagcgggaugggaacaagu

SEQ ID NO: 328212 - RNA, 32 nt, Human
aguggggcgggguggcgggggagaagcagccg

SEQ ID NO: 328213 - RNA, 32 nt, Human
aguggggcuauaaacuccuuccucauaggaaa

SEQ ID NO: 328214 - RNA, 32 nt, Human
aguggggcuggcugugggcccccugugcuguu

SEQ ID NO: 328215 - RNA, 31 nt, Human
aguggggcugggaccuggugggugaaccuga

SEQ ID NO: 328216 - RNA, 32 nt, Human
aguggggcuguaugaauccagguccaguuugu

SEQ ID NO: 328217 - RNA, 32 nt, Human
aguggggcugugggcucagagcucaggagucg

SEQ ID NO: 328218 - RNA, 32 nt, Human
aguggggcuucaugaccaugugcaucagaauu

SEQ ID NO: 328219 - RNA, 32 nt, Human
agugggggaaacacuuuucacugcagaguuug

SEQ ID NO: 328220 - RNA, 32 nt, Human
agugggggaaggcaggcuguugccaugguggc

SEQ ID NO: 328221 - RNA, 32 nt, Human
agugggggagagagaggagaccaggacagcug

SEQ ID NO: 328222 - RNA, 21 nt, Human
agugggggagagcaggcuggc

SEQ ID NO: 328223 - RNA, 32 nt, Human
agugggggagcacgggccuucuacaccacaug

SEQ ID NO: 328224 - RNA, 32 nt, Human
agugggggaggcggcggcagcguuaagugaga

SEQ ID NO: 328225 - RNA, 32 nt, Human
agugggggagguggagggggaggcaggcacca

SEQ ID NO: 328226 - RNA, 32 nt, Human
agugggggauggaagagaguaccagguggucc

SEQ ID NO: 328227 - RNA, 32 nt, Human
agugggggcacauguacugcaggugugcagug

SEQ ID NO: 328228 - RNA, 32 nt, Human
agugggggcccaaacccaguuuccuucucauu

SEQ ID NO: 328229 - RNA, 32 nt, Human
agugggggccugugggguggggugggauugag

SEQ ID NO: 328230 - RNA, 32 nt, Human
agugggggcuguacuggggacugcucggauga

SEQ ID NO: 328231 - RNA, 23 nt, Human
aguggggggcggaagugcagugg

SEQ ID NO: 328232 - RNA, 32 nt, Human
agugggggucagccaggagcccagggagucac

SEQ ID NO: 328233 - RNA, 32 nt, Human
agugggggucucucaugcucuguuguagggga

SEQ ID NO: 328234 - RNA, 32 nt, Human
agugggggucugccaugagggcggccgagcag

SEQ ID NO: 328235 - RNA, 32 nt, Human
agugggggugcagagcuccugagaggacagcu

SEQ ID NO: 328236 - RNA, 32 nt, Human
agugggguaguagaugguaacagagauguaga

SEQ ID NO: 328237 - RNA, 32 nt, Human
aguggggucagggcugagaggagaaggaggga

SEQ ID NO: 328238 - RNA, 32 nt, Human
aguggggucgagagagaaaguagcacgcccgc

SEQ ID NO: 328239 - RNA, 32 nt, Human
aguggggugaugugccuuaaagcaucagacac

SEQ ID NO: 328240 - RNA, 32 nt, Human
agugggguggccuccccucugucugccuggug

SEQ ID NO: 328241 - RNA, 32 nt, Human
aguggggugggcacagaugagcagaguggaug

SEQ ID NO: 328242 - RNA, 32 nt, Human
agugggguggugcuggggaagguugacucgcu

SEQ ID NO: 328243 - RNA, 32 nt, Human
aguggggugguuauguuuccaugguuaccaug

SEQ ID NO: 328244 - RNA, 22 nt, Human
agugggguucgaagccacacca

SEQ ID NO: 328245 - RNA, 32 nt, Human
agugggguugcagagaugggggagacucaagu

SEQ ID NO: 328246 - RNA, 32 nt, Human
agugggguugggggcggggugggcaggguucu

SEQ ID NO: 328247 - RNA, 23 nt, Human
agugggucaaaggaggccuggaa

SEQ ID NO: 328248 - RNA, 32 nt, Human
agugggucaggggagaaggaaaagaggucaac

SEQ ID NO: 328249 - RNA, 32 nt, Human
agugggucaguggucugugccaaccaaacgau

SEQ ID NO: 328250 - RNA, 32 nt, Human
agugggucaugagaagaugaacacugaagucu

SEQ ID NO: 328251 - RNA, 32 nt, Human
agugggucccuuccuuucuccuuuccucucua

SEQ ID NO: 328252 - RNA, 32 nt, Human
aguggguccuggagacccuaaguggccuauga

SEQ ID NO: 328253 - RNA, 32 nt, Human
agugggucuccagugagagaaaugccuaugaa

SEQ ID NO: 328254 - RNA, 32 nt, Human
agugggucugacuugaggucugugaugugacc

SEQ ID NO: 328255 - RNA, 32 nt, Human
agugggucugagaacagucccugcccccaagu

SEQ ID NO: 328256 - RNA, 32 nt, Human
agugggucuuggaccagggcaagugcaucuuu

SEQ ID NO: 328257 - RNA, 32 nt, Human
agugggugagaaugaaaacuugagacucccaa

SEQ ID NO: 328258 - RNA, 32 nt, Human
agugggugaggacaggcuucaggcugucucuu

SEQ ID NO: 328259 - RNA, 32 nt, Human
agugggugccuguaaucccagcuacuugggag

SEQ ID NO: 328260 - RNA, 32 nt, Human
agugggugccuguagucccagcuacuugggag

SEQ ID NO: 328261 - RNA, 32 nt, Human
agugggugccuugcuuuguucuucccaagcug

SEQ ID NO: 328262 - RNA, 32 nt, Human
agugggugcucagcuggucugcacugaacgca

SEQ ID NO: 328263 - RNA, 32 nt, Human
agugggugcuguucccgaauguacccauucga

SEQ ID NO: 328264 - RNA, 32 nt, Human
aguggguggaagaggagaagagggaccuggaa

SEQ ID NO: 328265 - RNA, 32 nt, Human
aguggguggccugggaaaacgcacuuguggcc

SEQ ID NO: 328266 - RNA, 32 nt, Human
aguggguggggaaaggaaguggcuuugaggca

SEQ ID NO: 328267 - RNA, 31 nt, Human
aguggguggguggggugggguggggcaagug

SEQ ID NO: 328268 - RNA, 32 nt, Human
agugggugguggggcccuggggccagugcuca

SEQ ID NO: 328269 - RNA, 32 nt, Human
agugggugucaguauggaugugucugaaugug

SEQ ID NO: 328270 - RNA, 32 nt, Human
agugggugucuccucaagccuuaccuuucuca

SEQ ID NO: 328271 - RNA, 17 nt, Human
agugggugucugaacug

SEQ ID NO: 328272 - RNA, 32 nt, Human
agugggugucugaacugaggggcaguugucaa

SEQ ID NO: 328273 - RNA, 32 nt, Human
aguggguucucugcaaguucugaggcccaggg

SEQ ID NO: 328274 - RNA, 27 nt, Human
aguggguugauuacugugaaauucuca

SEQ ID NO: 328275 - RNA, 32 nt, Human
aguggguugcaccuccaaccagcaggcuccgc

SEQ ID NO: 328276 - RNA, 32 nt, Human
aguggguuugcuaucaaugaaaugcuacaaau

SEQ ID NO: 328277 - RNA, 32 nt, Human
aguggguuuguaguaaugagugcugcuguaaa

SEQ ID NO: 328278 - RNA, 32 nt, Human
agugguaacugggaacaauuuuccccaauaca

SEQ ID NO: 328279 - RNA, 32 nt, Human
agugguaaguugcccucccucuccuggccuua

SEQ ID NO: 328280 - RNA, 32 nt, Human
agugguaauguaauaccuuaccucacagguuu

SEQ ID NO: 328281 - RNA, 32 nt, Human
agugguacuaccugguaaaagaauugguucug

SEQ ID NO: 328282 - RNA, 22 nt, Human
agugguagaauaaaggcaggau

SEQ ID NO: 328283 - RNA, 32 nt, Human
agugguagcgcugucuccuggugaaggaguau

SEQ ID NO: 328284 - RNA, 32 nt, Human
agugguaggaagagcauggguuagggggaugg

SEQ ID NO: 328285 - RNA, 32 nt, Human
agugguaggagaguugacaucuugccaagggc

SEQ ID NO: 328286 - RNA, 32 nt, Human
agugguaggauuacaggcgugagccacugcac

SEQ ID NO: 328287 - RNA, 23 nt, Human
agugguagucccagcuacucagg

SEQ ID NO: 328288 - RNA, 32 nt, Human
agugguaucagcugcuccuccucuccuaggag

SEQ ID NO: 328289 - RNA, 32 nt, Human
agugguaugagcauagcuuccucaaauuccug

SEQ ID NO: 328290 - RNA, 32 nt, Human
aguggucacaccucaucuauuuacuguuacuc

SEQ ID NO: 328291 - RNA, 32 nt, Human
aguggucaccccaugggacaggcacagcuacu

SEQ ID NO: 328292 - RNA, 32 nt, Human
aguggucacugcaaccuccaucucccuggcuc

SEQ ID NO: 328293 - RNA, 32 nt, Human
aguggucagaagcagccagcagugaggaaucc

SEQ ID NO: 328294 - RNA, 32 nt, Human
aguggucagaugcucacagucuuauggaggag

SEQ ID NO: 328295 - RNA, 32 nt, Human
aguggucagccagcacugucccugccuguccc

SEQ ID NO: 328296 - RNA, 32 nt, Human
aguggucagccccuggggcgcaaacauucccc

SEQ ID NO: 328297 - RNA, 32 nt, Human
aguggucaggcagaaggugcccuggugagagc

SEQ ID NO: 328298 - RNA, 32 nt, Human
aguggucaggcaggagaggcagucggaugcag

SEQ ID NO: 328299 - RNA, 32 nt, Human
aguggucagggcugaagucggagaagcauagg

SEQ ID NO: 328300 - RNA, 32 nt, Human
aguggucaucuauaagcaaaggagagaagccu

SEQ ID NO: 328301 - RNA, 32 nt, Human
agugguccaaagccuucagccuagauggugca

SEQ ID NO: 328302 - RNA, 32 nt, Human
aguggucccggcuugcgggcagucuccccucu

SEQ ID NO: 328303 - RNA, 32 nt, Human
agugguccuagugccgcaucagauccaggugg

SEQ ID NO: 328304 - RNA, 32 nt, Human
agugguccuggacuacagacucuguugccuug

SEQ ID NO: 328305 - RNA, 32 nt, Human
agugguccuuccucucccaauguggccaugug

SEQ ID NO: 328306 - RNA, 21 nt, Human
aguggucuaagagaccuggaa

SEQ ID NO: 328307 - RNA, 32 nt, Human
aguggucuagguuaaggagggaggaggguuga

SEQ ID NO: 328308 - RNA, 32 nt, Human
aguggucuccuuagacugaauucaugugaacu

SEQ ID NO: 328309 - RNA, 32 nt, Human
aguggucuguuuaaaugaaaaauguuaaaaga

SEQ ID NO: 328310 - RNA, 32 nt, Human
aguggugaaaggaagcaagaagaaaagggguu

SEQ ID NO: 328311 - RNA, 32 nt, Human
aguggugaacagcuccauuucugugcacaugu

SEQ ID NO: 328312 - RNA, 32 nt, Human
aguggugacucuggacaaggagacucccguag

SEQ ID NO: 328313 - RNA, 32 nt, Human
aguggugacuggagagagagcugggaggggca

SEQ ID NO: 328314 - RNA, 32 nt, Human
aguggugagacaggguauuucuguguuguucu

SEQ ID NO: 328315 - RNA, 32 nt, Human
aguggugcaaacacaucucauuguagcuucaa

SEQ ID NO: 328316 - RNA, 32 nt, Human
aguggugcagagcacuagccagaugcagugca

SEQ ID NO: 328317 - RNA, 32 nt, Human
aguggugccaucauagcucacuguagccucga

SEQ ID NO: 328318 - RNA, 32 nt, Human
aguggugccaugaaguagagcagugggcuuug

SEQ ID NO: 328319 - RNA, 32 nt, Human
aguggugccaugaauuaaagaugccacuucgg

SEQ ID NO: 328320 - RNA, 32 nt, Human
aguggugcccguggaaagagggagaaagagaa

SEQ ID NO: 328321 - RNA, 32 nt, Human
aguggugccuguaaucccagcaguuugggagg

SEQ ID NO: 328322 - RNA, 32 nt, Human
aguggugcgauuucggcucacuucaaacuccg

SEQ ID NO: 328323 - RNA, 32 nt, Human
aguggugcugcgaggggaaggaaaagggaggc

SEQ ID NO: 328324 - RNA, 32 nt, Human
aguggugcuguccauggaaucaggccacagca

SEQ ID NO: 328325 - RNA, 32 nt, Human
aguggugcuuuacuuagcccuguggacaacuu

SEQ ID NO: 328326 - RNA, 20 nt, Human
aguggugcuuucccgaaucu

SEQ ID NO: 328327 - RNA, 32 nt, Human
agugguggagccaagauuugaacccagcuaga

SEQ ID NO: 328328 - RNA, 32 nt, Human
agugguggagccaggacucaaagccagucuag

SEQ ID NO: 328329 - RNA, 32 nt, Human
agugguggagugaggacaggggagggccggcc

SEQ ID NO: 328330 - RNA, 32 nt, Human
agugguggcacacaccugucaucccagcuacu

SEQ ID NO: 328331 - RNA, 32 nt, Human
agugguggcaggcaccuguagucccagcuacu

SEQ ID NO: 328332 - RNA, 32 nt, Human
agugguggcaguggcucccagcacuuugggag

SEQ ID NO: 328333 - RNA, 32 nt, Human
agugguggcauaggccuguaauuccagcuacu

SEQ ID NO: 328334 - RNA, 32 nt, Human
agugguggcaugugccuguaaucccagcuacu

SEQ ID NO: 328335 - RNA, 32 nt, Human
agugguggccagaauuagauaucuuuaaagaa

SEQ ID NO: 328336 - RNA, 32 nt, Human
agugguggcggguaccuguaaucccagcuacu

SEQ ID NO: 328337 - RNA, 32 nt, Human
agugguggcucacgccuguaaugccagcacuc

SEQ ID NO: 328338 - RNA, 32 nt, Human
agugguggcucaugccuguaaucccagcacuu

SEQ ID NO: 328339 - RNA, 32 nt, Human
agugguggcucgcaccuguaaucccagggacu

SEQ ID NO: 328340 - RNA, 32 nt, Human
agugguggcugacaccuguaaucccagcauuu

SEQ ID NO: 328341 - RNA, 32 nt, Human
agugguggcuuacaccugugaucccagcacuu

SEQ ID NO: 328342 - RNA, 32 nt, Human
aguggugggaccccuccccgaccuggcggggg

SEQ ID NO: 328343 - RNA, 32 nt, Human
aguggugggacucagcccagacugcccugggg

SEQ ID NO: 328344 - RNA, 32 nt, Human
aguggugggaggaauagagggggacagucugu

SEQ ID NO: 328345 - RNA, 32 nt, Human
aguggugggaggauggcuugagccggggagga

SEQ ID NO: 328346 - RNA, 32 nt, Human
aguggugggaggcagcuguggugcaggagcug

SEQ ID NO: 328347 - RNA, 32 nt, Human
aguggugggaucacaggcgugagccaccgugc

SEQ ID NO: 328348 - RNA, 19 nt, Human
aguggugggaucagagcca

SEQ ID NO: 328349 - RNA, 32 nt, Human
aguggugggauuacaagcaugagccacuguac

SEQ ID NO: 328350 - RNA, 32 nt, Human
aguggugggauuacagacgugagccacugcag

SEQ ID NO: 328351 - RNA, 19 nt, Human
aguggugggauuacaggug

SEQ ID NO: 328352 - RNA, 32 nt, Human
aguggugggauuacaggugugagccaccgcgu

SEQ ID NO: 328353 - RNA, 32 nt, Human
aguggugggauuauaggcaugagccaccgcac

SEQ ID NO: 328354 - RNA, 32 nt, Human
aguggugggcaggccaguggcagggccggccc

SEQ ID NO: 328355 - RNA, 32 nt, Human
aguggugggggagggggccagagaggcggcuc

SEQ ID NO: 328356 - RNA, 32 nt, Human
agugguggggucucuuucugucuucccuucuu

SEQ ID NO: 328357 - RNA, 32 nt, Human
aguggugggugaagcaggggaggcuccucuau

SEQ ID NO: 328358 - RNA, 32 nt, Human
aguggugggugguaaggacugucuccuauuag

SEQ ID NO: 328359 - RNA, 32 nt, Human
agugguggguuuauagggggaggaggaggcag

SEQ ID NO: 328360 - RNA, 32 nt, Human
agugguggucccacccacccucuagcuggcca

SEQ ID NO: 328361 - RNA, 32 nt, Human
agugguggugcaugccuguaaucccagcuacu

SEQ ID NO: 328362 - RNA, 32 nt, Human
aguggugguggccagcgugcagugagcuggcc

SEQ ID NO: 328363 - RNA, 32 nt, Human
aguggugguggcugccuguaaucccagcuacu

SEQ ID NO: 328364 - RNA, 32 nt, Human
agugguggugggcaccuguaaucccaguuacu

SEQ ID NO: 328365 - RNA, 32 nt, Human
agugguggugugcaccuguaguaaucccagcu

SEQ ID NO: 328366 - RNA, 32 nt, Human
agugguguaggguauacagagagguggguagu

SEQ ID NO: 328367 - RNA, 32 nt, Human
aguggugucauucuccagaaccagguguggau

SEQ ID NO: 328368 - RNA, 32 nt, Human
aguggugugaagagaagugaaauguugugccu

SEQ ID NO: 328369 - RNA, 32 nt, Human
aguggugugguguuuggagacagucucugaau

SEQ ID NO: 328370 - RNA, 32 nt, Human
agugguguuggcaucagcuugggcaggugugc

SEQ ID NO: 328371 - RNA, 32 nt, Human
agugguuaaaacuuguauucaugugaaccuuu

SEQ ID NO: 328372 - RNA, 32 nt, Human
agugguuaccuauaccuagcauaguacaauca

SEQ ID NO: 328373 - RNA, 32 nt, Human
agugguuacuauccucugccuuccucuccucc

SEQ ID NO: 328374 - RNA, 32 nt, Human
agugguucacagaaaacagcaaauauccccag

SEQ ID NO: 328375 - RNA, 32 nt, Human
agugguucagcuuucccagcugaucugaagcu

SEQ ID NO: 328376 - RNA, 23 nt, Human
agugguucaugccuguaauccca

SEQ ID NO: 328377 - RNA, 32 nt, Human
agugguucuacaaucuauuuauuggacauguc

SEQ ID NO: 328378 - RNA, 32 nt, Human
agugguucucagaguguguuuccagagcagca

SEQ ID NO: 328379 - RNA, 32 nt, Human
agugguucugcagcuugaguccucugguuuua

SEQ ID NO: 328380 - RNA, 32 nt, Human
agugguucugucccccagauguggaccugucg

SEQ ID NO: 328381 - RNA, 32 nt, Human
agugguugcccaggccuaguuucaguggcaga

SEQ ID NO: 328382 - RNA, 32 nt, Human
agugguuggccaggcugcaguauaacugaagc

SEQ ID NO: 328383 - RNA, 32 nt, Human
agugguuucccuggaaguggcagcagcaguga

SEQ ID NO: 328384 - RNA, 32 nt, Human
agugguuugagaggcugggaggguugagggga

SEQ ID NO: 328385 - RNA, 32 nt, Human
agugguuuguccaggcuccaguacagauggcu

SEQ ID NO: 328386 - RNA, 32 nt, Human
agugguuuuccucuuggcagauucucaaacag

SEQ ID NO: 328387 - RNA, 32 nt, Human
agugguuuugaguuacuucauggaacuuggac

SEQ ID NO: 328388 - RNA, 32 nt, Human
agugguuuuucauaauggaugcauaaugacug

SEQ ID NO: 328389 - RNA, 32 nt, Human
aguguaacauccucucugguccuuuucugugu

SEQ ID NO: 328390 - RNA, 32 nt, Human
aguguaacauucucuccacccagcuuauaaaa

SEQ ID NO: 328391 - RNA, 32 nt, Human
aguguaagaaaaugauugcuuaucaguaguau

SEQ ID NO: 328392 - RNA, 32 nt, Human
aguguaagggaguagggggugcagugggagau

SEQ ID NO: 328393 - RNA, 32 nt, Human
aguguaagugcuggacugcaggcugcagugau

SEQ ID NO: 328394 - RNA, 32 nt, Human
aguguaaguucagacuuaguaauaaaagaaaa

SEQ ID NO: 328395 - RNA, 32 nt, Human
aguguaaguuguuuuugcuguuaaauuggaua

SEQ ID NO: 328396 - RNA, 32 nt, Human
aguguaauacguauauuuuaacaaaccugucc

SEQ ID NO: 328397 - RNA, 32 nt, Human
aguguaaugaacacaggcaugaagaugucugu

SEQ ID NO: 328398 - RNA, 32 nt, Human
aguguacaaacccauggcugggcucagcuuca

SEQ ID NO: 328399 - RNA, 19 nt, Human
aguguacaagacugugcug

SEQ ID NO: 328400 - RNA, 32 nt, Human
aguguacaccacugugccugcuuugaauccuu

SEQ ID NO: 328401 - RNA, 31 nt, Human
aguguacaccagguuuuuacauucuuauuuu

SEQ ID NO: 328402 - RNA, 32 nt, Human
aguguacagaaaacaguaaaucccuucuuuac

SEQ ID NO: 328403 - RNA, 32 nt, Human
aguguacagacaccugccuucuuuaaggauga

SEQ ID NO: 328404 - RNA, 32 nt, Human
aguguacauuucuauaaauagaugcuguguau

SEQ ID NO: 328405 - RNA, 32 nt, Human
aguguaccagcuuuuuccuucccuuuuagaaa

SEQ ID NO: 328406 - RNA, 32 nt, Human
aguguaccccauuugguuucaccaggaaccca

SEQ ID NO: 328407 - RNA, 32 nt, Human
aguguaccuuggagagcuauccacucaggccc

SEQ ID NO: 328408 - RNA, 32 nt, Human
aguguacgaggcagacggcggcagugcggcuu

SEQ ID NO: 328409 - RNA, 32 nt, Human
aguguacugaggguacuggccuagccaugugg

SEQ ID NO: 328410 - RNA, 32 nt, Human
aguguagaaaaacacuagauagugugagaggu

SEQ ID NO: 328411 - RNA, 32 nt, Human
aguguagaaaaauaacaccguggugccaguag

SEQ ID NO: 328412 - RNA, 32 nt, Human
aguguagaaacaaguuuccaccuuucuaaaac

SEQ ID NO: 328413 - RNA, 32 nt, Human
aguguagaccagacugccucucucagauaugu

SEQ ID NO: 328414 - RNA, 32 nt, Human
aguguagccuggggcugguguugccugccucc

SEQ ID NO: 328415 - RNA, 32 nt, Human
aguguagcgcccccucccucuuucggcuggug

SEQ ID NO: 328416 - RNA, 32 nt, Human
aguguaggaggccaggagcuuggggcuucgug

SEQ ID NO: 328417 - RNA, 32 nt, Human
aguguagggauuacaggcgugagccacugugc

SEQ ID NO: 328418 - RNA, 32 nt, Human
aguguaguuauacauuuuguuuuggauauuua

SEQ ID NO: 328419 - RNA, 32 nt, Human
aguguaguugacugaaaacuacaguuguaaua

SEQ ID NO: 328420 - RNA, 32 nt, Human
aguguauauacauguaucaaaaagucacauug

SEQ ID NO: 328421 - RNA, 32 nt, Human
aguguauaucagaaaagggaaguugugccuuu

SEQ ID NO: 328422 - RNA, 32 nt, Human
aguguauauuauagcugcauugcagguuucag

SEQ ID NO: 328423 - RNA, 32 nt, Human
aguguauauuccaugaagacaaaauagaagau

SEQ ID NO: 328424 - RNA, 32 nt, Human
aguguaucaaagaauucagacaggcuucuguu

SEQ ID NO: 328425 - RNA, 32 nt, Human
aguguaucacacaaaccaaucuuauaagggua

SEQ ID NO: 328426 - RNA, 31 nt, Human
aguguaucgacaaucugucagccgacacagg

SEQ ID NO: 328427 - RNA, 31 nt, Human
aguguaucgacaaucugucagccgacgcagg

SEQ ID NO: 328428 - RNA, 32 nt, Human
aguguaugagagggcccugccugcugcaucuu

SEQ ID NO: 328429 - RNA, 32 nt, Human
aguguaugcauguguggguguguucaugcaca

SEQ ID NO: 328430 - RNA, 31 nt, Human
aguguaugccuuuuccuucaugcagaauuuu

SEQ ID NO: 328431 - RNA, 32 nt, Human
aguguaugcuuuuaaaaagccccacacaacaa

SEQ ID NO: 328432 - RNA, 32 nt, Human
aguguauggaaauaaauguaucauagaaaugu

SEQ ID NO: 328433 - RNA, 32 nt, Human
aguguauuaacagugcaugcuuuuacuuugua

SEQ ID NO: 328434 - RNA, 32 nt, Human
aguguauucagaaauccaaguuggugucauac

SEQ ID NO: 328435 - RNA, 32 nt, Human
aguguauuggcaaucaugcaguuaacauuuga

SEQ ID NO: 328436 - RNA, 32 nt, Human
aguguauuuaaagagcauuucaguuaacuuuu

SEQ ID NO: 328437 - RNA, 32 nt, Human
aguguauuucucagauuacaugacauuaguca

SEQ ID NO: 328438 - RNA, 32 nt, Human
agugucaaacagaggcugggugaccuccuguc

SEQ ID NO: 328439 - RNA, 32 nt, Human
agugucaacaguuaaagcagacgaaacgaagu

SEQ ID NO: 328440 - RNA, 32 nt, Human
agugucaagagaaaucaagagaugcuaaaagc

SEQ ID NO: 328441 - RNA, 32 nt, Human
agugucaagccugaaaccaagcaauaccguca

SEQ ID NO: 328442 - RNA, 19 nt, Human
agugucaaggaggcugcug

SEQ ID NO: 328443 - RNA, 32 nt, Human
agugucaagguguggaagggaccaagcgacca

SEQ ID NO: 328444 - RNA, 32 nt, Human
agugucacccaggcuggagugcagugauccac

SEQ ID NO: 328445 - RNA, 32 nt, Human
agugucaccccaccaucuuccauaagcuguga

SEQ ID NO: 328446 - RNA, 32 nt, Human
agugucaccucaguggaccagccugggggaag

SEQ ID NO: 328447 - RNA, 32 nt, Human
agugucaccucucccaagcacaugcuugcauc

SEQ ID NO: 328448 - RNA, 32 nt, Human
agugucacuucugcaguccuccucugcucacc

SEQ ID NO: 328449 - RNA, 32 nt, Human
agugucacuuuagaaagaacuaaggugcuagc

SEQ ID NO: 328450 - RNA, 32 nt, Human
agugucagcuacucggaaggcuguggugggaa

SEQ ID NO: 328451 - RNA, 32 nt, Human
agugucaggacauucccacaaaugcuggaaaa

SEQ ID NO: 328452 - RNA, 32 nt, Human
agugucagggcgggggccuggagcagcccgag

SEQ ID NO: 328453 - RNA, 32 nt, Human
agugucauacauauuuguucuccauugauaua

SEQ ID NO: 328454 - RNA, 32 nt, Human
agugucauuucuucagaacuccccuucauuga

SEQ ID NO: 328455 - RNA, 32 nt, Human
aguguccaagagccuguuuuugaaacacaagc

SEQ ID NO: 328456 - RNA, 32 nt, Human
aguguccagaagccacacaggguauaucucag

SEQ ID NO: 328457 - RNA, 32 nt, Human
aguguccagcacaaacaggcacucaaccacua

SEQ ID NO: 328458 - RNA, 32 nt, Human
aguguccaggcugaagucagggcccggccagc

SEQ ID NO: 328459 - RNA, 32 nt, Human
aguguccaguggcagccagaacaggugacaca

SEQ ID NO: 328460 - RNA, 32 nt, Human
aguguccaucaucugacucuucucggagucuc

SEQ ID NO: 328461 - RNA, 32 nt, Human
aguguccaucuuaaaaucauaacuagguaguu

SEQ ID NO: 328462 - RNA, 32 nt, Human
aguguccaugcauauacauacaugauacacau

SEQ ID NO: 328463 - RNA, 32 nt, Human
agugucccaacuagaauugaaaagcuugauau

SEQ ID NO: 328464 - RNA, 32 nt, Human
agugucccaagaaauggccuugacacacagga

SEQ ID NO: 328465 - RNA, 32 nt, Human
agugucccaccugggaccuguacaguccucag

SEQ ID NO: 328466 - RNA, 32 nt, Human
agugucccagcgggguugggagaggcauguga

SEQ ID NO: 328467 - RNA, 32 nt, Human
agugucccaggacccugcggugcaguagaggc

SEQ ID NO: 328468 - RNA, 32 nt, Human
aguguccccaacagcagaugaggcugggucuu

SEQ ID NO: 328469 - RNA, 32 nt, Human
aguguccccacugugccagauccaagagaagc

SEQ ID NO: 328470 - RNA, 22 nt, Human
aguguccccagccaacccccca

SEQ ID NO: 328471 - RNA, 32 nt, Human
aguguccccaggagguugggggaggagcaucu

SEQ ID NO: 328472 - RNA, 21 nt, Human
aguguccccaggaugcagcca

SEQ ID NO: 328473 - RNA, 32 nt, Human
aguguccccaggauggccagcuugaggaugaa

SEQ ID NO: 328474 - RNA, 21 nt, Human
aguguccccaucucacugcca

SEQ ID NO: 328475 - RNA, 32 nt, Human
aguguccccucuugggggucagagaugaggug

SEQ ID NO: 328476 - RNA, 32 nt, Human
agugucccucagacuuggauggaguuucuggg

SEQ ID NO: 328477 - RNA, 32 nt, Human
agugucccuccuggcccagcucagccagcauc

SEQ ID NO: 328478 - RNA, 32 nt, Human
agugucccugcaggacgccaaagcugaggcag

SEQ ID NO: 328479 - RNA, 32 nt, Human
agugucccuucccuagaaaggccugcccuccu

SEQ ID NO: 328480 - RNA, 32 nt, Human
aguguccgggggccccagccaagggacacauc

SEQ ID NO: 328481 - RNA, 29 nt, Human
aguguccgucugugucugugagggauugg

SEQ ID NO: 328482 - RNA, 32 nt, Human
aguguccuacugggagcucagucuguagugcc

SEQ ID NO: 328483 - RNA, 32 nt, Human
aguguccucagcuucauguccaguggauggca

SEQ ID NO: 328484 - RNA, 32 nt, Human
aguguccuccuagaaagagugggagagcagcu

SEQ ID NO: 328485 - RNA, 32 nt, Human
aguguccucugccccugauuucccaggagagu

SEQ ID NO: 328486 - RNA, 32 nt, Human
aguguccucuucaacuugcucucuuucccacu

SEQ ID NO: 328487 - RNA, 32 nt, Human
aguguccucuuucuagauugccagcucaugac

SEQ ID NO: 328488 - RNA, 32 nt, Human
aguguccugaaagcuuacauuuuccugagacc

SEQ ID NO: 328489 - RNA, 32 nt, Human
aguguccugccugguccucugugccugguggg

SEQ ID NO: 328490 - RNA, 32 nt, Human
aguguccuucgaggaacccacccggcuggccg

SEQ ID NO: 328491 - RNA, 32 nt, Human
agugucgaccaggcuggcaugagggaagaagg

SEQ ID NO: 328492 - RNA, 32 nt, Human
agugucgcgccuguaaucccagcacuuuggga

SEQ ID NO: 328493 - RNA, 32 nt, Human
agugucggacccugccuuccucccacuccaga

SEQ ID NO: 328494 - RNA, 32 nt, Human
agugucgguucugcaccccugcaggcucugua

SEQ ID NO: 328495 - RNA, 32 nt, Human
agugucuacaucuaccuucugccuucucucua

SEQ ID NO: 328496 - RNA, 32 nt, Human
agugucuacauugccaaccacaggccucucuu

SEQ ID NO: 328497 - RNA, 31 nt, Human
agugucuauaagcucaucacagccuagaguu

SEQ ID NO: 328498 - RNA, 24 nt, Human
agugucuauaauaaaacuaaacuu

SEQ ID NO: 328499 - RNA, 32 nt, Human
agugucucaaagugcugggauuacagguauga

SEQ ID NO: 328500 - RNA, 32 nt, Human
agugucucacugccaaaccucuugguuacgcu

SEQ ID NO: 328501 - RNA, 32 nt, Human
agugucucacugguuguagcuuucauggguuc

SEQ ID NO: 328502 - RNA, 32 nt, Human
agugucucauuuccuaacagaaucaucccauu

SEQ ID NO: 328503 - RNA, 32 nt, Human
agugucuccagcugugaacccaggaggucaag

SEQ ID NO: 328504 - RNA, 32 nt, Human
agugucucccuguguugcucaggcuggagugc

SEQ ID NO: 328505 - RNA, 32 nt, Human
agugucucuacaacuuugaauaaagggaaaug

SEQ ID NO: 328506 - RNA, 32 nt, Human
agugucucuagcugagccugaccucgggguuu

SEQ ID NO: 328507 - RNA, 32 nt, Human
agugucucuauuucggguaaaggaaagaccaa

SEQ ID NO: 328508 - RNA, 32 nt, Human
agugucucuccacuuagguguccucaguuccc

SEQ ID NO: 328509 - RNA, 32 nt, Human
agugucucugcaggcacucaggaagcuguucu

SEQ ID NO: 328510 - RNA, 32 nt, Human
agugucucuggacucgccccugagcuuccagg

SEQ ID NO: 328511 - RNA, 32 nt, Human
agugucugagcucaucuccaguucuggacucg

SEQ ID NO: 328512 - RNA, 32 nt, Human
agugucugcaccugaggcccucugugguaccu

SEQ ID NO: 328513 - RNA, 32 nt, Human
agugucugcagcugcugcccuucucccaggcc

SEQ ID NO: 328514 - RNA, 32 nt, Human
agugucugccaaaaucucugguguuuucucgg

SEQ ID NO: 328515 - RNA, 32 nt, Human
agugucugccaaggaacugaaauuuaaaauga

SEQ ID NO: 328516 - RNA, 32 nt, Human
agugucugcgucuaagagagcacuuuguugcu

SEQ ID NO: 328517 - RNA, 32 nt, Human
agugucugcucacuccccuuccacccucagcg

SEQ ID NO: 328518 - RNA, 32 nt, Human
agugucuggaguuucauuccaucccagggcuu

SEQ ID NO: 328519 - RNA, 32 nt, Human
agugucugggauugguagcucucuccaacugc

SEQ ID NO: 328520 - RNA, 32 nt, Human
agugucuggucugggagcucguuaacuaugcu

SEQ ID NO: 328521 - RNA, 32 nt, Human
agugucugugucuaagagagcacuuuguugcu

SEQ ID NO: 328522 - RNA, 32 nt, Human
agugucuguguguauaucuguacauagauaua

SEQ ID NO: 328523 - RNA, 32 nt, Human
agugucuguuauuagagaaacgagaaggaucc

SEQ ID NO: 328524 - RNA, 32 nt, Human
agugucuuaccugagagccuggcuggagaaga

SEQ ID NO: 328525 - RNA, 32 nt, Human
agugucuuccaucauggauucauuacagcuua

SEQ ID NO: 328526 - RNA, 32 nt, Human
agugucuuccuggucgcuucugaugcucauug

SEQ ID NO: 328527 - RNA, 32 nt, Human
agugucuugccagcaacauuccugcuagcaua

SEQ ID NO: 328528 - RNA, 32 nt, Human
agugucuuugccauuuuagaagguuccaguga

SEQ ID NO: 328529 - RNA, 32 nt, Human
agugucuuuuagcauucaugccagcuuuucuc

SEQ ID NO: 328530 - RNA, 32 nt, Human
agugugaaacuugcucuacucucugaaaugau

SEQ ID NO: 328531 - RNA, 32 nt, Human
agugugaacucccggcugcagacaguugugcu

SEQ ID NO: 328532 - RNA, 32 nt, Human
agugugaagaaucuccagcaggggaggcaaca

SEQ ID NO: 328533 - RNA, 32 nt, Human
agugugaagcaagguauccagugaagauucuc

SEQ ID NO: 328534 - RNA, 32 nt, Human
agugugaaggggcaagagcugccauuuaucua

SEQ ID NO: 328535 - RNA, 32 nt, Human
agugugacaggacugugauugugcuagaugua

SEQ ID NO: 328536 - RNA, 32 nt, Human
agugugacaguguccagccgguucugcagcac

SEQ ID NO: 328537 - RNA, 32 nt, Human
agugugaccagcccuggccaugcuugcugggu

SEQ ID NO: 328538 - RNA, 32 nt, Human
agugugaccccgcaguggcucucggugcuaga

SEQ ID NO: 328539 - RNA, 32 nt, Human
agugugaccugcucucuucccuccaggcugac

SEQ ID NO: 328540 - RNA, 32 nt, Human
agugugaccugcucuguucccucccugcugac

SEQ ID NO: 328541 - RNA, 32 nt, Human
agugugacugguguccaucuaagaagaaauua

SEQ ID NO: 328542 - RNA, 32 nt, Human
agugugagagaaggggucuccagggaagaguc

SEQ ID NO: 328543 - RNA, 32 nt, Human
agugugagaggaucgagccauugaaagcucau

SEQ ID NO: 328544 - RNA, 32 nt, Human
agugugagcaagauuugggucucuccagaccu

SEQ ID NO: 328545 - RNA, 32 nt, Human
agugugagcacacgcuggagugcagcguucca

SEQ ID NO: 328546 - RNA, 32 nt, Human
agugugagcagcuaacauccuaccucaaaugg

SEQ ID NO: 328547 - RNA, 32 nt, Human
agugugagccaccacacccagccagcaauaua

SEQ ID NO: 328548 - RNA, 32 nt, Human
agugugagccaccacacccagccuaauguaac

SEQ ID NO: 328549 - RNA, 32 nt, Human
agugugagccaccacaccuggccuggaaggaa

SEQ ID NO: 328550 - RNA, 32 nt, Human
agugugaggagaggguggcaucaggagcugcu

SEQ ID NO: 328551 - RNA, 21 nt, Human
agugugaggcggcccugacca

SEQ ID NO: 328552 - RNA, 32 nt, Human
agugugagggagcagggguguugauguuuguu

SEQ ID NO: 328553 - RNA, 32 nt, Human
agugugaggucagugggcuuauuccuccagcu

SEQ ID NO: 328554 - RNA, 32 nt, Human
agugugagugugaugggccaccggggcaagag

SEQ ID NO: 328555 - RNA, 32 nt, Human
agugugauaccuaauaaaguaccacuucucug

SEQ ID NO: 328556 - RNA, 32 nt, Human
agugugaugagcagcauagcaaacagauggau

SEQ ID NO: 328557 - RNA, 32 nt, Human
agugugauguaaugagagacuguguguguaug

SEQ ID NO: 328558 - RNA, 32 nt, Human
agugugcacccgggcuggagaaggcaggaggu

SEQ ID NO: 328559 - RNA, 32 nt, Human
agugugcagagcccaaaugaggggaccgcagg

SEQ ID NO: 328560 - RNA, 32 nt, Human
agugugcagggacacugucaagggauaaaguu

SEQ ID NO: 328561 - RNA, 32 nt, Human
agugugcagguguggaauagagcucaagaucu

SEQ ID NO: 328562 - RNA, 32 nt, Human
agugugcaugcaggcaggaggcagggaaaugu

SEQ ID NO: 328563 - RNA, 32 nt, Human
agugugcauggaggcccuccugugcuggggga

SEQ ID NO: 328564 - RNA, 32 nt, Human
agugugccaaucuauuuuuguaucagcauugg

SEQ ID NO: 328565 - RNA, 32 nt, Human
agugugccaccaggcugggcagggacaaccac

SEQ ID NO: 328566 - RNA, 32 nt, Human
agugugccagccugcuaaguccuguaagaaua

SEQ ID NO: 328567 - RNA, 32 nt, Human
agugugcccccaccaucccucauggccugccg

SEQ ID NO: 328568 - RNA, 32 nt, Human
agugugccuggcuuggcuucccuuccccaugg

SEQ ID NO: 328569 - RNA, 32 nt, Human
agugugcgaaucuacccugaccaaugggcuca

SEQ ID NO: 328570 - RNA, 32 nt, Human
agugugcgagugugugugcacauguuacaaag

SEQ ID NO: 328571 - RNA, 32 nt, Human
agugugcgauacucggggagcuggggcauguu

SEQ ID NO: 328572 - RNA, 32 nt, Human
agugugcucauccugaacuguuacuccaaauc

SEQ ID NO: 328573 - RNA, 32 nt, Human
agugugcugaguucucaguuccuggcccugug

SEQ ID NO: 328574 - RNA, 32 nt, Human
agugugcugaugaaguccucuauaagcacaag

SEQ ID NO: 328575 - RNA, 32 nt, Human
agugugcuguauuccucagaagugagggcauc

SEQ ID NO: 328576 - RNA, 32 nt, Human
agugugcuguccagagagaccugcugacccag

SEQ ID NO: 328577 - RNA, 32 nt, Human
agugugcuuggaugaucucuaagauggaauca

SEQ ID NO: 328578 - RNA, 32 nt, Human
agugugcuugggccagcucuccugccuguguc

SEQ ID NO: 328579 - RNA, 32 nt, Human
agugugcuuucugcuacacugcuaguuuucag

SEQ ID NO: 328580 - RNA, 32 nt, Human
agugugcuuuuuggaaagaugauggacuggga

SEQ ID NO: 328581 - RNA, 32 nt, Human
aguguggaaaacacaggacuuggcaaucacag

SEQ ID NO: 328582 - RNA, 32 nt, Human
aguguggaaccugaggcucagugagaaucagg

SEQ ID NO: 328583 - RNA, 32 nt, Human
aguguggacaagcuuccauucacugcaaauuc

SEQ ID NO: 328584 - RNA, 32 nt, Human
aguguggacagcuuccuugugugggacugaga

SEQ ID NO: 328585 - RNA, 32 nt, Human
aguguggaccaggaguacaaauucagucccaa

SEQ ID NO: 328586 - RNA, 32 nt, Human
aguguggacugcugguuccugcacagacugcc

SEQ ID NO: 328587 - RNA, 32 nt, Human
aguguggagccccacagucuugcaggucacau

SEQ ID NO: 328588 - RNA, 32 nt, Human
aguguggaggcagggaggucgagucagccaug

SEQ ID NO: 328589 - RNA, 32 nt, Human
aguguggagucccagcccaggcugaccucaca

SEQ ID NO: 328590 - RNA, 32 nt, Human
aguguggauuugguucucccauacauuuuaau

SEQ ID NO: 328591 - RNA, 32 nt, Human
aguguggcaaagccuuccgagaaaagucaaca

SEQ ID NO: 328592 - RNA, 32 nt, Human
aguguggcaaagccuuucgugggcagucagca

SEQ ID NO: 328593 - RNA, 32 nt, Human
aguguggcaaagccuuuggcaagcagucaaca

SEQ ID NO: 328594 - RNA, 32 nt, Human
aguguggccagcuccagggaaaaggccuugcu

SEQ ID NO: 328595 - RNA, 32 nt, Human
aguguggccccuggcuguaccugagcuuccuc

SEQ ID NO: 328596 - RNA, 32 nt, Human
aguguggccugcgagauucugaccucagaugu

SEQ ID NO: 328597 - RNA, 32 nt, Human
aguguggccugugaaccagcagcauuuuuauc

SEQ ID NO: 328598 - RNA, 32 nt, Human
aguguggcuggccccaguaccuggccaagccc

SEQ ID NO: 328599 - RNA, 32 nt, Human
aguguggcuucccacuuuuccugcauugugga

SEQ ID NO: 328600 - RNA, 32 nt, Human
agugugggaagggagagcggggcagucucggg

SEQ ID NO: 328601 - RNA, 32 nt, Human
agugugggaauggguggagcagcagcucaagg

SEQ ID NO: 328602 - RNA, 32 nt, Human
agugugggacacgguuuaacugucccagcgac

SEQ ID NO: 328603 - RNA, 32 nt, Human
agugugggagaaaaggaggagggaaggagccg

SEQ ID NO: 328604 - RNA, 32 nt, Human
agugugggagcagcuggacaccaggcuucuug

SEQ ID NO: 328605 - RNA, 32 nt, Human
agugugggaggcaguggggcagguagagccac

SEQ ID NO: 328606 - RNA, 32 nt, Human
agugugggaugugcugcaagacguaaaccuac

SEQ ID NO: 328607 - RNA, 32 nt, Human
agugugggaugugguuucugccuucuagagag

SEQ ID NO: 328608 - RNA, 21 nt, Human
agugugggcaacauggugaaa

SEQ ID NO: 328609 - RNA, 32 nt, Human
agugugggcagagagaauuauguggccucauc

SEQ ID NO: 328610 - RNA, 32 nt, Human
agugugggccuuccagcugagcccaugcaaga

SEQ ID NO: 328611 - RNA, 32 nt, Human
agugugggcuauggaaagaggugaauugcggu

SEQ ID NO: 328612 - RNA, 32 nt, Human
aguguggggaagagauaggaaccagcaggaug

SEQ ID NO: 328613 - RNA, 32 nt, Human
aguguggggagggcagguccagcucugugggc

SEQ ID NO: 328614 - RNA, 32 nt, Human
aguguggggaugcacccccagucccgagauga

SEQ ID NO: 328615 - RNA, 32 nt, Human
aguguggggauuacgggugugagccaccacgc

SEQ ID NO: 328616 - RNA, 32 nt, Human
agugugggggagggaggcuuccccagccuuaa

SEQ ID NO: 328617 - RNA, 32 nt, Human
aguguggggugaggcagugagguuaggcccag

SEQ ID NO: 328618 - RNA, 32 nt, Human
aguguggguguggccagcugaagaggcaggaa

SEQ ID NO: 328619 - RNA, 32 nt, Human
aguguggguguguguggcugcacgugucacug

SEQ ID NO: 328620 - RNA, 32 nt, Human
agugugguaagaaggaaggacaaaaggcuuua

SEQ ID NO: 328621 - RNA, 17 nt, Human
agugugguccugaacug

SEQ ID NO: 328622 - RNA, 32 nt, Human
aguguggucucaaacuccugaccucaugauuu

SEQ ID NO: 328623 - RNA, 32 nt, Human
aguguggucuuuuucugaucuuccucagcuuc

SEQ ID NO: 328624 - RNA, 32 nt, Human
aguguggugcugcccaaggcuuugggagccca

SEQ ID NO: 328625 - RNA, 32 nt, Human
aguguggugcugcuaacauugcccaggcaaca

SEQ ID NO: 328626 - RNA, 29 nt, Human
agugugguguuugguuugccuggagaugc

SEQ ID NO: 328627 - RNA, 32 nt, Human
agugugguuacuucuuucuucugccucgacuc

SEQ ID NO: 328628 - RNA, 32 nt, Human
agugugguuugcagaugaucugggcuuguuuc

SEQ ID NO: 328629 - RNA, 32 nt, Human
aguguguaagauguuaacauuuugggcagagg

SEQ ID NO: 328630 - RNA, 21 nt, Human
aguguguacccucuccaggaa

SEQ ID NO: 328631 - RNA, 29 nt, Human
aguguguacuuguguguguuugggggagu

SEQ ID NO: 328632 - RNA, 32 nt, Human
aguguguagagauggcugagugcaauggcuca

SEQ ID NO: 328633 - RNA, 32 nt, Human
aguguguaugguaagacaugcccuucuauuaa

SEQ ID NO: 328634 - RNA, 29 nt, Human
aguguguaugugugugugggaguaugugu

SEQ ID NO: 328635 - RNA, 32 nt, Human
agugugucaacuccauuguuguccucaaugga

SEQ ID NO: 328636 - RNA, 23 nt, Human
agugugucaugccugcaauccca

SEQ ID NO: 328637 - RNA, 32 nt, Human
aguguguccauggccaggucucagcccugguc

SEQ ID NO: 328638 - RNA, 32 nt, Human
aguguguccuuugagcaagaggaggaacuccu

SEQ ID NO: 328639 - RNA, 32 nt, Human
agugugugaacugcuuucaagucugacucucc

SEQ ID NO: 328640 - RNA, 32 nt, Human
agugugugagaggaggaggagagggagaauuc

SEQ ID NO: 328641 - RNA, 32 nt, Human
agugugugagugcagugcagaugagcaccauu

SEQ ID NO: 328642 - RNA, 32 nt, Human
agugugugagugugugggggaguguguauggu

SEQ ID NO: 328643 - RNA, 32 nt, Human
agugugugaguucaaggcugcagugagguaug

SEQ ID NO: 328644 - RNA, 32 nt, Human
agugugugcaagccccucagaacucaagacau

SEQ ID NO: 328645 - RNA, 29 nt, Human
agugugugcaugugugugcucaggggcug

SEQ ID NO: 328646 - RNA, 32 nt, Human
agugugugccuguagucccagcuacucgggag

SEQ ID NO: 328647 - RNA, 32 nt, Human
agugugugccuguaguucagcuacucaggggg

SEQ ID NO: 328648 - RNA, 32 nt, Human
aguguguggacccaaaacugccaagccugagu

SEQ ID NO: 328649 - RNA, 32 nt, Human
aguguguggaggagggaggagggugaagacug

SEQ ID NO: 328650 - RNA, 32 nt, Human
aguguguggauucccuuuuaagauagaaagua

SEQ ID NO: 328651 - RNA, 32 nt, Human
aguguguggcaggcccccguggaggaucaaca

SEQ ID NO: 328652 - RNA, 32 nt, Human
agugugugguagccaacaaacuaccuagaaac

SEQ ID NO: 328653 - RNA, 32 nt, Human
agugugugguguguuauuacagcugcucuaga

SEQ ID NO: 328654 - RNA, 29 nt, Human
agugugugucugugugcagccuaugccug

SEQ ID NO: 328655 - RNA, 26 nt, Human
agugugugucuguuuugguuugugag

SEQ ID NO: 328656 - RNA, 32 nt, Human
agugugugucuuuacuccuucuuccucuccau

SEQ ID NO: 328657 - RNA, 32 nt, Human
agugugugugagguauaggaaaugcugaugac

SEQ ID NO: 328658 - RNA, 32 nt, Human
aguguguguggaauguucuggccgcucccagc

SEQ ID NO: 328659 - RNA, 32 nt, Human
aguguguguggaggggagggagaagagguuaa

SEQ ID NO: 328660 - RNA, 32 nt, Human
aguguguguucaucuacccaugaggaauaaaa

SEQ ID NO: 328661 - RNA, 32 nt, Human
aguguguguuuagccaggcaugguggcccaug

SEQ ID NO: 328662 - RNA, 32 nt, Human
aguguguucacuguuggcugcauuggacaauc

SEQ ID NO: 328663 - RNA, 32 nt, Human
aguguguucagacugugcacacagaaaacagg

SEQ ID NO: 328664 - RNA, 32 nt, Human
aguguguucucaauguuguaugaaccuccuuc

SEQ ID NO: 328665 - RNA, 32 nt, Human
aguguguugaagcauacaucuuuacgcugcua

SEQ ID NO: 328666 - RNA, 32 nt, Human
aguguguugauaaaaaugagugccaguuugga

SEQ ID NO: 328667 - RNA, 32 nt, Human
aguguguugggaagacuuaaucugagcaaaac

SEQ ID NO: 328668 - RNA, 32 nt, Human
aguguguuguuccccucuauguauccauaugu

SEQ ID NO: 328669 - RNA, 32 nt, Human
aguguguuucauccuucccacucugucgagcc

SEQ ID NO: 328670 - RNA, 32 nt, Human
aguguguuucucucaccuaaaacaccauuuac

SEQ ID NO: 328671 - RNA, 32 nt, Human
aguguguuuggacaguucauaggguccacaaa

SEQ ID NO: 328672 - RNA, 22 nt, Human
aguguguuuuuaucucuuucca

SEQ ID NO: 328673 - RNA, 23 nt, Human
aguguuaaaagaaaaguuugcug

SEQ ID NO: 328674 - RNA, 32 nt, Human
aguguuaagguugguuugcaguguguaagugg

SEQ ID NO: 328675 - RNA, 32 nt, Human
aguguuacaguucccacccauuguuuggaauu

SEQ ID NO: 328676 - RNA, 32 nt, Human
aguguuacccugagccccgcaggccaacccau

SEQ ID NO: 328677 - RNA, 32 nt, Human
aguguuagaaaagucaagcagagauaugccag

SEQ ID NO: 328678 - RNA, 32 nt, Human
aguguuagaauuagaaagagauccaaauugua

SEQ ID NO: 328679 - RNA, 32 nt, Human
aguguuaggagagagaugggugaggggaccug

SEQ ID NO: 328680 - RNA, 32 nt, Human
aguguuaggauuacaggcaugagccacugcgc

SEQ ID NO: 328681 - RNA, 23 nt, Human
aguguuaggauuacaggcgugag

SEQ ID NO: 328682 - RNA, 32 nt, Human
aguguuaggauuacaggcgugagccaccacac

SEQ ID NO: 328683 - RNA, 32 nt, Human
aguguuaggauuacaggcgugagccaccgcgc

SEQ ID NO: 328684 - RNA, 32 nt, Human
aguguuaggauuaggggcaugagccaccgcac

SEQ ID NO: 328685 - RNA, 32 nt, Human
aguguuaggauuauaggcgugagccaccacgc

SEQ ID NO: 328686 - RNA, 32 nt, Human
aguguuaggguagcaugggauuacagggcccu

SEQ ID NO: 328687 - RNA, 32 nt, Human
aguguuaguuucuuugggacccaucuacccug

SEQ ID NO: 328688 - RNA, 32 nt, Human
aguguuauucaggaacauaaaaauuagagcau

SEQ ID NO: 328689 - RNA, 32 nt, Human
aguguuauuuucugauugugguguugagaguu

SEQ ID NO: 328690 - RNA, 32 nt, Human
aguguuauuuucuuucucagugacacauaaca

SEQ ID NO: 328691 - RNA, 31 nt, Human
aguguucacaacuagaauaaauaccuagagc

SEQ ID NO: 328692 - RNA, 32 nt, Human
aguguucacuaaaucugaguuuguggugacuu

SEQ ID NO: 328693 - RNA, 32 nt, Human
aguguucacucuggguccacacugccuuuaug

SEQ ID NO: 328694 - RNA, 32 nt, Human
aguguucagauaguucaguauucauuaucguu

SEQ ID NO: 328695 - RNA, 20 nt, Human
aguguucagcagggcugcug

SEQ ID NO: 328696 - RNA, 32 nt, Human
aguguucaugaucuacuguaccuauuuccucc

SEQ ID NO: 328697 - RNA, 32 nt, Human
aguguucaugugacccgcacaggccaauccug

SEQ ID NO: 328698 - RNA, 32 nt, Human
aguguuccaaagugcugauauuacaggcauaa

SEQ ID NO: 328699 - RNA, 32 nt, Human
aguguuccaaguagcugggauuacagacgccu

SEQ ID NO: 328700 - RNA, 32 nt, Human
aguguuccaguguuuucucucaaaacucugug

SEQ ID NO: 328701 - RNA, 32 nt, Human
aguguuccuacauaacaaaccugaacauguac

SEQ ID NO: 328702 - RNA, 32 nt, Human
aguguuccuauuucccccuccucccagcuccu

SEQ ID NO: 328703 - RNA, 32 nt, Human
aguguucgacuaccuuuuaccuagccacuuaa

SEQ ID NO: 328704 - RNA, 24 nt, Human
aguguucggggggugucugggcca

SEQ ID NO: 328705 - RNA, 21 nt, Human
aguguucuaacaaacuaaacu

SEQ ID NO: 328706 - RNA, 32 nt, Human
aguguucucaaaggaaucacccuuucccuacc

SEQ ID NO: 328707 - RNA, 32 nt, Human
aguguucucaacagcaaauagugggugucuaa

SEQ ID NO: 328708 - RNA, 32 nt, Human
aguguucuccagccugggcaacagagugaguc

SEQ ID NO: 328709 - RNA, 32 nt, Human
aguguucuguagugagguuacauaucaggaac

SEQ ID NO: 328710 - RNA, 32 nt, Human
aguguucuguggagaaacugcagccccacuuc

SEQ ID NO: 328711 - RNA, 32 nt, Human
aguguucuuacacguuguaucacugcauugug

SEQ ID NO: 328712 - RNA, 32 nt, Human
aguguucuuggaccucacagccaagcagcacu

SEQ ID NO: 328713 - RNA, 32 nt, Human
aguguucuuuugaaauguucaucaggaauagg

SEQ ID NO: 328714 - RNA, 32 nt, Human
aguguugacagugugugcacacugcagacagc

SEQ ID NO: 328715 - RNA, 32 nt, Human
aguguugagauuacaggcaugagccacugugc

SEQ ID NO: 328716 - RNA, 32 nt, Human
aguguugaggagcagaggugagaagagagaga

SEQ ID NO: 328717 - RNA, 32 nt, Human
aguguugaggggaccaaagccaccaagacagg

SEQ ID NO: 328718 - RNA, 32 nt, Human
aguguugcaggcacuccagccuggcgacagag

SEQ ID NO: 328719 - RNA, 32 nt, Human
aguguugcaguaaacugcuagcaggagcugua

SEQ ID NO: 328720 - RNA, 28 nt, Human
aguguugcccaggcuggagugcaguggc

SEQ ID NO: 328721 - RNA, 32 nt, Human
aguguugcccuuaaguacagugguguaauuuu

SEQ ID NO: 328722 - RNA, 32 nt, Human
aguguugcuggaucucugccugccagggaagc

SEQ ID NO: 328723 - RNA, 32 nt, Human
aguguugcuuuccuugugcuuuccuugugguu

SEQ ID NO: 328724 - RNA, 32 nt, Human
aguguuggaaccugcuuagaaccaggugugaa

SEQ ID NO: 328725 - RNA, 32 nt, Human
aguguuggaacugccucuuauuuuaggcugua

SEQ ID NO: 328726 - RNA, 32 nt, Human
aguguuggaauuacaggcgugagccaccgcgc

SEQ ID NO: 328727 - RNA, 32 nt, Human
aguguuggaauugcaggugugagccacugcac

SEQ ID NO: 328728 - RNA, 32 nt, Human
aguguuggaggaggcaggggcugaagguguca

SEQ ID NO: 328729 - RNA, 32 nt, Human
aguguuggagugaggaccuguaaggcaggccc

SEQ ID NO: 328730 - RNA, 32 nt, Human
aguguuggcagauaggugauggagaggaugau

SEQ ID NO: 328731 - RNA, 32 nt, Human
aguguuggcuuccauugaccauaugaaggcca

SEQ ID NO: 328732 - RNA, 26 nt, Human
aguguugggaaacuggauucaguggg

SEQ ID NO: 328733 - RNA, 32 nt, Human
aguguugggauaacaggcaugagccacugugc

SEQ ID NO: 328734 - RNA, 32 nt, Human
aguguugggaucacaggcgugagccaccacau

SEQ ID NO: 328735 - RNA, 32 nt, Human
aguguugggaucacaggcgugagccaccgcau

SEQ ID NO: 328736 - RNA, 32 nt, Human
aguguugggauuacaagcgugagccacugcac

SEQ ID NO: 328737 - RNA, 32 nt, Human
aguguugggauuacagccaugagccaccaugc

SEQ ID NO: 328738 - RNA, 32 nt, Human
aguguugggauuacagccgugagccaccacgc

SEQ ID NO: 328739 - RNA, 32 nt, Human
aguguugggauuacaggcaaugagccaccacg

SEQ ID NO: 328740 - RNA, 32 nt, Human
aguguugggauuacaggcacgagccacugugc

SEQ ID NO: 328741 - RNA, 32 nt, Human
aguguugggauuacaggcauaagccauugugc

SEQ ID NO: 328742 - RNA, 32 nt, Human
aguguugggauuacaggcaugagacacugccu

SEQ ID NO: 328743 - RNA, 32 nt, Human
aguguugggauuacaggcaugagccaccacuc

SEQ ID NO: 328744 - RNA, 32 nt, Human
aguguugggauuacaggcaugagccaccaugc

SEQ ID NO: 328745 - RNA, 32 nt, Human
aguguugggauuacaggcaugagccaccgcac

SEQ ID NO: 328746 - RNA, 32 nt, Human
aguguugggauuacaggcaugagccaccugaa

SEQ ID NO: 328747 - RNA, 32 nt, Human
aguguugggauuacaggcaugagccacugcgc

SEQ ID NO: 328748 - RNA, 32 nt, Human
aguguugggauuacaggcaugagccacugugc

SEQ ID NO: 328749 - RNA, 32 nt, Human
aguguugggauuacaggcaugagccgcugccu

SEQ ID NO: 328750 - RNA, 32 nt, Human
aguguugggauuacaggcaugagcuacuacau

SEQ ID NO: 328751 - RNA, 32 nt, Human
aguguugggauuacaggcgugagccaccgcac

SEQ ID NO: 328752 - RNA, 32 nt, Human
aguguugggauuacaggcgugagccaccgcgc

SEQ ID NO: 328753 - RNA, 32 nt, Human
aguguugggauuacaggcgugagccaccucac

SEQ ID NO: 328754 - RNA, 32 nt, Human
aguguugggauuacaggcgugagccacugcac

SEQ ID NO: 328755 - RNA, 32 nt, Human
aguguugggauuacaggcgugagccacugccc

SEQ ID NO: 328756 - RNA, 32 nt, Human
aguguugggauuacaggcgugagccacugcgc

SEQ ID NO: 328757 - RNA, 32 nt, Human
aguguugggauuacaggcgugagccacugugc

SEQ ID NO: 328758 - RNA, 32 nt, Human
aguguugggauuacaggcgugagccauggugc

SEQ ID NO: 328759 - RNA, 32 nt, Human
aguguugggauuacaggcgugagccauugcgc

SEQ ID NO: 328760 - RNA, 32 nt, Human
aguguugggauuacaggcgugagucaccgcgc

SEQ ID NO: 328761 - RNA, 32 nt, Human
aguguugggauuacaggcgugagucacugugc

SEQ ID NO: 328762 - RNA, 32 nt, Human
aguguugggauuacaggcgugagugaccaugc

SEQ ID NO: 328763 - RNA, 32 nt, Human
aguguugggauuacaggcuugagccaccgcac

SEQ ID NO: 328764 - RNA, 32 nt, Human
aguguugggauuacaggcuugagccaccgugc

SEQ ID NO: 328765 - RNA, 19 nt, Human
aguguugggauuacaggug

SEQ ID NO: 328766 - RNA, 32 nt, Human
aguguugggauuacaggugugaaccacugugc

SEQ ID NO: 328767 - RNA, 32 nt, Human
aguguugggauuacaggugugagccacagcac

SEQ ID NO: 328768 - RNA, 32 nt, Human
aguguugggauuacaggugugagccaccacgc

SEQ ID NO: 328769 - RNA, 32 nt, Human
aguguugggauuacaggugugagccaccgugc

SEQ ID NO: 328770 - RNA, 32 nt, Human
aguguugggauuacaggugugagccacugugc

SEQ ID NO: 328771 - RNA, 32 nt, Human
aguguugggauuacaggugugugucacugugc

SEQ ID NO: 328772 - RNA, 32 nt, Human
aguguugggauuacaugcaugagccacugugc

SEQ ID NO: 328773 - RNA, 32 nt, Human
aguguugggauuaccggcgugagccaccaugc

SEQ ID NO: 328774 - RNA, 32 nt, Human
aguguugggauuacguguguaagccacagugc

SEQ ID NO: 328775 - RNA, 32 nt, Human
aguguugggauuauaagcgugagccaccaugc

SEQ ID NO: 328776 - RNA, 32 nt, Human
aguguugggauuauaggcacgagccaccaugc

SEQ ID NO: 328777 - RNA, 32 nt, Human
aguguugggauuauaggcaugagccaccacga

SEQ ID NO: 328778 - RNA, 32 nt, Human
aguguugggauuauaggcaugagccaccgugc

SEQ ID NO: 328779 - RNA, 32 nt, Human
aguguugggauuauaggcaugagccacugcau

SEQ ID NO: 328780 - RNA, 32 nt, Human
aguguugggauuauaggcgugagccaccaugc

SEQ ID NO: 328781 - RNA, 32 nt, Human
aguguugggauuauaggcgugagccaccgcgc

SEQ ID NO: 328782 - RNA, 32 nt, Human
aguguugggauuauaggcgugagccacugugu

SEQ ID NO: 328783 - RNA, 32 nt, Human
aguguugggauuauagguaugaaccacugcac

SEQ ID NO: 328784 - RNA, 32 nt, Human
aguguugggauuauagguaugagccaccgcgc

SEQ ID NO: 328785 - RNA, 32 nt, Human
aguguugggauuauaggugugagccagcagcc

SEQ ID NO: 328786 - RNA, 32 nt, Human
aguguugggauuaugggcgugagucacuguac

SEQ ID NO: 328787 - RNA, 32 nt, Human
aguguugggauugcagauaugagccacuggcc

SEQ ID NO: 328788 - RNA, 32 nt, Human
aguguugggauugcaggcgugagccacugcuc

SEQ ID NO: 328789 - RNA, 32 nt, Human
aguguugggcagguggugggagagcgucaggc

SEQ ID NO: 328790 - RNA, 32 nt, Human
aguguuggggcugggggccagcuccaggaggg

SEQ ID NO: 328791 - RNA, 25 nt, Human
aguguuggugacccaacacuagcca

SEQ ID NO: 328792 - RNA, 32 nt, Human
aguguuggugguaggaggauggggagaggaaa

SEQ ID NO: 328793 - RNA, 32 nt, Human
aguguugguguuuuaaugccugcagacaagcu

SEQ ID NO: 328794 - RNA, 32 nt, Human
aguguugguugagggucugccaugaccaagga

SEQ ID NO: 328795 - RNA, 31 nt, Human
aguguuguacagagggaaaaagacuggugga

SEQ ID NO: 328796 - RNA, 32 nt, Human
aguguugugauaguagagaagcuuuuagucaa

SEQ ID NO: 328797 - RNA, 32 nt, Human
aguguugugauuacaggcgugagccaccacac

SEQ ID NO: 328798 - RNA, 32 nt, Human
aguguuguucaguuucacaugguacaaauaag

SEQ ID NO: 328799 - RNA, 32 nt, Human
aguguuuaacaaacaaccccaaaacuuggaug

SEQ ID NO: 328800 - RNA, 32 nt, Human
aguguuuacgcuuuaauuucuaccacaaaaua

SEQ ID NO: 328801 - RNA, 32 nt, Human
aguguuuagauucuugauaaagauggaaaugg

SEQ ID NO: 328802 - RNA, 18 nt, Human
aguguuuagcaggcuguu

SEQ ID NO: 328803 - RNA, 32 nt, Human
aguguuuagcuucaagacuggaaagggaauau

SEQ ID NO: 328804 - RNA, 32 nt, Human
aguguuuaggaaccugcccuuuggugcugggc

SEQ ID NO: 328805 - RNA, 32 nt, Human
aguguuuaguauugcugcuauuuggaguacaa

SEQ ID NO: 328806 - RNA, 32 nt, Human
aguguuuaugguuucaggaaaagaacuuugug

SEQ ID NO: 328807 - RNA, 32 nt, Human
aguguuucaaagcugcucaaucaaaagaaaug

SEQ ID NO: 328808 - RNA, 32 nt, Human
aguguuucaaugcagugugagccacucccuuc

SEQ ID NO: 328809 - RNA, 32 nt, Human
aguguuucacacauuaucucauuuaauccucu

SEQ ID NO: 328810 - RNA, 32 nt, Human
aguguuucacugucucaaccuuaucugcacag

SEQ ID NO: 328811 - RNA, 32 nt, Human
aguguuuccacccagaaauuccugggcuggaa

SEQ ID NO: 328812 - RNA, 32 nt, Human
aguguuuccaggggcacuaagagaccaaaauc

SEQ ID NO: 328813 - RNA, 32 nt, Human
aguguuucccauaauuuucuucaugcaaugac

SEQ ID NO: 328814 - RNA, 32 nt, Human
aguguuucuaggguaagggaccugcaggugua

SEQ ID NO: 328815 - RNA, 32 nt, Human
aguguuugaagaaaaagguacaaaaauggcuu

SEQ ID NO: 328816 - RNA, 32 nt, Human
aguguuugagcagugcugagcacaaagcagac

SEQ ID NO: 328817 - RNA, 32 nt, Human
aguguuugccuauguggaaacaacagcaaacu

SEQ ID NO: 328818 - RNA, 32 nt, Human
aguguuugccugacugagccugugaagaaaau

SEQ ID NO: 328819 - RNA, 32 nt, Human
aguguuugccuuugaacacaucuucuugcuga

SEQ ID NO: 328820 - RNA, 32 nt, Human
aguguuugguuuucugaccuugcgauaguuua

SEQ ID NO: 328821 - RNA, 32 nt, Human
aguguuuguaccugacaucgggauguucauug

SEQ ID NO: 328822 - RNA, 29 nt, Human
aguguuugucuuucugugccuggcuuauu

SEQ ID NO: 328823 - RNA, 32 nt, Human
aguguuuguggaaugaguccuccuaguaaagu

SEQ ID NO: 328824 - RNA, 32 nt, Human
aguguuuguggauauacaugccaagccgccac

SEQ ID NO: 328825 - RNA, 32 nt, Human
aguguuugugucugugcugcguuugugagcug

SEQ ID NO: 328826 - RNA, 32 nt, Human
aguguuuuagagauggcuuucccagugugugu

SEQ ID NO: 328827 - RNA, 32 nt, Human
aguguuuugugccuguuuaaaggcuuuuguuu

SEQ ID NO: 328828 - RNA, 32 nt, Human
aguguuuuuagaggagagaggaggaggaggag

SEQ ID NO: 328829 - RNA, 32 nt, Human
aguguuuuuguguccagcucaguaucugcaac

SEQ ID NO: 328830 - RNA, 32 nt, Human
aguuaaaaagggcagggcaucuccugugcaug

SEQ ID NO: 328831 - RNA, 32 nt, Human
aguuaaaaaugcugggagucucugcauagaua

SEQ ID NO: 328832 - RNA, 32 nt, Human
aguuaaaaccuacaggccgggugcgguggcuc

SEQ ID NO: 328833 - RNA, 32 nt, Human
aguuaaaaugccacaagcaugagugugauugu

SEQ ID NO: 328834 - RNA, 32 nt, Human
aguuaaaauuaaaaauaaauuaguauauuauu

SEQ ID NO: 328835 - RNA, 32 nt, Human
aguuaaacagugacauguugagcaccuggagg

SEQ ID NO: 328836 - RNA, 32 nt, Human
aguuaaaccaaacuacagucucagccugucau

SEQ ID NO: 328837 - RNA, 32 nt, Human
aguuaaaccaugggacaaacccauaacauguu

SEQ ID NO: 328838 - RNA, 32 nt, Human
aguuaaaccccugcuuucuguccuuugcaccu

SEQ ID NO: 328839 - RNA, 32 nt, Human
aguuaaaccuuuuaacuuccauggcccuuuag

SEQ ID NO: 328840 - RNA, 32 nt, Human
aguuaaacucauuucacuucuccugggagacg

SEQ ID NO: 328841 - RNA, 32 nt, Human
aguuaaagagcaggaugaugucugaaguggcu

SEQ ID NO: 328842 - RNA, 32 nt, Human
aguuaaagcaaauucuagauacaugguagaga

SEQ ID NO: 328843 - RNA, 32 nt, Human
aguuaaaggaagcacacaugcuagucauguga

SEQ ID NO: 328844 - RNA, 32 nt, Human
aguuaaaggcauuuugaugaugcuuuuucuug

SEQ ID NO: 328845 - RNA, 32 nt, Human
aguuaaagggccuguuucuuacuggccuguga

SEQ ID NO: 328846 - RNA, 32 nt, Human
aguuaaauacaaaaucauggugacacuuccaa

SEQ ID NO: 328847 - RNA, 32 nt, Human
aguuaaaucuuuuccagggagaaagaacuucc

SEQ ID NO: 328848 - RNA, 32 nt, Human
aguuaaauuccagggucucagaugguuaggac

SEQ ID NO: 328849 - RNA, 31 nt, Human
aguuaaauuccauacacuaggagggaguuuu

SEQ ID NO: 328850 - RNA, 32 nt, Human
aguuaacacccugagaccaucuucccacuucc

SEQ ID NO: 328851 - RNA, 32 nt, Human
aguuaacagggagaggaugggggaggggacaa

SEQ ID NO: 328852 - RNA, 32 nt, Human
aguuaacauauaguuuuaaauguauguauuau

SEQ ID NO: 328853 - RNA, 32 nt, Human
aguuaacaucuaccccaggaaaccagaucucc

SEQ ID NO: 328854 - RNA, 32 nt, Human
aguuaaccaacauucaacaugaccuuaaaacu

SEQ ID NO: 328855 - RNA, 32 nt, Human
aguuaaccacauggcugauccuggugacugaa

SEQ ID NO: 328856 - RNA, 32 nt, Human
aguuaaccaccaccaucucucuccucuucaaa

SEQ ID NO: 328857 - RNA, 32 nt, Human
aguuaaccauuuuaaagggaacaauucagugg

SEQ ID NO: 328858 - RNA, 32 nt, Human
aguuaaccuauguaacaaaccugcauuuguac

SEQ ID NO: 328859 - RNA, 32 nt, Human
aguuaaccuucagcuacuuggagauucauggc

SEQ ID NO: 328860 - RNA, 32 nt, Human
aguuaacgguaugcuuucuucuuugcuuauuu

SEQ ID NO: 328861 - RNA, 32 nt, Human
aguuaacucccaguucuucucccugagcuugg

SEQ ID NO: 328862 - RNA, 32 nt, Human
aguuaacugagaggaagggauuuggaaaccau

SEQ ID NO: 328863 - RNA, 32 nt, Human
aguuaacugccuggcuccucugggcuaggcuc

SEQ ID NO: 328864 - RNA, 32 nt, Human
aguuaacugugcugaaaaacuaauaaagaacc

SEQ ID NO: 328865 - RNA, 32 nt, Human
aguuaacuucacugcugaugcccugaguucca

SEQ ID NO: 328866 - RNA, 32 nt, Human
aguuaacuuggcaauggaacaaacaaaauuga

SEQ ID NO: 328867 - RNA, 32 nt, Human
aguuaacuuuacugcuauuuuauuaccuaaua

SEQ ID NO: 328868 - RNA, 32 nt, Human
aguuaagaaggaaagaaggaaagcaggagaaa

SEQ ID NO: 328869 - RNA, 32 nt, Human
aguuaagaagggagccuggagcuguuuucaug

SEQ ID NO: 328870 - RNA, 32 nt, Human
aguuaagacagcuguaaauggacugaucuaca

SEQ ID NO: 328871 - RNA, 32 nt, Human
aguuaagaccugccuagcagagccccagucuc

SEQ ID NO: 328872 - RNA, 32 nt, Human
aguuaagcaaaaugcuucugcacacaaaacuc

SEQ ID NO: 328873 - RNA, 32 nt, Human
aguuaagcaaacaccucugaccaaaaguaggg

SEQ ID NO: 328874 - RNA, 32 nt, Human
aguuaagcagcuauuaaaucacccgaagacac

SEQ ID NO: 328875 - RNA, 32 nt, Human
aguuaagccuuuguauuuccauguuauuccac

SEQ ID NO: 328876 - RNA, 32 nt, Human
aguuaaggaauuauuuuucauuuccagcucug

SEQ ID NO: 328877 - RNA, 32 nt, Human
aguuaaggcacaucaaacacaggagucgagag

SEQ ID NO: 328878 - RNA, 32 nt, Human
aguuaagggaaagaggaggaaguccuaagcag

SEQ ID NO: 328879 - RNA, 32 nt, Human
aguuaagggagagagacaaaacggggauugag

SEQ ID NO: 328880 - RNA, 32 nt, Human
aguuaaggugccuagcagcucagucccucaca

SEQ ID NO: 328881 - RNA, 31 nt, Human
aguuaaguaguuuucugaacggccagaagac

SEQ ID NO: 328882 - RNA, 32 nt, Human
aguuaaguauucacauacacacagaaaauacg

SEQ ID NO: 328883 - RNA, 32 nt, Human
aguuaaguccuggaacccagagcugcugugua

SEQ ID NO: 328884 - RNA, 32 nt, Human
aguuaaguucucuccaaacucuugcccacaga

SEQ ID NO: 328885 - RNA, 32 nt, Human
aguuaaguuguagcacgugaauacuuacuuac

SEQ ID NO: 328886 - RNA, 32 nt, Human
aguuaauauaaauacauaauugcauuugcucu

SEQ ID NO: 328887 - RNA, 31 nt, Human
aguuaauaugauccucuguugaagcaagaag

SEQ ID NO: 328888 - RNA, 32 nt, Human
aguuaaucaaggcaaaucagcaagcccccaaa

SEQ ID NO: 328889 - RNA, 32 nt, Human
aguuaaucacccaccauagggcaugauuaaca

SEQ ID NO: 328890 - RNA, 32 nt, Human
aguuaaucauuugaauucugaacacuggagaa

SEQ ID NO: 328891 - RNA, 32 nt, Human
aguuaauccucacaccuacuguaggagauagg

SEQ ID NO: 328892 - RNA, 32 nt, Human
aguuaaugcuaagaaaagauuuggggaagguu

SEQ ID NO: 328893 - RNA, 32 nt, Human
aguuaauggaauauuucuuuccucacuaccuc

SEQ ID NO: 328894 - RNA, 32 nt, Human
aguuaaugugugugcgcauuuauauguaggca

SEQ ID NO: 328895 - RNA, 32 nt, Human
aguuaauugaauuuuaaauuaaugaucaauaa

SEQ ID NO: 328896 - RNA, 32 nt, Human
aguuacaaaugaagcuaacaaauagcuaaaua

SEQ ID NO: 328897 - RNA, 32 nt, Human
aguuacaacuguucacaacaccugugugugug

SEQ ID NO: 328898 - RNA, 32 nt, Human
aguuacaauuacaucucuaauuuuggauaaua

SEQ ID NO: 328899 - RNA, 32 nt, Human
aguuacaauuccaguuuuccucaagaucugag

SEQ ID NO: 328900 - RNA, 32 nt, Human
aguuacacccuguuuaacccugccuucaaagg

SEQ ID NO: 328901 - RNA, 32 nt, Human
aguuacagaaaugggagacuguuucucuggcc

SEQ ID NO: 328902 - RNA, 32 nt, Human
aguuacagacaguaaugcuggaccuggacggu

SEQ ID NO: 328903 - RNA, 32 nt, Human
aguuacagccugggcaauaaagugagacccug

SEQ ID NO: 328904 - RNA, 32 nt, Human
aguuacagcucaggaaaagccugcugaauuua

SEQ ID NO: 328905 - RNA, 32 nt, Human
aguuacaggagagaguaggugguggugacgug

SEQ ID NO: 328906 - RNA, 32 nt, Human
aguuacaggucaggaaaagccugcugaauuua

SEQ ID NO: 328907 - RNA, 32 nt, Human
aguuacaggugaggacguucaggccaaggcgu

SEQ ID NO: 328908 - RNA, 32 nt, Human
aguuacauccaucugucaucugaagaaggagg

SEQ ID NO: 328909 - RNA, 21 nt, Human
aguuaccaaguucaaccugcu

SEQ ID NO: 328910 - RNA, 32 nt, Human
aguuaccacgaggggaucugugugugagcugg

SEQ ID NO: 328911 - RNA, 32 nt, Human
aguuaccacuaggcuaccaggucucuaggggc

SEQ ID NO: 328912 - RNA, 32 nt, Human
aguuaccagaguugggggccucugaguguguc

SEQ ID NO: 328913 - RNA, 32 nt, Human
aguuacccauuggauucauaugagcuaaaacu

SEQ ID NO: 328914 - RNA, 32 nt, Human
aguuaccccacuugccuugggcguguccacug

SEQ ID NO: 328915 - RNA, 32 nt, Human
aguuacccuuucuccuuuucucuucagugguu

SEQ ID NO: 328916 - RNA, 32 nt, Human
aguuaccucugaaaaggcaggaaaggugguuc

SEQ ID NO: 328917 - RNA, 32 nt, Human
aguuaccuucuuucuggccaucuugacuucug

SEQ ID NO: 328918 - RNA, 32 nt, Human
aguuacuaggguaauuauaugucauggcuugg

SEQ ID NO: 328919 - RNA, 32 nt, Human
aguuacucaaagcuaaucagauagcgaaagaa

SEQ ID NO: 328920 - RNA, 32 nt, Human
aguuacucauuuccaucuucucuucaacuuuc

SEQ ID NO: 328921 - RNA, 32 nt, Human
aguuacucuccaagaccaacagacagcuguuu

SEQ ID NO: 328922 - RNA, 32 nt, Human
aguuacugaauacgucaggaaggaggcugguu

SEQ ID NO: 328923 - RNA, 32 nt, Human
aguuacugacaauauagugccaggguuggcca

SEQ ID NO: 328924 - RNA, 32 nt, Human
aguuacugacgacaggcagagaaugagccuuu

SEQ ID NO: 328925 - RNA, 32 nt, Human
aguuacugcaauauuugagaacuguucuuuuu

SEQ ID NO: 328926 - RNA, 32 nt, Human
aguuacugcacuccagccugggugacaagagu

SEQ ID NO: 328927 - RNA, 32 nt, Human
aguuacugccauuucacgcauuuccuuuuuga

SEQ ID NO: 328928 - RNA, 32 nt, Human
aguuacugggcuuucugugcuuggccugacuu

SEQ ID NO: 328929 - RNA, 32 nt, Human
aguuacugucuauuuaaaacugcaagcaguua

SEQ ID NO: 328930 - RNA, 32 nt, Human
aguuacuuaaccucucagcugugugucaguuu

SEQ ID NO: 328931 - RNA, 32 nt, Human
aguuacuucccuuaggauaacagcccccaguu

SEQ ID NO: 328932 - RNA, 32 nt, Human
aguuacuucugggcagaugaaaagcuaccauc

SEQ ID NO: 328933 - RNA, 32 nt, Human
aguuacuugcagcugaaaacaucccaggacag

SEQ ID NO: 328934 - RNA, 32 nt, Human
aguuacuugguaucaccgccucucaccuucuc

SEQ ID NO: 328935 - RNA, 32 nt, Human
aguuacuuuagauggcaagcauguaacuuaua

SEQ ID NO: 328936 - RNA, 32 nt, Human
aguuacuuucagaguagauacaggguuuuaga

SEQ ID NO: 328937 - RNA, 32 nt, Human
aguuacuuucccaagaucuccccacaagcaag

SEQ ID NO: 328938 - RNA, 32 nt, Human
aguuacuuuuaaaaauauaaguuagggcuagg

SEQ ID NO: 328939 - RNA, 32 nt, Human
aguuacuuuucuaguccagucuggaacacagg

SEQ ID NO: 328940 - RNA, 32 nt, Human
aguuacuuuugccuaccagcagcuaucccuag

SEQ ID NO: 328941 - RNA, 32 nt, Human
aguuacuuuuuaccugcugaguccggugaacc

SEQ ID NO: 328942 - RNA, 32 nt, Human
aguuacuuuuuguagagagagcuguauuaagu

SEQ ID NO: 328943 - RNA, 32 nt, Human
aguuagaaaaauuggccucagugugaaauuuu

SEQ ID NO: 328944 - RNA, 32 nt, Human
aguuagaaaacacacuagcauuuacaaaugug

SEQ ID NO: 328945 - RNA, 32 nt, Human
aguuagaauugagagacuugaacguggagaug

SEQ ID NO: 328946 - RNA, 32 nt, Human
aguuagaccagccugggcaacauagcaagacc

SEQ ID NO: 328947 - RNA, 32 nt, Human
aguuagaccgcagagagcuggcauucacucaa

SEQ ID NO: 328948 - RNA, 32 nt, Human
aguuagacugugaaccugcagaccacuccacu

SEQ ID NO: 328949 - RNA, 32 nt, Human
aguuagagaagcaguacauuugcuuuugauag

SEQ ID NO: 328950 - RNA, 26 nt, Human
aguuagagaccagccugggcaacgua

SEQ ID NO: 328951 - RNA, 32 nt, Human
aguuagaggaggaggaggaggaggaagaggug

SEQ ID NO: 328952 - RNA, 31 nt, Human
aguuagagugagaggaaagcuggagcugugg

SEQ ID NO: 328953 - RNA, 32 nt, Human
aguuagaguuagaccugucuuuggaugaagaa

SEQ ID NO: 328954 - RNA, 32 nt, Human
aguuagaguuugagcauuauucagcauuaggg

SEQ ID NO: 328955 - RNA, 32 nt, Human
aguuagcagaagacuuccuacaauggaaugca

SEQ ID NO: 328956 - RNA, 32 nt, Human
aguuagcagauggugguuggcucccucugcuu

SEQ ID NO: 328957 - RNA, 32 nt, Human
aguuagccacuaggcugcgggugaaaugggau

SEQ ID NO: 328958 - RNA, 32 nt, Human
aguuagccaggccugggcugggcacacuccac

SEQ ID NO: 328959 - RNA, 32 nt, Human
aguuagccaguuaguccccaggccuguggcac

SEQ ID NO: 328960 - RNA, 32 nt, Human
aguuagcccucccagggauugcaguccuucac

SEQ ID NO: 328961 - RNA, 32 nt, Human
aguuagccuaccaguuggaauguggaucagug

SEQ ID NO: 328962 - RNA, 32 nt, Human
aguuagccuugauuuuagcccagagacagaug

SEQ ID NO: 328963 - RNA, 32 nt, Human
aguuagcucccaggcuccuaucucugccugag

SEQ ID NO: 328964 - RNA, 32 nt, Human
aguuagcucugacagcuucuaaaggaaaggga

SEQ ID NO: 328965 - RNA, 32 nt, Human
aguuagcugccuggaaaacucauagaaccauu

SEQ ID NO: 328966 - RNA, 32 nt, Human
aguuagcuuucuuccuggauuccucacuuuga

SEQ ID NO: 328967 - RNA, 32 nt, Human
aguuaggaaacaccagcuccugccuggggcag

SEQ ID NO: 328968 - RNA, 32 nt, Human
aguuaggaaacugaagccauaggucaggcaga

SEQ ID NO: 328969 - RNA, 32 nt, Human
aguuaggaaaugcagaauucaaagugaucucc

SEQ ID NO: 328970 - RNA, 32 nt, Human
aguuaggaagaacaguaaacagugauguuaaa

SEQ ID NO: 328971 - RNA, 32 nt, Human
aguuaggacuucaacaaaugaauuggggugag

SEQ ID NO: 328972 - RNA, 32 nt, Human
aguuaggaggcugaggcaagagaaucucuuga

SEQ ID NO: 328973 - RNA, 23 nt, Human
aguuaggcagugcaguacucagg

SEQ ID NO: 328974 - RNA, 32 nt, Human
aguuaggccugucaggucuccuugggaaaggc

SEQ ID NO: 328975 - RNA, 32 nt, Human
aguuaggcugccccgccacagagcaggcuuca

SEQ ID NO: 328976 - RNA, 32 nt, Human
aguuagggcggacgaagcaggagccgcggggc

SEQ ID NO: 328977 - RNA, 32 nt, Human
aguuaggggccaaggagagggaaggccagggc

SEQ ID NO: 328978 - RNA, 32 nt, Human
aguuaggguccugcugucugucauguugccuu

SEQ ID NO: 328979 - RNA, 32 nt, Human
aguuaggucacuugcccgcugugugaccuugg

SEQ ID NO: 328980 - RNA, 32 nt, Human
aguuaggucucagcuacucaggaggcugagau

SEQ ID NO: 328981 - RNA, 32 nt, Human
aguuagguuucucaucuggagcuguuucucag

SEQ ID NO: 328982 - RNA, 32 nt, Human
aguuaguaaggguuuuauaucucuucugucca

SEQ ID NO: 328983 - RNA, 32 nt, Human
aguuaguaaguggcagaacagggacuugaacc

SEQ ID NO: 328984 - RNA, 32 nt, Human
aguuaguccuaacuuuuaaaagaaggaaaacc

SEQ ID NO: 328985 - RNA, 32 nt, Human
aguuagucggggacaauuucccucaauguuaa

SEQ ID NO: 328986 - RNA, 32 nt, Human
aguuaguggggagacuagcaccuagguaccca

SEQ ID NO: 328987 - RNA, 32 nt, Human
aguuaguguuaauaaggaucuacugagccucg

SEQ ID NO: 328988 - RNA, 20 nt, Human
aguuaguguuucuagcauua

SEQ ID NO: 328989 - RNA, 30 nt, Human
aguuaguuauucacugugcuccuguuuccu

SEQ ID NO: 328990 - RNA, 32 nt, Human
aguuaguucucagcugagcuuccuagggccag

SEQ ID NO: 328991 - RNA, 32 nt, Human
aguuauaaaauuauuuuuaauauuuaaggccu

SEQ ID NO: 328992 - RNA, 32 nt, Human
aguuauaaagacggcaagaccaugcuauugaa

SEQ ID NO: 328993 - RNA, 32 nt, Human
aguuauacacagaaacaaacacacacgcacgu

SEQ ID NO: 328994 - RNA, 32 nt, Human
aguuauacagaauugucauacugcauuagcuu

SEQ ID NO: 328995 - RNA, 32 nt, Human
aguuauagaccagaggcugaaacccaaacuau

SEQ ID NO: 328996 - RNA, 32 nt, Human
aguuauagagguugcucagaaccuucucagca

SEQ ID NO: 328997 - RNA, 32 nt, Human
aguuauaguaacugacugguauauucauucag

SEQ ID NO: 328998 - RNA, 32 nt, Human
aguuauagucucucuucugguuaucucuauga

SEQ ID NO: 328999 - RNA, 32 nt, Human
aguuauauuuucuuuuuccuuauauagaguaa

SEQ ID NO: 329000 - RNA, 32 nt, Human
aguuaucaaaagugacuuugaccucauaaaag

SEQ ID NO: 329001 - RNA, 32 nt, Human
aguuaucacaccacugcacuucagccuggaug

SEQ ID NO: 329002 - RNA, 32 nt, Human
aguuaucagggaaagagguugaugugaacuca

SEQ ID NO: 329003 - RNA, 32 nt, Human
aguuauccucuuugccuggccuuugagaauaa

SEQ ID NO: 329004 - RNA, 32 nt, Human
aguuaucgcagauauucuagcuucauuguaag

SEQ ID NO: 329005 - RNA, 32 nt, Human
aguuaucucaaagaagcucauuaccuugcuaa

SEQ ID NO: 329006 - RNA, 22 nt, Human
aguuaucuccaaagggaagcaa

SEQ ID NO: 329007 - RNA, 32 nt, Human
aguuaucugcaagcaaagagagaggcuucaga

SEQ ID NO: 329008 - RNA, 32 nt, Human
aguuaucuguuuccuguucucuuguauagcug

SEQ ID NO: 329009 - RNA, 32 nt, Human
aguuaucuuauuccugcucuguguucucauug

SEQ ID NO: 329010 - RNA, 32 nt, Human
aguuaugaaaguacaaacuauuugugugauua

SEQ ID NO: 329011 - RNA, 31 nt, Human
aguuaugaaauacuuuuacauuuaaggagau

SEQ ID NO: 329012 - RNA, 32 nt, Human
aguuaugaaaugcaucagcaguggguugaaga

SEQ ID NO: 329013 - RNA, 32 nt, Human
aguuaugacgcccauugcccagcuucagucca

SEQ ID NO: 329014 - RNA, 32 nt, Human
aguuaugagaaaggagaaagcuugcaaugcau

SEQ ID NO: 329015 - RNA, 32 nt, Human
aguuaugaggagagaauacaaaaagcaugcac

SEQ ID NO: 329016 - RNA, 32 nt, Human
aguuaugaguagaagcaauaagaagguguccu

SEQ ID NO: 329017 - RNA, 32 nt, Human
aguuaugaucaaagaagagaguaaagcuaugu

SEQ ID NO: 329018 - RNA, 32 nt, Human
aguuaugcacugugaagaaugagaagggaaaa

SEQ ID NO: 329019 - RNA, 32 nt, Human
aguuaugcagcacaucauuauaauuuugaugu

SEQ ID NO: 329020 - RNA, 32 nt, Human
aguuaugcagcagccacaauuugcauugccag

SEQ ID NO: 329021 - RNA, 32 nt, Human
aguuaugccacuccaauauuauuauuugaugg

SEQ ID NO: 329022 - RNA, 32 nt, Human
aguuaugcccagcuccuuccuccuccuccucc

SEQ ID NO: 329023 - RNA, 32 nt, Human
aguuauggauauagaacauccuugcagacuau

SEQ ID NO: 329024 - RNA, 32 nt, Human
aguuauggccucugcacuccagccugggugac

SEQ ID NO: 329025 - RNA, 32 nt, Human
aguuauggcuucacauucauugcagugggaua

SEQ ID NO: 329026 - RNA, 32 nt, Human
aguuaugggaaagagaaugcauagaccuaucu

SEQ ID NO: 329027 - RNA, 32 nt, Human
aguuauguaagcuaaaaagcugugugaaccca

SEQ ID NO: 329028 - RNA, 32 nt, Human
aguuauguauauguuuuccauguuuuuagcua

SEQ ID NO: 329029 - RNA, 32 nt, Human
aguuauguccacuuuugguggauuucccagga

SEQ ID NO: 329030 - RNA, 32 nt, Human
aguuaugugaaggaugaaaggugggugaaagg

SEQ ID NO: 329031 - RNA, 32 nt, Human
aguuaugugaagucaccaagguucuugaccgu

SEQ ID NO: 329032 - RNA, 32 nt, Human
aguuauuaaagaauuaaaagaagaacuagacc

SEQ ID NO: 329033 - RNA, 32 nt, Human
aguuauuagggaggggagagcaaguuaaggga

SEQ ID NO: 329034 - RNA, 32 nt, Human
aguuauuauacaaccaaauacaacuuccaguu

SEQ ID NO: 329035 - RNA, 32 nt, Human
aguuauuaucuauuuguucucccuuucaggaa

SEQ ID NO: 329036 - RNA, 32 nt, Human
aguuauuccuucuuucaguucaucucacugga

SEQ ID NO: 329037 - RNA, 32 nt, Human
aguuauucucucuauaagauccacacucagca

SEQ ID NO: 329038 - RNA, 32 nt, Human
aguuauugaucauuucuuaaggaacagcauug

SEQ ID NO: 329039 - RNA, 32 nt, Human
aguuauugcagaacuuccuguccugguggaga

SEQ ID NO: 329040 - RNA, 32 nt, Human
aguuauugccuaggagugugagacugauguug

SEQ ID NO: 329041 - RNA, 32 nt, Human
aguuauugcucucaugagaugauggcuguauu

SEQ ID NO: 329042 - RNA, 32 nt, Human
aguuauuggauuaaacuacuuuagaccuuagc

SEQ ID NO: 329043 - RNA, 32 nt, Human
aguuauugggagaaggaaggacuugagccggu

SEQ ID NO: 329044 - RNA, 32 nt, Human
aguuauuguggcuucuggugaggggaaguuua

SEQ ID NO: 329045 - RNA, 32 nt, Human
aguuauuguguaccaagcauugugcuaaauac

SEQ ID NO: 329046 - RNA, 32 nt, Human
aguuauuuccgcuccccagccccacacuccuu

SEQ ID NO: 329047 - RNA, 32 nt, Human
aguuauuugcaaccucccuuuggguuuggccc

SEQ ID NO: 329048 - RNA, 32 nt, Human
aguuauuugcauaagugcaauaagaaucuguu

SEQ ID NO: 329049 - RNA, 32 nt, Human
aguuauuuucccuguuacauucagaguugagc

SEQ ID NO: 329050 - RNA, 32 nt, Human
aguuauuuuguaaacauaagcaaauaagggcu

SEQ ID NO: 329051 - RNA, 32 nt, Human
aguucaaaaccagccuggacaaucuggcgaaa

SEQ ID NO: 329052 - RNA, 32 nt, Human
aguucaaaaccagccuggccaacauggugaaa

SEQ ID NO: 329053 - RNA, 32 nt, Human
aguucaaaagaauaguagaagugauagugccg

SEQ ID NO: 329054 - RNA, 31 nt, Human
aguucaaagcgcagcuucuggaaaaggcugu

SEQ ID NO: 329055 - RNA, 32 nt, Human
aguucaaagcugugaaggauugggagauccug

SEQ ID NO: 329056 - RNA, 32 nt, Human
aguucaaagugaucagaggaaaccuaguuuua

SEQ ID NO: 329057 - RNA, 32 nt, Human
aguucaaaucugcagugcgcaaugauuauucc

SEQ ID NO: 329058 - RNA, 32 nt, Human
aguucaaauuccaggaagccacuuuuuauugg

SEQ ID NO: 329059 - RNA, 32 nt, Human
aguucaacaacaccagccugaccaacauggug

SEQ ID NO: 329060 - RNA, 32 nt, Human
aguucaaccacugcacuccacuaagcaacugg

SEQ ID NO: 329061 - RNA, 32 nt, Human
aguucaaccagccuggacaacaaagcaagacc

SEQ ID NO: 329062 - RNA, 32 nt, Human
aguucaaccuuaaaaugauguuagacaacagg

SEQ ID NO: 329063 - RNA, 32 nt, Human
aguucaacucacagccucggaacugauucaga

SEQ ID NO: 329064 - RNA, 32 nt, Human
aguucaacugauaacuacuccuccaggccccc

SEQ ID NO: 329065 - RNA, 32 nt, Human
aguucaagaccacccuggccaaccuggugaaa

SEQ ID NO: 329066 - RNA, 32 nt, Human
aguucaagaccagccuggccaacagggugaaa

SEQ ID NO: 329067 - RNA, 32 nt, Human
aguucaagaccagcugggcaccauagugagac

SEQ ID NO: 329068 - RNA, 21 nt, Human
aguucaagcccaggaccacca

SEQ ID NO: 329069 - RNA, 31 nt, Human
aguucaagccuuaauugacaugcagguguuu

SEQ ID NO: 329070 - RNA, 32 nt, Human
aguucaagcuuugugggcuuuuauagucucug

SEQ ID NO: 329071 - RNA, 18 nt, Human
aguucaaggcugcaguga

SEQ ID NO: 329072 - RNA, 32 nt, Human
aguucaaucaugugauuucacucaugaacaua

SEQ ID NO: 329073 - RNA, 32 nt, Human
aguucacaaggcagucagaagugauccaaagu

SEQ ID NO: 329074 - RNA, 32 nt, Human
aguucacaaugaauuuuuaugccuggguuucu

SEQ ID NO: 329075 - RNA, 32 nt, Human
aguucacacauaaacuguaaaucaagagaagg

SEQ ID NO: 329076 - RNA, 32 nt, Human
aguucacaccacugccauuuccuccugggcaa

SEQ ID NO: 329077 - RNA, 32 nt, Human
aguucacaccuguaaucccagcacuuugggag

SEQ ID NO: 329078 - RNA, 32 nt, Human
aguucacacuucaggagagaacuucauagcac

SEQ ID NO: 329079 - RNA, 32 nt, Human
aguucacaggauucagcucggagagcucugua

SEQ ID NO: 329080 - RNA, 32 nt, Human
aguucacaggcagaagcgagcugugacauugu

SEQ ID NO: 329081 - RNA, 32 nt, Human
aguucacagugcgcccucccucccucccaucu

SEQ ID NO: 329082 - RNA, 32 nt, Human
aguucacauucagcucagcagagcaagacccc

SEQ ID NO: 329083 - RNA, 32 nt, Human
aguucacauuggagaaaagccuuacuguacug

SEQ ID NO: 329084 - RNA, 32 nt, Human
aguucacauugggucuuuaaaucuuuuagaua

SEQ ID NO: 329085 - RNA, 32 nt, Human
aguucaccaugauccaauaugaccucaucuug

SEQ ID NO: 329086 - RNA, 21 nt, Human
aguucaccauuucaggucacu

SEQ ID NO: 329087 - RNA, 32 nt, Human
aguucaccccaaccuuugccucacggguucaa

SEQ ID NO: 329088 - RNA, 32 nt, Human
aguucaccccagggccccagagggccucauuu

SEQ ID NO: 329089 - RNA, 32 nt, Human
aguucaccccucaccuccagccuggaggagac

SEQ ID NO: 329090 - RNA, 31 nt, Human
aguucacccucacugggcccugugucccugu

SEQ ID NO: 329091 - RNA, 32 nt, Human
aguucacccucauacucucaggagacucuucu

SEQ ID NO: 329092 - RNA, 32 nt, Human
aguucaccuacccugagugaacacccccagcu

SEQ ID NO: 329093 - RNA, 32 nt, Human
aguucaccugaaccuucucuucugcacaugga

SEQ ID NO: 329094 - RNA, 32 nt, Human
aguucaccuuaacauguaaauccacaggguag

SEQ ID NO: 329095 - RNA, 32 nt, Human
aguucacuccucuccagguggagcugccgccg

SEQ ID NO: 329096 - RNA, 32 nt, Human
aguucacucugucuuccugagcaguggaagau

SEQ ID NO: 329097 - RNA, 32 nt, Human
aguucacugcaaccuccacccugcagguucaa

SEQ ID NO: 329098 - RNA, 32 nt, Human
aguucacugcaaccuccaccucccagguucaa

SEQ ID NO: 329099 - RNA, 32 nt, Human
aguucacugcaaccuccacuuccuagguucaa

SEQ ID NO: 329100 - RNA, 32 nt, Human
aguucacugcaaccucugccucccacguucaa

SEQ ID NO: 329101 - RNA, 32 nt, Human
aguucacugcaaccucugccucccggguucaa

SEQ ID NO: 329102 - RNA, 32 nt, Human
aguucacugcaaccucugccuccuaaguucag

SEQ ID NO: 329103 - RNA, 32 nt, Human
aguucacugcaaccucugccuccuggguucaa

SEQ ID NO: 329104 - RNA, 32 nt, Human
aguucacugcaacuuccgcuucccagguucaa

SEQ ID NO: 329105 - RNA, 32 nt, Human
aguucacugcaacuucugccucccgaguucaa

SEQ ID NO: 329106 - RNA, 32 nt, Human
aguucacugcaagcuccgccuccucguuucaa

SEQ ID NO: 329107 - RNA, 32 nt, Human
aguucacugcagccuccgcccuccagguucaa

SEQ ID NO: 329108 - RNA, 32 nt, Human
aguucacugcagccucgaccucccaggcucaa

SEQ ID NO: 329109 - RNA, 32 nt, Human
aguucacugcagucucugccuccuugguucaa

SEQ ID NO: 329110 - RNA, 24 nt, Human
aguucacugcccaugugauacuga

SEQ ID NO: 329111 - RNA, 32 nt, Human
aguucacugcugcuuucccuccugggcucaag

SEQ ID NO: 329112 - RNA, 32 nt, Human
aguucacuggagggcccagccuggggaaagga

SEQ ID NO: 329113 - RNA, 32 nt, Human
aguucacuguacccuguuccuccugggcucaa

SEQ ID NO: 329114 - RNA, 32 nt, Human
aguucacuuuauugugagucuuugccacauuu

SEQ ID NO: 329115 - RNA, 32 nt, Human
aguucagaaaaaugauguugaauuguguguuu

SEQ ID NO: 329116 - RNA, 32 nt, Human
aguucagaaagaaaugucuuuauacaaaagac

SEQ ID NO: 329117 - RNA, 32 nt, Human
aguucagaacuuaaguaucagugcaaauuucu

SEQ ID NO: 329118 - RNA, 32 nt, Human
aguucagaagguguguccuugaacugaggccc

SEQ ID NO: 329119 - RNA, 32 nt, Human
aguucagacacaccgugcucaggagggaccca

SEQ ID NO: 329120 - RNA, 32 nt, Human
aguucagaccaccaccgucgcucuccuaccca

SEQ ID NO: 329121 - RNA, 32 nt, Human
aguucagacuagccacauuccaagugcuuaau

SEQ ID NO: 329122 - RNA, 32 nt, Human
aguucagagaaaagagauggaagagggaggaa

SEQ ID NO: 329123 - RNA, 32 nt, Human
aguucagagccgcgcaccgcccgccgccgcag

SEQ ID NO: 329124 - RNA, 32 nt, Human
aguucagagcugcccucuccugggcauggccu

SEQ ID NO: 329125 - RNA, 32 nt, Human
aguucagauaaauugcacuuggucaacggaaa

SEQ ID NO: 329126 - RNA, 32 nt, Human
aguucagaucgagucagaggccaaggaggaga

SEQ ID NO: 329127 - RNA, 32 nt, Human
aguucagcaaagcugcgcugggcacagcaugc

SEQ ID NO: 329128 - RNA, 32 nt, Human
aguucagcaaaucuauugaagucauugagaag

SEQ ID NO: 329129 - RNA, 32 nt, Human
aguucagcaagaaguguugaguguguacaaag

SEQ ID NO: 329130 - RNA, 32 nt, Human
aguucagcccuaggggaccucuuucuccugga

SEQ ID NO: 329131 - RNA, 32 nt, Human
aguucagcuccucuguggaugcguccccagau

SEQ ID NO: 329132 - RNA, 32 nt, Human
aguucagcugcacaugaauagaacagcaauga

SEQ ID NO: 329133 - RNA, 32 nt, Human
aguucaggcacugucuaaagccccaggcuggg

SEQ ID NO: 329134 - RNA, 32 nt, Human
aguucaggcccagauuguuccaggaucaaccc

SEQ ID NO: 329135 - RNA, 32 nt, Human
aguucaggcugucucaucccuugccaggagcu

SEQ ID NO: 329136 - RNA, 32 nt, Human
  misc_feature (30)..(30): n is a, c, g or u
aguucaggcuuagaggcuuaucgcuaagunua

SEQ ID NO: 329137 - RNA, 32 nt, Human
aguucagggauuacaggcaugagccaccaugc

SEQ ID NO: 329138 - RNA, 32 nt, Human
aguucagggcucacucauccuacuucaucagc

SEQ ID NO: 329139 - RNA, 32 nt, Human
aguucagucaucuggugcaccagcugcuggaa

SEQ ID NO: 329140 - RNA, 32 nt, Human
aguucagugagaauguuuauguuuacaacuag

SEQ ID NO: 329141 - RNA, 32 nt, Human
aguucagugcaaucuccgccuccuggguucaa

SEQ ID NO: 329142 - RNA, 32 nt, Human
aguucagugcuauuguauaucuuguuagagca

SEQ ID NO: 329143 - RNA, 32 nt, Human
aguucagugucugcgucuaagagagcacuuug

SEQ ID NO: 329144 - RNA, 32 nt, Human
aguucagugucugcgucuaagagaguacuuug

SEQ ID NO: 329145 - RNA, 19 nt, Human
aguucaguucucaccaugg

SEQ ID NO: 329146 - RNA, 32 nt, Human
aguucaguucucaccauggagugaguggccuu

SEQ ID NO: 329147 - RNA, 32 nt, Human
aguucaguugggcuuagcugggcaguucuggu

SEQ ID NO: 329148 - RNA, 32 nt, Human
aguucauagaggcagaggguggggaagggcug

SEQ ID NO: 329149 - RNA, 32 nt, Human
aguucauagguuauaagagguaaguugaacaa

SEQ ID NO: 329150 - RNA, 32 nt, Human
aguucauagugaaguuuccacugugagcggca

SEQ ID NO: 329151 - RNA, 32 nt, Human
aguucauaucuagccuggucaacauagcaaga

SEQ ID NO: 329152 - RNA, 32 nt, Human
aguucaucuagguuuuguugagcacuggccac

SEQ ID NO: 329153 - RNA, 32 nt, Human
aguucaucuccacguuuauuuuaccaagagau

SEQ ID NO: 329154 - RNA, 32 nt, Human
aguucaucucccagcugcaggcacuucagaaa

SEQ ID NO: 329155 - RNA, 19 nt, Human
aguucaucuucauugcaga

SEQ ID NO: 329156 - RNA, 32 nt, Human
aguucaucuucuaauguccucauccugguuuc

SEQ ID NO: 329157 - RNA, 32 nt, Human
aguucaugauguggauuugaauucagcuuuca

SEQ ID NO: 329158 - RNA, 32 nt, Human
aguucaugcaaccuccgccuccuggguucaag

SEQ ID NO: 329159 - RNA, 32 nt, Human
aguucaugcaaguucgaaggugccucuuguca

SEQ ID NO: 329160 - RNA, 32 nt, Human
aguucaugcaauugcacuccagccugggcaac

SEQ ID NO: 329161 - RNA, 21 nt, Human
aguucaugcccaaguccccag

SEQ ID NO: 329162 - RNA, 32 nt, Human
aguucaugcccuguaauccuagaacuuuggga

SEQ ID NO: 329163 - RNA, 32 nt, Human
aguucaugcccuguaauccuagcacuuuggga

SEQ ID NO: 329164 - RNA, 32 nt, Human
aguucaugccuguagcucucuuccuuuuguuu

SEQ ID NO: 329165 - RNA, 32 nt, Human
aguucauggcuuccuguggauucccucccucc

SEQ ID NO: 329166 - RNA, 21 nt, Human
aguucaugucugcuaucauua

SEQ ID NO: 329167 - RNA, 29 nt, Human
aguucaugucugcuaucauuauucguaga

SEQ ID NO: 329168 - RNA, 32 nt, Human
aguucaugugguucuuugugaggcagagcggg

SEQ ID NO: 329169 - RNA, 32 nt, Human
aguucauguuuuucuguagcacugggcccaaa

SEQ ID NO: 329170 - RNA, 32 nt, Human
aguucauuaccucccuaucaguucuagcauag

SEQ ID NO: 329171 - RNA, 32 nt, Human
aguucauucugggucgcagccaugaaguguca

SEQ ID NO: 329172 - RNA, 32 nt, Human
aguucauuuccaaucccagaacacauggaggg

SEQ ID NO: 329173 - RNA, 32 nt, Human
aguucauuuccagagaagguaaaccccacuua

SEQ ID NO: 329174 - RNA, 32 nt, Human
aguucauuuccugagguggauuuacugagaga

SEQ ID NO: 329175 - RNA, 32 nt, Human
aguucauuucuuugggguaguguccuuacaag

SEQ ID NO: 329176 - RNA, 32 nt, Human
aguucauuuucagcaaaccuucagagggugaa

SEQ ID NO: 329177 - RNA, 32 nt, Human
aguuccaacuccaggaagucaccauucaaaga

SEQ ID NO: 329178 - RNA, 32 nt, Human
aguuccaacuucugcuaaaauugguuaauugg

SEQ ID NO: 329179 - RNA, 24 nt, Human
aguuccaagauugacaacagagaa

SEQ ID NO: 329180 - RNA, 32 nt, Human
aguuccaagugaggacauggaagaggccaaaa

SEQ ID NO: 329181 - RNA, 32 nt, Human
aguuccaagugaugcagucucuucccagccca

SEQ ID NO: 329182 - RNA, 32 nt, Human
aguuccacaaaugguggguacaaaaagucaag

SEQ ID NO: 329183 - RNA, 32 nt, Human
aguuccacagaucaaagacaaacugaugauaa

SEQ ID NO: 329184 - RNA, 32 nt, Human
aguuccacaugcuggauuauggugguuuuaug

SEQ ID NO: 329185 - RNA, 32 nt, Human
aguuccaccaugagcucacccgugucuaugac

SEQ ID NO: 329186 - RNA, 32 nt, Human
aguuccaccgguaccagcguccuggcccacgg

SEQ ID NO: 329187 - RNA, 32 nt, Human
aguuccacgugucaaaacaauuacaguuacua

SEQ ID NO: 329188 - RNA, 32 nt, Human
aguuccacucaacaccagaucaagcaauucua

SEQ ID NO: 329189 - RNA, 32 nt, Human
aguuccacugcacuccagccuggguuacagag

SEQ ID NO: 329190 - RNA, 32 nt, Human
aguuccagaccacccuccaugcuccaccccca

SEQ ID NO: 329191 - RNA, 32 nt, Human
aguuccagcccuggugacagaggagaccccgu

SEQ ID NO: 329192 - RNA, 32 nt, Human
aguuccagcuacucaggaagcugaggcaggag

SEQ ID NO: 329193 - RNA, 32 nt, Human
aguuccagcuacucaggacacugacguaggag

SEQ ID NO: 329194 - RNA, 32 nt, Human
aguuccagcuacucaggaggcagaggugagag

SEQ ID NO: 329195 - RNA, 32 nt, Human
aguuccagcuacucaggaggcuaaggcaggag

SEQ ID NO: 329196 - RNA, 32 nt, Human
aguuccagcuacucaggaggcuaaggcgggag

SEQ ID NO: 329197 - RNA, 32 nt, Human
aguuccagcuacucaggaggcugaagugggag

SEQ ID NO: 329198 - RNA, 32 nt, Human
aguuccagcuacucaggaggcugaggcaagag

SEQ ID NO: 329199 - RNA, 32 nt, Human
aguuccagcuacucaggaggcugaggcaggag

SEQ ID NO: 329200 - RNA, 32 nt, Human
aguuccagcuacucaggaggcugaggcuagag

SEQ ID NO: 329201 - RNA, 32 nt, Human
aguuccagcuacucaggaggcugaggugggag

SEQ ID NO: 329202 - RNA, 32 nt, Human
aguuccagcuacucaguaggcugaggcagaag

SEQ ID NO: 329203 - RNA, 32 nt, Human
aguuccagcuacucggagacugaggcaggaga

SEQ ID NO: 329204 - RNA, 32 nt, Human
aguuccagcuacucgggaggcugaggcaagag

SEQ ID NO: 329205 - RNA, 32 nt, Human
aguuccagcuacucgggaggcugaggcaggau

SEQ ID NO: 329206 - RNA, 32 nt, Human
aguuccagcuacucgggaggcugaggugaaag

SEQ ID NO: 329207 - RNA, 32 nt, Human
aguuccagcuacucgggagucugaggcagagg

SEQ ID NO: 329208 - RNA, 18 nt, Human
aguuccagcuacuugaga

SEQ ID NO: 329209 - RNA, 32 nt, Human
aguuccagcuacuugagaggcugaggcaggag

SEQ ID NO: 329210 - RNA, 32 nt, Human
aguuccagcuacuugggaggcagaggcaggag

SEQ ID NO: 329211 - RNA, 32 nt, Human
aguuccagcuacuugggaggcugaagcaggag

SEQ ID NO: 329212 - RNA, 32 nt, Human
aguuccagcuacuugggaggcugagacaggcg

SEQ ID NO: 329213 - RNA, 32 nt, Human
aguuccagcuacuugggaggcugaggcagcau

SEQ ID NO: 329214 - RNA, 32 nt, Human
aguuccagcuacuugggaggcugaggcaggag

SEQ ID NO: 329215 - RNA, 32 nt, Human
aguuccagcuacuugggaggcugaggugggaa

SEQ ID NO: 329216 - RNA, 32 nt, Human
aguuccagcuacuugugaggcugaggugggag

SEQ ID NO: 329217 - RNA, 32 nt, Human
aguuccagcuggugcuucuuuauauuuagaaa

SEQ ID NO: 329218 - RNA, 32 nt, Human
aguuccaggaacacaaaccccaacaagaucca

SEQ ID NO: 329219 - RNA, 32 nt, Human
aguuccaggaagaguuuuccagccuagccuga

SEQ ID NO: 329220 - RNA, 32 nt, Human
aguuccaggagaaggaagacucuugccuuuuu

SEQ ID NO: 329221 - RNA, 32 nt, Human
aguuccaggauacaugugcaggaugugcaggu

SEQ ID NO: 329222 - RNA, 32 nt, Human
aguuccaguucugcaaagauucgucaacuuuc

SEQ ID NO: 329223 - RNA, 32 nt, Human
aguuccauacaaggagcucccuaucguccggg

SEQ ID NO: 329224 - RNA, 32 nt, Human
aguuccaucaaaagaaccagaguaguguucuu

SEQ ID NO: 329225 - RNA, 32 nt, Human
aguuccaucauguuggccaggcuggucuugaa

SEQ ID NO: 329226 - RNA, 32 nt, Human
aguuccauguacuguaaauauuuuucacauaa

SEQ ID NO: 329227 - RNA, 32 nt, Human
aguuccauugucagcacagccuaggaggguca

SEQ ID NO: 329228 - RNA, 32 nt, Human
aguuccauuuguauucuggcugggugaugagc

SEQ ID NO: 329229 - RNA, 22 nt, Human
aguucccaaauaaaucaauccu

SEQ ID NO: 329230 - RNA, 31 nt, Human
aguucccaaguguccaacaagaaggccuggu

SEQ ID NO: 329231 - RNA, 32 nt, Human
aguucccacugaggagccagcuguaggugaga

SEQ ID NO: 329232 - RNA, 32 nt, Human
aguucccagccagccaauggaugccagcacca

SEQ ID NO: 329233 - RNA, 32 nt, Human
aguucccaggaauauuugagggguuccgguga

SEQ ID NO: 329234 - RNA, 32 nt, Human
aguucccaggcuaggucauagaaggugaugca

SEQ ID NO: 329235 - RNA, 32 nt, Human
aguucccagguggaaggggugugccaggaggg

SEQ ID NO: 329236 - RNA, 32 nt, Human
aguucccaucaccaccaccaccaccaccacca

SEQ ID NO: 329237 - RNA, 32 nt, Human
aguucccaugccagcucuccccaagugcucca

SEQ ID NO: 329238 - RNA, 32 nt, Human
aguucccaugucccagccuggccuguggcugc

SEQ ID NO: 329239 - RNA, 32 nt, Human
aguuccccagcccuccacauucuuccaauggc

SEQ ID NO: 329240 - RNA, 32 nt, Human
aguuccccagccuggaggcucugguggagaac

SEQ ID NO: 329241 - RNA, 32 nt, Human
aguuccccagcuugaugguuucugagcuaagu

SEQ ID NO: 329242 - RNA, 32 nt, Human
aguuccccuccccuccccucccucuuuuuagu

SEQ ID NO: 329243 - RNA, 32 nt, Human
aguucccgccugccucccagcagccucaacag

SEQ ID NO: 329244 - RNA, 32 nt, Human
aguucccgggaggacauggacagggaaggaga

SEQ ID NO: 329245 - RNA, 32 nt, Human
aguucccgugugugccuggugugugggacgcu

SEQ ID NO: 329246 - RNA, 32 nt, Human
aguucccuacagccauccccagucaaggguga

SEQ ID NO: 329247 - RNA, 32 nt, Human
aguucccuccagcugcagagagcuucaguuug

SEQ ID NO: 329248 - RNA, 32 nt, Human
aguucccuccaggagcaaugacagucuuuauu

SEQ ID NO: 329249 - RNA, 32 nt, Human
aguucccucuuccuggccucuggaaccagccu

SEQ ID NO: 329250 - RNA, 32 nt, Human
aguucccucuuguagagccacaggguuaaaag

SEQ ID NO: 329251 - RNA, 32 nt, Human
aguucccugcccauaggcauugcccaggauag

SEQ ID NO: 329252 - RNA, 32 nt, Human
aguucccugcggccucugccuuggggaguuau

SEQ ID NO: 329253 - RNA, 32 nt, Human
aguucccuggacagagcuaaacucucgagacu

SEQ ID NO: 329254 - RNA, 32 nt, Human
aguucccuguaauccuaccaucuagggagaua

SEQ ID NO: 329255 - RNA, 32 nt, Human
aguucccuguaauccugccaucuagggagaua

SEQ ID NO: 329256 - RNA, 32 nt, Human
aguucccuguauggguggauguccucaggggc

SEQ ID NO: 329257 - RNA, 32 nt, Human
aguucccuuccaggaagccugcagcguucacg

SEQ ID NO: 329258 - RNA, 32 nt, Human
aguucccuucuuguggugccucuuucccagau

SEQ ID NO: 329259 - RNA, 32 nt, Human
aguucccuugacuucccuuuugagagcacacg

SEQ ID NO: 329260 - RNA, 32 nt, Human
aguuccgacacacgccacacaaaaaugaaccu

SEQ ID NO: 329261 - RNA, 32 nt, Human
aguuccgcacaucccuucuacccuccaacugc

SEQ ID NO: 329262 - RNA, 32 nt, Human
aguuccgcauccucaggcgccagccuguccag

SEQ ID NO: 329263 - RNA, 32 nt, Human
aguuccggcagccugcagugcugguccugcag

SEQ ID NO: 329264 - RNA, 32 nt, Human
aguuccggcagcuuuccccaggaaagggugag

SEQ ID NO: 329265 - RNA, 32 nt, Human
aguuccuagaggcaucuggcagcaagaaggug

SEQ ID NO: 329266 - RNA, 32 nt, Human
aguuccuaggcagaggggaagccccagcgccg

SEQ ID NO: 329267 - RNA, 32 nt, Human
aguuccuauuagccauuaccacugauuucuga

SEQ ID NO: 329268 - RNA, 32 nt, Human
aguuccucacucgccuccuaucaugccgauga

SEQ ID NO: 329269 - RNA, 32 nt, Human
aguuccuccaauuccaucuucucccauggaac

SEQ ID NO: 329270 - RNA, 32 nt, Human
aguuccuccaauuccauuuucucccauggaau

SEQ ID NO: 329271 - RNA, 32 nt, Human
aguuccuccagcaaagcccagaacagaguugu

SEQ ID NO: 329272 - RNA, 32 nt, Human
aguuccucccaguuccagagcaccucaggaca

SEQ ID NO: 329273 - RNA, 32 nt, Human
aguuccuccucuuccuccacgucauccuccuc

SEQ ID NO: 329274 - RNA, 32 nt, Human
aguuccucuaacuguagaguaaggauaauaau

SEQ ID NO: 329275 - RNA, 31 nt, Human
aguuccucuagccgggagguuggaggagcug

SEQ ID NO: 329276 - RNA, 32 nt, Human
aguuccucuagugcccuccacagccgcagccu

SEQ ID NO: 329277 - RNA, 32 nt, Human
aguuccucucgccagccgcauccaugcuucug

SEQ ID NO: 329278 - RNA, 32 nt, Human
aguuccucuggugggagggagaacgcacaucu

SEQ ID NO: 329279 - RNA, 32 nt, Human
aguuccugcccaggaccauguguguggaugcu

SEQ ID NO: 329280 - RNA, 32 nt, Human
aguuccugcucucauccuccccugcccugaug

SEQ ID NO: 329281 - RNA, 32 nt, Human
aguuccugcuucuguauggcaagcauaaauca

SEQ ID NO: 329282 - RNA, 32 nt, Human
aguuccugcuuugaugugacaugugacucccc

SEQ ID NO: 329283 - RNA, 32 nt, Human
aguuccugggcagaggggaaagcagcucccag

SEQ ID NO: 329284 - RNA, 32 nt, Human
aguuccuggugcucaaagaguuccaacaccug

SEQ ID NO: 329285 - RNA, 32 nt, Human
aguuccuguaacauuaccuccacacaacugca

SEQ ID NO: 329286 - RNA, 32 nt, Human
aguuccuguacaagguuccuggccugugggaa

SEQ ID NO: 329287 - RNA, 31 nt, Human
aguuccuguggccaggagguuggugacugaa

SEQ ID NO: 329288 - RNA, 32 nt, Human
aguuccugugugucuugaugucugacugguuc

SEQ ID NO: 329289 - RNA, 23 nt, Human
aguuccuuacaccaccaaagcac

SEQ ID NO: 329290 - RNA, 32 nt, Human
aguuccuuaccucccugguccccguuugucaa

SEQ ID NO: 329291 - RNA, 32 nt, Human
aguuccuuacuacccagagacuucaguguccu

SEQ ID NO: 329292 - RNA, 32 nt, Human
aguuccuucugcgcuuuguucaagaugugggu

SEQ ID NO: 329293 - RNA, 32 nt, Human
aguuccuucuucugcuauccccaaaaccucag

SEQ ID NO: 329294 - RNA, 32 nt, Human
aguuccuugcaacuuagccaugaugugagugg

SEQ ID NO: 329295 - RNA, 32 nt, Human
aguuccuuguuaggccucuccuuccgaugaaa

SEQ ID NO: 329296 - RNA, 23 nt, Human
aguuccuuguucugagucauuuu

SEQ ID NO: 329297 - RNA, 32 nt, Human
aguucgaaaccagccuggccaacauagugaaa

SEQ ID NO: 329298 - RNA, 32 nt, Human
aguucgaaaccagccuggccaacauggagaaa

SEQ ID NO: 329299 - RNA, 32 nt, Human
aguucgaaaccagccuggccaacauggggaaa

SEQ ID NO: 329300 - RNA, 32 nt, Human
aguucgaaaccagccuggccaacauggugaaa

SEQ ID NO: 329301 - RNA, 32 nt, Human
aguucgaacagcuguuugacugugagaauuag

SEQ ID NO: 329302 - RNA, 32 nt, Human
aguucgaaccagccuggccaacauggugaaac

SEQ ID NO: 329303 - RNA, 32 nt, Human
aguucgacucagaaccuugacauggccauaac

SEQ ID NO: 329304 - RNA, 32 nt, Human
aguucgagaacuaagcaaauuagcugagacca

SEQ ID NO: 329305 - RNA, 32 nt, Human
aguucgagaccaaccuccaacauggugaaacc

SEQ ID NO: 329306 - RNA, 32 nt, Human
aguucgagaccacccugaccaacauagagaaa

SEQ ID NO: 329307 - RNA, 32 nt, Human
aguucgagaccacccugggcaacacagugaga

SEQ ID NO: 329308 - RNA, 32 nt, Human
aguucgagaccagccuagccaacauggugaac

SEQ ID NO: 329309 - RNA, 32 nt, Human
aguucgagaccagccuggccaaaauagugaaa

SEQ ID NO: 329310 - RNA, 32 nt, Human
aguucgagaccagccugggcaacagagacccu

SEQ ID NO: 329311 - RNA, 32 nt, Human
aguucgagaccagccugggcaacagcaagacc

SEQ ID NO: 329312 - RNA, 32 nt, Human
aguucgagaccagccuugccaacauagugaaa

SEQ ID NO: 329313 - RNA, 32 nt, Human
aguucgagaccagcuuagccaauauggugaaa

SEQ ID NO: 329314 - RNA, 32 nt, Human
aguucgagaccagcuuaggcaacacggugaaa

SEQ ID NO: 329315 - RNA, 32 nt, Human
aguucgagaccagcuuggccaacaugucgaaa

SEQ ID NO: 329316 - RNA, 32 nt, Human
aguucgauuugccuaguaucccugcagcaauu

SEQ ID NO: 329317 - RNA, 32 nt, Human
aguucgcaugccacugcacuccagccugggcg

SEQ ID NO: 329318 - RNA, 32 nt, Human
aguucgccuuuauucugcacaggacagaauuc

SEQ ID NO: 329319 - RNA, 32 nt, Human
aguucgcucacuggauccuuccucucugauga

SEQ ID NO: 329320 - RNA, 32 nt, Human
aguucggaagacauuucucuguuugcaaggac

SEQ ID NO: 329321 - RNA, 32 nt, Human
aguucggcucugggugggcaguaggaccacca

SEQ ID NO: 329322 - RNA, 32 nt, Human
aguucggggccgcggcgggcgggcgcccggga

SEQ ID NO: 329323 - RNA, 32 nt, Human
aguucgggggcagagugggggaaucaggcuuu

SEQ ID NO: 329324 - RNA, 32 nt, Human
aguucggugugggcuuccacuaaggcacuugu

SEQ ID NO: 329325 - RNA, 32 nt, Human
aguucgguucucucccacagccagagcuggug

SEQ ID NO: 329326 - RNA, 32 nt, Human
aguucgucaccccacagaaacguacccaagau

SEQ ID NO: 329327 - RNA, 32 nt, Human
aguucgucagaacuuaaauacugaggaagaag

SEQ ID NO: 329328 - RNA, 32 nt, Human
aguucgugccaucggacuccagccugggugaa

SEQ ID NO: 329329 - RNA, 32 nt, Human
aguucgugccauuacacuccagccugggugac

SEQ ID NO: 329330 - RNA, 32 nt, Human
aguucguggucacugcacuccagccuggcuac

SEQ ID NO: 329331 - RNA, 32 nt, Human
aguucguggugacuuauggcagcccuaggaaa

SEQ ID NO: 329332 - RNA, 32 nt, Human
aguucguuacucagauaacauggcaguggccg

SEQ ID NO: 329333 - RNA, 32 nt, Human
aguucguuccaaguuacuuucugagguauuuu

SEQ ID NO: 329334 - RNA, 32 nt, Human
aguucuaaaacaauggcccaggguuuggugac

SEQ ID NO: 329335 - RNA, 32 nt, Human
aguucuaaaaugcuauuguggguuucuucugu

SEQ ID NO: 329336 - RNA, 31 nt, Human
aguucuaagagaccuccuucugggcuuaccc

SEQ ID NO: 329337 - RNA, 32 nt, Human
aguucuaauaaguggcaagcugcucugccggg

SEQ ID NO: 329338 - RNA, 32 nt, Human
aguucuaauucauauauuuaacaaacaugaug

SEQ ID NO: 329339 - RNA, 32 nt, Human
aguucuacacagaagugggagagacaaccacg

SEQ ID NO: 329340 - RNA, 32 nt, Human
aguucuacagccucaugcuggagcugagcaaa

SEQ ID NO: 329341 - RNA, 32 nt, Human
aguucuacccuuggcauacucagcauuccuca

SEQ ID NO: 329342 - RNA, 32 nt, Human
aguucuaccuuugggauagggcugcuuucccc

SEQ ID NO: 329343 - RNA, 32 nt, Human
aguucuacuuagaacuuuucauggacacaauu

SEQ ID NO: 329344 - RNA, 32 nt, Human
aguucuagagugagagaaagggagucaggcac

SEQ ID NO: 329345 - RNA, 32 nt, Human
aguucuagauugaucucugaaugugaucgacg

SEQ ID NO: 329346 - RNA, 32 nt, Human
aguucuagcuacucuggaggcugaggcaggag

SEQ ID NO: 329347 - RNA, 32 nt, Human
aguucuaggauuacaggugugagccaccacgu

SEQ ID NO: 329348 - RNA, 32 nt, Human
aguucuauauucacauaugcaaaccuccugcc

SEQ ID NO: 329349 - RNA, 32 nt, Human
aguucuaucuaagaaauggcauucuguagguu

SEQ ID NO: 329350 - RNA, 32 nt, Human
aguucuaugguuuuguuucacuucuuuucuuu

SEQ ID NO: 329351 - RNA, 32 nt, Human
aguucucaauccagggaaagggcugcuaacua

SEQ ID NO: 329352 - RNA, 32 nt, Human
aguucucacagaacuucuaucauuuuaaacug

SEQ ID NO: 329353 - RNA, 32 nt, Human
aguucucagaguggucaggauggcuugaccug

SEQ ID NO: 329354 - RNA, 32 nt, Human
aguucucaggagacauggaugguguucuaagg

SEQ ID NO: 329355 - RNA, 32 nt, Human
aguucucaucccucugucagggucaguaagga

SEQ ID NO: 329356 - RNA, 32 nt, Human
aguucucaugcugcccuugggugggcaucugu

SEQ ID NO: 329357 - RNA, 32 nt, Human
aguucuccacuccaaugauaauaguucacuua

SEQ ID NO: 329358 - RNA, 32 nt, Human
aguucuccagaacuuuucuucuguaaaggaua

SEQ ID NO: 329359 - RNA, 32 nt, Human
aguucuccagacaggguucauugaaaacuuag

SEQ ID NO: 329360 - RNA, 32 nt, Human
aguucuccagcacugagguggggcagauaacg

SEQ ID NO: 329361 - RNA, 28 nt, Human
aguucuccaguugcugccuccuugucuu

SEQ ID NO: 329362 - RNA, 32 nt, Human
aguucucccaacaacaugaaacugccuauuca

SEQ ID NO: 329363 - RNA, 32 nt, Human
aguucucccuaaggauggugcggucaauggac

SEQ ID NO: 329364 - RNA, 32 nt, Human
aguucucccugccccucagccugggggaagaa

SEQ ID NO: 329365 - RNA, 32 nt, Human
aguucuccgaguagcugggaccacauguguaa

SEQ ID NO: 329366 - RNA, 32 nt, Human
aguucuccuccacaucucccaucccagaauca

SEQ ID NO: 329367 - RNA, 32 nt, Human
aguucuccuccacuguuugaccaaauucucag

SEQ ID NO: 329368 - RNA, 20 nt, Human
aguucuccuccuugaucacc

SEQ ID NO: 329369 - RNA, 32 nt, Human
aguucuccugggacagugggcucugcauguuc

SEQ ID NO: 329370 - RNA, 32 nt, Human
aguucuccugggcuccagccuccugcaaggac

SEQ ID NO: 329371 - RNA, 32 nt, Human
aguucuccuucaggaucaugauguucgucaga

SEQ ID NO: 329372 - RNA, 32 nt, Human
aguucuccuuucucaccacucuccugcuagcc

SEQ ID NO: 329373 - RNA, 32 nt, Human
aguucucgcaucuucugcuccuaccuucuccu

SEQ ID NO: 329374 - RNA, 32 nt, Human
aguucucgcucucccuuccucccagcgggguc

SEQ ID NO: 329375 - RNA, 32 nt, Human
aguucucggauuacaggcgugagccacugcgc

SEQ ID NO: 329376 - RNA, 32 nt, Human
aguucucggccccggcuuucuuccaagaguug

SEQ ID NO: 329377 - RNA, 32 nt, Human
aguucucgggcgcgcacaggcagcucgguuug

SEQ ID NO: 329378 - RNA, 32 nt, Human
aguucucgucugucccuagcagucuuucuuca

SEQ ID NO: 329379 - RNA, 32 nt, Human
aguucucucagcccauuccccaccuccccuuc

SEQ ID NO: 329380 - RNA, 32 nt, Human
aguucucuccaccucucuaucuaugucucagu

SEQ ID NO: 329381 - RNA, 32 nt, Human
aguucucugggaacuugaaagacauuuaugcc

SEQ ID NO: 329382 - RNA, 32 nt, Human
aguucucuggguauuccuuuccuucacugugg

SEQ ID NO: 329383 - RNA, 32 nt, Human
aguucucuguggugaugaccgcucuccccugc

SEQ ID NO: 329384 - RNA, 32 nt, Human
aguucucuugugaacacuucaaacaucgcuaa

SEQ ID NO: 329385 - RNA, 32 nt, Human
aguucugaacaagacaagacugucauauugua

SEQ ID NO: 329386 - RNA, 32 nt, Human
aguucugaagucaaaggcugauguccuguuuc

SEQ ID NO: 329387 - RNA, 32 nt, Human
aguucugacccugagcccuggggaacaggaaa

SEQ ID NO: 329388 - RNA, 20 nt, Human
aguucugagcaaaucccuca

SEQ ID NO: 329389 - RNA, 32 nt, Human
aguucugcacacugaggaaaagcacuuccuga

SEQ ID NO: 329390 - RNA, 20 nt, Human
aguucugcagcaugcagcgg

SEQ ID NO: 329391 - RNA, 32 nt, Human
aguucugcagggaaaugacuuacuuguccuua

SEQ ID NO: 329392 - RNA, 32 nt, Human
aguucugccaucaccuccacuguaccaagacu

SEQ ID NO: 329393 - RNA, 32 nt, Human
aguucugccucuguccagguccuugugacccg

SEQ ID NO: 329394 - RNA, 32 nt, Human
aguucugccuugaguccugccaguguagaugg

SEQ ID NO: 329395 - RNA, 32 nt, Human
aguucugcuacaaccucuagaucugcagcuug

SEQ ID NO: 329396 - RNA, 32 nt, Human
aguucugcucgguuucccuugugaucagucca

SEQ ID NO: 329397 - RNA, 32 nt, Human
aguucugcuuccucuuauaaguacacaacuca

SEQ ID NO: 329398 - RNA, 32 nt, Human
aguucuggaaagucauugacaggggauuaacc

SEQ ID NO: 329399 - RNA, 32 nt, Human
aguucuggaaauugaaaagaagaaaaguaaag

SEQ ID NO: 329400 - RNA, 32 nt, Human
aguucuggaaggcagugggguuugagauugga

SEQ ID NO: 329401 - RNA, 32 nt, Human
aguucuggacagcugcucugcagauucuuaua

SEQ ID NO: 329402 - RNA, 32 nt, Human
aguucuggauguggaggaaccaguaggagacc

SEQ ID NO: 329403 - RNA, 30 nt, Human
aguucugggaauuuacaggcacaauacacu

SEQ ID NO: 329404 - RNA, 32 nt, Human
aguucugggaccccaccucagacaucugaccc

SEQ ID NO: 329405 - RNA, 32 nt, Human
aguucugggaggagacauugucuucagacuac

SEQ ID NO: 329406 - RNA, 32 nt, Human
aguucugggauacaugugcaggaugugcaggu

SEQ ID NO: 329407 - RNA, 32 nt, Human
aguucugggauuaaaugcgugagccaccaugc

SEQ ID NO: 329408 - RNA, 32 nt, Human
aguucugggauuacaagugugaaccaccgugc

SEQ ID NO: 329409 - RNA, 32 nt, Human
aguucugggauuacaagugugagccacugugc

SEQ ID NO: 329410 - RNA, 32 nt, Human
aguucugggauuacaggagugagccaccgcgc

SEQ ID NO: 329411 - RNA, 32 nt, Human
aguucugggauuacaggcaugagccaccaugc

SEQ ID NO: 329412 - RNA, 32 nt, Human
aguucugggauuacaggcaugagccaccgugc

SEQ ID NO: 329413 - RNA, 32 nt, Human
aguucugggauuacaggcaugagccacugugc

SEQ ID NO: 329414 - RNA, 32 nt, Human
aguucugggauuacaggcgugagccacacacu

SEQ ID NO: 329415 - RNA, 32 nt, Human
aguucugggauuacaggcgugagccaccgcgc

SEQ ID NO: 329416 - RNA, 32 nt, Human
aguucugggauuacaggcgugagccauggugc

SEQ ID NO: 329417 - RNA, 32 nt, Human
aguucugggauuacaggcuugagccacugcgc

SEQ ID NO: 329418 - RNA, 32 nt, Human
aguucugggauuacaggggugagccacugugc

SEQ ID NO: 329419 - RNA, 32 nt, Human
aguucugggauuacaggguguugagccacucu

SEQ ID NO: 329420 - RNA, 32 nt, Human
aguucugggauuacagguaugagccacaacac

SEQ ID NO: 329421 - RNA, 19 nt, Human
aguucugggauuacaggug

SEQ ID NO: 329422 - RNA, 32 nt, Human
aguucugggauuacaggugugagccaccgcgc

SEQ ID NO: 329423 - RNA, 32 nt, Human
aguucugggauuacaggugugagccaccgugc

SEQ ID NO: 329424 - RNA, 32 nt, Human
aguucugggauuacgggcgugagccacuucac

SEQ ID NO: 329425 - RNA, 32 nt, Human
aguucugggauuauaggugcgagccacugugc

SEQ ID NO: 329426 - RNA, 32 nt, Human
aguucugggauuaugggugugagccaccacac

SEQ ID NO: 329427 - RNA, 32 nt, Human
aguucugggcugggagcugugaccuccccaac

SEQ ID NO: 329428 - RNA, 32 nt, Human
aguucugggugaggcaggagcugggaggggug

SEQ ID NO: 329429 - RNA, 32 nt, Human
aguucugguccuggccaggccaugcuacacua

SEQ ID NO: 329430 - RNA, 32 nt, Human
aguucuguacuuccaguuucuaaaaugcacug

SEQ ID NO: 329431 - RNA, 32 nt, Human
aguucuguauuuguaaauucugucuuucaaaa

SEQ ID NO: 329432 - RNA, 16 nt, Human
aguucugucugaacug

SEQ ID NO: 329433 - RNA, 32 nt, Human
aguucuguggucugcauguccauguuugggac

SEQ ID NO: 329434 - RNA, 32 nt, Human
aguucuguggugcugcucggggauggacucca

SEQ ID NO: 329435 - RNA, 32 nt, Human
aguucuguguuagucaugcacacacauaccua

SEQ ID NO: 329436 - RNA, 32 nt, Human
aguucuguuugaucucuuucuagauucucuag

SEQ ID NO: 329437 - RNA, 32 nt, Human
aguucuuaauuuccucuccuccuggggaauuu

SEQ ID NO: 329438 - RNA, 32 nt, Human
aguucuuagcuccagguuuugggguaaaccaa

SEQ ID NO: 329439 - RNA, 32 nt, Human
aguucuuaguaacaggggcagcuccugaauuc

SEQ ID NO: 329440 - RNA, 32 nt, Human
aguucuuagucauugauuuuuguguuuaaaaa

SEQ ID NO: 329441 - RNA, 32 nt, Human
aguucuuauaguguacuccaccuuuuacuuuu

SEQ ID NO: 329442 - RNA, 32 nt, Human
aguucuuauguuuaucuugcuuuucauguguc

SEQ ID NO: 329443 - RNA, 32 nt, Human
aguucuuauucugaguacaguacucuuuguca

SEQ ID NO: 329444 - RNA, 32 nt, Human
aguucuucaccacuuuauaucaaggguugucu

SEQ ID NO: 329445 - RNA, 32 nt, Human
aguucuucaguuauauuuacauguguuguaaa

SEQ ID NO: 329446 - RNA, 32 nt, Human
aguucuuccaaaggcuggagaagugaacaagg

SEQ ID NO: 329447 - RNA, 32 nt, Human
aguucuuccacacaucuccugaaucacuccaa

SEQ ID NO: 329448 - RNA, 24 nt, Human
aguucuuccaccuagcucagcuga

SEQ ID NO: 329449 - RNA, 32 nt, Human
aguucuuccagauuuuaacuguguuaauaguu

SEQ ID NO: 329450 - RNA, 32 nt, Human
aguucuucccgcagugcucccaucuugugaau

SEQ ID NO: 329451 - RNA, 32 nt, Human
aguucuuccgggaggacgacgguggagccgau

SEQ ID NO: 329452 - RNA, 32 nt, Human
aguucuucucuuuccuccuccuuuucuucucu

SEQ ID NO: 329453 - RNA, 32 nt, Human
aguucuugagagaaggagaggaagauacagca

SEQ ID NO: 329454 - RNA, 32 nt, Human
aguucuuggaccaguuugcagagugaagauca

SEQ ID NO: 329455 - RNA, 23 nt, Human
aguucuuggucccuccagaacca

SEQ ID NO: 329456 - RNA, 32 nt, Human
aguucuuuagagaaucuccauacuguauuuca

SEQ ID NO: 329457 - RNA, 32 nt, Human
aguucuuuagggauagacugaauggcugguau

SEQ ID NO: 329458 - RNA, 32 nt, Human
aguucuuucaggccaaaaagcaaauggauuuc

SEQ ID NO: 329459 - RNA, 32 nt, Human
aguucuuucaucucccuccuccaggucggagu

SEQ ID NO: 329460 - RNA, 32 nt, Human
aguucuuuccucuuucugcucugccaucuuca

SEQ ID NO: 329461 - RNA, 32 nt, Human
aguucuuucucccaguguccgaccucacuguc

SEQ ID NO: 329462 - RNA, 32 nt, Human
aguucuuugaaaugugcuggaagacuuaaauu

SEQ ID NO: 329463 - RNA, 32 nt, Human
aguucuuuggagggaaaacuuugcugaauugu

SEQ ID NO: 329464 - RNA, 32 nt, Human
aguucuuuguggacucuacccuucccuucaag

SEQ ID NO: 329465 - RNA, 32 nt, Human
aguucuuuuauguuuuaguuuacccucacagc

SEQ ID NO: 329466 - RNA, 32 nt, Human
aguugaaaaagcuaucaaggaccaugauuuua

SEQ ID NO: 329467 - RNA, 32 nt, Human
aguugaaaaagcuucaacucucaaggacucau

SEQ ID NO: 329468 - RNA, 32 nt, Human
aguugaaaacauggggcugcucaccagcggag

SEQ ID NO: 329469 - RNA, 32 nt, Human
aguugaaacacuauauuuaucuugucaguuuu

SEQ ID NO: 329470 - RNA, 32 nt, Human
aguugaaacagaauuaaaaauauuucucaaac

SEQ ID NO: 329471 - RNA, 32 nt, Human
aguugaaacccuccucugccagccuggggucc

SEQ ID NO: 329472 - RNA, 32 nt, Human
aguugaaagaguagagaucuguuucuccaagg

SEQ ID NO: 329473 - RNA, 32 nt, Human
aguugaaauuucacaguguuguccucacugug

SEQ ID NO: 329474 - RNA, 32 nt, Human
aguugaacauuaugugagcaaaauuuaagcuu

SEQ ID NO: 329475 - RNA, 22 nt, Human
aguugaaccaguugguucuaga

SEQ ID NO: 329476 - RNA, 32 nt, Human
aguugaacccaggagguggagguugcagugag

SEQ ID NO: 329477 - RNA, 32 nt, Human
aguugaaccuaaacauagaaauugccugacga

SEQ ID NO: 329478 - RNA, 32 nt, Human
aguugaacucagguauuggaagggcuuccguu

SEQ ID NO: 329479 - RNA, 32 nt, Human
aguugaagaaaauaagcaacuugaagaaggua

SEQ ID NO: 329480 - RNA, 32 nt, Human
aguugaagaagaguguggaggaagcuauuacc

SEQ ID NO: 329481 - RNA, 32 nt, Human
aguugaagacagcuucccaugccgguacacag

SEQ ID NO: 329482 - RNA, 32 nt, Human
aguugaagagaaaugcucacugcacaaggaga

SEQ ID NO: 329483 - RNA, 20 nt, Human
aguugaagagguuaguugga

SEQ ID NO: 329484 - RNA, 32 nt, Human
aguugaagcuuaugcuaaucuguauguuacac

SEQ ID NO: 329485 - RNA, 32 nt, Human
aguugaaggaagagagugcauggcaccuggug

SEQ ID NO: 329486 - RNA, 32 nt, Human
aguugaaggaggcagaagggagagugaugcac

SEQ ID NO: 329487 - RNA, 32 nt, Human
aguugaaggaggcagagaagggguuggugaua

SEQ ID NO: 329488 - RNA, 31 nt, Human
aguugaagugagagaguuuggugauacuguc

SEQ ID NO: 329489 - RNA, 32 nt, Human
aguugaauccagccugaacgugggugcuugug

SEQ ID NO: 329490 - RNA, 32 nt, Human
aguugaauccuucucccugccuaccugcagca

SEQ ID NO: 329491 - RNA, 32 nt, Human
aguugaaugcuucuuuuuccuucaauguuguu

SEQ ID NO: 329492 - RNA, 32 nt, Human
aguugaauuauuuccaaaaugaaacaggcuuc

SEQ ID NO: 329493 - RNA, 32 nt, Human
aguugaauugaaugucuauaaggucuaaaggu

SEQ ID NO: 329494 - RNA, 32 nt, Human
aguugacagagguuuaccucccuacuuucuua

SEQ ID NO: 329495 - RNA, 32 nt, Human
aguugacccaggaguacagucucaaguaguuc

SEQ ID NO: 329496 - RNA, 32 nt, Human
aguugaccuccacggggugacauggugugugu

SEQ ID NO: 329497 - RNA, 32 nt, Human
aguugaccucucccgaccucuggagcaguuga

SEQ ID NO: 329498 - RNA, 32 nt, Human
aguugaccugacuuccuucuugaaaugacugu

SEQ ID NO: 329499 - RNA, 32 nt, Human
aguugaccuucaaauauucaagcuauucugca

SEQ ID NO: 329500 - RNA, 32 nt, Human
aguugacucucaugagcugauuggagucagcu

SEQ ID NO: 329501 - RNA, 32 nt, Human
aguugacuucaugguggaguauaaaguuguuu

SEQ ID NO: 329502 - RNA, 32 nt, Human
aguugagaaaacaaacuugcuaaucacuuuac

SEQ ID NO: 329503 - RNA, 32 nt, Human
aguugagaaagaagagaagaagaaaaucaacc

SEQ ID NO: 329504 - RNA, 32 nt, Human
aguugagaaaugugaccuuuuaggcaaagaac

SEQ ID NO: 329505 - RNA, 31 nt, Human
aguugagaacaaucuuccacuuagaagcaau

SEQ ID NO: 329506 - RNA, 32 nt, Human
aguugagaccacaggcaugcgccaccaugccc

SEQ ID NO: 329507 - RNA, 32 nt, Human
aguugagaccagccugaacaacauggugaaac

SEQ ID NO: 329508 - RNA, 32 nt, Human
aguugagaccagccuggccaacauggugaaac

SEQ ID NO: 329509 - RNA, 32 nt, Human
aguugagagcuggggcaggagccccagccggg

SEQ ID NO: 329510 - RNA, 32 nt, Human
aguugagaggcagaaagagaucaaguccuugg

SEQ ID NO: 329511 - RNA, 32 nt, Human
aguugagagggugggggacacagagagaauag

SEQ ID NO: 329512 - RNA, 32 nt, Human
aguugagaucgcacuccagccugggugacaga

SEQ ID NO: 329513 - RNA, 32 nt, Human
aguugagaugaauucuguacccaaagcagaau

SEQ ID NO: 329514 - RNA, 32 nt, Human
aguugagauguuucagcuugaagaaccaaaac

SEQ ID NO: 329515 - RNA, 32 nt, Human
aguugagauuggagagcagcgccgucuguacu

SEQ ID NO: 329516 - RNA, 32 nt, Human
aguugagauuguaccacugcacuccagucugg

SEQ ID NO: 329517 - RNA, 32 nt, Human
aguugagcacagaacccucagcucuggugcgg

SEQ ID NO: 329518 - RNA, 32 nt, Human
aguugagcagagguuugagcccacaccucacc

SEQ ID NO: 329519 - RNA, 32 nt, Human
aguugagcagggccaacggccaugaagaacgu

SEQ ID NO: 329520 - RNA, 32 nt, Human
aguugagcugacauauacugggugggguggaa

SEQ ID NO: 329521 - RNA, 32 nt, Human
aguugaggcaggaggauugcuugagugcaaga

SEQ ID NO: 329522 - RNA, 32 nt, Human
aguugaggccaaugaagagaucauugaugaug

SEQ ID NO: 329523 - RNA, 32 nt, Human
aguugagggaacugugggagcaguuagacagc

SEQ ID NO: 329524 - RNA, 32 nt, Human
aguugagggaaggagacugugccccuccuggc

SEQ ID NO: 329525 - RNA, 32 nt, Human
aguugagggcugggaaugaaaccuauagccuu

SEQ ID NO: 329526 - RNA, 32 nt, Human
aguugaggguggguggagggguuugcagugug

SEQ ID NO: 329527 - RNA, 21 nt, Human
aguugagugagaggaguugag

SEQ ID NO: 329528 - RNA, 32 nt, Human
aguugaguggugcccaagugagucacauccag

SEQ ID NO: 329529 - RNA, 32 nt, Human
aguugaguuaagggauggcuuucacagagcau

SEQ ID NO: 329530 - RNA, 32 nt, Human
aguugaguuuuuaaucucacuuuggguuuccu

SEQ ID NO: 329531 - RNA, 32 nt, Human
aguugauaaucgucaucagaacauggacuuuc

SEQ ID NO: 329532 - RNA, 32 nt, Human
aguugauaccugcuggcaggaaauggcuguuu

SEQ ID NO: 329533 - RNA, 32 nt, Human
aguugaucaugaggacaguagcauuaaauaag

SEQ ID NO: 329534 - RNA, 24 nt, Human
aguugaugaauaucagggcugaga

SEQ ID NO: 329535 - RNA, 32 nt, Human
aguugauggggccagaugagccagcauuccag

SEQ ID NO: 329536 - RNA, 32 nt, Human
aguugauugcagguccuccuggggccagaagg

SEQ ID NO: 329537 - RNA, 32 nt, Human
aguugcaagcagggaggggcaaauacaacugc

SEQ ID NO: 329538 - RNA, 32 nt, Human
aguugcacagcucaugugcccaggaagcugag

SEQ ID NO: 329539 - RNA, 32 nt, Human
aguugcacagcugccugguaggugacuggagg

SEQ ID NO: 329540 - RNA, 32 nt, Human
aguugcacaggagagaaagaagaaguugucca

SEQ ID NO: 329541 - RNA, 32 nt, Human
aguugcaccauguuggccaggcuggucuugaa

SEQ ID NO: 329542 - RNA, 32 nt, Human
aguugcaccauugcacuccacccugggcgaca

SEQ ID NO: 329543 - RNA, 32 nt, Human
aguugcacccugugaagugucugacaaaggca

SEQ ID NO: 329544 - RNA, 32 nt, Human
aguugcagaaagaagaaaggaaagggaaagaa

SEQ ID NO: 329545 - RNA, 32 nt, Human
aguugcagacgacuuguccugccaccaccaug

SEQ ID NO: 329546 - RNA, 32 nt, Human
aguugcagacuugcuacuggcaagagugaagc

SEQ ID NO: 329547 - RNA, 22 nt, Human
aguugcagagaugcaaaagaga

SEQ ID NO: 329548 - RNA, 32 nt, Human
aguugcagaggaggguggagugagagugucau

SEQ ID NO: 329549 - RNA, 32 nt, Human
aguugcagaucguggguguuggcgucuccgcu

SEQ ID NO: 329550 - RNA, 32 nt, Human
aguugcagauguggcuuuuacuuuuuaaaugg

SEQ ID NO: 329551 - RNA, 32 nt, Human
aguugcagcccugcugcugccugccuggacuu

SEQ ID NO: 329552 - RNA, 32 nt, Human
aguugcagccucaguuuuccaguggcucgugg

SEQ ID NO: 329553 - RNA, 32 nt, Human
aguugcagcuacucauggggcuaaggugggag

SEQ ID NO: 329554 - RNA, 32 nt, Human
aguugcagcuucaagaaaguaaagccaguaag

SEQ ID NO: 329555 - RNA, 32 nt, Human
aguugcagcuugcccuuguccagaccuauguu

SEQ ID NO: 329556 - RNA, 32 nt, Human
aguugcaggcagcagaaggcgaggagcgugug

SEQ ID NO: 329557 - RNA, 32 nt, Human
aguugcauggcuuuugacaagacaacugcucc

SEQ ID NO: 329558 - RNA, 32 nt, Human
aguugccaauaugccagcuuggacaucagugu

SEQ ID NO: 329559 - RNA, 32 nt, Human
aguugccaaucacuaaugcuguuacuaacuuu

SEQ ID NO: 329560 - RNA, 32 nt, Human
aguugccagccaccaacuuucuugccucaacu

SEQ ID NO: 329561 - RNA, 32 nt, Human
aguugcccacacugguaauacacacaucugcu

SEQ ID NO: 329562 - RNA, 32 nt, Human
aguugcccagaugaacuggccucugccuuugg

SEQ ID NO: 329563 - RNA, 22 nt, Human
aguugcccaggcuggagugcag

SEQ ID NO: 329564 - RNA, 25 nt, Human
aguugcccaggcuggagugcagugg

SEQ ID NO: 329565 - RNA, 32 nt, Human
aguugccccaacagcaaagacaacagucuggu

SEQ ID NO: 329566 - RNA, 32 nt, Human
aguugcccgaguagcugggacuacaggcaugu

SEQ ID NO: 329567 - RNA, 32 nt, Human
aguugcccuggccuuggggcccccaggaugcc

SEQ ID NO: 329568 - RNA, 32 nt, Human
aguugccuccacccugucccaacagcugacag

SEQ ID NO: 329569 - RNA, 32 nt, Human
aguugccuccaggucuucccagggugacgagg

SEQ ID NO: 329570 - RNA, 32 nt, Human
aguugccucuccuccuccucuuccccaacccc

SEQ ID NO: 329571 - RNA, 32 nt, Human
aguugccugaggacagcagugcaguugacaug

SEQ ID NO: 329572 - RNA, 32 nt, Human
aguugccuggacaacauacagccucuggaaac

SEQ ID NO: 329573 - RNA, 32 nt, Human
aguugccugggauuucugucaugggugucccu

SEQ ID NO: 329574 - RNA, 32 nt, Human
aguugccuguaauccuagcuacucaggaggcu

SEQ ID NO: 329575 - RNA, 32 nt, Human
aguugccuguaaucucaacuacuugggaggcu

SEQ ID NO: 329576 - RNA, 32 nt, Human
aguugccugucaaaggcuggagggcaggagga

SEQ ID NO: 329577 - RNA, 32 nt, Human
aguugccuuccugggcacuuguuuauccauuu

SEQ ID NO: 329578 - RNA, 32 nt, Human
aguugccuucugaaagggcacaguuuuaagga

SEQ ID NO: 329579 - RNA, 32 nt, Human
aguugccuugauauacuucauuccuacacuug

SEQ ID NO: 329580 - RNA, 32 nt, Human
aguugccuugcuggcugugagaauuuuauaug

SEQ ID NO: 329581 - RNA, 32 nt, Human
aguugcgacuccugugcucucuuuucaguguc

SEQ ID NO: 329582 - RNA, 32 nt, Human
aguugcuaggugauucugacacugcuggcuug

SEQ ID NO: 329583 - RNA, 32 nt, Human
aguugcuccuuugcaguuuccacaccauggcu

SEQ ID NO: 329584 - RNA, 31 nt, Human
aguugcucuagcuagaaagccaaggcucuuu

SEQ ID NO: 329585 - RNA, 32 nt, Human
aguugcucuaguaacccaaagaagugaaggag

SEQ ID NO: 329586 - RNA, 23 nt, Human
aguugcugagaagagugugcugg

SEQ ID NO: 329587 - RNA, 32 nt, Human
aguugcugagaaggggagagacucccuccucu

SEQ ID NO: 329588 - RNA, 32 nt, Human
aguugcugagagggcucgaggggugggcuggu

SEQ ID NO: 329589 - RNA, 32 nt, Human
aguugcugcacaggagcccaagcacaagggca

SEQ ID NO: 329590 - RNA, 32 nt, Human
aguugcugccuaagccccauccuuuguucucc

SEQ ID NO: 329591 - RNA, 32 nt, Human
aguugcugcuauucuuugccugccccuggggu

SEQ ID NO: 329592 - RNA, 32 nt, Human
aguugcugcuuggcauaaugagccucagcuuc

SEQ ID NO: 329593 - RNA, 32 nt, Human
aguugcugcuuuguuugucuaauugacucauu

SEQ ID NO: 329594 - RNA, 32 nt, Human
aguugcuggagcugggcugagaacugggcugc

SEQ ID NO: 329595 - RNA, 32 nt, Human
aguugcugggaauccaugaaucaaagacuugc

SEQ ID NO: 329596 - RNA, 20 nt, Human
aguugcugggauuacaggug

SEQ ID NO: 329597 - RNA, 32 nt, Human
aguugcugggauuacaggugugagccacagug

SEQ ID NO: 329598 - RNA, 32 nt, Human
aguugcugggauugcgggcaugguggcgugag

SEQ ID NO: 329599 - RNA, 22 nt, Human
aguugcugguauauuuaaauca

SEQ ID NO: 329600 - RNA, 32 nt, Human
aguugcugguuauuugaaaauaguaacaaaaa

SEQ ID NO: 329601 - RNA, 32 nt, Human
aguugcuguaggauucuaaauccaggugauug

SEQ ID NO: 329602 - RNA, 32 nt, Human
aguugcugucuuauucucuuuauuucucauug

SEQ ID NO: 329603 - RNA, 32 nt, Human
aguugcuuaccugucugugccucaguuuccuc

SEQ ID NO: 329604 - RNA, 17 nt, Human
aguugcuuacugaacug

SEQ ID NO: 329605 - RNA, 32 nt, Human
aguugcuuagguaugaauagggacuugcagua

SEQ ID NO: 329606 - RNA, 32 nt, Human
aguugcuuaguacaggcuucucacuuccuaca

SEQ ID NO: 329607 - RNA, 32 nt, Human
aguugcuucauaggcauucaugacauuuuagu

SEQ ID NO: 329608 - RNA, 32 nt, Human
aguugcuucugagacgccuucgcuucuguccu

SEQ ID NO: 329609 - RNA, 32 nt, Human
aguugcuuuaucucccacgggcuccccaagaa

SEQ ID NO: 329610 - RNA, 32 nt, Human
aguugcuuucaaaggccagaaaugcccauuau

SEQ ID NO: 329611 - RNA, 32 nt, Human
aguugcuuucauccuccuuuuguucugcauug

SEQ ID NO: 329612 - RNA, 32 nt, Human
aguugcuuugcuguuagccuguuggaccuucg

SEQ ID NO: 329613 - RNA, 32 nt, Human
aguuggaaaaacaaaaucugcaagcuuugaau

SEQ ID NO: 329614 - RNA, 32 nt, Human
aguuggaaacuguccagaggagcccagcgcug

SEQ ID NO: 329615 - RNA, 32 nt, Human
aguuggaagaaccaguucuggagcucaggccu

SEQ ID NO: 329616 - RNA, 32 nt, Human
aguuggaagaggagacugggaggcagcaagag

SEQ ID NO: 329617 - RNA, 32 nt, Human
aguuggaagaggagggauuagaaacaggagga

SEQ ID NO: 329618 - RNA, 32 nt, Human
aguuggaagaggaguaagcaaauuggggucug

SEQ ID NO: 329619 - RNA, 32 nt, Human
aguuggaagaugaggaagaagaggaggaagau

SEQ ID NO: 329620 - RNA, 32 nt, Human
aguuggaauuacaggugcaugccaccaugccu

SEQ ID NO: 329621 - RNA, 32 nt, Human
aguuggaauuauaggcaugugccaccacaccc

SEQ ID NO: 329622 - RNA, 32 nt, Human
aguuggaccccucaccuggccuccagggaaga

SEQ ID NO: 329623 - RNA, 32 nt, Human
aguuggacuggcuaccccuccuggccacccag

SEQ ID NO: 329624 - RNA, 32 nt, Human
aguuggacuguggccucaggaggcaguggcuu

SEQ ID NO: 329625 - RNA, 32 nt, Human
aguuggacuucagucuugccuaggcgauuuug

SEQ ID NO: 329626 - RNA, 32 nt, Human
aguuggagaacgaucucugccuuucaguucug

SEQ ID NO: 329627 - RNA, 32 nt, Human
aguuggagagagcagagguucgccuggaaggg

SEQ ID NO: 329628 - RNA, 32 nt, Human
aguuggaggaagagaacaggagccugaaggcu

SEQ ID NO: 329629 - RNA, 32 nt, Human
aguuggaggccaggguaccacaugucacaggc

SEQ ID NO: 329630 - RNA, 32 nt, Human
aguuggagggaggcagggaaucuggcuugauu

SEQ ID NO: 329631 - RNA, 32 nt, Human
aguuggaggugucuggguguuuggagguggcc

SEQ ID NO: 329632 - RNA, 32 nt, Human
aguuggaguagggaagguuuaauaguaaaaua

SEQ ID NO: 329633 - RNA, 32 nt, Human
aguuggaguauuugcauuuuuauuuuuaucaa

SEQ ID NO: 329634 - RNA, 32 nt, Human
aguuggagugcaauggcacaaucuagcucacu

SEQ ID NO: 329635 - RNA, 32 nt, Human
aguuggaguuagagcagaagaaaaugaaauua

SEQ ID NO: 329636 - RNA, 32 nt, Human
aguuggaguugacugcucauacccaggaagag

SEQ ID NO: 329637 - RNA, 32 nt, Human
aguuggauacagccgggcacaguggcucacac

SEQ ID NO: 329638 - RNA, 32 nt, Human
aguuggaucugcaguugggggcguggcggggc

SEQ ID NO: 329639 - RNA, 32 nt, Human
aguuggauguuguccuguuggugaggaaggga

SEQ ID NO: 329640 - RNA, 32 nt, Human
aguuggauuguacaaauuacugcaaauguaua

SEQ ID NO: 329641 - RNA, 32 nt, Human
aguuggauuugucgcagacaaugaguuaagga

SEQ ID NO: 329642 - RNA, 32 nt, Human
aguuggcacuacaggugcccgccaccacgcuc

SEQ ID NO: 329643 - RNA, 32 nt, Human
aguuggcacugcaggugcaggccaacccuuua

SEQ ID NO: 329644 - RNA, 32 nt, Human
aguuggcagagaauggaaagaaagcaaugguc

SEQ ID NO: 329645 - RNA, 32 nt, Human
aguuggcagaugggaaauaugaggcucagaga

SEQ ID NO: 329646 - RNA, 32 nt, Human
aguuggcauaaaagacacagguuacaacacga

SEQ ID NO: 329647 - RNA, 30 nt, Human
aguuggccaagccauagggcacagcaccuc

SEQ ID NO: 329648 - RNA, 32 nt, Human
aguuggccaauacuggugcccaaccuggauua

SEQ ID NO: 329649 - RNA, 32 nt, Human
aguuggccauauuuaccucagccugggcgcug

SEQ ID NO: 329650 - RNA, 32 nt, Human
aguuggcccaagaaacauaaacauauaaccac

SEQ ID NO: 329651 - RNA, 22 nt, Human
aguuggccccagcgcagaguag

SEQ ID NO: 329652 - RNA, 32 nt, Human
aguuggccuagagcaggccacugugagcucag

SEQ ID NO: 329653 - RNA, 32 nt, Human
aguuggccucuccuugaggugggcacagccug

SEQ ID NO: 329654 - RNA, 32 nt, Human
aguuggcggaggaggagaaggaaggggccggg

SEQ ID NO: 329655 - RNA, 32 nt, Human
aguuggcuagaagaaaguaaaaagaacaacac

SEQ ID NO: 329656 - RNA, 32 nt, Human
aguuggcucuacgcgagguuuguuaauaaaag

SEQ ID NO: 329657 - RNA, 32 nt, Human
aguuggcucucccacagucuuugaggugaauu

SEQ ID NO: 329658 - RNA, 32 nt, Human
aguuggcugaggaaggggaagauuaguaagaa

SEQ ID NO: 329659 - RNA, 32 nt, Human
aguuggcugcauuuucuuaucugaucacaaug

SEQ ID NO: 329660 - RNA, 32 nt, Human
aguuggcugggaagaaagaugagugaaauaac

SEQ ID NO: 329661 - RNA, 32 nt, Human
aguuggcuuuuggaagucugaaggugagcauu

SEQ ID NO: 329662 - RNA, 32 nt, Human
aguugggaauacaggcaugcgcuaccacgucc

SEQ ID NO: 329663 - RNA, 32 nt, Human
aguugggacagagaccauauggccugcaaagu

SEQ ID NO: 329664 - RNA, 32 nt, Human
aguugggaccauaggugcacaccaccacaccu

SEQ ID NO: 329665 - RNA, 32 nt, Human
aguugggaccugagggacagaggaucggaaug

SEQ ID NO: 329666 - RNA, 32 nt, Human
aguugggacuacaggaauacaccaccacacau

SEQ ID NO: 329667 - RNA, 32 nt, Human
aguugggacuacaggcauauaccaccacuuuc

SEQ ID NO: 329668 - RNA, 32 nt, Human
aguugggacuacaggcaugcgccaccacgccc

SEQ ID NO: 329669 - RNA, 32 nt, Human
aguugggaggcugaggcgggcagaucaucugg

SEQ ID NO: 329670 - RNA, 21 nt, Human
aguugggaucucacuauguug

SEQ ID NO: 329671 - RNA, 32 nt, Human
aguugggaucugccuuuuucauccagagcucu

SEQ ID NO: 329672 - RNA, 32 nt, Human
aguugggauuacaggcacaugccaccauacgc

SEQ ID NO: 329673 - RNA, 32 nt, Human
aguugggauuacaggcacaugccaccaugccc

SEQ ID NO: 329674 - RNA, 32 nt, Human
aguugggauuacaggcacccgccaccacgccc

SEQ ID NO: 329675 - RNA, 32 nt, Human
aguugggauuacaggcaccugccaccaugccu

SEQ ID NO: 329676 - RNA, 32 nt, Human
aguugggauuacaggcaugcauccccaugccc

SEQ ID NO: 329677 - RNA, 32 nt, Human
aguugggauuacaggcgcccaccaccaugccc

SEQ ID NO: 329678 - RNA, 32 nt, Human
aguugggauuacaggcgccugccaccacaccu

SEQ ID NO: 329679 - RNA, 32 nt, Human
aguugggauuacgggcaugcaccaccaugccu

SEQ ID NO: 329680 - RNA, 32 nt, Human
aguugggauuccagcccaguuggacgcugaag

SEQ ID NO: 329681 - RNA, 32 nt, Human
aguugggcaacagagaaccaucccuauuuugu

SEQ ID NO: 329682 - RNA, 32 nt, Human
aguugggcccccaucccuccccuugccacauc

SEQ ID NO: 329683 - RNA, 32 nt, Human
aguugggccgggacgggauccgggaggcuucu

SEQ ID NO: 329684 - RNA, 32 nt, Human
aguugggcgaacuguacuccaugugaauuacc

SEQ ID NO: 329685 - RNA, 32 nt, Human
aguugggcgagggagagcccccggccggcugc

SEQ ID NO: 329686 - RNA, 24 nt, Human
aguugggcggaucacaaggucagg

SEQ ID NO: 329687 - RNA, 25 nt, Human
aguugggcgucccggagcucaggga

SEQ ID NO: 329688 - RNA, 32 nt, Human
aguugggcugcuuguuaaaaaugcaggccagg

SEQ ID NO: 329689 - RNA, 32 nt, Human
aguugggcuguauuuuucaaagguggggagag

SEQ ID NO: 329690 - RNA, 32 nt, Human
aguuggggaggaagagugggagggagggcugg

SEQ ID NO: 329691 - RNA, 32 nt, Human
aguuggggauccagcaggagacccucugcaca

SEQ ID NO: 329692 - RNA, 32 nt, Human
aguuggggaugaagcauggguauucgagaucu

SEQ ID NO: 329693 - RNA, 32 nt, Human
aguuggggcaggaagagggggcuuccagggag

SEQ ID NO: 329694 - RNA, 17 nt, Human
aguuggggcugguccca

SEQ ID NO: 329695 - RNA, 32 nt, Human
aguugggggaggcagagccagcagguggacag

SEQ ID NO: 329696 - RNA, 32 nt, Human
aguugggguaaaaccauuugaggcagaucgcg

SEQ ID NO: 329697 - RNA, 21 nt, Human
aguuggggucucacuguguug

SEQ ID NO: 329698 - RNA, 32 nt, Human
aguuggggugcuugggugaucucugcuucauu

SEQ ID NO: 329699 - RNA, 32 nt, Human
aguuggguccuugccuggauuuugacacagca

SEQ ID NO: 329700 - RNA, 32 nt, Human
aguugggucuacaggcacgcaccaccacaccc

SEQ ID NO: 329701 - RNA, 32 nt, Human
aguugggucucugaagacgggggugaggugag

SEQ ID NO: 329702 - RNA, 32 nt, Human
aguugggugggaaaggagagaggagccagcca

SEQ ID NO: 329703 - RNA, 32 nt, Human
aguuggguuucugcguccaugugaagcauccu

SEQ ID NO: 329704 - RNA, 32 nt, Human
aguugguaaaggccccuuuucaggaaaguuug

SEQ ID NO: 329705 - RNA, 32 nt, Human
aguugguaaagucacuggaaagggaagaaugc

SEQ ID NO: 329706 - RNA, 23 nt, Human
aguugguacagaaggccaugcca

SEQ ID NO: 329707 - RNA, 32 nt, Human
aguugguacagauggcauugucccagucuguu

SEQ ID NO: 329708 - RNA, 32 nt, Human
aguugguauccugaagaacuugccuggcacac

SEQ ID NO: 329709 - RNA, 32 nt, Human
aguuggucagcagaggaggcuggggacaggca

SEQ ID NO: 329710 - RNA, 32 nt, Human
aguuggucuggaacuccugaccucgugaucca

SEQ ID NO: 329711 - RNA, 32 nt, Human
aguuggugagccagaggcuugacagagcuguu

SEQ ID NO: 329712 - RNA, 32 nt, Human
aguuggugccaaugcauuccagccuggaugau

SEQ ID NO: 329713 - RNA, 32 nt, Human
aguuggugggggaagagcaggaguuggaggcc

SEQ ID NO: 329714 - RNA, 32 nt, Human
aguugguguccaagacuuaucuugagacucuu

SEQ ID NO: 329715 - RNA, 32 nt, Human
aguugguucagaaacaucacaggcaaaaggug

SEQ ID NO: 329716 - RNA, 32 nt, Human
aguugguuggguaguagguugcauuaugagua

SEQ ID NO: 329717 - RNA, 32 nt, Human
aguugguuucugcuuuuaauuuacuuguacaa

SEQ ID NO: 329718 - RNA, 32 nt, Human
aguugguuucuuucuuucucuuaccugaaaug

SEQ ID NO: 329719 - RNA, 32 nt, Human
aguugguuuuuccaggcccagcuccugccuuu

SEQ ID NO: 329720 - RNA, 32 nt, Human
aguuguaaaacugggaagaggcuggaagaaga

SEQ ID NO: 329721 - RNA, 32 nt, Human
aguuguacagauaguuuauaagcacaauauuu

SEQ ID NO: 329722 - RNA, 32 nt, Human
aguuguacccuugagccuugacucaagggcug

SEQ ID NO: 329723 - RNA, 32 nt, Human
aguuguacccuuuaacucuauuuuguccuuga

SEQ ID NO: 329724 - RNA, 32 nt, Human
aguuguacuguugccaggacacauggccauaa

SEQ ID NO: 329725 - RNA, 32 nt, Human
aguuguagagccauccuaggugccauccccuu

SEQ ID NO: 329726 - RNA, 32 nt, Human
aguuguaguccaagcacacacaaauagugcca

SEQ ID NO: 329727 - RNA, 32 nt, Human
aguuguauaccugauuguaacaaucaucuuuu

SEQ ID NO: 329728 - RNA, 32 nt, Human
aguuguauagcaguugcaccccuugaagguuu

SEQ ID NO: 329729 - RNA, 32 nt, Human
aguuguaucuagacccuuaucauauaugugau

SEQ ID NO: 329730 - RNA, 32 nt, Human
aguuguaugagaaaguuggccuuuggacuuag

SEQ ID NO: 329731 - RNA, 26 nt, Human
aguuguaugcaguuaugguugggggg

SEQ ID NO: 329732 - RNA, 21 nt, Human
aguugucaccauuaugucuua

SEQ ID NO: 329733 - RNA, 32 nt, Human
aguugucacuauacccagauagacuacucauc

SEQ ID NO: 329734 - RNA, 32 nt, Human
aguugucaggcuccucccagguuauguuuuca

SEQ ID NO: 329735 - RNA, 32 nt, Human
aguugucaugcaccaugagacaaagcccaagc

SEQ ID NO: 329736 - RNA, 32 nt, Human
aguuguccacggucaauucagugcuuccauug

SEQ ID NO: 329737 - RNA, 32 nt, Human
aguuguccaucuguccaucccaacagcaagac

SEQ ID NO: 329738 - RNA, 32 nt, Human
aguuguccuaggaacugauguggagaaguuac

SEQ ID NO: 329739 - RNA, 32 nt, Human
aguuguccucaaggucauccuggagaugggau

SEQ ID NO: 329740 - RNA, 32 nt, Human
aguuguccuggugccuccaucagacucucccu

SEQ ID NO: 329741 - RNA, 32 nt, Human
aguugucgcccuggaauaggguccugcagggu

SEQ ID NO: 329742 - RNA, 32 nt, Human
aguugucgugcuccuguuucugagguugucgu

SEQ ID NO: 329743 - RNA, 32 nt, Human
aguugucuaaccacugaaaacuaccuagccag

SEQ ID NO: 329744 - RNA, 32 nt, Human
aguugucuagcuacuuaaaacccucagaagua

SEQ ID NO: 329745 - RNA, 32 nt, Human
aguugucucuccccagcuagauuguaagcucc

SEQ ID NO: 329746 - RNA, 32 nt, Human
aguugucuguccaggcccuuagggaaguuguc

SEQ ID NO: 329747 - RNA, 32 nt, Human
aguugucuucuaaggcuggggcugcuugcccu

SEQ ID NO: 329748 - RNA, 32 nt, Human
aguugucuuuacaaccuccccaucaucucuuc

SEQ ID NO: 329749 - RNA, 32 nt, Human
aguugugaaagaaaagcuucucagggaacugc

SEQ ID NO: 329750 - RNA, 32 nt, Human
aguugugaaauuugagaauuuguaagacuaau

SEQ ID NO: 329751 - RNA, 32 nt, Human
aguugugacugguuuagaaguggauacacagg

SEQ ID NO: 329752 - RNA, 32 nt, Human
aguugugauucugucuucucuuuauaacauga

SEQ ID NO: 329753 - RNA, 32 nt, Human
aguugugccaaagggcugcacagugguaucca

SEQ ID NO: 329754 - RNA, 32 nt, Human
aguugugccacaaaaaggaaacucagcgacau

SEQ ID NO: 329755 - RNA, 32 nt, Human
aguugugcccucaagugguccuaaguagaagu

SEQ ID NO: 329756 - RNA, 32 nt, Human
aguugugcccucugcugacacuaggucaggag

SEQ ID NO: 329757 - RNA, 32 nt, Human
aguugugccgaggacugucaccauugggcagg

SEQ ID NO: 329758 - RNA, 32 nt, Human
aguugugcugggauagcgcaggaagguggguc

SEQ ID NO: 329759 - RNA, 32 nt, Human
aguuguggaaacauugguccaugccgugagcc

SEQ ID NO: 329760 - RNA, 32 nt, Human
aguuguggagagugcaacaguagcauaggacc

SEQ ID NO: 329761 - RNA, 32 nt, Human
aguuguggagccacaacagaggcuucagacca

SEQ ID NO: 329762 - RNA, 32 nt, Human
aguuguggaggaggugaaagaaagggacccac

SEQ ID NO: 329763 - RNA, 19 nt, Human
aguuguggccucuaccauu

SEQ ID NO: 329764 - RNA, 32 nt, Human
aguugugggacuccagucgggauaucagucgg

SEQ ID NO: 329765 - RNA, 32 nt, Human
aguugugguguccagugugcagcagcccuggg

SEQ ID NO: 329766 - RNA, 32 nt, Human
aguuguguauguugaagcuguuguuucaaaag

SEQ ID NO: 329767 - RNA, 32 nt, Human
aguugugucucgucuucugucuccaugugguu

SEQ ID NO: 329768 - RNA, 20 nt, Human
aguugugucucucucuguca

SEQ ID NO: 329769 - RNA, 32 nt, Human
aguugugucuugucuucugucuccaugugguu

SEQ ID NO: 329770 - RNA, 32 nt, Human
aguuguguucagacacacacaucacagcuuga

SEQ ID NO: 329771 - RNA, 32 nt, Human
aguuguguuuuccaggugagccgagcaguucu

SEQ ID NO: 329772 - RNA, 24 nt, Human
aguuguuaacuaaauuaacauugg

SEQ ID NO: 329773 - RNA, 21 nt, Human
aguuguuaacuucuacauuca

SEQ ID NO: 329774 - RNA, 32 nt, Human
aguuguuagaagugggacacuccaaccacauu

SEQ ID NO: 329775 - RNA, 23 nt, Human
aguuguuaggccaggugcaaugg

SEQ ID NO: 329776 - RNA, 32 nt, Human
aguuguuagggcugaggaaccaaucaagguag

SEQ ID NO: 329777 - RNA, 32 nt, Human
aguuguuaugaauacuaauacaucacuuuuua

SEQ ID NO: 329778 - RNA, 32 nt, Human
aguuguucaaagagauggcuuugaauuccagc

SEQ ID NO: 329779 - RNA, 32 nt, Human
aguuguucagcccugagaauuuugagccacau

SEQ ID NO: 329780 - RNA, 32 nt, Human
aguuguucccaaucugccguuaccaucaacgc

SEQ ID NO: 329781 - RNA, 32 nt, Human
aguuguucucaggggugcuggggcagagugga

SEQ ID NO: 329782 - RNA, 32 nt, Human
aguuguucucauaguaaugaguucucacaaga

SEQ ID NO: 329783 - RNA, 32 nt, Human
aguuguucuugaacaccugaggccuuccugug

SEQ ID NO: 329784 - RNA, 32 nt, Human
aguuguugcaauauuugauuauccauuugguu

SEQ ID NO: 329785 - RNA, 32 nt, Human
aguuguugcacuccugaaauucuauuaacauu

SEQ ID NO: 329786 - RNA, 32 nt, Human
aguuguugcuauacauguuggaaauguguuuu

SEQ ID NO: 329787 - RNA, 32 nt, Human
aguuguugcuccuauguuccuuggagcaaaug

SEQ ID NO: 329788 - RNA, 32 nt, Human
aguuguugcuuuggaauagauggagcugcccc

SEQ ID NO: 329789 - RNA, 32 nt, Human
aguuguugggagcugagccggagccagaacuc

SEQ ID NO: 329790 - RNA, 32 nt, Human
aguuguugugcaaguugacaaaugccaaauag

SEQ ID NO: 329791 - RNA, 32 nt, Human
aguuguugugucucucagcgcuuguuggguuc

SEQ ID NO: 329792 - RNA, 32 nt, Human
aguuguuuacauaugagucgggaccaaagaga

SEQ ID NO: 329793 - RNA, 32 nt, Human
aguuguuucauucaaguguuuauaggaaucca

SEQ ID NO: 329794 - RNA, 32 nt, Human
aguuguuucucaucuucauaauaccaguguga

SEQ ID NO: 329795 - RNA, 32 nt, Human
aguuguuuugaugccuccccacccucacccua

SEQ ID NO: 329796 - RNA, 32 nt, Human
aguuguuuuuauuuucuuccuuugguguuuau

SEQ ID NO: 329797 - RNA, 32 nt, Human
aguuguuuuugaaaaggaaauaaacuuugaug

SEQ ID NO: 329798 - RNA, 32 nt, Human
aguuuaaaacuagaagcagcagaaaacuagcu

SEQ ID NO: 329799 - RNA, 18 nt, Human
aguuuaaaaggcugugcc

SEQ ID NO: 329800 - RNA, 32 nt, Human
aguuuaaacaagaucuuccacagcagacuuca

SEQ ID NO: 329801 - RNA, 32 nt, Human
aguuuaaacaaggugaaacaagauucuuuuuc

SEQ ID NO: 329802 - RNA, 32 nt, Human
aguuuaaagcugcuguuccucuaccucagugg

SEQ ID NO: 329803 - RNA, 32 nt, Human
aguuuaaaggaaguauuccucuaaagguucaa

SEQ ID NO: 329804 - RNA, 21 nt, Human
aguuuaaauauuugagcuuua

SEQ ID NO: 329805 - RNA, 19 nt, Human
aguuuaaaucucuaccaca

SEQ ID NO: 329806 - RNA, 32 nt, Human
aguuuaaauuagugcauacaucaugucauuuc

SEQ ID NO: 329807 - RNA, 32 nt, Human
aguuuaacaaaugacuccaccuauuuuuccag

SEQ ID NO: 329808 - RNA, 32 nt, Human
aguuuaacugauucaaacucuguuuauuucau

SEQ ID NO: 329809 - RNA, 32 nt, Human
aguuuaaguuauuguuuaauguaaucaguuuu

SEQ ID NO: 329810 - RNA, 32 nt, Human
aguuuaaucccccauuccaaaaguccaggcca

SEQ ID NO: 329811 - RNA, 32 nt, Human
aguuuaaucuuuuucuuuaccuccaugguuuu

SEQ ID NO: 329812 - RNA, 32 nt, Human
aguuuaaugccaccuuccucugucugccaugg

SEQ ID NO: 329813 - RNA, 32 nt, Human
aguuuaaugccuagcagagaacugccuuaaaa

SEQ ID NO: 329814 - RNA, 31 nt, Human
aguuuaauggaggauucagccaagaacagcu

SEQ ID NO: 329815 - RNA, 32 nt, Human
aguuuaauuagcuuuccaaccaaccaaauuuc

SEQ ID NO: 329816 - RNA, 32 nt, Human
aguuuaauuuccuucagcuguggugauguuga

SEQ ID NO: 329817 - RNA, 32 nt, Human
aguuuacaaucacuaggauggcuacaauaaaa

SEQ ID NO: 329818 - RNA, 32 nt, Human
aguuuacacaugggagcugccugccugcugcu

SEQ ID NO: 329819 - RNA, 32 nt, Human
aguuuacagaagaggucgcggggugagccucu

SEQ ID NO: 329820 - RNA, 32 nt, Human
aguuuacagcuguacuuuccagaucuucuaug

SEQ ID NO: 329821 - RNA, 32 nt, Human
aguuuacagugagccgagauccugccacugca

SEQ ID NO: 329822 - RNA, 32 nt, Human
aguuuacauccauucaugccucuuucagaacu

SEQ ID NO: 329823 - RNA, 32 nt, Human
aguuuacaucccucauucacaguguaaagcag

SEQ ID NO: 329824 - RNA, 32 nt, Human
aguuuaccuauguaacaaaccugcacuuauac

SEQ ID NO: 329825 - RNA, 32 nt, Human
aguuuaccuauguaacaaaccugcacuuguac

SEQ ID NO: 329826 - RNA, 32 nt, Human
aguuuaccuauguaacaaaccugcacuuguau

SEQ ID NO: 329827 - RNA, 32 nt, Human
auagaaacuguaggcugggugggcaggaauag

SEQ ID NO: 329828 - RNA, 32 nt, Human
auagaaagacccuuagaugucuucucacgcaa

SEQ ID NO: 329829 - RNA, 32 nt, Human
auagaaagaguuaagaaggcucgagaagagca

SEQ ID NO: 329830 - RNA, 32 nt, Human
auagaaagauucacacuggcgagaaacccuau

SEQ ID NO: 329831 - RNA, 32 nt, Human
auagaaagcacuacugcacuuaguagcuaugu

SEQ ID NO: 329832 - RNA, 32 nt, Human
auagaaagcucugccuugccagucuccuaaau

SEQ ID NO: 329833 - RNA, 24 nt, Human
auagaaagcugaagaacacuagaa

SEQ ID NO: 329834 - RNA, 21 nt, Human
auagaaagggggaaggaggac

SEQ ID NO: 329835 - RNA, 32 nt, Human
auagaaagugaacaggaagcaaacaggaagug

SEQ ID NO: 329836 - RNA, 32 nt, Human
auagaaaugucaguagaacucauugagggugc

SEQ ID NO: 329837 - RNA, 32 nt, Human
auagaaccaaaaacgccagucaugggaggcag

SEQ ID NO: 329838 - RNA, 32 nt, Human
auagaaccaugaggcaaccacucugggcaccu

SEQ ID NO: 329839 - RNA, 32 nt, Human
auagaaccauggaaaauucugauguccucucu

SEQ ID NO: 329840 - RNA, 32 nt, Human
auagaacccagaggaggagagaacccgggacu

SEQ ID NO: 329841 - RNA, 32 nt, Human
auagaacccaggagguggagacugcagugagc

SEQ ID NO: 329842 - RNA, 32 nt, Human
auagaacccaggaugugaggguggggguggag

SEQ ID NO: 329843 - RNA, 32 nt, Human
auagaacgaguuaagaaggcucgaaaagagca

SEQ ID NO: 329844 - RNA, 32 nt, Human
auagaacgaguuaagaaggcucgagaagagca

SEQ ID NO: 329845 - RNA, 32 nt, Human
auagaacucaacuauugcuuuucagggaaauc

SEQ ID NO: 329846 - RNA, 32 nt, Human
auagaacucaaugcagaugcauugguuauuac

SEQ ID NO: 329847 - RNA, 32 nt, Human
auagaacugugcacaggaacagcuuccagagc

SEQ ID NO: 329848 - RNA, 22 nt, Human
auagaagaagaggugguugcug

SEQ ID NO: 329849 - RNA, 32 nt, Human
auagaagaaggagggaaggaaguagggaggca

SEQ ID NO: 329850 - RNA, 32 nt, Human
auagaagaccagaaaggcgaccaccuugugaa

SEQ ID NO: 329851 - RNA, 32 nt, Human
auagaagaggcaucaugcugaagagggagggg

SEQ ID NO: 329852 - RNA, 32 nt, Human
auagaagauaugggcuuuuggaagcacugauu

SEQ ID NO: 329853 - RNA, 32 nt, Human
auagaagaucugccuccccuguggaaauuggg

SEQ ID NO: 329854 - RNA, 32 nt, Human
auagaagauuuacuauuauuccagccauguaa

SEQ ID NO: 329855 - RNA, 32 nt, Human
auagaagcaugagugaaugacaucccagagau

SEQ ID NO: 329856 - RNA, 32 nt, Human
auagaagcucucccgcuaauguuuccaucaug

SEQ ID NO: 329857 - RNA, 32 nt, Human
auagaaggaagcaggagugauuaguucggguu

SEQ ID NO: 329858 - RNA, 32 nt, Human
auagaaggagguuucugaggcugacagaaaca

SEQ ID NO: 329859 - RNA, 32 nt, Human
auagaagggacagggucuguguuacagacugc

SEQ ID NO: 329860 - RNA, 32 nt, Human
auagaagguuuguuugacagaggagaaaaauu

SEQ ID NO: 329861 - RNA, 32 nt, Human
auagaaguguuucauccuuucaaaaccauuuc

SEQ ID NO: 329862 - RNA, 32 nt, Human
auagaauacagcauggaaaauaucaguguauu

SEQ ID NO: 329863 - RNA, 32 nt, Human
auagaauacuauucauuaaccuagaaacugag

SEQ ID NO: 329864 - RNA, 24 nt, Human
auagaauagagaccaguuugcuuu

SEQ ID NO: 329865 - RNA, 32 nt, Human
auagaauauuuugcugcacaugcaucaacaaa

SEQ ID NO: 329866 - RNA, 32 nt, Human
auagaauccacccaagaaaauuuucuuagcau

SEQ ID NO: 329867 - RNA, 31 nt, Human
auagaaucccacuggaauaccacauagcuuu

SEQ ID NO: 329868 - RNA, 32 nt, Human
auagaauccuggcaaugccauggaccuuaaga

SEQ ID NO: 329869 - RNA, 32 nt, Human
auagaaucuaagaguugauuguggaaaacacg

SEQ ID NO: 329870 - RNA, 32 nt, Human
auagaaucuaagguaauggcaagagcaaaggu

SEQ ID NO: 329871 - RNA, 32 nt, Human
auagaaugaguuaagaaggcucgagaagagca

SEQ ID NO: 329872 - RNA, 23 nt, Human
auagaauggaagggggaucauca

SEQ ID NO: 329873 - RNA, 32 nt, Human
auagaauggugcuucugaucaccugugacaug

SEQ ID NO: 329874 - RNA, 32 nt, Human
auagaaugucaguucuuuucucucagcacguu

SEQ ID NO: 329875 - RNA, 32 nt, Human
auagaauguuaaguuucaagaaaguuuaccuu

SEQ ID NO: 329876 - RNA, 32 nt, Human
auagaauuaaugaucagagcaaguuuaauuuu

SEQ ID NO: 329877 - RNA, 32 nt, Human
auagaauuaauuuucagccauguggaccauau

SEQ ID NO: 329878 - RNA, 32 nt, Human
auagaauucuauacccccaaccccuuguguca

SEQ ID NO: 329879 - RNA, 32 nt, Human
auagaauugucucucaacucugcuuuucucca

SEQ ID NO: 329880 - RNA, 32 nt, Human
auagaauugugagagaauguuuugaaaggcca

SEQ ID NO: 329881 - RNA, 32 nt, Human
auagaauuuuucaauguuuucuugagaugcaa

SEQ ID NO: 329882 - RNA, 32 nt, Human
auagacaaugaaguccagccugagguggcuuc

SEQ ID NO: 329883 - RNA, 32 nt, Human
auagacacaccaagaaguggauguauauaaua

SEQ ID NO: 329884 - RNA, 32 nt, Human
auagacacauugagguauggcagagaagacac

SEQ ID NO: 329885 - RNA, 19 nt, Human
auagacaccucugagccca

SEQ ID NO: 329886 - RNA, 32 nt, Human
auagacacgguuucaccauguuggccaggcug

SEQ ID NO: 329887 - RNA, 32 nt, Human
auagacacucagacacccucacaaacacagua

SEQ ID NO: 329888 - RNA, 32 nt, Human
auagacaggaucuugcuaugcuguccaggcug

SEQ ID NO: 329889 - RNA, 32 nt, Human
auagacaggcuuccaaacccugggaagaaagc

SEQ ID NO: 329890 - RNA, 32 nt, Human
auagacaggggcuugcuauaguguccaggcug

SEQ ID NO: 329891 - RNA, 32 nt, Human
auagacauaaaaggacucacuggagagauacu

SEQ ID NO: 329892 - RNA, 32 nt, Human
auagacaugaaagguccccacagagcaagaga

SEQ ID NO: 329893 - RNA, 32 nt, Human
auagacaugaaccaccucaucugguuucaauc

SEQ ID NO: 329894 - RNA, 32 nt, Human
auagacaugaacccuggaaauucuccaacccu

SEQ ID NO: 329895 - RNA, 32 nt, Human
auagacaugugggagaaaaagugaggauggau

SEQ ID NO: 329896 - RNA, 32 nt, Human
auagacauguuccucucugaacauuuagaagg

SEQ ID NO: 329897 - RNA, 32 nt, Human
auagacauucugauccccacucccagguauga

SEQ ID NO: 329898 - RNA, 32 nt, Human
auagaccaccaccacccacucacacucugccu

SEQ ID NO: 329899 - RNA, 32 nt, Human
auagaccacuggcugcugaaauacuuuucuug

SEQ ID NO: 329900 - RNA, 22 nt, Human
auagaccaggcgccacugggga

SEQ ID NO: 329901 - RNA, 32 nt, Human
auagacccaagugcaucaugcaagcauaugau

SEQ ID NO: 329902 - RNA, 22 nt, Human
auagacccaauacccauguaga

SEQ ID NO: 329903 - RNA, 32 nt, Human
auagacccacuugggccuucaugccauggccu

SEQ ID NO: 329904 - RNA, 32 nt, Human
auagacccguuagaaaccagcauucuaaagca

SEQ ID NO: 329905 - RNA, 32 nt, Human
auagacccucaagagcccccaagagacaggag

SEQ ID NO: 329906 - RNA, 32 nt, Human
auagacccucgagggcuuguguccauuuggcc

SEQ ID NO: 329907 - RNA, 32 nt, Human
auagaccucaucuagaugucauggccuacauu

SEQ ID NO: 329908 - RNA, 32 nt, Human
auagaccucugcaccuuucacacucauacucc

SEQ ID NO: 329909 - RNA, 32 nt, Human
auagaccugcagcugcaguucuccauguccca

SEQ ID NO: 329910 - RNA, 32 nt, Human
auagacuagagaaaccguccucuuuuuccauc

SEQ ID NO: 329911 - RNA, 32 nt, Human
auagacucaacucaucugcccaaccaaguaug

SEQ ID NO: 329912 - RNA, 32 nt, Human
auagacuccaugccuucucucucccugcaaag

SEQ ID NO: 329913 - RNA, 21 nt, Human
auagacuccuaaggacaaggg

SEQ ID NO: 329914 - RNA, 32 nt, Human
auagacucggguacugugaugauggcugcagu

SEQ ID NO: 329915 - RNA, 32 nt, Human
auagacucugcuacuucaaagcagaaggccaa

SEQ ID NO: 329916 - RNA, 19 nt, Human
auagacugaacagcaggga

SEQ ID NO: 329917 - RNA, 32 nt, Human
auagacugaagaggagcaagaacagaaacagg

SEQ ID NO: 329918 - RNA, 32 nt, Human
auagacugaaggucaggagcuauaguggagug

SEQ ID NO: 329919 - RNA, 32 nt, Human
auagacugcaggaaagcgaagguggagagaga

SEQ ID NO: 329920 - RNA, 32 nt, Human
auagacuuaauuagagaaauuuagacccagaa

SEQ ID NO: 329921 - RNA, 32 nt, Human
auagacuuagcugggugcaguggcucacaccu

SEQ ID NO: 329922 - RNA, 32 nt, Human
auagacuuaggugugagaaugaggugggaggu

SEQ ID NO: 329923 - RNA, 32 nt, Human
auagacuuguucacccuucauguccucaacuc

SEQ ID NO: 329924 - RNA, 32 nt, Human
auagagaaaugaggagguaacagaagagcagu

SEQ ID NO: 329925 - RNA, 32 nt, Human
auagagaacaaaaggaaaagauuguuaccacc

SEQ ID NO: 329926 - RNA, 32 nt, Human
auagagaaggaagggcuucagugaccggcugc

SEQ ID NO: 329927 - RNA, 32 nt, Human
auagagacaacaaaagcacauacucuuuaaag

SEQ ID NO: 329928 - RNA, 32 nt, Human
auagagacaccgaggagccucaguucugcuug

SEQ ID NO: 329929 - RNA, 32 nt, Human
auagagacagaggaacaaaaagagcagcagug

SEQ ID NO: 329930 - RNA, 32 nt, Human
auagagaccaucagauagaagcagggaaggua

SEQ ID NO: 329931 - RNA, 32 nt, Human
auagagaccaucauugcuaacauggugaaacc

SEQ ID NO: 329932 - RNA, 32 nt, Human
auagagaccauccuggccaacacggugaaacc

SEQ ID NO: 329933 - RNA, 32 nt, Human
auagagaccauccuggccaacauggugaaacc

SEQ ID NO: 329934 - RNA, 32 nt, Human
auagagaccaucuuugccaacauggugaaacu

SEQ ID NO: 329935 - RNA, 21 nt, Human
auagagacccccaaaagggaa

SEQ ID NO: 329936 - RNA, 32 nt, Human
auagagagaaagggagccgcugugcugguggg

SEQ ID NO: 329937 - RNA, 32 nt, Human
auagagagacucugcggcccagauucuucagg

SEQ ID NO: 329938 - RNA, 32 nt, Human
auagagagguccagaugucacaugugccaauu

SEQ ID NO: 329939 - RNA, 32 nt, Human
auagagauacacuugcgcuccacagcacugua

SEQ ID NO: 329940 - RNA, 21 nt, Human
auagagauauauaugcuguaa

SEQ ID NO: 329941 - RNA, 32 nt, Human
auagagaucccaacuugaaacaacagccagug

SEQ ID NO: 329942 - RNA, 32 nt, Human
auagagaucgagcuucaggacagagcagccaa

SEQ ID NO: 329943 - RNA, 32 nt, Human
auagagaugguuucacuauguuggccaggcug

SEQ ID NO: 329944 - RNA, 32 nt, Human
auagagauugauuucaagggaguuacauuauu

SEQ ID NO: 329945 - RNA, 32 nt, Human
auagagcacagcaaagaucugccagccccagg

SEQ ID NO: 329946 - RNA, 32 nt, Human
auagagcacccuuccuccugggccagagcugg

SEQ ID NO: 329947 - RNA, 32 nt, Human
auagagcaggguggaagcugcaaguacuggga

SEQ ID NO: 329948 - RNA, 32 nt, Human
auagagccauguguucaguuguggaccugucc

SEQ ID NO: 329949 - RNA, 32 nt, Human
auagagcccuggucaaguucucuccaccucuc

SEQ ID NO: 329950 - RNA, 32 nt, Human
auagagcuagcuggugugguugcagugaccuu

SEQ ID NO: 329951 - RNA, 25 nt, Human
auagagcucugcuagaagucagcca

SEQ ID NO: 329952 - RNA, 32 nt, Human
auagagcuguucaucauggauauuucugcugc

SEQ ID NO: 329953 - RNA, 32 nt, Human
auagagcuucauuccauaccaaagacuuauca

SEQ ID NO: 329954 - RNA, 32 nt, Human
auagagcuugcuggauggaaccugaauuugga

SEQ ID NO: 329955 - RNA, 32 nt, Human
auagaggaagugaaaugccuccacggcugugu

SEQ ID NO: 329956 - RNA, 32 nt, Human
auagaggagaaaggaagaaacacaauggcagg

SEQ ID NO: 329957 - RNA, 32 nt, Human
auagaggagacagauccucucuccuuggauau

SEQ ID NO: 329958 - RNA, 32 nt, Human
auagaggaggugcugaggaguuggugguagca

SEQ ID NO: 329959 - RNA, 32 nt, Human
auagaggaguguuuccucuuuauuuuugcuga

SEQ ID NO: 329960 - RNA, 32 nt, Human
auagaggaugcugacaauaaggacuuggaagu

SEQ ID NO: 329961 - RNA, 32 nt, Human
auagaggcaggcaagccguggauuuugcacau

SEQ ID NO: 329962 - RNA, 32 nt, Human
auagaggcauugaaggguuuuucuuagaugcc

SEQ ID NO: 329963 - RNA, 32 nt, Human
auagaggcauuguagaauagcaguucagacac

SEQ ID NO: 329964 - RNA, 32 nt, Human
auagaggccaaauccagggaccaggcccuaau

SEQ ID NO: 329965 - RNA, 32 nt, Human
auagagggaagagaaaucaaaggggcucucgc

SEQ ID NO: 329966 - RNA, 32 nt, Human
auagagggaagagaaaugaagaaugcaaagug

SEQ ID NO: 329967 - RNA, 32 nt, Human
auagagggaagaggaagaggaggacgaacaga

SEQ ID NO: 329968 - RNA, 32 nt, Human
auagaggggaaagauggccggaggaggaaaag

SEQ ID NO: 329969 - RNA, 32 nt, Human
auagaggggaggcagggagagcuugugggacc

SEQ ID NO: 329970 - RNA, 32 nt, Human
auagaggguauauugcauuuacauuuguaaaa

SEQ ID NO: 329971 - RNA, 32 nt, Human
auagaggucagagacaucaaguuuaauuagaa

SEQ ID NO: 329972 - RNA, 32 nt, Human
auagaggucugggaggaccaggaaacagccuc

SEQ ID NO: 329973 - RNA, 32 nt, Human
auagaggugaugaagacacagaacaggcucag

SEQ ID NO: 329974 - RNA, 32 nt, Human
auagagguguggaaccugaggggccagcaggc

SEQ ID NO: 329975 - RNA, 32 nt, Human
auagaguagguugaacuggccagaccuagaca

SEQ ID NO: 329976 - RNA, 32 nt, Human
auagaguccagaucuugccuccagagauuugc

SEQ ID NO: 329977 - RNA, 32 nt, Human
auagagucuugcuauguuguccaggcugacac

SEQ ID NO: 329978 - RNA, 32 nt, Human
auagagugagcuccuccccaguaccugguaau

SEQ ID NO: 329979 - RNA, 32 nt, Human
auagagugcuuuggugggaguauuuugauuac

SEQ ID NO: 329980 - RNA, 32 nt, Human
auagaguggaaucucuuggaugcagcuucaag

SEQ ID NO: 329981 - RNA, 32 nt, Human
auagagugggaggcagggugcgguggcucaug

SEQ ID NO: 329982 - RNA, 32 nt, Human
auagaguuagguaagaaaguguggaaaguaua

SEQ ID NO: 329983 - RNA, 32 nt, Human
auagaguuuacugaaagguuuuuaaaguccug

SEQ ID NO: 329984 - RNA, 32 nt, Human
auagauaacagcuugaacauuaugaaaugcua

SEQ ID NO: 329985 - RNA, 32 nt, Human
auagauaaccaccuuuaauauuacacugcuua

SEQ ID NO: 329986 - RNA, 32 nt, Human
auagauaaccucuauagggacagaagccucac

SEQ ID NO: 329987 - RNA, 32 nt, Human
auagauaagaucaugagacaguagaagcgaug

SEQ ID NO: 329988 - RNA, 32 nt, Human
auagauaauguucuccacugacacaaaagaag

SEQ ID NO: 329989 - RNA, 32 nt, Human
auagauagggucucacuauauugcccagcuca

SEQ ID NO: 329990 - RNA, 32 nt, Human
auagauagugauauauuucauuuuuaauuugu

SEQ ID NO: 329991 - RNA, 32 nt, Human
auagauauagccaaauuccuucccccaaaaga

SEQ ID NO: 329992 - RNA, 32 nt, Human
auagauaucuucaugccauuacagcuuucuag

SEQ ID NO: 329993 - RNA, 32 nt, Human
auagaucaugaggccuaaaaugaauaaggaaa

SEQ ID NO: 329994 - RNA, 32 nt, Human
auagauccccugccaggcccaggaugauagga

SEQ ID NO: 329995 - RNA, 32 nt, Human
auagauccuccucagcaaggugugugaugccc

SEQ ID NO: 329996 - RNA, 32 nt, Human
auagaucggaguagagaucugccaaguugccu

SEQ ID NO: 329997 - RNA, 32 nt, Human
auagaucguaauaguuguagaagauugguugg

SEQ ID NO: 329998 - RNA, 32 nt, Human
auagaugaaaaauguguuuacugcuuucaguc

SEQ ID NO: 329999 - RNA, 32 nt, Human
auagaugaaugcuuucauuugaguuucauucu

SEQ ID NO: 330000 - RNA, 32 nt, Human
auagaugagagguucccauggagcucacauga

SEQ ID NO: 330001 - RNA, 32 nt, Human
auagaugaggcaugccugggaaaugcucccuu

SEQ ID NO: 330002 - RNA, 32 nt, Human
auagaugcccuaguccacuuuaucuuuguucc

SEQ ID NO: 330003 - RNA, 32 nt, Human
auagaugccugaccaguguccucuucccucag

SEQ ID NO: 330004 - RNA, 32 nt, Human
auagaugcgcaggcacgcacacacaaaacaag

SEQ ID NO: 330005 - RNA, 32 nt, Human
auagaugcuauccuuuaucacgauguucaauu

SEQ ID NO: 330006 - RNA, 32 nt, Human
auagaugcugucuauaauagugaacagucacc

SEQ ID NO: 330007 - RNA, 32 nt, Human
auagauggaggcuaaaaaugaagguuuuucuu

SEQ ID NO: 330008 - RNA, 32 nt, Human
auagauggaguggcugggcaugggggcucaca

SEQ ID NO: 330009 - RNA, 32 nt, Human
auagaugggguuucaccauguuggccaggaug

SEQ ID NO: 330010 - RNA, 32 nt, Human
auagaugugagacagauuugagagagcauuua

SEQ ID NO: 330011 - RNA, 32 nt, Human
auagauguggcuccucauaauucuccaacuuu

SEQ ID NO: 330012 - RNA, 32 nt, Human
auagauuaguuaaugguuuuucuugaauucga

SEQ ID NO: 330013 - RNA, 31 nt, Human
auagauuaguuucagugguucucauuucacu

SEQ ID NO: 330014 - RNA, 32 nt, Human
auagauuauaucuggagugaaggauccugcca

SEQ ID NO: 330015 - RNA, 32 nt, Human
auagauuauucaggacuguccuuuaguucugu

SEQ ID NO: 330016 - RNA, 32 nt, Human
auagauuauuuuauagcuuauuuuggauauuu

SEQ ID NO: 330017 - RNA, 32 nt, Human
auagauucaaugccauccccaucaagcuacca

SEQ ID NO: 330018 - RNA, 32 nt, Human
auagauucauucuuuuauuucuacucauucau

SEQ ID NO: 330019 - RNA, 32 nt, Human
auagauuccuucugcugggucuggaaagucug

SEQ ID NO: 330020 - RNA, 32 nt, Human
auagauucuccauuaagaaauaauucccuuuu

SEQ ID NO: 330021 - RNA, 32 nt, Human
auagauucuuccagauguuuuguuuuauacag

SEQ ID NO: 330022 - RNA, 32 nt, Human
auagauugaggcuacucucaggcaagugagcu

SEQ ID NO: 330023 - RNA, 32 nt, Human
auagauugcaggaaagcgaagguggagagaga

SEQ ID NO: 330024 - RNA, 32 nt, Human
auagauugcuacccuggggcacaauaugugcc

SEQ ID NO: 330025 - RNA, 32 nt, Human
auagauugugccugggguugcuaauucucugc

SEQ ID NO: 330026 - RNA, 32 nt, Human
auagauuguuccuaucccccucuccuugaugu

SEQ ID NO: 330027 - RNA, 32 nt, Human
auagauuuagucgaguggggcaggccugccuc

SEQ ID NO: 330028 - RNA, 32 nt, Human
auagcaaaauugaggccaagggccaagagaau

SEQ ID NO: 330029 - RNA, 32 nt, Human
auagcaaacugaggcugaguagggaacagacc

SEQ ID NO: 330030 - RNA, 19 nt, Human
auagcaaagcuguucucca

SEQ ID NO: 330031 - RNA, 32 nt, Human
auagcaacgagaugaauguauccaacauuuca

SEQ ID NO: 330032 - RNA, 32 nt, Human
auagcaagaaaugcagugucugccuguuacag

SEQ ID NO: 330033 - RNA, 32 nt, Human
auagcaagacucugucucaaaauaauaauaau

SEQ ID NO: 330034 - RNA, 32 nt, Human
auagcaaggacgaccuucccugcuccaugccc

SEQ ID NO: 330035 - RNA, 32 nt, Human
auagcaaggagcaaauuuccacaaagugcuug

SEQ ID NO: 330036 - RNA, 32 nt, Human
auagcaaucacauuaugaagcugcagugauac

SEQ ID NO: 330037 - RNA, 32 nt, Human
auagcaauugcacuccggccugggcaacaaga

SEQ ID NO: 330038 - RNA, 32 nt, Human
auagcaauuuucuguggcacugagaaaccaug

SEQ ID NO: 330039 - RNA, 32 nt, Human
auagcacagaagguaaaauggaagggcugcua

SEQ ID NO: 330040 - RNA, 32 nt, Human
auagcaccacugcacuccagccugggagacag

SEQ ID NO: 330041 - RNA, 32 nt, Human
auagcaccacugcacuccagccugggcaacag

SEQ ID NO: 330042 - RNA, 32 nt, Human
auagcaccacugcacuccagccugggugacag

SEQ ID NO: 330043 - RNA, 32 nt, Human
auagcaccacugcacuccaggcugggugacag

SEQ ID NO: 330044 - RNA, 32 nt, Human
auagcaccacugcacuuuagccugggcgacaa

SEQ ID NO: 330045 - RNA, 32 nt, Human
auagcaccacugcaguccagccugggcgacag

SEQ ID NO: 330046 - RNA, 32 nt, Human
auagcaccacugcaugcaagccugggcaauag

SEQ ID NO: 330047 - RNA, 32 nt, Human
auagcaccacugcgcuccagccugggugagga

SEQ ID NO: 330048 - RNA, 32 nt, Human
auagcaccauugcacuccagccugggcgacuc

SEQ ID NO: 330049 - RNA, 32 nt, Human
auagcaccuggagccucuggaggaagaggagg

SEQ ID NO: 330050 - RNA, 32 nt, Human
auagcacguucgcaaaguacgcucaaagccga

SEQ ID NO: 330051 - RNA, 32 nt, Human
auagcacuaagcugugugccugccugggagac

SEQ ID NO: 330052 - RNA, 32 nt, Human
auagcacuccagccuuagccugggcgacagag

SEQ ID NO: 330053 - RNA, 32 nt, Human
auagcacucccaggccacuuuggucucagugu

SEQ ID NO: 330054 - RNA, 32 nt, Human
auagcacugcaauaaacauacaugugcaugug

SEQ ID NO: 330055 - RNA, 32 nt, Human
auagcacuggacuccagaguuggucugcacgc

SEQ ID NO: 330056 - RNA, 32 nt, Human
auagcacugggauuuugccucccagccaaaau

SEQ ID NO: 330057 - RNA, 32 nt, Human
auagcacuggggaaagcagaacuccauucuca

SEQ ID NO: 330058 - RNA, 32 nt, Human
auagcacugggugugagaaugaucaaggaucu

SEQ ID NO: 330059 - RNA, 32 nt, Human
auagcacuuuucacuucuguguguuuuuaaaa

SEQ ID NO: 330060 - RNA, 32 nt, Human
auagcagaaagaacuuuaaagcucaggagggu

SEQ ID NO: 330061 - RNA, 32 nt, Human
auagcagaaugagagccaaggacuagaaaaac

SEQ ID NO: 330062 - RNA, 32 nt, Human
auagcagacaaugcccucccaaguacugaaau

SEQ ID NO: 330063 - RNA, 32 nt, Human
auagcagaguacaaaccagcugccucacuucu

SEQ ID NO: 330064 - RNA, 32 nt, Human
auagcagaucccuggagagggggcagguccca

SEQ ID NO: 330065 - RNA, 32 nt, Human
auagcagauguaacaccccugagaccccgauu

SEQ ID NO: 330066 - RNA, 32 nt, Human
auagcagauucugucaaccacauuucauaaag

SEQ ID NO: 330067 - RNA, 32 nt, Human
auagcagcgcacugcaaccuggaccuccuggg

SEQ ID NO: 330068 - RNA, 32 nt, Human
auagcagcuagugcggggcauccucauccugu

SEQ ID NO: 330069 - RNA, 32 nt, Human
auagcaggacuuuuagaugaaaaguauucuua

SEQ ID NO: 330070 - RNA, 32 nt, Human
auagcaggagccaaaauaguagaggaggggag

SEQ ID NO: 330071 - RNA, 32 nt, Human
auagcaggcguaaauaccuacuguauacaaug

SEQ ID NO: 330072 - RNA, 32 nt, Human
auagcagggaaugaauuuugaaacuaagcaac

SEQ ID NO: 330073 - RNA, 32 nt, Human
auagcagggaaugagucccucuaaacuauucc

SEQ ID NO: 330074 - RNA, 32 nt, Human
auagcagggacuagggagggaggcagggaacg

SEQ ID NO: 330075 - RNA, 32 nt, Human
auagcagggcugggcucugucuuccuggucau

SEQ ID NO: 330076 - RNA, 32 nt, Human
auagcaggggcugcaguagccauguuaacaug

SEQ ID NO: 330077 - RNA, 32 nt, Human
auagcaguccagaguccauggccccgccuagg

SEQ ID NO: 330078 - RNA, 32 nt, Human
auagcaucagccauggcaggaaugcacaggac

SEQ ID NO: 330079 - RNA, 32 nt, Human
auagcaucugcauucugggaaggaaagcugag

SEQ ID NO: 330080 - RNA, 32 nt, Human
auagcaucuggggacaaguggagccagguaga

SEQ ID NO: 330081 - RNA, 32 nt, Human
auagcaucuuugucauagccuugggagccagg

SEQ ID NO: 330082 - RNA, 32 nt, Human
auagcaugccuguccuaaguuacaguaguuug

SEQ ID NO: 330083 - RNA, 32 nt, Human
auagcaugggaggcucuggaagcuguggcauu

SEQ ID NO: 330084 - RNA, 32 nt, Human
auagcaugggcaagaaaaggcaucaaagaagu

SEQ ID NO: 330085 - RNA, 32 nt, Human
auagcaugggcaagaaaaggcaucaaagaggu

SEQ ID NO: 330086 - RNA, 32 nt, Human
auagcauguacagcacaaagcguuugcucuaa

SEQ ID NO: 330087 - RNA, 32 nt, Human
auagcauuugcccuguggggugcaguguuacc

SEQ ID NO: 330088 - RNA, 32 nt, Human
auagccaacuccaucuagauacaaauuagcag

SEQ ID NO: 330089 - RNA, 25 nt, Human
auagccaauguuaauuguacugcua

SEQ ID NO: 330090 - RNA, 32 nt, Human
auagccacauuuaacuccagccuuggguuuga

SEQ ID NO: 330091 - RNA, 32 nt, Human
auagccaccauuuuguccaagccugggcaugg

SEQ ID NO: 330092 - RNA, 32 nt, Human
auagccacugcacuccagccugggcaacauag

SEQ ID NO: 330093 - RNA, 32 nt, Human
auagccacugcacuccagccugggcaauauag

SEQ ID NO: 330094 - RNA, 32 nt, Human
auagccacugcacuccaucuugggcaacacag

SEQ ID NO: 330095 - RNA, 32 nt, Human
auagccacugcacucuagucuggggaacauau

SEQ ID NO: 330096 - RNA, 32 nt, Human
auagccacugcacuucagccugggcaacauag

SEQ ID NO: 330097 - RNA, 32 nt, Human
auagccacugcacuugagccucuugggaaaca

SEQ ID NO: 330098 - RNA, 32 nt, Human
auagccacugcauaccaaccugggcaauauag

SEQ ID NO: 330099 - RNA, 32 nt, Human
auagccacuggcagcuuugaagaacgggacac

SEQ ID NO: 330100 - RNA, 32 nt, Human
auagccagacaggacgugcaaacaggucucau

SEQ ID NO: 330101 - RNA, 32 nt, Human
auagccagacgccucaccuucucuccauucua

SEQ ID NO: 330102 - RNA, 32 nt, Human
auagccagagaaggagaagcucccauccaaau

SEQ ID NO: 330103 - RNA, 32 nt, Human
auagccagcucuccugauuucccuaacucugc

SEQ ID NO: 330104 - RNA, 32 nt, Human
auagccagugaggagccaggcacacaacuugg

SEQ ID NO: 330105 - RNA, 32 nt, Human
auagccauaagaaaauaucugcuauacaggaa

SEQ ID NO: 330106 - RNA, 32 nt, Human
auagccauaauuuuaccagccuuucugucaua

SEQ ID NO: 330107 - RNA, 32 nt, Human
auagccaugagcuccaauuaccucagagcucc

SEQ ID NO: 330108 - RNA, 31 nt, Human
auagccaugccuuuuggucugaagcuccgcc

SEQ ID NO: 330109 - RNA, 32 nt, Human
auagccauuugaagaaggaggaauuuuagaag

SEQ ID NO: 330110 - RNA, 32 nt, Human
auagccauuuuucaaagguuucuggcucaccc

SEQ ID NO: 330111 - RNA, 32 nt, Human
auagcccaagagagccugcuguguagucacaa

SEQ ID NO: 330112 - RNA, 22 nt, Human
auagcccaaggugacauuuccc

SEQ ID NO: 330113 - RNA, 32 nt, Human
auagcccacugcagccuccaccucccaggcuc

SEQ ID NO: 330114 - RNA, 32 nt, Human
auagcccagcaucuagaaauccuaugaaacgu

SEQ ID NO: 330115 - RNA, 32 nt, Human
auagcccaggcaggaguacaguggcacaaucu

SEQ ID NO: 330116 - RNA, 32 nt, Human
auagcccaucaagcuccugcccuggcugggcc

SEQ ID NO: 330117 - RNA, 32 nt, Human
auagcccaucacaggcucuucacccuuggcag

SEQ ID NO: 330118 - RNA, 32 nt, Human
auagccccacugcacuccagccugggugacag

SEQ ID NO: 330119 - RNA, 32 nt, Human
auagccccaggagugggcuuuagucuccaaua

SEQ ID NO: 330120 - RNA, 32 nt, Human
auagccccagguuccagguagacauuggaauc

SEQ ID NO: 330121 - RNA, 32 nt, Human
auagccccaguaggacaaacgggcucgggucu

SEQ ID NO: 330122 - RNA, 32 nt, Human
auagcccccuccaucauccuucaccuccuauc

SEQ ID NO: 330123 - RNA, 32 nt, Human
auagccccggacugaguccccuccagucgagg

SEQ ID NO: 330124 - RNA, 26 nt, Human
auagccccuggcucuggcaucucucc

SEQ ID NO: 330125 - RNA, 32 nt, Human
auagcccgaagucucauggcagucccaaagga

SEQ ID NO: 330126 - RNA, 32 nt, Human
auagcccuacuccugccuccccaaaucagaua

SEQ ID NO: 330127 - RNA, 32 nt, Human
auagcccuugcucucccaugcccaccccacuu

SEQ ID NO: 330128 - RNA, 32 nt, Human
auagccgccauguugauuucacauuaaacugu

SEQ ID NO: 330129 - RNA, 32 nt, Human
auagccggcuaaaucuggaaugugagugcuac

SEQ ID NO: 330130 - RNA, 32 nt, Human
auagccguuccuucccccucuaggccuuguau

SEQ ID NO: 330131 - RNA, 32 nt, Human
auagccuacauuuguauuuauuuucuauucca

SEQ ID NO: 330132 - RNA, 32 nt, Human
auagccuagagaaaccaaggcaaaugguugcu

SEQ ID NO: 330133 - RNA, 23 nt, Human
auagccuaggugacagagugaga

SEQ ID NO: 330134 - RNA, 32 nt, Human
auagccuccagcggaaugcugaguuugucaug

SEQ ID NO: 330135 - RNA, 28 nt, Human
auagccucgggugcugccuguagucaug

SEQ ID NO: 330136 - RNA, 32 nt, Human
auagccuggccgagccugggaaccaccugggg

SEQ ID NO: 330137 - RNA, 32 nt, Human
auagccuggcgggggcuggcagagccacaccc

SEQ ID NO: 330138 - RNA, 32 nt, Human
auagccugggcaacauagcaagaccccaucuc

SEQ ID NO: 330139 - RNA, 32 nt, Human
auagccuguuugaaaacuggaaaggagagcac

SEQ ID NO: 330140 - RNA, 32 nt, Human
auagcgagguggaggaagggaggcacugggga

SEQ ID NO: 330141 - RNA, 32 nt, Human
auagcgccacugcacugcacgccagccuaggc

SEQ ID NO: 330142 - RNA, 32 nt, Human
auagcgccacugcaguccggccugggugaaag

SEQ ID NO: 330143 - RNA, 32 nt, Human
auagcgccauugcacuccagccugagcgacag

SEQ ID NO: 330144 - RNA, 32 nt, Human
auagcgccauugcacuccagccugggcaacaa

SEQ ID NO: 330145 - RNA, 32 nt, Human
auagcgccauugcacuccagccugggcgacug

SEQ ID NO: 330146 - RNA, 32 nt, Human
auagcgcccacuuuccagggcugugcuaagga

SEQ ID NO: 330147 - RNA, 32 nt, Human
auagcggacuccuccuuucuccuccgaggugg

SEQ ID NO: 330148 - RNA, 32 nt, Human
auagcggcacugcacuccagccugggugacaa

SEQ ID NO: 330149 - RNA, 32 nt, Human
auagcggcauugcacuccagccugggcaacaa

SEQ ID NO: 330150 - RNA, 32 nt, Human
auagcggucaggcccagcaggagcuuggcaca

SEQ ID NO: 330151 - RNA, 32 nt, Human
auagcguaaccauacccccaccucugcuugcu

SEQ ID NO: 330152 - RNA, 32 nt, Human
auagcguaaguuuggaaaguuuagcaaaauca

SEQ ID NO: 330153 - RNA, 32 nt, Human
auagcgugaacccagaagguggagguagcagu

SEQ ID NO: 330154 - RNA, 32 nt, Human
auagcgugaggugcuucucucagucccaauua

SEQ ID NO: 330155 - RNA, 32 nt, Human
auagcuaaaaacaaaagcccauaaaguuggag

SEQ ID NO: 330156 - RNA, 32 nt, Human
auagcuaacucauguaaaaucccuucuccuuu

SEQ ID NO: 330157 - RNA, 32 nt, Human
auagcuaaggaaauuugcuuuuggagaaugua

SEQ ID NO: 330158 - RNA, 32 nt, Human
auagcuaaguagggucuugaggaugcaggggu

SEQ ID NO: 330159 - RNA, 32 nt, Human
auagcuagagaagggaaagacuuuaucauccc

SEQ ID NO: 330160 - RNA, 31 nt, Human
auagcuaggcacuuuauuacucuuuugaacu

SEQ ID NO: 330161 - RNA, 18 nt, Human
auagcuaggccugcaggu

SEQ ID NO: 330162 - RNA, 32 nt, Human
auagcuauccuuggagcuuauguuucagacaa

SEQ ID NO: 330163 - RNA, 32 nt, Human
auagcuaugaaagagaaaggugacaggcacaa

SEQ ID NO: 330164 - RNA, 32 nt, Human
auagcuauugcacuccagccuuggcaacauaa

SEQ ID NO: 330165 - RNA, 32 nt, Human
auagcuauuuugauaggauuugcucacauagu

SEQ ID NO: 330166 - RNA, 32 nt, Human
auagcucaacagugaaaguagcagggaaagag

SEQ ID NO: 330167 - RNA, 32 nt, Human
auagcucacaccuguaaucccagccuggaaug

SEQ ID NO: 330168 - RNA, 32 nt, Human
auagcucacauugagcuuuuggcuccagguga

SEQ ID NO: 330169 - RNA, 32 nt, Human
auagcucacugcaaaucuaacuucaucauggu

SEQ ID NO: 330170 - RNA, 32 nt, Human
auagcucacugcagacuccaacuccuggccuc

SEQ ID NO: 330171 - RNA, 32 nt, Human
auagcucacugcagccucaaacucuuuggcuc

SEQ ID NO: 330172 - RNA, 32 nt, Human
auagcucacugcagccucauacuccugggcuc

SEQ ID NO: 330173 - RNA, 32 nt, Human
auagcucacugcagccuccaacuccuggguuc

SEQ ID NO: 330174 - RNA, 32 nt, Human
auagcucacugcagccucgaacuccugggcuc

SEQ ID NO: 330175 - RNA, 32 nt, Human
auagcucacugcagccucgaacucuugggcuu

SEQ ID NO: 330176 - RNA, 32 nt, Human
auagcucacugcagccucgaaucccugggcuc

SEQ ID NO: 330177 - RNA, 32 nt, Human
auagcucacugcagccuggaauuccugggcuc

SEQ ID NO: 330178 - RNA, 32 nt, Human
auagcucacugcagccuucaacuucugggcuc

SEQ ID NO: 330179 - RNA, 32 nt, Human
auagcucacugcagccuugacccccucccuga

SEQ ID NO: 330180 - RNA, 32 nt, Human
auagcucacugcagccuuuaacuacugggcuc

SEQ ID NO: 330181 - RNA, 32 nt, Human
auagcucacugcagcuuugaccucccagaccc

SEQ ID NO: 330182 - RNA, 32 nt, Human
auagcucacugccagagcagccuggguuccca

SEQ ID NO: 330183 - RNA, 32 nt, Human
auagcucagaaacauuuguaaaagcaagguuu

SEQ ID NO: 330184 - RNA, 32 nt, Human
auagcucagccaaaucucuguuuuauguccug

SEQ ID NO: 330185 - RNA, 32 nt, Human
auagcucagugugcccuugaauccauacaguu

SEQ ID NO: 330186 - RNA, 32 nt, Human
auagcuccaagugucacacaccagaacauuaa

SEQ ID NO: 330187 - RNA, 32 nt, Human
auagcuccagccaggccagaccgagggcugcu

SEQ ID NO: 330188 - RNA, 32 nt, Human
auagcucccugccuccccacugccccuaaagc

SEQ ID NO: 330189 - RNA, 32 nt, Human
auagcucgcuaaaagauucaagcaagggacau

SEQ ID NO: 330190 - RNA, 32 nt, Human
auagcucggugcuauuuugguuuugcauuucc

SEQ ID NO: 330191 - RNA, 32 nt, Human
auagcucuaacuucuguauaccaauaaaauaa

SEQ ID NO: 330192 - RNA, 32 nt, Human
auagcucuauauugaaugaaagccacugugcu

SEQ ID NO: 330193 - RNA, 32 nt, Human
auagcucucuccugcuaccagucugugccuua

SEQ ID NO: 330194 - RNA, 32 nt, Human
auagcucugcauuuacagcagcuccugcucag

SEQ ID NO: 330195 - RNA, 32 nt, Human
auagcucugcggagguggaaguuggggagcuu

SEQ ID NO: 330196 - RNA, 32 nt, Human
auagcucugguggcucaugccuguaauccagc

SEQ ID NO: 330197 - RNA, 32 nt, Human
auagcucuuccccaccuccucauuuuaguaaa

SEQ ID NO: 330198 - RNA, 32 nt, Human
auagcucuuugggucccacuguuccauuuuau

SEQ ID NO: 330199 - RNA, 32 nt, Human
auagcucuuuuucuguuuuuccuugcucauuu

SEQ ID NO: 330200 - RNA, 32 nt, Human
auagcugaagugaggugucuggguuagacaau

SEQ ID NO: 330201 - RNA, 32 nt, Human
auagcugagccaagugagugaguuugcagaaa

SEQ ID NO: 330202 - RNA, 21 nt, Human
auagcugaugauucuguagua

SEQ ID NO: 330203 - RNA, 32 nt, Human
auagcugcauaucuuuuuccucugcuucauuu

SEQ ID NO: 330204 - RNA, 32 nt, Human
auagcugcgccccagcaaggagggucaugggc

SEQ ID NO: 330205 - RNA, 32 nt, Human
auagcugcugccuccuaaucuuccugcuagug

SEQ ID NO: 330206 - RNA, 32 nt, Human
auagcuggaauuacaggugugagccaccaugc

SEQ ID NO: 330207 - RNA, 21 nt, Human
auagcuggagcaaaccugggg

SEQ ID NO: 330208 - RNA, 32 nt, Human
auagcuggccugagaaggcagugcaagcccca

SEQ ID NO: 330209 - RNA, 32 nt, Human
auagcugggaggagaggaagauggauaauuaa

SEQ ID NO: 330210 - RNA, 32 nt, Human
auagcugggaggcugcagagggugcugggagc

SEQ ID NO: 330211 - RNA, 32 nt, Human
auagcugggauuacaggugcacgccaccaugc

SEQ ID NO: 330212 - RNA, 32 nt, Human
auagcugggauuacaggugcaugccaccacac

SEQ ID NO: 330213 - RNA, 32 nt, Human
auagcugggauuacaguugccugccaccacgc

SEQ ID NO: 330214 - RNA, 32 nt, Human
auagcugggauuauaggugccugccaccaugc

SEQ ID NO: 330215 - RNA, 32 nt, Human
auagcuggugaaggacaccuccauccauucca

SEQ ID NO: 330216 - RNA, 32 nt, Human
auagcuguaaggacagucaccuugcaaguggg

SEQ ID NO: 330217 - RNA, 32 nt, Human
auagcuguaggggagcacugagagucugacag

SEQ ID NO: 330218 - RNA, 20 nt, Human
auagcuguaguuuuaaucuu

SEQ ID NO: 330219 - RNA, 32 nt, Human
auagcuguuggaguaaaguugcaguggaagcu

SEQ ID NO: 330220 - RNA, 32 nt, Human
auagcuuaugccuaggagguugaggcugcagu

SEQ ID NO: 330221 - RNA, 32 nt, Human
auagcuuccaauaaagcagccucauucugagg

SEQ ID NO: 330222 - RNA, 32 nt, Human
auagcuuccccauccaaaacauaaaguuauag

SEQ ID NO: 330223 - RNA, 32 nt, Human
auagcuucuuccaggucauagugucugccccc

SEQ ID NO: 330224 - RNA, 32 nt, Human
auagcuugaacccaggagacagagguugcagu

SEQ ID NO: 330225 - RNA, 32 nt, Human
auagcuugaacccaggagguggagguugcagu

SEQ ID NO: 330226 - RNA, 32 nt, Human
auagcuugaacccaguggcggaggcugcagug

SEQ ID NO: 330227 - RNA, 32 nt, Human
auagcuugaacccgggaggcggagauugcggu

SEQ ID NO: 330228 - RNA, 32 nt, Human
auagcuugggcuguuccuucucugauacggga

SEQ ID NO: 330229 - RNA, 32 nt, Human
auagcuugugcuucugaggugcacugaauuca

SEQ ID NO: 330230 - RNA, 32 nt, Human
auagcuuucaauuguucuuucuggaagacuuu

SEQ ID NO: 330231 - RNA, 32 nt, Human
auagcuuucauccugaaauuucagccaugaau

SEQ ID NO: 330232 - RNA, 32 nt, Human
auagcuuuccaaaaugaaaguuacuugaggca

SEQ ID NO: 330233 - RNA, 32 nt, Human
auagcuuuccccacagcucagccuggggccug

SEQ ID NO: 330234 - RNA, 22 nt, Human
auagcuuucgggggaggagaga

SEQ ID NO: 330235 - RNA, 32 nt, Human
auagcuuuuuaacuuuguuugcacugggugug

SEQ ID NO: 330236 - RNA, 32 nt, Human
auaggaaaacagccuguugcaugguaagagug

SEQ ID NO: 330237 - RNA, 32 nt, Human
auaggaaaagguaacuagaaguuguacgaagu

SEQ ID NO: 330238 - RNA, 23 nt, Human
auaggaaacagugaccauuuuca

SEQ ID NO: 330239 - RNA, 23 nt, Human
auaggaaacugaaacucugugga

SEQ ID NO: 330240 - RNA, 32 nt, Human
auaggaaagaggaggaugaggucugggguucu

SEQ ID NO: 330241 - RNA, 32 nt, Human
auaggaaagauacaucagauuuacagauuaug

SEQ ID NO: 330242 - RNA, 32 nt, Human
auaggaaaugucccccaucucccuuccugcac

SEQ ID NO: 330243 - RNA, 32 nt, Human
auaggaacgucaaagcucuguauaccuacuaa

SEQ ID NO: 330244 - RNA, 32 nt, Human
auaggaacuuguagggcucauuuugguuucau

SEQ ID NO: 330245 - RNA, 32 nt, Human
auaggaagagaaggagaugcucacagauacaa

SEQ ID NO: 330246 - RNA, 32 nt, Human
auaggaagagggcuagaaaccuaacugauucu

SEQ ID NO: 330247 - RNA, 32 nt, Human
auaggaagcuccugggcuuagcugugggaagc

SEQ ID NO: 330248 - RNA, 32 nt, Human
auaggaagggcauuccaggcagagggaaaccu

SEQ ID NO: 330249 - RNA, 32 nt, Human
auaggaaguacauucuagaggaaagguuuuug

SEQ ID NO: 330250 - RNA, 32 nt, Human
auaggaaucucuauuugcuguauuuauugugu

SEQ ID NO: 330251 - RNA, 32 nt, Human
auaggaauguugcuaugaggacagauucauca

SEQ ID NO: 330252 - RNA, 31 nt, Human
auaggaauuuacuucuuuuccuugaauggag

SEQ ID NO: 330253 - RNA, 31 nt, Human
auaggaauuuacuucuuuuccuugaguggaa

SEQ ID NO: 330254 - RNA, 32 nt, Human
auaggaauuugagaaagguguaagaaauagga

SEQ ID NO: 330255 - RNA, 32 nt, Human
auaggacagaacccuuucagggcugaagaaag

SEQ ID NO: 330256 - RNA, 32 nt, Human
auaggacaucuggcucccagcauccaaauuaa

SEQ ID NO: 330257 - RNA, 32 nt, Human
auaggacauuuuccuuucuucuuucuguuuuc

SEQ ID NO: 330258 - RNA, 28 nt, Human
auaggaccaauaaauccuuuggaagagc

SEQ ID NO: 330259 - RNA, 32 nt, Human
auaggacugcccugcagggacaguuacuuaac

SEQ ID NO: 330260 - RNA, 32 nt, Human
auaggacugcccugcagggacaguuauuuaac

SEQ ID NO: 330261 - RNA, 24 nt, Human
auaggagaagagagagaucgcugu

SEQ ID NO: 330262 - RNA, 32 nt, Human
auaggagaagaggaggaggaggagcggggucc

SEQ ID NO: 330263 - RNA, 22 nt, Human
auaggagaagugagaauacugu

SEQ ID NO: 330264 - RNA, 32 nt, Human
auaggagacuccuguaccuuucuucguuuuac

SEQ ID NO: 330265 - RNA, 32 nt, Human
auaggagaugagcaauggcagcuuuggggacc

SEQ ID NO: 330266 - RNA, 32 nt, Human
auaggaggagagaaaauggggaugccaagaau

SEQ ID NO: 330267 - RNA, 32 nt, Human
auaggaggaggcagaggggugccuggaguuuc

SEQ ID NO: 330268 - RNA, 32 nt, Human
auaggaggcugaggcaggagaaucacuugaac

SEQ ID NO: 330269 - RNA, 32 nt, Human
auaggagggagagagggaaggggcugaggaaa

SEQ ID NO: 330270 - RNA, 23 nt, Human
auaggaguacgcugccugggagg

SEQ ID NO: 330271 - RNA, 32 nt, Human
auaggagucagauacaaaaagaaaaaucacug

SEQ ID NO: 330272 - RNA, 20 nt, Human
auaggagucauguccagagg

SEQ ID NO: 330273 - RNA, 31 nt, Human
auaggagugaagagagaaaagacuaacagga

SEQ ID NO: 330274 - RNA, 32 nt, Human
auaggagugaucucaagugagauagcagagca

SEQ ID NO: 330275 - RNA, 32 nt, Human
auaggagugauggcccaucacauucaguuuuc

SEQ ID NO: 330276 - RNA, 32 nt, Human
auaggaguuacuggagugaagcuccuauguga

SEQ ID NO: 330277 - RNA, 32 nt, Human
auaggaguucacuucaucuucucagcucccau

SEQ ID NO: 330278 - RNA, 32 nt, Human
auaggaguucauccugaaaagcugugacucau

SEQ ID NO: 330279 - RNA, 32 nt, Human
auaggaguugcuuacugaacugaauaucuuug

SEQ ID NO: 330280 - RNA, 32 nt, Human
auaggaguuugagaccagccuggguaacaugg

SEQ ID NO: 330281 - RNA, 32 nt, Human
auaggauaacauucgaugucccugccauuagu

SEQ ID NO: 330282 - RNA, 32 nt, Human
auaggauauugaggcaggagaaucgcuugaac

SEQ ID NO: 330283 - RNA, 32 nt, Human
auaggaucccaaaauucaucucuaaugugguu

SEQ ID NO: 330284 - RNA, 32 nt, Human
auaggaucccaugaggaugguccccuucaccu

SEQ ID NO: 330285 - RNA, 32 nt, Human
auaggaucucacuauguugcccaggcuguucu

SEQ ID NO: 330286 - RNA, 32 nt, Human
auaggaucuggguuuagaguguguaucauuaa

SEQ ID NO: 330287 - RNA, 32 nt, Human
auaggaugaucaccuccaguccuucggacuua

SEQ ID NO: 330288 - RNA, 32 nt, Human
auaggauuauccugcugccaucaugucuuggu

SEQ ID NO: 330289 - RNA, 32 nt, Human
auaggcaaagagaguugaucacuuccaggguc

SEQ ID NO: 330290 - RNA, 32 nt, Human
auaggcaagguagaugaaguugcuuugccagu

SEQ ID NO: 330291 - RNA, 32 nt, Human
auaggcaccaaagaaggcccagagagguuuaa

SEQ ID NO: 330292 - RNA, 32 nt, Human
auaggcacuugggaugucugagaucagugccu

SEQ ID NO: 330293 - RNA, 31 nt, Human
auaggcagaggagaaugucagaugcucagcu

SEQ ID NO: 330294 - RNA, 32 nt, Human
auaggcagcuggagagaucugugugacacaag

SEQ ID NO: 330295 - RNA, 32 nt, Human
auaggcaggaguaagggugggucuggguauau

SEQ ID NO: 330296 - RNA, 32 nt, Human
auaggcagucuucugcagacuuaacauguuuu

SEQ ID NO: 330297 - RNA, 32 nt, Human
auaggcaugguggcaaguaccuguagucucag

SEQ ID NO: 330298 - RNA, 32 nt, Human
auaggccaacccagacacagugcgguaccaga

SEQ ID NO: 330299 - RNA, 32 nt, Human
auaggccaaggaaaucugcauguauuuuugga

SEQ ID NO: 330300 - RNA, 32 nt, Human
auaggccacauccuuggggucuucuuauuacc

SEQ ID NO: 330301 - RNA, 32 nt, Human
auaggccagaaagugcuccaaauguccacuug

SEQ ID NO: 330302 - RNA, 32 nt, Human
auaggccaggcugguagcuucaccuuaccugg

SEQ ID NO: 330303 - RNA, 32 nt, Human
auaggccagggcauguguaugugucugcuaau

SEQ ID NO: 330304 - RNA, 32 nt, Human
auaggccaucaucagcugcaucagccuucaag

SEQ ID NO: 330305 - RNA, 32 nt, Human
auaggcccaggcuauccaggcugcaguggagc

SEQ ID NO: 330306 - RNA, 32 nt, Human
auaggcccugaggcacacagcccagccccuug

SEQ ID NO: 330307 - RNA, 32 nt, Human
auaggccuagaacuucucaucagcuccuguuu

SEQ ID NO: 330308 - RNA, 32 nt, Human
auaggccucagggugcacacaggauggcagga

SEQ ID NO: 330309 - RNA, 24 nt, Human
auaggccuccaagggcuccaggga

SEQ ID NO: 330310 - RNA, 32 nt, Human
auaggccucuggggcugagaugugaggaggag

SEQ ID NO: 330311 - RNA, 32 nt, Human
auaggccuguaaucguagcgcuuugagaggcu

SEQ ID NO: 330312 - RNA, 32 nt, Human
auaggccuguaauuccagcuacucuggcugcu

SEQ ID NO: 330313 - RNA, 32 nt, Human
auaggcgguucggagccaguucugccuaacuu

SEQ ID NO: 330314 - RNA, 32 nt, Human
auaggcgugguggcucaugccuauaaucccag

SEQ ID NO: 330315 - RNA, 32 nt, Human
auaggcucaaacacucagucuaaugccauguc

SEQ ID NO: 330316 - RNA, 32 nt, Human
auaggcucagaacuuuuacaggucgcgcugca

SEQ ID NO: 330317 - RNA, 32 nt, Human
auaggcuccccuaggcuacugucaguaaaagg

SEQ ID NO: 330318 - RNA, 32 nt, Human
auaggcucugauuuccggggcagccuuucaga

SEQ ID NO: 330319 - RNA, 32 nt, Human
auaggcugaggcagguggauugcuugagcucg

SEQ ID NO: 330320 - RNA, 32 nt, Human
auaggcugggagacugaagacucagcccgggu

SEQ ID NO: 330321 - RNA, 32 nt, Human
auaggcuggggugggaggguggagaauaagug

SEQ ID NO: 330322 - RNA, 32 nt, Human
auaggcuuuaugcucaaaugucauagucuccu

SEQ ID NO: 330323 - RNA, 32 nt, Human
auaggcuuuaugcucacaucauugucccauac

SEQ ID NO: 330324 - RNA, 22 nt, Human
auaggcuuucacagacugggga

SEQ ID NO: 330325 - RNA, 32 nt, Human
auaggcuuuguugaugaaaaacgacaauugaa

SEQ ID NO: 330326 - RNA, 32 nt, Human
auaggcuuuucuucccuuggggcucaugcucc

SEQ ID NO: 330327 - RNA, 19 nt, Human
auagggaaacacugucuca

SEQ ID NO: 330328 - RNA, 32 nt, Human
auagggaaaccugacaucucauuuucucagug

SEQ ID NO: 330329 - RNA, 32 nt, Human
auagggaaaggccauaaacaaagacagacuug

SEQ ID NO: 330330 - RNA, 32 nt, Human
auagggaaauaagguuccaaagaaaaccuuac

SEQ ID NO: 330331 - RNA, 32 nt, Human
auagggaaaucauuagguuucucuccagaugg

SEQ ID NO: 330332 - RNA, 32 nt, Human
auagggaaauuagguaacuuuccccagguaac

SEQ ID NO: 330333 - RNA, 32 nt, Human
auagggaagagaaagaaauggaagcacagcuu

SEQ ID NO: 330334 - RNA, 32 nt, Human
auagggaagucacgaaggauugcuugacauca

SEQ ID NO: 330335 - RNA, 32 nt, Human
auagggacagaagccucacaggucaagacugg

SEQ ID NO: 330336 - RNA, 32 nt, Human
auagggacccauucuacacagagcaggacugc

SEQ ID NO: 330337 - RNA, 32 nt, Human
auagggacgagcucaccacacaacaaccaagg

SEQ ID NO: 330338 - RNA, 32 nt, Human
auagggacugaauauggacccugcugaaagca

SEQ ID NO: 330339 - RNA, 32 nt, Human
auagggacuugcaguaugagggcugccauucu

SEQ ID NO: 330340 - RNA, 32 nt, Human
auagggagagaccccagagagcuuguucccuc

SEQ ID NO: 330341 - RNA, 32 nt, Human
auagggagagcuccucucggugaacaguccaa

SEQ ID NO: 330342 - RNA, 32 nt, Human
auagggagagguggcuguuaacagugggcugc

SEQ ID NO: 330343 - RNA, 32 nt, Human
auagggagagugaaggagggauaugugguaga

SEQ ID NO: 330344 - RNA, 32 nt, Human
auagggagcagucagacacagggagauuaaga

SEQ ID NO: 330345 - RNA, 32 nt, Human
auagggagcuccuuugggaucauagaaaagaa

SEQ ID NO: 330346 - RNA, 32 nt, Human
auagggaggaggaggcuucagccaucagcaau

SEQ ID NO: 330347 - RNA, 32 nt, Human
auagggaggcccaagaaaaggaagagagacgc

SEQ ID NO: 330348 - RNA, 32 nt, Human
auagggagggaggggacauaaagggaaugcau

SEQ ID NO: 330349 - RNA, 32 nt, Human
auagggagucuccaaaccaaagccugguggcc

SEQ ID NO: 330350 - RNA, 32 nt, Human
auagggaguuaagugguacuuucacaauccaa

SEQ ID NO: 330351 - RNA, 32 nt, Human
auagggauagaagaguugaaaagggaaagcaa

SEQ ID NO: 330352 - RNA, 32 nt, Human
auagggaucuggagguagaaucaagacgaaug

SEQ ID NO: 330353 - RNA, 32 nt, Human
auagggauuuaugaauggggcuuucaccuucu

SEQ ID NO: 330354 - RNA, 32 nt, Human
auagggcaaucaggacaaaaucugacuuucga

SEQ ID NO: 330355 - RNA, 32 nt, Human
auagggcagccgcggcggcgguggcacagcag

SEQ ID NO: 330356 - RNA, 32 nt, Human
auagggcaggagucuggccaggagcccaaggu

SEQ ID NO: 330357 - RNA, 32 nt, Human
auagggcagggggccucacugccuuguugguc

SEQ ID NO: 330358 - RNA, 32 nt, Human
auagggcauaagagagaagaagauguacuuac

SEQ ID NO: 330359 - RNA, 32 nt, Human
auagggccaccugaacuagccucgccuguccc

SEQ ID NO: 330360 - RNA, 32 nt, Human
auagggcccagcaaucccacuccuggggauag

SEQ ID NO: 330361 - RNA, 31 nt, Human
auagggcccaggaaaaugcagaugcugacga

SEQ ID NO: 330362 - RNA, 32 nt, Human
auagggcccugccuugccuugccuucccggca

SEQ ID NO: 330363 - RNA, 32 nt, Human
auagggcccuggaaggagugcagcaguuacug

SEQ ID NO: 330364 - RNA, 32 nt, Human
auagggcgcagaggagagaacuuccgaaggca

SEQ ID NO: 330365 - RNA, 32 nt, Human
auagggcucagcccaggcagccagcuuugggc

SEQ ID NO: 330366 - RNA, 32 nt, Human
auagggcucugcccucccccugucagcauggc

SEQ ID NO: 330367 - RNA, 32 nt, Human
auagggcugauaguccaaccaggggacagggu

SEQ ID NO: 330368 - RNA, 32 nt, Human
auagggcuggggacuggggaaggggagggugu

SEQ ID NO: 330369 - RNA, 32 nt, Human
auaggggaaauggcacuuaauagagguuuaau

SEQ ID NO: 330370 - RNA, 32 nt, Human
auaggggagagggaacagagcccagugaaaug

SEQ ID NO: 330371 - RNA, 32 nt, Human
auaggggaggcugaagcaggaggaucacuuga

SEQ ID NO: 330372 - RNA, 32 nt, Human
auaggggagguggagauuccagggguggguga

SEQ ID NO: 330373 - RNA, 32 nt, Human
auaggggagugagguauggccacugaggauuu

SEQ ID NO: 330374 - RNA, 32 nt, Human
auaggggaucucacccacccaguucagcagcg

SEQ ID NO: 330375 - RNA, 32 nt, Human
auaggggauguauucuaaaaacugacagaaaa

SEQ ID NO: 330376 - RNA, 32 nt, Human
auaggggcaaaaauuugacauugucagaaugu

SEQ ID NO: 330377 - RNA, 32 nt, Human
auaggggcagguuguauggcagaugcaccuga

SEQ ID NO: 330378 - RNA, 32 nt, Human
auaggggcauugaaauuuacucccaccaccag

SEQ ID NO: 330379 - RNA, 32 nt, Human
auaggggccaugggagccggcgccaaguagcc

SEQ ID NO: 330380 - RNA, 32 nt, Human
auaggggcucucuccccucucccaucucaaga

SEQ ID NO: 330381 - RNA, 32 nt, Human
auaggggcuggcacacaguaggagcucagugc

SEQ ID NO: 330382 - RNA, 32 nt, Human
auagggggaccagcuucugccagaaguuggug

SEQ ID NO: 330383 - RNA, 32 nt, Human
auagggggcucaaguucugcccuggugagcug

SEQ ID NO: 330384 - RNA, 32 nt, Human
auagggguuggaaggaaaaccuucaagaccua

SEQ ID NO: 330385 - RNA, 32 nt, Human
auaggguaucugagaagaugggugauucuucu

SEQ ID NO: 330386 - RNA, 32 nt, Human
auagggucacugggcgcuuggguguucguugc

SEQ ID NO: 330387 - RNA, 32 nt, Human
auagggucucucuauguugcccuagcucgucu

SEQ ID NO: 330388 - RNA, 32 nt, Human
auagggucuguuucacaggccauuucugugaa

SEQ ID NO: 330389 - RNA, 32 nt, Human
auagggucuugcacuccagcccaggcgagaga

SEQ ID NO: 330390 - RNA, 32 nt, Human
auagggucuugcuauguugcccaggcuggucu

SEQ ID NO: 330391 - RNA, 32 nt, Human
auagggucuugcuauguugcccaggcugguug

SEQ ID NO: 330392 - RNA, 32 nt, Human
auagggucuuucuauguugcccaggcucgucu

SEQ ID NO: 330393 - RNA, 32 nt, Human
auagggugagugugagggcugucaggcagcgu

SEQ ID NO: 330394 - RNA, 32 nt, Human
auagggugggaguggggguuugggagacgggu

SEQ ID NO: 330395 - RNA, 32 nt, Human
auaggguguccaccucuccccggugcucgccu

SEQ ID NO: 330396 - RNA, 32 nt, Human
auaggguguuugauauuucuucauauguuaag

SEQ ID NO: 330397 - RNA, 32 nt, Human
auaggguuggacucaucucagcagaauauggc

SEQ ID NO: 330398 - RNA, 32 nt, Human
auaggguuucauuacauugcucaggcuggucu

SEQ ID NO: 330399 - RNA, 32 nt, Human
auaggguuuuuggagggcuccucugggaaaug

SEQ ID NO: 330400 - RNA, 32 nt, Human
auagguaagaaagguuaaagagaaaugacuuu

SEQ ID NO: 330401 - RNA, 28 nt, Human
auagguacaagugcugcuuugucagccu

SEQ ID NO: 330402 - RNA, 32 nt, Human
auagguacagaaacugagguucagagaaguga

SEQ ID NO: 330403 - RNA, 32 nt, Human
auagguagauagagugccuuucuguuucuuuu

SEQ ID NO: 330404 - RNA, 24 nt, Human
auagguaucuagagcuuaaugcua

SEQ ID NO: 330405 - RNA, 32 nt, Human
auagguauucuccucauuuugugaaagaaaug

SEQ ID NO: 330406 - RNA, 32 nt, Human
auaggucacagaguugcugggccuaccgcagg

SEQ ID NO: 330407 - RNA, 32 nt, Human
auaggucacaucugguugguggaaaacuaggu

SEQ ID NO: 330408 - RNA, 32 nt, Human
auaggucacauuuugggaguucagaggaggcc

SEQ ID NO: 330409 - RNA, 32 nt, Human
auaggucacugcagccucaaacucccaaauga

SEQ ID NO: 330410 - RNA, 32 nt, Human
auaggucagcuccaccuggagugcgaauugcc

SEQ ID NO: 330411 - RNA, 32 nt, Human
auaggucagguaaaguucuaggcacagggaau

SEQ ID NO: 330412 - RNA, 32 nt, Human
auaggucagucuuagaaauacacugcuaaugu

SEQ ID NO: 330413 - RNA, 32 nt, Human
auaggucauuaacuugaaacucuuaucaaaau

SEQ ID NO: 330414 - RNA, 32 nt, Human
auaggucauuuuugucuguggcauuuuuacug

SEQ ID NO: 330415 - RNA, 32 nt, Human
auagguccacacacaggugguguuacuguccc

SEQ ID NO: 330416 - RNA, 32 nt, Human
auaggucugcacugcaacuucuguauccuucc

SEQ ID NO: 330417 - RNA, 32 nt, Human
auaggugaaagccauacaggcagcugcugcaa

SEQ ID NO: 330418 - RNA, 32 nt, Human
auaggugaagaguggcugggguuugaaccuuu

SEQ ID NO: 330419 - RNA, 32 nt, Human
auaggugacacacuuccaacacugugaauugc

SEQ ID NO: 330420 - RNA, 32 nt, Human
auaggugacaguguuaaccgugaaaacuugag

SEQ ID NO: 330421 - RNA, 32 nt, Human
auaggugacugcacugcagcccacauggagag

SEQ ID NO: 330422 - RNA, 32 nt, Human
auaggugauggccuggugggguggcucaugcc

SEQ ID NO: 330423 - RNA, 32 nt, Human
auaggugcagcaaaccaccauggcacacguuu

SEQ ID NO: 330424 - RNA, 32 nt, Human
auaggugcagcaaaccaccauggcacauguau

SEQ ID NO: 330425 - RNA, 32 nt, Human
auaggugcagcaaaccaccauggugcauguau

SEQ ID NO: 330426 - RNA, 32 nt, Human
auaggugcccaccaccaugccuggcugauuuu

SEQ ID NO: 330427 - RNA, 32 nt, Human
auaggugcccgccaccagacccggcuaauuuu

SEQ ID NO: 330428 - RNA, 32 nt, Human
auaggugccugccaccaugcccggcuaauuuu

SEQ ID NO: 330429 - RNA, 32 nt, Human
auagguggaaacaggaaugauagaaucauaaa

SEQ ID NO: 330430 - RNA, 32 nt, Human
auagguggaugugccaagaugcuggugaacuu

SEQ ID NO: 330431 - RNA, 32 nt, Human
auagguggcugcagaggcgaggugacggcgcg

SEQ ID NO: 330432 - RNA, 32 nt, Human
auaggugggacuguaucucacagaacccuggu

SEQ ID NO: 330433 - RNA, 32 nt, Human
auaggugggggaaaaugaauuuuguaugcuga

SEQ ID NO: 330434 - RNA, 32 nt, Human
auagguggguguauucuggucugcaccacacc

SEQ ID NO: 330435 - RNA, 32 nt, Human
auagguuaaaauggcugaaaaugugaucuuug

SEQ ID NO: 330436 - RNA, 32 nt, Human
auagguuaaauggugcagguaccucauagcca

SEQ ID NO: 330437 - RNA, 32 nt, Human
auagguuaugaagaaaaaugcaaaguagcaau

SEQ ID NO: 330438 - RNA, 32 nt, Human
auagguucugguagcuucugugccuggguagu

SEQ ID NO: 330439 - RNA, 32 nt, Human
auagguuggggucccaguaggagggcucaggg

SEQ ID NO: 330440 - RNA, 32 nt, Human
auagguuguaaacugaaugcugugauaauacu

SEQ ID NO: 330441 - RNA, 32 nt, Human
auagguuucauaauucuaacauccacaccaua

SEQ ID NO: 330442 - RNA, 32 nt, Human
auaguaaaagcaguaaaacagccccaggcagg

SEQ ID NO: 330443 - RNA, 26 nt, Human
auaguaaaauuguuaguaaaucauua

SEQ ID NO: 330444 - RNA, 32 nt, Human
auaguaaauuacauuucuaaucccagaggacu

SEQ ID NO: 330445 - RNA, 32 nt, Human
auaguaaccaaggagcagugaacagcagcuac

SEQ ID NO: 330446 - RNA, 32 nt, Human
auaguaacuuuucuaaggauugaauaaauuga

SEQ ID NO: 330447 - RNA, 21 nt, Human
auaguaagggcucaguaaaua

SEQ ID NO: 330448 - RNA, 21 nt, Human
auaguaaguguacaguaaaua

SEQ ID NO: 330449 - RNA, 32 nt, Human
auaguaaguuucuguguaacccaucucaauua

SEQ ID NO: 330450 - RNA, 32 nt, Human
auaguaauaauacaaaaauuagcugggcgugg

SEQ ID NO: 330451 - RNA, 32 nt, Human
auaguaauaauagugacagaggaugugaguua

SEQ ID NO: 330452 - RNA, 32 nt, Human
auaguaauauccauccuauguuugucccacua

SEQ ID NO: 330453 - RNA, 32 nt, Human
auaguaauuuggaaacuguuggaagguggcac

SEQ ID NO: 330454 - RNA, 32 nt, Human
auaguacacuagcaaaauggguaauaaacuag

SEQ ID NO: 330455 - RNA, 32 nt, Human
auaguacacuggcuguuuucugccagcaacug

SEQ ID NO: 330456 - RNA, 32 nt, Human
auaguacauaguuugaaaagcacuuggccguc

SEQ ID NO: 330457 - RNA, 32 nt, Human
auaguacaugucuauuuaacagcaccgauucc

SEQ ID NO: 330458 - RNA, 31 nt, Human
auaguacauuuucccuuccauuuaaaauguc

SEQ ID NO: 330459 - RNA, 32 nt, Human
auaguaccacugcacuccagccugggcaacag

SEQ ID NO: 330460 - RNA, 32 nt, Human
auaguaccacugcacuccagccugggcgacag

SEQ ID NO: 330461 - RNA, 32 nt, Human
auaguacuccacuuccggacuccuggacugca

SEQ ID NO: 330462 - RNA, 32 nt, Human
auaguacucuggaagguggcuugagguggagg

SEQ ID NO: 330463 - RNA, 32 nt, Human
auaguacuugcagcuagauggaugcuuuuagc

SEQ ID NO: 330464 - RNA, 32 nt, Human
auaguacuuuauccucccuuuucuaucucuuu

SEQ ID NO: 330465 - RNA, 32 nt, Human
auaguagaagcagcaaguagcaaacuucagga

SEQ ID NO: 330466 - RNA, 32 nt, Human
auaguagaucauaccaucuagguuuguguaag

SEQ ID NO: 330467 - RNA, 23 nt, Human
auaguagguguucaauaaauauu

SEQ ID NO: 330468 - RNA, 32 nt, Human
auaguagugaccgaggaauugugucuuaugcg

SEQ ID NO: 330469 - RNA, 32 nt, Human
auaguagugugaucauagcucacugcagccuc

SEQ ID NO: 330470 - RNA, 32 nt, Human
auaguauacaaaaggagugaaaagccaagagg

SEQ ID NO: 330471 - RNA, 32 nt, Human
auaguauacauuuuauaaugaugaacuuauaa

SEQ ID NO: 330472 - RNA, 32 nt, Human
auaguauagcugaaaugcaucuguuaaaaaug

SEQ ID NO: 330473 - RNA, 32 nt, Human
auaguauauugccuguauuucuaccucuagua

SEQ ID NO: 330474 - RNA, 31 nt, Human
auaguaucaauaaauauuuguguuaaugaga

SEQ ID NO: 330475 - RNA, 32 nt, Human
auaguaucaccugaagcauacuuacauuaucc

SEQ ID NO: 330476 - RNA, 32 nt, Human
auaguaucuuuguuuuccuuugcuguuccuca

SEQ ID NO: 330477 - RNA, 31 nt, Human
auaguauggacaacuuuuugccacuaacuga

SEQ ID NO: 330478 - RNA, 32 nt, Human
auaguauuccaugguguauauguacuauguuu

SEQ ID NO: 330479 - RNA, 32 nt, Human
auaguauuuaacagugaauccuuuguauaaug

SEQ ID NO: 330480 - RNA, 24 nt, Human
auagucaaagauuuuguacugcua

SEQ ID NO: 330481 - RNA, 32 nt, Human
auagucaacaucuugaacuauauuucaaauga

SEQ ID NO: 330482 - RNA, 31 nt, Human
auagucaccuuuuaaauccuguugaaaagcc

SEQ ID NO: 330483 - RNA, 32 nt, Human
auagucacugagaguggggaagaugggacagc

SEQ ID NO: 330484 - RNA, 32 nt, Human
auagucacuguagaauauaucuccaggaucug

SEQ ID NO: 330485 - RNA, 32 nt, Human
auagucacuuagauucccuauuuggaaaauug

SEQ ID NO: 330486 - RNA, 32 nt, Human
auagucacuugccaccaugcccggcuaauuua

SEQ ID NO: 330487 - RNA, 32 nt, Human
auagucacuuugccagcucaaaagaaaacaau

SEQ ID NO: 330488 - RNA, 32 nt, Human
auagucagcuacuucugaaacugcagcagugg

SEQ ID NO: 330489 - RNA, 32 nt, Human
auagucagcugacuaaagacuguguguguugu

SEQ ID NO: 330490 - RNA, 32 nt, Human
auagucaggccuggguggagggaguggcaagu

SEQ ID NO: 330491 - RNA, 31 nt, Human
auagucaguagcagagaaaagcagaucccaa

SEQ ID NO: 330492 - RNA, 32 nt, Human
auagucaguuuuauugacauuguuagaugaaa

SEQ ID NO: 330493 - RNA, 32 nt, Human
auagucaucccuccugcacugcuccuuuccaa

SEQ ID NO: 330494 - RNA, 31 nt, Human
auagucauggucaccacacagcuuguucguu

SEQ ID NO: 330495 - RNA, 32 nt, Human
auaguccaaugccacggaaagaggccaccagc

SEQ ID NO: 330496 - RNA, 32 nt, Human
auaguccagcagaggagugugggggaaggggg

SEQ ID NO: 330497 - RNA, 32 nt, Human
auagucccagcacucugagaggcucaggcaga

SEQ ID NO: 330498 - RNA, 32 nt, Human
auagucccagcacuuugggaggcugagguggg

SEQ ID NO: 330499 - RNA, 32 nt, Human
auagucccaugucaaaggaacuuuugagugau

SEQ ID NO: 330500 - RNA, 32 nt, Human
auaguccccuggacugagucccccaggccuuc

SEQ ID NO: 330501 - RNA, 32 nt, Human
auagucccugcuuccgugacacuugagugaac

SEQ ID NO: 330502 - RNA, 32 nt, Human
auaguccucuuuguggcaacagaucucagaua

SEQ ID NO: 330503 - RNA, 32 nt, Human
auaguccugccugagguugcagugagccgagc

SEQ ID NO: 330504 - RNA, 32 nt, Human
auagucgucucuucaucagucucccccgacga

SEQ ID NO: 330505 - RNA, 32 nt, Human
auagucucagcuacucagaggcugaggcagga

SEQ ID NO: 330506 - RNA, 32 nt, Human
auagucucauugaaaaaggaacauuugaguga

SEQ ID NO: 330507 - RNA, 32 nt, Human
auagucucuuccaacagucugcuccucagccu

SEQ ID NO: 330508 - RNA, 32 nt, Human
auagucugaggcugggccucugccuuugugaa

SEQ ID NO: 330509 - RNA, 32 nt, Human
auagucugggucagacccaucucucccuuacc

SEQ ID NO: 330510 - RNA, 32 nt, Human
auagucuguuucaaugcuacaauguuugcugg

SEQ ID NO: 330511 - RNA, 32 nt, Human
auagucuguuucccuggaacauuccugugguu

SEQ ID NO: 330512 - RNA, 32 nt, Human
auagucuuaguuaucuuuugaguaagaaaagc

SEQ ID NO: 330513 - RNA, 32 nt, Human
auagucuuauagaaaaaggaaaggugaugagc

SEQ ID NO: 330514 - RNA, 32 nt, Human
auagucuugguugggacuauugccucaggguu

SEQ ID NO: 330515 - RNA, 32 nt, Human
auagucuugucucaccaaccccagcccaucau

SEQ ID NO: 330516 - RNA, 32 nt, Human
auagucuuuauccuaaguucugaggagccaua

SEQ ID NO: 330517 - RNA, 32 nt, Human
auagucuuucuccaauguguccuccaagcaag

SEQ ID NO: 330518 - RNA, 32 nt, Human
auagugaacucaucagaauggcugguuugcag

SEQ ID NO: 330519 - RNA, 32 nt, Human
auagugaagggugggcuuggaggaacgggcug

SEQ ID NO: 330520 - RNA, 32 nt, Human
auagugacucuuuuaucugugugucuuuugcu

SEQ ID NO: 330521 - RNA, 32 nt, Human
auagugagcuaaaccucaaauuucuaucaccc

SEQ ID NO: 330522 - RNA, 32 nt, Human
auagugaggcuggccaagcugcacuggucgga

SEQ ID NO: 330523 - RNA, 32 nt, Human
auagugagggcggccagcaggaagaaacucag

SEQ ID NO: 330524 - RNA, 32 nt, Human
auagugagucacuaguauuuugcuucaagccu

SEQ ID NO: 330525 - RNA, 32 nt, Human
auagugagugggaaagagagugagagccugug

SEQ ID NO: 330526 - RNA, 32 nt, Human
auagugaguugggaggauggggagacagcuaa

SEQ ID NO: 330527 - RNA, 32 nt, Human
auagugaugcagauuaccuuucugcuccugaa

SEQ ID NO: 330528 - RNA, 32 nt, Human
auagugauuucaggccuuuuguuuucuuaaaa

SEQ ID NO: 330529 - RNA, 32 nt, Human
auagugcaaaugcuuuuauuagccaauaggaa

SEQ ID NO: 330530 - RNA, 32 nt, Human
auagugcaaauuugccagcuuggagauagaaa

SEQ ID NO: 330531 - RNA, 32 nt, Human
auagugcacagcaagagcuacauccaaguguc

SEQ ID NO: 330532 - RNA, 32 nt, Human
auagugcagccucagccccaggcacagcgccg

SEQ ID NO: 330533 - RNA, 32 nt, Human
auagugccacaauaaacauacacgugcaugug

SEQ ID NO: 330534 - RNA, 32 nt, Human
auagugccacagcucuccagccugggcgacag

SEQ ID NO: 330535 - RNA, 32 nt, Human
auagugccacugcaauucagccugggugacau

SEQ ID NO: 330536 - RNA, 32 nt, Human
auagugccacugcacuacagcccgggcgacag

SEQ ID NO: 330537 - RNA, 32 nt, Human
auagugccacugcacuccagccugggcaacac

SEQ ID NO: 330538 - RNA, 32 nt, Human
auagugccacugcacuccagccugggugacag

SEQ ID NO: 330539 - RNA, 32 nt, Human
auagugccacugcacuucagccugggugacag

SEQ ID NO: 330540 - RNA, 32 nt, Human
auagugccacugcacuucagcuugggcaacag

SEQ ID NO: 330541 - RNA, 32 nt, Human
auagugccacugcauuccggccugggcgacag

SEQ ID NO: 330542 - RNA, 32 nt, Human
auagugccacugugcuccagccuggaugacgg

SEQ ID NO: 330543 - RNA, 32 nt, Human
auagugccaggagucgaguuuccaauaacuuc

SEQ ID NO: 330544 - RNA, 32 nt, Human
auagugccaucgcacuccagccuggacaacag

SEQ ID NO: 330545 - RNA, 32 nt, Human
auagugccauugcacuccggccugggcaacag

SEQ ID NO: 330546 - RNA, 32 nt, Human
auagugccauuguacuccagcuugggcaacag

SEQ ID NO: 330547 - RNA, 32 nt, Human
auagugccgcugcacuccauucugggcaagag

SEQ ID NO: 330548 - RNA, 32 nt, Human
auagugcuauuugguuucuccaugauuucacu

SEQ ID NO: 330549 - RNA, 32 nt, Human
auagugcugccuggcccuccccacaaugccag

SEQ ID NO: 330550 - RNA, 32 nt, Human
auagugcuucaaaagaaauauuuuugaugaac

SEQ ID NO: 330551 - RNA, 32 nt, Human
auaguggacuggauggguuaggaggaccaggu

SEQ ID NO: 330552 - RNA, 32 nt, Human
auaguggagagaaaccuugaaaguguaaugag

SEQ ID NO: 330553 - RNA, 32 nt, Human
auaguggagcucauuuacaaauaggcaugccu

SEQ ID NO: 330554 - RNA, 32 nt, Human
auaguggcaaagccuucacuucacaccucaug

SEQ ID NO: 330555 - RNA, 32 nt, Human
auaguggcaggcaccuguaaucccagcuacuc

SEQ ID NO: 330556 - RNA, 32 nt, Human
auaguggcaggcaggagagagcaugugcaggg

SEQ ID NO: 330557 - RNA, 32 nt, Human
auaguggcugaaggcagaguuuacuguuaucc

SEQ ID NO: 330558 - RNA, 32 nt, Human
auaguggcugucaucccagcacuuuaggaggc

SEQ ID NO: 330559 - RNA, 32 nt, Human
auagugggcuaccugauucgucucucaaucaa

SEQ ID NO: 330560 - RNA, 32 nt, Human
auaguggguagaaaggagagaaaaacccacug

SEQ ID NO: 330561 - RNA, 25 nt, Human
auagugguggacaaggcucugguuu

SEQ ID NO: 330562 - RNA, 32 nt, Human
auaguggugggaacagacaaauaaggaagcgg

SEQ ID NO: 330563 - RNA, 32 nt, Human
auagugguucuuucuggauugaagacaaacuu

SEQ ID NO: 330564 - RNA, 32 nt, Human
auagugguucuuucuggauugaaggaaaacuu

SEQ ID NO: 330565 - RNA, 32 nt, Human
auagugguuuuucuaugcuauaugaaaauagu

SEQ ID NO: 330566 - RNA, 32 nt, Human
auaguguaacagcaccagcagaucugccugug

SEQ ID NO: 330567 - RNA, 32 nt, Human
auagugucccucuccauguccaggaaacuugu

SEQ ID NO: 330568 - RNA, 32 nt, Human
auaguguuacucucuugugauauuguguugau

SEQ ID NO: 330569 - RNA, 32 nt, Human
auaguguugcauaugagccugcccucacuccc

SEQ ID NO: 330570 - RNA, 32 nt, Human
auaguuaaaaacuuaagguuuauuuuagacuu

SEQ ID NO: 330571 - RNA, 32 nt, Human
auaguuaaaauggcuguaagaauaguuuuaua

SEQ ID NO: 330572 - RNA, 32 nt, Human
auaguuaaacgacuuuucaggagauuuagaaa

SEQ ID NO: 330573 - RNA, 32 nt, Human
auaguuacauacacaguuuucucuccacacau

SEQ ID NO: 330574 - RNA, 32 nt, Human
auaguuaccuuaaacaauguuuucucaacuuc

SEQ ID NO: 330575 - RNA, 32 nt, Human
auaguuacuagcaacagaaacugaucucaaau

SEQ ID NO: 330576 - RNA, 32 nt, Human
auaguuacuguacuauacuuuuuauuguuacu

SEQ ID NO: 330577 - RNA, 32 nt, Human
auaguucaagccugaauuucaaugagauggga

SEQ ID NO: 330578 - RNA, 32 nt, Human
auaguucacggguuacggcacacacgcguuac

SEQ ID NO: 330579 - RNA, 32 nt, Human
auaguucagaaacacuuuuuaucugcaaggca

SEQ ID NO: 330580 - RNA, 32 nt, Human
auaguucauacauauaaaugguggugaaauaa

SEQ ID NO: 330581 - RNA, 32 nt, Human
auaguuccuguuacuuuuuagcauuagcugcc

SEQ ID NO: 330582 - RNA, 32 nt, Human
auaguucuaaaagccauggcccagggacuggu

SEQ ID NO: 330583 - RNA, 32 nt, Human
auaguugaagauuaacuuuuccuaacauugug

SEQ ID NO: 330584 - RNA, 32 nt, Human
auaguugagggagcagggagagaaagacugga

SEQ ID NO: 330585 - RNA, 32 nt, Human
auaguugaguauggguuagaaaucauugaaau

SEQ ID NO: 330586 - RNA, 32 nt, Human
auaguugaucagauuucaaggucuggggagua

SEQ ID NO: 330587 - RNA, 32 nt, Human
auaguugaugguaggacauuuuagacuuuguu

SEQ ID NO: 330588 - RNA, 32 nt, Human
auaguugcaaccacuaaauccaaaaaggacac

SEQ ID NO: 330589 - RNA, 32 nt, Human
auaguuguauacaaaugagcaagguauuuguu

SEQ ID NO: 330590 - RNA, 32 nt, Human
auaguugugcaugccuggcacaacaucaagcc

SEQ ID NO: 330591 - RNA, 32 nt, Human
auaguuguggguggagagaggagugaguuugu

SEQ ID NO: 330592 - RNA, 32 nt, Human
auaguuguugacuguuaauauggaccugcuag

SEQ ID NO: 330593 - RNA, 32 nt, Human
auaguuuaacagucaggaaggcuaaacugguc

SEQ ID NO: 330594 - RNA, 32 nt, Human
auaguuuaacccagcaacuuuccuuuuuauaa

SEQ ID NO: 330595 - RNA, 32 nt, Human
auaguuuacaauauuauguuuccuaauuaaaa

SEQ ID NO: 330596 - RNA, 32 nt, Human
auaguuuacagcuguacuuuccagaucuucua

SEQ ID NO: 330597 - RNA, 32 nt, Human
auaguuuauguccuacuagauacacugcaaac

SEQ ID NO: 330598 - RNA, 32 nt, Human
auaguuucacuggguugcgguuauuuuccugg

SEQ ID NO: 330599 - RNA, 32 nt, Human
auaguuuccaggcugcaaugcugaaucuugcu

SEQ ID NO: 330600 - RNA, 32 nt, Human
auaguuucccccauccuuucauugacauuauu

SEQ ID NO: 330601 - RNA, 32 nt, Human
auaguuuccuuuuccucuucuagaacuuaccu

SEQ ID NO: 330602 - RNA, 32 nt, Human
auaguuucuggccccucacuuuguugcugggg

SEQ ID NO: 330603 - RNA, 24 nt, Human
auaguuugaauucaguaaauauua

SEQ ID NO: 330604 - RNA, 32 nt, Human
auaguuugagcugguauuuacccccuggguuu

SEQ ID NO: 330605 - RNA, 32 nt, Human
auaguuugcaguuucugggaagcaauugaaac

SEQ ID NO: 330606 - RNA, 32 nt, Human
auaguuuggcugcuccugugcugucaccugca

SEQ ID NO: 330607 - RNA, 32 nt, Human
auaguuuuaacaacaggaaacacuuguaggac

SEQ ID NO: 330608 - RNA, 32 nt, Human
auaguuuuauuuuuaaguuaucuuuaaguuua

SEQ ID NO: 330609 - RNA, 32 nt, Human
auaguuuucucccaauuuccauaucuuacuca

SEQ ID NO: 330610 - RNA, 32 nt, Human
auaguuuucuuccucuucuccuugggccaguu

SEQ ID NO: 330611 - RNA, 32 nt, Human
auaguuuugggucauuuaaagggacuugagga

SEQ ID NO: 330612 - RNA, 32 nt, Human
auaguuuuucccauuggucuuuaacuaagacu

SEQ ID NO: 330613 - RNA, 32 nt, Human
auauaaaaaccaccacccuccagccugggcaa

SEQ ID NO: 330614 - RNA, 32 nt, Human
auauaaaaaggagauaguuauauagauagaug

SEQ ID NO: 330615 - RNA, 32 nt, Human
auauaaaaauuagcaggacaugguggcucaug

SEQ ID NO: 330616 - RNA, 32 nt, Human
auauaaaaauuagcagggcaugguggugcaug

SEQ ID NO: 330617 - RNA, 32 nt, Human
auauaaaaauuagccaaguaugguggcauaug

SEQ ID NO: 330618 - RNA, 32 nt, Human
auauaaaaauuagccaggcaugguggcaccug

SEQ ID NO: 330619 - RNA, 32 nt, Human
auauaaaaauuagccaggcauggugguguggg

SEQ ID NO: 330620 - RNA, 32 nt, Human
auauaaaaauuagccgggcauggugaugcaug

SEQ ID NO: 330621 - RNA, 32 nt, Human
auauaaaaauuagccgugcaugguggcaugcg

SEQ ID NO: 330622 - RNA, 32 nt, Human
auauaaaaauuagcuggaugugguggugcaca

SEQ ID NO: 330623 - RNA, 32 nt, Human
auauaaaaauuagcuggguaugguggcacacg

SEQ ID NO: 330624 - RNA, 32 nt, Human
auauaaaaauuagcugggugugguggcaggag

SEQ ID NO: 330625 - RNA, 32 nt, Human
auauaaaaauuagcugggugugguggcgggca

SEQ ID NO: 330626 - RNA, 32 nt, Human
auauaaaaauuagcugggugugguggugggug

SEQ ID NO: 330627 - RNA, 32 nt, Human
auauaaaaauuagugaggcaugguggcacaug

SEQ ID NO: 330628 - RNA, 32 nt, Human
auauaaaaauuggcgaaaagaagccauacgcc

SEQ ID NO: 330629 - RNA, 32 nt, Human
auauaaaacaguucuguauaccaaaguggcua

SEQ ID NO: 330630 - RNA, 32 nt, Human
auauaaaacauacaguuuauuccacacagcag

SEQ ID NO: 330631 - RNA, 32 nt, Human
auauaaaagaacaccagagaucagaaauucaa

SEQ ID NO: 330632 - RNA, 32 nt, Human
auauaaaagcagcccuggaaugaugucuuccc

SEQ ID NO: 330633 - RNA, 32 nt, Human
auauaaaagcuuagauuguagcuguucuaaaa

SEQ ID NO: 330634 - RNA, 22 nt, Human
auauaaacaucacacacacaga

SEQ ID NO: 330635 - RNA, 32 nt, Human
auauaaacguuuguggcaagaggacaguucug

SEQ ID NO: 330636 - RNA, 32 nt, Human
auauaaacucuggcucaccuugcccaguggug

SEQ ID NO: 330637 - RNA, 32 nt, Human
auauaaagacagggauaugagugaagaaaaca

SEQ ID NO: 330638 - RNA, 32 nt, Human
auauaaagcucauguaccugugacccuuauag

SEQ ID NO: 330639 - RNA, 32 nt, Human
auauaaauaccagcaagaucacucugagauac

SEQ ID NO: 330640 - RNA, 32 nt, Human
auauaaauauauuauaucaaucuuaacuuuuu

SEQ ID NO: 330641 - RNA, 32 nt, Human
auauaaaucaagcuauaagucuuuggacccuc

SEQ ID NO: 330642 - RNA, 32 nt, Human
auauaaaugagagguuuggcuucaucucaguu

SEQ ID NO: 330643 - RNA, 32 nt, Human
auauaaauguacuuuuccuuccagaaaaauuu

SEQ ID NO: 330644 - RNA, 32 nt, Human
auauaacaaagaguuguguaaaugucucucau

SEQ ID NO: 330645 - RNA, 32 nt, Human
auauaacacauagagauuggcuuuugucacuc

SEQ ID NO: 330646 - RNA, 32 nt, Human
auauaacagagccuugauccagaagccagagg

SEQ ID NO: 330647 - RNA, 32 nt, Human
auauaacaucuauuuuuccugauacugugccu

SEQ ID NO: 330648 - RNA, 32 nt, Human
auauaacauuagaauguguguacuggaaaugc

SEQ ID NO: 330649 - RNA, 32 nt, Human
auauaacauuugaacucuuuacacaccugaac

SEQ ID NO: 330650 - RNA, 32 nt, Human
auauaaccaguauuuuacuucaaaagccaaaa

SEQ ID NO: 330651 - RNA, 32 nt, Human
auauaaccagugggauacaguuuaggaaaugg

SEQ ID NO: 330652 - RNA, 32 nt, Human
auauaacccccuccucuggacuuaaaucaccu

SEQ ID NO: 330653 - RNA, 32 nt, Human
auauaacucauacucaaggaacuccagaaggg

SEQ ID NO: 330654 - RNA, 32 nt, Human
auauaacuccacuguacaucauccuuugagua

SEQ ID NO: 330655 - RNA, 32 nt, Human
auauaacuccugucuuaaaaucugcagaauau

SEQ ID NO: 330656 - RNA, 32 nt, Human
auauaacucuuaagggcauuccugacccaaga

SEQ ID NO: 330657 - RNA, 32 nt, Human
auauaacuggugguauugugggcagagaucuu

SEQ ID NO: 330658 - RNA, 32 nt, Human
auauaacuucuauaauucaaagcuauucuuac

SEQ ID NO: 330659 - RNA, 32 nt, Human
auauaagagccaaacucuuuuccauuccaucu

SEQ ID NO: 330660 - RNA, 32 nt, Human
auauaagauguauaauauaaggcuccacaaau

SEQ ID NO: 330661 - RNA, 32 nt, Human
auauaagauguguugcuuuucucucauuauaa

SEQ ID NO: 330662 - RNA, 32 nt, Human
auauaagcacaaaauuucugacuaucuugcgg

SEQ ID NO: 330663 - RNA, 32 nt, Human
auauaagccagccugaucuaccaacaugccac

SEQ ID NO: 330664 - RNA, 32 nt, Human
auauaagccgagcucagcaucuugccacacac

SEQ ID NO: 330665 - RNA, 32 nt, Human
auauaagcucccggaaggcagggauguugaag

SEQ ID NO: 330666 - RNA, 32 nt, Human
auauaagcugaacucuauuauggggaauggau

SEQ ID NO: 330667 - RNA, 32 nt, Human
auauaaggcccaauucacccacuguguaucuu

SEQ ID NO: 330668 - RNA, 32 nt, Human
auauaagggccugggaugcauuuauuuuauca

SEQ ID NO: 330669 - RNA, 32 nt, Human
auauaaguauuuuggaauuaucucccaguuug

SEQ ID NO: 330670 - RNA, 32 nt, Human
auauaagugauuaacuucuucuaaucuauaac

SEQ ID NO: 330671 - RNA, 23 nt, Human
auauaauaacauuuuuuaacuac

SEQ ID NO: 330672 - RNA, 32 nt, Human
auauaauaagcuuuugcuguagauugccuagu

SEQ ID NO: 330673 - RNA, 32 nt, Human
auauaauagugaucauaaagaauaaagacucg

SEQ ID NO: 330674 - RNA, 32 nt, Human
auauaauaugguagaaaaggcuaaaucauacu

SEQ ID NO: 330675 - RNA, 32 nt, Human
auauaaucccaaguauccucucuccuuccuug

SEQ ID NO: 330676 - RNA, 32 nt, Human
auauaaucuucacuaucuccccuuaacucaga

SEQ ID NO: 330677 - RNA, 32 nt, Human
auauaaugaacuguauuuuuacaaugaucgcc

SEQ ID NO: 330678 - RNA, 32 nt, Human
auauaaugacuuagcccagcggccugcagaca

SEQ ID NO: 330679 - RNA, 32 nt, Human
auauaaugagucuaauguaauuuugaucaacu

SEQ ID NO: 330680 - RNA, 32 nt, Human
auauaaugggcuucacuaaccuucccuaggca

SEQ ID NO: 330681 - RNA, 32 nt, Human
auauaaugugugaccgugauauagugagaaag

SEQ ID NO: 330682 - RNA, 32 nt, Human
auauaauuauauggucauucugaccccagcuc

SEQ ID NO: 330683 - RNA, 31 nt, Human
auauaauugguggaaaggguggguggauaca

SEQ ID NO: 330684 - RNA, 32 nt, Human
auauaauuuaacagaaguugugaaacuaaaau

SEQ ID NO: 330685 - RNA, 32 nt, Human
auauaauuuccauccagggaaggaaguguccc

SEQ ID NO: 330686 - RNA, 32 nt, Human
auauacaacuuuuauaucauguaucaaaccag

SEQ ID NO: 330687 - RNA, 32 nt, Human
auauacaagcagcaacuucacugugugguggu

SEQ ID NO: 330688 - RNA, 20 nt, Human
auauacaaggcaucuaccca

SEQ ID NO: 330689 - RNA, 32 nt, Human
auauacaaguauaaaauuuacacauuucugag

SEQ ID NO: 330690 - RNA, 32 nt, Human
auauacacaaacaacauguacagaaauagaag

SEQ ID NO: 330691 - RNA, 32 nt, Human
auauacacaaacauguauaugugcacacacau

SEQ ID NO: 330692 - RNA, 27 nt, Human
auauacacacacauaaacguauacaca

SEQ ID NO: 330693 - RNA, 25 nt, Human
auauacacacacauacguauacaca

SEQ ID NO: 330694 - RNA, 25 nt, Human
auauacacacauauauauacucaca

SEQ ID NO: 330695 - RNA, 25 nt, Human
auauacacacauauauauguacaua

SEQ ID NO: 330696 - RNA, 32 nt, Human
auauacacacauauguaggauguaugcaugug

SEQ ID NO: 330697 - RNA, 32 nt, Human
auauacacagagaacagaaauauuccuacugu

SEQ ID NO: 330698 - RNA, 32 nt, Human
auauacaccaaacuguuaaaugugguuucucu

SEQ ID NO: 330699 - RNA, 32 nt, Human
auauacaccaauauauucauauauacucacac

SEQ ID NO: 330700 - RNA, 32 nt, Human
auauacaccaugggauacuaugcagccauaga

SEQ ID NO: 330701 - RNA, 32 nt, Human
auauacacugaucacugaagcugucagugaga

SEQ ID NO: 330702 - RNA, 32 nt, Human
auauacacuuuucaaaaugcuuuggugggaag

SEQ ID NO: 330703 - RNA, 32 nt, Human
auauacagaaaaagauuuccaccugucacgua

SEQ ID NO: 330704 - RNA, 32 nt, Human
auauacagaccuccagauuauuuucuauauuu

SEQ ID NO: 330705 - RNA, 32 nt, Human
auauacagagauaaagcuaaacguaauuauua

SEQ ID NO: 330706 - RNA, 32 nt, Human
auauacagaggaagaacagggugaugagggua

SEQ ID NO: 330707 - RNA, 32 nt, Human
auauacagaugguccucgauuuacauuguggu

SEQ ID NO: 330708 - RNA, 32 nt, Human
auauacagccugaacucaggaggcagaaauca

SEQ ID NO: 330709 - RNA, 32 nt, Human
auauacauaacauacacacaauauguauuccu

SEQ ID NO: 330710 - RNA, 32 nt, Human
auauacauaagaauuccacuaagaaaugccaa

SEQ ID NO: 330711 - RNA, 32 nt, Human
auauacauaccuuuguguauagacaagcccau

SEQ ID NO: 330712 - RNA, 32 nt, Human
auauacaucuucuuccuuuugguuucuugauc

SEQ ID NO: 330713 - RNA, 22 nt, Human
auauacauggaauauuguaaaa

SEQ ID NO: 330714 - RNA, 32 nt, Human
auauacauguauauacacacagacacaugcau

SEQ ID NO: 330715 - RNA, 32 nt, Human
auauacauguauauacacgugcauauaacaua

SEQ ID NO: 330716 - RNA, 32 nt, Human
auauaccaaggcagaggagcccauagccauga

SEQ ID NO: 330717 - RNA, 32 nt, Human
auauaccacaguuuauuucucccuucauccuu

SEQ ID NO: 330718 - RNA, 32 nt, Human
auauaccacccaggccugcgaggagcgugguc

SEQ ID NO: 330719 - RNA, 32 nt, Human
auauacccaacaacuggaauuguuuacacaug

SEQ ID NO: 330720 - RNA, 32 nt, Human
auauacccaauuuuucuuuuuauugguauuag

SEQ ID NO: 330721 - RNA, 32 nt, Human
auauacccaguaaugggauggcugagucaaga

SEQ ID NO: 330722 - RNA, 32 nt, Human
auauacccaguaaugggauggcugggucaaau

SEQ ID NO: 330723 - RNA, 32 nt, Human
auauaccugccuggcaucaguuugugcugauu

SEQ ID NO: 330724 - RNA, 32 nt, Human
auauaccuggcuuugcuuagcuuguugaagaa

SEQ ID NO: 330725 - RNA, 32 nt, Human
auauaccuguaaccccaacuacuuggguggcu

SEQ ID NO: 330726 - RNA, 32 nt, Human
auauaccuguaauccuagcuauucaaggggcu

SEQ ID NO: 330727 - RNA, 32 nt, Human
auauaccuguagucccagcuacucaggaagcu

SEQ ID NO: 330728 - RNA, 32 nt, Human
auauacgauauacaaaaaucagugguauuuuc

SEQ ID NO: 330729 - RNA, 32 nt, Human
auauacuaaaaucauuugucuaaaaauuuaag

SEQ ID NO: 330730 - RNA, 32 nt, Human
auauacuaaagauccagacaucagggcugggc

SEQ ID NO: 330731 - RNA, 22 nt, Human
auauacuauauguguguauaua

SEQ ID NO: 330732 - RNA, 32 nt, Human
auauacuauauuguggaaaagacugaagaaua

SEQ ID NO: 330733 - RNA, 32 nt, Human
auauacuaucaaauuauguugugugcauuaga

SEQ ID NO: 330734 - RNA, 19 nt, Human
auauacuaugaaaagugca

SEQ ID NO: 330735 - RNA, 32 nt, Human
auauacucgagcacucuccauauaaugccucc

SEQ ID NO: 330736 - RNA, 32 nt, Human
auauacugguggcacuggccagguaccauacg

SEQ ID NO: 330737 - RNA, 32 nt, Human
auauacugugaagccugguucacauucaugcu

SEQ ID NO: 330738 - RNA, 32 nt, Human
auauacuguggccauggagagaucauccacuu

SEQ ID NO: 330739 - RNA, 32 nt, Human
auauacuuccaucauugcaauguggagcuuca

SEQ ID NO: 330740 - RNA, 32 nt, Human
auauacuuggagcuuuaaaaauuaaaaggaga

SEQ ID NO: 330741 - RNA, 32 nt, Human
auauagaagaguuggcuuuaaaauguuugcaa

SEQ ID NO: 330742 - RNA, 32 nt, Human
auauagacauuuucaggcacgugcuuugcacc

SEQ ID NO: 330743 - RNA, 32 nt, Human
auauagagaugcauucacagggguuggcuggg

SEQ ID NO: 330744 - RNA, 32 nt, Human
auauagagcuccagggacugucuuuucuguau

SEQ ID NO: 330745 - RNA, 32 nt, Human
auauagagguaagggaguuccuuacuuacuau

SEQ ID NO: 330746 - RNA, 32 nt, Human
auauagaguagaauugggauagaguauugaag

SEQ ID NO: 330747 - RNA, 32 nt, Human
auauagaguguuucuaggguaagggaccugca

SEQ ID NO: 330748 - RNA, 32 nt, Human
auauagauacauauaugaaagaaggcuuuuau

SEQ ID NO: 330749 - RNA, 32 nt, Human
auauagcacagaaguccuccacacugccuggg

SEQ ID NO: 330750 - RNA, 32 nt, Human
auauagcacagcugucaucucauuuuggacac

SEQ ID NO: 330751 - RNA, 32 nt, Human
auauagcacaugcucucugggggccacagggu

SEQ ID NO: 330752 - RNA, 32 nt, Human
auauagcacuguaacggaaaaugauucuguua

SEQ ID NO: 330753 - RNA, 32 nt, Human
auauagcauauauguguauauguaugugugug

SEQ ID NO: 330754 - RNA, 32 nt, Human
auauagccaggagcugcugaauuugugccccu

SEQ ID NO: 330755 - RNA, 32 nt, Human
auauagcucucauggucugcuccaacugccau

SEQ ID NO: 330756 - RNA, 32 nt, Human
auauaggaaagaaagccaagauuuagguaaug

SEQ ID NO: 330757 - RNA, 32 nt, Human
auauaggacacugucuuccuucaagaggguua

SEQ ID NO: 330758 - RNA, 32 nt, Human
auauaggaggcagagguugcagugagccgagg

SEQ ID NO: 330759 - RNA, 32 nt, Human
auauaggaggcugaggcaggagaaucacuuga

SEQ ID NO: 330760 - RNA, 32 nt, Human
auauaggauuccagaauacuccuguugugguc

SEQ ID NO: 330761 - RNA, 32 nt, Human
auauaggcacuggguuguuucuauaucaucau

SEQ ID NO: 330762 - RNA, 32 nt, Human
auauaggcauuaaccacacacuuuaaugggua

SEQ ID NO: 330763 - RNA, 32 nt, Human
auauagggauagaagugguagagccaaaaguu

SEQ ID NO: 330764 - RNA, 32 nt, Human
auauagggcuuccuuugguaucaaaguacuuu

SEQ ID NO: 330765 - RNA, 32 nt, Human
auauaggucuguccaaauucauacaacuugug

SEQ ID NO: 330766 - RNA, 32 nt, Human
auauagguuaacauaggauucaagaggaugac

SEQ ID NO: 330767 - RNA, 32 nt, Human
auauaguaaccaguaaccacagcuagcuguaa

SEQ ID NO: 330768 - RNA, 32 nt, Human
auauaguaggcagaaagcuaguaagucacuua

SEQ ID NO: 330769 - RNA, 32 nt, Human
auauaguauuaggccaggcaugguggcucaua

SEQ ID NO: 330770 - RNA, 32 nt, Human
auauagucucaacuaauaggugcaauuuggga

SEQ ID NO: 330771 - RNA, 32 nt, Human
auauagugauguauauucucuucuacucuuca

SEQ ID NO: 330772 - RNA, 30 nt, Human
auauaguuacuacaaucagaaagcaguuau

SEQ ID NO: 330773 - RNA, 32 nt, Human
auauaguucuucaugaagaccucacaguggaa

SEQ ID NO: 330774 - RNA, 32 nt, Human
auauaguugcagaauucgagucacaaauagcg

SEQ ID NO: 330775 - RNA, 32 nt, Human
auauaguuuguacugagcuauugaagucccau

SEQ ID NO: 330776 - RNA, 32 nt, Human
auauaguuuuauucuccuaaaaucucaggagg

SEQ ID NO: 330777 - RNA, 32 nt, Human
auauauaaaacaauuugggggccaggcacgau

SEQ ID NO: 330778 - RNA, 32 nt, Human
auauauaaaauccugcauacuucauuuccugu

SEQ ID NO: 330779 - RNA, 32 nt, Human
auauauaaaauguacuaauuagcuuuaaacac

SEQ ID NO: 330780 - RNA, 32 nt, Human
auauauaaaauuauauucacuacuuuugaaca

SEQ ID NO: 330781 - RNA, 32 nt, Human
auauauaaaugaugauaguaguaccuacagua

SEQ ID NO: 330782 - RNA, 23 nt, Human
auauauaaauguuauguuauaua

SEQ ID NO: 330783 - RNA, 32 nt, Human
auauauaacugaccacgcucacccucauccag

SEQ ID NO: 330784 - RNA, 32 nt, Human
auauauaagcuacacaugauguaaaaaccuua

SEQ ID NO: 330785 - RNA, 32 nt, Human
auauauaagcuucaguaccauuugcucugaag

SEQ ID NO: 330786 - RNA, 32 nt, Human
auauauacaaauauuuguaucuucuggaggug

SEQ ID NO: 330787 - RNA, 32 nt, Human
auauauacacacacauauacacaugccuucua

SEQ ID NO: 330788 - RNA, 32 nt, Human
auauauacacauauauacauauauucacuaua

SEQ ID NO: 330789 - RNA, 25 nt, Human
auauauacauaauauauauuauaua

SEQ ID NO: 330790 - RNA, 32 nt, Human
auauauacauauauacauauuauguaugguug

SEQ ID NO: 330791 - RNA, 24 nt, Human
auauauaccaagccccuagucuua

SEQ ID NO: 330792 - RNA, 32 nt, Human
auauauaccaaggacuuacagacaaaauuaag

SEQ ID NO: 330793 - RNA, 32 nt, Human
auauauacuauacaauauguuuauugcacuuc

SEQ ID NO: 330794 - RNA, 32 nt, Human
auauauacuggauuagggcaagagaaggaauc

SEQ ID NO: 330795 - RNA, 32 nt, Human
auauauagccuuuaacacuaugcaacuuugua

SEQ ID NO: 330796 - RNA, 32 nt, Human
auauauaggcauuaaccacacacuuuaauggg

SEQ ID NO: 330797 - RNA, 32 nt, Human
auauauaguguauagaagcgauuuaaguuaca

SEQ ID NO: 330798 - RNA, 25 nt, Human
auauauauaaauguuauguuauaua

SEQ ID NO: 330799 - RNA, 24 nt, Human
auauauaugaauauauauuauaua

SEQ ID NO: 330800 - RNA, 27 nt, Human
auauauauggaauauguauauuauaua

SEQ ID NO: 330801 - RNA, 25 nt, Human
auauauauggcacauguauuauaua

SEQ ID NO: 330802 - RNA, 24 nt, Human
auauauauguaauauacauauaua

SEQ ID NO: 330803 - RNA, 23 nt, Human
auauauauguacauguguauaua

SEQ ID NO: 330804 - RNA, 23 nt, Human
auauauauguauauaugcauaua

SEQ ID NO: 330805 - RNA, 25 nt, Human
auauauauguauauauguauguaua

SEQ ID NO: 330806 - RNA, 25 nt, Human
auauauauguauauguauauauaua

SEQ ID NO: 330807 - RNA, 24 nt, Human
auauauauguauauguuuuauaua

SEQ ID NO: 330808 - RNA, 25 nt, Human
auauauauguauguauauauguaua

SEQ ID NO: 330809 - RNA, 24 nt, Human
auauauauguauguauguauguau

SEQ ID NO: 330810 - RNA, 23 nt, Human
auauauauguauguguauauaua

SEQ ID NO: 330811 - RNA, 23 nt, Human
auauauauguguauguauauaua

SEQ ID NO: 330812 - RNA, 23 nt, Human
auauauauguguguauauauaua

SEQ ID NO: 330813 - RNA, 25 nt, Human
auauauauguguguguauauauaua

SEQ ID NO: 330814 - RNA, 23 nt, Human
auauauauguuauauauuacaua

SEQ ID NO: 330815 - RNA, 22 nt, Human
auauauauguuuuauauauaua

SEQ ID NO: 330816 - RNA, 26 nt, Human
auauauauguuuuuuguauauguaua

SEQ ID NO: 330817 - RNA, 32 nt, Human
auauaucaccuaugcuauuaaguuaccuacca

SEQ ID NO: 330818 - RNA, 32 nt, Human
auauaucacugcauauuuuuacccuuauuuuu

SEQ ID NO: 330819 - RNA, 32 nt, Human
auauaucauuguuuucugucuuccucauuaga

SEQ ID NO: 330820 - RNA, 32 nt, Human
auauauccagcugagagaucacacuacaaggc

SEQ ID NO: 330821 - RNA, 32 nt, Human
auauauccugaacaucaaacuaucccaggaaa

SEQ ID NO: 330822 - RNA, 32 nt, Human
auauaucuacaaagccagaugcucugucuuca

SEQ ID NO: 330823 - RNA, 32 nt, Human
auauaucuacccagacuagauguaguauuuug

SEQ ID NO: 330824 - RNA, 32 nt, Human
auauaucuuauccaauucauuaugucaauuca

SEQ ID NO: 330825 - RNA, 32 nt, Human
auauaucuucuaaaauuccucaucucaaggcc

SEQ ID NO: 330826 - RNA, 32 nt, Human
auauaucuuguuaugggguuccuuccaaagac

SEQ ID NO: 330827 - RNA, 32 nt, Human
auauaugaaagaaauuauggagauaaguuaga

SEQ ID NO: 330828 - RNA, 32 nt, Human
auauaugaaugcagaagggcugugcuggaccc

SEQ ID NO: 330829 - RNA, 32 nt, Human
auauaugacuauuacuuauacaugcacaugca

SEQ ID NO: 330830 - RNA, 32 nt, Human
auauaugacucagugcagacuggucucucuua

SEQ ID NO: 330831 - RNA, 23 nt, Human
auauaugagauauauauuauaua

SEQ ID NO: 330832 - RNA, 32 nt, Human
auauaugcaaaaguggaauggcugggucacau

SEQ ID NO: 330833 - RNA, 32 nt, Human
auauauggcaaaaccccugcuaguuccccaaa

SEQ ID NO: 330834 - RNA, 32 nt, Human
auauauggcaaaguccacccucaggccuuaua

SEQ ID NO: 330835 - RNA, 32 nt, Human
auauauggcaggcuucccuggugccgauguaa

SEQ ID NO: 330836 - RNA, 32 nt, Human
auauauguacauauauacacaaacauguauau

SEQ ID NO: 330837 - RNA, 23 nt, Human
auauauguacauguguauguaca

SEQ ID NO: 330838 - RNA, 32 nt, Human
auauauguagcacacacacauagauguauaua

SEQ ID NO: 330839 - RNA, 32 nt, Human
auauauguauaugcugugucauacucauaauc

SEQ ID NO: 330840 - RNA, 21 nt, Human
auauauguauguacauguaca

SEQ ID NO: 330841 - RNA, 23 nt, Human
auauauguauguaugaauguaca

SEQ ID NO: 330842 - RNA, 23 nt, Human
auauauguauguguauguguaua

SEQ ID NO: 330843 - RNA, 23 nt, Human
auauauguguguauauauguaca

SEQ ID NO: 330844 - RNA, 32 nt, Human
auauauguuaugugcauuucuagaaauacaua

SEQ ID NO: 330845 - RNA, 32 nt, Human
auauauguuucauuuaaucuucacaaaagauc

SEQ ID NO: 330846 - RNA, 32 nt, Human
auauauuaaaccuucagauuaaugacuggcua

SEQ ID NO: 330847 - RNA, 32 nt, Human
auauauuaagcuuuugcuguagauugccuagu

SEQ ID NO: 330848 - RNA, 32 nt, Human
auauauuacuaguaucagaaacuacaguuuug

SEQ ID NO: 330849 - RNA, 32 nt, Human
auauauuagccuagccauuauguuagccuuug

SEQ ID NO: 330850 - RNA, 32 nt, Human
auauauuagcuguacuccuagaagaacaauug

SEQ ID NO: 330851 - RNA, 32 nt, Human
auauauuaguuauuugaauacaggcauacacc

SEQ ID NO: 330852 - RNA, 32 nt, Human
auauauuauaaauauugcucaucaaaaugucu

SEQ ID NO: 330853 - RNA, 32 nt, Human
auauauuauauagagagagggaggagagcgag

SEQ ID NO: 330854 - RNA, 22 nt, Human
auauauuauauuauauuauaua

SEQ ID NO: 330855 - RNA, 32 nt, Human
auauauuauuguuucaugaugacucuugauga

SEQ ID NO: 330856 - RNA, 32 nt, Human
auauauucaaaaccacccagcaguagguuuug

SEQ ID NO: 330857 - RNA, 31 nt, Human
auauauucaauaaaaaccaauuugaagacaa

SEQ ID NO: 330858 - RNA, 32 nt, Human
auauauucacuacuuuguauacuuugcaaauu

SEQ ID NO: 330859 - RNA, 32 nt, Human
auauauucacuggguggcaagacacugcaaga

SEQ ID NO: 330860 - RNA, 32 nt, Human
auauauucagccuggcuucaaauuguaagcau

SEQ ID NO: 330861 - RNA, 32 nt, Human
auauauucaggaguuggaauguuguaguuacc

SEQ ID NO: 330862 - RNA, 32 nt, Human
auauauucauucuuugagcauguacagggugg

SEQ ID NO: 330863 - RNA, 32 nt, Human
auauauucauuucaaagaguguuugguuccug

SEQ ID NO: 330864 - RNA, 32 nt, Human
auauauuccuucagacuucugaacuuuugcau

SEQ ID NO: 330865 - RNA, 32 nt, Human
auauauucuccauacccugcuucaccaaaauu

SEQ ID NO: 330866 - RNA, 32 nt, Human
auauauucucugcucuuuguauucuccuuuga

SEQ ID NO: 330867 - RNA, 32 nt, Human
auauauucuuaacuagcuucuggguccuaagu

SEQ ID NO: 330868 - RNA, 32 nt, Human
auauauugcccaggugaaagggaucucagugg

SEQ ID NO: 330869 - RNA, 32 nt, Human
auauauugcuuuguuaauuuguuuuuauauuu

SEQ ID NO: 330870 - RNA, 32 nt, Human
auauauuggagucuuuaaaaauguugaagaau

SEQ ID NO: 330871 - RNA, 32 nt, Human
auauauuggucuuaagugugacuuucucucug

SEQ ID NO: 330872 - RNA, 32 nt, Human
auauauuuaacaaaccugaauguggccguguu

SEQ ID NO: 330873 - RNA, 32 nt, Human
auauauuuagagauguuuucuuccauaaggag

SEQ ID NO: 330874 - RNA, 22 nt, Human
auauauuucacagcuucaggca

SEQ ID NO: 330875 - RNA, 32 nt, Human
auauauuugcuagauuucuaaagaauguguuc

SEQ ID NO: 330876 - RNA, 32 nt, Human
auauauuugucccaucuauaacauauuuaaau

SEQ ID NO: 330877 - RNA, 32 nt, Human
auauauuuucuuucucuuccuccuuccucuuc

SEQ ID NO: 330878 - RNA, 32 nt, Human
auauauuuugaaauggagucuugcucugucac

SEQ ID NO: 330879 - RNA, 32 nt, Human
auaucaaaaccucauucugcaaaguuuuugaa

SEQ ID NO: 330880 - RNA, 32 nt, Human
auaucaaaauuagcugggcacgguggugcgca

SEQ ID NO: 330881 - RNA, 32 nt, Human
auaucaaacaugugcugagggugacaggauau

SEQ ID NO: 330882 - RNA, 32 nt, Human
auaucaaaugacaagguuucucuccuucagag

SEQ ID NO: 330883 - RNA, 32 nt, Human
auaucaacaaauuggaacagcagagcaaggug

SEQ ID NO: 330884 - RNA, 32 nt, Human
auaucaacagaacucuagccaaaggcaagccc

SEQ ID NO: 330885 - RNA, 32 nt, Human
auaucaacaguaguucaaggugccaucuuaaa

SEQ ID NO: 330886 - RNA, 32 nt, Human
auaucaacuagcgcaagugaauacugaagauu

SEQ ID NO: 330887 - RNA, 32 nt, Human
auaucaacuauucuaaauacagguaaugguau

SEQ ID NO: 330888 - RNA, 32 nt, Human
auaucaacucauugccuguaaucccagcacuu

SEQ ID NO: 330889 - RNA, 32 nt, Human
auaucaacugacuuaauucugccucuuuaaaa

SEQ ID NO: 330890 - RNA, 32 nt, Human
auaucaagauguggcccaagggguuaaguggg

SEQ ID NO: 330891 - RNA, 32 nt, Human
auaucaagcugaaaaugucaccccuaucugga

SEQ ID NO: 330892 - RNA, 32 nt, Human
auaucaaguacauaucuuaauuuuggaugaau

SEQ ID NO: 330893 - RNA, 32 nt, Human
auaucaaguccauguuauucucucacagugua

SEQ ID NO: 330894 - RNA, 28 nt, Human
auaucaauccaugcugccugaucccugu

SEQ ID NO: 330895 - RNA, 32 nt, Human
auaucaauggaaaaggagaaggaccuccugca

SEQ ID NO: 330896 - RNA, 32 nt, Human
auaucaaugugguggagaaagggaagggguug

SEQ ID NO: 330897 - RNA, 32 nt, Human
auaucaauuuauuuuauaccacugaaccgugc

SEQ ID NO: 330898 - RNA, 32 nt, Human
auaucacaacccagaaguaaccaccuuuaaaa

SEQ ID NO: 330899 - RNA, 32 nt, Human
auaucacaauagauuucucaagguaagagaaa

SEQ ID NO: 330900 - RNA, 32 nt, Human
auaucacacauacucuuccuguguccaugugu

SEQ ID NO: 330901 - RNA, 32 nt, Human
auaucacacccagguaucacugugcuguccuu

SEQ ID NO: 330902 - RNA, 32 nt, Human
auaucacaucaugccagggaaagagagaugga

SEQ ID NO: 330903 - RNA, 32 nt, Human
auaucacaucuauuugucugucugcucauugu

SEQ ID NO: 330904 - RNA, 32 nt, Human
auaucacauguacccuagaaauauguauaauu

SEQ ID NO: 330905 - RNA, 32 nt, Human
auaucaccaggcaccugcagaagaggaaaauc

SEQ ID NO: 330906 - RNA, 32 nt, Human
auaucacccaggcuggagugcaguggcgcgau

SEQ ID NO: 330907 - RNA, 32 nt, Human
auaucacgaccagacggcgggucuccaucuuc

SEQ ID NO: 330908 - RNA, 32 nt, Human
auaucacuaugacugaagguacuucagcuuaa

SEQ ID NO: 330909 - RNA, 32 nt, Human
auaucacugacacuccagacuaaagcagaguc

SEQ ID NO: 330910 - RNA, 32 nt, Human
auaucacugcacuccagccuggcugacagagu

SEQ ID NO: 330911 - RNA, 32 nt, Human
auaucacugccuucucugggcuucaguguccu

SEQ ID NO: 330912 - RNA, 32 nt, Human
auaucacugcucaagucaagccuccuaaaacc

SEQ ID NO: 330913 - RNA, 32 nt, Human
auaucacuggacccaacaccuaggugauggga

SEQ ID NO: 330914 - RNA, 32 nt, Human
auaucacuguucugaauaucugugccauaguu

SEQ ID NO: 330915 - RNA, 21 nt, Human
auaucacuuccuuagcagcca

SEQ ID NO: 330916 - RNA, 32 nt, Human
auaucacuuugacagaggagaagauugaggga

SEQ ID NO: 330917 - RNA, 32 nt, Human
auaucagaagaacagaugaaguugccauccac

SEQ ID NO: 330918 - RNA, 32 nt, Human
auaucagacaacuucgcuuagcucuccagggu

SEQ ID NO: 330919 - RNA, 32 nt, Human
auaucagacaggcuccucccacagcugcaaug

SEQ ID NO: 330920 - RNA, 32 nt, Human
auaucagaccuacaggcugcuggcaggauuug

SEQ ID NO: 330921 - RNA, 32 nt, Human
auaucagagaggagaugccagagcagacagcc

SEQ ID NO: 330922 - RNA, 32 nt, Human
auaucagagccccagacagcacugccucuucc

SEQ ID NO: 330923 - RNA, 32 nt, Human
auaucagauaucuuuauauagcacuuuuaugu

SEQ ID NO: 330924 - RNA, 32 nt, Human
auaucagccugagucuccugugcccacauccc

SEQ ID NO: 330925 - RNA, 31 nt, Human
auaucagccuucucugggccuugugugugga

SEQ ID NO: 330926 - RNA, 32 nt, Human
auaucagcuacuugggagacugaggcaggaga

SEQ ID NO: 330927 - RNA, 32 nt, Human
auaucagcuauuuccugucuuacuugaaaagu

SEQ ID NO: 330928 - RNA, 32 nt, Human
auaucagguuggucuaagacuuuuggugaaca

SEQ ID NO: 330929 - RNA, 32 nt, Human
auaucagugaacucaacuuugcagugaggugg

SEQ ID NO: 330930 - RNA, 32 nt, Human
auaucaguggaccagauuuggcccaaggggua

SEQ ID NO: 330931 - RNA, 32 nt, Human
auaucaguuaugacgcccauugcccagcuuca

SEQ ID NO: 330932 - RNA, 32 nt, Human
auaucauacaacugauaaaagacuuuaagaac

SEQ ID NO: 330933 - RNA, 32 nt, Human
auaucauauauuuaggggaaagacuuaagccu

SEQ ID NO: 330934 - RNA, 32 nt, Human
auaucauaugcuucaccauucuguaaagggcc

SEQ ID NO: 330935 - RNA, 32 nt, Human
auaucaucagcccuccaucuaaugugauugcu

SEQ ID NO: 330936 - RNA, 32 nt, Human
auaucaucagcuuuccugauucugaggcuuug

SEQ ID NO: 330937 - RNA, 32 nt, Human
auaucauccagaaauaaagacacguacacuaa

SEQ ID NO: 330938 - RNA, 32 nt, Human
auaucauccagauaacugaaacucuuaucaau

SEQ ID NO: 330939 - RNA, 32 nt, Human
auaucauccuucuucagggagauaaggaaaaa

SEQ ID NO: 330940 - RNA, 32 nt, Human
auaucaucuaaauagaugcagaaaaauggaau

SEQ ID NO: 330941 - RNA, 32 nt, Human
auaucaugccacugcacuccagccugggugac

SEQ ID NO: 330942 - RNA, 32 nt, Human
auaucaugccccuguacuccagccugggugac

SEQ ID NO: 330943 - RNA, 32 nt, Human
auaucaugggccagaaggcaaaguuguuuuga

SEQ ID NO: 330944 - RNA, 32 nt, Human
auaucaugggcucugcagaacauaucaaaaua

SEQ ID NO: 330945 - RNA, 32 nt, Human
auaucauuaauccugcauuacuuagaucccau

SEQ ID NO: 330946 - RNA, 32 nt, Human
auauccaacagccuuucuggauuucucagagu

SEQ ID NO: 330947 - RNA, 32 nt, Human
auauccaaccugguuaaaugaaugaaagaaaa

SEQ ID NO: 330948 - RNA, 32 nt, Human
auauccacaaauguaaaaaugcaagaucaagg

SEQ ID NO: 330949 - RNA, 32 nt, Human
auauccacacagauacccacagaugccgcgug

SEQ ID NO: 330950 - RNA, 32 nt, Human
auauccaccucaccaaauucuaguucagccaa

SEQ ID NO: 330951 - RNA, 32 nt, Human
auauccagagggcgaaagauaucucuccauug

SEQ ID NO: 330952 - RNA, 32 nt, Human
auauccagcgagucccugacccuuucugcgaa

SEQ ID NO: 330953 - RNA, 32 nt, Human
auauccaggccaugcgcacccaggaggagcag

SEQ ID NO: 330954 - RNA, 32 nt, Human
auauccagugagugccagugugagggagcagg

SEQ ID NO: 330955 - RNA, 32 nt, Human
auauccauaagaauugagcgcuauggguguua

SEQ ID NO: 330956 - RNA, 32 nt, Human
auauccauguacuguaguuuuucuucaacauc

SEQ ID NO: 330957 - RNA, 32 nt, Human
auauccauuuugcuucccagcacuuuuuagga

SEQ ID NO: 330958 - RNA, 32 nt, Human
auaucccacaguuuccucaucccuucaccugu

SEQ ID NO: 330959 - RNA, 32 nt, Human
auaucccacauccuggaucuuuguuggguauu

SEQ ID NO: 330960 - RNA, 32 nt, Human
auaucccacucccagauugcacauuuggaaga

SEQ ID NO: 330961 - RNA, 25 nt, Human
auaucccagagaccacagagcaacu

SEQ ID NO: 330962 - RNA, 32 nt, Human
auaucccaggguggugacagcagauggagcua

SEQ ID NO: 330963 - RNA, 32 nt, Human
auauccccagaacguuaaagugaagauggaag

SEQ ID NO: 330964 - RNA, 32 nt, Human
auaucccccaaaaugaaguuaccuuccaaguu

SEQ ID NO: 330965 - RNA, 32 nt, Human
auaucccccauccugggcuuuucccagaggag

SEQ ID NO: 330966 - RNA, 32 nt, Human
auauccccugcucuaucuuggguuucuuaauu

SEQ ID NO: 330967 - RNA, 32 nt, Human
auaucccucacacccagcccccauuaccuagg

SEQ ID NO: 330968 - RNA, 32 nt, Human
auaucccugauggcuaaugauguugcccaucu

SEQ ID NO: 330969 - RNA, 32 nt, Human
auaucccugcaccccgcccauucuuugcucuc

SEQ ID NO: 330970 - RNA, 32 nt, Human
auauccgccauggagaaaucuuggccaggaug

SEQ ID NO: 330971 - RNA, 32 nt, Human
auauccuaaacaguacauuuuacuaagaaauu

SEQ ID NO: 330972 - RNA, 32 nt, Human
auauccuaccagcugcucuucagacacacaug

SEQ ID NO: 330973 - RNA, 32 nt, Human
auauccuacuccugggccuuacaugucgccug

SEQ ID NO: 330974 - RNA, 32 nt, Human
auauccuagagaaaaagacuaaugguauuuca

SEQ ID NO: 330975 - RNA, 32 nt, Human
auauccuagagggaagcgacagcagugcuucu

SEQ ID NO: 330976 - RNA, 32 nt, Human
auauccucacagcaagcacagcucucuuucag

SEQ ID NO: 330977 - RNA, 32 nt, Human
auauccucagcaccuaaaacagugcuugacau

SEQ ID NO: 330978 - RNA, 32 nt, Human
auauccucagggcagagguguuaagugagaag

SEQ ID NO: 330979 - RNA, 32 nt, Human
auauccucccacacuaagguuccccuggcccc

SEQ ID NO: 330980 - RNA, 32 nt, Human
auauccucuacaaauaggcuggcuccagcccg

SEQ ID NO: 330981 - RNA, 32 nt, Human
auauccugacugcaauccccuugcuguuccug

SEQ ID NO: 330982 - RNA, 32 nt, Human
auauccugccuggaugggguugcugugauuuu

SEQ ID NO: 330983 - RNA, 32 nt, Human
auauccugcucacaucugaaucuccuuguugu

SEQ ID NO: 330984 - RNA, 32 nt, Human
auauccuggguguccugaguguuuacagcagg

SEQ ID NO: 330985 - RNA, 32 nt, Human
auauccugguuuaccuggcacaacaaaguauc

SEQ ID NO: 330986 - RNA, 32 nt, Human
auauccugugaagaaaaucuuugcagggcacc

SEQ ID NO: 330987 - RNA, 32 nt, Human
auauccuguggcugagagggcugcagggaagu

SEQ ID NO: 330988 - RNA, 32 nt, Human
auauccuguuacugguaauucugguaccaaaa

SEQ ID NO: 330989 - RNA, 32 nt, Human
auauccuuaucagagcuaagggugggugcuca

SEQ ID NO: 330990 - RNA, 32 nt, Human
auauccuugaagacaagaaugcacccuucaag

SEQ ID NO: 330991 - RNA, 32 nt, Human
auauccuuuagcucagaaauucuaucuucggg

SEQ ID NO: 330992 - RNA, 32 nt, Human
auauccuuuccucugcuccugcccacucugcu

SEQ ID NO: 330993 - RNA, 32 nt, Human
auaucgagaguguguguauauguauuauagga

SEQ ID NO: 330994 - RNA, 32 nt, Human
auaucgauaucagcuuuugugauggcauugug

SEQ ID NO: 330995 - RNA, 32 nt, Human
auaucgauggcuuagcuugggcucagaggccu

SEQ ID NO: 330996 - RNA, 32 nt, Human
auaucgcaccacagcgcuccagccuggucgac

SEQ ID NO: 330997 - RNA, 32 nt, Human
auaucgcaccacugcacuccagccugggcaac

SEQ ID NO: 330998 - RNA, 32 nt, Human
auaucgcaccauuguacuccagccugugugac

SEQ ID NO: 330999 - RNA, 32 nt, Human
auaucgccacugcacuccagccugggugacag

SEQ ID NO: 331000 - RNA, 32 nt, Human
auaucgccguuguuccuucuguacuaaaguau

SEQ ID NO: 331001 - RNA, 32 nt, Human
auaucgcgucacugaaucuuuauagggaccca

SEQ ID NO: 331002 - RNA, 32 nt, Human
auaucgcuggggagggacaggccaugaggaga

SEQ ID NO: 331003 - RNA, 32 nt, Human
auaucggaacagacacagauaaguguguuucc

SEQ ID NO: 331004 - RNA, 32 nt, Human
auaucggcuccucauccaaagaacaacugcug

SEQ ID NO: 331005 - RNA, 32 nt, Human
auaucgguucucagugucuauuucaagauaca

SEQ ID NO: 331006 - RNA, 32 nt, Human
auaucgguuucauuaaguuggacuaaugcucu

SEQ ID NO: 331007 - RNA, 32 nt, Human
auaucgucaguuugaccaaguauuccaagagg

SEQ ID NO: 331008 - RNA, 32 nt, Human
auaucgugccacugcacuccagccuggaggac

SEQ ID NO: 331009 - RNA, 32 nt, Human
auaucgugccacugcauuccagccugggugac

SEQ ID NO: 331010 - RNA, 32 nt, Human
auaucgugccuagguuauguggugacuauuug

SEQ ID NO: 331011 - RNA, 32 nt, Human
auaucguuuuccauacagcagugccuauauag

SEQ ID NO: 331012 - RNA, 32 nt, Human
auaucuaauccuuccuauagaaagaacaguau

SEQ ID NO: 331013 - RNA, 32 nt, Human
auaucuacagagcagaggcaggaccuuuggca

SEQ ID NO: 331014 - RNA, 32 nt, Human
auaucuagcauucuuuccagacagcauccucc

SEQ ID NO: 331015 - RNA, 32 nt, Human
auaucuaggaggacucuucucucccaaacuac

SEQ ID NO: 331016 - RNA, 32 nt, Human
auaucuauauagaauagacauaucccacugua

SEQ ID NO: 331017 - RNA, 32 nt, Human
auaucuauauuauuucuuucucgucucaucaa

SEQ ID NO: 331018 - RNA, 32 nt, Human
auaucuaucuaacauuuaucuaucaucuauuc

SEQ ID NO: 331019 - RNA, 32 nt, Human
auaucucaaagacguggauuuucauuucagua

SEQ ID NO: 331020 - RNA, 32 nt, Human
auaucucaaggaaaccuaagagaaaguguucu

SEQ ID NO: 331021 - RNA, 32 nt, Human
auaucucaggcugcuggucccuccucaaucaa

SEQ ID NO: 331022 - RNA, 32 nt, Human
auaucucagucuucccucuguuucucugguga

SEQ ID NO: 331023 - RNA, 32 nt, Human
auaucucaucucuucuuuuaaaccauuuucuu

SEQ ID NO: 331024 - RNA, 32 nt, Human
auaucucaugguuuccuuuuccucuugacugu

SEQ ID NO: 331025 - RNA, 32 nt, Human
auaucucccaugggaauccuguccugccucga

SEQ ID NO: 331026 - RNA, 32 nt, Human
auaucucccugucguaggcagcuucuucggag

SEQ ID NO: 331027 - RNA, 32 nt, Human
auaucuccuacuucacugagguuugugaggac

SEQ ID NO: 331028 - RNA, 32 nt, Human
auaucuccuaguaacauuuuccauuuuuguuu

SEQ ID NO: 331029 - RNA, 32 nt, Human
auaucuccuccaucacuuccccuagcuccacu

SEQ ID NO: 331030 - RNA, 32 nt, Human
auaucucuagagacacagcagaaaaauacugg

SEQ ID NO: 331031 - RNA, 32 nt, Human
auaucucuauuccugcuagauaccuuuucagu

SEQ ID NO: 331032 - RNA, 32 nt, Human
auaucucucccaggauguucucaaggcauaca

SEQ ID NO: 331033 - RNA, 32 nt, Human
auaucucucuggaggacaaaugacagaagggu

SEQ ID NO: 331034 - RNA, 32 nt, Human
auaucucugggcaaagauaaagcaagcuuacu

SEQ ID NO: 331035 - RNA, 32 nt, Human
auaucucugugucucuccaucauuccaaagcu

SEQ ID NO: 331036 - RNA, 32 nt, Human
auaucucuguuuucaccucccuccaacccuac

SEQ ID NO: 331037 - RNA, 32 nt, Human
auaucucuuccuucuaguuggcuguauuucuu

SEQ ID NO: 331038 - RNA, 32 nt, Human
auaucucuuugcccuuccuacuccucauagca

SEQ ID NO: 331039 - RNA, 32 nt, Human
auaucugaaaacagcauuucuaagggugguaa

SEQ ID NO: 331040 - RNA, 32 nt, Human
auaucugaagucagagcauccacuccaaagca

SEQ ID NO: 331041 - RNA, 32 nt, Human
auaucugagaacugcucuggguggugagaugu

SEQ ID NO: 331042 - RNA, 32 nt, Human
auaucugcacacaucuuauucagcaucagaga

SEQ ID NO: 331043 - RNA, 32 nt, Human
auaucugcagugucuucuuccugggccuacac

SEQ ID NO: 331044 - RNA, 32 nt, Human
auaucugcaucgcuucccaccuccgggccuuu

SEQ ID NO: 331045 - RNA, 32 nt, Human
auaucugcauuucaagacuggguuaucuuugu

SEQ ID NO: 331046 - RNA, 25 nt, Human
auaucugccaccaguacauaccauu

SEQ ID NO: 331047 - RNA, 32 nt, Human
auaucugccauccagugguggaaauguggagu

SEQ ID NO: 331048 - RNA, 32 nt, Human
auaucugccuccagggaggggaggggauggga

SEQ ID NO: 331049 - RNA, 32 nt, Human
auaucugccugggggcagauauuauccccauu

SEQ ID NO: 331050 - RNA, 32 nt, Human
auaucugcugcucugcucaccaauugcugcug

SEQ ID NO: 331051 - RNA, 32 nt, Human
auaucugcugggcuuccaggagagaugggauc

SEQ ID NO: 331052 - RNA, 32 nt, Human
auaucugcuguacaacuucuuuuguuuguaac

SEQ ID NO: 331053 - RNA, 32 nt, Human
auaucugcuugugaagguucugucuuuaccac

SEQ ID NO: 331054 - RNA, 32 nt, Human
auaucuggcaauuuacaauugcccucaucuac

SEQ ID NO: 331055 - RNA, 32 nt, Human
auaucuggcaggcagaaagaagucugugauga

SEQ ID NO: 331056 - RNA, 32 nt, Human
auaucuggcuucacuacucagaagauugugug

SEQ ID NO: 331057 - RNA, 32 nt, Human
auaucugguuuaucuggguauuacaugcguuu

SEQ ID NO: 331058 - RNA, 32 nt, Human
auaucugucccaccgaaugcucccucuaacac

SEQ ID NO: 331059 - RNA, 32 nt, Human
auaucugucuuugcacaaauguaccaaucgac

SEQ ID NO: 331060 - RNA, 32 nt, Human
auaucugugcacaucuuauucaacaucagagu

SEQ ID NO: 331061 - RNA, 32 nt, Human
auaucugugugcccuagggcucagaggggccu

SEQ ID NO: 331062 - RNA, 32 nt, Human
auaucuguucacaucuuacucaacaucagaga

SEQ ID NO: 331063 - RNA, 32 nt, Human
auaucuuaaagauggauuggcccaguaucugg

SEQ ID NO: 331064 - RNA, 32 nt, Human
auaucuuacacuuugguaaagcagaaaaccag

SEQ ID NO: 331065 - RNA, 32 nt, Human
auaucuuagaacaaaagguauccucuugaaaa

SEQ ID NO: 331066 - RNA, 32 nt, Human
auaucuucaccucuauucuugggaaacacccu

SEQ ID NO: 331067 - RNA, 32 nt, Human
auaucuucaugguggggcagguuauuggaugc

SEQ ID NO: 331068 - RNA, 32 nt, Human
auaucuuccauagcucugcagauucuuggaug

SEQ ID NO: 331069 - RNA, 32 nt, Human
auaucuucuccagggaugucaacugaccuaaa

SEQ ID NO: 331070 - RNA, 32 nt, Human
auaucuucucccccagggaucuucuauuuaag

SEQ ID NO: 331071 - RNA, 32 nt, Human
auaucuucuccucuccccuugugaagaggacc

SEQ ID NO: 331072 - RNA, 32 nt, Human
auaucuucuucugcaagaccuggggcuauuuu

SEQ ID NO: 331073 - RNA, 32 nt, Human
auaucuugaacuguuuauugcucagaacuuaa

SEQ ID NO: 331074 - RNA, 32 nt, Human
auaucuugcaugucuaaucccuucuuggcauc

SEQ ID NO: 331075 - RNA, 18 nt, Human
auaucuuggccucuccca

SEQ ID NO: 331076 - RNA, 32 nt, Human
auaucuuggggagacgucaacuucugaaguga

SEQ ID NO: 331077 - RNA, 32 nt, Human
auaucuuguuuaccuggucuccagaaaaagaa

SEQ ID NO: 331078 - RNA, 32 nt, Human
auaucuuuauuaaucacuauuguuccagcagu

SEQ ID NO: 331079 - RNA, 32 nt, Human
auaucuuucaguuauuaaaugauagauaaugc

SEQ ID NO: 331080 - RNA, 32 nt, Human
auaucuuucauaauauaauuuucuaacaaugc

SEQ ID NO: 331081 - RNA, 32 nt, Human
auaucuuucccaaagauaucuaauuuggauuc

SEQ ID NO: 331082 - RNA, 32 nt, Human
auaucuuuccuacuagacacucucauuuuuau

SEQ ID NO: 331083 - RNA, 32 nt, Human
auaucuuuuucaacguuaucuuagcucuacua

SEQ ID NO: 331084 - RNA, 32 nt, Human
auaucuuuuugaaagauuauacuucuuuaccu

SEQ ID NO: 331085 - RNA, 32 nt, Human
auaugaaaaaccauauuagagauuaccuggga

SEQ ID NO: 331086 - RNA, 32 nt, Human
auaugaaaagagagacuggccuagcuucccag

SEQ ID NO: 331087 - RNA, 32 nt, Human
auaugaaaauuagccgugcaugguggugcauc

SEQ ID NO: 331088 - RNA, 32 nt, Human
auaugaaaauuagcugggcaugguggcacaug

SEQ ID NO: 331089 - RNA, 32 nt, Human
auaugaaaauuagcugggcuugguggcucaug

SEQ ID NO: 331090 - RNA, 32 nt, Human
auaugaaaauucaccagcuguaggauucaaaa

SEQ ID NO: 331091 - RNA, 32 nt, Human
auaugaaacaucuucucccaacacugcuuuaa

SEQ ID NO: 331092 - RNA, 32 nt, Human
auaugaaacugaagcggaagaaauaugaagag

SEQ ID NO: 331093 - RNA, 32 nt, Human
auaugaaaggugccauggaagaggcuacaggg

SEQ ID NO: 331094 - RNA, 32 nt, Human
auaugaaauauguuuuagaacugugaauagag

SEQ ID NO: 331095 - RNA, 32 nt, Human
auaugaaaucagauuucaacacuuacuuuguc

SEQ ID NO: 331096 - RNA, 32 nt, Human
auaugaaauguuccuuggcagcuggacugcug

SEQ ID NO: 331097 - RNA, 32 nt, Human
auaugaaauuuccaaaacaggcaaauccauaa

SEQ ID NO: 331098 - RNA, 31 nt, Human
auaugaagaacucauacauguugaaagcucc

SEQ ID NO: 331099 - RNA, 32 nt, Human
auaugaagaccaggaaccaauuucagguucua

SEQ ID NO: 331100 - RNA, 32 nt, Human
auaugaagacuauccaguucucaguuugaauu

SEQ ID NO: 331101 - RNA, 32 nt, Human
auaugaagagcgagagaaaagagaggacagcg

SEQ ID NO: 331102 - RNA, 32 nt, Human
auaugaagccauauguuuaaagagauacuuga

SEQ ID NO: 331103 - RNA, 32 nt, Human
auaugaagugaagggcucugacccuggaagug

SEQ ID NO: 331104 - RNA, 32 nt, Human
auaugaauauuuugaaauaacucugaaagaug

SEQ ID NO: 331105 - RNA, 32 nt, Human
auaugaauguccugaaggaaaccacuggcuug

SEQ ID NO: 331106 - RNA, 32 nt, Human
auaugaauuccaacacugcuuccaagagacau

SEQ ID NO: 331107 - RNA, 32 nt, Human
auaugacaggcugagagcaccuccccaaacac

SEQ ID NO: 331108 - RNA, 32 nt, Human
auaugacaucauccugaagaacuucgagaagc

SEQ ID NO: 331109 - RNA, 32 nt, Human
auaugacaugggugagaaugauuacaucagag

SEQ ID NO: 331110 - RNA, 32 nt, Human
auaugacauguauauguacacacucaugugaa

SEQ ID NO: 331111 - RNA, 32 nt, Human
auaugaccaagcucauauccuuaccuugcaag

SEQ ID NO: 331112 - RNA, 32 nt, Human
auaugaccucccuaaaacacugaagguuauuu

SEQ ID NO: 331113 - RNA, 32 nt, Human
auaugaccuuuaacccuuacauuuauaugauu

SEQ ID NO: 331114 - RNA, 32 nt, Human
auaugacuccacccuccccguuuuugcugaca

SEQ ID NO: 331115 - RNA, 32 nt, Human
auaugacugaacacuuguauguguuuguuaaa

SEQ ID NO: 331116 - RNA, 32 nt, Human
auaugacuuagaaccagguggcuggucaccug

SEQ ID NO: 331117 - RNA, 32 nt, Human
auaugacuucaugaggacagugauguguguuc

SEQ ID NO: 331118 - RNA, 32 nt, Human
auaugagaaugauaacaaagguguacaugacc

SEQ ID NO: 331119 - RNA, 32 nt, Human
auaugagauagagagacaauaauuucuugcaa

SEQ ID NO: 331120 - RNA, 31 nt, Human
auaugagauauuaaaauaagcacagaaaauc

SEQ ID NO: 331121 - RNA, 32 nt, Human
auaugagcaacaccccucauuccacccccaua

SEQ ID NO: 331122 - RNA, 32 nt, Human
auaugagcauuuuucuggagaaaggaccauag

SEQ ID NO: 331123 - RNA, 32 nt, Human
auaugagccacuggccuggccuucagcaguuc

SEQ ID NO: 331124 - RNA, 32 nt, Human
auaugagcccagggcucccaaaagcaauuguc

SEQ ID NO: 331125 - RNA, 32 nt, Human
auaugaggacccccuguucuuccucccaacga

SEQ ID NO: 331126 - RNA, 32 nt, Human
auaugaggaggcagaggcagcacccaggagaa

SEQ ID NO: 331127 - RNA, 32 nt, Human
auaugagggagauugaggcugcagugagcugu

SEQ ID NO: 331128 - RNA, 32 nt, Human
auaugagguauuaccuuucuuuaguucaccug

SEQ ID NO: 331129 - RNA, 32 nt, Human
auaugagguccccagcaggggcuggcugugca

SEQ ID NO: 331130 - RNA, 32 nt, Human
auaugaguaaaggguauaaaaguauuccuugu

SEQ ID NO: 331131 - RNA, 32 nt, Human
auaugagucuaugcuuuugagcucuuuaggca

SEQ ID NO: 331132 - RNA, 32 nt, Human
auaugagugaggcucccagcuuggguguggcc

SEQ ID NO: 331133 - RNA, 32 nt, Human
auaugaguggaguaaagaucucugccaaaugu

SEQ ID NO: 331134 - RNA, 27 nt, Human
auaugaguuacgggcagcagagcuggg

SEQ ID NO: 331135 - RNA, 32 nt, Human
auaugauauugcaguuuuacuaggcaaaucuu

SEQ ID NO: 331136 - RNA, 31 nt, Human
auaugaucaauaaaccuuuuaaagagaaaaa

SEQ ID NO: 331137 - RNA, 32 nt, Human
auaugauccagcaauuccucucccagguauau

SEQ ID NO: 331138 - RNA, 32 nt, Human
auaugaucucugcuggcucugauccucauuug

SEQ ID NO: 331139 - RNA, 32 nt, Human
auaugaugaaauuuugauuucucugaaucuca

SEQ ID NO: 331140 - RNA, 32 nt, Human
auaugauguaaaagagaaaacaugcuucagcu

SEQ ID NO: 331141 - RNA, 32 nt, Human
auaugaugucauguacacaggugcugccucuc

SEQ ID NO: 331142 - RNA, 27 nt, Human
auaugaugucccauguggauguuugug

SEQ ID NO: 331143 - RNA, 32 nt, Human
auaugauuauuccugaauguacagacagaagu

SEQ ID NO: 331144 - RNA, 32 nt, Human
auaugcaaaacaugcauguuuguuacauaggu

SEQ ID NO: 331145 - RNA, 32 nt, Human
auaugcaaaagcaguuccgcugggaaccccca

SEQ ID NO: 331146 - RNA, 32 nt, Human
auaugcaauaauauacaaagcacuuugagcuu

SEQ ID NO: 331147 - RNA, 19 nt, Human
auaugcacacacagaugca

SEQ ID NO: 331148 - RNA, 32 nt, Human
auaugcacacauauauaggcaguugcaugccu

SEQ ID NO: 331149 - RNA, 32 nt, Human
auaugcacacuuccauuaccagucuccaacga

SEQ ID NO: 331150 - RNA, 32 nt, Human
auaugcacagccguucacauccagggcacaga

SEQ ID NO: 331151 - RNA, 32 nt, Human
auaugcacgagagagacagaggaggaaagaga

SEQ ID NO: 331152 - RNA, 32 nt, Human
auaugcagaauaacuguaauugugcuagaguu

SEQ ID NO: 331153 - RNA, 19 nt, Human
auaugcagaauggcauuug

SEQ ID NO: 331154 - RNA, 32 nt, Human
auaugcagaccaacaggucuuugcauuccuuu

SEQ ID NO: 331155 - RNA, 32 nt, Human
auaugcagccaagguugagagucacugaauua

SEQ ID NO: 331156 - RNA, 32 nt, Human
auaugcagggacaggauaaaauaacuuucuag

SEQ ID NO: 331157 - RNA, 32 nt, Human
auaugcaucuugauuuggagagaggcuaauau

SEQ ID NO: 331158 - RNA, 32 nt, Human
auaugcaugaauucauucuccuuuugagaagu

SEQ ID NO: 331159 - RNA, 32 nt, Human
auaugcauguuauuuuucuuuacaaagugugg

SEQ ID NO: 331160 - RNA, 32 nt, Human
auaugcauguuccugagaacagcacuuagucc

SEQ ID NO: 331161 - RNA, 32 nt, Human
auaugcauucacucccaggaauacucauucgu

SEQ ID NO: 331162 - RNA, 32 nt, Human
auaugcauuuuauuuacuucuuugaccaaaaa

SEQ ID NO: 331163 - RNA, 32 nt, Human
auaugccaaaggacagacuagggagaaggcag

SEQ ID NO: 331164 - RNA, 32 nt, Human
auaugccauauguauaacaagaaauaugaggu

SEQ ID NO: 331165 - RNA, 32 nt, Human
auaugccaugcugggaggccacugagaaugcu

SEQ ID NO: 331166 - RNA, 32 nt, Human
auaugccauguggggugggugaugccaguaga

SEQ ID NO: 331167 - RNA, 32 nt, Human
auaugcccaagaggggaagagguggaaucgga

SEQ ID NO: 331168 - RNA, 27 nt, Human
auaugcccaucacuccaaaaggaaaac

SEQ ID NO: 331169 - RNA, 32 nt, Human
auaugcccauucucucuuucuggaguuuuucc

SEQ ID NO: 331170 - RNA, 32 nt, Human
auaugcccucaaguaaaagaaaagccgaaagg

SEQ ID NO: 331171 - RNA, 32 nt, Human
auaugcccuccuccucugcuuggcagaaggug

SEQ ID NO: 331172 - RNA, 32 nt, Human
auaugccgccgcggcccucuggcucuaggcca

SEQ ID NO: 331173 - RNA, 32 nt, Human
auaugccuauagucccagcuacuugggaggcu

SEQ ID NO: 331174 - RNA, 24 nt, Human
auaugccuggagucgucuguccaa

SEQ ID NO: 331175 - RNA, 32 nt, Human
auaugccuguaauucaguguauuucaguuccg

SEQ ID NO: 331176 - RNA, 32 nt, Human
auaugccuguaguaccugcaccccagagggag

SEQ ID NO: 331177 - RNA, 32 nt, Human
auaugccuguagucccagcuacucaggagguu

SEQ ID NO: 331178 - RNA, 32 nt, Human
auaugccuguggucccagcuacugaggaggcu

SEQ ID NO: 331179 - RNA, 32 nt, Human
auaugccuuccagggaaaaccuugaauuuuuc

SEQ ID NO: 331180 - RNA, 32 nt, Human
auaugcggcaguggugccgccuggugaaugaa

SEQ ID NO: 331181 - RNA, 32 nt, Human
auaugcuagcuggauacuacuacuaaugucac

SEQ ID NO: 331182 - RNA, 32 nt, Human
auaugcugaagccucuguccacacaugcacac

SEQ ID NO: 331183 - RNA, 32 nt, Human
auaugcugcuucuguuuaacagugaugcaaca

SEQ ID NO: 331184 - RNA, 32 nt, Human
auaugcugcuuuggagguguagugaacgugug

SEQ ID NO: 331185 - RNA, 32 nt, Human
auaugcuggaagaggaggugucccagugagcc

SEQ ID NO: 331186 - RNA, 32 nt, Human
auaugcuggacugcauucacacauggcaugaa

SEQ ID NO: 331187 - RNA, 32 nt, Human
auaugcugggagcugucaccuccacuccuagg

SEQ ID NO: 331188 - RNA, 32 nt, Human
auaugcugucuggacaggcacacacaugcaga

SEQ ID NO: 331189 - RNA, 32 nt, Human
auaugcuuuaucccaaaacaaagcagauaacg

SEQ ID NO: 331190 - RNA, 32 nt, Human
auaugcuuuauguaugcauauguauguagaua

SEQ ID NO: 331191 - RNA, 32 nt, Human
auaugcuuuuugauguuuuccucugcuccagc

SEQ ID NO: 331192 - RNA, 32 nt, Human
auauggaaaggauacacacuuuguagaaacaa

SEQ ID NO: 331193 - RNA, 32 nt, Human
auauggaaauuagcugggcaugacggcgggug

SEQ ID NO: 331194 - RNA, 32 nt, Human
auauggaacauuuucuguguguacauguacau

SEQ ID NO: 331195 - RNA, 32 nt, Human
auauggaagacugaagccggaagaacacagaa

SEQ ID NO: 331196 - RNA, 32 nt, Human
auauggacacagauucucaugccauuccagau

SEQ ID NO: 331197 - RNA, 32 nt, Human
auauggacaguuagcauuuaccaauauguauc

SEQ ID NO: 331198 - RNA, 32 nt, Human
auauggacucaguuuucuugcagaucaaauuu

SEQ ID NO: 331199 - RNA, 32 nt, Human
auauggagaaagagacgccucuggccuugggg

SEQ ID NO: 331200 - RNA, 27 nt, Human
auauggagagaagccauauacacauaa

SEQ ID NO: 331201 - RNA, 32 nt, Human
auauggagagugaaacaaagugcagacauuca

SEQ ID NO: 331202 - RNA, 32 nt, Human
auauggagcaaaauuagaggaggcacgagaag

SEQ ID NO: 331203 - RNA, 32 nt, Human
auauggagcccuuuuaaacuugucaucuuuau

SEQ ID NO: 331204 - RNA, 32 nt, Human
auauggagcuuuggagguucagagaagagaac

SEQ ID NO: 331205 - RNA, 32 nt, Human
auauggagguccuggagcacaccaagaaauga

SEQ ID NO: 331206 - RNA, 32 nt, Human
auauggaguagacugcauacagaucucuuuau

SEQ ID NO: 331207 - RNA, 32 nt, Human
auauggaguaguuuucucuagcaaagaguggc

SEQ ID NO: 331208 - RNA, 32 nt, Human
auauggagucucugcccugagaucuuccccau

SEQ ID NO: 331209 - RNA, 32 nt, Human
auauggaugagguggagagugggaagcaggag

SEQ ID NO: 331210 - RNA, 32 nt, Human
auauggcagccaccagccacacuggcuuuuga

SEQ ID NO: 331211 - RNA, 32 nt, Human
auauggcagugguuccauaagauuacaauacu

SEQ ID NO: 331212 - RNA, 31 nt, Human
auauggccaguggucuccaugccaagugcag

SEQ ID NO: 331213 - RNA, 32 nt, Human
auauggcggggaggaggaggagaaggcggcgg

SEQ ID NO: 331214 - RNA, 32 nt, Human
auauggcguuuugucuguguugcuguuuaggu

SEQ ID NO: 331215 - RNA, 32 nt, Human
auauggcuaaacccuuuccugauugagaguua

SEQ ID NO: 331216 - RNA, 32 nt, Human
auauggcuagcacugaaggccagucaguuuaa

SEQ ID NO: 331217 - RNA, 32 nt, Human
auauggcucacugcagccucgacaccuggguu

SEQ ID NO: 331218 - RNA, 32 nt, Human
auauggcugcuccagccccacuucuuagcauu

SEQ ID NO: 331219 - RNA, 32 nt, Human
auauggcugggcaggcacaggcagugaggccg

SEQ ID NO: 331220 - RNA, 32 nt, Human
auauggcuucagugugucaagaagaccugaaa

SEQ ID NO: 331221 - RNA, 32 nt, Human
auauggcuuucauacagccagcuccuguuuuu

SEQ ID NO: 331222 - RNA, 32 nt, Human
auaugggaaggcagagguaccugggaccuugc

SEQ ID NO: 331223 - RNA, 32 nt, Human
auaugggaagugaaaauaguuaacaccuugca

SEQ ID NO: 331224 - RNA, 32 nt, Human
auaugggcuucaucaacuccuucuggcuggaa

SEQ ID NO: 331225 - RNA, 32 nt, Human
auauggggacacagcaagaagaaugccaucug

SEQ ID NO: 331226 - RNA, 32 nt, Human
auauggggagagauggaagaggaccgggagga

SEQ ID NO: 331227 - RNA, 32 nt, Human
auauggggauucugcucucuuuucuuauuuac

SEQ ID NO: 331228 - RNA, 32 nt, Human
auauggggcgauagagacacauguggggugga

SEQ ID NO: 331229 - RNA, 32 nt, Human
auauggggcuuuagcaaguuugagcauaggcu

SEQ ID NO: 331230 - RNA, 32 nt, Human
auauggguggguguuuuguugcagcugcugau

SEQ ID NO: 331231 - RNA, 32 nt, Human
auaugguagaauccuucuuuacuuuuuaaguc

SEQ ID NO: 331232 - RNA, 32 nt, Human
auaugguagccacauuuugaauccucuaccac

SEQ ID NO: 331233 - RNA, 32 nt, Human
auaugguauacaaaagcagcugaaauaugcug

SEQ ID NO: 331234 - RNA, 32 nt, Human
auaugguauaccuccugaccccucucucccuc

SEQ ID NO: 331235 - RNA, 32 nt, Human
auaugguccuaauuccaugucaccaacaacac

SEQ ID NO: 331236 - RNA, 32 nt, Human
auauggugaaacccugucuguacuaaaauaca

SEQ ID NO: 331237 - RNA, 32 nt, Human
auauggugaaucugaacguacaucucacuggu

SEQ ID NO: 331238 - RNA, 32 nt, Human
auauggugacaauagucaucuccuagggcuca

SEQ ID NO: 331239 - RNA, 18 nt, Human
auauggugaccuuacaga

SEQ ID NO: 331240 - RNA, 32 nt, Human
auauggugauaugccaaaauauuuaugucaau

SEQ ID NO: 331241 - RNA, 27 nt, Human
auaugguggacaaagacacagagagag

SEQ ID NO: 331242 - RNA, 32 nt, Human
auaugguggacaaagacacagagagagacauu

SEQ ID NO: 331243 - RNA, 32 nt, Human
auaugguggagguggaggauaugaugguuaca

SEQ ID NO: 331244 - RNA, 32 nt, Human
auaugguggccggaggggcugccuuauauuug

SEQ ID NO: 331245 - RNA, 32 nt, Human
auaugguggucuguaacauuuuuccagcucau

SEQ ID NO: 331246 - RNA, 32 nt, Human
auaugguggugguggcagcugggcaggucucc

SEQ ID NO: 331247 - RNA, 21 nt, Human
auaugguguacguguguguac

SEQ ID NO: 331248 - RNA, 32 nt, Human
auaugguguccucugugccaguuuuguaccuu

SEQ ID NO: 331249 - RNA, 32 nt, Human
auaugguguucuguuguaugaauaauaccuca

SEQ ID NO: 331250 - RNA, 32 nt, Human
auaugguucuuauucacugagucucauggaga

SEQ ID NO: 331251 - RNA, 32 nt, Human
auaugguuggagaacaacaacuuuagagagag

SEQ ID NO: 331252 - RNA, 32 nt, Human
auaugguuuacuucucgaacauugguuaugac

SEQ ID NO: 331253 - RNA, 32 nt, Human
auaugguuuccagagaaaaggccaauaccuaa

SEQ ID NO: 331254 - RNA, 32 nt, Human
auaugguuuggcucugugugcuucacucugcc

SEQ ID NO: 331255 - RNA, 32 nt, Human
auauguaaacagagaaaaaggaaaguaaaaau

SEQ ID NO: 331256 - RNA, 32 nt, Human
auauguaaacugcucuuuuguuuccaaccccu

SEQ ID NO: 331257 - RNA, 32 nt, Human
auauguaaauacugcugaccucggccgccccu

SEQ ID NO: 331258 - RNA, 32 nt, Human
auauguacaacaaacuacuuucuucuucacuu

SEQ ID NO: 331259 - RNA, 32 nt, Human
auauguacacauauguaugcaaguauguauau

SEQ ID NO: 331260 - RNA, 32 nt, Human
auauguacauaccuugcuuuuucuauuuaaca

SEQ ID NO: 331261 - RNA, 32 nt, Human
auauguagacuuugucuuaugugucaaaaguc

SEQ ID NO: 331262 - RNA, 32 nt, Human
auauguagagacauauguggcuucauugguaa

SEQ ID NO: 331263 - RNA, 32 nt, Human
auauguagcacacacacauagauguauauagg

SEQ ID NO: 331264 - RNA, 32 nt, Human
auauguagcagcuucauugcuauuggaaaaau

SEQ ID NO: 331265 - RNA, 32 nt, Human
auauguagccacaaacacugaccucauguagg

SEQ ID NO: 331266 - RNA, 32 nt, Human
auauguagcuaacccuucguugugcacaugua

SEQ ID NO: 331267 - RNA, 32 nt, Human
auauguaggcugaguacaaaauaaucucaaau

SEQ ID NO: 331268 - RNA, 32 nt, Human
auauguaguauuauuauuuccuuauaugugua

SEQ ID NO: 331269 - RNA, 32 nt, Human
auauguaguucugaagauguugaauaaucauu

SEQ ID NO: 331270 - RNA, 32 nt, Human
auauguaucaaagcaagcugugccucgaccac

SEQ ID NO: 331271 - RNA, 32 nt, Human
auauguaucugacuaaaaauguugcaggcauc

SEQ ID NO: 331272 - RNA, 32 nt, Human
auauguaucuucauacacguuuggaaauguuu

SEQ ID NO: 331273 - RNA, 32 nt, Human
auauguauuauggagcugcuuccucucuccag

SEQ ID NO: 331274 - RNA, 31 nt, Human
auauguauuuguuuuauacauuuaaggcuua

SEQ ID NO: 331275 - RNA, 32 nt, Human
auauguauuuucaacucucaaaggacaagauu

SEQ ID NO: 331276 - RNA, 32 nt, Human
auaugucaacacaaaccagauccucaaauagc

SEQ ID NO: 331277 - RNA, 31 nt, Human
auaugucacaauguauccuguugaaaggacc

SEQ ID NO: 331278 - RNA, 32 nt, Human
auaugucacagaacuuuucacuuguauacuac

SEQ ID NO: 331279 - RNA, 27 nt, Human
auaugucacccaccaucucccacaagg

SEQ ID NO: 331280 - RNA, 32 nt, Human
auaugucacuugccucuggacacugguuauuu

SEQ ID NO: 331281 - RNA, 32 nt, Human
auaugucauauauacacauacauacguguaua

SEQ ID NO: 331282 - RNA, 32 nt, Human
auaugucuauacccaccacggucuccaucaaa

SEQ ID NO: 331283 - RNA, 32 nt, Human
auaugucuauuccaggauucagucuagaaacu

SEQ ID NO: 331284 - RNA, 32 nt, Human
auaugucugcuccuuuccccuuccuuuuaagu

SEQ ID NO: 331285 - RNA, 32 nt, Human
auaugugaacugccugugggguuuccaaggaa

SEQ ID NO: 331286 - RNA, 32 nt, Human
auaugugaauacagggaagcaccaacagacca

SEQ ID NO: 331287 - RNA, 32 nt, Human
auaugugagaggcagagagggcgaguggcugc

SEQ ID NO: 331288 - RNA, 32 nt, Human
auaugugaucagcuuucaaagcauuuacaagu

SEQ ID NO: 331289 - RNA, 32 nt, Human
auaugugcaaaacugcuacugaguggggagcu

SEQ ID NO: 331290 - RNA, 32 nt, Human
auaugugcaagugcccuugacagagaggcugg

SEQ ID NO: 331291 - RNA, 32 nt, Human
auaugugcagggagauuccuccccacagaguu

SEQ ID NO: 331292 - RNA, 32 nt, Human
auaugugcagugucagcaccaccuggaagguu

SEQ ID NO: 331293 - RNA, 32 nt, Human
auaugugccaaugugacaacauguggaaagcc

SEQ ID NO: 331294 - RNA, 32 nt, Human
auaugugcccgccaccagacccggcuaauauu

SEQ ID NO: 331295 - RNA, 32 nt, Human
auaugugccuguuucuggacaauggaggcgaa

SEQ ID NO: 331296 - RNA, 32 nt, Human
auaugugcucauaucuuacucaacaucagaga

SEQ ID NO: 331297 - RNA, 32 nt, Human
auauguggaaagccaggucagccagaccuguu

SEQ ID NO: 331298 - RNA, 32 nt, Human
auauguggaagacaucccuuuaggguguuaaa

SEQ ID NO: 331299 - RNA, 32 nt, Human
auauguggcaaaguccacccucaggccuuaua

SEQ ID NO: 331300 - RNA, 32 nt, Human
auaugugggaaagccuuugguugucccaguuu

SEQ ID NO: 331301 - RNA, 32 nt, Human
auaugugggugagggcauggaggagggugagu

SEQ ID NO: 331302 - RNA, 32 nt, Human
auauguggugccugucauaagcuccagagagc

SEQ ID NO: 331303 - RNA, 31 nt, Human
auauguguauauacauuuauauacgugcaca

SEQ ID NO: 331304 - RNA, 32 nt, Human
auauguguguaauuauaaggaaguucugacau

SEQ ID NO: 331305 - RNA, 32 nt, Human
auauguguguauaggcugggugcgguggcuca

SEQ ID NO: 331306 - RNA, 32 nt, Human
auauguguguguggguauguguuuauuuccag

SEQ ID NO: 331307 - RNA, 32 nt, Human
auauguguguuuguuucagcagcacuuaaaaa

SEQ ID NO: 331308 - RNA, 32 nt, Human
auauguguguuuucuuuucuuuuguuuuuggc

SEQ ID NO: 331309 - RNA, 32 nt, Human
auauguguucauguggacacacacagacacac

SEQ ID NO: 331310 - RNA, 20 nt, Human
auauguguuguacacugugg

SEQ ID NO: 331311 - RNA, 32 nt, Human
auauguguuuuugcacccuauuuucuguagug

SEQ ID NO: 331312 - RNA, 32 nt, Human
auauguuacuccucaugcugguuggaaucaug

SEQ ID NO: 331313 - RNA, 32 nt, Human
auauguucagcacacucaucucuuucuaauug

SEQ ID NO: 331314 - RNA, 32 nt, Human
auauguucauaucuaugggaaaaaucuaaaau

SEQ ID NO: 331315 - RNA, 32 nt, Human
auauguucauauggaucuuauguauguugguu

SEQ ID NO: 331316 - RNA, 32 nt, Human
auauguugaccuuagagaauugugaauauugu

SEQ ID NO: 331317 - RNA, 32 nt, Human
auauguugcaaacuuagccauauguagagugg

SEQ ID NO: 331318 - RNA, 32 nt, Human
auauguugccuggggcugggcgcgguggcuca

SEQ ID NO: 331319 - RNA, 32 nt, Human
auauguuguaucaagugaauguuaauaaguca

SEQ ID NO: 331320 - RNA, 32 nt, Human
auauguuugaccacuuugcugacuguauugaa

SEQ ID NO: 331321 - RNA, 32 nt, Human
auauguuugcaauauuuguuuuaagcacuuug

SEQ ID NO: 331322 - RNA, 32 nt, Human
auauguuuggguccuaaacagcuuuuuaaaau

SEQ ID NO: 331323 - RNA, 32 nt, Human
auauguuuuaaucucccuugucccucagaaua

SEQ ID NO: 331324 - RNA, 32 nt, Human
auauguuuugagauuggaaaguguucuugggc

SEQ ID NO: 331325 - RNA, 32 nt, Human
auauguuuugguauaguuaccaggacacuuac

SEQ ID NO: 331326 - RNA, 32 nt, Human
auauguuuuuggagaaagguggaaaugaagca

SEQ ID NO: 331327 - RNA, 32 nt, Human
auauuaaaacauuuuauacuuuauggcaaaug

SEQ ID NO: 331328 - RNA, 32 nt, Human
auauuaaacaugugggugauaugaggcagcag

SEQ ID NO: 331329 - RNA, 32 nt, Human
auauuaaaccaaucuugcauuccuagaauaaa

SEQ ID NO: 331330 - RNA, 32 nt, Human
auauuaaacuuuucuuccccuuccuaguucug

SEQ ID NO: 331331 - RNA, 32 nt, Human
auauuaaagugaucauuaagaauccagaagcu

SEQ ID NO: 331332 - RNA, 32 nt, Human
auauuaaagugugcuggacaugguggcucaug

SEQ ID NO: 331333 - RNA, 32 nt, Human
auauuaaauacugugacacucugagaaaguuu

SEQ ID NO: 331334 - RNA, 32 nt, Human
auauuaacuaacaucuucaaugugccauagac

SEQ ID NO: 331335 - RNA, 32 nt, Human
auauuaacugacugucaaaagcaacuguguaa

SEQ ID NO: 331336 - RNA, 32 nt, Human
auauuaacuggaaugcugccucuuggguucuc

SEQ ID NO: 331337 - RNA, 32 nt, Human
auauuaagaaaaucugugucuuuuuaauauuc

SEQ ID NO: 331338 - RNA, 32 nt, Human
auauuaagcauguagauagagagugaacugcu

SEQ ID NO: 331339 - RNA, 32 nt, Human
auauuaagguauaauuuacauaucauagugau

SEQ ID NO: 331340 - RNA, 32 nt, Human
auauuaagguguuccugguaaugaaggcaugu

SEQ ID NO: 331341 - RNA, 32 nt, Human
auauuaauuugagcuaauggauuguuaauucu

SEQ ID NO: 331342 - RNA, 32 nt, Human
auauuacaauugccaucuacugaguuccuaug

SEQ ID NO: 331343 - RNA, 32 nt, Human
auauuacacaccagucauuucaacauccaaaa

SEQ ID NO: 331344 - RNA, 32 nt, Human
auauuacagauggaaagaaugaggcucaggga

SEQ ID NO: 331345 - RNA, 32 nt, Human
auauuacagaugggcaaauuaaggcauaagaa

SEQ ID NO: 331346 - RNA, 32 nt, Human
auauuacauacaugcuuugaaguuucuggaaa

SEQ ID NO: 331347 - RNA, 32 nt, Human
auauuacauacauguaauaaaaacuaagcauu

SEQ ID NO: 331348 - RNA, 32 nt, Human
auauuacauuuugcuuuuaugacauucacgag

SEQ ID NO: 331349 - RNA, 32 nt, Human
auauuaccccuuccacuccaguaggggacacc

SEQ ID NO: 331350 - RNA, 21 nt, Human
auauuacccgcugacccagcc

SEQ ID NO: 331351 - RNA, 32 nt, Human
auauuaccuagaaaauuuauuuccccacuguu

SEQ ID NO: 331352 - RNA, 32 nt, Human
auauuaccucuucuuggucagaauucuauucu

SEQ ID NO: 331353 - RNA, 32 nt, Human
auauuaccuugacagaaucaugggacuuugag

SEQ ID NO: 331354 - RNA, 32 nt, Human
auauuacucagcacagagaugggggcccgguu

SEQ ID NO: 331355 - RNA, 32 nt, Human
auauuacugguacaucuuccacaugccaggcc

SEQ ID NO: 331356 - RNA, 32 nt, Human
auauuacuugcacgaaguacuugauguauggu

SEQ ID NO: 331357 - RNA, 32 nt, Human
auauuagcaacaaaaucccguaauucuuuugg

SEQ ID NO: 331358 - RNA, 32 nt, Human
auauuagcauuacagaagacacacacaucaca

SEQ ID NO: 331359 - RNA, 32 nt, Human
auauuagcccauuugaaaacgccugggaaguu

SEQ ID NO: 331360 - RNA, 32 nt, Human
auauuaggagggguuucucucaagaggcgaca

SEQ ID NO: 331361 - RNA, 32 nt, Human
auauuagggacugugguauaauuauuuuaaua

SEQ ID NO: 331362 - RNA, 32 nt, Human
auauuagggucccagacccaagauaaagaacc

SEQ ID NO: 331363 - RNA, 32 nt, Human
auauuagucauccuaaguauaccauuuaugua

SEQ ID NO: 331364 - RNA, 32 nt, Human
auauuauaaagugaugcaaacagaaauuccac

SEQ ID NO: 331365 - RNA, 32 nt, Human
auauuauacaauauacuuguauagcaguuucu

SEQ ID NO: 331366 - RNA, 32 nt, Human
auauuauacauacuguuuggaacuuugcauuu

SEQ ID NO: 331367 - RNA, 32 nt, Human
auauuauauacaacacaggcuuugaucuuggg

SEQ ID NO: 331368 - RNA, 32 nt, Human
auauuauauuucccuaacucugaagauguaua

SEQ ID NO: 331369 - RNA, 32 nt, Human
auauuaucacacacaaaggucucuauauuaac

SEQ ID NO: 331370 - RNA, 32 nt, Human
auauuauccaucaucucuuuuuggacacuucu

SEQ ID NO: 331371 - RNA, 32 nt, Human
auauuaucccuaauaccugccacccaacucuu

SEQ ID NO: 331372 - RNA, 32 nt, Human
auauuaucccuaauaccugccaccccacucuu

SEQ ID NO: 331373 - RNA, 32 nt, Human
auauuaucccuacuaccugccaccccacuguu

SEQ ID NO: 331374 - RNA, 32 nt, Human
auauuaucuauaaccagccuuuguuaacaaag

SEQ ID NO: 331375 - RNA, 32 nt, Human
auauuaucuugcccaacuggaccuuuacucac

SEQ ID NO: 331376 - RNA, 32 nt, Human
auauuaugaaaaaugaggaggccaggcaauaa

SEQ ID NO: 331377 - RNA, 32 nt, Human
auauuaugaaaagagaccuggaagugaguuca

SEQ ID NO: 331378 - RNA, 32 nt, Human
auauuaugcccaguuucugccucugagggaaa

SEQ ID NO: 331379 - RNA, 32 nt, Human
auauuaugcuuugcaauaaaucacagccuuuu

SEQ ID NO: 331380 - RNA, 32 nt, Human
auauuaugcuuuggcaaucaucugaccaugua

SEQ ID NO: 331381 - RNA, 32 nt, Human
auauuauggggaaagugaugccagcaguuccu

SEQ ID NO: 331382 - RNA, 32 nt, Human
auauuaugugugugaguuuacauaauucguau

SEQ ID NO: 331383 - RNA, 32 nt, Human
auauuauuauuuccagcuuagacauuguucuu

SEQ ID NO: 331384 - RNA, 32 nt, Human
auauuauucagcaaucaaagaaaaugaagaac

SEQ ID NO: 331385 - RNA, 32 nt, Human
auauuauugcagaauuuaucuuguucauaaug

SEQ ID NO: 331386 - RNA, 32 nt, Human
auauuauugccaacacacuuuaucucucugug

SEQ ID NO: 331387 - RNA, 32 nt, Human
auauuauuuagccagcaggaguggaguuuggu

SEQ ID NO: 331388 - RNA, 32 nt, Human
auauucaaaaccaguacaagaacugcugccug

SEQ ID NO: 331389 - RNA, 32 nt, Human
auauucaaaagaugcugcagagacagcucccc

SEQ ID NO: 331390 - RNA, 32 nt, Human
auauucaacagaaauccaccauauaaaccaua

SEQ ID NO: 331391 - RNA, 32 nt, Human
auauucaagaugaccugauuuaacaccuuuca

SEQ ID NO: 331392 - RNA, 32 nt, Human
auauucaauagcaagugcaugcaccagaaauu

SEQ ID NO: 331393 - RNA, 32 nt, Human
auauucacacaccaccaccaccacuugccaau

SEQ ID NO: 331394 - RNA, 32 nt, Human
auauucacagaauuggcagagggggucuauuu

SEQ ID NO: 331395 - RNA, 32 nt, Human
auauucaccaccuucucggcugccucagcaca

SEQ ID NO: 331396 - RNA, 32 nt, Human
auauucaccuuuauagcaacagaaaacagaca

SEQ ID NO: 331397 - RNA, 32 nt, Human
auauucacuguugccuuauaaaacuguuaggg

SEQ ID NO: 331398 - RNA, 32 nt, Human
auauucagacacauauggucagccucaugaag

SEQ ID NO: 331399 - RNA, 32 nt, Human
auauucagagacugaagugcuggccucagcaa

SEQ ID NO: 331400 - RNA, 32 nt, Human
auauucagcagucuguuccuucacacggcaau

SEQ ID NO: 331401 - RNA, 32 nt, Human
auauucaggaccaacucucucccuccccucau

SEQ ID NO: 331402 - RNA, 32 nt, Human
auauucaggagaagaggacagacacggcaccu

SEQ ID NO: 331403 - RNA, 32 nt, Human
auauucagguguagcuaauugcucuggugugg

SEQ ID NO: 331404 - RNA, 32 nt, Human
auauucagguuucaggaaugagccuuguaaua

SEQ ID NO: 331405 - RNA, 32 nt, Human
auauucagucaccaauucugcucacuucuugc

SEQ ID NO: 331406 - RNA, 32 nt, Human
auauucauaggaguuccauuuguauucuggcu

SEQ ID NO: 331407 - RNA, 32 nt, Human
auauucaucagugcugcccucacuuuggaucu

SEQ ID NO: 331408 - RNA, 32 nt, Human
auauuccaaauacuuucacucccuucacuuua

SEQ ID NO: 331409 - RNA, 32 nt, Human
auauuccaccugccaagcaagagaugcuuuca

SEQ ID NO: 331410 - RNA, 32 nt, Human
auauuccaccuguaauagcacuuuggaacugu

SEQ ID NO: 331411 - RNA, 32 nt, Human
auauuccagacaccugcccuaauccucagccu

SEQ ID NO: 331412 - RNA, 32 nt, Human
auauuccagagcugaugugaugggcugugcag

SEQ ID NO: 331413 - RNA, 32 nt, Human
auauuccagugaauaaaauacaaaagcauugu

SEQ ID NO: 331414 - RNA, 32 nt, Human
auauuccauagagaagaaagaugggauagcuc

SEQ ID NO: 331415 - RNA, 32 nt, Human
auauucccaagaggaguuaagauugggauaag

SEQ ID NO: 331416 - RNA, 32 nt, Human
auauucccagcacuuugagaggucaaaguggg

SEQ ID NO: 331417 - RNA, 32 nt, Human
auauucccagcaguaaccacuuccauuaaugu

SEQ ID NO: 331418 - RNA, 32 nt, Human
auauucccaguaaauuuauauagcagugaaga

SEQ ID NO: 331419 - RNA, 32 nt, Human
auauuccuauuucauauauucucucccuguug

SEQ ID NO: 331420 - RNA, 32 nt, Human
auauuccucuucaauucugcugucuaaaagaa

SEQ ID NO: 331421 - RNA, 32 nt, Human
auauuccucuugcauuucacuugaguggaggu

SEQ ID NO: 331422 - RNA, 32 nt, Human
auauuccuguaagauacaggugugguuagaca

SEQ ID NO: 331423 - RNA, 32 nt, Human
auauucguugaucaccuccuauuucccaggca

SEQ ID NO: 331424 - RNA, 32 nt, Human
auauucuacuagaaauacaaagaagagcuggu

SEQ ID NO: 331425 - RNA, 32 nt, Human
auauucuagcuacucaggaggcugagauggga

SEQ ID NO: 331426 - RNA, 32 nt, Human
auauucuauuaaaaaguaaauuggcugggugu

SEQ ID NO: 331427 - RNA, 32 nt, Human
auauucucagcagccuaaggugguggccugcu

SEQ ID NO: 331428 - RNA, 32 nt, Human
auauucucugaaagcaaugagaacaaagacac

SEQ ID NO: 331429 - RNA, 32 nt, Human
auauucucuuucaugcugaauuuacuaugacc

SEQ ID NO: 331430 - RNA, 32 nt, Human
auauucugaacaaagcuauaggguuuuaaguu

SEQ ID NO: 331431 - RNA, 32 nt, Human
auauucugaauacauuauuuccauucauuuag

SEQ ID NO: 331432 - RNA, 32 nt, Human
auauucugacucugaaagaagacagucccuug

SEQ ID NO: 331433 - RNA, 32 nt, Human
auauucugaguauaguauauuaacuggcauug

SEQ ID NO: 331434 - RNA, 32 nt, Human
auauucugcaaaugucucuuggaacacacugc

SEQ ID NO: 331435 - RNA, 32 nt, Human
auauucuggaaacauggcuacacacacccuug

SEQ ID NO: 331436 - RNA, 32 nt, Human
auauucuggccagagaacugagguccuuggau

SEQ ID NO: 331437 - RNA, 32 nt, Human
auauucuguaccacauacacuucuguggacuu

SEQ ID NO: 331438 - RNA, 32 nt, Human
auauucuuaucaaguacugcagaaggagcaga

SEQ ID NO: 331439 - RNA, 31 nt, Human
auauucuucaagaaauaauguugaaagccua

SEQ ID NO: 331440 - RNA, 32 nt, Human
auauucuucauaauggaggacaauguuuugca

SEQ ID NO: 331441 - RNA, 32 nt, Human
auauucuucaucugaggagcaucuauauguuu

SEQ ID NO: 331442 - RNA, 32 nt, Human
auauucuucuucuccugcccuuggacaucaga

SEQ ID NO: 331443 - RNA, 32 nt, Human
auauucuugguucuuaaaaucuaucacuuuuc

SEQ ID NO: 331444 - RNA, 32 nt, Human
auauucuuucaugguuucugcaaugagaggaa

SEQ ID NO: 331445 - RNA, 32 nt, Human
auauucuuucccucagcucuugggggccagaa

SEQ ID NO: 331446 - RNA, 32 nt, Human
auauugaaaacacacaccacacaucacacaca

SEQ ID NO: 331447 - RNA, 32 nt, Human
auauugaaagugguuugagauagugguauaag

SEQ ID NO: 331448 - RNA, 32 nt, Human
auauugaaguaguuugaugauuuguuuggcau

SEQ ID NO: 331449 - RNA, 32 nt, Human
auauugaagucucaacugucucuguucacaag

SEQ ID NO: 331450 - RNA, 32 nt, Human
auauugacuaaaucaagaucugugauugaaca

SEQ ID NO: 331451 - RNA, 32 nt, Human
auauugacuaaauccagaucugugauugaaca

SEQ ID NO: 331452 - RNA, 32 nt, Human
auauugacugccucugccugucgcaugagaac

SEQ ID NO: 331453 - RNA, 32 nt, Human
auauugagauuaauacaugaaaaugcuuaaaa

SEQ ID NO: 331454 - RNA, 32 nt, Human
auauugagccaucuguaucuacauauauuaaa

SEQ ID NO: 331455 - RNA, 32 nt, Human
auauugagcugaguuuucauuuugauuuuguu

SEQ ID NO: 331456 - RNA, 32 nt, Human
auauugaggaagcacaggacauccaaggguac

SEQ ID NO: 331457 - RNA, 22 nt, Human
auauugagggagacagcgcuaa

SEQ ID NO: 331458 - RNA, 32 nt, Human
auauugagggagcgcagagcacugggccuggc

SEQ ID NO: 331459 - RNA, 32 nt, Human
auauugagugccugucauaggucagguaaagu

SEQ ID NO: 331460 - RNA, 32 nt, Human
auauugaucugaaucuaggauucuauucuagu

SEQ ID NO: 331461 - RNA, 32 nt, Human
auauugaugccauuuaagggauggaugcaacc

SEQ ID NO: 331462 - RNA, 32 nt, Human
auauugaugggcuuggaugaacuggggcaggg

SEQ ID NO: 331463 - RNA, 32 nt, Human
auauugauucuuaacauuggcuuuucagucau

SEQ ID NO: 331464 - RNA, 32 nt, Human
auauugauugcuuuuaguuucagcuuucaauc

SEQ ID NO: 331465 - RNA, 32 nt, Human
auauugcaaauacauguuuccucaugaaaucu

SEQ ID NO: 331466 - RNA, 32 nt, Human
auauugcaccauugcacuccugccugggcaac

SEQ ID NO: 331467 - RNA, 31 nt, Human
auauugcagcauauuuuacauuugaauacaa

SEQ ID NO: 331468 - RNA, 32 nt, Human
auauugcagugucucuaaaggaggcaaauugg

SEQ ID NO: 331469 - RNA, 32 nt, Human
auauugccauuaugcuugacaugguuuccaaa

SEQ ID NO: 331470 - RNA, 32 nt, Human
auauugcccaggcuggucucgaaugccugggc

SEQ ID NO: 331471 - RNA, 32 nt, Human
auauugcccaggcuggucuucuggcuucugga

SEQ ID NO: 331472 - RNA, 32 nt, Human
auauugcccuucuucccuuagaagaacugcug

SEQ ID NO: 331473 - RNA, 32 nt, Human
auauugccuaggcuggaaugcagugguuauuc

SEQ ID NO: 331474 - RNA, 32 nt, Human
auauugccucacaacccugcuuacauugaaaa

SEQ ID NO: 331475 - RNA, 32 nt, Human
auauugccugcucuuuucuagucaaaccugau

SEQ ID NO: 331476 - RNA, 32 nt, Human
auauugccuggacacacacaugugcacagaua

SEQ ID NO: 331477 - RNA, 32 nt, Human
auauugcuagagcugggacucuggugagcauc

SEQ ID NO: 331478 - RNA, 29 nt, Human
auauugcugcaauaaacauacauguacag

SEQ ID NO: 331479 - RNA, 32 nt, Human
auauugcugcuuccucuuccuuugaagcauca

SEQ ID NO: 331480 - RNA, 32 nt, Human
auauugcugugcuccccaccacccccauggca

SEQ ID NO: 331481 - RNA, 32 nt, Human
auauugcuuugccuuuucuuauauggaaaauc

SEQ ID NO: 331482 - RNA, 32 nt, Human
auauuggaaaggcgccgccgccgccuccgccu

SEQ ID NO: 331483 - RNA, 21 nt, Human
auauuggaaaucagcugcuga

SEQ ID NO: 331484 - RNA, 24 nt, Human
auauuggaaucuauuuaacugcua

SEQ ID NO: 331485 - RNA, 32 nt, Human
auauuggacagaaguacaccaaauacggcauu

SEQ ID NO: 331486 - RNA, 32 nt, Human
auauuggacuucccagccucccaaaccaugag

SEQ ID NO: 331487 - RNA, 32 nt, Human
auauuggagagaagcauuacaagugaaggugg

SEQ ID NO: 331488 - RNA, 32 nt, Human
auauuggauggcagaacaugccaagccugugg

SEQ ID NO: 331489 - RNA, 32 nt, Human
auauuggcacagauuucauuugagagaacuca

SEQ ID NO: 331490 - RNA, 32 nt, Human
auauuggcauguaaacagcacagacaccguaa

SEQ ID NO: 331491 - RNA, 32 nt, Human
auauuggccuagaggggcugacuggggaggag

SEQ ID NO: 331492 - RNA, 32 nt, Human
auauuggccuuuugcuauccuuccugcuaugc

SEQ ID NO: 331493 - RNA, 32 nt, Human
auauuggcggaaaaacagcccuagaguuccag

SEQ ID NO: 331494 - RNA, 32 nt, Human
auauuggcuauugugaaaaaugaugcuauaaa

SEQ ID NO: 331495 - RNA, 32 nt, Human
auauuggcucacugcaaccucugccuucuggg

SEQ ID NO: 331496 - RNA, 32 nt, Human
auauuggcucacugcagccucugcuccccagu

SEQ ID NO: 331497 - RNA, 32 nt, Human
auauuggcucuggccucuuuagggaggcccau

SEQ ID NO: 331498 - RNA, 32 nt, Human
auauugggaggaggggaaagagaagcccagac

SEQ ID NO: 331499 - RNA, 32 nt, Human
auauuggggaauagaagggauugaggaaacau

SEQ ID NO: 331500 - RNA, 32 nt, Human
auauugggggaggaagagagggaggcacguag

SEQ ID NO: 331501 - RNA, 32 nt, Human
auauugggguggcgaaggggaggcgggggccc

SEQ ID NO: 331502 - RNA, 32 nt, Human
auauuggucccugguggaaauucaaaguuauc

SEQ ID NO: 331503 - RNA, 31 nt, Human
auauuggugguguccaucgugggcagcggac

SEQ ID NO: 331504 - RNA, 32 nt, Human
auauuguaacuugcauguauccauaccuggau

SEQ ID NO: 331505 - RNA, 32 nt, Human
auauuguaggaugccuuucuauuucaauuggu

SEQ ID NO: 331506 - RNA, 32 nt, Human
auauuguauaaccacacacauuauucauuguu

SEQ ID NO: 331507 - RNA, 32 nt, Human
auauuguaugcauguaucaaaauaucacaugu

SEQ ID NO: 331508 - RNA, 32 nt, Human
auauuguauuaaaaauuuaaaauagguauuuu

SEQ ID NO: 331509 - RNA, 32 nt, Human
auauugucagcuuucaguguagugagauuauu

SEQ ID NO: 331510 - RNA, 32 nt, Human
auauuguccgguugcucucucagaaucucgcg

SEQ ID NO: 331511 - RNA, 32 nt, Human
auauuguccuagaugcuggagugagauuauau

SEQ ID NO: 331512 - RNA, 32 nt, Human
auauuguccuccaugccccuccagaaggaccu

SEQ ID NO: 331513 - RNA, 32 nt, Human
auauugugaacugccuucucuucaucccaaca

SEQ ID NO: 331514 - RNA, 32 nt, Human
auauugugcaguuucaaaagaacuauuuaaaa

SEQ ID NO: 331515 - RNA, 32 nt, Human
auauugugcauauggcagacccugcccagcgu

SEQ ID NO: 331516 - RNA, 32 nt, Human
auauugugccacugcacuccagccugggcgac

SEQ ID NO: 331517 - RNA, 32 nt, Human
auauugugcucuuuuaaaugccaauuacaguc

SEQ ID NO: 331518 - RNA, 32 nt, Human
auauuguuaaaagucucucaaauuaggccaga

SEQ ID NO: 331519 - RNA, 32 nt, Human
auauuguuaaacugguucaaagaaauaaacug

SEQ ID NO: 331520 - RNA, 32 nt, Human
auauuguucuuccuccuuagaauuuagagaua

SEQ ID NO: 331521 - RNA, 32 nt, Human
auauuguuucauucuucucucuuccugucacc

SEQ ID NO: 331522 - RNA, 32 nt, Human
auauuguuugcagacacacaagaaaucuggcu

SEQ ID NO: 331523 - RNA, 32 nt, Human
auauuguuugcccaucauugugcaauaugcug

SEQ ID NO: 331524 - RNA, 32 nt, Human
auauuuaaaaacaaaacuuuuaaacuuccuau

SEQ ID NO: 331525 - RNA, 32 nt, Human
auauuuaaaauacuucauuccuuaacucuccc

SEQ ID NO: 331526 - RNA, 32 nt, Human
auauuuaaaggcagauguacgcuuuaaauugg

SEQ ID NO: 331527 - RNA, 32 nt, Human
auauuuaauuugugcuuaugugguguuuggug

SEQ ID NO: 331528 - RNA, 32 nt, Human
auauuuacacauauuuccaaauauuuauuuca

SEQ ID NO: 331529 - RNA, 32 nt, Human
auauuuacagaagaaaagcaugcauaucauua

SEQ ID NO: 331530 - RNA, 32 nt, Human
auauuuacucgucacuuucaaaccagaagcau

SEQ ID NO: 331531 - RNA, 32 nt, Human
auauuuacugaccacaccaauauucaauugaa

SEQ ID NO: 331532 - RNA, 32 nt, Human
auauuuagacccuguuuccuuucaggaggguc

SEQ ID NO: 331533 - RNA, 32 nt, Human
auauuuagacuuuuuguuguuguuguuguuuu

SEQ ID NO: 331534 - RNA, 32 nt, Human
auauuuagccuggccugagacaggacaggaag

SEQ ID NO: 331535 - RNA, 32 nt, Human
auauuuagcuuuuucacccauuucuuuaugaa

SEQ ID NO: 331536 - RNA, 32 nt, Human
auauuuauacagugacauauacucaugccaug

SEQ ID NO: 331537 - RNA, 32 nt, Human
auauuuauaggaauacuucaguuuuuccuuuu

SEQ ID NO: 331538 - RNA, 32 nt, Human
auauuuauccgcuggcuccuguuuccaauuga

SEQ ID NO: 331539 - RNA, 32 nt, Human
auauuuauccugcuuagaauuuacagaacuuc

SEQ ID NO: 331540 - RNA, 32 nt, Human
auauuuaucucaguuucccaaaggacaagcua

SEQ ID NO: 331541 - RNA, 32 nt, Human
auauuuaugggcugaggaaaacaauuaccagg

SEQ ID NO: 331542 - RNA, 32 nt, Human
auauuuaugguacuauuaugugggugaugccu

SEQ ID NO: 331543 - RNA, 32 nt, Human
auauuuauguaauaauuucuuaaaaccauuca

SEQ ID NO: 331544 - RNA, 32 nt, Human
auauuuauguuuuuacauuggaaauugucuuc

SEQ ID NO: 331545 - RNA, 32 nt, Human
auauuuauugaauuccuagaugcaguauggau

SEQ ID NO: 331546 - RNA, 32 nt, Human
auauuuauugagcugaaagagcaugagcccag

SEQ ID NO: 331547 - RNA, 32 nt, Human
auauuuauuuguacaguuaguauucuaaugaa

SEQ ID NO: 331548 - RNA, 32 nt, Human
auauuucaaagacugaauauuuucaaagaaaa

SEQ ID NO: 331549 - RNA, 32 nt, Human
auauuucaauaguuauccccaggccuggcacg

SEQ ID NO: 331550 - RNA, 32 nt, Human
auauuucaauccauugccaucauuguucuuau

SEQ ID NO: 331551 - RNA, 32 nt, Human
auauuucauguuagacauuugauaccuuuugg

SEQ ID NO: 331552 - RNA, 32 nt, Human
auauuucauucucucuuuacucccacuuuuua

SEQ ID NO: 331553 - RNA, 32 nt, Human
auauuucauuuucagcacagugcaaaaguucu

SEQ ID NO: 331554 - RNA, 21 nt, Human
auauuuccauaguaucacaua

SEQ ID NO: 331555 - RNA, 32 nt, Human
auauuuccaucuuccuccaguuggccuuucca

SEQ ID NO: 331556 - RNA, 32 nt, Human
auauuuccgccuuuugcuaagcuaauauauag

SEQ ID NO: 331557 - RNA, 32 nt, Human
auauuuccguguauuauaguguuuuccuugua

SEQ ID NO: 331558 - RNA, 32 nt, Human
auauuuccuaccucucccuccugugaguccca

SEQ ID NO: 331559 - RNA, 32 nt, Human
auauuuccuaucuggcauuuccaucuugcccc

SEQ ID NO: 331560 - RNA, 32 nt, Human
auauuuccuguuuuucccuuugcccacccugc

SEQ ID NO: 331561 - RNA, 32 nt, Human
auauuuccuucauucuaaaguuguucccuggc

SEQ ID NO: 331562 - RNA, 32 nt, Human
auauuuccuucauucuaaaguuguucucuggc

SEQ ID NO: 331563 - RNA, 32 nt, Human
auauuuccuucucucuuuacucccacuuuuua

SEQ ID NO: 331564 - RNA, 32 nt, Human
auauuuccuucucuucuuuuuacagaagucag

SEQ ID NO: 331565 - RNA, 32 nt, Human
auauuuccuuucuucuuuccuuauucauccca

SEQ ID NO: 331566 - RNA, 32 nt, Human
auauuucuagggguguacuuguuggggucagg

SEQ ID NO: 331567 - RNA, 32 nt, Human
auauuucucaucugcacuauguuuccauuugu

SEQ ID NO: 331568 - RNA, 32 nt, Human
auauuucuccauccuuuauucccuggugcuca

SEQ ID NO: 331569 - RNA, 32 nt, Human
auauuucucucuauuugcuaauauugcauugc

SEQ ID NO: 331570 - RNA, 32 nt, Human
auauuucuguaacucauucucuuggugcucac

SEQ ID NO: 331571 - RNA, 31 nt, Human
auauuucuuaauaaauaaauuuggaacuauu

SEQ ID NO: 331572 - RNA, 32 nt, Human
auauuucuucauuuucuuuuggaggaccgacu

SEQ ID NO: 331573 - RNA, 32 nt, Human
auauuucuuccagccuuugauuacaaauuugu

SEQ ID NO: 331574 - RNA, 32 nt, Human
auauuucuuuuuaaagaaucuuuuuaagauua

SEQ ID NO: 331575 - RNA, 32 nt, Human
auauuugaaugguuagcuauacaggcaauuaa

SEQ ID NO: 331576 - RNA, 32 nt, Human
auauuugacaggcuuauggaaggacuacagca

SEQ ID NO: 331577 - RNA, 32 nt, Human
auauuugagacggggucucccuguguuaccca

SEQ ID NO: 331578 - RNA, 32 nt, Human
auauuugagucagugggcuggaaaaggcagac

SEQ ID NO: 331579 - RNA, 32 nt, Human
auauuugaucacuuugauucucuguucuuuuc

SEQ ID NO: 331580 - RNA, 32 nt, Human
auauuugcagaauguuuuaaagugaauuguug

SEQ ID NO: 331581 - RNA, 32 nt, Human
auauuugcagguauuauaccauuuuucuauuc

SEQ ID NO: 331582 - RNA, 32 nt, Human
auauuugcaguugggguagaagaaagaaaucu

SEQ ID NO: 331583 - RNA, 32 nt, Human
auauuugcauuccucuuaucaggcauuuucau

SEQ ID NO: 331584 - RNA, 32 nt, Human
auauuugcguaugguguuccucugccucagag

SEQ ID NO: 331585 - RNA, 32 nt, Human
auauuugcuaucguuuuacuccagucauucga

SEQ ID NO: 331586 - RNA, 32 nt, Human
auauuugcucugcuuagcaaagaaaauaucac

SEQ ID NO: 331587 - RNA, 32 nt, Human
auauuuggaaccugcauuaguuccagcaauga

SEQ ID NO: 331588 - RNA, 32 nt, Human
auauuuggagagcuacaccaucaaaggugcca

SEQ ID NO: 331589 - RNA, 32 nt, Human
auauuuggcgucucucaggagcucaggaagua

SEQ ID NO: 331590 - RNA, 32 nt, Human
auauuuggcugcagauucaaauaggcaguucu

SEQ ID NO: 331591 - RNA, 32 nt, Human
auauuugggagugacugcaagcauuuuuccau

SEQ ID NO: 331592 - RNA, 32 nt, Human
auauuuggggaugucauacauuugauauugcu

SEQ ID NO: 331593 - RNA, 21 nt, Human
auauuugguauauuuaaggua

SEQ ID NO: 331594 - RNA, 28 nt, Human
auauuuguaagugcugcuuuauucuuca

SEQ ID NO: 331595 - RNA, 21 nt, Human
auauuuguaauuaauuauaua

SEQ ID NO: 331596 - RNA, 32 nt, Human
auauuuguguaauuuuuggugggugaaaggaa

SEQ ID NO: 331597 - RNA, 32 nt, Human
auauuuguguacauauuauauguauguauauu

SEQ ID NO: 331598 - RNA, 32 nt, Human
auauuuguuaaauauuuacauaugaaauuuaa

SEQ ID NO: 331599 - RNA, 32 nt, Human
auauuuguugacugaauaaaugaaugcacaac

SEQ ID NO: 331600 - RNA, 32 nt, Human
auauuuuaaauacccaucuucauuaaaguaua

SEQ ID NO: 331601 - RNA, 32 nt, Human
auauuuuaaccagcccacccagcagucaguac

SEQ ID NO: 331602 - RNA, 32 nt, Human
auauuuuaaggagagggauuugguguaauuca

SEQ ID NO: 331603 - RNA, 32 nt, Human
auauuuuaaggagcucccaaaauguguuaccu

SEQ ID NO: 331604 - RNA, 32 nt, Human
auauuuuaauuucaagcuuauuuuggagagau

SEQ ID NO: 331605 - RNA, 32 nt, Human
auauuuuaccauuuacaaagagauuaacuaca

SEQ ID NO: 331606 - RNA, 32 nt, Human
auauuuuagcuuuuagcuagacauuuauaggu

SEQ ID NO: 331607 - RNA, 32 nt, Human
auauuuuaggagauuauauugguucugccucu

SEQ ID NO: 331608 - RNA, 32 nt, Human
auauuuuaguauguauuucacuuuaugacuga

SEQ ID NO: 331609 - RNA, 32 nt, Human
auauuuuauaugccaucauagacuucauacug

SEQ ID NO: 331610 - RNA, 32 nt, Human
auauuuuaucaaccuuuccaucaugucuguuu

SEQ ID NO: 331611 - RNA, 32 nt, Human
auauuuuaucucuguuuguagagagcuaacgu

SEQ ID NO: 331612 - RNA, 32 nt, Human
auauuuucauaauuucuuucucacuuuuagca

SEQ ID NO: 331613 - RNA, 32 nt, Human
auauuuucauucuauaauuauguuacauaaaa

SEQ ID NO: 331614 - RNA, 32 nt, Human
auauuuucauucuguaauuauguuacauaaaa

SEQ ID NO: 331615 - RNA, 32 nt, Human
auauuuucccgcauaaccguauccaaugcuag

SEQ ID NO: 331616 - RNA, 32 nt, Human
auauuuucccucucaaaaccagaacaucaaca

SEQ ID NO: 331617 - RNA, 32 nt, Human
auauuuucccuucaucuaacauugauugaaca

SEQ ID NO: 331618 - RNA, 32 nt, Human
auauuuuccucaauuaugacugcccagauuua

SEQ ID NO: 331619 - RNA, 32 nt, Human
auauuuuccuuuguuaaaggaggaaccguaac

SEQ ID NO: 331620 - RNA, 32 nt, Human
auauuuucuaagaccaguuuuagaugacucuu

SEQ ID NO: 331621 - RNA, 32 nt, Human
auauuuucucucucauuugcaucauacagcuc

SEQ ID NO: 331622 - RNA, 32 nt, Human
auauuuucugugcaucacacacaugcuuuucu

SEQ ID NO: 331623 - RNA, 32 nt, Human
auauuuucuguugaggaaagauaaaaauguau

SEQ ID NO: 331624 - RNA, 32 nt, Human
auauuuucuuucccauucaucuugcccucccc

SEQ ID NO: 331625 - RNA, 28 nt, Human
auauuuugaugaccaaguuuucuggaag

SEQ ID NO: 331626 - RNA, 32 nt, Human
auauuuuggauucuuaugagccagucuuuucu

SEQ ID NO: 331627 - RNA, 32 nt, Human
auauuuugguaaaauauucaccacuuauaaug

SEQ ID NO: 331628 - RNA, 32 nt, Human
auauuuuguaacuuccaugugaggguuuucag

SEQ ID NO: 331629 - RNA, 32 nt, Human
auauuuugugaagccuguauucaccuuuuuca

SEQ ID NO: 331630 - RNA, 32 nt, Human
auauuuuguuucugcugcuucuguccaccuua

SEQ ID NO: 331631 - RNA, 32 nt, Human
auauuuuuaaaaauuuacaucaagagaggcag

SEQ ID NO: 331632 - RNA, 32 nt, Human
auauuuuuaaugauguuagguuugggggugug

SEQ ID NO: 331633 - RNA, 32 nt, Human
auauuuuuacauauauuuucucauuuuaucuu

SEQ ID NO: 331634 - RNA, 32 nt, Human
auauuuuuaucaguuaaugucauuuuagcugg

SEQ ID NO: 331635 - RNA, 32 nt, Human
auauuuuucccuuguugagaucuucuuuugua

SEQ ID NO: 331636 - RNA, 32 nt, Human
auauuuuuccucauagauuuuuccaccaucag

SEQ ID NO: 331637 - RNA, 32 nt, Human
auauuuuucuuuacuaaucauuuuggauuuuu

SEQ ID NO: 331638 - RNA, 32 nt, Human
auauuuuugacccauuggcaacaaauagacua

SEQ ID NO: 331639 - RNA, 32 nt, Human
auauuuuugcagaugaaguauguauguauguu

SEQ ID NO: 331640 - RNA, 32 nt, Human
auauuuuugcauucauauuuuugaggucuuga

SEQ ID NO: 331641 - RNA, 32 nt, Human
auauuuuugcauuuaaaaguaucaccuaucau

SEQ ID NO: 331642 - RNA, 32 nt, Human
auauuuuugccagcauuucguaaaugugcaua

SEQ ID NO: 331643 - RNA, 32 nt, Human
auauuuuuggcauaucuguugcuacucugagu

SEQ ID NO: 331644 - RNA, 32 nt, Human
auauuuuugggaggcagagaggggcaggcuug

SEQ ID NO: 331645 - RNA, 32 nt, Human
aucaaaaagcuuauccaccacgaucaaguugg

SEQ ID NO: 331646 - RNA, 32 nt, Human
aucaaaacauaacacaucacagcacucaguag

SEQ ID NO: 331647 - RNA, 32 nt, Human
aucaaaaccagccuggccaacauggugaaacc

SEQ ID NO: 331648 - RNA, 32 nt, Human
aucaaaaccauccuggcuaacauggugaaacc

SEQ ID NO: 331649 - RNA, 32 nt, Human
aucaaaacuacucacuccaccugggccccugc

SEQ ID NO: 331650 - RNA, 32 nt, Human
aucaaaagccuccacaucacagaagcuacccc

SEQ ID NO: 331651 - RNA, 32 nt, Human
aucaaaaggaaggggaaaaagguuuuugaagu

SEQ ID NO: 331652 - RNA, 32 nt, Human
aucaaaagucuacauaacuaauacagcugagc

SEQ ID NO: 331653 - RNA, 32 nt, Human
aucaaaaguggagaaugaggccaggcguggug

SEQ ID NO: 331654 - RNA, 32 nt, Human
aucaaaaguguacggcuuccugugcugcuugu

SEQ ID NO: 331655 - RNA, 32 nt, Human
aucaaaaguguauagaauauuauaguuuaaaa

SEQ ID NO: 331656 - RNA, 32 nt, Human
aucaaaaugaucauccaucuuuuguauaauga

SEQ ID NO: 331657 - RNA, 31 nt, Human
aucaaaaugauucucaacucuucuacugaag

SEQ ID NO: 331658 - RNA, 31 nt, Human
aucaaacaagugucuuuuacuuaagaagaaa

SEQ ID NO: 331659 - RNA, 32 nt, Human
aucaaacagcacagcucugggggaugucaaua

SEQ ID NO: 331660 - RNA, 32 nt, Human
aucaaacagcucccagaucugccugcagagcu

SEQ ID NO: 331661 - RNA, 19 nt, Human
aucaaacagcuuucaauca

SEQ ID NO: 331662 - RNA, 32 nt, Human
aucaaaccaaaaacuagagggggcagggccag

SEQ ID NO: 331663 - RNA, 32 nt, Human
aucaaaccacuccacaagcacagggagaugcg

SEQ ID NO: 331664 - RNA, 32 nt, Human
aucaaacccagagcggaaggagggagcucuga

SEQ ID NO: 331665 - RNA, 32 nt, Human
aucaaaccccuccaggauucccgcaggccggu

SEQ ID NO: 331666 - RNA, 31 nt, Human
aucaaacuccgccucccggguucaagcgauu

SEQ ID NO: 331667 - RNA, 32 nt, Human
aucaaacuccucaucuuuauggagauuacauu

SEQ ID NO: 331668 - RNA, 32 nt, Human
aucaaacugaaugaacuuuucucugcacugug

SEQ ID NO: 331669 - RNA, 32 nt, Human
aucaaacugagauuucaagucguacuauggaa

SEQ ID NO: 331670 - RNA, 32 nt, Human
aucaaacuuugucccuacuuuauucucucuag

SEQ ID NO: 331671 - RNA, 32 nt, Human
aucaaagaaccacagccgcugugggaggauua

SEQ ID NO: 331672 - RNA, 32 nt, Human
aucaaagacaccaucggaacagcagcgcccgc

SEQ ID NO: 331673 - RNA, 32 nt, Human
aucaaagagcugugcaaccucuucgaggccca

SEQ ID NO: 331674 - RNA, 32 nt, Human
aucaaagaggcugaggcuggcacaggacaugc

SEQ ID NO: 331675 - RNA, 32 nt, Human
aucaaagaugacaaagaggaguggaagaagac

SEQ ID NO: 331676 - RNA, 32 nt, Human
aucaaagauguggguucagaugaggaggauga

SEQ ID NO: 331677 - RNA, 32 nt, Human
aucaaagcaguuaacuuuaagacugagcaccu

SEQ ID NO: 331678 - RNA, 32 nt, Human
aucaaagccagccuauuuugacauuucauguc

SEQ ID NO: 331679 - RNA, 32 nt, Human
aucaaagcucacugcagccuugaacuccuagg

SEQ ID NO: 331680 - RNA, 32 nt, Human
aucaaagcucacugcagccuugaauuccuggg

SEQ ID NO: 331681 - RNA, 32 nt, Human
aucaaagcuguggagucgaccuccgggaacca

SEQ ID NO: 331682 - RNA, 31 nt, Human
aucaaaggaacauuugcuucacugggugaua

SEQ ID NO: 331683 - RNA, 32 nt, Human
aucaaaggaaccugggggaggaugcaggaggc

SEQ ID NO: 331684 - RNA, 32 nt, Human
aucaaaggagacaucggauggccaggccucag

SEQ ID NO: 331685 - RNA, 32 nt, Human
aucaaaggagauuauuguggaauuuucagauu

SEQ ID NO: 331686 - RNA, 32 nt, Human
aucaaagguaaucaaaguaagaugauucuucu

SEQ ID NO: 331687 - RNA, 32 nt, Human
aucaaaguuaauuuccuggucuugaggauugu

SEQ ID NO: 331688 - RNA, 32 nt, Human
aucaaauaacuagacauauaucagaaacuuua

SEQ ID NO: 331689 - RNA, 32 nt, Human
aucaaauacuauaugcaagaaaucauagcaaa

SEQ ID NO: 331690 - RNA, 32 nt, Human
aucaaauacuucaauguagauauuucuuaagu

SEQ ID NO: 331691 - RNA, 21 nt, Human
aucaaaucaguguaauuaaca

SEQ ID NO: 331692 - RNA, 21 nt, Human
aucaaaucaguguaauuagca

SEQ ID NO: 331693 - RNA, 32 nt, Human
aucaaaucucagaaagaaugucaaaucagaug

SEQ ID NO: 331694 - RNA, 32 nt, Human
aucaaaugacaagguuucucuccuucagagag

SEQ ID NO: 331695 - RNA, 32 nt, Human
aucaaaugaguauugagaagccacagaaauau

SEQ ID NO: 331696 - RNA, 32 nt, Human
aucaaaugaguauuguaaaagacuaauauaaa

SEQ ID NO: 331697 - RNA, 32 nt, Human
aucaaauggauacgcuggcagcaaagaguggu

SEQ ID NO: 331698 - RNA, 32 nt, Human
aucaaauguaucacauuuucucauguugaaca

SEQ ID NO: 331699 - RNA, 32 nt, Human
aucaaaugugcuguuuucuacucaagauccag

SEQ ID NO: 331700 - RNA, 32 nt, Human
aucaaauguuuauugggguucagcuuuguuuu

SEQ ID NO: 331701 - RNA, 32 nt, Human
aucaaauuacacaccauguuuucuaucauucu

SEQ ID NO: 331702 - RNA, 23 nt, Human
aucaaauuagcuggucucugaau

SEQ ID NO: 331703 - RNA, 32 nt, Human
aucaaauuaguaaaccaaaggaaaaguacuga

SEQ ID NO: 331704 - RNA, 32 nt, Human
aucaaauuauggacccaugaagggggcaguuu

SEQ ID NO: 331705 - RNA, 32 nt, Human
aucaaauucuaaggagcuugaucaggagggcu

SEQ ID NO: 331706 - RNA, 32 nt, Human
aucaaauuguguuggguaucaguaucuucucu

SEQ ID NO: 331707 - RNA, 32 nt, Human
aucaaauuugcacuucaugaggauuuacacau

SEQ ID NO: 331708 - RNA, 32 nt, Human
aucaaauuuggguuuccuggccccagaacuuc

SEQ ID NO: 331709 - RNA, 32 nt, Human
aucaacaaaagguuauggaagaaugguuuaug

SEQ ID NO: 331710 - RNA, 32 nt, Human
aucaacaagcaacccacccgaggggacugccu

SEQ ID NO: 331711 - RNA, 23 nt, Human
aucaacaaguuauuuucaacuca

SEQ ID NO: 331712 - RNA, 32 nt, Human
aucaacaauagaagaagaagaaaacaugucag

SEQ ID NO: 331713 - RNA, 32 nt, Human
aucaacaaugaggaaaauuacugaagaauaag

SEQ ID NO: 331714 - RNA, 32 nt, Human
aucaacacauucacuccaacaccuggguauaa

SEQ ID NO: 331715 - RNA, 32 nt, Human
aucaacaccagcugcugcccagcuacuuugga

SEQ ID NO: 331716 - RNA, 32 nt, Human
aucaacaccugucugcaaucucuugugauaga

SEQ ID NO: 331717 - RNA, 32 nt, Human
aucaacacuaaauggugugacuuggccuguuc

SEQ ID NO: 331718 - RNA, 32 nt, Human
aucaacacugauuuuauaaucugacaauaaau

SEQ ID NO: 331719 - RNA, 32 nt, Human
aucaacagaucaaugacauaggauccgaagug

SEQ ID NO: 331720 - RNA, 32 nt, Human
aucaacagaucagugccgacaugguaaggcca

SEQ ID NO: 331721 - RNA, 32 nt, Human
aucaacagcugcagggggaccccagugccaac

SEQ ID NO: 331722 - RNA, 32 nt, Human
aucaacaugccuggcacucuagcacuugagga

SEQ ID NO: 331723 - RNA, 31 nt, Human
aucaacaugccuuuggcuagagauuuacuac

SEQ ID NO: 331724 - RNA, 32 nt, Human
aucaacauugaauaucaguugacagaauggug

SEQ ID NO: 331725 - RNA, 32 nt, Human
aucaacauuguggcuggcucucgagucucuuc

SEQ ID NO: 331726 - RNA, 32 nt, Human
aucaacauuguggcugucaagaaugaucauga

SEQ ID NO: 331727 - RNA, 22 nt, Human
aucaaccaaccuggguaacaug

SEQ ID NO: 331728 - RNA, 32 nt, Human
aucaaccagcauggugaggacaccuucaaccg

SEQ ID NO: 331729 - RNA, 32 nt, Human
aucaaccaggagacugugggaggaugugagcu

SEQ ID NO: 331730 - RNA, 32 nt, Human
aucaaccagguggcauuggaggcguggcgcag

SEQ ID NO: 331731 - RNA, 32 nt, Human
aucaaccaugaucucuaucugagguccuguau

SEQ ID NO: 331732 - RNA, 32 nt, Human
aucaaccccuggcucaugcccacccuugguua

SEQ ID NO: 331733 - RNA, 32 nt, Human
aucaacccgacauuccuuucuuauaccaaugu

SEQ ID NO: 331734 - RNA, 20 nt, Human
aucaaccuacuuucaacuua

SEQ ID NO: 331735 - RNA, 32 nt, Human
aucaaccucagguucccaauagcugaaccgcu

SEQ ID NO: 331736 - RNA, 32 nt, Human
aucaaccucuagacagggaacagcuucaggau

SEQ ID NO: 331737 - RNA, 22 nt, Human
aucaaccucucaggugaaggug

SEQ ID NO: 331738 - RNA, 32 nt, Human
aucaaccugaauucagagaagccuucuuaguc

SEQ ID NO: 331739 - RNA, 24 nt, Human
aucaaccuggccaacauacugaaa

SEQ ID NO: 331740 - RNA, 32 nt, Human
aucaaccugggcaagagagugagacccugacu

SEQ ID NO: 331741 - RNA, 32 nt, Human
aucaacggaacacuaucucagcaguagcaauu

SEQ ID NO: 331742 - RNA, 32 nt, Human
aucaacggcagggaagacagagcagaggccuc

SEQ ID NO: 331743 - RNA, 32 nt, Human
aucaacgucuuuuguccagccucuuuuucuuc

SEQ ID NO: 331744 - RNA, 32 nt, Human
aucaacuacccauuuccucauucuccauguua

SEQ ID NO: 331745 - RNA, 32 nt, Human
aucaacuagguauuuaagacugauaauuuuac

SEQ ID NO: 331746 - RNA, 32 nt, Human
aucaacucacauauguucaaaaccaaaauaau

SEQ ID NO: 331747 - RNA, 18 nt, Human
aucaacuccugucucucu

SEQ ID NO: 331748 - RNA, 32 nt, Human
aucaacucucuauuucaaguacacuuauccuu

SEQ ID NO: 331749 - RNA, 32 nt, Human
aucaacucugcccguuggcugccugagccagg

SEQ ID NO: 331750 - RNA, 32 nt, Human
aucaacugagauauuuccugcuucuuaacaag

SEQ ID NO: 331751 - RNA, 32 nt, Human
aucaacugagccaaaugucugugugcaauugu

SEQ ID NO: 331752 - RNA, 22 nt, Human
aucaacugaggccucucaacca

SEQ ID NO: 331753 - RNA, 32 nt, Human
aucaacugaguggguguuuggaagaggaagga

SEQ ID NO: 331754 - RNA, 32 nt, Human
aucaacuggggucaggaguucaaaaccagccu

SEQ ID NO: 331755 - RNA, 32 nt, Human
aucaacugguuuaauauagccaauuguuuuau

SEQ ID NO: 331756 - RNA, 19 nt, Human
aucaacugucagucacuca

SEQ ID NO: 331757 - RNA, 17 nt, Human
aucaacugugucucuuu

SEQ ID NO: 331758 - RNA, 32 nt, Human
aucaacuuacaaaggauggcaggucuuaagaa

SEQ ID NO: 331759 - RNA, 32 nt, Human
aucaacuugaagcaagcuuucucucauaacgu

SEQ ID NO: 331760 - RNA, 32 nt, Human
aucaacuugcaauaccucacagagccaguuca

SEQ ID NO: 331761 - RNA, 32 nt, Human
aucaacuuuagaggagggaaagggguggcucu

SEQ ID NO: 331762 - RNA, 32 nt, Human
aucaacuuugggggaaauguaagauucugagc

SEQ ID NO: 331763 - RNA, 32 nt, Human
aucaacuuuucauaguacaugaccugcauucc

SEQ ID NO: 331764 - RNA, 32 nt, Human
aucaacuuuuuauugccuucucaccagcugca

SEQ ID NO: 331765 - RNA, 32 nt, Human
aucaagaaaaccugcuuguucacaaaagucau

SEQ ID NO: 331766 - RNA, 32 nt, Human
aucaagaacugucauccaccucuaaggaagca

SEQ ID NO: 331767 - RNA, 32 nt, Human
aucaagaagcacaucaucaccaaugacaucau

SEQ ID NO: 331768 - RNA, 17 nt, Human
aucaagaaggccucucu

SEQ ID NO: 331769 - RNA, 25 nt, Human
aucaagaagucagaauauaauugaa

SEQ ID NO: 331770 - RNA, 32 nt, Human
aucaagacaaacauguuagauaacaaaacacu

SEQ ID NO: 331771 - RNA, 32 nt, Human
aucaagaccagccugaccaacguggcgaaacc

SEQ ID NO: 331772 - RNA, 32 nt, Human
aucaagaccagccuggccaacauagugaaacc

SEQ ID NO: 331773 - RNA, 32 nt, Human
aucaagaccagccugggaaauauagcaagacc

SEQ ID NO: 331774 - RNA, 32 nt, Human
aucaagaccagcugggccaacaugguuaaacc

SEQ ID NO: 331775 - RNA, 32 nt, Human
aucaagaccagucugggcaacauagcaagacu

SEQ ID NO: 331776 - RNA, 32 nt, Human
aucaagaccauagugaccaacauagugaaacc

SEQ ID NO: 331777 - RNA, 32 nt, Human
aucaagaccauccuggccaacacagugaaacc

SEQ ID NO: 331778 - RNA, 32 nt, Human
aucaagaccauccuggccaacaugaugaaacc

SEQ ID NO: 331779 - RNA, 32 nt, Human
aucaagaccauccuggccaacauggcaaaacc

SEQ ID NO: 331780 - RNA, 32 nt, Human
aucaagaccauccuggccaacauggugaaacc

SEQ ID NO: 331781 - RNA, 32 nt, Human
aucaagaccauccuggccaacauggugaaacg

SEQ ID NO: 331782 - RNA, 32 nt, Human
aucaagaccauccuggcuaacauggugaaacc

SEQ ID NO: 331783 - RNA, 32 nt, Human
aucaagaccauccuugaucuuuaguagagacg

SEQ ID NO: 331784 - RNA, 32 nt, Human
aucaagaccaucuggcuaacagggugaaaccc

SEQ ID NO: 331785 - RNA, 32 nt, Human
aucaagaccauucuggccaacauggugaaacc

SEQ ID NO: 331786 - RNA, 32 nt, Human
aucaagacuauccuggccaacauggugaaacc

SEQ ID NO: 331787 - RNA, 32 nt, Human
aucaagacugagggucaucuugcagucugcuu

SEQ ID NO: 331788 - RNA, 32 nt, Human
aucaagacuguccuggacaacauggugaaacc

SEQ ID NO: 331789 - RNA, 32 nt, Human
aucaagagagcagcacucggagaggguguuug

SEQ ID NO: 331790 - RNA, 32 nt, Human
aucaagagaggcagucauucacgaugguuuug

SEQ ID NO: 331791 - RNA, 32 nt, Human
aucaagagccaucugcuuuccaggugaacauu

SEQ ID NO: 331792 - RNA, 32 nt, Human
aucaagagcuuacauaauuuuaaccaguucug

SEQ ID NO: 331793 - RNA, 32 nt, Human
aucaagagguggaaucuacaucccucuguugu

SEQ ID NO: 331794 - RNA, 32 nt, Human
aucaagagguugaagcugcagugagcugugau

SEQ ID NO: 331795 - RNA, 32 nt, Human
aucaagaucaaagauucuccccaucucacaga

SEQ ID NO: 331796 - RNA, 32 nt, Human
aucaagaucagugucagauauuguugagggaa

SEQ ID NO: 331797 - RNA, 32 nt, Human
aucaagaucagugucagauauuguugagggag

SEQ ID NO: 331798 - RNA, 32 nt, Human
aucaagaucauccuggccaacauggugaaacc

SEQ ID NO: 331799 - RNA, 32 nt, Human
aucaagaucuuugggaaggaacacuaaagaug

SEQ ID NO: 331800 - RNA, 32 nt, Human
aucaagaugaugggaggcaagggccuuaaaca

SEQ ID NO: 331801 - RNA, 32 nt, Human
aucaagauuacgaggcaucaccucucaaucag

SEQ ID NO: 331802 - RNA, 32 nt, Human
aucaagcaaauggugugucauugaaagucuua

SEQ ID NO: 331803 - RNA, 32 nt, Human
aucaagcaacagacuugauccagcagugucga

SEQ ID NO: 331804 - RNA, 32 nt, Human
aucaagcaauuugucuuugaaaguugauuauu

SEQ ID NO: 331805 - RNA, 32 nt, Human
aucaagcacacaguaagauuucauaagagacu

SEQ ID NO: 331806 - RNA, 32 nt, Human
aucaagcagacuguugggguugaaaggaggcu

SEQ ID NO: 331807 - RNA, 32 nt, Human
aucaagccaaaaagaaauuccauacucgccua

SEQ ID NO: 331808 - RNA, 32 nt, Human
aucaagccacugcacuccagccugggcgacag

SEQ ID NO: 331809 - RNA, 32 nt, Human
aucaagccacugcuucagccuguuggccaggg

SEQ ID NO: 331810 - RNA, 32 nt, Human
aucaagccagccugaccaacauggugaaaccc

SEQ ID NO: 331811 - RNA, 24 nt, Human
aucaagccaucgauuguguacuuu

SEQ ID NO: 331812 - RNA, 32 nt, Human
aucaagccauugcacuccagccugggcaacaa

SEQ ID NO: 331813 - RNA, 32 nt, Human
aucaagccauuguacuccagccuggacaacaa

SEQ ID NO: 331814 - RNA, 32 nt, Human
aucaagccuaguuucaaacccaucugaaauag

SEQ ID NO: 331815 - RNA, 29 nt, Human
aucaagccugugugugugcaugcuugggc

SEQ ID NO: 331816 - RNA, 32 nt, Human
aucaagcguauuccguuuucuuccugcaugau

SEQ ID NO: 331817 - RNA, 32 nt, Human
aucaagcuccacccuccuggccucauacagaa

SEQ ID NO: 331818 - RNA, 32 nt, Human
aucaagcugaagugaagccagugaagagccca

SEQ ID NO: 331819 - RNA, 32 nt, Human
aucaagcuggguaaucauggcagaagguggau

SEQ ID NO: 331820 - RNA, 32 nt, Human
aucaagcuuagugagcagugagcacugaaaca

SEQ ID NO: 331821 - RNA, 32 nt, Human
aucaaggaaagccaggccuugugggcccccuu

SEQ ID NO: 331822 - RNA, 32 nt, Human
aucaaggaaagccuggugaagccuuuacuugu

SEQ ID NO: 331823 - RNA, 32 nt, Human
aucaaggaaagggagagaaaauaauguuggag

SEQ ID NO: 331824 - RNA, 32 nt, Human
aucaaggaacaugcauuacaacuuuccuaauc

SEQ ID NO: 331825 - RNA, 32 nt, Human
aucaaggaccacugcgcccccuggccacccca

SEQ ID NO: 331826 - RNA, 32 nt, Human
aucaaggaccaugauuuuauuccuucauauag

SEQ ID NO: 331827 - RNA, 32 nt, Human
aucaaggagaagaaaagagugacuagaagacu

SEQ ID NO: 331828 - RNA, 32 nt, Human
aucaaggagaggaggaugaacagaaagaggga

SEQ ID NO: 331829 - RNA, 31 nt, Human
aucaaggagcauuguguacaugcagaagugc

SEQ ID NO: 331830 - RNA, 32 nt, Human
aucaaggaucacaaacuacagccugcaggcca

SEQ ID NO: 331831 - RNA, 32 nt, Human
aucaaggcaaaaagcauucauagauacaugca

SEQ ID NO: 331832 - RNA, 19 nt, Human
aucaaggcacuucaacuca

SEQ ID NO: 331833 - RNA, 32 nt, Human
aucaaggcagcacggcccacccaggccuccca

SEQ ID NO: 331834 - RNA, 32 nt, Human
aucaaggccagccugggaacauggaguggcag

SEQ ID NO: 331835 - RNA, 32 nt, Human
aucaaggccauccuggccaacauggugaaacc

SEQ ID NO: 331836 - RNA, 32 nt, Human
aucaaggcccagccagagguuaccaagguagg

SEQ ID NO: 331837 - RNA, 32 nt, Human
aucaaggcccugagggcagcaggaugguggcc

SEQ ID NO: 331838 - RNA, 32 nt, Human
aucaaggcgggagggccugcagugauucagca

SEQ ID NO: 331839 - RNA, 32 nt, Human
aucaaggcucacugcaaccucaaccuucuggu

SEQ ID NO: 331840 - RNA, 32 nt, Human
aucaaggcucacugcagccucaaccuucuggg

SEQ ID NO: 331841 - RNA, 32 nt, Human
aucaaggcucacugcagccuggaccuccuggu

SEQ ID NO: 331842 - RNA, 32 nt, Human
aucaaggcucacugcagccuugaacaccugga

SEQ ID NO: 331843 - RNA, 32 nt, Human
aucaaggcucaguuuauugguccucugguguu

SEQ ID NO: 331844 - RNA, 32 nt, Human
aucaaggcuuuaagagacucacugugaugccu

SEQ ID NO: 331845 - RNA, 32 nt, Human
aucaagggaggaaaaggucaccagggagaacu

SEQ ID NO: 331846 - RNA, 32 nt, Human
aucaagggccgguacaacuaccugccaggggu

SEQ ID NO: 331847 - RNA, 32 nt, Human
aucaagggccucuuccccucuuccugccagcu

SEQ ID NO: 331848 - RNA, 32 nt, Human
aucaaggucgcagacagccaaaagucaucaga

SEQ ID NO: 331849 - RNA, 32 nt, Human
aucaaggugccagcaugguuucuggugagggc

SEQ ID NO: 331850 - RNA, 32 nt, Human
aucaaggugcugcuugguuugcucugagugca

SEQ ID NO: 331851 - RNA, 32 nt, Human
aucaagguugacuucucauccuuuuugggaag

SEQ ID NO: 331852 - RNA, 32 nt, Human
aucaaguaugguaggggagggcaggcuugggg

SEQ ID NO: 331853 - RNA, 32 nt, Human
aucaagucaccacacuccagccugggugacag

SEQ ID NO: 331854 - RNA, 32 nt, Human
aucaagucauucuuuuugaaucuacuuuguau

SEQ ID NO: 331855 - RNA, 32 nt, Human
aucaaguccaacuucagaaacccgaagccugu

SEQ ID NO: 331856 - RNA, 32 nt, Human
aucaagugaauuggccccggucucacauuuuc

SEQ ID NO: 331857 - RNA, 20 nt, Human
aucaagugagacccaagcaa

SEQ ID NO: 331858 - RNA, 32 nt, Human
aucaagugaguugcuuucuggacuuuuuccau

SEQ ID NO: 331859 - RNA, 32 nt, Human
aucaagugauuguauaagcagaaacaagcugu

SEQ ID NO: 331860 - RNA, 32 nt, Human
aucaagugcacagccacccaggaaggcgacgc

SEQ ID NO: 331861 - RNA, 32 nt, Human
aucaagugccuagggaaaauuccaauggauga

SEQ ID NO: 331862 - RNA, 32 nt, Human
aucaaguggaaucacuggaaucccagaaacuu

SEQ ID NO: 331863 - RNA, 32 nt, Human
aucaaguggaggcggaggaggaggcggaggag

SEQ ID NO: 331864 - RNA, 32 nt, Human
aucaaguucacuuccaaaggcggaauucaugg

SEQ ID NO: 331865 - RNA, 32 nt, Human
aucaaguuccccagucagcagcuacuugguag

SEQ ID NO: 331866 - RNA, 32 nt, Human
aucaaguuuucugccugacaagauccaguauc

SEQ ID NO: 331867 - RNA, 32 nt, Human
aucaauaaaggaguagugcaguuuaagacaac

SEQ ID NO: 331868 - RNA, 32 nt, Human
aucaauaagaaauguucaggagagaggaaaga

SEQ ID NO: 331869 - RNA, 32 nt, Human
aucaauaagccuugccucuuuaaacuacuuau

SEQ ID NO: 331870 - RNA, 32 nt, Human
aucaauacaguauuuugauguauugcaaaaau

SEQ ID NO: 331871 - RNA, 32 nt, Human
aucaauacccuugugauuucuuaugccugucu

SEQ ID NO: 331872 - RNA, 32 nt, Human
aucaauagaagguuuucucugauuuucuucuc

SEQ ID NO: 331873 - RNA, 32 nt, Human
aucaauagcaaacccacugccauauuaguuau

SEQ ID NO: 331874 - RNA, 32 nt, Human
aucaauagguccaaucugcucucaaggccuug

SEQ ID NO: 331875 - RNA, 32 nt, Human
aucaauauaucaccuaccaucauuucauuacu

SEQ ID NO: 331876 - RNA, 32 nt, Human
aucaauaugaccacacuccagccaaggacaaa

SEQ ID NO: 331877 - RNA, 32 nt, Human
aucaauauggugcugguucaaaccagagaauu

SEQ ID NO: 331878 - RNA, 32 nt, Human
aucaaucaaauucccuuaaauuuguauggcac

SEQ ID NO: 331879 - RNA, 32 nt, Human
aucaaucaaucacuguccuggccaguugcagu

SEQ ID NO: 331880 - RNA, 32 nt, Human
aucaaucaaucagcauauacauuucagccaaa

SEQ ID NO: 331881 - RNA, 32 nt, Human
aucaaucacacagcaagcuuuucaaaggagga

SEQ ID NO: 331882 - RNA, 32 nt, Human
aucaaucacugaucccagccccuauaaaaggg

SEQ ID NO: 331883 - RNA, 32 nt, Human
aucaaucaguacaucgaccacaugcagagcga

SEQ ID NO: 331884 - RNA, 32 nt, Human
aucaaucugggcaagaagcaggauccugaguc

SEQ ID NO: 331885 - RNA, 20 nt, Human
aucaaugaaauucaaugaaa

SEQ ID NO: 331886 - RNA, 32 nt, Human
aucaaugaacuuacacauacuagcagcauuau

SEQ ID NO: 331887 - RNA, 32 nt, Human
aucaaugacagagaaggcagauagcagcaugc

SEQ ID NO: 331888 - RNA, 32 nt, Human
aucaaugaucauaucaauuggcagugacuuug

SEQ ID NO: 331889 - RNA, 24 nt, Human
aucaaugauuucaccauucuucca

SEQ ID NO: 331890 - RNA, 32 nt, Human
aucaaugcaagccugguuggaccauuguccau

SEQ ID NO: 331891 - RNA, 32 nt, Human
aucaaugcagaacagcuguggagacucuaacc

SEQ ID NO: 331892 - RNA, 32 nt, Human
aucaaugccaacaacauaaauuacaucacuga

SEQ ID NO: 331893 - RNA, 23 nt, Human
aucaaugcuuguuuuuccuggug

SEQ ID NO: 331894 - RNA, 32 nt, Human
aucaauggaagacagucgggaucuuuugcuuc

SEQ ID NO: 331895 - RNA, 32 nt, Human
aucaauggcuuuuugccgcucuaccucuugug

SEQ ID NO: 331896 - RNA, 29 nt, Human
aucaaugggaaugaacaaaaagaaugagg

SEQ ID NO: 331897 - RNA, 32 nt, Human
aucaaugugaaagucagggucacagcuggucu

SEQ ID NO: 331898 - RNA, 21 nt, Human
aucaauguggagccccagagg

SEQ ID NO: 331899 - RNA, 32 nt, Human
aucaauguuauucucccucccaccacuuccca

SEQ ID NO: 331900 - RNA, 32 nt, Human
aucaauuaaaggagacaaaaagaggcagagcg

SEQ ID NO: 331901 - RNA, 32 nt, Human
aucaauuaccacaccaucucccaugaagaaag

SEQ ID NO: 331902 - RNA, 32 nt, Human
aucaauuauuuuuagagaguaauguauaauuu

SEQ ID NO: 331903 - RNA, 32 nt, Human
aucaauucaccuuuaugcaugggcaccaaagu

SEQ ID NO: 331904 - RNA, 32 nt, Human
aucaauucuaaaaacuucaagcacuuaaugga

SEQ ID NO: 331905 - RNA, 32 nt, Human
aucaauugaaccuaggagguugaggcuauagu

SEQ ID NO: 331906 - RNA, 32 nt, Human
aucaauuguaggucauguauuuuacuauaugu

SEQ ID NO: 331907 - RNA, 32 nt, Human
aucaauuguucacaaugugguggaaauuaaaa

SEQ ID NO: 331908 - RNA, 32 nt, Human
aucaauuuguguguuaugcccuuucccccagu

SEQ ID NO: 331909 - RNA, 32 nt, Human
aucaauuuuacaccucauaugucuucuuaguu

SEQ ID NO: 331910 - RNA, 32 nt, Human
aucaauuuuccagagaacuuaaacuucuaaua

SEQ ID NO: 331911 - RNA, 32 nt, Human
aucacaaaaauaaguuaaaaagaaauauuugu

SEQ ID NO: 331912 - RNA, 32 nt, Human
aucacaaaaugcucucauaagaauuauugcau

SEQ ID NO: 331913 - RNA, 32 nt, Human
aucacaaagaugaucuuucuucuuuuaacuug

SEQ ID NO: 331914 - RNA, 32 nt, Human
aucacaaaguagacauauacacacacauauau

SEQ ID NO: 331915 - RNA, 32 nt, Human
aucacaaaguagugguuuaaauacuuuguugu

SEQ ID NO: 331916 - RNA, 17 nt, Human
aucacaaaugccucucu

SEQ ID NO: 331917 - RNA, 32 nt, Human
aucacaaauucuguucauuggaaaggguuuua

SEQ ID NO: 331918 - RNA, 19 nt, Human
aucacaacaccccauuucu

SEQ ID NO: 331919 - RNA, 32 nt, Human
aucacaacgucaguuuuccuaucugcaaaagg

SEQ ID NO: 331920 - RNA, 32 nt, Human
aucacaagaacacacacauauacacgaauaga

SEQ ID NO: 331921 - RNA, 25 nt, Human
aucacaagacuaugccauuggggua

SEQ ID NO: 331922 - RNA, 32 nt, Human
aucacaagagcccaggagguugagaaugcagu

SEQ ID NO: 331923 - RNA, 32 nt, Human
aucacaagagugaaaauugccagcacaggauu

SEQ ID NO: 331924 - RNA, 32 nt, Human
aucacaagccuuugagaacagccuggccuuca

SEQ ID NO: 331925 - RNA, 32 nt, Human
aucacaagcuuggcauugcucucugccacacg

SEQ ID NO: 331926 - RNA, 32 nt, Human
aucacaaggccgaguggacucucaccugaggg

SEQ ID NO: 331927 - RNA, 32 nt, Human
aucacaaguuugccagccuccaccuucuaacc

SEQ ID NO: 331928 - RNA, 32 nt, Human
aucacaaucauacaugguguguuuggagcagg

SEQ ID NO: 331929 - RNA, 32 nt, Human
aucacaaucauuuugaaucccucuuccucacu

SEQ ID NO: 331930 - RNA, 32 nt, Human
aucacaaugcuggugccagggaagggaaggaa

SEQ ID NO: 331931 - RNA, 32 nt, Human
aucacaauguuagcuuucuaauuccauaaaag

SEQ ID NO: 331932 - RNA, 32 nt, Human
aucacacacagccccggcacacagcaggggcu

SEQ ID NO: 331933 - RNA, 32 nt, Human
aucacacacaugcacacacacauaugcaccca

SEQ ID NO: 331934 - RNA, 32 nt, Human
aucacacacaugcacacacguguagcucacac

SEQ ID NO: 331935 - RNA, 23 nt, Human
aucacacaccagggccugucaug

SEQ ID NO: 331936 - RNA, 32 nt, Human
aucacacaggcugggugcaguggcucaugccu

SEQ ID NO: 331937 - RNA, 32 nt, Human
aucacacagucagcuaaaagcacuguggggaa

SEQ ID NO: 331938 - RNA, 24 nt, Human
aucacacauuuguugaggcugcug

SEQ ID NO: 331939 - RNA, 32 nt, Human
aucacacauuuuaaauaaguucagagaacuga

SEQ ID NO: 331940 - RNA, 20 nt, Human
aucacacauuuuucuguaua

SEQ ID NO: 331941 - RNA, 22 nt, Human
aucacaccacaguacuccagcc

SEQ ID NO: 331942 - RNA, 32 nt, Human
aucacaccacaguacuccagccuaggugacag

SEQ ID NO: 331943 - RNA, 22 nt, Human
aucacaccaccacacuccagcc

SEQ ID NO: 331944 - RNA, 32 nt, Human
aucacaccaccacuccagccugggcgagagcg

SEQ ID NO: 331945 - RNA, 32 nt, Human
aucacaccaccgcacuccacccugggaagcaa

SEQ ID NO: 331946 - RNA, 22 nt, Human
aucacaccaccucacuccagcc

SEQ ID NO: 331947 - RNA, 32 nt, Human
aucacaccaccucacuccagccugggcaacau

SEQ ID NO: 331948 - RNA, 22 nt, Human
aucacaccacuacacuccagcc

SEQ ID NO: 331949 - RNA, 23 nt, Human
aucacaccacuacacuccagcca

SEQ ID NO: 331950 - RNA, 32 nt, Human
aucacaccacuacacuccagccuaggcaacag

SEQ ID NO: 331951 - RNA, 32 nt, Human
aucacaccacuacacuccagccuggacaacag

SEQ ID NO: 331952 - RNA, 32 nt, Human
aucacaccacuacacuccagccugggcgacag

SEQ ID NO: 331953 - RNA, 32 nt, Human
aucacaccacuacacuccagccugggcgagac

SEQ ID NO: 331954 - RNA, 32 nt, Human
aucacaccacuccacuccagucuggacaacag

SEQ ID NO: 331955 - RNA, 22 nt, Human
aucacaccacugcaauccagcc

SEQ ID NO: 331956 - RNA, 32 nt, Human
aucacaccacugcaauccagccucgguaacac

SEQ ID NO: 331957 - RNA, 32 nt, Human
aucacaccacugcaauccagccugggcgacaa

SEQ ID NO: 331958 - RNA, 32 nt, Human
aucacaccacugcaccccagccugggugacag

SEQ ID NO: 331959 - RNA, 32 nt, Human
aucacaccacugcacuacagccucggcaauag

SEQ ID NO: 331960 - RNA, 21 nt, Human
aucacaccacugcacucagcc

SEQ ID NO: 331961 - RNA, 32 nt, Human
aucacaccacugcacucagccugggugacaga

SEQ ID NO: 331962 - RNA, 22 nt, Human
aucacaccacugcacuccaacc

SEQ ID NO: 331963 - RNA, 32 nt, Human
aucacaccacugcacuccaaccuggacaacag

SEQ ID NO: 331964 - RNA, 32 nt, Human
aucacaccacugcacuccaaccugggaaacgc

SEQ ID NO: 331965 - RNA, 22 nt, Human
aucacaccacugcacuccagcc

SEQ ID NO: 331966 - RNA, 23 nt, Human
aucacaccacugcacuccagcca

SEQ ID NO: 331967 - RNA, 32 nt, Human
aucacaccacugcacuccagccagggcaacag

SEQ ID NO: 331968 - RNA, 32 nt, Human
aucacaccacugcacuccagcccaggugacag

SEQ ID NO: 331969 - RNA, 32 nt, Human
aucacaccacugcacuccagccuaggcaacag

SEQ ID NO: 331970 - RNA, 32 nt, Human
aucacaccacugcacuccagccuggacaacag

SEQ ID NO: 331971 - RNA, 32 nt, Human
aucacaccacugcacuccagccuggacgacag

SEQ ID NO: 331972 - RNA, 32 nt, Human
aucacaccacugcacuccagccuggcaacaga

SEQ ID NO: 331973 - RNA, 32 nt, Human
aucacaccacugcacuccagccuggcgacaga

SEQ ID NO: 331974 - RNA, 32 nt, Human
aucacaccacugcacuccagccugggagagag

SEQ ID NO: 331975 - RNA, 32 nt, Human
aucacaccacugcacuccagccugggcaacaa

SEQ ID NO: 331976 - RNA, 32 nt, Human
aucacaccacugcacuccagccugggcaacag

SEQ ID NO: 331977 - RNA, 32 nt, Human
aucacaccacugcacuccagccugggcaacug

SEQ ID NO: 331978 - RNA, 32 nt, Human
aucacaccacugcacuccagccugggcaauag

SEQ ID NO: 331979 - RNA, 32 nt, Human
aucacaccacugcacuccagccugggcgacag

SEQ ID NO: 331980 - RNA, 32 nt, Human
aucacaccacugcacuccagccugggcggcag

SEQ ID NO: 331981 - RNA, 32 nt, Human
aucacaccacugcacuccagccugggggacag

SEQ ID NO: 331982 - RNA, 32 nt, Human
aucacaccacugcacuccagccuggggugaua

SEQ ID NO: 331983 - RNA, 32 nt, Human
aucacaccacugcacuccagccuggguaaaaa

SEQ ID NO: 331984 - RNA, 32 nt, Human
aucacaccacugcacuccagccugggugacag

SEQ ID NO: 331985 - RNA, 32 nt, Human
aucacaccacugcacuccagccugggugauag

SEQ ID NO: 331986 - RNA, 32 nt, Human
aucacaccacugcacuccagccuggguggcag

SEQ ID NO: 331987 - RNA, 32 nt, Human
aucacaccacugcacuccagccugggugucag

SEQ ID NO: 331988 - RNA, 32 nt, Human
aucacaccacugcacuccagccuggucaacag

SEQ ID NO: 331989 - RNA, 32 nt, Human
aucacaccacugcacuccagccuggugacaga

SEQ ID NO: 331990 - RNA, 32 nt, Human
aucacaccacugcacuccagccugugcgacag

SEQ ID NO: 331991 - RNA, 32 nt, Human
aucacaccacugcacuccagccuuggcgacaa

SEQ ID NO: 331992 - RNA, 32 nt, Human
aucacaccacugcacuccagccuuggcgacag

SEQ ID NO: 331993 - RNA, 32 nt, Human
aucacaccacugcacuccagccuuggugacag

SEQ ID NO: 331994 - RNA, 32 nt, Human
aucacaccacugcacuccagcuugggggauag

SEQ ID NO: 331995 - RNA, 32 nt, Human
aucacaccacugcacuccagucugggcaccag

SEQ ID NO: 331996 - RNA, 23 nt, Human
aucacaccacugcacuccaucca

SEQ ID NO: 331997 - RNA, 32 nt, Human
aucacaccacugcacuccauccagccugggug

SEQ ID NO: 331998 - RNA, 32 nt, Human
aucacaccacugcacuccggccugggcgacag

SEQ ID NO: 331999 - RNA, 22 nt, Human
aucacaccacugcacucuagcc

SEQ ID NO: 332000 - RNA, 32 nt, Human
aucacaccacugcacucuagccugggcaacag

SEQ ID NO: 332001 - RNA, 32 nt, Human
aucacaccacugcacucuagccugggugacag

SEQ ID NO: 332002 - RNA, 22 nt, Human
aucacaccacugcacucuggcc

SEQ ID NO: 332003 - RNA, 22 nt, Human
aucacaccacugcacuguagcc

SEQ ID NO: 332004 - RNA, 22 nt, Human
aucacaccacugcacuucagcc

SEQ ID NO: 332005 - RNA, 32 nt, Human
aucacaccacugcacuucagccuggaugacag

SEQ ID NO: 332006 - RNA, 32 nt, Human
aucacaccacugcacuucagccugggcaacag

SEQ ID NO: 332007 - RNA, 32 nt, Human
aucacaccacugcacuucauccuaggcaacag

SEQ ID NO: 332008 - RNA, 22 nt, Human
aucacaccacugcauuccagcc

SEQ ID NO: 332009 - RNA, 32 nt, Human
aucacaccacugcauuccagccugggcacuag

SEQ ID NO: 332010 - RNA, 32 nt, Human
aucacaccacugcauuccagccugggugacag

SEQ ID NO: 332011 - RNA, 32 nt, Human
aucacaccacugcauucccgccugggcagcag

SEQ ID NO: 332012 - RNA, 32 nt, Human
aucacaccacugcauucuggccugggugacag

SEQ ID NO: 332013 - RNA, 32 nt, Human
aucacaccacugcgcucuagccuggacaacaa

SEQ ID NO: 332014 - RNA, 32 nt, Human
aucacaccacugcgcucuagccugggcaacaa

SEQ ID NO: 332015 - RNA, 23 nt, Human
aucacaccacuggcacuccagcc

SEQ ID NO: 332016 - RNA, 32 nt, Human
aucacaccacuggcacuccagccugggcaaca

SEQ ID NO: 332017 - RNA, 22 nt, Human
aucacaccacuguacuccagcc

SEQ ID NO: 332018 - RNA, 32 nt, Human
aucacaccacuguacuccagcccggcacucca

SEQ ID NO: 332019 - RNA, 32 nt, Human
aucacaccacuguacuccagccugagugacaa

SEQ ID NO: 332020 - RNA, 32 nt, Human
aucacaccacuguacuccagccuggaugacag

SEQ ID NO: 332021 - RNA, 32 nt, Human
aucacaccacuguacuccagccugggcaacag

SEQ ID NO: 332022 - RNA, 32 nt, Human
aucacaccacuguacuccagccugggugacaa

SEQ ID NO: 332023 - RNA, 32 nt, Human
aucacaccacuguacuccagccuggugacaga

SEQ ID NO: 332024 - RNA, 22 nt, Human
aucacaccacuguauuccagcc

SEQ ID NO: 332025 - RNA, 32 nt, Human
aucacaccacuguauuccagccugggugacug

SEQ ID NO: 332026 - RNA, 32 nt, Human
aucacaccacugugcucuagccuggacaacaa

SEQ ID NO: 332027 - RNA, 32 nt, Human
aucacaccagccuaaccaacaugaugaaacuc

SEQ ID NO: 332028 - RNA, 22 nt, Human
aucacaccaguacacuccagcc

SEQ ID NO: 332029 - RNA, 22 nt, Human
aucacaccagugcacuccagcc

SEQ ID NO: 332030 - RNA, 32 nt, Human
aucacaccagugcacuccagccugggcgacag

SEQ ID NO: 332031 - RNA, 32 nt, Human
aucacaccaucgcacuccagccuaggcaacaa

SEQ ID NO: 332032 - RNA, 32 nt, Human
aucacaccauugcacuccaaccugggcaacaa

SEQ ID NO: 332033 - RNA, 22 nt, Human
aucacaccauugcacuccagcc

SEQ ID NO: 332034 - RNA, 32 nt, Human
aucacaccauugcacuccagccuagauaacaa

SEQ ID NO: 332035 - RNA, 32 nt, Human
aucacaccauugcacuccagccuaggcaacaa

SEQ ID NO: 332036 - RNA, 32 nt, Human
aucacaccauugcacuccagccuaggcauggu

SEQ ID NO: 332037 - RNA, 32 nt, Human
aucacaccauugcacuccagccugagcaacag

SEQ ID NO: 332038 - RNA, 32 nt, Human
aucacaccauugcacuccagccugggaaacaa

SEQ ID NO: 332039 - RNA, 32 nt, Human
aucacaccauugcacuccagccugggcaaaaa

SEQ ID NO: 332040 - RNA, 32 nt, Human
aucacaccauugcacuccagccugggcaacaa

SEQ ID NO: 332041 - RNA, 32 nt, Human
aucacaccauugcacuccagccugggcaacag

SEQ ID NO: 332042 - RNA, 32 nt, Human
aucacaccauugcacuccagccugggcgacaa

SEQ ID NO: 332043 - RNA, 32 nt, Human
aucacaccauugcacuccagccugggcgacag

SEQ ID NO: 332044 - RNA, 32 nt, Human
aucacaccauugcacuccagcuugggcaacaa

SEQ ID NO: 332045 - RNA, 32 nt, Human
aucacaccauugcacugcagccugggugaaga

SEQ ID NO: 332046 - RNA, 32 nt, Human
aucacaccauugcacuucagccugggcgacac

SEQ ID NO: 332047 - RNA, 22 nt, Human
aucacaccauugcccuccagcc

SEQ ID NO: 332048 - RNA, 32 nt, Human
aucacaccauugcccuccagccugggugacag

SEQ ID NO: 332049 - RNA, 32 nt, Human
aucacaccauugcgcuucagccugggcaacaa

SEQ ID NO: 332050 - RNA, 32 nt, Human
aucacaccauugcuguccagccugggugacag

SEQ ID NO: 332051 - RNA, 32 nt, Human
aucacaccauuuccuguuucuuuauaacccga

SEQ ID NO: 332052 - RNA, 32 nt, Human
aucacaccgcugcacucaagccugggugacag

SEQ ID NO: 332053 - RNA, 21 nt, Human
aucacaccguccuccacgcca

SEQ ID NO: 332054 - RNA, 32 nt, Human
aucacaccucacugcagccucaaucuuagcug

SEQ ID NO: 332055 - RNA, 32 nt, Human
aucacaccucacugcagccuuggccucucagg

SEQ ID NO: 332056 - RNA, 32 nt, Human
aucacaccuccaggcgccucugguuggacauu

SEQ ID NO: 332057 - RNA, 32 nt, Human
aucacaccugacugcacuccagccuggguggc

SEQ ID NO: 332058 - RNA, 32 nt, Human
aucacaccugcaaucccagcacuuugggaggc

SEQ ID NO: 332059 - RNA, 32 nt, Human
aucacaccuggaugaacuaucacuuucaaaug

SEQ ID NO: 332060 - RNA, 32 nt, Human
aucacaccuggucaacuuucuuuugauuagug

SEQ ID NO: 332061 - RNA, 32 nt, Human
aucacaccuguaaucccagcacuuugggaggc

SEQ ID NO: 332062 - RNA, 32 nt, Human
aucacaccuguaaucccagcacuuugggaggu

SEQ ID NO: 332063 - RNA, 32 nt, Human
aucacaccuguaaucccagcacuuugggauua

SEQ ID NO: 332064 - RNA, 30 nt, Human
aucacaccugugaguggcucccagcacuuu

SEQ ID NO: 332065 - RNA, 32 nt, Human
aucacacgccacugcacuccagccugggugac

SEQ ID NO: 332066 - RNA, 32 nt, Human
aucacacuacugcacuccagccugggcaacag

SEQ ID NO: 332067 - RNA, 32 nt, Human
aucacacuacugcacuccagccugggcgacaa

SEQ ID NO: 332068 - RNA, 32 nt, Human
aucacacuacugcacuccugcaugggcgacug

SEQ ID NO: 332069 - RNA, 32 nt, Human
aucacacuacugcauuccagccugagcaacag

SEQ ID NO: 332070 - RNA, 32 nt, Human
aucacacuauugcacuccagccugggcgacag

SEQ ID NO: 332071 - RNA, 32 nt, Human
aucacacuccagccuaggcgacagagugagac

SEQ ID NO: 332072 - RNA, 32 nt, Human
aucacacuccugccuuaacugcucugaguaug

SEQ ID NO: 332073 - RNA, 32 nt, Human
aucacacugccgcacugaagccuggaugacag

SEQ ID NO: 332074 - RNA, 28 nt, Human
aucacacugugcccugcaccucccacca

SEQ ID NO: 332075 - RNA, 32 nt, Human
aucacacugugcccugcaccucccaccaaggg

SEQ ID NO: 332076 - RNA, 32 nt, Human
aucacacuuuggcuuugauucuggguggguac

SEQ ID NO: 332077 - RNA, 32 nt, Human
aucacagaaagugggagcuuggaggaucccuc

SEQ ID NO: 332078 - RNA, 32 nt, Human
aucacagaagagucucuacagagaugugaugc

SEQ ID NO: 332079 - RNA, 32 nt, Human
aucacagacagccucuuuaugagguuuucuaa

SEQ ID NO: 332080 - RNA, 32 nt, Human
aucacagacccaccacacagcccagcagcccu

SEQ ID NO: 332081 - RNA, 32 nt, Human
aucacagagauggacaguuacaauuuauugcu

SEQ ID NO: 332082 - RNA, 32 nt, Human
aucacagagccagaagccagagggccagggau

SEQ ID NO: 332083 - RNA, 21 nt, Human
aucacagagcccuucuuggua

SEQ ID NO: 332084 - RNA, 32 nt, Human
aucacagaggacuugaucuauuucucagguua

SEQ ID NO: 332085 - RNA, 32 nt, Human
aucacagagugucaggaugcagcugggcaccu

SEQ ID NO: 332086 - RNA, 19 nt, Human
aucacagaugcaacuucuu

SEQ ID NO: 332087 - RNA, 32 nt, Human
aucacagcacauuuauaaaagauguguguuuc

SEQ ID NO: 332088 - RNA, 32 nt, Human
aucacagcauuuuuaaagcuuucccucaaaaa

SEQ ID NO: 332089 - RNA, 32 nt, Human
aucacagccaggcggcauucccugccacagug

SEQ ID NO: 332090 - RNA, 32 nt, Human
aucacagcccgccugcacuccugagggccccu

SEQ ID NO: 332091 - RNA, 32 nt, Human
aucacagcgcugugggagaagcuucuagaagg

SEQ ID NO: 332092 - RNA, 32 nt, Human
aucacagcuacucaggagacugaagcaggaga

SEQ ID NO: 332093 - RNA, 32 nt, Human
aucacagcucacagcaacuucaaacuccugag

SEQ ID NO: 332094 - RNA, 32 nt, Human
aucacagcucacugcaaccucaaacuccuggg

SEQ ID NO: 332095 - RNA, 32 nt, Human
aucacagcucacugcaaccucaauccugggcu

SEQ ID NO: 332096 - RNA, 32 nt, Human
aucacagcucacugcaaccucuacucccaggc

SEQ ID NO: 332097 - RNA, 32 nt, Human
aucacagcucacugcaaccuuacuccuaggcu

SEQ ID NO: 332098 - RNA, 32 nt, Human
aucacagcucacugcagcccugaacuccuggg

SEQ ID NO: 332099 - RNA, 32 nt, Human
aucacagcucacugcagccucaaacuccuggg

SEQ ID NO: 332100 - RNA, 32 nt, Human
aucacagcucacugcagccucaaccucugaag

SEQ ID NO: 332101 - RNA, 32 nt, Human
aucacagcucacugcagccucaaccuggguuc

SEQ ID NO: 332102 - RNA, 32 nt, Human
aucacagcucacugcagccuccaccuccuggg

SEQ ID NO: 332103 - RNA, 32 nt, Human
aucacagcucacugcagccuccaucuccuagg

SEQ ID NO: 332104 - RNA, 32 nt, Human
aucacagcucacugcagccucgaccuccugcg

SEQ ID NO: 332105 - RNA, 32 nt, Human
aucacagcucacugcagccucgaccuccugga

SEQ ID NO: 332106 - RNA, 32 nt, Human
aucacagcucacugcagccucgaccuccuggg

SEQ ID NO: 332107 - RNA, 32 nt, Human
aucacagcucacugcagccucgacuucccagg

SEQ ID NO: 332108 - RNA, 32 nt, Human
aucacagcucacugcagccuggaccuccuggc

SEQ ID NO: 332109 - RNA, 32 nt, Human
aucacagcucacugcagccuugaacugugcug

SEQ ID NO: 332110 - RNA, 32 nt, Human
aucacagcucacugcagccuugaccucccggg

SEQ ID NO: 332111 - RNA, 32 nt, Human
aucacagcucacugcagccuugaccuccuggg

SEQ ID NO: 332112 - RNA, 32 nt, Human
aucacagcucacugcagccuugagcuccuggg

SEQ ID NO: 332113 - RNA, 32 nt, Human
aucacagcucacugcagccuuguccucccagg

SEQ ID NO: 332114 - RNA, 32 nt, Human
aucacagcucacugcagguucagccuucugag

SEQ ID NO: 332115 - RNA, 32 nt, Human
aucacagcucacugcagucucgaacuccugga

SEQ ID NO: 332116 - RNA, 32 nt, Human
aucacagcucacugcugccucgaccuccguca

SEQ ID NO: 332117 - RNA, 32 nt, Human
aucacagcucacuguagccucuaacucccagg

SEQ ID NO: 332118 - RNA, 32 nt, Human
aucacagcucacuguagccuugaucuccuggg

SEQ ID NO: 332119 - RNA, 32 nt, Human
aucacagcuggcaucuggaggaagggccaaca

SEQ ID NO: 332120 - RNA, 32 nt, Human
aucacagcuguuacucacugagcaccagccag

SEQ ID NO: 332121 - RNA, 32 nt, Human
aucacagcuucaggaagccuucucaagugugc

SEQ ID NO: 332122 - RNA, 32 nt, Human
aucacagcuuuuccuggggcuggugagucugu

SEQ ID NO: 332123 - RNA, 32 nt, Human
aucacaggagccacugcacuccagccugggug

SEQ ID NO: 332124 - RNA, 32 nt, Human
aucacaggaggguaaaucuuugcuggaguuau

SEQ ID NO: 332125 - RNA, 32 nt, Human
aucacaggcaugagccaccgaacccagccuua

SEQ ID NO: 332126 - RNA, 32 nt, Human
aucacaggcaugagccacugugcccagccacg

SEQ ID NO: 332127 - RNA, 32 nt, Human
aucacaggccuggguggguggguugggggaag

SEQ ID NO: 332128 - RNA, 32 nt, Human
aucacaggcgccagccacugcgcccggcccag

SEQ ID NO: 332129 - RNA, 32 nt, Human
aucacaggcgugagccaccgcacccagccuuu

SEQ ID NO: 332130 - RNA, 32 nt, Human
aucacaggcgugagccaccgcauccggccuca

SEQ ID NO: 332131 - RNA, 32 nt, Human
aucacaggcgugagccaccgugcccggccucc

SEQ ID NO: 332132 - RNA, 32 nt, Human
aucacaggcgugagccacugcgcccagcccac

SEQ ID NO: 332133 - RNA, 32 nt, Human
aucacaggcgugagcuaucacaccuggcccca

SEQ ID NO: 332134 - RNA, 32 nt, Human
aucacaggcugcaggcuagagggggcaguuau

SEQ ID NO: 332135 - RNA, 32 nt, Human
aucacaggcuuagggacggcacuaacuuucuc

SEQ ID NO: 332136 - RNA, 32 nt, Human
aucacagggcccucggugaagcagaaaggcgg

SEQ ID NO: 332137 - RNA, 32 nt, Human
aucacaggggagggaauuaggagcagggcagc

SEQ ID NO: 332138 - RNA, 32 nt, Human
aucacaggggugagccaccgcgcccagcccuc

SEQ ID NO: 332139 - RNA, 32 nt, Human
aucacaggguguacaaucucugccuuccaggu

SEQ ID NO: 332140 - RNA, 32 nt, Human
aucacaggucacugcagcccugaccuccuggg

SEQ ID NO: 332141 - RNA, 32 nt, Human
aucacaggugggagccacugugccuggccagu

SEQ ID NO: 332142 - RNA, 32 nt, Human
aucacaggugugcaccaccaugcccagcuaau

SEQ ID NO: 332143 - RNA, 32 nt, Human
aucacagguuacguguucuguucuaugccuaa

SEQ ID NO: 332144 - RNA, 31 nt, Human
aucacagguuacuagaauacacauuugcugu

SEQ ID NO: 332145 - RNA, 32 nt, Human
aucacagugaaacacaacacaaaaggccauaa

SEQ ID NO: 332146 - RNA, 32 nt, Human
aucacagugauuugucaugaaaagccauauau

SEQ ID NO: 332147 - RNA, 32 nt, Human
aucacagugcccaugccauacaugccaguugg

SEQ ID NO: 332148 - RNA, 32 nt, Human
aucacagugcuguuuuuaaugccugagaaaug

SEQ ID NO: 332149 - RNA, 32 nt, Human
aucacaguggggcacgaaggaggaggccauuc

SEQ ID NO: 332150 - RNA, 32 nt, Human
aucacaguuacaaaagcgacagucuucuauuu

SEQ ID NO: 332151 - RNA, 32 nt, Human
aucacaguucacugcagccucaaccucuccag

SEQ ID NO: 332152 - RNA, 32 nt, Human
aucacaguucuuuccucuuucugcucugccau

SEQ ID NO: 332153 - RNA, 32 nt, Human
aucacaguugacugacagcuccugggguucau

SEQ ID NO: 332154 - RNA, 32 nt, Human
aucacaguuggccacucagcugugcugaguag

SEQ ID NO: 332155 - RNA, 32 nt, Human
aucacaguuuaccaccaccaacuaugucacag

SEQ ID NO: 332156 - RNA, 32 nt, Human
aucacaguuucugcucuucagaaguuucaccc

SEQ ID NO: 332157 - RNA, 32 nt, Human
aucacaguuuuuccuggaauugccagcugaca

SEQ ID NO: 332158 - RNA, 23 nt, Human
aucacauacggaggucuugugua

SEQ ID NO: 332159 - RNA, 32 nt, Human
aucacaucaaggagucaggggaaagugacugg

SEQ ID NO: 332160 - RNA, 32 nt, Human
aucacaucacugcacuccagccuggguaacag

SEQ ID NO: 332161 - RNA, 32 nt, Human
aucacaucacugcacuccauccugggugacag

SEQ ID NO: 332162 - RNA, 32 nt, Human
aucacaucacugcaguccagccugggugacag

SEQ ID NO: 332163 - RNA, 32 nt, Human
aucacaucacuuccauggcauggauguucaca

SEQ ID NO: 332164 - RNA, 32 nt, Human
aucacaucccaaagcuucagcaucaaaaauac

SEQ ID NO: 332165 - RNA, 32 nt, Human
aucacaugaacccaggagguugaagcugcggu

SEQ ID NO: 332166 - RNA, 32 nt, Human
aucacaugaauccaggagguggagguugcagu

SEQ ID NO: 332167 - RNA, 32 nt, Human
aucacaugagcccaggagguugaggcugcagu

SEQ ID NO: 332168 - RNA, 32 nt, Human
aucacaugcucaaugacucucuggugagcgag

SEQ ID NO: 332169 - RNA, 32 nt, Human
aucacauguaccacugcugcuuugauggagcu

SEQ ID NO: 332170 - RNA, 32 nt, Human
aucacauuaaaauguuguaaaacagcaaagcu

SEQ ID NO: 332171 - RNA, 32 nt, Human
aucacauucaccucuaccuccaccaucaccau

SEQ ID NO: 332172 - RNA, 32 nt, Human
aucacauuccuagcccacucucaucauuacug

SEQ ID NO: 332173 - RNA, 32 nt, Human
aucacauucuuuuagauuuagacaucucugag

SEQ ID NO: 332174 - RNA, 32 nt, Human
aucacauuguugaguuauaccugugaugggcu

SEQ ID NO: 332175 - RNA, 32 nt, Human
aucacauuucaaauucacccuacauuccucuc

SEQ ID NO: 332176 - RNA, 32 nt, Human
aucacauuuucagucuguaaauuuuucaaacu

SEQ ID NO: 332177 - RNA, 32 nt, Human
aucaccaaaaagcaaccaacuuagccagcuuu

SEQ ID NO: 332178 - RNA, 32 nt, Human
aucaccaaaaagcaaccaacuuagccaguuuu

SEQ ID NO: 332179 - RNA, 32 nt, Human
aucaccaaaagacgaggcggcaaagauccagc

SEQ ID NO: 332180 - RNA, 32 nt, Human
aucaccaaaggccaggaguuugaggcugcagu

SEQ ID NO: 332181 - RNA, 32 nt, Human
aucaccaacaugagcuuccccuuguccgacca

SEQ ID NO: 332182 - RNA, 32 nt, Human
aucaccaagcaugcaccaaacacugcuuuagg

SEQ ID NO: 332183 - RNA, 32 nt, Human
aucaccaagggugggaugggagggcagagggg

SEQ ID NO: 332184 - RNA, 32 nt, Human
aucaccaagggugggaugggagggcaggggaa

SEQ ID NO: 332185 - RNA, 32 nt, Human
aucaccaaguuugugaguucucaucaaggguu

SEQ ID NO: 332186 - RNA, 32 nt, Human
aucaccaaucauaguguacccaucuuuaauuu

SEQ ID NO: 332187 - RNA, 32 nt, Human
aucaccacaaauauaucuggcugaucagguug

SEQ ID NO: 332188 - RNA, 32 nt, Human
aucaccacacugucuuccgcaguggcugaacu

SEQ ID NO: 332189 - RNA, 32 nt, Human
aucaccacaugccuucacuccagaguguucuc

SEQ ID NO: 332190 - RNA, 32 nt, Human
aucaccaccaacaacagcagcagcagcagcca

SEQ ID NO: 332191 - RNA, 21 nt, Human
aucaccaccauaccaagguca

SEQ ID NO: 332192 - RNA, 32 nt, Human
aucaccaccuuccaucaucauaacucuuuuca

SEQ ID NO: 332193 - RNA, 32 nt, Human
aucaccaccuugucaccaacaggaugauguca

SEQ ID NO: 332194 - RNA, 32 nt, Human
aucaccacucacugcggccucaaccuucaggg

SEQ ID NO: 332195 - RNA, 19 nt, Human
aucaccacuguccaaggca

SEQ ID NO: 332196 - RNA, 32 nt, Human
aucaccagacaaccccaggcggaaguggcggu

SEQ ID NO: 332197 - RNA, 32 nt, Human
aucaccagagccaccaagccugccagaggggu

SEQ ID NO: 332198 - RNA, 32 nt, Human
aucaccagcaagcucugcuccucauucggggg

SEQ ID NO: 332199 - RNA, 32 nt, Human
aucaccagccugggcgacagagugagacuccu

SEQ ID NO: 332200 - RNA, 32 nt, Human
aucaccaggauggaacacaggucuugcaggau

SEQ ID NO: 332201 - RNA, 32 nt, Human
aucaccaggcuggagugcaguggugcgauguu

SEQ ID NO: 332202 - RNA, 32 nt, Human
aucaccaggugcaggcccccacccucggagau

SEQ ID NO: 332203 - RNA, 32 nt, Human
aucaccaggugggagugcaguggcacaaucuc

SEQ ID NO: 332204 - RNA, 32 nt, Human
aucaccaguucugccacccucggcccucccug

SEQ ID NO: 332205 - RNA, 17 nt, Human
aucaccaucaccaccaa

SEQ ID NO: 332206 - RNA, 22 nt, Human
aucaccaucaccaccagcagca

SEQ ID NO: 332207 - RNA, 31 nt, Human
aucaccaucacuacucaaguuggagaaauag

SEQ ID NO: 332208 - RNA, 32 nt, Human
aucaccaucugucaucucacuaccaccaugcu

SEQ ID NO: 332209 - RNA, 32 nt, Human
aucaccaugacugcugucagccuggaucgaua

SEQ ID NO: 332210 - RNA, 32 nt, Human
aucaccauuuauucauaccuacucugaaugac

SEQ ID NO: 332211 - RNA, 32 nt, Human
aucaccauuucuaacagaugccuguggcauug

SEQ ID NO: 332212 - RNA, 32 nt, Human
aucacccacaaacccacccugugcccacccuc

SEQ ID NO: 332213 - RNA, 32 nt, Human
aucacccacugcacuggccuugcucucccgca

SEQ ID NO: 332214 - RNA, 32 nt, Human
aucacccagcucugagugguuggugggaccuc

SEQ ID NO: 332215 - RNA, 19 nt, Human
aucacccagggugcagcca

SEQ ID NO: 332216 - RNA, 32 nt, Human
aucacccauacccacacauacaucuaguaugu

SEQ ID NO: 332217 - RNA, 32 nt, Human
aucaccccacugcauuccagccugggugacag

SEQ ID NO: 332218 - RNA, 32 nt, Human
aucaccccacuguccuccagccugggcaacag

SEQ ID NO: 332219 - RNA, 32 nt, Human
aucaccccagaagagaguacaggagccaggau

SEQ ID NO: 332220 - RNA, 32 nt, Human
aucaccccagagaaauuucuggaaucugauug

SEQ ID NO: 332221 - RNA, 32 nt, Human
aucaccccauugcacuccagccuggacaacaa

SEQ ID NO: 332222 - RNA, 32 nt, Human
aucaccccauuucacuccagccugggcgacaa

SEQ ID NO: 332223 - RNA, 32 nt, Human
aucaccccuccccucuucccucccccucaucc

SEQ ID NO: 332224 - RNA, 32 nt, Human
aucaccccugagcaucccucuggacucagagg

SEQ ID NO: 332225 - RNA, 32 nt, Human
aucaccccuuccuccuuccucuucucaaaaug

SEQ ID NO: 332226 - RNA, 32 nt, Human
aucacccuacuucccugaggcugcugaggucg

SEQ ID NO: 332227 - RNA, 32 nt, Human
aucacccuccuccucugcccagaccugggggc

SEQ ID NO: 332228 - RNA, 32 nt, Human
aucacccucugucaacaaccauggggaagauc

SEQ ID NO: 332229 - RNA, 32 nt, Human
aucacccucuucagacuggagucagugggaac

SEQ ID NO: 332230 - RNA, 32 nt, Human
aucacccugcuccccuacugcauuccuuugug

SEQ ID NO: 332231 - RNA, 22 nt, Human
aucacccugcucuccugcuaca

SEQ ID NO: 332232 - RNA, 32 nt, Human
aucacccuuccuggucuacagauggaagcugc

SEQ ID NO: 332233 - RNA, 32 nt, Human
aucaccgaauggcagagauugguguggggauc

SEQ ID NO: 332234 - RNA, 32 nt, Human
aucaccgacuggcuggagucaucuuccugccc

SEQ ID NO: 332235 - RNA, 32 nt, Human
aucaccgcaagaacaaguuccaguguggcuuu

SEQ ID NO: 332236 - RNA, 32 nt, Human
aucaccgccacugccaccccucccagacugug

SEQ ID NO: 332237 - RNA, 32 nt, Human
aucaccgccaugagccucuuugcgagugaccu

SEQ ID NO: 332238 - RNA, 21 nt, Human
aucaccuaaacugucuuccaa

SEQ ID NO: 332239 - RNA, 32 nt, Human
aucaccuaaggccaggaggucaaggcugcggu

SEQ ID NO: 332240 - RNA, 32 nt, Human
aucaccuacaaacucucacacgcccuagaaga

SEQ ID NO: 332241 - RNA, 32 nt, Human
aucaccuacucuccacuaauagaugcuaugcu

SEQ ID NO: 332242 - RNA, 32 nt, Human
aucaccucacugcacgcuagccugggcaacag

SEQ ID NO: 332243 - RNA, 32 nt, Human
aucaccuccaccauacuccaucaguuagagcu

SEQ ID NO: 332244 - RNA, 32 nt, Human
aucaccuccagccugacucccugucugcccuu

SEQ ID NO: 332245 - RNA, 32 nt, Human
aucaccuccaucucugcaaauacagcccgagg

SEQ ID NO: 332246 - RNA, 32 nt, Human
aucaccucucugcuuagccacuggcuuaaacu

SEQ ID NO: 332247 - RNA, 32 nt, Human
aucaccucugagacccaacuugcucauaaaca

SEQ ID NO: 332248 - RNA, 32 nt, Human
aucaccucugcgggacucgggugcaggaaggg

SEQ ID NO: 332249 - RNA, 29 nt, Human
aucaccucuggccucucaucccccacucu

SEQ ID NO: 332250 - RNA, 32 nt, Human
aucaccucugggacugugccuugcucaccgaa

SEQ ID NO: 332251 - RNA, 32 nt, Human
aucaccucuguaauuuuucagcucucuguaua

SEQ ID NO: 332252 - RNA, 32 nt, Human
  misc_feature (27)..(27): n is a, c, g or u
aucaccucuugaaccaggacccuucanacaua

SEQ ID NO: 332253 - RNA, 32 nt, Human
aucaccugaacccaggaggcagagguugcagu

SEQ ID NO: 332254 - RNA, 32 nt, Human
aucaccugaccuucuccaggacugucuucuca

SEQ ID NO: 332255 - RNA, 32 nt, Human
aucaccugagauugggaguucgagaccagccu

SEQ ID NO: 332256 - RNA, 32 nt, Human
aucaccugagcccaggagguggaggcugcagu

SEQ ID NO: 332257 - RNA, 32 nt, Human
aucaccugagccugggaaguggagguugcagu

SEQ ID NO: 332258 - RNA, 32 nt, Human
aucaccugagccugggaggcugaggcgggaga

SEQ ID NO: 332259 - RNA, 32 nt, Human
aucaccugagccugggaggucgaggcugcagc

SEQ ID NO: 332260 - RNA, 32 nt, Human
aucaccugaggccaggaagaccagccuggcca

SEQ ID NO: 332261 - RNA, 32 nt, Human
aucaccugagguauggcaaacauggugaaacg

SEQ ID NO: 332262 - RNA, 32 nt, Human
aucaccugaggucagcaguuugagacuagccu

SEQ ID NO: 332263 - RNA, 32 nt, Human
aucaccugaggucaggaguuugagacuagccu

SEQ ID NO: 332264 - RNA, 32 nt, Human
aucaccugaguccaggaggucgaggcugcagu

SEQ ID NO: 332265 - RNA, 26 nt, Human
aucaccugcugagccaguuucccugg

SEQ ID NO: 332266 - RNA, 32 nt, Human
aucaccugcugccccgcagaccccugucccuu

SEQ ID NO: 332267 - RNA, 32 nt, Human
aucaccugcuguaugccgaucaucucagaaag

SEQ ID NO: 332268 - RNA, 32 nt, Human
aucaccugggccacugcaaagacuucacuggg

SEQ ID NO: 332269 - RNA, 32 nt, Human
aucaccugggcuggagugcgauggcaugaucu

SEQ ID NO: 332270 - RNA, 32 nt, Human
aucaccuggggucaggaguucaagaccagccu

SEQ ID NO: 332271 - RNA, 28 nt, Human
aucaccuggggugcugccucucacacau

SEQ ID NO: 332272 - RNA, 32 nt, Human
aucaccugugcugcuuuccuccaccuucuccg

SEQ ID NO: 332273 - RNA, 32 nt, Human
aucaccuuaccaucagagcagugcagugcucu

SEQ ID NO: 332274 - RNA, 32 nt, Human
aucaccuugucaagggcucuguuuacaucuau

SEQ ID NO: 332275 - RNA, 32 nt, Human
aucaccuuuggugggggcagggccugguggca

SEQ ID NO: 332276 - RNA, 32 nt, Human
aucacgacacugcacuccagccugggcaacgg

SEQ ID NO: 332277 - RNA, 32 nt, Human
aucacgaccauccuggcuaacauggugguacc

SEQ ID NO: 332278 - RNA, 32 nt, Human
aucacgagccacuuccacuccuggguggccug

SEQ ID NO: 332279 - RNA, 32 nt, Human
aucacgauccugcacuccagccugggcaacag

SEQ ID NO: 332280 - RNA, 22 nt, Human
aucacgccacagcacuccagcc

SEQ ID NO: 332281 - RNA, 32 nt, Human
aucacgccacagcacuccagccugggcgacag

SEQ ID NO: 332282 - RNA, 32 nt, Human
auccugggagagcaaggagccagcaagucuag

SEQ ID NO: 332283 - RNA, 32 nt, Human
auccugggagcaaggcccugcagcuccacgag

SEQ ID NO: 332284 - RNA, 32 nt, Human
auccugggaggcagagguuguagugagccgag

SEQ ID NO: 332285 - RNA, 32 nt, Human
auccugggagggaggacuagaggcucaggggg

SEQ ID NO: 332286 - RNA, 32 nt, Human
auccugggaggugggagcuggaauggggagca

SEQ ID NO: 332287 - RNA, 32 nt, Human
auccugggcaagucacuuaaccucuuuaggcc

SEQ ID NO: 332288 - RNA, 32 nt, Human
auccugggcucaagugauccuccugccugggc

SEQ ID NO: 332289 - RNA, 32 nt, Human
auccugggcucccucuugauuaguaggugaca

SEQ ID NO: 332290 - RNA, 32 nt, Human
auccugggcucugagcuaggugcauugcucug

SEQ ID NO: 332291 - RNA, 32 nt, Human
auccuggggagaauggaggagcacacagaggc

SEQ ID NO: 332292 - RNA, 32 nt, Human
auccuggggccccagcucuggguccucaugua

SEQ ID NO: 332293 - RNA, 32 nt, Human
auccuggggcucccuucaucuccagggagucc

SEQ ID NO: 332294 - RNA, 32 nt, Human
auccugggggacccaauguaggagcugccuug

SEQ ID NO: 332295 - RNA, 32 nt, Human
auccuggguagauagagcagggcagcgacgga

SEQ ID NO: 332296 - RNA, 32 nt, Human
auccuggguggguggagcuggggagggcaugg

SEQ ID NO: 332297 - RNA, 32 nt, Human
auccuggguguacaguggugaaauggggagug

SEQ ID NO: 332298 - RNA, 32 nt, Human
auccugggugucucugagacccaucuccugcc

SEQ ID NO: 332299 - RNA, 32 nt, Human
auccuggguuccaaaggggcagguaauggcaa

SEQ ID NO: 332300 - RNA, 32 nt, Human
auccugguaguuuaaaugugccugauucaucu

SEQ ID NO: 332301 - RNA, 32 nt, Human
auccuggucagcugccccaaugugaccugggg

SEQ ID NO: 332302 - RNA, 32 nt, Human
auccuggucauuuaaaugugccugauucaucu

SEQ ID NO: 332303 - RNA, 32 nt, Human
auccuggucuacaaccuggucuauguggagaa

SEQ ID NO: 332304 - RNA, 32 nt, Human
auccuggugaagccacacccagccggccuggu

SEQ ID NO: 332305 - RNA, 29 nt, Human
auccuggugguucuuacaucccccucugc

SEQ ID NO: 332306 - RNA, 32 nt, Human
auccugguguuucucuguaucuucucacuucu

SEQ ID NO: 332307 - RNA, 32 nt, Human
auccugguuaccacucuuuuacugugcacaua

SEQ ID NO: 332308 - RNA, 32 nt, Human
auccugguucacugcacccucugccucccagg

SEQ ID NO: 332309 - RNA, 24 nt, Human
auccugguuucugaagacacaucc

SEQ ID NO: 332310 - RNA, 32 nt, Human
auccuguaagucuaaggauggcacaauggcaa

SEQ ID NO: 332311 - RNA, 32 nt, Human
auccuguacaagugcucaguuccaaugugccc

SEQ ID NO: 332312 - RNA, 32 nt, Human
auccuguccacucagaguucugagggggccag

SEQ ID NO: 332313 - RNA, 32 nt, Human
auccugucccacagcccugccuggauuuguau

SEQ ID NO: 332314 - RNA, 32 nt, Human
auccugucuguuccuguucuucucccagccuc

SEQ ID NO: 332315 - RNA, 32 nt, Human
auccugucuuccacggcucuccugucccaccu

SEQ ID NO: 332316 - RNA, 32 nt, Human
auccugucuucuucugugcugccugguuugac

SEQ ID NO: 332317 - RNA, 32 nt, Human
auccugucuugggaacuacuccaccucacugu

SEQ ID NO: 332318 - RNA, 32 nt, Human
auccugucuuugggggcaaugugucaaaaguc

SEQ ID NO: 332319 - RNA, 20 nt, Human
auccugugacuguguacugg

SEQ ID NO: 332320 - RNA, 32 nt, Human
auccugugagccuggcuccccaggagggcccc

SEQ ID NO: 332321 - RNA, 32 nt, Human
auccugugcaggggccaccugggagauagcag

SEQ ID NO: 332322 - RNA, 32 nt, Human
auccugugcaucaccauuguguccugugcucc

SEQ ID NO: 332323 - RNA, 32 nt, Human
auccugugcuugagggucuccuuuccuguucu

SEQ ID NO: 332324 - RNA, 32 nt, Human
auccuguggagggagaggagagcccagucauu

SEQ ID NO: 332325 - RNA, 32 nt, Human
auccuguggcauuauccccuggagucauauag

SEQ ID NO: 332326 - RNA, 32 nt, Human
auccugugggccacugcacaucugccucucuc

SEQ ID NO: 332327 - RNA, 32 nt, Human
auccugugugccugacagccagucugcuguaa

SEQ ID NO: 332328 - RNA, 32 nt, Human
auccuguuagucacugugguucaucaaauaaa

SEQ ID NO: 332329 - RNA, 32 nt, Human
auccuguucccauggguuuucugcaggggaag

SEQ ID NO: 332330 - RNA, 32 nt, Human
auccuguuguguuccuggagaagcuacagccu

SEQ ID NO: 332331 - RNA, 32 nt, Human
auccuguuuccucugcugacccagcugggagg

SEQ ID NO: 332332 - RNA, 32 nt, Human
auccuguuugccguuuccaccaugacugaagg

SEQ ID NO: 332333 - RNA, 32 nt, Human
auccuuaaaauacaaaugcuauaaaaauuccu

SEQ ID NO: 332334 - RNA, 32 nt, Human
auccuuaaaggauacacacaugacaggaagga

SEQ ID NO: 332335 - RNA, 32 nt, Human
auccuuaaauccugggcucugagcuaggugca

SEQ ID NO: 332336 - RNA, 32 nt, Human
auccuuaaauuuuuaugacacccuuuguaauc

SEQ ID NO: 332337 - RNA, 32 nt, Human
auccuuaacacaucugugguccagaagagcgc

SEQ ID NO: 332338 - RNA, 32 nt, Human
auccuuaaccaccgcauaugcaugccaggcug

SEQ ID NO: 332339 - RNA, 31 nt, Human
auccuuaccccuccugggccuccguuguguu

SEQ ID NO: 332340 - RNA, 32 nt, Human
auccuuagagucuauugaaacugcaaagaucc

SEQ ID NO: 332341 - RNA, 32 nt, Human
auccuuagcugaagcggggagacucacucucc

SEQ ID NO: 332342 - RNA, 32 nt, Human
auccuuaggccucccucucccuucccucuguc

SEQ ID NO: 332343 - RNA, 32 nt, Human
auccuuagguucuccccuucccccuggugccc

SEQ ID NO: 332344 - RNA, 32 nt, Human
auccuuaucacauccugcugggcaaaggccca

SEQ ID NO: 332345 - RNA, 32 nt, Human
auccuuaugcccacacugggagaggucugauu

SEQ ID NO: 332346 - RNA, 32 nt, Human
auccuuauucacucugaauguuuccccucuac

SEQ ID NO: 332347 - RNA, 32 nt, Human
auccuucagaccccuccagacauccaaucaga

SEQ ID NO: 332348 - RNA, 32 nt, Human
auccuucagcagagaggagcugacaggguacc

SEQ ID NO: 332349 - RNA, 32 nt, Human
auccuucagccugucuuguuucuucuuuaugu

SEQ ID NO: 332350 - RNA, 32 nt, Human
auccuucagccuugcuaaacugugaguucuca

SEQ ID NO: 332351 - RNA, 32 nt, Human
auccuucagggcauucugcccagcacaccuuu

SEQ ID NO: 332352 - RNA, 32 nt, Human
auccuucagguuccagucuggcuaucucuguc

SEQ ID NO: 332353 - RNA, 32 nt, Human
auccuucaguggcucucaucaccuucaggaaa

SEQ ID NO: 332354 - RNA, 32 nt, Human
auccuucauggaggccagagggccguggucua

SEQ ID NO: 332355 - RNA, 32 nt, Human
auccuucauucugaauaagauggcaguguucu

SEQ ID NO: 332356 - RNA, 32 nt, Human
auccuucauuuucugugagguaaagaagugga

SEQ ID NO: 332357 - RNA, 32 nt, Human
auccuuccacagugaccccaguuuuuauuucu

SEQ ID NO: 332358 - RNA, 32 nt, Human
auccuuccacccuugacugccaaaaaugugug

SEQ ID NO: 332359 - RNA, 32 nt, Human
auccuuccagagaagucucugggaccuuuugu

SEQ ID NO: 332360 - RNA, 22 nt, Human
auccuuccauuucuucugcaca

SEQ ID NO: 332361 - RNA, 32 nt, Human
auccuuccauuugauccucacaacagccaugu

SEQ ID NO: 332362 - RNA, 32 nt, Human
auccuucccacacuccuccaugguugcccucc

SEQ ID NO: 332363 - RNA, 32 nt, Human
auccuuccccaaagagaucucuggccuuuuac

SEQ ID NO: 332364 - RNA, 32 nt, Human
auccuuccccucaagccugggcucauggagcc

SEQ ID NO: 332365 - RNA, 32 nt, Human
auccuuccuaucucuccaugggacuagacugc

SEQ ID NO: 332366 - RNA, 32 nt, Human
auccuuccucagcacacccccaaccaauccac

SEQ ID NO: 332367 - RNA, 32 nt, Human
auccuuccucauuguggcaaggaguuucuuuc

SEQ ID NO: 332368 - RNA, 32 nt, Human
auccuuccuccaccuagcucgccaucucgccc

SEQ ID NO: 332369 - RNA, 32 nt, Human
auccuuccugcucaagguaugugugcccaugg

SEQ ID NO: 332370 - RNA, 32 nt, Human
auccuuccugugguugcuggagcugcuggcag

SEQ ID NO: 332371 - RNA, 18 nt, Human
auccuuccuucccaccca

SEQ ID NO: 332372 - RNA, 32 nt, Human
auccuucggaaggccuuccuggaaucccaccu

SEQ ID NO: 332373 - RNA, 32 nt, Human
auccuucggaguagcugggauuacaggcaggu

SEQ ID NO: 332374 - RNA, 32 nt, Human
auccuucuaaaaaggggaaauuuggacacaga

SEQ ID NO: 332375 - RNA, 32 nt, Human
auccuucuaaagugcugggauuacagguguga

SEQ ID NO: 332376 - RNA, 32 nt, Human
auccuucuaccucugcuaugcugaaccccuca

SEQ ID NO: 332377 - RNA, 32 nt, Human
auccuucucugagaccugcaccaauaagacua

SEQ ID NO: 332378 - RNA, 32 nt, Human
auccuucucugccucuuaacuccuucacgagg

SEQ ID NO: 332379 - RNA, 32 nt, Human
auccuucucuuuggacaucuucccaagaaacu

SEQ ID NO: 332380 - RNA, 32 nt, Human
auccuucugcuuguuuacaacuaugaucuucu

SEQ ID NO: 332381 - RNA, 32 nt, Human
auccuucuggaaggcauagaacacgguuacag

SEQ ID NO: 332382 - RNA, 32 nt, Human
auccuucugggcggugaaggggagaggcagcc

SEQ ID NO: 332383 - RNA, 32 nt, Human
auccuucuggggagaaguagggggaggaauau

SEQ ID NO: 332384 - RNA, 32 nt, Human
auccuucugucucuuuguuucugagcuuuccu

SEQ ID NO: 332385 - RNA, 32 nt, Human
auccuucuuacagcucuccaugaugccucaga

SEQ ID NO: 332386 - RNA, 32 nt, Human
auccuucuuagaagcuucgaacucaaaaucau

SEQ ID NO: 332387 - RNA, 32 nt, Human
auccuucuucacuuaggaagaguguugugaaa

SEQ ID NO: 332388 - RNA, 32 nt, Human
auccuucuuccucugccucccaaguagcuggg

SEQ ID NO: 332389 - RNA, 32 nt, Human
auccuucuuccucugcuguuggaugagaguga

SEQ ID NO: 332390 - RNA, 32 nt, Human
auccuucuuucuucuuuucacgauaacuuugg

SEQ ID NO: 332391 - RNA, 32 nt, Human
auccuucuuucuucuuuucaugauaaauuugu

SEQ ID NO: 332392 - RNA, 32 nt, Human
auccuugacuuagauucugguggagagaagug

SEQ ID NO: 332393 - RNA, 32 nt, Human
auccuugagcccaggagguugaggcugcagug

SEQ ID NO: 332394 - RNA, 32 nt, Human
auccuugaggccaggagguugaggcugcagug

SEQ ID NO: 332395 - RNA, 31 nt, Human
auccuugcacuuucuguuaucagggcccaaa

SEQ ID NO: 332396 - RNA, 19 nt, Human
auccuugcagcugaggagg

SEQ ID NO: 332397 - RNA, 32 nt, Human
auccuugccccaccccuugcuuccagaaaggg

SEQ ID NO: 332398 - RNA, 32 nt, Human
auccuugccugcugaacccagccugggccugg

SEQ ID NO: 332399 - RNA, 32 nt, Human
auccuugcucccaacgucuacuucuccuaccu

SEQ ID NO: 332400 - RNA, 32 nt, Human
auccuugcugcuuuauccuccuggaccuucag

SEQ ID NO: 332401 - RNA, 32 nt, Human
auccuugcuguggagcucuggaacacucucua

SEQ ID NO: 332402 - RNA, 32 nt, Human
auccuugcugugguagagguccucuacccauu

SEQ ID NO: 332403 - RNA, 31 nt, Human
auccuugcuucucuguggccugugccauggg

SEQ ID NO: 332404 - RNA, 32 nt, Human
auccuugcuucucuguggccugugccaugggg

SEQ ID NO: 332405 - RNA, 32 nt, Human
auccuuggacccacaguggagugcugguccgu

SEQ ID NO: 332406 - RNA, 32 nt, Human
auccuuggagcaguaguuuuuauacuuaugua

SEQ ID NO: 332407 - RNA, 32 nt, Human
auccuuggagcuuauguuucagacaagaauua

SEQ ID NO: 332408 - RNA, 32 nt, Human
auccuuggaggaggaggaagaggaggccacug

SEQ ID NO: 332409 - RNA, 32 nt, Human
auccuugggauuaaaguuuugguuacaaauug

SEQ ID NO: 332410 - RNA, 32 nt, Human
auccuugggcccagcuguagcggacaggugca

SEQ ID NO: 332411 - RNA, 32 nt, Human
auccuuggucacugccagcagaggucugggca

SEQ ID NO: 332412 - RNA, 32 nt, Human
auccuuguacagcaaucuccuccuccacugcc

SEQ ID NO: 332413 - RNA, 30 nt, Human
auccuuguacucuccaagcuccugucuuuc

SEQ ID NO: 332414 - RNA, 32 nt, Human
auccuugucugggucuaccaggaacgcuucau

SEQ ID NO: 332415 - RNA, 32 nt, Human
auccuuuaaacccaaggaagguggugucuauc

SEQ ID NO: 332416 - RNA, 32 nt, Human
auccuuuaagucugcuuaauuacuugaaaauu

SEQ ID NO: 332417 - RNA, 32 nt, Human
auccuuuacaauuuguaaaauucuaugaauuc

SEQ ID NO: 332418 - RNA, 32 nt, Human
auccuuuaguacaguguuuccacucuuucugc

SEQ ID NO: 332419 - RNA, 32 nt, Human
auccuuuauccagcacagcuuuaccaagcagc

SEQ ID NO: 332420 - RNA, 32 nt, Human
auccuuuauuuuuguaccauggggugggcccc

SEQ ID NO: 332421 - RNA, 32 nt, Human
auccuuucaaaccaaccaaacuacuauuagau

SEQ ID NO: 332422 - RNA, 31 nt, Human
auccuuucaauaaacaagacuuguagaaaau

SEQ ID NO: 332423 - RNA, 32 nt, Human
auccuuucaauacuugcugaacuugaaaaccu

SEQ ID NO: 332424 - RNA, 32 nt, Human
auccuuucauuucucagcucccuggauuccuu

SEQ ID NO: 332425 - RNA, 32 nt, Human
auccuuuccaccaugcucuccccuucaucaag

SEQ ID NO: 332426 - RNA, 32 nt, Human
auccuuuccucuagaagaccugagucuuccug

SEQ ID NO: 332427 - RNA, 32 nt, Human
auccuuuccugccugugcucucuccccuguuu

SEQ ID NO: 332428 - RNA, 32 nt, Human
auccuuucuaccucuggcugaaggaguggugc

SEQ ID NO: 332429 - RNA, 32 nt, Human
auccuuucuccacacagcaaugacauuuauca

SEQ ID NO: 332430 - RNA, 32 nt, Human
auccuuucuccaccauggacucaaucugagaa

SEQ ID NO: 332431 - RNA, 32 nt, Human
auccuuucuccucccucuccuuuuccugccac

SEQ ID NO: 332432 - RNA, 32 nt, Human
auccuuucuccuucugaacuagccguugcuca

SEQ ID NO: 332433 - RNA, 32 nt, Human
auccuuucugucuccagcuguuucuuggaacc

SEQ ID NO: 332434 - RNA, 32 nt, Human
auccuuugcauccuuccuccacagacauggcc

SEQ ID NO: 332435 - RNA, 32 nt, Human
auccuuugcuucauauucccuaccuggccccc

SEQ ID NO: 332436 - RNA, 32 nt, Human
auccuuuguacaaaugaaaauuacucuuaauu

SEQ ID NO: 332437 - RNA, 32 nt, Human
auccuuuuacuuuuugccccuuccacuuugag

SEQ ID NO: 332438 - RNA, 32 nt, Human
auccuuuuauauuuuucccuuccccacccccu

SEQ ID NO: 332439 - RNA, 32 nt, Human
auccuuuuaucucaguuauuugcccaucacaa

SEQ ID NO: 332440 - RNA, 32 nt, Human
auccuuuuccccucagccacugcaagcuggag

SEQ ID NO: 332441 - RNA, 32 nt, Human
auccuuuuccuucauucugucaccuuccacca

SEQ ID NO: 332442 - RNA, 32 nt, Human
auccuuuuccuugacuucucaacccagccuga

SEQ ID NO: 332443 - RNA, 32 nt, Human
auccuuuucuauuuucuugaugcuguuuacaa

SEQ ID NO: 332444 - RNA, 32 nt, Human
auccuuuugaaucucuccccugccucaccuuu

SEQ ID NO: 332445 - RNA, 32 nt, Human
aucgaaaaaccccaggccugagaaauaaagua

SEQ ID NO: 332446 - RNA, 32 nt, Human
aucgaaaacuuggagucggaggccguguucga

SEQ ID NO: 332447 - RNA, 32 nt, Human
aucgaaaagaugagcauucugggcgugcggag

SEQ ID NO: 332448 - RNA, 32 nt, Human
aucgaaacaauccuggccaacauggugaaacc

SEQ ID NO: 332449 - RNA, 32 nt, Human
aucgaaacaccguuggccgagccugggcggga

SEQ ID NO: 332450 - RNA, 32 nt, Human
aucgaaacgacagcgcuggaggagacucagga

SEQ ID NO: 332451 - RNA, 32 nt, Human
aucgaaacugagagcuccugggcaggcucggc

SEQ ID NO: 332452 - RNA, 19 nt, Human
aucgaaagggaccaagcag

SEQ ID NO: 332453 - RNA, 32 nt, Human
aucgaaaucagccuggccaagaugaugaagcc

SEQ ID NO: 332454 - RNA, 32 nt, Human
aucgaaccauuguacuccagccugggugacag

SEQ ID NO: 332455 - RNA, 22 nt, Human
aucgaacucugcacuucucucu

SEQ ID NO: 332456 - RNA, 32 nt, Human
aucgaacucugcacuucucucuccuuuacgag

SEQ ID NO: 332457 - RNA, 23 nt, Human
aucgaagacugagugacaggaau

SEQ ID NO: 332458 - RNA, 32 nt, Human
aucgaagagcaggggguugugaauuuccaggu

SEQ ID NO: 332459 - RNA, 32 nt, Human
aucgaagcuauacuugagaaaggugaaucuga

SEQ ID NO: 332460 - RNA, 32 nt, Human
aucgaaggccaggagucguggagcuccagugc

SEQ ID NO: 332461 - RNA, 32 nt, Human
aucgaaggcccaauaaauauuuguagaauaaa

SEQ ID NO: 332462 - RNA, 32 nt, Human
aucgaagugaaacauuugucucuaauacucaa

SEQ ID NO: 332463 - RNA, 32 nt, Human
aucgaauagaauagggguaaaagggaggagga

SEQ ID NO: 332464 - RNA, 32 nt, Human
aucgacaaugagcaccaccaucaaugaccacc

SEQ ID NO: 332465 - RNA, 32 nt, Human
aucgacacacaaaacagugcacauuuaguuca

SEQ ID NO: 332466 - RNA, 32 nt, Human
aucgacagcaugcuggccaacguggugaaacc

SEQ ID NO: 332467 - RNA, 32 nt, Human
aucgaccccugccucuguacccacuugaucua

SEQ ID NO: 332468 - RNA, 32 nt, Human
aucgacuuuuacagauuguggccagugaggau

SEQ ID NO: 332469 - RNA, 32 nt, Human
aucgagaacagccuggcuaacacggugaaacc

SEQ ID NO: 332470 - RNA, 32 nt, Human
aucgagacaauccuggccaacauggugaaacc

SEQ ID NO: 332471 - RNA, 32 nt, Human
aucgagaccacccuggcuaacauggugaaagc

SEQ ID NO: 332472 - RNA, 32 nt, Human
aucgagaccagccugaccaacauggugaaacc

SEQ ID NO: 332473 - RNA, 32 nt, Human
aucgagaccagccuggccaacauaguaaaacc

SEQ ID NO: 332474 - RNA, 32 nt, Human
aucgagaccagccuggccaacauggcgaaacc

SEQ ID NO: 332475 - RNA, 32 nt, Human
aucgagaccagccuggccaacauggugaaacc

SEQ ID NO: 332476 - RNA, 32 nt, Human
aucgagaccagccuggccaacguggugaaacc

SEQ ID NO: 332477 - RNA, 32 nt, Human
aucgagaccagccuggccaauauggugaaacc

SEQ ID NO: 332478 - RNA, 32 nt, Human
aucgagaccagccuggcuaacacagugaaacc

SEQ ID NO: 332479 - RNA, 32 nt, Human
aucgagaccagccuggcuaacacggugaaacc

SEQ ID NO: 332480 - RNA, 32 nt, Human
aucgagaccaucccggcuaacauggugaaacc

SEQ ID NO: 332481 - RNA, 32 nt, Human
aucgagaccauccuagccaacaucgugaaacc

SEQ ID NO: 332482 - RNA, 32 nt, Human
aucgagaccauccugcccaacauggugaaacc

SEQ ID NO: 332483 - RNA, 32 nt, Human
aucgagaccauccuggauaacacggagaaacc

SEQ ID NO: 332484 - RNA, 32 nt, Human
aucgagaccauccuggccaaaauggugaaacc

SEQ ID NO: 332485 - RNA, 32 nt, Human
aucgagaccauccuggccaacacggugaaacc

SEQ ID NO: 332486 - RNA, 32 nt, Human
aucgagaccauccuggccaacaucgugaaacc

SEQ ID NO: 332487 - RNA, 32 nt, Human
aucgagaccauccuggccaacaugaugaaacc

SEQ ID NO: 332488 - RNA, 32 nt, Human
aucgagaccauccuggccaacauggugaaaca

SEQ ID NO: 332489 - RNA, 32 nt, Human
aucgagaccauccuggccaacauggugaaacc

SEQ ID NO: 332490 - RNA, 32 nt, Human
aucgagaccauccuggccaacauuguaaaacc

SEQ ID NO: 332491 - RNA, 32 nt, Human
aucgagaccauccuggccaaccaugaugaaac

SEQ ID NO: 332492 - RNA, 32 nt, Human
aucgagaccauccuggccaacguggugaaacc

SEQ ID NO: 332493 - RNA, 32 nt, Human
aucgagaccauccuggccaacguggugaagcc

SEQ ID NO: 332494 - RNA, 32 nt, Human
aucgagaccauccuggccaauauggugaaacc

SEQ ID NO: 332495 - RNA, 32 nt, Human
aucgagaccauccuggcgaacauggugaaacc

SEQ ID NO: 332496 - RNA, 32 nt, Human
aucgagaccauccuggcgaacauggugagacc

SEQ ID NO: 332497 - RNA, 32 nt, Human
aucgagaccauccuggcuaacaugguaaaacc

SEQ ID NO: 332498 - RNA, 32 nt, Human
aucgagaccauccuggcuaacauggugaaacc

SEQ ID NO: 332499 - RNA, 32 nt, Human
aucgagaccauccuguuuaacacggggaaacc

SEQ ID NO: 332500 - RNA, 32 nt, Human
aucgagaccaucguggcuaacauggugaaacc

SEQ ID NO: 332501 - RNA, 32 nt, Human
aucgagaccaucuuggccaacauggugaaacc

SEQ ID NO: 332502 - RNA, 32 nt, Human
aucgagaccaucuuggcuaacauggugaaacc

SEQ ID NO: 332503 - RNA, 32 nt, Human
aucgagaccaugcuggcuaacauggugaaacc

SEQ ID NO: 332504 - RNA, 32 nt, Human
aucgagaccauggugaaaccccgucucuacua

SEQ ID NO: 332505 - RNA, 32 nt, Human
aucgagaccauucuggccaacauagugaaacc

SEQ ID NO: 332506 - RNA, 32 nt, Human
aucgagaccgcccuggcuaacauggugaaaca

SEQ ID NO: 332507 - RNA, 32 nt, Human
aucgagaccggguggagaaugaggcagaaaaa

SEQ ID NO: 332508 - RNA, 32 nt, Human
aucgagaccguccuggccgacauggugaaacc

SEQ ID NO: 332509 - RNA, 32 nt, Human
aucgagacgauccuggccaacacggugaaacc

SEQ ID NO: 332510 - RNA, 32 nt, Human
aucgagagggcucccaaacaucugcagcugau

SEQ ID NO: 332511 - RNA, 32 nt, Human
aucgagaucagccuggccaacauggugaaacc

SEQ ID NO: 332512 - RNA, 32 nt, Human
aucgagaugccuaugaggagaucgugaggcug

SEQ ID NO: 332513 - RNA, 32 nt, Human
aucgagccacugcacuccagccugggcaacag

SEQ ID NO: 332514 - RNA, 32 nt, Human
aucgagccacugcacuccagccugggcagcug

SEQ ID NO: 332515 - RNA, 32 nt, Human
aucgagccacugcacuccagccugggcgacag

SEQ ID NO: 332516 - RNA, 32 nt, Human
aucgagccacugcacuccagccugggugacag

SEQ ID NO: 332517 - RNA, 32 nt, Human
aucgagccacugcacuccagccugggugauga

SEQ ID NO: 332518 - RNA, 32 nt, Human
aucgagccacugcacuccugggcaacagagca

SEQ ID NO: 332519 - RNA, 32 nt, Human
aucgagccacugcauuccagccugggcgaaag

SEQ ID NO: 332520 - RNA, 32 nt, Human
aucgagccauugcacuccagccuggacagcag

SEQ ID NO: 332521 - RNA, 32 nt, Human
aucgagccauugcacuccagccugggcaacaa

SEQ ID NO: 332522 - RNA, 32 nt, Human
aucgagccggcccagcuucugaagggagaugu

SEQ ID NO: 332523 - RNA, 32 nt, Human
aucgagcuccaagcuggugcccugccaagcuu

SEQ ID NO: 332524 - RNA, 32 nt, Human
aucgagcuggacugacuggccaggccacgugg

SEQ ID NO: 332525 - RNA, 32 nt, Human
aucgaggaaccagagccauggacucuacacug

SEQ ID NO: 332526 - RNA, 32 nt, Human
aucgaggacucuccaaacccccaaagcagaga

SEQ ID NO: 332527 - RNA, 32 nt, Human
aucgaggaugcuggcccugcggcugcucaacg

SEQ ID NO: 332528 - RNA, 32 nt, Human
aucgaggcacauacuucaccacugucacagga

SEQ ID NO: 332529 - RNA, 32 nt, Human
aucgaggcugcaggauaugcucagacucuaga

SEQ ID NO: 332530 - RNA, 32 nt, Human
aucgaggcuguauuuccaucucuauggggucc

SEQ ID NO: 332531 - RNA, 32 nt, Human
aucgagggagcugagccgagagaaagagccgc

SEQ ID NO: 332532 - RNA, 32 nt, Human
aucgagggagggagggagaagagucacacaca

SEQ ID NO: 332533 - RNA, 32 nt, Human
aucgaggugaccugggcugagucccgggagug

SEQ ID NO: 332534 - RNA, 32 nt, Human
aucgaggugaccugggcugaguccugggagug

SEQ ID NO: 332535 - RNA, 32 nt, Human
aucgaguaguaacagccacuccaacucuccac

SEQ ID NO: 332536 - RNA, 32 nt, Human
aucgagucccuccuccucuucucccaugccuu

SEQ ID NO: 332537 - RNA, 32 nt, Human
aucgaguuacugcacuccagccugggugacaa

SEQ ID NO: 332538 - RNA, 32 nt, Human
aucgauacuguuucugugccuuauguuuuucg

SEQ ID NO: 332539 - RNA, 32 nt, Human
aucgauagcccaggcaggaguacaguggcaca

SEQ ID NO: 332540 - RNA, 32 nt, Human
aucgaucaagugcugugggagcuguuuuaagg

SEQ ID NO: 332541 - RNA, 32 nt, Human
aucgaugacaggcugguccugaggauacagcu

SEQ ID NO: 332542 - RNA, 32 nt, Human
aucgaugagccccugaccccuggguucugagg

SEQ ID NO: 332543 - RNA, 32 nt, Human
aucgaugcaugccacaacaugggugaaccuag

SEQ ID NO: 332544 - RNA, 32 nt, Human
aucgauggagaugcuucuagccucccaguagg

SEQ ID NO: 332545 - RNA, 32 nt, Human
aucgauucacguguaagccucuaccuccugca

SEQ ID NO: 332546 - RNA, 32 nt, Human
aucgauuuccuaaaggaccgugagugauauac

SEQ ID NO: 332547 - RNA, 32 nt, Human
aucgcaaaauuauucugaagcuucugcaguca

SEQ ID NO: 332548 - RNA, 32 nt, Human
aucgcaaagaggaugcgaaagggauggaggac

SEQ ID NO: 332549 - RNA, 32 nt, Human
aucgcaacacugcacuccagccugggcgacag

SEQ ID NO: 332550 - RNA, 32 nt, Human
aucgcaacacugcacuccagccugggugacag

SEQ ID NO: 332551 - RNA, 32 nt, Human
aucgcaccacagcgcuccagccuggucgacag

SEQ ID NO: 332552 - RNA, 32 nt, Human
aucgcaccaccacacuccagccugggugacag

SEQ ID NO: 332553 - RNA, 32 nt, Human
aucgcaccacggcacuccagccuggcgacaga

SEQ ID NO: 332554 - RNA, 32 nt, Human
aucgcaccacugaacuccagccugggcgacaa

SEQ ID NO: 332555 - RNA, 32 nt, Human
aucgcaccacugcacccaaaccuggggagaga

SEQ ID NO: 332556 - RNA, 32 nt, Human
aucgcaccacugcaccccagccugggcaacaa

SEQ ID NO: 332557 - RNA, 32 nt, Human
aucgcaccacugcaccccagcgugggcaacag

SEQ ID NO: 332558 - RNA, 32 nt, Human
aucgcaccacugcacgcacuccagccugggug

SEQ ID NO: 332559 - RNA, 32 nt, Human
aucgcaccacugcacuacagccugggcgacag

SEQ ID NO: 332560 - RNA, 32 nt, Human
aucgcaccacugcacucaagccugggcgacag

SEQ ID NO: 332561 - RNA, 32 nt, Human
aucgcaccacugcacuccaaccugggcaacag

SEQ ID NO: 332562 - RNA, 32 nt, Human
aucgcaccacugcacuccaaccugggugacga

SEQ ID NO: 332563 - RNA, 32 nt, Human
aucgcaccacugcacuccaaucugggcaagag

SEQ ID NO: 332564 - RNA, 32 nt, Human
aucgcaccacugcacuccagcacuccagccug

SEQ ID NO: 332565 - RNA, 32 nt, Human
aucgcaccacugcacuccagccuaggcgacgg

SEQ ID NO: 332566 - RNA, 32 nt, Human
aucgcaccacugcacuccagccuggaagacca

SEQ ID NO: 332567 - RNA, 32 nt, Human
aucgcaccacugcacuccagccuggacaacag

SEQ ID NO: 332568 - RNA, 32 nt, Human
aucgcaccacugcacuccagccugggagacag

SEQ ID NO: 332569 - RNA, 32 nt, Human
aucgcaccacugcacuccagccugggagauac

SEQ ID NO: 332570 - RNA, 32 nt, Human
aucgcaccacugcacuccagccugggcaacaa

SEQ ID NO: 332571 - RNA, 32 nt, Human
aucgcaccacugcacuccagccugggcaacac

SEQ ID NO: 332572 - RNA, 32 nt, Human
aucgcaccacugcacuccagccugggcaacag

SEQ ID NO: 332573 - RNA, 32 nt, Human
aucgcaccacugcacuccagccugggcaacau

SEQ ID NO: 332574 - RNA, 32 nt, Human
aucgcaccacugcacuccagccugggcgaaag

SEQ ID NO: 332575 - RNA, 32 nt, Human
aucgcaccacugcacuccagccugggcgacaa

SEQ ID NO: 332576 - RNA, 32 nt, Human
aucgcaccacugcacuccagccugggcgacag

SEQ ID NO: 332577 - RNA, 32 nt, Human
aucgcaccacugcacuccagccugggcggcag

SEQ ID NO: 332578 - RNA, 32 nt, Human
aucgcaccacugcacuccagccugggcuacag

SEQ ID NO: 332579 - RNA, 32 nt, Human
aucgcaccacugcacuccagccugggugacaa

SEQ ID NO: 332580 - RNA, 32 nt, Human
aucgcaccacugcacuccagccugggugacag

SEQ ID NO: 332581 - RNA, 32 nt, Human
aucgcaccacugcacuccagccugggugaugg

SEQ ID NO: 332582 - RNA, 32 nt, Human
aucgcaccacugcacuccagccuggguuacag

SEQ ID NO: 332583 - RNA, 32 nt, Human
aucgcaccacugcacuccagccuggucgacag

SEQ ID NO: 332584 - RNA, 32 nt, Human
aucgcaccacugcacuccagccuggugacaga

SEQ ID NO: 332585 - RNA, 32 nt, Human
aucgcaccacugcacuccagccugguuacaga

SEQ ID NO: 332586 - RNA, 32 nt, Human
aucgcaccacugcacuccagcucgggugacaa

SEQ ID NO: 332587 - RNA, 32 nt, Human
aucgcaccacugcacuccagcuuggaggaaag

SEQ ID NO: 332588 - RNA, 32 nt, Human
aucgcaccacugcacuccagcuugguucaugg

SEQ ID NO: 332589 - RNA, 32 nt, Human
aucgcaccacugcacuccagucuggcaacaga

SEQ ID NO: 332590 - RNA, 32 nt, Human
aucgcaccacugcacucccgcuuggcaauaga

SEQ ID NO: 332591 - RNA, 32 nt, Human
aucgcaccacugcacucuagccugggugaaag

SEQ ID NO: 332592 - RNA, 32 nt, Human
aucgcaccacugcacucuagccugggugaccg

SEQ ID NO: 332593 - RNA, 32 nt, Human
aucgcaccacugcacucuagccuuggcaacag

SEQ ID NO: 332594 - RNA, 32 nt, Human
aucgcaccacugcacucuagcuugggcaacag

SEQ ID NO: 332595 - RNA, 32 nt, Human
aucgcaccacugcacugcagccuggcaacaag

SEQ ID NO: 332596 - RNA, 32 nt, Human
aucgcaccacugcacuucagccugggugacag

SEQ ID NO: 332597 - RNA, 32 nt, Human
aucgcaccacugcauuccagccugggcaacag

SEQ ID NO: 332598 - RNA, 32 nt, Human
aucgcaccacugcauuccagccugggugacag

SEQ ID NO: 332599 - RNA, 32 nt, Human
aucgcaccacugcauugcagccuggugacaga

SEQ ID NO: 332600 - RNA, 32 nt, Human
aucgcaccacugcccuccagccuaggugacag

SEQ ID NO: 332601 - RNA, 32 nt, Human
aucgcaccacugcucuccagccuggcgacaga

SEQ ID NO: 332602 - RNA, 32 nt, Human
aucgcaccacuguacuccagccugggcaacag

SEQ ID NO: 332603 - RNA, 32 nt, Human
aucgcaccacuguacuccagccugggcgacgg

SEQ ID NO: 332604 - RNA, 32 nt, Human
aucgcaccacuguacuccagccugggugacag

SEQ ID NO: 332605 - RNA, 32 nt, Human
aucgcaccacuguacuccagccugggugacug

SEQ ID NO: 332606 - RNA, 32 nt, Human
aucgcaccacuguauuccagccuggaugacaa

SEQ ID NO: 332607 - RNA, 32 nt, Human
aucgcaccagugcacuccagccuuggugacaa

SEQ ID NO: 332608 - RNA, 32 nt, Human
aucgcaccauuacacuccagccugggcaacag

SEQ ID NO: 332609 - RNA, 32 nt, Human
aucgcaccauugcacuccagcccgggcaacaa

SEQ ID NO: 332610 - RNA, 32 nt, Human
aucgcaccauugcacuccagccuaggcaaaaa

SEQ ID NO: 332611 - RNA, 32 nt, Human
aucgcaccauugcacuccagccugagugacag

SEQ ID NO: 332612 - RNA, 32 nt, Human
aucgcaccauugcacuccagccuggaugauag

SEQ ID NO: 332613 - RNA, 32 nt, Human
aucgcaccauugcacuccagccuggcgaccga

SEQ ID NO: 332614 - RNA, 32 nt, Human
aucgcaccauugcacuccagccugggcaacaa

SEQ ID NO: 332615 - RNA, 32 nt, Human
aucgcaccauugcacuccagccugggcaacag

SEQ ID NO: 332616 - RNA, 32 nt, Human
aucgcaccauugcacuccagccugggcaacga

SEQ ID NO: 332617 - RNA, 32 nt, Human
aucgcaccauugcacuccagccugugcaacaa

SEQ ID NO: 332618 - RNA, 32 nt, Human
aucgcaccauugcacuccagcugggagacaca

SEQ ID NO: 332619 - RNA, 32 nt, Human
aucgcaccauugcacuccugccugggcaacaa

SEQ ID NO: 332620 - RNA, 32 nt, Human
aucgcaccauugcacuucagccugggcaacaa

SEQ ID NO: 332621 - RNA, 32 nt, Human
aucgcaccauugcauuccagccugggcaacaa

SEQ ID NO: 332622 - RNA, 32 nt, Human
aucgcaccauugcccuccagccugggcaacaa

SEQ ID NO: 332623 - RNA, 32 nt, Human
aucgcaccauuguacuccagccugggcaacaa

SEQ ID NO: 332624 - RNA, 32 nt, Human
aucgcaccauuguacuccagccugugugacag

SEQ ID NO: 332625 - RNA, 32 nt, Human
aucgcaccccugcacuccagccugggcaacag

SEQ ID NO: 332626 - RNA, 32 nt, Human
aucgcaccgcugcacuccagccuggcaacaga

SEQ ID NO: 332627 - RNA, 32 nt, Human
aucgcaccgcugcacuccagccugggcaacag

SEQ ID NO: 332628 - RNA, 32 nt, Human
aucgcaccgcugcacuccagccugggcaagag

SEQ ID NO: 332629 - RNA, 32 nt, Human
aucgcaccgcugcacuccagccugggugacag

SEQ ID NO: 332630 - RNA, 32 nt, Human
aucgcaccgcugcccuccagccugggcaacaa

SEQ ID NO: 332631 - RNA, 32 nt, Human
aucgcacuacugcacuccagccugggugacag

SEQ ID NO: 332632 - RNA, 32 nt, Human
aucgcacuccagccugggugacagagugagau

SEQ ID NO: 332633 - RNA, 32 nt, Human
aucgcagacagucaggcuucaggcugucugac

SEQ ID NO: 332634 - RNA, 32 nt, Human
aucgcagagaaaaaccacaugagaaaauuuuu

SEQ ID NO: 332635 - RNA, 32 nt, Human
aucgcagcacuguacuccagccugggcgaugg

SEQ ID NO: 332636 - RNA, 32 nt, Human
aucgcagcacuuugggaggcagcagcuggcgg

SEQ ID NO: 332637 - RNA, 32 nt, Human
aucgcagcucacugcaaucucugccuccuggg

SEQ ID NO: 332638 - RNA, 32 nt, Human
aucgcagcucacuguagccucuaucuccuggg

SEQ ID NO: 332639 - RNA, 32 nt, Human
aucgcagcucacuguagcuuugaccucucagg

SEQ ID NO: 332640 - RNA, 32 nt, Human
aucgcaggagugggaggguagcgagccagcug

SEQ ID NO: 332641 - RNA, 32 nt, Human
aucgcagggaaucuaccucuucacugggggca

SEQ ID NO: 332642 - RNA, 32 nt, Human
aucgcaggugugagccaccacacccggcccug

SEQ ID NO: 332643 - RNA, 32 nt, Human
aucgcaguugcuccggaucuuugcacacacuc

SEQ ID NO: 332644 - RNA, 32 nt, Human
aucgcaucacugcaguccagccuggaugacag

SEQ ID NO: 332645 - RNA, 32 nt, Human
aucgcaugcuacugcacuccagccugggagac

SEQ ID NO: 332646 - RNA, 32 nt, Human
aucgcauguagugcuuucuuuggaccaucauc

SEQ ID NO: 332647 - RNA, 32 nt, Human
aucgcauuacugcacuccagccuggguaacag

SEQ ID NO: 332648 - RNA, 32 nt, Human
aucgcauucccuccucuccaucuugaugccga

SEQ ID NO: 332649 - RNA, 32 nt, Human
aucgccaagagagacguggagaggagagcggu

SEQ ID NO: 332650 - RNA, 32 nt, Human
aucgccacagccccagacagggagugagugag

SEQ ID NO: 332651 - RNA, 32 nt, Human
aucgccacucuaugggggucugucuuuuaacu

SEQ ID NO: 332652 - RNA, 32 nt, Human
aucgccacugcacuccagccugggaaauagag

SEQ ID NO: 332653 - RNA, 32 nt, Human
aucgccacugcacuccagccugggugacagag

SEQ ID NO: 332654 - RNA, 32 nt, Human
aucgccacugccaccugccucccgcugaaucu

SEQ ID NO: 332655 - RNA, 32 nt, Human
aucgccagccagguuguuucucagccaucaaa

SEQ ID NO: 332656 - RNA, 32 nt, Human
aucgccagccuccuccuggaccucuuggcccc

SEQ ID NO: 332657 - RNA, 32 nt, Human
aucgccaguuggggaugaaaucacagagccug

SEQ ID NO: 332658 - RNA, 32 nt, Human
aucgcccaaauuuggaacugcuugucccaugc

SEQ ID NO: 332659 - RNA, 32 nt, Human
aucgcccaacagacccaugaacaaaguggcca

SEQ ID NO: 332660 - RNA, 32 nt, Human
aucgcccacugcacuccagguugggcuacaga

SEQ ID NO: 332661 - RNA, 32 nt, Human
aucgcccaggccugggaugcagugaugugauc

SEQ ID NO: 332662 - RNA, 32 nt, Human
aucgccccacuacacuccagccuggucaacag

SEQ ID NO: 332663 - RNA, 32 nt, Human
aucgccccacugcacuccagccuggcaauaga

SEQ ID NO: 332664 - RNA, 32 nt, Human
aucgccccacugcacuccagccugggcgacag

SEQ ID NO: 332665 - RNA, 32 nt, Human
aucgccccacugcacuccagccuggugacucc

SEQ ID NO: 332666 - RNA, 32 nt, Human
aucgccccauuguacuccagccuggggaacaa

SEQ ID NO: 332667 - RNA, 32 nt, Human
aucgccccuccugcccccuugugcacacccag

SEQ ID NO: 332668 - RNA, 32 nt, Human
aucgcccugcugcacuccagccugggcaacag

SEQ ID NO: 332669 - RNA, 32 nt, Human
aucgcccugcugcacuccagccugggugacag

SEQ ID NO: 332670 - RNA, 32 nt, Human
aucgccgauuggggguuggauugcggauuugg

SEQ ID NO: 332671 - RNA, 32 nt, Human
aucgccuacugucugcggguucuuuuaccugc

SEQ ID NO: 332672 - RNA, 32 nt, Human
aucgccucauuucuacaggggcaccuuggccu

SEQ ID NO: 332673 - RNA, 32 nt, Human
aucgccuccucccuccccaagauggcguccuu

SEQ ID NO: 332674 - RNA, 32 nt, Human
aucgccucuuguucggauuuuugcuacuaccg

SEQ ID NO: 332675 - RNA, 32 nt, Human
aucgccugaacccagaagcggagguugcagug

SEQ ID NO: 332676 - RNA, 32 nt, Human
aucgccugaacccagaggcggagguuguagug

SEQ ID NO: 332677 - RNA, 32 nt, Human
aucgccugaacccaggaggcggagguugcagg

SEQ ID NO: 332678 - RNA, 32 nt, Human
aucgccugagcccaggaggucaaggcuacagu

SEQ ID NO: 332679 - RNA, 32 nt, Human
aucgccugagcccaggagguggagguugcagu

SEQ ID NO: 332680 - RNA, 32 nt, Human
aucgccugcaccugccaucggggccaugugga

SEQ ID NO: 332681 - RNA, 32 nt, Human
aucgccugccuucugaccuuuuccuugauuca

SEQ ID NO: 332682 - RNA, 32 nt, Human
aucgccugcucgcuuccccuucccaggcccgu

SEQ ID NO: 332683 - RNA, 32 nt, Human
aucgccugggaggugaggugugugugacccac

SEQ ID NO: 332684 - RNA, 32 nt, Human
aucgccuucuccccuccauccagccuggcguc

SEQ ID NO: 332685 - RNA, 32 nt, Human
aucgcgacacugcacuccagccugggcaacag

SEQ ID NO: 332686 - RNA, 32 nt, Human
aucgcgacacugcacuccagccugggugacgg

SEQ ID NO: 332687 - RNA, 32 nt, Human
aucgcgacacugcgcuccagccugggcaacaa

SEQ ID NO: 332688 - RNA, 32 nt, Human
aucgcgcagcugcacuccagccugggcaacag

SEQ ID NO: 332689 - RNA, 32 nt, Human
aucgcgccaaugcacuccagccugggcgacag

SEQ ID NO: 332690 - RNA, 32 nt, Human
aucgcgccacccacuccagcccgggugacaga

SEQ ID NO: 332691 - RNA, 32 nt, Human
aucgcgccaccgcauuccagccugggcgacag

SEQ ID NO: 332692 - RNA, 32 nt, Human
aucgcgccaccgcccuccagccugggcgacag

SEQ ID NO: 332693 - RNA, 32 nt, Human
aucgcgccacggcacuccagccugggagacag

SEQ ID NO: 332694 - RNA, 32 nt, Human
aucgcgccacuacuccagccugggugacaaag

SEQ ID NO: 332695 - RNA, 32 nt, Human
aucgcgccacuauacuccagccugggcaacag

SEQ ID NO: 332696 - RNA, 32 nt, Human
aucgcgccacucacuacacuucagcuugggcg

SEQ ID NO: 332697 - RNA, 32 nt, Human
aucgcgccacugcaacccagccugggugacag

SEQ ID NO: 332698 - RNA, 32 nt, Human
aucgcgccacugcacucaagccugggcaacac

SEQ ID NO: 332699 - RNA, 32 nt, Human
aucgcgccacugcacuccaaccugggugacag

SEQ ID NO: 332700 - RNA, 32 nt, Human
aucgcgccacugcacuccacccuggguaacgg

SEQ ID NO: 332701 - RNA, 32 nt, Human
aucgcgccacugcacuccagcagucugggcga

SEQ ID NO: 332702 - RNA, 32 nt, Human
aucgcgccacugcacuccagcccgggugacag

SEQ ID NO: 332703 - RNA, 32 nt, Human
aucgcgccacugcacuccagccuagacgacag

SEQ ID NO: 332704 - RNA, 32 nt, Human
aucgcgccacugcacuccagccuaggggacag

SEQ ID NO: 332705 - RNA, 32 nt, Human
aucgcgccacugcacuccagccuaggugacag

SEQ ID NO: 332706 - RNA, 32 nt, Human
aucgcgccacugcacuccagccucggcaacag

SEQ ID NO: 332707 - RNA, 32 nt, Human
aucgcgccacugcacuccagccucggugacag

SEQ ID NO: 332708 - RNA, 32 nt, Human
aucgcgccacugcacuccagccuggacgacag

SEQ ID NO: 332709 - RNA, 32 nt, Human
aucgcgccacugcacuccagccuggcaacaga

SEQ ID NO: 332710 - RNA, 32 nt, Human
aucgcgccacugcacuccagccuggcgacaaa

SEQ ID NO: 332711 - RNA, 32 nt, Human
aucgcgccacugcacuccagccuggcgacaga

SEQ ID NO: 332712 - RNA, 32 nt, Human
aucgcgccacugcacuccagccugggcaacaa

SEQ ID NO: 332713 - RNA, 32 nt, Human
aucgcgccacugcacuccagccugggcaacag

SEQ ID NO: 332714 - RNA, 32 nt, Human
aucgcgccacugcacuccagccugggcgacac

SEQ ID NO: 332715 - RNA, 32 nt, Human
aucgcgccacugcacuccagccugggcgacag

SEQ ID NO: 332716 - RNA, 32 nt, Human
aucgcgccacugcacuccagccugggcgacgg

SEQ ID NO: 332717 - RNA, 32 nt, Human
aucgcgccacugcacuccagccugggcgagag

SEQ ID NO: 332718 - RNA, 32 nt, Human
aucgcgccacugcacuccagccugggcgauag

SEQ ID NO: 332719 - RNA, 32 nt, Human
aucgcgccacugcacuccagccuggguaacag

SEQ ID NO: 332720 - RNA, 32 nt, Human
aucgcgccacugcacuccagccugggugacac

SEQ ID NO: 332721 - RNA, 32 nt, Human
aucgcgccacugcacuccagccugggugacag

SEQ ID NO: 332722 - RNA, 32 nt, Human
aucgcgccacugcacuccagccugggugauag

SEQ ID NO: 332723 - RNA, 32 nt, Human
aucgcgccacugcacuccagccuggugacaga

SEQ ID NO: 332724 - RNA, 32 nt, Human
aucgcgccacugcacuccagcuugggcaacag

SEQ ID NO: 332725 - RNA, 32 nt, Human
aucgcgccacugcacuccaggccugggugaca

SEQ ID NO: 332726 - RNA, 32 nt, Human
aucgcgccacugcacuccaggcugggcaacgg

SEQ ID NO: 332727 - RNA, 32 nt, Human
aucgcgccacugcacuccaggcugggcgacag

SEQ ID NO: 332728 - RNA, 32 nt, Human
aucgcgccacugcacuccagucugggcaacag

SEQ ID NO: 332729 - RNA, 32 nt, Human
aucgcgccacugcacuccaguuugggcaacag

SEQ ID NO: 332730 - RNA, 32 nt, Human
aucgcgccacugcacuccggccugaugacaga

SEQ ID NO: 332731 - RNA, 32 nt, Human
aucgcgccacugcacuccugccugggacacaa

SEQ ID NO: 332732 - RNA, 32 nt, Human
aucgcgccacugcacuccugccugggcaacug

SEQ ID NO: 332733 - RNA, 32 nt, Human
aucgcgccacugcacucuagccggagugacag

SEQ ID NO: 332734 - RNA, 32 nt, Human
aucgcgccacugcacucuagccugagugacag

SEQ ID NO: 332735 - RNA, 32 nt, Human
aucgcgccacugcacucuagccugggccauag

SEQ ID NO: 332736 - RNA, 32 nt, Human
aucgcgccacugcacucuagccugggugacag

SEQ ID NO: 332737 - RNA, 32 nt, Human
aucgcgccacugcacuucagccuggacaacag

SEQ ID NO: 332738 - RNA, 32 nt, Human
aucgcgccacugcaguccagccugggcaacaa

SEQ ID NO: 332739 - RNA, 32 nt, Human
aucgcgccacugcauuccagccuggacgacag

SEQ ID NO: 332740 - RNA, 32 nt, Human
aucgcgccacugcccuccagccugggcgacag

SEQ ID NO: 332741 - RNA, 32 nt, Human
aucgcgccacugcgcuucagccugggagacag

SEQ ID NO: 332742 - RNA, 32 nt, Human
aucgcgccacugcucuccagccuggguggcag

SEQ ID NO: 332743 - RNA, 32 nt, Human
aucgcgccacuggacuccagccuggacaacag

SEQ ID NO: 332744 - RNA, 32 nt, Human
aucgcgccacugggcuccagccugggcgacag

SEQ ID NO: 332745 - RNA, 32 nt, Human
aucgcgccacuguacuccagccuggacaacag

SEQ ID NO: 332746 - RNA, 32 nt, Human
aucgcgccacuguacuccagccugggcaacag

SEQ ID NO: 332747 - RNA, 32 nt, Human
aucgcgccacuguacuccagccugggugacag

SEQ ID NO: 332748 - RNA, 32 nt, Human
aucgcgccacugugcuccagccugggcaacag

SEQ ID NO: 332749 - RNA, 32 nt, Human
aucgcgccaguacacuccagccuggguaacag

SEQ ID NO: 332750 - RNA, 32 nt, Human
aucgcgccagugcacuccagccugggcaagaa

SEQ ID NO: 332751 - RNA, 32 nt, Human
aucgcgccaucgcacuccagccugggcaacaa

SEQ ID NO: 332752 - RNA, 32 nt, Human
aucgcgccaucgcacuccagccugggugacaa

SEQ ID NO: 332753 - RNA, 32 nt, Human
aucgcgccauugcacuccaaccuggacgacag

SEQ ID NO: 332754 - RNA, 32 nt, Human
aucgcgccauugcacuccagccuggacaacaa

SEQ ID NO: 332755 - RNA, 32 nt, Human
aucgcgccauugcacuccagccuggccuauaa

SEQ ID NO: 332756 - RNA, 32 nt, Human
aucgcgccauugcacuccagccuggcugacag

SEQ ID NO: 332757 - RNA, 32 nt, Human
aucgcgccauugcacuccagccugggcaacaa

SEQ ID NO: 332758 - RNA, 32 nt, Human
aucgcgccauugcacuccagccugggcaacga

SEQ ID NO: 332759 - RNA, 32 nt, Human
aucgcgccauugcacuccagccugggcaacuc

SEQ ID NO: 332760 - RNA, 32 nt, Human
aucgcgccauugcacuccagccugggcgacaa

SEQ ID NO: 332761 - RNA, 32 nt, Human
aucgcgccauugcacuccagccugggcgacag

SEQ ID NO: 332762 - RNA, 32 nt, Human
aucgcgccauugcacuccagccugggcggcag

SEQ ID NO: 332763 - RNA, 32 nt, Human
aucgcgccauugcacuccagccugggggacaa

SEQ ID NO: 332764 - RNA, 32 nt, Human
aucgcgccauugcacuccagccuggguaacaa

SEQ ID NO: 332765 - RNA, 32 nt, Human
aucgcgccauugcacuccagccugggugacag

SEQ ID NO: 332766 - RNA, 32 nt, Human
aucgcgccauugcacuccagccugggugacga

SEQ ID NO: 332767 - RNA, 32 nt, Human
aucgcgccauugcacuccauccuggacaacag

SEQ ID NO: 332768 - RNA, 32 nt, Human
aucgcgccauugcacucccgccugggcgacuc

SEQ ID NO: 332769 - RNA, 32 nt, Human
aucgcgccauugcacuccggccuggggacaag

SEQ ID NO: 332770 - RNA, 32 nt, Human
aucgcgccauuguacuccagccugggcgauga

SEQ ID NO: 332771 - RNA, 32 nt, Human
aucgcgccccugcacuccagccugggugacag

SEQ ID NO: 332772 - RNA, 32 nt, Human
aucgcgcccggccaacuuuucuuuagaaaaau

SEQ ID NO: 332773 - RNA, 32 nt, Human
aucgcgccgcggcgguuccuguccuuacaguu

SEQ ID NO: 332774 - RNA, 32 nt, Human
aucgcgccgcugcacuccagccugggccacac

SEQ ID NO: 332775 - RNA, 32 nt, Human
aucgcgccgcugcacuccagccugggcgacag

SEQ ID NO: 332776 - RNA, 32 nt, Human
aucgcgccgcugcacuccagccugggcggcag

SEQ ID NO: 332777 - RNA, 32 nt, Human
aucgcgccgcugcacuccagccugggugacag

SEQ ID NO: 332778 - RNA, 32 nt, Human
aucgcgccgcugcauuccagccugggugacag

SEQ ID NO: 332779 - RNA, 32 nt, Human
aucgcgccguugcacuccagccugggcaacaa

SEQ ID NO: 332780 - RNA, 32 nt, Human
aucgcgccucacuucaucccagucccgggcga

SEQ ID NO: 332781 - RNA, 32 nt, Human
aucgcgccuuugcacuccagccuggaagacaa

SEQ ID NO: 332782 - RNA, 32 nt, Human
aucgcgcuacugcacuccagccugggcgacag

SEQ ID NO: 332783 - RNA, 32 nt, Human
aucgcgcuacugcacuccagccugggugacag

SEQ ID NO: 332784 - RNA, 32 nt, Human
aucgcgcuacugcauuccagccugggcgccga

SEQ ID NO: 332785 - RNA, 32 nt, Human
aucgcgcuauugcacuccagccugggugacag

SEQ ID NO: 332786 - RNA, 32 nt, Human
aucgcgcugcagcuggcucacuuccgggggua

SEQ ID NO: 332787 - RNA, 32 nt, Human
aucgcgcugcugcacuccagccugggugacag

SEQ ID NO: 332788 - RNA, 32 nt, Human
aucgcgcugggaagccacgugggagccgugcg

SEQ ID NO: 332789 - RNA, 32 nt, Human
aucgcggcgcugcacucuagccugggugacag

SEQ ID NO: 332790 - RNA, 32 nt, Human
aucgcggcggucgcggccuuggggaugggcgg

SEQ ID NO: 332791 - RNA, 24 nt, Human
aucgcggcucaccgcaaccuccgc

SEQ ID NO: 332792 - RNA, 32 nt, Human
aucgcggcucaccgcaaccuccgccuccuggg

SEQ ID NO: 332793 - RNA, 22 nt, Human
aucgcggcucacugcaaccucc

SEQ ID NO: 332794 - RNA, 32 nt, Human
aucgcggcucacugcaaccuccaccucccagg

SEQ ID NO: 332795 - RNA, 32 nt, Human
aucgcggcucacugcaaccuccaccucccggg

SEQ ID NO: 332796 - RNA, 32 nt, Human
aucgcggcucacugcaaccuggaacuccuggg

SEQ ID NO: 332797 - RNA, 32 nt, Human
aucgcggcucacugcagccuccauccucuggg

SEQ ID NO: 332798 - RNA, 32 nt, Human
aucgcguaccacacuccagccugggugacaga

SEQ ID NO: 332799 - RNA, 32 nt, Human
aucgcgucacugcacuccagccuggacaacag

SEQ ID NO: 332800 - RNA, 32 nt, Human
aucgcgucacugcacuccagccugggagacag

SEQ ID NO: 332801 - RNA, 32 nt, Human
aucgcgucacugcacuccagccugggcgacag

SEQ ID NO: 332802 - RNA, 32 nt, Human
aucgcgucauugcacuccagccugggcaacaa

SEQ ID NO: 332803 - RNA, 32 nt, Human
aucgcgugaacccaggaggcggaggcugcagu

SEQ ID NO: 332804 - RNA, 32 nt, Human
aucgcgugaacccaggaggcggcgguugcagu

SEQ ID NO: 332805 - RNA, 32 nt, Human
aucgcuaccauccaggaguaucagagccugaa

SEQ ID NO: 332806 - RNA, 32 nt, Human
aucgcuagggcugcagggugcuugcuucggaa

SEQ ID NO: 332807 - RNA, 32 nt, Human
aucgcucauggaggagauggccagggcggacc

SEQ ID NO: 332808 - RNA, 32 nt, Human
aucgcuccacugcacuccagcccaggugacag

SEQ ID NO: 332809 - RNA, 32 nt, Human
aucgcuccacugcacuccagccugggugacag

SEQ ID NO: 332810 - RNA, 32 nt, Human
aucgcuccauugcacuccagccugggugacag

SEQ ID NO: 332811 - RNA, 32 nt, Human
aucgcucccacugcacuccagccugggcgaca

SEQ ID NO: 332812 - RNA, 32 nt, Human
aucgcucccaggcugagacccaccuuggcucu

SEQ ID NO: 332813 - RNA, 32 nt, Human
aucgcuccucugacaucuccccggccauuucu

SEQ ID NO: 332814 - RNA, 32 nt, Human
aucgcucgaacccaggagguggagguugcagu

SEQ ID NO: 332815 - RNA, 32 nt, Human
aucgcucuacccaggcgguggugucgaucuac

SEQ ID NO: 332816 - RNA, 32 nt, Human
aucgcucuccuugccagcuuucuccucagggu

SEQ ID NO: 332817 - RNA, 32 nt, Human
aucgcucugucgcccagguuugagugcaaugg

SEQ ID NO: 332818 - RNA, 32 nt, Human
aucgcugccuccuggguucaagcaauucuccu

SEQ ID NO: 332819 - RNA, 32 nt, Human
aucgcugcucaccgcaaccuccgccuuccagg

SEQ ID NO: 332820 - RNA, 32 nt, Human
aucgcuggagaaagaggagccccuggaccagu

SEQ ID NO: 332821 - RNA, 29 nt, Human
aucgcuggucuguguucuccuggauuugg

SEQ ID NO: 332822 - RNA, 32 nt, Human
aucgcugguggagguggcggagagcaaggugg

SEQ ID NO: 332823 - RNA, 32 nt, Human
aucgcugucuccuccgcaaagcauuuuaacuc

SEQ ID NO: 332824 - RNA, 32 nt, Human
aucgcuuaaccccaggagguggggguuguugu

SEQ ID NO: 332825 - RNA, 32 nt, Human
aucgcuuaagcccaggagguucaggcugcagu

SEQ ID NO: 332826 - RNA, 32 nt, Human
aucgcuucccuucacugaauucccuucaaagc

SEQ ID NO: 332827 - RNA, 32 nt, Human
aucgcuugaacccaagaggcagagguugcagu

SEQ ID NO: 332828 - RNA, 32 nt, Human
aucgcuugaacccaagaggcggagguugcagu

SEQ ID NO: 332829 - RNA, 32 nt, Human
aucgcuugaacccaagagguggagguugcggu

SEQ ID NO: 332830 - RNA, 32 nt, Human
aucgcuugaacccagaaagcggagguugcagu

SEQ ID NO: 332831 - RNA, 32 nt, Human
aucgcuugaacccagaaggcggaaguugcagu

SEQ ID NO: 332832 - RNA, 32 nt, Human
aucgcuugaacccagauagcagagguugcagu

SEQ ID NO: 332833 - RNA, 32 nt, Human
aucgcuugaacccaggaagcagagguugcagu

SEQ ID NO: 332834 - RNA, 32 nt, Human
aucgcuugaacccaggaagcagugguugagau

SEQ ID NO: 332835 - RNA, 32 nt, Human
aucgcuugaacccaggaaguagagguugcagu

SEQ ID NO: 332836 - RNA, 32 nt, Human
aucgcuugaacccaggaaguggagguugcagu

SEQ ID NO: 332837 - RNA, 32 nt, Human
aucgcuugaacccaggagacagagguugcagu

SEQ ID NO: 332838 - RNA, 32 nt, Human
aucgcuugaacccaggagacagggguugcagu

SEQ ID NO: 332839 - RNA, 32 nt, Human
aucgcuugaacccaggagacgagguugcagug

SEQ ID NO: 332840 - RNA, 32 nt, Human
aucgcuugaacccaggagacggugguugcagu

SEQ ID NO: 332841 - RNA, 32 nt, Human
aucgcuugaacccaggagauggagauugcagu

SEQ ID NO: 332842 - RNA, 32 nt, Human
aucgcuugaacccaggagauugagguuguagu

SEQ ID NO: 332843 - RNA, 32 nt, Human
aucgcuugaacccaggaggcacagauugcagu

SEQ ID NO: 332844 - RNA, 32 nt, Human
aucgcuugaacccaggaggcagaaguugcagu

SEQ ID NO: 332845 - RNA, 32 nt, Human
aucgcuugaacccaggaggcagagauugcagu

SEQ ID NO: 332846 - RNA, 32 nt, Human
aucgcuugaacccaggaggcagagauugcggu

SEQ ID NO: 332847 - RNA, 32 nt, Human
aucgcuugaacccaggaggcagagguugcagu

SEQ ID NO: 332848 - RNA, 32 nt, Human
aucgcuugaacccaggaggcagaguuugcagu

SEQ ID NO: 332849 - RNA, 32 nt, Human
aucgcuugaacccaggaggcagugauugcagu

SEQ ID NO: 332850 - RNA, 32 nt, Human
aucgcuugaacccaggaggcggagauugcagu

SEQ ID NO: 332851 - RNA, 32 nt, Human
aucgcuugaacccaggaggcggagcuugcagu

SEQ ID NO: 332852 - RNA, 32 nt, Human
aucgcuugaacccaggaggcggaggcugcagu

SEQ ID NO: 332853 - RNA, 32 nt, Human
aucgcuugaacccaggaggcggagguugcagu

SEQ ID NO: 332854 - RNA, 32 nt, Human
aucgcuugaacccaggaggcggagguugcggu

SEQ ID NO: 332855 - RNA, 32 nt, Human
aucgcuugaacccaggagguagaagcugcagu

SEQ ID NO: 332856 - RNA, 32 nt, Human
aucgcuugaacccaggagguagaggcugcagu

SEQ ID NO: 332857 - RNA, 32 nt, Human
aucgcuugaacccaggagguagagguugcagu

SEQ ID NO: 332858 - RNA, 32 nt, Human
aucgcuugaacccaggaggugaagguugcagu

SEQ ID NO: 332859 - RNA, 32 nt, Human
aucgcuugaacccaggaggugcagguugcagu

SEQ ID NO: 332860 - RNA, 32 nt, Human
aucgcuugaacccaggagguggagguagcagu

SEQ ID NO: 332861 - RNA, 32 nt, Human
aucgcuugaacccaggagguggagguugcagu

SEQ ID NO: 332862 - RNA, 32 nt, Human
aucgcuugaacccaggagguggggguugcacc

SEQ ID NO: 332863 - RNA, 32 nt, Human
aucgcuugaacccaggagucagagguuucagu

SEQ ID NO: 332864 - RNA, 32 nt, Human
aucgcuugaacccaggagucggagguugcagu

SEQ ID NO: 332865 - RNA, 32 nt, Human
aucgcuugaacccaggaguucaagucugcagu

SEQ ID NO: 332866 - RNA, 32 nt, Human
aucgcuugaacccagguuguggagguuguagu

SEQ ID NO: 332867 - RNA, 32 nt, Human
aucgcuugaaccccagaggcagagguugcggu

SEQ ID NO: 332868 - RNA, 32 nt, Human
aucgcuugaaccccggaggcggagguugcagu

SEQ ID NO: 332869 - RNA, 32 nt, Human
aucgcuugaaccccggagguagagguugcagu

SEQ ID NO: 332870 - RNA, 32 nt, Human
aucgcuugaacccgagagacggagguugcagu

SEQ ID NO: 332871 - RNA, 32 nt, Human
aucgcuugaacccgagaggcggagguugcagu

SEQ ID NO: 332872 - RNA, 32 nt, Human
aucgcuugaacccgagagguggagguugcagu

SEQ ID NO: 332873 - RNA, 32 nt, Human
aucgcuugaacccgggaagcagagguugcagu

SEQ ID NO: 332874 - RNA, 32 nt, Human
aucgcuugaacccgggaagcggagguugcagu

SEQ ID NO: 332875 - RNA, 32 nt, Human
aucgcuugaacccgggaaggcggaaguugcag

SEQ ID NO: 332876 - RNA, 32 nt, Human
aucgcuugaacccgggaggcaaagguugcagu

SEQ ID NO: 332877 - RNA, 32 nt, Human
aucgcuugaacccgggaggcagaaguugcagu

SEQ ID NO: 332878 - RNA, 32 nt, Human
aucgcuugaacccgggaggcagagauugcagu

SEQ ID NO: 332879 - RNA, 32 nt, Human
aucgcuugaacccgggaggcagaggcugcagu

SEQ ID NO: 332880 - RNA, 32 nt, Human
aucgcuugaacccgggaggcagagguaguagu

SEQ ID NO: 332881 - RNA, 32 nt, Human
aucgcuugaacccgggaggcagagguggcugu

SEQ ID NO: 332882 - RNA, 32 nt, Human
aucgcuugaacccgggaggcagagguuacagu

SEQ ID NO: 332883 - RNA, 32 nt, Human
aucgcuugaacccgggaggcagagguugcagu

SEQ ID NO: 332884 - RNA, 32 nt, Human
aucgcuugaacccgggaggcagagguugcggu

SEQ ID NO: 332885 - RNA, 32 nt, Human
aucgcuugaacccgggaggcggagcuugcagu

SEQ ID NO: 332886 - RNA, 32 nt, Human
aucgcuugaacccgggaggcggagguugcagu

SEQ ID NO: 332887 - RNA, 32 nt, Human
aucgcuugaacccgggaggcggagguuguagu

SEQ ID NO: 332888 - RNA, 32 nt, Human
aucgcuugaacccgggagguggagauugcagu

SEQ ID NO: 332889 - RNA, 32 nt, Human
aucgcuugaacccgggagguggagguugcagc

SEQ ID NO: 332890 - RNA, 32 nt, Human
aucgcuugaacccgggagguggagguugcagu

SEQ ID NO: 332891 - RNA, 32 nt, Human
aucgcuugaacccgggagguggagguugcggu

SEQ ID NO: 332892 - RNA, 32 nt, Human
aucgcuugaacccgggagguguagguugcagu

SEQ ID NO: 332893 - RNA, 32 nt, Human
aucgcuugaacccgggcggcggagauugcagu

SEQ ID NO: 332894 - RNA, 32 nt, Human
aucgcuugaacccgguaggcagagguugcagu

SEQ ID NO: 332895 - RNA, 32 nt, Human
aucgcuugaacccuagaggcggaguuugcagu

SEQ ID NO: 332896 - RNA, 32 nt, Human
aucgcuugaacccuggagguggagguggaggu

SEQ ID NO: 332897 - RNA, 32 nt, Human
aucgcuugagcccaggaggcugaggcugcagu

SEQ ID NO: 332898 - RNA, 32 nt, Human
aucgcuugagcccaggaggucagggcugcagu

SEQ ID NO: 332899 - RNA, 32 nt, Human
aucgcuugagcccaggagguggagguugcagu

SEQ ID NO: 332900 - RNA, 31 nt, Human
aucgcuugagcccaggcaguuggagaccagu

SEQ ID NO: 332901 - RNA, 32 nt, Human
aucgcuugagccugggagguugaggcuucugu

SEQ ID NO: 332902 - RNA, 32 nt, Human
aucgcuugagccugggcaguugaggcuguagu

SEQ ID NO: 332903 - RNA, 32 nt, Human
aucgcuugaggccaggaguuagagacugcagu

SEQ ID NO: 332904 - RNA, 32 nt, Human
aucgcuugaucucaggagguugaggcugcagu

SEQ ID NO: 332905 - RNA, 32 nt, Human
aucgcuugggcccaggagguggagguugcagu

SEQ ID NO: 332906 - RNA, 32 nt, Human
aucggaaaccacuggcugcagcuucgggaugu

SEQ ID NO: 332907 - RNA, 32 nt, Human
aucggaaagggcggcuggaggcucccggagcg

SEQ ID NO: 332908 - RNA, 32 nt, Human
aucggaacaagccccuccuccuggggcugccc

SEQ ID NO: 332909 - RNA, 32 nt, Human
aucggaaguggugccuucagcacagaagaaga

SEQ ID NO: 332910 - RNA, 32 nt, Human
aucggaaucugccuugcacaggagacuuaaaa

SEQ ID NO: 332911 - RNA, 32 nt, Human
aucggaccaagcugcauggaggccacaauggg

SEQ ID NO: 332912 - RNA, 32 nt, Human
aucggacggcggaauguggcagaugaaaugug

SEQ ID NO: 332913 - RNA, 32 nt, Human
aucggacucagcauucagauaucaaagcagac

SEQ ID NO: 332914 - RNA, 32 nt, Human
aucggacuccagccugggugaaggagugagac

SEQ ID NO: 332915 - RNA, 32 nt, Human
aucggacuucugggccuguaaucccaguuugg

SEQ ID NO: 332916 - RNA, 32 nt, Human
aucggacuugcagcuucauuuugggcugccuu

SEQ ID NO: 332917 - RNA, 32 nt, Human
aucggagacgcugcgccugcucagaagguagc

SEQ ID NO: 332918 - RNA, 32 nt, Human
aucggagagcgccuggccgagauggaggacua

SEQ ID NO: 332919 - RNA, 32 nt, Human
aucggagcuagaugaaaaggcaaugcaggcag

SEQ ID NO: 332920 - RNA, 32 nt, Human
aucggaggagugaaccugggcuaagaguuugg

SEQ ID NO: 332921 - RNA, 32 nt, Human
aucggagggugcagcauacaccuaccacucag

SEQ ID NO: 332922 - RNA, 32 nt, Human
aucggaggugggcgggguugcagugacuggug

SEQ ID NO: 332923 - RNA, 32 nt, Human
aucggaugccugcgugccucccagaagugggu

SEQ ID NO: 332924 - RNA, 32 nt, Human
aucggaugcugaacagggagaugaaaggaggu

SEQ ID NO: 332925 - RNA, 32 nt, Human
aucggcagccgucaccccacaccccagcccau

SEQ ID NO: 332926 - RNA, 32 nt, Human
aucggcagggagaggaaggcgcgggaggggga

SEQ ID NO: 332927 - RNA, 21 nt, Human
aucggcagugccagggcagca

SEQ ID NO: 332928 - RNA, 32 nt, Human
aucggccaacagccagcccuugccagcugacg

SEQ ID NO: 332929 - RNA, 32 nt, Human
aucggccacugcacuccgggcugggcgacaga

SEQ ID NO: 332930 - RNA, 32 nt, Human
aucggccaugagguucuccuuuacuuacaaua

SEQ ID NO: 332931 - RNA, 32 nt, Human
aucggccaugccacugccuugcucugggccug

SEQ ID NO: 332932 - RNA, 32 nt, Human
aucggcccccacagaguggcccgcgggccucc

SEQ ID NO: 332933 - RNA, 32 nt, Human
aucggcccgcagcuggcuggcccagugcuccu

SEQ ID NO: 332934 - RNA, 23 nt, Human
aucggccgccaucgccgccgccg

SEQ ID NO: 332935 - RNA, 32 nt, Human
aucggccggccucgaacccccacagcuggagg

SEQ ID NO: 332936 - RNA, 32 nt, Human
aucggccugagcuuagucacauggccacaccc

SEQ ID NO: 332937 - RNA, 32 nt, Human
aucggccugaggcugggacauuacaugaaauc

SEQ ID NO: 332938 - RNA, 32 nt, Human
aucggccugccuguguuucccucuuaggugca

SEQ ID NO: 332939 - RNA, 18 nt, Human
aucggcgcaccuggggcg

SEQ ID NO: 332940 - RNA, 32 nt, Human
aucggcguccugugccccucugcuccggcacg

SEQ ID NO: 332941 - RNA, 32 nt, Human
aucggcucaaaaccgcuugccucgcaggggcu

SEQ ID NO: 332942 - RNA, 32 nt, Human
aucggcugacacugcugccuccagcuaguuau

SEQ ID NO: 332943 - RNA, 32 nt, Human
aucgggaacuccugcuucuccuugccucgaaa

SEQ ID NO: 332944 - RNA, 32 nt, Human
aucgggccacggcacuccagccugggugacag

SEQ ID NO: 332945 - RNA, 32 nt, Human
aucgggccacugcacuccagcuugggugacag

SEQ ID NO: 332946 - RNA, 32 nt, Human
aucgggccccaugucugugcugucuaguuugu

SEQ ID NO: 332947 - RNA, 32 nt, Human
aucgggccgcugcacuccagccugggggacag

SEQ ID NO: 332948 - RNA, 32 nt, Human
aucgggccuacagaugcucucccuugaaucga

SEQ ID NO: 332949 - RNA, 32 nt, Human
aucgggcuccuuuugcuugcugaggcccuaga

SEQ ID NO: 332950 - RNA, 32 nt, Human
aucggggaagcauggggauccgggagaagcac

SEQ ID NO: 332951 - RNA, 32 nt, Human
aucggggaggcagagcuugcagucagccgaga

SEQ ID NO: 332952 - RNA, 32 nt, Human
aucggggcacagacuuccuuuuacuucuuccu

SEQ ID NO: 332953 - RNA, 32 nt, Human
aucggggcucacugccuccugcccuucucucc

SEQ ID NO: 332954 - RNA, 32 nt, Human
aucggggugcaauggcaugcaucuguaaccca

SEQ ID NO: 332955 - RNA, 32 nt, Human
aucgggugcguacagaagaacacacaccgcuc

SEQ ID NO: 332956 - RNA, 32 nt, Human
aucgggugcucaauaaauauuugucgaaugaa

SEQ ID NO: 332957 - RNA, 32 nt, Human
aucggguggacuagcugggaucuccgcauugg

SEQ ID NO: 332958 - RNA, 32 nt, Human
aucggguguaggugaaaggcaucuuucugaau

SEQ ID NO: 332959 - RNA, 32 nt, Human
aucgguacaugguuguacaaguaucaauggac

SEQ ID NO: 332960 - RNA, 32 nt, Human
aucggucacuucuccaggcugcccuaaauuag

SEQ ID NO: 332961 - RNA, 32 nt, Human
aucggucucaccuggacggacgauccgcucag

SEQ ID NO: 332962 - RNA, 32 nt, Human
aucggugagccccugccauggucaccugucag

SEQ ID NO: 332963 - RNA, 32 nt, Human
aucggugcuguacugcauacccugccagcugu

SEQ ID NO: 332964 - RNA, 32 nt, Human
aucggugcuuugcuguccaucuucccaugcug

SEQ ID NO: 332965 - RNA, 32 nt, Human
aucgguggcacuguagccugcgucauggcuca

SEQ ID NO: 332966 - RNA, 32 nt, Human
aucgguggcucaugccuguaauccuagcacuu

SEQ ID NO: 332967 - RNA, 32 nt, Human
aucggugguauugcaggaauuuuucaaaaaca

SEQ ID NO: 332968 - RNA, 32 nt, Human
aucggugguuuacaccuguaaucccagcacuu

SEQ ID NO: 332969 - RNA, 32 nt, Human
aucgguuaugguuggagaagcauuucaagaaa

SEQ ID NO: 332970 - RNA, 32 nt, Human
aucgguucuccucacucuccagccuguuggcu

SEQ ID NO: 332971 - RNA, 32 nt, Human
aucgguugaacccguguggcagagguugcggu

SEQ ID NO: 332972 - RNA, 32 nt, Human
aucgguugagcccaggagguuguggcugcagu

SEQ ID NO: 332973 - RNA, 32 nt, Human
aucgguugaggccaggaguuugaggcugcagu

SEQ ID NO: 332974 - RNA, 32 nt, Human
aucgguuuuguuguacuugggacuaaacauuc

SEQ ID NO: 332975 - RNA, 32 nt, Human
aucguaaauguucugaagacgagcagcuggag

SEQ ID NO: 332976 - RNA, 32 nt, Human
aucguaacucucugucuugaccaauaauuuug

SEQ ID NO: 332977 - RNA, 32 nt, Human
aucguacaaacacauauauaacuacaaaagga

SEQ ID NO: 332978 - RNA, 21 nt, Human
aucguacauuuugcuugcgug

SEQ ID NO: 332979 - RNA, 32 nt, Human
aucguaccacuacacuccagccugggcaacgg

SEQ ID NO: 332980 - RNA, 32 nt, Human
aucguaccacugcacuccagccuaggugacag

SEQ ID NO: 332981 - RNA, 32 nt, Human
aucguaccacugcacuccagccuggaugacag

SEQ ID NO: 332982 - RNA, 32 nt, Human
aucguaccacugcacuccagccugggcgacag

SEQ ID NO: 332983 - RNA, 32 nt, Human
aucguaccacugcacuccagccugggcuacag

SEQ ID NO: 332984 - RNA, 32 nt, Human
aucguaccacugcacuccagccugggugacag

SEQ ID NO: 332985 - RNA, 32 nt, Human
aucguaccacugcacuccagucugggcgacag

SEQ ID NO: 332986 - RNA, 32 nt, Human
aucguaccacugcacucuggccugggcaacaa

SEQ ID NO: 332987 - RNA, 32 nt, Human
aucguaccauugcacuccagccugggcaacaa

SEQ ID NO: 332988 - RNA, 32 nt, Human
aucguacccagccugggcaacagugcgagguu

SEQ ID NO: 332989 - RNA, 32 nt, Human
aucguaccgcugcacuccagccugggugauag

SEQ ID NO: 332990 - RNA, 32 nt, Human
aucguaccuauugcacuccauccuggaugaaa

SEQ ID NO: 332991 - RNA, 32 nt, Human
aucguacuacugcacuccagcauggaagacag

SEQ ID NO: 332992 - RNA, 32 nt, Human
aucguacuuccaggaacagugaggcugauggg

SEQ ID NO: 332993 - RNA, 32 nt, Human
aucguagaaggagugaaagaagaaaagaagac

SEQ ID NO: 332994 - RNA, 32 nt, Human
aucguagagagggacgugagaagcagcuuccc

SEQ ID NO: 332995 - RNA, 32 nt, Human
aucguaggacagugaagaugcugcuggaauug

SEQ ID NO: 332996 - RNA, 32 nt, Human
aucguagucggggaagacucuacugaauaaga

SEQ ID NO: 332997 - RNA, 32 nt, Human
aucguaucuccaagucccucucacaggacaug

SEQ ID NO: 332998 - RNA, 32 nt, Human
aucgucaagacaucacuuggauuucuuaaucu

SEQ ID NO: 332999 - RNA, 32 nt, Human
aucgucaccuucuccaccgugggcuacgguga

SEQ ID NO: 333000 - RNA, 32 nt, Human
aucgucccacugcacuccagcccgggcaacag

SEQ ID NO: 333001 - RNA, 32 nt, Human
aucgucccacugcacuccagccugggcaacag

SEQ ID NO: 333002 - RNA, 32 nt, Human
aucguccccgggaggcagcuggggcagcagca

SEQ ID NO: 333003 - RNA, 32 nt, Human
aucguccucaugggcggaaugaacccacacaa

SEQ ID NO: 333004 - RNA, 32 nt, Human
aucguccugcagcugccggcaaaaccaucaac

SEQ ID NO: 333005 - RNA, 24 nt, Human
aucguccugcugaagcaggccaca

SEQ ID NO: 333006 - RNA, 32 nt, Human
aucguccugcugcugcugccguuccgguguca

SEQ ID NO: 333007 - RNA, 32 nt, Human
aucguccuggcuccccagaguaucuucccacu

SEQ ID NO: 333008 - RNA, 32 nt, Human
aucgucucaaagaacuuuugcuggagagaauc

SEQ ID NO: 333009 - RNA, 32 nt, Human
aucgucucagcccaaaaucugcuuaaacugau

SEQ ID NO: 333010 - RNA, 32 nt, Human
aucgucucugagauuaccuucuugcccuuucc

SEQ ID NO: 333011 - RNA, 32 nt, Human
aucgucugcugcauacuugacuagccuggacu

SEQ ID NO: 333012 - RNA, 32 nt, Human
aucgucuggggagggcaccaguggaaagcccc

SEQ ID NO: 333013 - RNA, 32 nt, Human
aucgucuguuucaucaagaggagucgcggcgg

SEQ ID NO: 333014 - RNA, 32 nt, Human
aucgucuguuuccccggccuugcccccgcccg

SEQ ID NO: 333015 - RNA, 32 nt, Human
aucgucuuauccccauaauccuugccaucccu

SEQ ID NO: 333016 - RNA, 32 nt, Human
aucgucuucccaucuggguuuuuggguuuuuc

SEQ ID NO: 333017 - RNA, 32 nt, Human
aucgugacacugcacuccagccugggcgacag

SEQ ID NO: 333018 - RNA, 32 nt, Human
aucgugacacugcacuucagccuggcugacag

SEQ ID NO: 333019 - RNA, 32 nt, Human
aucgugacauggccuccagccugggugaccga

SEQ ID NO: 333020 - RNA, 32 nt, Human
aucgugaucaguaaagacuggaagagagggac

SEQ ID NO: 333021 - RNA, 32 nt, Human
aucgugauuucggccuauuuccuugccaggcc

SEQ ID NO: 333022 - RNA, 32 nt, Human
aucgugcaucacucucccuucugccuccuuca

SEQ ID NO: 333023 - RNA, 29 nt, Human
aucgugcaucuguguguccugggagcugc

SEQ ID NO: 333024 - RNA, 32 nt, Human
aucgugccaaugcacuccauccugggcaaaaa

SEQ ID NO: 333025 - RNA, 32 nt, Human
aucgugccaccuacacuccagccugggugaca

SEQ ID NO: 333026 - RNA, 32 nt, Human
aucgugccacgcacugcaaccugggugacaga

SEQ ID NO: 333027 - RNA, 32 nt, Human
aucgugccacuacacuccagccugggcaaaag

SEQ ID NO: 333028 - RNA, 32 nt, Human
aucgugccacuacacuccagccugggggacag

SEQ ID NO: 333029 - RNA, 32 nt, Human
aucgugccacuacacuccagccugggugacag

SEQ ID NO: 333030 - RNA, 32 nt, Human
aucgugccacuccacuccagccugggcaacag

SEQ ID NO: 333031 - RNA, 32 nt, Human
aucgugccacugaccuccagccugggggacag

SEQ ID NO: 333032 - RNA, 32 nt, Human
aucgugccacugcacaccauccuggaugacag

SEQ ID NO: 333033 - RNA, 32 nt, Human
aucgugccacugcaccacuccagccugggcaa

SEQ ID NO: 333034 - RNA, 32 nt, Human
aucgugccacugcaccccagccugggcaacag

SEQ ID NO: 333035 - RNA, 32 nt, Human
aucgugccacugcaccguagccugggugauaa

SEQ ID NO: 333036 - RNA, 32 nt, Human
aucgugccacugcacgccagccugggcaacag

SEQ ID NO: 333037 - RNA, 32 nt, Human
aucgugccacugcacuacaaccugggugauag

SEQ ID NO: 333038 - RNA, 32 nt, Human
aucgugccacugcacucaagccugggugacag

SEQ ID NO: 333039 - RNA, 32 nt, Human
aucgugccacugcacucaagccuggugacaga

SEQ ID NO: 333040 - RNA, 32 nt, Human
aucgugccacugcacuccaaccugggugagag

SEQ ID NO: 333041 - RNA, 32 nt, Human
aucgugccacugcacuccagacugggggagag

SEQ ID NO: 333042 - RNA, 32 nt, Human
aucgugccacugcacuccagacuuggugacag

SEQ ID NO: 333043 - RNA, 32 nt, Human
aucgugccacugcacuccagagccugggcgac

SEQ ID NO: 333044 - RNA, 32 nt, Human
aucgugccacugcacuccagcccaggcaacag

SEQ ID NO: 333045 - RNA, 32 nt, Human
aucgugccacugcacuccagccugaagacaga

SEQ ID NO: 333046 - RNA, 32 nt, Human
aucgugccacugcacuccagccugagcaacag

SEQ ID NO: 333047 - RNA, 32 nt, Human
aucgugccacugcacuccagccugcgggacag

SEQ ID NO: 333048 - RNA, 32 nt, Human
aucgugccacugcacuccagccuggacaacgg

SEQ ID NO: 333049 - RNA, 32 nt, Human
aucgugccacugcacuccagccuggaggacag

SEQ ID NO: 333050 - RNA, 32 nt, Human
aucgugccacugcacuccagccuggauuacag

SEQ ID NO: 333051 - RNA, 32 nt, Human
aucgugccacugcacuccagccuggcgacaca

SEQ ID NO: 333052 - RNA, 32 nt, Human
aucgugccacugcacuccagccugggagacag

SEQ ID NO: 333053 - RNA, 32 nt, Human
aucgugccacugcacuccagccugggcaacaa

SEQ ID NO: 333054 - RNA, 32 nt, Human
aucgugccacugcacuccagccugggcaacag

SEQ ID NO: 333055 - RNA, 32 nt, Human
aucgugccacugcacuccagccugggcaccac

SEQ ID NO: 333056 - RNA, 32 nt, Human
aucgugccacugcacuccagccugggcaccag

SEQ ID NO: 333057 - RNA, 32 nt, Human
aucgugccacugcacuccagccugggccacag

SEQ ID NO: 333058 - RNA, 32 nt, Human
aucgugccacugcacuccagccugggcgacaa

SEQ ID NO: 333059 - RNA, 32 nt, Human
aucgugccacugcacuccagccugggcgacag

SEQ ID NO: 333060 - RNA, 32 nt, Human
aucgugccacugcacuccagccugggcgacga

SEQ ID NO: 333061 - RNA, 32 nt, Human
aucgugccacugcacuccagccugggcuacaa

SEQ ID NO: 333062 - RNA, 32 nt, Human
aucgugccacugcacuccagccuggggaacag

SEQ ID NO: 333063 - RNA, 32 nt, Human
aucgugccacugcacuccagccugggggacag

SEQ ID NO: 333064 - RNA, 32 nt, Human
aucgugccacugcacuccagccugggugacaa

SEQ ID NO: 333065 - RNA, 32 nt, Human
aucgugccacugcacuccagccugggugacac

SEQ ID NO: 333066 - RNA, 32 nt, Human
aucgugccacugcacuccagccugggugacag

SEQ ID NO: 333067 - RNA, 32 nt, Human
aucgugccacugcacuccagccugggugauag

SEQ ID NO: 333068 - RNA, 32 nt, Human
aucgugccacugcacuccagccuggguggaca

SEQ ID NO: 333069 - RNA, 32 nt, Human
aucgugccacugcacuccagccuggucaacag

SEQ ID NO: 333070 - RNA, 32 nt, Human
aucgugccacugcacuccagccuggugacaga

SEQ ID NO: 333071 - RNA, 32 nt, Human
aucgugccacugcacuccagccuggugagagc

SEQ ID NO: 333072 - RNA, 32 nt, Human
aucgugccacugcacuccagccugguugacag

SEQ ID NO: 333073 - RNA, 32 nt, Human
aucgugccacugcacuccagccuugagacaga

SEQ ID NO: 333074 - RNA, 32 nt, Human
aucgugccacugcacuccagccuuggugacag

SEQ ID NO: 333075 - RNA, 32 nt, Human
aucgugccacugcacuccagcuugggcaacaa

SEQ ID NO: 333076 - RNA, 32 nt, Human
aucgugccacugcacuccaggcugggcgacag

SEQ ID NO: 333077 - RNA, 32 nt, Human
aucgugccacugcacuccaggcugggugacag

SEQ ID NO: 333078 - RNA, 32 nt, Human
aucgugccacugcacuccagucugggcaacag

SEQ ID NO: 333079 - RNA, 32 nt, Human
aucgugccacugcacuccagucugggugacag

SEQ ID NO: 333080 - RNA, 32 nt, Human
aucgugccacugcacuccauccuggacgacag

SEQ ID NO: 333081 - RNA, 32 nt, Human
aucgugccacugcacucccagccugggcaacg

SEQ ID NO: 333082 - RNA, 32 nt, Human
aucgugccacugcacuccggccugggugaugg

SEQ ID NO: 333083 - RNA, 32 nt, Human
aucgugccacugcacucuagccggggcgacag

SEQ ID NO: 333084 - RNA, 32 nt, Human
aucgugccacugcacucuagccugggcgacag

SEQ ID NO: 333085 - RNA, 32 nt, Human
aucgugccacugcacucuagccugggugacag

SEQ ID NO: 333086 - RNA, 32 nt, Human
aucgugccacugcacucuauccuggguaacag

SEQ ID NO: 333087 - RNA, 32 nt, Human
aucgugccacugcacuucagccugggugacag

SEQ ID NO: 333088 - RNA, 32 nt, Human
aucgugccacugcaguccagccuaggcaacag

SEQ ID NO: 333089 - RNA, 32 nt, Human
aucgugccacugcauuccagccugagcgacag

SEQ ID NO: 333090 - RNA, 32 nt, Human
aucgugccacugcauuccagccugggagagag

SEQ ID NO: 333091 - RNA, 32 nt, Human
aucgugccacugcauuccagccugggcgacag

SEQ ID NO: 333092 - RNA, 32 nt, Human
aucgugccacugcauuccagccugggugacag

SEQ ID NO: 333093 - RNA, 32 nt, Human
aucgugccacugcauuccagccugguugacag

SEQ ID NO: 333094 - RNA, 32 nt, Human
aucgugccacugcgcuccagccugggugacag

SEQ ID NO: 333095 - RNA, 32 nt, Human
aucgugccacugcgcuccagccuggguggcag

SEQ ID NO: 333096 - RNA, 32 nt, Human
aucgugccacugcucuccagccugggugacag

SEQ ID NO: 333097 - RNA, 32 nt, Human
aucgugccacuguacaucaccagccugggcga

SEQ ID NO: 333098 - RNA, 32 nt, Human
aucgugccacuguacucuagccuggaagacag

SEQ ID NO: 333099 - RNA, 32 nt, Human
aucgugccacuucacuccagccugggcaaaag

SEQ ID NO: 333100 - RNA, 32 nt, Human
aucgugccagugcacuccagccugggugacag

SEQ ID NO: 333101 - RNA, 32 nt, Human
aucgugccauuacacuccagccugggcgaaag

SEQ ID NO: 333102 - RNA, 32 nt, Human
aucgugccauuccacuccagccugggcaacga

SEQ ID NO: 333103 - RNA, 32 nt, Human
aucgugccauugcacuacagccugggcaacaa

SEQ ID NO: 333104 - RNA, 32 nt, Human
aucgugccauugcacuccagcccggaugacag

SEQ ID NO: 333105 - RNA, 32 nt, Human
aucgugccauugcacuccagccuaggcaacaa

SEQ ID NO: 333106 - RNA, 32 nt, Human
aucgugccauugcacuccagccuaggcaagaa

SEQ ID NO: 333107 - RNA, 32 nt, Human
aucgugccauugcacuccagccuaggcaauaa

SEQ ID NO: 333108 - RNA, 32 nt, Human
aucgugccauugcacuccagccuggaugacaa

SEQ ID NO: 333109 - RNA, 32 nt, Human
aucgugccauugcacuccagccuggccacaga

SEQ ID NO: 333110 - RNA, 32 nt, Human
aucgugccauugcacuccagccuggcgacaag

SEQ ID NO: 333111 - RNA, 32 nt, Human
aucgugccauugcacuccagccuggcgacaga

SEQ ID NO: 333112 - RNA, 32 nt, Human
aucgugccauugcacuccagccugggcaacaa

SEQ ID NO: 333113 - RNA, 32 nt, Human
aucgugccauugcacuccagccugggcaacag

SEQ ID NO: 333114 - RNA, 32 nt, Human
aucgugccauugcacuccagccugggcaauag

SEQ ID NO: 333115 - RNA, 32 nt, Human
aucgugccauugcacuccagccugggcgacaa

SEQ ID NO: 333116 - RNA, 32 nt, Human
aucgugccauugcacuccagccugggugacag

SEQ ID NO: 333117 - RNA, 32 nt, Human
aucgugccauugcacuccagucugggagacaa

SEQ ID NO: 333118 - RNA, 32 nt, Human
aucgugccauugcacuccagucuggguaagaa

SEQ ID NO: 333119 - RNA, 32 nt, Human
aucgugccauugcacuccggccugggcaacaa

SEQ ID NO: 333120 - RNA, 32 nt, Human
aucgugccauugcauuccagccugggagacgg

SEQ ID NO: 333121 - RNA, 32 nt, Human
aucgugccauugcgcuccagccuaggugacag

SEQ ID NO: 333122 - RNA, 32 nt, Human
aucgugccauugcgcuccagccugggcaacaa

SEQ ID NO: 333123 - RNA, 32 nt, Human
aucgugccauugugcuccagccugggcaacaa

SEQ ID NO: 333124 - RNA, 32 nt, Human
aucgugccauugugcuccagccugggcaacag

SEQ ID NO: 333125 - RNA, 32 nt, Human
aucgugcccaggaggcgagaaagggcugggcg

SEQ ID NO: 333126 - RNA, 32 nt, Human
aucgugccgcugcauccagccugagcaacaga

SEQ ID NO: 333127 - RNA, 32 nt, Human
aucgugccguugcacuccagccugggcaacaa

SEQ ID NO: 333128 - RNA, 32 nt, Human
aucgugccguugcacuccagccugggcgacaa

SEQ ID NO: 333129 - RNA, 32 nt, Human
aucgugccucugcacuccaaccugggugaugg

SEQ ID NO: 333130 - RNA, 32 nt, Human
aucgugccuguacuguacuccagccugggaaa

SEQ ID NO: 333131 - RNA, 32 nt, Human
aucgugcuacugcacuccagccccagcugggu

SEQ ID NO: 333132 - RNA, 32 nt, Human
aucgugcuacugcacuccagccugggcaacac

SEQ ID NO: 333133 - RNA, 32 nt, Human
aucgugcuacugcacuccagccugggggacag

SEQ ID NO: 333134 - RNA, 32 nt, Human
aucgugcuacugcacuccagucugggugacag

SEQ ID NO: 333135 - RNA, 32 nt, Human
aucgugcuacugcaguccagccugggcuacag

SEQ ID NO: 333136 - RNA, 32 nt, Human
aucgugcuauugcacuccagccugggcgacag

SEQ ID NO: 333137 - RNA, 32 nt, Human
aucgugcugcagcuggacgacauccagcaugc

SEQ ID NO: 333138 - RNA, 32 nt, Human
aucgugcugcugcacuccagccugggcaauag

SEQ ID NO: 333139 - RNA, 32 nt, Human
aucguggccacugcaauccagccugggcgaua

SEQ ID NO: 333140 - RNA, 32 nt, Human
aucguggcucacugaagccuccgcuuccuggg

SEQ ID NO: 333141 - RNA, 32 nt, Human
aucguggcucacugcagccuccaucucccggg

SEQ ID NO: 333142 - RNA, 32 nt, Human
aucgugggcaucuccccuuaugauuacuaaau

SEQ ID NO: 333143 - RNA, 32 nt, Human
aucgugggcuugggggacagcaagaaagcugc

SEQ ID NO: 333144 - RNA, 32 nt, Human
aucgugguggggugggacaggaguauaguugu

SEQ ID NO: 333145 - RNA, 32 nt, Human
aucgugucacuacacuccaggcugggugacag

SEQ ID NO: 333146 - RNA, 32 nt, Human
aucgugucacugcacuccagccuggcgacaga

SEQ ID NO: 333147 - RNA, 32 nt, Human
aucgugucacugcacuccagccugggcgacag

SEQ ID NO: 333148 - RNA, 32 nt, Human
aucgugucacugcacuccagccugggugacaa

SEQ ID NO: 333149 - RNA, 32 nt, Human
aucgugucacugcacuccagccuggugacaga

SEQ ID NO: 333150 - RNA, 32 nt, Human
aucgugucagugcacggcuagccugggcaaca

SEQ ID NO: 333151 - RNA, 32 nt, Human
aucgugucuggcccaaucucugugucaucauu

SEQ ID NO: 333152 - RNA, 32 nt, Human
aucguguucaccacuguaugccaaggcuuuuc

SEQ ID NO: 333153 - RNA, 32 nt, Human
aucguguucccugagagacgcccucaaauuuu

SEQ ID NO: 333154 - RNA, 32 nt, Human
aucguguugacagcaaagaaacagagugcuaa

SEQ ID NO: 333155 - RNA, 32 nt, Human
aucguuaaagaaucuggagugaagcacaaggg

SEQ ID NO: 333156 - RNA, 32 nt, Human
aucguuaaagcugaaggaagaggaucaccuuc

SEQ ID NO: 333157 - RNA, 32 nt, Human
aucguuacaguuggagaggauggucgaauaaa

SEQ ID NO: 333158 - RNA, 32 nt, Human
aucguucggggcgcaguccucuccccggcugg

SEQ ID NO: 333159 - RNA, 21 nt, Human
aucguucugcacuucagcuuc

SEQ ID NO: 333160 - RNA, 23 nt, Human
aucguucuggaaagccucacuuc

SEQ ID NO: 333161 - RNA, 21 nt, Human
aucguucuuaacacgcauuuc

SEQ ID NO: 333162 - RNA, 32 nt, Human
aucguuucucaggcugcccaaggcucuucugu

SEQ ID NO: 333163 - RNA, 32 nt, Human
aucguuugaacccaggaggcggagguugcagu

SEQ ID NO: 333164 - RNA, 32 nt, Human
aucguuugaacccaggaggcugagguugcagu

SEQ ID NO: 333165 - RNA, 32 nt, Human
aucguuugaacccgggaagcggagguugcagg

SEQ ID NO: 333166 - RNA, 32 nt, Human
aucguuugaacccgggaggcggaggcugcagu

SEQ ID NO: 333167 - RNA, 32 nt, Human
aucguuugagcucaggagguugggucugcagu

SEQ ID NO: 333168 - RNA, 32 nt, Human
aucguuuguacccagagucggcauggccaccu

SEQ ID NO: 333169 - RNA, 32 nt, Human
aucguuuuacaugucacaccuaacucaacaua

SEQ ID NO: 333170 - RNA, 32 nt, Human
aucuaaaaagcccaguggcucuuuaguuuggc

SEQ ID NO: 333171 - RNA, 32 nt, Human
aucuaaaaauuagcugggcacaguggcucccu

SEQ ID NO: 333172 - RNA, 32 nt, Human
aucuaaaaauuagcugggugugguggugcaug

SEQ ID NO: 333173 - RNA, 32 nt, Human
aucuaaaaucauagcccuuucuugucacugcu

SEQ ID NO: 333174 - RNA, 32 nt, Human
aucuaaaauguucuguuucuagugccaguucu

SEQ ID NO: 333175 - RNA, 32 nt, Human
aucuaaacaggccuugcugggcuucccagcuc

SEQ ID NO: 333176 - RNA, 32 nt, Human
aucuaaaccugaaaaaugaauugauauucuga

SEQ ID NO: 333177 - RNA, 32 nt, Human
aucuaaagcaauagacuagaacugaauuaucu

SEQ ID NO: 333178 - RNA, 32 nt, Human
aucuaaaggauaagcacagugccuaauguaca

SEQ ID NO: 333179 - RNA, 32 nt, Human
aucuaaauggggacaaggcagguggaggggag

SEQ ID NO: 333180 - RNA, 32 nt, Human
aucuaacagacauaccugcagcuuuggcucuu

SEQ ID NO: 333181 - RNA, 32 nt, Human
aucuaaccaagauaugcaaaagaugcauucag

SEQ ID NO: 333182 - RNA, 32 nt, Human
aucuaaccggcucccucgccagucccgggggc

SEQ ID NO: 333183 - RNA, 32 nt, Human
aucuaacgggacuagggugggauagggaggaa

SEQ ID NO: 333184 - RNA, 32 nt, Human
aucuaacucaagcugaucgucuugcccucuau

SEQ ID NO: 333185 - RNA, 32 nt, Human
aucuaacugcgcucccccaaccccucgcccug

SEQ ID NO: 333186 - RNA, 32 nt, Human
aucuaacuugagccucacaguaacccuguaaa

SEQ ID NO: 333187 - RNA, 32 nt, Human
aucuaagaagcagagguugcagugagcugaga

SEQ ID NO: 333188 - RNA, 32 nt, Human
aucuaagacuccaaggcaccaaggucucuucu

SEQ ID NO: 333189 - RNA, 32 nt, Human
aucuaagagagagguuaaucacacuauagagg

SEQ ID NO: 333190 - RNA, 32 nt, Human
aucuaagaucuuugaacaccuggaccuuuaca

SEQ ID NO: 333191 - RNA, 32 nt, Human
aucuaagcagagggaaguaaaccucucaccgc

SEQ ID NO: 333192 - RNA, 32 nt, Human
aucuaagcaguuuucacccccucagaaaccac

SEQ ID NO: 333193 - RNA, 32 nt, Human
aucuaagcauuuuuguucucagcuucacagag

SEQ ID NO: 333194 - RNA, 32 nt, Human
aucuaagcucuuguaagugaguuaauuuaaaa

SEQ ID NO: 333195 - RNA, 32 nt, Human
aucuaagcuggcagaggcagggagagagaaac

SEQ ID NO: 333196 - RNA, 30 nt, Human
aucuaaggaugucacagggccaacuugagg

SEQ ID NO: 333197 - RNA, 32 nt, Human
aucuaaggcccacguaaccagucguuucaaau

SEQ ID NO: 333198 - RNA, 32 nt, Human
aucuaaggggucuggggaguccugcccugcaa

SEQ ID NO: 333199 - RNA, 22 nt, Human
aucuaaggucacugcaagcucc

SEQ ID NO: 333200 - RNA, 32 nt, Human
aucuaaggugguaguucucuacucacaucuuu

SEQ ID NO: 333201 - RNA, 32 nt, Human
aucuaaguaaaauguuuugaaguuuaucagaa

SEQ ID NO: 333202 - RNA, 32 nt, Human
aucuaaguaaacauguauuacucaaaguaaua

SEQ ID NO: 333203 - RNA, 32 nt, Human
aucuaaguucccagaggguuuguuuauuucua

SEQ ID NO: 333204 - RNA, 32 nt, Human
aucuaauaaaagucuaguuuaaaagaggagcg

SEQ ID NO: 333205 - RNA, 32 nt, Human
aucuaaucuuucucauaauuaucuccuucuag

SEQ ID NO: 333206 - RNA, 32 nt, Human
aucuaaugagccuguccggagcagaacacccc

SEQ ID NO: 333207 - RNA, 32 nt, Human
aucuaaugcauccuauauccaguaaguagaau

SEQ ID NO: 333208 - RNA, 32 nt, Human
aucuaaugccucugcugaucugccaggaggag

SEQ ID NO: 333209 - RNA, 32 nt, Human
aucuaauggaaaggagaguugacugaaguugg

SEQ ID NO: 333210 - RNA, 32 nt, Human
aucuaauuaaauggcaucagcacuuuaaccaa

SEQ ID NO: 333211 - RNA, 32 nt, Human
aucuaauuacuuuuauauuaaagccacuucca

SEQ ID NO: 333212 - RNA, 32 nt, Human
aucuaauugauacaauuguagaacaaaauguc

SEQ ID NO: 333213 - RNA, 32 nt, Human
aucuaauuucauccucaccccacccuccaggg

SEQ ID NO: 333214 - RNA, 32 nt, Human
aucuaauuucucuuggcagauuugcauauuuc

SEQ ID NO: 333215 - RNA, 32 nt, Human
aucuacaauuaaacaauauuuccucuuggccg

SEQ ID NO: 333216 - RNA, 32 nt, Human
aucuacacguacuccggccuuuucuguguggu

SEQ ID NO: 333217 - RNA, 32 nt, Human
aucuacacucaguuucauuacagggaaggaac

SEQ ID NO: 333218 - RNA, 32 nt, Human
aucuacacuccuuucucaaggcugacuuugua

SEQ ID NO: 333219 - RNA, 32 nt, Human
aucuacacugauuuuggacuguuaccuaaguu

SEQ ID NO: 333220 - RNA, 32 nt, Human
aucuacacugcugcccacuccucucuccagcu

SEQ ID NO: 333221 - RNA, 32 nt, Human
aucuacagagcagcaagucuccccacuccacc

SEQ ID NO: 333222 - RNA, 32 nt, Human
aucuacagagcauccacugaacaacauacauu

SEQ ID NO: 333223 - RNA, 32 nt, Human
aucuacagcacugguguaaaagaagggucugc

SEQ ID NO: 333224 - RNA, 32 nt, Human
aucuacaggagagagacugagaggaagaaggc

SEQ ID NO: 333225 - RNA, 32 nt, Human
aucuacauccaccauuuguuaugcaguguucc

SEQ ID NO: 333226 - RNA, 32 nt, Human
aucuaccaggugcagggaagcacuccacaccc

SEQ ID NO: 333227 - RNA, 32 nt, Human
aucuaccaugaagaaggucaagaagaaaaggu

SEQ ID NO: 333228 - RNA, 32 nt, Human
aucuacccaagaaacaugaacacagggaguca

SEQ ID NO: 333229 - RNA, 32 nt, Human
aucuacccaagaaggcucggcacgggcaccaa

SEQ ID NO: 333230 - RNA, 32 nt, Human
aucuacccuccacggcccugaggccuuaucag

SEQ ID NO: 333231 - RNA, 32 nt, Human
aucuaccucugccucucucuuauaaggacacu

SEQ ID NO: 333232 - RNA, 32 nt, Human
aucuacgacagaaacauagcuacaaacgacuu

SEQ ID NO: 333233 - RNA, 32 nt, Human
aucuacggaguccaccccucccucucuagaac

SEQ ID NO: 333234 - RNA, 32 nt, Human
aucuacguaacagaagccuuaaccaucagaac

SEQ ID NO: 333235 - RNA, 32 nt, Human
aucuacguuguugcuuucuaaaaugaauguga

SEQ ID NO: 333236 - RNA, 32 nt, Human
aucuacuaaaaauacaaaaauuagccaggcau

SEQ ID NO: 333237 - RNA, 32 nt, Human
aucuacuaaaaauacaaaaauuagccggacgu

SEQ ID NO: 333238 - RNA, 32 nt, Human
aucuacuaaaaauacaaaaauuagccgggcau

SEQ ID NO: 333239 - RNA, 32 nt, Human
aucuacuaaaaauacaaaaauuagucaacugc

SEQ ID NO: 333240 - RNA, 28 nt, Human
aucuacuaaaauacaaaaauuagccggg

SEQ ID NO: 333241 - RNA, 32 nt, Human
aucuacuaaaguacaaaggaauucuuuggaag

SEQ ID NO: 333242 - RNA, 32 nt, Human
aucuacuauuuuuauauacgguguauuccucu

SEQ ID NO: 333243 - RNA, 32 nt, Human
aucuacucaccauccuuccucagcacaccccc

SEQ ID NO: 333244 - RNA, 32 nt, Human
aucuacucccccaagugacuccaggugccccc

SEQ ID NO: 333245 - RNA, 32 nt, Human
aucuacucuccucaucucuaacagcucaggau

SEQ ID NO: 333246 - RNA, 32 nt, Human
aucuacucuuauacugacauucccaguaaaac

SEQ ID NO: 333247 - RNA, 32 nt, Human
aucuacugaacaaauauugggauaacuccaaa

SEQ ID NO: 333248 - RNA, 32 nt, Human
aucuacugaggaccauccuggagccucacgcu

SEQ ID NO: 333249 - RNA, 32 nt, Human
aucuacugaggcaggagaauugcuugacccag

SEQ ID NO: 333250 - RNA, 32 nt, Human
aucuacuugugagcuaucugccccaggcaggc

SEQ ID NO: 333251 - RNA, 32 nt, Human
aucuacuuucucuauaaauuugcccuuucugg

SEQ ID NO: 333252 - RNA, 32 nt, Human
aucuacuuuuccacuccagagugggaaaaauu

SEQ ID NO: 333253 - RNA, 32 nt, Human
aucuagaaaagcuuucacauugaagaucaacu

SEQ ID NO: 333254 - RNA, 32 nt, Human
aucuagaaacaugaaauuaguauuccaaagag

SEQ ID NO: 333255 - RNA, 32 nt, Human
aucuagaaaccagcagcuacuggcucaaauuc

SEQ ID NO: 333256 - RNA, 32 nt, Human
aucuagaaaguguggggaaacuuuaaacccaa

SEQ ID NO: 333257 - RNA, 32 nt, Human
aucuagaaaugagagacaucugaauggggcag

SEQ ID NO: 333258 - RNA, 32 nt, Human
aucuagaacagccuggucaacauggugaaacc

SEQ ID NO: 333259 - RNA, 32 nt, Human
aucuagaacagcuuccacuuuggcagugaggu

SEQ ID NO: 333260 - RNA, 32 nt, Human
aucuagaaccugggaaugugacuuuaauuugg

SEQ ID NO: 333261 - RNA, 32 nt, Human
aucuagaacuauacuguccaguaccauagccu

SEQ ID NO: 333262 - RNA, 32 nt, Human
aucuagaagacugucagcuuccaaacauuaau

SEQ ID NO: 333263 - RNA, 32 nt, Human
aucuagaagguaugggguagagcuugacaggg

SEQ ID NO: 333264 - RNA, 32 nt, Human
aucuagaaguaguaguuugauucugguuuccc

SEQ ID NO: 333265 - RNA, 32 nt, Human
aucuagaauccaugugacuugcagccuaccug

SEQ ID NO: 333266 - RNA, 32 nt, Human
aucuagacacgagggaaacagugcaaagcuag

SEQ ID NO: 333267 - RNA, 32 nt, Human
aucuagacacuagcgauuauguguuuucucug

SEQ ID NO: 333268 - RNA, 32 nt, Human
aucuagaccagggauccccaccccugggcugc

SEQ ID NO: 333269 - RNA, 32 nt, Human
aucuagacucacugcaaccuccaccuccugug

SEQ ID NO: 333270 - RNA, 32 nt, Human
aucuagagcccauguucuuuaacugcaacacu

SEQ ID NO: 333271 - RNA, 32 nt, Human
aucuagaguagguucauuccugggcuucacag

SEQ ID NO: 333272 - RNA, 32 nt, Human
aucuagauucuacauguuaccauugguuuauu

SEQ ID NO: 333273 - RNA, 32 nt, Human
aucuagcaaggacucuuucgugucacaccuua

SEQ ID NO: 333274 - RNA, 32 nt, Human
aucuagcaccagcauuucucucaccaggugaa

SEQ ID NO: 333275 - RNA, 32 nt, Human
aucuagccucaagcucuggcugaacuuugugg

SEQ ID NO: 333276 - RNA, 32 nt, Human
aucuagccugcccugccugccugcccugggcg

SEQ ID NO: 333277 - RNA, 32 nt, Human
aucuagcucacugcaacccugcaaccucugcc

SEQ ID NO: 333278 - RNA, 32 nt, Human
aucuaggaauuguugguguucaagagggagcu

SEQ ID NO: 333279 - RNA, 32 nt, Human
aucuaggacaugcagacucacugugagcgaga

SEQ ID NO: 333280 - RNA, 32 nt, Human
aucuaggagaggggagggcagagggggugagg

SEQ ID NO: 333281 - RNA, 32 nt, Human
aucuaggaggcagagguugcagugaacugaga

SEQ ID NO: 333282 - RNA, 32 nt, Human
aucuaggaggcugggagccaggugacaggaug

SEQ ID NO: 333283 - RNA, 32 nt, Human
aucuaggagguaagagagucagcuucaauacu

SEQ ID NO: 333284 - RNA, 32 nt, Human
aucuaggcacuuccuccagccucaggcagcca

SEQ ID NO: 333285 - RNA, 32 nt, Human
aucuaggcacuuuggaauuugaccucacagau

SEQ ID NO: 333286 - RNA, 32 nt, Human
aucuaggcagagugccuuagucagggaccacg

SEQ ID NO: 333287 - RNA, 32 nt, Human
aucuaggcucaccacaaccucugccuuccagg

SEQ ID NO: 333288 - RNA, 22 nt, Human
aucuaggcucacugcaaccucc

SEQ ID NO: 333289 - RNA, 32 nt, Human
aucuaggcucacugcaaccuccaccucccagg

SEQ ID NO: 333290 - RNA, 32 nt, Human
aucuaggcucacugcaaccuccuucucccagg

SEQ ID NO: 333291 - RNA, 32 nt, Human
aucuaggcucacugcaaccucugucuccaggg

SEQ ID NO: 333292 - RNA, 32 nt, Human
aucuaggcucacugcaaccuucaccgcccagg

SEQ ID NO: 333293 - RNA, 32 nt, Human
aucuaggcucacugcaacuuccgccucccggg

SEQ ID NO: 333294 - RNA, 32 nt, Human
aucuaggcuuaucuccuugucuugaaauccau

SEQ ID NO: 333295 - RNA, 32 nt, Human
aucuagggagacucaagagggagaagugacuc

SEQ ID NO: 333296 - RNA, 32 nt, Human
aucuaggggagccugggcugcgugcaugucga

SEQ ID NO: 333297 - RNA, 32 nt, Human
aucuaggucuacuccauuccuccuggcccacc

SEQ ID NO: 333298 - RNA, 32 nt, Human
aucuagguguccaccugcgucuguggaagaag

SEQ ID NO: 333299 - RNA, 32 nt, Human
aucuagguuauccaauucuuugauauguaauu

SEQ ID NO: 333300 - RNA, 32 nt, Human
aucuagucagugucucuggguuuugguagcag

SEQ ID NO: 333301 - RNA, 32 nt, Human
aucuagucuugaccucuccagcaucccagccu

SEQ ID NO: 333302 - RNA, 32 nt, Human
aucuagugagggagacaggugcagaugaggug

SEQ ID NO: 333303 - RNA, 32 nt, Human
aucuagugcauggaccuccuuguugacugcug

SEQ ID NO: 333304 - RNA, 23 nt, Human
aucuagugcucacaugaucugaa

SEQ ID NO: 333305 - RNA, 32 nt, Human
aucuaguggaaagacaagacagauaacagaua

SEQ ID NO: 333306 - RNA, 32 nt, Human
aucuaguggaggacagggcaagggaggaaaga

SEQ ID NO: 333307 - RNA, 32 nt, Human
aucuaguggggauguggagaaccuuugugucu

SEQ ID NO: 333308 - RNA, 32 nt, Human
aucuagugugcucagggcuugguacaaugagc

SEQ ID NO: 333309 - RNA, 32 nt, Human
aucuaguguguaucugcuccucucggacugug

SEQ ID NO: 333310 - RNA, 32 nt, Human
aucuauaaaaugagagaaaauauuugcaaucc

SEQ ID NO: 333311 - RNA, 32 nt, Human
aucuauacagaaaugcugcuggaugaauggaa

SEQ ID NO: 333312 - RNA, 32 nt, Human
aucuauagaaaaguagagugagggugaauuua

SEQ ID NO: 333313 - RNA, 32 nt, Human
aucuauagacccaguaaugucauuuauagcua

SEQ ID NO: 333314 - RNA, 32 nt, Human
aucuauagccacagccugaagcuuugaccacu

SEQ ID NO: 333315 - RNA, 32 nt, Human
aucuauagguugucucugcuguucauuguuuc

SEQ ID NO: 333316 - RNA, 32 nt, Human
aucuauagugcauuuggcaugugcgucuuugg

SEQ ID NO: 333317 - RNA, 32 nt, Human
aucuauauaauagaaacgcacacacacgaaaa

SEQ ID NO: 333318 - RNA, 32 nt, Human
aucuauauguguauuauguauguaugugugca

SEQ ID NO: 333319 - RNA, 32 nt, Human
aucuauauuaaaaauaacaaaaauuagccagg

SEQ ID NO: 333320 - RNA, 32 nt, Human
aucuaucaaacugucugcauuagugcaauuaa

SEQ ID NO: 333321 - RNA, 32 nt, Human
aucuaucaaugcguggcagagaacagcacggg

SEQ ID NO: 333322 - RNA, 32 nt, Human
aucuaucacaccacugugcucuagccugggug

SEQ ID NO: 333323 - RNA, 32 nt, Human
aucuaucacccagucaugugcacugaauguuc

SEQ ID NO: 333324 - RNA, 32 nt, Human
aucuaucauaagcagaccuaagcacaguuuua

SEQ ID NO: 333325 - RNA, 32 nt, Human
aucuauccaauacauuaaggaaaagucccacu

SEQ ID NO: 333326 - RNA, 32 nt, Human
aucuaucugaagauggaggcuuaucggugagu

SEQ ID NO: 333327 - RNA, 32 nt, Human
aucuaucuggcuggcagggaaggaaagaacuu

SEQ ID NO: 333328 - RNA, 32 nt, Human
aucuaucugucuuugcaagcagucuucagguu

SEQ ID NO: 333329 - RNA, 28 nt, Human
aucuaucuuccuguagccucaucaaucc

SEQ ID NO: 333330 - RNA, 32 nt, Human
aucuaugaaggacagggagcagcucuggucug

SEQ ID NO: 333331 - RNA, 29 nt, Human
aucuaugacuccaggucuucagcacccac

SEQ ID NO: 333332 - RNA, 32 nt, Human
aucuaugacuuaucuaaucugccuaucaaucu

SEQ ID NO: 333333 - RNA, 32 nt, Human
aucuaugcagccaagcucagcacuuugucaca

SEQ ID NO: 333334 - RNA, 32 nt, Human
aucuaugcagccaagcucggcacuuuguagca

SEQ ID NO: 333335 - RNA, 32 nt, Human
aucuaugccccacuucuucucuugccucaccu

SEQ ID NO: 333336 - RNA, 32 nt, Human
aucuaugcucacuguagccuugaccuucuggg

SEQ ID NO: 333337 - RNA, 32 nt, Human
aucuauggcacugacuacaggccauguccagg

SEQ ID NO: 333338 - RNA, 32 nt, Human
aucuauggcugggcccuuccuucccucuucuu

SEQ ID NO: 333339 - RNA, 32 nt, Human
aucuaugggaagcagacaucugagggagcaaa

SEQ ID NO: 333340 - RNA, 32 nt, Human
aucuaugggaggaaacugaagcucaggaggcu

SEQ ID NO: 333341 - RNA, 32 nt, Human
aucuaugguuucauuccuccccuggcucuucu

SEQ ID NO: 333342 - RNA, 32 nt, Human
aucuauguagaauauaaaggaagccugaacca

SEQ ID NO: 333343 - RNA, 32 nt, Human
aucuaugucauauuuugccacugccuuucaga

SEQ ID NO: 333344 - RNA, 32 nt, Human
aucuaugucuucaagcagcagaaccuggagca

SEQ ID NO: 333345 - RNA, 32 nt, Human
aucuaugugggauauugaguauccauugaaau

SEQ ID NO: 333346 - RNA, 32 nt, Human
aucuauguuaucugaguauauguuuggguaac

SEQ ID NO: 333347 - RNA, 32 nt, Human
aucuauuaaaggcaauagccaauaaaacauuu

SEQ ID NO: 333348 - RNA, 32 nt, Human
aucuauuaaggaagaacaaggaagggaaugau

SEQ ID NO: 333349 - RNA, 32 nt, Human
aucuauuacugaggaaaaccagaggaagccug

SEQ ID NO: 333350 - RNA, 32 nt, Human
aucuauuauucccccgaauuucuugguuccuu

SEQ ID NO: 333351 - RNA, 32 nt, Human
aucuauucguuugagccugagacacucuuuga

SEQ ID NO: 333352 - RNA, 32 nt, Human
aucuauucucuccaaaaaugcacccaacuagc

SEQ ID NO: 333353 - RNA, 32 nt, Human
aucuauucucucugaagucuucuaccuggagg

SEQ ID NO: 333354 - RNA, 32 nt, Human
aucuauugacaugcccacaaaacagguuuauu

SEQ ID NO: 333355 - RNA, 31 nt, Human
aucuauugacuucucucuaugggagguuaga

SEQ ID NO: 333356 - RNA, 32 nt, Human
aucuauugagccagcagcuguuguaccuguua

SEQ ID NO: 333357 - RNA, 32 nt, Human
aucuauuguugacucacauuuagauugauucc

SEQ ID NO: 333358 - RNA, 32 nt, Human
aucuauuuaaagacauuuauauuaauuugaaa

SEQ ID NO: 333359 - RNA, 32 nt, Human
aucuauuucagguuguggcucuugguucuagg

SEQ ID NO: 333360 - RNA, 32 nt, Human
aucuauuuugaaucuguaaauauuuuaaaugu

SEQ ID NO: 333361 - RNA, 22 nt, Human
aucucaaaaacauuaaguugag

SEQ ID NO: 333362 - RNA, 32 nt, Human
aucucaaaagaaaagaaagaaagggaaguaga

SEQ ID NO: 333363 - RNA, 32 nt, Human
aucucaaacccugcauccauccuuccuccagc

SEQ ID NO: 333364 - RNA, 32 nt, Human
aucucaaagacguggauuuucauuucaguaag

SEQ ID NO: 333365 - RNA, 32 nt, Human
aucucaaagccaccagcguucuugccuagugu

SEQ ID NO: 333366 - RNA, 32 nt, Human
aucucaaauacaguacauuuacauuacuguag

SEQ ID NO: 333367 - RNA, 32 nt, Human
aucucaacucaccgcaaccuccgccucccggg

SEQ ID NO: 333368 - RNA, 32 nt, Human
aucucaacucaccgcaaccuccuccucuuggg

SEQ ID NO: 333369 - RNA, 22 nt, Human
aucucaacucacugcaaccucc

SEQ ID NO: 333370 - RNA, 32 nt, Human
aucucaacucacugcaaccuccacccgccggg

SEQ ID NO: 333371 - RNA, 24 nt, Human
aucucaacucacugcaaccucugc

SEQ ID NO: 333372 - RNA, 32 nt, Human
aucucaacucacugcaaccucugcccuucagg

SEQ ID NO: 333373 - RNA, 24 nt, Human
aucucaacucacugcaagcuccgc

SEQ ID NO: 333374 - RNA, 32 nt, Human
aucucaacucacugcaagcuccgccuccuggg

SEQ ID NO: 333375 - RNA, 32 nt, Human
aucucaacucauugcaaccuccaccugccggg

SEQ ID NO: 333376 - RNA, 22 nt, Human
aucucaagacuaucuuaagcua

SEQ ID NO: 333377 - RNA, 32 nt, Human
aucucaagacuccucccuuagcuacucaggag

SEQ ID NO: 333378 - RNA, 32 nt, Human
aucucaagccuugccuugucucugccucggaa

SEQ ID NO: 333379 - RNA, 32 nt, Human
aucucaagcgagcauaugaacugugugacaac

SEQ ID NO: 333380 - RNA, 32 nt, Human
aucucaaggaucuuccaugggaagaugugaca

SEQ ID NO: 333381 - RNA, 32 nt, Human
aucucaagugguaaguuguuugugcuuuaggc

SEQ ID NO: 333382 - RNA, 32 nt, Human
aucucaaguucuuccauuuucucccccacgag

SEQ ID NO: 333383 - RNA, 32 nt, Human
aucucaauaaaaggaaugcucuggcugcuggg

SEQ ID NO: 333384 - RNA, 32 nt, Human
aucucaaucucagcuacucgggaggcugaggc

SEQ ID NO: 333385 - RNA, 32 nt, Human
aucucaauguaagggugguuuggcaacaccuc

SEQ ID NO: 333386 - RNA, 32 nt, Human
aucucaauguagguaauaguucaugccauuca

SEQ ID NO: 333387 - RNA, 32 nt, Human
aucucacacagcaucggaaaauucauacugau

SEQ ID NO: 333388 - RNA, 32 nt, Human
aucucacagaagauguaugaaaagucauggcc

SEQ ID NO: 333389 - RNA, 32 nt, Human
aucucacaggagccugagaacuccuccuccug

SEQ ID NO: 333390 - RNA, 32 nt, Human
aucucacagggcuaucuucugcauuuaaagaa

SEQ ID NO: 333391 - RNA, 32 nt, Human
aucucaccacacugcuuuacagucuuccugaa

SEQ ID NO: 333392 - RNA, 32 nt, Human
aucucaccacuacacuccagccugggugacag

SEQ ID NO: 333393 - RNA, 32 nt, Human
aucucaccacugaacuccagccugggcgacag

SEQ ID NO: 333394 - RNA, 32 nt, Human
aucucaccacugcacuccagccugggcagcag

SEQ ID NO: 333395 - RNA, 32 nt, Human
aucucaccacuguacuccagccugggugacag

SEQ ID NO: 333396 - RNA, 32 nt, Human
aucucaccaugcacuccagccuagacaacagg

SEQ ID NO: 333397 - RNA, 32 nt, Human
aucucaccauuacacuccagccugggcgacaa

SEQ ID NO: 333398 - RNA, 32 nt, Human
aucucaccauugcacuccagccugggcgacug

SEQ ID NO: 333399 - RNA, 32 nt, Human
aucucaccccugcacuccagccugggcaacag

SEQ ID NO: 333400 - RNA, 32 nt, Human
aucucacccuguagacucacacacgacuccaa

SEQ ID NO: 333401 - RNA, 32 nt, Human
aucucaccgggcggcacuggccagcgccagcc

SEQ ID NO: 333402 - RNA, 24 nt, Human
aucucaccucacugcaaccuccgc

SEQ ID NO: 333403 - RNA, 32 nt, Human
aucucaccucacugcaaccuccgccuccuggg

SEQ ID NO: 333404 - RNA, 32 nt, Human
aucucaccucacugcaaccucugccucccggg

SEQ ID NO: 333405 - RNA, 32 nt, Human
aucucaccucacugcaagcucugccucccggg

SEQ ID NO: 333406 - RNA, 32 nt, Human
aucucaccuccaccagaccuccggacuaccug

SEQ ID NO: 333407 - RNA, 32 nt, Human
aucucaccuuacugcaaccaccacuuccuggg

SEQ ID NO: 333408 - RNA, 32 nt, Human
aucucacgccuguagucccagcacuuugggag

SEQ ID NO: 333409 - RNA, 32 nt, Human
aucucacggaccauccggucaccagaagugaa

SEQ ID NO: 333410 - RNA, 32 nt, Human
aucucacuccaccccacuuugucccugauguc

SEQ ID NO: 333411 - RNA, 32 nt, Human
aucucacuccaucacucaggcuggaguacagu

SEQ ID NO: 333412 - RNA, 32 nt, Human
aucucacugcaaccuccaccucccagguucaa

SEQ ID NO: 333413 - RNA, 32 nt, Human
aucucacugcaaccuccaucuccugucucagc

SEQ ID NO: 333414 - RNA, 32 nt, Human
aucucacugcaaccuccgccuuccaguugcaa

SEQ ID NO: 333415 - RNA, 32 nt, Human
aucucacugcaaccucugccucccgggcuuga

SEQ ID NO: 333416 - RNA, 32 nt, Human
aucucacugcaagcuccacuuccuggguucau

SEQ ID NO: 333417 - RNA, 32 nt, Human
aucucacugcaagcucugccucccagguucac

SEQ ID NO: 333418 - RNA, 32 nt, Human
aucucacugcauccuccgccucccggguucaa

SEQ ID NO: 333419 - RNA, 32 nt, Human
aucucacuggacugcagacccggccugguggg

SEQ ID NO: 333420 - RNA, 32 nt, Human
aucucacuggcuuaggacucagucccacaaga

SEQ ID NO: 333421 - RNA, 32 nt, Human
aucucacugucucccaggcuggaauguagggu

SEQ ID NO: 333422 - RNA, 32 nt, Human
aucucacuguugccuugaacuccugggcucaa

SEQ ID NO: 333423 - RNA, 21 nt, Human
aucucacuuaauucucuauga

SEQ ID NO: 333424 - RNA, 32 nt, Human
aucucacuucuucacauuuaccaaaaugucua

SEQ ID NO: 333425 - RNA, 32 nt, Human
aucucacuuuucuaauuuacaggcuggaacag

SEQ ID NO: 333426 - RNA, 32 nt, Human
aucucagaauguccccaccaauccccgccaca

SEQ ID NO: 333427 - RNA, 24 nt, Human
aucucagacagugaaagugaaaug

SEQ ID NO: 333428 - RNA, 22 nt, Human
aucucagacagugacugaaaug

SEQ ID NO: 333429 - RNA, 32 nt, Human
aucucagagaaugcggacuccuauguucaugu

SEQ ID NO: 333430 - RNA, 32 nt, Human
aucucagauauaacaugucuucuuuccauugg

SEQ ID NO: 333431 - RNA, 32 nt, Human
aucucagaucacugcaaccuccaccucccagg

SEQ ID NO: 333432 - RNA, 32 nt, Human
aucucagaucacugcaaccucugccucccggg

SEQ ID NO: 333433 - RNA, 32 nt, Human
aucucagaucacugcaaccucugccuccuggg

SEQ ID NO: 333434 - RNA, 22 nt, Human
aucucagauugugagguaaaug

SEQ ID NO: 333435 - RNA, 25 nt, Human
aucucagauuguggggguguggaug

SEQ ID NO: 333436 - RNA, 32 nt, Human
aucucagcacuuugggaggcucaggcgggagg

SEQ ID NO: 333437 - RNA, 32 nt, Human
aucucagccagaaaaaccaacuccucaucuug

SEQ ID NO: 333438 - RNA, 24 nt, Human
aucucagccagagagagugaacug

SEQ ID NO: 333439 - RNA, 32 nt, Human
aucucagccagcccugcucucucccucuuccc

SEQ ID NO: 333440 - RNA, 32 nt, Human
aucucagccagccuccagcaccuucccucuca

SEQ ID NO: 333441 - RNA, 32 nt, Human
aucucagccccaugggcucuaauugauuggga

SEQ ID NO: 333442 - RNA, 22 nt, Human
aucucagccccugcagcucugc

SEQ ID NO: 333443 - RNA, 32 nt, Human
aucucagcccucucaggagcagucuuccauca

SEQ ID NO: 333444 - RNA, 32 nt, Human
aucucagccugagacgcacagagaggucucuu

SEQ ID NO: 333445 - RNA, 32 nt, Human
aucucagcggcauuaagcugugccugagcgag

SEQ ID NO: 333446 - RNA, 31 nt, Human
aucucagcuacucaggagguugaggcaggag

SEQ ID NO: 333447 - RNA, 32 nt, Human
aucucagcuacuugggagacugaggcaggaga

SEQ ID NO: 333448 - RNA, 32 nt, Human
aucucagcuacuugggaggcugggcagaagaa

SEQ ID NO: 333449 - RNA, 32 nt, Human
aucucagcucacagcaaccuccgccucccagg

SEQ ID NO: 333450 - RNA, 32 nt, Human
aucucagcucacagcaaccuccgccucccggg

SEQ ID NO: 333451 - RNA, 32 nt, Human
aucucagcucacagcaaccucugccuccuggg

SEQ ID NO: 333452 - RNA, 32 nt, Human
aucucagcucaccaaaucucugccucccaggc

SEQ ID NO: 333453 - RNA, 32 nt, Human
aucucagcucaccacaaccucugccuccccgg

SEQ ID NO: 333454 - RNA, 32 nt, Human
aucucagcucaccgcaaccuccaccuccaggg

SEQ ID NO: 333455 - RNA, 32 nt, Human
aucucagcucaccgcaaccuccaccuccuggg

SEQ ID NO: 333456 - RNA, 32 nt, Human
aucucagcucaccgcaaccuccacucgcaggu

SEQ ID NO: 333457 - RNA, 32 nt, Human
aucucagcucaccgcaaccuccgccucccggg

SEQ ID NO: 333458 - RNA, 32 nt, Human
aucucagcucaccgcaaccucugccucccaga

SEQ ID NO: 333459 - RNA, 32 nt, Human
aucucagcucacggcaaccuccgccucccggg

SEQ ID NO: 333460 - RNA, 32 nt, Human
aucucagcucacuacaaccuccgccucccaug

SEQ ID NO: 333461 - RNA, 32 nt, Human
aucucagcucacuacaaccucugccacuggga

SEQ ID NO: 333462 - RNA, 32 nt, Human
aucucagcucacuacaaccucugccucccagg

SEQ ID NO: 333463 - RNA, 32 nt, Human
aucucagcucacuacaaccucugccuucuggu

SEQ ID NO: 333464 - RNA, 22 nt, Human
aucucagcucacuacaagcucc

SEQ ID NO: 333465 - RNA, 32 nt, Human
aucucagcucacuacaagcuccccuucccagg

SEQ ID NO: 333466 - RNA, 32 nt, Human
aucucagcucacucugcaaccuccacuuccca

SEQ ID NO: 333467 - RNA, 32 nt, Human
aucucagcucacugaagccucgaccuccagaa

SEQ ID NO: 333468 - RNA, 32 nt, Human
aucucagcucacugcaaacuccaccucccagg

SEQ ID NO: 333469 - RNA, 24 nt, Human
aucucagcucacugcaaacucugc

SEQ ID NO: 333470 - RNA, 32 nt, Human
aucucagcucacugcaaacucugccucccgaa

SEQ ID NO: 333471 - RNA, 32 nt, Human
aucucagcucacugcaacaccgccucccgggu

SEQ ID NO: 333472 - RNA, 32 nt, Human
aucucagcucacugcaacauccaccuccuggg

SEQ ID NO: 333473 - RNA, 24 nt, Human
aucucagcucacugcaacauccgc

SEQ ID NO: 333474 - RNA, 32 nt, Human
aucucagcucacugcaacauccgccucugggg

SEQ ID NO: 333475 - RNA, 24 nt, Human
aucucagcucacugcaaccacugc

SEQ ID NO: 333476 - RNA, 32 nt, Human
aucucagcucacugcaaccacugccucccagg

SEQ ID NO: 333477 - RNA, 32 nt, Human
aucucagcucacugcaacccccgccuccuggg

SEQ ID NO: 333478 - RNA, 32 nt, Human
aucucagcucacugcaaccuacgccuucuggg

SEQ ID NO: 333479 - RNA, 21 nt, Human
aucucagcucacugcaaccuc

SEQ ID NO: 333480 - RNA, 22 nt, Human
aucucagcucacugcaaccucc

SEQ ID NO: 333481 - RNA, 32 nt, Human
aucucagcucacugcaaccuccaccucccaga

SEQ ID NO: 333482 - RNA, 32 nt, Human
aucucagcucacugcaaccuccaccucccagg

SEQ ID NO: 333483 - RNA, 32 nt, Human
aucucagcucacugcaaccuccaccucccggg

SEQ ID NO: 333484 - RNA, 32 nt, Human
aucucagcucacugcaaccuccaccucccugg

SEQ ID NO: 333485 - RNA, 32 nt, Human
aucucagcucacugcaaccuccaccuccgggu

SEQ ID NO: 333486 - RNA, 32 nt, Human
aucucagcucacugcaaccuccaccuccuggg

SEQ ID NO: 333487 - RNA, 32 nt, Human
aucucagcucacugcaaccuccaccucgcagg

SEQ ID NO: 333488 - RNA, 32 nt, Human
aucucagcucacugcaaccuccaccucucagg

SEQ ID NO: 333489 - RNA, 32 nt, Human
aucucagcucacugcaaccuccaccucuuaug

SEQ ID NO: 333490 - RNA, 32 nt, Human
aucucagcucacugcaaccuccaccuugcgug

SEQ ID NO: 333491 - RNA, 32 nt, Human
aucucagcucacugcaaccuccaucuccaggu

SEQ ID NO: 333492 - RNA, 32 nt, Human
aucucagcucacugcaaccuccaucucccgga

SEQ ID NO: 333493 - RNA, 32 nt, Human
aucucagcucacugcaaccuccaucuccugga

SEQ ID NO: 333494 - RNA, 32 nt, Human
aucucagcucacugcaaccucccccuccuggg

SEQ ID NO: 333495 - RNA, 24 nt, Human
aucucagcucacugcaaccuccgc

SEQ ID NO: 333496 - RNA, 32 nt, Human
aucucagcucacugcaaccuccgcaucccggg

SEQ ID NO: 333497 - RNA, 32 nt, Human
aucucagcucacugcaaccuccgcccccuggg

SEQ ID NO: 333498 - RNA, 32 nt, Human
aucucagcucacugcaaccuccgccucccaag

SEQ ID NO: 333499 - RNA, 32 nt, Human
aucucagcucacugcaaccuccgccucccagg

SEQ ID NO: 333500 - RNA, 32 nt, Human
aucucagcucacugcaaccuccgccucccggg

SEQ ID NO: 333501 - RNA, 32 nt, Human
aucucagcucacugcaaccuccgccuccugag

SEQ ID NO: 333502 - RNA, 32 nt, Human
aucucagcucacugcaaccuccgccuccuggg

SEQ ID NO: 333503 - RNA, 32 nt, Human
aucucagcucacugcaaccuccgccugcuggg

SEQ ID NO: 333504 - RNA, 24 nt, Human
aucucagcucacugcaaccuccgu

SEQ ID NO: 333505 - RNA, 32 nt, Human
aucucagcucacugcaaccuccgucuccaggg

SEQ ID NO: 333506 - RNA, 32 nt, Human
aucucagcucacugcaaccuccguuuccuggg

SEQ ID NO: 333507 - RNA, 32 nt, Human
aucucagcucacugcaaccuccuccucccggg

SEQ ID NO: 333508 - RNA, 32 nt, Human
aucucagcucacugcaaccuccuccuucuggg

SEQ ID NO: 333509 - RNA, 32 nt, Human
aucucagcucacugcaaccucgaccucuuggg

SEQ ID NO: 333510 - RNA, 24 nt, Human
aucucagcucacugcaaccucggc

SEQ ID NO: 333511 - RNA, 22 nt, Human
aucucagcucacugcaaccucu

SEQ ID NO: 333512 - RNA, 32 nt, Human
aucucagcucacugcaaccucuaccuccuggg

SEQ ID NO: 333513 - RNA, 32 nt, Human
aucucagcucacugcaaccucucucucccggg

SEQ ID NO: 333514 - RNA, 24 nt, Human
aucucagcucacugcaaccucugc

SEQ ID NO: 333515 - RNA, 32 nt, Human
aucucagcucacugcaaccucugccuccagag

SEQ ID NO: 333516 - RNA, 32 nt, Human
aucucagcucacugcaaccucugccucccagg

SEQ ID NO: 333517 - RNA, 32 nt, Human
aucucagcucacugcaaccucugccucccgga

SEQ ID NO: 333518 - RNA, 32 nt, Human
aucucagcucacugcaaccucugccucccggg

SEQ ID NO: 333519 - RNA, 32 nt, Human
aucucagcucacugcaaccucugccucccugg

SEQ ID NO: 333520 - RNA, 32 nt, Human
aucucagcucacugcaaccucugccuccugag

SEQ ID NO: 333521 - RNA, 32 nt, Human
aucucagcucacugcaaccucugccuccugga

SEQ ID NO: 333522 - RNA, 32 nt, Human
aucucagcucacugcaaccucugccuccuggg

SEQ ID NO: 333523 - RNA, 32 nt, Human
aucucagcucacugcaaccucugccuccuggu

SEQ ID NO: 333524 - RNA, 32 nt, Human
aucucagcucacugcaaccucugccuucugga

SEQ ID NO: 333525 - RNA, 32 nt, Human
aucucagcucacugcaaccucugcuucccggg

SEQ ID NO: 333526 - RNA, 32 nt, Human
aucucagcucacugcaaccucugucucccggg

SEQ ID NO: 333527 - RNA, 32 nt, Human
aucucagcucacugcaaccucugucuccuggg

SEQ ID NO: 333528 - RNA, 24 nt, Human
aucucagcucacugcaaccugugc

SEQ ID NO: 333529 - RNA, 32 nt, Human
aucucagcucacugcaaccugugccucccggc

SEQ ID NO: 333530 - RNA, 32 nt, Human
aucucagcucacugcaaccuucaccucccagg

SEQ ID NO: 333531 - RNA, 24 nt, Human
aucucagcucacugcaaccuuugu

SEQ ID NO: 333532 - RNA, 32 nt, Human
aucucagcucacugcaaccuuugucucccggg

SEQ ID NO: 333533 - RNA, 22 nt, Human
aucucagcucacugcaacgucc

SEQ ID NO: 333534 - RNA, 32 nt, Human
aucucagcucacugcaacguccaccuccuggg

SEQ ID NO: 333535 - RNA, 32 nt, Human
aucucagcucacugcaacguccaccucuugag

SEQ ID NO: 333536 - RNA, 24 nt, Human
aucucagcucacugcaacgucugc

SEQ ID NO: 333537 - RNA, 32 nt, Human
aucucagcucacugcaacgucugccucccggg

SEQ ID NO: 333538 - RNA, 22 nt, Human
aucucagcucacugcaacuucc

SEQ ID NO: 333539 - RNA, 32 nt, Human
aucucagcucacugcaacuuccaccucccagg

SEQ ID NO: 333540 - RNA, 24 nt, Human
aucucagcucacugcaacuuccgc

SEQ ID NO: 333541 - RNA, 32 nt, Human
aucucagcucacugcaacuuccgcaucccagg

SEQ ID NO: 333542 - RNA, 24 nt, Human
aucucagcucacugcaacuucugc

SEQ ID NO: 333543 - RNA, 32 nt, Human
aucucagcucacugcaacuucugccucccagg

SEQ ID NO: 333544 - RNA, 32 nt, Human
aucucagcucacugcaacuucugccuccuggg

SEQ ID NO: 333545 - RNA, 32 nt, Human
aucucagcucacugcaacuucugccuccuggu

SEQ ID NO: 333546 - RNA, 22 nt, Human
aucucagcucacugcaagcucc

SEQ ID NO: 333547 - RNA, 32 nt, Human
aucucagcucacugcaagcuccaacucccggg

SEQ ID NO: 333548 - RNA, 32 nt, Human
aucucagcucacugcaagcuccaccucccggg

SEQ ID NO: 333549 - RNA, 32 nt, Human
aucucagcucacugcaagcuccaccuuccggg

SEQ ID NO: 333550 - RNA, 24 nt, Human
aucucagcucacugcaagcuccgc

SEQ ID NO: 333551 - RNA, 32 nt, Human
aucucagcucacugcaagcuccgccucccagg

SEQ ID NO: 333552 - RNA, 32 nt, Human
aucucagcucacugcaagcuccgccucccggg

SEQ ID NO: 333553 - RNA, 32 nt, Human
aucucagcucacugcaagcuccgccuccuccc

SEQ ID NO: 333554 - RNA, 32 nt, Human
aucucagcucacugcaagcuccgccuccuggg

SEQ ID NO: 333555 - RNA, 22 nt, Human
aucucagcucacugcaagcucu

SEQ ID NO: 333556 - RNA, 32 nt, Human
aucucagcucacugcaagcucuaccucuuggu

SEQ ID NO: 333557 - RNA, 24 nt, Human
aucucagcucacugcaagcucugc

SEQ ID NO: 333558 - RNA, 32 nt, Human
aucucagcucacugcaagcucugccucccggg

SEQ ID NO: 333559 - RNA, 32 nt, Human
aucucagcucacugcaagcucugccucccgug

SEQ ID NO: 333560 - RNA, 32 nt, Human
aucucagcucacugcaagcucugccucucagg

SEQ ID NO: 333561 - RNA, 22 nt, Human
aucucagcucacugcaaucucc

SEQ ID NO: 333562 - RNA, 32 nt, Human
aucucagcucacugcaaucuccaccuccuggg

SEQ ID NO: 333563 - RNA, 32 nt, Human
aucucagcucacugcaaucuucaccuccuagg

SEQ ID NO: 333564 - RNA, 24 nt, Human
aucucagcucacugcacccuccgc

SEQ ID NO: 333565 - RNA, 32 nt, Human
aucucagcucacugcacccuccgccucucggg

SEQ ID NO: 333566 - RNA, 32 nt, Human
aucucagcucacugcacccuugaccucccaua

SEQ ID NO: 333567 - RNA, 24 nt, Human
aucucagcucacugcagccacugc

SEQ ID NO: 333568 - RNA, 32 nt, Human
aucucagcucacugcagccacugccucccagg

SEQ ID NO: 333569 - RNA, 32 nt, Human
aucucagcucacugcagcccccgccucccagg

SEQ ID NO: 333570 - RNA, 21 nt, Human
aucucagcucacugcagccuc

SEQ ID NO: 333571 - RNA, 32 nt, Human
aucucagcucacugcagccucaacugccccag

SEQ ID NO: 333572 - RNA, 22 nt, Human
aucucagcucacugcagccucc

SEQ ID NO: 333573 - RNA, 32 nt, Human
aucucagcucacugcagccuccaacucucugg

SEQ ID NO: 333574 - RNA, 32 nt, Human
aucucagcucacugcagccuccaccucccagg

SEQ ID NO: 333575 - RNA, 32 nt, Human
aucucagcucacugcagccuccacuuccuggg

SEQ ID NO: 333576 - RNA, 32 nt, Human
aucucagcucacugcagccuccgucucccagg

SEQ ID NO: 333577 - RNA, 22 nt, Human
aucucagcucacugcagccucg

SEQ ID NO: 333578 - RNA, 24 nt, Human
aucucagcucacugcagccucugc

SEQ ID NO: 333579 - RNA, 32 nt, Human
aucucagcucacugcagccucugccacccaga

SEQ ID NO: 333580 - RNA, 32 nt, Human
aucucagcucacugcagccucugccucccggg

SEQ ID NO: 333581 - RNA, 32 nt, Human
aucucagcucacugcagccucugccuccugag

SEQ ID NO: 333582 - RNA, 32 nt, Human
aucucagcucacugcagccucugucucccggg

SEQ ID NO: 333583 - RNA, 32 nt, Human
aucucagcucacugcagccuugaccuccuggg

SEQ ID NO: 333584 - RNA, 24 nt, Human
aucucagcucacugcaggcucugc

SEQ ID NO: 333585 - RNA, 32 nt, Human
aucucagcucacugcaggcucugccuccuggg

SEQ ID NO: 333586 - RNA, 24 nt, Human
aucucagcucacugcagucucugc

SEQ ID NO: 333587 - RNA, 32 nt, Human
aucucagcucacugcagucucugccucccggg

SEQ ID NO: 333588 - RNA, 24 nt, Human
aucucagcucacugcauccuccgc

SEQ ID NO: 333589 - RNA, 24 nt, Human
aucucagcucacugcauccucugc

SEQ ID NO: 333590 - RNA, 32 nt, Human
aucucagcucacugcauccucugccucccggg

SEQ ID NO: 333591 - RNA, 24 nt, Human
aucucagcucacugccaccucugc

SEQ ID NO: 333592 - RNA, 32 nt, Human
aucucagcucacugccaccucugccucccagg

SEQ ID NO: 333593 - RNA, 32 nt, Human
aucucagcucacugccaccuuugccuccuggg

SEQ ID NO: 333594 - RNA, 22 nt, Human
aucucagcucacugcgaccucc

SEQ ID NO: 333595 - RNA, 32 nt, Human
aucucagcucacugcgaccuccaccucccaug

SEQ ID NO: 333596 - RNA, 32 nt, Human
aucucagcucacugcgaccugcaccuccuggg

SEQ ID NO: 333597 - RNA, 32 nt, Human
aucucagcucacugcggccuugaacuccuggg

SEQ ID NO: 333598 - RNA, 32 nt, Human
aucucagcucacuggcaacaucugccucccgg

SEQ ID NO: 333599 - RNA, 24 nt, Human
aucucagcucacuguaaccucugc

SEQ ID NO: 333600 - RNA, 32 nt, Human
aucucagcucacuguaaccucugccucccugc

SEQ ID NO: 333601 - RNA, 32 nt, Human
aucucagcucacuguaccuuugccguggguuc

SEQ ID NO: 333602 - RNA, 23 nt, Human
aucucagcucacuguacuccagc

SEQ ID NO: 333603 - RNA, 32 nt, Human
aucucagcucacuguacuccagcccggguuca

SEQ ID NO: 333604 - RNA, 22 nt, Human
aucucagcucacuguaggcucu

SEQ ID NO: 333605 - RNA, 32 nt, Human
aucucagcucacuguaggcucuaccucauggg

SEQ ID NO: 333606 - RNA, 24 nt, Human
aucucagcucacuguauccucugc

SEQ ID NO: 333607 - RNA, 24 nt, Human
aucucagcucacugugaccuccgc

SEQ ID NO: 333608 - RNA, 32 nt, Human
aucucagcucacugugaccuccgccuccuggg

SEQ ID NO: 333609 - RNA, 32 nt, Human
aucucagcucagugcaaccuccgccacccggg

SEQ ID NO: 333610 - RNA, 32 nt, Human
aucucagcucagugcaaccuccgcccccuggg

SEQ ID NO: 333611 - RNA, 32 nt, Human
aucucagcucagugcaaccuccgccucccgag

SEQ ID NO: 333612 - RNA, 32 nt, Human
aucucagcucauugcaaccucggcucacugua

SEQ ID NO: 333613 - RNA, 32 nt, Human
aucucagcucauugcaaccucugccuaacggg

SEQ ID NO: 333614 - RNA, 32 nt, Human
aucucagcucauugcaaccucugucucccagg

SEQ ID NO: 333615 - RNA, 24 nt, Human
aucucagcucauugcagccuccgc

SEQ ID NO: 333616 - RNA, 32 nt, Human
aucucagcuccaugcaaccucugccuccuggg

SEQ ID NO: 333617 - RNA, 32 nt, Human
aucucagcucccugcaaccuccaccuccuggg

SEQ ID NO: 333618 - RNA, 32 nt, Human
aucucagcucccugcaaccuccgccucccggg

SEQ ID NO: 333619 - RNA, 32 nt, Human
aucucagcucgccgcaaccuccgccucccagg

SEQ ID NO: 333620 - RNA, 32 nt, Human
aucucagcucgcuacaaccucuaccucccagc

SEQ ID NO: 333621 - RNA, 32 nt, Human
aucucagcucgcugcaacccccaccucccagg

SEQ ID NO: 333622 - RNA, 32 nt, Human
aucucagcucgcugcaaccuccaccuccuggg

SEQ ID NO: 333623 - RNA, 32 nt, Human
aucucagcucgcugcaaccuccaccuuccggg

SEQ ID NO: 333624 - RNA, 24 nt, Human
aucucagcucgcugcaagcuccgc

SEQ ID NO: 333625 - RNA, 32 nt, Human
aucucagcucugccacacaccuuuacaccccc

SEQ ID NO: 333626 - RNA, 32 nt, Human
aucucagcugcugcaaccuccaccucccgggu

SEQ ID NO: 333627 - RNA, 32 nt, Human
aucucagcuuaaugcaaccucuaccucccagg

SEQ ID NO: 333628 - RNA, 32 nt, Human
aucucagcuuacugcaaccucugccucccggg

SEQ ID NO: 333629 - RNA, 32 nt, Human
aucucagcuuacugcaaccucugucucccggg

SEQ ID NO: 333630 - RNA, 32 nt, Human
aucucagcuuacugcacccucugccucccggu

SEQ ID NO: 333631 - RNA, 26 nt, Human
aucucagcuuauaugaaagucaagug

SEQ ID NO: 333632 - RNA, 32 nt, Human
aucucagcuuauuacaaccucugccuccuggg

SEQ ID NO: 333633 - RNA, 32 nt, Human
aucucaggaagcacuggacacaguguucugca

SEQ ID NO: 333634 - RNA, 24 nt, Human
aucucaggaccagauaguggagug

SEQ ID NO: 333635 - RNA, 32 nt, Human
aucucaggacucuugacugcagguuccucuga

SEQ ID NO: 333636 - RNA, 32 nt, Human
aucucaggagguugaggcugcagugaauuaug

SEQ ID NO: 333637 - RNA, 21 nt, Human
aucucaggauaaaguuugcua

SEQ ID NO: 333638 - RNA, 24 nt, Human
aucucaggcaauccacccaccuca

SEQ ID NO: 333639 - RNA, 32 nt, Human
aucucaggccugaagggucuagaagcccacug

SEQ ID NO: 333640 - RNA, 32 nt, Human
aucucaggccugaccuugaccugaguaugucu

SEQ ID NO: 333641 - RNA, 20 nt, Human
aucucaggcggcagugaagu

SEQ ID NO: 333642 - RNA, 22 nt, Human
aucucaggcucuaggugcaaug

SEQ ID NO: 333643 - RNA, 22 nt, Human
aucucaggcuggagugcagugg

SEQ ID NO: 333644 - RNA, 32 nt, Human
aucucaggcugucggugaggcugcagucacua

SEQ ID NO: 333645 - RNA, 32 nt, Human
aucucagggaauguccaucuggagcuggcaag

SEQ ID NO: 333646 - RNA, 22 nt, Human
aucucagggagggaaggggaug

SEQ ID NO: 333647 - RNA, 32 nt, Human
aucucagggcgcgacuuccggggcgacgggcg

SEQ ID NO: 333648 - RNA, 32 nt, Human
aucucaggggaaauguggcucucuccaccuug

SEQ ID NO: 333649 - RNA, 32 nt, Human
aucucaggggaaauguggcucucuccaucuug

SEQ ID NO: 333650 - RNA, 32 nt, Human
aucucaggguagcugcccugaccucggagcag

SEQ ID NO: 333651 - RNA, 32 nt, Human
aucucaggucacugcaaccucugccucccagg

SEQ ID NO: 333652 - RNA, 32 nt, Human
aucucaggucacugcaaccucugccuccuggg

SEQ ID NO: 333653 - RNA, 32 nt, Human
aucucaggugaucuacccuccucggccuccca

SEQ ID NO: 333654 - RNA, 32 nt, Human
aucucagguggguggagcaguggugggagaag

SEQ ID NO: 333655 - RNA, 32 nt, Human
aucucagucauacccaaugcucaguggaucau

SEQ ID NO: 333656 - RNA, 32 nt, Human
aucucaguccacugcaaccucugcccucccgg

SEQ ID NO: 333657 - RNA, 32 nt, Human
aucucagugaauuuucaguucagaccuuuuca

SEQ ID NO: 333658 - RNA, 18 nt, Human
aucucagugacugugaaa

SEQ ID NO: 333659 - RNA, 32 nt, Human
aucucaguggggcccguguccacccacacauc

SEQ ID NO: 333660 - RNA, 32 nt, Human
aucucaguguuaacugacugcugacuuggagu

SEQ ID NO: 333661 - RNA, 22 nt, Human
aucucaguucacugcaaccucc

SEQ ID NO: 333662 - RNA, 32 nt, Human
aucucaguucacugcaaccuccacccugcagg

SEQ ID NO: 333663 - RNA, 32 nt, Human
aucucaguucacugcaaccuccacuuccuagg

SEQ ID NO: 333664 - RNA, 32 nt, Human
aucucaguucacugcaaccucugccucccacg

SEQ ID NO: 333665 - RNA, 32 nt, Human
aucucaguucacugcaaccucugccucccggg

SEQ ID NO: 333666 - RNA, 32 nt, Human
aucucaguucacugcaaccucugccuccuaag

SEQ ID NO: 333667 - RNA, 32 nt, Human
aucucaguucacugcaaccucugccuccuggg

SEQ ID NO: 333668 - RNA, 32 nt, Human
aucucaguucacugcaacuucugccucccgag

SEQ ID NO: 333669 - RNA, 24 nt, Human
aucucaguucacugcaagcuccgc

SEQ ID NO: 333670 - RNA, 32 nt, Human
aucucaguucacugcaagcuccgccuccucgu

SEQ ID NO: 333671 - RNA, 32 nt, Human
aucucaguucacugcagucucugccuccuugg

SEQ ID NO: 333672 - RNA, 32 nt, Human
aucucaguucaugcaaccuccgccuccugggu

SEQ ID NO: 333673 - RNA, 32 nt, Human
aucucauagguacaaucaucucuuuuaaugga

SEQ ID NO: 333674 - RNA, 32 nt, Human
aucucaucaagaaggauugaagggauaacuau

SEQ ID NO: 333675 - RNA, 32 nt, Human
aucucaucagccagggaagaguaagugggauc

SEQ ID NO: 333676 - RNA, 32 nt, Human
aucucaucaucuccuaauaucugcagaggggc

SEQ ID NO: 333677 - RNA, 32 nt, Human
aucucaucccucaagguggccaccccagauga

SEQ ID NO: 333678 - RNA, 32 nt, Human
aucucauccuuuccucuagcuuuucuauuuuu

SEQ ID NO: 333679 - RNA, 32 nt, Human
aucucaucgccagccuccuccuggaccucuug

SEQ ID NO: 333680 - RNA, 32 nt, Human
aucucaucucacugcaaccuccaccucccagg

SEQ ID NO: 333681 - RNA, 32 nt, Human
aucucaucucagugcaaccuccaccucucacg

SEQ ID NO: 333682 - RNA, 32 nt, Human
aucucaucucccugcaaccuccgccuccuggg

SEQ ID NO: 333683 - RNA, 32 nt, Human
aucucaucugcaggcugggaggcagggcugga

SEQ ID NO: 333684 - RNA, 32 nt, Human
aucucaucuuuccuccugucuuagaagaacag

SEQ ID NO: 333685 - RNA, 32 nt, Human
aucucaugaacccaggaggcagagguugcagu

SEQ ID NO: 333686 - RNA, 24 nt, Human
aucucaugaauuuugacuuauuga

SEQ ID NO: 333687 - RNA, 23 nt, Human
aucucaugaggauuucuuuauga

SEQ ID NO: 333688 - RNA, 22 nt, Human
aucucaugagugugccccaugg

SEQ ID NO: 333689 - RNA, 32 nt, Human
aucucaugauucccuacaucugacauaaggaa

SEQ ID NO: 333690 - RNA, 32 nt, Human
aucucaugccuauaaucccagcacuuugggag

SEQ ID NO: 333691 - RNA, 32 nt, Human
aucucaugcuugcaaacuacacaaugcugcag

SEQ ID NO: 333692 - RNA, 32 nt, Human
aucucaugucacggcaaccuccgccucccagg

SEQ ID NO: 333693 - RNA, 32 nt, Human
aucucauucucucuccuuuuccaucuggacca

SEQ ID NO: 333694 - RNA, 32 nt, Human
aucucauucuucccucuucauuucuggccuau

SEQ ID NO: 333695 - RNA, 32 nt, Human
aucucauugcuuucuuuccuuugcagaauuau

SEQ ID NO: 333696 - RNA, 32 nt, Human
aucucauuggcccaagggagcugcagugguag

SEQ ID NO: 333697 - RNA, 32 nt, Human
aucucauuguagcuucaaccuccugagcucaa

SEQ ID NO: 333698 - RNA, 32 nt, Human
aucucauuuccuucaaccuugccuccucauac

SEQ ID NO: 333699 - RNA, 32 nt, Human
aucuccaacaaacuccagcagaccugcagcag

SEQ ID NO: 333700 - RNA, 32 nt, Human
aucuccaaccagugccuuccgcagcugcacgg

SEQ ID NO: 333701 - RNA, 32 nt, Human
aucuccaaccaugcccuaagacauaugguaac

SEQ ID NO: 333702 - RNA, 32 nt, Human
aucuccaaggccugcgggaaaaacuugccuuu

SEQ ID NO: 333703 - RNA, 32 nt, Human
aucuccaauugccucuugcaggcugagucccu

SEQ ID NO: 333704 - RNA, 32 nt, Human
aucuccaccucccagguucaagcaauucuccu

SEQ ID NO: 333705 - RNA, 32 nt, Human
aucuccaccucccggauucaagcaguuuuccu

SEQ ID NO: 333706 - RNA, 32 nt, Human
aucuccaccuccuggguucaagcaauuuucuu

SEQ ID NO: 333707 - RNA, 32 nt, Human
aucuccaccuccuggguucaagcgauucuccu

SEQ ID NO: 333708 - RNA, 32 nt, Human
aucuccacucacugcaacuuccgccuccuggg

SEQ ID NO: 333709 - RNA, 32 nt, Human
aucuccacucacugcagccuccgccucugggg

SEQ ID NO: 333710 - RNA, 32 nt, Human
aucuccacucacugcaggcuccgccucccggg

SEQ ID NO: 333711 - RNA, 32 nt, Human
aucuccacugauugcccccuugcuggccaagc

SEQ ID NO: 333712 - RNA, 32 nt, Human
aucuccacugcacugcugugggcugaacugug

SEQ ID NO: 333713 - RNA, 32 nt, Human
aucuccagaagaggggagcagaguccgagcuu

SEQ ID NO: 333714 - RNA, 32 nt, Human
aucuccagaagcagcacuaggguuugaguuuc

SEQ ID NO: 333715 - RNA, 32 nt, Human
aucuccagagcuaguucccugcccucacaccc

SEQ ID NO: 333716 - RNA, 32 nt, Human
aucuccagcaucuucuuccccuucccuggccc

SEQ ID NO: 333717 - RNA, 32 nt, Human
aucuccagccugccuggaaaugcugugggcuc

SEQ ID NO: 333718 - RNA, 32 nt, Human
aucuccagggcugccccuguagguugcuuaaa

SEQ ID NO: 333719 - RNA, 32 nt, Human
aucuccagggucucauucuguugcccaggcug

SEQ ID NO: 333720 - RNA, 32 nt, Human
aucuccagugccuggcacacaguagguguuca

SEQ ID NO: 333721 - RNA, 32 nt, Human
aucuccaguucuggacagugcagguugccaag

SEQ ID NO: 333722 - RNA, 32 nt, Human
aucuccaguucuggacucgugcccccacuccc

SEQ ID NO: 333723 - RNA, 32 nt, Human
aucuccaguucuuggaggguuccggugagaag

SEQ ID NO: 333724 - RNA, 32 nt, Human
aucuccaguuuauagaccagaaccagagcuca

SEQ ID NO: 333725 - RNA, 32 nt, Human
aucuccauccuccucaagcugccugugcaccc

SEQ ID NO: 333726 - RNA, 32 nt, Human
aucuccaucucccggguucaagcgauucuccu

SEQ ID NO: 333727 - RNA, 32 nt, Human
aucuccaucucccggguucaagcgauuuuccu

SEQ ID NO: 333728 - RNA, 32 nt, Human
aucuccaucugcacagagguccuggcuggacc

SEQ ID NO: 333729 - RNA, 32 nt, Human
aucuccaucuuucugcccugcauaccagcccu

SEQ ID NO: 333730 - RNA, 31 nt, Human
aucuccaugaucaucucagccaacaugcauc

SEQ ID NO: 333731 - RNA, 32 nt, Human
aucuccaugccagcagggugccuuuuauauca

SEQ ID NO: 333732 - RNA, 32 nt, Human
aucuccaugccagcagggugccuuuuauauga

SEQ ID NO: 333733 - RNA, 32 nt, Human
aucuccaugggaacaggaccauaggaugaugu

SEQ ID NO: 333734 - RNA, 32 nt, Human
aucuccauuccucugcccucuugagccagcac

SEQ ID NO: 333735 - RNA, 32 nt, Human
aucuccauuguuaagagaucacugugagguag

SEQ ID NO: 333736 - RNA, 32 nt, Human
aucucccaaagcucugaucccugccaugggaa

SEQ ID NO: 333737 - RNA, 32 nt, Human
aucucccaacuucucccuuuuggacccugccg

SEQ ID NO: 333738 - RNA, 32 nt, Human
aucucccaacuuguccauuuuguugcauauuc

SEQ ID NO: 333739 - RNA, 32 nt, Human
aucucccaccacacuuacugucuuccuuuauc

SEQ ID NO: 333740 - RNA, 19 nt, Human
aucucccacuuucacaccu

SEQ ID NO: 333741 - RNA, 32 nt, Human
aucucccagcagaagaaggaugugcggaugcu

SEQ ID NO: 333742 - RNA, 32 nt, Human
aucucccaggauccaugagguccagugcuguc

SEQ ID NO: 333743 - RNA, 32 nt, Human
aucucccaggauccaugagguccaguguuguc

SEQ ID NO: 333744 - RNA, 32 nt, Human
aucucccagggcuuccuccaagggccaaaaau

SEQ ID NO: 333745 - RNA, 32 nt, Human
aucucccaguccccaucucuuuuuccccacac

SEQ ID NO: 333746 - RNA, 32 nt, Human
aucucccauauguaugcuguaugcuaugcuaa

SEQ ID NO: 333747 - RNA, 32 nt, Human
aucucccauccuguuggccacacccagcucca

SEQ ID NO: 333748 - RNA, 32 nt, Human
aucucccaucuuuugaaaaaccuggaagugag

SEQ ID NO: 333749 - RNA, 32 nt, Human
aucucccauggggaggugaugguggggagaug

SEQ ID NO: 333750 - RNA, 28 nt, Human
aucuccccaagugcacacuuuauccacc

SEQ ID NO: 333751 - RNA, 32 nt, Human
aucuccccagacagcacuucaggcugggaaag

SEQ ID NO: 333752 - RNA, 32 nt, Human
aucuccccagcauaaccaaaucuuacuaaacu

SEQ ID NO: 333753 - RNA, 22 nt, Human
aucuccccaggagggugagaug

SEQ ID NO: 333754 - RNA, 32 nt, Human
aucuccccagucaagggcaaguuuacagagau

SEQ ID NO: 333755 - RNA, 32 nt, Human
aucuccccaucuucacccaacucccaaugccc

SEQ ID NO: 333756 - RNA, 32 nt, Human
aucuccccauuuccucuccuuccccaccacca

SEQ ID NO: 333757 - RNA, 32 nt, Human
aucucccccggcucugggacccuucccgccga

SEQ ID NO: 333758 - RNA, 32 nt, Human
aucucccccuaccacaaaccaggcuggaaccc

SEQ ID NO: 333759 - RNA, 32 nt, Human
aucucccccucuccaucuccucugucuccccc

SEQ ID NO: 333760 - RNA, 23 nt, Human
aucuccccucucaggaccaguca

SEQ ID NO: 333761 - RNA, 32 nt, Human
aucuccccucuccccucucccguucuuccucc

SEQ ID NO: 333762 - RNA, 32 nt, Human
aucuccccugcuccucugcugguggugggcua

SEQ ID NO: 333763 - RNA, 32 nt, Human
aucuccccugggaaguggggaugagaggagaa

SEQ ID NO: 333764 - RNA, 32 nt, Human
aucuccccuucccacaucacucaaggcauaag

SEQ ID NO: 333765 - RNA, 32 nt, Human
aucuccccuucccagccccuccuucauccccu

SEQ ID NO: 333766 - RNA, 32 nt, Human
aucuccccuuccucuucuugauggacauuuau

SEQ ID NO: 333767 - RNA, 32 nt, Human
aucucccuccaacaaacccuggcuccagcccc

SEQ ID NO: 333768 - RNA, 32 nt, Human
aucucccuccacccccucccacccaucuccuc

SEQ ID NO: 333769 - RNA, 23 nt, Human
aucucccuccaggaagcugcugc

SEQ ID NO: 333770 - RNA, 32 nt, Human
aucucccuccaggcagcccuuggcuggucccu

SEQ ID NO: 333771 - RNA, 32 nt, Human
aucucccucuucuccccuccuuucacaccgag

SEQ ID NO: 333772 - RNA, 32 nt, Human
aucucccugcaaccuccgccuccuggguugaa

SEQ ID NO: 333773 - RNA, 32 nt, Human
aucucccugccuccugccggcuccuugguucu

SEQ ID NO: 333774 - RNA, 32 nt, Human
aucucccugccuggcccccaaccucagggcuc

SEQ ID NO: 333775 - RNA, 32 nt, Human
aucucccugccugggcuggcugugaggccacc

SEQ ID NO: 333776 - RNA, 32 nt, Human
aucucccugcuccccucaacccccucccaccc

SEQ ID NO: 333777 - RNA, 32 nt, Human
aucucccugcugcggcagagccacugaguuca

SEQ ID NO: 333778 - RNA, 32 nt, Human
aucucccuggcagcagaugagguggcuucaca

SEQ ID NO: 333779 - RNA, 32 nt, Human
aucucccuggcuucagcaauuuguaguuauuu

SEQ ID NO: 333780 - RNA, 32 nt, Human
aucucccuggggagcccgggugggcaggaaca

SEQ ID NO: 333781 - RNA, 32 nt, Human
aucucccuggggcaggaaguggguggacuugg

SEQ ID NO: 333782 - RNA, 32 nt, Human
aucucccuggugcuuaugcucuuaauugccac

SEQ ID NO: 333783 - RNA, 32 nt, Human
aucucccuuaagcauccucuucuccaaccucc

SEQ ID NO: 333784 - RNA, 32 nt, Human
aucucccuucaggcggagguugcagugagccg

SEQ ID NO: 333785 - RNA, 32 nt, Human
aucucccuugacuuacccauaaugucuuucug

SEQ ID NO: 333786 - RNA, 32 nt, Human
aucucccuugcucuccuggggaacccuaaacc

SEQ ID NO: 333787 - RNA, 32 nt, Human
aucucccuuuaaguuuuugcugcagcaauuug

SEQ ID NO: 333788 - RNA, 32 nt, Human
aucucccuuucucuucaguuccuuccuuguuc

SEQ ID NO: 333789 - RNA, 32 nt, Human
aucuccgacaggggcugaguugcuggagcugg

SEQ ID NO: 333790 - RNA, 32 nt, Human
aucuccgacuccugacuuuggaagcccccaaa

SEQ ID NO: 333791 - RNA, 32 nt, Human
aucuccgagaacauggcaucacagaucauugu

SEQ ID NO: 333792 - RNA, 32 nt, Human
aucuccgaggagaagaaagaaugauggacagu

SEQ ID NO: 333793 - RNA, 32 nt, Human
aucuccgcaguguccaaaccuaguuucccaug

SEQ ID NO: 333794 - RNA, 32 nt, Human
aucuccgccucccaggcucaagcaauucuccu

SEQ ID NO: 333795 - RNA, 32 nt, Human
aucuccgccucccagguucaagcgauucuccu

SEQ ID NO: 333796 - RNA, 32 nt, Human
aucuccgccucccagguucaagcgauucucuu

SEQ ID NO: 333797 - RNA, 32 nt, Human
aucuccgccuccccaguucaagcgauucuccu

SEQ ID NO: 333798 - RNA, 32 nt, Human
aucuccgccucccggguucaagugauucuccu

SEQ ID NO: 333799 - RNA, 32 nt, Human
aucuccgccuccuggguucaaaugauucuccu

SEQ ID NO: 333800 - RNA, 32 nt, Human
aucuccgccuccuggguucaagggauucuccu

SEQ ID NO: 333801 - RNA, 32 nt, Human
aucuccgcuaagcccagggauccacuugugug

SEQ ID NO: 333802 - RNA, 32 nt, Human
aucuccgcucacugcaacauccgccucccgga

SEQ ID NO: 333803 - RNA, 22 nt, Human
aucuccgcucacugcaaccucc

SEQ ID NO: 333804 - RNA, 32 nt, Human
aucuccgcucacugcaaccuccaccuccuggc

SEQ ID NO: 333805 - RNA, 24 nt, Human
aucuccgcucacugcaaccuccgc

SEQ ID NO: 333806 - RNA, 32 nt, Human
aucuccgcucacugcaaccucugccucccggu

SEQ ID NO: 333807 - RNA, 24 nt, Human
aucuccgcucacugcaagcuccgc

SEQ ID NO: 333808 - RNA, 32 nt, Human
aucuccgcucacugcaagcuccgccucccggg

SEQ ID NO: 333809 - RNA, 32 nt, Human
aucuccgcucacugcaagcuccgccucgcgag

SEQ ID NO: 333810 - RNA, 32 nt, Human
aucuccgcucacugcaagcucugccuccuggg

SEQ ID NO: 333811 - RNA, 32 nt, Human
aucuccgcucacugcagccuccgccuccuggg

SEQ ID NO: 333812 - RNA, 32 nt, Human
aucuccgcucacugccaccuccgccucucuag

SEQ ID NO: 333813 - RNA, 32 nt, Human
aucuccgcucgcagcaaccucugccucccagg

SEQ ID NO: 333814 - RNA, 32 nt, Human
aucuccgcucgcugcaaccaccaucuccuggg

SEQ ID NO: 333815 - RNA, 32 nt, Human
aucuccgggaggcccugguuaaaggaggcuaa

SEQ ID NO: 333816 - RNA, 32 nt, Human
aucuccgggcagccaccaccuccucggucugc

SEQ ID NO: 333817 - RNA, 32 nt, Human
aucuccgucgugaacauggcccugccaccauu

SEQ ID NO: 333818 - RNA, 32 nt, Human
aucuccgugcucuucuuugacaacagcgacaa

SEQ ID NO: 333819 - RNA, 32 nt, Human
aucuccguucacugcaaucucugccuccuggg

SEQ ID NO: 333820 - RNA, 32 nt, Human
aucuccguucacugcagccuccaccuccccgg

SEQ ID NO: 333821 - RNA, 32 nt, Human
aucuccuaauuuguuucuucugucuuuauguu

SEQ ID NO: 333822 - RNA, 32 nt, Human
aucuccuacaggaaggugaggagguggcaggu

SEQ ID NO: 333823 - RNA, 32 nt, Human
aucuccuacuccucaguaaaugcucacaugaa

SEQ ID NO: 333824 - RNA, 32 nt, Human
aucuccuagaagcagccggcacaggagggaag

SEQ ID NO: 333825 - RNA, 32 nt, Human
aucuccuagccuggccuucauccaguucaccc

SEQ ID NO: 333826 - RNA, 21 nt, Human
aucuccucaacucugaguguu

SEQ ID NO: 333827 - RNA, 32 nt, Human
aucuccucaauccugucuccccagcggcucug

SEQ ID NO: 333828 - RNA, 32 nt, Human
aucuccucacuccuuuuucucuccuuaccuuu

SEQ ID NO: 333829 - RNA, 32 nt, Human
aucuccuccucaccuuuuguugcuaucggcag

SEQ ID NO: 333830 - RNA, 32 nt, Human
aucuccuccucuucuuccuguccaugccggcc

SEQ ID NO: 333831 - RNA, 32 nt, Human
aucuccucugucucccccgucucauggcucuc

SEQ ID NO: 333832 - RNA, 32 nt, Human
aucuccucuucucccuucuccucccuuagccc

SEQ ID NO: 333833 - RNA, 32 nt, Human
aucuccucuuucuccaccaccucgggccccgg

SEQ ID NO: 333834 - RNA, 32 nt, Human
aucuccugaagaaaaaugaaaagcuacuuaga

SEQ ID NO: 333835 - RNA, 32 nt, Human
aucuccugaccuucugaucugccugccucggc

SEQ ID NO: 333836 - RNA, 32 nt, Human
aucuccugaccuugugaucugccugccucagc

SEQ ID NO: 333837 - RNA, 32 nt, Human
aucuccugaccuugugaucugccugccucggc

SEQ ID NO: 333838 - RNA, 32 nt, Human
aucuccugaccuugugaucugccugccuuggc

SEQ ID NO: 333839 - RNA, 32 nt, Human
aucuccugagugaccugaaaaggucaucucac

SEQ ID NO: 333840 - RNA, 32 nt, Human
aucuccugccuuucugcucacuuuccugccug

SEQ ID NO: 333841 - RNA, 32 nt, Human
aucuccuggaaggcuguugugauuuccaucua

SEQ ID NO: 333842 - RNA, 32 nt, Human
aucuccuggacgcagaggugacagugggagcu

SEQ ID NO: 333843 - RNA, 32 nt, Human
aucuccuggaggcugguucugcugccucuaca

SEQ ID NO: 333844 - RNA, 32 nt, Human
aucuccugggagugagggagaaacagggagcu

SEQ ID NO: 333845 - RNA, 32 nt, Human
aucuccugucaucacgaucaauuaauguuuuc

SEQ ID NO: 333846 - RNA, 32 nt, Human
aucuccugugacugcuccucuccagcaacccu

SEQ ID NO: 333847 - RNA, 32 nt, Human
aucuccugugcaugggcucgaagggagagcca

SEQ ID NO: 333848 - RNA, 32 nt, Human
aucuccuguggacgaacaucugggguggaagu

SEQ ID NO: 333849 - RNA, 32 nt, Human
aucuccuguuucuguuccuguguucauagauu

SEQ ID NO: 333850 - RNA, 23 nt, Human
aucuccuuaaauaaaauaaaaua

SEQ ID NO: 333851 - RNA, 31 nt, Human
aucuccuucauuaggauaguuggagagggau

SEQ ID NO: 333852 - RNA, 22 nt, Human
aucuccuucauucugggcagug

SEQ ID NO: 333853 - RNA, 32 nt, Human
aucuccuuccuugccaaagcaugucccaacau

SEQ ID NO: 333854 - RNA, 32 nt, Human
aucuccuucucccuccuguccuguccuugccc

SEQ ID NO: 333855 - RNA, 32 nt, Human
aucuccuucuccucucugccugccuccucccu

SEQ ID NO: 333856 - RNA, 32 nt, Human
aucuccuucucuucgcuccacaggucuauaaa

SEQ ID NO: 333857 - RNA, 32 nt, Human
aucuccuucuuuccucacgcccuuccaaggcu

SEQ ID NO: 333858 - RNA, 32 nt, Human
aucuccuugcguccuugggcaucuccgggcau

SEQ ID NO: 333859 - RNA, 19 nt, Human
aucuccuuucaaaguagug

SEQ ID NO: 333860 - RNA, 32 nt, Human
aucuccuuugacuucaugaucugcauccuagg

SEQ ID NO: 333861 - RNA, 32 nt, Human
aucucgaaggcgccuucuccuccugggagauc

SEQ ID NO: 333862 - RNA, 32 nt, Human
aucucgacaggcuccuggaauguguuuugcuu

SEQ ID NO: 333863 - RNA, 24 nt, Human
aucucgacucacugcaaaaucugc

SEQ ID NO: 333864 - RNA, 32 nt, Human
aucucgacucacugcaaaaucugccucccggg

SEQ ID NO: 333865 - RNA, 22 nt, Human
aucucgacucacugcaaccucc

SEQ ID NO: 333866 - RNA, 32 nt, Human
aucucgacucacugcaaccuccaccucccagg

SEQ ID NO: 333867 - RNA, 24 nt, Human
aucucgacucacugcaaccuucgc

SEQ ID NO: 333868 - RNA, 32 nt, Human
aucucgacucacugcaaccuucgccucccagg

SEQ ID NO: 333869 - RNA, 22 nt, Human
aucucgacucacugcaacuucc

SEQ ID NO: 333870 - RNA, 32 nt, Human
aucucgacucacugcaacuuccaccuccugga

SEQ ID NO: 333871 - RNA, 24 nt, Human
aucucgacucacugcaagcuccgc

SEQ ID NO: 333872 - RNA, 32 nt, Human
aucucgacucacugcaagcuccgccucccggg

SEQ ID NO: 333873 - RNA, 32 nt, Human
aucucgacucacugcagccuccgccuccuggg

SEQ ID NO: 333874 - RNA, 19 nt, Human
aucucgacucacugcagcu

SEQ ID NO: 333875 - RNA, 32 nt, Human
aucucgacucacugcagcuaucucucgccuca

SEQ ID NO: 333876 - RNA, 32 nt, Human
aucucgaguagcugggauuacaggcaugcacc

SEQ ID NO: 333877 - RNA, 32 nt, Human
aucucgagucacugcagccugugucuccuggg

SEQ ID NO: 333878 - RNA, 32 nt, Human
aucucgaucuugccauaacuuuacaggguaac

SEQ ID NO: 333879 - RNA, 32 nt, Human
aucucgauuaauaaccugccagucccagauca

SEQ ID NO: 333880 - RNA, 32 nt, Human
aucucgcaguuaccccagcaagaggguguuau

SEQ ID NO: 333881 - RNA, 32 nt, Human
aucucgccaauaauucuugucuuugaguguug

SEQ ID NO: 333882 - RNA, 32 nt, Human
aucucgccacugcacuccaggcugggcgacag

SEQ ID NO: 333883 - RNA, 32 nt, Human
aucucgccacugcgcuccagccugggcaacag

SEQ ID NO: 333884 - RNA, 32 nt, Human
aucucgccacugugcuccagccugggcaacag

SEQ ID NO: 333885 - RNA, 32 nt, Human
aucucgccauugcacuccauucugggcaacaa

SEQ ID NO: 333886 - RNA, 32 nt, Human
aucucgcccugccuccacuugccuugugauau

SEQ ID NO: 333887 - RNA, 32 nt, Human
aucucgcccugccuccauuuaccuugugauau

SEQ ID NO: 333888 - RNA, 24 nt, Human
aucucgccucacugcaaccuccgc

SEQ ID NO: 333889 - RNA, 32 nt, Human
aucucgccucacugcaaccuccgccucccagg

SEQ ID NO: 333890 - RNA, 32 nt, Human
aucucgccucacugcaaccuucaccuaccgag

SEQ ID NO: 333891 - RNA, 32 nt, Human
aucucgccucacugcaacuugcgccucccggg

SEQ ID NO: 333892 - RNA, 32 nt, Human
aucucgcucacugcaaccuccaccucccaggu

SEQ ID NO: 333893 - RNA, 32 nt, Human
aucucgcucacugcaaccuccgccucccgggu

SEQ ID NO: 333894 - RNA, 32 nt, Human
aucucgcucugcacuccagccuaggugacaga

SEQ ID NO: 333895 - RNA, 32 nt, Human
aucucgcugugccucaguuucucccucuucua

SEQ ID NO: 333896 - RNA, 32 nt, Human
aucucggaaaacaaacaaaagaauggucccca

SEQ ID NO: 333897 - RNA, 32 nt, Human
aucucggacuccugaccuugugaucugccugu

SEQ ID NO: 333898 - RNA, 32 nt, Human
aucucggaucacugcaaccuccaccuccuagg

SEQ ID NO: 333899 - RNA, 32 nt, Human
aucucggaucauauggagcucaugucagccgu

SEQ ID NO: 333900 - RNA, 32 nt, Human
aucucggaugaaagggcucccuuguccucagg

SEQ ID NO: 333901 - RNA, 32 nt, Human
aucucggcacacugcaaccuucgccucccaga

SEQ ID NO: 333902 - RNA, 32 nt, Human
aucucggcaugaggccccuucucccaggaggg

SEQ ID NO: 333903 - RNA, 32 nt, Human
aucucggcccacugcaaccucugccuccuggg

SEQ ID NO: 333904 - RNA, 22 nt, Human
aucucggcccacugcagccucg

SEQ ID NO: 333905 - RNA, 32 nt, Human
aucucggcccgcugcagccucugccucuuggg

SEQ ID NO: 333906 - RNA, 32 nt, Human
aucucggcucaaugcagcuuugccuccccagc

SEQ ID NO: 333907 - RNA, 32 nt, Human
aucucggcucacagcaaccucucugccuccag

SEQ ID NO: 333908 - RNA, 32 nt, Human
aucucggcucacagcaaccucugccucccgga

SEQ ID NO: 333909 - RNA, 24 nt, Human
aucucggcucaccacaacauccgc

SEQ ID NO: 333910 - RNA, 22 nt, Human
aucucggcucaccacaaccucc

SEQ ID NO: 333911 - RNA, 24 nt, Human
aucucggcucaccacaaccuccgc

SEQ ID NO: 333912 - RNA, 24 nt, Human
aucucggcucaccacaaucgcugc

SEQ ID NO: 333913 - RNA, 24 nt, Human
aucucggcucaccccaaccuccgc

SEQ ID NO: 333914 - RNA, 24 nt, Human
aucucggcucaccgcaaaguccgc

SEQ ID NO: 333915 - RNA, 22 nt, Human
aucucggcucaccgcaaccucc

SEQ ID NO: 333916 - RNA, 32 nt, Human
aucucggcucaccgcaaccuccaccuuccugg

SEQ ID NO: 333917 - RNA, 24 nt, Human
aucucggcucaccgcaaccuccgc

SEQ ID NO: 333918 - RNA, 32 nt, Human
aucucggcucaccgcaaccuccgccucccagg

SEQ ID NO: 333919 - RNA, 32 nt, Human
aucucggcucaccgcaaccuccgccucccgga

SEQ ID NO: 333920 - RNA, 32 nt, Human
aucucggcucaccgcaaccuccgccucccggg

SEQ ID NO: 333921 - RNA, 32 nt, Human
aucucggcucaccgcaaccuccucuucugggu

SEQ ID NO: 333922 - RNA, 24 nt, Human
aucucggcucaccgcaaccucugc

SEQ ID NO: 333923 - RNA, 32 nt, Human
aucucggcucaccgcaaccucugccucccagg

SEQ ID NO: 333924 - RNA, 32 nt, Human
aucucggcucaccgcaaccucugccucccggg

SEQ ID NO: 333925 - RNA, 32 nt, Human
aucucggcucaccgcaaccucugccuccuggg

SEQ ID NO: 333926 - RNA, 32 nt, Human
aucucggcucaccgcaaccucugcuuccuggc

SEQ ID NO: 333927 - RNA, 24 nt, Human
aucucggcucaccgcaagcuccgc

SEQ ID NO: 333928 - RNA, 21 nt, Human
aucucggcucaccgcagccuc

SEQ ID NO: 333929 - RNA, 24 nt, Human
aucucggcucacggcaacccccgc

SEQ ID NO: 333930 - RNA, 22 nt, Human
aucucggcucacggcaaccucc

SEQ ID NO: 333931 - RNA, 32 nt, Human
aucucggcucacggcaaccuccaccucccggg

SEQ ID NO: 333932 - RNA, 24 nt, Human
aucucggcucacggcaccguccgc

SEQ ID NO: 333933 - RNA, 32 nt, Human
aucucggcucacgguaaccucugccucccagg

SEQ ID NO: 333934 - RNA, 21 nt, Human
aucucggcucacuacaaccuc

SEQ ID NO: 333935 - RNA, 22 nt, Human
aucucggcucacuacaaccucc

SEQ ID NO: 333936 - RNA, 24 nt, Human
aucucggcucacuacaaccucugc

SEQ ID NO: 333937 - RNA, 32 nt, Human
aucucggcucacuacaaccucugccucccagg

SEQ ID NO: 333938 - RNA, 24 nt, Human
aucucggcucacuacaacuuccgc

SEQ ID NO: 333939 - RNA, 32 nt, Human
aucucggcucacuacaagcucugccucccggg

SEQ ID NO: 333940 - RNA, 24 nt, Human
aucucggcucacuacagccucugc

SEQ ID NO: 333941 - RNA, 24 nt, Human
aucucggcucacuccaagcucugc

SEQ ID NO: 333942 - RNA, 32 nt, Human
aucucggcucacuccaccuccaccucccaggu

SEQ ID NO: 333943 - RNA, 24 nt, Human
aucucggcucacugaaaccucugc

SEQ ID NO: 333944 - RNA, 32 nt, Human
aucucggcucacugaaaccucugccucccggg

SEQ ID NO: 333945 - RNA, 32 nt, Human
aucucggcucacugaaaccucugccuuccagg

SEQ ID NO: 333946 - RNA, 32 nt, Human
aucucggcucacugaaaccugugccuccccgg

SEQ ID NO: 333947 - RNA, 32 nt, Human
aucucggcucacugaaacuucugccucccggg

SEQ ID NO: 333948 - RNA, 32 nt, Human
aucucggcucacugaaccuccgccucccaggu

SEQ ID NO: 333949 - RNA, 22 nt, Human
aucucggcucacugcaaaccgc

SEQ ID NO: 333950 - RNA, 32 nt, Human
aucucggcucacugcaaaccgccucccggguu

SEQ ID NO: 333951 - RNA, 24 nt, Human
aucucggcucacugcaaacuccgc

SEQ ID NO: 333952 - RNA, 32 nt, Human
aucucggcucacugcaaacuccgccucccagg

SEQ ID NO: 333953 - RNA, 32 nt, Human
aucucggcucacugcaaacuccgccucccggg

SEQ ID NO: 333954 - RNA, 32 nt, Human
aucucggcucacugcaaacuccgccuuccagg

SEQ ID NO: 333955 - RNA, 24 nt, Human
aucucggcucacugcaaacucugc

SEQ ID NO: 333956 - RNA, 32 nt, Human
aucucggcucacugcaaacucugccucccagg

SEQ ID NO: 333957 - RNA, 32 nt, Human
aucucggcucacugcaaacucugccucccggg

SEQ ID NO: 333958 - RNA, 32 nt, Human
aucucggcucacugcaaacucugccuccugga

SEQ ID NO: 333959 - RNA, 24 nt, Human
aucucggcucacugcaaaucuccg

SEQ ID NO: 333960 - RNA, 32 nt, Human
aucucggcucacugcaaaucuccgccucccag

SEQ ID NO: 333961 - RNA, 32 nt, Human
aucucggcucacugcaacauccaccuccuggg

SEQ ID NO: 333962 - RNA, 24 nt, Human
aucucggcucacugcaacaucugc

SEQ ID NO: 333963 - RNA, 22 nt, Human
aucucggcucacugcaaccacc

SEQ ID NO: 333964 - RNA, 32 nt, Human
aucucggcucacugcaaccaccaucucccagg

SEQ ID NO: 333965 - RNA, 32 nt, Human
aucucggcucacugcaaccacugccucccagg

SEQ ID NO: 333966 - RNA, 22 nt, Human
aucucggcucacugcaaccccc

SEQ ID NO: 333967 - RNA, 32 nt, Human
aucucggcucacugcaacccccaucucccagg

SEQ ID NO: 333968 - RNA, 32 nt, Human
aucucggcucacugcaaccuagguggaggucu

SEQ ID NO: 333969 - RNA, 21 nt, Human
aucucggcucacugcaaccuc

SEQ ID NO: 333970 - RNA, 32 nt, Human
aucucggcucacugcaaccucaccucccgggu

SEQ ID NO: 333971 - RNA, 22 nt, Human
aucucggcucacugcaaccucc

SEQ ID NO: 333972 - RNA, 32 nt, Human
aucucggcucacugcaaccuccaacucccugg

SEQ ID NO: 333973 - RNA, 32 nt, Human
aucucggcucacugcaaccuccacaucccaug

SEQ ID NO: 333974 - RNA, 32 nt, Human
aucucggcucacugcaaccuccacccccgggg

SEQ ID NO: 333975 - RNA, 32 nt, Human
aucucggcucacugcaaccuccaccucacagg

SEQ ID NO: 333976 - RNA, 32 nt, Human
aucucggcucacugcaaccuccaccucccaga

SEQ ID NO: 333977 - RNA, 32 nt, Human
aucucggcucacugcaaccuccaccucccagg

SEQ ID NO: 333978 - RNA, 32 nt, Human
aucucggcucacugcaaccuccaccuccccag

SEQ ID NO: 333979 - RNA, 32 nt, Human
aucucggcucacugcaaccuccaccuccccgg

SEQ ID NO: 333980 - RNA, 32 nt, Human
aucucggcucacugcaaccuccaccucccgag

SEQ ID NO: 333981 - RNA, 32 nt, Human
aucucggcucacugcaaccuccaccucccgga

SEQ ID NO: 333982 - RNA, 32 nt, Human
aucucggcucacugcaaccuccaccucccggg

SEQ ID NO: 333983 - RNA, 32 nt, Human
aucucggcucacugcaaccuccaccuccuagg

SEQ ID NO: 333984 - RNA, 32 nt, Human
aucucggcucacugcaaccuccaccuccugga

SEQ ID NO: 333985 - RNA, 32 nt, Human
aucucggcucacugcaaccuccaccuccuggc

SEQ ID NO: 333986 - RNA, 32 nt, Human
aucucggcucacugcaaccuccaccuccuggg

SEQ ID NO: 333987 - RNA, 32 nt, Human
aucucggcucacugcaaccuccaccuccuggu

SEQ ID NO: 333988 - RNA, 32 nt, Human
aucucggcucacugcaaccuccaccucucggc

SEQ ID NO: 333989 - RNA, 32 nt, Human
aucucggcucacugcaaccuccaccuucaggg

SEQ ID NO: 333990 - RNA, 32 nt, Human
aucucggcucacugcaaccuccacuucuuggg

SEQ ID NO: 333991 - RNA, 32 nt, Human
aucucggcucacugcaaccuccagcucccagg

SEQ ID NO: 333992 - RNA, 32 nt, Human
aucucggcucacugcaaccucccugccugauu

SEQ ID NO: 333993 - RNA, 23 nt, Human
aucucggcucacugcaaccuccg

SEQ ID NO: 333994 - RNA, 32 nt, Human
aucucggcucacugcaaccuccgacuccuggg

SEQ ID NO: 333995 - RNA, 24 nt, Human
aucucggcucacugcaaccuccgc

SEQ ID NO: 333996 - RNA, 32 nt, Human
aucucggcucacugcaaccuccgcccccuggg

SEQ ID NO: 333997 - RNA, 32 nt, Human
aucucggcucacugcaaccuccgccuaccggg

SEQ ID NO: 333998 - RNA, 32 nt, Human
aucucggcucacugcaaccuccgccucccaag

SEQ ID NO: 333999 - RNA, 32 nt, Human
aucucggcucacugcaaccuccgccucccagg

SEQ ID NO: 334000 - RNA, 32 nt, Human
aucucggcucacugcaaccuccgccucccagu

SEQ ID NO: 334001 - RNA, 32 nt, Human
aucucggcucacugcaaccuccgccucccggc

SEQ ID NO: 334002 - RNA, 32 nt, Human
aucucggcucacugcaaccuccgccucccggg

SEQ ID NO: 334003 - RNA, 32 nt, Human
aucucggcucacugcaaccuccgccucccggu

SEQ ID NO: 334004 - RNA, 32 nt, Human
aucucggcucacugcaaccuccgccuccugag

SEQ ID NO: 334005 - RNA, 32 nt, Human
aucucggcucacugcaaccuccgccuccuggg

SEQ ID NO: 334006 - RNA, 32 nt, Human
aucucggcucacugcaaccuccgccuccuugg

SEQ ID NO: 334007 - RNA, 32 nt, Human
aucucggcucacugcaaccuccgccuuccuga

SEQ ID NO: 334008 - RNA, 32 nt, Human
aucucggcucacugcaaccuccgccuugcugg

SEQ ID NO: 334009 - RNA, 32 nt, Human
aucucggcucacugcaaccuccgccuuuccac

SEQ ID NO: 334010 - RNA, 32 nt, Human
aucucggcucacugcaaccuccgcucccuggg

SEQ ID NO: 334011 - RNA, 24 nt, Human
aucucggcucacugcaaccuccgu

SEQ ID NO: 334012 - RNA, 32 nt, Human
aucucggcucacugcaaccuccgucucccagg

SEQ ID NO: 334013 - RNA, 32 nt, Human
aucucggcucacugcaaccuccuccucccggg

SEQ ID NO: 334014 - RNA, 23 nt, Human
aucucggcucacugcaaccucgc

SEQ ID NO: 334015 - RNA, 32 nt, Human
aucucggcucacugcaaccucgccucccuggu

SEQ ID NO: 334016 - RNA, 22 nt, Human
aucucggcucacugcaaccucu

SEQ ID NO: 334017 - RNA, 32 nt, Human
aucucggcucacugcaaccucuaccucccagg

SEQ ID NO: 334018 - RNA, 32 nt, Human
aucucggcucacugcaaccucuaccuccugga

SEQ ID NO: 334019 - RNA, 32 nt, Human
aucucggcucacugcaaccucuaccuccuggg

SEQ ID NO: 334020 - RNA, 24 nt, Human
aucucggcucacugcaaccucugc

SEQ ID NO: 334021 - RNA, 32 nt, Human
aucucggcucacugcaaccucugccaucagga

SEQ ID NO: 334022 - RNA, 32 nt, Human
aucucggcucacugcaaccucugccucacggg

SEQ ID NO: 334023 - RNA, 32 nt, Human
aucucggcucacugcaaccucugccucccagg

SEQ ID NO: 334024 - RNA, 32 nt, Human
aucucggcucacugcaaccucugccucccgag

SEQ ID NO: 334025 - RNA, 32 nt, Human
aucucggcucacugcaaccucugccucccgca

SEQ ID NO: 334026 - RNA, 32 nt, Human
aucucggcucacugcaaccucugccucccgga

SEQ ID NO: 334027 - RNA, 32 nt, Human
aucucggcucacugcaaccucugccucccggg

SEQ ID NO: 334028 - RNA, 32 nt, Human
aucucggcucacugcaaccucugccucccgug

SEQ ID NO: 334029 - RNA, 32 nt, Human
aucucggcucacugcaaccucugccuccuagg

SEQ ID NO: 334030 - RNA, 32 nt, Human
aucucggcucacugcaaccucugccuccugag

SEQ ID NO: 334031 - RNA, 32 nt, Human
aucucggcucacugcaaccucugccuccugga

SEQ ID NO: 334032 - RNA, 32 nt, Human
aucucggcucacugcaaccucugccuccuggg

SEQ ID NO: 334033 - RNA, 32 nt, Human
aucucggcucacugcaaccucugccucuuggg

SEQ ID NO: 334034 - RNA, 32 nt, Human
aucucggcucacugcaaccucugcuucccggg

SEQ ID NO: 334035 - RNA, 32 nt, Human
aucucggcucacugcaaccucugucuccugag

SEQ ID NO: 334036 - RNA, 32 nt, Human
aucucggcucacugcaaccucuugccucccag

SEQ ID NO: 334037 - RNA, 24 nt, Human
aucucggcucacugcaaccuucgc

SEQ ID NO: 334038 - RNA, 32 nt, Human
aucucggcucacugcaaccuucgccucugggu

SEQ ID NO: 334039 - RNA, 24 nt, Human
aucucggcucacugcaacguccgc

SEQ ID NO: 334040 - RNA, 32 nt, Human
aucucggcucacugcaacguccgccucccggg

SEQ ID NO: 334041 - RNA, 22 nt, Human
aucucggcucacugcaacuacc

SEQ ID NO: 334042 - RNA, 32 nt, Human
aucucggcucacugcaacuaccaccuccuggg

SEQ ID NO: 334043 - RNA, 21 nt, Human
aucucggcucacugcaacucc

SEQ ID NO: 334044 - RNA, 32 nt, Human
aucucggcucacugcaacuccaccucccgggu

SEQ ID NO: 334045 - RNA, 32 nt, Human
aucucggcucacugcaacucugccucccgggu

SEQ ID NO: 334046 - RNA, 21 nt, Human
aucucggcucacugcaacuuc

SEQ ID NO: 334047 - RNA, 24 nt, Human
aucucggcucacugcaacuuccgc

SEQ ID NO: 334048 - RNA, 32 nt, Human
aucucggcucacugcaacuuccgccucccggu

SEQ ID NO: 334049 - RNA, 32 nt, Human
aucucggcucacugcaacuuccgccuccuggg

SEQ ID NO: 334050 - RNA, 32 nt, Human
aucucggcucacugcaacuucuaccaccuagg

SEQ ID NO: 334051 - RNA, 24 nt, Human
aucucggcucacugcaacuucugc

SEQ ID NO: 334052 - RNA, 32 nt, Human
aucucggcucacugcaacuucugccucccggg

SEQ ID NO: 334053 - RNA, 32 nt, Human
aucucggcucacugcaacuucugccuccuagg

SEQ ID NO: 334054 - RNA, 24 nt, Human
aucucggcucacugcaagauccgc

SEQ ID NO: 334055 - RNA, 32 nt, Human
aucucggcucacugcaagauccgccucccggg

SEQ ID NO: 334056 - RNA, 22 nt, Human
aucucggcucacugcaagcccc

SEQ ID NO: 334057 - RNA, 32 nt, Human
aucucggcucacugcaagccccaccucccaag

SEQ ID NO: 334058 - RNA, 32 nt, Human
aucucggcucacugcaagccccaccuucugag

SEQ ID NO: 334059 - RNA, 24 nt, Human
aucucggcucacugcaagcccugc

SEQ ID NO: 334060 - RNA, 32 nt, Human
aucucggcucacugcaagcccugccuccuggg

SEQ ID NO: 334061 - RNA, 24 nt, Human
aucucggcucacugcaagcucagc

SEQ ID NO: 334062 - RNA, 32 nt, Human
aucucggcucacugcaagcucagccuccccga

SEQ ID NO: 334063 - RNA, 22 nt, Human
aucucggcucacugcaagcucc

SEQ ID NO: 334064 - RNA, 32 nt, Human
aucucggcucacugcaagcuccaccucccagg

SEQ ID NO: 334065 - RNA, 32 nt, Human
aucucggcucacugcaagcuccaccucccggg

SEQ ID NO: 334066 - RNA, 32 nt, Human
aucucggcucacugcaagcuccaccuccuggg

SEQ ID NO: 334067 - RNA, 32 nt, Human
aucucggcucacugcaagcuccaucucccagg

SEQ ID NO: 334068 - RNA, 23 nt, Human
aucucggcucacugcaagcuccg

SEQ ID NO: 334069 - RNA, 24 nt, Human
aucucggcucacugcaagcuccgc

SEQ ID NO: 334070 - RNA, 32 nt, Human
aucucggcucacugcaagcuccgccucccaga

SEQ ID NO: 334071 - RNA, 32 nt, Human
aucucggcucacugcaagcuccgccucccagg

SEQ ID NO: 334072 - RNA, 32 nt, Human
aucucggcucacugcaagcuccgccucccggg

SEQ ID NO: 334073 - RNA, 32 nt, Human
aucucggcucacugcaagcuccgccuccuggg

SEQ ID NO: 334074 - RNA, 32 nt, Human
aucucggcucacugcaagcuccgccucucggg

SEQ ID NO: 334075 - RNA, 32 nt, Human
aucucggcucacugcaagcuccggcucccagg

SEQ ID NO: 334076 - RNA, 24 nt, Human
aucucggcucacugcaagcucggc

SEQ ID NO: 334077 - RNA, 32 nt, Human
aucucggcucacugcaagcucggccuccuggg

SEQ ID NO: 334078 - RNA, 24 nt, Human
aucucggcucacugcaagcucugc

SEQ ID NO: 334079 - RNA, 32 nt, Human
aucucggcucacugcaagcucugccucccagg

SEQ ID NO: 334080 - RNA, 32 nt, Human
aucucggcucacugcaagcucugccucccggg

SEQ ID NO: 334081 - RNA, 32 nt, Human
aucucggcucacugcaagcucugccucccggu

SEQ ID NO: 334082 - RNA, 32 nt, Human
aucucggcucacugcaagcucugccucccgug

SEQ ID NO: 334083 - RNA, 32 nt, Human
aucucggcucacugcaagcucugccuccuggg

SEQ ID NO: 334084 - RNA, 32 nt, Human
aucucggcucacugcaagcucugccucucggg

SEQ ID NO: 334085 - RNA, 32 nt, Human
aucucggcucacugcaagcucugcguccuggg

SEQ ID NO: 334086 - RNA, 32 nt, Human
aucucggcucacugcaagcucugcuucccagg

SEQ ID NO: 334087 - RNA, 24 nt, Human
aucucggcucacugcaagcuucgc

SEQ ID NO: 334088 - RNA, 32 nt, Human
aucucggcucacugcaagcuucgccucccggg

SEQ ID NO: 334089 - RNA, 24 nt, Human
aucucggcucacugcaaguuccgc

SEQ ID NO: 334090 - RNA, 32 nt, Human
aucucggcucacugcaaguuccgccucccggg

SEQ ID NO: 334091 - RNA, 24 nt, Human
aucucggcucacugcaaucuaggu

SEQ ID NO: 334092 - RNA, 32 nt, Human
aucucggcucacugcaaucuagguggaggucu

SEQ ID NO: 334093 - RNA, 24 nt, Human
aucucggcucacugcaaucuccgc

SEQ ID NO: 334094 - RNA, 32 nt, Human
aucucggcucacugcaaucuccgccucccagg

SEQ ID NO: 334095 - RNA, 24 nt, Human
aucucggcucacugcaaucucugc

SEQ ID NO: 334096 - RNA, 32 nt, Human
aucucggcucacugcaaucucugccucccaag

SEQ ID NO: 334097 - RNA, 32 nt, Human
aucucggcucacugcaaucucugccucccagg

SEQ ID NO: 334098 - RNA, 32 nt, Human
aucucggcucacugcaaucucugccucccgga

SEQ ID NO: 334099 - RNA, 32 nt, Human
aucucggcucacugcaaucucugccucccggg

SEQ ID NO: 334100 - RNA, 32 nt, Human
aucucggcucacugcaaucucugccuccuggg

SEQ ID NO: 334101 - RNA, 24 nt, Human
aucucggcucacugcaauuugcgu

SEQ ID NO: 334102 - RNA, 24 nt, Human
aucucggcucacugcacccuccgu

SEQ ID NO: 334103 - RNA, 32 nt, Human
aucucggcucacugcacccucugccucuuggg

SEQ ID NO: 334104 - RNA, 23 nt, Human
aucucggcucacugcaccuccgc

SEQ ID NO: 334105 - RNA, 32 nt, Human
aucucggcucacugcaccuccgccucccaggu

SEQ ID NO: 334106 - RNA, 23 nt, Human
aucucggcucacugcaccucugc

SEQ ID NO: 334107 - RNA, 32 nt, Human
aucucggcucacugcaccucugccuccuggau

SEQ ID NO: 334108 - RNA, 24 nt, Human
aucucggcucacugcaccuucugc

SEQ ID NO: 334109 - RNA, 32 nt, Human
aucucggcucacugcaccuucugccuaccgag

SEQ ID NO: 334110 - RNA, 18 nt, Human
aucucggcucacugcagc

SEQ ID NO: 334111 - RNA, 32 nt, Human
aucucggcucacugcagcacugucucggcuca

SEQ ID NO: 334112 - RNA, 32 nt, Human
aucucggcucacugcagccccugccucccagg

SEQ ID NO: 334113 - RNA, 21 nt, Human
aucucggcucacugcagccuc

SEQ ID NO: 334114 - RNA, 32 nt, Human
aucucggcucacugcagccucaaccuccuggg

SEQ ID NO: 334115 - RNA, 22 nt, Human
aucucggcucacugcagccucc

SEQ ID NO: 334116 - RNA, 24 nt, Human
aucucggcucacugcagccuccgc

SEQ ID NO: 334117 - RNA, 32 nt, Human
aucucggcucacugcagccuccgccucccagg

SEQ ID NO: 334118 - RNA, 32 nt, Human
aucucggcucacugcagccuccgccucccugg

SEQ ID NO: 334119 - RNA, 32 nt, Human
aucucggcucacugcagccuccgccugccggg

SEQ ID NO: 334120 - RNA, 32 nt, Human
aucucggcucacugcagccucugccucccggg

SEQ ID NO: 334121 - RNA, 22 nt, Human
aucucggcucacugcagccuuc

SEQ ID NO: 334122 - RNA, 32 nt, Human
aucucggcucacugcagccuucaccucccggg

SEQ ID NO: 334123 - RNA, 32 nt, Human
aucucggcucacugcagccuugacuucccagg

SEQ ID NO: 334124 - RNA, 32 nt, Human
aucucggcucacugcagccuugacuuccuggg

SEQ ID NO: 334125 - RNA, 32 nt, Human
aucucggcucacugcagccuuugccucccggg

SEQ ID NO: 334126 - RNA, 32 nt, Human
aucucggcucacugcagcgucgacauuucggg

SEQ ID NO: 334127 - RNA, 24 nt, Human
aucucggcucacugcaggcucugc

SEQ ID NO: 334128 - RNA, 32 nt, Human
aucucggcucacugcaggcucugccuccuggg

SEQ ID NO: 334129 - RNA, 32 nt, Human
aucucggcucacugcagucaccuccucucagg

SEQ ID NO: 334130 - RNA, 21 nt, Human
aucucggcucacugcagucuc

SEQ ID NO: 334131 - RNA, 22 nt, Human
aucucggcucacugcagucuuc

SEQ ID NO: 334132 - RNA, 22 nt, Human
aucucggcucacugcauccucc

SEQ ID NO: 334133 - RNA, 32 nt, Human
aucucggcucacugcauccuccaccuccuggg

SEQ ID NO: 334134 - RNA, 24 nt, Human
aucucggcucacugcauccuccgc

SEQ ID NO: 334135 - RNA, 32 nt, Human
aucucggcucacugcauccuccgccucccggg

SEQ ID NO: 334136 - RNA, 24 nt, Human
aucucggcucacugcauccucugc

SEQ ID NO: 334137 - RNA, 32 nt, Human
aucucggcucacugcauccucugccucccggg

SEQ ID NO: 334138 - RNA, 32 nt, Human
aucucggcucacugcauccucugccuccuggg

SEQ ID NO: 334139 - RNA, 24 nt, Human
aucucggcucacugcaucuuccgc

SEQ ID NO: 334140 - RNA, 32 nt, Human
aucucggcucacugcaucuuccgccucccggg

SEQ ID NO: 334141 - RNA, 21 nt, Human
aucucggcucacugccaccuc

SEQ ID NO: 334142 - RNA, 22 nt, Human
aucucggcucacugccaccucc

SEQ ID NO: 334143 - RNA, 32 nt, Human
aucucggcucacugccaccucucccucauggu

SEQ ID NO: 334144 - RNA, 32 nt, Human
aucucggcucacugccaccucugccucccagg

SEQ ID NO: 334145 - RNA, 24 nt, Human
aucucggcucacugcgaccuccgu

SEQ ID NO: 334146 - RNA, 32 nt, Human
aucucggcucacugcgaccuccgucucccggg

SEQ ID NO: 334147 - RNA, 24 nt, Human
aucucggcucacugcgaccucugc

SEQ ID NO: 334148 - RNA, 32 nt, Human
aucucggcucacugcgaccucugccucccagg

SEQ ID NO: 334149 - RNA, 32 nt, Human
aucucggcucacugcgaccucugcuuccuggg

SEQ ID NO: 334150 - RNA, 32 nt, Human
aucucggcucacugcgagcuccaccucucggg

SEQ ID NO: 334151 - RNA, 32 nt, Human
aucucggcucacugcgagcucugccuccuggg

SEQ ID NO: 334152 - RNA, 32 nt, Human
aucucggcucacuguaaccuccaccuccuggg

SEQ ID NO: 334153 - RNA, 24 nt, Human
aucucggcucacuguaaccuccgc

SEQ ID NO: 334154 - RNA, 32 nt, Human
aucucggcucacuguaaccuccgccuccugaa

SEQ ID NO: 334155 - RNA, 32 nt, Human
aucucggcucacuguaaccuccgccuccuggg

SEQ ID NO: 334156 - RNA, 32 nt, Human
aucucggcucacuguaaccucugccuccugcc

SEQ ID NO: 334157 - RNA, 32 nt, Human
aucucggcucacuguaaccuucaccuacuggg

SEQ ID NO: 334158 - RNA, 24 nt, Human
aucucggcucacuguaagcuccgc

SEQ ID NO: 334159 - RNA, 32 nt, Human
aucucggcucacuguaagcuccgccucccggg

SEQ ID NO: 334160 - RNA, 24 nt, Human
aucucggcucacuguaaucuccgc

SEQ ID NO: 334161 - RNA, 32 nt, Human
aucucggcucacuguaaucuccgccuccuggg

SEQ ID NO: 334162 - RNA, 32 nt, Human
aucucggcucacuguaccucugucucccuggu

SEQ ID NO: 334163 - RNA, 21 nt, Human
aucucggcucacuguagccuc

SEQ ID NO: 334164 - RNA, 32 nt, Human
aucucggcucacuguagccucaaccugccagg

SEQ ID NO: 334165 - RNA, 24 nt, Human
aucucggcucacuguagccucugc

SEQ ID NO: 334166 - RNA, 24 nt, Human
aucucggcucacugugaccuccgc

SEQ ID NO: 334167 - RNA, 32 nt, Human
aucucggcucacugugaccucugccuccuggg

SEQ ID NO: 334168 - RNA, 32 nt, Human
aucucggcucacuugcacccuccgucucucgg

SEQ ID NO: 334169 - RNA, 32 nt, Human
aucucggcucagugcaaccucugccucccagg

SEQ ID NO: 334170 - RNA, 24 nt, Human
aucucggcucauagcaagcuccgc

SEQ ID NO: 334171 - RNA, 32 nt, Human
aucucggcucaucacaaccucugcuuccuggg

SEQ ID NO: 334172 - RNA, 24 nt, Human
aucucggcucauggcaagcuccgc

SEQ ID NO: 334173 - RNA, 22 nt, Human
aucucggcucauugcaaccucc

SEQ ID NO: 334174 - RNA, 32 nt, Human
aucucggcucauugcaaccuccaccuuccaga

SEQ ID NO: 334175 - RNA, 24 nt, Human
aucucggcucauugcaaccuccgc

SEQ ID NO: 334176 - RNA, 32 nt, Human
aucucggcucauugcaaccuccgccucccggg

SEQ ID NO: 334177 - RNA, 32 nt, Human
aucucggcucauugcaaccuccgccuccuggg

SEQ ID NO: 334178 - RNA, 32 nt, Human
aucucggcucauugcaaccuccgccuuccggg

SEQ ID NO: 334179 - RNA, 32 nt, Human
aucucggcucauugcaaccucugcuuccuggg

SEQ ID NO: 334180 - RNA, 24 nt, Human
aucucggcucauugcaagcuccgc

SEQ ID NO: 334181 - RNA, 22 nt, Human
aucucggcucccugcaaccucc

SEQ ID NO: 334182 - RNA, 32 nt, Human
aucucggcucccugcaaccuccaccucccggg

SEQ ID NO: 334183 - RNA, 32 nt, Human
aucucggcucccugcaaccuucgccucccggg

SEQ ID NO: 334184 - RNA, 22 nt, Human
aucucggcucgcuacaaccucc

SEQ ID NO: 334185 - RNA, 24 nt, Human
aucucggcucgcugcaaacucugc

SEQ ID NO: 334186 - RNA, 32 nt, Human
aucucggcucgcugcaaacucugccucccagg

SEQ ID NO: 334187 - RNA, 32 nt, Human
aucucggcucgcugcaaccuccgccucccggg

SEQ ID NO: 334188 - RNA, 32 nt, Human
aucucggcucgcugcaaccuccuccuccuggg

SEQ ID NO: 334189 - RNA, 32 nt, Human
aucucggcucgcugcagccucugccuccuggg

SEQ ID NO: 334190 - RNA, 22 nt, Human
aucucggcucuaugcaaccucc

SEQ ID NO: 334191 - RNA, 32 nt, Human
aucucggcucuaugcaaccuccaccuccuggg

SEQ ID NO: 334192 - RNA, 24 nt, Human
aucucggcucucugcaaccuccgc

SEQ ID NO: 334193 - RNA, 32 nt, Human
aucucggcucucugcaaccuccgccucccagg

SEQ ID NO: 334194 - RNA, 32 nt, Human
aucucggcucucugcaaccucugccucccggg

SEQ ID NO: 334195 - RNA, 32 nt, Human
aucucggcucucugcaaccucugucucccggg

SEQ ID NO: 334196 - RNA, 32 nt, Human
aucucggcugacugcaaccacugccuccaggg

SEQ ID NO: 334197 - RNA, 22 nt, Human
aucucggcugacugcaaccucc

SEQ ID NO: 334198 - RNA, 32 nt, Human
aucucggcugacugcaaccuccaccucccggg

SEQ ID NO: 334199 - RNA, 32 nt, Human
aucucggcugacugcaaccuccaccuccuggg

SEQ ID NO: 334200 - RNA, 32 nt, Human
aucucggcuuacuacgaccucugccuccuggg

SEQ ID NO: 334201 - RNA, 32 nt, Human
aucucggcuuacugaaaccucugccucccagg

SEQ ID NO: 334202 - RNA, 32 nt, Human
aucucggcuuacugcaaccuccaccucccagg

SEQ ID NO: 334203 - RNA, 24 nt, Human
aucucggcuuacugcaaccuccgc

SEQ ID NO: 334204 - RNA, 32 nt, Human
aucucggcuuacugcaaccuccgccuacuggg

SEQ ID NO: 334205 - RNA, 32 nt, Human
aucucggcuuacugcaaccuuugccucccagg

SEQ ID NO: 334206 - RNA, 32 nt, Human
aucucggcuuacugcaacuuccagcuccuggg

SEQ ID NO: 334207 - RNA, 24 nt, Human
aucucggcuuauggcaaccuccgc

SEQ ID NO: 334208 - RNA, 32 nt, Human
aucucggcuuauggcaaccuccgccucccggg

SEQ ID NO: 334209 - RNA, 24 nt, Human
aucucggcuuauugcaaccuccgc

SEQ ID NO: 334210 - RNA, 32 nt, Human
aucucggcuuauugcaaccuccgcuuccuggg

SEQ ID NO: 334211 - RNA, 22 nt, Human
aucucggcuuccugcaaccucc

SEQ ID NO: 334212 - RNA, 32 nt, Human
aucucgggaggcagagguugcagugagccgag

SEQ ID NO: 334213 - RNA, 32 nt, Human
aucucggggugaggaccagaccuuguucauaa

SEQ ID NO: 334214 - RNA, 24 nt, Human
aucucgggucacugcaaccuccgc

SEQ ID NO: 334215 - RNA, 32 nt, Human
aucucgggucacugcaaccuccgccucccggg

SEQ ID NO: 334216 - RNA, 32 nt, Human
aucucgggucacugcaaccucuaccuccaggg

SEQ ID NO: 334217 - RNA, 24 nt, Human
aucucgggucacugcaagcucugc

SEQ ID NO: 334218 - RNA, 32 nt, Human
aucucgggucacugcaagcucugccucccaag

SEQ ID NO: 334219 - RNA, 32 nt, Human
aucucgggugacugcaaccacugccucccagg

SEQ ID NO: 334220 - RNA, 32 nt, Human
aucucggugcagauggugcuuuccugaguggg

SEQ ID NO: 334221 - RNA, 32 nt, Human
aucucgguggaacuucagaaacgcugggcagu

SEQ ID NO: 334222 - RNA, 32 nt, Human
aucucggugucuuuccugcuuccaugagagcc

SEQ ID NO: 334223 - RNA, 32 nt, Human
aucucgguucacugcaacauucaccucccagg

SEQ ID NO: 334224 - RNA, 22 nt, Human
aucucgguucacugcaaccucc

SEQ ID NO: 334225 - RNA, 32 nt, Human
aucucgguucacugcaaccuccaccucccgag

SEQ ID NO: 334226 - RNA, 32 nt, Human
aucucgguucacugcaaccuccaccucucaga

SEQ ID NO: 334227 - RNA, 24 nt, Human
aucucgguucacugcaaccuccgc

SEQ ID NO: 334228 - RNA, 32 nt, Human
aucucgguucacugcaaccuccgccuccaggu

SEQ ID NO: 334229 - RNA, 32 nt, Human
aucucgguucacugcaaccuccgccucccggu

SEQ ID NO: 334230 - RNA, 32 nt, Human
aucucgguucacugcaaccucugccacccaug

SEQ ID NO: 334231 - RNA, 32 nt, Human
aucucgguucacugcaaccucugccucccagg

SEQ ID NO: 334232 - RNA, 32 nt, Human
aucucgguucacugcaaccucugccuccuggg

SEQ ID NO: 334233 - RNA, 32 nt, Human
aucucgguucacugcaaccuuggccuccuagg

SEQ ID NO: 334234 - RNA, 32 nt, Human
aucucgguucacugcagccuccaccucccgag

SEQ ID NO: 334235 - RNA, 32 nt, Human
aucucgguucacugcagccucugccuucuggg

SEQ ID NO: 334236 - RNA, 24 nt, Human
aucucgguucauugcaaccuccgc

SEQ ID NO: 334237 - RNA, 32 nt, Human
aucucgguucauugcaaccuccgccucccgag

SEQ ID NO: 334238 - RNA, 32 nt, Human
aucucgguucauugcaaccuccgccuccugcg

SEQ ID NO: 334239 - RNA, 32 nt, Human
aucucguccucuguccccaacuucuuaagcac

SEQ ID NO: 334240 - RNA, 24 nt, Human
aucucgucucacugcaaccuccgc

SEQ ID NO: 334241 - RNA, 32 nt, Human
aucucgucucacugcaaccuccgccucccaga

SEQ ID NO: 334242 - RNA, 32 nt, Human
aucucgucucacugcaaccucugccuccuggg

SEQ ID NO: 334243 - RNA, 32 nt, Human
aucucgugauccgccugccucugccucccaaa

SEQ ID NO: 334244 - RNA, 32 nt, Human
aucucguuagucugcauuccacagcuucucag

SEQ ID NO: 334245 - RNA, 32 nt, Human
aucucguuucuccucuuuccuccugcuucaug

SEQ ID NO: 334246 - RNA, 32 nt, Human
aucucguuucucuuggacaagcacagggaucu

SEQ ID NO: 334247 - RNA, 32 nt, Human
aucucuaaacagagacuggcccugccacugac

SEQ ID NO: 334248 - RNA, 32 nt, Human
aucucuaaaugcagauuccagaaaaauuacag

SEQ ID NO: 334249 - RNA, 32 nt, Human
aucucuaaaugcagcaaaacacugccugaaaa

SEQ ID NO: 334250 - RNA, 32 nt, Human
aucucuaacuagggccccagaggcugcuuaug

SEQ ID NO: 334251 - RNA, 32 nt, Human
aucucuaauuguaauccccacaugucgaggga

SEQ ID NO: 334252 - RNA, 32 nt, Human
aucucuacaaaaagacacaaaaauuagacagg

SEQ ID NO: 334253 - RNA, 32 nt, Human
aucucuacaaaaauacaaaauuagccagguau

SEQ ID NO: 334254 - RNA, 32 nt, Human
aucucuacagaaaguaaaagaaaaugagccag

SEQ ID NO: 334255 - RNA, 32 nt, Human
aucucuacauagaaaaacggaauuacaguugc

SEQ ID NO: 334256 - RNA, 32 nt, Human
aucucuacauagaaucuucagagccacaggcu

SEQ ID NO: 334257 - RNA, 32 nt, Human
aucucuaccacuccaaucgauguuuaguguga

SEQ ID NO: 334258 - RNA, 32 nt, Human
aucucuacuaaaaaguacaaaaauuagcuggg

SEQ ID NO: 334259 - RNA, 32 nt, Human
aucucuacuaaaaauacacaaaauuagcuggg

SEQ ID NO: 334260 - RNA, 32 nt, Human
aucucuacuaaaaauaccaaaaauuagccgag

SEQ ID NO: 334261 - RNA, 32 nt, Human
aucucuacuaaaacauacaaaaauuagccggg

SEQ ID NO: 334262 - RNA, 32 nt, Human
aucucuacuaaauacaaaaauuagcugggcgu

SEQ ID NO: 334263 - RNA, 22 nt, Human
aucucuacucacugcaaccucc

SEQ ID NO: 334264 - RNA, 32 nt, Human
aucucuacucacugcaaccuccaccucccggg

SEQ ID NO: 334265 - RNA, 32 nt, Human
aucucuacucacugcagccucaaucuccuggu

SEQ ID NO: 334266 - RNA, 32 nt, Human
aucucuacugcaaaauacaaaaauuagccggg

SEQ ID NO: 334267 - RNA, 32 nt, Human
aucucuacuuaaaaaugcaaaaauuagccgga

SEQ ID NO: 334268 - RNA, 30 nt, Human
aucucuagccucuuuguguuuuuguuguug

SEQ ID NO: 334269 - RNA, 24 nt, Human
aucucuagcuggaaaauccagaca

SEQ ID NO: 334270 - RNA, 30 nt, Human
aucucuaggcagcacagggcacagagcccu

SEQ ID NO: 334271 - RNA, 32 nt, Human
aucucuauauggcagcauuuuugaggcuuuau

SEQ ID NO: 334272 - RNA, 32 nt, Human
aucucuauccuucuucugguccuuccuagaaa

SEQ ID NO: 334273 - RNA, 32 nt, Human
aucucuauuugaagaaaaaguagagacaaaag

SEQ ID NO: 334274 - RNA, 32 nt, Human
aucucucaaacggcaacauuccucagaaacca

SEQ ID NO: 334275 - RNA, 32 nt, Human
aucucucaagccaccagcugccagccaccacg

SEQ ID NO: 334276 - RNA, 32 nt, Human
aucucucagggugccggcaccaugaagaucug

SEQ ID NO: 334277 - RNA, 32 nt, Human
aucucucauagcuuucuuuuccauuuuccccu

SEQ ID NO: 334278 - RNA, 32 nt, Human
aucucucauggugaaaucugcucuguacauca

SEQ ID NO: 334279 - RNA, 32 nt, Human
aucucucaugguugagaagugguggaggaugg

SEQ ID NO: 334280 - RNA, 32 nt, Human
aucucucauucuguauagaauucuugccgcca

SEQ ID NO: 334281 - RNA, 32 nt, Human
aucucuccacucccuguucaguugguucuuuu

SEQ ID NO: 334282 - RNA, 32 nt, Human
aucucuccagcacaguaagcaccaggagucca

SEQ ID NO: 334283 - RNA, 32 nt, Human
aucucuccagccugaauugucuucucuguguu

SEQ ID NO: 334284 - RNA, 32 nt, Human
aucucuccaugucacgcgcuccugggccagcc

SEQ ID NO: 334285 - RNA, 32 nt, Human
aucucucccacuguauggccgugccuagaccg

SEQ ID NO: 334286 - RNA, 32 nt, Human
aucucucccagagaacuacuggauuuccucau

SEQ ID NO: 334287 - RNA, 32 nt, Human
aucucuccccaucacuugccuugguagucacu

SEQ ID NO: 334288 - RNA, 32 nt, Human
aucucuccuccacaaagauuccuagacuuugg

SEQ ID NO: 334289 - RNA, 32 nt, Human
aucucuccucuacaguuuggaggugauggugc

SEQ ID NO: 334290 - RNA, 32 nt, Human
aucucuccuuccucccccucccuccccuuccc

SEQ ID NO: 334291 - RNA, 32 nt, Human
aucucucgggccagggagguugaggcugcagu

SEQ ID NO: 334292 - RNA, 32 nt, Human
aucucucguuuagcuaccaauuggagcaguuu

SEQ ID NO: 334293 - RNA, 32 nt, Human
aucucucuccacuuccccuuguccaguuccuc

SEQ ID NO: 334294 - RNA, 32 nt, Human
aucucucucugucacccaggcuggagugcagu

SEQ ID NO: 334295 - RNA, 32 nt, Human
aucucucugucaccucacccuucccugugcca

SEQ ID NO: 334296 - RNA, 32 nt, Human
aucucucuguccucuucuccccucucucagau

SEQ ID NO: 334297 - RNA, 32 nt, Human
aucucucuguucucucuccugccuccuccucc

SEQ ID NO: 334298 - RNA, 32 nt, Human
aucucucuucauuccuggaaugagccauggac

SEQ ID NO: 334299 - RNA, 32 nt, Human
aucucucuuccucccuuacuccgugcucccau

SEQ ID NO: 334300 - RNA, 32 nt, Human
aucucucuugcuuuuccccacagggucaaggu

SEQ ID NO: 334301 - RNA, 32 nt, Human
aucucugaaauccuuccuucucuuucccccua

SEQ ID NO: 334302 - RNA, 32 nt, Human
aucucugaaugucagaacccugucuuuuaaaa

SEQ ID NO: 334303 - RNA, 32 nt, Human
aucucugaccucagcuguggcucuuggugcug

SEQ ID NO: 334304 - RNA, 32 nt, Human
aucucugacuaaaaauacuuaaauuugguuug

SEQ ID NO: 334305 - RNA, 32 nt, Human
aucucugagagacguguggaagaggcugugaa

SEQ ID NO: 334306 - RNA, 32 nt, Human
aucucugaggacaucaccaucaucucaggaug

SEQ ID NO: 334307 - RNA, 32 nt, Human
aucucugaucccaagcccauaguuccucacug

SEQ ID NO: 334308 - RNA, 31 nt, Human
aucucugaugcuucuuuagauuuaagaguuc

SEQ ID NO: 334309 - RNA, 32 nt, Human
aucucugaugggagagggugaggaaaucagcu

SEQ ID NO: 334310 - RNA, 32 nt, Human
aucucugcacagaugagugccaccccagcguc

SEQ ID NO: 334311 - RNA, 32 nt, Human
aucucugcagaacaaccagcuggaaaagaucu

SEQ ID NO: 334312 - RNA, 32 nt, Human
aucucugcagggacuggccuuggccuagggaa

SEQ ID NO: 334313 - RNA, 32 nt, Human
aucucugcagggccgccagggagaccuggaca

SEQ ID NO: 334314 - RNA, 18 nt, Human
aucucugcaugccuuucu

SEQ ID NO: 334315 - RNA, 32 nt, Human
aucucugccaacaccaugaggcuuaaggugcu

SEQ ID NO: 334316 - RNA, 32 nt, Human
aucucugccaacccuuccccuguccucggguu

SEQ ID NO: 334317 - RNA, 32 nt, Human
aucucugcccaggacugggugccugcaucgcc

SEQ ID NO: 334318 - RNA, 32 nt, Human
aucucugcccccuccucuccccaggccucugg

SEQ ID NO: 334319 - RNA, 32 nt, Human
aucucugccgaggcugcuggaaucgacugggg

SEQ ID NO: 334320 - RNA, 32 nt, Human
aucucugccugggaaacaggcuucauucagca

SEQ ID NO: 334321 - RNA, 32 nt, Human
aucucugccuuccggguucaagugauucucgu

SEQ ID NO: 334322 - RNA, 32 nt, Human
aucucugccuuugccuguguguguucuggggg

SEQ ID NO: 334323 - RNA, 32 nt, Human
aucucugcguuucagugaccuaccuuaaaaca

SEQ ID NO: 334324 - RNA, 32 nt, Human
aucucugcuauuugggagacugaggcaggaga

SEQ ID NO: 334325 - RNA, 32 nt, Human
aucucugcucacuacaaccucugccucccagg

SEQ ID NO: 334326 - RNA, 24 nt, Human
aucucugcucacuacaagcucugc

SEQ ID NO: 334327 - RNA, 32 nt, Human
aucucugcucacuacaagcucugccucccgag

SEQ ID NO: 334328 - RNA, 24 nt, Human
aucucugcucacugaaagcuccgc

SEQ ID NO: 334329 - RNA, 32 nt, Human
aucucugcucacugaaagcuccgccucccggg

SEQ ID NO: 334330 - RNA, 24 nt, Human
aucucugcucacugcaaccuccgc

SEQ ID NO: 334331 - RNA, 32 nt, Human
aucucugcucacugcaaccuccgccucccggg

SEQ ID NO: 334332 - RNA, 32 nt, Human
aucucugcucacugcaaccucugccuccuggg

SEQ ID NO: 334333 - RNA, 24 nt, Human
aucucugcucacugcaagccccgc

SEQ ID NO: 334334 - RNA, 32 nt, Human
aucucugcucacugcaagcucagccucucggg

SEQ ID NO: 334335 - RNA, 24 nt, Human
aucucugcucacugcaagcuccgc

SEQ ID NO: 334336 - RNA, 32 nt, Human
aucucugcucacugcaagcuccgccaucuggg

SEQ ID NO: 334337 - RNA, 32 nt, Human
aucucugcucacugcaagcuccgccucccggg

SEQ ID NO: 334338 - RNA, 32 nt, Human
aucucugcucacugcaagcuccgccuccuggg

SEQ ID NO: 334339 - RNA, 32 nt, Human
aucucugcucacuguaaccucugccuccuggg

SEQ ID NO: 334340 - RNA, 32 nt, Human
aucucugcuccagaaaagauggcagccucuuu

SEQ ID NO: 334341 - RNA, 32 nt, Human
aucucugcucccacccuugccugccucuaacc

SEQ ID NO: 334342 - RNA, 32 nt, Human
aucucugcucccugcaaccuccaccucccggg

SEQ ID NO: 334343 - RNA, 24 nt, Human
aucucugcucccugcaagcuccgc

SEQ ID NO: 334344 - RNA, 32 nt, Human
aucucugcucuuugucagagauuugcaaagac

SEQ ID NO: 334345 - RNA, 32 nt, Human
aucucugcugggugguugggugaugugggggc

SEQ ID NO: 334346 - RNA, 32 nt, Human
aucucugcuucauuugugccucccucaccaug

SEQ ID NO: 334347 - RNA, 32 nt, Human
aucucugcuucccggguucaagcaauucuucu

SEQ ID NO: 334348 - RNA, 32 nt, Human
aucucuggagagaaagaggagagccucacggg

SEQ ID NO: 334349 - RNA, 32 nt, Human
aucucuggagccagagagaacaacaggcaggg

SEQ ID NO: 334350 - RNA, 32 nt, Human
aucucuggagccagcuucuagagguaggaaag

SEQ ID NO: 334351 - RNA, 32 nt, Human
aucucuggaggcagaaugagggagugagcagc

SEQ ID NO: 334352 - RNA, 32 nt, Human
aucucuggaguccuggcuuccagaaacaggau

SEQ ID NO: 334353 - RNA, 32 nt, Human
aucucuggaugccacagaccugagcagcauug

SEQ ID NO: 334354 - RNA, 32 nt, Human
aucucuggauuucaugaagguguaauaucguu

SEQ ID NO: 334355 - RNA, 32 nt, Human
aucucuggccauauccugccccucgcucgguc

SEQ ID NO: 334356 - RNA, 32 nt, Human
aucucuggccuuacccugccuuccugccucca

SEQ ID NO: 334357 - RNA, 32 nt, Human
aucucuggcucaccgcaaccuccgccucccag

SEQ ID NO: 334358 - RNA, 32 nt, Human
aucucuggcuuucuucucuccugcucaggacc

SEQ ID NO: 334359 - RNA, 32 nt, Human
aucucugggaauagggccaggaaaucugcccu

SEQ ID NO: 334360 - RNA, 32 nt, Human
aucucugggcuccgggguggcagugaggacca

SEQ ID NO: 334361 - RNA, 32 nt, Human
aucucuggggcccacucucuucugucuuccca

SEQ ID NO: 334362 - RNA, 32 nt, Human
aucucuggggguggggacaggggcgggggcag

SEQ ID NO: 334363 - RNA, 32 nt, Human
aucucuggucacagcaacagcccagcaggcag

SEQ ID NO: 334364 - RNA, 32 nt, Human
aucucuguauauguguuugugaaacugggaua

SEQ ID NO: 334365 - RNA, 32 nt, Human
aucucuguccacugcaaccuccacauccuggg

SEQ ID NO: 334366 - RNA, 32 nt, Human
aucucugucuuccucaagcuugguugugccug

SEQ ID NO: 334367 - RNA, 32 nt, Human
aucucugugacaugaaugcacacaucacaaug

SEQ ID NO: 334368 - RNA, 32 nt, Human
aucucugugacucugugccaaacuguguuucc

SEQ ID NO: 334369 - RNA, 32 nt, Human
aucucugugcaggaaccaagauggggcugaag

SEQ ID NO: 334370 - RNA, 32 nt, Human
aucucugugguuacaagaaacagccacugacc

SEQ ID NO: 334371 - RNA, 32 nt, Human
aucucuguguacacaaacagguacaaaccagc

SEQ ID NO: 334372 - RNA, 32 nt, Human
aucucuguucacugcaaccgccucccgugcuc

SEQ ID NO: 334373 - RNA, 32 nt, Human
aucucuguuccuuuuggcucuaauaugcuaca

SEQ ID NO: 334374 - RNA, 32 nt, Human
aucucuguugguuugucugucucugucuuccu

SEQ ID NO: 334375 - RNA, 32 nt, Human
aucucuguugugggcagcagggccagguccug

SEQ ID NO: 334376 - RNA, 32 nt, Human
aucucuucagugaucauaauagaucaucaaug

SEQ ID NO: 334377 - RNA, 30 nt, Human
aucucuucauccucgcaaagccagcuccac

SEQ ID NO: 334378 - RNA, 32 nt, Human
aucucuucauuucucuguacacugguuucucu

SEQ ID NO: 334379 - RNA, 32 nt, Human
aucucuuccacauuccuccuucuuauaagagc

SEQ ID NO: 334380 - RNA, 32 nt, Human
aucucuuccaucuggcuguuucuaaguugcau

SEQ ID NO: 334381 - RNA, 32 nt, Human
aucucuuccccagcuacagaggaaucuuuucu

SEQ ID NO: 334382 - RNA, 32 nt, Human
aucucuuccccuguuuucacaauggaggacuc

SEQ ID NO: 334383 - RNA, 32 nt, Human
aucucuuccuuuaguuuuucugagguagugca

SEQ ID NO: 334384 - RNA, 32 nt, Human
aucucuuccuuuccuuucccuuucuuuucuuu

SEQ ID NO: 334385 - RNA, 32 nt, Human
aucucuuccuuuuccuccucaucuuuucuccc

SEQ ID NO: 334386 - RNA, 32 nt, Human
aucucuucucaccucuuuccuagucaguauau

SEQ ID NO: 334387 - RNA, 22 nt, Human
aucucuucucacugcaaccucc

SEQ ID NO: 334388 - RNA, 32 nt, Human
aucucuucugcuucccaucccugcugccugga

SEQ ID NO: 334389 - RNA, 32 nt, Human
aucucuugaacccaggaggccgagguugcagu

SEQ ID NO: 334390 - RNA, 32 nt, Human
aucucuugaacccaggagguggaggaugcagu

SEQ ID NO: 334391 - RNA, 32 nt, Human
aucucuugaacccaggagguggagguugcagu

SEQ ID NO: 334392 - RNA, 32 nt, Human
aucucuugaacccgggaggcggagguugcagu

SEQ ID NO: 334393 - RNA, 32 nt, Human
aucucuugaacccgggaggugggaguuguagu

SEQ ID NO: 334394 - RNA, 32 nt, Human
aucucuugaacccgggaguuggagguugcagu

SEQ ID NO: 334395 - RNA, 32 nt, Human
aucucuugaacucuggagucugcucaccuucc

SEQ ID NO: 334396 - RNA, 32 nt, Human
aucucuugaacucuggguucucccagccccuu

SEQ ID NO: 334397 - RNA, 32 nt, Human
aucucuugaccucgugaucugccugccucagc

SEQ ID NO: 334398 - RNA, 32 nt, Human
aucucuugaccucgugaucugccugccuuggc

SEQ ID NO: 334399 - RNA, 32 nt, Human
aucucuugacucuccagaacaacucuaugagg

SEQ ID NO: 334400 - RNA, 32 nt, Human
aucucuugagccugagaaguggagauugcaau

SEQ ID NO: 334401 - RNA, 32 nt, Human
aucucuugccacuuccccucucuggcucugga

SEQ ID NO: 334402 - RNA, 32 nt, Human
aucucuugcggacuucucugccugguuuugug

SEQ ID NO: 334403 - RNA, 32 nt, Human
aucucuuggacuccagccuguaugcacagacc

SEQ ID NO: 334404 - RNA, 32 nt, Human
aucucuuggauguuuaggaaggaagacuuggc

SEQ ID NO: 334405 - RNA, 32 nt, Human
aucucuuggcauaccacugccucccagggaac

SEQ ID NO: 334406 - RNA, 32 nt, Human
aucucuuggucuccucucuuccucacucccuu

SEQ ID NO: 334407 - RNA, 32 nt, Human
aucucuugguucccucuuucugcugccagcuc

SEQ ID NO: 334408 - RNA, 32 nt, Human
aucucuuguccacuaaguaucuuguuaaaugc

SEQ ID NO: 334409 - RNA, 32 nt, Human
aucucuuguguauguuuuacuuauguauacca

SEQ ID NO: 334410 - RNA, 32 nt, Human
aucucuuuaccuccuuuucucuuucacggggc

SEQ ID NO: 334411 - RNA, 32 nt, Human
aucucuuuccaaucacuuguucauacaacagc

SEQ ID NO: 334412 - RNA, 32 nt, Human
aucucuuuccugccuuugcccugcacuguucc

SEQ ID NO: 334413 - RNA, 32 nt, Human
aucucuuucucucuuuccaucucccuugguug

SEQ ID NO: 334414 - RNA, 32 nt, Human
aucucuuucucuuccucccuucugccaucacu

SEQ ID NO: 334415 - RNA, 32 nt, Human
aucucuuugugcaaacaccaggaagcccuggu

SEQ ID NO: 334416 - RNA, 32 nt, Human
aucucuuuuauaggccugauaaaacucuucuc

SEQ ID NO: 334417 - RNA, 32 nt, Human
aucucuuuuggcucggaggccugugauauuuc

SEQ ID NO: 334418 - RNA, 32 nt, Human
aucucuuuuucagaauuuugagucuguaauuc

SEQ ID NO: 334419 - RNA, 32 nt, Human
aucugaaacagcuucaugggguggacucuaac

SEQ ID NO: 334420 - RNA, 32 nt, Human
aucugaaaccaccaguaccaccaccacuaccc

SEQ ID NO: 334421 - RNA, 32 nt, Human
aucugaaaggagcaaggaacagcaaggaauua

SEQ ID NO: 334422 - RNA, 32 nt, Human
aucugaaaugaucuuaauuacuagaagaucug

SEQ ID NO: 334423 - RNA, 32 nt, Human
aucugaacaacaacacuuuaagcuguuuuucu

SEQ ID NO: 334424 - RNA, 22 nt, Human
aucugaacacagaaggugugaa

SEQ ID NO: 334425 - RNA, 32 nt, Human
aucugaacacaugaaucuuuuugaucagagua

SEQ ID NO: 334426 - RNA, 32 nt, Human
aucugaacagaagaggacuuaggagagaucug

SEQ ID NO: 334427 - RNA, 32 nt, Human
aucugaacaggguuagucagcaaaauaaaauc

SEQ ID NO: 334428 - RNA, 32 nt, Human
aucugaacaugccucucucuugcuuacaaaug

SEQ ID NO: 334429 - RNA, 32 nt, Human
aucugaaccagcuguguccagacugaggcccc

SEQ ID NO: 334430 - RNA, 32 nt, Human
aucugaacccaggagacagguugcagugagcc

SEQ ID NO: 334431 - RNA, 32 nt, Human
aucugaacgugccucucucuugcuuacaaaug

SEQ ID NO: 334432 - RNA, 32 nt, Human
aucugaacuccuuggcuucuuuacuuaguuca

SEQ ID NO: 334433 - RNA, 32 nt, Human
aucugaacuguuuuguaaaucaucuuaucccc

SEQ ID NO: 334434 - RNA, 32 nt, Human
aucugaacuuccguuuccccagggccuccagc

SEQ ID NO: 334435 - RNA, 32 nt, Human
aucugaagagcagaaaauguguuaauaggagc

SEQ ID NO: 334436 - RNA, 32 nt, Human
aucugaagagcagcucaaagucuccaguggaa

SEQ ID NO: 334437 - RNA, 23 nt, Human
aucugaagcagcaaccccacuga

SEQ ID NO: 334438 - RNA, 32 nt, Human
aucugaagcagcagagugaacugcagagucag

SEQ ID NO: 334439 - RNA, 32 nt, Human
aucugaaggaagaaagcagcagcuggacaaug

SEQ ID NO: 334440 - RNA, 32 nt, Human
aucugaaggccaggcuuaccucugauucugau

SEQ ID NO: 334441 - RNA, 32 nt, Human
aucugaaggcugaaagagcccugggcuuggaa

SEQ ID NO: 334442 - RNA, 32 nt, Human
aucugaagggcggccugggaaggggcccugug

SEQ ID NO: 334443 - RNA, 32 nt, Human
aucugaaggggcgggguuagagccaagcugca

SEQ ID NO: 334444 - RNA, 32 nt, Human
aucugaaguguucacacuuacacauguaggac

SEQ ID NO: 334445 - RNA, 32 nt, Human
aucugaaguucaagggcgagccugggcuacag

SEQ ID NO: 334446 - RNA, 32 nt, Human
aucugaaucauguucuggguaaggggacgagg

SEQ ID NO: 334447 - RNA, 32 nt, Human
aucugaaucccaugggugugagggugaugggu

SEQ ID NO: 334448 - RNA, 32 nt, Human
aucugaauguguuucuggaaauggaccagcau

SEQ ID NO: 334449 - RNA, 32 nt, Human
aucugaauucuugcuucucucuccuuuuccuu

SEQ ID NO: 334450 - RNA, 32 nt, Human
aucugaauucuuuauguauauuccuagcuaua

SEQ ID NO: 334451 - RNA, 32 nt, Human
aucugacaaacuauugaccuucucccagagau

SEQ ID NO: 334452 - RNA, 32 nt, Human
aucugacaccuugccuugcucuugccaccagg

SEQ ID NO: 334453 - RNA, 32 nt, Human
aucugacagacaccagcucagccaggugauug

SEQ ID NO: 334454 - RNA, 32 nt, Human
aucugacaggaggcagagcucaggcgguaaug

SEQ ID NO: 334455 - RNA, 32 nt, Human
aucugacaucagcucuguucaugagugcucag

SEQ ID NO: 334456 - RNA, 32 nt, Human
aucugaccgcgggcucugcccaggaagaccga

SEQ ID NO: 334457 - RNA, 32 nt, Human
aucugacggcgcagguccuccccuucuguguc

SEQ ID NO: 334458 - RNA, 32 nt, Human
aucugacgucaucuugucucgaagucucuuuu

SEQ ID NO: 334459 - RNA, 32 nt, Human
aucugacuauggcaaggaucucugucacugag

SEQ ID NO: 334460 - RNA, 21 nt, Human
aucugacucuggcuucugcuu

SEQ ID NO: 334461 - RNA, 32 nt, Human
aucugacugguuuccccauguccucccauuca

SEQ ID NO: 334462 - RNA, 32 nt, Human
aucugacugucaccacugccaguggcugugga

SEQ ID NO: 334463 - RNA, 32 nt, Human
aucugacuuaaguccucucucccuccacuagu

SEQ ID NO: 334464 - RNA, 32 nt, Human
aucugacuucaguugugcccauguuauaaugu

SEQ ID NO: 334465 - RNA, 32 nt, Human
aucugacuugccacuagcacaggaagcucagg

SEQ ID NO: 334466 - RNA, 32 nt, Human
aucugacuuuucagaagaaaauaaacaaaugc

SEQ ID NO: 334467 - RNA, 32 nt, Human
aucugacuuuucccucuucaguugccugguau

SEQ ID NO: 334468 - RNA, 32 nt, Human
aucugagaauacugucuuuccauauggcuaag

SEQ ID NO: 334469 - RNA, 32 nt, Human
aucugagacaggaccuugccacgcuggccucu

SEQ ID NO: 334470 - RNA, 32 nt, Human
aucugagagagagucuguggauuggggguaac

SEQ ID NO: 334471 - RNA, 32 nt, Human
aucugagagauggaggcugcagugagccgaga

SEQ ID NO: 334472 - RNA, 32 nt, Human
aucugagaggguggguggcagaggggagcaga

SEQ ID NO: 334473 - RNA, 32 nt, Human
aucugagagugacuggggagccuuugguguuu

SEQ ID NO: 334474 - RNA, 32 nt, Human
aucugagauagaagaaugcuguggucaauuag

SEQ ID NO: 334475 - RNA, 32 nt, Human
aucugagcaaaucuuccucuagcuucaggagg

SEQ ID NO: 334476 - RNA, 32 nt, Human
aucugagcacagacagagggugcugugggucu

SEQ ID NO: 334477 - RNA, 32 nt, Human
aucugagcagccgccacccgcuccccagugcc

SEQ ID NO: 334478 - RNA, 32 nt, Human
aucugagcaggacaaggccccuguugcugaug

SEQ ID NO: 334479 - RNA, 32 nt, Human
aucugagccauugcaggccucugccugcugcc

SEQ ID NO: 334480 - RNA, 32 nt, Human
aucugagcccccuucagagggugggacagggg

SEQ ID NO: 334481 - RNA, 32 nt, Human
aucugagccucaggagguugaggcugcaguga

SEQ ID NO: 334482 - RNA, 32 nt, Human
aucugagcucacugcaaccucugacucccaga

SEQ ID NO: 334483 - RNA, 32 nt, Human
aucugagcucacugcaaccucugccucccaag

SEQ ID NO: 334484 - RNA, 32 nt, Human
aucugagcuggaaacucuucacugccaagucu

SEQ ID NO: 334485 - RNA, 32 nt, Human
aucugaggaaugcagaaaaaccagggcaggac

SEQ ID NO: 334486 - RNA, 23 nt, Human
aucugaggacccagccucaggga

SEQ ID NO: 334487 - RNA, 32 nt, Human
aucugaggagaaaggagagccaguccgagucc

SEQ ID NO: 334488 - RNA, 32 nt, Human
aucugaggagcuccauaaagagguucaagaag

SEQ ID NO: 334489 - RNA, 32 nt, Human
aucugaggcuccuucacuuucucuccauggga

SEQ ID NO: 334490 - RNA, 32 nt, Human
aucugaggcuucuguugcugauacaagaggca

SEQ ID NO: 334491 - RNA, 32 nt, Human
aucugagggaaagacacaccaagcaaagggaa

SEQ ID NO: 334492 - RNA, 32 nt, Human
aucugagggcugcuccccuuuuagaauuuacc

SEQ ID NO: 334493 - RNA, 32 nt, Human
aucugagguauuaagaaauggagagaaaaaua

SEQ ID NO: 334494 - RNA, 32 nt, Human
aucugaggucacugcaaccuccaccucccggg

SEQ ID NO: 334495 - RNA, 32 nt, Human
aucugaggugugaguagagccugggggagagu

SEQ ID NO: 334496 - RNA, 31 nt, Human
aucugaguguguauaagcacagcaggacacc

SEQ ID NO: 334497 - RNA, 32 nt, Human
aucugaguucccaguacacuagucuccccuua

SEQ ID NO: 334498 - RNA, 32 nt, Human
aucugaguugggaguaaggcccccagggacac

SEQ ID NO: 334499 - RNA, 32 nt, Human
aucugaguuuucaguaaaaugauuauggaauu

SEQ ID NO: 334500 - RNA, 24 nt, Human
aucugauagaaacacuagcaccag

SEQ ID NO: 334501 - RNA, 32 nt, Human
aucugauauuuuuacagucugaucuuuugacu

SEQ ID NO: 334502 - RNA, 32 nt, Human
aucugaucacacuugugccaacuugauucaua

SEQ ID NO: 334503 - RNA, 32 nt, Human
aucugaucagcuguggugugaggacuucucag

SEQ ID NO: 334504 - RNA, 32 nt, Human
aucugaucccccauagacuuggggauggacag

SEQ ID NO: 334505 - RNA, 32 nt, Human
aucugaugaaggauaaagaaguauuugaugug

SEQ ID NO: 334506 - RNA, 32 nt, Human
aucugaugagcuucuuucuucuggcaucauua

SEQ ID NO: 334507 - RNA, 32 nt, Human
aucugauguucucagaaggggguggauuuaaa

SEQ ID NO: 334508 - RNA, 32 nt, Human
aucugauguugauccugucucagucuccccac

SEQ ID NO: 334509 - RNA, 26 nt, Human
aucugauuaaaaugcuuccucccagc

SEQ ID NO: 334510 - RNA, 32 nt, Human
aucugauuccucugcugucccugccaggagcu

SEQ ID NO: 334511 - RNA, 31 nt, Human
aucugauuugcucuuugccaugcagaccugu

SEQ ID NO: 334512 - RNA, 32 nt, Human
aucugcaacccuggggaggaccccaacucacc

SEQ ID NO: 334513 - RNA, 32 nt, Human
aucugcaacuaucaaaaaugaggggaaaaggu

SEQ ID NO: 334514 - RNA, 23 nt, Human
aucugcaacuucauuuuccccca

SEQ ID NO: 334515 - RNA, 32 nt, Human
aucugcaagccaaggagagaggcugcaggaga

SEQ ID NO: 334516 - RNA, 32 nt, Human
aucugcaaggcugaacaacagccccugggguu

SEQ ID NO: 334517 - RNA, 32 nt, Human
aucugcaagggcugcaggagaacauucacgag

SEQ ID NO: 334518 - RNA, 18 nt, Human
aucugcaagucccugaca

SEQ ID NO: 334519 - RNA, 32 nt, Human
aucugcacaaaugcaauguuuacaagaacugg

SEQ ID NO: 334520 - RNA, 32 nt, Human
aucugcacagucccuguccuagugcaggacuu

SEQ ID NO: 334521 - RNA, 32 nt, Human
aucugcaccaugggccaaguuucucagaaaau

SEQ ID NO: 334522 - RNA, 32 nt, Human
aucugcaccccuggcccugcucugggcuucag

SEQ ID NO: 334523 - RNA, 32 nt, Human
aucugcagacuccugagggcuagaggacagag

SEQ ID NO: 334524 - RNA, 19 nt, Human
aucugcagaggccaaguaa

SEQ ID NO: 334525 - RNA, 32 nt, Human
aucugcagaguuuugagggcugugcugaccuu

SEQ ID NO: 334526 - RNA, 32 nt, Human
aucugcagccuccaccaggccuugaguagcuu

SEQ ID NO: 334527 - RNA, 32 nt, Human
aucugcagccuccucugugacuccccuuucuc

SEQ ID NO: 334528 - RNA, 32 nt, Human
aucugcagcucucagaggacgacugggcagcc

SEQ ID NO: 334529 - RNA, 32 nt, Human
aucugcaggaagcagagagagcagggcuguuc

SEQ ID NO: 334530 - RNA, 32 nt, Human
aucugcaggagaagacauuuuagugaaauugu

SEQ ID NO: 334531 - RNA, 32 nt, Human
aucugcagggcacagccagggaaggaaauggu

SEQ ID NO: 334532 - RNA, 32 nt, Human
aucugcagguccccagccuggguaaagauggc

SEQ ID NO: 334533 - RNA, 21 nt, Human
aucugcagguggaaggaggug

SEQ ID NO: 334534 - RNA, 32 nt, Human
aucugcagugaugcaauaaccagcauaauaaa

SEQ ID NO: 334535 - RNA, 32 nt, Human
aucugcagugccagcuucuccuucucggugac

SEQ ID NO: 334536 - RNA, 32 nt, Human
aucugcagugccuggcacaucacuggaaaaac

SEQ ID NO: 334537 - RNA, 32 nt, Human
aucugcaguguugaggccagucacuguuggaa

SEQ ID NO: 334538 - RNA, 32 nt, Human
aucugcauaagucugauucuauuucuaugacu

SEQ ID NO: 334539 - RNA, 32 nt, Human
aucugcauagagcuggucucacuguggcgcag

SEQ ID NO: 334540 - RNA, 32 nt, Human
aucugcauauucuggaucauagauguucuuag

SEQ ID NO: 334541 - RNA, 32 nt, Human
aucugcauccagggcuggaggaccgauguaca

SEQ ID NO: 334542 - RNA, 32 nt, Human
aucugcaucugggaccgaccuccugggcuggc

SEQ ID NO: 334543 - RNA, 32 nt, Human
aucugcauggggcucagaggcuguaagaacug

SEQ ID NO: 334544 - RNA, 32 nt, Human
aucugcauuucuaacaggcuccugcccccaag

SEQ ID NO: 334545 - RNA, 32 nt, Human
aucugccaaacauuauauuacuaauaaaacuu

SEQ ID NO: 334546 - RNA, 20 nt, Human
aucugccaacaccagaacuu

SEQ ID NO: 334547 - RNA, 32 nt, Human
aucugccaauagacccaggacgaguaagagag

SEQ ID NO: 334548 - RNA, 32 nt, Human
aucugccacaaaccuguggcggcuucagaucu

SEQ ID NO: 334549 - RNA, 32 nt, Human
aucugccacauagaaggcucucaacaucaugu

SEQ ID NO: 334550 - RNA, 32 nt, Human
aucugccacccagguucaagugauucucgugu

SEQ ID NO: 334551 - RNA, 21 nt, Human
aucugccaccggaaauaccau

SEQ ID NO: 334552 - RNA, 32 nt, Human
aucugccacugcacuccagccuggcgacagag

SEQ ID NO: 334553 - RNA, 32 nt, Human
aucugccacugcugcugacugccacuaccagc

SEQ ID NO: 334554 - RNA, 32 nt, Human
aucugccauauaaaggagauguuucucauucg

SEQ ID NO: 334555 - RNA, 32 nt, Human
aucugccauugauguccagccucugacaugcu

SEQ ID NO: 334556 - RNA, 32 nt, Human
aucugcccaagguaaggagcagaggaggcaug

SEQ ID NO: 334557 - RNA, 32 nt, Human
aucugcccaauaaagcagaaacaugcugaauu

SEQ ID NO: 334558 - RNA, 22 nt, Human
aucugcccaccucagccuccca

SEQ ID NO: 334559 - RNA, 32 nt, Human
aucugcccaguaaauaccagcucguagcaguu

SEQ ID NO: 334560 - RNA, 32 nt, Human
aucugcccauuuccugucuacauucuccuccc

SEQ ID NO: 334561 - RNA, 32 nt, Human
aucugccccagcugccuccacagacugcuguc

SEQ ID NO: 334562 - RNA, 32 nt, Human
aucugcccccugcgccuggccuccgagggcuu

SEQ ID NO: 334563 - RNA, 22 nt, Human
aucugcccgccucugccuccca

SEQ ID NO: 334564 - RNA, 32 nt, Human
aucugcccuccccaaacaucucccucccuacc

SEQ ID NO: 334565 - RNA, 32 nt, Human
aucugcccugcaccaguggccuccaggaaguu

SEQ ID NO: 334566 - RNA, 32 nt, Human
aucugcccuucugucggaccccaggguacguc

SEQ ID NO: 334567 - RNA, 21 nt, Human
aucugccgccaaauacaucca

SEQ ID NO: 334568 - RNA, 32 nt, Human
aucugccguccgggcccugccaggcuugccag

SEQ ID NO: 334569 - RNA, 32 nt, Human
aucugccuauguuuuccuuucucaugcuuuua

SEQ ID NO: 334570 - RNA, 32 nt, Human
aucugccuccaggaccauucaggcuguugaca

SEQ ID NO: 334571 - RNA, 32 nt, Human
aucugccuccuucugugccugccuggcugccc

SEQ ID NO: 334572 - RNA, 32 nt, Human
aucugccucuggcugccugcguccucucggug

SEQ ID NO: 334573 - RNA, 32 nt, Human
aucugccugauccaccuccuccucccaccaca

SEQ ID NO: 334574 - RNA, 32 nt, Human
aucugccugcagcgucacaccgauggccuggc

SEQ ID NO: 334575 - RNA, 32 nt, Human
aucugccugccccucacacacuugcuccccaa

SEQ ID NO: 334576 - RNA, 32 nt, Human
aucugccugccucccaggcagcugcugccuca

SEQ ID NO: 334577 - RNA, 32 nt, Human
aucugccugccugcggccugucuguguuuguc

SEQ ID NO: 334578 - RNA, 32 nt, Human
aucugccugccuggaaagaugagaacacuguu

SEQ ID NO: 334579 - RNA, 32 nt, Human
aucugccuggccccaucuaccuucccuggaag

SEQ ID NO: 334580 - RNA, 32 nt, Human
aucugccuguagucccagcuacucgggaggcu

SEQ ID NO: 334581 - RNA, 32 nt, Human
aucugccuguccggggcaccaggcugggacag

SEQ ID NO: 334582 - RNA, 32 nt, Human
aucugccugugcugggacuuccuguacuaccc

SEQ ID NO: 334583 - RNA, 32 nt, Human
aucugccuucuccaaauuuuaugagcagucug

SEQ ID NO: 334584 - RNA, 32 nt, Human
aucugcgccuccauuuucuaucugcacuuuuu

SEQ ID NO: 334585 - RNA, 31 nt, Human
aucugcggggcgauaggaugggugagucaga

SEQ ID NO: 334586 - RNA, 32 nt, Human
aucugcguggugcugggauguggggacucugg

SEQ ID NO: 334587 - RNA, 32 nt, Human
aucugcguguaugucaaggaagugagaugcca

SEQ ID NO: 334588 - RNA, 32 nt, Human
aucugcguuccuucuggacucuccaaguaagc

SEQ ID NO: 334589 - RNA, 32 nt, Human
aucugcuaaaacugauggcuacauggaaaaag

SEQ ID NO: 334590 - RNA, 32 nt, Human
aucugcuaggacccugcagcugugcugccgcc

SEQ ID NO: 334591 - RNA, 32 nt, Human
aucugcuaugugaggacucuggagagaaauga

SEQ ID NO: 334592 - RNA, 32 nt, Human
aucugcucaagaggauccccucugaucuacag

SEQ ID NO: 334593 - RNA, 21 nt, Human
aucugcuccccucaacucuca

SEQ ID NO: 334594 - RNA, 32 nt, Human
aucugcucuccucagccucccaaaguacuggg

SEQ ID NO: 334595 - RNA, 32 nt, Human
aucugcucugagccaagguucuccaaguagcu

SEQ ID NO: 334596 - RNA, 32 nt, Human
aucugcucugcucucggugaccuugcaacuuc

SEQ ID NO: 334597 - RNA, 32 nt, Human
aucugcucugucacuucaccuuagcucagugc

SEQ ID NO: 334598 - RNA, 32 nt, Human
aucugcucuguucaccuucauccaggccuuug

SEQ ID NO: 334599 - RNA, 32 nt, Human
aucugcugaaaugacacguuuauucuucaucu

SEQ ID NO: 334600 - RNA, 32 nt, Human
aucugcugaacagugaccuccaccaccuuggg

SEQ ID NO: 334601 - RNA, 32 nt, Human
aucugcugagccuuugcucaaauauagcagcu

SEQ ID NO: 334602 - RNA, 32 nt, Human
aucugcugcaggcaggaaggcaugugagugua

SEQ ID NO: 334603 - RNA, 32 nt, Human
aucugcugcaucugaagagcuggguccagcuu

SEQ ID NO: 334604 - RNA, 32 nt, Human
aucugcugccagaaaauguaaaccugaguuga

SEQ ID NO: 334605 - RNA, 32 nt, Human
aucugcugcuuuugauguugcaagacaaauau

SEQ ID NO: 334606 - RNA, 32 nt, Human
aucugcuggccuagggccuggagaccuucucc

SEQ ID NO: 334607 - RNA, 32 nt, Human
aucugcuggcuucagcccuggcagcugagaaa

SEQ ID NO: 334608 - RNA, 32 nt, Human
aucugcugggccagucccuauggcaagcacag

SEQ ID NO: 334609 - RNA, 32 nt, Human
aucugcugggcucugccuuaaacacacauugc

SEQ ID NO: 334610 - RNA, 32 nt, Human
aucugcuguaacuuccagugcaagauaauuca

SEQ ID NO: 334611 - RNA, 32 nt, Human
aucugcuuagaauguggcccugguuucuuuuc

SEQ ID NO: 334612 - RNA, 32 nt, Human
aucugcuucaaccuuaggauguuuucagacca

SEQ ID NO: 334613 - RNA, 32 nt, Human
aucugcuuccaaggcuccgcuucagaggcggc

SEQ ID NO: 334614 - RNA, 32 nt, Human
aucugcuuccagaugagccagugccucgcaug

SEQ ID NO: 334615 - RNA, 32 nt, Human
aucugcuucucagacccaaucacuguggccag

SEQ ID NO: 334616 - RNA, 32 nt, Human
aucugcuucugucccuggcuugaguccugggc

SEQ ID NO: 334617 - RNA, 32 nt, Human
aucugcuugaagcacauuuugcuaauguuuua

SEQ ID NO: 334618 - RNA, 32 nt, Human
aucugcuugugaagguucugucuuuaccacca

SEQ ID NO: 334619 - RNA, 32 nt, Human
aucugcuuuaauuuuaaaaucaucacuaacag

SEQ ID NO: 334620 - RNA, 32 nt, Human
aucugcuuuacaugauacuaugcaaugcuugu

SEQ ID NO: 334621 - RNA, 32 nt, Human
aucugcuuuacucaaaugaugaucucauccac

SEQ ID NO: 334622 - RNA, 32 nt, Human
aucugcuuuauucccauugcugucugcaggcu

SEQ ID NO: 334623 - RNA, 32 nt, Human
aucugcuuucaccaagcugucucuccaccgug

SEQ ID NO: 334624 - RNA, 32 nt, Human
aucugcuuucuauggcaucugaagggaacuaa

SEQ ID NO: 334625 - RNA, 32 nt, Human
aucugcuuugggccgcagcagugcuggguguu

SEQ ID NO: 334626 - RNA, 32 nt, Human
aucuggaaaaacagaccagaaggcuucucuuc

SEQ ID NO: 334627 - RNA, 32 nt, Human
aucuggaaagaaaggaaggaaaacaaaggcgg

SEQ ID NO: 334628 - RNA, 32 nt, Human
aucuggaaagugauuuaucaggaugugagcac

SEQ ID NO: 334629 - RNA, 32 nt, Human
aucuggaacgcugugggcaucuucugcccaug

SEQ ID NO: 334630 - RNA, 32 nt, Human
aucuggaagagagauucugaucugcccaccuc

SEQ ID NO: 334631 - RNA, 32 nt, Human
aucuggaagaggaagaagagaggaaugagaaa

SEQ ID NO: 334632 - RNA, 32 nt, Human
aucuggaagccuuucuggauuaauccagugau

SEQ ID NO: 334633 - RNA, 32 nt, Human
aucuggaaggcagagguugcagugagauugca

SEQ ID NO: 334634 - RNA, 32 nt, Human
aucuggaaggcaggcaggacgggggcguuggg

SEQ ID NO: 334635 - RNA, 32 nt, Human
aucuggaaguucugggauucagguuguuauua

SEQ ID NO: 334636 - RNA, 32 nt, Human
aucuggaauaccaagaggacauguauugaaac

SEQ ID NO: 334637 - RNA, 31 nt, Human
aucuggacaaaugccaccacagcaggugggg

SEQ ID NO: 334638 - RNA, 32 nt, Human
aucuggacaacccaauugagccacuuuaucuc

SEQ ID NO: 334639 - RNA, 32 nt, Human
aucuggacagucaaacucuucccacugcgcca

SEQ ID NO: 334640 - RNA, 32 nt, Human
aucuggaccaagcaaggaagccggcaggagcc

SEQ ID NO: 334641 - RNA, 32 nt, Human
aucuggaccaguuucccugcugugcuguggcc

SEQ ID NO: 334642 - RNA, 32 nt, Human
aucuggaccgaggugugggaguguggagcagg

SEQ ID NO: 334643 - RNA, 32 nt, Human
aucuggacgaucugucucucugcuccaaagaa

SEQ ID NO: 334644 - RNA, 32 nt, Human
aucuggacuccuggauaggcagcuggaccaac

SEQ ID NO: 334645 - RNA, 32 nt, Human
aucuggagaacagcugggccuccucacucagg

SEQ ID NO: 334646 - RNA, 32 nt, Human
aucuggagagcauccuaacugcauuucaacuc

SEQ ID NO: 334647 - RNA, 32 nt, Human
aucuggagaucuggacugcugccccuuagaua

SEQ ID NO: 334648 - RNA, 32 nt, Human
aucuggagccccugaagaccagucccacccac

SEQ ID NO: 334649 - RNA, 32 nt, Human
aucuggaggagagagucggagagcagaaacca

SEQ ID NO: 334650 - RNA, 32 nt, Human
aucuggaggcgggggccagggcgaagguauaa

SEQ ID NO: 334651 - RNA, 32 nt, Human
aucuggagggcagggguugaggggccaccacc

SEQ ID NO: 334652 - RNA, 32 nt, Human
aucuggaggguacagaggugaauggcuuuggu

SEQ ID NO: 334653 - RNA, 32 nt, Human
aucuggauaagaaugcaaugcacugcuugguu

SEQ ID NO: 334654 - RNA, 32 nt, Human
aucuggaucagauucugggggcucagaaacgu

SEQ ID NO: 334655 - RNA, 32 nt, Human
aucuggaugugaagagaaagagaaaaacaaaa

SEQ ID NO: 334656 - RNA, 32 nt, Human
aucuggauuccugguucccugaaggaggagag

SEQ ID NO: 334657 - RNA, 32 nt, Human
aucuggcaaaggcagagaccaaacuucauacc

SEQ ID NO: 334658 - RNA, 32 nt, Human
aucuggcaaucagaagcccaaacugccuuuga

SEQ ID NO: 334659 - RNA, 32 nt, Human
aucuggcacaaggugugccugggaaacccugg

SEQ ID NO: 334660 - RNA, 32 nt, Human
aucuggcacacggggcagagcagagaagcuca

SEQ ID NO: 334661 - RNA, 32 nt, Human
aucuggcagaaguuuccagaaggaggucacuu

SEQ ID NO: 334662 - RNA, 32 nt, Human
aucuggcagauggugccucugccugcucuucu

SEQ ID NO: 334663 - RNA, 32 nt, Human
aucuggcagcaugcaaaugauacauuggaaau

SEQ ID NO: 334664 - RNA, 32 nt, Human
aucuggcaggaggcagagcucaggugggaaug

SEQ ID NO: 334665 - RNA, 32 nt, Human
aucuggcagggugggauggaggagaagaauuu

SEQ ID NO: 334666 - RNA, 32 nt, Human
aucuggcagugagacugaggaugaggacagca

SEQ ID NO: 334667 - RNA, 32 nt, Human
aucuggcaugaggaaauauggagagggaauua

SEQ ID NO: 334668 - RNA, 32 nt, Human
aucuggcauggaguaggugcucaccaguguuu

SEQ ID NO: 334669 - RNA, 32 nt, Human
aucuggcaugggacaggaagggcagagaaggg

SEQ ID NO: 334670 - RNA, 32 nt, Human
aucuggccauggcggacacucagcauuuguug

SEQ ID NO: 334671 - RNA, 32 nt, Human
aucuggccauugcacuccagcgugggcaacag

SEQ ID NO: 334672 - RNA, 19 nt, Human
aucuggcccauggcuguca

SEQ ID NO: 334673 - RNA, 32 nt, Human
aucuggccccagagaagggcagagggaaaggg

SEQ ID NO: 334674 - RNA, 32 nt, Human
aucuggcccuggaccuucugauuugcacagug

SEQ ID NO: 334675 - RNA, 32 nt, Human
aucuggcccuggccagcucugcauuugacaaa

SEQ ID NO: 334676 - RNA, 32 nt, Human
aucuggccucagacaacuacugguggcaagcu

SEQ ID NO: 334677 - RNA, 32 nt, Human
aucuggccuggcugggaggcuugggggcagga

SEQ ID NO: 334678 - RNA, 32 nt, Human
aucuggcgugaggaaauacggagagggaaacu

SEQ ID NO: 334679 - RNA, 32 nt, Human
aucuggcguucuguuuaggguacaccaauaug

SEQ ID NO: 334680 - RNA, 32 nt, Human
aucuggcucacugcagccuccgccucccgggu

SEQ ID NO: 334681 - RNA, 32 nt, Human
aucuggcucacugcauccucaacuuccugggc

SEQ ID NO: 334682 - RNA, 32 nt, Human
aucuggcuccguuucuggugcuucuggaaguc

SEQ ID NO: 334683 - RNA, 32 nt, Human
aucuggcucugcccucaacacgcccugaagcu

SEQ ID NO: 334684 - RNA, 32 nt, Human
aucuggcugggaaaggggaccaggagugcagg

SEQ ID NO: 334685 - RNA, 32 nt, Human
aucuggcugggaucaagaaaccucuuuucacu

SEQ ID NO: 334686 - RNA, 32 nt, Human
aucuggcugggaugugaagggcagcacucccu

SEQ ID NO: 334687 - RNA, 32 nt, Human
aucuggcugugaugaaugaggucuaggaaaua

SEQ ID NO: 334688 - RNA, 32 nt, Human
aucuggcuguuucccaggcugaagugcagugg

SEQ ID NO: 334689 - RNA, 32 nt, Human
aucugggaagagaaauggagaauaagcagcac

SEQ ID NO: 334690 - RNA, 32 nt, Human
aucugggaagcauaguuuauuugcaaguguuc

SEQ ID NO: 334691 - RNA, 32 nt, Human
aucugggaagcggagguugcagugagcugaga

SEQ ID NO: 334692 - RNA, 32 nt, Human
aucugggaaugaggcaguggguggagagagaa

SEQ ID NO: 334693 - RNA, 32 nt, Human
aucugggaccacaggcgugcaccaccaugcau

SEQ ID NO: 334694 - RNA, 32 nt, Human
aucugggaccucuauugcuggagggaggcugc

SEQ ID NO: 334695 - RNA, 32 nt, Human
aucugggacgugaggagugccucugccuggac

SEQ ID NO: 334696 - RNA, 32 nt, Human
aucugggacuacagaugcgugccaccaagccu

SEQ ID NO: 334697 - RNA, 32 nt, Human
aucugggacuacaggcaugcgccaccacgccc

SEQ ID NO: 334698 - RNA, 32 nt, Human
aucugggagagaaggugacacagcugggccca

SEQ ID NO: 334699 - RNA, 32 nt, Human
aucugggagagggaagggagguguugggcucc

SEQ ID NO: 334700 - RNA, 32 nt, Human
aucugggagagguggaggaggggaugaccaaa

SEQ ID NO: 334701 - RNA, 32 nt, Human
aucugggagauccugcauuucuaacaagcucc

SEQ ID NO: 334702 - RNA, 32 nt, Human
aucugggagauccuguuaaaaugcagguucug

SEQ ID NO: 334703 - RNA, 32 nt, Human
aucugggagaugaccugccuuauccuguucua

SEQ ID NO: 334704 - RNA, 32 nt, Human
aucugggagcuguccagccaggucuggugcug

SEQ ID NO: 334705 - RNA, 32 nt, Human
aucugggaggcagagguugcagugagccgaga

SEQ ID NO: 334706 - RNA, 32 nt, Human
aucugggaggcagagguugcagugagcugaga

SEQ ID NO: 334707 - RNA, 32 nt, Human
aucugggaggcagagguugcugugagccgaga

SEQ ID NO: 334708 - RNA, 32 nt, Human
aucugggaggcagaguuugccgugagcugaga

SEQ ID NO: 334709 - RNA, 32 nt, Human
aucugggaggcggagauugcagugagccgaga

SEQ ID NO: 334710 - RNA, 25 nt, Human
aucugggaggcggagguugcaguga

SEQ ID NO: 334711 - RNA, 32 nt, Human
aucugggaggcggagguugcagugagccagga

SEQ ID NO: 334712 - RNA, 32 nt, Human
aucugggagguggaaguugcagugagccgaga

SEQ ID NO: 334713 - RNA, 32 nt, Human
aucugggagguggagguugcagugagccaaga

SEQ ID NO: 334714 - RNA, 32 nt, Human
aucugggauuacaggcaugugccaccacaccu

SEQ ID NO: 334715 - RNA, 32 nt, Human
aucugggauuacaggcgugcaccaccaugccu

SEQ ID NO: 334716 - RNA, 32 nt, Human
aucugggauuacaggugcccaccaccaugccu

SEQ ID NO: 334717 - RNA, 32 nt, Human
aucugggauuacaggugcccgcuaccaugccc

SEQ ID NO: 334718 - RNA, 32 nt, Human
aucugggauugcaggugcacaccaccacgccc

SEQ ID NO: 334719 - RNA, 32 nt, Human
aucugggcagucaggggcaaggacuguuggag

SEQ ID NO: 334720 - RNA, 32 nt, Human
aucugggcauuuuccuccucugccuacagcca

SEQ ID NO: 334721 - RNA, 18 nt, Human
aucugggccaaccagggg

SEQ ID NO: 334722 - RNA, 32 nt, Human
aucugggcccaccucuccccugccucaagccc

SEQ ID NO: 334723 - RNA, 32 nt, Human
aucugggccuaugcuuccuucuggaccaccau

SEQ ID NO: 334724 - RNA, 32 nt, Human
aucugggcucaagugaugcuccugucucagcc

SEQ ID NO: 334725 - RNA, 24 nt, Human
aucugggcucacugcaaccuccgc

SEQ ID NO: 334726 - RNA, 32 nt, Human
aucugggcucacugcaaccuccgccucccugg

SEQ ID NO: 334727 - RNA, 32 nt, Human
aucugggcucacugcaaccuccuccuccugga

SEQ ID NO: 334728 - RNA, 32 nt, Human
aucugggcucauugcaaccuccgccucccggc

SEQ ID NO: 334729 - RNA, 32 nt, Human
aucugggcucauugcaaccucugccucccggg

SEQ ID NO: 334730 - RNA, 32 nt, Human
aucugggcugguuugucuggggagacagacag

SEQ ID NO: 334731 - RNA, 32 nt, Human
aucugggcuuucuaaagcaagugaccugaagg

SEQ ID NO: 334732 - RNA, 31 nt, Human
aucuggggagcgggugugcucacuuacauua

SEQ ID NO: 334733 - RNA, 32 nt, Human
aucuggggaggcagaggugacagugagcugag

SEQ ID NO: 334734 - RNA, 32 nt, Human
aucuggggcacagaagaagaaaaagaacuggg

SEQ ID NO: 334735 - RNA, 32 nt, Human
aucuggggcaccugcuuccacccgucucucug

SEQ ID NO: 334736 - RNA, 32 nt, Human
aucuggggcagcugaggcagggcuaggagaag

SEQ ID NO: 334737 - RNA, 32 nt, Human
aucuggggcaggcacaaauugguggaaaucac

SEQ ID NO: 334738 - RNA, 32 nt, Human
aucuggggcaggugccuguaaucccagcacuu

SEQ ID NO: 334739 - RNA, 32 nt, Human
aucuggggcuacaggcauguaccaucaagccu

SEQ ID NO: 334740 - RNA, 32 nt, Human
aucugggggcugugucagggcagcgggagucc

SEQ ID NO: 334741 - RNA, 32 nt, Human
aucugggggugaggaggacaagaaggagagga

SEQ ID NO: 334742 - RNA, 32 nt, Human
aucugggguauggugggcugaacuccacaagg

SEQ ID NO: 334743 - RNA, 32 nt, Human
aucuggggucugcucccacccaucacaagcug

SEQ ID NO: 334744 - RNA, 32 nt, Human
aucugggucucccucuccacacccagaacuga

SEQ ID NO: 334745 - RNA, 32 nt, Human
aucugggucucuguaucucauguagaacauaa

SEQ ID NO: 334746 - RNA, 32 nt, Human
aucugggugaaggauuugagggaguuuuuggu

SEQ ID NO: 334747 - RNA, 32 nt, Human
aucugggugaaggccuugacagcagcgcuggu

SEQ ID NO: 334748 - RNA, 32 nt, Human
augcacgccuguaaacccagcuacucgggagg

SEQ ID NO: 334749 - RNA, 32 nt, Human
augcacggcuccugcaguuuccugaugcuucu

SEQ ID NO: 334750 - RNA, 32 nt, Human
augcacguacuucaccaccugcccccggggca

SEQ ID NO: 334751 - RNA, 32 nt, Human
augcacguauguccagggcauggggguggcgu

SEQ ID NO: 334752 - RNA, 32 nt, Human
augcacguccucauuauauguaaggaaucuau

SEQ ID NO: 334753 - RNA, 32 nt, Human
augcacuccagccuagacaacagggcaaggcc

SEQ ID NO: 334754 - RNA, 32 nt, Human
augcacuccagccugggcaacagacagaguga

SEQ ID NO: 334755 - RNA, 27 nt, Human
augcacuccagccuggguaacagagcg

SEQ ID NO: 334756 - RNA, 32 nt, Human
augcacucgcggaaauucuccaggcaaaugac

SEQ ID NO: 334757 - RNA, 21 nt, Human
augcacucucucccacccccu

SEQ ID NO: 334758 - RNA, 32 nt, Human
augcacucucuuccaucucuuuccccaaggcu

SEQ ID NO: 334759 - RNA, 32 nt, Human
augcacugaauaugcauuuuauugcuuuacuc

SEQ ID NO: 334760 - RNA, 32 nt, Human
augcacugaccacagcccccaggggaggaugg

SEQ ID NO: 334761 - RNA, 32 nt, Human
augcacugcaccccagccugggcgacagagcc

SEQ ID NO: 334762 - RNA, 32 nt, Human
augcacugcucuccucccacagucuccacuug

SEQ ID NO: 334763 - RNA, 31 nt, Human
augcacuggguggaagaaggguaggagggcu

SEQ ID NO: 334764 - RNA, 32 nt, Human
augcacuucagguuugcuaucuguaaagccuu

SEQ ID NO: 334765 - RNA, 32 nt, Human
augcacuucauacuagcaaucacagcacagga

SEQ ID NO: 334766 - RNA, 32 nt, Human
augcacuucuuacugguacaguuuucuuuugu

SEQ ID NO: 334767 - RNA, 32 nt, Human
augcacuucuuucucuguagcacauguuaccu

SEQ ID NO: 334768 - RNA, 32 nt, Human
augcacuuguacucccagcuacuugggaggcu

SEQ ID NO: 334769 - RNA, 32 nt, Human
augcacuuguagucccagcuacucaagaggcu

SEQ ID NO: 334770 - RNA, 32 nt, Human
augcacuuuauguagcauugaaugaucaaaua

SEQ ID NO: 334771 - RNA, 16 nt, Human
augcacuuuguguuga

SEQ ID NO: 334772 - RNA, 32 nt, Human
augcagaaagagauauucugugauagauauau

SEQ ID NO: 334773 - RNA, 32 nt, Human
augcagaaauaucaggaggagugugaaauacu

SEQ ID NO: 334774 - RNA, 32 nt, Human
augcagaacaugcacguguacacauaccacag

SEQ ID NO: 334775 - RNA, 32 nt, Human
augcagaacccccagaggagugacuguaugcc

SEQ ID NO: 334776 - RNA, 32 nt, Human
augcagaagaggaagaggaggaguaugguguc

SEQ ID NO: 334777 - RNA, 32 nt, Human
augcagaagcuggcaaaggauccuccacacgc

SEQ ID NO: 334778 - RNA, 32 nt, Human
augcagaagucaacgcaaaaucaugcugccgu

SEQ ID NO: 334779 - RNA, 32 nt, Human
augcagaauuaauaagcuauuuagauagcgua

SEQ ID NO: 334780 - RNA, 32 nt, Human
augcagaauuaauaagcuauuuggauagugua

SEQ ID NO: 334781 - RNA, 32 nt, Human
augcagacagggaagggaauuucacuuaaaag

SEQ ID NO: 334782 - RNA, 32 nt, Human
augcagaccagcugugggaagccuccugaaga

SEQ ID NO: 334783 - RNA, 32 nt, Human
augcagaccccaaggagacugggcuggggcug

SEQ ID NO: 334784 - RNA, 32 nt, Human
augcagaccccuggcuuagucuggauacaggc

SEQ ID NO: 334785 - RNA, 32 nt, Human
augcagagaagcagagaagaagaaaggagcug

SEQ ID NO: 334786 - RNA, 32 nt, Human
augcagagacuacacagaaaacuacaagaugu

SEQ ID NO: 334787 - RNA, 32 nt, Human
augcagagcagggccaucauggucagcccuug

SEQ ID NO: 334788 - RNA, 32 nt, Human
augcagagccugcacucuggcacucgcugaag

SEQ ID NO: 334789 - RNA, 32 nt, Human
augcagaggugaugcagcugggguccagcucc

SEQ ID NO: 334790 - RNA, 32 nt, Human
augcagagucuacagccugacccagcugcccg

SEQ ID NO: 334791 - RNA, 32 nt, Human
augcagagucuagagugcaguggugcaagcuc

SEQ ID NO: 334792 - RNA, 32 nt, Human
augcagaguggaccagccgccucugaagcagc

SEQ ID NO: 334793 - RNA, 32 nt, Human
augcagaucccagcuuuaccacuugcuggcug

SEQ ID NO: 334794 - RNA, 32 nt, Human
augcagaucugaagaccccaaucucagaaauu

SEQ ID NO: 334795 - RNA, 32 nt, Human
augcagaugcuuggccccuggcccaggcugug

SEQ ID NO: 334796 - RNA, 32 nt, Human
augcagauggaccacacuuugagaaacaccac

SEQ ID NO: 334797 - RNA, 32 nt, Human
augcagauggccaagcucccacccuggguauu

SEQ ID NO: 334798 - RNA, 32 nt, Human
augcagaugggaguugggggaggggaggauac

SEQ ID NO: 334799 - RNA, 32 nt, Human
augcagauguggaagcagacguuacuauuauc

SEQ ID NO: 334800 - RNA, 32 nt, Human
augcagauucccaggcugggugcaguggcuca

SEQ ID NO: 334801 - RNA, 32 nt, Human
augcagcacacacacaauuccccagcccagug

SEQ ID NO: 334802 - RNA, 32 nt, Human
augcagcacagagagguuaaguaacuugucca

SEQ ID NO: 334803 - RNA, 32 nt, Human
augcagcacgacccagccuggccacacacugu

SEQ ID NO: 334804 - RNA, 32 nt, Human
augcagcacgcaacauggcacauguguauaca

SEQ ID NO: 334805 - RNA, 32 nt, Human
augcagcaggcaggcucagaagacgaugcggg

SEQ ID NO: 334806 - RNA, 32 nt, Human
augcagcagggacugugguggugggcaucacg

SEQ ID NO: 334807 - RNA, 32 nt, Human
augcagcagguauucuuaacugccuuuuucag

SEQ ID NO: 334808 - RNA, 32 nt, Human
augcagcaucaucuuuugcagcauuccucugc

SEQ ID NO: 334809 - RNA, 32 nt, Human
augcagcaugaacacaauuucucuccaccugg

SEQ ID NO: 334810 - RNA, 32 nt, Human
augcagccaagguugagagucacugaauuaag

SEQ ID NO: 334811 - RNA, 32 nt, Human
augcagccaauaggaaccccauuuuuccaccu

SEQ ID NO: 334812 - RNA, 32 nt, Human
augcagccacaggucaccuucugugaucccca

SEQ ID NO: 334813 - RNA, 32 nt, Human
augcagcccagccugaaccuccgcaaaacccc

SEQ ID NO: 334814 - RNA, 17 nt, Human
augcagcccaucgggga

SEQ ID NO: 334815 - RNA, 32 nt, Human
augcagcccccuucuuggucccaugugauguc

SEQ ID NO: 334816 - RNA, 32 nt, Human
augcagccuaaaguacagccuggaccaccccu

SEQ ID NO: 334817 - RNA, 32 nt, Human
augcagcgaugcucccagcccaagagcccaug

SEQ ID NO: 334818 - RNA, 32 nt, Human
augcagcuaacauuucggaaaguuucuaaaag

SEQ ID NO: 334819 - RNA, 32 nt, Human
augcagcuacuaagauuuccuacuacaaagaa

SEQ ID NO: 334820 - RNA, 32 nt, Human
augcagcuagagcagacccaggaaagcuuucu

SEQ ID NO: 334821 - RNA, 32 nt, Human
augcagcucccaggcccuggucugcgcucauu

SEQ ID NO: 334822 - RNA, 32 nt, Human
augcagcucguagaggagagaaaacaagagug

SEQ ID NO: 334823 - RNA, 32 nt, Human
augcagcucucagcacugggugggagggcguu

SEQ ID NO: 334824 - RNA, 32 nt, Human
augcagcucuuccuggacaggccagguggugg

SEQ ID NO: 334825 - RNA, 25 nt, Human
augcagcugacucaucugggccuga

SEQ ID NO: 334826 - RNA, 32 nt, Human
augcagcugcgugaccuaaggcacguaucucc

SEQ ID NO: 334827 - RNA, 32 nt, Human
augcagcugcugcaggggauggggaagggaug

SEQ ID NO: 334828 - RNA, 32 nt, Human
augcagcugggcugagugaugucagcgagacu

SEQ ID NO: 334829 - RNA, 32 nt, Human
augcagcugggcuuccugugaccaggcacccu

SEQ ID NO: 334830 - RNA, 32 nt, Human
augcagcuucuucuguaaccuaccucagaggg

SEQ ID NO: 334831 - RNA, 32 nt, Human
augcagcuuugccuccccagcucaagugaucc

SEQ ID NO: 334832 - RNA, 32 nt, Human
augcaggaaaaugacgagagcauaacuuuucu

SEQ ID NO: 334833 - RNA, 32 nt, Human
augcaggaaguuaaguuuuuaaaggugauucu

SEQ ID NO: 334834 - RNA, 32 nt, Human
augcaggacaagcagagggguugcuggaggug

SEQ ID NO: 334835 - RNA, 32 nt, Human
augcaggagagggagguggucauagagucagg

SEQ ID NO: 334836 - RNA, 32 nt, Human
augcaggaggacccggagaaggccccgacaga

SEQ ID NO: 334837 - RNA, 32 nt, Human
augcaggaggggcugcagguccaugugggcag

SEQ ID NO: 334838 - RNA, 32 nt, Human
augcaggcacacaccacgaaguuuacucagca

SEQ ID NO: 334839 - RNA, 32 nt, Human
augcaggcacagauuuaucaagcuccucaguc

SEQ ID NO: 334840 - RNA, 32 nt, Human
augcaggcaguggcaugaucuuggcucacgac

SEQ ID NO: 334841 - RNA, 22 nt, Human
augcaggccacugaucucugca

SEQ ID NO: 334842 - RNA, 32 nt, Human
augcaggcccuuugaagccucagcuacccacu

SEQ ID NO: 334843 - RNA, 32 nt, Human
augcaggcugcuguacccgcucugccucaagc

SEQ ID NO: 334844 - RNA, 32 nt, Human
augcaggcugugucugcaccagaagaggcucc

SEQ ID NO: 334845 - RNA, 32 nt, Human
augcaggcuucugggccaccugcuccaggcac

SEQ ID NO: 334846 - RNA, 32 nt, Human
augcaggcuuuggugaacagagccgagcuugg

SEQ ID NO: 334847 - RNA, 32 nt, Human
augcaggcuuuuaggacugaguagccuugaaa

SEQ ID NO: 334848 - RNA, 32 nt, Human
augcagggagcacuguucacaucauagauaaa

SEQ ID NO: 334849 - RNA, 32 nt, Human
augcagggaggccacgucccaccccaccucuu

SEQ ID NO: 334850 - RNA, 32 nt, Human
augcagggccuuucagagaugcauugugauug

SEQ ID NO: 334851 - RNA, 32 nt, Human
augcagggcugguucuuuuaccccuugguuua

SEQ ID NO: 334852 - RNA, 32 nt, Human
augcaggggcuggagagaggggcuagggcuug

SEQ ID NO: 334853 - RNA, 32 nt, Human
augcagggggcuggcagguggggagggcuuga

SEQ ID NO: 334854 - RNA, 32 nt, Human
augcaggucagggagagggaaggcaggggugg

SEQ ID NO: 334855 - RNA, 32 nt, Human
augcaggucugcaggacugaccccaaggagga

SEQ ID NO: 334856 - RNA, 32 nt, Human
augcaggucuuucugagcucaagggugaaaga

SEQ ID NO: 334857 - RNA, 32 nt, Human
augcaggugaaacccagucacugugagcuccc

SEQ ID NO: 334858 - RNA, 32 nt, Human
augcaggugaaaggggacagagaaagcaauag

SEQ ID NO: 334859 - RNA, 32 nt, Human
augcaggugagaugcaagguuuucuaaguguu

SEQ ID NO: 334860 - RNA, 32 nt, Human
augcagguggaagaggguaggagggaugcugg

SEQ ID NO: 334861 - RNA, 32 nt, Human
augcaggugguagucacaucaccagagugauc

SEQ ID NO: 334862 - RNA, 32 nt, Human
augcagguggucuccugggaaaguguagagga

SEQ ID NO: 334863 - RNA, 32 nt, Human
augcagguguuuucucaguaucacagaccagc

SEQ ID NO: 334864 - RNA, 32 nt, Human
augcagguuagaauucaggaauuucaaguaug

SEQ ID NO: 334865 - RNA, 32 nt, Human
augcagguucccaggucccacccuggacuucu

SEQ ID NO: 334866 - RNA, 32 nt, Human
augcagguugcugcagcucugccuucuccaug

SEQ ID NO: 334867 - RNA, 32 nt, Human
augcaguagacgauacagguugcauguggaca

SEQ ID NO: 334868 - RNA, 32 nt, Human
augcaguagagauuugaguuuaauuucauguc

SEQ ID NO: 334869 - RNA, 32 nt, Human
augcagucaacuggagagaguuccgauuuguc

SEQ ID NO: 334870 - RNA, 32 nt, Human
augcagucauauggcagcagguuggugauuca

SEQ ID NO: 334871 - RNA, 32 nt, Human
augcagucaucuuccccuccaagggggcagaa

SEQ ID NO: 334872 - RNA, 32 nt, Human
augcagucccaccucagaguaaggacuaccca

SEQ ID NO: 334873 - RNA, 32 nt, Human
augcagucgcaauaacaugucugcucccgagg

SEQ ID NO: 334874 - RNA, 32 nt, Human
augcagucuuacuauguugcccaggcugucuc

SEQ ID NO: 334875 - RNA, 32 nt, Human
augcagugacauugcacaaucugccucugaag

SEQ ID NO: 334876 - RNA, 32 nt, Human
augcagugaccucacuggccuguggugacugc

SEQ ID NO: 334877 - RNA, 32 nt, Human
augcagugauggaagccagaaggaaugaaggc

SEQ ID NO: 334878 - RNA, 32 nt, Human
augcagugcacaggcucugggcucagguuggc

SEQ ID NO: 334879 - RNA, 32 nt, Human
augcagugccuagagagagaguauugucucuu

SEQ ID NO: 334880 - RNA, 32 nt, Human
augcaguggaaccugucaccuaaugggacugc

SEQ ID NO: 334881 - RNA, 32 nt, Human
augcaguggcaccauuucggcucacugcaacu

SEQ ID NO: 334882 - RNA, 32 nt, Human
augcagugggagccaccuccagcugaaugccc

SEQ ID NO: 334883 - RNA, 32 nt, Human
augcagugguagucccagcuacucaggaggcu

SEQ ID NO: 334884 - RNA, 32 nt, Human
augcaguggugugaacugggcucacugcagcc

SEQ ID NO: 334885 - RNA, 32 nt, Human
augcaguguagggagaggagauggcaggacac

SEQ ID NO: 334886 - RNA, 32 nt, Human
augcaguuaccuguggucauuuuggaggaagu

SEQ ID NO: 334887 - RNA, 32 nt, Human
augcaguugcuucucaggggaggaagaaggaa

SEQ ID NO: 334888 - RNA, 32 nt, Human
augcauaagcuacugauaacuugcuuacagca

SEQ ID NO: 334889 - RNA, 32 nt, Human
augcauaagcuugugguucacacugaguguac

SEQ ID NO: 334890 - RNA, 32 nt, Human
augcauacacagacacaagacacacacgcuca

SEQ ID NO: 334891 - RNA, 27 nt, Human
augcauaccccaccccuuaccugcucu

SEQ ID NO: 334892 - RNA, 32 nt, Human
augcauacugucauuugcaggcugucauuuga

SEQ ID NO: 334893 - RNA, 32 nt, Human
augcauagcacaaacuccuccugcuucauuua

SEQ ID NO: 334894 - RNA, 32 nt, Human
augcauaggaauaugcuggugccugaauguac

SEQ ID NO: 334895 - RNA, 32 nt, Human
augcauagguuagagaaauggagagaggcuug

SEQ ID NO: 334896 - RNA, 32 nt, Human
augcauauaauauauguauauguauaugaaga

SEQ ID NO: 334897 - RNA, 32 nt, Human
augcauaugcuucauuccacauuguacuugcu

SEQ ID NO: 334898 - RNA, 32 nt, Human
augcauauuccugguggggauggaggaagaag

SEQ ID NO: 334899 - RNA, 22 nt, Human
augcaucaacugucgggaagag

SEQ ID NO: 334900 - RNA, 22 nt, Human
augcaucaauuucuugaaggag

SEQ ID NO: 334901 - RNA, 32 nt, Human
augcaucaauuuuugugcauucccaacaugcu

SEQ ID NO: 334902 - RNA, 32 nt, Human
augcaucacagaaaagcaacuacuuauauuuc

SEQ ID NO: 334903 - RNA, 32 nt, Human
augcaucacucucccuucugccuccuucaacu

SEQ ID NO: 334904 - RNA, 32 nt, Human
augcaucacucucccuucuuccuccuucaacu

SEQ ID NO: 334905 - RNA, 32 nt, Human
augcaucacucugccagaguaugacuuuuuac

SEQ ID NO: 334906 - RNA, 32 nt, Human
augcaucagcacugcacacuggaaucauugcu

SEQ ID NO: 334907 - RNA, 32 nt, Human
augcaucauugcacuccagccugggugacaga

SEQ ID NO: 334908 - RNA, 32 nt, Human
augcaucauuuccccucugagucucagauucu

SEQ ID NO: 334909 - RNA, 32 nt, Human
augcauccagcucccggguucucagcugguuu

SEQ ID NO: 334910 - RNA, 32 nt, Human
augcauccuaaugaauguuguccccuucaaug

SEQ ID NO: 334911 - RNA, 32 nt, Human
augcaucuagcacauuuaaacugugcaaauau

SEQ ID NO: 334912 - RNA, 32 nt, Human
augcaucuauauguguauuauguauguaugug

SEQ ID NO: 334913 - RNA, 32 nt, Human
augcaucucaacaaagguggcagcaguugaag

SEQ ID NO: 334914 - RNA, 32 nt, Human
augcaucuccaccugcucccaggccaguaagg

SEQ ID NO: 334915 - RNA, 28 nt, Human
augcaucucccaagugccucaugcuugc

SEQ ID NO: 334916 - RNA, 32 nt, Human
augcaucugcaugagccaggcacuacauacag

SEQ ID NO: 334917 - RNA, 32 nt, Human
augcaucugcauucagcugauggcucaucugg

SEQ ID NO: 334918 - RNA, 32 nt, Human
augcaucuguaacccagcuauucaagaggcug

SEQ ID NO: 334919 - RNA, 32 nt, Human
augcaucuguagucccagcuacucgggaggcu

SEQ ID NO: 334920 - RNA, 32 nt, Human
augcaucugugcucccagcuccucacgaggcu

SEQ ID NO: 334921 - RNA, 31 nt, Human
augcaucuguuucagcccuaaccccagugug

SEQ ID NO: 334922 - RNA, 32 nt, Human
augcaucuuagcaauuaccugauuuccaaagu

SEQ ID NO: 334923 - RNA, 32 nt, Human
augcaucuuaucuggcauguccugggagaugg

SEQ ID NO: 334924 - RNA, 32 nt, Human
augcaucuuugugcagggagggugguguaccu

SEQ ID NO: 334925 - RNA, 32 nt, Human
augcaugagcgaaauaucaaacuuucaucuuc

SEQ ID NO: 334926 - RNA, 32 nt, Human
augcaugaggugggcugguagagcaggaagcu

SEQ ID NO: 334927 - RNA, 32 nt, Human
augcaugcaaccuuguaaaaugagcuuauuua

SEQ ID NO: 334928 - RNA, 32 nt, Human
augcaugcacacaaacguguacacaaguguga

SEQ ID NO: 334929 - RNA, 32 nt, Human
augcaugcacacacaugcacacauacacgcac

SEQ ID NO: 334930 - RNA, 32 nt, Human
augcaugcacacacgagcauacuuguaccuuu

SEQ ID NO: 334931 - RNA, 32 nt, Human
augcaugcacacauacacaggcauacaugcau

SEQ ID NO: 334932 - RNA, 32 nt, Human
augcaugcacacauacacaugcacacacacau

SEQ ID NO: 334933 - RNA, 32 nt, Human
augcaugcacacauacauacauauguauacac

SEQ ID NO: 334934 - RNA, 32 nt, Human
augcaugcacacauacauaugcacgcacacac

SEQ ID NO: 334935 - RNA, 32 nt, Human
augcaugcacaugcaguagcuucucugcuuga

SEQ ID NO: 334936 - RNA, 32 nt, Human
augcaugccuguaaucccagcuacucgggagg

SEQ ID NO: 334937 - RNA, 32 nt, Human
augcaugcucagcucaccccugcucugcccuc

SEQ ID NO: 334938 - RNA, 32 nt, Human
augcaugcucuucucucacauggagaaaacca

SEQ ID NO: 334939 - RNA, 32 nt, Human
augcauggaaauucccuucaucuggaaccauc

SEQ ID NO: 334940 - RNA, 32 nt, Human
augcauggauuuaaaugcugugucuuucuaag

SEQ ID NO: 334941 - RNA, 32 nt, Human
augcauggcaaauauuuuaauauuucuguuuu

SEQ ID NO: 334942 - RNA, 32 nt, Human
augcauggggaugcaggucccuugcauuucuu

SEQ ID NO: 334943 - RNA, 32 nt, Human
augcauggguguggggguaugugcccucugug

SEQ ID NO: 334944 - RNA, 32 nt, Human
augcaugucaccagcccaucacggugauucuu

SEQ ID NO: 334945 - RNA, 32 nt, Human
augcaugucucuccuucucuagcugucaaaca

SEQ ID NO: 334946 - RNA, 32 nt, Human
augcaugugaagcccuauaggucucagcagag

SEQ ID NO: 334947 - RNA, 32 nt, Human
augcaugugggcucauucucuccaagcugcuu

SEQ ID NO: 334948 - RNA, 32 nt, Human
augcauguuuuccagcuccucauccagggcuc

SEQ ID NO: 334949 - RNA, 32 nt, Human
augcauuacuaucaguguccuaggcaauaccu

SEQ ID NO: 334950 - RNA, 32 nt, Human
augcauuauggcacagaugagauaauggaugu

SEQ ID NO: 334951 - RNA, 32 nt, Human
augcauucaauauuccaagucuggacagcauc

SEQ ID NO: 334952 - RNA, 32 nt, Human
augcauuccauauuuugcuuucagaacuuaua

SEQ ID NO: 334953 - RNA, 32 nt, Human
augcauuccugucaagucaucuugugaaaggc

SEQ ID NO: 334954 - RNA, 32 nt, Human
augcauucuuauaacauaaccucagaguaucu

SEQ ID NO: 334955 - RNA, 32 nt, Human
augcauugggcauauagagaugaccaaccaca

SEQ ID NO: 334956 - RNA, 32 nt, Human
augcauugucauuuaauauaguagccucuuaa

SEQ ID NO: 334957 - RNA, 32 nt, Human
augcauuguuucuacccaccugagaugguugg

SEQ ID NO: 334958 - RNA, 32 nt, Human
augcauuguuugcuucagauccaugguguuaa

SEQ ID NO: 334959 - RNA, 32 nt, Human
augcauuuccagagaaauguggacuuuucaua

SEQ ID NO: 334960 - RNA, 32 nt, Human
augcauuuccuuaaaauuaauuguagacucca

SEQ ID NO: 334961 - RNA, 32 nt, Human
augcauuucuccacaaguuagcacuugauugu

SEQ ID NO: 334962 - RNA, 31 nt, Human
augcauuucugcuuccuuugccaaagccagc

SEQ ID NO: 334963 - RNA, 32 nt, Human
augcauuucuucuuccugccacugugacucgg

SEQ ID NO: 334964 - RNA, 32 nt, Human
augcauuugagcugccccaggcucugucuccu

SEQ ID NO: 334965 - RNA, 32 nt, Human
augcauuugugcauuucuacuacaauggcauc

SEQ ID NO: 334966 - RNA, 32 nt, Human
augcauuuuaaagcagagagacagggcauuga

SEQ ID NO: 334967 - RNA, 32 nt, Human
augcauuuuagugaauguucucugugcaaaaa

SEQ ID NO: 334968 - RNA, 32 nt, Human
augcauuuucacugaauaugguauguaugcua

SEQ ID NO: 334969 - RNA, 32 nt, Human
augcauuuucugcuuuugguaacuuccuuucg

SEQ ID NO: 334970 - RNA, 32 nt, Human
augcauuuuugaugggaagaaaagguacaugu

SEQ ID NO: 334971 - RNA, 32 nt, Human
augccaaaaacccaaacugcaagugguacugu

SEQ ID NO: 334972 - RNA, 32 nt, Human
augccaaaacuugcuaccaggccaggugugau

SEQ ID NO: 334973 - RNA, 23 nt, Human
augccaaaccaauuuugggucga

SEQ ID NO: 334974 - RNA, 32 nt, Human
augccaaaccacugcacuccuacugccacucu

SEQ ID NO: 334975 - RNA, 23 nt, Human
augccaaacggacaaagggucaa

SEQ ID NO: 334976 - RNA, 32 nt, Human
augccaaagcugcuuucuucucugccuccucc

SEQ ID NO: 334977 - RNA, 32 nt, Human
augccaaaggauuuggcaugcuguaaacaaaa

SEQ ID NO: 334978 - RNA, 32 nt, Human
augccaaaucagcaaccauuguuguuaugauc

SEQ ID NO: 334979 - RNA, 32 nt, Human
augccaaauccacugagugagcaacagaugag

SEQ ID NO: 334980 - RNA, 32 nt, Human
augccaacacccuucucggaggcucaggucaa

SEQ ID NO: 334981 - RNA, 18 nt, Human
augccaacacucgagggg

SEQ ID NO: 334982 - RNA, 19 nt, Human
augccaacagccugggaga

SEQ ID NO: 334983 - RNA, 18 nt, Human
augccaacagcuugggga

SEQ ID NO: 334984 - RNA, 32 nt, Human
augccaaccagcuucccuacuccuacccuggc

SEQ ID NO: 334985 - RNA, 32 nt, Human
augccaacuacaaaagaaaaauauaaaguaaa

SEQ ID NO: 334986 - RNA, 32 nt, Human
augccaacuggagaaagggaagaaggacauau

SEQ ID NO: 334987 - RNA, 32 nt, Human
augccaagaaaauucuuuuuauuggugccuau

SEQ ID NO: 334988 - RNA, 32 nt, Human
augccaagcagugggagcacgcaggacagaca

SEQ ID NO: 334989 - RNA, 32 nt, Human
augccaagccugacacauuugacagugaggac

SEQ ID NO: 334990 - RNA, 25 nt, Human
augccaagcuuacuggaguauuuga

SEQ ID NO: 334991 - RNA, 32 nt, Human
augccaagggcagaaagcaaaccuaguuaaau

SEQ ID NO: 334992 - RNA, 32 nt, Human
augccaaggggagaacaaugagcugaaauugu

SEQ ID NO: 334993 - RNA, 32 nt, Human
augccaaguccgaggcagagcugcagggccug

SEQ ID NO: 334994 - RNA, 32 nt, Human
augccaaugcacuccagucugggcaacagagu

SEQ ID NO: 334995 - RNA, 32 nt, Human
augccaauguacuggcagauuaacauacaacc

SEQ ID NO: 334996 - RNA, 32 nt, Human
augccaauugcugcuacucaacagguuuucug

SEQ ID NO: 334997 - RNA, 32 nt, Human
augccacaccguacuccagccugggcgacauc

SEQ ID NO: 334998 - RNA, 32 nt, Human
augccacaucacagggaccagccaucacagag

SEQ ID NO: 334999 - RNA, 32 nt, Human
augccacaucacuccagccugggcaacagaac

SEQ ID NO: 335000 - RNA, 32 nt, Human
augccaccaaccaaccucagaaacccauaaug

SEQ ID NO: 335001 - RNA, 32 nt, Human
augccaccaccugaacccugcucccucguggg

SEQ ID NO: 335002 - RNA, 32 nt, Human
augccaccaugccuggcuaaucuuuugcagcg

SEQ ID NO: 335003 - RNA, 32 nt, Human
augccacccaaagaaaaggcccugccaggucc

SEQ ID NO: 335004 - RNA, 19 nt, Human
augccacccaccgccugga

SEQ ID NO: 335005 - RNA, 30 nt, Human
augccaccccccaccuuucgccccugccca

SEQ ID NO: 335006 - RNA, 32 nt, Human
augccacccguacuaugaacaccagaacagaa

SEQ ID NO: 335007 - RNA, 32 nt, Human
augccacccucuuccuucucuuugaccccugu

SEQ ID NO: 335008 - RNA, 32 nt, Human
augccacccugaccccacggcuggagaacccu

SEQ ID NO: 335009 - RNA, 32 nt, Human
augccaccgcacuccagccugggcaacagagc

SEQ ID NO: 335010 - RNA, 32 nt, Human
augccaccgcacuuccagccugggugacagag

SEQ ID NO: 335011 - RNA, 32 nt, Human
augccaccucucucaccacguucuagucccag

SEQ ID NO: 335012 - RNA, 32 nt, Human
augccaccuggaaaacagccuggaccugcacc

SEQ ID NO: 335013 - RNA, 18 nt, Human
augccaccugucgucuua

SEQ ID NO: 335014 - RNA, 32 nt, Human
augccacggaccugugcacaugccuggaauug

SEQ ID NO: 335015 - RNA, 32 nt, Human
augccacuacacuccagccuggcgacagagcg

SEQ ID NO: 335016 - RNA, 32 nt, Human
augccacuauacuccagccugggcaacaaagc

SEQ ID NO: 335017 - RNA, 32 nt, Human
augccacuccacuccagucugggcgacagagc

SEQ ID NO: 335018 - RNA, 32 nt, Human
augccacugaacuccagccugggcaacagagu

SEQ ID NO: 335019 - RNA, 32 nt, Human
augccacugaacuccagccugggcaacaggug

SEQ ID NO: 335020 - RNA, 32 nt, Human
augccacugaacuccagccugggugacagagc

SEQ ID NO: 335021 - RNA, 32 nt, Human
augccacugagcaaggagagaugggugagccu

SEQ ID NO: 335022 - RNA, 32 nt, Human
augccacugcacuacagccugggcgacaaagu

SEQ ID NO: 335023 - RNA, 32 nt, Human
augccacugcacuagagccugggcaacagacc

SEQ ID NO: 335024 - RNA, 32 nt, Human
augccacugcacucaaaccuggcggacagagu

SEQ ID NO: 335025 - RNA, 32 nt, Human
augccacugcacuccaaccugggcaacagaau

SEQ ID NO: 335026 - RNA, 32 nt, Human
augccacugcacuccaaccugggcagcagagc

SEQ ID NO: 335027 - RNA, 32 nt, Human
augccacugcacuccaaccugggcgacagagu

SEQ ID NO: 335028 - RNA, 32 nt, Human
augccacugcacuccaaccugggugacagagc

SEQ ID NO: 335029 - RNA, 32 nt, Human
augccacugcacuccacucugggcaacagaau

SEQ ID NO: 335030 - RNA, 32 nt, Human
augccacugcacuccagcaugggugauggaga

SEQ ID NO: 335031 - RNA, 32 nt, Human
augccacugcacuccagcccaggugacagagg

SEQ ID NO: 335032 - RNA, 32 nt, Human
augccacugcacuccagccuaggugacaaaga

SEQ ID NO: 335033 - RNA, 32 nt, Human
augccacugcacuccagccuaugugacuagug

SEQ ID NO: 335034 - RNA, 32 nt, Human
augccacugcacuccagccugagugacagaga

SEQ ID NO: 335035 - RNA, 32 nt, Human
augccacugcacuccagccugccuggaugaca

SEQ ID NO: 335036 - RNA, 32 nt, Human
augccacugcacuccagccuggacaacagagc

SEQ ID NO: 335037 - RNA, 32 nt, Human
augccacugcacuccagccuggaugacagagc

SEQ ID NO: 335038 - RNA, 32 nt, Human
augccacugcacuccagccuggaugacagcga

SEQ ID NO: 335039 - RNA, 32 nt, Human
augccacugcacuccagccuggccugggcaac

SEQ ID NO: 335040 - RNA, 32 nt, Human
augccacugcacuccagccugggagacagagc

SEQ ID NO: 335041 - RNA, 32 nt, Human
augccacugcacuccagccugggcaacaaaac

SEQ ID NO: 335042 - RNA, 32 nt, Human
augccacugcacuccagccugggcaacaaagc

SEQ ID NO: 335043 - RNA, 32 nt, Human
augccacugcacuccagccugggcaacaagaa

SEQ ID NO: 335044 - RNA, 32 nt, Human
augccacugcacuccagccugggcaacaagug

SEQ ID NO: 335045 - RNA, 32 nt, Human
augccacugcacuccagccugggcaacacagc

SEQ ID NO: 335046 - RNA, 32 nt, Human
augccacugcacuccagccugggcaacacagg

SEQ ID NO: 335047 - RNA, 32 nt, Human
augccacugcacuccagccugggcaacagagc

SEQ ID NO: 335048 - RNA, 32 nt, Human
augccacugcacuccagccugggcaacagagu

SEQ ID NO: 335049 - RNA, 32 nt, Human
augccacugcacuccagccugggcaacagcaa

SEQ ID NO: 335050 - RNA, 32 nt, Human
augccacugcacuccagccugggcaaccaggu

SEQ ID NO: 335051 - RNA, 32 nt, Human
augccacugcacuccagccugggcaauggaga

SEQ ID NO: 335052 - RNA, 32 nt, Human
augccacugcacuccagccugggcagcagagc

SEQ ID NO: 335053 - RNA, 32 nt, Human
augccacugcacuccagccugggcaugagacu

SEQ ID NO: 335054 - RNA, 32 nt, Human
augccacugcacuccagccugggccagaauga

SEQ ID NO: 335055 - RNA, 32 nt, Human
augccacugcacuccagccugggcgacagaga

SEQ ID NO: 335056 - RNA, 32 nt, Human
augccacugcacuccagccugggcgacagagc

SEQ ID NO: 335057 - RNA, 32 nt, Human
augccacugcacuccagccugggcgacagagu

SEQ ID NO: 335058 - RNA, 32 nt, Human
augccacugcacuccagccugggcgacggagu

SEQ ID NO: 335059 - RNA, 32 nt, Human
augccacugcacuccagccugggcgauggagu

SEQ ID NO: 335060 - RNA, 32 nt, Human
augccacugcacuccagccugggcggcagagc

SEQ ID NO: 335061 - RNA, 32 nt, Human
augccacugcacuccagccugggcuacagagc

SEQ ID NO: 335062 - RNA, 32 nt, Human
augccacugcacuccagccuggggcugacaga

SEQ ID NO: 335063 - RNA, 25 nt, Human
augccacugcacuccagccugggug

SEQ ID NO: 335064 - RNA, 32 nt, Human
augccacugcacuccagccugggugacagaac

SEQ ID NO: 335065 - RNA, 32 nt, Human
augccacugcacuccagccugggugacagagc

SEQ ID NO: 335066 - RNA, 32 nt, Human
augccacugcacuccagccugggugacagagu

SEQ ID NO: 335067 - RNA, 32 nt, Human
augccacugcacuccagccuggugacagagcg

SEQ ID NO: 335068 - RNA, 32 nt, Human
augccacugcacuccagcuugggcgacagagc

SEQ ID NO: 335069 - RNA, 32 nt, Human
augccacugcacuccagcuugggugagagugg

SEQ ID NO: 335070 - RNA, 32 nt, Human
augccacugcacuccagucuggaugacagaga

SEQ ID NO: 335071 - RNA, 32 nt, Human
augccacugcacuccagucugggugacagcaa

SEQ ID NO: 335072 - RNA, 32 nt, Human
augccacugcacuccauccugggcaacaagaa

SEQ ID NO: 335073 - RNA, 32 nt, Human
augccacugcacuccauccugggugacagcaa

SEQ ID NO: 335074 - RNA, 32 nt, Human
augccacugcacucccgccugggugacaaagc

SEQ ID NO: 335075 - RNA, 32 nt, Human
augccacugcacuccggccuaggugacagagg

SEQ ID NO: 335076 - RNA, 32 nt, Human
augccacugcacuccggccugggugacaaagc

SEQ ID NO: 335077 - RNA, 32 nt, Human
augccacugcacuccuccgugggugacagagc

SEQ ID NO: 335078 - RNA, 32 nt, Human
augccacugcacuccugccugggugacaaagu

SEQ ID NO: 335079 - RNA, 32 nt, Human
augccacugcacucuagccuaggcuacagagc

SEQ ID NO: 335080 - RNA, 32 nt, Human
augccacugcacucuagccugggugacagagc

SEQ ID NO: 335081 - RNA, 32 nt, Human
augccacugcacucugggcuggguaacagagu

SEQ ID NO: 335082 - RNA, 32 nt, Human
augccacugcacugcacuccagccugggugac

SEQ ID NO: 335083 - RNA, 32 nt, Human
augccacugcacugcagcccgggcgacagaga

SEQ ID NO: 335084 - RNA, 32 nt, Human
augccacugcacugcagccugggcgacagagc

SEQ ID NO: 335085 - RNA, 32 nt, Human
augccacugcacuucagccugggugacagagc

SEQ ID NO: 335086 - RNA, 32 nt, Human
augccacugcacuuccagccugggugacacag

SEQ ID NO: 335087 - RNA, 32 nt, Human
augccacugcacuuccagccugggugacagag

SEQ ID NO: 335088 - RNA, 32 nt, Human
augccacugcacuuuagccugggcaacagauc

SEQ ID NO: 335089 - RNA, 32 nt, Human
augccacugcacuuuagccugggugacagagc

SEQ ID NO: 335090 - RNA, 32 nt, Human
augccacugcauuccagccugggcaacagagc

SEQ ID NO: 335091 - RNA, 32 nt, Human
augccacugcauuccagccugggcgacagagu

SEQ ID NO: 335092 - RNA, 32 nt, Human
augccacugcauuccagccugugugauggaga

SEQ ID NO: 335093 - RNA, 32 nt, Human
augccacugccagagcuggccuagcaagaugu

SEQ ID NO: 335094 - RNA, 25 nt, Human
augccacugccuccaugccccuguc

SEQ ID NO: 335095 - RNA, 32 nt, Human
augccacugccucuccccaagugcaacaccua

SEQ ID NO: 335096 - RNA, 32 nt, Human
augccacugcuuuccagccugggcaacauagu

SEQ ID NO: 335097 - RNA, 32 nt, Human
augccacuggacuccagccugggugaaagagc

SEQ ID NO: 335098 - RNA, 32 nt, Human
augccacuguacuccagccuaggugacagagc

SEQ ID NO: 335099 - RNA, 32 nt, Human
augccacuguacuccagccugagcuacagagc

SEQ ID NO: 335100 - RNA, 32 nt, Human
augccacuguacuccagccugggcgacagcaa

SEQ ID NO: 335101 - RNA, 32 nt, Human
augccacuguacuccagccuggguaacaggaa

SEQ ID NO: 335102 - RNA, 32 nt, Human
augccacuguacuccagccugggugacagagc

SEQ ID NO: 335103 - RNA, 32 nt, Human
augccacuguacuccagccugggugacagagu

SEQ ID NO: 335104 - RNA, 32 nt, Human
augccacuguacuccagcgugggugacagagu

SEQ ID NO: 335105 - RNA, 32 nt, Human
augccacugucaaucccggcacuuugggaggc

SEQ ID NO: 335106 - RNA, 32 nt, Human
augccacuucccaggguggagacaguggaaaa

SEQ ID NO: 335107 - RNA, 32 nt, Human
augccacuuuggcugaacuacaaguguaggcc

SEQ ID NO: 335108 - RNA, 32 nt, Human
augccagaacaaccaccuuauuucucaaugac

SEQ ID NO: 335109 - RNA, 32 nt, Human
augccagagaaauauacuaucucaccaguauu

SEQ ID NO: 335110 - RNA, 32 nt, Human
augccagaggaagcacuccugaggcagaggag

SEQ ID NO: 335111 - RNA, 24 nt, Human
augccagagggaggcuugugcaaa

SEQ ID NO: 335112 - RNA, 32 nt, Human
augccagauggaaauuuauuauuucuugcaau

SEQ ID NO: 335113 - RNA, 32 nt, Human
augccagcaacaacccuaccccugccaacgcg

SEQ ID NO: 335114 - RNA, 32 nt, Human
augccagcacacacaaggaagcagagcucugg

SEQ ID NO: 335115 - RNA, 31 nt, Human
augccagcagcucuuccuugccagagaugau

SEQ ID NO: 335116 - RNA, 32 nt, Human
augccagcccagaacagagaaucagcuggagc

SEQ ID NO: 335117 - RNA, 32 nt, Human
augccagccugggcgaugcugcagugaccguu

SEQ ID NO: 335118 - RNA, 32 nt, Human
augccagcgccaacaggaggcugucuggacac

SEQ ID NO: 335119 - RNA, 32 nt, Human
augccagcgcccagggaggagucaguaccccu

SEQ ID NO: 335120 - RNA, 32 nt, Human
augccagcgucaacaggaggcugucuggacac

SEQ ID NO: 335121 - RNA, 32 nt, Human
augccagcuauaaucuccccugccuuccuuua

SEQ ID NO: 335122 - RNA, 32 nt, Human
augccagcugcaaccuccgcuagguacgauac

SEQ ID NO: 335123 - RNA, 32 nt, Human
augccagcuguacugaguucucauccacagag

SEQ ID NO: 335124 - RNA, 32 nt, Human
augccagcuguacugccggcucugccggcacc

SEQ ID NO: 335125 - RNA, 23 nt, Human
augccagcuuaccaucucuacca

SEQ ID NO: 335126 - RNA, 32 nt, Human
augccagcuuggagagucacgugagagcaaga

SEQ ID NO: 335127 - RNA, 30 nt, Human
augccagcuuugcaaucaugagauucaaaa

SEQ ID NO: 335128 - RNA, 32 nt, Human
augccaggaagagaagaaagggggugcagucu

SEQ ID NO: 335129 - RNA, 32 nt, Human
augccaggacacccccucccacacucaggaca

SEQ ID NO: 335130 - RNA, 32 nt, Human
augccaggaccucacagacaaagccauugcua

SEQ ID NO: 335131 - RNA, 32 nt, Human
augccaggacuugugcacaucuuuuuggagcc

SEQ ID NO: 335132 - RNA, 32 nt, Human
augccaggagagguucaagcgucuuaccugaa

SEQ ID NO: 335133 - RNA, 32 nt, Human
augccaggagcacggccacugcccgccgggcu

SEQ ID NO: 335134 - RNA, 32 nt, Human
augccaggaggguggcugggcaggcugcuguc

SEQ ID NO: 335135 - RNA, 32 nt, Human
augccaggaguuuggggaaggaagggguggga

SEQ ID NO: 335136 - RNA, 32 nt, Human
augccaggcacuguacuaggcacuuuucaugc

SEQ ID NO: 335137 - RNA, 32 nt, Human
augccaggccaggaacugggaccaccaucuug

SEQ ID NO: 335138 - RNA, 32 nt, Human
augccaggccuccugggucugcagugagucug

SEQ ID NO: 335139 - RNA, 32 nt, Human
augccaggguuagaggcuagagaguggaaguc

SEQ ID NO: 335140 - RNA, 32 nt, Human
augccagguaggaggaagggcuggggcaaugg

SEQ ID NO: 335141 - RNA, 32 nt, Human
augccaggucccaggaacucaggcuucaggug

SEQ ID NO: 335142 - RNA, 32 nt, Human
augccagguuuuccucuucuggguccggagcu

SEQ ID NO: 335143 - RNA, 32 nt, Human
augccaguagguuugaagggggcagagcacug

SEQ ID NO: 335144 - RNA, 22 nt, Human
augccaguagugaccaagaaca

SEQ ID NO: 335145 - RNA, 32 nt, Human
augccagugcacuccagccugggcaacagagu

SEQ ID NO: 335146 - RNA, 32 nt, Human
augccagugccuggcccccucuugccuuuuau

SEQ ID NO: 335147 - RNA, 32 nt, Human
augccaguggccacccuugggcucagacagcu

SEQ ID NO: 335148 - RNA, 32 nt, Human
augccaguguuacuccagcaggcaaccaagaa

SEQ ID NO: 335149 - RNA, 32 nt, Human
augccaguuacauucccaucagauaagagcaa

SEQ ID NO: 335150 - RNA, 32 nt, Human
augccaucacaggcucagccuuuuacauguau

SEQ ID NO: 335151 - RNA, 32 nt, Human
augccaucauuucccuuuccccucugaauggc

SEQ ID NO: 335152 - RNA, 32 nt, Human
augccauccccaucaagcuaccaaugacuuuc

SEQ ID NO: 335153 - RNA, 32 nt, Human
augccauccuuugggcccucugcuggaaaagu

SEQ ID NO: 335154 - RNA, 32 nt, Human
augccaucuccucugugaagccuccuuguuuc

SEQ ID NO: 335155 - RNA, 32 nt, Human
augccaucugaaggggauucugaucuguucuu

SEQ ID NO: 335156 - RNA, 30 nt, Human
augccauggcuaguccagggaaagauaacu

SEQ ID NO: 335157 - RNA, 32 nt, Human
augccaugucuuggcugggauuacaggcauga

SEQ ID NO: 335158 - RNA, 32 nt, Human
augccaugugucaggagggaaaggccuaggaa

SEQ ID NO: 335159 - RNA, 32 nt, Human
augccauuacacuccagccugggcaacagcgu

SEQ ID NO: 335160 - RNA, 32 nt, Human
augccauuacacuccagccugggcgacagaac

SEQ ID NO: 335161 - RNA, 32 nt, Human
augccauuaccuaaggggaggguauuaugcac

SEQ ID NO: 335162 - RNA, 32 nt, Human
augccauugcacuccaaccugggugacagagu

SEQ ID NO: 335163 - RNA, 32 nt, Human
augccauugcacuccagcccagguaacagagu

SEQ ID NO: 335164 - RNA, 32 nt, Human
augccauugcacuccagcccggguuacagugu

SEQ ID NO: 335165 - RNA, 32 nt, Human
augccauugcacuccagccuaggcaacaagag

SEQ ID NO: 335166 - RNA, 32 nt, Human
augccauugcacuccagccugagugacaagag

SEQ ID NO: 335167 - RNA, 32 nt, Human
augccauugcacuccagccuggacaacagagc

SEQ ID NO: 335168 - RNA, 32 nt, Human
augccauugcacuccagccugggcaacaagag

SEQ ID NO: 335169 - RNA, 32 nt, Human
augccauugcacuccagccugggcaacagagc

SEQ ID NO: 335170 - RNA, 32 nt, Human
augccauugcacuccagccugggcaacagagu

SEQ ID NO: 335171 - RNA, 32 nt, Human
augccauugcacuccagccugggcaacgagag

SEQ ID NO: 335172 - RNA, 32 nt, Human
augccauugcacuccagccugggcgacaagag

SEQ ID NO: 335173 - RNA, 32 nt, Human
augccauugcacuccagccugggcgacagagc

SEQ ID NO: 335174 - RNA, 32 nt, Human
augccauugcacuccagccugggcgacagagu

SEQ ID NO: 335175 - RNA, 32 nt, Human
augccauugcacuccagccugggugacaaagc

SEQ ID NO: 335176 - RNA, 32 nt, Human
augccauugcacuccagccugggugacaagag

SEQ ID NO: 335177 - RNA, 32 nt, Human
augccauugcacuccagccugggugacaaggg

SEQ ID NO: 335178 - RNA, 32 nt, Human
augccauugcacuccagccugggugacagagc

SEQ ID NO: 335179 - RNA, 32 nt, Human
augccauugcacuccagccugggugacagagu

SEQ ID NO: 335180 - RNA, 32 nt, Human
augccauugcacuccagccugggugauaagag

SEQ ID NO: 335181 - RNA, 32 nt, Human
augccauugcacuccagcuugggugacagagu

SEQ ID NO: 335182 - RNA, 32 nt, Human
augccauugcacuccagucugggcgacaggag

SEQ ID NO: 335183 - RNA, 32 nt, Human
augccauugcacuccgacucugggcaacagag

SEQ ID NO: 335184 - RNA, 32 nt, Human
augccauugcacugcaccugggcaacaagagu

SEQ ID NO: 335185 - RNA, 32 nt, Human
augccauugcauuccagccuaggcaacacgag

SEQ ID NO: 335186 - RNA, 32 nt, Human
augccauugcauuccagccuuggcgacagagc

SEQ ID NO: 335187 - RNA, 32 nt, Human
augccauuggacuccagccugggcaaaaaggg

SEQ ID NO: 335188 - RNA, 32 nt, Human
augccauuguacuccagccugggcaacaagag

SEQ ID NO: 335189 - RNA, 32 nt, Human
augccauuucugcaucucccagaagggaugag

SEQ ID NO: 335190 - RNA, 32 nt, Human
augccauuuuauuucuuuuugauuuuuaaauc

SEQ ID NO: 335191 - RNA, 22 nt, Human
augcccaaaaauaagucuuaga

SEQ ID NO: 335192 - RNA, 22 nt, Human
augcccaaaacaucccucccca

SEQ ID NO: 335193 - RNA, 32 nt, Human
augcccaaaauaccagccuguuuagcaguguu

SEQ ID NO: 335194 - RNA, 32 nt, Human
augcccaaaauguagaacuuuaaccaaagacu

SEQ ID NO: 335195 - RNA, 24 nt, Human
augcccaaagcccaaccuucucca

SEQ ID NO: 335196 - RNA, 32 nt, Human
augcccaaccuauccuguucuuuuaauugaaa

SEQ ID NO: 335197 - RNA, 22 nt, Human
augcccaagacccccgcuucca

SEQ ID NO: 335198 - RNA, 32 nt, Human
augcccaagacuauguccugacauauaacuau

SEQ ID NO: 335199 - RNA, 32 nt, Human
augcccaagagaaagccugaaggggaugcuac

SEQ ID NO: 335200 - RNA, 32 nt, Human
augcccaagaugacuugcgaggcaaucucagg

SEQ ID NO: 335201 - RNA, 32 nt, Human
augcccacacaacaggcuuauuuucugugaag

SEQ ID NO: 335202 - RNA, 32 nt, Human
augcccacagcaccagcaccugagcucaccuc

SEQ ID NO: 335203 - RNA, 32 nt, Human
augcccacaggccacacacacugcaucacuga

SEQ ID NO: 335204 - RNA, 32 nt, Human
augcccacgccuagucccaucugggcccccau

SEQ ID NO: 335205 - RNA, 32 nt, Human
augcccacgcuggagugcagugagccgagauc

SEQ ID NO: 335206 - RNA, 32 nt, Human
augcccacuccccuuuuuccuuccaccaugau

SEQ ID NO: 335207 - RNA, 32 nt, Human
augcccacuccuccuucucucacucccuuucu

SEQ ID NO: 335208 - RNA, 32 nt, Human
augcccacugcagcccuccagccucugguccc

SEQ ID NO: 335209 - RNA, 32 nt, Human
augcccagaggucugguccugaugcuggcagg

SEQ ID NO: 335210 - RNA, 18 nt, Human
augcccagcacacauggg

SEQ ID NO: 335211 - RNA, 24 nt, Human
augcccagccagccaccccugcca

SEQ ID NO: 335212 - RNA, 32 nt, Human
augcccagccugagaggagucaagacacaaua

SEQ ID NO: 335213 - RNA, 32 nt, Human
augcccagccuggcugagcccgagauucgcuc

SEQ ID NO: 335214 - RNA, 32 nt, Human
augcccagcugcaacccuaauuuuucauucag

SEQ ID NO: 335215 - RNA, 32 nt, Human
augcccagcugcggaugggagcuguuccugga

SEQ ID NO: 335216 - RNA, 32 nt, Human
augcccaggagaagagugaaccucucccacgu

SEQ ID NO: 335217 - RNA, 32 nt, Human
augcccaggcagcuccuggggcaguggaugga

SEQ ID NO: 335218 - RNA, 32 nt, Human
augcccagggccuggcagacuguggcuagaac

SEQ ID NO: 335219 - RNA, 32 nt, Human
augcccagggccugugcggccgcccuggaggc

SEQ ID NO: 335220 - RNA, 28 nt, Human
augcccaggucuccugccucacaucaca

SEQ ID NO: 335221 - RNA, 32 nt, Human
augcccagguuggggugcaguggcacaaucau

SEQ ID NO: 335222 - RNA, 32 nt, Human
augcccagucccccaguauuccccaucucgaa

SEQ ID NO: 335223 - RNA, 32 nt, Human
augcccagugcugcaugggacccaugucuccu

SEQ ID NO: 335224 - RNA, 32 nt, Human
augcccaucaucaagcaaaggggccauccagg

SEQ ID NO: 335225 - RNA, 32 nt, Human
augcccaucuaauauuuguauuuuuaguagag

SEQ ID NO: 335226 - RNA, 32 nt, Human
augcccaucugacaucagagacggcagugcuc

SEQ ID NO: 335227 - RNA, 32 nt, Human
augcccaucuugagggaagagggugagugaag

SEQ ID NO: 335228 - RNA, 32 nt, Human
augcccaugaccuguaauuguaaagaagcuug

SEQ ID NO: 335229 - RNA, 32 nt, Human
augcccaugagguauuuaaaacagauauuuau

SEQ ID NO: 335230 - RNA, 32 nt, Human
augccccacucccuuacugcagucucuacuaa

SEQ ID NO: 335231 - RNA, 32 nt, Human
augccccacugagguccuagagugccuccagg

SEQ ID NO: 335232 - RNA, 32 nt, Human
augccccacugcacuccagccugggcgacaga

SEQ ID NO: 335233 - RNA, 32 nt, Human
augccccacuggcagcaucuucacuucuaaau

SEQ ID NO: 335234 - RNA, 32 nt, Human
augccccagaguaaaucccagauggaucaaag

SEQ ID NO: 335235 - RNA, 32 nt, Human
augccccaggggacccagccagggggugggcu

SEQ ID NO: 335236 - RNA, 32 nt, Human
augccccaguucagaaauuuggcauugaucuu

SEQ ID NO: 335237 - RNA, 32 nt, Human
augccccaucacagcacacgcuguccugcauu

SEQ ID NO: 335238 - RNA, 32 nt, Human
augccccaugucucagaaauagguggccaugg

SEQ ID NO: 335239 - RNA, 32 nt, Human
augcccccacgaccauccucacugcagaacug

SEQ ID NO: 335240 - RNA, 32 nt, Human
augcccccaggaaccucagcccgggugcugca

SEQ ID NO: 335241 - RNA, 32 nt, Human
augcccccauugagguucacuuccuggauccu

SEQ ID NO: 335242 - RNA, 32 nt, Human
augcccccuacacuccuccccaccucaaccag

SEQ ID NO: 335243 - RNA, 32 nt, Human
augcccccuccaggcugagacugaugugauaa

SEQ ID NO: 335244 - RNA, 32 nt, Human
augcccccuuucagaugucuucugccuguuau

SEQ ID NO: 335245 - RNA, 31 nt, Human
augccccggcaccucugcccugugucuuuca

SEQ ID NO: 335246 - RNA, 32 nt, Human
augccccucccgcccccaaauacgagaucgaa

SEQ ID NO: 335247 - RNA, 32 nt, Human
augccccucucagaccacccagcggaugccua

SEQ ID NO: 335248 - RNA, 24 nt, Human
augccccugacacugcacugagca

SEQ ID NO: 335249 - RNA, 32 nt, Human
augccccugcauuccagccuaggcgacagagu

SEQ ID NO: 335250 - RNA, 32 nt, Human
augccccugguccccucugcaucaccucugcg

SEQ ID NO: 335251 - RNA, 32 nt, Human
augccccuguacuccagccugggugacagagc

SEQ ID NO: 335252 - RNA, 32 nt, Human
augccccuguagucccagcuacuugggaggcu

SEQ ID NO: 335253 - RNA, 32 nt, Human
augccccuuccuuccuucuccugggacuggug

SEQ ID NO: 335254 - RNA, 32 nt, Human
augcccgcgagguggcccccaggcuggccuuu

SEQ ID NO: 335255 - RNA, 32 nt, Human
augcccggacauccuggaagcugggaaauggu

SEQ ID NO: 335256 - RNA, 32 nt, Human
augcccggcugauuucuuuuuguauuuuuagu

SEQ ID NO: 335257 - RNA, 32 nt, Human
augcccgggaggaccagcagaggauuaaaggu

SEQ ID NO: 335258 - RNA, 32 nt, Human
augcccggggcaggccugacgggcagcugagg

SEQ ID NO: 335259 - RNA, 32 nt, Human
augcccggucaccaugggggucagguuauuuu

SEQ ID NO: 335260 - RNA, 32 nt, Human
augcccgugaaaugauguuguugcugcccaca

SEQ ID NO: 335261 - RNA, 32 nt, Human
augcccgugagcugcuaugggguggugggggu

SEQ ID NO: 335262 - RNA, 32 nt, Human
augcccgugggugggaugggaguggaggguuc

SEQ ID NO: 335263 - RNA, 32 nt, Human
augcccuacagaccuggcuggucaaggauuug

SEQ ID NO: 335264 - RNA, 19 nt, Human
augcccuauccaucauuaa

SEQ ID NO: 335265 - RNA, 32 nt, Human
augcccucaaccgccuccuggugacggacuac

SEQ ID NO: 335266 - RNA, 32 nt, Human
augcccucuucucgugccuccccaccaccacu

SEQ ID NO: 335267 - RNA, 32 nt, Human
augcccugaaaaggaaaggaaaagggaagcuu

SEQ ID NO: 335268 - RNA, 32 nt, Human
augcccugaaggacacugugacaggaagaaca

SEQ ID NO: 335269 - RNA, 32 nt, Human
augcccugccaagcagcagauggggagggugc

SEQ ID NO: 335270 - RNA, 32 nt, Human
augcccugcgcuccuccacagccugggccggg

SEQ ID NO: 335271 - RNA, 32 nt, Human
augcccuggcagcagauuucugcaggaugagg

SEQ ID NO: 335272 - RNA, 32 nt, Human
augcccugguccaccggaaggccggcgccucc

SEQ ID NO: 335273 - RNA, 32 nt, Human
augcccuggugucuuucuccugggcuucuauc

SEQ ID NO: 335274 - RNA, 17 nt, Human
augcccuguacuaccau

SEQ ID NO: 335275 - RNA, 32 nt, Human
augcccugucacaguucccucgacucuuucaa

SEQ ID NO: 335276 - RNA, 32 nt, Human
augcccugucauuccugagauggggccaccug

SEQ ID NO: 335277 - RNA, 32 nt, Human
augcccugucucauuuugggaaaaaggaaauc

SEQ ID NO: 335278 - RNA, 32 nt, Human
augcccugugggcucccagaccccugagcuuu

SEQ ID NO: 335279 - RNA, 32 nt, Human
augcccuucaccaaagcugccucccaguggcc

SEQ ID NO: 335280 - RNA, 32 nt, Human
augcccuucacuuucuccugguguuuuucucu

SEQ ID NO: 335281 - RNA, 32 nt, Human
augcccuucccccuuucucugccuggcaacau

SEQ ID NO: 335282 - RNA, 32 nt, Human
augcccuucucccaaauggcuucccuccugga

SEQ ID NO: 335283 - RNA, 32 nt, Human
augcccuucucccccaucuccguguccucguu

SEQ ID NO: 335284 - RNA, 32 nt, Human
augcccuugaauuccucccugucuggcccucc

SEQ ID NO: 335285 - RNA, 32 nt, Human
augcccuugauauaucuuuugcaccugcugaa

SEQ ID NO: 335286 - RNA, 20 nt, Human
augccgaaagguuucugucu

SEQ ID NO: 335287 - RNA, 32 nt, Human
augccgaggguggagugcaguggcacaaucuc

SEQ ID NO: 335288 - RNA, 32 nt, Human
augccgaugaagccuccagguaacaggcuuca

SEQ ID NO: 335289 - RNA, 32 nt, Human
augccgcauucauuuaaagcuauuuuguuuac

SEQ ID NO: 335290 - RNA, 23 nt, Human
augccgccaagcgccccccgcca

SEQ ID NO: 335291 - RNA, 27 nt, Human
augccgccaccagaaaccccucugcca

SEQ ID NO: 335292 - RNA, 20 nt, Human
augccgccaccggccccgcc

SEQ ID NO: 335293 - RNA, 30 nt, Human
augccgccgccauccgcccgccgccgccgc

SEQ ID NO: 335294 - RNA, 20 nt, Human
augccgccgccgcugccgcc

SEQ ID NO: 335295 - RNA, 32 nt, Human
augccgccucaagggucuucaggggaggccag

SEQ ID NO: 335296 - RNA, 30 nt, Human
augccgccugucaauaaauguugaaaaguc

SEQ ID NO: 335297 - RNA, 32 nt, Human
augccgcugcacuccagccugggagacugcau

SEQ ID NO: 335298 - RNA, 32 nt, Human
augccgcugcacuccagccugggggacagagc

SEQ ID NO: 335299 - RNA, 25 nt, Human
augccgcugcauuccagccugggug

SEQ ID NO: 335300 - RNA, 32 nt, Human
augccggagugggggaaauggaacccgcaaag

SEQ ID NO: 335301 - RNA, 32 nt, Human
augccggcucacugcaaccucugucuucuggg

SEQ ID NO: 335302 - RNA, 23 nt, Human
augccggcuuaccaucucuacca

SEQ ID NO: 335303 - RNA, 32 nt, Human
augccggggaccugggccgcgcugccaggacc

SEQ ID NO: 335304 - RNA, 32 nt, Human
augccggucuccuacucuucauggccuuugua

SEQ ID NO: 335305 - RNA, 32 nt, Human
augccguuguacuccagcuugggcaacagagu

SEQ ID NO: 335306 - RNA, 32 nt, Human
augccuaaagcuuugggucugaaggggccccc

SEQ ID NO: 335307 - RNA, 32 nt, Human
augccuaaggucgccacugccugcugcagaga

SEQ ID NO: 335308 - RNA, 32 nt, Human
augccuaccaacaagcuguaaaaugaucaccc

SEQ ID NO: 335309 - RNA, 32 nt, Human
augccuaccuucucuuucuucguucccugccc

SEQ ID NO: 335310 - RNA, 32 nt, Human
augccuacugcacuccagccugggcaacaaag

SEQ ID NO: 335311 - RNA, 32 nt, Human
augccuacuggaagccuguucuucagcuuugg

SEQ ID NO: 335312 - RNA, 17 nt, Human
augccuagacacggggg

SEQ ID NO: 335313 - RNA, 32 nt, Human
augccuaggagguugaggcugcagugagcugu

SEQ ID NO: 335314 - RNA, 32 nt, Human
augccuauagucccagcacuuugggaggccaa

SEQ ID NO: 335315 - RNA, 32 nt, Human
augccuauuauucacauaucuccuuuuaugaa

SEQ ID NO: 335316 - RNA, 32 nt, Human
augccuauuguuggauauugaaugacagacaa

SEQ ID NO: 335317 - RNA, 32 nt, Human
augccucagcacagcagagaaaaccaugcugu

SEQ ID NO: 335318 - RNA, 32 nt, Human
augccucagcuugcugcuugugccaguugccu

SEQ ID NO: 335319 - RNA, 32 nt, Human
augccucaggcaguuauaugaagguuuauuuc

SEQ ID NO: 335320 - RNA, 32 nt, Human
augccucaguguuaaaaugacaucucaaaaga

SEQ ID NO: 335321 - RNA, 32 nt, Human
augccucaguuuccucauuuugaucuagauau

SEQ ID NO: 335322 - RNA, 32 nt, Human
augccucauggagaauuaagagagaagccucc

SEQ ID NO: 335323 - RNA, 32 nt, Human
augccuccaaggccgguccccugcugcccagg

SEQ ID NO: 335324 - RNA, 32 nt, Human
augccuccaccauuuucuaccuggugacuuga

SEQ ID NO: 335325 - RNA, 32 nt, Human
augccucccacugugacaggcccugucaccac

SEQ ID NO: 335326 - RNA, 32 nt, Human
augccucccucuuccuccucuuuccuccucuc

SEQ ID NO: 335327 - RNA, 32 nt, Human
augccuccgggacugacacuccaggcagcuuu

SEQ ID NO: 335328 - RNA, 32 nt, Human
augccuccucagcucaccuucucucuucacca

SEQ ID NO: 335329 - RNA, 32 nt, Human
augccuccucccucugaccacagggucaugcc

SEQ ID NO: 335330 - RNA, 32 nt, Human
augccuccugcacacagccgucugagcagggc

SEQ ID NO: 335331 - RNA, 32 nt, Human
augccucggggugggagcugggccuggcgacc

SEQ ID NO: 335332 - RNA, 32 nt, Human
augccucuccaccucacucuggacugcccaag

SEQ ID NO: 335333 - RNA, 32 nt, Human
augccucuccaccucccaugucacccaugaaa

SEQ ID NO: 335334 - RNA, 32 nt, Human
augccucucccauccucucucaggaagcuucu

SEQ ID NO: 335335 - RNA, 32 nt, Human
augccucucuacuccagccugggcaauagggu

SEQ ID NO: 335336 - RNA, 32 nt, Human
augccucugaagagagggacagaccgucagaa

SEQ ID NO: 335337 - RNA, 32 nt, Human
augccucugcagccacaauucugaccuaagug

SEQ ID NO: 335338 - RNA, 32 nt, Human
augccucugcagcuacacaaucccaagacaga

SEQ ID NO: 335339 - RNA, 32 nt, Human
augccucugcauuccagccuuggugacagagc

SEQ ID NO: 335340 - RNA, 32 nt, Human
augccucugccucucuucauuuucuuucaucu

SEQ ID NO: 335341 - RNA, 20 nt, Human
augccucuggcaccugcgca

SEQ ID NO: 335342 - RNA, 32 nt, Human
augccucuucacuguucuggauugugagagug

SEQ ID NO: 335343 - RNA, 32 nt, Human
augccucuuugugccaggcaugugggugucuu

SEQ ID NO: 335344 - RNA, 32 nt, Human
augccugaggcaugagugacugugcauuugag

SEQ ID NO: 335345 - RNA, 32 nt, Human
augccugaguauguaaccaaaagaauugaaau

SEQ ID NO: 335346 - RNA, 32 nt, Human
augccugagugccugcagcccaggaggcccgc

SEQ ID NO: 335347 - RNA, 32 nt, Human
augccugauuugcuauuuuugacauuuccucg

SEQ ID NO: 335348 - RNA, 32 nt, Human
augccugcaacaaaauguucucccauagggac

SEQ ID NO: 335349 - RNA, 32 nt, Human
augccugcaacaacugcucaugccaagcuggg

SEQ ID NO: 335350 - RNA, 22 nt, Human
augccugcaguuagccaacuca

SEQ ID NO: 335351 - RNA, 32 nt, Human
augccugccuguaaucccagcacugugggagg

SEQ ID NO: 335352 - RNA, 32 nt, Human
augccugcuagugcuuucugauuacucgcauu

SEQ ID NO: 335353 - RNA, 32 nt, Human
augccugcuccccagcccccugccuggaaccc

SEQ ID NO: 335354 - RNA, 32 nt, Human
augccugcucgagagccagcuguuccaugugc

SEQ ID NO: 335355 - RNA, 32 nt, Human
augccugcugcuucucugccucuuugagguac

SEQ ID NO: 335356 - RNA, 32 nt, Human
augccugcuucaugccaugugcugacugagcc

SEQ ID NO: 335357 - RNA, 32 nt, Human
augccugcuuccaagcuuccaucaagucaggg

SEQ ID NO: 335358 - RNA, 32 nt, Human
augccuggaacaccccaacgugcucaaguuca

SEQ ID NO: 335359 - RNA, 32 nt, Human
augccuggaagaaaccuggggacuuaguuagg

SEQ ID NO: 335360 - RNA, 32 nt, Human
augccuggaagaggagcugguggcugccagcc

SEQ ID NO: 335361 - RNA, 32 nt, Human
augccuggacacugaaaaguaaacgcaucacc

SEQ ID NO: 335362 - RNA, 32 nt, Human
augccuggagagaagggauguuacagaguagc

SEQ ID NO: 335363 - RNA, 32 nt, Human
augccuggcaggacugugccuuuugcauuuuc

SEQ ID NO: 335364 - RNA, 32 nt, Human
augccuggccagaacaaaugccuuuuuaaacc

SEQ ID NO: 335365 - RNA, 32 nt, Human
augccuggccagggacaugaauuuguacaaag

SEQ ID NO: 335366 - RNA, 32 nt, Human
augccuggccuuaggcuguggcccagaagcug

SEQ ID NO: 335367 - RNA, 32 nt, Human
augccuggcuaaaauucuuuuguauuuuuacu

SEQ ID NO: 335368 - RNA, 32 nt, Human
augccugggagggagaauaagaguaagugaac

SEQ ID NO: 335369 - RNA, 32 nt, Human
augccugggcccagcuggagguucugacaggg

SEQ ID NO: 335370 - RNA, 32 nt, Human
augccugggugagccuaggagggaaggcucug

SEQ ID NO: 335371 - RNA, 31 nt, Human
augccuggucaucaggagguugagaaaagcc

SEQ ID NO: 335372 - RNA, 32 nt, Human
augccuggucuugagcaaccucccacugcugg

SEQ ID NO: 335373 - RNA, 32 nt, Human
augccuguaaaucccagcuauuugggaggcug

SEQ ID NO: 335374 - RNA, 32 nt, Human
augccuguaaucaaucccagcacuuugggagg

SEQ ID NO: 335375 - RNA, 32 nt, Human
augccuguaaucacugcacccagccucaaauu

SEQ ID NO: 335376 - RNA, 22 nt, Human
augccuguaaucccaacacuuu

SEQ ID NO: 335377 - RNA, 32 nt, Human
augccuguaaucccagcacuugggaggccaag

SEQ ID NO: 335378 - RNA, 22 nt, Human
augccuguaaucccagcacuuu

SEQ ID NO: 335379 - RNA, 22 nt, Human
augccuguaaucccaguacuuu

SEQ ID NO: 335380 - RNA, 22 nt, Human
augccuguaaucccggcacuuu

SEQ ID NO: 335381 - RNA, 18 nt, Human
augccuguaauuccagcu

SEQ ID NO: 335382 - RNA, 32 nt, Human
augccuguaguaaucccagcacuuuuggaggc

SEQ ID NO: 335383 - RNA, 32 nt, Human
augccuguagucccagcacucgggaaggccga

SEQ ID NO: 335384 - RNA, 32 nt, Human
augccuguagucccagcacucuguggggccga

SEQ ID NO: 335385 - RNA, 32 nt, Human
augccuguauaaucccagcacuuugggaggcc

SEQ ID NO: 335386 - RNA, 32 nt, Human
augccuguccaaaauugcagacuugaaaaguu

SEQ ID NO: 335387 - RNA, 32 nt, Human
augccuguccuccaggcuggggcagguucuua

SEQ ID NO: 335388 - RNA, 32 nt, Human
augccuguccucugccuuaucuugccccucua

SEQ ID NO: 335389 - RNA, 32 nt, Human
augccugucugucauaaacaguacaaacguga

SEQ ID NO: 335390 - RNA, 32 nt, Human
augccugugcuggggccagggguucagggagg

SEQ ID NO: 335391 - RNA, 32 nt, Human
augccugugggaaggcugcacugguuuccuga

SEQ ID NO: 335392 - RNA, 32 nt, Human
augccugugggcuccugucacccuccacgucu

SEQ ID NO: 335393 - RNA, 32 nt, Human
augccuguggucaugcucucagcuccaccugg

SEQ ID NO: 335394 - RNA, 32 nt, Human
augccuguguucucccccggggccacuuagau

SEQ ID NO: 335395 - RNA, 32 nt, Human
augccuguucaucugcugacuucugucuaggc

SEQ ID NO: 335396 - RNA, 32 nt, Human
augccuguucccaggaugcaggugcagucugg

SEQ ID NO: 335397 - RNA, 32 nt, Human
augccuguucugauucucauuugugucucugg

SEQ ID NO: 335398 - RNA, 28 nt, Human
augccuguuuaagggauuacugguccua

SEQ ID NO: 335399 - RNA, 32 nt, Human
augccuuaacccaucaacacagagccggauuu

SEQ ID NO: 335400 - RNA, 32 nt, Human
augccuuaaggaaaaagauugugccaggugug

SEQ ID NO: 335401 - RNA, 32 nt, Human
augccuuaauauuugcaugauaagcuaguuuu

SEQ ID NO: 335402 - RNA, 32 nt, Human
augccuuaguaaaauagcucuauuuaauaaag

SEQ ID NO: 335403 - RNA, 32 nt, Human
augccuucaaccuggcaggagguguagccacu

SEQ ID NO: 335404 - RNA, 32 nt, Human
augccuucacuggcuucuugugcaauaauaug

SEQ ID NO: 335405 - RNA, 32 nt, Human
augccuucaugcccuucucugcagagcauggg

SEQ ID NO: 335406 - RNA, 32 nt, Human
augccuucaugcccuucucugcugagcauggu

SEQ ID NO: 335407 - RNA, 32 nt, Human
augccuuccagugaugcccaccagagaauaca

SEQ ID NO: 335408 - RNA, 32 nt, Human
augccuucccaaucaucucccaaagucucaac

SEQ ID NO: 335409 - RNA, 32 nt, Human
augccuucccagcagucccucaaagucuuaac

SEQ ID NO: 335410 - RNA, 32 nt, Human
augccuucccuuguagcaguuuucagccuccu

SEQ ID NO: 335411 - RNA, 32 nt, Human
augccuuccugucuuucuggcccuuucuggac

SEQ ID NO: 335412 - RNA, 32 nt, Human
augccuucugggcuggggaugggugagcaaag

SEQ ID NO: 335413 - RNA, 32 nt, Human
augccuucuuuggggcucugcaguuccugcau

SEQ ID NO: 335414 - RNA, 32 nt, Human
augccuugcccuaaaccuugaaugacugugag

SEQ ID NO: 335415 - RNA, 32 nt, Human
augccuuggauguggucccaccagcccagugg

SEQ ID NO: 335416 - RNA, 32 nt, Human
augccuuggcccauuccagcagucccaguuau

SEQ ID NO: 335417 - RNA, 25 nt, Human
augccuuggcugcucucagccccca

SEQ ID NO: 335418 - RNA, 32 nt, Human
augccuuuccauccugguacauggaugcuuug

SEQ ID NO: 335419 - RNA, 32 nt, Human
augccuuucccuucccccucugcuccaccgug

SEQ ID NO: 335420 - RNA, 32 nt, Human
augccuuugcgcaaaggaccucccucuugcac

SEQ ID NO: 335421 - RNA, 32 nt, Human
augccuuuuauuucuuuuucuugccuaacugc

SEQ ID NO: 335422 - RNA, 32 nt, Human
augccuuuucccgaauggguucaccucuggca

SEQ ID NO: 335423 - RNA, 32 nt, Human
augccuuuuccucccuuuuccuguacacuccc

SEQ ID NO: 335424 - RNA, 22 nt, Human
augccuuuugccaccuccccca

SEQ ID NO: 335425 - RNA, 32 nt, Human
augccuuuugucuauuucugacacagaugcau

SEQ ID NO: 335426 - RNA, 24 nt, Human
augcgaaaaccugaugagggcaaa

SEQ ID NO: 335427 - RNA, 32 nt, Human
augcgaaaacucagaaggagcuagaaguuacu

SEQ ID NO: 335428 - RNA, 16 nt, Human
augcgaacacugcuca

SEQ ID NO: 335429 - RNA, 32 nt, Human
augcgaaccuauaguagcagcuacuccagagg

SEQ ID NO: 335430 - RNA, 32 nt, Human
augcgaagagugauaguuacgugcuccugacu

SEQ ID NO: 335431 - RNA, 32 nt, Human
augcgacauagcugugucugugccaguaugcc

SEQ ID NO: 335432 - RNA, 32 nt, Human
augcgacaugcccugccugaacaggugcucaa

SEQ ID NO: 335433 - RNA, 32 nt, Human
augcgaccuuugccagccagagcugcugccag

SEQ ID NO: 335434 - RNA, 32 nt, Human
augcgacgcuugaacccaggaggcggagguug

SEQ ID NO: 335435 - RNA, 32 nt, Human
augcgacugcacuccagccugggugacugagc

SEQ ID NO: 335436 - RNA, 32 nt, Human
augcgagggcacucgccuucugccuucugguu

SEQ ID NO: 335437 - RNA, 32 nt, Human
augcgagggcagggugagcaccugagagugag

SEQ ID NO: 335438 - RNA, 32 nt, Human
augcgaguaccugaggaaggugaccuugagga

SEQ ID NO: 335439 - RNA, 32 nt, Human
augcgagucaagguaguugaugcccaacugug

SEQ ID NO: 335440 - RNA, 32 nt, Human
augcgaguccccuagagagaggcauuguacug

SEQ ID NO: 335441 - RNA, 32 nt, Human
augcgauagggagggguggggacugugguggg

SEQ ID NO: 335442 - RNA, 32 nt, Human
augcgaucacggaucagucagagcagggucag

SEQ ID NO: 335443 - RNA, 32 nt, Human
augcgaucucacugcaaccucugccucccggg

SEQ ID NO: 335444 - RNA, 32 nt, Human
augcgcaaaacuuggaaaaugugacaauaaag

SEQ ID NO: 335445 - RNA, 32 nt, Human
augcgcagugccuugcauacccaaaccaggug

SEQ ID NO: 335446 - RNA, 32 nt, Human
augcgccacugcacuccagccugggcgacaga

SEQ ID NO: 335447 - RNA, 32 nt, Human
augcgcccggagcgauccuccuucccucuccu

SEQ ID NO: 335448 - RNA, 32 nt, Human
augcgccgucaccaucuccaccucccaccaaa

SEQ ID NO: 335449 - RNA, 32 nt, Human
augcgccuagaaucccagcuacucggaaggcc

SEQ ID NO: 335450 - RNA, 32 nt, Human
augcgccuauaaucucagcuacuugggaggcu

SEQ ID NO: 335451 - RNA, 32 nt, Human
augcgccuauagucccagcugcucaggaggcu

SEQ ID NO: 335452 - RNA, 32 nt, Human
augcgccucaccucucccuccccaccagcaga

SEQ ID NO: 335453 - RNA, 32 nt, Human
augcgccuccucucccccaucccagcccucag

SEQ ID NO: 335454 - RNA, 32 nt, Human
augcgccuguaaucccagcuacccaggaggcu

SEQ ID NO: 335455 - RNA, 32 nt, Human
augcgccuguaaucccagcuacucaggaagcu

SEQ ID NO: 335456 - RNA, 32 nt, Human
augcgccuguaaucccagcuacucaggaggcu

SEQ ID NO: 335457 - RNA, 32 nt, Human
augcgccuguaaucccagcuacucgggaggcu

SEQ ID NO: 335458 - RNA, 32 nt, Human
augcgccuguaaucccagcuacucgggagguu

SEQ ID NO: 335459 - RNA, 32 nt, Human
augcgccuguaaucccagcuacucgggagucu

SEQ ID NO: 335460 - RNA, 32 nt, Human
augcgccuguaaucccagcuacucgggcagcu

SEQ ID NO: 335461 - RNA, 32 nt, Human
augcgccuguaaucccagcuacuucggagguu

SEQ ID NO: 335462 - RNA, 32 nt, Human
augcgccuguaaucccggcuacucgggaggcu

SEQ ID NO: 335463 - RNA, 32 nt, Human
augcgccuguaauccuagcuauucuggaggcu

SEQ ID NO: 335464 - RNA, 20 nt, Human
augcgccuguagucccagcu

SEQ ID NO: 335465 - RNA, 32 nt, Human
augcgccuguagucccagcuacccaggaggcu

SEQ ID NO: 335466 - RNA, 32 nt, Human
augcgccuguagucccagcuacucccuccaga

SEQ ID NO: 335467 - RNA, 32 nt, Human
augcgccuguagucccagcuacucgggaggcu

SEQ ID NO: 335468 - RNA, 32 nt, Human
augcgccuguagucccagcuacuuggaagcug

SEQ ID NO: 335469 - RNA, 32 nt, Human
augcgccuguagucccagcuacuugggagacu

SEQ ID NO: 335470 - RNA, 32 nt, Human
augcgccuguagucccagcuacuugggaggcu

SEQ ID NO: 335471 - RNA, 32 nt, Human
augcgccuguagucccagcugcucaggaggcu

SEQ ID NO: 335472 - RNA, 32 nt, Human
augcgccuguauacccagcuacucgggaggcu

SEQ ID NO: 335473 - RNA, 32 nt, Human
augcgccugucaucccagcuacuugagaggcu

SEQ ID NO: 335474 - RNA, 32 nt, Human
augcgccugugaucccagcuacuuggaaggcu

SEQ ID NO: 335475 - RNA, 32 nt, Human
augcgccugugcucccagcuacuuggaagacu

SEQ ID NO: 335476 - RNA, 32 nt, Human
augcgccuguugucccagcugcucuggaggcu

SEQ ID NO: 335477 - RNA, 32 nt, Human
augcgcgaugcccaacucuuuccaagagcacc

SEQ ID NO: 335478 - RNA, 32 nt, Human
augcgcuccagcugcacaaggcagccucugug

SEQ ID NO: 335479 - RNA, 32 nt, Human
augcgcucgccccucuacuccuccacgccccg

SEQ ID NO: 335480 - RNA, 32 nt, Human
augcgcugcugaaaccaggaauccaggucagg

SEQ ID NO: 335481 - RNA, 32 nt, Human
augcgcugcuuucccucuccugccucauuccu

SEQ ID NO: 335482 - RNA, 32 nt, Human
augcggaaagcugcuuucucucccuucuucga

SEQ ID NO: 335483 - RNA, 32 nt, Human
augcggaaaggccuuuuuccagaagucacacc

SEQ ID NO: 335484 - RNA, 32 nt, Human
augcggacccagcccgccgccuccaggagcac

SEQ ID NO: 335485 - RNA, 32 nt, Human
augcggagacugagguuuagggcaguuaagcu

SEQ ID NO: 335486 - RNA, 32 nt, Human
augcggagccggcugaaaugcuccaacuuuuu

SEQ ID NO: 335487 - RNA, 32 nt, Human
augcggauccacacuggagaaaaacccuacaa

SEQ ID NO: 335488 - RNA, 32 nt, Human
augcggccgcugcuacacgccuggugggcagc

SEQ ID NO: 335489 - RNA, 32 nt, Human
augcggcugcucccugcuccgucccgcccagc

SEQ ID NO: 335490 - RNA, 32 nt, Human
augcggcuggaggcggaggcaacggcggcugg

SEQ ID NO: 335491 - RNA, 32 nt, Human
augcggcuggagggacacagagggcaagacug

SEQ ID NO: 335492 - RNA, 32 nt, Human
augcggcuguuuggcagaguccuguccuggcu

SEQ ID NO: 335493 - RNA, 32 nt, Human
augcgggagagggcggcgccggggcgcucgcg

SEQ ID NO: 335494 - RNA, 32 nt, Human
augcgggagaggguuagagcuauagagauuau

SEQ ID NO: 335495 - RNA, 32 nt, Human
augcgggagcagcagaaggagcagcgggagca

SEQ ID NO: 335496 - RNA, 21 nt, Human
augcgggagguucaaugugaa

SEQ ID NO: 335497 - RNA, 32 nt, Human
augcgggauaucucccccugcucucuggguau

SEQ ID NO: 335498 - RNA, 32 nt, Human
augcgggcgcgggacacuccaucucuguuccu

SEQ ID NO: 335499 - RNA, 32 nt, Human
augcggggacaggcuggaaugagggaggcguc

SEQ ID NO: 335500 - RNA, 32 nt, Human
augcggggcugcagaggagacgcggggccgga

SEQ ID NO: 335501 - RNA, 32 nt, Human
augcggggcugcucagggcaggccccagggcg

SEQ ID NO: 335502 - RNA, 32 nt, Human
augcgggggaagagaacugacccagguaauga

SEQ ID NO: 335503 - RNA, 32 nt, Human
augcggucagcagucucaggccagcuucucug

SEQ ID NO: 335504 - RNA, 32 nt, Human
augcggucaggaguucgagaccagccuggcca

SEQ ID NO: 335505 - RNA, 32 nt, Human
augcggugaccugccagcaccugccgcagccu

SEQ ID NO: 335506 - RNA, 32 nt, Human
augcgguuuugccuaauaaagcauuuucacag

SEQ ID NO: 335507 - RNA, 32 nt, Human
augcguagccugaguggcuggguagacggagg

SEQ ID NO: 335508 - RNA, 32 nt, Human
augcguaggagaaggggugggaagauggguuu

SEQ ID NO: 335509 - RNA, 32 nt, Human
augcguauagacauacauacauguacaccaua

SEQ ID NO: 335510 - RNA, 32 nt, Human
augcguauuagguacuagcugcagugaaggcu

SEQ ID NO: 335511 - RNA, 32 nt, Human
augcgucacugcagccuccaccucccgggcuc

SEQ ID NO: 335512 - RNA, 32 nt, Human
augcgucaguuauuuagggauggucuuuuguu

SEQ ID NO: 335513 - RNA, 32 nt, Human
augcguccuugaaagaaaaagaaucugaauuc

SEQ ID NO: 335514 - RNA, 32 nt, Human
augcgucgggugggcaccucagcaaccaguag

SEQ ID NO: 335515 - RNA, 32 nt, Human
augcgucuccccugcccuccuggagcccugca

SEQ ID NO: 335516 - RNA, 32 nt, Human
augcgugaugguccuucuuugucccugcaagu

SEQ ID NO: 335517 - RNA, 32 nt, Human
augcgugcacacauagacgcaugcacucacac

SEQ ID NO: 335518 - RNA, 32 nt, Human
augcgugcagugcucuuaucaccaucucuggu

SEQ ID NO: 335519 - RNA, 32 nt, Human
augcgugccugcuggggagggggugaguggug

SEQ ID NO: 335520 - RNA, 32 nt, Human
augcguggagaguccaccuccaguguagagac

SEQ ID NO: 335521 - RNA, 32 nt, Human
augcgugggcugggcuaggucccucuguccau

SEQ ID NO: 335522 - RNA, 32 nt, Human
augcguguauaguccaagcuacucaggaggcu

SEQ ID NO: 335523 - RNA, 32 nt, Human
augcguguguagucgaagcuacucaggaggcu

SEQ ID NO: 335524 - RNA, 32 nt, Human
augcguguuaccuggcuuuuggcuccacgcuc

SEQ ID NO: 335525 - RNA, 32 nt, Human
augcguucacaauuaaggucucuuccaaaucc

SEQ ID NO: 335526 - RNA, 32 nt, Human
augcguucagcagacugguuugcagugaauuu

SEQ ID NO: 335527 - RNA, 32 nt, Human
augcguucuggugugucuuaaaauuccaaaca

SEQ ID NO: 335528 - RNA, 32 nt, Human
augcguugccugcccuuccuccauuguugccc

SEQ ID NO: 335529 - RNA, 32 nt, Human
augcuaaaagaggaagaagagaggcuccagcu

SEQ ID NO: 335530 - RNA, 32 nt, Human
augcuaaagcuuucucuccucaauaaaaauau

SEQ ID NO: 335531 - RNA, 32 nt, Human
augcuaaccucuguuucaugcuaaccagacac

SEQ ID NO: 335532 - RNA, 32 nt, Human
augcuaagaacagcaccuguacguaguauguc

SEQ ID NO: 335533 - RNA, 32 nt, Human
augcuaagacucaguggggaggggcugugggc

SEQ ID NO: 335534 - RNA, 32 nt, Human
augcuaaggaaaaugggcugagcccccaauag

SEQ ID NO: 335535 - RNA, 32 nt, Human
augcuaaggacugcgggaaugagggagucaga

SEQ ID NO: 335536 - RNA, 32 nt, Human
augcuaaggacugugggaaugagggggucaga

SEQ ID NO: 335537 - RNA, 32 nt, Human
augcuaaucucuuccagaaacagccucacaga

SEQ ID NO: 335538 - RNA, 32 nt, Human
augcuacaacuacuauuuuuagcaauguuuuu

SEQ ID NO: 335539 - RNA, 32 nt, Human
augcuacaaguaugagaugagaucuaaguaaa

SEQ ID NO: 335540 - RNA, 32 nt, Human
augcuacacagcacuccucuuguccuugaucc

SEQ ID NO: 335541 - RNA, 32 nt, Human
augcuacacccacauucucuccaacucuucau

SEQ ID NO: 335542 - RNA, 32 nt, Human
augcuacauggucauaggaaacuggggaaugu

SEQ ID NO: 335543 - RNA, 32 nt, Human
augcuaccccacaagcuugucagaucgcccag

SEQ ID NO: 335544 - RNA, 32 nt, Human
augcuacugcacuccagccuaggugacagagu

SEQ ID NO: 335545 - RNA, 32 nt, Human
augcuacugcacuccagccugggagacagagc

SEQ ID NO: 335546 - RNA, 32 nt, Human
augcuacugcacuccagccugggcgacagagc

SEQ ID NO: 335547 - RNA, 32 nt, Human
augcuacugcacuccagccugggugacagagc

SEQ ID NO: 335548 - RNA, 32 nt, Human
augcuacugcacuccagcuuagguggcaaagu

SEQ ID NO: 335549 - RNA, 32 nt, Human
augcuacugcacucuagccugagcgacagagu

SEQ ID NO: 335550 - RNA, 32 nt, Human
augcuagaagcauaugcaacagugaauaaaag

SEQ ID NO: 335551 - RNA, 24 nt, Human
augcuagaggugccccgcuccauc

SEQ ID NO: 335552 - RNA, 32 nt, Human
augcuagagugaaagaaaaagaaagagagcac

SEQ ID NO: 335553 - RNA, 32 nt, Human
augcuagaucagugagaggagauugcaguucu

SEQ ID NO: 335554 - RNA, 32 nt, Human
augcuagcaacauuauagaaauuuugccuugu

SEQ ID NO: 335555 - RNA, 32 nt, Human
augcuagccaggccucuccaucuugccugguu

SEQ ID NO: 335556 - RNA, 32 nt, Human
augcuagccauggucaucugacagucucuacg

SEQ ID NO: 335557 - RNA, 32 nt, Human
augcuagccccuuucccuccccugaaccuggu

SEQ ID NO: 335558 - RNA, 30 nt, Human
augcuaggaacgugcugggcacaauuaggg

SEQ ID NO: 335559 - RNA, 32 nt, Human
augcuaggaggcagaaggggcagagaguaaaa

SEQ ID NO: 335560 - RNA, 30 nt, Human
augcuaggcaagcccagggcacagaugccg

SEQ ID NO: 335561 - RNA, 32 nt, Human
augcuagggugagguuuagccaucuuacuugg

SEQ ID NO: 335562 - RNA, 32 nt, Human
augcuagguuaauccaauuauaugagacguuu

SEQ ID NO: 335563 - RNA, 32 nt, Human
augcuagugcgcuccagccugggcaacagagc

SEQ ID NO: 335564 - RNA, 32 nt, Human
augcuaguggcugauaugggugugggggaugc

SEQ ID NO: 335565 - RNA, 32 nt, Human
augcuaguguguggcagccaugaaaaguuaca

SEQ ID NO: 335566 - RNA, 31 nt, Human
augcuaguuacaggguagaaagacuguauug

SEQ ID NO: 335567 - RNA, 32 nt, Human
augcuaguuaccacugugaacacaggacauga

SEQ ID NO: 335568 - RNA, 32 nt, Human
augcuaucauuguauucuuuaagaacuuuauu

SEQ ID NO: 335569 - RNA, 32 nt, Human
augcuaugaaaccucaagggaacaaauuaugu

SEQ ID NO: 335570 - RNA, 32 nt, Human
augcuauguauggguauguaaauaucagugcu

SEQ ID NO: 335571 - RNA, 32 nt, Human
augcuauugugauauuuuagcacuuugguagc

SEQ ID NO: 335572 - RNA, 32 nt, Human
augcuauuuuauggaaacuuuggucucacauc

SEQ ID NO: 335573 - RNA, 32 nt, Human
augcucaaacaugagaagacugggacauccau

SEQ ID NO: 335574 - RNA, 32 nt, Human
augcucacaaaagacaaaaauuagcugaaaca

SEQ ID NO: 335575 - RNA, 32 nt, Human
augcucacacacacagagauauauuaaagcac

SEQ ID NO: 335576 - RNA, 32 nt, Human
augcucacaccacugcacuccagccuggguga

SEQ ID NO: 335577 - RNA, 32 nt, Human
augcucacaccacugcacuccauccugggcaa

SEQ ID NO: 335578 - RNA, 32 nt, Human
augcucacagucacacagcaggcaguggcagg

SEQ ID NO: 335579 - RNA, 32 nt, Human
augcucaccaauaugaauugggaucuucaaag

SEQ ID NO: 335580 - RNA, 32 nt, Human
augcucaccugugccaucuguccuccugucug

SEQ ID NO: 335581 - RNA, 32 nt, Human
augcucacuacuuucucucuucucucucccug

SEQ ID NO: 335582 - RNA, 32 nt, Human
augcucacuguagccuugaccuucuggguuca

SEQ ID NO: 335583 - RNA, 32 nt, Human
augcucacuucugguccagagcucuuuccuca

SEQ ID NO: 335584 - RNA, 32 nt, Human
augcucagaaccuaaccacuaccuuacaguga

SEQ ID NO: 335585 - RNA, 32 nt, Human
augcucagaauggagcaguggacaaaggagac

SEQ ID NO: 335586 - RNA, 32 nt, Human
augcucagaccucucccaccccaaacccucuc

SEQ ID NO: 335587 - RNA, 32 nt, Human
augcucagauuaacuuccauagguacauaagu

SEQ ID NO: 335588 - RNA, 32 nt, Human
augcucagauuucucacauccugcccaggauc

SEQ ID NO: 335589 - RNA, 32 nt, Human
augcucagcaugcucacccugcagcacagcgc

SEQ ID NO: 335590 - RNA, 32 nt, Human
augcucagccagcucuggaggcuggagucuga

SEQ ID NO: 335591 - RNA, 32 nt, Human
augcucagcccaggcauugagugugaugcuga

SEQ ID NO: 335592 - RNA, 32 nt, Human
augcucaggaacaggcuuuuguccuucugcau

SEQ ID NO: 335593 - RNA, 32 nt, Human
augcucaggaagagcugggccuuuggcacuug

SEQ ID NO: 335594 - RNA, 32 nt, Human
augcucaggaaggaggcgccucugcaaggguu

SEQ ID NO: 335595 - RNA, 32 nt, Human
augcucaggagaacagggggaagagagagauu

SEQ ID NO: 335596 - RNA, 32 nt, Human
augcucaggagaagccaugggccccuccuguc

SEQ ID NO: 335597 - RNA, 32 nt, Human
augcucaggggcccuggagcagccaccccaug

SEQ ID NO: 335598 - RNA, 31 nt, Human
augcucaggguaaggagcaccaaagcugagg

SEQ ID NO: 335599 - RNA, 24 nt, Human
augcucauaaauaagccugggaag

SEQ ID NO: 335600 - RNA, 32 nt, Human
augcucaugugcuucuucugggcuuguaacac

SEQ ID NO: 335601 - RNA, 32 nt, Human
augcuccaaaccauaccacagagugauccaaa

SEQ ID NO: 335602 - RNA, 32 nt, Human
augcuccaaaggccaaacuucuggggcugggg

SEQ ID NO: 335603 - RNA, 23 nt, Human
augcuccacaaauucaacuugua

SEQ ID NO: 335604 - RNA, 32 nt, Human
augcuccacuaaaccauuucuugcaucacagu

SEQ ID NO: 335605 - RNA, 32 nt, Human
augcuccagaucccaguauucagaugugucua

SEQ ID NO: 335606 - RNA, 32 nt, Human
augcuccagcaacccugugggggaaguguuuu

SEQ ID NO: 335607 - RNA, 32 nt, Human
augcuccaggaggucugggguaccagugggcu

SEQ ID NO: 335608 - RNA, 32 nt, Human
augcuccagggcagccuccaccuugcucuucu

SEQ ID NO: 335609 - RNA, 32 nt, Human
augcuccaucauacucaggucucccuacuccu

SEQ ID NO: 335610 - RNA, 32 nt, Human
augcucccaagcuccauucuuccuucccucaa

SEQ ID NO: 335611 - RNA, 32 nt, Human
augcucccaagugccagggagggccgagcgag

SEQ ID NO: 335612 - RNA, 32 nt, Human
augcucccaguucccucgucccugcccagguc

SEQ ID NO: 335613 - RNA, 32 nt, Human
augcucccaguucuguuaggacaggcauacug

SEQ ID NO: 335614 - RNA, 32 nt, Human
augcuccccaaauaagaaaugcaucagcucag

SEQ ID NO: 335615 - RNA, 32 nt, Human
augcuccccacccccuggcaaaaggcuggcca

SEQ ID NO: 335616 - RNA, 32 nt, Human
augcuccccgaucuccuuccucuaccacucug

SEQ ID NO: 335617 - RNA, 32 nt, Human
augcuccccuacugacuagcugugccacucug

SEQ ID NO: 335618 - RNA, 32 nt, Human
augcuccccuccaggauggagugggggucggc

SEQ ID NO: 335619 - RNA, 32 nt, Human
augcuccccuuccucugcuccuuaaggucacu

SEQ ID NO: 335620 - RNA, 32 nt, Human
augcucccucucuccagaccagccuucugcuu

SEQ ID NO: 335621 - RNA, 32 nt, Human
augcucccugcucacccccuucuccaaagccc

SEQ ID NO: 335622 - RNA, 32 nt, Human
augcucccuuccuccccagcuccugguuggac

SEQ ID NO: 335623 - RNA, 20 nt, Human
augcuccgacacagcaggga

SEQ ID NO: 335624 - RNA, 32 nt, Human
augcuccuauagucccagcuuggagauugagg

SEQ ID NO: 335625 - RNA, 32 nt, Human
augcuccucucuuuucugagagagaaggcaug

SEQ ID NO: 335626 - RNA, 32 nt, Human
augcuccugcuauccagaaagcagagaucugu

SEQ ID NO: 335627 - RNA, 32 nt, Human
augcuccugggaacucggaaagcucugggaug

SEQ ID NO: 335628 - RNA, 25 nt, Human
augcuccuugccucugcucugugca

SEQ ID NO: 335629 - RNA, 32 nt, Human
augcucgccagccgggguacacccugcacaau

SEQ ID NO: 335630 - RNA, 32 nt, Human
augcucgcccagcccucccccugcugcugaga

SEQ ID NO: 335631 - RNA, 32 nt, Human
augcucggcccagggucugggagcugggcuaa

SEQ ID NO: 335632 - RNA, 32 nt, Human
augcucggccuccugcgggaagaggaagcggc

SEQ ID NO: 335633 - RNA, 32 nt, Human
augcucggccugcugcugcucugcacccccag

SEQ ID NO: 335634 - RNA, 32 nt, Human
augcucgucaaugaucaguaucaacacagaag

SEQ ID NO: 335635 - RNA, 32 nt, Human
augcucgucuccaacuccugaccucagguaau

SEQ ID NO: 335636 - RNA, 32 nt, Human
augcucuaagagaacagccagaugguuuauau

SEQ ID NO: 335637 - RNA, 32 nt, Human
augcucuacuucugcucuaguauuugguuugg

SEQ ID NO: 335638 - RNA, 32 nt, Human
augcucucacccucgucuggaggggcaggagu

SEQ ID NO: 335639 - RNA, 32 nt, Human
augcucuccaucucccuuauguggacucuugu

SEQ ID NO: 335640 - RNA, 32 nt, Human
augcucucccuguuccucuccccgccacccca

SEQ ID NO: 335641 - RNA, 32 nt, Human
augcucucucaccucuauuaccuccucacauc

SEQ ID NO: 335642 - RNA, 32 nt, Human
augcucucuccuaaggccuuuccucuuuccug

SEQ ID NO: 335643 - RNA, 32 nt, Human
augcucucuccucugcccaucaccuccccuug

SEQ ID NO: 335644 - RNA, 32 nt, Human
augcucucucuuacccugucacuuggucuaga

SEQ ID NO: 335645 - RNA, 23 nt, Human
augcucucuguccgaucugugca

SEQ ID NO: 335646 - RNA, 32 nt, Human
augcucugaaauggcgugcccucugcccaggu

SEQ ID NO: 335647 - RNA, 23 nt, Human
augcucugacacccaccucauca

SEQ ID NO: 335648 - RNA, 32 nt, Human
augcucugaguagaagguggugaccuccagga

SEQ ID NO: 335649 - RNA, 32 nt, Human
augcucugcacucuggggucagcagaguucaa

SEQ ID NO: 335650 - RNA, 22 nt, Human
augcucugccuuuuagcuucua

SEQ ID NO: 335651 - RNA, 32 nt, Human
augcucugcgucuguguuggaucaguguucuu

SEQ ID NO: 335652 - RNA, 32 nt, Human
augcucugcuucucuuuuaagcauaaguucca

SEQ ID NO: 335653 - RNA, 29 nt, Human
augcucuggcugcuguccccagcuccccg

SEQ ID NO: 335654 - RNA, 32 nt, Human
augcucuggcuucucucuugaaugcucacuaa

SEQ ID NO: 335655 - RNA, 32 nt, Human
augcucugggcucucccucucuguccauuucu

SEQ ID NO: 335656 - RNA, 32 nt, Human
augcucuggggcuucuguggccaagccccacc

SEQ ID NO: 335657 - RNA, 32 nt, Human
augcucuguaguucuuuccacaaagagcugac

SEQ ID NO: 335658 - RNA, 32 nt, Human
augcucugucugcccaggcuguguagauucug

SEQ ID NO: 335659 - RNA, 32 nt, Human
augcucugugacuugggcugauccccacccuu

SEQ ID NO: 335660 - RNA, 32 nt, Human
augcucuguggcuacauauacacacacguauu

SEQ ID NO: 335661 - RNA, 32 nt, Human
augcucuguuuccaacugcauuuccuuuccaa

SEQ ID NO: 335662 - RNA, 32 nt, Human
augcucuguuugcagugagcccuggaaaauua

SEQ ID NO: 335663 - RNA, 32 nt, Human
augcucuucagccgucccccaggauugaucca

SEQ ID NO: 335664 - RNA, 32 nt, Human
augcucuuccacccugcucgugcugcccagag

SEQ ID NO: 335665 - RNA, 32 nt, Human
augcucuugcuuguaagauaauuuuaacuuaa

SEQ ID NO: 335666 - RNA, 32 nt, Human
augcucuuguucugccgugacuguucaggugu

SEQ ID NO: 335667 - RNA, 32 nt, Human
augcugaaaaagcguuuguuuuugaaacaaau

SEQ ID NO: 335668 - RNA, 32 nt, Human
augcugaaaagcuuuccugacccaagcaaaga

SEQ ID NO: 335669 - RNA, 32 nt, Human
augcugaaacuaguuguucacaguuguuacac

SEQ ID NO: 335670 - RNA, 32 nt, Human
augcugaaggcagagcagcugagggaggggcg

SEQ ID NO: 335671 - RNA, 32 nt, Human
augcugaagggaaauguacaagagcacuacug

SEQ ID NO: 335672 - RNA, 32 nt, Human
augcugaagggaagagagguugcagcugagca

SEQ ID NO: 335673 - RNA, 32 nt, Human
augcugaagguaaacauuggagaacugauggc

SEQ ID NO: 335674 - RNA, 32 nt, Human
augcugaauaagagacgguaagagccaaggca

SEQ ID NO: 335675 - RNA, 32 nt, Human
augcugaauucuauguggcaacuugcuggacg

SEQ ID NO: 335676 - RNA, 32 nt, Human
augcugacagcuggugacagaugaagacggaa

SEQ ID NO: 335677 - RNA, 32 nt, Human
augcugacaggcaauuugcacuauauuuggcu

SEQ ID NO: 335678 - RNA, 32 nt, Human
augcugaccagaacacucuugagcccaggcau

SEQ ID NO: 335679 - RNA, 32 nt, Human
augcugaccagaacgcucuugagcccaggcau

SEQ ID NO: 335680 - RNA, 32 nt, Human
augcugagaauuuguauugaugaaccucuuuu

SEQ ID NO: 335681 - RNA, 32 nt, Human
augcugagcagcuuugaaggcugcaguccuau

SEQ ID NO: 335682 - RNA, 32 nt, Human
augcugagccagccugaaauaagacuugauaa

SEQ ID NO: 335683 - RNA, 32 nt, Human
augcugaggacuacuaaaugaagaggacuugg

SEQ ID NO: 335684 - RNA, 24 nt, Human
augcugaggagcgggggcauggua

SEQ ID NO: 335685 - RNA, 32 nt, Human
augcugaggaugacagcuuuuagccugacucu

SEQ ID NO: 335686 - RNA, 32 nt, Human
augcugaggcugcaguggugucguggguguua

SEQ ID NO: 335687 - RNA, 32 nt, Human
augcugaguaugacacuuuucuucuugcaugc

SEQ ID NO: 335688 - RNA, 32 nt, Human
augcugauagcugcuuagguucuugaguaguu

SEQ ID NO: 335689 - RNA, 32 nt, Human
augcugaucacacugcaugggagauuuuguua

SEQ ID NO: 335690 - RNA, 32 nt, Human
augcugaucucgaacuccuggccucaagugau

SEQ ID NO: 335691 - RNA, 32 nt, Human
augcugaugauaauuuaucuacaugcauuuca

SEQ ID NO: 335692 - RNA, 32 nt, Human
augcugauguaucaggccaucugugucaugcu

SEQ ID NO: 335693 - RNA, 19 nt, Human
augcugaugugcagucacc

SEQ ID NO: 335694 - RNA, 32 nt, Human
augcugauuaccuggggacaaaauuaacugua

SEQ ID NO: 335695 - RNA, 32 nt, Human
augcugauuaugcagaccgaugaguaggccuc

SEQ ID NO: 335696 - RNA, 32 nt, Human
augcugauucucucacuccucaugcagaaugu

SEQ ID NO: 335697 - RNA, 32 nt, Human
augcugauuuggccagagaugaccucaaggcc

SEQ ID NO: 335698 - RNA, 22 nt, Human
augcugcaaacacauucaccua

SEQ ID NO: 335699 - RNA, 32 nt, Human
augcugcaacucucaacauuucccuuauuugg

SEQ ID NO: 335700 - RNA, 32 nt, Human
augcugcaaguucuuucuggaccucuggcaaa

SEQ ID NO: 335701 - RNA, 32 nt, Human
augcugcaccaaaacaggaucucuccaaggca

SEQ ID NO: 335702 - RNA, 32 nt, Human
augcugcacugcacuacuccaaugucuuccau

SEQ ID NO: 335703 - RNA, 32 nt, Human
augcugcacuucugacaggcugcuuccuggau

SEQ ID NO: 335704 - RNA, 32 nt, Human
augcugcagaaccuggccucaccuggacuuuu

SEQ ID NO: 335705 - RNA, 32 nt, Human
augcugcagaacugccaccuccuggucaagug

SEQ ID NO: 335706 - RNA, 32 nt, Human
augcugcagaagagaagugaagagcacaucaa

SEQ ID NO: 335707 - RNA, 32 nt, Human
augcugcagagggagaggacaacagcuccagu

SEQ ID NO: 335708 - RNA, 32 nt, Human
augcugcagcagagugagcaagggggcccgaa

SEQ ID NO: 335709 - RNA, 32 nt, Human
augcugcagccuggaacucugaucuccagugu

SEQ ID NO: 335710 - RNA, 32 nt, Human
augcugcagcugccgggagacucacgccuuag

SEQ ID NO: 335711 - RNA, 30 nt, Human
augcugcagcuuuaaucagaaaguccaugg

SEQ ID NO: 335712 - RNA, 32 nt, Human
augcugcaggugugacuggaaggucacguuug

SEQ ID NO: 335713 - RNA, 32 nt, Human
augcugcagugagcuaugguagcaccacugca

SEQ ID NO: 335714 - RNA, 32 nt, Human
augcugcaguuguucucucaagcuagggcaga

SEQ ID NO: 335715 - RNA, 32 nt, Human
augcugcauaaaugauuuuugaugucaaagac

SEQ ID NO: 335716 - RNA, 20 nt, Human
augcugcaugacaaaauguu

SEQ ID NO: 335717 - RNA, 32 nt, Human
augcugcauuccuuuugcacuuuuggauucca

SEQ ID NO: 335718 - RNA, 32 nt, Human
augcugccaagugccauuuggggucagcaucc

SEQ ID NO: 335719 - RNA, 25 nt, Human
augcugccaccgccgccgccaccuc

SEQ ID NO: 335720 - RNA, 32 nt, Human
augcugccagaauaaaaccaccaggaaugaau

SEQ ID NO: 335721 - RNA, 32 nt, Human
augcugcccgggcccuuccuccaagacccuac

SEQ ID NO: 335722 - RNA, 32 nt, Human
augcugcccgugacccaugcagguggucuccu

SEQ ID NO: 335723 - RNA, 32 nt, Human
augcugcccuggcuugccaggauggcaggccg

SEQ ID NO: 335724 - RNA, 21 nt, Human
augcugccgccaccgccgcca

SEQ ID NO: 335725 - RNA, 25 nt, Human
augcugccgccaccgccgccaccac

SEQ ID NO: 335726 - RNA, 31 nt, Human
augcugccgcccccgucgccgccgccgccgc

SEQ ID NO: 335727 - RNA, 31 nt, Human
augcugccgccgccaccgccccggcugccau

SEQ ID NO: 335728 - RNA, 29 nt, Human
augcugccgccgccgccgcccggagcgcc

SEQ ID NO: 335729 - RNA, 29 nt, Human
augcugccgccgccgccgcgcagccccac

SEQ ID NO: 335730 - RNA, 25 nt, Human
augcugccgcuucugcugggccugc

SEQ ID NO: 335731 - RNA, 32 nt, Human
augcugccucacugcuuaagugccugcaggag

SEQ ID NO: 335732 - RNA, 32 nt, Human
augcugccuuucuacucuguucuugcugucuc

SEQ ID NO: 335733 - RNA, 25 nt, Human
augcugcgcguucugugccuccugc

SEQ ID NO: 335734 - RNA, 32 nt, Human
augcugcggcgacgggcccaggaagaggacag

SEQ ID NO: 335735 - RNA, 32 nt, Human
augcugcggggaggaaggcaagaggugccaaa

SEQ ID NO: 335736 - RNA, 32 nt, Human
augcugcuacuugccaggaacagguugggaag

SEQ ID NO: 335737 - RNA, 32 nt, Human
augcugcuaggguggaggaguaugcagagaaa

SEQ ID NO: 335738 - RNA, 32 nt, Human
augcugcuccacccucccccagacacagccca

SEQ ID NO: 335739 - RNA, 32 nt, Human
augcugcuccaggagcucuucucugcaacaag

SEQ ID NO: 335740 - RNA, 32 nt, Human
augcugcugagagugaaagaaaggaggaaagu

SEQ ID NO: 335741 - RNA, 32 nt, Human
augcugcugcacuccagccuggacaacagagu

SEQ ID NO: 335742 - RNA, 32 nt, Human
augcugcugcccaggcuggagugcaguggugc

SEQ ID NO: 335743 - RNA, 32 nt, Human
augcugcugccucugggcagucguagaaucuc

SEQ ID NO: 335744 - RNA, 32 nt, Human
augcugcugcucauguugggcuuuccuuuugg

SEQ ID NO: 335745 - RNA, 32 nt, Human
augcugcuguaaauacagguauuuuuaauuuu

SEQ ID NO: 335746 - RNA, 32 nt, Human
augcugcugugaaauuuauaaaauuagcuuuu

SEQ ID NO: 335747 - RNA, 32 nt, Human
augcugcuguggcugcucagcugccuccuuuu

SEQ ID NO: 335748 - RNA, 32 nt, Human
augcugcuucaugcaaccuuccauuccuauuc

SEQ ID NO: 335749 - RNA, 32 nt, Human
augcugcuugaccccugaaacugacauucaug

SEQ ID NO: 335750 - RNA, 32 nt, Human
augcugcuuuuccaccagacuugcuccauacu

SEQ ID NO: 335751 - RNA, 32 nt, Human
augcuggaaaggugcuccugcccacacccagc

SEQ ID NO: 335752 - RNA, 32 nt, Human
augcuggaacacaucccugccuccgggaagug

SEQ ID NO: 335753 - RNA, 32 nt, Human
augcuggaaggacgaaggugagugaagauggc

SEQ ID NO: 335754 - RNA, 32 nt, Human
augcuggagaagaaggaagggggaacccauag

SEQ ID NO: 335755 - RNA, 32 nt, Human
augcuggagacacccugguugucuccacacgu

SEQ ID NO: 335756 - RNA, 32 nt, Human
augcuggagauggcggaggcuccucacucuuu

SEQ ID NO: 335757 - RNA, 32 nt, Human
augcuggaggagaaggaaguaggccagaaguc

SEQ ID NO: 335758 - RNA, 32 nt, Human
augcuggaggcaggugacggggagcacagacu

SEQ ID NO: 335759 - RNA, 32 nt, Human
augcuggaugagcaacuccuguucuuugggcu

SEQ ID NO: 335760 - RNA, 32 nt, Human
augcuggcagaggcacucagguacuugguaag

SEQ ID NO: 335761 - RNA, 32 nt, Human
augcuggccaggacgcagaguguggccgugcu

SEQ ID NO: 335762 - RNA, 32 nt, Human
augcuggccccuggcccagcaggccugucugu

SEQ ID NO: 335763 - RNA, 32 nt, Human
augcuggcgcccaaagccuccagccugagagu

SEQ ID NO: 335764 - RNA, 32 nt, Human
augcuggcucacugcagccuccaccucccagg

SEQ ID NO: 335765 - RNA, 32 nt, Human
augcuggcucagaaaaugaaagugaacaguua

SEQ ID NO: 335766 - RNA, 22 nt, Human
augcuggcucaugccuguaauc

SEQ ID NO: 335767 - RNA, 32 nt, Human
augcuggcuggcacccucaggccuacguuccc

SEQ ID NO: 335768 - RNA, 32 nt, Human
augcuggcuggccacucucugccucaguggcc

SEQ ID NO: 335769 - RNA, 32 nt, Human
augcuggcugucuggggucugcauuuucugaa

SEQ ID NO: 335770 - RNA, 30 nt, Human
augcuggcuuccuccuugcuccugaaacag

SEQ ID NO: 335771 - RNA, 32 nt, Human
augcuggcuuggaggccgggugcaguggcuca

SEQ ID NO: 335772 - RNA, 26 nt, Human
augcugggaaaguccugcaacugugg

SEQ ID NO: 335773 - RNA, 32 nt, Human
augcugggaaggcagagauugauuaagugcau

SEQ ID NO: 335774 - RNA, 32 nt, Human
augcugggagcugucaccuccacuccuaggcu

SEQ ID NO: 335775 - RNA, 32 nt, Human
augcugggagggcugaacccccacucacacaa

SEQ ID NO: 335776 - RNA, 32 nt, Human
augcugggcaacagggaccccaucucuacaaa

SEQ ID NO: 335777 - RNA, 32 nt, Human
augcugggcagcguuuuugccauugaggguug

SEQ ID NO: 335778 - RNA, 31 nt, Human
augcugggccgaggacagggcggcaggggug

SEQ ID NO: 335779 - RNA, 32 nt, Human
augcugggcuucugcugagaccuguuccagua

SEQ ID NO: 335780 - RNA, 23 nt, Human
augcuggggaaccaaaaugguga

SEQ ID NO: 335781 - RNA, 32 nt, Human
augcuggggacgcagaggugacccagagacau

SEQ ID NO: 335782 - RNA, 32 nt, Human
augcuggggcccagagagguuaagugucuugc

SEQ ID NO: 335783 - RNA, 32 nt, Human
augcuggguucugcacagcuggccucccgcgg

SEQ ID NO: 335784 - RNA, 32 nt, Human
augcugguacuuccagcucccuuccaccugca

SEQ ID NO: 335785 - RNA, 32 nt, Human
augcugguauguuuuaagcuacucuaugaagu

SEQ ID NO: 335786 - RNA, 32 nt, Human
augcuggucucaaacuccugaccucgugugau

SEQ ID NO: 335787 - RNA, 32 nt, Human
augcuggucucaaacuccugggcucaagcaau

SEQ ID NO: 335788 - RNA, 32 nt, Human
augcuggucucgaacuccugaccucagaugau

SEQ ID NO: 335789 - RNA, 32 nt, Human
augcuggucucgaacuccugaccucagguguu

SEQ ID NO: 335790 - RNA, 32 nt, Human
augcuggucucgaacuccugggcucaagcgau

SEQ ID NO: 335791 - RNA, 32 nt, Human
augcuggugagguuguggagaaaaaggaaugc

SEQ ID NO: 335792 - RNA, 32 nt, Human
augcuggugcagcguaaggacgaacuccucca

SEQ ID NO: 335793 - RNA, 21 nt, Human
augcugguggccucacccauc

SEQ ID NO: 335794 - RNA, 24 nt, Human
augcugguguaccccagcaguucu

SEQ ID NO: 335795 - RNA, 32 nt, Human
augcugguguccaccuccugaccucaguugau

SEQ ID NO: 335796 - RNA, 23 nt, Human
augcugguuccaacuguuuaauc

SEQ ID NO: 335797 - RNA, 23 nt, Human
augcugguucugacucuacccca

SEQ ID NO: 335798 - RNA, 32 nt, Human
augcugguuuuccacugccugacaguuaccac

SEQ ID NO: 335799 - RNA, 32 nt, Human
augcuguaacccaguaccuacaaaaucagcuc

SEQ ID NO: 335800 - RNA, 32 nt, Human
augcuguacagguuuguagccuaggagcaaua

SEQ ID NO: 335801 - RNA, 32 nt, Human
augcuguacuauuuaauuauccuuccagcguu

SEQ ID NO: 335802 - RNA, 32 nt, Human
augcuguacuccaauuuucuuugcaaggccuu

SEQ ID NO: 335803 - RNA, 32 nt, Human
augcuguacuccugaaaauuuuucccacaagg

SEQ ID NO: 335804 - RNA, 32 nt, Human
augcuguagacagaagaaauaaaauacucaac

SEQ ID NO: 335805 - RNA, 32 nt, Human
augcuguagaccuaguuucacacacaucugug

SEQ ID NO: 335806 - RNA, 31 nt, Human
augcuguaguaacugccucaguguuucacgu

SEQ ID NO: 335807 - RNA, 32 nt, Human
augcugucaaagggauaaggaaauagcaagau

SEQ ID NO: 335808 - RNA, 32 nt, Human
augcugucacugggugcugugagauuucgauu

SEQ ID NO: 335809 - RNA, 32 nt, Human
augcugucuauccucucuucucuccuugcagg

SEQ ID NO: 335810 - RNA, 32 nt, Human
augcugucuauucacuucauagucauuaagga

SEQ ID NO: 335811 - RNA, 32 nt, Human
augcugucugcagcucagucccugccagcccc

SEQ ID NO: 335812 - RNA, 21 nt, Human
augcugucugccgacugcucu

SEQ ID NO: 335813 - RNA, 32 nt, Human
augcugucuguuaaauaaaaugccauucugca

SEQ ID NO: 335814 - RNA, 32 nt, Human
augcugucuugacaucucuugccuuguccucc

SEQ ID NO: 335815 - RNA, 32 nt, Human
augcugugaauuacucuuccuccccuucucug

SEQ ID NO: 335816 - RNA, 32 nt, Human
augcugugagaaaucucucuuguugcuguccu

SEQ ID NO: 335817 - RNA, 32 nt, Human
augcugugagagaagcauuggggcacaaauag

SEQ ID NO: 335818 - RNA, 32 nt, Human
augcugugaugccugugacuccuucaucccgc

SEQ ID NO: 335819 - RNA, 32 nt, Human
augcugugcaggagugaaaacacggauccaag

SEQ ID NO: 335820 - RNA, 32 nt, Human
augcugugcaguucaaccaucuggaggugguc

SEQ ID NO: 335821 - RNA, 32 nt, Human
augcugugcugccuacagccuggacagggucu

SEQ ID NO: 335822 - RNA, 32 nt, Human
augcugugcuuccucuggaggccugggcugag

SEQ ID NO: 335823 - RNA, 32 nt, Human
augcuguggaaaugaacggggagcagcagcuu

SEQ ID NO: 335824 - RNA, 32 nt, Human
augcuguggagaaagggaagagcugcaugugu

SEQ ID NO: 335825 - RNA, 32 nt, Human
augcuguguaucaugacacuaucuucgucugu

SEQ ID NO: 335826 - RNA, 24 nt, Human
augcuguguauuggguguaaggua

SEQ ID NO: 335827 - RNA, 32 nt, Human
augcuguguuccauacagccuuggacuagcaa

SEQ ID NO: 335828 - RNA, 32 nt, Human
augcuguguuccuuuuauaaaaggacauuugc

SEQ ID NO: 335829 - RNA, 32 nt, Human
augcuguuacccaagguuaggguguugaagga

SEQ ID NO: 335830 - RNA, 32 nt, Human
augcuguuacuuggccauuucuucccaucucc

SEQ ID NO: 335831 - RNA, 32 nt, Human
augcuguucuucagugcugaaauccacgccag

SEQ ID NO: 335832 - RNA, 32 nt, Human
augcuguugagggcccuggagaaacuucagca

SEQ ID NO: 335833 - RNA, 32 nt, Human
augcuguugcccaggcuggagugcaguggugc

SEQ ID NO: 335834 - RNA, 32 nt, Human
augcuguugcccaggcuggagugcaguguccc

SEQ ID NO: 335835 - RNA, 32 nt, Human
augcuguuucaggcuuaaacaucacagcagau

SEQ ID NO: 335836 - RNA, 32 nt, Human
augcuguuucuagucaucaucauguuuacuuu

SEQ ID NO: 335837 - RNA, 32 nt, Human
augcuguuucuguuggugcuagcuacuggggc

SEQ ID NO: 335838 - RNA, 17 nt, Human
augcuguuuuauucaaa

SEQ ID NO: 335839 - RNA, 32 nt, Human
augcuuaacagcuguuuccuguuucucuuaaa

SEQ ID NO: 335840 - RNA, 32 nt, Human
augcuuaacauacuaaccuuacauacacucua

SEQ ID NO: 335841 - RNA, 32 nt, Human
augcuuaacuuaggaagagauaaggcaagagc

SEQ ID NO: 335842 - RNA, 32 nt, Human
augcuuaacuucacaaguuaacuuuuucuuau

SEQ ID NO: 335843 - RNA, 32 nt, Human
augcuuaagaacauaguugcaguuuuuguucu

SEQ ID NO: 335844 - RNA, 31 nt, Human
augcuuaaggcucucaaaacagcagaacaau

SEQ ID NO: 335845 - RNA, 32 nt, Human
augcuuacagagguagauugcauuuugucaau

SEQ ID NO: 335846 - RNA, 32 nt, Human
augcuuaccuucugcuguuuguuccaggcuca

SEQ ID NO: 335847 - RNA, 32 nt, Human
augcuuacugugugcuucucauccccugguug

SEQ ID NO: 335848 - RNA, 32 nt, Human
augcuuaggauucaugcugagauaucaauugg

SEQ ID NO: 335849 - RNA, 32 nt, Human
augcuuagggaagguugauaccagcuucaguc

SEQ ID NO: 335850 - RNA, 32 nt, Human
augcuuauccuuucaucugugugauuguuuuu

SEQ ID NO: 335851 - RNA, 32 nt, Human
augcuuaugcccaaggagaguucuggaggguu

SEQ ID NO: 335852 - RNA, 32 nt, Human
augcuuaugcuacucaggaggcugagguggga

SEQ ID NO: 335853 - RNA, 32 nt, Human
augcuuauguagugccuucuguuguccuacau

SEQ ID NO: 335854 - RNA, 32 nt, Human
augcuuauugcccuccagucugggcaacaaaa

SEQ ID NO: 335855 - RNA, 32 nt, Human
augcuuauuuguuuuaaaaccuguaucaucaa

SEQ ID NO: 335856 - RNA, 32 nt, Human
augcuuauuuuagaauccuccccuuuuugagg

SEQ ID NO: 335857 - RNA, 32 nt, Human
augcuucaagaguuccagcuggccugcuguga

SEQ ID NO: 335858 - RNA, 32 nt, Human
augcuucaauaguucaaggaacuugaaaaaua

SEQ ID NO: 335859 - RNA, 19 nt, Human
augcuucagaaacaccuca

SEQ ID NO: 335860 - RNA, 32 nt, Human
augcuucagaccacccucccuucuucacagac

SEQ ID NO: 335861 - RNA, 32 nt, Human
augcuucagccugucuggccuucuuaucauau

SEQ ID NO: 335862 - RNA, 32 nt, Human
augcuucauggggcuccaggaagccuguauca

SEQ ID NO: 335863 - RNA, 32 nt, Human
augcuucauggucacacauacaggcacaaaaa

SEQ ID NO: 335864 - RNA, 32 nt, Human
augcuucaugucccuccaagauuugagaucaa

SEQ ID NO: 335865 - RNA, 32 nt, Human
augcuucauucugccaugugggauugcugcag

SEQ ID NO: 335866 - RNA, 32 nt, Human
augcuuccagucacaaaaaugcagcccagcuc

SEQ ID NO: 335867 - RNA, 32 nt, Human
augcuuccccuggguguguccucccuugguuu

SEQ ID NO: 335868 - RNA, 32 nt, Human
augcuucccgccagucaagauggucuguggac

SEQ ID NO: 335869 - RNA, 32 nt, Human
augcuucccuccacuguuuauguacucaugua

SEQ ID NO: 335870 - RNA, 32 nt, Human
augcuuccugcccuugaacaucagacuccaag

SEQ ID NO: 335871 - RNA, 32 nt, Human
augcuuccugcccuugaacaucagacuccagg

SEQ ID NO: 335872 - RNA, 32 nt, Human
augcuuccuggguggaguguugaguuggaacc

SEQ ID NO: 335873 - RNA, 32 nt, Human
augcuucuagguuacuuuuucucuuuaagcaa

SEQ ID NO: 335874 - RNA, 32 nt, Human
augcuucuauucuaucaucuaaaacaaaucau

SEQ ID NO: 335875 - RNA, 32 nt, Human
augcuucucccccauucccacccucucugccc

SEQ ID NO: 335876 - RNA, 32 nt, Human
augcuucucugaguucugcuacaaccucuaga

SEQ ID NO: 335877 - RNA, 32 nt, Human
augcuucucugauucccucuucugccugcacc

SEQ ID NO: 335878 - RNA, 32 nt, Human
augcuucugaagcugcucaccuggccgaggga

SEQ ID NO: 335879 - RNA, 32 nt, Human
augcuucugcucacagccuuguggucagaaca

SEQ ID NO: 335880 - RNA, 32 nt, Human
augcuucugcucucccugcucuggcauccugc

SEQ ID NO: 335881 - RNA, 32 nt, Human
augcuucugucuccacucggcuuucccaaaag

SEQ ID NO: 335882 - RNA, 32 nt, Human
augcuucuguguauauaaaggccuuuauuuau

SEQ ID NO: 335883 - RNA, 32 nt, Human
augcuucuuccuccucagaccuggcaugcccu

SEQ ID NO: 335884 - RNA, 32 nt, Human
augcuugaaauaugcacuuagcacuuugguuc

SEQ ID NO: 335885 - RNA, 32 nt, Human
augcuugaaauuuaacacuuuucacuugguuc

SEQ ID NO: 335886 - RNA, 25 nt, Human
augcuugaaccccaggcuucagacu

SEQ ID NO: 335887 - RNA, 32 nt, Human
augcuugaccauuccuuucuucauaacaaaaa

SEQ ID NO: 335888 - RNA, 32 nt, Human
augcuugaccucuauguccagggaguccuuca

SEQ ID NO: 335889 - RNA, 32 nt, Human
augcuugaguuuucugcuucugugccaaaaug

SEQ ID NO: 335890 - RNA, 32 nt, Human
augcuugcacacaugcacacacagugaauguu

SEQ ID NO: 335891 - RNA, 32 nt, Human
augcuugcagucaggagagggcaggggauaga

SEQ ID NO: 335892 - RNA, 32 nt, Human
augcuugcauuuucuugccugauuucccuggg

SEQ ID NO: 335893 - RNA, 32 nt, Human
augcuugccaugaccaaguggcagucaccauu

SEQ ID NO: 335894 - RNA, 32 nt, Human
augcuugcuaagugccuucagcugaaugugaa

SEQ ID NO: 335895 - RNA, 32 nt, Human
augcuugcugggugcugagugcagggggugcc

SEQ ID NO: 335896 - RNA, 32 nt, Human
augcuuggacucuucucccaaaucugaugaau

SEQ ID NO: 335897 - RNA, 32 nt, Human
augcuuggauguaaaacugaacuucagagcau

SEQ ID NO: 335898 - RNA, 32 nt, Human
augcuuggccuggacaaugcuggaaagacaac

SEQ ID NO: 335899 - RNA, 32 nt, Human
augcuugggaggcgcaggaugguacuggcaca

SEQ ID NO: 335900 - RNA, 32 nt, Human
augcuugggaggucgaggcugcagugagucau

SEQ ID NO: 335901 - RNA, 32 nt, Human
augcuugggguaggguggaguggggagggauu

SEQ ID NO: 335902 - RNA, 31 nt, Human
augcuugguguggggaucugggugaaggggg

SEQ ID NO: 335903 - RNA, 32 nt, Human
augcuugucauccaagcuggaguacagugcca

SEQ ID NO: 335904 - RNA, 32 nt, Human
augcuugugcagguagcuaugagcagggagcu

SEQ ID NO: 335905 - RNA, 32 nt, Human
augcuuguucugaaaguaagaucagugaacug

SEQ ID NO: 335906 - RNA, 32 nt, Human
augcuuguugaugccgucuaaggaaccaaugu

SEQ ID NO: 335907 - RNA, 32 nt, Human
augcuuguugccgaaacuguuuauggccuucu

SEQ ID NO: 335908 - RNA, 32 nt, Human
augcuuuacuccuguauuguuauuuuguucau

SEQ ID NO: 335909 - RNA, 32 nt, Human
augcuuucaugccaaguaaauggucuugccag

SEQ ID NO: 335910 - RNA, 32 nt, Human
augcuuuccacauuucuuucuccauucuguuc

SEQ ID NO: 335911 - RNA, 32 nt, Human
augcuuucucccaccgugagggauaugcaaac

SEQ ID NO: 335912 - RNA, 32 nt, Human
augcuuugaaauugaaccuuugugcccuauca

SEQ ID NO: 335913 - RNA, 32 nt, Human
augcuuugcauccuucaauccaaucaaguuga

SEQ ID NO: 335914 - RNA, 32 nt, Human
augcuuugggcagcuuuugaggaacagcaggg

SEQ ID NO: 335915 - RNA, 32 nt, Human
augcuuuguaaggcauaaagugcaauacuagc

SEQ ID NO: 335916 - RNA, 32 nt, Human
augcuuuuaaccaauucucaaaucuuacuaaa

SEQ ID NO: 335917 - RNA, 32 nt, Human
augcuuuuagagacagggucucacuguguugc

SEQ ID NO: 335918 - RNA, 32 nt, Human
augcuuuuauagaccaugcuaaugcuagacca

SEQ ID NO: 335919 - RNA, 32 nt, Human
augcuuuuauucaagacaccaaauuccaaacu

SEQ ID NO: 335920 - RNA, 32 nt, Human
augcuuuuccuuccuuucccuucccugccuuc

SEQ ID NO: 335921 - RNA, 32 nt, Human
augcuuuucuucuaucagugaaaaugucauca

SEQ ID NO: 335922 - RNA, 32 nt, Human
augcuuuugcagaaauguguucauagaugaug

SEQ ID NO: 335923 - RNA, 32 nt, Human
augcuuuugccacuuuggcuucuccugugacc

SEQ ID NO: 335924 - RNA, 32 nt, Human
augcuuuugccuucccuucccuucccauccgc

SEQ ID NO: 335925 - RNA, 22 nt, Human
auggaaaaaucucaugcugcuc

SEQ ID NO: 335926 - RNA, 32 nt, Human
auggaaaaauuuuaggaaauguauuuauuagg

SEQ ID NO: 335927 - RNA, 32 nt, Human
auggaaaacaaauauaucacacagacaacagc

SEQ ID NO: 335928 - RNA, 32 nt, Human
auggaaaacucuuuccagucuggggaugacac

SEQ ID NO: 335929 - RNA, 32 nt, Human
auggaaaagauggggaagagcaaaauacaugg

SEQ ID NO: 335930 - RNA, 24 nt, Human
auggaaaagccugcaugccuguuc

SEQ ID NO: 335931 - RNA, 32 nt, Human
auggaaaaguuaaagacucagucucugagaaa

SEQ ID NO: 335932 - RNA, 22 nt, Human
auggaaaauaccuaauugugga

SEQ ID NO: 335933 - RNA, 22 nt, Human
auggaaaauaguaaacacggga

SEQ ID NO: 335934 - RNA, 32 nt, Human
auggaaaauauauguguagaaguauuucuucu

SEQ ID NO: 335935 - RNA, 21 nt, Human
auggaaaaugcagggugugga

SEQ ID NO: 335936 - RNA, 25 nt, Human
auggaaaauuaccucacaucuguuu

SEQ ID NO: 335937 - RNA, 20 nt, Human
auggaaaauucccaugagag

SEQ ID NO: 335938 - RNA, 23 nt, Human
auggaaaauucuagggacaggag

SEQ ID NO: 335939 - RNA, 32 nt, Human
auggaaacacaaauuucauggagcuguguacc

SEQ ID NO: 335940 - RNA, 32 nt, Human
auggaaacagcaacuuguacaguggcugagaa

SEQ ID NO: 335941 - RNA, 32 nt, Human
auggaaaccaugauuauaacaagaccacaugg

SEQ ID NO: 335942 - RNA, 32 nt, Human
auggaaacccauagguccacacacagguggug

SEQ ID NO: 335943 - RNA, 32 nt, Human
auggaaacucaggaggugccgugagucccaug

SEQ ID NO: 335944 - RNA, 32 nt, Human
auggaaacugagaugcuggcacuuuggcccug

SEQ ID NO: 335945 - RNA, 22 nt, Human
auggaaacugcagcaucuccug

SEQ ID NO: 335946 - RNA, 24 nt, Human
auggaaacugcccugacucuugaa

SEQ ID NO: 335947 - RNA, 32 nt, Human
auggaaagaaaauauuuuugucgauucuuauu

SEQ ID NO: 335948 - RNA, 32 nt, Human
auggaaagcacuuggaacaaugccugguuguu

SEQ ID NO: 335949 - RNA, 32 nt, Human
auggaaagccauuugaggguuuugaacaggga

SEQ ID NO: 335950 - RNA, 32 nt, Human
auggaaaggaaggcuucuaauuagaaaacaca

SEQ ID NO: 335951 - RNA, 32 nt, Human
auggaaaggagccaccuccaccccuuuccgga

SEQ ID NO: 335952 - RNA, 31 nt, Human
auggaaagggagacuguuucagaggacuuga

SEQ ID NO: 335953 - RNA, 32 nt, Human
auggaaagggucucacccugucacucaggcug

SEQ ID NO: 335954 - RNA, 24 nt, Human
auggaaaguugcuuaaauugugga

SEQ ID NO: 335955 - RNA, 32 nt, Human
auggaaauaauuaaauaaaauaguccaucuaa

SEQ ID NO: 335956 - RNA, 32 nt, Human
auggaaaucagaaaaucccaucacuccagcag

SEQ ID NO: 335957 - RNA, 18 nt, Human
auggaaauccagagcaag

SEQ ID NO: 335958 - RNA, 32 nt, Human
auggaaaucccagcuaugcagcacuagcaggu

SEQ ID NO: 335959 - RNA, 32 nt, Human
auggaaaugagguugggcucuauccuccacgg

SEQ ID NO: 335960 - RNA, 32 nt, Human
auggaaaugccaccgugucugcucccaggccu

SEQ ID NO: 335961 - RNA, 32 nt, Human
auggaaaugccacgucugcucuucagugaaga

SEQ ID NO: 335962 - RNA, 24 nt, Human
auggaaauggaauuuaaucuguuu

SEQ ID NO: 335963 - RNA, 32 nt, Human
auggaacaaacaaugaaaguggggugagugcc

SEQ ID NO: 335964 - RNA, 32 nt, Human
auggaacaaauacuaaggucccagggugggag

SEQ ID NO: 335965 - RNA, 32 nt, Human
auggaacacaugcuccuugcuaaccacacgga

SEQ ID NO: 335966 - RNA, 32 nt, Human
auggaacacguaugucaccuccuccugaggau

SEQ ID NO: 335967 - RNA, 32 nt, Human
auggaacagagggugagagaggcaguggccgu

SEQ ID NO: 335968 - RNA, 32 nt, Human
auggaacagcacaagaaagaccugcccccaua

SEQ ID NO: 335969 - RNA, 32 nt, Human
auggaacagcugguauaacauaaguuguuggc

SEQ ID NO: 335970 - RNA, 32 nt, Human
auggaacaggaaacuagagugcauuuaaaaua

SEQ ID NO: 335971 - RNA, 32 nt, Human
auggaacaggugguaggagagccccagggaga

SEQ ID NO: 335972 - RNA, 32 nt, Human
auggaacagucucagaguacugaagaucaaag

SEQ ID NO: 335973 - RNA, 32 nt, Human
auggaacauaucuuuaaccaaauguuuggcau

SEQ ID NO: 335974 - RNA, 32 nt, Human
auggaacauugugagaauggccagucuggaaa

SEQ ID NO: 335975 - RNA, 32 nt, Human
auggaacauuuccugaacauuuacgggcuaug

SEQ ID NO: 335976 - RNA, 32 nt, Human
auggaacccacacccauagcucuccccacagc

SEQ ID NO: 335977 - RNA, 32 nt, Human
auggaacccacuguaccaggcccaggccucag

SEQ ID NO: 335978 - RNA, 32 nt, Human
auggaacccacuguuuggccagcacagggcau

SEQ ID NO: 335979 - RNA, 32 nt, Human
auggaacccugggaacugcccucccccuuagc

SEQ ID NO: 335980 - RNA, 32 nt, Human
auggaaccugcuguguucuguccucuuccagc

SEQ ID NO: 335981 - RNA, 32 nt, Human
auggaaccugggaacagaagccucaaccccca

SEQ ID NO: 335982 - RNA, 32 nt, Human
auggaacucaggaggcggaggcugcagucaac

SEQ ID NO: 335983 - RNA, 32 nt, Human
auggaacuccacccuuucuuguuuuaaguaug

SEQ ID NO: 335984 - RNA, 32 nt, Human
auggaacucuccagagcccuccuugaaaguuu

SEQ ID NO: 335985 - RNA, 32 nt, Human
auggaacugaggugaaauugugcuccaugauu

SEQ ID NO: 335986 - RNA, 32 nt, Human
auggaacugcagacagaaagcacuccaugcga

SEQ ID NO: 335987 - RNA, 32 nt, Human
auggaacuuccucucuguaucucaggucagua

SEQ ID NO: 335988 - RNA, 32 nt, Human
auggaagaaaugcccaagacggcaggcagcag

SEQ ID NO: 335989 - RNA, 32 nt, Human
auggaagaaggcacgugagcagaggaggcagc

SEQ ID NO: 335990 - RNA, 32 nt, Human
auggaagacagaggagaagaagaugauucuuu

SEQ ID NO: 335991 - RNA, 32 nt, Human
auggaagacaucaccuuggcuuccuggcuguc

SEQ ID NO: 335992 - RNA, 32 nt, Human
auggaagagaaaagacagggugggagggagga

SEQ ID NO: 335993 - RNA, 32 nt, Human
auggaagagcccccuccagaccacucuacagc

SEQ ID NO: 335994 - RNA, 32 nt, Human
auggaagaggaggaggaggaggagcuggagga

SEQ ID NO: 335995 - RNA, 32 nt, Human
auggaagaguccagcagcugaaaggacauuug

SEQ ID NO: 335996 - RNA, 32 nt, Human
auggaagaguuuugucaacacaacacuuuguc

SEQ ID NO: 335997 - RNA, 32 nt, Human
auggaagaucaagagagcucgcuuugcaagaa

SEQ ID NO: 335998 - RNA, 32 nt, Human
auggaagcaaagugcuggauuguccuuggagg

SEQ ID NO: 335999 - RNA, 32 nt, Human
auggaagcaaggcaccuguugaaggaaaaaga

SEQ ID NO: 336000 - RNA, 32 nt, Human
auggaagcauccaggagggaggcuguacccug

SEQ ID NO: 336001 - RNA, 32 nt, Human
auggaagcauuuucaccgcccugggguuuuaa

SEQ ID NO: 336002 - RNA, 32 nt, Human
auggaagccguaagugcuucuuugucaucgac

SEQ ID NO: 336003 - RNA, 28 nt, Human
auggaagcugaggcugccucuuccuagc

SEQ ID NO: 336004 - RNA, 25 nt, Human
auggaagcuguugccaaguuugauu

SEQ ID NO: 336005 - RNA, 32 nt, Human
auggaagcuuagaaaagccuggagucuguggg

SEQ ID NO: 336006 - RNA, 32 nt, Human
auggaagcuucccaucagucucccagcugaau

SEQ ID NO: 336007 - RNA, 32 nt, Human
auggaagcuuuuugagggcagguccuugucuu

SEQ ID NO: 336008 - RNA, 32 nt, Human
auggaaggaauuggaacugaaagggaaaggaa

SEQ ID NO: 336009 - RNA, 32 nt, Human
auggaaggacaggcagcacgggagccaggcgc

SEQ ID NO: 336010 - RNA, 22 nt, Human
auggaaggagggagccaagaag

SEQ ID NO: 336011 - RNA, 25 nt, Human
auggaaggcacgcagucgugccugc

SEQ ID NO: 336012 - RNA, 32 nt, Human
auggaaggcggcgcagaggcagcugugugggc

SEQ ID NO: 336013 - RNA, 32 nt, Human
auggaaggcgggaaugaaugggccucugaugg

SEQ ID NO: 336014 - RNA, 25 nt, Human
auggaaggcguggugggauuugcuc

SEQ ID NO: 336015 - RNA, 32 nt, Human
auggaaggcuccugccugggcccugcucacag

SEQ ID NO: 336016 - RNA, 22 nt, Human
auggaagggacgguacccgcuu

SEQ ID NO: 336017 - RNA, 32 nt, Human
auggaagggagagcugggcauggcgguucaug

SEQ ID NO: 336018 - RNA, 20 nt, Human
auggaagggaggcauuugcu

SEQ ID NO: 336019 - RNA, 32 nt, Human
auggaagucaggaggaagggaagaugugagug

SEQ ID NO: 336020 - RNA, 32 nt, Human
auggaagugacucaacaaagagccaaagugga

SEQ ID NO: 336021 - RNA, 25 nt, Human
auggaagugcaguuagggcugggaa

SEQ ID NO: 336022 - RNA, 32 nt, Human
auggaagugguacauaacauugccaaaauaau

SEQ ID NO: 336023 - RNA, 32 nt, Human
auggaaguucaacccgccccuaccucuucaga

SEQ ID NO: 336024 - RNA, 32 nt, Human
auggaaguuuggguguuuaccaacaagguacc

SEQ ID NO: 336025 - RNA, 32 nt, Human
auggaauaagaaguauaccuccuucuacaugu

SEQ ID NO: 336026 - RNA, 32 nt, Human
auggaauaagcauaacaucuguccuaaucuaa

SEQ ID NO: 336027 - RNA, 32 nt, Human
auggaauacuauucagccacaaaaaggaacaa

SEQ ID NO: 336028 - RNA, 32 nt, Human
auggaauacuguugaaccuauagcguugucuu

SEQ ID NO: 336029 - RNA, 25 nt, Human
auggaaucaaacacaauuuuuuaaa

SEQ ID NO: 336030 - RNA, 32 nt, Human
auggaaucacagacuuguuuugagccagucac

SEQ ID NO: 336031 - RNA, 32 nt, Human
auggaaucacugcaaaucuaucugcucuucag

SEQ ID NO: 336032 - RNA, 32 nt, Human
auggaaucugaaggggcucugcagggaggagu

SEQ ID NO: 336033 - RNA, 32 nt, Human
auggaaugaucauuuuguguacauacagguua

SEQ ID NO: 336034 - RNA, 32 nt, Human
auggaaugccuagugcuaagugcaguguccuu

SEQ ID NO: 336035 - RNA, 32 nt, Human
auggaaugcuccacggagcuccaggcuuacua

SEQ ID NO: 336036 - RNA, 32 nt, Human
auggaaugcuugcagagcaugaccugaggagg

SEQ ID NO: 336037 - RNA, 30 nt, Human
auggaaugggcagaggagauggauuugauu

SEQ ID NO: 336038 - RNA, 32 nt, Human
auggaaugggggaagaggaggagcaggaggcc

SEQ ID NO: 336039 - RNA, 32 nt, Human
auggaaugucaguugagugcaggugcagcagg

SEQ ID NO: 336040 - RNA, 25 nt, Human
auggaauucaaacuuaugccugcuc

SEQ ID NO: 336041 - RNA, 32 nt, Human
auggaauucaagaacagacucuggagugucca

SEQ ID NO: 336042 - RNA, 32 nt, Human
auggaauucuaaaguuuuaauuucauuuugga

SEQ ID NO: 336043 - RNA, 32 nt, Human
auggaauugcccagccagucacagcaguagcu

SEQ ID NO: 336044 - RNA, 32 nt, Human
auggaauuguguugugccuuacuucagaggug

SEQ ID NO: 336045 - RNA, 32 nt, Human
auggaauuuuuccagccucauccuggccugcc

SEQ ID NO: 336046 - RNA, 32 nt, Human
auggacaaaaugucucuuagaccuguucuggc

SEQ ID NO: 336047 - RNA, 32 nt, Human
auggacaaauuaacagcauucugcacuuggaa

SEQ ID NO: 336048 - RNA, 32 nt, Human
auggacaacauacucugcaguagcaugaagaa

SEQ ID NO: 336049 - RNA, 32 nt, Human
auggacaacuggaggguaaacaagguggagag

SEQ ID NO: 336050 - RNA, 19 nt, Human
auggacaaggcgucuccug

SEQ ID NO: 336051 - RNA, 32 nt, Human
auggacaaggcugguuauuagaacaaagauuu

SEQ ID NO: 336052 - RNA, 32 nt, Human
auggacaauagcugagaaggggagccaugaaa

SEQ ID NO: 336053 - RNA, 32 nt, Human
auggacaaucaagcaugccucugugaugaagu

SEQ ID NO: 336054 - RNA, 32 nt, Human
auggacacaagaauugacucuaacuccauguc

SEQ ID NO: 336055 - RNA, 20 nt, Human
auggacacaagaugcucuug

SEQ ID NO: 336056 - RNA, 32 nt, Human
auggacacacaaaaacacaugcacccaauuau

SEQ ID NO: 336057 - RNA, 32 nt, Human
auggacacacaaccccagcggcagcaggaaaa

SEQ ID NO: 336058 - RNA, 32 nt, Human
auggacacacaauggauggacacauuauaucu

SEQ ID NO: 336059 - RNA, 24 nt, Human
auggacacacacuuugcaauacca

SEQ ID NO: 336060 - RNA, 32 nt, Human
auggacacacagagccucggcggccacugcug

SEQ ID NO: 336061 - RNA, 32 nt, Human
auggacacacagauggcuccggcuagccgccu

SEQ ID NO: 336062 - RNA, 32 nt, Human
auggacacaccaacgagguacugagugucggc

SEQ ID NO: 336063 - RNA, 32 nt, Human
auggacacagauucucaugccauuccagauuu

SEQ ID NO: 336064 - RNA, 22 nt, Human
auggacacagggaucuucugaa

SEQ ID NO: 336065 - RNA, 20 nt, Human
auggacaccaccggacacca

SEQ ID NO: 336066 - RNA, 16 nt, Human
auggacacccaaccac

SEQ ID NO: 336067 - RNA, 32 nt, Human
auggacaccugccucagacugggccagucaca

SEQ ID NO: 336068 - RNA, 32 nt, Human
auggacaccugcucaccccugccucaucugua

SEQ ID NO: 336069 - RNA, 22 nt, Human
auggacacuacaggcccuggaa

SEQ ID NO: 336070 - RNA, 32 nt, Human
auggacacucaggcacagaguggcccucagga

SEQ ID NO: 336071 - RNA, 32 nt, Human
auggacacugccugucguucugucacuguuaa

SEQ ID NO: 336072 - RNA, 20 nt, Human
auggacacuuguauuuccua

SEQ ID NO: 336073 - RNA, 21 nt, Human
auggacacuuugcguuucuua

SEQ ID NO: 336074 - RNA, 32 nt, Human
auggacagacagaaggggaggaagagaggccu

SEQ ID NO: 336075 - RNA, 32 nt, Human
auggacagacaggccauggaggcagcacugag

SEQ ID NO: 336076 - RNA, 22 nt, Human
auggacagacaguaaucuccug

SEQ ID NO: 336077 - RNA, 24 nt, Human
auggacagagccuuuuucuaaaga

SEQ ID NO: 336078 - RNA, 32 nt, Human
auggacagagggccgugaggggucccccugcu

SEQ ID NO: 336079 - RNA, 32 nt, Human
auggacagaucuuccucagaggaggccucagc

SEQ ID NO: 336080 - RNA, 32 nt, Human
auggacagcuugguuaccuccaccuuccugca

SEQ ID NO: 336081 - RNA, 32 nt, Human
auggacaggaaggggcagagugagucacggcc

SEQ ID NO: 336082 - RNA, 32 nt, Human
auggacaggagccuugagcuggcgugugggaa

SEQ ID NO: 336083 - RNA, 32 nt, Human
auggacaggcgcugcagccugcagagaccuca

SEQ ID NO: 336084 - RNA, 22 nt, Human
auggacagggcugucucugaag

SEQ ID NO: 336085 - RNA, 32 nt, Human
auggacagguaggaaggaaggaaaggaggaaa

SEQ ID NO: 336086 - RNA, 24 nt, Human
auggacagucuagagacucuggag

SEQ ID NO: 336087 - RNA, 32 nt, Human
auggacagugaucauuagaaacugaauuuugu

SEQ ID NO: 336088 - RNA, 32 nt, Human
auggacaguuccaagcccugauccuggcagac

SEQ ID NO: 336089 - RNA, 23 nt, Human
auggacaucauguuuucugguga

SEQ ID NO: 336090 - RNA, 32 nt, Human
auggacaucuacaaggagacuggugaauaaug

SEQ ID NO: 336091 - RNA, 32 nt, Human
auggacaugccuuugugaaaccaggaaguauu

SEQ ID NO: 336092 - RNA, 32 nt, Human
auggacaugguagaggauguggauacuuugca

SEQ ID NO: 336093 - RNA, 32 nt, Human
auggacauguacaaauuugaacucaaaccauc

SEQ ID NO: 336094 - RNA, 32 nt, Human
auggacaugucaguuauugcucugucuaaaca

SEQ ID NO: 336095 - RNA, 32 nt, Human
auggaccaaacagcucuggccuagggauuggg

SEQ ID NO: 336096 - RNA, 32 nt, Human
auggaccaacucagugcuucaggucuuaaugc

SEQ ID NO: 336097 - RNA, 32 nt, Human
auggaccaaucaggaggaaguggguggggcca

SEQ ID NO: 336098 - RNA, 32 nt, Human
auggaccacuuccaaaacagagacgggggcag

SEQ ID NO: 336099 - RNA, 32 nt, Human
auggaccacuugaggucaggaguuugagacca

SEQ ID NO: 336100 - RNA, 32 nt, Human
auggaccagcugcccggaccuccuaguccaga

SEQ ID NO: 336101 - RNA, 32 nt, Human
auggaccauccaggucucgccugcugcagggc

SEQ ID NO: 336102 - RNA, 32 nt, Human
auggaccauguaacaaauaccucagcaggccc

SEQ ID NO: 336103 - RNA, 32 nt, Human
auggaccauugugccaguugccaaucacuaau

SEQ ID NO: 336104 - RNA, 32 nt, Human
auggacccaagugcccuggaggcucugaucaa

SEQ ID NO: 336105 - RNA, 32 nt, Human
auggacccaggcugucauuccaggaagaacug

SEQ ID NO: 336106 - RNA, 32 nt, Human
auggacccauuccaauucaauaccuuucuagu

SEQ ID NO: 336107 - RNA, 32 nt, Human
auggacccgagagcuucacagcugccugcugu

SEQ ID NO: 336108 - RNA, 32 nt, Human
auggacccugagcaaggaaggagggagggagg

SEQ ID NO: 336109 - RNA, 32 nt, Human
auggacccugccaaccuggccugggugugcag

SEQ ID NO: 336110 - RNA, 32 nt, Human
auggacccuggagggaaucuccccagccgacu

SEQ ID NO: 336111 - RNA, 19 nt, Human
auggaccucacacugugga

SEQ ID NO: 336112 - RNA, 32 nt, Human
auggaccucaggucagcuucagcgugagaagc

SEQ ID NO: 336113 - RNA, 32 nt, Human
auggaccuccccucccuugcuggagcuagaau

SEQ ID NO: 336114 - RNA, 32 nt, Human
auggaccuccuagugccuccuggaccuaaggg

SEQ ID NO: 336115 - RNA, 32 nt, Human
auggaccuccuagugccuucuggaccuaaggg

SEQ ID NO: 336116 - RNA, 21 nt, Human
auggaccuccugcccuggggg

SEQ ID NO: 336117 - RNA, 32 nt, Human
auggaccugacucuucuugacugccuuguucu

SEQ ID NO: 336118 - RNA, 21 nt, Human
auggaccugcuagaauuugga

SEQ ID NO: 336119 - RNA, 32 nt, Human
auggaccuggcaccuggcgcgguauucaccag

SEQ ID NO: 336120 - RNA, 32 nt, Human
auggaccuguaauuccgggugugacgagagaa

SEQ ID NO: 336121 - RNA, 32 nt, Human
auggaccugucacgauugucaucaggagaaaa

SEQ ID NO: 336122 - RNA, 32 nt, Human
auggaccuuacauccucacugcagucaccuuu

SEQ ID NO: 336123 - RNA, 32 nt, Human
auggaccuugcacucuagaagggacaauggac

SEQ ID NO: 336124 - RNA, 20 nt, Human
auggacgccaggacgagcgg

SEQ ID NO: 336125 - RNA, 32 nt, Human
auggacgcucgcgaggagcaggcugcagguuu

SEQ ID NO: 336126 - RNA, 25 nt, Human
auggacgggaagguggcagugcaag

SEQ ID NO: 336127 - RNA, 32 nt, Human
auggacgggcugccccucccauuccuucaagc

SEQ ID NO: 336128 - RNA, 32 nt, Human
auggacuaggagagagacugggucaaguaagc

SEQ ID NO: 336129 - RNA, 32 nt, Human
auggacuagucacuaaccccacacucaaaggg

SEQ ID NO: 336130 - RNA, 32 nt, Human
auggacucaccgccagcccugacuguggaggg

SEQ ID NO: 336131 - RNA, 32 nt, Human
auggacucagauucagccccagaggagauggg

SEQ ID NO: 336132 - RNA, 32 nt, Human
auggacucagcaggaagcauauugucugggga

SEQ ID NO: 336133 - RNA, 32 nt, Human
auggacucaguggcauuugaggauguggcuau

SEQ ID NO: 336134 - RNA, 32 nt, Human
auggacucuccugccgggcaacucuugcguaa

SEQ ID NO: 336135 - RNA, 32 nt, Human
auggacucuuccagauccugggugacaauggc

SEQ ID NO: 336136 - RNA, 32 nt, Human
auggacucuucccacccagaggaugcagggaa

SEQ ID NO: 336137 - RNA, 32 nt, Human
auggacugaaagaggaagaggcugcaauggag

SEQ ID NO: 336138 - RNA, 32 nt, Human
auggacugacccggggcugggccucgccagcc

SEQ ID NO: 336139 - RNA, 32 nt, Human
auggacuggccaaaaguuauccuuacuccauc

SEQ ID NO: 336140 - RNA, 32 nt, Human
auggacugggaggagggggagggugaugcauu

SEQ ID NO: 336141 - RNA, 32 nt, Human
auggacugggcauuuaaaagaaauggcaacug

SEQ ID NO: 336142 - RNA, 32 nt, Human
auggacugggcugggaggcgagcaaaggaagc

SEQ ID NO: 336143 - RNA, 27 nt, Human
auggacugggugguggagacgaugccc

SEQ ID NO: 336144 - RNA, 21 nt, Human
auggacugucucauacugcuc

SEQ ID NO: 336145 - RNA, 32 nt, Human
auggacugugcugcaguaucaccagaagacau

SEQ ID NO: 336146 - RNA, 32 nt, Human
auggacuguggacucuuuaggucucaggguuu

SEQ ID NO: 336147 - RNA, 32 nt, Human
auggacuuccacugccauccucccaaggggcc

SEQ ID NO: 336148 - RNA, 25 nt, Human
auggacuucuccaaguuccuggcag

SEQ ID NO: 336149 - RNA, 32 nt, Human
auggacuugaguaaaaugguaguuggcucuug

SEQ ID NO: 336150 - RNA, 32 nt, Human
auggacuugcccacaccuccaccuccccugag

SEQ ID NO: 336151 - RNA, 32 nt, Human
auggacuugguuugagggagggggaaucacag

SEQ ID NO: 336152 - RNA, 32 nt, Human
auggagaaauucaggcugggugcaguggcuca

SEQ ID NO: 336153 - RNA, 32 nt, Human
auggagaacagcaugacagcugucuuuggcag

SEQ ID NO: 336154 - RNA, 32 nt, Human
auggagaacaggccuggugggaaaggcuuugg

SEQ ID NO: 336155 - RNA, 32 nt, Human
auggagaacaucaccuguuacuaguucaguaa

SEQ ID NO: 336156 - RNA, 32 nt, Human
auggagaacuaaaucuuuuguaguagcugaga

SEQ ID NO: 336157 - RNA, 21 nt, Human
auggagaacugauguaugaga

SEQ ID NO: 336158 - RNA, 32 nt, Human
auggagaagaaaggcugccaaaaugagaucug

SEQ ID NO: 336159 - RNA, 32 nt, Human
auggagaagcaccuuugcucucagccaccugu

SEQ ID NO: 336160 - RNA, 32 nt, Human
auggagaauggcugucucucagcuggggagga

SEQ ID NO: 336161 - RNA, 32 nt, Human
auggagacaaauucuggguacuagagucagaa

SEQ ID NO: 336162 - RNA, 32 nt, Human
auggagacagacaaacccacugugggcagcau

SEQ ID NO: 336163 - RNA, 27 nt, Human
auggagacauuuaagauugucagcaaa

SEQ ID NO: 336164 - RNA, 18 nt, Human
auggagaccaacaaauag

SEQ ID NO: 336165 - RNA, 32 nt, Human
auggagaccacggugaaaccccgucucuacua

SEQ ID NO: 336166 - RNA, 32 nt, Human
auggagaccagccugcaagccggcccagccug

SEQ ID NO: 336167 - RNA, 32 nt, Human
auggagaccauccuggccaacacagugaggcc

SEQ ID NO: 336168 - RNA, 32 nt, Human
auggagaccauccuggccaacauggugaaacc

SEQ ID NO: 336169 - RNA, 32 nt, Human
auggagaccauccuggcuaacauggugaaacc

SEQ ID NO: 336170 - RNA, 25 nt, Human
auggagacccucugugcaccccagg

SEQ ID NO: 336171 - RNA, 20 nt, Human
auggagacucagauuucuua

SEQ ID NO: 336172 - RNA, 32 nt, Human
auggagacuccuugagugcacacaccugagcc

SEQ ID NO: 336173 - RNA, 32 nt, Human
auggagagaaaggagaaaaaucagaauucuau

SEQ ID NO: 336174 - RNA, 32 nt, Human
auggagagaaggauggaaagccuggacuuaaa

SEQ ID NO: 336175 - RNA, 25 nt, Human
auggagagaaggggcccucccagca

SEQ ID NO: 336176 - RNA, 32 nt, Human
auggagagaauagcaucucuauuccaauguag

SEQ ID NO: 336177 - RNA, 32 nt, Human
auggagagagugagccagacagacuucaccuc

SEQ ID NO: 336178 - RNA, 32 nt, Human
auggagagagugagcuggggaacaggaaaguc

SEQ ID NO: 336179 - RNA, 32 nt, Human
auggagagaugggccguugccaugguggacgg

SEQ ID NO: 336180 - RNA, 20 nt, Human
auggagagcuucagcuaaga

SEQ ID NO: 336181 - RNA, 32 nt, Human
auggagaggaacgcggaaggugcccucugcgg

SEQ ID NO: 336182 - RNA, 32 nt, Human
auggagaggacaaaggcagcuucugcacacca

SEQ ID NO: 336183 - RNA, 32 nt, Human
auggagaggaggaggaggcugaguuuggggua

SEQ ID NO: 336184 - RNA, 32 nt, Human
auggagagggcugcuuuuggggauuauuuaua

SEQ ID NO: 336185 - RNA, 32 nt, Human
auggagaggugggguuuuccuuuugauucagu

SEQ ID NO: 336186 - RNA, 32 nt, Human
auggagagguuagugugaugagguggugucug

SEQ ID NO: 336187 - RNA, 21 nt, Human
auggagagucuaaaauuugga

SEQ ID NO: 336188 - RNA, 32 nt, Human
auggagaguuuacaaagacugaauaauuauug

SEQ ID NO: 336189 - RNA, 32 nt, Human
auggagaucagcugccugagcaccugcgcugu

SEQ ID NO: 336190 - RNA, 32 nt, Human
auggagaugaagauuguuuucuccaauuuucu

SEQ ID NO: 336191 - RNA, 32 nt, Human
auggagaugaagugaaggucugagggacgggc

SEQ ID NO: 336192 - RNA, 32 nt, Human
auggagaugagagagggugagagauggagggc

SEQ ID NO: 336193 - RNA, 32 nt, Human
auggagaugggaucacuauguugcccaugcug

SEQ ID NO: 336194 - RNA, 32 nt, Human
auggagauggggucuugcuuuguugcccaggc

SEQ ID NO: 336195 - RNA, 32 nt, Human
auggagaugguucagggaggcuuggaguacca

SEQ ID NO: 336196 - RNA, 32 nt, Human
auggagaugguuuugcccucccucucugcccu

SEQ ID NO: 336197 - RNA, 31 nt, Human
auggagaugucgggacucagcuuuucagaga

SEQ ID NO: 336198 - RNA, 32 nt, Human
auggagauguggagccuugucaccaaccucua

SEQ ID NO: 336199 - RNA, 32 nt, Human
auggagcaaaagagacagggagagguggagaa

SEQ ID NO: 336200 - RNA, 25 nt, Human
auggagcaacugcccucaggaggca

SEQ ID NO: 336201 - RNA, 26 nt, Human
auggagcacgccaagaagagccagga

SEQ ID NO: 336202 - RNA, 32 nt, Human
auggagcagcaacccugagucccuaaggcagc

SEQ ID NO: 336203 - RNA, 32 nt, Human
auggagcagcaggaauuugagggauggagcag

SEQ ID NO: 336204 - RNA, 32 nt, Human
auggagcagccccauuccagggucccaucugu

SEQ ID NO: 336205 - RNA, 32 nt, Human
auggagcaggaaacuggaguugaggagggcag

SEQ ID NO: 336206 - RNA, 32 nt, Human
auggagcaggagcagaagcacacguuggagaa

SEQ ID NO: 336207 - RNA, 32 nt, Human
auggagcaggaguggagaaagggaaaggcagg

SEQ ID NO: 336208 - RNA, 32 nt, Human
auggagcagggagggagacggcuagggcagca

SEQ ID NO: 336209 - RNA, 32 nt, Human
auggagcaggugugcagagggugagaacccag

SEQ ID NO: 336210 - RNA, 32 nt, Human
auggagcauguacuuauuugcauuugcuggca

SEQ ID NO: 336211 - RNA, 32 nt, Human
auggagcauguggcuguccugagguucuuuua

SEQ ID NO: 336212 - RNA, 32 nt, Human
auggagccacugcacuccagcccaggugacag

SEQ ID NO: 336213 - RNA, 32 nt, Human
auggagccacugcacuccagccugggcgacag

SEQ ID NO: 336214 - RNA, 32 nt, Human
auggagccacugcacuccagccugggggaaag

SEQ ID NO: 336215 - RNA, 32 nt, Human
auggagcccagagugacacagaggaagaggcc

SEQ ID NO: 336216 - RNA, 32 nt, Human
auggagcccuagggagccccugugcugccccu

SEQ ID NO: 336217 - RNA, 32 nt, Human
auggagcccuugccucauguacaccgggaguc

SEQ ID NO: 336218 - RNA, 32 nt, Human
auggagccuagacagaagcccagaacuuucug

SEQ ID NO: 336219 - RNA, 32 nt, Human
auggagccucaggcaccaugccaaaaauaauu

SEQ ID NO: 336220 - RNA, 32 nt, Human
auggagccugccuuggggagugcauguguugg

SEQ ID NO: 336221 - RNA, 32 nt, Human
auggagccuggcagauaacaagcacgagauaa

SEQ ID NO: 336222 - RNA, 32 nt, Human
auggagccuuucuguggcauugaaggaacaaa

SEQ ID NO: 336223 - RNA, 32 nt, Human
auggagcgggaggcguugccguggggccucga

SEQ ID NO: 336224 - RNA, 32 nt, Human
auggagcuagagagacaacaggaaagacggug

SEQ ID NO: 336225 - RNA, 32 nt, Human
auggagcucaugccagaaaugguccuaagcau

SEQ ID NO: 336226 - RNA, 32 nt, Human
auggagcuccacccuucagucugugucguguu

SEQ ID NO: 336227 - RNA, 25 nt, Human
auggagcugcuugaagaagaucuca

SEQ ID NO: 336228 - RNA, 32 nt, Human
auggagcugggagcugaggcuccuguugcacc

SEQ ID NO: 336229 - RNA, 19 nt, Human
auggagcugucaucuccua

SEQ ID NO: 336230 - RNA, 32 nt, Human
auggagcuuacaaugaauaaaaagacaugacg

SEQ ID NO: 336231 - RNA, 32 nt, Human
auggagcuuauggguagaagaccaugucuacu

SEQ ID NO: 336232 - RNA, 32 nt, Human
auggagcuucaugacccacggucagcccccaa

SEQ ID NO: 336233 - RNA, 32 nt, Human
auggaggaaccagcagcccagaaacacucccc

SEQ ID NO: 336234 - RNA, 32 nt, Human
auggaggaagauugauuuucuccaucaguuca

SEQ ID NO: 336235 - RNA, 23 nt, Human
auggaggaaggaaaaagggagaa

SEQ ID NO: 336236 - RNA, 32 nt, Human
auggaggacacuggagagaguugcuauuccag

SEQ ID NO: 336237 - RNA, 32 nt, Human
auggaggacaggacaggauggcuggaggggcu

SEQ ID NO: 336238 - RNA, 32 nt, Human
auggaggacgugagaggaacagccagcugugu

SEQ ID NO: 336239 - RNA, 32 nt, Human
auggaggacuccucucuucugcuucuguggau

SEQ ID NO: 336240 - RNA, 31 nt, Human
auggaggagacgucucccacgaggccaaggc

SEQ ID NO: 336241 - RNA, 32 nt, Human
auggaggagauaguuugugguccauuauugua

SEQ ID NO: 336242 - RNA, 32 nt, Human
auggaggaggaaugagcugggguggggccguu

SEQ ID NO: 336243 - RNA, 32 nt, Human
auggaggaggcccagcccugaggucaacgcca

SEQ ID NO: 336244 - RNA, 32 nt, Human
auggaggagggagggcuucaggacggggcguc

SEQ ID NO: 336245 - RNA, 32 nt, Human
auggaggauggggcagccaggagccagacuua

SEQ ID NO: 336246 - RNA, 32 nt, Human
auggaggauguaagcaaguaacacagccaaga

SEQ ID NO: 336247 - RNA, 32 nt, Human
auggaggcacaucuucagggcaccaguguuaa

SEQ ID NO: 336248 - RNA, 32 nt, Human
auggaggcacaugucagaugcugcagucgcaa

SEQ ID NO: 336249 - RNA, 32 nt, Human
auggaggcagguauuucccaugcuauucuuuu

SEQ ID NO: 336250 - RNA, 24 nt, Human
auggaggcauccugacaucuguuc

SEQ ID NO: 336251 - RNA, 32 nt, Human
auggaggccacuauggugaaaaagccagggga

SEQ ID NO: 336252 - RNA, 22 nt, Human
auggaggcccugaccucugcug

SEQ ID NO: 336253 - RNA, 32 nt, Human
auggaggccugggaacaggguuuauacuaagu

SEQ ID NO: 336254 - RNA, 32 nt, Human
auggaggcggcggcucccuaaaccacuuuucg

SEQ ID NO: 336255 - RNA, 20 nt, Human
auggaggcgucuacaccugc

SEQ ID NO: 336256 - RNA, 22 nt, Human
auggaggcucaugccuguaauc

SEQ ID NO: 336257 - RNA, 32 nt, Human
auggaggcuggcaagggaaaguuucagcucac

SEQ ID NO: 336258 - RNA, 32 nt, Human
auggaggcuguucauucccugcagugucggca

SEQ ID NO: 336259 - RNA, 32 nt, Human
auggagggagccuguuggaauaucgagccagc

SEQ ID NO: 336260 - RNA, 32 nt, Human
auggagggaggcaccccuuccaggaacaaggc

SEQ ID NO: 336261 - RNA, 32 nt, Human
auggagggaggcagaguaacagcgaagagggg

SEQ ID NO: 336262 - RNA, 27 nt, Human
auggagggagggucccaaauuagcaaa

SEQ ID NO: 336263 - RNA, 22 nt, Human
auggagggcagccacuuuucuc

SEQ ID NO: 336264 - RNA, 32 nt, Human
auggagggcaucuacacacauacacaucccuc

SEQ ID NO: 336265 - RNA, 32 nt, Human
auggagggccguuguugccucucccggcguuu

SEQ ID NO: 336266 - RNA, 32 nt, Human
auggagggcuaaauuugcucaugugaaacuuc

SEQ ID NO: 336267 - RNA, 26 nt, Human
auggagggcuccguaggucucagcaa

SEQ ID NO: 336268 - RNA, 32 nt, Human
auggagggcuccugcccuucugcugagccaca

SEQ ID NO: 336269 - RNA, 32 nt, Human
auggagggcuuuguuucacaagcuuuucuccu

SEQ ID NO: 336270 - RNA, 32 nt, Human
auggaggggaacgugcugacugggacucccag

SEQ ID NO: 336271 - RNA, 21 nt, Human
auggaggggaagauacugcuu

SEQ ID NO: 336272 - RNA, 32 nt, Human
auggagggggcugcagguuggaacuaugcagu

SEQ ID NO: 336273 - RNA, 32 nt, Human
auggagggguaggaguugaugguucugaaggc

SEQ ID NO: 336274 - RNA, 24 nt, Human
auggagggugacuggcccuggcuc

SEQ ID NO: 336275 - RNA, 23 nt, Human
auggaggguggcgcaggccucuc

SEQ ID NO: 336276 - RNA, 21 nt, Human
auggaggguggucacauguuc

SEQ ID NO: 336277 - RNA, 32 nt, Human
auggagguaaaaggaaaggaaggaaggaaaaa

SEQ ID NO: 336278 - RNA, 32 nt, Human
auggagguaaguggccagcaaaaaugaaagug

SEQ ID NO: 336279 - RNA, 28 nt, Human
auggaggucucaggaagggcccagcgaa

SEQ ID NO: 336280 - RNA, 32 nt, Human
auggaggucuggggcucugguggcuuccauag

SEQ ID NO: 336281 - RNA, 32 nt, Human
auggaggugggaccagaugcuucccugugcug

SEQ ID NO: 336282 - RNA, 32 nt, Human
auggagguggugagccguggggaacgcucucu

SEQ ID NO: 336283 - RNA, 32 nt, Human
auggagguuccuucccucucaccugcauuuuu

SEQ ID NO: 336284 - RNA, 32 nt, Human
auggagguugucacucucuggaaaaggauuuc

SEQ ID NO: 336285 - RNA, 32 nt, Human
auggaguagagaaagaaagagcaagagcaggc

SEQ ID NO: 336286 - RNA, 32 nt, Human
auggaguagcaacuaguuuuguagcacuacau

SEQ ID NO: 336287 - RNA, 32 nt, Human
auggaguauaccuuguaaaucuucccaaaugu

SEQ ID NO: 336288 - RNA, 32 nt, Human
auggagucacacucuccaggcuggagugcagu

SEQ ID NO: 336289 - RNA, 32 nt, Human
auggagucaggugcuggaggccguggcagcgg

SEQ ID NO: 336290 - RNA, 32 nt, Human
auggagucauucauccugauguccucaauugc

SEQ ID NO: 336291 - RNA, 32 nt, Human
auggaguccagccugggugacagagugagacc

SEQ ID NO: 336292 - RNA, 32 nt, Human
auggaguccagggaagagaaagugauuucuag

SEQ ID NO: 336293 - RNA, 32 nt, Human
auggagucucaaacuaucaccugggcuggagu

SEQ ID NO: 336294 - RNA, 19 nt, Human
auggagucucaccauguug

SEQ ID NO: 336295 - RNA, 23 nt, Human
auggagucucaccauguugguca

SEQ ID NO: 336296 - RNA, 18 nt, Human
auggagucucacuauguu

SEQ ID NO: 336297 - RNA, 19 nt, Human
auggagucucacuauguug

SEQ ID NO: 336298 - RNA, 32 nt, Human
auggagucucacuauguugcccagacuggucu

SEQ ID NO: 336299 - RNA, 32 nt, Human
auggagucuccaggaaccccagccuguuaggg

SEQ ID NO: 336300 - RNA, 32 nt, Human
auggagucucccuauguugcucaggccgguug

SEQ ID NO: 336301 - RNA, 32 nt, Human
auggagucucgcucucuggagugcaauggcgc

SEQ ID NO: 336302 - RNA, 32 nt, Human
auggagucucucugcacuccagccugggugac

SEQ ID NO: 336303 - RNA, 32 nt, Human
auggagucuugcucugucucucaggcuagagc

SEQ ID NO: 336304 - RNA, 32 nt, Human
auggagugaaaccuauuguaaggcuguacuuu

SEQ ID NO: 336305 - RNA, 32 nt, Human
auggagugaaguauaccaugcaccaaaauaaa

SEQ ID NO: 336306 - RNA, 32 nt, Human
auggagugcagugguugaucauagcucccggg

SEQ ID NO: 336307 - RNA, 32 nt, Human
auggagugcaguguugugaucaugccucagug

SEQ ID NO: 336308 - RNA, 15 nt, Human
auggaguggagacaa

SEQ ID NO: 336309 - RNA, 32 nt, Human
auggaguggcccacggcggccuuggggugaag

SEQ ID NO: 336310 - RNA, 32 nt, Human
auggaguggcccagccucccaccuucagcccg

SEQ ID NO: 336311 - RNA, 31 nt, Human
auggaguggcccugguccaugccagguuuuc

SEQ ID NO: 336312 - RNA, 32 nt, Human
auggagugggaaauguguuucucuggagaagg

SEQ ID NO: 336313 - RNA, 31 nt, Human
auggagugggaaugaagauggggaacuuacg

SEQ ID NO: 336314 - RNA, 31 nt, Human
auggagugggagaugccaaagacugaucauu

SEQ ID NO: 336315 - RNA, 32 nt, Human
auggaguggugagaauugaaugguuaaugcac

SEQ ID NO: 336316 - RNA, 32 nt, Human
auggaguguaggaaagagcagaccaaaaucag

SEQ ID NO: 336317 - RNA, 32 nt, Human
auggagugugcgugugugcauguaugugugug

SEQ ID NO: 336318 - RNA, 32 nt, Human
auggaguguugaugcuuucgucuccagccccu

SEQ ID NO: 336319 - RNA, 32 nt, Human
auggaguucagggcaucccagagcagauccau

SEQ ID NO: 336320 - RNA, 32 nt, Human
auggaguugaauccuuucucugccacucuuug

SEQ ID NO: 336321 - RNA, 32 nt, Human
auggaguugggaacaggcugggaaggaugccc

SEQ ID NO: 336322 - RNA, 32 nt, Human
auggaguugugcaaagcuauggcuuccuuggu

SEQ ID NO: 336323 - RNA, 32 nt, Human
auggaguuuaaguugagugaacaucggccaug

SEQ ID NO: 336324 - RNA, 19 nt, Human
auggaguuucaccacguug

SEQ ID NO: 336325 - RNA, 32 nt, Human
auggaguuucuaagccaccugauuuuaaggcu

SEQ ID NO: 336326 - RNA, 32 nt, Human
auggaguuuugcucuugcacuccauccuggac

SEQ ID NO: 336327 - RNA, 32 nt, Human
auggauaaacugccuuuucucacauccccucu

SEQ ID NO: 336328 - RNA, 32 nt, Human
auggauaacaacucucacuuuaguggauguaa

SEQ ID NO: 336329 - RNA, 32 nt, Human
auggauaagcgcacggaugaauggagcuuaca

SEQ ID NO: 336330 - RNA, 32 nt, Human
auggauaaucaggaggcaucacugaggccagg

SEQ ID NO: 336331 - RNA, 32 nt, Human
auggauaaucuaugugcuucuaguaggcacag

SEQ ID NO: 336332 - RNA, 32 nt, Human
auggauacaggcucuuccuaugguauuauuua

SEQ ID NO: 336333 - RNA, 32 nt, Human
auggauacccgcacuccuccuccugggccgga

SEQ ID NO: 336334 - RNA, 32 nt, Human
auggauacuacugcauuggcaucuagcagaaa

SEQ ID NO: 336335 - RNA, 32 nt, Human
auggauacugacaccaaggacauucagauuuu

SEQ ID NO: 336336 - RNA, 32 nt, Human
auggauagaguauugagauacuuuuucuuuug

SEQ ID NO: 336337 - RNA, 32 nt, Human
auggauagcugggguuggcagauggcuagaga

SEQ ID NO: 336338 - RNA, 32 nt, Human
auggauaggaauuaguacuaagcaaugugucu

SEQ ID NO: 336339 - RNA, 32 nt, Human
auggauaggggagggggcgguaggggcugcag

SEQ ID NO: 336340 - RNA, 32 nt, Human
auggaucaagacgguuaccuggcacgcuggcc

SEQ ID NO: 336341 - RNA, 21 nt, Human
auggaucaagccccuaaaaug

SEQ ID NO: 336342 - RNA, 21 nt, Human
auggaucagccaaggccgaga

SEQ ID NO: 336343 - RNA, 32 nt, Human
auggaucaggcaggccagaggggcaguucaug

SEQ ID NO: 336344 - RNA, 28 nt, Human
auggaucaucugucggguguguggugaa

SEQ ID NO: 336345 - RNA, 32 nt, Human
auggaucaugaggaucagagaggaaaagucac

SEQ ID NO: 336346 - RNA, 32 nt, Human
auggaucauuucuugacuuucauguggguaac

SEQ ID NO: 336347 - RNA, 32 nt, Human
auggauccaaaccaagaagaaaucccugauuu

SEQ ID NO: 336348 - RNA, 32 nt, Human
auggauccgugacagcacuuuccuguugcacu

SEQ ID NO: 336349 - RNA, 32 nt, Human
auggaucgcuugagcccaggagguggagguug

SEQ ID NO: 336350 - RNA, 32 nt, Human
auggaucgcuugagcccaggaguuugagacca

SEQ ID NO: 336351 - RNA, 32 nt, Human
auggaucggccacugcacuccgggcugggcga

SEQ ID NO: 336352 - RNA, 32 nt, Human
auggaucugaagagugggcaacggagaguuaa

SEQ ID NO: 336353 - RNA, 32 nt, Human
auggaucugauccuccgaagcacagcagagau

SEQ ID NO: 336354 - RNA, 32 nt, Human
auggaucuuguaaucaugccaagagaauagau

SEQ ID NO: 336355 - RNA, 32 nt, Human
auggaucuuuggguguguaggggauagaggag

SEQ ID NO: 336356 - RNA, 32 nt, Human
auggaugaaugagagagggagggaacagugcc

SEQ ID NO: 336357 - RNA, 32 nt, Human
auggaugacaaaugugacauugugcacuagcu

SEQ ID NO: 336358 - RNA, 32 nt, Human
auggaugauggacccuuuccuaaugagccucc

SEQ ID NO: 336359 - RNA, 32 nt, Human
auggaugcagcaaaccaccauggcacguguau

SEQ ID NO: 336360 - RNA, 32 nt, Human
auggaugccaucacucuuuucuccacauacag

SEQ ID NO: 336361 - RNA, 32 nt, Human
auggaugccucaucagaacaugcuguugaguc

SEQ ID NO: 336362 - RNA, 32 nt, Human
auggaugcuaugccuggauaccagucuccacu

SEQ ID NO: 336363 - RNA, 32 nt, Human
auggaugcugggcuucauaccugggugaugag

SEQ ID NO: 336364 - RNA, 29 nt, Human
auggaugcuguuuccccucccccgggcca

SEQ ID NO: 336365 - RNA, 32 nt, Human
auggauggacacaccucuccacaauuccuuca

SEQ ID NO: 336366 - RNA, 18 nt, Human
auggauggagacuaugaa

SEQ ID NO: 336367 - RNA, 32 nt, Human
auggauggagccaugcagacaccaaggugaag

SEQ ID NO: 336368 - RNA, 29 nt, Human
auggauggaggcagaguuggcacccagag

SEQ ID NO: 336369 - RNA, 32 nt, Human
auggauggcugucaaucccgaggcagaaguuu

SEQ ID NO: 336370 - RNA, 32 nt, Human
auggaugggcagaggcucucucccugcccacu

SEQ ID NO: 336371 - RNA, 32 nt, Human
auggaugggcugagggaguggagggggaccuc

SEQ ID NO: 336372 - RNA, 32 nt, Human
auggauggggcugcuuuugcagugggugccac

SEQ ID NO: 336373 - RNA, 32 nt, Human
auggaugguuaugucaaagucauaguucaucc

SEQ ID NO: 336374 - RNA, 32 nt, Human
auggaugugaugcacugaaaaguuaguugcuc

SEQ ID NO: 336375 - RNA, 32 nt, Human
auggaugugcagugggagguugaggcacaagg

SEQ ID NO: 336376 - RNA, 23 nt, Human
auggaugugcuguacaucugcuc

SEQ ID NO: 336377 - RNA, 32 nt, Human
auggauguggggagaguggaagaggcagggag

SEQ ID NO: 336378 - RNA, 32 nt, Human
auggauguggggccagugcacacagaugccac

SEQ ID NO: 336379 - RNA, 32 nt, Human
auggaugugggguggucccuucacacaaggca

SEQ ID NO: 336380 - RNA, 32 nt, Human
auggauguuggugaaaauuaaagggaaacaga

SEQ ID NO: 336381 - RNA, 32 nt, Human
auggauguuugaagcuaaucugcaacagccuu

SEQ ID NO: 336382 - RNA, 32 nt, Human
auggauuacauaaucacagccaaaaagcacgg

SEQ ID NO: 336383 - RNA, 32 nt, Human
auggauuaccaucuuuauugcuguaauguguu

SEQ ID NO: 336384 - RNA, 32 nt, Human
auggauuaugcucugugaaaugaaaaguucaa

SEQ ID NO: 336385 - RNA, 32 nt, Human
auggauucaaaccaagaugaaaucacugaauu

SEQ ID NO: 336386 - RNA, 32 nt, Human
auggauucaauggacucauccauuugugagga

SEQ ID NO: 336387 - RNA, 32 nt, Human
auggauucagcauguccaacaugguaauucac

SEQ ID NO: 336388 - RNA, 32 nt, Human
auggauucauucuuucaaacauccgcauucuc

SEQ ID NO: 336389 - RNA, 32 nt, Human
auggauucgagccacuuguaggcacauuagcu

SEQ ID NO: 336390 - RNA, 32 nt, Human
auggauucuucuuuuguguauuuccuuuucug

SEQ ID NO: 336391 - RNA, 32 nt, Human
auggauuggaagagaacugcuggcauauugag

SEQ ID NO: 336392 - RNA, 32 nt, Human
auggauuggcaagagaaaaaggaggaacaggg

SEQ ID NO: 336393 - RNA, 32 nt, Human
auggauuguucaaugguacaguuuggaaccaa

SEQ ID NO: 336394 - RNA, 32 nt, Human
auggauuuacuuuugggauacacucauuauuc

SEQ ID NO: 336395 - RNA, 32 nt, Human
auggauuuauuagaauuucauaugacauucau

SEQ ID NO: 336396 - RNA, 32 nt, Human
auggauuuauuuucucucucagucuccauuuu

SEQ ID NO: 336397 - RNA, 32 nt, Human
auggauuucacuucugaacaguuuacagcaca

SEQ ID NO: 336398 - RNA, 23 nt, Human
auggauuucuaggucacugggga

SEQ ID NO: 336399 - RNA, 32 nt, Human
auggauuugaagcaaagcaccagcuucuccag

SEQ ID NO: 336400 - RNA, 32 nt, Human
auggauuugguauucaacuuuuucccuggaug

SEQ ID NO: 336401 - RNA, 31 nt, Human
auggauuuucauaaauacaguuugaauauau

SEQ ID NO: 336402 - RNA, 32 nt, Human
  misc_feature (32)..(32): n is a, c, g or u
auggauuuucccuuuuguuuucaguguuccun

SEQ ID NO: 336403 - RNA, 32 nt, Human
auggcaaaaccagcuuaggaccucugcuguac

SEQ ID NO: 336404 - RNA, 32 nt, Human
auggcaaaagauuggacuaagacacuggccau

SEQ ID NO: 336405 - RNA, 32 nt, Human
auggcaaacaauccuaaaauauacaagacuac

SEQ ID NO: 336406 - RNA, 32 nt, Human
auggcaaacacucggcugggcacaguggcuca

SEQ ID NO: 336407 - RNA, 32 nt, Human
auggcaaacagaaacgcaacaaaaagacagac

SEQ ID NO: 336408 - RNA, 32 nt, Human
auggcaaacauggugaaacgcugucucuacua

SEQ ID NO: 336409 - RNA, 32 nt, Human
auggcaaagggaugugggaaguauccaugggc

SEQ ID NO: 336410 - RNA, 32 nt, Human
auggcaaauggguggcaaguaccgccuuaugg

SEQ ID NO: 336411 - RNA, 32 nt, Human
auggcaacauaauucacuuuccaucuuuuaaa

SEQ ID NO: 336412 - RNA, 21 nt, Human
auggcaacguccagggcccag

SEQ ID NO: 336413 - RNA, 32 nt, Human
auggcaagaagggcauuuuucucuucaauuuc

SEQ ID NO: 336414 - RNA, 32 nt, Human
auggcaagaugccauauccuggaaacauauua

SEQ ID NO: 336415 - RNA, 32 nt, Human
auggcaagcugguguuuaagaggucaggaggc

SEQ ID NO: 336416 - RNA, 32 nt, Human
auggcaagcuuacugccuugaugcacaucugg

SEQ ID NO: 336417 - RNA, 32 nt, Human
auggcaaggaagagagagccuucauggcaauu

SEQ ID NO: 336418 - RNA, 32 nt, Human
auggcaagugauaucaccucucuucagccccu

SEQ ID NO: 336419 - RNA, 32 nt, Human
auggcaaguggucccugaugugcagugucuca

SEQ ID NO: 336420 - RNA, 31 nt, Human
auggcaauauacauggagaggagggacucuu

SEQ ID NO: 336421 - RNA, 32 nt, Human
auggcaauuguuuagugacuguaagugauacu

SEQ ID NO: 336422 - RNA, 32 nt, Human
auggcacaaauccauggcugggcauggcuuua

SEQ ID NO: 336423 - RNA, 32 nt, Human
auggcacaauccaggcuguugcaccccuucuu

SEQ ID NO: 336424 - RNA, 32 nt, Human
auggcacacugggauaaacaagcaagauugcu

SEQ ID NO: 336425 - RNA, 32 nt, Human
auggcacagaaacacaucccaaauacuaugau

SEQ ID NO: 336426 - RNA, 32 nt, Human
auggcacagcacagugugcacugcucccacag

SEQ ID NO: 336427 - RNA, 32 nt, Human
auggcacagcagagcaccgggaccugcccagc

SEQ ID NO: 336428 - RNA, 32 nt, Human
auggcacauguggagagccagggagaagaaga

SEQ ID NO: 336429 - RNA, 32 nt, Human
auggcaccaauacuugggacacgaugauuuag

SEQ ID NO: 336430 - RNA, 32 nt, Human
auggcaccacaguggugggggcccauggccuc

SEQ ID NO: 336431 - RNA, 32 nt, Human
auggcaccaccaggguagagggaaggucggcu

SEQ ID NO: 336432 - RNA, 32 nt, Human
auggcaccaccagugguggggacagcgaugcc

SEQ ID NO: 336433 - RNA, 32 nt, Human
auggcaccacuacacuccagcccgggcgacag

SEQ ID NO: 336434 - RNA, 32 nt, Human
auggcaccacuacauuucagccugggcgaaag

SEQ ID NO: 336435 - RNA, 32 nt, Human
auggcaccacugcacuccagccuaggugacag

SEQ ID NO: 336436 - RNA, 25 nt, Human
auggcaccacugcacuccagccugg

SEQ ID NO: 336437 - RNA, 32 nt, Human
auggcaccacugcacuccagccuggacgacag

SEQ ID NO: 336438 - RNA, 32 nt, Human
auggcaccacugcacuccagccugggagacac

SEQ ID NO: 336439 - RNA, 32 nt, Human
auggcaccacugcacuccagccugggagacag

SEQ ID NO: 336440 - RNA, 32 nt, Human
auggcaccacugcacuccagccugggcaacag

SEQ ID NO: 336441 - RNA, 32 nt, Human
auggcaccacugcacuccagccugggugacag

SEQ ID NO: 336442 - RNA, 32 nt, Human
auggcaccacugcacuccagccugggugagag

SEQ ID NO: 336443 - RNA, 32 nt, Human
auggcaccacugcacuccagcuugggugacag

SEQ ID NO: 336444 - RNA, 32 nt, Human
auggcaccacugcacuccauccugggugacag

SEQ ID NO: 336445 - RNA, 32 nt, Human
auggcaccacugcacuccggccuaggcaacga

SEQ ID NO: 336446 - RNA, 32 nt, Human
auggcaccacugcacuucagccugggugacag

SEQ ID NO: 336447 - RNA, 32 nt, Human
auggcaccacugcauuccagccugggugacag

SEQ ID NO: 336448 - RNA, 32 nt, Human
auggcaccacuggacuccagccugggcgacag

SEQ ID NO: 336449 - RNA, 32 nt, Human
auggcaccacuguacuccagccugggugacag

SEQ ID NO: 336450 - RNA, 32 nt, Human
auggcaccauuacacuccagccugggcaacag

SEQ ID NO: 336451 - RNA, 32 nt, Human
auggcaccauugcacuccagccugggugacaa

SEQ ID NO: 336452 - RNA, 32 nt, Human
auggcacccucagaccacacaguagccaaguu

SEQ ID NO: 336453 - RNA, 32 nt, Human
auggcacccugagacagcccagaggugaauag

SEQ ID NO: 336454 - RNA, 32 nt, Human
auggcacccuggaaccgggaaggguggccugu

SEQ ID NO: 336455 - RNA, 32 nt, Human
auggcacccuggcuucucacacaucucaucgu

SEQ ID NO: 336456 - RNA, 32 nt, Human
auggcaccgcugcacuccaaccugggcaacag

SEQ ID NO: 336457 - RNA, 32 nt, Human
auggcaccugcucugauccggugggcuccacg

SEQ ID NO: 336458 - RNA, 32 nt, Human
auggcaccugguguguaacgacacaaucagca

SEQ ID NO: 336459 - RNA, 32 nt, Human
auggcaccuucaccaucuuguagaaucacuuu

SEQ ID NO: 336460 - RNA, 32 nt, Human
auggcacucacuccagccugggcaacaagagc

SEQ ID NO: 336461 - RNA, 32 nt, Human
auggcacucauuaaaaaggaucagagaccauu

SEQ ID NO: 336462 - RNA, 32 nt, Human
auggcacugcacuccagccugggcaacagagu

SEQ ID NO: 336463 - RNA, 32 nt, Human
auggcacugcugcacuccagccugcgggacag

SEQ ID NO: 336464 - RNA, 32 nt, Human
auggcacuggguccagcacaaacacaagguca

SEQ ID NO: 336465 - RNA, 32 nt, Human
auggcacuucaugguccuugaaaaccucggau

SEQ ID NO: 336466 - RNA, 32 nt, Human
auggcagaaaaaccauuuccacuaugcaaagu

SEQ ID NO: 336467 - RNA, 32 nt, Human
auggcagaaaugucauucucuuccauauaugu

SEQ ID NO: 336468 - RNA, 32 nt, Human
auggcagacacugcuucuucucagggaggccc

SEQ ID NO: 336469 - RNA, 32 nt, Human
auggcagacaucaggaaggaggagaggaacca

SEQ ID NO: 336470 - RNA, 32 nt, Human
auggcagaccuugauguuuauuucucaaaugg

SEQ ID NO: 336471 - RNA, 32 nt, Human
auggcagagaaauauacuaucucaccaguauu

SEQ ID NO: 336472 - RNA, 32 nt, Human
auggcagagaugggugugugaggggugaggag

SEQ ID NO: 336473 - RNA, 25 nt, Human
auggcagagguggaggaaaccuuaa

SEQ ID NO: 336474 - RNA, 32 nt, Human
auggcagaugcacaaauugugcagugauguaa

SEQ ID NO: 336475 - RNA, 23 nt, Human
auggcagauugaaaaggaucuca

SEQ ID NO: 336476 - RNA, 22 nt, Human
auggcagcacagauauaccuca

SEQ ID NO: 336477 - RNA, 32 nt, Human
auggcagcacaggcaacaguucagagguagug

SEQ ID NO: 336478 - RNA, 32 nt, Human
auggcagcacuuccaucaaaagacaccauagc

SEQ ID NO: 336479 - RNA, 32 nt, Human
auggcagcagaggcagccuccuacguccuggc

SEQ ID NO: 336480 - RNA, 24 nt, Human
auggcagcagcaugcagaaucuua

SEQ ID NO: 336481 - RNA, 32 nt, Human
auggcagcagucgagagagagugugugaagga

SEQ ID NO: 336482 - RNA, 21 nt, Human
auggcagcauccagggccucg

SEQ ID NO: 336483 - RNA, 23 nt, Human
auggcagcauccuucggaccuca

SEQ ID NO: 336484 - RNA, 32 nt, Human
auggcagccacuguugaguacuguuacagggg

SEQ ID NO: 336485 - RNA, 32 nt, Human
auggcagcgguggcaguggcagcaguggccca

SEQ ID NO: 336486 - RNA, 32 nt, Human
auggcagcuccuggcuccuaucugggacaccu

SEQ ID NO: 336487 - RNA, 32 nt, Human
auggcagcugaaacucacucugugcugggcuu

SEQ ID NO: 336488 - RNA, 32 nt, Human
auggcagcugugugcucagcccgcacaggcag

SEQ ID NO: 336489 - RNA, 22 nt, Human
auggcagcuguugagaaucuca

SEQ ID NO: 336490 - RNA, 32 nt, Human
auggcaggaugcuugucuccagguguggccug

SEQ ID NO: 336491 - RNA, 31 nt, Human
auggcaggauguucuggcacagcagacugga

SEQ ID NO: 336492 - RNA, 32 nt, Human
auggcaggccuggguuuggauuucagaauccu

SEQ ID NO: 336493 - RNA, 32 nt, Human
auggcagggaauggagagagugagccagacag

SEQ ID NO: 336494 - RNA, 32 nt, Human
auggcagggagggcugcacugacauugaugcc

SEQ ID NO: 336495 - RNA, 32 nt, Human
auggcagggccagcagggaggugggcauggca

SEQ ID NO: 336496 - RNA, 32 nt, Human
auggcaggggcagagugcagguggagagaaca

SEQ ID NO: 336497 - RNA, 32 nt, Human
auggcaggggcagagugcagguggagagaaua

SEQ ID NO: 336498 - RNA, 32 nt, Human
auggcaggugagugaaaacguuauaagggacu

SEQ ID NO: 336499 - RNA, 32 nt, Human
auggcaggugugugaguucuguccuagaccug

SEQ ID NO: 336500 - RNA, 32 nt, Human
auggcaguaggcaguggcuggacuggaaccca

SEQ ID NO: 336501 - RNA, 20 nt, Human
auggcaguccuaaccuagca

SEQ ID NO: 336502 - RNA, 32 nt, Human
auggcaguccuggaggcagggggugaggggca

SEQ ID NO: 336503 - RNA, 32 nt, Human
auggcagucgaaggagcuucgucuggcagcag

SEQ ID NO: 336504 - RNA, 32 nt, Human
auggcagugaagagcuuguggaaaagaaaccu

SEQ ID NO: 336505 - RNA, 32 nt, Human
auggcagugaaucuccuuucuguucuacuuua

SEQ ID NO: 336506 - RNA, 32 nt, Human
auggcauaacaaaggcaagacucugccuuaau

SEQ ID NO: 336507 - RNA, 32 nt, Human
auggcauaggccauagaccaggucccugcugc

SEQ ID NO: 336508 - RNA, 32 nt, Human
auggcaucaaggcucacugcagccuggaccuc

SEQ ID NO: 336509 - RNA, 32 nt, Human
auggcaucaaguggcauccaucauaagaucgu

SEQ ID NO: 336510 - RNA, 32 nt, Human
auggcaucagcguuucaugcucugccuuuuag

SEQ ID NO: 336511 - RNA, 32 nt, Human
auggcaucauugcauuccagccugggcaacag

SEQ ID NO: 336512 - RNA, 32 nt, Human
auggcaucccacuugcccacucuccuuccugg

SEQ ID NO: 336513 - RNA, 32 nt, Human
auggcauccugcucugaaucuagacuuuuuag

SEQ ID NO: 336514 - RNA, 32 nt, Human
auggcaucucacuauguugcccaggcugaucu

SEQ ID NO: 336515 - RNA, 32 nt, Human
auggcaucuccucuugagauauguucuucuua

SEQ ID NO: 336516 - RNA, 32 nt, Human
auggcaucugguagggagggagguauaguugg

SEQ ID NO: 336517 - RNA, 32 nt, Human
auggcaugaacccaggaggcagagcuugcagu

SEQ ID NO: 336518 - RNA, 32 nt, Human
auggcaugaacccaggaggcagagcuuguagu

SEQ ID NO: 336519 - RNA, 32 nt, Human
auggcaugauuagauugcaaagcaaugaacuc

SEQ ID NO: 336520 - RNA, 32 nt, Human
auggcauggaaucacugccuccugugauuuga

SEQ ID NO: 336521 - RNA, 32 nt, Human
auggcauggcaauccauccaucaaugagaaga

SEQ ID NO: 336522 - RNA, 32 nt, Human
auggcauggccuuaucgauugcagugggaagc

SEQ ID NO: 336523 - RNA, 32 nt, Human
auggcaugguuuugugccaucuguagcuauaa

SEQ ID NO: 336524 - RNA, 32 nt, Human
auggcauguaccaccuguccuaggaagaccag

SEQ ID NO: 336525 - RNA, 32 nt, Human
auggcauuaccuccguguuucucccuuucgag

SEQ ID NO: 336526 - RNA, 31 nt, Human
auggcauucaauaaacauauguugaaagaau

SEQ ID NO: 336527 - RNA, 32 nt, Human
auggcauucuguagguuuauagaagguuuagc

SEQ ID NO: 336528 - RNA, 32 nt, Human
auggcauugcucagcaacuacuucucccuucc

SEQ ID NO: 336529 - RNA, 19 nt, Human
auggcauuugcauuuucua

SEQ ID NO: 336530 - RNA, 32 nt, Human
auggcauuugucugucucugugucaaagcacu

SEQ ID NO: 336531 - RNA, 32 nt, Human
auggccaaaacaauccagggauuguuaagugc

SEQ ID NO: 336532 - RNA, 32 nt, Human
auggccaacaaaacaugaaacaccuugaaccc

SEQ ID NO: 336533 - RNA, 32 nt, Human
auggccaacaugguaagacccugucucuacua

SEQ ID NO: 336534 - RNA, 31 nt, Human
auggccaacauggugaagccccaucucuacu

SEQ ID NO: 336535 - RNA, 32 nt, Human
auggccaaccuccaccuuccccucucucagcc

SEQ ID NO: 336536 - RNA, 32 nt, Human
auggccaagcugcugggcucuguaucucccac

SEQ ID NO: 336537 - RNA, 32 nt, Human
auggccaauauuuugaaggucuucccaacccu

SEQ ID NO: 336538 - RNA, 32 nt, Human
auggccacaagugcccacagcuggccccaggu

SEQ ID NO: 336539 - RNA, 32 nt, Human
auggccacaaguucuuucccagccucuuccau

SEQ ID NO: 336540 - RNA, 32 nt, Human
auggccacagacaaucugccgucuccuggaaa

SEQ ID NO: 336541 - RNA, 32 nt, Human
auggccacaguacagucugguccuuuuccuuc

SEQ ID NO: 336542 - RNA, 32 nt, Human
auggccaccauccuggguauccagggccccuc

SEQ ID NO: 336543 - RNA, 32 nt, Human
auggccaccccugccaagguuugcuucucuuu

SEQ ID NO: 336544 - RNA, 32 nt, Human
auggccacuaccccacuguuugcucuccugca

SEQ ID NO: 336545 - RNA, 22 nt, Human
auggccagagggccucagggag

SEQ ID NO: 336546 - RNA, 32 nt, Human
auggccaggaaagaagccagcacaggguuaaa

SEQ ID NO: 336547 - RNA, 32 nt, Human
auggccaggagaagggccaggggaauagagcu

SEQ ID NO: 336548 - RNA, 32 nt, Human
auggccagguguacugggugaccaugggcacc

SEQ ID NO: 336549 - RNA, 32 nt, Human
auggccagguucucacacuggcccagagaaaa

SEQ ID NO: 336550 - RNA, 32 nt, Human
auggccaguaaacugagcaagggccuuggaau

SEQ ID NO: 336551 - RNA, 32 nt, Human
auggccaguauggugaaacccugucucuccua

SEQ ID NO: 336552 - RNA, 32 nt, Human
auggccagugaccgcuuucucccuucaagaaa

SEQ ID NO: 336553 - RNA, 32 nt, Human
auggccagugcaagauugcaaaaagacugugc

SEQ ID NO: 336554 - RNA, 32 nt, Human
auggccagugcacuccaaugaugggacaggcc

SEQ ID NO: 336555 - RNA, 32 nt, Human
auggccagugggacuaguguucccuccaucug

SEQ ID NO: 336556 - RNA, 23 nt, Human
auggccaguugauugguuuucua

SEQ ID NO: 336557 - RNA, 32 nt, Human
auggccauagauuugccuugugguguuggauc

SEQ ID NO: 336558 - RNA, 31 nt, Human
auggccauaguacuuuaccuguugaacucuu

SEQ ID NO: 336559 - RNA, 32 nt, Human
auggccauaguuugagccacagagaaagccaa

SEQ ID NO: 336560 - RNA, 32 nt, Human
auggccaugacucuguguaagacagagggcac

SEQ ID NO: 336561 - RNA, 32 nt, Human
auggccaugcugggcuggaguggcuguggggu

SEQ ID NO: 336562 - RNA, 32 nt, Human
auggccaugggcagaggcgaagggcugguggg

SEQ ID NO: 336563 - RNA, 32 nt, Human
auggccauucacccccaggccuggugcuucuc

SEQ ID NO: 336564 - RNA, 32 nt, Human
auggcccaacagcaaacaaaugauggggccac

SEQ ID NO: 336565 - RNA, 32 nt, Human
auggcccaaucagcaugcacuuccucccuucu

SEQ ID NO: 336566 - RNA, 32 nt, Human
auggcccaccagcccaucccagaucuuccuuu

SEQ ID NO: 336567 - RNA, 32 nt, Human
auggcccacccaggccuggagcugggaugcaa

SEQ ID NO: 336568 - RNA, 32 nt, Human
auggcccacuccaaauacgaagugagauccug

SEQ ID NO: 336569 - RNA, 32 nt, Human
auggcccacuggccuuuuucucccccacguca

SEQ ID NO: 336570 - RNA, 32 nt, Human
auggcccagagaggagcucaugugucuaaagu

SEQ ID NO: 336571 - RNA, 32 nt, Human
auggcccagcagacgagacagcaaagaccaag

SEQ ID NO: 336572 - RNA, 32 nt, Human
auggcccagccacugcagcacaggaggcuccg

SEQ ID NO: 336573 - RNA, 32 nt, Human
auggcccagggguguugaggccagcggugaga

SEQ ID NO: 336574 - RNA, 28 nt, Human
auggccccaauucuugccucauccuaug

SEQ ID NO: 336575 - RNA, 32 nt, Human
auggccccacccucaccagccugggcagcagc

SEQ ID NO: 336576 - RNA, 32 nt, Human
auggcccccuccacauaucucagccauuuugc

SEQ ID NO: 336577 - RNA, 28 nt, Human
auggcccccuccgugauccauccaucuc

SEQ ID NO: 336578 - RNA, 32 nt, Human
auggcccccuuagagaccacaggugaugucug

SEQ ID NO: 336579 - RNA, 32 nt, Human
auggccccugggcuggagcccccauggccagc

SEQ ID NO: 336580 - RNA, 32 nt, Human
auggccccugucuuguuuggggagaggggaac

SEQ ID NO: 336581 - RNA, 32 nt, Human
auggccccuguggucugcuuguccuucagccc

SEQ ID NO: 336582 - RNA, 32 nt, Human
auggcccgcaguggcuuuugccccagaaaggg

SEQ ID NO: 336583 - RNA, 32 nt, Human
auggcccgcgcugcgcuccgaggucccgcgcc

SEQ ID NO: 336584 - RNA, 32 nt, Human
auggcccuagcagccaguacagugcccugucu

SEQ ID NO: 336585 - RNA, 32 nt, Human
auggcccuauggcacaguuccacccacagagu

SEQ ID NO: 336586 - RNA, 32 nt, Human
auggcccucccucuccccugacgcacccuccc

SEQ ID NO: 336587 - RNA, 23 nt, Human
auggcccucuugcagaucuucug

SEQ ID NO: 336588 - RNA, 32 nt, Human
auggcccugccuggaccccauggaggccgaau

SEQ ID NO: 336589 - RNA, 32 nt, Human
auggcccugggacacccacagcugcagcaggu

SEQ ID NO: 336590 - RNA, 32 nt, Human
auggccggagcagacacuacagucuucaccag

SEQ ID NO: 336591 - RNA, 32 nt, Human
auggccggcgugagccaccaugcccggcucca

SEQ ID NO: 336592 - RNA, 32 nt, Human
auggccgggcuggggcaucuuucccuccuugg

SEQ ID NO: 336593 - RNA, 32 nt, Human
auggccggggccugaguggacgugaggcaccg

SEQ ID NO: 336594 - RNA, 32 nt, Human
auggccuaauuuucaccuuugcacccaguuga

SEQ ID NO: 336595 - RNA, 32 nt, Human
auggccucacuuuauugaagugcaaaauaaac

SEQ ID NO: 336596 - RNA, 24 nt, Human
auggccucagcugcagaucuccug

SEQ ID NO: 336597 - RNA, 32 nt, Human
auggccucagggccuggugaagucugcuacuc

SEQ ID NO: 336598 - RNA, 28 nt, Human
auggccucaggugugauccgcccgccuc

SEQ ID NO: 336599 - RNA, 32 nt, Human
auggccucagugccuccauaaaaagcuuaagu

SEQ ID NO: 336600 - RNA, 32 nt, Human
auggccucauugguaucagcacucuggccugc

SEQ ID NO: 336601 - RNA, 32 nt, Human
auggccuccagaggaggggugguguccuucuc

SEQ ID NO: 336602 - RNA, 32 nt, Human
auggccuccagccaggcaccugggcgucccuu

SEQ ID NO: 336603 - RNA, 32 nt, Human
auggccucccaaagugcugggauuacaggcgu

SEQ ID NO: 336604 - RNA, 32 nt, Human
auggccucccaaagugcugggauuacaggcuc

SEQ ID NO: 336605 - RNA, 32 nt, Human
auggccucggacaggcagaggcugugaaauac

SEQ ID NO: 336606 - RNA, 32 nt, Human
auggccucugcaagccucuccuccaccuucac

SEQ ID NO: 336607 - RNA, 32 nt, Human
auggccucugcacuccagccugggugacagag

SEQ ID NO: 336608 - RNA, 32 nt, Human
auggccucugcagauuuuccugaacuucugcu

SEQ ID NO: 336609 - RNA, 32 nt, Human
auggccugaagaugcagggcagaggaauugcc

SEQ ID NO: 336610 - RNA, 32 nt, Human
auggccugaagcaagugaagaaucacaaaaga

SEQ ID NO: 336611 - RNA, 32 nt, Human
auggccugaagcaaguggagaaucacaaaaga

SEQ ID NO: 336612 - RNA, 32 nt, Human
auggccugaccaggaacuacugcaggaaucca

SEQ ID NO: 336613 - RNA, 32 nt, Human
auggccugcacccuccugcagugcaguugcug

SEQ ID NO: 336614 - RNA, 32 nt, Human
auggccugccaagaguugcaggagacccagga

SEQ ID NO: 336615 - RNA, 32 nt, Human
auggccugcuaccuagcaugugucuagcucaa

SEQ ID NO: 336616 - RNA, 32 nt, Human
auggccugggaggccagaaugaaguggguauu

SEQ ID NO: 336617 - RNA, 32 nt, Human
auggccugggagguugguuugggauugggguu

SEQ ID NO: 336618 - RNA, 32 nt, Human
auggccugggggccaagccucacccugcggug

SEQ ID NO: 336619 - RNA, 21 nt, Human
auggccuggugcccccaccug

SEQ ID NO: 336620 - RNA, 32 nt, Human
auggccuguagcaaugaggcugugcauuccua

SEQ ID NO: 336621 - RNA, 32 nt, Human
auggccuuagccuuugaaaauauuuuaaaaua

SEQ ID NO: 336622 - RNA, 32 nt, Human
auggccuucuuagagcagagagaggaguaugu

SEQ ID NO: 336623 - RNA, 32 nt, Human
auggccuucuucccugcuaccucucuuccugg

SEQ ID NO: 336624 - RNA, 32 nt, Human
auggccuuggaaauggggccagggcaggccca

SEQ ID NO: 336625 - RNA, 32 nt, Human
auggccuugugucccucgggcaugacaggcag

SEQ ID NO: 336626 - RNA, 32 nt, Human
auggccuuuauuucuccucuuccagugggagu

SEQ ID NO: 336627 - RNA, 32 nt, Human
auggcgacaggucauuuuaugaccuggaggca

SEQ ID NO: 336628 - RNA, 32 nt, Human
auggcgagcaccuugcaggcagccuucugauc

SEQ ID NO: 336629 - RNA, 32 nt, Human
auggcgagcauccuggccaacauggugaaacc

SEQ ID NO: 336630 - RNA, 32 nt, Human
auggcgccacuacacuccagccugggcaacag

SEQ ID NO: 336631 - RNA, 32 nt, Human
auggcgccacuacacuccagccugggcgacag

SEQ ID NO: 336632 - RNA, 32 nt, Human
auggcgccacugcacuccagcccgggcgacag

SEQ ID NO: 336633 - RNA, 32 nt, Human
auggcgccacugcacuccagccuaggcaacag

SEQ ID NO: 336634 - RNA, 32 nt, Human
auggcgccacugcacuccagccugagugacag

SEQ ID NO: 336635 - RNA, 32 nt, Human
auggcgccacugcacuccagccugggcgacag

SEQ ID NO: 336636 - RNA, 32 nt, Human
auggcgccacugcacuccagccugggcgucag

SEQ ID NO: 336637 - RNA, 32 nt, Human
auggcgccacugcacuccagccuggguaacag

SEQ ID NO: 336638 - RNA, 32 nt, Human
auggcgccacugcacuccagccugggugacag

SEQ ID NO: 336639 - RNA, 32 nt, Human
auggcgccacugcacuccagccugggugagag

SEQ ID NO: 336640 - RNA, 32 nt, Human
auggcgccacugcacuccagucugggcaacag

SEQ ID NO: 336641 - RNA, 32 nt, Human
auggcgccacugcacuccagucugggcgauag

SEQ ID NO: 336642 - RNA, 32 nt, Human
auggcgccacugcacucccgucugggggagag

SEQ ID NO: 336643 - RNA, 32 nt, Human
auggcgccacugcacuucagccuuggagacag

SEQ ID NO: 336644 - RNA, 32 nt, Human
auggcgccacugcauuccagccugggcaacag

SEQ ID NO: 336645 - RNA, 32 nt, Human
auggcgccacugcgcuccagccugggcaacag

SEQ ID NO: 336646 - RNA, 32 nt, Human
auggcgccacuucacugcagccuggguggcag

SEQ ID NO: 336647 - RNA, 32 nt, Human
auggcgccauugcacuccagccugggcaaaaa

SEQ ID NO: 336648 - RNA, 32 nt, Human
auggcgccauugcacuccagccugggugacaa

SEQ ID NO: 336649 - RNA, 32 nt, Human
auggcgccauuucacuccagccugggcgacag

SEQ ID NO: 336650 - RNA, 32 nt, Human
auggcgcccagccugggccaaccuuuucugag

SEQ ID NO: 336651 - RNA, 32 nt, Human
auggcgcgacugcacuccagccugggcgagag

SEQ ID NO: 336652 - RNA, 32 nt, Human
auggcgcuauugcacuccagucuggguaacag

SEQ ID NO: 336653 - RNA, 32 nt, Human
auggcgcuccgauccccuccucccucucuccg

SEQ ID NO: 336654 - RNA, 32 nt, Human
auggcgcugcugcacucaagcuuggaugacag

SEQ ID NO: 336655 - RNA, 32 nt, Human
auggcggaaagaaggcaccagggcacagugga

SEQ ID NO: 336656 - RNA, 32 nt, Human
auggcggaacccugucucuaccaaaauuacaa

SEQ ID NO: 336657 - RNA, 25 nt, Human
auggcggcagcggugcugacggacc

SEQ ID NO: 336658 - RNA, 32 nt, Human
auggcggcccugucuucuuggcccuggcacug

SEQ ID NO: 336659 - RNA, 25 nt, Human
auggcggccucucagguccuggggg

SEQ ID NO: 336660 - RNA, 22 nt, Human
auggcggcucacgccuguaauc

SEQ ID NO: 336661 - RNA, 32 nt, Human
auggcgggaacccaggaggcagagguugcagu

SEQ ID NO: 336662 - RNA, 32 nt, Human
auggcgggaaccugggaggcggagcuuacagu

SEQ ID NO: 336663 - RNA, 32 nt, Human
auggcgggagagaagaagcgcaggcacaggaa

SEQ ID NO: 336664 - RNA, 32 nt, Human
auggcgggcuucagccagaccugcugagaccu

SEQ ID NO: 336665 - RNA, 32 nt, Human
auggcggggaaagaggcaaggagcagaguccu

SEQ ID NO: 336666 - RNA, 32 nt, Human
auggcggggaggaggaggagaaggcggcggcg

SEQ ID NO: 336667 - RNA, 32 nt, Human
auggcgguggagguggugguuguagugugaug

SEQ ID NO: 336668 - RNA, 32 nt, Human
auggcguccugcccuugcuccagccugacaac

SEQ ID NO: 336669 - RNA, 32 nt, Human
auggcgucuuagucaucuccccagugugcccu

SEQ ID NO: 336670 - RNA, 32 nt, Human
auggcgugaacccagcgggaagagguugcagu

SEQ ID NO: 336671 - RNA, 32 nt, Human
auggcgugaacccaggaggcagagcuugcagu

SEQ ID NO: 336672 - RNA, 32 nt, Human
auggcgugaacccaggaggcagagguugcagu

SEQ ID NO: 336673 - RNA, 32 nt, Human
auggcgugaacccaggaggcggagguugcagu

SEQ ID NO: 336674 - RNA, 32 nt, Human
auggcgugaacccaggagguggagcuugcagu

SEQ ID NO: 336675 - RNA, 31 nt, Human
auggcgugacuucucgugcacagggcugguu

SEQ ID NO: 336676 - RNA, 32 nt, Human
auggcgugagccaccguaccuggccauauuuu

SEQ ID NO: 336677 - RNA, 32 nt, Human
auggcgugagccacuguaccuggccauauuuu

SEQ ID NO: 336678 - RNA, 32 nt, Human
auggcguggcagcugcgugaauaccaggagcu

SEQ ID NO: 336679 - RNA, 32 nt, Human
auggcguggccuuaucgauugcagugggaagu

SEQ ID NO: 336680 - RNA, 31 nt, Human
auggcguggcucagcugucuguugaaguugu

SEQ ID NO: 336681 - RNA, 32 nt, Human
auggcgugguuauguggaguuguaucucuauc

SEQ ID NO: 336682 - RNA, 32 nt, Human
auggcguucccugagccuguuccccaacugug

SEQ ID NO: 336683 - RNA, 32 nt, Human
auggcguucgccgggcuggagcgaguacauua

SEQ ID NO: 336684 - RNA, 32 nt, Human
auggcuaacauggugaaaccccaucucuacua

SEQ ID NO: 336685 - RNA, 32 nt, Human
auggcuaauaauauucaggaccucuuuaugug

SEQ ID NO: 336686 - RNA, 21 nt, Human
auggcuagaagagaccugcca

SEQ ID NO: 336687 - RNA, 32 nt, Human
auggcuaguuaggaagaaaggaggugggauaa

SEQ ID NO: 336688 - RNA, 30 nt, Human
auggcuauucuguagacagaaagacaacag

SEQ ID NO: 336689 - RNA, 25 nt, Human
auggcucaauuuggaggacagaaga

SEQ ID NO: 336690 - RNA, 32 nt, Human
auggcucacaccuguaucccaacacuuuggga

SEQ ID NO: 336691 - RNA, 30 nt, Human
auggcucacgccuguagucccagagcuuug

SEQ ID NO: 336692 - RNA, 32 nt, Human
auggcucacucacuuuucuauuuuggaauuac

SEQ ID NO: 336693 - RNA, 32 nt, Human
auggcucacugcaaccuccaccuccuggguuc

SEQ ID NO: 336694 - RNA, 32 nt, Human
auggcucacugcaaccucugccucccgguuuc

SEQ ID NO: 336695 - RNA, 32 nt, Human
auggcucacugcaaccuugaccucccaggcuc

SEQ ID NO: 336696 - RNA, 32 nt, Human
auggcucacugcaaccuugacgucccagguuc

SEQ ID NO: 336697 - RNA, 32 nt, Human
auggcucacugcagccccaaccuucagggcuc

SEQ ID NO: 336698 - RNA, 32 nt, Human
auggcucacugcagccccgaacuacugggcuc

SEQ ID NO: 336699 - RNA, 32 nt, Human
auggcucacugcagccucaaccucccaggcuc

SEQ ID NO: 336700 - RNA, 32 nt, Human
auggcucacugcagccucaaccugcugggcuc

SEQ ID NO: 336701 - RNA, 32 nt, Human
auggcucacugcagccuccaccucccaggcuc

SEQ ID NO: 336702 - RNA, 32 nt, Human
auggcucacugcagccuccaccuccuugacuc

SEQ ID NO: 336703 - RNA, 32 nt, Human
auggcucacugcagccucgaacuccugggcuc

SEQ ID NO: 336704 - RNA, 32 nt, Human
auggcucacugcagccucgacaccuggguuca

SEQ ID NO: 336705 - RNA, 32 nt, Human
auggcucacugcagccucgaccucccaggcuc

SEQ ID NO: 336706 - RNA, 32 nt, Human
auggcucacugcagccuugaacucccagacuc

SEQ ID NO: 336707 - RNA, 32 nt, Human
auggcucacugcagccuugaacuccugagcuc

SEQ ID NO: 336708 - RNA, 32 nt, Human
auggcucacugcagccuugaccuuccagccug

SEQ ID NO: 336709 - RNA, 32 nt, Human
auggcucacugcagccuugacuucucaggcuu

SEQ ID NO: 336710 - RNA, 32 nt, Human
auggcucacugcagucucaaucucucuggcuc

SEQ ID NO: 336711 - RNA, 32 nt, Human
auggcucacugcagucucugccucccaggcuc

SEQ ID NO: 336712 - RNA, 32 nt, Human
auggcucacugcaguuucaaccucccagauuc

SEQ ID NO: 336713 - RNA, 32 nt, Human
auggcucacuguagccacaaccucucaggcuc

SEQ ID NO: 336714 - RNA, 32 nt, Human
auggcucagcacuugcucaucuuggauggcuu

SEQ ID NO: 336715 - RNA, 32 nt, Human
auggcucaggggcaaugugagguguguugcca

SEQ ID NO: 336716 - RNA, 32 nt, Human
auggcucagguguggagaaggguuucagaaca

SEQ ID NO: 336717 - RNA, 24 nt, Human
auggcucaugccuguaaucccagc

SEQ ID NO: 336718 - RNA, 32 nt, Human
auggcuccaaagguuaaaugaagcaggaaaaa

SEQ ID NO: 336719 - RNA, 32 nt, Human
auggcuccagcaccaucugccucugcaguucu

SEQ ID NO: 336720 - RNA, 32 nt, Human
auggcuccaugcucaccagccucgccgaggag

SEQ ID NO: 336721 - RNA, 32 nt, Human
auggcucccacuccucccuccuuucacuucuc

SEQ ID NO: 336722 - RNA, 32 nt, Human
auggcuccccuggaacaggagggagagccaag

SEQ ID NO: 336723 - RNA, 32 nt, Human
auggcucccucaggaagaagcucuggaguggg

SEQ ID NO: 336724 - RNA, 32 nt, Human
auggcucccugaccacccaacucugaaacaau

SEQ ID NO: 336725 - RNA, 32 nt, Human
auggcuccuccucuuccuucugcuccaagaag

SEQ ID NO: 336726 - RNA, 32 nt, Human
auggcucuaaucucacacauuuacuuacuaaa

SEQ ID NO: 336727 - RNA, 32 nt, Human
auggcucuagcugggcugccugggugagaugc

SEQ ID NO: 336728 - RNA, 20 nt, Human
auggcucucaccauuuccua

SEQ ID NO: 336729 - RNA, 32 nt, Human
auggcucuccacccagcccgcuccugacccuu

SEQ ID NO: 336730 - RNA, 32 nt, Human
auggcucucccuccucccuccccauuucauug

SEQ ID NO: 336731 - RNA, 32 nt, Human
auggcucugagcucccugaggugggggcgagg

SEQ ID NO: 336732 - RNA, 32 nt, Human
auggcucugcaccagccggcccccaggagguc

SEQ ID NO: 336733 - RNA, 32 nt, Human
auggcucugucaaugucaggcccgagaacagc

SEQ ID NO: 336734 - RNA, 32 nt, Human
auggcucugucucuccugcuucuuuaaccuga

SEQ ID NO: 336735 - RNA, 32 nt, Human
auggcucuguggacaccaggaggucagggcac

SEQ ID NO: 336736 - RNA, 32 nt, Human
auggcucuguggcuggagugcagccauccagu

SEQ ID NO: 336737 - RNA, 32 nt, Human
auggcucuuucuauccugcucuucuguugaaa

SEQ ID NO: 336738 - RNA, 32 nt, Human
auggcugaacugggggcccacuguggagagcu

SEQ ID NO: 336739 - RNA, 32 nt, Human
auggcugaagacagaaucuagagccuucaaau

SEQ ID NO: 336740 - RNA, 32 nt, Human
auggcugaaggcggaggugcagggcagcgggg

SEQ ID NO: 336741 - RNA, 32 nt, Human
auggcugaaguuggccaccuugcuugagggac

SEQ ID NO: 336742 - RNA, 32 nt, Human
auggcugaccguggcccagccucugcaacagc

SEQ ID NO: 336743 - RNA, 32 nt, Human
auggcugacuuccucacuauccucuucacaug

SEQ ID NO: 336744 - RNA, 32 nt, Human
auggcugagacaccuaguccuccaggcacuga

SEQ ID NO: 336745 - RNA, 32 nt, Human
auggcugagagccaggcuuccuuccuggucuc

SEQ ID NO: 336746 - RNA, 32 nt, Human
auggcugagaugaccugguccuaggacacccu

SEQ ID NO: 336747 - RNA, 32 nt, Human
auggcugagggagggggcuaagagaggagcaa

SEQ ID NO: 336748 - RNA, 32 nt, Human
auggcugauguggcauuuaagggaagagagug

SEQ ID NO: 336749 - RNA, 32 nt, Human
auggcugcacucuagccugggugacaguguga

SEQ ID NO: 336750 - RNA, 32 nt, Human
auggcugcagcccucgaccuccugggcucaag

SEQ ID NO: 336751 - RNA, 32 nt, Human
auggcugcagugccagccuggggcagcaggua

SEQ ID NO: 336752 - RNA, 32 nt, Human
auggcugcaguggaugugggaaagccuacagu

SEQ ID NO: 336753 - RNA, 32 nt, Human
auggcugccaacucccaaucucccaggaaggc

SEQ ID NO: 336754 - RNA, 32 nt, Human
auggcugccaucaagccuuuucuggauccagc

SEQ ID NO: 336755 - RNA, 32 nt, Human
auggcugccuguaaucccagcacuuugggagg

SEQ ID NO: 336756 - RNA, 32 nt, Human
auggcugcgccaagcccuucgucuucacccag

SEQ ID NO: 336757 - RNA, 32 nt, Human
auggcugcuaucaauucuuccuuucccuaugu

SEQ ID NO: 336758 - RNA, 32 nt, Human
auggcugcucagacuggcauccaggcuuugcu

SEQ ID NO: 336759 - RNA, 32 nt, Human
auggcugcucuaucuugggcuguaucaaggga

SEQ ID NO: 336760 - RNA, 32 nt, Human
auggcugcuuagagucagccuggguggcacca

SEQ ID NO: 336761 - RNA, 32 nt, Human
auggcugcuugccuggcccaaccuagcguucu

SEQ ID NO: 336762 - RNA, 32 nt, Human
auggcuggaauagaauagaaacuuccaaaauu

SEQ ID NO: 336763 - RNA, 32 nt, Human
auggcuggacaugggugggcucugaugcagaa

SEQ ID NO: 336764 - RNA, 32 nt, Human
auggcuggccugagcccaucucagccuccugc

SEQ ID NO: 336765 - RNA, 32 nt, Human
auggcugggaagagaggaggaguggcagaaga

SEQ ID NO: 336766 - RNA, 32 nt, Human
auggcugggcaggcacaggcagugaggccgag

SEQ ID NO: 336767 - RNA, 32 nt, Human
auggcuggggagagguggaggcugacagcuga

SEQ ID NO: 336768 - RNA, 32 nt, Human
auggcuggggagcagcaaagcaguucauuagg

SEQ ID NO: 336769 - RNA, 21 nt, Human
auggcuggggccgcugggguc

SEQ ID NO: 336770 - RNA, 32 nt, Human
auggcuggggcucuugagcuauaaguggcacc

SEQ ID NO: 336771 - RNA, 32 nt, Human
auggcugggucucccccuaccucuuccagcuc

SEQ ID NO: 336772 - RNA, 32 nt, Human
auggcugguggcagagguagaaaggacauugg

SEQ ID NO: 336773 - RNA, 28 nt, Human
auggcuguaagugcuggccucauuucgc

SEQ ID NO: 336774 - RNA, 32 nt, Human
auggcugugacccugggcugacccgcccagug

SEQ ID NO: 336775 - RNA, 32 nt, Human
auggcugugacggauaagggguguggggugcg

SEQ ID NO: 336776 - RNA, 32 nt, Human
auggcuguggugagcaacugaacgagccuacg

SEQ ID NO: 336777 - RNA, 32 nt, Human
auggcuguguguggaauugcuugccaaagaag

SEQ ID NO: 336778 - RNA, 32 nt, Human
auggcuuaacacaacagaaacuuauuugcuua

SEQ ID NO: 336779 - RNA, 32 nt, Human
auggcuuagcccaagugggaggcugccugauu

SEQ ID NO: 336780 - RNA, 32 nt, Human
auggcuuaguuuucauacacagccugggcugg

SEQ ID NO: 336781 - RNA, 32 nt, Human
auggcuuauuuccuuugccaucagggcuuucc

SEQ ID NO: 336782 - RNA, 32 nt, Human
auggcuucaagggaaacucccacccucaauau

SEQ ID NO: 336783 - RNA, 32 nt, Human
auggcuucaguuaucacuuuugggugucugua

SEQ ID NO: 336784 - RNA, 32 nt, Human
auggcuuccaucuccaacagaacacaaggucg

SEQ ID NO: 336785 - RNA, 32 nt, Human
auggcuuccauuuggcuguuucuaaguuguau

SEQ ID NO: 336786 - RNA, 25 nt, Human
auggcuucccaggaguuugagguug

SEQ ID NO: 336787 - RNA, 32 nt, Human
auggcuucuaaaguaguccuaagaacaugguu

SEQ ID NO: 336788 - RNA, 32 nt, Human
auggcuucucagggcaugccacaaguuaaagg

SEQ ID NO: 336789 - RNA, 32 nt, Human
auggcuucucauuaugggagcacuugguuaaa

SEQ ID NO: 336790 - RNA, 32 nt, Human
auggcuucucccgacccucuggcugccccggu

SEQ ID NO: 336791 - RNA, 32 nt, Human
auggcuugaacccaagagguggaggcugaagu

SEQ ID NO: 336792 - RNA, 32 nt, Human
auggcuugaacccagcagauggagguugcagu

SEQ ID NO: 336793 - RNA, 32 nt, Human
auggcuugaacccaggaggcagagguugcagu

SEQ ID NO: 336794 - RNA, 32 nt, Human
auggcuugaacccaggagguggagguugcggu

SEQ ID NO: 336795 - RNA, 32 nt, Human
auggcuugaaccccagaggcggagguugcagu

SEQ ID NO: 336796 - RNA, 32 nt, Human
auggcuugaacccggaaggcggagcuugcagu

SEQ ID NO: 336797 - RNA, 32 nt, Human
auggcuugaacccgggaggcagagguugcagu

SEQ ID NO: 336798 - RNA, 32 nt, Human
auggcuugaacccgggaggcagagguugcugu

SEQ ID NO: 336799 - RNA, 32 nt, Human
auggcuugaacccgggaggcggagcuugcagu

SEQ ID NO: 336800 - RNA, 32 nt, Human
auggcuugaacccgggaggcggagguugcagu

SEQ ID NO: 336801 - RNA, 32 nt, Human
auggcuugaacccgggagguggagguugcagu

SEQ ID NO: 336802 - RNA, 32 nt, Human
auggcuugagcccaggagguggagguugcagu

SEQ ID NO: 336803 - RNA, 32 nt, Human
auggcuugagcccaggagguugaggcugcagu

SEQ ID NO: 336804 - RNA, 32 nt, Human
auggcuugagugugugaauaugaugugugcac

SEQ ID NO: 336805 - RNA, 32 nt, Human
auggcuugggccagaagcacuugugugucacc

SEQ ID NO: 336806 - RNA, 32 nt, Human
auggcuuggugucuuucuuguuucauggcugu

SEQ ID NO: 336807 - RNA, 32 nt, Human
auggcuugugugaaaacugagcagguguuugu

SEQ ID NO: 336808 - RNA, 32 nt, Human
auggcuuucuguagccacaccugugaggcgug

SEQ ID NO: 336809 - RNA, 32 nt, Human
auggcuuucuguagucuuuagcaagacacaag

SEQ ID NO: 336810 - RNA, 32 nt, Human
auggcuuugcaagaagaugacauuucagaaga

SEQ ID NO: 336811 - RNA, 32 nt, Human
auggcuuuggaaggcggaguucaggcugagga

SEQ ID NO: 336812 - RNA, 32 nt, Human
auggcuuuuaucuaccaucaaccugauaaggc

SEQ ID NO: 336813 - RNA, 32 nt, Human
auggcuuuuauuccuuuccacauuuccuaugu

SEQ ID NO: 336814 - RNA, 32 nt, Human
augggaaaaauguccagaaagccauguuccug

SEQ ID NO: 336815 - RNA, 32 nt, Human
augggaaaacugccaauauagaaaaauaaaaa

SEQ ID NO: 336816 - RNA, 32 nt, Human
augggaaaauucagauauuuucuuaguagugc

SEQ ID NO: 336817 - RNA, 21 nt, Human
augggaaacauccauuugcuu

SEQ ID NO: 336818 - RNA, 32 nt, Human
augggaaagacacccucagaggcacaagauuc

SEQ ID NO: 336819 - RNA, 32 nt, Human
augggaaagcacaguguccucuaaagaaacuu

SEQ ID NO: 336820 - RNA, 32 nt, Human
augggaaagcgaagaagagaagagggaugugu

SEQ ID NO: 336821 - RNA, 32 nt, Human
augggaaagcugaucuauaaagaggcauucug

SEQ ID NO: 336822 - RNA, 32 nt, Human
augggaaagggaggguaggaagagggagaagu

SEQ ID NO: 336823 - RNA, 32 nt, Human
augggaaaguuccugguacugaagggguccau

SEQ ID NO: 336824 - RNA, 32 nt, Human
augggaaauagcccuggauuggguagugggug

SEQ ID NO: 336825 - RNA, 32 nt, Human
augggaaauaggggacaguaagcacaaugccc

SEQ ID NO: 336826 - RNA, 23 nt, Human
augggaacaacagacacugggga

SEQ ID NO: 336827 - RNA, 32 nt, Human
augggaacaagugcccucagcaagaagccgug

SEQ ID NO: 336828 - RNA, 32 nt, Human
augggaaccuagaagagaggggauaccagguu

SEQ ID NO: 336829 - RNA, 32 nt, Human
augggaacgaggcagaggaaauagagaaauuu

SEQ ID NO: 336830 - RNA, 32 nt, Human
augggaacgcagcccuccucaguggcaccugg

SEQ ID NO: 336831 - RNA, 32 nt, Human
augggaacggcagaggcuggcaggugacugaa

SEQ ID NO: 336832 - RNA, 32 nt, Human
augggaacugccucuuuccuguuguuguuaau

SEQ ID NO: 336833 - RNA, 32 nt, Human
augggaagaagcaggagcccugucuggcugua

SEQ ID NO: 336834 - RNA, 32 nt, Human
augggaagaaggaggaauggagggucagggcu

SEQ ID NO: 336835 - RNA, 32 nt, Human
augggaagaaggcagaaggcccaggggcuuug

SEQ ID NO: 336836 - RNA, 32 nt, Human
augggaagaaguaguccucucuuccuucuccu

SEQ ID NO: 336837 - RNA, 32 nt, Human
augggaagaccucacaucucagagcucaucua

SEQ ID NO: 336838 - RNA, 32 nt, Human
augggaagagaacugggcugacuccaggaccu

SEQ ID NO: 336839 - RNA, 32 nt, Human
augggaagagcagaaggccuuggugggggugg

SEQ ID NO: 336840 - RNA, 32 nt, Human
augggaagaucacuugagcucaggaguaugag

SEQ ID NO: 336841 - RNA, 32 nt, Human
augggaagaugugacagaaccaggacacuacu

SEQ ID NO: 336842 - RNA, 32 nt, Human
augggaagccuccucagcguggguucuuggaa

SEQ ID NO: 336843 - RNA, 22 nt, Human
augggaagcucucacuaaaaca

SEQ ID NO: 336844 - RNA, 32 nt, Human
augggaagcugaggcaggagaaucaccugaac

SEQ ID NO: 336845 - RNA, 32 nt, Human
augggaaggaacccccucaccaccugcccggc

SEQ ID NO: 336846 - RNA, 32 nt, Human
augggaaggagaagcaguggcuuuugugggca

SEQ ID NO: 336847 - RNA, 32 nt, Human
augggaagggugaggaagggcuggggccaguc

SEQ ID NO: 336848 - RNA, 32 nt, Human
augggaagugaagccaaccgaggcagaggugg

SEQ ID NO: 336849 - RNA, 32 nt, Human
augggaagugugagacacuggaaggcaagaaa

SEQ ID NO: 336850 - RNA, 32 nt, Human
augggaaguuaggaaagauaugggaagaaugg

SEQ ID NO: 336851 - RNA, 32 nt, Human
augggaaguugcaugcugccuccuggguuuua

SEQ ID NO: 336852 - RNA, 32 nt, Human
augggaaguuguuccuuugcucucucgcgccc

SEQ ID NO: 336853 - RNA, 32 nt, Human
augggaaucaggcaugugucccuuccaagcug

SEQ ID NO: 336854 - RNA, 32 nt, Human
augggaaugggguuuggagcagcccugccccu

SEQ ID NO: 336855 - RNA, 32 nt, Human
augggacaaaggacauuuguuggagggguggg

SEQ ID NO: 336856 - RNA, 32 nt, Human
augggacaaaggacggaggucuaggaagaggg

SEQ ID NO: 336857 - RNA, 32 nt, Human
augggacaagaagcugagucucagagagagaa

SEQ ID NO: 336858 - RNA, 32 nt, Human
augggacaagggaggcagagucuggaguuacg

SEQ ID NO: 336859 - RNA, 32 nt, Human
augggacacagcaggacaggaacgguuccagu

SEQ ID NO: 336860 - RNA, 32 nt, Human
augggacacauggucugucaaugagagcauaa

SEQ ID NO: 336861 - RNA, 32 nt, Human
augggacacuccuuuucuguuccucaguuguc

SEQ ID NO: 336862 - RNA, 32 nt, Human
augggacacugcagauaaaaucacaaaaacca

SEQ ID NO: 336863 - RNA, 32 nt, Human
augggacacuugacagugacuugaaacauuug

SEQ ID NO: 336864 - RNA, 31 nt, Human
augggacacuuuuucugaaugaagagauuga

SEQ ID NO: 336865 - RNA, 32 nt, Human
augggacagagugacauuucuccucugugcgg

SEQ ID NO: 336866 - RNA, 32 nt, Human
augggacaggaaauuuuccaagacgcuuuugg

SEQ ID NO: 336867 - RNA, 32 nt, Human
augggacaggaggccaaacacaucucaguaug

SEQ ID NO: 336868 - RNA, 32 nt, Human
augggacaugcagccauguuggaaagcaguuu

SEQ ID NO: 336869 - RNA, 32 nt, Human
augggaccacuucuagaaaucuuucagcuguc

SEQ ID NO: 336870 - RNA, 22 nt, Human
augggaccaggaugguuuuuug

SEQ ID NO: 336871 - RNA, 32 nt, Human
augggaccaguucugcugccuaagaaggucug

SEQ ID NO: 336872 - RNA, 32 nt, Human
augggaccccucucacacuuugucacuggaau

SEQ ID NO: 336873 - RNA, 32 nt, Human
augggacccuggaggcagagcuggagccacgg

SEQ ID NO: 336874 - RNA, 32 nt, Human
augggacccuggcaagugaccaaauccucucu

SEQ ID NO: 336875 - RNA, 32 nt, Human
augggaccgaggggcuggaggagaggcggagc

SEQ ID NO: 336876 - RNA, 32 nt, Human
augggacggucacccagcagugccgggcuggg

SEQ ID NO: 336877 - RNA, 32 nt, Human
augggacuaaaaaggccaggcgugguggcuca

SEQ ID NO: 336878 - RNA, 32 nt, Human
augggacucuuggaggauacccagugucuauu

SEQ ID NO: 336879 - RNA, 32 nt, Human
augggacugcacuccagccugggugacagagc

SEQ ID NO: 336880 - RNA, 32 nt, Human
augggacugcgccggauccggugacagcaggg

SEQ ID NO: 336881 - RNA, 32 nt, Human
augggacugggcagaugcaucugggaaguaac

SEQ ID NO: 336882 - RNA, 32 nt, Human
augggacuucuucccuuccuccucagcccccg

SEQ ID NO: 336883 - RNA, 32 nt, Human
augggagaacugcggagcuugccccucggaaa

SEQ ID NO: 336884 - RNA, 32 nt, Human
augggagaaucuuaagaauuucacuacugaag

SEQ ID NO: 336885 - RNA, 32 nt, Human
augggagacagaaaccugcgucauaccugcuu

SEQ ID NO: 336886 - RNA, 32 nt, Human
augggagacaggagagaugagccccaggaccc

SEQ ID NO: 336887 - RNA, 32 nt, Human
augggagagaggaggcuuugacugggcugccu

SEQ ID NO: 336888 - RNA, 32 nt, Human
augggagagccagcagggguucuggagaaaaa

SEQ ID NO: 336889 - RNA, 32 nt, Human
augggagaggggcugagggggagccaagggug

SEQ ID NO: 336890 - RNA, 32 nt, Human
augggagauaauuuauuuuaaaggacagaauu

SEQ ID NO: 336891 - RNA, 32 nt, Human
augggagaugagauagaaaguguuaggaguua

SEQ ID NO: 336892 - RNA, 32 nt, Human
augggagcacacagagagauggcagccaccua

SEQ ID NO: 336893 - RNA, 32 nt, Human
augggagcacccuggcaccugggagcacagug

SEQ ID NO: 336894 - RNA, 32 nt, Human
augggagcaggaggagaagauacgagagcagg

SEQ ID NO: 336895 - RNA, 32 nt, Human
augggagcaggcaccagcuauggagagggaua

SEQ ID NO: 336896 - RNA, 32 nt, Human
augggagcagguuggagggagggagagccaau

SEQ ID NO: 336897 - RNA, 32 nt, Human
augggagcauaguacugggaaaccccagaccu

SEQ ID NO: 336898 - RNA, 21 nt, Human
augggagccaggccacaggga

SEQ ID NO: 336899 - RNA, 32 nt, Human
augggagccaggccacagggaggaggcuucuu

SEQ ID NO: 336900 - RNA, 32 nt, Human
augggagcccacaguacugggaaaggggaguu

SEQ ID NO: 336901 - RNA, 32 nt, Human
augggagccgggacugcucagcaaagauggau

SEQ ID NO: 336902 - RNA, 32 nt, Human
augggagccugaggcaugagaaucacuugaac

SEQ ID NO: 336903 - RNA, 32 nt, Human
augggagccugccuggugagggguccaguggu

SEQ ID NO: 336904 - RNA, 32 nt, Human
augggagcgaaguaaggagaccccaccugagc

SEQ ID NO: 336905 - RNA, 32 nt, Human
augggagcuggaguuaaaaccccagccagagc

SEQ ID NO: 336906 - RNA, 30 nt, Human
augggaggaagccgcgggguggagcagggg

SEQ ID NO: 336907 - RNA, 32 nt, Human
augggaggaauaggauauaagcaguugaggaa

SEQ ID NO: 336908 - RNA, 32 nt, Human
augggaggagacaaggagcugaaggaguaguu

SEQ ID NO: 336909 - RNA, 32 nt, Human
augggaggagcagcaaugucauauuacaaaag

SEQ ID NO: 336910 - RNA, 32 nt, Human
augggaggaggacauggagcugauggagucca

SEQ ID NO: 336911 - RNA, 32 nt, Human
augggaggaggcgggaucugcucugaggcccu

SEQ ID NO: 336912 - RNA, 32 nt, Human
augggaggagggaggggaaagugaagagggaa

SEQ ID NO: 336913 - RNA, 32 nt, Human
augggaggaguuaaagagguuggaagggaaga

SEQ ID NO: 336914 - RNA, 32 nt, Human
augggaggaucacuugaacccaggagguugag

SEQ ID NO: 336915 - RNA, 32 nt, Human
augggaggaucucuugagaccagguguucaag

SEQ ID NO: 336916 - RNA, 32 nt, Human
augggaggaucucuugagcccaggagaugcag

SEQ ID NO: 336917 - RNA, 32 nt, Human
augggaggaucucuugagcccaggaguuggag

SEQ ID NO: 336918 - RNA, 32 nt, Human
augggaggcaaaaugcucuguucuccaagagg

SEQ ID NO: 336919 - RNA, 21 nt, Human
augggaggcacguggccucuc

SEQ ID NO: 336920 - RNA, 32 nt, Human
augggaggccagagaugagaacccuuugaaaa

SEQ ID NO: 336921 - RNA, 32 nt, Human
augggaggcccaggugagcagaucaccugagg

SEQ ID NO: 336922 - RNA, 32 nt, Human
augggaggccgagguggguggaucacgagguc

SEQ ID NO: 336923 - RNA, 32 nt, Human
augggaggcgccuccuagaccuccucgaaggc

SEQ ID NO: 336924 - RNA, 19 nt, Human
augggaggcggcgcugcuc

SEQ ID NO: 336925 - RNA, 32 nt, Human
augggaggcggcgcugcucuccccgagggcgg

SEQ ID NO: 336926 - RNA, 32 nt, Human
augggaggcugaacaggagaaucgcuugaacc

SEQ ID NO: 336927 - RNA, 32 nt, Human
augggaggcugaggcacgagaaucacuugaac

SEQ ID NO: 336928 - RNA, 32 nt, Human
augggaggcugaggcaggagaagggcgugaac

SEQ ID NO: 336929 - RNA, 32 nt, Human
augggaggcugaggcaggagaaucaguugaac

SEQ ID NO: 336930 - RNA, 32 nt, Human
augggaggcugaggcaggagaaucgcuugaac

SEQ ID NO: 336931 - RNA, 32 nt, Human
augggaggcugaggcaggaggaucacuugaac

SEQ ID NO: 336932 - RNA, 32 nt, Human
augggaggcugaggcgggauugcuugagucca

SEQ ID NO: 336933 - RNA, 32 nt, Human
augggaggcugcagcuggaucagaggaaaaau

SEQ ID NO: 336934 - RNA, 32 nt, Human
augggaggcugcaggggacagcagggccugag

SEQ ID NO: 336935 - RNA, 32 nt, Human
augggagggcuguuauuuccccuagucaucuc

SEQ ID NO: 336936 - RNA, 32 nt, Human
augggagggggacacagaaaaagggaaggaaa

SEQ ID NO: 336937 - RNA, 32 nt, Human
augggagggggcaugacuggaauggccggaau

SEQ ID NO: 336938 - RNA, 32 nt, Human
augggagguaauugaaucauggggacgggucu

SEQ ID NO: 336939 - RNA, 32 nt, Human
augggagguguuagaaaacuuagagacuagaa

SEQ ID NO: 336940 - RNA, 32 nt, Human
augggagugaaggaggaggagggaugccacac

SEQ ID NO: 336941 - RNA, 32 nt, Human
augggaguggagggcaggauuggggcagggcu

SEQ ID NO: 336942 - RNA, 32 nt, Human
augggagugggacugccaggaggaggagagga

SEQ ID NO: 336943 - RNA, 32 nt, Human
augggaguggguaaagaguuugggaagguuau

SEQ ID NO: 336944 - RNA, 32 nt, Human
augggaguucacagcacuaggaaaugggagca

SEQ ID NO: 336945 - RNA, 32 nt, Human
augggaguugaagcacuguaugaaaaggguuu

SEQ ID NO: 336946 - RNA, 32 nt, Human
augggaguuggacccaggcuugaaggacacau

SEQ ID NO: 336947 - RNA, 32 nt, Human
augggauauagaauuggcagaguggcagaugu

SEQ ID NO: 336948 - RNA, 32 nt, Human
augggaucacagaauuuuuggcuuuccuguua

SEQ ID NO: 336949 - RNA, 32 nt, Human
augggaucacuuugauuccuaccugcaacuua

SEQ ID NO: 336950 - RNA, 32 nt, Human
augggaucaggugcccuuaugaaaaggcuuga

SEQ ID NO: 336951 - RNA, 24 nt, Human
augggaucauggauuuucugggca

SEQ ID NO: 336952 - RNA, 32 nt, Human
augggaugacagauggggucagacagaaagag

SEQ ID NO: 336953 - RNA, 32 nt, Human
augggaugcaggaagaagaggcaggagacacc

SEQ ID NO: 336954 - RNA, 32 nt, Human
augggauggcaaaggugguggugcuuucaucu

SEQ ID NO: 336955 - RNA, 32 nt, Human
augggaugggagaacuugagggugaucgggaa

SEQ ID NO: 336956 - RNA, 32 nt, Human
augggauggggaggggguaugagaacuggcag

SEQ ID NO: 336957 - RNA, 32 nt, Human
augggaugguacagcggccugggcaggggcgg

SEQ ID NO: 336958 - RNA, 32 nt, Human
augggaugguagagcggccugggcaggggcgg

SEQ ID NO: 336959 - RNA, 32 nt, Human
augggauguucuguuccgcuuuuaugauaucc

SEQ ID NO: 336960 - RNA, 32 nt, Human
augggauucggccucuggaaaguggugguagu

SEQ ID NO: 336961 - RNA, 32 nt, Human
augggauucuaagaagugaagaacagcauagg

SEQ ID NO: 336962 - RNA, 32 nt, Human
augggauugccugggaccagaggaaaggucua

SEQ ID NO: 336963 - RNA, 32 nt, Human
augggauuucugugccuaggcagccacuccag

SEQ ID NO: 336964 - RNA, 32 nt, Human
augggauuuuaguucuuauucugugauaacua

SEQ ID NO: 336965 - RNA, 32 nt, Human
augggauuuugccauguugcccaggcuggucu

SEQ ID NO: 336966 - RNA, 32 nt, Human
augggcaacaugguaagaccuccgccucuacg

SEQ ID NO: 336967 - RNA, 32 nt, Human
augggcaacauggugaaacacugucucuacaa

SEQ ID NO: 336968 - RNA, 32 nt, Human
augggcaagguaugagggaaggaaauaaaaca

SEQ ID NO: 336969 - RNA, 32 nt, Human
augggcaaugagugcaugggaacucacucacc

SEQ ID NO: 336970 - RNA, 32 nt, Human
augggcacaggcugggacaucagauagaagcu

SEQ ID NO: 336971 - RNA, 19 nt, Human
augggcaccacauuucuua

SEQ ID NO: 336972 - RNA, 32 nt, Human
augggcacccuggcagcagaccccaaaccaac

SEQ ID NO: 336973 - RNA, 32 nt, Human
augggcaccucauggacucaggauccuccugg

SEQ ID NO: 336974 - RNA, 32 nt, Human
augggcaccucuagugacccaggcuggcugag

SEQ ID NO: 336975 - RNA, 32 nt, Human
augggcacuggcagucaaaguggagagagugg

SEQ ID NO: 336976 - RNA, 32 nt, Human
augggcagaacugcugucuuuacuacuucauc

SEQ ID NO: 336977 - RNA, 32 nt, Human
augggcagaaggcagggugcacagguggcucc

SEQ ID NO: 336978 - RNA, 32 nt, Human
augggcagagaagaaaaugaccaggaguguca

SEQ ID NO: 336979 - RNA, 32 nt, Human
augggcagaggaccaggcuguaggaaaucuag

SEQ ID NO: 336980 - RNA, 32 nt, Human
augggcagcacagacacagacacacaccgcag

SEQ ID NO: 336981 - RNA, 21 nt, Human
augggcagccugugcuuuuug

SEQ ID NO: 336982 - RNA, 32 nt, Human
augggcagcuccauccucuugaucuucuaaau

SEQ ID NO: 336983 - RNA, 30 nt, Human
augggcagcuugcacucaccaauagaccaa

SEQ ID NO: 336984 - RNA, 32 nt, Human
augggcagcuuuguuuuauuuauuuauuuauu

SEQ ID NO: 336985 - RNA, 32 nt, Human
augggcaggagaaagagcagauuccuuuuagc

SEQ ID NO: 336986 - RNA, 32 nt, Human
augggcaggcagugcuggaggaacugggaggc

SEQ ID NO: 336987 - RNA, 24 nt, Human
augggcaggcuuuucuguugaaga

SEQ ID NO: 336988 - RNA, 32 nt, Human
augggcagugaauggccucuucugccagccac

SEQ ID NO: 336989 - RNA, 16 nt, Human
augggcagugccucuc

SEQ ID NO: 336990 - RNA, 32 nt, Human
augggcaguuucaccuuccaugaaggcuuaua

SEQ ID NO: 336991 - RNA, 20 nt, Human
augggcauaaacuggcuucu

SEQ ID NO: 336992 - RNA, 32 nt, Human
augggcaucacacccucugccuacccacgugc

SEQ ID NO: 336993 - RNA, 32 nt, Human
augggcaugaggaaucuuacagugauggaaau

SEQ ID NO: 336994 - RNA, 32 nt, Human
augggcaugggaagaugggcucccuggccccc

SEQ ID NO: 336995 - RNA, 32 nt, Human
augggcaugguagcuuacgccuguaaucccag

SEQ ID NO: 336996 - RNA, 32 nt, Human
augggcauguauuuauugcaggugcuaugcag

SEQ ID NO: 336997 - RNA, 32 nt, Human
augggcauguggcccugaaggcugggugagag

SEQ ID NO: 336998 - RNA, 32 nt, Human
augggcauguggucccagcuacucuggaagcu

SEQ ID NO: 336999 - RNA, 32 nt, Human
augggcauguuaacauugccuaccucauagga

SEQ ID NO: 337000 - RNA, 32 nt, Human
augggccaaguugaagacuguugaugaucccu

SEQ ID NO: 337001 - RNA, 32 nt, Human
augggccaccacuguaccccuggucucagucc

SEQ ID NO: 337002 - RNA, 32 nt, Human
augggccaccugacuuagacucucauuaguau

SEQ ID NO: 337003 - RNA, 32 nt, Human
augggccacguagcgcgacuccaucucuacaa

SEQ ID NO: 337004 - RNA, 32 nt, Human
augggccagaaaccgcuucugagcggggcacu

SEQ ID NO: 337005 - RNA, 32 nt, Human
augggccagccaggcauccugauuuccagcuc

SEQ ID NO: 337006 - RNA, 19 nt, Human
augggccagccgucuccua

SEQ ID NO: 337007 - RNA, 32 nt, Human
augggccagccugccccaaggcucuuuacuga

SEQ ID NO: 337008 - RNA, 32 nt, Human
augggccaggagaagacugugcuggguugauu

SEQ ID NO: 337009 - RNA, 32 nt, Human
augggccaggcagggggagggcaagugaggga

SEQ ID NO: 337010 - RNA, 32 nt, Human
augggccaguaugccaguuugaauucucaguc

SEQ ID NO: 337011 - RNA, 32 nt, Human
augggccauauuccgcacugggcacaggccgu

SEQ ID NO: 337012 - RNA, 22 nt, Human
augggccaugagaugcugggga

SEQ ID NO: 337013 - RNA, 32 nt, Human
augggccauuuauuuuccucggagcuccacag

SEQ ID NO: 337014 - RNA, 32 nt, Human
augggcccaaguuucuguggcucauuacaggg

SEQ ID NO: 337015 - RNA, 32 nt, Human
augggcccacauccaccuccagucccuggcca

SEQ ID NO: 337016 - RNA, 25 nt, Human
augggcccaccagaccaaacagccc

SEQ ID NO: 337017 - RNA, 32 nt, Human
augggcccaguucugggagaggacagaaaagg

SEQ ID NO: 337018 - RNA, 25 nt, Human
augggccccaggggaacacugggga

SEQ ID NO: 337019 - RNA, 22 nt, Human
augggcccccaggggcugagga

SEQ ID NO: 337020 - RNA, 32 nt, Human
augggccccugcagaauaaaucugccaguuuu

SEQ ID NO: 337021 - RNA, 32 nt, Human
augggccccugggggagcugcaguaaggcggc

SEQ ID NO: 337022 - RNA, 32 nt, Human
augggcccgcaggagagagggagggaaggucu

SEQ ID NO: 337023 - RNA, 32 nt, Human
augggcccggcgcagauccucugugguuguug

SEQ ID NO: 337024 - RNA, 32 nt, Human
augggcccuauugugcucacacauucagaacc

SEQ ID NO: 337025 - RNA, 21 nt, Human
augggcccucucagcagggga

SEQ ID NO: 337026 - RNA, 32 nt, Human
augggcccucugcuccccaaugccuuagagag

SEQ ID NO: 337027 - RNA, 32 nt, Human
augggcccugcaugcuaauaaaugcuucuuca

SEQ ID NO: 337028 - RNA, 32 nt, Human
augggcccugcccucuuucuucacaccagccc

SEQ ID NO: 337029 - RNA, 32 nt, Human
augggccggcgauugggaccagcugggcccca

SEQ ID NO: 337030 - RNA, 32 nt, Human
augggccuaucacccuugucagagauauaaau

SEQ ID NO: 337031 - RNA, 25 nt, Human
augggccuaucugggcugccuucug

SEQ ID NO: 337032 - RNA, 28 nt, Human
augggccucaauaaaaugguugaguugc

SEQ ID NO: 337033 - RNA, 32 nt, Human
augggccucaccuccccaccagccugggaagg

SEQ ID NO: 337034 - RNA, 32 nt, Human
augggccuccacugacccaucccucucuuuua

SEQ ID NO: 337035 - RNA, 32 nt, Human
augggccugagcugugggugccaagccagaga

SEQ ID NO: 337036 - RNA, 32 nt, Human
augggccugaggccuccacuucuugaggucug

SEQ ID NO: 337037 - RNA, 19 nt, Human
augggccugcagcgucucc

SEQ ID NO: 337038 - RNA, 32 nt, Human
augggccugcuuccugucuuugggagaaaacg

SEQ ID NO: 337039 - RNA, 32 nt, Human
augggccuggaugcagaucugcguggcuggug

SEQ ID NO: 337040 - RNA, 32 nt, Human
augggccuggugugguggcucacaccuguaau

SEQ ID NO: 337041 - RNA, 32 nt, Human
augggccugugugaugucccugaggcagaaga

SEQ ID NO: 337042 - RNA, 32 nt, Human
augggcgcuguucauccucuggugcugaagca

SEQ ID NO: 337043 - RNA, 32 nt, Human
augggcgggaugagacaaaaggagggaugaaa

SEQ ID NO: 337044 - RNA, 21 nt, Human
augggcgggugugucugaagg

SEQ ID NO: 337045 - RNA, 32 nt, Human
augggcgguacuuuagcacggaagcuucccuu

SEQ ID NO: 337046 - RNA, 32 nt, Human
augggcgugguggcaggugccuguaaucccau

SEQ ID NO: 337047 - RNA, 32 nt, Human
augggcgugguggcucacgccuguaauuccag

SEQ ID NO: 337048 - RNA, 32 nt, Human
augggcuacacagcagcuguucaacaagagua

SEQ ID NO: 337049 - RNA, 32 nt, Human
augggcuacagugucuggccuugggaagaagu

SEQ ID NO: 337050 - RNA, 32 nt, Human
augggcuaccggaccugcuggaggcugguccc

SEQ ID NO: 337051 - RNA, 32 nt, Human
augggcuaggcagaguugucccagggccgccu

SEQ ID NO: 337052 - RNA, 32 nt, Human
augggcucaagcaguccucccaccucagccuc

SEQ ID NO: 337053 - RNA, 32 nt, Human
augggcucaccuuuggccagaagccaaacuug

SEQ ID NO: 337054 - RNA, 32 nt, Human
augggcucaggcugauggucagcugggcgcuu

SEQ ID NO: 337055 - RNA, 32 nt, Human
augggcucaugggauucuccuaccucagccuc

SEQ ID NO: 337056 - RNA, 32 nt, Human
augggcuccaacacgggaaggaagcaaaggga

SEQ ID NO: 337057 - RNA, 32 nt, Human
augggcuccacugucuucuggcucccaugugu

SEQ ID NO: 337058 - RNA, 32 nt, Human
augggcuccauccucuggauucuggccaauga

SEQ ID NO: 337059 - RNA, 32 nt, Human
augggcuccauuuggcaccugcugagccacag

SEQ ID NO: 337060 - RNA, 22 nt, Human
augggcuccugcagccugggga

SEQ ID NO: 337061 - RNA, 32 nt, Human
augggcuccuugagagcaagcauuguuuccca

SEQ ID NO: 337062 - RNA, 32 nt, Human
augggcucucagaauaaucucucagaugaaau

SEQ ID NO: 337063 - RNA, 31 nt, Human
augggcugacuucucauuuuagagaugaaga

SEQ ID NO: 337064 - RNA, 21 nt, Human
augggcugaggcccccagcug

SEQ ID NO: 337065 - RNA, 32 nt, Human
augggcugagucccugggcucagaccuagcag

SEQ ID NO: 337066 - RNA, 26 nt, Human
augggcugcagcagaggcacuggggg

SEQ ID NO: 337067 - RNA, 32 nt, Human
augggcugccaagaguugcgggagacccagga

SEQ ID NO: 337068 - RNA, 32 nt, Human
augggcugccuaggagcugccugcacggcaca

SEQ ID NO: 337069 - RNA, 32 nt, Human
augggcugcgcgucuccagccucugcacacac

SEQ ID NO: 337070 - RNA, 32 nt, Human
augggcugcugcuuagcuugcaccuugucaca

SEQ ID NO: 337071 - RNA, 32 nt, Human
augggcugcuggggugucgggagaagccacac

SEQ ID NO: 337072 - RNA, 32 nt, Human
augggcuggaaccggaucuguuuccagacgca

SEQ ID NO: 337073 - RNA, 32 nt, Human
augggcuggacauuggacuuccuccgggagcg

SEQ ID NO: 337074 - RNA, 32 nt, Human
augggcuggaugugguggcucacaccuguaau

SEQ ID NO: 337075 - RNA, 32 nt, Human
augggcugggaacccagccaggugagagccgu

SEQ ID NO: 337076 - RNA, 32 nt, Human
augggcugggcugggcuguggugggguggggg

SEQ ID NO: 337077 - RNA, 32 nt, Human
augggcuggggaaggagagggaauuagagauu

SEQ ID NO: 337078 - RNA, 32 nt, Human
augggcugggggccgcggaggcugcgagcggc

SEQ ID NO: 337079 - RNA, 32 nt, Human
augggcugggugagaugaggggagacagccau

SEQ ID NO: 337080 - RNA, 32 nt, Human
augggcuggucaaugcauccuacaccaaacug

SEQ ID NO: 337081 - RNA, 32 nt, Human
augggcugguggggugagagggggucuaucau

SEQ ID NO: 337082 - RNA, 19 nt, Human
augggcuguacaacuucau

SEQ ID NO: 337083 - RNA, 32 nt, Human
augggcugugcgucaucuuccuuuccuguacc

SEQ ID NO: 337084 - RNA, 32 nt, Human
augggcuguggggcaccggcugccuuucccca

SEQ ID NO: 337085 - RNA, 32 nt, Human
augggcugugucugugccucucucucuuuccu

SEQ ID NO: 337086 - RNA, 32 nt, Human
augggcuuagaagccuuuuugagggaccuccc

SEQ ID NO: 337087 - RNA, 32 nt, Human
augggcuucaguuucaacaucuguaaaauggg

SEQ ID NO: 337088 - RNA, 25 nt, Human
augggcuucugccuggcacuggggg

SEQ ID NO: 337089 - RNA, 32 nt, Human
augggcuugcaggauggagugucuguaaaauc

SEQ ID NO: 337090 - RNA, 32 nt, Human
augggcuugggggccuacagcagccucaccuu

SEQ ID NO: 337091 - RNA, 32 nt, Human
augggcuuguugcagucagcaggugugggcuu

SEQ ID NO: 337092 - RNA, 32 nt, Human
augggcuuucugcuuagucugaaaggugugug

SEQ ID NO: 337093 - RNA, 32 nt, Human
auggggaaaaagaggaucuggagaaccucauc

SEQ ID NO: 337094 - RNA, 32 nt, Human
auggggaaaacaagcugugucuucuuaacugc

SEQ ID NO: 337095 - RNA, 18 nt, Human
auggggaaaacacaaggu

SEQ ID NO: 337096 - RNA, 32 nt, Human
auggggaaaggcuguuauuaccuagaguuuac

SEQ ID NO: 337097 - RNA, 32 nt, Human
auggggaaaggggcuuccugcaccacacaugc

SEQ ID NO: 337098 - RNA, 27 nt, Human
auggggaaaucccuguuauuuugugaa

SEQ ID NO: 337099 - RNA, 32 nt, Human
auggggaacauauucuucuaguuuaagauaca

SEQ ID NO: 337100 - RNA, 32 nt, Human
auggggaagcaaccccagagcaggcagacauc

SEQ ID NO: 337101 - RNA, 32 nt, Human
auggggaaggcagaggcuggcaccauggugac

SEQ ID NO: 337102 - RNA, 32 nt, Human
auggggaaggcagaggcuggcacgauggugac

SEQ ID NO: 337103 - RNA, 24 nt, Human
auggggaaugcuugucacugugga

SEQ ID NO: 337104 - RNA, 32 nt, Human
auggggaaugucugggaagcuggggacauugc

SEQ ID NO: 337105 - RNA, 32 nt, Human
auggggacacauauaaagcaguguuuaauaga

SEQ ID NO: 337106 - RNA, 32 nt, Human
auggggacaccaguggcuucaaacuuccugau

SEQ ID NO: 337107 - RNA, 23 nt, Human
auggggacaguuccguucuugaa

SEQ ID NO: 337108 - RNA, 32 nt, Human
auggggaccaaagugcuuuuuccuucaggaag

SEQ ID NO: 337109 - RNA, 32 nt, Human
auggggaccagccuugccaacugcugcugugg

SEQ ID NO: 337110 - RNA, 32 nt, Human
auggggaccccaaagaagcagaagcugaagaa

SEQ ID NO: 337111 - RNA, 32 nt, Human
auggggaccccaagccccuuccuccauuuaug

SEQ ID NO: 337112 - RNA, 32 nt, Human
auggggaccccagcgaagcaggggcugaagaa

SEQ ID NO: 337113 - RNA, 32 nt, Human
auggggaccucuugcuaagucauuccacuccu

SEQ ID NO: 337114 - RNA, 32 nt, Human
auggggaccuggaaccugggcguacuagagug

SEQ ID NO: 337115 - RNA, 32 nt, Human
auggggacugagaaggauaggaagggauagaa

SEQ ID NO: 337116 - RNA, 32 nt, Human
auggggacuuccugggacaagcaaggaaagua

SEQ ID NO: 337117 - RNA, 22 nt, Human
auggggacuuggacccugagga

SEQ ID NO: 337118 - RNA, 32 nt, Human
auggggagaacacagaacacacaaagcuuucu

SEQ ID NO: 337119 - RNA, 32 nt, Human
auggggagaagcacccacaucucuccuguagc

SEQ ID NO: 337120 - RNA, 32 nt, Human
auggggagaggaacuccuuggccuagcccacc

SEQ ID NO: 337121 - RNA, 32 nt, Human
auggggagauuauccugaauuacuuuggaggg

SEQ ID NO: 337122 - RNA, 32 nt, Human
auggggagcuggcagagcagguggcagucacu

SEQ ID NO: 337123 - RNA, 32 nt, Human
auggggaggaaaugcuggggaggugggggcag

SEQ ID NO: 337124 - RNA, 32 nt, Human
auggggagggaagaggaauaagaaaaguuacg

SEQ ID NO: 337125 - RNA, 32 nt, Human
auggggagggaagaggaggagaggggagggga

SEQ ID NO: 337126 - RNA, 32 nt, Human
auggggagggaagggaaggcagcuccaagaag

SEQ ID NO: 337127 - RNA, 32 nt, Human
auggggagggagcaggggaagguuguaugugu

SEQ ID NO: 337128 - RNA, 32 nt, Human
auggggagggugaacaguccccacagcagaca

SEQ ID NO: 337129 - RNA, 32 nt, Human
auggggagguauaaaaagcaaagauuauuuuu

SEQ ID NO: 337130 - RNA, 32 nt, Human
auggggagguugagggacaggaucuauaggca

SEQ ID NO: 337131 - RNA, 32 nt, Human
auggggaguagagagaaaacaggcgagaacaa

SEQ ID NO: 337132 - RNA, 28 nt, Human
auggggagucccagagguauccagcaga

SEQ ID NO: 337133 - RNA, 32 nt, Human
auggggaguccccagaccccaggaucagggag

SEQ ID NO: 337134 - RNA, 32 nt, Human
auggggagugagagagagggcacgagaaccca

SEQ ID NO: 337135 - RNA, 20 nt, Human
auggggauaccauucuggaa

SEQ ID NO: 337136 - RNA, 32 nt, Human
auggggauaugggggaacagugaagaaaagga

SEQ ID NO: 337137 - RNA, 32 nt, Human
auggggaugacuauccccucucugguuauugu

SEQ ID NO: 337138 - RNA, 21 nt, Human
auggggaugagggcagagaga

SEQ ID NO: 337139 - RNA, 22 nt, Human
auggggaugauagaaggaagaa

SEQ ID NO: 337140 - RNA, 21 nt, Human
auggggaugggguuggggaga

SEQ ID NO: 337141 - RNA, 19 nt, Human
auggggauucaccauguug

SEQ ID NO: 337142 - RNA, 23 nt, Human
auggggauucaccauguugguca

SEQ ID NO: 337143 - RNA, 21 nt, Human
auggggauugugccuguugga

SEQ ID NO: 337144 - RNA, 32 nt, Human
auggggcaaucaauggcugucuugcucaauug

SEQ ID NO: 337145 - RNA, 22 nt, Human
auggggcacccuggacaaagaa

SEQ ID NO: 337146 - RNA, 32 nt, Human
auggggcagaaauuccguggaggcagauagcu

SEQ ID NO: 337147 - RNA, 32 nt, Human
auggggcagaaggcacguaaccauaaccucca

SEQ ID NO: 337148 - RNA, 32 nt, Human
auggggcagagcugggcauucaggaccuugag

SEQ ID NO: 337149 - RNA, 32 nt, Human
auggggcagaggacaggggagcugagguuggu

SEQ ID NO: 337150 - RNA, 32 nt, Human
auggggcagaggcauaaaugcccagaugacuu

SEQ ID NO: 337151 - RNA, 20 nt, Human
auggggcagaggccgcccaa

SEQ ID NO: 337152 - RNA, 32 nt, Human
auggggcaggaaaugcugagucuggggacagg

SEQ ID NO: 337153 - RNA, 32 nt, Human
auggggcaggaggggcugagggccugucccag

SEQ ID NO: 337154 - RNA, 32 nt, Human
auggggcagggcugcugaagcgcggaguucgg

SEQ ID NO: 337155 - RNA, 32 nt, Human
auggggcaguagaucuggaggaguuuaucggu

SEQ ID NO: 337156 - RNA, 25 nt, Human
auggggcaguuagcagcauuuccua

SEQ ID NO: 337157 - RNA, 27 nt, Human
auggggcauccucaucccagggcucuc

SEQ ID NO: 337158 - RNA, 32 nt, Human
auggggcauggagaacccagaggaucuaggcc

SEQ ID NO: 337159 - RNA, 32 nt, Human
auggggcauguucugugacugcauuugcaucu

SEQ ID NO: 337160 - RNA, 32 nt, Human
auggggcauugugaggaacugugcaaagacau

SEQ ID NO: 337161 - RNA, 32 nt, Human
auggggccacguguuggcaguggaaucagccu

SEQ ID NO: 337162 - RNA, 32 nt, Human
auggggccacugcacugcagccugugugacaa

SEQ ID NO: 337163 - RNA, 18 nt, Human
auggggcccagacugcag

SEQ ID NO: 337164 - RNA, 32 nt, Human
auggggcccucccaggccccugccccaacuga

SEQ ID NO: 337165 - RNA, 32 nt, Human
auggggccucuggugucucuuuaccaggggca

SEQ ID NO: 337166 - RNA, 32 nt, Human
auggggccugaaacugucugggucugagcugg

SEQ ID NO: 337167 - RNA, 32 nt, Human
auggggccugcaggacuucuuucugggggucc

SEQ ID NO: 337168 - RNA, 32 nt, Human
auggggccugugcucccaggcucgggggagcc

SEQ ID NO: 337169 - RNA, 32 nt, Human
auggggcgagggcugaggacucucuggcucua

SEQ ID NO: 337170 - RNA, 32 nt, Human
auggggcgcagcccuggguuugccaugcagca

SEQ ID NO: 337171 - RNA, 32 nt, Human
auggggcggcucagugguccccagggaccuca

SEQ ID NO: 337172 - RNA, 32 nt, Human
auggggcuaacaauauuaccuaccucauagga

SEQ ID NO: 337173 - RNA, 32 nt, Human
auggggcucaggucugucacuuaacuuagagu

SEQ ID NO: 337174 - RNA, 32 nt, Human
auggggcucuccaagcaagagguggcccuggg

SEQ ID NO: 337175 - RNA, 32 nt, Human
auggggcucugccugcccccgccccugccucc

SEQ ID NO: 337176 - RNA, 21 nt, Human
auggggcucuuucucugaagg

SEQ ID NO: 337177 - RNA, 23 nt, Human
auggggcugcagaggacgcgccc

SEQ ID NO: 337178 - RNA, 32 nt, Human
auggggcugcuucccugucccuucccuccccu

SEQ ID NO: 337179 - RNA, 32 nt, Human
auggggcuggacaaagaaggaggggccagacu

SEQ ID NO: 337180 - RNA, 25 nt, Human
auggggcuggcaccagaugaugucc

SEQ ID NO: 337181 - RNA, 32 nt, Human
auggggcugggacuucucauuggccaaccugc

SEQ ID NO: 337182 - RNA, 32 nt, Human
auggggcugggagggcaaagauggggcggggc

SEQ ID NO: 337183 - RNA, 32 nt, Human
auggggcugggcuggagaggguggcaggcagu

SEQ ID NO: 337184 - RNA, 21 nt, Human
auggggcugugucagaugccc

SEQ ID NO: 337185 - RNA, 31 nt, Human
auggggcuguugagaugccuguugaagguac

SEQ ID NO: 337186 - RNA, 32 nt, Human
auggggcuucuucuccccuucuuccuuucccc

SEQ ID NO: 337187 - RNA, 32 nt, Human
auggggcuuuagugaugcuccucuuuuguguc

SEQ ID NO: 337188 - RNA, 30 nt, Human
augggggaaagccacaaggaacaguucuga

SEQ ID NO: 337189 - RNA, 32 nt, Human
augggggaaagccagcaugcaaggcccucccc

SEQ ID NO: 337190 - RNA, 23 nt, Human
augggggaaugcccauccuggag

SEQ ID NO: 337191 - RNA, 32 nt, Human
augggggaauuaccuacacaccugcuaaacac

SEQ ID NO: 337192 - RNA, 17 nt, Human
augggggacaauuucau

SEQ ID NO: 337193 - RNA, 32 nt, Human
augggggaggagaacccagggaugggagagau

SEQ ID NO: 337194 - RNA, 32 nt, Human
augggggaggagucagggcaugguggcccaca

SEQ ID NO: 337195 - RNA, 32 nt, Human
augggggaggcugugcauauguuggggaaggu

SEQ ID NO: 337196 - RNA, 32 nt, Human
augggggaggggcaaggcuggucagggagcau

SEQ ID NO: 337197 - RNA, 32 nt, Human
augggggaggggcaggaagcugaauucaccac

SEQ ID NO: 337198 - RNA, 32 nt, Human
augggggaggguggggagcagcucccagcacc

SEQ ID NO: 337199 - RNA, 32 nt, Human
augggggagguggggaguuggggaguacuugg

SEQ ID NO: 337200 - RNA, 32 nt, Human
augggggauccaguggagcaggaguugacgga

SEQ ID NO: 337201 - RNA, 32 nt, Human
augggggauggcuugguuaacugugaagcucc

SEQ ID NO: 337202 - RNA, 32 nt, Human
augggggcaaggggcugaaccucucacagauu

SEQ ID NO: 337203 - RNA, 32 nt, Human
augggggcagcaaaccaccauggcacaugugu

SEQ ID NO: 337204 - RNA, 32 nt, Human
augggggcagggaggauuuugcuuuugcuuuu

SEQ ID NO: 337205 - RNA, 32 nt, Human
augggggcagucuccccuuccuggcacauugc

SEQ ID NO: 337206 - RNA, 32 nt, Human
augggggcauuagaggccugagguucucuagg

SEQ ID NO: 337207 - RNA, 32 nt, Human
augggggccaccucuuaacaccuggcaacagu

SEQ ID NO: 337208 - RNA, 32 nt, Human
augggggccaggcugucaacugugcauagagu

SEQ ID NO: 337209 - RNA, 32 nt, Human
augggggccccucggcauucacacacagccug

SEQ ID NO: 337210 - RNA, 32 nt, Human
augggggcggaggcgggagugagaggagaagg

SEQ ID NO: 337211 - RNA, 25 nt, Human
augggggcucccagcugcuugugga

SEQ ID NO: 337212 - RNA, 32 nt, Human
augggggcucucuccccuagauggcugcuccu

SEQ ID NO: 337213 - RNA, 32 nt, Human
augggggcuggccucucuugcccagccagcgg

SEQ ID NO: 337214 - RNA, 32 nt, Human
augggggucaccaggugaccagugggagcccc

SEQ ID NO: 337215 - RNA, 32 nt, Human
augggggugcccacacugagugaggaagggaa

SEQ ID NO: 337216 - RNA, 32 nt, Human
augggggugcugcagccaggaggagaggaaag

SEQ ID NO: 337217 - RNA, 32 nt, Human
auggggguggguggccggguggguggagcguu

SEQ ID NO: 337218 - RNA, 20 nt, Human
augggggugugauuugugaa

SEQ ID NO: 337219 - RNA, 32 nt, Human
auuacaggcaugagccacugcacccagccaag

SEQ ID NO: 337220 - RNA, 32 nt, Human
auuacaggcaugagccacugcacccagcccag

SEQ ID NO: 337221 - RNA, 32 nt, Human
auuacaggcaugagccacugcacccagccgau

SEQ ID NO: 337222 - RNA, 32 nt, Human
auuacaggcaugagccacugcacccagccucu

SEQ ID NO: 337223 - RNA, 32 nt, Human
auuacaggcaugagccacugcacccagccuug

SEQ ID NO: 337224 - RNA, 32 nt, Human
auuacaggcaugagccacugcacccggccaag

SEQ ID NO: 337225 - RNA, 32 nt, Human
auuacaggcaugagccacugcacccggccuuu

SEQ ID NO: 337226 - RNA, 32 nt, Human
auuacaggcaugagccacugcacccggcgcau

SEQ ID NO: 337227 - RNA, 32 nt, Human
auuacaggcaugagccacugcacccggcuuga

SEQ ID NO: 337228 - RNA, 32 nt, Human
auuacaggcaugagccacugcaccuggcccac

SEQ ID NO: 337229 - RNA, 32 nt, Human
auuacaggcaugagccacugcaccuggccuag

SEQ ID NO: 337230 - RNA, 32 nt, Human
auuacaggcaugagccacugcauccggccugu

SEQ ID NO: 337231 - RNA, 32 nt, Human
auuacaggcaugagccacugcgcccaguauau

SEQ ID NO: 337232 - RNA, 32 nt, Human
auuacaggcaugagccacugcgcccggccaag

SEQ ID NO: 337233 - RNA, 32 nt, Human
auuacaggcaugagccacugcgcccggccaau

SEQ ID NO: 337234 - RNA, 32 nt, Human
auuacaggcaugagccacugcgcccggccaug

SEQ ID NO: 337235 - RNA, 32 nt, Human
auuacaggcaugagccacugcgcccggcccaa

SEQ ID NO: 337236 - RNA, 32 nt, Human
auuacaggcaugagccacugcgcccggccucc

SEQ ID NO: 337237 - RNA, 32 nt, Human
auuacaggcaugagccacugcgcccggccucu

SEQ ID NO: 337238 - RNA, 32 nt, Human
auuacaggcaugagccacugcgcccggccugg

SEQ ID NO: 337239 - RNA, 32 nt, Human
auuacaggcaugagccacugcgcccggcugag

SEQ ID NO: 337240 - RNA, 32 nt, Human
auuacaggcaugagccacugcgccuggcaaau

SEQ ID NO: 337241 - RNA, 32 nt, Human
auuacaggcaugagccacugcgccuggccagc

SEQ ID NO: 337242 - RNA, 32 nt, Human
auuacaggcaugagccacugcgccuggccgga

SEQ ID NO: 337243 - RNA, 32 nt, Human
auuacaggcaugagccacugcgccuggccuca

SEQ ID NO: 337244 - RNA, 32 nt, Human
auuacaggcaugagccacugcgccugguugcc

SEQ ID NO: 337245 - RNA, 32 nt, Human
auuacaggcaugagccacugggcgcggccaga

SEQ ID NO: 337246 - RNA, 32 nt, Human
auuacaggcaugagccacuguacccagccaaa

SEQ ID NO: 337247 - RNA, 32 nt, Human
auuacaggcaugagccacugugcccagcccuu

SEQ ID NO: 337248 - RNA, 32 nt, Human
auuacaggcaugagccacugugcccagcuggg

SEQ ID NO: 337249 - RNA, 32 nt, Human
auuacaggcaugagccacugugcccagucagg

SEQ ID NO: 337250 - RNA, 32 nt, Human
auuacaggcaugagccacugugcccggcaagc

SEQ ID NO: 337251 - RNA, 32 nt, Human
auuacaggcaugagccacugugcccggccacu

SEQ ID NO: 337252 - RNA, 32 nt, Human
auuacaggcaugagccacugugcccggccagu

SEQ ID NO: 337253 - RNA, 32 nt, Human
auuacaggcaugagccacugugcccggccuau

SEQ ID NO: 337254 - RNA, 32 nt, Human
auuacaggcaugagccacugugcccggccugg

SEQ ID NO: 337255 - RNA, 32 nt, Human
auuacaggcaugagccacugugcccggccuuu

SEQ ID NO: 337256 - RNA, 32 nt, Human
auuacaggcaugagccacugugccuggccaac

SEQ ID NO: 337257 - RNA, 32 nt, Human
auuacaggcaugagccacugugccuggccaga

SEQ ID NO: 337258 - RNA, 32 nt, Human
auuacaggcaugagccacugugccuggccccu

SEQ ID NO: 337259 - RNA, 32 nt, Human
auuacaggcaugagccacugugccuggccuga

SEQ ID NO: 337260 - RNA, 32 nt, Human
auuacaggcaugagccacugugccuggcuauu

SEQ ID NO: 337261 - RNA, 32 nt, Human
auuacaggcaugagccacugugcucagccuuc

SEQ ID NO: 337262 - RNA, 32 nt, Human
auuacaggcaugagccacugugcuuggccugu

SEQ ID NO: 337263 - RNA, 32 nt, Human
auuacaggcaugagccacuguguccggucuug

SEQ ID NO: 337264 - RNA, 32 nt, Human
auuacaggcaugagccacugugucuggcccua

SEQ ID NO: 337265 - RNA, 32 nt, Human
auuacaggcaugagccacuguguucaguuggc

SEQ ID NO: 337266 - RNA, 32 nt, Human
auuacaggcaugagccaucacaccuggucaac

SEQ ID NO: 337267 - RNA, 32 nt, Human
auuacaggcaugagccaucgcccagcccagaa

SEQ ID NO: 337268 - RNA, 32 nt, Human
auuacaggcaugcaccaccacgcccagcuaau

SEQ ID NO: 337269 - RNA, 32 nt, Human
auuacaggcaugcaccaccacgcccagcuuau

SEQ ID NO: 337270 - RNA, 32 nt, Human
auuacaggcaugggccaccacgcccagcuagu

SEQ ID NO: 337271 - RNA, 32 nt, Human
auuacaggcaugugccaccacgcccagcuaau

SEQ ID NO: 337272 - RNA, 32 nt, Human
auuacaggcaugugccacuacccggccaauuu

SEQ ID NO: 337273 - RNA, 32 nt, Human
auuacaggccugagcaacugugccuggcccaa

SEQ ID NO: 337274 - RNA, 32 nt, Human
auuacaggccugagccaccauacccagcaagu

SEQ ID NO: 337275 - RNA, 32 nt, Human
auuacaggccugagccaccaugcccagcugaa

SEQ ID NO: 337276 - RNA, 32 nt, Human
auuacaggccugagccaccgcgcccagucucu

SEQ ID NO: 337277 - RNA, 32 nt, Human
auuacaggccugagccaccgcgcccggccuau

SEQ ID NO: 337278 - RNA, 32 nt, Human
auuacaggccugagccaccgcguccggccucc

SEQ ID NO: 337279 - RNA, 32 nt, Human
auuacaggccugagccaccgugcccagccaaa

SEQ ID NO: 337280 - RNA, 32 nt, Human
auuacaggccugagccacugcgcccagccaau

SEQ ID NO: 337281 - RNA, 32 nt, Human
auuacaggccugagccacugcgcccagccagg

SEQ ID NO: 337282 - RNA, 32 nt, Human
auuacaggcgcccaccaccacgcccagcuaau

SEQ ID NO: 337283 - RNA, 32 nt, Human
auuacaggcgcccgccaccacgcccagagaga

SEQ ID NO: 337284 - RNA, 32 nt, Human
auuacaggcgcccgccaccacgcccagcaugc

SEQ ID NO: 337285 - RNA, 32 nt, Human
auuacaggcgcccgccaccacgcccagcuaau

SEQ ID NO: 337286 - RNA, 32 nt, Human
auuacaggcgcccgccaccacgcccaggcggu

SEQ ID NO: 337287 - RNA, 32 nt, Human
auuacaggcgcccgccacuacgcccagcuaau

SEQ ID NO: 337288 - RNA, 32 nt, Human
auuacaggcgccgaucaccaagcccggcuaau

SEQ ID NO: 337289 - RNA, 32 nt, Human
auuacaggcgccugccaccacgcccagcuaau

SEQ ID NO: 337290 - RNA, 32 nt, Human
auuacaggcgccugccaccaugccuagcaaau

SEQ ID NO: 337291 - RNA, 32 nt, Human
auuacaggcgcuggccacacacccagcugauu

SEQ ID NO: 337292 - RNA, 32 nt, Human
auuacaggcguaagccacugcgcccagccacu

SEQ ID NO: 337293 - RNA, 32 nt, Human
auuacaggcgugagccaaugugcccggccuaa

SEQ ID NO: 337294 - RNA, 32 nt, Human
auuacaggcgugagccacaaugcccggcccac

SEQ ID NO: 337295 - RNA, 32 nt, Human
auuacaggcgugagccacacacuuagugucuu

SEQ ID NO: 337296 - RNA, 32 nt, Human
auuacaggcgugagccacagcgcccggcccuc

SEQ ID NO: 337297 - RNA, 32 nt, Human
auuacaggcgugagccacagugccuggccucu

SEQ ID NO: 337298 - RNA, 32 nt, Human
auuacaggcgugagccaccacacccagccaaa

SEQ ID NO: 337299 - RNA, 32 nt, Human
auuacaggcgugagccaccacacccagccagu

SEQ ID NO: 337300 - RNA, 32 nt, Human
auuacaggcgugagccaccacacccagcccuu

SEQ ID NO: 337301 - RNA, 32 nt, Human
auuacaggcgugagccaccacacccagcucag

SEQ ID NO: 337302 - RNA, 32 nt, Human
auuacaggcgugagccaccacacccggcccac

SEQ ID NO: 337303 - RNA, 32 nt, Human
auuacaggcgugagccaccacacccggccccc

SEQ ID NO: 337304 - RNA, 32 nt, Human
auuacaggcgugagccaccacacccggccgug

SEQ ID NO: 337305 - RNA, 32 nt, Human
auuacaggcgugagccaccacacccggcuccg

SEQ ID NO: 337306 - RNA, 32 nt, Human
auuacaggcgugagccaccacaccuagcugga

SEQ ID NO: 337307 - RNA, 32 nt, Human
auuacaggcgugagccaccacauccagccagu

SEQ ID NO: 337308 - RNA, 32 nt, Human
auuacaggcgugagccaccacauccggccagu

SEQ ID NO: 337309 - RNA, 32 nt, Human
auuacaggcgugagccaccacccccggccugu

SEQ ID NO: 337310 - RNA, 32 nt, Human
auuacaggcgugagccaccacgccagggcuuu

SEQ ID NO: 337311 - RNA, 32 nt, Human
auuacaggcgugagccaccacgcccagccgua

SEQ ID NO: 337312 - RNA, 32 nt, Human
auuacaggcgugagccaccacgcccagccuau

SEQ ID NO: 337313 - RNA, 32 nt, Human
auuacaggcgugagccaccacgcccggccacu

SEQ ID NO: 337314 - RNA, 32 nt, Human
auuacaggcgugagccaccacgcccggcccca

SEQ ID NO: 337315 - RNA, 32 nt, Human
auuacaggcgugagccaccacgcccggccccc

SEQ ID NO: 337316 - RNA, 32 nt, Human
auuacaggcgugagccaccacgcccggcccgu

SEQ ID NO: 337317 - RNA, 32 nt, Human
auuacaggcgugagccaccacgcccggccucu

SEQ ID NO: 337318 - RNA, 32 nt, Human
auuacaggcgugagccaccacgcccggccugg

SEQ ID NO: 337319 - RNA, 32 nt, Human
auuacaggcgugagccaccacgcccggucacc

SEQ ID NO: 337320 - RNA, 32 nt, Human
auuacaggcgugagccaccacgccuggccaau

SEQ ID NO: 337321 - RNA, 32 nt, Human
auuacaggcgugagccaccacgccuggccgaa

SEQ ID NO: 337322 - RNA, 32 nt, Human
auuacaggcgugagccaccacgccuggccuca

SEQ ID NO: 337323 - RNA, 32 nt, Human
auuacaggcgugagccaccacgccuggcugga

SEQ ID NO: 337324 - RNA, 32 nt, Human
auuacaggcgugagccaccacgcucagccuuu

SEQ ID NO: 337325 - RNA, 32 nt, Human
auuacaggcgugagccaccacucccggccgug

SEQ ID NO: 337326 - RNA, 32 nt, Human
auuacaggcgugagccaccacucccggcuaag

SEQ ID NO: 337327 - RNA, 32 nt, Human
auuacaggcgugagccaccacuccuggccuau

SEQ ID NO: 337328 - RNA, 32 nt, Human
auuacaggcgugagccaccagccaggccaagc

SEQ ID NO: 337329 - RNA, 32 nt, Human
auuacaggcgugagccaccaggcccagccucg

SEQ ID NO: 337330 - RNA, 32 nt, Human
auuacaggcgugagccaccaggccuggcuccu

SEQ ID NO: 337331 - RNA, 32 nt, Human
auuacaggcgugagccaccauacccggcccac

SEQ ID NO: 337332 - RNA, 32 nt, Human
auuacaggcgugagccaccaugaccagcccuc

SEQ ID NO: 337333 - RNA, 32 nt, Human
auuacaggcgugagccaccaugcccagaugcu

SEQ ID NO: 337334 - RNA, 32 nt, Human
auuacaggcgugagccaccaugcccagccuaa

SEQ ID NO: 337335 - RNA, 32 nt, Human
auuacaggcgugagccaccaugcccagccuac

SEQ ID NO: 337336 - RNA, 32 nt, Human
auuacaggcgugagccaccaugcccggccagc

SEQ ID NO: 337337 - RNA, 32 nt, Human
auuacaggcgugagccaccaugcccggccaug

SEQ ID NO: 337338 - RNA, 32 nt, Human
auuacaggcgugagccaccaugcccggcccaa

SEQ ID NO: 337339 - RNA, 32 nt, Human
auuacaggcgugagccaccaugcccggccucu

SEQ ID NO: 337340 - RNA, 32 nt, Human
auuacaggcgugagccaccaugccuagcaaca

SEQ ID NO: 337341 - RNA, 32 nt, Human
auuacaggcgugagccaccaugccugcccagc

SEQ ID NO: 337342 - RNA, 32 nt, Human
auuacaggcgugagccaccaugccuggcaaca

SEQ ID NO: 337343 - RNA, 32 nt, Human
auuacaggcgugagccaccaugccuggccaaa

SEQ ID NO: 337344 - RNA, 32 nt, Human
auuacaggcgugagccaccaugccuggccaca

SEQ ID NO: 337345 - RNA, 32 nt, Human
auuacaggcgugagccaccaugccuggccaga

SEQ ID NO: 337346 - RNA, 32 nt, Human
auuacaggcgugagccaccaugccuggccauc

SEQ ID NO: 337347 - RNA, 32 nt, Human
auuacaggcgugagccaccaugccuggccuuc

SEQ ID NO: 337348 - RNA, 32 nt, Human
auuacaggcgugagccaccaugcucggccuaa

SEQ ID NO: 337349 - RNA, 32 nt, Human
auuacaggcgugagccaccauguccagccaaa

SEQ ID NO: 337350 - RNA, 32 nt, Human
auuacaggcgugagccaccauguccggcuugu

SEQ ID NO: 337351 - RNA, 32 nt, Human
auuacaggcgugagccaccauucccgggcgcu

SEQ ID NO: 337352 - RNA, 32 nt, Human
auuacaggcgugagccacccggccuggccuag

SEQ ID NO: 337353 - RNA, 32 nt, Human
auuacaggcgugagccaccgagccuggccggu

SEQ ID NO: 337354 - RNA, 32 nt, Human
auuacaggcgugagccaccgcacccagccagg

SEQ ID NO: 337355 - RNA, 32 nt, Human
auuacaggcgugagccaccgcacccagcccau

SEQ ID NO: 337356 - RNA, 32 nt, Human
auuacaggcgugagccaccgcacccagcccgu

SEQ ID NO: 337357 - RNA, 32 nt, Human
auuacaggcgugagccaccgcacccggcagag

SEQ ID NO: 337358 - RNA, 32 nt, Human
auuacaggcgugagccaccgcacccggcccuu

SEQ ID NO: 337359 - RNA, 32 nt, Human
auuacaggcgugagccaccgcacccggccuau

SEQ ID NO: 337360 - RNA, 32 nt, Human
auuacaggcgugagccaccgcacccggccucu

SEQ ID NO: 337361 - RNA, 32 nt, Human
auuacaggcgugagccaccgcacccggcuugc

SEQ ID NO: 337362 - RNA, 32 nt, Human
auuacaggcgugagccaccgcacccggucagc

SEQ ID NO: 337363 - RNA, 32 nt, Human
auuacaggcgugagccaccgcaccuggccuac

SEQ ID NO: 337364 - RNA, 32 nt, Human
auuacaggcgugagccaccgcacggauauguu

SEQ ID NO: 337365 - RNA, 32 nt, Human
auuacaggcgugagccaccgcccccggccgcc

SEQ ID NO: 337366 - RNA, 32 nt, Human
auuacaggcgugagccaccgcgacuggccuac

SEQ ID NO: 337367 - RNA, 32 nt, Human
auuacaggcgugagccaccgcgccaggcugag

SEQ ID NO: 337368 - RNA, 32 nt, Human
auuacaggcgugagccaccgcgcccagccaaa

SEQ ID NO: 337369 - RNA, 32 nt, Human
auuacaggcgugagccaccgcgcccagccaga

SEQ ID NO: 337370 - RNA, 32 nt, Human
auuacaggcgugagccaccgcgcccagcccca

SEQ ID NO: 337371 - RNA, 32 nt, Human
auuacaggcgugagccaccgcgcccagcccug

SEQ ID NO: 337372 - RNA, 32 nt, Human
auuacaggcgugagccaccgcgcccagccgga

SEQ ID NO: 337373 - RNA, 32 nt, Human
auuacaggcgugagccaccgcgcccagccuac

SEQ ID NO: 337374 - RNA, 32 nt, Human
auuacaggcgugagccaccgcgcccagccuau

SEQ ID NO: 337375 - RNA, 32 nt, Human
auuacaggcgugagccaccgcgcccagccuca

SEQ ID NO: 337376 - RNA, 32 nt, Human
auuacaggcgugagccaccgcgcccagccuua

SEQ ID NO: 337377 - RNA, 32 nt, Human
auuacaggcgugagccaccgcgcccagcugaa

SEQ ID NO: 337378 - RNA, 32 nt, Human
auuacaggcgugagccaccgcgcccggccaag

SEQ ID NO: 337379 - RNA, 32 nt, Human
auuacaggcgugagccaccgcgcccggccaau

SEQ ID NO: 337380 - RNA, 32 nt, Human
auuacaggcgugagccaccgcgcccggccagg

SEQ ID NO: 337381 - RNA, 32 nt, Human
auuacaggcgugagccaccgcgcccggccagu

SEQ ID NO: 337382 - RNA, 32 nt, Human
auuacaggcgugagccaccgcgcccggccaua

SEQ ID NO: 337383 - RNA, 32 nt, Human
auuacaggcgugagccaccgcgcccggccaug

SEQ ID NO: 337384 - RNA, 32 nt, Human
auuacaggcgugagccaccgcgcccggcccac

SEQ ID NO: 337385 - RNA, 32 nt, Human
auuacaggcgugagccaccgcgcccggcccag

SEQ ID NO: 337386 - RNA, 32 nt, Human
auuacaggcgugagccaccgcgcccggcccau

SEQ ID NO: 337387 - RNA, 32 nt, Human
auuacaggcgugagccaccgcgcccggcccuc

SEQ ID NO: 337388 - RNA, 32 nt, Human
auuacaggcgugagccaccgcgcccggccggc

SEQ ID NO: 337389 - RNA, 32 nt, Human
auuacaggcgugagccaccgcgcccggccgua

SEQ ID NO: 337390 - RNA, 32 nt, Human
auuacaggcgugagccaccgcgcccggccuag

SEQ ID NO: 337391 - RNA, 32 nt, Human
auuacaggcgugagccaccgcgcccggccuca

SEQ ID NO: 337392 - RNA, 32 nt, Human
auuacaggcgugagccaccgcgcccggccucc

SEQ ID NO: 337393 - RNA, 32 nt, Human
auuacaggcgugagccaccgcgcccggccuga

SEQ ID NO: 337394 - RNA, 32 nt, Human
auuacaggcgugagccaccgcgcccggccugu

SEQ ID NO: 337395 - RNA, 32 nt, Human
auuacaggcgugagccaccgcgcccggcggcg

SEQ ID NO: 337396 - RNA, 32 nt, Human
auuacaggcgugagccaccgcgcccggcugcc

SEQ ID NO: 337397 - RNA, 32 nt, Human
auuacaggcgugagccaccgcgccgggcaccu

SEQ ID NO: 337398 - RNA, 32 nt, Human
auuacaggcgugagccaccgcgccuggccaaa

SEQ ID NO: 337399 - RNA, 32 nt, Human
auuacaggcgugagccaccgcgccuggccaag

SEQ ID NO: 337400 - RNA, 32 nt, Human
auuacaggcgugagccaccgcgccuggccaca

SEQ ID NO: 337401 - RNA, 32 nt, Human
auuacaggcgugagccaccgcgccuggccagg

SEQ ID NO: 337402 - RNA, 32 nt, Human
auuacaggcgugagccaccgcgccuggccgau

SEQ ID NO: 337403 - RNA, 32 nt, Human
auuacaggcgugagccaccgcgccuggccuaa

SEQ ID NO: 337404 - RNA, 32 nt, Human
auuacaggcgugagccaccgcgccuggccuca

SEQ ID NO: 337405 - RNA, 32 nt, Human
auuacaggcgugagccaccgcgccuggccuuc

SEQ ID NO: 337406 - RNA, 32 nt, Human
auuacaggcgugagccaccgcgccuggucuau

SEQ ID NO: 337407 - RNA, 32 nt, Human
auuacaggcgugagccaccgcggcccaacagc

SEQ ID NO: 337408 - RNA, 32 nt, Human
auuacaggcgugagccaccgcguccagccaca

SEQ ID NO: 337409 - RNA, 32 nt, Human
auuacaggcgugagccaccgcguccggccucu

SEQ ID NO: 337410 - RNA, 32 nt, Human
auuacaggcgugagccaccgcguccggcucag

SEQ ID NO: 337411 - RNA, 32 nt, Human
auuacaggcgugagccaccgcuccuggccuau

SEQ ID NO: 337412 - RNA, 32 nt, Human
auuacaggcgugagccaccguacccagccugg

SEQ ID NO: 337413 - RNA, 32 nt, Human
auuacaggcgugagccaccgugcccagccucc

SEQ ID NO: 337414 - RNA, 32 nt, Human
auuacaggcgugagccaccgugcccagccuuc

SEQ ID NO: 337415 - RNA, 32 nt, Human
auuacaggcgugagccaccgugcccagccuuu

SEQ ID NO: 337416 - RNA, 32 nt, Human
auuacaggcgugagccaccgugcccggcccaa

SEQ ID NO: 337417 - RNA, 32 nt, Human
auuacaggcgugagccaccgugcccggcccag

SEQ ID NO: 337418 - RNA, 32 nt, Human
auuacaggcgugagccaccgugcccggcccua

SEQ ID NO: 337419 - RNA, 32 nt, Human
auuacaggcgugagccaccgugcccggcccuu

SEQ ID NO: 337420 - RNA, 32 nt, Human
auuacaggcgugagccaccgugcccggccuaa

SEQ ID NO: 337421 - RNA, 32 nt, Human
auuacaggcgugagccaccgugcccggccuac

SEQ ID NO: 337422 - RNA, 32 nt, Human
auuacaggcgugagccaccgugcccggccucu

SEQ ID NO: 337423 - RNA, 32 nt, Human
auuacaggcgugagccaccgugcccggccuga

SEQ ID NO: 337424 - RNA, 32 nt, Human
auuacaggcgugagccaccgugcccggccugu

SEQ ID NO: 337425 - RNA, 32 nt, Human
auuacaggcgugagccaccgugccuggccaag

SEQ ID NO: 337426 - RNA, 32 nt, Human
auuacaggcgugagccaccgugccuggccacg

SEQ ID NO: 337427 - RNA, 32 nt, Human
auuacaggcgugagccaccgugccuggccaga

SEQ ID NO: 337428 - RNA, 32 nt, Human
auuacaggcgugagccaccgugccuggccagg

SEQ ID NO: 337429 - RNA, 32 nt, Human
auuacaggcgugagccaccgugccuggcccug

SEQ ID NO: 337430 - RNA, 32 nt, Human
auuacaggcgugagccaccgugccuggccgau

SEQ ID NO: 337431 - RNA, 32 nt, Human
auuacaggcgugagccaccgugccuggccgug

SEQ ID NO: 337432 - RNA, 32 nt, Human
auuacaggcgugagccaccgugccuggccuaa

SEQ ID NO: 337433 - RNA, 32 nt, Human
auuacaggcgugagccaccgugccuggcugag

SEQ ID NO: 337434 - RNA, 32 nt, Human
auuacaggcgugagccaccgugccuggcugua

SEQ ID NO: 337435 - RNA, 32 nt, Human
auuacaggcgugagccaccgugcucagccuaa

SEQ ID NO: 337436 - RNA, 32 nt, Human
auuacaggcgugagccaccguguccggccgua

SEQ ID NO: 337437 - RNA, 32 nt, Human
auuacaggcgugagccaccucacccagccggc

SEQ ID NO: 337438 - RNA, 32 nt, Human
auuacaggcgugagccaccucgcccagcggca

SEQ ID NO: 337439 - RNA, 32 nt, Human
auuacaggcgugagccaccucgcccggccaau

SEQ ID NO: 337440 - RNA, 32 nt, Human
auuacaggcgugagccaccuugcccagcccac

SEQ ID NO: 337441 - RNA, 32 nt, Human
auuacaggcgugagccaccuugccuagcccac

SEQ ID NO: 337442 - RNA, 32 nt, Human
auuacaggcgugagccacggcaccaggcccuc

SEQ ID NO: 337443 - RNA, 32 nt, Human
auuacaggcgugagccacggcacgcagccagc

SEQ ID NO: 337444 - RNA, 32 nt, Human
auuacaggcgugagccacggcgcccagccugu

SEQ ID NO: 337445 - RNA, 32 nt, Human
auuacaggcgugagccacuacacccagccaau

SEQ ID NO: 337446 - RNA, 32 nt, Human
auuacaggcgugagccacuccacccagcccag

SEQ ID NO: 337447 - RNA, 32 nt, Human
auuacaggcgugagccacucugcccggccugu

SEQ ID NO: 337448 - RNA, 32 nt, Human
auuacaggcgugagccacugagcccagccuac

SEQ ID NO: 337449 - RNA, 32 nt, Human
auuacaggcgugagccacugagcccggccaaa

SEQ ID NO: 337450 - RNA, 32 nt, Human
auuacaggcgugagccacugcacccacccacg

SEQ ID NO: 337451 - RNA, 32 nt, Human
auuacaggcgugagccacugcacccagccaaa

SEQ ID NO: 337452 - RNA, 32 nt, Human
auuacaggcgugagccacugcacccagcccuc

SEQ ID NO: 337453 - RNA, 32 nt, Human
auuacaggcgugagccacugcacccagccgag

SEQ ID NO: 337454 - RNA, 32 nt, Human
auuacaggcgugagccacugcacccagccuag

SEQ ID NO: 337455 - RNA, 32 nt, Human
auuacaggcgugagccacugcacccagccuau

SEQ ID NO: 337456 - RNA, 32 nt, Human
auuacaggcgugagccacugcacccagccuca

SEQ ID NO: 337457 - RNA, 32 nt, Human
auuacaggcgugagccacugcacccagccugg

SEQ ID NO: 337458 - RNA, 32 nt, Human
auuacaggcgugagccacugcacccggccgug

SEQ ID NO: 337459 - RNA, 32 nt, Human
auuacaggcgugagccacugcacccggccuaa

SEQ ID NO: 337460 - RNA, 32 nt, Human
auuacaggcgugagccacugcacccggcucac

SEQ ID NO: 337461 - RNA, 32 nt, Human
auuacaggcgugagccacugcaccuggcccuc

SEQ ID NO: 337462 - RNA, 32 nt, Human
auuacaggcgugagccacugcaccuggccucu

SEQ ID NO: 337463 - RNA, 32 nt, Human
auuacaggcgugagccacugcaccuggccuga

SEQ ID NO: 337464 - RNA, 32 nt, Human
auuacaggcgugagccacugcaccuggccuua

SEQ ID NO: 337465 - RNA, 32 nt, Human
auuacaggcgugagccacugcccagcuauacu

SEQ ID NO: 337466 - RNA, 32 nt, Human
auuacaggcgugagccacugcccccagcccca

SEQ ID NO: 337467 - RNA, 32 nt, Human
auuacaggcgugagccacugcgcccagccaac

SEQ ID NO: 337468 - RNA, 32 nt, Human
auuacaggcgugagccacugcgcccagccuga

SEQ ID NO: 337469 - RNA, 32 nt, Human
auuacaggcgugagccacugcgcccagccugu

SEQ ID NO: 337470 - RNA, 32 nt, Human
auuacaggcgugagccacugcgcccagccuug

SEQ ID NO: 337471 - RNA, 32 nt, Human
auuacaggcgugagccacugcgcccagcuacc

SEQ ID NO: 337472 - RNA, 32 nt, Human
auuacaggcgugagccacugcgcccggccaau

SEQ ID NO: 337473 - RNA, 32 nt, Human
auuacaggcgugagccacugcgcccggccaca

SEQ ID NO: 337474 - RNA, 32 nt, Human
auuacaggcgugagccacugcgcccggcccua

SEQ ID NO: 337475 - RNA, 32 nt, Human
auuacaggcgugagccacugcgcccggccuaa

SEQ ID NO: 337476 - RNA, 32 nt, Human
auuacaggcgugagccacugcgcccggccuau

SEQ ID NO: 337477 - RNA, 32 nt, Human
auuacaggcgugagccacugcgcccggccucc

SEQ ID NO: 337478 - RNA, 32 nt, Human
auuacaggcgugagccacugcgcccggccugu

SEQ ID NO: 337479 - RNA, 32 nt, Human
auuacaggcgugagccacugcgcccggccuug

SEQ ID NO: 337480 - RNA, 32 nt, Human
auuacaggcgugagccacugcgcccgggcaag

SEQ ID NO: 337481 - RNA, 32 nt, Human
auuacaggcgugagccacugcgccuggccaag

SEQ ID NO: 337482 - RNA, 32 nt, Human
auuacaggcgugagccacugcgccuggccaga

SEQ ID NO: 337483 - RNA, 32 nt, Human
auuacaggcgugagccacugcgccuggccauc

SEQ ID NO: 337484 - RNA, 32 nt, Human
auuacaggcgugagccacugcgccuggccgug

SEQ ID NO: 337485 - RNA, 32 nt, Human
auuacaggcgugagccacugcgccuggccuag

SEQ ID NO: 337486 - RNA, 32 nt, Human
auuacaggcgugagccacugcgccuggccuuu

SEQ ID NO: 337487 - RNA, 32 nt, Human
auuacaggcgugagccacugcguccagccaga

SEQ ID NO: 337488 - RNA, 32 nt, Human
auuacaggcgugagccacugcucccagccucu

SEQ ID NO: 337489 - RNA, 32 nt, Human
auuacaggcgugagccacugcuccuggcccaa

SEQ ID NO: 337490 - RNA, 32 nt, Human
auuacaggcgugagccacuggcccggcggcac

SEQ ID NO: 337491 - RNA, 32 nt, Human
auuacaggcgugagccacuggcggccucaacu

SEQ ID NO: 337492 - RNA, 32 nt, Human
auuacaggcgugagccacugggcccagccuaa

SEQ ID NO: 337493 - RNA, 32 nt, Human
auuacaggcgugagccacugugcauggcccca

SEQ ID NO: 337494 - RNA, 32 nt, Human
auuacaggcgugagccacugugcccagccaaa

SEQ ID NO: 337495 - RNA, 32 nt, Human
auuacaggcgugagccacugugcccagccacc

SEQ ID NO: 337496 - RNA, 32 nt, Human
auuacaggcgugagccacugugcccagccgau

SEQ ID NO: 337497 - RNA, 32 nt, Human
auuacaggcgugagccacugugcccagccgga

SEQ ID NO: 337498 - RNA, 32 nt, Human
auuacaggcgugagccacugugcccagccuaa

SEQ ID NO: 337499 - RNA, 32 nt, Human
auuacaggcgugagccacugugcccagcugag

SEQ ID NO: 337500 - RNA, 32 nt, Human
auuacaggcgugagccacugugcccggccaag

SEQ ID NO: 337501 - RNA, 32 nt, Human
auuacaggcgugagccacugugcccggccuca

SEQ ID NO: 337502 - RNA, 32 nt, Human
auuacaggcgugagccacugugcccggccuug

SEQ ID NO: 337503 - RNA, 32 nt, Human
auuacaggcgugagccacugugcccggcuguu

SEQ ID NO: 337504 - RNA, 32 nt, Human
auuacaggcgugagccacugugccuagccauu

SEQ ID NO: 337505 - RNA, 32 nt, Human
auuacaggcgugagccacugugccuggccgac

SEQ ID NO: 337506 - RNA, 32 nt, Human
auuacaggcgugagccacugugccuggccuau

SEQ ID NO: 337507 - RNA, 32 nt, Human
auuacaggcgugagccacugugccuggccugu

SEQ ID NO: 337508 - RNA, 32 nt, Human
auuacaggcgugagccacugugccuggccuua

SEQ ID NO: 337509 - RNA, 32 nt, Human
auuacaggcgugagccacugugccuggcugag

SEQ ID NO: 337510 - RNA, 32 nt, Human
auuacaggcgugagccacugugccuggcuggu

SEQ ID NO: 337511 - RNA, 32 nt, Human
auuacaggcgugagccacugugccuggcuucc

SEQ ID NO: 337512 - RNA, 32 nt, Human
auuacaggcgugagccacuuacccggccucug

SEQ ID NO: 337513 - RNA, 32 nt, Human
auuacaggcgugagccagugugcccggccucc

SEQ ID NO: 337514 - RNA, 32 nt, Human
auuacaggcgugagccauggcgcccagccugg

SEQ ID NO: 337515 - RNA, 32 nt, Human
auuacaggcgugagccauggcgcccagccuuc

SEQ ID NO: 337516 - RNA, 32 nt, Human
auuacaggcgugagccauggugcccagccugg

SEQ ID NO: 337517 - RNA, 32 nt, Human
auuacaggcgugagccauugcgccugggcagg

SEQ ID NO: 337518 - RNA, 32 nt, Human
auuacaggcgugcaccacugaguccagccuau

SEQ ID NO: 337519 - RNA, 32 nt, Human
auuacaggcguuagccacugcgcccggcccga

SEQ ID NO: 337520 - RNA, 32 nt, Human
auuacaggcucaauaacuauuuacugaaugug

SEQ ID NO: 337521 - RNA, 32 nt, Human
auuacaggcuccugccaccacgcccagcuaau

SEQ ID NO: 337522 - RNA, 32 nt, Human
auuacaggcuggagcuacagagcccagccugu

SEQ ID NO: 337523 - RNA, 32 nt, Human
auuacaggcuugagccaccacgcccagacuug

SEQ ID NO: 337524 - RNA, 32 nt, Human
auuacaggcuugagccaccacgcccagccugu

SEQ ID NO: 337525 - RNA, 32 nt, Human
auuacaggcuugagccaccacgcccaguccaa

SEQ ID NO: 337526 - RNA, 32 nt, Human
auuacaggcuugagccaccgcgcccggcuaua

SEQ ID NO: 337527 - RNA, 32 nt, Human
auuacaggcuugagccaccgugccaggccugu

SEQ ID NO: 337528 - RNA, 32 nt, Human
auuacaggcuugagccacugcaccuagccucu

SEQ ID NO: 337529 - RNA, 32 nt, Human
auuacaggcuugagccacugcgcccggccuag

SEQ ID NO: 337530 - RNA, 32 nt, Human
auuacaggcuugagccacugcgccuggccugg

SEQ ID NO: 337531 - RNA, 32 nt, Human
auuacaggcuugagccacugcucccggcugau

SEQ ID NO: 337532 - RNA, 32 nt, Human
auuacaggcuugagccacugugccuggcuuca

SEQ ID NO: 337533 - RNA, 32 nt, Human
auuacagggacaucucaggcugugcuguccug

SEQ ID NO: 337534 - RNA, 32 nt, Human
auuacagggaugagccaccauacccggcuuuu

SEQ ID NO: 337535 - RNA, 32 nt, Human
auuacagggaugagccaccgcgcccagccuca

SEQ ID NO: 337536 - RNA, 32 nt, Human
auuacagggccagccgggcaugguggcucacg

SEQ ID NO: 337537 - RNA, 32 nt, Human
auuacagggggccgggacagggagguugggag

SEQ ID NO: 337538 - RNA, 32 nt, Human
auuacagggguaagccacugugcccggccggu

SEQ ID NO: 337539 - RNA, 32 nt, Human
auuacaggggucuucuagguauuccccacaca

SEQ ID NO: 337540 - RNA, 32 nt, Human
auuacaggggugagccaccacgcccagcccca

SEQ ID NO: 337541 - RNA, 32 nt, Human
auuacaggggugagccacugcgcccagccuaa

SEQ ID NO: 337542 - RNA, 32 nt, Human
auuacaggggugagccacugugcccggccaua

SEQ ID NO: 337543 - RNA, 32 nt, Human
auuacagguacgcaccaccacgcccagcucau

SEQ ID NO: 337544 - RNA, 32 nt, Human
auuacagguaugagccacaacacccagccuuu

SEQ ID NO: 337545 - RNA, 32 nt, Human
auuacagguaugagccacaacgcccagccauc

SEQ ID NO: 337546 - RNA, 32 nt, Human
auuacagguaugagccaccacgcccggucaga

SEQ ID NO: 337547 - RNA, 32 nt, Human
auuacagguaugagccaccaugcccggcuggc

SEQ ID NO: 337548 - RNA, 32 nt, Human
auuacagguaugagccaccaugccuggcccca

SEQ ID NO: 337549 - RNA, 32 nt, Human
auuacagguaugagccaccgcaccgggccugu

SEQ ID NO: 337550 - RNA, 32 nt, Human
auuacagguaugagccaccgcgcccagcccau

SEQ ID NO: 337551 - RNA, 32 nt, Human
auuacagguaugagccacugcgcccggccagu

SEQ ID NO: 337552 - RNA, 32 nt, Human
auuacaggugcacaccaccaugcccggcaaau

SEQ ID NO: 337553 - RNA, 32 nt, Human
auuacaggugcccaccaccaagcccugcaaau

SEQ ID NO: 337554 - RNA, 32 nt, Human
auuacaggugcccaccaccaugcccggcaaau

SEQ ID NO: 337555 - RNA, 32 nt, Human
auuacaggugcccaccaccaugcccggcuaau

SEQ ID NO: 337556 - RNA, 32 nt, Human
auuacaggugcccaccagcacgcccagcuaau

SEQ ID NO: 337557 - RNA, 32 nt, Human
auuacaggugcccaccuccacgcccagcuaau

SEQ ID NO: 337558 - RNA, 32 nt, Human
auuacaggugcccgccaccacgcccagcuaau

SEQ ID NO: 337559 - RNA, 32 nt, Human
auuacaggugcccgcuaccaugcccggguaau

SEQ ID NO: 337560 - RNA, 32 nt, Human
auuacaggugcccgcuacuaugcccggcuaau

SEQ ID NO: 337561 - RNA, 32 nt, Human
auuacaggugcgcaccaccaugcccggcuaac

SEQ ID NO: 337562 - RNA, 32 nt, Human
auuacaggugggagccacuacagcuggcccag

SEQ ID NO: 337563 - RNA, 32 nt, Human
auuacaggugggagccacugcacccggccuga

SEQ ID NO: 337564 - RNA, 32 nt, Human
auuacagguguaagccacugagcccggccuaa

SEQ ID NO: 337565 - RNA, 32 nt, Human
auuacagguguaagccacugcgcccggccuuu

SEQ ID NO: 337566 - RNA, 32 nt, Human
auuacagguguaagccacugcucccagccuuu

SEQ ID NO: 337567 - RNA, 32 nt, Human
auuacagguguaagccacugugcccggccucc

SEQ ID NO: 337568 - RNA, 32 nt, Human
auuacagguguaagccacugugccugguuuug

SEQ ID NO: 337569 - RNA, 32 nt, Human
auuacaggugugaaccaccacacccagcccac

SEQ ID NO: 337570 - RNA, 32 nt, Human
auuacaggugugaaccaccaugcccagccaga

SEQ ID NO: 337571 - RNA, 32 nt, Human
auuacaggugugaaccaccguacccagccuau

SEQ ID NO: 337572 - RNA, 32 nt, Human
auuacaggugugaaccacugcgcccagcccca

SEQ ID NO: 337573 - RNA, 32 nt, Human
auuacaggugugaaccacugugcccggccugu

SEQ ID NO: 337574 - RNA, 32 nt, Human
auuacaggugugaaucaccauacucagccuca

SEQ ID NO: 337575 - RNA, 32 nt, Human
auuacaggugugacccacugcgcacagcccca

SEQ ID NO: 337576 - RNA, 32 nt, Human
auuacaggugugagcaaccauugagacaagag

SEQ ID NO: 337577 - RNA, 32 nt, Human
auuacaggugugagcauagugagaccuuggcg

SEQ ID NO: 337578 - RNA, 32 nt, Human
auuacaggugugagccacagcacccaaccuuu

SEQ ID NO: 337579 - RNA, 32 nt, Human
auuacaggugugagccacagcaccuggccaac

SEQ ID NO: 337580 - RNA, 32 nt, Human
auuacaggugugagccacagcacucggccuaa

SEQ ID NO: 337581 - RNA, 32 nt, Human
auuacaggugugagccacagcgccuggcccag

SEQ ID NO: 337582 - RNA, 32 nt, Human
auuacaggugugagccacagugcccagcacuu

SEQ ID NO: 337583 - RNA, 32 nt, Human
auuacaggugugagccacagugccuggcccau

SEQ ID NO: 337584 - RNA, 32 nt, Human
auuacaggugugagccaccacacccagccaac

SEQ ID NO: 337585 - RNA, 32 nt, Human
auuacaggugugagccaccacacccagccaau

SEQ ID NO: 337586 - RNA, 32 nt, Human
auuacaggugugagccaccacacccagcccag

SEQ ID NO: 337587 - RNA, 32 nt, Human
auuacaggugugagccaccacacccagccucu

SEQ ID NO: 337588 - RNA, 32 nt, Human
auuacaggugugagccaccacacccggccaac

SEQ ID NO: 337589 - RNA, 32 nt, Human
auuacaggugugagccaccacacccggcccaa

SEQ ID NO: 337590 - RNA, 32 nt, Human
auuacaggugugagccaccacacccggccccc

SEQ ID NO: 337591 - RNA, 32 nt, Human
auuacaggugugagccaccacacccggccuau

SEQ ID NO: 337592 - RNA, 32 nt, Human
auuacaggugugagccaccacacccggccuua

SEQ ID NO: 337593 - RNA, 32 nt, Human
auuacaggugugagccaccacaccugacccau

SEQ ID NO: 337594 - RNA, 32 nt, Human
auuacaggugugagccaccacaccuggccaag

SEQ ID NO: 337595 - RNA, 32 nt, Human
auuacaggugugagccaccacaccuggcccau

SEQ ID NO: 337596 - RNA, 32 nt, Human
auuacaggugugagccaccacaccuggcccca

SEQ ID NO: 337597 - RNA, 32 nt, Human
auuacaggugugagccaccacacugggccaau

SEQ ID NO: 337598 - RNA, 32 nt, Human
auuacaggugugagccaccacauccagccuaa

SEQ ID NO: 337599 - RNA, 32 nt, Human
auuacaggugugagccaccacgaucagccucu

SEQ ID NO: 337600 - RNA, 32 nt, Human
auuacaggugugagccaccacgcauggcccug

SEQ ID NO: 337601 - RNA, 32 nt, Human
auuacaggugugagccaccacgcccagccaug

SEQ ID NO: 337602 - RNA, 32 nt, Human
auuacaggugugagccaccacgcccagccugu

SEQ ID NO: 337603 - RNA, 32 nt, Human
auuacaggugugagccaccacgcccagccuuu

SEQ ID NO: 337604 - RNA, 32 nt, Human
auuacaggugugagccaccacgcccggccaag

SEQ ID NO: 337605 - RNA, 32 nt, Human
auuacaggugugagccaccacgcccggccgau

SEQ ID NO: 337606 - RNA, 32 nt, Human
auuacaggugugagccaccacgcccgguacau

SEQ ID NO: 337607 - RNA, 32 nt, Human
auuacaggugugagccaccacgccuggacuau

SEQ ID NO: 337608 - RNA, 32 nt, Human
auuacaggugugagccaccacgccuggcuaau

SEQ ID NO: 337609 - RNA, 32 nt, Human
auuacaggugugagccaccacgccugggccca

SEQ ID NO: 337610 - RNA, 32 nt, Human
auuacaggugugagccaccacguccggccaau

SEQ ID NO: 337611 - RNA, 32 nt, Human
auuacaggugugagccaccaggcccagccuau

SEQ ID NO: 337612 - RNA, 32 nt, Human
auuacaggugugagccaccaggcucagccccc

SEQ ID NO: 337613 - RNA, 32 nt, Human
auuacaggugugagccaccaugccaggcccuc

SEQ ID NO: 337614 - RNA, 32 nt, Human
auuacaggugugagccaccaugcccaacaccc

SEQ ID NO: 337615 - RNA, 32 nt, Human
auuacaggugugagccaccaugcccagcccaa

SEQ ID NO: 337616 - RNA, 32 nt, Human
auuacaggugugagccaccaugcccagccucu

SEQ ID NO: 337617 - RNA, 32 nt, Human
auuacaggugugagccaccaugcccagccuga

SEQ ID NO: 337618 - RNA, 32 nt, Human
auuacaggugugagccaccaugcccagccugu

SEQ ID NO: 337619 - RNA, 32 nt, Human
auuacaggugugagccaccaugcccggccuug

SEQ ID NO: 337620 - RNA, 32 nt, Human
auuacaggugugagccaccaugcccggcuaau

SEQ ID NO: 337621 - RNA, 32 nt, Human
auuacaggugugagccaccaugccuggcccca

SEQ ID NO: 337622 - RNA, 32 nt, Human
auuacaggugugagccaccaugccuggccgug

SEQ ID NO: 337623 - RNA, 32 nt, Human
auuacaggugugagccaccaugccuggccuaa

SEQ ID NO: 337624 - RNA, 32 nt, Human
auuacaggugugagccaccaugccuggccugc

SEQ ID NO: 337625 - RNA, 32 nt, Human
auuacaggugugagccaccaugccuggcucug

SEQ ID NO: 337626 - RNA, 32 nt, Human
auuacaggugugagccaccaugccugggcuaa

SEQ ID NO: 337627 - RNA, 32 nt, Human
auuacaggugugagccaccaugccuggucacc

SEQ ID NO: 337628 - RNA, 32 nt, Human
auuacaggugugagccaccaugucuggccuug

SEQ ID NO: 337629 - RNA, 32 nt, Human
auuacaggugugagccacccugcccagccguc

SEQ ID NO: 337630 - RNA, 32 nt, Human
auuacaggugugagccaccgcacccaauccua

SEQ ID NO: 337631 - RNA, 32 nt, Human
auuacaggugugagccaccgcacccagccuau

SEQ ID NO: 337632 - RNA, 32 nt, Human
auuacaggugugagccaccgcacccggccaaa

SEQ ID NO: 337633 - RNA, 32 nt, Human
auuacaggugugagccaccgcacccggccaac

SEQ ID NO: 337634 - RNA, 32 nt, Human
auuacaggugugagccaccgcacccggcuggc

SEQ ID NO: 337635 - RNA, 32 nt, Human
auuacaggugugagccaccgcaccuggccaga

SEQ ID NO: 337636 - RNA, 32 nt, Human
auuacaggugugagccaccgcaccuggccugc

SEQ ID NO: 337637 - RNA, 32 nt, Human
auuacaggugugagccaccgcacucagcugau

SEQ ID NO: 337638 - RNA, 32 nt, Human
auuacaggugugagccaccgcgccaggccuca

SEQ ID NO: 337639 - RNA, 32 nt, Human
auuacaggugugagccaccgcgcccagccaag

SEQ ID NO: 337640 - RNA, 32 nt, Human
auuacaggugugagccaccgcgcccagccacc

SEQ ID NO: 337641 - RNA, 32 nt, Human
auuacaggugugagccaccgcgcccagcccgu

SEQ ID NO: 337642 - RNA, 32 nt, Human
auuacaggugugagccaccgcgcccggcccga

SEQ ID NO: 337643 - RNA, 32 nt, Human
auuacaggugugagccaccgcgcccggcccuu

SEQ ID NO: 337644 - RNA, 32 nt, Human
auuacaggugugagccaccgcgcccggccgag

SEQ ID NO: 337645 - RNA, 32 nt, Human
auuacaggugugagccaccgcgcccggccucu

SEQ ID NO: 337646 - RNA, 32 nt, Human
auuacaggugugagccaccgcgcccggcuguu

SEQ ID NO: 337647 - RNA, 32 nt, Human
auuacaggugugagccaccgcgccgggcccuu

SEQ ID NO: 337648 - RNA, 32 nt, Human
auuacaggugugagccaccgcgccuggcccuc

SEQ ID NO: 337649 - RNA, 32 nt, Human
auuacaggugugagccaccgcgccuggcccug

SEQ ID NO: 337650 - RNA, 32 nt, Human
auuacaggugugagccaccgcgccuggccuau

SEQ ID NO: 337651 - RNA, 32 nt, Human
auuacaggugugagccaccgcgccuggccugg

SEQ ID NO: 337652 - RNA, 32 nt, Human
auuacaggugugagccaccgcgcucggccaga

SEQ ID NO: 337653 - RNA, 32 nt, Human
auuacaggugugagccaccgcguccagccagc

SEQ ID NO: 337654 - RNA, 32 nt, Human
auuacaggugugagccaccgugaccagccaau

SEQ ID NO: 337655 - RNA, 32 nt, Human
auuacaggugugagccaccgugcacggccggc

SEQ ID NO: 337656 - RNA, 32 nt, Human
auuacaggugugagccaccgugcccagccuau

SEQ ID NO: 337657 - RNA, 32 nt, Human
auuacaggugugagccaccgugcccaggcccu

SEQ ID NO: 337658 - RNA, 32 nt, Human
auuacaggugugagccaccgugcccggccaag

SEQ ID NO: 337659 - RNA, 32 nt, Human
auuacaggugugagccaccgugcccggccacc

SEQ ID NO: 337660 - RNA, 32 nt, Human
auuacaggugugagccaccgugcccggcccag

SEQ ID NO: 337661 - RNA, 32 nt, Human
auuacaggugugagccaccgugcccggcccau

SEQ ID NO: 337662 - RNA, 32 nt, Human
auuacaggugugagccaccgugcccggccucu

SEQ ID NO: 337663 - RNA, 32 nt, Human
auuacaggugugagccaccgugccuggccaau

SEQ ID NO: 337664 - RNA, 32 nt, Human
auuacaggugugagccaccgugccuggccagu

SEQ ID NO: 337665 - RNA, 32 nt, Human
auuacaggugugagccaccgugccuggccgag

SEQ ID NO: 337666 - RNA, 32 nt, Human
auuacaggugugagccaccucgccugggcccc

SEQ ID NO: 337667 - RNA, 32 nt, Human
auuacaggugugagccacggcacccagccuag

SEQ ID NO: 337668 - RNA, 32 nt, Human
auuacaggugugagccacggcaccuggccaga

SEQ ID NO: 337669 - RNA, 32 nt, Human
auuacaggugugagccacggugcccggcccac

SEQ ID NO: 337670 - RNA, 32 nt, Human
auuacaggugugagccacuacacccagcccug

SEQ ID NO: 337671 - RNA, 32 nt, Human
auuacaggugugagccacuacgccccggccca

SEQ ID NO: 337672 - RNA, 32 nt, Human
auuacaggugugagccacuauacccgaccaga

SEQ ID NO: 337673 - RNA, 32 nt, Human
auuacaggugugagccacuaugccuggccuuc

SEQ ID NO: 337674 - RNA, 32 nt, Human
auuacaggugugagccacucugccuggccuac

SEQ ID NO: 337675 - RNA, 32 nt, Human
auuacaggugugagccacugagcccagccauu

SEQ ID NO: 337676 - RNA, 32 nt, Human
auuacaggugugagccacugagcccggccaca

SEQ ID NO: 337677 - RNA, 32 nt, Human
auuacaggugugagccacugcaacuggcuaua

SEQ ID NO: 337678 - RNA, 32 nt, Human
auuacaggugugagccacugcacccaacccaa

SEQ ID NO: 337679 - RNA, 32 nt, Human
auuacaggugugagccacugcacccacccaag

SEQ ID NO: 337680 - RNA, 32 nt, Human
auuacaggugugagccacugcacccagcccac

SEQ ID NO: 337681 - RNA, 32 nt, Human
auuacaggugugagccacugcacccagccuac

SEQ ID NO: 337682 - RNA, 32 nt, Human
auuacaggugugagccacugcacccagccugu

SEQ ID NO: 337683 - RNA, 32 nt, Human
auuacaggugugagccacugcacccagcugag

SEQ ID NO: 337684 - RNA, 32 nt, Human
auuacaggugugagccacugcaccccuccuaa

SEQ ID NO: 337685 - RNA, 32 nt, Human
auuacaggugugagccacugcacccgaccgau

SEQ ID NO: 337686 - RNA, 28 nt, Human
auuacaggugugagccacugcacccggc

SEQ ID NO: 337687 - RNA, 32 nt, Human
auuacaggugugagccacugcacccggccaac

SEQ ID NO: 337688 - RNA, 32 nt, Human
auuacaggugugagccacugcacccggccuga

SEQ ID NO: 337689 - RNA, 32 nt, Human
auuacaggugugagccacugcaccuggcagug

SEQ ID NO: 337690 - RNA, 32 nt, Human
auuacaggugugagccacugcaccuggccaug

SEQ ID NO: 337691 - RNA, 32 nt, Human
auuacaggugugagccacugcaccuggccucc

SEQ ID NO: 337692 - RNA, 32 nt, Human
auuacaggugugagccacugcaccuggcucua

SEQ ID NO: 337693 - RNA, 32 nt, Human
auuacaggugugagccacugcacguggccuaa

SEQ ID NO: 337694 - RNA, 32 nt, Human
auuacaggugugagccacugccuggccuggcc

SEQ ID NO: 337695 - RNA, 32 nt, Human
auuacaggugugagccacugcgcccagcacac

SEQ ID NO: 337696 - RNA, 32 nt, Human
auuacaggugugagccacugcgcccagccagc

SEQ ID NO: 337697 - RNA, 32 nt, Human
auuacaggugugagccacugcgcccagccuau

SEQ ID NO: 337698 - RNA, 32 nt, Human
auuacaggugugagccacugcgcccagucaug

SEQ ID NO: 337699 - RNA, 32 nt, Human
auuacaggugugagccacugcgcccggccaug

SEQ ID NO: 337700 - RNA, 32 nt, Human
auuacaggugugagccacugcgccgggccuaa

SEQ ID NO: 337701 - RNA, 32 nt, Human
auuacaggugugagccacugcgccuggccugu

SEQ ID NO: 337702 - RNA, 32 nt, Human
auuacaggugugagccacugggcccggucuuu

SEQ ID NO: 337703 - RNA, 32 nt, Human
auuacaggugugagccacugugcccagcaguu

SEQ ID NO: 337704 - RNA, 32 nt, Human
auuacaggugugagccacugugcccagccuaa

SEQ ID NO: 337705 - RNA, 32 nt, Human
auuacaggugugagccacugugcccagccucu

SEQ ID NO: 337706 - RNA, 32 nt, Human
auuacaggugugagccacugugcccagcguga

SEQ ID NO: 337707 - RNA, 32 nt, Human
auuacaggugugagccacugugcccggccaaa

SEQ ID NO: 337708 - RNA, 32 nt, Human
auuacaggugugagccacugugccuagccuau

SEQ ID NO: 337709 - RNA, 32 nt, Human
auuacaggugugagccacugugccuggccccc

SEQ ID NO: 337710 - RNA, 32 nt, Human
auuacaggugugagccacugugccuggccucc

SEQ ID NO: 337711 - RNA, 32 nt, Human
auuacaggugugagccacugugccuggccuga

SEQ ID NO: 337712 - RNA, 32 nt, Human
auuacaggugugagccacugugccuggccuuc

SEQ ID NO: 337713 - RNA, 32 nt, Human
auuacaggugugagccacugugcguggccucc

SEQ ID NO: 337714 - RNA, 32 nt, Human
auuacaggugugagccacugugcucggccuac

SEQ ID NO: 337715 - RNA, 32 nt, Human
auuacaggugugagccacuguggccgaccuac

SEQ ID NO: 337716 - RNA, 32 nt, Human
auuacaggugugagccacuguguccagccugu

SEQ ID NO: 337717 - RNA, 32 nt, Human
auuacaggugugagccacugugucuagccaag

SEQ ID NO: 337718 - RNA, 32 nt, Human
auuacaggugugagccacuucaccaggcccau

SEQ ID NO: 337719 - RNA, 32 nt, Human
auuacaggugugagccaucacgcucggccaag

SEQ ID NO: 337720 - RNA, 32 nt, Human
auuacaggugugagccauggcacccagcccua

SEQ ID NO: 337721 - RNA, 32 nt, Human
auuacaggugugagccauugugccuggccaag

SEQ ID NO: 337722 - RNA, 32 nt, Human
auuacaggugugagccgccaugccaggccggg

SEQ ID NO: 337723 - RNA, 32 nt, Human
auuacaggugugagccgccaugcccggccggg

SEQ ID NO: 337724 - RNA, 32 nt, Human
auuacaggugugagccgcugcgcucggccuuc

SEQ ID NO: 337725 - RNA, 32 nt, Human
auuacaggugugagccgcugggcccagccugg

SEQ ID NO: 337726 - RNA, 32 nt, Human
auuacaggugugagccuccaugcccagccuaa

SEQ ID NO: 337727 - RNA, 30 nt, Human
auuacaggugugagcuaccaugcccagcca

SEQ ID NO: 337728 - RNA, 32 nt, Human
auuacaggugugagcuaccgcgcccggccuau

SEQ ID NO: 337729 - RNA, 32 nt, Human
auuacaggugugagcuaccgcgccuggccaug

SEQ ID NO: 337730 - RNA, 32 nt, Human
auuacaggugugagcuacugcgcccagcccca

SEQ ID NO: 337731 - RNA, 32 nt, Human
auuacaggugugagcuacugugcccagccugc

SEQ ID NO: 337732 - RNA, 32 nt, Human
auuacaggugugagcugccacgcccagcccca

SEQ ID NO: 337733 - RNA, 32 nt, Human
auuacaggugugagcugccgcacccggccguu

SEQ ID NO: 337734 - RNA, 32 nt, Human
auuacaggugugaggcaccgugccuggcaguc

SEQ ID NO: 337735 - RNA, 32 nt, Human
auuacaggugugaggcacggugcccagccaau

SEQ ID NO: 337736 - RNA, 32 nt, Human
auuacaggugugagucaccacaccuggcugca

SEQ ID NO: 337737 - RNA, 32 nt, Human
auuacaggugugagucaccgcgccuggccggg

SEQ ID NO: 337738 - RNA, 32 nt, Human
auuacaggugugagucaccgcgccuggccuuu

SEQ ID NO: 337739 - RNA, 32 nt, Human
auuacaggugugagucaccgugcccagccugg

SEQ ID NO: 337740 - RNA, 32 nt, Human
auuacaggugugagucacugcacccagccgag

SEQ ID NO: 337741 - RNA, 32 nt, Human
auuacaggugugagucacugcaccuggccaag

SEQ ID NO: 337742 - RNA, 32 nt, Human
auuacaggugugagugcccaugccuggcagga

SEQ ID NO: 337743 - RNA, 32 nt, Human
auuacaggugugcgccaccacgcccaggaaau

SEQ ID NO: 337744 - RNA, 32 nt, Human
auuacaggugugugccaccacacccgacuaau

SEQ ID NO: 337745 - RNA, 32 nt, Human
auuacaggugugugucacugugccugacagcu

SEQ ID NO: 337746 - RNA, 32 nt, Human
auuacagguguuagccacugcuccuggcugau

SEQ ID NO: 337747 - RNA, 32 nt, Human
auuacagguuccugcuaccacgcccagcuaau

SEQ ID NO: 337748 - RNA, 32 nt, Human
auuacagguuugagccaccgugccuggccuaa

SEQ ID NO: 337749 - RNA, 32 nt, Human
auuacagguuugagccacugcaccuagucuuu

SEQ ID NO: 337750 - RNA, 32 nt, Human
auuacagucagaaaauccuuuuucuacugaau

SEQ ID NO: 337751 - RNA, 32 nt, Human
auuacagugccacugcaauccagccugggcaa

SEQ ID NO: 337752 - RNA, 32 nt, Human
auuacaguucuuuccucuuucugcucugccau

SEQ ID NO: 337753 - RNA, 32 nt, Human
auuacaguugccugccaccacgcccagcuaau

SEQ ID NO: 337754 - RNA, 32 nt, Human
auuacaguugcgagccacugugcguggccaga

SEQ ID NO: 337755 - RNA, 32 nt, Human
auuacaguugugagccacugugccuggccuuu

SEQ ID NO: 337756 - RNA, 32 nt, Human
auuacauaugcaauuguagguucaaccugucc

SEQ ID NO: 337757 - RNA, 32 nt, Human
auuacaucuucuuucuucuucucuccuuuucc

SEQ ID NO: 337758 - RNA, 32 nt, Human
auuacaugagccaccacaugcagccagauguu

SEQ ID NO: 337759 - RNA, 32 nt, Human
auuacauguauaccuauguaacaaacccgcau

SEQ ID NO: 337760 - RNA, 32 nt, Human
auuacauuaagaauuugucagauaauguguag

SEQ ID NO: 337761 - RNA, 32 nt, Human
auuacauuaugagggcagcugcagccugugug

SEQ ID NO: 337762 - RNA, 32 nt, Human
auuacauuccauccagccugggcgacaagagc

SEQ ID NO: 337763 - RNA, 32 nt, Human
auuacauucuguacuuacuaagugucaacagc

SEQ ID NO: 337764 - RNA, 32 nt, Human
auuacauugccucaaaaauugguccucgguaa

SEQ ID NO: 337765 - RNA, 32 nt, Human
auuacauuucuauuguuaaaaauaacagaaau

SEQ ID NO: 337766 - RNA, 32 nt, Human
auuacauuuggugugugucccauugaaucaac

SEQ ID NO: 337767 - RNA, 32 nt, Human
auuaccaagguuucaguguacuaguuuugaau

SEQ ID NO: 337768 - RNA, 32 nt, Human
auuaccaauuugaggcccaacaacaguguauu

SEQ ID NO: 337769 - RNA, 32 nt, Human
auuaccacaacagugccacuuauguggaaucu

SEQ ID NO: 337770 - RNA, 32 nt, Human
auuaccacaccaccuggaauaucauacugugg

SEQ ID NO: 337771 - RNA, 28 nt, Human
auuaccacaguugcugccuccuccagaa

SEQ ID NO: 337772 - RNA, 32 nt, Human
auuaccacaugggugcaagucagcauuguaag

SEQ ID NO: 337773 - RNA, 32 nt, Human
auuaccacauuuuuguauuuuaauagucuaca

SEQ ID NO: 337774 - RNA, 32 nt, Human
auuaccagaaaggugauaagccugcauguguc

SEQ ID NO: 337775 - RNA, 32 nt, Human
auuaccagaaagugccucugaaggagccagug

SEQ ID NO: 337776 - RNA, 32 nt, Human
auuaccagaguaaucagauguauaggcuccac

SEQ ID NO: 337777 - RNA, 32 nt, Human
auuaccagauccuaaagcuguguccuuaauga

SEQ ID NO: 337778 - RNA, 32 nt, Human
auuaccagcacuuacaagcacugugaaaacug

SEQ ID NO: 337779 - RNA, 32 nt, Human
auuaccagcuucuaaaugaauguuguuuuuga

SEQ ID NO: 337780 - RNA, 32 nt, Human
auuaccagguucuuauaaauacagcuuguaca

SEQ ID NO: 337781 - RNA, 32 nt, Human
auuaccagucauuaaaguccaguauuacuaag

SEQ ID NO: 337782 - RNA, 32 nt, Human
auuaccauaaaugcuauacauccaugcauugg

SEQ ID NO: 337783 - RNA, 32 nt, Human
auuaccauagacgacuccuagaggacagugcu

SEQ ID NO: 337784 - RNA, 32 nt, Human
auuaccaucugucccuuaucucuuggggcaua

SEQ ID NO: 337785 - RNA, 32 nt, Human
auuaccauugucauccaugcuuucagagggac

SEQ ID NO: 337786 - RNA, 32 nt, Human
auuacccagcggcugcuaaccccucuccucgc

SEQ ID NO: 337787 - RNA, 32 nt, Human
auuacccagcuggucucgagcuccuggccuca

SEQ ID NO: 337788 - RNA, 32 nt, Human
auuacccaggagaaaucaagugauccucaagg

SEQ ID NO: 337789 - RNA, 32 nt, Human
auuacccggcugcgguccagagccaagcggcg

SEQ ID NO: 337790 - RNA, 32 nt, Human
auuacccgggcuugguggagugcaccuguaau

SEQ ID NO: 337791 - RNA, 32 nt, Human
auuacccucuacugccccuugggcccccuguc

SEQ ID NO: 337792 - RNA, 32 nt, Human
auuacccugccugcucugugcuuugcugcaga

SEQ ID NO: 337793 - RNA, 32 nt, Human
auuacccuuggucacugugauuucuguuuugu

SEQ ID NO: 337794 - RNA, 32 nt, Human
auuaccggcaugagccacugcgccuggccgac

SEQ ID NO: 337795 - RNA, 32 nt, Human
auuaccggcgugagccaccaugcccagccuau

SEQ ID NO: 337796 - RNA, 32 nt, Human
auuaccggcgugagccaccaugccuggcccgg

SEQ ID NO: 337797 - RNA, 32 nt, Human
auuaccggcuugagccaccacacccggcacau

SEQ ID NO: 337798 - RNA, 32 nt, Human
auuaccggugugagccaccgcgccggcccagc

SEQ ID NO: 337799 - RNA, 32 nt, Human
auuaccggugugagccacugcgcccggccuuu

SEQ ID NO: 337800 - RNA, 32 nt, Human
auuaccgugguggcaggcgccuguaaucccag

SEQ ID NO: 337801 - RNA, 32 nt, Human
auuaccucacugcauuccagccugggcaacag

SEQ ID NO: 337802 - RNA, 32 nt, Human
auuaccuccuacuugccauucacccaucaaug

SEQ ID NO: 337803 - RNA, 32 nt, Human
auuaccucuaauugcuuuauuucaguguauga

SEQ ID NO: 337804 - RNA, 32 nt, Human
auuaccuggacccagaggguguaggaauggca

SEQ ID NO: 337805 - RNA, 32 nt, Human
auuaccugggauuacaggcaugugccaccaca

SEQ ID NO: 337806 - RNA, 32 nt, Human
auuaccugggcaugguggcaggugcuuauaau

SEQ ID NO: 337807 - RNA, 32 nt, Human
auuaccugguucugcuauccuuagucauaacu

SEQ ID NO: 337808 - RNA, 32 nt, Human
auuaccugucuuccuguuucucaagaauauuu

SEQ ID NO: 337809 - RNA, 32 nt, Human
auuaccuguugcugucaaguggcugggggcca

SEQ ID NO: 337810 - RNA, 32 nt, Human
auuaccuuauuggauauuugauauuugguuau

SEQ ID NO: 337811 - RNA, 31 nt, Human
auuaccuucagaagcucucuguugaauucca

SEQ ID NO: 337812 - RNA, 32 nt, Human
auuaccuucuaucccuuccuccacgugaggac

SEQ ID NO: 337813 - RNA, 32 nt, Human
auuaccuugacaggauaacugucagucuuguc

SEQ ID NO: 337814 - RNA, 32 nt, Human
auuaccuugcuaaggaauagcacacagugaag

SEQ ID NO: 337815 - RNA, 32 nt, Human
auuaccuugggaggggaaggggcagugguggc

SEQ ID NO: 337816 - RNA, 32 nt, Human
auuaccuugguaucugaaguuucccucugucu

SEQ ID NO: 337817 - RNA, 32 nt, Human
auuaccuuuaccucuuuuuaccaaaauguuaa

SEQ ID NO: 337818 - RNA, 24 nt, Human
auuaccuuuccuuugucugccuca

SEQ ID NO: 337819 - RNA, 32 nt, Human
auuaccuuucuccuucccaaaaagcuuuaucu

SEQ ID NO: 337820 - RNA, 32 nt, Human
auuaccuuuggucuaucugugugugcucugcc

SEQ ID NO: 337821 - RNA, 32 nt, Human
auuaccuuuuuagcuauuuuuaauagucuucu

SEQ ID NO: 337822 - RNA, 32 nt, Human
auuacgacccugcaacaggaaaaugaggaccu

SEQ ID NO: 337823 - RNA, 32 nt, Human
auuacgacuccuguaaucccagcacuuuggga

SEQ ID NO: 337824 - RNA, 32 nt, Human
auuacgccacugcaccccaaccugggcgacag

SEQ ID NO: 337825 - RNA, 32 nt, Human
auuacgccacugcacuaaugucuggugacaga

SEQ ID NO: 337826 - RNA, 32 nt, Human
auuacgccacugcacuccagccugggcaacac

SEQ ID NO: 337827 - RNA, 32 nt, Human
auuacgccacugcacuccagccugggcaacag

SEQ ID NO: 337828 - RNA, 32 nt, Human
auuacgccacugcacuccagccugggugacgg

SEQ ID NO: 337829 - RNA, 32 nt, Human
auuacgccacugcauuguagccugggcaacag

SEQ ID NO: 337830 - RNA, 32 nt, Human
auuacgccuguaaucccagcacuuugggaggu

SEQ ID NO: 337831 - RNA, 32 nt, Human
auuacggacgugagccaccacgccuggcccag

SEQ ID NO: 337832 - RNA, 32 nt, Human
auuacggcucagugcaaccuugaccuccuggg

SEQ ID NO: 337833 - RNA, 32 nt, Human
auuacgggcaugagccacugcacccagcaaug

SEQ ID NO: 337834 - RNA, 32 nt, Human
auuacgggcaugagccacugcacccggcccug

SEQ ID NO: 337835 - RNA, 32 nt, Human
auuacgggcgugagccaccgugcucggcccaa

SEQ ID NO: 337836 - RNA, 32 nt, Human
auuacgggcgugagccacuucacccggcccgg

SEQ ID NO: 337837 - RNA, 32 nt, Human
auuacgggggugagccacugcgcccggccccu

SEQ ID NO: 337838 - RNA, 32 nt, Human
auuacgggugugagcaacccugcccggccagu

SEQ ID NO: 337839 - RNA, 32 nt, Human
auuacgggugugagccaccacacccggcccaa

SEQ ID NO: 337840 - RNA, 32 nt, Human
auuacgggugugagccaccacgccuggcuaau

SEQ ID NO: 337841 - RNA, 32 nt, Human
auuacgggugugagccaccgugcccagccuuu

SEQ ID NO: 337842 - RNA, 32 nt, Human
auuacgggugugagccgccgcgccgagcaugg

SEQ ID NO: 337843 - RNA, 32 nt, Human
auuacgguagugcauugccuuaguggcuugcc

SEQ ID NO: 337844 - RNA, 32 nt, Human
auuacgguugaguucuguggcuucuucacuug

SEQ ID NO: 337845 - RNA, 32 nt, Human
auuacgucacagcuucccaucugguugcuuuc

SEQ ID NO: 337846 - RNA, 32 nt, Human
auuacgucacugcauuccagccugggugacag

SEQ ID NO: 337847 - RNA, 32 nt, Human
auuacgucaguguggcugccuuccaggugaug

SEQ ID NO: 337848 - RNA, 32 nt, Human
auuacgugaacgcauccucuuugcuaggucaa

SEQ ID NO: 337849 - RNA, 32 nt, Human
auuacuaaaaacacaaaaauuagccaggugug

SEQ ID NO: 337850 - RNA, 32 nt, Human
auuacuaacuccaaggggaggguuccccugcu

SEQ ID NO: 337851 - RNA, 32 nt, Human
auuacuaauaguuucacaucaccucacugcac

SEQ ID NO: 337852 - RNA, 32 nt, Human
auuacuacaacuaaccuguugugcucaccucu

SEQ ID NO: 337853 - RNA, 32 nt, Human
auuacuagaggagagaguugaaggagcugaga

SEQ ID NO: 337854 - RNA, 32 nt, Human
auuacuaugugagccuuuauuuccuucagaua

SEQ ID NO: 337855 - RNA, 32 nt, Human
auuacucaaauaagggcacacagugaucauau

SEQ ID NO: 337856 - RNA, 32 nt, Human
auuacucaaauacccaaaucccauuccaaguu

SEQ ID NO: 337857 - RNA, 32 nt, Human
auuacucaacagcucuccagaguugcacauua

SEQ ID NO: 337858 - RNA, 32 nt, Human
auuacucacucaccagccucccucuuuugucc

SEQ ID NO: 337859 - RNA, 32 nt, Human
auuacucaguggaaagcuaaguucagaaggua

SEQ ID NO: 337860 - RNA, 32 nt, Human
auuacucauucaaauuuccccugggcacguaa

SEQ ID NO: 337861 - RNA, 32 nt, Human
auuacuccacaccuuuuaugaaucaaauauga

SEQ ID NO: 337862 - RNA, 32 nt, Human
auuacuccacugcacuccagccugggcaacag

SEQ ID NO: 337863 - RNA, 32 nt, Human
auuacucccaauugaauuaucuaccucauuuu

SEQ ID NO: 337864 - RNA, 32 nt, Human
auuacucccccaaaccuccuggcucucaagga

SEQ ID NO: 337865 - RNA, 32 nt, Human
auuacucuccacccccuuacucugcuauaauu

SEQ ID NO: 337866 - RNA, 32 nt, Human
auuacugaaauuuuacaauucaagagaggaaa

SEQ ID NO: 337867 - RNA, 32 nt, Human
auuacugaagucagauuggaaccacuaaagau

SEQ ID NO: 337868 - RNA, 32 nt, Human
auuacugagaagauaaggggagagggauugag

SEQ ID NO: 337869 - RNA, 32 nt, Human
auuacugagcuuuuugacauuuccuuagacuu

SEQ ID NO: 337870 - RNA, 32 nt, Human
auuacugcagugggaaggugggagggagacgg

SEQ ID NO: 337871 - RNA, 32 nt, Human
auuacugccaaacaucucaccuuuaucaauga

SEQ ID NO: 337872 - RNA, 32 nt, Human
auuacugcccuaaaaugucucuggcaauguac

SEQ ID NO: 337873 - RNA, 32 nt, Human
auuacugcgguguuaagguagcccugccacgu

SEQ ID NO: 337874 - RNA, 32 nt, Human
auuacugcuggguuuuggaggcugcgauaaaa

SEQ ID NO: 337875 - RNA, 32 nt, Human
auuacuggauaaaucacuucaauuucccaaug

SEQ ID NO: 337876 - RNA, 32 nt, Human
auuacuggauccuuguguugcagcccuaagau

SEQ ID NO: 337877 - RNA, 32 nt, Human
auuacuggcaaaaacggccagguacaacaccu

SEQ ID NO: 337878 - RNA, 32 nt, Human
auuacuggcaugagccaccgaggcuggccuga

SEQ ID NO: 337879 - RNA, 32 nt, Human
auuacuggcaugagccacugugcccagcccgg

SEQ ID NO: 337880 - RNA, 32 nt, Human
auuacuggcgugagccaccgugccuggccagc

SEQ ID NO: 337881 - RNA, 32 nt, Human
auuacuggcucucaagcuauaguuuguuuuca

SEQ ID NO: 337882 - RNA, 32 nt, Human
auuacuggcuuaguuuugcuuuccuuugacac

SEQ ID NO: 337883 - RNA, 32 nt, Human
auuacugggagguggagguggaaaacgugauu

SEQ ID NO: 337884 - RNA, 32 nt, Human
auuacugggauuacaggcaugaggcaucacag

SEQ ID NO: 337885 - RNA, 32 nt, Human
auuacugguacacaccugcauugccucaccag

SEQ ID NO: 337886 - RNA, 32 nt, Human
auuacuggugcacaccaccacacucagcuaau

SEQ ID NO: 337887 - RNA, 32 nt, Human
auuacuggugcccaccaccaugcccagcuaau

SEQ ID NO: 337888 - RNA, 32 nt, Human
auuacuggugugagccacugugucuggccaga

SEQ ID NO: 337889 - RNA, 32 nt, Human
auuacugguguuuucaugccuugaggauucuu

SEQ ID NO: 337890 - RNA, 32 nt, Human
auuacuguaaagaacuuccuguaaaacacguu

SEQ ID NO: 337891 - RNA, 32 nt, Human
auuacugucaauaaacagcuucaugccuuugu

SEQ ID NO: 337892 - RNA, 32 nt, Human
auuacugugggccacucgcugcagaaauguag

SEQ ID NO: 337893 - RNA, 32 nt, Human
auuacuguguuguaauaaacauguuuguaugu

SEQ ID NO: 337894 - RNA, 32 nt, Human
auuacuguuuacugguggaguacauaugcaua

SEQ ID NO: 337895 - RNA, 32 nt, Human
auuacuguuuaggguauaauuuuuaacuugac

SEQ ID NO: 337896 - RNA, 32 nt, Human
auuacuguuucacauguacagcuuucuacuuc

SEQ ID NO: 337897 - RNA, 32 nt, Human
auuacuuaaacucuuuuccuguccugcauuaa

SEQ ID NO: 337898 - RNA, 32 nt, Human
auuacuuaagcagagggagagaaccucuacug

SEQ ID NO: 337899 - RNA, 32 nt, Human
auuacuuacuacugcacuccugcuuuuguggg

SEQ ID NO: 337900 - RNA, 32 nt, Human
auuacuuaggaaaugcuacaugcggaaugugc

SEQ ID NO: 337901 - RNA, 32 nt, Human
auuacuuauaacaaagcacaaauuacuucuaa

SEQ ID NO: 337902 - RNA, 32 nt, Human
auuacuuauuugggagaaacccugauuugugu

SEQ ID NO: 337903 - RNA, 31 nt, Human
auuacuucaaccugggagguugaggcugcag

SEQ ID NO: 337904 - RNA, 32 nt, Human
auuacuucaaccugggagguugaggcugcagu

SEQ ID NO: 337905 - RNA, 32 nt, Human
auuacuucucaaggauuauuagaaucuuaggu

SEQ ID NO: 337906 - RNA, 32 nt, Human
auuacuucugcuucacuuacugccuuuucuca

SEQ ID NO: 337907 - RNA, 32 nt, Human
auuacuugaacccaggaggcagagaucgcagu

SEQ ID NO: 337908 - RNA, 32 nt, Human
auuacuugaacccgggagguggagguugcagu

SEQ ID NO: 337909 - RNA, 32 nt, Human
auuacuuggguuauuucuugaaugaacauaca

SEQ ID NO: 337910 - RNA, 32 nt, Human
auuacuugugcauuugccucaccucugacaau

SEQ ID NO: 337911 - RNA, 32 nt, Human
auuacuuguucaauacagccacugauggaaug

SEQ ID NO: 337912 - RNA, 32 nt, Human
auuacuuucucauucuuuuaguguauucaaca

SEQ ID NO: 337913 - RNA, 32 nt, Human
auuacuuugucccgcuuauucuccucccuguu

SEQ ID NO: 337914 - RNA, 32 nt, Human
auuacuuuucaaagaauacuguucauaugcau

SEQ ID NO: 337915 - RNA, 32 nt, Human
auuacuuuugggaggggaaccaguagguugag

SEQ ID NO: 337916 - RNA, 32 nt, Human
auuagaaagaguuuuauuuaauuuucucccca

SEQ ID NO: 337917 - RNA, 32 nt, Human
auuagaaaugacucccuuucaaagucaaucuu

SEQ ID NO: 337918 - RNA, 32 nt, Human
auuagaacucuagcccaggcuuugucaacugu

SEQ ID NO: 337919 - RNA, 32 nt, Human
auuagaagaaacacaccuucaaacuucaacuu

SEQ ID NO: 337920 - RNA, 32 nt, Human
auuagaagaccugaaagccacuuuucauguuu

SEQ ID NO: 337921 - RNA, 32 nt, Human
auuagaaggagaggguaggugcagagcuggag

SEQ ID NO: 337922 - RNA, 32 nt, Human
auuagaaggggcccucgcuauuuucuguguca

SEQ ID NO: 337923 - RNA, 32 nt, Human
auuagaagguauuguucagugggauuuggaga

SEQ ID NO: 337924 - RNA, 32 nt, Human
auuagaauaaauccuaaucucuaaucuaagaa

SEQ ID NO: 337925 - RNA, 32 nt, Human
auuagaauuugacaacgucauuaagaaggaua

SEQ ID NO: 337926 - RNA, 32 nt, Human
auuagacaaauuagggaauucaggguuagaga

SEQ ID NO: 337927 - RNA, 32 nt, Human
auuagacagauacaaaauagcaaggcaguuaa

SEQ ID NO: 337928 - RNA, 32 nt, Human
auuagaccaaacccuugugacuuuuagguaag

SEQ ID NO: 337929 - RNA, 32 nt, Human
auuagaccaggaaaacuuaauguaauauuauu

SEQ ID NO: 337930 - RNA, 32 nt, Human
auuagaccuguaaaauguaguuauuauuccug

SEQ ID NO: 337931 - RNA, 32 nt, Human
auuagacgguuuccagguuuucucccagguga

SEQ ID NO: 337932 - RNA, 32 nt, Human
auuagacuuccucauucuuucucagaccucag

SEQ ID NO: 337933 - RNA, 32 nt, Human
auuagacuucucugcugacucucagaguugug

SEQ ID NO: 337934 - RNA, 32 nt, Human
auuagagaauaaacagccacacacacauuuuu

SEQ ID NO: 337935 - RNA, 32 nt, Human
auuagagagacuauucuuuucccauuggguau

SEQ ID NO: 337936 - RNA, 32 nt, Human
auuagagaguauuguucagugggauuuggaaa

SEQ ID NO: 337937 - RNA, 32 nt, Human
auuagagaguucccauuccuccacauccuuac

SEQ ID NO: 337938 - RNA, 32 nt, Human
auuagagauugacuucagaaacuuuuucuaaa

SEQ ID NO: 337939 - RNA, 32 nt, Human
auuagagccuugacuauuuugaagauuaaaug

SEQ ID NO: 337940 - RNA, 32 nt, Human
auuagaggaauagacucagccuucauguuugu

SEQ ID NO: 337941 - RNA, 32 nt, Human
auuagaggacggaagcagagggugcuguuuca

SEQ ID NO: 337942 - RNA, 32 nt, Human
auuagaggagauaaaucuccuuguuaucacaa

SEQ ID NO: 337943 - RNA, 32 nt, Human
auuagaggauauuguucagugggauuuggaga

SEQ ID NO: 337944 - RNA, 32 nt, Human
auuagaggcagaggaagagacagaggaguuuu

SEQ ID NO: 337945 - RNA, 32 nt, Human
auuagaggcaugagccaccgugcccagccuca

SEQ ID NO: 337946 - RNA, 32 nt, Human
auuagaggcaugagccacugcgcccggccccu

SEQ ID NO: 337947 - RNA, 32 nt, Human
auuagaggcaugagccacuguccccggccucc

SEQ ID NO: 337948 - RNA, 32 nt, Human
auuagaggcuauuguucagugggauuuggaga

SEQ ID NO: 337949 - RNA, 32 nt, Human
auuagaggcuugagccaccaggcccggcugga

SEQ ID NO: 337950 - RNA, 32 nt, Human
auuagaggguauuguucagugggauuuggaga

SEQ ID NO: 337951 - RNA, 32 nt, Human
auuagagggucuuucauggggagagaaggaga

SEQ ID NO: 337952 - RNA, 32 nt, Human
auuagaggugugagccaccacgcccggccuau

SEQ ID NO: 337953 - RNA, 32 nt, Human
auuagaggugugagccacugugcccagcccau

SEQ ID NO: 337954 - RNA, 32 nt, Human
auuagagucagccuucccccucccagggccag

SEQ ID NO: 337955 - RNA, 32 nt, Human
auuagagucaucuggggaucuuuuaaaaaccc

SEQ ID NO: 337956 - RNA, 32 nt, Human
auuagaguccucagaagagaacuuaucuagug

SEQ ID NO: 337957 - RNA, 32 nt, Human
auuagaguucagcucagcugggcauggaguua

SEQ ID NO: 337958 - RNA, 32 nt, Human
auuagaguugugagccaccgcugccagcccag

SEQ ID NO: 337959 - RNA, 32 nt, Human
auuagaucauuucuaaugguccucaaauaaug

SEQ ID NO: 337960 - RNA, 32 nt, Human
auuagaugaagguguugcaaaagauaaugcua

SEQ ID NO: 337961 - RNA, 30 nt, Human
auuagaugccuucgucuuuucagucaucau

SEQ ID NO: 337962 - RNA, 32 nt, Human
auuagaugucaugaggaaacuacugaacuagc

SEQ ID NO: 337963 - RNA, 32 nt, Human
auuagcaaaaaucauacaauauacagaugguc

SEQ ID NO: 337964 - RNA, 32 nt, Human
auuagcaaaaucaugaugcucagcuguuggga

SEQ ID NO: 337965 - RNA, 18 nt, Human
auuagcaaacacaagaca

SEQ ID NO: 337966 - RNA, 32 nt, Human
auuagcaaaucaggaaugcaaggcuuguucaa

SEQ ID NO: 337967 - RNA, 32 nt, Human
auuagcaaguuccuuuuuacuucaagcuacuu

SEQ ID NO: 337968 - RNA, 32 nt, Human
auuagcaauagcuccacuuugggugggggaga

SEQ ID NO: 337969 - RNA, 32 nt, Human
auuagcaauauuaaaugccaaaauuccauuga

SEQ ID NO: 337970 - RNA, 32 nt, Human
auuagcacuccccucccucaucuuuucuucua

SEQ ID NO: 337971 - RNA, 32 nt, Human
auuagcagccaaggaaaagggaaacaugagcu

SEQ ID NO: 337972 - RNA, 32 nt, Human
auuagcaggacaagggcucucuccucaguuuc

SEQ ID NO: 337973 - RNA, 32 nt, Human
auuagcaugagacugggcggcuguccugcuuc

SEQ ID NO: 337974 - RNA, 32 nt, Human
auuagcaugccaccaugccccuccuccgaugc

SEQ ID NO: 337975 - RNA, 32 nt, Human
auuagcauuacagaagacacacacaucacaua

SEQ ID NO: 337976 - RNA, 32 nt, Human
auuagccaaaaacccaguagccuagaagauac

SEQ ID NO: 337977 - RNA, 32 nt, Human
auuagccaagaaagcaaaguacugaugaauuc

SEQ ID NO: 337978 - RNA, 32 nt, Human
auuagccaccaccacugaaaacucagccgaau

SEQ ID NO: 337979 - RNA, 32 nt, Human
auuagccacgcuuccuguagcauacagugguc

SEQ ID NO: 337980 - RNA, 32 nt, Human
auuagccagauaugauggcaggcgccuguaau

SEQ ID NO: 337981 - RNA, 32 nt, Human
auuagccaggcauaauggcacacaccuguagu

SEQ ID NO: 337982 - RNA, 32 nt, Human
auuagccaggcaugauggcacacaccuguaau

SEQ ID NO: 337983 - RNA, 32 nt, Human
auuagccaggcauggugacacacuccuauaau

SEQ ID NO: 337984 - RNA, 32 nt, Human
auuagccaggcguggugaugggcaccuguaau

SEQ ID NO: 337985 - RNA, 32 nt, Human
auuagccaggcguggugaugggugccuguaau

SEQ ID NO: 337986 - RNA, 32 nt, Human
auuagccaggugguaguggugugugccuauaa

SEQ ID NO: 337987 - RNA, 32 nt, Human
auuagccagguguggcggcguaaucccaugcu

SEQ ID NO: 337988 - RNA, 32 nt, Human
auuagccaggugugguggcaagugccuuuaau

SEQ ID NO: 337989 - RNA, 32 nt, Human
auuagccaggugugguggcacacaccaguaau

SEQ ID NO: 337990 - RNA, 32 nt, Human
auuagccaggugugguggcacgcaccaguagu

SEQ ID NO: 337991 - RNA, 32 nt, Human
auuagccagguucucauuagauuuugcucggg

SEQ ID NO: 337992 - RNA, 32 nt, Human
auuagccaugcaacauggauauguauugggca

SEQ ID NO: 337993 - RNA, 32 nt, Human
auuagccauuugagaugagaugagacuacuug

SEQ ID NO: 337994 - RNA, 32 nt, Human
auuagcccuagaaaggagguugggguguaugg

SEQ ID NO: 337995 - RNA, 32 nt, Human
auuagcccugucuuagagugugaggaaaaugu

SEQ ID NO: 337996 - RNA, 32 nt, Human
auuagcccuucaccaucuaccugcuuggucuu

SEQ ID NO: 337997 - RNA, 32 nt, Human
auuagccggccgugguggcaagugccugaaau

SEQ ID NO: 337998 - RNA, 32 nt, Human
auuagccgggcauguuggcacacaccuauagu

SEQ ID NO: 337999 - RNA, 32 nt, Human
auuagccgggcgugguggcacacuccuguaau

SEQ ID NO: 338000 - RNA, 32 nt, Human
auuagccgucuucugcuacaucaaugcagcaa

SEQ ID NO: 338001 - RNA, 32 nt, Human
auuagccuaugugcaugcagcaucuaaguaau

SEQ ID NO: 338002 - RNA, 32 nt, Human
auuagccucuuccucauuauggagcugauuuu

SEQ ID NO: 338003 - RNA, 24 nt, Human
auuagccuggacaacauggugaaa

SEQ ID NO: 338004 - RNA, 32 nt, Human
auuagccuggacaacauggugaaaccccaucu

SEQ ID NO: 338005 - RNA, 24 nt, Human
auuagccuggccaagauggugaaa

SEQ ID NO: 338006 - RNA, 32 nt, Human
auuagccugggcaacagagcaagacucugucu

SEQ ID NO: 338007 - RNA, 32 nt, Human
auuagccugguaaggccgggugcaguggcuca

SEQ ID NO: 338008 - RNA, 32 nt, Human
auuagccugguggcucacgccuguaaucccag

SEQ ID NO: 338009 - RNA, 32 nt, Human
auuagcggcaugcaccaccacgcccagcuauu

SEQ ID NO: 338010 - RNA, 32 nt, Human
auuagcucaccuuucuccuaggcaauuauaau

SEQ ID NO: 338011 - RNA, 32 nt, Human
auuagcucacugcagucuccaccuccugagcu

SEQ ID NO: 338012 - RNA, 32 nt, Human
auuagcuccuaacaacacuuugaaguaauucu

SEQ ID NO: 338013 - RNA, 32 nt, Human
auuagcugagauauuaacuuacucacacggac

SEQ ID NO: 338014 - RNA, 32 nt, Human
auuagcugagugugguggugcaugcauguagu

SEQ ID NO: 338015 - RNA, 21 nt, Human
auuagcugcggagcccuggaa

SEQ ID NO: 338016 - RNA, 32 nt, Human
auuagcugcuuccuccccuccuggcacccacu

SEQ ID NO: 338017 - RNA, 32 nt, Human
auuagcugggauuacaggcaugcgccaccagg

SEQ ID NO: 338018 - RNA, 32 nt, Human
auuagcugggauuacaggcaugcgccaccaug

SEQ ID NO: 338019 - RNA, 32 nt, Human
auuagcugggauuacaggcaugugccacuacc

SEQ ID NO: 338020 - RNA, 32 nt, Human
auuagcugggauuacaggcgugugccaccaug

SEQ ID NO: 338021 - RNA, 32 nt, Human
auuagcugggcgucugggcaugguggcacaca

SEQ ID NO: 338022 - RNA, 32 nt, Human
auuagcuggguaugaugaugcacgccuguaaa

SEQ ID NO: 338023 - RNA, 32 nt, Human
auuagcuguagaguccuuggcaaaucacaaca

SEQ ID NO: 338024 - RNA, 32 nt, Human
auuagcuguugugagauauuucucggguccuu

SEQ ID NO: 338025 - RNA, 18 nt, Human
auuagcuucacaagcaca

SEQ ID NO: 338026 - RNA, 32 nt, Human
auuagcuuucaguuccuuugguagugugggca

SEQ ID NO: 338027 - RNA, 32 nt, Human
auuagcuuuccacagggauuucuugaaaugcu

SEQ ID NO: 338028 - RNA, 32 nt, Human
auuagcuuuccucugcuuuaugaccacagguu

SEQ ID NO: 338029 - RNA, 32 nt, Human
auuagcuuugcuucaaaagaaauaggcuuaau

SEQ ID NO: 338030 - RNA, 32 nt, Human
auuagcuuuuaguuuuaaaacucuuuauccca

SEQ ID NO: 338031 - RNA, 32 nt, Human
auuagcuuuuucucagauguugaaacuuugaa

SEQ ID NO: 338032 - RNA, 32 nt, Human
auuaggaaaaacaaacuacccgcaucuucugu

SEQ ID NO: 338033 - RNA, 32 nt, Human
auuaggaaaacagguguuccuccuccccucuc

SEQ ID NO: 338034 - RNA, 32 nt, Human
auuaggaaagaugaguuuuaccucugguacac

SEQ ID NO: 338035 - RNA, 32 nt, Human
auuaggaaaggggcugugcaugugggugcagc

SEQ ID NO: 338036 - RNA, 32 nt, Human
auuaggaaaugagucuguauggaaaucucacc

SEQ ID NO: 338037 - RNA, 32 nt, Human
auuaggaaucucagugcagagguccucagagg

SEQ ID NO: 338038 - RNA, 32 nt, Human
auuaggacaguccugcaucucucucacaaagg

SEQ ID NO: 338039 - RNA, 32 nt, Human
auuaggacauggucauauuuuaguuggcacaa

SEQ ID NO: 338040 - RNA, 32 nt, Human
auuaggaugauuguuaauacugcacuguggau

SEQ ID NO: 338041 - RNA, 32 nt, Human
auuaggauugcaugaguccaggaguucgagac

SEQ ID NO: 338042 - RNA, 32 nt, Human
auuaggcaacccaagugugacuccacucaagu

SEQ ID NO: 338043 - RNA, 32 nt, Human
auuaggcagccugcucuccucuuaugauggcc

SEQ ID NO: 338044 - RNA, 32 nt, Human
auuaggcaggcagaggcaguuaugggcuucug

SEQ ID NO: 338045 - RNA, 32 nt, Human
auuaggcauucauccugccaaccagggcaggc

SEQ ID NO: 338046 - RNA, 32 nt, Human
auuaggcccagagagacaaagacagaucugaa

SEQ ID NO: 338047 - RNA, 32 nt, Human
auuaggcccagccugccauggcagcuccaaca

SEQ ID NO: 338048 - RNA, 32 nt, Human
auuaggcccccaucauccucuggcuuggccac

SEQ ID NO: 338049 - RNA, 32 nt, Human
auuaggcugcaacucugauauacagagacuag

SEQ ID NO: 338050 - RNA, 32 nt, Human
auuaggcugcugcugcugcuuccaaauggggg

SEQ ID NO: 338051 - RNA, 32 nt, Human
auuagggaggcugaggcaggagaaucgcuuga

SEQ ID NO: 338052 - RNA, 32 nt, Human
auuagggaucauugcagacucugccucucagg

SEQ ID NO: 338053 - RNA, 32 nt, Human
auuagggcaagcuaguugaccugcacuuuauc

SEQ ID NO: 338054 - RNA, 32 nt, Human
auuagggcagaguuugcacguccucuggucac

SEQ ID NO: 338055 - RNA, 32 nt, Human
auuagggcccaugccagcaucccagugaaguu

SEQ ID NO: 338056 - RNA, 32 nt, Human
auuaggggaggaauguuuucaucaccuaaguu

SEQ ID NO: 338057 - RNA, 32 nt, Human
auuaggggcaugagccaccgcacccagcuugc

SEQ ID NO: 338058 - RNA, 32 nt, Human
auuagggggaaugcaaacuggaagggaauacg

SEQ ID NO: 338059 - RNA, 32 nt, Human
auuagggguggaggcagcaggaugagcagaaa

SEQ ID NO: 338060 - RNA, 32 nt, Human
auuaggguaccacauuuuaacuuaccaugacu

SEQ ID NO: 338061 - RNA, 32 nt, Human
auuagggugcgugccagcuccgggaggccgcg

SEQ ID NO: 338062 - RNA, 32 nt, Human
auuagguaguguccucauuuuauauugugacc

SEQ ID NO: 338063 - RNA, 32 nt, Human
auuagguauacaaauaaacuaacaaauaaauc

SEQ ID NO: 338064 - RNA, 32 nt, Human
auuaggucaggaguucgagaccagccuggcca

SEQ ID NO: 338065 - RNA, 24 nt, Human
auuaggucagucugccuccugaca

SEQ ID NO: 338066 - RNA, 32 nt, Human
auuaggugaggguugucuaauccuauggcaca

SEQ ID NO: 338067 - RNA, 32 nt, Human
auuaggugagguuuauagaaagauagauaucc

SEQ ID NO: 338068 - RNA, 32 nt, Human
auuaggugcagccggcaggccaucccaacucg

SEQ ID NO: 338069 - RNA, 32 nt, Human
auuagguggaacugagggaaacagaaauagga

SEQ ID NO: 338070 - RNA, 32 nt, Human
auuaggugggcaugguggcaggugcuuguaau

SEQ ID NO: 338071 - RNA, 32 nt, Human
auuaggugugagccaccgcaccuggccgauau

SEQ ID NO: 338072 - RNA, 32 nt, Human
auuaggugugaugucaacagcauguuagaagg

SEQ ID NO: 338073 - RNA, 32 nt, Human
auuaggugugcacaccuguaaucccagcuacc

SEQ ID NO: 338074 - RNA, 32 nt, Human
auuaguaauguucaacuuuucacaaagaugau

SEQ ID NO: 338075 - RNA, 32 nt, Human
auuaguagcuguucuucuguacugggauggaa

SEQ ID NO: 338076 - RNA, 32 nt, Human
auuaguauacuuauaaaagagacuucagagag

SEQ ID NO: 338077 - RNA, 32 nt, Human
auuaguauccccacacugaguguggggaauaa

SEQ ID NO: 338078 - RNA, 32 nt, Human
auuagucacggcacugcagccugggcaacaua

SEQ ID NO: 338079 - RNA, 24 nt, Human
auuaguccuggcgggccccuggga

SEQ ID NO: 338080 - RNA, 32 nt, Human
auuagucgggucggagaugaaaucagagggag

SEQ ID NO: 338081 - RNA, 32 nt, Human
auuagucugagagagaacuuauaguaaggaaa

SEQ ID NO: 338082 - RNA, 32 nt, Human
auuagucugggcauugaccaggacagcgcugc

SEQ ID NO: 338083 - RNA, 32 nt, Human
auuagucugggucugaguccucugcuuuuucu

SEQ ID NO: 338084 - RNA, 32 nt, Human
auuagucuguuauccauggcuggcacuucacu

SEQ ID NO: 338085 - RNA, 32 nt, Human
auuagugaaauggcaugaaguagcauguggag

SEQ ID NO: 338086 - RNA, 32 nt, Human
auuagugaaccuagaagcagagacucugugag

SEQ ID NO: 338087 - RNA, 32 nt, Human
auuagugaagaaaagacggaguuucgaaauug

SEQ ID NO: 338088 - RNA, 32 nt, Human
auuagugauuccaucaaagagaaggaaaguaa

SEQ ID NO: 338089 - RNA, 31 nt, Human
auuagugcaaugucauaucugaucccaggaa

SEQ ID NO: 338090 - RNA, 32 nt, Human
auuagugcagagcagggguggucaggcugaac

SEQ ID NO: 338091 - RNA, 32 nt, Human
auuagugcucaggaguuugaugagcaaaaagu

SEQ ID NO: 338092 - RNA, 32 nt, Human
auuaguggauuucuuaauaggaagaugcaaug

SEQ ID NO: 338093 - RNA, 32 nt, Human
auuaguggucugaggaagagcagaucacauug

SEQ ID NO: 338094 - RNA, 32 nt, Human
auuaguguagguuuagacucuuguacauuucu

SEQ ID NO: 338095 - RNA, 32 nt, Human
auuaguguguuuuggguugcaugcaggauagu

SEQ ID NO: 338096 - RNA, 32 nt, Human
auuaguguuaaagaaguguggugccugauguu

SEQ ID NO: 338097 - RNA, 32 nt, Human
auuaguguuuuucauaguuugcacugaugcgu

SEQ ID NO: 338098 - RNA, 32 nt, Human
auuaguuaccacagccagcccagagagaaacu

SEQ ID NO: 338099 - RNA, 32 nt, Human
auuaguuaggcuucugagcuugcaaucauauu

SEQ ID NO: 338100 - RNA, 32 nt, Human
auuaguucaagcgauucucgugccucagccuc

SEQ ID NO: 338101 - RNA, 22 nt, Human
auuaguuccauugugccuggaa

SEQ ID NO: 338102 - RNA, 32 nt, Human
auuaguucccccucagcuacuggagaucucag

SEQ ID NO: 338103 - RNA, 32 nt, Human
auuaguugcugcacuccagccuaggcaacaua

SEQ ID NO: 338104 - RNA, 32 nt, Human
auuaguuuucuuccucuucuaccugcucauga

SEQ ID NO: 338105 - RNA, 32 nt, Human
auuaguuuugcaagaucacacacuaauguaac

SEQ ID NO: 338106 - RNA, 32 nt, Human
auuaguuuuuguguuguggcuuuuguugcuuu

SEQ ID NO: 338107 - RNA, 32 nt, Human
auuauaaaaggauuuuugaaaguauaaacaaa

SEQ ID NO: 338108 - RNA, 32 nt, Human
auuauaaaaucuaaaacaaaacuuuauagagu

SEQ ID NO: 338109 - RNA, 32 nt, Human
auuauaaacagaaaaucuuuccucuucucauu

SEQ ID NO: 338110 - RNA, 32 nt, Human
auuauaaagacuguauuucccauagacguuua

SEQ ID NO: 338111 - RNA, 32 nt, Human
auuauaaaggccauggagagugcugccaguuu

SEQ ID NO: 338112 - RNA, 32 nt, Human
auuauaaccccucaccuugaccagagucauug

SEQ ID NO: 338113 - RNA, 32 nt, Human
auuauaacuuccuagugugcagccaggcugug

SEQ ID NO: 338114 - RNA, 32 nt, Human
auuauaagcagcuguauccccuuugccauggu

SEQ ID NO: 338115 - RNA, 32 nt, Human
auuauaagcuguuccaguucacaggcagcaaa

SEQ ID NO: 338116 - RNA, 32 nt, Human
auuauaagcuguucucagaguauccaaagauc

SEQ ID NO: 338117 - RNA, 32 nt, Human
auuauaauaccaccuuaagcacuugcugaaaa

SEQ ID NO: 338118 - RNA, 32 nt, Human
auuauaauaggccuucuauauuuccuugucuu

SEQ ID NO: 338119 - RNA, 32 nt, Human
auuauaaugcaaauacuuuuuaacuuagaggc

SEQ ID NO: 338120 - RNA, 32 nt, Human
auuauaauuaugguuuacacuguugggaguaa

SEQ ID NO: 338121 - RNA, 32 nt, Human
auuauaauuucuuuaaaaagaggggaggggag

SEQ ID NO: 338122 - RNA, 32 nt, Human
auuauacaaguaugaugcuucuggaccuucaa

SEQ ID NO: 338123 - RNA, 30 nt, Human
auuauacauauguuauaaaauauguucauu

SEQ ID NO: 338124 - RNA, 32 nt, Human
auuauacauggcuacuuuacugugucuguagc

SEQ ID NO: 338125 - RNA, 32 nt, Human
auuauaccaagggauucccuuguccuccagcu

SEQ ID NO: 338126 - RNA, 32 nt, Human
auuauaccacugcacuccagccugggugacag

SEQ ID NO: 338127 - RNA, 21 nt, Human
auuauacccaggaggcucuca

SEQ ID NO: 338128 - RNA, 32 nt, Human
auuauaccuucuguaacaguggcauucccuua

SEQ ID NO: 338129 - RNA, 32 nt, Human
auuauaccuugguguuugccucuuucuaaguu

SEQ ID NO: 338130 - RNA, 24 nt, Human
auuauacgcuaugggauacuggca

SEQ ID NO: 338131 - RNA, 32 nt, Human
auuauacggacucuucagauuuacagagaacu

SEQ ID NO: 338132 - RNA, 32 nt, Human
auuauacuaacauaaacacauauaaaugcacu

SEQ ID NO: 338133 - RNA, 32 nt, Human
auuauacuccauguguauuuugcccacuuuuu

SEQ ID NO: 338134 - RNA, 32 nt, Human
auuauacugcucuguacaggaagcuugcaaau

SEQ ID NO: 338135 - RNA, 32 nt, Human
auuauacuguagcugaugaaacuccugauuuu

SEQ ID NO: 338136 - RNA, 32 nt, Human
auuauacuucaugcuguuuuccagcaugguau

SEQ ID NO: 338137 - RNA, 32 nt, Human
auuauacuuguaaugggcgacauggcaaacaa

SEQ ID NO: 338138 - RNA, 32 nt, Human
auuauacuuuaacaaacuauucaacugauuua

SEQ ID NO: 338139 - RNA, 32 nt, Human
auuauagacagaaauuuguaacauuacuucug

SEQ ID NO: 338140 - RNA, 32 nt, Human
auuauagauacacuaccaaacauaucaccuua

SEQ ID NO: 338141 - RNA, 32 nt, Human
auuauagaugugagccaccgcgcccggccuac

SEQ ID NO: 338142 - RNA, 32 nt, Human
auuauagcagagggacuugggcagcccacagc

SEQ ID NO: 338143 - RNA, 32 nt, Human
auuauagcauugagggagcagagauacccaua

SEQ ID NO: 338144 - RNA, 32 nt, Human
auuauagcucacugcagccuggaacuccuggg

SEQ ID NO: 338145 - RNA, 32 nt, Human
auuauagcuuucugcagcaaggaagcccacgu

SEQ ID NO: 338146 - RNA, 32 nt, Human
auuauaggaacuuugcuugcucuagugcucau

SEQ ID NO: 338147 - RNA, 32 nt, Human
auuauaggagugagccaccgcgccgggccaga

SEQ ID NO: 338148 - RNA, 32 nt, Human
auuauaggcaugagccaccacacccagccucc

SEQ ID NO: 338149 - RNA, 32 nt, Human
auuauaggcaugagccaccacaccuggcuacu

SEQ ID NO: 338150 - RNA, 32 nt, Human
auuauaggcaugagccaccacgcccagccugu

SEQ ID NO: 338151 - RNA, 32 nt, Human
auuauaggcaugagccaccaugcccagccagg

SEQ ID NO: 338152 - RNA, 32 nt, Human
auuauaggcaugagccaccgcacccagccucu

SEQ ID NO: 338153 - RNA, 32 nt, Human
auuauaggcaugagccaccgugcccagccuac

SEQ ID NO: 338154 - RNA, 32 nt, Human
auuauaggcaugagccaccgugcccggcuauu

SEQ ID NO: 338155 - RNA, 32 nt, Human
auuauaggcaugagccacugcacccggccggu

SEQ ID NO: 338156 - RNA, 32 nt, Human
auuauaggcaugagccacugcauccagcauca

SEQ ID NO: 338157 - RNA, 32 nt, Human
auuauaggcaugagccacugcgccuggccaac

SEQ ID NO: 338158 - RNA, 32 nt, Human
auuauaggcaugagccacugugccaggcccaa

SEQ ID NO: 338159 - RNA, 32 nt, Human
auuauaggcaugagccacugugcccagcugaa

SEQ ID NO: 338160 - RNA, 32 nt, Human
auuauaggcaugagccacugugccuggcccuc

SEQ ID NO: 338161 - RNA, 32 nt, Human
auuauaggccugagccacugcguacagcuugu

SEQ ID NO: 338162 - RNA, 32 nt, Human
auuauaggcgagagccacugcauccagugacu

SEQ ID NO: 338163 - RNA, 32 nt, Human
auuauaggcguaagccacugugucuggccuag

SEQ ID NO: 338164 - RNA, 32 nt, Human
auuauaggcgugagccaccacgcccggcgagg

SEQ ID NO: 338165 - RNA, 32 nt, Human
auuauaggcgugagccaccaugcccagccuaa

SEQ ID NO: 338166 - RNA, 32 nt, Human
auuauaggcgugagccaccaugcucagccauu

SEQ ID NO: 338167 - RNA, 32 nt, Human
auuauaggcgugagccaccgcaccuggccuau

SEQ ID NO: 338168 - RNA, 32 nt, Human
auuauaggcgugagccaccgcccccggccuug

SEQ ID NO: 338169 - RNA, 32 nt, Human
auuauaggcgugagccaccgcgcccagcccug

SEQ ID NO: 338170 - RNA, 32 nt, Human
auuauaggcgugagccaccgcgcccggccucc

SEQ ID NO: 338171 - RNA, 32 nt, Human
auuauaggcgugagccaccgcgccuggccccg

SEQ ID NO: 338172 - RNA, 32 nt, Human
auuauaggcgugagccaccgcgccuggcuuau

SEQ ID NO: 338173 - RNA, 32 nt, Human
auuauaggcgugagccaccguacccggccuac

SEQ ID NO: 338174 - RNA, 32 nt, Human
auuauaggcgugagccaccgugccuggccuaa

SEQ ID NO: 338175 - RNA, 32 nt, Human
auuauaggcgugagccacggcauccagccuca

SEQ ID NO: 338176 - RNA, 32 nt, Human
auuauaggcgugagccacugcacccggccccu

SEQ ID NO: 338177 - RNA, 32 nt, Human
auuauaggcgugagccacugcaccuggucccc

SEQ ID NO: 338178 - RNA, 32 nt, Human
auuauaggcgugagccacugcgccuggccaaa

SEQ ID NO: 338179 - RNA, 32 nt, Human
auuauaggcgugagccacugugcccagccuca

SEQ ID NO: 338180 - RNA, 32 nt, Human
auuauaggcgugagccacuguguccagccuuu

SEQ ID NO: 338181 - RNA, 32 nt, Human
auuauaggcuugagccaccacgcccggcuggu

SEQ ID NO: 338182 - RNA, 32 nt, Human
auuauagguaugagccaccgcgccuggucugg

SEQ ID NO: 338183 - RNA, 32 nt, Human
auuauaggugcccaccaccaagcccagcuaaa

SEQ ID NO: 338184 - RNA, 32 nt, Human
auuauaggugcgagccacugcgcccagccuca

SEQ ID NO: 338185 - RNA, 32 nt, Human
auuauaggugugaaccaccauacccaggcuca

SEQ ID NO: 338186 - RNA, 32 nt, Human
auuauaggugugagccacagcacccagccaaa

SEQ ID NO: 338187 - RNA, 32 nt, Human
auuauaggugugagccaccacacccagccucu

SEQ ID NO: 338188 - RNA, 32 nt, Human
auuauaggugugagccaccaugcccagccccu

SEQ ID NO: 338189 - RNA, 32 nt, Human
auuauaggugugagccacccugcucaaccagg

SEQ ID NO: 338190 - RNA, 32 nt, Human
auuauaggugugagccaccgcacccagccaaa

SEQ ID NO: 338191 - RNA, 32 nt, Human
auuauaggugugagccaccgcacccaguuggg

SEQ ID NO: 338192 - RNA, 32 nt, Human
auuauaggugugagccaccgcgcccggccugc

SEQ ID NO: 338193 - RNA, 32 nt, Human
auuauaggugugagccaccgcgccgggccggu

SEQ ID NO: 338194 - RNA, 32 nt, Human
auuauaggugugagccaccgugccgggccugg

SEQ ID NO: 338195 - RNA, 32 nt, Human
auuauaggugugagccacugcacccggccucc

SEQ ID NO: 338196 - RNA, 32 nt, Human
auuauaggugugagccacugcgccuggcuaag

SEQ ID NO: 338197 - RNA, 32 nt, Human
auuauaggugugagccacugcucccgggcccu

SEQ ID NO: 338198 - RNA, 32 nt, Human
auuauaggugugagccagcaugccuggccccu

SEQ ID NO: 338199 - RNA, 32 nt, Human
auuauaggugugagccaucacgccaggucaag

SEQ ID NO: 338200 - RNA, 32 nt, Human
auuauaggugugagcccccacgccuggccaac

SEQ ID NO: 338201 - RNA, 32 nt, Human
auuauaggugugagcccccgugccuggcccac

SEQ ID NO: 338202 - RNA, 32 nt, Human
auuauaggugugagcuacuguacccagccuua

SEQ ID NO: 338203 - RNA, 32 nt, Human
auuauaguugcccacggccuccagucaaugaa

SEQ ID NO: 338204 - RNA, 32 nt, Human
auuauauacuauauacuauacacuguaucucc

SEQ ID NO: 338205 - RNA, 32 nt, Human
auuauauacuucugaauggcaccuuacuuuuu

SEQ ID NO: 338206 - RNA, 32 nt, Human
auuauauagcuuaagugaagauauuuaagauu

SEQ ID NO: 338207 - RNA, 32 nt, Human
auuauaucaucaaaacccguguuuccaaauaa

SEQ ID NO: 338208 - RNA, 32 nt, Human
auuauauccaagguaauauaaaagccauuacg

SEQ ID NO: 338209 - RNA, 32 nt, Human
auuauaucuccaccacuucccuuuggcucagu

SEQ ID NO: 338210 - RNA, 32 nt, Human
auuauaucuggagugaaggauccugccaccua

SEQ ID NO: 338211 - RNA, 32 nt, Human
auuauaugaacuguuuuauaucauguucauau

SEQ ID NO: 338212 - RNA, 32 nt, Human
auuauaugaauagaaguggagagccagaaugc

SEQ ID NO: 338213 - RNA, 32 nt, Human
auuauaugggcaagagcuagaaguaauaaaau

SEQ ID NO: 338214 - RNA, 32 nt, Human
auuauauguaguguuucagcucccauuguguu

SEQ ID NO: 338215 - RNA, 32 nt, Human
auuauauucccaagccucccuuucaacuagag

SEQ ID NO: 338216 - RNA, 32 nt, Human
auuauauuuacauaaaugcaaauaucacuuga

SEQ ID NO: 338217 - RNA, 32 nt, Human
auuauauuuauugguuacuuacauuccuuuuu

SEQ ID NO: 338218 - RNA, 32 nt, Human
auuauauuucuuuguuuaaaaauaacaggcaa

SEQ ID NO: 338219 - RNA, 32 nt, Human
auuauauuugacuugaaugcccaaaauuuuca

SEQ ID NO: 338220 - RNA, 32 nt, Human
auuaucaauuuaaucaucaccaccgguguuuc

SEQ ID NO: 338221 - RNA, 32 nt, Human
auuaucacauagccuaaauucuagccuggcag

SEQ ID NO: 338222 - RNA, 32 nt, Human
auuaucacccagacaugugcagaugaaauguc

SEQ ID NO: 338223 - RNA, 32 nt, Human
auuaucacccuuuucuccauguuuucagaguu

SEQ ID NO: 338224 - RNA, 32 nt, Human
auuaucacgccgcugcacuccagcuugaauga

SEQ ID NO: 338225 - RNA, 32 nt, Human
auuaucacuauauuaauuuucaaagguuuuuc

SEQ ID NO: 338226 - RNA, 32 nt, Human
auuaucaggaauacaauguugcaaugaugcuu

SEQ ID NO: 338227 - RNA, 32 nt, Human
auuaucagguaucaauauuuuuccaggaaagu

SEQ ID NO: 338228 - RNA, 32 nt, Human
auuaucagugaauuuucaguggguaggauguu

SEQ ID NO: 338229 - RNA, 32 nt, Human
auuaucagugcagaguuaggccagauucauuu

SEQ ID NO: 338230 - RNA, 32 nt, Human
auuaucaguggcuuugccacuaguaaaugugu

SEQ ID NO: 338231 - RNA, 32 nt, Human
auuaucaguguugaucucugcaaccaacauug

SEQ ID NO: 338232 - RNA, 32 nt, Human
auuaucauccuccugaguuauuugaaaugauu

SEQ ID NO: 338233 - RNA, 32 nt, Human
auuaucauccuccugaguuauuuugaaaugau

SEQ ID NO: 338234 - RNA, 32 nt, Human
auuaucaucucaauaagcacuucaguaagaaa

SEQ ID NO: 338235 - RNA, 32 nt, Human
auuaucaucuucacuucagacaauucagaagc

SEQ ID NO: 338236 - RNA, 32 nt, Human
auuaucaugaucaacuacccagcuuggauuuc

SEQ ID NO: 338237 - RNA, 32 nt, Human
auuauccaaagaauugaaacuccuagcacauc

SEQ ID NO: 338238 - RNA, 32 nt, Human
auuauccaaagagagaagacagaaucauuaua

SEQ ID NO: 338239 - RNA, 32 nt, Human
auuauccaacacaguaauauugguaccuguca

SEQ ID NO: 338240 - RNA, 32 nt, Human
auuauccacagcaacugcugagccccacuaca

SEQ ID NO: 338241 - RNA, 32 nt, Human
auuauccacugcccccucccuccuggugucuc

SEQ ID NO: 338242 - RNA, 32 nt, Human
auuauccagcugaacaucaccuaggagggcca

SEQ ID NO: 338243 - RNA, 32 nt, Human
auuauccagucgugguggugcaugccuguagu

SEQ ID NO: 338244 - RNA, 32 nt, Human
auuauccaguuuccuguucuugcugacacucc

SEQ ID NO: 338245 - RNA, 32 nt, Human
auuaucccuccaguccccauggauuggaaaug

SEQ ID NO: 338246 - RNA, 32 nt, Human
auuaucccugaacaagggcagcuccugcuuua

SEQ ID NO: 338247 - RNA, 32 nt, Human
auuaucccugggaaacagugcuuacccacaag

SEQ ID NO: 338248 - RNA, 32 nt, Human
auuaucccuuucucugccucucuuggcuuuau

SEQ ID NO: 338249 - RNA, 32 nt, Human
auuauccguaucacucucagcauuuuggucaa

SEQ ID NO: 338250 - RNA, 32 nt, Human
auuauccucagcaaacuggcaaaggaacagaa

SEQ ID NO: 338251 - RNA, 22 nt, Human
auuauccucauacucauucugg

SEQ ID NO: 338252 - RNA, 32 nt, Human
auuauccuccucucuucucucccccucagccu

SEQ ID NO: 338253 - RNA, 32 nt, Human
auuauccucuggugaugcuguuucucguuagu

SEQ ID NO: 338254 - RNA, 32 nt, Human
auuauccugagguguaccaggaaaggauuuua

SEQ ID NO: 338255 - RNA, 32 nt, Human
auuauccugcaccaccucacuguuccccaugc

SEQ ID NO: 338256 - RNA, 32 nt, Human
auuauccuuccuccucacccugccggguagcu

SEQ ID NO: 338257 - RNA, 32 nt, Human
auuauccuuggaguuggaauuaggucuuucua

SEQ ID NO: 338258 - RNA, 32 nt, Human
auuaucgaaauaagcauccauuuaaaagaaug

SEQ ID NO: 338259 - RNA, 32 nt, Human
auuaucguauauuuauaaugucucauccaguu

SEQ ID NO: 338260 - RNA, 32 nt, Human
auuaucguucaugggcguaagucucuucucag

SEQ ID NO: 338261 - RNA, 32 nt, Human
auuaucuacuaguaauaauguaauacuguaga

SEQ ID NO: 338262 - RNA, 32 nt, Human
auuaucuaguuuaauuucuucuuuggacaagg

SEQ ID NO: 338263 - RNA, 32 nt, Human
auuaucuaucuaccuagauagacagagauauc

SEQ ID NO: 338264 - RNA, 32 nt, Human
auuaucuaucugucugucugucugucugucug

SEQ ID NO: 338265 - RNA, 32 nt, Human
auuaucuauucuagacaaauuucuugaagaau

SEQ ID NO: 338266 - RNA, 32 nt, Human
auuaucuccaggaguuuggaagugagcugaac

SEQ ID NO: 338267 - RNA, 32 nt, Human
auuaucucucagacagcuguuucauuuuccaa

SEQ ID NO: 338268 - RNA, 32 nt, Human
auuaucucuggauuucaugaagguguaauauc

SEQ ID NO: 338269 - RNA, 32 nt, Human
auuaucuguaugaauuauauguuccagugaaa

SEQ ID NO: 338270 - RNA, 32 nt, Human
auuaucugugaggaauggacucuccccagacg

SEQ ID NO: 338271 - RNA, 32 nt, Human
auuaucuuaaaacuuuggccauaguuaauaac

SEQ ID NO: 338272 - RNA, 32 nt, Human
auuaucuuacagucuucuaccucuucaagaua

SEQ ID NO: 338273 - RNA, 32 nt, Human
auuaucuuuaaugaagacaaaggaaucuagug

SEQ ID NO: 338274 - RNA, 32 nt, Human
auuaucuuuggacauguacugcagcuucuugu

SEQ ID NO: 338275 - RNA, 32 nt, Human
auuaucuuuucuuucuccuuuuguuucucuaa

SEQ ID NO: 338276 - RNA, 32 nt, Human
auuaugaaaaacaucccaaacuuuaaaaugcg

SEQ ID NO: 338277 - RNA, 32 nt, Human
auuaugaaaauggguauacagcauuaaaaccu

SEQ ID NO: 338278 - RNA, 32 nt, Human
auuaugaaugauuuuucuccuuuugcuuguua

SEQ ID NO: 338279 - RNA, 32 nt, Human
auuaugaauguucaucaauuugacuauuauag

SEQ ID NO: 338280 - RNA, 32 nt, Human
auuaugaauucuuugaacucuuaagguuuuug

SEQ ID NO: 338281 - RNA, 32 nt, Human
auuaugacaacugaaugagacaugcacauaau

SEQ ID NO: 338282 - RNA, 32 nt, Human
auuaugacucacuguagccucaagagauccuc

SEQ ID NO: 338283 - RNA, 32 nt, Human
auuaugagaacuuucaguucaaagcaucaaau

SEQ ID NO: 338284 - RNA, 32 nt, Human
auuaugagagcaucagaguauuaucacugcug

SEQ ID NO: 338285 - RNA, 32 nt, Human
auuaugagagugaguuacgggagcaguuuuua

SEQ ID NO: 338286 - RNA, 32 nt, Human
auuaugagggaggcguguagcuucuuaucauu

SEQ ID NO: 338287 - RNA, 32 nt, Human
auuaugauguuccucagagaagugagguggga

SEQ ID NO: 338288 - RNA, 32 nt, Human
auuaugcaaagccacagcauuaaggagcucaa

SEQ ID NO: 338289 - RNA, 32 nt, Human
auuaugcaagugacuuucuuucuuacuugggg

SEQ ID NO: 338290 - RNA, 32 nt, Human
auuaugcacugacaugacccugggugacagga

SEQ ID NO: 338291 - RNA, 32 nt, Human
auuaugcacuucauuuugaggaauuacuacua

SEQ ID NO: 338292 - RNA, 32 nt, Human
auuaugcacuugcugcugccuccugggcucug

SEQ ID NO: 338293 - RNA, 32 nt, Human
auuaugcagagaauuggauugggucucuguca

SEQ ID NO: 338294 - RNA, 32 nt, Human
auuaugcagccaaggguacucuuuuacauaag

SEQ ID NO: 338295 - RNA, 32 nt, Human
auuaugccacugcacuccagccugggcaacag

SEQ ID NO: 338296 - RNA, 32 nt, Human
auuaugccacugcacuccagccugggugacag

SEQ ID NO: 338297 - RNA, 32 nt, Human
auuaugccacugcacuccagccuggugacaga

SEQ ID NO: 338298 - RNA, 32 nt, Human
auuaugccacugcacuucagccugggugacag

SEQ ID NO: 338299 - RNA, 32 nt, Human
auuaugccacugcuuuccagccugggcaacau

SEQ ID NO: 338300 - RNA, 32 nt, Human
auuaugccacuguacuccagccugggugacag

SEQ ID NO: 338301 - RNA, 32 nt, Human
auuaugccacuguacuccagcgugggugacag

SEQ ID NO: 338302 - RNA, 32 nt, Human
auuaugccagugcauuccagccaggaugacag

SEQ ID NO: 338303 - RNA, 32 nt, Human
auuaugccauuacacuccagccugggcaacag

SEQ ID NO: 338304 - RNA, 32 nt, Human
auuaugccauugcacuccagccugggugacaa

SEQ ID NO: 338305 - RNA, 32 nt, Human
auuaugccauugcacuccagccugggugacag

SEQ ID NO: 338306 - RNA, 32 nt, Human
auuaugccccugcacaucagccugggugauag

SEQ ID NO: 338307 - RNA, 32 nt, Human
auuaugccuaguuugucauaucacagaaaaac

SEQ ID NO: 338308 - RNA, 22 nt, Human
auuaugccugaaaagucuccca

SEQ ID NO: 338309 - RNA, 32 nt, Human
auuaugcuaauuugugaguucugaucacuuuu

SEQ ID NO: 338310 - RNA, 32 nt, Human
auuaugcuaggugaaauaagccugucacaaaa

SEQ ID NO: 338311 - RNA, 32 nt, Human
auuaugcugcccucaggcuugccuguaggauu

SEQ ID NO: 338312 - RNA, 32 nt, Human
auuaugcugcugcacuccagccuggacaacag

SEQ ID NO: 338313 - RNA, 32 nt, Human
auuaugcuuuugguucuuacugggugacuuug

SEQ ID NO: 338314 - RNA, 32 nt, Human
auuauggaagcacgauuuauuuaaauagguac

SEQ ID NO: 338315 - RNA, 32 nt, Human
auuauggaaggugagcuuggagaagaaggcag

SEQ ID NO: 338316 - RNA, 32 nt, Human
auuauggacgugagccaccacacccgcccuug

SEQ ID NO: 338317 - RNA, 32 nt, Human
auuauggagaaaaggccaggugcaguggcuca

SEQ ID NO: 338318 - RNA, 32 nt, Human
auuauggagccucguguguucuuaggggcuau

SEQ ID NO: 338319 - RNA, 32 nt, Human
auuauggaggcugagaagucucaagaucacag

SEQ ID NO: 338320 - RNA, 32 nt, Human
auuauggagggucuccugcaggcccuuguggg

SEQ ID NO: 338321 - RNA, 32 nt, Human
auuauggaguguaguguuuucuuaguucuuca

SEQ ID NO: 338322 - RNA, 32 nt, Human
auuauggcaggcaccuguaaucccagcuaccu

SEQ ID NO: 338323 - RNA, 32 nt, Human
auuauggccauuugauaccauucaagugaaau

SEQ ID NO: 338324 - RNA, 32 nt, Human
auuauggccauuuuccuuaucucccucccaag

SEQ ID NO: 338325 - RNA, 32 nt, Human
auuauggcuaaguugauauggaagcauucugg

SEQ ID NO: 338326 - RNA, 32 nt, Human
auuauggcucacugcaguuucaaccucccaga

SEQ ID NO: 338327 - RNA, 32 nt, Human
auuauggcucacugcggccucgacuuuccagu

SEQ ID NO: 338328 - RNA, 32 nt, Human
auuauggcuucacaaauaugugcucuauauug

SEQ ID NO: 338329 - RNA, 32 nt, Human
auuaugggaaaauaguguagccagcugccacc

SEQ ID NO: 338330 - RNA, 32 nt, Human
auuaugggaauuccauuuuaagaauuacuaca

SEQ ID NO: 338331 - RNA, 28 nt, Human
auuaugggaccaggccagccagcuucaa

SEQ ID NO: 338332 - RNA, 32 nt, Human
auuaugggcgcccgccaccacgcccagcuaau

SEQ ID NO: 338333 - RNA, 32 nt, Human
auuauggggacagagagcagggggcagacagc

SEQ ID NO: 338334 - RNA, 32 nt, Human
auuaugggugugagccaccacacccggccccc

SEQ ID NO: 338335 - RNA, 32 nt, Human
auuauggugaugguggccaacaagaaaaguca

SEQ ID NO: 338336 - RNA, 32 nt, Human
auuauggugcugggaagcucugucuuugauuu

SEQ ID NO: 338337 - RNA, 32 nt, Human
auuaugguucacugcagacuccaccucuccag

SEQ ID NO: 338338 - RNA, 23 nt, Human
auuaugguucugccagggcuccc

SEQ ID NO: 338339 - RNA, 32 nt, Human
auuaugguugacagagaguuuaugauccagaa

SEQ ID NO: 338340 - RNA, 28 nt, Human
auuaugguugcuucugcaggaagccuuu

SEQ ID NO: 338341 - RNA, 32 nt, Human
auuauguaauggaagaaaaaugcggaugccua

SEQ ID NO: 338342 - RNA, 32 nt, Human
auuauguacaaaccacaaaucagguacuguau

SEQ ID NO: 338343 - RNA, 32 nt, Human
auuauguacauacuuuuucauucuuaacuuag

SEQ ID NO: 338344 - RNA, 32 nt, Human
auuauguacuaucaaacccccaagaugcugau

SEQ ID NO: 338345 - RNA, 32 nt, Human
auuauguauacugucuguugcugccuggugau

SEQ ID NO: 338346 - RNA, 32 nt, Human
auuauguauuagauaucgcuauaaguggacau

SEQ ID NO: 338347 - RNA, 32 nt, Human
auuaugucacugcacuccauccugggugacaa

SEQ ID NO: 338348 - RNA, 28 nt, Human
auuaugucagggaccuugccuaugagcc

SEQ ID NO: 338349 - RNA, 32 nt, Human
auuaugucauucuucugcucaaaacucuccaa

SEQ ID NO: 338350 - RNA, 32 nt, Human
auuaugucgauuuuuaacugaggggaaauuaa

SEQ ID NO: 338351 - RNA, 32 nt, Human
auuaugucuguaaucaguguggaaaagccuuu

SEQ ID NO: 338352 - RNA, 24 nt, Human
auuaugugacuugcaauaaaguua

SEQ ID NO: 338353 - RNA, 32 nt, Human
auuaugugcucacugcuggcucaggccccaac

SEQ ID NO: 338354 - RNA, 32 nt, Human
auuauguucacugcacucugauuuucuguagg

SEQ ID NO: 338355 - RNA, 24 nt, Human
auuauguuccugucuuucuugaug

SEQ ID NO: 338356 - RNA, 32 nt, Human
auuauuaaaagaacaggggcagaaguggcuca

SEQ ID NO: 338357 - RNA, 32 nt, Human
auuauuaaaggcagaccuccaaguuccucccu

SEQ ID NO: 338358 - RNA, 32 nt, Human
auuauuaaaugaggugaaaacaaguaggagug

SEQ ID NO: 338359 - RNA, 32 nt, Human
auuauuaaucuugauacuaaggauuuguuacu

SEQ ID NO: 338360 - RNA, 32 nt, Human
auuauuacaaauguaugggauauuuuucaacc

SEQ ID NO: 338361 - RNA, 28 nt, Human
auuauuacaagugcuguauuauuugacu

SEQ ID NO: 338362 - RNA, 32 nt, Human
auuauuacccagaauugcucuuccauaaagcu

SEQ ID NO: 338363 - RNA, 32 nt, Human
auuauuagaagcaguauggaaaccccacaagg

SEQ ID NO: 338364 - RNA, 32 nt, Human
auuauuagauuucaggaugauuuauaauaauu

SEQ ID NO: 338365 - RNA, 32 nt, Human
auuauuaugagccaggagauggggacugugac

SEQ ID NO: 338366 - RNA, 32 nt, Human
auuauuauguguacauuauuguugcuauugug

SEQ ID NO: 338367 - RNA, 32 nt, Human
auuauuauuaugaaccuucagccuacuuucuu

SEQ ID NO: 338368 - RNA, 32 nt, Human
auuauuauuuuagagagacuguuaacggccug

SEQ ID NO: 338369 - RNA, 32 nt, Human
auuauucaaauacagagaaauagccacagggc

SEQ ID NO: 338370 - RNA, 32 nt, Human
auuauucaacagaugaggaaacagugaguuua

SEQ ID NO: 338371 - RNA, 21 nt, Human
auuauucaacugacggugcaa

SEQ ID NO: 338372 - RNA, 32 nt, Human
auuauucaauuguaaugcaauggcuugaaacc

SEQ ID NO: 338373 - RNA, 32 nt, Human
auuauucaccagacccagaaguuguacgcauu

SEQ ID NO: 338374 - RNA, 32 nt, Human
auuauucacugcacuauauucuaagcacuuac

SEQ ID NO: 338375 - RNA, 32 nt, Human
auuauuccaaaccaaauuuuaauuuuugcuuu

SEQ ID NO: 338376 - RNA, 21 nt, Human
auuauuccaguagucaguaca

SEQ ID NO: 338377 - RNA, 32 nt, Human
auuauucccucacaaaacaagccuggcgaggg

SEQ ID NO: 338378 - RNA, 32 nt, Human
auuauucccuuaggaauaucuccaaagaggga

SEQ ID NO: 338379 - RNA, 32 nt, Human
auuauuccugaggguuugcuccaccuucucug

SEQ ID NO: 338380 - RNA, 32 nt, Human
auuauucgucuucuccccauuccgcugccgcc

SEQ ID NO: 338381 - RNA, 32 nt, Human
auuauucuaguuucaguaaaucuaaagcaagu

SEQ ID NO: 338382 - RNA, 32 nt, Human
auuauucugccuggccccauguccucuuggag

SEQ ID NO: 338383 - RNA, 32 nt, Human
auuauucuggaaggcaaaaauaaagcuauuua

SEQ ID NO: 338384 - RNA, 32 nt, Human
auuauucuggguuuaggugucagcuuuugagc

SEQ ID NO: 338385 - RNA, 32 nt, Human
auuauucuucagugccuagauuuccugggacu

SEQ ID NO: 338386 - RNA, 32 nt, Human
auuauucuugcagcuaagcaagacagccauau

SEQ ID NO: 338387 - RNA, 32 nt, Human
auuauugaagcgauuucuauguggaaauaaau

SEQ ID NO: 338388 - RNA, 32 nt, Human
auuauugacccauagugacaccaguuuuggga

SEQ ID NO: 338389 - RNA, 32 nt, Human
auuauugaccuugagaaacuugccugcuucau

SEQ ID NO: 338390 - RNA, 32 nt, Human
auuauugaggggcaacucaggauuuuaaguuc

SEQ ID NO: 338391 - RNA, 32 nt, Human
auuauugaugaauuuucauaagguggaauuga

SEQ ID NO: 338392 - RNA, 32 nt, Human
auuauugcaaagcacugucaccggccucaggg

SEQ ID NO: 338393 - RNA, 32 nt, Human
auuauugcacacugccugaacaaaaccuauuu

SEQ ID NO: 338394 - RNA, 32 nt, Human
auuauugcaccacugaacuccagccugggcca

SEQ ID NO: 338395 - RNA, 32 nt, Human
auuauugcacuacugcauuccagccuggguga

SEQ ID NO: 338396 - RNA, 32 nt, Human
auuauugcucacaggcuggggaggcagaauga

SEQ ID NO: 338397 - RNA, 32 nt, Human
auuauugcuguacugugauucugucgucagcu

SEQ ID NO: 338398 - RNA, 32 nt, Human
auuauugcuguugcuugaauagcaauagcaug

SEQ ID NO: 338399 - RNA, 32 nt, Human
auuauugcuucaaccaucagucauaacucuag

SEQ ID NO: 338400 - RNA, 32 nt, Human
auuauuggaaaguguaacggggaccuucugca

SEQ ID NO: 338401 - RNA, 32 nt, Human
auuauuggcuucuguuucauauggacccagag

SEQ ID NO: 338402 - RNA, 32 nt, Human
auuauugggaaucgcuuacaguaccauuucau

SEQ ID NO: 338403 - RNA, 21 nt, Human
auuauugggcaaaauguccca

SEQ ID NO: 338404 - RNA, 32 nt, Human
auuauugggggaaaaggaaaauuagugaucuc

SEQ ID NO: 338405 - RNA, 32 nt, Human
auuauugguaccacucuucacuggcacaguug

SEQ ID NO: 338406 - RNA, 32 nt, Human
auuauugguuacacuucaauuuacagggcaua

SEQ ID NO: 338407 - RNA, 32 nt, Human
auuauugguuauuucucacuguucauucuauu

SEQ ID NO: 338408 - RNA, 32 nt, Human
auuauugucaucuguagccaccagcacaucac

SEQ ID NO: 338409 - RNA, 32 nt, Human
auuauugugaagaucgaccugaaaucuaucuu

SEQ ID NO: 338410 - RNA, 32 nt, Human
auuauuguugcagaagcauagauuuaauugca

SEQ ID NO: 338411 - RNA, 32 nt, Human
auuauuuaaaguguggaaagcaaaauaacaaa

SEQ ID NO: 338412 - RNA, 32 nt, Human
auuauuuaaauccaccuagaguagaaguuugc

SEQ ID NO: 338413 - RNA, 32 nt, Human
auuauuuacacaguuaaggaacaggugauaca

SEQ ID NO: 338414 - RNA, 32 nt, Human
auuauuuagaauauuuguuguugcaauuuuca

SEQ ID NO: 338415 - RNA, 32 nt, Human
auuauuuaggaaacaaagcaugugagugcuac

SEQ ID NO: 338416 - RNA, 32 nt, Human
auuauuuauccuauuuauuaaauuuaaaaagc

SEQ ID NO: 338417 - RNA, 32 nt, Human
auuauuuauucacuccuuuccucaccccaagu

SEQ ID NO: 338418 - RNA, 32 nt, Human
auuauuucacacacggaccaucuuuagcaguu

SEQ ID NO: 338419 - RNA, 32 nt, Human
auuauuucagaggaagcgccucugauuuguuu

SEQ ID NO: 338420 - RNA, 32 nt, Human
auuauuucauucaguuuuuggagcucaguuaa

SEQ ID NO: 338421 - RNA, 32 nt, Human
auuauuucccaauauuucauaguuuaugaggc

SEQ ID NO: 338422 - RNA, 32 nt, Human
auuauuucucuuaagagauauuuccuuuuauu

SEQ ID NO: 338423 - RNA, 32 nt, Human
auuauuucugcccuagaguuguucacagccua

SEQ ID NO: 338424 - RNA, 32 nt, Human
auuauuucuuaaucugaacaugaaggcuccau

SEQ ID NO: 338425 - RNA, 32 nt, Human
auuauuugaacccgguaguuuguuugaccuag

SEQ ID NO: 338426 - RNA, 32 nt, Human
auuauuugagucuauguauucugaccucagaa

SEQ ID NO: 338427 - RNA, 32 nt, Human
auuauuugauggcgauggcaggacacagcaua

SEQ ID NO: 338428 - RNA, 32 nt, Human
auuauuugugccaccugcuguggacuguuuuc

SEQ ID NO: 338429 - RNA, 32 nt, Human
auuauuuuaaaugugacucccuugucccaacc

SEQ ID NO: 338430 - RNA, 32 nt, Human
auuauuuuaacaaaaguuacauuccucuccac

SEQ ID NO: 338431 - RNA, 32 nt, Human
auuauuuuaauacagagaugauuuucaaaaua

SEQ ID NO: 338432 - RNA, 32 nt, Human
auuauuuuaccuccuuuguccccuucuagucc

SEQ ID NO: 338433 - RNA, 32 nt, Human
auuauuuucccuuauuuuucuuucauuaguuu

SEQ ID NO: 338434 - RNA, 32 nt, Human
auuauuuuccucuuucuuugguaaggucaaua

SEQ ID NO: 338435 - RNA, 32 nt, Human
auuauuuuccuuccaugcucccaacucccuuc

SEQ ID NO: 338436 - RNA, 32 nt, Human
auuauuuucuccccaacaguauuuuccaguag

SEQ ID NO: 338437 - RNA, 32 nt, Human
auuauuuucuguaguuccggagagaugguggg

SEQ ID NO: 338438 - RNA, 32 nt, Human
auuauuuucuguauuuuaguauauaguauaaa

SEQ ID NO: 338439 - RNA, 32 nt, Human
auuauuuugaagcaagggcucacucugucacc

SEQ ID NO: 338440 - RNA, 32 nt, Human
auuauuuuucccuuggacacaaaugucuacag

SEQ ID NO: 338441 - RNA, 32 nt, Human
auuauuuuugaaacggagucucgcucugucac

SEQ ID NO: 338442 - RNA, 32 nt, Human
auuauuuuugagacagagucuuacucuguugc

SEQ ID NO: 338443 - RNA, 32 nt, Human
auuauuuuugagacagggucucgcucugccag

SEQ ID NO: 338444 - RNA, 32 nt, Human
auuauuuuugagacagugucuugcucugucuc

SEQ ID NO: 338445 - RNA, 32 nt, Human
auuauuuuugagauggaguuuugcucuuaaug

SEQ ID NO: 338446 - RNA, 32 nt, Human
auuauuuuugagauggggacucacucuguugc

SEQ ID NO: 338447 - RNA, 32 nt, Human
auuauuuuugucacggaaaacauccucuccaa

SEQ ID NO: 338448 - RNA, 32 nt, Human
auucaaaaagcucuccuuguaauugcaaguuu

SEQ ID NO: 338449 - RNA, 32 nt, Human
auucaaaaaggcaugcaacacaccuggagcac

SEQ ID NO: 338450 - RNA, 32 nt, Human
auucaaaaaugccugcaucucuucucuuauuu

SEQ ID NO: 338451 - RNA, 32 nt, Human
auucaaaaccagccuggccaacauagugaaac

SEQ ID NO: 338452 - RNA, 32 nt, Human
auucaaaaccagccuggccaacaugcaaaacc

SEQ ID NO: 338453 - RNA, 32 nt, Human
auucaaaacucggguucugugauaugaggaua

SEQ ID NO: 338454 - RNA, 32 nt, Human
auucaaaauaguccacugacuccucacaucug

SEQ ID NO: 338455 - RNA, 32 nt, Human
auucaaaauuuccagauuugggcuauuucugu

SEQ ID NO: 338456 - RNA, 32 nt, Human
auucaaacaggcugucggucuccucucacccc

SEQ ID NO: 338457 - RNA, 32 nt, Human
auucaaaccacccacccccaucaugaccuggg

SEQ ID NO: 338458 - RNA, 32 nt, Human
auucaaaccucacauccucccuucaguuuaau

SEQ ID NO: 338459 - RNA, 32 nt, Human
auucaaacucaugcuggaucucuuucauauua

SEQ ID NO: 338460 - RNA, 32 nt, Human
auucaaagaacucagucugauaaucugccucc

SEQ ID NO: 338461 - RNA, 32 nt, Human
auucaaagauguggcuguggauuucacccagg

SEQ ID NO: 338462 - RNA, 31 nt, Human
auucaaagccguccugggccuaaguccuugc

SEQ ID NO: 338463 - RNA, 32 nt, Human
auucaaauaaaaaugauagacacagaaagguu

SEQ ID NO: 338464 - RNA, 24 nt, Human
auucaaauaugcaccuggcucccu

SEQ ID NO: 338465 - RNA, 23 nt, Human
auucaaaucccguguugcacccu

SEQ ID NO: 338466 - RNA, 32 nt, Human
auucaacaaacacuuacugaggccaacacugg

SEQ ID NO: 338467 - RNA, 32 nt, Human
auucaacaaacaguuauguagcaucuacuggu

SEQ ID NO: 338468 - RNA, 32 nt, Human
auucaacaacgggucugaaugucuagcuggcc

SEQ ID NO: 338469 - RNA, 32 nt, Human
auucaacaagcugaguggagaccauggucugu

SEQ ID NO: 338470 - RNA, 32 nt, Human
auucaacaccagccuggccaacauagugaaac

SEQ ID NO: 338471 - RNA, 32 nt, Human
auucaacacccacuuucuccucccucugcccc

SEQ ID NO: 338472 - RNA, 32 nt, Human
auucaacaccuuuaacaauguauaugugaagu

SEQ ID NO: 338473 - RNA, 32 nt, Human
auucaacacugcagaaugggugaccucaaaga

SEQ ID NO: 338474 - RNA, 32 nt, Human
auucaacagaacaccaggaaggucaagacgcu

SEQ ID NO: 338475 - RNA, 32 nt, Human
auucaacaggaggaacccgcgggagaggagcc

SEQ ID NO: 338476 - RNA, 32 nt, Human
auucaacauagggugaaacuauuucugauaaa

SEQ ID NO: 338477 - RNA, 32 nt, Human
auucaacuaauucccuucccuucccccuucuu

SEQ ID NO: 338478 - RNA, 32 nt, Human
auucaacuagguuuugugucuccuggaucuau

SEQ ID NO: 338479 - RNA, 32 nt, Human
auucaacugaauauauuuccauggccaucaca

SEQ ID NO: 338480 - RNA, 32 nt, Human
auucaacuggaaggaaaccucaaugcugccuc

SEQ ID NO: 338481 - RNA, 32 nt, Human
auucaacuuugcuuagcuaaucaugccuaaca

SEQ ID NO: 338482 - RNA, 32 nt, Human
auucaagaacgaguuucucuucccucuccauu

SEQ ID NO: 338483 - RNA, 32 nt, Human
auucaagaacuccagaaaucaggagacggaga

SEQ ID NO: 338484 - RNA, 32 nt, Human
auucaagaacucccuagugaggagcugaacuu

SEQ ID NO: 338485 - RNA, 32 nt, Human
auucaagaccagccuagguaacauagugggac

SEQ ID NO: 338486 - RNA, 32 nt, Human
auucaagaccagccuggccaacauggugaaac

SEQ ID NO: 338487 - RNA, 32 nt, Human
auucaagaccagccugggcaacauggugaaac

SEQ ID NO: 338488 - RNA, 32 nt, Human
auucaagaccucagucacggucuuccaaagca

SEQ ID NO: 338489 - RNA, 32 nt, Human
auucaagacuggagacaccugggaaauaaaaa

SEQ ID NO: 338490 - RNA, 32 nt, Human
auucaagacuggucaguccaagagcagacaaa

SEQ ID NO: 338491 - RNA, 32 nt, Human
auucaagaggaaaugucacagaagcagcuaaa

SEQ ID NO: 338492 - RNA, 32 nt, Human
auucaagaggcugaggcaugaggaucucuuga

SEQ ID NO: 338493 - RNA, 32 nt, Human
auucaagaggggguuaaguacagugaguucug

SEQ ID NO: 338494 - RNA, 32 nt, Human
auucaagauacaacagugagggaauccgguca

SEQ ID NO: 338495 - RNA, 32 nt, Human
auucaagauuagccuggacaacauggugaaac

SEQ ID NO: 338496 - RNA, 32 nt, Human
auucaagcaaacaaauauggaagcuaccaaag

SEQ ID NO: 338497 - RNA, 32 nt, Human
auucaagcaauccucccaucucagccuccuga

SEQ ID NO: 338498 - RNA, 32 nt, Human
auucaagcaauggaugcaaggaacaugcugua

SEQ ID NO: 338499 - RNA, 32 nt, Human
auucaagcaauucuucugccucagcuucccga

SEQ ID NO: 338500 - RNA, 32 nt, Human
auucaagcacauauuggucaccuacugugugc

SEQ ID NO: 338501 - RNA, 32 nt, Human
auucaagcaguuuuccugccucagccucccca

SEQ ID NO: 338502 - RNA, 23 nt, Human
auucaagcgauucuccugccuca

SEQ ID NO: 338503 - RNA, 23 nt, Human
auucaagcgauucuccugucuca

SEQ ID NO: 338504 - RNA, 32 nt, Human
auucaagcugugggugagaagcucucuagcag

SEQ ID NO: 338505 - RNA, 32 nt, Human
auucaaggaaauaaggaaugaccuggaacagg

SEQ ID NO: 338506 - RNA, 32 nt, Human
auucaaggaaugucaggagaaacuccaggcag

SEQ ID NO: 338507 - RNA, 32 nt, Human
auucaaggagaguugagauacagugaaaugag

SEQ ID NO: 338508 - RNA, 32 nt, Human
auucaaggcaaauaccacucugugcauuuucu

SEQ ID NO: 338509 - RNA, 32 nt, Human
auucaagggaggcaggcgcuuuggaaguuugu

SEQ ID NO: 338510 - RNA, 32 nt, Human
auucaaggggcccugaggacuggacugcuagu

SEQ ID NO: 338511 - RNA, 32 nt, Human
auucaaggugacaaucaagcccaauggcuuga

SEQ ID NO: 338512 - RNA, 32 nt, Human
auucaagugcuuguaaaugcuuucauuucugg

SEQ ID NO: 338513 - RNA, 32 nt, Human
auucaaguuucaucuuugcagggaccacaaaa

SEQ ID NO: 338514 - RNA, 32 nt, Human
auucaauacaaacugcacuaugauuugcuuua

SEQ ID NO: 338515 - RNA, 32 nt, Human
auucaauauaaauauauuauaucaaucuuaac

SEQ ID NO: 338516 - RNA, 32 nt, Human
auucaauauuuaucauccuccuuucccucucu

SEQ ID NO: 338517 - RNA, 32 nt, Human
auucaauccucaggucuccaccaaggaggcag

SEQ ID NO: 338518 - RNA, 32 nt, Human
auucaaucuccagaagauugggauuaucgucu

SEQ ID NO: 338519 - RNA, 32 nt, Human
auucaaucugcaugccagccuggaggaggaaa

SEQ ID NO: 338520 - RNA, 32 nt, Human
auucaaucuuaugcuugggaggaggaauaacu

SEQ ID NO: 338521 - RNA, 32 nt, Human
auucaaugaccuucucaauugaccugaguuac

SEQ ID NO: 338522 - RNA, 22 nt, Human
auucaaugugaacaacuuuuua

SEQ ID NO: 338523 - RNA, 32 nt, Human
auucaauucacgcauugaaaacaaauuuagaa

SEQ ID NO: 338524 - RNA, 32 nt, Human
auucaauugcuuguugugcugaugagcuauga

SEQ ID NO: 338525 - RNA, 32 nt, Human
auucaauuuauucaagaaaaguaagcccuuga

SEQ ID NO: 338526 - RNA, 32 nt, Human
auucaauuuggacuggugugcucucuuuaaau

SEQ ID NO: 338527 - RNA, 32 nt, Human
auucacaaacaugacaucacccugcagcuugc

SEQ ID NO: 338528 - RNA, 32 nt, Human
auucacaaauauagaaaaguauacaaaacaaa

SEQ ID NO: 338529 - RNA, 32 nt, Human
auucacaaggcaauucauacuggagagaaacc

SEQ ID NO: 338530 - RNA, 32 nt, Human
auucacaaugauuuuguucucugcuccauauu

SEQ ID NO: 338531 - RNA, 32 nt, Human
auucacacaaguguuugucuuagaugauuaag

SEQ ID NO: 338532 - RNA, 32 nt, Human
auucacacagacugaaagugaguucgggcuug

SEQ ID NO: 338533 - RNA, 32 nt, Human
auucacacaggccacagcagaaaagagagcac

SEQ ID NO: 338534 - RNA, 32 nt, Human
auucacacucaacagguuuuaggauaauuuaa

SEQ ID NO: 338535 - RNA, 32 nt, Human
auucacacuuucuacuuucauaccuuuuuaau

SEQ ID NO: 338536 - RNA, 32 nt, Human
auucacagaaugcacuuucuacccugugugcc

SEQ ID NO: 338537 - RNA, 32 nt, Human
auucacagaguuguucaucuaucacuacuaaa

SEQ ID NO: 338538 - RNA, 32 nt, Human
auucacagcaauuuucuucacauuauuccuuu

SEQ ID NO: 338539 - RNA, 32 nt, Human
auucacagcaccaacagaaggaagagggugag

SEQ ID NO: 338540 - RNA, 32 nt, Human
auucacagcacugcacugcagccugggugaca

SEQ ID NO: 338541 - RNA, 32 nt, Human
auucacagcccaggcaggacagagcagaucac

SEQ ID NO: 338542 - RNA, 32 nt, Human
auucacagcuacucgggagguugaggcaggag

SEQ ID NO: 338543 - RNA, 32 nt, Human
auucacagcuguucccuggcagcacacaggag

SEQ ID NO: 338544 - RNA, 32 nt, Human
auucacauagccaucauuuacacugcuugcca

SEQ ID NO: 338545 - RNA, 32 nt, Human
auucacauaguccucagggcucagucuuuuga

SEQ ID NO: 338546 - RNA, 32 nt, Human
auucacaucccaggagcauccauuuuaaggaa

SEQ ID NO: 338547 - RNA, 32 nt, Human
auucacauccugggugggacagagcaggacaa

SEQ ID NO: 338548 - RNA, 32 nt, Human
auucacaugaggugagcuucagccugagauag

SEQ ID NO: 338549 - RNA, 32 nt, Human
auucacaugccauucaguuuacccauugcuag

SEQ ID NO: 338550 - RNA, 32 nt, Human
auucacauuaacagugcugccuguguccugug

SEQ ID NO: 338551 - RNA, 32 nt, Human
auucacauugaauggggaugaggucggacagu

SEQ ID NO: 338552 - RNA, 32 nt, Human
auucaccaaagacaugcuuaauuuuuaagaga

SEQ ID NO: 338553 - RNA, 32 nt, Human
auucaccaagccgccuccacagugccgguggg

SEQ ID NO: 338554 - RNA, 32 nt, Human
auucaccacacaugccagcugaugcaaagaaa

SEQ ID NO: 338555 - RNA, 21 nt, Human
auucaccacaguacaaaccuc

SEQ ID NO: 338556 - RNA, 32 nt, Human
auucaccacauuggccagccuggucuugaacu

SEQ ID NO: 338557 - RNA, 23 nt, Human
auucaccaccacaagaccuauua

SEQ ID NO: 338558 - RNA, 32 nt, Human
auucaccacuggcuuuucucuccccuggccuu

SEQ ID NO: 338559 - RNA, 32 nt, Human
auucaccagagaaacugcuguauacuaggugu

SEQ ID NO: 338560 - RNA, 32 nt, Human
auucaccagguaaaugaauguuuccagggacc

SEQ ID NO: 338561 - RNA, 32 nt, Human
auucaccagucgucucuggguugugugugaga

SEQ ID NO: 338562 - RNA, 32 nt, Human
auucaccaguguuccugaagcugcuguguccu

SEQ ID NO: 338563 - RNA, 32 nt, Human
auucaccauccaguagaggagaaagacgucga

SEQ ID NO: 338564 - RNA, 32 nt, Human
auucacccaauagaaucaucaccagagguuaa

SEQ ID NO: 338565 - RNA, 32 nt, Human
auucacccagaaccauggugggagagaacaga

SEQ ID NO: 338566 - RNA, 32 nt, Human
auucacccagcucucuugccugcaggcugauc

SEQ ID NO: 338567 - RNA, 32 nt, Human
auucacccaggaggucacagaaugacagcaag

SEQ ID NO: 338568 - RNA, 32 nt, Human
auucacccaucuuucuguuugucauucuuauc

SEQ ID NO: 338569 - RNA, 32 nt, Human
auucacccauuuuucuucuucagaaggccuuu

SEQ ID NO: 338570 - RNA, 32 nt, Human
auucacccccagucacaauggucuccauugca

SEQ ID NO: 338571 - RNA, 32 nt, Human
auucaccccugccccguugcuucccgcugcac

SEQ ID NO: 338572 - RNA, 32 nt, Human
auucacccugcacaccuccaggauggauaguu

SEQ ID NO: 338573 - RNA, 32 nt, Human
auucacccuggaccaacagggagagcaagaag

SEQ ID NO: 338574 - RNA, 32 nt, Human
auucacccuuccccuuccuccccuuucucuuu

SEQ ID NO: 338575 - RNA, 32 nt, Human
auucacccuuuuccuuuguuucuugcucuguu

SEQ ID NO: 338576 - RNA, 32 nt, Human
auucaccugccucuugcuuuuuguggguggcu

SEQ ID NO: 338577 - RNA, 32 nt, Human
auucaccuugaccuuauuuaugacuuuacgug

SEQ ID NO: 338578 - RNA, 32 nt, Human
auucaccuuuucuucaaaaucgauaugguggc

SEQ ID NO: 338579 - RNA, 32 nt, Human
auucacgacucugcagcccgagguccccucug

SEQ ID NO: 338580 - RNA, 32 nt, Human
auucacgagaacagcacauacauguguuugaa

SEQ ID NO: 338581 - RNA, 32 nt, Human
auucacgaggcugaggcaggaaaaucacuuga

SEQ ID NO: 338582 - RNA, 32 nt, Human
auucacgaugguuuugugccagcucuuuuuag

SEQ ID NO: 338583 - RNA, 32 nt, Human
auucacgccuguaaucccagaacucugggaag

SEQ ID NO: 338584 - RNA, 32 nt, Human
auucacgccuguaaucccagcacuuugagagg

SEQ ID NO: 338585 - RNA, 32 nt, Human
auucacgccuguaaucccagcacuuugggagg

SEQ ID NO: 338586 - RNA, 32 nt, Human
auucacggaaagcaaguugaugaccagaaauc

SEQ ID NO: 338587 - RNA, 32 nt, Human
auucacgggaggaggucaaaauaucaacauua

SEQ ID NO: 338588 - RNA, 32 nt, Human
auucacguucccacccagccuggcuggcggug

SEQ ID NO: 338589 - RNA, 32 nt, Human
auucacuaagcaagguuggugagacggcaaca

SEQ ID NO: 338590 - RNA, 32 nt, Human
auucacuacagccuggaugacaagcaagaccc

SEQ ID NO: 338591 - RNA, 21 nt, Human
auucacucacucguuugcaaa

SEQ ID NO: 338592 - RNA, 32 nt, Human
auucacucagaccuucauggcugcaaucucau

SEQ ID NO: 338593 - RNA, 32 nt, Human
auucacucaucuggagaacacaggguuggacu

SEQ ID NO: 338594 - RNA, 32 nt, Human
auucacuccuuuccucaccccaagugcccugc

SEQ ID NO: 338595 - RNA, 32 nt, Human
auucacugaaucaacagacacaaaaagcuggc

SEQ ID NO: 338596 - RNA, 32 nt, Human
auucacugauuucgugcugugugcucugggga

SEQ ID NO: 338597 - RNA, 32 nt, Human
auucacugcaucauagcuaugccuguauggag

SEQ ID NO: 338598 - RNA, 32 nt, Human
auucacugccccuggggcguuuccuugaaggu

SEQ ID NO: 338599 - RNA, 32 nt, Human
auucacugcugaaccccuggccccagagcccc

SEQ ID NO: 338600 - RNA, 32 nt, Human
auucacugcuguugcucauuugcccuuuucca

SEQ ID NO: 338601 - RNA, 32 nt, Human
auucacugguaagaguccagugggguccccug

SEQ ID NO: 338602 - RNA, 32 nt, Human
auucacuguuuucaaagagacaugagaagauc

SEQ ID NO: 338603 - RNA, 32 nt, Human
auucacuuaacuucuccauggcugcuuccugc

SEQ ID NO: 338604 - RNA, 32 nt, Human
auucacuuagcuuccucagucucuccaucuua

SEQ ID NO: 338605 - RNA, 32 nt, Human
auucacuucuaagggcccuguuuugagauugu

SEQ ID NO: 338606 - RNA, 22 nt, Human
auucacuucugucuucugcaaa

SEQ ID NO: 338607 - RNA, 32 nt, Human
auucacuucuucuucaaagcuuuuucuuaguu

SEQ ID NO: 338608 - RNA, 32 nt, Human
auucacuuucccuuggacauauggaugacauu

SEQ ID NO: 338609 - RNA, 32 nt, Human
auucagaaacgguagagagggaggggcugggg

SEQ ID NO: 338610 - RNA, 32 nt, Human
auucagaaauccaaguuggugucauacauuuc

SEQ ID NO: 338611 - RNA, 32 nt, Human
auucagaaauucauuucagcauguuauuauug

SEQ ID NO: 338612 - RNA, 32 nt, Human
auucagaacucacguagggagccccaggaaua

SEQ ID NO: 338613 - RNA, 32 nt, Human
auucagaagaguuccguccaacagaaauguaa

SEQ ID NO: 338614 - RNA, 32 nt, Human
auucagaagcccuaaaacauaccaccuuggcu

SEQ ID NO: 338615 - RNA, 32 nt, Human
auucagaagcucaagaagacaccagagaagcc

SEQ ID NO: 338616 - RNA, 32 nt, Human
auucagaagucugcuuuucagguuuauuccua

SEQ ID NO: 338617 - RNA, 32 nt, Human
auucagaaucuauucucuucucuccagucccg

SEQ ID NO: 338618 - RNA, 24 nt, Human
auucagaaugacaccauauucuua

SEQ ID NO: 338619 - RNA, 24 nt, Human
auucagaaugauguuucgguucuu

SEQ ID NO: 338620 - RNA, 32 nt, Human
auucagacaacauuaugaucuaauaaacuuua

SEQ ID NO: 338621 - RNA, 32 nt, Human
auucagacaugauccaguccagccugggcuug

SEQ ID NO: 338622 - RNA, 32 nt, Human
auucagacgcuuccgucagccucccaggaugg

SEQ ID NO: 338623 - RNA, 32 nt, Human
auucagacugauuuccaaaucugucaacuaga

SEQ ID NO: 338624 - RNA, 24 nt, Human
auucagacuggaguggauaggaua

SEQ ID NO: 338625 - RNA, 32 nt, Human
auucagacugucagucuauuccugggcaguag

SEQ ID NO: 338626 - RNA, 32 nt, Human
auucagagaaaugcugcaugcugccgucaugg

SEQ ID NO: 338627 - RNA, 31 nt, Human
auucagagaacuaauuuuucacuggauaaga

SEQ ID NO: 338628 - RNA, 32 nt, Human
auucagagacgggguuucaccguguuagccag

SEQ ID NO: 338629 - RNA, 32 nt, Human
auucagagaggcccugaggacuuggccaccac

SEQ ID NO: 338630 - RNA, 32 nt, Human
auucagagagguuucgcagacucgguaacggc

SEQ ID NO: 338631 - RNA, 32 nt, Human
auucagagcuugguaaaugucacuguacagaa

SEQ ID NO: 338632 - RNA, 32 nt, Human
auucagaggaaaacccagauucagugauuaac

SEQ ID NO: 338633 - RNA, 32 nt, Human
auucagaggacagcgucuguccccagcugcag

SEQ ID NO: 338634 - RNA, 32 nt, Human
auucagagugugagagcaagcucuacagauag

SEQ ID NO: 338635 - RNA, 32 nt, Human
auucagaguugugaugcucucuucugacagcc

SEQ ID NO: 338636 - RNA, 32 nt, Human
auucagauacccuaucgucgucagucauggcu

SEQ ID NO: 338637 - RNA, 32 nt, Human
auucagauaugacagcuaauuaccucaucaua

SEQ ID NO: 338638 - RNA, 32 nt, Human
auucagaugcugugaaccagauuuccuuuucu

SEQ ID NO: 338639 - RNA, 32 nt, Human
auucagauuccccucugggaucugucuucaga

SEQ ID NO: 338640 - RNA, 32 nt, Human
auucagauugacugaaaagucacaugaagagu

SEQ ID NO: 338641 - RNA, 32 nt, Human
auucagcaaagucuacuaucagaagacacguu

SEQ ID NO: 338642 - RNA, 32 nt, Human
auucagcaagggacagauuuaccucaaggcca

SEQ ID NO: 338643 - RNA, 32 nt, Human
auucagcacaacggccucaucaagaucggcuc

SEQ ID NO: 338644 - RNA, 32 nt, Human
auucagcaccuuuguuguuacugugaacguga

SEQ ID NO: 338645 - RNA, 32 nt, Human
auucagcacgcacacaacacacaagggagaga

SEQ ID NO: 338646 - RNA, 32 nt, Human
auucagcagcagaguuggugacuuugacaacu

SEQ ID NO: 338647 - RNA, 32 nt, Human
auucagcaggucugcggggacugaggcauggc

SEQ ID NO: 338648 - RNA, 32 nt, Human
auucagcaguccaggcugaugcaguggcuuca

SEQ ID NO: 338649 - RNA, 32 nt, Human
auucagcaucuucucuauucauguggagugaa

SEQ ID NO: 338650 - RNA, 32 nt, Human
auucagcauguguguggguguggauguuuaua

SEQ ID NO: 338651 - RNA, 32 nt, Human
auucagccaagaggaaaagcacucugauuaug

SEQ ID NO: 338652 - RNA, 22 nt, Human
auucagcccaccagccaccuca

SEQ ID NO: 338653 - RNA, 32 nt, Human
auucagccucaccuaucuccccacccauucuc

SEQ ID NO: 338654 - RNA, 32 nt, Human
auucagccucgcaguccagcacacacaaacag

SEQ ID NO: 338655 - RNA, 32 nt, Human
auucagccucuucggacccucucucacucccu

SEQ ID NO: 338656 - RNA, 32 nt, Human
auucagccuuaaauuaagcucuuaguuguuca

SEQ ID NO: 338657 - RNA, 32 nt, Human
auucagcguuuuguuucuuucuguccauacuu

SEQ ID NO: 338658 - RNA, 32 nt, Human
auucagcuacuuuuuccccucaguuaaaaggu

SEQ ID NO: 338659 - RNA, 32 nt, Human
auucagcucaaggauucagugucuucauuuuu

SEQ ID NO: 338660 - RNA, 32 nt, Human
auucagcucaauucucaaccauacuccaaacu

SEQ ID NO: 338661 - RNA, 32 nt, Human
auucagcucacugcaaucuccgccucccgggu

SEQ ID NO: 338662 - RNA, 32 nt, Human
auucagcucagcugccucuuucuugaggacac

SEQ ID NO: 338663 - RNA, 32 nt, Human
auucagcucauauggcaucuguccucgacuaa

SEQ ID NO: 338664 - RNA, 32 nt, Human
auucagcugcccaggcagaggagaaugggguc

SEQ ID NO: 338665 - RNA, 32 nt, Human
auucagcuggagcccuuaaaacuucgagcgug

SEQ ID NO: 338666 - RNA, 31 nt, Human
auucagcuguggagugugguuggagaugaag

SEQ ID NO: 338667 - RNA, 32 nt, Human
auucagcuucaaaugcagcccaguauccugcc

SEQ ID NO: 338668 - RNA, 26 nt, Human
auucagcuucuggguggugggugggg

SEQ ID NO: 338669 - RNA, 32 nt, Human
auucagcuucuucauuuccaacauggaagaaa

SEQ ID NO: 338670 - RNA, 32 nt, Human
auucagcuugcuugcuuccuccaccagucuga

SEQ ID NO: 338671 - RNA, 32 nt, Human
auucaggaaacugaggugggaggaucacuuga

SEQ ID NO: 338672 - RNA, 32 nt, Human
auucaggaaccgcggcugcugaaggagaaggu

SEQ ID NO: 338673 - RNA, 32 nt, Human
auucaggaagaggggguaaauguggauuguau

SEQ ID NO: 338674 - RNA, 32 nt, Human
auucaggaagcauaaaguaguaugaaagguuu

SEQ ID NO: 338675 - RNA, 32 nt, Human
auucaggaccaacuucugggaaacccaaacua

SEQ ID NO: 338676 - RNA, 32 nt, Human
auucaggacgcugaggcaggaggaucacuuca

SEQ ID NO: 338677 - RNA, 32 nt, Human
auucaggagauuaaggcaggaggaucacuuga

SEQ ID NO: 338678 - RNA, 32 nt, Human
auucaggagcaaguuuccaaagagacucauaa

SEQ ID NO: 338679 - RNA, 32 nt, Human
auucaggagcuucuguuauauucaaagguaau

SEQ ID NO: 338680 - RNA, 25 nt, Human
auucaggaggcggagguugcaguga

SEQ ID NO: 338681 - RNA, 32 nt, Human
auucaggaggcggagguugcagugagccaaga

SEQ ID NO: 338682 - RNA, 32 nt, Human
auucaggaggcugaggcaggagaaucacuuga

SEQ ID NO: 338683 - RNA, 32 nt, Human
auucaggaggcugaggcaggagaaucacuugg

SEQ ID NO: 338684 - RNA, 32 nt, Human
auucaggaggcugaggcaggaggaucgcuuga

SEQ ID NO: 338685 - RNA, 32 nt, Human
auucaggaggcugaggcggcaggaucacuuga

SEQ ID NO: 338686 - RNA, 32 nt, Human
auucaggaggcugaggugggaggaucauuuga

SEQ ID NO: 338687 - RNA, 32 nt, Human
auucaggaggcugaggugggaggaucgguuga

SEQ ID NO: 338688 - RNA, 32 nt, Human
auucaggaggcugaggugggaggauugcuuga

SEQ ID NO: 338689 - RNA, 32 nt, Human
auucaggagguggagguugcagugagccgaca

SEQ ID NO: 338690 - RNA, 32 nt, Human
auucaggaguccugugcuccagucacagccuu

SEQ ID NO: 338691 - RNA, 32 nt, Human
auucaggcaugaugccaggugcaccaacuuac

SEQ ID NO: 338692 - RNA, 32 nt, Human
auucaggcauuuucccccuuggcucucaaugc

SEQ ID NO: 338693 - RNA, 32 nt, Human
auucaggcgaguuuugcccaggccugcugucu

SEQ ID NO: 338694 - RNA, 32 nt, Human
auucaggcugggaaccugaacacacacuugug

SEQ ID NO: 338695 - RNA, 32 nt, Human
auucagggaaaucucucccuucauuuacuuuu

SEQ ID NO: 338696 - RNA, 32 nt, Human
auucagggaucacacaguucugccuguucuca

SEQ ID NO: 338697 - RNA, 32 nt, Human
auucaggggcaaucugguuugcauuuaagauc

SEQ ID NO: 338698 - RNA, 32 nt, Human
auucaggggcugcuucagaaucccaucuuugc

SEQ ID NO: 338699 - RNA, 32 nt, Human
auucaggggcuggggucugccugguccuugag

SEQ ID NO: 338700 - RNA, 32 nt, Human
auucaggguuuccugacugcuaaugcagaaag

SEQ ID NO: 338701 - RNA, 32 nt, Human
auucagguauaugugauauuuugccugguuug

SEQ ID NO: 338702 - RNA, 32 nt, Human
auucaggucaacacugcacuccagccugggcg

SEQ ID NO: 338703 - RNA, 32 nt, Human
auucaggugaucucuguggagguagucaggga

SEQ ID NO: 338704 - RNA, 32 nt, Human
auucagguggagggguacaucuagggguggag

SEQ ID NO: 338705 - RNA, 32 nt, Human
auucagguucaguacauuuauuacaaagugaa

SEQ ID NO: 338706 - RNA, 32 nt, Human
auucaguaaauguuaagcagcagaagacuucg

SEQ ID NO: 338707 - RNA, 32 nt, Human
auucaguacugagcuagaucguguaaagaauc

SEQ ID NO: 338708 - RNA, 32 nt, Human
auucaguaguuagggcagggaggagaaauaaa

SEQ ID NO: 338709 - RNA, 32 nt, Human
auucaguauaauggcaucacugccuguuuuuc

SEQ ID NO: 338710 - RNA, 32 nt, Human
auucaguauuucugcacucuuagcuggauucu

SEQ ID NO: 338711 - RNA, 32 nt, Human
auucagucacagucacagccaccaugccaggg

SEQ ID NO: 338712 - RNA, 32 nt, Human
auucagucauggagaaaaacauauuaaaauaa

SEQ ID NO: 338713 - RNA, 32 nt, Human
auucaguccagggggagccacggaaaccaugu

SEQ ID NO: 338714 - RNA, 32 nt, Human
auucagucuguggagguuugcauucaccugcc

SEQ ID NO: 338715 - RNA, 32 nt, Human
auucagugcagcagggggacacagaccugccc

SEQ ID NO: 338716 - RNA, 32 nt, Human
auucagugcagccucuuuaccaccuccccacu

SEQ ID NO: 338717 - RNA, 32 nt, Human
auucagugcauccagguccugccuugugagau

SEQ ID NO: 338718 - RNA, 19 nt, Human
auucaguggaaagaugcac

SEQ ID NO: 338719 - RNA, 32 nt, Human
auucaguggccugcuuucgccugcugucucug

SEQ ID NO: 338720 - RNA, 32 nt, Human
auucagugggccagucaaaucuuaaagcuccc

SEQ ID NO: 338721 - RNA, 24 nt, Human
auucagugucuucauuuuuacaaa

SEQ ID NO: 338722 - RNA, 32 nt, Human
auucaguucauccaaaauggaguaauauccuu

SEQ ID NO: 338723 - RNA, 32 nt, Human
auucaguuccaguuuaaugauguggcccucua

SEQ ID NO: 338724 - RNA, 32 nt, Human
auucaguucugccuccaaaaugcaugugucca

SEQ ID NO: 338725 - RNA, 32 nt, Human
auucaguugagugcagcaucuuucccacauuc

SEQ ID NO: 338726 - RNA, 21 nt, Human
auucaguuuauguguaaaaua

SEQ ID NO: 338727 - RNA, 32 nt, Human
auucaguuucuggggaaagugaagcaugaagg

SEQ ID NO: 338728 - RNA, 32 nt, Human
auucaguuuuaaaaggaaaacagagcauaaaa

SEQ ID NO: 338729 - RNA, 32 nt, Human
auucaguuuucuuguccauaucuuuaaaagag

SEQ ID NO: 338730 - RNA, 32 nt, Human
auucauaaaggagauaaauuauacaaauguga

SEQ ID NO: 338731 - RNA, 32 nt, Human
auucauaagcauguaauuccagugacuuacua

SEQ ID NO: 338732 - RNA, 32 nt, Human
auucauaaggcaauucauacuggagaaaaacc

SEQ ID NO: 338733 - RNA, 32 nt, Human
auucauaaggcaauucauacuggagagaaacc

SEQ ID NO: 338734 - RNA, 32 nt, Human
auucauaaggcaauucauacuggagagaaucc

SEQ ID NO: 338735 - RNA, 32 nt, Human
auucauaauuauucagcucugcugcuaaacac

SEQ ID NO: 338736 - RNA, 32 nt, Human
auucauacacaugcaaucauacaugcacacug

SEQ ID NO: 338737 - RNA, 21 nt, Human
auucauacgggagagaagccu

SEQ ID NO: 338738 - RNA, 32 nt, Human
auucauagcuaggaaaugaaauucuuguaauu

SEQ ID NO: 338739 - RNA, 32 nt, Human
auucauaggcaguaauguuccucccaggguuu

SEQ ID NO: 338740 - RNA, 32 nt, Human
auucauaguauuaggaucuuuaugauuuauca

SEQ ID NO: 338741 - RNA, 32 nt, Human
auucauauauuuuugcucguuaguguauuucu

SEQ ID NO: 338742 - RNA, 32 nt, Human
auucauaugcugcugcugcugcagccaccaga

SEQ ID NO: 338743 - RNA, 32 nt, Human
auucauauugcuuaagaggcuuaacauuaccu

SEQ ID NO: 338744 - RNA, 32 nt, Human
auucauauuugcaaagacuacagacuuuuucu

SEQ ID NO: 338745 - RNA, 32 nt, Human
auucaucaacagaccaguuuuugugggcauau

SEQ ID NO: 338746 - RNA, 20 nt, Human
auucaucaacuaagaaccaa

SEQ ID NO: 338747 - RNA, 32 nt, Human
auucaucaccaaguccuuauuagaugagcacu

SEQ ID NO: 338748 - RNA, 32 nt, Human
auucaucacugcaucuccaacgccuagcacag

SEQ ID NO: 338749 - RNA, 32 nt, Human
auucaucagauccaguuuaugaggguuggggg

SEQ ID NO: 338750 - RNA, 32 nt, Human
auucaucaggacuuguauuagcagguucuggc

SEQ ID NO: 338751 - RNA, 21 nt, Human
auucaucagggcaggaagcag

SEQ ID NO: 338752 - RNA, 32 nt, Human
auucaucaugauauugucugugccuagugaau

SEQ ID NO: 338753 - RNA, 32 nt, Human
auucauccauauaugacuuaaaagccacccag

SEQ ID NO: 338754 - RNA, 32 nt, Human
auucauccaugcguccgccugccugccugcgc

SEQ ID NO: 338755 - RNA, 32 nt, Human
auucauccauuuuagagccaggaauucccaug

SEQ ID NO: 338756 - RNA, 32 nt, Human
auucaucccagaggaaccugaggccugaagga

SEQ ID NO: 338757 - RNA, 32 nt, Human
auucauccucuauccauccaucauccauccau

SEQ ID NO: 338758 - RNA, 32 nt, Human
auucauccucuggaaauauucucucucagcca

SEQ ID NO: 338759 - RNA, 32 nt, Human
auucauccugcacagggaaauggcuaccuauu

SEQ ID NO: 338760 - RNA, 32 nt, Human
auucauccuugcaaccccauucaccaggagcc

SEQ ID NO: 338761 - RNA, 32 nt, Human
auucauccuugccucugcccuucaggagcagc

SEQ ID NO: 338762 - RNA, 32 nt, Human
auucauccuuguuucccuugugggaucaggua

SEQ ID NO: 338763 - RNA, 32 nt, Human
auucaucuacccugcugaccucccagugaccc

SEQ ID NO: 338764 - RNA, 32 nt, Human
auucaucuaccugccaggccucaggcccagga

SEQ ID NO: 338765 - RNA, 32 nt, Human
auucaucuccacccccuucccccaccacuucu

SEQ ID NO: 338766 - RNA, 32 nt, Human
auucaucuccacccuucaugacugcccgcuga

SEQ ID NO: 338767 - RNA, 32 nt, Human
auucaucuccccuuuucagccauuucaacaaa

SEQ ID NO: 338768 - RNA, 32 nt, Human
auucaucuccuggaauuuccaugugaaucaca

SEQ ID NO: 338769 - RNA, 32 nt, Human
auucaucugaccccaucuccucauccuccccc

SEQ ID NO: 338770 - RNA, 32 nt, Human
auucaucugcccacccauccgucccuccgucu

SEQ ID NO: 338771 - RNA, 32 nt, Human
auucaucuggaaggagggaggcuuggaugagc

SEQ ID NO: 338772 - RNA, 32 nt, Human
auucaucuuccuggucccaaagccugguuggu

SEQ ID NO: 338773 - RNA, 32 nt, Human
auucaucuuuauucccuccaucaucuagacuu

SEQ ID NO: 338774 - RNA, 32 nt, Human
auucaugaagaaaagcagauagaaguggcuga

SEQ ID NO: 338775 - RNA, 32 nt, Human
auucaugaguuucuacuugagugagaaaacug

SEQ ID NO: 338776 - RNA, 32 nt, Human
auucaugcacuguagggcugggcgcagcaucc

SEQ ID NO: 338777 - RNA, 32 nt, Human
auucaugccuuacagaacaucagagaguucau

SEQ ID NO: 338778 - RNA, 32 nt, Human
auucaugccuuggaauuaaauauacauauaua

SEQ ID NO: 338779 - RNA, 32 nt, Human
auucaugcugugaugcgauuucaccuuauagu

SEQ ID NO: 338780 - RNA, 32 nt, Human
auucaugcuuacccugcugcucagcuuucuca

SEQ ID NO: 338781 - RNA, 31 nt, Human
auucauggaccaguagauuguugaaaguugg

SEQ ID NO: 338782 - RNA, 32 nt, Human
auucauggagaaauacacccucccacaacuga

SEQ ID NO: 338783 - RNA, 29 nt, Human
auucauggcugaaguggaggaucaggcag

SEQ ID NO: 338784 - RNA, 31 nt, Human
auucauguagagagagaaaaguaacuguuuu

SEQ ID NO: 338785 - RNA, 32 nt, Human
auucaugucagaccaagaauuuaaauuauuuu

SEQ ID NO: 338786 - RNA, 32 nt, Human
auucauguccuguaauacuucaccuccaggaa

SEQ ID NO: 338787 - RNA, 32 nt, Human
auucauguccuucuggggaggagggaggaccc

SEQ ID NO: 338788 - RNA, 32 nt, Human
auucaugucuucauuuugggaugcagcuaaua

SEQ ID NO: 338789 - RNA, 31 nt, Human
auucauguucaucaauaccugcugagaguac

SEQ ID NO: 338790 - RNA, 32 nt, Human
auucauguucugagaguucuucagcugcccug

SEQ ID NO: 338791 - RNA, 32 nt, Human
auucauguuugugagagaaggaaagaguaagu

SEQ ID NO: 338792 - RNA, 32 nt, Human
auucauguuuucucaagcuccagauuggcuag

SEQ ID NO: 338793 - RNA, 32 nt, Human
auucauuaaccaccaaaccucuaccucuucuc

SEQ ID NO: 338794 - RNA, 32 nt, Human
auucauuaaggaaccagcugcggaggaaggug

SEQ ID NO: 338795 - RNA, 32 nt, Human
auucauuaguaaaaugaguuaccaagauccuc

SEQ ID NO: 338796 - RNA, 32 nt, Human
auucauuaguaagcagcaaucuuccagaagug

SEQ ID NO: 338797 - RNA, 32 nt, Human
auucauuaucugaaaugggcucagcugcuucu

SEQ ID NO: 338798 - RNA, 32 nt, Human
auucauuauggugaacccuucuugucugcuau

SEQ ID NO: 338799 - RNA, 32 nt, Human
auucauuauucuaguccugcuuuaguccuuug

SEQ ID NO: 338800 - RNA, 32 nt, Human
auucauucaaccuaauuaucugugauaugaga

SEQ ID NO: 338801 - RNA, 32 nt, Human
auucauucauuauucuaguccugcuuuagucc

SEQ ID NO: 338802 - RNA, 32 nt, Human
auucauucauucuuucauucauucgauaggua

SEQ ID NO: 338803 - RNA, 32 nt, Human
auucauuccagagaaaugaaaaccuauauugu

SEQ ID NO: 338804 - RNA, 32 nt, Human
auucauucucucugaacacacauugcuauucc

SEQ ID NO: 338805 - RNA, 32 nt, Human
auucauucucucuucuccaucacccauaccca

SEQ ID NO: 338806 - RNA, 32 nt, Human
auucauucuuagcuucuucaucuuugugugga

SEQ ID NO: 338807 - RNA, 32 nt, Human
auucauuguuucugcugggggcauuuuuaucu

SEQ ID NO: 338808 - RNA, 32 nt, Human
auucauuuaaggccuaaggaugaaggcgagaa

SEQ ID NO: 338809 - RNA, 32 nt, Human
auucauuucaacaaaauagugaauugauaauc

SEQ ID NO: 338810 - RNA, 32 nt, Human
auucauuucuguagcaugacagggauuucaau

SEQ ID NO: 338811 - RNA, 32 nt, Human
auucauuugaaggcucaucaacaacaaaaagu

SEQ ID NO: 338812 - RNA, 26 nt, Human
auucauuugaauaaaaaggaacuugg

SEQ ID NO: 338813 - RNA, 32 nt, Human
auucauuugcagcaaaauacuggcuuguuaau

SEQ ID NO: 338814 - RNA, 32 nt, Human
auucauuuuaaggcuucucugaauugugcuca

SEQ ID NO: 338815 - RNA, 32 nt, Human
auucauuuuaucaauguagcugugaaggccau

SEQ ID NO: 338816 - RNA, 32 nt, Human
auucauuuucucaguugaagaagagaaaauuu

SEQ ID NO: 338817 - RNA, 32 nt, Human
auucauuuucuuuggguuagagcuagagagaa

SEQ ID NO: 338818 - RNA, 32 nt, Human
auuccaaacauguaggaugggggucuuguccu

SEQ ID NO: 338819 - RNA, 18 nt, Human
auuccaaaguacuaaaca

SEQ ID NO: 338820 - RNA, 32 nt, Human
auuccaaagugcugggauuacaggugugagcc

SEQ ID NO: 338821 - RNA, 32 nt, Human
auuccaacacucuuaaaaaccccuacccccaa

SEQ ID NO: 338822 - RNA, 32 nt, Human
auuccaacccuccacagaugugcaguugguuc

SEQ ID NO: 338823 - RNA, 32 nt, Human
auuccaacucaggccuccaagggcugcaguuc

SEQ ID NO: 338824 - RNA, 32 nt, Human
auuccaacugccuccgaccccaaagggauucu

SEQ ID NO: 338825 - RNA, 32 nt, Human
auuccaagacucaagugucuucaaugagacuu

SEQ ID NO: 338826 - RNA, 32 nt, Human
auuccaagagaaggauaugcugagggaaaaug

SEQ ID NO: 338827 - RNA, 32 nt, Human
auuccaagcucgagagcuucagccucaggaaa

SEQ ID NO: 338828 - RNA, 32 nt, Human
auuccaagcuggcacugccacuguggagggcg

SEQ ID NO: 338829 - RNA, 32 nt, Human
auuccaagcugguccccucuguguaucacucu

SEQ ID NO: 338830 - RNA, 32 nt, Human
auuccaaggcauggccagcccagcuggagggc

SEQ ID NO: 338831 - RNA, 32 nt, Human
auuccaaggccaccccuucuccuuuuagucau

SEQ ID NO: 338832 - RNA, 32 nt, Human
auuccaagucaccacuucucucaccggcuucu

SEQ ID NO: 338833 - RNA, 32 nt, Human
auuccaagugaguccuggguggagaaagaaga

SEQ ID NO: 338834 - RNA, 32 nt, Human
auuccaaugcucuccucuuucucuggccacag

SEQ ID NO: 338835 - RNA, 32 nt, Human
auuccaauuaugaagccucuucccucaugacc

SEQ ID NO: 338836 - RNA, 32 nt, Human
auuccaauugcuuuuuggccuuuuggcuaaaa

SEQ ID NO: 338837 - RNA, 25 nt, Human
auuccaauuugaagauucauuugaa

SEQ ID NO: 338838 - RNA, 20 nt, Human
auuccacaaacgaacaaaca

SEQ ID NO: 338839 - RNA, 32 nt, Human
auuccacaaagaagaggaagaaguggaagauu

SEQ ID NO: 338840 - RNA, 32 nt, Human
auuccacacuagaccagcuuuguccacucagc

SEQ ID NO: 338841 - RNA, 18 nt, Human
auuccacagaaucuucaa

SEQ ID NO: 338842 - RNA, 32 nt, Human
auuccacagacacauauguuguguacauacgu

SEQ ID NO: 338843 - RNA, 32 nt, Human
auuccacagaugugggucagaggcagagaugg

SEQ ID NO: 338844 - RNA, 32 nt, Human
auuccacaggcuccugaguccccgaggccugg

SEQ ID NO: 338845 - RNA, 32 nt, Human
auuccacaugcaauucacucuggcgacccugu

SEQ ID NO: 338846 - RNA, 19 nt, Human
auuccaccagagucugcac

SEQ ID NO: 338847 - RNA, 32 nt, Human
auuccaccaggacucaucucccuuccuucuca

SEQ ID NO: 338848 - RNA, 32 nt, Human
auuccaccagggguauuucagcuuugaaacca

SEQ ID NO: 338849 - RNA, 32 nt, Human
auuccaccauugcacuccagucugggcaacag

SEQ ID NO: 338850 - RNA, 32 nt, Human
auuccacccaggaacuaaggcugcagcccacc

SEQ ID NO: 338851 - RNA, 32 nt, Human
auuccacccucugccugccugccugccugcug

SEQ ID NO: 338852 - RNA, 32 nt, Human
auuccaccuccaccuccaccucccccugccac

SEQ ID NO: 338853 - RNA, 32 nt, Human
auuccaccuccccucccaagugacccuccucc

SEQ ID NO: 338854 - RNA, 32 nt, Human
auuccacgaagaaaauccugauuccaagaugu

SEQ ID NO: 338855 - RNA, 32 nt, Human
auuccacucccaugaaacuuuggucauuguua

SEQ ID NO: 338856 - RNA, 32 nt, Human
auuccacugaaaccucuguucucaugaaggag

SEQ ID NO: 338857 - RNA, 32 nt, Human
auuccacugggccuaccuuccuuggggauguu

SEQ ID NO: 338858 - RNA, 32 nt, Human
auuccacugggucugcagcucacacauaggca

SEQ ID NO: 338859 - RNA, 32 nt, Human
auuccacuguuagacagcuacagggaaugauu

SEQ ID NO: 338860 - RNA, 32 nt, Human
auuccagaaugcugggaguuuuacagugccau

SEQ ID NO: 338861 - RNA, 32 nt, Human
auuccagacacacaccacucagaaaugugggc

SEQ ID NO: 338862 - RNA, 32 nt, Human
auuccagacuuugaugacuacacccaccccau

SEQ ID NO: 338863 - RNA, 32 nt, Human
auuccagagaugcacuccgcucuggaacucac

SEQ ID NO: 338864 - RNA, 32 nt, Human
auuccagaugcaugauccagcuguguguuuuc

SEQ ID NO: 338865 - RNA, 32 nt, Human
auuccagauggaaauagaauucucucucuugc

SEQ ID NO: 338866 - RNA, 32 nt, Human
auuccagcaauucuccugccucggcuucccaa

SEQ ID NO: 338867 - RNA, 32 nt, Human
auuccagcaccguuucuacaucugccaucuua

SEQ ID NO: 338868 - RNA, 20 nt, Human
auuccagcacuggaggaccc

SEQ ID NO: 338869 - RNA, 32 nt, Human
auuccagcacuggaggacccccugccacggcg

SEQ ID NO: 338870 - RNA, 32 nt, Human
auuccagcagccacccagaccaugcuccgccg

SEQ ID NO: 338871 - RNA, 32 nt, Human
auuccagccucauuguaacacacauucuacgc

SEQ ID NO: 338872 - RNA, 26 nt, Human
auuccagccugggugacagagcgaga

SEQ ID NO: 338873 - RNA, 26 nt, Human
auuccagccugggugacagagugaga

SEQ ID NO: 338874 - RNA, 32 nt, Human
auuccagcucacugcgcagccugggaggaggc

SEQ ID NO: 338875 - RNA, 32 nt, Human
auuccagcuuuucuucuacuagucugauguuu

SEQ ID NO: 338876 - RNA, 32 nt, Human
auuccaggaggcuuuucauauagaagaugagu

SEQ ID NO: 338877 - RNA, 32 nt, Human
auuccaggcaugagccacugcgcccagucuac

SEQ ID NO: 338878 - RNA, 32 nt, Human
auuccaggccagagacccaguccuuucaauua

SEQ ID NO: 338879 - RNA, 32 nt, Human
auuccaggcccuggcauaagcugaaucccaaa

SEQ ID NO: 338880 - RNA, 32 nt, Human
auuccaggccuccgcuucuccuggggcagcca

SEQ ID NO: 338881 - RNA, 32 nt, Human
auuccaggcgugagccacugcaccuggcggaa

SEQ ID NO: 338882 - RNA, 32 nt, Human
auuccaggcgugagccacugcgcccggccagc

SEQ ID NO: 338883 - RNA, 32 nt, Human
auuccaggcgugagccaucgugcccagcuaga

SEQ ID NO: 338884 - RNA, 32 nt, Human
auuccaggcuccucagcugcaggauggcuccu

SEQ ID NO: 338885 - RNA, 32 nt, Human
auuccagggaagaaacucuggagaagagcuaa

SEQ ID NO: 338886 - RNA, 32 nt, Human
auuccagggacccugccgcugccccucugagg

SEQ ID NO: 338887 - RNA, 32 nt, Human
auuccagggaggucaggaagagguaaaguaca

SEQ ID NO: 338888 - RNA, 32 nt, Human
auuccagggcacagucccuaaauuacugauca

SEQ ID NO: 338889 - RNA, 32 nt, Human
auuccagggcccagagcuggacagacaucaca

SEQ ID NO: 338890 - RNA, 32 nt, Human
auuccagggucacagccccaacagaagcagca

SEQ ID NO: 338891 - RNA, 32 nt, Human
auuccagggugaugccugcugaagccacgcag

SEQ ID NO: 338892 - RNA, 32 nt, Human
auuccagguaguucuggugcagguaaguggcc

SEQ ID NO: 338893 - RNA, 32 nt, Human
auuccaggugggagccacugcaccuggcucuu

SEQ ID NO: 338894 - RNA, 32 nt, Human
auuccaggugugagccacaucacaguauuacc

SEQ ID NO: 338895 - RNA, 32 nt, Human
auuccaggugugagccacuucacccagccaca

SEQ ID NO: 338896 - RNA, 32 nt, Human
auuccaggugugagcuacugugcccagcuaaa

SEQ ID NO: 338897 - RNA, 32 nt, Human
auuccagguguucccuggaaaggucaagugag

SEQ ID NO: 338898 - RNA, 32 nt, Human
auuccaguccuucccuuccucuccucacucug

SEQ ID NO: 338899 - RNA, 32 nt, Human
auuccagugcucucaaaaagcauguuuuucaa

SEQ ID NO: 338900 - RNA, 31 nt, Human
auuccaguugcuuucaucacagccugaaaau

SEQ ID NO: 338901 - RNA, 32 nt, Human
auuccaguuguuaggaagagaugaggaguugg

SEQ ID NO: 338902 - RNA, 32 nt, Human
auuccauaauuguaaagcgggcuguucuuauc

SEQ ID NO: 338903 - RNA, 32 nt, Human
auuccauacaaauaacucagcacacaagugac

SEQ ID NO: 338904 - RNA, 32 nt, Human
auuccauaggaagacacacauaugcacacaaa

SEQ ID NO: 338905 - RNA, 32 nt, Human
auuccauaggagagcugggggcaggagaaugg

SEQ ID NO: 338906 - RNA, 32 nt, Human
auuccauagguuggcagggcuuggggagcaag

SEQ ID NO: 338907 - RNA, 32 nt, Human
auuccauauuagggcaaugagacugaaacuac

SEQ ID NO: 338908 - RNA, 32 nt, Human
auuccauccacacaguuuccacccucaccugc

SEQ ID NO: 338909 - RNA, 32 nt, Human
auuccaucccaagagaggucugcgugacgcgu

SEQ ID NO: 338910 - RNA, 32 nt, Human
auuccaucccacauggcggcgcuccugaggag

SEQ ID NO: 338911 - RNA, 32 nt, Human
auuccauccccaguccagccugggcaacccca

SEQ ID NO: 338912 - RNA, 32 nt, Human
auuccaucucagaagagacuugacuuguggau

SEQ ID NO: 338913 - RNA, 32 nt, Human
auuccaucuuggaagagcacaaggugcaggug

SEQ ID NO: 338914 - RNA, 32 nt, Human
auuccaucuugguuacaaaugagacuccuuca

SEQ ID NO: 338915 - RNA, 32 nt, Human
auuccaucuuuuucagacaagugaacaauuua

SEQ ID NO: 338916 - RNA, 32 nt, Human
auuccaugaacccaggaugcggagguugcagu

SEQ ID NO: 338917 - RNA, 32 nt, Human
auuccaugaaguauuguuuccuuuauuuaaaa

SEQ ID NO: 338918 - RNA, 32 nt, Human
auuccaugaugcauauuacuggauuagauuaa

SEQ ID NO: 338919 - RNA, 29 nt, Human
auuccauggcugcuguuuucuccucugua

SEQ ID NO: 338920 - RNA, 32 nt, Human
auuccauggcugggagucacugaugcugccuc

SEQ ID NO: 338921 - RNA, 29 nt, Human
auuccaugugugccugugccuggggcaug

SEQ ID NO: 338922 - RNA, 32 nt, Human
auuccauguguuagauggaagcauuuccuauc

SEQ ID NO: 338923 - RNA, 32 nt, Human
auuccauguuuucuucccaucugccuuauaua

SEQ ID NO: 338924 - RNA, 32 nt, Human
auuccauuacacuccagccugggcaccaggaa

SEQ ID NO: 338925 - RNA, 32 nt, Human
auuccauuagauaguacauuucucaaagauuu

SEQ ID NO: 338926 - RNA, 23 nt, Human
auuccauucccuccagccucagc

SEQ ID NO: 338927 - RNA, 23 nt, Human
auuccauucccuucggccaaaca

SEQ ID NO: 338928 - RNA, 32 nt, Human
auuccauugcugcaaugaaugugaaaaagcca

SEQ ID NO: 338929 - RNA, 32 nt, Human
auuccauuguaaaguuguacagaaaguuauag

SEQ ID NO: 338930 - RNA, 32 nt, Human
auucccaaaagcuuccuuucaaaccacgauuu

SEQ ID NO: 338931 - RNA, 32 nt, Human
auucccaacugcucugcccacugugaaaccac

SEQ ID NO: 338932 - RNA, 32 nt, Human
auucccaagcaugccagcuucugugcccaugg

SEQ ID NO: 338933 - RNA, 32 nt, Human
auucccaagccgcggggcggcuccgguggugc

SEQ ID NO: 338934 - RNA, 32 nt, Human
auucccaagcuggucuugaaaucuugggcuca

SEQ ID NO: 338935 - RNA, 32 nt, Human
auucccaaucacuggucaucugacccuacuug

SEQ ID NO: 338936 - RNA, 32 nt, Human
auucccacagcugggagccagcaagagagcuu

SEQ ID NO: 338937 - RNA, 32 nt, Human
auucccacaguaauauagacugugcauggugu

SEQ ID NO: 338938 - RNA, 23 nt, Human
auucccacaucuacaucagugaa

SEQ ID NO: 338939 - RNA, 32 nt, Human
auucccacaugccgugacucuggacuauauca

SEQ ID NO: 338940 - RNA, 32 nt, Human
auucccaccagcugcaggcugucaggguauca

SEQ ID NO: 338941 - RNA, 32 nt, Human
auucccaccauccugugaacuuuguuguacuu

SEQ ID NO: 338942 - RNA, 32 nt, Human
auucccacccacgacucacaggcauuccuccc

SEQ ID NO: 338943 - RNA, 32 nt, Human
auucccaccugccacaguucacaugccacaaa

SEQ ID NO: 338944 - RNA, 32 nt, Human
auucccaccuucacccugucauggucucaggg

SEQ ID NO: 338945 - RNA, 32 nt, Human
auucccacuccccuccucucagccucccugau

SEQ ID NO: 338946 - RNA, 32 nt, Human
auucccacuccuggcauuuucuggcagguuua

SEQ ID NO: 338947 - RNA, 32 nt, Human
auucccacugcacuuggugcugcuuuggcuga

SEQ ID NO: 338948 - RNA, 32 nt, Human
auucccacuggagagacuugugcucaaggaau

SEQ ID NO: 338949 - RNA, 32 nt, Human
auucccagaccccagcccuuugugcucacccu

SEQ ID NO: 338950 - RNA, 32 nt, Human
auucccagcagaggcuucaggugcuuugugua

SEQ ID NO: 338951 - RNA, 32 nt, Human
auucccagcccagcugcgugguggugacugga

SEQ ID NO: 338952 - RNA, 32 nt, Human
auucccagcccugaggcccaccccagaggcug

SEQ ID NO: 338953 - RNA, 32 nt, Human
auucccagcuacucagaggcugaggcaggaaa

SEQ ID NO: 338954 - RNA, 32 nt, Human
auucccagcuacucaggagguugaggugggag

SEQ ID NO: 338955 - RNA, 32 nt, Human
auucccagcuacucaugaggcugaggcaggag

SEQ ID NO: 338956 - RNA, 32 nt, Human
auucccagcuacucgggaggcugaggcaggag

SEQ ID NO: 338957 - RNA, 32 nt, Human
auucccagcuacucuggaggcugaggcggagg

SEQ ID NO: 338958 - RNA, 32 nt, Human
auucccagcuacuggggaggcugaggcaggag

SEQ ID NO: 338959 - RNA, 32 nt, Human
auucccagcuacuuggaaggcugagacaggag

SEQ ID NO: 338960 - RNA, 32 nt, Human
auucccagcuacuugggaggcugaggcaggaa

SEQ ID NO: 338961 - RNA, 32 nt, Human
auucccagcuacuugggaggcugaggcaggag

SEQ ID NO: 338962 - RNA, 32 nt, Human
auucccagcuacuugggagguugagggaggag

SEQ ID NO: 338963 - RNA, 32 nt, Human
auucccagcucugaccagacuugcugugugac

SEQ ID NO: 338964 - RNA, 32 nt, Human
auucccagcuucucgggaggcugaggcaggag

SEQ ID NO: 338965 - RNA, 32 nt, Human
auucccaggagaagagggaacaaccaauucau

SEQ ID NO: 338966 - RNA, 32 nt, Human
auucccaggccaggcugucgcuggccauccau

SEQ ID NO: 338967 - RNA, 32 nt, Human
auucccaggcuggagugcaaugucgugaucuu

SEQ ID NO: 338968 - RNA, 32 nt, Human
auucccaggcugggugcaguggcucacgccug

SEQ ID NO: 338969 - RNA, 32 nt, Human
auucccaggcuggucugagcuccggggccgug

SEQ ID NO: 338970 - RNA, 32 nt, Human
auucccaguccccagcuggggcuuggugugag

SEQ ID NO: 338971 - RNA, 32 nt, Human
auucccagucuacaaaaccccacagcuccuag

SEQ ID NO: 338972 - RNA, 32 nt, Human
auucccagugccccuggcuaggggcagagggc

SEQ ID NO: 338973 - RNA, 32 nt, Human
auucccauccccaaaagucaccagcguguggc

SEQ ID NO: 338974 - RNA, 32 nt, Human
auucccaucuacucgggaggcuuaggcaggau

SEQ ID NO: 338975 - RNA, 32 nt, Human
auucccaucuuugucucuagccuggagaagag

SEQ ID NO: 338976 - RNA, 32 nt, Human
auucccaugaacauccggggccugguguuguc

SEQ ID NO: 338977 - RNA, 32 nt, Human
auucccaugagagggcugaggucugggggcuu

SEQ ID NO: 338978 - RNA, 32 nt, Human
auucccauucgacgggcaaccagucaaugaaa

SEQ ID NO: 338979 - RNA, 21 nt, Human
auuccccaagccccuaauuca

SEQ ID NO: 338980 - RNA, 32 nt, Human
auuccccaccugcuucccagcuucacaauaaa

SEQ ID NO: 338981 - RNA, 32 nt, Human
auuccccacucacuuugugugcucuuaaccuu

SEQ ID NO: 338982 - RNA, 22 nt, Human
auuccccacuuuugcuaugcua

SEQ ID NO: 338983 - RNA, 20 nt, Human
auuccccagauccucuuagg

SEQ ID NO: 338984 - RNA, 32 nt, Human
auuccccagcuacuuggaaggcugagauggga

SEQ ID NO: 338985 - RNA, 20 nt, Human
auuccccagucacgaaaggg

SEQ ID NO: 338986 - RNA, 31 nt, Human
auuccccaguuucagugcguugcccacuuca

SEQ ID NO: 338987 - RNA, 22 nt, Human
auuccccaucgauggcaccuuc

SEQ ID NO: 338988 - RNA, 32 nt, Human
auucccccaagaggagugucuggaaggaucug

SEQ ID NO: 338989 - RNA, 32 nt, Human
auucccccagccccugggcaacuaucuacuuu

SEQ ID NO: 338990 - RNA, 32 nt, Human
auucccccuuuauuuuccuuuuugcccaauaa

SEQ ID NO: 338991 - RNA, 32 nt, Human
auuccccgagcacuccagccuggcagucagca

SEQ ID NO: 338992 - RNA, 32 nt, Human
auuccccgugugucugugcugcagccugccug

SEQ ID NO: 338993 - RNA, 32 nt, Human
auuccccuaaaccaccuccuguguuccugcuu

SEQ ID NO: 338994 - RNA, 32 nt, Human
auuccccuacaagggcccuguugugaggaguc

SEQ ID NO: 338995 - RNA, 25 nt, Human
auuccccuacccuucccuccucugu

SEQ ID NO: 338996 - RNA, 32 nt, Human
auuccccucacugcacuuuggaccccuggggc

SEQ ID NO: 338997 - RNA, 32 nt, Human
auuccccuccucacgccagccuaggagaagaa

SEQ ID NO: 338998 - RNA, 32 nt, Human
auuccccugaauauuuuugcauucauauuuuu

SEQ ID NO: 338999 - RNA, 32 nt, Human
auuccccugcucccccugucccuuccccaucc

SEQ ID NO: 339000 - RNA, 32 nt, Human
auuccccuucuagaacauguagacacuugaga

SEQ ID NO: 339001 - RNA, 32 nt, Human
auucccgaggaggccugagcagcuggacacgc

SEQ ID NO: 339002 - RNA, 32 nt, Human
auucccgaguagcugggauuacagaugugcac

SEQ ID NO: 339003 - RNA, 32 nt, Human
auucccgccagucugcccagcugcaguacuca

SEQ ID NO: 339004 - RNA, 32 nt, Human
auucccggccacucgggaggcugaggcaggag

SEQ ID NO: 339005 - RNA, 32 nt, Human
auucccggcgugagccaccgcgcccagcccuc

SEQ ID NO: 339006 - RNA, 32 nt, Human
auucccgggauucauuccucagccucugcuuc

SEQ ID NO: 339007 - RNA, 32 nt, Human
auucccgguucaauaaauggugcugggauaac

SEQ ID NO: 339008 - RNA, 32 nt, Human
auucccuaacugcuuccugaaagcuggaaaag

SEQ ID NO: 339009 - RNA, 32 nt, Human
auucccuaauuacagugaaauucuaucuugca

SEQ ID NO: 339010 - RNA, 32 nt, Human
auucccuacaaagccuccucugcaugccaguu

SEQ ID NO: 339011 - RNA, 32 nt, Human
auucccuaccuggcccccuccaccucccuagc

SEQ ID NO: 339012 - RNA, 22 nt, Human
auucccuagacaccuccggggu

SEQ ID NO: 339013 - RNA, 24 nt, Human
auucccuaggcguauuuuuguggu

SEQ ID NO: 339014 - RNA, 23 nt, Human
auucccuauuuaauaaauggugc

SEQ ID NO: 339015 - RNA, 32 nt, Human
auucccucaaagcaauaucagguaaaccaagu

SEQ ID NO: 339016 - RNA, 32 nt, Human
auucccucaaaucccuccucuuacuccaugcu

SEQ ID NO: 339017 - RNA, 32 nt, Human
auucccucaagugcccugaggagcauuugcaa

SEQ ID NO: 339018 - RNA, 32 nt, Human
auucccucacuacccccaggagauauucacug

SEQ ID NO: 339019 - RNA, 32 nt, Human
auucccucacuggcuguguauuuauugagugg

SEQ ID NO: 339020 - RNA, 32 nt, Human
auucccucauuuccuucaagucugcucaaaug

SEQ ID NO: 339021 - RNA, 32 nt, Human
auucccuccaggcuugggcagggagacucgca

SEQ ID NO: 339022 - RNA, 21 nt, Human
auucccucccaagaagucagu

SEQ ID NO: 339023 - RNA, 32 nt, Human
auucccuccuccacuccucccuuggucuggcc

SEQ ID NO: 339024 - RNA, 32 nt, Human
auucccuccucugaaaugcaccccuuuguaau

SEQ ID NO: 339025 - RNA, 32 nt, Human
auucccucuccucuuggcucauaggucaaugg

SEQ ID NO: 339026 - RNA, 32 nt, Human
auucccucuccuggucucugggucuggcuucc

SEQ ID NO: 339027 - RNA, 32 nt, Human
auucccucuggcccagcuucccagugcucaca

SEQ ID NO: 339028 - RNA, 32 nt, Human
auucccucuuccaggcccuugucuccccaguu

SEQ ID NO: 339029 - RNA, 32 nt, Human
auucccugagguauggcuuggucacucucagg

SEQ ID NO: 339030 - RNA, 21 nt, Human
auucccugauuuaauaugcaa

SEQ ID NO: 339031 - RNA, 32 nt, Human
auucccugcccagccgaccaaaugaccucugc

SEQ ID NO: 339032 - RNA, 32 nt, Human
auucccuggauaguguagugguagauuucucc

SEQ ID NO: 339033 - RNA, 32 nt, Human
auucccugggcaacacuggucaggcauucauu

SEQ ID NO: 339034 - RNA, 32 nt, Human
auucccuggugaggacagccagaggagcugcg

SEQ ID NO: 339035 - RNA, 32 nt, Human
auucccuguccuggcccccuucagcaacccug

SEQ ID NO: 339036 - RNA, 32 nt, Human
auucccugugaccuaguuggugcaguggcuug

SEQ ID NO: 339037 - RNA, 32 nt, Human
auucccuguggauuuuuaaaacagauauuauu

SEQ ID NO: 339038 - RNA, 32 nt, Human
auucccuuccaucucccuccccucugccuuuu

SEQ ID NO: 339039 - RNA, 32 nt, Human
auucccuucggccaaacagacagguggaaaaa

SEQ ID NO: 339040 - RNA, 32 nt, Human
auucccuucucccauuccuugucugccauucu

SEQ ID NO: 339041 - RNA, 32 nt, Human
auucccuucuccuauccuccugccucccuauc

SEQ ID NO: 339042 - RNA, 32 nt, Human
auucccuucucuucaacgguuucaguacauau

SEQ ID NO: 339043 - RNA, 32 nt, Human
auuccgacagcaggacauacauguugguguga

SEQ ID NO: 339044 - RNA, 32 nt, Human
auuccgagagccugagacugacgcccgaccug

SEQ ID NO: 339045 - RNA, 32 nt, Human
auuccgcacgggccuacuguaggaccauuguc

SEQ ID NO: 339046 - RNA, 32 nt, Human
auuccgccccuuggaaccuggccaugcaaagc

SEQ ID NO: 339047 - RNA, 20 nt, Human
auuccgcgccgccgccgccg

SEQ ID NO: 339048 - RNA, 32 nt, Human
auuccggacacacaaccggccaugugacaggc

SEQ ID NO: 339049 - RNA, 32 nt, Human
auuccggaggaaaccuguuugacuugaguaga

SEQ ID NO: 339050 - RNA, 32 nt, Human
auuccgguccuuucuccuccccuagcugggga

SEQ ID NO: 339051 - RNA, 32 nt, Human
auuccguaugauagauggggccuggacaccca

SEQ ID NO: 339052 - RNA, 32 nt, Human
auuccgucuccugcucuggacuugcccucucc

SEQ ID NO: 339053 - RNA, 32 nt, Human
auuccgugcugucuggcaggaagcuccaucuc

SEQ ID NO: 339054 - RNA, 32 nt, Human
auuccguggaggagcuugaagagauggauagu

SEQ ID NO: 339055 - RNA, 22 nt, Human
auuccguggcaacuagauauca

SEQ ID NO: 339056 - RNA, 32 nt, Human
auuccguggucaaaauucuuccucacuauaau

SEQ ID NO: 339057 - RNA, 32 nt, Human
auuccuacuaucuguguucccuuagauacucc

SEQ ID NO: 339058 - RNA, 32 nt, Human
auuccuacuuucugaaucaacagugccuguua

SEQ ID NO: 339059 - RNA, 32 nt, Human
auuccuagaguuaagagaaccuuaaaagauua

SEQ ID NO: 339060 - RNA, 32 nt, Human
auuccuagcaucugcuaucaaacugugccuua

SEQ ID NO: 339061 - RNA, 31 nt, Human
auuccuaggcccuuucugccugugucagggc

SEQ ID NO: 339062 - RNA, 32 nt, Human
auuccuaguaacuagagaaaagacuuauuuau

SEQ ID NO: 339063 - RNA, 32 nt, Human
auuccuaucauucagaucuuccuuccucccaa

SEQ ID NO: 339064 - RNA, 32 nt, Human
auuccuaucuucuuccucaaaaucuggugacc

SEQ ID NO: 339065 - RNA, 32 nt, Human
auuccuauguguuucuuuggccuguguaucag

SEQ ID NO: 339066 - RNA, 32 nt, Human
auuccucaacucccagugugcccaugaguaag

SEQ ID NO: 339067 - RNA, 32 nt, Human
auuccucaccccaccugugaacuccuaccaga

SEQ ID NO: 339068 - RNA, 32 nt, Human
auuccucacuccauccagccucuugacaagca

SEQ ID NO: 339069 - RNA, 31 nt, Human
auuccucacugcuagaaugagaccagagguc

SEQ ID NO: 339070 - RNA, 32 nt, Human
auuccucagacuccaugagucuugcugccagg

SEQ ID NO: 339071 - RNA, 32 nt, Human
auuccucaggggccuguggcuggagaaaaggu

SEQ ID NO: 339072 - RNA, 32 nt, Human
auuccucagucagccaaaagcuuuucaaagag

SEQ ID NO: 339073 - RNA, 32 nt, Human
auuccucagugucgccucugagcccaggccuc

SEQ ID NO: 339074 - RNA, 31 nt, Human
auuccucaguuucaccaccucccucuuccag

SEQ ID NO: 339075 - RNA, 32 nt, Human
auuccucaucaacuuagaagguggugauauuc

SEQ ID NO: 339076 - RNA, 32 nt, Human
auuccucaucucccacccuugaucucaucacc

SEQ ID NO: 339077 - RNA, 32 nt, Human
auuccucaugcuguauguuuagauuugugauu

SEQ ID NO: 339078 - RNA, 32 nt, Human
auuccucauucuguggauguuucuaugagcca

SEQ ID NO: 339079 - RNA, 32 nt, Human
auuccuccaaaccaaauacagcaccuacugug

SEQ ID NO: 339080 - RNA, 32 nt, Human
auuccuccccacccacccauguuuuuaaacua

SEQ ID NO: 339081 - RNA, 32 nt, Human
auuccuccccauucacccaccuugccaggugc

SEQ ID NO: 339082 - RNA, 32 nt, Human
auuccucccuccugccacaaauuccccaaaaa

SEQ ID NO: 339083 - RNA, 32 nt, Human
auuccucccuuucucagucuaccuacucuuug

SEQ ID NO: 339084 - RNA, 32 nt, Human
auuccucccuuucucucuguuucuguuccucu

SEQ ID NO: 339085 - RNA, 32 nt, Human
auuccuccggucagcaauuucuugccucccuu

SEQ ID NO: 339086 - RNA, 32 nt, Human
auuccuccuaaggagcuggugucuucauccag

SEQ ID NO: 339087 - RNA, 32 nt, Human
auuccuccucaaggcaccaguguggagggcau

SEQ ID NO: 339088 - RNA, 32 nt, Human
auuccuccuccccugggccucucucccuuucu

SEQ ID NO: 339089 - RNA, 32 nt, Human
auuccuccugcuccaaacuuugcccauccucu

SEQ ID NO: 339090 - RNA, 32 nt, Human
auuccuccuuuuucucuguuucucucucuguu

SEQ ID NO: 339091 - RNA, 32 nt, Human
auuccucgucacagcaaaaacacuuuccuuuc

SEQ ID NO: 339092 - RNA, 24 nt, Human
auuccucucagugacccucagggu

SEQ ID NO: 339093 - RNA, 32 nt, Human
auuccucucaugggagaaacaaggaggcaguc

SEQ ID NO: 339094 - RNA, 32 nt, Human
auuccucuccaauuucugucuucuuuccacuu

SEQ ID NO: 339095 - RNA, 32 nt, Human
auuccucuccuccuccuccuccuggguccccc

SEQ ID NO: 339096 - RNA, 32 nt, Human
auuccucugcccucuugagccagcacaggaag

SEQ ID NO: 339097 - RNA, 32 nt, Human
auuccucugcuccauuccugccccucucugcc

SEQ ID NO: 339098 - RNA, 32 nt, Human
auuccucugggaaaaaugaaacauaaaauuuc

SEQ ID NO: 339099 - RNA, 32 nt, Human
auuccucugggcagcagcuccaacacaugggg

SEQ ID NO: 339100 - RNA, 32 nt, Human
auuccucugucugauccuuuggucuuugcuac

SEQ ID NO: 339101 - RNA, 32 nt, Human
auuccucuuacuuuauccuuuuuccuuaagua

SEQ ID NO: 339102 - RNA, 32 nt, Human
auuccucuucaaagauuuuagccuguaaaaau

SEQ ID NO: 339103 - RNA, 32 nt, Human
auuccucuucccaaucagccucuacccauucu

SEQ ID NO: 339104 - RNA, 32 nt, Human
auuccucuuucucugcuggagcugggauauuc

SEQ ID NO: 339105 - RNA, 32 nt, Human
auuccugaccucaggugauccaccugcuucgg

SEQ ID NO: 339106 - RNA, 32 nt, Human
auuccugacuaguuuugcacacuugaaaauug

SEQ ID NO: 339107 - RNA, 32 nt, Human
auuccugagacaggaguuacagucccuuuugg

SEQ ID NO: 339108 - RNA, 32 nt, Human
auuccugagauggggccaccuggggcccacag

SEQ ID NO: 339109 - RNA, 32 nt, Human
auuccugagccagagccuuccugguuuguaag

SEQ ID NO: 339110 - RNA, 32 nt, Human
auuccugaugaccgguuucauuuauucaugua

SEQ ID NO: 339111 - RNA, 32 nt, Human
auuccugauguuggggaagggacauggaggga

SEQ ID NO: 339112 - RNA, 32 nt, Human
auuccugcaacuugaccuucaggcugggagag

SEQ ID NO: 339113 - RNA, 32 nt, Human
auuccugcacucugccguguccacacugcccc

SEQ ID NO: 339114 - RNA, 32 nt, Human
auuccugcagagaagagcagggguggccagga

SEQ ID NO: 339115 - RNA, 32 nt, Human
auuccugcagagccauggucccaggcuuccca

SEQ ID NO: 339116 - RNA, 32 nt, Human
auuccugcagagccugcagcccaggacgacug

SEQ ID NO: 339117 - RNA, 32 nt, Human
auuccugcagcccuccagacuuccugcccuua

SEQ ID NO: 339118 - RNA, 32 nt, Human
auuccugccagacuuccaguacuguccucgac

SEQ ID NO: 339119 - RNA, 31 nt, Human
auuccugcccucucugagucucaguuuuucc

SEQ ID NO: 339120 - RNA, 32 nt, Human
auuccugcccugcccaauuuugcagggagcau

SEQ ID NO: 339121 - RNA, 32 nt, Human
auuccugccucgccacuguccugcugcccucc

SEQ ID NO: 339122 - RNA, 32 nt, Human
auuccugccuuggagaaaauacuucaaccaga

SEQ ID NO: 339123 - RNA, 32 nt, Human
auuccugcgcccccagcguggaaaggcuucca

SEQ ID NO: 339124 - RNA, 32 nt, Human
auuccugcugcagacaucaauagcuuaucuau

SEQ ID NO: 339125 - RNA, 32 nt, Human
auuccugcuucucaagggacacaguggccugc

SEQ ID NO: 339126 - RNA, 32 nt, Human
auuccugcuugccugccugccugccaauggcc

SEQ ID NO: 339127 - RNA, 32 nt, Human
auuccuggagucaguggauacaaguagugcag

SEQ ID NO: 339128 - RNA, 32 nt, Human
auuccuggccugcccuccuccuccaggcagcc

SEQ ID NO: 339129 - RNA, 32 nt, Human
auuccugggccggcaccauuucccaggaggac

SEQ ID NO: 339130 - RNA, 32 nt, Human
auuccugggccuggcccagguggcuguuuccc

SEQ ID NO: 339131 - RNA, 32 nt, Human
auuccuggggccagggcagagcuugagguguu

SEQ ID NO: 339132 - RNA, 32 nt, Human
auuccugggggcugagacuacaguggccaggu

SEQ ID NO: 339133 - RNA, 32 nt, Human
auuccugggguuuaauuguugugcaguuucau

SEQ ID NO: 339134 - RNA, 32 nt, Human
auuccugguccucaguguuggccaagggaucc

SEQ ID NO: 339135 - RNA, 32 nt, Human
auuccuggucucaagcaguccucccaccucag

SEQ ID NO: 339136 - RNA, 32 nt, Human
auuccuggugaagcaaaggagaggaggauggg

SEQ ID NO: 339137 - RNA, 32 nt, Human
auuccuguaaaugugacaaaauuuuaggauuu

SEQ ID NO: 339138 - RNA, 32 nt, Human
auuccuguaaggaaaauccgggcagauggagg

SEQ ID NO: 339139 - RNA, 32 nt, Human
auuccugucaaugacugggaugacaugaggaa

SEQ ID NO: 339140 - RNA, 32 nt, Human
auuccugucccaagcuaccucuaccaacccuc

SEQ ID NO: 339141 - RNA, 32 nt, Human
auuccugugaaccucuagaggauuugcgccug

SEQ ID NO: 339142 - RNA, 32 nt, Human
auuccuguugcugucuucagucucacagagaa

SEQ ID NO: 339143 - RNA, 32 nt, Human
auuccuguuguacauggggaggaagcaggucu

SEQ ID NO: 339144 - RNA, 32 nt, Human
auuccuuaacuccuuuuugauucauguuugua

SEQ ID NO: 339145 - RNA, 32 nt, Human
auuccuuacuaccgcuaacuccagucauaaac

SEQ ID NO: 339146 - RNA, 32 nt, Human
auuccuuacuaggcuuccaaagccacugcugu

SEQ ID NO: 339147 - RNA, 32 nt, Human
auuccuuacugcccagguucugucuaggaagg

SEQ ID NO: 339148 - RNA, 32 nt, Human
auuccuuagggcagugccucuagcuguguccu

SEQ ID NO: 339149 - RNA, 20 nt, Human
auuccuuagguucucagggu

SEQ ID NO: 339150 - RNA, 21 nt, Human
auuccuuagucuagcauaucc

SEQ ID NO: 339151 - RNA, 32 nt, Human
auuccuuauaaaggugauacuggagaauguga

SEQ ID NO: 339152 - RNA, 32 nt, Human
auuccuucacauaguuugauaaaaagaucaau

SEQ ID NO: 339153 - RNA, 32 nt, Human
auuccuucaggauacaaucagugagaaauaaa

SEQ ID NO: 339154 - RNA, 32 nt, Human
auuccuucaggauagagccaggaugggcccag

SEQ ID NO: 339155 - RNA, 32 nt, Human
auuccuucaggucuggaggcagaggaaugggc

SEQ ID NO: 339156 - RNA, 32 nt, Human
auuccuucauuaguggaagugucccgucuaca

SEQ ID NO: 339157 - RNA, 32 nt, Human
auuccuuccauccucuuuauuuccugaggucc

SEQ ID NO: 339158 - RNA, 32 nt, Human
auuccuucccauaggaacuguaagcucaaaaa

SEQ ID NO: 339159 - RNA, 32 nt, Human
auuccuuccuuuagaaaaacugaagauuaccc

SEQ ID NO: 339160 - RNA, 32 nt, Human
auuccuucuagcucccccugggggcugagccu

SEQ ID NO: 339161 - RNA, 32 nt, Human
auuccuucuccaccucaaccaccagcauugau

SEQ ID NO: 339162 - RNA, 32 nt, Human
auuccuucuggccucugcugaaugcagggaau

SEQ ID NO: 339163 - RNA, 32 nt, Human
auuccuucuggcuggucuuucuccuugacaca

SEQ ID NO: 339164 - RNA, 23 nt, Human
auuccuucuucauucuuugcaaa

SEQ ID NO: 339165 - RNA, 32 nt, Human
auuccuucuuuacugcuuuuucaucaagugaa

SEQ ID NO: 339166 - RNA, 32 nt, Human
auuccuugaacccaggagguggagguugcagu

SEQ ID NO: 339167 - RNA, 32 nt, Human
auuccuugaucauccaaagcaccugcagaguc

SEQ ID NO: 339168 - RNA, 32 nt, Human
auuccuugcacugugcuggugaucaaguuugu

SEQ ID NO: 339169 - RNA, 32 nt, Human
auuccuugccagggaggaaggggagggaacag

SEQ ID NO: 339170 - RNA, 32 nt, Human
auuccuugcucaccuauuccuuucucucucca

SEQ ID NO: 339171 - RNA, 32 nt, Human
auuccuuggagccacugggauucauggcuuug

SEQ ID NO: 339172 - RNA, 32 nt, Human
auuccuuggcaggggaacaggaaauguggucg

SEQ ID NO: 339173 - RNA, 32 nt, Human
auuccuuggguuugcauccaucagaagaucca

SEQ ID NO: 339174 - RNA, 32 nt, Human
auuccuuggucugcgugcuuguuuucuccuuu

SEQ ID NO: 339175 - RNA, 32 nt, Human
auuccuuguguagaaaugauucccagucuagu

SEQ ID NO: 339176 - RNA, 22 nt, Human
auuccuuuaauguagcauccuu

SEQ ID NO: 339177 - RNA, 32 nt, Human
auuccuuuauuuuuauaaauuauucccccuau

SEQ ID NO: 339178 - RNA, 32 nt, Human
auuccuuucucauuggagccuagugaaaccaa

SEQ ID NO: 339179 - RNA, 32 nt, Human
auuccuuucuucugccucuguuuccugaggaa

SEQ ID NO: 339180 - RNA, 32 nt, Human
auuccuuugcauccauugcauuucucaggaag

SEQ ID NO: 339181 - RNA, 32 nt, Human
auuccuuugucaagacuuuggaagcagacaaa

SEQ ID NO: 339182 - RNA, 21 nt, Human
auuccuuugucuacagcaucc

SEQ ID NO: 339183 - RNA, 32 nt, Human
auuccuuuucuccaaacucuuuaaccacaaga

SEQ ID NO: 339184 - RNA, 32 nt, Human
auuccuuuuuacugcugacuaauagucugcug

SEQ ID NO: 339185 - RNA, 31 nt, Human
auucgaagagggagagaaacuggacuggaac

SEQ ID NO: 339186 - RNA, 32 nt, Human
auucgacaaacaugaggagaaacacagcaaac

SEQ ID NO: 339187 - RNA, 32 nt, Human
auucgacaucacggugaugauccgggagaaga

SEQ ID NO: 339188 - RNA, 32 nt, Human
auucgacuacuucaacuuacuuucaacuacau

SEQ ID NO: 339189 - RNA, 32 nt, Human
auucgagaagcaaagaucuguucuccauauug

SEQ ID NO: 339190 - RNA, 32 nt, Human
auucgagaagugagagagggucgggggcggug

SEQ ID NO: 339191 - RNA, 32 nt, Human
auucgagaccagccuaggugacauagugagac

SEQ ID NO: 339192 - RNA, 32 nt, Human
auucgagaccagccuggcaacauggcaagacc

SEQ ID NO: 339193 - RNA, 32 nt, Human
auucgagaccagccuggccaacauggugaaac

SEQ ID NO: 339194 - RNA, 32 nt, Human
auucgagaccagccuggccagcauggugaaac

SEQ ID NO: 339195 - RNA, 32 nt, Human
auucgagaccagccugggcaacauagugagac

SEQ ID NO: 339196 - RNA, 32 nt, Human
auucgagaccagccugggccacaugacaaagc

SEQ ID NO: 339197 - RNA, 32 nt, Human
auucgagaccagccugggcuacauagugagac

SEQ ID NO: 339198 - RNA, 32 nt, Human
auucgauggcaugcagcugcgugaccuaaggc

SEQ ID NO: 339199 - RNA, 32 nt, Human
auucgcaacauguuuucuacccugccaccucu

SEQ ID NO: 339200 - RNA, 32 nt, Human
auucgcaccagccaccacccacucccaccccc

SEQ ID NO: 339201 - RNA, 32 nt, Human
auucgcacguuauuugccauguaaaugaaaac

SEQ ID NO: 339202 - RNA, 32 nt, Human
auucgcacuuggcgcugggcccuuccccuccc

SEQ ID NO: 339203 - RNA, 32 nt, Human
auucgcagagggaaaggagcuggaauaaggac

SEQ ID NO: 339204 - RNA, 32 nt, Human
auucgcaggaaggggaguggggagcccugagc

SEQ ID NO: 339205 - RNA, 32 nt, Human
auucgccaggcagagcugagaagcgcaccagg

SEQ ID NO: 339206 - RNA, 32 nt, Human
auucgccgcagcggaccggccucggcgaauuu

SEQ ID NO: 339207 - RNA, 32 nt, Human
auucgccgcccgcuccgagccuggugcuuccg

SEQ ID NO: 339208 - RNA, 32 nt, Human
auucgcgaggcagagguugcagcgaacccaga

SEQ ID NO: 339209 - RNA, 32 nt, Human
auucgcucuuccuccagccucuggcaaccacu

SEQ ID NO: 339210 - RNA, 32 nt, Human
auucgcuggaaaugcaggcucaagccccuccc

SEQ ID NO: 339211 - RNA, 32 nt, Human
auucgcugugugacucagggcaagugugcgca

SEQ ID NO: 339212 - RNA, 32 nt, Human
auucgcuuuucacccaagaugauuugaugucu

SEQ ID NO: 339213 - RNA, 32 nt, Human
auucggagccugggguugucagagugaucggg

SEQ ID NO: 339214 - RNA, 32 nt, Human
auucggagcugcauuucccagcugggcacucu

SEQ ID NO: 339215 - RNA, 32 nt, Human
auucggagugaggagcacuuucagaguuacug

SEQ ID NO: 339216 - RNA, 32 nt, Human
auucggaucauagucaaagggcuguagcauua

SEQ ID NO: 339217 - RNA, 32 nt, Human
auucggcaccaaacacacagacugcuuugcau

SEQ ID NO: 339218 - RNA, 32 nt, Human
auucggcagugcauuccagccugcagaaaacc

SEQ ID NO: 339219 - RNA, 21 nt, Human
auucggccaccuccacgacca

SEQ ID NO: 339220 - RNA, 32 nt, Human
auucggcccuccugucccuagagacuaccaga

SEQ ID NO: 339221 - RNA, 32 nt, Human
auucggcuuggugaaauccuucucuaaagccu

SEQ ID NO: 339222 - RNA, 30 nt, Human
auucgggaaauccacagggacaguucaagu

SEQ ID NO: 339223 - RNA, 32 nt, Human
auucgggacacaauaccaacucuuucaugcca

SEQ ID NO: 339224 - RNA, 32 nt, Human
auucgggaggcugagacaggagaaucacuuga

SEQ ID NO: 339225 - RNA, 32 nt, Human
auucgggaggcugaggcacaagaaucauuuga

SEQ ID NO: 339226 - RNA, 32 nt, Human
auucgggaggcugaggcaggagaaucgcguga

SEQ ID NO: 339227 - RNA, 32 nt, Human
auucgggaggcugaggcaggaggauggcguga

SEQ ID NO: 339228 - RNA, 32 nt, Human
auucgggaggcugaggcccgagaaucgcuuga

SEQ ID NO: 339229 - RNA, 32 nt, Human
auucgggaggcugagguaagaggaucaccuaa

SEQ ID NO: 339230 - RNA, 32 nt, Human
auucgggaggcugagguaggagaaucacuuga

SEQ ID NO: 339231 - RNA, 32 nt, Human
auucgggaggcugagguagguggaucaccucu

SEQ ID NO: 339232 - RNA, 25 nt, Human
auucgggagguggagguugcaguga

SEQ ID NO: 339233 - RNA, 32 nt, Human
auucgggagguggagguugcagugagccgaaa

SEQ ID NO: 339234 - RNA, 32 nt, Human
auucgggcauaagcaggagacacacacaucag

SEQ ID NO: 339235 - RNA, 32 nt, Human
auucgggccugggacugugucugucgcccaug

SEQ ID NO: 339236 - RNA, 32 nt, Human
auucgggcgccgcggcagcugcuccggcugcc

SEQ ID NO: 339237 - RNA, 32 nt, Human
auucggguaggauucucucuaaauuauuuauu

SEQ ID NO: 339238 - RNA, 32 nt, Human
auucggguggucuuccugaaccacagccagug

SEQ ID NO: 339239 - RNA, 32 nt, Human
auucggugauucagccccaaaacaucucugcc

SEQ ID NO: 339240 - RNA, 32 nt, Human
auucgguggcucccugguuugcauuuaccuca

SEQ ID NO: 339241 - RNA, 31 nt, Human
auucguaugcacgcccugcccagcuggucag

SEQ ID NO: 339242 - RNA, 32 nt, Human
auucgucaguuucacuggguaucugcaaggcu

SEQ ID NO: 339243 - RNA, 32 nt, Human
auucgucuguaaucccagcuacuugaugcgaa

SEQ ID NO: 339244 - RNA, 32 nt, Human
auucgugacaacaugcgaccgugccaggaaca

SEQ ID NO: 339245 - RNA, 32 nt, Human
auucgugagugugcgagugugugugcacaugu

SEQ ID NO: 339246 - RNA, 32 nt, Human
auucgugcagugggaugagcuacuuugccagc

SEQ ID NO: 339247 - RNA, 32 nt, Human
auucguuaugguagaaucauuuuuaauucacg

SEQ ID NO: 339248 - RNA, 32 nt, Human
auucguucaaagagauugacugcuguggagac

SEQ ID NO: 339249 - RNA, 32 nt, Human
auucguugugcucaaaggcaggaaacaacuau

SEQ ID NO: 339250 - RNA, 32 nt, Human
auucguuuuccuauuucuuuucauacaaauaa

SEQ ID NO: 339251 - RNA, 32 nt, Human
auucuaaaaugagaggauuguuacaggaggga

SEQ ID NO: 339252 - RNA, 32 nt, Human
auucuaaacccucccuccucuucuugcuggag

SEQ ID NO: 339253 - RNA, 32 nt, Human
auucuaaagcugcuucagacugcuucaugagg

SEQ ID NO: 339254 - RNA, 32 nt, Human
auucuaaaggaaauguucucugaugggaggag

SEQ ID NO: 339255 - RNA, 32 nt, Human
auucuaaaguuuuaauuucauuuuggaauuua

SEQ ID NO: 339256 - RNA, 32 nt, Human
auucuaacaacaaaagcugaauuucuucaccc

SEQ ID NO: 339257 - RNA, 32 nt, Human
auucuaacauucucugaaacacuugagauguu

SEQ ID NO: 339258 - RNA, 32 nt, Human
auucuaaccaacucacacauauacacaaaauc

SEQ ID NO: 339259 - RNA, 32 nt, Human
auucuaaccugacuggcacaucucagccuaac

SEQ ID NO: 339260 - RNA, 32 nt, Human
auucuaacuccugcuccuucucuuguccuucc

SEQ ID NO: 339261 - RNA, 32 nt, Human
auucuaagcgguuggggcaugagggaggauau

SEQ ID NO: 339262 - RNA, 32 nt, Human
auucuaaggacugaggcaauagaaaggggagg

SEQ ID NO: 339263 - RNA, 32 nt, Human
auucuaaggugauguucuuagcacuuuaauuc

SEQ ID NO: 339264 - RNA, 32 nt, Human
auucuaagugccaaggcucugagggugucuug

SEQ ID NO: 339265 - RNA, 32 nt, Human
auucuaaucaagcuguauguagagacugaaug

SEQ ID NO: 339266 - RNA, 32 nt, Human
auucuaaucccauccaucccuguggagcugca

SEQ ID NO: 339267 - RNA, 32 nt, Human
auucuaaugauuggcaagucacguuguuuuca

SEQ ID NO: 339268 - RNA, 32 nt, Human
auucuaauguacaaguuuguuuuaaaaagugu

SEQ ID NO: 339269 - RNA, 32 nt, Human
auucuaaugucacguaugugaccguguggacu

SEQ ID NO: 339270 - RNA, 32 nt, Human
auucuaauguuugccaggaaaggcuagguuca

SEQ ID NO: 339271 - RNA, 32 nt, Human
auucuaauuauuuugagucugccuccuaggaa

SEQ ID NO: 339272 - RNA, 32 nt, Human
auucuaauucauuuuaaaaucuuuuaggucag

SEQ ID NO: 339273 - RNA, 32 nt, Human
auucuaauuugagggcugcacuguacaccaug

SEQ ID NO: 339274 - RNA, 32 nt, Human
auucuacaaacugcucucaaguuaccaaggaa

SEQ ID NO: 339275 - RNA, 32 nt, Human
auucuacacauacaaccuguucuguuaucaua

SEQ ID NO: 339276 - RNA, 25 nt, Human
auucuacagcauacagagcaggcca

SEQ ID NO: 339277 - RNA, 32 nt, Human
auucuacagugaugauugaauucuaaaaaugg

SEQ ID NO: 339278 - RNA, 32 nt, Human
auucuacauauaguggaaaaucugccaaagaa

SEQ ID NO: 339279 - RNA, 32 nt, Human
auucuaccuaaaucuuccaauuuccuuuaaau

SEQ ID NO: 339280 - RNA, 32 nt, Human
auucuaccucagccuccugaauagcugggaau

SEQ ID NO: 339281 - RNA, 32 nt, Human
auucuacgugcagcggguucucugccuccgug

SEQ ID NO: 339282 - RNA, 25 nt, Human
auucuacucauauauaucuaucuua

SEQ ID NO: 339283 - RNA, 32 nt, Human
auucuacugaguagacaggacuggaaauccau

SEQ ID NO: 339284 - RNA, 32 nt, Human
auucuacuggauuucaaaaagagacuaauacc

SEQ ID NO: 339285 - RNA, 32 nt, Human
auucuacuuauccacaugugccaagaugugcc

SEQ ID NO: 339286 - RNA, 32 nt, Human
auucuagaacaugacccacauucugaguauca

SEQ ID NO: 339287 - RNA, 32 nt, Human
auucuagaccagccugggcaacauagugagac

SEQ ID NO: 339288 - RNA, 32 nt, Human
auucuagagccagucucugccucccagacgcg

SEQ ID NO: 339289 - RNA, 32 nt, Human
auucuagaggauguaucucacaaguaggauca

SEQ ID NO: 339290 - RNA, 32 nt, Human
auucuagaggcugaggcgggaggauugcuuga

SEQ ID NO: 339291 - RNA, 32 nt, Human
auucuagaguauuccaggugguugcacauuug

SEQ ID NO: 339292 - RNA, 32 nt, Human
auucuagcacagugccuugccuagaguaguag

SEQ ID NO: 339293 - RNA, 32 nt, Human
auucuagcaguccuggggcacugaccuuugcc

SEQ ID NO: 339294 - RNA, 32 nt, Human
auucuagccaaacuauucuauggccauuacua

SEQ ID NO: 339295 - RNA, 26 nt, Human
auucuagccugggugacagagcgaga

SEQ ID NO: 339296 - RNA, 32 nt, Human
auucuagcuuuauucaaguuugcuuugcauuc

SEQ ID NO: 339297 - RNA, 32 nt, Human
auucuaggaccuguguccuagacuucagggag

SEQ ID NO: 339298 - RNA, 32 nt, Human
auucuaggauucuggaaacagagacaguaaga

SEQ ID NO: 339299 - RNA, 32 nt, Human
auucuaggcagaggcuggaaugcaaugaugcg

SEQ ID NO: 339300 - RNA, 32 nt, Human
auucuagggaccacuccagaccuacagaauca

SEQ ID NO: 339301 - RNA, 32 nt, Human
auucuagguagaggagacagccuggacaaagg

SEQ ID NO: 339302 - RNA, 32 nt, Human
auucuagucuugaacuccugaccucaggugau

SEQ ID NO: 339303 - RNA, 32 nt, Human
auucuaguggcuguucaugcuccaagacuuua

SEQ ID NO: 339304 - RNA, 32 nt, Human
auucuaguguuuuucauccuuugcuaggaugc

SEQ ID NO: 339305 - RNA, 32 nt, Human
auucuaguuacccuuugcuucccuucaccucu

SEQ ID NO: 339306 - RNA, 32 nt, Human
auucuaguugaauauguucaaggaaguuauuu

SEQ ID NO: 339307 - RNA, 32 nt, Human
auucuauaagagccucaccagugacugggaag

SEQ ID NO: 339308 - RNA, 32 nt, Human
auucuauauuauaucugcuguacaacuucuuu

SEQ ID NO: 339309 - RNA, 32 nt, Human
auucuaucacccaggcuggaguggagugguau

SEQ ID NO: 339310 - RNA, 32 nt, Human
auucuaucgcccaggcuggagugcaauggcac

SEQ ID NO: 339311 - RNA, 32 nt, Human
auucuaucggccaggcuggagugcaguggugc

SEQ ID NO: 339312 - RNA, 32 nt, Human
auucuaucuccaaguaucuugugcaucccucc

SEQ ID NO: 339313 - RNA, 32 nt, Human
auucuaucuucauuuuagacuuuuggucugug

SEQ ID NO: 339314 - RNA, 32 nt, Human
auucuaucuuuuccuuucaucuauuuucuaca

SEQ ID NO: 339315 - RNA, 32 nt, Human
auucuaugacaucaugaggucuccucagugca

SEQ ID NO: 339316 - RNA, 32 nt, Human
auucuaugacucuugucuccuccuccaggagg

SEQ ID NO: 339317 - RNA, 32 nt, Human
auucuaugcaaaaagaagguggggaagaaagu

SEQ ID NO: 339318 - RNA, 32 nt, Human
auucuauggaauugagagccaucgcugcaugg

SEQ ID NO: 339319 - RNA, 32 nt, Human
auucuauguagugaucuuuuuacugugaccac

SEQ ID NO: 339320 - RNA, 32 nt, Human
auucuauguagugguuuuaggauacuuaacaa

SEQ ID NO: 339321 - RNA, 32 nt, Human
auucuauguauugagaaaauguuuaauaucaa

SEQ ID NO: 339322 - RNA, 32 nt, Human
auucuauuaagccaucuugcucugccuucuug

SEQ ID NO: 339323 - RNA, 32 nt, Human
auucuauucgcuuguuauuggacuugaaacuc

SEQ ID NO: 339324 - RNA, 19 nt, Human
auucuauuuaccucacuga

SEQ ID NO: 339325 - RNA, 32 nt, Human
auucuauuugaccaguggccuauuuggucaca

SEQ ID NO: 339326 - RNA, 32 nt, Human
auucuauuuuuagcuuuucauuucucagcugu

SEQ ID NO: 339327 - RNA, 32 nt, Human
auucucaaacaccaaaaggaaaaguugaaucu

SEQ ID NO: 339328 - RNA, 32 nt, Human
auucucaaauugugucugcuuccccugacccc

SEQ ID NO: 339329 - RNA, 32 nt, Human
auucucaacgcuucuccuuucucuccaccucc

SEQ ID NO: 339330 - RNA, 32 nt, Human
auucucaacuagcaauuggaacuccuaggcuc

SEQ ID NO: 339331 - RNA, 32 nt, Human
auucucaacuagccuuggcaaaacagcuguag

SEQ ID NO: 339332 - RNA, 32 nt, Human
auucucaaguggcugcaauuacaggcaaccag

SEQ ID NO: 339333 - RNA, 32 nt, Human
auucucaaugcagaauuauugggucuuucaua

SEQ ID NO: 339334 - RNA, 22 nt, Human
auucucaauuuucuuuaugcua

SEQ ID NO: 339335 - RNA, 32 nt, Human
auucucacagauccuccucaacaugagggugu

SEQ ID NO: 339336 - RNA, 32 nt, Human
auucucacagcacagaugagguugagaccaug

SEQ ID NO: 339337 - RNA, 32 nt, Human
auucucacucacuguagacccuauauuccuuc

SEQ ID NO: 339338 - RNA, 32 nt, Human
auucucacucucccucccuucucucacucuca

SEQ ID NO: 339339 - RNA, 32 nt, Human
auucucagacuugccacccccagguuagcaac

SEQ ID NO: 339340 - RNA, 32 nt, Human
auucucagagagacccgaccgcgcucuugaug

SEQ ID NO: 339341 - RNA, 32 nt, Human
auucucagaguguuuaauuguacucaauggua

SEQ ID NO: 339342 - RNA, 32 nt, Human
auucucagauugcccugaauuuugccacuuuu

SEQ ID NO: 339343 - RNA, 32 nt, Human
auucucagccaagaagacagugagcacaccua

SEQ ID NO: 339344 - RNA, 32 nt, Human
auucucagccaucuuugaagcuugaaagaaga

SEQ ID NO: 339345 - RNA, 32 nt, Human
auucucagccuuccuucccucuccuugucuca

SEQ ID NO: 339346 - RNA, 32 nt, Human
auucucagcuacucgggaggcugaggcaggag

SEQ ID NO: 339347 - RNA, 32 nt, Human
auucucagcugaugcaguccaggcuccaugcu

SEQ ID NO: 339348 - RNA, 32 nt, Human
auucucaggaacaccagguuucagaccaucuu

SEQ ID NO: 339349 - RNA, 32 nt, Human
auucucaguagaguugggaaugaggaugcugu

SEQ ID NO: 339350 - RNA, 32 nt, Human
auucucaguggggguucaccacaaaacacggg

SEQ ID NO: 339351 - RNA, 24 nt, Human
auucucaguucauaggcuauccca

SEQ ID NO: 339352 - RNA, 24 nt, Human
auucucaguucauuuuuacuccca

SEQ ID NO: 339353 - RNA, 32 nt, Human
auucucaguuuaugaagauaauaggauuaaga

SEQ ID NO: 339354 - RNA, 32 nt, Human
auucucaucccagccauuuaucuucuuuguuu

SEQ ID NO: 339355 - RNA, 32 nt, Human
auucucaugccucggcccuccgaguagcuggg

SEQ ID NO: 339356 - RNA, 32 nt, Human
auucucaugccuguagguuuccauugcucugu

SEQ ID NO: 339357 - RNA, 32 nt, Human
auucucauggcuaccuccucugacccauccac

SEQ ID NO: 339358 - RNA, 32 nt, Human
auucucauguaaaugucagugccaacgcuggu

SEQ ID NO: 339359 - RNA, 32 nt, Human
auucucauuccugcucugggccauuuguguuu

SEQ ID NO: 339360 - RNA, 32 nt, Human
auucuccaaaacaugcauaaaaguaaaauaug

SEQ ID NO: 339361 - RNA, 32 nt, Human
auucuccaaaggacaggaacuggacuuauggg

SEQ ID NO: 339362 - RNA, 32 nt, Human
auucuccaagccuggucagcugccugcacagg

SEQ ID NO: 339363 - RNA, 32 nt, Human
auucuccaauccccucuccuuugguccaguag

SEQ ID NO: 339364 - RNA, 32 nt, Human
auucuccacaauauuaccaugcaaguuaucuc

SEQ ID NO: 339365 - RNA, 32 nt, Human
auucuccacaguuaccuuuagagagaauuuau

SEQ ID NO: 339366 - RNA, 32 nt, Human
auucuccacccuuaacccugugcucaggcacc

SEQ ID NO: 339367 - RNA, 32 nt, Human
auucuccaguauuccuguuuccauccaguucc

SEQ ID NO: 339368 - RNA, 32 nt, Human
auucuccauagaaaauaggagugaagagagaa

SEQ ID NO: 339369 - RNA, 26 nt, Human
auucuccauggacaggcucucggggu

SEQ ID NO: 339370 - RNA, 32 nt, Human
auucucccaggagccuccagaaggaaccuugg

SEQ ID NO: 339371 - RNA, 32 nt, Human
auucuccccaaaacccuucuugcaugcaggau

SEQ ID NO: 339372 - RNA, 32 nt, Human
auucuccccaauaaaucucucuccaggcuuua

SEQ ID NO: 339373 - RNA, 32 nt, Human
auucuccccacuugauuuuucuucuauaaaau

SEQ ID NO: 339374 - RNA, 32 nt, Human
auucuccccaguagcugggauuacaggugccc

SEQ ID NO: 339375 - RNA, 32 nt, Human
auucucccccucucucccuccugugucuugcg

SEQ ID NO: 339376 - RNA, 32 nt, Human
auucucccgccucagccuucugaguagcuggg

SEQ ID NO: 339377 - RNA, 32 nt, Human
auucucccucucauccugccauccgcugcggc

SEQ ID NO: 339378 - RNA, 32 nt, Human
auucucccugcucccuguggacaaaagcacau

SEQ ID NO: 339379 - RNA, 32 nt, Human
auucucccuugccuccccuuuugagacuggag

SEQ ID NO: 339380 - RNA, 32 nt, Human
auucuccuaaaaucucaggagggcagcaagug

SEQ ID NO: 339381 - RNA, 32 nt, Human
auucuccuagaugagucagaacuuaguuuuga

SEQ ID NO: 339382 - RNA, 32 nt, Human
auucuccucuccccauuucagucacaggaaau

SEQ ID NO: 339383 - RNA, 32 nt, Human
auucuccucuggggcucuaccucuccacacuu

SEQ ID NO: 339384 - RNA, 32 nt, Human
auucuccugaguagcugggauugcuggugcac

SEQ ID NO: 339385 - RNA, 32 nt, Human
auucuccugccucagccuucugaguagcugga

SEQ ID NO: 339386 - RNA, 32 nt, Human
auucuccugccucagccuucugaguagcuggg

SEQ ID NO: 339387 - RNA, 32 nt, Human
auucuccugccucaggcuucugaguagcuggg

SEQ ID NO: 339388 - RNA, 32 nt, Human
auucuccugccucauucuccccaguagcuggg

SEQ ID NO: 339389 - RNA, 32 nt, Human
auucuccugccugagccuuccgaguagcuggg

SEQ ID NO: 339390 - RNA, 32 nt, Human
auucuccugccuugccuccugaguagcuggga

SEQ ID NO: 339391 - RNA, 31 nt, Human
auucuccugcucucuggguuccuuggugcua

SEQ ID NO: 339392 - RNA, 32 nt, Human
auucuccugcuucagccuucugagcagcuggg

SEQ ID NO: 339393 - RNA, 32 nt, Human
auucuccuggcaagagaaaaagacuuaacuag

SEQ ID NO: 339394 - RNA, 32 nt, Human
auucuccugguguuugcgcaagugccuucucc

SEQ ID NO: 339395 - RNA, 32 nt, Human
auucuccuguaaucccagcuacucgggaggcc

SEQ ID NO: 339396 - RNA, 32 nt, Human
auucuccuguaccuccuggccugcagaaguga

SEQ ID NO: 339397 - RNA, 32 nt, Human
auucuccuucuuucucuuccugcuggcugaag

SEQ ID NO: 339398 - RNA, 32 nt, Human
auucuccuuuauuuucuucccgucugccugcc

SEQ ID NO: 339399 - RNA, 32 nt, Human
auucuccuuuguccuguuucuccuguuucauu

SEQ ID NO: 339400 - RNA, 32 nt, Human
auucucgaaagacauccugaagguggcuuucu

SEQ ID NO: 339401 - RNA, 32 nt, Human
auucucgccuccccaucucccauagacuguaa

SEQ ID NO: 339402 - RNA, 32 nt, Human
auucucgccucgccgcagcccagcccugcgcg

SEQ ID NO: 339403 - RNA, 32 nt, Human
auucucggaagagagaagggagagggaggagg

SEQ ID NO: 339404 - RNA, 32 nt, Human
auucucgggcucaagugguccucccaaagugc

SEQ ID NO: 339405 - RNA, 32 nt, Human
auucucgguucuucccccuccucccagagcug

SEQ ID NO: 339406 - RNA, 32 nt, Human
auucucuacccccuucauuaucaugccuugca

SEQ ID NO: 339407 - RNA, 32 nt, Human
auucucuaggccugcagccaaauuacuggacc

SEQ ID NO: 339408 - RNA, 32 nt, Human
auucucuaggugguaacaucagagccaccacu

SEQ ID NO: 339409 - RNA, 32 nt, Human
auucucuaguacucauccaggaaaccauucuu

SEQ ID NO: 339410 - RNA, 32 nt, Human
auucucucagcggucucucuucuccucaaguu

SEQ ID NO: 339411 - RNA, 32 nt, Human
auucucucaguuacuccauuggugaaauggcc

SEQ ID NO: 339412 - RNA, 32 nt, Human
auucucucaugcacuuuccuuuccaggucccc

SEQ ID NO: 339413 - RNA, 32 nt, Human
auucucuccaaaaaugcacccaacuagcucua

SEQ ID NO: 339414 - RNA, 32 nt, Human
auucucuccauuuucucccaagaagcaugacu

SEQ ID NO: 339415 - RNA, 23 nt, Human
auucucucccccaaugaaucaau

SEQ ID NO: 339416 - RNA, 20 nt, Human
auucucuccccugaaaucaa

SEQ ID NO: 339417 - RNA, 32 nt, Human
auucucucucacucacauuuucucagugugcc

SEQ ID NO: 339418 - RNA, 21 nt, Human
auucucucuccccucacuggu

SEQ ID NO: 339419 - RNA, 32 nt, Human
auucucucuccuuuuccaucuggaccacccag

SEQ ID NO: 339420 - RNA, 32 nt, Human
auucucucugagucugggauguaaagacaaag

SEQ ID NO: 339421 - RNA, 32 nt, Human
auucucucuggccaucuuuggucacucacgug

SEQ ID NO: 339422 - RNA, 32 nt, Human
auucucucuuucucauagacugaccuucuuuu

SEQ ID NO: 339423 - RNA, 32 nt, Human
auucucugaaagcucacugcugccaaggugcu

SEQ ID NO: 339424 - RNA, 32 nt, Human
auucucugagccucugcucacucucagggcca

SEQ ID NO: 339425 - RNA, 32 nt, Human
auucucugcaaaaccuacucuaaugccugugu

SEQ ID NO: 339426 - RNA, 32 nt, Human
auucucugcaagugucuguuauuagagaaacg

SEQ ID NO: 339427 - RNA, 32 nt, Human
auucucugccagcugcugugcacugcugucag

SEQ ID NO: 339428 - RNA, 32 nt, Human
auucucuggaugagggagaguggucgugagcu

SEQ ID NO: 339429 - RNA, 32 nt, Human
auucucugggaggcaaaggcuggcacuggacu

SEQ ID NO: 339430 - RNA, 32 nt, Human
auucucugucucucucuguuuaucucuccccu

SEQ ID NO: 339431 - RNA, 32 nt, Human
auucucugugggccuagcagggaaggggacag

SEQ ID NO: 339432 - RNA, 32 nt, Human
auucucuguggguaugcaaaguuaugggaauu

SEQ ID NO: 339433 - RNA, 32 nt, Human
auucucuucacuuaagaaacuuaaguugcugc

SEQ ID NO: 339434 - RNA, 32 nt, Human
auucucuuccccucaucucuuggggcuguucc

SEQ ID NO: 339435 - RNA, 32 nt, Human
auucucuuccccugugugccucaguguccuuc

SEQ ID NO: 339436 - RNA, 32 nt, Human
auucucuucucuccagucccguuguuauaguc

SEQ ID NO: 339437 - RNA, 32 nt, Human
auucucuugcccaggcuuuuugcuccuucaag

SEQ ID NO: 339438 - RNA, 32 nt, Human
auucucuugccucaaucuccccaguaccuggg

SEQ ID NO: 339439 - RNA, 32 nt, Human
auucucuugccucagccuucugaguagcuggg

SEQ ID NO: 339440 - RNA, 32 nt, Human
auucucuuggagccuugggugggcagggacgg

SEQ ID NO: 339441 - RNA, 32 nt, Human
auucucuuuaccaguauccuggcaaugguugu

SEQ ID NO: 339442 - RNA, 32 nt, Human
auucucuuugcaccuggcgagagggucugacu

SEQ ID NO: 339443 - RNA, 32 nt, Human
auucucuuugcucacuggcucuccuauaauca

SEQ ID NO: 339444 - RNA, 32 nt, Human
auucucuuuuguagcuugagcagggaggaucc

SEQ ID NO: 339445 - RNA, 21 nt, Human
auucugaaaggcccacugagc

SEQ ID NO: 339446 - RNA, 22 nt, Human
auucugaacuuuucaggaggua

SEQ ID NO: 339447 - RNA, 32 nt, Human
auucugaagaagaugggggcuaugacagugau

SEQ ID NO: 339448 - RNA, 23 nt, Human
auucugaauaguuccaugucaua

SEQ ID NO: 339449 - RNA, 32 nt, Human
auucugaauggaggcagaaccagcaacaacuc

SEQ ID NO: 339450 - RNA, 31 nt, Human
auucugaauuuccucccuuggggaagaaggg

SEQ ID NO: 339451 - RNA, 32 nt, Human
auucugacaagguccagccaggaauuucuaag

SEQ ID NO: 339452 - RNA, 32 nt, Human
auucugacaccagcuugcugcuaugauuucag

SEQ ID NO: 339453 - RNA, 32 nt, Human
auucugacauauauuuguuuauaaaauuccuu

SEQ ID NO: 339454 - RNA, 32 nt, Human
auucugacauuuucuauucuaaaauaaaucuc

SEQ ID NO: 339455 - RNA, 32 nt, Human
auucugacgccaacaugcagcgaaguaucaug

SEQ ID NO: 339456 - RNA, 32 nt, Human
auucugacuacucgcuauuuuguaguaguugu

SEQ ID NO: 339457 - RNA, 32 nt, Human
auucugacuaucccaagagagcagaaaaggga

SEQ ID NO: 339458 - RNA, 32 nt, Human
auucugacuaucucccuuucccgcccuccauc

SEQ ID NO: 339459 - RNA, 32 nt, Human
auucugacucaaaauucuccuaaaccucccug

SEQ ID NO: 339460 - RNA, 32 nt, Human
auucugacugcacucuauguccugggccaugg

SEQ ID NO: 339461 - RNA, 32 nt, Human
auucugagauuuguuuaucugcuuuauucauu

SEQ ID NO: 339462 - RNA, 32 nt, Human
auucugagcaagauaagcaacaugacaaauuc

SEQ ID NO: 339463 - RNA, 22 nt, Human
auucugagcauguaggaaggua

SEQ ID NO: 339464 - RNA, 32 nt, Human
auucugagcuaaaaucuauuuaccauugagua

SEQ ID NO: 339465 - RNA, 32 nt, Human
auucugagcuucugugggauauuuugcagaag

SEQ ID NO: 339466 - RNA, 32 nt, Human
auucugaggcacugaagugccucccagaugug

SEQ ID NO: 339467 - RNA, 32 nt, Human
auucugaguuuucacacuccacaaauccucag

SEQ ID NO: 339468 - RNA, 32 nt, Human
auucugauacaaccaccugaaaaugcuacagc

SEQ ID NO: 339469 - RNA, 32 nt, Human
auucugauaccgaagaagaggggccaaugaaa

SEQ ID NO: 339470 - RNA, 21 nt, Human
auucugaucacuggcuccauc

SEQ ID NO: 339471 - RNA, 32 nt, Human
auucugaucugcauuuucagaagaggacaauc

SEQ ID NO: 339472 - RNA, 32 nt, Human
auucugaucugcccaccuccucuuccuucuuc

SEQ ID NO: 339473 - RNA, 32 nt, Human
auucugaugcagauggucaggaugguggugac

SEQ ID NO: 339474 - RNA, 32 nt, Human
auucugaugcccagguuggggugcaguggcac

SEQ ID NO: 339475 - RNA, 22 nt, Human
auucugaugcuggaggcaggug

SEQ ID NO: 339476 - RNA, 21 nt, Human
auucugaugcugggacaggug

SEQ ID NO: 339477 - RNA, 32 nt, Human
auucugauugauuuuuauuuuauucuauuauu

SEQ ID NO: 339478 - RNA, 32 nt, Human
auucugcaauauguaaccaacaugucacaaac

SEQ ID NO: 339479 - RNA, 32 nt, Human
auucugcaauccucuugcucaggaaguguaua

SEQ ID NO: 339480 - RNA, 32 nt, Human
auucugcacccuuuuaaauucauugcuuuucu

SEQ ID NO: 339481 - RNA, 32 nt, Human
auucugcaccugcuagcacagcuguccacguc

SEQ ID NO: 339482 - RNA, 32 nt, Human
auucugcacuuuagccagccugggucggcaac

SEQ ID NO: 339483 - RNA, 32 nt, Human
auucugcagagacuuccaguuuauugcauaua

SEQ ID NO: 339484 - RNA, 20 nt, Human
auucugcagccagcccaggc

SEQ ID NO: 339485 - RNA, 21 nt, Human
auucugcagccuggacggcca

SEQ ID NO: 339486 - RNA, 32 nt, Human
auucugcagccuguguugcucucuaccuggca

SEQ ID NO: 339487 - RNA, 32 nt, Human
auucugcagcuuccuaaaauauuuuaaaaaua

SEQ ID NO: 339488 - RNA, 32 nt, Human
auucugcagguggagguugcuagucuaguuuc

SEQ ID NO: 339489 - RNA, 32 nt, Human
auucugcaucagaaaaacaaacaaaacaaaaa

SEQ ID NO: 339490 - RNA, 32 nt, Human
auucugcauccagcucuaucccccucugaugc

SEQ ID NO: 339491 - RNA, 32 nt, Human
auucugcauccccuccccauccaaccuaaaug

SEQ ID NO: 339492 - RNA, 32 nt, Human
auucugcaucuggucaauguuuccaaugaaga

SEQ ID NO: 339493 - RNA, 32 nt, Human
auucugcauggugacagucucccccaaacaug

SEQ ID NO: 339494 - RNA, 20 nt, Human
auucugccaggcccccaagc

SEQ ID NO: 339495 - RNA, 32 nt, Human
auucugccaucuccucauggaaagagaggcuc

SEQ ID NO: 339496 - RNA, 32 nt, Human
auucugcccacacccauuuauuuccuuccuuc

SEQ ID NO: 339497 - RNA, 32 nt, Human
auucugcccaggauccuaggccccucuacucc

SEQ ID NO: 339498 - RNA, 31 nt, Human
auucugcccaucaaggugguuggagggccaa

SEQ ID NO: 339499 - RNA, 21 nt, Human
auucugccccacacccagcca

SEQ ID NO: 339500 - RNA, 32 nt, Human
auucugcccccgcccuuccuccccuuauuugu

SEQ ID NO: 339501 - RNA, 22 nt, Human
auucugcccuacaugaugggua

SEQ ID NO: 339502 - RNA, 32 nt, Human
auucugcccuggcccaugcacacccgucuuuc

SEQ ID NO: 339503 - RNA, 32 nt, Human
auucugccgagccucuugucccuucccugcuc

SEQ ID NO: 339504 - RNA, 32 nt, Human
auucugccucaguugucuuuucuugaaauauu

SEQ ID NO: 339505 - RNA, 32 nt, Human
auucugccuccaucucugccuccauggcuacc

SEQ ID NO: 339506 - RNA, 32 nt, Human
auucugccucuggacucacauuucucgucuug

SEQ ID NO: 339507 - RNA, 32 nt, Human
auucugccuguaaucccagaauuuugggaggc

SEQ ID NO: 339508 - RNA, 32 nt, Human
auucugccuuccuaaggcaggagaccugaugg

SEQ ID NO: 339509 - RNA, 32 nt, Human
auucugccuuucugcuggagggaaguguuuuc

SEQ ID NO: 339510 - RNA, 32 nt, Human
auucugcgcccugauccagucaccucccacca

SEQ ID NO: 339511 - RNA, 16 nt, Human
auucugcucccugaac

SEQ ID NO: 339512 - RNA, 32 nt, Human
auucugcucccugaacacccacagaaccccaa

SEQ ID NO: 339513 - RNA, 32 nt, Human
auucugcucucaggaacucuaagucuagcaga

SEQ ID NO: 339514 - RNA, 32 nt, Human
auucugcugaccacagcacuccaaccaaaagc

SEQ ID NO: 339515 - RNA, 32 nt, Human
auucugcuuuucauccucugugguguuggcca

SEQ ID NO: 339516 - RNA, 32 nt, Human
auucuggaaacuuuuguuagggcugcuuuuaa

SEQ ID NO: 339517 - RNA, 32 nt, Human
auucuggaaacuuuuguuagggcugcuuuucu

SEQ ID NO: 339518 - RNA, 32 nt, Human
auucuggaagauuucuuucuucacuggacuau

SEQ ID NO: 339519 - RNA, 32 nt, Human
auucuggaagcauggaaggcguggacuugcua

SEQ ID NO: 339520 - RNA, 32 nt, Human
auucuggaaucugagccuucucuuacaacagg

SEQ ID NO: 339521 - RNA, 32 nt, Human
auucuggaauugcauguugcaaggagucuccu

SEQ ID NO: 339522 - RNA, 32 nt, Human
auucuggagcaaguggagugguugcaggcaga

SEQ ID NO: 339523 - RNA, 28 nt, Human
auucuggaggaaaagcagugaucuguaa

SEQ ID NO: 339524 - RNA, 32 nt, Human
auucuggaggcugagaugggaggaucacuuga

SEQ ID NO: 339525 - RNA, 32 nt, Human
auucuggaggcugaggcaggaaucgcuugaaa

SEQ ID NO: 339526 - RNA, 32 nt, Human
auucuggaggcugaggcaggagaaucgcuuga

SEQ ID NO: 339527 - RNA, 32 nt, Human
auucuggauauauucuggauacaugguuugca

SEQ ID NO: 339528 - RNA, 32 nt, Human
auucuggaugucagaggagggugcgugugaug

SEQ ID NO: 339529 - RNA, 32 nt, Human
auucuggcaauauuuuuccagucucagaggca

SEQ ID NO: 339530 - RNA, 32 nt, Human
auucuggcaaucuuuagaaagggagauuccaa

SEQ ID NO: 339531 - RNA, 32 nt, Human
auucuggccauuugagcauucucuccaacucu

SEQ ID NO: 339532 - RNA, 32 nt, Human
auucuggccucucaucccaggcugcagacccu

SEQ ID NO: 339533 - RNA, 32 nt, Human
auucuggccucucccaugccucaggcucuggu

SEQ ID NO: 339534 - RNA, 32 nt, Human
auucuggccucugugguaggaggcagggagag

SEQ ID NO: 339535 - RNA, 32 nt, Human
auucuggcgucagcuuccucaggauuuucuuc

SEQ ID NO: 339536 - RNA, 32 nt, Human
auucuggcucacugcagccucaaacuccugag

SEQ ID NO: 339537 - RNA, 32 nt, Human
auucuggcuuugguagagucuccucuuguguu

SEQ ID NO: 339538 - RNA, 32 nt, Human
auucugggccaagagacacucacuggacaaua

SEQ ID NO: 339539 - RNA, 30 nt, Human
auucugggccucuccaggccuguccugccu

SEQ ID NO: 339540 - RNA, 32 nt, Human
auucugggcucuggucagggcuggcaggcugg

SEQ ID NO: 339541 - RNA, 32 nt, Human
auucugggcugaagugagauuuucuugaaugg

SEQ ID NO: 339542 - RNA, 32 nt, Human
auucugggcuggacugugggaucuguuacaga

SEQ ID NO: 339543 - RNA, 32 nt, Human
auucuggggagagcagccuuguggaaauugau

SEQ ID NO: 339544 - RNA, 32 nt, Human
auucuggggccagccaggggcagucaaauuag

SEQ ID NO: 339545 - RNA, 32 nt, Human
auucugggguagaaggaaggcugggaguggug

SEQ ID NO: 339546 - RNA, 32 nt, Human
auucugggguuauuuaacaauagcaauaguuc

SEQ ID NO: 339547 - RNA, 32 nt, Human
auucugggucucaguacugggaaagggugagg

SEQ ID NO: 339548 - RNA, 32 nt, Human
auucugggugugagccacugucaugccuggcc

SEQ ID NO: 339549 - RNA, 32 nt, Human
auucugguaaagaagaaagagauaagggacgc

SEQ ID NO: 339550 - RNA, 32 nt, Human
auucuggucuuucugggccagauuuuuauauu

SEQ ID NO: 339551 - RNA, 32 nt, Human
auucuggugaucuacugcacaggaugguagcc

SEQ ID NO: 339552 - RNA, 25 nt, Human
auucuggugcaguggugguauacca

SEQ ID NO: 339553 - RNA, 32 nt, Human
auucuggugguagacugguagugagcagcaaa

SEQ ID NO: 339554 - RNA, 26 nt, Human
auucugguucauuuuaaacucccucc

SEQ ID NO: 339555 - RNA, 23 nt, Human
auucuguaaagcaaguauuaucc

SEQ ID NO: 339556 - RNA, 32 nt, Human
auucuguagaaaguggaacuguuguugcguug

SEQ ID NO: 339557 - RNA, 21 nt, Human
auucuguagagcagccugcca

SEQ ID NO: 339558 - RNA, 32 nt, Human
auucuguaugcugcuguuuucaaguuggcaaa

SEQ ID NO: 339559 - RNA, 32 nt, Human
auucuguauuuuuaguagagaugggguuucac

SEQ ID NO: 339560 - RNA, 32 nt, Human
auucuguauuuuuaguagagaugggguuucuc

SEQ ID NO: 339561 - RNA, 32 nt, Human
auucuguauuuuuaguagggaugggguuucuc

SEQ ID NO: 339562 - RNA, 32 nt, Human
auucugucacacagucuggagugcuguggugc

SEQ ID NO: 339563 - RNA, 32 nt, Human
auucugucacccagacuggagugcagugccac

SEQ ID NO: 339564 - RNA, 32 nt, Human
auucugucacccaggccggagugcaguggugu

SEQ ID NO: 339565 - RNA, 32 nt, Human
auucugucacccaggcuagagcgcaguggcaa

SEQ ID NO: 339566 - RNA, 32 nt, Human
auucugucacccaggcuagaguacagugggaa

SEQ ID NO: 339567 - RNA, 32 nt, Human
auucugucacccaggcuggaguccaauggggc

SEQ ID NO: 339568 - RNA, 32 nt, Human
auucugucacccaggcuggagugcaaaggugc

SEQ ID NO: 339569 - RNA, 32 nt, Human
auucugucacccaggcuggagugcaguggcgc

SEQ ID NO: 339570 - RNA, 32 nt, Human
auucugucacccaggcuggagugcaguggcgu

SEQ ID NO: 339571 - RNA, 32 nt, Human
auucugucacccaggcuggagugcaguggugc

SEQ ID NO: 339572 - RNA, 32 nt, Human
auucugucacccgggcuggagugcaguggcgu

SEQ ID NO: 339573 - RNA, 32 nt, Human
auucugucacucaagcuguagugcaguggugc

SEQ ID NO: 339574 - RNA, 32 nt, Human
auucugucacucaggcuagagugcaguggcau

SEQ ID NO: 339575 - RNA, 32 nt, Human
auucugucacucaggcuggagugcaguggcgu

SEQ ID NO: 339576 - RNA, 21 nt, Human
auucugucaggcuggacggga

SEQ ID NO: 339577 - RNA, 32 nt, Human
auucugucaucaaauccugugcugcuguuccu

SEQ ID NO: 339578 - RNA, 26 nt, Human
auucugucauugguuacaaauuuuua

SEQ ID NO: 339579 - RNA, 24 nt, Human
auucugucauuugucagauuuaca

SEQ ID NO: 339580 - RNA, 32 nt, Human
auucugucccucaacccaaauccacuuucaua

SEQ ID NO: 339581 - RNA, 32 nt, Human
auucuguccuccaggcuggagugcaaugacau

SEQ ID NO: 339582 - RNA, 32 nt, Human
auucuguccuuagaguacugaaggcaguucaa

SEQ ID NO: 339583 - RNA, 32 nt, Human
auucugucgaugccauccagcucucuugugua

SEQ ID NO: 339584 - RNA, 32 nt, Human
auucugucgcccaggcuggaguguagugacgc

SEQ ID NO: 339585 - RNA, 32 nt, Human
auucugucgcccuggcuggagugcaauggugu

SEQ ID NO: 339586 - RNA, 32 nt, Human
auucugucgccuuagcauguuugcugaacacc

SEQ ID NO: 339587 - RNA, 32 nt, Human
auucugucuccucuucuuugucaucagccaaa

SEQ ID NO: 339588 - RNA, 32 nt, Human
auucugucucgcaggccagagugcaguggugu

SEQ ID NO: 339589 - RNA, 32 nt, Human
auucugucucugcuuggcuuccccuccacccu

SEQ ID NO: 339590 - RNA, 32 nt, Human
auucugucucuuccuuugcucagugguaugga

SEQ ID NO: 339591 - RNA, 32 nt, Human
auucugucuggcagagaguggggaaaagacgc

SEQ ID NO: 339592 - RNA, 32 nt, Human
auucugucuuauaaccuccugggucccaucca

SEQ ID NO: 339593 - RNA, 32 nt, Human
auucugucuuucuccucccacacuggguuaaa

SEQ ID NO: 339594 - RNA, 32 nt, Human
auucugugaagaaugaaguggaggaaguaacu

SEQ ID NO: 339595 - RNA, 32 nt, Human
auucugugacucauggaaaugauaugagauuc

SEQ ID NO: 339596 - RNA, 32 nt, Human
auucugugcugcgcugccgcugggcgaugcag

SEQ ID NO: 339597 - RNA, 32 nt, Human
auucuguggaggagaagaaaagugauucagug

SEQ ID NO: 339598 - RNA, 23 nt, Human
auucugugggcuguaguaugcca

SEQ ID NO: 339599 - RNA, 32 nt, Human
auucuguggggugagaggaugggugauggggu

SEQ ID NO: 339600 - RNA, 32 nt, Human
auucuguguagugggaugagcagagaacaaaa

SEQ ID NO: 339601 - RNA, 32 nt, Human
auucugugugagccagaauguucaacuaauaa

SEQ ID NO: 339602 - RNA, 32 nt, Human
auucugugugugacucuggguggaagugccca

SEQ ID NO: 339603 - RNA, 32 nt, Human
auucuguguuuugcugucacuuuggcauccuc

SEQ ID NO: 339604 - RNA, 32 nt, Human
auucuguuaaacuccaggcuuggaugguguua

SEQ ID NO: 339605 - RNA, 32 nt, Human
auucuguuaauauggacuuggacuaauaaccu

SEQ ID NO: 339606 - RNA, 32 nt, Human
auucuguuaauguaaugaacaugggaaagacc

SEQ ID NO: 339607 - RNA, 24 nt, Human
auucuguuauuuuuagcauucuca

SEQ ID NO: 339608 - RNA, 22 nt, Human
auucuguucaagugguauauca

SEQ ID NO: 339609 - RNA, 32 nt, Human
auucuguucagugcgauccugaugguccggga

SEQ ID NO: 339610 - RNA, 32 nt, Human
auucuguucucccagagcugcaccugccucgc

SEQ ID NO: 339611 - RNA, 32 nt, Human
auucuguucucuuccuccuccaucuuuauuca

SEQ ID NO: 339612 - RNA, 32 nt, Human
auucuguugcccaaguuggagugcaguggcau

SEQ ID NO: 339613 - RNA, 32 nt, Human
auucuguugcccagacuagaguacaauauugc

SEQ ID NO: 339614 - RNA, 32 nt, Human
auucuguugcccaggcuggagugcaauggcau

SEQ ID NO: 339615 - RNA, 32 nt, Human
auucuguugcccaggcuggagugcaguggcgu

SEQ ID NO: 339616 - RNA, 32 nt, Human
auucuguugcccaggcuggagugcaguggugc

SEQ ID NO: 339617 - RNA, 32 nt, Human
auucuguugcccaugcuggagugcaguggcgu

SEQ ID NO: 339618 - RNA, 32 nt, Human
auucuguugccuaggcuggagugcaguggcgc

SEQ ID NO: 339619 - RNA, 23 nt, Human
auucuguuuauguggacacccca

SEQ ID NO: 339620 - RNA, 32 nt, Human
auucuguuugcuccacgugccugcuucuugcu

SEQ ID NO: 339621 - RNA, 32 nt, Human
auucuguuuggucaguucuagaugguacguca

SEQ ID NO: 339622 - RNA, 32 nt, Human
auucuuaacauugcagcuuucucuccaucugc

SEQ ID NO: 339623 - RNA, 32 nt, Human
auucuuaacugccuuuuucagacaagcaaaua

SEQ ID NO: 339624 - RNA, 32 nt, Human
auucuuaauuaaaaucauuaaauuuaauuaaa

SEQ ID NO: 339625 - RNA, 32 nt, Human
auucuuacuaccaacaguauaacugaacaugu

SEQ ID NO: 339626 - RNA, 32 nt, Human
auucuuacuugaaugcuuugaaugacuacauc

SEQ ID NO: 339627 - RNA, 32 nt, Human
auucuuagaagaguaagaacaaauaaaguaca

SEQ ID NO: 339628 - RNA, 32 nt, Human
auucuuagcacugaacuccucugugaucuagg

SEQ ID NO: 339629 - RNA, 31 nt, Human
auucuuaggcacuuuuugaccuugcugucug

SEQ ID NO: 339630 - RNA, 32 nt, Human
auucuuagguacuaggcugugugucuugggau

SEQ ID NO: 339631 - RNA, 32 nt, Human
auucuuaguuguuuucuuuagaagaacauuuc

SEQ ID NO: 339632 - RNA, 32 nt, Human
auucuuauaacauauccagccauuucaauuuu

SEQ ID NO: 339633 - RNA, 32 nt, Human
auucuuauaaucauguuauagaauguaaaugu

SEQ ID NO: 339634 - RNA, 32 nt, Human
auucuuaugagccagucuuuucuugaauuaga

SEQ ID NO: 339635 - RNA, 32 nt, Human
auucuuauuaauauuguuacuaaccuauuaac

SEQ ID NO: 339636 - RNA, 32 nt, Human
auucuuauuggaagccaggucucuccucucau

SEQ ID NO: 339637 - RNA, 32 nt, Human
auucuucaaaguagauuuccuauuacauacaa

SEQ ID NO: 339638 - RNA, 32 nt, Human
auucuucaaagucacccuaaaagaagaucuga

SEQ ID NO: 339639 - RNA, 32 nt, Human
auucuucaaaugagacucuucucaccuuaaau

SEQ ID NO: 339640 - RNA, 32 nt, Human
auucuucaacaacaguaacuaaucuuuaaaaa

SEQ ID NO: 339641 - RNA, 32 nt, Human
auucuucaacagacugucaucuggaggccugg

SEQ ID NO: 339642 - RNA, 32 nt, Human
auucuucaacagcauuaacggaguuugccaag

SEQ ID NO: 339643 - RNA, 32 nt, Human
auucuucaagcaaucacuaugucaacagacac

SEQ ID NO: 339644 - RNA, 32 nt, Human
auucuucaaggggagucagggucccucaggcu

SEQ ID NO: 339645 - RNA, 32 nt, Human
auucuucacagcaacagagcucaguuaaaugc

SEQ ID NO: 339646 - RNA, 32 nt, Human
auucuucaccucuuuucucagcucccugcagc

SEQ ID NO: 339647 - RNA, 32 nt, Human
auucuucagacagaagcugggccagcacugug

SEQ ID NO: 339648 - RNA, 32 nt, Human
auucuucagcuucauauugucuugaaaaccua

SEQ ID NO: 339649 - RNA, 24 nt, Human
auucuucaguuuuacauuaugcua

SEQ ID NO: 339650 - RNA, 32 nt, Human
auucuucauaaauacaugcauacugacacuau

SEQ ID NO: 339651 - RNA, 32 nt, Human
auucuucauuucuucuuccuacugccuccacu

SEQ ID NO: 339652 - RNA, 32 nt, Human
auucuuccagcaguucuucugauucugaagau

SEQ ID NO: 339653 - RNA, 32 nt, Human
auucuuccaggaaaacucagucuuccaacugc

SEQ ID NO: 339654 - RNA, 32 nt, Human
auucuuccauaaagaagugaucuguagaacac

SEQ ID NO: 339655 - RNA, 32 nt, Human
auucuuccaucuccuucuaaagccccucaccc

SEQ ID NO: 339656 - RNA, 32 nt, Human
auucuuccaugcuggggcugaugugggcuagu

SEQ ID NO: 339657 - RNA, 32 nt, Human
auucuucccaaggcagcuucagcuaggaguuu

SEQ ID NO: 339658 - RNA, 32 nt, Human
auucuucccugccucuucccuaacuagacaau

SEQ ID NO: 339659 - RNA, 32 nt, Human
auucuucccuggagccuacagagcaggcaggc

SEQ ID NO: 339660 - RNA, 32 nt, Human
auucuucccuugccugugggcaguggagagug

SEQ ID NO: 339661 - RNA, 32 nt, Human
auucuuccuagagaagauuauccuguccugca

SEQ ID NO: 339662 - RNA, 32 nt, Human
auucuuccucaaguaguucuuuacugcaagau

SEQ ID NO: 339663 - RNA, 32 nt, Human
auucuuccucauucauucuuuaucauccugug

SEQ ID NO: 339664 - RNA, 32 nt, Human
auuucucuccacccuaacucagaccucaccuu

SEQ ID NO: 339665 - RNA, 32 nt, Human
auuucucuccucuccuccuucugcuuaauuua

SEQ ID NO: 339666 - RNA, 32 nt, Human
auuucucucucccauaacagugcagugauagu

SEQ ID NO: 339667 - RNA, 32 nt, Human
auuucucugaguagcuucugcuaugauauucu

SEQ ID NO: 339668 - RNA, 32 nt, Human
auuucucugccucucucuccugccaugucgua

SEQ ID NO: 339669 - RNA, 32 nt, Human
auuucucugcuaggagccagccuggguggcgc

SEQ ID NO: 339670 - RNA, 32 nt, Human
auuucucugucauuuggauggcuggucaaugg

SEQ ID NO: 339671 - RNA, 32 nt, Human
auuucucuuagcagaucagcaaucccucuagg

SEQ ID NO: 339672 - RNA, 32 nt, Human
auuucucuucauuugcuuggcuuaucucauau

SEQ ID NO: 339673 - RNA, 23 nt, Human
auuucucuuccaauuacuguuca

SEQ ID NO: 339674 - RNA, 32 nt, Human
auuucucuuccauugagcuuccugccugaccc

SEQ ID NO: 339675 - RNA, 32 nt, Human
auuucucuuccuccucaccuccaccaccccuu

SEQ ID NO: 339676 - RNA, 32 nt, Human
auuucucuucgccucuccuuuucacuucuugc

SEQ ID NO: 339677 - RNA, 32 nt, Human
auuucucuucucuccacaccagaccucguuca

SEQ ID NO: 339678 - RNA, 32 nt, Human
auuucugaaaggcucuucugaaaggugguauc

SEQ ID NO: 339679 - RNA, 32 nt, Human
auuucugaagcgagcgucuucgaugccuaugu

SEQ ID NO: 339680 - RNA, 32 nt, Human
auuucugaaugugcauuuccagccuucuugcu

SEQ ID NO: 339681 - RNA, 32 nt, Human
auuucugcaaaucaagagaaacucugcagggc

SEQ ID NO: 339682 - RNA, 32 nt, Human
auuucugcacacucugggucugugcuggugga

SEQ ID NO: 339683 - RNA, 32 nt, Human
auuucugcacagacacagaucucugugccugg

SEQ ID NO: 339684 - RNA, 32 nt, Human
auuucugcacuugggcccuccucugggagccg

SEQ ID NO: 339685 - RNA, 32 nt, Human
auuucugcagcaaaccccaaagcagggugcca

SEQ ID NO: 339686 - RNA, 32 nt, Human
auuucugcagcggcaugaaagcucugcagcua

SEQ ID NO: 339687 - RNA, 32 nt, Human
auuucugcaguugagacagacccugaagaugu

SEQ ID NO: 339688 - RNA, 32 nt, Human
auuucugcaguuucgguuuucauuugcuucag

SEQ ID NO: 339689 - RNA, 32 nt, Human
auuucugcucaccgcaaccuccgccucccagg

SEQ ID NO: 339690 - RNA, 32 nt, Human
auuucuggaaacagccagugcaggaguuggug

SEQ ID NO: 339691 - RNA, 32 nt, Human
auuucuggaaucugauugagucuccacuccac

SEQ ID NO: 339692 - RNA, 32 nt, Human
auuucuggaaugcuucugcaucaaaggagauu

SEQ ID NO: 339693 - RNA, 32 nt, Human
auuucuggagugagaguaaagaggcuuaauua

SEQ ID NO: 339694 - RNA, 32 nt, Human
auuucuggccagacuuucugggucccuuucag

SEQ ID NO: 339695 - RNA, 32 nt, Human
auuucugggcagcagcauugcaggaagaggaa

SEQ ID NO: 339696 - RNA, 31 nt, Human
auuucugggucuuucugacaucagcagagaa

SEQ ID NO: 339697 - RNA, 32 nt, Human
auuucuggucccacccaccucugccuccgcca

SEQ ID NO: 339698 - RNA, 32 nt, Human
auuucuggugguuucugcccugcagaugucua

SEQ ID NO: 339699 - RNA, 32 nt, Human
auuucuggugugugcagacaugguggccauug

SEQ ID NO: 339700 - RNA, 32 nt, Human
auuucuguagcaucugccuucaucucaucuca

SEQ ID NO: 339701 - RNA, 32 nt, Human
auuucuguaguuagugaacagagcagauagag

SEQ ID NO: 339702 - RNA, 32 nt, Human
auuucuguauguucucaguaugcaucacuaga

SEQ ID NO: 339703 - RNA, 32 nt, Human
auuucuguauugcuggcaucugugcuaagcuu

SEQ ID NO: 339704 - RNA, 32 nt, Human
auuucugucucccuuccaucuuuucucccauu

SEQ ID NO: 339705 - RNA, 32 nt, Human
auuucugugagagagaaaaagagagagucaua

SEQ ID NO: 339706 - RNA, 32 nt, Human
auuucuguggaugccuuuuucucuccaaccuc

SEQ ID NO: 339707 - RNA, 32 nt, Human
auuucuguggcgucaucuuuacauucuagucc

SEQ ID NO: 339708 - RNA, 32 nt, Human
auuucugugggaggggcagagagguagguggc

SEQ ID NO: 339709 - RNA, 32 nt, Human
auuucuguguuccccuuccacccuuuaaaucu

SEQ ID NO: 339710 - RNA, 32 nt, Human
auuucuguuaggguaggaaaugaaucauaggg

SEQ ID NO: 339711 - RNA, 22 nt, Human
auuucuguucuauuucaaggcc

SEQ ID NO: 339712 - RNA, 32 nt, Human
auuucuuauauacuuuguuuucucuaaggaga

SEQ ID NO: 339713 - RNA, 32 nt, Human
auuucuucaacguuccauuccuaggugauuuu

SEQ ID NO: 339714 - RNA, 31 nt, Human
auuucuucaauaaauuuggaagagggcuggc

SEQ ID NO: 339715 - RNA, 32 nt, Human
auuucuucacugcaauugccauuugccuuuuu

SEQ ID NO: 339716 - RNA, 32 nt, Human
auuucuucagccccuucucuggcccagacccu

SEQ ID NO: 339717 - RNA, 32 nt, Human
auuucuucauaaagcaccucgauggcagggac

SEQ ID NO: 339718 - RNA, 32 nt, Human
auuucuucauuuucuuuuggaggaccgacuua

SEQ ID NO: 339719 - RNA, 32 nt, Human
auuucuuccuaaagggagagugagugauaugu

SEQ ID NO: 339720 - RNA, 32 nt, Human
auuucuuccuuucccagggccugauugguuca

SEQ ID NO: 339721 - RNA, 32 nt, Human
auuucuucgucaugcauucggcauuugcuaaa

SEQ ID NO: 339722 - RNA, 32 nt, Human
auuucuucuacccagcuuccugaucuauuuau

SEQ ID NO: 339723 - RNA, 32 nt, Human
auuucuucuccuggaguugcauugauucagua

SEQ ID NO: 339724 - RNA, 32 nt, Human
auuucuucucucucugcauaugccuggaauaa

SEQ ID NO: 339725 - RNA, 32 nt, Human
auuucuucugacaaagcugaaaaugcuagugc

SEQ ID NO: 339726 - RNA, 32 nt, Human
auuucuucuuucccucuauccaaaggagcuug

SEQ ID NO: 339727 - RNA, 32 nt, Human
auuucuucuuucucuuauuccuccuguuucgu

SEQ ID NO: 339728 - RNA, 32 nt, Human
auuucuucuuuuccuuucucuuuucuagaaau

SEQ ID NO: 339729 - RNA, 32 nt, Human
auuucuugaaguccacaggaggcacauggucc

SEQ ID NO: 339730 - RNA, 32 nt, Human
auuucuugaucuuuacucaaagaauuauucug

SEQ ID NO: 339731 - RNA, 32 nt, Human
auuucuugccaacaaauggcuagaaaggacug

SEQ ID NO: 339732 - RNA, 32 nt, Human
auuucuugccaagaggucucccaggagauauu

SEQ ID NO: 339733 - RNA, 32 nt, Human
auuucuugcccagguuccaguguguguuccaa

SEQ ID NO: 339734 - RNA, 32 nt, Human
auuucuugccuguaacccuagcacuuugggag

SEQ ID NO: 339735 - RNA, 32 nt, Human
auuucuuggaaauggacuuucaaaggcuuuaa

SEQ ID NO: 339736 - RNA, 32 nt, Human
auuucuugguuccaauaaagcauuuuacaaga

SEQ ID NO: 339737 - RNA, 32 nt, Human
auuucuugguucccuggccaggaagcaaggua

SEQ ID NO: 339738 - RNA, 32 nt, Human
auuucuuuaaaaauaaaaacaaaacuugccaa

SEQ ID NO: 339739 - RNA, 32 nt, Human
auuucuuuacagaauggauuuguuaaacuagc

SEQ ID NO: 339740 - RNA, 31 nt, Human
auuucuuucaauaaauaauuauuggauagcu

SEQ ID NO: 339741 - RNA, 32 nt, Human
auuucuuucugugccacacaauggauggcucu

SEQ ID NO: 339742 - RNA, 32 nt, Human
auuucuuugagggaucaggaaggaauccuggg

SEQ ID NO: 339743 - RNA, 32 nt, Human
auuucuuugcuacacagaggugucuuggaaag

SEQ ID NO: 339744 - RNA, 32 nt, Human
auuucuuuucaacuggcuauuucccaaggauc

SEQ ID NO: 339745 - RNA, 32 nt, Human
auuucuuuucccugaugcaggcagagcugaac

SEQ ID NO: 339746 - RNA, 32 nt, Human
auuucuuuucuuccuggcuuuuuaacuccccu

SEQ ID NO: 339747 - RNA, 32 nt, Human
auuucuuuucuuugcccuccugauucuuggcu

SEQ ID NO: 339748 - RNA, 32 nt, Human
auuucuuuugagauggaguuuugcucugucac

SEQ ID NO: 339749 - RNA, 32 nt, Human
auuucuuuugcagcuuccuauaaaguuugucu

SEQ ID NO: 339750 - RNA, 32 nt, Human
auuugaaaacaguacucaaugagacuggaaau

SEQ ID NO: 339751 - RNA, 32 nt, Human
auuugaaaaggagcccaggacagauacaaaca

SEQ ID NO: 339752 - RNA, 32 nt, Human
auuugaaaaugccagucaggguuguuucuuac

SEQ ID NO: 339753 - RNA, 32 nt, Human
auuugaaacaugugaacuauaugacauucaga

SEQ ID NO: 339754 - RNA, 21 nt, Human
auuugaaaccaaaacuugaga

SEQ ID NO: 339755 - RNA, 32 nt, Human
auuugaaaccaguuuuuaucccuucucuuucc

SEQ ID NO: 339756 - RNA, 32 nt, Human
auuugaaacucaugcaauaauuauccucagua

SEQ ID NO: 339757 - RNA, 32 nt, Human
auuugaaacuugaggaaacaugcucagagugc

SEQ ID NO: 339758 - RNA, 32 nt, Human
auuugaaagagcauugacuuugccacuuaaaa

SEQ ID NO: 339759 - RNA, 32 nt, Human
auuugaaagaguagggaugacauggaggaugc

SEQ ID NO: 339760 - RNA, 32 nt, Human
auuugaaaugaauuccucauuuggaggaaaaa

SEQ ID NO: 339761 - RNA, 32 nt, Human
auuugaaaugagggugggccagaugaguaugu

SEQ ID NO: 339762 - RNA, 32 nt, Human
auuugaacaaauuccuggcucacugagcauca

SEQ ID NO: 339763 - RNA, 32 nt, Human
auuugaacaagugggccauuagccagauuugu

SEQ ID NO: 339764 - RNA, 32 nt, Human
auuugaacccuuggaccaggcauuugcacagg

SEQ ID NO: 339765 - RNA, 32 nt, Human
auuugaaccuaccucuuuuauuuucugaacca

SEQ ID NO: 339766 - RNA, 32 nt, Human
auuugaaccuaggagguggcgguugcugugag

SEQ ID NO: 339767 - RNA, 32 nt, Human
auuugaagaagagagagccuguggggauagcc

SEQ ID NO: 339768 - RNA, 32 nt, Human
auuugaagagcuaaagagucugcagcaggauu

SEQ ID NO: 339769 - RNA, 32 nt, Human
auuugaagaggaaaggaugguggcuggguggu

SEQ ID NO: 339770 - RNA, 32 nt, Human
auuugaagcaaagggaggaagacugguagcgg

SEQ ID NO: 339771 - RNA, 32 nt, Human
auuugaaggaaaaacugugaaugacaaaaucu

SEQ ID NO: 339772 - RNA, 32 nt, Human
auuugaaggccuugagugcccucugcccaucg

SEQ ID NO: 339773 - RNA, 32 nt, Human
auuugaaggccuugagugcccucugccgaccg

SEQ ID NO: 339774 - RNA, 32 nt, Human
auuugaagguauaaccuucaugaugaauuacu

SEQ ID NO: 339775 - RNA, 32 nt, Human
auuugaaggucugcaagaaccugacucgucug

SEQ ID NO: 339776 - RNA, 32 nt, Human
auuugaaguaauguuuuaguaaggagagauua

SEQ ID NO: 339777 - RNA, 32 nt, Human
auuugaaguauuagaagaaagugugccaugag

SEQ ID NO: 339778 - RNA, 32 nt, Human
auuugaaguguauguaacuuagcuuauguuaa

SEQ ID NO: 339779 - RNA, 32 nt, Human
auuugaauagaugcugauaaauuugauucucu

SEQ ID NO: 339780 - RNA, 32 nt, Human
auuugaauagggucuuccaaauccagacucca

SEQ ID NO: 339781 - RNA, 32 nt, Human
auuugaauccagagaagagcgagcugaggcug

SEQ ID NO: 339782 - RNA, 32 nt, Human
auuugaaucucaggacucuucuggccguaggu

SEQ ID NO: 339783 - RNA, 32 nt, Human
auuugaaugcauggguagaaaauaucauauuu

SEQ ID NO: 339784 - RNA, 32 nt, Human
auuugaauguauuuuuauauucucuugauaau

SEQ ID NO: 339785 - RNA, 32 nt, Human
auuugaaugucauuguccuugagacccuacau

SEQ ID NO: 339786 - RNA, 32 nt, Human
auuugaauuucagcuuaaucaugugggauuua

SEQ ID NO: 339787 - RNA, 32 nt, Human
auuugaauuuucuuccccaaccugagugcuuu

SEQ ID NO: 339788 - RNA, 32 nt, Human
auuugacagauggcaaaacugaggcuuaaaga

SEQ ID NO: 339789 - RNA, 32 nt, Human
auuugacagcuuuccuuggugacccaaaccuu

SEQ ID NO: 339790 - RNA, 32 nt, Human
auuugacaggaaauuaggaugagcacgagcaa

SEQ ID NO: 339791 - RNA, 32 nt, Human
auuugacagggaggggccagcagugagcugca

SEQ ID NO: 339792 - RNA, 17 nt, Human
auuugacauaccuuaga

SEQ ID NO: 339793 - RNA, 32 nt, Human
auuugacauccucucuggauucccaaggagca

SEQ ID NO: 339794 - RNA, 32 nt, Human
auuugaccaucccugggggccuggcugcugac

SEQ ID NO: 339795 - RNA, 32 nt, Human
auuugaccuuaaaucuccagugacucagagcu

SEQ ID NO: 339796 - RNA, 32 nt, Human
auuugacuaagaaaucacccagcuuuaaagcu

SEQ ID NO: 339797 - RNA, 31 nt, Human
auuugacucaauaaagacuucuugaaugacu

SEQ ID NO: 339798 - RNA, 32 nt, Human
auuugacuccacccucaucacccacacucccu

SEQ ID NO: 339799 - RNA, 32 nt, Human
auuugacugcaacucuugucgucuuauguggg

SEQ ID NO: 339800 - RNA, 32 nt, Human
auuugacugguuccauuacauuuccuuuuggu

SEQ ID NO: 339801 - RNA, 32 nt, Human
auuugagaaaauaucugguucacuuacacuac

SEQ ID NO: 339802 - RNA, 32 nt, Human
auuugagaaacagcagguggguguggccaaag

SEQ ID NO: 339803 - RNA, 32 nt, Human
auuugagaagaaaaucagagagggaagaucug

SEQ ID NO: 339804 - RNA, 32 nt, Human
auuugagaagcaaacaauuacaugucauguca

SEQ ID NO: 339805 - RNA, 32 nt, Human
auuugagaaggugauuuaagguguggacauuu

SEQ ID NO: 339806 - RNA, 32 nt, Human
auuugagaauaguuucaucucagcccccauua

SEQ ID NO: 339807 - RNA, 32 nt, Human
auuugagaccagccuggccaacauagugaaac

SEQ ID NO: 339808 - RNA, 32 nt, Human
auuugagaccagccugggcaacauagugagug

SEQ ID NO: 339809 - RNA, 32 nt, Human
auuugagaccagccuggguaacauagugagac

SEQ ID NO: 339810 - RNA, 32 nt, Human
auuugagagagcauuuacucugucucccugug

SEQ ID NO: 339811 - RNA, 32 nt, Human
auuugagagagggagagaaggcccuugccacg

SEQ ID NO: 339812 - RNA, 32 nt, Human
auuugagaggcugaggugggaggaucauuuga

SEQ ID NO: 339813 - RNA, 32 nt, Human
auuugagaugcagaggaaugagcuugagccuu

SEQ ID NO: 339814 - RNA, 32 nt, Human
auuugagaugccagauuccuuggaaguagaga

SEQ ID NO: 339815 - RNA, 32 nt, Human
auuugagauguuugggauuaagccauacaauu

SEQ ID NO: 339816 - RNA, 32 nt, Human
auuugagcacauuagguuuugugucuucauuc

SEQ ID NO: 339817 - RNA, 32 nt, Human
auuugagcauagcaagugaguuuugaauccca

SEQ ID NO: 339818 - RNA, 32 nt, Human
auuugagcaucaggaaaacuguugaaggguua

SEQ ID NO: 339819 - RNA, 32 nt, Human
auuugagccaggagguugagguugcagugagc

SEQ ID NO: 339820 - RNA, 32 nt, Human
auuugagccaucauuucacuucugauuuuaag

SEQ ID NO: 339821 - RNA, 32 nt, Human
auuugagcccagagguagaggcugcagugagc

SEQ ID NO: 339822 - RNA, 32 nt, Human
auuugagcccaggaauuugaggcugcagugag

SEQ ID NO: 339823 - RNA, 32 nt, Human
auuugagcccaggaggcugaggcugcaaugac

SEQ ID NO: 339824 - RNA, 32 nt, Human
auuugagcccaggaggucaaggcugcagugag

SEQ ID NO: 339825 - RNA, 32 nt, Human
auuugagcccaggaguuugagaccagcugggg

SEQ ID NO: 339826 - RNA, 32 nt, Human
auuugagcccaggaguuugaggcugcagugag

SEQ ID NO: 339827 - RNA, 32 nt, Human
auuugagcccagggguuugaagcuucagugag

SEQ ID NO: 339828 - RNA, 32 nt, Human
auuugagcccccaggggugggguggacgcgug

SEQ ID NO: 339829 - RNA, 32 nt, Human
auuugagccuaggaggucaaggcugcagugag

SEQ ID NO: 339830 - RNA, 32 nt, Human
auuugagccugggagaucgaggcugcagugag

SEQ ID NO: 339831 - RNA, 32 nt, Human
auuugagccuugcugguuugacauugggugcc

SEQ ID NO: 339832 - RNA, 32 nt, Human
auuugagcuuucuccccucccgcuaguaucuu

SEQ ID NO: 339833 - RNA, 30 nt, Human
auuugaggaagccgcaggguugacaaccau

SEQ ID NO: 339834 - RNA, 32 nt, Human
auuugaggacaguccugugugacucagaggcc

SEQ ID NO: 339835 - RNA, 32 nt, Human
auuugaggacaucuaucguauucuugugugcu

SEQ ID NO: 339836 - RNA, 32 nt, Human
auuugaggagcacaauacagagauuuuaaaaa

SEQ ID NO: 339837 - RNA, 32 nt, Human
auuugaggccaggcguggaggcucacaccuau

SEQ ID NO: 339838 - RNA, 32 nt, Human
auuugaggccuauagauuuagcuuaagagaac

SEQ ID NO: 339839 - RNA, 32 nt, Human
auuugaggcggcugcuggaggcugguucccuc

SEQ ID NO: 339840 - RNA, 32 nt, Human
auuugaggcuggaugcaguggcucacgccuac

SEQ ID NO: 339841 - RNA, 32 nt, Human
auuugaggcuuagggguagucauuccaucuuu

SEQ ID NO: 339842 - RNA, 32 nt, Human
auuugagggaggcagaagucugcaguugaaga

SEQ ID NO: 339843 - RNA, 32 nt, Human
auuugagggguaauuuuuaagcaguaaaaaga

SEQ ID NO: 339844 - RNA, 32 nt, Human
auuugaguagaggcacagucuguaucccaucu

SEQ ID NO: 339845 - RNA, 32 nt, Human
auuugaguagccacuuauucaccagaguugga

SEQ ID NO: 339846 - RNA, 32 nt, Human
auuugaguagucugcauuuuggcaacuccucu

SEQ ID NO: 339847 - RNA, 32 nt, Human
auuugaguauuuuuauaaugucucuuuuaaag

SEQ ID NO: 339848 - RNA, 32 nt, Human
auuugagucuauguauucugaccucagaacua

SEQ ID NO: 339849 - RNA, 32 nt, Human
auuugagugcaggaguucaaggacagccuggg

SEQ ID NO: 339850 - RNA, 32 nt, Human
auuugaguuagcaacacuguuuucuuuacgag

SEQ ID NO: 339851 - RNA, 32 nt, Human
auuugaguucaggaguucgaguuacagccugg

SEQ ID NO: 339852 - RNA, 32 nt, Human
auuugaguucuugagaauaaagccacugggcc

SEQ ID NO: 339853 - RNA, 32 nt, Human
auuugaguuuuaaauucucacacugagguaaa

SEQ ID NO: 339854 - RNA, 32 nt, Human
auuugaguuuuagcaagaguccugagggcggg

SEQ ID NO: 339855 - RNA, 32 nt, Human
auuugauaacuaagaggaagacuugcaaagcc

SEQ ID NO: 339856 - RNA, 32 nt, Human
auuugauauaauucuggauggaagaccucuua

SEQ ID NO: 339857 - RNA, 32 nt, Human
auuugauaucccuuucuccauucuagguuuuu

SEQ ID NO: 339858 - RNA, 32 nt, Human
auuugauccaagcagguuggggaacauauugg

SEQ ID NO: 339859 - RNA, 32 nt, Human
auuugauccucccagggcccugccagguuguu

SEQ ID NO: 339860 - RNA, 32 nt, Human
auuugaugacaugcagcauuacuuaguucugu

SEQ ID NO: 339861 - RNA, 32 nt, Human
auuugaugcaccugggaggccaugucucccgg

SEQ ID NO: 339862 - RNA, 32 nt, Human
auuugaugcuuagaauuuuaaaccugaagaga

SEQ ID NO: 339863 - RNA, 31 nt, Human
auuugauggacaaaauuaccgccaccaacac

SEQ ID NO: 339864 - RNA, 32 nt, Human
auuugauggagggagcagggacauagcacauu

SEQ ID NO: 339865 - RNA, 32 nt, Human
auuugauggcccaugugggaucaaaggccacu

SEQ ID NO: 339866 - RNA, 32 nt, Human
auuugauguaccugggaggccaugucucccgg

SEQ ID NO: 339867 - RNA, 32 nt, Human
auuugauuagaauuugaaaauaaaucacauuu

SEQ ID NO: 339868 - RNA, 32 nt, Human
auuugauucauacuggaaucucugguucauuu

SEQ ID NO: 339869 - RNA, 32 nt, Human
auuugauugcuguauauggauacauggcuguu

SEQ ID NO: 339870 - RNA, 32 nt, Human
auuugauuuccaagucagguagaucauuggcc

SEQ ID NO: 339871 - RNA, 32 nt, Human
auuugauuuuacugcugauuucacagcuccuu

SEQ ID NO: 339872 - RNA, 32 nt, Human
auuugcaaaacacacauaauaccgucagagug

SEQ ID NO: 339873 - RNA, 32 nt, Human
auuugcaaaacaucaucuaaaauuuaaauuug

SEQ ID NO: 339874 - RNA, 32 nt, Human
auuugcaaagucugcugacaauguuauuuaca

SEQ ID NO: 339875 - RNA, 32 nt, Human
auuugcaaaugcugucaaaacaugcuuuccuu

SEQ ID NO: 339876 - RNA, 32 nt, Human
auuugcaaugcacuuguauacacuucaaaaau

SEQ ID NO: 339877 - RNA, 32 nt, Human
auuugcaauguuuguccuucucugccuguugc

SEQ ID NO: 339878 - RNA, 32 nt, Human
auuugcacaagucaccuuggacugcagggagc

SEQ ID NO: 339879 - RNA, 32 nt, Human
auuugcacacaaaaauaaagacuagagcaaaa

SEQ ID NO: 339880 - RNA, 32 nt, Human
auuugcacccacugcauuugcagccuugaggu

SEQ ID NO: 339881 - RNA, 32 nt, Human
auuugcaccgcuguacuccagccugggcaaca

SEQ ID NO: 339882 - RNA, 22 nt, Human
auuugcaccucuguucauuuca

SEQ ID NO: 339883 - RNA, 32 nt, Human
auuugcacuaucugcuuaaugagcaaaucugu

SEQ ID NO: 339884 - RNA, 32 nt, Human
auuugcacuucacuuuguuggaauaucccaua

SEQ ID NO: 339885 - RNA, 32 nt, Human
auuugcacuuccaauagaccagggauugacca

SEQ ID NO: 339886 - RNA, 32 nt, Human
auuugcagaauguaagugauuucuccagcagu

SEQ ID NO: 339887 - RNA, 32 nt, Human
auuugcagaggaagaaugagaacccuggaaag

SEQ ID NO: 339888 - RNA, 32 nt, Human
auuugcagaguguugggacugucauuugugau

SEQ ID NO: 339889 - RNA, 32 nt, Human
auuugcagcccccagcccuggguucaaguccc

SEQ ID NO: 339890 - RNA, 32 nt, Human
auuugcagccuaacuucucuuuuccuuuuaaa

SEQ ID NO: 339891 - RNA, 32 nt, Human
auuugcagccugacaaugagacaggaaagaaa

SEQ ID NO: 339892 - RNA, 32 nt, Human
auuugcagcuauucuggaugucaguuuaauaa

SEQ ID NO: 339893 - RNA, 32 nt, Human
auuugcagggccaccuggaggcuggggugcug

SEQ ID NO: 339894 - RNA, 32 nt, Human
auuugcauaccagccaguguuguccagcacuu

SEQ ID NO: 339895 - RNA, 32 nt, Human
auuugcaucacugaggaugaaacugacuuuug

SEQ ID NO: 339896 - RNA, 32 nt, Human
auuugcaucauuuccccucucuggcuccaauu

SEQ ID NO: 339897 - RNA, 32 nt, Human
auuugcaucauuuugucccuuguaaaucaaga

SEQ ID NO: 339898 - RNA, 32 nt, Human
auuugcauccaccuucccuucugacucacguu

SEQ ID NO: 339899 - RNA, 32 nt, Human
auuugcauccaccuucccuucugacucagguu

SEQ ID NO: 339900 - RNA, 32 nt, Human
auuugcaugggcagggacagaauaauaugacu

SEQ ID NO: 339901 - RNA, 32 nt, Human
auuugcauuucuaacacauucucagcugaugc

SEQ ID NO: 339902 - RNA, 32 nt, Human
auuugcauuuuagugguuagggagaggauaua

SEQ ID NO: 339903 - RNA, 32 nt, Human
auuugccaagauuuuccagccaaaaaggauua

SEQ ID NO: 339904 - RNA, 32 nt, Human
auuugccacuggcuauaaacaccucccucagg

SEQ ID NO: 339905 - RNA, 32 nt, Human
auuugccagcagucugagcuucuaccgagucu

SEQ ID NO: 339906 - RNA, 32 nt, Human
auuugccauacaguaaccagagaccuccaacu

SEQ ID NO: 339907 - RNA, 32 nt, Human
auuugccaucucccagcagaagaaggaugugc

SEQ ID NO: 339908 - RNA, 32 nt, Human
auuugcccaccagcuucuccucuggagccuga

SEQ ID NO: 339909 - RNA, 32 nt, Human
auuugcccaguuuuuaauuacacugagauaau

SEQ ID NO: 339910 - RNA, 32 nt, Human
auuugcccauuuccaagccaguacaguaaaug

SEQ ID NO: 339911 - RNA, 32 nt, Human
auuugccccucaccugcccuuggugagccuuu

SEQ ID NO: 339912 - RNA, 32 nt, Human
auuugccccuggcaaaugcacacaccucaugc

SEQ ID NO: 339913 - RNA, 32 nt, Human
auuugccccuggcaaaugcauacaccucaugc

SEQ ID NO: 339914 - RNA, 26 nt, Human
auuugccccuggcuaucaucauccua

SEQ ID NO: 339915 - RNA, 29 nt, Human
auuugccccuggcuaucaucauccuacau

SEQ ID NO: 339916 - RNA, 32 nt, Human
auuugcccgccucugccuccccaaagugcugg

SEQ ID NO: 339917 - RNA, 32 nt, Human
auuugccguguucccuuccuccugucacugca

SEQ ID NO: 339918 - RNA, 32 nt, Human
auuugccuacuauccugaauuugccuacuauc

SEQ ID NO: 339919 - RNA, 32 nt, Human
auuugccuaggacuucucagcuucucccauag

SEQ ID NO: 339920 - RNA, 32 nt, Human
auuugccuauugccuaucgccucucucuccca

SEQ ID NO: 339921 - RNA, 32 nt, Human
auuugccucauucagacugagacagggcuguu

SEQ ID NO: 339922 - RNA, 32 nt, Human
auuugccucccaggaggaagccagggcagggu

SEQ ID NO: 339923 - RNA, 32 nt, Human
auuugccuccuccagagggacauggcaauguu

SEQ ID NO: 339924 - RNA, 32 nt, Human
auuugccucucaagcagccucuggucaucuau

SEQ ID NO: 339925 - RNA, 32 nt, Human
auuugccucugaguuucagaugaccucucugu

SEQ ID NO: 339926 - RNA, 32 nt, Human
auuugccucuuuauggaaaaaguuugccauuc

SEQ ID NO: 339927 - RNA, 32 nt, Human
auuugccuguucugggcauuucaugucaaugg

SEQ ID NO: 339928 - RNA, 32 nt, Human
auuugccuguucuuacccuuugcucauguauc

SEQ ID NO: 339929 - RNA, 32 nt, Human
auuugccuguuucugcuugcucuuguccuagc

SEQ ID NO: 339930 - RNA, 32 nt, Human
auuugccuuauaacugacauuucuucaaauua

SEQ ID NO: 339931 - RNA, 32 nt, Human
auuugccuucucugagcuucaguuuccuucua

SEQ ID NO: 339932 - RNA, 32 nt, Human
auuugccuuggccuugcccugagaaggugcug

SEQ ID NO: 339933 - RNA, 32 nt, Human
auuugccuuuaagaguuacuuuuguugaaugu

SEQ ID NO: 339934 - RNA, 32 nt, Human
auuugccuuugccccggcuugccuguaauccc

SEQ ID NO: 339935 - RNA, 32 nt, Human
auuugcgaggcacccaguaccuccauuagugu

SEQ ID NO: 339936 - RNA, 32 nt, Human
auuugcgccacugcauucuagccugagugaca

SEQ ID NO: 339937 - RNA, 32 nt, Human
auuugcgcuguuucagccuccugauucaacuc

SEQ ID NO: 339938 - RNA, 32 nt, Human
auuugcggaaugaaugaacacccugucugcag

SEQ ID NO: 339939 - RNA, 32 nt, Human
auuugcuaaaagggaugcugaggcucugggag

SEQ ID NO: 339940 - RNA, 32 nt, Human
auuugcuagagggagggagcagccacggaguu

SEQ ID NO: 339941 - RNA, 32 nt, Human
auuugcucacccucaaacugucucagcccucu

SEQ ID NO: 339942 - RNA, 32 nt, Human
auuugcucagugauggcagacaagauggcugu

SEQ ID NO: 339943 - RNA, 32 nt, Human
auuugcucccguggagcuucaucgggguggug

SEQ ID NO: 339944 - RNA, 32 nt, Human
auuugcucuagggaaucagggaagaaagauac

SEQ ID NO: 339945 - RNA, 32 nt, Human
auuugcugauccgucugcuccagcauagguuc

SEQ ID NO: 339946 - RNA, 32 nt, Human
auuugcugcucccugaaucuucuacugaacau

SEQ ID NO: 339947 - RNA, 32 nt, Human
auuugcugcuuuguugcaaguugauauaacug

SEQ ID NO: 339948 - RNA, 32 nt, Human
auuugcugggagaggguguugaguucacugug

SEQ ID NO: 339949 - RNA, 32 nt, Human
auuugcugucuucacugugcagcuaucacagg

SEQ ID NO: 339950 - RNA, 31 nt, Human
auuugcuuaguaaaugccuguugaugguuuu

SEQ ID NO: 339951 - RNA, 32 nt, Human
auuugcuucaaaauagaaucggauaaguuuaa

SEQ ID NO: 339952 - RNA, 32 nt, Human
auuugcuuccaucauccagccccugggcaaca

SEQ ID NO: 339953 - RNA, 32 nt, Human
auuugcuucccaaggcacacacuguccccaca

SEQ ID NO: 339954 - RNA, 32 nt, Human
auuugcuuccucuagacuacagcagggaaagg

SEQ ID NO: 339955 - RNA, 32 nt, Human
auuugcuuccucugacaaguuaccucaccuaa

SEQ ID NO: 339956 - RNA, 32 nt, Human
auuugcuucucccagcccaccucaagcagucu

SEQ ID NO: 339957 - RNA, 32 nt, Human
auuugcuucucccuccccaaccaccucauggu

SEQ ID NO: 339958 - RNA, 32 nt, Human
auuugcuucucuuucuccucaacucgacugac

SEQ ID NO: 339959 - RNA, 32 nt, Human
auuugcuucuuacccuguguuuucugcaaacu

SEQ ID NO: 339960 - RNA, 32 nt, Human
auuugcuugggcucccccuucauggccucugc

SEQ ID NO: 339961 - RNA, 32 nt, Human
auuugcuuguaagaguaacguuaaagguuuaa

SEQ ID NO: 339962 - RNA, 32 nt, Human
auuugcuuugacuguaaguguagaacaggacg

SEQ ID NO: 339963 - RNA, 32 nt, Human
auuugcuuugagagcuacaggaaaugguuguu

SEQ ID NO: 339964 - RNA, 22 nt, Human
auuuggaaaacccugagucuaa

SEQ ID NO: 339965 - RNA, 32 nt, Human
auuuggaaaaugugaucaauugaaaucaacug

SEQ ID NO: 339966 - RNA, 32 nt, Human
auuuggaaauccuaguuuccucuccuucguau

SEQ ID NO: 339967 - RNA, 32 nt, Human
auuuggaaaugaggacugucuugggaaaaggg

SEQ ID NO: 339968 - RNA, 32 nt, Human
auuuggaacaccauuccagaccaaaauugaaa

SEQ ID NO: 339969 - RNA, 32 nt, Human
auuuggaagaaacaaauuuaaauaaguucuaa

SEQ ID NO: 339970 - RNA, 32 nt, Human
auuuggaagggaagccggaaauccagauuuaa

SEQ ID NO: 339971 - RNA, 32 nt, Human
auuuggaaugagcagucuuccauuccaacuuu

SEQ ID NO: 339972 - RNA, 31 nt, Human
auuuggaauguggaaaggagguagaagucau

SEQ ID NO: 339973 - RNA, 32 nt, Human
auuuggaauucuaucagauaaauuuaacaaug

SEQ ID NO: 339974 - RNA, 32 nt, Human
auuuggacacagaaagacacaaacaaggagaa

SEQ ID NO: 339975 - RNA, 32 nt, Human
auuuggagaagaggcaugaccuuuguauuuca

SEQ ID NO: 339976 - RNA, 32 nt, Human
auuuggagaggaaggauggagguggacucuca

SEQ ID NO: 339977 - RNA, 32 nt, Human
auuuggagcauccauggauugcagugaucauu

SEQ ID NO: 339978 - RNA, 32 nt, Human
auuuggagcaugccauuggaaaacccaccccc

SEQ ID NO: 339979 - RNA, 32 nt, Human
auuuggagccaccucugcuucucagccccacc

SEQ ID NO: 339980 - RNA, 32 nt, Human
auuuggaggccccauucuaggacucuggggau

SEQ ID NO: 339981 - RNA, 32 nt, Human
auuuggagggccugggccuggcucccucacuc

SEQ ID NO: 339982 - RNA, 32 nt, Human
auuuggagguggggcuuuugggaggugauuag

SEQ ID NO: 339983 - RNA, 32 nt, Human
auuuggagguggggcuuuugguaagugauagg

SEQ ID NO: 339984 - RNA, 32 nt, Human
auuuggaucaaauugcuacuaugauaggaaau

SEQ ID NO: 339985 - RNA, 32 nt, Human
auuuggaucucacgcugccucugugguucccu

SEQ ID NO: 339986 - RNA, 32 nt, Human
auuuggaugagacugauuagggaggggauuug

SEQ ID NO: 339987 - RNA, 32 nt, Human
auuuggaugagguugaggugagaucaggucac

SEQ ID NO: 339988 - RNA, 32 nt, Human
auuuggauguuuggcguugcacacacacaucc

SEQ ID NO: 339989 - RNA, 32 nt, Human
auuuggauuauucuauauaauuuuggacuuuu

SEQ ID NO: 339990 - RNA, 32 nt, Human
auuuggauucaguccuugccagccuggcuggu

SEQ ID NO: 339991 - RNA, 32 nt, Human
auuuggauugccuuacuucucuugccuuaaau

SEQ ID NO: 339992 - RNA, 32 nt, Human
auuuggauuguugcgccucugcucugaagaaa

SEQ ID NO: 339993 - RNA, 32 nt, Human
auuuggauuucccuuauuucucucauaagcgu

SEQ ID NO: 339994 - RNA, 32 nt, Human
auuuggauuugcucauagaggagcagauagga

SEQ ID NO: 339995 - RNA, 32 nt, Human
auuuggauuuggagaagaguuucuugaacauu

SEQ ID NO: 339996 - RNA, 32 nt, Human
auuuggauuuggagaugguggcuuccagaugu

SEQ ID NO: 339997 - RNA, 32 nt, Human
auuuggcaacccaaggaaccauuugcuuaaac

SEQ ID NO: 339998 - RNA, 32 nt, Human
auuuggcacagcaaaaagcccacccaggacuu

SEQ ID NO: 339999 - RNA, 32 nt, Human
auuuggcagcauggugagggcucuggccccag

SEQ ID NO: 340000 - RNA, 32 nt, Human
auuuggcagcucacugaucucuugccucugcu

SEQ ID NO: 340001 - RNA, 32 nt, Human
auuuggcaugaaggauauggugcucuauuugu

SEQ ID NO: 340002 - RNA, 23 nt, Human
auuuggcaugugugugugaaaua

SEQ ID NO: 340003 - RNA, 32 nt, Human
auuuggccacauuuggccuggugacagaacug

SEQ ID NO: 340004 - RNA, 32 nt, Human
auuuggccagagacacaccuggcccucagggg

SEQ ID NO: 340005 - RNA, 32 nt, Human
auuuggccauugauauucaacaggucacugac

SEQ ID NO: 340006 - RNA, 32 nt, Human
auuuggcccagccuguacuggugugccgcaau

SEQ ID NO: 340007 - RNA, 32 nt, Human
auuuggccccuggcuccuccagccugaaugag

SEQ ID NO: 340008 - RNA, 32 nt, Human
auuuggccggcucugguggccacugagcuggc

SEQ ID NO: 340009 - RNA, 32 nt, Human
auuuggccugugaacuuggcugugccagggcu

SEQ ID NO: 340010 - RNA, 32 nt, Human
auuuggccuuguggaggguguuccuagguaga

SEQ ID NO: 340011 - RNA, 32 nt, Human
auuuggccuuucuuucuuucuguaccuucaag

SEQ ID NO: 340012 - RNA, 32 nt, Human
auuuggcuacuguaaacauggcugguggaaaa

SEQ ID NO: 340013 - RNA, 32 nt, Human
auuuggcuacuucccugucccucugacuccua

SEQ ID NO: 340014 - RNA, 32 nt, Human
auuuggcucuggagguggccuguucagugggg

SEQ ID NO: 340015 - RNA, 32 nt, Human
auuuggcugggccucuggauggaaggucuggu

SEQ ID NO: 340016 - RNA, 32 nt, Human
auuuggcuuuaucaucuucacuugacuguuug

SEQ ID NO: 340017 - RNA, 32 nt, Human
auuugggaaccagcuuaggcaaaagagucccc

SEQ ID NO: 340018 - RNA, 32 nt, Human
auuugggaaucaaggcaacagauggauuagga

SEQ ID NO: 340019 - RNA, 32 nt, Human
auuugggagagggaugcccaggaacgccucau

SEQ ID NO: 340020 - RNA, 32 nt, Human
auuugggagcauauccuugucacugcagccag

SEQ ID NO: 340021 - RNA, 32 nt, Human
auuugggaggccaagaugggaggaucacuuga

SEQ ID NO: 340022 - RNA, 32 nt, Human
auuugggaggccaaggaaggaggaaugcuuga

SEQ ID NO: 340023 - RNA, 32 nt, Human
auuugggaggccaaggugggcagaucacuuga

SEQ ID NO: 340024 - RNA, 32 nt, Human
auuugggaggcugaggcaagagaaucauuuga

SEQ ID NO: 340025 - RNA, 32 nt, Human
auuugggaggcugaggcagaagaaucacuuga

SEQ ID NO: 340026 - RNA, 32 nt, Human
auuugggaggcugaggcagaagaaucgcuuga

SEQ ID NO: 340027 - RNA, 32 nt, Human
auuugggaggcugaggcaggagaaucacuuga

SEQ ID NO: 340028 - RNA, 32 nt, Human
auuugggaggcugaggcaggagaaucgcuuga

SEQ ID NO: 340029 - RNA, 32 nt, Human
auuugggaggcugaggcaggagaaucgguuga

SEQ ID NO: 340030 - RNA, 32 nt, Human
auuugggaggcugaggcaggaggaucgcuuga

SEQ ID NO: 340031 - RNA, 32 nt, Human
auuugggaggcugaggcaggcagaucaccuga

SEQ ID NO: 340032 - RNA, 32 nt, Human
auuugggaggcugaggcaggcagaucacguga

SEQ ID NO: 340033 - RNA, 32 nt, Human
auuugggaggcugaggcaguagaaucgcuuga

SEQ ID NO: 340034 - RNA, 32 nt, Human
auuugggaggcugaggcgagaggaucacuuga

SEQ ID NO: 340035 - RNA, 32 nt, Human
auuugggaggcugaggcggauggaucacuuga

SEQ ID NO: 340036 - RNA, 32 nt, Human
auuugggaggcugaggcgggaggaucacuuga

SEQ ID NO: 340037 - RNA, 32 nt, Human
auuugggaggcugaggcuggaggauugcuuaa

SEQ ID NO: 340038 - RNA, 32 nt, Human
auuugggaggcugaggcuggcggaucaugagg

SEQ ID NO: 340039 - RNA, 32 nt, Human
auuugggaggcugaggugggagaaucacuuga

SEQ ID NO: 340040 - RNA, 32 nt, Human
auuugggaggcugaggugggcagaucacuuga

SEQ ID NO: 340041 - RNA, 32 nt, Human
auuugggaggcugaggugggcggaucaugagg

SEQ ID NO: 340042 - RNA, 32 nt, Human
auuugggaggcugauguggguggauuaccuga

SEQ ID NO: 340043 - RNA, 32 nt, Human
auuugggaguaguggccaggggcccuggacgc

SEQ ID NO: 340044 - RNA, 32 nt, Human
auuugggaguggcgacagggaaugggagcucg

SEQ ID NO: 340045 - RNA, 32 nt, Human
auuugggauaccagauagcucaauacucucug

SEQ ID NO: 340046 - RNA, 32 nt, Human
auuugggaucuugaaucaggaagcugauucaa

SEQ ID NO: 340047 - RNA, 32 nt, Human
auuugggaugagcccucucaggaauccugugg

SEQ ID NO: 340048 - RNA, 32 nt, Human
auuugggaugcagaggaggagccguagccucg

SEQ ID NO: 340049 - RNA, 32 nt, Human
auuugggcauggcaucuucaaaacaauuaauu

SEQ ID NO: 340050 - RNA, 32 nt, Human
auuugggcauuucucguuucucaaguguaugc

SEQ ID NO: 340051 - RNA, 32 nt, Human
auuugggcucagccuuggacauggaggccuga

SEQ ID NO: 340052 - RNA, 32 nt, Human
auuugggcugucuuguauguuuuuaugcuccu

SEQ ID NO: 340053 - RNA, 32 nt, Human
auuuggggaaacacaacguugaaaacuuccua

SEQ ID NO: 340054 - RNA, 32 nt, Human
auuuggggaaggaaaagaaaguaguuguuuua

SEQ ID NO: 340055 - RNA, 32 nt, Human
auuuggggaaggagggaggaaauaugucccuu

SEQ ID NO: 340056 - RNA, 32 nt, Human
auuuggggaaugaucucuggaggcagaaugag

SEQ ID NO: 340057 - RNA, 32 nt, Human
auuuggggagagauagggugggaggcagggca

SEQ ID NO: 340058 - RNA, 32 nt, Human
auuuggggagcagcgguucuccuuauuuuucu

SEQ ID NO: 340059 - RNA, 32 nt, Human
auuuggggaggcaggcugggccaaaggguaga

SEQ ID NO: 340060 - RNA, 32 nt, Human
auuuggggauucacuguuucagaggacacaga

SEQ ID NO: 340061 - RNA, 32 nt, Human
auuugggggccagaggauccagguguacaugu

SEQ ID NO: 340062 - RNA, 32 nt, Human
auuuggggguguacuguccugccugugcaucu

SEQ ID NO: 340063 - RNA, 32 nt, Human
auuuggggugaguggguggugggagccuggag

SEQ ID NO: 340064 - RNA, 32 nt, Human
auuuggggugccaaagguuggggguaggauau

SEQ ID NO: 340065 - RNA, 32 nt, Human
auuuggggugggcucuucaacaucucaggcug

SEQ ID NO: 340066 - RNA, 32 nt, Human
auuuggggugguugauuagacuuuugaaaaac

SEQ ID NO: 340067 - RNA, 32 nt, Human
auuugggguuuggcauccugcccagccacuuc

SEQ ID NO: 340068 - RNA, 32 nt, Human
auuuggguauauguggaaguuccuggaaccaa

SEQ ID NO: 340069 - RNA, 32 nt, Human
auuugggucagagcuccccucccuucagauua

SEQ ID NO: 340070 - RNA, 31 nt, Human
auuuggguccugggagggugggugaaauaaa

SEQ ID NO: 340071 - RNA, 32 nt, Human
auuuggguggacuccagccuccccagcaacaa

SEQ ID NO: 340072 - RNA, 32 nt, Human
auuuggguugucugucuugucuucucauuuua

SEQ ID NO: 340073 - RNA, 32 nt, Human
auuuggguuguuuccagguuugggcuguuaca

SEQ ID NO: 340074 - RNA, 32 nt, Human
auuuggguuucuguuccuguguuaguuugcuu

SEQ ID NO: 340075 - RNA, 32 nt, Human
auuugguaaagcagcuaugcugugcuguggga

SEQ ID NO: 340076 - RNA, 32 nt, Human
auuugguaaguggccuccacuuaaacgacuua

SEQ ID NO: 340077 - RNA, 32 nt, Human
auuugguagcagcuccaacagggguccagccu

SEQ ID NO: 340078 - RNA, 32 nt, Human
auuugguaggaagaggaagcauuuagaaaggg

SEQ ID NO: 340079 - RNA, 32 nt, Human
auuugguagucugaaauggugacagauuacuu

SEQ ID NO: 340080 - RNA, 32 nt, Human
auuugguauggauucacuuuuuacuuauguua

SEQ ID NO: 340081 - RNA, 32 nt, Human
auuuggucaccaaaaaugaaauaauaguuuaa

SEQ ID NO: 340082 - RNA, 32 nt, Human
auuugguccauguccgaguccggccuuuggag

SEQ ID NO: 340083 - RNA, 32 nt, Human
auuugguccccuggacugucuuuguugauucu

SEQ ID NO: 340084 - RNA, 32 nt, Human
auuuggucucagaauuuagguuccuucccugu

SEQ ID NO: 340085 - RNA, 32 nt, Human
auuuggugacuagaaaggcaagggaggcauag

SEQ ID NO: 340086 - RNA, 32 nt, Human
auuuggugagagggguggagguggcaggcagg

SEQ ID NO: 340087 - RNA, 32 nt, Human
auuuggugcaugggaugggcucaguugggcag

SEQ ID NO: 340088 - RNA, 32 nt, Human
auuugguguggaaugaguguuucugaacugug

SEQ ID NO: 340089 - RNA, 32 nt, Human
auuugguguuuaaguuggagucugggcacugg

SEQ ID NO: 340090 - RNA, 32 nt, Human
auuugguuaaugacuuaugagcaagcugguuu

SEQ ID NO: 340091 - RNA, 32 nt, Human
auuugguucugacuucuguggcuguuuaaaau

SEQ ID NO: 340092 - RNA, 32 nt, Human
auuugguucugcuuuuugaccucucucuaccu

SEQ ID NO: 340093 - RNA, 32 nt, Human
auuugguugccugggaccuggaaaguguuuag

SEQ ID NO: 340094 - RNA, 32 nt, Human
auuugguugggaacagcugaauacuaggaaua

SEQ ID NO: 340095 - RNA, 32 nt, Human
auuugguuucagaaccaaagaccucagcuccc

SEQ ID NO: 340096 - RNA, 32 nt, Human
auuugguuucaguuguuuuaaggcuuaauuaa

SEQ ID NO: 340097 - RNA, 32 nt, Human
auuuguaaaagaaccacagcagcuauuuugga

SEQ ID NO: 340098 - RNA, 32 nt, Human
auuuguaacugcagaagacuaucuuaaaauac

SEQ ID NO: 340099 - RNA, 32 nt, Human
auuuguaagcccugcagcagauuucuuugaua

SEQ ID NO: 340100 - RNA, 32 nt, Human
auuuguaaguacuauuuccuuccuuauugucu

SEQ ID NO: 340101 - RNA, 32 nt, Human
auuuguaauucuuccucuucguucuucaccug

SEQ ID NO: 340102 - RNA, 32 nt, Human
auuuguacaaaugacaugauaauaaaaguuuu

SEQ ID NO: 340103 - RNA, 32 nt, Human
auuuguacaaauguuaauaucacugcaauucc

SEQ ID NO: 340104 - RNA, 32 nt, Human
auuuguacuggagauuucccuccuggaaccaa

SEQ ID NO: 340105 - RNA, 32 nt, Human
auuuguagaaaagauuugauuugaguuaaaua

SEQ ID NO: 340106 - RNA, 32 nt, Human
auuuguagaagcacgagacgcacuuuuauauc

SEQ ID NO: 340107 - RNA, 32 nt, Human
auuuguaggagagagggaugauugacaucuuc

SEQ ID NO: 340108 - RNA, 32 nt, Human
auuuguaggauuauuucgagggcagggcaggg

SEQ ID NO: 340109 - RNA, 32 nt, Human
auuuguaguuauugauuuaagcauuuuuagaa

SEQ ID NO: 340110 - RNA, 32 nt, Human
auuuguaguugauucuuaacugugcauaaacc

SEQ ID NO: 340111 - RNA, 32 nt, Human
auuuguaucuuuacuagaacaugagaaucuuu

SEQ ID NO: 340112 - RNA, 32 nt, Human
auuuguauggggaguugaagauucagauagag

SEQ ID NO: 340113 - RNA, 32 nt, Human
auuuguauucaugaacuuggcuguaaucaguu

SEQ ID NO: 340114 - RNA, 32 nt, Human
auuuguauuccuggaccugaaagagaagaaga

SEQ ID NO: 340115 - RNA, 32 nt, Human
auuuguauuuauuucucucccuugccaaaaag

SEQ ID NO: 340116 - RNA, 32 nt, Human
auuuguauuuauuuugaguuauacuugacaca

SEQ ID NO: 340117 - RNA, 32 nt, Human
auuuguauuuguauucccuucccccuacaaga

SEQ ID NO: 340118 - RNA, 32 nt, Human
auuugucaaagggggaaggcacccacugccua

SEQ ID NO: 340119 - RNA, 32 nt, Human
auuugucaacauugcuuuaaugagcugaggaa

SEQ ID NO: 340120 - RNA, 32 nt, Human
auuugucaauauagaugguaggaagcagaaug

SEQ ID NO: 340121 - RNA, 32 nt, Human
auuugucacagaaaucagaggagagauggugu

SEQ ID NO: 340122 - RNA, 32 nt, Human
auuugucaccucucuuucuucccuauccugcc

SEQ ID NO: 340123 - RNA, 32 nt, Human
auuugucagccaagccucggcuccagcuccgc

SEQ ID NO: 340124 - RNA, 32 nt, Human
auuugucaggcugggugcaguggcucaugccu

SEQ ID NO: 340125 - RNA, 32 nt, Human
auuugucagggugggaggaaaacuguugaagu

SEQ ID NO: 340126 - RNA, 32 nt, Human
auuugucaguguauccuuuccaaaaagaguaa

SEQ ID NO: 340127 - RNA, 31 nt, Human
auuugucaguuucaaagcugcuucacauuuu

SEQ ID NO: 340128 - RNA, 31 nt, Human
auuugucaguuucaaaucugcuucacauuuu

SEQ ID NO: 340129 - RNA, 32 nt, Human
auuugucauucuagucacuuccugccuuguga

SEQ ID NO: 340130 - RNA, 32 nt, Human
auuugucccacucuguuuucucccucucagcc

SEQ ID NO: 340131 - RNA, 32 nt, Human
auuugucccaugaauuccccugagcagagauu

SEQ ID NO: 340132 - RNA, 32 nt, Human
auuuguccccacccucaucucuuccuuuaugg

SEQ ID NO: 340133 - RNA, 32 nt, Human
auuuguccuaagauuccaggaggcuggccucc

SEQ ID NO: 340134 - RNA, 32 nt, Human
auuuguccuaucucucccuuauaguccuaagc

SEQ ID NO: 340135 - RNA, 32 nt, Human
auuuguccuucagaccaaugagcgucagggcc

SEQ ID NO: 340136 - RNA, 32 nt, Human
auuugucgccuccgucugccucuuuggucagu

SEQ ID NO: 340137 - RNA, 32 nt, Human
auuugucucugaccaaccagaaacaucgacgg

SEQ ID NO: 340138 - RNA, 32 nt, Human
auuugucugauuuaggacuuguucuguguuuu

SEQ ID NO: 340139 - RNA, 24 nt, Human
auuugucuggaucagauccgcgcu

SEQ ID NO: 340140 - RNA, 32 nt, Human
auuugucuggaucugagaaccugcauuuggua

SEQ ID NO: 340141 - RNA, 32 nt, Human
auuugucuguuucucauuuacuuccucuuaua

SEQ ID NO: 340142 - RNA, 32 nt, Human
auuugucuuccuauugacucuacuucuuuaaa

SEQ ID NO: 340143 - RNA, 32 nt, Human
auuugucuucuuucugucuuuaagacucaggg

SEQ ID NO: 340144 - RNA, 32 nt, Human
auuugugaaaucggcucaacucccaggugaga

SEQ ID NO: 340145 - RNA, 32 nt, Human
auuugugagaaagguaagaggucugggggcug

SEQ ID NO: 340146 - RNA, 32 nt, Human
auuugugaguccaggaacaauuuacuauuuuu

SEQ ID NO: 340147 - RNA, 32 nt, Human
auuugugauaguauuuucuacuagccauuggg

SEQ ID NO: 340148 - RNA, 32 nt, Human
auuugugcaaaacaaauuccacaccacaugua

SEQ ID NO: 340149 - RNA, 32 nt, Human
auuugugcacacacacagggcucuugggugug

SEQ ID NO: 340150 - RNA, 32 nt, Human
auuugugcaguguggcuucugaccagcugcau

SEQ ID NO: 340151 - RNA, 32 nt, Human
auuugugcauguccuucugccuccccgguggg

SEQ ID NO: 340152 - RNA, 32 nt, Human
auuugugcccuuucccuucuugcugcacccau

SEQ ID NO: 340153 - RNA, 32 nt, Human
auuugugcgaagugccuuaugcuaugagacca

SEQ ID NO: 340154 - RNA, 32 nt, Human
auuuguggaagcucgugugucuucucaacuga

SEQ ID NO: 340155 - RNA, 32 nt, Human
auuuguggaaggagagaggauacacauguaaa

SEQ ID NO: 340156 - RNA, 32 nt, Human
auuuguggagaaaggucuccauggagcgacag

SEQ ID NO: 340157 - RNA, 32 nt, Human
auuuguggagagaacaggagggccagauagau

SEQ ID NO: 340158 - RNA, 32 nt, Human
auuuguggaggaugagaaagaugaagaagaca

SEQ ID NO: 340159 - RNA, 32 nt, Human
auuuguggaguuagguggaagccagauuuuaa

SEQ ID NO: 340160 - RNA, 32 nt, Human
auuuguggcuguaaagcuguagcagcucaggu

SEQ ID NO: 340161 - RNA, 32 nt, Human
auuugugggaagaagagaagcgaggcugggga

SEQ ID NO: 340162 - RNA, 32 nt, Human
auuugugguaaacaccuuucccagggaaccuc

SEQ ID NO: 340163 - RNA, 32 nt, Human
auuugugguacaauaugcuaugugccaaauga

SEQ ID NO: 340164 - RNA, 31 nt, Human
auuuguggucuucauuuacauuuagaauacc

SEQ ID NO: 340165 - RNA, 32 nt, Human
auuugugguuaagguuagacuauaugauccau

SEQ ID NO: 340166 - RNA, 32 nt, Human
auuugugguuuagcccaggagacaucugccuc

SEQ ID NO: 340167 - RNA, 32 nt, Human
auuuguguacuagccucugccgcaggaugggg

SEQ ID NO: 340168 - RNA, 32 nt, Human
auuugugucuuucugaggagacauccucuuca

SEQ ID NO: 340169 - RNA, 32 nt, Human
auuugugugcgugcuugcaugugcugcaggug

SEQ ID NO: 340170 - RNA, 32 nt, Human
auuuguguucugauaucugaggccaguaacua

SEQ ID NO: 340171 - RNA, 32 nt, Human
auuuguguugggggaaauguuguggggguggg

SEQ ID NO: 340172 - RNA, 32 nt, Human
auuuguguuugugaccaagcagccucucccuu

SEQ ID NO: 340173 - RNA, 32 nt, Human
auuuguguuuuuaagaaggcuuugcugcaagc

SEQ ID NO: 340174 - RNA, 32 nt, Human
auuuguuaaccagcuguccugggcuauugaag

SEQ ID NO: 340175 - RNA, 31 nt, Human
auuuguuaaguguccauccaggugggccuac

SEQ ID NO: 340176 - RNA, 32 nt, Human
auuuguuacagggugaccuguucucuagcugu

SEQ ID NO: 340177 - RNA, 32 nt, Human
auuuguuacuauauuacuaugcaaaacuggca

SEQ ID NO: 340178 - RNA, 32 nt, Human
auuuguuacuaucuucuuaauuuguuccaaag

SEQ ID NO: 340179 - RNA, 31 nt, Human
auuuguuagauugucaguuggaagggguuua

SEQ ID NO: 340180 - RNA, 32 nt, Human
auuuguuaggaaacuugugagcauucacacua

SEQ ID NO: 340181 - RNA, 32 nt, Human
auuuguuagggaggauagagaaacagagcacc

SEQ ID NO: 340182 - RNA, 32 nt, Human
auuuguuaucuucuuugccugccuguauuuua

SEQ ID NO: 340183 - RNA, 17 nt, Human
auuuguucacaccuuga

SEQ ID NO: 340184 - RNA, 32 nt, Human
auuuguucaucaaauuacaucauguaauuugg

SEQ ID NO: 340185 - RNA, 32 nt, Human
auuuguuccaauacaaacucacuuuauucuaa

SEQ ID NO: 340186 - RNA, 32 nt, Human
auuuguucccauccucucuguccacagccugg

SEQ ID NO: 340187 - RNA, 32 nt, Human
auuuguuccuggcuucuccauggaacucgguc

SEQ ID NO: 340188 - RNA, 32 nt, Human
auuuguuccuuuaaauuucagaccauguccaa

SEQ ID NO: 340189 - RNA, 32 nt, Human
auuuguucuaucaccccucucccuaucauuaa

SEQ ID NO: 340190 - RNA, 32 nt, Human
auuuguucuccucugcuggugucauuucuuuu

SEQ ID NO: 340191 - RNA, 32 nt, Human
auuuguugaacacagagguuuaacugaucauu

SEQ ID NO: 340192 - RNA, 32 nt, Human
auuuguugaggcuuguuugauagcccaggaua

SEQ ID NO: 340193 - RNA, 32 nt, Human
auuuguugaguauuuuuaaaauuuuggauagu

SEQ ID NO: 340194 - RNA, 32 nt, Human
auuuguugcacugugccuugaagggcagcagg

SEQ ID NO: 340195 - RNA, 32 nt, Human
auuuguuggaugaauguaugcauauguauuca

SEQ ID NO: 340196 - RNA, 32 nt, Human
auuuguuggcugcuugagcugggauauucauc

SEQ ID NO: 340197 - RNA, 32 nt, Human
auuuguuggguaguuaaacuucagagauauuu

SEQ ID NO: 340198 - RNA, 32 nt, Human
auuuguuuaguacacauuaaaggucagaugug

SEQ ID NO: 340199 - RNA, 32 nt, Human
auuuguuuaguuuugcaccaauaaaacugugu

SEQ ID NO: 340200 - RNA, 32 nt, Human
auuuguuuauucacccccugcccaugauuuau

SEQ ID NO: 340201 - RNA, 32 nt, Human
auuuguuuauuuccucaucugagccuuugcca

SEQ ID NO: 340202 - RNA, 32 nt, Human
auuuguuucucaucucuugaggaucacugccc

SEQ ID NO: 340203 - RNA, 32 nt, Human
auuuguuucuucucuucuguguuucgauuuuu

SEQ ID NO: 340204 - RNA, 32 nt, Human
auuuguuuguuugcaauguuacuguaauacua

SEQ ID NO: 340205 - RNA, 32 nt, Human
auuuguuuguuuuuagaacaugagugacaguu

SEQ ID NO: 340206 - RNA, 32 nt, Human
auuuguuuugcaguaucuccccagacuuccug

SEQ ID NO: 340207 - RNA, 32 nt, Human
auuuuaaaaaccagaauuuuaguugcaauaca

SEQ ID NO: 340208 - RNA, 32 nt, Human
auuuuaaaaauuaaggucauuaggaagcaaau

SEQ ID NO: 340209 - RNA, 32 nt, Human
auuuuaaaaauugaauaaccaugugaaauaau

SEQ ID NO: 340210 - RNA, 32 nt, Human
auuuuaaaagagaaguuucuuuucugguuuua

SEQ ID NO: 340211 - RNA, 32 nt, Human
auuuuaaaagccagguaacaccuaccagucca

SEQ ID NO: 340212 - RNA, 32 nt, Human
auuuuaaaagugaaaaauauuaacacagugcu

SEQ ID NO: 340213 - RNA, 32 nt, Human
auuuuaaaauaaccaggcacucacucuuauga

SEQ ID NO: 340214 - RNA, 32 nt, Human
auuuuaaaauuaagugcauagcacucaucuaa

SEQ ID NO: 340215 - RNA, 32 nt, Human
auuuuaaaauuaauccaguuggugaugaggaa

SEQ ID NO: 340216 - RNA, 32 nt, Human
auuuuaaaauuagcugggcgugguggugugua

SEQ ID NO: 340217 - RNA, 32 nt, Human
auuuuaaacaagccaagguuuuccauuaccuu

SEQ ID NO: 340218 - RNA, 32 nt, Human
auuuuaaaccauuucuucuggcccagaagaca

SEQ ID NO: 340219 - RNA, 32 nt, Human
auuuuaaagaauugaccuaaggaaagcuuaug

SEQ ID NO: 340220 - RNA, 32 nt, Human
auuuuaaagaguguaggcaggccaggugcagu

SEQ ID NO: 340221 - RNA, 32 nt, Human
auuuuaaagauaaggaaaucaaacucaaagaa

SEQ ID NO: 340222 - RNA, 32 nt, Human
auuuuaaaggaaacuugcuuacaggaaggauu

SEQ ID NO: 340223 - RNA, 32 nt, Human
auuuuaaaggaaauguugcugugggggauuca

SEQ ID NO: 340224 - RNA, 32 nt, Human
auuuuaaaggccucuggauuuugcucauccag

SEQ ID NO: 340225 - RNA, 32 nt, Human
auuuuaaauccaguacuguacacugaguuaau

SEQ ID NO: 340226 - RNA, 32 nt, Human
auuuuaaauggaauggaaugagcuccauagau

SEQ ID NO: 340227 - RNA, 32 nt, Human
auuuuaaaugugaccauuuuucugguaugaau

SEQ ID NO: 340228 - RNA, 32 nt, Human
auuuuaaccaauugauuuuauguugcaauuua

SEQ ID NO: 340229 - RNA, 32 nt, Human
auuuuaacuauaauuuuaacugugauauaggc

SEQ ID NO: 340230 - RNA, 32 nt, Human
auuuuaagaagguacuuuauacauuuauuuaa

SEQ ID NO: 340231 - RNA, 32 nt, Human
auuuuaagaccaccauugcugauauugaaacu

SEQ ID NO: 340232 - RNA, 22 nt, Human
auuuuaagacugaaagugaaau

SEQ ID NO: 340233 - RNA, 32 nt, Human
auuuuaagauucagcauuugaaagauuucccu

SEQ ID NO: 340234 - RNA, 32 nt, Human
auuuuaagcaagaaguucuauuuaauggagau

SEQ ID NO: 340235 - RNA, 32 nt, Human
auuuuaagcuguucaugcugggacugacagcc

SEQ ID NO: 340236 - RNA, 32 nt, Human
auuuuaaggacccaggagguggggcagaagag

SEQ ID NO: 340237 - RNA, 32 nt, Human
auuuuaaggagacagaauccaacagggcuggg

SEQ ID NO: 340238 - RNA, 32 nt, Human
auuuuaaguccuuucguauaagaauuaaugag

SEQ ID NO: 340239 - RNA, 32 nt, Human
auuuuaagugauauuaaauuaugucaauaguu

SEQ ID NO: 340240 - RNA, 32 nt, Human
auuuuaauaagaauuacaaagacaauggcaua

SEQ ID NO: 340241 - RNA, 32 nt, Human
auuuuaauagcaacuguguacaugucacgaaa

SEQ ID NO: 340242 - RNA, 32 nt, Human
auuuuaauauuaaaauacaguugauuagcaac

SEQ ID NO: 340243 - RNA, 31 nt, Human
auuuuaaucaauaaaguaugucuguugaagc

SEQ ID NO: 340244 - RNA, 32 nt, Human
auuuuaaucauaguuaccuaagcagcaugcau

SEQ ID NO: 340245 - RNA, 32 nt, Human
auuuuaauccagacaucucugcuaacaagccu

SEQ ID NO: 340246 - RNA, 32 nt, Human
auuuuaauccccuuuauuggagguggggccug

SEQ ID NO: 340247 - RNA, 32 nt, Human
auuuuaauccuuuucaaguggaauggcuuaga

SEQ ID NO: 340248 - RNA, 32 nt, Human
auuuuaaugcauggaaaagcuguccauguucc

SEQ ID NO: 340249 - RNA, 31 nt, Human
auuuuaaugguauacucauguugaaagauaa

SEQ ID NO: 340250 - RNA, 32 nt, Human
auuuuaauguuuucagucauugcuuugguuau

SEQ ID NO: 340251 - RNA, 32 nt, Human
auuuuaauuagcugggugugguggcucaagcc

SEQ ID NO: 340252 - RNA, 32 nt, Human
auuuuaauuuucugcucugaguauuuaguaac

SEQ ID NO: 340253 - RNA, 32 nt, Human
auuuuaauuuuucugucuuuguuuucauaaga

SEQ ID NO: 340254 - RNA, 32 nt, Human
auuuuacaaaacugaggcuuagugagguucag

SEQ ID NO: 340255 - RNA, 32 nt, Human
auuuuacaaaccugaaauaugugccacauuga

SEQ ID NO: 340256 - RNA, 32 nt, Human
auuuuacaaagcaguuuucugaauggggauua

SEQ ID NO: 340257 - RNA, 32 nt, Human
auuuuacaaagcuucuaccacucugaaucaac

SEQ ID NO: 340258 - RNA, 32 nt, Human
auuuuacaauccagggauuguucaggccaugu

SEQ ID NO: 340259 - RNA, 32 nt, Human
auuuuacaauugcacgcuuucaaguuauuaaa

SEQ ID NO: 340260 - RNA, 32 nt, Human
auuuuacacagcaauuuuguauccauuuaaac

SEQ ID NO: 340261 - RNA, 32 nt, Human
auuuuacacagcaccacagugaauccagacca

SEQ ID NO: 340262 - RNA, 32 nt, Human
auuuuacagagcuugaaaacucacuucaauga

SEQ ID NO: 340263 - RNA, 32 nt, Human
auuuuacagcaaaaucagauuuauagauaaaa

SEQ ID NO: 340264 - RNA, 26 nt, Human
auuuuacagcccugcuacuuuugcuu

SEQ ID NO: 340265 - RNA, 32 nt, Human
auuuuacaguccugacaacuguguacaccuag

SEQ ID NO: 340266 - RNA, 32 nt, Human
auuuuacauagcuucagaccuuguccagaaaa

SEQ ID NO: 340267 - RNA, 32 nt, Human
auuuuacauauguaaaugguauguuucaauaa

SEQ ID NO: 340268 - RNA, 32 nt, Human
auuuuacaucucacaauguacuguuuacaugg

SEQ ID NO: 340269 - RNA, 32 nt, Human
auuuuacaugauuucaaaauaaaguugauugu

SEQ ID NO: 340270 - RNA, 32 nt, Human
auuuuaccaaagcaucaauacaaccagcccaa

SEQ ID NO: 340271 - RNA, 32 nt, Human
auuuuaccacugcacuccagcuugggcgacgg

SEQ ID NO: 340272 - RNA, 32 nt, Human
auuuuaccagcauuauuguaguuuaaugauug

SEQ ID NO: 340273 - RNA, 32 nt, Human
auuuuaccaggucgugcacacacacaagccgc

SEQ ID NO: 340274 - RNA, 32 nt, Human
auuuuaccaugauguuuuaaucucagguaaau

SEQ ID NO: 340275 - RNA, 32 nt, Human
auuuuaccccaucccugcaugacugugaagcu

SEQ ID NO: 340276 - RNA, 32 nt, Human
auuuuacgaagcucuguguucucaacgcccuc

SEQ ID NO: 340277 - RNA, 32 nt, Human
auuuuacgguaugcuuugcccauuccaucgag

SEQ ID NO: 340278 - RNA, 32 nt, Human
auuuuacuacucgaagaaaggcagaagaaguu

SEQ ID NO: 340279 - RNA, 32 nt, Human
auuuuacugaaguggagggaagaggugaaugc

SEQ ID NO: 340280 - RNA, 32 nt, Human
auuuuacugccaccaucugucuuaaaucuauu

SEQ ID NO: 340281 - RNA, 32 nt, Human
auuuuacugcugauuucacagcuccuucagcu

SEQ ID NO: 340282 - RNA, 32 nt, Human
auuuuacuucauccuccaaggaguucaaucac

SEQ ID NO: 340283 - RNA, 32 nt, Human
auuuuacuucgucuuggccagaauucacaaug

SEQ ID NO: 340284 - RNA, 32 nt, Human
auuuuacuucuaaaggagagaaugucaaaaag

SEQ ID NO: 340285 - RNA, 32 nt, Human
auuuuacuuugcuuuuaacauuuccuuggggu

SEQ ID NO: 340286 - RNA, 32 nt, Human
auuuuacuuuuuaaaaugacauuccuacugau

SEQ ID NO: 340287 - RNA, 32 nt, Human
auuuuagaaauguggaaauggaggcaucaggc

SEQ ID NO: 340288 - RNA, 32 nt, Human
auuuuagaaggugaggggaggggaggcuuuuu

SEQ ID NO: 340289 - RNA, 32 nt, Human
auuuuagacuuuguuucucagcucuguacaaa

SEQ ID NO: 340290 - RNA, 32 nt, Human
auuuuagagacagggucucgcucugucaccca

SEQ ID NO: 340291 - RNA, 32 nt, Human
auuuuagagccaaguuaacaaguacuucagga

SEQ ID NO: 340292 - RNA, 32 nt, Human
auuuuagagcuuucagcagccuuuuuaagaga

SEQ ID NO: 340293 - RNA, 32 nt, Human
auuuuagaggccaaggcaggaggaucacuugg

SEQ ID NO: 340294 - RNA, 32 nt, Human
auuuuagaucaugucuggagggaagucagccc

SEQ ID NO: 340295 - RNA, 32 nt, Human
auuuuagcacccagauggcauugcagugccag

SEQ ID NO: 340296 - RNA, 32 nt, Human
auuuuagccaguguccaggcuaucagcagaga

SEQ ID NO: 340297 - RNA, 32 nt, Human
auuuuagccaugccugcuccucugccuggacc

SEQ ID NO: 340298 - RNA, 32 nt, Human
auuuuagccugcuauaugucaugguuuuaacu

SEQ ID NO: 340299 - RNA, 32 nt, Human
auuuuagcucacuacaaccuccacuuuccagg

SEQ ID NO: 340300 - RNA, 32 nt, Human
auuuuagcuggauaacuuacugcuuuuaucug

SEQ ID NO: 340301 - RNA, 32 nt, Human
auuuuagcuguuucagcaucaauccaacuuaa

SEQ ID NO: 340302 - RNA, 32 nt, Human
auuuuaggcagggauuugaggagcagcuucag

SEQ ID NO: 340303 - RNA, 32 nt, Human
auuuuaggcugcaggggagggcagggcugggg

SEQ ID NO: 340304 - RNA, 32 nt, Human
auuuuagggacagggucuugcucuguugccaa

SEQ ID NO: 340305 - RNA, 32 nt, Human
auuuuagggaccuugcaguuugcacauaauug

SEQ ID NO: 340306 - RNA, 32 nt, Human
auuuuagggccugugaccaaaaaugaagcuug

SEQ ID NO: 340307 - RNA, 32 nt, Human
auuuuagguauguagagcaaguugaaaaugga

SEQ ID NO: 340308 - RNA, 32 nt, Human
auuuuaguauccucaggaguccuggaaccaac

SEQ ID NO: 340309 - RNA, 32 nt, Human
auuuuaguauuaaaauacauguaaagaucagg

SEQ ID NO: 340310 - RNA, 32 nt, Human
auuuuagucuuuuaagcaaaguuuacgaauga

SEQ ID NO: 340311 - RNA, 32 nt, Human
auuuuaguucacugcaacuuccgcuucccagg

SEQ ID NO: 340312 - RNA, 32 nt, Human
auuuuauaaauggugcugggauaacugggaua

SEQ ID NO: 340313 - RNA, 32 nt, Human
auuuuauaacuauaacuacuaguagaaauaua

SEQ ID NO: 340314 - RNA, 32 nt, Human
auuuuauaaguauauaaaaagcauuagguuca

SEQ ID NO: 340315 - RNA, 32 nt, Human
auuuuauacaaacuccguacaccuaagaugug

SEQ ID NO: 340316 - RNA, 32 nt, Human
auuuuauacaguauuuguuuuguuuugguuuu

SEQ ID NO: 340317 - RNA, 32 nt, Human
auuuuauaccagaacucagcaggcauuggcuc

SEQ ID NO: 340318 - RNA, 32 nt, Human
auuuuauacucagcagaagacagggaaauuua

SEQ ID NO: 340319 - RNA, 32 nt, Human
auuuuauaggcucauaggcugaagggacuugc

SEQ ID NO: 340320 - RNA, 32 nt, Human
auuuuauaggggauacuugaaaccaguauuua

SEQ ID NO: 340321 - RNA, 32 nt, Human
auuuuauccagccugcuucuccagccuucuag

SEQ ID NO: 340322 - RNA, 32 nt, Human
auuuuaucccuaaugccuucucucaacucugc

SEQ ID NO: 340323 - RNA, 32 nt, Human
auuuuaucccuuuuuguaaucaucucaucuca

SEQ ID NO: 340324 - RNA, 32 nt, Human
auuuuauccuucagaaccucacuuuucuauuu

SEQ ID NO: 340325 - RNA, 32 nt, Human
auuuuaucuuuuccuuucaggguuuuguccuc

SEQ ID NO: 340326 - RNA, 32 nt, Human
auuuuaugaagacauugcccauuuuuacuucc

SEQ ID NO: 340327 - RNA, 32 nt, Human
auuuuaugaccccuacuugcaggauguggucg

SEQ ID NO: 340328 - RNA, 32 nt, Human
auuuuaugcacuccaaccaugaauuuaaacua

SEQ ID NO: 340329 - RNA, 32 nt, Human
auuuuauggauggggaaacaggcucuaagaca

SEQ ID NO: 340330 - RNA, 32 nt, Human
auuuuaugugagagaaaaguuggaugcucacg

SEQ ID NO: 340331 - RNA, 32 nt, Human
auuuuaugugcaaagaaaagauuucaccauua

SEQ ID NO: 340332 - RNA, 32 nt, Human
auuuuauguuggccucaguuguacuagaaaag

SEQ ID NO: 340333 - RNA, 32 nt, Human
auuuuauguuguguuuucuacuuuucucaucu

SEQ ID NO: 340334 - RNA, 32 nt, Human
auuuuauuauaguaaugugacuuggauucaau

SEQ ID NO: 340335 - RNA, 32 nt, Human
auuuuauuauauacuaaaacaaaaaggauuuu

SEQ ID NO: 340336 - RNA, 32 nt, Human
auuuuauuauguaaucauguucugguaugucu

SEQ ID NO: 340337 - RNA, 32 nt, Human
auuuuauucaaaggaauuguaaaccuuaaacc

SEQ ID NO: 340338 - RNA, 32 nt, Human
auuuuauucaagauugugcucuucuaucaaaa

SEQ ID NO: 340339 - RNA, 31 nt, Human
auuuuauucaauaaauacuuaaaaugaaaaa

SEQ ID NO: 340340 - RNA, 32 nt, Human
auuuuauucuguagcauggagaaugggugcaa

SEQ ID NO: 340341 - RNA, 32 nt, Human
auuuuauugaagaucuccuaugugccagaggu

SEQ ID NO: 340342 - RNA, 32 nt, Human
auuuuauugaaggugacuacauuuuauuaguu

SEQ ID NO: 340343 - RNA, 32 nt, Human
auuuuauugagcccagaccacaugcaguuuuc

SEQ ID NO: 340344 - RNA, 32 nt, Human
auuuuauugcagucuuccauuacauggaaaua

SEQ ID NO: 340345 - RNA, 32 nt, Human
auuuuauugcauuucaaaaacaugcuaggaac

SEQ ID NO: 340346 - RNA, 32 nt, Human
auuuuauugccuggaucugcuuuaaagacaau

SEQ ID NO: 340347 - RNA, 32 nt, Human
auuuuauuuaggauugggagcagggaaaggag

SEQ ID NO: 340348 - RNA, 32 nt, Human
auuuuauuugacuuauagagaauagcauauag

SEQ ID NO: 340349 - RNA, 32 nt, Human
auuuuauuuggugcauuucugcucuggguaua

SEQ ID NO: 340350 - RNA, 32 nt, Human
auuuuauuuuuacccuugcaugacauuuucau

SEQ ID NO: 340351 - RNA, 32 nt, Human
auuuucaaaccagcuuuacacccuucaggaaa

SEQ ID NO: 340352 - RNA, 24 nt, Human
auuuucaaaguaagucucugcccu

SEQ ID NO: 340353 - RNA, 32 nt, Human
auuuucaaaugaccacccacagagguauuaaa

SEQ ID NO: 340354 - RNA, 32 nt, Human
auuuucaacugcuuugaaacuugccugggguc

SEQ ID NO: 340355 - RNA, 32 nt, Human
auuuucaaguucaagacuuaacucaggguuca

SEQ ID NO: 340356 - RNA, 31 nt, Human
auuuucaauacuucuuuaaauuuaaaauaaa

SEQ ID NO: 340357 - RNA, 32 nt, Human
auuuucaaucuggcaggaguagaaagaugcuc

SEQ ID NO: 340358 - RNA, 32 nt, Human
auuuucaaugugaucaguucuagaccuagaag

SEQ ID NO: 340359 - RNA, 32 nt, Human
auuuucacaagaagcacuuauuuuagccauag

SEQ ID NO: 340360 - RNA, 32 nt, Human
auuuucacaagugggucucccuuguccgggac

SEQ ID NO: 340361 - RNA, 32 nt, Human
auuuucacaauccucucuucccucaccagaag

SEQ ID NO: 340362 - RNA, 17 nt, Human
auuuucacacaccuuga

SEQ ID NO: 340363 - RNA, 32 nt, Human
auuuucacacaugaaagugaacaguggaauau

SEQ ID NO: 340364 - RNA, 32 nt, Human
auuuucacugguguuuccuucuuaaaguauug

SEQ ID NO: 340365 - RNA, 32 nt, Human
auuuucacuguagugucauccccucacaggcu

SEQ ID NO: 340366 - RNA, 32 nt, Human
auuuucagaaugacugacacugccgaagcugu

SEQ ID NO: 340367 - RNA, 32 nt, Human
auuuucagaaugcagaugcguuccuucagagc

SEQ ID NO: 340368 - RNA, 32 nt, Human
auuuucagagcuuaucucugaagaucuaaacu

SEQ ID NO: 340369 - RNA, 32 nt, Human
auuuucagaggaugagaaauagcugguuucca

SEQ ID NO: 340370 - RNA, 32 nt, Human
auuuucagcaaagugcuccaaaugccuuuuuc

SEQ ID NO: 340371 - RNA, 32 nt, Human
auuuucagcaccucaccuucuuuucugcaucu

SEQ ID NO: 340372 - RNA, 32 nt, Human
auuuucagcacuaccucugagccaugggguug

SEQ ID NO: 340373 - RNA, 32 nt, Human
auuuucagccaucuuugaagcuugaaagaaga

SEQ ID NO: 340374 - RNA, 32 nt, Human
auuuucagcguauagaucccuaugcauuuuug

SEQ ID NO: 340375 - RNA, 32 nt, Human
auuuucagcucucaaaggcaaaggacacuccu

SEQ ID NO: 340376 - RNA, 32 nt, Human
auuuucagcucugcuauaaucuuaugggacca

SEQ ID NO: 340377 - RNA, 32 nt, Human
auuuucaggacucaaacuaccacaaugaacag

SEQ ID NO: 340378 - RNA, 32 nt, Human
auuuucaggcuugguuuccacauucgagguag

SEQ ID NO: 340379 - RNA, 32 nt, Human
auuuucagguuucuuaaaaacagcuguaacua

SEQ ID NO: 340380 - RNA, 32 nt, Human
auuuucagugaucucauuugaaugauuuauag

SEQ ID NO: 340381 - RNA, 32 nt, Human
auuuucaguggacaaugggaauaaagcauuuc

SEQ ID NO: 340382 - RNA, 32 nt, Human
auuuucaguggguaggauguucugagcaguga

SEQ ID NO: 340383 - RNA, 32 nt, Human
auuuucaguuuaguguagcagcacacuuguuc

SEQ ID NO: 340384 - RNA, 32 nt, Human
auuuucauauccacuuccccaccacugaaaua

SEQ ID NO: 340385 - RNA, 32 nt, Human
auuuucaucacagaggagugggagaggggaca

SEQ ID NO: 340386 - RNA, 32 nt, Human
auuuucaucacugaaagucagaggccaacgaa

SEQ ID NO: 340387 - RNA, 32 nt, Human
auuuucauccucagugcuguacagaucuauuu

SEQ ID NO: 340388 - RNA, 32 nt, Human
auuuucaucuuucccccaaaccuccuuuaaag

SEQ ID NO: 340389 - RNA, 32 nt, Human
auuuucauuuuucucaagcucuccaauaaaua

SEQ ID NO: 340390 - RNA, 32 nt, Human
auuuuccaauuguuuucauucuuucugaaguu

SEQ ID NO: 340391 - RNA, 32 nt, Human
auuuuccacagcuguuuauucuuguuugacuu

SEQ ID NO: 340392 - RNA, 32 nt, Human
auuuuccagccuucugucagcagugaaacuua

SEQ ID NO: 340393 - RNA, 32 nt, Human
auuuuccaggagacuuggcuugcacugagagc

SEQ ID NO: 340394 - RNA, 32 nt, Human
auuuuccaggauaacugugacuccaggcccgc

SEQ ID NO: 340395 - RNA, 22 nt, Human
auuuuccagucuacuuuggggu

SEQ ID NO: 340396 - RNA, 32 nt, Human
auuuuccagucuccaguggccccggggucuuu

SEQ ID NO: 340397 - RNA, 32 nt, Human
auuuuccagugauugcuuuggccuguacaacc

SEQ ID NO: 340398 - RNA, 31 nt, Human
auuuuccaguuucaaguaccuauucaaaauu

SEQ ID NO: 340399 - RNA, 32 nt, Human
auuuuccauacagaacaacagccagagcagcu

SEQ ID NO: 340400 - RNA, 32 nt, Human
auuuucccaacaaguagaaacacuuaaaauca

SEQ ID NO: 340401 - RNA, 32 nt, Human
auuuucccaaccaauagaaacuauuuauugua

SEQ ID NO: 340402 - RNA, 32 nt, Human
auuuucccacagacuuccuggccuccugugac

SEQ ID NO: 340403 - RNA, 32 nt, Human
auuuucccaccugaccucccugccucagcagc

SEQ ID NO: 340404 - RNA, 32 nt, Human
auuuucccagaacagaagcaccaagaaaauua

SEQ ID NO: 340405 - RNA, 32 nt, Human
auuuucccagcccuaaauaugaaucauggggc

SEQ ID NO: 340406 - RNA, 32 nt, Human
auuuuccccagcuggccuggacugccugugcu

SEQ ID NO: 340407 - RNA, 20 nt, Human
auuuuccccaucccucugca

SEQ ID NO: 340408 - RNA, 28 nt, Human
auuuuccccgaggacaucuuucucugca

SEQ ID NO: 340409 - RNA, 32 nt, Human
auuuuccccgaggacaucuuucucugcaaguu

SEQ ID NO: 340410 - RNA, 19 nt, Human
auuuuccccuacacuuugu

SEQ ID NO: 340411 - RNA, 26 nt, Human
auuuuccccuccccaccccucuuugc

SEQ ID NO: 340412 - RNA, 32 nt, Human
auuuucccgacgaucuuccuggcuccaacacu

SEQ ID NO: 340413 - RNA, 32 nt, Human
auuuucccuccaggaccaccuugguuucuagg

SEQ ID NO: 340414 - RNA, 32 nt, Human
auuuucccuccugggaccagagcugacuccau

SEQ ID NO: 340415 - RNA, 32 nt, Human
auuuucccugcaguccccuugguuuguaaauu

SEQ ID NO: 340416 - RNA, 32 nt, Human
auuuucccugcucuuccucaguuguccggggc

SEQ ID NO: 340417 - RNA, 32 nt, Human
auuuucccuuucuacuuuuuaugagagccagu

SEQ ID NO: 340418 - RNA, 32 nt, Human
auuuuccgaaggagguggguugggagaaauau

SEQ ID NO: 340419 - RNA, 32 nt, Human
auuuuccgggaaauauuuccaguguuuauuug

SEQ ID NO: 340420 - RNA, 32 nt, Human
auuuuccgggaauauaauauuucuugaaugaa

SEQ ID NO: 340421 - RNA, 22 nt, Human
auuuuccguagugcucugggug

SEQ ID NO: 340422 - RNA, 32 nt, Human
auuuuccuaaggaggacuacagauggauuaaa

SEQ ID NO: 340423 - RNA, 32 nt, Human
auuuuccuaaguguuuacuaugugccaguucc

SEQ ID NO: 340424 - RNA, 32 nt, Human
auuuuccuacggcguuagcacuuuaagcacau

SEQ ID NO: 340425 - RNA, 32 nt, Human
auuuuccuccauccucagaccgugacaucucc

SEQ ID NO: 340426 - RNA, 32 nt, Human
auuuuccuccauucucuuucuucaccucuuga

SEQ ID NO: 340427 - RNA, 32 nt, Human
auuuuccugcaggcuuuuccaugaguauuauu

SEQ ID NO: 340428 - RNA, 32 nt, Human
auuuuccugcugucuucugugcguuuaguuuu

SEQ ID NO: 340429 - RNA, 31 nt, Human
auuuuccuggagguauuagccaacacaguua

SEQ ID NO: 340430 - RNA, 32 nt, Human
auuuuccugggcagguuuauguugauguuuac

SEQ ID NO: 340431 - RNA, 32 nt, Human
auuuuccuguaaucacaggaugacucaggaug

SEQ ID NO: 340432 - RNA, 32 nt, Human
auuuuccuucaaguguucaagucuaaugaaga

SEQ ID NO: 340433 - RNA, 32 nt, Human
auuuuccuuccagaaaaaugguaaugcuucug

SEQ ID NO: 340434 - RNA, 25 nt, Human
auuuuccuuuaucuuucuccuggca

SEQ ID NO: 340435 - RNA, 32 nt, Human
auuuucgcucugucucccagguuggagugcag

SEQ ID NO: 340436 - RNA, 32 nt, Human
auuuucguggaauucauguugcucugacggga

SEQ ID NO: 340437 - RNA, 19 nt, Human
auuuucuaaaugccucccu

SEQ ID NO: 340438 - RNA, 32 nt, Human
auuuucuaagacaguccucuggauccucuaaa

SEQ ID NO: 340439 - RNA, 32 nt, Human
auuuucuagagucacuguauaagggucuauga

SEQ ID NO: 340440 - RNA, 32 nt, Human
auuuucuaguaacccaggucuaaaguagcuac

SEQ ID NO: 340441 - RNA, 32 nt, Human
auuuucuauaagaaaaaggaaaaguugagggg

SEQ ID NO: 340442 - RNA, 32 nt, Human
auuuucuaugugaaguuuccugguuuuaaaau

SEQ ID NO: 340443 - RNA, 32 nt, Human
auuuucucaagcaauuuuuaaauuucauucau

SEQ ID NO: 340444 - RNA, 31 nt, Human
auuuucucacauaaauacugaggaagacccu

SEQ ID NO: 340445 - RNA, 32 nt, Human
auuuucucagccucuucucugccuccagagag

SEQ ID NO: 340446 - RNA, 32 nt, Human
auuuucucauucucuagugauuaccuucauac

SEQ ID NO: 340447 - RNA, 32 nt, Human
auuuucuccagccucugagacuaucgcucuua

SEQ ID NO: 340448 - RNA, 32 nt, Human
auuuucucccacccucggcccucuuguuuuua

SEQ ID NO: 340449 - RNA, 32 nt, Human
auuuucuccuagauuuucucauguuaugccau

SEQ ID NO: 340450 - RNA, 32 nt, Human
auuuucucucacucuuuaauuauuuucagcuu

SEQ ID NO: 340451 - RNA, 32 nt, Human
auuuucucuccccagccauucagagguuucca

SEQ ID NO: 340452 - RNA, 32 nt, Human
auuuucucuccuccuuucaaguuguucagccu

SEQ ID NO: 340453 - RNA, 32 nt, Human
auuuucucuccucgaguugcuccucauggcug

SEQ ID NO: 340454 - RNA, 32 nt, Human
auuuucucucuccaaaaugauaaaaacaauaa

SEQ ID NO: 340455 - RNA, 32 nt, Human
auuuucucugcagcuuauucuugccaugcuua

SEQ ID NO: 340456 - RNA, 32 nt, Human
auuuucucuggcccucuaccuugcuuccuggg

SEQ ID NO: 340457 - RNA, 32 nt, Human
auuuucucugucagauccccacucuauaccaa

SEQ ID NO: 340458 - RNA, 32 nt, Human
auuuucucuguggaaaacaucagccauuacau

SEQ ID NO: 340459 - RNA, 32 nt, Human
auuuucucuuccugccaagaacuaggugaauc

SEQ ID NO: 340460 - RNA, 32 nt, Human
auuuucucuuucuuuaaaugccuuuugggugu

SEQ ID NO: 340461 - RNA, 32 nt, Human
auuuucucuuugucugauuuggaaaaggaacu

SEQ ID NO: 340462 - RNA, 32 nt, Human
auuuucugaaggcagagauaucuacuguauaa

SEQ ID NO: 340463 - RNA, 32 nt, Human
auuuucugaaucugcaaucauuccuuugacaa

SEQ ID NO: 340464 - RNA, 32 nt, Human
auuuucugaugagacuagagugacaguguuuc

SEQ ID NO: 340465 - RNA, 32 nt, Human
auuuucugauguuccgccccacugugaagagu

SEQ ID NO: 340466 - RNA, 32 nt, Human
auuuucugcaccuucugauuuuacuuaagcag

SEQ ID NO: 340467 - RNA, 32 nt, Human
auuuucugcauuauagccucucauuuuccaug

SEQ ID NO: 340468 - RNA, 32 nt, Human
auuuucugccagccccucuccccagcuuauuu

SEQ ID NO: 340469 - RNA, 31 nt, Human
auuuucugccucuuugugugucuauuaaucu

SEQ ID NO: 340470 - RNA, 32 nt, Human
auuuucugcuuggaccucuuugguucucuccc

SEQ ID NO: 340471 - RNA, 32 nt, Human
auuuucugggccaguuucccugccuuauuuua

SEQ ID NO: 340472 - RNA, 32 nt, Human
auuuucuggugagguggguuugggaggaaaga

SEQ ID NO: 340473 - RNA, 32 nt, Human
auuuucuguccuuuuaaacuaaacccaaaaau

SEQ ID NO: 340474 - RNA, 32 nt, Human
auuuucugugccugaauauuuguuauguagau

SEQ ID NO: 340475 - RNA, 32 nt, Human
auuuucuguggcuccagugagaacaaggcuuu

SEQ ID NO: 340476 - RNA, 32 nt, Human
auuuucuguguguacauguacaugcauuuuuc

SEQ ID NO: 340477 - RNA, 32 nt, Human
auuuucuguuuguccccaccuccccagccuuc

SEQ ID NO: 340478 - RNA, 32 nt, Human
auuuucuuacccuucuggagugcauaugugcc

SEQ ID NO: 340479 - RNA, 32 nt, Human
auuuucuuauaccucaaacccaccucacagga

SEQ ID NO: 340480 - RNA, 32 nt, Human
auuuucuuauuaucuucuucucccucuagaau

SEQ ID NO: 340481 - RNA, 32 nt, Human
auuuucuucauacucugguucccuuucuacaa

SEQ ID NO: 340482 - RNA, 32 nt, Human
auuuucuucccuucccuucccuucccuuuccu

SEQ ID NO: 340483 - RNA, 32 nt, Human
auuuucuucuaugccuuaggcuucgaugguuc

SEQ ID NO: 340484 - RNA, 32 nt, Human
auuuucuucucuuccucucaggcuaggcuuuc

SEQ ID NO: 340485 - RNA, 32 nt, Human
auuuucuucucuucugaaaguucuggcuugua

SEQ ID NO: 340486 - RNA, 32 nt, Human
auuuucuucugacuucuuggcuaacuuccaga

SEQ ID NO: 340487 - RNA, 32 nt, Human
auuuucuucugugcuucucucuaucugcucug

SEQ ID NO: 340488 - RNA, 32 nt, Human
auuuucuucuugaaauuagaugccauauuagg

SEQ ID NO: 340489 - RNA, 32 nt, Human
auuuucuugccuccuuugcuucaucuuuucac

SEQ ID NO: 340490 - RNA, 32 nt, Human
auuuucuuggagcugggguuugaauaggaacc

SEQ ID NO: 340491 - RNA, 32 nt, Human
auuuucuuguacaacugguacacacuaauaaa

SEQ ID NO: 340492 - RNA, 32 nt, Human
auuuucuuguacucucuguacuccucaagcac

SEQ ID NO: 340493 - RNA, 32 nt, Human
auuuucuuguauacagggagagugagauaacu

SEQ ID NO: 340494 - RNA, 32 nt, Human
auuuucuuguguagcuucccagauuugcaaac

SEQ ID NO: 340495 - RNA, 32 nt, Human
auuuucuuucaguuuaguucagugcaugcacu

SEQ ID NO: 340496 - RNA, 32 nt, Human
auuuucuuuccucccuaaacacugaccucccg

SEQ ID NO: 340497 - RNA, 32 nt, Human
auuuucuuucuuuccucucccggcguugauga

SEQ ID NO: 340498 - RNA, 32 nt, Human
auuuucuuugggcauaacagucagacuuguug

SEQ ID NO: 340499 - RNA, 25 nt, Human
auuuucuuuugguuucuucuuuaca

SEQ ID NO: 340500 - RNA, 32 nt, Human
auuuugaaaggauuauuuuguaaggaauaacu

SEQ ID NO: 340501 - RNA, 32 nt, Human
auuuugaaauuucugaaucgagcuagagcgag

SEQ ID NO: 340502 - RNA, 19 nt, Human
auuuugaacaaaagaaauu

SEQ ID NO: 340503 - RNA, 32 nt, Human
auuuugaacagauuaugcaacauuggaaggaa

SEQ ID NO: 340504 - RNA, 32 nt, Human
auuuugaaccuaaaaagcacucagggaaaugc

SEQ ID NO: 340505 - RNA, 32 nt, Human
auuuugaacuguuuuguccucucuggccauaa

SEQ ID NO: 340506 - RNA, 32 nt, Human
auuuugaagaagcuagggucuggagggacaga

SEQ ID NO: 340507 - RNA, 32 nt, Human
auuuugaagcuucaaacuuagugcugcugcag

SEQ ID NO: 340508 - RNA, 32 nt, Human
auuuugaauagggguugaguaaaauaaggcug

SEQ ID NO: 340509 - RNA, 32 nt, Human
auuuugaauauguacauauuauaaauauguug

SEQ ID NO: 340510 - RNA, 32 nt, Human
auuuugaauccacgagcacugcagcccuccac

SEQ ID NO: 340511 - RNA, 32 nt, Human
auuuugaaucuccccuuuccucucacaauacu

SEQ ID NO: 340512 - RNA, 32 nt, Human
auuuugaauguucucuuuggcaacuuauccau

SEQ ID NO: 340513 - RNA, 32 nt, Human
auuuugaauuuaggcugggugcaguggcucac

SEQ ID NO: 340514 - RNA, 32 nt, Human
auuuugacaauguuguaaguguuuaccaagcc

SEQ ID NO: 340515 - RNA, 32 nt, Human
auuuugacaucaaggaugaguucuguguuccc

SEQ ID NO: 340516 - RNA, 32 nt, Human
auuuugaccaaacauggauaaagauuaagcuu

SEQ ID NO: 340517 - RNA, 32 nt, Human
auuuugaccaaccuucuucuaacaaggugcuc

SEQ ID NO: 340518 - RNA, 32 nt, Human
auuuugacucaauccuuuucuggaccauuuuu

SEQ ID NO: 340519 - RNA, 32 nt, Human
auuuugacuguacuaacuauaaauguaaugaa

SEQ ID NO: 340520 - RNA, 32 nt, Human
auuuugagaacuaauaaaugcaccuuaauggu

SEQ ID NO: 340521 - RNA, 32 nt, Human
auuuugagaauuccucccagugauggucagua

SEQ ID NO: 340522 - RNA, 32 nt, Human
auuuugagacuguucgggaggaaaaguuccuc

SEQ ID NO: 340523 - RNA, 32 nt, Human
auuuugagaggugggugauaugugagagagaa

SEQ ID NO: 340524 - RNA, 32 nt, Human
auuuugagaugguggaaucuguggaaacuuuc

SEQ ID NO: 340525 - RNA, 32 nt, Human
auuuugagcaaaccacauaaucucucuagguc

SEQ ID NO: 340526 - RNA, 32 nt, Human
auuuugagcagcacaguccaauucuuuaacua

SEQ ID NO: 340527 - RNA, 32 nt, Human
auuuugagcccccauuccaccacaguuuccug

SEQ ID NO: 340528 - RNA, 32 nt, Human
auuuugagcuaucaaaaugucuuuguaauuuu

SEQ ID NO: 340529 - RNA, 32 nt, Human
auuuugaggaaaggaagaaacacugagacagg

SEQ ID NO: 340530 - RNA, 32 nt, Human
auuuugaggaagaggugauggcggcaggcaau

SEQ ID NO: 340531 - RNA, 32 nt, Human
auuuugaggaggucagcccacccuggaaugua

SEQ ID NO: 340532 - RNA, 32 nt, Human
auuuugaguucuguucauccuacccuaaugcc

SEQ ID NO: 340533 - RNA, 32 nt, Human
auuuugauaaaaugccacaaaauaagggcuau

SEQ ID NO: 340534 - RNA, 32 nt, Human
auuuugauggacugugcugcaguaucaccaga

SEQ ID NO: 340535 - RNA, 32 nt, Human
auuuugauuauugugcagaaacugacagaauu

SEQ ID NO: 340536 - RNA, 32 nt, Human
auuuugcaacuguauucauacaugucaaacac

SEQ ID NO: 340537 - RNA, 32 nt, Human
auuuugcaacuuguugguguggaucuauuggc

SEQ ID NO: 340538 - RNA, 21 nt, Human
auuuugcaagucaagugacca

SEQ ID NO: 340539 - RNA, 32 nt, Human
auuuugcaauguuaaagaugcacagaauaugu

SEQ ID NO: 340540 - RNA, 32 nt, Human
auuuugcacaaacuagucauuggucucuuuaa

SEQ ID NO: 340541 - RNA, 32 nt, Human
auuuugcacaugcugcccuaagaaucacugcu

SEQ ID NO: 340542 - RNA, 24 nt, Human
auuuugcacggcgcccucccucua

SEQ ID NO: 340543 - RNA, 21 nt, Human
auuuugcacggucucccccuc

SEQ ID NO: 340544 - RNA, 31 nt, Human
auuuugcagaaucugcaccuacagcucaaua

SEQ ID NO: 340545 - RNA, 32 nt, Human
auuuugcagagcucugcuaucacugaauuaca

SEQ ID NO: 340546 - RNA, 32 nt, Human
auuuugcagguguaacagauaaccagagaagc

SEQ ID NO: 340547 - RNA, 32 nt, Human
auuuugcauaccacccucagggcccagagacc

SEQ ID NO: 340548 - RNA, 32 nt, Human
auuuugcauauguuuguaugggagaaagggug

SEQ ID NO: 340549 - RNA, 32 nt, Human
auuuugcauggcccucauucaguggcucacaa

SEQ ID NO: 340550 - RNA, 32 nt, Human
auuuugcauugaagauacauugccagguugug

SEQ ID NO: 340551 - RNA, 32 nt, Human
auuuugcauuugaaggaauugacuuccucauu

SEQ ID NO: 340552 - RNA, 32 nt, Human
auuuugccacugcacuccugccugggugacag

SEQ ID NO: 340553 - RNA, 21 nt, Human
auuuugcccaaccuaaugcuc

SEQ ID NO: 340554 - RNA, 32 nt, Human
auuuugcccaggcuggagugcgauggugcgau

SEQ ID NO: 340555 - RNA, 24 nt, Human
auuuugccccucaccccaauguuc

SEQ ID NO: 340556 - RNA, 19 nt, Human
auuuugccccucauugugu

SEQ ID NO: 340557 - RNA, 23 nt, Human
auuuugccccugcuauaaaauuc

SEQ ID NO: 340558 - RNA, 32 nt, Human
auuuugccugaacaccccaacacucuugguuu

SEQ ID NO: 340559 - RNA, 18 nt, Human
auuuugccugcugccauc

SEQ ID NO: 340560 - RNA, 18 nt, Human
auuuugccuucugugaua

SEQ ID NO: 340561 - RNA, 32 nt, Human
auuuugccuuucuuuuggaaggaaggaggcga

SEQ ID NO: 340562 - RNA, 32 nt, Human
auuuugcgaaacccccuuuucccuucagcuug

SEQ ID NO: 340563 - RNA, 32 nt, Human
auuuugcuaagagacacagucuucucaucacu

SEQ ID NO: 340564 - RNA, 32 nt, Human
auuuugcuacauauuagaaucaucugggaggu

SEQ ID NO: 340565 - RNA, 32 nt, Human
auuuugcuagauaaggaaaaaggcuagcaacu

SEQ ID NO: 340566 - RNA, 32 nt, Human
auuuugcuauuuuuacaguugauuccccagau

SEQ ID NO: 340567 - RNA, 31 nt, Human
auuuugcucaauaaaauuguucagaagauca

SEQ ID NO: 340568 - RNA, 32 nt, Human
auuuugcucagaggaggcagagaugggguggu

SEQ ID NO: 340569 - RNA, 32 nt, Human
auuuugcucugaugcauggugugaacuuucug

SEQ ID NO: 340570 - RNA, 32 nt, Human
auuuugcucuuaggauggucuuugggauucaa

SEQ ID NO: 340571 - RNA, 32 nt, Human
auuuugcucuucaauguugccuguaaacuuag

SEQ ID NO: 340572 - RNA, 32 nt, Human
auuuugcugagcugcaaagguaucugucauaa

SEQ ID NO: 340573 - RNA, 32 nt, Human
auuuugcugcaaaccucugcaggccugagagc

SEQ ID NO: 340574 - RNA, 32 nt, Human
auuuugcugcucccuauugcuucuguuuacaa

SEQ ID NO: 340575 - RNA, 32 nt, Human
auuuugcuggggagaggcuaaagggaaaggua

SEQ ID NO: 340576 - RNA, 32 nt, Human
auuuugcuggugaugaggaagcauuuagcuga

SEQ ID NO: 340577 - RNA, 32 nt, Human
auuuugcuucuaauuuugacaguaucacuuuc

SEQ ID NO: 340578 - RNA, 32 nt, Human
auuuugcuugccgcuggcaugccugaggaaug

SEQ ID NO: 340579 - RNA, 32 nt, Human
auuuugcuuuguuuaacgaugcuuuuagucgc

SEQ ID NO: 340580 - RNA, 32 nt, Human
auuuuggaaauaaucauaacuugucuuuccaa

SEQ ID NO: 340581 - RNA, 32 nt, Human
auuuuggaagcucacuuccagcagaggcaaac

SEQ ID NO: 340582 - RNA, 32 nt, Human
auuuuggaaggcagcauacucuaggagaaaaa

SEQ ID NO: 340583 - RNA, 32 nt, Human
auuuuggacaauuggaaagguagaaaagaaaa

SEQ ID NO: 340584 - RNA, 32 nt, Human
auuuuggacacacccugaagcuuuuguuuuga

SEQ ID NO: 340585 - RNA, 24 nt, Human
auuuuggacauugugaaggaaaug

SEQ ID NO: 340586 - RNA, 32 nt, Human
auuuuggagaagggagaaagaagggagaggca

SEQ ID NO: 340587 - RNA, 32 nt, Human
auuuuggagcagaucuuagaaauagaauuuaa

SEQ ID NO: 340588 - RNA, 32 nt, Human
auuuuggaggcagggcugggaagggagcgcuc

SEQ ID NO: 340589 - RNA, 32 nt, Human
auuuuggaggcugaggaggggucggaaaauua

SEQ ID NO: 340590 - RNA, 32 nt, Human
auuuuggagggguacuuguggcauuuuccugu

SEQ ID NO: 340591 - RNA, 32 nt, Human
auuuuggauauucuaggagaaagccuauaauu

SEQ ID NO: 340592 - RNA, 32 nt, Human
auuuuggaugccucucauauguaauuaguucu

SEQ ID NO: 340593 - RNA, 32 nt, Human
auuuuggauuucugaccuaaagaauuguaagg

SEQ ID NO: 340594 - RNA, 32 nt, Human
auuuuggcauuuuccuguccuuacaucucagc

SEQ ID NO: 340595 - RNA, 32 nt, Human
auuuuggccacuuguagguaucagugugaucu

SEQ ID NO: 340596 - RNA, 32 nt, Human
auuuuggcucaaugcaaccuccaccucccagg

SEQ ID NO: 340597 - RNA, 32 nt, Human
auuuuggcucacuauaaccucuuccuccaggg

SEQ ID NO: 340598 - RNA, 22 nt, Human
auuuuggcucacugcaaccucc

SEQ ID NO: 340599 - RNA, 32 nt, Human
auuuuggcucacugcaaccuccaccucccagg

SEQ ID NO: 340600 - RNA, 32 nt, Human
auuuuggcucacugcaaccuccgccuccgggg

SEQ ID NO: 340601 - RNA, 32 nt, Human
auuuuggcucacugcaaccuccgccuucuggg

SEQ ID NO: 340602 - RNA, 24 nt, Human
auuuuggcucacugcaagcucugc

SEQ ID NO: 340603 - RNA, 32 nt, Human
auuuuggcucacugcaagcucugccucccggg

SEQ ID NO: 340604 - RNA, 32 nt, Human
auuuuggcucacugcagccucugccucccagg

SEQ ID NO: 340605 - RNA, 32 nt, Human
auuuuggcucacuguauccuucgccucccugg

SEQ ID NO: 340606 - RNA, 32 nt, Human
auuuuggcucccugcaaccuccgccuccugga

SEQ ID NO: 340607 - RNA, 32 nt, Human
auuuuggcugcaggaccugggucuauuguuau

SEQ ID NO: 340608 - RNA, 32 nt, Human
auuuuggcuucauuucaaucauugaaguauau

SEQ ID NO: 340609 - RNA, 32 nt, Human
auuuuggcuuucucccugucccuuccuuucuc

SEQ ID NO: 340610 - RNA, 32 nt, Human
auuuugggaccccagccugcuggaggcuguca

SEQ ID NO: 340611 - RNA, 32 nt, Human
auuuugggacugcugcagggagggcagaggca

SEQ ID NO: 340612 - RNA, 32 nt, Human
auuuugggaggcacucuugaugguuaggaaaa

SEQ ID NO: 340613 - RNA, 32 nt, Human
auuuugggaggcagaggcaggaggauugcuua

SEQ ID NO: 340614 - RNA, 32 nt, Human
auuuugggaugaaacuguuucaucucagauca

SEQ ID NO: 340615 - RNA, 23 nt, Human
auuuugggcaugcucaguacaga

SEQ ID NO: 340616 - RNA, 32 nt, Human
auuuugggggcagggagguugggugggcugau

SEQ ID NO: 340617 - RNA, 32 nt, Human
auuuugggggcuggggugucaaaagugagaug

SEQ ID NO: 340618 - RNA, 32 nt, Human
auuuugggguuauuuauuaugaaaacaacaug

SEQ ID NO: 340619 - RNA, 32 nt, Human
auuuuggguaacauagcacauggagauaauca

SEQ ID NO: 340620 - RNA, 32 nt, Human
auuuuggguacagaacucacaaaagaagagca

SEQ ID NO: 340621 - RNA, 32 nt, Human
auuuugggugggacuaagcaaagacgaaacac

SEQ ID NO: 340622 - RNA, 32 nt, Human
auuuuggguucccacuccugaccuaaccagaa

SEQ ID NO: 340623 - RNA, 32 nt, Human
auuuuggguuuucucuucuccugcuuuccugg

SEQ ID NO: 340624 - RNA, 32 nt, Human
auuuugguagaguauauacauaccucacugcc

SEQ ID NO: 340625 - RNA, 32 nt, Human
auuuugguagguaaagugugguggacguccuu

SEQ ID NO: 340626 - RNA, 32 nt, Human
auuuuggucaauguggguaacuuacuuuagaa

SEQ ID NO: 340627 - RNA, 32 nt, Human
auuuuggucacuucuagucaaugaaaaaugua

SEQ ID NO: 340628 - RNA, 32 nt, Human
auuuuggucauggagauguuuaaauaguaaag

SEQ ID NO: 340629 - RNA, 32 nt, Human
auuuuggucuguccaagauuauggaugaugau

SEQ ID NO: 340630 - RNA, 32 nt, Human
auuuuggugcuugcugcugaaauaaauugaaa

SEQ ID NO: 340631 - RNA, 32 nt, Human
auuuuggugggaaugggguuucaaccacguug

SEQ ID NO: 340632 - RNA, 32 nt, Human
auuuugguuaacagcaagaaaaaugcuuauaa

SEQ ID NO: 340633 - RNA, 32 nt, Human
auuuugguuucauugaaacaguaucuaauuau

SEQ ID NO: 340634 - RNA, 18 nt, Human
auuuuguaaaaagaaauu

SEQ ID NO: 340635 - RNA, 32 nt, Human
auuuuguaaaccugcagccguuuugcacaccc

SEQ ID NO: 340636 - RNA, 22 nt, Human
auuuuguaaauacuguauacca

SEQ ID NO: 340637 - RNA, 32 nt, Human
auuuuguaacacuguaccagguggugacuguu

SEQ ID NO: 340638 - RNA, 32 nt, Human
auuuuguagagugcuuuguuuauccaguuuaa

SEQ ID NO: 340639 - RNA, 32 nt, Human
auuuuguagcaguuuuacuacugugugauuuu

SEQ ID NO: 340640 - RNA, 32 nt, Human
auuuuguagggguggcacauucauugguugug

SEQ ID NO: 340641 - RNA, 32 nt, Human
auuuuguauaaaugaagugcuggacuuuaccu

SEQ ID NO: 340642 - RNA, 32 nt, Human
auuuuguauucccaccugugcugguagauauu

SEQ ID NO: 340643 - RNA, 32 nt, Human
auuuuguauugauuuuugauuaugaaaaucaa

SEQ ID NO: 340644 - RNA, 32 nt, Human
auuuuguauuuuuacaguuuugauuggguaau

SEQ ID NO: 340645 - RNA, 32 nt, Human
auuuuguauuuuuaguagagacagggucucac

SEQ ID NO: 340646 - RNA, 32 nt, Human
auuuuguauuuuuaguagagacaggguuccac

SEQ ID NO: 340647 - RNA, 32 nt, Human
auuuuguauuuuuaguagagacaggguuucac

SEQ ID NO: 340648 - RNA, 32 nt, Human
auuuuguauuuuuaguagagacaggguuucuc

SEQ ID NO: 340649 - RNA, 32 nt, Human
auuuuguauuuuuaguagagacaggguuucuu

SEQ ID NO: 340650 - RNA, 32 nt, Human
auuuuguauuuuuaguagagauagggauucac

SEQ ID NO: 340651 - RNA, 32 nt, Human
auuuuguauuuuuaguagagauggggcuucac

SEQ ID NO: 340652 - RNA, 32 nt, Human
auuuuguauuuuuaguagagaugggguuuauc

SEQ ID NO: 340653 - RNA, 32 nt, Human
auuuuguauuuuuaguagagaugggguuucac

SEQ ID NO: 340654 - RNA, 32 nt, Human
auuuuguauuuuuaguagagaugggguuucau

SEQ ID NO: 340655 - RNA, 32 nt, Human
auuuuguauuuuuaguagagaugggguuucuc

SEQ ID NO: 340656 - RNA, 32 nt, Human
auuuuguauuuuuauagagacgggguuucacc

SEQ ID NO: 340657 - RNA, 32 nt, Human
auuuuguauuuuuauuagagacaggguuucuc

SEQ ID NO: 340658 - RNA, 32 nt, Human
auuuugucaccgaggcuggagugcaauggccc

SEQ ID NO: 340659 - RNA, 32 nt, Human
auuuugucagcccagauguggcccaguuauuu

SEQ ID NO: 340660 - RNA, 32 nt, Human
auuuugucccaagucuuauuugcugacuuuuu

SEQ ID NO: 340661 - RNA, 32 nt, Human
auuuugucccagagagaaaggcucuuuggggg

SEQ ID NO: 340662 - RNA, 32 nt, Human
auuuuguccuaaaaauacaaaaauuaguuggg

SEQ ID NO: 340663 - RNA, 32 nt, Human
auuuuguccugauucacugccaauugucacau

SEQ ID NO: 340664 - RNA, 32 nt, Human
auuuugucucucucgacguaggccucaguguc

SEQ ID NO: 340665 - RNA, 32 nt, Human
auuuugugaggugagagaaaacuaauguuuac

SEQ ID NO: 340666 - RNA, 32 nt, Human
auuuugugcaguuuacaaaggcggccaaacag

SEQ ID NO: 340667 - RNA, 32 nt, Human
auuuugugggagaaagaggagcuggaguuaca

SEQ ID NO: 340668 - RNA, 32 nt, Human
auuuuguggggugggaguggggagcaggaauu

SEQ ID NO: 340669 - RNA, 32 nt, Human
auuuuguguaagaaauacagacuggauguacc

SEQ ID NO: 340670 - RNA, 32 nt, Human
auuuuguuaaugcacauucuguuuguuuaagg

SEQ ID NO: 340671 - RNA, 32 nt, Human
auuuuguuccaagucagaggugggcaccuaua

SEQ ID NO: 340672 - RNA, 32 nt, Human
auuuuguucccugagugucugaguccccggca

SEQ ID NO: 340673 - RNA, 32 nt, Human
auuuuguucuauaugaauaaaaaggcaaauua

SEQ ID NO: 340674 - RNA, 32 nt, Human
auuuuguucuugagaggggucagucuagaagc

SEQ ID NO: 340675 - RNA, 32 nt, Human
auuuuguucuugugggcagaagugggaaugau

SEQ ID NO: 340676 - RNA, 32 nt, Human
auuuuguugcccaggcuggucuccaauuucug

SEQ ID NO: 340677 - RNA, 32 nt, Human
auuuuguuuaaaacaugauuaucuuaauuccu

SEQ ID NO: 340678 - RNA, 32 nt, Human
auuuuguuuaauuuucugggguguuuuuguug

SEQ ID NO: 340679 - RNA, 32 nt, Human
auuuuguuuccaucuucuguaaucuuccaaag

SEQ ID NO: 340680 - RNA, 32 nt, Human
auuuuguuugagauggagaucuugcuauauug

SEQ ID NO: 340681 - RNA, 32 nt, Human
auuuuguuuucagaagagccauucuuuauuaa

SEQ ID NO: 340682 - RNA, 32 nt, Human
auuuuuaaaaauccauccacacacauugguaa

SEQ ID NO: 340683 - RNA, 32 nt, Human
auuuuuaaaacaaugcauaccaguguuuaaaa

SEQ ID NO: 340684 - RNA, 32 nt, Human
auuuuuaaagaauguuguuagaggccgggcgc

SEQ ID NO: 340685 - RNA, 32 nt, Human
auuuuuaaaggaguuggaggagagggaggggg

SEQ ID NO: 340686 - RNA, 32 nt, Human
auuuuuaaauuaugcaguauuuuccaguucuc

SEQ ID NO: 340687 - RNA, 32 nt, Human
auuuuuaacuucuuccuggggccugagcaggg

SEQ ID NO: 340688 - RNA, 32 nt, Human
auuuuuaagaugaccaagguuccagccaccaa

SEQ ID NO: 340689 - RNA, 32 nt, Human
auuuuuaaggcuuuccuaauaggcugaucaca

SEQ ID NO: 340690 - RNA, 32 nt, Human
auuuuuaagguagugggcaucucucuccuaau

SEQ ID NO: 340691 - RNA, 32 nt, Human
auuuuuaaggucgggaguuagauuuuaugaua

SEQ ID NO: 340692 - RNA, 32 nt, Human
auuuuuaagugcccucuuuucagucauuugca

SEQ ID NO: 340693 - RNA, 32 nt, Human
auuuuuaaguguccucagcauugcagaaaaua

SEQ ID NO: 340694 - RNA, 32 nt, Human
auuuuuacacgcagccugagcgguuauucuug

SEQ ID NO: 340695 - RNA, 32 nt, Human
auuuuuacauucaucaauaucccucuuguaag

SEQ ID NO: 340696 - RNA, 32 nt, Human
auuuuuacccccaaaggaacugaagauggaaa

SEQ ID NO: 340697 - RNA, 32 nt, Human
auuuuuacucaggcuuucuauuggcauggauu

SEQ ID NO: 340698 - RNA, 32 nt, Human
auuuuuacugccacuaaacugccuguauuucu

SEQ ID NO: 340699 - RNA, 32 nt, Human
auuuuuacuuucuguaugcuaaaacaaacccc

SEQ ID NO: 340700 - RNA, 32 nt, Human
auuuuuagacuuaaguucacugugauaucccu

SEQ ID NO: 340701 - RNA, 32 nt, Human
auuuuuagaggaacagaaagaaagugaaaaga

SEQ ID NO: 340702 - RNA, 32 nt, Human
auuuuuagaguuuccaguuuuucuguucuguu

SEQ ID NO: 340703 - RNA, 32 nt, Human
auuuuuagauugcccuguauuuuguuaacaug

SEQ ID NO: 340704 - RNA, 32 nt, Human
auuuuuagccuucuuuuucugcacugagucuc

SEQ ID NO: 340705 - RNA, 23 nt, Human
auuuuuagcugugcagauaggug

SEQ ID NO: 340706 - RNA, 32 nt, Human
auuuuuaguagacacaggguuucuccauguug

SEQ ID NO: 340707 - RNA, 32 nt, Human
auuuuuaguagagacaggauuuugccauguuu

SEQ ID NO: 340708 - RNA, 32 nt, Human
auuuuuaguagagacaggguuucuccauguug

SEQ ID NO: 340709 - RNA, 32 nt, Human
auuuuuaguagagacgagguuucuccauguuc

SEQ ID NO: 340710 - RNA, 32 nt, Human
auuuuuaguagagacggaguuucuccauguug

SEQ ID NO: 340711 - RNA, 32 nt, Human
auuuuuaguagagacgggauuucuccauguug

SEQ ID NO: 340712 - RNA, 32 nt, Human
auuuuuaguagagacgggguuucuccauguua

SEQ ID NO: 340713 - RNA, 32 nt, Human
auuuuuaguagagacgggguuucuccauguug

SEQ ID NO: 340714 - RNA, 32 nt, Human
auuuuuaguagagaugggguuucuccaaaggc

SEQ ID NO: 340715 - RNA, 32 nt, Human
auuuuuaguagagaugggguuucuccauguug

SEQ ID NO: 340716 - RNA, 32 nt, Human
auuuuuaguagagaugugguuucuccauguug

SEQ ID NO: 340717 - RNA, 32 nt, Human
auuuuuaguagaggcaggguuucuccauguug

SEQ ID NO: 340718 - RNA, 32 nt, Human
auuuuuaguagggaugggguuucuccauguug

SEQ ID NO: 340719 - RNA, 32 nt, Human
auuuuuaguauaacauuuucaccaucugauau

SEQ ID NO: 340720 - RNA, 32 nt, Human
auuuuuaguugcugagguuggcauuuuaguga

SEQ ID NO: 340721 - RNA, 32 nt, Human
auuuuuauaagaaaauuuuacuauuauuuuca

SEQ ID NO: 340722 - RNA, 32 nt, Human
auuuuuauagaguagggguacaaggacaguug

SEQ ID NO: 340723 - RNA, 32 nt, Human
auuuuuauauaaauuauaucuuguccuauuaa

SEQ ID NO: 340724 - RNA, 32 nt, Human
auuuuuauauagcaacugcucucugcaaguag

SEQ ID NO: 340725 - RNA, 32 nt, Human
auuuuuauaucaauuuguuuauauuuuuauua

SEQ ID NO: 340726 - RNA, 32 nt, Human
auuuuuaucaccaaaaugaauguuaaugaauu

SEQ ID NO: 340727 - RNA, 32 nt, Human
auuuuuauccaugaagacuuuccuacuuuucu

SEQ ID NO: 340728 - RNA, 32 nt, Human
auuuuuaucuauuuuucccuuucucuuacauu

SEQ ID NO: 340729 - RNA, 32 nt, Human
auuuuuaugaaaugugugcaguauuuaauuuu

SEQ ID NO: 340730 - RNA, 32 nt, Human
auuuuuaugauucccaacucauugaaggucuu

SEQ ID NO: 340731 - RNA, 32 nt, Human
auuuuuaugcaaccucugugccaggcucuggg

SEQ ID NO: 340732 - RNA, 32 nt, Human
auuuuuauggagaagaaauauggccauauuau

SEQ ID NO: 340733 - RNA, 32 nt, Human
auuuuuaugucaggugaacuggcaugcugaac

SEQ ID NO: 340734 - RNA, 32 nt, Human
auuuuuauguuaggcuuauuucauguauagcu

SEQ ID NO: 340735 - RNA, 32 nt, Human
auuuuuauuguauauuccuacagaucagucau

SEQ ID NO: 340736 - RNA, 32 nt, Human
auuuuuauuucaccaccuuuaacugagucacc

SEQ ID NO: 340737 - RNA, 32 nt, Human
auuuuuauuuccuuugaaauaauaggacuuua

SEQ ID NO: 340738 - RNA, 32 nt, Human
auuuuucaaagauaaagaaaguguacugcgaa

SEQ ID NO: 340739 - RNA, 32 nt, Human
auuuuucaacccagugucacuagaugucacac

SEQ ID NO: 340740 - RNA, 32 nt, Human
auuuuucaauuggcaauucaguuaauuuuuaa

SEQ ID NO: 340741 - RNA, 32 nt, Human
auuuuucacaggcuggcuugguggcgggauua

SEQ ID NO: 340742 - RNA, 32 nt, Human
auuuuucacaucccaccauacacugcugccca

SEQ ID NO: 340743 - RNA, 32 nt, Human
auuuuucaccacugcguuuuagguggugaucu

SEQ ID NO: 340744 - RNA, 32 nt, Human
auuuuucacuccucguucuugugcuugguucu

SEQ ID NO: 340745 - RNA, 32 nt, Human
auuuuucacugccauaugcucuugucaaaacu

SEQ ID NO: 340746 - RNA, 32 nt, Human
auuuuucagcagucacagccagugugagugcu

SEQ ID NO: 340747 - RNA, 32 nt, Human
auuuuucaguagcuccagguagaugagccuuu

SEQ ID NO: 340748 - RNA, 32 nt, Human
auuuuucaucagucauucuauagugacaucau

SEQ ID NO: 340749 - RNA, 32 nt, Human
auuuuucaugaucuugccauuuuugaaaagga

SEQ ID NO: 340750 - RNA, 23 nt, Human
auuuuucauuucacccaauguuc

SEQ ID NO: 340751 - RNA, 32 nt, Human
auuuuuccaacuuuuguacaguaaguaguuag

SEQ ID NO: 340752 - RNA, 32 nt, Human
auuuuuccacaccuugaagucacaguguuuua

SEQ ID NO: 340753 - RNA, 32 nt, Human
auuuuuccacuccagcugagacugccucacug

SEQ ID NO: 340754 - RNA, 32 nt, Human
auuuuuccagccaaaccacucacccguacacu

SEQ ID NO: 340755 - RNA, 32 nt, Human
auuuuucccaaaacaaagcccaugccuugcuc

SEQ ID NO: 340756 - RNA, 32 nt, Human
auuuuucccacauaguauauuaguauauuuua

SEQ ID NO: 340757 - RNA, 32 nt, Human
auuuuucccuacucuggaauuugaacuuucuu

SEQ ID NO: 340758 - RNA, 32 nt, Human
auuuuucccuuucuuuaaaagaaacuuaacug

SEQ ID NO: 340759 - RNA, 32 nt, Human
auuuuuccuacagcuacauugagauauaguuc

SEQ ID NO: 340760 - RNA, 32 nt, Human
auuuuuccuaguuuaguaucaacauuuuagaa

SEQ ID NO: 340761 - RNA, 32 nt, Human
auuuuuccugcacuuuuucucagguaucaaua

SEQ ID NO: 340762 - RNA, 32 nt, Human
auuuuuccuucccauuauuuaugcauguaaau

SEQ ID NO: 340763 - RNA, 22 nt, Human
auuuuucgaugaaaucuucaga

SEQ ID NO: 340764 - RNA, 32 nt, Human
auuuuucuaaggauuuaaacagcuccacuaua

SEQ ID NO: 340765 - RNA, 32 nt, Human
auuuuucuacuuugcuuuucucuccauacuua

SEQ ID NO: 340766 - RNA, 32 nt, Human
auuuuucuagagccaaagaagcucuuuaaaga

SEQ ID NO: 340767 - RNA, 32 nt, Human
auuuuucuagcgaacguauuucuccagaccca

SEQ ID NO: 340768 - RNA, 32 nt, Human
auuuuucuauugaaaauauguccccuugcaaa

SEQ ID NO: 340769 - RNA, 32 nt, Human
auuuuucuauuuucucuugaaucugcuucuau

SEQ ID NO: 340770 - RNA, 32 nt, Human
auuuuucucauuuuuaguacuauuucaggguu

SEQ ID NO: 340771 - RNA, 32 nt, Human
auuuuucuccaccccaacuucaaugucuugac

SEQ ID NO: 340772 - RNA, 32 nt, Human
auuuuucucuuuacagaaaccccaugcuguuu

SEQ ID NO: 340773 - RNA, 32 nt, Human
auuuuucucuuucuccuccuggccuggccuga

SEQ ID NO: 340774 - RNA, 32 nt, Human
auuuuucugcuccugcuucucucucuucauug

SEQ ID NO: 340775 - RNA, 32 nt, Human
auuuuucuggccucgcuguucuccauagagca

SEQ ID NO: 340776 - RNA, 32 nt, Human
auuuuucugggaauucucagaggccuggaucc

SEQ ID NO: 340777 - RNA, 32 nt, Human
auuuuucuggggagaagguucaagagauucau

SEQ ID NO: 340778 - RNA, 32 nt, Human
auuuuucuguucuguugaauugcuauguucag

SEQ ID NO: 340779 - RNA, 32 nt, Human
auuuuucuuaaccuuggagauggcugucuagg

SEQ ID NO: 340780 - RNA, 32 nt, Human
auuuuucuuagcagacugcagucaauccacau

SEQ ID NO: 340781 - RNA, 32 nt, Human
auuuuucuuccaggaugguguuacugcaguug

SEQ ID NO: 340782 - RNA, 32 nt, Human
auuuuucuuccucuccagccagucuccugugg

SEQ ID NO: 340783 - RNA, 32 nt, Human
auuuuucuucucuucccuuugaucucucuucc

SEQ ID NO: 340784 - RNA, 32 nt, Human
auuuuucuugguuucacacucagcuacaugug

SEQ ID NO: 340785 - RNA, 32 nt, Human
auuuuucuuuucacacaaucucuuuacagcag

SEQ ID NO: 340786 - RNA, 32 nt, Human
auuuuucuuuuggcuccuugaauccccauagg

SEQ ID NO: 340787 - RNA, 32 nt, Human
auuuuucuuuuucuguguauuacuacagguuu

SEQ ID NO: 340788 - RNA, 32 nt, Human
auuuuugaagugaaaaaguacauauauuuugc

SEQ ID NO: 340789 - RNA, 32 nt, Human
auuuuugaagugacugggcaggcagcagaaau

SEQ ID NO: 340790 - RNA, 32 nt, Human
auuuuugaaguuaaaguauucauagcuggaac

SEQ ID NO: 340791 - RNA, 32 nt, Human
auuuuugaaguugaguuuggaguagauugguu

SEQ ID NO: 340792 - RNA, 32 nt, Human
auuuuugagacagggucuugcucugucaccca

SEQ ID NO: 340793 - RNA, 32 nt, Human
auuuuugagauggagucucacucugucaccca

SEQ ID NO: 340794 - RNA, 32 nt, Human
auuuuugagauggagucuugcucugucaccca

SEQ ID NO: 340795 - RNA, 32 nt, Human
auuuuugaggggaagcuggaggcuccccaagg

SEQ ID NO: 340796 - RNA, 32 nt, Human
auuuuugagguuucugugagaaguaaagauag

SEQ ID NO: 340797 - RNA, 32 nt, Human
auuuuugagucuuuuucuuucucauauacaga

SEQ ID NO: 340798 - RNA, 32 nt, Human
auuuuugaugccaaucuuaugagacccuacgc

SEQ ID NO: 340799 - RNA, 32 nt, Human
auuuuugcacauucuacacacagugccuguaa

SEQ ID NO: 340800 - RNA, 32 nt, Human
auuuuugcaccaggauggaaggggauucuuac

SEQ ID NO: 340801 - RNA, 32 nt, Human
auuuuugcaccuuuccauccuccagguuucaa

SEQ ID NO: 340802 - RNA, 31 nt, Human
auuuuugcauugauguucaucagggauauug

SEQ ID NO: 340803 - RNA, 32 nt, Human
auuuuugcauuuuuaguaaugacaggguuuca

SEQ ID NO: 340804 - RNA, 32 nt, Human
auuuuugccaaaauaccacuaguggaaaguca

SEQ ID NO: 340805 - RNA, 32 nt, Human
auuuuugccaacaacucagaagcuaacaaaac

SEQ ID NO: 340806 - RNA, 32 nt, Human
auuuuugccauggaaagaacaucaaacaagcc

SEQ ID NO: 340807 - RNA, 32 nt, Human
auuuuugccccaaauguuucauggcuuauacc

SEQ ID NO: 340808 - RNA, 32 nt, Human
auuuuugcuucaaaggagcucacaagcuaagu

SEQ ID NO: 340809 - RNA, 32 nt, Human
auuuuugcuuggaauaagcaugacagaaagau

SEQ ID NO: 340810 - RNA, 32 nt, Human
auuuuuggaaacaucugcccaauccuggguga

SEQ ID NO: 340811 - RNA, 32 nt, Human
auuuuuggaaacugaagagagaaugguuacca

SEQ ID NO: 340812 - RNA, 32 nt, Human
auuuuuggacccuguuaauagcauuaagguag

SEQ ID NO: 340813 - RNA, 32 nt, Human
auuuuuggagagagcuauguugcugcuuauuu

SEQ ID NO: 340814 - RNA, 32 nt, Human
auuuuuggagcuuuccuuccagaguccuggcu

SEQ ID NO: 340815 - RNA, 32 nt, Human
auuuuuggauucauuccuuugaagggagucgg

SEQ ID NO: 340816 - RNA, 32 nt, Human
auuuuugggaggcagagaggggcaggcuuggg

SEQ ID NO: 340817 - RNA, 32 nt, Human
auuuuugguauuguggcagaaggugaaggcuc

SEQ ID NO: 340818 - RNA, 32 nt, Human
auuuuugguccagaguacuuguuuucccgaug

SEQ ID NO: 340819 - RNA, 32 nt, Human
auuuuuggugacaugcacugagccaaggugau

SEQ ID NO: 340820 - RNA, 32 nt, Human
auuuuuggugcaaguagcacaugguuuaaaua

SEQ ID NO: 340821 - RNA, 32 nt, Human
auuuuugguucuauuaggauuuacuuaacuga

SEQ ID NO: 340822 - RNA, 32 nt, Human
auuuuuguaauuuuaguagagacagaguuuca

SEQ ID NO: 340823 - RNA, 32 nt, Human
auuuuuguaccaaggcgagcaagccuuuuuga

SEQ ID NO: 340824 - RNA, 32 nt, Human
auuuuuguauugaccuuauuucaacugaagcg

SEQ ID NO: 340825 - RNA, 32 nt, Human
auuuuuguauuuuuaguaaagacaggguuuca

SEQ ID NO: 340826 - RNA, 32 nt, Human
auuuuuguauuuuuaguaaagacaggguuuug

SEQ ID NO: 340827 - RNA, 32 nt, Human
auuuuuguauuuuuaguagagacagaguuuca

SEQ ID NO: 340828 - RNA, 32 nt, Human
auuuuuguauuuuuaguagagacagaguuuua

SEQ ID NO: 340829 - RNA, 32 nt, Human
auuuuuguauuuuugguagagacagaguuuca

SEQ ID NO: 340830 - RNA, 32 nt, Human
auuuuuguauuuuuguaauauuuguccacuaa

SEQ ID NO: 340831 - RNA, 32 nt, Human
auuuuugucaugauuuuaaauacacugacacg

SEQ ID NO: 340832 - RNA, 32 nt, Human
auuuuugucauuguuauuuucagaauaccaga

SEQ ID NO: 340833 - RNA, 32 nt, Human
auuuuuguccaguuuucucucuuccaguccca

SEQ ID NO: 340834 - RNA, 32 nt, Human
auuuuuguccauuuguguuucagaaucagcac

SEQ ID NO: 340835 - RNA, 32 nt, Human
auuuuugucgaguuuacuucaugaggagguca

SEQ ID NO: 340836 - RNA, 32 nt, Human
auuuuugucuccccuucccacccuccagccaa

SEQ ID NO: 340837 - RNA, 32 nt, Human
auuuuugugggauguuguucccauucuucuuu

SEQ ID NO: 340838 - RNA, 32 nt, Human
auuuuuguguuuuaguagagauaggguuucac

SEQ ID NO: 340839 - RNA, 32 nt, Human
auuuuuguguuuuuaauaaagacaggguuuca

SEQ ID NO: 340840 - RNA, 32 nt, Human
auuuuuguguuuuuaguagagacagaguuuug

SEQ ID NO: 340841 - RNA, 32 nt, Human
auuuuuguucacugcaaccucugccuuccaag

SEQ ID NO: 340842 - RNA, 32 nt, Human
auuuuuguucugacagugcaugucuuuggaag

SEQ ID NO: 340843 - RNA, 32 nt, Human
auuuuuguuuagacucccugagguuccguuuu

SEQ ID NO: 340844 - RNA, 32 nt, Human
auuuuuguuuuguucacucuucugccuucagu

SEQ ID NO: 340845 - RNA, 32 nt, Human
auuuuuguuuuuaaaaauauuucuuaaacaug

SEQ ID NO: 340846 - RNA, 25 nt, Human
caaaaaagcaaacacaagaaaucaa

SEQ ID NO: 340847 - RNA, 17 nt, Human
caaaaaagcaagcuuua

SEQ ID NO: 340848 - RNA, 25 nt, Human
caaaaaaggcugggauuacaggcau

SEQ ID NO: 340849 - RNA, 20 nt, Human
caaaaaauacgaauguguuc

SEQ ID NO: 340850 - RNA, 27 nt, Human
caaaaaaucaaaugaaagagcauuccu

SEQ ID NO: 340851 - RNA, 22 nt, Human
caaaaaaucagaaaagagccuu

SEQ ID NO: 340852 - RNA, 28 nt, Human
caaaaaauccugauauaaaagaaaucaa

SEQ ID NO: 340853 - RNA, 16 nt, Human
caaaaacaaaaacacc

SEQ ID NO: 340854 - RNA, 22 nt, Human
caaaaacaaaagucuugcuucu

SEQ ID NO: 340855 - RNA, 32 nt, Human
caaaaacaaaccuguguuguuuuuguauagau

SEQ ID NO: 340856 - RNA, 18 nt, Human
caaaaacaacaaaacacc

SEQ ID NO: 340857 - RNA, 32 nt, Human
caaaaacaacugcucaccaaucuuacauugau

SEQ ID NO: 340858 - RNA, 32 nt, Human
caaaaacaauuagcugggcaugauggcacaca

SEQ ID NO: 340859 - RNA, 32 nt, Human
caaaaacaauuagcugggcaugguggccggcg

SEQ ID NO: 340860 - RNA, 22 nt, Human
caaaaacacacccaaacacacc

SEQ ID NO: 340861 - RNA, 21 nt, Human
caaaaacacagaaucccugca

SEQ ID NO: 340862 - RNA, 32 nt, Human
caaaaacacaugcacccaauuauggacaccaa

SEQ ID NO: 340863 - RNA, 32 nt, Human
caaaaacaccuucauccccacccaguggggcc

SEQ ID NO: 340864 - RNA, 17 nt, Human
caaaaacagaaaaaccc

SEQ ID NO: 340865 - RNA, 32 nt, Human
caaaaacaggcagguacagguagugggcucac

SEQ ID NO: 340866 - RNA, 32 nt, Human
caaaaacagugauuaaagcaagagaauuauua

SEQ ID NO: 340867 - RNA, 32 nt, Human
caaaaacauaauucuggcaaugagaguauuuu

SEQ ID NO: 340868 - RNA, 32 nt, Human
caaaaacauccagguuuucucccaagucagag

SEQ ID NO: 340869 - RNA, 32 nt, Human
caaaaaccaaccaaccaaccaaccaaccaaca

SEQ ID NO: 340870 - RNA, 32 nt, Human
caaaaaccaagcucuaccccauccccauccca

SEQ ID NO: 340871 - RNA, 32 nt, Human
caaaaaccagccuguggcccagcuucagcagg

SEQ ID NO: 340872 - RNA, 32 nt, Human
caaaaaccagcugcaaccacagagcucaguca

SEQ ID NO: 340873 - RNA, 32 nt, Human
caaaaaccaucuuuacaggcuccuagaagcug

SEQ ID NO: 340874 - RNA, 32 nt, Human
caaaaacccaacaacacacuuuugugauuuua

SEQ ID NO: 340875 - RNA, 32 nt, Human
caaaaaccccuauggauuagauuuacaauacc

SEQ ID NO: 340876 - RNA, 32 nt, Human
caaaaacggugcuuguucaacuauccugaacu

SEQ ID NO: 340877 - RNA, 32 nt, Human
caaaaacuaccuaaaauaaagauuauagagcc

SEQ ID NO: 340878 - RNA, 32 nt, Human
caaaaacuagccaggugugguucuccaugccu

SEQ ID NO: 340879 - RNA, 32 nt, Human
caaaaacucccaggaugccccggugugaccgc

SEQ ID NO: 340880 - RNA, 32 nt, Human
caaaaacugcagggcccuuggccacacgguca

SEQ ID NO: 340881 - RNA, 32 nt, Human
caaaaacugugccuccccacucgucugugcag

SEQ ID NO: 340882 - RNA, 32 nt, Human
caaaaagaaagaaagaaagaaagaaagaaaga

SEQ ID NO: 340883 - RNA, 32 nt, Human
caaaaagaacaacauaucucagguugucuaag

SEQ ID NO: 340884 - RNA, 32 nt, Human
caaaaagaagaaaugaaagggaaaauaguaca

SEQ ID NO: 340885 - RNA, 32 nt, Human
caaaaagaagaaccuguucuauguuaacuacc

SEQ ID NO: 340886 - RNA, 32 nt, Human
caaaaagaagucguuccccaucaggaaguccu

SEQ ID NO: 340887 - RNA, 32 nt, Human
caaaaagaauugcccacgcuguggaagauaaa

SEQ ID NO: 340888 - RNA, 32 nt, Human
caaaaagacaagcaaaaacaauuaccagauug

SEQ ID NO: 340889 - RNA, 32 nt, Human
caaaaagacugccuuuuuaugauccacauacc

SEQ ID NO: 340890 - RNA, 32 nt, Human
caaaaagagaagagaagaaaaagggaggagag

SEQ ID NO: 340891 - RNA, 32 nt, Human
caaaaagagacagcaacuggcccagggucacc

SEQ ID NO: 340892 - RNA, 32 nt, Human
caaaaagagacuugaauguuguggacaaaauc

SEQ ID NO: 340893 - RNA, 32 nt, Human
caaaaagaggcagagccggcagggaccgagcg

SEQ ID NO: 340894 - RNA, 32 nt, Human
caaaaagaggcagagcgaguagagagcagccc

SEQ ID NO: 340895 - RNA, 32 nt, Human
caaaaagaguaauuuaauaagcauuaaaggua

SEQ ID NO: 340896 - RNA, 32 nt, Human
caaaaagaucaccacacccaagacacuugcuu

SEQ ID NO: 340897 - RNA, 32 nt, Human
caaaaagaugcagagagcagggcaguagcuac

SEQ ID NO: 340898 - RNA, 32 nt, Human
caaaaagcaauauuuuucaucacaugccaaaa

SEQ ID NO: 340899 - RNA, 32 nt, Human
caaaaagcacagaaaaaggaagugcuggugca

SEQ ID NO: 340900 - RNA, 32 nt, Human
caaaaagccagccugaauuuucauggccaugg

SEQ ID NO: 340901 - RNA, 32 nt, Human
caaaaagccagggugugccaggagaagggcau

SEQ ID NO: 340902 - RNA, 32 nt, Human
caaaaagcccucugcugacucccucaaguccu

SEQ ID NO: 340903 - RNA, 23 nt, Human
caaaaagcugggauuacuagcau

SEQ ID NO: 340904 - RNA, 32 nt, Human
caaaaaggaaccucuuucaggagcuauaaaag

SEQ ID NO: 340905 - RNA, 32 nt, Human
caaaaaggaccagccugaccagcguggagaaa

SEQ ID NO: 340906 - RNA, 32 nt, Human
caaaaaggagccugugguguuccccagugggg

SEQ ID NO: 340907 - RNA, 32 nt, Human
caaaaaggauguaagacuuggagccagagcau

SEQ ID NO: 340908 - RNA, 32 nt, Human
caaaaaggcaaaggacuccuacucacauaccc

SEQ ID NO: 340909 - RNA, 32 nt, Human
caaaaaggcaagguagaaagaggagugauggg

SEQ ID NO: 340910 - RNA, 32 nt, Human
caaaaaggcugcaagaaggguguuggaggguc

SEQ ID NO: 340911 - RNA, 32 nt, Human
caaaaaggcuuagaucugggcuauucccaugu

SEQ ID NO: 340912 - RNA, 32 nt, Human
caaaaaggggaagaguagacacugcugaagga

SEQ ID NO: 340913 - RNA, 32 nt, Human
caaaaaggggacauagugacaauuucuccugg

SEQ ID NO: 340914 - RNA, 32 nt, Human
caaaaagggucuggcaaaauaaccucaggagg

SEQ ID NO: 340915 - RNA, 23 nt, Human
caaaaaggugccaaaugcauaua

SEQ ID NO: 340916 - RNA, 32 nt, Human
caaaaagguucuuacaggaguugcaggagaag

SEQ ID NO: 340917 - RNA, 32 nt, Human
caaaaagguuucagguggagcagaucggagag

SEQ ID NO: 340918 - RNA, 32 nt, Human
caaaaaguagcuuuuucuuuccuuccuuccuu

SEQ ID NO: 340919 - RNA, 32 nt, Human
caaaaagucuaagccaaagguucucaggggag

SEQ ID NO: 340920 - RNA, 32 nt, Human
caaaaagucugaccauuggucuuuggauaccu

SEQ ID NO: 340921 - RNA, 32 nt, Human
caaaaagugccugccugugcucucucccucuc

SEQ ID NO: 340922 - RNA, 32 nt, Human
caaaaaguuaaggaacuagggaaaagagaugg

SEQ ID NO: 340923 - RNA, 25 nt, Human
caaaaaguuggagaaaaagucuucc

SEQ ID NO: 340924 - RNA, 32 nt, Human
caaaaaguuucuuuucugaggcugccauacug

SEQ ID NO: 340925 - RNA, 32 nt, Human
caaaaauaaaaauaaaaauuauccaggcgugg

SEQ ID NO: 340926 - RNA, 22 nt, Human
caaaaauaaaagaggugccucu

SEQ ID NO: 340927 - RNA, 24 nt, Human
caaaaauaaagcuggucugccucu

SEQ ID NO: 340928 - RNA, 32 nt, Human
caaaaauaaaggggcuacagaaacacucauuu

SEQ ID NO: 340929 - RNA, 32 nt, Human
caaaaauaaagguuugguuugguuuguuaugg

SEQ ID NO: 340930 - RNA, 22 nt, Human
caaaaauaauuacuucugcccu

SEQ ID NO: 340931 - RNA, 32 nt, Human
caaaaauacaaaaaguuagcugggcauggugg

SEQ ID NO: 340932 - RNA, 22 nt, Human
caaaaauagcaaaagccucucu

SEQ ID NO: 340933 - RNA, 32 nt, Human
caaaaauagugccggguggcccaaagauaaca

SEQ ID NO: 340934 - RNA, 32 nt, Human
caaaaauaucauuaugcagugugugacuguau

SEQ ID NO: 340935 - RNA, 32 nt, Human
caaaaauaugaacauggcugggcgcgguggcu

SEQ ID NO: 340936 - RNA, 32 nt, Human
caaaaaucagaaaguugaaaaagguggggaaa

SEQ ID NO: 340937 - RNA, 32 nt, Human
caaaaaucagccccaaaaagguauuauccauu

SEQ ID NO: 340938 - RNA, 32 nt, Human
caaaaauccugccuucuuugugggggaggggg

SEQ ID NO: 340939 - RNA, 32 nt, Human
caaaaauccuucuccaccgcacagacugggaa

SEQ ID NO: 340940 - RNA, 32 nt, Human
caaaaaugaaaccaucaauaaagacuggguug

SEQ ID NO: 340941 - RNA, 32 nt, Human
caaaaaugaagaggaaaacaaacagguggaga

SEQ ID NO: 340942 - RNA, 32 nt, Human
caaaaaugaauagggauuucacuugggaaaug

SEQ ID NO: 340943 - RNA, 32 nt, Human
caaaaaugacacaagcacaacucuccagacgu

SEQ ID NO: 340944 - RNA, 32 nt, Human
caaaaaugcauucauccaaagcgacacaugug

SEQ ID NO: 340945 - RNA, 32 nt, Human
caaaaauggugaggagggacagauaggaacuc

SEQ ID NO: 340946 - RNA, 32 nt, Human
caaaaauguagaacauauuauagauaguuuac

SEQ ID NO: 340947 - RNA, 22 nt, Human
caaaaauuaacugggcuuggug

SEQ ID NO: 340948 - RNA, 22 nt, Human
caaaaauuagccaggcauggua

SEQ ID NO: 340949 - RNA, 22 nt, Human
caaaaauuagccaggcguggua

SEQ ID NO: 340950 - RNA, 32 nt, Human
caaaaauuagccaggcgugguggugcacaccu

SEQ ID NO: 340951 - RNA, 32 nt, Human
caaaaauuagccaggcgugguggugcacgucu

SEQ ID NO: 340952 - RNA, 32 nt, Human
caaaaauuagccaggcgugguggugcaugccu

SEQ ID NO: 340953 - RNA, 22 nt, Human
caaaaauuagccgggcauggua

SEQ ID NO: 340954 - RNA, 22 nt, Human
caaaaauuagccgggccuggug

SEQ ID NO: 340955 - RNA, 22 nt, Human
caaaaauuagccgggcguggua

SEQ ID NO: 340956 - RNA, 22 nt, Human
caaaaauuagccgggcuuagug

SEQ ID NO: 340957 - RNA, 32 nt, Human
caaaaauuagccuggcgugguggugcacaccu

SEQ ID NO: 340958 - RNA, 32 nt, Human
caaaaauuagccuggcgugguggugcaugccu

SEQ ID NO: 340959 - RNA, 32 nt, Human
caaaaauuagccuggugugguggugcacgccu

SEQ ID NO: 340960 - RNA, 22 nt, Human
caaaaauuagcuaggccuggug

SEQ ID NO: 340961 - RNA, 22 nt, Human
caaaaauuagcugggcauggua

SEQ ID NO: 340962 - RNA, 22 nt, Human
caaaaauuagcugggcgcagua

SEQ ID NO: 340963 - RNA, 32 nt, Human
caaaaauuagcugggcgcgguggugcacaccu

SEQ ID NO: 340964 - RNA, 22 nt, Human
caaaaauuagcugggcguggua

SEQ ID NO: 340965 - RNA, 22 nt, Human
caaaaauuagcugggcuuggug

SEQ ID NO: 340966 - RNA, 32 nt, Human
caaaaauuagcugggugcaguggugcaugccu

SEQ ID NO: 340967 - RNA, 32 nt, Human
caaaaauuagcugggugugauggugcacaucu

SEQ ID NO: 340968 - RNA, 32 nt, Human
caaaaauuagcugggugugguggugcacaccu

SEQ ID NO: 340969 - RNA, 32 nt, Human
caaaaauuagcugggugugguggugcacgccu

SEQ ID NO: 340970 - RNA, 32 nt, Human
caaaaauuagcugggugugguggugcaugccu

SEQ ID NO: 340971 - RNA, 32 nt, Human
caaaaauuauagaauaugggaucccgugugug

SEQ ID NO: 340972 - RNA, 32 nt, Human
caaaaauuaucggggugcaauggcaugcaucu

SEQ ID NO: 340973 - RNA, 32 nt, Human
caaaaauucaccaagcagaaugccucucagcc

SEQ ID NO: 340974 - RNA, 32 nt, Human
caaaaauucccacugucauagcuauaggcugu

SEQ ID NO: 340975 - RNA, 32 nt, Human
caaaaauuccuccccuccuggagcucaguguc

SEQ ID NO: 340976 - RNA, 32 nt, Human
caaaaauuggcugggcgcgguggugcaugccu

SEQ ID NO: 340977 - RNA, 32 nt, Human
caaaaauuucuggcuucucuuaccccuauugc

SEQ ID NO: 340978 - RNA, 32 nt, Human
caaaacaaaacaaaacaaaauuagcugagcau

SEQ ID NO: 340979 - RNA, 32 nt, Human
caaaacaaaacaaaacaaaugacaguaacccu

SEQ ID NO: 340980 - RNA, 32 nt, Human
caaaacaaaacaaaaguggguggcucacuggu

SEQ ID NO: 340981 - RNA, 32 nt, Human
caaaacaaaacaaaugacaguaacccuucccc

SEQ ID NO: 340982 - RNA, 31 nt, Human
caaaacaaaacagugacacucacuugugugu

SEQ ID NO: 340983 - RNA, 32 nt, Human
caaaacaaacaaacacaugggggagagagacu

SEQ ID NO: 340984 - RNA, 32 nt, Human
caaaacaaaccucccuuccccagcagggcugc

SEQ ID NO: 340985 - RNA, 32 nt, Human
caaaacaaaggaugggauacguauagaaugga

SEQ ID NO: 340986 - RNA, 22 nt, Human
caaaacaacaauguaagcagca

SEQ ID NO: 340987 - RNA, 32 nt, Human
caaaacaacacaugaaaccaggauacaagaca

SEQ ID NO: 340988 - RNA, 32 nt, Human
caaaacaacaugcaaccaaaaacuucugacau

SEQ ID NO: 340989 - RNA, 16 nt, Human
caaaacaagaacugug

SEQ ID NO: 340990 - RNA, 32 nt, Human
caaaacaagccaccaugaagcugucggugugu

SEQ ID NO: 340991 - RNA, 32 nt, Human
caaaacaagccgcuaaggcgguggcggcggcg

SEQ ID NO: 340992 - RNA, 32 nt, Human
caaaacaaggaaaucacacauaugcacacaua

SEQ ID NO: 340993 - RNA, 32 nt, Human
caaaacaaggaaaugcagagacagggaaggag

SEQ ID NO: 340994 - RNA, 32 nt, Human
caaaacaauauguauccguacuguaugugaua

SEQ ID NO: 340995 - RNA, 32 nt, Human
caaaacacaaaaagauauuccacaggacaugc

SEQ ID NO: 340996 - RNA, 23 nt, Human
caaaacacaaaucccuuugcuaa

SEQ ID NO: 340997 - RNA, 32 nt, Human
caaaacacacaccacacacacgcgcuuuucca

SEQ ID NO: 340998 - RNA, 32 nt, Human
caaaacacacaugccucuuuguuuugaugcuu

SEQ ID NO: 340999 - RNA, 32 nt, Human
caaaacacagaauugaagguggagccucagcc

SEQ ID NO: 341000 - RNA, 32 nt, Human
caaaacaccacugcuuccuacccagguggcga

SEQ ID NO: 341001 - RNA, 32 nt, Human
caaaacaccagccucucagcccucucuccaua

SEQ ID NO: 341002 - RNA, 32 nt, Human
caaaacacccaccccugcccuccuggcauacu

SEQ ID NO: 341003 - RNA, 32 nt, Human
caaaacacccggcuguccccagacuugugucc

SEQ ID NO: 341004 - RNA, 25 nt, Human
caaaacaccugguguugccgcuuca

SEQ ID NO: 341005 - RNA, 32 nt, Human
caaaacaccuuaaaacuuucuucauaaauacu

SEQ ID NO: 341006 - RNA, 32 nt, Human
caaaacacgguaccuccagaacacuucagcuc

SEQ ID NO: 341007 - RNA, 23 nt, Human
caaaacacuaggaaaugauuaug

SEQ ID NO: 341008 - RNA, 32 nt, Human
caaaacacugaauucucuagaccagaggugcu

SEQ ID NO: 341009 - RNA, 32 nt, Human
caaaacacugcacccgaggcagccaggcagcu

SEQ ID NO: 341010 - RNA, 32 nt, Human
caaaacacuuugaucauggcucagccacuuac

SEQ ID NO: 341011 - RNA, 32 nt, Human
caaaacagaaaagucgcuagaggaauaacaau

SEQ ID NO: 341012 - RNA, 23 nt, Human
caaaacagaacccgugggcccag

SEQ ID NO: 341013 - RNA, 32 nt, Human
caaaacagaagagggaacggaaaaagacaguc

SEQ ID NO: 341014 - RNA, 32 nt, Human
caaaacagagacgggggcaggggcugaagggc

SEQ ID NO: 341015 - RNA, 32 nt, Human
caaaacagaucaggcacagaaagcugaaggug

SEQ ID NO: 341016 - RNA, 32 nt, Human
caaaacagcuaacaacuuagcuguuuucauug

SEQ ID NO: 341017 - RNA, 32 nt, Human
caaaacaggauuagcagagcucuuaaaaacag

SEQ ID NO: 341018 - RNA, 31 nt, Human
caaaacagucuacacagcaggagggauggcu

SEQ ID NO: 341019 - RNA, 32 nt, Human
caaaacauaagaaaguauaccuuggauauaga

SEQ ID NO: 341020 - RNA, 32 nt, Human
caaaacauaccuguauacacacacauucacuc

SEQ ID NO: 341021 - RNA, 32 nt, Human
caaaacaucugaagagcuguacacccacaagg

SEQ ID NO: 341022 - RNA, 24 nt, Human
caaaacaugagaaagccgacugug

SEQ ID NO: 341023 - RNA, 32 nt, Human
caaaacaugcaaaaauuagcugggcaugguag

SEQ ID NO: 341024 - RNA, 32 nt, Human
caaaacauguaaauuaucaaaacaugcauuaa

SEQ ID NO: 341025 - RNA, 32 nt, Human
caaaacauuaggcuccuguuguaucuugguuu

SEQ ID NO: 341026 - RNA, 32 nt, Human
caaaacauuuggugaguuguauucugguuuuc

SEQ ID NO: 341027 - RNA, 32 nt, Human
caaaaccaaacagagacagcuuccagcaccuu

SEQ ID NO: 341028 - RNA, 32 nt, Human
caaaaccaaaggacaacugaggagacugccca

SEQ ID NO: 341029 - RNA, 32 nt, Human
caaaaccaagaacauaucuagcaagaaaacuu

SEQ ID NO: 341030 - RNA, 32 nt, Human
caaaaccaagcucccuucccuuccucccccuu

SEQ ID NO: 341031 - RNA, 32 nt, Human
caaaaccacaauaucagcaacacuuccuaauc

SEQ ID NO: 341032 - RNA, 32 nt, Human
caaaaccacagcccugucagugcagcccgugu

SEQ ID NO: 341033 - RNA, 32 nt, Human
caaaaccacauuagggaauaagcaguauuugc

SEQ ID NO: 341034 - RNA, 32 nt, Human
caaaaccaccuugccucagcugaucagaguuu

SEQ ID NO: 341035 - RNA, 32 nt, Human
caaaaccacuucagagaccaggguaucuccuc

SEQ ID NO: 341036 - RNA, 32 nt, Human
caaaaccagaacugaucuucacauuggaacaa

SEQ ID NO: 341037 - RNA, 32 nt, Human
caaaaccagaagcaaugagaacuaaucucuau

SEQ ID NO: 341038 - RNA, 23 nt, Human
caaaaccagcuugccuccaggac

SEQ ID NO: 341039 - RNA, 32 nt, Human
caaaaccaucaucaacaccaagauaaaaggac

SEQ ID NO: 341040 - RNA, 32 nt, Human
caaaacccacacauagagagacugagaucaca

SEQ ID NO: 341041 - RNA, 32 nt, Human
caaaacccagugccuuccaaaugagcugcagu

SEQ ID NO: 341042 - RNA, 32 nt, Human
caaaacccaguguuugcacacacacaaaaucu

SEQ ID NO: 341043 - RNA, 32 nt, Human
caaaaccccacaaugagauacuaccuacacgg

SEQ ID NO: 341044 - RNA, 32 nt, Human
caaaaccccagccaaugaccagcaguugguau

SEQ ID NO: 341045 - RNA, 32 nt, Human
caaaacccuagcagccugaagaacucuaagcc

SEQ ID NO: 341046 - RNA, 20 nt, Human
caaaacccugaagccauugg

SEQ ID NO: 341047 - RNA, 32 nt, Human
caaaaccgaggacauggugcucuggaguggcc

SEQ ID NO: 341048 - RNA, 32 nt, Human
caaaaccuaccacuucccagagaacaaaauua

SEQ ID NO: 341049 - RNA, 24 nt, Human
caaaaccuauucaaauggguucua

SEQ ID NO: 341050 - RNA, 32 nt, Human
caaaaccucaugcugaccagaguugaggaaca

SEQ ID NO: 341051 - RNA, 32 nt, Human
caaaaccugaaccaccuucugcacuuaaagaa

SEQ ID NO: 341052 - RNA, 22 nt, Human
caaaaccuggcagaugguccua

SEQ ID NO: 341053 - RNA, 32 nt, Human
caaaaccuggggaaguggggcuggaggcucug

SEQ ID NO: 341054 - RNA, 32 nt, Human
caaaaccuggugugucacgugaggucaggagu

SEQ ID NO: 341055 - RNA, 22 nt, Human
caaaaccuguugccuccaccac

SEQ ID NO: 341056 - RNA, 32 nt, Human
caaaaccuucuccagagaaucaagcaagaccu

SEQ ID NO: 341057 - RNA, 32 nt, Human
caaaaccuuugagguagaccaggauuucuaau

SEQ ID NO: 341058 - RNA, 32 nt, Human
caaaacgcaggcaacagaccuauacauuucaa

SEQ ID NO: 341059 - RNA, 32 nt, Human
caaaacggaagaggagaaacucaauacaaaga

SEQ ID NO: 341060 - RNA, 32 nt, Human
caaaacgucgucccugcccuccgggaguuugu

SEQ ID NO: 341061 - RNA, 32 nt, Human
caaaacgugggugcaaaagugaugagacccca

SEQ ID NO: 341062 - RNA, 32 nt, Human
caaaacuaaaaucaaaguuucacuacauaaca

SEQ ID NO: 341063 - RNA, 32 nt, Human
caaaacuaaauaaacguaaaagaaauacaaca

SEQ ID NO: 341064 - RNA, 32 nt, Human
caaaacuaaauacuugcuccauuuacaaacua

SEQ ID NO: 341065 - RNA, 32 nt, Human
caaaacuaacaaaaauccuguuagccaaauaa

SEQ ID NO: 341066 - RNA, 32 nt, Human
caaaacuaacuguacaucacagaacacacuug

SEQ ID NO: 341067 - RNA, 32 nt, Human
caaaacuaccucuucaguguuuuuaacuuuug

SEQ ID NO: 341068 - RNA, 32 nt, Human
caaaacuagaucuuugucaucuuuucaguaau

SEQ ID NO: 341069 - RNA, 32 nt, Human
caaaacucaaaggcggagagcucagugggcac

SEQ ID NO: 341070 - RNA, 32 nt, Human
caaaacucaggccagagccacagcugggagac

SEQ ID NO: 341071 - RNA, 32 nt, Human
caaaacucaguagcucagguucucuggagcca

SEQ ID NO: 341072 - RNA, 32 nt, Human
caaaacucaguuaucugugggggaagugguag

SEQ ID NO: 341073 - RNA, 32 nt, Human
caaaacuccugccucucggccgcuucagcagg

SEQ ID NO: 341074 - RNA, 32 nt, Human
caaaacucuauucaagaaagcacacaggccuu

SEQ ID NO: 341075 - RNA, 32 nt, Human
caaaacucuccucugcugcuggcugguuagag

SEQ ID NO: 341076 - RNA, 32 nt, Human
caaaacucugucaggcauugaaugacaagcau

SEQ ID NO: 341077 - RNA, 32 nt, Human
caaaacucuguggggcuggguuccucucuuuu

SEQ ID NO: 341078 - RNA, 32 nt, Human
caaaacugagugaaaguaacugcugagauaac

SEQ ID NO: 341079 - RNA, 32 nt, Human
caaaacugagugugugucucuguuucaugggg

SEQ ID NO: 341080 - RNA, 32 nt, Human
caaaacugccaaaaauauaauucuuaguggaa

SEQ ID NO: 341081 - RNA, 32 nt, Human
caaaacugccucaagucggccucuccaggccc

SEQ ID NO: 341082 - RNA, 32 nt, Human
caaaacugccucuuucuuucucguggcaaauc

SEQ ID NO: 341083 - RNA, 20 nt, Human
caaaacugcuccuccuccug

SEQ ID NO: 341084 - RNA, 32 nt, Human
caaaacugcuucugguuuaggcacacgucacg

SEQ ID NO: 341085 - RNA, 32 nt, Human
caaaacugcuuugaaccaucgcacugcaaccu

SEQ ID NO: 341086 - RNA, 32 nt, Human
caaaacuggacucagcacacuccugggaaucu

SEQ ID NO: 341087 - RNA, 32 nt, Human
caaaacuguccagcaaaaugaaaagacucacg

SEQ ID NO: 341088 - RNA, 32 nt, Human
caaaacugugaggaagguuaucgggacagagg

SEQ ID NO: 341089 - RNA, 32 nt, Human
caaaacuguuaggugaguagggcaguucauuc

SEQ ID NO: 341090 - RNA, 32 nt, Human
caaaacuguuuuauagucauugauuuggugag

SEQ ID NO: 341091 - RNA, 32 nt, Human
caaaacuuccaggggaauguagagccacgucc

SEQ ID NO: 341092 - RNA, 32 nt, Human
caaaacuucgagaagauuuggaacucuacuau

SEQ ID NO: 341093 - RNA, 32 nt, Human
caaaacuugcagcuagaauugagggaagagag

SEQ ID NO: 341094 - RNA, 32 nt, Human
caaaacuuuguugaccucuuucucuguagaaa

SEQ ID NO: 341095 - RNA, 32 nt, Human
caaaagaaaagaaagaaagggaaguagaagua

SEQ ID NO: 341096 - RNA, 32 nt, Human
caaaagaaaccagcuccugugucaaagggcuu

SEQ ID NO: 341097 - RNA, 18 nt, Human
caaaagaaagaaaggggg

SEQ ID NO: 341098 - RNA, 32 nt, Human
caaaagaaagagacuucauuuggcaguucuga

SEQ ID NO: 341099 - RNA, 32 nt, Human
caaaagaaagccccaaacaacagaaagcauag

SEQ ID NO: 341100 - RNA, 32 nt, Human
caaaagaaagcggggacagggaaggaggaaga

SEQ ID NO: 341101 - RNA, 32 nt, Human
caaaagaacacaaaagccuuuuuccauuguau

SEQ ID NO: 341102 - RNA, 32 nt, Human
caaaagaagaauagccuccaccaggaaggugu

SEQ ID NO: 341103 - RNA, 32 nt, Human
caaaagaagacauacaugcagccaacaaauac

SEQ ID NO: 341104 - RNA, 32 nt, Human
caaaagaagagagauuccaagcaacccaucuu

SEQ ID NO: 341105 - RNA, 32 nt, Human
caaaagaagccaauggagggagagggagcguc

SEQ ID NO: 341106 - RNA, 32 nt, Human
caaaagaaugaaagguggcagugaagaugggg

SEQ ID NO: 341107 - RNA, 32 nt, Human
caaaagacagcagugggccugacaucuugggc

SEQ ID NO: 341108 - RNA, 32 nt, Human
caaaagacagccacccuccugcuccggauccu

SEQ ID NO: 341109 - RNA, 32 nt, Human
caaaagacauuucugauuucugcuucacuuug

SEQ ID NO: 341110 - RNA, 32 nt, Human
caaaagaccagaaaagcacucuccacccagca

SEQ ID NO: 341111 - RNA, 32 nt, Human
caaaagaccagcuggucccagauucgcugcug

SEQ ID NO: 341112 - RNA, 19 nt, Human
caaaagacugcccagaggg

SEQ ID NO: 341113 - RNA, 32 nt, Human
caaaagacugguuuguuugcuuaauuuccuuc

SEQ ID NO: 341114 - RNA, 32 nt, Human
caaaagacuguaccuaacuggaaugagguuac

SEQ ID NO: 341115 - RNA, 32 nt, Human
caaaagagcccaaaugaccaaauccauggaua

SEQ ID NO: 341116 - RNA, 32 nt, Human
caaaagagcggagcauuccucccacccaggcg

SEQ ID NO: 341117 - RNA, 32 nt, Human
caaaagagucaccaccucaugccaucuuguua

SEQ ID NO: 341118 - RNA, 32 nt, Human
caaaagaguuguuuuuaacugcccuaaacauu

SEQ ID NO: 341119 - RNA, 32 nt, Human
caaaagauaacauuggugucacugugguauua

SEQ ID NO: 341120 - RNA, 32 nt, Human
caaaagauacgcccuucucccugcacauaaag

SEQ ID NO: 341121 - RNA, 32 nt, Human
caaaagaugcagaggucaaccugauaaucaug

SEQ ID NO: 341122 - RNA, 32 nt, Human
caaaagaugcugcagagacagcuccccacgcc

SEQ ID NO: 341123 - RNA, 32 nt, Human
caaaagauggagugagccacaggaaguuuggg

SEQ ID NO: 341124 - RNA, 24 nt, Human
caaaagcaaaagcacaguaacuca

SEQ ID NO: 341125 - RNA, 32 nt, Human
caaaagcaaacaguuccagcaggcucucuaaa

SEQ ID NO: 341126 - RNA, 22 nt, Human
caaaagcaaagcauuaguggcu

SEQ ID NO: 341127 - RNA, 32 nt, Human
caaaagcaagaaguggucuucuggccuggcaa

SEQ ID NO: 341128 - RNA, 22 nt, Human
caaaagcagaaaucgcugcaag

SEQ ID NO: 341129 - RNA, 32 nt, Human
caaaagcagacaccuuugccuuguuccugagc

SEQ ID NO: 341130 - RNA, 32 nt, Human
caaaagcagcagacauguaagcagaugugcaa

SEQ ID NO: 341131 - RNA, 32 nt, Human
caaaagcagcgugggagcgccgggcuggcuuc

SEQ ID NO: 341132 - RNA, 32 nt, Human
caaaagcaggugaaaugaggcugaaaucaagg

SEQ ID NO: 341133 - RNA, 32 nt, Human
caaaagcaugucucacauaguggcaggcagga

SEQ ID NO: 341134 - RNA, 32 nt, Human
caaaagccaaggggaauuuugcagugauagga

SEQ ID NO: 341135 - RNA, 32 nt, Human
caaaagccaaguccagaaggaggugcuuuuaa

SEQ ID NO: 341136 - RNA, 32 nt, Human
caaaagccagcaacacagcauugaguacacga

SEQ ID NO: 341137 - RNA, 24 nt, Human
caaaagccagcaauaauucuucaa

SEQ ID NO: 341138 - RNA, 32 nt, Human
caaaagccagggugcccccagaagaacugaga

SEQ ID NO: 341139 - RNA, 32 nt, Human
caaaagccagucccauggcacucgagaagcag

SEQ ID NO: 341140 - RNA, 32 nt, Human
caaaagccauucuaacagcagcaccuugucgg

SEQ ID NO: 341141 - RNA, 32 nt, Human
caaaagccccuggcagugguggggaauguuga

SEQ ID NO: 341142 - RNA, 32 nt, Human
caaaagcccugaccccagggaaggaggcugcu

SEQ ID NO: 341143 - RNA, 32 nt, Human
caaaagccuaccccugcaacaaaauagaagcu

SEQ ID NO: 341144 - RNA, 32 nt, Human
caaaagccucuccugcugaugggcacuaggag

SEQ ID NO: 341145 - RNA, 32 nt, Human
caaaagccugaagaaagugaucaagaucacug

SEQ ID NO: 341146 - RNA, 32 nt, Human
caaaagccugggaagaauuuucccuauccaga

SEQ ID NO: 341147 - RNA, 26 nt, Human
caaaagccuguguguuccuccauuga

SEQ ID NO: 341148 - RNA, 25 nt, Human
caaaagcuccauaaaggguuggaga

SEQ ID NO: 341149 - RNA, 22 nt, Human
caaaagcugggauuacaggcgu

SEQ ID NO: 341150 - RNA, 32 nt, Human
caaaagcuucuucucccccagugcugaucuug

SEQ ID NO: 341151 - RNA, 20 nt, Human
caaaagcuugggggaggagg

SEQ ID NO: 341152 - RNA, 32 nt, Human
caaaagcuuugccacauucuucacauuuguau

SEQ ID NO: 341153 - RNA, 32 nt, Human
caaaagcuuuucauuaucugaagacaaaaccg

SEQ ID NO: 341154 - RNA, 32 nt, Human
caaaaggaacacacuugcaauuuucuacuuuu

SEQ ID NO: 341155 - RNA, 32 nt, Human
caaaaggaagaaaaggaggaaggaaggaaaag

SEQ ID NO: 341156 - RNA, 32 nt, Human
caaaaggaauaagcaaaggugugcaaagguaa

SEQ ID NO: 341157 - RNA, 32 nt, Human
caaaaggacaggcuguccaagguagaaacugu

SEQ ID NO: 341158 - RNA, 32 nt, Human
caaaaggagacacccccaaaucccacucuaaa

SEQ ID NO: 341159 - RNA, 23 nt, Human
caaaaggaggcgaaugggcucag

SEQ ID NO: 341160 - RNA, 32 nt, Human
caaaaggaucagaauccacguaaugaaaaagg

SEQ ID NO: 341161 - RNA, 32 nt, Human
caaaaggcaaagguauuauguaaaaauauuua

SEQ ID NO: 341162 - RNA, 32 nt, Human
caaaaggcaagacucuggcaggugggucaaug

SEQ ID NO: 341163 - RNA, 32 nt, Human
caaaaggcagaaggagggagaccccaaaaaga

SEQ ID NO: 341164 - RNA, 32 nt, Human
caaaaggcaggcagugcugguuccucugccug

SEQ ID NO: 341165 - RNA, 32 nt, Human
caaaaggcagugccaugcaagcuguuuaaaau

SEQ ID NO: 341166 - RNA, 32 nt, Human
caaaaggccuguugacuggggcugcuuuuaac

SEQ ID NO: 341167 - RNA, 32 nt, Human
caaaaggcuaggggguuggagguggggacucu

SEQ ID NO: 341168 - RNA, 32 nt, Human
caaaagggaagcagaaacaaaugaaguugcag

SEQ ID NO: 341169 - RNA, 32 nt, Human
caaaagggaguggagugcagucaugcagaagc

SEQ ID NO: 341170 - RNA, 32 nt, Human
caaaagggccauuuucaccugccucagcauuc

SEQ ID NO: 341171 - RNA, 32 nt, Human
caaaagggccucucccuuuguguucuauacau

SEQ ID NO: 341172 - RNA, 32 nt, Human
caaaagggcugcacuucucgggguuugcagaa

SEQ ID NO: 341173 - RNA, 18 nt, Human
caaaagggcuggcagcug

SEQ ID NO: 341174 - RNA, 32 nt, Human
caaaaggggagaagaucccacuacucucccac

SEQ ID NO: 341175 - RNA, 32 nt, Human
caaaaggggcugggacacucugaacuccugca

SEQ ID NO: 341176 - RNA, 32 nt, Human
caaaaggguggaagaaccaucaagacagcuug

SEQ ID NO: 341177 - RNA, 32 nt, Human
caaaagggugggggugggaggggcagaggcca

SEQ ID NO: 341178 - RNA, 32 nt, Human
caaaaggucauuguuucucacuagaccccagg

SEQ ID NO: 341179 - RNA, 32 nt, Human
caaaaggugccauuaaaaagcaauaccauuuu

SEQ ID NO: 341180 - RNA, 32 nt, Human
caaaagguggcaacccauggaggcagaaagaa

SEQ ID NO: 341181 - RNA, 32 nt, Human
caaaaggugggugguagguguggggagagcug

SEQ ID NO: 341182 - RNA, 32 nt, Human
caaaaguaagccauccucaaauaaggaacccc

SEQ ID NO: 341183 - RNA, 23 nt, Human
caaaaguaaucgcaguuuugcca

SEQ ID NO: 341184 - RNA, 24 nt, Human
caaaaguaauugcgguuuuugcca

SEQ ID NO: 341185 - RNA, 22 nt, Human
caaaaguaauugugguuuuugc

SEQ ID NO: 341186 - RNA, 24 nt, Human
caaaaguaauugugguuuuugcca

SEQ ID NO: 341187 - RNA, 32 nt, Human
caaaaguacgaacuuagcaacacuauauugag

SEQ ID NO: 341188 - RNA, 32 nt, Human
caaaaguagacugauuacacugaggugaggcu

SEQ ID NO: 341189 - RNA, 24 nt, Human
caaaaguagggccagguuuugaca

SEQ ID NO: 341190 - RNA, 17 nt, Human
caaaaguauugggugag

SEQ ID NO: 341191 - RNA, 32 nt, Human
caaaagucacagcuuagcugggcacaguggcu

SEQ ID NO: 341192 - RNA, 32 nt, Human
caaaagucaucaacucagagacagagccaggg

SEQ ID NO: 341193 - RNA, 32 nt, Human
caaaagucauucucucuuuaaccauauaauuu

SEQ ID NO: 341194 - RNA, 32 nt, Human
caaaaguccccgggaccuggagagauggaguc

SEQ ID NO: 341195 - RNA, 32 nt, Human
caaaaguccuuuuagcauucuaccucaaaggg

SEQ ID NO: 341196 - RNA, 32 nt, Human
caaaagugaaguaaugcacagauggaaauuua

SEQ ID NO: 341197 - RNA, 32 nt, Human
caaaagugaauuacccagagugugcuggcaga

SEQ ID NO: 341198 - RNA, 32 nt, Human
caaaagugacaauacuguugguccuugugaau

SEQ ID NO: 341199 - RNA, 32 nt, Human
caaaagugaccuucuagccuucuccugcccuc

SEQ ID NO: 341200 - RNA, 32 nt, Human
caaaagugaguuugcuuaaugaagacauuuaa

SEQ ID NO: 341201 - RNA, 32 nt, Human
caaaagugauguaaaaaugaaaagccaaauaa

SEQ ID NO: 341202 - RNA, 32 nt, Human
caaaaguggccaggcuggaggucuucuaaugu

SEQ ID NO: 341203 - RNA, 32 nt, Human
caaaaguggccuuuaccucuggauagcuuuua

SEQ ID NO: 341204 - RNA, 32 nt, Human
caaaagugugugccaccauggccugcuauuuu

SEQ ID NO: 341205 - RNA, 32 nt, Human
caaaaguuccccucaguucuuggcuuucccuu

SEQ ID NO: 341206 - RNA, 32 nt, Human
caaaaguuuaaucagaggaaauucuuucccag

SEQ ID NO: 341207 - RNA, 32 nt, Human
caaaaguuuaguuuauaaugauaucucucaaa

SEQ ID NO: 341208 - RNA, 32 nt, Human
caaaaguuuccccucauaauucuuugcucuug

SEQ ID NO: 341209 - RNA, 32 nt, Human
caaaauaaaaggauuuuucuguaacugucacc

SEQ ID NO: 341210 - RNA, 21 nt, Human
caaaauaaacagauucuucaa

SEQ ID NO: 341211 - RNA, 32 nt, Human
caaaauaaacuuucuccagucugggaaccuuu

SEQ ID NO: 341212 - RNA, 26 nt, Human
caaaauaaagccccucuuugcauuua

SEQ ID NO: 341213 - RNA, 32 nt, Human
caaaauaaaggccgacuacuuagcagagaaua

SEQ ID NO: 341214 - RNA, 32 nt, Human
caaaauaacacacuccagaacuuggcaguugu

SEQ ID NO: 341215 - RNA, 32 nt, Human
caaaauaacuaaagacauuucagcauugcuua

SEQ ID NO: 341216 - RNA, 32 nt, Human
caaaauaacuccagaaagaagcacuuagcgug

SEQ ID NO: 341217 - RNA, 32 nt, Human
caaaauaagacauacuuuaacuauugucauuu

SEQ ID NO: 341218 - RNA, 32 nt, Human
caaaauaauaacaggcugggugcaauggcuca

SEQ ID NO: 341219 - RNA, 32 nt, Human
caaaauaauaagagccaucuaugacaaaacca

SEQ ID NO: 341220 - RNA, 32 nt, Human
caaaauaauaagagccauuuaugacaaaccca

SEQ ID NO: 341221 - RNA, 32 nt, Human
caaaauaauacaacaaucccagcaucugauug

SEQ ID NO: 341222 - RNA, 32 nt, Human
caaaauaauggugauacauucuagccuuaaga

SEQ ID NO: 341223 - RNA, 32 nt, Human
caaaauaaugugccacuagaaaugguguaaag

SEQ ID NO: 341224 - RNA, 32 nt, Human
caaaauacaaguccuguucuguaguucuugcc

SEQ ID NO: 341225 - RNA, 32 nt, Human
caaaauacacugugaguucaaugauucugcuu

SEQ ID NO: 341226 - RNA, 32 nt, Human
caaaauacagcagaggacaccaggacuuucau

SEQ ID NO: 341227 - RNA, 32 nt, Human
caaaauaccacggacaugcuagugcagagugg

SEQ ID NO: 341228 - RNA, 32 nt, Human
caaaauaccagccuguuuagcaguguuacacu

SEQ ID NO: 341229 - RNA, 32 nt, Human
caaaauaccuguaaucccagcacuuugggagg

SEQ ID NO: 341230 - RNA, 32 nt, Human
caaaauacgugcucuccucucuccuugucagc

SEQ ID NO: 341231 - RNA, 21 nt, Human
caaaauacuauuucuuacauu

SEQ ID NO: 341232 - RNA, 32 nt, Human
caaaauacuguaaucucagcauuuugggagac

SEQ ID NO: 341233 - RNA, 32 nt, Human
caaaauagaacacaauagagaacuucaaaaua

SEQ ID NO: 341234 - RNA, 32 nt, Human
caaaauagaacugcauuuccuuuaaaauggag

SEQ ID NO: 341235 - RNA, 32 nt, Human
caaaauagagagagggaaaaauccuuguuuuc

SEQ ID NO: 341236 - RNA, 32 nt, Human
caaaauagaguaaagaaagaaguugagucaaa

SEQ ID NO: 341237 - RNA, 32 nt, Human
caaaauagcaaaauggugaagaggaggguucu

SEQ ID NO: 341238 - RNA, 32 nt, Human
caaaauagcaguaucagugucauaauaucacc

SEQ ID NO: 341239 - RNA, 32 nt, Human
caaaauagcccucccauugucagucuggacaa

SEQ ID NO: 341240 - RNA, 32 nt, Human
caaaauagccuauccuuaauaaauccuccacu

SEQ ID NO: 341241 - RNA, 31 nt, Human
caaaauagugauggagaaaaagguugucuuu

SEQ ID NO: 341242 - RNA, 32 nt, Human
caaaauaguucagaacauagagaaggaccaag

SEQ ID NO: 341243 - RNA, 32 nt, Human
caaaauaguugaagcuuaauuacuugacuugc

SEQ ID NO: 341244 - RNA, 32 nt, Human
caaaauauaaugaaggggauggugggauauuu

SEQ ID NO: 341245 - RNA, 23 nt, Human
caaaauauauacaacacacauuu

SEQ ID NO: 341246 - RNA, 24 nt, Human
caaaauauauauucauaccauuua

SEQ ID NO: 341247 - RNA, 32 nt, Human
caaaauauccuaagccuccuggaccuggcagg

SEQ ID NO: 341248 - RNA, 32 nt, Human
caaaauaucugaauaggugcaguuuuaguuua

SEQ ID NO: 341249 - RNA, 32 nt, Human
caaaauauggcugggugcaguggcucacaccg

SEQ ID NO: 341250 - RNA, 32 nt, Human
caaaauauggugcauggacaugcugaacugaa

SEQ ID NO: 341251 - RNA, 31 nt, Human
caaaauauuacuguggagguugaagaguuug

SEQ ID NO: 341252 - RNA, 32 nt, Human
caaaauauugagacuccugucucuccaaaaca

SEQ ID NO: 341253 - RNA, 23 nt, Human
caaaauauuggaaauacaggcau

SEQ ID NO: 341254 - RNA, 32 nt, Human
caaaaucacaaaacuaaguugucaguuaucac

SEQ ID NO: 341255 - RNA, 32 nt, Human
caaaaucacgccacugcacuccagccugggca

SEQ ID NO: 341256 - RNA, 32 nt, Human
caaaaucacugaggcugugacaggaggggaag

SEQ ID NO: 341257 - RNA, 32 nt, Human
caaaaucacugcaccuuguccaacuccauuuu

SEQ ID NO: 341258 - RNA, 32 nt, Human
caaaaucagaaacacaguacaaauaaaacaga

SEQ ID NO: 341259 - RNA, 23 nt, Human
caaaaucagaccagaacuucuga

SEQ ID NO: 341260 - RNA, 32 nt, Human
caaaaucagaccuuggccaugaccuuaagcag

SEQ ID NO: 341261 - RNA, 32 nt, Human
caaaaucaggguuugguuuggggaagaaaauc

SEQ ID NO: 341262 - RNA, 20 nt, Human
caaaaucauaggcuuuuucu

SEQ ID NO: 341263 - RNA, 32 nt, Human
caaaaucaugccaauguauuccagucugggug

SEQ ID NO: 341264 - RNA, 32 nt, Human
caaaaucaugccacugcacuccagccugggca

SEQ ID NO: 341265 - RNA, 32 nt, Human
caaaaucaugccauugcacuccagccugggug

SEQ ID NO: 341266 - RNA, 32 nt, Human
caaaauccaaauucaaagaaacagggcguggg

SEQ ID NO: 341267 - RNA, 32 nt, Human
caaaauccauuucuuauugaucuuuaaagaug

SEQ ID NO: 341268 - RNA, 32 nt, Human
caaaaucccaccacugcacuccagccugggug

SEQ ID NO: 341269 - RNA, 32 nt, Human
caaaaucccacugaugcccaucaugcccucag

SEQ ID NO: 341270 - RNA, 32 nt, Human
caaaauccccucccaaaccacucuccacagcu

SEQ ID NO: 341271 - RNA, 22 nt, Human
caaaauccugggauuacaggcg

SEQ ID NO: 341272 - RNA, 32 nt, Human
caaaauccuuucucccccgaaugcuuuaccag

SEQ ID NO: 341273 - RNA, 32 nt, Human
caaaaucgaaaucagguguuugcucaaaugag

SEQ ID NO: 341274 - RNA, 32 nt, Human
caaaaucgcgucacugcacuccagccugagug

SEQ ID NO: 341275 - RNA, 32 nt, Human
caaaaucuauucuauuuccucaucucccuaac

SEQ ID NO: 341276 - RNA, 32 nt, Human
caaaaucucagcucuuuauccauugcuuucac

SEQ ID NO: 341277 - RNA, 32 nt, Human
caaaaucucauggguuaguuaaccaggugcaa

SEQ ID NO: 341278 - RNA, 32 nt, Human
caaaaucuccaauccacacauauuguuuuaaa

SEQ ID NO: 341279 - RNA, 32 nt, Human
caaaaucucuacugcuuuggauccugggucaa

SEQ ID NO: 341280 - RNA, 32 nt, Human
caaaaucuuccuuuguguaggacaagaaaauu

SEQ ID NO: 341281 - RNA, 32 nt, Human
caaaaucuuugguagauggagggaacugggga

SEQ ID NO: 341282 - RNA, 24 nt, Human
caaaaugaaaacaaagcaaaugaa

SEQ ID NO: 341283 - RNA, 32 nt, Human
caaaaugaaaccaguaaagcaucuguugacca

SEQ ID NO: 341284 - RNA, 24 nt, Human
caaaaugaaaggaaaaagccuccu

SEQ ID NO: 341285 - RNA, 32 nt, Human
caaaaugaaaggauuucuggucucggugcugu

SEQ ID NO: 341286 - RNA, 21 nt, Human
caaaaugaaaguaauggagaa

SEQ ID NO: 341287 - RNA, 20 nt, Human
caaaaugaaauccagugaag

SEQ ID NO: 341288 - RNA, 32 nt, Human
caaaaugaacuuacucuagaaagcuuacccuu

SEQ ID NO: 341289 - RNA, 32 nt, Human
caaaaugaagaaaagcagaugaacagaaggag

SEQ ID NO: 341290 - RNA, 32 nt, Human
caaaaugacaaacacaaagggaaagaggagag

SEQ ID NO: 341291 - RNA, 29 nt, Human
caaaaugacaacacccagaaauucaguaa

SEQ ID NO: 341292 - RNA, 32 nt, Human
caaaaugacuucgaacugucuaaugccucaga

SEQ ID NO: 341293 - RNA, 32 nt, Human
caaaaugagacguggucuaaagcccuuucccu

SEQ ID NO: 341294 - RNA, 23 nt, Human
caaaaugagagacaaaaaugaag

SEQ ID NO: 341295 - RNA, 32 nt, Human
caaaaugagcccuguccugccuaaggcugaac

SEQ ID NO: 341296 - RNA, 32 nt, Human
caaaaugaggaagugaguguucuuggacgaac

SEQ ID NO: 341297 - RNA, 32 nt, Human
caaaaugaucacugccuacuugugauucaaau

SEQ ID NO: 341298 - RNA, 32 nt, Human
caaaaugauuuccaaagcagaacauggaacuu

SEQ ID NO: 341299 - RNA, 32 nt, Human
caaaaugcagagccaggucccucagcccagac

SEQ ID NO: 341300 - RNA, 32 nt, Human
caaaaugcauuacaccuguaguguaaaguggc

SEQ ID NO: 341301 - RNA, 32 nt, Human
caaaaugccaaagauuaaucugugauugguga

SEQ ID NO: 341302 - RNA, 32 nt, Human
caaaaugccgaacgagaaaacuguccauuuuc

SEQ ID NO: 341303 - RNA, 32 nt, Human
caaaaugcuacacccacauucucuccaacucu

SEQ ID NO: 341304 - RNA, 32 nt, Human
caaaaugcucaaggaauuagcucugggaauau

SEQ ID NO: 341305 - RNA, 32 nt, Human
caaaaugcucagaagaaaagugaauaauucag

SEQ ID NO: 341306 - RNA, 23 nt, Human
caaaaugcugagauuacaggugu

SEQ ID NO: 341307 - RNA, 32 nt, Human
caaaaugcugggacuauaggugugagccacug

SEQ ID NO: 341308 - RNA, 23 nt, Human
caaaaugcugggacuaugggcau

SEQ ID NO: 341309 - RNA, 23 nt, Human
caaaaugcugggauuacaagcgu

SEQ ID NO: 341310 - RNA, 19 nt, Human
caaaaugcugggauuacag

SEQ ID NO: 341311 - RNA, 20 nt, Human
caaaaugcugggauuacagg

SEQ ID NO: 341312 - RNA, 21 nt, Human
caaaaugcugggauuacaggc

SEQ ID NO: 341313 - RNA, 22 nt, Human
caaaaugcugggauuacaggca

SEQ ID NO: 341314 - RNA, 23 nt, Human
caaaaugcugggauuacaggcau

SEQ ID NO: 341315 - RNA, 23 nt, Human
caaaaugcugggauuacaggcgu

SEQ ID NO: 341316 - RNA, 23 nt, Human
caaaaugcugggauuacaggggu

SEQ ID NO: 341317 - RNA, 23 nt, Human
caaaaugcugggauuacaugcau

SEQ ID NO: 341318 - RNA, 32 nt, Human
caaaaugcugggauugcagacauggaccauca

SEQ ID NO: 341319 - RNA, 32 nt, Human
caaaaugcuguuggaauaugcagagaauugcu

SEQ ID NO: 341320 - RNA, 23 nt, Human
caaaaugcuucgauugcaggcau

SEQ ID NO: 341321 - RNA, 23 nt, Human
caaaaugcuuggauuacaggcau

SEQ ID NO: 341322 - RNA, 23 nt, Human
caaaaugcuuguccaggacucag

SEQ ID NO: 341323 - RNA, 32 nt, Human
caaaaugcuuugaggauucaucagaaccagua

SEQ ID NO: 341324 - RNA, 32 nt, Human
caaaaugcuuuuuauuucugcauauguugaau

SEQ ID NO: 341325 - RNA, 32 nt, Human
caaaaugcuuuuuauuucugcauauguuugaa

SEQ ID NO: 341326 - RNA, 21 nt, Human
caaaauggaauagggacucag

SEQ ID NO: 341327 - RNA, 32 nt, Human
caaaauggaauagggacucagggugggucagg

SEQ ID NO: 341328 - RNA, 21 nt, Human
caaaauggagauggaucccag

SEQ ID NO: 341329 - RNA, 32 nt, Human
caaaauggagguuucacaggcugugcgggagc

SEQ ID NO: 341330 - RNA, 21 nt, Human
caaaauggcagcauggcccag

SEQ ID NO: 341331 - RNA, 21 nt, Human
caaaauggcuuccuacauuua

SEQ ID NO: 341332 - RNA, 32 nt, Human
caaaauggggaugucaagccaaagagucagaa

SEQ ID NO: 341333 - RNA, 32 nt, Human
caaaaugguaaauacucauuaccucucucagc

SEQ ID NO: 341334 - RNA, 32 nt, Human
caaaauguaaauuauguauaccugccaagaua

SEQ ID NO: 341335 - RNA, 24 nt, Human
caaaauguauaauuucuuaauuug

SEQ ID NO: 341336 - RNA, 32 nt, Human
caaaauguauuuauauguucucugcugauguu

SEQ ID NO: 341337 - RNA, 32 nt, Human
caaaaugucucaauggugcuauaauaaauaaa

SEQ ID NO: 341338 - RNA, 32 nt, Human
caaaaugucucuggacaaagagagucagagaa

SEQ ID NO: 341339 - RNA, 32 nt, Human
caaaaugugcaaggaagaauaauggaagcccc

SEQ ID NO: 341340 - RNA, 32 nt, Human
caaaauguggaaugcauccaaauaggagucuu

SEQ ID NO: 341341 - RNA, 32 nt, Human
caaaauguuccaagcacuuuaggcagacacca

SEQ ID NO: 341342 - RNA, 32 nt, Human
caaaauguucuuuguucuuuggcuccaaaaag

SEQ ID NO: 341343 - RNA, 23 nt, Human
caaaauguugagauugcaggcau

SEQ ID NO: 341344 - RNA, 23 nt, Human
caaaauguugcaauuacaggcau

SEQ ID NO: 341345 - RNA, 19 nt, Human
caaaauguuggcuuuuucu

SEQ ID NO: 341346 - RNA, 32 nt, Human
caaaauguuuucuccagcaucacagauccugc

SEQ ID NO: 341347 - RNA, 32 nt, Human
caaaauuaaaaacacaacaguggaagagaaac

SEQ ID NO: 341348 - RNA, 32 nt, Human
caaaauuacagacaggucuugcuuucuuugua

SEQ ID NO: 341349 - RNA, 32 nt, Human
caaaauuaccuguacaccacaccccugugaca

SEQ ID NO: 341350 - RNA, 32 nt, Human
caaaauuacgccacugcacuccagccugggca

SEQ ID NO: 341351 - RNA, 32 nt, Human
caaaauuagaaaaauaacucccuacuuuucca

SEQ ID NO: 341352 - RNA, 32 nt, Human
caaaauuagccgggcaugguggaacacaccug

SEQ ID NO: 341353 - RNA, 32 nt, Human
caaaauuagcuaggcacuaucucauucauacu

SEQ ID NO: 341354 - RNA, 32 nt, Human
caaaauuauuuccauauucauaugaaaaaccc

SEQ ID NO: 341355 - RNA, 32 nt, Human
caaaauuauuuguaaagaacaucuuuccuacu

SEQ ID NO: 341356 - RNA, 22 nt, Human
caaaauuauuuucaaaucaaga

SEQ ID NO: 341357 - RNA, 32 nt, Human
caaaauucaaauaacauaaacuucaccacuuu

SEQ ID NO: 341358 - RNA, 32 nt, Human
caaaauucaagcaauucuccugccucagccuc

SEQ ID NO: 341359 - RNA, 32 nt, Human
caaaauucagcaccuuguacauauaucagaua

SEQ ID NO: 341360 - RNA, 28 nt, Human
caaaauucagcugcugccucugucuuga

SEQ ID NO: 341361 - RNA, 32 nt, Human
caaaauucaguaaaccacacaaaucagguaag

SEQ ID NO: 341362 - RNA, 32 nt, Human
caaaauucauuugcuugcaaucuaaucugaac

SEQ ID NO: 341363 - RNA, 32 nt, Human
caaaauuccuagaauaccauguuuucaugguu

SEQ ID NO: 341364 - RNA, 32 nt, Human
caaaauucuagggaaaaauacugcuaaaaaug

SEQ ID NO: 341365 - RNA, 32 nt, Human
caaaauucucauuuaauuuucuggucagcaag

SEQ ID NO: 341366 - RNA, 32 nt, Human
caaaauucuccacaauccuccaccuccgcucu

SEQ ID NO: 341367 - RNA, 23 nt, Human
caaaauucugggauuacaggcau

SEQ ID NO: 341368 - RNA, 32 nt, Human
caaaauugagcauaguaauuacccacagaagg

SEQ ID NO: 341369 - RNA, 32 nt, Human
caaaauugcaccacugcacacugcacuccauc

SEQ ID NO: 341370 - RNA, 32 nt, Human
caaaauugcaccacugcacuccagccugggaa

SEQ ID NO: 341371 - RNA, 32 nt, Human
caaaauugcaccacugcacuccagccugggag

SEQ ID NO: 341372 - RNA, 32 nt, Human
caaaauugcaccacugcacuccauccugggca

SEQ ID NO: 341373 - RNA, 32 nt, Human
caaaauugcaccacugcacugcagccugggaa

SEQ ID NO: 341374 - RNA, 32 nt, Human
caaaauugccuccuuuucaucuccucauauug

SEQ ID NO: 341375 - RNA, 32 nt, Human
caaaauuggaaauguuggcuucaccagaaccu

SEQ ID NO: 341376 - RNA, 32 nt, Human
caaaauuggagacacuccaacgaggcuaaguu

SEQ ID NO: 341377 - RNA, 32 nt, Human
caaaauuggcacaaagugcuaggguuuauaua

SEQ ID NO: 341378 - RNA, 32 nt, Human
caaaauuguuaaaaauaccuuuagaaggucua

SEQ ID NO: 341379 - RNA, 32 nt, Human
caaaauuguucuggaaacuuugguggugguca

SEQ ID NO: 341380 - RNA, 32 nt, Human
caaaauuuaggauuugccgcuuccauaaauca

SEQ ID NO: 341381 - RNA, 32 nt, Human
caaaauuuagucugggccuagugcaguggcuc

SEQ ID NO: 341382 - RNA, 32 nt, Human
caaaauuucaggcuuuuucuccacacuuguau

SEQ ID NO: 341383 - RNA, 32 nt, Human
caaaauuuccuugagacucuuuagcauucaua

SEQ ID NO: 341384 - RNA, 32 nt, Human
caaaauuucuguauuuggagggaccaguagac

SEQ ID NO: 341385 - RNA, 23 nt, Human
caaaauuugugcucuuucauuug

SEQ ID NO: 341386 - RNA, 24 nt, Human
caaaauuuuaaauuuaacucugcc

SEQ ID NO: 341387 - RNA, 32 nt, Human
caaaauuuugacugucagcuacauguugguaa

SEQ ID NO: 341388 - RNA, 32 nt, Human
caaaauuuuguuguuucuagauaacuguucug

SEQ ID NO: 341389 - RNA, 26 nt, Human
caaaauuuuuugcucuuuuacauuua

SEQ ID NO: 341390 - RNA, 32 nt, Human
caaacaaaaaccauagcauucugaaacaauag

SEQ ID NO: 341391 - RNA, 22 nt, Human
caaacaaaaagagaggcauuuu

SEQ ID NO: 341392 - RNA, 22 nt, Human
caaacaaaaggugggcuuuccu

SEQ ID NO: 341393 - RNA, 32 nt, Human
caaacaaaauaggagcucacauggauauauuu

SEQ ID NO: 341394 - RNA, 32 nt, Human
caaacaaaauuagcugggcaugguggcggaca

SEQ ID NO: 341395 - RNA, 31 nt, Human
caaacaaacaaaacaacuagcuagggauggu

SEQ ID NO: 341396 - RNA, 32 nt, Human
caaacaaacagccuuguuucucuagucacauc

SEQ ID NO: 341397 - RNA, 32 nt, Human
caaacaaacauacacucucuccagcaaagcuu

SEQ ID NO: 341398 - RNA, 32 nt, Human
caaacaaagcagcaggcuuuugggaacaucug

SEQ ID NO: 341399 - RNA, 32 nt, Human
caaacaaagccagaagcugagcaccaggggau

SEQ ID NO: 341400 - RNA, 32 nt, Human
caaacaaagcuacaauaaguucauguguauug

SEQ ID NO: 341401 - RNA, 32 nt, Human
caaacaaaguagggggaaaagaauaagcaaua

SEQ ID NO: 341402 - RNA, 32 nt, Human
caaacaaauacaaaauccuucuccagacccca

SEQ ID NO: 341403 - RNA, 22 nt, Human
caaacaaauuaucuucuuuuaa

SEQ ID NO: 341404 - RNA, 32 nt, Human
caaacaacaacaagacauucauucccaacgau

SEQ ID NO: 341405 - RNA, 32 nt, Human
caaacaacagaaacguauugcucacaguccug

SEQ ID NO: 341406 - RNA, 32 nt, Human
caaacaaccagcuacugcccagcucuuuaucc

SEQ ID NO: 341407 - RNA, 20 nt, Human
caaacaaccauccacacugc

SEQ ID NO: 341408 - RNA, 32 nt, Human
caaacaaccaugugguuggauuacauggaguc

SEQ ID NO: 341409 - RNA, 32 nt, Human
caaacaaccgcagccgcuguucccaggauggu

SEQ ID NO: 341410 - RNA, 32 nt, Human
caaacaacuuggggaaaccgaggcagaaagcc

SEQ ID NO: 341411 - RNA, 32 nt, Human
caaacaagacacaaacaaacagucuuuugcuu

SEQ ID NO: 341412 - RNA, 32 nt, Human
caaacaaguuagagcuggcagcugaaugauag

SEQ ID NO: 341413 - RNA, 32 nt, Human
caaacaaugagguuguagggggagguagggaa

SEQ ID NO: 341414 - RNA, 32 nt, Human
caaacaauuuucucuuggugguguggaaacuc

SEQ ID NO: 341415 - RNA, 32 nt, Human
caaacacaacuaaggccucugguacccucugc

SEQ ID NO: 341416 - RNA, 32 nt, Human
caaacacaagaggcaggucaaagggcuuugga

SEQ ID NO: 341417 - RNA, 32 nt, Human
caaacacacacaaaugcccaaccagcucuaag

SEQ ID NO: 341418 - RNA, 32 nt, Human
caaacacacacccggcagacuucaagagucuc

SEQ ID NO: 341419 - RNA, 32 nt, Human
caaacacacaugcacacagcacaauucagaaa

SEQ ID NO: 341420 - RNA, 32 nt, Human
caaacacacaugcccacacaaugcucacagug

SEQ ID NO: 341421 - RNA, 22 nt, Human
caaacacaccaagaagcauuuu

SEQ ID NO: 341422 - RNA, 23 nt, Human
caaacacacccugccucccccag

SEQ ID NO: 341423 - RNA, 32 nt, Human
caaacacacuccugcucaaauggcguuauucu

SEQ ID NO: 341424 - RNA, 32 nt, Human
caaacacagcauggaggacacagaugacucuu

SEQ ID NO: 341425 - RNA, 32 nt, Human
caaacacaggaaaauaaaaugcauaacuauac

SEQ ID NO: 341426 - RNA, 31 nt, Human
caaacacaguuucacacugauucuuaacauu

SEQ ID NO: 341427 - RNA, 32 nt, Human
caaacaccaaucucucaaaggcagcagauugu

SEQ ID NO: 341428 - RNA, 32 nt, Human
caaacaccagaaggagcugucuggaagguuug

SEQ ID NO: 341429 - RNA, 23 nt, Human
caaacaccagaaugauguucgac

SEQ ID NO: 341430 - RNA, 32 nt, Human
caaacacccaaacuguuuggauugauugcuuu

SEQ ID NO: 341431 - RNA, 32 nt, Human
caaacacccaagccacaggauaccucagaugg

SEQ ID NO: 341432 - RNA, 32 nt, Human
caaacacccagcucagccacacacaacuaccc

SEQ ID NO: 341433 - RNA, 32 nt, Human
caaacaccuccaccacugccccgcaacaucca

SEQ ID NO: 341434 - RNA, 32 nt, Human
caaacaccugccucccccuccagccuucucca

SEQ ID NO: 341435 - RNA, 32 nt, Human
caaacacgggccuugcucuuguggagcuuaga

SEQ ID NO: 341436 - RNA, 32 nt, Human
caaacacgugcucacccucacacucgccccgg

SEQ ID NO: 341437 - RNA, 32 nt, Human
caaacacuaguggaacuuggagcauuguggug

SEQ ID NO: 341438 - RNA, 32 nt, Human
caaacacuccacccccuccagcuccaguuucc

SEQ ID NO: 341439 - RNA, 32 nt, Human
caaacacuccacccuccaccuuccauuuuccc

SEQ ID NO: 341440 - RNA, 32 nt, Human
caaacacucgagcuuccaucuuguugaggagg

SEQ ID NO: 341441 - RNA, 32 nt, Human
caaacacugcagcaucuuccccagcguugaga

SEQ ID NO: 341442 - RNA, 32 nt, Human
caaacacugcaggaggugagggugucugacgu

SEQ ID NO: 341443 - RNA, 32 nt, Human
caaacacuggagaaagcugggcccuacagaaa

SEQ ID NO: 341444 - RNA, 22 nt, Human
caaacacugguuugcaucccag

SEQ ID NO: 341445 - RNA, 32 nt, Human
caaacacugugccuacagccucccaggggugg

SEQ ID NO: 341446 - RNA, 32 nt, Human
caaacacuguggcuccuccaccaccuucaaac

SEQ ID NO: 341447 - RNA, 32 nt, Human
caaacacuguugcccaggcuggagugcaguga

SEQ ID NO: 341448 - RNA, 32 nt, Human
caaacacuuacugacaaaucggguccugaguu

SEQ ID NO: 341449 - RNA, 32 nt, Human
caaacacuuucacuuugagcugggcaaaucuu

SEQ ID NO: 341450 - RNA, 32 nt, Human
caaacagaaagaaaucugcaugaguugcuuuu

SEQ ID NO: 341451 - RNA, 21 nt, Human
caaacagaaggagaagcauuu

SEQ ID NO: 341452 - RNA, 32 nt, Human
caaacagaccaccaccaggacugugccugaac

SEQ ID NO: 341453 - RNA, 32 nt, Human
caaacagcaaaacugagugugugucucuguuu

SEQ ID NO: 341454 - RNA, 32 nt, Human
caaacagcaaagacccaagaacugaauaugcu

SEQ ID NO: 341455 - RNA, 20 nt, Human
caaacagcaccugcggagcc

SEQ ID NO: 341456 - RNA, 32 nt, Human
caaacagccccugggcugugccuggauccccc

SEQ ID NO: 341457 - RNA, 32 nt, Human
caaacagcccuucacuuccucucccacuucag

SEQ ID NO: 341458 - RNA, 32 nt, Human
caaacagccuacucgggguucuuggguagccu

SEQ ID NO: 341459 - RNA, 32 nt, Human
caaacagcucacuguccucuggaucugcugcg

SEQ ID NO: 341460 - RNA, 32 nt, Human
caaacagcuuugaacaagaucuagucauguaa

SEQ ID NO: 341461 - RNA, 32 nt, Human
caaacaggaacacuagagaccaaaaaggggac

SEQ ID NO: 341462 - RNA, 20 nt, Human
caaacaggaccaggccuccu

SEQ ID NO: 341463 - RNA, 24 nt, Human
caaacaggacccuggcagccuccc

SEQ ID NO: 341464 - RNA, 32 nt, Human
caaacaggcacucaaccacuauuuguugaaug

SEQ ID NO: 341465 - RNA, 32 nt, Human
caaacaggcagcgcgcgacaauggcggucgcu

SEQ ID NO: 341466 - RNA, 32 nt, Human
caaacagggcgagaggucgcugggcagcguuc

SEQ ID NO: 341467 - RNA, 32 nt, Human
caaacaggguccuuagcuggggcaggggagcc

SEQ ID NO: 341468 - RNA, 32 nt, Human
caaacaggucaggugcuuguucuguccucuug

SEQ ID NO: 341469 - RNA, 32 nt, Human
caaacagucaguggaguggaggcuccagucag

SEQ ID NO: 341470 - RNA, 32 nt, Human
caaacagucccuguccagcuuggacgcugcuc

SEQ ID NO: 341471 - RNA, 32 nt, Human
caaacagugggacaaugguuggaaagcauugg

SEQ ID NO: 341472 - RNA, 32 nt, Human
caaacaguuccagcaggcucucuaaagaaaaa

SEQ ID NO: 341473 - RNA, 32 nt, Human
caaacaguuccaucugccguuuauggguaaaa

SEQ ID NO: 341474 - RNA, 32 nt, Human
caaacaguucccaaacagaaauuccagagaug

SEQ ID NO: 341475 - RNA, 32 nt, Human
caaacaguugcuugaugugauauggaguagaa

SEQ ID NO: 341476 - RNA, 32 nt, Human
caaacaguugugccuuuuuccucuuuugguuu

SEQ ID NO: 341477 - RNA, 32 nt, Human
caaacauacccuaguccuucagccuggggcuc

SEQ ID NO: 341478 - RNA, 32 nt, Human
caaacauacuguucccauacauaguacaaaga

SEQ ID NO: 341479 - RNA, 32 nt, Human
caaacauauauguauguaugaauguacauaaa

SEQ ID NO: 341480 - RNA, 32 nt, Human
caaacaucaggcaauuuccaggguuggucuag

SEQ ID NO: 341481 - RNA, 32 nt, Human
caaacauccagucccucucauauugccuuuga

SEQ ID NO: 341482 - RNA, 17 nt, Human
caaacaucccccaauga

SEQ ID NO: 341483 - RNA, 32 nt, Human
caaacaucccuucugcugaaacaagcugugau

SEQ ID NO: 341484 - RNA, 32 nt, Human
caaacaucguauguucucaauuauaagaggga

SEQ ID NO: 341485 - RNA, 32 nt, Human
caaacaucuccagcacuaauguuuccaucuua

SEQ ID NO: 341486 - RNA, 32 nt, Human
caaacaucugagauuccauuuuugccaugugu

SEQ ID NO: 341487 - RNA, 32 nt, Human
caaacaugaagcucuggccuccuuuccucagc

SEQ ID NO: 341488 - RNA, 32 nt, Human
caaacaugagacaaagcugacuguucacacug

SEQ ID NO: 341489 - RNA, 32 nt, Human
caaacaugcacacacacauaugcauaucuuga

SEQ ID NO: 341490 - RNA, 32 nt, Human
caaacauggcgaaaccccaucuguacugaaaa

SEQ ID NO: 341491 - RNA, 32 nt, Human
caaacauggguuuaguuuucaccagaauggaa

SEQ ID NO: 341492 - RNA, 32 nt, Human
caaacauuagauuugaaagaguaauaguuuau

SEQ ID NO: 341493 - RNA, 32 nt, Human
caaacauucuuuaucccucccaccccagggaa

SEQ ID NO: 341494 - RNA, 32 nt, Human
caaacauuggccuucccuuggagggauccucu

SEQ ID NO: 341495 - RNA, 32 nt, Human
caaaccaaaacacacaccaaauaaucagaaac

SEQ ID NO: 341496 - RNA, 32 nt, Human
caaaccaaacuuuuucucaaaccagggacuau

SEQ ID NO: 341497 - RNA, 32 nt, Human
caaaccaaagagaccguucguggagucuaaug

SEQ ID NO: 341498 - RNA, 31 nt, Human
caaaccaacaacacagcuggggcgggcccug

SEQ ID NO: 341499 - RNA, 32 nt, Human
caaaccaacuccaccaaccucuggcucuuaaa

SEQ ID NO: 341500 - RNA, 32 nt, Human
caaaccaacuccaccaaccucuggcucuuaca

SEQ ID NO: 341501 - RNA, 32 nt, Human
caaaccaagccgcggcgguguccgcggcccug

SEQ ID NO: 341502 - RNA, 32 nt, Human
caaaccaauuugggauaucuaacucuaaagag

SEQ ID NO: 341503 - RNA, 32 nt, Human
caaaccacagccuauccucugcuccauuucac

SEQ ID NO: 341504 - RNA, 32 nt, Human
caaaccacauuagaagucugugcagacauccc

SEQ ID NO: 341505 - RNA, 32 nt, Human
caaaccacccuccaaggccugucccacacgau

SEQ ID NO: 341506 - RNA, 32 nt, Human
caaaccacucacuggguaccccaccuccucuc

SEQ ID NO: 341507 - RNA, 32 nt, Human
caaaccacucagccucugugugccucaguuuu

SEQ ID NO: 341508 - RNA, 32 nt, Human
caaaccacugcaauccagccugggcaacgagc

SEQ ID NO: 341509 - RNA, 32 nt, Human
caaaccacuguaguccagccugagugacagag

SEQ ID NO: 341510 - RNA, 32 nt, Human
caaaccacuguggagccugaagcuccuuaaga

SEQ ID NO: 341511 - RNA, 32 nt, Human
caaaccagacugggcuaaguucugcugcuauc

SEQ ID NO: 341512 - RNA, 32 nt, Human
caaaccagagguggaggaagaacgguaggaag

SEQ ID NO: 341513 - RNA, 32 nt, Human
caaaccagcccagagcagggucucucuaaagg

SEQ ID NO: 341514 - RNA, 32 nt, Human
caaaccagccuccuggugcuugaagguuucau

SEQ ID NO: 341515 - RNA, 32 nt, Human
caaaccagccugggcaauagagugagacccug

SEQ ID NO: 341516 - RNA, 32 nt, Human
caaaccagcuuuguggccuguuuuaugucauc

SEQ ID NO: 341517 - RNA, 32 nt, Human
caaaccaggaaaacagcaggagaggguggcuc

SEQ ID NO: 341518 - RNA, 32 nt, Human
caaaccaggaauauucuugaaaagaacgugag

SEQ ID NO: 341519 - RNA, 32 nt, Human
caaaccagucaccucucuccuagauucauucu

SEQ ID NO: 341520 - RNA, 32 nt, Human
caaaccagucugcugguuaaauggaaacuuaa

SEQ ID NO: 341521 - RNA, 32 nt, Human
caaaccaguucugaagcaguuuccccuagagc

SEQ ID NO: 341522 - RNA, 32 nt, Human
caaaccauaagccugaggagguuuuuaucaac

SEQ ID NO: 341523 - RNA, 32 nt, Human
caaaccauagcugucuguccagugcucucuuc

SEQ ID NO: 341524 - RNA, 32 nt, Human
caaaccaugacgugaagaaugagauaggagac

SEQ ID NO: 341525 - RNA, 32 nt, Human
caaacccaaaacaaacaagaaaagcaaaagga

SEQ ID NO: 341526 - RNA, 32 nt, Human
caaacccaacagcccaaaaccaggcacagcca

SEQ ID NO: 341527 - RNA, 32 nt, Human
caaacccaaccauaucagcugcugcucuuuau

SEQ ID NO: 341528 - RNA, 32 nt, Human
caaacccaagaggcggagguugaguaagcuga

SEQ ID NO: 341529 - RNA, 32 nt, Human
caaacccaaggaggugacaggaggagcccccg

SEQ ID NO: 341530 - RNA, 32 nt, Human
caaacccaccucacaggaacuaaagcaacuuu

SEQ ID NO: 341531 - RNA, 32 nt, Human
caaacccaccuccaccaugggggccaugacuc

SEQ ID NO: 341532 - RNA, 32 nt, Human
caaacccaccuugcucuguguucucaggcccc

SEQ ID NO: 341533 - RNA, 32 nt, Human
caaacccagaauucuuaaccaguacccaacag

SEQ ID NO: 341534 - RNA, 31 nt, Human
caaacccagagagccaaacuuguagaggugg

SEQ ID NO: 341535 - RNA, 32 nt, Human
caaacccagccuuuugcgauuauggcuugugg

SEQ ID NO: 341536 - RNA, 32 nt, Human
caaacccaggaggcagaaguugcaagguugag

SEQ ID NO: 341537 - RNA, 18 nt, Human
caaacccagggcugaggc

SEQ ID NO: 341538 - RNA, 32 nt, Human
caaacccagguguggcuccagagcccauccuc

SEQ ID NO: 341539 - RNA, 32 nt, Human
caaacccaguggcuugaaacuuccugagaaac

SEQ ID NO: 341540 - RNA, 32 nt, Human
caaacccauucauucccaucccugucaccagu

SEQ ID NO: 341541 - RNA, 23 nt, Human
caaacccauugagcuuggggcug

SEQ ID NO: 341542 - RNA, 32 nt, Human
caaacccauuuuggcuuugugcgucauauccu

SEQ ID NO: 341543 - RNA, 17 nt, Human
caaaccccaaacugggg

SEQ ID NO: 341544 - RNA, 32 nt, Human
caaaccccaaggcccucaucugccuuuguccc

SEQ ID NO: 341545 - RNA, 32 nt, Human
caaaccccaaugugucaagacagacuuguuua

SEQ ID NO: 341546 - RNA, 32 nt, Human
caaaccccacacacacucaaggggucgaaaac

SEQ ID NO: 341547 - RNA, 32 nt, Human
caaaccccuccaccaucccacacccuccuccu

SEQ ID NO: 341548 - RNA, 32 nt, Human
caaaccccuccaggauucccgcaggccggugu

SEQ ID NO: 341549 - RNA, 32 nt, Human
caaaccccucucuccuccucaugccacugccu

SEQ ID NO: 341550 - RNA, 32 nt, Human
caaacccgagcagggagcaggagcaggaaaag

SEQ ID NO: 341551 - RNA, 32 nt, Human
caaacccgggaggcagagguugcagugaccca

SEQ ID NO: 341552 - RNA, 32 nt, Human
caaacccgggaggcggagauugcagugagcca

SEQ ID NO: 341553 - RNA, 32 nt, Human
caaacccgguggcugcuucaugagccugacug

SEQ ID NO: 341554 - RNA, 32 nt, Human
caaacccuacagucugcaggggacuuggacaa

SEQ ID NO: 341555 - RNA, 18 nt, Human
caaacccuccaagugauu

SEQ ID NO: 341556 - RNA, 32 nt, Human
caaacccuccacugguucccauggcccaugcc

SEQ ID NO: 341557 - RNA, 32 nt, Human
caaacccuccaggccucaguuucuucaccugu

SEQ ID NO: 341558 - RNA, 32 nt, Human
caaacccugacccaccuccuuccuuuccucca

SEQ ID NO: 341559 - RNA, 32 nt, Human
caaacccuggcuccagugucauggaauccguc

SEQ ID NO: 341560 - RNA, 32 nt, Human
caaacccugguguuuggagaggccccagggag

SEQ ID NO: 341561 - RNA, 32 nt, Human
caaacccuugcugccaguuccucuuugauaaa

SEQ ID NO: 341562 - RNA, 32 nt, Human
caaaccgaaguuggcugggaagaaagaugagu

SEQ ID NO: 341563 - RNA, 32 nt, Human
caaaccuacacugucuaugacagcucuaguug

SEQ ID NO: 341564 - RNA, 32 nt, Human
caaaccuaccacugcaugacaguuuuaguuug

SEQ ID NO: 341565 - RNA, 32 nt, Human
caaaccuaccccggaucucuggcuucagccgc

SEQ ID NO: 341566 - RNA, 32 nt, Human
caaaccuaggagagggcaguggguagauucuc

SEQ ID NO: 341567 - RNA, 32 nt, Human
caaaccucacauccucccuucaguuuaaugca

SEQ ID NO: 341568 - RNA, 32 nt, Human
caaaccucacguggccucugauuucauugugg

SEQ ID NO: 341569 - RNA, 32 nt, Human
caaaccucaguucugaaagagcuacagaaugc

SEQ ID NO: 341570 - RNA, 32 nt, Human
caaaccucauauaccacucucuuccgaggauu

SEQ ID NO: 341571 - RNA, 32 nt, Human
caaaccucaugcuccccacuugcccuuauugg

SEQ ID NO: 341572 - RNA, 32 nt, Human
caaaccucuccucaugucuccucaugucuuau

SEQ ID NO: 341573 - RNA, 32 nt, Human
caaaccucuccucugcugcaguuuauuccaaa

SEQ ID NO: 341574 - RNA, 32 nt, Human
caaaccucucugcuagcucuucagucuacaaa

SEQ ID NO: 341575 - RNA, 32 nt, Human
caaaccucugcagcaucugcuuuauugccaaa

SEQ ID NO: 341576 - RNA, 32 nt, Human
caaaccucugccgcccuccacaccucuaaaca

SEQ ID NO: 341577 - RNA, 32 nt, Human
caaaccugaacugggcaguggggugagaggag

SEQ ID NO: 341578 - RNA, 26 nt, Human
caaaccugacgaagcagaagcugcau

SEQ ID NO: 341579 - RNA, 32 nt, Human
caaaccugagucccaccaggcccagggcuuca

SEQ ID NO: 341580 - RNA, 32 nt, Human
caaaccugagucuagcacaaugcagcuggagg

SEQ ID NO: 341581 - RNA, 32 nt, Human
caaaccugccuggguuuaaggggagaggaaau

SEQ ID NO: 341582 - RNA, 32 nt, Human
caaaccugcuaaucccacuaauucaggaauuu

SEQ ID NO: 341583 - RNA, 32 nt, Human
caaaccugcuugcugaccucaggcuuggccgu

SEQ ID NO: 341584 - RNA, 32 nt, Human
caaaccuggaugccaccuggagcugcuuccug

SEQ ID NO: 341585 - RNA, 32 nt, Human
caaaccugggaggcgaagauugcagugagcug

SEQ ID NO: 341586 - RNA, 32 nt, Human
caaaccugggcaauguggggagaccccaucuc

SEQ ID NO: 341587 - RNA, 32 nt, Human
caaaccuguaagugucuugggcucagggacca

SEQ ID NO: 341588 - RNA, 32 nt, Human
caaaccuguagucccagcuaccugggaggcug

SEQ ID NO: 341589 - RNA, 32 nt, Human
caaaccuguggagucuguuacuguucuuucug

SEQ ID NO: 341590 - RNA, 32 nt, Human
caaaccuguuucugcuggguugguuaggucug

SEQ ID NO: 341591 - RNA, 32 nt, Human
caaaccuguuuuccacacucugucuuugcagu

SEQ ID NO: 341592 - RNA, 32 nt, Human
caaaccuucaguggugcugucccuggaugggg

SEQ ID NO: 341593 - RNA, 32 nt, Human
caaaccuucauccggcuggagggcagcaugcg

SEQ ID NO: 341594 - RNA, 32 nt, Human
caaaccuucauccuucugucuccagggccuga

SEQ ID NO: 341595 - RNA, 32 nt, Human
caaaccuucuaaguccagagcuaacuuaguac

SEQ ID NO: 341596 - RNA, 32 nt, Human
caaaccuucugccuuugauguuacagauuuaa

SEQ ID NO: 341597 - RNA, 32 nt, Human
caaaccuugggaacagggaguuauggaaacgu

SEQ ID NO: 341598 - RNA, 32 nt, Human
caaaccuuggguuugaaaaggcugggaccccc

SEQ ID NO: 341599 - RNA, 32 nt, Human
caaaccuugguauagaucacuuccuuuucugu

SEQ ID NO: 341600 - RNA, 20 nt, Human
caaaccuuucagcuggcaga

SEQ ID NO: 341601 - RNA, 32 nt, Human
caaaccuuugaagaaacuggaguaggcuguua

SEQ ID NO: 341602 - RNA, 32 nt, Human
caaacgagagucagccuuuaacgaaaugacca

SEQ ID NO: 341603 - RNA, 32 nt, Human
caaacgagauucacccagcgcgaggaggaaga

SEQ ID NO: 341604 - RNA, 32 nt, Human
caaacgaggcauuccaaguuugacagcaugga

SEQ ID NO: 341605 - RNA, 31 nt, Human
caaacgcaggcuaaggagaccaaagcggcga

SEQ ID NO: 341606 - RNA, 32 nt, Human
caaacgcaucccagggccgagugcagggccuc

SEQ ID NO: 341607 - RNA, 32 nt, Human
caaacgcauucacucggggcaguauuaaccgu

SEQ ID NO: 341608 - RNA, 32 nt, Human
caaacgcccucuccgccgucauggcccggcau

SEQ ID NO: 341609 - RNA, 32 nt, Human
caaacgcugccacccuccacuucccaacccag

SEQ ID NO: 341610 - RNA, 32 nt, Human
caaacgggagccaaaacucgaagcuuggaaga

SEQ ID NO: 341611 - RNA, 32 nt, Human
caaacggggaggcagagggaggagggaaggcu

SEQ ID NO: 341612 - RNA, 32 nt, Human
caaacguaugguaaaaugcagcccagccugaa

SEQ ID NO: 341613 - RNA, 32 nt, Human
caaacguauugguucgaugaaggaagggccca

SEQ ID NO: 341614 - RNA, 32 nt, Human
caaacgucugcagcuucacuccugaagccagc

SEQ ID NO: 341615 - RNA, 32 nt, Human
caaacgugagccacugugcuuggccacacaca

SEQ ID NO: 341616 - RNA, 32 nt, Human
caaacgugagccaucgcaccuagccucuuuga

SEQ ID NO: 341617 - RNA, 32 nt, Human
caaacguggaaauggcgccuccaagacccuga

SEQ ID NO: 341618 - RNA, 32 nt, Human
caaacguuaccugacaguuaaggagaggagcu

SEQ ID NO: 341619 - RNA, 32 nt, Human
caaacguuuaauuugcuaaauauuuuaacaag

SEQ ID NO: 341620 - RNA, 18 nt, Human
caaacuaaaaacugggua

SEQ ID NO: 341621 - RNA, 32 nt, Human
caaacuaaaggccacagaaaugggcacuaccu

SEQ ID NO: 341622 - RNA, 32 nt, Human
caaacuaaccagcugggauuacagguaugagc

SEQ ID NO: 341623 - RNA, 32 nt, Human
caaacuaagauaucccucacacccagccccca

SEQ ID NO: 341624 - RNA, 32 nt, Human
caaacuacacagaagaauauuagaacaauuuc

SEQ ID NO: 341625 - RNA, 32 nt, Human
caaacuacagcccaaaggccaaauccauccug

SEQ ID NO: 341626 - RNA, 32 nt, Human
caaacuacauucugaucugcucagggagaagc

SEQ ID NO: 341627 - RNA, 32 nt, Human
caaacuacuaacaugcauugugagaaugccgu

SEQ ID NO: 341628 - RNA, 32 nt, Human
caaacuacuacuggaccuuauuuuggaacuau

SEQ ID NO: 341629 - RNA, 32 nt, Human
caaacuacuauucuuuuuaaacuucuaggauu

SEQ ID NO: 341630 - RNA, 32 nt, Human
caaacuacuguagcagauacuuugccaccuuu

SEQ ID NO: 341631 - RNA, 32 nt, Human
caaacuagccauauuucaagugcucaacagcc

SEQ ID NO: 341632 - RNA, 32 nt, Human
caaacuauuuuccagaguggcugcagucauuu

SEQ ID NO: 341633 - RNA, 32 nt, Human
caaacucaaaauguggaccaguucccucagcc

SEQ ID NO: 341634 - RNA, 32 nt, Human
caaacucaaagcuagguccugaugucucaagg

SEQ ID NO: 341635 - RNA, 32 nt, Human
caaacucaaaggacagauuagggaucgagauu

SEQ ID NO: 341636 - RNA, 32 nt, Human
caaacucaaggaccaggugcugcuggaggggg

SEQ ID NO: 341637 - RNA, 32 nt, Human
caaacucaaguuaugucauaccuuuggauacg

SEQ ID NO: 341638 - RNA, 32 nt, Human
caaacucacagcccucuccaaacuggcugggg

SEQ ID NO: 341639 - RNA, 32 nt, Human
caaacucacuuagaaggagcaagaagcaacug

SEQ ID NO: 341640 - RNA, 32 nt, Human
caaacucaggaagaaaaaggaaagcagaagug

SEQ ID NO: 341641 - RNA, 28 nt, Human
caaacuccaagaccugccucaccucacc

SEQ ID NO: 341642 - RNA, 20 nt, Human
caaacuccagaauuggaggc

SEQ ID NO: 341643 - RNA, 26 nt, Human
caaacucccaaccucaagugauccgc

SEQ ID NO: 341644 - RNA, 21 nt, Human
caaacuccccaucugaagcug

SEQ ID NO: 341645 - RNA, 20 nt, Human
caaacucccccagcccugga

SEQ ID NO: 341646 - RNA, 32 nt, Human
caaacuccccuccaggcugccccugggacaug

SEQ ID NO: 341647 - RNA, 26 nt, Human
caaacucccgaccucaggugauccac

SEQ ID NO: 341648 - RNA, 26 nt, Human
caaacucccgaccucaggugauccgc

SEQ ID NO: 341649 - RNA, 32 nt, Human
caaacucccuuucugugaaagaggccuguggg

SEQ ID NO: 341650 - RNA, 26 nt, Human
caaacuccuaaccucaacugauccac

SEQ ID NO: 341651 - RNA, 24 nt, Human
caaacuccuaaccuugugauccgc

SEQ ID NO: 341652 - RNA, 21 nt, Human
caaacuccuaaggucauccac

SEQ ID NO: 341653 - RNA, 24 nt, Human
caaacuccuacugcuugauggcug

SEQ ID NO: 341654 - RNA, 17 nt, Human
caaacuccucaacuggg

SEQ ID NO: 341655 - RNA, 32 nt, Human
caaacuccucaugauaacugcacacaaucuga

SEQ ID NO: 341656 - RNA, 32 nt, Human
caaacuccuccuccucagccguggcauccuga

SEQ ID NO: 341657 - RNA, 31 nt, Human
caaacuccucuucucaccugccaaagaugga

SEQ ID NO: 341658 - RNA, 24 nt, Human
caaacuccugacccugugauccgc

SEQ ID NO: 341659 - RNA, 26 nt, Human
caaacuccugaccgcaggugauccac

SEQ ID NO: 341660 - RNA, 24 nt, Human
caaacuccugaccuagugauccac

SEQ ID NO: 341661 - RNA, 24 nt, Human
caaacuccugaccuagugaugcac

SEQ ID NO: 341662 - RNA, 26 nt, Human
caaacuccugaccucaaaugauccac

SEQ ID NO: 341663 - RNA, 26 nt, Human
caaacuccugaccucaaguaauccac

SEQ ID NO: 341664 - RNA, 26 nt, Human
caaacuccugaccucaagugauccac

SEQ ID NO: 341665 - RNA, 26 nt, Human
caaacuccugaccucaagugauccgc

SEQ ID NO: 341666 - RNA, 26 nt, Human
caaacuccugaccucagaugauccac

SEQ ID NO: 341667 - RNA, 26 nt, Human
caaacuccugaccucagaugauccgc

SEQ ID NO: 341668 - RNA, 26 nt, Human
caaacuccugaccucagaugaucuac

SEQ ID NO: 341669 - RNA, 26 nt, Human
caaacuccugaccucaggugauccac

SEQ ID NO: 341670 - RNA, 26 nt, Human
caaacuccugaccucaggugauccgc

SEQ ID NO: 341671 - RNA, 26 nt, Human
caaacuccugaccucaggugaucuac

SEQ ID NO: 341672 - RNA, 26 nt, Human
caaacuccugaccucaguugauccac

SEQ ID NO: 341673 - RNA, 24 nt, Human
caaacuccugaccucaugauccac

SEQ ID NO: 341674 - RNA, 26 nt, Human
caaacuccugaccucauguaauccac

SEQ ID NO: 341675 - RNA, 25 nt, Human
caaacuccugaccuccagugaucca

SEQ ID NO: 341676 - RNA, 24 nt, Human
caaacuccugaccucguaauccac

SEQ ID NO: 341677 - RNA, 24 nt, Human
caaacuccugaccucgugauccac

SEQ ID NO: 341678 - RNA, 24 nt, Human
caaacuccugaccucgugauccgc

SEQ ID NO: 341679 - RNA, 24 nt, Human
caaacuccugaccucgugaugcac

SEQ ID NO: 341680 - RNA, 24 nt, Human
caaacuccugaccucuugauccgc

SEQ ID NO: 341681 - RNA, 23 nt, Human
caaacuccugaccuuaggugauc

SEQ ID NO: 341682 - RNA, 24 nt, Human
caaacuccugaccuuauaauccgc

SEQ ID NO: 341683 - RNA, 24 nt, Human
caaacuccugaccuugugauccac

SEQ ID NO: 341684 - RNA, 24 nt, Human
caaacuccugaccuugugauccgc

SEQ ID NO: 341685 - RNA, 22 nt, Human
caaacuccugaccuugugaucu

SEQ ID NO: 341686 - RNA, 24 nt, Human
caaacuccugaccuugugguccac

SEQ ID NO: 341687 - RNA, 26 nt, Human
caaacuccugacuucaaaugauccac

SEQ ID NO: 341688 - RNA, 24 nt, Human
caaacuccugacuuugugauccac

SEQ ID NO: 341689 - RNA, 23 nt, Human
caaacuccugaucucaagugauc

SEQ ID NO: 341690 - RNA, 22 nt, Human
caaacuccugggcucaagugau

SEQ ID NO: 341691 - RNA, 32 nt, Human
caaacuccuggucuugaacuccuggccacaag

SEQ ID NO: 341692 - RNA, 19 nt, Human
caaacuccugguuggugau

SEQ ID NO: 341693 - RNA, 32 nt, Human
caaacuccuuuacugcagccugggcucccucu

SEQ ID NO: 341694 - RNA, 20 nt, Human
caaacucgcaggacauuccu

SEQ ID NO: 341695 - RNA, 32 nt, Human
caaacucuaaaagaaggacgcauuuuagguaa

SEQ ID NO: 341696 - RNA, 32 nt, Human
caaacucuagcuguuucaguaguucuaugagg

SEQ ID NO: 341697 - RNA, 32 nt, Human
caaacucuccccaucucuacugccucaccccg

SEQ ID NO: 341698 - RNA, 32 nt, Human
caaacucugccuggaccccauugucugucugc

SEQ ID NO: 341699 - RNA, 32 nt, Human
caaacucugcucaucuucgagcucucuggaac

SEQ ID NO: 341700 - RNA, 32 nt, Human
caaacucugggaacaggcgagauggaacaggg

SEQ ID NO: 341701 - RNA, 32 nt, Human
caaacucugggcagccucaggaagucaggcag

SEQ ID NO: 341702 - RNA, 32 nt, Human
caaacugaagcagcaaacccacaaagcaucaa

SEQ ID NO: 341703 - RNA, 32 nt, Human
caaacugacagaaaccgucaccacacuggucu

SEQ ID NO: 341704 - RNA, 32 nt, Human
caaacugaggcccagaggggcagggaguuacc

SEQ ID NO: 341705 - RNA, 32 nt, Human
caaacugcagugacuguaaauuggccuggcgu

SEQ ID NO: 341706 - RNA, 32 nt, Human
caaacugccacuccacuccaggugggccacuc

SEQ ID NO: 341707 - RNA, 32 nt, Human
caaacugccagcugccacuggcuuaucaggag

SEQ ID NO: 341708 - RNA, 21 nt, Human
caaacugcccagacuugagcc

SEQ ID NO: 341709 - RNA, 32 nt, Human
caaacugcccaggagugaguagcugcuuucgg

SEQ ID NO: 341710 - RNA, 32 nt, Human
caaacugccguaaccucugccguucaggaacc

SEQ ID NO: 341711 - RNA, 32 nt, Human
caaacugccucacuguuacuucaucaaucaca

SEQ ID NO: 341712 - RNA, 32 nt, Human
caaacugcgggcagaaacuacacacaugugga

SEQ ID NO: 341713 - RNA, 32 nt, Human
caaacugcugaagagugacaagcccuaucacu

SEQ ID NO: 341714 - RNA, 32 nt, Human
caaacugcugaagagugacaagcccuaucauu

SEQ ID NO: 341715 - RNA, 23 nt, Human
caaacugcugggauuacaggcgu

SEQ ID NO: 341716 - RNA, 32 nt, Human
caaacugcuugacccaggaacaaguggcuuag

SEQ ID NO: 341717 - RNA, 32 nt, Human
caaacuggagcaaagucugucuucucacaggg

SEQ ID NO: 341718 - RNA, 32 nt, Human
caaacuggccagacuguucuguagguuaaguc

SEQ ID NO: 341719 - RNA, 32 nt, Human
caaacuggcuacugcugcuuccuguggccucc

SEQ ID NO: 341720 - RNA, 32 nt, Human
caaacugggacugccuuucccucuccucagcc

SEQ ID NO: 341721 - RNA, 32 nt, Human
caaacugggucaucgccuguucacaaaaugcu

SEQ ID NO: 341722 - RNA, 32 nt, Human
caaacuggucucaaacuccuggccucaagcaa

SEQ ID NO: 341723 - RNA, 23 nt, Human
caaacuggugagauuacaggcau

SEQ ID NO: 341724 - RNA, 32 nt, Human
caaacuguacagacucucccaccccaaccucc

SEQ ID NO: 341725 - RNA, 32 nt, Human
caaacuguaugguggagaaagaagugggaagg

SEQ ID NO: 341726 - RNA, 32 nt, Human
caaacugucaaugcacagacuuuucaaagaag

SEQ ID NO: 341727 - RNA, 32 nt, Human
caaacugugaaacagccacuucccuaggcacu

SEQ ID NO: 341728 - RNA, 32 nt, Human
caaacugugcagguccacccacagggauguuu

SEQ ID NO: 341729 - RNA, 32 nt, Human
caaacugugguguuuggaauuggguuuuucaa

SEQ ID NO: 341730 - RNA, 21 nt, Human
caaacugugucucaaggaggu

SEQ ID NO: 341731 - RNA, 32 nt, Human
caaacuguuccagccucugccuguuacccagu

SEQ ID NO: 341732 - RNA, 32 nt, Human
caaacuuaaaagcaaaaucuagccaggugccg

SEQ ID NO: 341733 - RNA, 32 nt, Human
caaacuuaaaaugcccaugucauuucacgagu

SEQ ID NO: 341734 - RNA, 32 nt, Human
caaacuucagcuggcuuggcccucucucugac

SEQ ID NO: 341735 - RNA, 32 nt, Human
caaacuucccagagaguaugugagaaccaacc

SEQ ID NO: 341736 - RNA, 24 nt, Human
caaacuucugaccucgugauccac

SEQ ID NO: 341737 - RNA, 32 nt, Human
caaacuucuggcucccucuucuuucagacuug

SEQ ID NO: 341738 - RNA, 23 nt, Human
caaacuucugggauuacaggcgu

SEQ ID NO: 341739 - RNA, 32 nt, Human
caaacuugaacaaagcugcaggcuccagcguc

SEQ ID NO: 341740 - RNA, 32 nt, Human
caaacuugaggaaugggcaugaauaacuggcu

SEQ ID NO: 341741 - RNA, 32 nt, Human
caaacuugcuugaccuccacuuuucaggagac

SEQ ID NO: 341742 - RNA, 32 nt, Human
caaacuugggcaauucuguuuguguaacuccc

SEQ ID NO: 341743 - RNA, 32 nt, Human
caaacuugguggcaacuugccucccggugcgg

SEQ ID NO: 341744 - RNA, 22 nt, Human
caaacuugugacaaguucuuuu

SEQ ID NO: 341745 - RNA, 32 nt, Human
caaacuuuacuugauaugaaacuccuauuaac

SEQ ID NO: 341746 - RNA, 32 nt, Human
caaacuuucagucucccaccuccagagagggg

SEQ ID NO: 341747 - RNA, 32 nt, Human
caaacuuucaguggugcugucccuggaugggg

SEQ ID NO: 341748 - RNA, 32 nt, Human
caaagaaaaagaaaaagauacgcuugaagaua

SEQ ID NO: 341749 - RNA, 32 nt, Human
caaagaaaacaaaccauugcuuaugcuguuau

SEQ ID NO: 341750 - RNA, 32 nt, Human
caaagaaacagaugccccagccugcuuucaca

SEQ ID NO: 341751 - RNA, 32 nt, Human
caaagaaagaaagcccaaagucaaaguuguua

SEQ ID NO: 341752 - RNA, 32 nt, Human
caaagaaagucacagcaucaauggaggagguu

SEQ ID NO: 341753 - RNA, 19 nt, Human
caaagaaauaaaagaaauc

SEQ ID NO: 341754 - RNA, 32 nt, Human
caaagaacaaagacagacuggaaaguauguga

SEQ ID NO: 341755 - RNA, 32 nt, Human
caaagaacaaauuccagccggcaaauaaauuc

SEQ ID NO: 341756 - RNA, 32 nt, Human
caaagaacacagaaagaggaggagcaaguggg

SEQ ID NO: 341757 - RNA, 24 nt, Human
caaagaacagcucagaugcacaaa

SEQ ID NO: 341758 - RNA, 32 nt, Human
caaagaaccaccaggaaagcaaaucaguuugg

SEQ ID NO: 341759 - RNA, 18 nt, Human
caaagaacuccugccuug

SEQ ID NO: 341760 - RNA, 25 nt, Human
caaagaacugccccaucuccuccca

SEQ ID NO: 341761 - RNA, 23 nt, Human
caaagaacugggauuacaggcau

SEQ ID NO: 341762 - RNA, 32 nt, Human
caaagaacuuguccagaagaaaaaccuguuaa

SEQ ID NO: 341763 - RNA, 22 nt, Human
caaagaacuuuacagaaaucaa

SEQ ID NO: 341764 - RNA, 24 nt, Human
caaagaagaaaauaaaaugagcua

SEQ ID NO: 341765 - RNA, 32 nt, Human
caaagaagaaaaucacucucagaaaugcauug

SEQ ID NO: 341766 - RNA, 32 nt, Human
caaagaagaauaagcaagaaagaaaagaagga

SEQ ID NO: 341767 - RNA, 32 nt, Human
caaagaagcaagaaauaguaugcauguuuggg

SEQ ID NO: 341768 - RNA, 32 nt, Human
caaagaagccaagaugcuagcuaaggugacua

SEQ ID NO: 341769 - RNA, 25 nt, Human
caaagaaggcagcucacuccugcuc

SEQ ID NO: 341770 - RNA, 32 nt, Human
caaagaaggggugggaggagggaacaggggac

SEQ ID NO: 341771 - RNA, 32 nt, Human
caaagaaggguggcgagaagaaaacgggccgu

SEQ ID NO: 341772 - RNA, 32 nt, Human
caaagaagguauaaaguccagagaugagaaaa

SEQ ID NO: 341773 - RNA, 32 nt, Human
caaagaaguucugcaaaccuccccuggacccu

SEQ ID NO: 341774 - RNA, 32 nt, Human
caaagaauaagccagauguaucagggccugag

SEQ ID NO: 341775 - RNA, 32 nt, Human
caaagaauacgaacauuagcugggucugaugg

SEQ ID NO: 341776 - RNA, 32 nt, Human
caaagaaucggcaaauggagugguuagaaggc

SEQ ID NO: 341777 - RNA, 32 nt, Human
caaagaaucucuucuagggauauuguaagaau

SEQ ID NO: 341778 - RNA, 32 nt, Human
caaagaaugcacucugcaggccuggcagaaga

SEQ ID NO: 341779 - RNA, 32 nt, Human
caaagaaugucagaaauuuguagaaaaugacu

SEQ ID NO: 341780 - RNA, 32 nt, Human
caaagaauuggacaaaacacacaaacaaagca

SEQ ID NO: 341781 - RNA, 32 nt, Human
caaagacaagaugggaaggggcuuccauuuau

SEQ ID NO: 341782 - RNA, 32 nt, Human
caaagacaagaugggaaggggcuuccauuugu

SEQ ID NO: 341783 - RNA, 32 nt, Human
caaagacagagucuugcucuuguuguccaggc

SEQ ID NO: 341784 - RNA, 32 nt, Human
caaagacagcaaccaaugagccagagguuucu

SEQ ID NO: 341785 - RNA, 32 nt, Human
caaagacaggcgucuggcuggcugcaggaguc

SEQ ID NO: 341786 - RNA, 32 nt, Human
caaagacaggggacuugccugaauggcauccg

SEQ ID NO: 341787 - RNA, 24 nt, Human
caaagacaggugaacgcucagcca

SEQ ID NO: 341788 - RNA, 32 nt, Human
caaagaccaaaacaaccaaaugccaccgcugc

SEQ ID NO: 341789 - RNA, 32 nt, Human
caaagaccaaccaaagagccagccagaguaag

SEQ ID NO: 341790 - RNA, 32 nt, Human
caaagacccacugcuacaggagcccccagccu

SEQ ID NO: 341791 - RNA, 32 nt, Human
caaagacccaguccaagauccauccagauuau

SEQ ID NO: 341792 - RNA, 25 nt, Human
caaagacccuggcuuucauuuucuc

SEQ ID NO: 341793 - RNA, 32 nt, Human
caaagaccuacauuccucauuguuucauguuu

SEQ ID NO: 341794 - RNA, 32 nt, Human
caaagaccucaagcucauucugcccaggauua

SEQ ID NO: 341795 - RNA, 32 nt, Human
caaagaccugccugugugcuccggagaugaau

SEQ ID NO: 341796 - RNA, 32 nt, Human
caaagaccuugugcccuucccaggagccgcgg

SEQ ID NO: 341797 - RNA, 32 nt, Human
caaagacgcuucuggggagugagggaagcggu

SEQ ID NO: 341798 - RNA, 31 nt, Human
caaagacggcuucagcaccauccugcaccug

SEQ ID NO: 341799 - RNA, 31 nt, Human
caaagacgguagagagaaacagcuugaugcu

SEQ ID NO: 341800 - RNA, 32 nt, Human
caaagacggugccaccaggcacggccaccgga

SEQ ID NO: 341801 - RNA, 32 nt, Human
caaagacgguggaaugcucucagaggagcccc

SEQ ID NO: 341802 - RNA, 32 nt, Human
caaagacuaauggggagagggagggccgggaa

SEQ ID NO: 341803 - RNA, 32 nt, Human
caaagacucccuccucccugaugcugggaugu

SEQ ID NO: 341804 - RNA, 24 nt, Human
caaagacucgaauucauuuucuca

SEQ ID NO: 341805 - RNA, 32 nt, Human
caaagacugugcaccuugccaacauuaaccuu

SEQ ID NO: 341806 - RNA, 32 nt, Human
caaagacuguuuggugcuucugucuuucacca

SEQ ID NO: 341807 - RNA, 32 nt, Human
caaagacuuauucgacucauuaaugaggaaac

SEQ ID NO: 341808 - RNA, 32 nt, Human
caaagacuuccucuggcuccccaaggcugcaa

SEQ ID NO: 341809 - RNA, 32 nt, Human
caaagacuuuccucuuagucgagccaaguuaa

SEQ ID NO: 341810 - RNA, 32 nt, Human
caaagacuuuucucccaauucugcgcuuccug

SEQ ID NO: 341811 - RNA, 32 nt, Human
caaagagaaaggagagccaggagcauuuaaaa

SEQ ID NO: 341812 - RNA, 32 nt, Human
caaagagaaauccugcacccaucagccaacac

SEQ ID NO: 341813 - RNA, 32 nt, Human
caaagagaagcuucuuuaaaagcugcuauuga

SEQ ID NO: 341814 - RNA, 32 nt, Human
caaagagaagggggagaaaaccuagcagacca

SEQ ID NO: 341815 - RNA, 23 nt, Human
caaagagaauauucauuuucuua

SEQ ID NO: 341816 - RNA, 32 nt, Human
caaagagaccuccuuguuucagcugggccugc

SEQ ID NO: 341817 - RNA, 32 nt, Human
caaagagacuacuagguuaccacucugggcau

SEQ ID NO: 341818 - RNA, 32 nt, Human
caaagagagagaaagaaagaaggaaggaagga

SEQ ID NO: 341819 - RNA, 32 nt, Human
caaagagauacaaccuaauccccaaccuacuu

SEQ ID NO: 341820 - RNA, 32 nt, Human
caaagagauacuuucucaguccugcaggcugu

SEQ ID NO: 341821 - RNA, 32 nt, Human
caaagagaugcugcaguccaggucugaggucc

SEQ ID NO: 341822 - RNA, 32 nt, Human
caaagagcaacaacucugcugccagcaccaaa

SEQ ID NO: 341823 - RNA, 32 nt, Human
caaagagcaaggaaagagagaaaacaacaaag

SEQ ID NO: 341824 - RNA, 32 nt, Human
caaagagcagaggacccaccccaccagccaug

SEQ ID NO: 341825 - RNA, 32 nt, Human
caaagagcagggcagaggguggcaguggcaca

SEQ ID NO: 341826 - RNA, 32 nt, Human
caaagagccauugagaaacauuucucaaacag

SEQ ID NO: 341827 - RNA, 32 nt, Human
caaagagccucaggggcucuggggcccuggag

SEQ ID NO: 341828 - RNA, 32 nt, Human
caaagagccugccgggccgccugcugccgggg

SEQ ID NO: 341829 - RNA, 32 nt, Human
caaagagcgugccuuuuuccuccaucauaacc

SEQ ID NO: 341830 - RNA, 32 nt, Human
caaagagcuacuuugaauacauaauucucuuc

SEQ ID NO: 341831 - RNA, 32 nt, Human
caaagagcucagcagaggcucacguggcccag

SEQ ID NO: 341832 - RNA, 23 nt, Human
caaagagcugagauuacaggcgu

SEQ ID NO: 341833 - RNA, 23 nt, Human
caaagagcugggauuacaggcgu

SEQ ID NO: 341834 - RNA, 32 nt, Human
caaagagcugggucuggcugagcaccagcugc

SEQ ID NO: 341835 - RNA, 32 nt, Human
caaagaggaaaggagaaaaacaaacagaccaa

SEQ ID NO: 341836 - RNA, 32 nt, Human
caaagaggaaauggagguuuugccugagcccc

SEQ ID NO: 341837 - RNA, 32 nt, Human
  misc_feature (31)..(31): n is a, c, g or u
caaagaggacuucacagcccuggggaggcanc

SEQ ID NO: 341838 - RNA, 32 nt, Human
caaagaggagcucugcugucccuuccuaagcu

SEQ ID NO: 341839 - RNA, 32 nt, Human
caaagaggaggaggcaggagaagcaggcagcc

SEQ ID NO: 341840 - RNA, 32 nt, Human
caaagaggccaacugcccagagccacagaaaa

SEQ ID NO: 341841 - RNA, 32 nt, Human
caaagagggaguuggcuggaucuuuuggugga

SEQ ID NO: 341842 - RNA, 32 nt, Human
caaagaggggagugauacggggugggggcacu

SEQ ID NO: 341843 - RNA, 32 nt, Human
caaagagguacacgaggaaauggaauugguau

SEQ ID NO: 341844 - RNA, 32 nt, Human
caaagagguauauguaaaguugcucaacaucg

SEQ ID NO: 341845 - RNA, 32 nt, Human
caaagaggugcccaggccugagguacucacau

SEQ ID NO: 341846 - RNA, 32 nt, Human
caaagaguaaguaagcaguauucuugggaguc

SEQ ID NO: 341847 - RNA, 32 nt, Human
caaagagucuccugccagcaccaagcaagcuu

SEQ ID NO: 341848 - RNA, 32 nt, Human
caaagagugugugggcuuuccuguuucuaaac

SEQ ID NO: 341849 - RNA, 32 nt, Human
caaagauaaagaaaguguacugcgaaaauaug

SEQ ID NO: 341850 - RNA, 32 nt, Human
caaagauagauggcugaacaucaggguguggc

SEQ ID NO: 341851 - RNA, 32 nt, Human
caaagauagggagggaagggggaacaugagcc

SEQ ID NO: 341852 - RNA, 32 nt, Human
caaagaucauuccacucagccugggacgaugg

SEQ ID NO: 341853 - RNA, 24 nt, Human
caaagauccccuacugccucagcc

SEQ ID NO: 341854 - RNA, 32 nt, Human
caaagauccucucaccuccaccucccaaagug

SEQ ID NO: 341855 - RNA, 32 nt, Human
caaagaucucagaagaaaucuaagaugucaua

SEQ ID NO: 341856 - RNA, 32 nt, Human
caaagaucuuugucucuuucugcuggaaugcg

SEQ ID NO: 341857 - RNA, 32 nt, Human
caaagaugaaagugcagcaaagcaaugaaaaa

SEQ ID NO: 341858 - RNA, 32 nt, Human
caaagaugaccaggauaaaacugagaaggauu

SEQ ID NO: 341859 - RNA, 32 nt, Human
caaagaugagggcagauuccuuaccugucugc

SEQ ID NO: 341860 - RNA, 32 nt, Human
caaagaugccugaaguguuggggaggaugaca

SEQ ID NO: 341861 - RNA, 30 nt, Human
caaagauggagcggcgggaggagcagccgg

SEQ ID NO: 341862 - RNA, 32 nt, Human
caaagaugggccuucucucucccagauaaguu

SEQ ID NO: 341863 - RNA, 32 nt, Human
caaagaugggggcagagagaaggucugagucc

SEQ ID NO: 341864 - RNA, 32 nt, Human
caaagauguaaacgcagcgugugcccacgcuc

SEQ ID NO: 341865 - RNA, 32 nt, Human
caaagaugucaccauuccuaguuauuugucac

SEQ ID NO: 341866 - RNA, 32 nt, Human
caaagauguccagauguccaugugcuagucuc

SEQ ID NO: 341867 - RNA, 30 nt, Human
caaagauguuugccaggaugucugaucucc

SEQ ID NO: 341868 - RNA, 32 nt, Human
caaagauucaccaagaaauaaagucaaccaaa

SEQ ID NO: 341869 - RNA, 32 nt, Human
caaagauucuccccaucucacagacaaggaaa

SEQ ID NO: 341870 - RNA, 32 nt, Human
caaagauuucaaaaucaggcugcaguacuuug

SEQ ID NO: 341871 - RNA, 32 nt, Human
caaagcaaaaguacauugguaauuugggcaca

SEQ ID NO: 341872 - RNA, 22 nt, Human
caaagcaaacauccuuaacuga

SEQ ID NO: 341873 - RNA, 32 nt, Human
caaagcaaacccuuacacacacaaagccccgg

SEQ ID NO: 341874 - RNA, 32 nt, Human
caaagcaaaccugcuuugacuuaauuuauuug

SEQ ID NO: 341875 - RNA, 32 nt, Human
caaagcaaacugccuugcuccuuuggggugau

SEQ ID NO: 341876 - RNA, 32 nt, Human
caaagcaaagagaaccaaagucucaguucugc

SEQ ID NO: 341877 - RNA, 22 nt, Human
caaagcaaagagucacugcauc

SEQ ID NO: 341878 - RNA, 32 nt, Human
caaagcaacgggagguggaggauccuggaggu

SEQ ID NO: 341879 - RNA, 32 nt, Human
caaagcaagcauucagaagaaaaagaagcaac

SEQ ID NO: 341880 - RNA, 21 nt, Human
caaagcaaggacuccaugacc

SEQ ID NO: 341881 - RNA, 32 nt, Human
caaagcaauaaaaucacuguauaucuuucuaa

SEQ ID NO: 341882 - RNA, 21 nt, Human
caaagcaaugucuaaaaacuc

SEQ ID NO: 341883 - RNA, 32 nt, Human
caaagcacacagagccccuggccccgccgcgg

SEQ ID NO: 341884 - RNA, 32 nt, Human
caaagcacagccccaguuucuggaggcagaug

SEQ ID NO: 341885 - RNA, 32 nt, Human
caaagcacagccuggccaacauggugaaaucc

SEQ ID NO: 341886 - RNA, 32 nt, Human
caaagcacagcuccagcucggacagcacccuc

SEQ ID NO: 341887 - RNA, 32 nt, Human
caaagcacaguaauguggcacugagcccuacc

SEQ ID NO: 341888 - RNA, 32 nt, Human
caaagcacauuuuuggggaucauagaagguug

SEQ ID NO: 341889 - RNA, 25 nt, Human
caaagcaccagacagaaagcaguca

SEQ ID NO: 341890 - RNA, 32 nt, Human
caaagcacgcacgggcauccugacugauccug

SEQ ID NO: 341891 - RNA, 32 nt, Human
caaagcacugccucuacugggcgugcugccaa

SEQ ID NO: 341892 - RNA, 23 nt, Human
caaagcacugggauuacaagcau

SEQ ID NO: 341893 - RNA, 23 nt, Human
caaagcacugggauuacaggcau

SEQ ID NO: 341894 - RNA, 23 nt, Human
caaagcacugggauuacaggcgu

SEQ ID NO: 341895 - RNA, 32 nt, Human
caaagcagaccaccuggugaaugaaaucaaug

SEQ ID NO: 341896 - RNA, 32 nt, Human
caaagcagaccagccuggggcagauauaccua

SEQ ID NO: 341897 - RNA, 21 nt, Human
caaagcagacucaaugcacug

SEQ ID NO: 341898 - RNA, 32 nt, Human
caaagcagacugcagugcaacggcacgaucuu

SEQ ID NO: 341899 - RNA, 18 nt, Human
caaagcagagcuggcaga

SEQ ID NO: 341900 - RNA, 22 nt, Human
caaagcagaggggcaggcagca

SEQ ID NO: 341901 - RNA, 32 nt, Human
caaagcagcaguguccagagaccccucaaucc

SEQ ID NO: 341902 - RNA, 32 nt, Human
caaagcagccccuuggagcugcagggagcuuc

SEQ ID NO: 341903 - RNA, 32 nt, Human
caaagcagcuugccaacagucaaaucacugau

SEQ ID NO: 341904 - RNA, 22 nt, Human
caaagcaggaccagcaggcaca

SEQ ID NO: 341905 - RNA, 23 nt, Human
caaagcaggaccuauuuggagca

SEQ ID NO: 341906 - RNA, 32 nt, Human
caaagcaggacgaucacuugagcccaggaguu

SEQ ID NO: 341907 - RNA, 32 nt, Human
caaagcaggaggaagaaaaggaagaaagaaaa

SEQ ID NO: 341908 - RNA, 32 nt, Human
caaagcaggaggaucacuugagccuaggaauu

SEQ ID NO: 341909 - RNA, 32 nt, Human
caaagcaggaggaucgcuugagcccaggaguu

SEQ ID NO: 341910 - RNA, 32 nt, Human
caaagcaggcuggggcaccaggugugcaugug

SEQ ID NO: 341911 - RNA, 32 nt, Human
caaagcagguggaucacgguaucaggaaacug

SEQ ID NO: 341912 - RNA, 32 nt, Human
caaagcaguagagaaaaauguaagauaggaag

SEQ ID NO: 341913 - RNA, 32 nt, Human
caaagcaguuccaagcaugcuuuggaaguaag

SEQ ID NO: 341914 - RNA, 32 nt, Human
caaagcauaagcucaguaacugugcaucuggu

SEQ ID NO: 341915 - RNA, 32 nt, Human
caaagcauaucgaugcagaauacugcgucuau

SEQ ID NO: 341916 - RNA, 32 nt, Human
caaagcaucccccgccguugugccacuuuugc

SEQ ID NO: 341917 - RNA, 32 nt, Human
caaagcaucccucuuagucuagguccuuguug

SEQ ID NO: 341918 - RNA, 32 nt, Human
caaagcaucuggaagaggaagaagagaggaau

SEQ ID NO: 341919 - RNA, 23 nt, Human
caaagcauugggauuacaggcau

SEQ ID NO: 341920 - RNA, 32 nt, Human
caaagccaaacaauacucuuggaguugauauu

SEQ ID NO: 341921 - RNA, 32 nt, Human
caaagccaaacagaugcccgccuaccaaagau

SEQ ID NO: 341922 - RNA, 32 nt, Human
caaagccaaauacccucaaggggagcagugug

SEQ ID NO: 341923 - RNA, 32 nt, Human
caaagccaagcccaauggcaagaagcccgcug

SEQ ID NO: 341924 - RNA, 32 nt, Human
caaagccaagugaagguguauuggggauucuc

SEQ ID NO: 341925 - RNA, 23 nt, Human
caaagccacaaggcuggccagca

SEQ ID NO: 341926 - RNA, 31 nt, Human
caaagccacagcuaacgagaggcagagagag

SEQ ID NO: 341927 - RNA, 32 nt, Human
caaagccacaugcaccaacgugacauauaagc

SEQ ID NO: 341928 - RNA, 32 nt, Human
caaagccacuaucagccuguuuccugagggaa

SEQ ID NO: 341929 - RNA, 32 nt, Human
caaagccacugccucugaucccacggaaugac

SEQ ID NO: 341930 - RNA, 32 nt, Human
caaagccagagaagaaagaugggguguccuuc

SEQ ID NO: 341931 - RNA, 32 nt, Human
caaagccagcaccacuuugccuuacuugaguc

SEQ ID NO: 341932 - RNA, 32 nt, Human
caaagccagcucccucuuuugucuguggcuag

SEQ ID NO: 341933 - RNA, 32 nt, Human
caaagccagcuugaaaccuucacuuaggaacg

SEQ ID NO: 341934 - RNA, 22 nt, Human
caaagccaggcacaacaaggga

SEQ ID NO: 341935 - RNA, 32 nt, Human
caaagccaggcagagccaggggugagaggcag

SEQ ID NO: 341936 - RNA, 32 nt, Human
caaagccaggcaggccaagacuugaguuggca

SEQ ID NO: 341937 - RNA, 32 nt, Human
caaagccaggcaggccauggggcucugggcgc

SEQ ID NO: 341938 - RNA, 32 nt, Human
caaagccaggccaggguacagugagaacacgg

SEQ ID NO: 341939 - RNA, 32 nt, Human
caaagccauggugaaacaucucugugcuaauu

SEQ ID NO: 341940 - RNA, 22 nt, Human
caaagcccaaccccuuaaugaa

SEQ ID NO: 341941 - RNA, 32 nt, Human
caaagcccaaggcaccagaagguuuguuucag

SEQ ID NO: 341942 - RNA, 32 nt, Human
caaagcccaccaugccccaggcucagccagga

SEQ ID NO: 341943 - RNA, 32 nt, Human
caaagcccagcccagcuggagagaucagcccu

SEQ ID NO: 341944 - RNA, 32 nt, Human
caaagcccagggaugcaaagguugcagugagu

SEQ ID NO: 341945 - RNA, 32 nt, Human
caaagcccauagcacugggcucugauggcugc

SEQ ID NO: 341946 - RNA, 26 nt, Human
caaagccccaaacacagcugcacuga

SEQ ID NO: 341947 - RNA, 26 nt, Human
caaagccccaaacacaggugcacuga

SEQ ID NO: 341948 - RNA, 32 nt, Human
caaagccccaggaaaccuaccaaagcuagaau

SEQ ID NO: 341949 - RNA, 32 nt, Human
caaagccccaggagaacaggcuggacagagga

SEQ ID NO: 341950 - RNA, 21 nt, Human
caaagccccccagcucccaca

SEQ ID NO: 341951 - RNA, 32 nt, Human
caaagcccuucacuggcuccccaaagccuaug

SEQ ID NO: 341952 - RNA, 32 nt, Human
caaagcccuucaggcuggaguauaguggcaug

SEQ ID NO: 341953 - RNA, 32 nt, Human
caaagcccuucaucuaauauuuguugcuauug

SEQ ID NO: 341954 - RNA, 32 nt, Human
caaagccgggcugggcuuggagcugcucaugg

SEQ ID NO: 341955 - RNA, 32 nt, Human
caaagccuccgaguccuugcagcuggucuuug

SEQ ID NO: 341956 - RNA, 32 nt, Human
caaagccucuaugugugaaacacagggguacc

SEQ ID NO: 341957 - RNA, 32 nt, Human
caaagccugcagaggaggccagccugaguccu

SEQ ID NO: 341958 - RNA, 32 nt, Human
caaagccugcagcguggcaagcacuuugcaca

SEQ ID NO: 341959 - RNA, 24 nt, Human
caaagccugcaguccccucugcca

SEQ ID NO: 341960 - RNA, 32 nt, Human
caaagccugcuguuucaggcugucaggaagaa

SEQ ID NO: 341961 - RNA, 32 nt, Human
caaagccuggaggccuuccugccugccuucca

SEQ ID NO: 341962 - RNA, 32 nt, Human
caaagccugggcaggugccaccgggaaggaau

SEQ ID NO: 341963 - RNA, 32 nt, Human
caaagccuuuaaauaccaacugcagcauggag

SEQ ID NO: 341964 - RNA, 32 nt, Human
caaagccuuuccgcacccuccugacuguccug

SEQ ID NO: 341965 - RNA, 22 nt, Human
caaagccuuuggcaagcaguca

SEQ ID NO: 341966 - RNA, 32 nt, Human
caaagcgaagccugugcuacugugagucuugc

SEQ ID NO: 341967 - RNA, 23 nt, Human
caaagcgauaggauuacaggcgu

SEQ ID NO: 341968 - RNA, 23 nt, Human
caaagcgcuaggauuacaagcau

SEQ ID NO: 341969 - RNA, 32 nt, Human
caaagcgcucaucuugcccucuaccuccugau

SEQ ID NO: 341970 - RNA, 20 nt, Human
caaagcgcuggauuacaggc

SEQ ID NO: 341971 - RNA, 21 nt, Human
caaagcgcuggauuacaggca

SEQ ID NO: 341972 - RNA, 23 nt, Human
caaagcgcugggauuacaggcgu

SEQ ID NO: 341973 - RNA, 32 nt, Human
caaagcggugagcaguagggaggcagaguauc

SEQ ID NO: 341974 - RNA, 32 nt, Human
caaagcguauuuuugugaaaucuuuuaagagc

SEQ ID NO: 341975 - RNA, 32 nt, Human
caaagcgugccacccuuuuauuuuccgucagg

SEQ ID NO: 341976 - RNA, 23 nt, Human
caaagcguugggauuauaggcau

SEQ ID NO: 341977 - RNA, 32 nt, Human
caaagcuacugaaacuccuccaccugcuucua

SEQ ID NO: 341978 - RNA, 32 nt, Human
caaagcuagagucagagguuccgguugagauc

SEQ ID NO: 341979 - RNA, 21 nt, Human
caaagcucaaaacaaucaaga

SEQ ID NO: 341980 - RNA, 32 nt, Human
caaagcucacugcagccuugaacuccuaggcu

SEQ ID NO: 341981 - RNA, 32 nt, Human
caaagcucacugcagccuugaauuccugggcu

SEQ ID NO: 341982 - RNA, 32 nt, Human
caaagcucagcccucugggcgguccccuugcc

SEQ ID NO: 341983 - RNA, 32 nt, Human
caaagcucauucuucugaaucuaauaucacua

SEQ ID NO: 341984 - RNA, 32 nt, Human
caaagcucauuucaaaugccccuucauuugug

SEQ ID NO: 341985 - RNA, 32 nt, Human
caaagcuccccaccccagccugguggcagagg

SEQ ID NO: 341986 - RNA, 32 nt, Human
caaagcucugaugacagagaucauugacauuu

SEQ ID NO: 341987 - RNA, 20 nt, Human
caaagcucugucccccugcu

SEQ ID NO: 341988 - RNA, 32 nt, Human
caaagcugagacugacgggugauguugcucau

SEQ ID NO: 341989 - RNA, 32 nt, Human
caaagcugaggugcuggagaugccaagggaag

SEQ ID NO: 341990 - RNA, 32 nt, Human
caaagcugcaccugaugaugcugccucuccuc

SEQ ID NO: 341991 - RNA, 32 nt, Human
caaagcugcgcaaaccaugcaggaugauuuac

SEQ ID NO: 341992 - RNA, 32 nt, Human
caaagcugcuucucuuccccagacccaugcug

SEQ ID NO: 341993 - RNA, 32 nt, Human
caaagcugggauuacaggugugagcauaguga

SEQ ID NO: 341994 - RNA, 21 nt, Human
caaagcugucacaccugccuc

SEQ ID NO: 341995 - RNA, 32 nt, Human
caaagcugugugaccggcugggcaugguggcu

SEQ ID NO: 341996 - RNA, 32 nt, Human
caaagcuguuuugcagcuguuuucccuuaaag

SEQ ID NO: 341997 - RNA, 28 nt, Human
caaagcuuaaccgcugccuccugucccc

SEQ ID NO: 341998 - RNA, 21 nt, Human
caaagcuuaugcagaacagca

SEQ ID NO: 341999 - RNA, 32 nt, Human
caaagcuuccaauauuugauguugguuaagcu

SEQ ID NO: 342000 - RNA, 32 nt, Human
caaagcuuccacccuucuccccucagagagga

SEQ ID NO: 342001 - RNA, 32 nt, Human
caaagcuuccagcacgggaaaaugagaaacac

SEQ ID NO: 342002 - RNA, 32 nt, Human
caaagcuucucaagugcggacaggguuaccua

SEQ ID NO: 342003 - RNA, 32 nt, Human
caaagcuugugggcacaugggcacauacagac

SEQ ID NO: 342004 - RNA, 32 nt, Human
caaagcuuuauuuuuccacaucaugcuuacaa

SEQ ID NO: 342005 - RNA, 32 nt, Human
caaagcuuugcuuaucucagcaaagaagguuu

SEQ ID NO: 342006 - RNA, 32 nt, Human
caaagcuuuuuaaugcauaaaaguauaauuga

SEQ ID NO: 342007 - RNA, 32 nt, Human
caaaggaaaaggcaaugggaguaaauagacaa

SEQ ID NO: 342008 - RNA, 32 nt, Human
caaaggaaaugcacagaacauaucuucacauu

SEQ ID NO: 342009 - RNA, 32 nt, Human
caaaggaacucugaccucugaaguacuugagc

SEQ ID NO: 342010 - RNA, 32 nt, Human
caaaggaagagacuccagcagcagaugcagca

SEQ ID NO: 342011 - RNA, 32 nt, Human
caaaggaagcagcugggacagguggagaagga

SEQ ID NO: 342012 - RNA, 32 nt, Human
caaaggaagcuuuuaaacucagcagcugcacc

SEQ ID NO: 342013 - RNA, 32 nt, Human
caaaggaaucacccuuucccuaccuucagacu

SEQ ID NO: 342014 - RNA, 32 nt, Human
caaaggaaucugccuuuccuccgucucaaguc

SEQ ID NO: 342015 - RNA, 32 nt, Human
caaaggaaugagaaaagacaaguuaagaaugc

SEQ ID NO: 342016 - RNA, 32 nt, Human
caaaggaauuggauauggucugugauaacuau

SEQ ID NO: 342017 - RNA, 32 nt, Human
caaaggacaagaaaacacuucucacuaugaau

SEQ ID NO: 342018 - RNA, 32 nt, Human
caaaggacagagaauuuaagcacagaaauccc

SEQ ID NO: 342019 - RNA, 32 nt, Human
caaaggacagccgccuggagaugacuugaggc

SEQ ID NO: 342020 - RNA, 21 nt, Human
caaaggaccccaccucaccca

SEQ ID NO: 342021 - RNA, 24 nt, Human
caaaggacucuggugucucaccca

SEQ ID NO: 342022 - RNA, 32 nt, Human
caaaggacucuuaugucacugcagugucccau

SEQ ID NO: 342023 - RNA, 32 nt, Human
caaaggacuucaccgaucuacuuuugcagucg

SEQ ID NO: 342024 - RNA, 32 nt, Human
caaaggacuuccuagugggugugaaaggcagc

SEQ ID NO: 342025 - RNA, 32 nt, Human
caaaggacuuugcccaguggaugccauucaua

SEQ ID NO: 342026 - RNA, 32 nt, Human
caaaggagaaaaggaagugauuggagaauuaa

SEQ ID NO: 342027 - RNA, 32 nt, Human
caaaggagacaguuguuuguguuuguaugguu

SEQ ID NO: 342028 - RNA, 32 nt, Human
caaaggagacuccugagggauuuagaaauuca

SEQ ID NO: 342029 - RNA, 32 nt, Human
caaaggagaugcagagaugcccaugccgagac

SEQ ID NO: 342030 - RNA, 32 nt, Human
caaaggagcaagagguauaauggauauggcau

SEQ ID NO: 342031 - RNA, 32 nt, Human
caaaggagccccgcugccugcccacccacccu

SEQ ID NO: 342032 - RNA, 32 nt, Human
caaaggaggaagaauuaaaagagugggaaugg

SEQ ID NO: 342033 - RNA, 32 nt, Human
caaaggagggagcccugcagggcacagcaaga

SEQ ID NO: 342034 - RNA, 32 nt, Human
caaaggagggcaccucugucugguuuccucuu

SEQ ID NO: 342035 - RNA, 32 nt, Human
caaaggagggcugcggcuuccuucccucacug

SEQ ID NO: 342036 - RNA, 32 nt, Human
caaaggagggucaggaaggaugagcauuuagg

SEQ ID NO: 342037 - RNA, 32 nt, Human
caaaggagguggggagcaggagagagagggua

SEQ ID NO: 342038 - RNA, 32 nt, Human
caaaggagugugagagaggaguggauggucaa

SEQ ID NO: 342039 - RNA, 32 nt, Human
caaaggauaaaagaguagcauaagcugcugaa

SEQ ID NO: 342040 - RNA, 32 nt, Human
caaaggauaaucuuucuuuucauugacaacac

SEQ ID NO: 342041 - RNA, 24 nt, Human
caaaggaugaccccuaaacacaga

SEQ ID NO: 342042 - RNA, 32 nt, Human
caaaggauucaggcaaaccccagcaaguuucu

SEQ ID NO: 342043 - RNA, 32 nt, Human
caaaggauucugggaaggagaauaaagagaaa

SEQ ID NO: 342044 - RNA, 32 nt, Human
caaaggauuuuaaaaucugagcacuuagguga

SEQ ID NO: 342045 - RNA, 32 nt, Human
caaaggcaacuuggcuucacaggaucugccug

SEQ ID NO: 342046 - RNA, 32 nt, Human
caaaggcaccuaaaccuuuuguuucuuuuucu

SEQ ID NO: 342047 - RNA, 32 nt, Human
caaaggcacuguuacucguugugugaccccgc

SEQ ID NO: 342048 - RNA, 32 nt, Human
caaaggcagaaugcuugugagauuauaagccu

SEQ ID NO: 342049 - RNA, 32 nt, Human
caaaggcagagccacagaggggcugcuggucc

SEQ ID NO: 342050 - RNA, 32 nt, Human
caaaggcagagcuuacugucauggcucagaug

SEQ ID NO: 342051 - RNA, 32 nt, Human
caaaggcaggcagaucaccugaggucaggagu

SEQ ID NO: 342052 - RNA, 32 nt, Human
caaaggcaggccuggcugggugcaguggcuca

SEQ ID NO: 342053 - RNA, 32 nt, Human
caaaggcagguggaucaccugaggucaggagu

SEQ ID NO: 342054 - RNA, 32 nt, Human
caaaggcauccugcaaccaccccauccaucca

SEQ ID NO: 342055 - RNA, 32 nt, Human
caaaggcaugguaccucagucugguauccaga

SEQ ID NO: 342056 - RNA, 32 nt, Human
caaaggcaugugauugauuaaugauucccccu

SEQ ID NO: 342057 - RNA, 32 nt, Human
caaaggccaacuucagccuggcacggcggcgc

SEQ ID NO: 342058 - RNA, 32 nt, Human
caaaggccacaguccccuccugugcuggcagc

SEQ ID NO: 342059 - RNA, 32 nt, Human
caaaggccacaucuucugugaagacuguguug

SEQ ID NO: 342060 - RNA, 32 nt, Human
caaaggccaggaguuugaggcugcagugagcu

SEQ ID NO: 342061 - RNA, 32 nt, Human
caaaggccaggcuugggaaggaaggagggauc

SEQ ID NO: 342062 - RNA, 32 nt, Human
caaaggccaucuccuauggaccaaggacccca

SEQ ID NO: 342063 - RNA, 32 nt, Human
caaaggcccaaugcagaggagcccgcggagca

SEQ ID NO: 342064 - RNA, 32 nt, Human
caaaggcccccuuucuauguucauguuaguuu

SEQ ID NO: 342065 - RNA, 32 nt, Human
caaaggccccgcagucccucucccaggaggac

SEQ ID NO: 342066 - RNA, 32 nt, Human
caaaggcccgaaagaggagcugggcggggugg

SEQ ID NO: 342067 - RNA, 32 nt, Human
caaaggcccugaggugggugcaguaauaccac

SEQ ID NO: 342068 - RNA, 32 nt, Human
caaaggccuagauuugagacaagagcugaugu

SEQ ID NO: 342069 - RNA, 31 nt, Human
caaaggccucagccugugccugugucgagcu

SEQ ID NO: 342070 - RNA, 32 nt, Human
caaaggccucagccugugccugugucgagcuc

SEQ ID NO: 342071 - RNA, 32 nt, Human
caaaggccugagagcuggagucaguguggugu

SEQ ID NO: 342072 - RNA, 32 nt, Human
caaaggcgagggacaagagagaguuaacaucu

SEQ ID NO: 342073 - RNA, 32 nt, Human
caaaggcgggcagaucaccugaggucaggagu

SEQ ID NO: 342074 - RNA, 32 nt, Human
caaaggcgggcggaucaccugaggucaggagu

SEQ ID NO: 342075 - RNA, 19 nt, Human
caaaggcggggguugaaga

SEQ ID NO: 342076 - RNA, 32 nt, Human
caaaggcuacacagcagcccacaguccacagu

SEQ ID NO: 342077 - RNA, 32 nt, Human
caaaggcucaacaaccagagggaauggugaga

SEQ ID NO: 342078 - RNA, 32 nt, Human
caaaggcugaaaucucugccugaccuggcagc

SEQ ID NO: 342079 - RNA, 32 nt, Human
caaaggcugagaaaugcaaaggcucauauuua

SEQ ID NO: 342080 - RNA, 32 nt, Human
caaaggcugcaacccuauggccucuuggagac

SEQ ID NO: 342081 - RNA, 32 nt, Human
caaaggcugccaggacccuugaagaugcuuuu

SEQ ID NO: 342082 - RNA, 32 nt, Human
caaaggcugcucccggcaaccccugcccagcu

SEQ ID NO: 342083 - RNA, 32 nt, Human
caaaggcugugaugcugcuguggcuuucuaug

SEQ ID NO: 342084 - RNA, 32 nt, Human
caaaggcuuacugauaaacuugagucugcccu

SEQ ID NO: 342085 - RNA, 32 nt, Human
caaagggaagaguaugcaugcagccuggaggu

SEQ ID NO: 342086 - RNA, 32 nt, Human
caaagggaaucaggauucuguggcuguagacu

SEQ ID NO: 342087 - RNA, 32 nt, Human
caaagggacgauccuccagaucugcugcaaag

SEQ ID NO: 342088 - RNA, 32 nt, Human
caaagggacuccugugaaacugcugccaaaaa

SEQ ID NO: 342089 - RNA, 32 nt, Human
caaagggaggaggccagcugguaggcagccug

SEQ ID NO: 342090 - RNA, 32 nt, Human
caaagggaggcuagggacaggaaagccaucuc

SEQ ID NO: 342091 - RNA, 32 nt, Human
caaagggauccuggggaaggaggggaacaugc

SEQ ID NO: 342092 - RNA, 32 nt, Human
caaagggauugcuuuuuccucucauugucuug

SEQ ID NO: 342093 - RNA, 32 nt, Human
caaagggcacauggaguauggaagggggcaug

SEQ ID NO: 342094 - RNA, 32 nt, Human
caaagggcagaggcaggaucagccacgggauu

SEQ ID NO: 342095 - RNA, 32 nt, Human
caaagggccguucgccuuucauggccuccaca

SEQ ID NO: 342096 - RNA, 32 nt, Human
caaagggccuuguuggacagggggacuggcug

SEQ ID NO: 342097 - RNA, 32 nt, Human
caaaggggaaggcagggguggggccguggcug

SEQ ID NO: 342098 - RNA, 32 nt, Human
caaaggggcagggccuggcuuugcuacaagau

SEQ ID NO: 342099 - RNA, 32 nt, Human
caaaggggcauguugcuccugagcagcaugaa

SEQ ID NO: 342100 - RNA, 32 nt, Human
caaagggggaaagaaacaccugagcagaaugg

SEQ ID NO: 342101 - RNA, 32 nt, Human
caaagggggcacaugucccuggaguugcuucc

SEQ ID NO: 342102 - RNA, 32 nt, Human
caaagggguaccccaaauccagagcugccuac

SEQ ID NO: 342103 - RNA, 32 nt, Human
caaaggggugggggcugggugcaguggcucac

SEQ ID NO: 342104 - RNA, 32 nt, Human
caaaggguccucaccucuccccuaguacacuu

SEQ ID NO: 342105 - RNA, 32 nt, Human
caaagggucugagucugccaccuacgugcccg

SEQ ID NO: 342106 - RNA, 32 nt, Human
caaagggucugcccuuucccugccugaguugc

SEQ ID NO: 342107 - RNA, 32 nt, Human
caaaggguguuuaaauggucugcccaaaguca

SEQ ID NO: 342108 - RNA, 23 nt, Human
caaaggguugggauuaccggcau

SEQ ID NO: 342109 - RNA, 32 nt, Human
caaaggguugugagucccggcccagccccucc

SEQ ID NO: 342110 - RNA, 31 nt, Human
caaagguagguguccaugcagauuuuauugg

SEQ ID NO: 342111 - RNA, 32 nt, Human
caaaggucagaaaagcuuuacugacauucuau

SEQ ID NO: 342112 - RNA, 32 nt, Human
caaaggucaggaacucucuccacugcaugaaa

SEQ ID NO: 342113 - RNA, 32 nt, Human
caaaggucaggaguucgagaccagccuggcca

SEQ ID NO: 342114 - RNA, 32 nt, Human
caaagguccaauaaaaugccucaaccacggaa

SEQ ID NO: 342115 - RNA, 32 nt, Human
caaagguccacauguaagacacacuggaaaaa

SEQ ID NO: 342116 - RNA, 32 nt, Human
caaagguccuugguggccuguccccugcccug

SEQ ID NO: 342117 - RNA, 32 nt, Human
caaaggucucuuccagcucaaaaauauuguca

SEQ ID NO: 342118 - RNA, 32 nt, Human
caaaggucugcagcuucacuccugaagccagc

SEQ ID NO: 342119 - RNA, 32 nt, Human
caaaggugagccuuguuugggaaaucagcgcc

SEQ ID NO: 342120 - RNA, 32 nt, Human
caaaggugauggauucugcagugaacauuucc

SEQ ID NO: 342121 - RNA, 32 nt, Human
caaaggugcacuccagacucuggggguggaca

SEQ ID NO: 342122 - RNA, 32 nt, Human
caaaggugcaguuucuccucuccugggcaccu

SEQ ID NO: 342123 - RNA, 32 nt, Human
caaaggugccugaggcucugguaagggugaag

SEQ ID NO: 342124 - RNA, 32 nt, Human
caaaggugccuucuguagacacuccugcucuc

SEQ ID NO: 342125 - RNA, 32 nt, Human
caaaggugcucuugcauugguggagaggggcu

SEQ ID NO: 342126 - RNA, 32 nt, Human
caaagguggauuuaagaauuaaaccauuacau

SEQ ID NO: 342127 - RNA, 32 nt, Human
caaagguggcagcugagcaucccuggagaggg

SEQ ID NO: 342128 - RNA, 32 nt, Human
caaagguggcuaaggcagaggcugagggggcu

SEQ ID NO: 342129 - RNA, 32 nt, Human
caaagguggguagaucaccugaggucgggagu

SEQ ID NO: 342130 - RNA, 32 nt, Human
caaagguguccaagucacacagagccacggaa

SEQ ID NO: 342131 - RNA, 32 nt, Human
caaagguguggaggaggaggggagggaggaag

SEQ ID NO: 342132 - RNA, 32 nt, Human
caaagguguuggagagcagcuuuggguucugu

SEQ ID NO: 342133 - RNA, 32 nt, Human
caaagguuaaaaagaccaaaucaagcugaggu

SEQ ID NO: 342134 - RNA, 32 nt, Human
caaagguuagcaugcagaagugaaagugucaa

SEQ ID NO: 342135 - RNA, 32 nt, Human
caaagguucagaauggggaauguguuaaacaa

SEQ ID NO: 342136 - RNA, 32 nt, Human
caagauggcgccacuacacuccagccugggcg

SEQ ID NO: 342137 - RNA, 32 nt, Human
caagauggcgccacugcacuccagccugggug

SEQ ID NO: 342138 - RNA, 32 nt, Human
caagauggcgccacugcacuccagucugggcg

SEQ ID NO: 342139 - RNA, 32 nt, Human
caagauggcgccacugcauuccagccugggca

SEQ ID NO: 342140 - RNA, 32 nt, Human
caagauggcgccauugcacuccagccugggug

SEQ ID NO: 342141 - RNA, 29 nt, Human
caagauggcgccgguggggguggagaaga

SEQ ID NO: 342142 - RNA, 32 nt, Human
caagauggcugcaucacauuuucaaaugauuu

SEQ ID NO: 342143 - RNA, 32 nt, Human
caagauggcugugacacccugcccucaccucc

SEQ ID NO: 342144 - RNA, 32 nt, Human
caagaugggaagaucacuugagcucaggagua

SEQ ID NO: 342145 - RNA, 32 nt, Human
caagaugggaggagugcuugagguuaggcguu

SEQ ID NO: 342146 - RNA, 32 nt, Human
caagaugggaggaucacuugaagccaggaguu

SEQ ID NO: 342147 - RNA, 32 nt, Human
caagaugggaggaucauuugagcccaggaguu

SEQ ID NO: 342148 - RNA, 32 nt, Human
caagaugggaggaucgcuugagcccaggagcu

SEQ ID NO: 342149 - RNA, 32 nt, Human
caagaugggaggauugcuugagcccagaaguu

SEQ ID NO: 342150 - RNA, 32 nt, Human
caagaugggauuaugggggcgcagccgcggug

SEQ ID NO: 342151 - RNA, 32 nt, Human
caagaugggcaaaucacuugagucuaggaguu

SEQ ID NO: 342152 - RNA, 32 nt, Human
caagauggucucaagcuccugaccucgugauc

SEQ ID NO: 342153 - RNA, 32 nt, Human
caagauggugcggugcuggugccuugggaccu

SEQ ID NO: 342154 - RNA, 32 nt, Human
caagauggugcuggugcugcgccauccuuugu

SEQ ID NO: 342155 - RNA, 32 nt, Human
caagaugucagccgaggugacagugaagauau

SEQ ID NO: 342156 - RNA, 21 nt, Human
caagaugucccuguggacucc

SEQ ID NO: 342157 - RNA, 29 nt, Human
caagaugucccuugugacuguccccuucu

SEQ ID NO: 342158 - RNA, 32 nt, Human
caagaugucuaaggaaaaagcucaggucugug

SEQ ID NO: 342159 - RNA, 32 nt, Human
caagaugugcccaggagguggcgguggcgcac

SEQ ID NO: 342160 - RNA, 29 nt, Human
caagaugugcucucugggguuguucccuc

SEQ ID NO: 342161 - RNA, 32 nt, Human
caagauguggcccaagggguuaagugggaaca

SEQ ID NO: 342162 - RNA, 32 nt, Human
caagauguggcugaagaucagaggcucaguua

SEQ ID NO: 342163 - RNA, 32 nt, Human
caagauguggugaugacagaaucagcuuuugu

SEQ ID NO: 342164 - RNA, 32 nt, Human
caagauguucucuuuucagaucuugggaacug

SEQ ID NO: 342165 - RNA, 32 nt, Human
caagauguugaggcgagcagggcaggcccccg

SEQ ID NO: 342166 - RNA, 32 nt, Human
caagauguuuccaucacagucaaaacuugaua

SEQ ID NO: 342167 - RNA, 32 nt, Human
caagauuaacaccccuccugcaggaggaagac

SEQ ID NO: 342168 - RNA, 32 nt, Human
caagauuacgccacugcacuccagccugggug

SEQ ID NO: 342169 - RNA, 32 nt, Human
caagauuauaaauaugaacugauuaugaucug

SEQ ID NO: 342170 - RNA, 32 nt, Human
caagauuaugccacugcacuccagccugggug

SEQ ID NO: 342171 - RNA, 32 nt, Human
caagauuaugccacugcacuucagccugggug

SEQ ID NO: 342172 - RNA, 32 nt, Human
caagauuaugccauugcacuccagccugggug

SEQ ID NO: 342173 - RNA, 32 nt, Human
caagauucauucucccugaaucuuaccaacaa

SEQ ID NO: 342174 - RNA, 32 nt, Human
caagauuccacauucauauuacuuacuuauac

SEQ ID NO: 342175 - RNA, 32 nt, Human
caagauuccagauccuucucuccuggaguucu

SEQ ID NO: 342176 - RNA, 32 nt, Human
caagauuccugucaaucccaucugcagggaac

SEQ ID NO: 342177 - RNA, 32 nt, Human
caagauugagccacugcacuccagccugggug

SEQ ID NO: 342178 - RNA, 32 nt, Human
caagauugcacacugcacuccagccuggguga

SEQ ID NO: 342179 - RNA, 32 nt, Human
caagauugcaccaccacacuccagccugggug

SEQ ID NO: 342180 - RNA, 32 nt, Human
caagauugcaccacggcacgcuagccugggug

SEQ ID NO: 342181 - RNA, 32 nt, Human
caagauugcaccacugcacuacagcuugggug

SEQ ID NO: 342182 - RNA, 32 nt, Human
caagauugcaccacugcacuccagccggggug

SEQ ID NO: 342183 - RNA, 32 nt, Human
caagauugcaccacugcacuccagccugggca

SEQ ID NO: 342184 - RNA, 32 nt, Human
caagauugcaccacugcacuccagccugggcg

SEQ ID NO: 342185 - RNA, 32 nt, Human
caagauugcaccacugcauuccagcauggcca

SEQ ID NO: 342186 - RNA, 32 nt, Human
caagauugcaccacugcucuccagccugggga

SEQ ID NO: 342187 - RNA, 32 nt, Human
caagauugcaccacuguacuccagccugggca

SEQ ID NO: 342188 - RNA, 32 nt, Human
caagauugcaccacuguacuccagccugggug

SEQ ID NO: 342189 - RNA, 32 nt, Human
caagauugcaccagugcacuccagcugggcga

SEQ ID NO: 342190 - RNA, 32 nt, Human
caagauugcaccauugaacuccagccugggca

SEQ ID NO: 342191 - RNA, 32 nt, Human
caagauugcaccauugcacuccagccuggcga

SEQ ID NO: 342192 - RNA, 32 nt, Human
caagauugcaccauugcacuccagccugggug

SEQ ID NO: 342193 - RNA, 32 nt, Human
caagauugcaccauugcauuccagccugggug

SEQ ID NO: 342194 - RNA, 32 nt, Human
caagauugcacccugcacucuagccugggcaa

SEQ ID NO: 342195 - RNA, 32 nt, Human
caagauugcacuacuacacuccagccugguga

SEQ ID NO: 342196 - RNA, 32 nt, Human
caagauugcacuacugcacuccagccugggug

SEQ ID NO: 342197 - RNA, 32 nt, Human
caagauugcaucacugcacuccagcuugggug

SEQ ID NO: 342198 - RNA, 32 nt, Human
caagauugccaagggcaucuucuggggcaucc

SEQ ID NO: 342199 - RNA, 32 nt, Human
caagauugccacggcaaaccuaggcaaguucc

SEQ ID NO: 342200 - RNA, 32 nt, Human
caagauugccccacugcacuccacccugggca

SEQ ID NO: 342201 - RNA, 32 nt, Human
caagauugcgccacugcacuccacccugggug

SEQ ID NO: 342202 - RNA, 32 nt, Human
caagauugcgccacugcacuccagccagggcg

SEQ ID NO: 342203 - RNA, 32 nt, Human
caagauugcgccacugcacuccagccugacga

SEQ ID NO: 342204 - RNA, 32 nt, Human
caagauugcgccacugcacuccagccugggca

SEQ ID NO: 342205 - RNA, 32 nt, Human
caagauugcgccacugcacuccagccugggug

SEQ ID NO: 342206 - RNA, 32 nt, Human
caagauugcgccauugcacuccagccugggca

SEQ ID NO: 342207 - RNA, 32 nt, Human
caagauugcgccauugcauuccagccugggca

SEQ ID NO: 342208 - RNA, 32 nt, Human
caagauugcgucacugcacugcagccugggug

SEQ ID NO: 342209 - RNA, 32 nt, Human
caagauuggggcugcugcauuccagguucccu

SEQ ID NO: 342210 - RNA, 32 nt, Human
caagauuguaaccagagagcagccaggagcuu

SEQ ID NO: 342211 - RNA, 32 nt, Human
caagauuguaccacugcacuccaaccuggguu

SEQ ID NO: 342212 - RNA, 32 nt, Human
caagauuguaccacugcacuccagccugggca

SEQ ID NO: 342213 - RNA, 32 nt, Human
caagauuguaccacugcacuccaguuuggcaa

SEQ ID NO: 342214 - RNA, 32 nt, Human
caagauugugacacugcacuccagccugggca

SEQ ID NO: 342215 - RNA, 32 nt, Human
caagauugugcacugcacucuagccuggggga

SEQ ID NO: 342216 - RNA, 32 nt, Human
caagauugugccacuacuguacucuagccugg

SEQ ID NO: 342217 - RNA, 32 nt, Human
caagauugugccacugaacucuagccugggua

SEQ ID NO: 342218 - RNA, 32 nt, Human
caagauugugccacugcacuccacccugggca

SEQ ID NO: 342219 - RNA, 32 nt, Human
caagauugugccacugcacuccagccugagca

SEQ ID NO: 342220 - RNA, 32 nt, Human
caagauugugccacugcacuccagccugggca

SEQ ID NO: 342221 - RNA, 32 nt, Human
caagauugugccacugcacuccagccugggcg

SEQ ID NO: 342222 - RNA, 32 nt, Human
caagauugugccacugcacuccagccugggug

SEQ ID NO: 342223 - RNA, 32 nt, Human
caagauugugccacugcacuccagcgugggca

SEQ ID NO: 342224 - RNA, 32 nt, Human
caagauugugccacugcacucuagccuaggug

SEQ ID NO: 342225 - RNA, 32 nt, Human
caagauugugccacugcacucuagccugggca

SEQ ID NO: 342226 - RNA, 32 nt, Human
caagauugugccacugcacugcaggcugggug

SEQ ID NO: 342227 - RNA, 32 nt, Human
caagauugugccauugcacuccagccugggca

SEQ ID NO: 342228 - RNA, 32 nt, Human
caagauugugccauugcacuccagccugggug

SEQ ID NO: 342229 - RNA, 32 nt, Human
caagauugugccauugcacucuagccugggca

SEQ ID NO: 342230 - RNA, 32 nt, Human
caagauugugccccugcauucuagccugggug

SEQ ID NO: 342231 - RNA, 32 nt, Human
caagauuguuuguucagauguaggccuaacaa

SEQ ID NO: 342232 - RNA, 32 nt, Human
caagauuuaagguaaauuucuuaaacauuauc

SEQ ID NO: 342233 - RNA, 32 nt, Human
caagauuuaauaacagaggcugcucuggucac

SEQ ID NO: 342234 - RNA, 32 nt, Human
caagauuucaaagaagauuuugggggagagag

SEQ ID NO: 342235 - RNA, 32 nt, Human
caagauuucccaaugugccucuauucuuacau

SEQ ID NO: 342236 - RNA, 32 nt, Human
caagauuuccuccauuaaaacuccugaggcac

SEQ ID NO: 342237 - RNA, 32 nt, Human
caagauuuccuuaaaaucucuaauagaggcau

SEQ ID NO: 342238 - RNA, 32 nt, Human
caagauuuuaaauucaaauaaagccuaauauc

SEQ ID NO: 342239 - RNA, 32 nt, Human
caagauuuugucccauuuucccaugaagcuac

SEQ ID NO: 342240 - RNA, 32 nt, Human
caagcaaaccaccucaccacacuauccagggg

SEQ ID NO: 342241 - RNA, 32 nt, Human
caagcaaagagagguuaaacauuucuccaagu

SEQ ID NO: 342242 - RNA, 32 nt, Human
caagcaaaggcagagagggaggacggcaccga

SEQ ID NO: 342243 - RNA, 32 nt, Human
caagcaaaucccaaauucuccuccugaacccu

SEQ ID NO: 342244 - RNA, 32 nt, Human
caagcaacacacaagggcgucaagucacuggc

SEQ ID NO: 342245 - RNA, 32 nt, Human
caagcaaccucuagcucccacaauucaguguu

SEQ ID NO: 342246 - RNA, 32 nt, Human
caagcaacucuucugccucagcaucccaagua

SEQ ID NO: 342247 - RNA, 32 nt, Human
caagcaagaagaggaguggaagcacaguugcc

SEQ ID NO: 342248 - RNA, 32 nt, Human
caagcaagacacaccagagcucuucccucgau

SEQ ID NO: 342249 - RNA, 32 nt, Human
caagcaagaggugaagaaggcaggagagagac

SEQ ID NO: 342250 - RNA, 32 nt, Human
caagcaagaugggguucucaucaguucuuccu

SEQ ID NO: 342251 - RNA, 32 nt, Human
caagcaagccagugagcagcccugccagacua

SEQ ID NO: 342252 - RNA, 32 nt, Human
caagcaagcccccagaggccgugucucuggac

SEQ ID NO: 342253 - RNA, 32 nt, Human
caagcaagccugggacucagagacagaugugc

SEQ ID NO: 342254 - RNA, 32 nt, Human
caagcaagccugggagccggcgggaggucugc

SEQ ID NO: 342255 - RNA, 32 nt, Human
caagcaaggaagcagagcacuguguaaccagc

SEQ ID NO: 342256 - RNA, 32 nt, Human
caagcaaggguacauccugacacucacugaga

SEQ ID NO: 342257 - RNA, 32 nt, Human
caagcaaguccacauggagauuuggaggacac

SEQ ID NO: 342258 - RNA, 32 nt, Human
caagcaauccaagugauccucccaccucaacc

SEQ ID NO: 342259 - RNA, 32 nt, Human
caagcaaucccccagccucggccucccaaagu

SEQ ID NO: 342260 - RNA, 20 nt, Human
caagcaauccucccaccuca

SEQ ID NO: 342261 - RNA, 22 nt, Human
caagcaaugcgagcuuccucuc

SEQ ID NO: 342262 - RNA, 32 nt, Human
caagcaauucacugcaucccucugugccucag

SEQ ID NO: 342263 - RNA, 32 nt, Human
caagcaauucauuagaugacuacagccuagau

SEQ ID NO: 342264 - RNA, 32 nt, Human
caagcaauucuccugccccagccuccugagua

SEQ ID NO: 342265 - RNA, 32 nt, Human
caagcacaaucagcaaaucuagcagagccguu

SEQ ID NO: 342266 - RNA, 32 nt, Human
caagcacacaugcauggcauuuguuccugaac

SEQ ID NO: 342267 - RNA, 32 nt, Human
caagcacagaaucuuucccacucuccagaagc

SEQ ID NO: 342268 - RNA, 32 nt, Human
caagcacagagggagagguucaggagucaggu

SEQ ID NO: 342269 - RNA, 32 nt, Human
caagcacaucugggcggggaggccguggaggg

SEQ ID NO: 342270 - RNA, 32 nt, Human
caagcaccaccaggucggaaggaggagaccca

SEQ ID NO: 342271 - RNA, 32 nt, Human
caagcaccagccaccaugccuggcuaauuuug

SEQ ID NO: 342272 - RNA, 32 nt, Human
caagcacccacugccaagcuaccccaccccuu

SEQ ID NO: 342273 - RNA, 32 nt, Human
caagcaccccagagauaugaggcacccuuugc

SEQ ID NO: 342274 - RNA, 32 nt, Human
caagcaccccagcauagccacccagggauggc

SEQ ID NO: 342275 - RNA, 32 nt, Human
caagcaccccagggcuggagugcggaucucca

SEQ ID NO: 342276 - RNA, 32 nt, Human
caagcaccgagugaggggucuguuggggacgc

SEQ ID NO: 342277 - RNA, 32 nt, Human
caagcaccgcacagcaaugacgucuguccugg

SEQ ID NO: 342278 - RNA, 23 nt, Human
caagcaccugggauuacaagcau

SEQ ID NO: 342279 - RNA, 32 nt, Human
caagcaccugucuuccccuccucccauccagg

SEQ ID NO: 342280 - RNA, 32 nt, Human
caagcaccuuaaucccagcuacuugggaggca

SEQ ID NO: 342281 - RNA, 32 nt, Human
caagcacgaagcccuuucccacccgucgggcu

SEQ ID NO: 342282 - RNA, 32 nt, Human
caagcacguagcccuuuaccucuuggggaagg

SEQ ID NO: 342283 - RNA, 32 nt, Human
caagcacucacacacaugcaaugguauaugug

SEQ ID NO: 342284 - RNA, 32 nt, Human
caagcacucacucuugggugaacuaugcuucu

SEQ ID NO: 342285 - RNA, 32 nt, Human
caagcacuccacccaccucggccucccaaagu

SEQ ID NO: 342286 - RNA, 32 nt, Human
caagcacugagaaauucuuucucagguuucuu

SEQ ID NO: 342287 - RNA, 32 nt, Human
caagcacugcagcugccugcacccccgggcuu

SEQ ID NO: 342288 - RNA, 32 nt, Human
caagcacugccucccuccggggucuguaagag

SEQ ID NO: 342289 - RNA, 32 nt, Human
caagcacugccucccuccugcucuguccaggu

SEQ ID NO: 342290 - RNA, 32 nt, Human
caagcacugcucacgucucugccgccugcguu

SEQ ID NO: 342291 - RNA, 32 nt, Human
caagcacuggaagagagguuccggggcugggc

SEQ ID NO: 342292 - RNA, 32 nt, Human
caagcacuggacuacaagggcauggcucacaa

SEQ ID NO: 342293 - RNA, 32 nt, Human
caagcacuggggugccuccucucaccuggcca

SEQ ID NO: 342294 - RNA, 32 nt, Human
caagcacuugcuggaaaagauaucagauugga

SEQ ID NO: 342295 - RNA, 32 nt, Human
caagcagacacacacauauauacauacgcaau

SEQ ID NO: 342296 - RNA, 32 nt, Human
caagcagacagcccggugccacacccugggca

SEQ ID NO: 342297 - RNA, 32 nt, Human
caagcagagcacucccucagagacccaaacag

SEQ ID NO: 342298 - RNA, 32 nt, Human
caagcagagccccaggaaugaagcacaaaauc

SEQ ID NO: 342299 - RNA, 32 nt, Human
caagcagaggagacacagcagugagggaggcg

SEQ ID NO: 342300 - RNA, 32 nt, Human
caagcagaggcuccccucaugaaggaagccau

SEQ ID NO: 342301 - RNA, 19 nt, Human
caagcagaggcugugcaaa

SEQ ID NO: 342302 - RNA, 23 nt, Human
caagcagaucacccaaggucagg

SEQ ID NO: 342303 - RNA, 23 nt, Human
caagcagaucacuugaggucagg

SEQ ID NO: 342304 - RNA, 32 nt, Human
caagcagcaccagcaggccugcccaggaugcu

SEQ ID NO: 342305 - RNA, 32 nt, Human
caagcagcaccugucugucugccggcccaggu

SEQ ID NO: 342306 - RNA, 32 nt, Human
caagcagcacugcuccccucugacagagugag

SEQ ID NO: 342307 - RNA, 32 nt, Human
caagcagcagagcaccugggauagagaaagug

SEQ ID NO: 342308 - RNA, 32 nt, Human
caagcagcagcgggccgcgacgcccagccugc

SEQ ID NO: 342309 - RNA, 24 nt, Human
caagcagcagcucuccagcaucuc

SEQ ID NO: 342310 - RNA, 21 nt, Human
caagcagcauucccagcagcu

SEQ ID NO: 342311 - RNA, 24 nt, Human
caagcagccagcagccuagcagcc

SEQ ID NO: 342312 - RNA, 22 nt, Human
caagcagccagccuccaagcuc

SEQ ID NO: 342313 - RNA, 32 nt, Human
caagcagccaugcuuucugggcauuuucgucc

SEQ ID NO: 342314 - RNA, 32 nt, Human
caagcagcccaggcagcugugggcagugcugg

SEQ ID NO: 342315 - RNA, 20 nt, Human
caagcagcccuccugccuag

SEQ ID NO: 342316 - RNA, 32 nt, Human
caagcagcccuccuggacuucauguuaaagac

SEQ ID NO: 342317 - RNA, 32 nt, Human
caagcagccgcugagacggacgguuccaugcc

SEQ ID NO: 342318 - RNA, 32 nt, Human
caagcagcguggcuggaagcugaugggaaacg

SEQ ID NO: 342319 - RNA, 32 nt, Human
caagcagcugaguagauauacaacugucacaa

SEQ ID NO: 342320 - RNA, 23 nt, Human
caagcaggaaugggauccaaaga

SEQ ID NO: 342321 - RNA, 32 nt, Human
caagcaggaaugggauccaaagagacucccac

SEQ ID NO: 342322 - RNA, 32 nt, Human
caagcaggaggagaagcggaagaagagggccu

SEQ ID NO: 342323 - RNA, 32 nt, Human
caagcaggcaggacacaggagggauggcacug

SEQ ID NO: 342324 - RNA, 22 nt, Human
caagcaggccuggacccagaga

SEQ ID NO: 342325 - RNA, 32 nt, Human
caagcagggcacauugcuugggcuuguuccca

SEQ ID NO: 342326 - RNA, 32 nt, Human
caagcagggccccuccuuccuccugucuuuau

SEQ ID NO: 342327 - RNA, 32 nt, Human
caagcagggccugucuuuugccugguacaagg

SEQ ID NO: 342328 - RNA, 32 nt, Human
caagcagggcucugccccagaggccucucucu

SEQ ID NO: 342329 - RNA, 32 nt, Human
caagcaggugugaagagcagggcucagcagca

SEQ ID NO: 342330 - RNA, 32 nt, Human
caagcaguagcauuugcuuccucccaacaagc

SEQ ID NO: 342331 - RNA, 32 nt, Human
caagcaguccacagcagucuggcuggcagguc

SEQ ID NO: 342332 - RNA, 32 nt, Human
caagcaguccuccccacucagccucucuagua

SEQ ID NO: 342333 - RNA, 32 nt, Human
caagcagucuccccaccccuugagucucagca

SEQ ID NO: 342334 - RNA, 32 nt, Human
caagcaguggacauuccuauccauucaaggcu

SEQ ID NO: 342335 - RNA, 32 nt, Human
caagcaguggacugcccacccacucccacacc

SEQ ID NO: 342336 - RNA, 32 nt, Human
caagcagugggaggaggagaaggaggaggagg

SEQ ID NO: 342337 - RNA, 32 nt, Human
caagcaguuccccugccucaagggcuucuuuu

SEQ ID NO: 342338 - RNA, 32 nt, Human
caagcaguucuuuucagcagauuuugcccacu

SEQ ID NO: 342339 - RNA, 23 nt, Human
caagcaguugggacuacaggcgu

SEQ ID NO: 342340 - RNA, 32 nt, Human
caagcauacaugcacacugauacauacagaga

SEQ ID NO: 342341 - RNA, 32 nt, Human
caagcauacaugcacacugauacauacaugua

SEQ ID NO: 342342 - RNA, 32 nt, Human
caagcauagaauugcauccauucuucugaaau

SEQ ID NO: 342343 - RNA, 32 nt, Human
caagcauagcugccugcacucugucucuccaa

SEQ ID NO: 342344 - RNA, 32 nt, Human
caagcauaugcauacacacauauauacaugua

SEQ ID NO: 342345 - RNA, 32 nt, Human
caagcaucaauacuccuagggcucaggacaag

SEQ ID NO: 342346 - RNA, 32 nt, Human
caagcaucccagcgggcaucucaccacgacuu

SEQ ID NO: 342347 - RNA, 32 nt, Human
caagcaucccuugccaggauuuguuaucacug

SEQ ID NO: 342348 - RNA, 32 nt, Human
caagcauccugcugggggcuucaaagaugaaa

SEQ ID NO: 342349 - RNA, 32 nt, Human
caagcaucugguucagcggaaaugggauguga

SEQ ID NO: 342350 - RNA, 30 nt, Human
caagcaugacuucugccagcccugaagacc

SEQ ID NO: 342351 - RNA, 32 nt, Human
caagcaugagccaccacaccuggccuaugugu

SEQ ID NO: 342352 - RNA, 32 nt, Human
caagcaugagccaccacaccuggccuguuauu

SEQ ID NO: 342353 - RNA, 32 nt, Human
caagcaugagccaccacgccugagcuuucugc

SEQ ID NO: 342354 - RNA, 32 nt, Human
caagcaugagccaccgcaccugaccaaauuua

SEQ ID NO: 342355 - RNA, 32 nt, Human
caagcaugagccacugugcccagccuguucca

SEQ ID NO: 342356 - RNA, 32 nt, Human
caagcaugagccacugugcccagccuucuuua

SEQ ID NO: 342357 - RNA, 32 nt, Human
caagcaugauuuuacauguguaccaaauuucc

SEQ ID NO: 342358 - RNA, 32 nt, Human
caagcaugcaccacuacacucagccaaauacu

SEQ ID NO: 342359 - RNA, 30 nt, Human
caagcauggacgccguggaugccaccaugg

SEQ ID NO: 342360 - RNA, 32 nt, Human
caagcauggaggaaaggcaaugccuggaccac

SEQ ID NO: 342361 - RNA, 32 nt, Human
caagcauggagugcucugagcaagggcaauca

SEQ ID NO: 342362 - RNA, 32 nt, Human
caagcaugguaucaucucacuuuucuaauuua

SEQ ID NO: 342363 - RNA, 31 nt, Human
caagcaugucugcaaauuaggagggaguuag

SEQ ID NO: 342364 - RNA, 32 nt, Human
caagcauguggcagagcuggagugcaggccau

SEQ ID NO: 342365 - RNA, 24 nt, Human
caagcauuuauuuuuaguacauuu

SEQ ID NO: 342366 - RNA, 20 nt, Human
caagccaaagcaacuguggg

SEQ ID NO: 342367 - RNA, 19 nt, Human
caagccaagcccaaggaca

SEQ ID NO: 342368 - RNA, 32 nt, Human
caagccaagcuggccccugccuguuccuguag

SEQ ID NO: 342369 - RNA, 32 nt, Human
caagccaaggaaaaagauacaagagcagaaua

SEQ ID NO: 342370 - RNA, 32 nt, Human
caagccaagucaacagugucucugggguggca

SEQ ID NO: 342371 - RNA, 32 nt, Human
caagccaauauuugugacuuugcucugcuacc

SEQ ID NO: 342372 - RNA, 32 nt, Human
caagccacauaucaacacagguuuuuaggugg

SEQ ID NO: 342373 - RNA, 32 nt, Human
caagccacauuuccucccagugcugggugcgc

SEQ ID NO: 342374 - RNA, 32 nt, Human
caagccacccagcccagcuucuuuccauuccu

SEQ ID NO: 342375 - RNA, 32 nt, Human
caagccacugcacuccagccugggcgacagag

SEQ ID NO: 342376 - RNA, 32 nt, Human
caagccacugcugagacccuucccagggagga

SEQ ID NO: 342377 - RNA, 32 nt, Human
caagccacuggguggagcaaugugcucugggg

SEQ ID NO: 342378 - RNA, 32 nt, Human
caagccacuucccaucucugggccucgucuuu

SEQ ID NO: 342379 - RNA, 32 nt, Human
caagccacuuccuuuaggcuaacacacugcua

SEQ ID NO: 342380 - RNA, 32 nt, Human
caagccagaaaacuguccuguaccaaagcuug

SEQ ID NO: 342381 - RNA, 32 nt, Human
caagccagaaauucaggcugcuugcagagugg

SEQ ID NO: 342382 - RNA, 32 nt, Human
caagccagacucugcaauuucucccaaggcuc

SEQ ID NO: 342383 - RNA, 22 nt, Human
caagccagagcgccuccucuca

SEQ ID NO: 342384 - RNA, 32 nt, Human
caagccagauggugaccagagcuugccucuga

SEQ ID NO: 342385 - RNA, 32 nt, Human
caagccagcagaaacagccucagccuaccgca

SEQ ID NO: 342386 - RNA, 32 nt, Human
caagccagccaucagggcaaguguuuugaauc

SEQ ID NO: 342387 - RNA, 32 nt, Human
caagccagccccacccuuaagcuuccucugac

SEQ ID NO: 342388 - RNA, 32 nt, Human
caagccagcccuuaggagauacugaacaaggc

SEQ ID NO: 342389 - RNA, 32 nt, Human
caagccagccugcugagacucccuagccacag

SEQ ID NO: 342390 - RNA, 32 nt, Human
caagccagcucugccuguaccauuuuccucug

SEQ ID NO: 342391 - RNA, 32 nt, Human
caagccagcugcagaaauuugcauaacuagca

SEQ ID NO: 342392 - RNA, 21 nt, Human
caagccagcugccuugucuga

SEQ ID NO: 342393 - RNA, 32 nt, Human
caagccaggaaggcagcuuucgcuuguuccug

SEQ ID NO: 342394 - RNA, 32 nt, Human
caagccaggaagggaaggagucuguguggugu

SEQ ID NO: 342395 - RNA, 32 nt, Human
caagccaggaguuuauuucagguaauuugggc

SEQ ID NO: 342396 - RNA, 21 nt, Human
caagccagggaagcaacuggg

SEQ ID NO: 342397 - RNA, 32 nt, Human
caagccagggcuccuccuccugucgugggcuc

SEQ ID NO: 342398 - RNA, 32 nt, Human
caagccaguacaguaaaugacacuggggccgc

SEQ ID NO: 342399 - RNA, 22 nt, Human
caagccaguggggaucuucuga

SEQ ID NO: 342400 - RNA, 21 nt, Human
caagccagugucuucagcuga

SEQ ID NO: 342401 - RNA, 32 nt, Human
caagccauccuccugccucagcauccacagua

SEQ ID NO: 342402 - RNA, 32 nt, Human
caagccaucucuccucuuuaugcucguguuuc

SEQ ID NO: 342403 - RNA, 32 nt, Human
caagccaucuuccuuagccucccaaguagcua

SEQ ID NO: 342404 - RNA, 32 nt, Human
caagccaugguggcagaggagcuggugugaac

SEQ ID NO: 342405 - RNA, 32 nt, Human
caagccauugcacuccagccugggcaacaaga

SEQ ID NO: 342406 - RNA, 32 nt, Human
caagccauugcacucuagcccggacgacagag

SEQ ID NO: 342407 - RNA, 32 nt, Human
caagccauuguacuccagccuggacaacaaga

SEQ ID NO: 342408 - RNA, 32 nt, Human
caagccauuuuucugccucagcuuuucgagua

SEQ ID NO: 342409 - RNA, 32 nt, Human
caagcccaagagccaucccaggccuguucagg

SEQ ID NO: 342410 - RNA, 32 nt, Human
caagcccaccugccucucuccugcugcuccuc

SEQ ID NO: 342411 - RNA, 21 nt, Human
caagcccacugcugcagcugc

SEQ ID NO: 342412 - RNA, 32 nt, Human
caagcccagaagagaggccucggaaggaaccg

SEQ ID NO: 342413 - RNA, 32 nt, Human
caagcccagccagcaaaccucaccgaugaaac

SEQ ID NO: 342414 - RNA, 19 nt, Human
caagcccagcccuaggagg

SEQ ID NO: 342415 - RNA, 19 nt, Human
caagcccagcuggcaccaa

SEQ ID NO: 342416 - RNA, 32 nt, Human
caagcccaggaccuucguggagcugcuucucc

SEQ ID NO: 342417 - RNA, 32 nt, Human
caagcccaggcagacgagaccucugcccugaa

SEQ ID NO: 342418 - RNA, 32 nt, Human
caagcccaggcccugcgcggagcggagcggcg

SEQ ID NO: 342419 - RNA, 32 nt, Human
caagcccagggagucugaaugugaguccaagg

SEQ ID NO: 342420 - RNA, 32 nt, Human
caagcccagggcaaggauccugugcugcuguc

SEQ ID NO: 342421 - RNA, 19 nt, Human
caagcccaugcugcugcag

SEQ ID NO: 342422 - RNA, 32 nt, Human
caagcccauggcaauuugucauccccuccuua

SEQ ID NO: 342423 - RNA, 32 nt, Human
caagcccauugucaccuggcucaaggagggga

SEQ ID NO: 342424 - RNA, 32 nt, Human
caagccccaagacauccccuuagaugaucuga

SEQ ID NO: 342425 - RNA, 32 nt, Human
caagccccagaacucagacaacagaaaggaaa

SEQ ID NO: 342426 - RNA, 32 nt, Human
caagccccagcagccccagccccagccccagg

SEQ ID NO: 342427 - RNA, 32 nt, Human
caagcccccaagaggauggcagccugggcguc

SEQ ID NO: 342428 - RNA, 32 nt, Human
caagcccccuggcagcugccccuccuggagca

SEQ ID NO: 342429 - RNA, 32 nt, Human
caagccccgcuucuaccagccuguggaguuca

SEQ ID NO: 342430 - RNA, 32 nt, Human
caagccccuccaggaggguccuggggugggcc

SEQ ID NO: 342431 - RNA, 32 nt, Human
caagccccuccccacgucgcccccuccugcac

SEQ ID NO: 342432 - RNA, 32 nt, Human
caagccccuccccuccacuccccuuccugcgu

SEQ ID NO: 342433 - RNA, 32 nt, Human
caagccccugcucccuuuaugggucugccuca

SEQ ID NO: 342434 - RNA, 32 nt, Human
caagccccuuccccucucugggccucaguuuc

SEQ ID NO: 342435 - RNA, 32 nt, Human
caagccccuuucucucccuauggucaacaucu

SEQ ID NO: 342436 - RNA, 32 nt, Human
caagcccgacuugcuguuuuguucugugguuu

SEQ ID NO: 342437 - RNA, 32 nt, Human
caagcccgaguaacaaacuuucuuaucuucca

SEQ ID NO: 342438 - RNA, 18 nt, Human
caagcccgcggcagcugc

SEQ ID NO: 342439 - RNA, 18 nt, Human
caagcccgcuacagcugc

SEQ ID NO: 342440 - RNA, 18 nt, Human
caagcccgcugcagcugc

SEQ ID NO: 342441 - RNA, 32 nt, Human
caagcccgcuuccuccugaugaugcucagcau

SEQ ID NO: 342442 - RNA, 32 nt, Human
caagcccgggcugaggagggggcggcggcggc

SEQ ID NO: 342443 - RNA, 32 nt, Human
caagcccuagguugcaguggggcuaagcacga

SEQ ID NO: 342444 - RNA, 31 nt, Human
caagcccucaauaaauaaauauugaaugaau

SEQ ID NO: 342445 - RNA, 32 nt, Human
caagcccucauuuugccugcugccaucuauau

SEQ ID NO: 342446 - RNA, 32 nt, Human
caagcccuccaauccccaucccaggcuugcug

SEQ ID NO: 342447 - RNA, 32 nt, Human
caagcccuccugugauaacagaauaaagcacu

SEQ ID NO: 342448 - RNA, 17 nt, Human
caagcccugacugugga

SEQ ID NO: 342449 - RNA, 32 nt, Human
caagcccugaugcuauggacuccauacuguug

SEQ ID NO: 342450 - RNA, 32 nt, Human
caagcccugcagccuccgacuccugcuggcuc

SEQ ID NO: 342451 - RNA, 32 nt, Human
caagcccugcagcgacugagacugucuauuca

SEQ ID NO: 342452 - RNA, 32 nt, Human
caagcccugccucugauucugcagguauggaa

SEQ ID NO: 342453 - RNA, 32 nt, Human
caagcccugcuguguggcugucguuuacauuu

SEQ ID NO: 342454 - RNA, 32 nt, Human
caagcccugggaggucaaggcugcagugagcu

SEQ ID NO: 342455 - RNA, 32 nt, Human
caagcccuguauccuuuugaaggacaugacaa

SEQ ID NO: 342456 - RNA, 32 nt, Human
caagcccugucugaccgccaaggcuucauacu

SEQ ID NO: 342457 - RNA, 32 nt, Human
caagccgaacacugagggcugaggagaaagcu

SEQ ID NO: 342458 - RNA, 32 nt, Human
caagccgcaguuuucugugcuggcugugccuc

SEQ ID NO: 342459 - RNA, 32 nt, Human
caagccgcuacccugaaucuuuguggcggguu

SEQ ID NO: 342460 - RNA, 32 nt, Human
caagccgcuccccguguccucccuggcuggcc

SEQ ID NO: 342461 - RNA, 32 nt, Human
caagccggggccuggucggcagcugggccgcc

SEQ ID NO: 342462 - RNA, 32 nt, Human
caagccggucucaaacuccugagcucaaguga

SEQ ID NO: 342463 - RNA, 32 nt, Human
caagccgugcugcugauuccgucucacaguuu

SEQ ID NO: 342464 - RNA, 32 nt, Human
caagccuaaaggauucccacagcugggagcca

SEQ ID NO: 342465 - RNA, 32 nt, Human
caagccuagagccaccagcccagcuuccuucu

SEQ ID NO: 342466 - RNA, 32 nt, Human
caagccuaugccagugcugaugaagcuggagg

SEQ ID NO: 342467 - RNA, 32 nt, Human
caagccucaaauggugaauaauucuuucccua

SEQ ID NO: 342468 - RNA, 32 nt, Human
caagccucagagucugaaugccuccagucugc

SEQ ID NO: 342469 - RNA, 32 nt, Human
caagccucagccugccaaauugccagaauuac

SEQ ID NO: 342470 - RNA, 32 nt, Human
caagccucccacucugaacaucaccuccugua

SEQ ID NO: 342471 - RNA, 32 nt, Human
caagccucccgccucugccacccgcauagcua

SEQ ID NO: 342472 - RNA, 32 nt, Human
caagccucccuccucauccucagugugccugu

SEQ ID NO: 342473 - RNA, 32 nt, Human
caagccuccuccuuccugccagccucuuucuc

SEQ ID NO: 342474 - RNA, 19 nt, Human
caagccucgcagcagcugc

SEQ ID NO: 342475 - RNA, 32 nt, Human
caagccucucucucuuccuacugagcaccugu

SEQ ID NO: 342476 - RNA, 32 nt, Human
caagccucugccuuuccuucugcuccagagca

SEQ ID NO: 342477 - RNA, 32 nt, Human
caagccucuggguuuucccuuuaccagucugu

SEQ ID NO: 342478 - RNA, 23 nt, Human
caagccucuuaguacuuaauuua

SEQ ID NO: 342479 - RNA, 32 nt, Human
caagccucuuggccaccuccucccuuagccuu

SEQ ID NO: 342480 - RNA, 32 nt, Human
caagccugaaaccacacaguacgacagcuuug

SEQ ID NO: 342481 - RNA, 32 nt, Human
caagccugagcaacauaucaaaaccccaucuc

SEQ ID NO: 342482 - RNA, 32 nt, Human
caagccugagcaacauaucaaaaccccgucuc

SEQ ID NO: 342483 - RNA, 32 nt, Human
caagccugagccaagcucaucuucauugaaug

SEQ ID NO: 342484 - RNA, 32 nt, Human
caagccugagucugucccgugcuucugcugcu

SEQ ID NO: 342485 - RNA, 22 nt, Human
caagccugaugggcagcacaga

SEQ ID NO: 342486 - RNA, 19 nt, Human
caagccugcagucaucuug

SEQ ID NO: 342487 - RNA, 32 nt, Human
caagccugccaacaagcugaaaccccaucucc

SEQ ID NO: 342488 - RNA, 21 nt, Human
caagccugcccacugauggca

SEQ ID NO: 342489 - RNA, 32 nt, Human
caagccugcuaacauggaggagcugaccgaag

SEQ ID NO: 342490 - RNA, 32 nt, Human
caagccugcucacccacugcuucugcuuuaag

SEQ ID NO: 342491 - RNA, 32 nt, Human
caagccugcuccagucccaggggcaggccauu

SEQ ID NO: 342492 - RNA, 32 nt, Human
caagccugcugcuucuccucccugcagacuua

SEQ ID NO: 342493 - RNA, 32 nt, Human
caagccugcuggcugcggcccccucucggcca

SEQ ID NO: 342494 - RNA, 32 nt, Human
caagccuggccauggcccugcccucaccccac

SEQ ID NO: 342495 - RNA, 32 nt, Human
caagccuggcugacacaggugugaagaggcca

SEQ ID NO: 342496 - RNA, 32 nt, Human
caagccugggcaacagagugagacacugucuc

SEQ ID NO: 342497 - RNA, 32 nt, Human
caagccugggcaacagagugagaccccaacuu

SEQ ID NO: 342498 - RNA, 32 nt, Human
caagccugggcaacauagugagaccuucuccc

SEQ ID NO: 342499 - RNA, 32 nt, Human
caagccugggcaacauggugaaacugucucua

SEQ ID NO: 342500 - RNA, 32 nt, Human
caagccugggcugcaguccuugcuauguuccc

SEQ ID NO: 342501 - RNA, 32 nt, Human
caagccugggcuggaagaggauggcagaggcu

SEQ ID NO: 342502 - RNA, 32 nt, Human
caagccuggggugagagcacagaggagugggc

SEQ ID NO: 342503 - RNA, 32 nt, Human
caagccuggggugcucuucuccaccccagauu

SEQ ID NO: 342504 - RNA, 32 nt, Human
caagccuggguggcagaugaacagugcuuccu

SEQ ID NO: 342505 - RNA, 32 nt, Human
caagccuggugugcccacacaccacuuacuuc

SEQ ID NO: 342506 - RNA, 32 nt, Human
caagccuguaaucccagcuauuugggaggcug

SEQ ID NO: 342507 - RNA, 32 nt, Human
caagccuguagucccagcuacucgggaggcug

SEQ ID NO: 342508 - RNA, 32 nt, Human
caagccugucaguggcccucccuggugcacug

SEQ ID NO: 342509 - RNA, 32 nt, Human
caagccuguggcuggagcuggggucuguuuac

SEQ ID NO: 342510 - RNA, 32 nt, Human
caagccuguggguagaggaaagagugaucugg

SEQ ID NO: 342511 - RNA, 32 nt, Human
caagccugugugugugcaugcuugggcggagu

SEQ ID NO: 342512 - RNA, 31 nt, Human
caagccuuaauaaauauaaguagacugaaau

SEQ ID NO: 342513 - RNA, 32 nt, Human
caagccuuagaugaccuccagcaacuucaguu

SEQ ID NO: 342514 - RNA, 21 nt, Human
caagccuuaggggcugugaga

SEQ ID NO: 342515 - RNA, 31 nt, Human
caagccuuauccaaggaggaagagauggaga

SEQ ID NO: 342516 - RNA, 32 nt, Human
caagccuugaaaggcaggcuucacagugccga

SEQ ID NO: 342517 - RNA, 32 nt, Human
caagccuugcccaucugggcugcucgcuuuac

SEQ ID NO: 342518 - RNA, 32 nt, Human
caagccuuucaucugcugcuucuccguccagc

SEQ ID NO: 342519 - RNA, 32 nt, Human
caagccuuuucaaaacacuuaucugcagucca

SEQ ID NO: 342520 - RNA, 32 nt, Human
caagcgacaaguguacccagaguagaaggccu

SEQ ID NO: 342521 - RNA, 20 nt, Human
caagcgacccucccaccuca

SEQ ID NO: 342522 - RNA, 32 nt, Human
caagcgaggcagggguugcacuggaccaaagg

SEQ ID NO: 342523 - RNA, 32 nt, Human
caagcgagguccaagcacaucuugucaacaug

SEQ ID NO: 342524 - RNA, 32 nt, Human
caagcgauccuccagccucggccucucaaagu

SEQ ID NO: 342525 - RNA, 20 nt, Human
caagcgauccucccaccuca

SEQ ID NO: 342526 - RNA, 32 nt, Human
caagcgauucuccagccucagccuccugagua

SEQ ID NO: 342527 - RNA, 32 nt, Human
caagcgauucuccagccucagcuuccugagua

SEQ ID NO: 342528 - RNA, 18 nt, Human
caagcgauucuccugccu

SEQ ID NO: 342529 - RNA, 32 nt, Human
caagcgauucuccugccucagcauccuaauua

SEQ ID NO: 342530 - RNA, 18 nt, Human
caagcgauucuccugcuu

SEQ ID NO: 342531 - RNA, 18 nt, Human
caagcgauucuccugucu

SEQ ID NO: 342532 - RNA, 18 nt, Human
caagcgauucucuugccu

SEQ ID NO: 342533 - RNA, 32 nt, Human
caagcgauuuuucugccucagccucuggugua

SEQ ID NO: 342534 - RNA, 32 nt, Human
caagcgcagagagggagagaauucuccacaaa

SEQ ID NO: 342535 - RNA, 32 nt, Human
caagcgcaggauucagggcagggguccucuug

SEQ ID NO: 342536 - RNA, 32 nt, Human
caagcgcaucuuaggaaugacaguaacagcgg

SEQ ID NO: 342537 - RNA, 32 nt, Human
caagcgcuccacccucucucccaccauggccc

SEQ ID NO: 342538 - RNA, 32 nt, Human
caagcgcucuugcuggccgucugggugcacac

SEQ ID NO: 342539 - RNA, 32 nt, Human
caagcgcugcccagguccuggggugguggcag

SEQ ID NO: 342540 - RNA, 32 nt, Human
caagcgcugccugggcuccgccggcucacuaa

SEQ ID NO: 342541 - RNA, 32 nt, Human
caagcgcuucuccagccucagccuccugagua

SEQ ID NO: 342542 - RNA, 20 nt, Human
caagcggagguugcagugag

SEQ ID NO: 342543 - RNA, 32 nt, Human
caagcggauauuuuagagguacaguguaauau

SEQ ID NO: 342544 - RNA, 24 nt, Human
caagcggaucuacaagggcaccca

SEQ ID NO: 342545 - RNA, 32 nt, Human
caagcggcauccaggcuucucucaccuccauu

SEQ ID NO: 342546 - RNA, 31 nt, Human
caagcgggccgucucccuuggcccagagacg

SEQ ID NO: 342547 - RNA, 32 nt, Human
caagcgggucauaaggcuucagcuucugggug

SEQ ID NO: 342548 - RNA, 32 nt, Human
caagcgguaugagucucauccagucugugcug

SEQ ID NO: 342549 - RNA, 32 nt, Human
caagcgguggugaggcaggcucgccuccucca

SEQ ID NO: 342550 - RNA, 32 nt, Human
caagcggugucucucauccugacuggggaucc

SEQ ID NO: 342551 - RNA, 32 nt, Human
caagcgugagccaccauuccuggacccucgua

SEQ ID NO: 342552 - RNA, 32 nt, Human
caagcgugagccaccgaccccugccgaggauu

SEQ ID NO: 342553 - RNA, 32 nt, Human
caagcgugagccaccgccccugacaugagcca

SEQ ID NO: 342554 - RNA, 32 nt, Human
caagcgugagccaccgggccuggccugcauuu

SEQ ID NO: 342555 - RNA, 32 nt, Human
caagcgugagccaccgugccuggccugccauc

SEQ ID NO: 342556 - RNA, 32 nt, Human
caagcgugagccacugcacccagccuguaaaa

SEQ ID NO: 342557 - RNA, 32 nt, Human
caagcgugagccacugcaccgggccacagaga

SEQ ID NO: 342558 - RNA, 32 nt, Human
caagcuaaacaagcaugcucuaacccaaugca

SEQ ID NO: 342559 - RNA, 32 nt, Human
caagcuaagccagcucagagaacacggggagc

SEQ ID NO: 342560 - RNA, 22 nt, Human
caagcuaauaaagaccuggaga

SEQ ID NO: 342561 - RNA, 32 nt, Human
caagcuacaaugaagaggagggaggcagucug

SEQ ID NO: 342562 - RNA, 32 nt, Human
caagcuacagcagcagcacuucccaagccugc

SEQ ID NO: 342563 - RNA, 32 nt, Human
caagcuacuggcacauagugaaagauuacuuc

SEQ ID NO: 342564 - RNA, 32 nt, Human
caagcuacuggcacauaugaaagauuacuucu

SEQ ID NO: 342565 - RNA, 32 nt, Human
caagcuacuugaaggcugagacaggaggaucg

SEQ ID NO: 342566 - RNA, 32 nt, Human
caagcuacuuuggcuucugccuggcucaggaa

SEQ ID NO: 342567 - RNA, 32 nt, Human
caagcuagaaagccaccaaggccaggcuuugu

SEQ ID NO: 342568 - RNA, 32 nt, Human
caagcuagaacuugcugaugugaacaguuuca

SEQ ID NO: 342569 - RNA, 32 nt, Human
caagcuagacugugucugaaucaugucuguau

SEQ ID NO: 342570 - RNA, 32 nt, Human
caagcuagagggcugggcccuaugacuguggu

SEQ ID NO: 342571 - RNA, 32 nt, Human
caagcuagaguuucaggucugugcggcugcua

SEQ ID NO: 342572 - RNA, 32 nt, Human
caagcuaggaaagaggaggcagaaagauuugg

SEQ ID NO: 342573 - RNA, 32 nt, Human
caagcuaggaagcacagaacugcaggccagag

SEQ ID NO: 342574 - RNA, 32 nt, Human
caagcuaguucucugaaaauuuugccauuuau

SEQ ID NO: 342575 - RNA, 20 nt, Human
caagcuauccucccaccuca

SEQ ID NO: 342576 - RNA, 32 nt, Human
caagcuaugggcuacuccagccgcuucagacu

SEQ ID NO: 342577 - RNA, 32 nt, Human
caagcucaagcccuacgagaagaaggacuggc

SEQ ID NO: 342578 - RNA, 32 nt, Human
caagcucacacagcaggaacugagccagaaac

SEQ ID NO: 342579 - RNA, 32 nt, Human
caagcucacaucuuccugugggaaaccuucua

SEQ ID NO: 342580 - RNA, 32 nt, Human
caagcucacugcaaccucugugcagguucaag

SEQ ID NO: 342581 - RNA, 32 nt, Human
caagcucacuucacugcacuccagucugggug

SEQ ID NO: 342582 - RNA, 32 nt, Human
caagcucagagagguuaacuugcccacagucu

SEQ ID NO: 342583 - RNA, 32 nt, Human
caagcucagagcagccucuguccuggcugugc

SEQ ID NO: 342584 - RNA, 18 nt, Human
caagcucagcucagcguc

SEQ ID NO: 342585 - RNA, 32 nt, Human
caagcucaggaaggccaagaaaagaauccauu

SEQ ID NO: 342586 - RNA, 20 nt, Human
caagcucaggagcagccucg

SEQ ID NO: 342587 - RNA, 32 nt, Human
caagcucaggaguucaagaccagccuggccaa

SEQ ID NO: 342588 - RNA, 32 nt, Human
caagcucaggcaggaggugggcagugaagggg

SEQ ID NO: 342589 - RNA, 32 nt, Human
caagcucagugaauguaucccggcaugggugg

SEQ ID NO: 342590 - RNA, 24 nt, Human
caagcucagugggcagcagcugca

SEQ ID NO: 342591 - RNA, 32 nt, Human
caagcucaguuucaaugcuguaaacuuaaagc

SEQ ID NO: 342592 - RNA, 32 nt, Human
caagcucauggccacaugaagaagauacauug

SEQ ID NO: 342593 - RNA, 32 nt, Human
caagcucauguuuucuccugaucaagaaaauc

SEQ ID NO: 342594 - RNA, 32 nt, Human
caagcuccaagaagguuaagagacauuaacag

SEQ ID NO: 342595 - RNA, 32 nt, Human
caagcuccagaacaguaaccaagugggaaaau

SEQ ID NO: 342596 - RNA, 32 nt, Human
caagcuccagcagagaguggccagauguggug

SEQ ID NO: 342597 - RNA, 32 nt, Human
caagcuccauaacuccuuuuggugcuaaugau

SEQ ID NO: 342598 - RNA, 32 nt, Human
caagcucccugcucugugcuaggcccuggcuu

SEQ ID NO: 342599 - RNA, 32 nt, Human
caagcuccuuggucuucuugccaagcaggaag

SEQ ID NO: 342600 - RNA, 18 nt, Human
caagcucgcugcagcugc

SEQ ID NO: 342601 - RNA, 32 nt, Human
caagcucgggcugaggagggaggacuccuggc

SEQ ID NO: 342602 - RNA, 32 nt, Human
caagcucucaacugcugaucacccagugauug

SEQ ID NO: 342603 - RNA, 32 nt, Human
caagcucuccugucccauugugcauugucugu

SEQ ID NO: 342604 - RNA, 32 nt, Human
caagcucugauugacacagucaccuucccugu

SEQ ID NO: 342605 - RNA, 32 nt, Human
caagcucuggccaccagaacugugagcaaaua

SEQ ID NO: 342606 - RNA, 32 nt, Human
caagcucuggccccuaggacucaggccugcca

SEQ ID NO: 342607 - RNA, 32 nt, Human
caagcucugggcuuugagagcugaauagcauu

SEQ ID NO: 342608 - RNA, 32 nt, Human
caagcucugggguuuugccaugaaucagcagc

SEQ ID NO: 342609 - RNA, 32 nt, Human
caagcucuuacagaguugacagucuaguuuca

SEQ ID NO: 342610 - RNA, 32 nt, Human
caagcucuucauuguuccuaucugccaaauca

SEQ ID NO: 342611 - RNA, 32 nt, Human
caagcucuuccucccaaaggcuucugcaggcc

SEQ ID NO: 342612 - RNA, 24 nt, Human
caagcugaaaccccaucuccacua

SEQ ID NO: 342613 - RNA, 32 nt, Human
caagcugaagugaagccagugaagagcccacc

SEQ ID NO: 342614 - RNA, 32 nt, Human
caagcugacaagggguggacuuguggaccuaa

SEQ ID NO: 342615 - RNA, 32 nt, Human
caagcugacuccagccuugggcucagcagcac

SEQ ID NO: 342616 - RNA, 32 nt, Human
caagcugacuccagccuuggggucagcagcac

SEQ ID NO: 342617 - RNA, 32 nt, Human
caagcugacuuggaauugugugcugcuugcug

SEQ ID NO: 342618 - RNA, 32 nt, Human
caagcugagaggggagaccugccccuuuccaa

SEQ ID NO: 342619 - RNA, 32 nt, Human
caagcugagccucuauguggcaccaauuccug

SEQ ID NO: 342620 - RNA, 32 nt, Human
caagcugauaaggaaaacaauuuggagaauga

SEQ ID NO: 342621 - RNA, 32 nt, Human
caagcugauccaguagugcagcugccgcagcc

SEQ ID NO: 342622 - RNA, 32 nt, Human
caagcugaucucaaacuccugaccucaaguga

SEQ ID NO: 342623 - RNA, 32 nt, Human
caagcugauucacuuucuuucugguaagcuca

SEQ ID NO: 342624 - RNA, 32 nt, Human
caagcugcaaagugccuugcucauuugaaaau

SEQ ID NO: 342625 - RNA, 32 nt, Human
caagcugcagaucgucgugccgaugaaagaga

SEQ ID NO: 342626 - RNA, 32 nt, Human
caagcugcaucgugcaaccucuuuggugccag

SEQ ID NO: 342627 - RNA, 32 nt, Human
caagcugcauggcaaguucugugguucugaga

SEQ ID NO: 342628 - RNA, 32 nt, Human
caagcugccacuggucggccaguacagccucc

SEQ ID NO: 342629 - RNA, 32 nt, Human
caagcugccuccagaaccucagagcuucccug

SEQ ID NO: 342630 - RNA, 32 nt, Human
caagcugccuccccucuccuuccugugugucc

SEQ ID NO: 342631 - RNA, 32 nt, Human
caagcugccugcugccccagguccucaccuca

SEQ ID NO: 342632 - RNA, 32 nt, Human
caagcugccuuguuuagccugcuuuacauugu

SEQ ID NO: 342633 - RNA, 32 nt, Human
caagcugcguaacugucgugugccucaguuuc

SEQ ID NO: 342634 - RNA, 32 nt, Human
caagcugcuacaaauaaauucuguguucuuuu

SEQ ID NO: 342635 - RNA, 32 nt, Human
caagcugcugaaggagggucaccgcauggaca

SEQ ID NO: 342636 - RNA, 32 nt, Human
caagcugcuggcacagcgcagggagggccaga

SEQ ID NO: 342637 - RNA, 32 nt, Human
caagcugcuuugccuccagcugccucagucuc

SEQ ID NO: 342638 - RNA, 32 nt, Human
caagcuggacccauccucccugcucacagagg

SEQ ID NO: 342639 - RNA, 32 nt, Human
caagcuggagaagggaagaguuauuccuccau

SEQ ID NO: 342640 - RNA, 32 nt, Human
caagcuggagggcaauggcgccaucucagcuc

SEQ ID NO: 342641 - RNA, 32 nt, Human
caagcuggagguaguggagcaaacaagaucag

SEQ ID NO: 342642 - RNA, 32 nt, Human
caagcuggagugcacuggcaugauauuggcuc

SEQ ID NO: 342643 - RNA, 32 nt, Human
caagcuggagugcaguggcacaaucauaccuc

SEQ ID NO: 342644 - RNA, 32 nt, Human
caagcuggagugcaguggugcaaugugggcuc

SEQ ID NO: 342645 - RNA, 32 nt, Human
caagcuggaugugggagccacggagggccaag

SEQ ID NO: 342646 - RNA, 32 nt, Human
caagcuggcagccuggccaccaggcuggcugu

SEQ ID NO: 342647 - RNA, 32 nt, Human
caagcuggcauuucaguaguugcuuuugaaua

SEQ ID NO: 342648 - RNA, 19 nt, Human
caagcuggcugggguggcc

SEQ ID NO: 342649 - RNA, 32 nt, Human
caagcugggacuucuccaggccuguguucccu

SEQ ID NO: 342650 - RNA, 32 nt, Human
caagcugggagagagaaaugacugagaugaau

SEQ ID NO: 342651 - RNA, 32 nt, Human
caagcugggaggaccaaggccgggcagccggg

SEQ ID NO: 342652 - RNA, 32 nt, Human
caagcugggaggaucgcuugaggccaggaguu

SEQ ID NO: 342653 - RNA, 18 nt, Human
caagcugggcaucgggga

SEQ ID NO: 342654 - RNA, 32 nt, Human
caagcugggcccaagcccagagccccugccug

SEQ ID NO: 342655 - RNA, 32 nt, Human
caagcuggggaauagcaacucagucccugccc

SEQ ID NO: 342656 - RNA, 32 nt, Human
caagcuggggacccacccuccuucccuuucug

SEQ ID NO: 342657 - RNA, 32 nt, Human
caagcuggguuauguuggcacacaggcaguag

SEQ ID NO: 342658 - RNA, 32 nt, Human
caagcuggguuugcacaucugucugcaggcug

SEQ ID NO: 342659 - RNA, 32 nt, Human
caagcuggucucaaacuccuagucuuaagcaa

SEQ ID NO: 342660 - RNA, 32 nt, Human
caagcuggucucaaacuccugaccucagguaa

SEQ ID NO: 342661 - RNA, 32 nt, Human
caagcuggucucaaacuccugaccucagguga

SEQ ID NO: 342662 - RNA, 32 nt, Human
caagcuggucucaaacuccuggccucaagcag

SEQ ID NO: 342663 - RNA, 32 nt, Human
caagcuggucucaaacuccuggguucaagcca

SEQ ID NO: 342664 - RNA, 32 nt, Human
caagcuggucucaagcuccugggcucaagcaa

SEQ ID NO: 342665 - RNA, 32 nt, Human
caagcuguccgagcuggaggccgcccugcagc

SEQ ID NO: 342666 - RNA, 32 nt, Human
caagcugugaaagaaaauggcuggaggugugc

SEQ ID NO: 342667 - RNA, 32 nt, Human
caagcugugggggaagaagugggaccuucgga

SEQ ID NO: 342668 - RNA, 32 nt, Human
caagcuucagagagaauagacugugaauguua

SEQ ID NO: 342669 - RNA, 19 nt, Human
caagcuuccggagcugggg

SEQ ID NO: 342670 - RNA, 32 nt, Human
caagcuucgccaugcagagcacugaccuaggc

SEQ ID NO: 342671 - RNA, 32 nt, Human
caagcuucuaccuguaccuuauguaagguaga

SEQ ID NO: 342672 - RNA, 32 nt, Human
caagcuucuaggacaagagccaggaagaaacc

SEQ ID NO: 342673 - RNA, 32 nt, Human
caagcuucuuggaggaggcagggagaccgugg

SEQ ID NO: 342674 - RNA, 32 nt, Human
caagcuugagacacaggagagcccauggugug

SEQ ID NO: 342675 - RNA, 32 nt, Human
caagcuugcaaguguauuuuguguacauuuua

SEQ ID NO: 342676 - RNA, 32 nt, Human
caagcuuggcauugacaugugcugcuaguuua

SEQ ID NO: 342677 - RNA, 32 nt, Human
caagcuuggcugcuuuccuagauccacacuuu

SEQ ID NO: 342678 - RNA, 32 nt, Human
caagcuugggagccagccugccaacagccacc

SEQ ID NO: 342679 - RNA, 32 nt, Human
caagcuugggagccagccugccaagagccgcc

SEQ ID NO: 342680 - RNA, 32 nt, Human
caagcuugggcaacacagugagauccugucua

SEQ ID NO: 342681 - RNA, 23 nt, Human
caagcuuggucaaacuuuuccca

SEQ ID NO: 342682 - RNA, 32 nt, Human
caagcuugguggaucgcuugagcccagcgguu

SEQ ID NO: 342683 - RNA, 32 nt, Human
caagcuuuacaauaaucgccaagcagaagcuu

SEQ ID NO: 342684 - RNA, 32 nt, Human
caagcuuucagaugaggccacaauccuagcca

SEQ ID NO: 342685 - RNA, 32 nt, Human
caagcuuuugggaucgggggaauaagagggua

SEQ ID NO: 342686 - RNA, 32 nt, Human
caaggaaaacucaggaccaugauggcucaguu

SEQ ID NO: 342687 - RNA, 32 nt, Human
caaggaaaagcuacacaaaaagccuggaucac

SEQ ID NO: 342688 - RNA, 19 nt, Human
caaggaaaccgcuggcaga

SEQ ID NO: 342689 - RNA, 19 nt, Human
caaggaaaccugggcccuc

SEQ ID NO: 342690 - RNA, 32 nt, Human
caaggaaagaguacugugugcugagagaccau

SEQ ID NO: 342691 - RNA, 17 nt, Human
caaggaaagcuggcaaa

SEQ ID NO: 342692 - RNA, 32 nt, Human
caaggaaaucaagaugaaaagcacucauuaag

SEQ ID NO: 342693 - RNA, 32 nt, Human
caaggaaaucugugucaguggaugcugcucug

SEQ ID NO: 342694 - RNA, 32 nt, Human
caaggaaaugcagagacagggaaggagcaucu

SEQ ID NO: 342695 - RNA, 32 nt, Human
caaggaaauggccaguuaaguagugucuucuc

SEQ ID NO: 342696 - RNA, 32 nt, Human
caaggaaaugguccuggacaucaaagaucuga

SEQ ID NO: 342697 - RNA, 32 nt, Human
caaggaacaagacugaauagcucagcagcucc

SEQ ID NO: 342698 - RNA, 32 nt, Human
caaggaacaauccaaugucuccuacuccugcc

SEQ ID NO: 342699 - RNA, 18 nt, Human
caaggaacacuuggcaaa

SEQ ID NO: 342700 - RNA, 32 nt, Human
caaggaacaucaagaagaaccggggccuguac

SEQ ID NO: 342701 - RNA, 32 nt, Human
caaggaaccaacaccgaugacauggacucagg

SEQ ID NO: 342702 - RNA, 32 nt, Human
caaggaacuacauuccagauuuaaagaaauga

SEQ ID NO: 342703 - RNA, 32 nt, Human
caaggaacugaacucagccuccaugagcucug

SEQ ID NO: 342704 - RNA, 22 nt, Human
caaggaacuggacauuaccuca

SEQ ID NO: 342705 - RNA, 32 nt, Human
caaggaacuggaggagaagacagccacgcuca

SEQ ID NO: 342706 - RNA, 32 nt, Human
caaggaagaaaggaaggaaggaaggcgagaga

SEQ ID NO: 342707 - RNA, 32 nt, Human
caaggaagagaguaugggaagaaggaggaaug

SEQ ID NO: 342708 - RNA, 32 nt, Human
caaggaagaggaagaggaggagaggccgggga

SEQ ID NO: 342709 - RNA, 32 nt, Human
caaggaagaggaguuggccaacaggcagcagg

SEQ ID NO: 342710 - RNA, 32 nt, Human
caaggaagagucauucacauggaagguccggg

SEQ ID NO: 342711 - RNA, 32 nt, Human
caaggaagagugauuucucuaugucuaguaag

SEQ ID NO: 342712 - RNA, 32 nt, Human
caaggaagcccaaguaggagauuugggaaaca

SEQ ID NO: 342713 - RNA, 32 nt, Human
caaggaagcugccugaauuugccuguauacuc

SEQ ID NO: 342714 - RNA, 32 nt, Human
caaggaaggaaugccauccaccaggagcaguc

SEQ ID NO: 342715 - RNA, 32 nt, Human
caaggaaggagaggaagaggacacucuuauuu

SEQ ID NO: 342716 - RNA, 32 nt, Human
caaggaaggaggauugcuugagcucaggaguu

SEQ ID NO: 342717 - RNA, 32 nt, Human
caaggaaggaguagaauaaggagcaggcagag

SEQ ID NO: 342718 - RNA, 32 nt, Human
caaggaaggcagggugguuggaacagaacaag

SEQ ID NO: 342719 - RNA, 32 nt, Human
caaggaaggcauuuggaccccugccuuuucau

SEQ ID NO: 342720 - RNA, 32 nt, Human
caaggaaggcugggcugcucagucccuucaug

SEQ ID NO: 342721 - RNA, 32 nt, Human
caaggaagggaagccgggggagaggggccagg

SEQ ID NO: 342722 - RNA, 32 nt, Human
caaggaaggggccugguggugcuccacuugca

SEQ ID NO: 342723 - RNA, 32 nt, Human
caaggaaguagcugccccaguguaugucuugc

SEQ ID NO: 342724 - RNA, 32 nt, Human
caaggaagucugcugcuccccgcagcugcgga

SEQ ID NO: 342725 - RNA, 32 nt, Human
caaggaagucugugucuaccagaagccagaau

SEQ ID NO: 342726 - RNA, 32 nt, Human
caaggaauacaaaaaugauuaagacuucuucc

SEQ ID NO: 342727 - RNA, 32 nt, Human
caaggaauacaucagcuuauugccuggcaugg

SEQ ID NO: 342728 - RNA, 19 nt, Human
caaggaauacguuccccca

SEQ ID NO: 342729 - RNA, 32 nt, Human
caaggaaugaggaagaucagggacaaccuggg

SEQ ID NO: 342730 - RNA, 31 nt, Human
caaggaaugggaggccuuucacuggguccag

SEQ ID NO: 342731 - RNA, 32 nt, Human
caaggaauucuuccaucuccuucuaaagcccc

SEQ ID NO: 342732 - RNA, 32 nt, Human
caaggaauuucgagguagaacaauacaccaaa

SEQ ID NO: 342733 - RNA, 32 nt, Human
caaggacaaagucuccagcccacguucucucu

SEQ ID NO: 342734 - RNA, 21 nt, Human
caaggacaacugacuccccca

SEQ ID NO: 342735 - RNA, 32 nt, Human
caaggacaagcuucucauuauggcaggcauaa

SEQ ID NO: 342736 - RNA, 32 nt, Human
caaggacaagggcaucgcgcccauauuccucc

SEQ ID NO: 342737 - RNA, 32 nt, Human
caaggacaaggucagguugaaugaguaggagg

SEQ ID NO: 342738 - RNA, 21 nt, Human
caaggacaaugaauccacuca

SEQ ID NO: 342739 - RNA, 32 nt, Human
caaggacacacagcaaguuauggcugcaccag

SEQ ID NO: 342740 - RNA, 22 nt, Human
caaggacacagacauucccuca

SEQ ID NO: 342741 - RNA, 22 nt, Human
caaggacacagcugcuccccuc

SEQ ID NO: 342742 - RNA, 20 nt, Human
caaggacacagguuccccca

SEQ ID NO: 342743 - RNA, 32 nt, Human
caaggacaccaggagcccccaaggaguuggaa

SEQ ID NO: 342744 - RNA, 17 nt, Human
caaggacacccucccuc

SEQ ID NO: 342745 - RNA, 19 nt, Human
caaggacacccucccugca

SEQ ID NO: 342746 - RNA, 20 nt, Human
caaggacacgcgccccccuc

SEQ ID NO: 342747 - RNA, 19 nt, Human
caaggacacgcucucccca

SEQ ID NO: 342748 - RNA, 32 nt, Human
caaggacacuccugaggucuuuguucucacug

SEQ ID NO: 342749 - RNA, 32 nt, Human
caaggacagaacagcaauuuccagggagcguc

SEQ ID NO: 342750 - RNA, 32 nt, Human
caaggacaggcagaagccggacaggggcccuu

SEQ ID NO: 342751 - RNA, 31 nt, Human
caaggacaguggcuuccuugccaagggcugu

SEQ ID NO: 342752 - RNA, 32 nt, Human
caaggacauggugagucuauuuuuaaugcacc

SEQ ID NO: 342753 - RNA, 32 nt, Human
caaggacauuggagagauagagucacuauuac

SEQ ID NO: 342754 - RNA, 32 nt, Human
caaggaccaaauccuggaguucucccaacuuu

SEQ ID NO: 342755 - RNA, 32 nt, Human
caaggaccaagaaggggacaguauccugaucu

SEQ ID NO: 342756 - RNA, 32 nt, Human
caaggaccacgggaggagguguaggagagaag

SEQ ID NO: 342757 - RNA, 32 nt, Human
caaggaccagcuggguccccuuugcuuucuug

SEQ ID NO: 342758 - RNA, 32 nt, Human
caaggaccagugccaccuuauggcaaagagcu

SEQ ID NO: 342759 - RNA, 32 nt, Human
caaggaccaucccaacucaggaugaacccucc

SEQ ID NO: 342760 - RNA, 32 nt, Human
caaggacccacuguucuucaucagugacccag

SEQ ID NO: 342761 - RNA, 32 nt, Human
caaggacccacuguucuuccucagugacccag

SEQ ID NO: 342762 - RNA, 32 nt, Human
caaggacccagccaucaaaaccagccucaaau

SEQ ID NO: 342763 - RNA, 32 nt, Human
caaggacccagccuuuguucugcacuuaauaa

SEQ ID NO: 342764 - RNA, 32 nt, Human
caaggacccccaaacucugcuccgugcacguc

SEQ ID NO: 342765 - RNA, 32 nt, Human
caaggacccccagcucucacugggcucugugg

SEQ ID NO: 342766 - RNA, 32 nt, Human
caaggaccgcgccgaaggaggugcccacugga

SEQ ID NO: 342767 - RNA, 32 nt, Human
caaggaccuaggcgucucuaagucuuaguuuc

SEQ ID NO: 342768 - RNA, 18 nt, Human
caaggaccucacaugcca

SEQ ID NO: 342769 - RNA, 32 nt, Human
caaggaccugggccucccagcccagcccagcc

SEQ ID NO: 342770 - RNA, 32 nt, Human
caaggacggacgggagcuccacugugaaucgg

SEQ ID NO: 342771 - RNA, 32 nt, Human
caaggacgggucaggaaggaaggagaggcuuu

SEQ ID NO: 342772 - RNA, 32 nt, Human
caaggacuagauuccuccucaaaccaguugua

SEQ ID NO: 342773 - RNA, 32 nt, Human
caaggacuagggucagggucucuggcucucag

SEQ ID NO: 342774 - RNA, 32 nt, Human
caaggacucaggucuaggucccuucccagaag

SEQ ID NO: 342775 - RNA, 32 nt, Human
caaggacucgguggucaugcugcuccaccacg

SEQ ID NO: 342776 - RNA, 32 nt, Human
caaggacugcacuaguccagggaguaggggac

SEQ ID NO: 342777 - RNA, 32 nt, Human
caaggacugcagcuucgccuauggcaguggca

SEQ ID NO: 342778 - RNA, 32 nt, Human
caaggacugccucaggugacgggccgugagag

SEQ ID NO: 342779 - RNA, 32 nt, Human
caaggacugccucugacccucccccugccuuc

SEQ ID NO: 342780 - RNA, 32 nt, Human
caaggacugcugggaccuucaacccugaucuu

SEQ ID NO: 342781 - RNA, 32 nt, Human
caaggacuggacuccaugccgaagguaucugg

SEQ ID NO: 342782 - RNA, 32 nt, Human
caaggacuggacuuagcucccuaggugccaca

SEQ ID NO: 342783 - RNA, 32 nt, Human
caaggacuggccccagcauggauaacagguag

SEQ ID NO: 342784 - RNA, 19 nt, Human
caaggacugggcuggcaaa

SEQ ID NO: 342785 - RNA, 32 nt, Human
caaggacugucaggcuggacaaaaauaacugc

SEQ ID NO: 342786 - RNA, 32 nt, Human
caaggacuguccaaaagccagccaguucaggg

SEQ ID NO: 342787 - RNA, 32 nt, Human
caaggacuucuaacaauaaacucucuuuugca

SEQ ID NO: 342788 - RNA, 32 nt, Human
caaggacuugugcugaagacucacaggugcag

SEQ ID NO: 342789 - RNA, 32 nt, Human
caaggacuuuguacauuugggaguuuuuauga

SEQ ID NO: 342790 - RNA, 32 nt, Human
caaggagaaaaaugggaagaaccaguuuuauc

SEQ ID NO: 342791 - RNA, 20 nt, Human
caaggagaaaacauucccuc

SEQ ID NO: 342792 - RNA, 32 nt, Human
caaggagaaaccuggcagauaccaccuuaacc

SEQ ID NO: 342793 - RNA, 32 nt, Human
caaggagaaagaggagagacagcagugcuggg

SEQ ID NO: 342794 - RNA, 32 nt, Human
caaggagaagaaaagagugacuagaagacucc

SEQ ID NO: 342795 - RNA, 32 nt, Human
caaggagaagaggaagggaggaagggaacaga

SEQ ID NO: 342796 - RNA, 32 nt, Human
caaggagaaggagguuuauucauaccccugaa

SEQ ID NO: 342797 - RNA, 32 nt, Human
caaggagaagguggagugagggcuggggucgg

SEQ ID NO: 342798 - RNA, 32 nt, Human
caaggagacaguggcauggagcuuugaaagac

SEQ ID NO: 342799 - RNA, 32 nt, Human
caaggagagacacuaucauucaucucuaccgg

SEQ ID NO: 342800 - RNA, 32 nt, Human
caaggagagagaaucacuugaggccaggaguu

SEQ ID NO: 342801 - RNA, 32 nt, Human
caaggagagaugaccucucauuuugccgagag

SEQ ID NO: 342802 - RNA, 32 nt, Human
caaggagauaaauguuguuuucaugcuuggua

SEQ ID NO: 342803 - RNA, 32 nt, Human
caaggagaugccacucugcucugccuuacugu

SEQ ID NO: 342804 - RNA, 32 nt, Human
caaggagauggccaugcuuaagccagcaauug

SEQ ID NO: 342805 - RNA, 32 nt, Human
caaggagcaaaguccuaucacagcgggagggg

SEQ ID NO: 342806 - RNA, 32 nt, Human
caaggagcagggagacaggaggcagagaagag

SEQ ID NO: 342807 - RNA, 32 nt, Human
caaggagccaugagucuuaggcuugacacuag

SEQ ID NO: 342808 - RNA, 32 nt, Human
caaggagcccaggcccccucccugccuccucc

SEQ ID NO: 342809 - RNA, 32 nt, Human
caaggagccccgcggcggccugggcagcgccu

SEQ ID NO: 342810 - RNA, 32 nt, Human
caaggagccuccagaaggaaaggaggaagaaa

SEQ ID NO: 342811 - RNA, 32 nt, Human
caaggagcuacacucccacuucuucagcuugg

SEQ ID NO: 342812 - RNA, 32 nt, Human
caaggagcuaugaacauagaaacccuauacau

SEQ ID NO: 342813 - RNA, 32 nt, Human
caaggagcucaaccucccugugccucaauuuc

SEQ ID NO: 342814 - RNA, 32 nt, Human
caaggagcucacuuggccugcuugcccugccc

SEQ ID NO: 342815 - RNA, 32 nt, Human
caaggagcugcacuccgaggccuugggccaaa

SEQ ID NO: 342816 - RNA, 32 nt, Human
caaggagcugggacucacaggagugugggcac

SEQ ID NO: 342817 - RNA, 22 nt, Human
caaggagcugggauuacaggca

SEQ ID NO: 342818 - RNA, 32 nt, Human
caaggagcuuuuccacaccugccaugcagcug

SEQ ID NO: 342819 - RNA, 32 nt, Human
caaggagcuuuucccccuuuugcucaggacuc

SEQ ID NO: 342820 - RNA, 26 nt, Human
caaggaggaagagaccaagaaauaaa

SEQ ID NO: 342821 - RNA, 32 nt, Human
caaggaggagagaagagaagggaagccccgag

SEQ ID NO: 342822 - RNA, 32 nt, Human
caaggaggaggcugaaagagccugagcugugc

SEQ ID NO: 342823 - RNA, 32 nt, Human
caaggaggaggcugccaaagaaaacaaaggcc

SEQ ID NO: 342824 - RNA, 32 nt, Human
caaggaggaugagcugcugucccuggaagaga

SEQ ID NO: 342825 - RNA, 32 nt, Human
caaggaggauuaugugugacuggguggccugg

SEQ ID NO: 342826 - RNA, 32 nt, Human
caaggaggcccaggaguagaggcugcagcgcc

SEQ ID NO: 342827 - RNA, 32 nt, Human
caaggaggcccagguguggccucacagaaaac

SEQ ID NO: 342828 - RNA, 32 nt, Human
caaggaggcugugcagcccgaggcucucaaag

SEQ ID NO: 342829 - RNA, 32 nt, Human
caaggagggaaacccaguucuguggggaaggu

SEQ ID NO: 342830 - RNA, 32 nt, Human
caaggagggaggaucacuugaacucaggaauu

SEQ ID NO: 342831 - RNA, 32 nt, Human
caaggagggaggaucacuugagccugggaguu

SEQ ID NO: 342832 - RNA, 32 nt, Human
caaggagggaggaucgcuuaagcccaggaauu

SEQ ID NO: 342833 - RNA, 32 nt, Human
caaggagggcagaucacuucaggucaggaguu

SEQ ID NO: 342834 - RNA, 32 nt, Human
caaggagggcccugcugcuggcuguccuggcc

SEQ ID NO: 342835 - RNA, 32 nt, Human
caaggagggcccuguuagcucccacuguccug

SEQ ID NO: 342836 - RNA, 32 nt, Human
caaggaggggcuuuugcugugcuaauuaggau

SEQ ID NO: 342837 - RNA, 32 nt, Human
caaggaggguccuacagacaagguggcaucuc

SEQ ID NO: 342838 - RNA, 32 nt, Human
caaggaggguggaucacuuaaggucaggaguu

SEQ ID NO: 342839 - RNA, 32 nt, Human
caaggaggguggaucacuugagaucaggaguu

SEQ ID NO: 342840 - RNA, 32 nt, Human
caaggaggguggaucacuugaggucaggaguu

SEQ ID NO: 342841 - RNA, 32 nt, Human
caaggagguaggaagagagggaggaggaaagg

SEQ ID NO: 342842 - RNA, 32 nt, Human
caaggaggugcagguaaagggugcagugcagc

SEQ ID NO: 342843 - RNA, 32 nt, Human
caaggagguugacuugccucucgggccccgua

SEQ ID NO: 342844 - RNA, 32 nt, Human
caaggaguagggcggcugccagcugggccggg

SEQ ID NO: 342845 - RNA, 32 nt, Human
caaggaguauauggacacuacacuggggcccu

SEQ ID NO: 342846 - RNA, 32 nt, Human
caaggaguauuuucuggguggaucucccauac

SEQ ID NO: 342847 - RNA, 24 nt, Human
caaggagucaaauuuauuuuccca

SEQ ID NO: 342848 - RNA, 32 nt, Human
caaggagucacugagaccaaggcuuucucuac

SEQ ID NO: 342849 - RNA, 32 nt, Human
caaggagucauuaacuuccucccucuaugccc

SEQ ID NO: 342850 - RNA, 32 nt, Human
caaggagucugcaugucuaagugcuagacaug

SEQ ID NO: 342851 - RNA, 32 nt, Human
caaggaguugccugggugcuggcuggucacug

SEQ ID NO: 342852 - RNA, 32 nt, Human
caaggaguuggguuuggaucaaaaguguuuaa

SEQ ID NO: 342853 - RNA, 32 nt, Human
caaggauaacaaccaacauuuucagagcacuu

SEQ ID NO: 342854 - RNA, 32 nt, Human
caaggauaagcagaguugauccaucugagaaa

SEQ ID NO: 342855 - RNA, 32 nt, Human
caaggauacaucagagaauuccugccucaucu

SEQ ID NO: 342856 - RNA, 32 nt, Human
caaggauauagguuuuucucauguaucuuuuu

SEQ ID NO: 342857 - RNA, 32 nt, Human
caaggaucaagaaaauuucuuucuucaugacc

SEQ ID NO: 342858 - RNA, 32 nt, Human
caaggaucaucagcaaucagcaaaucauuaau

SEQ ID NO: 342859 - RNA, 32 nt, Human
caaggauccaaagugccccaccaggggacagc

SEQ ID NO: 342860 - RNA, 32 nt, Human
caaggauccugagucuccuucagccuaacagc

SEQ ID NO: 342861 - RNA, 32 nt, Human
caaggaugaaugaaaauguauagcaucugccc

SEQ ID NO: 342862 - RNA, 32 nt, Human
caaggaugagcagcaugaagaugucagaucag

SEQ ID NO: 342863 - RNA, 32 nt, Human
caaggaugagccugaucuggggagagggccgg

SEQ ID NO: 342864 - RNA, 32 nt, Human
caaggaugauauguacucccaccccagagugc

SEQ ID NO: 342865 - RNA, 32 nt, Human
caaggaugccuacucuaaccaugccuauccaa

SEQ ID NO: 342866 - RNA, 32 nt, Human
caaggauggagaaagggagacagcuugcagau

SEQ ID NO: 342867 - RNA, 32 nt, Human
caaggauggagcaaaugucaacaggcacagau

SEQ ID NO: 342868 - RNA, 29 nt, Human
caaggauggcugcuaucaauucuuccuuu

SEQ ID NO: 342869 - RNA, 32 nt, Human
caaggauggucagcaaagccagcaaccuugaa

SEQ ID NO: 342870 - RNA, 32 nt, Human
caaggauggugcuaggucauucauggcuggcc

SEQ ID NO: 342871 - RNA, 32 nt, Human
caaggauguacauuuuaugaagaauuacaauc

SEQ ID NO: 342872 - RNA, 32 nt, Human
caaggaugugggguuuaaauggguuagugcac

SEQ ID NO: 342873 - RNA, 32 nt, Human
caaggauguuguagagcugccauaccaguccu

SEQ ID NO: 342874 - RNA, 32 nt, Human
caaggauguuuggucuuuaaugaaaagcugaa

SEQ ID NO: 342875 - RNA, 32 nt, Human
caaggauuagaagaaaagcagcaacacugaua

SEQ ID NO: 342876 - RNA, 32 nt, Human
caaggcaaaagaaucacuugagcccaggaguu

SEQ ID NO: 342877 - RNA, 21 nt, Human
caaggcaaagaucugcucacu

SEQ ID NO: 342878 - RNA, 32 nt, Human
caaggcaacacuuaucuuccacaggguaacag

SEQ ID NO: 342879 - RNA, 32 nt, Human
caaggcaaccagacacauccaugggugucaca

SEQ ID NO: 342880 - RNA, 32 nt, Human
caaggcaacuccccuucuccaagucacuuaca

SEQ ID NO: 342881 - RNA, 17 nt, Human
caaggcaagaaacugcu

SEQ ID NO: 342882 - RNA, 32 nt, Human
caaggcaagaggaucacuugagcccaggcguu

SEQ ID NO: 342883 - RNA, 32 nt, Human
caaggcaagaggcagagaugaugauuccauuu

SEQ ID NO: 342884 - RNA, 32 nt, Human
caaggcaagagguggaaggguacugacugggu

SEQ ID NO: 342885 - RNA, 32 nt, Human
caaggcaagcaaaucacuugagcucaggaguu

SEQ ID NO: 342886 - RNA, 24 nt, Human
caaggcaaggagcauccaugcacc

SEQ ID NO: 342887 - RNA, 32 nt, Human
caaggcaaggauuugccaaaaauguucugggg

SEQ ID NO: 342888 - RNA, 32 nt, Human
caaggcaagggcccugcucaccccaagguagg

SEQ ID NO: 342889 - RNA, 32 nt, Human
caaggcaaggggaucacuugagcccaggaguc

SEQ ID NO: 342890 - RNA, 32 nt, Human
caaggcaaguggaucacuucaggucaggaguu

SEQ ID NO: 342891 - RNA, 32 nt, Human
caaggcaauaacauauucagcaaugcaggucu

SEQ ID NO: 342892 - RNA, 32 nt, Human
caaggcaaugaccagaaugauaugcuuccugc

SEQ ID NO: 342893 - RNA, 22 nt, Human
caaggcacacauauauuggaaa

SEQ ID NO: 342894 - RNA, 32 nt, Human
caaggcacacauauauuggaaagaucauguug

SEQ ID NO: 342895 - RNA, 22 nt, Human
caaggcacagcgccuguuggaa

SEQ ID NO: 342896 - RNA, 18 nt, Human
caaggcacauuuggcaaa

SEQ ID NO: 342897 - RNA, 32 nt, Human
caaggcacccaggauugauugcaggaauaucu

SEQ ID NO: 342898 - RNA, 22 nt, Human
caaggcacccccugaccugccu

SEQ ID NO: 342899 - RNA, 32 nt, Human
caaggcaccgggcccuuucgcucugcagaacu

SEQ ID NO: 342900 - RNA, 32 nt, Human
caaggcaccugaggccauggcacucccagagg

SEQ ID NO: 342901 - RNA, 18 nt, Human
caaggcaccugcuggcaa

SEQ ID NO: 342902 - RNA, 23 nt, Human
caaggcacgcgcuccugacagcc

SEQ ID NO: 342903 - RNA, 32 nt, Human
caaggcacugagaccuccacccacuguggacu

SEQ ID NO: 342904 - RNA, 32 nt, Human
caaggcacugccugauggaccugucacgauug

SEQ ID NO: 342905 - RNA, 32 nt, Human
caaggcacuuacugcugccaggccggccagga

SEQ ID NO: 342906 - RNA, 32 nt, Human
caaggcagaagcagcaggggauggcgugguca

SEQ ID NO: 342907 - RNA, 32 nt, Human
caaggcagaaggaucacuugaacccaggaguu

SEQ ID NO: 342908 - RNA, 32 nt, Human
caaggcagaaggaucacuugagaccaggaguu

SEQ ID NO: 342909 - RNA, 32 nt, Human
caaggcagaaggaucacuugagcccaggaauu

SEQ ID NO: 342910 - RNA, 32 nt, Human
caaggcagaccgggacugggaagcugcccgga

SEQ ID NO: 342911 - RNA, 32 nt, Human
caaggcagagcugaggggacagggaggagcag

SEQ ID NO: 342912 - RNA, 32 nt, Human
caaggcagauggaacacuugaggucaggaguu

SEQ ID NO: 342913 - RNA, 32 nt, Human
caaggcagauggaucaugaggucagggguuca

SEQ ID NO: 342914 - RNA, 32 nt, Human
caaggcagcagaaaggagucacccagccaaag

SEQ ID NO: 342915 - RNA, 32 nt, Human
caaggcagccaagaacugccauaaacacuaca

SEQ ID NO: 342916 - RNA, 32 nt, Human
caaggcagccccuuccuuccagccugggcucu

SEQ ID NO: 342917 - RNA, 32 nt, Human
caaggcagcucacagcgggaaaacucugggac

SEQ ID NO: 342918 - RNA, 32 nt, Human
caaggcagcugggccagaucucaggccagccg

SEQ ID NO: 342919 - RNA, 32 nt, Human
caaggcagcuuccugauaauaaggcuguagga

SEQ ID NO: 342920 - RNA, 32 nt, Human
caaggcaggaagagaauugggcaucggguacg

SEQ ID NO: 342921 - RNA, 32 nt, Human
caaggcaggaagaucccuggagcucaggaguu

SEQ ID NO: 342922 - RNA, 24 nt, Human
caaggcaggaaggagacagacagc

SEQ ID NO: 342923 - RNA, 32 nt, Human
caaggcaggaaggggguggugccugcuggggc

SEQ ID NO: 342924 - RNA, 21 nt, Human
caaggcaggaaugagaaagca

SEQ ID NO: 342925 - RNA, 32 nt, Human
caaggcaggaggaguuaaaaccagcuuccugg

SEQ ID NO: 342926 - RNA, 32 nt, Human
caaggcaggaggaucacuugaaccuaggaguu

SEQ ID NO: 342927 - RNA, 32 nt, Human
caaggcaggaggaucacuugagccugggaguu

SEQ ID NO: 342928 - RNA, 32 nt, Human
caaggcaggaggaucacuugaggccagugagc

SEQ ID NO: 342929 - RNA, 32 nt, Human
caaggcaggaggaucacuugaggcuaggaguu

SEQ ID NO: 342930 - RNA, 32 nt, Human
caaggcaggaggaucacuuggagccaggaguu

SEQ ID NO: 342931 - RNA, 32 nt, Human
caaggcaggaggaucacuuuagcccaggaggu

SEQ ID NO: 342932 - RNA, 32 nt, Human
caaggcaggaggaucgcuggagcccaguaggu

SEQ ID NO: 342933 - RNA, 32 nt, Human
caaggcaggaggaucgcuugagcccaggaguu

SEQ ID NO: 342934 - RNA, 32 nt, Human
caaggcaggaggaucgcuugaggucagaaguu

SEQ ID NO: 342935 - RNA, 32 nt, Human
caaggcaggaggaucgcuugaggucaggaguu

SEQ ID NO: 342936 - RNA, 32 nt, Human
caaggcaggaggaucguuugaggccaggaggu

SEQ ID NO: 342937 - RNA, 32 nt, Human
caaggcaggaggaucucuugagcccaggaguu

SEQ ID NO: 342938 - RNA, 32 nt, Human
caaggcaggaggaucucuugaggccaggaguu

SEQ ID NO: 342939 - RNA, 32 nt, Human
caaggcaggaggauggcuugagcucaguaguu

SEQ ID NO: 342940 - RNA, 32 nt, Human
caaggcaggcagaucacuugaggucaggacuu

SEQ ID NO: 342941 - RNA, 32 nt, Human
caaggcaggcagaucacuugaggucaggaguu

SEQ ID NO: 342942 - RNA, 32 nt, Human
caaggcaggcagaucacuugaggucgggcguu

SEQ ID NO: 342943 - RNA, 32 nt, Human
caaggcaggcagcaguggggcugugacaggaa

SEQ ID NO: 342944 - RNA, 32 nt, Human
caaggcaggcauaucacuugagccgaggcgga

SEQ ID NO: 342945 - RNA, 32 nt, Human
caaggcaggcggaucacuugaggccaggaguu

SEQ ID NO: 342946 - RNA, 32 nt, Human
caaggcaggcggaucacuugaggccagggguu

SEQ ID NO: 342947 - RNA, 32 nt, Human
caaggcaggcucucacaugccuggacgccugg

SEQ ID NO: 342948 - RNA, 32 nt, Human
caaggcaggcuggaggugccggugggccugug

SEQ ID NO: 342949 - RNA, 32 nt, Human
caaggcaggcuggaucaccugaggacaggagu

SEQ ID NO: 342950 - RNA, 32 nt, Human
caaggcagguagaucacuugaugccaggaguu

SEQ ID NO: 342951 - RNA, 32 nt, Human
caaggcaggugcaucacuugaggccaggaguu

SEQ ID NO: 342952 - RNA, 32 nt, Human
caaggcagguggaucacuuaagaucaggaguu

SEQ ID NO: 342953 - RNA, 32 nt, Human
caaggcagguggaucacuugaggucaggagcu

SEQ ID NO: 342954 - RNA, 32 nt, Human
caaggcagguggaucacuugggucgggaguuc

SEQ ID NO: 342955 - RNA, 32 nt, Human
caaggcagguggaucccuugagcccaggaguu

SEQ ID NO: 342956 - RNA, 32 nt, Human
caaggcagguggaucccuugagcucaggaguu

SEQ ID NO: 342957 - RNA, 32 nt, Human
caaggcagguggaucgcuugagcucaggaguu

SEQ ID NO: 342958 - RNA, 32 nt, Human
caaggcagguggaugacuugagcucaggaguu

SEQ ID NO: 342959 - RNA, 32 nt, Human
caaggcagguggauugcuugagcccaggaguu

SEQ ID NO: 342960 - RNA, 32 nt, Human
caaggcagugggggugaacauccagggccuac

SEQ ID NO: 342961 - RNA, 31 nt, Human
caaggcauaacuucccaacauuuaagaaacc

SEQ ID NO: 342962 - RNA, 32 nt, Human
caaggcauaguggcuuaugccuguaaucccgg

SEQ ID NO: 342963 - RNA, 32 nt, Human
caaggcaucccccagccccaagccugcgcgca

SEQ ID NO: 342964 - RNA, 32 nt, Human
caaggcauccucacaacaaagaagagauguga

SEQ ID NO: 342965 - RNA, 20 nt, Human
caaggcauccucccaccuca

SEQ ID NO: 342966 - RNA, 22 nt, Human
caaggcauggacccugacaccu

SEQ ID NO: 342967 - RNA, 32 nt, Human
caaggcauggcagacugagcuggaggaagaug

SEQ ID NO: 342968 - RNA, 32 nt, Human
caaggcauguacaaagcugaguaacugcaucu

SEQ ID NO: 342969 - RNA, 32 nt, Human
caaggccaaagccugcccugagcccagacaca

SEQ ID NO: 342970 - RNA, 32 nt, Human
caaggccaacagcugugcaaagccacaaguua

SEQ ID NO: 342971 - RNA, 22 nt, Human
caaggccaaccacaacacagaa

SEQ ID NO: 342972 - RNA, 24 nt, Human
caaggccaagauacgugcuuuuca

SEQ ID NO: 342973 - RNA, 32 nt, Human
caaggccacaaacuguucaacacacacaaagu

SEQ ID NO: 342974 - RNA, 32 nt, Human
caaggccacaaccuccauucucccagaaaaga

SEQ ID NO: 342975 - RNA, 32 nt, Human
caaggccacacagcuggcuugaacuucagcac

SEQ ID NO: 342976 - RNA, 32 nt, Human
caaggccacagaaagagccugauguccaugau

SEQ ID NO: 342977 - RNA, 32 nt, Human
caaggccacaugcagggaugcacccacaaugu

SEQ ID NO: 342978 - RNA, 32 nt, Human
caaggccacggcucuacuaaaagagagagagg

SEQ ID NO: 342979 - RNA, 32 nt, Human
caaggccacucggcuacucaggacagggcugg

SEQ ID NO: 342980 - RNA, 24 nt, Human
caaggccagaccaaggaggcagca

SEQ ID NO: 342981 - RNA, 32 nt, Human
caaggccagagcaggcucccucagcuugcagg

SEQ ID NO: 342982 - RNA, 32 nt, Human
caaggccagcagcugcaacaacugcugcaagc

SEQ ID NO: 342983 - RNA, 24 nt, Human
caaggccagccugggcaacauaga

SEQ ID NO: 342984 - RNA, 22 nt, Human
caaggccagccuuucuggcaaa

SEQ ID NO: 342985 - RNA, 32 nt, Human
caaggccaggaggaccaggggugcagacagaa

SEQ ID NO: 342986 - RNA, 32 nt, Human
caaggccaggaguucaagaccagccuggccaa

SEQ ID NO: 342987 - RNA, 32 nt, Human
caaggccaggcccccggcccaccagcuuucgg

SEQ ID NO: 342988 - RNA, 32 nt, Human
caaggccagucuccagaugaggggacuauagc

SEQ ID NO: 342989 - RNA, 22 nt, Human
caaggccauaaaaaacaaggaa

SEQ ID NO: 342990 - RNA, 22 nt, Human
caaggccaucaaagacaaggaa

SEQ ID NO: 342991 - RNA, 32 nt, Human
caaggccauccuggggaagggccggaagcuga

SEQ ID NO: 342992 - RNA, 32 nt, Human
caaggccauggaaguggaggcugcagaggccc

SEQ ID NO: 342993 - RNA, 32 nt, Human
caaggccaugggcauggaugugcugaacgagg

SEQ ID NO: 342994 - RNA, 32 nt, Human
caaggcccacuucuucucagaaaagaggccag

SEQ ID NO: 342995 - RNA, 32 nt, Human
caaggcccagcagagcugagaugugacugcag

SEQ ID NO: 342996 - RNA, 25 nt, Human
caaggcccagccaaaacaacacaga

SEQ ID NO: 342997 - RNA, 32 nt, Human
caaggcccagcccugggcaaggaagcuuugga

SEQ ID NO: 342998 - RNA, 32 nt, Human
caaggcccccgcgcucggcaagugagccuggc

SEQ ID NO: 342999 - RNA, 32 nt, Human
caaggccccugaccucagcucagcuuuuguag

SEQ ID NO: 343000 - RNA, 32 nt, Human
caaggcccgccccuuccuugugcucaaauggc

SEQ ID NO: 343001 - RNA, 32 nt, Human
caaggcccuagacugcaguaaaacccagaacu

SEQ ID NO: 343002 - RNA, 32 nt, Human
caaggcccucaagguggcccucagccaccacc

SEQ ID NO: 343003 - RNA, 32 nt, Human
caaggcccucagaagcagauuauuccuguuuu

SEQ ID NO: 343004 - RNA, 32 nt, Human
caaggcccugaaggagggccgugagccugacu

SEQ ID NO: 343005 - RNA, 32 nt, Human
caaggcccugacagcccugccuucugcccucu

SEQ ID NO: 343006 - RNA, 32 nt, Human
caaggcccugaccacuucugugccaguugucu

SEQ ID NO: 343007 - RNA, 32 nt, Human
caaggcccugcaggaacgcgccgaggucuccc

SEQ ID NO: 343008 - RNA, 32 nt, Human
caaggcccuggccgccaugguggaggaccuga

SEQ ID NO: 343009 - RNA, 32 nt, Human
caaggcccugggaggcaacaggcuagcccuua

SEQ ID NO: 343010 - RNA, 32 nt, Human
caaggccgagggccaggcagaauggcugcacg

SEQ ID NO: 343011 - RNA, 32 nt, Human
caaggccgagguagaagaaucgcuugagacua

SEQ ID NO: 343012 - RNA, 32 nt, Human
caaggccgcaagguggaggagcugcgguggca

SEQ ID NO: 343013 - RNA, 32 nt, Human
caaggccgcccaccugcaucagccucuggcca

SEQ ID NO: 343014 - RNA, 32 nt, Human
caaggccggagcagugccuggcaguuggccaa

SEQ ID NO: 343015 - RNA, 32 nt, Human
caaggccgggcgugcgugaggccagguccacg

SEQ ID NO: 343016 - RNA, 32 nt, Human
caaggccuacagagacagagcuauaggaaggc

SEQ ID NO: 343017 - RNA, 32 nt, Human
caaggccucacacgcagccacuucuucaagag

SEQ ID NO: 343018 - RNA, 32 nt, Human
caaggccucagaagaaaaguugucugggaaug

SEQ ID NO: 343019 - RNA, 32 nt, Human
caaggccuccaaugcucaccgaugcccucugc

SEQ ID NO: 343020 - RNA, 20 nt, Human
caaggccuccaauuggcaaa

SEQ ID NO: 343021 - RNA, 32 nt, Human
caaggccuccuggauccaaagcaccaugucag

SEQ ID NO: 343022 - RNA, 32 nt, Human
caaggccucucagacccagaugugacggggug

SEQ ID NO: 343023 - RNA, 32 nt, Human
caaggccucucagccuuacuccuggcuucaua

SEQ ID NO: 343024 - RNA, 32 nt, Human
caaggccucugccucucagccucuuccauggu

SEQ ID NO: 343025 - RNA, 25 nt, Human
caaggccucugcugccacugacagc

SEQ ID NO: 343026 - RNA, 32 nt, Human
caaggccugagaaaggaaaggaagggaaaggc

SEQ ID NO: 343027 - RNA, 32 nt, Human
caaggccugccgagcuguggccuucucugaag

SEQ ID NO: 343028 - RNA, 32 nt, Human
caaggccuguauugcagucuucauacaaaaca

SEQ ID NO: 343029 - RNA, 32 nt, Human
caaggccuuaucuucaccccacaaacaauaaa

SEQ ID NO: 343030 - RNA, 32 nt, Human
caaggccuucacugcagccccaucuccuccuc

SEQ ID NO: 343031 - RNA, 32 nt, Human
caaggccuuggauuucuggcucccagaccacc

SEQ ID NO: 343032 - RNA, 32 nt, Human
caaggccuuggggagcuuaggggaccuggugg

SEQ ID NO: 343033 - RNA, 32 nt, Human
caaggccuuuccagcauugcacaucuaugaua

SEQ ID NO: 343034 - RNA, 24 nt, Human
caaggcgaaacccugucucuacua

SEQ ID NO: 343035 - RNA, 32 nt, Human
caaggcgcaaauggcccuggcuucauuuauuc

SEQ ID NO: 343036 - RNA, 32 nt, Human
caaggcgcagcgggagcgcacaggugccccgc

SEQ ID NO: 343037 - RNA, 32 nt, Human
caaggcgccauuggcuuccugggacucugagu

SEQ ID NO: 343038 - RNA, 32 nt, Human
caaggcgcgucccccucggccucccagcgcuc

SEQ ID NO: 343039 - RNA, 32 nt, Human
caaggcggacagaucacuugagcucaggaguu

SEQ ID NO: 343040 - RNA, 32 nt, Human
caaggcggacggaucacuugagguuaggaguu

SEQ ID NO: 343041 - RNA, 21 nt, Human
caaggcggagcuugcagugag

SEQ ID NO: 343042 - RNA, 32 nt, Human
caaggcggaucugggcuuccacccucaugaac

SEQ ID NO: 343043 - RNA, 32 nt, Human
caaggcggauggaucacuugagcccaggaguu

SEQ ID NO: 343044 - RNA, 32 nt, Human
caaggcggcccagaggcugggcccugcacaua

SEQ ID NO: 343045 - RNA, 18 nt, Human
caaggcggcuauggcaga

SEQ ID NO: 343046 - RNA, 32 nt, Human
caaggcgggaggaucacuugaggucaggaguu

SEQ ID NO: 343047 - RNA, 32 nt, Human
caaggcgggaggaucgcuugagcccagagguu

SEQ ID NO: 343048 - RNA, 32 nt, Human
caaggcgggaggauggcuugagccugggaggu

SEQ ID NO: 343049 - RNA, 32 nt, Human
caaggcgggaggauugcuugagcccaggaguu

SEQ ID NO: 343050 - RNA, 32 nt, Human
caaggcgggaggguugcuugagcucaggaguu

SEQ ID NO: 343051 - RNA, 32 nt, Human
caaggcgggcagaucacuugagaucaggaguu

SEQ ID NO: 343052 - RNA, 32 nt, Human
caaggcgggcagaucacuugaggucaggaguu

SEQ ID NO: 343053 - RNA, 32 nt, Human
caaggcgggcagaucacuugaggucgggaguu

SEQ ID NO: 343054 - RNA, 32 nt, Human
caaggcgggcagaucgcuugagcucaacaguu

SEQ ID NO: 343055 - RNA, 32 nt, Human
caaggcgggcagauugccugaccucaggaguu

SEQ ID NO: 343056 - RNA, 32 nt, Human
caaggcgggcggaucacuuaaagucaggaguc

SEQ ID NO: 343057 - RNA, 32 nt, Human
caaggcgggcggaucacuugaggucaggaguu

SEQ ID NO: 343058 - RNA, 32 nt, Human
caaggcgggcggaucacuugcggucaggaguu

SEQ ID NO: 343059 - RNA, 32 nt, Human
caaggcgggcggauugccugagcucaggaguu

SEQ ID NO: 343060 - RNA, 32 nt, Human
caaggcggguagaucacuugaggucaggaguu

SEQ ID NO: 343061 - RNA, 32 nt, Human
caaggcggguggaacacuugaggucaggaguu

SEQ ID NO: 343062 - RNA, 27 nt, Human
caaggcggguggaucacuugagaccag

SEQ ID NO: 343063 - RNA, 32 nt, Human
caaggcggguggaucacuugaggccaggaguu

SEQ ID NO: 343064 - RNA, 32 nt, Human
caaggcggguggaucacuugaggucaggaguu

SEQ ID NO: 343065 - RNA, 32 nt, Human
caaggcggguggcucacuugaggcuaggaguu

SEQ ID NO: 343066 - RNA, 32 nt, Human
caaggcgguagucacuuccgcucugcagcuag

SEQ ID NO: 343067 - RNA, 32 nt, Human
caaggcgguucagcuaccagacugcacuauaa

SEQ ID NO: 343068 - RNA, 32 nt, Human
caaggcguagggcuggagggcaggggcgggcc

SEQ ID NO: 343069 - RNA, 32 nt, Human
caaggcgucaguagugggcacuggccuggggg

SEQ ID NO: 343070 - RNA, 32 nt, Human
caaggcuaaaccugccugugcucacacacgca

SEQ ID NO: 343071 - RNA, 32 nt, Human
caaggcuaaaggcagagccagauggagaagga

SEQ ID NO: 343072 - RNA, 32 nt, Human
caaggcuaacaucccacuuagccgcacccugc

SEQ ID NO: 343073 - RNA, 18 nt, Human
caaggcuacacugucaag

SEQ ID NO: 343074 - RNA, 19 nt, Human
caaggcuacagacauggug

SEQ ID NO: 343075 - RNA, 19 nt, Human
caaggcuacagcgaccgga

SEQ ID NO: 343076 - RNA, 18 nt, Human
caaggcuacagcgucgaa

SEQ ID NO: 343077 - RNA, 19 nt, Human
caaggcuacaguaaccaaa

SEQ ID NO: 343078 - RNA, 18 nt, Human
caaggcuaccaacugcaa

SEQ ID NO: 343079 - RNA, 17 nt, Human
caaggcuacgcugacaa

SEQ ID NO: 343080 - RNA, 18 nt, Human
caaggcuacuuuggugaa

SEQ ID NO: 343081 - RNA, 18 nt, Human
caaggcuagaaaacagca

SEQ ID NO: 343082 - RNA, 17 nt, Human
caaggcuaggucacaaa

SEQ ID NO: 343083 - RNA, 19 nt, Human
caaggcuaguugugacaga

SEQ ID NO: 343084 - RNA, 32 nt, Human
caaggcucaaggcuuccccagcaaagauuagg

SEQ ID NO: 343085 - RNA, 32 nt, Human
caaggcucaaugcuauucuaacuaaugacaag

SEQ ID NO: 343086 - RNA, 31 nt, Human
caaggcucaauuccgaacuguugaaggaaga

SEQ ID NO: 343087 - RNA, 32 nt, Human
caaggcucacugcaaccucaaccuucugguuu

SEQ ID NO: 343088 - RNA, 32 nt, Human
caaggcucacugcagccucaaccuucuggguu

SEQ ID NO: 343089 - RNA, 32 nt, Human
caaggcucacugcagccuggaccuccugguuc

SEQ ID NO: 343090 - RNA, 32 nt, Human
caaggcucagccaucugugccuuagggagcuc

SEQ ID NO: 343091 - RNA, 32 nt, Human
caaggcucccgccgcugcuccagcgcggcgca

SEQ ID NO: 343092 - RNA, 32 nt, Human
caaggcucccguacugucuguguccuuguaua

SEQ ID NO: 343093 - RNA, 32 nt, Human
caaggcucccuaaugcuggucucugcuccacu

SEQ ID NO: 343094 - RNA, 32 nt, Human
caaggcucccugccccuccucaugccccucug

SEQ ID NO: 343095 - RNA, 32 nt, Human
caaggcuccuugugggauuccucagcagcacc

SEQ ID NO: 343096 - RNA, 32 nt, Human
caaggcugacuacgagaggaggcuccagcacc

SEQ ID NO: 343097 - RNA, 17 nt, Human
caaggcugagcggcaga

SEQ ID NO: 343098 - RNA, 32 nt, Human
caaggcugaggcaggagaaucgcuugaaccug

SEQ ID NO: 343099 - RNA, 32 nt, Human
caaggcugaggcaggagaauugcuugagccca

SEQ ID NO: 343100 - RNA, 32 nt, Human
caaggcugaggcaggaggcucucuugagaaua

SEQ ID NO: 343101 - RNA, 17 nt, Human
caaggcugcaaagcaaa

SEQ ID NO: 343102 - RNA, 19 nt, Human
caaggcugcagccagcaaa

SEQ ID NO: 343103 - RNA, 16 nt, Human
caaggcugcagucaaa

SEQ ID NO: 343104 - RNA, 32 nt, Human
caaggcugcauuccaguaugguaucaaaaugu

SEQ ID NO: 343105 - RNA, 32 nt, Human
caaggcugcccagcuggugguguuaagccaga

SEQ ID NO: 343106 - RNA, 21 nt, Human
caaggcugcccccucagcaga

SEQ ID NO: 343107 - RNA, 32 nt, Human
caaggcugcugaggccuggucuccaguuggaa

SEQ ID NO: 343108 - RNA, 32 nt, Human
caaggcugcugccggaaucacuucuccaauca

SEQ ID NO: 343109 - RNA, 17 nt, Human
caaggcugcuggacaaa

SEQ ID NO: 343110 - RNA, 32 nt, Human
caaggcugcuugugcuaccaguuuguuggugg

SEQ ID NO: 343111 - RNA, 32 nt, Human
caaggcuggagagagaacaggaggugaaagaa

SEQ ID NO: 343112 - RNA, 32 nt, Human
caaggcuggagugcaguggaacgaucuuggcu

SEQ ID NO: 343113 - RNA, 32 nt, Human
caaggcuggagugcaguggugugaucucggcu

SEQ ID NO: 343114 - RNA, 19 nt, Human
caaggcuggcagugacaga

SEQ ID NO: 343115 - RNA, 32 nt, Human
caaggcuggccacacaccacuuuuacuggcca

SEQ ID NO: 343116 - RNA, 17 nt, Human
caaggcuggccagcaag

SEQ ID NO: 343117 - RNA, 29 nt, Human
caaggcuggcugcagcuggccuccgccgc

SEQ ID NO: 343118 - RNA, 32 nt, Human
caaggcugggauuacagguaugcaccaccacg

SEQ ID NO: 343119 - RNA, 19 nt, Human
caaggcugggcgggacaga

SEQ ID NO: 343120 - RNA, 32 nt, Human
caaggcugggcuggugaaaggaguucacucaa

SEQ ID NO: 343121 - RNA, 19 nt, Human
caaggcuggggcauggcaa

SEQ ID NO: 343122 - RNA, 32 nt, Human
caaggcuggggcuggagaaugagagacugcgc

SEQ ID NO: 343123 - RNA, 32 nt, Human
caaggcuggguguggaggcucacaccuguaau

SEQ ID NO: 343124 - RNA, 21 nt, Human
caaggcuggugccuggggcua

SEQ ID NO: 343125 - RNA, 17 nt, Human
caaggcugucguggcaa

SEQ ID NO: 343126 - RNA, 32 nt, Human
caaggcuguggaccauggaguggcagcccagc

SEQ ID NO: 343127 - RNA, 32 nt, Human
caaggcuguggagucccagagccagcaguuca

SEQ ID NO: 343128 - RNA, 19 nt, Human
caaggcuguggguccacca

SEQ ID NO: 343129 - RNA, 32 nt, Human
caaggcuguuuccaacucuccccauuuuccug

SEQ ID NO: 343130 - RNA, 32 nt, Human
caaggcuguuucugugugugaggaacuuugcc

SEQ ID NO: 343131 - RNA, 32 nt, Human
caaggcuuauucuucuacauccauagaugcuu

SEQ ID NO: 343132 - RNA, 32 nt, Human
caaggcuucaggaagggccagccacaugccau

SEQ ID NO: 343133 - RNA, 32 nt, Human
caaggcuugaaauccagcaggauggaggacuu

SEQ ID NO: 343134 - RNA, 32 nt, Human
caaggcuugccagagccaacaggaagugagcc

SEQ ID NO: 343135 - RNA, 32 nt, Human
caaggcuuggaaacuaugaggggcagggagga

SEQ ID NO: 343136 - RNA, 32 nt, Human
caaggcuuuaaagcugagagacccuggccuca

SEQ ID NO: 343137 - RNA, 32 nt, Human
caaggcuuucugugccaagaaucccaagugac

SEQ ID NO: 343138 - RNA, 32 nt, Human
caaggcuuucuugagccccgccccuuucuuuc

SEQ ID NO: 343139 - RNA, 32 nt, Human
caaggcuuugauaccugucacccaggguaucu

SEQ ID NO: 343140 - RNA, 32 nt, Human
caagggaaaaacaaaaaccccacaaaauaccc

SEQ ID NO: 343141 - RNA, 32 nt, Human
caagggaaaaccugcguuguaaacaugaggau

SEQ ID NO: 343142 - RNA, 32 nt, Human
caagggaaaagcaguuuucuguggggcuuauu

SEQ ID NO: 343143 - RNA, 32 nt, Human
caagggaaagagacuugcuggagcagcugccg

SEQ ID NO: 343144 - RNA, 32 nt, Human
caagggaaaguuucagcucacugugaagccag

SEQ ID NO: 343145 - RNA, 32 nt, Human
caagggaaaucaggaaaacuguccugauugaa

SEQ ID NO: 343146 - RNA, 32 nt, Human
caagggaacucauacugucuacacaucagacc

SEQ ID NO: 343147 - RNA, 32 nt, Human
caagggaacuguggggaugcacgaggaugccc

SEQ ID NO: 343148 - RNA, 32 nt, Human
caagggaaugcacagggcugcacagagugacu

SEQ ID NO: 343149 - RNA, 32 nt, Human
caagggacaaaccaaaucccaauugccuauag

SEQ ID NO: 343150 - RNA, 32 nt, Human
caagggacaagaggagcagaggacaggugaug

SEQ ID NO: 343151 - RNA, 32 nt, Human
caagggacagaggcggggguccuagcugacgg

SEQ ID NO: 343152 - RNA, 32 nt, Human
caagggacagcaagugagcagagauguacugc

SEQ ID NO: 343153 - RNA, 32 nt, Human
caagggaccaaggucugucaccaggagaucag

SEQ ID NO: 343154 - RNA, 17 nt, Human
caagggacccuggcaga

SEQ ID NO: 343155 - RNA, 32 nt, Human
caagggacccuuugccuuucuucugcccuuuc

SEQ ID NO: 343156 - RNA, 18 nt, Human
caagggacuccuggagcc

SEQ ID NO: 343157 - RNA, 32 nt, Human
caagggacugagugagccuuuugcaggaaaag

SEQ ID NO: 343158 - RNA, 32 nt, Human
caagggagaagagcugccaggagaagcaaggg

SEQ ID NO: 343159 - RNA, 32 nt, Human
caagggagcaggcaguccagagaacuggccuc

SEQ ID NO: 343160 - RNA, 32 nt, Human
caagggagcaggcugccuaaugaaggagccag

SEQ ID NO: 343161 - RNA, 32 nt, Human
caagggaggaaagaauucuggaaagaauucuu

SEQ ID NO: 343162 - RNA, 32 nt, Human
caagggaggaagcagagggaggcagaagcgug

SEQ ID NO: 343163 - RNA, 32 nt, Human
caagggaggaggaucacuugagcccaggaguu

SEQ ID NO: 343164 - RNA, 32 nt, Human
caagggagggccuggacugagggggaccaggu

SEQ ID NO: 343165 - RNA, 20 nt, Human
caagggagggguguuggaga

SEQ ID NO: 343166 - RNA, 24 nt, Human
caagggagugacagaaucuggaaa

SEQ ID NO: 343167 - RNA, 32 nt, Human
caagggauaggcucguuggugacauugugaau

SEQ ID NO: 343168 - RNA, 32 nt, Human
caagggaucuuucugccucagcuucccaaagu

SEQ ID NO: 343169 - RNA, 23 nt, Human
caagggaugcaccuucagucaaa

SEQ ID NO: 343170 - RNA, 32 nt, Human
caagggcaacauaguacuucuccuucacccau

SEQ ID NO: 343171 - RNA, 32 nt, Human
caagggcaagugcuagaguugcagugaauuua

SEQ ID NO: 343172 - RNA, 32 nt, Human
caagggcacacaaguucacacagcagagucag

SEQ ID NO: 343173 - RNA, 32 nt, Human
caagggcacagaaacagccaggccacaccaac

SEQ ID NO: 343174 - RNA, 32 nt, Human
caagggcacagcuguccguaucuccuuuggau

SEQ ID NO: 343175 - RNA, 32 nt, Human
caagggcagaagugagaaaaauaaccaucacc

SEQ ID NO: 343176 - RNA, 32 nt, Human
caagggcagaggugggagauugaugguucauu

SEQ ID NO: 343177 - RNA, 32 nt, Human
caagggcagcacccccagccuccaagggccgu

SEQ ID NO: 343178 - RNA, 32 nt, Human
caagggcagccaugcacucccccugggugucg

SEQ ID NO: 343179 - RNA, 32 nt, Human
caagggcagcccugggcucuggcuggggauga

SEQ ID NO: 343180 - RNA, 32 nt, Human
caagggcaggaagaggcgucucagggaacccc

SEQ ID NO: 343181 - RNA, 32 nt, Human
caagggcaggguggguccagccuugagccccu

SEQ ID NO: 343182 - RNA, 32 nt, Human
caagggcauccacuccaaugcccaccuaguac

SEQ ID NO: 343183 - RNA, 32 nt, Human
caagggcaugacagugcuggaggccgucuugg

SEQ ID NO: 343184 - RNA, 32 nt, Human
caagggccagccuggccaacauggugaaaccc

SEQ ID NO: 343185 - RNA, 32 nt, Human
caagggccaggccagagacccaggaaggcaga

SEQ ID NO: 343186 - RNA, 32 nt, Human
caagggccaggccagagacccaggaaggcagc

SEQ ID NO: 343187 - RNA, 32 nt, Human
caagggccauucaguacaucaggaaaguggca

SEQ ID NO: 343188 - RNA, 32 nt, Human
caagggcccaagcagaaguacacccacaagca

SEQ ID NO: 343189 - RNA, 24 nt, Human
caagggccgccgggggcuggacga

SEQ ID NO: 343190 - RNA, 32 nt, Human
caagggccuagauuuggagacuuuguuccuua

SEQ ID NO: 343191 - RNA, 32 nt, Human
caagggccuauccugcagccggcccgcuccgg

SEQ ID NO: 343192 - RNA, 32 nt, Human
caagggccuccacaguguggaggucccauuuu

SEQ ID NO: 343193 - RNA, 18 nt, Human
caagggccuggacucaga

SEQ ID NO: 343194 - RNA, 19 nt, Human
caagggcgacauccccccg

SEQ ID NO: 343195 - RNA, 32 nt, Human
caagggcgaggcaagggcgcuuucugccgacg

SEQ ID NO: 343196 - RNA, 32 nt, Human
caagggcuccugucuguccuuugcuguuuuau

SEQ ID NO: 343197 - RNA, 20 nt, Human
caagggcucgggacuggaga

SEQ ID NO: 343198 - RNA, 24 nt, Human
caagggcucugcaaaugccaguuu

SEQ ID NO: 343199 - RNA, 32 nt, Human
caagggcugauggucccuccccugugcgccuu

SEQ ID NO: 343200 - RNA, 32 nt, Human
caagggcuggaaggacaccagaacgcucccga

SEQ ID NO: 343201 - RNA, 20 nt, Human
caagggcuggagcccagaga

SEQ ID NO: 343202 - RNA, 20 nt, Human
caagggcuggcacuuuuuua

SEQ ID NO: 343203 - RNA, 22 nt, Human
caagggcugggcuguccguuca

SEQ ID NO: 343204 - RNA, 32 nt, Human
caagggcugguucugggagaggcgcaagggca

SEQ ID NO: 343205 - RNA, 23 nt, Human
caagggcuguacauccagcuaca

SEQ ID NO: 343206 - RNA, 32 nt, Human
caagggcugugccugcgcccagaagcagcuac

SEQ ID NO: 343207 - RNA, 21 nt, Human
caagggcuuagggguuggagg

SEQ ID NO: 343208 - RNA, 32 nt, Human
caagggcuugcagccuaguaggagcugagcuu

SEQ ID NO: 343209 - RNA, 32 nt, Human
caagggcuuuguuuccugcucuccucugcccu

SEQ ID NO: 343210 - RNA, 32 nt, Human
caagggcuuuuccuugcugucaucuggcuuga

SEQ ID NO: 343211 - RNA, 32 nt, Human
caaggggaaaccuguagugacagugugcccug

SEQ ID NO: 343212 - RNA, 32 nt, Human
caaggggaaggacuguugcugguaugaagcag

SEQ ID NO: 343213 - RNA, 32 nt, Human
caaggggacauggagaaagcagacauggugga

SEQ ID NO: 343214 - RNA, 32 nt, Human
caaggggaccccggccuaggaggcaggaagcc

SEQ ID NO: 343215 - RNA, 32 nt, Human
caaggggacgucgggcucagaggcagacgaug

SEQ ID NO: 343216 - RNA, 19 nt, Human
caaggggaggaguuggaga

SEQ ID NO: 343217 - RNA, 32 nt, Human
caaggggagggaggggcguggggagccggaac

SEQ ID NO: 343218 - RNA, 32 nt, Human
caaggggcaaaaagaucuauuuauagaucuau

SEQ ID NO: 343219 - RNA, 32 nt, Human
caaggggcaauauuuuuaucuuuuccaaaaua

SEQ ID NO: 343220 - RNA, 32 nt, Human
caaggggcaggcggcaggcccggggagacgga

SEQ ID NO: 343221 - RNA, 32 nt, Human
caaggggccaggagccaacaccagaggccacu

SEQ ID NO: 343222 - RNA, 19 nt, Human
caaggggcccagagccccc

SEQ ID NO: 343223 - RNA, 32 nt, Human
caaggggcccagccuccucuggacuccaccuu

SEQ ID NO: 343224 - RNA, 32 nt, Human
caaggggcccaggcccuguccucugucccuca

SEQ ID NO: 343225 - RNA, 32 nt, Human
caaggggccgcuaagacagugucuccuaaguc

SEQ ID NO: 343226 - RNA, 32 nt, Human
caaggggcuacuguuaguccucuuguuagaug

SEQ ID NO: 343227 - RNA, 32 nt, Human
caaggggcuucaggcauccucaguuucuuuau

SEQ ID NO: 343228 - RNA, 32 nt, Human
caagggggacgaggcagaugacgagagaagcg

SEQ ID NO: 343229 - RNA, 32 nt, Human
caagggggaggaagaggaggaagguuggaccu

SEQ ID NO: 343230 - RNA, 32 nt, Human
caagggggaggggagcccacaggccugcagcc

SEQ ID NO: 343231 - RNA, 32 nt, Human
caagggggcugcugcuccucucuuggguaggg

SEQ ID NO: 343232 - RNA, 32 nt, Human
caagggggcugugccguggagcugggcucgcg

SEQ ID NO: 343233 - RNA, 32 nt, Human
caaggggucacagcaugccuccugccuuaccg

SEQ ID NO: 343234 - RNA, 32 nt, Human
caaggggucaugccaauuuaaggaaaugcccc

SEQ ID NO: 343235 - RNA, 32 nt, Human
caagggguccaauccagucuucagggccaaca

SEQ ID NO: 343236 - RNA, 32 nt, Human
caaggggugcugcuggccacacugcacuagca

SEQ ID NO: 343237 - RNA, 32 nt, Human
caaggggugggccacagccauggugggagugg

SEQ ID NO: 343238 - RNA, 18 nt, Human
caaggguagguguggcag

SEQ ID NO: 343239 - RNA, 32 nt, Human
caaggguaguuucuuuccuaugcauacucuag

SEQ ID NO: 343240 - RNA, 32 nt, Human
caagggucacccaaauagcugagugcaguccu

SEQ ID NO: 343241 - RNA, 32 nt, Human
caagggucagcccucuugacugucacaugcug

SEQ ID NO: 343242 - RNA, 32 nt, Human
caaggguccggggcggaggaugcuuuguucuu

SEQ ID NO: 343243 - RNA, 32 nt, Human
caaggguccugucaucccucauggccaccccg

SEQ ID NO: 343244 - RNA, 32 nt, Human
caagggucucacaaccccaacaucuucagacu

SEQ ID NO: 343245 - RNA, 32 nt, Human
caagggucuuaccauguugcccaggcuggucu

SEQ ID NO: 343246 - RNA, 23 nt, Human
caagggucuucucacccguaaug

SEQ ID NO: 343247 - RNA, 32 nt, Human
caagggugacucuuuaccacaggaugaauaaa

SEQ ID NO: 343248 - RNA, 32 nt, Human
caagggugagccaccaugcccggccguaaaug

SEQ ID NO: 343249 - RNA, 32 nt, Human
caagggugagccagcagcaaggggcuggcuau

SEQ ID NO: 343250 - RNA, 32 nt, Human
caagggugccaagcugugugagagggccaccg

SEQ ID NO: 343251 - RNA, 32 nt, Human
caagggugcccagggguguggugucucugagc

SEQ ID NO: 343252 - RNA, 32 nt, Human
caagggugggaugggagggcagaggggaaaua

SEQ ID NO: 343253 - RNA, 32 nt, Human
caagggugggggagggagggagggaguuggca

SEQ ID NO: 343254 - RNA, 32 nt, Human
caagggugggguggccagcagauggacugcug

SEQ ID NO: 343255 - RNA, 32 nt, Human
caaggguggugaccaaugcauuaccuucuguu

SEQ ID NO: 343256 - RNA, 32 nt, Human
caaggguggugugacaguuaauacugaguguc

SEQ ID NO: 343257 - RNA, 32 nt, Human
caagggugugugugacuacaaguacacacuac

SEQ ID NO: 343258 - RNA, 31 nt, Human
caaggguuggguaaggagguuuuaagggaga

SEQ ID NO: 343259 - RNA, 22 nt, Human
caaggguugugcuccucagcuu

SEQ ID NO: 343260 - RNA, 21 nt, Human
caaggguuuagagucuggaga

SEQ ID NO: 343261 - RNA, 24 nt, Human
caaggguuucauuaaggucaccuu

SEQ ID NO: 343262 - RNA, 32 nt, Human
caagguaaaauuauugucaaaguuuaaauacc

SEQ ID NO: 343263 - RNA, 32 nt, Human
caagguaaacucugacaugcacuagguaugug

SEQ ID NO: 343264 - RNA, 32 nt, Human
caagguaaacucugacaugcacuaguaugugc

SEQ ID NO: 343265 - RNA, 32 nt, Human
caagguaacucugggcuacagaguccuugcug

SEQ ID NO: 343266 - RNA, 32 nt, Human
caagguaaggagcagaggaggcaugagcaugg

SEQ ID NO: 343267 - RNA, 32 nt, Human
caagguacacagauggcagugccauaagcaag

SEQ ID NO: 343268 - RNA, 32 nt, Human
caagguacccagaauuuuuagaagccuucaga

SEQ ID NO: 343269 - RNA, 21 nt, Human
caagguacucuggcuggcaaa

SEQ ID NO: 343270 - RNA, 32 nt, Human
caagguagaaaaggguuggaaaagaaugauaa

SEQ ID NO: 343271 - RNA, 32 nt, Human
caagguagaagaaucacuugagcccaggaguu

SEQ ID NO: 343272 - RNA, 32 nt, Human
caagguagagaguggaaggaaugaaggggugg

SEQ ID NO: 343273 - RNA, 32 nt, Human
caagguagagugagccaauggcgagagaucag

SEQ ID NO: 343274 - RNA, 32 nt, Human
caagguagaugaaguugcuuugccaguaagga

SEQ ID NO: 343275 - RNA, 32 nt, Human
caagguagcagugugguaggauagagacaaaa

SEQ ID NO: 343276 - RNA, 32 nt, Human
caagguaggagaaucgcuugagcucaggaguu

SEQ ID NO: 343277 - RNA, 32 nt, Human
caagguaggcagagguugcagugagccaagau

SEQ ID NO: 343278 - RNA, 16 nt, Human
caagguaggcugcaaa

SEQ ID NO: 343279 - RNA, 32 nt, Human
caagguaugaagcagaugagggaccagcacuc

SEQ ID NO: 343280 - RNA, 32 nt, Human
caagguauuauuuagaaaagaagagaauguuu

SEQ ID NO: 343281 - RNA, 32 nt, Human
caaggucaagagaucaagaccauccucgccaa

SEQ ID NO: 343282 - RNA, 32 nt, Human
caaggucaagagaucaagaccauucuggccaa

SEQ ID NO: 343283 - RNA, 31 nt, Human
caaggucaagaggcaacgacagcagaggugg

SEQ ID NO: 343284 - RNA, 32 nt, Human
caaggucaagaguucgagaccagccugaccaa

SEQ ID NO: 343285 - RNA, 32 nt, Human
caaggucaagaguucgagaccagccuggccaa

SEQ ID NO: 343286 - RNA, 32 nt, Human
caaggucaagaguucgugaccagccuggccaa

SEQ ID NO: 343287 - RNA, 32 nt, Human
caaggucacacagcagagcuggaacuagagcu

SEQ ID NO: 343288 - RNA, 32 nt, Human
caaggucacacagcuggcuggggcaggauugg

SEQ ID NO: 343289 - RNA, 32 nt, Human
caaggucacaccacugcacuccagccugggcu

SEQ ID NO: 343290 - RNA, 32 nt, Human
caaggucacaccauugcacuccaaccugggcg

SEQ ID NO: 343291 - RNA, 32 nt, Human
caaggucacccagcugugaaugaacgugguca

SEQ ID NO: 343292 - RNA, 32 nt, Human
caaggucacgucacugcacucuagccugggca

SEQ ID NO: 343293 - RNA, 32 nt, Human
caaggucacucugccagacgccuuuuugccug

SEQ ID NO: 343294 - RNA, 32 nt, Human
caaggucagcaguucaagaccagccugaccaa

SEQ ID NO: 343295 - RNA, 32 nt, Human
caaggucagcugcccccugcccucucucuggg

SEQ ID NO: 343296 - RNA, 32 nt, Human
caaggucaggagaucaagaccauccuggccaa

SEQ ID NO: 343297 - RNA, 32 nt, Human
caaggucaggagaucaagaccauccuggcuaa

SEQ ID NO: 343298 - RNA, 32 nt, Human
caaggucaggaguucaagaccagccugaccaa

SEQ ID NO: 343299 - RNA, 32 nt, Human
caaggucaggaguucaagaccagccuggacaa

SEQ ID NO: 343300 - RNA, 32 nt, Human
caaggucaggaguucaagaccagccuggccaa

SEQ ID NO: 343301 - RNA, 32 nt, Human
caaggucaggaguucaagaccagccuggccca

SEQ ID NO: 343302 - RNA, 32 nt, Human
caaggucaggaguucaagaccagcugaccaac

SEQ ID NO: 343303 - RNA, 24 nt, Human
caaggucaggaguuccagaccagc

SEQ ID NO: 343304 - RNA, 32 nt, Human
caaggucaggaguugagaccagccuggccaac

SEQ ID NO: 343305 - RNA, 32 nt, Human
caaggucaggaguuuugagaccagccuggcca

SEQ ID NO: 343306 - RNA, 32 nt, Human
caaggucauagagugagugccugagucaucca

SEQ ID NO: 343307 - RNA, 32 nt, Human
caaggucauccaggcagcacuuccagaaacuu

SEQ ID NO: 343308 - RNA, 32 nt, Human
caaggucauccuggagaugggauccaggacgu

SEQ ID NO: 343309 - RNA, 32 nt, Human
caaggucaucgaugaccucccgcugacaaacu

SEQ ID NO: 343310 - RNA, 32 nt, Human
caaggucaucuccugggggcccucucuggagc

SEQ ID NO: 343311 - RNA, 32 nt, Human
caaggucaugccacugcacuccagccugggag

SEQ ID NO: 343312 - RNA, 32 nt, Human
caaggucaugccacugcacucuagccugggug

SEQ ID NO: 343313 - RNA, 32 nt, Human
caaggucauuggagagaacuucuguaugggca

SEQ ID NO: 343314 - RNA, 32 nt, Human
caaggucauuuugcacugauucauacuuugag

SEQ ID NO: 343315 - RNA, 32 nt, Human
caagguccagaguucaagagcagccuggccaa

SEQ ID NO: 343316 - RNA, 32 nt, Human
caagguccaggauauagaaucuacagagucca

SEQ ID NO: 343317 - RNA, 32 nt, Human
caaggucccaccgcccucacagccaaugaggg

SEQ ID NO: 343318 - RNA, 32 nt, Human
caagguccuccaggccuggggacaggaaagcc

SEQ ID NO: 343319 - RNA, 32 nt, Human
caagguccugggugcagccgggugcauggcag

SEQ ID NO: 343320 - RNA, 32 nt, Human
caaggucgcaccgcuacacuccagccugggug

SEQ ID NO: 343321 - RNA, 19 nt, Human
caaggucgcgacacugcac

SEQ ID NO: 343322 - RNA, 32 nt, Human
caaggucgcgccacugcacuccagccugggca

SEQ ID NO: 343323 - RNA, 32 nt, Human
caaggucgcgccacugcacuccagccugggcg

SEQ ID NO: 343324 - RNA, 32 nt, Human
caaggucgcgccacugcgcuccagccuggaca

SEQ ID NO: 343325 - RNA, 32 nt, Human
caaggucgcgccauugcacuccagccugggcg

SEQ ID NO: 343326 - RNA, 32 nt, Human
caaggucgcuucucuuuuccucuucucuccca

SEQ ID NO: 343327 - RNA, 32 nt, Human
caaggucggaggagacaggggaugaggaaggc

SEQ ID NO: 343328 - RNA, 32 nt, Human
caaggucggggaggggagggaaaagcagcacc

SEQ ID NO: 343329 - RNA, 32 nt, Human
caaggucucacucugcugcucaggcuggagug

SEQ ID NO: 343330 - RNA, 18 nt, Human
caaggucucacucuguca

SEQ ID NO: 343331 - RNA, 32 nt, Human
caaggucuccagcagcccccagaaggagggca

SEQ ID NO: 343332 - RNA, 32 nt, Human
caaggucucccaguccagaaacagucugguga

SEQ ID NO: 343333 - RNA, 23 nt, Human
caaggucucugaagaagagaaug

SEQ ID NO: 343334 - RNA, 32 nt, Human
caaggucucuucuccauuguugcucucuauac

SEQ ID NO: 343335 - RNA, 32 nt, Human
caaggucugagugccacguggacuucuucagg

SEQ ID NO: 343336 - RNA, 32 nt, Human
caaggucugggaauuuaucgagaagcucuuug

SEQ ID NO: 343337 - RNA, 32 nt, Human
caaggucugugccucuccugcagccccgccac

SEQ ID NO: 343338 - RNA, 20 nt, Human
caaggucuucagucuagcuu

SEQ ID NO: 343339 - RNA, 24 nt, Human
caaggugaaaccccaucucuacua

SEQ ID NO: 343340 - RNA, 24 nt, Human
caaggugaaaccccgucucuacua

SEQ ID NO: 343341 - RNA, 32 nt, Human
caaggugaaagcuucuaauggagacacuccua

SEQ ID NO: 343342 - RNA, 21 nt, Human
caaggugaaccagcugguaaa

SEQ ID NO: 343343 - RNA, 32 nt, Human
caaggugaacugggacauucuucuuucucaga

SEQ ID NO: 343344 - RNA, 32 nt, Human
caaggugaagaggacuccgaaguccuuuguca

SEQ ID NO: 343345 - RNA, 32 nt, Human
caaggugaagccugagacgaauggcuuuccca

SEQ ID NO: 343346 - RNA, 32 nt, Human
caaggugagcaagucacuugaggucgggaguu

SEQ ID NO: 343347 - RNA, 32 nt, Human
caaggugagcccagagaugaauugggcacaca

SEQ ID NO: 343348 - RNA, 32 nt, Human
caaggugaggagcaaggaagccagucugaguc

SEQ ID NO: 343349 - RNA, 32 nt, Human
caaggugaggccuugagcucuuuguuuuuaua

SEQ ID NO: 343350 - RNA, 32 nt, Human
caaggugaggcugugccuucuggugccaggac

SEQ ID NO: 343351 - RNA, 26 nt, Human
caaggugauaaaacccgucucuacua

SEQ ID NO: 343352 - RNA, 32 nt, Human
caaggugcacacaucuugaccaacucagcagc

SEQ ID NO: 343353 - RNA, 32 nt, Human
caaggugcacacugcuguguguaccuugcaga

SEQ ID NO: 343354 - RNA, 32 nt, Human
caaggugcagaagacucagggaaggguagucu

SEQ ID NO: 343355 - RNA, 17 nt, Human
caaggugcagcugacaa

SEQ ID NO: 343356 - RNA, 32 nt, Human
caaggugcccccaucugccugccuguagaaau

SEQ ID NO: 343357 - RNA, 32 nt, Human
caaggugcccugagcuccccugggcagcaccc

SEQ ID NO: 343358 - RNA, 32 nt, Human
caaggugccucccgccucuccucccccagacc

SEQ ID NO: 343359 - RNA, 32 nt, Human
caaggugccuccuccucuccuuagcuggcccg

SEQ ID NO: 343360 - RNA, 23 nt, Human
caaggugcuaggauuacaggcau

SEQ ID NO: 343361 - RNA, 23 nt, Human
caaggugcuggaauuacaggcgu

SEQ ID NO: 343362 - RNA, 22 nt, Human
caaggugcuggauuacaggcau

SEQ ID NO: 343363 - RNA, 32 nt, Human
caaggugcuggcaagauuugaaggcaaaaguc

SEQ ID NO: 343364 - RNA, 23 nt, Human
caaggugcugggacuacaggcgu

SEQ ID NO: 343365 - RNA, 23 nt, Human
caaggugcugggauuacaagcgu

SEQ ID NO: 343366 - RNA, 22 nt, Human
caaggugcugggauuacaggca

SEQ ID NO: 343367 - RNA, 23 nt, Human
caaggugcugggauuacaggcau

SEQ ID NO: 343368 - RNA, 32 nt, Human
caaggugcugggauuacaggcaugagggacca

SEQ ID NO: 343369 - RNA, 32 nt, Human
caaggugcuguuccagcacacaugcuuccugc

SEQ ID NO: 343370 - RNA, 32 nt, Human
caagguggaaggaucacuuagagcuaggaguu

SEQ ID NO: 343371 - RNA, 32 nt, Human
caagguggagugaaacggggugcggggguggg

SEQ ID NO: 343372 - RNA, 32 nt, Human
caagguggagugaaucaaggagcauguggagg

SEQ ID NO: 343373 - RNA, 24 nt, Human
caagguggcaagcaggcuaccugu

SEQ ID NO: 343374 - RNA, 20 nt, Human
caagguggcaggcgccugua

SEQ ID NO: 343375 - RNA, 32 nt, Human
caagguggcgcaugccuauaaucccagguacu

SEQ ID NO: 343376 - RNA, 32 nt, Human
caagguggcucacaccuauaaucccagcccuu

SEQ ID NO: 343377 - RNA, 32 nt, Human
caagguggcucacgccuguaaucccagcacuu

SEQ ID NO: 343378 - RNA, 32 nt, Human
caagguggcucaugccuuuaaucccagcauuu

SEQ ID NO: 343379 - RNA, 32 nt, Human
caagguggcugugucagccagugugagggccc

SEQ ID NO: 343380 - RNA, 32 nt, Human
caaggugggaagaucacuugagcccaggaauu

SEQ ID NO: 343381 - RNA, 32 nt, Human
caaggugggaagauugccugagcucaggaguu

SEQ ID NO: 343382 - RNA, 32 nt, Human
caaggugggagcaucacuugauccugggaguu

SEQ ID NO: 343383 - RNA, 32 nt, Human
caaggugggaggaucaauugaggccagaguuu

SEQ ID NO: 343384 - RNA, 32 nt, Human
caaggugggaggaucaccagagccugggaagg

SEQ ID NO: 343385 - RNA, 32 nt, Human
caaggugggaggaucaccugaggucaggaguu

SEQ ID NO: 343386 - RNA, 32 nt, Human
caaggugggaggaucaccugaugucgggaguu

SEQ ID NO: 343387 - RNA, 32 nt, Human
caaggugggaggaucacuggaggucaggaguu

SEQ ID NO: 343388 - RNA, 32 nt, Human
caaggugggaggaucacuugagcccaggaguu

SEQ ID NO: 343389 - RNA, 32 nt, Human
caaggugggaggaucacuugaggccaggaguu

SEQ ID NO: 343390 - RNA, 32 nt, Human
caaggugggaggaucacuuuaguccaggaguu

SEQ ID NO: 343391 - RNA, 32 nt, Human
caaggugggaggaucaguugagccccagaguu

SEQ ID NO: 343392 - RNA, 32 nt, Human
caaggugggaggaucgcuugagaccaggaguu

SEQ ID NO: 343393 - RNA, 32 nt, Human
caaggugggaggaucgcuugagcccaggaguu

SEQ ID NO: 343394 - RNA, 32 nt, Human
caaggugggaggaucguuugagcccaggaguu

SEQ ID NO: 343395 - RNA, 32 nt, Human
caaggugggaggauuacuugagaccaggaguu

SEQ ID NO: 343396 - RNA, 32 nt, Human
caaggugggaggauugcuugaacccaggaguu

SEQ ID NO: 343397 - RNA, 32 nt, Human
caaggugggaggauugcuugagccagaaguuc

SEQ ID NO: 343398 - RNA, 32 nt, Human
caaggugggaggauugcuugagcccaagaguu

SEQ ID NO: 343399 - RNA, 32 nt, Human
caaggugggaggauugcuugagcccaggaguu

SEQ ID NO: 343400 - RNA, 32 nt, Human
caaggugggaggauugcuugagcccaguaguu

SEQ ID NO: 343401 - RNA, 32 nt, Human
caaggugggaggauugcuugagccuaggaguu

SEQ ID NO: 343402 - RNA, 32 nt, Human
caaggugggaggauugcuugagcguagccauu

SEQ ID NO: 343403 - RNA, 32 nt, Human
caaggugggaggauugcuugagcucaggaguu

SEQ ID NO: 343404 - RNA, 32 nt, Human
caaggugggaggauugcuugagcucggaagau

SEQ ID NO: 343405 - RNA, 32 nt, Human
caaggugggaggauugcuugaggccaggaguu

SEQ ID NO: 343406 - RNA, 32 nt, Human
caaggugggaggauugucuuaagcccgggacu

SEQ ID NO: 343407 - RNA, 32 nt, Human
caaggugggaggugggauggggcaggacuuuc

SEQ ID NO: 343408 - RNA, 19 nt, Human
caaggugggagguugaaga

SEQ ID NO: 343409 - RNA, 32 nt, Human
caaggugggauggugaucccuuugaccccugc

SEQ ID NO: 343410 - RNA, 32 nt, Human
caaggugggcagaucacuugaagucaggaguu

SEQ ID NO: 343411 - RNA, 32 nt, Human
caaggugggcagaucacuugagcccagcaguu

SEQ ID NO: 343412 - RNA, 32 nt, Human
caaggugggcagaucacuugaggucaggaguu

SEQ ID NO: 343413 - RNA, 32 nt, Human
caaggugggcagauccccugagcucaggaguc

SEQ ID NO: 343414 - RNA, 32 nt, Human
caaggugggcagauugccugagcucaggaguu

SEQ ID NO: 343415 - RNA, 32 nt, Human
caaggugggcaguuugccugagcucaggaguu

SEQ ID NO: 343416 - RNA, 32 nt, Human
caaggugggcggaucaccugagcucaggaguu

SEQ ID NO: 343417 - RNA, 32 nt, Human
caaggugggcggaucaccuugaggucaggagu

SEQ ID NO: 343418 - RNA, 32 nt, Human
caaggugggcggaucacuugagaucaggaguu

SEQ ID NO: 343419 - RNA, 32 nt, Human
caaggugggcggaucacuugaggccaggaauu

SEQ ID NO: 343420 - RNA, 32 nt, Human
caaggugggcggaucacuugaggucaggaauu

SEQ ID NO: 343421 - RNA, 32 nt, Human
caaggugggcggaucacuugaggucaggaguu

SEQ ID NO: 343422 - RNA, 32 nt, Human
caaggugggcggauugcuugagcuuaggaguu

SEQ ID NO: 343423 - RNA, 32 nt, Human
caaggugggcgggucacuugagaucaggaguu

SEQ ID NO: 343424 - RNA, 32 nt, Human
caaggugggcugaucacuugaucccaggaguu

SEQ ID NO: 343425 - RNA, 21 nt, Human
caagguggggaaaucuggaaa

SEQ ID NO: 343426 - RNA, 31 nt, Human
caaggugggguggaagcuuggggaagaccca

SEQ ID NO: 343427 - RNA, 32 nt, Human
caaggugggguggaagcuuggggaagacccau

SEQ ID NO: 343428 - RNA, 32 nt, Human
caagguggguaaaucacuugaggucaggaguu

SEQ ID NO: 343429 - RNA, 32 nt, Human
caagguggguagaucacuugaggucaggaguu

SEQ ID NO: 343430 - RNA, 18 nt, Human
caaggugggugacagaga

SEQ ID NO: 343431 - RNA, 32 nt, Human
caagguggguggaucacuugaagccaggaguu

SEQ ID NO: 343432 - RNA, 32 nt, Human
caagguggguggaucacuugagccuaagagau

SEQ ID NO: 343433 - RNA, 32 nt, Human
caagguggguggaucacuugaggccaggaguu

SEQ ID NO: 343434 - RNA, 32 nt, Human
caagguggguggaucacuugaggucaggaguu

SEQ ID NO: 343435 - RNA, 32 nt, Human
caagguggguggaucacuugaggucgggaguu

SEQ ID NO: 343436 - RNA, 32 nt, Human
caagguggguggaucacuugaguucaggaguu

SEQ ID NO: 343437 - RNA, 32 nt, Human
caagguggguggaucgcuugagcccaggcagu

SEQ ID NO: 343438 - RNA, 32 nt, Human
caagguggguggaucgcuugagcucaggaguu

SEQ ID NO: 343439 - RNA, 32 nt, Human
caaggugggugggucacuugaacccaggaguu

SEQ ID NO: 343440 - RNA, 32 nt, Human
caagguggguggguugcuugagcucaggaguu

SEQ ID NO: 343441 - RNA, 32 nt, Human
caagguggguugaucacuuggggcuagggguu

SEQ ID NO: 343442 - RNA, 32 nt, Human
caagguggugcaccccuguaaucccagcuacu

SEQ ID NO: 343443 - RNA, 32 nt, Human
caaggugguggagacauucugagcagggcuga

SEQ ID NO: 343444 - RNA, 32 nt, Human
caagguguccuucugaaaugcaugcccugugg

SEQ ID NO: 343445 - RNA, 32 nt, Human
caaggugucggcugccccagauugcuucauuu

SEQ ID NO: 343446 - RNA, 32 nt, Human
caaggugucuaguccagcucccauggagggug

SEQ ID NO: 343447 - RNA, 32 nt, Human
caaggugucucaucugaaaagaaaccugagcc

SEQ ID NO: 343448 - RNA, 32 nt, Human
caaggugugagcauuugagcugugcuggaagg

SEQ ID NO: 343449 - RNA, 32 nt, Human
caaggugugcagggcaggucagggaagggcag

SEQ ID NO: 343450 - RNA, 32 nt, Human
caaggugugcccagcagaagugcaauagccag

SEQ ID NO: 343451 - RNA, 32 nt, Human
caagguguuccgcaaggaggaggacuccacgg

SEQ ID NO: 343452 - RNA, 32 nt, Human
caagguguucucuguagcucaaucugcaaaca

SEQ ID NO: 343453 - RNA, 23 nt, Human
caagguguugggaccacaggcgu

SEQ ID NO: 343454 - RNA, 32 nt, Human
caagguguuuccaaagcacauccucugauccu

SEQ ID NO: 343455 - RNA, 32 nt, Human
caagguuaaucaggaaaaauagcuuuugacag

SEQ ID NO: 343456 - RNA, 17 nt, Human
caagguuaggguuggag

SEQ ID NO: 343457 - RNA, 32 nt, Human
caagguuagucaggucuggcuauauuuccacu

SEQ ID NO: 343458 - RNA, 32 nt, Human
caagguuaugccaaauuuccaggccuuuuuga

SEQ ID NO: 343459 - RNA, 32 nt, Human
caagguucacuacaaaacaaacaguuccuggu

SEQ ID NO: 343460 - RNA, 32 nt, Human
caagguucaugaguugccugacuugcccaccg

SEQ ID NO: 343461 - RNA, 32 nt, Human
caagguuccccucugcucaucccuccucauuc

SEQ ID NO: 343462 - RNA, 16 nt, Human
caagguuccugguaaa

SEQ ID NO: 343463 - RNA, 32 nt, Human
caagguucuauacaaaugcaagggaauuaaug

SEQ ID NO: 343464 - RNA, 32 nt, Human
caagguucuccaaguagcucauacagcuuuga

SEQ ID NO: 343465 - RNA, 32 nt, Human
caagguucucuccccucuuuccucucacauac

SEQ ID NO: 343466 - RNA, 32 nt, Human
caagguugcgccacugcacuccagccugggca

SEQ ID NO: 343467 - RNA, 19 nt, Human
caagguugcucacugcaaa

SEQ ID NO: 343468 - RNA, 32 nt, Human
caagguuggaaaggagagcuugcugaaguggg

SEQ ID NO: 343469 - RNA, 32 nt, Human
caagguuggggaggggaacaggagagaggcaa

SEQ ID NO: 343470 - RNA, 32 nt, Human
caagguuggugagacggcaacaggguaggagg

SEQ ID NO: 343471 - RNA, 32 nt, Human
caagguuguagcugugcucaggcuucagcuug

SEQ ID NO: 343472 - RNA, 32 nt, Human
caagguugugccacugcacuccagccugggca

SEQ ID NO: 343473 - RNA, 32 nt, Human
caagguugugcuuucaaacacauauuaguccu

SEQ ID NO: 343474 - RNA, 31 nt, Human
caagguuucaauaaauauuugcuaaaugagu

SEQ ID NO: 343475 - RNA, 32 nt, Human
caagguuugcaagcucccugccccagggagcu

SEQ ID NO: 343476 - RNA, 17 nt, Human
caagguuugcuggcaga

SEQ ID NO: 343477 - RNA, 32 nt, Human
caaguaaaaccagcacaaccagccaccagugg

SEQ ID NO: 343478 - RNA, 32 nt, Human
caaguaaacuuacuuuccuguuucuggaauac

SEQ ID NO: 343479 - RNA, 32 nt, Human
caaguaaaugagcagagacagccccugguuua

SEQ ID NO: 343480 - RNA, 32 nt, Human
caaguaaauucagggaaacacauuuacuugaa

SEQ ID NO: 343481 - RNA, 32 nt, Human
caaguaacagaaaccugguugaaaugcuuaac

SEQ ID NO: 343482 - RNA, 21 nt, Human
caaguaaccagcuucucacuc

SEQ ID NO: 343483 - RNA, 23 nt, Human
caaguaacugggauuacaggcau

SEQ ID NO: 343484 - RNA, 32 nt, Human
caaguaacuuauaucuuuuuauuugaauguau

SEQ ID NO: 343485 - RNA, 32 nt, Human
caaguaacuugucucugcuauuuuuaauguau

SEQ ID NO: 343486 - RNA, 32 nt, Human
caaguaagaggagcuucaucucagccugcuag

SEQ ID NO: 343487 - RNA, 32 nt, Human
caaguaagcuuaaaaugcauucucuagcaaag

SEQ ID NO: 343488 - RNA, 32 nt, Human
caaguaaggaagaggaagaccuccagcauugg

SEQ ID NO: 343489 - RNA, 32 nt, Human
caaguaaggaagucucaagcccaaagagcagc

SEQ ID NO: 343490 - RNA, 32 nt, Human
caaguaaggcagcgugggggaaaggaaacgug

SEQ ID NO: 343491 - RNA, 32 nt, Human
caaguaaggguucucauuguugccuuuuaaga

SEQ ID NO: 343492 - RNA, 32 nt, Human
caaguaaguagcuuccuucaucuguguguacu

SEQ ID NO: 343493 - RNA, 32 nt, Human
caaguaaguugcaaaccacauauccgacaagg

SEQ ID NO: 343494 - RNA, 32 nt, Human
caaguaauauagaauaacuuuccuuaaaauga

SEQ ID NO: 343495 - RNA, 32 nt, Human
caaguaauccugcugauccaguuguacuuaag

SEQ ID NO: 343496 - RNA, 18 nt, Human
caaguacagaaaccucca

SEQ ID NO: 343497 - RNA, 23 nt, Human
caaguacagaagaccuuccuuuc

SEQ ID NO: 343498 - RNA, 32 nt, Human
caaguacagagggagggagggccccagcccac

SEQ ID NO: 343499 - RNA, 32 nt, Human
caaguacagauggacugaguauggccugacgu

SEQ ID NO: 343500 - RNA, 32 nt, Human
caaguacaucuguauucaacuggguaaagcca

SEQ ID NO: 343501 - RNA, 32 nt, Human
caaguacaucuucucccagauucucuggccuu

SEQ ID NO: 343502 - RNA, 32 nt, Human
caaguacaugcacgaccacuaccuggacaagu

SEQ ID NO: 343503 - RNA, 32 nt, Human
caaguaccacuccauccagccuugggcaagau

SEQ ID NO: 343504 - RNA, 32 nt, Human
caaguaccagccagcaacaccaaccaaaugcu

SEQ ID NO: 343505 - RNA, 19 nt, Human
caaguacccuuuccucuca

SEQ ID NO: 343506 - RNA, 23 nt, Human
caaguaccugggacuacaggcgu

SEQ ID NO: 343507 - RNA, 32 nt, Human
caaguaccuggggcuagcagggcagauaccag

SEQ ID NO: 343508 - RNA, 32 nt, Human
caaguaccuugcagcauuucucugccauugcu

SEQ ID NO: 343509 - RNA, 32 nt, Human
caaguacuggggacacaucaaagugugguguu

SEQ ID NO: 343510 - RNA, 32 nt, Human
caaguacuuaacaaaaagaugaaaacuugaag

SEQ ID NO: 343511 - RNA, 32 nt, Human
caaguagaaggugagcaaggugaagaggugcu

SEQ ID NO: 343512 - RNA, 32 nt, Human
caaguagaggugagccauuccccagaggaaga

SEQ ID NO: 343513 - RNA, 18 nt, Human
caaguagcagaagcugug

SEQ ID NO: 343514 - RNA, 23 nt, Human
caaguagcggggaucacaggcau

SEQ ID NO: 343515 - RNA, 32 nt, Human
caaguagcuagcaugcaguugcagcucaauga

SEQ ID NO: 343516 - RNA, 32 nt, Human
caaguagcucaguucuugcguuuuauauuagg

SEQ ID NO: 343517 - RNA, 22 nt, Human
caaguagcugagauuacaggca

SEQ ID NO: 343518 - RNA, 23 nt, Human
caaguagcugagauuacaggcau

SEQ ID NO: 343519 - RNA, 22 nt, Human
caaguagcuggaauuacaggca

SEQ ID NO: 343520 - RNA, 23 nt, Human
caaguagcuggaauuacaggcau

SEQ ID NO: 343521 - RNA, 23 nt, Human
caaguagcuggaauuacaggcgu

SEQ ID NO: 343522 - RNA, 22 nt, Human
caaguagcugggaauacaggca

SEQ ID NO: 343523 - RNA, 23 nt, Human
caaguagcugggaccacaggcau

SEQ ID NO: 343524 - RNA, 23 nt, Human
caaguagcugggaccacaggcgu

SEQ ID NO: 343525 - RNA, 32 nt, Human
caaguagcugggacuacagaugugggccacca

SEQ ID NO: 343526 - RNA, 22 nt, Human
caaguagcugggacuacaggca

SEQ ID NO: 343527 - RNA, 23 nt, Human
caaguagcugggacuacaggcau

SEQ ID NO: 343528 - RNA, 23 nt, Human
caaguagcugggacuacaggcgu

SEQ ID NO: 343529 - RNA, 23 nt, Human
caaguagcugggacugcaggcau

SEQ ID NO: 343530 - RNA, 32 nt, Human
caaguagcugggacuucagagauggcuggagc

SEQ ID NO: 343531 - RNA, 23 nt, Human
caaguagcugggaucacaggcgu

SEQ ID NO: 343532 - RNA, 23 nt, Human
caaguagcugggauuacagacau

SEQ ID NO: 343533 - RNA, 22 nt, Human
caaguagcugggauuacaggca

SEQ ID NO: 343534 - RNA, 23 nt, Human
caaguagcugggauuacaggcau

SEQ ID NO: 343535 - RNA, 22 nt, Human
caaguagcugggauuacaggcg

SEQ ID NO: 343536 - RNA, 23 nt, Human
caaguagcugggauuacgggcau

SEQ ID NO: 343537 - RNA, 23 nt, Human
caaguagcugggguuacaggcau

SEQ ID NO: 343538 - RNA, 32 nt, Human
caaguagcuuauacugaggugugcuucaaggg

SEQ ID NO: 343539 - RNA, 32 nt, Human
caaguaggaguaaaccaaaaagugugauuuuu

SEQ ID NO: 343540 - RNA, 32 nt, Human
caaguaggcaaacugaggcucugggagaugua

SEQ ID NO: 343541 - RNA, 21 nt, Human
caaguagggacugucuucuca

SEQ ID NO: 343542 - RNA, 23 nt, Human
caaguaggugggauuacaggcau

SEQ ID NO: 343543 - RNA, 32 nt, Human
caaguagugccccucccucccccuggccaagc

SEQ ID NO: 343544 - RNA, 32 nt, Human
caaguaguguuugguugcauggaaaaguucuu

SEQ ID NO: 343545 - RNA, 32 nt, Human
caaguaguuagcaaagggaggcccaaauucuc

SEQ ID NO: 343546 - RNA, 32 nt, Human
caaguaguucacaaaucucauugugaagaggc

SEQ ID NO: 343547 - RNA, 32 nt, Human
caaguaguugcuaaugugccucuuggucuacc

SEQ ID NO: 343548 - RNA, 32 nt, Human
caaguaguugcuaaugugccucuuggucugcc

SEQ ID NO: 343549 - RNA, 22 nt, Human
caaguaguugggauuacaggca

SEQ ID NO: 343550 - RNA, 23 nt, Human
caaguaguugggauuacgggcau

SEQ ID NO: 343551 - RNA, 22 nt, Human
caaguaguugggauugcaggca

SEQ ID NO: 343552 - RNA, 32 nt, Human
caaguauaauagccggccacugcucugcucac

SEQ ID NO: 343553 - RNA, 32 nt, Human
caaguauagguugcacugauccugaccuuuug

SEQ ID NO: 343554 - RNA, 32 nt, Human
caaguaucaguguguggcagagcuguggcgga

SEQ ID NO: 343555 - RNA, 32 nt, Human
caaguaucuaauacuagagcauugguucugac

SEQ ID NO: 343556 - RNA, 23 nt, Human
caaguaucugggacuacaggcau

SEQ ID NO: 343557 - RNA, 32 nt, Human
caaguaucuguucauauuuccaauugucuccu

SEQ ID NO: 343558 - RNA, 24 nt, Human
caaguaugaccagaagccaggaca

SEQ ID NO: 343559 - RNA, 32 nt, Human
caaguauggacucaugagcuauuguugguugc

SEQ ID NO: 343560 - RNA, 32 nt, Human
caaguauggcuccuccauaucucccucuuccc

SEQ ID NO: 343561 - RNA, 32 nt, Human
caaguaugggcaggaggcauggggcagggugg

SEQ ID NO: 343562 - RNA, 31 nt, Human
caaguauguauucagcaccuguugcaguaug

SEQ ID NO: 343563 - RNA, 22 nt, Human
caaguaugugggacuacaggua

SEQ ID NO: 343564 - RNA, 32 nt, Human
caaguauuacuuuuugggcaaaacuacucauu

SEQ ID NO: 343565 - RNA, 32 nt, Human
caaguauucauuucaugauguaaagaaacuga

SEQ ID NO: 343566 - RNA, 32 nt, Human
caaguauuccaugagccacauagcccagauac

SEQ ID NO: 343567 - RNA, 32 nt, Human
caagucaaacaugguccaaucuuggcaauuuc

SEQ ID NO: 343568 - RNA, 32 nt, Human
caagucaacauggugaaaccucaucucugcua

SEQ ID NO: 343569 - RNA, 32 nt, Human
caagucaaccucucuguucaggcacagaucug

SEQ ID NO: 343570 - RNA, 32 nt, Human
caagucaagaauugagguuugggaaccuccac

SEQ ID NO: 343571 - RNA, 32 nt, Human
caagucaauucagguuccggugccauccgcag

SEQ ID NO: 343572 - RNA, 32 nt, Human
caagucacacaaaacucaaaaacuguauuaaa

SEQ ID NO: 343573 - RNA, 32 nt, Human
caagucacagagagacagagaggaggggacga

SEQ ID NO: 343574 - RNA, 32 nt, Human
caagucacagcuaaacuuacuaauucugauuu

SEQ ID NO: 343575 - RNA, 32 nt, Human
caagucacaggagauuauaugcaccaaugaca

SEQ ID NO: 343576 - RNA, 32 nt, Human
caagucacauuacauuugucauguuccaaagu

SEQ ID NO: 343577 - RNA, 32 nt, Human
caagucaccacacuccagccugggugacagag

SEQ ID NO: 343578 - RNA, 32 nt, Human
caagucacguaauguuuuugugccucaacaau

SEQ ID NO: 343579 - RNA, 22 nt, Human
caagucacucaguuuuauuuua

SEQ ID NO: 343580 - RNA, 32 nt, Human
caagucagaacccaggguucauccugagcugg

SEQ ID NO: 343581 - RNA, 32 nt, Human
caagucagaauagaaguguccuuuauauuacc

SEQ ID NO: 343582 - RNA, 32 nt, Human
caagucagagacugcagaaccagguaggcaga

SEQ ID NO: 343583 - RNA, 32 nt, Human
caagucagccuccaccugcuuuuccugggucc

SEQ ID NO: 343584 - RNA, 32 nt, Human
caagucagccuccucccuccaugccucucugg

SEQ ID NO: 343585 - RNA, 32 nt, Human
caagucagcguaaaccucuuugccuuucucuc

SEQ ID NO: 343586 - RNA, 32 nt, Human
caagucaggaauagaaacugaugagcugauug

SEQ ID NO: 343587 - RNA, 32 nt, Human
caagucaggagacacuguucccaaagccuuga

SEQ ID NO: 343588 - RNA, 22 nt, Human
caagucagggaccacuugcuga

SEQ ID NO: 343589 - RNA, 32 nt, Human
caagucagggagcagggcuggccgcaggaacu

SEQ ID NO: 343590 - RNA, 32 nt, Human
caagucagggcuaaauaugacagaucacaaug

SEQ ID NO: 343591 - RNA, 32 nt, Human
caagucaggucugagggaacccaucggcuucu

SEQ ID NO: 343592 - RNA, 32 nt, Human
caagucaucaaaccacuucaggucucaguuuu

SEQ ID NO: 343593 - RNA, 32 nt, Human
caagucaucaguuucauguggagaacucagug

SEQ ID NO: 343594 - RNA, 20 nt, Human
caagucauccucccaccuca

SEQ ID NO: 343595 - RNA, 32 nt, Human
caagucaucguuugugaucuggacccgcggug

SEQ ID NO: 343596 - RNA, 32 nt, Human
caagucauuuggaaccugccgagugagcacug

SEQ ID NO: 343597 - RNA, 22 nt, Human
caaguccaaccugggcagcacg

SEQ ID NO: 343598 - RNA, 32 nt, Human
caaguccaagaaaagagggagggguggcagag

SEQ ID NO: 343599 - RNA, 32 nt, Human
caaguccaagcuaccauacuccugccugagcu

SEQ ID NO: 343600 - RNA, 20 nt, Human
caaguccaaguaucaucuua

SEQ ID NO: 343601 - RNA, 22 nt, Human
caaguccaauagcacucacuua

SEQ ID NO: 343602 - RNA, 32 nt, Human
caaguccacugaggcccggaccccggacugcg

SEQ ID NO: 343603 - RNA, 32 nt, Human
caaguccagcaaccugcacuccagccugggug

SEQ ID NO: 343604 - RNA, 23 nt, Human
caaguccagccugggcuacauag

SEQ ID NO: 343605 - RNA, 21 nt, Human
caaguccagcucaggcccagg

SEQ ID NO: 343606 - RNA, 21 nt, Human
caaguccagcugcaacccaga

SEQ ID NO: 343607 - RNA, 32 nt, Human
caaguccaggagagagacacggaucccgccac

SEQ ID NO: 343608 - RNA, 32 nt, Human
caaguccaggcagagcggcgcaggcagcugug

SEQ ID NO: 343609 - RNA, 20 nt, Human
caaguccagggcucauuuug

SEQ ID NO: 343610 - RNA, 32 nt, Human
caaguccagucaauuuuacaugauauccuaca

SEQ ID NO: 343611 - RNA, 30 nt, Human
caaguccaguuugcuguagaaagaccaguc

SEQ ID NO: 343612 - RNA, 32 nt, Human
caagucccaaaaacuaagggacagcuaagaag

SEQ ID NO: 343613 - RNA, 32 nt, Human
caagucccaggcccaaugccuaagagaccaga

SEQ ID NO: 343614 - RNA, 32 nt, Human
caaguccccaaacuaccucuuguuacaguagc

SEQ ID NO: 343615 - RNA, 32 nt, Human
caaguccccacuccacgcauccuuccucacca

SEQ ID NO: 343616 - RNA, 32 nt, Human
caaguccccagcccagggccagagcgacagcc

SEQ ID NO: 343617 - RNA, 32 nt, Human
caaguccccaggaaacccaaucaugagguccu

SEQ ID NO: 343618 - RNA, 32 nt, Human
caaguccccugccuggucccccacaaggacuc

SEQ ID NO: 343619 - RNA, 32 nt, Human
caagucccuaggcugcacacacaugucagggg

SEQ ID NO: 343620 - RNA, 32 nt, Human
caagucccuauuuggcuaccuacuucucuaca

SEQ ID NO: 343621 - RNA, 32 nt, Human
caagucccugcagugagcacuagggacagucu

SEQ ID NO: 343622 - RNA, 32 nt, Human
caagucccugcucugggcugggugaucuuaga

SEQ ID NO: 343623 - RNA, 32 nt, Human
caaguccuaacuuuucaauuguaaauguuauu

SEQ ID NO: 343624 - RNA, 20 nt, Human
caaguccuacagucaucuua

SEQ ID NO: 343625 - RNA, 32 nt, Human
caaguccucacaccccugucaucccaggagau

SEQ ID NO: 343626 - RNA, 32 nt, Human
caaguccuccauccugcuggacuucaagccuu

SEQ ID NO: 343627 - RNA, 32 nt, Human
caaguccugcagccucagcaugcgcuggccgg

SEQ ID NO: 343628 - RNA, 32 nt, Human
caaguccuggaggcagggagaucacugccugc

SEQ ID NO: 343629 - RNA, 20 nt, Human
caaguccuggcuacauccca

SEQ ID NO: 343630 - RNA, 32 nt, Human
caaguccugugcaauagccccaggauuggauu

SEQ ID NO: 343631 - RNA, 32 nt, Human
caaguccugugugugcacgugugugcaagugc

SEQ ID NO: 343632 - RNA, 32 nt, Human
caaguccuuccaauuauauuucccaaguauau

SEQ ID NO: 343633 - RNA, 32 nt, Human
caaguccuuccucuuggcgcauucccacacuc

SEQ ID NO: 343634 - RNA, 32 nt, Human
caagucgacaucaccauguguuacuggccugg

SEQ ID NO: 343635 - RNA, 20 nt, Human
caagucgcguggguuggaga

SEQ ID NO: 343636 - RNA, 32 nt, Human
caagucgcugggauaugaaauuagggaauaaa

SEQ ID NO: 343637 - RNA, 32 nt, Human
caagucggaacagcagauaacaaugcagcaag

SEQ ID NO: 343638 - RNA, 32 nt, Human
caagucggaggcaggggcuagggguggaggcc

SEQ ID NO: 343639 - RNA, 32 nt, Human
caagucggaugguggcagggaggagagcaaga

SEQ ID NO: 343640 - RNA, 30 nt, Human
caagucggccucuccaugcccagccuccug

SEQ ID NO: 343641 - RNA, 32 nt, Human
caagucggccuggaagugggccuggaagagca

SEQ ID NO: 343642 - RNA, 32 nt, Human
caagucggccuggaauuaggccuggaagagca

SEQ ID NO: 343643 - RNA, 25 nt, Human
caagucguggccuggggaacacaga

SEQ ID NO: 343644 - RNA, 32 nt, Human
caagucuagaaaccaguauggaagggaggggu

SEQ ID NO: 343645 - RNA, 32 nt, Human
caagucuagagucucagaaacuccccuggggg

SEQ ID NO: 343646 - RNA, 32 nt, Human
caagucuaugugaaauuggguagguguggaau

SEQ ID NO: 343647 - RNA, 32 nt, Human
caagucucaaagauaaccuaccuuuacauucu

SEQ ID NO: 343648 - RNA, 32 nt, Human
caagucucaggcggaggagaaaaagagaucgg

SEQ ID NO: 343649 - RNA, 20 nt, Human
caagucucccacaggccaug

SEQ ID NO: 343650 - RNA, 18 nt, Human
caagucucccacucaucu

SEQ ID NO: 343651 - RNA, 32 nt, Human
caagucucccgccucacaccugccucggcggg

SEQ ID NO: 343652 - RNA, 32 nt, Human
caagucucccuuucccugucuggcuucucccu

SEQ ID NO: 343653 - RNA, 32 nt, Human
caagucuccuccuuccugccagccucuuucuc

SEQ ID NO: 343654 - RNA, 32 nt, Human
caagucuccugccucagccuccgaguagcugg

SEQ ID NO: 343655 - RNA, 32 nt, Human
caagucuccuguccuccuccuggagcagcaga

SEQ ID NO: 343656 - RNA, 20 nt, Human
caagucucgcuccucauuuu

SEQ ID NO: 343657 - RNA, 18 nt, Human
caagucucgucuggcaaa

SEQ ID NO: 343658 - RNA, 21 nt, Human
caagucucuauacaaugucuu

SEQ ID NO: 343659 - RNA, 19 nt, Human
caagucucuauccauguua

SEQ ID NO: 343660 - RNA, 32 nt, Human
caagucucuccucgagugcugggcuauuccgg

SEQ ID NO: 343661 - RNA, 32 nt, Human
caagucucugaggugaccucaggguggaauuc

SEQ ID NO: 343662 - RNA, 32 nt, Human
caagucucugauuucagaagagacuguuaaaa

SEQ ID NO: 343663 - RNA, 22 nt, Human
caagucucugggcuauuuuuua

SEQ ID NO: 343664 - RNA, 32 nt, Human
caagucucugggggaggaguuggggcucugca

SEQ ID NO: 343665 - RNA, 21 nt, Human
caagucucugguacucaggcu

SEQ ID NO: 343666 - RNA, 32 nt, Human
caagucucuguuuccuuuuuguguuuuguugc

SEQ ID NO: 343667 - RNA, 19 nt, Human
caagucucuucuagucuua

SEQ ID NO: 343668 - RNA, 19 nt, Human
caagucucuuucucuuuua

SEQ ID NO: 343669 - RNA, 22 nt, Human
caagucugagcuauuucuucca

SEQ ID NO: 343670 - RNA, 18 nt, Human
caagucugagcuggcaga

SEQ ID NO: 343671 - RNA, 32 nt, Human
caagucugagucuaacaguuuuuggcuuagau

SEQ ID NO: 343672 - RNA, 32 nt, Human
caagucugauuccacuucaugccaucuauuug

SEQ ID NO: 343673 - RNA, 32 nt, Human
caagucugccauaaucuccaucuguguuggaa

SEQ ID NO: 343674 - RNA, 32 nt, Human
caagucugcccuaggcaggagugccuagugca

SEQ ID NO: 343675 - RNA, 32 nt, Human
caagucugccuggcugccucuuaggauaugac

SEQ ID NO: 343676 - RNA, 32 nt, Human
caagucugggagggcaugggagcagugagcag

SEQ ID NO: 343677 - RNA, 21 nt, Human
caagucugggcugcuuaucuu

SEQ ID NO: 343678 - RNA, 22 nt, Human
caagucuguaaucccagcacuu

SEQ ID NO: 343679 - RNA, 32 nt, Human
caagucuguccuuuucuuguggucuacuauaa

SEQ ID NO: 343680 - RNA, 32 nt, Human
caagucuguggcuuggugagucuguguggcca

SEQ ID NO: 343681 - RNA, 32 nt, Human
caagucuguggggcaagaggcugcaauauucc

SEQ ID NO: 343682 - RNA, 21 nt, Human
caagucuuauacucacucuug

SEQ ID NO: 343683 - RNA, 32 nt, Human
caagucuuauuuccucaacguugcuccccauc

SEQ ID NO: 343684 - RNA, 30 nt, Human
caagucuucaauaaagacucuugaauauug

SEQ ID NO: 343685 - RNA, 32 nt, Human
caagucuuccccucagccucuggaguagcugg

SEQ ID NO: 343686 - RNA, 23 nt, Human
caagucuuggccgggaacacaga

SEQ ID NO: 343687 - RNA, 20 nt, Human
caagucuuguagucauuuug

SEQ ID NO: 343688 - RNA, 19 nt, Human
caagucuuuaaauuucuug

SEQ ID NO: 343689 - RNA, 20 nt, Human
caagucuuuguaaaauuuua

SEQ ID NO: 343690 - RNA, 21 nt, Human
caagucuuuuuggcaaucuug

SEQ ID NO: 343691 - RNA, 32 nt, Human
caagugaaaaguguuaaauuucaagcaucuga

SEQ ID NO: 343692 - RNA, 32 nt, Human
caagugaaaccagcuuccuucaucucuaaggc

SEQ ID NO: 343693 - RNA, 32 nt, Human
caagugaaagacagagugaugcugucaaugaa

SEQ ID NO: 343694 - RNA, 32 nt, Human
caagugaagacaagggcuuuuuaugcaaguuu

SEQ ID NO: 343695 - RNA, 32 nt, Human
caagugaaguugcaaucuccuccaucacagcu

SEQ ID NO: 343696 - RNA, 32 nt, Human
caagugaaugccugcccugccgcuagccccac

SEQ ID NO: 343697 - RNA, 23 nt, Human
caagugacaaaaagaucuucuca

SEQ ID NO: 343698 - RNA, 32 nt, Human
caagugacaauauugguguagauuuguacuua

SEQ ID NO: 343699 - RNA, 32 nt, Human
caagugacauuccucaagucaccagagagaau

SEQ ID NO: 343700 - RNA, 32 nt, Human
caagugacauuugcagagaaacagguguacag

SEQ ID NO: 343701 - RNA, 32 nt, Human
caagugacccugacagugcugcaccugucaua

SEQ ID NO: 343702 - RNA, 32 nt, Human
caagugaccuucagagcagcugccacaacugg

SEQ ID NO: 343703 - RNA, 32 nt, Human
caagugacggccuccugguuccucucaguuca

SEQ ID NO: 343704 - RNA, 32 nt, Human
caagugacugacacagguggucuaaaaauuac

SEQ ID NO: 343705 - RNA, 32 nt, Human
caagugacugugugugggguuugacaacugug

SEQ ID NO: 343706 - RNA, 32 nt, Human
caagugagaacaugugguauuuacuuuuguuc

SEQ ID NO: 343707 - RNA, 32 nt, Human
caagugagagcaucugcaaaaugcaaagagaa

SEQ ID NO: 343708 - RNA, 32 nt, Human
caagugagcccaagccuuucguccuugacacu

SEQ ID NO: 343709 - RNA, 22 nt, Human
caagugaggaaagugaucuaga

SEQ ID NO: 343710 - RNA, 32 nt, Human
caagugaggugcuggagccacauucaaaugug

SEQ ID NO: 343711 - RNA, 32 nt, Human
caagugagucucggcuggagugcaguggugca

SEQ ID NO: 343712 - RNA, 32 nt, Human
caagugagugaggaggaggaggaggagaagga

SEQ ID NO: 343713 - RNA, 32 nt, Human
caagugauaaccagacccaucucuccuccacc

SEQ ID NO: 343714 - RNA, 32 nt, Human
caagugauaccccacccccaucugggagguaa

SEQ ID NO: 343715 - RNA, 32 nt, Human
caagugaucagacuuugagugacaucaagaaa

SEQ ID NO: 343716 - RNA, 32 nt, Human
caagugauccacccaccucggccuccgaaagu

SEQ ID NO: 343717 - RNA, 20 nt, Human
caagugauccucccaccuca

SEQ ID NO: 343718 - RNA, 32 nt, Human
caagugauccucccaccucaaccuucggagua

SEQ ID NO: 343719 - RNA, 32 nt, Human
caagugauccucccaucucugccuugaguagc

SEQ ID NO: 343720 - RNA, 32 nt, Human
caagugauccuccugccccagccuccugaagu

SEQ ID NO: 343721 - RNA, 32 nt, Human
caagugauucuccagccucagccuccugagua

SEQ ID NO: 343722 - RNA, 18 nt, Human
caagugauucuccugccu

SEQ ID NO: 343723 - RNA, 32 nt, Human
caagugauucuccugccucugccuccugagua

SEQ ID NO: 343724 - RNA, 32 nt, Human
caagugcaacccaggcagccacggcuguuucg

SEQ ID NO: 343725 - RNA, 19 nt, Human
caagugcaagcuuggcaaa

SEQ ID NO: 343726 - RNA, 32 nt, Human
caagugcaaguguuugccauuuuguaaaacau

SEQ ID NO: 343727 - RNA, 32 nt, Human
caagugcacugaggaccugucaggcccagggg

SEQ ID NO: 343728 - RNA, 32 nt, Human
caagugcagcaacccagcccauggagauugcc

SEQ ID NO: 343729 - RNA, 32 nt, Human
caagugcagugucgugagcauguacagaggga

SEQ ID NO: 343730 - RNA, 32 nt, Human
caagugcaugagaggacagagagagaagggaa

SEQ ID NO: 343731 - RNA, 32 nt, Human
caagugccaggguugggcugagcugcuaugac

SEQ ID NO: 343732 - RNA, 32 nt, Human
caagugcccagccuguggagagacccugcaag

SEQ ID NO: 343733 - RNA, 32 nt, Human
caagugccccacagggaccccagccugggugg

SEQ ID NO: 343734 - RNA, 32 nt, Human
caagugcccccaggacuccugggcccugcuuc

SEQ ID NO: 343735 - RNA, 32 nt, Human
caagugccgacuccugaauuuucccauggugu

SEQ ID NO: 343736 - RNA, 32 nt, Human
caagugccgucgccgcgccccuucccccuccc

SEQ ID NO: 343737 - RNA, 31 nt, Human
caagugccucagugugcccuguugaaacuua

SEQ ID NO: 343738 - RNA, 32 nt, Human
caagugccugagagcaacuacaggacuaacug

SEQ ID NO: 343739 - RNA, 32 nt, Human
caagugccugugucccuguccuucaggcccau

SEQ ID NO: 343740 - RNA, 32 nt, Human
caagugcgaauggggagguggggcaggaggag

SEQ ID NO: 343741 - RNA, 32 nt, Human
caagugcgcacacacaccgauguacacacaca

SEQ ID NO: 343742 - RNA, 32 nt, Human
caagugcgcauugaguaaaacccggcccgccu

SEQ ID NO: 343743 - RNA, 31 nt, Human
caagugcuauuucagcaacaaccaucucauc

SEQ ID NO: 343744 - RNA, 31 nt, Human
caagugcucaauaaaugcuugcugauugacu

SEQ ID NO: 343745 - RNA, 32 nt, Human
caagugcuccacugaggcuuccguaacaccuc

SEQ ID NO: 343746 - RNA, 32 nt, Human
caagugcucccuauccaguccaaaggacccuc

SEQ ID NO: 343747 - RNA, 32 nt, Human
caagugcucucauaguucuauccucuaauucc

SEQ ID NO: 343748 - RNA, 32 nt, Human
caagugcucugccagccccuguucauccaagu

SEQ ID NO: 343749 - RNA, 32 nt, Human
caagugcucuguaaucacaggcagugguuuuc

SEQ ID NO: 343750 - RNA, 32 nt, Human
caagugcugaagaugaaauggaagagaaccgu

SEQ ID NO: 343751 - RNA, 32 nt, Human
caagugcugcauggaaaggcaauaucucuggu

SEQ ID NO: 343752 - RNA, 32 nt, Human
caagugcuggggcucauggugcucugagcugg

SEQ ID NO: 343753 - RNA, 32 nt, Human
caagugcugggucaagugucucaucauacugg

SEQ ID NO: 343754 - RNA, 32 nt, Human
caagugcuucacuuccaaauggagguucaugu

SEQ ID NO: 343755 - RNA, 32 nt, Human
caagugcuuccaggaacucagccugcacagag

SEQ ID NO: 343756 - RNA, 32 nt, Human
caagugcuucccagcccagaacagggguggau

SEQ ID NO: 343757 - RNA, 23 nt, Human
caaguggaaagccauucaucuua

SEQ ID NO: 343758 - RNA, 32 nt, Human
caaguggaagagaagaacuugaacccaggucc

SEQ ID NO: 343759 - RNA, 32 nt, Human
caaguggaaguuggaagaaccaguucuggagc

SEQ ID NO: 343760 - RNA, 32 nt, Human
caaguggacacauggcugugcaggccaggagg

SEQ ID NO: 343761 - RNA, 32 nt, Human
caaguggagacagugaagucaccccguguccu

SEQ ID NO: 343762 - RNA, 32 nt, Human
caaguggagaggguuaguuggcaguuaguucu

SEQ ID NO: 343763 - RNA, 32 nt, Human
caaguggagcuuuugcugauguguuccugacc

SEQ ID NO: 343764 - RNA, 32 nt, Human
caaguggaggcggaggaggaggcggaggaggg

SEQ ID NO: 343765 - RNA, 32 nt, Human
caaguggauaagaggagcggccugcaaccaug

SEQ ID NO: 343766 - RNA, 32 nt, Human
caaguggaugugucauauauugccaaacauua

SEQ ID NO: 343767 - RNA, 32 nt, Human
caaguggcauaacccauggauuuucuaaaggu

SEQ ID NO: 343768 - RNA, 32 nt, Human
caaguggcauuuucaucucgcuuucacccuga

SEQ ID NO: 343769 - RNA, 32 nt, Human
caaguggccaaagguggccuggguuuaauacu

SEQ ID NO: 343770 - RNA, 32 nt, Human
caaguggccaagauaaaguagaaaaaugcaca

SEQ ID NO: 343771 - RNA, 32 nt, Human
caaguggccaggaauucuccuccugcaccggg

SEQ ID NO: 343772 - RNA, 32 nt, Human
caaguggcucaagggauccuuuaugaucacag

SEQ ID NO: 343773 - RNA, 32 nt, Human
caaguggcucacaaccuccucagggcaccaga

SEQ ID NO: 343774 - RNA, 32 nt, Human
caaguggcugaucugaagaacucucuggggag

SEQ ID NO: 343775 - RNA, 23 nt, Human
caaguggcugggacugcaggcau

SEQ ID NO: 343776 - RNA, 22 nt, Human
caaguggcugggauuacaggcg

SEQ ID NO: 343777 - RNA, 23 nt, Human
caaguggcugggauugcaggcau

SEQ ID NO: 343778 - RNA, 32 nt, Human
caaguggcuguucugggaccauggaagccugg

SEQ ID NO: 343779 - RNA, 32 nt, Human
caagugggaggcaagcacaaguacaaaggcau

SEQ ID NO: 343780 - RNA, 32 nt, Human
caagugggaggcacagcgcagccgggaguugc

SEQ ID NO: 343781 - RNA, 32 nt, Human
caagugggaguuaagagaggucuggaaagugu

SEQ ID NO: 343782 - RNA, 32 nt, Human
caagugggcgguguccauuaaagagcagacuc

SEQ ID NO: 343783 - RNA, 32 nt, Human
caagugggcugcacuccuuucucuccaaccag

SEQ ID NO: 343784 - RNA, 32 nt, Human
caaguggggaggcaggugacagggacuccgag

SEQ ID NO: 343785 - RNA, 32 nt, Human
caagugggggcagagggcagaggcuggaggca

SEQ ID NO: 343786 - RNA, 32 nt, Human
caagugggggcugaggcagaggcagggauagc

SEQ ID NO: 343787 - RNA, 32 nt, Human
caaguggucccuggaccucucuugcauccauu

SEQ ID NO: 343788 - RNA, 32 nt, Human
caaguggucuucuacccugucuucuauguuug

SEQ ID NO: 343789 - RNA, 32 nt, Human
caaguggugugugcggcgguucaugccuguaa

SEQ ID NO: 343790 - RNA, 32 nt, Human
caagugguuaggacagugccuggcacauagua

SEQ ID NO: 343791 - RNA, 32 nt, Human
caaguguaacaucacaucuuggguacuucacc

SEQ ID NO: 343792 - RNA, 32 nt, Human
caaguguacagccacagcaaggagcccgacac

SEQ ID NO: 343793 - RNA, 32 nt, Human
caaguguaccucugcacucaaugcuggaauca

SEQ ID NO: 343794 - RNA, 32 nt, Human
caaguguacuugguuuaugcugugaaggaauu

SEQ ID NO: 343795 - RNA, 32 nt, Human
caaguguaguauccugaacuucucccauuaau

SEQ ID NO: 343796 - RNA, 32 nt, Human
caaguguaugggauuaacuaaucauugaaggc

SEQ ID NO: 343797 - RNA, 21 nt, Human
caagugucaugguuuaucuua

SEQ ID NO: 343798 - RNA, 32 nt, Human
caagugucccucuguacccacacccacccacu

SEQ ID NO: 343799 - RNA, 32 nt, Human
caagugucccuuuauauuuaaauuugaaaguu

SEQ ID NO: 343800 - RNA, 23 nt, Human
caaguguccggcuccagcaacuc

SEQ ID NO: 343801 - RNA, 32 nt, Human
caaguguccucccacuugagugccaccacgcc

SEQ ID NO: 343802 - RNA, 32 nt, Human
caaguguccuggacccuggccuaaagaauccc

SEQ ID NO: 343803 - RNA, 32 nt, Human
caagugucuaacuucugugccuguuaaucaug

SEQ ID NO: 343804 - RNA, 32 nt, Human
caagugucuccaggaacuggacguuggggcca

SEQ ID NO: 343805 - RNA, 29 nt, Human
caagugucucugugugugggugggugagg

SEQ ID NO: 343806 - RNA, 32 nt, Human
caagugucugggcuccuggcccagggguccgu

SEQ ID NO: 343807 - RNA, 32 nt, Human
caagugugaaaccucuggauccuauggauuug

SEQ ID NO: 343808 - RNA, 32 nt, Human
caagugugacauccuucagcacccagggacaa

SEQ ID NO: 343809 - RNA, 32 nt, Human
caagugugacuccacucaaguguccuuuucug

SEQ ID NO: 343810 - RNA, 32 nt, Human
caagugugagagaacugagcggggccuggaaa

SEQ ID NO: 343811 - RNA, 32 nt, Human
caagugugagccaccacacccagccuaaugua

SEQ ID NO: 343812 - RNA, 32 nt, Human
caagugugagccaccacaccuggccuggaagg

SEQ ID NO: 343813 - RNA, 32 nt, Human
caagugugagccaccacaccuggcuccagaaa

SEQ ID NO: 343814 - RNA, 32 nt, Human
caagugugagccaccacgccaagccugacuuu

SEQ ID NO: 343815 - RNA, 32 nt, Human
caagugugagccaccgcgccuggcccaagccc

SEQ ID NO: 343816 - RNA, 32 nt, Human
caagugugagccacugugccaggcacaauggu

SEQ ID NO: 343817 - RNA, 32 nt, Human
caagugugagccuauuguguuacuugaccuua

SEQ ID NO: 343818 - RNA, 32 nt, Human
caagugugagcugcggcugagcccagcgcucg

SEQ ID NO: 343819 - RNA, 32 nt, Human
caagugugagggcugaaagaaugccccagucu

SEQ ID NO: 343820 - RNA, 32 nt, Human
caagugugcaccaccaugccuggcuaauuuuu

SEQ ID NO: 343821 - RNA, 32 nt, Human
caagugugcacuccagcuucggaggcccugcg

SEQ ID NO: 343822 - RNA, 32 nt, Human
caagugugggcaacacagcaagaccccaucuc

SEQ ID NO: 343823 - RNA, 32 nt, Human
caaguguguaccaccaugccuggcugaacacu

SEQ ID NO: 343824 - RNA, 31 nt, Human
caaguguguggacgaaagaaagacugauggc

SEQ ID NO: 343825 - RNA, 32 nt, Human
caaguguucauaaugacuuuccaauuggcccu

SEQ ID NO: 343826 - RNA, 32 nt, Human
caaguguuccugcugccaguucuuuccucuuu

SEQ ID NO: 343827 - RNA, 32 nt, Human
caaguguuucaaggagcaaguagcuaagugug

SEQ ID NO: 343828 - RNA, 32 nt, Human
caaguuaaguguuuccuucccucucucaauaa

SEQ ID NO: 343829 - RNA, 32 nt, Human
caaguuaauaacaucaccuacucuccacuaau

SEQ ID NO: 343830 - RNA, 32 nt, Human
caaguuacccccagaggaucagagagggguug

SEQ ID NO: 343831 - RNA, 32 nt, Human
caaguuaccucaccuaauuuuugcuucucagg

SEQ ID NO: 343832 - RNA, 32 nt, Human
caaguuacgggagagucggcugugaaggagac

SEQ ID NO: 343833 - RNA, 32 nt, Human
caaguuaggaagcagaggaucagagaugggaa

SEQ ID NO: 343834 - RNA, 32 nt, Human
caaguuaucgagcuccuccucauguuucaaca

SEQ ID NO: 343835 - RNA, 32 nt, Human
caaguuaucuuucuguuccacacacaccuuau

SEQ ID NO: 343836 - RNA, 32 nt, Human
caaguuaugaggaaaagagggcugagggccug

SEQ ID NO: 343837 - RNA, 32 nt, Human
caaguuauuucuccuucucucugcuucaugca

SEQ ID NO: 343838 - RNA, 32 nt, Human
caaguucaagccaagagacuagcagagaaggu

SEQ ID NO: 343839 - RNA, 32 nt, Human
caaguucacaccacugccauuuccuccugggc

SEQ ID NO: 343840 - RNA, 32 nt, Human
caaguucacaccauucuccugccucagccucc

SEQ ID NO: 343841 - RNA, 32 nt, Human
caaguucagccgccaccggcacggccaggcca

SEQ ID NO: 343842 - RNA, 32 nt, Human
caaguucaggaggucaagaccauccuggcuaa

SEQ ID NO: 343843 - RNA, 32 nt, Human
caaguucagguggaacuuggccgacugaugcu

SEQ ID NO: 343844 - RNA, 32 nt, Human
caaguucaugccauucuccugccucagccucc

SEQ ID NO: 343845 - RNA, 32 nt, Human
caaguucauguaucuucugaauucuauccgug

SEQ ID NO: 343846 - RNA, 32 nt, Human
caaguuccacaggucugcuaccacaggccauc

SEQ ID NO: 343847 - RNA, 32 nt, Human
caaguuccacucccgcuuuccccacacauuac

SEQ ID NO: 343848 - RNA, 32 nt, Human
caaguuccaguaaaccacaaguauggcaaagc

SEQ ID NO: 343849 - RNA, 32 nt, Human
caaguuccaguaggugggacagugaugccguc

SEQ ID NO: 343850 - RNA, 32 nt, Human
caaguuccaguaugggaauuauugcaaauacu

SEQ ID NO: 343851 - RNA, 32 nt, Human
caaguucccaggugaugcugugcugcuugucc

SEQ ID NO: 343852 - RNA, 32 nt, Human
caaguucccuccaccuucuguauuuauacgcu

SEQ ID NO: 343853 - RNA, 32 nt, Human
caaguucccuucuccuuucucucccccggcgg

SEQ ID NO: 343854 - RNA, 32 nt, Human
caaguuccgccaggcccugccccaucgccagu

SEQ ID NO: 343855 - RNA, 32 nt, Human
caaguuccuccagcaaagcccagaacagaguu

SEQ ID NO: 343856 - RNA, 32 nt, Human
caaguuccucggagaucugccucugccucacc

SEQ ID NO: 343857 - RNA, 32 nt, Human
caaguucgaccagcuucuuugugccucuuuuc

SEQ ID NO: 343858 - RNA, 32 nt, Human
caaguucgccuuggcccugccuccagcucagg

SEQ ID NO: 343859 - RNA, 32 nt, Human
caaguucggcagugggagaguugaccguguca

SEQ ID NO: 343860 - RNA, 32 nt, Human
caaguucuacagccguucagugcugaguuguu

SEQ ID NO: 343861 - RNA, 32 nt, Human
caaguucuacagccuguagcccuggcccuucu

SEQ ID NO: 343862 - RNA, 32 nt, Human
caaguucuaggguacauguccacaaugcacau

SEQ ID NO: 343863 - RNA, 24 nt, Human
caaguucuauuucuugaagaauaa

SEQ ID NO: 343864 - RNA, 32 nt, Human
caaguucuauuuucucuacuucccaagggggu

SEQ ID NO: 343865 - RNA, 32 nt, Human
caaguucucccaggaaccccaguuggggaagg

SEQ ID NO: 343866 - RNA, 32 nt, Human
caaguugagcucugguaacugaucuuaauagc

SEQ ID NO: 343867 - RNA, 32 nt, Human
caaguugaggcugaacccggguacagucgcaa

SEQ ID NO: 343868 - RNA, 32 nt, Human
caaguugagggcugggucacaaaagugaguuc

SEQ ID NO: 343869 - RNA, 32 nt, Human
caaguugagggucucugguggggaaggacagg

SEQ ID NO: 343870 - RNA, 20 nt, Human
caaguugauguggauccuga

SEQ ID NO: 343871 - RNA, 32 nt, Human
caaguugcaacugaccuugaacugaaucacuc

SEQ ID NO: 343872 - RNA, 32 nt, Human
caaguugcaguuuaagguggucucagccaauu

SEQ ID NO: 343873 - RNA, 32 nt, Human
caaguugccaacaccugugggacccaggugag

SEQ ID NO: 343874 - RNA, 32 nt, Human
caaguugcccugcuaggcaguuguaaucuggc

SEQ ID NO: 343875 - RNA, 19 nt, Human
caaguugccggcuggcaaa

SEQ ID NO: 343876 - RNA, 32 nt, Human
caaguugcugcugagagaagaccugaguucag

SEQ ID NO: 343877 - RNA, 32 nt, Human
caaguugcugucuccccuucccucaccuccuc

SEQ ID NO: 343878 - RNA, 32 nt, Human
caaguuggaagguuguggauuuacaggaauga

SEQ ID NO: 343879 - RNA, 32 nt, Human
caaguuggagaaaaugugccuuucauucauua

SEQ ID NO: 343880 - RNA, 32 nt, Human
caaguuggagugaugcagccggaagggaaggg

SEQ ID NO: 343881 - RNA, 32 nt, Human
caaguuggcaaaauagacuguucacagaaacu

SEQ ID NO: 343882 - RNA, 32 nt, Human
caaguuggcaguugccuggugaucgagaaaga

SEQ ID NO: 343883 - RNA, 32 nt, Human
caaguugggaggcugaggcgggcagaucaucu

SEQ ID NO: 343884 - RNA, 32 nt, Human
caaguugggcccugaccuuucuguugcugucu

SEQ ID NO: 343885 - RNA, 32 nt, Human
caaguuggguggaugcugggaggcaggaggcu

SEQ ID NO: 343886 - RNA, 32 nt, Human
caaguuggucucaaacuccugaccucaaguga

SEQ ID NO: 343887 - RNA, 19 nt, Human
caaguugguuuggcaguaa

SEQ ID NO: 343888 - RNA, 32 nt, Human
caaguuguacucaaagcauucaguuaaagugu

SEQ ID NO: 343889 - RNA, 32 nt, Human
caaguuguauucccuggcaaaauggacuuucu

SEQ ID NO: 343890 - RNA, 32 nt, Human
caaguuguauucuuuuaaguucuuuuauucuc

SEQ ID NO: 343891 - RNA, 32 nt, Human
caaguuguccgagcuggaggccgcccugcagc

SEQ ID NO: 343892 - RNA, 32 nt, Human
caaguugugcuuuguggggacaaucauucuuu

SEQ ID NO: 343893 - RNA, 32 nt, Human
caaguuuaaugccaccuuccucugucugccau

SEQ ID NO: 343894 - RNA, 24 nt, Human
caaguuuacuuaggcaacacaaga

SEQ ID NO: 343895 - RNA, 32 nt, Human
caaguuuagguucucauaguguauuugaagua

SEQ ID NO: 343896 - RNA, 32 nt, Human
caaguuucacaaaucccaaugcugugcauuga

SEQ ID NO: 343897 - RNA, 32 nt, Human
caaguuucacucuuguggcugaugccaucauu

SEQ ID NO: 343898 - RNA, 32 nt, Human
caaguuucacucuuguggcugaugccauuauu

SEQ ID NO: 343899 - RNA, 32 nt, Human
caaguuucaguaagguguuuuagaugaacauc

SEQ ID NO: 343900 - RNA, 32 nt, Human
caaguuuccagaaagagaauagccauauaaau

SEQ ID NO: 343901 - RNA, 22 nt, Human
caaguuuccccagcuucaucuu

SEQ ID NO: 343902 - RNA, 32 nt, Human
caaguuuccgcaggaaguuuggugcugagcug

SEQ ID NO: 343903 - RNA, 32 nt, Human
caaguuuccuagcucugugcucaguuucaguu

SEQ ID NO: 343904 - RNA, 32 nt, Human
caaguuuccugaggcccucaccagaagcucau

SEQ ID NO: 343905 - RNA, 26 nt, Human
caaguuucuaauacagaauuauuuua

SEQ ID NO: 343906 - RNA, 21 nt, Human
caaguuucuagcagauauuuu

SEQ ID NO: 343907 - RNA, 32 nt, Human
caaguuucuccucugacccaucagcucccugu

SEQ ID NO: 343908 - RNA, 32 nt, Human
caaguuucuuugaggccacuugcccccaagca

SEQ ID NO: 343909 - RNA, 32 nt, Human
caaguuugaaguuucgccgcuuuugucaacua

SEQ ID NO: 343910 - RNA, 32 nt, Human
caaguuugagccacugcaccuggcuaacuugc

SEQ ID NO: 343911 - RNA, 23 nt, Human
caaguuugcauaaccuacuuuca

SEQ ID NO: 343912 - RNA, 32 nt, Human
caaguuugcugugcucucugcagcuacaaaac

SEQ ID NO: 343913 - RNA, 32 nt, Human
caaguuugcuuugcaaaccuuauggccuugca

SEQ ID NO: 343914 - RNA, 32 nt, Human
caaguuuggaauuggaugacuugugaagaggc

SEQ ID NO: 343915 - RNA, 32 nt, Human
caaguuuggccuggccuuagcuguugcaggag

SEQ ID NO: 343916 - RNA, 32 nt, Human
caaguuuggcgauuugcugucggugccucagc

SEQ ID NO: 343917 - RNA, 32 nt, Human
caaguuugugccucacacuccagccuggguaa

SEQ ID NO: 343918 - RNA, 22 nt, Human
caaguuuuaaauacuuaucuug

SEQ ID NO: 343919 - RNA, 32 nt, Human
caaguuuuaacucagaugcaagcuuuggcucu

SEQ ID NO: 343920 - RNA, 18 nt, Human
caaguuuuagcuggcaga

SEQ ID NO: 343921 - RNA, 32 nt, Human
caaguuuucagguaaaccucagcucaggacug

SEQ ID NO: 343922 - RNA, 32 nt, Human
caaguuuuccuaggaggaagggaagacagggu

SEQ ID NO: 343923 - RNA, 32 nt, Human
caaguuuugagaugcagagcuuuuauuccucu

SEQ ID NO: 343924 - RNA, 32 nt, Human
caaguuuugggcuugcuauauaauccauuuuu

SEQ ID NO: 343925 - RNA, 22 nt, Human
caaguuuuuaaauuuacucuug

SEQ ID NO: 343926 - RNA, 20 nt, Human
caaguuuuucagacucauuu

SEQ ID NO: 343927 - RNA, 18 nt, Human
caauaaaaacaacuuuca

SEQ ID NO: 343928 - RNA, 27 nt, Human
caauaaaaacauuugaagaauuguggc

SEQ ID NO: 343929 - RNA, 32 nt, Human
caauaaaagagaaaaucuccuggagaaaaaga

SEQ ID NO: 343930 - RNA, 32 nt, Human
caauaaaccaaggucaugagcauucgagcuaa

SEQ ID NO: 343931 - RNA, 32 nt, Human
caauaaaccuaaccuuuuaacagggucuaaca

SEQ ID NO: 343932 - RNA, 32 nt, Human
caauaaagaagaaaaacuguaguuguguagcu

SEQ ID NO: 343933 - RNA, 31 nt, Human
caauaaagcaacaacaagcuucaaggaauuc

SEQ ID NO: 343934 - RNA, 32 nt, Human
caauaaagguuuauggaacagaaacaaaguca

SEQ ID NO: 343935 - RNA, 32 nt, Human
caauaaaguugcaugguaaauauuucauuaca

SEQ ID NO: 343936 - RNA, 32 nt, Human
caauaaaguuuuccucuuccucuccucguacg

SEQ ID NO: 343937 - RNA, 32 nt, Human
caauaaauacaacagaaaauugcacagucaau

SEQ ID NO: 343938 - RNA, 32 nt, Human
caauaaaugucaaaugaaacaagcucuugugu

SEQ ID NO: 343939 - RNA, 32 nt, Human
caauaaaugugaauguuggaccccaaaugauu

SEQ ID NO: 343940 - RNA, 32 nt, Human
caauaaauuccugagauacauucuuccaaucu

SEQ ID NO: 343941 - RNA, 32 nt, Human
caauaaauugccuauaugugcaaagaaagaau

SEQ ID NO: 343942 - RNA, 32 nt, Human
caauaacacccaggcugagagucaaaccaaga

SEQ ID NO: 343943 - RNA, 23 nt, Human
caauaacaccuuccaaaaaccug

SEQ ID NO: 343944 - RNA, 32 nt, Human
caauaacagcaggucacagcugcucuucugga

SEQ ID NO: 343945 - RNA, 32 nt, Human
caauaacaggagacuuccauaaguuuguguau

SEQ ID NO: 343946 - RNA, 32 nt, Human
caauaacccuguuuaaagaggaauggagauug

SEQ ID NO: 343947 - RNA, 32 nt, Human
caauaacuaguaauaccaaagacuauuucaaa

SEQ ID NO: 343948 - RNA, 32 nt, Human
caauaacuauugcacaaccaccugucccugcc

SEQ ID NO: 343949 - RNA, 32 nt, Human
caauaacucagggagcuuauagaagugaagau

SEQ ID NO: 343950 - RNA, 32 nt, Human
caauaagaaaugcuagaaagcaauagggcggg

SEQ ID NO: 343951 - RNA, 32 nt, Human
caauaagagucuccuucucuucucuucuuugg

SEQ ID NO: 343952 - RNA, 32 nt, Human
caauaagauaugcacacacagguauuuuguug

SEQ ID NO: 343953 - RNA, 32 nt, Human
caauaagauauuacuacacaccugccaaaaug

SEQ ID NO: 343954 - RNA, 32 nt, Human
caauaagcaaagaaauaaaugcaugauguaau

SEQ ID NO: 343955 - RNA, 32 nt, Human
caauaaggcacuugugggugcacuacauagau

SEQ ID NO: 343956 - RNA, 32 nt, Human
caauaagguccaggcugagguagucucagaug

SEQ ID NO: 343957 - RNA, 32 nt, Human
caauaaggugccaugaaaucaaaaucaaaggg

SEQ ID NO: 343958 - RNA, 32 nt, Human
caauaaguauauacaucugagcacagauuauu

SEQ ID NO: 343959 - RNA, 32 nt, Human
caauaauacuuuuauccaugugcucaagaaag

SEQ ID NO: 343960 - RNA, 32 nt, Human
caauaauccauucaauagaauggaauuaaaac

SEQ ID NO: 343961 - RNA, 32 nt, Human
caauaauccuguuucacuugaaugaagggagu

SEQ ID NO: 343962 - RNA, 32 nt, Human
caauaaugacuauuucaaaauugcuaaaagau

SEQ ID NO: 343963 - RNA, 32 nt, Human
caauaaugcaauacaggagcugaaagaugaaa

SEQ ID NO: 343964 - RNA, 32 nt, Human
caauaaugcuguucuaacuacagugcucaaua

SEQ ID NO: 343965 - RNA, 32 nt, Human
caauaaugguggccuguagcugcuaagagcuu

SEQ ID NO: 343966 - RNA, 32 nt, Human
caauaauuaacucuuccucucuucugauaaau

SEQ ID NO: 343967 - RNA, 32 nt, Human
caauaauugccacauuuauuguccucaaaauu

SEQ ID NO: 343968 - RNA, 32 nt, Human
caauacaaaguagcacacuguguacuuugcaa

SEQ ID NO: 343969 - RNA, 32 nt, Human
caauacaagauuccugguuaaauuugaauuuc

SEQ ID NO: 343970 - RNA, 32 nt, Human
caauacacuguaguuacugccuagccagcagc

SEQ ID NO: 343971 - RNA, 32 nt, Human
caauacagacaacuuuguggcucuccuguucu

SEQ ID NO: 343972 - RNA, 32 nt, Human
caauacagcaggacauccaggacugaccacgu

SEQ ID NO: 343973 - RNA, 31 nt, Human
caauacaggaaauguucucagaugcugaugu

SEQ ID NO: 343974 - RNA, 32 nt, Human
caauacaggccuugcccugcugaaacuucccu

SEQ ID NO: 343975 - RNA, 18 nt, Human
caauacagucacacauca

SEQ ID NO: 343976 - RNA, 32 nt, Human
caauacaugaauaugguacagcucuucauuua

SEQ ID NO: 343977 - RNA, 24 nt, Human
caauacaugagaaagaugucuaug

SEQ ID NO: 343978 - RNA, 32 nt, Human
caauacaugggaagcuuugcugaaaaaguaaa

SEQ ID NO: 343979 - RNA, 32 nt, Human
caauacauuaacagacccuuuaucaacauaaa

SEQ ID NO: 343980 - RNA, 18 nt, Human
caauacauucuguguaua

SEQ ID NO: 343981 - RNA, 32 nt, Human
caauaccacaacaacacauuuugcagagcuuu

SEQ ID NO: 343982 - RNA, 23 nt, Human
caauaccaccaccaccaccacca

SEQ ID NO: 343983 - RNA, 32 nt, Human
caauacccugcucuuuacucaaugguacccag

SEQ ID NO: 343984 - RNA, 32 nt, Human
caauacccuuuauuuaaccccuacucuguuuu

SEQ ID NO: 343985 - RNA, 32 nt, Human
caauaccgauugcaccaccaaacuccauugca

SEQ ID NO: 343986 - RNA, 32 nt, Human
caauaccuagguuaccacacaccacuuuuuga

SEQ ID NO: 343987 - RNA, 32 nt, Human
caauaccucgaauuuccaaaagaggucaccag

SEQ ID NO: 343988 - RNA, 32 nt, Human
caauaccugggaccaugcucuccugggacugu

SEQ ID NO: 343989 - RNA, 32 nt, Human
caauaccugguuuccaccuuggacugacuuug

SEQ ID NO: 343990 - RNA, 32 nt, Human
caauacgcuaggauagaccggccacacgucag

SEQ ID NO: 343991 - RNA, 32 nt, Human
caauacgugagagcaugggcaagugaggauuu

SEQ ID NO: 343992 - RNA, 32 nt, Human
caauacuccagccuggugacagagugagacuc

SEQ ID NO: 343993 - RNA, 32 nt, Human
caauacucuagccccgcucucuuccccucuuu

SEQ ID NO: 343994 - RNA, 32 nt, Human
caauacucuuuugagguagauaccagaaccau

SEQ ID NO: 343995 - RNA, 32 nt, Human
caauacugaaugucccuuucuuugccauaaaa

SEQ ID NO: 343996 - RNA, 32 nt, Human
caauacugacauccuucaugacguuuucccga

SEQ ID NO: 343997 - RNA, 32 nt, Human
caauacugcaaucacgucucacugcagccuca

SEQ ID NO: 343998 - RNA, 32 nt, Human
caauacugccgcugcccccacccugcuucugc

SEQ ID NO: 343999 - RNA, 32 nt, Human
caauacuggcuauuuucucuucucgccguagu

SEQ ID NO: 344000 - RNA, 32 nt, Human
caauacuguccgguggacaaaaugacaauuga

SEQ ID NO: 344001 - RNA, 26 nt, Human
caauacugugacuuccaaacaauguu

SEQ ID NO: 344002 - RNA, 31 nt, Human
caauacugugagagaaagacuguacuccaua

SEQ ID NO: 344003 - RNA, 32 nt, Human
caauacuuacuucaaagaacguaauuuguggc

SEQ ID NO: 344004 - RNA, 32 nt, Human
caauacuugguauccaccggguaagagugguu

SEQ ID NO: 344005 - RNA, 32 nt, Human
caauacuuugggaggccgaggugggcagauca

SEQ ID NO: 344006 - RNA, 32 nt, Human
caauacuuugggaggcugaggcaagugaagca

SEQ ID NO: 344007 - RNA, 32 nt, Human
caauacuuuuugaaauugauguacuuaguuuc

SEQ ID NO: 344008 - RNA, 32 nt, Human
caauagaaaauguagagugcuuaaacaaaaau

SEQ ID NO: 344009 - RNA, 32 nt, Human
caauagaaaucaagaaagugauggucaggcca

SEQ ID NO: 344010 - RNA, 32 nt, Human
caauagaaaugagauuugguggagucuggauu

SEQ ID NO: 344011 - RNA, 24 nt, Human
caauagaacugugccccuccucag

SEQ ID NO: 344012 - RNA, 30 nt, Human
caauagaccagccugcaagaaagacaugug

SEQ ID NO: 344013 - RNA, 32 nt, Human
caauagaguauuucaaaauggaaucaggaucu

SEQ ID NO: 344014 - RNA, 31 nt, Human
caauagaguugaccuguuauuggauuuccug

SEQ ID NO: 344015 - RNA, 32 nt, Human
caauagaucugcaaauaaugaggacugaugua

SEQ ID NO: 344016 - RNA, 32 nt, Human
caauagaucuuccucaucccccaaacccaaca

SEQ ID NO: 344017 - RNA, 32 nt, Human
caauagcaacagacauuugcuuccugguggca

SEQ ID NO: 344018 - RNA, 32 nt, Human
caauagcaaucuuggcugaugugcacagucug

SEQ ID NO: 344019 - RNA, 32 nt, Human
caauagcacagcccuuguugaggucagcaggg

SEQ ID NO: 344020 - RNA, 32 nt, Human
caauagcaugaucacgacuuacugcagccuug

SEQ ID NO: 344021 - RNA, 32 nt, Human
caauagcccaggcuggagugcaguggcagagu

SEQ ID NO: 344022 - RNA, 24 nt, Human
caauagccccaucucuccugcuca

SEQ ID NO: 344023 - RNA, 32 nt, Human
caauagcccuggaaggcaagagcuguuuccuu

SEQ ID NO: 344024 - RNA, 32 nt, Human
caauagccuccauaauccucucagccuacaga

SEQ ID NO: 344025 - RNA, 32 nt, Human
caauagcucaaaaacacuaucauuucaacaua

SEQ ID NO: 344026 - RNA, 32 nt, Human
caauagcugcuggguccuggccgccuccuccc

SEQ ID NO: 344027 - RNA, 32 nt, Human
caauagcuuagagugggacuccugaucucccu

SEQ ID NO: 344028 - RNA, 32 nt, Human
caauagcuugcgcccauuggaaggggaaacgc

SEQ ID NO: 344029 - RNA, 21 nt, Human
caauaggaaaccccaacaggu

SEQ ID NO: 344030 - RNA, 32 nt, Human
caauaggacuguuuacugcccaccuccgccug

SEQ ID NO: 344031 - RNA, 32 nt, Human
caauaggaucuuauuuaguuauuugaaucugu

SEQ ID NO: 344032 - RNA, 32 nt, Human
caauaggauggcaccuuggaaagaaaaaugaa

SEQ ID NO: 344033 - RNA, 31 nt, Human
caauaggcauucaauaaauguugaaauaaug

SEQ ID NO: 344034 - RNA, 32 nt, Human
caauaggccugggaaagucgcacuuucaucca

SEQ ID NO: 344035 - RNA, 24 nt, Human
caauaggcucagcucaugaugaca

SEQ ID NO: 344036 - RNA, 32 nt, Human
caauaggcuucuccuugugugaucucagcuuc

SEQ ID NO: 344037 - RNA, 32 nt, Human
caauagggcgcagaggagagaacuuccgaagg

SEQ ID NO: 344038 - RNA, 32 nt, Human
caauagggcuguugggacuuucuugaaaagaa

SEQ ID NO: 344039 - RNA, 32 nt, Human
caauaguaaaacacaucaggucaggggguuaa

SEQ ID NO: 344040 - RNA, 32 nt, Human
caauagugaaugcuugcaaagauguggagaag

SEQ ID NO: 344041 - RNA, 32 nt, Human
caauagugagcagcacuguggugaggucccuu

SEQ ID NO: 344042 - RNA, 32 nt, Human
caauaguggacccagaggcagugcauaaaacc

SEQ ID NO: 344043 - RNA, 32 nt, Human
caauaguucauuccuggcugggcgcgguggcu

SEQ ID NO: 344044 - RNA, 24 nt, Human
caauaguuggcuucuccccuguca

SEQ ID NO: 344045 - RNA, 32 nt, Human
caauaguuugacauuuuucccucuuuuacauu

SEQ ID NO: 344046 - RNA, 32 nt, Human
caauauaucuuagaaaaagcacaggaaacaga

SEQ ID NO: 344047 - RNA, 32 nt, Human
caauaucaaaugcuauucaucagguuucuaua

SEQ ID NO: 344048 - RNA, 32 nt, Human
caauaucauaugcauuauaugcauaauaugau

SEQ ID NO: 344049 - RNA, 32 nt, Human
caauaucauccaguaccuuaagcccugauugu

SEQ ID NO: 344050 - RNA, 32 nt, Human
caauaucaugccacugcacuccagccugggug

SEQ ID NO: 344051 - RNA, 32 nt, Human
caauaucccaguaacaugugaagagaaagacu

SEQ ID NO: 344052 - RNA, 32 nt, Human
caauauccuuuuuauaaaaauucaugucugua

SEQ ID NO: 344053 - RNA, 32 nt, Human
caauaucgcaccacugcacuccagccugggca

SEQ ID NO: 344054 - RNA, 32 nt, Human
caauaucgugccacugcauuccagccugggug

SEQ ID NO: 344055 - RNA, 32 nt, Human
caauaugaauacagggcaugcauuuugcagca

SEQ ID NO: 344056 - RNA, 32 nt, Human
caauaugaccacacuccagccaaggacaaaau

SEQ ID NO: 344057 - RNA, 32 nt, Human
caauaugcauuuaaauacagucuuccauuugc

SEQ ID NO: 344058 - RNA, 19 nt, Human
caauauggcaaaacccugu

SEQ ID NO: 344059 - RNA, 32 nt, Human
caauauguacacgucucucaaacuaugaagag

SEQ ID NO: 344060 - RNA, 32 nt, Human
caauauguauuaaccugaaaaguguucaugau

SEQ ID NO: 344061 - RNA, 32 nt, Human
caauauucaaccacaguaaaagacucagugag

SEQ ID NO: 344062 - RNA, 31 nt, Human
caauauucaauaaagcugcugagaaucuagc

SEQ ID NO: 344063 - RNA, 32 nt, Human
caauauucagcugccgcugagaagauuagacu

SEQ ID NO: 344064 - RNA, 32 nt, Human
caauauucauuugguuguggagacugauuugc

SEQ ID NO: 344065 - RNA, 32 nt, Human
caauauucccugacccuucacccccaaucacc

SEQ ID NO: 344066 - RNA, 32 nt, Human
caauauucuuuuaaccucucugcagcauuuua

SEQ ID NO: 344067 - RNA, 32 nt, Human
caauauugaaaggaggugggggauugagggag

SEQ ID NO: 344068 - RNA, 32 nt, Human
caauauugcaaucacagcucacugcagccuca

SEQ ID NO: 344069 - RNA, 32 nt, Human
caauauugcaccauugcacuccugccugggca

SEQ ID NO: 344070 - RNA, 32 nt, Human
caauauuggcugcuugcuguggcucuccccgg

SEQ ID NO: 344071 - RNA, 32 nt, Human
caauauuggugacuaccuaaaugugauuuuug

SEQ ID NO: 344072 - RNA, 23 nt, Human
caauauuguaauccuagcacuuu

SEQ ID NO: 344073 - RNA, 32 nt, Human
caauauuugauguauaacuuccccuuaauuua

SEQ ID NO: 344074 - RNA, 21 nt, Human
caauauuuuccaguaacauua

SEQ ID NO: 344075 - RNA, 32 nt, Human
caaucaaagcaguuuccggcaaaggucagcug

SEQ ID NO: 344076 - RNA, 32 nt, Human
caaucaaauguguuugugggauuuucaguccg

SEQ ID NO: 344077 - RNA, 32 nt, Human
caaucaacacccugugucuagcucaggguuug

SEQ ID NO: 344078 - RNA, 32 nt, Human
caaucaacuuucagacuugaaccuucuuagcc

SEQ ID NO: 344079 - RNA, 32 nt, Human
caaucaauaacauuaucccugccugcauacau

SEQ ID NO: 344080 - RNA, 32 nt, Human
caaucaauacauguaacauguacauuguuuug

SEQ ID NO: 344081 - RNA, 32 nt, Human
caaucaaucaaugccagcgucguggcgggcgc

SEQ ID NO: 344082 - RNA, 32 nt, Human
caaucacaaggguagagaucuguugcgaggaa

SEQ ID NO: 344083 - RNA, 32 nt, Human
caaucacacagaaccacuuuuauucaacauag

SEQ ID NO: 344084 - RNA, 32 nt, Human
caaucacaccacuacucuccaaccugggugac

SEQ ID NO: 344085 - RNA, 32 nt, Human
caaucacaccugccugagaaggagugggcugu

SEQ ID NO: 344086 - RNA, 32 nt, Human
caaucacaccugcgggaaggaccaggaauaaa

SEQ ID NO: 344087 - RNA, 32 nt, Human
caaucacagcuacucaggaggcugaggcagaa

SEQ ID NO: 344088 - RNA, 32 nt, Human
caaucacaggcaggaagaugaagguucugugg

SEQ ID NO: 344089 - RNA, 32 nt, Human
caaucacagucuccagaagaucagcucaauug

SEQ ID NO: 344090 - RNA, 32 nt, Human
caaucacauaagagggaggcagaggagacuug

SEQ ID NO: 344091 - RNA, 32 nt, Human
caaucacaucacagaucacacugcaguuucca

SEQ ID NO: 344092 - RNA, 32 nt, Human
caaucaccauccuuuauaccaggauuugcaua

SEQ ID NO: 344093 - RNA, 32 nt, Human
caaucacgagacugggggaccggccgggccug

SEQ ID NO: 344094 - RNA, 32 nt, Human
caaucacucucuuuaccccaugcaugccaucc

SEQ ID NO: 344095 - RNA, 32 nt, Human
caaucacuguaaccugauucauccugggaugu

SEQ ID NO: 344096 - RNA, 32 nt, Human
caaucacuguccuggccaguugcaguggcuca

SEQ ID NO: 344097 - RNA, 32 nt, Human
caaucacuuuaccuauacaaaaugacugcuau

SEQ ID NO: 344098 - RNA, 32 nt, Human
caaucacuuucucuuugcuuuuagaggauagc

SEQ ID NO: 344099 - RNA, 20 nt, Human
caaucagaaucaucauauca

SEQ ID NO: 344100 - RNA, 32 nt, Human
caaucagacaugaaaacucuggcuccaaaaau

SEQ ID NO: 344101 - RNA, 32 nt, Human
caaucagacaugaaaucucuggcuccaaaaau

SEQ ID NO: 344102 - RNA, 32 nt, Human
caaucagagacugucucgaucucuccacucac

SEQ ID NO: 344103 - RNA, 32 nt, Human
caaucagaugcagcuuucuccuucgucugguc

SEQ ID NO: 344104 - RNA, 32 nt, Human
caaucagauugguuuuauucuuuuauuuuacg

SEQ ID NO: 344105 - RNA, 32 nt, Human
caaucagcagaugacccccaggccuuggcagc

SEQ ID NO: 344106 - RNA, 32 nt, Human
caaucagcugccauccugcccuccagggacaa

SEQ ID NO: 344107 - RNA, 32 nt, Human
caaucagcuggguuuacugugauucaguaagg

SEQ ID NO: 344108 - RNA, 32 nt, Human
caaucaggagaaggguucugccucccaucccc

SEQ ID NO: 344109 - RNA, 32 nt, Human
caaucagggucauaaccauccaugcagacaug

SEQ ID NO: 344110 - RNA, 32 nt, Human
caaucaggucagaaagggaugagugaagaagc

SEQ ID NO: 344111 - RNA, 32 nt, Human
caaucaggucuaccccagagagguccuagggc

SEQ ID NO: 344112 - RNA, 32 nt, Human
caaucagguggaggcugcauggcuggaaggcc

SEQ ID NO: 344113 - RNA, 32 nt, Human
caaucagguuucuaaauaaacaacuggaccau

SEQ ID NO: 344114 - RNA, 32 nt, Human
caaucaguaagcccacagggaaauguuugauu

SEQ ID NO: 344115 - RNA, 32 nt, Human
caaucagucaccaggcucuccccaaaaccaug

SEQ ID NO: 344116 - RNA, 32 nt, Human
caaucagucaugugaccacacccuccucccuc

SEQ ID NO: 344117 - RNA, 32 nt, Human
caaucaguggggcagccagagcucagaccuga

SEQ ID NO: 344118 - RNA, 32 nt, Human
caaucagugguuuggagcaacagugaaagcuc

SEQ ID NO: 344119 - RNA, 32 nt, Human
caaucauaaagugaaugacaaacccuuugaau

SEQ ID NO: 344120 - RNA, 32 nt, Human
caaucauacaugcacacugacucugaacuggg

SEQ ID NO: 344121 - RNA, 32 nt, Human
caaucauagcaagcaagaaaggcuccaguguc

SEQ ID NO: 344122 - RNA, 32 nt, Human
caaucauaguacaggcaucacaggcagaaaaa

SEQ ID NO: 344123 - RNA, 32 nt, Human
caaucauauaggucuggaauacaucuuucauu

SEQ ID NO: 344124 - RNA, 32 nt, Human
caaucaucacuuagugguggugagugacuugu

SEQ ID NO: 344125 - RNA, 32 nt, Human
caaucaucugacccuucuuggagucucauauu

SEQ ID NO: 344126 - RNA, 32 nt, Human
caaucaucuuuauauacuuuccuuacaaaccc

SEQ ID NO: 344127 - RNA, 32 nt, Human
caaucaugagugcguggcuggggacagaccuc

SEQ ID NO: 344128 - RNA, 32 nt, Human
caaucaugcaauucuucagcucuuccagggag

SEQ ID NO: 344129 - RNA, 32 nt, Human
caaucaugcccugccuugucccucucacuccc

SEQ ID NO: 344130 - RNA, 30 nt, Human
caaucauggacagcaacaauuucuuaggca

SEQ ID NO: 344131 - RNA, 32 nt, Human
caaucaugggugagcugauuuacaucuuuaua

SEQ ID NO: 344132 - RNA, 32 nt, Human
caaucauguauuucaccguuugcacuuuuugu

SEQ ID NO: 344133 - RNA, 32 nt, Human
caaucaugucgagucacuggacucugaaaauc

SEQ ID NO: 344134 - RNA, 32 nt, Human
caaucauguggacacaagcauaaguaaagaaa

SEQ ID NO: 344135 - RNA, 32 nt, Human
caaucauugucuccugagauuuuucuaauuag

SEQ ID NO: 344136 - RNA, 32 nt, Human
caauccaagagucugaugauuucuugaaaagg

SEQ ID NO: 344137 - RNA, 32 nt, Human
caauccacaaaugaugcaggugcaaaugguuu

SEQ ID NO: 344138 - RNA, 32 nt, Human
caauccacuucuucaagcuccaacacaaaugc

SEQ ID NO: 344139 - RNA, 32 nt, Human
caauccagaaauucauguuagaacauugucag

SEQ ID NO: 344140 - RNA, 32 nt, Human
caauccagacacacucacacucucaucucuuu

SEQ ID NO: 344141 - RNA, 32 nt, Human
caauccagcaugcuuucauucuuucugaauaa

SEQ ID NO: 344142 - RNA, 32 nt, Human
caauccagcauuuguagcagguuuugaauggg

SEQ ID NO: 344143 - RNA, 32 nt, Human
caauccagccugggcaacagagcgaggucccg

SEQ ID NO: 344144 - RNA, 32 nt, Human
caauccagccugggcaacgagcaagacccagu

SEQ ID NO: 344145 - RNA, 32 nt, Human
caauccagccugggcgacaaagcaagacucug

SEQ ID NO: 344146 - RNA, 32 nt, Human
caauccagccugggcgauagagugagacuacg

SEQ ID NO: 344147 - RNA, 32 nt, Human
caauccagccugggcggagccggaguugcgag

SEQ ID NO: 344148 - RNA, 32 nt, Human
caauccagcggcagaggagugagaggacugug

SEQ ID NO: 344149 - RNA, 32 nt, Human
caauccaggcuacaaucuucauuuaauauaaa

SEQ ID NO: 344150 - RNA, 32 nt, Human
caauccaggcuggaguugguuuauccuuggca

SEQ ID NO: 344151 - RNA, 32 nt, Human
caauccaucuggaagguggauagccauggcag

SEQ ID NO: 344152 - RNA, 32 nt, Human
caaucccaacacuuugggaggcugaggaaggg

SEQ ID NO: 344153 - RNA, 32 nt, Human
caaucccaacagccaaacuucugccacucaca

SEQ ID NO: 344154 - RNA, 32 nt, Human
caaucccaacuaagggcaggacccaggcagaa

SEQ ID NO: 344155 - RNA, 32 nt, Human
caaucccaaucccaccaccgggaacacccagg

SEQ ID NO: 344156 - RNA, 32 nt, Human
caaucccagacuuuucuuuuguagucaccuca

SEQ ID NO: 344157 - RNA, 32 nt, Human
caaucccagcacuuuggaaggccgaggugggc

SEQ ID NO: 344158 - RNA, 32 nt, Human
caaucccagcacuuugggaggccgaggcaggu

SEQ ID NO: 344159 - RNA, 32 nt, Human
caaucccagcacuuugggaggccgaggcgggc

SEQ ID NO: 344160 - RNA, 32 nt, Human
caaucccagcacuuugggaggccgaggugggc

SEQ ID NO: 344161 - RNA, 32 nt, Human
caaucccagccugucacgucaugccuagugag

SEQ ID NO: 344162 - RNA, 32 nt, Human
caaucccagcuacaugggaggcugaggcagga

SEQ ID NO: 344163 - RNA, 32 nt, Human
caaucccagcuacucaagaggcugaggcagga

SEQ ID NO: 344164 - RNA, 32 nt, Human
caaucccagcuacucaggaggcugaggcagga

SEQ ID NO: 344165 - RNA, 32 nt, Human
caaucccagcuacucauaaggcugagguggga

SEQ ID NO: 344166 - RNA, 32 nt, Human
caaucccagcuacucgggaggcugaggcaaga

SEQ ID NO: 344167 - RNA, 32 nt, Human
caaucccagcuacucgggaggcugaggcacaa

SEQ ID NO: 344168 - RNA, 32 nt, Human
caaucccagcuacuugagaggcugaggccgga

SEQ ID NO: 344169 - RNA, 32 nt, Human
caaucccagcuacuuggaaggcugaggcagga

SEQ ID NO: 344170 - RNA, 32 nt, Human
caaucccagcuacuugggaggcugaggcagga

SEQ ID NO: 344171 - RNA, 32 nt, Human
caaucccagcuauuugggaggcugaggcgaga

SEQ ID NO: 344172 - RNA, 32 nt, Human
caaucccagugcuuugggaggcugagguggga

SEQ ID NO: 344173 - RNA, 32 nt, Human
caaucccaucucgcaggagagcagggucuggg

SEQ ID NO: 344174 - RNA, 32 nt, Human
caauccccaacaauuaggaacuggacccuggg

SEQ ID NO: 344175 - RNA, 32 nt, Human
caauccccucaaggaucugcauucaggccugc

SEQ ID NO: 344176 - RNA, 32 nt, Human
caauccccugcauacacacuucccaggggaca

SEQ ID NO: 344177 - RNA, 32 nt, Human
caauccccuugccaccacuuugcaucaccugg

SEQ ID NO: 344178 - RNA, 32 nt, Human
caauccccuuugccaucucugcucucacuggg

SEQ ID NO: 344179 - RNA, 32 nt, Human
caaucccggcauccagccuucagucccgccca

SEQ ID NO: 344180 - RNA, 32 nt, Human
caaucccgugaggugagcagagcaguauuugu

SEQ ID NO: 344181 - RNA, 19 nt, Human
caaucccuaugcauugcca

SEQ ID NO: 344182 - RNA, 32 nt, Human
caaucccucacugcugccucaacuuccugggc

SEQ ID NO: 344183 - RNA, 32 nt, Human
caaucccucuccacucuucucuccuuucuccc

SEQ ID NO: 344184 - RNA, 32 nt, Human
caaucccucugcacuccaaaaccggagcccgu

SEQ ID NO: 344185 - RNA, 32 nt, Human
caaucccugaguaucucgggaaggaggugucc

SEQ ID NO: 344186 - RNA, 32 nt, Human
caauccgccucccagguucaagcgauucuccc

SEQ ID NO: 344187 - RNA, 32 nt, Human
caauccggguccugccuuccaacuacaacuuu

SEQ ID NO: 344188 - RNA, 32 nt, Human
caauccuacuuuucgaacaccaaaaaugaugc

SEQ ID NO: 344189 - RNA, 32 nt, Human
caauccuagcacuuugggaggcugaggugagc

SEQ ID NO: 344190 - RNA, 32 nt, Human
caauccucaaauagugauuauuucauuuguuc

SEQ ID NO: 344191 - RNA, 32 nt, Human
caauccucagccacuuugguguuuucucaagg

SEQ ID NO: 344192 - RNA, 32 nt, Human
caauccucagggaagugggggugccggaggag

SEQ ID NO: 344193 - RNA, 32 nt, Human
caauccucauucucugccuccuggacccucau

SEQ ID NO: 344194 - RNA, 32 nt, Human
caauccuccugccucagccucccaaagcacgg

SEQ ID NO: 344195 - RNA, 32 nt, Human
caauccuccugccucagccucccaagcagcug

SEQ ID NO: 344196 - RNA, 32 nt, Human
caauccuccugccucagccucccuaguagcug

SEQ ID NO: 344197 - RNA, 32 nt, Human
caauccuccugccucagccuccugaacagcug

SEQ ID NO: 344198 - RNA, 32 nt, Human
caauccuccugccucagccuccugaguagcug

SEQ ID NO: 344199 - RNA, 32 nt, Human
caauccuccugccucagccucgcaaguagcug

SEQ ID NO: 344200 - RNA, 32 nt, Human
caauccuccugccucagcuccugaguagcugg

SEQ ID NO: 344201 - RNA, 32 nt, Human
caauccuccugccucugcccccugagcagcug

SEQ ID NO: 344202 - RNA, 32 nt, Human
caauccuccugccucugccucccaaguagcug

SEQ ID NO: 344203 - RNA, 32 nt, Human
caauccucuugguggaggaagcucggcugauu

SEQ ID NO: 344204 - RNA, 32 nt, Human
caauccugaagcacagugaacuugaaagaucu

SEQ ID NO: 344205 - RNA, 32 nt, Human
caauccugccucacuggccuuacccuccuccu

SEQ ID NO: 344206 - RNA, 31 nt, Human
caauccugccucuuuauggucugguucacag

SEQ ID NO: 344207 - RNA, 32 nt, Human
caauccugcuuuguuaaagcaaaaacuaugcg

SEQ ID NO: 344208 - RNA, 32 nt, Human
caauccuggcccugagccucagccucugccau

SEQ ID NO: 344209 - RNA, 32 nt, Human
caauccugggagaagaggaaaaaggagcuaau

SEQ ID NO: 344210 - RNA, 32 nt, Human
caauccuguggccacauggcacaaaacaccaa

SEQ ID NO: 344211 - RNA, 32 nt, Human
caauccugugggugaagagagagggaaacaca

SEQ ID NO: 344212 - RNA, 32 nt, Human
caauccuuccaccucagacuccaaagcauugg

SEQ ID NO: 344213 - RNA, 23 nt, Human
caauccuuccaccuugcccuccc

SEQ ID NO: 344214 - RNA, 32 nt, Human
caauccuuccuuguaucaaaauucccaggucu

SEQ ID NO: 344215 - RNA, 32 nt, Human
caaucgacauccuagccccacccagagguggc

SEQ ID NO: 344216 - RNA, 32 nt, Human
caaucgcggagagaucaaagggucugagucug

SEQ ID NO: 344217 - RNA, 32 nt, Human
caaucggacuccuggucuccuccggggaugcu

SEQ ID NO: 344218 - RNA, 31 nt, Human
caaucggaguucuccccuugccggagcugcc

SEQ ID NO: 344219 - RNA, 32 nt, Human
caaucggcaauuugacuugcucugcugcaugu

SEQ ID NO: 344220 - RNA, 32 nt, Human
caaucggcuacuguucuguucuguauuuuggc

SEQ ID NO: 344221 - RNA, 32 nt, Human
caaucgguagagaagagacaguuuaauauuug

SEQ ID NO: 344222 - RNA, 32 nt, Human
caaucgguccgaguggcugucggcucuucagc

SEQ ID NO: 344223 - RNA, 32 nt, Human
caaucgucacccacauuggagugcagugguac

SEQ ID NO: 344224 - RNA, 32 nt, Human
caaucgugagaucauauuugagguaucuucuu

SEQ ID NO: 344225 - RNA, 32 nt, Human
caaucuaagccccauucccugucucuuuacau

SEQ ID NO: 344226 - RNA, 32 nt, Human
caaucuacaaaaccaguagccaaacaggaucu

SEQ ID NO: 344227 - RNA, 32 nt, Human
caaucuagccugggugacagagcaagacuuug

SEQ ID NO: 344228 - RNA, 32 nt, Human
caaucuauucuugccacaucaagggauuguua

SEQ ID NO: 344229 - RNA, 32 nt, Human
caaucucaacuuugauuucacucggaguuacc

SEQ ID NO: 344230 - RNA, 32 nt, Human
caaucucacugcaaccuccgccuuccaguugc

SEQ ID NO: 344231 - RNA, 32 nt, Human
caaucucacugcaagcucugccucccagguuc

SEQ ID NO: 344232 - RNA, 32 nt, Human
caaucucacugcauccuccgccucccggguuc

SEQ ID NO: 344233 - RNA, 32 nt, Human
caaucucagcuacucaggaggcugaggcagga

SEQ ID NO: 344234 - RNA, 32 nt, Human
caaucucagcuacucgggaggcugaggcagga

SEQ ID NO: 344235 - RNA, 32 nt, Human
caaucucagcuucagaccaggagccaagagac

SEQ ID NO: 344236 - RNA, 32 nt, Human
caaucuccaucuuuagggucuccacagacuaa

SEQ ID NO: 344237 - RNA, 32 nt, Human
caaucucccaggaaggcagggggcagaaucuu

SEQ ID NO: 344238 - RNA, 19 nt, Human
caaucuccccucccuccca

SEQ ID NO: 344239 - RNA, 32 nt, Human
caaucuccccucccucccaucccccaccuucg

SEQ ID NO: 344240 - RNA, 24 nt, Human
caaucuccugaccucaugauccac

SEQ ID NO: 344241 - RNA, 24 nt, Human
caaucuccugaccucgugauccac

SEQ ID NO: 344242 - RNA, 24 nt, Human
caaucuccugaccuugugauccac

SEQ ID NO: 344243 - RNA, 32 nt, Human
caaucuccugacugcacuggccugacugcccc

SEQ ID NO: 344244 - RNA, 32 nt, Human
caaucuccugagaccagccucuaccuccagau

SEQ ID NO: 344245 - RNA, 32 nt, Human
caaucucgacucugcucuuugccaguucaguc

SEQ ID NO: 344246 - RNA, 32 nt, Human
caaucucggcucacugcagucaccuccucuca

SEQ ID NO: 344247 - RNA, 32 nt, Human
caaucucggcucauggcaagcuccgccuccug

SEQ ID NO: 344248 - RNA, 32 nt, Human
caaucucuagccccucuccugcucucagaggu

SEQ ID NO: 344249 - RNA, 18 nt, Human
caaucucuaggacucucc

SEQ ID NO: 344250 - RNA, 32 nt, Human
caaucucucuccccaucuucgcauauucugau

SEQ ID NO: 344251 - RNA, 32 nt, Human
caaucucucucccccucauuucucuuccuccu

SEQ ID NO: 344252 - RNA, 32 nt, Human
caaucucugcuucagacucuggguaauuacua

SEQ ID NO: 344253 - RNA, 32 nt, Human
caaucugaagacagaauacuucuaacacccag

SEQ ID NO: 344254 - RNA, 32 nt, Human
caaucugacuaacacggugaaaccccaucucu

SEQ ID NO: 344255 - RNA, 32 nt, Human
caaucugacugagcccugacugccuuuguuuu

SEQ ID NO: 344256 - RNA, 32 nt, Human
caaucugagggaggggauaaagaggaagcaau

SEQ ID NO: 344257 - RNA, 32 nt, Human
caaucugcaaaauggggauggggaagguucaa

SEQ ID NO: 344258 - RNA, 32 nt, Human
caaucugcacuguccagccuagcaggccgccg

SEQ ID NO: 344259 - RNA, 32 nt, Human
caaucuggaaggcagagguugcagugagauug

SEQ ID NO: 344260 - RNA, 32 nt, Human
caaucuggacauugaauaaauauucauuuucc

SEQ ID NO: 344261 - RNA, 31 nt, Human
caaucuggacucucuggacacugugcaugcu

SEQ ID NO: 344262 - RNA, 32 nt, Human
caaucuggacucucuggacacugugcaugcua

SEQ ID NO: 344263 - RNA, 21 nt, Human
caaucuggauggcuucaucca

SEQ ID NO: 344264 - RNA, 32 nt, Human
caaucuggccaacauggcgaaaccccgucuuu

SEQ ID NO: 344265 - RNA, 32 nt, Human
caaucuggccaacauggugaaaccccaucucu

SEQ ID NO: 344266 - RNA, 32 nt, Human
caaucugggaauggguuggauggggagggaga

SEQ ID NO: 344267 - RNA, 32 nt, Human
caaucugggagccuuccuggccagucugagug

SEQ ID NO: 344268 - RNA, 32 nt, Human
caaucugggagguggaaguugcagugagccga

SEQ ID NO: 344269 - RNA, 32 nt, Human
caaucugggcaacauggggaaaccccagcucu

SEQ ID NO: 344270 - RNA, 32 nt, Human
caaucugucacccaggcuggagcgcaguggug

SEQ ID NO: 344271 - RNA, 32 nt, Human
caaucugucagccaggugugguggcucaggcc

SEQ ID NO: 344272 - RNA, 32 nt, Human
caaucugugcagacauucauguuuagaugauu

SEQ ID NO: 344273 - RNA, 21 nt, Human
caaucuguguugaagcugcuu

SEQ ID NO: 344274 - RNA, 32 nt, Human
caaucuguuacccaggcuggagugcaguggug

SEQ ID NO: 344275 - RNA, 32 nt, Human
caaucuuacuauauguaacuucagacaaagug

SEQ ID NO: 344276 - RNA, 32 nt, Human
caaucuucaaacugagccaugcuuuaggggag

SEQ ID NO: 344277 - RNA, 32 nt, Human
caaucuucaagcaaucuuggaauccucaacug

SEQ ID NO: 344278 - RNA, 32 nt, Human
caaucuucacuccagucucugccucuguguuc

SEQ ID NO: 344279 - RNA, 32 nt, Human
caaucuucaguauuuuuaaauuguaaaugaau

SEQ ID NO: 344280 - RNA, 32 nt, Human
caaucuuccugccucaggcuucugaguagcua

SEQ ID NO: 344281 - RNA, 32 nt, Human
caaucuugaacccucuaugcagugagagcauu

SEQ ID NO: 344282 - RNA, 32 nt, Human
caaucuugaccaucacuaucacugccuucuuu

SEQ ID NO: 344283 - RNA, 32 nt, Human
caaucuugccuucugguuucuuccagccacau

SEQ ID NO: 344284 - RNA, 32 nt, Human
caaucuugugaaucugccacagcuccaagaug

SEQ ID NO: 344285 - RNA, 32 nt, Human
caaucuuucaggccauuucccccaccaucaac

SEQ ID NO: 344286 - RNA, 32 nt, Human
caaucuuucauucugugugacagaaguaguag

SEQ ID NO: 344287 - RNA, 32 nt, Human
caaucuuuccuucugucaacggcaggggcagg

SEQ ID NO: 344288 - RNA, 32 nt, Human
caaucuuucucccagccugccuccaagggaau

SEQ ID NO: 344289 - RNA, 32 nt, Human
caaucuuuuucccaggccccagccucucuggc

SEQ ID NO: 344290 - RNA, 32 nt, Human
caaugaaaacagucccaucgcucuuacccggu

SEQ ID NO: 344291 - RNA, 32 nt, Human
caaugaaaacagucccaucgcucuuagccggu

SEQ ID NO: 344292 - RNA, 24 nt, Human
caaugaaaacauguacuacagcua

SEQ ID NO: 344293 - RNA, 32 nt, Human
caaugaaagauaacacucugggcacagcuaaa

SEQ ID NO: 344294 - RNA, 32 nt, Human
caaugaaaggcuauccucugagaggagcaggg

SEQ ID NO: 344295 - RNA, 32 nt, Human
caaugaaauaucucccuggcaggguccucuuc

SEQ ID NO: 344296 - RNA, 17 nt, Human
caaugaaaucaaugaaa

SEQ ID NO: 344297 - RNA, 32 nt, Human
caaugaaaugagaagauaaaauucagcguugg

SEQ ID NO: 344298 - RNA, 32 nt, Human
caaugaacaguuucaggcuggcguggugugcc

SEQ ID NO: 344299 - RNA, 32 nt, Human
caaugaagaaucaucuuucuucauucaacaca

SEQ ID NO: 344300 - RNA, 32 nt, Human
caaugaaggagagaggagcauggggugucccg

SEQ ID NO: 344301 - RNA, 32 nt, Human
caaugaaggccuuucugaugaggucucagaug

SEQ ID NO: 344302 - RNA, 32 nt, Human
caaugaaucaaaacacagauaaaaucaguggu

SEQ ID NO: 344303 - RNA, 32 nt, Human
caaugaaucaguacuuuguuuccccagguaga

SEQ ID NO: 344304 - RNA, 32 nt, Human
caaugaauccacccugcuccacugcgcgccuc

SEQ ID NO: 344305 - RNA, 32 nt, Human
caaugaauugaauaucuaauaaggagauuuaa

SEQ ID NO: 344306 - RNA, 32 nt, Human
caaugacaaacacacaacauuacacacauaua

SEQ ID NO: 344307 - RNA, 32 nt, Human
caaugacaaacacacauuacacacacaacauc

SEQ ID NO: 344308 - RNA, 32 nt, Human
caaugacaacaacauuacuaaccuguggaguc

SEQ ID NO: 344309 - RNA, 32 nt, Human
caaugacaacaucacaaggggaagggagggau

SEQ ID NO: 344310 - RNA, 32 nt, Human
caaugacacacacaucacacacacaucacaau

SEQ ID NO: 344311 - RNA, 32 nt, Human
caaugacaccagucuggacucugggguggaca

SEQ ID NO: 344312 - RNA, 32 nt, Human
caaugacauggucaugcgucacugcagccucc

SEQ ID NO: 344313 - RNA, 32 nt, Human
caaugacauguacagccaucugggacaugccu

SEQ ID NO: 344314 - RNA, 32 nt, Human
caaugaccagagaauuuucucugcccuuucug

SEQ ID NO: 344315 - RNA, 32 nt, Human
caaugaccagccugcaaccauccugccuuucc

SEQ ID NO: 344316 - RNA, 32 nt, Human
caaugaccaucuugaaccacagauuucugcua

SEQ ID NO: 344317 - RNA, 32 nt, Human
caaugaccuaugucacaagagguggcguguaa

SEQ ID NO: 344318 - RNA, 32 nt, Human
caaugacggcaaccucugagccaucccagagc

SEQ ID NO: 344319 - RNA, 32 nt, Human
caaugacggggugggagaggggagaggagaga

SEQ ID NO: 344320 - RNA, 32 nt, Human
caaugacuccggcuuugacacaacaccuuacc

SEQ ID NO: 344321 - RNA, 32 nt, Human
caaugacugagcaggcccagccccagaggaca

SEQ ID NO: 344322 - RNA, 32 nt, Human
caaugacugcagcaccuccugggcuuacacaa

SEQ ID NO: 344323 - RNA, 32 nt, Human
caaugacuggcugggugcaguggcucaugccu

SEQ ID NO: 344324 - RNA, 32 nt, Human
caaugacugugcuacugucuuuggaaaaaugu

SEQ ID NO: 344325 - RNA, 32 nt, Human
caaugacuugaucaucugcuuccuuuuugaau

SEQ ID NO: 344326 - RNA, 32 nt, Human
caaugagacugugcacaaugaagagaaaggag

SEQ ID NO: 344327 - RNA, 32 nt, Human
caaugagagcaguccuguuucauucacauggg

SEQ ID NO: 344328 - RNA, 32 nt, Human
caaugagaggaaccagguaccucuguuggaaa

SEQ ID NO: 344329 - RNA, 32 nt, Human
caaugagauaucacaucacaacuguuaggaug

SEQ ID NO: 344330 - RNA, 32 nt, Human
caaugagauggaaacuccucccucauucagau

SEQ ID NO: 344331 - RNA, 32 nt, Human
caaugagcagcccaggccugggcaaaaagcgc

SEQ ID NO: 344332 - RNA, 32 nt, Human
caaugagcccccaacagagcucuucaucuuac

SEQ ID NO: 344333 - RNA, 32 nt, Human
caaugagcuacugcuuuccgcugccuuccaca

SEQ ID NO: 344334 - RNA, 31 nt, Human
caaugagcuccuuguuuuugccaaaguuucu

SEQ ID NO: 344335 - RNA, 32 nt, Human
caaugagcugggcuuuguugggccaguuucau

SEQ ID NO: 344336 - RNA, 32 nt, Human
caaugagcuuucugaacagcugguguagcuac

SEQ ID NO: 344337 - RNA, 32 nt, Human
caaugaggaccccagccccacuucccuggaac

SEQ ID NO: 344338 - RNA, 32 nt, Human
caaugaggagagaccugcuuuugcagguggau

SEQ ID NO: 344339 - RNA, 32 nt, Human
caaugaggcaguaggagguggggaagaaaaga

SEQ ID NO: 344340 - RNA, 32 nt, Human
caaugagggaggcaggcaauaugcagugaaaa

SEQ ID NO: 344341 - RNA, 32 nt, Human
caaugaggggcaggaaagggguacagaaugaa

SEQ ID NO: 344342 - RNA, 32 nt, Human
caaugaggucaucucauccuugaggggagcag

SEQ ID NO: 344343 - RNA, 19 nt, Human
caaugagucucaguucuga

SEQ ID NO: 344344 - RNA, 32 nt, Human
caaugagucugccugggaugugugugaauccc

SEQ ID NO: 344345 - RNA, 32 nt, Human
caaugagucuguuucuuguaauggcugaccag

SEQ ID NO: 344346 - RNA, 32 nt, Human
caaugagugaugaggcaggaaaagagggccag

SEQ ID NO: 344347 - RNA, 32 nt, Human
caaugagugggggaggagagcagcuggauauc

SEQ ID NO: 344348 - RNA, 32 nt, Human
caaugaguguaauguauuuucucccaauagua

SEQ ID NO: 344349 - RNA, 32 nt, Human
caaugaguguuacagagagcuugcugugacua

SEQ ID NO: 344350 - RNA, 32 nt, Human
caaugaguucuacgcgugagcuugcuuguggg

SEQ ID NO: 344351 - RNA, 32 nt, Human
caaugauagggagguuggacagcucaguuccc

SEQ ID NO: 344352 - RNA, 32 nt, Human
caaugaugccuagugaguauguguccacaggc

SEQ ID NO: 344353 - RNA, 32 nt, Human
caaugauggaaauuauuucaucagguggaaag

SEQ ID NO: 344354 - RNA, 32 nt, Human
caaugauggagucccuguuaaaggucaaaaau

SEQ ID NO: 344355 - RNA, 30 nt, Human
caaugaugggguccccagugagucaucugc

SEQ ID NO: 344356 - RNA, 32 nt, Human
caaugauguagccaccuccuaaccuucccuuc

SEQ ID NO: 344357 - RNA, 32 nt, Human
caaugaugucuuuccauauucuuaucugggcu

SEQ ID NO: 344358 - RNA, 32 nt, Human
caaugauguuggcucuguggcuuggggguuuu

SEQ ID NO: 344359 - RNA, 32 nt, Human
caaugauguuucugaaacugcuauguacaacc

SEQ ID NO: 344360 - RNA, 32 nt, Human
caaugauuuguuguucaccugaaauucaaauu

SEQ ID NO: 344361 - RNA, 32 nt, Human
caaugauuuuggucagggagagucagacaagg

SEQ ID NO: 344362 - RNA, 32 nt, Human
caaugcaaagcagaguuggaucuucaaacuga

SEQ ID NO: 344363 - RNA, 32 nt, Human
caaugcaaggcacuggccacaccaggcuggcc

SEQ ID NO: 344364 - RNA, 32 nt, Human
caaugcaaugaagccggguugcagagauuagg

SEQ ID NO: 344365 - RNA, 32 nt, Human
caaugcaauuugucacagaaggauguuaugua

SEQ ID NO: 344366 - RNA, 22 nt, Human
caaugcacacaugguacaauga

SEQ ID NO: 344367 - RNA, 32 nt, Human
caaugcacugaaccuggacuugggggaaagag

SEQ ID NO: 344368 - RNA, 32 nt, Human
caaugcagaagccaggcuuuggggguagaaag

SEQ ID NO: 344369 - RNA, 32 nt, Human
caaugcaggcccuggaggacugugcgucaccc

SEQ ID NO: 344370 - RNA, 32 nt, Human
caaugcagggcaccuccgaggccacggcgagc

SEQ ID NO: 344371 - RNA, 32 nt, Human
caaugcaguguucucaguaggaaauguucauc

SEQ ID NO: 344372 - RNA, 32 nt, Human
caaugcaguuagguggcucuuuccaagacucu

SEQ ID NO: 344373 - RNA, 32 nt, Human
caaugcaucauaaaaccuucagaaggaaagga

SEQ ID NO: 344374 - RNA, 20 nt, Human
caaugcauccuagcaucaca

SEQ ID NO: 344375 - RNA, 32 nt, Human
caaugcaucguaaaaccuucagaaggaaagga

SEQ ID NO: 344376 - RNA, 27 nt, Human
caaugcaugaugacucuucuuaucaca

SEQ ID NO: 344377 - RNA, 32 nt, Human
caaugcauucuaaguguaagacugguuacauu

SEQ ID NO: 344378 - RNA, 32 nt, Human
caaugccaaacauuucugcacagggaagcuag

SEQ ID NO: 344379 - RNA, 32 nt, Human
caaugccaaggacuucagcccagggcuguuug

SEQ ID NO: 344380 - RNA, 32 nt, Human
caaugccagcugguaggaucccugagccccuu

SEQ ID NO: 344381 - RNA, 32 nt, Human
caaugccagguaggaggaagggcuggggcaau

SEQ ID NO: 344382 - RNA, 32 nt, Human
caaugccauuucuccccaccacggaaccuucc

SEQ ID NO: 344383 - RNA, 32 nt, Human
caaugcccaacaaccaaccagcuggcccuugg

SEQ ID NO: 344384 - RNA, 21 nt, Human
caaugcccacccgcaucgcca

SEQ ID NO: 344385 - RNA, 32 nt, Human
caaugcccagacaaacgugagcacacccacca

SEQ ID NO: 344386 - RNA, 32 nt, Human
caaugcccaguguggcuguguuugaagugagg

SEQ ID NO: 344387 - RNA, 32 nt, Human
caaugccccugcuuccauuucuccccaccuca

SEQ ID NO: 344388 - RNA, 32 nt, Human
caaugccucuacuucccgcaaggccuaccggg

SEQ ID NO: 344389 - RNA, 32 nt, Human
caaugcgagcuuccucuccugucccauguugg

SEQ ID NO: 344390 - RNA, 32 nt, Human
caaugcgccgucaccaucuccaccucccacca

SEQ ID NO: 344391 - RNA, 32 nt, Human
caaugcggagcuggggcugagaugcuccaggu

SEQ ID NO: 344392 - RNA, 32 nt, Human
caaugcuacccagcaccccaugugccaaaaga

SEQ ID NO: 344393 - RNA, 32 nt, Human
caaugcucaugugcuucuucugggcuuguaac

SEQ ID NO: 344394 - RNA, 32 nt, Human
caaugcucccuccuucccaggguccacaggcg

SEQ ID NO: 344395 - RNA, 32 nt, Human
caaugcucuguaggugcuuccucugccaaaaa

SEQ ID NO: 344396 - RNA, 32 nt, Human
caaugcugagcaggaagcagcagcugcaggcc

SEQ ID NO: 344397 - RNA, 27 nt, Human
caaugcugaggcugcuggcguccgggu

SEQ ID NO: 344398 - RNA, 31 nt, Human
caaugcuggguggaggagggcagaaacgcag

SEQ ID NO: 344399 - RNA, 32 nt, Human
caaugcuguggaugaacgaugaugucaauguc

SEQ ID NO: 344400 - RNA, 32 nt, Human
caaugcuucuggagacuuccugccuaggccuc

SEQ ID NO: 344401 - RNA, 32 nt, Human
caaugcuucuuuuugaccuuucccaaggagaa

SEQ ID NO: 344402 - RNA, 32 nt, Human
caaugcuuuccagaggauggaguccuuuuugu

SEQ ID NO: 344403 - RNA, 32 nt, Human
caauggaacccuugauuuccuaccucagugua

SEQ ID NO: 344404 - RNA, 32 nt, Human
caauggaagaacaagacaucaaacuucgugaa

SEQ ID NO: 344405 - RNA, 32 nt, Human
caauggaagggaggggacaagaaauaggggcc

SEQ ID NO: 344406 - RNA, 32 nt, Human
caauggaauuauucauuuuucucuaucuuuua

SEQ ID NO: 344407 - RNA, 27 nt, Human
caauggacaagcaugugggcuuuucau

SEQ ID NO: 344408 - RNA, 32 nt, Human
caauggacaauaaacccagccuggugggcccc

SEQ ID NO: 344409 - RNA, 32 nt, Human
caauggacaggcaccuucgggaucaaaguaca

SEQ ID NO: 344410 - RNA, 32 nt, Human
caauggacccuucacaaguguuucuccugccc

SEQ ID NO: 344411 - RNA, 32 nt, Human
caauggacuuccacuuucaucaacuuuccauc

SEQ ID NO: 344412 - RNA, 32 nt, Human
caauggagaacuuauagcugugcaaagaucua

SEQ ID NO: 344413 - RNA, 32 nt, Human
caauggagagcuaccuuguccugcugcugccc

SEQ ID NO: 344414 - RNA, 32 nt, Human
caauggagauagaucauuguucucuccaucuc

SEQ ID NO: 344415 - RNA, 32 nt, Human
caauggagaucuacggcauacgcccagggccu

SEQ ID NO: 344416 - RNA, 27 nt, Human
caauggaggaggaggaugaggaagcgc

SEQ ID NO: 344417 - RNA, 32 nt, Human
caauggaggcuucagugagcaggaccagcugc

SEQ ID NO: 344418 - RNA, 32 nt, Human
caauggaguccauuccuuccccuagaacaggg

SEQ ID NO: 344419 - RNA, 32 nt, Human
caauggaguggcugagccuuugagcacaccac

SEQ ID NO: 344420 - RNA, 32 nt, Human
caauggaucaucaaaccacuccacaagcacag

SEQ ID NO: 344421 - RNA, 21 nt, Human
caauggaugugaagaagaaau

SEQ ID NO: 344422 - RNA, 32 nt, Human
caauggauugugcugcucucguuucagcuuug

SEQ ID NO: 344423 - RNA, 23 nt, Human
caauggcaaaaccccgucucuac

SEQ ID NO: 344424 - RNA, 32 nt, Human
caauggcaaugccaguggaaccacacugcuug

SEQ ID NO: 344425 - RNA, 32 nt, Human
caauggcacaaccuccaccuccuggguucaag

SEQ ID NO: 344426 - RNA, 32 nt, Human
caauggcacaugcuuccacuccauccauacug

SEQ ID NO: 344427 - RNA, 32 nt, Human
caauggcagaaggagaugcucagggcuccugg

SEQ ID NO: 344428 - RNA, 32 nt, Human
caauggcagccuuggcacaaugccuggguguc

SEQ ID NO: 344429 - RNA, 32 nt, Human
caauggcagcuuuggggaccuuuugucuuugc

SEQ ID NO: 344430 - RNA, 32 nt, Human
caauggcaggaggcggacguggggugucgugc

SEQ ID NO: 344431 - RNA, 32 nt, Human
caauggccacccaacuccuucccaacccuccc

SEQ ID NO: 344432 - RNA, 27 nt, Human
caauggccacugucccuggccuccagc

SEQ ID NO: 344433 - RNA, 32 nt, Human
caauggccacugugagccacagaaggaagaca

SEQ ID NO: 344434 - RNA, 32 nt, Human
caauggccccuggaacaugccagcacacacug

SEQ ID NO: 344435 - RNA, 23 nt, Human
caauggcccuucagggccugccu

SEQ ID NO: 344436 - RNA, 32 nt, Human
caauggccucuuuagacccagcuccugccucc

SEQ ID NO: 344437 - RNA, 32 nt, Human
caauggccugggaaguugaggucacuuuuuac

SEQ ID NO: 344438 - RNA, 27 nt, Human
caauggccuuucaggaccuccuggguc

SEQ ID NO: 344439 - RNA, 32 nt, Human
caauggcucacaccuguaaugccagcccuuug

SEQ ID NO: 344440 - RNA, 21 nt, Human
caauggcucacgccuguaauc

SEQ ID NO: 344441 - RNA, 32 nt, Human
caauggcucacugcagccucaaccuccugagc

SEQ ID NO: 344442 - RNA, 21 nt, Human
caauggcucaugcuuguaauc

SEQ ID NO: 344443 - RNA, 32 nt, Human
caauggcucuaggaguuagccaacaagggacu

SEQ ID NO: 344444 - RNA, 27 nt, Human
caauggcugaacaaguccuuccucagg

SEQ ID NO: 344445 - RNA, 32 nt, Human
caauggcugcugcaacgggagcagcugagucc

SEQ ID NO: 344446 - RNA, 32 nt, Human
caauggcuucauuuugaagaaaagccacagaa

SEQ ID NO: 344447 - RNA, 32 nt, Human
caauggcuugaucuuccgcucacugcaaccuc

SEQ ID NO: 344448 - RNA, 32 nt, Human
caauggcuuggaccaggccagagcuguucucc

SEQ ID NO: 344449 - RNA, 32 nt, Human
caaugggaaaagagucucuaccccuuucuguu

SEQ ID NO: 344450 - RNA, 32 nt, Human
caaugggaaacugcagucucagaggaaggccc

SEQ ID NO: 344451 - RNA, 32 nt, Human
caaugggaaaugcagggcaguguggcaggugg

SEQ ID NO: 344452 - RNA, 32 nt, Human
caaugggacagaaaggccaugugggcacacgg

SEQ ID NO: 344453 - RNA, 32 nt, Human
caaugggacugaagcaggagagaaggcugggc

SEQ ID NO: 344454 - RNA, 32 nt, Human
caaugggaucguccuucaagaggaccucacag

SEQ ID NO: 344455 - RNA, 32 nt, Human
caaugggauuaaaccaaccugcuuggucucua

SEQ ID NO: 344456 - RNA, 32 nt, Human
caaugggcaagacuggugcuguuuauuaaaaa

SEQ ID NO: 344457 - RNA, 32 nt, Human
caaugggcagcagggagagagcaggguuucca

SEQ ID NO: 344458 - RNA, 32 nt, Human
caaugggcaggcggguuguacuuaguguggug

SEQ ID NO: 344459 - RNA, 24 nt, Human
caaugggcauaguaaaagugcaug

SEQ ID NO: 344460 - RNA, 32 nt, Human
caaugggcucuguggggcaggugcagaggccc

SEQ ID NO: 344461 - RNA, 32 nt, Human
caauggggccggccucacagagagcgccgugu

SEQ ID NO: 344462 - RNA, 32 nt, Human
caauggggcuuccuuucuauagggaggauacc

SEQ ID NO: 344463 - RNA, 32 nt, Human
caauggggguggggaaaagcccaggagagcag

SEQ ID NO: 344464 - RNA, 32 nt, Human
caauggggucacggugccugaagagggccuga

SEQ ID NO: 344465 - RNA, 32 nt, Human
caaugggguucacuaaggggguucccgaggcc

SEQ ID NO: 344466 - RNA, 32 nt, Human
caaugggugagaugagauccuggagagagaac

SEQ ID NO: 344467 - RNA, 32 nt, Human
caaugggugagucuuucucacccuccauuucu

SEQ ID NO: 344468 - RNA, 32 nt, Human
caaugguagaagcacaaacaagcaagcuccuu

SEQ ID NO: 344469 - RNA, 32 nt, Human
caauggucagcuuuagugaaaaugagugaaaa

SEQ ID NO: 344470 - RNA, 32 nt, Human
caaugguccacccacaaaugaauuaucaggag

SEQ ID NO: 344471 - RNA, 32 nt, Human
caaugguccacccacaaaugaauuaucaggug

SEQ ID NO: 344472 - RNA, 32 nt, Human
caauggucccugccaccuagagcugcuagcau

SEQ ID NO: 344473 - RNA, 32 nt, Human
caaugguccuaagaucuccaccaacaggagaa

SEQ ID NO: 344474 - RNA, 32 nt, Human
caauggugcaaucucaagcucacugcaaccuc

SEQ ID NO: 344475 - RNA, 32 nt, Human
caauggugcccaggcuggagugcaguggcgug

SEQ ID NO: 344476 - RNA, 32 nt, Human
caauggugcggucacagcucacugccuccugg

SEQ ID NO: 344477 - RNA, 32 nt, Human
caaugguguccaggcuggagugcaguggcgug

SEQ ID NO: 344478 - RNA, 32 nt, Human
caaugguuacuuuugucauauucacuuuaaau

SEQ ID NO: 344479 - RNA, 32 nt, Human
caaugguucucuucccuuuuccauccuccaaa

SEQ ID NO: 344480 - RNA, 32 nt, Human
caaugguugagcaguggagugggagcccaggu

SEQ ID NO: 344481 - RNA, 32 nt, Human
caaugguuggccacagauggguguacugcaaa

SEQ ID NO: 344482 - RNA, 32 nt, Human
caaugguugggacaauggcaauaggacaaaac

SEQ ID NO: 344483 - RNA, 32 nt, Human
caauguaaaggaugaucaaacacuggaauaua

SEQ ID NO: 344484 - RNA, 32 nt, Human
caauguacaagagacucaaaucuaaacauuua

SEQ ID NO: 344485 - RNA, 32 nt, Human
caauguacacugccaaacacaagaguaggaca

SEQ ID NO: 344486 - RNA, 32 nt, Human
caauguacauuuugaaacuuucuuucaggggu

SEQ ID NO: 344487 - RNA, 32 nt, Human
caauguacuaaaggagggauguacuuucagau

SEQ ID NO: 344488 - RNA, 32 nt, Human
caauguagagagaguuccaaaccaccaauuuu

SEQ ID NO: 344489 - RNA, 32 nt, Human
caauguagaguuaagaaccaggaggcaggaac

SEQ ID NO: 344490 - RNA, 32 nt, Human
caauguagcagccacugucauuucucaguggu

SEQ ID NO: 344491 - RNA, 32 nt, Human
caauguauaaagauuguacuuagccaguucaa

SEQ ID NO: 344492 - RNA, 32 nt, Human
caauguauaagucuuauacuucuuuuauuaaa

SEQ ID NO: 344493 - RNA, 32 nt, Human
caauguauuaugaaccagucagcuaucugucu

SEQ ID NO: 344494 - RNA, 32 nt, Human
caaugucaccacccucugcauggcccugugug

SEQ ID NO: 344495 - RNA, 32 nt, Human
caaugucauaacaggcauugccaaccucacug

SEQ ID NO: 344496 - RNA, 32 nt, Human
caaugucaucuucuccaugaagaccacugaau

SEQ ID NO: 344497 - RNA, 32 nt, Human
caauguccagugcuaggauuauuugcagguuu

SEQ ID NO: 344498 - RNA, 32 nt, Human
caaugucccaccuuggagcucuccuuguugaa

SEQ ID NO: 344499 - RNA, 32 nt, Human
caaugucugcuguuuccaacacuggugauuuc

SEQ ID NO: 344500 - RNA, 32 nt, Human
caaugucuuccccuagccacagguucaaccaa

SEQ ID NO: 344501 - RNA, 32 nt, Human
caaugugaaacaauuuucucucuuuauacuaa

SEQ ID NO: 344502 - RNA, 32 nt, Human
caaugugaacucagggaacuggggaaggcuga

SEQ ID NO: 344503 - RNA, 32 nt, Human
caaugugacaguguuacauuuggagagaagug

SEQ ID NO: 344504 - RNA, 32 nt, Human
caaugugaucugagccuccaucauuguccucc

SEQ ID NO: 344505 - RNA, 32 nt, Human
caaugugcagccuucagguuugcggaaaggga

SEQ ID NO: 344506 - RNA, 32 nt, Human
caaugugccgucuucugucuuuggaaaauggg

SEQ ID NO: 344507 - RNA, 32 nt, Human
caaugugcgugggcaucugugagaagaagaga

SEQ ID NO: 344508 - RNA, 32 nt, Human
caaugugcugcugcaaguccuccugggcuucc

SEQ ID NO: 344509 - RNA, 23 nt, Human
caaugugcugggauuacaggcau

SEQ ID NO: 344510 - RNA, 32 nt, Human
caauguggaaaagccuuuauuucuuucaguuc

SEQ ID NO: 344511 - RNA, 32 nt, Human
caauguggaaagggaaggaaaggaagcuguau

SEQ ID NO: 344512 - RNA, 32 nt, Human
caauguggagaaacuuuuggccagauuccaga

SEQ ID NO: 344513 - RNA, 32 nt, Human
caauguggauuucggcaauggccggcagaaac

SEQ ID NO: 344514 - RNA, 19 nt, Human
caauguggcaaaacccugu

SEQ ID NO: 344515 - RNA, 32 nt, Human
caauguggccuaaaaaugcaacuucuuuuuau

SEQ ID NO: 344516 - RNA, 32 nt, Human
caauguggcugcaagggugguggugguggugg

SEQ ID NO: 344517 - RNA, 32 nt, Human
caaugugggaaagccuuuauuucuuucacuuc

SEQ ID NO: 344518 - RNA, 32 nt, Human
caaugugggaggcaggaugcagggaugggcuc

SEQ ID NO: 344519 - RNA, 32 nt, Human
caaugugggcaggggcugggcaggaggguggg

SEQ ID NO: 344520 - RNA, 32 nt, Human
caaugugggcauccuugugcucuuccugcacg

SEQ ID NO: 344521 - RNA, 32 nt, Human
caauguggguaaucaguaagacaguauggcac

SEQ ID NO: 344522 - RNA, 32 nt, Human
caaugugucauauacucgcacaacuuaaauag

SEQ ID NO: 344523 - RNA, 31 nt, Human
caaugugucugggucaucacagcagugaaua

SEQ ID NO: 344524 - RNA, 32 nt, Human
caauguguguuuuagauaaauaggauugggua

SEQ ID NO: 344525 - RNA, 26 nt, Human
caauguguucuuuguuccacuggaaa

SEQ ID NO: 344526 - RNA, 32 nt, Human
caauguuaaucuguuugagucuuuggagaaag

SEQ ID NO: 344527 - RNA, 32 nt, Human
caauguuagugccaccaccuucugaacacagu

SEQ ID NO: 344528 - RNA, 32 nt, Human
caauguuccucuucauauguuaacuuuucuua

SEQ ID NO: 344529 - RNA, 32 nt, Human
caauguucuacaacuuggaaaguuuucauuuu

SEQ ID NO: 344530 - RNA, 32 nt, Human
caauguucucucugccacauuaaucagagaaa

SEQ ID NO: 344531 - RNA, 32 nt, Human
caauguugaaaccucaucucuugaaugcagac

SEQ ID NO: 344532 - RNA, 32 nt, Human
caauguugcccaggcuggagugcaguggcgug

SEQ ID NO: 344533 - RNA, 32 nt, Human
caauguuggucaguaacagaaugaguugguuu

SEQ ID NO: 344534 - RNA, 31 nt, Human
caauguuuacucaaggguguucuuaggaggc

SEQ ID NO: 344535 - RNA, 32 nt, Human
caauguuuagcuuuuguuaacuccucacucuu

SEQ ID NO: 344536 - RNA, 32 nt, Human
caauguuucccaggaaaucaaagauguaaaug

SEQ ID NO: 344537 - RNA, 32 nt, Human
caauguuuggaggauguugucacagcuaguag

SEQ ID NO: 344538 - RNA, 25 nt, Human
caauguuuguguccaccaccagcca

SEQ ID NO: 344539 - RNA, 32 nt, Human
caauguuuuuacuuuuuguauaaugggguggg

SEQ ID NO: 344540 - RNA, 32 nt, Human
caauguuuuuauagaugguguggaaagacuuu

SEQ ID NO: 344541 - RNA, 32 nt, Human
caauguuuuucugcuuuuugccuuccccauau

SEQ ID NO: 344542 - RNA, 32 nt, Human
caauguuuuugcaacauaugagagaagauagu

SEQ ID NO: 344543 - RNA, 32 nt, Human
caauuaaaacacuaugugucuccuuauagagg

SEQ ID NO: 344544 - RNA, 26 nt, Human
caauuaaaaugaaggaaugcugaguu

SEQ ID NO: 344545 - RNA, 32 nt, Human
caauuaaacuucuuuuucuucccagucucggg

SEQ ID NO: 344546 - RNA, 32 nt, Human
caauuaaagcaauugauuuucuagugcuggua

SEQ ID NO: 344547 - RNA, 32 nt, Human
caauuaaaugacuuagaaacaauguuugcuuu

SEQ ID NO: 344548 - RNA, 32 nt, Human
caauuaaguggcccugaugauguuaccaagcc

SEQ ID NO: 344549 - RNA, 32 nt, Human
caauuaaucaggagaaaaguaaauauaaaaac

SEQ ID NO: 344550 - RNA, 32 nt, Human
caauuaauucuagagcaacuuugccccagcga

SEQ ID NO: 344551 - RNA, 32 nt, Human
caauuacaauuaaaagcacauuguuggaccau

SEQ ID NO: 344552 - RNA, 32 nt, Human
caauuacacagcacaaaaugauauccacgugg

SEQ ID NO: 344553 - RNA, 32 nt, Human
caauuacaggagccugccaccaugcccgugcu

SEQ ID NO: 344554 - RNA, 32 nt, Human
caauuaccauuuucuucuuucucaggauuugg

SEQ ID NO: 344555 - RNA, 32 nt, Human
caauuacugcuggcaucuuaguugagaguaua

SEQ ID NO: 344556 - RNA, 32 nt, Human
caauuagaaagucuccaccacuuucaaaaauc

SEQ ID NO: 344557 - RNA, 32 nt, Human
caauuagcaaaggagaaacuuucucaauuuaa

SEQ ID NO: 344558 - RNA, 32 nt, Human
caauuagcacaaauacgccaagggaacagggu

SEQ ID NO: 344559 - RNA, 32 nt, Human
caauuagcaguuaugcaauggaccugauucua

SEQ ID NO: 344560 - RNA, 32 nt, Human
caauuagcucuauucaucuugucuccuagcug

SEQ ID NO: 344561 - RNA, 32 nt, Human
caauuagcugauuggagaauguggaaugcaga

SEQ ID NO: 344562 - RNA, 32 nt, Human
caauuaggcccagccugccauggcagcuccaa

SEQ ID NO: 344563 - RNA, 32 nt, Human
caauuagggagaagaagcagcagaaaaggaga

SEQ ID NO: 344564 - RNA, 32 nt, Human
caauuaguccauguacccuccuuccucacuac

SEQ ID NO: 344565 - RNA, 32 nt, Human
caauuagucuuucuccccuggacuagaaaucc

SEQ ID NO: 344566 - RNA, 32 nt, Human
caauuauaucagaauaccuuucugaauuugag

SEQ ID NO: 344567 - RNA, 32 nt, Human
caauuauauuuuucucaguuauacuagaaaau

SEQ ID NO: 344568 - RNA, 32 nt, Human
caauuaucagguuugcuagaaauauaacuuuu

SEQ ID NO: 344569 - RNA, 32 nt, Human
caauuauccaguuuuagaagagagagacuuua

SEQ ID NO: 344570 - RNA, 32 nt, Human
caauuauccugccucaggcucccgaguagcug

SEQ ID NO: 344571 - RNA, 32 nt, Human
caauuaucuccucccccucuucucuccugucu

SEQ ID NO: 344572 - RNA, 32 nt, Human
caauuaugaaucugugaauucucuuaagucuu

SEQ ID NO: 344573 - RNA, 24 nt, Human
caauuaugaauuccaaauucugac

SEQ ID NO: 344574 - RNA, 32 nt, Human
caauuaugauaaaggacaaaauaagcuguuug

SEQ ID NO: 344575 - RNA, 32 nt, Human
caauuaugcuuugguuuuuagugaaugaaaaa

SEQ ID NO: 344576 - RNA, 32 nt, Human
caauuauucuaaucugaacacaguuaucagga

SEQ ID NO: 344577 - RNA, 32 nt, Human
caauucaaaaugaagagagaccucuggauccc

SEQ ID NO: 344578 - RNA, 32 nt, Human
caauucaaaugcagacuaauuauagggaauuu

SEQ ID NO: 344579 - RNA, 32 nt, Human
caauucaagaugagauuugggugaggacacag

SEQ ID NO: 344580 - RNA, 32 nt, Human
caauucaaggguuagguugcagagagcuggcu

SEQ ID NO: 344581 - RNA, 32 nt, Human
caauucaccaacacaguugggacccaaaacac

SEQ ID NO: 344582 - RNA, 32 nt, Human
caauucaccaccaacuaggugugugaccgugg

SEQ ID NO: 344583 - RNA, 32 nt, Human
caauucaccauggagcuuugucucuggcccuu

SEQ ID NO: 344584 - RNA, 32 nt, Human
caauucaccugccuuuccuucucccauccuuu

SEQ ID NO: 344585 - RNA, 32 nt, Human
caauucagaaacggagcauggaagcaucagaa

SEQ ID NO: 344586 - RNA, 32 nt, Human
caauucagccugggugacauagagagacucca

SEQ ID NO: 344587 - RNA, 32 nt, Human
caauucaggaaucaagggcuguggagaaacuc

SEQ ID NO: 344588 - RNA, 32 nt, Human
caauucaguuuccuuagaccagugccagugug

SEQ ID NO: 344589 - RNA, 32 nt, Human
caauucauaguaugaucagggaaaguguaacu

SEQ ID NO: 344590 - RNA, 32 nt, Human
caauucaucaguuucugagaccacagaaucag

SEQ ID NO: 344591 - RNA, 32 nt, Human
caauucaugaagugaauuaaugaugaggaucu

SEQ ID NO: 344592 - RNA, 32 nt, Human
caauucauuaacguucuugccuagagauacug

SEQ ID NO: 344593 - RNA, 32 nt, Human
caauucauuccuccucuuccucucaaaggcug

SEQ ID NO: 344594 - RNA, 32 nt, Human
caauucauuuucucccacccucggcccucuug

SEQ ID NO: 344595 - RNA, 32 nt, Human
caauuccaccucugagggcuguccucagaaug

SEQ ID NO: 344596 - RNA, 32 nt, Human
caauuccagaacuauaguuacuuccacagugc

SEQ ID NO: 344597 - RNA, 32 nt, Human
caauuccagagcugucuggugaucacuuuaug

SEQ ID NO: 344598 - RNA, 32 nt, Human
caauuccagcauauccagugaguuuugacagu

SEQ ID NO: 344599 - RNA, 32 nt, Human
caauuccaggugugcacagaaaaccgagaaua

SEQ ID NO: 344600 - RNA, 32 nt, Human
caauuccauccuggcgagauccaagugcuuac

SEQ ID NO: 344601 - RNA, 32 nt, Human
caauuccaucuucucccauggaaccucaaaga

SEQ ID NO: 344602 - RNA, 32 nt, Human
caauucccaccaagcugaaggaagagagaugg

SEQ ID NO: 344603 - RNA, 32 nt, Human
caauucccagcgucaccccauggcuuguguug

SEQ ID NO: 344604 - RNA, 32 nt, Human
caauucccauccuucccaccccggcuaggugu

SEQ ID NO: 344605 - RNA, 32 nt, Human
caauuccccaggagguacucaccccaagucug

SEQ ID NO: 344606 - RNA, 32 nt, Human
caauucccccuucuuucagaaggaaagaagga

SEQ ID NO: 344607 - RNA, 32 nt, Human
caauuccccugccucagcuuccugaguagcug

SEQ ID NO: 344608 - RNA, 32 nt, Human
caauuccccugccuuugccucccgaguagcug

SEQ ID NO: 344609 - RNA, 32 nt, Human
caauucccugaagguggccacuuuaagagaga

SEQ ID NO: 344610 - RNA, 32 nt, Human
caauucccuuucucucugucacugcuucagca

SEQ ID NO: 344611 - RNA, 32 nt, Human
caauucccuuuuccuuucuucagccuaacccg

SEQ ID NO: 344612 - RNA, 32 nt, Human
caauuccggggugggauugcuagggggagagu

SEQ ID NO: 344613 - RNA, 32 nt, Human
caauuccuccagcuacccuugugaccuaaguc

SEQ ID NO: 344614 - RNA, 32 nt, Human
caauuccucugcaacuccucccccuuuuauuu

SEQ ID NO: 344615 - RNA, 32 nt, Human
caauuccugagagcccuggagcgguuuccuac

SEQ ID NO: 344616 - RNA, 32 nt, Human
caauuccugaguagggccuugcuugaguucuu

SEQ ID NO: 344617 - RNA, 32 nt, Human
caauuccugcagcugggaagcauggcgacuca

SEQ ID NO: 344618 - RNA, 32 nt, Human
caauuccuucugagcccuugaggacaggaccu

SEQ ID NO: 344619 - RNA, 32 nt, Human
caauuccuugauaucuggaguuucuucaccau

SEQ ID NO: 344620 - RNA, 32 nt, Human
caauucgagguugcugagcuucucuccaaagu

SEQ ID NO: 344621 - RNA, 32 nt, Human
caauucguucucucugccccaaggaggcugga

SEQ ID NO: 344622 - RNA, 32 nt, Human
caauucuacugucaaaacaaaggggguuuaca

SEQ ID NO: 344623 - RNA, 32 nt, Human
caauucucacuuuguuuagauaccagaggggc

SEQ ID NO: 344624 - RNA, 32 nt, Human
caauucuccagaggacuaucucacauaaguca

SEQ ID NO: 344625 - RNA, 32 nt, Human
caauucuccugccucagccucacgaguagcug

SEQ ID NO: 344626 - RNA, 32 nt, Human
caauucuccugccucagccuccagaauagcug

SEQ ID NO: 344627 - RNA, 32 nt, Human
caauucuccugccucagccucccaaauagcgg

SEQ ID NO: 344628 - RNA, 32 nt, Human
cacauaugcuggcugcuguuuacacacccugc

SEQ ID NO: 344629 - RNA, 21 nt, Human
cacauaugcuugucacuggga

SEQ ID NO: 344630 - RNA, 32 nt, Human
cacauauggcaacccccaacucccaggggguu

SEQ ID NO: 344631 - RNA, 32 nt, Human
cacauauguggcagcagaggcagugagaguuu

SEQ ID NO: 344632 - RNA, 32 nt, Human
cacauauguguauguguggaguauguguguuu

SEQ ID NO: 344633 - RNA, 32 nt, Human
cacauauguguauguguguggaucuguacaca

SEQ ID NO: 344634 - RNA, 32 nt, Human
cacaucaaccuauuuuguuuuacccuuuuucu

SEQ ID NO: 344635 - RNA, 32 nt, Human
cacaucaacuggcacacaugcacacgaauucu

SEQ ID NO: 344636 - RNA, 32 nt, Human
cacaucaaugauuuuucacaaguggagcacgu

SEQ ID NO: 344637 - RNA, 32 nt, Human
cacaucacagcugaaaacaugaagagcaguuu

SEQ ID NO: 344638 - RNA, 32 nt, Human
cacaucaccaagcccagccaaauuuuguuuuu

SEQ ID NO: 344639 - RNA, 21 nt, Human
cacaucacuccagccugggca

SEQ ID NO: 344640 - RNA, 32 nt, Human
cacaucacugacagcuugacacaugccuccua

SEQ ID NO: 344641 - RNA, 32 nt, Human
cacaucacugcacuccagccuggguaacagag

SEQ ID NO: 344642 - RNA, 32 nt, Human
cacaucacugcacuccauccugggugacagag

SEQ ID NO: 344643 - RNA, 32 nt, Human
cacaucacugcaguccagccugggugacagag

SEQ ID NO: 344644 - RNA, 32 nt, Human
cacaucacuguccuucugccauggcccugugg

SEQ ID NO: 344645 - RNA, 32 nt, Human
cacaucagagucaggacaaaaagaagauacga

SEQ ID NO: 344646 - RNA, 32 nt, Human
cacaucagccuaccucccuccuggcugcuggc

SEQ ID NO: 344647 - RNA, 32 nt, Human
cacaucagccugggugauagauugaggcccca

SEQ ID NO: 344648 - RNA, 22 nt, Human
cacaucaggccagcugugggcc

SEQ ID NO: 344649 - RNA, 32 nt, Human
cacaucagugcugugaaggcaaccucaccaug

SEQ ID NO: 344650 - RNA, 20 nt, Human
cacaucaguuuuaaaguguu

SEQ ID NO: 344651 - RNA, 32 nt, Human
cacaucauagaacauacacaggggagaaaccc

SEQ ID NO: 344652 - RNA, 32 nt, Human
cacaucaucugccuacuuaacgcccagcucug

SEQ ID NO: 344653 - RNA, 32 nt, Human
cacaucaucuucucucuguguaugauggugcc

SEQ ID NO: 344654 - RNA, 32 nt, Human
cacaucauguacuggaaugaucugcauuaaac

SEQ ID NO: 344655 - RNA, 32 nt, Human
cacaucauuccagagaccaaaaccuuacucau

SEQ ID NO: 344656 - RNA, 32 nt, Human
cacaucauucuggcuggagagugcaauguguc

SEQ ID NO: 344657 - RNA, 32 nt, Human
cacaucauuuggucaacuccuuuucccugguu

SEQ ID NO: 344658 - RNA, 25 nt, Human
cacauccaaguuucugccucuuuua

SEQ ID NO: 344659 - RNA, 32 nt, Human
cacauccacacacaccacagacuucaacacau

SEQ ID NO: 344660 - RNA, 32 nt, Human
cacauccacaccucugcucuuuccuguuccug

SEQ ID NO: 344661 - RNA, 32 nt, Human
cacauccacccuccaccucuagcccagacacc

SEQ ID NO: 344662 - RNA, 32 nt, Human
cacauccacgcacucccaaaggccagaaguau

SEQ ID NO: 344663 - RNA, 32 nt, Human
cacauccagaagcuacuucucaguguugcaua

SEQ ID NO: 344664 - RNA, 32 nt, Human
cacauccagaccuugaguauuguuaaauggag

SEQ ID NO: 344665 - RNA, 32 nt, Human
cacauccagcaacugggcccagcuuuaaccag

SEQ ID NO: 344666 - RNA, 32 nt, Human
cacauccagcacugugucuugccuuucagauc

SEQ ID NO: 344667 - RNA, 32 nt, Human
cacauccagggguguucacaggcuuucacagc

SEQ ID NO: 344668 - RNA, 21 nt, Human
cacauccaguucuuuucuuuu

SEQ ID NO: 344669 - RNA, 32 nt, Human
cacauccaucuugcagagaaguuuacagaacu

SEQ ID NO: 344670 - RNA, 32 nt, Human
cacauccauggaaucagagcaagauuuccuuu

SEQ ID NO: 344671 - RNA, 32 nt, Human
cacaucccaacacccaccccagggagaguucc

SEQ ID NO: 344672 - RNA, 32 nt, Human
cacaucccaauccugaauccaagagucuaaga

SEQ ID NO: 344673 - RNA, 32 nt, Human
cacaucccaauucugacaagaccucaugccug

SEQ ID NO: 344674 - RNA, 32 nt, Human
cacaucccaccauacacugcugcccaggcagu

SEQ ID NO: 344675 - RNA, 32 nt, Human
cacaucccaccuacagacuaccaccuuucgag

SEQ ID NO: 344676 - RNA, 32 nt, Human
cacaucccacucugaguccaaauguucucucc

SEQ ID NO: 344677 - RNA, 32 nt, Human
cacaucccaggcaggacagagcaggagaucau

SEQ ID NO: 344678 - RNA, 32 nt, Human
cacauccccagcugccuggcuggguccugaag

SEQ ID NO: 344679 - RNA, 23 nt, Human
cacaucccccagcaagccagcca

SEQ ID NO: 344680 - RNA, 32 nt, Human
cacauccccuaaacucucaucuccuguggccc

SEQ ID NO: 344681 - RNA, 32 nt, Human
cacaucccggcacagacagacacacacgaggc

SEQ ID NO: 344682 - RNA, 18 nt, Human
cacaucccugauggcaga

SEQ ID NO: 344683 - RNA, 32 nt, Human
cacaucccugcucccuacuuccuggcagccaa

SEQ ID NO: 344684 - RNA, 31 nt, Human
cacaucccugggugaagauggggagacagug

SEQ ID NO: 344685 - RNA, 32 nt, Human
cacaucccuggucucccgccuccugggcaagc

SEQ ID NO: 344686 - RNA, 32 nt, Human
cacauccgcugccauggucugugucgugccag

SEQ ID NO: 344687 - RNA, 32 nt, Human
cacauccguccuccugucucagggcuggcagg

SEQ ID NO: 344688 - RNA, 32 nt, Human
cacauccgugagccuguguccgcagcugcugc

SEQ ID NO: 344689 - RNA, 26 nt, Human
cacauccucaauaaaaccuguuguau

SEQ ID NO: 344690 - RNA, 32 nt, Human
cacauccucagcaucccugccuccugcaucca

SEQ ID NO: 344691 - RNA, 32 nt, Human
cacauccucgagccaggcagggcgcccggcuu

SEQ ID NO: 344692 - RNA, 32 nt, Human
cacauccucuccaggaaggcagugaggggcug

SEQ ID NO: 344693 - RNA, 20 nt, Human
cacauccugccugccccuca

SEQ ID NO: 344694 - RNA, 32 nt, Human
cacauccugccugccccucagcccuggcccag

SEQ ID NO: 344695 - RNA, 32 nt, Human
cacauccugccugcuguugcagccuggcuggg

SEQ ID NO: 344696 - RNA, 32 nt, Human
cacauccugggugggacagagcaggacaaugc

SEQ ID NO: 344697 - RNA, 32 nt, Human
cacauccuguccuaucucccccaaaccauacc

SEQ ID NO: 344698 - RNA, 32 nt, Human
cacauccugugcacugcugaaggacccuacgc

SEQ ID NO: 344699 - RNA, 25 nt, Human
cacauccuucuccugcucucuuuca

SEQ ID NO: 344700 - RNA, 32 nt, Human
cacauccuucuugcucaaccacugggugcaca

SEQ ID NO: 344701 - RNA, 32 nt, Human
cacauccuugugcacacauagauccaugcaca

SEQ ID NO: 344702 - RNA, 32 nt, Human
cacaucguaacuuugaccccaccgcaacccuu

SEQ ID NO: 344703 - RNA, 32 nt, Human
cacaucuaaucucauuucacaugaaagaagaa

SEQ ID NO: 344704 - RNA, 32 nt, Human
cacaucuacacccccaagcacacacacauggu

SEQ ID NO: 344705 - RNA, 32 nt, Human
cacaucuacucaacuauccgaauauguccauu

SEQ ID NO: 344706 - RNA, 32 nt, Human
cacaucuagaauucagcuucugacuaccaauc

SEQ ID NO: 344707 - RNA, 32 nt, Human
cacaucuagcauccagaacagugagaauguau

SEQ ID NO: 344708 - RNA, 32 nt, Human
cacaucuauguucacugccacucugaaaaagg

SEQ ID NO: 344709 - RNA, 32 nt, Human
cacaucucacgcagcugggaacaugugcaggc

SEQ ID NO: 344710 - RNA, 32 nt, Human
cacaucuccauucuaguugucuugaaccacgu

SEQ ID NO: 344711 - RNA, 32 nt, Human
cacaucuccuagagcugggaaugugucccuaa

SEQ ID NO: 344712 - RNA, 32 nt, Human
cacaucuccuccugcccaagauguaaggaagc

SEQ ID NO: 344713 - RNA, 32 nt, Human
cacaucucgcccuucuggaccugcacugggag

SEQ ID NO: 344714 - RNA, 32 nt, Human
cacaucucuagucccaauuacucaggaggcug

SEQ ID NO: 344715 - RNA, 32 nt, Human
cacaucucuagucccagcuacucgggaggcug

SEQ ID NO: 344716 - RNA, 32 nt, Human
cacaucugaaaaggaaggugugagaagcaaag

SEQ ID NO: 344717 - RNA, 32 nt, Human
cacaucugaauuccuucucuguggcauaugcu

SEQ ID NO: 344718 - RNA, 32 nt, Human
cacaucugaguugcugccuguucuucacacuu

SEQ ID NO: 344719 - RNA, 32 nt, Human
cacaucugcaccugugagaggccaguuugagg

SEQ ID NO: 344720 - RNA, 31 nt, Human
cacaucugcagcugccggccugugaucgugc

SEQ ID NO: 344721 - RNA, 32 nt, Human
cacaucugcccauggggaguguuuucacagcc

SEQ ID NO: 344722 - RNA, 31 nt, Human
cacaucugccucuggcugccugcguccucuc

SEQ ID NO: 344723 - RNA, 32 nt, Human
cacaucugcuuccacuguguucccacgggugc

SEQ ID NO: 344724 - RNA, 18 nt, Human
cacaucugggacaggagg

SEQ ID NO: 344725 - RNA, 32 nt, Human
cacaucugggagacaaaugcaccaucagggag

SEQ ID NO: 344726 - RNA, 22 nt, Human
cacaucuguaaucccagcacuu

SEQ ID NO: 344727 - RNA, 23 nt, Human
cacaucuguaaucccagcacuuu

SEQ ID NO: 344728 - RNA, 32 nt, Human
cacaucuguaaucccagcuacucgggaggcug

SEQ ID NO: 344729 - RNA, 32 nt, Human
cacaucuguagucccagcuacucuggaggcug

SEQ ID NO: 344730 - RNA, 32 nt, Human
cacaucuguauuccagccugggcaauagagca

SEQ ID NO: 344731 - RNA, 32 nt, Human
cacaucugucaugcaguaguuugcugcaaggu

SEQ ID NO: 344732 - RNA, 32 nt, Human
cacaucugucugcaggcugucucuccaggcac

SEQ ID NO: 344733 - RNA, 32 nt, Human
cacaucugugaaacagggagcaugaggcacaa

SEQ ID NO: 344734 - RNA, 32 nt, Human
cacaucugugagguggagggcugguguggagg

SEQ ID NO: 344735 - RNA, 32 nt, Human
cacaucuguggucccagcuacuggggaggcug

SEQ ID NO: 344736 - RNA, 32 nt, Human
cacaucuguggucccagcuacuugagaggcug

SEQ ID NO: 344737 - RNA, 32 nt, Human
cacaucuguggucccagcugcuggggaggcug

SEQ ID NO: 344738 - RNA, 32 nt, Human
cacaucuguguguugcauagcauaagccaaau

SEQ ID NO: 344739 - RNA, 32 nt, Human
cacaucuguuggagagauaaucacuccuuuuc

SEQ ID NO: 344740 - RNA, 32 nt, Human
cacaucuguuggaggacaucccagauuugcuu

SEQ ID NO: 344741 - RNA, 32 nt, Human
cacaucuuauaguaugagaaggaagguuuggg

SEQ ID NO: 344742 - RNA, 32 nt, Human
cacaucuucagccuccuccugggccagcucuu

SEQ ID NO: 344743 - RNA, 24 nt, Human
cacaucuuccacaggucucagaau

SEQ ID NO: 344744 - RNA, 32 nt, Human
cacaucuucccaagccaggccagccaggagcg

SEQ ID NO: 344745 - RNA, 32 nt, Human
cacaucuuccugucuucuucugagccuucuaa

SEQ ID NO: 344746 - RNA, 32 nt, Human
cacaucuugcagcauuuuucuuaaggcuaugc

SEQ ID NO: 344747 - RNA, 32 nt, Human
cacaucuugccaugaucucugcuggaggaagc

SEQ ID NO: 344748 - RNA, 32 nt, Human
cacaucuugcucugcugacagacacaggcccg

SEQ ID NO: 344749 - RNA, 32 nt, Human
cacaucuuggccucuuacccagcuucagcagu

SEQ ID NO: 344750 - RNA, 32 nt, Human
cacaugaaagccucugaggcuucuguugcgag

SEQ ID NO: 344751 - RNA, 20 nt, Human
cacaugaacacaugcacaug

SEQ ID NO: 344752 - RNA, 32 nt, Human
cacaugaagaagcacacgggggagcggcccua

SEQ ID NO: 344753 - RNA, 32 nt, Human
cacaugaagguuuacuugagcuuuugugauuc

SEQ ID NO: 344754 - RNA, 32 nt, Human
cacaugacacccaggagggguugugaggacuc

SEQ ID NO: 344755 - RNA, 32 nt, Human
cacaugacagcccauucuuucuuucuggguga

SEQ ID NO: 344756 - RNA, 22 nt, Human
cacaugacagugaccaagugga

SEQ ID NO: 344757 - RNA, 32 nt, Human
cacaugacagugccugaagggcucccuucaag

SEQ ID NO: 344758 - RNA, 32 nt, Human
cacaugacauugaagaccaucccaagcuaucg

SEQ ID NO: 344759 - RNA, 32 nt, Human
cacaugaccugugguagcuggaaguggggcag

SEQ ID NO: 344760 - RNA, 32 nt, Human
cacaugacguguccccuacaagcacagacaca

SEQ ID NO: 344761 - RNA, 32 nt, Human
cacaugacucuaguuauugauugcuuuuaaug

SEQ ID NO: 344762 - RNA, 32 nt, Human
cacaugagaaacuuuuaaaaaugcagaugcuu

SEQ ID NO: 344763 - RNA, 28 nt, Human
cacaugagacaaaugcgcucagcuucaa

SEQ ID NO: 344764 - RNA, 32 nt, Human
cacaugagacauggucagaaacagugcuugga

SEQ ID NO: 344765 - RNA, 32 nt, Human
cacaugagcagggugagaggugaggcaagguu

SEQ ID NO: 344766 - RNA, 32 nt, Human
cacaugagcccaggagguugaggcugcaguga

SEQ ID NO: 344767 - RNA, 32 nt, Human
cacaugagccugcucccuacugccaacaccgu

SEQ ID NO: 344768 - RNA, 31 nt, Human
cacaugagccuucucccaugcaaagcuuccc

SEQ ID NO: 344769 - RNA, 28 nt, Human
cacaugagcuacucucagggcaccaguc

SEQ ID NO: 344770 - RNA, 26 nt, Human
cacaugagugggucuauagcccgcuc

SEQ ID NO: 344771 - RNA, 25 nt, Human
cacaugauauuaaaacguacacuca

SEQ ID NO: 344772 - RNA, 32 nt, Human
cacaugaugaacaccuggcucauccauagagu

SEQ ID NO: 344773 - RNA, 32 nt, Human
cacaugcaaaaauacacacaugcacaaagaug

SEQ ID NO: 344774 - RNA, 32 nt, Human
cacaugcaacccaacagcagugcagugugaua

SEQ ID NO: 344775 - RNA, 32 nt, Human
cacaugcacacacacucacgcaugagcaaacg

SEQ ID NO: 344776 - RNA, 20 nt, Human
cacaugcacacacauaugca

SEQ ID NO: 344777 - RNA, 18 nt, Human
cacaugcacacacaugca

SEQ ID NO: 344778 - RNA, 22 nt, Human
cacaugcacacacaugcaugca

SEQ ID NO: 344779 - RNA, 32 nt, Human
cacaugcacacacgcacacacaugcacacacg

SEQ ID NO: 344780 - RNA, 32 nt, Human
cacaugcacacagaacucugacacaggaucag

SEQ ID NO: 344781 - RNA, 19 nt, Human
cacaugcacacagcaugca

SEQ ID NO: 344782 - RNA, 32 nt, Human
cacaugcacacauacacgcacaugcacacaua

SEQ ID NO: 344783 - RNA, 20 nt, Human
cacaugcacacaugcaugca

SEQ ID NO: 344784 - RNA, 32 nt, Human
cacaugcacacaugcaugcacacucacauaca

SEQ ID NO: 344785 - RNA, 32 nt, Human
cacaugcacacaugcaugcacacucauacacu

SEQ ID NO: 344786 - RNA, 32 nt, Human
cacaugcaccuguaaucccagcuacucaggaa

SEQ ID NO: 344787 - RNA, 32 nt, Human
cacaugcacgauuaaagaggagacgccgggac

SEQ ID NO: 344788 - RNA, 32 nt, Human
cacaugcacgcacacacacauauggggaccug

SEQ ID NO: 344789 - RNA, 32 nt, Human
cacaugcacgugugugcacguacacacacaua

SEQ ID NO: 344790 - RNA, 32 nt, Human
cacaugcagcucccaugccacccuccagaauu

SEQ ID NO: 344791 - RNA, 32 nt, Human
cacaugcagcugggcugagugaugucagcgag

SEQ ID NO: 344792 - RNA, 32 nt, Human
cacaugcaggcagauggaggcagggcucacac

SEQ ID NO: 344793 - RNA, 32 nt, Human
cacaugcaguccucaauucuucauugagcuag

SEQ ID NO: 344794 - RNA, 32 nt, Human
cacaugcauaaauauuaugugucaauaaaauu

SEQ ID NO: 344795 - RNA, 32 nt, Human
cacaugcaugcacacauacacaugcacacaca

SEQ ID NO: 344796 - RNA, 32 nt, Human
cacaugcaugcacacucauacacucacgcacu

SEQ ID NO: 344797 - RNA, 32 nt, Human
cacaugccaauuucagcacccaacugagaucc

SEQ ID NO: 344798 - RNA, 32 nt, Human
cacaugccaccugagcaaaacugccugcacuu

SEQ ID NO: 344799 - RNA, 32 nt, Human
cacaugccauucaguuuacccauugcuagugu

SEQ ID NO: 344800 - RNA, 32 nt, Human
cacaugcccaaacucuggguggggaagaggaa

SEQ ID NO: 344801 - RNA, 32 nt, Human
cacaugcccacauacucaugcacucacauuca

SEQ ID NO: 344802 - RNA, 32 nt, Human
cacaugcccacugcagcccuccagccucuggu

SEQ ID NO: 344803 - RNA, 32 nt, Human
cacaugccccaggggagcgaggagaacucuug

SEQ ID NO: 344804 - RNA, 32 nt, Human
cacaugccuauaaucccagcacuuugggaggc

SEQ ID NO: 344805 - RNA, 32 nt, Human
cacaugccugcgccugcugccugcugagauga

SEQ ID NO: 344806 - RNA, 32 nt, Human
cacaugccuguaacccagcuacucgggaggcu

SEQ ID NO: 344807 - RNA, 32 nt, Human
cacaugccuguaaucccagauacuugggaggc

SEQ ID NO: 344808 - RNA, 32 nt, Human
cacaugccuguaaucccagcacuuugggaagc

SEQ ID NO: 344809 - RNA, 32 nt, Human
cacaugccuguaaucccagcacuuugggaggc

SEQ ID NO: 344810 - RNA, 32 nt, Human
cacaugccuguaaucccagcacuuuggggguc

SEQ ID NO: 344811 - RNA, 32 nt, Human
cacaugccuguaaucccagcuacuuggcaggc

SEQ ID NO: 344812 - RNA, 32 nt, Human
cacaugccuguaaucccagcuacuugggaggc

SEQ ID NO: 344813 - RNA, 32 nt, Human
cacaugccuguaauccgagugcuuugggaggc

SEQ ID NO: 344814 - RNA, 32 nt, Human
cacaugccuguaauccuagcacuuugggaggc

SEQ ID NO: 344815 - RNA, 32 nt, Human
cacaugccuguaauccuagcuacucgggaggc

SEQ ID NO: 344816 - RNA, 32 nt, Human
cacaugccuguaaucucagcuacuugggaggc

SEQ ID NO: 344817 - RNA, 32 nt, Human
cacaugccugugaucccagcacuuugggaugc

SEQ ID NO: 344818 - RNA, 32 nt, Human
cacaugccuuccucccccuauuccacccccaa

SEQ ID NO: 344819 - RNA, 32 nt, Human
cacaugccuugaucauagcacuugccugcgcu

SEQ ID NO: 344820 - RNA, 32 nt, Human
cacaugcgaaggacagccugcagugaccagag

SEQ ID NO: 344821 - RNA, 32 nt, Human
cacaugcgcacacacacuugcauucaugaauc

SEQ ID NO: 344822 - RNA, 32 nt, Human
cacaugcgcacacgcacacucggacucacacg

SEQ ID NO: 344823 - RNA, 32 nt, Human
cacaugcgccuguaaucccagcuacucgggca

SEQ ID NO: 344824 - RNA, 32 nt, Human
cacaugcgugucagcacauacagccgcuuccu

SEQ ID NO: 344825 - RNA, 32 nt, Human
cacaugcguuucuguggcagcuguggggacuu

SEQ ID NO: 344826 - RNA, 31 nt, Human
cacaugcucaauaaauauuuuaaaugaguga

SEQ ID NO: 344827 - RNA, 32 nt, Human
cacaugcucacugccagcuccuguccugagua

SEQ ID NO: 344828 - RNA, 32 nt, Human
cacaugcucacuguucuccccauccuuguccu

SEQ ID NO: 344829 - RNA, 32 nt, Human
cacaugcucacuguuuuccccauccuuguccu

SEQ ID NO: 344830 - RNA, 32 nt, Human
cacaugcucagggccaccugagacugucacug

SEQ ID NO: 344831 - RNA, 32 nt, Human
cacaugcucaucuacagcuuucuuggaagaag

SEQ ID NO: 344832 - RNA, 32 nt, Human
cacaugcuguuuucucugccuggcucucucuu

SEQ ID NO: 344833 - RNA, 32 nt, Human
cacaugcuuccugcggccucuucauccuugaa

SEQ ID NO: 344834 - RNA, 32 nt, Human
cacaugcuuguaaucccagcuacucgggagcu

SEQ ID NO: 344835 - RNA, 32 nt, Human
cacaugcuuguaaucccagcuacucgggaggc

SEQ ID NO: 344836 - RNA, 32 nt, Human
cacauggaagaggucagaguguguggucacca

SEQ ID NO: 344837 - RNA, 32 nt, Human
cacauggaaucuaccagcaucucccaagaaga

SEQ ID NO: 344838 - RNA, 32 nt, Human
cacauggacacacacccaagccacaagaaauc

SEQ ID NO: 344839 - RNA, 32 nt, Human
cacauggacacaugauggggaacaacacacac

SEQ ID NO: 344840 - RNA, 23 nt, Human
cacauggacccagucuacacuca

SEQ ID NO: 344841 - RNA, 32 nt, Human
cacauggaccccuugggcugagcaccaagacc

SEQ ID NO: 344842 - RNA, 32 nt, Human
cacauggacucuuccagggagagagaccagcu

SEQ ID NO: 344843 - RNA, 32 nt, Human
cacauggagcuaaauggcucaguggcuccaga

SEQ ID NO: 344844 - RNA, 21 nt, Human
cacauggaggcuuuucuuuca

SEQ ID NO: 344845 - RNA, 32 nt, Human
cacauggaggucuacggauggcccaggcaaug

SEQ ID NO: 344846 - RNA, 28 nt, Human
cacauggcaacagcaggagcaagugaga

SEQ ID NO: 344847 - RNA, 32 nt, Human
cacauggcagcccagggggcaggagaagcccg

SEQ ID NO: 344848 - RNA, 32 nt, Human
cacauggccauggagucagccucagcccuguc

SEQ ID NO: 344849 - RNA, 32 nt, Human
cacauggcccaggaguggcaccauguugcagg

SEQ ID NO: 344850 - RNA, 32 nt, Human
cacauggcccuugagaaauguccuugcacauu

SEQ ID NO: 344851 - RNA, 32 nt, Human
cacauggccuccaaggagugggacuccuggac

SEQ ID NO: 344852 - RNA, 18 nt, Human
cacauggcucccucgccu

SEQ ID NO: 344853 - RNA, 32 nt, Human
cacauggcuggacuccagccaggaggacacac

SEQ ID NO: 344854 - RNA, 32 nt, Human
cacauggcuggcuggcugcugggugcacuuac

SEQ ID NO: 344855 - RNA, 32 nt, Human
cacauggcugugcaggccaggaggcccacaga

SEQ ID NO: 344856 - RNA, 24 nt, Human
cacauggcuucuuuugcaguuuuu

SEQ ID NO: 344857 - RNA, 32 nt, Human
cacaugggaauugcacuggugacagauaaggu

SEQ ID NO: 344858 - RNA, 32 nt, Human
cacaugggagauggggacaggaaagaugauaa

SEQ ID NO: 344859 - RNA, 32 nt, Human
cacaugggcagcucuguucccuucgccucuac

SEQ ID NO: 344860 - RNA, 32 nt, Human
cacaugggcccaggcugagugugagugagcau

SEQ ID NO: 344861 - RNA, 32 nt, Human
cacaugggcugggggccagggauaauggacag

SEQ ID NO: 344862 - RNA, 32 nt, Human
cacaugggcugggggccagggcuggauggaca

SEQ ID NO: 344863 - RNA, 32 nt, Human
cacauggggccagcucaggaccaccagggcau

SEQ ID NO: 344864 - RNA, 32 nt, Human
cacaugggguuuuggagguugaauaggaguuc

SEQ ID NO: 344865 - RNA, 32 nt, Human
cacauggguaggucaguucuuugguccaagcc

SEQ ID NO: 344866 - RNA, 32 nt, Human
cacauggguauaugccaucuucaugccuggcu

SEQ ID NO: 344867 - RNA, 32 nt, Human
cacauggguguuucuauuauccuuggaagcac

SEQ ID NO: 344868 - RNA, 32 nt, Human
cacauggugccaucuucaucuuccgcuccaca

SEQ ID NO: 344869 - RNA, 32 nt, Human
cacaugguggcaccagcaccacuccuuuccuu

SEQ ID NO: 344870 - RNA, 32 nt, Human
cacauggugugggccgacaugaagagcugcca

SEQ ID NO: 344871 - RNA, 24 nt, Human
cacaugguguuucuuuuguuccuu

SEQ ID NO: 344872 - RNA, 32 nt, Human
cacaugguuauuggaaaauacuaccuacuggu

SEQ ID NO: 344873 - RNA, 32 nt, Human
cacaugguucauaauuucacuuccuuuagauc

SEQ ID NO: 344874 - RNA, 32 nt, Human
cacaugguugcagcacugacagaguguuuuga

SEQ ID NO: 344875 - RNA, 20 nt, Human
cacaugguuuccucugccuu

SEQ ID NO: 344876 - RNA, 32 nt, Human
cacauguaauccauaaccaccaaaaauacuau

SEQ ID NO: 344877 - RNA, 32 nt, Human
cacauguacauccuggaagcugcccaaggugu

SEQ ID NO: 344878 - RNA, 32 nt, Human
cacauguacaucuuauuucugccucuaguuuu

SEQ ID NO: 344879 - RNA, 32 nt, Human
cacauguagcauggucccucugucucaggcuc

SEQ ID NO: 344880 - RNA, 32 nt, Human
cacauguagcuacucaggaggcugagacaaga

SEQ ID NO: 344881 - RNA, 32 nt, Human
cacauguaucuaugcauuuucuggacccguuc

SEQ ID NO: 344882 - RNA, 32 nt, Human
cacauguaugcacacacacaugcaccgcacac

SEQ ID NO: 344883 - RNA, 32 nt, Human
cacaugucccugucacacagguuccaagaaac

SEQ ID NO: 344884 - RNA, 32 nt, Human
cacauguccggggguugccaccagagacggcu

SEQ ID NO: 344885 - RNA, 32 nt, Human
cacaugucuaacaccacuuccaccccaccccu

SEQ ID NO: 344886 - RNA, 20 nt, Human
cacaugucucagggcuaccu

SEQ ID NO: 344887 - RNA, 32 nt, Human
cacaugucuguaauccuagcacuuugggaggc

SEQ ID NO: 344888 - RNA, 32 nt, Human
cacaugucuguccucagagcaggggccagaug

SEQ ID NO: 344889 - RNA, 32 nt, Human
cacaugugcacacacccucaugcauggguguc

SEQ ID NO: 344890 - RNA, 24 nt, Human
cacaugugcacauguacacaugua

SEQ ID NO: 344891 - RNA, 32 nt, Human
cacaugugcaggacaagcccaggggagcuccc

SEQ ID NO: 344892 - RNA, 32 nt, Human
cacaugugcuaucagggauggcuggugcgcca

SEQ ID NO: 344893 - RNA, 32 nt, Human
cacauguggcuguugucauucuuucugcaucc

SEQ ID NO: 344894 - RNA, 32 nt, Human
cacauguguaugcacauuugccagaauauaag

SEQ ID NO: 344895 - RNA, 32 nt, Human
cacaugugugcacgcacacauacaaucugggu

SEQ ID NO: 344896 - RNA, 18 nt, Human
cacauguucaccauagaa

SEQ ID NO: 344897 - RNA, 32 nt, Human
cacauguuccagcucccagccugcugagcaca

SEQ ID NO: 344898 - RNA, 22 nt, Human
cacauguugccuuuuugucuuu

SEQ ID NO: 344899 - RNA, 32 nt, Human
cacauuaaaacaaugggcucucguuugcuaua

SEQ ID NO: 344900 - RNA, 32 nt, Human
cacauuaaagagcaaagucaacagaaaaucag

SEQ ID NO: 344901 - RNA, 32 nt, Human
cacauuaaaggucagauguggggaagauagau

SEQ ID NO: 344902 - RNA, 32 nt, Human
cacauuaauucccuuugcuauacugugauccu

SEQ ID NO: 344903 - RNA, 32 nt, Human
cacauuacagcccaggacucagucaaggaugc

SEQ ID NO: 344904 - RNA, 32 nt, Human
cacauuaccaguacuuagaguaugcuaguuau

SEQ ID NO: 344905 - RNA, 32 nt, Human
cacauuaccugggaaagcucuccucccuccug

SEQ ID NO: 344906 - RNA, 32 nt, Human
cacauuaggaagcacaaaauaccaauuuuccu

SEQ ID NO: 344907 - RNA, 23 nt, Human
cacauuaguguguugucucuuuc

SEQ ID NO: 344908 - RNA, 32 nt, Human
cacauuauaaaacuaaggaugaucauuuuuaa

SEQ ID NO: 344909 - RNA, 32 nt, Human
cacauuaucuggagagaaagaaaggagaauuu

SEQ ID NO: 344910 - RNA, 32 nt, Human
cacauucaccucuaccuccaccaucaccauca

SEQ ID NO: 344911 - RNA, 22 nt, Human
cacauucacgcuguuuguuuca

SEQ ID NO: 344912 - RNA, 32 nt, Human
cacauucacugcacugccaaagcugcgccccu

SEQ ID NO: 344913 - RNA, 32 nt, Human
cacauucagcacccaccaccucccucuuucgc

SEQ ID NO: 344914 - RNA, 32 nt, Human
cacauucagcuggcuggauggacagugaggaa

SEQ ID NO: 344915 - RNA, 32 nt, Human
cacauucaugaagaauggccuggagauguuuu

SEQ ID NO: 344916 - RNA, 16 nt, Human
cacauuccacagggca

SEQ ID NO: 344917 - RNA, 32 nt, Human
cacauuccauuuucuucugaucauacuuccuc

SEQ ID NO: 344918 - RNA, 32 nt, Human
cacauuccccaaccaaggacagucuauaccaa

SEQ ID NO: 344919 - RNA, 32 nt, Human
cacauucccuugggacagaggcuacagguugg

SEQ ID NO: 344920 - RNA, 32 nt, Human
cacauuccuagagaggagccaaguucuaguag

SEQ ID NO: 344921 - RNA, 32 nt, Human
cacauuccucuccuagugucagucuccaacaa

SEQ ID NO: 344922 - RNA, 32 nt, Human
cacauuccucuugaguucugcagcuucugugu

SEQ ID NO: 344923 - RNA, 32 nt, Human
cacauuccugccacccuucuucuucuugcucu

SEQ ID NO: 344924 - RNA, 32 nt, Human
cacauuccugggugccuuuggugaggacugca

SEQ ID NO: 344925 - RNA, 32 nt, Human
cacauucuaaucccucuccccauccuguuuca

SEQ ID NO: 344926 - RNA, 32 nt, Human
cacauucucccagggacccagggcgggccgug

SEQ ID NO: 344927 - RNA, 32 nt, Human
cacauucugauucagcaggccugagauucuac

SEQ ID NO: 344928 - RNA, 32 nt, Human
cacauucugcaaggacaggagccaccuuccuc

SEQ ID NO: 344929 - RNA, 32 nt, Human
cacauucugguugugcagaacccacggcgaca

SEQ ID NO: 344930 - RNA, 32 nt, Human
cacauucuuacagaggagauggagugcuauga

SEQ ID NO: 344931 - RNA, 32 nt, Human
cacauucuuagcacaccuacaccucuugaaaa

SEQ ID NO: 344932 - RNA, 32 nt, Human
cacauucuucaaggucaaagucuagaugacag

SEQ ID NO: 344933 - RNA, 32 nt, Human
cacauucuucaugauccauuucccaggagccc

SEQ ID NO: 344934 - RNA, 32 nt, Human
cacauucuuccuacagacuccaaccaaccauu

SEQ ID NO: 344935 - RNA, 32 nt, Human
cacauucuuguccuaaaaggguacuucaagca

SEQ ID NO: 344936 - RNA, 24 nt, Human
cacauucuuuggcuguuucuuuua

SEQ ID NO: 344937 - RNA, 32 nt, Human
cacauugaacauccuuccagaaagucuuugag

SEQ ID NO: 344938 - RNA, 32 nt, Human
cacauugaauagaaauagugacaacuucucaa

SEQ ID NO: 344939 - RNA, 32 nt, Human
cacauugagaaccucaaggaggagcuggccua

SEQ ID NO: 344940 - RNA, 32 nt, Human
cacauugaucacuuucucaaccuuugaucucu

SEQ ID NO: 344941 - RNA, 32 nt, Human
cacauugccuccuuccccucccucucucaugg

SEQ ID NO: 344942 - RNA, 32 nt, Human
cacauugcucuuccuggcucuaugcacaaagg

SEQ ID NO: 344943 - RNA, 32 nt, Human
cacauuggaacaaccuucuuuccagugcuaag

SEQ ID NO: 344944 - RNA, 32 nt, Human
cacauuggacaauggugcaugccucacaccug

SEQ ID NO: 344945 - RNA, 32 nt, Human
cacauuggcucacaccugugaucccagcacuu

SEQ ID NO: 344946 - RNA, 32 nt, Human
cacauugggaagaucacuugaggcaaggaguu

SEQ ID NO: 344947 - RNA, 32 nt, Human
cacauugggaauggccacaacugugaaguuag

SEQ ID NO: 344948 - RNA, 32 nt, Human
cacauugggaggccgaggcgggcagaugucuu

SEQ ID NO: 344949 - RNA, 32 nt, Human
cacauugggcagcgcccuuccucuccacccuc

SEQ ID NO: 344950 - RNA, 32 nt, Human
cacauuggugcagaccuucggggccugucuga

SEQ ID NO: 344951 - RNA, 32 nt, Human
cacauuguacaaaaauaaugugacuucugagg

SEQ ID NO: 344952 - RNA, 32 nt, Human
cacauuguauaugauucgguuuauacauauua

SEQ ID NO: 344953 - RNA, 21 nt, Human
cacauuguccauccacuggaa

SEQ ID NO: 344954 - RNA, 32 nt, Human
cacauuguguucuugguucaucauguuaaaga

SEQ ID NO: 344955 - RNA, 32 nt, Human
cacauuguuuuuccugccuuuuuauggcuguc

SEQ ID NO: 344956 - RNA, 32 nt, Human
cacauuuacagaaugguugcugagugucugug

SEQ ID NO: 344957 - RNA, 32 nt, Human
cacauuuaccacuugcacaccagaccuuauaa

SEQ ID NO: 344958 - RNA, 21 nt, Human
cacauuuagaauucagagcca

SEQ ID NO: 344959 - RNA, 31 nt, Human
cacauuucaauaaaauuguuuggaaaauaaa

SEQ ID NO: 344960 - RNA, 32 nt, Human
cacauuucagaugcucaguagccacauguggu

SEQ ID NO: 344961 - RNA, 32 nt, Human
cacauuucagcagcuuugagaaaugaggacag

SEQ ID NO: 344962 - RNA, 32 nt, Human
cacauuucagggcacucuggccugugugcugg

SEQ ID NO: 344963 - RNA, 32 nt, Human
cacauuucauucuuugcagcuuugcuaaucca

SEQ ID NO: 344964 - RNA, 32 nt, Human
cacauuuccguguuacagcagcugccugauga

SEQ ID NO: 344965 - RNA, 32 nt, Human
cacauuucuacaaaaugcaaaaauuagcuggg

SEQ ID NO: 344966 - RNA, 32 nt, Human
cacauuucucauuccuccuaaaugaucaucuu

SEQ ID NO: 344967 - RNA, 32 nt, Human
cacauuucuuagcuucucugagccuccauuuc

SEQ ID NO: 344968 - RNA, 32 nt, Human
cacauuucuuucuccauucuguuccacugcuc

SEQ ID NO: 344969 - RNA, 32 nt, Human
cacauuugcccuuggucuucucucuuucuaga

SEQ ID NO: 344970 - RNA, 32 nt, Human
cacauuuggaauugggcaccgagaagaccuga

SEQ ID NO: 344971 - RNA, 24 nt, Human
cacauuuggagguuuugcuggaaa

SEQ ID NO: 344972 - RNA, 22 nt, Human
cacauuuguaaaugucuuuuca

SEQ ID NO: 344973 - RNA, 21 nt, Human
cacauuuguccugacucuuca

SEQ ID NO: 344974 - RNA, 32 nt, Human
cacauuugucuucugagcugcuggcaguuuug

SEQ ID NO: 344975 - RNA, 32 nt, Human
cacauuuuacauaugaaagaguggauuuucag

SEQ ID NO: 344976 - RNA, 32 nt, Human
cacauuuuacucaucaagucucuuucauuucg

SEQ ID NO: 344977 - RNA, 32 nt, Human
cacauuuuccagaaaguuguucuaaguugaga

SEQ ID NO: 344978 - RNA, 32 nt, Human
cacauuuuccuauccucuucugagccuuccaa

SEQ ID NO: 344979 - RNA, 32 nt, Human
cacauuuuccugucuucuucugagcccuccaa

SEQ ID NO: 344980 - RNA, 32 nt, Human
cacauuuuccuucuaugcaaucaugccugucu

SEQ ID NO: 344981 - RNA, 32 nt, Human
cacauuuucuacccaaucaucuggauuucaag

SEQ ID NO: 344982 - RNA, 32 nt, Human
cacauuuugauacgcagaucacuugagcuugu

SEQ ID NO: 344983 - RNA, 32 nt, Human
cacauuuugcagaaacuuguucacauuuccaa

SEQ ID NO: 344984 - RNA, 32 nt, Human
cacauuuugggagcuuuucuacaugucuguuu

SEQ ID NO: 344985 - RNA, 32 nt, Human
cacauuuugugcgcaugaugaagagagcaccg

SEQ ID NO: 344986 - RNA, 32 nt, Human
cacauuuuuacuaccagcuuuagacaaaaccc

SEQ ID NO: 344987 - RNA, 32 nt, Human
cacauuuuucaugcagucauuugcagugaauu

SEQ ID NO: 344988 - RNA, 32 nt, Human
cacauuuuucauuguugcauuuagagguuuca

SEQ ID NO: 344989 - RNA, 32 nt, Human
cacauuuuucgucuuuuggacuucuggugucu

SEQ ID NO: 344990 - RNA, 32 nt, Human
cacauuuuugcuuguggaaagacuguuuucca

SEQ ID NO: 344991 - RNA, 32 nt, Human
caccaaaaaugagucagaaacacagaagacua

SEQ ID NO: 344992 - RNA, 32 nt, Human
caccaaaagaggcaaacugagaugcagacaaa

SEQ ID NO: 344993 - RNA, 32 nt, Human
caccaaaauagcugggauuacaggcgcccacc

SEQ ID NO: 344994 - RNA, 32 nt, Human
caccaaacacccaagauuaacaggcuuuuguu

SEQ ID NO: 344995 - RNA, 32 nt, Human
caccaaaccacugccccucggagccugguagu

SEQ ID NO: 344996 - RNA, 32 nt, Human
caccaaacuaccucucugauagcugguguuca

SEQ ID NO: 344997 - RNA, 32 nt, Human
caccaaacucgaacugguaagaagacuguuag

SEQ ID NO: 344998 - RNA, 32 nt, Human
caccaaacuucucccuguucccaaacccugcc

SEQ ID NO: 344999 - RNA, 32 nt, Human
caccaaagaggaagaagagcuguggaggccac

SEQ ID NO: 345000 - RNA, 18 nt, Human
caccaaagaucccaggga

SEQ ID NO: 345001 - RNA, 32 nt, Human
caccaaagccaaucugcucuagcugcccacag

SEQ ID NO: 345002 - RNA, 32 nt, Human
caccaaagccccagggauggagcccaguggcu

SEQ ID NO: 345003 - RNA, 32 nt, Human
caccaaagcuacucaggaagccaaggugugag

SEQ ID NO: 345004 - RNA, 32 nt, Human
caccaaagcugacagaaguuauaccuuacucc

SEQ ID NO: 345005 - RNA, 32 nt, Human
caccaaagcuuuauuuauaucauuccaguauc

SEQ ID NO: 345006 - RNA, 32 nt, Human
caccaaaggaagaugcagccacccuccuuuac

SEQ ID NO: 345007 - RNA, 20 nt, Human
caccaaaggcacccgggggc

SEQ ID NO: 345008 - RNA, 32 nt, Human
caccaaaggccaccaggcuaccuucacagauc

SEQ ID NO: 345009 - RNA, 32 nt, Human
caccaaagggccagauuucuaucuucagaagg

SEQ ID NO: 345010 - RNA, 32 nt, Human
caccaaaggggaagaacaauaugggagaagcg

SEQ ID NO: 345011 - RNA, 32 nt, Human
caccaaaguaugaacuggagaggguaccucag

SEQ ID NO: 345012 - RNA, 32 nt, Human
caccaaaguucugcagacagacccagccaccc

SEQ ID NO: 345013 - RNA, 22 nt, Human
caccaaaucccuguuuuugucc

SEQ ID NO: 345014 - RNA, 20 nt, Human
caccaaauccucugcguccc

SEQ ID NO: 345015 - RNA, 32 nt, Human
caccaaaucuccugcccuucccagcuccaucc

SEQ ID NO: 345016 - RNA, 32 nt, Human
caccaaaucugacgacuccuuccagagccuac

SEQ ID NO: 345017 - RNA, 32 nt, Human
caccaaauguccccugcuccagucccacuccu

SEQ ID NO: 345018 - RNA, 26 nt, Human
caccaaauuaagucauucuuaucaca

SEQ ID NO: 345019 - RNA, 32 nt, Human
caccaaauucuguuugagauccuggccaagac

SEQ ID NO: 345020 - RNA, 32 nt, Human
caccaaauucuuuuggugaaggacgcuucaga

SEQ ID NO: 345021 - RNA, 32 nt, Human
caccaacaacacagacaagacccuguuuacaa

SEQ ID NO: 345022 - RNA, 32 nt, Human
caccaacaaggcagugccugagcaccugugcu

SEQ ID NO: 345023 - RNA, 32 nt, Human
caccaacaagggaggaagucagaggggcuggu

SEQ ID NO: 345024 - RNA, 32 nt, Human
caccaacaccaccaccaccaccgcgagcugga

SEQ ID NO: 345025 - RNA, 32 nt, Human
caccaacaccacugaaauucaccguggcuucc

SEQ ID NO: 345026 - RNA, 32 nt, Human
caccaacacugccuuccuccagccugucccuc

SEQ ID NO: 345027 - RNA, 32 nt, Human
caccaacacuggacgccuucccaugaaaaauu

SEQ ID NO: 345028 - RNA, 32 nt, Human
caccaacagaaggaagagggugaggaagccau

SEQ ID NO: 345029 - RNA, 32 nt, Human
caccaacagcacagcucaucagauguuuucua

SEQ ID NO: 345030 - RNA, 32 nt, Human
caccaacagcaggcagcacagaacagcuugcu

SEQ ID NO: 345031 - RNA, 32 nt, Human
caccaacagcuccaccauggggcuggccuggg

SEQ ID NO: 345032 - RNA, 32 nt, Human
caccaacauacaagucuugacaacagcaucug

SEQ ID NO: 345033 - RNA, 32 nt, Human
caccaacaucacaugcacgcaugcccuuucac

SEQ ID NO: 345034 - RNA, 32 nt, Human
caccaacauggacuggggacuucucagaggca

SEQ ID NO: 345035 - RNA, 32 nt, Human
caccaacauggagaaaccccgucuccacuaaa

SEQ ID NO: 345036 - RNA, 32 nt, Human
caccaacauggagaaaccccgucucuacuaaa

SEQ ID NO: 345037 - RNA, 32 nt, Human
caccaacauggagaaaucccaucucuacuaaa

SEQ ID NO: 345038 - RNA, 32 nt, Human
caccaacauuuagugccagccuaggcacaacu

SEQ ID NO: 345039 - RNA, 32 nt, Human
caccaaccaaaccacuccuaucugcaugauuc

SEQ ID NO: 345040 - RNA, 32 nt, Human
caccaaccagacggugcugauccggaguggcc

SEQ ID NO: 345041 - RNA, 32 nt, Human
caccaaccagccaagaugaacauggugaagag

SEQ ID NO: 345042 - RNA, 32 nt, Human
caccaaccaggaugcuucaccaugcuucggua

SEQ ID NO: 345043 - RNA, 32 nt, Human
caccaacccaggcagcucugcuguggcuucuc

SEQ ID NO: 345044 - RNA, 32 nt, Human
caccaacccucauccaggaaucugccaugagu

SEQ ID NO: 345045 - RNA, 32 nt, Human
caccaacccuugugguagcuguuacaaguaua

SEQ ID NO: 345046 - RNA, 23 nt, Human
caccaaccuauagcaggcaccaa

SEQ ID NO: 345047 - RNA, 32 nt, Human
caccaaccuccagggucgcucuccaaucuuaa

SEQ ID NO: 345048 - RNA, 24 nt, Human
caccaaccucuacaaagaaccagc

SEQ ID NO: 345049 - RNA, 32 nt, Human
caccaaccuggcagacuugaagaacagagggc

SEQ ID NO: 345050 - RNA, 32 nt, Human
caccaacuauuauuuucccuuguuuaucuacu

SEQ ID NO: 345051 - RNA, 32 nt, Human
caccaacucaacaacaaagugcaauacaggcu

SEQ ID NO: 345052 - RNA, 32 nt, Human
caccaacucauagcaaagucacuucuguuaau

SEQ ID NO: 345053 - RNA, 32 nt, Human
caccaacuccaaaaccgugggauucugcuuuu

SEQ ID NO: 345054 - RNA, 32 nt, Human
caccaacuccacugcuuuggaggcugcccagu

SEQ ID NO: 345055 - RNA, 32 nt, Human
caccaacuccaggaaacucauucugggccagc

SEQ ID NO: 345056 - RNA, 22 nt, Human
caccaacucuccccuaaucaca

SEQ ID NO: 345057 - RNA, 32 nt, Human
caccaacucucggccugccaguucucaagcga

SEQ ID NO: 345058 - RNA, 32 nt, Human
caccaacugcacuuugggaggcugaggcugga

SEQ ID NO: 345059 - RNA, 32 nt, Human
caccaacugcaugaagcagcacuugcuagaga

SEQ ID NO: 345060 - RNA, 24 nt, Human
caccaacuugaacaacuauccaca

SEQ ID NO: 345061 - RNA, 32 nt, Human
caccaacuuggcuggcauguugcuucugccuc

SEQ ID NO: 345062 - RNA, 32 nt, Human
caccaagaaagcuucuucagagugaagaaucu

SEQ ID NO: 345063 - RNA, 32 nt, Human
caccaagaacaaugcuggagugcaguggcgug

SEQ ID NO: 345064 - RNA, 22 nt, Human
caccaagaaggaaaauccugga

SEQ ID NO: 345065 - RNA, 32 nt, Human
caccaagaaguuaaaggcagucggacaucuca

SEQ ID NO: 345066 - RNA, 32 nt, Human
caccaagacagugcugagauuggaaagggcac

SEQ ID NO: 345067 - RNA, 22 nt, Human
caccaagaccccaaaggcccag

SEQ ID NO: 345068 - RNA, 32 nt, Human
caccaagacccuucccucccaagcccucaaag

SEQ ID NO: 345069 - RNA, 32 nt, Human
caccaagacucugcacaaccagauugcuugug

SEQ ID NO: 345070 - RNA, 32 nt, Human
caccaagagcccacuugccugggauggcccca

SEQ ID NO: 345071 - RNA, 32 nt, Human
caccaagagccgcggcagcagagaggagcgcu

SEQ ID NO: 345072 - RNA, 32 nt, Human
caccaagagcggacaggaaggccuggguccca

SEQ ID NO: 345073 - RNA, 32 nt, Human
caccaagaggccaccugucacucauggccagg

SEQ ID NO: 345074 - RNA, 32 nt, Human
caccaagaggcggggguggagcagggagcugc

SEQ ID NO: 345075 - RNA, 32 nt, Human
caccaagaggguguugugaugaggugccggug

SEQ ID NO: 345076 - RNA, 32 nt, Human
caccaagaguagaagcacaaguucuucuggga

SEQ ID NO: 345077 - RNA, 32 nt, Human
caccaagaugggcguucacuccccacggccac

SEQ ID NO: 345078 - RNA, 21 nt, Human
caccaagauggguggcaccaa

SEQ ID NO: 345079 - RNA, 32 nt, Human
caccaagcacagaaccucugcagcagaucccg

SEQ ID NO: 345080 - RNA, 31 nt, Human
caccaagcacugccugugcaugcagagaaaa

SEQ ID NO: 345081 - RNA, 32 nt, Human
caccaagcauuacuccccaucgccagcugaug

SEQ ID NO: 345082 - RNA, 32 nt, Human
caccaagcccagcuaauuuuuguauuuuagua

SEQ ID NO: 345083 - RNA, 32 nt, Human
caccaagcccagcuaauuuuuguauuuuuagu

SEQ ID NO: 345084 - RNA, 32 nt, Human
caccaagcccggcuaauuuuuguauuuuuagu

SEQ ID NO: 345085 - RNA, 32 nt, Human
caccaagcccggcuugaccucuuggcuuuuac

SEQ ID NO: 345086 - RNA, 32 nt, Human
caccaagccuggcuaaguuuuguauugccaua

SEQ ID NO: 345087 - RNA, 32 nt, Human
caccaagcgagauauuuuugggaguuauuccc

SEQ ID NO: 345088 - RNA, 32 nt, Human
caccaagcucacaccuguccuucucaggcugg

SEQ ID NO: 345089 - RNA, 32 nt, Human
caccaaggaaaagcagaacaccugaaagccag

SEQ ID NO: 345090 - RNA, 31 nt, Human
caccaaggacaacuagaaaccaaagccaucu

SEQ ID NO: 345091 - RNA, 32 nt, Human
caccaaggagagcgugaaggagaugauugagc

SEQ ID NO: 345092 - RNA, 32 nt, Human
caccaaggagcagcagcuggggcagaggagcu

SEQ ID NO: 345093 - RNA, 32 nt, Human
caccaaggauuguaauccaagccugggaaaau

SEQ ID NO: 345094 - RNA, 32 nt, Human
caccaaggccagaugacuucagcauugggaag

SEQ ID NO: 345095 - RNA, 32 nt, Human
caccaaggccaucaauaaccaggugugagcua

SEQ ID NO: 345096 - RNA, 32 nt, Human
caccaaggcccucugcaguggggaggacgagg

SEQ ID NO: 345097 - RNA, 32 nt, Human
caccaaggccuuuccagcauugcacaucuaug

SEQ ID NO: 345098 - RNA, 32 nt, Human
caccaagggaaacaaggugguucucacacugg

SEQ ID NO: 345099 - RNA, 23 nt, Human
caccaagggaaggccccauuccg

SEQ ID NO: 345100 - RNA, 32 nt, Human
caccaagggcagcccugggcucuggcugggga

SEQ ID NO: 345101 - RNA, 32 nt, Human
caccaagggcucugcuccagccucucagagaa

SEQ ID NO: 345102 - RNA, 32 nt, Human
caccaaggggaucuuaacaaauuccugaacaa

SEQ ID NO: 345103 - RNA, 32 nt, Human
caccaagggugggaugggagggcagaggggaa

SEQ ID NO: 345104 - RNA, 32 nt, Human
caccaagggugggaugggagggcaggggaaaa

SEQ ID NO: 345105 - RNA, 32 nt, Human
caccaagguccugcccacagggccaggcugcc

SEQ ID NO: 345106 - RNA, 32 nt, Human
caccaaggugaugggacucagggccuuggcuu

SEQ ID NO: 345107 - RNA, 32 nt, Human
caccaaguacuaaacccacaaagcgaucgcug

SEQ ID NO: 345108 - RNA, 31 nt, Human
caccaaguacuuuucucaugagagucaacau

SEQ ID NO: 345109 - RNA, 32 nt, Human
caccaaguacuuuucuuucuagcuaaccuuug

SEQ ID NO: 345110 - RNA, 17 nt, Human
caccaaguauauuuuga

SEQ ID NO: 345111 - RNA, 32 nt, Human
caccaagucacuguucagcuugugggcaacag

SEQ ID NO: 345112 - RNA, 32 nt, Human
caccaaguccaccuggccucagaagaggacuc

SEQ ID NO: 345113 - RNA, 32 nt, Human
caccaagucccuaggcugcacacacaugucag

SEQ ID NO: 345114 - RNA, 32 nt, Human
caccaagucgcagguccucagccuggggcaug

SEQ ID NO: 345115 - RNA, 32 nt, Human
caccaagugcacuuugggaggcugaggcugga

SEQ ID NO: 345116 - RNA, 32 nt, Human
caccaagugcagcccucguccugggucugcac

SEQ ID NO: 345117 - RNA, 32 nt, Human
caccaagugcugaggcuggaagaaaaacgcac

SEQ ID NO: 345118 - RNA, 32 nt, Human
caccaauagcucccagcacagccaggguauuc

SEQ ID NO: 345119 - RNA, 21 nt, Human
caccaauauagacauucuaga

SEQ ID NO: 345120 - RNA, 32 nt, Human
caccaaucagcaccuugugucuagcucagggu

SEQ ID NO: 345121 - RNA, 32 nt, Human
caccaaucuaugaagaccucaggccagggggu

SEQ ID NO: 345122 - RNA, 32 nt, Human
caccaaucuguggcccuucaucaugcuaagaa

SEQ ID NO: 345123 - RNA, 25 nt, Human
caccaaugaaggagagaggcaccug

SEQ ID NO: 345124 - RNA, 32 nt, Human
caccaaugauuccuaaacuccagccuggccaa

SEQ ID NO: 345125 - RNA, 32 nt, Human
caccaauggauuacaugccaucugggacaggc

SEQ ID NO: 345126 - RNA, 32 nt, Human
caccacaaacgagcucccagacauguaaacac

SEQ ID NO: 345127 - RNA, 32 nt, Human
caccacaaaggaugugugugcauccuggggca

SEQ ID NO: 345128 - RNA, 19 nt, Human
caccacaacaaaggcucau

SEQ ID NO: 345129 - RNA, 32 nt, Human
caccacaaccuccagccucccuuuucagagca

SEQ ID NO: 345130 - RNA, 32 nt, Human
caccacaaccucugccuuccagguucaaguga

SEQ ID NO: 345131 - RNA, 32 nt, Human
caccacaacuggcuaauuuuuguauuuuuagu

SEQ ID NO: 345132 - RNA, 24 nt, Human
caccacaacuugacaagguugcua

SEQ ID NO: 345133 - RNA, 22 nt, Human
caccacaagcccagccuaguca

SEQ ID NO: 345134 - RNA, 31 nt, Human
caccacaaugcaaauaccugcuugcaaaaug

SEQ ID NO: 345135 - RNA, 18 nt, Human
caccacaaugccagugaa

SEQ ID NO: 345136 - RNA, 32 nt, Human
caccacaauucacaccagcaacuaucugauca

SEQ ID NO: 345137 - RNA, 32 nt, Human
caccacacaauaggaucccccuucuugcccuc

SEQ ID NO: 345138 - RNA, 32 nt, Human
caccacacacacugcaaaccaggccucuucuu

SEQ ID NO: 345139 - RNA, 32 nt, Human
caccacacagccccaaagucaggaagccuggg

SEQ ID NO: 345140 - RNA, 32 nt, Human
caccacacauagacaugcaggcaaacacaaau

SEQ ID NO: 345141 - RNA, 32 nt, Human
caccacacauggcuaauuuuuguauuuuuaau

SEQ ID NO: 345142 - RNA, 32 nt, Human
caccacacauggcuaauuuuuguauuuuuagu

SEQ ID NO: 345143 - RNA, 32 nt, Human
caccacaccacugcuuuucagcauuguacugg

SEQ ID NO: 345144 - RNA, 32 nt, Human
caccacaccacuggauauuccugggagucacu

SEQ ID NO: 345145 - RNA, 32 nt, Human
caccacaccaggcuaauuuuguauuuuuagua

SEQ ID NO: 345146 - RNA, 32 nt, Human
caccacaccaggcuaauuuuuguauuuuuagu

SEQ ID NO: 345147 - RNA, 32 nt, Human
caccacaccagguugauuuuuguauuuuuagu

SEQ ID NO: 345148 - RNA, 32 nt, Human
caccacacccagcuaauuuuguauuuuuagua

SEQ ID NO: 345149 - RNA, 32 nt, Human
caccacacccagcuaauuuuguauuuuuggua

SEQ ID NO: 345150 - RNA, 32 nt, Human
caccacacccagcuaauuuuuguauuuuuaca

SEQ ID NO: 345151 - RNA, 32 nt, Human
caccacacccagcuaauuuuuguauuuuuacu

SEQ ID NO: 345152 - RNA, 32 nt, Human
caccacacccagcuaauuuuuguauuuuuagu

SEQ ID NO: 345153 - RNA, 32 nt, Human
caccacacccagcuaauuuuuguauuuuuggu

SEQ ID NO: 345154 - RNA, 32 nt, Human
caccacacccagcuaauuuuuguguuuuuagu

SEQ ID NO: 345155 - RNA, 32 nt, Human
caccacacccagguaauuuuuguauuuuuagu

SEQ ID NO: 345156 - RNA, 32 nt, Human
caccacacccaggucuaagucaucagaaaaga

SEQ ID NO: 345157 - RNA, 32 nt, Human
caccacacccaguuaauuuuuguauuuuuaga

SEQ ID NO: 345158 - RNA, 32 nt, Human
caccacacccaguuaauuuuuguauuuuuggu

SEQ ID NO: 345159 - RNA, 32 nt, Human
caccacaccccguuaauuuuuguauuuuuagu

SEQ ID NO: 345160 - RNA, 32 nt, Human
caccacacccggcuaauuuuguauuuuuagua

SEQ ID NO: 345161 - RNA, 32 nt, Human
caccacacccggcuaauuuuguauuuuucagu

SEQ ID NO: 345162 - RNA, 32 nt, Human
caccacacccggcuaauuuuuauauuuuuagu

SEQ ID NO: 345163 - RNA, 32 nt, Human
caccacacccggcuaauuuuugcauuuuuagu

SEQ ID NO: 345164 - RNA, 32 nt, Human
caccacacccggcuaauuuuuggauuuuuagu

SEQ ID NO: 345165 - RNA, 32 nt, Human
caccacacccggcuaauuuuuguauuuucagu

SEQ ID NO: 345166 - RNA, 32 nt, Human
caccacacccggcuaauuuuuguauuuuuagu

SEQ ID NO: 345167 - RNA, 32 nt, Human
caccacacccggcuaauuuuuguauuuuuggu

SEQ ID NO: 345168 - RNA, 32 nt, Human
caccacacccgguuaauuuuuguauuuuuagu

SEQ ID NO: 345169 - RNA, 32 nt, Human
caccacacccuccacacaccagccucugcaac

SEQ ID NO: 345170 - RNA, 32 nt, Human
caccacacccugcuaauuuuuguauuuuuagu

SEQ ID NO: 345171 - RNA, 32 nt, Human
caccacaccggaguaguuuuuguauuuuuagu

SEQ ID NO: 345172 - RNA, 32 nt, Human
caccacaccgggcuaauuuuuguauuuuuagu

SEQ ID NO: 345173 - RNA, 32 nt, Human
caccacaccuagcuaauuuuguauuuuuagua

SEQ ID NO: 345174 - RNA, 32 nt, Human
caccacaccugacuaauuuuuguauuuuuagu

SEQ ID NO: 345175 - RNA, 32 nt, Human
caccacaccuggcuaacuuuuuguauuuuuag

SEQ ID NO: 345176 - RNA, 32 nt, Human
caccacaccuggcuaaguuuuuguguuuuuag

SEQ ID NO: 345177 - RNA, 32 nt, Human
caccacaccuggcuaauuuguguguuuuuagu

SEQ ID NO: 345178 - RNA, 32 nt, Human
caccacaccuggcuaauuuucauauuuuuagu

SEQ ID NO: 345179 - RNA, 32 nt, Human
caccacaccuggcuaauuuuguauuuuuagua

SEQ ID NO: 345180 - RNA, 32 nt, Human
caccacaccuggcuaauuuuuguauauuuuug

SEQ ID NO: 345181 - RNA, 32 nt, Human
caccacaccuggcuaauuuuuguauuuuuagc

SEQ ID NO: 345182 - RNA, 32 nt, Human
caccacaccuggcuaauuuuuguauuuuuagu

SEQ ID NO: 345183 - RNA, 32 nt, Human
caccacaccuggcuaauuuuuguauuuuuggu

SEQ ID NO: 345184 - RNA, 32 nt, Human
caccacaccuggcuaauuuuuguguuguuagu

SEQ ID NO: 345185 - RNA, 32 nt, Human
caccacaccuggcuaauuuuuguguuuuuagu

SEQ ID NO: 345186 - RNA, 32 nt, Human
caccacaccuggcuaguguuuuguauuuuuag

SEQ ID NO: 345187 - RNA, 32 nt, Human
caccacaccuggcuaguuuuguguuuuuagua

SEQ ID NO: 345188 - RNA, 32 nt, Human
caccacaccuggcuaguuuuuauauuuuuagu

SEQ ID NO: 345189 - RNA, 32 nt, Human
caccacaccuggcuaguuuuuguauuuucagu

SEQ ID NO: 345190 - RNA, 32 nt, Human
caccacaccuggcuaguuuuuguauuuuuagu

SEQ ID NO: 345191 - RNA, 32 nt, Human
caccacaccugggugauuuuuguauuuuuagu

SEQ ID NO: 345192 - RNA, 32 nt, Human
caccacacgcagcuaauuuuuguauuuuuagu

SEQ ID NO: 345193 - RNA, 32 nt, Human
caccacacucaaccgucccuugugcuuguaac

SEQ ID NO: 345194 - RNA, 32 nt, Human
caccacacucagcuaauuuuuguauuuucagu

SEQ ID NO: 345195 - RNA, 32 nt, Human
caccacacucccacacuccagccuggguaaca

SEQ ID NO: 345196 - RNA, 24 nt, Human
caccacacucugccugaaggcuca

SEQ ID NO: 345197 - RNA, 32 nt, Human
caccacacugccuugagguaggaaaaggaggc

SEQ ID NO: 345198 - RNA, 32 nt, Human
caccacacuuggcuaauuuuuguauuauuagu

SEQ ID NO: 345199 - RNA, 32 nt, Human
caccacagacacacccacgacaccugaucucg

SEQ ID NO: 345200 - RNA, 32 nt, Human
caccacagagacaugcaacgguacaucuuaca

SEQ ID NO: 345201 - RNA, 20 nt, Human
caccacagagaccugcacca

SEQ ID NO: 345202 - RNA, 32 nt, Human
caccacagaggcagaaggggugaugagugaga

SEQ ID NO: 345203 - RNA, 32 nt, Human
caccacagcacaccucaccacaccacaccgca

SEQ ID NO: 345204 - RNA, 32 nt, Human
caccacagcacuccaaccugggugacagagug

SEQ ID NO: 345205 - RNA, 32 nt, Human
caccacagcacuccagcccaggcggcagugag

SEQ ID NO: 345206 - RNA, 24 nt, Human
caccacagcacugcagccuagaca

SEQ ID NO: 345207 - RNA, 32 nt, Human
caccacagcagaacagcacccagaccaacggg

SEQ ID NO: 345208 - RNA, 18 nt, Human
caccacagcagccccagg

SEQ ID NO: 345209 - RNA, 32 nt, Human
caccacagccugcuaauuuuuguauuuuuagu

SEQ ID NO: 345210 - RNA, 19 nt, Human
caccacagcgagcugcagg

SEQ ID NO: 345211 - RNA, 32 nt, Human
caccacagcgcuccagccuggucgacagagug

SEQ ID NO: 345212 - RNA, 32 nt, Human
caccacagcgggcuccccagcuuagggagguc

SEQ ID NO: 345213 - RNA, 32 nt, Human
caccacagcguccuccuccucccuggagaaga

SEQ ID NO: 345214 - RNA, 32 nt, Human
caccacagcuggagaguccuggcugagccuug

SEQ ID NO: 345215 - RNA, 22 nt, Human
caccacaggagcgugagccacu

SEQ ID NO: 345216 - RNA, 32 nt, Human
caccacagggucuggaagugugugugacgccc

SEQ ID NO: 345217 - RNA, 32 nt, Human
caccacaggugaaggaaguaaagaccacuucu

SEQ ID NO: 345218 - RNA, 32 nt, Human
caccacagucaggccuugaugggaucuucuag

SEQ ID NO: 345219 - RNA, 32 nt, Human
caccacauagaauuauccgaccccagauguca

SEQ ID NO: 345220 - RNA, 32 nt, Human
caccacaucaauaaucuuuuacucacauucug

SEQ ID NO: 345221 - RNA, 32 nt, Human
caccacaucagccuguggccauugaacuaugg

SEQ ID NO: 345222 - RNA, 32 nt, Human
caccacauccaccucgccccagagaggcucug

SEQ ID NO: 345223 - RNA, 32 nt, Human
caccacauccagcuaauuuuuguauuuuuagu

SEQ ID NO: 345224 - RNA, 32 nt, Human
caccacauccggcuaauguuuguauuuuuagc

SEQ ID NO: 345225 - RNA, 32 nt, Human
caccacauccgguuaauuuuuguauuuuuagu

SEQ ID NO: 345226 - RNA, 32 nt, Human
caccacaucuggcgaauuuuuguauuuuuagu

SEQ ID NO: 345227 - RNA, 32 nt, Human
caccacaucuggcuaacuuuuuguauuuuuag

SEQ ID NO: 345228 - RNA, 32 nt, Human
caccacaucuggcuaauuuuuguauuuuuagu

SEQ ID NO: 345229 - RNA, 32 nt, Human
caccacauggcccagccccaacauuucacucc

SEQ ID NO: 345230 - RNA, 22 nt, Human
caccacauuuaucuaagaagug

SEQ ID NO: 345231 - RNA, 32 nt, Human
caccaccaacaccaccaccaccaccgcgagcu

SEQ ID NO: 345232 - RNA, 32 nt, Human
caccaccaaggagagagguugacaugaccucc

SEQ ID NO: 345233 - RNA, 20 nt, Human
caccaccacacccagccuag

SEQ ID NO: 345234 - RNA, 24 nt, Human
caccaccacacuccagccugagca

SEQ ID NO: 345235 - RNA, 32 nt, Human
caccaccacacuccagccugagcagcagagcg

SEQ ID NO: 345236 - RNA, 23 nt, Human
caccaccacacuccagccugcgc

SEQ ID NO: 345237 - RNA, 23 nt, Human
caccaccacacuccagccugggu

SEQ ID NO: 345238 - RNA, 32 nt, Human
caccaccacacuccagccugggugacaagagc

SEQ ID NO: 345239 - RNA, 32 nt, Human
caccaccacacuccagccugggugacagagcg

SEQ ID NO: 345240 - RNA, 32 nt, Human
caccaccacacuccagccugggugacagagug

SEQ ID NO: 345241 - RNA, 32 nt, Human
caccaccacagcuugaucucucucacaacuuc

SEQ ID NO: 345242 - RNA, 32 nt, Human
caccaccaccaacaccaccaccaccaccgcga

SEQ ID NO: 345243 - RNA, 32 nt, Human
caccaccaccacagcaacccagacagcuaggc

SEQ ID NO: 345244 - RNA, 32 nt, Human
caccaccaccaccaacaccaccaccaccaccg

SEQ ID NO: 345245 - RNA, 16 nt, Human
caccaccaccaccacc

SEQ ID NO: 345246 - RNA, 32 nt, Human
caccaccaccaccaccaccaacaccaccacca

SEQ ID NO: 345247 - RNA, 32 nt, Human
caccaccaccaccaccaccaccaccaccacua

SEQ ID NO: 345248 - RNA, 32 nt, Human
caccaccaccaccaccaccaccaccacuacca

SEQ ID NO: 345249 - RNA, 32 nt, Human
caccaccaccaccaccaccaccaccuacuuca

SEQ ID NO: 345250 - RNA, 32 nt, Human
caccaccaccaccaccaccaccacuaccacca

SEQ ID NO: 345251 - RNA, 32 nt, Human
caccaccaccaccaccaccaccaucaccacca

SEQ ID NO: 345252 - RNA, 32 nt, Human
caccaccaccaccaccaccaccuacuucaaga

SEQ ID NO: 345253 - RNA, 32 nt, Human
caccaccaccaccaccaccacuaccaccacca

SEQ ID NO: 345254 - RNA, 32 nt, Human
caccaccaccaccaccaccaucaccaccacca

SEQ ID NO: 345255 - RNA, 32 nt, Human
caccaccaccaccaccaccccuacuaccccug

SEQ ID NO: 345256 - RNA, 32 nt, Human
caccaccaccaccaccaccuacuucaagaugc

SEQ ID NO: 345257 - RNA, 32 nt, Human
caccaccaccaccaccagcaccaccacuccau

SEQ ID NO: 345258 - RNA, 32 nt, Human
caccaccaccaccaccauuacagcgccuccuu

SEQ ID NO: 345259 - RNA, 32 nt, Human
caccaccaccaccacccacugccugcagcagg

SEQ ID NO: 345260 - RNA, 17 nt, Human
caccaccaccacccugg

SEQ ID NO: 345261 - RNA, 32 nt, Human
caccaccaccacugagauccggcuugcuacaa

SEQ ID NO: 345262 - RNA, 32 nt, Human
caccaccacccaggagcucagagaucuaagcu

SEQ ID NO: 345263 - RNA, 32 nt, Human
caccaccacccccaaaugcauacugcuggccu

SEQ ID NO: 345264 - RNA, 32 nt, Human
caccaccaccgccaccacuaccaccaucacua

SEQ ID NO: 345265 - RNA, 32 nt, Human
caccaccaccuucuccccauagcgacucuucu

SEQ ID NO: 345266 - RNA, 32 nt, Human
caccaccacgcccagcuaauuuuguagagaug

SEQ ID NO: 345267 - RNA, 32 nt, Human
caccaccacgcccagcuaauuuuuggauuuuu

SEQ ID NO: 345268 - RNA, 32 nt, Human
caccaccagagggcgcccgagcacagagacgc

SEQ ID NO: 345269 - RNA, 32 nt, Human
caccaccagcguaacuggcaaguuaccaaggu

SEQ ID NO: 345270 - RNA, 32 nt, Human
caccaccaggguggaccaggccuggagggcac

SEQ ID NO: 345271 - RNA, 32 nt, Human
caccaccaucaccaccaccaucaccaccacca

SEQ ID NO: 345272 - RNA, 32 nt, Human
caccaccaucaucaucauugucaucgucauca

SEQ ID NO: 345273 - RNA, 32 nt, Human
caccaccauggcucucugcagccuugaccucu

SEQ ID NO: 345274 - RNA, 32 nt, Human
caccaccauggugaaacccuaucucuacuaaa

SEQ ID NO: 345275 - RNA, 32 nt, Human
caccaccauuauagucagacugggcaccguuu

SEQ ID NO: 345276 - RNA, 17 nt, Human
caccaccauuuccccca

SEQ ID NO: 345277 - RNA, 28 nt, Human
caccacccaagcugugccucauggaguc

SEQ ID NO: 345278 - RNA, 28 nt, Human
caccacccaaguguccagccucucugug

SEQ ID NO: 345279 - RNA, 19 nt, Human
caccacccaccugcuggcc

SEQ ID NO: 345280 - RNA, 32 nt, Human
caccacccaccuuucuccuccuggggaguguc

SEQ ID NO: 345281 - RNA, 32 nt, Human
caccacccacugcaccguggucucgggcucac

SEQ ID NO: 345282 - RNA, 32 nt, Human
caccacccagccugaccuguguuuuggcaagg

SEQ ID NO: 345283 - RNA, 32 nt, Human
caccaccccaccccaagccacagugagcuugg

SEQ ID NO: 345284 - RNA, 32 nt, Human
caccaccccacccuccuccugucccgugguuu

SEQ ID NO: 345285 - RNA, 32 nt, Human
caccaccccagccaugggccauacgggggucc

SEQ ID NO: 345286 - RNA, 32 nt, Human
caccaccccagcugcuccccucccuccucugu

SEQ ID NO: 345287 - RNA, 32 nt, Human
caccacccccagcuaauuuuuguauuuuuagu

SEQ ID NO: 345288 - RNA, 19 nt, Human
caccaccccccaugccacc

SEQ ID NO: 345289 - RNA, 32 nt, Human
caccaccccucccucugcucucauaggaguua

SEQ ID NO: 345290 - RNA, 32 nt, Human
caccaccccuggcuaaauuuguauuuucagua

SEQ ID NO: 345291 - RNA, 32 nt, Human
caccaccccuggcuaauuuuuguauuuuuagu

SEQ ID NO: 345292 - RNA, 25 nt, Human
caccaccccuuccccaccuccuggg

SEQ ID NO: 345293 - RNA, 32 nt, Human
caccaccccuugcccagccaauggacacagua

SEQ ID NO: 345294 - RNA, 32 nt, Human
caccacccgagcgcuccuucucugauauuggc

SEQ ID NO: 345295 - RNA, 22 nt, Human
caccacccguccaguaccacca

SEQ ID NO: 345296 - RNA, 32 nt, Human
caccacccucacuguccuccagcccaggaugg

SEQ ID NO: 345297 - RNA, 21 nt, Human
caccacccuccagccugggca

SEQ ID NO: 345298 - RNA, 32 nt, Human
caccacccuccgucucuucggcugcuugcucu

SEQ ID NO: 345299 - RNA, 32 nt, Human
caccacccugaaggagcuucuuuuccucuggg

SEQ ID NO: 345300 - RNA, 32 nt, Human
caccacccugauggugacagagggggacagcc

SEQ ID NO: 345301 - RNA, 32 nt, Human
caccacccugcuguccaguccccagccuggcc

SEQ ID NO: 345302 - RNA, 21 nt, Human
caccacccuggacuggcccag

SEQ ID NO: 345303 - RNA, 32 nt, Human
caccacccuggagucuagaccaacacacaaag

SEQ ID NO: 345304 - RNA, 32 nt, Human
caccacccuguauuccagaaacaggugcaauu

SEQ ID NO: 345305 - RNA, 32 nt, Human
caccaccgcacuccacccugggaagcaaagug

SEQ ID NO: 345306 - RNA, 23 nt, Human
caccaccgcacuccagccugggu

SEQ ID NO: 345307 - RNA, 32 nt, Human
caccaccgcacuccagccugggugacagagcg

SEQ ID NO: 345308 - RNA, 16 nt, Human
caccaccgccaccacc

SEQ ID NO: 345309 - RNA, 32 nt, Human
caccaccgccaccaccaccaccaucaucacca

SEQ ID NO: 345310 - RNA, 32 nt, Human
caccaccgccccaugugaaccugucccacucc

SEQ ID NO: 345311 - RNA, 32 nt, Human
caccaccgcugccaccaccaccgccaccaccg

SEQ ID NO: 345312 - RNA, 32 nt, Human
caccaccguucccgcccgccucccugcggcuc

SEQ ID NO: 345313 - RNA, 19 nt, Human
caccaccuacagcccagug

SEQ ID NO: 345314 - RNA, 19 nt, Human
caccaccuacaggcacacc

SEQ ID NO: 345315 - RNA, 16 nt, Human
caccaccuaccccucc

SEQ ID NO: 345316 - RNA, 18 nt, Human
caccaccuacgugcacac

SEQ ID NO: 345317 - RNA, 18 nt, Human
caccaccuauucccccca

SEQ ID NO: 345318 - RNA, 32 nt, Human
caccaccucacacgcccucuucccuggcccca

SEQ ID NO: 345319 - RNA, 24 nt, Human
caccaccucacuccagccugggca

SEQ ID NO: 345320 - RNA, 32 nt, Human
caccaccucacuccagccugggcaacauagug

SEQ ID NO: 345321 - RNA, 32 nt, Human
caccaccucauuguucucaucuggaacugaaa

SEQ ID NO: 345322 - RNA, 32 nt, Human
caccaccuccaccaccaccaccaccaccacca

SEQ ID NO: 345323 - RNA, 32 nt, Human
caccaccuccacugccaugaccaggccgaagg

SEQ ID NO: 345324 - RNA, 32 nt, Human
caccaccucccaggauggcaaggaagugagag

SEQ ID NO: 345325 - RNA, 17 nt, Human
caccaccuccccaucca

SEQ ID NO: 345326 - RNA, 32 nt, Human
caccaccuccuccaaagcacugagguccuggc

SEQ ID NO: 345327 - RNA, 32 nt, Human
caccaccucucacuucucaaggcugugggucc

SEQ ID NO: 345328 - RNA, 32 nt, Human
caccaccugcagcuucucagccaaugcugauu

SEQ ID NO: 345329 - RNA, 32 nt, Human
caccaccugcagcuugucuccggauucagcca

SEQ ID NO: 345330 - RNA, 20 nt, Human
caccaccugcccucccgcga

SEQ ID NO: 345331 - RNA, 32 nt, Human
caccaccugccugcuugcuucucuggcugccu

SEQ ID NO: 345332 - RNA, 18 nt, Human
caccaccugcuccagcca

SEQ ID NO: 345333 - RNA, 32 nt, Human
caccaccuggacaauaauugaugcccuuaaaa

SEQ ID NO: 345334 - RNA, 32 nt, Human
caccaccuggagugaucaccucuuggggaccc

SEQ ID NO: 345335 - RNA, 32 nt, Human
caccaccuggcccagccuccaucagggacccc

SEQ ID NO: 345336 - RNA, 17 nt, Human
caccaccugugccccca

SEQ ID NO: 345337 - RNA, 17 nt, Human
caccaccuuucccauca

SEQ ID NO: 345338 - RNA, 32 nt, Human
caccaccuuugucugauacuuguuuccaggga

SEQ ID NO: 345339 - RNA, 17 nt, Human
caccaccuuuuguccca

SEQ ID NO: 345340 - RNA, 32 nt, Human
caccacgacuggcuaauuuuuauauuuuuagu

SEQ ID NO: 345341 - RNA, 32 nt, Human
caccacgacuggcuaauuuuuguauuuuuagu

SEQ ID NO: 345342 - RNA, 22 nt, Human
caccacgcaagcccagggccug

SEQ ID NO: 345343 - RNA, 32 nt, Human
caccacgcacaacacuguccccugccagcucc

SEQ ID NO: 345344 - RNA, 32 nt, Human
caccacgcacaacuaauuuuuguauuuuuagu

SEQ ID NO: 345345 - RNA, 32 nt, Human
caccacgcacggcuaauuuuuguauuuuuagu

SEQ ID NO: 345346 - RNA, 32 nt, Human
caccacgcagaggcgcuucaggucaugacagu

SEQ ID NO: 345347 - RNA, 32 nt, Human
caccacgcagccgccgccgcccacgccggccu

SEQ ID NO: 345348 - RNA, 32 nt, Human
caccacgcauggcuaaucuuuuuguguuuuug

SEQ ID NO: 345349 - RNA, 32 nt, Human
caccacgccaagcuaauuuuuguauuuuuagu

SEQ ID NO: 345350 - RNA, 32 nt, Human
caccacgccacugcacuccagccugggugaca

SEQ ID NO: 345351 - RNA, 32 nt, Human
caccacgccacugcacuccagcgugggcaaca

SEQ ID NO: 345352 - RNA, 32 nt, Human
caccacgccaggcuaauuuuguauuuuuagua

SEQ ID NO: 345353 - RNA, 32 nt, Human
caccacgccaggcuaauuuuguauuuuuggug

SEQ ID NO: 345354 - RNA, 32 nt, Human
caccacgccaggcuaauuuuuguauuuuuagu

SEQ ID NO: 345355 - RNA, 32 nt, Human
caccacgccaggcuacuuuuuguauuuuuagu

SEQ ID NO: 345356 - RNA, 32 nt, Human
caccacgcccaacuaauuuuguauuuuuagua

SEQ ID NO: 345357 - RNA, 32 nt, Human
caccacgcccaacuaauuuuuauauuuuuagu

SEQ ID NO: 345358 - RNA, 32 nt, Human
caccacgcccaacugauuuuuguauuuuuagu

SEQ ID NO: 345359 - RNA, 18 nt, Human
caccacgcccaacuggga

SEQ ID NO: 345360 - RNA, 32 nt, Human
caccacgcccagcuaauuuuauguauuuuuag

SEQ ID NO: 345361 - RNA, 32 nt, Human
caccacgcccagcuaauuuuguauuuuuagua

SEQ ID NO: 345362 - RNA, 32 nt, Human
caccacgcccagcuaauuuuuauauuuuuagu

SEQ ID NO: 345363 - RNA, 32 nt, Human
caccacgcccagcuaauuuuugcauuuuuagu

SEQ ID NO: 345364 - RNA, 32 nt, Human
caccacgcccagcuaauuuuuguauuauuuua

SEQ ID NO: 345365 - RNA, 32 nt, Human
caccacgcccagcuaauuuuuguauuucuuuu

SEQ ID NO: 345366 - RNA, 32 nt, Human
caccacgcccagcuaauuuuuguauuugagua

SEQ ID NO: 345367 - RNA, 32 nt, Human
caccacgcccagcuaauuuuuguauuuucagu

SEQ ID NO: 345368 - RNA, 32 nt, Human
caccacgcccagcuaauuuuuguauuuuuaca

SEQ ID NO: 345369 - RNA, 32 nt, Human
caccacgcccagcuaauuuuuguauuuuuagc

SEQ ID NO: 345370 - RNA, 32 nt, Human
caccacgcccagcuaauuuuuguauuuuuagu

SEQ ID NO: 345371 - RNA, 32 nt, Human
caccacgcccagcuaauuuuuguauuuuuggu

SEQ ID NO: 345372 - RNA, 32 nt, Human
caccacgcccagcuaauuuuuguauuuuugua

SEQ ID NO: 345373 - RNA, 32 nt, Human
caccacgcccagcuaauuuuuguguuuuuagu

SEQ ID NO: 345374 - RNA, 32 nt, Human
caccacgcccagcuacuuuuuguauuuuuagu

SEQ ID NO: 345375 - RNA, 32 nt, Human
caccacgcccagcuaguuuuuguauuuuuggu

SEQ ID NO: 345376 - RNA, 32 nt, Human
caccacgcccagcugauuuuuguauuuuuagu

SEQ ID NO: 345377 - RNA, 32 nt, Human
caccacgcccaguugauuuuuguauuuuugau

SEQ ID NO: 345378 - RNA, 32 nt, Human
caccacgccccacuaauuuuuguauuuuuggu

SEQ ID NO: 345379 - RNA, 32 nt, Human
caccacgccccgcuaauuuuuguauuuuuggu

SEQ ID NO: 345380 - RNA, 32 nt, Human
caccacgcccggccaauuuuuguguuuucagu

SEQ ID NO: 345381 - RNA, 32 nt, Human
caccacgcccggcuaauguuuguauuuuuagu

SEQ ID NO: 345382 - RNA, 32 nt, Human
caccacgcccggcuaauuucuguauuuuuagu

SEQ ID NO: 345383 - RNA, 32 nt, Human
caccacgcccggcuaauuuguguauuuuuagu

SEQ ID NO: 345384 - RNA, 32 nt, Human
caccacgcccggcuaauuuuguauuucuagua

SEQ ID NO: 345385 - RNA, 32 nt, Human
caccacgcccggcuaauuuuguauuuucaguc

SEQ ID NO: 345386 - RNA, 32 nt, Human
caccacgcccggcuaauuuuguauuuuuaagu

SEQ ID NO: 345387 - RNA, 32 nt, Human
caccacgcccggcuaauuuuguauuuuuagua

SEQ ID NO: 345388 - RNA, 32 nt, Human
caccacgcccggcuaauuuuguauuuuucaua

SEQ ID NO: 345389 - RNA, 32 nt, Human
caccacgcccggcuaauuuuuauauuuuuggu

SEQ ID NO: 345390 - RNA, 32 nt, Human
caccacgcccggcuaauuuuuauguuuuuagu

SEQ ID NO: 345391 - RNA, 32 nt, Human
caccacgcccggcuaauuuuuguauucuuagu

SEQ ID NO: 345392 - RNA, 32 nt, Human
caccacgcccggcuaauuuuuguauuuucagu

SEQ ID NO: 345393 - RNA, 32 nt, Human
caccacgcccggcuaauuuuuguauuuuguau

SEQ ID NO: 345394 - RNA, 32 nt, Human
caccacgcccggcuaauuuuuguauuuuuaau

SEQ ID NO: 345395 - RNA, 32 nt, Human
caccacgcccggcuaauuuuuguauuuuuagu

SEQ ID NO: 345396 - RNA, 32 nt, Human
caccacgcccggcuaauuuuuguguuuuuagu

SEQ ID NO: 345397 - RNA, 32 nt, Human
caccacgcccggcugauuuuuguguuuuuagu

SEQ ID NO: 345398 - RNA, 32 nt, Human
caccacgcccguguaauuuuuguauuuuuagu

SEQ ID NO: 345399 - RNA, 32 nt, Human
caccacgcccugcuaauuuuuguauucuuagu

SEQ ID NO: 345400 - RNA, 32 nt, Human
caccacgccuagcuaauuucuguauuuuuagu

SEQ ID NO: 345401 - RNA, 32 nt, Human
caccacgccuagcuaauuucuuuguauuuuug

SEQ ID NO: 345402 - RNA, 32 nt, Human
caccacgccuagcuaauuuuuauauuuuuagu

SEQ ID NO: 345403 - RNA, 32 nt, Human
caccacgccuagcuaauuuuuguauuuuuagc

SEQ ID NO: 345404 - RNA, 32 nt, Human
caccacgccucgcugauuuuuguauuuuagua

SEQ ID NO: 345405 - RNA, 32 nt, Human
caccacgccugacuaauuuuguauuuuuagua

SEQ ID NO: 345406 - RNA, 32 nt, Human
caccacgccugacuaauuuuuguauuuuuagu

SEQ ID NO: 345407 - RNA, 32 nt, Human
caccacgccuggcuaaauuuuguauuuuuagg

SEQ ID NO: 345408 - RNA, 32 nt, Human
caccacgccuggcuaaauuuuguauuuuuagu

SEQ ID NO: 345409 - RNA, 32 nt, Human
caccacgccuggcuaauguuguauuuuaguag

SEQ ID NO: 345410 - RNA, 32 nt, Human
caccacgccuggcuaauuuguguauuuuuagu

SEQ ID NO: 345411 - RNA, 32 nt, Human
caccacgccuggcuaauuuucguauuuuuagu

SEQ ID NO: 345412 - RNA, 32 nt, Human
caccacgccuggcuaauuuuguauuuuuagua

SEQ ID NO: 345413 - RNA, 32 nt, Human
caccacgccuggcuaauuuuguuuuuguauuu

SEQ ID NO: 345414 - RNA, 32 nt, Human
caccacgccuggcuaauuuuugaauuuuuagu

SEQ ID NO: 345415 - RNA, 32 nt, Human
caccacgccuggcuaauuuuuguacuuuucau

SEQ ID NO: 345416 - RNA, 32 nt, Human
caccacgccuggcuaauuuuuguaguuuuagu

SEQ ID NO: 345417 - RNA, 32 nt, Human
caccacgccuggcuaauuuuuguauauuuaag

SEQ ID NO: 345418 - RNA, 32 nt, Human
caccacgccuggcuaauuuuuguauuuuagug

SEQ ID NO: 345419 - RNA, 32 nt, Human
caccacgccuggcuaauuuuuguauuuuuaau

SEQ ID NO: 345420 - RNA, 32 nt, Human
caccacgccuggcuaauuuuuguauuuuuagu

SEQ ID NO: 345421 - RNA, 32 nt, Human
caccacgccuggcuaauuuuuguauuuuuggu

SEQ ID NO: 345422 - RNA, 32 nt, Human
caccacgccuggcugauuuuuguauuuuuagu

SEQ ID NO: 345423 - RNA, 32 nt, Human
caccacgccuggcugauuuuuguguuuuuagu

SEQ ID NO: 345424 - RNA, 32 nt, Human
caccacgccuggguaauuuuuguauuuuuacu

SEQ ID NO: 345425 - RNA, 32 nt, Human
caccacgccugguuaauuuuuguauuuauagu

SEQ ID NO: 345426 - RNA, 32 nt, Human
caccacgcguggcuaauguuuuuguauuuuua

SEQ ID NO: 345427 - RNA, 32 nt, Human
caccacgcucagcuaauuuuuguauuuuuagu

SEQ ID NO: 345428 - RNA, 32 nt, Human
caccacgcucagcuaauuuuuguguuuuagua

SEQ ID NO: 345429 - RNA, 32 nt, Human
caccacgcucgacuaauuuuuguauuuuuagu

SEQ ID NO: 345430 - RNA, 32 nt, Human
caccacgcucggcuaauuuuuguauuuuuagu

SEQ ID NO: 345431 - RNA, 32 nt, Human
caccacgcucugcuaauuuuuguauuuuuagu

SEQ ID NO: 345432 - RNA, 32 nt, Human
caccacgcuggggucugggaggaauggacaga

SEQ ID NO: 345433 - RNA, 32 nt, Human
caccacgcuuggcuaauuuuuguauuuuuagu

SEQ ID NO: 345434 - RNA, 32 nt, Human
caccacgcuugguuaauuuuuguauuuuuagu

SEQ ID NO: 345435 - RNA, 32 nt, Human
caccacggcacacaccuccagccucgagcccg

SEQ ID NO: 345436 - RNA, 32 nt, Human
caccacggcacucaagccugggcaauguagca

SEQ ID NO: 345437 - RNA, 32 nt, Human
caccacggcacuccagccugggugacagagug

SEQ ID NO: 345438 - RNA, 32 nt, Human
caccacggcacuucagccugggugacagaaug

SEQ ID NO: 345439 - RNA, 19 nt, Human
caccacggccugggcccca

SEQ ID NO: 345440 - RNA, 32 nt, Human
caccacgggacaggaaggugagauccgggacc

SEQ ID NO: 345441 - RNA, 24 nt, Human
caccacggggcagcaugaccacca

SEQ ID NO: 345442 - RNA, 32 nt, Human
caccacguccagcuaauuguuguauuuuugau

SEQ ID NO: 345443 - RNA, 32 nt, Human
caccacguccagcuaauuuuuauauuuuuagu

SEQ ID NO: 345444 - RNA, 32 nt, Human
caccacguccagcuaauuuuuguauuuucagu

SEQ ID NO: 345445 - RNA, 32 nt, Human
caccacguccagcuaauuuuuguauuuuuagu

SEQ ID NO: 345446 - RNA, 32 nt, Human
caccacguccggcuaauuuuuguauuuuuagu

SEQ ID NO: 345447 - RNA, 32 nt, Human
caccacgucuggcuaauuuuguauuuuuagua

SEQ ID NO: 345448 - RNA, 32 nt, Human
caccacgucuggcuaauuuuuguauuuuuagu

SEQ ID NO: 345449 - RNA, 22 nt, Human
caccacgugcuccaccuagaca

SEQ ID NO: 345450 - RNA, 32 nt, Human
caccacgugcuucacacuucauuuuucuccuc

SEQ ID NO: 345451 - RNA, 32 nt, Human
caccacguggcuggccccuuccucugcugcuc

SEQ ID NO: 345452 - RNA, 32 nt, Human
caccacguuaacugcauuuuacacauugacaa

SEQ ID NO: 345453 - RNA, 32 nt, Human
caccacguucggcuaauuuuuguauuuucagu

SEQ ID NO: 345454 - RNA, 32 nt, Human
caccacguuggccaggcuggucucaaacuccu

SEQ ID NO: 345455 - RNA, 32 nt, Human
caccacguuggccaggcuggucuggaacuccu

SEQ ID NO: 345456 - RNA, 32 nt, Human
caccacguuggccaggguggucuugagcuccu

SEQ ID NO: 345457 - RNA, 32 nt, Human
caccacuaacaccucagacgcuugggcaggga

SEQ ID NO: 345458 - RNA, 32 nt, Human
caccacuaaguuucagaacuuuccuuaggacu

SEQ ID NO: 345459 - RNA, 24 nt, Human
caccacuacacuccagccaaagca

SEQ ID NO: 345460 - RNA, 23 nt, Human
caccacuacacuccagcccgggc

SEQ ID NO: 345461 - RNA, 32 nt, Human
caccacuacacuccagcccgggcgacagagca

SEQ ID NO: 345462 - RNA, 24 nt, Human
caccacuacacuccagccuaggca

SEQ ID NO: 345463 - RNA, 32 nt, Human
caccacuacacuccagccuaggcaacagagca

SEQ ID NO: 345464 - RNA, 21 nt, Human
caccacuacacuccagccugg

SEQ ID NO: 345465 - RNA, 24 nt, Human
caccacuacacuccagccuggaca

SEQ ID NO: 345466 - RNA, 32 nt, Human
caccacuacacuccagccuggaugacagagug

SEQ ID NO: 345467 - RNA, 23 nt, Human
caccacuacacuccagccugggc

SEQ ID NO: 345468 - RNA, 24 nt, Human
caccacuacacuccagccugggca

SEQ ID NO: 345469 - RNA, 32 nt, Human
caccacuacacuccagccugggcaacagagag

SEQ ID NO: 345470 - RNA, 32 nt, Human
caccacuacacuccagccugggcgacagagug

SEQ ID NO: 345471 - RNA, 32 nt, Human
caccacuacacuccagccugggcgagacggca

SEQ ID NO: 345472 - RNA, 23 nt, Human
caccacuacacuccagccugggu

SEQ ID NO: 345473 - RNA, 32 nt, Human
caccacuacacuccagccugggugacaaagca

SEQ ID NO: 345474 - RNA, 32 nt, Human
caccacuacacuccagccugggugacagcaag

SEQ ID NO: 345475 - RNA, 32 nt, Human
caccacuacacuguagccugggugacaaagug

SEQ ID NO: 345476 - RNA, 32 nt, Human
caccacuacgacuuaguccgggauaagggccu

SEQ ID NO: 345477 - RNA, 32 nt, Human
caccacuacuauaugaugaauagcacuaauac

SEQ ID NO: 345478 - RNA, 32 nt, Human
caccacuagaacuuuaauaacuacccagggag

SEQ ID NO: 345479 - RNA, 32 nt, Human
caccacuagagggugcuacagaauguaaagca

SEQ ID NO: 345480 - RNA, 32 nt, Human
caccacuaguagauagaaauucuaacaacuug

SEQ ID NO: 345481 - RNA, 32 nt, Human
caccacuaucucuguuccaucugggcuuauau

SEQ ID NO: 345482 - RNA, 32 nt, Human
caccacucacagauuccucacacuggggaaau

SEQ ID NO: 345483 - RNA, 32 nt, Human
caccacucagccacccagaguacguguuuaca

SEQ ID NO: 345484 - RNA, 17 nt, Human
caccacucaugucacca

SEQ ID NO: 345485 - RNA, 32 nt, Human
caccacuccagccugggcaacaagagcgagac

SEQ ID NO: 345486 - RNA, 32 nt, Human
caccacucccagcuaauuuuuguauuuuuagu

SEQ ID NO: 345487 - RNA, 32 nt, Human
caccacucccucugcagguagcuccugcccca

SEQ ID NO: 345488 - RNA, 32 nt, Human
caccacuccgggcuaauuuuuguguuuuaagu

SEQ ID NO: 345489 - RNA, 21 nt, Human
caccacuccugccugccccca

SEQ ID NO: 345490 - RNA, 32 nt, Human
caccacugaacuccagccugggcgacaagagg

SEQ ID NO: 345491 - RNA, 32 nt, Human
caccacugaacuccagccugggcgacagaggg

SEQ ID NO: 345492 - RNA, 32 nt, Human
caccacugaccucuagccugguggcagaguga

SEQ ID NO: 345493 - RNA, 32 nt, Human
caccacugagccuagaccauggagccuuggca

SEQ ID NO: 345494 - RNA, 32 nt, Human
caccacugcaauccagccucgguaacacagcg

SEQ ID NO: 345495 - RNA, 32 nt, Human
caccacugcaauccagccugggcgacaaagca

SEQ ID NO: 345496 - RNA, 32 nt, Human
caccacugcacacugcacuccauccugggcga

SEQ ID NO: 345497 - RNA, 24 nt, Human
caccacugcaccccagccugggca

SEQ ID NO: 345498 - RNA, 32 nt, Human
caccacugcaccccagccugggcaacaagagu

SEQ ID NO: 345499 - RNA, 32 nt, Human
caccacugcaccccagccugggugacagcgag

SEQ ID NO: 345500 - RNA, 32 nt, Human
caccacugcaccucggaggccagcccugucca

SEQ ID NO: 345501 - RNA, 32 nt, Human
caccacugcacgcacuccagccugggugacag

SEQ ID NO: 345502 - RNA, 32 nt, Human
caccacugcacgccagccugggugaaagagug

SEQ ID NO: 345503 - RNA, 32 nt, Human
caccacugcacuacagccugggcgacagaacg

SEQ ID NO: 345504 - RNA, 24 nt, Human
caccacugcacucaagccugggca

SEQ ID NO: 345505 - RNA, 32 nt, Human
caccacugcacucaagccugggcaacagagug

SEQ ID NO: 345506 - RNA, 32 nt, Human
caccacugcacucaagccugggcgacagagca

SEQ ID NO: 345507 - RNA, 32 nt, Human
caccacugcacucaagccugggcgacagaggg

SEQ ID NO: 345508 - RNA, 32 nt, Human
caccacugcacucagccugggugacagagcaa

SEQ ID NO: 345509 - RNA, 24 nt, Human
caccacugcacuccaaccuaggua

SEQ ID NO: 345510 - RNA, 32 nt, Human
caccacugcacuccaaccuagguaacagagag

SEQ ID NO: 345511 - RNA, 24 nt, Human
caccacugcacuccaaccuggaca

SEQ ID NO: 345512 - RNA, 22 nt, Human
caccacugcacuccaaccuggg

SEQ ID NO: 345513 - RNA, 32 nt, Human
caccacugcacuccaaccugggaaacgcagug

SEQ ID NO: 345514 - RNA, 24 nt, Human
caccacugcacuccaaccugggca

SEQ ID NO: 345515 - RNA, 32 nt, Human
caccacugcacuccaaccugggcaacagaggg

SEQ ID NO: 345516 - RNA, 23 nt, Human
caccacugcacuccaaccugggu

SEQ ID NO: 345517 - RNA, 32 nt, Human
caccacugcacuccaaccugggugacaagagu

SEQ ID NO: 345518 - RNA, 32 nt, Human
caccacugcacuccaaccugggugacagagug

SEQ ID NO: 345519 - RNA, 32 nt, Human
caccacugcacuccaaccugggugacgaguga

SEQ ID NO: 345520 - RNA, 32 nt, Human
caccacugcacuccaaucugggcaagagaacg

SEQ ID NO: 345521 - RNA, 32 nt, Human
caccacugcacuccacccugggcagaggugga

SEQ ID NO: 345522 - RNA, 32 nt, Human
caccacugcacuccagcacuccagccugggug

SEQ ID NO: 345523 - RNA, 32 nt, Human
caccacugcacuccagcaugagugacagagac

SEQ ID NO: 345524 - RNA, 24 nt, Human
caccacugcacuccagcaugggca

SEQ ID NO: 345525 - RNA, 21 nt, Human
caccacugcacuccagccagg

SEQ ID NO: 345526 - RNA, 32 nt, Human
caccacugcacuccagccaggaaugaggcaga

SEQ ID NO: 345527 - RNA, 22 nt, Human
caccacugcacuccagccaggg

SEQ ID NO: 345528 - RNA, 24 nt, Human
caccacugcacuccagccagggca

SEQ ID NO: 345529 - RNA, 24 nt, Human
caccacugcacuccagcccaggca

SEQ ID NO: 345530 - RNA, 32 nt, Human
caccacugcacuccagcccaggcaacagagug

SEQ ID NO: 345531 - RNA, 24 nt, Human
caccacugcacuccagcccaggua

SEQ ID NO: 345532 - RNA, 32 nt, Human
caccacugcacuccagcccaggugacagagca

SEQ ID NO: 345533 - RNA, 21 nt, Human
caccacugcacuccagccggg

SEQ ID NO: 345534 - RNA, 32 nt, Human
caccacugcacuccagccggggugacagagug

SEQ ID NO: 345535 - RNA, 23 nt, Human
caccacugcacuccagccuaggc

SEQ ID NO: 345536 - RNA, 24 nt, Human
caccacugcacuccagccuaggca

SEQ ID NO: 345537 - RNA, 32 nt, Human
caccacugcacuccagccuaggcgacggggca

SEQ ID NO: 345538 - RNA, 23 nt, Human
caccacugcacuccagccuaggu

SEQ ID NO: 345539 - RNA, 32 nt, Human
caccacugcacuccagccuaggugacagagug

SEQ ID NO: 345540 - RNA, 23 nt, Human
caccacugcacuccagccugagc

SEQ ID NO: 345541 - RNA, 23 nt, Human
caccacugcacuccagccugagu

SEQ ID NO: 345542 - RNA, 32 nt, Human
caccacugcacuccagccugagugacagagcg

SEQ ID NO: 345543 - RNA, 32 nt, Human
caccacugcacuccagccugagugaggaagca

SEQ ID NO: 345544 - RNA, 21 nt, Human
caccacugcacuccagccugg

SEQ ID NO: 345545 - RNA, 32 nt, Human
caccacugcacuccagccuggaaaacggagug

SEQ ID NO: 345546 - RNA, 32 nt, Human
caccacugcacuccagccuggaagaccaaacg

SEQ ID NO: 345547 - RNA, 24 nt, Human
caccacugcacuccagccuggaca

SEQ ID NO: 345548 - RNA, 32 nt, Human
caccacugcacuccagccuggacgacagagcg

SEQ ID NO: 345549 - RNA, 32 nt, Human
caccacugcacuccagccuggacgacagagug

SEQ ID NO: 345550 - RNA, 32 nt, Human
caccacugcacuccagccuggaugacaaagca

SEQ ID NO: 345551 - RNA, 32 nt, Human
caccacugcacuccagccuggaugacagagug

SEQ ID NO: 345552 - RNA, 23 nt, Human
caccacugcacuccagccuggca

SEQ ID NO: 345553 - RNA, 32 nt, Human
caccacugcacuccagccuggcaacagagcga

SEQ ID NO: 345554 - RNA, 23 nt, Human
caccacugcacuccagccuggcg

SEQ ID NO: 345555 - RNA, 32 nt, Human
caccacugcacuccagccuggcgacaaaguga

SEQ ID NO: 345556 - RNA, 22 nt, Human
caccacugcacuccagccuggg

SEQ ID NO: 345557 - RNA, 32 nt, Human
caccacugcacuccagccugggaagcagagug

SEQ ID NO: 345558 - RNA, 32 nt, Human
caccacugcacuccagccugggagacacagcg

SEQ ID NO: 345559 - RNA, 32 nt, Human
caccacugcacuccagccugggagacagagca

SEQ ID NO: 345560 - RNA, 32 nt, Human
caccacugcacuccagccugggagacagagcg

SEQ ID NO: 345561 - RNA, 32 nt, Human
caccacugcacuccagccugggagacagaguc

SEQ ID NO: 345562 - RNA, 32 nt, Human
caccacugcacuccagccugggagacagagug

SEQ ID NO: 345563 - RNA, 32 nt, Human
caccacugcacuccagccugggagauacagcg

SEQ ID NO: 345564 - RNA, 23 nt, Human
caccacugcacuccagccugggc

SEQ ID NO: 345565 - RNA, 24 nt, Human
caccacugcacuccagccugggca

SEQ ID NO: 345566 - RNA, 32 nt, Human
caccacugcacuccagccugggcaacaaagug

SEQ ID NO: 345567 - RNA, 32 nt, Human
caccacugcacuccagccugggcaacaagagc

SEQ ID NO: 345568 - RNA, 32 nt, Human
caccacugcacuccagccugggcaacaagagu

SEQ ID NO: 345569 - RNA, 32 nt, Human
caccacugcacuccagccugggcaacacagug

SEQ ID NO: 345570 - RNA, 32 nt, Human
caccacugcacuccagccugggcaacagaacg

SEQ ID NO: 345571 - RNA, 32 nt, Human
caccacugcacuccagccugggcaacagaggg

SEQ ID NO: 345572 - RNA, 32 nt, Human
caccacugcacuccagccugggcaacagagua

SEQ ID NO: 345573 - RNA, 32 nt, Human
caccacugcacuccagccugggcaacagagug

SEQ ID NO: 345574 - RNA, 32 nt, Human
caccacugcacuccagccugggcaacugagca

SEQ ID NO: 345575 - RNA, 32 nt, Human
caccacugcacuccagccugggcaauagagua

SEQ ID NO: 345576 - RNA, 32 nt, Human
caccacugcacuccagccugggcaauagagug

SEQ ID NO: 345577 - RNA, 32 nt, Human
caccacugcacuccagccugggcagcagagcg

SEQ ID NO: 345578 - RNA, 32 nt, Human
caccacugcacuccagccugggcgaaagggca

SEQ ID NO: 345579 - RNA, 32 nt, Human
caccacugcacuccagccugggcgacaaagug

SEQ ID NO: 345580 - RNA, 32 nt, Human
caccacugcacuccagccugggcgacacagcg

SEQ ID NO: 345581 - RNA, 32 nt, Human
caccacugcacuccagccugggcgacagaaug

SEQ ID NO: 345582 - RNA, 32 nt, Human
caccacugcacuccagccugggcgacagaccg

SEQ ID NO: 345583 - RNA, 32 nt, Human
caccacugcacuccagccugggcgacagagac

SEQ ID NO: 345584 - RNA, 32 nt, Human
caccacugcacuccagccugggcgacagagca

SEQ ID NO: 345585 - RNA, 32 nt, Human
caccacugcacuccagccugggcgacagagcg

SEQ ID NO: 345586 - RNA, 32 nt, Human
caccacugcacuccagccugggcgacagaggg

SEQ ID NO: 345587 - RNA, 32 nt, Human
caccacugcacuccagccugggcgacagagua

SEQ ID NO: 345588 - RNA, 32 nt, Human
caccacugcacuccagccugggcgacagagug

SEQ ID NO: 345589 - RNA, 32 nt, Human
caccacugcacuccagccugggcgacagugag

SEQ ID NO: 345590 - RNA, 32 nt, Human
caccacugcacuccagccugggcgacugugag

SEQ ID NO: 345591 - RNA, 32 nt, Human
caccacugcacuccagccugggcggcagagca

SEQ ID NO: 345592 - RNA, 32 nt, Human
caccacugcacuccagccuggggacagagcaa

SEQ ID NO: 345593 - RNA, 32 nt, Human
caccacugcacuccagccugggggacagagcg

SEQ ID NO: 345594 - RNA, 32 nt, Human
caccacugcacuccagccuggggugauagaac

SEQ ID NO: 345595 - RNA, 23 nt, Human
caccacugcacuccagccugggu

SEQ ID NO: 345596 - RNA, 32 nt, Human
caccacugcacuccagccugggugacaagagc

SEQ ID NO: 345597 - RNA, 32 nt, Human
caccacugcacuccagccugggugacagagac

SEQ ID NO: 345598 - RNA, 32 nt, Human
caccacugcacuccagccugggugacagagag

SEQ ID NO: 345599 - RNA, 32 nt, Human
caccacugcacuccagccugggugacagagca

SEQ ID NO: 345600 - RNA, 32 nt, Human
caccacugcacuccagccugggugacagagcc

SEQ ID NO: 345601 - RNA, 32 nt, Human
caccacugcacuccagccugggugacagagcg

SEQ ID NO: 345602 - RNA, 32 nt, Human
caccacugcacuccagccugggugacagaggg

SEQ ID NO: 345603 - RNA, 32 nt, Human
caccacugcacuccagccugggugacagagua

SEQ ID NO: 345604 - RNA, 32 nt, Human
caccacugcacuccagccugggugacagagug

SEQ ID NO: 345605 - RNA, 32 nt, Human
caccacugcacuccagccugggugacagauug

SEQ ID NO: 345606 - RNA, 32 nt, Human
caccacugcacuccagccugggugacagcaag

SEQ ID NO: 345607 - RNA, 32 nt, Human
caccacugcacuccagccugggugagagagca

SEQ ID NO: 345608 - RNA, 32 nt, Human
caccacugcacuccagccugggugauagagca

SEQ ID NO: 345609 - RNA, 32 nt, Human
caccacugcacuccagccugggugauagagug

SEQ ID NO: 345610 - RNA, 32 nt, Human
caccacugcacuccagccugggugauggagca

SEQ ID NO: 345611 - RNA, 32 nt, Human
caccacugcacuccagccuggguggcagagca

SEQ ID NO: 345612 - RNA, 32 nt, Human
caccacugcacuccagccuggguggcagagug

SEQ ID NO: 345613 - RNA, 32 nt, Human
caccacugcacuccagccugggugucagagca

SEQ ID NO: 345614 - RNA, 32 nt, Human
caccacugcacuccagccugggugucagagcg

SEQ ID NO: 345615 - RNA, 22 nt, Human
caccacugcacuccagccuggu

SEQ ID NO: 345616 - RNA, 24 nt, Human
caccacugcacuccagccugguca

SEQ ID NO: 345617 - RNA, 32 nt, Human
caccacugcacuccagccuggucaacagagca

SEQ ID NO: 345618 - RNA, 24 nt, Human
caccacugcacuccagccuggucg

SEQ ID NO: 345619 - RNA, 32 nt, Human
caccacugcacuccagccuggucgacagcgag

SEQ ID NO: 345620 - RNA, 30 nt, Human
caccacugcacuccagccuggugacagagc

SEQ ID NO: 345621 - RNA, 32 nt, Human
caccacugcacuccagccuggugacagagcaa

SEQ ID NO: 345622 - RNA, 32 nt, Human
caccacugcacuccagccuggugacagagcua

SEQ ID NO: 345623 - RNA, 32 nt, Human
caccacugcacuccagccuggugacagggcga

SEQ ID NO: 345624 - RNA, 32 nt, Human
caccacugcacuccagccugguuacagagcaa

SEQ ID NO: 345625 - RNA, 23 nt, Human
caccacugcacuccagccugugu

SEQ ID NO: 345626 - RNA, 23 nt, Human
caccacugcacuccagccuuggc

SEQ ID NO: 345627 - RNA, 23 nt, Human
caccacugcacuccagccuuggu

SEQ ID NO: 345628 - RNA, 32 nt, Human
caccacugcacuccagccuuggugacagagug

SEQ ID NO: 345629 - RNA, 32 nt, Human
caccacugcacuccagcucgggugacaagagu

SEQ ID NO: 345630 - RNA, 32 nt, Human
caccacugcacuccagcuugggggauagagug

SEQ ID NO: 345631 - RNA, 32 nt, Human
caccacugcacuccagcuugggugacagagug

SEQ ID NO: 345632 - RNA, 32 nt, Human
caccacugcacuccagcuugguucauggagac

SEQ ID NO: 345633 - RNA, 24 nt, Human
caccacugcacuccaggcugggua

SEQ ID NO: 345634 - RNA, 32 nt, Human
caccacugcacuccaggcugggugacagagcg

SEQ ID NO: 345635 - RNA, 32 nt, Human
caccacugcacuccagucuggaugacaaagca

SEQ ID NO: 345636 - RNA, 23 nt, Human
caccacugcacuccagucuggca

SEQ ID NO: 345637 - RNA, 32 nt, Human
caccacugcacuccagucuggcaacagagcaa

SEQ ID NO: 345638 - RNA, 24 nt, Human
caccacugcacuccagucugggca

SEQ ID NO: 345639 - RNA, 24 nt, Human
caccacugcacuccagucugggua

SEQ ID NO: 345640 - RNA, 32 nt, Human
caccacugcacuccagucugggugagagugag

SEQ ID NO: 345641 - RNA, 32 nt, Human
caccacugcacuccagucugguugagagagug

SEQ ID NO: 345642 - RNA, 32 nt, Human
caccacugcacuccauccagccugggugacag

SEQ ID NO: 345643 - RNA, 24 nt, Human
caccacugcacuccauccugggca

SEQ ID NO: 345644 - RNA, 32 nt, Human
caccacugcacuccauccugggcaacagagug

SEQ ID NO: 345645 - RNA, 32 nt, Human
caccacugcacuccauccugggugacagagca

SEQ ID NO: 345646 - RNA, 32 nt, Human
caccacugcacucccgcuuggcaauagaguga

SEQ ID NO: 345647 - RNA, 24 nt, Human
caccacugcacuccggccuaggca

SEQ ID NO: 345648 - RNA, 32 nt, Human
caccacugcacuccggccugggcgacagagcg

SEQ ID NO: 345649 - RNA, 32 nt, Human
caccacugcacuccugccugggcaauagagcc

SEQ ID NO: 345650 - RNA, 32 nt, Human
caccacugcacucuacucugggugacagaaug

SEQ ID NO: 345651 - RNA, 32 nt, Human
caccacugcacucuagccugcgugacacaacc

SEQ ID NO: 345652 - RNA, 24 nt, Human
caccacugcacucuagccugggca

SEQ ID NO: 345653 - RNA, 32 nt, Human
caccacugcacucuagccugggcaacagagcg

SEQ ID NO: 345654 - RNA, 32 nt, Human
caccacugcacucuagccugggcaacagagug

SEQ ID NO: 345655 - RNA, 32 nt, Human
caccacugcacucuagccugggcaagagaaca

SEQ ID NO: 345656 - RNA, 32 nt, Human
caccacugcacucuagccuggggaacagagug

SEQ ID NO: 345657 - RNA, 32 nt, Human
caccacugcacucuagccuggguaacaagcac

SEQ ID NO: 345658 - RNA, 32 nt, Human
caccacugcacucuagccugggugaaagagcg

SEQ ID NO: 345659 - RNA, 32 nt, Human
caccacugcacucuagccugggugacagagca

SEQ ID NO: 345660 - RNA, 32 nt, Human
caccacugcacucuagccugggugaccgaggg

SEQ ID NO: 345661 - RNA, 24 nt, Human
caccacugcacucuagccuuggca

SEQ ID NO: 345662 - RNA, 32 nt, Human
caccacugcacucuagccuuggcaacagugca

SEQ ID NO: 345663 - RNA, 32 nt, Human
caccacugcacucuggccugcaugcacucugg

SEQ ID NO: 345664 - RNA, 23 nt, Human
caccacugcacugcagccuggca

SEQ ID NO: 345665 - RNA, 32 nt, Human
caccacugcacugcagccuggcaacaagagcg

SEQ ID NO: 345666 - RNA, 32 nt, Human
caccacugcacugcagccugggaaacagagug

SEQ ID NO: 345667 - RNA, 32 nt, Human
caccacugcacugcagccugggugacagagug

SEQ ID NO: 345668 - RNA, 32 nt, Human
caccacugcacuucagccuggaugacagagug

SEQ ID NO: 345669 - RNA, 32 nt, Human
caccacugcacuucagccugggcaacagagug

SEQ ID NO: 345670 - RNA, 32 nt, Human
caccacugcacuucagccugggugacagaggg

SEQ ID NO: 345671 - RNA, 32 nt, Human
caccacugcacuucagccugggugacagagug

SEQ ID NO: 345672 - RNA, 32 nt, Human
caccacugcacuucagccuggugacagagcga

SEQ ID NO: 345673 - RNA, 24 nt, Human
caccacugcacuucauccuaggca

SEQ ID NO: 345674 - RNA, 24 nt, Human
caccacugcacuugagccugggca

SEQ ID NO: 345675 - RNA, 32 nt, Human
caccacugcacuuuagccugggcgacaagagc

SEQ ID NO: 345676 - RNA, 32 nt, Human
caccacugcacuuuagucugggugacagagca

SEQ ID NO: 345677 - RNA, 32 nt, Human
caccacugcaguccagccuaggcaacagugag

SEQ ID NO: 345678 - RNA, 32 nt, Human
caccacugcaguccagccugggcgacagagug

SEQ ID NO: 345679 - RNA, 32 nt, Human
caccacugcaguucagccuggaugaugagagu

SEQ ID NO: 345680 - RNA, 24 nt, Human
caccacugcaugcaagccugggca

SEQ ID NO: 345681 - RNA, 32 nt, Human
caccacugcaugcaagccugggcaauagagcg

SEQ ID NO: 345682 - RNA, 23 nt, Human
caccacugcauucagccugagca

SEQ ID NO: 345683 - RNA, 24 nt, Human
caccacugcauuccagccuaagca

SEQ ID NO: 345684 - RNA, 24 nt, Human
caccacugcauuccagccuaggca

SEQ ID NO: 345685 - RNA, 32 nt, Human
caccacugcauuccagccuggaugacagagca

SEQ ID NO: 345686 - RNA, 32 nt, Human
caccacugcauuccagccuggcgacagaguga

SEQ ID NO: 345687 - RNA, 24 nt, Human
caccacugcauuccagccugggca

SEQ ID NO: 345688 - RNA, 32 nt, Human
caccacugcauuccagccugggcacuagagug

SEQ ID NO: 345689 - RNA, 32 nt, Human
caccacugcauuccagccugggugacagagca

SEQ ID NO: 345690 - RNA, 32 nt, Human
caccacugcauuccagccugggugacagagcc

SEQ ID NO: 345691 - RNA, 32 nt, Human
caccacugcauuccagccugggugacagagug

SEQ ID NO: 345692 - RNA, 24 nt, Human
caccacugcauucuagccugggca

SEQ ID NO: 345693 - RNA, 32 nt, Human
caccacugcauucuagccugggcaacagagug

SEQ ID NO: 345694 - RNA, 32 nt, Human
caccacugcauucuggccugggugacagaguu

SEQ ID NO: 345695 - RNA, 32 nt, Human
caccacugcauugcagccuggugacagaguga

SEQ ID NO: 345696 - RNA, 32 nt, Human
caccacugccaccaccaccaaccacgaccacc

SEQ ID NO: 345697 - RNA, 32 nt, Human
caccacugcccaggugggugacuuugaccugg

SEQ ID NO: 345698 - RNA, 32 nt, Human
caccacugcccuccagccuggaugacagagug

SEQ ID NO: 345699 - RNA, 32 nt, Human
caccacugcccuccagccugggugacagagcg

SEQ ID NO: 345700 - RNA, 32 nt, Human
caccacugcccuuucuccuuuuccauaaaacu

SEQ ID NO: 345701 - RNA, 32 nt, Human
caccacugcccuuugaauguacaccuucauau

SEQ ID NO: 345702 - RNA, 32 nt, Human
caccacugcgcuccagccugggugaggagacc

SEQ ID NO: 345703 - RNA, 32 nt, Human
caccacuggaaauguuagcauaaaagaacuug

SEQ ID NO: 345704 - RNA, 32 nt, Human
caccacuggaacucacaaaggucuccuucacc

SEQ ID NO: 345705 - RNA, 32 nt, Human
caccacuggacuccagccugggcgacagagug

SEQ ID NO: 345706 - RNA, 24 nt, Human
caccacuggacugggcuggcccag

SEQ ID NO: 345707 - RNA, 25 nt, Human
caccacuggcacuccagccugggca

SEQ ID NO: 345708 - RNA, 32 nt, Human
caccacuggcacuccagccugggcaacagagu

SEQ ID NO: 345709 - RNA, 32 nt, Human
caccacuggcccacagauguagacccuucuac

SEQ ID NO: 345710 - RNA, 32 nt, Human
caccacuggccgccucuccuugccaggccugc

SEQ ID NO: 345711 - RNA, 31 nt, Human
caccacugggaaaucucagccacaccuuuuc

SEQ ID NO: 345712 - RNA, 32 nt, Human
caccacugggagccacccugcccuccugcuau

SEQ ID NO: 345713 - RNA, 32 nt, Human
caccacugggcagaggcuggacagcacggacu

SEQ ID NO: 345714 - RNA, 23 nt, Human
caccacuguacuccagcccggca

SEQ ID NO: 345715 - RNA, 32 nt, Human
caccacuguacuccagccugagugacaaagug

SEQ ID NO: 345716 - RNA, 32 nt, Human
caccacuguacuccagccuggaugacagagug

SEQ ID NO: 345717 - RNA, 24 nt, Human
caccacuguacuccagccugggca

SEQ ID NO: 345718 - RNA, 32 nt, Human
caccacuguacuccagccugggcaacagaaga

SEQ ID NO: 345719 - RNA, 32 nt, Human
caccacuguacuccagccugggcaacagaggg

SEQ ID NO: 345720 - RNA, 32 nt, Human
caccacuguacuccagccugggcaacagagug

SEQ ID NO: 345721 - RNA, 32 nt, Human
caccacuguacuccagccugggcgacggagug

SEQ ID NO: 345722 - RNA, 32 nt, Human
caccacuguacuccagccugggcgauacaaca

SEQ ID NO: 345723 - RNA, 32 nt, Human
caccacuguacuccagccugggugacaaaguc

SEQ ID NO: 345724 - RNA, 32 nt, Human
caccacuguacuccagccugggugacaaagug

SEQ ID NO: 345725 - RNA, 32 nt, Human
caccacuguacuccagccugggugacagagca

SEQ ID NO: 345726 - RNA, 32 nt, Human
caccacuguacuccagccugggugacagagcg

SEQ ID NO: 345727 - RNA, 32 nt, Human
caccacuguacuccagccugggugacagggca

SEQ ID NO: 345728 - RNA, 32 nt, Human
caccacuguacuccagccugggugacugagcg

SEQ ID NO: 345729 - RNA, 32 nt, Human
caccacuguacuccagccuggugacagagcca

SEQ ID NO: 345730 - RNA, 32 nt, Human
caccacuguaguucucucauuuccaaaccauc

SEQ ID NO: 345731 - RNA, 32 nt, Human
caccacuguauuccagccuggaugacaaagca

SEQ ID NO: 345732 - RNA, 32 nt, Human
caccacuguauuccagccugggugacagagug

SEQ ID NO: 345733 - RNA, 32 nt, Human
caccacuguauuccagccugggugacugagac

SEQ ID NO: 345734 - RNA, 32 nt, Human
caccacuguauuuugaaaacauguuugguuuc

SEQ ID NO: 345735 - RNA, 32 nt, Human
caccacugugaccuuccucgugccccaauugc

SEQ ID NO: 345736 - RNA, 32 nt, Human
caccacugugauuuguucuccugguggagaga

SEQ ID NO: 345737 - RNA, 22 nt, Human
caccacugugcucaaccagaca

SEQ ID NO: 345738 - RNA, 32 nt, Human
caccacuguggaccccugcucugcacccccag

SEQ ID NO: 345739 - RNA, 32 nt, Human
caccacuguguauuuaacugccuuguguacag

SEQ ID NO: 345740 - RNA, 32 nt, Human
caccacugugugaccuugggcaagucacuuca

SEQ ID NO: 345741 - RNA, 32 nt, Human
caccacuuaccggccuccuccaccuucucggc

SEQ ID NO: 345742 - RNA, 23 nt, Human
caccacuuacuccagccugggca

SEQ ID NO: 345743 - RNA, 32 nt, Human
caccacuuauugcacuccagcccgggcgacag

SEQ ID NO: 345744 - RNA, 21 nt, Human
caccacuucaagugaccacca

SEQ ID NO: 345745 - RNA, 32 nt, Human
caccacuucacuccagccugggugacggagug

SEQ ID NO: 345746 - RNA, 32 nt, Human
caccacuucuauucccccagacugcuugggac

SEQ ID NO: 345747 - RNA, 32 nt, Human
caccacuuggaaaugacuaguauuaucagaag

SEQ ID NO: 345748 - RNA, 32 nt, Human
caccacuuggagagacacaggaagguaauauu

SEQ ID NO: 345749 - RNA, 32 nt, Human
caccacuuggggaccucucugagcaggcucuc

SEQ ID NO: 345750 - RNA, 32 nt, Human
caccacuuguaacuccagccugggcaacagag

SEQ ID NO: 345751 - RNA, 32 nt, Human
caccacuuuacuuagccugggugacagaguga

SEQ ID NO: 345752 - RNA, 32 nt, Human
caccacuuuccaccaucagcugccaaacuggu

SEQ ID NO: 345753 - RNA, 21 nt, Human
caccacuuuggaaggccgagg

SEQ ID NO: 345754 - RNA, 32 nt, Human
caccacuuugggaggccgaggcgggcagauca

SEQ ID NO: 345755 - RNA, 32 nt, Human
caccagaaacagacaucuugcaguguuucacu

SEQ ID NO: 345756 - RNA, 32 nt, Human
caccagaaagccugccuaacucugccuggugg

SEQ ID NO: 345757 - RNA, 32 nt, Human
caccagaacacaguccgugcugugcugcgcua

SEQ ID NO: 345758 - RNA, 32 nt, Human
caccagaagcaguucuggagaaagcuuagcuc

SEQ ID NO: 345759 - RNA, 32 nt, Human
caccagaagcugagauuggagcuguucguaau

SEQ ID NO: 345760 - RNA, 32 nt, Human
caccagaccauccugcgcgccugggccgugaa

SEQ ID NO: 345761 - RNA, 32 nt, Human
caccagaccuggcuaauuuuuguauuuuuagu

SEQ ID NO: 345762 - RNA, 32 nt, Human
caccagacucuccugagggugaaagaagacac

SEQ ID NO: 345763 - RNA, 32 nt, Human
caccagagacagcggacuuuccuccgaugguu

SEQ ID NO: 345764 - RNA, 32 nt, Human
caccagagccuucugcaagaugcuucugauuc

SEQ ID NO: 345765 - RNA, 32 nt, Human
caccagaggaagagagcuuggcaggaaaguua

SEQ ID NO: 345766 - RNA, 32 nt, Human
caccagaguaguuuggaggcaggccugcaggc

SEQ ID NO: 345767 - RNA, 32 nt, Human
caccagagucccugugcaaacaccuagacuca

SEQ ID NO: 345768 - RNA, 32 nt, Human
caccagaugcuggacacccucuucccaucugu

SEQ ID NO: 345769 - RNA, 32 nt, Human
caccagauguuaccgcucgguugaaugugucc

SEQ ID NO: 345770 - RNA, 22 nt, Human
caccagcaaccccccagugcca

SEQ ID NO: 345771 - RNA, 32 nt, Human
caccagcaacugacaggagcuugggagcucgg

SEQ ID NO: 345772 - RNA, 32 nt, Human
caccagcacagcaaacccgccgggaucaaagu

SEQ ID NO: 345773 - RNA, 32 nt, Human
caccagcacaugcaugcacaccaguacacaca

SEQ ID NO: 345774 - RNA, 21 nt, Human
caccagcaccaacaccacggu

SEQ ID NO: 345775 - RNA, 20 nt, Human
caccagcaccacagucaggc

SEQ ID NO: 345776 - RNA, 31 nt, Human
caccagcaccaccagcaccuacccagcauuc

SEQ ID NO: 345777 - RNA, 24 nt, Human
caccagcaccaccagccccaggcg

SEQ ID NO: 345778 - RNA, 32 nt, Human
caccagcaccagagcccagcugcccagcuuaa

SEQ ID NO: 345779 - RNA, 32 nt, Human
caccagcaccucagugggggauacugcaaguu

SEQ ID NO: 345780 - RNA, 32 nt, Human
caccagcaccuccuggcugaaggucagcccac

SEQ ID NO: 345781 - RNA, 22 nt, Human
caccagcacuacgcugccggcg

SEQ ID NO: 345782 - RNA, 20 nt, Human
caccagcacuguggcaaggc

SEQ ID NO: 345783 - RNA, 32 nt, Human
caccagcacuuugugggaaagacagaggcggg

SEQ ID NO: 345784 - RNA, 32 nt, Human
caccagcacuuugugggaaagacagagguggg

SEQ ID NO: 345785 - RNA, 18 nt, Human
caccagcagauaguggga

SEQ ID NO: 345786 - RNA, 19 nt, Human
caccagcagccccaguagc

SEQ ID NO: 345787 - RNA, 32 nt, Human
caccagcagccccugacacagccaccucuagc

SEQ ID NO: 345788 - RNA, 32 nt, Human
caccagcagcugguccuggccuuggagcgcaa

SEQ ID NO: 345789 - RNA, 32 nt, Human
caccagcaggcagguggacugacuguguuggg

SEQ ID NO: 345790 - RNA, 32 nt, Human
caccagcaggugucuggacgaaaacaucaaug

SEQ ID NO: 345791 - RNA, 32 nt, Human
caccagcaucaucuuaacuaacauucugaacu

SEQ ID NO: 345792 - RNA, 32 nt, Human
caccagcaucccuccucuccccaaggugaagu

SEQ ID NO: 345793 - RNA, 32 nt, Human
caccagcaucggcagaggugauagcugaggag

SEQ ID NO: 345794 - RNA, 32 nt, Human
caccagcaucucucaacagucucagcucgcuc

SEQ ID NO: 345795 - RNA, 19 nt, Human
caccagcaugauggcccca

SEQ ID NO: 345796 - RNA, 32 nt, Human
caccagcauuuauuuucauuauuugaggauau

SEQ ID NO: 345797 - RNA, 32 nt, Human
caccagccaagaaaugcugucagugccuggaa

SEQ ID NO: 345798 - RNA, 32 nt, Human
caccagccaagcccagccugagccagcaccug

SEQ ID NO: 345799 - RNA, 32 nt, Human
caccagccauuuuggcuucaaaggaccccacc

SEQ ID NO: 345800 - RNA, 32 nt, Human
caccagcccagagaggccucucaccacagcag

SEQ ID NO: 345801 - RNA, 32 nt, Human
caccagcccagcucugucccuccccuagguaa

SEQ ID NO: 345802 - RNA, 19 nt, Human
caccagcccagggcugauc

SEQ ID NO: 345803 - RNA, 32 nt, Human
caccagcccccggcagaggcugagguggcagu

SEQ ID NO: 345804 - RNA, 32 nt, Human
caccagccccuugcugcucucccuuuaaugcc

SEQ ID NO: 345805 - RNA, 32 nt, Human
caccagccccuuucaucccuccuuccuccccc

SEQ ID NO: 345806 - RNA, 32 nt, Human
caccagcccucagaacccuccugggcuugccc

SEQ ID NO: 345807 - RNA, 32 nt, Human
caccagcccugagcucccagagcacugguggc

SEQ ID NO: 345808 - RNA, 32 nt, Human
caccagcccugaggugucagcugccuucagag

SEQ ID NO: 345809 - RNA, 32 nt, Human
caccagcccuggagaggaggaagggacugacu

SEQ ID NO: 345810 - RNA, 32 nt, Human
caccagcccuggcaacugcuaaucuacuuucu

SEQ ID NO: 345811 - RNA, 32 nt, Human
caccagcccuugcccaugguggggaggacauc

SEQ ID NO: 345812 - RNA, 32 nt, Human
caccagcccuugugggacucccaacacaagac

SEQ ID NO: 345813 - RNA, 32 nt, Human
caccagccgccccucuccuccugggcugcaga

SEQ ID NO: 345814 - RNA, 32 nt, Human
caccagccuccacgaagucguggaaaaggaga

SEQ ID NO: 345815 - RNA, 32 nt, Human
caccagccuccaggagcacugggccagggccc

SEQ ID NO: 345816 - RNA, 24 nt, Human
caccagccuccaggcccagugcca

SEQ ID NO: 345817 - RNA, 16 nt, Human
caccagccuccugguc

SEQ ID NO: 345818 - RNA, 32 nt, Human
caccagccucucugggguucucaggccauccc

SEQ ID NO: 345819 - RNA, 32 nt, Human
caccagccucugauggcucaggaggacuugug

SEQ ID NO: 345820 - RNA, 32 nt, Human
caccagccugacucucucccucccucuguuug

SEQ ID NO: 345821 - RNA, 32 nt, Human
caccagccugacugcacacagcuaggcaugcc

SEQ ID NO: 345822 - RNA, 32 nt, Human
caccagccugcucuccgcaggcccacuguccu

SEQ ID NO: 345823 - RNA, 19 nt, Human
caccagccuggacaggaag

SEQ ID NO: 345824 - RNA, 32 nt, Human
caccagccuggaccuccaccuccccuggaaau

SEQ ID NO: 345825 - RNA, 25 nt, Human
caccagccugggugacagagcaaga

SEQ ID NO: 345826 - RNA, 25 nt, Human
caccagccugggugacagagcgaga

SEQ ID NO: 345827 - RNA, 32 nt, Human
caccagccugucucccugaggacacagugagc

SEQ ID NO: 345828 - RNA, 32 nt, Human
caccagccuuucucccaggccaggcuccuucc

SEQ ID NO: 345829 - RNA, 32 nt, Human
caccagccuuucuuccccuuuguguguguggu

SEQ ID NO: 345830 - RNA, 32 nt, Human
caccagcgcagcaguccuggagcugugaggag

SEQ ID NO: 345831 - RNA, 32 nt, Human
caccagcggcuguccccaccagcucuucucag

SEQ ID NO: 345832 - RNA, 20 nt, Human
caccagcuaccacuaccacc

SEQ ID NO: 345833 - RNA, 32 nt, Human
caccagcuagaggcaccugcugccaacacgau

SEQ ID NO: 345834 - RNA, 21 nt, Human
caccagcuaucagauaaggca

SEQ ID NO: 345835 - RNA, 20 nt, Human
caccagcuccauuccuuagc

SEQ ID NO: 345836 - RNA, 32 nt, Human
caccagcucccucaccaccaaugcgaccaugg

SEQ ID NO: 345837 - RNA, 32 nt, Human
caccagcucggcaaccgcacagagccaggucc

SEQ ID NO: 345838 - RNA, 20 nt, Human
caccagcucguuccccucca

SEQ ID NO: 345839 - RNA, 32 nt, Human
caccagcucguuccccuccagccuggugcugg

SEQ ID NO: 345840 - RNA, 20 nt, Human
caccagcucuagacugcaga

SEQ ID NO: 345841 - RNA, 22 nt, Human
caccagcucuccccacagggcc

SEQ ID NO: 345842 - RNA, 32 nt, Human
caccagcucugcagccagccuauggcaauuau

SEQ ID NO: 345843 - RNA, 19 nt, Human
caccagcugacaauggacu

SEQ ID NO: 345844 - RNA, 32 nt, Human
caccagcugagaugucaccugcuuuauuucug

SEQ ID NO: 345845 - RNA, 32 nt, Human
caccagcugcagcugauccaauacaccaagcc

SEQ ID NO: 345846 - RNA, 22 nt, Human
caccagcugccaagagaauccc

SEQ ID NO: 345847 - RNA, 23 nt, Human
caccagcugccaguacaccucca

SEQ ID NO: 345848 - RNA, 22 nt, Human
caccagcugccaguggcuccca

SEQ ID NO: 345849 - RNA, 32 nt, Human
caccagcugcccugagcugcuuguacaaccaa

SEQ ID NO: 345850 - RNA, 32 nt, Human
caccagcugccuccuccacucagcauuccaug

SEQ ID NO: 345851 - RNA, 32 nt, Human
caccagcugccugggccccacccuccugacuc

SEQ ID NO: 345852 - RNA, 32 nt, Human
caccagcugcucccccucauccccuucacccu

SEQ ID NO: 345853 - RNA, 32 nt, Human
caccagcugcucucuuuccucuuccaaguaga

SEQ ID NO: 345854 - RNA, 32 nt, Human
caccagcugcugcccagcuacuuuggacacag

SEQ ID NO: 345855 - RNA, 23 nt, Human
caccagcuggaugaccucaggca

SEQ ID NO: 345856 - RNA, 32 nt, Human
caccagcuggcuggccgucugccuggcccaug

SEQ ID NO: 345857 - RNA, 32 nt, Human
caccagcuuccccaagagagugucagaaucuu

SEQ ID NO: 345858 - RNA, 21 nt, Human
caccagcuucuccucuggagc

SEQ ID NO: 345859 - RNA, 21 nt, Human
caccagcuuucagccaccaug

SEQ ID NO: 345860 - RNA, 32 nt, Human
caccaggaagacaacaguugaagguuccuuag

SEQ ID NO: 345861 - RNA, 32 nt, Human
caccaggaagccugagaaugaauccugagggc

SEQ ID NO: 345862 - RNA, 32 nt, Human
caccaggaagcgugagccccuguugcauuucu

SEQ ID NO: 345863 - RNA, 32 nt, Human
caccaggaaggaacucugcguccgacggcuuc

SEQ ID NO: 345864 - RNA, 21 nt, Human
caccaggaaggagaaccacca

SEQ ID NO: 345865 - RNA, 21 nt, Human
caccaggaaggaggaccacca

SEQ ID NO: 345866 - RNA, 32 nt, Human
caccaggaaggaugcugcuucggaugggagcc

SEQ ID NO: 345867 - RNA, 32 nt, Human
caccaggaaggcggaggacgcaggagccaaga

SEQ ID NO: 345868 - RNA, 32 nt, Human
caccaggaagguguggcugagccccagagccc

SEQ ID NO: 345869 - RNA, 32 nt, Human
caccaggacuccuuguucugcucuggcaagag

SEQ ID NO: 345870 - RNA, 32 nt, Human
caccaggagacggccacagacacacacugcua

SEQ ID NO: 345871 - RNA, 32 nt, Human
caccaggagcaguucuggaacaggccucucca

SEQ ID NO: 345872 - RNA, 32 nt, Human
caccaggagcccugccuucgucuccauaggaa

SEQ ID NO: 345873 - RNA, 32 nt, Human
caccaggagcuggagaggccugggacagagcc

SEQ ID NO: 345874 - RNA, 32 nt, Human
caccaggaggagguuggauuucugccaguggg

SEQ ID NO: 345875 - RNA, 32 nt, Human
caccaggaggcccucgagguugcucuggaucc

SEQ ID NO: 345876 - RNA, 32 nt, Human
caccaggagggugagggggagugaagaagggu

SEQ ID NO: 345877 - RNA, 32 nt, Human
caccaggaggugagcuugcucugggaggcaua

SEQ ID NO: 345878 - RNA, 32 nt, Human
caccaggagugcguggaucucagucucucugu

SEQ ID NO: 345879 - RNA, 32 nt, Human
caccaggaguuagagagcagccugggcaacau

SEQ ID NO: 345880 - RNA, 32 nt, Human
caccaggaugagcaagcugcccagggagcuga

SEQ ID NO: 345881 - RNA, 32 nt, Human
caccaggauugagacuuccugugggcaccaaa

SEQ ID NO: 345882 - RNA, 32 nt, Human
caccaggcauggugacuugugccugaaauccc

SEQ ID NO: 345883 - RNA, 32 nt, Human
caccaggcauggugauuugugccugaaaucuc

SEQ ID NO: 345884 - RNA, 32 nt, Human
caccaggcauugaaaagacaugacuuacccag

SEQ ID NO: 345885 - RNA, 32 nt, Human
caccaggccacagcccaaggcagagcuggcag

SEQ ID NO: 345886 - RNA, 22 nt, Human
caccaggccacccugcagucca

SEQ ID NO: 345887 - RNA, 32 nt, Human
caccaggccagcagccucaucccugccauuca

SEQ ID NO: 345888 - RNA, 32 nt, Human
caccaggccagccccacugggaauggggucag

SEQ ID NO: 345889 - RNA, 32 nt, Human
caccaggccagccugccugaggacuuuggcaa

SEQ ID NO: 345890 - RNA, 32 nt, Human
caccaggccaggcuaauuuuuguauuuuuagu

SEQ ID NO: 345891 - RNA, 32 nt, Human
caccaggcccagcuaauuuuuguauuuuuaau

SEQ ID NO: 345892 - RNA, 32 nt, Human
caccaggcccagcugauuuuuguauuuuuguu

SEQ ID NO: 345893 - RNA, 32 nt, Human
caccaggcccaggagcuggcgccucagcaacu

SEQ ID NO: 345894 - RNA, 32 nt, Human
caccaggcccagggcuucaccugcugagcugu

SEQ ID NO: 345895 - RNA, 32 nt, Human
caccaggccccaggcacauggcugcccugaac

SEQ ID NO: 345896 - RNA, 32 nt, Human
caccaggccucgggccccagaggucccgcucc

SEQ ID NO: 345897 - RNA, 20 nt, Human
caccaggccuuccucagggg

SEQ ID NO: 345898 - RNA, 32 nt, Human
caccaggcgaggaaacgagaccucuuucguuc

SEQ ID NO: 345899 - RNA, 32 nt, Human
caccaggcgggugggacucaagggcaggcugg

SEQ ID NO: 345900 - RNA, 22 nt, Human
caccaggcuagaggcaacugcc

SEQ ID NO: 345901 - RNA, 32 nt, Human
caccaggcuccccagagacaaugcucaguauu

SEQ ID NO: 345902 - RNA, 32 nt, Human
caccaggcuccucaggcaccuucaccaucggc

SEQ ID NO: 345903 - RNA, 32 nt, Human
caccaggcugcagggggcuggagaagcaacac

SEQ ID NO: 345904 - RNA, 32 nt, Human
caccaggcugcuuccagcccuggguagaauga

SEQ ID NO: 345905 - RNA, 32 nt, Human
caccaggcugggcagggacaaccaccaggugu

SEQ ID NO: 345906 - RNA, 19 nt, Human
caccaggcugggugcaaug

SEQ ID NO: 345907 - RNA, 32 nt, Human
caccaggcuggucaccccaggccagcgucugu

SEQ ID NO: 345908 - RNA, 32 nt, Human
caccagggagagacagagacagagaugacaga

SEQ ID NO: 345909 - RNA, 32 nt, Human
caccagggauccuuagcacccaaccggucugc

SEQ ID NO: 345910 - RNA, 32 nt, Human
caccagggaucuccaggagaaacuucacaggc

SEQ ID NO: 345911 - RNA, 32 nt, Human
caccagggcaggcagaugggggcggcggcaca

SEQ ID NO: 345912 - RNA, 31 nt, Human
caccagggcauaagucuacucacuuauaucu

SEQ ID NO: 345913 - RNA, 32 nt, Human
caccagggccuccccacgucugccuuugaggg

SEQ ID NO: 345914 - RNA, 32 nt, Human
caccaggggaggugggguuuggugagagacgc

SEQ ID NO: 345915 - RNA, 32 nt, Human
caccaggggcaggcacagcacagggauccgac

SEQ ID NO: 345916 - RNA, 32 nt, Human
caccaggggugaguccgggcaaggagguuagg

SEQ ID NO: 345917 - RNA, 32 nt, Human
caccaggguugaccccagaggauugcugcccc

SEQ ID NO: 345918 - RNA, 18 nt, Human
caccagguagccuacuga

SEQ ID NO: 345919 - RNA, 32 nt, Human
caccaggucacuuuaugcugggugauauaguc

SEQ ID NO: 345920 - RNA, 32 nt, Human
caccaggucaggcugggugcgccaugguugag

SEQ ID NO: 345921 - RNA, 32 nt, Human
caccaggucccggggagagggauugagccaag

SEQ ID NO: 345922 - RNA, 32 nt, Human
caccagguccucgucagacuccugugcucuuc

SEQ ID NO: 345923 - RNA, 24 nt, Human
caccaggucucccaggcuuccuca

SEQ ID NO: 345924 - RNA, 22 nt, Human
caccaggucucccgggaagcca

SEQ ID NO: 345925 - RNA, 32 nt, Human
caccagguggauugauaccauggcuguagcug

SEQ ID NO: 345926 - RNA, 32 nt, Human
caccagguggcaccaaggguccugaguccugg

SEQ ID NO: 345927 - RNA, 32 nt, Human
caccaggugucaggauagucacagugauacca

SEQ ID NO: 345928 - RNA, 32 nt, Human
caccaggugugggcagggcaccaagcagggag

SEQ ID NO: 345929 - RNA, 22 nt, Human
caccagguuggagaggcaccug

SEQ ID NO: 345930 - RNA, 32 nt, Human
caccagguuucugucucccaguauaaucauau

SEQ ID NO: 345931 - RNA, 32 nt, Human
caccaguaaauccugcuacaucauguacugug

SEQ ID NO: 345932 - RNA, 32 nt, Human
caccaguaacucuuguguucaccaggacccag

SEQ ID NO: 345933 - RNA, 21 nt, Human
caccaguaaucccagcuacuc

SEQ ID NO: 345934 - RNA, 32 nt, Human
caccaguagcguugugugugauuucugauaaa

SEQ ID NO: 345935 - RNA, 22 nt, Human
caccaguagucccagcuacuca

SEQ ID NO: 345936 - RNA, 32 nt, Human
caccagucccagaacccgccaaugcuggggaa

SEQ ID NO: 345937 - RNA, 32 nt, Human
caccagucccagaacccgcuaaugcuggggaa

SEQ ID NO: 345938 - RNA, 32 nt, Human
caccagucccccagacugggugaagguacagc

SEQ ID NO: 345939 - RNA, 21 nt, Human
caccagucccggcaguggcca

SEQ ID NO: 345940 - RNA, 24 nt, Human
caccagucccuguccggaaugcca

SEQ ID NO: 345941 - RNA, 32 nt, Human
caccagucccuuacucuguucucccccaguga

SEQ ID NO: 345942 - RNA, 32 nt, Human
caccaguccucccagggaguccucgagucgcc

SEQ ID NO: 345943 - RNA, 24 nt, Human
caccagucuccuccugcagugcca

SEQ ID NO: 345944 - RNA, 32 nt, Human
caccagucucugcucuucccagccucuccggc

SEQ ID NO: 345945 - RNA, 32 nt, Human
caccagucucuuucucuuuccugcuucacccc

SEQ ID NO: 345946 - RNA, 20 nt, Human
caccagucugaagcagugcc

SEQ ID NO: 345947 - RNA, 32 nt, Human
caccagucugaccucaguccucccucccucug

SEQ ID NO: 345948 - RNA, 25 nt, Human
caccagucugccaacgcuccuggcu

SEQ ID NO: 345949 - RNA, 32 nt, Human
caccagugaaacaaacaggagaugcuaucacc

SEQ ID NO: 345950 - RNA, 32 nt, Human
caccagugaacggagaccucucugaacuaaga

SEQ ID NO: 345951 - RNA, 32 nt, Human
caccagugaaguuuaaucuagcuaaacacugg

SEQ ID NO: 345952 - RNA, 32 nt, Human
caccagugacgguggucacaguugcaauaaag

SEQ ID NO: 345953 - RNA, 32 nt, Human
caccagugcaaaccccagcaccagcgggagug

SEQ ID NO: 345954 - RNA, 32 nt, Human
caccagugcaagcagaugacaaaaaggugcag

SEQ ID NO: 345955 - RNA, 24 nt, Human
caccagugcacuccagccugggca

SEQ ID NO: 345956 - RNA, 32 nt, Human
caccagugcacuccagccugggcgacagagag

SEQ ID NO: 345957 - RNA, 32 nt, Human
caccagugcacuccagccugggugacagagca

SEQ ID NO: 345958 - RNA, 32 nt, Human
caccagugcacuccagccuuggugacaauggg

SEQ ID NO: 345959 - RNA, 32 nt, Human
caccagugcacuccagcugggcgacagagcga

SEQ ID NO: 345960 - RNA, 32 nt, Human
caccaguggcgguggaggugugcugagcucag

SEQ ID NO: 345961 - RNA, 32 nt, Human
caccaguggggaucagugcgggugggggagaa

SEQ ID NO: 345962 - RNA, 32 nt, Human
caccaguggucuucauucuuccucauucauuc

SEQ ID NO: 345963 - RNA, 32 nt, Human
caccaguguguacacuggaaguuuuguuuugu

SEQ ID NO: 345964 - RNA, 26 nt, Human
caccagugugugaggggagcaggcag

SEQ ID NO: 345965 - RNA, 32 nt, Human
caccaguucauggggagccagguccaagucuu

SEQ ID NO: 345966 - RNA, 32 nt, Human
caccaguuccucugcaacccacucugagccuc

SEQ ID NO: 345967 - RNA, 32 nt, Human
caccauaaagagagcuccauguucuuuugcuc

SEQ ID NO: 345968 - RNA, 32 nt, Human
caccauaaccaccaaccugucugccucaggcg

SEQ ID NO: 345969 - RNA, 32 nt, Human
caccauacaguggccucaaagcaaccauggcc

SEQ ID NO: 345970 - RNA, 32 nt, Human
caccauacccagcuaauuuuuguauuuuuagu

SEQ ID NO: 345971 - RNA, 32 nt, Human
caccauacccggcuaauuuuuauauuuuuaga

SEQ ID NO: 345972 - RNA, 32 nt, Human
caccauaccuagcuaauuuuuccucuuuuuag

SEQ ID NO: 345973 - RNA, 32 nt, Human
caccauaccuggcuaauuuuuguauuuuuagu

SEQ ID NO: 345974 - RNA, 32 nt, Human
caccauaccuggcuaauuuuuguauuuuuggu

SEQ ID NO: 345975 - RNA, 32 nt, Human
caccauacuccaggcccugcauggcuucuucc

SEQ ID NO: 345976 - RNA, 20 nt, Human
caccauaggguuuucugcuc

SEQ ID NO: 345977 - RNA, 32 nt, Human
caccaucaagcuuuuccaggaaugcuguccuu

SEQ ID NO: 345978 - RNA, 32 nt, Human
caccaucaagguuugcuugccuguggaggucg

SEQ ID NO: 345979 - RNA, 32 nt, Human
caccaucaccaccaccaccaccaucaccacca

SEQ ID NO: 345980 - RNA, 32 nt, Human
caccaucaccaccaccaccaucaucaucauug

SEQ ID NO: 345981 - RNA, 17 nt, Human
caccaucacgccuggcu

SEQ ID NO: 345982 - RNA, 23 nt, Human
caccaucagacaccugacccuca

SEQ ID NO: 345983 - RNA, 32 nt, Human
caccaucagggcuggaaggaagagaaagggga

SEQ ID NO: 345984 - RNA, 32 nt, Human
caccaucauccucccuuccucaucaucauccu

SEQ ID NO: 345985 - RNA, 32 nt, Human
caccaucauuaaggagaggaguguggaggccg

SEQ ID NO: 345986 - RNA, 32 nt, Human
caccauccaagaggugguagguuggaguaaga

SEQ ID NO: 345987 - RNA, 32 nt, Human
caccauccaugguaucaccucaucucacuucc

SEQ ID NO: 345988 - RNA, 25 nt, Human
caccaucccagcugugaggcugcca

SEQ ID NO: 345989 - RNA, 32 nt, Human
caccaucccauccuggggccccuucagugacu

SEQ ID NO: 345990 - RNA, 20 nt, Human
caccauccccagcagggccu

SEQ ID NO: 345991 - RNA, 32 nt, Human
caccaucccuaaaaguuacaguuuggggagag

SEQ ID NO: 345992 - RNA, 32 nt, Human
caccauccuacaaguaccucagucuccagcag

SEQ ID NO: 345993 - RNA, 32 nt, Human
caccauccugagccagggaacagccccagggu

SEQ ID NO: 345994 - RNA, 32 nt, Human
caccauccuguauucuucaaccagugaucccc

SEQ ID NO: 345995 - RNA, 32 nt, Human
caccauccugugagcccaugcccggccccacu

SEQ ID NO: 345996 - RNA, 32 nt, Human
caccauccuguggccccgcacccggccccucu

SEQ ID NO: 345997 - RNA, 32 nt, Human
caccaucguaccacugcacuccagccuggaug

SEQ ID NO: 345998 - RNA, 32 nt, Human
caccaucgucuugcugauuauaugucaaguuc

SEQ ID NO: 345999 - RNA, 32 nt, Human
caccaucguucuguuugugcuuaaauggcaca

SEQ ID NO: 346000 - RNA, 32 nt, Human
caccaucuacagccaccugccugcuccuaugu

SEQ ID NO: 346001 - RNA, 32 nt, Human
caccaucuacagcucauuuccccguccuccaa

SEQ ID NO: 346002 - RNA, 32 nt, Human
caccaucuccacccugccugcuguggaaucuc

SEQ ID NO: 346003 - RNA, 32 nt, Human
caccaucuccaccucccaccaaaccaccagca

SEQ ID NO: 346004 - RNA, 32 nt, Human
caccaucuccagcugcucacagacaccagcaa

SEQ ID NO: 346005 - RNA, 32 nt, Human
caccaucuccagcugcucacagacgccagcaa

SEQ ID NO: 346006 - RNA, 32 nt, Human
caccaucugaagcuuuugaaacuccuguugua

SEQ ID NO: 346007 - RNA, 32 nt, Human
caccaucugaaggagagugccaucauccuuag

SEQ ID NO: 346008 - RNA, 32 nt, Human
caccaucugagggagaggaacguggaacagga

SEQ ID NO: 346009 - RNA, 17 nt, Human
caccaucugcaccccca

SEQ ID NO: 346010 - RNA, 32 nt, Human
caccaucuggaagccagcugggccacagcaga

SEQ ID NO: 346011 - RNA, 32 nt, Human
caccaucuggacaacagagcaagacuccgucu

SEQ ID NO: 346012 - RNA, 32 nt, Human
caccaucugucaccuucccuugcagcuuaagg

SEQ ID NO: 346013 - RNA, 32 nt, Human
caccaucuucugaagugaacugaucugcccuu

SEQ ID NO: 346014 - RNA, 32 nt, Human
caccaucuucugcaguugccucuuuguugggc

SEQ ID NO: 346015 - RNA, 32 nt, Human
caccaucuuggggucccucccacccucacgga

SEQ ID NO: 346016 - RNA, 32 nt, Human
caccaucuuguaagacugugcccagccccacu

SEQ ID NO: 346017 - RNA, 23 nt, Human
caccaucuuuuauccccgagcag

SEQ ID NO: 346018 - RNA, 29 nt, Human
caccaugaacagcacccccaggaaugccc

SEQ ID NO: 346019 - RNA, 21 nt, Human
caccaugaauuaaaggugcca

SEQ ID NO: 346020 - RNA, 32 nt, Human
caccaugacagcccggcuuugccuugacugac

SEQ ID NO: 346021 - RNA, 22 nt, Human
caccaugacaugaaggaggcca

SEQ ID NO: 346022 - RNA, 32 nt, Human
caccaugaccagcuaauguuuguauuuuuagu

SEQ ID NO: 346023 - RNA, 32 nt, Human
caccaugagcuccccuccccugucuccgggcc

SEQ ID NO: 346024 - RNA, 22 nt, Human
caccaugagggggaggcugcca

SEQ ID NO: 346025 - RNA, 32 nt, Human
caccaugaucuucaucacagucuuugauaugu

SEQ ID NO: 346026 - RNA, 23 nt, Human
caccaugcacuccagccuagaca

SEQ ID NO: 346027 - RNA, 29 nt, Human
caccaugcaggagcugcaucugcucuggu

SEQ ID NO: 346028 - RNA, 29 nt, Human
caccaugccacugcacuccagccugggug

SEQ ID NO: 346029 - RNA, 32 nt, Human
caccaugccaggcuaauuuuuauauuuuuaga

SEQ ID NO: 346030 - RNA, 32 nt, Human
caccaugccaggcuaauuuuuauguuuuuagu

SEQ ID NO: 346031 - RNA, 32 nt, Human
caccaugccaggcuaauuuuuguauuuuuagu

SEQ ID NO: 346032 - RNA, 32 nt, Human
caccaugccaggcucauuguuguauuuuuggu

SEQ ID NO: 346033 - RNA, 32 nt, Human
caccaugcccaacuaauuuuuguauuuuuaua

SEQ ID NO: 346034 - RNA, 32 nt, Human
caccaugcccacauaauuuuuguauuuuuauu

SEQ ID NO: 346035 - RNA, 32 nt, Human
caccaugcccagccaauuuuuguauuuuuagu

SEQ ID NO: 346036 - RNA, 32 nt, Human
caccaugcccagcuaacuuuuguauuuuuagu

SEQ ID NO: 346037 - RNA, 32 nt, Human
caccaugcccagcuaacuuuuguauuuuuggc

SEQ ID NO: 346038 - RNA, 32 nt, Human
caccaugcccagcuaaguuuuguauuuuuagu

SEQ ID NO: 346039 - RNA, 32 nt, Human
caccaugcccagcuaauucuuguauuuuuagu

SEQ ID NO: 346040 - RNA, 32 nt, Human
caccaugcccagcuaauuuguguauuucuagu

SEQ ID NO: 346041 - RNA, 32 nt, Human
caccaugcccagcuaauuuguuguauuuuuag

SEQ ID NO: 346042 - RNA, 32 nt, Human
caccaugcccagcuaauuuuguauuuuuagua

SEQ ID NO: 346043 - RNA, 32 nt, Human
caccaugcccagcuaauuuuguauuuuuauua

SEQ ID NO: 346044 - RNA, 32 nt, Human
caccaugcccagcuaauuuuuauauuuuuagu

SEQ ID NO: 346045 - RNA, 32 nt, Human
caccaugcccagcuaauuuuuguauuauuauu

SEQ ID NO: 346046 - RNA, 32 nt, Human
caccaugcccagcuaauuuuuguauuuuagua

SEQ ID NO: 346047 - RNA, 32 nt, Human
caccaugcccagcuaauuuuuguauuuucagu

SEQ ID NO: 346048 - RNA, 32 nt, Human
caccaugcccagcuaauuuuuguauuuuuaau

SEQ ID NO: 346049 - RNA, 32 nt, Human
caccaugcccagcuaauuuuuguauuuuuagc

SEQ ID NO: 346050 - RNA, 32 nt, Human
caccaugcccagcuaauuuuuguauuuuuagu

SEQ ID NO: 346051 - RNA, 32 nt, Human
caccaugcccagcuaauuuuuguguuuuuagu

SEQ ID NO: 346052 - RNA, 32 nt, Human
caccaugcccagcuaauuuuuguuuuucuugu

SEQ ID NO: 346053 - RNA, 32 nt, Human
caccaugcccagcuaguuuuuguauuuuuagu

SEQ ID NO: 346054 - RNA, 32 nt, Human
caccaugcccagguaauuuuuguauuuuuaau

SEQ ID NO: 346055 - RNA, 32 nt, Human
caccaugcccaguuaacuuuuguauuuuuagu

SEQ ID NO: 346056 - RNA, 32 nt, Human
caccaugcccaucuaauauuuguauuuuuagu

SEQ ID NO: 346057 - RNA, 29 nt, Human
caccaugccccggcagcucagcgcggcgg

SEQ ID NO: 346058 - RNA, 32 nt, Human
caccaugccccggcuauuuuuguauuuuuagu

SEQ ID NO: 346059 - RNA, 32 nt, Human
caccaugcccgacuaauuuuuguauuuugagu

SEQ ID NO: 346060 - RNA, 32 nt, Human
caccaugcccggauaauuuuuguauuuuuagu

SEQ ID NO: 346061 - RNA, 32 nt, Human
caccaugcccggcaaauguuuguauuuuuagu

SEQ ID NO: 346062 - RNA, 32 nt, Human
caccaugcccggcuaacuuuuguauuuuuagu

SEQ ID NO: 346063 - RNA, 32 nt, Human
caccaugcccggcuaauacuuguauuuuuagu

SEQ ID NO: 346064 - RNA, 32 nt, Human
caccaugcccggcuaaucuuuguauuuuuagu

SEQ ID NO: 346065 - RNA, 32 nt, Human
caccaugcccggcuaauuuaguuguauuuuua

SEQ ID NO: 346066 - RNA, 32 nt, Human
caccaugcccggcuaauuuuguauuuuuagua

SEQ ID NO: 346067 - RNA, 32 nt, Human
caccaugcccggcuaauuuuuauauuuuuaau

SEQ ID NO: 346068 - RNA, 32 nt, Human
caccaugcccggcuaauuuuugcauuuuuagu

SEQ ID NO: 346069 - RNA, 32 nt, Human
caccaugcccggcuaauuuuuguauuauaagu

SEQ ID NO: 346070 - RNA, 32 nt, Human
caccaugcccggcuaauuuuuguauucuuagu

SEQ ID NO: 346071 - RNA, 32 nt, Human
caccaugcccggcuaauuuuuguauuuuagua

SEQ ID NO: 346072 - RNA, 32 nt, Human
caccaugcccggcuaauuuuuguauuuuuagu

SEQ ID NO: 346073 - RNA, 32 nt, Human
caccaugcccggcuaauuuuuguauuuuuggu

SEQ ID NO: 346074 - RNA, 32 nt, Human
caccaugcccggcuaauuuuuguuuuuguauu

SEQ ID NO: 346075 - RNA, 32 nt, Human
caccaugcccggcuaguuuuuguauuuuuaau

SEQ ID NO: 346076 - RNA, 32 nt, Human
caccaugcccggcugauuuuuguauuuuuaau

SEQ ID NO: 346077 - RNA, 32 nt, Human
caccaugcccggguaaguuuuguauuuuuagu

SEQ ID NO: 346078 - RNA, 32 nt, Human
caccaugcccugcuaauuuuuguguuuuaagu

SEQ ID NO: 346079 - RNA, 32 nt, Human
caccaugccgagcuaauuuuuguauuuauaau

SEQ ID NO: 346080 - RNA, 32 nt, Human
caccaugccggugugaggagcaucuguucuuc

SEQ ID NO: 346081 - RNA, 32 nt, Human
caccaugccuagcaaauuuuuguauuuuuagu

SEQ ID NO: 346082 - RNA, 32 nt, Human
caccaugccuagcuaauuuuuguauuuuuagu

SEQ ID NO: 346083 - RNA, 32 nt, Human
caccaugccucacaugguagaccccaguggga

SEQ ID NO: 346084 - RNA, 32 nt, Human
caccaugccucacuaauuuuuguauuauuuuu

SEQ ID NO: 346085 - RNA, 29 nt, Human
caccaugccucggggaagccgcagcgcgg

SEQ ID NO: 346086 - RNA, 32 nt, Human
caccaugccugaccaauuuuuguauuuuuagu

SEQ ID NO: 346087 - RNA, 32 nt, Human
caccaugccuggcuaaaauucuuuuguauuuu

SEQ ID NO: 346088 - RNA, 32 nt, Human
caccaugccuggcuaaauuuuguauuuuuaau

SEQ ID NO: 346089 - RNA, 32 nt, Human
caccaugccuggcuaauuucuguauuuuuagu

SEQ ID NO: 346090 - RNA, 32 nt, Human
caccaugccuggcuaauuuucuguauuuuuag

SEQ ID NO: 346091 - RNA, 32 nt, Human
caccaugccuggcuaauuuugguauuuuuagu

SEQ ID NO: 346092 - RNA, 32 nt, Human
caccaugccuggcuaauuuuguauauuuagua

SEQ ID NO: 346093 - RNA, 32 nt, Human
caccaugccuggcuaauuuuguauuucuagua

SEQ ID NO: 346094 - RNA, 32 nt, Human
caccaugccuggcuaauuuuguauuuguagua

SEQ ID NO: 346095 - RNA, 32 nt, Human
caccaugccuggcuaauuuuguauuuuuagua

SEQ ID NO: 346096 - RNA, 32 nt, Human
caccaugccuggcuaauuuuguguuuuuagua

SEQ ID NO: 346097 - RNA, 32 nt, Human
caccaugccuggcuaauuuuguguuuuuagug

SEQ ID NO: 346098 - RNA, 32 nt, Human
caccaugccuggcuaauuuuuaguauuuuuag

SEQ ID NO: 346099 - RNA, 32 nt, Human
caccaugccuggcuaauuuuuauauuuucagu

SEQ ID NO: 346100 - RNA, 32 nt, Human
caccaugccuggcuaauuuuugcauuuuuagu

SEQ ID NO: 346101 - RNA, 32 nt, Human
caccaugccuggcuaauuuuuguacuuuugcu

SEQ ID NO: 346102 - RNA, 32 nt, Human
caccaugccuggcuaauuuuuguaguauuagu

SEQ ID NO: 346103 - RNA, 32 nt, Human
caccaugccuggcuaauuuuuguauuaguaga

SEQ ID NO: 346104 - RNA, 32 nt, Human
caccaugccuggcuaauuuuuguauuuuaugu

SEQ ID NO: 346105 - RNA, 32 nt, Human
caccaugccuggcuaauuuuuguauuuuuaau

SEQ ID NO: 346106 - RNA, 32 nt, Human
caccaugccuggcuaauuuuuguauuuuuagu

SEQ ID NO: 346107 - RNA, 32 nt, Human
caccaugccuggcuaauuuuuguauuuuuggu

SEQ ID NO: 346108 - RNA, 32 nt, Human
caccaugccuggcuaauuuuuguguuuuuagu

SEQ ID NO: 346109 - RNA, 32 nt, Human
caccaugccuggcuacuuuuuguauuuuuagu

SEQ ID NO: 346110 - RNA, 32 nt, Human
caccaugccuggcuaguuuuuguauuuuuagu

SEQ ID NO: 346111 - RNA, 32 nt, Human
caccaugccuggcucauuuuuguauuuuuagu

SEQ ID NO: 346112 - RNA, 32 nt, Human
caccaugccuggcugauauuuauauuuuuagu

SEQ ID NO: 346113 - RNA, 32 nt, Human
caccaugccuggcugauuuuuguauuuuuagu

SEQ ID NO: 346114 - RNA, 32 nt, Human
caccaugccuggcuggguauuuauauuaucau

SEQ ID NO: 346115 - RNA, 32 nt, Human
caccaugccuggcugguuuuuguauuuuuagu

SEQ ID NO: 346116 - RNA, 32 nt, Human
caccaugccugguucauuuuuguguuuuuagu

SEQ ID NO: 346117 - RNA, 32 nt, Human
caccaugcguggcuaaauuuuguauuuuuaau

SEQ ID NO: 346118 - RNA, 32 nt, Human
caccaugcucacagaacugggcucagagcucc

SEQ ID NO: 346119 - RNA, 32 nt, Human
caccaugcucagcuaauuuuuguauuuuuagu

SEQ ID NO: 346120 - RNA, 32 nt, Human
caccaugcugggcuaauuuuuguauuuuuaau

SEQ ID NO: 346121 - RNA, 32 nt, Human
caccaugcuuggcuaauuuuuguauuuuuagu

SEQ ID NO: 346122 - RNA, 32 nt, Human
caccaugcuuggcucauuuuuguauuuuuagu

SEQ ID NO: 346123 - RNA, 29 nt, Human
caccauggacaguggugaaugggacgugc

SEQ ID NO: 346124 - RNA, 29 nt, Human
caccauggaccaaagugggauggagauuc

SEQ ID NO: 346125 - RNA, 29 nt, Human
caccauggauccugaacacgccaaaccug

SEQ ID NO: 346126 - RNA, 29 nt, Human
caccauggauccugaacacgccaagcuaa

SEQ ID NO: 346127 - RNA, 32 nt, Human
caccauggaugccauggauuagcugugcaacu

SEQ ID NO: 346128 - RNA, 32 nt, Human
caccauggauuuggcugccucacccaggugag

SEQ ID NO: 346129 - RNA, 32 nt, Human
caccauggccagcuaauuuuuguauuuuuagu

SEQ ID NO: 346130 - RNA, 32 nt, Human
caccauggcccacacuuguaaucccagcacuu

SEQ ID NO: 346131 - RNA, 32 nt, Human
caccauggcccuccuaaagacacucuaggaaa

SEQ ID NO: 346132 - RNA, 29 nt, Human
caccauggcccugcugcacuccggccgcg

SEQ ID NO: 346133 - RNA, 29 nt, Human
caccauggccgagccucugaaggaggaag

SEQ ID NO: 346134 - RNA, 27 nt, Human
caccauggccugccugcccugccuccg

SEQ ID NO: 346135 - RNA, 32 nt, Human
caccauggcucacgccuguaaucccaggacuu

SEQ ID NO: 346136 - RNA, 32 nt, Human
caccauggcuccuguccuccugcugcuccucu

SEQ ID NO: 346137 - RNA, 29 nt, Human
caccauggcugaagaagaggaaacugcug

SEQ ID NO: 346138 - RNA, 32 nt, Human
caccauggcuggcuaauuuuuguauuuuuagu

SEQ ID NO: 346139 - RNA, 32 nt, Human
caccauggcuggcuaauuuuuguauuuuuggu

SEQ ID NO: 346140 - RNA, 32 nt, Human
caccaugggaaacuguugugggcgcugcuucc

SEQ ID NO: 346141 - RNA, 29 nt, Human
caccaugggacccaccucaggucccagcc

SEQ ID NO: 346142 - RNA, 32 nt, Human
caccaugggaggcugagcaggaggauggcucg

SEQ ID NO: 346143 - RNA, 29 nt, Human
caccaugggccuccaccuccgccccuacc

SEQ ID NO: 346144 - RNA, 32 nt, Human
caccauggggaccugagagggaaggggacaga

SEQ ID NO: 346145 - RNA, 32 nt, Human
caccauggggcugcugcccucaaauaccuccc

SEQ ID NO: 346146 - RNA, 32 nt, Human
caccaugguagacucuuuuugguaaugguauu

SEQ ID NO: 346147 - RNA, 29 nt, Human
caccauggugggccccgcgccgcggcggc

SEQ ID NO: 346148 - RNA, 32 nt, Human
caccaugguugaaaaccuucucuagauguagu

SEQ ID NO: 346149 - RNA, 32 nt, Human
caccauguaaggacacagcagaaggugcuauc

SEQ ID NO: 346150 - RNA, 32 nt, Human
caccaugucacccaggcucaucgcaagccugu

SEQ ID NO: 346151 - RNA, 32 nt, Human
caccaugucauuguuuugguccaaucagguac

SEQ ID NO: 346152 - RNA, 32 nt, Human
caccauguccagcuaauuuuuguauuuuuagu

SEQ ID NO: 346153 - RNA, 32 nt, Human
caccauguccaucagggugauccagaaguccu

SEQ ID NO: 346154 - RNA, 32 nt, Human
caccaugucccaaggcugcacagagcaggggg

SEQ ID NO: 346155 - RNA, 32 nt, Human
caccauguccccauuacaccagagggccaucg

SEQ ID NO: 346156 - RNA, 32 nt, Human
caccauguccggcuaauuuuuguauuuuuagc

SEQ ID NO: 346157 - RNA, 32 nt, Human
caccaugucucaaacuccugaccucaggcgau

SEQ ID NO: 346158 - RNA, 32 nt, Human
caccaugucucccaggcuggucucaaacuccu

SEQ ID NO: 346159 - RNA, 32 nt, Human
caccaugucuuccucuuccucucucuuccaga

SEQ ID NO: 346160 - RNA, 29 nt, Human
caccauguggccccuguggcucugcuggg

SEQ ID NO: 346161 - RNA, 32 nt, Human
caccaugugggacuccaggcaccaucuguucu

SEQ ID NO: 346162 - RNA, 32 nt, Human
caccauguguguguccugaguuuccagugcaa

SEQ ID NO: 346163 - RNA, 32 nt, Human
caccauguguuacuggccuggaaacugaaggg

SEQ ID NO: 346164 - RNA, 32 nt, Human
caccauguuacccagccuggucucaaacuccc

SEQ ID NO: 346165 - RNA, 32 nt, Human
caccauguuacccaggauggucucaauauccu

SEQ ID NO: 346166 - RNA, 32 nt, Human
caccauguuacccaggcuggucucaaacuccu

SEQ ID NO: 346167 - RNA, 32 nt, Human
caccauguuaccuaggguggucucggcuagug

SEQ ID NO: 346168 - RNA, 32 nt, Human
caccauguuacucaggcuggucucaaacuccc

SEQ ID NO: 346169 - RNA, 32 nt, Human
caccauguuagccaggcuggucucaaacuccu

SEQ ID NO: 346170 - RNA, 32 nt, Human
caccauguuagccaggcuggucucgaacuccu

SEQ ID NO: 346171 - RNA, 32 nt, Human
caccauguucaagaggagguugaaguggcaug

SEQ ID NO: 346172 - RNA, 29 nt, Human
caccauguuccccagcccugcucucacgc

SEQ ID NO: 346173 - RNA, 32 nt, Human
caccauguucgccaggcuggucuggaacuccu

SEQ ID NO: 346174 - RNA, 32 nt, Human
caccauguugaccaggcuggucucaaacuccu

SEQ ID NO: 346175 - RNA, 32 nt, Human
caccauguugcccaggcuggcuucaaacuccu

SEQ ID NO: 346176 - RNA, 32 nt, Human
caccauguugcccaggcuggucucaaaccccc

SEQ ID NO: 346177 - RNA, 32 nt, Human
caccauguugcccaggcuggucucaaacuccu

SEQ ID NO: 346178 - RNA, 32 nt, Human
caccauguugcccaggcuggucucaaccuccu

SEQ ID NO: 346179 - RNA, 32 nt, Human
caccauguugcccaggcuggucucaacuccug

SEQ ID NO: 346180 - RNA, 32 nt, Human
caccauguugcccaggcuggucucgaacuccu

SEQ ID NO: 346181 - RNA, 32 nt, Human
caccauguugcccaggcuggucuugauuccug

SEQ ID NO: 346182 - RNA, 32 nt, Human
caccauguugcccaggcuggugucaaacuccu

SEQ ID NO: 346183 - RNA, 32 nt, Human
caccauguugcccaggcugguuucgaacuccu

SEQ ID NO: 346184 - RNA, 32 nt, Human
caccauguugcucaggcuggucacaaacucca

SEQ ID NO: 346185 - RNA, 32 nt, Human
caccauguugcucaggcuggucucaaacuccu

SEQ ID NO: 346186 - RNA, 32 nt, Human
caccauguuggccaggcuggccucaaacuccu

SEQ ID NO: 346187 - RNA, 32 nt, Human
caccauguuggccaggcugguaucgaccuccu

SEQ ID NO: 346188 - RNA, 32 nt, Human
caccauguuggccaggcuggucacaaacuccu

SEQ ID NO: 346189 - RNA, 32 nt, Human
caccauguuggccaggcuggucucaaacaccu

SEQ ID NO: 346190 - RNA, 32 nt, Human
caccauguuggccaggcuggucucaaacgcca

SEQ ID NO: 346191 - RNA, 32 nt, Human
caccauguuggccaggcuggucucaaacuccu

SEQ ID NO: 346192 - RNA, 32 nt, Human
caccauguuggccaggcuggucucaaacucuc

SEQ ID NO: 346193 - RNA, 32 nt, Human
caccauguuggccaggcuggucucaaacucuu

SEQ ID NO: 346194 - RNA, 32 nt, Human
caccauguuggccaggcuggucucaaacugcu

SEQ ID NO: 346195 - RNA, 32 nt, Human
caccauguuggccaggcuggucucaaacuucu

SEQ ID NO: 346196 - RNA, 32 nt, Human
caccauguuggccaggcuggucucaaauuccu

SEQ ID NO: 346197 - RNA, 32 nt, Human
caccauguuggccaggcuggucucaaauucuu

SEQ ID NO: 346198 - RNA, 32 nt, Human
caccauguuggccaggcuggucucaaccucug

SEQ ID NO: 346199 - RNA, 32 nt, Human
caccauguuggccaggcuggucucaacuccug

SEQ ID NO: 346200 - RNA, 32 nt, Human
caccauguuggccaggcuggucuccaacuccu

SEQ ID NO: 346201 - RNA, 32 nt, Human
caccauguuggccaggcuggucucgaacgccu

SEQ ID NO: 346202 - RNA, 32 nt, Human
caccauguuggccaggcuggucucgaacuacu

SEQ ID NO: 346203 - RNA, 32 nt, Human
caccauguuggccaggcuggucucgaacucau

SEQ ID NO: 346204 - RNA, 32 nt, Human
caccauguuggccaggcuggucucgaacuccc

SEQ ID NO: 346205 - RNA, 32 nt, Human
caccauguuggccaggcuggucucgaacuccg

SEQ ID NO: 346206 - RNA, 32 nt, Human
caccauguuggccaggcuggucucgaacuccu

SEQ ID NO: 346207 - RNA, 32 nt, Human
caccauguuggccaggcuggucucgaacucgu

SEQ ID NO: 346208 - RNA, 32 nt, Human
caccauguuggccaggcuggucucgaacucug

SEQ ID NO: 346209 - RNA, 32 nt, Human
caccauguuggccaggcuggucucgaacucuu

SEQ ID NO: 346210 - RNA, 32 nt, Human
caccauguuggccaggcuggucucgaaugucu

SEQ ID NO: 346211 - RNA, 32 nt, Human
caccauguuggccaggcuggucucgaauucca

SEQ ID NO: 346212 - RNA, 32 nt, Human
caccauguuggccaggcuggucucgaucuccu

SEQ ID NO: 346213 - RNA, 32 nt, Human
caccauguuggccaggcuggucuggaaccccu

SEQ ID NO: 346214 - RNA, 32 nt, Human
caccauguuggccaggcuggucuggaacuccu

SEQ ID NO: 346215 - RNA, 32 nt, Human
caccauguuggccaggcuggucuucaacucca

SEQ ID NO: 346216 - RNA, 32 nt, Human
caccauguuggccaggcugguuucaaacuccu

SEQ ID NO: 346217 - RNA, 32 nt, Human
caccauguuggccaggcugguuucgaacuccu

SEQ ID NO: 346218 - RNA, 32 nt, Human
caccauguuggccaggcuguucuugaaauccu

SEQ ID NO: 346219 - RNA, 32 nt, Human
caccauguuguccaggcuggucucaaacuccu

SEQ ID NO: 346220 - RNA, 32 nt, Human
caccauuaaaggcuuagcauuuaaguagcaac

SEQ ID NO: 346221 - RNA, 32 nt, Human
caccauuaaauggugugcaagcauaauucugu

SEQ ID NO: 346222 - RNA, 32 nt, Human
caccauuaauccagagagaaugaacauagguc

SEQ ID NO: 346223 - RNA, 24 nt, Human
caccauuacacuccagccugggca

SEQ ID NO: 346224 - RNA, 32 nt, Human
caccauuacacuccagccugggcaacagugac

SEQ ID NO: 346225 - RNA, 32 nt, Human
caccauuacacuccagccugggcgacaagaac

SEQ ID NO: 346226 - RNA, 32 nt, Human
caccauuacacuccagccugggcgacaagagc

SEQ ID NO: 346227 - RNA, 32 nt, Human
caccauucaguaggauucaauucaauguggaa

SEQ ID NO: 346228 - RNA, 32 nt, Human
caccauucauuuuaccuccuguucuuacagaa

SEQ ID NO: 346229 - RNA, 20 nt, Human
caccauucccagcagggccu

SEQ ID NO: 346230 - RNA, 32 nt, Human
caccauucccagcuaauuuuuguauuuuuagu

SEQ ID NO: 346231 - RNA, 32 nt, Human
caccauuccccuaggcaggcccugcagguccc

SEQ ID NO: 346232 - RNA, 32 nt, Human
caccauucccggcuaauuuuuguauuuuuggu

SEQ ID NO: 346233 - RNA, 32 nt, Human
caccauucccuugagcagggcccgcucaggag

SEQ ID NO: 346234 - RNA, 32 nt, Human
caccauuccuggcuaauuuuuguauuuucagu

SEQ ID NO: 346235 - RNA, 32 nt, Human
caccauuccuggcuaauuuuuguauuuuuagu

SEQ ID NO: 346236 - RNA, 32 nt, Human
caccauucucacuggaaaacaguggucugcug

SEQ ID NO: 346237 - RNA, 32 nt, Human
caccauucuuuuugccguacuuccuagaagca

SEQ ID NO: 346238 - RNA, 24 nt, Human
caccauugaacuccagccugggca

SEQ ID NO: 346239 - RNA, 32 nt, Human
caccauugaacuccagccugggcaacaagagc

SEQ ID NO: 346240 - RNA, 32 nt, Human
caccauugaugaauucaaacaaauggcuguaa

SEQ ID NO: 346241 - RNA, 32 nt, Human
caccauugcaacaaaauacauucuuuuugcuc

SEQ ID NO: 346242 - RNA, 24 nt, Human
caccauugcaccccagccugagca

SEQ ID NO: 346243 - RNA, 24 nt, Human
caccauugcacccgagccuaggca

SEQ ID NO: 346244 - RNA, 32 nt, Human
caccauugcacccuagccugggcaacagagca

SEQ ID NO: 346245 - RNA, 32 nt, Human
caccauugcaccuccagccugggcaacagagu

SEQ ID NO: 346246 - RNA, 32 nt, Human
caccauugcacuccaaccugggcaacaagagc

SEQ ID NO: 346247 - RNA, 32 nt, Human
caccauugcacuccaaccugggcgacagggcg

SEQ ID NO: 346248 - RNA, 32 nt, Human
caccauugcacuccacccugggcgacagagca

SEQ ID NO: 346249 - RNA, 32 nt, Human
caccauugcacuccagccuagauaacaagagu

SEQ ID NO: 346250 - RNA, 24 nt, Human
caccauugcacuccagccuaggca

SEQ ID NO: 346251 - RNA, 32 nt, Human
caccauugcacuccagccuaggcauggugaga

SEQ ID NO: 346252 - RNA, 32 nt, Human
caccauugcacuccagccugagcaacagagug

SEQ ID NO: 346253 - RNA, 32 nt, Human
caccauugcacuccagccugagugacagagug

SEQ ID NO: 346254 - RNA, 32 nt, Human
caccauugcacuccagccuggaugacagagaa

SEQ ID NO: 346255 - RNA, 32 nt, Human
caccauugcacuccagccuggaugacagagug

SEQ ID NO: 346256 - RNA, 32 nt, Human
caccauugcacuccagccuggaugauagagug

SEQ ID NO: 346257 - RNA, 32 nt, Human
caccauugcacuccagccuggcgaccgagcgg

SEQ ID NO: 346258 - RNA, 24 nt, Human
caccauugcacuccagccugggca

SEQ ID NO: 346259 - RNA, 32 nt, Human
caccauugcacuccagccugggcaaaaagagc

SEQ ID NO: 346260 - RNA, 32 nt, Human
caccauugcacuccagccugggcaacaagaac

SEQ ID NO: 346261 - RNA, 32 nt, Human
caccauugcacuccagccugggcaacaagagc

SEQ ID NO: 346262 - RNA, 32 nt, Human
caccauugcacuccagccugggcaacaagagu

SEQ ID NO: 346263 - RNA, 32 nt, Human
caccauugcacuccagccugggcaacagagua

SEQ ID NO: 346264 - RNA, 32 nt, Human
caccauugcacuccagccugggcaacagagug

SEQ ID NO: 346265 - RNA, 32 nt, Human
caccauugcacuccagccugggcaacagcagc

SEQ ID NO: 346266 - RNA, 32 nt, Human
caccauugcacuccagccugggcaauaagagc

SEQ ID NO: 346267 - RNA, 32 nt, Human
caccauugcacuccagccugggcgacaagagc

SEQ ID NO: 346268 - RNA, 32 nt, Human
caccauugcacuccagccugggcgacaagagu

SEQ ID NO: 346269 - RNA, 32 nt, Human
caccauugcacuccagccugggcgacagagca

SEQ ID NO: 346270 - RNA, 32 nt, Human
caccauugcacuccagccugggcgacagaguc

SEQ ID NO: 346271 - RNA, 32 nt, Human
caccauugcacuccagccugggcgacagggug

SEQ ID NO: 346272 - RNA, 32 nt, Human
caccauugcacuccagccugggcgacuccauc

SEQ ID NO: 346273 - RNA, 32 nt, Human
caccauugcacuccagccugggcgacugagcg

SEQ ID NO: 346274 - RNA, 32 nt, Human
caccauugcacuccagccugggugacaagagc

SEQ ID NO: 346275 - RNA, 32 nt, Human
caccauugcacuccagccugggugacagagcg

SEQ ID NO: 346276 - RNA, 32 nt, Human
caccauugcacuccagccugugcaacaagcga

SEQ ID NO: 346277 - RNA, 32 nt, Human
caccauugcacuccagccuugggcgacaaaaa

SEQ ID NO: 346278 - RNA, 32 nt, Human
caccauugcacuccagcugggagacacagcaa

SEQ ID NO: 346279 - RNA, 32 nt, Human
caccauugcacuccagcuugggcaacaauagc

SEQ ID NO: 346280 - RNA, 32 nt, Human
caccauugcacuccagcuugggugacagagcg

SEQ ID NO: 346281 - RNA, 32 nt, Human
caccauugcacuccugccugggcaacaagagc

SEQ ID NO: 346282 - RNA, 32 nt, Human
caccauugcacuccugccugggcaacaagagu

SEQ ID NO: 346283 - RNA, 32 nt, Human
caccauugcacucuagccuggcaacagagcga

SEQ ID NO: 346284 - RNA, 32 nt, Human
caccauugcacugcagccugggugaagaaaca

SEQ ID NO: 346285 - RNA, 32 nt, Human
caccauugcacuucagccugggcaacaagagc

SEQ ID NO: 346286 - RNA, 32 nt, Human
caccauugcacuucagccugggcgacacagcg

SEQ ID NO: 346287 - RNA, 32 nt, Human
caccauugcagggaggaugccgccaccaugag

SEQ ID NO: 346288 - RNA, 24 nt, Human
caccauugcauuccagccuaggca

SEQ ID NO: 346289 - RNA, 32 nt, Human
caccauugcauuccagccugggcaacaagagc

SEQ ID NO: 346290 - RNA, 32 nt, Human
caccauugcauuccagccugggcaacaagagg

SEQ ID NO: 346291 - RNA, 32 nt, Human
caccauugcauuccagccugggcaacaagagu

SEQ ID NO: 346292 - RNA, 32 nt, Human
caccauugcauuccagccugggugacagagcg

SEQ ID NO: 346293 - RNA, 19 nt, Human
caccauugccaccuacugc

SEQ ID NO: 346294 - RNA, 32 nt, Human
caccauugcccuccagccugggcaacaagagc

SEQ ID NO: 346295 - RNA, 32 nt, Human
caccauugcccuccagccugggugacagagug

SEQ ID NO: 346296 - RNA, 32 nt, Human
caccauugcgcucuagccugggcaacaacagc

SEQ ID NO: 346297 - RNA, 32 nt, Human
caccauugcgcuucagccugggcaacaagagu

SEQ ID NO: 346298 - RNA, 32 nt, Human
caccauugcuguccagccugggugacagagca

SEQ ID NO: 346299 - RNA, 32 nt, Human
caccauuggaccccacccagccuggaucuacc

SEQ ID NO: 346300 - RNA, 23 nt, Human
caccauuggccguagccagcagg

SEQ ID NO: 346301 - RNA, 32 nt, Human
caccauuggcugcuccgagcagcuucucagag

SEQ ID NO: 346302 - RNA, 24 nt, Human
caccauuguacuccagccugggca

SEQ ID NO: 346303 - RNA, 32 nt, Human
caccauuguacuccagccugggcaacaagagu

SEQ ID NO: 346304 - RNA, 32 nt, Human
caccauuguacuccagccugggcaauaagagc

SEQ ID NO: 346305 - RNA, 32 nt, Human
caccauuguacuccagccugugugacagagca

SEQ ID NO: 346306 - RNA, 32 nt, Human
caccauuguggaggccagaggcagcugcguau

SEQ ID NO: 346307 - RNA, 24 nt, Human
caccauuguggcagcugagccacu

SEQ ID NO: 346308 - RNA, 32 nt, Human
caccauuguuaaaugucagccuguacggcaga

SEQ ID NO: 346309 - RNA, 32 nt, Human
caccauuuaggugaucauacaggacaggcugc

SEQ ID NO: 346310 - RNA, 32 nt, Human
caccauuuauucagcaccuguuauguaccagg

SEQ ID NO: 346311 - RNA, 32 nt, Human
caccauuucauuccagccugggcaacaugagu

SEQ ID NO: 346312 - RNA, 32 nt, Human
caccauuucucuccaggcuuucugccuccgag

SEQ ID NO: 346313 - RNA, 21 nt, Human
caccauuugggagaccuaggu

SEQ ID NO: 346314 - RNA, 32 nt, Human
caccauuuucucaguuucucccucucucuccc

SEQ ID NO: 346315 - RNA, 32 nt, Human
cacccaaaauagagagaugaggguaaaauaag

SEQ ID NO: 346316 - RNA, 32 nt, Human
cacccaaaaugcugggauuacaggcaugagcc

SEQ ID NO: 346317 - RNA, 32 nt, Human
cacccaaaggcaacaugacggaaccuugccaa

SEQ ID NO: 346318 - RNA, 32 nt, Human
cacccaaaggugcuaauuccagcaguuuggga

SEQ ID NO: 346319 - RNA, 32 nt, Human
cacccaaagugcuaggauuacagguaugagcc

SEQ ID NO: 346320 - RNA, 32 nt, Human
cacccaaagugcuaggguuacaggcaugagcc

SEQ ID NO: 346321 - RNA, 32 nt, Human
cacccaaagugcugggauuacaggcgugaacc

SEQ ID NO: 346322 - RNA, 32 nt, Human
cacccaaaguguugggauuacaggcaugagcc

SEQ ID NO: 346323 - RNA, 32 nt, Human
cacccaaaguguugggauuacaggugugagcc

SEQ ID NO: 346324 - RNA, 32 nt, Human
cacccaaaguguugggauuauaggcaugagcc

SEQ ID NO: 346325 - RNA, 32 nt, Human
cacccaacacccagaaucugugcaguuauuug

SEQ ID NO: 346326 - RNA, 32 nt, Human
cacccaacccccaggaccucaggcugcuguca

SEQ ID NO: 346327 - RNA, 32 nt, Human
cacccaacccuuggcagccaucugucccugca

SEQ ID NO: 346328 - RNA, 32 nt, Human
cacccaaccucuccaucaccaucccgccaccc

SEQ ID NO: 346329 - RNA, 32 nt, Human
cacccaaccucucccaccuccaccccacaaug

SEQ ID NO: 346330 - RNA, 23 nt, Human
cacccaacuaauuuuuguauuuu

SEQ ID NO: 346331 - RNA, 23 nt, Human
cacccaacuaauuuuuguguuuu

SEQ ID NO: 346332 - RNA, 18 nt, Human
cacccaacuuucccccuc

SEQ ID NO: 346333 - RNA, 32 nt, Human
cacccaagaacgucaccuccuccaucagauug

SEQ ID NO: 346334 - RNA, 32 nt, Human
cacccaagacacaagcuucagcagcaucggaa

SEQ ID NO: 346335 - RNA, 32 nt, Human
cacccaagacggucacagguaacucccaucug

SEQ ID NO: 346336 - RNA, 32 nt, Human
cacccaagagaagagauggaagggcauggccc

SEQ ID NO: 346337 - RNA, 32 nt, Human
cacccaagaugcagggugguuggggccaggag

SEQ ID NO: 346338 - RNA, 32 nt, Human
cacccaagcagaagggagacugagugccucag

SEQ ID NO: 346339 - RNA, 32 nt, Human
cacccaagcccucuccaguucucccccaagcu

SEQ ID NO: 346340 - RNA, 21 nt, Human
cacccaagcuccaaccacaga

SEQ ID NO: 346341 - RNA, 32 nt, Human
cacccaagcugcuggccuccagucccaucucc

SEQ ID NO: 346342 - RNA, 20 nt, Human
cacccaagcuggagugcagu

SEQ ID NO: 346343 - RNA, 21 nt, Human
cacccaagcuggagugcagug

SEQ ID NO: 346344 - RNA, 32 nt, Human
cacccaaggaagcccagcacagaccaucucag

SEQ ID NO: 346345 - RNA, 32 nt, Human
cacccaaggaagcccagcacagaccaucucau

SEQ ID NO: 346346 - RNA, 32 nt, Human
cacccaaggagcagugccggacaacugucggc

SEQ ID NO: 346347 - RNA, 32 nt, Human
cacccaaggcggagugcagugacgacaucaca

SEQ ID NO: 346348 - RNA, 32 nt, Human
cacccaaggcugccuccagccccagcaacccg

SEQ ID NO: 346349 - RNA, 32 nt, Human
cacccaagguucagugacacagggugguuugg

SEQ ID NO: 346350 - RNA, 32 nt, Human
cacccaaguagcuggaauuacaggcaccugcc

SEQ ID NO: 346351 - RNA, 32 nt, Human
cacccaaguagugaacauaguaccaaauaggu

SEQ ID NO: 346352 - RNA, 22 nt, Human
cacccaagucaccgaccacaga

SEQ ID NO: 346353 - RNA, 32 nt, Human
cacccaagucugagaaacccuuaauuacugag

SEQ ID NO: 346354 - RNA, 32 nt, Human
cacccaagugccugaugccucaggugacagaa

SEQ ID NO: 346355 - RNA, 22 nt, Human
cacccaauaucuccagccgcgc

SEQ ID NO: 346356 - RNA, 32 nt, Human
cacccaauggcaggaugggaacagaaaagcaa

SEQ ID NO: 346357 - RNA, 32 nt, Human
cacccaauggggaaggaaggggguuucaacca

SEQ ID NO: 346358 - RNA, 19 nt, Human
cacccaauuccaccacaga

SEQ ID NO: 346359 - RNA, 32 nt, Human
cacccaauucugccauuguagugcaaaagcag

SEQ ID NO: 346360 - RNA, 23 nt, Human
cacccacacacauacacauuuca

SEQ ID NO: 346361 - RNA, 32 nt, Human
cacccacacagcugcccuagcugaccccgaga

SEQ ID NO: 346362 - RNA, 32 nt, Human
cacccacaccaggucugcuuguuucucacaug

SEQ ID NO: 346363 - RNA, 32 nt, Human
cacccacacccacaggucgauuuggucucuuu

SEQ ID NO: 346364 - RNA, 32 nt, Human
cacccacacccacaguaaagaggagacugaau

SEQ ID NO: 346365 - RNA, 19 nt, Human
cacccacacuccaccagca

SEQ ID NO: 346366 - RNA, 32 nt, Human
cacccacagacagaggaugcagggcuucauuu

SEQ ID NO: 346367 - RNA, 32 nt, Human
cacccacagacccuuucucuggcugcgaugcu

SEQ ID NO: 346368 - RNA, 32 nt, Human
cacccacagccuucccuuugggaucuggcaug

SEQ ID NO: 346369 - RNA, 32 nt, Human
cacccacagcucccuucucaucucuuauguuc

SEQ ID NO: 346370 - RNA, 32 nt, Human
cacccacaggagagaauaaaauuaccugugca

SEQ ID NO: 346371 - RNA, 24 nt, Human
cacccacaguaagcaccaugguca

SEQ ID NO: 346372 - RNA, 22 nt, Human
cacccacauaaucaccaucuca

SEQ ID NO: 346373 - RNA, 32 nt, Human
cacccacauccucucuuuuccacacacaacua

SEQ ID NO: 346374 - RNA, 24 nt, Human
cacccacauuugccuguguccuug

SEQ ID NO: 346375 - RNA, 32 nt, Human
cacccaccaccaggauauuuggaaguaacuuc

SEQ ID NO: 346376 - RNA, 32 nt, Human
cacccaccaggccaagcccucugugauucuga

SEQ ID NO: 346377 - RNA, 32 nt, Human
cacccaccaugucucggcaguccuccaucacc

SEQ ID NO: 346378 - RNA, 32 nt, Human
cacccacccaggcuggagccauggauaaauuc

SEQ ID NO: 346379 - RNA, 32 nt, Human
cacccaccccacccuuugcuuucauuucaggu

SEQ ID NO: 346380 - RNA, 25 nt, Human
cacccaccccauuccuggacuccuc

SEQ ID NO: 346381 - RNA, 32 nt, Human
cacccacccccuggcccugccagcugguaguc

SEQ ID NO: 346382 - RNA, 19 nt, Human
cacccacccgaccagcaga

SEQ ID NO: 346383 - RNA, 21 nt, Human
cacccacccgcagccuaggca

SEQ ID NO: 346384 - RNA, 32 nt, Human
cacccacccgccgccucccacggcaccucggg

SEQ ID NO: 346385 - RNA, 32 nt, Human
cacccacccuccaggaccccagcaaguggauu

SEQ ID NO: 346386 - RNA, 32 nt, Human
cacccacccuccugcccuucucagcccagaug

SEQ ID NO: 346387 - RNA, 32 nt, Human
cacccacccucugguccuucugaccccacuua

SEQ ID NO: 346388 - RNA, 32 nt, Human
cacccaccucagccucccaacaugcugcaauu

SEQ ID NO: 346389 - RNA, 32 nt, Human
cacccaccugaguuccgaggagcaccugggaa

SEQ ID NO: 346390 - RNA, 32 nt, Human
cacccaccugcugcugccaugaggcaccuugg

SEQ ID NO: 346391 - RNA, 32 nt, Human
cacccaccuucccaagacccaggaucauguac

SEQ ID NO: 346392 - RNA, 32 nt, Human
cacccaccuuccuugcgaccaccaacacacag

SEQ ID NO: 346393 - RNA, 32 nt, Human
cacccaccuuucuccuccuggggagugucgug

SEQ ID NO: 346394 - RNA, 32 nt, Human
cacccacgaggcccuguccuugcugccagagg

SEQ ID NO: 346395 - RNA, 18 nt, Human
cacccacgccgcaccuca

SEQ ID NO: 346396 - RNA, 32 nt, Human
cacccacgccgccgcggccccacgcugggcga

SEQ ID NO: 346397 - RNA, 32 nt, Human
cacccacgcgcaccgccgugugcaguggccgg

SEQ ID NO: 346398 - RNA, 32 nt, Human
cacccacgugaacaccaccaccagcgccacac

SEQ ID NO: 346399 - RNA, 32 nt, Human
cacccacuaacucugugcucccuucccucucc

SEQ ID NO: 346400 - RNA, 32 nt, Human
cacccacuacucuguccucugccugugcuccg

SEQ ID NO: 346401 - RNA, 25 nt, Human
cacccacucaccguccuugcugcug

SEQ ID NO: 346402 - RNA, 32 nt, Human
cacccacucauguacaugcucacacaugcaga

SEQ ID NO: 346403 - RNA, 32 nt, Human
cacccacucauuuuuauuuuugcucaauauaa

SEQ ID NO: 346404 - RNA, 32 nt, Human
cacccacuccauggaccucaagcagcccucag

SEQ ID NO: 346405 - RNA, 32 nt, Human
cacccacuccccucagaucucaguuagaacau

SEQ ID NO: 346406 - RNA, 32 nt, Human
cacccacucccuugaaguuguggaggagguga

SEQ ID NO: 346407 - RNA, 21 nt, Human
cacccacucucuccagcugca

SEQ ID NO: 346408 - RNA, 32 nt, Human
cacccacucucugaaacuucuuugcuaauaaa

SEQ ID NO: 346409 - RNA, 32 nt, Human
cacccacucuggggcuggccucaugacuuugu

SEQ ID NO: 346410 - RNA, 32 nt, Human
cacccacugcagcugcgcacagucgcauuucu

SEQ ID NO: 346411 - RNA, 32 nt, Human
cacccacugccucugugaccuuggguggguua

SEQ ID NO: 346412 - RNA, 32 nt, Human
cacccacugugaaguccuacaggaaguagaac

SEQ ID NO: 346413 - RNA, 32 nt, Human
cacccacuuccagcuccacuucugcaagguua

SEQ ID NO: 346414 - RNA, 21 nt, Human
cacccacuucccuguguuuca

SEQ ID NO: 346415 - RNA, 27 nt, Human
cacccacuugaugccacagccaugcca

SEQ ID NO: 346416 - RNA, 32 nt, Human
cacccacuuuuuccagaucuuccucuugcucu

SEQ ID NO: 346417 - RNA, 32 nt, Human
cacccagaaagccucacauugugcaguggaga

SEQ ID NO: 346418 - RNA, 32 nt, Human
cacccagaacaguuggaaguguggaaaggagg

SEQ ID NO: 346419 - RNA, 32 nt, Human
cacccagaagugaagaagcagauacacaaggc

SEQ ID NO: 346420 - RNA, 32 nt, Human
cacccagacacacgcacgcacacacacgcgcg

SEQ ID NO: 346421 - RNA, 32 nt, Human
cacccagacagagggaugaccuucaaccucau

SEQ ID NO: 346422 - RNA, 32 nt, Human
cacccagaccgagagacacagugaugaccuca

SEQ ID NO: 346423 - RNA, 32 nt, Human
cacccagaccuccagacagccggcuagcccca

SEQ ID NO: 346424 - RNA, 32 nt, Human
cacccagaccucuggguccuugcucaggcagc

SEQ ID NO: 346425 - RNA, 32 nt, Human
cacccagacucagggaugagugcagcgucaag

SEQ ID NO: 346426 - RNA, 32 nt, Human
cacccagagagggcauggaggcuccacgcaac

SEQ ID NO: 346427 - RNA, 32 nt, Human
cacccagagauggaggaagggucagccauuug

SEQ ID NO: 346428 - RNA, 32 nt, Human
cacccagagccaguguggucaguauuccaaac

SEQ ID NO: 346429 - RNA, 32 nt, Human
cacccagagcccacccucccaagcucaggggc

SEQ ID NO: 346430 - RNA, 32 nt, Human
cacccagagcuuuagaagagagcugugcuucu

SEQ ID NO: 346431 - RNA, 32 nt, Human
cacccagaguagccaugaggaggcagagaggg

SEQ ID NO: 346432 - RNA, 32 nt, Human
cacccagaucccucccucccagucccaugauu

SEQ ID NO: 346433 - RNA, 32 nt, Human
cacccagaucucagacuuccagccuccagaac

SEQ ID NO: 346434 - RNA, 32 nt, Human
cacccagaugagugggagagacacccagggcc

SEQ ID NO: 346435 - RNA, 32 nt, Human
cacccagaugucccuuugauggcccuuguuga

SEQ ID NO: 346436 - RNA, 32 nt, Human
cacccagcaagguugaaguucaugaguucgcc

SEQ ID NO: 346437 - RNA, 32 nt, Human
cacccagcacacacacagaugucagggaccag

SEQ ID NO: 346438 - RNA, 32 nt, Human
cacccagcacccagugcugcagguuucuccug

SEQ ID NO: 346439 - RNA, 32 nt, Human
cacccagcacggcugucagccucggcaggagg

SEQ ID NO: 346440 - RNA, 32 nt, Human
cacccagcacucagcgacucuuccugcagaac

SEQ ID NO: 346441 - RNA, 24 nt, Human
cacccagcacucucauugcugcug

SEQ ID NO: 346442 - RNA, 32 nt, Human
cacccagcagaauuacuggaagagcgaagacu

SEQ ID NO: 346443 - RNA, 32 nt, Human
cacccagcagagccacuggagcuggcuagucc

SEQ ID NO: 346444 - RNA, 32 nt, Human
cacccagcagaggcuucuccccauagcacgag

SEQ ID NO: 346445 - RNA, 32 nt, Human
cacccagcaguggguugcagagcuccccaugc

SEQ ID NO: 346446 - RNA, 32 nt, Human
cacccagcaugcagcucugccuccgcagccuc

SEQ ID NO: 346447 - RNA, 32 nt, Human
cacccagcaugguggagggaaugccagccggc

SEQ ID NO: 346448 - RNA, 19 nt, Human
cacccagccaccuuccuca

SEQ ID NO: 346449 - RNA, 32 nt, Human
cacccagccaggcagagcugggauugaaggac

SEQ ID NO: 346450 - RNA, 32 nt, Human
cacccagcccacgaaucaucucccucuugaag

SEQ ID NO: 346451 - RNA, 32 nt, Human
cacccagcccagagaagaguuuagugacugag

SEQ ID NO: 346452 - RNA, 32 nt, Human
cacccagcccagggcuggcagucuuugcagcg

SEQ ID NO: 346453 - RNA, 32 nt, Human
cacccagccccagccccauccccagccccagc

SEQ ID NO: 346454 - RNA, 32 nt, Human
cacccagcccccacauccugugccuccaucag

SEQ ID NO: 346455 - RNA, 32 nt, Human
cacccagccggcccuccgucuccugagggacg

SEQ ID NO: 346456 - RNA, 32 nt, Human
cacccagccgugggaggaagggggcguggcaa

SEQ ID NO: 346457 - RNA, 32 nt, Human
cacccagccguuggcagcaucuacucagcaag

SEQ ID NO: 346458 - RNA, 32 nt, Human
cacccagccugugggaccucaggagggucaga

SEQ ID NO: 346459 - RNA, 24 nt, Human
cacccagcgucuccccugcugcug

SEQ ID NO: 346460 - RNA, 23 nt, Human
cacccagcuaacuuuuguauuuu

SEQ ID NO: 346461 - RNA, 24 nt, Human
cacccagcuaacuuuuuguauuuu

SEQ ID NO: 346462 - RNA, 20 nt, Human
cacccagcuaaucuucaucu

SEQ ID NO: 346463 - RNA, 22 nt, Human
cacccagcuaaucuuuguacuu

SEQ ID NO: 346464 - RNA, 23 nt, Human
cacccagcuaauuuucguauuuu

SEQ ID NO: 346465 - RNA, 23 nt, Human
cacccagcuaauuuucgucuuuu

SEQ ID NO: 346466 - RNA, 21 nt, Human
cacccagcuaauuuuguauuu

SEQ ID NO: 346467 - RNA, 22 nt, Human
cacccagcuaauuuuguauuuu

SEQ ID NO: 346468 - RNA, 23 nt, Human
cacccagcuaauuuuuauguuuu

SEQ ID NO: 346469 - RNA, 23 nt, Human
cacccagcuaauuuuugcauuuu

SEQ ID NO: 346470 - RNA, 23 nt, Human
cacccagcuaauuuuuguauuuu

SEQ ID NO: 346471 - RNA, 23 nt, Human
cacccagcuaauuuuuguguuuu

SEQ ID NO: 346472 - RNA, 22 nt, Human
cacccagcuaauuuuuguuuuu

SEQ ID NO: 346473 - RNA, 23 nt, Human
cacccagcuaauuuuuuauacuu

SEQ ID NO: 346474 - RNA, 23 nt, Human
cacccagcuaauuuuuuguauuu

SEQ ID NO: 346475 - RNA, 24 nt, Human
cacccagcuaauuuuuuguauuuu

SEQ ID NO: 346476 - RNA, 32 nt, Human
cacccagcucaaggagcuuaugcaggagcagg

SEQ ID NO: 346477 - RNA, 32 nt, Human
cacccagcucugucaccuccugacugaaccua

SEQ ID NO: 346478 - RNA, 27 nt, Human
cacccagcugccugagacccuccuuca

SEQ ID NO: 346479 - RNA, 19 nt, Human
cacccagcugggugcagug

SEQ ID NO: 346480 - RNA, 32 nt, Human
cacccagcugugaaugaacguggucagaacac

SEQ ID NO: 346481 - RNA, 32 nt, Human
cacccagcuugauguccacuggacacuggcaa

SEQ ID NO: 346482 - RNA, 32 nt, Human
cacccaggaacucccuggcaguggauuguggg

SEQ ID NO: 346483 - RNA, 32 nt, Human
cacccaggacacccaggauauggucuuugcug

SEQ ID NO: 346484 - RNA, 32 nt, Human
cacccaggacuuugcucugccugguggagggu

SEQ ID NO: 346485 - RNA, 32 nt, Human
cacccaggagcagaagaccauguuguuggauu

SEQ ID NO: 346486 - RNA, 32 nt, Human
cacccaggaggagugggcuuugcuggauccuu

SEQ ID NO: 346487 - RNA, 32 nt, Human
cacccaggaggagugggcuuugcuggguccuu

SEQ ID NO: 346488 - RNA, 32 nt, Human
cacccaggaggaguggggccagcuggaccuag

SEQ ID NO: 346489 - RNA, 32 nt, Human
cacccaggaggaguuuuuacauuuuggucuaa

SEQ ID NO: 346490 - RNA, 32 nt, Human
cacccaggaggccggcccugaccacacuguuc

SEQ ID NO: 346491 - RNA, 32 nt, Human
cacccaggagguggagguugcagugagccgag

SEQ ID NO: 346492 - RNA, 32 nt, Human
cacccaggcacugggcaagugaagaguuugcc

SEQ ID NO: 346493 - RNA, 32 nt, Human
cacccaggccagaauaacagagcuuucuuagu

SEQ ID NO: 346494 - RNA, 21 nt, Human
cacccaggccgaccuccugcu

SEQ ID NO: 346495 - RNA, 32 nt, Human
cacccaggccuuacaguccaaccuuuuucugu

SEQ ID NO: 346496 - RNA, 24 nt, Human
cacccaggccuugaugccgagcgg

SEQ ID NO: 346497 - RNA, 32 nt, Human
cacccaggcugaagcuccugagggacucacau

SEQ ID NO: 346498 - RNA, 32 nt, Human
cacccaggcugaguaucaucuccugggccaca

SEQ ID NO: 346499 - RNA, 32 nt, Human
cacccaggcugcagggugaggccaggcaggcc

SEQ ID NO: 346500 - RNA, 32 nt, Human
cacccaggcuggaaugcagugcaguggcacaa

SEQ ID NO: 346501 - RNA, 20 nt, Human
cacccaggcuggaguacagu

SEQ ID NO: 346502 - RNA, 21 nt, Human
cacccaggcuggaguacagug

SEQ ID NO: 346503 - RNA, 20 nt, Human
cacccaggcuggaguccagu

SEQ ID NO: 346504 - RNA, 21 nt, Human
cacccaggcuggaguccagug

SEQ ID NO: 346505 - RNA, 21 nt, Human
cacccaggcuggagugcagug

SEQ ID NO: 346506 - RNA, 21 nt, Human
cacccaggcuggagugcugug

SEQ ID NO: 346507 - RNA, 32 nt, Human
cacccaggcuggcagaucaugguagcagcagc

SEQ ID NO: 346508 - RNA, 32 nt, Human
cacccaggcugggagcuugccaggaacccagu

SEQ ID NO: 346509 - RNA, 32 nt, Human
cacccagggaaaaugggcuugacgaggccggc

SEQ ID NO: 346510 - RNA, 32 nt, Human
cacccagggacccccuuuccucagccuccacc

SEQ ID NO: 346511 - RNA, 32 nt, Human
cacccagggaggccgaggcgggaggaucgcug

SEQ ID NO: 346512 - RNA, 16 nt, Human
cacccagggccagucg

SEQ ID NO: 346513 - RNA, 32 nt, Human
cacccagggcccagagagacccaggacagagg

SEQ ID NO: 346514 - RNA, 32 nt, Human
cacccagggcccuguccugugucugccaccac

SEQ ID NO: 346515 - RNA, 21 nt, Human
cacccagggccgggcggcugc

SEQ ID NO: 346516 - RNA, 32 nt, Human
cacccagggcuaagcuuuugaacacuuucuuu

SEQ ID NO: 346517 - RNA, 20 nt, Human
cacccagguccugggcaguc

SEQ ID NO: 346518 - RNA, 32 nt, Human
cacccaggugccgaggaaagagacugagggca

SEQ ID NO: 346519 - RNA, 32 nt, Human
cacccaguaguauacccaaaauagcgaaauau

SEQ ID NO: 346520 - RNA, 32 nt, Human
cacccaguccccauaacaaaaccacuguccaa

SEQ ID NO: 346521 - RNA, 32 nt, Human
cacccagucccucccucugguccacugccuuu

SEQ ID NO: 346522 - RNA, 32 nt, Human
cacccagucuaagggcagguucugucccauug

SEQ ID NO: 346523 - RNA, 19 nt, Human
cacccagucuggagugcag

SEQ ID NO: 346524 - RNA, 20 nt, Human
cacccagucuggagugcagu

SEQ ID NO: 346525 - RNA, 21 nt, Human
cacccagucuggagugcagug

SEQ ID NO: 346526 - RNA, 32 nt, Human
cacccagucuucauguacggccgaccgcaggc

SEQ ID NO: 346527 - RNA, 32 nt, Human
cacccagugcugcagguuucuccugggugaag

SEQ ID NO: 346528 - RNA, 32 nt, Human
cacccauaccacagcauccccuagagagagug

SEQ ID NO: 346529 - RNA, 32 nt, Human
cacccauaucuauccuggauucugaacucuuc

SEQ ID NO: 346530 - RNA, 32 nt, Human
cacccaucaccaccaccaccacggugacccca

SEQ ID NO: 346531 - RNA, 32 nt, Human
cacccaucaccuagcaacaggaugcagccuuc

SEQ ID NO: 346532 - RNA, 32 nt, Human
cacccaucagccaacacuccccaacccaucgg

SEQ ID NO: 346533 - RNA, 32 nt, Human
cacccauccacacacaccuacacucacacacg

SEQ ID NO: 346534 - RNA, 32 nt, Human
cacccauccccuggugggcuccugggcggccu

SEQ ID NO: 346535 - RNA, 32 nt, Human
cacccauccuauuagccucccacauucaaggc

SEQ ID NO: 346536 - RNA, 32 nt, Human
cacccaucuaccugaaaacaaaacaggcacag

SEQ ID NO: 346537 - RNA, 32 nt, Human
cacccaucucacucacacacacaggcauccau

SEQ ID NO: 346538 - RNA, 32 nt, Human
cacccaucuccacaaagccaagugaaggugua

SEQ ID NO: 346539 - RNA, 32 nt, Human
cacccaucucuuaguguugccugagacuaaag

SEQ ID NO: 346540 - RNA, 32 nt, Human
cacccaucugguuuggccauuccuccuuggug

SEQ ID NO: 346541 - RNA, 32 nt, Human
cacccaucuuuguucccaucugaggacucagg

SEQ ID NO: 346542 - RNA, 32 nt, Human
cacccaugaggggaaacguggggaagaaggaa

SEQ ID NO: 346543 - RNA, 32 nt, Human
cacccaugaugcugugccuuccagaaaccugu

SEQ ID NO: 346544 - RNA, 32 nt, Human
cacccaugcacgcacacacauacacacugaag

SEQ ID NO: 346545 - RNA, 32 nt, Human
cacccaugccaucucaaccucuuccccgcccg

SEQ ID NO: 346546 - RNA, 32 nt, Human
cacccaugccucccucuuccuccucuuuccuc

SEQ ID NO: 346547 - RNA, 32 nt, Human
cacccaugcucccuccuuuaggcaggcccaga

SEQ ID NO: 346548 - RNA, 32 nt, Human
cacccauggcugcaguggaggggccagggcug

SEQ ID NO: 346549 - RNA, 29 nt, Human
cacccauggcugcugugacuccuaccagg

SEQ ID NO: 346550 - RNA, 32 nt, Human
cacccauggcuguaauggaugaacaugccacc

SEQ ID NO: 346551 - RNA, 32 nt, Human
cacccaugugaacaccaccaccagugccacac

SEQ ID NO: 346552 - RNA, 32 nt, Human
cacccaugugccaccuaacugaacuugaauau

SEQ ID NO: 346553 - RNA, 31 nt, Human
cacccauucaauaaauauguauugaacaucu

SEQ ID NO: 346554 - RNA, 32 nt, Human
cacccauucauucauuuauucauucacagcac

SEQ ID NO: 346555 - RNA, 32 nt, Human
cacccauuccaggugccacaggcaggggaugu

SEQ ID NO: 346556 - RNA, 32 nt, Human
cacccauucccccauaaaacagcuuauugucu

SEQ ID NO: 346557 - RNA, 32 nt, Human
cacccauuuaaaugcacaagcaaccaaaauug

SEQ ID NO: 346558 - RNA, 32 nt, Human
cacccauuucaccaccaccaugacaccgggca

SEQ ID NO: 346559 - RNA, 32 nt, Human
caccccaaagugcugggauuacaggcgugaag

SEQ ID NO: 346560 - RNA, 28 nt, Human
caccccaaaucuuaccccaccacuggca

SEQ ID NO: 346561 - RNA, 32 nt, Human
caccccaaccaccuugcaccagucuucucauu

SEQ ID NO: 346562 - RNA, 32 nt, Human
caccccaacccuauccacccuggaccaccucu

SEQ ID NO: 346563 - RNA, 32 nt, Human
caccccaaccugggcgacagagccagacucug

SEQ ID NO: 346564 - RNA, 32 nt, Human
caccccaaccuguucaaaccuuccgcuugguc

SEQ ID NO: 346565 - RNA, 32 nt, Human
caccccaacuaccaccucuuuucaggcacaga

SEQ ID NO: 346566 - RNA, 32 nt, Human
caccccaagccacagggacucccaccaggguc

SEQ ID NO: 346567 - RNA, 32 nt, Human
caccccaaggcgugaccaggaggaacagccug

SEQ ID NO: 346568 - RNA, 32 nt, Human
caccccaagucugcccaagugaagauggcuga

SEQ ID NO: 346569 - RNA, 32 nt, Human
caccccaaucucccaguucauuuccuaauccu

SEQ ID NO: 346570 - RNA, 32 nt, Human
caccccaauguucuggaggcugcgguucugcu

SEQ ID NO: 346571 - RNA, 32 nt, Human
caccccacaaccuucaggacagucuaucuuaa

SEQ ID NO: 346572 - RNA, 20 nt, Human
caccccacacaggcugcggc

SEQ ID NO: 346573 - RNA, 22 nt, Human
caccccacacaugacccacacc

SEQ ID NO: 346574 - RNA, 21 nt, Human
caccccacacccccacuggca

SEQ ID NO: 346575 - RNA, 18 nt, Human
caccccacaccccuccca

SEQ ID NO: 346576 - RNA, 21 nt, Human
caccccacaccugcagugcca

SEQ ID NO: 346577 - RNA, 32 nt, Human
caccccacacugauagcacuuccccaggccug

SEQ ID NO: 346578 - RNA, 32 nt, Human
caccccacagggcauagccagggggaccagca

SEQ ID NO: 346579 - RNA, 32 nt, Human
caccccacagugggugccuuccagaaauauag

SEQ ID NO: 346580 - RNA, 32 nt, Human
caccccaccagaagugccccugccuggguucu

SEQ ID NO: 346581 - RNA, 32 nt, Human
caccccaccaggcucugcuguaggcugggcuc

SEQ ID NO: 346582 - RNA, 15 nt, Human
caccccaccaggguc

SEQ ID NO: 346583 - RNA, 32 nt, Human
caccccacccaaggaagcccagcacagaccau

SEQ ID NO: 346584 - RNA, 32 nt, Human
caccccaccccagcugcccggcggcugggccc

SEQ ID NO: 346585 - RNA, 23 nt, Human
caccccacccccgggcgccuggc

SEQ ID NO: 346586 - RNA, 20 nt, Human
caccccacccccuccagcca

SEQ ID NO: 346587 - RNA, 16 nt, Human
caccccaccccuccca

SEQ ID NO: 346588 - RNA, 32 nt, Human
caccccacccuucacacccuuuccugaaaggc

SEQ ID NO: 346589 - RNA, 18 nt, Human
caccccaccuaccucaca

SEQ ID NO: 346590 - RNA, 32 nt, Human
caccccacgcugaugcagaagcucccagaaca

SEQ ID NO: 346591 - RNA, 32 nt, Human
caccccacguagcugcucacaccagccuccgg

SEQ ID NO: 346592 - RNA, 32 nt, Human
caccccacuccucaucucaccauuuggucaaa

SEQ ID NO: 346593 - RNA, 32 nt, Human
caccccacugcauuccagccugggugacagag

SEQ ID NO: 346594 - RNA, 32 nt, Human
caccccacugccaaggguggggucucaggagu

SEQ ID NO: 346595 - RNA, 32 nt, Human
caccccacuggcagcuuuguggauuaggaugg

SEQ ID NO: 346596 - RNA, 32 nt, Human
caccccacuggccuucucaggugcaaucagua

SEQ ID NO: 346597 - RNA, 32 nt, Human
caccccacuguccuccagccugggcaacagag

SEQ ID NO: 346598 - RNA, 32 nt, Human
caccccacugugcuguagccugggugacagug

SEQ ID NO: 346599 - RNA, 32 nt, Human
caccccacuuccuucucggaaggccagcucuu

SEQ ID NO: 346600 - RNA, 32 nt, Human
caccccagaagcagcaguggcagcuugggaaa

SEQ ID NO: 346601 - RNA, 32 nt, Human
caccccagaagguucucuuguauaccugcuca

SEQ ID NO: 346602 - RNA, 32 nt, Human
caccccagacacagggaucccuauguaaaaau

SEQ ID NO: 346603 - RNA, 32 nt, Human
caccccagaggugagaggaaugaggggcauug

SEQ ID NO: 346604 - RNA, 32 nt, Human
caccccagaguccucaacuggaccuaggggaa

SEQ ID NO: 346605 - RNA, 32 nt, Human
caccccagagugaggaggacgcaggggucaga

SEQ ID NO: 346606 - RNA, 32 nt, Human
caccccagcacaucugaagaugagcgccucuc

SEQ ID NO: 346607 - RNA, 32 nt, Human
caccccagcaugagugcugagauauggacucu

SEQ ID NO: 346608 - RNA, 32 nt, Human
caccccagccagccgaacaccaugaaguccag

SEQ ID NO: 346609 - RNA, 32 nt, Human
caccccagccccacugcccuccagggccagga

SEQ ID NO: 346610 - RNA, 32 nt, Human
caccccagcccgggugacagagcgagacuccg

SEQ ID NO: 346611 - RNA, 32 nt, Human
caccccagccuaagugaaagagcgagagccug

SEQ ID NO: 346612 - RNA, 32 nt, Human
caccccagccucgccuucccaccccaucgucu

SEQ ID NO: 346613 - RNA, 32 nt, Human
caccccagccuggacaacagagugagacuccu

SEQ ID NO: 346614 - RNA, 32 nt, Human
caccccagccugggcaacagagcaagacucca

SEQ ID NO: 346615 - RNA, 32 nt, Human
caccccagccugggcaacagagcaagacuccg

SEQ ID NO: 346616 - RNA, 32 nt, Human
caccccagccugggcaacagaguaagauuagg

SEQ ID NO: 346617 - RNA, 32 nt, Human
caccccagccugggcgacagagcaagagaccc

SEQ ID NO: 346618 - RNA, 32 nt, Human
caccccagccugggcgacagagccagacccug

SEQ ID NO: 346619 - RNA, 32 nt, Human
caccccagccugggcgacggagcgagacuccg

SEQ ID NO: 346620 - RNA, 32 nt, Human
caccccagccugggugacagagcgagacuccg

SEQ ID NO: 346621 - RNA, 32 nt, Human
caccccagccugggugacagagcgagacucug

SEQ ID NO: 346622 - RNA, 32 nt, Human
caccccagccugggugacagcgagauccuguc

SEQ ID NO: 346623 - RNA, 32 nt, Human
caccccagcgcugucugugggucccuugcccc

SEQ ID NO: 346624 - RNA, 19 nt, Human
caccccagcugaccaugag

SEQ ID NO: 346625 - RNA, 32 nt, Human
caccccagcugccucucuuguccugaggguua

SEQ ID NO: 346626 - RNA, 32 nt, Human
caccccaggcaaagcagagagcagagguucuu

SEQ ID NO: 346627 - RNA, 32 nt, Human
caccccaggcagugccugcuggcugggcuggu

SEQ ID NO: 346628 - RNA, 32 nt, Human
caccccagggccugagccuggccagccuacaa

SEQ ID NO: 346629 - RNA, 32 nt, Human
caccccagggccuguggcugccugggcaccuc

SEQ ID NO: 346630 - RNA, 32 nt, Human
caccccagugccugucuggagcucacccaagg

SEQ ID NO: 346631 - RNA, 32 nt, Human
caccccauagagacucucucuauaccagcaug

SEQ ID NO: 346632 - RNA, 32 nt, Human
caccccauccccaggaaacuguagcuucuuaa

SEQ ID NO: 346633 - RNA, 24 nt, Human
caccccaucccgucccccacccca

SEQ ID NO: 346634 - RNA, 32 nt, Human
caccccaucccucuccccagucuuggauacua

SEQ ID NO: 346635 - RNA, 32 nt, Human
caccccaucgugcagcugcauggcuacuugga

SEQ ID NO: 346636 - RNA, 21 nt, Human
caccccaucuccccaccacca

SEQ ID NO: 346637 - RNA, 31 nt, Human
caccccauggaggaaugcugggugacagaga

SEQ ID NO: 346638 - RNA, 32 nt, Human
caccccauggaggcgcaaugauagcagaauua

SEQ ID NO: 346639 - RNA, 32 nt, Human
caccccauuccauacccuucuucaccuggggu

SEQ ID NO: 346640 - RNA, 32 nt, Human
caccccauucuccucuccucugaccccucagc

SEQ ID NO: 346641 - RNA, 32 nt, Human
caccccauugcacuccagccuggacaacaaga

SEQ ID NO: 346642 - RNA, 32 nt, Human
caccccauuucacuccagccugggcgacaaga

SEQ ID NO: 346643 - RNA, 32 nt, Human
cacccccaaauaccaccaaagaagaaagaaag

SEQ ID NO: 346644 - RNA, 32 nt, Human
cacccccaacccaguccuaccugucacaccgg

SEQ ID NO: 346645 - RNA, 32 nt, Human
cacccccaagaguuuccauuaacuugauccca

SEQ ID NO: 346646 - RNA, 32 nt, Human
cacccccaagccugggcuugagcugcagaaug

SEQ ID NO: 346647 - RNA, 32 nt, Human
cacccccaaggcugcagccacaccauguuuca

SEQ ID NO: 346648 - RNA, 32 nt, Human
cacccccacauucucuccucuggacccccagg

SEQ ID NO: 346649 - RNA, 32 nt, Human
cacccccacauuugcacaccuuccacaggguc

SEQ ID NO: 346650 - RNA, 22 nt, Human
cacccccacccaccuccaccca

SEQ ID NO: 346651 - RNA, 32 nt, Human
cacccccacccccauucccaagccuccaacuu

SEQ ID NO: 346652 - RNA, 32 nt, Human
cacccccaccuuccuccagccugugcgcaccu

SEQ ID NO: 346653 - RNA, 32 nt, Human
cacccccaccuuuuccuuuuccucuuagacuu

SEQ ID NO: 346654 - RNA, 22 nt, Human
cacccccacuccaaccauguca

SEQ ID NO: 346655 - RNA, 32 nt, Human
cacccccacucugccucauuucugccuccagg

SEQ ID NO: 346656 - RNA, 32 nt, Human
cacccccacugcacccccuccccauggguucu

SEQ ID NO: 346657 - RNA, 32 nt, Human
cacccccagaacaggcagagacagggcacagu

SEQ ID NO: 346658 - RNA, 32 nt, Human
cacccccagaggaggcggaagaggagcccgag

SEQ ID NO: 346659 - RNA, 32 nt, Human
cacccccagcaaccccaucccagaauccuauu

SEQ ID NO: 346660 - RNA, 32 nt, Human
cacccccagcacagggggauucugagcagugc

SEQ ID NO: 346661 - RNA, 32 nt, Human
cacccccagcacuucggacauggccgaggaag

SEQ ID NO: 346662 - RNA, 32 nt, Human
cacccccagcauggcuuggaagacugaaaggc

SEQ ID NO: 346663 - RNA, 32 nt, Human
cacccccagccagaacacgcagugccagccgu

SEQ ID NO: 346664 - RNA, 32 nt, Human
cacccccagccagcucaggguuuuagaguguu

SEQ ID NO: 346665 - RNA, 22 nt, Human
cacccccagcccugcacccuca

SEQ ID NO: 346666 - RNA, 20 nt, Human
cacccccagcuccugaggug

SEQ ID NO: 346667 - RNA, 32 nt, Human
cacccccagcuggcccuccacccccaccucaa

SEQ ID NO: 346668 - RNA, 27 nt, Human
cacccccagcuuccaccucaaggaggu

SEQ ID NO: 346669 - RNA, 32 nt, Human
cacccccaggauguugcggaggcugcuggagc

SEQ ID NO: 346670 - RNA, 32 nt, Human
cacccccaggcgugggggacaaaagccaaagg

SEQ ID NO: 346671 - RNA, 32 nt, Human
cacccccaggcuuuaccaggugcccccucaga

SEQ ID NO: 346672 - RNA, 32 nt, Human
cacccccagggaggggccuggggaaagcuggu

SEQ ID NO: 346673 - RNA, 31 nt, Human
cacccccagucccagcaccugugucaguaaa

SEQ ID NO: 346674 - RNA, 32 nt, Human
cacccccagugcagggcuggucuuggggaggc

SEQ ID NO: 346675 - RNA, 32 nt, Human
cacccccaguuccuaugacacaguuaucaaaa

SEQ ID NO: 346676 - RNA, 32 nt, Human
cacccccaucaccuucucaacugggaaacccc

SEQ ID NO: 346677 - RNA, 25 nt, Human
cacccccaucccacccaaccacagg

SEQ ID NO: 346678 - RNA, 32 nt, Human
cacccccaucuccaccuccgcaugucauuucu

SEQ ID NO: 346679 - RNA, 32 nt, Human
cacccccaucuuccaccugugcccucaccacc

SEQ ID NO: 346680 - RNA, 32 nt, Human
cacccccaugccuguccuccaggcuggggcag

SEQ ID NO: 346681 - RNA, 32 nt, Human
cacccccauugcucuccuccaggggcagaaca

SEQ ID NO: 346682 - RNA, 24 nt, Human
cacccccauuuguuucaaagaggu

SEQ ID NO: 346683 - RNA, 18 nt, Human
caccccccacccaccgca

SEQ ID NO: 346684 - RNA, 24 nt, Human
caccccccgugggucucagggagg

SEQ ID NO: 346685 - RNA, 24 nt, Human
caccccccuucagccgccuggaga

SEQ ID NO: 346686 - RNA, 32 nt, Human
cacccccgcacaccugcaucccugccggaggc

SEQ ID NO: 346687 - RNA, 23 nt, Human
cacccccgcagcggcgcuacggg

SEQ ID NO: 346688 - RNA, 32 nt, Human
cacccccgcaggcugcagagcaaggaugaagc

SEQ ID NO: 346689 - RNA, 22 nt, Human
cacccccgccacagccuacacg

SEQ ID NO: 346690 - RNA, 17 nt, Human
cacccccgcccccuccc

SEQ ID NO: 346691 - RNA, 32 nt, Human
cacccccggagcucucaccccuccagugccga

SEQ ID NO: 346692 - RNA, 20 nt, Human
cacccccggagucgccacac

SEQ ID NO: 346693 - RNA, 19 nt, Human
cacccccggccucagccac

SEQ ID NO: 346694 - RNA, 32 nt, Human
cacccccguccaccccagagacccugcccuuc

SEQ ID NO: 346695 - RNA, 32 nt, Human
cacccccguggagacagggcucuggggcugau

SEQ ID NO: 346696 - RNA, 21 nt, Human
cacccccucaaacucuguuua

SEQ ID NO: 346697 - RNA, 32 nt, Human
cacccccucaacuucacaccuugauuucacuc

SEQ ID NO: 346698 - RNA, 32 nt, Human
cacccccucacugccuacuccugcuuucggga

SEQ ID NO: 346699 - RNA, 32 nt, Human
cacccccucagaaggcuggugacaucuguuga

SEQ ID NO: 346700 - RNA, 20 nt, Human
cacccccucagcgccacgga

SEQ ID NO: 346701 - RNA, 32 nt, Human
cacccccuccacucugcaucauacacccuuca

SEQ ID NO: 346702 - RNA, 32 nt, Human
cacccccuccccauggguucucuccuuccucu

SEQ ID NO: 346703 - RNA, 18 nt, Human
cacccccucccccauaga

SEQ ID NO: 346704 - RNA, 32 nt, Human
cacccccuccccuuccccuccugccugcuuug

SEQ ID NO: 346705 - RNA, 32 nt, Human
cacccccucuuccccacuucccugcacucuca

SEQ ID NO: 346706 - RNA, 32 nt, Human
cacccccugaagccacucgcucccagauuagg

SEQ ID NO: 346707 - RNA, 32 nt, Human
cacccccugauugcuggcaucugccucuucuc

SEQ ID NO: 346708 - RNA, 32 nt, Human
cacccccugcaacuucugcacauacuggggcc

SEQ ID NO: 346709 - RNA, 32 nt, Human
cacccccugcaaucccccaccuuucggggucu

SEQ ID NO: 346710 - RNA, 32 nt, Human
cacccccugcaccuccaccugccccagccccu

SEQ ID NO: 346711 - RNA, 32 nt, Human
cacccccugccugcccagccugggcccugcag

SEQ ID NO: 346712 - RNA, 32 nt, Human
cacccccugccuggaaacuuaaggaggccgga

SEQ ID NO: 346713 - RNA, 32 nt, Human
cacccccugcuccaccagcagcauggcauagc

SEQ ID NO: 346714 - RNA, 32 nt, Human
cacccccuggcuuccccaccucuccagguguc

SEQ ID NO: 346715 - RNA, 32 nt, Human
cacccccugggaacaccugagcagaaacugaa

SEQ ID NO: 346716 - RNA, 32 nt, Human
cacccccugggcaagugagagcaucugcaaaa

SEQ ID NO: 346717 - RNA, 18 nt, Human
cacccccugggcagggag

SEQ ID NO: 346718 - RNA, 32 nt, Human
cacccccuggggcugcucagccucaggcacgg

SEQ ID NO: 346719 - RNA, 32 nt, Human
cacccccuguaaucccagcacuuugggaagcc

SEQ ID NO: 346720 - RNA, 32 nt, Human
cacccccugucucuuuugguucagucuuuucg

SEQ ID NO: 346721 - RNA, 32 nt, Human
cacccccuugggccuggcuggaucccaggcag

SEQ ID NO: 346722 - RNA, 22 nt, Human
cacccccuuuucacucucuuua

SEQ ID NO: 346723 - RNA, 32 nt, Human
cacccccuuuucuuccuacucugugccuggag

SEQ ID NO: 346724 - RNA, 32 nt, Human
caccccgacuuuuccuuccuccuuccuccccg

SEQ ID NO: 346725 - RNA, 32 nt, Human
caccccgaggcagaguugggaaagcagugguc

SEQ ID NO: 346726 - RNA, 32 nt, Human
caccccgagugcggagccagagaucaaaagau

SEQ ID NO: 346727 - RNA, 32 nt, Human
caccccgauguggaccucuacuuuccaggcua

SEQ ID NO: 346728 - RNA, 32 nt, Human
caccccgcaaggcucccgcuggugucccugga

SEQ ID NO: 346729 - RNA, 32 nt, Human
caccccgcaguguccucguucuuuauuggucc

SEQ ID NO: 346730 - RNA, 32 nt, Human
caccccgccagccuacacugccagccgccacc

SEQ ID NO: 346731 - RNA, 32 nt, Human
caccccgcccagcaccuugggccccgccgcuu

SEQ ID NO: 346732 - RNA, 32 nt, Human
caccccgccccuccccuccacagcagagagug

SEQ ID NO: 346733 - RNA, 23 nt, Human
caccccgccccugcaugccuggc

SEQ ID NO: 346734 - RNA, 21 nt, Human
caccccgccugccuccuggcu

SEQ ID NO: 346735 - RNA, 32 nt, Human
caccccgccugccuccuggcucaggcccagcu

SEQ ID NO: 346736 - RNA, 32 nt, Human
caccccgcgagcccauggaggcuccgggaccc

SEQ ID NO: 346737 - RNA, 32 nt, Human
caccccgcugccucuagguucugggaagaugg

SEQ ID NO: 346738 - RNA, 32 nt, Human
caccccggcccaggacgggaugcgggucgguc

SEQ ID NO: 346739 - RNA, 32 nt, Human
caccccggcccccugcccguucuugaaaugua

SEQ ID NO: 346740 - RNA, 32 nt, Human
caccccggcuggccaugcuguccccucccugu

SEQ ID NO: 346741 - RNA, 32 nt, Human
caccccggcuuggcgcugucucucccccucgg

SEQ ID NO: 346742 - RNA, 32 nt, Human
caccccgggaucuggugacgcuggggcuggaa

SEQ ID NO: 346743 - RNA, 32 nt, Human
caccccgggcagcagagaaggcccagcugaca

SEQ ID NO: 346744 - RNA, 32 nt, Human
caccccggucccgccgaggagccuccgggugg

SEQ ID NO: 346745 - RNA, 32 nt, Human
caccccgucgcacaggcuggagugcaguggca

SEQ ID NO: 346746 - RNA, 32 nt, Human
caccccgugagggaggggaggggugggcuggg

SEQ ID NO: 346747 - RNA, 32 nt, Human
caccccgugauucugcccacgcuccuccacca

SEQ ID NO: 346748 - RNA, 32 nt, Human
caccccuaaauacccacccuguggacuuugag

SEQ ID NO: 346749 - RNA, 32 nt, Human
caccccuaacccaaaucucuggccucacccca

SEQ ID NO: 346750 - RNA, 32 nt, Human
caccccuaacugcccccugccugcuccggcac

SEQ ID NO: 346751 - RNA, 32 nt, Human
caccccuacucgccuaagagcuuucuccucuc

SEQ ID NO: 346752 - RNA, 32 nt, Human
caccccuacucuccucccuugcucccagcagc

SEQ ID NO: 346753 - RNA, 32 nt, Human
caccccuacucuggcccuccuuaugucacugc

SEQ ID NO: 346754 - RNA, 32 nt, Human
caccccuagaggcagaugggcugagauaaaag

SEQ ID NO: 346755 - RNA, 32 nt, Human
caccccuaggcuguggaagcaagugcagaccc

SEQ ID NO: 346756 - RNA, 32 nt, Human
caccccuaguaaugaugaggcagaugccuugg

SEQ ID NO: 346757 - RNA, 32 nt, Human
caccccucaaagcagcgccugccuccucccuc

SEQ ID NO: 346758 - RNA, 32 nt, Human
caccccucaccccucaccauccuuccucagga

SEQ ID NO: 346759 - RNA, 32 nt, Human
caccccucacugcaaaagcaucuccuuaagua

SEQ ID NO: 346760 - RNA, 32 nt, Human
caccccucagcccaggagggaaagggcauuuu

SEQ ID NO: 346761 - RNA, 32 nt, Human
caccccuccagccgcaguuuuuggcuacaaac

SEQ ID NO: 346762 - RNA, 32 nt, Human
caccccuccaucucaaagaaauaacaucaucc

SEQ ID NO: 346763 - RNA, 18 nt, Human
caccccucccacccccau

SEQ ID NO: 346764 - RNA, 32 nt, Human
caccccuccccaagcccuucccagucacugca

SEQ ID NO: 346765 - RNA, 19 nt, Human
caccccuccccaguacagg

SEQ ID NO: 346766 - RNA, 32 nt, Human
caccccuccccauugucccucucccauucauc

SEQ ID NO: 346767 - RNA, 21 nt, Human
caccccuccccucaccacaga

SEQ ID NO: 346768 - RNA, 22 nt, Human
caccccucccuccggcugcacg

SEQ ID NO: 346769 - RNA, 19 nt, Human
caccccucccugccacagg

SEQ ID NO: 346770 - RNA, 18 nt, Human
caccccucccugccacca

SEQ ID NO: 346771 - RNA, 32 nt, Human
caccccucccuucacccaccccacccccgggc

SEQ ID NO: 346772 - RNA, 19 nt, Human
caccccuccgcagccccau

SEQ ID NO: 346773 - RNA, 32 nt, Human
caccccuccguguggagcacuggagauagugc

SEQ ID NO: 346774 - RNA, 32 nt, Human
caccccuccucagauccgucccucuaaugggu

SEQ ID NO: 346775 - RNA, 32 nt, Human
caccccuccuccuaaacuccccaacccaccuc

SEQ ID NO: 346776 - RNA, 32 nt, Human
caccccuccugcuaggagaggcugcgggcugc

SEQ ID NO: 346777 - RNA, 32 nt, Human
caccccuccuguuaugcccguggcgguggcac

SEQ ID NO: 346778 - RNA, 32 nt, Human
caccccuccuucccucuugacccccuagguuu

SEQ ID NO: 346779 - RNA, 32 nt, Human
caccccucgaccaauccuccacaaacuucagu

SEQ ID NO: 346780 - RNA, 32 nt, Human
caccccucgcagcugcuuccuucugccuggga

SEQ ID NO: 346781 - RNA, 32 nt, Human
caccccucgggccuuugggcuggaccagccac

SEQ ID NO: 346782 - RNA, 32 nt, Human
caccccucuccucgucccuccuggucgugccc

SEQ ID NO: 346783 - RNA, 32 nt, Human
caccccucuccucugcccacccgagccccaga

SEQ ID NO: 346784 - RNA, 32 nt, Human
caccccucucuggccacgucacccccgccuuu

SEQ ID NO: 346785 - RNA, 32 nt, Human
caccccucugaccccugccuucccaggcaggg

SEQ ID NO: 346786 - RNA, 32 nt, Human
caccccucugggaugcgggugagggaagguug

SEQ ID NO: 346787 - RNA, 32 nt, Human
caccccucuguaaccuccauaauccaucaggu

SEQ ID NO: 346788 - RNA, 32 nt, Human
caccccucuuagcuguccuugcuugugccugc

SEQ ID NO: 346789 - RNA, 32 nt, Human
caccccucuugcuucuuccccaccucaccauc

SEQ ID NO: 346790 - RNA, 32 nt, Human
caccccugagccaccuguggcucugcuaccca

SEQ ID NO: 346791 - RNA, 32 nt, Human
caccccugaucuccagacucauggccccagcu

SEQ ID NO: 346792 - RNA, 32 nt, Human
caccccugcacgaugaacacacaccgggcugg

SEQ ID NO: 346793 - RNA, 32 nt, Human
caccccugcacuccagccugggcaacagagug

SEQ ID NO: 346794 - RNA, 32 nt, Human
caccccugcacuccagccugggcggcagagug

SEQ ID NO: 346795 - RNA, 32 nt, Human
caccccugcacuccagccugggugacagagug

SEQ ID NO: 346796 - RNA, 32 nt, Human
caccccugcacuccagccugggugacagcuag

SEQ ID NO: 346797 - RNA, 32 nt, Human
caccccugcacuccaggcugggcaacaguacg

SEQ ID NO: 346798 - RNA, 32 nt, Human
caccccugcacuccugccuucccgugggcacu

SEQ ID NO: 346799 - RNA, 32 nt, Human
caccccugcaggcauccaaaggagcacacaug

SEQ ID NO: 346800 - RNA, 32 nt, Human
caccccugcccugcccucucucccaggauucc

SEQ ID NO: 346801 - RNA, 32 nt, Human
caccccugccuccccuccaccccugccucucc

SEQ ID NO: 346802 - RNA, 32 nt, Human
caccccugccuccgggaugaaaggggguaacc

SEQ ID NO: 346803 - RNA, 32 nt, Human
caccccugccuucgugccauccuuccugggag

SEQ ID NO: 346804 - RNA, 32 nt, Human
caccccuggacuccagcuugggugacacagug

SEQ ID NO: 346805 - RNA, 32 nt, Human
caccccuggcagccaggcagagcaucagugcc

SEQ ID NO: 346806 - RNA, 32 nt, Human
caccccugggcugagggaagggagaggagagg

SEQ ID NO: 346807 - RNA, 32 nt, Human
caccccuggggagcacagggaggcagaggcuu

SEQ ID NO: 346808 - RNA, 32 nt, Human
caccccuguagucccagcuacuugggaggcug

SEQ ID NO: 346809 - RNA, 19 nt, Human
caccccugucaccuggagg

SEQ ID NO: 346810 - RNA, 32 nt, Human
caccccuguccucacugcucccugaagcccag

SEQ ID NO: 346811 - RNA, 18 nt, Human
caccccugucucaaggag

SEQ ID NO: 346812 - RNA, 32 nt, Human
caccccugugagaugcugagggcaggauaccu

SEQ ID NO: 346813 - RNA, 32 nt, Human
caccccugugucugcagagugccuucaaaacu

SEQ ID NO: 346814 - RNA, 32 nt, Human
caccccuguuaaaccugaucugugucauaagu

SEQ ID NO: 346815 - RNA, 19 nt, Human
caccccuguuaccccagga

SEQ ID NO: 346816 - RNA, 32 nt, Human
caccccuuagcacaccugcucgucccauuuag

SEQ ID NO: 346817 - RNA, 32 nt, Human
caccccuuagcuccccuauccugggcuaggag

SEQ ID NO: 346818 - RNA, 32 nt, Human
caccccuucaccugaggcuucuccccucucaa

SEQ ID NO: 346819 - RNA, 32 nt, Human
caccccuucaggaucagucaagggaaagcacu

SEQ ID NO: 346820 - RNA, 32 nt, Human
caccccuuccaguuaagaccugccuagcagag

SEQ ID NO: 346821 - RNA, 18 nt, Human
caccccuucccagcccca

SEQ ID NO: 346822 - RNA, 20 nt, Human
caccccuuccccaaucccau

SEQ ID NO: 346823 - RNA, 20 nt, Human
caccccuuccccaggcaaga

SEQ ID NO: 346824 - RNA, 32 nt, Human
caccccuuccuccuccuagccucucucccaaa

SEQ ID NO: 346825 - RNA, 20 nt, Human
caccccuuccugaccacgga

SEQ ID NO: 346826 - RNA, 32 nt, Human
caccccuugcacuuaacauaagcuauuuuugg

SEQ ID NO: 346827 - RNA, 32 nt, Human
caccccuugcccagagugugcccucugcaugg

SEQ ID NO: 346828 - RNA, 32 nt, Human
caccccuugccucuguggcagcugcgagugug

SEQ ID NO: 346829 - RNA, 32 nt, Human
caccccuugccuggccuggccugaggcucagc

SEQ ID NO: 346830 - RNA, 32 nt, Human
caccccuuguuacugauaaagcccagagagcu

SEQ ID NO: 346831 - RNA, 32 nt, Human
caccccuuucaucucuguuuccauacguuugc

SEQ ID NO: 346832 - RNA, 32 nt, Human
caccccuuucuuucuuucucucucugauugag

SEQ ID NO: 346833 - RNA, 32 nt, Human
caccccuuuucuguggcaucugaucugucauc

SEQ ID NO: 346834 - RNA, 32 nt, Human
cacccgacaacuaccacuccccaagccuucag

SEQ ID NO: 346835 - RNA, 32 nt, Human
cacccgaccagccccgugccauggcccuagug

SEQ ID NO: 346836 - RNA, 32 nt, Human
cacccgaccagccugggccgcauucccugcag

SEQ ID NO: 346837 - RNA, 32 nt, Human
cacccgacgagaggaggcggggugggggaggc

SEQ ID NO: 346838 - RNA, 32 nt, Human
cacccgacguaaucccagcacguugggaggcc

SEQ ID NO: 346839 - RNA, 32 nt, Human
cacccgacuaacaucucagucucugaaaaugc

SEQ ID NO: 346840 - RNA, 32 nt, Human
cacccgacuguacugccuuccugcagccucca

SEQ ID NO: 346841 - RNA, 32 nt, Human
cacccgagaggacccauaugugcaaccuggag

SEQ ID NO: 346842 - RNA, 21 nt, Human
cacccgaggcuccugcugcug

SEQ ID NO: 346843 - RNA, 32 nt, Human
cacccgaucaugugcuccaguuuaugaaauag

SEQ ID NO: 346844 - RNA, 32 nt, Human
cacccgcacacagaggcauuugcaccagcucc

SEQ ID NO: 346845 - RNA, 32 nt, Human
cacccgcacugcagucuccagccugagccaug

SEQ ID NO: 346846 - RNA, 32 nt, Human
cacccgcacuucucccaaaaggcagaugacgg

SEQ ID NO: 346847 - RNA, 32 nt, Human
cacccgcagcuccggcgccgcggcgagacgga

SEQ ID NO: 346848 - RNA, 18 nt, Human
cacccgcaggccuacuga

SEQ ID NO: 346849 - RNA, 32 nt, Human
cacccgcagggaggguggggagagcuggcagg

SEQ ID NO: 346850 - RNA, 32 nt, Human
cacccgcauucuuccuccuucuucuggugcua

SEQ ID NO: 346851 - RNA, 32 nt, Human
cacccgccaagcucucuagccucuccuggccu

SEQ ID NO: 346852 - RNA, 32 nt, Human
cacccgccaggcggaaagucacccuguuccca

SEQ ID NO: 346853 - RNA, 18 nt, Human
cacccgccauggaccauc

SEQ ID NO: 346854 - RNA, 21 nt, Human
cacccgccccagcuucugcca

SEQ ID NO: 346855 - RNA, 32 nt, Human
cacccgcccgggaucaggaggccgggggcgcc

SEQ ID NO: 346856 - RNA, 22 nt, Human
cacccgcccugcccaagcccag

SEQ ID NO: 346857 - RNA, 32 nt, Human
cacccgcccuuuccuugccuucuuuacucggc

SEQ ID NO: 346858 - RNA, 32 nt, Human
cacccgccgcacgaccaccacccgccgcacga

SEQ ID NO: 346859 - RNA, 32 nt, Human
cacccgccgcugcuaauuuuuguauuuuuagu

SEQ ID NO: 346860 - RNA, 32 nt, Human
cacccgccugccuggccgcaggugguucuccc

SEQ ID NO: 346861 - RNA, 32 nt, Human
cacccgccuguaguccagcuacuugaggcuga

SEQ ID NO: 346862 - RNA, 32 nt, Human
cacccgccuuuccuuccugacguccucugucc

SEQ ID NO: 346863 - RNA, 32 nt, Human
cacccgcuaugccugcacugcagcccagcccc

SEQ ID NO: 346864 - RNA, 32 nt, Human
cacccgcucgacccucucccggccccuccccu

SEQ ID NO: 346865 - RNA, 32 nt, Human
cacccgcugacauuuccguuguacauguuccu

SEQ ID NO: 346866 - RNA, 19 nt, Human
cacccgcuggcucuacuga

SEQ ID NO: 346867 - RNA, 32 nt, Human
cacccgcuggguuucuugaggucugaggaccg

SEQ ID NO: 346868 - RNA, 32 nt, Human
cacccgcugugaggcccgaccacccacccaga

SEQ ID NO: 346869 - RNA, 32 nt, Human
cacccggaacuuggcauccagcaaugggcccc

SEQ ID NO: 346870 - RNA, 32 nt, Human
cacccggaccuggacgcagggccaggugcugu

SEQ ID NO: 346871 - RNA, 32 nt, Human
cacccggagcaggauggggaggagcugagccg

SEQ ID NO: 346872 - RNA, 32 nt, Human
cacccggaggcagcggaggcaggcgcagcauc

SEQ ID NO: 346873 - RNA, 32 nt, Human
cacccggaggcagugggauggaggagugauug

SEQ ID NO: 346874 - RNA, 32 nt, Human
cacccggaugccugccccgcacggccagcagc

SEQ ID NO: 346875 - RNA, 32 nt, Human
cacccggcacacacccucccugccaccaggau

SEQ ID NO: 346876 - RNA, 32 nt, Human
cacccggcagggaggacaaagcagaaagggca

SEQ ID NO: 346877 - RNA, 32 nt, Human
cacccggccucagggcaguccccaccacacug

SEQ ID NO: 346878 - RNA, 32 nt, Human
cacccgggaagacgacagagacugaagauugg

SEQ ID NO: 346879 - RNA, 32 nt, Human
cacccgggaagggaaagcagccagcagcccuc

SEQ ID NO: 346880 - RNA, 32 nt, Human
cacccgggagaagggagaggguccuguugacg

SEQ ID NO: 346881 - RNA, 32 nt, Human
cacccgggagcaccgccugggcaaccacuaca

SEQ ID NO: 346882 - RNA, 32 nt, Human
cacccgggauuggaaugcaauggcgcgaucuc

SEQ ID NO: 346883 - RNA, 32 nt, Human
cacccgggcccggaggaugaugaagcucaagu

SEQ ID NO: 346884 - RNA, 21 nt, Human
cacccgggccuuggcggcugc

SEQ ID NO: 346885 - RNA, 32 nt, Human
cacccgggcucagggaccacagcaaggcaccu

SEQ ID NO: 346886 - RNA, 32 nt, Human
cacccggggcccugcuuccucacacuggcggg

SEQ ID NO: 346887 - RNA, 32 nt, Human
cacccggguccuugaagugaucucuaggcccc

SEQ ID NO: 346888 - RNA, 32 nt, Human
cacccggucccaccuggugacacugggcuucc

SEQ ID NO: 346889 - RNA, 32 nt, Human
cacccgguuaccaaagucagcaaagaagaugc

SEQ ID NO: 346890 - RNA, 22 nt, Human
cacccguaaucccagcuacuca

SEQ ID NO: 346891 - RNA, 32 nt, Human
cacccgugcccagccugagcuguuuucuucug

SEQ ID NO: 346892 - RNA, 32 nt, Human
cacccguggggaggggacggagcugugcuuag

SEQ ID NO: 346893 - RNA, 32 nt, Human
cacccguucgcccgucccccugccgcauucac

SEQ ID NO: 346894 - RNA, 32 nt, Human
cacccuaacacauacccucccacccaccuucc

SEQ ID NO: 346895 - RNA, 32 nt, Human
cacccuaacccccaccucccggcccugagcgu

SEQ ID NO: 346896 - RNA, 32 nt, Human
cacccuaaccccgacuccccagcccugggacu

SEQ ID NO: 346897 - RNA, 32 nt, Human
cacccuacacaaaauacagcacuuugacauau

SEQ ID NO: 346898 - RNA, 32 nt, Human
cacccuacaccuccccucagaacuucaaaagg

SEQ ID NO: 346899 - RNA, 32 nt, Human
cacccuacagccagaagagauaugaggaaaau

SEQ ID NO: 346900 - RNA, 32 nt, Human
cacccuacauggcugcccugugcccucgggau

SEQ ID NO: 346901 - RNA, 32 nt, Human
cacccuacauuccucuccucuucacuagccuc

SEQ ID NO: 346902 - RNA, 32 nt, Human
cacccuaccaccagacacagagcccggaccac

SEQ ID NO: 346903 - RNA, 17 nt, Human
cacccuacccccagggu

SEQ ID NO: 346904 - RNA, 32 nt, Human
cacccuacccgacgcagcugugaauggccggu

SEQ ID NO: 346905 - RNA, 32 nt, Human
cacccuacccgcccaaggagacuccacccugg

SEQ ID NO: 346906 - RNA, 32 nt, Human
cacccuaccucaccucuucucaggcaccccuc

SEQ ID NO: 346907 - RNA, 32 nt, Human
cacccuacugugaaaaggggaggggauguggu

SEQ ID NO: 346908 - RNA, 32 nt, Human
cacccuagaagaggagggagggauucugggug

SEQ ID NO: 346909 - RNA, 32 nt, Human
cacccuagaucuuccccaagagggacuggggu

SEQ ID NO: 346910 - RNA, 32 nt, Human
cacccuagccugggcaacagagcaagacaccg

SEQ ID NO: 346911 - RNA, 32 nt, Human
cacccuagcucccugcuccagggaugugagca

SEQ ID NO: 346912 - RNA, 32 nt, Human
cacccuaggaggcgcggugccacccacuacuc

SEQ ID NO: 346913 - RNA, 32 nt, Human
cacccuaucgguucuccuccaccuggacagga

SEQ ID NO: 346914 - RNA, 32 nt, Human
cacccuaugcuguacaacacacagaaagcccc

SEQ ID NO: 346915 - RNA, 32 nt, Human
cacccuauugcccaggcuggagugcaauggcg

SEQ ID NO: 346916 - RNA, 22 nt, Human
cacccucaaagccgucugccca

SEQ ID NO: 346917 - RNA, 32 nt, Human
cacccucaacaaacaccagcgcuuuggguacg

SEQ ID NO: 346918 - RNA, 32 nt, Human
cacccucaacugcucuuuuugucuuacauccc

SEQ ID NO: 346919 - RNA, 32 nt, Human
cacccucaagaggaguuagaaaagagguccuu

SEQ ID NO: 346920 - RNA, 32 nt, Human
cacccucaagcagcagaugugcagcaagggag

SEQ ID NO: 346921 - RNA, 32 nt, Human
cacccucaagguguucaucuuccaguucguca

SEQ ID NO: 346922 - RNA, 32 nt, Human
cacccucaaguagcagagacaggugugcaaag

SEQ ID NO: 346923 - RNA, 32 nt, Human
cacccucaaguagcagggacaggugugcaaaa

SEQ ID NO: 346924 - RNA, 32 nt, Human
cacccucacagacacacccaggaacaaguuua

SEQ ID NO: 346925 - RNA, 32 nt, Human
cacccucaccuguguucucuucccucucuccc

SEQ ID NO: 346926 - RNA, 32 nt, Human
cacccucaccuugccaggccucuccccugcag

SEQ ID NO: 346927 - RNA, 32 nt, Human
cacccucacuguccuccagcccaggaugggcc

SEQ ID NO: 346928 - RNA, 31 nt, Human
cacccucagagagucggggcggagugagggu

SEQ ID NO: 346929 - RNA, 32 nt, Human
cacccucagcacugaccacugugauggggacc

SEQ ID NO: 346930 - RNA, 32 nt, Human
cacccucagguaggccccaguauguuauuccu

SEQ ID NO: 346931 - RNA, 32 nt, Human
cacccucaguagcugggauuauuggcaugcac

SEQ ID NO: 346932 - RNA, 32 nt, Human
cacccucaucuuugacguggagcugcucaacu

SEQ ID NO: 346933 - RNA, 32 nt, Human
cacccucaugcaccgacccaacccaggccugg

SEQ ID NO: 346934 - RNA, 32 nt, Human
cacccuccaagccugcaccucuuaguccagca

SEQ ID NO: 346935 - RNA, 32 nt, Human
cacccuccacacaccagccucugcaaccagac

SEQ ID NO: 346936 - RNA, 23 nt, Human
cacccuccacuucccaacccaga

SEQ ID NO: 346937 - RNA, 32 nt, Human
cacccuccagccagccccucacaugcccuagg

SEQ ID NO: 346938 - RNA, 32 nt, Human
cacccuccagccugccuuaguacugcggcaag

SEQ ID NO: 346939 - RNA, 32 nt, Human
cacccuccagccugggcaacguaguaaaaccu

SEQ ID NO: 346940 - RNA, 22 nt, Human
cacccuccaggccaugcccucu

SEQ ID NO: 346941 - RNA, 32 nt, Human
cacccuccaugugauccagagaacagcaacuc

SEQ ID NO: 346942 - RNA, 32 nt, Human
cacccuccauuccuccuccccugggccucucu

SEQ ID NO: 346943 - RNA, 32 nt, Human
cacccucccacaccucccugaacuuccaucug

SEQ ID NO: 346944 - RNA, 32 nt, Human
cacccucccaucaucugcuucccccaaggccu

SEQ ID NO: 346945 - RNA, 20 nt, Human
cacccuccccaaguccacca

SEQ ID NO: 346946 - RNA, 15 nt, Human
cacccuccccacuga

SEQ ID NO: 346947 - RNA, 15 nt, Human
cacccuccccauuaa

SEQ ID NO: 346948 - RNA, 19 nt, Human
cacccucccccacuugcca

SEQ ID NO: 346949 - RNA, 22 nt, Human
cacccuccccccagucaccuca

SEQ ID NO: 346950 - RNA, 32 nt, Human
cacccuccccgugcugcuguguucugcuccuc

SEQ ID NO: 346951 - RNA, 32 nt, Human
cacccuccccuccccuccccuccccucccccg

SEQ ID NO: 346952 - RNA, 32 nt, Human
cacccuccccuccccuccccuuccucccuccc

SEQ ID NO: 346953 - RNA, 23 nt, Human
cacccuccccucccgucuacuca

SEQ ID NO: 346954 - RNA, 24 nt, Human
cacccuccccuccucuccuccuca

SEQ ID NO: 346955 - RNA, 32 nt, Human
cacccuccccuccugacccuccuacgaggcuu

SEQ ID NO: 346956 - RNA, 22 nt, Human
cacccuccccugucuucucuca

SEQ ID NO: 346957 - RNA, 32 nt, Human
cacccuccccugucuucucucaaagggaagcu

SEQ ID NO: 346958 - RNA, 32 nt, Human
cacccucccggcaucugucaccagugauccgu

SEQ ID NO: 346959 - RNA, 32 nt, Human
cacccucccgggagcugaggcuggggcucaug

SEQ ID NO: 346960 - RNA, 32 nt, Human
cacccucccgucccugccacugggugaggaca

SEQ ID NO: 346961 - RNA, 32 nt, Human
cacccucccuccacuccucucaacugccucag

SEQ ID NO: 346962 - RNA, 32 nt, Human
cacccucccuccagagccaccaguguuagagc

SEQ ID NO: 346963 - RNA, 21 nt, Human
cacccucccuggcucugcuca

SEQ ID NO: 346964 - RNA, 32 nt, Human
cacccucccugggccuuggaaucccccaaggc

SEQ ID NO: 346965 - RNA, 23 nt, Human
cacccucccuuagcucugacuca

SEQ ID NO: 346966 - RNA, 32 nt, Human
cacccucccuuuccuuuuccccucuucuaccc

SEQ ID NO: 346967 - RNA, 32 nt, Human
cacccuccggacacaugggccagcugccugug

SEQ ID NO: 346968 - RNA, 18 nt, Human
cacccuccuccacccucu

SEQ ID NO: 346969 - RNA, 32 nt, Human
cacccuccuccacggcucuggccacacccuca

SEQ ID NO: 346970 - RNA, 32 nt, Human
cacccuccuccaggaaccuccacaucuccaaa

SEQ ID NO: 346971 - RNA, 32 nt, Human
cacccuccuccaggaagcccccuucauggucu

SEQ ID NO: 346972 - RNA, 32 nt, Human
cacccuccuccaggacaccacuagguggugcu

SEQ ID NO: 346973 - RNA, 21 nt, Human
cacccuccucccaccuucuca

SEQ ID NO: 346974 - RNA, 32 nt, Human
cacccuccucccccauggagguuuccaggggu

SEQ ID NO: 346975 - RNA, 32 nt, Human
cacccuccucggccuccucucucccuccuccc

SEQ ID NO: 346976 - RNA, 32 nt, Human
cacccuccucucacccuccacccuccaggaga

SEQ ID NO: 346977 - RNA, 32 nt, Human
cacccuccugaggaccuccccaccccagugua

SEQ ID NO: 346978 - RNA, 32 nt, Human
cacccuccuuacccugcccccuugucuuguau

SEQ ID NO: 346979 - RNA, 32 nt, Human
cacccuccuuuggaccaugcagucagaggggc

SEQ ID NO: 346980 - RNA, 32 nt, Human
cacccucgccaagcuccaggguaccugccccu

SEQ ID NO: 346981 - RNA, 32 nt, Human
cacccucgcuuaucuguagauucaaagcgaug

SEQ ID NO: 346982 - RNA, 32 nt, Human
cacccucggacuccugcccuccucggccuccc

SEQ ID NO: 346983 - RNA, 32 nt, Human
cacccucuacacggcuccacccugccauggcc

SEQ ID NO: 346984 - RNA, 32 nt, Human
cacccucuacagccuuccucaggccccugucu

SEQ ID NO: 346985 - RNA, 32 nt, Human
cacccucuauauggaaauguggucaaaauacu

SEQ ID NO: 346986 - RNA, 32 nt, Human
cacccucucaagggucuuuccagcucuagguc

SEQ ID NO: 346987 - RNA, 32 nt, Human
cacccucuccaccccuaauccccaugcugcug

SEQ ID NO: 346988 - RNA, 32 nt, Human
cacccucuccaucaccugcucugcucuuacaa

SEQ ID NO: 346989 - RNA, 32 nt, Human
cacccucuccaucaccugcucugcucuuauaa

SEQ ID NO: 346990 - RNA, 32 nt, Human
cacccucucccaggacccaucacgccugugca

SEQ ID NO: 346991 - RNA, 32 nt, Human
cacccucucccaugguauuagcagagcauuuu

SEQ ID NO: 346992 - RNA, 32 nt, Human
cacccucucccccaggaaacagugccuaagga

SEQ ID NO: 346993 - RNA, 32 nt, Human
cacccucuccccuuguccacugcugccgccuc

SEQ ID NO: 346994 - RNA, 19 nt, Human
cacccucuccuugcuuuca

SEQ ID NO: 346995 - RNA, 32 nt, Human
cacccucucucccucaccccucucucugggau

SEQ ID NO: 346996 - RNA, 32 nt, Human
cacccucugcacaccuuuaacuggaggacuga

SEQ ID NO: 346997 - RNA, 32 nt, Human
cacccucugcagccccacuccugggccuucuu

SEQ ID NO: 346998 - RNA, 32 nt, Human
cacccucugccucacucccaaugucuccuuug

SEQ ID NO: 346999 - RNA, 32 nt, Human
cacccucugcugcuucagcaucuccgccugga

SEQ ID NO: 347000 - RNA, 20 nt, Human
cacccucugcuuccuggcca

SEQ ID NO: 347001 - RNA, 32 nt, Human
cacccucugcuugaacuuuuuccaaauaaauu

SEQ ID NO: 347002 - RNA, 22 nt, Human
cacccucuggugccucuacuca

SEQ ID NO: 347003 - RNA, 32 nt, Human
cacccucugucucuccugccuucugcuuauuc

SEQ ID NO: 347004 - RNA, 18 nt, Human
cacccucugugagccccu

SEQ ID NO: 347005 - RNA, 32 nt, Human
cacccucuuagcagcccuccccaggaaaagug

SEQ ID NO: 347006 - RNA, 32 nt, Human
cacccucuucgccugguacagcccucacagcu

SEQ ID NO: 347007 - RNA, 32 nt, Human
cacccucuucucucuucucuucucccugcccc

SEQ ID NO: 347008 - RNA, 32 nt, Human
cacccucuugucuucagggaauucagaggauu

SEQ ID NO: 347009 - RNA, 32 nt, Human
cacccucuuucuguuggcuccaccuccagccu

SEQ ID NO: 347010 - RNA, 23 nt, Human
cacccucuuuucccuucccaaag

SEQ ID NO: 347011 - RNA, 32 nt, Human
cacccugaacaacgagccuuuucacccuucua

SEQ ID NO: 347012 - RNA, 32 nt, Human
cacccugaacagcucagagggaggagccagac

SEQ ID NO: 347013 - RNA, 32 nt, Human
cacccugaagaugacuuccugagccagccccc

SEQ ID NO: 347014 - RNA, 32 nt, Human
cacccugaauccagcuuccugcuaugaaugaa

SEQ ID NO: 347015 - RNA, 32 nt, Human
cacccugaccaacaguccagccaucccauugg

SEQ ID NO: 347016 - RNA, 32 nt, Human
cacccugaccaacauagagaaaccccgucucc

SEQ ID NO: 347017 - RNA, 32 nt, Human
cacccugaccaacaugaaaccccgucucuacu

SEQ ID NO: 347018 - RNA, 32 nt, Human
cacccugaccaagguggugaaaccccgucucu

SEQ ID NO: 347019 - RNA, 32 nt, Human
cacccugacuaacauggagagacccugucucu

SEQ ID NO: 347020 - RNA, 32 nt, Human
cacccugacuccugucacugucuccaucccca

SEQ ID NO: 347021 - RNA, 32 nt, Human
cacccugagaaaagguccuagcuggagucagu

SEQ ID NO: 347022 - RNA, 32 nt, Human
cacccugagaauucugggagccagucugccau

SEQ ID NO: 347023 - RNA, 32 nt, Human
cacccugagauguacagaccaauacuggccau

SEQ ID NO: 347024 - RNA, 20 nt, Human
cacccugagcuccggugcuc

SEQ ID NO: 347025 - RNA, 22 nt, Human
cacccugagcugaggagcacag

SEQ ID NO: 347026 - RNA, 32 nt, Human
cacccugaggacccuggggcucaguggaggca

SEQ ID NO: 347027 - RNA, 32 nt, Human
cacccugagguccugcauuucucagucggugu

SEQ ID NO: 347028 - RNA, 32 nt, Human
cacccugaucaaaacagagaaaccccaucacu

SEQ ID NO: 347029 - RNA, 32 nt, Human
cacccugaucaaaacagagaaaccccaucucu

SEQ ID NO: 347030 - RNA, 32 nt, Human
cacccugaucaaaacauagaaaccccaucucu

SEQ ID NO: 347031 - RNA, 32 nt, Human
cacccugaugauggcccuguuggccugucagc

SEQ ID NO: 347032 - RNA, 19 nt, Human
cacccugauggccagcaga

SEQ ID NO: 347033 - RNA, 32 nt, Human
cacccugcaaagcacccuuccgaaaaucaaca

SEQ ID NO: 347034 - RNA, 32 nt, Human
cacccugcaagccugaagcuggggagcccugc

SEQ ID NO: 347035 - RNA, 32 nt, Human
cacccugcaccacuccuugucuacaagauccu

SEQ ID NO: 347036 - RNA, 32 nt, Human
cacccugcaccaggaaggaacucugcguccga

SEQ ID NO: 347037 - RNA, 32 nt, Human
cacccugcacuacccuguucuguaguuauucu

SEQ ID NO: 347038 - RNA, 32 nt, Human
cacccugcacucccucccuugccuguagaugu

SEQ ID NO: 347039 - RNA, 32 nt, Human
cacccugcagagcuauggugagguguggauaa

SEQ ID NO: 347040 - RNA, 32 nt, Human
cacccugcagcaucugcccacgaacagaugcc

SEQ ID NO: 347041 - RNA, 32 nt, Human
cacccugcagccaccagcacugccuggcucca

SEQ ID NO: 347042 - RNA, 32 nt, Human
cacccugcagccgcugccuccugggccccggg

SEQ ID NO: 347043 - RNA, 32 nt, Human
cacccugccagcugcagcagguccugggccug

SEQ ID NO: 347044 - RNA, 32 nt, Human
cacccugccaugguggcaguccugccuuacac

SEQ ID NO: 347045 - RNA, 22 nt, Human
cacccugccccaagggcaagca

SEQ ID NO: 347046 - RNA, 22 nt, Human
cacccugccccacagggaaugg

SEQ ID NO: 347047 - RNA, 22 nt, Human
cacccugccccagccugaggag

SEQ ID NO: 347048 - RNA, 24 nt, Human
cacccugcccgccucugccugcca

SEQ ID NO: 347049 - RNA, 21 nt, Human
cacccugcccggagccuggca

SEQ ID NO: 347050 - RNA, 32 nt, Human
cacccugcccuccuccccagccuggaaucggg

SEQ ID NO: 347051 - RNA, 25 nt, Human
cacccugcccugccugcaguugagg

SEQ ID NO: 347052 - RNA, 18 nt, Human
cacccugccuacaaggag

SEQ ID NO: 347053 - RNA, 19 nt, Human
cacccugccucgugggugg

SEQ ID NO: 347054 - RNA, 22 nt, Human
cacccugccugacuccaaggag

SEQ ID NO: 347055 - RNA, 17 nt, Human
cacccugccugccauca

SEQ ID NO: 347056 - RNA, 32 nt, Human
cacccugccugccuccccaacaccguggaauc

SEQ ID NO: 347057 - RNA, 20 nt, Human
cacccugccuucugaagaag

SEQ ID NO: 347058 - RNA, 21 nt, Human
cacccugccuugacaguaggu

SEQ ID NO: 347059 - RNA, 24 nt, Human
cacccugccuugucuccaggaggu

SEQ ID NO: 347060 - RNA, 18 nt, Human
cacccugccuugucuggg

SEQ ID NO: 347061 - RNA, 20 nt, Human
cacccugccuuuccacagga

SEQ ID NO: 347062 - RNA, 20 nt, Human
cacccugcuagccugccugg

SEQ ID NO: 347063 - RNA, 32 nt, Human
cacccugcucacugcuggcaucaccugagccu

SEQ ID NO: 347064 - RNA, 32 nt, Human
cacccugcugcaggaacccugggccauggcgg

SEQ ID NO: 347065 - RNA, 20 nt, Human
cacccugcuggccaaggagg

SEQ ID NO: 347066 - RNA, 32 nt, Human
cacccugcuguccaguccccagccuggcccca

SEQ ID NO: 347067 - RNA, 32 nt, Human
cacccuggaccaacagggagagcaagaaggga

SEQ ID NO: 347068 - RNA, 32 nt, Human
cacccuggacucaguguugcugggaaacaggg

SEQ ID NO: 347069 - RNA, 22 nt, Human
cacccuggagaguccaaggagg

SEQ ID NO: 347070 - RNA, 32 nt, Human
cacccuggagccaagggucuuucacaucaccu

SEQ ID NO: 347071 - RNA, 32 nt, Human
cacccuggagugagccccaggccaggaggcug

SEQ ID NO: 347072 - RNA, 32 nt, Human
cacccuggauccugaggcgccgagcuugaggg

SEQ ID NO: 347073 - RNA, 32 nt, Human
cacccuggcagcaucccaccuccugaguccuc

SEQ ID NO: 347074 - RNA, 32 nt, Human
cacccuggcagggccucaagggccaaggcugc

SEQ ID NO: 347075 - RNA, 32 nt, Human
cacccuggccaacauggcaaaaccccaucucc

SEQ ID NO: 347076 - RNA, 32 nt, Human
cacccuggccaacauggugaaaccccauaucu

SEQ ID NO: 347077 - RNA, 32 nt, Human
cacccuggccaacauggugaaaccccaucucu

SEQ ID NO: 347078 - RNA, 32 nt, Human
cacccuggccaacauggugaaaccccgucucu

SEQ ID NO: 347079 - RNA, 32 nt, Human
cacccuggccaacauggugaaaccccgucugu

SEQ ID NO: 347080 - RNA, 32 nt, Human
cacccuggccaacauggugaaacccugucucu

SEQ ID NO: 347081 - RNA, 32 nt, Human
cacccuggccaacauggugaaaccuugucucu

SEQ ID NO: 347082 - RNA, 32 nt, Human
cacccuggccaacauggugacacccugucucu

SEQ ID NO: 347083 - RNA, 32 nt, Human
cacccuggccaacaugguuaaaccccaucucu

SEQ ID NO: 347084 - RNA, 32 nt, Human
cacccuggccaaccuggugaaaccccgucucu

SEQ ID NO: 347085 - RNA, 32 nt, Human
cacccuggccaacguggugaaaccccgucucu

SEQ ID NO: 347086 - RNA, 32 nt, Human
cacccuggccaauauggugaaaccccaucucu

SEQ ID NO: 347087 - RNA, 32 nt, Human
cacccuggccagcacccagcuuagugcuggga

SEQ ID NO: 347088 - RNA, 32 nt, Human
cacccuggccagucccacuuccuggauaauuc

SEQ ID NO: 347089 - RNA, 32 nt, Human
cacccuggccuuccuuuccucuuuccuccuca

SEQ ID NO: 347090 - RNA, 32 nt, Human
cacccuggcuaacacggugaaaccccaucucu

SEQ ID NO: 347091 - RNA, 32 nt, Human
cacccuggcuaacacggugaaaccccgucucu

SEQ ID NO: 347092 - RNA, 17 nt, Human
cacccuggcugccauca

SEQ ID NO: 347093 - RNA, 32 nt, Human
cacccuggcuguggcugccuccuucauccaag

SEQ ID NO: 347094 - RNA, 32 nt, Human
cacccuggcuuccaucaugagugcagugucau

SEQ ID NO: 347095 - RNA, 32 nt, Human
cacccugggaacuguggaaaaaguaggagagg

SEQ ID NO: 347096 - RNA, 32 nt, Human
cacccugggaauuggcagcauguggaggaacu

SEQ ID NO: 347097 - RNA, 32 nt, Human
cacccugggaggccgaggcagguggaucacuu

SEQ ID NO: 347098 - RNA, 32 nt, Human
cacccugggaugucuguguaccucugucccua

SEQ ID NO: 347099 - RNA, 21 nt, Human
cacccugggcaacagagcaag

SEQ ID NO: 347100 - RNA, 32 nt, Human
cacccugggcaacauggugaaaccccuucucu

SEQ ID NO: 347101 - RNA, 32 nt, Human
cacccugggcagagagaugcagugggugcggg

SEQ ID NO: 347102 - RNA, 32 nt, Human
cacccugggcccugggcuggaaucaggaauau

SEQ ID NO: 347103 - RNA, 32 nt, Human
cacccugggccuggcccacucuuugcagggcc

SEQ ID NO: 347104 - RNA, 32 nt, Human
cacccugggcggggagggcugaggucagggag

SEQ ID NO: 347105 - RNA, 32 nt, Human
cacccugggcguggcccuggucuguggugucc

SEQ ID NO: 347106 - RNA, 32 nt, Human
cacccugggcuccacucugcagccucugugug

SEQ ID NO: 347107 - RNA, 32 nt, Human
cacccuggggcaacaugaugaaaucccaucuc

SEQ ID NO: 347108 - RNA, 32 nt, Human
cacccuggggcagaggagggugcacuggcccu

SEQ ID NO: 347109 - RNA, 32 nt, Human
cacccuggggcuaggaaauccagggugguggu

SEQ ID NO: 347110 - RNA, 32 nt, Human
cacccuggggcugagagggcccugcaggacag

SEQ ID NO: 347111 - RNA, 32 nt, Human
cacccugggugaggccuggggguuuccgaaaa

SEQ ID NO: 347112 - RNA, 18 nt, Human
cacccuggguugccacca

SEQ ID NO: 347113 - RNA, 32 nt, Human
cacccuggucuuucaggcuccaaccaucaaca

SEQ ID NO: 347114 - RNA, 32 nt, Human
cacccuguacucuccagccaccuuaccuggau

SEQ ID NO: 347115 - RNA, 19 nt, Human
cacccuguagucuuucaca

SEQ ID NO: 347116 - RNA, 32 nt, Human
cacccugucacccaggcuggaaugcaauggca

SEQ ID NO: 347117 - RNA, 32 nt, Human
cacccuguccccauuccaaggggccagcagca

SEQ ID NO: 347118 - RNA, 32 nt, Human
cacccuguccuggaaagauugggagggggcca

SEQ ID NO: 347119 - RNA, 32 nt, Human
cacccugucgcccaggcuggagugcaaugccg

SEQ ID NO: 347120 - RNA, 32 nt, Human
cacccugucuucacccagcagcuccaguuuuc

SEQ ID NO: 347121 - RNA, 32 nt, Human
cacccugugcaggaugucaaagagcagcugca

SEQ ID NO: 347122 - RNA, 32 nt, Human
cacccugugcugcugaggugcguagcugcaca

SEQ ID NO: 347123 - RNA, 20 nt, Human
cacccugugggaccuggccu

SEQ ID NO: 347124 - RNA, 32 nt, Human
cacccuguugccaggcuggaaugcaguggcgc

SEQ ID NO: 347125 - RNA, 32 nt, Human
cacccuguugcccaggcuacagugcaauggca

SEQ ID NO: 347126 - RNA, 32 nt, Human
cacccuguugcccaggcuggaauacaguggca

SEQ ID NO: 347127 - RNA, 32 nt, Human
cacccuguugcccaggcuggagugcaauggcg

SEQ ID NO: 347128 - RNA, 32 nt, Human
cacccuguugcccaggcuggagugcaauggug

SEQ ID NO: 347129 - RNA, 32 nt, Human
cacccuguuggccaggcuggagugcaguaagu

SEQ ID NO: 347130 - RNA, 32 nt, Human
cacccuguuggccaggcuggucucaaauuccu

SEQ ID NO: 347131 - RNA, 32 nt, Human
cacccuguuggccaggcuggucucgaacuccu

SEQ ID NO: 347132 - RNA, 32 nt, Human
cacccuuaucaccccucacugccuugugggaa

SEQ ID NO: 347133 - RNA, 32 nt, Human
cacccuuauguuacagacggggagacuggggc

SEQ ID NO: 347134 - RNA, 32 nt, Human
cacucauuuccccaguugguguuuccaacaaa

SEQ ID NO: 347135 - RNA, 32 nt, Human
cacucauuugauugugaaaagacuugaauucu

SEQ ID NO: 347136 - RNA, 32 nt, Human
cacucauuuuuccuggaccucagucuaucuca

SEQ ID NO: 347137 - RNA, 32 nt, Human
cacuccaacaguucuggccuccuggccuucuc

SEQ ID NO: 347138 - RNA, 32 nt, Human
cacuccaaccuaggugacagagcaagacccug

SEQ ID NO: 347139 - RNA, 32 nt, Human
cacuccaaccuggacaacagagcgagacucca

SEQ ID NO: 347140 - RNA, 32 nt, Human
cacuccaaccuggacgacagagcaagacucca

SEQ ID NO: 347141 - RNA, 32 nt, Human
cacuccaaccugggcgacagagcaagacucca

SEQ ID NO: 347142 - RNA, 32 nt, Human
cacuccaaccugggugacaagagugaaacuga

SEQ ID NO: 347143 - RNA, 22 nt, Human
cacuccaaccugggugacagag

SEQ ID NO: 347144 - RNA, 32 nt, Human
cacuccaaccugggugacagagcgaaacucca

SEQ ID NO: 347145 - RNA, 32 nt, Human
cacuccaaccugggugacagagcgagacucca

SEQ ID NO: 347146 - RNA, 32 nt, Human
cacuccaaccugggugacagagcgagacuccg

SEQ ID NO: 347147 - RNA, 32 nt, Human
cacuccaaccugggugacagagugagacccug

SEQ ID NO: 347148 - RNA, 32 nt, Human
cacuccaaccugggugacagagugagacucca

SEQ ID NO: 347149 - RNA, 32 nt, Human
cacuccaaccugggugacagagugagauucca

SEQ ID NO: 347150 - RNA, 32 nt, Human
cacuccaaccugggugacagagugagugagac

SEQ ID NO: 347151 - RNA, 32 nt, Human
cacuccaaccugggugacgagugagacuccau

SEQ ID NO: 347152 - RNA, 32 nt, Human
cacuccaaccugggugagagagcgagacccug

SEQ ID NO: 347153 - RNA, 32 nt, Human
cacuccaaccugggugauggagcaagacucca

SEQ ID NO: 347154 - RNA, 32 nt, Human
cacuccaagccagcucaagaagcaaagcaggc

SEQ ID NO: 347155 - RNA, 32 nt, Human
cacuccaagccugagcauccacacaauuccag

SEQ ID NO: 347156 - RNA, 32 nt, Human
cacuccaagccuggccccaccagugcuguuug

SEQ ID NO: 347157 - RNA, 32 nt, Human
cacuccaaggacagacacagugccucaccugu

SEQ ID NO: 347158 - RNA, 32 nt, Human
cacuccaaggaucagaaguauggaauuuucug

SEQ ID NO: 347159 - RNA, 31 nt, Human
cacuccaaguuucagcaguuuuagcgccacc

SEQ ID NO: 347160 - RNA, 32 nt, Human
cacuccaaucugggugaaagaccgagacuccg

SEQ ID NO: 347161 - RNA, 32 nt, Human
cacuccaaucugggugacagaauaagaccccg

SEQ ID NO: 347162 - RNA, 32 nt, Human
cacuccacaaaaacauuuaauuuauggauccu

SEQ ID NO: 347163 - RNA, 32 nt, Human
cacuccacacacacccuuccaaccuccuccac

SEQ ID NO: 347164 - RNA, 22 nt, Human
cacuccacacucuugagucucu

SEQ ID NO: 347165 - RNA, 32 nt, Human
cacuccacaggcucuuuggcacagcagggcuc

SEQ ID NO: 347166 - RNA, 32 nt, Human
cacuccacccaccaguuccucagucagguacu

SEQ ID NO: 347167 - RNA, 17 nt, Human
cacuccacccccuucca

SEQ ID NO: 347168 - RNA, 32 nt, Human
cacuccacccugggcgacagagcaagauucua

SEQ ID NO: 347169 - RNA, 32 nt, Human
cacuccacccugggugacagagugaagacucc

SEQ ID NO: 347170 - RNA, 20 nt, Human
cacuccacuaagcaacuggc

SEQ ID NO: 347171 - RNA, 32 nt, Human
cacuccacuacccggguauacuccaacucaga

SEQ ID NO: 347172 - RNA, 21 nt, Human
cacuccacuccagccugggca

SEQ ID NO: 347173 - RNA, 32 nt, Human
cacuccacuccccucguucugucacuuugaac

SEQ ID NO: 347174 - RNA, 18 nt, Human
cacuccacucugcuucca

SEQ ID NO: 347175 - RNA, 32 nt, Human
cacuccacugcacccaguguggccguacaccu

SEQ ID NO: 347176 - RNA, 32 nt, Human
cacuccacugcacuccagccugggcaacagag

SEQ ID NO: 347177 - RNA, 32 nt, Human
cacuccacugcacuccagccugggcgacagaa

SEQ ID NO: 347178 - RNA, 32 nt, Human
cacuccacugcacuccagccugggugacagac

SEQ ID NO: 347179 - RNA, 21 nt, Human
cacuccagaaacacccugaca

SEQ ID NO: 347180 - RNA, 21 nt, Human
cacuccagaaauguuuguuga

SEQ ID NO: 347181 - RNA, 32 nt, Human
cacuccagacaccaggauaaacuccugauggg

SEQ ID NO: 347182 - RNA, 21 nt, Human
cacuccagacgucagccggca

SEQ ID NO: 347183 - RNA, 32 nt, Human
cacuccagacugggugacacagcgagacuuca

SEQ ID NO: 347184 - RNA, 32 nt, Human
cacuccagacugguguggccacccuugucuuc

SEQ ID NO: 347185 - RNA, 32 nt, Human
cacuccagacuuggugacagagcaagacucca

SEQ ID NO: 347186 - RNA, 32 nt, Human
cacuccagaggaagaaucaaugccgugggugg

SEQ ID NO: 347187 - RNA, 32 nt, Human
cacuccagcacuccagccugggugacagagca

SEQ ID NO: 347188 - RNA, 32 nt, Human
cacuccagcaugcaugacagagugagacccug

SEQ ID NO: 347189 - RNA, 32 nt, Human
cacuccagcaugggugacagagugagauccug

SEQ ID NO: 347190 - RNA, 23 nt, Human
cacuccagccaaagcaacaagag

SEQ ID NO: 347191 - RNA, 32 nt, Human
cacuccagccaaggacaaaaugcucacaggag

SEQ ID NO: 347192 - RNA, 32 nt, Human
cacuccagccacuaaagccagaaaguugaaag

SEQ ID NO: 347193 - RNA, 32 nt, Human
cacuccagccagagugacagagcaagacucca

SEQ ID NO: 347194 - RNA, 21 nt, Human
cacuccagcccacuuucugcc

SEQ ID NO: 347195 - RNA, 32 nt, Human
cacuccagcccaggcgagagagcgagagucug

SEQ ID NO: 347196 - RNA, 29 nt, Human
cacuccagcccaggcggcagugagagacu

SEQ ID NO: 347197 - RNA, 32 nt, Human
cacuccagcccaggugacagagcaagacucca

SEQ ID NO: 347198 - RNA, 32 nt, Human
cacuccagcccaggugacagagcgagacucca

SEQ ID NO: 347199 - RNA, 32 nt, Human
cacuccagcccaggugacagagggagacucuc

SEQ ID NO: 347200 - RNA, 32 nt, Human
cacuccagcccaggugacagagugagacucug

SEQ ID NO: 347201 - RNA, 32 nt, Human
cacuccagcccaggugacagugugagacucca

SEQ ID NO: 347202 - RNA, 32 nt, Human
cacuccagccccggcucaguucagggaaaugc

SEQ ID NO: 347203 - RNA, 32 nt, Human
cacuccagcccgagugacagaaugaggcugua

SEQ ID NO: 347204 - RNA, 32 nt, Human
cacuccagcccggaugacagagcaagacucug

SEQ ID NO: 347205 - RNA, 22 nt, Human
cacuccagcccgggcgacagag

SEQ ID NO: 347206 - RNA, 32 nt, Human
cacuccagcccgggcgacagagcaagacucug

SEQ ID NO: 347207 - RNA, 32 nt, Human
cacuccagcccgggcgacagagcgagacucca

SEQ ID NO: 347208 - RNA, 32 nt, Human
cacuccagcccgggcgacagagcgagacucug

SEQ ID NO: 347209 - RNA, 32 nt, Human
cacuccagcccgggugacagagcaagacuccg

SEQ ID NO: 347210 - RNA, 32 nt, Human
cacuccagcccgggugacagagcgagacucua

SEQ ID NO: 347211 - RNA, 32 nt, Human
cacuccagcccgggugacagagcgagacucug

SEQ ID NO: 347212 - RNA, 32 nt, Human
cacuccagccggggugacagaagagaccuugu

SEQ ID NO: 347213 - RNA, 32 nt, Human
cacuccagccggggugacagagugagacuccg

SEQ ID NO: 347214 - RNA, 32 nt, Human
cacuccagccuagacgacagagcaagacuaug

SEQ ID NO: 347215 - RNA, 32 nt, Human
cacuccagccuaggcaaaaagagcaagacucc

SEQ ID NO: 347216 - RNA, 22 nt, Human
cacuccagccuaggcaacagag

SEQ ID NO: 347217 - RNA, 22 nt, Human
cacuccagccuaggcgacagag

SEQ ID NO: 347218 - RNA, 32 nt, Human
cacuccagccuaggcgacagagcgagacucug

SEQ ID NO: 347219 - RNA, 32 nt, Human
cacuccagccuaggugacagagcaagacucug

SEQ ID NO: 347220 - RNA, 32 nt, Human
cacuccagccuaggugacagagggagacucug

SEQ ID NO: 347221 - RNA, 32 nt, Human
cacuccagccuaggugacagagugagacccug

SEQ ID NO: 347222 - RNA, 32 nt, Human
cacuccagccuaggugacagagugagacucca

SEQ ID NO: 347223 - RNA, 32 nt, Human
cacuccagccuaggugacagagugagacuccg

SEQ ID NO: 347224 - RNA, 32 nt, Human
cacuccagccuaggugacagggcaagaaccug

SEQ ID NO: 347225 - RNA, 32 nt, Human
cacuccagccucggugacagagcaagacucca

SEQ ID NO: 347226 - RNA, 32 nt, Human
cacuccagccucggugacagagcaagacuguu

SEQ ID NO: 347227 - RNA, 22 nt, Human
cacuccagccugagagacagaa

SEQ ID NO: 347228 - RNA, 22 nt, Human
cacuccagccugagcaacagag

SEQ ID NO: 347229 - RNA, 32 nt, Human
cacuccagccugagcaacagagcgagacccug

SEQ ID NO: 347230 - RNA, 32 nt, Human
cacuccagccugagcacagagcaagacucuua

SEQ ID NO: 347231 - RNA, 22 nt, Human
cacuccagccugagcagcagag

SEQ ID NO: 347232 - RNA, 22 nt, Human
cacuccagccugagcgacagag

SEQ ID NO: 347233 - RNA, 32 nt, Human
cacuccagccugagcgacagagcaagacuccg

SEQ ID NO: 347234 - RNA, 32 nt, Human
cacuccagccugagcgacagagcgagacucug

SEQ ID NO: 347235 - RNA, 32 nt, Human
cacuccagccugagugacagaaugagaccuug

SEQ ID NO: 347236 - RNA, 32 nt, Human
cacuccagccugagugacagagagagauucaa

SEQ ID NO: 347237 - RNA, 32 nt, Human
cacuccagccugagugacagagcgagacccug

SEQ ID NO: 347238 - RNA, 32 nt, Human
cacuccagccugagugacagagcgagacucca

SEQ ID NO: 347239 - RNA, 32 nt, Human
cacuccagccugagugacagagcgagacucua

SEQ ID NO: 347240 - RNA, 32 nt, Human
cacuccagccugagugacagagcgagacucug

SEQ ID NO: 347241 - RNA, 32 nt, Human
cacuccagccugagugacagagugagacccug

SEQ ID NO: 347242 - RNA, 32 nt, Human
cacuccagccuggaaaacggagugagaguguc

SEQ ID NO: 347243 - RNA, 32 nt, Human
cacuccagccuggaagaccaaacgagacucug

SEQ ID NO: 347244 - RNA, 32 nt, Human
cacuccagccuggaaggcagagagagacuccg

SEQ ID NO: 347245 - RNA, 32 nt, Human
cacuccagccuggacaacaagagcaagacucc

SEQ ID NO: 347246 - RNA, 22 nt, Human
cacuccagccuggacaacagaa

SEQ ID NO: 347247 - RNA, 32 nt, Human
cacuccagccuggacaacagaaagagaccuug

SEQ ID NO: 347248 - RNA, 32 nt, Human
cacuccagccuggacaacagagcaagaccuuc

SEQ ID NO: 347249 - RNA, 32 nt, Human
cacuccagccuggacaacagagcaagacuccu

SEQ ID NO: 347250 - RNA, 32 nt, Human
cacuccagccuggacaacagagcgagacucca

SEQ ID NO: 347251 - RNA, 32 nt, Human
cacuccagccuggacaacagagcuagacucca

SEQ ID NO: 347252 - RNA, 32 nt, Human
cacuccagccuggacaacagagggagacucug

SEQ ID NO: 347253 - RNA, 32 nt, Human
cacuccagccuggacaacagagugagaaccug

SEQ ID NO: 347254 - RNA, 32 nt, Human
cacuccagccuggacaacagagugagacucgu

SEQ ID NO: 347255 - RNA, 32 nt, Human
cacuccagccuggacaacagagugggacucug

SEQ ID NO: 347256 - RNA, 32 nt, Human
cacuccagccuggacaacggagugagacucug

SEQ ID NO: 347257 - RNA, 32 nt, Human
cacuccagccuggacgacagagcaagacucag

SEQ ID NO: 347258 - RNA, 32 nt, Human
cacuccagccuggacgacagagcgagacucca

SEQ ID NO: 347259 - RNA, 32 nt, Human
cacuccagccuggacgacagagcgagacuccg

SEQ ID NO: 347260 - RNA, 32 nt, Human
cacuccagccuggacgacagagugagacgucc

SEQ ID NO: 347261 - RNA, 32 nt, Human
cacuccagccuggacgacagagugagauucug

SEQ ID NO: 347262 - RNA, 32 nt, Human
cacuccagccuggaggacagagcgagacucua

SEQ ID NO: 347263 - RNA, 32 nt, Human
cacuccagccuggaggccagagugagacuccg

SEQ ID NO: 347264 - RNA, 32 nt, Human
cacuccagccuggauaaaagagcaagacucca

SEQ ID NO: 347265 - RNA, 22 nt, Human
cacuccagccuggauaacagag

SEQ ID NO: 347266 - RNA, 32 nt, Human
cacuccagccuggauaacagagcgagacccug

SEQ ID NO: 347267 - RNA, 32 nt, Human
cacuccagccuggaugacaaagcaggacucug

SEQ ID NO: 347268 - RNA, 32 nt, Human
cacuccagccuggaugacaagagugaaacucc

SEQ ID NO: 347269 - RNA, 32 nt, Human
cacuccagccuggaugacagaacaagaaccug

SEQ ID NO: 347270 - RNA, 32 nt, Human
cacuccagccuggaugacagaacaagaaucug

SEQ ID NO: 347271 - RNA, 22 nt, Human
cacuccagccuggaugacagag

SEQ ID NO: 347272 - RNA, 32 nt, Human
cacuccagccuggaugacagagcaagacucug

SEQ ID NO: 347273 - RNA, 32 nt, Human
cacuccagccuggaugacagagcgagacuccg

SEQ ID NO: 347274 - RNA, 32 nt, Human
cacuccagccuggaugacagagugaaacccug

SEQ ID NO: 347275 - RNA, 32 nt, Human
cacuccagccuggaugacagagugagaccuug

SEQ ID NO: 347276 - RNA, 32 nt, Human
cacuccagccuggaugacagagugagacucca

SEQ ID NO: 347277 - RNA, 32 nt, Human
cacuccagccuggaugacagagugagacuccg

SEQ ID NO: 347278 - RNA, 32 nt, Human
cacuccagccuggaugacagagugagacuuca

SEQ ID NO: 347279 - RNA, 32 nt, Human
cacuccagccuggaugacagcgagacuccauc

SEQ ID NO: 347280 - RNA, 32 nt, Human
cacuccagccuggaugauagagcaagacccug

SEQ ID NO: 347281 - RNA, 32 nt, Human
cacuccagccuggaugauagagugagacugua

SEQ ID NO: 347282 - RNA, 32 nt, Human
cacuccagccuggcaacagagcaagacuccgu

SEQ ID NO: 347283 - RNA, 32 nt, Human
cacuccagccuggcaacagagcaaggcuccgu

SEQ ID NO: 347284 - RNA, 32 nt, Human
cacuccagccuggcaacagagcgagacuccau

SEQ ID NO: 347285 - RNA, 32 nt, Human
cacuccagccuggcaacagagugagacucugu

SEQ ID NO: 347286 - RNA, 21 nt, Human
cacuccagccuggccacagag

SEQ ID NO: 347287 - RNA, 32 nt, Human
cacuccagccuggccacagagcgagacucaga

SEQ ID NO: 347288 - RNA, 32 nt, Human
cacuccagccuggccacagagcgagacuccau

SEQ ID NO: 347289 - RNA, 32 nt, Human
cacuccagccuggccgacagagcaagauucug

SEQ ID NO: 347290 - RNA, 32 nt, Human
cacuccagccuggccugggcaacagagcaaga

SEQ ID NO: 347291 - RNA, 32 nt, Human
cacuccagccuggcgacaaagcgagacuccgu

SEQ ID NO: 347292 - RNA, 32 nt, Human
cacuccagccuggcgacaaagugagacuccgu

SEQ ID NO: 347293 - RNA, 32 nt, Human
cacuccagccuggcgacaagagcgagacuccg

SEQ ID NO: 347294 - RNA, 32 nt, Human
cacuccagccuggcgacaagagugagacucca

SEQ ID NO: 347295 - RNA, 32 nt, Human
cacuccagccuggcgacacagugagacucugu

SEQ ID NO: 347296 - RNA, 21 nt, Human
cacuccagccuggcgacagag

SEQ ID NO: 347297 - RNA, 32 nt, Human
cacuccagccuggcgacagagagagacuccau

SEQ ID NO: 347298 - RNA, 32 nt, Human
cacuccagccuggcgacagagcaagacuccau

SEQ ID NO: 347299 - RNA, 32 nt, Human
cacuccagccuggcgacagagcaagacucugu

SEQ ID NO: 347300 - RNA, 32 nt, Human
cacuccagccuggcgacagagcaagacuucgu

SEQ ID NO: 347301 - RNA, 32 nt, Human
cacuccagccuggcgacagagcgagacaccgu

SEQ ID NO: 347302 - RNA, 32 nt, Human
cacuccagccuggcgacagagcgagacucccu

SEQ ID NO: 347303 - RNA, 32 nt, Human
cacuccagccuggcgacagagcgagacuccgu

SEQ ID NO: 347304 - RNA, 32 nt, Human
cacuccagccuggcgacagagcgagacucguc

SEQ ID NO: 347305 - RNA, 32 nt, Human
cacuccagccuggcgacagagcgagacucugu

SEQ ID NO: 347306 - RNA, 32 nt, Human
cacuccagccuggcgacagagcgagacuuggu

SEQ ID NO: 347307 - RNA, 32 nt, Human
cacuccagccuggcgacagagugagacuccuu

SEQ ID NO: 347308 - RNA, 32 nt, Human
cacuccagccuggcgacagagugagacucugu

SEQ ID NO: 347309 - RNA, 32 nt, Human
cacuccagccuggcgaccgagcgggacuccgu

SEQ ID NO: 347310 - RNA, 32 nt, Human
cacuccagccuggcgacugagugagacuccau

SEQ ID NO: 347311 - RNA, 32 nt, Human
cacuccagccuggcuacagagugagauuccau

SEQ ID NO: 347312 - RNA, 32 nt, Human
cacuccagccuggcugacagagcgagacuguc

SEQ ID NO: 347313 - RNA, 32 nt, Human
cacuccagccuggcugacagagugagaaucug

SEQ ID NO: 347314 - RNA, 32 nt, Human
cacuccagccuggcugacagugagacacucca

SEQ ID NO: 347315 - RNA, 32 nt, Human
cacuccagccuggcugacagugcaagacucug

SEQ ID NO: 347316 - RNA, 22 nt, Human
cacuccagccugggaaacagag

SEQ ID NO: 347317 - RNA, 32 nt, Human
cacuccagccugggaaacagagugaggcucug

SEQ ID NO: 347318 - RNA, 32 nt, Human
cacuccagccugggaaauagagugagcaagac

SEQ ID NO: 347319 - RNA, 32 nt, Human
cacuccagccugggaagcagagugagacccug

SEQ ID NO: 347320 - RNA, 32 nt, Human
cacuccagccugggagacacagcgagacucug

SEQ ID NO: 347321 - RNA, 22 nt, Human
cacuccagccugggagacagag

SEQ ID NO: 347322 - RNA, 32 nt, Human
cacuccagccugggagacagagcaagacucag

SEQ ID NO: 347323 - RNA, 32 nt, Human
cacuccagccugggagacagagcaagacucca

SEQ ID NO: 347324 - RNA, 32 nt, Human
cacuccagccugggagacagagcaagacuccg

SEQ ID NO: 347325 - RNA, 32 nt, Human
cacuccagccugggagacagagcaagacucug

SEQ ID NO: 347326 - RNA, 32 nt, Human
cacuccagccugggagacagagccagacucca

SEQ ID NO: 347327 - RNA, 32 nt, Human
cacuccagccugggagacagagcgagacgcug

SEQ ID NO: 347328 - RNA, 32 nt, Human
cacuccagccugggagacagagcgagacucca

SEQ ID NO: 347329 - RNA, 32 nt, Human
cacuccagccugggagacagagcgagacuccg

SEQ ID NO: 347330 - RNA, 32 nt, Human
cacuccagccugggagacagagcgagacucug

SEQ ID NO: 347331 - RNA, 32 nt, Human
cacuccagccugggagacagagcgagacucuu

SEQ ID NO: 347332 - RNA, 32 nt, Human
cacuccagccugggagacagagugagacuccg

SEQ ID NO: 347333 - RNA, 32 nt, Human
cacuccagccugggagacagagugagacucug

SEQ ID NO: 347334 - RNA, 32 nt, Human
cacuccagccugggagacagagugagauacua

SEQ ID NO: 347335 - RNA, 32 nt, Human
cacuccagccugggagacagaguuagacuccg

SEQ ID NO: 347336 - RNA, 32 nt, Human
cacuccagccugggagauacagcgagacuguc

SEQ ID NO: 347337 - RNA, 32 nt, Human
cacuccagccugggcaaaaagagccagacucc

SEQ ID NO: 347338 - RNA, 32 nt, Human
cacuccagccugggcaaaaagagugagacucu

SEQ ID NO: 347339 - RNA, 32 nt, Human
cacuccagccugggcaaaagagugagacuccg

SEQ ID NO: 347340 - RNA, 32 nt, Human
cacuccagccugggcaacaaaacgagacuucg

SEQ ID NO: 347341 - RNA, 32 nt, Human
cacuccagccugggcaacaaagcaagacccug

SEQ ID NO: 347342 - RNA, 32 nt, Human
cacuccagccugggcaacaaagcgagacucca

SEQ ID NO: 347343 - RNA, 32 nt, Human
cacuccagccugggcaacaaagcuagacucca

SEQ ID NO: 347344 - RNA, 32 nt, Human
cacuccagccugggcaacaaagugagacucgg

SEQ ID NO: 347345 - RNA, 32 nt, Human
cacuccagccugggcaacaaagugagacucug

SEQ ID NO: 347346 - RNA, 32 nt, Human
cacuccagccugggcaacaaagugggacucug

SEQ ID NO: 347347 - RNA, 23 nt, Human
cacuccagccugggcaacaagag

SEQ ID NO: 347348 - RNA, 32 nt, Human
cacuccagccugggcaacaagagaagaaacuc

SEQ ID NO: 347349 - RNA, 32 nt, Human
cacuccagccugggcaacaagagagaaacucc

SEQ ID NO: 347350 - RNA, 32 nt, Human
cacuccagccugggcaacaagagagaaacucu

SEQ ID NO: 347351 - RNA, 32 nt, Human
cacuccagccugggcaacaagagagaaggucc

SEQ ID NO: 347352 - RNA, 32 nt, Human
cacuccagccugggcaacaagagcgaaacucc

SEQ ID NO: 347353 - RNA, 32 nt, Human
cacuccagccugggcaacaagagcgaaacucu

SEQ ID NO: 347354 - RNA, 32 nt, Human
cacuccagccugggcaacaagagcgagacugu

SEQ ID NO: 347355 - RNA, 32 nt, Human
cacuccagccugggcaacaagagcgaggcucc

SEQ ID NO: 347356 - RNA, 32 nt, Human
cacuccagccugggcaacaagaguaagacucu

SEQ ID NO: 347357 - RNA, 32 nt, Human
cacuccagccugggcaacaagagugagacucc

SEQ ID NO: 347358 - RNA, 32 nt, Human
cacuccagccugggcaacaagcgagacuccgu

SEQ ID NO: 347359 - RNA, 32 nt, Human
cacuccagccugggcaacaaugcgagauugca

SEQ ID NO: 347360 - RNA, 32 nt, Human
cacuccagccugggcaacacagagagacccug

SEQ ID NO: 347361 - RNA, 32 nt, Human
cacuccagccugggcaacacagcaagacccua

SEQ ID NO: 347362 - RNA, 32 nt, Human
cacuccagccugggcaacacagcaagacucug

SEQ ID NO: 347363 - RNA, 32 nt, Human
cacuccagccugggcaacacagcaagauccug

SEQ ID NO: 347364 - RNA, 32 nt, Human
cacuccagccugggcaacacagcgagacuccg

SEQ ID NO: 347365 - RNA, 32 nt, Human
cacuccagccugggcaacacagggagacucca

SEQ ID NO: 347366 - RNA, 32 nt, Human
cacuccagccugggcaacacagugagacucug

SEQ ID NO: 347367 - RNA, 22 nt, Human
cacuccagccugggcaacagaa

SEQ ID NO: 347368 - RNA, 32 nt, Human
cacuccagccugggcaacagaacaagaaccca

SEQ ID NO: 347369 - RNA, 32 nt, Human
cacuccagccugggcaacagaacaagacuccg

SEQ ID NO: 347370 - RNA, 32 nt, Human
cacuccagccugggcaacagaacaagauucug

SEQ ID NO: 347371 - RNA, 32 nt, Human
cacuccagccugggcaacagaacgagauucug

SEQ ID NO: 347372 - RNA, 32 nt, Human
cacuccagccugggcaacagaagaagacuuug

SEQ ID NO: 347373 - RNA, 32 nt, Human
cacuccagccugggcaacagaaugagacccuu

SEQ ID NO: 347374 - RNA, 32 nt, Human
cacuccagccugggcaacagacagagugagac

SEQ ID NO: 347375 - RNA, 22 nt, Human
cacuccagccugggcaacagag

SEQ ID NO: 347376 - RNA, 32 nt, Human
cacuccagccugggcaacagagagagacaguc

SEQ ID NO: 347377 - RNA, 32 nt, Human
cacuccagccugggcaacagagagagaccuug

SEQ ID NO: 347378 - RNA, 32 nt, Human
cacuccagccugggcaacagagagcgacucuc

SEQ ID NO: 347379 - RNA, 32 nt, Human
cacuccagccugggcaacagagcaagacccca

SEQ ID NO: 347380 - RNA, 32 nt, Human
cacuccagccugggcaacagagcaagaccuug

SEQ ID NO: 347381 - RNA, 32 nt, Human
cacuccagccugggcaacagagcaagacucca

SEQ ID NO: 347382 - RNA, 32 nt, Human
cacuccagccugggcaacagagcaagacuccg

SEQ ID NO: 347383 - RNA, 32 nt, Human
cacuccagccugggcaacagagcaagacucgg

SEQ ID NO: 347384 - RNA, 32 nt, Human
cacuccagccugggcaacagagcaagacucug

SEQ ID NO: 347385 - RNA, 32 nt, Human
cacuccagccugggcaacagagcaagacugcc

SEQ ID NO: 347386 - RNA, 32 nt, Human
cacuccagccugggcaacagagcaagacuguc

SEQ ID NO: 347387 - RNA, 32 nt, Human
cacuccagccugggcaacagagcaagaguccg

SEQ ID NO: 347388 - RNA, 32 nt, Human
cacuccagccugggcaacagagcaagauccug

SEQ ID NO: 347389 - RNA, 32 nt, Human
cacuccagccugggcaacagagcaaggcucug

SEQ ID NO: 347390 - RNA, 32 nt, Human
cacuccagccugggcaacagagcaaggcuguc

SEQ ID NO: 347391 - RNA, 32 nt, Human
cacuccagccugggcaacagagccagacuccg

SEQ ID NO: 347392 - RNA, 32 nt, Human
cacuccagccugggcaacagagccagacucug

SEQ ID NO: 347393 - RNA, 32 nt, Human
cacuccagccugggcaacagagccaggcccug

SEQ ID NO: 347394 - RNA, 32 nt, Human
cacuccagccugggcaacagagcgacacuccg

SEQ ID NO: 347395 - RNA, 32 nt, Human
cacuccagccugggcaacagagcgagacaguc

SEQ ID NO: 347396 - RNA, 32 nt, Human
cacuccagccugggcaacagagcgagaccauc

SEQ ID NO: 347397 - RNA, 32 nt, Human
cacuccagccugggcaacagagcgagacccug

SEQ ID NO: 347398 - RNA, 32 nt, Human
cacuccagccugggcaacagagcgagaccucu

SEQ ID NO: 347399 - RNA, 32 nt, Human
cacuccagccugggcaacagagcgagacuaca

SEQ ID NO: 347400 - RNA, 32 nt, Human
cacuccagccugggcaacagagcgagacucag

SEQ ID NO: 347401 - RNA, 32 nt, Human
cacuccagccugggcaacagagcgagacucca

SEQ ID NO: 347402 - RNA, 32 nt, Human
cacuccagccugggcaacagagcgagacuccg

SEQ ID NO: 347403 - RNA, 32 nt, Human
cacuccagccugggcaacagagcgagacuuca

SEQ ID NO: 347404 - RNA, 32 nt, Human
cacuccagccugggcaacagagcgagacuuug

SEQ ID NO: 347405 - RNA, 32 nt, Human
cacuccagccugggcaacagagcgagagucug

SEQ ID NO: 347406 - RNA, 32 nt, Human
cacuccagccugggcaacagagcgaggcucug

SEQ ID NO: 347407 - RNA, 32 nt, Human
cacuccagccugggcaacagagcgcgacugug

SEQ ID NO: 347408 - RNA, 32 nt, Human
cacuccagccugggcaacagagcgugacucuc

SEQ ID NO: 347409 - RNA, 32 nt, Human
cacuccagccugggcaacagagcuagacucug

SEQ ID NO: 347410 - RNA, 32 nt, Human
cacuccagccugggcaacagagggagacucca

SEQ ID NO: 347411 - RNA, 32 nt, Human
cacuccagccugggcaacagagggagacucug

SEQ ID NO: 347412 - RNA, 32 nt, Human
cacuccagccugggcaacagagggagcccccg

SEQ ID NO: 347413 - RNA, 32 nt, Human
cacuccagccugggcaacagaguaagaacugu

SEQ ID NO: 347414 - RNA, 32 nt, Human
cacuccagccugggcaacagaguaagacucca

SEQ ID NO: 347415 - RNA, 32 nt, Human
cacuccagccugggcaacagaguaagacuccg

SEQ ID NO: 347416 - RNA, 32 nt, Human
cacuccagccugggcaacagaguaagacucug

SEQ ID NO: 347417 - RNA, 32 nt, Human
cacuccagccugggcaacagaguaagauucca

SEQ ID NO: 347418 - RNA, 32 nt, Human
cacuccagccugggcaacagagugaaacucug

SEQ ID NO: 347419 - RNA, 32 nt, Human
cacuccagccugggcaacagagugacacucug

SEQ ID NO: 347420 - RNA, 32 nt, Human
cacuccagccugggcaacagagugagacccua

SEQ ID NO: 347421 - RNA, 32 nt, Human
cacuccagccugggcaacagagugagacccug

SEQ ID NO: 347422 - RNA, 32 nt, Human
cacuccagccugggcaacagagugagacgcug

SEQ ID NO: 347423 - RNA, 32 nt, Human
cacuccagccugggcaacagagugagacuauc

SEQ ID NO: 347424 - RNA, 32 nt, Human
cacuccagccugggcaacagagugagacucca

SEQ ID NO: 347425 - RNA, 32 nt, Human
cacuccagccugggcaacagagugagacuccc

SEQ ID NO: 347426 - RNA, 32 nt, Human
cacuccagccugggcaacagagugagacuccg

SEQ ID NO: 347427 - RNA, 32 nt, Human
cacuccagccugggcaacagagugagacucua

SEQ ID NO: 347428 - RNA, 32 nt, Human
cacuccagccugggcaacagagugagacucug

SEQ ID NO: 347429 - RNA, 32 nt, Human
cacuccagccugggcaacagagugagacugug

SEQ ID NO: 347430 - RNA, 32 nt, Human
cacuccagccugggcaacagagugagacuucg

SEQ ID NO: 347431 - RNA, 32 nt, Human
cacuccagccugggcaacagagugagauccag

SEQ ID NO: 347432 - RNA, 32 nt, Human
cacuccagccugggcaacagagugaggcccuu

SEQ ID NO: 347433 - RNA, 32 nt, Human
cacuccagccugggcaacagaguggacuccau

SEQ ID NO: 347434 - RNA, 32 nt, Human
cacuccagccugggcaacagagugggacucca

SEQ ID NO: 347435 - RNA, 32 nt, Human
cacuccagccugggcaacagaugaagacccua

SEQ ID NO: 347436 - RNA, 32 nt, Human
cacuccagccugggcaacagcagcgaaacucc

SEQ ID NO: 347437 - RNA, 32 nt, Human
cacuccagccugggcaacagcguaagacccug

SEQ ID NO: 347438 - RNA, 32 nt, Human
cacuccagccugggcaacagggcaagauuccg

SEQ ID NO: 347439 - RNA, 32 nt, Human
cacuccagccugggcaacagguaagacucugu

SEQ ID NO: 347440 - RNA, 32 nt, Human
cacuccagccugggcaacagugagacucugca

SEQ ID NO: 347441 - RNA, 32 nt, Human
cacuccagccugggcaacagugugagaccuug

SEQ ID NO: 347442 - RNA, 32 nt, Human
cacuccagccugggcaacaguguuaagacucu

SEQ ID NO: 347443 - RNA, 32 nt, Human
cacuccagccugggcaacauagcaagacucca

SEQ ID NO: 347444 - RNA, 32 nt, Human
cacuccagccugggcaacauagcgagaccuca

SEQ ID NO: 347445 - RNA, 32 nt, Human
cacuccagccugggcaacauagugagacccca

SEQ ID NO: 347446 - RNA, 32 nt, Human
cacuccagccugggcaaccaggugagacccug

SEQ ID NO: 347447 - RNA, 32 nt, Human
cacuccagccugggcaacgagagggaaacucu

SEQ ID NO: 347448 - RNA, 32 nt, Human
cacuccagccugggcaacgagaggggaacucc

SEQ ID NO: 347449 - RNA, 22 nt, Human
cacuccagccugggcaacggag

SEQ ID NO: 347450 - RNA, 32 nt, Human
cacuccagccugggcaacggagcaagacccug

SEQ ID NO: 347451 - RNA, 32 nt, Human
cacuccagccugggcaacggauugagacucug

SEQ ID NO: 347452 - RNA, 32 nt, Human
cacuccagccugggcaacguggugagacccug

SEQ ID NO: 347453 - RNA, 32 nt, Human
cacuccagccugggcaacugagcaagacuguc

SEQ ID NO: 347454 - RNA, 32 nt, Human
cacuccagccugggcaacugagcaagauucca

SEQ ID NO: 347455 - RNA, 32 nt, Human
cacuccagccugggcaagagaaugacacucug

SEQ ID NO: 347456 - RNA, 32 nt, Human
cacuccagccugggcaauagagcaagacucca

SEQ ID NO: 347457 - RNA, 32 nt, Human
cacuccagccugggcaauagagcaagacugca

SEQ ID NO: 347458 - RNA, 32 nt, Human
cacuccagccugggcaauagaguaagacccug

SEQ ID NO: 347459 - RNA, 32 nt, Human
cacuccagccugggcaauagagugagacuccg

SEQ ID NO: 347460 - RNA, 32 nt, Human
cacuccagccugggcaauagagugagacucug

SEQ ID NO: 347461 - RNA, 32 nt, Human
cacuccagccugggcaauagagugagauuccg

SEQ ID NO: 347462 - RNA, 32 nt, Human
cacuccagccugggcaauagagugagcccuga

SEQ ID NO: 347463 - RNA, 32 nt, Human
cacuccagccugggcaauagggcaagagucca

SEQ ID NO: 347464 - RNA, 32 nt, Human
cacuccagccugggcaauauagcaagacccca

SEQ ID NO: 347465 - RNA, 32 nt, Human
cacuccagccugggcaauggagagaggcucug

SEQ ID NO: 347466 - RNA, 32 nt, Human
cacuccagccugggcaauggagugagacuccu

SEQ ID NO: 347467 - RNA, 32 nt, Human
cacuccagccugggcaccaaugugagaaccug

SEQ ID NO: 347468 - RNA, 32 nt, Human
cacuccagccugggcaccacagcaagacuccg

SEQ ID NO: 347469 - RNA, 32 nt, Human
cacuccagccugggcaccagagcgagacuccg

SEQ ID NO: 347470 - RNA, 23 nt, Human
cacuccagccugggcaccaggaa

SEQ ID NO: 347471 - RNA, 32 nt, Human
cacuccagccugggcagcagagcgagacuccg

SEQ ID NO: 347472 - RNA, 32 nt, Human
cacuccagccugggcagcagagcgagacucug

SEQ ID NO: 347473 - RNA, 32 nt, Human
cacuccagccugggcagcagaggaagaucuug

SEQ ID NO: 347474 - RNA, 32 nt, Human
cacuccagccugggcagcagagugagacucuc

SEQ ID NO: 347475 - RNA, 32 nt, Human
cacuccagccugggcagcagagugagacuuug

SEQ ID NO: 347476 - RNA, 32 nt, Human
cacuccagccugggccacacagugagacuccg

SEQ ID NO: 347477 - RNA, 32 nt, Human
cacuccagccugggccacagaacgagacuuca

SEQ ID NO: 347478 - RNA, 32 nt, Human
cacuccagccugggccacagaaugagacucca

SEQ ID NO: 347479 - RNA, 32 nt, Human
cacuccagccugggccacagagcaagacuccg

SEQ ID NO: 347480 - RNA, 32 nt, Human
cacuccagccugggccacagagugagauucca

SEQ ID NO: 347481 - RNA, 32 nt, Human
cacuccagccugggccagaaugagacuccguc

SEQ ID NO: 347482 - RNA, 32 nt, Human
cacuccagccugggcgaaagagcgacucuguc

SEQ ID NO: 347483 - RNA, 32 nt, Human
cacuccagccugggcgaaagggcaagacucca

SEQ ID NO: 347484 - RNA, 32 nt, Human
cacuccagccugggcgaaagggugagacucca

SEQ ID NO: 347485 - RNA, 20 nt, Human
cacuccagccugggcgacaa

SEQ ID NO: 347486 - RNA, 32 nt, Human
cacuccagccugggcgacaaagcaagacuccg

SEQ ID NO: 347487 - RNA, 32 nt, Human
cacuccagccugggcgacaaagugagacucug

SEQ ID NO: 347488 - RNA, 32 nt, Human
cacuccagccugggcgacaagagcaagacucu

SEQ ID NO: 347489 - RNA, 32 nt, Human
cacuccagccugggcgacaagagcagaacucu

SEQ ID NO: 347490 - RNA, 32 nt, Human
cacuccagccugggcgacaagagcgaaacucu

SEQ ID NO: 347491 - RNA, 32 nt, Human
cacuccagccugggcgacaagagcgagacucu

SEQ ID NO: 347492 - RNA, 32 nt, Human
cacuccagccugggcgacaagagugaaacucc

SEQ ID NO: 347493 - RNA, 32 nt, Human
cacuccagccugggcgacaagagugaaacucg

SEQ ID NO: 347494 - RNA, 32 nt, Human
cacuccagccugggcgacaagagugaaacucu

SEQ ID NO: 347495 - RNA, 32 nt, Human
cacuccagccugggcgacaagagugaaauucc

SEQ ID NO: 347496 - RNA, 32 nt, Human
cacuccagccugggcgacaagcgaaacuucgu

SEQ ID NO: 347497 - RNA, 32 nt, Human
cacuccagccugggcgacacagcaagacuccg

SEQ ID NO: 347498 - RNA, 32 nt, Human
cacuccagccugggcgacacagcgagauuucc

SEQ ID NO: 347499 - RNA, 22 nt, Human
cacuccagccugggcgacagaa

SEQ ID NO: 347500 - RNA, 32 nt, Human
cacuccagccugggcgacagaacaagacuccg

SEQ ID NO: 347501 - RNA, 32 nt, Human
cacuccagccugggcgacagaacgagacccca

SEQ ID NO: 347502 - RNA, 32 nt, Human
cacuccagccugggcgacagaacgagacgcca

SEQ ID NO: 347503 - RNA, 32 nt, Human
cacuccagccugggcgacagaaugagacccug

SEQ ID NO: 347504 - RNA, 32 nt, Human
cacuccagccugggcgacagaaugagacucca

SEQ ID NO: 347505 - RNA, 32 nt, Human
cacuccagccugggcgacagaaugagacucug

SEQ ID NO: 347506 - RNA, 32 nt, Human
cacuccagccugggcgacagaccgagacuccg

SEQ ID NO: 347507 - RNA, 22 nt, Human
cacuccagccugggcgacagag

SEQ ID NO: 347508 - RNA, 32 nt, Human
cacuccagccugggcgacagagagagacucca

SEQ ID NO: 347509 - RNA, 32 nt, Human
cacuccagccugggcgacagagcaagacacug

SEQ ID NO: 347510 - RNA, 32 nt, Human
cacuccagccugggcgacagagcaagacccug

SEQ ID NO: 347511 - RNA, 32 nt, Human
cacuccagccugggcgacagagcaagacgcca

SEQ ID NO: 347512 - RNA, 32 nt, Human
cacuccagccugggcgacagagcaagacucag

SEQ ID NO: 347513 - RNA, 32 nt, Human
cacuccagccugggcgacagagcaagacucca

SEQ ID NO: 347514 - RNA, 32 nt, Human
cacuccagccugggcgacagagcaagacuccc

SEQ ID NO: 347515 - RNA, 32 nt, Human
cacuccagccugggcgacagagcaagacuccg

SEQ ID NO: 347516 - RNA, 32 nt, Human
cacuccagccugggcgacagagcaagacuccu

SEQ ID NO: 347517 - RNA, 32 nt, Human
cacuccagccugggcgacagagcaagacucgg

SEQ ID NO: 347518 - RNA, 32 nt, Human
cacuccagccugggcgacagagcaagacucuc

SEQ ID NO: 347519 - RNA, 32 nt, Human
cacuccagccugggcgacagagcaagacucug

SEQ ID NO: 347520 - RNA, 32 nt, Human
cacuccagccugggcgacagagcaagaucguu

SEQ ID NO: 347521 - RNA, 32 nt, Human
cacuccagccugggcgacagagcaagauuccg

SEQ ID NO: 347522 - RNA, 32 nt, Human
cacuccagccugggcgacagagcaaggcucug

SEQ ID NO: 347523 - RNA, 32 nt, Human
cacuccagccugggcgacagagcaggacucca

SEQ ID NO: 347524 - RNA, 32 nt, Human
cacuccagccugggcgacagagcaggacucuc

SEQ ID NO: 347525 - RNA, 32 nt, Human
cacuccagccugggcgacagagcaggacucuu

SEQ ID NO: 347526 - RNA, 32 nt, Human
cacuccagccugggcgacagagccagacccua

SEQ ID NO: 347527 - RNA, 32 nt, Human
cacuccagccugggcgacagagccagacucaa

SEQ ID NO: 347528 - RNA, 32 nt, Human
cacuccagccugggcgacagagccagacucca

SEQ ID NO: 347529 - RNA, 32 nt, Human
cacuccagccugggcgacagagccagacuccg

SEQ ID NO: 347530 - RNA, 32 nt, Human
cacuccagccugggcgacagagccagacuguc

SEQ ID NO: 347531 - RNA, 32 nt, Human
cacuccagccugggcgacagagcgaaacuccg

SEQ ID NO: 347532 - RNA, 32 nt, Human
cacuccagccugggcgacagagcgagacccca

SEQ ID NO: 347533 - RNA, 32 nt, Human
cacuccagccugggcgacagagcgagacucca

SEQ ID NO: 347534 - RNA, 32 nt, Human
cacuccagccugggcgacagagcgagacuccg

SEQ ID NO: 347535 - RNA, 32 nt, Human
cacuccagccugggcgacagagcgagacucug

SEQ ID NO: 347536 - RNA, 32 nt, Human
cacuccagccugggcgacagagcgagacuguc

SEQ ID NO: 347537 - RNA, 32 nt, Human
cacuccagccugggcgacagagcgagacuucg

SEQ ID NO: 347538 - RNA, 32 nt, Human
cacuccagccugggcgacagagcgagacuuug

SEQ ID NO: 347539 - RNA, 32 nt, Human
cacuccagccugggcgacagagcgagagucug

SEQ ID NO: 347540 - RNA, 32 nt, Human
cacuccagccugggcgacagagcgagaguuug

SEQ ID NO: 347541 - RNA, 32 nt, Human
cacuccagccugggcgacagagcgagauuccg

SEQ ID NO: 347542 - RNA, 32 nt, Human
cacuccagccugggcgacagagcgagauucug

SEQ ID NO: 347543 - RNA, 32 nt, Human
cacuccagccugggcgacagagcgauauuccg

SEQ ID NO: 347544 - RNA, 32 nt, Human
cacuccagccugggcgacagagcuagacuccg

SEQ ID NO: 347545 - RNA, 32 nt, Human
cacuccagccugggcgacagaggaagacucca

SEQ ID NO: 347546 - RNA, 32 nt, Human
cacuccagccugggcgacagagggagacacug

SEQ ID NO: 347547 - RNA, 32 nt, Human
cacuccagccugggcgacagagggagacuccg

SEQ ID NO: 347548 - RNA, 32 nt, Human
cacuccagccugggcgacagagggagacucug

SEQ ID NO: 347549 - RNA, 32 nt, Human
cacuccagccugggcgacagaguaagacugug

SEQ ID NO: 347550 - RNA, 32 nt, Human
cacuccagccugggcgacagagugacacuucu

SEQ ID NO: 347551 - RNA, 32 nt, Human
cacuccagccugggcgacagagugacccugcc

SEQ ID NO: 347552 - RNA, 32 nt, Human
cacuccagccugggcgacagagugacucuguc

SEQ ID NO: 347553 - RNA, 32 nt, Human
cacuccagccugggcgacagagugagacccug

SEQ ID NO: 347554 - RNA, 32 nt, Human
cacuccagccugggcgacagagugagacucca

SEQ ID NO: 347555 - RNA, 32 nt, Human
cacuccagccugggcgacagagugagacuccc

SEQ ID NO: 347556 - RNA, 32 nt, Human
cacuccagccugggcgacagagugagacuccg

SEQ ID NO: 347557 - RNA, 32 nt, Human
cacuccagccugggcgacagagugagacuccu

SEQ ID NO: 347558 - RNA, 32 nt, Human
cacuccagccugggcgacagagugagacucug

SEQ ID NO: 347559 - RNA, 32 nt, Human
cacuccagccugggcgacagagugagacucuu

SEQ ID NO: 347560 - RNA, 32 nt, Human
cacuccagccugggcgacagagugagacugca

SEQ ID NO: 347561 - RNA, 32 nt, Human
cacuccagccugggcgacagagugagacuuug

SEQ ID NO: 347562 - RNA, 32 nt, Human
cacuccagccugggcgacagagugaggcuccg

SEQ ID NO: 347563 - RNA, 32 nt, Human
cacuccagccugggcgacagagugggacucca

SEQ ID NO: 347564 - RNA, 32 nt, Human
cacuccagccugggcgacagcgagacuccgaa

SEQ ID NO: 347565 - RNA, 32 nt, Human
cacuccagccugggcgacagcgugagauccug

SEQ ID NO: 347566 - RNA, 32 nt, Human
cacuccagccugggcgacagggcaagacucug

SEQ ID NO: 347567 - RNA, 32 nt, Human
cacuccagccugggcgacagggugagacugug

SEQ ID NO: 347568 - RNA, 32 nt, Human
cacuccagccugggcgacaguaccagacucca

SEQ ID NO: 347569 - RNA, 32 nt, Human
cacuccagccugggcgacagugagacccuguc

SEQ ID NO: 347570 - RNA, 32 nt, Human
cacuccagccugggcgacagugagacugcuuc

SEQ ID NO: 347571 - RNA, 32 nt, Human
cacuccagccugggcgacagugagacuuuguc

SEQ ID NO: 347572 - RNA, 32 nt, Human
cacuccagccugggcgacagugcaagacucug

SEQ ID NO: 347573 - RNA, 32 nt, Human
cacuccagccugggcgacggagcgaaacuccg

SEQ ID NO: 347574 - RNA, 32 nt, Human
cacuccagccugggcgacggagcgagacucug

SEQ ID NO: 347575 - RNA, 32 nt, Human
cacuccagccugggcgacggagugagacucca

SEQ ID NO: 347576 - RNA, 32 nt, Human
cacuccagccugggcgacugagcgagacucua

SEQ ID NO: 347577 - RNA, 32 nt, Human
cacuccagccugggcgacugugagaccccguc

SEQ ID NO: 347578 - RNA, 32 nt, Human
cacuccagccugggcgagacggcaagacucca

SEQ ID NO: 347579 - RNA, 32 nt, Human
cacuccagccugggcgagagaaugagacucua

SEQ ID NO: 347580 - RNA, 32 nt, Human
cacuccagccugggcgagagagcaagacucca

SEQ ID NO: 347581 - RNA, 30 nt, Human
cacuccagccugggcgagagcgagacuccu

SEQ ID NO: 347582 - RNA, 32 nt, Human
cacuccagccugggcgauagagcaagacucug

SEQ ID NO: 347583 - RNA, 32 nt, Human
cacuccagccugggcgauagagcuagacucug

SEQ ID NO: 347584 - RNA, 32 nt, Human
cacuccagccugggcgauagagugagacucag

SEQ ID NO: 347585 - RNA, 32 nt, Human
cacuccagccugggcgauggagcaagacucca

SEQ ID NO: 347586 - RNA, 32 nt, Human
cacuccagccugggcgauggagcgagacucca

SEQ ID NO: 347587 - RNA, 32 nt, Human
cacuccagccugggcgauggagugagacucca

SEQ ID NO: 347588 - RNA, 32 nt, Human
cacuccagccugggcggcagagcaagacuccc

SEQ ID NO: 347589 - RNA, 32 nt, Human
cacuccagccugggcggcagagcaagacuccg

SEQ ID NO: 347590 - RNA, 32 nt, Human
cacuccagccugggcggcagagcaagacucug

SEQ ID NO: 347591 - RNA, 32 nt, Human
cacuccagccugggcggcagagcaagauucug

SEQ ID NO: 347592 - RNA, 32 nt, Human
cacuccagccugggcggcagagcgagacucug

SEQ ID NO: 347593 - RNA, 32 nt, Human
cacuccagccugggcggcagagugagacucug

SEQ ID NO: 347594 - RNA, 32 nt, Human
cacuccagccugggcgucagagugagaacucu

SEQ ID NO: 347595 - RNA, 32 nt, Human
cacuccagccugggcuacagagcaagacucca

SEQ ID NO: 347596 - RNA, 32 nt, Human
cacuccagccugggcuacagagcgagacacgg

SEQ ID NO: 347597 - RNA, 32 nt, Human
cacuccagccugggcuacagagcgagacucua

SEQ ID NO: 347598 - RNA, 32 nt, Human
cacuccagccugggcuacagagcgagacucug

SEQ ID NO: 347599 - RNA, 32 nt, Human
cacuccagccugggcugcagggugagguccug

SEQ ID NO: 347600 - RNA, 32 nt, Human
cacuccagccugggcuucagagcaagacucgg

SEQ ID NO: 347601 - RNA, 32 nt, Human
cacuccagccuggggaacagagcaagauucug

SEQ ID NO: 347602 - RNA, 32 nt, Human
cacuccagccuggggaacagagcgagacucca

SEQ ID NO: 347603 - RNA, 32 nt, Human
cacuccagccuggggacaaagcaagacucaau

SEQ ID NO: 347604 - RNA, 32 nt, Human
cacuccagccuggggacagagcaagacucuug

SEQ ID NO: 347605 - RNA, 32 nt, Human
cacuccagccuggggcugacagagcaagacac

SEQ ID NO: 347606 - RNA, 32 nt, Human
cacuccagccugggggaaagagcgagacuccg

SEQ ID NO: 347607 - RNA, 32 nt, Human
cacuccagccugggggacaagagugagacuua

SEQ ID NO: 347608 - RNA, 32 nt, Human
cacuccagccugggggacagaaagagacuccg

SEQ ID NO: 347609 - RNA, 32 nt, Human
cacuccagccugggggacagagcaagacccug

SEQ ID NO: 347610 - RNA, 32 nt, Human
cacuccagccugggggacagagcaagacucua

SEQ ID NO: 347611 - RNA, 32 nt, Human
cacuccagccugggggacagagcaagacuguu

SEQ ID NO: 347612 - RNA, 32 nt, Human
cacuccagccugggggacagagcaaggcuccg

SEQ ID NO: 347613 - RNA, 32 nt, Human
cacuccagccugggggacagagcgagacuccg

SEQ ID NO: 347614 - RNA, 32 nt, Human
cacuccagccugggggacagagcgagacucug

SEQ ID NO: 347615 - RNA, 32 nt, Human
cacuccagccugggggacagagugagacccug

SEQ ID NO: 347616 - RNA, 32 nt, Human
cacuccagccuggggugauagaacaagacccu

SEQ ID NO: 347617 - RNA, 22 nt, Human
cacuccagccuggguaaaagag

SEQ ID NO: 347618 - RNA, 32 nt, Human
cacuccagccuggguaaaagagugagaccuca

SEQ ID NO: 347619 - RNA, 32 nt, Human
cacuccagccuggguaacaagagcgaaacucc

SEQ ID NO: 347620 - RNA, 22 nt, Human
cacuccagccuggguaacagag

SEQ ID NO: 347621 - RNA, 32 nt, Human
cacuccagccuggguaacagagcaagaccaug

SEQ ID NO: 347622 - RNA, 32 nt, Human
cacuccagccuggguaacagagcaagacucca

SEQ ID NO: 347623 - RNA, 32 nt, Human
cacuccagccuggguaacagagcaagacucug

SEQ ID NO: 347624 - RNA, 32 nt, Human
cacuccagccuggguaacagagcaagagucug

SEQ ID NO: 347625 - RNA, 32 nt, Human
cacuccagccuggguaacagagcgagaccccg

SEQ ID NO: 347626 - RNA, 32 nt, Human
cacuccagccuggguaacagagcgagacucca

SEQ ID NO: 347627 - RNA, 32 nt, Human
cacuccagccuggguaacagagcuagacucca

SEQ ID NO: 347628 - RNA, 32 nt, Human
cacuccagccuggguaacagagugagacucca

SEQ ID NO: 347629 - RNA, 32 nt, Human
cacuccagccuggguaacagagugagacucug

SEQ ID NO: 347630 - RNA, 32 nt, Human
cacuccagccuggguaacagagugagacuguc

SEQ ID NO: 347631 - RNA, 32 nt, Human
cacuccagccuggguaacagugagaccauguc

SEQ ID NO: 347632 - RNA, 32 nt, Human
cacuccagccuggguaacagugagaggccuca

SEQ ID NO: 347633 - RNA, 32 nt, Human
cacuccagccuggguaagagagcgaggugcug

SEQ ID NO: 347634 - RNA, 32 nt, Human
cacuccagccugggugaaagagcuagauucuc

SEQ ID NO: 347635 - RNA, 20 nt, Human
cacuccagccugggugacaa

SEQ ID NO: 347636 - RNA, 32 nt, Human
cacuccagccugggugacaaaagugaaacucu

SEQ ID NO: 347637 - RNA, 32 nt, Human
cacuccagccugggugacaaagcaagacucca

SEQ ID NO: 347638 - RNA, 32 nt, Human
cacuccagccugggugacaaagcaagacugug

SEQ ID NO: 347639 - RNA, 32 nt, Human
cacuccagccugggugacaaagcaagauucug

SEQ ID NO: 347640 - RNA, 32 nt, Human
cacuccagccugggugacaaagcgagacucca

SEQ ID NO: 347641 - RNA, 32 nt, Human
cacuccagccugggugacaaaggagaccccgu

SEQ ID NO: 347642 - RNA, 32 nt, Human
cacuccagccugggugacaaagugagacucca

SEQ ID NO: 347643 - RNA, 32 nt, Human
cacuccagccugggugacaaagugagacuccg

SEQ ID NO: 347644 - RNA, 32 nt, Human
cacuccagccugggugacaagagcaagacucc

SEQ ID NO: 347645 - RNA, 32 nt, Human
cacuccagccugggugacaagagcgaaacucc

SEQ ID NO: 347646 - RNA, 32 nt, Human
cacuccagccugggugacaagagugaaacucc

SEQ ID NO: 347647 - RNA, 32 nt, Human
cacuccagccugggugacaagagugagacucc

SEQ ID NO: 347648 - RNA, 32 nt, Human
cacuccagccugggugacaagagugagacucu

SEQ ID NO: 347649 - RNA, 32 nt, Human
cacuccagccugggugacaagggaagacucuc

SEQ ID NO: 347650 - RNA, 32 nt, Human
cacuccagccugggugacacagcgacacucug

SEQ ID NO: 347651 - RNA, 32 nt, Human
cacuccagccugggugacacagcgagacuccg

SEQ ID NO: 347652 - RNA, 32 nt, Human
cacuccagccugggugacacagcgagacucug

SEQ ID NO: 347653 - RNA, 32 nt, Human
cacuccagccugggugacacagugagacucca

SEQ ID NO: 347654 - RNA, 32 nt, Human
cacuccagccugggugacagaacaagacucug

SEQ ID NO: 347655 - RNA, 32 nt, Human
cacuccagccugggugacagaacaagacuguc

SEQ ID NO: 347656 - RNA, 32 nt, Human
cacuccagccugggugacagaacgagacccug

SEQ ID NO: 347657 - RNA, 32 nt, Human
cacuccagccugggugacagaacgagacucca

SEQ ID NO: 347658 - RNA, 32 nt, Human
cacuccagccugggugacagaacgagacuccg

SEQ ID NO: 347659 - RNA, 32 nt, Human
cacuccagccugggugacagaaugagacucca

SEQ ID NO: 347660 - RNA, 32 nt, Human
cacuccagccugggugacagaaugaggcuccc

SEQ ID NO: 347661 - RNA, 32 nt, Human
cacuccagccugggugacagaccgagacucug

SEQ ID NO: 347662 - RNA, 32 nt, Human
cacuccagccugggugacagacuaagacuccg

SEQ ID NO: 347663 - RNA, 22 nt, Human
cacuccagccugggugacagag

SEQ ID NO: 347664 - RNA, 32 nt, Human
cacuccagccugggugacagagacagugagac

SEQ ID NO: 347665 - RNA, 32 nt, Human
cacuccagccugggugacagagagacucuguc

SEQ ID NO: 347666 - RNA, 32 nt, Human
cacuccagccugggugacagagagagacccug

SEQ ID NO: 347667 - RNA, 32 nt, Human
cacuccagccugggugacagagagagacucca

SEQ ID NO: 347668 - RNA, 32 nt, Human
cacuccagccugggugacagagagagacuccg

SEQ ID NO: 347669 - RNA, 32 nt, Human
cacuccagccugggugacagagagauacccug

SEQ ID NO: 347670 - RNA, 32 nt, Human
cacuccagccugggugacagagcaagaaaaua

SEQ ID NO: 347671 - RNA, 32 nt, Human
cacuccagccugggugacagagcaagaaucau

SEQ ID NO: 347672 - RNA, 32 nt, Human
cacuccagccugggugacagagcaagacauaa

SEQ ID NO: 347673 - RNA, 32 nt, Human
cacuccagccugggugacagagcaagacccug

SEQ ID NO: 347674 - RNA, 32 nt, Human
cacuccagccugggugacagagcaagacucca

SEQ ID NO: 347675 - RNA, 32 nt, Human
cacuccagccugggugacagagcaagacuccc

SEQ ID NO: 347676 - RNA, 32 nt, Human
cacuccagccugggugacagagcaagacuccg

SEQ ID NO: 347677 - RNA, 32 nt, Human
cacuccagccugggugacagagcaagacucuc

SEQ ID NO: 347678 - RNA, 32 nt, Human
cacuccagccugggugacagagcaagacucug

SEQ ID NO: 347679 - RNA, 32 nt, Human
cacuccagccugggugacagagcaagacuuca

SEQ ID NO: 347680 - RNA, 32 nt, Human
cacuccagccugggugacagagcaagacuugg

SEQ ID NO: 347681 - RNA, 32 nt, Human
cacuccagccugggugacagagcaagagaccc

SEQ ID NO: 347682 - RNA, 32 nt, Human
cacuccagccugggugacagagcaagaucuug

SEQ ID NO: 347683 - RNA, 32 nt, Human
cacuccagccugggugacagagcaagauuccg

SEQ ID NO: 347684 - RNA, 32 nt, Human
cacuccagccugggugacagagcaaggcuccc

SEQ ID NO: 347685 - RNA, 32 nt, Human
cacuccagccugggugacagagcaaggcucug

SEQ ID NO: 347686 - RNA, 32 nt, Human
cacuccagccugggugacagagcaagugagac

SEQ ID NO: 347687 - RNA, 31 nt, Human
cacuccagccugggugacagagcagacucca

SEQ ID NO: 347688 - RNA, 32 nt, Human
cacuccagccugggugacagagcaggacccug

SEQ ID NO: 347689 - RNA, 32 nt, Human
cacuccagccugggugacagagccagaccccg

SEQ ID NO: 347690 - RNA, 32 nt, Human
cacuccagccugggugacagagccagacucca

SEQ ID NO: 347691 - RNA, 32 nt, Human
cacuccagccugggugacagagccagacuccg

SEQ ID NO: 347692 - RNA, 32 nt, Human
cacuccagccugggugacagagccagacucug

SEQ ID NO: 347693 - RNA, 32 nt, Human
cacuccagccugggugacagagcgacccucug

SEQ ID NO: 347694 - RNA, 32 nt, Human
cacuccagccugggugacagagcgagaaucag

SEQ ID NO: 347695 - RNA, 32 nt, Human
cacuccagccugggugacagagcgagacccug

SEQ ID NO: 347696 - RNA, 32 nt, Human
cacuccagccugggugacagagcgagaccguc

SEQ ID NO: 347697 - RNA, 32 nt, Human
cacuccagccugggugacagagcgagacuauc

SEQ ID NO: 347698 - RNA, 32 nt, Human
cacuccagccugggugacagagcgagacucca

SEQ ID NO: 347699 - RNA, 32 nt, Human
cacuccagccugggugacagagcgagacuccg

SEQ ID NO: 347700 - RNA, 32 nt, Human
cacuccagccugggugacagagcgagacucug

SEQ ID NO: 347701 - RNA, 32 nt, Human
cacuccagccugggugacagagcgagacuguc

SEQ ID NO: 347702 - RNA, 32 nt, Human
cacuccagccugggugacagagcgagacugug

SEQ ID NO: 347703 - RNA, 32 nt, Human
cacuccagccugggugacagagcgagacuuau

SEQ ID NO: 347704 - RNA, 32 nt, Human
cacuccagccugggugacagagcgagacuuug

SEQ ID NO: 347705 - RNA, 28 nt, Human
cacuccagccugggugacagagcgaggc

SEQ ID NO: 347706 - RNA, 32 nt, Human
cacuccagccugggugacagagcgugagacuc

SEQ ID NO: 347707 - RNA, 32 nt, Human
cacuccagccugggugacagagggaaacucca

SEQ ID NO: 347708 - RNA, 32 nt, Human
cacuccagccugggugacagagggagacucca

SEQ ID NO: 347709 - RNA, 32 nt, Human
cacuccagccugggugacagagggagacuccg

SEQ ID NO: 347710 - RNA, 32 nt, Human
cacuccagccugggugacagagggagacucug

SEQ ID NO: 347711 - RNA, 32 nt, Human
cacuccagccugggugacagaguaagacccug

SEQ ID NO: 347712 - RNA, 32 nt, Human
cacuccagccugggugacagaguaagacucca

SEQ ID NO: 347713 - RNA, 32 nt, Human
cacuccagccugggugacagaguaagacuccg

SEQ ID NO: 347714 - RNA, 32 nt, Human
cacuccagccugggugacagaguaagacucug

SEQ ID NO: 347715 - RNA, 32 nt, Human
cacuccagccugggugacagaguaggacccug

SEQ ID NO: 347716 - RNA, 32 nt, Human
cacuccagccugggugacagagucagacccua

SEQ ID NO: 347717 - RNA, 32 nt, Human
cacuccagccugggugacagagucagacccug

SEQ ID NO: 347718 - RNA, 32 nt, Human
cacuccagccugggugacagagugaaacccug

SEQ ID NO: 347719 - RNA, 32 nt, Human
cacuccagccugggugacagagugaaacccuu

SEQ ID NO: 347720 - RNA, 32 nt, Human
cacuccagccugggugacagagugagacacca

SEQ ID NO: 347721 - RNA, 32 nt, Human
cacuccagccugggugacagagugagacccca

SEQ ID NO: 347722 - RNA, 32 nt, Human
cacuccagccugggugacagagugagaccccc

SEQ ID NO: 347723 - RNA, 32 nt, Human
cacuccagccugggugacagagugagacccug

SEQ ID NO: 347724 - RNA, 32 nt, Human
cacuccagccugggugacagagugagaccuca

SEQ ID NO: 347725 - RNA, 32 nt, Human
cacuccagccugggugacagagugagacucag

SEQ ID NO: 347726 - RNA, 32 nt, Human
cacuccagccugggugacagagugagacucca

SEQ ID NO: 347727 - RNA, 32 nt, Human
cacuccagccugggugacagagugagacuccg

SEQ ID NO: 347728 - RNA, 32 nt, Human
cacuccagccugggugacagagugagacucug

SEQ ID NO: 347729 - RNA, 32 nt, Human
cacuccagccugggugacagagugagacuguc

SEQ ID NO: 347730 - RNA, 32 nt, Human
cacuccagccugggugacagagugagacuuug

SEQ ID NO: 347731 - RNA, 32 nt, Human
cacuccagccugggugacagagugagagaccu

SEQ ID NO: 347732 - RNA, 32 nt, Human
cacuccagccugggugacagagugagaguccg

SEQ ID NO: 347733 - RNA, 32 nt, Human
cacuccagccugggugacagagugagaucccg

SEQ ID NO: 347734 - RNA, 32 nt, Human
cacuccagccugggugacagagugagauccug

SEQ ID NO: 347735 - RNA, 32 nt, Human
cacuccagccugggugacagagugagaucugc

SEQ ID NO: 347736 - RNA, 32 nt, Human
cacuccagccugggugacagagugagauuccg

SEQ ID NO: 347737 - RNA, 32 nt, Human
cacuccagccugggugacagagugagauucug

SEQ ID NO: 347738 - RNA, 32 nt, Human
cacuccagccugggugacagagugaggcccug

SEQ ID NO: 347739 - RNA, 32 nt, Human
cacuccagccugggugacagagugagugagac

SEQ ID NO: 347740 - RNA, 32 nt, Human
cacuccagccugggugacagauccagacucug

SEQ ID NO: 347741 - RNA, 32 nt, Human
cacuccagccugggugacagauugagacuccc

SEQ ID NO: 347742 - RNA, 26 nt, Human
cacuccagccugggugacagcaagag

SEQ ID NO: 347743 - RNA, 32 nt, Human
cacuccagccugggugacagcaagagaucuug

SEQ ID NO: 347744 - RNA, 32 nt, Human
cacuccagccugggugacagcgagacccuguc

SEQ ID NO: 347745 - RNA, 32 nt, Human
cacuccagccugggugacagcgcgagacucca

SEQ ID NO: 347746 - RNA, 32 nt, Human
cacuccagccugggugacagcguaagacucuc

SEQ ID NO: 347747 - RNA, 32 nt, Human
cacuccagccugggugacagggcaagacucug

SEQ ID NO: 347748 - RNA, 32 nt, Human
cacuccagccugggugacagugaaacuccauc

SEQ ID NO: 347749 - RNA, 32 nt, Human
cacuccagccugggugacagugagacucuguc

SEQ ID NO: 347750 - RNA, 32 nt, Human
cacuccagccugggugacagugagacuguggc

SEQ ID NO: 347751 - RNA, 32 nt, Human
cacuccagccugggugacagugagacuuuguc

SEQ ID NO: 347752 - RNA, 32 nt, Human
cacuccagccugggugacagugagucuuuguc

SEQ ID NO: 347753 - RNA, 32 nt, Human
cacuccagccugggugacagugugaaacuuug

SEQ ID NO: 347754 - RNA, 32 nt, Human
cacuccagccugggugacgagugaaacuccau

SEQ ID NO: 347755 - RNA, 32 nt, Human
cacuccagccugggugacggagcgagacucca

SEQ ID NO: 347756 - RNA, 32 nt, Human
cacuccagccugggugacggagugagacucca

SEQ ID NO: 347757 - RNA, 32 nt, Human
cacuccagccugggugacggugagacuuuguc

SEQ ID NO: 347758 - RNA, 32 nt, Human
cacuccagccugggugacugagcaagacucug

SEQ ID NO: 347759 - RNA, 32 nt, Human
cacuccagccugggugacugagcgagauucug

SEQ ID NO: 347760 - RNA, 32 nt, Human
cacuccagccugggugacugagggagacucug

SEQ ID NO: 347761 - RNA, 32 nt, Human
cacuccagccugggugacugagugagacccug

SEQ ID NO: 347762 - RNA, 32 nt, Human
cacuccagccugggugagaaagcaagacccua

SEQ ID NO: 347763 - RNA, 32 nt, Human
cacuccagccugggugagaagagcgaaacucc

SEQ ID NO: 347764 - RNA, 32 nt, Human
cacuccagccugggugagagagcaagacccug

SEQ ID NO: 347765 - RNA, 32 nt, Human
cacuccagccugggugagagagugagacacug

SEQ ID NO: 347766 - RNA, 32 nt, Human
cacuccagccugggugauaagagcaagacucu

SEQ ID NO: 347767 - RNA, 32 nt, Human
cacuccagccugggugauaagagcgaaauucu

SEQ ID NO: 347768 - RNA, 32 nt, Human
cacuccagccugggugauagagcaagacccca

SEQ ID NO: 347769 - RNA, 32 nt, Human
cacuccagccugggugauagagcaagacccua

SEQ ID NO: 347770 - RNA, 32 nt, Human
cacuccagccugggugauagagcaagacuguc

SEQ ID NO: 347771 - RNA, 32 nt, Human
cacuccagccugggugauagagcuggagggaa

SEQ ID NO: 347772 - RNA, 32 nt, Human
cacuccagccugggugauagagugagaacuug

SEQ ID NO: 347773 - RNA, 32 nt, Human
cacuccagccugggugauagagugagacacug

SEQ ID NO: 347774 - RNA, 32 nt, Human
cacuccagccugggugauagagugagacccuc

SEQ ID NO: 347775 - RNA, 32 nt, Human
cacuccagccugggugauagagugagauucag

SEQ ID NO: 347776 - RNA, 32 nt, Human
cacuccagccugggugaugaagacgagacucu

SEQ ID NO: 347777 - RNA, 32 nt, Human
cacuccagccugggugauggagcaagacucca

SEQ ID NO: 347778 - RNA, 32 nt, Human
cacuccagccuggguggacagagcaagacucc

SEQ ID NO: 347779 - RNA, 32 nt, Human
cacuccagccuggguggcaaagcaagaccccu

SEQ ID NO: 347780 - RNA, 32 nt, Human
cacuccagccuggguggcaaagugagacucug

SEQ ID NO: 347781 - RNA, 32 nt, Human
cacuccagccuggguggcagagcaagacuguc

SEQ ID NO: 347782 - RNA, 32 nt, Human
cacuccagccuggguggcagagccagacccug

SEQ ID NO: 347783 - RNA, 32 nt, Human
cacuccagccuggguggcagagugagacccug

SEQ ID NO: 347784 - RNA, 32 nt, Human
cacuccagccuggguggcagagugagacucgu

SEQ ID NO: 347785 - RNA, 32 nt, Human
cacuccagccugggugucagagcaagacucug

SEQ ID NO: 347786 - RNA, 32 nt, Human
cacuccagccugggugucagagcgagaacccg

SEQ ID NO: 347787 - RNA, 32 nt, Human
cacuccagccuggguuacagagugagacccug

SEQ ID NO: 347788 - RNA, 19 nt, Human
cacuccagccuggucaaca

SEQ ID NO: 347789 - RNA, 32 nt, Human
cacuccagccuggucaacaaagcaagacccuu

SEQ ID NO: 347790 - RNA, 32 nt, Human
cacuccagccuggucaacagagcaagacucca

SEQ ID NO: 347791 - RNA, 32 nt, Human
cacuccagccuggucaacagagugagacucug

SEQ ID NO: 347792 - RNA, 32 nt, Human
cacuccagccuggucaacagagugggacuccg

SEQ ID NO: 347793 - RNA, 32 nt, Human
cacuccagccuggucaauggagugcgacucca

SEQ ID NO: 347794 - RNA, 22 nt, Human
cacuccagccuggucgacagag

SEQ ID NO: 347795 - RNA, 32 nt, Human
cacuccagccuggucgacagagugaacucugu

SEQ ID NO: 347796 - RNA, 32 nt, Human
cacuccagccuggucgacagcgagacuccauc

SEQ ID NO: 347797 - RNA, 32 nt, Human
cacuccagccuggugacagagcaagacuccau

SEQ ID NO: 347798 - RNA, 32 nt, Human
cacuccagccuggugacagagcaagacuccgg

SEQ ID NO: 347799 - RNA, 32 nt, Human
cacuccagccuggugacagagcaagacucugu

SEQ ID NO: 347800 - RNA, 32 nt, Human
cacuccagccuggugacagagcgagacuccau

SEQ ID NO: 347801 - RNA, 32 nt, Human
cacuccagccuggugacagagcgagacuccgu

SEQ ID NO: 347802 - RNA, 32 nt, Human
cacuccagccuggugacagagcuagauuccau

SEQ ID NO: 347803 - RNA, 32 nt, Human
cacuccagccuggugacagagugagacuccau

SEQ ID NO: 347804 - RNA, 32 nt, Human
cacuccagccuggugacagagugagacuccgu

SEQ ID NO: 347805 - RNA, 32 nt, Human
cacuccagccuggugacagagugagacucugu

SEQ ID NO: 347806 - RNA, 32 nt, Human
cacuccagccuggugacagcgugagacucuuu

SEQ ID NO: 347807 - RNA, 32 nt, Human
cacuccagccuggugacagggcgagacuccgu

SEQ ID NO: 347808 - RNA, 32 nt, Human
cacuccagccuggugagagcaagacucugucu

SEQ ID NO: 347809 - RNA, 32 nt, Human
cacuccagccugguuacagagcaagacucugu

SEQ ID NO: 347810 - RNA, 32 nt, Human
cacuccagccugguugacagagcaagacuccg

SEQ ID NO: 347811 - RNA, 32 nt, Human
cacuccagccugguugacagagcaagacucug

SEQ ID NO: 347812 - RNA, 32 nt, Human
cacuccagccuuggugacagagcaagacucug

SEQ ID NO: 347813 - RNA, 32 nt, Human
cacuccagccuuggugacagagugagacucug

SEQ ID NO: 347814 - RNA, 32 nt, Human
cacuccagcgugggcaacagagcgagacucug

SEQ ID NO: 347815 - RNA, 32 nt, Human
cacuccagcgugggcgacagagcgagacuccg

SEQ ID NO: 347816 - RNA, 32 nt, Human
cacuccagcucggggaacagagcgagaccuug

SEQ ID NO: 347817 - RNA, 32 nt, Human
cacuccagcucgggugacaagagugagacccc

SEQ ID NO: 347818 - RNA, 32 nt, Human
cacuccagcuuaggugacagagugagaaccug

SEQ ID NO: 347819 - RNA, 32 nt, Human
cacuccagcuugaaugacagagggagacucug

SEQ ID NO: 347820 - RNA, 32 nt, Human
cacuccagcuugggcaacagagcgagacuccg

SEQ ID NO: 347821 - RNA, 32 nt, Human
cacuccagcuugggcgacagagcgagacucug

SEQ ID NO: 347822 - RNA, 32 nt, Human
cacuccagcuugggugacaaaguaagacccug

SEQ ID NO: 347823 - RNA, 32 nt, Human
cacuccagcuugggugacagagcaagacucca

SEQ ID NO: 347824 - RNA, 32 nt, Human
cacuccagcuugggugacagagcaagagucug

SEQ ID NO: 347825 - RNA, 32 nt, Human
cacuccagcuugggugacagagcgagacuccg

SEQ ID NO: 347826 - RNA, 32 nt, Human
cacuccagcuugggugacagagugagacgcug

SEQ ID NO: 347827 - RNA, 32 nt, Human
cacuccagcuugggugacagagugagacucca

SEQ ID NO: 347828 - RNA, 32 nt, Human
cacuccagcuugggugacagagugagacucug

SEQ ID NO: 347829 - RNA, 32 nt, Human
cacuccaggaacagcuggcacagggaguccca

SEQ ID NO: 347830 - RNA, 32 nt, Human
cacuccaggaauaagacaaaaggagaggagga

SEQ ID NO: 347831 - RNA, 32 nt, Human
cacuccaggagggacccacugccuucccgggg

SEQ ID NO: 347832 - RNA, 32 nt, Human
cacuccaggaugggacacggccccucuuucuu

SEQ ID NO: 347833 - RNA, 32 nt, Human
cacuccaggccagcucaagaagcaaagcaggc

SEQ ID NO: 347834 - RNA, 20 nt, Human
cacuccaggccucuguggca

SEQ ID NO: 347835 - RNA, 32 nt, Human
cacuccaggccugcguuucagcagggugugcc

SEQ ID NO: 347836 - RNA, 32 nt, Human
cacuccaggcuggacaacacagcaagacucca

SEQ ID NO: 347837 - RNA, 32 nt, Human
cacuccaggcuggacgacagagcaagacccug

SEQ ID NO: 347838 - RNA, 32 nt, Human
cacuccaggcugggcaauuuuguaccuggccc

SEQ ID NO: 347839 - RNA, 32 nt, Human
cacuccaggcugggcagcaagagcaagacucu

SEQ ID NO: 347840 - RNA, 32 nt, Human
cacuccaggcugggcgacagagcgagacuccg

SEQ ID NO: 347841 - RNA, 32 nt, Human
cacuccaggcugggugacagagcgagacucca

SEQ ID NO: 347842 - RNA, 32 nt, Human
cacuccaggcugggugacagauuaagcaagac

SEQ ID NO: 347843 - RNA, 20 nt, Human
cacuccagguucccucaggc

SEQ ID NO: 347844 - RNA, 32 nt, Human
cacuccaguccacuccugaccccucuccucaa

SEQ ID NO: 347845 - RNA, 32 nt, Human
cacuccagucuggaugacagagagagacccug

SEQ ID NO: 347846 - RNA, 32 nt, Human
cacuccagucugggcaacagagcgagacucca

SEQ ID NO: 347847 - RNA, 32 nt, Human
cacuccagucugggcaacagagcgagacuccc

SEQ ID NO: 347848 - RNA, 32 nt, Human
cacuccagucugggcaacagagcgauccuguu

SEQ ID NO: 347849 - RNA, 32 nt, Human
cacuccagucugggcaccagagcgagacuccg

SEQ ID NO: 347850 - RNA, 32 nt, Human
cacuccagucugggcgacagagcaagacucug

SEQ ID NO: 347851 - RNA, 32 nt, Human
cacuccagucugggcgacagagcgagacucug

SEQ ID NO: 347852 - RNA, 32 nt, Human
cacuccagucuggguaacagagcgagacuuuc

SEQ ID NO: 347853 - RNA, 32 nt, Human
cacuccagucugggugacagagagagaccaua

SEQ ID NO: 347854 - RNA, 32 nt, Human
cacuccagucugggugacagagcaagacucag

SEQ ID NO: 347855 - RNA, 32 nt, Human
cacuccagucugggugacagagcaagacucgg

SEQ ID NO: 347856 - RNA, 32 nt, Human
cacuccagucugggugacagagugagacuccg

SEQ ID NO: 347857 - RNA, 32 nt, Human
cacuccagucugggugacagagugagacucug

SEQ ID NO: 347858 - RNA, 32 nt, Human
cacuccagucugggugacagagugagaugcua

SEQ ID NO: 347859 - RNA, 26 nt, Human
cacuccagucugggugacagcaagac

SEQ ID NO: 347860 - RNA, 32 nt, Human
cacuccagucugggugagagugagacucaguc

SEQ ID NO: 347861 - RNA, 32 nt, Human
cacuccagucugguugacagagugagacucau

SEQ ID NO: 347862 - RNA, 32 nt, Human
cacuccagugcacucgagccugggugacaggg

SEQ ID NO: 347863 - RNA, 32 nt, Human
cacuccagugcccaccagccuugucuuaauaa

SEQ ID NO: 347864 - RNA, 23 nt, Human
cacuccagugucaaccacuggca

SEQ ID NO: 347865 - RNA, 32 nt, Human
cacuccaguuacuuaacuuucccuucagaaua

SEQ ID NO: 347866 - RNA, 26 nt, Human
cacuccauaaccuccaucuucuccca

SEQ ID NO: 347867 - RNA, 21 nt, Human
cacuccauauuuguaagcccu

SEQ ID NO: 347868 - RNA, 32 nt, Human
cacuccaucacccaggcuggaguccaguggug

SEQ ID NO: 347869 - RNA, 32 nt, Human
cacuccaucccucccucccguccuuccccucu

SEQ ID NO: 347870 - RNA, 32 nt, Human
cacuccauccugggugacaaagugagacuccc

SEQ ID NO: 347871 - RNA, 32 nt, Human
cacuccauccugggugacaagagcgaaacucc

SEQ ID NO: 347872 - RNA, 32 nt, Human
cacuccauccugggugacagagagagacccug

SEQ ID NO: 347873 - RNA, 32 nt, Human
cacuccauccugggugacagagcaagacuucc

SEQ ID NO: 347874 - RNA, 32 nt, Human
cacuccauccuugccaaaccucuacccaaaag

SEQ ID NO: 347875 - RNA, 32 nt, Human
cacuccaucguccaggcuggagugcaguggcg

SEQ ID NO: 347876 - RNA, 32 nt, Human
cacuccauugcccaggcuggaguacaauggug

SEQ ID NO: 347877 - RNA, 32 nt, Human
cacucccaaacaguuaaacccagcucuaauuc

SEQ ID NO: 347878 - RNA, 32 nt, Human
cacucccaaccauuuucccugcuacuacagau

SEQ ID NO: 347879 - RNA, 32 nt, Human
cacucccaagcccacacccacaggggcucacu

SEQ ID NO: 347880 - RNA, 32 nt, Human
cacucccacacacacccccuggcucugcugag

SEQ ID NO: 347881 - RNA, 32 nt, Human
cacucccacucccucucucucccucucugccu

SEQ ID NO: 347882 - RNA, 32 nt, Human
cacucccacuggugcuggaguacgcacuggug

SEQ ID NO: 347883 - RNA, 32 nt, Human
cacucccagcacuccccuugccuuccccuguc

SEQ ID NO: 347884 - RNA, 32 nt, Human
cacucccagccuguccuguggccugucccacu

SEQ ID NO: 347885 - RNA, 23 nt, Human
cacucccagcgaugcgcagcggg

SEQ ID NO: 347886 - RNA, 32 nt, Human
cacucccaggcaggcagaugccagugucugcu

SEQ ID NO: 347887 - RNA, 22 nt, Human
cacucccaggcggggcaggaag

SEQ ID NO: 347888 - RNA, 32 nt, Human
cacucccagggagggcaggagagcgccggggg

SEQ ID NO: 347889 - RNA, 32 nt, Human
cacucccagguaaaauccagggggaagaguca

SEQ ID NO: 347890 - RNA, 32 nt, Human
cacucccaugcuugccccagccugcuucuugc

SEQ ID NO: 347891 - RNA, 18 nt, Human
cacucccauuccuggcca

SEQ ID NO: 347892 - RNA, 32 nt, Human
cacuccccacauaggaauaguccauccccaga

SEQ ID NO: 347893 - RNA, 32 nt, Human
cacuccccacccaagagauugguggaauaaaa

SEQ ID NO: 347894 - RNA, 32 nt, Human
cacuccccacggccagcgugggcacaggacug

SEQ ID NO: 347895 - RNA, 32 nt, Human
cacucccccaaaaugacacccaccgucgucag

SEQ ID NO: 347896 - RNA, 32 nt, Human
cacucccccucagacccugucaagccggcucc

SEQ ID NO: 347897 - RNA, 21 nt, Human
cacucccccugggacgguaag

SEQ ID NO: 347898 - RNA, 19 nt, Human
cacuccccgacacuauugc

SEQ ID NO: 347899 - RNA, 32 nt, Human
cacuccccgggucaccugaccugcugcccagg

SEQ ID NO: 347900 - RNA, 32 nt, Human
cacuccccgugccucugcuucccaagaugcca

SEQ ID NO: 347901 - RNA, 32 nt, Human
cacuccccuaacccauagcacaggcugagucc

SEQ ID NO: 347902 - RNA, 32 nt, Human
cacuccccuaccccuuccccagccacugcugc

SEQ ID NO: 347903 - RNA, 32 nt, Human
cacuccccuccccuuuuucauuccuuccuccc

SEQ ID NO: 347904 - RNA, 32 nt, Human
cacuccccucuccuccccuuccuguuucucgu

SEQ ID NO: 347905 - RNA, 32 nt, Human
cacuccccucugacccucaggcuuucccagcu

SEQ ID NO: 347906 - RNA, 32 nt, Human
cacuccccugccccagcucgagccaggcucug

SEQ ID NO: 347907 - RNA, 23 nt, Human
cacuccccuugacucucucuguu

SEQ ID NO: 347908 - RNA, 32 nt, Human
cacucccgacaggacaugcuggagucuggccu

SEQ ID NO: 347909 - RNA, 32 nt, Human
cacucccgccugggcgacagagcgagacucug

SEQ ID NO: 347910 - RNA, 32 nt, Human
cacucccgccugggugacagagugagacucua

SEQ ID NO: 347911 - RNA, 32 nt, Human
cacucccgguggggacacagcacagaccccaa

SEQ ID NO: 347912 - RNA, 32 nt, Human
cacucccguuuggcccucagcacuuugggccu

SEQ ID NO: 347913 - RNA, 32 nt, Human
cacucccucacugccacuccucucaucccuac

SEQ ID NO: 347914 - RNA, 32 nt, Human
cacucccucccagaaaaacuggcucugauugg

SEQ ID NO: 347915 - RNA, 32 nt, Human
cacucccucccagagaacaggggcuucuuucu

SEQ ID NO: 347916 - RNA, 32 nt, Human
cacucccucccucuuuguuuccuuccuuccuu

SEQ ID NO: 347917 - RNA, 32 nt, Human
cacucccucucucuccccuugauggccacauu

SEQ ID NO: 347918 - RNA, 32 nt, Human
cacucccucugccuucaggcuucugucaauuu

SEQ ID NO: 347919 - RNA, 32 nt, Human
cacucccucuguagugaggccucugccauguc

SEQ ID NO: 347920 - RNA, 32 nt, Human
cacucccugcagcucucagcucccuguucccu

SEQ ID NO: 347921 - RNA, 32 nt, Human
cacucccugcagcuggucagcccauccuucuc

SEQ ID NO: 347922 - RNA, 32 nt, Human
cacucccugcauggucaccucaguccuggaca

SEQ ID NO: 347923 - RNA, 32 nt, Human
cacucccugcccccagccuggcuggacagcaa

SEQ ID NO: 347924 - RNA, 32 nt, Human
cacucccugcccuucccacugcagagaugaca

SEQ ID NO: 347925 - RNA, 32 nt, Human
cacucccugccugugcugguugcagccucaga

SEQ ID NO: 347926 - RNA, 19 nt, Human
cacucccuggccccuccca

SEQ ID NO: 347927 - RNA, 27 nt, Human
cacucccuguagugaauccucuguuua

SEQ ID NO: 347928 - RNA, 32 nt, Human
cacucccugugcauggucugaccccaggcccc

SEQ ID NO: 347929 - RNA, 32 nt, Human
cacucccugugccucugccaucagcacagggg

SEQ ID NO: 347930 - RNA, 20 nt, Human
cacucccuucccaaguuccu

SEQ ID NO: 347931 - RNA, 32 nt, Human
cacucccuuccccaucccaaccccuucuuucu

SEQ ID NO: 347932 - RNA, 32 nt, Human
cacucccuuccucuccaucucucccucucucc

SEQ ID NO: 347933 - RNA, 32 nt, Human
cacucccuucuagcacccccaaaggaaaagcc

SEQ ID NO: 347934 - RNA, 32 nt, Human
cacucccuuuugucuuucacauggagguugaa

SEQ ID NO: 347935 - RNA, 32 nt, Human
cacuccgacucugggcaacagagcaagacucu

SEQ ID NO: 347936 - RNA, 32 nt, Human
cacuccgagcacagccguggguuuguucccug

SEQ ID NO: 347937 - RNA, 22 nt, Human
cacuccgccgccucugcccgca

SEQ ID NO: 347938 - RNA, 32 nt, Human
cacuccgccucaccagccuucuugcgccggag

SEQ ID NO: 347939 - RNA, 32 nt, Human
cacuccgcgggcggaggacgcacgucggggcg

SEQ ID NO: 347940 - RNA, 32 nt, Human
cacuccgcugcagcggagggugugugagggag

SEQ ID NO: 347941 - RNA, 26 nt, Human
cacuccggagguagagguugugguga

SEQ ID NO: 347942 - RNA, 32 nt, Human
cacuccggagguagagguuguggugagccgag

SEQ ID NO: 347943 - RNA, 21 nt, Human
cacuccggaguuauccugcuc

SEQ ID NO: 347944 - RNA, 32 nt, Human
cacuccggcacggccucaggugcucuaccccg

SEQ ID NO: 347945 - RNA, 32 nt, Human
cacuccggcaggcagaccugcuggagcugcuu

SEQ ID NO: 347946 - RNA, 32 nt, Human
cacuccggccugggcgacagagcgagacuguc

SEQ ID NO: 347947 - RNA, 32 nt, Human
cacuccggccugggugacaaagcaagacucug

SEQ ID NO: 347948 - RNA, 32 nt, Human
cacuccggccugggugacagagccagacucca

SEQ ID NO: 347949 - RNA, 32 nt, Human
cacuccggccugggugacagagugagacccgu

SEQ ID NO: 347950 - RNA, 32 nt, Human
cacuccggccugggugauggagcaagaccucg

SEQ ID NO: 347951 - RNA, 32 nt, Human
cacuccgggaaagcccucugcccacacccaca

SEQ ID NO: 347952 - RNA, 32 nt, Human
cacuccgggcugggcgacagagcgagacccug

SEQ ID NO: 347953 - RNA, 32 nt, Human
cacuccggggccugugccgccagaaccgggcu

SEQ ID NO: 347954 - RNA, 32 nt, Human
cacuccguagugugcacuuggugagggcagca

SEQ ID NO: 347955 - RNA, 32 nt, Human
cacuccgucauccaagcuggagugcaguggug

SEQ ID NO: 347956 - RNA, 32 nt, Human
cacuccguccugggugacaaagugagacuccc

SEQ ID NO: 347957 - RNA, 32 nt, Human
cacuccgucucuggagcccaccagggaaggcc

SEQ ID NO: 347958 - RNA, 32 nt, Human
cacuccgugcaacugauagugcaucagccgac

SEQ ID NO: 347959 - RNA, 32 nt, Human
cacuccgugccuggcucccccuuggcaggugu

SEQ ID NO: 347960 - RNA, 32 nt, Human
cacuccgugcuggaaguaggaggagagucagg

SEQ ID NO: 347961 - RNA, 32 nt, Human
cacuccguugccaggcuggagugcuguggcgc

SEQ ID NO: 347962 - RNA, 32 nt, Human
cacuccuaaaaccaaaaacaacagugacaaua

SEQ ID NO: 347963 - RNA, 32 nt, Human
cacuccuacuaccaauggccacugugagccac

SEQ ID NO: 347964 - RNA, 32 nt, Human
cacuccuacuccuucucuuacugugccacugg

SEQ ID NO: 347965 - RNA, 32 nt, Human
cacuccuacugaggcuugcaggcaaagaggaa

SEQ ID NO: 347966 - RNA, 32 nt, Human
cacuccuacugccagucccaggcucuauucuu

SEQ ID NO: 347967 - RNA, 32 nt, Human
cacuccuagagaaagguacacaguuguccggc

SEQ ID NO: 347968 - RNA, 32 nt, Human
cacuccuaucucaggcuuagaggauuagauua

SEQ ID NO: 347969 - RNA, 32 nt, Human
cacuccucacuggcugguucacuguguucuga

SEQ ID NO: 347970 - RNA, 32 nt, Human
cacuccucagcuuuaauggguguggccccuuu

SEQ ID NO: 347971 - RNA, 32 nt, Human
cacuccucaugugccauuuuguccucagaggg

SEQ ID NO: 347972 - RNA, 32 nt, Human
cacuccucauucauaaggugguggugaggauu

SEQ ID NO: 347973 - RNA, 32 nt, Human
cacuccucccauuuucaccugcccccauuuug

SEQ ID NO: 347974 - RNA, 32 nt, Human
cacuccuccccaccucaaccagucccugcugg

SEQ ID NO: 347975 - RNA, 32 nt, Human
cacuccuccccacugcugacaucccccacaag

SEQ ID NO: 347976 - RNA, 32 nt, Human
cacuccuccgugggugacagagcgagaccuga

SEQ ID NO: 347977 - RNA, 32 nt, Human
cacuccucgaugcccagugaaaccagacugug

SEQ ID NO: 347978 - RNA, 32 nt, Human
cacuccucguccacuuucauguuccucccaua

SEQ ID NO: 347979 - RNA, 32 nt, Human
cacuccucuacccucugggcaccagaaggcuc

SEQ ID NO: 347980 - RNA, 32 nt, Human
cacuccucuccucugcucucgugcguccugga

SEQ ID NO: 347981 - RNA, 32 nt, Human
cacuccucugacucagggcuccuggguuuugu

SEQ ID NO: 347982 - RNA, 32 nt, Human
cacuccucuguagaugugugcccagugggagu

SEQ ID NO: 347983 - RNA, 32 nt, Human
cacuccucuuucuccucuccucagccuuacag

SEQ ID NO: 347984 - RNA, 32 nt, Human
cacuccugaauugucuccucucccucugcaug

SEQ ID NO: 347985 - RNA, 32 nt, Human
cacuccugacagaaugaaugcccucgauggug

SEQ ID NO: 347986 - RNA, 31 nt, Human
cacuccugacuucucccagccucgagaauug

SEQ ID NO: 347987 - RNA, 32 nt, Human
cacuccugcaacaacaacaaauacggcugaua

SEQ ID NO: 347988 - RNA, 32 nt, Human
cacuccugcaugggcgacugagacucugucuc

SEQ ID NO: 347989 - RNA, 32 nt, Human
cacuccugcccuccucuuccuccuccuccucc

SEQ ID NO: 347990 - RNA, 32 nt, Human
cacuccugccugggugacaaagugagacucug

SEQ ID NO: 347991 - RNA, 32 nt, Human
cacuccugccugggugacagaagagacccugu

SEQ ID NO: 347992 - RNA, 32 nt, Human
cacuccugcucugguccgagggagaucucagg

SEQ ID NO: 347993 - RNA, 32 nt, Human
cacuccugcuguuccagccucugcaggugaag

SEQ ID NO: 347994 - RNA, 31 nt, Human
cacuccugcuucucugggggccucuuucugu

SEQ ID NO: 347995 - RNA, 32 nt, Human
cacuccuggacagugauccugaugucuguugu

SEQ ID NO: 347996 - RNA, 32 nt, Human
cacuccuggcccaagacaggggccgcaggcuu

SEQ ID NO: 347997 - RNA, 22 nt, Human
cacuccugggaacugucuggca

SEQ ID NO: 347998 - RNA, 32 nt, Human
cacuccugggagcucaggaggcuucugagcuu

SEQ ID NO: 347999 - RNA, 32 nt, Human
cacuccugggcaacagagcaagacuucgucuc

SEQ ID NO: 348000 - RNA, 32 nt, Human
cacuccugggcccgggcagcagaccagucagc

SEQ ID NO: 348001 - RNA, 32 nt, Human
cacuccugggcuggguaaacaggucaucagca

SEQ ID NO: 348002 - RNA, 32 nt, Human
cacuccugguucugcugggccuguggcugcca

SEQ ID NO: 348003 - RNA, 32 nt, Human
cacuccuguaaucccagcuacuggggaggcug

SEQ ID NO: 348004 - RNA, 32 nt, Human
cacuccuguaaucccagcuacuuaggaggcug

SEQ ID NO: 348005 - RNA, 32 nt, Human
cacuccuguagucccagcacuuugggaggcug

SEQ ID NO: 348006 - RNA, 32 nt, Human
cacuccuguagucccagcuaaucaggaggcug

SEQ ID NO: 348007 - RNA, 32 nt, Human
cacuccuguagucccagcuacuaggaaggcug

SEQ ID NO: 348008 - RNA, 32 nt, Human
cacuccuguagucccaggacuuugggaggccg

SEQ ID NO: 348009 - RNA, 32 nt, Human
cacuccuguccugugcuggcuuuucuggaacg

SEQ ID NO: 348010 - RNA, 32 nt, Human
cacuccugucuucuggcuucagucuggaagau

SEQ ID NO: 348011 - RNA, 32 nt, Human
cacuccuuagaaguggggcacagcagggguga

SEQ ID NO: 348012 - RNA, 32 nt, Human
cacuccuuagaugacugacacacagauugcaa

SEQ ID NO: 348013 - RNA, 32 nt, Human
cacuccuucccaaaucugucuccccagaagac

SEQ ID NO: 348014 - RNA, 32 nt, Human
cacuccuucucccccaacucccagcccugccu

SEQ ID NO: 348015 - RNA, 32 nt, Human
cacuccuucugggcugaccagugaguccccca

SEQ ID NO: 348016 - RNA, 32 nt, Human
cacuccuugcaaccugugugacugggggcaag

SEQ ID NO: 348017 - RNA, 32 nt, Human
cacuccuugcugcugccggcgguuccagccug

SEQ ID NO: 348018 - RNA, 32 nt, Human
cacuccuuuucuccucuuggcuacauuaaaau

SEQ ID NO: 348019 - RNA, 32 nt, Human
cacucgacuuuccucuuaggaaccuggccugg

SEQ ID NO: 348020 - RNA, 32 nt, Human
cacucgagaagcaggaggccguucccugacag

SEQ ID NO: 348021 - RNA, 32 nt, Human
cacucgagccugggugacagagugagacuccg

SEQ ID NO: 348022 - RNA, 32 nt, Human
cacucgagccugggugacagggcaagacccug

SEQ ID NO: 348023 - RNA, 32 nt, Human
cacucgaggccuggggaaggggacucaggggc

SEQ ID NO: 348024 - RNA, 19 nt, Human
cacucgcaaggggacucuu

SEQ ID NO: 348025 - RNA, 32 nt, Human
cacucgcacgcucagggccacacucacacgcc

SEQ ID NO: 348026 - RNA, 32 nt, Human
cacucgcacugcaaaugccgcucucacguaug

SEQ ID NO: 348027 - RNA, 32 nt, Human
cacucgcugaggccaggcagcgcugcggagag

SEQ ID NO: 348028 - RNA, 32 nt, Human
cacucgcugccacaagugccuccuggaaaagc

SEQ ID NO: 348029 - RNA, 32 nt, Human
cacucgcuuuccagcaccucaacacggacucg

SEQ ID NO: 348030 - RNA, 20 nt, Human
cacucggauguccccugcca

SEQ ID NO: 348031 - RNA, 32 nt, Human
cacucggcacacugaagcacaugcgugggcag

SEQ ID NO: 348032 - RNA, 32 nt, Human
cacucggccaauccgcaucucagcccucucag

SEQ ID NO: 348033 - RNA, 23 nt, Human
cacucggcugggcacagugacgu

SEQ ID NO: 348034 - RNA, 32 nt, Human
cacucgggaggcugagacaggagaaucgcuua

SEQ ID NO: 348035 - RNA, 32 nt, Human
cacucgggaggcugaggcaggagaaucgcugg

SEQ ID NO: 348036 - RNA, 32 nt, Human
cacucgggccaaguaaacuugagagguuuaau

SEQ ID NO: 348037 - RNA, 32 nt, Human
cacucgucaccccagcccucggguccauagag

SEQ ID NO: 348038 - RNA, 32 nt, Human
cacucgucaccccagcuggagugcaguggugc

SEQ ID NO: 348039 - RNA, 32 nt, Human
cacucgucccccuccugccucaucuuccuucu

SEQ ID NO: 348040 - RNA, 32 nt, Human
cacucgucuuaguugcuucacacuggucacug

SEQ ID NO: 348041 - RNA, 32 nt, Human
cacucgugaugucgcgcauccgauaggcccuu

SEQ ID NO: 348042 - RNA, 32 nt, Human
cacucgugcacucacacauacaugcccacaca

SEQ ID NO: 348043 - RNA, 32 nt, Human
cacucguugcccaggcuggagugcaguggcgc

SEQ ID NO: 348044 - RNA, 32 nt, Human
cacucguugcccaggcuggaguguagaggcga

SEQ ID NO: 348045 - RNA, 32 nt, Human
cacucguuuccgaacugccucuccccaaagaa

SEQ ID NO: 348046 - RNA, 31 nt, Human
cacucuaaaccuagggagguugaagaaugag

SEQ ID NO: 348047 - RNA, 32 nt, Human
cacucuaacgaguuuucagucucucuguaugc

SEQ ID NO: 348048 - RNA, 32 nt, Human
cacucuaaguuuggagcuauuucuugauggaa

SEQ ID NO: 348049 - RNA, 32 nt, Human
cacucuaccagggaaguaugguauuggauuua

SEQ ID NO: 348050 - RNA, 32 nt, Human
cacucuaccucuaccagcgcacugauggucac

SEQ ID NO: 348051 - RNA, 23 nt, Human
cacucuacguggcacuggcccag

SEQ ID NO: 348052 - RNA, 21 nt, Human
cacucuacuccagccugggca

SEQ ID NO: 348053 - RNA, 32 nt, Human
cacucuacucugggugacagaaugagacccca

SEQ ID NO: 348054 - RNA, 32 nt, Human
cacucuagaaggccgaggcgggcggaucaccu

SEQ ID NO: 348055 - RNA, 32 nt, Human
cacucuagcccggacgacagagcgagacuguc

SEQ ID NO: 348056 - RNA, 32 nt, Human
cacucuagccggagugacagaguaagacucug

SEQ ID NO: 348057 - RNA, 32 nt, Human
cacucuagccggggcgacagagcgagacucug

SEQ ID NO: 348058 - RNA, 32 nt, Human
cacucuagccuacauagagcuuucuguugcug

SEQ ID NO: 348059 - RNA, 32 nt, Human
cacucuagccuaggugacagagugagacucca

SEQ ID NO: 348060 - RNA, 32 nt, Human
cacucuagccuagguggcugagcgagacucca

SEQ ID NO: 348061 - RNA, 32 nt, Human
cacucuagccucggugacagaguaagauucca

SEQ ID NO: 348062 - RNA, 23 nt, Human
cacucuagccugagcaacaagag

SEQ ID NO: 348063 - RNA, 32 nt, Human
cacucuagccugagugacagagcagacuccug

SEQ ID NO: 348064 - RNA, 32 nt, Human
cacucuagccugggauacagagcuagacucca

SEQ ID NO: 348065 - RNA, 32 nt, Human
cacucuagccugggcaacagagcaaggcucug

SEQ ID NO: 348066 - RNA, 32 nt, Human
cacucuagccugggcaacagagcgagacucug

SEQ ID NO: 348067 - RNA, 32 nt, Human
cacucuagccugggcaacagaguaagacaaaa

SEQ ID NO: 348068 - RNA, 32 nt, Human
cacucuagccugggcaacagagugagaucccg

SEQ ID NO: 348069 - RNA, 32 nt, Human
cacucuagccugggcaagagaacaagauccug

SEQ ID NO: 348070 - RNA, 32 nt, Human
cacucuagccugggcaauaagagcaagacugu

SEQ ID NO: 348071 - RNA, 32 nt, Human
cacucuagccugggccacagggcgagacuccg

SEQ ID NO: 348072 - RNA, 32 nt, Human
cacucuagccugggccauagagcgagagucca

SEQ ID NO: 348073 - RNA, 32 nt, Human
cacucuagccugggcgacagagcaagacuguc

SEQ ID NO: 348074 - RNA, 32 nt, Human
cacucuagccugggcgacagagcgagacucca

SEQ ID NO: 348075 - RNA, 32 nt, Human
cacucuagccugggcgacagagugagacucug

SEQ ID NO: 348076 - RNA, 32 nt, Human
cacucuagccugggcuacagagcgagacucug

SEQ ID NO: 348077 - RNA, 32 nt, Human
cacucuagccuggggaacagagugaggcccug

SEQ ID NO: 348078 - RNA, 32 nt, Human
cacucuagccuggggaauagagugagauccug

SEQ ID NO: 348079 - RNA, 32 nt, Human
cacucuagccugggggaagagugagacucugu

SEQ ID NO: 348080 - RNA, 32 nt, Human
cacucuagccugggugaaagagcgaaacucca

SEQ ID NO: 348081 - RNA, 32 nt, Human
cacucuagccugggugacaaagcaagacucca

SEQ ID NO: 348082 - RNA, 32 nt, Human
cacucuagccugggugacagagagagacuccg

SEQ ID NO: 348083 - RNA, 32 nt, Human
cacucuagccugggugacagagcaagacucug

SEQ ID NO: 348084 - RNA, 32 nt, Human
cacucuagccugggugacagagcgagaccuug

SEQ ID NO: 348085 - RNA, 32 nt, Human
cacucuagccugggugacagagcgagacucca

SEQ ID NO: 348086 - RNA, 32 nt, Human
cacucuagccugggugacagagucagacuccg

SEQ ID NO: 348087 - RNA, 32 nt, Human
cacucuagccugggugacagagugagacucca

SEQ ID NO: 348088 - RNA, 32 nt, Human
cacucuagccugggugacagugugagacucug

SEQ ID NO: 348089 - RNA, 32 nt, Human
cacucuagccugggugaccgagggaggcucug

SEQ ID NO: 348090 - RNA, 32 nt, Human
cacucuagccugugugacagagcaagacccug

SEQ ID NO: 348091 - RNA, 32 nt, Human
cacucuagcucaauauauccucuggggaccau

SEQ ID NO: 348092 - RNA, 32 nt, Human
cacucuagcuugggagacagagcgagacuccg

SEQ ID NO: 348093 - RNA, 32 nt, Human
cacucuaggaagaagacaaaugacagauucug

SEQ ID NO: 348094 - RNA, 32 nt, Human
cacucuaggacucugcacugaauggcugaccu

SEQ ID NO: 348095 - RNA, 32 nt, Human
cacucuaggagaaggaggggaaccagauguua

SEQ ID NO: 348096 - RNA, 32 nt, Human
cacucuaggaggccgaggagggcagaucaacu

SEQ ID NO: 348097 - RNA, 32 nt, Human
cacucuaucacccaagcuggagugcaguggca

SEQ ID NO: 348098 - RNA, 32 nt, Human
cacucuauccucugcacuguuaauaguaaccu

SEQ ID NO: 348099 - RNA, 32 nt, Human
cacucuauugcccaggcuggagugcacuggcg

SEQ ID NO: 348100 - RNA, 32 nt, Human
cacucuauugcucaggcuggagugugguggca

SEQ ID NO: 348101 - RNA, 32 nt, Human
cacucuauuuuggucccugugacauuuuaaau

SEQ ID NO: 348102 - RNA, 32 nt, Human
cacucucaacccaggcaaucacagucauuucc

SEQ ID NO: 348103 - RNA, 19 nt, Human
cacucucaauccuacauca

SEQ ID NO: 348104 - RNA, 32 nt, Human
cacucucacacccaggcuggagugcagucuca

SEQ ID NO: 348105 - RNA, 32 nt, Human
cacucucacagaaccgggcauguguuucaacc

SEQ ID NO: 348106 - RNA, 32 nt, Human
cacucucacagucacacacaugcacucaccac

SEQ ID NO: 348107 - RNA, 32 nt, Human
cacucucacccaggcuggagugcaguggcaca

SEQ ID NO: 348108 - RNA, 32 nt, Human
cacucucagaggauuccagacacacaccacuc

SEQ ID NO: 348109 - RNA, 32 nt, Human
cacucucagagguaccucaagagaccaaagag

SEQ ID NO: 348110 - RNA, 32 nt, Human
cacucucagccugggagacuccugccaagccc

SEQ ID NO: 348111 - RNA, 32 nt, Human
cacucucaggggccucuuucagcuggggcugg

SEQ ID NO: 348112 - RNA, 32 nt, Human
cacucucaugcuugccgcaucaugccucccug

SEQ ID NO: 348113 - RNA, 32 nt, Human
cacucucaugucuuaaguucagcuggugcuau

SEQ ID NO: 348114 - RNA, 32 nt, Human
cacucuccagcagaaugucugcuugugucuag

SEQ ID NO: 348115 - RNA, 32 nt, Human
cacucuccagccuuuuccuggcugaggagggg

SEQ ID NO: 348116 - RNA, 32 nt, Human
cacucuccaucuuucccaaagucacuccagga

SEQ ID NO: 348117 - RNA, 32 nt, Human
cacucucccacuguacccaccccuaaaucauu

SEQ ID NO: 348118 - RNA, 32 nt, Human
cacucucccccuccucuucuggucuggcggcu

SEQ ID NO: 348119 - RNA, 32 nt, Human
cacucuccccuccuccaaacuucaacuccucc

SEQ ID NO: 348120 - RNA, 32 nt, Human
cacucucccucugcuacugcugcugaucugaa

SEQ ID NO: 348121 - RNA, 32 nt, Human
cacucucccuggcaggagcccgccuggcacag

SEQ ID NO: 348122 - RNA, 32 nt, Human
cacucuccuccaccggcgccucccccuccgcu

SEQ ID NO: 348123 - RNA, 32 nt, Human
cacucuccuccccucuuuuccuuccuuccuac

SEQ ID NO: 348124 - RNA, 32 nt, Human
cacucuccucgcccaguuucugaggucagacg

SEQ ID NO: 348125 - RNA, 32 nt, Human
cacucuccuuuuucugggucccuucccacuuc

SEQ ID NO: 348126 - RNA, 32 nt, Human
cacucucucagggacauccauucuguaccagc

SEQ ID NO: 348127 - RNA, 32 nt, Human
cacucucucaucauccuguuccuuggauugga

SEQ ID NO: 348128 - RNA, 32 nt, Human
cacucucuccacccucccuucaccucccucuu

SEQ ID NO: 348129 - RNA, 32 nt, Human
cacucucucgcccaggcuggagugcaacggua

SEQ ID NO: 348130 - RNA, 32 nt, Human
cacucucucgcccaggcuggagugcaguggcg

SEQ ID NO: 348131 - RNA, 32 nt, Human
cacucucuggagguggagacugccgugauuca

SEQ ID NO: 348132 - RNA, 32 nt, Human
cacucucuggccgaaguggccgcaggcugugc

SEQ ID NO: 348133 - RNA, 32 nt, Human
cacucucugggagcuugaagcugccauguaau

SEQ ID NO: 348134 - RNA, 32 nt, Human
cacucucuguucuugcuaucuaauggccgcug

SEQ ID NO: 348135 - RNA, 32 nt, Human
cacucucuuaaccugcccucccugcacucgcu

SEQ ID NO: 348136 - RNA, 32 nt, Human
cacucucuuaggggcuauggggcaguuagcag

SEQ ID NO: 348137 - RNA, 32 nt, Human
cacucucuucaguuguugaggugccagaagag

SEQ ID NO: 348138 - RNA, 32 nt, Human
cacucucuuccacgaagagucaaugggacugg

SEQ ID NO: 348139 - RNA, 32 nt, Human
cacucucuucuuacuucugucacucuuccuuc

SEQ ID NO: 348140 - RNA, 32 nt, Human
cacucucuucuuuagaccccuaccuuugcccu

SEQ ID NO: 348141 - RNA, 32 nt, Human
cacucucuucuuuccacuuccuucucaucuuu

SEQ ID NO: 348142 - RNA, 32 nt, Human
cacucucuugcccaggcuggagugcaguggua

SEQ ID NO: 348143 - RNA, 32 nt, Human
cacucucuuucucucucccucuggcaugcaug

SEQ ID NO: 348144 - RNA, 32 nt, Human
cacucucuuugccuccccugaaucuguguggu

SEQ ID NO: 348145 - RNA, 32 nt, Human
cacucugaacaucaccuccuguacuuccagcu

SEQ ID NO: 348146 - RNA, 32 nt, Human
cacucugaagccacagcccgagcuguauguug

SEQ ID NO: 348147 - RNA, 32 nt, Human
cacucugaccaccaccuccuagcuauccaggu

SEQ ID NO: 348148 - RNA, 17 nt, Human
cacucugagccuacuga

SEQ ID NO: 348149 - RNA, 32 nt, Human
cacucugagggcccuggacugggccugagcuu

SEQ ID NO: 348150 - RNA, 32 nt, Human
cacucugauuggcagccugcuuugccaaagag

SEQ ID NO: 348151 - RNA, 32 nt, Human
cacucugcaagcccuucaggugcucaaguacu

SEQ ID NO: 348152 - RNA, 32 nt, Human
cacucugcacacaagagaaaucaacuucgugg

SEQ ID NO: 348153 - RNA, 32 nt, Human
cacucugcacucucccccucuauggaucagga

SEQ ID NO: 348154 - RNA, 32 nt, Human
cacucugcagaggcugagaugcacccaucuag

SEQ ID NO: 348155 - RNA, 32 nt, Human
cacucugcagcucaccaugcagcugaugccaa

SEQ ID NO: 348156 - RNA, 32 nt, Human
cacucugccaaggacggaggucgcauugcugu

SEQ ID NO: 348157 - RNA, 32 nt, Human
cacucugccacccaagcuggagugcaguggca

SEQ ID NO: 348158 - RNA, 32 nt, Human
cacucugccauuuuggaacugaucucauuuca

SEQ ID NO: 348159 - RNA, 21 nt, Human
cacucugccccagcucccugg

SEQ ID NO: 348160 - RNA, 32 nt, Human
cacucugccucauuucugccuccaggaugcca

SEQ ID NO: 348161 - RNA, 32 nt, Human
cacucugccucccugucaccucaggcuugacc

SEQ ID NO: 348162 - RNA, 32 nt, Human
cacucugcgccccucgaucucccaggcucuuu

SEQ ID NO: 348163 - RNA, 32 nt, Human
cacucugcuaagccugguuuucuugagcagag

SEQ ID NO: 348164 - RNA, 32 nt, Human
cacucugcucaauccaaaucacagcucucccg

SEQ ID NO: 348165 - RNA, 32 nt, Human
cacucugcugcccagccaccaggauuucugcc

SEQ ID NO: 348166 - RNA, 32 nt, Human
cacucugcugcccaggcuggaguacaguggca

SEQ ID NO: 348167 - RNA, 32 nt, Human
cacucugcugccuaggcugagugcaguggugu

SEQ ID NO: 348168 - RNA, 32 nt, Human
cacucugcugcucaggcuggagugcaguggug

SEQ ID NO: 348169 - RNA, 32 nt, Human
cacucugcuuccuuggacaauaucaguaauag

SEQ ID NO: 348170 - RNA, 32 nt, Human
cacucugcuuugcccaagugugacagcacugg

SEQ ID NO: 348171 - RNA, 32 nt, Human
cacucuggaaagaagagagaagugaaggcucu

SEQ ID NO: 348172 - RNA, 32 nt, Human
cacucuggaagccacaguggaguccucugcuu

SEQ ID NO: 348173 - RNA, 32 nt, Human
cacucuggagagaagccauaugaauguaagga

SEQ ID NO: 348174 - RNA, 32 nt, Human
cacucuggaggcggcggcagccagcgagggag

SEQ ID NO: 348175 - RNA, 32 nt, Human
cacucuggagugucuuugggaggcaggcuauu

SEQ ID NO: 348176 - RNA, 32 nt, Human
cacucuggauccagugacagcaggugucaugg

SEQ ID NO: 348177 - RNA, 32 nt, Human
cacucuggccacuccuccucugguggcaugag

SEQ ID NO: 348178 - RNA, 32 nt, Human
cacucuggccugcaugcacucuggccugcaug

SEQ ID NO: 348179 - RNA, 32 nt, Human
cacucuggccugcuuuguucccuucccugucc

SEQ ID NO: 348180 - RNA, 32 nt, Human
cacucuggcgcucuggagugcaguggugugau

SEQ ID NO: 348181 - RNA, 32 nt, Human
cacucuggcucaagccuguaaucccagcacuu

SEQ ID NO: 348182 - RNA, 32 nt, Human
cacucugggaggagaggguggagaaagcacuu

SEQ ID NO: 348183 - RNA, 32 nt, Human
cacucugggaggccaaggugggcagaucacga

SEQ ID NO: 348184 - RNA, 32 nt, Human
cacucugggaggccaagguggguugaucacuu

SEQ ID NO: 348185 - RNA, 32 nt, Human
cacucugggaggccgaggcgggaagaucacuu

SEQ ID NO: 348186 - RNA, 32 nt, Human
cacucugggaggccgaggcggguggaucaccu

SEQ ID NO: 348187 - RNA, 32 nt, Human
cacucugggaggccgagguggauggaucaccu

SEQ ID NO: 348188 - RNA, 32 nt, Human
cacucugggaggcugaggcgggcagaucaccu

SEQ ID NO: 348189 - RNA, 32 nt, Human
cacucugggaggcugaggcggguggaucacga

SEQ ID NO: 348190 - RNA, 32 nt, Human
cacucugggcagcucuaggcucagcagauguu

SEQ ID NO: 348191 - RNA, 32 nt, Human
cacucugggcugcuccagccugcaacuuagug

SEQ ID NO: 348192 - RNA, 32 nt, Human
cacucuggggacccgcugggggcuggcagagg

SEQ ID NO: 348193 - RNA, 32 nt, Human
cacucuggggcccagccugccugccgcacccc

SEQ ID NO: 348194 - RNA, 31 nt, Human
cacucuggguuccacagcacagcagacaugg

SEQ ID NO: 348195 - RNA, 32 nt, Human
cacucuggucccuauuccccagcuccuaggca

SEQ ID NO: 348196 - RNA, 32 nt, Human
cacucuggucucaaacuccugggcucaaccaa

SEQ ID NO: 348197 - RNA, 32 nt, Human
cacucuguaacccaggcuggagugcaguggcc

SEQ ID NO: 348198 - RNA, 32 nt, Human
cacucuguagcccagucuggagugcaguggua

SEQ ID NO: 348199 - RNA, 32 nt, Human
cacucuguagcccagucuggagugcaguggug

SEQ ID NO: 348200 - RNA, 32 nt, Human
cacucugucaaccaggcuggagugcacuggcg

SEQ ID NO: 348201 - RNA, 32 nt, Human
cacucugucacacaggcuggagugcaguacaa

SEQ ID NO: 348202 - RNA, 32 nt, Human
cacucugucacacaggcuggagugcaguggca

SEQ ID NO: 348203 - RNA, 32 nt, Human
cacucugucaccagacuggagugcaguggcgc

SEQ ID NO: 348204 - RNA, 32 nt, Human
cacucugucaccaggcuagagugcaguggcac

SEQ ID NO: 348205 - RNA, 32 nt, Human
cacucugucaccaggcuggagugcagugccgc

SEQ ID NO: 348206 - RNA, 32 nt, Human
cacucugucaccaggcuggagugcaguggcgc

SEQ ID NO: 348207 - RNA, 32 nt, Human
cacucugucacccaagauggagugcaauggca

SEQ ID NO: 348208 - RNA, 32 nt, Human
cacucugucacccaagcuggagugcacuggca

SEQ ID NO: 348209 - RNA, 32 nt, Human
cacucugucacccaagcuggagugcaguggug

SEQ ID NO: 348210 - RNA, 32 nt, Human
cacucugucacccaaggcggagugcagugacg

SEQ ID NO: 348211 - RNA, 32 nt, Human
cacucugucacccagacuggagugcagugcca

SEQ ID NO: 348212 - RNA, 32 nt, Human
cacucugucacccagacuggagugcaguggcg

SEQ ID NO: 348213 - RNA, 32 nt, Human
cacucugucacccaggccaaguucaauggugc

SEQ ID NO: 348214 - RNA, 32 nt, Human
cacucugucacccaggcgggaguuagguggca

SEQ ID NO: 348215 - RNA, 32 nt, Human
cacucugucacccaggcugaagugcaguggua

SEQ ID NO: 348216 - RNA, 32 nt, Human
cacucugucacccaggcugcagugcaauggcg

SEQ ID NO: 348217 - RNA, 32 nt, Human
cacucugucacccaggcugcaguguaguggug

SEQ ID NO: 348218 - RNA, 32 nt, Human
cacucugucacccaggcuggaaugacgaagug

SEQ ID NO: 348219 - RNA, 32 nt, Human
cacucugucacccaggcuggaaugcaguggug

SEQ ID NO: 348220 - RNA, 32 nt, Human
cacucugucacccaggcuggacugcaaugacg

SEQ ID NO: 348221 - RNA, 32 nt, Human
cacucugucacccaggcuggagagcaauugca

SEQ ID NO: 348222 - RNA, 32 nt, Human
cacucugucacccaggcuggaguacaauggcg

SEQ ID NO: 348223 - RNA, 32 nt, Human
cacucugucacccaggcuggaguacagugaca

SEQ ID NO: 348224 - RNA, 32 nt, Human
cacucugucacccaggcuggaguacaguggca

SEQ ID NO: 348225 - RNA, 32 nt, Human
cacucugucacccaggcuggagugcaaugcug

SEQ ID NO: 348226 - RNA, 32 nt, Human
cacucugucacccaggcuggagugcaauggca

SEQ ID NO: 348227 - RNA, 32 nt, Human
cacucugucacccaggcuggagugcaauggcg

SEQ ID NO: 348228 - RNA, 32 nt, Human
cacucugucacccaggcuggagugcaauggug

SEQ ID NO: 348229 - RNA, 32 nt, Human
cacucugucacccaggcuggagugcaguagca

SEQ ID NO: 348230 - RNA, 32 nt, Human
cacucugucacccaggcuggagugcaguagcg

SEQ ID NO: 348231 - RNA, 32 nt, Human
cacucugucacccaggcuggagugcaguggca

SEQ ID NO: 348232 - RNA, 32 nt, Human
cacucugucacccaggcuggagugcaguggcg

SEQ ID NO: 348233 - RNA, 32 nt, Human
cacucugucacccaggcuggagugcaguggcu

SEQ ID NO: 348234 - RNA, 32 nt, Human
cacucugucacccaggcuggagugcaguggua

SEQ ID NO: 348235 - RNA, 32 nt, Human
cacucugucacccaggcuggagugcaguggug

SEQ ID NO: 348236 - RNA, 32 nt, Human
cacucugucacccaggcuggagugcaguguca

SEQ ID NO: 348237 - RNA, 32 nt, Human
cacucugucacccaggcuggagugcgguggcg

SEQ ID NO: 348238 - RNA, 32 nt, Human
cacucugucacccaggcuggaguguaguggca

SEQ ID NO: 348239 - RNA, 32 nt, Human
cacucugucacccaggcuggaguguaguggug

SEQ ID NO: 348240 - RNA, 32 nt, Human
cacucugucacccaggcugggaauugcagugg

SEQ ID NO: 348241 - RNA, 32 nt, Human
cacucugucacccaggcugggaugcaguggcu

SEQ ID NO: 348242 - RNA, 32 nt, Human
cacucugucacccagguuggagugcagcaggg

SEQ ID NO: 348243 - RNA, 32 nt, Human
cacucugucacccuggcuggagugcgguggcg

SEQ ID NO: 348244 - RNA, 32 nt, Human
cacucugucaccgagguuggagugcaguggua

SEQ ID NO: 348245 - RNA, 32 nt, Human
cacucugucaccuaggcuggagugcaguggug

SEQ ID NO: 348246 - RNA, 32 nt, Human
cacucugucaccuaggcuggaguugcaguggu

SEQ ID NO: 348247 - RNA, 32 nt, Human
cacucugucaccuaggcuggauugcaauggug

SEQ ID NO: 348248 - RNA, 32 nt, Human
cacucugucacucaggcuggagugcaaugacg

SEQ ID NO: 348249 - RNA, 32 nt, Human
cacucugucacucaggcuggagugcaguggcg

SEQ ID NO: 348250 - RNA, 32 nt, Human
cacucugucacucaggcuggagugcaguggua

SEQ ID NO: 348251 - RNA, 32 nt, Human
cacucugucacucaggcuggagugcgguggua

SEQ ID NO: 348252 - RNA, 32 nt, Human
cacucugucauccaggcuggagugcaguggca

SEQ ID NO: 348253 - RNA, 32 nt, Human
cacucugucauccaggcuggagugcaguggug

SEQ ID NO: 348254 - RNA, 32 nt, Human
cacucugucccccaggcuggagugcaguggcg

SEQ ID NO: 348255 - RNA, 32 nt, Human
cacucugucgccaggcuggaaugcaguagggc

SEQ ID NO: 348256 - RNA, 32 nt, Human
cacucugucgccaggcuggagugcaguggcgu

SEQ ID NO: 348257 - RNA, 32 nt, Human
cacucugucgccaggcuggagugcaguggugu

SEQ ID NO: 348258 - RNA, 32 nt, Human
cacucugucgcccaagcuggagugcaguggca

SEQ ID NO: 348259 - RNA, 32 nt, Human
cacucugucgcccagacuggagugcaguagcg

SEQ ID NO: 348260 - RNA, 32 nt, Human
cacucugucgcccaggcuagagugcaguggca

SEQ ID NO: 348261 - RNA, 32 nt, Human
cacucugucgcccaggcuagagugcaguggcg

SEQ ID NO: 348262 - RNA, 32 nt, Human
cacucugucgcccaggcuggaaugcaguggca

SEQ ID NO: 348263 - RNA, 32 nt, Human
cacucugucgcccaggcuggaaugcaguggcg

SEQ ID NO: 348264 - RNA, 32 nt, Human
cacucugucgcccaggcuggacuacaauggca

SEQ ID NO: 348265 - RNA, 32 nt, Human
cacucugucgcccaggcuggagggcaguggcg

SEQ ID NO: 348266 - RNA, 32 nt, Human
cacucugucgcccaggcuggagugcaauacug

SEQ ID NO: 348267 - RNA, 32 nt, Human
cacucugucgcccaggcuggagugcaguagcg

SEQ ID NO: 348268 - RNA, 29 nt, Human
cacucugucgcccaggcuggagugcagug

SEQ ID NO: 348269 - RNA, 32 nt, Human
cacucugucgcccaggcuggagugcaguggca

SEQ ID NO: 348270 - RNA, 32 nt, Human
cacucugucgcccaggcuggagugcaguggcg

SEQ ID NO: 348271 - RNA, 32 nt, Human
cacucugucgcccaggcuggagugcaguggug

SEQ ID NO: 348272 - RNA, 32 nt, Human
cacucugucgcccaggcuggagugcaguguca

SEQ ID NO: 348273 - RNA, 32 nt, Human
cacucugucgcccaggcuggggugcaguggcg

SEQ ID NO: 348274 - RNA, 32 nt, Human
cacucugucgcccaggguggagugcgguggca

SEQ ID NO: 348275 - RNA, 32 nt, Human
cacucugucgccugggcuggaguacaguggug

SEQ ID NO: 348276 - RNA, 32 nt, Human
cacucugucgcgccagcuggagugcagugcca

SEQ ID NO: 348277 - RNA, 32 nt, Human
cacucugucgcucaggcuggagugcagugaug

SEQ ID NO: 348278 - RNA, 32 nt, Human
cacucugucguccagguuagagugcaauggcu

SEQ ID NO: 348279 - RNA, 32 nt, Human
cacucugucucccaggcuagagugcaguggug

SEQ ID NO: 348280 - RNA, 32 nt, Human
cacucugucucccaggcuggacugcaguggug

SEQ ID NO: 348281 - RNA, 32 nt, Human
cacucugucucccaggcuggagugcaauggug

SEQ ID NO: 348282 - RNA, 32 nt, Human
cacucugucucccaggcuggagugcaguggag

SEQ ID NO: 348283 - RNA, 32 nt, Human
cacucugucucccaggcuggagugcaguggca

SEQ ID NO: 348284 - RNA, 32 nt, Human
cacucugucucccaggcuggagugcaguggug

SEQ ID NO: 348285 - RNA, 32 nt, Human
cacucugucucccaggcuggagugugauggcg

SEQ ID NO: 348286 - RNA, 32 nt, Human
cacucugucucccaggcuggaguugcaguggu

SEQ ID NO: 348287 - RNA, 32 nt, Human
cacucugucuccuccccuccugccuggguccc

SEQ ID NO: 348288 - RNA, 32 nt, Human
cacucugucugucuccccaagcugggcagccc

SEQ ID NO: 348289 - RNA, 32 nt, Human
cacucugugaggcagcagagccugggcaggug

SEQ ID NO: 348290 - RNA, 32 nt, Human
cacucugugcaggggcccggagcccagcgccc

SEQ ID NO: 348291 - RNA, 32 nt, Human
cacucugugccucugcugagaauccagggcug

SEQ ID NO: 348292 - RNA, 21 nt, Human
cacucuguggccagccuggca

SEQ ID NO: 348293 - RNA, 32 nt, Human
cacucuguggcccaggcuggagugcaguggca

SEQ ID NO: 348294 - RNA, 32 nt, Human
cacucuguggcccaggcuggagugcaguggcg

SEQ ID NO: 348295 - RNA, 32 nt, Human
cacucuguggcccaggcuggagugcaguggug

SEQ ID NO: 348296 - RNA, 32 nt, Human
cacucuguggugucaggcacugggcugugucc

SEQ ID NO: 348297 - RNA, 32 nt, Human
cacucugugucccaggcuggagugcaguggca

SEQ ID NO: 348298 - RNA, 32 nt, Human
cacucugugucucaggcuggaguacaguggug

SEQ ID NO: 348299 - RNA, 32 nt, Human
cacucuguguucaacacacagaacaacauaga

SEQ ID NO: 348300 - RNA, 32 nt, Human
cacucuguuacccaggccggagugcaguggcg

SEQ ID NO: 348301 - RNA, 32 nt, Human
cacucuguuacccaggcuagagugcaguggcg

SEQ ID NO: 348302 - RNA, 32 nt, Human
cacucuguuacccaggcuagaguguaguggca

SEQ ID NO: 348303 - RNA, 32 nt, Human
cacucuguuacccaggcuggaaugcaguggcg

SEQ ID NO: 348304 - RNA, 32 nt, Human
cacucuguuacccaggcuggagugcaauggag

SEQ ID NO: 348305 - RNA, 32 nt, Human
cacucuguucauaagaaaaaggccugaaguga

SEQ ID NO: 348306 - RNA, 32 nt, Human
cacucuguuccccaggccggagugcaguggua

SEQ ID NO: 348307 - RNA, 32 nt, Human
cacucuguuccuacuggagauaccagagacuc

SEQ ID NO: 348308 - RNA, 32 nt, Human
cacucuguugaccaggcuggagugcaguggug

SEQ ID NO: 348309 - RNA, 32 nt, Human
cacucuguugccaaggcuggaaugcaguggcg

SEQ ID NO: 348310 - RNA, 32 nt, Human
cacucuguugccaggcuggaaugcaguggcgu

SEQ ID NO: 348311 - RNA, 32 nt, Human
cacucuguugccaggcuggagugcaguggcgc

SEQ ID NO: 348312 - RNA, 32 nt, Human
cacucuguugcccagacuggagugcaguggca

SEQ ID NO: 348313 - RNA, 32 nt, Human
cacucuguugcccagacuggagugcaguggug

SEQ ID NO: 348314 - RNA, 32 nt, Human
cacucuguugcccagccuggagugcaguggca

SEQ ID NO: 348315 - RNA, 32 nt, Human
cacucuguugcccagccuggagugcagugugu

SEQ ID NO: 348316 - RNA, 32 nt, Human
cacucuguugcccagcuggagugcaguggcgu

SEQ ID NO: 348317 - RNA, 32 nt, Human
cacucuguugcccaggauggagugcaguggug

SEQ ID NO: 348318 - RNA, 32 nt, Human
cacucuguugcccaggcuagagugcaauggca

SEQ ID NO: 348319 - RNA, 32 nt, Human
cacucuguugcccaggcuagagugcacuaaua

SEQ ID NO: 348320 - RNA, 32 nt, Human
cacucuguugcccaggcugaagugcaguggug

SEQ ID NO: 348321 - RNA, 32 nt, Human
cacucuguugcccaggcugagguacaguggcg

SEQ ID NO: 348322 - RNA, 32 nt, Human
cacucuguugcccaggcugcagugcaguggug

SEQ ID NO: 348323 - RNA, 32 nt, Human
cacucuguugcccaggcuggaaugcagugaua

SEQ ID NO: 348324 - RNA, 32 nt, Human
cacucuguugcccaggcuggaaugcaguggua

SEQ ID NO: 348325 - RNA, 32 nt, Human
cacucuguugcccaggcuggacuacaguggca

SEQ ID NO: 348326 - RNA, 32 nt, Human
cacucuguugcccaggcuggaguaaagggcag

SEQ ID NO: 348327 - RNA, 32 nt, Human
cacucuguugcccaggcuggaguacaguggca

SEQ ID NO: 348328 - RNA, 32 nt, Human
cacucuguugcccaggcuggaguacaguggcg

SEQ ID NO: 348329 - RNA, 32 nt, Human
cacucuguugcccaggcuggagugcaauggca

SEQ ID NO: 348330 - RNA, 32 nt, Human
cacucuguugcccaggcuggagugcagugaug

SEQ ID NO: 348331 - RNA, 30 nt, Human
cacucuguugcccaggcuggagugcagugg

SEQ ID NO: 348332 - RNA, 32 nt, Human
cacucuguugcccaggcuggagugcaguggca

SEQ ID NO: 348333 - RNA, 32 nt, Human
cacucuguugcccaggcuggagugcaguggcg

SEQ ID NO: 348334 - RNA, 32 nt, Human
cacucuguugcccaggcuggagugcaguggug

SEQ ID NO: 348335 - RNA, 32 nt, Human
cacucuguugcccaggcuggagugcaguguca

SEQ ID NO: 348336 - RNA, 32 nt, Human
cacucuguugcccaggcuggagugccucuuca

SEQ ID NO: 348337 - RNA, 32 nt, Human
cacucuguugcccaggcuggagugcgauggca

SEQ ID NO: 348338 - RNA, 32 nt, Human
cacucuguugcccaggcuggaguguaguggug

SEQ ID NO: 348339 - RNA, 32 nt, Human
cacucuguugcccaggcuggaguucagcggug

SEQ ID NO: 348340 - RNA, 32 nt, Human
cacucuguugcccaggguggagugcaguggca

SEQ ID NO: 348341 - RNA, 32 nt, Human
cacucuguugcccagucuggagugcaguggcg

SEQ ID NO: 348342 - RNA, 32 nt, Human
cacucuguugcccgggcuggagugcagcggcg

SEQ ID NO: 348343 - RNA, 32 nt, Human
cacucuguugcccuggcuggagugcaguagag

SEQ ID NO: 348344 - RNA, 32 nt, Human
cacucuguugccuagacuggagugcaauggcg

SEQ ID NO: 348345 - RNA, 32 nt, Human
cacucuguugccuaggcuggaggacaguggca

SEQ ID NO: 348346 - RNA, 32 nt, Human
cacucuguugccuaggcuggaguacaguggca

SEQ ID NO: 348347 - RNA, 32 nt, Human
cacucuguugcuaggcuggagugcaguggcac

SEQ ID NO: 348348 - RNA, 32 nt, Human
cacucuguugcucaggcuggagugcaguggca

SEQ ID NO: 348349 - RNA, 32 nt, Human
cacucuguuggccaggcugguuucgaacuccu

SEQ ID NO: 348350 - RNA, 32 nt, Human
cacucuguuguaagcugaauguuaacacacua

SEQ ID NO: 348351 - RNA, 32 nt, Human
cacucuguuguccaggcuggagugcagcgaua

SEQ ID NO: 348352 - RNA, 32 nt, Human
cacucuguuucuggggcugcugaggccccugg

SEQ ID NO: 348353 - RNA, 32 nt, Human
cacucuuaaauacuguacuacuucacuguaag

SEQ ID NO: 348354 - RNA, 32 nt, Human
cacucuuaagggugagaagaauaaccacaauu

SEQ ID NO: 348355 - RNA, 32 nt, Human
cacucuuacccaauuucugggcucuggauccu

SEQ ID NO: 348356 - RNA, 32 nt, Human
cacucuuacuuucuuacucucuucucagguca

SEQ ID NO: 348357 - RNA, 32 nt, Human
cacucuuagguucaccccgcggccgaucgucc

SEQ ID NO: 348358 - RNA, 32 nt, Human
cacucuuaucagcuuagaguguucaacugauc

SEQ ID NO: 348359 - RNA, 32 nt, Human
cacucuuaugcccacgcuggagugcagugagc

SEQ ID NO: 348360 - RNA, 32 nt, Human
cacucuuauuggccaggcaggggcucccacag

SEQ ID NO: 348361 - RNA, 32 nt, Human
cacucuucacagguaguucacacucugagacu

SEQ ID NO: 348362 - RNA, 32 nt, Human
cacucuucacucaggcugcagugcaguggcgc

SEQ ID NO: 348363 - RNA, 32 nt, Human
cacucuucagccaggggaguggguaggccaua

SEQ ID NO: 348364 - RNA, 32 nt, Human
cacucuucaguucugaaauagacagacuugag

SEQ ID NO: 348365 - RNA, 32 nt, Human
cacucuuccacugacuugcugugugaccuuag

SEQ ID NO: 348366 - RNA, 32 nt, Human
cacucuucccucucaucaucauggccccaccg

SEQ ID NO: 348367 - RNA, 32 nt, Human
cacucuuccuacccucucccuccuaacccucu

SEQ ID NO: 348368 - RNA, 32 nt, Human
cacucuuccucuucuccuuuuuccgcacuucu

SEQ ID NO: 348369 - RNA, 32 nt, Human
cacucuucugagaaggcuuugccuccucguac

SEQ ID NO: 348370 - RNA, 32 nt, Human
cacucuugaccuggagccaucuuccuaguggg

SEQ ID NO: 348371 - RNA, 32 nt, Human
cacucuugagccacaauaccugucaccagccu

SEQ ID NO: 348372 - RNA, 32 nt, Human
cacucuugauuacacuggcagcucuaugagua

SEQ ID NO: 348373 - RNA, 32 nt, Human
cacucuugcccaggcuggagcgcaaguggcgc

SEQ ID NO: 348374 - RNA, 32 nt, Human
cacucuugcccaggcuggagugcaguggugcg

SEQ ID NO: 348375 - RNA, 32 nt, Human
cacucuugcccaggcuggggugucguggcgug

SEQ ID NO: 348376 - RNA, 32 nt, Human
cacucuugcccaggcuguagugcuguggcacg

SEQ ID NO: 348377 - RNA, 32 nt, Human
cacucuugcccaguggaggguguccaaagugc

SEQ ID NO: 348378 - RNA, 32 nt, Human
cacucuugcugucugucuuucuugccuucuuu

SEQ ID NO: 348379 - RNA, 32 nt, Human
cacucuugggcccugguuuuguuaugauuugg

SEQ ID NO: 348380 - RNA, 32 nt, Human
cacucuuguagucccagcuauuugggaggcug

SEQ ID NO: 348381 - RNA, 32 nt, Human
cacucuugucuggagacaggcaggacaaugga

SEQ ID NO: 348382 - RNA, 32 nt, Human
cacucuugucugggugacagagugagaccccu

SEQ ID NO: 348383 - RNA, 32 nt, Human
cacucuugugcccaggcuggagugcaauagcu

SEQ ID NO: 348384 - RNA, 32 nt, Human
cacucuuguugcccaggcggagugcaguggaa

SEQ ID NO: 348385 - RNA, 32 nt, Human
cacucuuguugccuagcuggagugcaauggcg

SEQ ID NO: 348386 - RNA, 32 nt, Human
cacucuuucaauccugcgaagggagacccugu

SEQ ID NO: 348387 - RNA, 32 nt, Human
cacucuuucacccaggcuggagugcaguggca

SEQ ID NO: 348388 - RNA, 32 nt, Human
cacucuuucagagaaaccucagcuucaucaca

SEQ ID NO: 348389 - RNA, 32 nt, Human
cacucuuucaggccucuuucugccuuuuguug

SEQ ID NO: 348390 - RNA, 32 nt, Human
cacucuuucaugucacaauagcguggagcauu

SEQ ID NO: 348391 - RNA, 32 nt, Human
cacucuuucccaggcugcaguacagugacaca

SEQ ID NO: 348392 - RNA, 32 nt, Human
cacucuuucgcccaggcuggagugcaguggua

SEQ ID NO: 348393 - RNA, 32 nt, Human
cacucuuugggcaggggcgacauggcacaccu

SEQ ID NO: 348394 - RNA, 32 nt, Human
cacucuuuguugcccaggcuggagugcaaugg

SEQ ID NO: 348395 - RNA, 32 nt, Human
cacugaaacauccuuugguucucaagcuucuu

SEQ ID NO: 348396 - RNA, 23 nt, Human
cacugaaacauuucuccagaacc

SEQ ID NO: 348397 - RNA, 32 nt, Human
cacugaaacuauacuugaacaguuccaacugu

SEQ ID NO: 348398 - RNA, 32 nt, Human
cacugaaagauaagcugggagauacugaagau

SEQ ID NO: 348399 - RNA, 23 nt, Human
cacugaaagcaaggaaagccuga

SEQ ID NO: 348400 - RNA, 22 nt, Human
cacugaaagccuggugagcaga

SEQ ID NO: 348401 - RNA, 22 nt, Human
cacugaaagucccgcugccagg

SEQ ID NO: 348402 - RNA, 32 nt, Human
cacugaacaaaguuggagguuggggugggugu

SEQ ID NO: 348403 - RNA, 20 nt, Human
cacugaacccagugcuuuca

SEQ ID NO: 348404 - RNA, 32 nt, Human
cacugaaccuuaaggcuuuguaugacagugaa

SEQ ID NO: 348405 - RNA, 21 nt, Human
cacugaacuccagccugggca

SEQ ID NO: 348406 - RNA, 32 nt, Human
cacugaagaaaaucuguggugaagggaacauc

SEQ ID NO: 348407 - RNA, 32 nt, Human
cacugaagaacucuuguccucacuggcugaug

SEQ ID NO: 348408 - RNA, 32 nt, Human
cacugaagacccagcaauccugaguucagaaa

SEQ ID NO: 348409 - RNA, 32 nt, Human
cacugaagagccugagucccaggaggccuccu

SEQ ID NO: 348410 - RNA, 19 nt, Human
cacugaagagggacagcaa

SEQ ID NO: 348411 - RNA, 32 nt, Human
cacugaagccauuuaguggcuaacccacugug

SEQ ID NO: 348412 - RNA, 32 nt, Human
cacugaagccuggaugacagagugagaccuua

SEQ ID NO: 348413 - RNA, 32 nt, Human
cacugaagcuauaaauuaccuggucauuuugu

SEQ ID NO: 348414 - RNA, 22 nt, Human
cacugaagcugaacagcagcag

SEQ ID NO: 348415 - RNA, 32 nt, Human
cacugaagcugcacucugaaaacugggcaguu

SEQ ID NO: 348416 - RNA, 32 nt, Human
cacugaagcugcaggcuagaucaaggggacca

SEQ ID NO: 348417 - RNA, 32 nt, Human
cacugaagcuuagaggagugaaauguuuugag

SEQ ID NO: 348418 - RNA, 25 nt, Human
cacugaaggaaaaagaacauggaga

SEQ ID NO: 348419 - RNA, 32 nt, Human
cacugaaggccgugcaccuccaccuccagccu

SEQ ID NO: 348420 - RNA, 32 nt, Human
cacugaaggcugaggggccucaguuuacccag

SEQ ID NO: 348421 - RNA, 32 nt, Human
cacugaagggcuuguuuaaaaauaaauugugu

SEQ ID NO: 348422 - RNA, 32 nt, Human
cacugaaggggguaggggcaguguagguccug

SEQ ID NO: 348423 - RNA, 32 nt, Human
cacugaagguaggccaggcaugguggcucaug

SEQ ID NO: 348424 - RNA, 32 nt, Human
cacugaagucaccauuaggucacuuaagaagu

SEQ ID NO: 348425 - RNA, 32 nt, Human
cacugaagucuuguuucagaaaccagaccacu

SEQ ID NO: 348426 - RNA, 32 nt, Human
cacugaaguguacacagauaaagcaggucuuu

SEQ ID NO: 348427 - RNA, 32 nt, Human
cacugaauaaauucagcaucuugguggucgau

SEQ ID NO: 348428 - RNA, 27 nt, Human
cacugaauggggaaacugggggcagca

SEQ ID NO: 348429 - RNA, 32 nt, Human
cacugaauguuacugauugcggcugagggccu

SEQ ID NO: 348430 - RNA, 32 nt, Human
cacugacaauacugaauaaacaucucaccgga

SEQ ID NO: 348431 - RNA, 32 nt, Human
cacugacacagaacucaacugguccagcccuu

SEQ ID NO: 348432 - RNA, 19 nt, Human
cacugacaccccugccccu

SEQ ID NO: 348433 - RNA, 32 nt, Human
cacugacacccuguguguaagcagaaccucca

SEQ ID NO: 348434 - RNA, 21 nt, Human
cacugacagccggugugguca

SEQ ID NO: 348435 - RNA, 32 nt, Human
cacugacagcuugcacuguggccuggaaaagc

SEQ ID NO: 348436 - RNA, 32 nt, Human
cacugacagcuugcacugugugccuggaaaag

SEQ ID NO: 348437 - RNA, 32 nt, Human
cacugacaggauagccuguucuguggauguca

SEQ ID NO: 348438 - RNA, 32 nt, Human
cacugacagguauccccugaaacugagcugag

SEQ ID NO: 348439 - RNA, 32 nt, Human
cacugaccaggcacuugccuucccucucuucc

SEQ ID NO: 348440 - RNA, 32 nt, Human
cacugaccaggcccaaggaggguccaggcggg

SEQ ID NO: 348441 - RNA, 22 nt, Human
cacugaccaguaggagcagcag

SEQ ID NO: 348442 - RNA, 28 nt, Human
cacugacccccaggggccucauccuccc

SEQ ID NO: 348443 - RNA, 32 nt, Human
cacugaccuauaccucaggaugggcgcgucug

SEQ ID NO: 348444 - RNA, 32 nt, Human
cacugaccucuuucucguuuguggacaaagca

SEQ ID NO: 348445 - RNA, 25 nt, Human
cacugaccuguaugaagaauccaga

SEQ ID NO: 348446 - RNA, 32 nt, Human
cacugacuccuacucuccuacuucuccagaug

SEQ ID NO: 348447 - RNA, 32 nt, Human
cacugacuccucaaccccugugcucagccgac

SEQ ID NO: 348448 - RNA, 21 nt, Human
cacugacugaacagacuuuua

SEQ ID NO: 348449 - RNA, 21 nt, Human
cacugacugcaaaacugccug

SEQ ID NO: 348450 - RNA, 20 nt, Human
cacugacugcuugaccuuua

SEQ ID NO: 348451 - RNA, 32 nt, Human
cacugacugguaccccacucucauuucacugg

SEQ ID NO: 348452 - RNA, 32 nt, Human
cacugacuguuuccucugccuggaccccacuu

SEQ ID NO: 348453 - RNA, 32 nt, Human
cacugacuuuagcaccucuauaccucagcuga

SEQ ID NO: 348454 - RNA, 32 nt, Human
cacugagaaagaaccccuacagguggagagga

SEQ ID NO: 348455 - RNA, 23 nt, Human
cacugagaaagcuaagcccuaca

SEQ ID NO: 348456 - RNA, 32 nt, Human
cacugagacagcccgggcucugcuucccauca

SEQ ID NO: 348457 - RNA, 32 nt, Human
cacugagacguaggaauguggagggaggugcu

SEQ ID NO: 348458 - RNA, 32 nt, Human
cacugagaggccgaucacuugaggucaggagu

SEQ ID NO: 348459 - RNA, 32 nt, Human
cacugagaggggaaucugauugccaucaaggc

SEQ ID NO: 348460 - RNA, 31 nt, Human
cacugagcaaauaaauauguugagaaugaug

SEQ ID NO: 348461 - RNA, 31 nt, Human
cacugagcacagcaaggcaccaaagccccug

SEQ ID NO: 348462 - RNA, 32 nt, Human
cacugagcacuuccgggaagagcaggcaccca

SEQ ID NO: 348463 - RNA, 32 nt, Human
cacugagcauggucagggcauuggucagaggg

SEQ ID NO: 348464 - RNA, 32 nt, Human
cacugagcauuuucucauuuguugcauuacug

SEQ ID NO: 348465 - RNA, 32 nt, Human
cacugagccauccgugggucaggaugcaauua

SEQ ID NO: 348466 - RNA, 32 nt, Human
cacugagcccaggaguuuaaggcugcagugag

SEQ ID NO: 348467 - RNA, 32 nt, Human
cacugagcccucugcugcccugccagaaucug

SEQ ID NO: 348468 - RNA, 21 nt, Human
cacugagcccuuuugcugcug

SEQ ID NO: 348469 - RNA, 32 nt, Human
cacugagccuccacaggcuccauuccaaguaa

SEQ ID NO: 348470 - RNA, 19 nt, Human
cacugagccuccagacccu

SEQ ID NO: 348471 - RNA, 32 nt, Human
cacugagcugcucugcucaccucuagaugcuc

SEQ ID NO: 348472 - RNA, 32 nt, Human
cacugaggacucagagaggcugagucacuuac

SEQ ID NO: 348473 - RNA, 32 nt, Human
cacugaggaugaggcccuggggaccccagaga

SEQ ID NO: 348474 - RNA, 32 nt, Human
cacugaggccagcauggcugggcccaggaugc

SEQ ID NO: 348475 - RNA, 20 nt, Human
cacugagggaaggugaagua

SEQ ID NO: 348476 - RNA, 23 nt, Human
cacugaggggugcggugccaaca

SEQ ID NO: 348477 - RNA, 32 nt, Human
cacugaguaggcaguugguuaaagaagcaaga

SEQ ID NO: 348478 - RNA, 32 nt, Human
cacugaguccucccgauucggaccuguuuuag

SEQ ID NO: 348479 - RNA, 32 nt, Human
cacugagugcauucaccaccuuuuaaauuuug

SEQ ID NO: 348480 - RNA, 32 nt, Human
cacugaguggagugucaggcagggugugucgg

SEQ ID NO: 348481 - RNA, 32 nt, Human
cacugaguggccacuguccuuccuaaauguca

SEQ ID NO: 348482 - RNA, 32 nt, Human
cacugaguguuuuggccacuuggaggaccugg

SEQ ID NO: 348483 - RNA, 24 nt, Human
cacugaguuccaggcacacuggug

SEQ ID NO: 348484 - RNA, 32 nt, Human
cacugaguucuagaaugaagcugcagacccuc

SEQ ID NO: 348485 - RNA, 32 nt, Human
cacugauaagguuccagcaaagagauuaggac

SEQ ID NO: 348486 - RNA, 32 nt, Human
cacugauacauacauguacugauacauuccaa

SEQ ID NO: 348487 - RNA, 32 nt, Human
cacugauauuacauccacaguaccacaguauu

SEQ ID NO: 348488 - RNA, 24 nt, Human
cacugauauugaagaaccuggaga

SEQ ID NO: 348489 - RNA, 32 nt, Human
cacugaugacaugguauaggaguggguggggu

SEQ ID NO: 348490 - RNA, 32 nt, Human
cacugaugacgaucauagcucacuacagcuuc

SEQ ID NO: 348491 - RNA, 32 nt, Human
cacugaugcacacggaccuggacacagacaug

SEQ ID NO: 348492 - RNA, 32 nt, Human
cacugaugcagcuguccugaaggacuccccga

SEQ ID NO: 348493 - RNA, 32 nt, Human
cacugaugcuggaugaccuuggccugacccug

SEQ ID NO: 348494 - RNA, 32 nt, Human
cacugauggaggagguacagccguggaggaga

SEQ ID NO: 348495 - RNA, 23 nt, Human
cacugaugggcuggggcaggggc

SEQ ID NO: 348496 - RNA, 32 nt, Human
cacugaugggcuucugccccugcccuuccuca

SEQ ID NO: 348497 - RNA, 32 nt, Human
cacugauguggaccacagaaccucacaguuua

SEQ ID NO: 348498 - RNA, 18 nt, Human
cacugauguucaccuuua

SEQ ID NO: 348499 - RNA, 19 nt, Human
cacugauguuugaacugga

SEQ ID NO: 348500 - RNA, 32 nt, Human
cacugauucugucuuuuccucagaaucuggcc

SEQ ID NO: 348501 - RNA, 32 nt, Human
cacugauugcauuccagccugggugacagagc

SEQ ID NO: 348502 - RNA, 32 nt, Human
cacugcaaaaggaguguucguggcaguguucc

SEQ ID NO: 348503 - RNA, 32 nt, Human
cacugcaaaaucauaagaggcuucuggacuuc

SEQ ID NO: 348504 - RNA, 32 nt, Human
cacugcaaagagacgcuucaaguggggagaag

SEQ ID NO: 348505 - RNA, 32 nt, Human
cacugcaacaacaggagugcaaacuucucuac

SEQ ID NO: 348506 - RNA, 21 nt, Human
cacugcaacaccuccacauca

SEQ ID NO: 348507 - RNA, 32 nt, Human
cacugcaacagacucuaccagagaugcaaaga

SEQ ID NO: 348508 - RNA, 32 nt, Human
cacugcaacauccaccuccuggguucaagcaa

SEQ ID NO: 348509 - RNA, 32 nt, Human
cacugcaacauccaccuccuggguucaagcga

SEQ ID NO: 348510 - RNA, 32 nt, Human
cacugcaaccacugccucccaggcucaaguga

SEQ ID NO: 348511 - RNA, 22 nt, Human
cacugcaaccucaaccuucugg

SEQ ID NO: 348512 - RNA, 32 nt, Human
cacugcaaccucaauccugggcucaagugauc

SEQ ID NO: 348513 - RNA, 22 nt, Human
cacugcaaccucagccuccugg

SEQ ID NO: 348514 - RNA, 24 nt, Human
cacugcaaccuccaccuccugagu

SEQ ID NO: 348515 - RNA, 22 nt, Human
cacugcaaccuccaccuccugg

SEQ ID NO: 348516 - RNA, 24 nt, Human
cacugcaaccuccaccuccuggcu

SEQ ID NO: 348517 - RNA, 32 nt, Human
cacugcaaccuccaccuccugggcucaagcga

SEQ ID NO: 348518 - RNA, 24 nt, Human
cacugcaaccuccaccuccugguu

SEQ ID NO: 348519 - RNA, 32 nt, Human
cacugcaaccuccaccuccuguguucaaguga

SEQ ID NO: 348520 - RNA, 25 nt, Human
cacugcaaccuccaccuuccugguu

SEQ ID NO: 348521 - RNA, 22 nt, Human
cacugcaaccuccacuuccugg

SEQ ID NO: 348522 - RNA, 22 nt, Human
cacugcaaccuccaucuccugg

SEQ ID NO: 348523 - RNA, 24 nt, Human
cacugcaaccuccgccuccugagu

SEQ ID NO: 348524 - RNA, 22 nt, Human
cacugcaaccuccgccuccugg

SEQ ID NO: 348525 - RNA, 22 nt, Human
cacugcaaccuccgcuuccugg

SEQ ID NO: 348526 - RNA, 22 nt, Human
cacugcaaccuccgucuccugg

SEQ ID NO: 348527 - RNA, 22 nt, Human
cacugcaaccuccuccuccugg

SEQ ID NO: 348528 - RNA, 22 nt, Human
cacugcaaccucgaccuccugg

SEQ ID NO: 348529 - RNA, 22 nt, Human
cacugcaaccucgaccucuugg

SEQ ID NO: 348530 - RNA, 22 nt, Human
cacugcaaccucuaccuccugg

SEQ ID NO: 348531 - RNA, 24 nt, Human
cacugcaaccucugccuccugagc

SEQ ID NO: 348532 - RNA, 24 nt, Human
cacugcaaccucugccuccugagu

SEQ ID NO: 348533 - RNA, 22 nt, Human
cacugcaaccucugccuccugg

SEQ ID NO: 348534 - RNA, 24 nt, Human
cacugcaaccucugccuccugguu

SEQ ID NO: 348535 - RNA, 32 nt, Human
cacugcaaccucugccuuccagguucaagcaa

SEQ ID NO: 348536 - RNA, 22 nt, Human
cacugcaaccucugcuuccugg

SEQ ID NO: 348537 - RNA, 22 nt, Human
cacugcaaccucugucuccugg

SEQ ID NO: 348538 - RNA, 24 nt, Human
cacugcaaccucuuccuccugguu

SEQ ID NO: 348539 - RNA, 22 nt, Human
cacugcaaccugcgccuccugg

SEQ ID NO: 348540 - RNA, 22 nt, Human
cacugcaaccuggaccuccugg

SEQ ID NO: 348541 - RNA, 32 nt, Human
cacugcaaccugggugacagaacaagacaaaa

SEQ ID NO: 348542 - RNA, 32 nt, Human
cacugcaaccugggugacagagcgagacucca

SEQ ID NO: 348543 - RNA, 22 nt, Human
cacugcaaccuucgccuccugg

SEQ ID NO: 348544 - RNA, 24 nt, Human
cacugcaaccuugaccucccaggc

SEQ ID NO: 348545 - RNA, 24 nt, Human
cacugcaaccuuggccuccuaggu

SEQ ID NO: 348546 - RNA, 32 nt, Human
cacugcaacguccaccuccuggguucaagcga

SEQ ID NO: 348547 - RNA, 22 nt, Human
cacugcaacuaccaccuccugg

SEQ ID NO: 348548 - RNA, 32 nt, Human
cacugcaacuaccaccuccuggguucaagcga

SEQ ID NO: 348549 - RNA, 22 nt, Human
cacugcaacuuccaccuccugg

SEQ ID NO: 348550 - RNA, 32 nt, Human
cacugcaacuuccgccuccuguguucaagcga

SEQ ID NO: 348551 - RNA, 32 nt, Human
cacugcaagaggaggaggugaugcaggugcca

SEQ ID NO: 348552 - RNA, 32 nt, Human
cacugcaagcaaguaaccagcuucucacucca

SEQ ID NO: 348553 - RNA, 32 nt, Human
cacugcaagcuccaccuccuggguucaagcga

SEQ ID NO: 348554 - RNA, 32 nt, Human
cacugcaagcuccaccuccuggguucacgcca

SEQ ID NO: 348555 - RNA, 32 nt, Human
cacugcaagcuccaccuccuggguucaugcca

SEQ ID NO: 348556 - RNA, 32 nt, Human
cacugcaagggccgaggcagggccagaccaga

SEQ ID NO: 348557 - RNA, 32 nt, Human
cacugcacaagcuauucuaauagugaucuggc

SEQ ID NO: 348558 - RNA, 32 nt, Human
cacugcacacugcacuccauccugggcgacag

SEQ ID NO: 348559 - RNA, 32 nt, Human
cacugcacagacagcugcgaccagagacugga

SEQ ID NO: 348560 - RNA, 21 nt, Human
cacugcacagcaagccuucaa

SEQ ID NO: 348561 - RNA, 32 nt, Human
cacugcacauuuucaggcuugguuuccacauu

SEQ ID NO: 348562 - RNA, 16 nt, Human
cacugcaccaaaguca

SEQ ID NO: 348563 - RNA, 32 nt, Human
cacugcaccacuccagccugggcaacaagagc

SEQ ID NO: 348564 - RNA, 19 nt, Human
cacugcaccagccccaggg

SEQ ID NO: 348565 - RNA, 32 nt, Human
cacugcacccagcccaaggucuugccauggua

SEQ ID NO: 348566 - RNA, 32 nt, Human
cacugcacccagccgagugagaauuuuuaugc

SEQ ID NO: 348567 - RNA, 32 nt, Human
cacugcacccagcuaauuuuuguauuuuuagu

SEQ ID NO: 348568 - RNA, 32 nt, Human
cacugcacccaggggacaacuccaccuggacu

SEQ ID NO: 348569 - RNA, 32 nt, Human
cacugcaccccacccauucaaguccacauccc

SEQ ID NO: 348570 - RNA, 32 nt, Human
cacugcacccggcucccagucacucaaucuug

SEQ ID NO: 348571 - RNA, 22 nt, Human
cacugcacccucaaccuccugg

SEQ ID NO: 348572 - RNA, 32 nt, Human
cacugcacccucaaccuccuggguucaagcaa

SEQ ID NO: 348573 - RNA, 32 nt, Human
cacugcaccugccuccagccgccggcugugca

SEQ ID NO: 348574 - RNA, 32 nt, Human
cacugcaccuggcuaauuuuuauauuuuuggu

SEQ ID NO: 348575 - RNA, 32 nt, Human
cacugcacgacggggcuggacugaccugaaaa

SEQ ID NO: 348576 - RNA, 32 nt, Human
cacugcacgcacuccagccugggcgacagagc

SEQ ID NO: 348577 - RNA, 32 nt, Human
cacugcacgcacuccagccugggugacagagc

SEQ ID NO: 348578 - RNA, 32 nt, Human
cacugcacguggccuaaaaguuuuaaguuuua

SEQ ID NO: 348579 - RNA, 32 nt, Human
cacugcacucaaccuuaagaccuacuguucua

SEQ ID NO: 348580 - RNA, 32 nt, Human
cacugcacuccagcacuccagccugggugaca

SEQ ID NO: 348581 - RNA, 32 nt, Human
cacugcacuccagccuaggugacagggcaaga

SEQ ID NO: 348582 - RNA, 32 nt, Human
cacugcacuccagccuggaaggcagagagaga

SEQ ID NO: 348583 - RNA, 32 nt, Human
cacugcacuccagccuggccugggcaacagag

SEQ ID NO: 348584 - RNA, 21 nt, Human
cacugcacuccagccugggca

SEQ ID NO: 348585 - RNA, 32 nt, Human
cacugcacuccagccugggugacagggcaaga

SEQ ID NO: 348586 - RNA, 21 nt, Human
cacugcacuccagccuuggca

SEQ ID NO: 348587 - RNA, 32 nt, Human
cacugcacuccaggcugggcaacggagugaga

SEQ ID NO: 348588 - RNA, 32 nt, Human
cacugcacuccaggcugggugacagagcgaga

SEQ ID NO: 348589 - RNA, 32 nt, Human
cacugcacuccauccagccugggugacagggc

SEQ ID NO: 348590 - RNA, 32 nt, Human
cacugcacuccauccagccugggugacagggu

SEQ ID NO: 348591 - RNA, 32 nt, Human
cacugcacuccugggcaacagagcaagacuuc

SEQ ID NO: 348592 - RNA, 32 nt, Human
cacugcacugcacgccagccuaggcgacagag

SEQ ID NO: 348593 - RNA, 32 nt, Human
cacugcacugcacuccagccugggugacaaag

SEQ ID NO: 348594 - RNA, 32 nt, Human
cacugcacuguuagcugagagugcgggcaaga

SEQ ID NO: 348595 - RNA, 32 nt, Human
cacugcagacaggcccuggcucagaaucagag

SEQ ID NO: 348596 - RNA, 20 nt, Human
cacugcagagcccaccuggc

SEQ ID NO: 348597 - RNA, 32 nt, Human
cacugcagaggcgaaagccagugcuuugguaa

SEQ ID NO: 348598 - RNA, 32 nt, Human
cacugcagaggggaggagcugucuccuccucc

SEQ ID NO: 348599 - RNA, 32 nt, Human
cacugcagaguguguuucugcucgucagcugc

SEQ ID NO: 348600 - RNA, 32 nt, Human
cacugcagaucccugaacaccuugggggccac

SEQ ID NO: 348601 - RNA, 21 nt, Human
cacugcagaugccugcuggcu

SEQ ID NO: 348602 - RNA, 22 nt, Human
cacugcagauuccuccccuggc

SEQ ID NO: 348603 - RNA, 32 nt, Human
cacugcagcaggagucgggcccugccucccuc

SEQ ID NO: 348604 - RNA, 24 nt, Human
cacugcagccacugccucccaggu

SEQ ID NO: 348605 - RNA, 22 nt, Human
cacugcagcccacugcccagcu

SEQ ID NO: 348606 - RNA, 24 nt, Human
cacugcagccccaaccuucagggc

SEQ ID NO: 348607 - RNA, 22 nt, Human
cacugcagccccaggccccggc

SEQ ID NO: 348608 - RNA, 24 nt, Human
cacugcagcccgaguucucuggcu

SEQ ID NO: 348609 - RNA, 23 nt, Human
cacugcagcccuccagcucuggc

SEQ ID NO: 348610 - RNA, 32 nt, Human
cacugcagcccugaccuccugggcucaaggga

SEQ ID NO: 348611 - RNA, 24 nt, Human
cacugcagcccugacugccuaggc

SEQ ID NO: 348612 - RNA, 22 nt, Human
cacugcagcccugccacuugcu

SEQ ID NO: 348613 - RNA, 24 nt, Human
cacugcagcccuggcgagcaggcu

SEQ ID NO: 348614 - RNA, 32 nt, Human
cacugcagcccuuuggaagacauuguccugca

SEQ ID NO: 348615 - RNA, 24 nt, Human
cacugcagccuagaccucccagcu

SEQ ID NO: 348616 - RNA, 32 nt, Human
cacugcagccuaggugacagagcgagacccug

SEQ ID NO: 348617 - RNA, 24 nt, Human
cacugcagccucaaacuccuaggc

SEQ ID NO: 348618 - RNA, 24 nt, Human
cacugcagccucaaacuccugagc

SEQ ID NO: 348619 - RNA, 22 nt, Human
cacugcagccucaaacuccugg

SEQ ID NO: 348620 - RNA, 23 nt, Human
cacugcagccucaaacuucuggc

SEQ ID NO: 348621 - RNA, 22 nt, Human
cacugcagccucaaauuccugg

SEQ ID NO: 348622 - RNA, 24 nt, Human
cacugcagccucaaccucccaggc

SEQ ID NO: 348623 - RNA, 20 nt, Human
cacugcagccucaaccuccu

SEQ ID NO: 348624 - RNA, 24 nt, Human
cacugcagccucaaccuccugagc

SEQ ID NO: 348625 - RNA, 32 nt, Human
cacugcagccucaaccuccugagcucaagcaa

SEQ ID NO: 348626 - RNA, 22 nt, Human
cacugcagccucaaccuccugg

SEQ ID NO: 348627 - RNA, 32 nt, Human
cacugcagccucaaccuccuggacucagagau

SEQ ID NO: 348628 - RNA, 32 nt, Human
cacugcagccucaaccuccugggcucaagcaa

SEQ ID NO: 348629 - RNA, 32 nt, Human
cacugcagccucaaccuccugggcucaagcca

SEQ ID NO: 348630 - RNA, 32 nt, Human
cacugcagccucaaccuccuggguucaaguga

SEQ ID NO: 348631 - RNA, 22 nt, Human
cacugcagccucaaccugcugg

SEQ ID NO: 348632 - RNA, 22 nt, Human
cacugcagccucaaccuggguu

SEQ ID NO: 348633 - RNA, 22 nt, Human
cacugcagccucaaccuucugg

SEQ ID NO: 348634 - RNA, 24 nt, Human
cacugcagccucaacguuuugagc

SEQ ID NO: 348635 - RNA, 24 nt, Human
cacugcagccucaacuucccaggc

SEQ ID NO: 348636 - RNA, 22 nt, Human
cacugcagccucaacuuccugg

SEQ ID NO: 348637 - RNA, 32 nt, Human
cacugcagccucaacuucuuguccucaaguga

SEQ ID NO: 348638 - RNA, 23 nt, Human
cacugcagccucaaucuccuggu

SEQ ID NO: 348639 - RNA, 24 nt, Human
cacugcagccucaaucuuccaggc

SEQ ID NO: 348640 - RNA, 22 nt, Human
cacugcagccucagcguccugg

SEQ ID NO: 348641 - RNA, 22 nt, Human
cacugcagccucauacuccugg

SEQ ID NO: 348642 - RNA, 23 nt, Human
cacugcagccuccaacuccuagc

SEQ ID NO: 348643 - RNA, 24 nt, Human
cacugcagccuccaccucccaggc

SEQ ID NO: 348644 - RNA, 24 nt, Human
cacugcagccuccaccucccaggu

SEQ ID NO: 348645 - RNA, 24 nt, Human
cacugcagccuccaccuccccggu

SEQ ID NO: 348646 - RNA, 22 nt, Human
cacugcagccuccaccucccgg

SEQ ID NO: 348647 - RNA, 24 nt, Human
cacugcagccuccaccucccgggc

SEQ ID NO: 348648 - RNA, 24 nt, Human
cacugcagccuccaccuccuaggc

SEQ ID NO: 348649 - RNA, 22 nt, Human
cacugcagccuccaccuccugg

SEQ ID NO: 348650 - RNA, 32 nt, Human
cacugcagccuccaccuccugggcucaaagug

SEQ ID NO: 348651 - RNA, 32 nt, Human
cacugcagccuccaccuccugggcucaagcga

SEQ ID NO: 348652 - RNA, 32 nt, Human
cacugcagccuccaccuccugggcucauguga

SEQ ID NO: 348653 - RNA, 25 nt, Human
cacugcagccuccaccuccuugacu

SEQ ID NO: 348654 - RNA, 22 nt, Human
cacugcagccuccacuuccugg

SEQ ID NO: 348655 - RNA, 22 nt, Human
cacugcagccuccaucucccgg

SEQ ID NO: 348656 - RNA, 24 nt, Human
cacugcagccuccaucuccuaggc

SEQ ID NO: 348657 - RNA, 22 nt, Human
cacugcagccuccaucuccugg

SEQ ID NO: 348658 - RNA, 22 nt, Human
cacugcagccucccaacaggcu

SEQ ID NO: 348659 - RNA, 20 nt, Human
cacugcagccucccugccug

SEQ ID NO: 348660 - RNA, 22 nt, Human
cacugcagccuccgccucccgg

SEQ ID NO: 348661 - RNA, 24 nt, Human
cacugcagccuccgccucccuggu

SEQ ID NO: 348662 - RNA, 32 nt, Human
cacugcagccuccgccucccugguucaaacaa

SEQ ID NO: 348663 - RNA, 24 nt, Human
cacugcagccuccgcuucccuggu

SEQ ID NO: 348664 - RNA, 32 nt, Human
cacugcagccuccugagauauuuuuagagacu

SEQ ID NO: 348665 - RNA, 22 nt, Human
cacugcagccuccuucuccugg

SEQ ID NO: 348666 - RNA, 22 nt, Human
cacugcagccucgaacaccugg

SEQ ID NO: 348667 - RNA, 22 nt, Human
cacugcagccucgaacuccugg

SEQ ID NO: 348668 - RNA, 22 nt, Human
cacugcagccucgaaucccugg

SEQ ID NO: 348669 - RNA, 21 nt, Human
cacugcagccucgacaccugg

SEQ ID NO: 348670 - RNA, 24 nt, Human
cacugcagccucgaccucccaggc

SEQ ID NO: 348671 - RNA, 24 nt, Human
cacugcagccucgaccuccccagc

SEQ ID NO: 348672 - RNA, 24 nt, Human
cacugcagccucgaccucccgggc

SEQ ID NO: 348673 - RNA, 23 nt, Human
cacugcagccucgaccucccugg

SEQ ID NO: 348674 - RNA, 24 nt, Human
cacugcagccucgaccucccuggc

SEQ ID NO: 348675 - RNA, 32 nt, Human
cacugcagccucgaccuccugcgcucagguga

SEQ ID NO: 348676 - RNA, 22 nt, Human
cacugcagccucgaccuccugg

SEQ ID NO: 348677 - RNA, 32 nt, Human
cacugcagccucgaccuccuggacucaguugg

SEQ ID NO: 348678 - RNA, 32 nt, Human
cacugcagccucgaccuccugggcucaacuga

SEQ ID NO: 348679 - RNA, 32 nt, Human
cacugcagccucgaccuccugggcucaagcaa

SEQ ID NO: 348680 - RNA, 32 nt, Human
cacugcagccucgaccuccugggcucaagcag

SEQ ID NO: 348681 - RNA, 24 nt, Human
cacugcagccucgaccucuggggc

SEQ ID NO: 348682 - RNA, 22 nt, Human
cacugcagccucgacuuccugg

SEQ ID NO: 348683 - RNA, 32 nt, Human
cacugcagccucugccacccagauucaacaga

SEQ ID NO: 348684 - RNA, 24 nt, Human
cacugcagccucugccucccaggu

SEQ ID NO: 348685 - RNA, 22 nt, Human
cacugcagccucugccuccugg

SEQ ID NO: 348686 - RNA, 21 nt, Human
cacugcagccucugucccugg

SEQ ID NO: 348687 - RNA, 24 nt, Human
cacugcagccucugucucccgggc

SEQ ID NO: 348688 - RNA, 25 nt, Human
cacugcagccugaaacuccuuggcu

SEQ ID NO: 348689 - RNA, 23 nt, Human
cacugcagccugcgccucccagc

SEQ ID NO: 348690 - RNA, 22 nt, Human
cacugcagccuggaacuccugg

SEQ ID NO: 348691 - RNA, 25 nt, Human
cacugcagccuggaacuccuuggcu

SEQ ID NO: 348692 - RNA, 22 nt, Human
cacugcagccuggaauuccugg

SEQ ID NO: 348693 - RNA, 23 nt, Human
cacugcagccuggaccuccuagc

SEQ ID NO: 348694 - RNA, 24 nt, Human
cacugcagccuggaccuccugguu

SEQ ID NO: 348695 - RNA, 22 nt, Human
cacugcagccuggagcuccugg

SEQ ID NO: 348696 - RNA, 32 nt, Human
cacugcagccuggaugacagagcgagacucua

SEQ ID NO: 348697 - RNA, 32 nt, Human
cacugcagccugggaaacagagugaggcucug

SEQ ID NO: 348698 - RNA, 32 nt, Human
cacugcagccugggcaacagaaugagacugug

SEQ ID NO: 348699 - RNA, 32 nt, Human
cacugcagccugggcaacauagcaagacucug

SEQ ID NO: 348700 - RNA, 32 nt, Human
cacugcagccugggcaacauagcgagacucug

SEQ ID NO: 348701 - RNA, 32 nt, Human
cacugcagccugggcgacagagcgagauucug

SEQ ID NO: 348702 - RNA, 32 nt, Human
cacugcagccugggcuacagagagcaagacuc

SEQ ID NO: 348703 - RNA, 32 nt, Human
cacugcagccugggugacaaagcaagacccug

SEQ ID NO: 348704 - RNA, 32 nt, Human
cacugcagccugggugacagaaugugacucug

SEQ ID NO: 348705 - RNA, 32 nt, Human
cacugcagccugggugacagagugagacucug

SEQ ID NO: 348706 - RNA, 32 nt, Human
cacugcagccuggguggcagagugagacccag

SEQ ID NO: 348707 - RNA, 22 nt, Human
cacugcagccugugucuccugg

SEQ ID NO: 348708 - RNA, 22 nt, Human
cacugcagccuucaccucccgg

SEQ ID NO: 348709 - RNA, 22 nt, Human
cacugcagccuucgccucccgg

SEQ ID NO: 348710 - RNA, 24 nt, Human
cacugcagccuugaacaccugagc

SEQ ID NO: 348711 - RNA, 22 nt, Human
cacugcagccuugaacaccugg

SEQ ID NO: 348712 - RNA, 24 nt, Human
cacugcagccuugaacuccuaggc

SEQ ID NO: 348713 - RNA, 24 nt, Human
cacugcagccuugaacuccugagc

SEQ ID NO: 348714 - RNA, 22 nt, Human
cacugcagccuugaacuccugg

SEQ ID NO: 348715 - RNA, 23 nt, Human
cacugcagccuugaacuccuggc

SEQ ID NO: 348716 - RNA, 24 nt, Human
cacugcagccuugaacucugggcu

SEQ ID NO: 348717 - RNA, 22 nt, Human
cacugcagccuugaauuccugg

SEQ ID NO: 348718 - RNA, 32 nt, Human
cacugcagccuugaauuccugggcucgagcgg

SEQ ID NO: 348719 - RNA, 24 nt, Human
cacugcagccuugaccuccagggc

SEQ ID NO: 348720 - RNA, 24 nt, Human
cacugcagccuugaccucccaggc

SEQ ID NO: 348721 - RNA, 23 nt, Human
cacugcagccuugaccuccccgg

SEQ ID NO: 348722 - RNA, 24 nt, Human
cacugcagccuugaccucccgggc

SEQ ID NO: 348723 - RNA, 24 nt, Human
cacugcagccuugaccuccugagc

SEQ ID NO: 348724 - RNA, 32 nt, Human
cacugcagccuugaccuccugagcucaagcga

SEQ ID NO: 348725 - RNA, 22 nt, Human
cacugcagccuugaccuccugg

SEQ ID NO: 348726 - RNA, 23 nt, Human
cacugcagccuugaccuuccagc

SEQ ID NO: 348727 - RNA, 32 nt, Human
cacugcagccuugaccuuccagccugccaagu

SEQ ID NO: 348728 - RNA, 22 nt, Human
cacugcagccuugacuuccugg

SEQ ID NO: 348729 - RNA, 24 nt, Human
cacugcagccuugacuucucaggc

SEQ ID NO: 348730 - RNA, 24 nt, Human
cacugcagccuugauuucccgggc

SEQ ID NO: 348731 - RNA, 24 nt, Human
cacugcagccuuguccucccaggc

SEQ ID NO: 348732 - RNA, 18 nt, Human
cacugcagcgcgcuccug

SEQ ID NO: 348733 - RNA, 32 nt, Human
cacugcagcugggccaagucgcuuagcucuuc

SEQ ID NO: 348734 - RNA, 19 nt, Human
cacugcagcuuugaccucc

SEQ ID NO: 348735 - RNA, 32 nt, Human
cacugcaggaaggaggccccucugaggcgagg

SEQ ID NO: 348736 - RNA, 22 nt, Human
cacugcaggcacagucugugca

SEQ ID NO: 348737 - RNA, 32 nt, Human
cacugcaggcagcggcgcaggaagcgguggcc

SEQ ID NO: 348738 - RNA, 32 nt, Human
cacugcaggcaggacaaaccuggaugccaccu

SEQ ID NO: 348739 - RNA, 32 nt, Human
cacugcaggcaugcugaacaaggggccuccaa

SEQ ID NO: 348740 - RNA, 32 nt, Human
cacugcaggcccuccccacccaggacuccagg

SEQ ID NO: 348741 - RNA, 32 nt, Human
cacugcaggcugcugcuauucccugucugcug

SEQ ID NO: 348742 - RNA, 32 nt, Human
cacugcaggcugggugacagagugagacucca

SEQ ID NO: 348743 - RNA, 32 nt, Human
cacugcagggcccugagguggucgugucccug

SEQ ID NO: 348744 - RNA, 21 nt, Human
cacugcaguccagccuaggca

SEQ ID NO: 348745 - RNA, 24 nt, Human
cacugcagucucgaccucccaggc

SEQ ID NO: 348746 - RNA, 32 nt, Human
cacugcagucugagugacagagugagacucca

SEQ ID NO: 348747 - RNA, 32 nt, Human
cacugcaguggucacuguccuggaaaaguaac

SEQ ID NO: 348748 - RNA, 32 nt, Human
cacugcaguucugcuaggucugcuuccugccc

SEQ ID NO: 348749 - RNA, 32 nt, Human
cacugcaguuuccauguuagcacuguggaugg

SEQ ID NO: 348750 - RNA, 24 nt, Human
cacugcaguuuugaccucccaggc

SEQ ID NO: 348751 - RNA, 32 nt, Human
cacugcaucaggagucaggagaccuggcuucu

SEQ ID NO: 348752 - RNA, 32 nt, Human
cacugcaucaggcugcagggugaaggggaggu

SEQ ID NO: 348753 - RNA, 32 nt, Human
cacugcauccaggacucugucagcucugcugc

SEQ ID NO: 348754 - RNA, 22 nt, Human
cacugcauccucaaccuccugg

SEQ ID NO: 348755 - RNA, 32 nt, Human
cacugcauccucaaccuccuggguucagauua

SEQ ID NO: 348756 - RNA, 19 nt, Human
cacugcauccuugaccucc

SEQ ID NO: 348757 - RNA, 32 nt, Human
cacugcaucucuccugugaguuggagacuucu

SEQ ID NO: 348758 - RNA, 32 nt, Human
cacugcaucuuuugaaagccugugccacccca

SEQ ID NO: 348759 - RNA, 32 nt, Human
cacugcaugcaagccaugaaucuguuuugaga

SEQ ID NO: 348760 - RNA, 32 nt, Human
cacugcaugccugggaaaggccagcacuucau

SEQ ID NO: 348761 - RNA, 32 nt, Human
cacugcauggaugucccaggaggcagcucucc

SEQ ID NO: 348762 - RNA, 32 nt, Human
cacugcauggccuccugucacugugaaucgug

SEQ ID NO: 348763 - RNA, 32 nt, Human
cacugcauggucauccuguugaacugugcuca

SEQ ID NO: 348764 - RNA, 32 nt, Human
cacugcauuacaucagcagacugcauuggaga

SEQ ID NO: 348765 - RNA, 32 nt, Human
cacugcauugcacuggaccugggaugccuauc

SEQ ID NO: 348766 - RNA, 32 nt, Human
cacugccaaacaguaaccuccaggagaaaaca

SEQ ID NO: 348767 - RNA, 32 nt, Human
cacugccaacgggcaugggcugaggggaacga

SEQ ID NO: 348768 - RNA, 32 nt, Human
cacugccaagccccaguacuuggaggaacugg

SEQ ID NO: 348769 - RNA, 32 nt, Human
cacugccaagcuaccccaccccuucccccaaa

SEQ ID NO: 348770 - RNA, 32 nt, Human
cacugccaauguuugugaaccugaccuucagg

SEQ ID NO: 348771 - RNA, 32 nt, Human
cacugccacagcugugagggccaagaugcugu

SEQ ID NO: 348772 - RNA, 32 nt, Human
cacugccacauacuuguuuucucccauguucc

SEQ ID NO: 348773 - RNA, 32 nt, Human
cacugccaccugggccagcuucuggagcauga

SEQ ID NO: 348774 - RNA, 32 nt, Human
cacugccacugcauggccuccugucacuguga

SEQ ID NO: 348775 - RNA, 32 nt, Human
cacugccacuucagaaaagccuggugaccucu

SEQ ID NO: 348776 - RNA, 32 nt, Human
cacugccagcaaccucugcucucuggagaggu

SEQ ID NO: 348777 - RNA, 32 nt, Human
cacugccagcagagagggugugucugggggcc

SEQ ID NO: 348778 - RNA, 32 nt, Human
cacugccagcagcgcgcagagggagggauggg

SEQ ID NO: 348779 - RNA, 32 nt, Human
cacugccagcccacccccuuugacucuggggu

SEQ ID NO: 348780 - RNA, 16 nt, Human
cacugccagcggcugc

SEQ ID NO: 348781 - RNA, 20 nt, Human
cacugccagcucauuguuga

SEQ ID NO: 348782 - RNA, 32 nt, Human
cacugccagcuggauuggccagugcaccuugu

SEQ ID NO: 348783 - RNA, 32 nt, Human
cacugccagcuugccaguuucugcccagcaaa

SEQ ID NO: 348784 - RNA, 32 nt, Human
cacugccaggaccaaggcugagcccagcugug

SEQ ID NO: 348785 - RNA, 19 nt, Human
cacugccagucgagggaug

SEQ ID NO: 348786 - RNA, 23 nt, Human
cacugccauaauauucucacuga

SEQ ID NO: 348787 - RNA, 32 nt, Human
cacugccauaguccagaccagagcagacugcu

SEQ ID NO: 348788 - RNA, 32 nt, Human
cacugccauccaucuccagaaagcuuuucauc

SEQ ID NO: 348789 - RNA, 32 nt, Human
cacugccaucccuggcuaauguuuucauauuu

SEQ ID NO: 348790 - RNA, 32 nt, Human
cacugccaucgugggcagaugcagcuuccauc

SEQ ID NO: 348791 - RNA, 32 nt, Human
cacugccaucuauccaccugcccaccuccccu

SEQ ID NO: 348792 - RNA, 32 nt, Human
cacugccauuuucuugcuguuuuuguuuuuaa

SEQ ID NO: 348793 - RNA, 32 nt, Human
cacugcccaagacucagccauagaagaugccg

SEQ ID NO: 348794 - RNA, 32 nt, Human
cacugcccaguagcugcucaauaaaggcugug

SEQ ID NO: 348795 - RNA, 32 nt, Human
cacugccccaccccgagaacccucagcucuca

SEQ ID NO: 348796 - RNA, 32 nt, Human
cacugccccaccgcccugcacccuccacccgg

SEQ ID NO: 348797 - RNA, 32 nt, Human
cacugccccaggagcacuuuagggcucucagu

SEQ ID NO: 348798 - RNA, 32 nt, Human
cacugccccaguaagcuggaggcugcuccaga

SEQ ID NO: 348799 - RNA, 32 nt, Human
cacugccccaucucccucuccccaccaagaca

SEQ ID NO: 348800 - RNA, 32 nt, Human
cacugcccccgccaaagacccaaccaaucuuc

SEQ ID NO: 348801 - RNA, 32 nt, Human
cacugcccccucgcucccauguuuccacccgg

SEQ ID NO: 348802 - RNA, 32 nt, Human
cacugccccucacucuucucuggacccccacc

SEQ ID NO: 348803 - RNA, 32 nt, Human
cacugccccucagcagggaugacucagcaggg

SEQ ID NO: 348804 - RNA, 32 nt, Human
cacugccccucagcagggauggcucagcaggg

SEQ ID NO: 348805 - RNA, 32 nt, Human
cacugccccuccccacuguuuauuuauugcac

SEQ ID NO: 348806 - RNA, 32 nt, Human
cacugccccucggagccugguagugggccaca

SEQ ID NO: 348807 - RNA, 32 nt, Human
cacugccccuucucccuccugagagcucugug

SEQ ID NO: 348808 - RNA, 32 nt, Human
cacugcccuacaaauccucuguacccuaccaa

SEQ ID NO: 348809 - RNA, 32 nt, Human
cacugcccuaucuccuucuuuccucacgcccu

SEQ ID NO: 348810 - RNA, 32 nt, Human
cacugcccucaaacccggggcggaggauucca

SEQ ID NO: 348811 - RNA, 32 nt, Human
cacugcccucaaggcugcuugaggcucccacg

SEQ ID NO: 348812 - RNA, 32 nt, Human
cacugcccucccagagcucacugucuagccca

SEQ ID NO: 348813 - RNA, 32 nt, Human
cacugcccuccccagucucucuuaaaguugga

SEQ ID NO: 348814 - RNA, 32 nt, Human
cacugcccuccucuggcacucaugcugggccu

SEQ ID NO: 348815 - RNA, 32 nt, Human
cacugcccugcuccaucucccaccaccucccc

SEQ ID NO: 348816 - RNA, 32 nt, Human
cacugcccugcuccuggauggugggggccacu

SEQ ID NO: 348817 - RNA, 32 nt, Human
cacugcccuggcucaucucucccuucacugca

SEQ ID NO: 348818 - RNA, 32 nt, Human
cacugcccuuguccuggauccaacaccaaaua

SEQ ID NO: 348819 - RNA, 20 nt, Human
cacugcccuuugagggaugg

SEQ ID NO: 348820 - RNA, 32 nt, Human
cacugccgccucaaccucuccuggguucaggu

SEQ ID NO: 348821 - RNA, 30 nt, Human
cacugccgccucuccgagcucuugugacgc

SEQ ID NO: 348822 - RNA, 20 nt, Human
cacugccgcuguggcugcca

SEQ ID NO: 348823 - RNA, 32 nt, Human
cacugccgggccuucucuuauaaagcagguuu

SEQ ID NO: 348824 - RNA, 32 nt, Human
cacugccgucaccucucccuccucagcuccag

SEQ ID NO: 348825 - RNA, 32 nt, Human
cacugccuacaccuguuuacaaaaagaaucaa

SEQ ID NO: 348826 - RNA, 32 nt, Human
cacugccuauucgcucuuccuccagccucugg

SEQ ID NO: 348827 - RNA, 31 nt, Human
cacugccucaauaacuugguauugagcacgu

SEQ ID NO: 348828 - RNA, 32 nt, Human
cacugccucaccuggaaagccauguccugcug

SEQ ID NO: 348829 - RNA, 32 nt, Human
cacugccucacugcaccugccaaggcugcccu

SEQ ID NO: 348830 - RNA, 32 nt, Human
cacugccucagccuuugcacaugguaaugaag

SEQ ID NO: 348831 - RNA, 32 nt, Human
cacugccucuaccaccaccucucacuucucaa

SEQ ID NO: 348832 - RNA, 32 nt, Human
cacugccucuacugggcgugcugccaaggcca

SEQ ID NO: 348833 - RNA, 32 nt, Human
cacugccucucgcccuguaucugucaacuucc

SEQ ID NO: 348834 - RNA, 32 nt, Human
cacugccugauuucuuuucucucugccugaug

SEQ ID NO: 348835 - RNA, 32 nt, Human
cacugccugcagccucacucagaggggcccuu

SEQ ID NO: 348836 - RNA, 32 nt, Human
cacugccugccuggcccacgcugcugggacgg

SEQ ID NO: 348837 - RNA, 32 nt, Human
cacugccuggaguuccccuuguguacccccuu

SEQ ID NO: 348838 - RNA, 23 nt, Human
cacugccuggugcccuccuggcu

SEQ ID NO: 348839 - RNA, 32 nt, Human
cacugccugucccuccccauccuguguccucu

SEQ ID NO: 348840 - RNA, 23 nt, Human
cacugccuucccggggagcacag

SEQ ID NO: 348841 - RNA, 32 nt, Human
cacugccuucuuguuccagcuaggcaaugccu

SEQ ID NO: 348842 - RNA, 32 nt, Human
cacugccuugacaugaggaccagcaaguuuau

SEQ ID NO: 348843 - RNA, 32 nt, Human
cacugccuugcaauccaaacaguggcaauuuu

SEQ ID NO: 348844 - RNA, 32 nt, Human
cacugccuuugccccagcacagaagaggcccc

SEQ ID NO: 348845 - RNA, 32 nt, Human
cacugccuuugguuuuagcaguucuuugaaaa

SEQ ID NO: 348846 - RNA, 32 nt, Human
cacugcgauauaauacauugccaagcagaaga

SEQ ID NO: 348847 - RNA, 32 nt, Human
cacugcgauccucuugggcucuccuaggaucc

SEQ ID NO: 348848 - RNA, 32 nt, Human
cacugcgcccagcuaaauuuuguauuuuuagu

SEQ ID NO: 348849 - RNA, 32 nt, Human
cacugcgcccagcuaauuuuuguauuuuucgu

SEQ ID NO: 348850 - RNA, 32 nt, Human
cacugcgcccagcugauuuuuguauuuuuagu

SEQ ID NO: 348851 - RNA, 32 nt, Human
cacugcgccccaccucccugccuguguguguu

SEQ ID NO: 348852 - RNA, 32 nt, Human
cacugcgcggcucacauagaagccugagcugg

SEQ ID NO: 348853 - RNA, 32 nt, Human
cacugcgcuguugccgcagcauccugcucagu

SEQ ID NO: 348854 - RNA, 32 nt, Human
cacugcggagcugcagcgccuccuggacacgg

SEQ ID NO: 348855 - RNA, 32 nt, Human
cacugcggcaagaggaccccagcuggggugcu

SEQ ID NO: 348856 - RNA, 32 nt, Human
cacugcggccucaaacuccugggcucaaguga

SEQ ID NO: 348857 - RNA, 32 nt, Human
cacugcggcgucugggcugagccggagggagg

SEQ ID NO: 348858 - RNA, 32 nt, Human
cacugcgggggccaaggaaggaagaaaugugg

SEQ ID NO: 348859 - RNA, 32 nt, Human
cacugcgguaggucauucuuuugccacauccc

SEQ ID NO: 348860 - RNA, 32 nt, Human
cacugcgucuggcuaauuuuuguauuuuuagu

SEQ ID NO: 348861 - RNA, 32 nt, Human
cacugcguggcugaagccucgaggucaccagg

SEQ ID NO: 348862 - RNA, 32 nt, Human
cacugcguguggucaaaguuccucacccagca

SEQ ID NO: 348863 - RNA, 32 nt, Human
cacugcguugcccaggcuggucucaaacucuu

SEQ ID NO: 348864 - RNA, 32 nt, Human
cacugcuaaaacugaagcaccacugugugagc

SEQ ID NO: 348865 - RNA, 32 nt, Human
cacugcuaacaagccccacuggaaucauucgg

SEQ ID NO: 348866 - RNA, 32 nt, Human
cacugcuagaaaggcuucaacugugaauggga

SEQ ID NO: 348867 - RNA, 32 nt, Human
cacugcuagagcuuccuguuaagcaaguguga

SEQ ID NO: 348868 - RNA, 32 nt, Human
cacugcuagcacaggcuccucacucuucucca

SEQ ID NO: 348869 - RNA, 28 nt, Human
cacugcucacacgcugccuccucagcag

SEQ ID NO: 348870 - RNA, 32 nt, Human
cacugcucacauacuuaugugcugcuagucuc

SEQ ID NO: 348871 - RNA, 32 nt, Human
cacugcucacugcagccucgaccucccaaggc

SEQ ID NO: 348872 - RNA, 32 nt, Human
cacugcucagcccagagggccacugcagagau

SEQ ID NO: 348873 - RNA, 19 nt, Human
cacugcucagcugccgccu

SEQ ID NO: 348874 - RNA, 32 nt, Human
cacugcucaggccacugauggguaggagcaac

SEQ ID NO: 348875 - RNA, 32 nt, Human
cacugcucagugcaaccucugccucccaggau

SEQ ID NO: 348876 - RNA, 32 nt, Human
cacugcucaguguguuccuuugcucacuucau

SEQ ID NO: 348877 - RNA, 32 nt, Human
cacugcuccaaacccacccaccaaggacucug

SEQ ID NO: 348878 - RNA, 32 nt, Human
cacugcuccagccucagccagggcagggaggg

SEQ ID NO: 348879 - RNA, 32 nt, Human
cacugcuccaucucuuuuccucccucuccuuc

SEQ ID NO: 348880 - RNA, 32 nt, Human
cacugcuccccacucaccugugcucagggcga

SEQ ID NO: 348881 - RNA, 32 nt, Human
cacugcuccccagcagcuggugccucaaagca

SEQ ID NO: 348882 - RNA, 31 nt, Human
cacugcuccguggaggagguugggagggggu

SEQ ID NO: 348883 - RNA, 32 nt, Human
cacugcuccuccggcucccgggaagccgcgag

SEQ ID NO: 348884 - RNA, 32 nt, Human
cacugcuccugccucuagggugcaguguccgu

SEQ ID NO: 348885 - RNA, 32 nt, Human
cacugcuccuggauucuguucuuggggaacag

SEQ ID NO: 348886 - RNA, 32 nt, Human
cacugcucucccagcccugccugggccuaccu

SEQ ID NO: 348887 - RNA, 32 nt, Human
cacugcucuccuuuuaaucauguauucaucua

SEQ ID NO: 348888 - RNA, 20 nt, Human
cacugcucucuauguuuuaa

SEQ ID NO: 348889 - RNA, 32 nt, Human
cacugcucuguaaaggcagcuggcagcuuuuu

SEQ ID NO: 348890 - RNA, 32 nt, Human
cacugcucuguaacuauuuacaguauucuuug

SEQ ID NO: 348891 - RNA, 32 nt, Human
cacugcucugugggacgcggcgaccccucucc

SEQ ID NO: 348892 - RNA, 32 nt, Human
cacugcugaacaauguggccugggugggguuu

SEQ ID NO: 348893 - RNA, 32 nt, Human
cacugcugaccuuugcaaaggcugccgagcuu

SEQ ID NO: 348894 - RNA, 32 nt, Human
cacugcugagccacucuuagccacaccucagc

SEQ ID NO: 348895 - RNA, 32 nt, Human
cacugcugagcuccucaccuggacagucuccu

SEQ ID NO: 348896 - RNA, 32 nt, Human
cacugcugagugagguugaggggugucucggu

SEQ ID NO: 348897 - RNA, 23 nt, Human
cacugcugauugucacucuuuua

SEQ ID NO: 348898 - RNA, 32 nt, Human
cacugcugcaaccucccccuccuggguucaag

SEQ ID NO: 348899 - RNA, 32 nt, Human
cacugcugcacuccagccugcgggacagagug

SEQ ID NO: 348900 - RNA, 32 nt, Human
cacugcugcacuuuagccugggugaaaaagug

SEQ ID NO: 348901 - RNA, 32 nt, Human
cacugcugcagggccuuccugccuggacagag

SEQ ID NO: 348902 - RNA, 31 nt, Human
cacugcugccucucaaguguugcauuguccc

SEQ ID NO: 348903 - RNA, 31 nt, Human
cacugcugccucuccugggcauggcuguuag

SEQ ID NO: 348904 - RNA, 31 nt, Human
cacugcugcggaggaacugccuucagagaag

SEQ ID NO: 348905 - RNA, 22 nt, Human
cacugcugcuacugccccucuc

SEQ ID NO: 348906 - RNA, 32 nt, Human
cacugcugcuccuucccaucucgaggaacugu

SEQ ID NO: 348907 - RNA, 32 nt, Human
cacugcugcugcuucugcuccugcugccgcug

SEQ ID NO: 348908 - RNA, 32 nt, Human
cacugcuggacaggaauuaacucuccaaaggu

SEQ ID NO: 348909 - RNA, 32 nt, Human
cacugcuggaggcauaauguacaaggcaggaa

SEQ ID NO: 348910 - RNA, 32 nt, Human
cacugcuggaucccaggagcagguguggaaca

SEQ ID NO: 348911 - RNA, 32 nt, Human
cacugcuggcuauaaagauuuggagaccuggg

SEQ ID NO: 348912 - RNA, 32 nt, Human
cacugcugggaccugggccaugucuccccacc

SEQ ID NO: 348913 - RNA, 32 nt, Human
cacugcugggagaagaaacaggccgaggccca

SEQ ID NO: 348914 - RNA, 32 nt, Human
cacugcugggcuggaggagggcucgagcugcg

SEQ ID NO: 348915 - RNA, 32 nt, Human
cacugcuggggagaggagggcagugaggagcg

SEQ ID NO: 348916 - RNA, 32 nt, Human
cacugcugggugguggaggugggcaguggcac

SEQ ID NO: 348917 - RNA, 32 nt, Human
cacugcuggugcccuucucuucugaccugcug

SEQ ID NO: 348918 - RNA, 22 nt, Human
cacugcuggugggagcaggaag

SEQ ID NO: 348919 - RNA, 32 nt, Human
cacugcuguaccggccaccacccuccggccac

SEQ ID NO: 348920 - RNA, 32 nt, Human
cacugcuguccagccacagccccagcccaggc

SEQ ID NO: 348921 - RNA, 32 nt, Human
cacugcugugagugcgccucaccagaaccagu

SEQ ID NO: 348922 - RNA, 32 nt, Human
cacugcugugauucagggaucuuucuucuaaa

SEQ ID NO: 348923 - RNA, 23 nt, Human
cacugcuguggaaccaccuggcu

SEQ ID NO: 348924 - RNA, 32 nt, Human
cacugcuuaagggguuucagcaacacagaaac

SEQ ID NO: 348925 - RNA, 32 nt, Human
cacugcuuaagugccugcaggagccgccugcc

SEQ ID NO: 348926 - RNA, 32 nt, Human
cacugcuuagcccaaaguaauaguacuuuuga

SEQ ID NO: 348927 - RNA, 32 nt, Human
cacugcuucaacaggggccagaacagucugcc

SEQ ID NO: 348928 - RNA, 32 nt, Human
cacugcuucagagacacgaaccaccuugagug

SEQ ID NO: 348929 - RNA, 31 nt, Human
cacugcuuccaaacucugccugugucccaug

SEQ ID NO: 348930 - RNA, 32 nt, Human
cacugcuucucccagcauucuggugccuccaa

SEQ ID NO: 348931 - RNA, 32 nt, Human
cacugcuucucccaucucucuccugcccaacc

SEQ ID NO: 348932 - RNA, 32 nt, Human
cacugcuucugggaggggcgggcagacauggu

SEQ ID NO: 348933 - RNA, 32 nt, Human
cacugcuucugugaacagucuuugucuccucc

SEQ ID NO: 348934 - RNA, 32 nt, Human
cacugcuugaagcacagcacuugguuaggggg

SEQ ID NO: 348935 - RNA, 32 nt, Human
cacugcuugccuggccucgugcuuggauuguc

SEQ ID NO: 348936 - RNA, 32 nt, Human
cacugcuuggauaagccaggugcaaugugcau

SEQ ID NO: 348937 - RNA, 32 nt, Human
cacugcuuggggaggaagacgaagaggcacug

SEQ ID NO: 348938 - RNA, 32 nt, Human
cacugcuuucaacacugcaugacuguaaaaac

SEQ ID NO: 348939 - RNA, 32 nt, Human
cacuggaaacacacccaccgcaaccucaagaa

SEQ ID NO: 348940 - RNA, 28 nt, Human
cacuggaaacuaggccgggaagcagcag

SEQ ID NO: 348941 - RNA, 32 nt, Human
cacuggaaagaggggcuuggagagggagacag

SEQ ID NO: 348942 - RNA, 31 nt, Human
cacuggaaccucccugggccugucucagauu

SEQ ID NO: 348943 - RNA, 32 nt, Human
cacuggaacguuucacugcaaacacaccuugg

SEQ ID NO: 348944 - RNA, 32 nt, Human
cacuggaauauaaaacagccauggucugauau

SEQ ID NO: 348945 - RNA, 32 nt, Human
cacuggacacagaaauggaaaacaggagucga

SEQ ID NO: 348946 - RNA, 32 nt, Human
cacuggacagagggccagaguggguagugggg

SEQ ID NO: 348947 - RNA, 32 nt, Human
cacuggacucaggcaugucuauggcugccugu

SEQ ID NO: 348948 - RNA, 21 nt, Human
cacuggacuccagccuggaca

SEQ ID NO: 348949 - RNA, 18 nt, Human
cacuggacucccauugaa

SEQ ID NO: 348950 - RNA, 32 nt, Human
cacuggacucuuuauccuuagaagaacccaag

SEQ ID NO: 348951 - RNA, 32 nt, Human
cacuggacugcagacccggccugguggggcca

SEQ ID NO: 348952 - RNA, 26 nt, Human
cacuggacugcauggggaggcagcag

SEQ ID NO: 348953 - RNA, 32 nt, Human
cacuggacuguccuguuugccuccaggagaac

SEQ ID NO: 348954 - RNA, 32 nt, Human
cacuggacuguggagggagccuuaaaccuuug

SEQ ID NO: 348955 - RNA, 32 nt, Human
cacuggacuucuguccagagcuccucagcuca

SEQ ID NO: 348956 - RNA, 32 nt, Human
cacuggagaagacaggaggguccuguagugua

SEQ ID NO: 348957 - RNA, 32 nt, Human
cacuggagacagugucaggccaggcauggugg

SEQ ID NO: 348958 - RNA, 32 nt, Human
cacuggagacgggguuucacuguguuagccac

SEQ ID NO: 348959 - RNA, 32 nt, Human
cacuggagagguuaagauagaggcucaagaac

SEQ ID NO: 348960 - RNA, 32 nt, Human
cacuggagcagucuguccuuaugccgaaucaa

SEQ ID NO: 348961 - RNA, 32 nt, Human
cacuggagccagccccacccuaggcaggaaga

SEQ ID NO: 348962 - RNA, 32 nt, Human
cacuggagccucugccuuccagguucaaguga

SEQ ID NO: 348963 - RNA, 32 nt, Human
cacuggagcuaccagaagcaucauggggcccu

SEQ ID NO: 348964 - RNA, 32 nt, Human
cacuggagcugaugucuggcaucuccagggcc

SEQ ID NO: 348965 - RNA, 32 nt, Human
cacuggaggcacaccugcuauaccucaugccu

SEQ ID NO: 348966 - RNA, 32 nt, Human
cacuggaggcauucuucaggcuccuuuaaggc

SEQ ID NO: 348967 - RNA, 21 nt, Human
cacuggagggagcugguuuga

SEQ ID NO: 348968 - RNA, 32 nt, Human
cacuggagggcagaggccucaguguccagcac

SEQ ID NO: 348969 - RNA, 32 nt, Human
cacuggagugguaacaagaggagcaggaagca

SEQ ID NO: 348970 - RNA, 32 nt, Human
cacuggauaauuacuuuugugauuuagauuuu

SEQ ID NO: 348971 - RNA, 32 nt, Human
cacuggaucagccuggucauucuguccguguu

SEQ ID NO: 348972 - RNA, 32 nt, Human
cacuggaucugagaaacuucccaggggaccgc

SEQ ID NO: 348973 - RNA, 32 nt, Human
cacuggaucuggagaguggaggaagcacuggg

SEQ ID NO: 348974 - RNA, 32 nt, Human
cacuggauggaaaauugugagcacauaagugu

SEQ ID NO: 348975 - RNA, 32 nt, Human
cacuggauggacuuggcuucagacucggacuu

SEQ ID NO: 348976 - RNA, 32 nt, Human
cacuggauugaccacuccauauuuugcuaccu

SEQ ID NO: 348977 - RNA, 18 nt, Human
cacuggauugggggauag

SEQ ID NO: 348978 - RNA, 32 nt, Human
cacuggcaagauuucaagaccacucucugcac

SEQ ID NO: 348979 - RNA, 32 nt, Human
cacuggcaagcccugagguagggauggcuggc

SEQ ID NO: 348980 - RNA, 32 nt, Human
cacuggcaauggacggccucagccuggagcca

SEQ ID NO: 348981 - RNA, 32 nt, Human
cacuggcacacacacauacacacauaugcaca

SEQ ID NO: 348982 - RNA, 32 nt, Human
cacuggcacacaggcuggaaaacgggcacugg

SEQ ID NO: 348983 - RNA, 32 nt, Human
cacuggcaccccggaaccucaggggcugccga

SEQ ID NO: 348984 - RNA, 32 nt, Human
cacuggcacugcacgaggggccaggagagcag

SEQ ID NO: 348985 - RNA, 32 nt, Human
cacuggcacuucagacuacacuaaaucagagu

SEQ ID NO: 348986 - RNA, 32 nt, Human
cacuggcagcauuaucucaggcucccuagaau

SEQ ID NO: 348987 - RNA, 32 nt, Human
cacuggcagccgcuggugucucuucacacaga

SEQ ID NO: 348988 - RNA, 32 nt, Human
cacuggcagcuugcacucucagccugaaaaag

SEQ ID NO: 348989 - RNA, 32 nt, Human
cacuggcaggcgagggcucucguucauauucu

SEQ ID NO: 348990 - RNA, 32 nt, Human
cacuggcaucuucuuuuaacuugggccaucug

SEQ ID NO: 348991 - RNA, 32 nt, Human
cacuggcaugggagacccuugacaacugcuga

SEQ ID NO: 348992 - RNA, 32 nt, Human
cacuggccacaauacccaccucuguggaugau

SEQ ID NO: 348993 - RNA, 32 nt, Human
cacuggccaccucuggaggcucugccuuuccc

SEQ ID NO: 348994 - RNA, 22 nt, Human
cacuggccagagccuggcccag

SEQ ID NO: 348995 - RNA, 32 nt, Human
cacuggccaguucuaccauagacuugacugca

SEQ ID NO: 348996 - RNA, 32 nt, Human
cacuggccaucagcacuuucucccucugccag

SEQ ID NO: 348997 - RNA, 32 nt, Human
cacuggccauucuggucaucucagucuggaac

SEQ ID NO: 348998 - RNA, 32 nt, Human
cacuggcccacacauuccuuucuacagagaau

SEQ ID NO: 348999 - RNA, 32 nt, Human
cacuggcccagaggaagcuucuguuguguuca

SEQ ID NO: 349000 - RNA, 32 nt, Human
cacuggcccaugagccucugccuggccccugc

SEQ ID NO: 349001 - RNA, 21 nt, Human
cacuggccccgcagcccuugg

SEQ ID NO: 349002 - RNA, 19 nt, Human
cacuggcccgugcugccug

SEQ ID NO: 349003 - RNA, 32 nt, Human
cacuggcccuugcccaaggcagggaagaagga

SEQ ID NO: 349004 - RNA, 32 nt, Human
cacuggccgaggugaugcccacccuucccugg

SEQ ID NO: 349005 - RNA, 32 nt, Human
cacuggccgccucccuccucuggccaauccuc

SEQ ID NO: 349006 - RNA, 32 nt, Human
cacuggccggggucuggcugggucuggcgcuc

SEQ ID NO: 349007 - RNA, 23 nt, Human
cacuggccguggucuacagcgug

SEQ ID NO: 349008 - RNA, 32 nt, Human
cacuggccuccaccaccugaccagaguguucu

SEQ ID NO: 349009 - RNA, 32 nt, Human
cacuggccuccauaauuccugccugcagaucu

SEQ ID NO: 349010 - RNA, 32 nt, Human
cacuggccucugccucugcccugggccaaaag

SEQ ID NO: 349011 - RNA, 32 nt, Human
cacuggccucugggcuagcccagagucccuua

SEQ ID NO: 349012 - RNA, 32 nt, Human
cacuggccugagcaugcagccuggagaguguu

SEQ ID NO: 349013 - RNA, 32 nt, Human
cacuggccuggguagagccagggcgagcacca

SEQ ID NO: 349014 - RNA, 32 nt, Human
cacuggccuucugaugaaauguuaacaaugcc

SEQ ID NO: 349015 - RNA, 32 nt, Human
cacuggccuuucuguuccuuggacaugccugg

SEQ ID NO: 349016 - RNA, 32 nt, Human
cacuggccuuucuucuacccaccucuaaagcu

SEQ ID NO: 349017 - RNA, 32 nt, Human
cacuggccuuucuuuccgucuagccuccucuu

SEQ ID NO: 349018 - RNA, 32 nt, Human
cacuggccuuugcaguccccaaaggaucaggu

SEQ ID NO: 349019 - RNA, 32 nt, Human
cacuggcucauuucucgcaaauaccucgaagg

SEQ ID NO: 349020 - RNA, 32 nt, Human
cacuggcuccaacuuccuccucauggggcauu

SEQ ID NO: 349021 - RNA, 32 nt, Human
cacuggcuccacugagggcgccuaacucuaca

SEQ ID NO: 349022 - RNA, 32 nt, Human
cacuggcuccccaguauucuggaaaaggggua

SEQ ID NO: 349023 - RNA, 32 nt, Human
cacuggcucccugauggcaccugcuggaggaa

SEQ ID NO: 349024 - RNA, 32 nt, Human
cacuggcucccuggaagagaucaagccaucgg

SEQ ID NO: 349025 - RNA, 32 nt, Human
cacuggcuccugccaucuccucugccaugaag

SEQ ID NO: 349026 - RNA, 18 nt, Human
cacuggcucggcccugcc

SEQ ID NO: 349027 - RNA, 23 nt, Human
cacuggcucugagcugacauuga

SEQ ID NO: 349028 - RNA, 32 nt, Human
cacuggcugagcggaugcaucuggggaugagg

SEQ ID NO: 349029 - RNA, 32 nt, Human
cacuggcugagcugcaagacauccuggaauug

SEQ ID NO: 349030 - RNA, 32 nt, Human
cacuggcugcaagugguuaagaauguauauca

SEQ ID NO: 349031 - RNA, 32 nt, Human
cacuggcugcagcuguuccuggagggccugcg

SEQ ID NO: 349032 - RNA, 32 nt, Human
cacuggcugcccaggcugaauggcagugccug

SEQ ID NO: 349033 - RNA, 32 nt, Human
cacuggcugugccucccccgccaccugugugu

SEQ ID NO: 349034 - RNA, 21 nt, Human
cacuggcuguguccccugcca

SEQ ID NO: 349035 - RNA, 18 nt, Human
cacuggcuuggaacaccu

SEQ ID NO: 349036 - RNA, 21 nt, Human
cacuggcuuuaggacagggag

SEQ ID NO: 349037 - RNA, 32 nt, Human
cacuggcuuucuguuuucacaagacagacguc

SEQ ID NO: 349038 - RNA, 24 nt, Human
cacuggcuuuuauaagagcagcag

SEQ ID NO: 349039 - RNA, 32 nt, Human
cacugggaaauguaaaaaucuucacucaccau

SEQ ID NO: 349040 - RNA, 32 nt, Human
cacugggaacaacagguugccuuagaagcuuu

SEQ ID NO: 349041 - RNA, 32 nt, Human
cacugggaccacgaggcagggagccaggcuug

SEQ ID NO: 349042 - RNA, 32 nt, Human
cacugggaccagcaggugaagcguugcaacau

SEQ ID NO: 349043 - RNA, 32 nt, Human
cacugggaccccaggcaugcaccaccucacca

SEQ ID NO: 349044 - RNA, 32 nt, Human
cacugggacccucaccugucucuggcuucugc

SEQ ID NO: 349045 - RNA, 32 nt, Human
cacugggagaagggaugugggucugagagcuu

SEQ ID NO: 349046 - RNA, 32 nt, Human
cacugggagaggggccagaggagcggcuaugg

SEQ ID NO: 349047 - RNA, 32 nt, Human
cacugggagccaugggucccacugccugucca

SEQ ID NO: 349048 - RNA, 32 nt, Human
cacugggagcuuccccauccucccugccuucc

SEQ ID NO: 349049 - RNA, 32 nt, Human
cacugggaggaggcggugcggcgaagcgcuca

SEQ ID NO: 349050 - RNA, 32 nt, Human
cacugggaggccucuggagccgaacugcaaac

SEQ ID NO: 349051 - RNA, 32 nt, Human
cacugggaggccugagagugggccagcucgcu

SEQ ID NO: 349052 - RNA, 32 nt, Human
cacugggagggccaacuuggaggaucagugcu

SEQ ID NO: 349053 - RNA, 32 nt, Human
cacugggaggggcugggaccuuccacaggguc

SEQ ID NO: 349054 - RNA, 32 nt, Human
cacugggagugagggucacaaaggagaccuug

SEQ ID NO: 349055 - RNA, 32 nt, Human
cacugggaucacugggacacugucuuaugaag

SEQ ID NO: 349056 - RNA, 32 nt, Human
cacugggaugccgcagccuggccggcuguggg

SEQ ID NO: 349057 - RNA, 32 nt, Human
cacugggaugcucugcuauuugcacauuuuga

SEQ ID NO: 349058 - RNA, 32 nt, Human
cacugggauuacaggcaugagccaccaugccu

SEQ ID NO: 349059 - RNA, 32 nt, Human
cacugggauuacaggcaugagccaccgcgccu

SEQ ID NO: 349060 - RNA, 32 nt, Human
cacugggauuacaggcgugagccacccggccu

SEQ ID NO: 349061 - RNA, 32 nt, Human
cacugggauuacaggugcccaccaccacacca

SEQ ID NO: 349062 - RNA, 32 nt, Human
cacugggcagaggcacgagcacguccacauag

SEQ ID NO: 349063 - RNA, 32 nt, Human
cacugggccaugugacaacugcaccugugugg

SEQ ID NO: 349064 - RNA, 32 nt, Human
cacugggcccaaagugucuccccaccagccag

SEQ ID NO: 349065 - RNA, 32 nt, Human
cacugggccccucaggggaagcugcuagggga

SEQ ID NO: 349066 - RNA, 32 nt, Human
cacugggccggcagccugguucccucuuuccu

SEQ ID NO: 349067 - RNA, 32 nt, Human
cacugggccucuuguccaucuuccugcaggac

SEQ ID NO: 349068 - RNA, 32 nt, Human
cacugggccugagaccuuuucugcuguccagg

SEQ ID NO: 349069 - RNA, 32 nt, Human
cacugggcggguuccccucugcugcuugugcg

SEQ ID NO: 349070 - RNA, 32 nt, Human
cacugggcucaagaugauucuccuuccucggc

SEQ ID NO: 349071 - RNA, 32 nt, Human
cacugggcucacugcaggcaugcugaacaagg

SEQ ID NO: 349072 - RNA, 32 nt, Human
cacugggcucucccucccccagccuggagcac

SEQ ID NO: 349073 - RNA, 32 nt, Human
cacugggcucuguuuucacuguucgucugcug

SEQ ID NO: 349074 - RNA, 32 nt, Human
cacugggcugaaaucaagguguuaacagggcu

SEQ ID NO: 349075 - RNA, 32 nt, Human
cacugggcuucugcuuucugcucuggcccaca

SEQ ID NO: 349076 - RNA, 21 nt, Human
cacuggggaaagaguuuguca

SEQ ID NO: 349077 - RNA, 32 nt, Human
cacuggggaaugcucccagcugugcuguggag

SEQ ID NO: 349078 - RNA, 22 nt, Human
cacuggggacacaaaggggaca

SEQ ID NO: 349079 - RNA, 24 nt, Human
cacuggggacacagaguucagaca

SEQ ID NO: 349080 - RNA, 32 nt, Human
cacuggggaggaauccuggaccaagcacaaaa

SEQ ID NO: 349081 - RNA, 22 nt, Human
cacuggggauuacaauuugaca

SEQ ID NO: 349082 - RNA, 32 nt, Human
cacuggggcaagggugacagacacgagaaugg

SEQ ID NO: 349083 - RNA, 32 nt, Human
cacuggggcagaggacugggaaccgcggcagc

SEQ ID NO: 349084 - RNA, 32 nt, Human
cacuggggcaggcggagggcccugcgugcucc

SEQ ID NO: 349085 - RNA, 32 nt, Human
cacuggggccaggcucacaccuguaauccuaa

SEQ ID NO: 349086 - RNA, 32 nt, Human
cacuggggcugcuacauaauauuuucauuuga

SEQ ID NO: 349087 - RNA, 32 nt, Human
cacuggggcuggcuggguuggaaagugggcug

SEQ ID NO: 349088 - RNA, 26 nt, Human
cacuggggcuucccaggaggcagcag

SEQ ID NO: 349089 - RNA, 24 nt, Human
cacuggggcuugcuauuuuaugag

SEQ ID NO: 349090 - RNA, 32 nt, Human
cacugggggagggaugguuugggcaggugcag

SEQ ID NO: 349091 - RNA, 32 nt, Human
cacugggggcaacccuuccaggaaggaguugg

SEQ ID NO: 349092 - RNA, 32 nt, Human
cacugggggcucgaagacugguuucuagcacu

SEQ ID NO: 349093 - RNA, 32 nt, Human
cacugggguauggcgucgaggcuuccaugggg

SEQ ID NO: 349094 - RNA, 32 nt, Human
cacugggguggaggcggcaggaaggggcggcc

SEQ ID NO: 349095 - RNA, 32 nt, Human
cacuggguaacaguguaguauccugugagaga

SEQ ID NO: 349096 - RNA, 32 nt, Human
cacugggucaccaucgagaucaauccuccucc

SEQ ID NO: 349097 - RNA, 19 nt, Human
cacugggucuccacagcgg

SEQ ID NO: 349098 - RNA, 32 nt, Human
cacugggucugaggcuuuugaggacagucagg

SEQ ID NO: 349099 - RNA, 32 nt, Human
cacugggugaagccagcugggcuccugagucu

SEQ ID NO: 349100 - RNA, 32 nt, Human
cacugggugaauccucccucucagaaccaaua

SEQ ID NO: 349101 - RNA, 32 nt, Human
cacuggguggcuguggagggagcucagcccuc

SEQ ID NO: 349102 - RNA, 32 nt, Human
cacuggguucaucagagcagugugugaaauuc

SEQ ID NO: 349103 - RNA, 32 nt, Human
cacuggguugggagccggguccugguuuccaa

SEQ ID NO: 349104 - RNA, 32 nt, Human
cacugguaagaaugagaaugaaauacuuaaag

SEQ ID NO: 349105 - RNA, 32 nt, Human
cacugguaaggcucagccuacagaaagauuug

SEQ ID NO: 349106 - RNA, 32 nt, Human
cacugguagaugccguuucuucccuuccccuu

SEQ ID NO: 349107 - RNA, 32 nt, Human
cacugguaugauggccccggugcauugugcca

SEQ ID NO: 349108 - RNA, 32 nt, Human
cacugguauuccugccuccauauuuucuuuaa

SEQ ID NO: 349109 - RNA, 32 nt, Human
cacugguauuuggagcaagugacaugccaucc

SEQ ID NO: 349110 - RNA, 32 nt, Human
cacuggucagagaguucgcaguggggagaagu

SEQ ID NO: 349111 - RNA, 32 nt, Human
cacugguccaggucuucaguuuccgaaucucu

SEQ ID NO: 349112 - RNA, 32 nt, Human
cacuggucuacccgccgcccuccugggaacuc

SEQ ID NO: 349113 - RNA, 21 nt, Human
cacuggucuagagagcggcag

SEQ ID NO: 349114 - RNA, 32 nt, Human
cacuggucucaaacuccugaccucaggcgauc

SEQ ID NO: 349115 - RNA, 32 nt, Human
cacuggucucaaacuccugaccucaggugauc

SEQ ID NO: 349116 - RNA, 32 nt, Human
cacuggucucagacacaggccccugguguccc

SEQ ID NO: 349117 - RNA, 32 nt, Human
cacuggucugcugggagaaucaagaacagaac

SEQ ID NO: 349118 - RNA, 23 nt, Human
cacuggucuguggacagcagcag

SEQ ID NO: 349119 - RNA, 32 nt, Human
cacuggucuuguccucuucuccagcauggugu

SEQ ID NO: 349120 - RNA, 23 nt, Human
cacuggugaacugagcugggcag

SEQ ID NO: 349121 - RNA, 32 nt, Human
cacuggugaaggagcagugaggaaccugcaga

SEQ ID NO: 349122 - RNA, 32 nt, Human
cacuggugacugggcucaugccuccaagucag

SEQ ID NO: 349123 - RNA, 32 nt, Human
cacuggugagggggcagcaugggugaagccca

SEQ ID NO: 349124 - RNA, 32 nt, Human
cacuggugcagaucggagaaucugcagaggua

SEQ ID NO: 349125 - RNA, 32 nt, Human
cacuggugcagucugaaaguuacacccaaaau

SEQ ID NO: 349126 - RNA, 32 nt, Human
cacuggugccagccuggaugcaggcuggguag

SEQ ID NO: 349127 - RNA, 32 nt, Human
cacuggugggaggcgguugggaaaguugcagg

SEQ ID NO: 349128 - RNA, 32 nt, Human
cacuggugggaggcuggcggagucagugacua

SEQ ID NO: 349129 - RNA, 32 nt, Human
cacugguggggugggaggagcaccacucacuu

SEQ ID NO: 349130 - RNA, 24 nt, Human
cacugguggguugcaggaacagca

SEQ ID NO: 349131 - RNA, 32 nt, Human
cacugguggugccggcauuugagacccugcgc

SEQ ID NO: 349132 - RNA, 20 nt, Human
cacugguguuuucccugcca

SEQ ID NO: 349133 - RNA, 32 nt, Human
cacugguuccagggauuaaggaaugaaccucu

SEQ ID NO: 349134 - RNA, 32 nt, Human
cacugguucugaggccccuacccucccaggcu

SEQ ID NO: 349135 - RNA, 32 nt, Human
cacugguucuugaagcuuuggcccagaaguaa

SEQ ID NO: 349136 - RNA, 32 nt, Human
cacugguugcagacgucuuuauaggcagucac

SEQ ID NO: 349137 - RNA, 32 nt, Human
cacugguugccugaacagucacacuugcaacc

SEQ ID NO: 349138 - RNA, 32 nt, Human
cacugguuggagcgccgcgccgcgcccgagcc

SEQ ID NO: 349139 - RNA, 32 nt, Human
cacugguuucaggauacucaucaguccugauu

SEQ ID NO: 349140 - RNA, 32 nt, Human
cacugguuuucaugcgcuguuuuuguuuuaaa

SEQ ID NO: 349141 - RNA, 32 nt, Human
cacugguuuuguugccccagggcugcuuugcu

SEQ ID NO: 349142 - RNA, 21 nt, Human
cacuguaaaacaaagaaccaa

SEQ ID NO: 349143 - RNA, 32 nt, Human
cacuguaaaacuaguuagcugaagacgacuuc

SEQ ID NO: 349144 - RNA, 32 nt, Human
cacuguaaaaugugggauuaugggucacagga

SEQ ID NO: 349145 - RNA, 32 nt, Human
cacuguaaacaugcuuuuaauaagaaggguag

SEQ ID NO: 349146 - RNA, 32 nt, Human
cacuguaaccaugugccaucaucccccaagag

SEQ ID NO: 349147 - RNA, 32 nt, Human
cacuguaaccucuggguucaagcaauucuucu

SEQ ID NO: 349148 - RNA, 32 nt, Human
cacuguaacuagcaggccacaggaagcaaagc

SEQ ID NO: 349149 - RNA, 32 nt, Human
cacuguaacugccgagcugccugcugucacgu

SEQ ID NO: 349150 - RNA, 32 nt, Human
cacuguaauacagcuuaaaauauuuuuagaau

SEQ ID NO: 349151 - RNA, 32 nt, Human
cacuguaaugcaugagugcggggauguggugu

SEQ ID NO: 349152 - RNA, 32 nt, Human
cacuguacagaagagccaccacugggaugggg

SEQ ID NO: 349153 - RNA, 32 nt, Human
cacuguacaucaccagccugggcgacagagug

SEQ ID NO: 349154 - RNA, 32 nt, Human
cacuguaccccaucaagcuuacucugaaucaa

SEQ ID NO: 349155 - RNA, 32 nt, Human
cacuguacccuccagcgagucccaggagagug

SEQ ID NO: 349156 - RNA, 32 nt, Human
cacuguaccugcccuagaaccugggccuaggc

SEQ ID NO: 349157 - RNA, 32 nt, Human
cacuguacuccagcacucuagccugggcgaca

SEQ ID NO: 349158 - RNA, 22 nt, Human
cacuguacuccagccugaagag

SEQ ID NO: 349159 - RNA, 20 nt, Human
cacuguacuccagccuggca

SEQ ID NO: 349160 - RNA, 21 nt, Human
cacuguacuccagccugggca

SEQ ID NO: 349161 - RNA, 32 nt, Human
cacuguacuccagccugggugacagggcaaga

SEQ ID NO: 349162 - RNA, 32 nt, Human
cacuguacuucuccaccgacguguacccgagg

SEQ ID NO: 349163 - RNA, 32 nt, Human
cacuguagccacaaccucucaggcucaaguga

SEQ ID NO: 349164 - RNA, 32 nt, Human
cacuguagccagacugccucucuagauuccuc

SEQ ID NO: 349165 - RNA, 32 nt, Human
cacuguagccugggugacaaagugagacccug

SEQ ID NO: 349166 - RNA, 32 nt, Human
cacuguagcucuaaucgugccugguguucuga

SEQ ID NO: 349167 - RNA, 32 nt, Human
cacuguaggaggaucaauugagccuagaaguu

SEQ ID NO: 349168 - RNA, 32 nt, Human
cacuguaggaggcagauccaagaggcuuccua

SEQ ID NO: 349169 - RNA, 31 nt, Human
cacuguaggcggccgaggugggugaaucaca

SEQ ID NO: 349170 - RNA, 22 nt, Human
cacuguagucucaaccuccugg

SEQ ID NO: 349171 - RNA, 24 nt, Human
cacuguagucucgaccucccaggc

SEQ ID NO: 349172 - RNA, 32 nt, Human
cacuguaguucucucauuuccaaaccaucagc

SEQ ID NO: 349173 - RNA, 32 nt, Human
cacuguauguuccucucuuuuggaguugugac

SEQ ID NO: 349174 - RNA, 32 nt, Human
cacuguauucucaaccuccuaggcucaaauga

SEQ ID NO: 349175 - RNA, 32 nt, Human
cacuguauuuggaauucugccugcuagugaua

SEQ ID NO: 349176 - RNA, 32 nt, Human
cacuguauuuggagaaaaugguaagaguucca

SEQ ID NO: 349177 - RNA, 32 nt, Human
cacugucaaaucuucugcccuggaccagaaac

SEQ ID NO: 349178 - RNA, 32 nt, Human
cacugucaaccaggccagagugcagugaagau

SEQ ID NO: 349179 - RNA, 32 nt, Human
cacugucacacagcuuauaacauguaugcuuu

SEQ ID NO: 349180 - RNA, 32 nt, Human
cacugucacacucaacaucaccucucaggguc

SEQ ID NO: 349181 - RNA, 19 nt, Human
cacugucaccauccugccu

SEQ ID NO: 349182 - RNA, 21 nt, Human
cacugucacccagagcagcca

SEQ ID NO: 349183 - RNA, 32 nt, Human
cacugucacccaggccggagugcaguggcaca

SEQ ID NO: 349184 - RNA, 32 nt, Human
cacugucacccaggcugaacugcaguggugug

SEQ ID NO: 349185 - RNA, 32 nt, Human
cacugucacccaggcugcuggaguacaguggc

SEQ ID NO: 349186 - RNA, 32 nt, Human
cacugucacccaggcuggagugcaguggcaug

SEQ ID NO: 349187 - RNA, 32 nt, Human
cacugucacccaggcuggagugcaguggcgcg

SEQ ID NO: 349188 - RNA, 32 nt, Human
cacugucacccaggcuggagugcaguguugca

SEQ ID NO: 349189 - RNA, 32 nt, Human
cacugucacccagucuggaguggaguggcaua

SEQ ID NO: 349190 - RNA, 32 nt, Human
cacugucacccgggcuggagugcaauggcucg

SEQ ID NO: 349191 - RNA, 32 nt, Human
cacugucaccuaggcuggagugcagugguaaa

SEQ ID NO: 349192 - RNA, 32 nt, Human
cacugucaccucucaccaacauucuaaaucau

SEQ ID NO: 349193 - RNA, 32 nt, Human
cacugucagauuuccacucuucugccuuuagg

SEQ ID NO: 349194 - RNA, 32 nt, Human
cacugucaggagaaaagaagaggauucacaua

SEQ ID NO: 349195 - RNA, 32 nt, Human
cacugucagggcuagccugccugcuuacgcgc

SEQ ID NO: 349196 - RNA, 32 nt, Human
cacugucagucuuugcaccugcuuucaguguu

SEQ ID NO: 349197 - RNA, 32 nt, Human
cacuguccacaaccacacagauauguuuccca

SEQ ID NO: 349198 - RNA, 32 nt, Human
cacuguccagaggcuuuggcugcauggucuga

SEQ ID NO: 349199 - RNA, 32 nt, Human
cacuguccaggcaaaugccaggccuugucccc

SEQ ID NO: 349200 - RNA, 32 nt, Human
cacuguccaggccucagacucuggggcagaga

SEQ ID NO: 349201 - RNA, 32 nt, Human
cacugucccacaagagcuuuccugccuaauga

SEQ ID NO: 349202 - RNA, 32 nt, Human
cacugucccagcugccaccuagacucggagcu

SEQ ID NO: 349203 - RNA, 32 nt, Human
cacugucccccaggcuggagugcaguggcaug

SEQ ID NO: 349204 - RNA, 32 nt, Human
cacugucccugccuguccccaucccacagagg

SEQ ID NO: 349205 - RNA, 31 nt, Human
cacuguccugagagaggaggaggcugggcag

SEQ ID NO: 349206 - RNA, 32 nt, Human
cacuguccugcaggaagcccucgggguagggc

SEQ ID NO: 349207 - RNA, 32 nt, Human
cacuguccugguuucuccuccuggagucuaau

SEQ ID NO: 349208 - RNA, 32 nt, Human
cacuguccuguuuuccagagcugcugcaccau

SEQ ID NO: 349209 - RNA, 32 nt, Human
cacugucgcacuccagccuggaugauagagca

SEQ ID NO: 349210 - RNA, 32 nt, Human
cacugucgcccaaucuggagugcacuggcgcu

SEQ ID NO: 349211 - RNA, 32 nt, Human
cacugucgcccaggcuggagugcaguggcgca

SEQ ID NO: 349212 - RNA, 32 nt, Human
cacugucgcccaggcuggagugcaguggcgug

SEQ ID NO: 349213 - RNA, 32 nt, Human
cacugucgcccaggcuggagugcgguggugca

SEQ ID NO: 349214 - RNA, 32 nt, Human
cacugucgccuaggcuggagugcaacagugug

SEQ ID NO: 349215 - RNA, 32 nt, Human
cacugucgcgguguaguuguccaccucgcagg

SEQ ID NO: 349216 - RNA, 32 nt, Human
cacugucguccucugcggccucugccacuggu

SEQ ID NO: 349217 - RNA, 32 nt, Human
cacugucucaggcuggaggucagcgaaccucg

SEQ ID NO: 349218 - RNA, 32 nt, Human
cacugucuccaccucaguuccucagggcuguu

SEQ ID NO: 349219 - RNA, 32 nt, Human
cacugucuccaucagugcuguugaacucaaau

SEQ ID NO: 349220 - RNA, 32 nt, Human
cacugucuccauccuccaccucugagauggac

SEQ ID NO: 349221 - RNA, 32 nt, Human
cacugucucccaggcuggaauguagggugugc

SEQ ID NO: 349222 - RNA, 32 nt, Human
cacugucuccccuguuucucagcggccuagau

SEQ ID NO: 349223 - RNA, 32 nt, Human
cacugucuccggcgggugaggcugcagcccag

SEQ ID NO: 349224 - RNA, 32 nt, Human
cacugucuccuaggcuggagugcaguggugug

SEQ ID NO: 349225 - RNA, 32 nt, Human
cacugucugaagguucuccaaauugucuguga

SEQ ID NO: 349226 - RNA, 28 nt, Human
cacugucugagaguuuaguuguagcaga

SEQ ID NO: 349227 - RNA, 24 nt, Human
cacugucugauaaggugagaucaa

SEQ ID NO: 349228 - RNA, 32 nt, Human
cacugucugguuuccaaugcuucuggagacuu

SEQ ID NO: 349229 - RNA, 32 nt, Human
cacugucuguggcccauugucauuguuuccuc

SEQ ID NO: 349230 - RNA, 32 nt, Human
cacugucuuaagccacuuugacccugggagac

SEQ ID NO: 349231 - RNA, 32 nt, Human
cacugucuuaauauuucuuuacauucuuucaa

SEQ ID NO: 349232 - RNA, 32 nt, Human
cacugucuucuuucuuauccccuuggugggcu

SEQ ID NO: 349233 - RNA, 32 nt, Human
cacugucuugcccaggcuggagugcaguggcc

SEQ ID NO: 349234 - RNA, 32 nt, Human
cacugucuuucccaucucuaucucuccucuac

SEQ ID NO: 349235 - RNA, 32 nt, Human
cacugugaaggagaaagagugagggcaaugaa

SEQ ID NO: 349236 - RNA, 32 nt, Human
cacugugaagggcagauaucuauuaccaaacc

SEQ ID NO: 349237 - RNA, 32 nt, Human
cacugugaagucagcguuaaccaugugcauac

SEQ ID NO: 349238 - RNA, 32 nt, Human
cacugugacccacaggccugggugguguaccu

SEQ ID NO: 349239 - RNA, 20 nt, Human
cacugugacggccacagggg

SEQ ID NO: 349240 - RNA, 32 nt, Human
cacugugacggggaguccaggcgcaggaggga

SEQ ID NO: 349241 - RNA, 32 nt, Human
cacugugacucaguggcacuuccacuggacac

SEQ ID NO: 349242 - RNA, 32 nt, Human
cacugugacucugccaucuuccucagacggag

SEQ ID NO: 349243 - RNA, 32 nt, Human
cacugugagaggcugaggcgggaugaucaccu

SEQ ID NO: 349244 - RNA, 32 nt, Human
cacugugagccagggauacaacaaaauacuag

SEQ ID NO: 349245 - RNA, 32 nt, Human
cacugugagccccgggcuccugcucagccuug

SEQ ID NO: 349246 - RNA, 32 nt, Human
cacugugagcucagcacagaguaggaagaaca

SEQ ID NO: 349247 - RNA, 24 nt, Human
cacugugaggccaagauccccuca

SEQ ID NO: 349248 - RNA, 32 nt, Human
cacugugaggccuacagcucugccggggagga

SEQ ID NO: 349249 - RNA, 32 nt, Human
cacugugaugacugccacaaaaagcagcauua

SEQ ID NO: 349250 - RNA, 32 nt, Human
cacugugaugcagagccccaggggucuuugcc

SEQ ID NO: 349251 - RNA, 32 nt, Human
cacugugauguggcauucuguaaauaagacua

SEQ ID NO: 349252 - RNA, 32 nt, Human
cacugugauugcacucccagcccagaucagca

SEQ ID NO: 349253 - RNA, 32 nt, Human
cacugugcaaagcaugcccuucugcacaggag

SEQ ID NO: 349254 - RNA, 32 nt, Human
cacugugcaacacaggcuucagauucauguau

SEQ ID NO: 349255 - RNA, 32 nt, Human
cacugugcaggacguggaccagcuggagcugc

SEQ ID NO: 349256 - RNA, 32 nt, Human
cacugugcaguggcaugaucuccgcucgcagc

SEQ ID NO: 349257 - RNA, 32 nt, Human
cacugugcaguguggcuggcucuccagcauca

SEQ ID NO: 349258 - RNA, 32 nt, Human
cacugugccaaagugugcaguguccuucagag

SEQ ID NO: 349259 - RNA, 32 nt, Human
cacugugccacucuacuccagccugggcaaca

SEQ ID NO: 349260 - RNA, 32 nt, Human
cacugugccacugacuugcugugugacccugg

SEQ ID NO: 349261 - RNA, 32 nt, Human
cacugugcccagacaugugugcucaggguggc

SEQ ID NO: 349262 - RNA, 32 nt, Human
cacugugcccugccguuuccugcugggccccu

SEQ ID NO: 349263 - RNA, 15 nt, Human
cacugugccuggcca

SEQ ID NO: 349264 - RNA, 32 nt, Human
cacugugccuuccgggccuccugggcuucugc

SEQ ID NO: 349265 - RNA, 32 nt, Human
cacugugcgaagagagaugggggccaggaagu

SEQ ID NO: 349266 - RNA, 32 nt, Human
cacugugcggcucuggggagcucuuuccugug

SEQ ID NO: 349267 - RNA, 32 nt, Human
cacugugcuacucuacuccagccugggcaaca

SEQ ID NO: 349268 - RNA, 32 nt, Human
cacugugcuauccuugaacuaccaauaauuuu

SEQ ID NO: 349269 - RNA, 32 nt, Human
cacugugcucucucccgucucuuccauucucu

SEQ ID NO: 349270 - RNA, 32 nt, Human
cacugugcugcgauccguguguccucaaucug

SEQ ID NO: 349271 - RNA, 32 nt, Human
cacugugcuggcgggcuccggguggggacccc

SEQ ID NO: 349272 - RNA, 32 nt, Human
cacugugcuguuguugucugacuguggcuauc

SEQ ID NO: 349273 - RNA, 32 nt, Human
cacugugcuuccacaugccuggccuaaaaugg

SEQ ID NO: 349274 - RNA, 32 nt, Human
cacuguggaaacagccuggcagucccuugaaa

SEQ ID NO: 349275 - RNA, 24 nt, Human
cacuguggaagauaaagccuacaa

SEQ ID NO: 349276 - RNA, 32 nt, Human
cacuguggacaguguacacuauggugugagug

SEQ ID NO: 349277 - RNA, 32 nt, Human
cacuguggagcaguguggcccagccuggucca

SEQ ID NO: 349278 - RNA, 32 nt, Human
cacuguggaggaugaaagcacacagaugaauu

SEQ ID NO: 349279 - RNA, 32 nt, Human
cacuguggaggcagugguuguggaggacauuu

SEQ ID NO: 349280 - RNA, 30 nt, Human
cacuguggaggccacaggagcagaaacaug

SEQ ID NO: 349281 - RNA, 32 nt, Human
cacuguggagggaagcauuggaacuggaguug

SEQ ID NO: 349282 - RNA, 32 nt, Human
cacuguggaucugccauccauucugcagucuc

SEQ ID NO: 349283 - RNA, 18 nt, Human
cacuguggcaaagccuca

SEQ ID NO: 349284 - RNA, 32 nt, Human
cacuguggcagcggccaccauggccaugccag

SEQ ID NO: 349285 - RNA, 32 nt, Human
cacuguggcauccucaggcaaagcuccugccu

SEQ ID NO: 349286 - RNA, 32 nt, Human
cacuguggcauccucaggcgaagcuccugccu

SEQ ID NO: 349287 - RNA, 32 nt, Human
cacuguggcauccucaggugaagcuccugccu

SEQ ID NO: 349288 - RNA, 32 nt, Human
cacuguggcccaggcuggacuccagcacagug

SEQ ID NO: 349289 - RNA, 32 nt, Human
cacuguggccucggucccuuagugaagccaug

SEQ ID NO: 349290 - RNA, 30 nt, Human
cacuguggccucuccaagcguccugcacgu

SEQ ID NO: 349291 - RNA, 32 nt, Human
cacuguggccugaucagcaggagccaauaucc

SEQ ID NO: 349292 - RNA, 32 nt, Human
cacuguggcuagauauauacacacacauauau

SEQ ID NO: 349293 - RNA, 32 nt, Human
cacuguggcucacgccuguaaucccagcacuu

SEQ ID NO: 349294 - RNA, 32 nt, Human
cacuguggcucacgccuguaaucucagcacuu

SEQ ID NO: 349295 - RNA, 32 nt, Human
cacuguggcucacuccuguaaucucagaacuu

SEQ ID NO: 349296 - RNA, 32 nt, Human
cacuguggcucaugccugcaaucccagcacuu

SEQ ID NO: 349297 - RNA, 32 nt, Human
cacuguggcucaugccuguaaucccagcacuu

SEQ ID NO: 349298 - RNA, 32 nt, Human
cacuguggcucaugccuuuaaucccagcacuu

SEQ ID NO: 349299 - RNA, 32 nt, Human
cacuguggcucaugcuuguaaucccagcacuu

SEQ ID NO: 349300 - RNA, 32 nt, Human
cacuguggcucccuggaggagcucccagucug

SEQ ID NO: 349301 - RNA, 32 nt, Human
cacugugggaacggcuuggcccagcggggccu

SEQ ID NO: 349302 - RNA, 32 nt, Human
cacugugggaagcugaggcgggcggaucaccu

SEQ ID NO: 349303 - RNA, 23 nt, Human
cacugugggagagaaccugucaa

SEQ ID NO: 349304 - RNA, 32 nt, Human
cacugugggaggccgaggcggauggaucaccu

SEQ ID NO: 349305 - RNA, 32 nt, Human
cacugugggaggccgaggcgggcggaucaccu

SEQ ID NO: 349306 - RNA, 32 nt, Human
cacugugggaggccgaggcgggcggaucgcuu

SEQ ID NO: 349307 - RNA, 32 nt, Human
cacugugggaggccgaggcggguggaucaccu

SEQ ID NO: 349308 - RNA, 32 nt, Human
cacugugggaggcggaggcgggaggaucauga

SEQ ID NO: 349309 - RNA, 32 nt, Human
cacugugggaggcugaggcggguggaucaucu

SEQ ID NO: 349310 - RNA, 32 nt, Human
cacugugggaggcugaggugguuguauugcuu

SEQ ID NO: 349311 - RNA, 32 nt, Human
cacugugggcaguaucaccugccucucaaaau

SEQ ID NO: 349312 - RNA, 32 nt, Human
cacugugggcuaggguggucagaggaagccag

SEQ ID NO: 349313 - RNA, 24 nt, Human
cacugugggcucgguucccugcca

SEQ ID NO: 349314 - RNA, 32 nt, Human
cacugugggcuggggacgccugcccuucuguc

SEQ ID NO: 349315 - RNA, 24 nt, Human
cacuguggucucaaucuccugacu

SEQ ID NO: 349316 - RNA, 32 nt, Human
cacuguggucucaaucuccugacuucaugguc

SEQ ID NO: 349317 - RNA, 32 nt, Human
cacuguggugcccucugcucccuggagcucuu

SEQ ID NO: 349318 - RNA, 32 nt, Human
cacugugguucaugccuauaaucccagcacuu

SEQ ID NO: 349319 - RNA, 32 nt, Human
cacugugguugcccccuuccucucuguggcac

SEQ ID NO: 349320 - RNA, 32 nt, Human
cacuguguacagcuggccacacacagggaagg

SEQ ID NO: 349321 - RNA, 32 nt, Human
cacuguguaguguauuugagggaucagucauc

SEQ ID NO: 349322 - RNA, 32 nt, Human
cacugugucacccaggcuggagugcaguggca

SEQ ID NO: 349323 - RNA, 32 nt, Human
cacugugucacccaggcuggagugcaguggcg

SEQ ID NO: 349324 - RNA, 32 nt, Human
cacugugucacccaggcuggagugcaguggug

SEQ ID NO: 349325 - RNA, 32 nt, Human
cacugugucaugcaggcuggagugcaguggca

SEQ ID NO: 349326 - RNA, 32 nt, Human
cacugugucccccaggcuggagugcaguggca

SEQ ID NO: 349327 - RNA, 32 nt, Human
cacugugucgcccaggcuggagugcaaguggc

SEQ ID NO: 349328 - RNA, 32 nt, Human
cacugugucgcccaggcuggagugcaguggcg

SEQ ID NO: 349329 - RNA, 25 nt, Human
cacugugugaagggacucuuuuaaa

SEQ ID NO: 349330 - RNA, 22 nt, Human
cacugugugcagaaggcagcag

SEQ ID NO: 349331 - RNA, 32 nt, Human
cacugugugccuggcccugugcugggcacugg

SEQ ID NO: 349332 - RNA, 32 nt, Human
cacugugugggccuguguuguguccugugcug

SEQ ID NO: 349333 - RNA, 32 nt, Human
cacuguguguuuuuaccaaaguggccauuggc

SEQ ID NO: 349334 - RNA, 32 nt, Human
cacuguguucaagcgauucuccugccucagcc

SEQ ID NO: 349335 - RNA, 32 nt, Human
cacuguguucccacgggugccaugaagugugu

SEQ ID NO: 349336 - RNA, 32 nt, Human
cacuguguuccuuccgcuuggagcuauuuucc

SEQ ID NO: 349337 - RNA, 32 nt, Human
cacuguguugcccaggcuagagugcaguggug

SEQ ID NO: 349338 - RNA, 32 nt, Human
cacuguguugcccaggcuggagugcaaauggc

SEQ ID NO: 349339 - RNA, 32 nt, Human
cacuguguugcccaggcuggagugcaguagug

SEQ ID NO: 349340 - RNA, 32 nt, Human
cacuguguugcccaggcuggucucaaaacucc

SEQ ID NO: 349341 - RNA, 32 nt, Human
cacuguguugcccaggcuggucucaaacucca

SEQ ID NO: 349342 - RNA, 32 nt, Human
cacuguguugcccaggcuggucucaaacuccu

SEQ ID NO: 349343 - RNA, 32 nt, Human
cacuguguugcccaggcuggucucgaacuccu

SEQ ID NO: 349344 - RNA, 32 nt, Human
cacuguguuggccaggcuggucucaaacuccu

SEQ ID NO: 349345 - RNA, 32 nt, Human
cacuguguuggccaggcuggucucgaacaccu

SEQ ID NO: 349346 - RNA, 32 nt, Human
cacuguguuggccaggcuggucucgaacuccu

SEQ ID NO: 349347 - RNA, 23 nt, Human
cacuguguuguucaugguggcuu

SEQ ID NO: 349348 - RNA, 32 nt, Human
cacuguuacauacauuuuccaugguagaaagg

SEQ ID NO: 349349 - RNA, 32 nt, Human
cacuguuacuuucccccuccccuagucagcag

SEQ ID NO: 349350 - RNA, 32 nt, Human
cacuguuaguaaggcaauuuauuggacacaau

SEQ ID NO: 349351 - RNA, 25 nt, Human
cacuguuauagcagagccuuucaaa

SEQ ID NO: 349352 - RNA, 32 nt, Human
cacuguuauccaggcuggagugcagaggcaca

SEQ ID NO: 349353 - RNA, 32 nt, Human
cacuguucagcuuucuuauggaaugacagaga

SEQ ID NO: 349354 - RNA, 32 nt, Human
cacuguucaggcugaggcaggagaauugcuug

SEQ ID NO: 349355 - RNA, 32 nt, Human
cacuguucagggccacggagaauucucgaagu

SEQ ID NO: 349356 - RNA, 32 nt, Human
cacuguucccuaagaaauauccuugagcaaua

SEQ ID NO: 349357 - RNA, 32 nt, Human
cacuguucggccaguggcaacaaggagcugag

SEQ ID NO: 349358 - RNA, 32 nt, Human
cacuguucucuagcgccaauauucccagguaa

SEQ ID NO: 349359 - RNA, 32 nt, Human
cacuguucucuugcaucucucuaacaacuggc

SEQ ID NO: 349360 - RNA, 32 nt, Human
cacuguucugggacuccaggucuugaggagag

SEQ ID NO: 349361 - RNA, 32 nt, Human
cacuguucuugcaccugcuccuagcccugaac

SEQ ID NO: 349362 - RNA, 32 nt, Human
cacuguugacuccuggcuuaaagggaucuccc

SEQ ID NO: 349363 - RNA, 32 nt, Human
cacuguugauggacauuuggguuguuuccagu

SEQ ID NO: 349364 - RNA, 32 nt, Human
cacuguugcccaggcuggacugcaguggcgug

SEQ ID NO: 349365 - RNA, 32 nt, Human
cacuguugcccaggcuggagagcaguggcgcg

SEQ ID NO: 349366 - RNA, 32 nt, Human
cacuguugcccaggcuggagugcagugacgcg

SEQ ID NO: 349367 - RNA, 32 nt, Human
cacuguugcccaggcuggagugcaguggcgug

SEQ ID NO: 349368 - RNA, 32 nt, Human
cacuguugcccaggcuggagugcaguggugca

SEQ ID NO: 349369 - RNA, 32 nt, Human
cacuguugcccaggcuggagugcauugaugug

SEQ ID NO: 349370 - RNA, 32 nt, Human
cacuguugcccaggcuggcgugcaguggugcg

SEQ ID NO: 349371 - RNA, 32 nt, Human
cacuguugcugaucagauuucccacuggucug

SEQ ID NO: 349372 - RNA, 32 nt, Human
cacuguugcuuugguagagaugagaggccgca

SEQ ID NO: 349373 - RNA, 32 nt, Human
cacuguuggagcugcugucuuuccaaggccuu

SEQ ID NO: 349374 - RNA, 32 nt, Human
cacuguuguccacugcccuguguggccuucug

SEQ ID NO: 349375 - RNA, 32 nt, Human
cacuguuuacacccugacugugcuuaaaaaca

SEQ ID NO: 349376 - RNA, 32 nt, Human
cacuguuuauguugcugccuccucucucaaaa

SEQ ID NO: 349377 - RNA, 32 nt, Human
cacuguuucguagacugagaacauggagggac

SEQ ID NO: 349378 - RNA, 32 nt, Human
cacuguuucugucugguuuuaaaacaaauuac

SEQ ID NO: 349379 - RNA, 32 nt, Human
cacuguuucuuuucccuucaguuccucuccug

SEQ ID NO: 349380 - RNA, 32 nt, Human
cacuguuugcccaggggaugacugcaggaggc

SEQ ID NO: 349381 - RNA, 32 nt, Human
cacuguuugccuggauauccccagcagaggcu

SEQ ID NO: 349382 - RNA, 32 nt, Human
cacuguuuucaucacaacuuguuuucccagca

SEQ ID NO: 349383 - RNA, 32 nt, Human
cacuguuuucaucuccuuuuccaucuuagucu

SEQ ID NO: 349384 - RNA, 32 nt, Human
cacuguuuucccucuguaguuucucaagugaa

SEQ ID NO: 349385 - RNA, 32 nt, Human
cacuguuuuccugcauuccuggcgcgggacuc

SEQ ID NO: 349386 - RNA, 32 nt, Human
cacuguuuucucacuuucaucccauaucuccg

SEQ ID NO: 349387 - RNA, 32 nt, Human
cacuguuuuggaaaucuuggccagucugagug

SEQ ID NO: 349388 - RNA, 32 nt, Human
cacuuaaaagaaaacaaagccccaugggcugc

SEQ ID NO: 349389 - RNA, 21 nt, Human
cacuuaaaccagggcaggaag

SEQ ID NO: 349390 - RNA, 32 nt, Human
cacuuaaaguaguuuuguguggcaucacagug

SEQ ID NO: 349391 - RNA, 32 nt, Human
cacuuaaaugauguaauauuccaggaugcugc

SEQ ID NO: 349392 - RNA, 32 nt, Human
cacuuaaccuccugccaccacugccaggcuug

SEQ ID NO: 349393 - RNA, 32 nt, Human
cacuuaagcccucgugcacacacacaaauuau

SEQ ID NO: 349394 - RNA, 32 nt, Human
cacuuaagcuacuugcagucacgucacaccuu

SEQ ID NO: 349395 - RNA, 32 nt, Human
cacuuaaggcuguugugaucugugacauaugg

SEQ ID NO: 349396 - RNA, 32 nt, Human
cacuuaagguugggugcugcuaauucuuugca

SEQ ID NO: 349397 - RNA, 32 nt, Human
cacuuaaguaacaaaguaaucacuuugucuau

SEQ ID NO: 349398 - RNA, 32 nt, Human
cacuuaauugcuuuccugccuccuugaaagaa

SEQ ID NO: 349399 - RNA, 32 nt, Human
cacuuacagcagaaacgcagccagcuuuucug

SEQ ID NO: 349400 - RNA, 32 nt, Human
cacuuacagcucuggccacaacagggcauuuu

SEQ ID NO: 349401 - RNA, 32 nt, Human
cacuuacaggguuucagcacagcuggugugug

SEQ ID NO: 349402 - RNA, 32 nt, Human
cacuuacaucauuugguacacagggucaaaua

SEQ ID NO: 349403 - RNA, 20 nt, Human
cacuuaccaaggacaggaag

SEQ ID NO: 349404 - RNA, 32 nt, Human
cacuuaccacagugccuggcggaccgcaugcc

SEQ ID NO: 349405 - RNA, 32 nt, Human
cacuuaccaccagguggguguuuaggacaggg

SEQ ID NO: 349406 - RNA, 21 nt, Human
cacuuacccaccagcugcacg

SEQ ID NO: 349407 - RNA, 32 nt, Human
cacuuacccuccacuuccuccuccuguuuggc

SEQ ID NO: 349408 - RNA, 23 nt, Human
cacuuaccuuccaacuuccuggc

SEQ ID NO: 349409 - RNA, 32 nt, Human
cacuuacgacgucucccaggcuugccuccccg

SEQ ID NO: 349410 - RNA, 32 nt, Human
cacuuacuagauuauacuaaugagcuaauggg

SEQ ID NO: 349411 - RNA, 32 nt, Human
cacuuacucaaggaggugggggcagggaggau

SEQ ID NO: 349412 - RNA, 32 nt, Human
cacuuacugagagccagauaccugccaggcac

SEQ ID NO: 349413 - RNA, 32 nt, Human
cacuuacugaguacagaugaaggaaaguggua

SEQ ID NO: 349414 - RNA, 32 nt, Human
cacuuacugccugggccccugcccagcagccu

SEQ ID NO: 349415 - RNA, 21 nt, Human
cacuuacuguccugugaagua

SEQ ID NO: 349416 - RNA, 18 nt, Human
cacuuagaugagaaagua

SEQ ID NO: 349417 - RNA, 18 nt, Human
cacuuagauugucaagug

SEQ ID NO: 349418 - RNA, 32 nt, Human
cacuuagcagaggcucagguucuugccuuggg

SEQ ID NO: 349419 - RNA, 32 nt, Human
cacuuagcaguuuggcaaagauaaaaaucugg

SEQ ID NO: 349420 - RNA, 32 nt, Human
cacuuagccacuucuccccacccuccagaagg

SEQ ID NO: 349421 - RNA, 32 nt, Human
cacuuaggaagaccgaggugggcagaucacuu

SEQ ID NO: 349422 - RNA, 20 nt, Human
cacuuaggaagacgaaagua

SEQ ID NO: 349423 - RNA, 30 nt, Human
cacuuaggaagccacgugccaauaccuggc

SEQ ID NO: 349424 - RNA, 23 nt, Human
cacuuaggauaaacagugaagua

SEQ ID NO: 349425 - RNA, 20 nt, Human
cacuuaggcagugcgaagug

SEQ ID NO: 349426 - RNA, 32 nt, Human
cacuuagggaggccaaggcgggcagaucaccu

SEQ ID NO: 349427 - RNA, 32 nt, Human
cacuuagggaggccgaggcgggcggaucaccu

SEQ ID NO: 349428 - RNA, 32 nt, Human
cacuuagggaggcugagccagguggagccacu

SEQ ID NO: 349429 - RNA, 32 nt, Human
cacuuagggaggcugaggugggcagaucaccu

SEQ ID NO: 349430 - RNA, 32 nt, Human
cacuuagggaggucaacguaggaggaucacuu

SEQ ID NO: 349431 - RNA, 32 nt, Human
cacuuagggcugggaacccgaaccuggugacu

SEQ ID NO: 349432 - RNA, 32 nt, Human
cacuuaggggcagcauguuaguuuugggaggc

SEQ ID NO: 349433 - RNA, 32 nt, Human
cacuuaguguguuccuucaggcuagugagguu

SEQ ID NO: 349434 - RNA, 22 nt, Human
cacuuauaaaggggacagggag

SEQ ID NO: 349435 - RNA, 32 nt, Human
cacuuauaaaucagugagauucucccaauuag

SEQ ID NO: 349436 - RNA, 32 nt, Human
cacuuauacuucugauugauuccuuuguguag

SEQ ID NO: 349437 - RNA, 32 nt, Human
cacuuauccuccuuccuggcgggggugggccg

SEQ ID NO: 349438 - RNA, 32 nt, Human
cacuuaugaucuggauuuauaaacauuacuug

SEQ ID NO: 349439 - RNA, 32 nt, Human
cacuuaugcagaaccaugaguggccagagagg

SEQ ID NO: 349440 - RNA, 32 nt, Human
cacuuauguggaaucugcucccaugacccaag

SEQ ID NO: 349441 - RNA, 32 nt, Human
cacuuauguguauggguccauauguacgugug

SEQ ID NO: 349442 - RNA, 32 nt, Human
cacuuauuacuuugccacguacugaugggcca

SEQ ID NO: 349443 - RNA, 32 nt, Human
cacuuauuauccagcggggaacagugguuacc

SEQ ID NO: 349444 - RNA, 32 nt, Human
cacuuauuaugcaccaccucccuucagucacc

SEQ ID NO: 349445 - RNA, 32 nt, Human
cacuuauuccuccuccccucuucccgguggca

SEQ ID NO: 349446 - RNA, 32 nt, Human
cacuuauugcacuccagcccgggcgacagagc

SEQ ID NO: 349447 - RNA, 32 nt, Human
cacuucaaccuggucaacagagcgagacuccg

SEQ ID NO: 349448 - RNA, 22 nt, Human
cacuucaagacagggcaggaag

SEQ ID NO: 349449 - RNA, 32 nt, Human
cacuucaagagaagagaaaaaugaaguuuauu

SEQ ID NO: 349450 - RNA, 32 nt, Human
cacuucaaucacaaaaugaaacagugagaaag

SEQ ID NO: 349451 - RNA, 32 nt, Human
cacuucacacacaggcaacugaggcagacagc

SEQ ID NO: 349452 - RNA, 32 nt, Human
cacuucaccuccauccucugucucuggggcuc

SEQ ID NO: 349453 - RNA, 32 nt, Human
cacuucacuaaccaaauuccuacuuuccagug

SEQ ID NO: 349454 - RNA, 21 nt, Human
cacuucacuccagccugggca

SEQ ID NO: 349455 - RNA, 32 nt, Human
cacuucacuccggcaggcagaccugcuggagc

SEQ ID NO: 349456 - RNA, 32 nt, Human
cacuucacugcacuccagucugggugacagag

SEQ ID NO: 349457 - RNA, 32 nt, Human
cacuucagaaaccucagacccuuguagguaga

SEQ ID NO: 349458 - RNA, 32 nt, Human
cacuucagacacauacaucacuuucacaccac

SEQ ID NO: 349459 - RNA, 21 nt, Human
cacuucagaccaucuuccaca

SEQ ID NO: 349460 - RNA, 29 nt, Human
cacuucagagccucugaggggccaccacu

SEQ ID NO: 349461 - RNA, 32 nt, Human
cacuucagagccucugaggggccaccacuucu

SEQ ID NO: 349462 - RNA, 32 nt, Human
cacuucagauccugucugucagucucuguuag

SEQ ID NO: 349463 - RNA, 32 nt, Human
cacuucagccuaggugacagagugagaccucg

SEQ ID NO: 349464 - RNA, 32 nt, Human
cacuucagccuccagagccuguccucacagug

SEQ ID NO: 349465 - RNA, 32 nt, Human
cacuucagccucccauugaucgcuuucugcaa

SEQ ID NO: 349466 - RNA, 32 nt, Human
cacuucagccucccgaguagcuggaaccacag

SEQ ID NO: 349467 - RNA, 32 nt, Human
cacuucagccucccgaguaucugggauuauaa

SEQ ID NO: 349468 - RNA, 32 nt, Human
cacuucagccuccugaguagcugggauuacag

SEQ ID NO: 349469 - RNA, 32 nt, Human
cacuucagccuggacaacagagugagacccug

SEQ ID NO: 349470 - RNA, 32 nt, Human
cacuucagccuggacaacagagugagacucca

SEQ ID NO: 349471 - RNA, 32 nt, Human
cacuucagccuggaugacagagcgagguccug

SEQ ID NO: 349472 - RNA, 32 nt, Human
cacuucagccuggaugacagagugagacccug

SEQ ID NO: 349473 - RNA, 32 nt, Human
cacuucagccuggcugacagagcaagacucag

SEQ ID NO: 349474 - RNA, 32 nt, Human
cacuucagccugggcaacagagcgagacucca

SEQ ID NO: 349475 - RNA, 32 nt, Human
cacuucagccugggcaacagagugagacucca

SEQ ID NO: 349476 - RNA, 32 nt, Human
cacuucagccugggcaacagagugagacuggg

SEQ ID NO: 349477 - RNA, 32 nt, Human
cacuucagccugggcaacauagcaagauuuug

SEQ ID NO: 349478 - RNA, 32 nt, Human
cacuucagccugggcgacacagcgagacccug

SEQ ID NO: 349479 - RNA, 32 nt, Human
cacuucagccugggcgacagagcgagacugcu

SEQ ID NO: 349480 - RNA, 32 nt, Human
cacuucagccugggcgacagagugacucuguc

SEQ ID NO: 349481 - RNA, 32 nt, Human
cacuucagccugggcgaccgagacuccgucuc

SEQ ID NO: 349482 - RNA, 32 nt, Human
cacuucagccugggcgauagagcaagacucug

SEQ ID NO: 349483 - RNA, 32 nt, Human
cacuucagccugggugacagaaagagaccuuc

SEQ ID NO: 349484 - RNA, 32 nt, Human
cacuucagccugggugacagaaugagacucug

SEQ ID NO: 349485 - RNA, 32 nt, Human
cacuucagccugggugacagagaaggacuccg

SEQ ID NO: 349486 - RNA, 32 nt, Human
cacuucagccugggugacagagcaagacucuu

SEQ ID NO: 349487 - RNA, 32 nt, Human
cacuucagccugggugacagagcuagacucca

SEQ ID NO: 349488 - RNA, 32 nt, Human
cacuucagccugggugacagagggagacucug

SEQ ID NO: 349489 - RNA, 32 nt, Human
cacuucagccugggugacagagugagacaguc

SEQ ID NO: 349490 - RNA, 32 nt, Human
cacuucagccugggugacagagugagacccuu

SEQ ID NO: 349491 - RNA, 32 nt, Human
cacuucagccugggugacagagugagacucca

SEQ ID NO: 349492 - RNA, 32 nt, Human
cacuucagccugggugacagagugagacucug

SEQ ID NO: 349493 - RNA, 32 nt, Human
cacuucagccuggugacagagcgagacucguc

SEQ ID NO: 349494 - RNA, 32 nt, Human
cacuucagcgaccugcaaauucuacacauuag

SEQ ID NO: 349495 - RNA, 32 nt, Human
cacuucagcucccuucccugccuggaccauuc

SEQ ID NO: 349496 - RNA, 32 nt, Human
cacuucagcuccucaaguagaugggacuacag

SEQ ID NO: 349497 - RNA, 32 nt, Human
cacuucagcugguccacuaguuuugacacagg

SEQ ID NO: 349498 - RNA, 32 nt, Human
cacuucagcuugggcgacagagcgaaacccug

SEQ ID NO: 349499 - RNA, 32 nt, Human
cacuucagcuugggugacagagccagaccuua

SEQ ID NO: 349500 - RNA, 32 nt, Human
cacuucaggaggccaaggugggaagaucauuu

SEQ ID NO: 349501 - RNA, 32 nt, Human
cacuucagggcaccugagccacccucagcagg

SEQ ID NO: 349502 - RNA, 32 nt, Human
cacuucaguccaucugcccuccagaggagggg

SEQ ID NO: 349503 - RNA, 32 nt, Human
cacuucauauucccugaacuuuucuggauguu

SEQ ID NO: 349504 - RNA, 32 nt, Human
cacuucaucacaccccugcccugggccggcag

SEQ ID NO: 349505 - RNA, 32 nt, Human
cacuucauccuaggcaacagagcgagacucug

SEQ ID NO: 349506 - RNA, 32 nt, Human
cacuucauccuccucaguuucucuccaggcca

SEQ ID NO: 349507 - RNA, 32 nt, Human
cacuucauccuuuguaccuggagaccugguua

SEQ ID NO: 349508 - RNA, 32 nt, Human
cacuucauuacccaggcuggagugcaaggcac

SEQ ID NO: 349509 - RNA, 32 nt, Human
cacuucauugacuacaaccacagacuuucccu

SEQ ID NO: 349510 - RNA, 32 nt, Human
cacuucauuuuuccuuuguccuuucucucuaa

SEQ ID NO: 349511 - RNA, 32 nt, Human
cacuuccaagggaguggcuuuucuugaaaauu

SEQ ID NO: 349512 - RNA, 32 nt, Human
cacuuccaaguggccagugauuuguuaaaaua

SEQ ID NO: 349513 - RNA, 32 nt, Human
cacuuccacaguuuggacaaggagcuucaaaa

SEQ ID NO: 349514 - RNA, 32 nt, Human
cacuuccaccucuucucucaguuuuggacaag

SEQ ID NO: 349515 - RNA, 32 nt, Human
cacuuccagcacaagcugcagccugcauccca

SEQ ID NO: 349516 - RNA, 32 nt, Human
cacuuccagcacagcugugcucuguguccugc

SEQ ID NO: 349517 - RNA, 32 nt, Human
cacuuccaggcccgagcuucucagccugccgu

SEQ ID NO: 349518 - RNA, 32 nt, Human
cacuuccagugcgccccacugucaugcccggc

SEQ ID NO: 349519 - RNA, 32 nt, Human
cacuuccagugggaagagaaggcccggaggua

SEQ ID NO: 349520 - RNA, 32 nt, Human
cacuuccauuugucugacauggagauugaggg

SEQ ID NO: 349521 - RNA, 32 nt, Human
cacuucccagaaauugaacacauugcuucaac

SEQ ID NO: 349522 - RNA, 32 nt, Human
cacuucccagccacagggugacccuggcacug

SEQ ID NO: 349523 - RNA, 32 nt, Human
cacuucccagcgauuccagccugggcuccgca

SEQ ID NO: 349524 - RNA, 32 nt, Human
cacuucccaggggacacagcugugccuggggu

SEQ ID NO: 349525 - RNA, 18 nt, Human
cacuucccagucuguugg

SEQ ID NO: 349526 - RNA, 32 nt, Human
cacuucccauuuccucugcccuuuuccaccuc

SEQ ID NO: 349527 - RNA, 32 nt, Human
cacuuccccuaccagguggaagagucugacuc

SEQ ID NO: 349528 - RNA, 32 nt, Human
cacuuccccuccucccccuuccccuggucccc

SEQ ID NO: 349529 - RNA, 32 nt, Human
cacuucccggcucccuucgccuccaggaugcg

SEQ ID NO: 349530 - RNA, 32 nt, Human
cacuucccuagccucagaugggugaguaaaca

SEQ ID NO: 349531 - RNA, 32 nt, Human
cacuucccugcaacccauccaccccugguuuc

SEQ ID NO: 349532 - RNA, 32 nt, Human
cacuucccugcucccgcccgaggacuccugcg

SEQ ID NO: 349533 - RNA, 32 nt, Human
cacuucccugcucccugcuuggggacccggca

SEQ ID NO: 349534 - RNA, 23 nt, Human
cacuucccuguccccacagggag

SEQ ID NO: 349535 - RNA, 32 nt, Human
cacuuccggacacacaugcacacacaggugca

SEQ ID NO: 349536 - RNA, 32 nt, Human
cacuuccguggacugaaggaaccguaggagcc

SEQ ID NO: 349537 - RNA, 32 nt, Human
cacuuccuacuucccacucccaacuccugaaa

SEQ ID NO: 349538 - RNA, 19 nt, Human
cacuuccucaucuaggaag

SEQ ID NO: 349539 - RNA, 32 nt, Human
cacuuccucauuucuggggaaggaaaggagac

SEQ ID NO: 349540 - RNA, 32 nt, Human
cacuuccuccaggaagucuuuccugauauauc

SEQ ID NO: 349541 - RNA, 31 nt, Human
cacuuccuccucucugugugccucagucucc

SEQ ID NO: 349542 - RNA, 32 nt, Human
cacuuccucgucuccuccuccuucccacaggc

SEQ ID NO: 349543 - RNA, 18 nt, Human
cacuuccucuccaggagg

SEQ ID NO: 349544 - RNA, 32 nt, Human
cacuuccucugccugccccuccuccuccuucc

SEQ ID NO: 349545 - RNA, 32 nt, Human
cacuuccucuuccauaccccuuccucgaggcc

SEQ ID NO: 349546 - RNA, 23 nt, Human
cacuuccucuugcccuccuggcu

SEQ ID NO: 349547 - RNA, 32 nt, Human
cacuuccugcuuaguugagauaguugaaucua

SEQ ID NO: 349548 - RNA, 20 nt, Human
cacuuccugguugcaagagg

SEQ ID NO: 349549 - RNA, 22 nt, Human
cacuuccugugaaagcaggaag

SEQ ID NO: 349550 - RNA, 22 nt, Human
cacuuccuguucccaccacugg

SEQ ID NO: 349551 - RNA, 20 nt, Human
cacuuccuuaacaaaggaag

SEQ ID NO: 349552 - RNA, 18 nt, Human
cacuuccuucagaaggaa

SEQ ID NO: 349553 - RNA, 32 nt, Human
cacuuccuucaucggccaccuuccucagcaag

SEQ ID NO: 349554 - RNA, 20 nt, Human
cacuuccuucguggaggaag

SEQ ID NO: 349555 - RNA, 31 nt, Human
cacuuccuugcuggguggccugugaucauua

SEQ ID NO: 349556 - RNA, 32 nt, Human
cacuuccuugcuucuccucccccaggaccaag

SEQ ID NO: 349557 - RNA, 32 nt, Human
cacuuccuuggaacuccugccuccacagcccc

SEQ ID NO: 349558 - RNA, 32 nt, Human
cacuuccuuggaggaggagagggauuacuccu

SEQ ID NO: 349559 - RNA, 17 nt, Human
cacuuccuuuaaggaag

SEQ ID NO: 349560 - RNA, 19 nt, Human
cacuuccuuuaggacugaa

SEQ ID NO: 349561 - RNA, 21 nt, Human
cacuuccuuucaaacaggaag

SEQ ID NO: 349562 - RNA, 23 nt, Human
cacuuccuuuccugagcaggagg

SEQ ID NO: 349563 - RNA, 32 nt, Human
cacuuccuuugagaccugcacucucaugcuug

SEQ ID NO: 349564 - RNA, 32 nt, Human
cacuuccuuugcccaagggggaagggaggaca

SEQ ID NO: 349565 - RNA, 32 nt, Human
cacuuccuuuguccuagagacauuuauucauu

SEQ ID NO: 349566 - RNA, 32 nt, Human
cacuuccuuuguucuuuuccugccacagaguc

SEQ ID NO: 349567 - RNA, 32 nt, Human
cacuuccuuuguucuuuuccugccacaggguc

SEQ ID NO: 349568 - RNA, 18 nt, Human
cacuuccuuuuacaggaa

SEQ ID NO: 349569 - RNA, 20 nt, Human
cacuuccuuuucuguaggaa

SEQ ID NO: 349570 - RNA, 21 nt, Human
cacuuccuuuucuguuaggaa

SEQ ID NO: 349571 - RNA, 32 nt, Human
cacuucgaggaggaggaggaggccggggugga

SEQ ID NO: 349572 - RNA, 32 nt, Human
cacuucgauuuucagaauuccuccugggaaug

SEQ ID NO: 349573 - RNA, 32 nt, Human
cacuucgccuuacaggucuccauuuuguggua

SEQ ID NO: 349574 - RNA, 32 nt, Human
cacuucgggaagcugaggcgggcggaucacaa

SEQ ID NO: 349575 - RNA, 32 nt, Human
cacuucgggaggccaaggugagaggauaacuu

SEQ ID NO: 349576 - RNA, 32 nt, Human
cacuucgggaggccaaggugggcaguucgcuu

SEQ ID NO: 349577 - RNA, 32 nt, Human
cacuucgggaggccgaggcagguggaacacuu

SEQ ID NO: 349578 - RNA, 32 nt, Human
cacuucgggaggccgaggcggguggaucacga

SEQ ID NO: 349579 - RNA, 32 nt, Human
cacuucgggaggcugaggcagguggaucacuu

SEQ ID NO: 349580 - RNA, 32 nt, Human
cacuucgggaggucaagguagguggaucaccu

SEQ ID NO: 349581 - RNA, 32 nt, Human
cacuucgggaggucgaggcaggaggaucacuu

SEQ ID NO: 349582 - RNA, 32 nt, Human
cacuucgucuucauggauucccagcccagcug

SEQ ID NO: 349583 - RNA, 32 nt, Human
cacuucuaaagugccuacagagacuuguaaau

SEQ ID NO: 349584 - RNA, 18 nt, Human
cacuucuaagacaggaag

SEQ ID NO: 349585 - RNA, 23 nt, Human
cacuucuacaaaucagcaagaua

SEQ ID NO: 349586 - RNA, 32 nt, Human
cacuucuacaguuuagaaaguaucuggacuca

SEQ ID NO: 349587 - RNA, 31 nt, Human
cacuucuagagagaagaaaaaggcuggguuu

SEQ ID NO: 349588 - RNA, 32 nt, Human
cacuucuagagcagggaggcuuggggagggga

SEQ ID NO: 349589 - RNA, 32 nt, Human
cacuucuagguuugggguuucucaguucccuc

SEQ ID NO: 349590 - RNA, 32 nt, Human
cacuucuauuaacugcuucucuucuauuccaa

SEQ ID NO: 349591 - RNA, 31 nt, Human
cacuucucaauaaaugugagauccuguugag

SEQ ID NO: 349592 - RNA, 32 nt, Human
cacuucucaccgcgcccuccagcuucacccgu

SEQ ID NO: 349593 - RNA, 32 nt, Human
cacuucucauuuucuuugcugacuuaccuuuu

SEQ ID NO: 349594 - RNA, 32 nt, Human
cacuucuccacugucggagcacguuccgaaaa

SEQ ID NO: 349595 - RNA, 32 nt, Human
cacuucuccagccucucagcccugugcuccug

SEQ ID NO: 349596 - RNA, 32 nt, Human
cacuucuccaggccucucuccccgaccaugag

SEQ ID NO: 349597 - RNA, 32 nt, Human
cacuucucgggaauuugaggccagccugagga

SEQ ID NO: 349598 - RNA, 32 nt, Human
cacuucucuccucuuccuccugccccugguuc

SEQ ID NO: 349599 - RNA, 32 nt, Human
cacuucucugaaggagggcuggguucugggcc

SEQ ID NO: 349600 - RNA, 32 nt, Human
cacuucucugauccucuggccaacacacaucu

SEQ ID NO: 349601 - RNA, 32 nt, Human
cacuucucuggccucugguuucucucugcugu

SEQ ID NO: 349602 - RNA, 18 nt, Human
cacuucucugugaaacac

SEQ ID NO: 349603 - RNA, 32 nt, Human
cacuucucuguucugaacagcucuuccugccc

SEQ ID NO: 349604 - RNA, 18 nt, Human
cacuucugaugcaugaaa

SEQ ID NO: 349605 - RNA, 32 nt, Human
cacuucugauuuagugaaaccaauuguaauaa

SEQ ID NO: 349606 - RNA, 32 nt, Human
cacuucugcauuuaaggaggucugggagaagg

SEQ ID NO: 349607 - RNA, 32 nt, Human
cacuucugccaagaacacagaacuacuuuggc

SEQ ID NO: 349608 - RNA, 32 nt, Human
cacuucugcccaggcagcagggugggugggua

SEQ ID NO: 349609 - RNA, 25 nt, Human
cacuucugcucccggccgcccggca

SEQ ID NO: 349610 - RNA, 32 nt, Human
cacuucugcucuccucuaccagaaucacucag

SEQ ID NO: 349611 - RNA, 32 nt, Human
cacuucugcuuaccccuccauucacagccucc

SEQ ID NO: 349612 - RNA, 32 nt, Human
cacuucugcuucuguguuuccaaacagcauug

SEQ ID NO: 349613 - RNA, 32 nt, Human
cacuucugggagacagagcuacagcugggaca

SEQ ID NO: 349614 - RNA, 32 nt, Human
cacuucuggggaaggaaaacaggcuccuggcc

SEQ ID NO: 349615 - RNA, 32 nt, Human
cacuucuggucucugucccucugccuccccgg

SEQ ID NO: 349616 - RNA, 32 nt, Human
cacuucugucgaggagcuucggggcucagaga

SEQ ID NO: 349617 - RNA, 32 nt, Human
cacuucuguggacaccccaaauaggaagaagg

SEQ ID NO: 349618 - RNA, 32 nt, Human
cacuucuguguguauguacauauucaaacaca

SEQ ID NO: 349619 - RNA, 32 nt, Human
cacuucuuaccuccucaccuaccucuccaguc

SEQ ID NO: 349620 - RNA, 32 nt, Human
cacuucuuauccacccuucccucuaccucacc

SEQ ID NO: 349621 - RNA, 32 nt, Human
cacuucuucagcuugggcaagugugugccugu

SEQ ID NO: 349622 - RNA, 32 nt, Human
cagagcuacagccagggauagagcagaugagc

SEQ ID NO: 349623 - RNA, 32 nt, Human
cagagcuacuucacuccucacuugggcaaaug

SEQ ID NO: 349624 - RNA, 32 nt, Human
cagagcuagccaccacccacacugcaagucug

SEQ ID NO: 349625 - RNA, 32 nt, Human
cagagcuagcccggaaggaggagcaagagcca

SEQ ID NO: 349626 - RNA, 21 nt, Human
cagagcuagccggacguccuc

SEQ ID NO: 349627 - RNA, 32 nt, Human
cagagcuagugucaacugugucuggguucagu

SEQ ID NO: 349628 - RNA, 32 nt, Human
cagagcucaagucugaacucuaccuccagaca

SEQ ID NO: 349629 - RNA, 16 nt, Human
cagagcucacacaggu

SEQ ID NO: 349630 - RNA, 32 nt, Human
cagagcucacugagccuccaccuggggucucu

SEQ ID NO: 349631 - RNA, 32 nt, Human
cagagcucacugcagcuucaaucuccuggcuc

SEQ ID NO: 349632 - RNA, 32 nt, Human
cagagcucagagagacagcaagucaggagaug

SEQ ID NO: 349633 - RNA, 32 nt, Human
cagagcucagaggucacacuguaucaaagauc

SEQ ID NO: 349634 - RNA, 21 nt, Human
cagagcucaugguuuauggug

SEQ ID NO: 349635 - RNA, 32 nt, Human
cagagcuccaaguaaccaaauucccccaaaga

SEQ ID NO: 349636 - RNA, 32 nt, Human
cagagcuccaggccucccuuccagucagaaca

SEQ ID NO: 349637 - RNA, 32 nt, Human
cagagcuccccacucccugauugucaagaccu

SEQ ID NO: 349638 - RNA, 32 nt, Human
cagagcucgagaccagccuggccaacauggug

SEQ ID NO: 349639 - RNA, 32 nt, Human
cagagcucgcugagacagagacugagaacgcc

SEQ ID NO: 349640 - RNA, 16 nt, Human
cagagcucuaagauga

SEQ ID NO: 349641 - RNA, 32 nt, Human
cagagcucucugagggugauggggcugagcag

SEQ ID NO: 349642 - RNA, 24 nt, Human
cagagcucugcacaaacacugcca

SEQ ID NO: 349643 - RNA, 32 nt, Human
cagagcucuggcucugaacacagacagccuug

SEQ ID NO: 349644 - RNA, 32 nt, Human
cagagcucuggguggaagagggaagagauccu

SEQ ID NO: 349645 - RNA, 32 nt, Human
cagagcucuucagaaaccaggcugcuuucagg

SEQ ID NO: 349646 - RNA, 21 nt, Human
cagagcugaaagcugguggca

SEQ ID NO: 349647 - RNA, 23 nt, Human
cagagcugaagcaggcccugggg

SEQ ID NO: 349648 - RNA, 32 nt, Human
cagagcugaaggagugaagagcccuuggccau

SEQ ID NO: 349649 - RNA, 32 nt, Human
cagagcugaagggguugggagaugucucccaa

SEQ ID NO: 349650 - RNA, 32 nt, Human
cagagcugaaguuaacaaaugcaccugguucu

SEQ ID NO: 349651 - RNA, 32 nt, Human
cagagcugacgucugggugacagugaaacggg

SEQ ID NO: 349652 - RNA, 22 nt, Human
cagagcugaggggccccuggga

SEQ ID NO: 349653 - RNA, 32 nt, Human
cagagcugagggugggcaggugcagcugggac

SEQ ID NO: 349654 - RNA, 32 nt, Human
cagagcugaucuccuccaccuuucuccaauga

SEQ ID NO: 349655 - RNA, 32 nt, Human
cagagcugaugcaggccaugcuggaaguaucu

SEQ ID NO: 349656 - RNA, 32 nt, Human
cagagcugcagcuacacagcugcccaguguca

SEQ ID NO: 349657 - RNA, 32 nt, Human
cagagcugcaucucucugggucucuggguaac

SEQ ID NO: 349658 - RNA, 18 nt, Human
cagagcugccauaaugaa

SEQ ID NO: 349659 - RNA, 32 nt, Human
cagagcugccggcugaaaauuacccaaccaag

SEQ ID NO: 349660 - RNA, 32 nt, Human
cagagcugcuacugcugugauggccgggagga

SEQ ID NO: 349661 - RNA, 32 nt, Human
cagagcugcuccacaggcaccaugaggaucau

SEQ ID NO: 349662 - RNA, 32 nt, Human
cagagcugcuuucgggcgcagcuccugcugca

SEQ ID NO: 349663 - RNA, 32 nt, Human
cagagcuggaagcagacaguaaggggaagagc

SEQ ID NO: 349664 - RNA, 32 nt, Human
cagagcuggacaaccucugccucggcccucuc

SEQ ID NO: 349665 - RNA, 32 nt, Human
cagagcuggagccccugcugcccagcucagac

SEQ ID NO: 349666 - RNA, 32 nt, Human
cagagcuggaggaggaggagggcaaacccgag

SEQ ID NO: 349667 - RNA, 22 nt, Human
cagagcuggagguucuguccuc

SEQ ID NO: 349668 - RNA, 32 nt, Human
cagagcuggcagaggccucuggcuccaggaac

SEQ ID NO: 349669 - RNA, 22 nt, Human
cagagcuggcagggacccugcc

SEQ ID NO: 349670 - RNA, 23 nt, Human
cagagcuggccaggccacugggc

SEQ ID NO: 349671 - RNA, 32 nt, Human
cagagcuggcuaccagcagucuugcccuuuac

SEQ ID NO: 349672 - RNA, 29 nt, Human
cagagcuggcugcugugcccacccucagg

SEQ ID NO: 349673 - RNA, 32 nt, Human
cagagcugggacuccagcucauggcccuagca

SEQ ID NO: 349674 - RNA, 26 nt, Human
cagagcugggaggcauggcccugggg

SEQ ID NO: 349675 - RNA, 32 nt, Human
cagagcugggaggccaaggguucacugggcuu

SEQ ID NO: 349676 - RNA, 32 nt, Human
cagagcugggcuuuuauuuaauuuuucuuaaa

SEQ ID NO: 349677 - RNA, 23 nt, Human
cagagcuggggaagaaaggagga

SEQ ID NO: 349678 - RNA, 18 nt, Human
cagagcugggggagggau

SEQ ID NO: 349679 - RNA, 21 nt, Human
cagagcugggggcagccgggg

SEQ ID NO: 349680 - RNA, 20 nt, Human
cagagcugggggcccugugg

SEQ ID NO: 349681 - RNA, 18 nt, Human
cagagcuggggguccugg

SEQ ID NO: 349682 - RNA, 32 nt, Human
cagagcugggguugaagcuggagcagcagcaa

SEQ ID NO: 349683 - RNA, 32 nt, Human
cagagcugggucccccugcuccuccucgaccc

SEQ ID NO: 349684 - RNA, 32 nt, Human
cagagcugggucucacucuguugcccaggcug

SEQ ID NO: 349685 - RNA, 32 nt, Human
cagagcugggugggcugagaccagcaucccag

SEQ ID NO: 349686 - RNA, 32 nt, Human
cagagcuggucuccucccagcagacggagcca

SEQ ID NO: 349687 - RNA, 32 nt, Human
cagagcuggucugccauggacauccugguccc

SEQ ID NO: 349688 - RNA, 17 nt, Human
cagagcugguggggcgc

SEQ ID NO: 349689 - RNA, 22 nt, Human
cagagcugguuccucccuggga

SEQ ID NO: 349690 - RNA, 32 nt, Human
cagagcuguauaccugggacaggccagggagc

SEQ ID NO: 349691 - RNA, 32 nt, Human
cagagcuguccaggauugcaguggauaggaau

SEQ ID NO: 349692 - RNA, 32 nt, Human
cagagcuuacaaggagcugcaaggguuugccg

SEQ ID NO: 349693 - RNA, 32 nt, Human
cagagcuuaccucauugccuguccccaucuca

SEQ ID NO: 349694 - RNA, 32 nt, Human
cagagcuuccauccaguucagaaacaaagcaa

SEQ ID NO: 349695 - RNA, 32 nt, Human
cagagcuucuccaagaaaaaucaagccuaaug

SEQ ID NO: 349696 - RNA, 22 nt, Human
cagagcuugcuguccccugaga

SEQ ID NO: 349697 - RNA, 32 nt, Human
cagagcuugguuugggagguugaagugcucug

SEQ ID NO: 349698 - RNA, 32 nt, Human
cagagcuuucccuugacuucugagucuagugu

SEQ ID NO: 349699 - RNA, 32 nt, Human
cagagcuuugggaagccgaggcagcaggaucc

SEQ ID NO: 349700 - RNA, 32 nt, Human
cagaggaaaaaugggagccaggaguaagacaa

SEQ ID NO: 349701 - RNA, 27 nt, Human
cagaggaaaagaagaggaggagaagga

SEQ ID NO: 349702 - RNA, 32 nt, Human
cagaggaaagaacauuuuaugaggcuuucucu

SEQ ID NO: 349703 - RNA, 32 nt, Human
cagaggaaagagugugggcuuuggagacagca

SEQ ID NO: 349704 - RNA, 32 nt, Human
cagaggaaagccaagcugcuucuguugugagc

SEQ ID NO: 349705 - RNA, 32 nt, Human
cagaggaaauaaaucacugaucgcuaccagga

SEQ ID NO: 349706 - RNA, 32 nt, Human
cagaggaaccaggagucuuggggucuucucug

SEQ ID NO: 349707 - RNA, 32 nt, Human
cagaggaacggugucagcauuuugaaaaugcu

SEQ ID NO: 349708 - RNA, 32 nt, Human
cagaggaacucagcccugauugcgcuccaggg

SEQ ID NO: 349709 - RNA, 32 nt, Human
cagaggaacucugggaaacccacuuuugugca

SEQ ID NO: 349710 - RNA, 32 nt, Human
cagaggaagaagcauacaagugggaaaaacug

SEQ ID NO: 349711 - RNA, 32 nt, Human
cagaggaagacucagaaucacaaaaaggaaaa

SEQ ID NO: 349712 - RNA, 32 nt, Human
cagaggaagaggaaagaaagaagaggagggaa

SEQ ID NO: 349713 - RNA, 23 nt, Human
cagaggaagaggaggaggcggcg

SEQ ID NO: 349714 - RNA, 23 nt, Human
cagaggaagaggcaggggcagca

SEQ ID NO: 349715 - RNA, 32 nt, Human
cagaggaagagggagcgggagcucugcgaggc

SEQ ID NO: 349716 - RNA, 32 nt, Human
cagaggaagaggggacguguguuugcagacug

SEQ ID NO: 349717 - RNA, 22 nt, Human
cagaggaagaugccugccggca

SEQ ID NO: 349718 - RNA, 20 nt, Human
cagaggaagcacgggcagca

SEQ ID NO: 349719 - RNA, 32 nt, Human
cagaggaagcgggagagcaguuuacgacagcg

SEQ ID NO: 349720 - RNA, 24 nt, Human
cagaggaaggccgggagaagggga

SEQ ID NO: 349721 - RNA, 32 nt, Human
cagaggaaggccuguccugcuggaacuggagc

SEQ ID NO: 349722 - RNA, 32 nt, Human
cagaggaagggcuggagaugaagguucucagc

SEQ ID NO: 349723 - RNA, 21 nt, Human
cagaggaagguaaagguggug

SEQ ID NO: 349724 - RNA, 22 nt, Human
cagaggaauggcagggauggca

SEQ ID NO: 349725 - RNA, 31 nt, Human
cagaggaauuguggcucuugccaaggucaca

SEQ ID NO: 349726 - RNA, 32 nt, Human
cagaggaauuugucuucucugccuucacucag

SEQ ID NO: 349727 - RNA, 21 nt, Human
cagaggacaaggaagagaagg

SEQ ID NO: 349728 - RNA, 32 nt, Human
cagaggacaaucugggaugcucaggggacaga

SEQ ID NO: 349729 - RNA, 32 nt, Human
cagaggacacaaauacguuguuccagagcuca

SEQ ID NO: 349730 - RNA, 32 nt, Human
cagaggacacagaaggacuuggcagcagggug

SEQ ID NO: 349731 - RNA, 30 nt, Human
cagaggacaggccacagguaacagucaaau

SEQ ID NO: 349732 - RNA, 32 nt, Human
cagaggaccaaccagucuucugaaggucaugc

SEQ ID NO: 349733 - RNA, 32 nt, Human
cagaggaccacccauccugcucagggagacag

SEQ ID NO: 349734 - RNA, 32 nt, Human
cagaggaccagcugggaggacugguugugcug

SEQ ID NO: 349735 - RNA, 32 nt, Human
cagaggaccugagacucacacucucugcagcc

SEQ ID NO: 349736 - RNA, 20 nt, Human
cagaggaccuggagaacagg

SEQ ID NO: 349737 - RNA, 22 nt, Human
cagaggaccugggugaggacua

SEQ ID NO: 349738 - RNA, 32 nt, Human
cagaggaccuugagaauggggaagagagcucu

SEQ ID NO: 349739 - RNA, 31 nt, Human
cagaggacgauucucccuguaaaaggaacua

SEQ ID NO: 349740 - RNA, 32 nt, Human
cagaggacggggaaagacaggaggugcagguu

SEQ ID NO: 349741 - RNA, 32 nt, Human
cagaggacucacucagcucuuugcuucaugcc

SEQ ID NO: 349742 - RNA, 32 nt, Human
cagaggacugaaaccuccacugcaggcugguu

SEQ ID NO: 349743 - RNA, 32 nt, Human
cagaggagaagcagcggcuggagcagcagcug

SEQ ID NO: 349744 - RNA, 20 nt, Human
cagaggagaagcugagcccu

SEQ ID NO: 349745 - RNA, 32 nt, Human
cagaggagaaggagggggaggagaagagagaa

SEQ ID NO: 349746 - RNA, 32 nt, Human
cagaggagaaggcaggcagggcccagugagag

SEQ ID NO: 349747 - RNA, 32 nt, Human
cagaggagaccacucugcuccuggggccagag

SEQ ID NO: 349748 - RNA, 32 nt, Human
cagaggagacccaggcagugucagcagugaag

SEQ ID NO: 349749 - RNA, 32 nt, Human
cagaggagaccggagggcagaaggcagagucc

SEQ ID NO: 349750 - RNA, 32 nt, Human
cagaggagacgcgggcacaggagagcgcagag

SEQ ID NO: 349751 - RNA, 32 nt, Human
cagaggagacucugcugcuugcucccagcccc

SEQ ID NO: 349752 - RNA, 32 nt, Human
cagaggagagauuuacuacaccugugcuguaa

SEQ ID NO: 349753 - RNA, 32 nt, Human
cagaggagagcaucgcaucucacguuuuuagg

SEQ ID NO: 349754 - RNA, 32 nt, Human
cagaggagagcugagccauggaaggaggugug

SEQ ID NO: 349755 - RNA, 32 nt, Human
cagaggagaggaacuccauuauccuuacagug

SEQ ID NO: 349756 - RNA, 32 nt, Human
cagaggagaugcuggcuaccagcuggggcgac

SEQ ID NO: 349757 - RNA, 32 nt, Human
cagaggagcaggugggaugggagcagccccug

SEQ ID NO: 349758 - RNA, 32 nt, Human
cagaggagccaagaagcugcugggaaucgaga

SEQ ID NO: 349759 - RNA, 32 nt, Human
cagaggagcccagugggcugcacgcuccccuc

SEQ ID NO: 349760 - RNA, 32 nt, Human
cagaggagccguccagccacaccagcuuuccu

SEQ ID NO: 349761 - RNA, 32 nt, Human
cagaggagcggcuauggcauugaggaggaugg

SEQ ID NO: 349762 - RNA, 32 nt, Human
cagaggagcuaaauaucuuguucaaggcuaua

SEQ ID NO: 349763 - RNA, 19 nt, Human
cagaggagcucuccagccc

SEQ ID NO: 349764 - RNA, 24 nt, Human
cagaggagcuguuguggggccagg

SEQ ID NO: 349765 - RNA, 21 nt, Human
cagaggaggaaagagcaggca

SEQ ID NO: 349766 - RNA, 32 nt, Human
cagaggaggaagacagcagccuggcagcagcc

SEQ ID NO: 349767 - RNA, 25 nt, Human
cagaggaggaagaggaagaggagga

SEQ ID NO: 349768 - RNA, 32 nt, Human
cagaggaggagaaaggccggagccagccgagc

SEQ ID NO: 349769 - RNA, 32 nt, Human
cagaggaggagaaggaagaguuaugggaagaa

SEQ ID NO: 349770 - RNA, 32 nt, Human
cagaggaggagaaugaagaaagauggagucaa

SEQ ID NO: 349771 - RNA, 32 nt, Human
cagaggaggagagagccuggcagcggaggagc

SEQ ID NO: 349772 - RNA, 32 nt, Human
cagaggaggagaggaggaaaggaugggggcug

SEQ ID NO: 349773 - RNA, 26 nt, Human
cagaggaggaggaggacagagggaga

SEQ ID NO: 349774 - RNA, 32 nt, Human
cagaggaggaggaggacagagggagagaauac

SEQ ID NO: 349775 - RNA, 27 nt, Human
cagaggaggaggggcccgccuuagcca

SEQ ID NO: 349776 - RNA, 32 nt, Human
cagaggaggcgacagagggaaaaagggccgag

SEQ ID NO: 349777 - RNA, 32 nt, Human
cagaggagggaagaaaauuugcagugacugaa

SEQ ID NO: 349778 - RNA, 32 nt, Human
cagaggagggagaagcucuggggagccagcuu

SEQ ID NO: 349779 - RNA, 32 nt, Human
cagaggagggagcaguuugcagugcccagcca

SEQ ID NO: 349780 - RNA, 24 nt, Human
cagaggagggagccagcuaagcca

SEQ ID NO: 349781 - RNA, 22 nt, Human
cagaggagggagguggugagca

SEQ ID NO: 349782 - RNA, 32 nt, Human
cagaggaguccuuccucaauguccagcaaugc

SEQ ID NO: 349783 - RNA, 32 nt, Human
cagaggagugagcugagcaccuccagugagaa

SEQ ID NO: 349784 - RNA, 32 nt, Human
cagaggagugcagaggagggucuggcaggggc

SEQ ID NO: 349785 - RNA, 32 nt, Human
cagaggagugccagccuggcccaggugaaagc

SEQ ID NO: 349786 - RNA, 22 nt, Human
cagaggaguggcaaggauggca

SEQ ID NO: 349787 - RNA, 32 nt, Human
cagaggagugugcugugcuggcaaguguaagu

SEQ ID NO: 349788 - RNA, 32 nt, Human
cagaggaguuccgagggaucacugugguggag

SEQ ID NO: 349789 - RNA, 32 nt, Human
cagaggaucccuugaggccaggagguggaguc

SEQ ID NO: 349790 - RNA, 19 nt, Human
cagaggaucucgggcuagg

SEQ ID NO: 349791 - RNA, 32 nt, Human
cagaggaucugggagguggaagccaggccaga

SEQ ID NO: 349792 - RNA, 32 nt, Human
cagaggaugacucuguucacacccaauccagc

SEQ ID NO: 349793 - RNA, 32 nt, Human
cagaggaugagcuagggugcacagggggagua

SEQ ID NO: 349794 - RNA, 21 nt, Human
cagaggaugcuuccccugagg

SEQ ID NO: 349795 - RNA, 32 nt, Human
cagaggaugggaaagcuucaccugccacaguu

SEQ ID NO: 349796 - RNA, 19 nt, Human
cagaggaugggcagccagg

SEQ ID NO: 349797 - RNA, 32 nt, Human
cagaggauggggagacaggcaggaccuugucu

SEQ ID NO: 349798 - RNA, 32 nt, Human
cagaggauguggcagugagggacgauggggug

SEQ ID NO: 349799 - RNA, 32 nt, Human
cagaggaugugguuuggggcaggcagguaugg

SEQ ID NO: 349800 - RNA, 32 nt, Human
cagaggauucccgaguguggcugucuuggggc

SEQ ID NO: 349801 - RNA, 32 nt, Human
cagaggcaagaaagauuugcaucuucuaccac

SEQ ID NO: 349802 - RNA, 32 nt, Human
cagaggcaagccccaccucugacagagccagu

SEQ ID NO: 349803 - RNA, 32 nt, Human
cagaggcaaggcagagaacaagaccugugcuu

SEQ ID NO: 349804 - RNA, 32 nt, Human
cagaggcacacagcuggcauacuccaggcuca

SEQ ID NO: 349805 - RNA, 32 nt, Human
cagaggcaccccggacagagacgugaagcacu

SEQ ID NO: 349806 - RNA, 26 nt, Human
cagaggcaccucaagaagaagagggg

SEQ ID NO: 349807 - RNA, 32 nt, Human
cagaggcaccugcagagccucaugggcuggcu

SEQ ID NO: 349808 - RNA, 32 nt, Human
cagaggcaccuguuagggaaaaucagaugucu

SEQ ID NO: 349809 - RNA, 22 nt, Human
cagaggcagaaaaaguggggga

SEQ ID NO: 349810 - RNA, 21 nt, Human
cagaggcagagauuggaguga

SEQ ID NO: 349811 - RNA, 23 nt, Human
cagaggcagagcggcgcaagggc

SEQ ID NO: 349812 - RNA, 32 nt, Human
cagaggcagagcggcgcaagggccaaggagua

SEQ ID NO: 349813 - RNA, 32 nt, Human
cagaggcagaggaggcgacagagggaaaaagg

SEQ ID NO: 349814 - RNA, 21 nt, Human
cagaggcagagguugcaauga

SEQ ID NO: 349815 - RNA, 24 nt, Human
cagaggcagagguugcaaugaagc

SEQ ID NO: 349816 - RNA, 23 nt, Human
cagaggcagagguugcaaugagc

SEQ ID NO: 349817 - RNA, 24 nt, Human
cagaggcagagguugcagugagcu

SEQ ID NO: 349818 - RNA, 21 nt, Human
cagaggcagagguugugguga

SEQ ID NO: 349819 - RNA, 20 nt, Human
cagaggcagagucuggggcu

SEQ ID NO: 349820 - RNA, 32 nt, Human
cagaggcagauguggcaugucuuuuuguaccc

SEQ ID NO: 349821 - RNA, 23 nt, Human
cagaggcagcagaugcccaggga

SEQ ID NO: 349822 - RNA, 32 nt, Human
cagaggcagcagcccuggggaaauugaugggu

SEQ ID NO: 349823 - RNA, 32 nt, Human
cagaggcagcaugguccgcagggcaccauggg

SEQ ID NO: 349824 - RNA, 32 nt, Human
cagaggcagcucagaguggaggcucuaggcag

SEQ ID NO: 349825 - RNA, 32 nt, Human
cagaggcagcuccggcggccgagaggagggag

SEQ ID NO: 349826 - RNA, 32 nt, Human
cagaggcagcuuccagccugggggcuggugac

SEQ ID NO: 349827 - RNA, 32 nt, Human
cagaggcaggaacugggaauaggcuuggaggu

SEQ ID NO: 349828 - RNA, 32 nt, Human
cagaggcaggagaccaagauggcagguggagg

SEQ ID NO: 349829 - RNA, 32 nt, Human
cagaggcaggcagaggaaauauugucagagac

SEQ ID NO: 349830 - RNA, 32 nt, Human
cagaggcaggcagaucacaaggucaggaguuc

SEQ ID NO: 349831 - RNA, 24 nt, Human
cagaggcaggcccaaagagggagg

SEQ ID NO: 349832 - RNA, 32 nt, Human
cagaggcaggguggcccaucggagagagcagu

SEQ ID NO: 349833 - RNA, 32 nt, Human
cagaggcaggguggcuggaguacagacggugg

SEQ ID NO: 349834 - RNA, 32 nt, Human
cagaggcagguggaucaccugaggucgggagu

SEQ ID NO: 349835 - RNA, 32 nt, Human
cagaggcagguggcaagguggcgggugguaag

SEQ ID NO: 349836 - RNA, 32 nt, Human
cagaggcaguuuggaauaagcugcggcaaguu

SEQ ID NO: 349837 - RNA, 32 nt, Human
cagaggcauagauguucacaaugcagaguucg

SEQ ID NO: 349838 - RNA, 32 nt, Human
cagaggcauucccagcucuggcuuacuggaug

SEQ ID NO: 349839 - RNA, 21 nt, Human
cagaggccaaauaagguggga

SEQ ID NO: 349840 - RNA, 32 nt, Human
cagaggccaacacugugggugugugacucuuu

SEQ ID NO: 349841 - RNA, 22 nt, Human
cagaggccaagagagguuaggg

SEQ ID NO: 349842 - RNA, 24 nt, Human
cagaggccaagaguuugagggaga

SEQ ID NO: 349843 - RNA, 32 nt, Human
cagaggccacagcaccagcucugacaaguccu

SEQ ID NO: 349844 - RNA, 32 nt, Human
cagaggccaccacugcuuuucaugcaggaguu

SEQ ID NO: 349845 - RNA, 32 nt, Human
cagaggccacugcaccugggcuagggguccac

SEQ ID NO: 349846 - RNA, 32 nt, Human
cagaggccagacggcauagcagaggaagaggu

SEQ ID NO: 349847 - RNA, 32 nt, Human
cagaggccagcucucccccuccaucuuggggg

SEQ ID NO: 349848 - RNA, 20 nt, Human
cagaggccaggggcccaggg

SEQ ID NO: 349849 - RNA, 20 nt, Human
cagaggcccaaauccaugga

SEQ ID NO: 349850 - RNA, 18 nt, Human
cagaggcccacaccgggc

SEQ ID NO: 349851 - RNA, 20 nt, Human
cagaggcccacccucauggg

SEQ ID NO: 349852 - RNA, 32 nt, Human
cagaggcccagccucuguggcccugugaccug

SEQ ID NO: 349853 - RNA, 32 nt, Human
cagaggcccaggaaucggagcgaagcagagag

SEQ ID NO: 349854 - RNA, 32 nt, Human
cagaggcccaggcugaggagcuuggcggcgag

SEQ ID NO: 349855 - RNA, 32 nt, Human
cagaggcccagggagagcagcaggaagauagc

SEQ ID NO: 349856 - RNA, 20 nt, Human
cagaggcccauggagaggga

SEQ ID NO: 349857 - RNA, 22 nt, Human
cagaggcccauggccccagcga

SEQ ID NO: 349858 - RNA, 20 nt, Human
cagaggccccacucaggaga

SEQ ID NO: 349859 - RNA, 32 nt, Human
cagaggcccccugcgggugcugaggggagagu

SEQ ID NO: 349860 - RNA, 19 nt, Human
cagaggccccgggcccagg

SEQ ID NO: 349861 - RNA, 24 nt, Human
cagaggcccgcacaaugaccggag

SEQ ID NO: 349862 - RNA, 21 nt, Human
cagaggcccgcuugcuggggg

SEQ ID NO: 349863 - RNA, 25 nt, Human
cagaggcccggccgcagcgcaggga

SEQ ID NO: 349864 - RNA, 23 nt, Human
cagaggcccggcgaccuccaggg

SEQ ID NO: 349865 - RNA, 32 nt, Human
cagaggcccuccagagagacugcccugcacgc

SEQ ID NO: 349866 - RNA, 32 nt, Human
cagaggcccugagauugcugcccucccauauu

SEQ ID NO: 349867 - RNA, 32 nt, Human
cagaggcccugcagagcggcaggauggagaua

SEQ ID NO: 349868 - RNA, 32 nt, Human
cagaggcccugcagagcggcaggauggagaug

SEQ ID NO: 349869 - RNA, 32 nt, Human
cagaggcccugccuuuggcugagcugagacac

SEQ ID NO: 349870 - RNA, 32 nt, Human
cagaggcccuggaauugugggugaggcugucu

SEQ ID NO: 349871 - RNA, 32 nt, Human
cagaggcccuggagggaaggacagucccugcu

SEQ ID NO: 349872 - RNA, 25 nt, Human
cagaggcccuggaggucuccagggg

SEQ ID NO: 349873 - RNA, 32 nt, Human
cagaggcccuggaggucuccaggggccugcag

SEQ ID NO: 349874 - RNA, 22 nt, Human
cagaggcccugggcacgggagg

SEQ ID NO: 349875 - RNA, 24 nt, Human
cagaggccgagcugaagagaugga

SEQ ID NO: 349876 - RNA, 32 nt, Human
cagaggccgagcugaagagauggacccggguc

SEQ ID NO: 349877 - RNA, 32 nt, Human
cagaggccgggaagagacacccccucccaaac

SEQ ID NO: 349878 - RNA, 32 nt, Human
cagaggccgggacggccucucccucucagugu

SEQ ID NO: 349879 - RNA, 32 nt, Human
cagaggccgugucaccuggccugggccgcaca

SEQ ID NO: 349880 - RNA, 28 nt, Human
cagaggccuaaggcugccucagcacccu

SEQ ID NO: 349881 - RNA, 22 nt, Human
cagaggccuacgaaccuaggga

SEQ ID NO: 349882 - RNA, 21 nt, Human
cagaggccuaggcccacgggg

SEQ ID NO: 349883 - RNA, 32 nt, Human
cagaggccuaucuccacuuuaaaucuguccug

SEQ ID NO: 349884 - RNA, 25 nt, Human
cagaggccucagagggcccuaggga

SEQ ID NO: 349885 - RNA, 21 nt, Human
cagaggccucagcccugggga

SEQ ID NO: 349886 - RNA, 32 nt, Human
cagaggccucgccuccugaaggacgcagugug

SEQ ID NO: 349887 - RNA, 23 nt, Human
cagaggccugggcccucagugga

SEQ ID NO: 349888 - RNA, 32 nt, Human
cagaggccugggucuccaggagaagcugaggg

SEQ ID NO: 349889 - RNA, 32 nt, Human
cagaggccugggugggaggggaccaagggugu

SEQ ID NO: 349890 - RNA, 32 nt, Human
cagaggccugguggcccugcugggcagcccaa

SEQ ID NO: 349891 - RNA, 32 nt, Human
cagaggccuguaaucccagcuacuugggaggc

SEQ ID NO: 349892 - RNA, 32 nt, Human
cagaggccuguaaucccaguuccuugggaggc

SEQ ID NO: 349893 - RNA, 32 nt, Human
cagaggccugucucccccuucccuccccaccg

SEQ ID NO: 349894 - RNA, 32 nt, Human
cagaggccugucucccugugaugcugugcuuc

SEQ ID NO: 349895 - RNA, 19 nt, Human
cagaggccugugcccaucg

SEQ ID NO: 349896 - RNA, 32 nt, Human
cagaggccuuaaaauauucuuucacaguagcu

SEQ ID NO: 349897 - RNA, 32 nt, Human
cagaggccuuagaccagcaggucuaggucaca

SEQ ID NO: 349898 - RNA, 32 nt, Human
cagaggccuuucagaaggagaaggcagcucug

SEQ ID NO: 349899 - RNA, 32 nt, Human
cagaggccuuucuuuucccuucccccagcucu

SEQ ID NO: 349900 - RNA, 32 nt, Human
cagaggcgaaggcagauggggcacugacccag

SEQ ID NO: 349901 - RNA, 24 nt, Human
cagaggcgccgcucccuggcucgc

SEQ ID NO: 349902 - RNA, 24 nt, Human
cagaggcgcugcgagggcagccgc

SEQ ID NO: 349903 - RNA, 25 nt, Human
cagaggcggagccgcuguggcacug

SEQ ID NO: 349904 - RNA, 21 nt, Human
cagaggcggcgauuguggcgg

SEQ ID NO: 349905 - RNA, 21 nt, Human
cagaggcgggagaugguggca

SEQ ID NO: 349906 - RNA, 32 nt, Human
cagaggcgggcagaucacuugaggucaggagu

SEQ ID NO: 349907 - RNA, 32 nt, Human
cagaggcgggcagcuccuccuccagggcccac

SEQ ID NO: 349908 - RNA, 32 nt, Human
cagaggcgggcggaucaucugaggucaggagu

SEQ ID NO: 349909 - RNA, 32 nt, Human
cagaggcgggucgggcugggccagcuggggua

SEQ ID NO: 349910 - RNA, 32 nt, Human
cagaggcgugaggagaggaaagcagggagguc

SEQ ID NO: 349911 - RNA, 24 nt, Human
cagaggcuacaucugcccuaggga

SEQ ID NO: 349912 - RNA, 32 nt, Human
cagaggcuagguuguuucugugggugccuuau

SEQ ID NO: 349913 - RNA, 23 nt, Human
cagaggcuaugggaagaggguga

SEQ ID NO: 349914 - RNA, 24 nt, Human
cagaggcucacgccuguaauccca

SEQ ID NO: 349915 - RNA, 32 nt, Human
cagaggcucagagagaauaaccuccaucuccu

SEQ ID NO: 349916 - RNA, 32 nt, Human
cagaggcucaggaaguggaaauggccucaggu

SEQ ID NO: 349917 - RNA, 24 nt, Human
cagaggcucaugccuguaauccca

SEQ ID NO: 349918 - RNA, 32 nt, Human
cagaggcuccaccuguggguccugguucaugg

SEQ ID NO: 349919 - RNA, 32 nt, Human
cagaggcuccagaaacacugggugacacccag

SEQ ID NO: 349920 - RNA, 21 nt, Human
cagaggcuccucccgcgggga

SEQ ID NO: 349921 - RNA, 32 nt, Human
cagaggcuccugggccuggcuuggcugucccc

SEQ ID NO: 349922 - RNA, 23 nt, Human
cagaggcucgaggggcucagggg

SEQ ID NO: 349923 - RNA, 32 nt, Human
cagaggcucugacacugucugguuuccaaugc

SEQ ID NO: 349924 - RNA, 32 nt, Human
cagaggcugcacucuagccugggcaacagagc

SEQ ID NO: 349925 - RNA, 32 nt, Human
cagaggcugcagccccgguccccagcggcuaa

SEQ ID NO: 349926 - RNA, 32 nt, Human
cagaggcugcauuugccuucuucugccaccua

SEQ ID NO: 349927 - RNA, 32 nt, Human
cagaggcugcccacucaggucuugccuuguug

SEQ ID NO: 349928 - RNA, 24 nt, Human
cagaggcugcugccagggcugcug

SEQ ID NO: 349929 - RNA, 19 nt, Human
cagaggcugcugcccaggg

SEQ ID NO: 349930 - RNA, 27 nt, Human
cagaggcugcugggaggaaggaggaga

SEQ ID NO: 349931 - RNA, 32 nt, Human
cagaggcuggcguaguggggcagcugcugacc

SEQ ID NO: 349932 - RNA, 32 nt, Human
cagaggcugggaagaggggguagggguuaggu

SEQ ID NO: 349933 - RNA, 32 nt, Human
cagaggcugggaaugggagcaguaagcugucg

SEQ ID NO: 349934 - RNA, 32 nt, Human
cagaggcugugaacagggagaugggggagggg

SEQ ID NO: 349935 - RNA, 32 nt, Human
cagaggcuguggcgagggagagccaagcauau

SEQ ID NO: 349936 - RNA, 24 nt, Human
cagaggcuuaauguugccugugga

SEQ ID NO: 349937 - RNA, 23 nt, Human
cagaggcuuacagguccaggugg

SEQ ID NO: 349938 - RNA, 32 nt, Human
cagaggcuuccccagcccuggggaucauuuuu

SEQ ID NO: 349939 - RNA, 32 nt, Human
cagaggcuucuccaaagggagggugacaugcu

SEQ ID NO: 349940 - RNA, 32 nt, Human
cagaggcuuguauaucaguucaaggauaugcc

SEQ ID NO: 349941 - RNA, 32 nt, Human
cagagggaaaggaggaagcugcguggcauuuc

SEQ ID NO: 349942 - RNA, 32 nt, Human
cagagggaaaggaggcuggagaggcuucugau

SEQ ID NO: 349943 - RNA, 32 nt, Human
cagagggaaagggagagccaccugguacuugu

SEQ ID NO: 349944 - RNA, 32 nt, Human
cagagggaaccagcuccggccucagccagccc

SEQ ID NO: 349945 - RNA, 32 nt, Human
cagagggaacccaggcuggaugcugcagagaa

SEQ ID NO: 349946 - RNA, 32 nt, Human
cagagggaacuaagcaaauccaauagagaugu

SEQ ID NO: 349947 - RNA, 32 nt, Human
cagagggaacuccagggcagggaugugccuga

SEQ ID NO: 349948 - RNA, 18 nt, Human
cagagggaagaagagggg

SEQ ID NO: 349949 - RNA, 32 nt, Human
cagagggaagugggucugcuucaugguuguua

SEQ ID NO: 349950 - RNA, 32 nt, Human
cagagggacacaucuccugggcacaaugugca

SEQ ID NO: 349951 - RNA, 25 nt, Human
cagagggacagcgcccagagcccag

SEQ ID NO: 349952 - RNA, 22 nt, Human
cagagggacaggugugguggca

SEQ ID NO: 349953 - RNA, 32 nt, Human
cagagggacccuuggcuccugugucuggucca

SEQ ID NO: 349954 - RNA, 32 nt, Human
cagagggaccuggcaggcagagcuccagaagg

SEQ ID NO: 349955 - RNA, 32 nt, Human
cagagggacuccucccuaucugauucuaugag

SEQ ID NO: 349956 - RNA, 32 nt, Human
cagagggagaagagccccugcccacugcacuc

SEQ ID NO: 349957 - RNA, 32 nt, Human
cagagggagaaguguuucaggauuguaggagu

SEQ ID NO: 349958 - RNA, 32 nt, Human
cagagggagaggagacaggaaggaaagaugaa

SEQ ID NO: 349959 - RNA, 32 nt, Human
cagagggagaggaggaagaagagguagaagga

SEQ ID NO: 349960 - RNA, 32 nt, Human
cagagggagaggggacccaguucagaaucuca

SEQ ID NO: 349961 - RNA, 32 nt, Human
cagagggagcagcucccccacccauggcaucu

SEQ ID NO: 349962 - RNA, 32 nt, Human
cagagggagcagucauggcggagcuggaggcu

SEQ ID NO: 349963 - RNA, 32 nt, Human
cagagggagcaguccggagaggcaagaugacc

SEQ ID NO: 349964 - RNA, 22 nt, Human
cagagggagcauggcccagggg

SEQ ID NO: 349965 - RNA, 20 nt, Human
cagagggagcccuccaggag

SEQ ID NO: 349966 - RNA, 32 nt, Human
cagagggagcgucaaggcccugugcugcuguc

SEQ ID NO: 349967 - RNA, 30 nt, Human
cagagggagcugggcagggcacagcagggc

SEQ ID NO: 349968 - RNA, 32 nt, Human
cagagggagcugucuccagacagcuccaucag

SEQ ID NO: 349969 - RNA, 32 nt, Human
cagagggaggaagaagccagacgacagucagg

SEQ ID NO: 349970 - RNA, 32 nt, Human
cagagggaggaagaagccagaugacagucagg

SEQ ID NO: 349971 - RNA, 32 nt, Human
cagagggaggaagaagcggcggcgcggcggcg

SEQ ID NO: 349972 - RNA, 32 nt, Human
cagagggaggaaggcagagcaaguggagcagg

SEQ ID NO: 349973 - RNA, 32 nt, Human
cagagggaggagcaggcaggagagagagggga

SEQ ID NO: 349974 - RNA, 32 nt, Human
cagagggaggcugaaccugagggcaagaagaa

SEQ ID NO: 349975 - RNA, 24 nt, Human
cagagggagggaaggguggucaca

SEQ ID NO: 349976 - RNA, 32 nt, Human
cagagggaggucauuguuacacacacaucccc

SEQ ID NO: 349977 - RNA, 32 nt, Human
cagagggaguugucacgcuacagugaguggcu

SEQ ID NO: 349978 - RNA, 25 nt, Human
cagagggauggcugcucagcugcug

SEQ ID NO: 349979 - RNA, 24 nt, Human
cagagggcaccaaggaggguggca

SEQ ID NO: 349980 - RNA, 21 nt, Human
cagagggcacugggcuggggc

SEQ ID NO: 349981 - RNA, 32 nt, Human
cagagggcagcccagcuccagguaggcaccag

SEQ ID NO: 349982 - RNA, 32 nt, Human
cagagggcagggcuaggcgagagccuggggug

SEQ ID NO: 349983 - RNA, 32 nt, Human
cagagggcagugcaggcuucugccugggcccc

SEQ ID NO: 349984 - RNA, 32 nt, Human
cagagggccagaagaaugagagagaggaagac

SEQ ID NO: 349985 - RNA, 20 nt, Human
cagagggccagaguggguag

SEQ ID NO: 349986 - RNA, 21 nt, Human
cagagggccagguacagggag

SEQ ID NO: 349987 - RNA, 21 nt, Human
cagagggccaucgugacguag

SEQ ID NO: 349988 - RNA, 32 nt, Human
cagagggcccaggagggucuugcagucaucua

SEQ ID NO: 349989 - RNA, 18 nt, Human
cagagggcccuccaggaa

SEQ ID NO: 349990 - RNA, 21 nt, Human
cagagggcgcugccuguccuc

SEQ ID NO: 349991 - RNA, 32 nt, Human
cagagggcucagauggacacagaauucuagcu

SEQ ID NO: 349992 - RNA, 25 nt, Human
cagagggcucuuggucgcucaggga

SEQ ID NO: 349993 - RNA, 32 nt, Human
cagagggcugcacauagacacagggaaacaca

SEQ ID NO: 349994 - RNA, 32 nt, Human
cagagggcugggcucccagacuccugggugcu

SEQ ID NO: 349995 - RNA, 32 nt, Human
cagagggcuggggaggugggaaagacgauuuu

SEQ ID NO: 349996 - RNA, 19 nt, Human
cagagggcuuugcccaggg

SEQ ID NO: 349997 - RNA, 32 nt, Human
cagaggggaaaccaguguagccuugcccggau

SEQ ID NO: 349998 - RNA, 32 nt, Human
cagaggggaaagcagcucccaggccuuacuca

SEQ ID NO: 349999 - RNA, 32 nt, Human
cagaggggaaggacguguggauuggagucaga

SEQ ID NO: 350000 - RNA, 32 nt, Human
cagaggggacacaccucagccucucacugugg

SEQ ID NO: 350001 - RNA, 22 nt, Human
cagaggggaccaaaggauggca

SEQ ID NO: 350002 - RNA, 32 nt, Human
cagaggggagagagggcaggacaggccagagu

SEQ ID NO: 350003 - RNA, 32 nt, Human
cagaggggagcccacugcccugaagggagaga

SEQ ID NO: 350004 - RNA, 32 nt, Human
cagaggggagccugugcuggucccgggcgucu

SEQ ID NO: 350005 - RNA, 32 nt, Human
cagaggggaggaacaggcacaggcuagaggca

SEQ ID NO: 350006 - RNA, 32 nt, Human
cagaggggagggaggaaggaaggagucccagc

SEQ ID NO: 350007 - RNA, 32 nt, Human
cagaggggaguguggagugggaagcaccuaac

SEQ ID NO: 350008 - RNA, 19 nt, Human
cagaggggaugugggagua

SEQ ID NO: 350009 - RNA, 32 nt, Human
cagaggggcaggggagcccacccuggauccug

SEQ ID NO: 350010 - RNA, 21 nt, Human
cagaggggccccgaagggcac

SEQ ID NO: 350011 - RNA, 32 nt, Human
cagaggggcgggguugaccuaggcugaauauc

SEQ ID NO: 350012 - RNA, 21 nt, Human
cagaggggcugcagggagcau

SEQ ID NO: 350013 - RNA, 32 nt, Human
cagaggggcuuccccaagcucuguuuugaagc

SEQ ID NO: 350014 - RNA, 23 nt, Human
cagagggggaaauaagaggagga

SEQ ID NO: 350015 - RNA, 32 nt, Human
cagagggggagggagaggccggacacaagcuc

SEQ ID NO: 350016 - RNA, 32 nt, Human
cagagggggugagaaagcaguggaugauuggg

SEQ ID NO: 350017 - RNA, 32 nt, Human
cagaggggguggaggacucuccccugccucug

SEQ ID NO: 350018 - RNA, 32 nt, Human
cagagggguugcagauacgugacuuggagcac

SEQ ID NO: 350019 - RNA, 32 nt, Human
cagaggguagguggagagugaagccaagcccc

SEQ ID NO: 350020 - RNA, 32 nt, Human
cagaggguaggugggaaagaacagacaagcca

SEQ ID NO: 350021 - RNA, 32 nt, Human
cagagggucauugugacagcuuucuguauccc

SEQ ID NO: 350022 - RNA, 32 nt, Human
cagagggucccauggaccuggccggcggccuu

SEQ ID NO: 350023 - RNA, 24 nt, Human
cagagggucgguggaggggucauu

SEQ ID NO: 350024 - RNA, 32 nt, Human
cagagggucuacacccugcaggauuugcugua

SEQ ID NO: 350025 - RNA, 32 nt, Human
cagagggugccucugccucucugugucagggg

SEQ ID NO: 350026 - RNA, 32 nt, Human
cagaggguggccguccucacaccugugcgcag

SEQ ID NO: 350027 - RNA, 22 nt, Human
cagaggguggcucugggagcag

SEQ ID NO: 350028 - RNA, 32 nt, Human
cagagguagcggccccagccccagagaguggg

SEQ ID NO: 350029 - RNA, 32 nt, Human
cagagguauccagcagaggggagaagaaagag

SEQ ID NO: 350030 - RNA, 32 nt, Human
cagagguaugaaaaggagagcucuccuaguug

SEQ ID NO: 350031 - RNA, 32 nt, Human
cagaggucaagaaaagcaguccagagauggag

SEQ ID NO: 350032 - RNA, 32 nt, Human
cagaggucaagaguuugagaccagcuugguga

SEQ ID NO: 350033 - RNA, 32 nt, Human
cagaggucacacagccugugugcaguggagcu

SEQ ID NO: 350034 - RNA, 32 nt, Human
cagaggucaccaggaaaguugaggagacggac

SEQ ID NO: 350035 - RNA, 32 nt, Human
cagaggucacccgugauucugccugcaccuua

SEQ ID NO: 350036 - RNA, 32 nt, Human
cagaggucaggaaaacacaagauggaaaauug

SEQ ID NO: 350037 - RNA, 32 nt, Human
cagaggucaggaguuccagaccagccuggcca

SEQ ID NO: 350038 - RNA, 32 nt, Human
cagaggucaggaguucgagaccagcccagcca

SEQ ID NO: 350039 - RNA, 32 nt, Human
cagaggucaggaguucgagaccagccuggcca

SEQ ID NO: 350040 - RNA, 32 nt, Human
cagaggucaggaguuggagaccagccugccca

SEQ ID NO: 350041 - RNA, 32 nt, Human
cagaggucagguguucaagaccagccugacca

SEQ ID NO: 350042 - RNA, 32 nt, Human
cagaggucaucccucuugcccucuaugacucu

SEQ ID NO: 350043 - RNA, 32 nt, Human
cagagguccaagcuauacugugcaggacaugg

SEQ ID NO: 350044 - RNA, 32 nt, Human
cagaggucccagaugccugggcugagaaccca

SEQ ID NO: 350045 - RNA, 32 nt, Human
cagaggucccgggcggaggaggaagcuguggc

SEQ ID NO: 350046 - RNA, 26 nt, Human
cagagguccuacccucugucuaggga

SEQ ID NO: 350047 - RNA, 32 nt, Human
cagaggucucagacacguuuggucaucagaca

SEQ ID NO: 350048 - RNA, 22 nt, Human
cagaggucuccaccccacggga

SEQ ID NO: 350049 - RNA, 32 nt, Human
cagaggucucugccggcucuuuccuugcucaa

SEQ ID NO: 350050 - RNA, 32 nt, Human
cagaggucucugcuagccuugguaucauuuuc

SEQ ID NO: 350051 - RNA, 23 nt, Human
cagaggucugggucccccagggg

SEQ ID NO: 350052 - RNA, 32 nt, Human
cagaggucugugagacagggaagggcaagagg

SEQ ID NO: 350053 - RNA, 32 nt, Human
cagaggugaaggagucagagaggcgacaggau

SEQ ID NO: 350054 - RNA, 32 nt, Human
cagaggugagcaauggccguggccggaggugc

SEQ ID NO: 350055 - RNA, 21 nt, Human
cagaggugagccugucguggc

SEQ ID NO: 350056 - RNA, 32 nt, Human
cagaggugagggccagggcagcucagguuccu

SEQ ID NO: 350057 - RNA, 32 nt, Human
cagaggugcaagggcuuagaaaagacccuggc

SEQ ID NO: 350058 - RNA, 32 nt, Human
cagaggugcacaggcuggaguuucaggcacug

SEQ ID NO: 350059 - RNA, 32 nt, Human
cagaggugcccgcucuucccuccugggcccac

SEQ ID NO: 350060 - RNA, 32 nt, Human
cagaggugccugagggugguuggggaggugag

SEQ ID NO: 350061 - RNA, 21 nt, Human
cagagguggaaggcgcggcgg

SEQ ID NO: 350062 - RNA, 20 nt, Human
cagagguggagaaggggaca

SEQ ID NO: 350063 - RNA, 20 nt, Human
cagagguggagccacugagg

SEQ ID NO: 350064 - RNA, 32 nt, Human
cagagguggagcgaccccauuacgcuaaagau

SEQ ID NO: 350065 - RNA, 21 nt, Human
cagagguggagguugcaguga

SEQ ID NO: 350066 - RNA, 32 nt, Human
cagagguggaugcuagcuacaccagcuaugcu

SEQ ID NO: 350067 - RNA, 19 nt, Human
cagagguggcgcccagggg

SEQ ID NO: 350068 - RNA, 32 nt, Human
cagagguggcugcugugcugugccuagaugca

SEQ ID NO: 350069 - RNA, 32 nt, Human
cagagguggcuggaggauaaugguccuacgca

SEQ ID NO: 350070 - RNA, 32 nt, Human
cagaggugggacuagguaaggccaggucucug

SEQ ID NO: 350071 - RNA, 19 nt, Human
cagaggugggagcugcggc

SEQ ID NO: 350072 - RNA, 22 nt, Human
cagaggugggcaggugguggca

SEQ ID NO: 350073 - RNA, 32 nt, Human
cagagguggucuggugccaccgucccucugca

SEQ ID NO: 350074 - RNA, 32 nt, Human
cagaggugucccaucccauugcagccuccacc

SEQ ID NO: 350075 - RNA, 32 nt, Human
cagaggugucuucucccccuaaccuacagcuu

SEQ ID NO: 350076 - RNA, 32 nt, Human
cagaggugugggaggcagaaggcuacaaccua

SEQ ID NO: 350077 - RNA, 32 nt, Human
cagagguguuacaugccaggauaucagggagu

SEQ ID NO: 350078 - RNA, 32 nt, Human
cagagguucacacaggugcagcuucgaggccc

SEQ ID NO: 350079 - RNA, 32 nt, Human
cagagguucucaucugaauuaccaucuguccc

SEQ ID NO: 350080 - RNA, 32 nt, Human
cagagguucuuccagccccacuucuaugcgau

SEQ ID NO: 350081 - RNA, 22 nt, Human
cagagguugaccguaccccgga

SEQ ID NO: 350082 - RNA, 23 nt, Human
cagagguugcagcagauggugug

SEQ ID NO: 350083 - RNA, 32 nt, Human
cagagguugcaguaagcugagaucccaccauu

SEQ ID NO: 350084 - RNA, 32 nt, Human
cagagguugcagugaaccgagguugcgccacu

SEQ ID NO: 350085 - RNA, 32 nt, Human
cagagguuuaggcuggaggcuuggugagaaua

SEQ ID NO: 350086 - RNA, 24 nt, Human
cagaguaacagggauuacaggcau

SEQ ID NO: 350087 - RNA, 32 nt, Human
cagaguaaggcucuuccuggaagggacugggg

SEQ ID NO: 350088 - RNA, 32 nt, Human
cagaguaauggaccagcaaugcugaagacgcc

SEQ ID NO: 350089 - RNA, 32 nt, Human
cagaguacagaugagaacagcuuacaugaacc

SEQ ID NO: 350090 - RNA, 32 nt, Human
cagaguacaugauagcaaaauaaagccauuug

SEQ ID NO: 350091 - RNA, 22 nt, Human
cagaguacaugucucugccucu

SEQ ID NO: 350092 - RNA, 21 nt, Human
cagaguacccaguacaaguca

SEQ ID NO: 350093 - RNA, 32 nt, Human
cagaguacgagucugaggcggagggaguaaug

SEQ ID NO: 350094 - RNA, 21 nt, Human
cagaguacugggauuacaggc

SEQ ID NO: 350095 - RNA, 32 nt, Human
cagaguagaaaagauuguggccaagaagagug

SEQ ID NO: 350096 - RNA, 32 nt, Human
cagaguagccaggguguggcccugccaucuuc

SEQ ID NO: 350097 - RNA, 23 nt, Human
cagaguagcugggacuacaggca

SEQ ID NO: 350098 - RNA, 24 nt, Human
cagaguagcugggacuacaggcau

SEQ ID NO: 350099 - RNA, 23 nt, Human
cagaguagcugggauuacaggca

SEQ ID NO: 350100 - RNA, 23 nt, Human
cagaguagcugggauuacaggcg

SEQ ID NO: 350101 - RNA, 32 nt, Human
cagaguaggccugcuucuucccaugaaagcca

SEQ ID NO: 350102 - RNA, 20 nt, Human
cagaguagucacacugaaga

SEQ ID NO: 350103 - RNA, 32 nt, Human
cagaguaguuagagaauauguaugccugcaau

SEQ ID NO: 350104 - RNA, 32 nt, Human
cagaguaguucaggcuggguggagcaguggga

SEQ ID NO: 350105 - RNA, 32 nt, Human
cagaguauacauggcccugaaauuaacugccc

SEQ ID NO: 350106 - RNA, 32 nt, Human
cagaguaucuugaaauaaugaucugaccgccu

SEQ ID NO: 350107 - RNA, 32 nt, Human
cagaguauggagcucagagagggcaggcauga

SEQ ID NO: 350108 - RNA, 32 nt, Human
cagaguaugguucucagcccaccagcuaguau

SEQ ID NO: 350109 - RNA, 32 nt, Human
cagaguauuacaucaucuuauuuugguuuuau

SEQ ID NO: 350110 - RNA, 23 nt, Human
cagaguauugcuuuucacauuua

SEQ ID NO: 350111 - RNA, 32 nt, Human
cagaguauuguugaaguaauuagaagauauau

SEQ ID NO: 350112 - RNA, 32 nt, Human
cagaguauuuggaaguuaagaauugauuagac

SEQ ID NO: 350113 - RNA, 32 nt, Human
cagagucacagcagugccgagguguccgcggc

SEQ ID NO: 350114 - RNA, 32 nt, Human
cagagucaccaaggcaaaguuggggcuggucc

SEQ ID NO: 350115 - RNA, 32 nt, Human
cagagucacccaggcuggagugcaguggugag

SEQ ID NO: 350116 - RNA, 32 nt, Human
cagagucaccugcuggcuuagaggaguggagu

SEQ ID NO: 350117 - RNA, 32 nt, Human
cagagucacugcaccaucaggcuuggcccugc

SEQ ID NO: 350118 - RNA, 19 nt, Human
cagagucacuucuccuccu

SEQ ID NO: 350119 - RNA, 32 nt, Human
cagagucaggcuguucaugagugcucaccugg

SEQ ID NO: 350120 - RNA, 32 nt, Human
cagagucagggagggcagaggguggcagcgag

SEQ ID NO: 350121 - RNA, 32 nt, Human
cagagucaggggcuggccagagggucugcucc

SEQ ID NO: 350122 - RNA, 24 nt, Human
cagagucauauuucucuucuuuca

SEQ ID NO: 350123 - RNA, 32 nt, Human
cagagucaucaugucucucgagcagaggaguc

SEQ ID NO: 350124 - RNA, 32 nt, Human
cagagucauccugagggguccccaggggaggc

SEQ ID NO: 350125 - RNA, 32 nt, Human
cagagucaugugcccugugaccacugaagggu

SEQ ID NO: 350126 - RNA, 32 nt, Human
cagaguccacaggaaagaagucacuguugcaa

SEQ ID NO: 350127 - RNA, 32 nt, Human
cagagucccagcccuggcuggggcagggcccc

SEQ ID NO: 350128 - RNA, 32 nt, Human
cagaguccccaaccccagaagggggccaugga

SEQ ID NO: 350129 - RNA, 23 nt, Human
cagaguccccaggagccgagggg

SEQ ID NO: 350130 - RNA, 32 nt, Human
cagagucccgucucaccauccugggcuuccaa

SEQ ID NO: 350131 - RNA, 32 nt, Human
cagaguccggcauccccuccccagacugccug

SEQ ID NO: 350132 - RNA, 32 nt, Human
cagaguccgggagaaugcuggcaaaggcuggc

SEQ ID NO: 350133 - RNA, 32 nt, Human
cagagucggguguagaccagcccugggauuuc

SEQ ID NO: 350134 - RNA, 32 nt, Human
cagagucguaggaaacagcagauggaaaugga

SEQ ID NO: 350135 - RNA, 32 nt, Human
cagagucuacagccugacccagcugcccgcua

SEQ ID NO: 350136 - RNA, 18 nt, Human
cagagucucacucuguca

SEQ ID NO: 350137 - RNA, 32 nt, Human
cagagucucacugucuugcccaggcuggagug

SEQ ID NO: 350138 - RNA, 18 nt, Human
cagagucucacuuuguca

SEQ ID NO: 350139 - RNA, 18 nt, Human
cagagucucauucuguca

SEQ ID NO: 350140 - RNA, 21 nt, Human
cagagucuccuccuggccagg

SEQ ID NO: 350141 - RNA, 32 nt, Human
cagagucuccuggcuggcugcugcucucugga

SEQ ID NO: 350142 - RNA, 18 nt, Human
cagagucucgcucuguca

SEQ ID NO: 350143 - RNA, 32 nt, Human
cagagucucgcucuguugcccagccuggagug

SEQ ID NO: 350144 - RNA, 32 nt, Human
cagagucucucucuguagccaggcuggagggc

SEQ ID NO: 350145 - RNA, 32 nt, Human
cagagucugggagucuucagacugguuugccu

SEQ ID NO: 350146 - RNA, 32 nt, Human
cagagucuuacaugacuuaaagccacaccccc

SEQ ID NO: 350147 - RNA, 18 nt, Human
cagagucuuacucuguca

SEQ ID NO: 350148 - RNA, 22 nt, Human
cagagucuuauuaaaagagggg

SEQ ID NO: 350149 - RNA, 32 nt, Human
cagagucuucacuggcaguagggggagauggg

SEQ ID NO: 350150 - RNA, 32 nt, Human
cagagucuucacuggggcacuguauaguggag

SEQ ID NO: 350151 - RNA, 32 nt, Human
cagagucuuccucugucuccuaagcuggagug

SEQ ID NO: 350152 - RNA, 32 nt, Human
cagagucuugcucugcuggagugcgguggugc

SEQ ID NO: 350153 - RNA, 32 nt, Human
cagagucuuguccuaugcauucccagcccagc

SEQ ID NO: 350154 - RNA, 32 nt, Human
cagagugaaacugugacccucucccuucccug

SEQ ID NO: 350155 - RNA, 32 nt, Human
cagagugaacagcaccgcgagacaggccaggc

SEQ ID NO: 350156 - RNA, 32 nt, Human
cagagugaacagcauaugcaaagguguggaaa

SEQ ID NO: 350157 - RNA, 32 nt, Human
cagagugaagaggaagccagaagaugggagag

SEQ ID NO: 350158 - RNA, 21 nt, Human
cagagugaaugaaggcaggua

SEQ ID NO: 350159 - RNA, 32 nt, Human
cagagugacaguggcccagcuggacugggaca

SEQ ID NO: 350160 - RNA, 32 nt, Human
cagagugaccuugacgucuguaugacaauuaa

SEQ ID NO: 350161 - RNA, 31 nt, Human
cagagugacucagaagaaaaagaagcugagg

SEQ ID NO: 350162 - RNA, 20 nt, Human
cagagugagaccauguuuca

SEQ ID NO: 350163 - RNA, 20 nt, Human
cagagugagacccugucuca

SEQ ID NO: 350164 - RNA, 20 nt, Human
cagagugagaccucgucuca

SEQ ID NO: 350165 - RNA, 19 nt, Human
cagagugagaccugucuca

SEQ ID NO: 350166 - RNA, 20 nt, Human
cagagugagaccuugucuca

SEQ ID NO: 350167 - RNA, 31 nt, Human
cagagugagacgcugccucacugcuccccca

SEQ ID NO: 350168 - RNA, 20 nt, Human
cagagugagacuuugucuca

SEQ ID NO: 350169 - RNA, 24 nt, Human
cagagugagcagguaagagaggga

SEQ ID NO: 350170 - RNA, 32 nt, Human
cagagugagccaaugcucaccagccccagagu

SEQ ID NO: 350171 - RNA, 22 nt, Human
cagagugagucaggcaccucca

SEQ ID NO: 350172 - RNA, 32 nt, Human
cagagugagugagugaguaugugugcacacac

SEQ ID NO: 350173 - RNA, 22 nt, Human
cagagugcaccugacacugcca

SEQ ID NO: 350174 - RNA, 17 nt, Human
cagagugcagcugcauu

SEQ ID NO: 350175 - RNA, 20 nt, Human
cagagugcaggaagaagggg

SEQ ID NO: 350176 - RNA, 32 nt, Human
cagagugcagggaagcagaugggcuaaauuuu

SEQ ID NO: 350177 - RNA, 32 nt, Human
cagagugcaggucucaggggcagaagacaugg

SEQ ID NO: 350178 - RNA, 32 nt, Human
cagagugcagguggagagaacagaaggugggc

SEQ ID NO: 350179 - RNA, 32 nt, Human
cagagugcaguggcaugauuguagcucacugc

SEQ ID NO: 350180 - RNA, 32 nt, Human
cagagugcaguggugugaucauagcucacugc

SEQ ID NO: 350181 - RNA, 32 nt, Human
cagagugccaggaacacuguggacgucuuugu

SEQ ID NO: 350182 - RNA, 32 nt, Human
cagagugcccacuccccucuacuugcugcucu

SEQ ID NO: 350183 - RNA, 24 nt, Human
cagagugcccccuccccugcaagg

SEQ ID NO: 350184 - RNA, 32 nt, Human
cagagugcccguggcucccaccccagggucug

SEQ ID NO: 350185 - RNA, 32 nt, Human
cagagugccugguggagacagagcggaacgcc

SEQ ID NO: 350186 - RNA, 32 nt, Human
cagagugccuuaaaaaugacuuuaauuaggaa

SEQ ID NO: 350187 - RNA, 21 nt, Human
cagagugcuaggauuacaggc

SEQ ID NO: 350188 - RNA, 23 nt, Human
cagagugcuaggauuacaggcau

SEQ ID NO: 350189 - RNA, 32 nt, Human
cagagugcucagaaagucaagauaggauaugc

SEQ ID NO: 350190 - RNA, 32 nt, Human
cagagugcucccuucaagccucccaggccaug

SEQ ID NO: 350191 - RNA, 23 nt, Human
cagagugcugagauuacaggcgu

SEQ ID NO: 350192 - RNA, 32 nt, Human
cagagugcugcagcuguuucugucucgaacgg

SEQ ID NO: 350193 - RNA, 23 nt, Human
cagagugcuggaauuacaagcau

SEQ ID NO: 350194 - RNA, 23 nt, Human
cagagugcuggaauuacuggcau

SEQ ID NO: 350195 - RNA, 23 nt, Human
cagagugcugggauuacaggcau

SEQ ID NO: 350196 - RNA, 23 nt, Human
cagagugcugggauuacaggcgu

SEQ ID NO: 350197 - RNA, 32 nt, Human
cagagugcugggauuacagggggagccacugu

SEQ ID NO: 350198 - RNA, 24 nt, Human
cagagugcugggauuuacaggcau

SEQ ID NO: 350199 - RNA, 32 nt, Human
cagagugcuggguugggauuacaggcgugagc

SEQ ID NO: 350200 - RNA, 32 nt, Human
cagaguggaaaaagauuccaauucugcagaga

SEQ ID NO: 350201 - RNA, 32 nt, Human
cagaguggaaggagggggaagcagcaggacac

SEQ ID NO: 350202 - RNA, 32 nt, Human
cagaguggaaggguugggggaggcgauaaaga

SEQ ID NO: 350203 - RNA, 32 nt, Human
cagaguggacccuggcccuggcccaggcugug

SEQ ID NO: 350204 - RNA, 32 nt, Human
cagaguggagccagggggacaguggagccgag

SEQ ID NO: 350205 - RNA, 32 nt, Human
cagaguggagccauggcuagaggcaggaagau

SEQ ID NO: 350206 - RNA, 32 nt, Human
cagaguggagccuccugcucuccuggaccagc

SEQ ID NO: 350207 - RNA, 15 nt, Human
cagaguggagucaag

SEQ ID NO: 350208 - RNA, 32 nt, Human
cagaguggaugaccacacuagcacagaagaga

SEQ ID NO: 350209 - RNA, 32 nt, Human
cagaguggaugcuucugccuagugacagguua

SEQ ID NO: 350210 - RNA, 32 nt, Human
cagaguggcaguacaccugugccuuguuccuc

SEQ ID NO: 350211 - RNA, 32 nt, Human
cagaguggcgaggcugagcacugucacagggg

SEQ ID NO: 350212 - RNA, 32 nt, Human
cagaguggcuagaaugaugucaccagcaccag

SEQ ID NO: 350213 - RNA, 32 nt, Human
cagaguggcuccugccacaugccagaaugucc

SEQ ID NO: 350214 - RNA, 32 nt, Human
cagaguggcugaugcugcaaguuaugucuaag

SEQ ID NO: 350215 - RNA, 32 nt, Human
cagaguggcugcaggccaggccuggagucccc

SEQ ID NO: 350216 - RNA, 32 nt, Human
cagaguggcuuacaccuauaaucccagcaauu

SEQ ID NO: 350217 - RNA, 32 nt, Human
cagaguggcuuccaucucagcacucugugggu

SEQ ID NO: 350218 - RNA, 32 nt, Human
cagagugggaagaccucagccuuggguggcuu

SEQ ID NO: 350219 - RNA, 32 nt, Human
cagagugggaagagaguaccggcaucggguuu

SEQ ID NO: 350220 - RNA, 32 nt, Human
cagagugggaggcagagaagugugcucagagg

SEQ ID NO: 350221 - RNA, 32 nt, Human
cagagugggaggucagggcaguauuuaaaaau

SEQ ID NO: 350222 - RNA, 23 nt, Human
cagagugggcucccugccccucu

SEQ ID NO: 350223 - RNA, 32 nt, Human
cagagugggcugggaccagacuuuguucucuu

SEQ ID NO: 350224 - RNA, 32 nt, Human
cagaguggggcugagugggcgcugagccaggc

SEQ ID NO: 350225 - RNA, 20 nt, Human
cagaguggggggccuuccuc

SEQ ID NO: 350226 - RNA, 23 nt, Human
cagaguggucagugcugaccccu

SEQ ID NO: 350227 - RNA, 19 nt, Human
cagaguggucccugcccuc

SEQ ID NO: 350228 - RNA, 32 nt, Human
cagaguguauuuuuguaauuccucuagcuacc

SEQ ID NO: 350229 - RNA, 32 nt, Human
cagagugucagaaagaaagaaugagaacuaac

SEQ ID NO: 350230 - RNA, 24 nt, Human
cagaguguccuuccucuguccucu

SEQ ID NO: 350231 - RNA, 32 nt, Human
cagagugucuggauggaaccugagcugggucu

SEQ ID NO: 350232 - RNA, 32 nt, Human
cagagugugaugggccugccuccugggcuggu

SEQ ID NO: 350233 - RNA, 32 nt, Human
cagagugugauggggaggagggacaggaagac

SEQ ID NO: 350234 - RNA, 32 nt, Human
cagaguguggaggucaggauggcugcgggcaa

SEQ ID NO: 350235 - RNA, 32 nt, Human
cagagugugucaugccugcaaucccagcacuu

SEQ ID NO: 350236 - RNA, 32 nt, Human
cagaguguucucucgacacugccagccccgug

SEQ ID NO: 350237 - RNA, 23 nt, Human
cagaguuaagggaaagaggagga

SEQ ID NO: 350238 - RNA, 32 nt, Human
cagaguuacagguaggucccaaaaguggccag

SEQ ID NO: 350239 - RNA, 32 nt, Human
cagaguuaguaagccucggcuugucaccugcu

SEQ ID NO: 350240 - RNA, 32 nt, Human
cagaguucaagaccagccugggcaauguagua

SEQ ID NO: 350241 - RNA, 21 nt, Human
cagaguucaagagugguggca

SEQ ID NO: 350242 - RNA, 32 nt, Human
cagaguucaagaguucaagaccagccugggca

SEQ ID NO: 350243 - RNA, 24 nt, Human
cagaguucaagcaauucuccugcc

SEQ ID NO: 350244 - RNA, 25 nt, Human
cagaguucaagcaauucuccuuccu

SEQ ID NO: 350245 - RNA, 32 nt, Human
cagaguucaagcaauucuccuuccucagccuc

SEQ ID NO: 350246 - RNA, 32 nt, Human
cagaguucaagcacauuccuaccugcagggca

SEQ ID NO: 350247 - RNA, 32 nt, Human
cagaguucacuauucuaucugccauuagaccu

SEQ ID NO: 350248 - RNA, 18 nt, Human
cagaguucacuccaggaa

SEQ ID NO: 350249 - RNA, 18 nt, Human
cagaguucacuccuuccu

SEQ ID NO: 350250 - RNA, 32 nt, Human
cagaguucaugcucccuucgacaucauuaaua

SEQ ID NO: 350251 - RNA, 32 nt, Human
cagaguuccagaccagccuggccaacauagug

SEQ ID NO: 350252 - RNA, 32 nt, Human
cagaguuccaggcaaucaaaaugagugcaggu

SEQ ID NO: 350253 - RNA, 32 nt, Human
cagaguuccagggucagagagcauggaguacu

SEQ ID NO: 350254 - RNA, 32 nt, Human
cagaguuccucuucuugcuucuugaaucacau

SEQ ID NO: 350255 - RNA, 32 nt, Human
cagaguuccuguacaagguuccuggccugugg

SEQ ID NO: 350256 - RNA, 32 nt, Human
cagaguucugguuccagcuccgaccacucauu

SEQ ID NO: 350257 - RNA, 32 nt, Human
cagaguucuuccuuccccaucugggccuucau

SEQ ID NO: 350258 - RNA, 32 nt, Human
cagaguugagauauaggguucauccauguugc

SEQ ID NO: 350259 - RNA, 32 nt, Human
cagaguugagaucaucauugcaaaguucucug

SEQ ID NO: 350260 - RNA, 32 nt, Human
cagaguugcaggucaccuccccuaccugcuuc

SEQ ID NO: 350261 - RNA, 32 nt, Human
cagaguugccucuccuccuccucuuccccaac

SEQ ID NO: 350262 - RNA, 32 nt, Human
cagaguugcugucaguucauugguagagaugc

SEQ ID NO: 350263 - RNA, 32 nt, Human
cagaguuggaaacccucaccaacuggccucuu

SEQ ID NO: 350264 - RNA, 32 nt, Human
cagaguuggaaagaucaagaaagagagaaugc

SEQ ID NO: 350265 - RNA, 32 nt, Human
cagaguugggaaaaacaacagguuugaguccu

SEQ ID NO: 350266 - RNA, 32 nt, Human
cagaguugggaggaucaccugaugucaggggu

SEQ ID NO: 350267 - RNA, 32 nt, Human
cagaguugguuuccuuccuuccuuccuuccuu

SEQ ID NO: 350268 - RNA, 32 nt, Human
cagaguugucaguaaagaaagagaaaauugca

SEQ ID NO: 350269 - RNA, 32 nt, Human
cagaguuuaaguuucaggagaaaacaggaaca

SEQ ID NO: 350270 - RNA, 32 nt, Human
cagaguuuaccugagaugugcaucuggggucc

SEQ ID NO: 350271 - RNA, 32 nt, Human
cagaguuucaccugcccacacaggguccguug

SEQ ID NO: 350272 - RNA, 18 nt, Human
cagaguuucacucuguca

SEQ ID NO: 350273 - RNA, 32 nt, Human
cagaguuuccaaguugggacccagaagguggg

SEQ ID NO: 350274 - RNA, 32 nt, Human
cagaguuuccauuucaggaggucugggaucag

SEQ ID NO: 350275 - RNA, 32 nt, Human
cagaguuucgaccuggaggaguacagccucuc

SEQ ID NO: 350276 - RNA, 32 nt, Human
cagaguuugaaaccagccuagguaacauagug

SEQ ID NO: 350277 - RNA, 32 nt, Human
cagaguuugcgcuggccagaggguuccagaaa

SEQ ID NO: 350278 - RNA, 32 nt, Human
cagaguuugugucuuucuuucuguccauaacu

SEQ ID NO: 350279 - RNA, 32 nt, Human
cagaguuuuagccaaagguguacuuacuuccu

SEQ ID NO: 350280 - RNA, 32 nt, Human
cagaguuuugcucuugccguccaggcuggagu

SEQ ID NO: 350281 - RNA, 32 nt, Human
cagaguuuugcucuuguuguccaggcuggagu

SEQ ID NO: 350282 - RNA, 32 nt, Human
cagauaaaacucagaggaaauuugcacagaug

SEQ ID NO: 350283 - RNA, 32 nt, Human
cagauaaagcacacuguggggccaggcaugac

SEQ ID NO: 350284 - RNA, 32 nt, Human
cagauaaaggaaaaaguuuucuucucacaaaa

SEQ ID NO: 350285 - RNA, 32 nt, Human
cagauaaauagaaguacagugaggucuauagc

SEQ ID NO: 350286 - RNA, 32 nt, Human
cagauaaauccuuaacauuucucuccaccuua

SEQ ID NO: 350287 - RNA, 32 nt, Human
cagauaacacaugcuguuucuacuuguaaaug

SEQ ID NO: 350288 - RNA, 32 nt, Human
cagauaacacuguaauccaccuccagguuucc

SEQ ID NO: 350289 - RNA, 32 nt, Human
cagauaacauguccacggauucuugacagaga

SEQ ID NO: 350290 - RNA, 32 nt, Human
cagauaaccaugucagccacaguuguagaugc

SEQ ID NO: 350291 - RNA, 32 nt, Human
cagauaacgggccggcccugccuccacguggc

SEQ ID NO: 350292 - RNA, 32 nt, Human
cagauaacuccuuuguggccugggcaggaugc

SEQ ID NO: 350293 - RNA, 32 nt, Human
cagauaacugaggaggggagaggugggccgua

SEQ ID NO: 350294 - RNA, 32 nt, Human
cagauaacuucugcuuccugucaacucauccc

SEQ ID NO: 350295 - RNA, 32 nt, Human
cagauaagaaaaucacagauuucacaaaaccu

SEQ ID NO: 350296 - RNA, 32 nt, Human
cagauaagaaaauuaaaguuacuuuucucaaa

SEQ ID NO: 350297 - RNA, 32 nt, Human
cagauaagaggaagugggaagagagguggucu

SEQ ID NO: 350298 - RNA, 32 nt, Human
cagauaagagguggaggaggugacagggagcu

SEQ ID NO: 350299 - RNA, 32 nt, Human
cagauaagaguguugcuguugaucaucuuugc

SEQ ID NO: 350300 - RNA, 22 nt, Human
cagauaagcaaaaaaguccuug

SEQ ID NO: 350301 - RNA, 32 nt, Human
cagauaagcagcccaggaagaaaugaaacucc

SEQ ID NO: 350302 - RNA, 32 nt, Human
cagauaagcccaaagacagcaacuucuccacu

SEQ ID NO: 350303 - RNA, 32 nt, Human
cagauaauaaccauacacugaccucauacuug

SEQ ID NO: 350304 - RNA, 32 nt, Human
cagauaaucggccagagacuguuucucuacuc

SEQ ID NO: 350305 - RNA, 32 nt, Human
cagauaaugcugccuugacacacacaugcacg

SEQ ID NO: 350306 - RNA, 32 nt, Human
cagauaaugguaguguagucagugacuaaaau

SEQ ID NO: 350307 - RNA, 32 nt, Human
cagauaauucuuuagaugaauguuucuuagga

SEQ ID NO: 350308 - RNA, 32 nt, Human
cagauaauuugucagcagcuccaagaguggga

SEQ ID NO: 350309 - RNA, 32 nt, Human
cagauacaacucagcauuaaaaagcuaucuuu

SEQ ID NO: 350310 - RNA, 32 nt, Human
cagauacagaaaccauccuauuucaggauuug

SEQ ID NO: 350311 - RNA, 18 nt, Human
cagauacagcaaguugug

SEQ ID NO: 350312 - RNA, 32 nt, Human
cagauacaguauauucucaucaacuggaaggu

SEQ ID NO: 350313 - RNA, 32 nt, Human
cagauacagugcucugcaggccugcuguggga

SEQ ID NO: 350314 - RNA, 32 nt, Human
cagauacaucacacacagacuucucaccuguu

SEQ ID NO: 350315 - RNA, 32 nt, Human
cagauacaucgaaaaguugaccaaugaaauga

SEQ ID NO: 350316 - RNA, 32 nt, Human
cagauacaugauaacacaucugaacaggguua

SEQ ID NO: 350317 - RNA, 24 nt, Human
cagauacccggguaacaguccuca

SEQ ID NO: 350318 - RNA, 32 nt, Human
cagauaccuuaaaucaucucugucaaguucaa

SEQ ID NO: 350319 - RNA, 32 nt, Human
cagauacuagccuauccucuggcugcucccag

SEQ ID NO: 350320 - RNA, 32 nt, Human
cagauacucuuuccuuuccucucuccuguuuu

SEQ ID NO: 350321 - RNA, 32 nt, Human
cagauacugagucucaauggacuucuuguuua

SEQ ID NO: 350322 - RNA, 32 nt, Human
cagauacugguccugcauucugacugagauug

SEQ ID NO: 350323 - RNA, 32 nt, Human
cagauacugugccuggcgggucuucagcgaua

SEQ ID NO: 350324 - RNA, 32 nt, Human
cagauacuguucuggacugugccuguuaaguu

SEQ ID NO: 350325 - RNA, 32 nt, Human
cagauacuuauccauuaugugucuauaguuca

SEQ ID NO: 350326 - RNA, 32 nt, Human
cagauacuucuuucuuucucucuggaagacuu

SEQ ID NO: 350327 - RNA, 32 nt, Human
cagauacuugggaggcugaggguggagaaucg

SEQ ID NO: 350328 - RNA, 32 nt, Human
cagauacuugggaggcugaggugggaggguug

SEQ ID NO: 350329 - RNA, 32 nt, Human
cagauagaacuggucagacaaggccaaugggu

SEQ ID NO: 350330 - RNA, 32 nt, Human
cagauagaagucuuucuaugcaaagauuaaag

SEQ ID NO: 350331 - RNA, 32 nt, Human
cagauagagcuggaguuggccacggccaagaa

SEQ ID NO: 350332 - RNA, 32 nt, Human
cagauagagguguggagguagagccagccccu

SEQ ID NO: 350333 - RNA, 32 nt, Human
cagauagauaccuuauuuugcauauguuugaa

SEQ ID NO: 350334 - RNA, 32 nt, Human
cagauagcacugggugugagaaugaucaagga

SEQ ID NO: 350335 - RNA, 32 nt, Human
cagauagccccacugcacuccagccuggguga

SEQ ID NO: 350336 - RNA, 32 nt, Human
cagauagcccgaggccagaggacagcggaauc

SEQ ID NO: 350337 - RNA, 32 nt, Human
cagauagccucgggugcugccuguagucaugc

SEQ ID NO: 350338 - RNA, 32 nt, Human
cagauagcucacugccagagcagccuggguuc

SEQ ID NO: 350339 - RNA, 22 nt, Human
cagauagcugggacuacaggca

SEQ ID NO: 350340 - RNA, 32 nt, Human
cagauaggccgcccaugcucucagccuuucuc

SEQ ID NO: 350341 - RNA, 21 nt, Human
cagauagggaaauagcacaga

SEQ ID NO: 350342 - RNA, 32 nt, Human
cagauagggaccggugaacaccugauuccaaa

SEQ ID NO: 350343 - RNA, 32 nt, Human
cagauagggccuuccuacagagcagcaagagu

SEQ ID NO: 350344 - RNA, 32 nt, Human
cagauaggggcugaggcucagagagggcaagu

SEQ ID NO: 350345 - RNA, 32 nt, Human
cagauaggucucaaacuccugacuucagguga

SEQ ID NO: 350346 - RNA, 32 nt, Human
cagauaggucugccucugccuuccagcuccca

SEQ ID NO: 350347 - RNA, 31 nt, Human
cagauaggugagagacaaacaguugcacucu

SEQ ID NO: 350348 - RNA, 31 nt, Human
cagauagucacagucaagguuggagagucuc

SEQ ID NO: 350349 - RNA, 32 nt, Human
cagauagucaucucaguccaaggaucccaaaa

SEQ ID NO: 350350 - RNA, 32 nt, Human
cagauagugccacugcacuccagccuggguga

SEQ ID NO: 350351 - RNA, 32 nt, Human
cagauauacacauucccaugcacugacauaag

SEQ ID NO: 350352 - RNA, 32 nt, Human
cagauauagaagcauggaaaccugauagggcu

SEQ ID NO: 350353 - RNA, 32 nt, Human
cagauauaggacuucugagcugagaggaccuc

SEQ ID NO: 350354 - RNA, 32 nt, Human
cagauaucagccacuuucacauuucauuucau

SEQ ID NO: 350355 - RNA, 32 nt, Human
cagauaucccuaucccaaccucuccuauggga

SEQ ID NO: 350356 - RNA, 32 nt, Human
cagauaugaaguauucuuggaaugcaauaagu

SEQ ID NO: 350357 - RNA, 32 nt, Human
cagauaugaauggcuaauacuccauuguucug

SEQ ID NO: 350358 - RNA, 32 nt, Human
cagauaugaugcggccaaucucugucuccaaa

SEQ ID NO: 350359 - RNA, 32 nt, Human
cagauauggucuggaguggaccuccagcaaac

SEQ ID NO: 350360 - RNA, 32 nt, Human
cagauauguuuuaaagacaaagauccauguag

SEQ ID NO: 350361 - RNA, 32 nt, Human
cagauauuauucagucuuauuuccuaagauuu

SEQ ID NO: 350362 - RNA, 32 nt, Human
cagauauucaucguaagucucccuucaccugu

SEQ ID NO: 350363 - RNA, 32 nt, Human
cagauauuccaccuguaauagcacuuuggaac

SEQ ID NO: 350364 - RNA, 32 nt, Human
cagauauuccagggucauuuguucucucccug

SEQ ID NO: 350365 - RNA, 32 nt, Human
cagauauuccccagguuggcaaugguuuccuu

SEQ ID NO: 350366 - RNA, 32 nt, Human
cagauauugucuuacucacauuuccuuugcuu

SEQ ID NO: 350367 - RNA, 32 nt, Human
cagauauuuacuugguaaagugcaguggggaa

SEQ ID NO: 350368 - RNA, 32 nt, Human
cagauauuuucuuaguagugcagaccuuuacc

SEQ ID NO: 350369 - RNA, 32 nt, Human
cagaucaaggagaacccaggaguuucaaagaa

SEQ ID NO: 350370 - RNA, 32 nt, Human
cagaucacacacaugcacacacacauaugcac

SEQ ID NO: 350371 - RNA, 32 nt, Human
cagaucacaccauugcacuccagccuaggcaa

SEQ ID NO: 350372 - RNA, 17 nt, Human
cagaucacagacauggu

SEQ ID NO: 350373 - RNA, 32 nt, Human
cagaucacaggcaaaaagcaaaacuuugaagu

SEQ ID NO: 350374 - RNA, 32 nt, Human
cagaucacaucuaacuuugucauuccaaguga

SEQ ID NO: 350375 - RNA, 32 nt, Human
cagaucaccaacaaaaaugaaggcggcagaug

SEQ ID NO: 350376 - RNA, 19 nt, Human
cagaucaccugaggucagg

SEQ ID NO: 350377 - RNA, 32 nt, Human
cagaucacgccacugcacucuagccugggcaa

SEQ ID NO: 350378 - RNA, 32 nt, Human
cagaucacgccagugcacuccagccugagaga

SEQ ID NO: 350379 - RNA, 32 nt, Human
cagaucacgggguuaggaguucaggaccagcc

SEQ ID NO: 350380 - RNA, 32 nt, Human
cagaucacgugggguccagagagcagacaucu

SEQ ID NO: 350381 - RNA, 32 nt, Human
cagaucacugcaaccuccaccucccagguuca

SEQ ID NO: 350382 - RNA, 32 nt, Human
cagaucacugcaaccuccgccuccuggguuca

SEQ ID NO: 350383 - RNA, 32 nt, Human
cagaucacugcaaccucugccucccggguuca

SEQ ID NO: 350384 - RNA, 32 nt, Human
cagaucacugcaaccucugccuccuggguuca

SEQ ID NO: 350385 - RNA, 32 nt, Human
cagaucacuugagaucaggaccagccugguca

SEQ ID NO: 350386 - RNA, 32 nt, Human
cagaucacuugaguucaagaccagccuggcca

SEQ ID NO: 350387 - RNA, 32 nt, Human
cagaucagccacuugcugacccugguucuuaa

SEQ ID NO: 350388 - RNA, 32 nt, Human
cagaucagcgugggguggaggagaaguggagu

SEQ ID NO: 350389 - RNA, 32 nt, Human
cagaucaggcaaccaaccacacaaaguuucua

SEQ ID NO: 350390 - RNA, 17 nt, Human
cagaucaggccggggca

SEQ ID NO: 350391 - RNA, 32 nt, Human
cagaucaggccuucuuugguucuugggugguu

SEQ ID NO: 350392 - RNA, 19 nt, Human
cagaucaggguacuugcug

SEQ ID NO: 350393 - RNA, 32 nt, Human
cagaucagugcagaacucauggaggaggcuuu

SEQ ID NO: 350394 - RNA, 32 nt, Human
cagaucaguguaccauuugccucccgggcuca

SEQ ID NO: 350395 - RNA, 32 nt, Human
cagaucaucauguuaugcaaagaccagugaga

SEQ ID NO: 350396 - RNA, 32 nt, Human
cagaucaugccacugcacuccagccugggcaa

SEQ ID NO: 350397 - RNA, 32 nt, Human
cagauccaaauacaaggaagucuggaaaacau

SEQ ID NO: 350398 - RNA, 32 nt, Human
cagauccaacaagauauuggauagcaggcaaa

SEQ ID NO: 350399 - RNA, 32 nt, Human
cagauccaagggaaccucagaaauccauugaa

SEQ ID NO: 350400 - RNA, 22 nt, Human
cagauccaccgacccguagcau

SEQ ID NO: 350401 - RNA, 32 nt, Human
cagauccaguuagcaaaagccuaggacuuguu

SEQ ID NO: 350402 - RNA, 32 nt, Human
cagaucccaauuggccagaauauggcacgugc

SEQ ID NO: 350403 - RNA, 32 nt, Human
cagaucccagcagccuguuggggcaggggugc

SEQ ID NO: 350404 - RNA, 32 nt, Human
cagauccccacuguccuaccaguugcccuagc

SEQ ID NO: 350405 - RNA, 32 nt, Human
cagaucccccuucccuucuuccccugccggcc

SEQ ID NO: 350406 - RNA, 32 nt, Human
cagaucccccuucucuccugcuuccuccaggg

SEQ ID NO: 350407 - RNA, 32 nt, Human
cagauccccuccuguaaguggccaggcauucu

SEQ ID NO: 350408 - RNA, 32 nt, Human
cagauccccugaacuaccaaauagcugugggc

SEQ ID NO: 350409 - RNA, 20 nt, Human
cagaucccucccagccccau

SEQ ID NO: 350410 - RNA, 19 nt, Human
cagaucccugauccuucca

SEQ ID NO: 350411 - RNA, 32 nt, Human
cagauccgcaggcuggagagcgaagcacgagg

SEQ ID NO: 350412 - RNA, 32 nt, Human
cagauccuaauuggaaauuuagcaauaaggag

SEQ ID NO: 350413 - RNA, 32 nt, Human
cagauccucaguccucccuugacuucacgacu

SEQ ID NO: 350414 - RNA, 32 nt, Human
cagauccucagugcagcucugccagcaucaag

SEQ ID NO: 350415 - RNA, 32 nt, Human
cagauccugcacaagauagcuggacuucucua

SEQ ID NO: 350416 - RNA, 23 nt, Human
cagauccugcguaauggcagcau

SEQ ID NO: 350417 - RNA, 32 nt, Human
cagauccuggagggcuuugggcuuccagguag

SEQ ID NO: 350418 - RNA, 32 nt, Human
cagauccuggggaccugcaggagcuggaucag

SEQ ID NO: 350419 - RNA, 32 nt, Human
cagauccugggugacaauggcaaagagauucg

SEQ ID NO: 350420 - RNA, 32 nt, Human
cagauccuucuaaaacaacagucacauugaug

SEQ ID NO: 350421 - RNA, 32 nt, Human
cagauccuugauaaaugccucaugaagaccaa

SEQ ID NO: 350422 - RNA, 32 nt, Human
cagaucgaaccauuguacuccagccuggguga

SEQ ID NO: 350423 - RNA, 32 nt, Human
cagaucgagauggagaaggucuagcaccuuug

SEQ ID NO: 350424 - RNA, 32 nt, Human
cagaucgagccacugcauuccagccugggcga

SEQ ID NO: 350425 - RNA, 32 nt, Human
cagaucgaggcaccuccaccaacagcccacgc

SEQ ID NO: 350426 - RNA, 32 nt, Human
cagaucgcacaagggggcugccccagagggug

SEQ ID NO: 350427 - RNA, 32 nt, Human
cagaucgcaccacugcacuccagucuggcaac

SEQ ID NO: 350428 - RNA, 32 nt, Human
cagaucgcgacacugcacuccagccugggcaa

SEQ ID NO: 350429 - RNA, 32 nt, Human
cagaucgcgccauugcacuccagccuggguaa

SEQ ID NO: 350430 - RNA, 32 nt, Human
cagaucgcgccgcugcacuccagccugggcgg

SEQ ID NO: 350431 - RNA, 32 nt, Human
cagaucggggaugugcaacaaauuccauuuca

SEQ ID NO: 350432 - RNA, 32 nt, Human
cagaucggugacuccuaaaaucugagacagga

SEQ ID NO: 350433 - RNA, 32 nt, Human
cagaucguccacaccacacccucuuucaggga

SEQ ID NO: 350434 - RNA, 32 nt, Human
cagaucgugccacugcacuccagccuggguga

SEQ ID NO: 350435 - RNA, 32 nt, Human
cagaucuaagcacacaugggcaucaaaccaga

SEQ ID NO: 350436 - RNA, 32 nt, Human
cagaucuacagcuccuggauaauugcuugauu

SEQ ID NO: 350437 - RNA, 32 nt, Human
cagaucuagaagcgggcaagucucagcugagg

SEQ ID NO: 350438 - RNA, 32 nt, Human
cagaucuagcccaucuuacuccagguuugaua

SEQ ID NO: 350439 - RNA, 32 nt, Human
cagaucuaggcaggccuaggauggugcugucu

SEQ ID NO: 350440 - RNA, 32 nt, Human
cagaucuauaaggucacaugcuuuuaaaauag

SEQ ID NO: 350441 - RNA, 32 nt, Human
cagaucucaccauugcacuccagccugggcga

SEQ ID NO: 350442 - RNA, 32 nt, Human
cagaucucacuggucauauagcucuucuaggu

SEQ ID NO: 350443 - RNA, 32 nt, Human
cagaucucagccagaugcugccgggagggagg

SEQ ID NO: 350444 - RNA, 32 nt, Human
cagaucucaguguggcucucucuggagacaaa

SEQ ID NO: 350445 - RNA, 32 nt, Human
cagaucuccacuccucuccaggagcuagccug

SEQ ID NO: 350446 - RNA, 32 nt, Human
cagaucuccagguucuggagguuggagguucc

SEQ ID NO: 350447 - RNA, 32 nt, Human
cagaucucccuuucccccucccccaucucuug

SEQ ID NO: 350448 - RNA, 19 nt, Human
cagaucuccgcacagggga

SEQ ID NO: 350449 - RNA, 32 nt, Human
cagaucuccuagcuacugguccugggccauuu

SEQ ID NO: 350450 - RNA, 32 nt, Human
cagaucuccuggcaaaggccccagcaucuccc

SEQ ID NO: 350451 - RNA, 32 nt, Human
cagaucuccuuucaaaguaguggcuuucugga

SEQ ID NO: 350452 - RNA, 32 nt, Human
cagaucucugcacuucucagucccagaucccu

SEQ ID NO: 350453 - RNA, 32 nt, Human
cagaucucuggcccaucaggcuuucuaaauuc

SEQ ID NO: 350454 - RNA, 32 nt, Human
cagaucucuugugcccaggaguuuuaagacua

SEQ ID NO: 350455 - RNA, 32 nt, Human
cagaucugagccaccgccugccagugugagag

SEQ ID NO: 350456 - RNA, 32 nt, Human
cagaucugcacuccugucucuugggaagcagu

SEQ ID NO: 350457 - RNA, 32 nt, Human
cagaucugccaagaaccuucgaauucaugaaa

SEQ ID NO: 350458 - RNA, 32 nt, Human
cagaucugccacccucuagcugggugacuuuu

SEQ ID NO: 350459 - RNA, 32 nt, Human
cagaucugcccguggaucacugaagauuccug

SEQ ID NO: 350460 - RNA, 32 nt, Human
cagaucugcccuucugagaugcugaccaucca

SEQ ID NO: 350461 - RNA, 32 nt, Human
cagaucugccuaaggacuucuuuaauuuugga

SEQ ID NO: 350462 - RNA, 32 nt, Human
cagaucugcucacugccaggcuccucuccccu

SEQ ID NO: 350463 - RNA, 22 nt, Human
cagaucugcuccccagcaucuu

SEQ ID NO: 350464 - RNA, 22 nt, Human
cagaucugcucuccagcaucuu

SEQ ID NO: 350465 - RNA, 17 nt, Human
cagaucuggacuaucca

SEQ ID NO: 350466 - RNA, 32 nt, Human
cagaucuguguguguacugucggcgcaugaag

SEQ ID NO: 350467 - RNA, 28 nt, Human
cagaucuuaaaugcugccuaucauguug

SEQ ID NO: 350468 - RNA, 16 nt, Human
cagaucuuccucuaca

SEQ ID NO: 350469 - RNA, 32 nt, Human
cagaucuuccuuguggccuuccucgcccacuc

SEQ ID NO: 350470 - RNA, 32 nt, Human
cagaucuugacagaaacauggccuguuuauuc

SEQ ID NO: 350471 - RNA, 32 nt, Human
cagaucuuuguccuaaccacaagguuccccuu

SEQ ID NO: 350472 - RNA, 32 nt, Human
cagaucuuuuggggagggugugcuuggcaggg

SEQ ID NO: 350473 - RNA, 32 nt, Human
cagaugaaacucaaggaaauucuucagagcaa

SEQ ID NO: 350474 - RNA, 22 nt, Human
cagaugaagaaaaugaggugca

SEQ ID NO: 350475 - RNA, 32 nt, Human
cagaugaagacugaaagccaaagaugugaagu

SEQ ID NO: 350476 - RNA, 28 nt, Human
cagaugaaggaagaaugggugaaauguu

SEQ ID NO: 350477 - RNA, 32 nt, Human
cagaugaaggaguuuucaggagcuuuugacac

SEQ ID NO: 350478 - RNA, 32 nt, Human
cagaugaauaguaucacaucauuaucaauuuc

SEQ ID NO: 350479 - RNA, 32 nt, Human
cagaugaaugcagccagcuauaugaagcacuu

SEQ ID NO: 350480 - RNA, 32 nt, Human
cagaugacacagacaagaguuccuggagaaug

SEQ ID NO: 350481 - RNA, 32 nt, Human
cagaugacacagauggagucuugcucugucac

SEQ ID NO: 350482 - RNA, 20 nt, Human
cagaugacagauggggugca

SEQ ID NO: 350483 - RNA, 18 nt, Human
cagaugacaucugucucc

SEQ ID NO: 350484 - RNA, 32 nt, Human
cagaugaccucaccauccacacucagacauau

SEQ ID NO: 350485 - RNA, 32 nt, Human
cagaugaccugagaccgguguuccggaaacug

SEQ ID NO: 350486 - RNA, 32 nt, Human
cagaugacgcaugaagcaaggacucuggcuac

SEQ ID NO: 350487 - RNA, 32 nt, Human
cagaugacuaggcccacugcagguccugccag

SEQ ID NO: 350488 - RNA, 32 nt, Human
cagaugacucagugaagaaacugaggcuucuc

SEQ ID NO: 350489 - RNA, 32 nt, Human
cagaugacuucucaucucuccccacaccauga

SEQ ID NO: 350490 - RNA, 32 nt, Human
cagaugagaaaagacuuggguuggagugaaau

SEQ ID NO: 350491 - RNA, 28 nt, Human
cagaugagagccaaguucagagccggag

SEQ ID NO: 350492 - RNA, 32 nt, Human
cagaugagcagauaccccuggccacccauguc

SEQ ID NO: 350493 - RNA, 24 nt, Human
cagaugagccccaucugagcacau

SEQ ID NO: 350494 - RNA, 32 nt, Human
cagaugagccuacugccucacaacagccucca

SEQ ID NO: 350495 - RNA, 32 nt, Human
cagaugagcugcagaugcuuaccuaccacggc

SEQ ID NO: 350496 - RNA, 32 nt, Human
cagaugagcuuggaagcagauccgucagcccc

SEQ ID NO: 350497 - RNA, 31 nt, Human
cagaugaggaaacugaggcucagaucuuggg

SEQ ID NO: 350498 - RNA, 22 nt, Human
cagaugaggaaacugcgccuca

SEQ ID NO: 350499 - RNA, 32 nt, Human
cagaugaggaagcugaggcccagcaaguuaag

SEQ ID NO: 350500 - RNA, 32 nt, Human
cagaugaggagagagaagaaacggaagaggaa

SEQ ID NO: 350501 - RNA, 32 nt, Human
cagaugaggagggagagaaggaggccgccaga

SEQ ID NO: 350502 - RNA, 32 nt, Human
cagaugaggcgagaggaggaggaggaggagga

SEQ ID NO: 350503 - RNA, 32 nt, Human
cagaugauauggaagaagauccuuaucacuga

SEQ ID NO: 350504 - RNA, 32 nt, Human
cagaugauauguccuugaagcuggcaggggau

SEQ ID NO: 350505 - RNA, 20 nt, Human
cagaugaucacaguccccca

SEQ ID NO: 350506 - RNA, 32 nt, Human
cagaugaucauggucugccucaacugucuggu

SEQ ID NO: 350507 - RNA, 19 nt, Human
cagaugauggggagcacuu

SEQ ID NO: 350508 - RNA, 28 nt, Human
cagaugauggucaguuguccaagcgggc

SEQ ID NO: 350509 - RNA, 32 nt, Human
cagaugauguacuggaaaaugcucagaagaug

SEQ ID NO: 350510 - RNA, 32 nt, Human
cagaugauucauuggauugggggugaguguuu

SEQ ID NO: 350511 - RNA, 32 nt, Human
cagaugcaaaacgaaauggaccuucacacagc

SEQ ID NO: 350512 - RNA, 32 nt, Human
cagaugcaaagucaugggcacaugucaagaaa

SEQ ID NO: 350513 - RNA, 32 nt, Human
cagaugcaagcuuuggcucuuucauaaaaagu

SEQ ID NO: 350514 - RNA, 32 nt, Human
cagaugcaaucacuuuuggacaugcuuuugca

SEQ ID NO: 350515 - RNA, 32 nt, Human
cagaugcacaacacuccuccagucuugugggg

SEQ ID NO: 350516 - RNA, 32 nt, Human
cagaugcacacagcccugcuuuuaugagaauu

SEQ ID NO: 350517 - RNA, 20 nt, Human
cagaugcacggcccaagggg

SEQ ID NO: 350518 - RNA, 32 nt, Human
cagaugcagaagcagaagagggaggggaaacc

SEQ ID NO: 350519 - RNA, 32 nt, Human
cagaugcagaagguuucucuggauagcacacc

SEQ ID NO: 350520 - RNA, 32 nt, Human
cagaugcagccugcagucucgccuaauggagc

SEQ ID NO: 350521 - RNA, 28 nt, Human
cagaugcaggaggcagauaucaguggcu

SEQ ID NO: 350522 - RNA, 32 nt, Human
cagaugcagguggugcccgcccggccucucac

SEQ ID NO: 350523 - RNA, 32 nt, Human
cagaugcauauagacacacauacauaauggua

SEQ ID NO: 350524 - RNA, 20 nt, Human
cagaugccaaaacaaaggaa

SEQ ID NO: 350525 - RNA, 32 nt, Human
cagaugccaaaccaaagacagauugcuuaacc

SEQ ID NO: 350526 - RNA, 32 nt, Human
cagaugccagcacugacucaggaacagcaagu

SEQ ID NO: 350527 - RNA, 32 nt, Human
cagaugcccccaaaucagagcucacagugagu

SEQ ID NO: 350528 - RNA, 32 nt, Human
cagaugcccccaaaucagagcucacagugggu

SEQ ID NO: 350529 - RNA, 32 nt, Human
cagaugccccgagaagagaugacuaggcaucu

SEQ ID NO: 350530 - RNA, 19 nt, Human
cagaugccccuucuaggaa

SEQ ID NO: 350531 - RNA, 32 nt, Human
cagaugccuccugcuuggauucugagugguca

SEQ ID NO: 350532 - RNA, 32 nt, Human
cagaugccugagccuuuguccaaagugagguc

SEQ ID NO: 350533 - RNA, 32 nt, Human
cagaugccuucucuaagacagcuccuguguac

SEQ ID NO: 350534 - RNA, 32 nt, Human
cagaugccuuucugccucugucgauuuuaggg

SEQ ID NO: 350535 - RNA, 32 nt, Human
cagaugcggcuguuuggcagaguccuguccug

SEQ ID NO: 350536 - RNA, 32 nt, Human
cagaugcgugccacuacguccgucugauguuu

SEQ ID NO: 350537 - RNA, 21 nt, Human
cagaugcuagagccucugccu

SEQ ID NO: 350538 - RNA, 32 nt, Human
cagaugcuagcacaugcccuaaugucuguauc

SEQ ID NO: 350539 - RNA, 32 nt, Human
cagaugcuagcgcugcacuccauuuugcaaug

SEQ ID NO: 350540 - RNA, 32 nt, Human
cagaugcuccuggaacacagagcugcggccuc

SEQ ID NO: 350541 - RNA, 21 nt, Human
cagaugcugaaugagucccuc

SEQ ID NO: 350542 - RNA, 32 nt, Human
cagaugcugauagucuguagagucaggaauac

SEQ ID NO: 350543 - RNA, 28 nt, Human
cagaugcugcauauugcuggcccagcuc

SEQ ID NO: 350544 - RNA, 32 nt, Human
cagaugcugcauauugcuggcccagcuccuga

SEQ ID NO: 350545 - RNA, 32 nt, Human
cagaugcugggacccagucucugcccagguca

SEQ ID NO: 350546 - RNA, 32 nt, Human
cagaugcuggugugguccgaagccacuuucuc

SEQ ID NO: 350547 - RNA, 32 nt, Human
cagaugcuuccagaguucuuaaugccucucug

SEQ ID NO: 350548 - RNA, 32 nt, Human
cagaugcuugcagcuuccugcauccaggagau

SEQ ID NO: 350549 - RNA, 32 nt, Human
cagauggaaauccuaaugacagucuccaaauu

SEQ ID NO: 350550 - RNA, 32 nt, Human
cagauggaaaugcagaaaucaccgucuucucc

SEQ ID NO: 350551 - RNA, 32 nt, Human
cagauggaagaaauagcaggagagaggaccca

SEQ ID NO: 350552 - RNA, 23 nt, Human
cagauggaagcuuacucucugcu

SEQ ID NO: 350553 - RNA, 32 nt, Human
cagauggaagggagaggguccagggcuuccua

SEQ ID NO: 350554 - RNA, 32 nt, Human
cagauggacacugccaagagccgacaaugccc

SEQ ID NO: 350555 - RNA, 32 nt, Human
cagauggagaaacaggcucugagauuucacag

SEQ ID NO: 350556 - RNA, 22 nt, Human
cagauggagaaccagccuguga

SEQ ID NO: 350557 - RNA, 20 nt, Human
cagauggagaagcugaggcu

SEQ ID NO: 350558 - RNA, 20 nt, Human
cagauggagaagcuggggcu

SEQ ID NO: 350559 - RNA, 28 nt, Human
cagauggagacccaggcugagcagcagg

SEQ ID NO: 350560 - RNA, 32 nt, Human
cagauggagcagggguugauucacacagaugg

SEQ ID NO: 350561 - RNA, 32 nt, Human
cagauggagcccauaggccacccccuauccuc

SEQ ID NO: 350562 - RNA, 32 nt, Human
cagauggagcuggaggaggaaaaggcaggcag

SEQ ID NO: 350563 - RNA, 32 nt, Human
cagauggaggcaguggcuggugggccacucuc

SEQ ID NO: 350564 - RNA, 32 nt, Human
cagauggagggccaggaggaggaagagucugc

SEQ ID NO: 350565 - RNA, 28 nt, Human
cagauggaggucggaggagacacugcug

SEQ ID NO: 350566 - RNA, 32 nt, Human
cagauggagguggaggguugauuugggaagca

SEQ ID NO: 350567 - RNA, 32 nt, Human
cagauggaguuuuguucuuguugcccaggcug

SEQ ID NO: 350568 - RNA, 21 nt, Human
cagauggaucacgaggucagg

SEQ ID NO: 350569 - RNA, 21 nt, Human
cagauggaucaugaggucagg

SEQ ID NO: 350570 - RNA, 22 nt, Human
cagauggauuaggaaacaccuc

SEQ ID NO: 350571 - RNA, 32 nt, Human
cagauggccccagugaucccuggccuccuggu

SEQ ID NO: 350572 - RNA, 19 nt, Human
cagauggccuauugagguc

SEQ ID NO: 350573 - RNA, 32 nt, Human
cagauggccuauuugaggaagagggugucugc

SEQ ID NO: 350574 - RNA, 32 nt, Human
cagauggccugaagcaagugaagaaucacaaa

SEQ ID NO: 350575 - RNA, 32 nt, Human
cagauggccugaagcaaguggagaaucacaaa

SEQ ID NO: 350576 - RNA, 32 nt, Human
cagauggccugaugggcuagugcuuggggcau

SEQ ID NO: 350577 - RNA, 22 nt, Human
cagauggccugggcgagccagg

SEQ ID NO: 350578 - RNA, 32 nt, Human
cagauggcgccacugcacuccagccugaguga

SEQ ID NO: 350579 - RNA, 32 nt, Human
cagauggcgcugcugcacucaagcuuggauga

SEQ ID NO: 350580 - RNA, 32 nt, Human
cagauggcucacuccuaacuuuggugagucau

SEQ ID NO: 350581 - RNA, 32 nt, Human
cagauggcugaaccucugcccccggagccccc

SEQ ID NO: 350582 - RNA, 32 nt, Human
cagauggcuggccaaaguugaagggucagaga

SEQ ID NO: 350583 - RNA, 32 nt, Human
cagauggcugggaucccuccccuguacccuuc

SEQ ID NO: 350584 - RNA, 32 nt, Human
cagauggcuuaguuaagucauccacagcccaa

SEQ ID NO: 350585 - RNA, 32 nt, Human
cagaugggaauugcacaguaggauguggaacc

SEQ ID NO: 350586 - RNA, 32 nt, Human
cagaugggagagagccagagagaggagugagg

SEQ ID NO: 350587 - RNA, 23 nt, Human
cagaugggcagcugcaaaugagu

SEQ ID NO: 350588 - RNA, 32 nt, Human
cagaugggccaccaggcaggagcugcugcugg

SEQ ID NO: 350589 - RNA, 32 nt, Human
cagaugggcugggcagaucaagcacaaaccug

SEQ ID NO: 350590 - RNA, 32 nt, Human
cagaugggcuuccaggacuggcccagaccagc

SEQ ID NO: 350591 - RNA, 32 nt, Human
cagaugggcuuggcuauugucaugcccaagaa

SEQ ID NO: 350592 - RNA, 20 nt, Human
cagauggggaaacugaggcu

SEQ ID NO: 350593 - RNA, 31 nt, Human
cagauggggaaacugaggcucaggugacugc

SEQ ID NO: 350594 - RNA, 32 nt, Human
cagauggggaaacugagguuugcgggagugaa

SEQ ID NO: 350595 - RNA, 32 nt, Human
cagauggggaggaucacuugacccaggaguuc

SEQ ID NO: 350596 - RNA, 24 nt, Human
cagauggggaugcaggcccuggug

SEQ ID NO: 350597 - RNA, 32 nt, Human
cagaugggggagcugguaggcagaugguuuua

SEQ ID NO: 350598 - RNA, 32 nt, Human
cagauggguaauccugugcauuuggguugggg

SEQ ID NO: 350599 - RNA, 27 nt, Human
cagauggguucuggaggccccugaaca

SEQ ID NO: 350600 - RNA, 32 nt, Human
cagaugguagggagagagagccacuggaucgg

SEQ ID NO: 350601 - RNA, 23 nt, Human
cagaugguaugcaacagguggug

SEQ ID NO: 350602 - RNA, 32 nt, Human
cagauggucuacagggcuuaguacagugccug

SEQ ID NO: 350603 - RNA, 32 nt, Human
cagauggugccacugcacuccagccuggguga

SEQ ID NO: 350604 - RNA, 22 nt, Human
cagauggugcggcggcuggcca

SEQ ID NO: 350605 - RNA, 32 nt, Human
cagauggugggcacugacuagacuggaagugc

SEQ ID NO: 350606 - RNA, 32 nt, Human
cagauggugucaggcugucacggacauaggga

SEQ ID NO: 350607 - RNA, 32 nt, Human
cagaugguuugaggccgcagagccagaccauu

SEQ ID NO: 350608 - RNA, 32 nt, Human
cagauguaaaccccaaacuuguacacaaaaga

SEQ ID NO: 350609 - RNA, 32 nt, Human
cagauguaaggccugugcuguggcucugaggc

SEQ ID NO: 350610 - RNA, 32 nt, Human
cagauguagaagagagcgaaagugauuguguu

SEQ ID NO: 350611 - RNA, 32 nt, Human
cagauguagucuccuugcuuuagugaauacac

SEQ ID NO: 350612 - RNA, 32 nt, Human
cagauguauaguguuuugagggcagaggauga

SEQ ID NO: 350613 - RNA, 32 nt, Human
cagauguaucauuuugggguccaccauucaac

SEQ ID NO: 350614 - RNA, 32 nt, Human
cagauguauggcuaccggaaacagguggguca

SEQ ID NO: 350615 - RNA, 32 nt, Human
cagaugucacccagaguaaauuauaauuagaa

SEQ ID NO: 350616 - RNA, 32 nt, Human
cagauguccccgccccacaucccuucagaucc

SEQ ID NO: 350617 - RNA, 32 nt, Human
cagauguccccuccucuccacccccgacgcug

SEQ ID NO: 350618 - RNA, 32 nt, Human
cagaugucccuugaugcacagagaagcugggg

SEQ ID NO: 350619 - RNA, 32 nt, Human
cagaugucgggaguuagaaaccagccuggcca

SEQ ID NO: 350620 - RNA, 32 nt, Human
cagaugucucucuuugccauuuuuggaggcau

SEQ ID NO: 350621 - RNA, 32 nt, Human
cagaugugaaugaaggggcagcuggaggaugu

SEQ ID NO: 350622 - RNA, 32 nt, Human
cagaugugacccaaugcacccaaccaaacuuc

SEQ ID NO: 350623 - RNA, 32 nt, Human
cagaugugagaguguggcaggccaggucucac

SEQ ID NO: 350624 - RNA, 32 nt, Human
cagaugugagccaccacacacaccaucugauu

SEQ ID NO: 350625 - RNA, 32 nt, Human
cagaugugagccaccacaccaggccggugaag

SEQ ID NO: 350626 - RNA, 32 nt, Human
cagaugugagccaccacaccuggccccaagcu

SEQ ID NO: 350627 - RNA, 32 nt, Human
cagaugugagccaccacgcccagccagaaauu

SEQ ID NO: 350628 - RNA, 32 nt, Human
cagaugugagccaccaugcccagcuuucuugc

SEQ ID NO: 350629 - RNA, 32 nt, Human
cagaugugagccaccgcacccagccugaguuu

SEQ ID NO: 350630 - RNA, 32 nt, Human
cagaugugagccaccguacccagcuaauuuuu

SEQ ID NO: 350631 - RNA, 32 nt, Human
cagaugugagccaccgugccuagccaaggaug

SEQ ID NO: 350632 - RNA, 32 nt, Human
cagaugugagccaccgugccuggccagauuuu

SEQ ID NO: 350633 - RNA, 32 nt, Human
cagaugugagccacugcaccuggccccagaaa

SEQ ID NO: 350634 - RNA, 32 nt, Human
cagaugugagccacugcguccugccuaaaaug

SEQ ID NO: 350635 - RNA, 32 nt, Human
cagaugugagccacugcguccuuccuaaaaug

SEQ ID NO: 350636 - RNA, 32 nt, Human
cagaugugagccauggugcccggcuacucuua

SEQ ID NO: 350637 - RNA, 32 nt, Human
cagaugugagccugugccuggcuggucuuucu

SEQ ID NO: 350638 - RNA, 32 nt, Human
cagaugugcaaggucuucugucuuccagcuug

SEQ ID NO: 350639 - RNA, 32 nt, Human
cagaugugcaccugagaccugaugucuaucug

SEQ ID NO: 350640 - RNA, 32 nt, Human
cagaugugcaucaccaugccuggcuaauuuuu

SEQ ID NO: 350641 - RNA, 32 nt, Human
cagauguggccaagcaucacucuucaccagga

SEQ ID NO: 350642 - RNA, 32 nt, Human
cagauguggccacaguccuuccugacucacug

SEQ ID NO: 350643 - RNA, 32 nt, Human
cagaugugggcaacauggugucagaucugcca

SEQ ID NO: 350644 - RNA, 32 nt, Human
cagaugugggcuuguuauugggaugaagacug

SEQ ID NO: 350645 - RNA, 32 nt, Human
cagaugugggguugagcggggguggggcugca

SEQ ID NO: 350646 - RNA, 32 nt, Human
cagauguggugcuucucauuuauucuuaaagc

SEQ ID NO: 350647 - RNA, 32 nt, Human
cagaugugguucuccagccucuugccuggcug

SEQ ID NO: 350648 - RNA, 32 nt, Human
cagauguguagagagagaaaggaagggaagga

SEQ ID NO: 350649 - RNA, 32 nt, Human
cagaugugucagcaggugacaagaacaagucc

SEQ ID NO: 350650 - RNA, 29 nt, Human
cagaugugucugugugugggaauugguau

SEQ ID NO: 350651 - RNA, 32 nt, Human
cagaugugugggauugggggaggaguggggac

SEQ ID NO: 350652 - RNA, 32 nt, Human
cagauguguuaaccauuuaagcagaucaucug

SEQ ID NO: 350653 - RNA, 32 nt, Human
cagauguguugacagcugcucuucugaauugc

SEQ ID NO: 350654 - RNA, 32 nt, Human
cagauguucaacaauccugcuguuccucaagg

SEQ ID NO: 350655 - RNA, 32 nt, Human
cagauguugaaguuucugaagguugacgucac

SEQ ID NO: 350656 - RNA, 32 nt, Human
cagauguuugugccuuuucuuuacuuugcuua

SEQ ID NO: 350657 - RNA, 32 nt, Human
cagauguuuucuucuuuucuuacugcgcauuu

SEQ ID NO: 350658 - RNA, 32 nt, Human
cagauuaaagccucuguuuugcaccuguaaaa

SEQ ID NO: 350659 - RNA, 32 nt, Human
cagauuaaauggacucaucaggguaagaggaa

SEQ ID NO: 350660 - RNA, 20 nt, Human
cagauuaacccuuccuggaa

SEQ ID NO: 350661 - RNA, 32 nt, Human
cagauuacacauguaaauaugaccucagacaa

SEQ ID NO: 350662 - RNA, 32 nt, Human
cagauuacguuuuugaauggugaacaggcuau

SEQ ID NO: 350663 - RNA, 32 nt, Human
cagauuagccuccuccucuugaaaauggagac

SEQ ID NO: 350664 - RNA, 31 nt, Human
cagauuagccucucuuccucugucaggcaaa

SEQ ID NO: 350665 - RNA, 32 nt, Human
cagauuagcugugguucaagacugccugugug

SEQ ID NO: 350666 - RNA, 32 nt, Human
cagauuauuuuuauagugauuuuugcagcuaa

SEQ ID NO: 350667 - RNA, 32 nt, Human
cagauucaaagcuuccagagguggugagaacu

SEQ ID NO: 350668 - RNA, 24 nt, Human
cagauucaacagauucuccugccu

SEQ ID NO: 350669 - RNA, 24 nt, Human
cagauucaagcaauucuccugccu

SEQ ID NO: 350670 - RNA, 24 nt, Human
cagauucaagcaauucuccuguuu

SEQ ID NO: 350671 - RNA, 24 nt, Human
cagauucaagcgauucuccugccu

SEQ ID NO: 350672 - RNA, 24 nt, Human
cagauucaagcgauucuccugucu

SEQ ID NO: 350673 - RNA, 32 nt, Human
cagauucaagcgauucuccugucucagccucc

SEQ ID NO: 350674 - RNA, 22 nt, Human
cagauucaagcgauuuccagcu

SEQ ID NO: 350675 - RNA, 24 nt, Human
cagauucaagugauccucccaucu

SEQ ID NO: 350676 - RNA, 24 nt, Human
cagauucacaccauucuccugccu

SEQ ID NO: 350677 - RNA, 24 nt, Human
cagauucacgccauucuccugccu

SEQ ID NO: 350678 - RNA, 32 nt, Human
cagauucacugcagcucuccucuuaauaugua

SEQ ID NO: 350679 - RNA, 32 nt, Human
cagauucagcagugacauaacaaggacauaau

SEQ ID NO: 350680 - RNA, 32 nt, Human
cagauucaucauuauuccuaaaguauugcugu

SEQ ID NO: 350681 - RNA, 28 nt, Human
cagauuccaagugcugcuacuucaagug

SEQ ID NO: 350682 - RNA, 32 nt, Human
cagauuccacaaagccucucuccccucccucg

SEQ ID NO: 350683 - RNA, 32 nt, Human
cagauuccacaguggcaagaaacaucauucua

SEQ ID NO: 350684 - RNA, 32 nt, Human
cagauuccagagagucccaggcgggcgggagu

SEQ ID NO: 350685 - RNA, 24 nt, Human
cagauuccagucauccuccugccu

SEQ ID NO: 350686 - RNA, 32 nt, Human
cagauuccaucuuuuccaacuccaaggugcca

SEQ ID NO: 350687 - RNA, 32 nt, Human
cagauuccauuuuagaauggggauucacaggu

SEQ ID NO: 350688 - RNA, 32 nt, Human
cagauucccaagcaagggugacccaugguuaa

SEQ ID NO: 350689 - RNA, 32 nt, Human
cagauucccaggcugggugcaguggcucacgc

SEQ ID NO: 350690 - RNA, 32 nt, Human
cagauuccuggaccugguguccugguuggguc

SEQ ID NO: 350691 - RNA, 19 nt, Human
cagauucggaaacugggga

SEQ ID NO: 350692 - RNA, 32 nt, Human
cagauucuacaaaaaugguguuucaaaacuga

SEQ ID NO: 350693 - RNA, 32 nt, Human
cagauucucaaacagucgcagcucuuuggagg

SEQ ID NO: 350694 - RNA, 32 nt, Human
cagauucuccacggugguccccaaaacacugu

SEQ ID NO: 350695 - RNA, 32 nt, Human
cagauucuccccugaaguuucucaggccuuuu

SEQ ID NO: 350696 - RNA, 32 nt, Human
cagauucugccucucuggaaagaggcucugga

SEQ ID NO: 350697 - RNA, 32 nt, Human
cagauucuggcuauuccauccauucugauuca

SEQ ID NO: 350698 - RNA, 32 nt, Human
cagauucuucucgaucgaucucccgacaucac

SEQ ID NO: 350699 - RNA, 32 nt, Human
cagauucuuucaucucuacuucccaagcuuuc

SEQ ID NO: 350700 - RNA, 32 nt, Human
cagauugagaaccucaaggaggaccuggucua

SEQ ID NO: 350701 - RNA, 32 nt, Human
cagauugcaacaggcugggcuucaguggcagc

SEQ ID NO: 350702 - RNA, 32 nt, Human
cagauugcaccacuacacuccagccugggcaa

SEQ ID NO: 350703 - RNA, 32 nt, Human
cagauugcaccacugcacuccagccugggcaa

SEQ ID NO: 350704 - RNA, 32 nt, Human
cagauugcaccacugcucucuagccugggcaa

SEQ ID NO: 350705 - RNA, 32 nt, Human
cagauugcaccauugcacuccagccugcgcaa

SEQ ID NO: 350706 - RNA, 32 nt, Human
cagauugcaccauugcccuccagccugagcaa

SEQ ID NO: 350707 - RNA, 32 nt, Human
cagauugcagacugcauguucacagagcuggg

SEQ ID NO: 350708 - RNA, 32 nt, Human
cagauugcagagcugaaaaagauaugugaaca

SEQ ID NO: 350709 - RNA, 31 nt, Human
cagauugcaggguucugacaaggcaggacag

SEQ ID NO: 350710 - RNA, 32 nt, Human
cagauugcagugagccaagaucacgccacugc

SEQ ID NO: 350711 - RNA, 32 nt, Human
cagauugcccacugcacuccagccugggcaac

SEQ ID NO: 350712 - RNA, 32 nt, Human
cagauugcgccauugugcuccagccuggguga

SEQ ID NO: 350713 - RNA, 32 nt, Human
cagauugcgucacugcacuccaaccuggguga

SEQ ID NO: 350714 - RNA, 32 nt, Human
cagauugcuagucugugucugucugaucagaa

SEQ ID NO: 350715 - RNA, 32 nt, Human
cagauugcugaccaggggcuugagagcugggu

SEQ ID NO: 350716 - RNA, 23 nt, Human
cagauugcuggguuuacaggcau

SEQ ID NO: 350717 - RNA, 32 nt, Human
cagauuggaaaugacauuuuaguuuaucagau

SEQ ID NO: 350718 - RNA, 24 nt, Human
cagauuggacuugcccgcguuccu

SEQ ID NO: 350719 - RNA, 32 nt, Human
cagauuggagccauggcuuuggaacagaacca

SEQ ID NO: 350720 - RNA, 32 nt, Human
cagauuggagcucugcaguaccacagaacagg

SEQ ID NO: 350721 - RNA, 32 nt, Human
cagauuggagcucugcaguaccacagggccaa

SEQ ID NO: 350722 - RNA, 23 nt, Human
cagauuggaucaccucccacccu

SEQ ID NO: 350723 - RNA, 32 nt, Human
cagauuggaucucuuuuucauauggaucuucu

SEQ ID NO: 350724 - RNA, 32 nt, Human
cagauuggcagagugcagggaggugagagagu

SEQ ID NO: 350725 - RNA, 32 nt, Human
cagauuggccuccaaucaaaccugaacaggcu

SEQ ID NO: 350726 - RNA, 32 nt, Human
cagauugggaaaaugguugaaucaaaaguuug

SEQ ID NO: 350727 - RNA, 32 nt, Human
cagauuggggagggcuugacaggcuagggggc

SEQ ID NO: 350728 - RNA, 32 nt, Human
cagauugggggaaaacaacaaaugucuugaag

SEQ ID NO: 350729 - RNA, 32 nt, Human
cagauugggugucaguucaggauaaauaccaa

SEQ ID NO: 350730 - RNA, 32 nt, Human
cagauuggucacauaaaugccacggcauuccg

SEQ ID NO: 350731 - RNA, 32 nt, Human
cagauuggucucaaacuccuggacucaaguga

SEQ ID NO: 350732 - RNA, 32 nt, Human
cagauuggucucaaacuccuggccucucacuc

SEQ ID NO: 350733 - RNA, 32 nt, Human
cagauuggugcuuucuaaauaaaaauugaaag

SEQ ID NO: 350734 - RNA, 32 nt, Human
cagauuguaaauauuucagacuguguggacca

SEQ ID NO: 350735 - RNA, 32 nt, Human
cagauuguauuuuuauuguuaaugcucuucuu

SEQ ID NO: 350736 - RNA, 32 nt, Human
cagauugugagcuccuggagggcaggagcugu

SEQ ID NO: 350737 - RNA, 32 nt, Human
cagauugugcacuccagcggggagcuguuuca

SEQ ID NO: 350738 - RNA, 32 nt, Human
cagauugugccacugcacuccagccugggcaa

SEQ ID NO: 350739 - RNA, 32 nt, Human
cagauugugccacugcacucuagccucgguga

SEQ ID NO: 350740 - RNA, 32 nt, Human
cagauugugccacugcauucuagccugggcga

SEQ ID NO: 350741 - RNA, 32 nt, Human
cagauugugccacugcccuccagccuggguga

SEQ ID NO: 350742 - RNA, 32 nt, Human
cagauugugccacugcucuccagccugggagg

SEQ ID NO: 350743 - RNA, 32 nt, Human
cagauuguggggacccagggaagggaggaauu

SEQ ID NO: 350744 - RNA, 32 nt, Human
cagauuguggggcacauuguguagccugacuu

SEQ ID NO: 350745 - RNA, 32 nt, Human
cagauuguuagugcuuucaacauuucauuuga

SEQ ID NO: 350746 - RNA, 32 nt, Human
cagauuuaaaauauuaauuugcugcuaauuaa

SEQ ID NO: 350747 - RNA, 32 nt, Human
cagauuuaaagaaaugaaaggauaccauuagu

SEQ ID NO: 350748 - RNA, 32 nt, Human
cagauuuagcaaaaccaaaacagagugcugag

SEQ ID NO: 350749 - RNA, 32 nt, Human
cagauuucaccacccacacucuuuuuaggugu

SEQ ID NO: 350750 - RNA, 32 nt, Human
cagauuucagcuuaaauuuugccuccucagag

SEQ ID NO: 350751 - RNA, 32 nt, Human
cagauuucauucucagcaccauacagauuugg

SEQ ID NO: 350752 - RNA, 32 nt, Human
cagauuucauucuuuguuagcucacuuuauaa

SEQ ID NO: 350753 - RNA, 32 nt, Human
cagauuuccagagcucugucucuguacagccc

SEQ ID NO: 350754 - RNA, 32 nt, Human
cagauuuccagccuggugaugcuguacagaac

SEQ ID NO: 350755 - RNA, 32 nt, Human
cagauuucccuaauuaguggugugugaacauc

SEQ ID NO: 350756 - RNA, 32 nt, Human
cagauuuccgggcuaacuuuccucgccgucuc

SEQ ID NO: 350757 - RNA, 32 nt, Human
cagauuuccuguucuuuaccuggcucugcuuc

SEQ ID NO: 350758 - RNA, 32 nt, Human
cagauuucgugcuugaaguggaagaaaaauga

SEQ ID NO: 350759 - RNA, 32 nt, Human
cagauuucuccaccaaauucucagccugauaa

SEQ ID NO: 350760 - RNA, 32 nt, Human
cagauuucuuuguccucuaagaguugauugcu

SEQ ID NO: 350761 - RNA, 19 nt, Human
cagauuugaaaguucaaug

SEQ ID NO: 350762 - RNA, 32 nt, Human
cagauuugagguaccagugcauagcagcugaa

SEQ ID NO: 350763 - RNA, 32 nt, Human
cagauuugccuaggaugccaauguuuuuaauu

SEQ ID NO: 350764 - RNA, 32 nt, Human
cagauuuggaaugggaccagaggcccuugaaa

SEQ ID NO: 350765 - RNA, 18 nt, Human
cagauuuggaauucaaug

SEQ ID NO: 350766 - RNA, 25 nt, Human
cagauuugggaggccccuccugccc

SEQ ID NO: 350767 - RNA, 32 nt, Human
cagauuugugguggaaaaggcggccaucaucu

SEQ ID NO: 350768 - RNA, 32 nt, Human
cagauuuguucuuccgccccugccuccgcggc

SEQ ID NO: 350769 - RNA, 32 nt, Human
cagauuuuacccacuugguugucacaacugaa

SEQ ID NO: 350770 - RNA, 32 nt, Human
cagauuuuauucuucuuaacagauuuagguua

SEQ ID NO: 350771 - RNA, 32 nt, Human
cagauuuucaucuauaaacaaaggagcauuug

SEQ ID NO: 350772 - RNA, 32 nt, Human
cagauuuuccuguuuucguuguuuucaaagac

SEQ ID NO: 350773 - RNA, 21 nt, Human
cagauuuugauucuguccucu

SEQ ID NO: 350774 - RNA, 32 nt, Human
cagauuuugcaagagccaggcucgcccaccuu

SEQ ID NO: 350775 - RNA, 32 nt, Human
cagauuuugccuccccgaucagugugugccug

SEQ ID NO: 350776 - RNA, 32 nt, Human
cagauuuugccuccuguugaccagccugguuu

SEQ ID NO: 350777 - RNA, 19 nt, Human
cagauuuuggacuuucaca

SEQ ID NO: 350778 - RNA, 32 nt, Human
cagauuuuuauguuuugaaagacagagucuuc

SEQ ID NO: 350779 - RNA, 32 nt, Human
cagauuuuugcaaccuccuccugagccgggau

SEQ ID NO: 350780 - RNA, 32 nt, Human
cagcaaaaaggaaaguugcccaaggaagggaa

SEQ ID NO: 350781 - RNA, 32 nt, Human
cagcaaaaauggagcagaaaaugcagagauuu

SEQ ID NO: 350782 - RNA, 32 nt, Human
cagcaaaacccccaccuuaaccucuuuucuuu

SEQ ID NO: 350783 - RNA, 32 nt, Human
cagcaaaagaucuacauucuugcucaaaguug

SEQ ID NO: 350784 - RNA, 32 nt, Human
cagcaaaaguucaccaccuacucuuauuuacu

SEQ ID NO: 350785 - RNA, 32 nt, Human
cagcaaaauagagcucauaaagaaauagugaa

SEQ ID NO: 350786 - RNA, 32 nt, Human
cagcaaaauagagucccucagggugacaguug

SEQ ID NO: 350787 - RNA, 32 nt, Human
cagcaaaauucuacgagagacugugugaggcu

SEQ ID NO: 350788 - RNA, 32 nt, Human
cagcaaacaaaugggaaguuauucuuguuucu

SEQ ID NO: 350789 - RNA, 32 nt, Human
cagcaaacaccacaggacagaggggagggcug

SEQ ID NO: 350790 - RNA, 32 nt, Human
cagcaaacagcacaaucucacccucacaggaa

SEQ ID NO: 350791 - RNA, 20 nt, Human
cagcaaaccaccauggugca

SEQ ID NO: 350792 - RNA, 32 nt, Human
cagcaaaccaucuagauuaaacuccuaaagcc

SEQ ID NO: 350793 - RNA, 32 nt, Human
cagcaaaccccagcugcuucagcagccaugaa

SEQ ID NO: 350794 - RNA, 32 nt, Human
cagcaaaccuccuggguuugaaaaauuccaac

SEQ ID NO: 350795 - RNA, 32 nt, Human
cagcaaaccuugacagcauuuccucuuaucca

SEQ ID NO: 350796 - RNA, 32 nt, Human
cagcaaacgcccuggcgucuguccucaccaug

SEQ ID NO: 350797 - RNA, 32 nt, Human
cagcaaagaagagauuuuuagagugggaagaa

SEQ ID NO: 350798 - RNA, 21 nt, Human
cagcaaagaccacgacuggag

SEQ ID NO: 350799 - RNA, 32 nt, Human
cagcaaagacuccgcuuauccucauuuuacca

SEQ ID NO: 350800 - RNA, 32 nt, Human
cagcaaagagaagugucagagcaugagcgcca

SEQ ID NO: 350801 - RNA, 32 nt, Human
cagcaaagagaauggggcugggcagaucugug

SEQ ID NO: 350802 - RNA, 32 nt, Human
cagcaaagauagauuucagagcacagcagcag

SEQ ID NO: 350803 - RNA, 32 nt, Human
cagcaaagauggagaggaaaaagggaguggag

SEQ ID NO: 350804 - RNA, 32 nt, Human
cagcaaagccccaggagaacaggcuggacaga

SEQ ID NO: 350805 - RNA, 32 nt, Human
cagcaaagccuugcaaucccaggcugggguca

SEQ ID NO: 350806 - RNA, 32 nt, Human
cagcaaagccuugcucucuggagcuuacuaug

SEQ ID NO: 350807 - RNA, 32 nt, Human
cagcaaaggaaaacucagauuuuagaggcuuu

SEQ ID NO: 350808 - RNA, 23 nt, Human
cagcaaaggagacgacacagaca

SEQ ID NO: 350809 - RNA, 21 nt, Human
cagcaaaggcugcugguguca

SEQ ID NO: 350810 - RNA, 32 nt, Human
cagcaaagggucagguauccacacugccucug

SEQ ID NO: 350811 - RNA, 32 nt, Human
cagcaaaggugguuugagguagucaccugcuu

SEQ ID NO: 350812 - RNA, 32 nt, Human
cagcaaagucuacaauaaaacuuuaaaacaau

SEQ ID NO: 350813 - RNA, 32 nt, Human
cagcaaauacacaaggaauucuuuuuguuugu

SEQ ID NO: 350814 - RNA, 32 nt, Human
cagcaaauauaugauucuagugucugacuuuu

SEQ ID NO: 350815 - RNA, 32 nt, Human
cagcaaauccacccucucagcucagcccagcc

SEQ ID NO: 350816 - RNA, 32 nt, Human
cagcaaaugccacucauccccacucuucauag

SEQ ID NO: 350817 - RNA, 32 nt, Human
cagcaaauggaagcaagcuuguucuuugucug

SEQ ID NO: 350818 - RNA, 32 nt, Human
cagcaaauucacugcuucaaaguggccuggcu

SEQ ID NO: 350819 - RNA, 32 nt, Human
cagcaaauuucuugauaucaaggaaagugggg

SEQ ID NO: 350820 - RNA, 32 nt, Human
cagcaaauuugacuucuuaguagccacuucac

SEQ ID NO: 350821 - RNA, 32 nt, Human
cagcaaauuuggauagucucuagggcucauca

SEQ ID NO: 350822 - RNA, 21 nt, Human
cagcaacaaacucacaaagua

SEQ ID NO: 350823 - RNA, 32 nt, Human
cagcaacaaccagcaucccuugaccaggccug

SEQ ID NO: 350824 - RNA, 32 nt, Human
cagcaacaaucagaauguccaaaugcuguccu

SEQ ID NO: 350825 - RNA, 32 nt, Human
cagcaacacagugaaaccccgucucuacuaaa

SEQ ID NO: 350826 - RNA, 32 nt, Human
cagcaacagcacagagcgcugaacacacaccc

SEQ ID NO: 350827 - RNA, 32 nt, Human
cagcaacaggcaggagaggcagcgugugacca

SEQ ID NO: 350828 - RNA, 32 nt, Human
cagcaacauaguaagaccccaucucuauaaau

SEQ ID NO: 350829 - RNA, 32 nt, Human
cagcaacaucacaucauuuuugcuuuucaaua

SEQ ID NO: 350830 - RNA, 32 nt, Human
cagcaacaucauuaccgcuagcggcaguuuug

SEQ ID NO: 350831 - RNA, 32 nt, Human
cagcaaccacugcagcgacuagggacacuugu

SEQ ID NO: 350832 - RNA, 32 nt, Human
cagcaaccaggccuggccuccuggugucugcg

SEQ ID NO: 350833 - RNA, 32 nt, Human
cagcaaccauguccaagggaccugcaguuggu

SEQ ID NO: 350834 - RNA, 32 nt, Human
cagcaaccccugugucuccuacuccugcaaag

SEQ ID NO: 350835 - RNA, 32 nt, Human
cagcaacccggccgcccugccuguggccuccg

SEQ ID NO: 350836 - RNA, 32 nt, Human
cagcaacccugggucucccucucugcugcucc

SEQ ID NO: 350837 - RNA, 32 nt, Human
cagcaaccugcacuccagccugggugacagag

SEQ ID NO: 350838 - RNA, 32 nt, Human
cagcaaccugggaagacgagacgcugcgacug

SEQ ID NO: 350839 - RNA, 32 nt, Human
cagcaaccugggaguccgaggugggaggauug

SEQ ID NO: 350840 - RNA, 32 nt, Human
cagcaaccuguaacucacauucucuucccagu

SEQ ID NO: 350841 - RNA, 32 nt, Human
cagcaaccuuucucuccugucuacccuuuuag

SEQ ID NO: 350842 - RNA, 32 nt, Human
cagcaacgcuuguagaacucacucugggcugu

SEQ ID NO: 350843 - RNA, 31 nt, Human
cagcaacgucuuucagggguuggagacagaa

SEQ ID NO: 350844 - RNA, 32 nt, Human
cagcaacucaggagacugagacaggagaaucg

SEQ ID NO: 350845 - RNA, 32 nt, Human
cagcaacuccaccaccuuaggauuucccccuc

SEQ ID NO: 350846 - RNA, 24 nt, Human
cagcaacuccaguagcagcuccag

SEQ ID NO: 350847 - RNA, 21 nt, Human
cagcaacucucuauuggauca

SEQ ID NO: 350848 - RNA, 32 nt, Human
cagcaacugcuaaggagagaucaaagguagcu

SEQ ID NO: 350849 - RNA, 32 nt, Human
cagcaacugcuuguuugugcaugaguagggcu

SEQ ID NO: 350850 - RNA, 32 nt, Human
cagcaacuggacuggcacugccaggacguggu

SEQ ID NO: 350851 - RNA, 32 nt, Human
cagcaacuuccagaacgugaagcagcuguacg

SEQ ID NO: 350852 - RNA, 32 nt, Human
cagcaacuuccuguagugagcacuuuguauga

SEQ ID NO: 350853 - RNA, 32 nt, Human
cagcaacuuguccuagcacagauggccagccc

SEQ ID NO: 350854 - RNA, 32 nt, Human
cagcaagaagaagaaaaaguaagagacacgag

SEQ ID NO: 350855 - RNA, 22 nt, Human
cagcaagaaggcacuaaagcag

SEQ ID NO: 350856 - RNA, 24 nt, Human
cagcaagaauugguugcuggaauu

SEQ ID NO: 350857 - RNA, 32 nt, Human
cagcaagagcaaggcaugggagaggggaggug

SEQ ID NO: 350858 - RNA, 23 nt, Human
cagcaagaggcccguacagaauu

SEQ ID NO: 350859 - RNA, 32 nt, Human
cagcaagagggaacaaaacuguucuuuugcau

SEQ ID NO: 350860 - RNA, 32 nt, Human
cagcaagagggggagucagaagaaaaacagau

SEQ ID NO: 350861 - RNA, 32 nt, Human
cagcaagagguggagcugccagccugaggugc

SEQ ID NO: 350862 - RNA, 32 nt, Human
cagcaagauggaaauaccaaaucccccuaccu

SEQ ID NO: 350863 - RNA, 32 nt, Human
cagcaagaugggaucagagagggccuggccua

SEQ ID NO: 350864 - RNA, 21 nt, Human
cagcaagauugaggauaagau

SEQ ID NO: 350865 - RNA, 32 nt, Human
cagcaagcaaacugagagaggugaaauccaug

SEQ ID NO: 350866 - RNA, 32 nt, Human
cagcaagcaaagcauuuauaccauuacaaucu

SEQ ID NO: 350867 - RNA, 32 nt, Human
cagcaagcagcaaccgaaggcgcaagugccag

SEQ ID NO: 350868 - RNA, 19 nt, Human
cagcaagcagcaugcagca

SEQ ID NO: 350869 - RNA, 20 nt, Human
cagcaagcaggagacuagag

SEQ ID NO: 350870 - RNA, 32 nt, Human
cagcaagccagacugcuguguucuccacagcc

SEQ ID NO: 350871 - RNA, 32 nt, Human
cagcaagccagccaccugcccagccgggccug

SEQ ID NO: 350872 - RNA, 21 nt, Human
cagcaagccaugccccugggg

SEQ ID NO: 350873 - RNA, 18 nt, Human
cagcaagccccccuccca

SEQ ID NO: 350874 - RNA, 32 nt, Human
cagcaagcccccgaauagccccggcugccacc

SEQ ID NO: 350875 - RNA, 23 nt, Human
cagcaagccuccaccagcaagcu

SEQ ID NO: 350876 - RNA, 23 nt, Human
cagcaagcgcaacucuguggaca

SEQ ID NO: 350877 - RNA, 32 nt, Human
cagcaagcguccagggcagauggcagaggauc

SEQ ID NO: 350878 - RNA, 24 nt, Human
cagcaagcuaauaaagaccuggag

SEQ ID NO: 350879 - RNA, 32 nt, Human
cagcaagcuaauugagucucuguuauauacca

SEQ ID NO: 350880 - RNA, 32 nt, Human
cagcaagcuccauuuccaggggucugcccaga

SEQ ID NO: 350881 - RNA, 20 nt, Human
cagcaagcucccugcgggca

SEQ ID NO: 350882 - RNA, 18 nt, Human
cagcaagcugcccccucc

SEQ ID NO: 350883 - RNA, 32 nt, Human
cagcaagcuggagacccaggagagcugauggu

SEQ ID NO: 350884 - RNA, 32 nt, Human
cagcaagcuguggucggaugagugccaggacc

SEQ ID NO: 350885 - RNA, 32 nt, Human
cagcaaggaacacagggcuugcaggaucacag

SEQ ID NO: 350886 - RNA, 32 nt, Human
cagcaaggagaaggaaaaacaccucagcaugg

SEQ ID NO: 350887 - RNA, 32 nt, Human
cagcaaggagacagaagagaaggaggaggggg

SEQ ID NO: 350888 - RNA, 32 nt, Human
cagcaaggauaacauucaaaggagcucacauu

SEQ ID NO: 350889 - RNA, 24 nt, Human
cagcaaggcagggcagcccagagg

SEQ ID NO: 350890 - RNA, 32 nt, Human
cagcaaggcauggacuccgggaagaaggggag

SEQ ID NO: 350891 - RNA, 32 nt, Human
cagcaaggcccaggucccgaaagaugcaguga

SEQ ID NO: 350892 - RNA, 32 nt, Human
cagcaaggcugcacccuccuugaucaucacag

SEQ ID NO: 350893 - RNA, 32 nt, Human
cagcaaggcugcucgggggccccugguucguc

SEQ ID NO: 350894 - RNA, 32 nt, Human
cagcaagggaaaggagcuggaaucacaggcag

SEQ ID NO: 350895 - RNA, 32 nt, Human
cagcaagggcagcagaguugggugcuaagauc

SEQ ID NO: 350896 - RNA, 32 nt, Human
cagcaagggcuggaggccagugcugcagggcc

SEQ ID NO: 350897 - RNA, 32 nt, Human
cagcaaggggcagacccagagauagaaccgca

SEQ ID NO: 350898 - RNA, 32 nt, Human
cagcaaggggcucugcccucccuccuuccuuc

SEQ ID NO: 350899 - RNA, 32 nt, Human
cagcaagguaauccuugauggcuggaucuuuu

SEQ ID NO: 350900 - RNA, 32 nt, Human
cagcaagguggacauggagaccccacucuuug

SEQ ID NO: 350901 - RNA, 32 nt, Human
cagcaaguaaggagcuacaggagaagcuuggc

SEQ ID NO: 350902 - RNA, 32 nt, Human
cagcaaguaaguauaacaggagagccaggauu

SEQ ID NO: 350903 - RNA, 32 nt, Human
cagcaagucugaagaguuucccagaagcccug

SEQ ID NO: 350904 - RNA, 32 nt, Human
cagcaaguggggcccauggaacugaaucuuua

SEQ ID NO: 350905 - RNA, 32 nt, Human
cagcaagugugaagcuggacgugaugcaaaau

SEQ ID NO: 350906 - RNA, 32 nt, Human
cagcaaguuaagaccccagcagguuagggagg

SEQ ID NO: 350907 - RNA, 32 nt, Human
cagcaaguucacagggauccgggaaguugugu

SEQ ID NO: 350908 - RNA, 32 nt, Human
cagcaaguugggaggcugaggcgggcagauca

SEQ ID NO: 350909 - RNA, 32 nt, Human
cagcaauagaaaacuaauaaaccucccucuuu

SEQ ID NO: 350910 - RNA, 32 nt, Human
cagcaaucaggcagcacccagcugugggggca

SEQ ID NO: 350911 - RNA, 32 nt, Human
cagcaaucauaagugcugugcauaacuauugu

SEQ ID NO: 350912 - RNA, 32 nt, Human
cagcaaucauccgugcucccacccccaccccg

SEQ ID NO: 350913 - RNA, 32 nt, Human
cagcaauccacagaacucucucuccuuccuuc

SEQ ID NO: 350914 - RNA, 32 nt, Human
cagcaaucccuuccuuucacuaccuucuuuuu

SEQ ID NO: 350915 - RNA, 32 nt, Human
cagcaaucuccaaaguccuguggugggagggc

SEQ ID NO: 350916 - RNA, 32 nt, Human
cagcaaucucugaggguaaagccggugggagg

SEQ ID NO: 350917 - RNA, 32 nt, Human
cagcaaucucugccuacaccuccugcggcgcc

SEQ ID NO: 350918 - RNA, 32 nt, Human
cagcaaucuuugcuguucugcagccucugcug

SEQ ID NO: 350919 - RNA, 32 nt, Human
cagcaaugaacuguucuagggaaaguggcuuc

SEQ ID NO: 350920 - RNA, 24 nt, Human
cagcaaugagcugucccccuccca

SEQ ID NO: 350921 - RNA, 23 nt, Human
cagcaaugcuaucuaccuucaca

SEQ ID NO: 350922 - RNA, 32 nt, Human
cagcaauggagcuaagaggaguggugaugggc

SEQ ID NO: 350923 - RNA, 30 nt, Human
cagcaauggaugcacaggaagcuuuagcua

SEQ ID NO: 350924 - RNA, 32 nt, Human
cagcaaugucauccuuuuguucuuuuagcuca

SEQ ID NO: 350925 - RNA, 32 nt, Human
cagcaauguuuccuucaacucuggcaguuccc

SEQ ID NO: 350926 - RNA, 20 nt, Human
cagcaauuaaaaauugucuu

SEQ ID NO: 350927 - RNA, 23 nt, Human
cagcaauuacccugacuaaauug

SEQ ID NO: 350928 - RNA, 32 nt, Human
cagcaauuacucacuaaagggcuucauuuuag

SEQ ID NO: 350929 - RNA, 24 nt, Human
cagcaauuacuuggcuaaauuaga

SEQ ID NO: 350930 - RNA, 22 nt, Human
cagcaauuacuuuucaaaauua

SEQ ID NO: 350931 - RNA, 21 nt, Human
cagcaauuccacaaccaccuu

SEQ ID NO: 350932 - RNA, 19 nt, Human
cagcaauuuaacagcuuga

SEQ ID NO: 350933 - RNA, 32 nt, Human
cagcaauuuacaugaauucaugcaagcuuggg

SEQ ID NO: 350934 - RNA, 32 nt, Human
cagcaauuuccagggagcgucuccccacaaca

SEQ ID NO: 350935 - RNA, 32 nt, Human
cagcaauuucuguauaguuuucaccucugaga

SEQ ID NO: 350936 - RNA, 32 nt, Human
cagcaauuugggaggccaaggugggcagauca

SEQ ID NO: 350937 - RNA, 32 nt, Human
cagcaauuugggaggcugagacaggaggauug

SEQ ID NO: 350938 - RNA, 32 nt, Human
cagcaauuugggaggcugaggcuggcggauca

SEQ ID NO: 350939 - RNA, 32 nt, Human
cagcaauuugggaggcugaggugggcagauca

SEQ ID NO: 350940 - RNA, 32 nt, Human
cagcaauuugggaggcugaggugggcggauca

SEQ ID NO: 350941 - RNA, 21 nt, Human
cagcacaaaacaccuucaaug

SEQ ID NO: 350942 - RNA, 23 nt, Human
cagcacaacccuguggccacguu

SEQ ID NO: 350943 - RNA, 21 nt, Human
cagcacaacucaccuugaaua

SEQ ID NO: 350944 - RNA, 32 nt, Human
cagcacaacuuugaccugaugaccucauccca

SEQ ID NO: 350945 - RNA, 32 nt, Human
cagcacaaggaugcaggauaccagcgucuccu

SEQ ID NO: 350946 - RNA, 31 nt, Human
cagcacacaaccuugauuaggaggggcuggg

SEQ ID NO: 350947 - RNA, 32 nt, Human
cagcacacacaguggauuccagugcaugggga

SEQ ID NO: 350948 - RNA, 32 nt, Human
cagcacacaugcucucucucugcuccagcgug

SEQ ID NO: 350949 - RNA, 22 nt, Human
cagcacaccaagguggcccgga

SEQ ID NO: 350950 - RNA, 24 nt, Human
cagcacacccagcucccauggcgu

SEQ ID NO: 350951 - RNA, 20 nt, Human
cagcacaccggugcuggcca

SEQ ID NO: 350952 - RNA, 32 nt, Human
cagcacaccucaccacaccacaccgcacugca

SEQ ID NO: 350953 - RNA, 32 nt, Human
cagcacaccugagugaugaugauuacaccuuc

SEQ ID NO: 350954 - RNA, 32 nt, Human
cagcacaccuggcuaauuuuuguauuuuuagu

SEQ ID NO: 350955 - RNA, 32 nt, Human
cagcacacucuguaucuccuguccuuaaaauc

SEQ ID NO: 350956 - RNA, 32 nt, Human
cagcacacuguuccaaccaaaauugaucuaau

SEQ ID NO: 350957 - RNA, 32 nt, Human
cagcacagaaaaagauuuccaucaccacagaa

SEQ ID NO: 350958 - RNA, 32 nt, Human
cagcacagacacagcauagcaggaguccuccc

SEQ ID NO: 350959 - RNA, 23 nt, Human
cagcacagaccagcagaccauca

SEQ ID NO: 350960 - RNA, 22 nt, Human
cagcacagacccagacgagggg

SEQ ID NO: 350961 - RNA, 32 nt, Human
cagcacagacccucuggcuggggcagcgcaga

SEQ ID NO: 350962 - RNA, 32 nt, Human
cagcacagaggaagagugaugguggcaugcug

SEQ ID NO: 350963 - RNA, 32 nt, Human
cagcacagaggcaauaaaggcaguggucccuu

SEQ ID NO: 350964 - RNA, 32 nt, Human
cagcacagcagcacccauccccugccagagcc

SEQ ID NO: 350965 - RNA, 32 nt, Human
cagcacagcauccucugcccacccuuguuucu

SEQ ID NO: 350966 - RNA, 32 nt, Human
cagcacagccagagaagccucuggaugcagcc

SEQ ID NO: 350967 - RNA, 32 nt, Human
cagcacagccaugccucacagcacacaaaugu

SEQ ID NO: 350968 - RNA, 32 nt, Human
cagcacagccuggccaagaucgagcgcaaccu

SEQ ID NO: 350969 - RNA, 32 nt, Human
cagcacagccugguuacagagugagauuccgu

SEQ ID NO: 350970 - RNA, 23 nt, Human
cagcacagcucugccugacgcuc

SEQ ID NO: 350971 - RNA, 32 nt, Human
cagcacaggcacaaaccauugcccggcacugg

SEQ ID NO: 350972 - RNA, 32 nt, Human
cagcacaggcagcccgggcugccugaauagcc

SEQ ID NO: 350973 - RNA, 32 nt, Human
cagcacaggcagcuagaagggccggugggcac

SEQ ID NO: 350974 - RNA, 32 nt, Human
cagcacaggcuggccagagagcuguucuuguu

SEQ ID NO: 350975 - RNA, 32 nt, Human
cagcacaggcuggcccccaccauguccacagu

SEQ ID NO: 350976 - RNA, 24 nt, Human
cagcacaggcuguaggcccaggag

SEQ ID NO: 350977 - RNA, 19 nt, Human
cagcacagguuccagcacu

SEQ ID NO: 350978 - RNA, 21 nt, Human
cagcacaguccuggggacagg

SEQ ID NO: 350979 - RNA, 32 nt, Human
cagcacagugccugaugccucccuaggcauua

SEQ ID NO: 350980 - RNA, 18 nt, Human
cagcacaguguggcaccc

SEQ ID NO: 350981 - RNA, 32 nt, Human
cagcacaguguguggcauuuacaugguaccca

SEQ ID NO: 350982 - RNA, 19 nt, Human
cagcacaucaaagcugcuu

SEQ ID NO: 350983 - RNA, 32 nt, Human
cagcacaucacugacguauaggacuccuuugg

SEQ ID NO: 350984 - RNA, 32 nt, Human
cagcacauccagccuggcaucccacacgcugg

SEQ ID NO: 350985 - RNA, 32 nt, Human
cagcacaucuuccuccucgcaggagggaccag

SEQ ID NO: 350986 - RNA, 32 nt, Human
cagcacaugaacacuggacccugcuuugccug

SEQ ID NO: 350987 - RNA, 32 nt, Human
cagcacauuccgggcaccucaggcucuggccu

SEQ ID NO: 350988 - RNA, 32 nt, Human
cagcacauugaauggguaagcagacaggccau

SEQ ID NO: 350989 - RNA, 32 nt, Human
cagcacauugacccauagcacacacauacaca

SEQ ID NO: 350990 - RNA, 18 nt, Human
cagcacauugacuauaga

SEQ ID NO: 350991 - RNA, 32 nt, Human
cagcacauugggaggccgaggcaggcggauca

SEQ ID NO: 350992 - RNA, 32 nt, Human
cagcacauugggaggccgaggcgggcagaugu

SEQ ID NO: 350993 - RNA, 25 nt, Human
cagcacauuuuccuguaagcacuca

SEQ ID NO: 350994 - RNA, 32 nt, Human
cagcaccaaaccuggcugugcccauuccccac

SEQ ID NO: 350995 - RNA, 32 nt, Human
cagcaccaacagcacaguucuucauauccacg

SEQ ID NO: 350996 - RNA, 32 nt, Human
cagcaccaacaucugcugcuacucaaaauguc

SEQ ID NO: 350997 - RNA, 22 nt, Human
cagcaccaacugccaacgagcu

SEQ ID NO: 350998 - RNA, 32 nt, Human
cagcaccaagagcagcugggaacugacauagg

SEQ ID NO: 350999 - RNA, 32 nt, Human
cagcaccaaguacuaaacccacaaagcgaucg

SEQ ID NO: 351000 - RNA, 32 nt, Human
cagcaccaccaccaccaccaccaccaccuacu

SEQ ID NO: 351001 - RNA, 32 nt, Human
cagcaccacccagggacgggaggcaugagccg

SEQ ID NO: 351002 - RNA, 32 nt, Human
cagcaccaccuacacaggagucuucagaccca

SEQ ID NO: 351003 - RNA, 21 nt, Human
cagcaccacggaccuuggcgc

SEQ ID NO: 351004 - RNA, 32 nt, Human
cagcaccacugcacagagcuuugggaggcugc

SEQ ID NO: 351005 - RNA, 32 nt, Human
cagcaccacugcacuccagccaggaaugaggc

SEQ ID NO: 351006 - RNA, 32 nt, Human
cagcaccacugcacuccagccugggugacaga

SEQ ID NO: 351007 - RNA, 19 nt, Human
cagcaccacugccugcucc

SEQ ID NO: 351008 - RNA, 32 nt, Human
cagcaccagcagaucugccugugcacagacuu

SEQ ID NO: 351009 - RNA, 32 nt, Human
cagcaccagcagcagaggaaacccaggaaaaa

SEQ ID NO: 351010 - RNA, 23 nt, Human
cagcaccagcagcucuugccacc

SEQ ID NO: 351011 - RNA, 32 nt, Human
cagcaccagcgccaggagggggagcugggcau

SEQ ID NO: 351012 - RNA, 32 nt, Human
cagcaccaggcagagggcaagacggagagggc

SEQ ID NO: 351013 - RNA, 32 nt, Human
cagcaccaggcagaugaugcagaggagugagc

SEQ ID NO: 351014 - RNA, 32 nt, Human
cagcaccaggcaggcaguccugucugcgugug

SEQ ID NO: 351015 - RNA, 23 nt, Human
cagcaccagugacaggcugguca

SEQ ID NO: 351016 - RNA, 32 nt, Human
cagcaccauccagcugugcccaagaagccacc

SEQ ID NO: 351017 - RNA, 32 nt, Human
cagcaccaugcuuccuauacagccugcagaac

SEQ ID NO: 351018 - RNA, 20 nt, Human
cagcaccauggaggcaggcu

SEQ ID NO: 351019 - RNA, 32 nt, Human
cagcacccaacuuuaccacccucccccaccuc

SEQ ID NO: 351020 - RNA, 32 nt, Human
cagcacccaagugcccuccccucacaguguca

SEQ ID NO: 351021 - RNA, 32 nt, Human
cagcacccacacugggucuccacagcggcaug

SEQ ID NO: 351022 - RNA, 32 nt, Human
cagcacccagacucagggaugagugcagcguc

SEQ ID NO: 351023 - RNA, 32 nt, Human
cagcacccagaggccgggucugcaccgugccc

SEQ ID NO: 351024 - RNA, 32 nt, Human
cagcacccagggaagaucuguccuccuguucu

SEQ ID NO: 351025 - RNA, 18 nt, Human
cagcacccagggcugccu

SEQ ID NO: 351026 - RNA, 32 nt, Human
cagcacccaggucuuaguuuucaccucuaguu

SEQ ID NO: 351027 - RNA, 32 nt, Human
cagcacccagguuuugcacucuuguuucuccc

SEQ ID NO: 351028 - RNA, 21 nt, Human
cagcacccaucagggaacuca

SEQ ID NO: 351029 - RNA, 32 nt, Human
cagcaccccauccuguuguucccagagcuggu

SEQ ID NO: 351030 - RNA, 21 nt, Human
cagcacccccucccagcacca

SEQ ID NO: 351031 - RNA, 32 nt, Human
cagcaccccuucugaccucugugugguggauc

SEQ ID NO: 351032 - RNA, 32 nt, Human
cagcaccccuuuccuuccucuccucccaccuc

SEQ ID NO: 351033 - RNA, 32 nt, Human
cagcacccgaugggcccaggagccagcaggag

SEQ ID NO: 351034 - RNA, 32 nt, Human
cagcacccgggcucagggaccacagcaaggca

SEQ ID NO: 351035 - RNA, 21 nt, Human
cagcacccuccaauggcauca

SEQ ID NO: 351036 - RNA, 32 nt, Human
cagcacccuccaggacaggagaucugggaugc

SEQ ID NO: 351037 - RNA, 20 nt, Human
cagcacccuccaugggcuca

SEQ ID NO: 351038 - RNA, 22 nt, Human
cagcacccuccccagggggugc

SEQ ID NO: 351039 - RNA, 32 nt, Human
cagcacccuccgggcuguggaggaccugauug

SEQ ID NO: 351040 - RNA, 32 nt, Human
cagcacccucuccaggugcucccaccacacac

SEQ ID NO: 351041 - RNA, 32 nt, Human
cagcacccucuuccucuucuaaccugcuuucu

SEQ ID NO: 351042 - RNA, 32 nt, Human
cagcacccugauuggccagcuccucaggugga

SEQ ID NO: 351043 - RNA, 32 nt, Human
cagcacccugcaagccagccuggccagcugcu

SEQ ID NO: 351044 - RNA, 32 nt, Human
cagcacccugggaggccgaggcagguggauca

SEQ ID NO: 351045 - RNA, 32 nt, Human
cagcacccugggucauucuugcaccugucacc

SEQ ID NO: 351046 - RNA, 18 nt, Human
cagcacccugugcugcug

SEQ ID NO: 351047 - RNA, 32 nt, Human
cagcaccgaccuccccugaucucccuccuccc

SEQ ID NO: 351048 - RNA, 32 nt, Human
cagcaccgaugcagucguggugaacaggaggu

SEQ ID NO: 351049 - RNA, 32 nt, Human
cagcaccgcccagcccuuccuugccuacuguc

SEQ ID NO: 351050 - RNA, 19 nt, Human
cagcaccgcgcuggcuggc

SEQ ID NO: 351051 - RNA, 32 nt, Human
cagcaccggaggaagaaagaggaggggcuggc

SEQ ID NO: 351052 - RNA, 24 nt, Human
cagcaccgggcucggagcuggcca

SEQ ID NO: 351053 - RNA, 23 nt, Human
cagcaccgugccaaccccaccca

SEQ ID NO: 351054 - RNA, 18 nt, Human
cagcaccuagaccugggg

SEQ ID NO: 351055 - RNA, 32 nt, Human
cagcaccucacugcaucugcagcucucgcucu

SEQ ID NO: 351056 - RNA, 23 nt, Human
cagcaccuccuacccugcuccgu

SEQ ID NO: 351057 - RNA, 32 nt, Human
cagcaccuccuuggccaccuugcauggaugca

SEQ ID NO: 351058 - RNA, 32 nt, Human
cagcaccucuuccagcccuuaaagcugcagaa

SEQ ID NO: 351059 - RNA, 32 nt, Human
cagcaccucuuucccguggcuccuguguucag

SEQ ID NO: 351060 - RNA, 32 nt, Human
cagcaccugcagcucccaccuugcagccgugg

SEQ ID NO: 351061 - RNA, 32 nt, Human
cagcaccugccuccucguuccuuucuccuguu

SEQ ID NO: 351062 - RNA, 32 nt, Human
cagcaccugccugagaccugccccaggcaccc

SEQ ID NO: 351063 - RNA, 20 nt, Human
cagcaccugcuuccugcucc

SEQ ID NO: 351064 - RNA, 32 nt, Human
cagcaccuggaggggcaccagguggaggguuu

SEQ ID NO: 351065 - RNA, 32 nt, Human
cagcaccuggaucuggaggagcccgcccagga

SEQ ID NO: 351066 - RNA, 19 nt, Human
cagcaccugggaggggcug

SEQ ID NO: 351067 - RNA, 32 nt, Human
cagcaccuguaaucccagcuacucaggaggcu

SEQ ID NO: 351068 - RNA, 32 nt, Human
cagcaccuguaaucccagcuacucgggagggu

SEQ ID NO: 351069 - RNA, 32 nt, Human
cagcaccuguuauguaccaggcacuuuaugua

SEQ ID NO: 351070 - RNA, 32 nt, Human
cagcaccuguucucuuggucaggagcuguaga

SEQ ID NO: 351071 - RNA, 32 nt, Human
cagcaccuucaccucuguuacuuccuucucac

SEQ ID NO: 351072 - RNA, 32 nt, Human
cagcaccuuccagagacaaggcugcaggcccu

SEQ ID NO: 351073 - RNA, 32 nt, Human
cagcaccuucccggcucaccagugccaccugc

SEQ ID NO: 351074 - RNA, 32 nt, Human
cagcaccuugggaggcccaggcaggcagauca

SEQ ID NO: 351075 - RNA, 32 nt, Human
cagcaccuugggaggccgagacggguguauaa

SEQ ID NO: 351076 - RNA, 32 nt, Human
cagcaccuugggaggccgaggcaggcagauca

SEQ ID NO: 351077 - RNA, 32 nt, Human
cagcaccuugggaggccgaggcaggcggauca

SEQ ID NO: 351078 - RNA, 32 nt, Human
cagcaccuugggaggccgaggcaggcggauua

SEQ ID NO: 351079 - RNA, 32 nt, Human
cagcaccuugggaggcuaagacaggaagauca

SEQ ID NO: 351080 - RNA, 32 nt, Human
cagcaccuugggaggcugaggcgggcagauca

SEQ ID NO: 351081 - RNA, 32 nt, Human
cagcacgagagccgggcucugcagggaggaag

SEQ ID NO: 351082 - RNA, 32 nt, Human
cagcacgaggggaaaagagcugagcggagacc

SEQ ID NO: 351083 - RNA, 32 nt, Human
cagcacgcccagcuaauuuuuguauuuuuagu

SEQ ID NO: 351084 - RNA, 32 nt, Human
cagcacgcccggcuaaguuuuguauuuuuggc

SEQ ID NO: 351085 - RNA, 32 nt, Human
cagcacgccuggcuaauuguuguauuuuaugu

SEQ ID NO: 351086 - RNA, 32 nt, Human
cagcacgcuucuugcgcauuugcacaucucca

SEQ ID NO: 351087 - RNA, 32 nt, Human
cagcacggaaggugggcugaggcccaggguga

SEQ ID NO: 351088 - RNA, 19 nt, Human
cagcacggaugauuuuuuc

SEQ ID NO: 351089 - RNA, 20 nt, Human
cagcacggcagugcugacca

SEQ ID NO: 351090 - RNA, 32 nt, Human
cagcacggccugaauauugggcaggacaccgc

SEQ ID NO: 351091 - RNA, 32 nt, Human
cagcacgggccagauggccagcugucgagagc

SEQ ID NO: 351092 - RNA, 32 nt, Human
cagcacgggcuuccggcuucucuccucagugg

SEQ ID NO: 351093 - RNA, 23 nt, Human
cagcacgguagcucacccuugua

SEQ ID NO: 351094 - RNA, 32 nt, Human
cagcacguacccagcaagacuuccuguccuga

SEQ ID NO: 351095 - RNA, 32 nt, Human
cagcacguaucagaagccagacuugcucuucg

SEQ ID NO: 351096 - RNA, 32 nt, Human
cagcacgucguguaguccuuucugccuccagg

SEQ ID NO: 351097 - RNA, 32 nt, Human
cagcacgucugccucuggcuucacccagccuc

SEQ ID NO: 351098 - RNA, 23 nt, Human
cagcacgugguuuuaugaaggua

SEQ ID NO: 351099 - RNA, 32 nt, Human
cagcacguugggaggcugaggcgggcggaucg

SEQ ID NO: 351100 - RNA, 32 nt, Human
cagcacguugggaggcugaggcgguagaauca

SEQ ID NO: 351101 - RNA, 32 nt, Human
cagcacuaacacaugcacacacaaagugcaua

SEQ ID NO: 351102 - RNA, 32 nt, Human
cagcacuaauugcaaggauuucucaggugacu

SEQ ID NO: 351103 - RNA, 20 nt, Human
cagcacuacuggugccugaa

SEQ ID NO: 351104 - RNA, 32 nt, Human
cagcacuaggacaccaggaggccagggaaagc

SEQ ID NO: 351105 - RNA, 32 nt, Human
cagcacuaggacaccaggaggccagguaacuu

SEQ ID NO: 351106 - RNA, 18 nt, Human
cagcacuaucauguguca

SEQ ID NO: 351107 - RNA, 20 nt, Human
cagcacuauccggacucuag

SEQ ID NO: 351108 - RNA, 32 nt, Human
cagcacuaugggaggccagggagggaggaucu

SEQ ID NO: 351109 - RNA, 32 nt, Human
cagcacuaugggaggcugaggcaagcagguug

SEQ ID NO: 351110 - RNA, 32 nt, Human
cagcacuaugggaggcugaggugggcagaucu

SEQ ID NO: 351111 - RNA, 20 nt, Human
cagcacuauuuauuuagccu

SEQ ID NO: 351112 - RNA, 32 nt, Human
cagcacucacggucaucaagccagccccugug

SEQ ID NO: 351113 - RNA, 32 nt, Human
cagcacucacucucccccuccucuucuggucu

SEQ ID NO: 351114 - RNA, 32 nt, Human
cagcacucagcccccuugcccaccucacuccu

SEQ ID NO: 351115 - RNA, 32 nt, Human
cagcacuccagaaaucucucugccaucauuac

SEQ ID NO: 351116 - RNA, 32 nt, Human
cagcacuccagccugggcgacagagugagacu

SEQ ID NO: 351117 - RNA, 32 nt, Human
cagcacucccaccagggaucccacccccgcag

SEQ ID NO: 351118 - RNA, 32 nt, Human
cagcacucccuccaaacagaccuugaggccca

SEQ ID NO: 351119 - RNA, 19 nt, Human
cagcacuccggaggagcag

SEQ ID NO: 351120 - RNA, 32 nt, Human
cagcacucuaauucacauccucagcaucccug

SEQ ID NO: 351121 - RNA, 32 nt, Human
cagcacucuggccuccuugcuguucuucagua

SEQ ID NO: 351122 - RNA, 32 nt, Human
cagcacucugggagaccgaggaagggggauug

SEQ ID NO: 351123 - RNA, 32 nt, Human
cagcacucugggaggcagagguggguggauca

SEQ ID NO: 351124 - RNA, 32 nt, Human
cagcacucugggaggccaaggugggcagauca

SEQ ID NO: 351125 - RNA, 32 nt, Human
cagcacucugggaggccgaggcaggcggauca

SEQ ID NO: 351126 - RNA, 32 nt, Human
cagcacucugggaggccgaggcggguggauca

SEQ ID NO: 351127 - RNA, 32 nt, Human
cagcacucugggaggccgaggugggcggauca

SEQ ID NO: 351128 - RNA, 32 nt, Human
cagcacucugggaggcggaggcgguggaucac

SEQ ID NO: 351129 - RNA, 32 nt, Human
cagcacucugggaggcugagacagguagauca

SEQ ID NO: 351130 - RNA, 32 nt, Human
cagcacucugggaggcugaggcgggcagauca

SEQ ID NO: 351131 - RNA, 32 nt, Human
cagcacucugggaggcugaggcggguggauca

SEQ ID NO: 351132 - RNA, 32 nt, Human
cagcacucugggaggcugaggugggcggauug

SEQ ID NO: 351133 - RNA, 22 nt, Human
cagcacugaaccugggaaagag

SEQ ID NO: 351134 - RNA, 32 nt, Human
cagcacugaaggagaugggaggggcugaugcc

SEQ ID NO: 351135 - RNA, 31 nt, Human
cagcacugacuucuguaucaugucagggauu

SEQ ID NO: 351136 - RNA, 32 nt, Human
cagcacugagauggaaccuggccucaguuuag

SEQ ID NO: 351137 - RNA, 32 nt, Human
cagcacugagccagcaccacacguccauccug

SEQ ID NO: 351138 - RNA, 23 nt, Human
cagcacugcaccccaggcagcca

SEQ ID NO: 351139 - RNA, 32 nt, Human
cagcacugcacugcagccugggugacaaagca

SEQ ID NO: 351140 - RNA, 32 nt, Human
cagcacugcacugcugccugggcgacagcgag

SEQ ID NO: 351141 - RNA, 23 nt, Human
cagcacugcacuguggugcggcu

SEQ ID NO: 351142 - RNA, 21 nt, Human
cagcacugcagccacaagcca

SEQ ID NO: 351143 - RNA, 32 nt, Human
cagcacugcagccucaaccuccugggcucaag

SEQ ID NO: 351144 - RNA, 32 nt, Human
cagcacugcaggacuuguggccagucacccag

SEQ ID NO: 351145 - RNA, 32 nt, Human
cagcacugcagucucccaucuccucgugggcu

SEQ ID NO: 351146 - RNA, 32 nt, Human
cagcacugcauucucuuugcacccucaaugca

SEQ ID NO: 351147 - RNA, 21 nt, Human
cagcacugcauuguccagcca

SEQ ID NO: 351148 - RNA, 32 nt, Human
cagcacugcccugggcuaugauuugcaacagc

SEQ ID NO: 351149 - RNA, 32 nt, Human
cagcacugccgcuccccaccccugagccagga

SEQ ID NO: 351150 - RNA, 32 nt, Human
cagcacugccuccuguuuucucccucucaugu

SEQ ID NO: 351151 - RNA, 19 nt, Human
cagcacugcgcggcgcggc

SEQ ID NO: 351152 - RNA, 18 nt, Human
cagcacuggaguuggcca

SEQ ID NO: 351153 - RNA, 18 nt, Human
cagcacuggcaucaggcc

SEQ ID NO: 351154 - RNA, 32 nt, Human
cagcacuggcgggggccuuuccugccgccgac

SEQ ID NO: 351155 - RNA, 23 nt, Human
cagcacuggcucucuccaggauc

SEQ ID NO: 351156 - RNA, 19 nt, Human
cagcacuggcucugggacu

SEQ ID NO: 351157 - RNA, 18 nt, Human
cagcacuggcuggagcag

SEQ ID NO: 351158 - RNA, 22 nt, Human
cagcacuggcuggagcaggcca

SEQ ID NO: 351159 - RNA, 16 nt, Human
cagcacuggcuggggc

SEQ ID NO: 351160 - RNA, 32 nt, Human
cagcacugggaaagauauaauugaaacaaaau

SEQ ID NO: 351161 - RNA, 32 nt, Human
cagcacugggagcugcuccgcccuugccuugg

SEQ ID NO: 351162 - RNA, 32 nt, Human
cagcacugggaggaggcggugcggcgaagcgc

SEQ ID NO: 351163 - RNA, 21 nt, Human
cagcacugggaggccgagggg

SEQ ID NO: 351164 - RNA, 22 nt, Human
cagcacugggauccaagcaggg

SEQ ID NO: 351165 - RNA, 32 nt, Human
cagcacugggcaggcacagagcaggggcugcc

SEQ ID NO: 351166 - RNA, 23 nt, Human
cagcacugggcuggggcagggcu

SEQ ID NO: 351167 - RNA, 18 nt, Human
cagcacuggggggaccuc

SEQ ID NO: 351168 - RNA, 32 nt, Human
cagcacugggguggaggcggcaggaaggggcg

SEQ ID NO: 351169 - RNA, 25 nt, Human
cagcacugggugcucaggcuggcca

SEQ ID NO: 351170 - RNA, 32 nt, Human
cagcacuggugucucugugcuuccuucacuuc

SEQ ID NO: 351171 - RNA, 32 nt, Human
cagcacuguaaagaacaaaggccagugcgagg

SEQ ID NO: 351172 - RNA, 32 nt, Human
cagcacuguaaugccaguggcauugaauugcu

SEQ ID NO: 351173 - RNA, 32 nt, Human
cagcacuguacuccagccugggcgauggagca

SEQ ID NO: 351174 - RNA, 32 nt, Human
cagcacuguaggcucccaacccuaggcuguuu

SEQ ID NO: 351175 - RNA, 32 nt, Human
cagcacuguccacccagggagaguccauuaag

SEQ ID NO: 351176 - RNA, 32 nt, Human
cagcacuguccagcacuugccugcuccugucu

SEQ ID NO: 351177 - RNA, 32 nt, Human
cagcacugucucggcucacugcagccuccgcc

SEQ ID NO: 351178 - RNA, 32 nt, Human
cagcacugucugcgucugcucuucugugccca

SEQ ID NO: 351179 - RNA, 32 nt, Human
cagcacugugagaggcugaggcgggaugauca

SEQ ID NO: 351180 - RNA, 20 nt, Human
cagcacugugagcaggggcu

SEQ ID NO: 351181 - RNA, 23 nt, Human
cagcacugugcaugcaacagcca

SEQ ID NO: 351182 - RNA, 32 nt, Human
cagcacugugggaggccgaggcgggcggauca

SEQ ID NO: 351183 - RNA, 32 nt, Human
cagcacugugggaggccgaggcgggcggaucg

SEQ ID NO: 351184 - RNA, 32 nt, Human
cagcacugugggaggccgaggcggguggauca

SEQ ID NO: 351185 - RNA, 32 nt, Human
cagcacugugggaggccgaggugggucgacua

SEQ ID NO: 351186 - RNA, 32 nt, Human
cagcacugugggaggcugaggcggguggauca

SEQ ID NO: 351187 - RNA, 32 nt, Human
cagcacuguguguuggccgcacccaugagagc

SEQ ID NO: 351188 - RNA, 32 nt, Human
cagcacuguguuugaacacccuggugacuagg

SEQ ID NO: 351189 - RNA, 20 nt, Human
cagcacuguucaucuggcca

SEQ ID NO: 351190 - RNA, 32 nt, Human
cagcacuucccaagccugcugaccacagucac

SEQ ID NO: 351191 - RNA, 32 nt, Human
cagcacuuccccauguccuuucaccuucaugu

SEQ ID NO: 351192 - RNA, 32 nt, Human
cagcacuuccucuugcccuccuggcuuuaugu

SEQ ID NO: 351193 - RNA, 21 nt, Human
cagcacuuccuguccgcccuu

SEQ ID NO: 351194 - RNA, 32 nt, Human
cagcacuucucccacuuugucccgagccuccu

SEQ ID NO: 351195 - RNA, 32 nt, Human
cagcacuugcaaggcuagagggaaacugguga

SEQ ID NO: 351196 - RNA, 32 nt, Human
cagcacuugcccauuccuuacaccccuucccc

SEQ ID NO: 351197 - RNA, 32 nt, Human
cagcacuuguuagcuggguguuuuuggccagg

SEQ ID NO: 351198 - RNA, 32 nt, Human
cagcacuuucaucagauccugccuccuggagu

SEQ ID NO: 351199 - RNA, 32 nt, Human
cagcacuuucggaggcagaggcaggcggauca

SEQ ID NO: 351200 - RNA, 21 nt, Human
cagcacuuucggaggccgagg

SEQ ID NO: 351201 - RNA, 32 nt, Human
cagcacuuucuccucccuugucaguuugcaaa

SEQ ID NO: 351202 - RNA, 32 nt, Human
cagcacuuugagagacugagacaggaggauca

SEQ ID NO: 351203 - RNA, 21 nt, Human
cagcacuuugagaggccgagg

SEQ ID NO: 351204 - RNA, 20 nt, Human
cagcacuuuggaggccaagg

SEQ ID NO: 351205 - RNA, 32 nt, Human
cagcacuuugggaaguggaggugggagaauca

SEQ ID NO: 351206 - RNA, 32 nt, Human
cagcacuuugggaggcaaaggcgggcagauca

SEQ ID NO: 351207 - RNA, 32 nt, Human
cagcacuuugggaggcaaaggcgggcggauca

SEQ ID NO: 351208 - RNA, 32 nt, Human
cagcacuuugggaggcaaagguggguagauca

SEQ ID NO: 351209 - RNA, 32 nt, Human
cagcacuuugggaggcagagacaggcaggucg

SEQ ID NO: 351210 - RNA, 32 nt, Human
cagcacuuugggaggcagaggagggcggauca

SEQ ID NO: 351211 - RNA, 32 nt, Human
cagcacuuugggaggcagaggcaggcagauca

SEQ ID NO: 351212 - RNA, 32 nt, Human
cagcacuuugggaggcagaggccgguggguug

SEQ ID NO: 351213 - RNA, 32 nt, Human
cagcacuuugggaggcagaggcgggcggauca

SEQ ID NO: 351214 - RNA, 32 nt, Human
cagcacuuugggaggcagaggugggaggacug

SEQ ID NO: 351215 - RNA, 32 nt, Human
cagcacuuugggaggcagaggugggaggauug

SEQ ID NO: 351216 - RNA, 32 nt, Human
cagcacuuugggaggcagaggugggcagauca

SEQ ID NO: 351217 - RNA, 32 nt, Human
cagcacuuugggaggcagaggugggcggauca

SEQ ID NO: 351218 - RNA, 32 nt, Human
cagcacuuugggaggcagaggugggcggaucg

SEQ ID NO: 351219 - RNA, 32 nt, Human
cagcacuuugggaggcagagguggguggauca

SEQ ID NO: 351220 - RNA, 32 nt, Human
cagcacuuugggaggcagaguugggaggauca

SEQ ID NO: 351221 - RNA, 32 nt, Human
cagcacuuugggaggcagcagcuggcggauca

SEQ ID NO: 351222 - RNA, 32 nt, Human
cagcacuuugggaggcaggggcggguggauca

SEQ ID NO: 351223 - RNA, 32 nt, Human
cagcacuuugggaggccaagacaggaggauca

SEQ ID NO: 351224 - RNA, 32 nt, Human
cagcacuuugggaggccaaggcaggcaaucac

SEQ ID NO: 351225 - RNA, 32 nt, Human
cagcacuuugggaggccaaggcaggcagacca

SEQ ID NO: 351226 - RNA, 32 nt, Human
cagcacuuugggaggccaaggcaggcagauaa

SEQ ID NO: 351227 - RNA, 32 nt, Human
cagcacuuugggaggccaaggcaggcagauca

SEQ ID NO: 351228 - RNA, 32 nt, Human
cagcacuuugggaggccaaggcagguagauua

SEQ ID NO: 351229 - RNA, 32 nt, Human
cagcacuuugggaggccaaggcggacagacca

SEQ ID NO: 351230 - RNA, 32 nt, Human
cagcacuuugggaggccaaggcgggcagacca

SEQ ID NO: 351231 - RNA, 32 nt, Human
cagcacuuugggaggccaaggcgggcagauca

SEQ ID NO: 351232 - RNA, 32 nt, Human
cagcacuuugggaggccaaggcggguagauca

SEQ ID NO: 351233 - RNA, 32 nt, Human
cagcacuuugggaggccaaggcguguggauca

SEQ ID NO: 351234 - RNA, 32 nt, Human
cagcacuuugggaggccaaggugcaaggcggg

SEQ ID NO: 351235 - RNA, 32 nt, Human
cagcacuuugggaggccaaggugggaggauua

SEQ ID NO: 351236 - RNA, 32 nt, Human
cagcacuuugggaggccaaggugggaggauug

SEQ ID NO: 351237 - RNA, 32 nt, Human
cagcacuuugggaggccaaggugggagggaag

SEQ ID NO: 351238 - RNA, 32 nt, Human
cagcacuuugggaggccaagguuggcagauca

SEQ ID NO: 351239 - RNA, 32 nt, Human
cagcacuuugggaggccaaugcaggaagauca

SEQ ID NO: 351240 - RNA, 32 nt, Human
cagcacuuugggaggccgaagcaggcagauca

SEQ ID NO: 351241 - RNA, 32 nt, Human
cagcacuuugggaggccgagacaggcagauca

SEQ ID NO: 351242 - RNA, 32 nt, Human
cagcacuuugggaggccgagacaggcagaucg

SEQ ID NO: 351243 - RNA, 32 nt, Human
cagcacuuugggaggccgagacgggcagauca

SEQ ID NO: 351244 - RNA, 21 nt, Human
cagcacuuugggaggccgagg

SEQ ID NO: 351245 - RNA, 32 nt, Human
cagcacuuugggaggccgaggagggcagagau

SEQ ID NO: 351246 - RNA, 32 nt, Human
cagcacuuugggaggccgaggagggcagauca

SEQ ID NO: 351247 - RNA, 32 nt, Human
cagcacuuugggaggccgaggcagcagauugc

SEQ ID NO: 351248 - RNA, 32 nt, Human
cagcacuuugggaggccgaggcaggcagauca

SEQ ID NO: 351249 - RNA, 32 nt, Human
cagcacuuugggaggccgaggcaggcgaauca

SEQ ID NO: 351250 - RNA, 32 nt, Human
cagcacuuugggaggccgaggcaggcggauca

SEQ ID NO: 351251 - RNA, 32 nt, Human
cagcacuuugggaggccgaggcaggcggcuca

SEQ ID NO: 351252 - RNA, 32 nt, Human
cagcacuuugggaggccgaggcaggcgggcca

SEQ ID NO: 351253 - RNA, 32 nt, Human
cagcacuuugggaggccgaggcauguggauca

SEQ ID NO: 351254 - RNA, 32 nt, Human
cagcacuuugggaggccgaggccggcaaauca

SEQ ID NO: 351255 - RNA, 32 nt, Human
cagcacuuugggaggccgaggccggcagauca

SEQ ID NO: 351256 - RNA, 32 nt, Human
cagcacuuugggaggccgaggccggcggauca

SEQ ID NO: 351257 - RNA, 32 nt, Human
cagcacuuugggaggccgaggccggugauuca

SEQ ID NO: 351258 - RNA, 32 nt, Human
cagcacuuugggaggccgaggcgagcagauca

SEQ ID NO: 351259 - RNA, 32 nt, Human
cagcacuuugggaggccgaggcggacagauca

SEQ ID NO: 351260 - RNA, 32 nt, Human
cagcacuuugggaggccgaggcgggcagauca

SEQ ID NO: 351261 - RNA, 32 nt, Human
cagcacuuugggaggccgaggcgggcagauga

SEQ ID NO: 351262 - RNA, 32 nt, Human
cagcacuuugggaggccgaggcgggcgaauca

SEQ ID NO: 351263 - RNA, 32 nt, Human
cagcacuuugggaggccgaggcgggcggauca

SEQ ID NO: 351264 - RNA, 32 nt, Human
cagcacuuugggaggccgaggcgggcggaucg

SEQ ID NO: 351265 - RNA, 32 nt, Human
cagcacuuugggaggccgaggcgggcggaucu

SEQ ID NO: 351266 - RNA, 32 nt, Human
cagcacuuugggaggccgaggcgggcggauga

SEQ ID NO: 351267 - RNA, 32 nt, Human
cagcacuuugggaggccgaggcgggcggcuca

SEQ ID NO: 351268 - RNA, 32 nt, Human
cagcacuuugggaggccgaggcgggcggguca

SEQ ID NO: 351269 - RNA, 32 nt, Human
cagcacuuugggaggccgaggcgggugaauca

SEQ ID NO: 351270 - RNA, 32 nt, Human
cagcacuuugggaggccgaggcgggugaucac

SEQ ID NO: 351271 - RNA, 32 nt, Human
cagcacuuugggaggccgaggcguguggauca

SEQ ID NO: 351272 - RNA, 32 nt, Human
cagcacuuugggaggccgaggcuggcggauca

SEQ ID NO: 351273 - RNA, 32 nt, Human
cagcacuuugggaggccgaggcugggggauug

SEQ ID NO: 351274 - RNA, 23 nt, Human
cagcacuuugggaggccgagggg

SEQ ID NO: 351275 - RNA, 32 nt, Human
cagcacuuugggaggccgagguaggcagauca

SEQ ID NO: 351276 - RNA, 32 nt, Human
cagcacuuugggaggccgagguaggcggauca

SEQ ID NO: 351277 - RNA, 32 nt, Human
cagcacuuugggaggccgagguaggcggaucu

SEQ ID NO: 351278 - RNA, 32 nt, Human
cagcacuuugggaggccgaggucaggaguugg

SEQ ID NO: 351279 - RNA, 32 nt, Human
cagcacuuugggaggccgaggugagcagauca

SEQ ID NO: 351280 - RNA, 32 nt, Human
cagcacuuugggaggccgaggugagcggauca

SEQ ID NO: 351281 - RNA, 32 nt, Human
cagcacuuugggaggccgaggugaguagauca

SEQ ID NO: 351282 - RNA, 32 nt, Human
cagcacuuugggaggccgaggugcauggauca

SEQ ID NO: 351283 - RNA, 32 nt, Human
cagcacuuugggaggccgaggugggaggauug

SEQ ID NO: 351284 - RNA, 32 nt, Human
cagcacuuugggaggccgaggugggcaaauca

SEQ ID NO: 351285 - RNA, 32 nt, Human
cagcacuuugggaggccgaggugggcaaauua

SEQ ID NO: 351286 - RNA, 32 nt, Human
cagcacuuugggaggccgaggugggcagauca

SEQ ID NO: 351287 - RNA, 32 nt, Human
cagcacuuugggaggccgaggugggcggauca

SEQ ID NO: 351288 - RNA, 32 nt, Human
cagcacuuugggaggccgaggugggcggaucc

SEQ ID NO: 351289 - RNA, 32 nt, Human
cagcacuuugggaggccgaggugggcggguca

SEQ ID NO: 351290 - RNA, 32 nt, Human
cagcacuuugggaggccgagguggguagauac

SEQ ID NO: 351291 - RNA, 32 nt, Human
cagcacuuugggaggccgagguuggaggauca

SEQ ID NO: 351292 - RNA, 32 nt, Human
cagcacuuugggaggccuaggcaggcagacug

SEQ ID NO: 351293 - RNA, 32 nt, Human
cagcacuuugggaggccuaggcgggcagauca

SEQ ID NO: 351294 - RNA, 32 nt, Human
cagcacuuugggaggcggaggcaggcggaucg

SEQ ID NO: 351295 - RNA, 32 nt, Human
cagcacuuugggaggcggaggcaggcggguug

SEQ ID NO: 351296 - RNA, 32 nt, Human
cagcacuuugggaggcggaggugagcagauca

SEQ ID NO: 351297 - RNA, 32 nt, Human
cagcacuuugggaggcuaaggcaggcagauca

SEQ ID NO: 351298 - RNA, 32 nt, Human
cagcacuuugggaggcugaagcaggcagauca

SEQ ID NO: 351299 - RNA, 32 nt, Human
cagcacuuugggaggcugagacaggcagauca

SEQ ID NO: 351300 - RNA, 32 nt, Human
cagcacuuugggaggcugagacgggcagauca

SEQ ID NO: 351301 - RNA, 32 nt, Human
cagcacuuugggaggcugaggaaggcaaauca

SEQ ID NO: 351302 - RNA, 32 nt, Human
cagcacuuugggaggcugaggaaggcagaucu

SEQ ID NO: 351303 - RNA, 32 nt, Human
cagcacuuugggaggcugaggagagcagauca

SEQ ID NO: 351304 - RNA, 32 nt, Human
cagcacuuugggaggcugaggagggcagauca

SEQ ID NO: 351305 - RNA, 32 nt, Human
cagcacuuugggaggcugaggcaagcggauca

SEQ ID NO: 351306 - RNA, 32 nt, Human
cagcacuuugggaggcugaggcaggcagauca

SEQ ID NO: 351307 - RNA, 32 nt, Human
cagcacuuugggaggcugaggcaggcggacac

SEQ ID NO: 351308 - RNA, 32 nt, Human
cagcacuuugggaggcugaggcaggcggauca

SEQ ID NO: 351309 - RNA, 32 nt, Human
cagcacuuugggaggcugaggcaggcggguca

SEQ ID NO: 351310 - RNA, 32 nt, Human
cagcacuuugggaggcugaggcagguagcuca

SEQ ID NO: 351311 - RNA, 32 nt, Human
cagcacuuugggaggcugaggcaggugaauca

SEQ ID NO: 351312 - RNA, 32 nt, Human
cagcacuuugggaggcugaggccggcagauca

SEQ ID NO: 351313 - RNA, 32 nt, Human
cagcacuuugggaggcugaggcgggcaaaaca

SEQ ID NO: 351314 - RNA, 32 nt, Human
cagcacuuugggaggcugaggcgggcagauca

SEQ ID NO: 351315 - RNA, 32 nt, Human
cagcacuuugggaggcugaggcgggcagauug

SEQ ID NO: 351316 - RNA, 32 nt, Human
cagcacuuugggaggcugaggcgggcgaauca

SEQ ID NO: 351317 - RNA, 32 nt, Human
cagcacuuugggaggcugaggcgggcggaaca

SEQ ID NO: 351318 - RNA, 32 nt, Human
cagcacuuugggaggcugaggcgggcggauca

SEQ ID NO: 351319 - RNA, 32 nt, Human
cagcacuuugggaggcugaggcgggugaauca

SEQ ID NO: 351320 - RNA, 32 nt, Human
cagcacuuugggaggcugaggcggucagauca

SEQ ID NO: 351321 - RNA, 32 nt, Human
cagcacuuugggaggcugaggcuggcagauca

SEQ ID NO: 351322 - RNA, 32 nt, Human
cagcacuuugggaggcugaggcuggcgaauca

SEQ ID NO: 351323 - RNA, 32 nt, Human
cagcacuuugggaggcugaggcugggggauca

SEQ ID NO: 351324 - RNA, 32 nt, Human
cagcacuuugggaggcugagguaggcagauca

SEQ ID NO: 351325 - RNA, 32 nt, Human
cagcacuuugggaggcugagguggacagauca

SEQ ID NO: 351326 - RNA, 32 nt, Human
cagcacuuugggaggcugaggugggagaauug

SEQ ID NO: 351327 - RNA, 32 nt, Human
cagcacuuugggaggcugaggugggaggguug

SEQ ID NO: 351328 - RNA, 32 nt, Human
cagcacuuugggaggcugaggugggcagauca

SEQ ID NO: 351329 - RNA, 32 nt, Human
cagcacuuugggaggcugaggugggcagaucg

SEQ ID NO: 351330 - RNA, 32 nt, Human
cagcacuuugggaggcugaggugggcagguca

SEQ ID NO: 351331 - RNA, 32 nt, Human
cagcacuuugggaggcugaggugggcgaauca

SEQ ID NO: 351332 - RNA, 32 nt, Human
cagcacuuugggaggcugaggugggcggauca

SEQ ID NO: 351333 - RNA, 32 nt, Human
cagcacuuugggaggcugaggugggcggcuca

SEQ ID NO: 351334 - RNA, 32 nt, Human
cagcacuuugggaggcugagguggguagauua

SEQ ID NO: 351335 - RNA, 32 nt, Human
cagcacuuugggaggcugagguggucagauca

SEQ ID NO: 351336 - RNA, 32 nt, Human
cagcacuuugggaggcugcggcaggcagauug

SEQ ID NO: 351337 - RNA, 32 nt, Human
cagcacuuugggaggcuggggcgagcggauca

SEQ ID NO: 351338 - RNA, 32 nt, Human
cagcacuuugggaggcuguggcaggcagauua

SEQ ID NO: 351339 - RNA, 32 nt, Human
cagcacuuugggagguggaggcggguggauca

SEQ ID NO: 351340 - RNA, 32 nt, Human
cagcacuuugggagguggaggcgugcggauca

SEQ ID NO: 351341 - RNA, 32 nt, Human
cagcacuuugggagguggaggugggcggauca

SEQ ID NO: 351342 - RNA, 32 nt, Human
cagcacuuugugggaaagacagaggugggagg

SEQ ID NO: 351343 - RNA, 32 nt, Human
cagcacuuuugguuugaguuaucugagauugu

SEQ ID NO: 351344 - RNA, 32 nt, Human
cagcagaaaaucuacucuuuagcaauauauaa

SEQ ID NO: 351345 - RNA, 19 nt, Human
cagcagaaagcccccaacc

SEQ ID NO: 351346 - RNA, 32 nt, Human
cagcagaaccauugggaccugaggcaggagug

SEQ ID NO: 351347 - RNA, 17 nt, Human
cagcagaacgcuggcau

SEQ ID NO: 351348 - RNA, 32 nt, Human
cagcagaagaaacaaacuaaaugagugagcgg

SEQ ID NO: 351349 - RNA, 32 nt, Human
cagcagaagaaagaagaagguguugggguagg

SEQ ID NO: 351350 - RNA, 32 nt, Human
cagcagaagaaggaacugagcaguugaacucu

SEQ ID NO: 351351 - RNA, 32 nt, Human
cagcagaagauuaagagcugagggccuccuuu

SEQ ID NO: 351352 - RNA, 21 nt, Human
cagcagaagcagaugcaccug

SEQ ID NO: 351353 - RNA, 32 nt, Human
cagcagaagcagcacaagacccccaagcaucg

SEQ ID NO: 351354 - RNA, 21 nt, Human
cagcagaagcagcagcagcag

SEQ ID NO: 351355 - RNA, 32 nt, Human
cagcagaagccuucauacaacaugacgaaaca

SEQ ID NO: 351356 - RNA, 32 nt, Human
cagcagaaggagcugcggaaucagggcucaac

SEQ ID NO: 351357 - RNA, 31 nt, Human
cagcagaagguuagagaaaaagagauugcau

SEQ ID NO: 351358 - RNA, 32 nt, Human
cagcagaagguuagagaaaaagagauugcaua

SEQ ID NO: 351359 - RNA, 32 nt, Human
cagcagaauuuucuccccgucuuccccuuccu

SEQ ID NO: 351360 - RNA, 32 nt, Human
cagcagacaaggagaagagcaaggguucccuc

SEQ ID NO: 351361 - RNA, 32 nt, Human
cagcagacaauccaggcugaugcuuuugcuga

SEQ ID NO: 351362 - RNA, 32 nt, Human
cagcagacaucaaggaccugggcagaugggcc

SEQ ID NO: 351363 - RNA, 32 nt, Human
cagcagacaugauggggagagccuucuaauaa

SEQ ID NO: 351364 - RNA, 32 nt, Human
cagcagaccagccuggccaaugccuaugggug

SEQ ID NO: 351365 - RNA, 32 nt, Human
cagcagaccaggagacuggucccaagguuacu

SEQ ID NO: 351366 - RNA, 21 nt, Human
cagcagacccagcagcagcag

SEQ ID NO: 351367 - RNA, 32 nt, Human
cagcagacccucagccccuccuaggcccugua

SEQ ID NO: 351368 - RNA, 32 nt, Human
cagcagacgccccuuuccuccuggugcccuga

SEQ ID NO: 351369 - RNA, 32 nt, Human
cagcagacucaggcccuccaugguccucuuug

SEQ ID NO: 351370 - RNA, 32 nt, Human
cagcagacucuccagcccucuuccuccuuccu

SEQ ID NO: 351371 - RNA, 32 nt, Human
cagcagagaagaccuccaguauaucgcaggcc

SEQ ID NO: 351372 - RNA, 32 nt, Human
cagcagagagcagagagcagaaagcaguccua

SEQ ID NO: 351373 - RNA, 32 nt, Human
cagcagagaggccagagguagcuggugauacc

SEQ ID NO: 351374 - RNA, 32 nt, Human
cagcagagcaaacugcuuuccagccugaagcc

SEQ ID NO: 351375 - RNA, 20 nt, Human
cagcagagcacucccuccca

SEQ ID NO: 351376 - RNA, 32 nt, Human
cagcagagcagaggagaauuguacauuugggg

SEQ ID NO: 351377 - RNA, 32 nt, Human
cagcagagcaugggugacagugggagcacacg

SEQ ID NO: 351378 - RNA, 32 nt, Human
cagcagagccaggagagguugggugacaccca

SEQ ID NO: 351379 - RNA, 32 nt, Human
cagcagagccgggugugguggggacccgggag

SEQ ID NO: 351380 - RNA, 32 nt, Human
cagcagaggaagcacgggcagcagcccuuacc

SEQ ID NO: 351381 - RNA, 18 nt, Human
cagcagaggauuggcaua

SEQ ID NO: 351382 - RNA, 32 nt, Human
cagcagaggccuccccugucaaggcuucccgu

SEQ ID NO: 351383 - RNA, 32 nt, Human
cagcagagggccggccacaagcgaguguccuu

SEQ ID NO: 351384 - RNA, 23 nt, Human
cagcagaguccugccuccuccca

SEQ ID NO: 351385 - RNA, 23 nt, Human
cagcagaguugaaaauugccucc

SEQ ID NO: 351386 - RNA, 32 nt, Human
cagcagaguugaguguugcaacagaaaccuau

SEQ ID NO: 351387 - RNA, 32 nt, Human
cagcagauaggagagcacugagcccggauagu

SEQ ID NO: 351388 - RNA, 32 nt, Human
cagcagaucaaaugguaaaugaggauagucag

SEQ ID NO: 351389 - RNA, 32 nt, Human
cagcagaucaacaggauggagcucuucaugac

SEQ ID NO: 351390 - RNA, 21 nt, Human
cagcagaucucagcagcccag

SEQ ID NO: 351391 - RNA, 32 nt, Human
cagcagaugaccaccaggcaggcucgggcgac

SEQ ID NO: 351392 - RNA, 23 nt, Human
cagcagaugauauugugcaguua

SEQ ID NO: 351393 - RNA, 32 nt, Human
cagcagaugcagaggacagaggccugggucuc

SEQ ID NO: 351394 - RNA, 23 nt, Human
cagcagcaaaugccacucugggc

SEQ ID NO: 351395 - RNA, 32 nt, Human
cagcagcaacacaggagaucaucuguccauuu

SEQ ID NO: 351396 - RNA, 24 nt, Human
cagcagcaacaccagcagcagcag

SEQ ID NO: 351397 - RNA, 32 nt, Human
cagcagcaacaguuuguguaccagucuaccac

SEQ ID NO: 351398 - RNA, 26 nt, Human
cagcagcaagagcccaggccccgggc

SEQ ID NO: 351399 - RNA, 22 nt, Human
cagcagcaaggacccugacgcu

SEQ ID NO: 351400 - RNA, 32 nt, Human
cagcagcaagggcagcagaguugggugcuaag

SEQ ID NO: 351401 - RNA, 24 nt, Human
cagcagcaauugcagcagcagcag

SEQ ID NO: 351402 - RNA, 32 nt, Human
cagcagcacaaccuugaccagagcuugggucc

SEQ ID NO: 351403 - RNA, 32 nt, Human
cagcagcacacagcaaccagucucucagcggg

SEQ ID NO: 351404 - RNA, 25 nt, Human
cagcagcacaugccacguucuaagc

SEQ ID NO: 351405 - RNA, 32 nt, Human
cagcagcacaugcgggucaucuucccagaagu

SEQ ID NO: 351406 - RNA, 32 nt, Human
cagcagcaccaccaccaccaccaccaccaccu

SEQ ID NO: 351407 - RNA, 22 nt, Human
cagcagcaccaguugacugcuc

SEQ ID NO: 351408 - RNA, 25 nt, Human
cagcagcacccccugcacgcugagc

SEQ ID NO: 351409 - RNA, 32 nt, Human
cagcagcacccugcaagccagccuggccagcu

SEQ ID NO: 351410 - RNA, 23 nt, Human
cagcagcacccuuccccugaggc

SEQ ID NO: 351411 - RNA, 32 nt, Human
cagcagcaccgagcuuuacaguguggaucagg

SEQ ID NO: 351412 - RNA, 21 nt, Human
cagcagcacucacaucccggc

SEQ ID NO: 351413 - RNA, 32 nt, Human
cagcagcacugagcucccacccgcagagccuc

SEQ ID NO: 351414 - RNA, 20 nt, Human
cagcagcagaaagcucaaag

SEQ ID NO: 351415 - RNA, 32 nt, Human
cagcagcagaagcagauauugggugaaagacu

SEQ ID NO: 351416 - RNA, 21 nt, Human
cagcagcagaagcagcagcag

SEQ ID NO: 351417 - RNA, 21 nt, Human
cagcagcagagcgcccugagg

SEQ ID NO: 351418 - RNA, 32 nt, Human
cagcagcagaggggcccuagagcccccacaga

SEQ ID NO: 351419 - RNA, 32 nt, Human
cagcagcagcacacaaaugacaagaagcggag

SEQ ID NO: 351420 - RNA, 32 nt, Human
cagcagcagcaccaccaccaccaccaccacca

SEQ ID NO: 351421 - RNA, 24 nt, Human
cagcagcagcaccagcagcaacag

SEQ ID NO: 351422 - RNA, 32 nt, Human
cagcagcagcagagagcagagagcagaaagca

SEQ ID NO: 351423 - RNA, 32 nt, Human
cagcagcagcagaggcagcagcgggcggcgcu

SEQ ID NO: 351424 - RNA, 32 nt, Human
cagcagcagcagcaaccacuagccuccugccc

SEQ ID NO: 351425 - RNA, 32 nt, Human
cagcagcagcagcaccaccaccaccaccacca

SEQ ID NO: 351426 - RNA, 18 nt, Human
cagcagcagcagcagcgg

SEQ ID NO: 351427 - RNA, 32 nt, Human
cagcagcagcagcaggcgaggaggaagauggc

SEQ ID NO: 351428 - RNA, 31 nt, Human
cagcagcagcagccggcgaggagggagcagc

SEQ ID NO: 351429 - RNA, 32 nt, Human
cagcagcagcaggucuggagggcugagaauga

SEQ ID NO: 351430 - RNA, 32 nt, Human
cagcagcagccacccucucucccagucaagug

SEQ ID NO: 351431 - RNA, 21 nt, Human
cagcagcagcccgaggccuga

SEQ ID NO: 351432 - RNA, 32 nt, Human
cagcagcagccgcggcugcggcugcaguggug

SEQ ID NO: 351433 - RNA, 20 nt, Human
cagcagcagccugaggcuga

SEQ ID NO: 351434 - RNA, 32 nt, Human
cagcagcagccuggcugccuugucauggccuc

SEQ ID NO: 351435 - RNA, 32 nt, Human
cagcagcagccuguguaucugcccccgggaaa

SEQ ID NO: 351436 - RNA, 20 nt, Human
cagcagcagcugacccaggc

SEQ ID NO: 351437 - RNA, 32 nt, Human
cagcagcagcuguggcagcacgcccagcgcca

SEQ ID NO: 351438 - RNA, 32 nt, Human
cagcagcaggauucugcagcuccuuuugugcc

SEQ ID NO: 351439 - RNA, 32 nt, Human
cagcagcaggcagaugaugcagaggagcgagc

SEQ ID NO: 351440 - RNA, 32 nt, Human
cagcagcaggcgcgcccuuccggccgcgagcu

SEQ ID NO: 351441 - RNA, 32 nt, Human
cagcagcagguacguacccaaccaugggcucg

SEQ ID NO: 351442 - RNA, 21 nt, Human
cagcagcaggugccugaacuc

SEQ ID NO: 351443 - RNA, 32 nt, Human
cagcagcagguuguggagguggccaugacagu

SEQ ID NO: 351444 - RNA, 32 nt, Human
cagcagcaguaucuuguucucuaauucauaga

SEQ ID NO: 351445 - RNA, 32 nt, Human
cagcagcagucacuguaacagacugccacaua

SEQ ID NO: 351446 - RNA, 24 nt, Human
cagcagcagucccagcagcagcag

SEQ ID NO: 351447 - RNA, 32 nt, Human
cagcagcaguuucaaguaagucgugcaguaaa

SEQ ID NO: 351448 - RNA, 32 nt, Human
cagcagcauaaauguaagcuuuuauaucauaa

SEQ ID NO: 351449 - RNA, 23 nt, Human
cagcagcauaauuccauccuagg

SEQ ID NO: 351450 - RNA, 32 nt, Human
cagcagcauaccaaaugcguucucuaaguucc

SEQ ID NO: 351451 - RNA, 21 nt, Human
cagcagcaucccaccccuggg

SEQ ID NO: 351452 - RNA, 23 nt, Human
cagcagcauccccuaccccaggc

SEQ ID NO: 351453 - RNA, 24 nt, Human
cagcagcauccgccaugucccagc

SEQ ID NO: 351454 - RNA, 19 nt, Human
cagcagcauccgccgccug

SEQ ID NO: 351455 - RNA, 32 nt, Human
cagcagcauccuccucucuggccuugccccag

SEQ ID NO: 351456 - RNA, 32 nt, Human
cagcagcaucucagccuccuacccacaauucc

SEQ ID NO: 351457 - RNA, 32 nt, Human
cagcagcaucuuaaagcacauccacagguuac

SEQ ID NO: 351458 - RNA, 23 nt, Human
cagcagcaugagggucccgaggc

SEQ ID NO: 351459 - RNA, 32 nt, Human
cagcagcaugcugagguguccauguugucugc

SEQ ID NO: 351460 - RNA, 32 nt, Human
cagcagcauuacaagcaugcugucaggcagag

SEQ ID NO: 351461 - RNA, 21 nt, Human
cagcagcauucaggccugggc

SEQ ID NO: 351462 - RNA, 32 nt, Human
cagcagccaaccugccaacaccuacugacacu

SEQ ID NO: 351463 - RNA, 19 nt, Human
cagcagccacagcuggggc

SEQ ID NO: 351464 - RNA, 32 nt, Human
cagcagccaccagggaagaggcagggagggag

SEQ ID NO: 351465 - RNA, 32 nt, Human
cagcagccacccugcagcaucugcccacgaac

SEQ ID NO: 351466 - RNA, 32 nt, Human
cagcagccaccgcacaacaccccugguggaag

SEQ ID NO: 351467 - RNA, 20 nt, Human
cagcagccacgacagcacca

SEQ ID NO: 351468 - RNA, 32 nt, Human
cagcagccacuaacaaacacacaacuggugug

SEQ ID NO: 351469 - RNA, 32 nt, Human
cagcagccagcaggcugggggagcagugaggg

SEQ ID NO: 351470 - RNA, 18 nt, Human
cagcagccagcccccucc

SEQ ID NO: 351471 - RNA, 32 nt, Human
cagcagccagcuaccccacuguguggcuggug

SEQ ID NO: 351472 - RNA, 32 nt, Human
cagcagccagcuaucucccacacccacggcug

SEQ ID NO: 351473 - RNA, 32 nt, Human
cagcagccaggauucuggcugaaggaaaugau

SEQ ID NO: 351474 - RNA, 21 nt, Human
cagcagccaggcuagcaccag

SEQ ID NO: 351475 - RNA, 22 nt, Human
cagcagccaugagcagcuccag

SEQ ID NO: 351476 - RNA, 32 nt, Human
cagcagccauggcgccuugugcagccuccuuu

SEQ ID NO: 351477 - RNA, 32 nt, Human
cagcagccauggguacauggguccccagcuca

SEQ ID NO: 351478 - RNA, 32 nt, Human
cagcagcccaagguggagggugcguggaaaug

SEQ ID NO: 351479 - RNA, 32 nt, Human
cagcagcccaggcuccacucacacaacacucu

SEQ ID NO: 351480 - RNA, 32 nt, Human
cagcagccccaccugcccccagccucugugac

SEQ ID NO: 351481 - RNA, 27 nt, Human
cagcagccccagcagcagcaacuccag

SEQ ID NO: 351482 - RNA, 27 nt, Human
cagcagccccagcagcagcagcuccag

SEQ ID NO: 351483 - RNA, 24 nt, Human
cagcagccccagcaguagcuccag

SEQ ID NO: 351484 - RNA, 24 nt, Human
cagcagccccagccccagccccag

SEQ ID NO: 351485 - RNA, 22 nt, Human
cagcagccccaggcaguaccag

SEQ ID NO: 351486 - RNA, 24 nt, Human
cagcagccccaguagcagcaacag

SEQ ID NO: 351487 - RNA, 24 nt, Human
cagcagccccaguagcagcagcag

SEQ ID NO: 351488 - RNA, 24 nt, Human
cagcagccccaguagcagcuccag

SEQ ID NO: 351489 - RNA, 24 nt, Human
cagcagccccaguaguagcagcag

SEQ ID NO: 351490 - RNA, 32 nt, Human
cagcagccccuccaagggccagggcaccuggg

SEQ ID NO: 351491 - RNA, 32 nt, Human
cagcagccccuccacaggcgcccccaccacag

SEQ ID NO: 351492 - RNA, 32 nt, Human
cagcagccccucccaucacaggcucagggacc

SEQ ID NO: 351493 - RNA, 22 nt, Human
cagcagccccucuuucaccuca

SEQ ID NO: 351494 - RNA, 32 nt, Human
cagcagccccugcgccaacaccaccuucugcu

SEQ ID NO: 351495 - RNA, 23 nt, Human
cagcagccccugggcagcaccag

SEQ ID NO: 351496 - RNA, 32 nt, Human
cagcagcccugcacuccacgcuggccaagaag

SEQ ID NO: 351497 - RNA, 32 nt, Human
cagcagcccugccugugaagcucuuguuucug

SEQ ID NO: 351498 - RNA, 32 nt, Human
cagcagcccuggacacuggcaauggacggccu

SEQ ID NO: 351499 - RNA, 32 nt, Human
cagcagcccuggacaguggcccccagcaguca

SEQ ID NO: 351500 - RNA, 32 nt, Human
cagcagcccuggacggcggugaguccccucag

SEQ ID NO: 351501 - RNA, 32 nt, Human
cagcagcccuggagagcagcagggggccuuca

SEQ ID NO: 351502 - RNA, 32 nt, Human
cagcagcccugggggugggugcaaugaggaug

SEQ ID NO: 351503 - RNA, 32 nt, Human
cagcagcccuugccagaugugccagggagugg

SEQ ID NO: 351504 - RNA, 32 nt, Human
cagcagccgcccggcuggcugcagaggccgag

SEQ ID NO: 351505 - RNA, 19 nt, Human
cagcagccgcucccgcucc

SEQ ID NO: 351506 - RNA, 32 nt, Human
cagcagccggguaggccucaccagaggcuccu

SEQ ID NO: 351507 - RNA, 32 nt, Human
cagcagccgguucuggguagcagaucaauuuc

SEQ ID NO: 351508 - RNA, 32 nt, Human
cagcagccgucacagccgccuccugagaugcc

SEQ ID NO: 351509 - RNA, 32 nt, Human
cagcagccuagacaggcccaggucuugccuca

SEQ ID NO: 351510 - RNA, 32 nt, Human
cagcagccucaacaggcacagcuccucccuca

SEQ ID NO: 351511 - RNA, 32 nt, Human
cagcagccucaacucuugccuccuuggaagaa

SEQ ID NO: 351512 - RNA, 32 nt, Human
cagcagccucacuagccccaccgucagucuuc

SEQ ID NO: 351513 - RNA, 32 nt, Human
cagcagccuccgcagucccuccagagacaugg

SEQ ID NO: 351514 - RNA, 32 nt, Human
cagcagccucuacacacccagcuccugccacc

SEQ ID NO: 351515 - RNA, 32 nt, Human
cagcagccucugcucuguggcuccauucaggc

SEQ ID NO: 351516 - RNA, 20 nt, Human
cagcagccugaggugguguc

SEQ ID NO: 351517 - RNA, 32 nt, Human
cagcagccugcagcccaggcaccccgcacccc

SEQ ID NO: 351518 - RNA, 32 nt, Human
cagcagccugccagcaguuacugugaauguuc

SEQ ID NO: 351519 - RNA, 32 nt, Human
cagcagccuggagaugucagcacucugagggc

SEQ ID NO: 351520 - RNA, 32 nt, Human
cagcagccuuggaagcagggugugcuccucgg

SEQ ID NO: 351521 - RNA, 22 nt, Human
cagcagccuuuaagaagugucc

SEQ ID NO: 351522 - RNA, 32 nt, Human
cagcagcgagaggcagaggcggcggcggcggg

SEQ ID NO: 351523 - RNA, 32 nt, Human
cagcagcgccucagugcccgagcugguccccu

SEQ ID NO: 351524 - RNA, 19 nt, Human
cagcagcgcgcuaugcgcu

SEQ ID NO: 351525 - RNA, 32 nt, Human
cagcagcgcugcaagcuggaggcugcgguggc

SEQ ID NO: 351526 - RNA, 24 nt, Human
cagcagcggcagaggcagcaccag

SEQ ID NO: 351527 - RNA, 21 nt, Human
cagcagcggcagcagcagcag

SEQ ID NO: 351528 - RNA, 24 nt, Human
cagcagcggcagcagcagcagcag

SEQ ID NO: 351529 - RNA, 32 nt, Human
cagcagcggccgcggccgcggugggcacgcac

SEQ ID NO: 351530 - RNA, 32 nt, Human
cagcagcggcggaguccaggaggagagcugga

SEQ ID NO: 351531 - RNA, 24 nt, Human
cagcagcggcggcagcagcagcag

SEQ ID NO: 351532 - RNA, 32 nt, Human
cagcagcggcugggaccccacaccuuucacgg

SEQ ID NO: 351533 - RNA, 19 nt, Human
cagcagcgggccgcgacgc

SEQ ID NO: 351534 - RNA, 32 nt, Human
cagcagcgggccgcgacgcccagccugccagu

SEQ ID NO: 351535 - RNA, 32 nt, Human
cagcagcgguggagacucucuccugugugugu

SEQ ID NO: 351536 - RNA, 32 nt, Human
cagcagcguccgcugcgucugcacugaugacc

SEQ ID NO: 351537 - RNA, 32 nt, Human
cagcagcgucuucccgccgcucccucuucucc

SEQ ID NO: 351538 - RNA, 32 nt, Human
cagcagcguggccugaaggccagcgagcccaa

SEQ ID NO: 351539 - RNA, 32 nt, Human
cagcagcguuuggaaagcagguucugugggac

SEQ ID NO: 351540 - RNA, 19 nt, Human
cagcagcuaagcugguuca

SEQ ID NO: 351541 - RNA, 32 nt, Human
cagcagcuacaaagacgacgccggcugcgcuc

SEQ ID NO: 351542 - RNA, 21 nt, Human
cagcagcuaccagcagcccag

SEQ ID NO: 351543 - RNA, 18 nt, Human
cagcagcuaccucaguga

SEQ ID NO: 351544 - RNA, 20 nt, Human
cagcagcuacuugguaguca

SEQ ID NO: 351545 - RNA, 32 nt, Human
cagcagcuagaaaugaaagaguagaagaagag

SEQ ID NO: 351546 - RNA, 32 nt, Human
cagcagcuagaauuuccaggggaaaguacugg

SEQ ID NO: 351547 - RNA, 32 nt, Human
cagcagcuagaugcaugccugaggcagggugg

SEQ ID NO: 351548 - RNA, 24 nt, Human
cagcagcuagugggagagcaccag

SEQ ID NO: 351549 - RNA, 18 nt, Human
cagcagcucaaggugcca

SEQ ID NO: 351550 - RNA, 32 nt, Human
cagcagcucaaggugccaucugccuggcaagc

SEQ ID NO: 351551 - RNA, 24 nt, Human
cagcagcucacgccuguaauccca

SEQ ID NO: 351552 - RNA, 24 nt, Human
cagcagcucaggccuguaaucuca

SEQ ID NO: 351553 - RNA, 20 nt, Human
cagcagcucagucacaguca

SEQ ID NO: 351554 - RNA, 32 nt, Human
cagcagcucaguugaguuagagucuggaagac

SEQ ID NO: 351555 - RNA, 21 nt, Human
cagcagcucaugccuguaauc

SEQ ID NO: 351556 - RNA, 24 nt, Human
cagcagcucaugccuguaauccua

SEQ ID NO: 351557 - RNA, 32 nt, Human
cagcagcuccacccucccaagugacaggccau

SEQ ID NO: 351558 - RNA, 21 nt, Human
cagcagcuccaccuuuaccag

SEQ ID NO: 351559 - RNA, 27 nt, Human
cagcagcuccagcaacagcagcagcag

SEQ ID NO: 351560 - RNA, 20 nt, Human
cagcagcuccagcagcagca

SEQ ID NO: 351561 - RNA, 27 nt, Human
cagcagcuccagcaguuacagcagcag

SEQ ID NO: 351562 - RNA, 32 nt, Human
cagcagcuccagccaccagugcccggucuccc

SEQ ID NO: 351563 - RNA, 32 nt, Human
cagcagcuccagcucagagcagugccagcccc

SEQ ID NO: 351564 - RNA, 19 nt, Human
cagcagcuccagggauguc

SEQ ID NO: 351565 - RNA, 18 nt, Human
cagcagcuccaguguguc

SEQ ID NO: 351566 - RNA, 20 nt, Human
cagcagcuccaucguuugca

SEQ ID NO: 351567 - RNA, 23 nt, Human
cagcagcuccaugagccacacag

SEQ ID NO: 351568 - RNA, 32 nt, Human
cagcagcucccaggaugaacugguugcagugg

SEQ ID NO: 351569 - RNA, 19 nt, Human
cagcagcuccccagcacca

SEQ ID NO: 351570 - RNA, 18 nt, Human
cagcagcucccucccguc

SEQ ID NO: 351571 - RNA, 20 nt, Human
cagcagcuccgcccgcaccg

SEQ ID NO: 351572 - RNA, 20 nt, Human
cagcagcuccgccuggcacc

SEQ ID NO: 351573 - RNA, 21 nt, Human
cagcagcuccgcgcccuccca

SEQ ID NO: 351574 - RNA, 22 nt, Human
cagcagcuccgcgcccucccag

SEQ ID NO: 351575 - RNA, 21 nt, Human
cagcagcuccgugccugcacc

SEQ ID NO: 351576 - RNA, 32 nt, Human
cagcagcuccuccagcugcaccaccuucagca

SEQ ID NO: 351577 - RNA, 21 nt, Human
cagcagcuccucucaagcuca

SEQ ID NO: 351578 - RNA, 19 nt, Human
cagcagcuccugagugcca

SEQ ID NO: 351579 - RNA, 32 nt, Human
cagcagcuccuugaagguccucugccuccagc

SEQ ID NO: 351580 - RNA, 18 nt, Human
cagcagcuccuuucugca

SEQ ID NO: 351581 - RNA, 21 nt, Human
cagcagcucuaccaugguguc

SEQ ID NO: 351582 - RNA, 32 nt, Human
cagcagcucugcaaccuccgcuccaccacuga

SEQ ID NO: 351583 - RNA, 19 nt, Human
cagcagcucugcuacguca

SEQ ID NO: 351584 - RNA, 19 nt, Human
cagcagcucuggaugcuca

SEQ ID NO: 351585 - RNA, 19 nt, Human
cagcagcucuguuggcuca

SEQ ID NO: 351586 - RNA, 31 nt, Human
cagcagcucuucuccuccaugccaagaccug

SEQ ID NO: 351587 - RNA, 32 nt, Human
cagcagcucuugggaaggacuugcugggaggc

SEQ ID NO: 351588 - RNA, 32 nt, Human
cagcagcugaaccaccugagcaccauccugac

SEQ ID NO: 351589 - RNA, 32 nt, Human
cagcagcugacuccuucuuccaccccucuucu

SEQ ID NO: 351590 - RNA, 19 nt, Human
cagcagcugaugaacguca

SEQ ID NO: 351591 - RNA, 22 nt, Human
cagcagcugcaauagcuccucu

SEQ ID NO: 351592 - RNA, 32 nt, Human
cagcagcugcagcugcuaagauggcccccaac

SEQ ID NO: 351593 - RNA, 32 nt, Human
cagcagcugcagcuguuucacaggcuguccuc

SEQ ID NO: 351594 - RNA, 32 nt, Human
cagcagcugcggacuuguccccggcuggagcc

SEQ ID NO: 351595 - RNA, 32 nt, Human
cagcagcuggacagccauuagaccucagugcc

SEQ ID NO: 351596 - RNA, 32 nt, Human
cagcagcuggaggaggaggaggaggauacgcc

SEQ ID NO: 351597 - RNA, 16 nt, Human
cagcagcuggagucua

SEQ ID NO: 351598 - RNA, 18 nt, Human
cagcagcuggcccagugu

SEQ ID NO: 351599 - RNA, 32 nt, Human
cagcagcuggcuggcuugacuuugccaacugc

SEQ ID NO: 351600 - RNA, 32 nt, Human
cagcagcugggaccccucccaaccucaaugcc

SEQ ID NO: 351601 - RNA, 32 nt, Human
cagcagcugggcagcccccagggcuccuccuc

SEQ ID NO: 351602 - RNA, 32 nt, Human
cagcagcugggcuggggugcaggucaucacag

SEQ ID NO: 351603 - RNA, 18 nt, Human
cagcagcugucggugccg

SEQ ID NO: 351604 - RNA, 32 nt, Human
cagcagcugucuggcccuugcugggugagggc

SEQ ID NO: 351605 - RNA, 32 nt, Human
cagcagcugugaagggcauccugaccugcaug

SEQ ID NO: 351606 - RNA, 32 nt, Human
cagcagcugugcgagcucugcugcgacacgga

SEQ ID NO: 351607 - RNA, 32 nt, Human
cagcagcugugcgagcucugcugugaugcaga

SEQ ID NO: 351608 - RNA, 20 nt, Human
cagcagcuuaauggauuuca

SEQ ID NO: 351609 - RNA, 20 nt, Human
cagcagcuuacaugaucuca

SEQ ID NO: 351610 - RNA, 32 nt, Human
cagcagcuuacaugaucucauugacaauucca

SEQ ID NO: 351611 - RNA, 32 nt, Human
cagcagcuucacuaaggugggauggauagcag

SEQ ID NO: 351612 - RNA, 20 nt, Human
cagcagcuucuccacuguca

SEQ ID NO: 351613 - RNA, 32 nt, Human
cagcagcuucucggaagaggaggaggacgagg

SEQ ID NO: 351614 - RNA, 32 nt, Human
cagcagcuuggccugcaccaaguccuccauca

SEQ ID NO: 351615 - RNA, 32 nt, Human
cagcagcuugggaggcugaggcuggagaaugg

SEQ ID NO: 351616 - RNA, 20 nt, Human
cagcagcuuguacugccuuu

SEQ ID NO: 351617 - RNA, 20 nt, Human
cagcagcuugucuggcguca

SEQ ID NO: 351618 - RNA, 20 nt, Human
cagcagcuuguugguuguca

SEQ ID NO: 351619 - RNA, 32 nt, Human
cagcaggaaacauagaacucagagccagaucc

SEQ ID NO: 351620 - RNA, 23 nt, Human
cagcaggaaaguacagaugcagc

SEQ ID NO: 351621 - RNA, 23 nt, Human
cagcaggaacaccaaaucccgga

SEQ ID NO: 351622 - RNA, 32 nt, Human
cagcaggaagaaaccccaggaggaagaaaccu

SEQ ID NO: 351623 - RNA, 21 nt, Human
cagcaggaagggaccccugga

SEQ ID NO: 351624 - RNA, 32 nt, Human
cagcaggaauucaaagcugcuugcuguaacug

SEQ ID NO: 351625 - RNA, 32 nt, Human
cagcaggacaaaccaacagguacuccgcaagu

SEQ ID NO: 351626 - RNA, 32 nt, Human
cagcaggacacaaauaguacaugugaaauuuc

SEQ ID NO: 351627 - RNA, 32 nt, Human
cagcaggacagaaaaaccaacgccaccauguc

SEQ ID NO: 351628 - RNA, 32 nt, Human
cagcaggacagcaacagucuuugccgcagccu

SEQ ID NO: 351629 - RNA, 32 nt, Human
cagcaggacaggggaaaggcagcuuuauuuuu

SEQ ID NO: 351630 - RNA, 32 nt, Human
cagcaggacaucugcauauaacacacagccga

SEQ ID NO: 351631 - RNA, 21 nt, Human
cagcaggacccaaaugcagcu

SEQ ID NO: 351632 - RNA, 32 nt, Human
cagcaggaccucucuguauccacuuccuaugg

SEQ ID NO: 351633 - RNA, 19 nt, Human
cagcaggacgacucuugaa

SEQ ID NO: 351634 - RNA, 32 nt, Human
cagcaggacuccagucaccucuaccccagcuc

SEQ ID NO: 351635 - RNA, 32 nt, Human
cagcaggagaagcaguggccagaggggagaua

SEQ ID NO: 351636 - RNA, 32 nt, Human
cagcaggagagaggagagggcagaacaggauc

SEQ ID NO: 351637 - RNA, 30 nt, Human
cagcaggagagccacagagagcacgggagc

SEQ ID NO: 351638 - RNA, 32 nt, Human
cagcaggagagccacagagagcacgggagcuu

SEQ ID NO: 351639 - RNA, 23 nt, Human
cagcaggagaggagagccagaga

SEQ ID NO: 351640 - RNA, 32 nt, Human
cagcaggagaggggagugggcugguucuuccc

SEQ ID NO: 351641 - RNA, 32 nt, Human
cagcaggagaguuccuggaggaaagggacugg

SEQ ID NO: 351642 - RNA, 21 nt, Human
cagcaggagcagcagcagcag

SEQ ID NO: 351643 - RNA, 32 nt, Human
cagcaggagcuuccgccuccucuccacuggag

SEQ ID NO: 351644 - RNA, 32 nt, Human
cagcaggaggagcaggaggagccggaggagga

SEQ ID NO: 351645 - RNA, 32 nt, Human
cagcaggaggcagacagguuucugggcagaag

SEQ ID NO: 351646 - RNA, 32 nt, Human
cagcaggaggccagaggacagagcagaggauc

SEQ ID NO: 351647 - RNA, 19 nt, Human
cagcaggaggccuuugccc

SEQ ID NO: 351648 - RNA, 32 nt, Human
cagcaggaggcugaaggaggggagaacaaaau

SEQ ID NO: 351649 - RNA, 19 nt, Human
cagcaggaggggcgggagg

SEQ ID NO: 351650 - RNA, 32 nt, Human
cagcaggaggggcgggaggcaccaggguucuu

SEQ ID NO: 351651 - RNA, 32 nt, Human
cagcaggaguaggaaugagaguuagcagccuu

SEQ ID NO: 351652 - RNA, 32 nt, Human
cagcaggagugaccacagggaggggacagcuc

SEQ ID NO: 351653 - RNA, 32 nt, Human
cagcaggagugagagacaaguuuaggauagga

SEQ ID NO: 351654 - RNA, 21 nt, Human
cagcaggauaaacauuccaga

SEQ ID NO: 351655 - RNA, 32 nt, Human
cagcaggauagggagagccccaggacucagga

SEQ ID NO: 351656 - RNA, 23 nt, Human
cagcaggaucugcuggcaggguu

SEQ ID NO: 351657 - RNA, 32 nt, Human
cagcaggaugaaacgaggaggaagagauagug

SEQ ID NO: 351658 - RNA, 32 nt, Human
cagcaggaugguggguguucagccugaaugcc

SEQ ID NO: 351659 - RNA, 32 nt, Human
cagcaggauguggcagaacaucacaagcagau

SEQ ID NO: 351660 - RNA, 25 nt, Human
cagcaggcacaaaccauggguccag

SEQ ID NO: 351661 - RNA, 18 nt, Human
cagcaggcagaaaugcug

SEQ ID NO: 351662 - RNA, 32 nt, Human
cagcaggcagaggcgcguccucgaccccaagg

SEQ ID NO: 351663 - RNA, 20 nt, Human
cagcaggcagaugaccagag

SEQ ID NO: 351664 - RNA, 18 nt, Human
cagcaggcagcucuggaa

SEQ ID NO: 351665 - RNA, 32 nt, Human
cagcaggcagcuucuacuccugccucaugcau

SEQ ID NO: 351666 - RNA, 32 nt, Human
cagcaggcaggcaagcaggcaucagcuccggc

SEQ ID NO: 351667 - RNA, 32 nt, Human
cagcaggcaggcuggggaggccaguguugugg

SEQ ID NO: 351668 - RNA, 22 nt, Human
cagcaggccacauggcuggcca

SEQ ID NO: 351669 - RNA, 32 nt, Human
cagcaggccagaccagucucccaggaggcuga

SEQ ID NO: 351670 - RNA, 17 nt, Human
cagcaggccauggcugg

SEQ ID NO: 351671 - RNA, 32 nt, Human
cagcaggcccagaucagcuuugcacauggugc

SEQ ID NO: 351672 - RNA, 32 nt, Human
cagcaggcccaggaggaaggauacacuacccc

SEQ ID NO: 351673 - RNA, 32 nt, Human
cagcaggcccaguucuggaaaggccaggaugu

SEQ ID NO: 351674 - RNA, 19 nt, Human
cagcaggccccgagccccu

SEQ ID NO: 351675 - RNA, 32 nt, Human
cagcaggcccucagccuggaagaggccccuug

SEQ ID NO: 351676 - RNA, 32 nt, Human
cagcaggccucugggguccagccugggagccc

SEQ ID NO: 351677 - RNA, 21 nt, Human
cagcaggccugguugcagcug

SEQ ID NO: 351678 - RNA, 32 nt, Human
cagcaggccuuaccugcacuccaggcuccuuc

SEQ ID NO: 351679 - RNA, 32 nt, Human
cagcaggcgccaagcacccaacuccagagaug

SEQ ID NO: 351680 - RNA, 32 nt, Human
cagcaggcgcccagaagcuccaccuccacccc

SEQ ID NO: 351681 - RNA, 22 nt, Human
cagcaggcggcugcagcaggug

SEQ ID NO: 351682 - RNA, 32 nt, Human
cagcaggcgucugaggccugcccacuaaggag

SEQ ID NO: 351683 - RNA, 32 nt, Human
cagcaggcucaggccggcucagggcucagagu

SEQ ID NO: 351684 - RNA, 32 nt, Human
cagcaggcuuugacugacgcuguuuagucuuu

SEQ ID NO: 351685 - RNA, 32 nt, Human
cagcagggacacugacgucaggacccgagccu

SEQ ID NO: 351686 - RNA, 32 nt, Human
cagcagggacauaguggggcugggcagggaug

SEQ ID NO: 351687 - RNA, 32 nt, Human
cagcagggagagagcaggguuuccagacaggc

SEQ ID NO: 351688 - RNA, 32 nt, Human
cagcagggagaucagcgaagaggcuggaaugg

SEQ ID NO: 351689 - RNA, 32 nt, Human
cagcagggagcuagcaggacacuaggaccagu

SEQ ID NO: 351690 - RNA, 32 nt, Human
cagcagggaggcagcucuggagggagccgcug

SEQ ID NO: 351691 - RNA, 17 nt, Human
cagcagggagucuugaa

SEQ ID NO: 351692 - RNA, 32 nt, Human
cagcagggcacgccuggcuuuccuuggauacc

SEQ ID NO: 351693 - RNA, 32 nt, Human
cagcagggcaggcagggguuggagugggcaua

SEQ ID NO: 351694 - RNA, 32 nt, Human
cagcagggcccaaacucauacucccagcccuu

SEQ ID NO: 351695 - RNA, 32 nt, Human
cagcagggccuucugcuugccugcugccauac

SEQ ID NO: 351696 - RNA, 32 nt, Human
cagcagggccuugccagcaaagcccagggccu

SEQ ID NO: 351697 - RNA, 32 nt, Human
cagcagggcgcucugcccucccuccuuccuuc

SEQ ID NO: 351698 - RNA, 32 nt, Human
cagcaggggacucugcccucccuccuuccuuu

SEQ ID NO: 351699 - RNA, 32 nt, Human
cagcaggggaggagggccugcugagagacucu

SEQ ID NO: 351700 - RNA, 32 nt, Human
cagcaggggcugggccccacgcucacacucgu

SEQ ID NO: 351701 - RNA, 32 nt, Human
cagcaggggcuggggucuucuccugaagccug

SEQ ID NO: 351702 - RNA, 32 nt, Human
cagcaggggucuggggcacggagccuugccgg

SEQ ID NO: 351703 - RNA, 32 nt, Human
cagcagggucugagagaggagccacagucccu

SEQ ID NO: 351704 - RNA, 31 nt, Human
cagcagggugacuugccucagaggcuauauc

SEQ ID NO: 351705 - RNA, 32 nt, Human
cagcaggguggcagggcagaagagucuggucc

SEQ ID NO: 351706 - RNA, 32 nt, Human
cagcagguagagcagagccggagccaggugca

SEQ ID NO: 351707 - RNA, 32 nt, Human
cagcagguagaggaaucaaagccagcagcauc

SEQ ID NO: 351708 - RNA, 19 nt, Human
cagcagguaggggcacagu

SEQ ID NO: 351709 - RNA, 24 nt, Human
cagcaggucaaaaaggccaacaca

SEQ ID NO: 351710 - RNA, 22 nt, Human
cagcaggucaaagcaggaucag

SEQ ID NO: 351711 - RNA, 21 nt, Human
cagcaggucagaagccagagc

SEQ ID NO: 351712 - RNA, 22 nt, Human
cagcaggucagagcaggcgagc

SEQ ID NO: 351713 - RNA, 22 nt, Human
cagcaggucagaguaggaacag

SEQ ID NO: 351714 - RNA, 32 nt, Human
cagcagguccucugugguucucugccucuggu

SEQ ID NO: 351715 - RNA, 32 nt, Human
cagcaggugaggcugaaaguuccaagccucaa

SEQ ID NO: 351716 - RNA, 21 nt, Human
cagcaggugcaacagcagcug

SEQ ID NO: 351717 - RNA, 23 nt, Human
cagcagguggagagcagcagcug

SEQ ID NO: 351718 - RNA, 20 nt, Human
cagcagguggagguugcagu

SEQ ID NO: 351719 - RNA, 32 nt, Human
cagcagguggaguaggcacagauggaaaacug

SEQ ID NO: 351720 - RNA, 18 nt, Human
cagcagguggcacugcag

SEQ ID NO: 351721 - RNA, 20 nt, Human
cagcagguggcacugcagcu

SEQ ID NO: 351722 - RNA, 22 nt, Human
cagcagguggcagcaguaguua

SEQ ID NO: 351723 - RNA, 20 nt, Human
cagcagguggcgcaggcggu

SEQ ID NO: 351724 - RNA, 32 nt, Human
cagcagguggcgcugccuuccacccaugguga

SEQ ID NO: 351725 - RNA, 21 nt, Human
cagcagguggcuggacugcug

SEQ ID NO: 351726 - RNA, 32 nt, Human
cagcaggugggugggacuaugccaggacggga

SEQ ID NO: 351727 - RNA, 23 nt, Human
cagcagguggguucugaaugcag

SEQ ID NO: 351728 - RNA, 20 nt, Human
cagcagguggucaccuggag

SEQ ID NO: 351729 - RNA, 32 nt, Human
cagcaggugugggugaggggaagguucugaug

SEQ ID NO: 351730 - RNA, 32 nt, Human
cagcagguugucugggguagggggaggcguuu

SEQ ID NO: 351731 - RNA, 24 nt, Human
cagcagguuuauccagaugaacug

SEQ ID NO: 351732 - RNA, 32 nt, Human
cagcaguaaaauggcucugucuucuacaggau

SEQ ID NO: 351733 - RNA, 21 nt, Human
cagcaguaacagcagcagcag

SEQ ID NO: 351734 - RNA, 20 nt, Human
cagcaguaaugcuauguacu

SEQ ID NO: 351735 - RNA, 19 nt, Human
cagcaguaauuauggugca

SEQ ID NO: 351736 - RNA, 32 nt, Human
cagcaguacacaaagcacuuaccuugacuggu

SEQ ID NO: 351737 - RNA, 32 nt, Human
cagcaguacugcugccccaacucgcugugccc

SEQ ID NO: 351738 - RNA, 32 nt, Human
cagcaguagagaaaucacuaggacuacuuuuu

SEQ ID NO: 351739 - RNA, 32 nt, Human
cagcaguaggaaaacgaggagggagggagagg

SEQ ID NO: 351740 - RNA, 32 nt, Human
cagcaguagggaggggcagggguaaggggacc

SEQ ID NO: 351741 - RNA, 32 nt, Human
cagcaguaguacuuuggcaugugucccaggug

SEQ ID NO: 351742 - RNA, 20 nt, Human
cagcaguauagcauauguca

SEQ ID NO: 351743 - RNA, 23 nt, Human
cagcaguaucccggaagcacuca

SEQ ID NO: 351744 - RNA, 18 nt, Human
cagcaguauuuccugguc

SEQ ID NO: 351745 - RNA, 32 nt, Human
cagcagucacuuccaguucauucagcuauuuu

SEQ ID NO: 351746 - RNA, 32 nt, Human
cagcagucagcugucuuugucaaccauacguu

SEQ ID NO: 351747 - RNA, 32 nt, Human
  misc_feature (13)..(13): n is a, c, g or u
cagcagucauugncauccugugaccuuauccc

SEQ ID NO: 351748 - RNA, 32 nt, Human
cagcaguccaggcugaugcaguggcuucaaga

SEQ ID NO: 351749 - RNA, 32 nt, Human
cagcaguccagugcaacgucuccuccauagcu

SEQ ID NO: 351750 - RNA, 19 nt, Human
cagcagucgccuccuccca

SEQ ID NO: 351751 - RNA, 32 nt, Human
cagcagucgcuggccucucccugcccugacac

SEQ ID NO: 351752 - RNA, 32 nt, Human
cagcagucguguugaagaggcagugucaucca

SEQ ID NO: 351753 - RNA, 32 nt, Human
cagcagucuaguucuuuucauuuggaaugaau

SEQ ID NO: 351754 - RNA, 32 nt, Human
cagcagucucacugcgaggccucaaggccucu

SEQ ID NO: 351755 - RNA, 32 nt, Human
cagcagucucugagcaccagggagcaguugcc

SEQ ID NO: 351756 - RNA, 32 nt, Human
cagcagucugcucccaugacccucugcccacu

SEQ ID NO: 351757 - RNA, 32 nt, Human
cagcagugacaucuacaggcagcugcucuaua

SEQ ID NO: 351758 - RNA, 32 nt, Human
cagcagugagagcagaugaggugaaaaggcca

SEQ ID NO: 351759 - RNA, 32 nt, Human
cagcagugccaccgccaccacaccccagaucc

SEQ ID NO: 351760 - RNA, 32 nt, Human
cagcagugcccaggauuaggcaguaccuccug

SEQ ID NO: 351761 - RNA, 32 nt, Human
cagcagugcccgccgccgucaccagcuaugca

SEQ ID NO: 351762 - RNA, 31 nt, Human
cagcagugccucucuagcagcugugcggaau

SEQ ID NO: 351763 - RNA, 29 nt, Human
cagcagugcuugcaggugccugggcuggc

SEQ ID NO: 351764 - RNA, 32 nt, Human
cagcaguggaagccucaagcaagaccagggcc

SEQ ID NO: 351765 - RNA, 32 nt, Human
cagcaguggagcagagggcaaggguggggcau

SEQ ID NO: 351766 - RNA, 32 nt, Human
cagcaguggauaaaggagaggggacccucugg

SEQ ID NO: 351767 - RNA, 22 nt, Human
cagcaguggaucccaugccacu

SEQ ID NO: 351768 - RNA, 32 nt, Human
cagcaguggcaguggugaggccagugcugggc

SEQ ID NO: 351769 - RNA, 32 nt, Human
cagcaguggccuguuuguucucugccuguugc

SEQ ID NO: 351770 - RNA, 21 nt, Human
cagcaguggcgccugguguca

SEQ ID NO: 351771 - RNA, 32 nt, Human
cagcagugggagguggggccuuagugccucac

SEQ ID NO: 351772 - RNA, 32 nt, Human
cagcagugggccugccacccagacacacagag

SEQ ID NO: 351773 - RNA, 32 nt, Human
cagcaguggggcaggagggugccugauuucgg

SEQ ID NO: 351774 - RNA, 32 nt, Human
cagcaguggugcaagguccuucccaggggaac

SEQ ID NO: 351775 - RNA, 23 nt, Human
cagcagugguggcaacuaugccu

SEQ ID NO: 351776 - RNA, 32 nt, Human
cagcagugugcccagacuuguggaaaugaagu

SEQ ID NO: 351777 - RNA, 32 nt, Human
cagcagugugugguauccuacagaucacuauu

SEQ ID NO: 351778 - RNA, 32 nt, Human
cagcaguguuaaccagucauggugcuagauug

SEQ ID NO: 351779 - RNA, 32 nt, Human
cagcaguguugcucagcuccuaccucugugcc

SEQ ID NO: 351780 - RNA, 32 nt, Human
cagcaguuaaagaaugaagaugagacagaccg

SEQ ID NO: 351781 - RNA, 21 nt, Human
cagcaguuacagcagcagcag

SEQ ID NO: 351782 - RNA, 32 nt, Human
cagcaguuacuuuuggagacgauucacugccc

SEQ ID NO: 351783 - RNA, 32 nt, Human
cagcaguuagagagcaaggaaacucucauauu

SEQ ID NO: 351784 - RNA, 21 nt, Human
cagcaguucacgccuguaauc

SEQ ID NO: 351785 - RNA, 24 nt, Human
cagcaguucacgccuguaauccca

SEQ ID NO: 351786 - RNA, 18 nt, Human
cagcaguucagaaaccuc

SEQ ID NO: 351787 - RNA, 32 nt, Human
cagcaguuccuccucuuccuccacgucauccu

SEQ ID NO: 351788 - RNA, 32 nt, Human
cagcaguucucagcccugacagaggugcuuuu

SEQ ID NO: 351789 - RNA, 32 nt, Human
cagcaguucugaugccuugaccccugugauga

SEQ ID NO: 351790 - RNA, 32 nt, Human
cagcaguugaaggaagagagugcauggcaccu

SEQ ID NO: 351791 - RNA, 32 nt, Human
cagcaguugagaccagccugaacaacauggug

SEQ ID NO: 351792 - RNA, 32 nt, Human
cagcaguuucccuguccugugugaaaucaggc

SEQ ID NO: 351793 - RNA, 32 nt, Human
cagcaguuucuccaaaaacaaaaacaaaacac

SEQ ID NO: 351794 - RNA, 23 nt, Human
cagcaguuugggaggccgaaggg

SEQ ID NO: 351795 - RNA, 32 nt, Human
cagcaguuugggaggccgaggcaggcagauca

SEQ ID NO: 351796 - RNA, 32 nt, Human
cagcaguuugggaggccgaggcgagcagauca

SEQ ID NO: 351797 - RNA, 32 nt, Human
cagcaguuugggaggcugaggcgggcggauca

SEQ ID NO: 351798 - RNA, 23 nt, Human
cagcauaaaccugggggcccuca

SEQ ID NO: 351799 - RNA, 32 nt, Human
cagcauaagggaaaugauggagaagggagaau

SEQ ID NO: 351800 - RNA, 32 nt, Human
cagcauaaugacuguguguucugagaaaugca

SEQ ID NO: 351801 - RNA, 32 nt, Human
cagcauacaagcuucugcuccaguaugauaau

SEQ ID NO: 351802 - RNA, 32 nt, Human
cagcauacugcuguuucuucaccagcuucauu

SEQ ID NO: 351803 - RNA, 32 nt, Human
cagcauagacacacacccccugacccuuacca

SEQ ID NO: 351804 - RNA, 19 nt, Human
cagcauagauaccuucaca

SEQ ID NO: 351805 - RNA, 23 nt, Human
cagcauagccccucuaccagggg

SEQ ID NO: 351806 - RNA, 21 nt, Human
cagcauagcccuggccagugg

SEQ ID NO: 351807 - RNA, 32 nt, Human
cagcauagcugcagugucacaaagccauggca

SEQ ID NO: 351808 - RNA, 19 nt, Human
cagcauaguccuggaugca

SEQ ID NO: 351809 - RNA, 21 nt, Human
cagcauaguccugugccaggg

SEQ ID NO: 351810 - RNA, 32 nt, Human
cagcauauaggaucagucgcauugguuauaag

SEQ ID NO: 351811 - RNA, 20 nt, Human
cagcauauccccccucugcc

SEQ ID NO: 351812 - RNA, 32 nt, Human
cagcauaucugugccacacaggaauccaucau

SEQ ID NO: 351813 - RNA, 32 nt, Human
cagcauaucuugagggaagagcauuagugcaa

SEQ ID NO: 351814 - RNA, 32 nt, Human
cagcauauuaaagucauguucuaaagaaaucu

SEQ ID NO: 351815 - RNA, 32 nt, Human
cagcaucaaaggacggacuucaggggacacgu

SEQ ID NO: 351816 - RNA, 32 nt, Human
cagcaucacaggucuaaaugcaucaggaauuc

SEQ ID NO: 351817 - RNA, 18 nt, Human
cagcaucacagucagagg

SEQ ID NO: 351818 - RNA, 32 nt, Human
cagcaucacaucuucugugcucuuuauuuuug

SEQ ID NO: 351819 - RNA, 22 nt, Human
cagcaucacugaucauuagaga

SEQ ID NO: 351820 - RNA, 32 nt, Human
cagcaucacuugaacccaggaggcagagguug

SEQ ID NO: 351821 - RNA, 32 nt, Human
cagcaucagauaugaagacgacagcccuauag

SEQ ID NO: 351822 - RNA, 32 nt, Human
cagcaucagauggggaaaggcaguucuccucu

SEQ ID NO: 351823 - RNA, 32 nt, Human
cagcaucagcaacugggcacagaaaggagccg

SEQ ID NO: 351824 - RNA, 32 nt, Human
cagcaucagcacccggugaaugugguucucuu

SEQ ID NO: 351825 - RNA, 32 nt, Human
cagcaucagccccaauguccagccucuuuaac

SEQ ID NO: 351826 - RNA, 32 nt, Human
cagcaucaggcccacuggguugccccggccag

SEQ ID NO: 351827 - RNA, 19 nt, Human
cagcaucagugacgggagg

SEQ ID NO: 351828 - RNA, 32 nt, Human
cagcaucauacaaguuucacaaaaagaaauca

SEQ ID NO: 351829 - RNA, 32 nt, Human
cagcaucaucacacugacuguggcgcacuggg

SEQ ID NO: 351830 - RNA, 32 nt, Human
cagcaucauccucugcugaccuguuccuugag

SEQ ID NO: 351831 - RNA, 32 nt, Human
cagcaucauggaguccacgaugaagagaaucu

SEQ ID NO: 351832 - RNA, 32 nt, Human
cagcauccagaacgacggaggaaggggcggag

SEQ ID NO: 351833 - RNA, 32 nt, Human
cagcauccagcaugaaguuguaaaguggggau

SEQ ID NO: 351834 - RNA, 23 nt, Human
cagcauccagcuccccaccccca

SEQ ID NO: 351835 - RNA, 32 nt, Human
cagcaucccacaugcauucuuaccaugcugca

SEQ ID NO: 351836 - RNA, 32 nt, Human
cagcaucccagaggaagucgugcaguuucuag

SEQ ID NO: 351837 - RNA, 32 nt, Human
cagcaucccagccucagaagccuucuugcugc

SEQ ID NO: 351838 - RNA, 32 nt, Human
cagcaucccagccuugagaugcuucacuuucc

SEQ ID NO: 351839 - RNA, 32 nt, Human
cagcaucccaggagcccggccugaggggcugg

SEQ ID NO: 351840 - RNA, 32 nt, Human
cagcaucccaggcugguggcaggagcuggggg

SEQ ID NO: 351841 - RNA, 32 nt, Human
cagcaucccagucaccaccagguggcgcuucu

SEQ ID NO: 351842 - RNA, 32 nt, Human
cagcauccccuccacuccagaguuggguggca

SEQ ID NO: 351843 - RNA, 32 nt, Human
cagcauccccuccacuccagaguuggguggua

SEQ ID NO: 351844 - RNA, 18 nt, Human
cagcauccccuccaggga

SEQ ID NO: 351845 - RNA, 32 nt, Human
cagcaucccucgggaaccucacucugaaggga

SEQ ID NO: 351846 - RNA, 32 nt, Human
cagcaucccugccuccugcauccagggcuuag

SEQ ID NO: 351847 - RNA, 32 nt, Human
cagcauccguggggaccagauugccugggugg

SEQ ID NO: 351848 - RNA, 32 nt, Human
cagcauccuaacaaagguacagaaggaccagg

SEQ ID NO: 351849 - RNA, 32 nt, Human
cagcauccuccagcuccaaggcaggcuucccc

SEQ ID NO: 351850 - RNA, 21 nt, Human
cagcauccuccccacccacca

SEQ ID NO: 351851 - RNA, 32 nt, Human
cagcauccuccuugauaaaagcagaaaagcaa

SEQ ID NO: 351852 - RNA, 32 nt, Human
cagcauccugguagcugggacuacaaguguga

SEQ ID NO: 351853 - RNA, 32 nt, Human
cagcaucgacgagcugaagcaccaggagaacc

SEQ ID NO: 351854 - RNA, 32 nt, Human
cagcaucuaacuaaauccucaggauuuauucu

SEQ ID NO: 351855 - RNA, 32 nt, Human
cagcaucuagcagaaagccaggcauggaguag

SEQ ID NO: 351856 - RNA, 32 nt, Human
cagcaucuccacccuccgccccacuccagcca

SEQ ID NO: 351857 - RNA, 32 nt, Human
cagcaucuccaccugccaucucacccucagac

SEQ ID NO: 351858 - RNA, 32 nt, Human
cagcaucuccaccuuccccggaagccucccuu

SEQ ID NO: 351859 - RNA, 32 nt, Human
cagcaucuccaucccccauccagucucaguca

SEQ ID NO: 351860 - RNA, 32 nt, Human
cagcaucucccaucaccaccucuaggacucgg

SEQ ID NO: 351861 - RNA, 32 nt, Human
cagcaucuccuuaaaacagauugggaaagaaa

SEQ ID NO: 351862 - RNA, 32 nt, Human
cagcaucuccuugggguguugguuugcacuuc

SEQ ID NO: 351863 - RNA, 21 nt, Human
cagcaucucgcuggcuacagg

SEQ ID NO: 351864 - RNA, 32 nt, Human
cagcaucucuuaaaauucaauaugaaaagaac

SEQ ID NO: 351865 - RNA, 21 nt, Human
cagcaucugaucaggcuguga

SEQ ID NO: 351866 - RNA, 32 nt, Human
cagcaucugcuccugucccugcuuuuucaccc

SEQ ID NO: 351867 - RNA, 32 nt, Human
cagcaucugcugucagguggcucaggucuuca

SEQ ID NO: 351868 - RNA, 32 nt, Human
cagcaucugguaugcagccaccaggacaagga

SEQ ID NO: 351869 - RNA, 32 nt, Human
cagcaucuguacaaaugcauuuuauuugcuau

SEQ ID NO: 351870 - RNA, 32 nt, Human
cagcaucuguccucucuccucagggaggcaag

SEQ ID NO: 351871 - RNA, 32 nt, Human
cagcaucuucacucaacaaaggaaagaaauug

SEQ ID NO: 351872 - RNA, 25 nt, Human
cagcaucuuccggugacucuggagg

SEQ ID NO: 351873 - RNA, 32 nt, Human
cagcaucuuccucccuccuuuaauuaauggaa

SEQ ID NO: 351874 - RNA, 18 nt, Human
cagcaucuugcagcugga

SEQ ID NO: 351875 - RNA, 32 nt, Human
cagcaucuuucuuuccccaucuuucuauuuuc

SEQ ID NO: 351876 - RNA, 32 nt, Human
cagcaugaaauacauuuagucuccucaaaggg

SEQ ID NO: 351877 - RNA, 32 nt, Human
cagcaugacagaccuccagcauccacgcaucu

SEQ ID NO: 351878 - RNA, 32 nt, Human
cagcaugaccaacauggagaaaccccgucucu

SEQ ID NO: 351879 - RNA, 32 nt, Human
cagcaugaccaacauggagaaccccaucucua

SEQ ID NO: 351880 - RNA, 32 nt, Human
cagcaugaccaacauggcgaaaccccaucucu

SEQ ID NO: 351881 - RNA, 32 nt, Human
cagcaugaccaacauggugaaacccugucucu

SEQ ID NO: 351882 - RNA, 29 nt, Human
cagcaugacugagaaaauguccagcuucc

SEQ ID NO: 351883 - RNA, 32 nt, Human
cagcaugagaacaguggcacaccaccagugag

SEQ ID NO: 351884 - RNA, 32 nt, Human
cagcaugagcccuggggagcuccaaggcugca

SEQ ID NO: 351885 - RNA, 32 nt, Human
cagcaugaggaggccggguucaugcagggucc

SEQ ID NO: 351886 - RNA, 19 nt, Human
cagcaugaggcugggccgg

SEQ ID NO: 351887 - RNA, 29 nt, Human
cagcaugagggagugccuuuccauccaca

SEQ ID NO: 351888 - RNA, 32 nt, Human
cagcaugauguucuugucuuuggagcuuagcc

SEQ ID NO: 351889 - RNA, 32 nt, Human
cagcaugcaaucauuuccaucuuauggaaauc

SEQ ID NO: 351890 - RNA, 32 nt, Human
cagcaugcaauugaccagcuuaagagaaaacu

SEQ ID NO: 351891 - RNA, 32 nt, Human
cagcaugcaugcugggagcugccaagggcuua

SEQ ID NO: 351892 - RNA, 32 nt, Human
cagcaugcccagcuccucccugggugacucgg

SEQ ID NO: 351893 - RNA, 32 nt, Human
cagcaugcccuggggugcaguggucagccacc

SEQ ID NO: 351894 - RNA, 32 nt, Human
cagcaugccuggcugauuuuuguauuuuuagu

SEQ ID NO: 351895 - RNA, 32 nt, Human
cagcaugccugucuaauuuuuguauuuuagua

SEQ ID NO: 351896 - RNA, 32 nt, Human
cagcaugcuacagccuuggacuccugggcuca

SEQ ID NO: 351897 - RNA, 22 nt, Human
cagcaugcuccccgcaacauca

SEQ ID NO: 351898 - RNA, 20 nt, Human
cagcaugcugcaauaccucu

SEQ ID NO: 351899 - RNA, 29 nt, Human
cagcaugcugcacucucaggagucuggca

SEQ ID NO: 351900 - RNA, 32 nt, Human
cagcaugcugcucuccccugggcccggcuuuc

SEQ ID NO: 351901 - RNA, 22 nt, Human
cagcauggaaaucaacauccug

SEQ ID NO: 351902 - RNA, 32 nt, Human
cagcauggaagagaaguguaaccaugcaaaua

SEQ ID NO: 351903 - RNA, 32 nt, Human
cagcauggaaggcaugguggagaugacucaaa

SEQ ID NO: 351904 - RNA, 18 nt, Human
cagcauggacaaaggcuc

SEQ ID NO: 351905 - RNA, 29 nt, Human
cagcauggagccagcacgggaacaggggg

SEQ ID NO: 351906 - RNA, 32 nt, Human
cagcauggagcgagccauacccugccggaucu

SEQ ID NO: 351907 - RNA, 32 nt, Human
cagcauggaggcagauguggggcugagcuggg

SEQ ID NO: 351908 - RNA, 32 nt, Human
cagcauggcacugucuuggcuuacaaaaucug

SEQ ID NO: 351909 - RNA, 32 nt, Human
cagcauggccaacauggugaagccccaucucu

SEQ ID NO: 351910 - RNA, 20 nt, Human
cagcauggccaggcuggcca

SEQ ID NO: 351911 - RNA, 24 nt, Human
cagcauggccaguaaacugagcaa

SEQ ID NO: 351912 - RNA, 32 nt, Human
cagcauggccccagugcugaggcucccacugc

SEQ ID NO: 351913 - RNA, 29 nt, Human
cagcauggccucugcugccucugugacca

SEQ ID NO: 351914 - RNA, 19 nt, Human
cagcauggcgaaacccugu

SEQ ID NO: 351915 - RNA, 29 nt, Human
cagcauggcugcagguugcucagaggcgc

SEQ ID NO: 351916 - RNA, 32 nt, Human
cagcauggcuguuuugaaaaacaggugcaaaa

SEQ ID NO: 351917 - RNA, 32 nt, Human
cagcaugggaaaaugggacuguggaaauaaag

SEQ ID NO: 351918 - RNA, 32 nt, Human
cagcaugggaaacguggcgaaaccccaucucu

SEQ ID NO: 351919 - RNA, 29 nt, Human
cagcaugggcaacugcguggggagacagc

SEQ ID NO: 351920 - RNA, 32 nt, Human
cagcaugggcagggguucuggguaggacgguc

SEQ ID NO: 351921 - RNA, 21 nt, Human
cagcaugggcuguggcaacca

SEQ ID NO: 351922 - RNA, 32 nt, Human
cagcauggggauggcguggcccccagggcggg

SEQ ID NO: 351923 - RNA, 23 nt, Human
cagcauggggcuucagcugcugg

SEQ ID NO: 351924 - RNA, 32 nt, Human
cagcaugggguuuuuauuauguuuuaccuaaa

SEQ ID NO: 351925 - RNA, 21 nt, Human
cagcaugggugaauaagggcu

SEQ ID NO: 351926 - RNA, 16 nt, Human
cagcaugguccucaca

SEQ ID NO: 351927 - RNA, 32 nt, Human
cagcaugguucccuggggcuucccaagagccu

SEQ ID NO: 351928 - RNA, 32 nt, Human
cagcauguaaagagcugggagggcggagaauu

SEQ ID NO: 351929 - RNA, 32 nt, Human
cagcauguacaaaggcccuguggcaagaggga

SEQ ID NO: 351930 - RNA, 32 nt, Human
cagcaugucaacuccauugaaaaacccugcug

SEQ ID NO: 351931 - RNA, 32 nt, Human
cagcauguccaagaaagggaguggaggugcag

SEQ ID NO: 351932 - RNA, 29 nt, Human
cagcauguccgccucggccccugcugcgg

SEQ ID NO: 351933 - RNA, 32 nt, Human
cagcaugugacuggucacuccuggggagagac

SEQ ID NO: 351934 - RNA, 32 nt, Human
cagcaugugccuguaauuccagcuacucggga

SEQ ID NO: 351935 - RNA, 32 nt, Human
cagcaugugcugcugccuuuguaacugcaugg

SEQ ID NO: 351936 - RNA, 32 nt, Human
cagcauguguccuuuuucaucccuucaucuug

SEQ ID NO: 351937 - RNA, 32 nt, Human
cagcaugugugugucucuaucuugcaucuacc

SEQ ID NO: 351938 - RNA, 32 nt, Human
cagcauguguuacugauguguugcugaagauu

SEQ ID NO: 351939 - RNA, 32 nt, Human
cagcauguucucugucugcuccugccuccucc

SEQ ID NO: 351940 - RNA, 32 nt, Human
cagcauguuggccaggcuggucucgaacuccu

SEQ ID NO: 351941 - RNA, 32 nt, Human
cagcauuaaagaaccaauguuauucacuaaua

SEQ ID NO: 351942 - RNA, 32 nt, Human
cagcauuaaucacuaggucacuuugcuugcug

SEQ ID NO: 351943 - RNA, 32 nt, Human
cagcauuacagggagauucuuugcucagcuaa

SEQ ID NO: 351944 - RNA, 32 nt, Human
cagcauuaccugcuggacagagcagggcaggc

SEQ ID NO: 351945 - RNA, 32 nt, Human
cagcauuacuguguugucucugugccagaugu

SEQ ID NO: 351946 - RNA, 32 nt, Human
cagcauuagagauuuuucuguucuugaaaaua

SEQ ID NO: 351947 - RNA, 32 nt, Human
cagcauuaggcagagucccauggacagccuua

SEQ ID NO: 351948 - RNA, 32 nt, Human
cagcauucaagguccucuucuguuaaacccaa

SEQ ID NO: 351949 - RNA, 32 nt, Human
cagcauucaccaucacaccugggaagcaugga

SEQ ID NO: 351950 - RNA, 32 nt, Human
cagcauucacggcgacuuucaggcaagcaggc

SEQ ID NO: 351951 - RNA, 32 nt, Human
cagcauucacugggugugugaaauuccagagc

SEQ ID NO: 351952 - RNA, 32 nt, Human
cagcauucagcaggugcagaucucggcuuuac

SEQ ID NO: 351953 - RNA, 32 nt, Human
cagcauucagcaguugacacaggcuaagaaau

SEQ ID NO: 351954 - RNA, 32 nt, Human
cagcauucagcccagggaaugugguuuucacu

SEQ ID NO: 351955 - RNA, 32 nt, Human
cagcauucaggcugguagagcagaucaccccc

SEQ ID NO: 351956 - RNA, 32 nt, Human
cagcauucauuuccauucauuuccauacuggc

SEQ ID NO: 351957 - RNA, 32 nt, Human
cagcauuccaagaucuuagcccuucccagaac

SEQ ID NO: 351958 - RNA, 32 nt, Human
cagcauuccacagccuggucaggagggaagga

SEQ ID NO: 351959 - RNA, 31 nt, Human
cagcauuccagcuagaagaagcggaacaggg

SEQ ID NO: 351960 - RNA, 24 nt, Human
cagcauuccaucuucccgaucuuc

SEQ ID NO: 351961 - RNA, 32 nt, Human
cagcauucccaaugcagauguuucgggauugu

SEQ ID NO: 351962 - RNA, 32 nt, Human
cagcauuccugccuguaagucuucccaagaca

SEQ ID NO: 351963 - RNA, 25 nt, Human
cagcauuccuggccagguacagggg

SEQ ID NO: 351964 - RNA, 32 nt, Human
cagcauuccugggcuggugcucaggccggccu

SEQ ID NO: 351965 - RNA, 32 nt, Human
cagcauucuauggggaguaacaccuuacauuu

SEQ ID NO: 351966 - RNA, 32 nt, Human
cagcauucugcucuucugaugaugcgcuguga

SEQ ID NO: 351967 - RNA, 32 nt, Human
cagcauucugggaggccgaggcgggcagauca

SEQ ID NO: 351968 - RNA, 32 nt, Human
cagcauugaagcagccuuuucccauuguagaa

SEQ ID NO: 351969 - RNA, 32 nt, Human
cagcauugcacuccagccugggugacagaacg

SEQ ID NO: 351970 - RNA, 20 nt, Human
cagcauugcuugaacccagg

SEQ ID NO: 351971 - RNA, 32 nt, Human
cagcauuguuuccaaugagcagcacucagagu

SEQ ID NO: 351972 - RNA, 32 nt, Human
cagcauuuauagaacaugcugccccacauaca

SEQ ID NO: 351973 - RNA, 17 nt, Human
cagcauuucagcuguga

SEQ ID NO: 351974 - RNA, 32 nt, Human
cagcauuuccacaccaagcagcaacagcaaau

SEQ ID NO: 351975 - RNA, 20 nt, Human
cagcauuucugagcagggcu

SEQ ID NO: 351976 - RNA, 32 nt, Human
cagcauuuggucagcacaucugaaaaggaagg

SEQ ID NO: 351977 - RNA, 32 nt, Human
cagcauuuggugcaacuccacccuucugcaga

SEQ ID NO: 351978 - RNA, 23 nt, Human
cagcauuuuagcucagaaggcuc

SEQ ID NO: 351979 - RNA, 32 nt, Human
cagcauuuuccucugcuuugaaagccccagaa

SEQ ID NO: 351980 - RNA, 32 nt, Human
cagcauuuugggaggcagaggcgggcggauca

SEQ ID NO: 351981 - RNA, 32 nt, Human
cagcauuuugggaggccaaggugggaggauug

SEQ ID NO: 351982 - RNA, 32 nt, Human
cagcauuuugggaggccgaggcgggcggauca

SEQ ID NO: 351983 - RNA, 32 nt, Human
cagcauuuugggaggccgaggugggaagauug

SEQ ID NO: 351984 - RNA, 32 nt, Human
cagcauuuugggaggccgaggugggcggauca

SEQ ID NO: 351985 - RNA, 32 nt, Human
cagcauuuugggaggccgggguuggaggauca

SEQ ID NO: 351986 - RNA, 32 nt, Human
cagcauuuugggaggcugaggcaggcggauca

SEQ ID NO: 351987 - RNA, 32 nt, Human
cagcauuuugggaggcugaggcaggcggaucg

SEQ ID NO: 351988 - RNA, 32 nt, Human
cagcauuuugggaggcugaggugggcagauca

SEQ ID NO: 351989 - RNA, 32 nt, Human
cagcauuuuucuuggaaccucuacgcucuugg

SEQ ID NO: 351990 - RNA, 32 nt, Human
cagccaaaauaacuuuaaaaacuuacauuuuu

SEQ ID NO: 351991 - RNA, 32 nt, Human
cagccaaagcauauuugcuuccuuccagcaua

SEQ ID NO: 351992 - RNA, 32 nt, Human
cagccaaaggcagcuacauuuccacagaagcc

SEQ ID NO: 351993 - RNA, 32 nt, Human
cagccaaauggaggccacugagccacaggaua

SEQ ID NO: 351994 - RNA, 32 nt, Human
cagccaaauugcuucaucuguacguggugaua

SEQ ID NO: 351995 - RNA, 22 nt, Human
cagccaacaaagaggcccugga

SEQ ID NO: 351996 - RNA, 32 nt, Human
cagccaacaacaaaugccugaucuuccggaaa

SEQ ID NO: 351997 - RNA, 32 nt, Human
cagccaacacccuucucagcuucguggacccu

SEQ ID NO: 351998 - RNA, 32 nt, Human
cagccaacauacuaaaaccccgucucuacuaa

SEQ ID NO: 351999 - RNA, 32 nt, Human
cagccaacauggcaaaaccccaucucuacuaa

SEQ ID NO: 352000 - RNA, 32 nt, Human
cagccaacauggcgaaaccaugucucuacuaa

SEQ ID NO: 352001 - RNA, 32 nt, Human
cagccaacccucugcaugccaggcuggagagu

SEQ ID NO: 352002 - RNA, 32 nt, Human
cagccaaccucaccuccucgggcccagcucaa

SEQ ID NO: 352003 - RNA, 32 nt, Human
cagccaacugaggaggcgauccccgagcagga

SEQ ID NO: 352004 - RNA, 17 nt, Human
cagccaacuucguggcc

SEQ ID NO: 352005 - RNA, 32 nt, Human
cagccaagacagccagcauccccaggcgcuca

SEQ ID NO: 352006 - RNA, 32 nt, Human
cagccaagacuggagcagucucucaccuugac

SEQ ID NO: 352007 - RNA, 32 nt, Human
cagccaagagcugaggguaagggcagguaggc

SEQ ID NO: 352008 - RNA, 32 nt, Human
cagccaagagcugaguauauaaaggagaggga

SEQ ID NO: 352009 - RNA, 32 nt, Human
cagccaagaggagucagagaugaggugggaag

SEQ ID NO: 352010 - RNA, 32 nt, Human
cagccaagaguuuuccugugguuccagcccau

SEQ ID NO: 352011 - RNA, 32 nt, Human
cagccaagauagcaccacugcacuccaggcug

SEQ ID NO: 352012 - RNA, 23 nt, Human
cagccaagcaggaggccaagggg

SEQ ID NO: 352013 - RNA, 20 nt, Human
cagccaagcauuggggccgc

SEQ ID NO: 352014 - RNA, 19 nt, Human
cagccaagcccaagucucc

SEQ ID NO: 352015 - RNA, 32 nt, Human
cagccaagcccaggcucgcaguaucaauaaag

SEQ ID NO: 352016 - RNA, 26 nt, Human
cagccaagccucggcuccagcuccgc

SEQ ID NO: 352017 - RNA, 20 nt, Human
cagccaagcugccccugccc

SEQ ID NO: 352018 - RNA, 26 nt, Human
cagccaagcugcccgagcuucacuca

SEQ ID NO: 352019 - RNA, 20 nt, Human
cagccaaggaaaguggcucc

SEQ ID NO: 352020 - RNA, 21 nt, Human
cagccaaggacagacuguaga

SEQ ID NO: 352021 - RNA, 22 nt, Human
cagccaaggacgaaagccccac

SEQ ID NO: 352022 - RNA, 32 nt, Human
cagccaaggauuugaacccaggucucgucuga

SEQ ID NO: 352023 - RNA, 32 nt, Human
cagccaaggccagacuuccuaguggaagagca

SEQ ID NO: 352024 - RNA, 32 nt, Human
cagccaaggcccuguccuuucuugaauggugg

SEQ ID NO: 352025 - RNA, 32 nt, Human
cagccaaggcuggacuggguuggcugcagugu

SEQ ID NO: 352026 - RNA, 32 nt, Human
cagccaagggaaugccaccucuucucagaccc

SEQ ID NO: 352027 - RNA, 32 nt, Human
cagccaagggacagugccauccuuggggacag

SEQ ID NO: 352028 - RNA, 32 nt, Human
cagccaagggccagagaccaggaaaggaagaa

SEQ ID NO: 352029 - RNA, 20 nt, Human
cagccaagguagggucacua

SEQ ID NO: 352030 - RNA, 32 nt, Human
cagccaagguggugagggcagcuguuccuaaa

SEQ ID NO: 352031 - RNA, 20 nt, Human
cagccaagguucccuccaca

SEQ ID NO: 352032 - RNA, 31 nt, Human
cagccaaguccaauagcacucacuuaggugu

SEQ ID NO: 352033 - RNA, 32 nt, Human
cagccaagucgccacauuucucugcaaaaugu

SEQ ID NO: 352034 - RNA, 32 nt, Human
cagccaagucucccaccucucugcucgguuuc

SEQ ID NO: 352035 - RNA, 32 nt, Human
cagccaagugccuuuuccucagcacugaggga

SEQ ID NO: 352036 - RNA, 32 nt, Human
cagccaaguggagcucugagaauacaacaagu

SEQ ID NO: 352037 - RNA, 32 nt, Human
cagccaaguggugcuuucuuccaaaugccuug

SEQ ID NO: 352038 - RNA, 32 nt, Human
cagccaagugugaccccacugccaagugggga

SEQ ID NO: 352039 - RNA, 32 nt, Human
cagccaauagccauguaacugagcuuggaaga

SEQ ID NO: 352040 - RNA, 32 nt, Human
cagccaauaugcauuccucccacuggucagag

SEQ ID NO: 352041 - RNA, 32 nt, Human
cagccaauauuugccuguuucuuuggauugug

SEQ ID NO: 352042 - RNA, 21 nt, Human
cagccaaucccuccaccagca

SEQ ID NO: 352043 - RNA, 32 nt, Human
cagccaaugagggauugaaugaaugccaaugu

SEQ ID NO: 352044 - RNA, 32 nt, Human
cagccaauggauucuggucaacugguggagau

SEQ ID NO: 352045 - RNA, 32 nt, Human
cagccaaugguaccacccaguuuccugagcua

SEQ ID NO: 352046 - RNA, 32 nt, Human
cagccaauuuagugaaaccccaucucuacuaa

SEQ ID NO: 352047 - RNA, 32 nt, Human
cagccacaaggcaggaaaacuggcgcaaauuu

SEQ ID NO: 352048 - RNA, 31 nt, Human
cagccacaaguguuggagcugcagagagacc

SEQ ID NO: 352049 - RNA, 32 nt, Human
cagccacacacagccaugcacuacccaacugc

SEQ ID NO: 352050 - RNA, 32 nt, Human
cagccacacaggaguccugggcacccuggcuu

SEQ ID NO: 352051 - RNA, 32 nt, Human
cagccacacaggugugaucagagccagugguc

SEQ ID NO: 352052 - RNA, 21 nt, Human
cagccacaccacccucuccca

SEQ ID NO: 352053 - RNA, 32 nt, Human
cagccacaccacccucucccgacagcccucaa

SEQ ID NO: 352054 - RNA, 32 nt, Human
cagccacacucauucauuuauuuucugugguu

SEQ ID NO: 352055 - RNA, 32 nt, Human
cagccacacuccugcucugguccgagggagau

SEQ ID NO: 352056 - RNA, 22 nt, Human
cagccacacugaaaaugggaug

SEQ ID NO: 352057 - RNA, 32 nt, Human
cagccacacuuccuucagaaggaacuguuaua

SEQ ID NO: 352058 - RNA, 32 nt, Human
cagccacagaacuuccucccacuuaucccuua

SEQ ID NO: 352059 - RNA, 32 nt, Human
cagccacagauggccucacaccagagacagcc

SEQ ID NO: 352060 - RNA, 32 nt, Human
cagccacagcacuccagccugggugacagagc

SEQ ID NO: 352061 - RNA, 32 nt, Human
cagccacagcagagccaaucacagacccacca

SEQ ID NO: 352062 - RNA, 32 nt, Human
cagccacagccaagggcccaagcagaaguaca

SEQ ID NO: 352063 - RNA, 32 nt, Human
cagccacagccaaggguggaggcuucaggucu

SEQ ID NO: 352064 - RNA, 32 nt, Human
cagccacagccccagcccaggcagcccacagu

SEQ ID NO: 352065 - RNA, 32 nt, Human
cagccacagccuccccacccaggaugaccccu

SEQ ID NO: 352066 - RNA, 31 nt, Human
cagccacagcucauguguaccaaaguagaaa

SEQ ID NO: 352067 - RNA, 32 nt, Human
cagccacaggcagaggacgaggacgacuggga

SEQ ID NO: 352068 - RNA, 32 nt, Human
cagccacaggcagaggaggacgaggacgacug

SEQ ID NO: 352069 - RNA, 32 nt, Human
cagccacaggcagaggaggacgaggaugacug

SEQ ID NO: 352070 - RNA, 31 nt, Human
cagccacaggccuagaauaucuggcuucucu

SEQ ID NO: 352071 - RNA, 32 nt, Human
cagccacagggagagacaugggcgaaugagug

SEQ ID NO: 352072 - RNA, 32 nt, Human
cagccacagugauacuuaggaaaccagaggaa

SEQ ID NO: 352073 - RNA, 32 nt, Human
cagccacaucagugcugaugugccucaaggca

SEQ ID NO: 352074 - RNA, 32 nt, Human
cagccacauggaacucuucuuccuuuagguua

SEQ ID NO: 352075 - RNA, 32 nt, Human
cagccacaugugcacaaugagcacaugaaaug

SEQ ID NO: 352076 - RNA, 19 nt, Human
cagccacauucucauagca

SEQ ID NO: 352077 - RNA, 22 nt, Human
cagccaccaacucuggguccag

SEQ ID NO: 352078 - RNA, 32 nt, Human
cagccaccaaguccauggucugacccccagca

SEQ ID NO: 352079 - RNA, 32 nt, Human
cagccaccacagaccucagcuguguauccuau

SEQ ID NO: 352080 - RNA, 18 nt, Human
cagccaccaccaccacca

SEQ ID NO: 352081 - RNA, 32 nt, Human
cagccaccaccaggcugagcagugaggagaga

SEQ ID NO: 352082 - RNA, 32 nt, Human
cagccaccacucagugcuucucugugcaggag

SEQ ID NO: 352083 - RNA, 32 nt, Human
cagccaccagacaacauggagacccucugugc

SEQ ID NO: 352084 - RNA, 32 nt, Human
cagccaccagaggcauggaugugcagugggag

SEQ ID NO: 352085 - RNA, 32 nt, Human
cagccaccaggccagauugaagaagacagcag

SEQ ID NO: 352086 - RNA, 32 nt, Human
cagccaccaguggaagcggggucacugcccca

SEQ ID NO: 352087 - RNA, 17 nt, Human
cagccaccagugggaug

SEQ ID NO: 352088 - RNA, 32 nt, Human
cagccaccaugcuccacucccugcugcuucac

SEQ ID NO: 352089 - RNA, 32 nt, Human
cagccaccauuccucuccccugggcgauggcg

SEQ ID NO: 352090 - RNA, 32 nt, Human
cagccacccacugcugccccaagcucacucag

SEQ ID NO: 352091 - RNA, 32 nt, Human
cagccacccagccaggaggggcuguccaauca

SEQ ID NO: 352092 - RNA, 32 nt, Human
cagccacccagccucagcacucaucugcgcag

SEQ ID NO: 352093 - RNA, 32 nt, Human
cagccacccagccuuuaccagcagcguacggc

SEQ ID NO: 352094 - RNA, 32 nt, Human
cagccacccaggaggaagagcgggcugaggaa

SEQ ID NO: 352095 - RNA, 32 nt, Human
cagccacccaggcagggagcaaguggccuggu

SEQ ID NO: 352096 - RNA, 32 nt, Human
cagccacccaggcagggcaggggccaagguaa

SEQ ID NO: 352097 - RNA, 32 nt, Human
cagccacccagggggcccuccugggaggagcu

SEQ ID NO: 352098 - RNA, 32 nt, Human
cagccaccccacauccagccuacacagaacuu

SEQ ID NO: 352099 - RNA, 32 nt, Human
cagccaccccgcagucacuuucuuuguaacaa

SEQ ID NO: 352100 - RNA, 30 nt, Human
cagccaccccucuccaugccucuugucugu

SEQ ID NO: 352101 - RNA, 32 nt, Human
cagccaccccucuccaugccucuugucugucu

SEQ ID NO: 352102 - RNA, 32 nt, Human
cagccacccgggagccugaggugggaggauug

SEQ ID NO: 352103 - RNA, 25 nt, Human
cagccaccggucccagaacccgcca

SEQ ID NO: 352104 - RNA, 32 nt, Human
cagccaccuccagggcccuguuugggaccacu

SEQ ID NO: 352105 - RNA, 32 nt, Human
cagccaccucugcaaccugccaccuccugcug

SEQ ID NO: 352106 - RNA, 32 nt, Human
cagccaccugagccaccaccgagccauggcag

SEQ ID NO: 352107 - RNA, 32 nt, Human
cagccaccugcucucugugggcugaacugucu

SEQ ID NO: 352108 - RNA, 32 nt, Human
cagccaccugggagcuggcagguggcccgugg

SEQ ID NO: 352109 - RNA, 32 nt, Human
cagccaccugugucuguguucuugccacuguc

SEQ ID NO: 352110 - RNA, 32 nt, Human
cagccacgaagggauggaugugcaucugcccu

SEQ ID NO: 352111 - RNA, 32 nt, Human
cagccacggccaggccagagggagugacagag

SEQ ID NO: 352112 - RNA, 32 nt, Human
cagccacggggccugcacuuccagcuccuuug

SEQ ID NO: 352113 - RNA, 32 nt, Human
cagccacguauggucuggagugcucuguagaa

SEQ ID NO: 352114 - RNA, 32 nt, Human
cagccacgucaaacuucucucccucagggacu

SEQ ID NO: 352115 - RNA, 18 nt, Human
cagccacgugccgagcug

SEQ ID NO: 352116 - RNA, 32 nt, Human
cagccacuaacgguaugugcucuccuucagcc

SEQ ID NO: 352117 - RNA, 32 nt, Human
cagccacucaaaagugcugggauuacuggcgu

SEQ ID NO: 352118 - RNA, 32 nt, Human
cagccacucaaaggaggcagcacugaccugcu

SEQ ID NO: 352119 - RNA, 20 nt, Human
cagccacucacuggggccac

SEQ ID NO: 352120 - RNA, 23 nt, Human
cagccacucacuggggccaccaa

SEQ ID NO: 352121 - RNA, 32 nt, Human
cagccacucagaccuaggucucaggcugcagc

SEQ ID NO: 352122 - RNA, 32 nt, Human
cagccacucagcccugcucugcucagcugaag

SEQ ID NO: 352123 - RNA, 32 nt, Human
cagccacucaguucuuccuccaccuccaccca

SEQ ID NO: 352124 - RNA, 32 nt, Human
cagccacuccaacucuccaccuccagcuucua

SEQ ID NO: 352125 - RNA, 32 nt, Human
cagccacuccaggaacuccugggggugcucca

SEQ ID NO: 352126 - RNA, 25 nt, Human
cagccacuccaggaggaagucggga

SEQ ID NO: 352127 - RNA, 32 nt, Human
cagccacucccaggggccuuugcagcgucuuu

SEQ ID NO: 352128 - RNA, 21 nt, Human
cagccacuccugcagcugcca

SEQ ID NO: 352129 - RNA, 18 nt, Human
cagccacuccuggcccca

SEQ ID NO: 352130 - RNA, 22 nt, Human
cagccacuccuuguucacccca

SEQ ID NO: 352131 - RNA, 32 nt, Human
cagccacucgggaggcugagacaggagaaucg

SEQ ID NO: 352132 - RNA, 32 nt, Human
cagccacugagauccuccagccuggacaugcu

SEQ ID NO: 352133 - RNA, 32 nt, Human
cagccacugcaagcccugggccucuggcaccu

SEQ ID NO: 352134 - RNA, 32 nt, Human
cagccacugcucauguaauguacucccuuaac

SEQ ID NO: 352135 - RNA, 32 nt, Human
cagccacuggccaggccguuguauccauguca

SEQ ID NO: 352136 - RNA, 32 nt, Human
cagccacugugggcccugccucugccuguucu

SEQ ID NO: 352137 - RNA, 21 nt, Human
cagccacuucauccccuccca

SEQ ID NO: 352138 - RNA, 32 nt, Human
cagccacuugacuguccucgacggccuguucc

SEQ ID NO: 352139 - RNA, 32 nt, Human
cagccacuugcagaacaggaugggaccgagau

SEQ ID NO: 352140 - RNA, 32 nt, Human
cagccacuuguccuagccaaauguccaaaaca

SEQ ID NO: 352141 - RNA, 32 nt, Human
cagccacuuucugccagcaucugcagccacuu

SEQ ID NO: 352142 - RNA, 32 nt, Human
cagccacuuucugccagcaucugcagccagca

SEQ ID NO: 352143 - RNA, 20 nt, Human
cagccacuuucuguguggua

SEQ ID NO: 352144 - RNA, 32 nt, Human
cagccagaaaccaguaaagaaaccccauucag

SEQ ID NO: 352145 - RNA, 32 nt, Human
cagccagaacaggugacacagagcaggggcuu

SEQ ID NO: 352146 - RNA, 32 nt, Human
cagccagaagcagccucagcuuggcaaggugu

SEQ ID NO: 352147 - RNA, 32 nt, Human
cagccagaagccucugccucccuagcuuuucu

SEQ ID NO: 352148 - RNA, 23 nt, Human
cagccagaaggcggggaucacua

SEQ ID NO: 352149 - RNA, 32 nt, Human
cagccagaaguuaaacaucugggauaugacgu

SEQ ID NO: 352150 - RNA, 32 nt, Human
cagccagaaguuaaagggcugaggguugaggu

SEQ ID NO: 352151 - RNA, 20 nt, Human
cagccagacaccuuguacug

SEQ ID NO: 352152 - RNA, 32 nt, Human
cagccagaccaacaugaugaaaccccgucugu

SEQ ID NO: 352153 - RNA, 32 nt, Human
cagccagaccacauucuauaaucuuugaacau

SEQ ID NO: 352154 - RNA, 18 nt, Human
cagccagaccucuccaca

SEQ ID NO: 352155 - RNA, 32 nt, Human
cagccagacgucacccacgaccccuaugaguu

SEQ ID NO: 352156 - RNA, 32 nt, Human
cagccagacuggguuaagggagcugcucaagc

SEQ ID NO: 352157 - RNA, 32 nt, Human
cagccagagcaugcgucucagcagagcugucu

SEQ ID NO: 352158 - RNA, 17 nt, Human
cagccagagccuccaua

SEQ ID NO: 352159 - RNA, 32 nt, Human
cagccagagccugucuuucagcauucagucgc

SEQ ID NO: 352160 - RNA, 32 nt, Human
cagccagagcugggagccccuuguucaaggau

SEQ ID NO: 352161 - RNA, 21 nt, Human
cagccagagcuuccaugugcc

SEQ ID NO: 352162 - RNA, 32 nt, Human
cagccagaggagggcagagggagaauccaagg

SEQ ID NO: 352163 - RNA, 32 nt, Human
cagccagaggcugaccugagggccacuguccu

SEQ ID NO: 352164 - RNA, 32 nt, Human
cagccagagggacuggagccaggugugcaugg

SEQ ID NO: 352165 - RNA, 32 nt, Human
cagccagaggggccucaggaccagcccugucc

SEQ ID NO: 352166 - RNA, 32 nt, Human
cagccagaguccaaggcauaaggaggaaaaug

SEQ ID NO: 352167 - RNA, 22 nt, Human
cagccagagugacagagcaaga

SEQ ID NO: 352168 - RNA, 32 nt, Human
cagcuacuugggaggcugaggugggaggauaa

SEQ ID NO: 352169 - RNA, 32 nt, Human
cagcuacuugggaggcugaggugggaggaugg

SEQ ID NO: 352170 - RNA, 32 nt, Human
cagcuacuugggaggcugaggugggaggauug

SEQ ID NO: 352171 - RNA, 32 nt, Human
cagcuacuugggaggcugaguugggaggauug

SEQ ID NO: 352172 - RNA, 32 nt, Human
cagcuacuugggaggcugcagcuguggcugug

SEQ ID NO: 352173 - RNA, 32 nt, Human
cagcuacuugggagggcugaagccaggggauu

SEQ ID NO: 352174 - RNA, 32 nt, Human
cagcuacuugggagguggaggugggaggauua

SEQ ID NO: 352175 - RNA, 19 nt, Human
cagcuacuuggggggcuca

SEQ ID NO: 352176 - RNA, 32 nt, Human
cagcuacuugguuuguguucuucuucauauuc

SEQ ID NO: 352177 - RNA, 32 nt, Human
cagcuagaacaagaauuccuggagcucaaccc

SEQ ID NO: 352178 - RNA, 32 nt, Human
cagcuagaacaccuuccagacacuugcuggac

SEQ ID NO: 352179 - RNA, 32 nt, Human
cagcuagagcuuccacugucagcccucacugu

SEQ ID NO: 352180 - RNA, 18 nt, Human
cagcuagaugucuuuaca

SEQ ID NO: 352181 - RNA, 32 nt, Human
cagcuagccccagggguggaacaacuguggga

SEQ ID NO: 352182 - RNA, 32 nt, Human
cagcuagccuacucccuuuggaaugcaauaaa

SEQ ID NO: 352183 - RNA, 32 nt, Human
cagcuagcucccuggagggcacggugaagagg

SEQ ID NO: 352184 - RNA, 32 nt, Human
cagcuaggccggcucuuccacgcccagcauga

SEQ ID NO: 352185 - RNA, 32 nt, Human
cagcuaggcuuagccccucugcccucccucca

SEQ ID NO: 352186 - RNA, 32 nt, Human
cagcuaggcuuagccccucugcccucccuuca

SEQ ID NO: 352187 - RNA, 32 nt, Human
cagcuagggaaagcaguugcgggcagggggug

SEQ ID NO: 352188 - RNA, 32 nt, Human
cagcuagggaggcaaagcaggcugcagucagu

SEQ ID NO: 352189 - RNA, 32 nt, Human
cagcuagggcgaagccagcagaggugugugua

SEQ ID NO: 352190 - RNA, 32 nt, Human
cagcuaguaauagcauuuucaguacuuuucau

SEQ ID NO: 352191 - RNA, 32 nt, Human
cagcuaguagcgggugcucugggaucuggugg

SEQ ID NO: 352192 - RNA, 32 nt, Human
cagcuaguaggugacagagcccagauugaauc

SEQ ID NO: 352193 - RNA, 18 nt, Human
cagcuaguggcuuccaca

SEQ ID NO: 352194 - RNA, 32 nt, Human
cagcuauagacagaaauaauaagccacccugg

SEQ ID NO: 352195 - RNA, 32 nt, Human
cagcuauagccugucccaggggcugcugucca

SEQ ID NO: 352196 - RNA, 32 nt, Human
cagcuaucacaggugaauugcagugagcgcua

SEQ ID NO: 352197 - RNA, 32 nt, Human
cagcuaucccagaggucgaggcugcagugagc

SEQ ID NO: 352198 - RNA, 32 nt, Human
cagcuauccuugcccccagaggagcagucauu

SEQ ID NO: 352199 - RNA, 32 nt, Human
cagcuaugaauccauuguccuuguaguuucuu

SEQ ID NO: 352200 - RNA, 32 nt, Human
cagcuaugcugauuuugaaaaucagaucugag

SEQ ID NO: 352201 - RNA, 32 nt, Human
cagcuauggccugggcucuagcuuuggcucug

SEQ ID NO: 352202 - RNA, 30 nt, Human
cagcuaugggagaaccugcguucaccucuu

SEQ ID NO: 352203 - RNA, 32 nt, Human
cagcuauuauacuugggacucuaccucucacu

SEQ ID NO: 352204 - RNA, 31 nt, Human
cagcuauucaggagcuguuguaggagagauu

SEQ ID NO: 352205 - RNA, 32 nt, Human
cagcuauucuguaacaucaucaagucccagcc

SEQ ID NO: 352206 - RNA, 32 nt, Human
cagcuauugcacuucagccaaauguuuauuuc

SEQ ID NO: 352207 - RNA, 32 nt, Human
cagcuauuuaaggggagcaggagugcagaaca

SEQ ID NO: 352208 - RNA, 32 nt, Human
cagcuauuuggaagcuaccaggaaugcuuucu

SEQ ID NO: 352209 - RNA, 32 nt, Human
cagcuauuugggaggcugaggcaguagaaucg

SEQ ID NO: 352210 - RNA, 32 nt, Human
cagcuauuugggaggcugaugcaggagaauag

SEQ ID NO: 352211 - RNA, 32 nt, Human
cagcuauuuuauacucauaaggucaguguaca

SEQ ID NO: 352212 - RNA, 23 nt, Human
cagcuauuuuccuggcuguggga

SEQ ID NO: 352213 - RNA, 32 nt, Human
cagcucaacugauuucuuguccaaugauccuu

SEQ ID NO: 352214 - RNA, 32 nt, Human
cagcucaagagcaagaugauguucucauaguu

SEQ ID NO: 352215 - RNA, 24 nt, Human
cagcucaagauacaguggcaaaga

SEQ ID NO: 352216 - RNA, 32 nt, Human
cagcucaagccuugccacuucgggcuucucac

SEQ ID NO: 352217 - RNA, 23 nt, Human
cagcucaaggaaaggccugaaag

SEQ ID NO: 352218 - RNA, 20 nt, Human
cagcucaaggcuccuccaca

SEQ ID NO: 352219 - RNA, 32 nt, Human
cagcucaaugcuguuuucuugcaggugaagcu

SEQ ID NO: 352220 - RNA, 32 nt, Human
cagcucacaccacuccagaaccugacaaggca

SEQ ID NO: 352221 - RNA, 32 nt, Human
cagcucacaccuguaaucccagcacuuuggga

SEQ ID NO: 352222 - RNA, 18 nt, Human
cagcucacagacgcucuu

SEQ ID NO: 352223 - RNA, 32 nt, Human
cagcucacagcaaccuccgccucccagguuca

SEQ ID NO: 352224 - RNA, 32 nt, Human
cagcucacagcaaccuccgccucccggguuca

SEQ ID NO: 352225 - RNA, 22 nt, Human
cagcucacagcaaccucugccu

SEQ ID NO: 352226 - RNA, 32 nt, Human
cagcucacagcaaccucugccuccuggguuca

SEQ ID NO: 352227 - RNA, 32 nt, Human
cagcucacagcaggcuccaccucucaggcuca

SEQ ID NO: 352228 - RNA, 32 nt, Human
cagcucacagccgcacccagaauccuuugcag

SEQ ID NO: 352229 - RNA, 32 nt, Human
cagcucacaucugaggcccugggaggucuugu

SEQ ID NO: 352230 - RNA, 32 nt, Human
cagcucaccaagcuacuaucucuuuuaacucc

SEQ ID NO: 352231 - RNA, 32 nt, Human
cagcucaccacaaccuccaccuccuggguuua

SEQ ID NO: 352232 - RNA, 32 nt, Human
cagcucaccacaaccuccgccucccagguuca

SEQ ID NO: 352233 - RNA, 32 nt, Human
cagcucaccacaaccucugccuccccgguuca

SEQ ID NO: 352234 - RNA, 32 nt, Human
cagcucaccccuccuuagcccaaggucuuccu

SEQ ID NO: 352235 - RNA, 32 nt, Human
cagcucaccccuggcccuugcccuggcugccc

SEQ ID NO: 352236 - RNA, 32 nt, Human
cagcucacccucaucuccucugcccuagagcu

SEQ ID NO: 352237 - RNA, 32 nt, Human
cagcucaccgaaaccuccaccuacuaggcuca

SEQ ID NO: 352238 - RNA, 32 nt, Human
cagcucaccgcaaccuccaccuccaggguuga

SEQ ID NO: 352239 - RNA, 32 nt, Human
cagcucaccgcaaccuccaccuccuggguuca

SEQ ID NO: 352240 - RNA, 32 nt, Human
cagcucaccgcaaccuccacucgcagguucaa

SEQ ID NO: 352241 - RNA, 32 nt, Human
cagcucaccgcaaccuccgccucccggguuca

SEQ ID NO: 352242 - RNA, 32 nt, Human
cagcucaccgcaaccucugccucccagauuca

SEQ ID NO: 352243 - RNA, 32 nt, Human
cagcucaccgcaacgucuaccucccagguuca

SEQ ID NO: 352244 - RNA, 32 nt, Human
cagcucaccgcaaucuccgccucccagauuca

SEQ ID NO: 352245 - RNA, 32 nt, Human
cagcucaccgcauccuccaccucccagguuca

SEQ ID NO: 352246 - RNA, 32 nt, Human
cagcucaccucaaccuccgccucccggguuca

SEQ ID NO: 352247 - RNA, 32 nt, Human
cagcucaccucaggacugggcucucuggccug

SEQ ID NO: 352248 - RNA, 32 nt, Human
cagcucacgccuguaaucccagcacuuuggga

SEQ ID NO: 352249 - RNA, 32 nt, Human
cagcucacgccuguaaucccaucacuuuggga

SEQ ID NO: 352250 - RNA, 32 nt, Human
cagcucacggcaaccuccgccucccggguuca

SEQ ID NO: 352251 - RNA, 32 nt, Human
cagcucacggcagccucaaccucccuggcuca

SEQ ID NO: 352252 - RNA, 32 nt, Human
cagcucacggcuaccucugccucccggguuca

SEQ ID NO: 352253 - RNA, 19 nt, Human
cagcucacguccagguuca

SEQ ID NO: 352254 - RNA, 32 nt, Human
cagcucacuacaaccuccugcuccuggguucg

SEQ ID NO: 352255 - RNA, 32 nt, Human
cagcucacuacaaccucugccucccagguuca

SEQ ID NO: 352256 - RNA, 32 nt, Human
cagcucacuacaaccucugccuccggguucaa

SEQ ID NO: 352257 - RNA, 32 nt, Human
cagcucacuauaagcuccaccucccagguuca

SEQ ID NO: 352258 - RNA, 32 nt, Human
cagcucacugaaaccucugccucccggguuca

SEQ ID NO: 352259 - RNA, 32 nt, Human
cagcucacugaaccucugccucccaggucaag

SEQ ID NO: 352260 - RNA, 32 nt, Human
cagcucacugaagccucgaccuccagaacuca

SEQ ID NO: 352261 - RNA, 32 nt, Human
cagcucacugaagucucgaccucccaggcuca

SEQ ID NO: 352262 - RNA, 32 nt, Human
cagcucacugaucucuugccucugcugauggg

SEQ ID NO: 352263 - RNA, 32 nt, Human
cagcucacugcaaacuccaccucccagguuca

SEQ ID NO: 352264 - RNA, 32 nt, Human
cagcucacugcaaacucugccucccgaauuca

SEQ ID NO: 352265 - RNA, 32 nt, Human
cagcucacugcaacaccgccucccggguucaa

SEQ ID NO: 352266 - RNA, 32 nt, Human
cagcucacugcaacauccaccuccuggguuca

SEQ ID NO: 352267 - RNA, 32 nt, Human
cagcucacugcaacauccgccucugggguuca

SEQ ID NO: 352268 - RNA, 32 nt, Human
cagcucacugcaaccacugccucccaggcuca

SEQ ID NO: 352269 - RNA, 32 nt, Human
cagcucacugcaacccccgccuccuggguuca

SEQ ID NO: 352270 - RNA, 32 nt, Human
cagcucacugcaaccuacgccuucuggguuca

SEQ ID NO: 352271 - RNA, 32 nt, Human
cagcucacugcaaccucaaacuccugggcuca

SEQ ID NO: 352272 - RNA, 32 nt, Human
cagcucacugcaaccucaauccugggcucaag

SEQ ID NO: 352273 - RNA, 32 nt, Human
cagcucacugcaaccuccaccucccagacuca

SEQ ID NO: 352274 - RNA, 32 nt, Human
cagcucacugcaaccuccaccucccaggauca

SEQ ID NO: 352275 - RNA, 32 nt, Human
cagcucacugcaaccuccaccucccaggcuca

SEQ ID NO: 352276 - RNA, 32 nt, Human
cagcucacugcaaccuccaccucccaggugca

SEQ ID NO: 352277 - RNA, 32 nt, Human
cagcucacugcaaccuccaccucccagguuca

SEQ ID NO: 352278 - RNA, 32 nt, Human
cagcucacugcaaccuccaccucccgggucaa

SEQ ID NO: 352279 - RNA, 32 nt, Human
cagcucacugcaaccuccaccucccggguuca

SEQ ID NO: 352280 - RNA, 32 nt, Human
cagcucacugcaaccuccaccucccggguuuc

SEQ ID NO: 352281 - RNA, 32 nt, Human
cagcucacugcaaccuccaccucccugguuca

SEQ ID NO: 352282 - RNA, 32 nt, Human
cagcucacugcaaccuccaccuccggguucaa

SEQ ID NO: 352283 - RNA, 32 nt, Human
cagcucacugcaaccuccaccuccuggauucg

SEQ ID NO: 352284 - RNA, 32 nt, Human
cagcucacugcaaccuccaccuccuggguuca

SEQ ID NO: 352285 - RNA, 32 nt, Human
cagcucacugcaaccuccaccuccuggguuga

SEQ ID NO: 352286 - RNA, 32 nt, Human
cagcucacugcaaccuccaccucgcagguuca

SEQ ID NO: 352287 - RNA, 32 nt, Human
cagcucacugcaaccuccaccucucagguuca

SEQ ID NO: 352288 - RNA, 32 nt, Human
cagcucacugcaaccuccaccucuuauguuca

SEQ ID NO: 352289 - RNA, 32 nt, Human
cagcucacugcaaccuccaucuccagguuuca

SEQ ID NO: 352290 - RNA, 32 nt, Human
cagcucacugcaaccuccaucucccggauucc

SEQ ID NO: 352291 - RNA, 32 nt, Human
cagcucacugcaaccuccaucuccuggauuca

SEQ ID NO: 352292 - RNA, 32 nt, Human
cagcucacugcaaccucccccuccuggguuca

SEQ ID NO: 352293 - RNA, 32 nt, Human
cagcucacugcaaccuccgcaucccggguuca

SEQ ID NO: 352294 - RNA, 32 nt, Human
cagcucacugcaaccuccgcccccuggguuca

SEQ ID NO: 352295 - RNA, 32 nt, Human
cagcucacugcaaccuccgccucccaaguuca

SEQ ID NO: 352296 - RNA, 32 nt, Human
cagcucacugcaaccuccgccucccagguuca

SEQ ID NO: 352297 - RNA, 32 nt, Human
cagcucacugcaaccuccgccucccggguuca

SEQ ID NO: 352298 - RNA, 32 nt, Human
cagcucacugcaaccuccgccuccugagguuc

SEQ ID NO: 352299 - RNA, 32 nt, Human
cagcucacugcaaccuccgccuccugggauca

SEQ ID NO: 352300 - RNA, 32 nt, Human
cagcucacugcaaccuccgccuccuggguuca

SEQ ID NO: 352301 - RNA, 32 nt, Human
cagcucacugcaaccuccgccucuuggguuca

SEQ ID NO: 352302 - RNA, 32 nt, Human
cagcucacugcaaccuccgccugcuggguuca

SEQ ID NO: 352303 - RNA, 32 nt, Human
cagcucacugcaaccuccgccuucuggguuca

SEQ ID NO: 352304 - RNA, 32 nt, Human
cagcucacugcaaccuccgguucccgggcuca

SEQ ID NO: 352305 - RNA, 32 nt, Human
cagcucacugcaaccuccgucuccaggguuca

SEQ ID NO: 352306 - RNA, 32 nt, Human
cagcucacugcaaccuccgucucuacuaaaaa

SEQ ID NO: 352307 - RNA, 32 nt, Human
cagcucacugcaaccuccguuuccuggguucg

SEQ ID NO: 352308 - RNA, 32 nt, Human
cagcucacugcaaccuccuccucccggguuca

SEQ ID NO: 352309 - RNA, 32 nt, Human
cagcucacugcaaccuccuccuucuggguuca

SEQ ID NO: 352310 - RNA, 32 nt, Human
cagcucacugcaaccucgaccucuuggguuca

SEQ ID NO: 352311 - RNA, 32 nt, Human
cagcucacugcaaccucuaccuccuggguuca

SEQ ID NO: 352312 - RNA, 32 nt, Human
cagcucacugcaaccucuacucccaggcucaa

SEQ ID NO: 352313 - RNA, 32 nt, Human
cagcucacugcaaccucucucucccggguuca

SEQ ID NO: 352314 - RNA, 32 nt, Human
cagcucacugcaaccucugccuccagaguuca

SEQ ID NO: 352315 - RNA, 32 nt, Human
cagcucacugcaaccucugccucccagguuca

SEQ ID NO: 352316 - RNA, 32 nt, Human
cagcucacugcaaccucugccucccaguucaa

SEQ ID NO: 352317 - RNA, 32 nt, Human
cagcucacugcaaccucugccucccggauuca

SEQ ID NO: 352318 - RNA, 32 nt, Human
cagcucacugcaaccucugccucccggauuua

SEQ ID NO: 352319 - RNA, 32 nt, Human
cagcucacugcaaccucugccucccggguuca

SEQ ID NO: 352320 - RNA, 32 nt, Human
cagcucacugcaaccucugccucccugguuca

SEQ ID NO: 352321 - RNA, 32 nt, Human
cagcucacugcaaccucugccuccugaguuca

SEQ ID NO: 352322 - RNA, 32 nt, Human
cagcucacugcaaccucugccuccuggauuca

SEQ ID NO: 352323 - RNA, 32 nt, Human
cagcucacugcaaccucugccuccugggcuca

SEQ ID NO: 352324 - RNA, 32 nt, Human
cagcucacugcaaccucugccuccuggguuca

SEQ ID NO: 352325 - RNA, 32 nt, Human
cagcucacugcaaccucugccuccuggguucu

SEQ ID NO: 352326 - RNA, 32 nt, Human
cagcucacugcaaccucugccuccuggguuua

SEQ ID NO: 352327 - RNA, 32 nt, Human
cagcucacugcaaccucugccuccugguucaa

SEQ ID NO: 352328 - RNA, 32 nt, Human
cagcucacugcaaccucugccuucuggauuca

SEQ ID NO: 352329 - RNA, 32 nt, Human
cagcucacugcaaccucugcuucccggguuca

SEQ ID NO: 352330 - RNA, 32 nt, Human
cagcucacugcaaccucugucucccggguuca

SEQ ID NO: 352331 - RNA, 32 nt, Human
cagcucacugcaaccucugucuccuggguuca

SEQ ID NO: 352332 - RNA, 32 nt, Human
cagcucacugcaaccugugccucccggcuuca

SEQ ID NO: 352333 - RNA, 32 nt, Human
cagcucacugcaaccuuacuccuaggcucaag

SEQ ID NO: 352334 - RNA, 32 nt, Human
cagcucacugcaaccuucaccucccagguuca

SEQ ID NO: 352335 - RNA, 32 nt, Human
cagcucacugcaaccuucgccaccuggguucc

SEQ ID NO: 352336 - RNA, 32 nt, Human
cagcucacugcaaccuucgccucccagcuuca

SEQ ID NO: 352337 - RNA, 32 nt, Human
cagcucacugcaaccuuugucucccgggcuca

SEQ ID NO: 352338 - RNA, 32 nt, Human
cagcucacugcaacguccaccuccuggguuca

SEQ ID NO: 352339 - RNA, 32 nt, Human
cagcucacugcaacgucugccucccggguuca

SEQ ID NO: 352340 - RNA, 32 nt, Human
cagcucacugcaacuuccaccucccagguuca

SEQ ID NO: 352341 - RNA, 32 nt, Human
cagcucacugcaacuuccgcaucccagguuca

SEQ ID NO: 352342 - RNA, 32 nt, Human
cagcucacugcaacuuccgccccgccagguuc

SEQ ID NO: 352343 - RNA, 32 nt, Human
cagcucacugcaacuucugccucccagguuca

SEQ ID NO: 352344 - RNA, 32 nt, Human
cagcucacugcaacuucugccuccuggguuca

SEQ ID NO: 352345 - RNA, 32 nt, Human
cagcucacugcaacuucugccuccugguauca

SEQ ID NO: 352346 - RNA, 32 nt, Human
cagcucacugcaagcuccaacucccggguuca

SEQ ID NO: 352347 - RNA, 32 nt, Human
cagcucacugcaagcuccaccucccggguuca

SEQ ID NO: 352348 - RNA, 32 nt, Human
cagcucacugcaagcuccaccucccggguuua

SEQ ID NO: 352349 - RNA, 32 nt, Human
cagcucacugcaagcuccaccuuccggguuca

SEQ ID NO: 352350 - RNA, 32 nt, Human
cagcucacugcaagcuccgccucccagguuca

SEQ ID NO: 352351 - RNA, 32 nt, Human
cagcucacugcaagcuccgccucccggguaca

SEQ ID NO: 352352 - RNA, 32 nt, Human
cagcucacugcaagcuccgccuccucccgggu

SEQ ID NO: 352353 - RNA, 32 nt, Human
cagcucacugcaagcuccgccuccuggguuca

SEQ ID NO: 352354 - RNA, 32 nt, Human
cagcucacugcaagcucuaccucuugguucac

SEQ ID NO: 352355 - RNA, 32 nt, Human
cagcucacugcaagcucugccucccggguuca

SEQ ID NO: 352356 - RNA, 32 nt, Human
cagcucacugcaagcucugccucccguguuca

SEQ ID NO: 352357 - RNA, 32 nt, Human
cagcucacugcaagcucugccucucagguuca

SEQ ID NO: 352358 - RNA, 32 nt, Human
cagcucacugcaaucuccaccuccuggguuca

SEQ ID NO: 352359 - RNA, 32 nt, Human
cagcucacugcaaucuccgccucccggguuca

SEQ ID NO: 352360 - RNA, 32 nt, Human
cagcucacugcaaucucugccacccagauuca

SEQ ID NO: 352361 - RNA, 32 nt, Human
cagcucacugcaaucucugccuccuggguuca

SEQ ID NO: 352362 - RNA, 32 nt, Human
cagcucacugcaaucuucaccuccuaggcuca

SEQ ID NO: 352363 - RNA, 32 nt, Human
cagcucacugcagccacugccucccagguuca

SEQ ID NO: 352364 - RNA, 32 nt, Human
cagcucacugcagcccccgccucccagguucg

SEQ ID NO: 352365 - RNA, 32 nt, Human
cagcucacugcagccucaaccuggguucaagu

SEQ ID NO: 352366 - RNA, 32 nt, Human
cagcucacugcagccuccaccucccagguuca

SEQ ID NO: 352367 - RNA, 32 nt, Human
cagcucacugcagccuccaccuccugggcuca

SEQ ID NO: 352368 - RNA, 32 nt, Human
cagcucacugcagccuccaccuccuggguuca

SEQ ID NO: 352369 - RNA, 32 nt, Human
cagcucacugcagccucugccucccggguuca

SEQ ID NO: 352370 - RNA, 32 nt, Human
cagcucacugcagccucugccuccugaguuca

SEQ ID NO: 352371 - RNA, 32 nt, Human
cagcucacugcagccuuguccucccaggcuca

SEQ ID NO: 352372 - RNA, 32 nt, Human
cagcucacugcaggcucugccuccuggguucc

SEQ ID NO: 352373 - RNA, 32 nt, Human
cagcucacugcagucucugccucccggguucg

SEQ ID NO: 352374 - RNA, 20 nt, Human
cagcucacugcauccuccgc

SEQ ID NO: 352375 - RNA, 32 nt, Human
cagcucacugcauccucugccucccggguuca

SEQ ID NO: 352376 - RNA, 32 nt, Human
cagcucacugccaccucugccucccagguuca

SEQ ID NO: 352377 - RNA, 32 nt, Human
cagcucacugcgaccuccaccucccauguuca

SEQ ID NO: 352378 - RNA, 32 nt, Human
cagcucacugcgaccuccaccuccuggguuca

SEQ ID NO: 352379 - RNA, 32 nt, Human
cagcucacugcggccucuaagaaggugaagca

SEQ ID NO: 352380 - RNA, 32 nt, Human
cagcucacugguuuacaaauauagguugucuu

SEQ ID NO: 352381 - RNA, 32 nt, Human
cagcucacuguaaccuccaccucccggauuca

SEQ ID NO: 352382 - RNA, 32 nt, Human
cagcucacuguaaccucugccucccugcuuca

SEQ ID NO: 352383 - RNA, 32 nt, Human
cagcucacuguacuccagcccggguucaagca

SEQ ID NO: 352384 - RNA, 32 nt, Human
cagcucacuguagccucgaccuuccaggcuca

SEQ ID NO: 352385 - RNA, 32 nt, Human
cagcucacuguagccucuaacucccaggcuca

SEQ ID NO: 352386 - RNA, 32 nt, Human
cagcucacuguagccucuaucuccugggcuca

SEQ ID NO: 352387 - RNA, 32 nt, Human
cagcucacuguagccuugaucuccugggcuca

SEQ ID NO: 352388 - RNA, 32 nt, Human
cagcucacuguagcuuugaccucucaggcuca

SEQ ID NO: 352389 - RNA, 32 nt, Human
cagcucacuguaggcucuaccucauggguucc

SEQ ID NO: 352390 - RNA, 32 nt, Human
cagcucagaacagcuggaucuugcucagucuc

SEQ ID NO: 352391 - RNA, 32 nt, Human
cagcucagagaaugugcuugaugaggaaggcg

SEQ ID NO: 352392 - RNA, 22 nt, Human
cagcucagagcuccucccaccc

SEQ ID NO: 352393 - RNA, 32 nt, Human
cagcucagagcuggucugccauggacauccug

SEQ ID NO: 352394 - RNA, 32 nt, Human
cagcucagaggaggaggaaggugaagaugaag

SEQ ID NO: 352395 - RNA, 32 nt, Human
cagcucagaggguggucacagcauguguccuc

SEQ ID NO: 352396 - RNA, 32 nt, Human
cagcucagauugcaccacugcacuccagccug

SEQ ID NO: 352397 - RNA, 32 nt, Human
cagcucagcaacccuugcugugcucaaguucu

SEQ ID NO: 352398 - RNA, 32 nt, Human
cagcucagccaccuccuccucucaggucugcc

SEQ ID NO: 352399 - RNA, 32 nt, Human
cagcucagccccaacacagaggugagaccagg

SEQ ID NO: 352400 - RNA, 32 nt, Human
cagcucagccccggccacucccugccaacucc

SEQ ID NO: 352401 - RNA, 32 nt, Human
cagcucagccucccccugcugcucauccaggg

SEQ ID NO: 352402 - RNA, 32 nt, Human
cagcucagccuccuugauaaggguucuucuau

SEQ ID NO: 352403 - RNA, 32 nt, Human
cagcucagccugggcggcacagccagaugcga

SEQ ID NO: 352404 - RNA, 32 nt, Human
cagcucagcuaccacuuccccuucccucugca

SEQ ID NO: 352405 - RNA, 32 nt, Human
cagcucagcugauucugaccucagcgucucca

SEQ ID NO: 352406 - RNA, 32 nt, Human
cagcucagcugcaucuugcccuggauccucau

SEQ ID NO: 352407 - RNA, 32 nt, Human
cagcucagcuggccuggaaugggccaggcugg

SEQ ID NO: 352408 - RNA, 32 nt, Human
cagcucagcugucaucucagugaccaguuuuu

SEQ ID NO: 352409 - RNA, 32 nt, Human
cagcucaggaacccgcgaacccucucuugacc

SEQ ID NO: 352410 - RNA, 32 nt, Human
cagcucaggaaggaaagcccagcccuuucugg

SEQ ID NO: 352411 - RNA, 20 nt, Human
cagcucaggaugagucuucc

SEQ ID NO: 352412 - RNA, 32 nt, Human
cagcucaggcacaauugucaccaaggaguuaa

SEQ ID NO: 352413 - RNA, 32 nt, Human
cagcucaggcagcagaaguugcaggaagaaca

SEQ ID NO: 352414 - RNA, 32 nt, Human
cagcucaggcagcgcaggugugaugggcacag

SEQ ID NO: 352415 - RNA, 20 nt, Human
cagcucaggccccugggucc

SEQ ID NO: 352416 - RNA, 32 nt, Human
cagcucaggccccuuggagcaggauggcuccu

SEQ ID NO: 352417 - RNA, 32 nt, Human
cagcucaggccuguaaucucagcacuuuggga

SEQ ID NO: 352418 - RNA, 32 nt, Human
cagcucaggcugggcuguggugccagcauaga

SEQ ID NO: 352419 - RNA, 32 nt, Human
cagcucaggcuugauuccuacucucaaugugg

SEQ ID NO: 352420 - RNA, 32 nt, Human
cagcucagguacuucagaugugcuuaauaugg

SEQ ID NO: 352421 - RNA, 32 nt, Human
cagcucagguagcacauguaagagugagacug

SEQ ID NO: 352422 - RNA, 32 nt, Human
cagcucagugcaaccuccgccacccggguuca

SEQ ID NO: 352423 - RNA, 32 nt, Human
cagcucagugcaaccuccgcccccugggauca

SEQ ID NO: 352424 - RNA, 32 nt, Human
cagcucagugucauccagggccugugucccuc

SEQ ID NO: 352425 - RNA, 32 nt, Human
cagcucaguguuauggggaagggaggcccagc

SEQ ID NO: 352426 - RNA, 32 nt, Human
cagcucaguguucacagucaacacagcaggcu

SEQ ID NO: 352427 - RNA, 32 nt, Human
cagcucaguucugucauccaggacauggccgu

SEQ ID NO: 352428 - RNA, 20 nt, Human
cagcucaucagcagcagcag

SEQ ID NO: 352429 - RNA, 32 nt, Human
cagcucaucggcuguaggauuugggugagaca

SEQ ID NO: 352430 - RNA, 32 nt, Human
cagcucaucucccugguugcauggcccacuug

SEQ ID NO: 352431 - RNA, 32 nt, Human
cagcucaucucuggaagccuuugcuacucaag

SEQ ID NO: 352432 - RNA, 32 nt, Human
cagcucaugacuguaaucccagcacuuuggga

SEQ ID NO: 352433 - RNA, 32 nt, Human
cagcucaugccgagguggagguaguggaggaa

SEQ ID NO: 352434 - RNA, 32 nt, Human
cagcucaugccgguaaucucagcacuuuggga

SEQ ID NO: 352435 - RNA, 32 nt, Human
cagcucaugccuguaaucccagcacuuuggga

SEQ ID NO: 352436 - RNA, 32 nt, Human
cagcucaugccuguaauccuagcacuuuggaa

SEQ ID NO: 352437 - RNA, 32 nt, Human
cagcucaugccuguaaucuccagcacuuuggg

SEQ ID NO: 352438 - RNA, 32 nt, Human
cagcucauggcagaaggggacauacaggccca

SEQ ID NO: 352439 - RNA, 32 nt, Human
cagcucauuacagccuccaccucccaguuuca

SEQ ID NO: 352440 - RNA, 32 nt, Human
cagcucauugcaaccucugccuaacggguuca

SEQ ID NO: 352441 - RNA, 32 nt, Human
cagcucauugcaaccucugucucccagguuca

SEQ ID NO: 352442 - RNA, 32 nt, Human
cagcucauugcaacuuccaccuccuggguuga

SEQ ID NO: 352443 - RNA, 32 nt, Human
cagcucauugcagccucaaccucccaggcuca

SEQ ID NO: 352444 - RNA, 32 nt, Human
cagcucauuucugcuugaccuuuccuuguugc

SEQ ID NO: 352445 - RNA, 32 nt, Human
cagcuccaaacaggcuguaaccaaguccaccc

SEQ ID NO: 352446 - RNA, 32 nt, Human
cagcuccaaauacacauucucguucacucaac

SEQ ID NO: 352447 - RNA, 32 nt, Human
cagcuccaaaugcucaccuggcugucagggau

SEQ ID NO: 352448 - RNA, 19 nt, Human
cagcuccaaccugcaaaga

SEQ ID NO: 352449 - RNA, 18 nt, Human
cagcuccaagagguuuuu

SEQ ID NO: 352450 - RNA, 32 nt, Human
cagcuccaagagguuuuucagcucuuugacaa

SEQ ID NO: 352451 - RNA, 32 nt, Human
cagcuccaagagugggaccccaacucugucuu

SEQ ID NO: 352452 - RNA, 32 nt, Human
cagcuccaagccccagacagcaguucagaagu

SEQ ID NO: 352453 - RNA, 32 nt, Human
cagcuccaagccccagaccaugggagcugucu

SEQ ID NO: 352454 - RNA, 21 nt, Human
cagcuccaaggcccaguccag

SEQ ID NO: 352455 - RNA, 17 nt, Human
cagcuccaagggucucu

SEQ ID NO: 352456 - RNA, 21 nt, Human
cagcuccaauuugucuacaga

SEQ ID NO: 352457 - RNA, 32 nt, Human
cagcuccacaaccaccuccagccugggagaua

SEQ ID NO: 352458 - RNA, 24 nt, Human
cagcuccacaagcagcaggcccag

SEQ ID NO: 352459 - RNA, 19 nt, Human
cagcuccacacgccccggu

SEQ ID NO: 352460 - RNA, 21 nt, Human
cagcuccacagcagguggcug

SEQ ID NO: 352461 - RNA, 20 nt, Human
cagcuccacagccccuggca

SEQ ID NO: 352462 - RNA, 32 nt, Human
cagcuccacagccccuggcagaucccagaccc

SEQ ID NO: 352463 - RNA, 21 nt, Human
cagcuccacagcuuuacccag

SEQ ID NO: 352464 - RNA, 18 nt, Human
cagcuccacauccugggc

SEQ ID NO: 352465 - RNA, 21 nt, Human
cagcuccaccauccggaccag

SEQ ID NO: 352466 - RNA, 32 nt, Human
cagcuccaccauuccucccuguggcugugcca

SEQ ID NO: 352467 - RNA, 23 nt, Human
cagcuccacccuggccgagucca

SEQ ID NO: 352468 - RNA, 21 nt, Human
cagcuccacucaccuccugcc

SEQ ID NO: 352469 - RNA, 19 nt, Human
cagcuccacuccacgggug

SEQ ID NO: 352470 - RNA, 19 nt, Human
cagcuccacuccuggcugg

SEQ ID NO: 352471 - RNA, 32 nt, Human
cagcuccacuggcuggcugcgggcuccagcgg

SEQ ID NO: 352472 - RNA, 21 nt, Human
cagcuccagaaccacccgccc

SEQ ID NO: 352473 - RNA, 32 nt, Human
cagcuccagaagcuguuggaguugaggauuug

SEQ ID NO: 352474 - RNA, 32 nt, Human
cagcuccagagcagcgucugccaccgcccgcg

SEQ ID NO: 352475 - RNA, 32 nt, Human
cagcuccagagcccuggccggggccgcgggau

SEQ ID NO: 352476 - RNA, 32 nt, Human
cagcuccagcagcugcuccagcaguccccacc

SEQ ID NO: 352477 - RNA, 32 nt, Human
cagcuccagccccugaagaaacgauagaugug

SEQ ID NO: 352478 - RNA, 21 nt, Human
cagcuccagcuccagcuccag

SEQ ID NO: 352479 - RNA, 32 nt, Human
cagcuccagcucccagguauuuucuacaggac

SEQ ID NO: 352480 - RNA, 24 nt, Human
cagcuccaggacaucucagcccag

SEQ ID NO: 352481 - RNA, 21 nt, Human
cagcuccaggagggcaacaga

SEQ ID NO: 352482 - RNA, 32 nt, Human
cagcuccaggaguaggaagaagggugggcuuc

SEQ ID NO: 352483 - RNA, 32 nt, Human
cagcuccaggcugcaguaauguguugguaguu

SEQ ID NO: 352484 - RNA, 22 nt, Human
cagcuccagggacccaggccag

SEQ ID NO: 352485 - RNA, 18 nt, Human
cagcuccagggggacuca

SEQ ID NO: 352486 - RNA, 32 nt, Human
cagcuccaguguccaaaaagcgguuucuccaa

SEQ ID NO: 352487 - RNA, 32 nt, Human
cagcuccauccacucuccacaggcuggcucca

SEQ ID NO: 352488 - RNA, 32 nt, Human
cagcuccauccccuaguugcagacucaucacc

SEQ ID NO: 352489 - RNA, 32 nt, Human
cagcuccaugcaaccucugccuccuggguuca

SEQ ID NO: 352490 - RNA, 32 nt, Human
cagcuccaugccauugcaccuucuuuagucuu

SEQ ID NO: 352491 - RNA, 32 nt, Human
cagcuccauucauguuccugcaaaggacauaa

SEQ ID NO: 352492 - RNA, 32 nt, Human
cagcuccauuggaggggacacaucacuggcuu

SEQ ID NO: 352493 - RNA, 32 nt, Human
cagcucccaaaacaggaaguauacaaaauaac

SEQ ID NO: 352494 - RNA, 32 nt, Human
cagcucccaaaggucccggaggcccuuugucc

SEQ ID NO: 352495 - RNA, 32 nt, Human
cagcucccaaagugcugggauuacaggcauga

SEQ ID NO: 352496 - RNA, 32 nt, Human
cagcucccaaguagcugagauuacaggcaucc

SEQ ID NO: 352497 - RNA, 32 nt, Human
cagcucccaaguagcugggacuacaggugcac

SEQ ID NO: 352498 - RNA, 32 nt, Human
cagcucccaaguagcugggauuacaggcaugu

SEQ ID NO: 352499 - RNA, 28 nt, Human
cagcucccaagugcucccuauccagucc

SEQ ID NO: 352500 - RNA, 21 nt, Human
cagcucccaccuccuccuccc

SEQ ID NO: 352501 - RNA, 23 nt, Human
cagcucccacgccugacucaaca

SEQ ID NO: 352502 - RNA, 32 nt, Human
cagcucccagcaccccugcugugugguucauc

SEQ ID NO: 352503 - RNA, 32 nt, Human
cagcucccagcccugggcggccguaucaucag

SEQ ID NO: 352504 - RNA, 20 nt, Human
cagcucccagccuccugcuc

SEQ ID NO: 352505 - RNA, 32 nt, Human
cagcucccagccucuugcuuccugggcugagg

SEQ ID NO: 352506 - RNA, 32 nt, Human
cagcucccagcucucccccaggcugcaguauu

SEQ ID NO: 352507 - RNA, 32 nt, Human
cagcucccaggccacagcagaagcgggcuugu

SEQ ID NO: 352508 - RNA, 32 nt, Human
cagcucccaggcccuugggcaggcugggguga

SEQ ID NO: 352509 - RNA, 32 nt, Human
cagcucccaucccuccuuccucuccuucucca

SEQ ID NO: 352510 - RNA, 32 nt, Human
cagcucccaucuccuuucagaaaaauucaagg

SEQ ID NO: 352511 - RNA, 17 nt, Human
cagcucccauggcguca

SEQ ID NO: 352512 - RNA, 32 nt, Human
cagcucccauguccccaagaccucuggaguuu

SEQ ID NO: 352513 - RNA, 32 nt, Human
cagcuccccacccuccuugccuuugggugcgc

SEQ ID NO: 352514 - RNA, 32 nt, Human
cagcuccccacccucugccuccagucaccaug

SEQ ID NO: 352515 - RNA, 32 nt, Human
cagcuccccacuguccuccaucaaaguccccc

SEQ ID NO: 352516 - RNA, 21 nt, Human
cagcuccccacuucaccccaa

SEQ ID NO: 352517 - RNA, 32 nt, Human
cagcuccccacuugcugugcucucacucaaug

SEQ ID NO: 352518 - RNA, 32 nt, Human
cagcuccccagcccugcccgggggucgcgccg

SEQ ID NO: 352519 - RNA, 32 nt, Human
cagcuccccaggaggcugaggugggagguugg

SEQ ID NO: 352520 - RNA, 32 nt, Human
cagcuccccaggcaucccuccccaaauaaagg

SEQ ID NO: 352521 - RNA, 32 nt, Human
cagcuccccaguagcugggacuacaggcgccc

SEQ ID NO: 352522 - RNA, 32 nt, Human
cagcucccccuucaccccuccuugcccgccua

SEQ ID NO: 352523 - RNA, 32 nt, Human
cagcucccccuucacguugucaccaaggcccu

SEQ ID NO: 352524 - RNA, 22 nt, Human
cagcuccccgcagcuccugccc

SEQ ID NO: 352525 - RNA, 32 nt, Human
cagcuccccgccacucagaccuggguggugau

SEQ ID NO: 352526 - RNA, 32 nt, Human
cagcuccccgccugcaggggcaaagaggucga

SEQ ID NO: 352527 - RNA, 25 nt, Human
cagcuccccgcuccugcagguccag

SEQ ID NO: 352528 - RNA, 32 nt, Human
cagcuccccuccaguuucagugucacuguuaa

SEQ ID NO: 352529 - RNA, 32 nt, Human
cagcuccccuccccaucuccuugagucagcag

SEQ ID NO: 352530 - RNA, 32 nt, Human
cagcuccccugaccacagaggaagaggaucac

SEQ ID NO: 352531 - RNA, 32 nt, Human
cagcuccccugccacccagccucugaggccgg

SEQ ID NO: 352532 - RNA, 32 nt, Human
cagcuccccugccuccaggacccuguugcuau

SEQ ID NO: 352533 - RNA, 32 nt, Human
cagcuccccuguccuccuccaccuucuuccuc

SEQ ID NO: 352534 - RNA, 32 nt, Human
cagcuccccuugggucucagugccagugcugg

SEQ ID NO: 352535 - RNA, 32 nt, Human
cagcucccgggagcccuuaagccccagcuguc

SEQ ID NO: 352536 - RNA, 32 nt, Human
cagcucccgucccugggaccucagggaguagc

SEQ ID NO: 352537 - RNA, 32 nt, Human
cagcucccuagacugcaucccguaccucuucc

SEQ ID NO: 352538 - RNA, 32 nt, Human
cagcucccuagaggaauagagaugucugucac

SEQ ID NO: 352539 - RNA, 21 nt, Human
cagcucccuaggggcugagaa

SEQ ID NO: 352540 - RNA, 23 nt, Human
cagcucccuccagaaauucaaga

SEQ ID NO: 352541 - RNA, 20 nt, Human
cagcucccuccagaagcugc

SEQ ID NO: 352542 - RNA, 32 nt, Human
cagcucccuccccaucucacaucacccucagg

SEQ ID NO: 352543 - RNA, 20 nt, Human
cagcucccucuaaaauacuc

SEQ ID NO: 352544 - RNA, 32 nt, Human
cagcucccucuuugcuccucuggggcagcugc

SEQ ID NO: 352545 - RNA, 32 nt, Human
cagcucccugcaaccuccaccuccuggguuca

SEQ ID NO: 352546 - RNA, 32 nt, Human
cagcucccugcaaccuccgccucccggguuca

SEQ ID NO: 352547 - RNA, 32 nt, Human
cagcucccugcaaccuccgccuccuggguuca

SEQ ID NO: 352548 - RNA, 32 nt, Human
cagcucccugcacauccuggagagacaggugc

SEQ ID NO: 352549 - RNA, 32 nt, Human
cagcucccuggacccagagcucuuccagcucc

SEQ ID NO: 352550 - RNA, 32 nt, Human
cagcucccuguccuccccaacaccuagugaga

SEQ ID NO: 352551 - RNA, 32 nt, Human
cagcucccuugcccuuccccagccucaggcac

SEQ ID NO: 352552 - RNA, 22 nt, Human
cagcuccgaagaaucccccgcc

SEQ ID NO: 352553 - RNA, 20 nt, Human
cagcuccgaggaguccgccc

SEQ ID NO: 352554 - RNA, 21 nt, Human
cagcuccgcccggcuccgccc

SEQ ID NO: 352555 - RNA, 20 nt, Human
cagcuccgccuccccugccc

SEQ ID NO: 352556 - RNA, 20 nt, Human
cagcuccgcgcuccgcucuu

SEQ ID NO: 352557 - RNA, 23 nt, Human
cagcuccgcggcucugagaccag

SEQ ID NO: 352558 - RNA, 32 nt, Human
cagcuccgcucacagggcucucauuucgucca

SEQ ID NO: 352559 - RNA, 32 nt, Human
cagcuccgcucuuucagggaaggaugguaaca

SEQ ID NO: 352560 - RNA, 19 nt, Human
cagcuccggagcaguggcc

SEQ ID NO: 352561 - RNA, 32 nt, Human
cagcuccggcgcuggucucuggcuucgaaguc

SEQ ID NO: 352562 - RNA, 32 nt, Human
cagcuccguccccauggccauuggaucaugag

SEQ ID NO: 352563 - RNA, 23 nt, Human
cagcuccguggggcccuccgccc

SEQ ID NO: 352564 - RNA, 32 nt, Human
cagcuccuaccucuucccuccuugccagcccc

SEQ ID NO: 352565 - RNA, 32 nt, Human
cagcuccucacacuuauggcuauuucugacgu

SEQ ID NO: 352566 - RNA, 32 nt, Human
cagcuccucacucagcuccugccucccucucc

SEQ ID NO: 352567 - RNA, 32 nt, Human
cagcuccucaguaggcugagacaggagcauca

SEQ ID NO: 352568 - RNA, 22 nt, Human
cagcuccuccagucaugcucuu

SEQ ID NO: 352569 - RNA, 32 nt, Human
cagcuccucccccagcccuugggaccaucuuc

SEQ ID NO: 352570 - RNA, 32 nt, Human
cagcuccucccugccagcaucccagucaccac

SEQ ID NO: 352571 - RNA, 32 nt, Human
cagcuccucccuugcugaccugcccuuuccau

SEQ ID NO: 352572 - RNA, 22 nt, Human
cagcuccuccugcuuucuuggg

SEQ ID NO: 352573 - RNA, 32 nt, Human
cagcuccucgccucagcuccgcacggcccgug

SEQ ID NO: 352574 - RNA, 22 nt, Human
cagcuccucuccaauccugagg

SEQ ID NO: 352575 - RNA, 23 nt, Human
cagcuccucucugcaugcugagg

SEQ ID NO: 352576 - RNA, 32 nt, Human
cagcuccucucugugccgggggugggugaucc

SEQ ID NO: 352577 - RNA, 22 nt, Human
cagcuccucugcauaguuuuga

SEQ ID NO: 352578 - RNA, 32 nt, Human
cagcuccucuuaaauccuccaaucucaguacc

SEQ ID NO: 352579 - RNA, 32 nt, Human
cagcuccugaaaugcuaauuuaccccuuaccu

SEQ ID NO: 352580 - RNA, 32 nt, Human
cagcuccugagacacagcuggccggcacaaca

SEQ ID NO: 352581 - RNA, 32 nt, Human
cagcuccugaguagcuggaacuacaggcacgc

SEQ ID NO: 352582 - RNA, 32 nt, Human
cagcuccugaguagcugggauuacaggcgccc

SEQ ID NO: 352583 - RNA, 32 nt, Human
cagcuccugaguagcugggccugugcacuggg

SEQ ID NO: 352584 - RNA, 32 nt, Human
cagcuccugcagccucauccuaguuuaauaug

SEQ ID NO: 352585 - RNA, 32 nt, Human
cagcuccugcagcuccacgggaggcuugccgg

SEQ ID NO: 352586 - RNA, 32 nt, Human
cagcuccugcagucccagcuacucaggaguug

SEQ ID NO: 352587 - RNA, 32 nt, Human
cagcuccugcccaucugucccaacacaggaag

SEQ ID NO: 352588 - RNA, 32 nt, Human
cagcuccugccucacacuggccuguugaggcc

SEQ ID NO: 352589 - RNA, 32 nt, Human
cagcuccugccuggggcagugagggaauggga

SEQ ID NO: 352590 - RNA, 32 nt, Human
cagcuccugcucccccuaguucuuccgcuccu

SEQ ID NO: 352591 - RNA, 23 nt, Human
cagcuccugcugccauccccagg

SEQ ID NO: 352592 - RNA, 32 nt, Human
cagcuccuggacagccucuuggcuccagcccc

SEQ ID NO: 352593 - RNA, 32 nt, Human
cagcuccuggggagcaucagggaagagggggc

SEQ ID NO: 352594 - RNA, 32 nt, Human
cagcuccuggggauggaaauggaggaucccag

SEQ ID NO: 352595 - RNA, 22 nt, Human
cagcuccugucccuggguucag

SEQ ID NO: 352596 - RNA, 22 nt, Human
cagcuccugucuccagcagcuu

SEQ ID NO: 352597 - RNA, 24 nt, Human
cagcuccuguggccacagcagcuu

SEQ ID NO: 352598 - RNA, 32 nt, Human
cagcuccuuccuccuccuccuccuccucuggu

SEQ ID NO: 352599 - RNA, 32 nt, Human
cagcuccuuccuccucuuccuccuccuccucc

SEQ ID NO: 352600 - RNA, 32 nt, Human
cagcuccuuccuggaaagcuggaggggacuuu

SEQ ID NO: 352601 - RNA, 32 nt, Human
cagcuccuucggcauuucugcaaggaggacuu

SEQ ID NO: 352602 - RNA, 32 nt, Human
cagcuccuucuggucauuuucucagcugguua

SEQ ID NO: 352603 - RNA, 32 nt, Human
cagcuccuucuuacagugcacacacacgcucc

SEQ ID NO: 352604 - RNA, 20 nt, Human
cagcuccuugaucuucgaca

SEQ ID NO: 352605 - RNA, 32 nt, Human
cagcuccuugggaggcugagacaggaggauuc

SEQ ID NO: 352606 - RNA, 19 nt, Human
cagcuccuuggucaauaga

SEQ ID NO: 352607 - RNA, 32 nt, Human
cagcuccuuggugguuucaucuccucuguggg

SEQ ID NO: 352608 - RNA, 32 nt, Human
cagcuccuuucccuuuuccaucaucucuuuuc

SEQ ID NO: 352609 - RNA, 22 nt, Human
cagcuccuuugagagacugagg

SEQ ID NO: 352610 - RNA, 21 nt, Human
cagcuccuuugccccuggagg

SEQ ID NO: 352611 - RNA, 21 nt, Human
cagcuccuuugggucccgagg

SEQ ID NO: 352612 - RNA, 32 nt, Human
cagcuccuuuggugugugggugcucugaccuc

SEQ ID NO: 352613 - RNA, 32 nt, Human
cagcucgauuccagauaggaaaaaggaaauau

SEQ ID NO: 352614 - RNA, 19 nt, Human
cagcucgcaccccuucugu

SEQ ID NO: 352615 - RNA, 32 nt, Human
cagcucgcaugggggagucuaucccgcuggcc

SEQ ID NO: 352616 - RNA, 32 nt, Human
cagcucgccgcaaccuccgccucccagguuca

SEQ ID NO: 352617 - RNA, 24 nt, Human
cagcucgccgcucccuagcaccuu

SEQ ID NO: 352618 - RNA, 32 nt, Human
cagcucgcgagcccuggcgucgcguaggaggg

SEQ ID NO: 352619 - RNA, 18 nt, Human
cagcucgcgccccuuccc

SEQ ID NO: 352620 - RNA, 19 nt, Human
cagcucgcgccccuuccca

SEQ ID NO: 352621 - RNA, 32 nt, Human
cagcucgcuacaaccucuaccucccagccacc

SEQ ID NO: 352622 - RNA, 32 nt, Human
cagcucgcucucuccccucagcuuaacgauga

SEQ ID NO: 352623 - RNA, 32 nt, Human
cagcucgcugcaacccccaccucccagguuca

SEQ ID NO: 352624 - RNA, 32 nt, Human
cagcucgcugcaaccuccaccuccugggcuca

SEQ ID NO: 352625 - RNA, 32 nt, Human
cagcucgcugcaaccuccaccuccuggguuca

SEQ ID NO: 352626 - RNA, 32 nt, Human
cagcucgcugcaaccuccaccuuccggguuca

SEQ ID NO: 352627 - RNA, 32 nt, Human
cagcucgcugcaagcuccgccucccaaguuca

SEQ ID NO: 352628 - RNA, 32 nt, Human
cagcucgcugcagccuccaccucccggacucc

SEQ ID NO: 352629 - RNA, 19 nt, Human
cagcucggagcuugugcug

SEQ ID NO: 352630 - RNA, 32 nt, Human
cagcucggaggcggguguggcuggaggacggc

SEQ ID NO: 352631 - RNA, 32 nt, Human
cagcucggccgugccuugaggccagguucgag

SEQ ID NO: 352632 - RNA, 32 nt, Human
cagcucggccucugcugccugccggugcucuu

SEQ ID NO: 352633 - RNA, 32 nt, Human
cagcucggcuugcugcggucucagguuucuuu

SEQ ID NO: 352634 - RNA, 32 nt, Human
cagcucgggcccagccuucucucuccagcugc

SEQ ID NO: 352635 - RNA, 32 nt, Human
cagcucgggcucugcugccggcucuccggcuu

SEQ ID NO: 352636 - RNA, 23 nt, Human
cagcucgggugacaagagugaga

SEQ ID NO: 352637 - RNA, 32 nt, Human
cagcucggucaccaaagcugucuggucccagg

SEQ ID NO: 352638 - RNA, 32 nt, Human
cagcucguccacaagcucaucgauuuucuuua

SEQ ID NO: 352639 - RNA, 32 nt, Human
cagcucgugugggcgcucguccacaaacacuc

SEQ ID NO: 352640 - RNA, 32 nt, Human
cagcucuaaccagucuuucauggaugcauaca

SEQ ID NO: 352641 - RNA, 32 nt, Human
cagcucuaaucaagcaccauauaaacaagaaa

SEQ ID NO: 352642 - RNA, 32 nt, Human
cagcucuaccugcauaggcaguggcugcucaa

SEQ ID NO: 352643 - RNA, 32 nt, Human
cagcucuacuaagaauacaaaaauuagccagg

SEQ ID NO: 352644 - RNA, 32 nt, Human
cagcucuacuuaagaugcgaaaauuagccugg

SEQ ID NO: 352645 - RNA, 32 nt, Human
cagcucuagacacugccacacagggucugcaa

SEQ ID NO: 352646 - RNA, 32 nt, Human
cagcucuaggaacuuaguacuuuggagcuuuu

SEQ ID NO: 352647 - RNA, 32 nt, Human
cagcucuaggcggcucuggguaaguugucguu

SEQ ID NO: 352648 - RNA, 32 nt, Human
cagcucuaucccaaccucucccaacuauaaaa

SEQ ID NO: 352649 - RNA, 32 nt, Human
cagcucuauuccuuucuaugagcuagaagacc

SEQ ID NO: 352650 - RNA, 32 nt, Human
cagcucucagaucaggacaggcuguggaucug

SEQ ID NO: 352651 - RNA, 32 nt, Human
cagcucucagcccuauggccuuggcugagucc

SEQ ID NO: 352652 - RNA, 19 nt, Human
cagcucucagggcagggcu

SEQ ID NO: 352653 - RNA, 19 nt, Human
cagcucucauuuccuggca

SEQ ID NO: 352654 - RNA, 32 nt, Human
cagcucuccacccugaacuccccagcccccuc

SEQ ID NO: 352655 - RNA, 32 nt, Human
cagcucuccagccccaggacuucugcuggaac

SEQ ID NO: 352656 - RNA, 32 nt, Human
cagcucuccagccugggcgacagagugagacu

SEQ ID NO: 352657 - RNA, 22 nt, Human
cagcucuccagggagcuucugg

SEQ ID NO: 352658 - RNA, 22 nt, Human
cagcucuccauucuucccaaag

SEQ ID NO: 352659 - RNA, 32 nt, Human
cagcucucccagagaagauccaagggagagga

SEQ ID NO: 352660 - RNA, 23 nt, Human
cagcucuccccaaaguccacaga

SEQ ID NO: 352661 - RNA, 32 nt, Human
cagcucuccccaggaauccugcugccugcuga

SEQ ID NO: 352662 - RNA, 32 nt, Human
cagcucuccuaaaaauacaaaaauuagcugga

SEQ ID NO: 352663 - RNA, 32 nt, Human
cagcucuccuccagaagccuagguuuugccgc

SEQ ID NO: 352664 - RNA, 32 nt, Human
cagcucuccuguaacucagaggccagugugau

SEQ ID NO: 352665 - RNA, 32 nt, Human
cagcucuccuucuggcuucauccugucuucca

SEQ ID NO: 352666 - RNA, 24 nt, Human
cagcucucucgaagagaucuuaca

SEQ ID NO: 352667 - RNA, 32 nt, Human
cagcucucucuggggcccucccacucuccaca

SEQ ID NO: 352668 - RNA, 32 nt, Human
cagcucucugcaaccuccaccuccuggguuca

SEQ ID NO: 352669 - RNA, 32 nt, Human
cagcucucugcagucuccggcucucuccugca

SEQ ID NO: 352670 - RNA, 32 nt, Human
cagcucucugcgucccuccugggcccuccagc

SEQ ID NO: 352671 - RNA, 32 nt, Human
cagcucucugggaggcugaggcggguggauca

SEQ ID NO: 352672 - RNA, 32 nt, Human
cagcucucuucaaugacauagaaaguucaugg

SEQ ID NO: 352673 - RNA, 32 nt, Human
cagcucucuucgacguaccuguccucaggagc

SEQ ID NO: 352674 - RNA, 32 nt, Human
cagcucucuucucuccccaggacccaggcugu

SEQ ID NO: 352675 - RNA, 32 nt, Human
cagcucugaaaauucugccauuuccuuauuaa

SEQ ID NO: 352676 - RNA, 32 nt, Human
cagcucugaaggcugugagaccccggauuucc

SEQ ID NO: 352677 - RNA, 32 nt, Human
cagcucugaaugucuaaccugcuccccugauu

SEQ ID NO: 352678 - RNA, 17 nt, Human
cagcucugaucuccaca

SEQ ID NO: 352679 - RNA, 22 nt, Human
cagcucugaucugcaguuccca

SEQ ID NO: 352680 - RNA, 24 nt, Human
cagcucugauucuguaauacuaau

SEQ ID NO: 352681 - RNA, 32 nt, Human
cagcucugcauaccugcaccugcaccccagcc

SEQ ID NO: 352682 - RNA, 32 nt, Human
cagcucugcaucaacacagcagccugcagaua

SEQ ID NO: 352683 - RNA, 22 nt, Human
cagcucugccagugcucucugg

SEQ ID NO: 352684 - RNA, 32 nt, Human
cagcucugccccagcccugagaggggugguga

SEQ ID NO: 352685 - RNA, 22 nt, Human
cagcucugcccucgcuugcugg

SEQ ID NO: 352686 - RNA, 21 nt, Human
cagcucugcccucugggucca

SEQ ID NO: 352687 - RNA, 21 nt, Human
cagcucugccguccuuccgca

SEQ ID NO: 352688 - RNA, 32 nt, Human
cagcucugccucacagcacccuggccaaguuu

SEQ ID NO: 352689 - RNA, 32 nt, Human
cagcucugccuccgccccuccugcggcuucac

SEQ ID NO: 352690 - RNA, 20 nt, Human
cagcucugccuccuccuccc

SEQ ID NO: 352691 - RNA, 20 nt, Human
cagcucugccugcugccugg

SEQ ID NO: 352692 - RNA, 20 nt, Human
cagcucugcucuguuuucuc

SEQ ID NO: 352693 - RNA, 20 nt, Human
cagcucugcugcccccaccc

SEQ ID NO: 352694 - RNA, 32 nt, Human
cagcucugcugcuccucuacucuugggucgag

SEQ ID NO: 352695 - RNA, 32 nt, Human
cagcucuggaaacaaugagaucaaaugagaaa

SEQ ID NO: 352696 - RNA, 32 nt, Human
cagcucuggaaagaggguuuaagaugcuagga

SEQ ID NO: 352697 - RNA, 19 nt, Human
cagcucuggaaccuucaua

SEQ ID NO: 352698 - RNA, 32 nt, Human
cagcucuggacccccucccucaccgcacaacu

SEQ ID NO: 352699 - RNA, 24 nt, Human
cagcucuggcacugcccccuccca

SEQ ID NO: 352700 - RNA, 32 nt, Human
cagcucuggccugugguuccagaagcugagaa

SEQ ID NO: 352701 - RNA, 32 nt, Human
cagcucuggcuuuggagcagcuucugggacca

SEQ ID NO: 352702 - RNA, 32 nt, Human
cagcucugggacccagcucugaaagggcacga

SEQ ID NO: 352703 - RNA, 32 nt, Human
cagcucugggagagaggagugucagacagcug

SEQ ID NO: 352704 - RNA, 32 nt, Human
cagcucugggcaagauccauaaacuuuuaaag

SEQ ID NO: 352705 - RNA, 32 nt, Human
cagcucugggcacccuggccacccugguccuu

SEQ ID NO: 352706 - RNA, 32 nt, Human
cagcucugggcucugcugugagucaagcugug

SEQ ID NO: 352707 - RNA, 32 nt, Human
cagcucugggcugggcuuucugggggccacac

SEQ ID NO: 352708 - RNA, 32 nt, Human
cagcucugggggccuagcaggagcucagggac

SEQ ID NO: 352709 - RNA, 32 nt, Human
cagcucugggguccccauguaagggcaggggc

SEQ ID NO: 352710 - RNA, 21 nt, Human
cagcucugguaccuccugccc

SEQ ID NO: 352711 - RNA, 32 nt, Human
cagcucuggugagacggccugggcaggccgag

SEQ ID NO: 352712 - RNA, 32 nt, Human
cagcucugguuacccacguauuuccuuuaaug

SEQ ID NO: 352713 - RNA, 32 nt, Human
cagcucuguagggagcucugccagaggggcag

SEQ ID NO: 352714 - RNA, 32 nt, Human
cagcucuguauggcccacaccugguccacagg

SEQ ID NO: 352715 - RNA, 21 nt, Human
cagcucuguccccuccugcuc

SEQ ID NO: 352716 - RNA, 32 nt, Human
cagcucugucccugugcaggcuccaggcuccc

SEQ ID NO: 352717 - RNA, 32 nt, Human
cagcucuguccuuaacacacagcaggucuaug

SEQ ID NO: 352718 - RNA, 32 nt, Human
cagcucugugacugauucccucccgggugcug

SEQ ID NO: 352719 - RNA, 19 nt, Human
cagcucugugauccuuccg

SEQ ID NO: 352720 - RNA, 32 nt, Human
cagcucugugccccaugcuccuuggggcuugc

SEQ ID NO: 352721 - RNA, 32 nt, Human
cagcucuguggccuucauguuccgaaaguuca

SEQ ID NO: 352722 - RNA, 32 nt, Human
cagcucugugucagccacugcggccuuagaga

SEQ ID NO: 352723 - RNA, 32 nt, Human
cagcucuguguccucagagucgcugucaucaa

SEQ ID NO: 352724 - RNA, 32 nt, Human
cagcucugugugauucaaguucuggcagagcu

SEQ ID NO: 352725 - RNA, 32 nt, Human
cagcucuguguguguggguggucacaggagag

SEQ ID NO: 352726 - RNA, 32 nt, Human
cagcucuguguguguggguggucacaggaggg

SEQ ID NO: 352727 - RNA, 32 nt, Human
cagcucuguuccacaagaagcaaugggacugc

SEQ ID NO: 352728 - RNA, 32 nt, Human
cagcucuguuucugcugcuuccaucaaagcca

SEQ ID NO: 352729 - RNA, 32 nt, Human
cagcucuuaccucaccucccuccauuuacauu

SEQ ID NO: 352730 - RNA, 21 nt, Human
cagcucuuaggagcucucaca

SEQ ID NO: 352731 - RNA, 32 nt, Human
cagcucuucauuaugcagcuucccuuuuaggu

SEQ ID NO: 352732 - RNA, 21 nt, Human
cagcucuucccugaccuucac

SEQ ID NO: 352733 - RNA, 17 nt, Human
cagcucuuccgcuccuc

SEQ ID NO: 352734 - RNA, 32 nt, Human
cagcucuuccucacccacuacaucaccaaguc

SEQ ID NO: 352735 - RNA, 32 nt, Human
cagcucuuccuugagcagccauggccagcucc

SEQ ID NO: 352736 - RNA, 19 nt, Human
cagcucuucggaggcauca

SEQ ID NO: 352737 - RNA, 25 nt, Human
cagcucuucucucagaaguucagcu

SEQ ID NO: 352738 - RNA, 32 nt, Human
cagcucuucugagaacuuccaaccacccaugc

SEQ ID NO: 352739 - RNA, 32 nt, Human
cagcucuucuguccuuggccaccagagacugc

SEQ ID NO: 352740 - RNA, 32 nt, Human
cagcucuugccagcuucucugacacuuggguu

SEQ ID NO: 352741 - RNA, 32 nt, Human
cagcucuugcccagagcugugcagugcagugg

SEQ ID NO: 352742 - RNA, 32 nt, Human
cagcucuuucagcuccuucuugcucagcuugu

SEQ ID NO: 352743 - RNA, 24 nt, Human
cagcucuuucuggaccuucaggca

SEQ ID NO: 352744 - RNA, 20 nt, Human
cagcucuuugauuugccaua

SEQ ID NO: 352745 - RNA, 32 nt, Human
cagcucuuugggaggccaaggcagguagauca

SEQ ID NO: 352746 - RNA, 32 nt, Human
cagcucuuugggaggccgaggugggcagauca

SEQ ID NO: 352747 - RNA, 32 nt, Human
cagcugaacaacaaggcuuugggugugaaggg

SEQ ID NO: 352748 - RNA, 32 nt, Human
cagcugaagacucagcccugaggucuggggca

SEQ ID NO: 352749 - RNA, 32 nt, Human
cagcugaaggguaaaaucuuucuuugcagaga

SEQ ID NO: 352750 - RNA, 22 nt, Human
cagcugaaggugaggggaugga

SEQ ID NO: 352751 - RNA, 32 nt, Human
cagcugaagucugccuguggauucuccuugua

SEQ ID NO: 352752 - RNA, 32 nt, Human
cagcugaauacuaagcucaucaacuucuccuu

SEQ ID NO: 352753 - RNA, 19 nt, Human
cagcugacaauggcuuugg

SEQ ID NO: 352754 - RNA, 32 nt, Human
cagcugacacauaauuugaauggugcagaaaa

SEQ ID NO: 352755 - RNA, 19 nt, Human
cagcugacagauacauaga

SEQ ID NO: 352756 - RNA, 21 nt, Human
cagcugacagauagacucaga

SEQ ID NO: 352757 - RNA, 21 nt, Human
cagcugacagccgugcucaga

SEQ ID NO: 352758 - RNA, 20 nt, Human
cagcugacagugggaugagg

SEQ ID NO: 352759 - RNA, 20 nt, Human
cagcugacaguggucgugga

SEQ ID NO: 352760 - RNA, 20 nt, Human
cagcugaccauacuaccaga

SEQ ID NO: 352761 - RNA, 32 nt, Human
cagcugaccccaaaagugcugagcaugugcug

SEQ ID NO: 352762 - RNA, 32 nt, Human
cagcugacccuugagccauaacccauaagcuc

SEQ ID NO: 352763 - RNA, 32 nt, Human
cagcugaccucccuccccuugugcagacugga

SEQ ID NO: 352764 - RNA, 22 nt, Human
cagcugaccugcccuguccucu

SEQ ID NO: 352765 - RNA, 32 nt, Human
cagcugacgacuggcccugcuucugcuggggc

SEQ ID NO: 352766 - RNA, 32 nt, Human
cagcugacgcccucccugccucccagggcagc

SEQ ID NO: 352767 - RNA, 32 nt, Human
cagcugacgggacccagcuguagugagguugc

SEQ ID NO: 352768 - RNA, 32 nt, Human
cagcugacucacagagcugcagagccaggcug

SEQ ID NO: 352769 - RNA, 32 nt, Human
cagcugacugcacugccaggagccaaggccua

SEQ ID NO: 352770 - RNA, 32 nt, Human
cagcugacugcagccuugaccuccagggcuca

SEQ ID NO: 352771 - RNA, 32 nt, Human
cagcugacugcugcauuuaggccaggucucca

SEQ ID NO: 352772 - RNA, 32 nt, Human
cagcugagaaaagguauguucaagucauaagu

SEQ ID NO: 352773 - RNA, 32 nt, Human
cagcugagaaggcugcaagugacgagaaagau

SEQ ID NO: 352774 - RNA, 32 nt, Human
cagcugagaggcauccagaaaaguaucagggu

SEQ ID NO: 352775 - RNA, 32 nt, Human
cagcugagaucucugugacacuguggauucag

SEQ ID NO: 352776 - RNA, 32 nt, Human
cagcugagauggcagacaggagagaugggccc

SEQ ID NO: 352777 - RNA, 32 nt, Human
cagcugagauggugccacugcacuccagccug

SEQ ID NO: 352778 - RNA, 32 nt, Human
cagcugagcagggagcaguggagaagcaguaa

SEQ ID NO: 352779 - RNA, 32 nt, Human
cagcugagcaucagcucagcccugccaugucc

SEQ ID NO: 352780 - RNA, 17 nt, Human
cagcugagcaugggaug

SEQ ID NO: 352781 - RNA, 32 nt, Human
cagcugagccgguuagggcugaagaggagcgu

SEQ ID NO: 352782 - RNA, 32 nt, Human
cagcugagccuagaggugaauuucauugggga

SEQ ID NO: 352783 - RNA, 32 nt, Human
cagcugagccuagaggugaauuucguugggga

SEQ ID NO: 352784 - RNA, 32 nt, Human
cagcugagccuggaacugacccuuccuucauc

SEQ ID NO: 352785 - RNA, 32 nt, Human
cagcugaggagggagagggggagcguagccuu

SEQ ID NO: 352786 - RNA, 32 nt, Human
cagcugaggccuugccuugaaggggcagcugu

SEQ ID NO: 352787 - RNA, 18 nt, Human
cagcugaggcgucucucu

SEQ ID NO: 352788 - RNA, 32 nt, Human
cagcugagguccaauaguuaugucuguguauu

SEQ ID NO: 352789 - RNA, 17 nt, Human
cagcugagguccuccca

SEQ ID NO: 352790 - RNA, 32 nt, Human
cagcugagugagagacacagagagaaggagaa

SEQ ID NO: 352791 - RNA, 32 nt, Human
cagcugagugagugggagaguaccuguguguu

SEQ ID NO: 352792 - RNA, 20 nt, Human
cagcugagugccugcuuuuu

SEQ ID NO: 352793 - RNA, 32 nt, Human
cagcugagugguuguucucagucuuauuauua

SEQ ID NO: 352794 - RNA, 32 nt, Human
cagcugaguuuccagcuggcagccagguccuc

SEQ ID NO: 352795 - RNA, 32 nt, Human
cagcugauccagaggaacccagagccaacuua

SEQ ID NO: 352796 - RNA, 32 nt, Human
cagcugauccggacuggaugugaccuucugcc

SEQ ID NO: 352797 - RNA, 32 nt, Human
cagcugauccugcuccuguggccuccagccuc

SEQ ID NO: 352798 - RNA, 31 nt, Human
cagcugaugggccccagguggggagggacag

SEQ ID NO: 352799 - RNA, 32 nt, Human
cagcugauuagcaaccuuaguucaucugcagu

SEQ ID NO: 352800 - RNA, 32 nt, Human
cagcugauugacaccguccugccuuccuuauu

SEQ ID NO: 352801 - RNA, 32 nt, Human
cagcugcaaauggucaguuguauauuugcuaa

SEQ ID NO: 352802 - RNA, 18 nt, Human
cagcugcaaucacuagca

SEQ ID NO: 352803 - RNA, 19 nt, Human
cagcugcacagcacaggca

SEQ ID NO: 352804 - RNA, 25 nt, Human
cagcugcacagcccgcaacgccgca

SEQ ID NO: 352805 - RNA, 32 nt, Human
cagcugcaccagagcaaccucucacuccccau

SEQ ID NO: 352806 - RNA, 32 nt, Human
cagcugcacccauuuucuggagguuuugcugc

SEQ ID NO: 352807 - RNA, 32 nt, Human
cagcugcacgucccaggcucuccagcgcgcgg

SEQ ID NO: 352808 - RNA, 32 nt, Human
cagcugcacugaagacgagccugggguggaga

SEQ ID NO: 352809 - RNA, 32 nt, Human
cagcugcacugagaggggagguuuccacaccc

SEQ ID NO: 352810 - RNA, 32 nt, Human
cagcugcagagcuuguggaggccauggggcgc

SEQ ID NO: 352811 - RNA, 32 nt, Human
cagcugcagaggaggaaagggaaaggguaggc

SEQ ID NO: 352812 - RNA, 32 nt, Human
cagcugcagaggcugcagccccgguccccagc

SEQ ID NO: 352813 - RNA, 32 nt, Human
cagcugcagagugcacagggagggucagaagu

SEQ ID NO: 352814 - RNA, 32 nt, Human
cagcugcagcagcgggaagcucgguggcaagc

SEQ ID NO: 352815 - RNA, 32 nt, Human
cagcugcagcagcuggagggcgaagugaagga

SEQ ID NO: 352816 - RNA, 32 nt, Human
cagcugcagcaucaucuccacccuccagccau

SEQ ID NO: 352817 - RNA, 32 nt, Human
cagcugcagcccaggcaggagcagucgccuuu

SEQ ID NO: 352818 - RNA, 24 nt, Human
cagcugcagccuccgccuacguga

SEQ ID NO: 352819 - RNA, 23 nt, Human
cagcugcagccuccucccccuga

SEQ ID NO: 352820 - RNA, 32 nt, Human
cagcugcagccugccugugcuggcugcugggg

SEQ ID NO: 352821 - RNA, 32 nt, Human
cagcugcagccugcucugugguuuacuuugca

SEQ ID NO: 352822 - RNA, 32 nt, Human
cagcugcagccugcugccugcccuucauggcu

SEQ ID NO: 352823 - RNA, 32 nt, Human
cagcugcagcugcuggucgccaguauaaguau

SEQ ID NO: 352824 - RNA, 32 nt, Human
cagcugcaggaaggcucugacaacagcccgcc

SEQ ID NO: 352825 - RNA, 32 nt, Human
cagcugcaggaccucaagacaccugggcagac

SEQ ID NO: 352826 - RNA, 32 nt, Human
cagcugcaggagugcuugugggcugcuauggg

SEQ ID NO: 352827 - RNA, 32 nt, Human
cagcugcaggcaagcauuaugcugcuauugaa

SEQ ID NO: 352828 - RNA, 32 nt, Human
cagcugcagggagggccagggagguugggggu

SEQ ID NO: 352829 - RNA, 21 nt, Human
cagcugcaggguccuuccaca

SEQ ID NO: 352830 - RNA, 32 nt, Human
cagcugcagugguugggaggagcuugaccagu

SEQ ID NO: 352831 - RNA, 18 nt, Human
cagcugcaugagucuucc

SEQ ID NO: 352832 - RNA, 24 nt, Human
cagcugcaugcagccugcagggga

SEQ ID NO: 352833 - RNA, 32 nt, Human
cagcugcauggaagguggaggacagaagcccu

SEQ ID NO: 352834 - RNA, 32 nt, Human
cagcugccaacccuggagcccagaccgaggug

SEQ ID NO: 352835 - RNA, 32 nt, Human
cagcugccaacuucacaccagccccaacccgc

SEQ ID NO: 352836 - RNA, 28 nt, Human
cagcugccaagugcucuuuguuacuguc

SEQ ID NO: 352837 - RNA, 32 nt, Human
cagcugccacacccuuucugggagaagcaugg

SEQ ID NO: 352838 - RNA, 23 nt, Human
cagcugccaccucccucaccaca

SEQ ID NO: 352839 - RNA, 32 nt, Human
cagcugccagccuucuguccugggcaaacuac

SEQ ID NO: 352840 - RNA, 22 nt, Human
cagcugccagcuucauuuucuc

SEQ ID NO: 352841 - RNA, 32 nt, Human
cagcugccaguguggcuagaaugaagcaggca

SEQ ID NO: 352842 - RNA, 32 nt, Human
cagcugccaucgccgcuacaggcaccagugcc

SEQ ID NO: 352843 - RNA, 32 nt, Human
cagcugccaucgccuccugggugaagaggacg

SEQ ID NO: 352844 - RNA, 32 nt, Human
cagcugcccagccccaggccugcccucggccu

SEQ ID NO: 352845 - RNA, 32 nt, Human
cagcugcccagccuguucacaugcuggggacc

SEQ ID NO: 352846 - RNA, 23 nt, Human
cagcugcccagcuccugcucagu

SEQ ID NO: 352847 - RNA, 32 nt, Human
cagcugcccaggacacagugcaggccagagcg

SEQ ID NO: 352848 - RNA, 32 nt, Human
cagcugcccaggaggcugaggcaggagaaucg

SEQ ID NO: 352849 - RNA, 32 nt, Human
cagcugcccaggaggcugaggcaugagaaucg

SEQ ID NO: 352850 - RNA, 32 nt, Human
cagcugcccaggcuggagugugguggcgccau

SEQ ID NO: 352851 - RNA, 32 nt, Human
cagcugcccagugucauagaaaagcaauucac

SEQ ID NO: 352852 - RNA, 32 nt, Human
cagcugcccaguuuccugaucgggguggauuu

SEQ ID NO: 352853 - RNA, 21 nt, Human
cagcugccccccuccccuccc

SEQ ID NO: 352854 - RNA, 32 nt, Human
cagcugcccccuucguguuucccuguguuugc

SEQ ID NO: 352855 - RNA, 32 nt, Human
cagcugccccuguccccaccucuggagaaucc

SEQ ID NO: 352856 - RNA, 32 nt, Human
cagcugccccuucucagccucugaggauccag

SEQ ID NO: 352857 - RNA, 32 nt, Human
cagcugcccuagugaggccccagccuaccugc

SEQ ID NO: 352858 - RNA, 32 nt, Human
cagcugccgaagguggagcccagagccugucu

SEQ ID NO: 352859 - RNA, 32 nt, Human
cagcugccgcgccugcucacacccugaccucg

SEQ ID NO: 352860 - RNA, 32 nt, Human
cagcugccuaucuucccggugcaacaucgccu

SEQ ID NO: 352861 - RNA, 32 nt, Human
cagcugccucaaaccuuugggauuuucagaau

SEQ ID NO: 352862 - RNA, 32 nt, Human
cagcugccucaaaucuuugggaauuucagaau

SEQ ID NO: 352863 - RNA, 32 nt, Human
cagcugccucagcacuuugauuuuggacaggg

SEQ ID NO: 352864 - RNA, 32 nt, Human
cagcugccuccaccaagacuucacccaaccac

SEQ ID NO: 352865 - RNA, 32 nt, Human
cagcugccuccuccaggcaucuuccuggcucu

SEQ ID NO: 352866 - RNA, 18 nt, Human
cagcugccuccuccucca

SEQ ID NO: 352867 - RNA, 32 nt, Human
cagcugccuccuccucuucucuccccgcucuc

SEQ ID NO: 352868 - RNA, 32 nt, Human
cagcugccuccuggcaggagccugcuugugcg

SEQ ID NO: 352869 - RNA, 32 nt, Human
cagcugccugcaggaagaucuggcucagucua

SEQ ID NO: 352870 - RNA, 32 nt, Human
cagcugccugcaggugcucccagcuauaucca

SEQ ID NO: 352871 - RNA, 32 nt, Human
cagcugccugccaggggagaccugggaccugg

SEQ ID NO: 352872 - RNA, 32 nt, Human
cagcugccugcucuccagccucuggaggaacu

SEQ ID NO: 352873 - RNA, 32 nt, Human
cagcugccugcuucucgccugccugugucugc

SEQ ID NO: 352874 - RNA, 18 nt, Human
cagcugccuggcugggga

SEQ ID NO: 352875 - RNA, 32 nt, Human
cagcugccugggaagucuucacucacuuccug

SEQ ID NO: 352876 - RNA, 32 nt, Human
cagcugccugggaaucacgcuccuuccugcuc

SEQ ID NO: 352877 - RNA, 32 nt, Human
cagcugccugggacucaauuugccccauccau

SEQ ID NO: 352878 - RNA, 32 nt, Human
cagcugccugggaucccucauccucauaccca

SEQ ID NO: 352879 - RNA, 32 nt, Human
cagcugccuggggcccaaguugcagugagcag

SEQ ID NO: 352880 - RNA, 32 nt, Human
cagcugccuggugcauaccucuugccucgguc

SEQ ID NO: 352881 - RNA, 32 nt, Human
cagcugccuucaggcccugcgccgccuccgga

SEQ ID NO: 352882 - RNA, 32 nt, Human
cagcugccuuccuuuuggauucccaagcuuca

SEQ ID NO: 352883 - RNA, 32 nt, Human
cagcugccuugauuucccucucccaggggccu

SEQ ID NO: 352884 - RNA, 32 nt, Human
cagcugccuuuaaaggguacacagaccaguuc

SEQ ID NO: 352885 - RNA, 32 nt, Human
cagcugccuuucuacccccaauggcagcugcc

SEQ ID NO: 352886 - RNA, 32 nt, Human
cagcugccuuuuucacacccacuccagcccuc

SEQ ID NO: 352887 - RNA, 32 nt, Human
cagcugcgccuaggcuggagcuggaagggugg

SEQ ID NO: 352888 - RNA, 32 nt, Human
cagcugcgcggagaacuggggcucaccgucau

SEQ ID NO: 352889 - RNA, 32 nt, Human
cagcugcggacucuggagcugccuguagauua

SEQ ID NO: 352890 - RNA, 24 nt, Human
cagcugcggcagccccucccagcc

SEQ ID NO: 352891 - RNA, 32 nt, Human
cagcugcgggcuuugagaguccugagccaggc

SEQ ID NO: 352892 - RNA, 24 nt, Human
cagcugcguacaaaggccucugcc

SEQ ID NO: 352893 - RNA, 19 nt, Human
cagcugcguccggcggagg

SEQ ID NO: 352894 - RNA, 19 nt, Human
cagcugcguggucuccgca

SEQ ID NO: 352895 - RNA, 20 nt, Human
cagcugcuaacugauuuccu

SEQ ID NO: 352896 - RNA, 32 nt, Human
cagcugcuaagcucugcagcuccccaguggac

SEQ ID NO: 352897 - RNA, 18 nt, Human
cagcugcuaauccuuuuc

SEQ ID NO: 352898 - RNA, 32 nt, Human
cagcugcuagagaaagagaaguagaagaacgg

SEQ ID NO: 352899 - RNA, 32 nt, Human
cagcugcuaucagcgcagugguggugaccgag

SEQ ID NO: 352900 - RNA, 17 nt, Human
cagcugcuaucauuuuc

SEQ ID NO: 352901 - RNA, 32 nt, Human
cagcugcucagcucuggcuucuguaaaccgcc

SEQ ID NO: 352902 - RNA, 32 nt, Human
cagcugcucaggauaucaaagaaucuucaacc

SEQ ID NO: 352903 - RNA, 20 nt, Human
cagcugcucaguucccaggg

SEQ ID NO: 352904 - RNA, 32 nt, Human
cagcugcucauuucccccagccccagccccug

SEQ ID NO: 352905 - RNA, 20 nt, Human
cagcugcuccccaugguuca

SEQ ID NO: 352906 - RNA, 32 nt, Human
cagcugcuccuugggcagaguuggcaauguuu

SEQ ID NO: 352907 - RNA, 32 nt, Human
cagcugcucgggagguugagggagaagaauca

SEQ ID NO: 352908 - RNA, 32 nt, Human
cagcugcucgggagguugaugcaggagaauca

SEQ ID NO: 352909 - RNA, 32 nt, Human
cagcugcucguuucugugccucugcacucaca

SEQ ID NO: 352910 - RNA, 32 nt, Human
cagcugcucugccccuuuccccuucuucccug

SEQ ID NO: 352911 - RNA, 32 nt, Human
cagcugcucuguccucuccaugccuggccggc

SEQ ID NO: 352912 - RNA, 32 nt, Human
cagcugcugaacuccagccaucaacacggugg

SEQ ID NO: 352913 - RNA, 18 nt, Human
cagcugcugacgaagcuc

SEQ ID NO: 352914 - RNA, 32 nt, Human
cagcugcugaggaggaggaagaggacacugaa

SEQ ID NO: 352915 - RNA, 19 nt, Human
cagcugcugagggauuauc

SEQ ID NO: 352916 - RNA, 18 nt, Human
cagcugcugaguuuacuc

SEQ ID NO: 352917 - RNA, 19 nt, Human
cagcugcugaugguguuuc

SEQ ID NO: 352918 - RNA, 32 nt, Human
cagcugcugcaaccuccaccucccggguucaa

SEQ ID NO: 352919 - RNA, 32 nt, Human
cagcugcugcagcugcugugaccccugcagcc

SEQ ID NO: 352920 - RNA, 19 nt, Human
cagcugcugcauaucuucu

SEQ ID NO: 352921 - RNA, 32 nt, Human
cagcugcugccagagcccugagugcccagacu

SEQ ID NO: 352922 - RNA, 32 nt, Human
cagcugcugcucaucagcugcccgcuagcaug

SEQ ID NO: 352923 - RNA, 32 nt, Human
cagcugcugcuguggccccagcagguucucaa

SEQ ID NO: 352924 - RNA, 32 nt, Human
cagcugcugcuuguucugauguuuuaugguau

SEQ ID NO: 352925 - RNA, 18 nt, Human
cagcugcuggagguccuc

SEQ ID NO: 352926 - RNA, 21 nt, Human
cagcugcuggauugcacucuc

SEQ ID NO: 352927 - RNA, 18 nt, Human
cagcugcuggcacuucuc

SEQ ID NO: 352928 - RNA, 19 nt, Human
cagcugcuggcauuuccuu

SEQ ID NO: 352929 - RNA, 17 nt, Human
cagcugcugggccucuc

SEQ ID NO: 352930 - RNA, 17 nt, Human
cagcugcugggcgucuc

SEQ ID NO: 352931 - RNA, 32 nt, Human
cagcugcuggggaagagccagggggaccgcga

SEQ ID NO: 352932 - RNA, 20 nt, Human
cagcugcuggggauuuucuu

SEQ ID NO: 352933 - RNA, 32 nt, Human
cagcugcugggucagucacagagcugggggca

SEQ ID NO: 352934 - RNA, 18 nt, Human
cagcugcuggucuccaca

SEQ ID NO: 352935 - RNA, 18 nt, Human
cagcugcuggugauccuc

SEQ ID NO: 352936 - RNA, 18 nt, Human
cagcugcuguccucuaca

SEQ ID NO: 352937 - RNA, 19 nt, Human
cagcugcuguggaucgcuc

SEQ ID NO: 352938 - RNA, 18 nt, Human
cagcugcugugguugcuc

SEQ ID NO: 352939 - RNA, 25 nt, Human
cagcugcuguuuagaaaauuuucuc

SEQ ID NO: 352940 - RNA, 32 nt, Human
cagcugcuucaggcugaugagugauggcugcc

SEQ ID NO: 352941 - RNA, 32 nt, Human
cagcugcuucuccacaccccugcccacccccu

SEQ ID NO: 352942 - RNA, 20 nt, Human
cagcugcuugcucacagcca

SEQ ID NO: 352943 - RNA, 32 nt, Human
cagcugcuugggaggcugaggcaguagaauca

SEQ ID NO: 352944 - RNA, 32 nt, Human
cagcugcuugggaggcugagggcaggagaauu

SEQ ID NO: 352945 - RNA, 20 nt, Human
cagcugcuuuugcauuucuc

SEQ ID NO: 352946 - RNA, 23 nt, Human
cagcuggaacaagagguggugug

SEQ ID NO: 352947 - RNA, 32 nt, Human
cagcuggaacauaccacugccucuagacuaag

SEQ ID NO: 352948 - RNA, 21 nt, Human
cagcuggaagagucugggcca

SEQ ID NO: 352949 - RNA, 32 nt, Human
cagcuggaagcauuuguuuuugaaguuguaca

SEQ ID NO: 352950 - RNA, 32 nt, Human
cagcuggacaacagaagccccaugccgccugu

SEQ ID NO: 352951 - RNA, 32 nt, Human
cagcuggacagaaaaggggcagacacaccgag

SEQ ID NO: 352952 - RNA, 32 nt, Human
cagcuggacuuccgagaccuccuggggaagaa

SEQ ID NO: 352953 - RNA, 32 nt, Human
cagcuggagaaccggggagcagcuggacaccc

SEQ ID NO: 352954 - RNA, 32 nt, Human
cagcuggagaagaccaccaaugcugagaugag

SEQ ID NO: 352955 - RNA, 32 nt, Human
cagcuggagaggggcuggggcgccgguuuccc

SEQ ID NO: 352956 - RNA, 32 nt, Human
cagcuggagcacucacgguccacugagcucug

SEQ ID NO: 352957 - RNA, 20 nt, Human
cagcuggagccaguagggga

SEQ ID NO: 352958 - RNA, 32 nt, Human
cagcuggagcccagagaauuuaauuuaauguu

SEQ ID NO: 352959 - RNA, 32 nt, Human
cagcuggagccgcccgugccuccaggggccaa

SEQ ID NO: 352960 - RNA, 32 nt, Human
cagcuggagccuggggcugccugcaugcgcgc

SEQ ID NO: 352961 - RNA, 32 nt, Human
cagcuggagcugggacuguucagucacuggga

SEQ ID NO: 352962 - RNA, 32 nt, Human
cagcuggaggagcugggacggcggcaugagaa

SEQ ID NO: 352963 - RNA, 32 nt, Human
cagcuggaggaggagcagggaggcaagucaga

SEQ ID NO: 352964 - RNA, 32 nt, Human
cagcuggaggaggaggaggaggauacgccagu

SEQ ID NO: 352965 - RNA, 18 nt, Human
cagcuggaggcaguggga

SEQ ID NO: 352966 - RNA, 32 nt, Human
cagcuggaggcugggagcguuguggcuuccuc

SEQ ID NO: 352967 - RNA, 32 nt, Human
cagcuggagggagaacccaaagagacagcucu

SEQ ID NO: 352968 - RNA, 32 nt, Human
cagcuggagggcagggggcuggggaagggggu

SEQ ID NO: 352969 - RNA, 32 nt, Human
cagcuggagggcgagcgcgccgcccgcacacc

SEQ ID NO: 352970 - RNA, 32 nt, Human
cagcuggaggugaagguggccucggaacagac

SEQ ID NO: 352971 - RNA, 32 nt, Human
cagcuggaucagaagggaccagcuggagacca

SEQ ID NO: 352972 - RNA, 32 nt, Human
cagcuggaucgaagggcggguugcagucccga

SEQ ID NO: 352973 - RNA, 32 nt, Human
cagcuggaucuugcucacacucuuucaagaga

SEQ ID NO: 352974 - RNA, 23 nt, Human
cagcuggaugcuguggcuggcca

SEQ ID NO: 352975 - RNA, 32 nt, Human
cagcuggcacacuggcaccugcacuaaauuac

SEQ ID NO: 352976 - RNA, 32 nt, Human
cagcuggcacgggcacguucuugcccugcaca

SEQ ID NO: 352977 - RNA, 32 nt, Human
cagcuggcacuuccccuggccuagagaguucc

SEQ ID NO: 352978 - RNA, 17 nt, Human
cagcuggcagagcgaga

SEQ ID NO: 352979 - RNA, 32 nt, Human
cagcuggcaggagcccacccucccucugccau

SEQ ID NO: 352980 - RNA, 19 nt, Human
cagcuggcagggacccaga

SEQ ID NO: 352981 - RNA, 32 nt, Human
cagcuggcagggacccagaagagccuggagau

SEQ ID NO: 352982 - RNA, 32 nt, Human
cagcuggcagggccagggggugggugggcgug

SEQ ID NO: 352983 - RNA, 21 nt, Human
cagcuggccaagauggugaaa

SEQ ID NO: 352984 - RNA, 32 nt, Human
cagcuggccagccuccacucccacucugccag

SEQ ID NO: 352985 - RNA, 32 nt, Human
cagcuggccagccucgggcagcgcggcccccu

SEQ ID NO: 352986 - RNA, 32 nt, Human
cagcuggccagcuucagccaccuugggagacg

SEQ ID NO: 352987 - RNA, 19 nt, Human
cagcuggccccugcugcug

SEQ ID NO: 352988 - RNA, 32 nt, Human
cagcuggccucaccuccugaaggccuggguca

SEQ ID NO: 352989 - RNA, 19 nt, Human
cagcuggccugagcugcug

SEQ ID NO: 352990 - RNA, 23 nt, Human
cagcuggccuggaaugggccagg

SEQ ID NO: 352991 - RNA, 32 nt, Human
cagcuggccuugcggauuccagaacuuucuga

SEQ ID NO: 352992 - RNA, 20 nt, Human
cagcuggcgcgccccuccca

SEQ ID NO: 352993 - RNA, 32 nt, Human
cagcuggcucccuugucuccagggcuuuggag

SEQ ID NO: 352994 - RNA, 32 nt, Human
cagcuggcucugggaaggucucagcuuuaaga

SEQ ID NO: 352995 - RNA, 19 nt, Human
cagcuggcugaacuacaga

SEQ ID NO: 352996 - RNA, 32 nt, Human
cagcuggcugcagccuccaccucccuggcuca

SEQ ID NO: 352997 - RNA, 32 nt, Human
cagcuggcuguggugugggcucuccagccccg

SEQ ID NO: 352998 - RNA, 19 nt, Human
cagcuggcuguugauuuuc

SEQ ID NO: 352999 - RNA, 32 nt, Human
cagcuggcuugaauuucuccccagaaaauggg

SEQ ID NO: 353000 - RNA, 17 nt, Human
cagcugggagaaggggg

SEQ ID NO: 353001 - RNA, 18 nt, Human
cagcugggagcaguggga

SEQ ID NO: 353002 - RNA, 32 nt, Human
cagcugggaggucuccucccaccccaaccguc

SEQ ID NO: 353003 - RNA, 22 nt, Human
cagcugggaggugggcagugga

SEQ ID NO: 353004 - RNA, 32 nt, Human
cagcugggagguuucuaggcagcagcaaaacu

SEQ ID NO: 353005 - RNA, 32 nt, Human
cagcugggagugcagaagucucagggccuggc

SEQ ID NO: 353006 - RNA, 31 nt, Human
cagcugggaguguccaucaucaggggaagau

SEQ ID NO: 353007 - RNA, 21 nt, Human
cagcugggaguugccaaggga

SEQ ID NO: 353008 - RNA, 32 nt, Human
cagcugggaucucaguggcucccagcugcaug

SEQ ID NO: 353009 - RNA, 32 nt, Human
cagcugggaucugcccagagcuugguccucac

SEQ ID NO: 353010 - RNA, 32 nt, Human
cagcugggauuuacaggcgugagccaccgcgc

SEQ ID NO: 353011 - RNA, 20 nt, Human
cagcugggcaacacagcaag

SEQ ID NO: 353012 - RNA, 17 nt, Human
cagcugggcagcagggg

SEQ ID NO: 353013 - RNA, 32 nt, Human
cagcugggccaacaugguuaaacccuauuucu

SEQ ID NO: 353014 - RNA, 19 nt, Human
cagcugggccaauacagua

SEQ ID NO: 353015 - RNA, 32 nt, Human
cagcugggccacccccucccacccugggguug

SEQ ID NO: 353016 - RNA, 19 nt, Human
cagcugggccaggacucca

SEQ ID NO: 353017 - RNA, 32 nt, Human
cagcugggcccaggacugggguuggaggugaa

SEQ ID NO: 353018 - RNA, 32 nt, Human
cagcugggccuaggggugcagggucagugcug

SEQ ID NO: 353019 - RNA, 32 nt, Human
cagcugggccuccucacucaggacuucucucc

SEQ ID NO: 353020 - RNA, 22 nt, Human
cagcugggccuggagccaaggg

SEQ ID NO: 353021 - RNA, 23 nt, Human
cagcugggccuuugaagccacua

SEQ ID NO: 353022 - RNA, 32 nt, Human
cagcugggccuuugcucagggcugucugugcu

SEQ ID NO: 353023 - RNA, 32 nt, Human
cagcugggcuaggggcggggacugggggugcu

SEQ ID NO: 353024 - RNA, 32 nt, Human
cagcugggcucagacgugucucagcucuuguu

SEQ ID NO: 353025 - RNA, 32 nt, Human
cagcugggcuggaacugcccuccuggaacucc

SEQ ID NO: 353026 - RNA, 32 nt, Human
cagcuggggaaacugaggccuggaauggccca

SEQ ID NO: 353027 - RNA, 32 nt, Human
cagcuggggaaacugaggcucugggaugcuaa

SEQ ID NO: 353028 - RNA, 32 nt, Human
cagcuggggacauaauggagcucuggugcugg

SEQ ID NO: 353029 - RNA, 23 nt, Human
cagcuggggccccugggaggaga

SEQ ID NO: 353030 - RNA, 20 nt, Human
cagcuggggcugcagggaga

SEQ ID NO: 353031 - RNA, 20 nt, Human
cagcugggggcuccuugcca

SEQ ID NO: 353032 - RNA, 32 nt, Human
cagcuggggugacauccccagugguuugucgc

SEQ ID NO: 353033 - RNA, 32 nt, Human
cagcuggggugauggccagggcaggcugggag

SEQ ID NO: 353034 - RNA, 32 nt, Human
cagcuggggugauggccugugagccacaggcc

SEQ ID NO: 353035 - RNA, 32 nt, Human
cagcuggguacccccgauuugggccgacuuug

SEQ ID NO: 353036 - RNA, 17 nt, Human
cagcuggguaugaggug

SEQ ID NO: 353037 - RNA, 32 nt, Human
cagcugggucagagaaaacuucuugacuaaaa

SEQ ID NO: 353038 - RNA, 32 nt, Human
cagcuggguccaucaugcaaugcugagcacug

SEQ ID NO: 353039 - RNA, 32 nt, Human
cagcugggucguggagacccuaacccaguggc

SEQ ID NO: 353040 - RNA, 21 nt, Human
cagcugggugacagagugaga

SEQ ID NO: 353041 - RNA, 32 nt, Human
cagcuggguucagacuucacacugugaguuca

SEQ ID NO: 353042 - RNA, 32 nt, Human
cagcugguaaaggggugcuggaggccauggag

SEQ ID NO: 353043 - RNA, 32 nt, Human
cagcugguaccaggcugcagcguuucaggaau

SEQ ID NO: 353044 - RNA, 25 nt, Human
cagcugguaccauccagggcaacau

SEQ ID NO: 353045 - RNA, 32 nt, Human
cagcugguacugggugggcaccugggagccac

SEQ ID NO: 353046 - RNA, 32 nt, Human
cagcugguagcagcagcccugcagugaaguag

SEQ ID NO: 353047 - RNA, 24 nt, Human
cagcuggucaccaaaagcuugaua

SEQ ID NO: 353048 - RNA, 32 nt, Human
cagcuggucaucccucccgaaguuuugcggua

SEQ ID NO: 353049 - RNA, 32 nt, Human
cagcugguccaaguggccacagugauggguuu

SEQ ID NO: 353050 - RNA, 32 nt, Human
cagcuggucucaaacuccugaccucaggugau

SEQ ID NO: 353051 - RNA, 32 nt, Human
cagcuggucucgaacuccugaccucgugaucc

SEQ ID NO: 353052 - RNA, 32 nt, Human
cagcuggucucgagcuccuggccucaagcgau

SEQ ID NO: 353053 - RNA, 32 nt, Human
cagcuggugccuggccuucggcuccugcgucc

SEQ ID NO: 353054 - RNA, 32 nt, Human
cagcugguggauucccgcugcaucaaggccua

SEQ ID NO: 353055 - RNA, 32 nt, Human
cagcugguggccaagagauugguguggaggca

SEQ ID NO: 353056 - RNA, 32 nt, Human
cagcugguggguauggaggaaagacuagacau

SEQ ID NO: 353057 - RNA, 32 nt, Human
cagcuggugugaccccacacacccagugaggu

SEQ ID NO: 353058 - RNA, 18 nt, Human
cagcuggugugacuuaga

SEQ ID NO: 353059 - RNA, 21 nt, Human
cagcuggugugugacugcaga

SEQ ID NO: 353060 - RNA, 17 nt, Human
cagcugguuacggcugg

SEQ ID NO: 353061 - RNA, 32 nt, Human
cagcugguucugcugcuugguuucaacaccuu

SEQ ID NO: 353062 - RNA, 23 nt, Human
cagcugguuuaaaaauauccuuu

SEQ ID NO: 353063 - RNA, 32 nt, Human
cagcuguaaaggccauuaacuugcaaucugga

SEQ ID NO: 353064 - RNA, 32 nt, Human
cagcuguaaggaacucccaggucaagccagug

SEQ ID NO: 353065 - RNA, 22 nt, Human
cagcuguacaucaacucugccc

SEQ ID NO: 353066 - RNA, 31 nt, Human
cagcuguacuuuugugggccugucaucuuga

SEQ ID NO: 353067 - RNA, 32 nt, Human
cagcuguaggguggggaccggggagcaccugc

SEQ ID NO: 353068 - RNA, 32 nt, Human
cagcuguaguaagaagagauucaggaugcuag

SEQ ID NO: 353069 - RNA, 32 nt, Human
cagcuguaguacagugcugugcccucaccucc

SEQ ID NO: 353070 - RNA, 32 nt, Human
cagcuguaguuggucuacuccuuacuuagcac

SEQ ID NO: 353071 - RNA, 32 nt, Human
cagcuguauagccugugacucuccguguguca

SEQ ID NO: 353072 - RNA, 32 nt, Human
cagcuguaugccccagucacacaaaguaggag

SEQ ID NO: 353073 - RNA, 32 nt, Human
cagcuguauuuccaguaacacagcaucaucac

SEQ ID NO: 353074 - RNA, 32 nt, Human
cagcugucaauauuucuuugacuucagcauug

SEQ ID NO: 353075 - RNA, 32 nt, Human
cagcugucagagggauaccauccuagggucug

SEQ ID NO: 353076 - RNA, 32 nt, Human
cagcuguccagccaacugucucuccacccuuc

SEQ ID NO: 353077 - RNA, 32 nt, Human
cagcuguccgcccugccugccugccugugugg

SEQ ID NO: 353078 - RNA, 31 nt, Human
cagcugucgccuuucugaccagcaggccugg

SEQ ID NO: 353079 - RNA, 32 nt, Human
cagcugucucaaaccuccaaaagcccugaguu

SEQ ID NO: 353080 - RNA, 32 nt, Human
cagcugucucccacguguguauuaugguucac

SEQ ID NO: 353081 - RNA, 32 nt, Human
cagcugucuccuccaggcagugcugccagugu

SEQ ID NO: 353082 - RNA, 32 nt, Human
cagcugucuccugcuuucuugcccuuaaaauc

SEQ ID NO: 353083 - RNA, 19 nt, Human
cagcugucugaacuauagg

SEQ ID NO: 353084 - RNA, 32 nt, Human
cagcugucugggagucaaggcugcaguagcgu

SEQ ID NO: 353085 - RNA, 32 nt, Human
cagcugucugucugggacugggauuuacguua

SEQ ID NO: 353086 - RNA, 32 nt, Human
cagcugucuguguggcuaguggcacagugugc

SEQ ID NO: 353087 - RNA, 32 nt, Human
cagcugucuguguuucuccuguucucauaccg

SEQ ID NO: 353088 - RNA, 32 nt, Human
cagcugucuguucaccuucagcucagagagca

SEQ ID NO: 353089 - RNA, 32 nt, Human
cagcugugaacccaggaggucaagugggcuau

SEQ ID NO: 353090 - RNA, 32 nt, Human
cagcugugaaggagggcagggcuggauggaag

SEQ ID NO: 353091 - RNA, 18 nt, Human
cagcugugacaugaagug

SEQ ID NO: 353092 - RNA, 31 nt, Human
cagcugugacccauuugaccuguguccccag

SEQ ID NO: 353093 - RNA, 19 nt, Human
cagcugugacuccuccaca

SEQ ID NO: 353094 - RNA, 32 nt, Human
cagcugugacuccuccacagcccccggaggug

SEQ ID NO: 353095 - RNA, 31 nt, Human
cagcugugacuuccuccuaacugucagggug

SEQ ID NO: 353096 - RNA, 32 nt, Human
cagcugugagccaccgugccuggccuuuuauu

SEQ ID NO: 353097 - RNA, 32 nt, Human
cagcugugagccacugcacccggccgggaauu

SEQ ID NO: 353098 - RNA, 32 nt, Human
cagcugugagccaugccucccugggccaccuc

SEQ ID NO: 353099 - RNA, 32 nt, Human
cagcugugagccauggcaccuggccacacacg

SEQ ID NO: 353100 - RNA, 32 nt, Human
cagcugugauaccucaguuggaaagggaauuc

SEQ ID NO: 353101 - RNA, 16 nt, Human
cagcugugaugaguug

SEQ ID NO: 353102 - RNA, 32 nt, Human
cagcugugaugcauuauugagcacuuuagcug

SEQ ID NO: 353103 - RNA, 31 nt, Human
cagcugugccucucgggcaggguccucgggc

SEQ ID NO: 353104 - RNA, 31 nt, Human
cagcugugccucucugccuguugguugugau

SEQ ID NO: 353105 - RNA, 17 nt, Human
cagcugugcggguggua

SEQ ID NO: 353106 - RNA, 32 nt, Human
cagcugugcucaagacuggaucucaguucuuc

SEQ ID NO: 353107 - RNA, 32 nt, Human
cagcugugcucacuuuuccugcuuugugccuu

SEQ ID NO: 353108 - RNA, 18 nt, Human
cagcugugcugagggagg

SEQ ID NO: 353109 - RNA, 32 nt, Human
cagcugugcuuccagcagugagguaacuaugc

SEQ ID NO: 353110 - RNA, 21 nt, Human
cagcugugcuuucauggcugg

SEQ ID NO: 353111 - RNA, 32 nt, Human
cagcuguggaacaggcuuuuuacaccccaagu

SEQ ID NO: 353112 - RNA, 21 nt, Human
cagcuguggaucccgcccacu

SEQ ID NO: 353113 - RNA, 24 nt, Human
cagcuguggcagccccucccagcc

SEQ ID NO: 353114 - RNA, 20 nt, Human
cagcuguggccagcggcugg

SEQ ID NO: 353115 - RNA, 32 nt, Human
cagcugugggaaugcggacaggaagcagggga

SEQ ID NO: 353116 - RNA, 32 nt, Human
cagcugugggagggcagcauggagaggaggaa

SEQ ID NO: 353117 - RNA, 31 nt, Human
cagcuguggguggaggaugacccaggugccc

SEQ ID NO: 353118 - RNA, 32 nt, Human
cagcugugguacacaggccugaccaacucgga

SEQ ID NO: 353119 - RNA, 18 nt, Human
cagcugugugcagggagg

SEQ ID NO: 353120 - RNA, 32 nt, Human
cagcuguuaacguguugauuccuuccacuucc

SEQ ID NO: 353121 - RNA, 32 nt, Human
cagcuguuacccacucugggaccagcagucuu

SEQ ID NO: 353122 - RNA, 32 nt, Human
cagcuguuaguuucccgggcagucuccggguu

SEQ ID NO: 353123 - RNA, 32 nt, Human
cagcuguucaacaggaaugagagguuauggaa

SEQ ID NO: 353124 - RNA, 32 nt, Human
cagcuguucccccuggcauacaagcuuaugga

SEQ ID NO: 353125 - RNA, 32 nt, Human
cagcuguucuucuguucugcagacacgccuuc

SEQ ID NO: 353126 - RNA, 32 nt, Human
cagcuguugacuccugagucugggugaauuug

SEQ ID NO: 353127 - RNA, 32 nt, Human
cagcuguugauuggcugugacacugcuuugug

SEQ ID NO: 353128 - RNA, 32 nt, Human
cagcuguugcugcugccaacuacuucuuugca

SEQ ID NO: 353129 - RNA, 32 nt, Human
cagcuguugcuuuauuuuccaucaaagcccuc

SEQ ID NO: 353130 - RNA, 19 nt, Human
cagcuguugggccuugaga

SEQ ID NO: 353131 - RNA, 32 nt, Human
cagcuguuuagcccguggggcaguccuuugag

SEQ ID NO: 353132 - RNA, 19 nt, Human
cagcuguuuaggcuauaga

SEQ ID NO: 353133 - RNA, 32 nt, Human
cagcuguuuccuggcccuggcgagugucuguc

SEQ ID NO: 353134 - RNA, 19 nt, Human
cagcuguuuccugugugga

SEQ ID NO: 353135 - RNA, 32 nt, Human
cagcuguuuucagaggcuggagggcgggcgga

SEQ ID NO: 353136 - RNA, 32 nt, Human
cagcuguuuuccuccccucuguguacucccuu

SEQ ID NO: 353137 - RNA, 32 nt, Human
cagcuuaaaacacacaucguacagcuguacaa

SEQ ID NO: 353138 - RNA, 32 nt, Human
cagcuuaacauccaccacagagggugagcccu

SEQ ID NO: 353139 - RNA, 32 nt, Human
cagcuuaacaugaauaacaaagacuggcucag

SEQ ID NO: 353140 - RNA, 32 nt, Human
cagcuuaagguccugcauucagcucuuuucac

SEQ ID NO: 353141 - RNA, 32 nt, Human
cagcuuaaugcaaccucuaccucccagguuca

SEQ ID NO: 353142 - RNA, 32 nt, Human
cagcuuaccaucuccucacaccccagagugga

SEQ ID NO: 353143 - RNA, 21 nt, Human
cagcuuacgcagccucaggau

SEQ ID NO: 353144 - RNA, 32 nt, Human
cagcuuacucaaccucugccucuuggguuuca

SEQ ID NO: 353145 - RNA, 32 nt, Human
cagcuuacugcaaccucugccucccggguuca

SEQ ID NO: 353146 - RNA, 32 nt, Human
cagcuuacugcaaccucugucucccggguuca

SEQ ID NO: 353147 - RNA, 32 nt, Human
cagcuuacugcacccucugccucccgguuuca

SEQ ID NO: 353148 - RNA, 32 nt, Human
cagcuuacugcagccucaaccuccugggcuca

SEQ ID NO: 353149 - RNA, 32 nt, Human
cagcuuacugcagccuugaccucccaggcuca

SEQ ID NO: 353150 - RNA, 32 nt, Human
cagcuuacuguaaccucugccuccuggauuca

SEQ ID NO: 353151 - RNA, 32 nt, Human
cagcuuagacacaucaaggauugucuggggaa

SEQ ID NO: 353152 - RNA, 32 nt, Human
cagcuuagacccaagcccugaaggccugaggc

SEQ ID NO: 353153 - RNA, 18 nt, Human
cagcuuagacuccuccac

SEQ ID NO: 353154 - RNA, 19 nt, Human
cagcuuagacuccuccaca

SEQ ID NO: 353155 - RNA, 24 nt, Human
cagcuuagcauucguugcagcuga

SEQ ID NO: 353156 - RNA, 32 nt, Human
cagcuuagccucuucucccaggggagcuacuc

SEQ ID NO: 353157 - RNA, 32 nt, Human
cagcuuagcuggggcugugcagccaggggcuu

SEQ ID NO: 353158 - RNA, 32 nt, Human
cagcuuaggcaacacggugaaaccccaucucu

SEQ ID NO: 353159 - RNA, 20 nt, Human
cagcuuaggccuccuccaua

SEQ ID NO: 353160 - RNA, 22 nt, Human
cagcuuaggugacagagugaga

SEQ ID NO: 353161 - RNA, 22 nt, Human
cagcuuagguggcaaagugaga

SEQ ID NO: 353162 - RNA, 19 nt, Human
cagcuuauaccauggaaug

SEQ ID NO: 353163 - RNA, 32 nt, Human
cagcuuauccugggugcucugugaucagaagg

SEQ ID NO: 353164 - RNA, 32 nt, Human
cagcuuaugucuguaaucccagcacuuuugag

SEQ ID NO: 353165 - RNA, 32 nt, Human
cagcuuauuacaaccucugccuccugggcuca

SEQ ID NO: 353166 - RNA, 32 nt, Human
cagcuuauuauuugcugugugcauggggcaau

SEQ ID NO: 353167 - RNA, 32 nt, Human
cagcuucaaaugcagcccaguauccugcccua

SEQ ID NO: 353168 - RNA, 32 nt, Human
cagcuucaaggagaaagaguucagaggcccug

SEQ ID NO: 353169 - RNA, 32 nt, Human
cagcuucacaaaccuuaucuaagguuuuccag

SEQ ID NO: 353170 - RNA, 23 nt, Human
cagcuucacaagccaacccagga

SEQ ID NO: 353171 - RNA, 25 nt, Human
cagcuucacucaacucuggggaaug

SEQ ID NO: 353172 - RNA, 32 nt, Human
cagcuucacuccucaggaaguaccauggacag

SEQ ID NO: 353173 - RNA, 32 nt, Human
cagcuucagaacccucagucccucucucaccu

SEQ ID NO: 353174 - RNA, 32 nt, Human
cagcuucagaauugggcugaacuucagugccc

SEQ ID NO: 353175 - RNA, 32 nt, Human
cagcuucagacagggagccaggaugggaacca

SEQ ID NO: 353176 - RNA, 32 nt, Human
cagcuucagagauacugcuucucagcgucucu

SEQ ID NO: 353177 - RNA, 32 nt, Human
cagcuucagcaguguugaacuguguguuuaaa

SEQ ID NO: 353178 - RNA, 32 nt, Human
cagcuucaggcagaggagacaacauggaagaa

SEQ ID NO: 353179 - RNA, 32 nt, Human
cagcuucaggucgcuaccaucuggaccucucg

SEQ ID NO: 353180 - RNA, 32 nt, Human
cagcuucauaagacacugagguuuagaauugu

SEQ ID NO: 353181 - RNA, 32 nt, Human
cagcuucauccacuccaggacagcugagcguc

SEQ ID NO: 353182 - RNA, 21 nt, Human
cagcuucaugccucuuccaca

SEQ ID NO: 353183 - RNA, 32 nt, Human
cagcuucaugugaagcucugcacagacaagac

SEQ ID NO: 353184 - RNA, 32 nt, Human
cagcuucauuuuggguuuuugccuccucccac

SEQ ID NO: 353185 - RNA, 32 nt, Human
cagcuuccacugcuccccuuguucccggccgg

SEQ ID NO: 353186 - RNA, 19 nt, Human
cagcuuccagacagaaaac

SEQ ID NO: 353187 - RNA, 32 nt, Human
cagcuuccagaguucaagcgagucuccugcuu

SEQ ID NO: 353188 - RNA, 32 nt, Human
cagcuuccagcaccuucuucaguguuaccauc

SEQ ID NO: 353189 - RNA, 21 nt, Human
cagcuuccaggcgcuaagaaa

SEQ ID NO: 353190 - RNA, 32 nt, Human
cagcuuccaggggacugucacuguggacgcca

SEQ ID NO: 353191 - RNA, 32 nt, Human
cagcuuccaggguccugggccugcugugaccc

SEQ ID NO: 353192 - RNA, 24 nt, Human
cagcuuccagugcagagcuccaca

SEQ ID NO: 353193 - RNA, 32 nt, Human
cagcuucccacugcagcagcaccagucugggg

SEQ ID NO: 353194 - RNA, 32 nt, Human
cagcuucccagccaugcccaggacguccuauc

SEQ ID NO: 353195 - RNA, 32 nt, Human
cagcuucccagcugcccuggcuuagccuuccc

SEQ ID NO: 353196 - RNA, 32 nt, Human
cagcuucccaggaaguucagcuucggguuagu

SEQ ID NO: 353197 - RNA, 32 nt, Human
cagcuucccaggagagaccaaaggcuucugag

SEQ ID NO: 353198 - RNA, 32 nt, Human
cagcuucccccagccccugccaccccagaggg

SEQ ID NO: 353199 - RNA, 32 nt, Human
cagcuucccgggcucuguccuccauaucgaau

SEQ ID NO: 353200 - RNA, 32 nt, Human
cagcuucccuccagccucuccuccauucccua

SEQ ID NO: 353201 - RNA, 32 nt, Human
cagcuucccugacagggcaggggcucacucuu

SEQ ID NO: 353202 - RNA, 32 nt, Human
cagcuucccugcuguguugcugcccagccgcu

SEQ ID NO: 353203 - RNA, 32 nt, Human
cagcuucccugucucuuccugccuguguaccu

SEQ ID NO: 353204 - RNA, 32 nt, Human
cagcuuccgccucccccauccugggcgccccu

SEQ ID NO: 353205 - RNA, 32 nt, Human
cagcuuccuaaccuugaggggccagagaacaa

SEQ ID NO: 353206 - RNA, 32 nt, Human
cagcuuccuaagggaugcaggaaggggccggg

SEQ ID NO: 353207 - RNA, 32 nt, Human
cagcuuccuaguagcugggauugcaggcacuc

SEQ ID NO: 353208 - RNA, 32 nt, Human
cagcuuccuccccuugcuacagccucugcccu

SEQ ID NO: 353209 - RNA, 32 nt, Human
cagcuuccuccuucugucacuuguguaaguug

SEQ ID NO: 353210 - RNA, 32 nt, Human
cagcuuccugggagcaggaggaggcaggauuc

SEQ ID NO: 353211 - RNA, 32 nt, Human
cagcuuccugugggccaggagcucagccgugc

SEQ ID NO: 353212 - RNA, 32 nt, Human
cagcuuccuucaaaaugucuacuguucacgaa

SEQ ID NO: 353213 - RNA, 32 nt, Human
cagcuuccuuucuccucacgacggccuccaca

SEQ ID NO: 353214 - RNA, 32 nt, Human
cagcuucgaaccuacaccugagggcuaccagc

SEQ ID NO: 353215 - RNA, 21 nt, Human
cagcuucggucccccuucugu

SEQ ID NO: 353216 - RNA, 32 nt, Human
cagcuucuaaucccagcacuuugguaggcaaa

SEQ ID NO: 353217 - RNA, 32 nt, Human
cagcuucuacuugagcccucucucucugccac

SEQ ID NO: 353218 - RNA, 32 nt, Human
cagcuucucaaucagugacugugugcuaaauu

SEQ ID NO: 353219 - RNA, 32 nt, Human
cagcuucucagcagcaagcaccagccuuccac

SEQ ID NO: 353220 - RNA, 32 nt, Human
cagcuucucaggaggcugagacaggagaaucg

SEQ ID NO: 353221 - RNA, 32 nt, Human
cagcuucucauggguggucuuaccagcuacug

SEQ ID NO: 353222 - RNA, 32 nt, Human
cagcuucuccacugucaucaaacuggccaugu

SEQ ID NO: 353223 - RNA, 32 nt, Human
cagcuucucccuccaucucccuccccuuuccc

SEQ ID NO: 353224 - RNA, 32 nt, Human
cagcuucuccucugccccgauggaugcuuuau

SEQ ID NO: 353225 - RNA, 19 nt, Human
cagcuucuccugaguccuc

SEQ ID NO: 353226 - RNA, 32 nt, Human
cagcuucuccugccucuucuucugcaauccuc

SEQ ID NO: 353227 - RNA, 32 nt, Human
cagcuucucugccucucuucugauacaaggac

SEQ ID NO: 353228 - RNA, 32 nt, Human
cagcuucugccucccuccucaucacuuccucu

SEQ ID NO: 353229 - RNA, 32 nt, Human
cagcuucugccuccugucuccugggacccucg

SEQ ID NO: 353230 - RNA, 32 nt, Human
cagcuucuggguauccagagagcacugcacuu

SEQ ID NO: 353231 - RNA, 32 nt, Human
cagcuucugguccucuucuuccaccucuuaga

SEQ ID NO: 353232 - RNA, 32 nt, Human
cagcuucugucucugcugucccaguuuugagg

SEQ ID NO: 353233 - RNA, 32 nt, Human
cagcuucugucugucucacugucuucccuccc

SEQ ID NO: 353234 - RNA, 32 nt, Human
cagcuucuguuuaccuuuuuggcaucaaauaa

SEQ ID NO: 353235 - RNA, 32 nt, Human
cagcuucuucauuccugcacugguugccacca

SEQ ID NO: 353236 - RNA, 32 nt, Human
cagcuucuuccucugcccaguccugcccucac

SEQ ID NO: 353237 - RNA, 32 nt, Human
cagcuucuucuccacgaguuuuaacaagcaug

SEQ ID NO: 353238 - RNA, 32 nt, Human
cagcuucuuggcaugagguuuacccugguaac

SEQ ID NO: 353239 - RNA, 32 nt, Human
cagcuucuugggaggcugagaugggaaucacu

SEQ ID NO: 353240 - RNA, 32 nt, Human
cagcuucuugggaggcugaggugggaggauug

SEQ ID NO: 353241 - RNA, 32 nt, Human
cagcuucuuuggugauuacaucuuuccauauc

SEQ ID NO: 353242 - RNA, 32 nt, Human
cagcuugaccaacauggagaaaccucguuucu

SEQ ID NO: 353243 - RNA, 32 nt, Human
cagcuugaccaacauggugaaaccccaucucu

SEQ ID NO: 353244 - RNA, 23 nt, Human
cagcuugagcuaaugaguccucc

SEQ ID NO: 353245 - RNA, 32 nt, Human
cagcuugagcuccacgaugcucugcuugauga

SEQ ID NO: 353246 - RNA, 25 nt, Human
cagcuugaucaauucugcagucaua

SEQ ID NO: 353247 - RNA, 24 nt, Human
cagcuugauccacuguugcucuua

SEQ ID NO: 353248 - RNA, 32 nt, Human
cagcuugauuggcuuccccgagggccagcagg

SEQ ID NO: 353249 - RNA, 20 nt, Human
cagcuugcaacuauuuucuc

SEQ ID NO: 353250 - RNA, 32 nt, Human
cagcuugcagggguuggggagggagacaucca

SEQ ID NO: 353251 - RNA, 32 nt, Human
cagcuugcagugagcgaagaucgcaccacugc

SEQ ID NO: 353252 - RNA, 20 nt, Human
cagcuugcaguggacauaga

SEQ ID NO: 353253 - RNA, 32 nt, Human
cagcuugcaucugccaucauuugaugcccacu

SEQ ID NO: 353254 - RNA, 21 nt, Human
cagcuugcccaaugcuucugg

SEQ ID NO: 353255 - RNA, 32 nt, Human
cagcuugccccagggaaaggacaaggcugaga

SEQ ID NO: 353256 - RNA, 32 nt, Human
cagcuugccccgcuccuccaccaucuaggccc

SEQ ID NO: 353257 - RNA, 32 nt, Human
cagcuugcucaggccccaggguggcugccucg

SEQ ID NO: 353258 - RNA, 32 nt, Human
cagcuugcucccugccccagaccuguuucuuc

SEQ ID NO: 353259 - RNA, 32 nt, Human
cagcuugcugaaugucagcugccugagagagc

SEQ ID NO: 353260 - RNA, 32 nt, Human
cagcuugcugcaaacuccgccucccagguuca

SEQ ID NO: 353261 - RNA, 32 nt, Human
cagcuugcugggagagcgggacgguccggagc

SEQ ID NO: 353262 - RNA, 32 nt, Human
cagcuugcuguucauguccaaggucaaaaacu

SEQ ID NO: 353263 - RNA, 32 nt, Human
cagcuugcuuaaccauuccucuaccucuugca

SEQ ID NO: 353264 - RNA, 19 nt, Human
cagcuugcuucucucuaca

SEQ ID NO: 353265 - RNA, 32 nt, Human
cagcuuggacacagcccacugcagagaugaaa

SEQ ID NO: 353266 - RNA, 32 nt, Human
cagcuuggacaucaugacgaaaccccaucucc

SEQ ID NO: 353267 - RNA, 31 nt, Human
cagcuuggagacuucucagccaaugcucuga

SEQ ID NO: 353268 - RNA, 32 nt, Human
cagcuuggagccagcugagcaggcuuugcuuu

SEQ ID NO: 353269 - RNA, 20 nt, Human
cagcuuggcaacagagcgag

SEQ ID NO: 353270 - RNA, 32 nt, Human
cagcuuggcacucaggugcugaaggguaauau

SEQ ID NO: 353271 - RNA, 17 nt, Human
cagcuuggcaugguugg

SEQ ID NO: 353272 - RNA, 32 nt, Human
cagcuuggccaacauggagaaaccccaucucu

SEQ ID NO: 353273 - RNA, 32 nt, Human
cagcuuggccaacauggcgaaaccccaucucu

SEQ ID NO: 353274 - RNA, 32 nt, Human
cagcuuggccaacauggugaaaccccaucucc

SEQ ID NO: 353275 - RNA, 32 nt, Human
cagcuuggccaacauggugaaaccccaucucu

SEQ ID NO: 353276 - RNA, 32 nt, Human
cagcuuggccaacauggugaaaccucaucucu

SEQ ID NO: 353277 - RNA, 32 nt, Human
cagcuuggccaacauggugaaauccugucugu

SEQ ID NO: 353278 - RNA, 32 nt, Human
cagcuuggccaacauggugaagcucugucucu

SEQ ID NO: 353279 - RNA, 32 nt, Human
cagcuuggccaacauggugagcccccgucucu

SEQ ID NO: 353280 - RNA, 32 nt, Human
cagcuuggccaacaugucgaaacuucaucucu

SEQ ID NO: 353281 - RNA, 32 nt, Human
cagcuuggccaagauggugaaaccccaucucu

SEQ ID NO: 353282 - RNA, 19 nt, Human
cagcuuggcccuuuucaca

SEQ ID NO: 353283 - RNA, 32 nt, Human
cagcuuggccgacaugguaaaaccccacgucu

SEQ ID NO: 353284 - RNA, 32 nt, Human
cagcuuggcugugaggaucagcuuguuagccu

SEQ ID NO: 353285 - RNA, 22 nt, Human
cagcuuggcuuggcuuuggcug

SEQ ID NO: 353286 - RNA, 32 nt, Human
cagcuugggaaugauggcugccaacucccaau

SEQ ID NO: 353287 - RNA, 31 nt, Human
cagcuugggaggccaaggugggugaauugcu

SEQ ID NO: 353288 - RNA, 32 nt, Human
cagcuugggaggccaaggugggugaauugcuu

SEQ ID NO: 353289 - RNA, 22 nt, Human
cagcuugggcaacaaagugaga

SEQ ID NO: 353290 - RNA, 21 nt, Human
cagcuugggcaacagagcaag

SEQ ID NO: 353291 - RNA, 18 nt, Human
cagcuugggcaacagagu

SEQ ID NO: 353292 - RNA, 21 nt, Human
cagcuugggcaacagaguaag

SEQ ID NO: 353293 - RNA, 22 nt, Human
cagcuugggcaacagaguaaga

SEQ ID NO: 353294 - RNA, 22 nt, Human
cagcuugggcaacagagugaga

SEQ ID NO: 353295 - RNA, 32 nt, Human
cagcuugggcaacauggagaaaccccaucuuu

SEQ ID NO: 353296 - RNA, 32 nt, Human
cagcuugggcaacauggcaaagccccaucucu

SEQ ID NO: 353297 - RNA, 32 nt, Human
cagcuugggcaacauggcgaaaccccgucucu

SEQ ID NO: 353298 - RNA, 19 nt, Human
cagcuugggcaacgagcaa

SEQ ID NO: 353299 - RNA, 32 nt, Human
cagcuugggcaauaagaaugaaacucugucuc

SEQ ID NO: 353300 - RNA, 21 nt, Human
cagcuugggcaccagagcaag

SEQ ID NO: 353301 - RNA, 32 nt, Human
cagcuugggcagguggccuggaggcacaaagg

SEQ ID NO: 353302 - RNA, 32 nt, Human
cagcuugggcccugcaaacacaaccaucuaca

SEQ ID NO: 353303 - RNA, 32 nt, Human
cagcuugggccugaacuacuggaaaaggucug

SEQ ID NO: 353304 - RNA, 21 nt, Human
cagcuugggcgacagagcaag

SEQ ID NO: 353305 - RNA, 22 nt, Human
cagcuugggcgacagagcaaga

SEQ ID NO: 353306 - RNA, 22 nt, Human
cagcuugggcgacagagcgaga

SEQ ID NO: 353307 - RNA, 22 nt, Human
cagcuugggcgacggagugaga

SEQ ID NO: 353308 - RNA, 22 nt, Human
cagcuugggugacaaaguaaga

SEQ ID NO: 353309 - RNA, 22 nt, Human
cagcuugggugacacagugaga

SEQ ID NO: 353310 - RNA, 22 nt, Human
cagcuugggugacagagcaaga

SEQ ID NO: 353311 - RNA, 22 nt, Human
cagcuugggugacagagcgaga

SEQ ID NO: 353312 - RNA, 21 nt, Human
cagcuugggugacagagugag

SEQ ID NO: 353313 - RNA, 22 nt, Human
cagcuugggugacagagugaga

SEQ ID NO: 353314 - RNA, 32 nt, Human
cagcuugguccucuuguccugcagaggcaggc

SEQ ID NO: 353315 - RNA, 18 nt, Human
cagcuugguguuuucaca

SEQ ID NO: 353316 - RNA, 32 nt, Human
cagcuugucccagccacucuagcugcuggaug

SEQ ID NO: 353317 - RNA, 22 nt, Human
cagcuugucuaggaaggggaug

SEQ ID NO: 353318 - RNA, 32 nt, Human
cagcuugucucuuccggccaggucaagguauc

SEQ ID NO: 353319 - RNA, 32 nt, Human
cagcuugucugucucuggguccugggccagcc

SEQ ID NO: 353320 - RNA, 32 nt, Human
cagcuugucuucaaauacggccaagcagaaaa

SEQ ID NO: 353321 - RNA, 32 nt, Human
cagcuugugaauguuuagugugcugcuguucu

SEQ ID NO: 353322 - RNA, 32 nt, Human
cagcuuguggcaguggaaauauggcugaauga

SEQ ID NO: 353323 - RNA, 32 nt, Human
cagcuuguguguggcuguccuugaguagugau

SEQ ID NO: 353324 - RNA, 32 nt, Human
cagcuuguucaggagggcuugauguccucacc

SEQ ID NO: 353325 - RNA, 32 nt, Human
cagcuuguucuuucuuucucuucaguccucug

SEQ ID NO: 353326 - RNA, 21 nt, Human
cagcuuguugaugccuccaua

SEQ ID NO: 353327 - RNA, 18 nt, Human
cagcuuguugggagucua

SEQ ID NO: 353328 - RNA, 32 nt, Human
cagcuuguuuuccaggcaucgaauaacuguug

SEQ ID NO: 353329 - RNA, 32 nt, Human
cagcuuuacaguccacacagucucaagaagaa

SEQ ID NO: 353330 - RNA, 21 nt, Human
cagcuuuacucuucuuccaca

SEQ ID NO: 353331 - RNA, 32 nt, Human
cagcuuuaggugaccugguucuugucucaacu

SEQ ID NO: 353332 - RNA, 21 nt, Human
cagcuuuaguccgucuucaca

SEQ ID NO: 353333 - RNA, 21 nt, Human
cagcuuuauuugccuucuaca

SEQ ID NO: 353334 - RNA, 32 nt, Human
cagcuuucaagcagugcuuguugugagguccc

SEQ ID NO: 353335 - RNA, 32 nt, Human
cagcuuucaagugccuuucugcaguuuuucag

SEQ ID NO: 353336 - RNA, 21 nt, Human
cagcuuucagauuccuccaua

SEQ ID NO: 353337 - RNA, 32 nt, Human
cagcuuucagcccucuacaggaauuacccucc

SEQ ID NO: 353338 - RNA, 32 nt, Human
cagcuuucaggaaggaucucacaaacacccac

SEQ ID NO: 353339 - RNA, 32 nt, Human
cagcuuucaggaggacaguggaaagagugcag

SEQ ID NO: 353340 - RNA, 24 nt, Human
cagcuuucaguuccugacucccca

SEQ ID NO: 353341 - RNA, 32 nt, Human
cagcuuuccaccgugccaaggcuccuuacacg

SEQ ID NO: 353342 - RNA, 32 nt, Human
cagcuuuccagcuuuccucuggauuccggccu

SEQ ID NO: 353343 - RNA, 21 nt, Human
cagcuuucccuacuccugccc

SEQ ID NO: 353344 - RNA, 32 nt, Human
cagcuuuccucaagacaggccaugccaggcga

SEQ ID NO: 353345 - RNA, 23 nt, Human
cagcuuuccucccgcuccugccc

SEQ ID NO: 353346 - RNA, 32 nt, Human
cagcuuuccucuuccucuccaaaccaccucga

SEQ ID NO: 353347 - RNA, 32 nt, Human
cagcuuucggcgccaaccacacagccagcaac

SEQ ID NO: 353348 - RNA, 30 nt, Human
cagcuuucucagaaaggccucuguaagccu

SEQ ID NO: 353349 - RNA, 21 nt, Human
cagcuuucuccggccucaggg

SEQ ID NO: 353350 - RNA, 19 nt, Human
cagcuuucuucuuuccaca

SEQ ID NO: 353351 - RNA, 32 nt, Human
cagcuuucuuuggggcuucagugagaacucuc

SEQ ID NO: 353352 - RNA, 18 nt, Human
cagcuuugacauuuucuc

SEQ ID NO: 353353 - RNA, 32 nt, Human
cagcuuugaccuuuauucaagagaccagaugg

SEQ ID NO: 353354 - RNA, 17 nt, Human
cagcuuugagcucuacg

SEQ ID NO: 353355 - RNA, 32 nt, Human
cagcuuugagcucuggcaggugcaaugugccc

SEQ ID NO: 353356 - RNA, 22 nt, Human
cagcuuugagcuguggcugcca

SEQ ID NO: 353357 - RNA, 18 nt, Human
cagcuuugaucugaccgc

SEQ ID NO: 353358 - RNA, 18 nt, Human
cagcuuugcaccuacaua

SEQ ID NO: 353359 - RNA, 20 nt, Human
cagcuuugcagucccuucgc

SEQ ID NO: 353360 - RNA, 17 nt, Human
cagcuuugcuuuucaca

SEQ ID NO: 353361 - RNA, 32 nt, Human
cagcuuuggaaauggcuguugagccaggaacu

SEQ ID NO: 353362 - RNA, 32 nt, Human
cagcuuuggagucaagaaugaaguucuaggag

SEQ ID NO: 353363 - RNA, 19 nt, Human
cagcuuuggccccuccaca

SEQ ID NO: 353364 - RNA, 32 nt, Human
cagcuuuggccgagguucgggcucgaacuugg

SEQ ID NO: 353365 - RNA, 32 nt, Human
cagcuuuggccgucaggagagccuucugggca

SEQ ID NO: 353366 - RNA, 32 nt, Human
cagcuuugggacucagacuggcuuccuugcuc

SEQ ID NO: 353367 - RNA, 32 nt, Human
cagcuuugggcaacacagugagaccucaucuc

SEQ ID NO: 353368 - RNA, 32 nt, Human
cagcuuuggggacuuccgcucccuggauaugu

SEQ ID NO: 353369 - RNA, 32 nt, Human
cagcuuuggggguuugcugcuggcucugacuc

SEQ ID NO: 353370 - RNA, 32 nt, Human
cagcuuuggguuugcagagauuacacaggaau

SEQ ID NO: 353371 - RNA, 32 nt, Human
cagcuuuggugagaaaacuaaucuugaacuau

SEQ ID NO: 353372 - RNA, 20 nt, Human
cagcuuuggugcucuccaca

SEQ ID NO: 353373 - RNA, 21 nt, Human
cagcuuuguaaauucuuaaca

SEQ ID NO: 353374 - RNA, 32 nt, Human
cagcuuugucaaucacccaagcacuuuaugca

SEQ ID NO: 353375 - RNA, 32 nt, Human
cagcuuugucagcucaggucugucuacaccca

SEQ ID NO: 353376 - RNA, 32 nt, Human
cagcuuugugagcuggugcugccccuggggca

SEQ ID NO: 353377 - RNA, 32 nt, Human
cagcuuuguuagguggguagggggagaccaag

SEQ ID NO: 353378 - RNA, 18 nt, Human
cagcuuuguucuucuuca

SEQ ID NO: 353379 - RNA, 18 nt, Human
cagcuuuuaucuugcaca

SEQ ID NO: 353380 - RNA, 32 nt, Human
cagcuuuucuaagccugaaccugugcuaaauc

SEQ ID NO: 353381 - RNA, 32 nt, Human
cagcuuuucucaauuaacauuuugguaguaua

SEQ ID NO: 353382 - RNA, 19 nt, Human
cagcuuuucugccuccgca

SEQ ID NO: 353383 - RNA, 32 nt, Human
cagcuuuugccuugguucuuccuagugccuac

SEQ ID NO: 353384 - RNA, 32 nt, Human
cagcuuuuggaaaggacucaggaagcuuuuac

SEQ ID NO: 353385 - RNA, 32 nt, Human
cagcuuuuggggcucagaggccagucuggggg

SEQ ID NO: 353386 - RNA, 32 nt, Human
cagcuuuuguuauugguccucauaaagggaaa

SEQ ID NO: 353387 - RNA, 18 nt, Human
cagcuuuuuccucucaua

SEQ ID NO: 353388 - RNA, 32 nt, Human
cagcuuuuucucgauaggcuucauccuuguuu

SEQ ID NO: 353389 - RNA, 32 nt, Human
cagcuuuuugcacuaaagccaaaccacaccgc

SEQ ID NO: 353390 - RNA, 32 nt, Human
cagcuuuuugccugaugccauuuuauugacag

SEQ ID NO: 353391 - RNA, 32 nt, Human
cagcuuuuugggaaaagaacgugcucgucugu

SEQ ID NO: 353392 - RNA, 22 nt, Human
cagcuuuuuuccucaaaaguaa

SEQ ID NO: 353393 - RNA, 21 nt, Human
cagcuuuuuugaacuuccaca

SEQ ID NO: 353394 - RNA, 32 nt, Human
caggaaaaagagagcugugggcuuccagggcg

SEQ ID NO: 353395 - RNA, 22 nt, Human
caggaaaaagguuggagcagug

SEQ ID NO: 353396 - RNA, 19 nt, Human
caggaaaacuagcaugaaa

SEQ ID NO: 353397 - RNA, 32 nt, Human
caggaaaagaagcagagcccagaagcagggcc

SEQ ID NO: 353398 - RNA, 32 nt, Human
caggaaaagacuguuaacauuacauuuaugca

SEQ ID NO: 353399 - RNA, 32 nt, Human
caggaaaagaggaagaagaaguagaggagcug

SEQ ID NO: 353400 - RNA, 18 nt, Human
caggaaaagcugaugcua

SEQ ID NO: 353401 - RNA, 32 nt, Human
caggaaaaggaaaaagaaugaggacucugaac

SEQ ID NO: 353402 - RNA, 32 nt, Human
caggaaaaugucaccaagcacccuccucccca

SEQ ID NO: 353403 - RNA, 21 nt, Human
caggaaaauugcuugaaccca

SEQ ID NO: 353404 - RNA, 21 nt, Human
caggaaaauugcuugaacuca

SEQ ID NO: 353405 - RNA, 21 nt, Human
caggaaaauuguuugaaccca

SEQ ID NO: 353406 - RNA, 19 nt, Human
caggaaacaacagaugcug

SEQ ID NO: 353407 - RNA, 32 nt, Human
caggaaacacaaaauaaguaugcauaaauaaa

SEQ ID NO: 353408 - RNA, 32 nt, Human
caggaaacaugauguuuuaagcugcuaagaug

SEQ ID NO: 353409 - RNA, 32 nt, Human
caggaaaccccgagaaggaauggugcuuggca

SEQ ID NO: 353410 - RNA, 32 nt, Human
caggaaaccggagaaaacggggcaaagaaaaa

SEQ ID NO: 353411 - RNA, 24 nt, Human
caggaaaccuacacauucucugcu

SEQ ID NO: 353412 - RNA, 32 nt, Human
caggaaacgaaucccuuccuccucuccccuuu

SEQ ID NO: 353413 - RNA, 32 nt, Human
caggaaacucucccucuccaucgccauccugc

SEQ ID NO: 353414 - RNA, 32 nt, Human
caggaaacugcuagacagccugguccgaaagc

SEQ ID NO: 353415 - RNA, 32 nt, Human
caggaaacugcucucccucagcugggcugggg

SEQ ID NO: 353416 - RNA, 32 nt, Human
caggaaagaacaguggucccuuuguugggccu

SEQ ID NO: 353417 - RNA, 32 nt, Human
caggaaagaagucacuguugcaauaaaagcac

SEQ ID NO: 353418 - RNA, 32 nt, Human
caggaaagacagaggaaggaaggagggagaag

SEQ ID NO: 353419 - RNA, 32 nt, Human
caggaaagaccagccucacuccugggaacugu

SEQ ID NO: 353420 - RNA, 24 nt, Human
caggaaagacgggcauuacaggga

SEQ ID NO: 353421 - RNA, 23 nt, Human
caggaaagacuaucucucugacu

SEQ ID NO: 353422 - RNA, 32 nt, Human
caggaaagacuggccacggccccgcagaagcu

SEQ ID NO: 353423 - RNA, 32 nt, Human
caggaaagagagaagcggagggcgggcugggu

SEQ ID NO: 353424 - RNA, 32 nt, Human
caggaaagagagaccuuucuuguuucuggacu

SEQ ID NO: 353425 - RNA, 32 nt, Human
caggaaagaggagagaaagaaagaaagggcac

SEQ ID NO: 353426 - RNA, 25 nt, Human
caggaaagaggcccccauccagccc

SEQ ID NO: 353427 - RNA, 32 nt, Human
caggaaagauguccacugaaaauguggaaggg

SEQ ID NO: 353428 - RNA, 22 nt, Human
caggaaagaugucccacaggga

SEQ ID NO: 353429 - RNA, 32 nt, Human
caggaaagcagagacagacaaagcguuaggag

SEQ ID NO: 353430 - RNA, 32 nt, Human
caggaaagccaagguggaggcugagguggcug

SEQ ID NO: 353431 - RNA, 22 nt, Human
caggaaagccagauuccagccu

SEQ ID NO: 353432 - RNA, 32 nt, Human
caggaaagccagccaaagcguguucaggaagu

SEQ ID NO: 353433 - RNA, 32 nt, Human
caggaaagcguggcuggccucuugcacugcuu

SEQ ID NO: 353434 - RNA, 32 nt, Human
caggaaagcugaagcaggagguggcauuugaa

SEQ ID NO: 353435 - RNA, 32 nt, Human
caggaaagcugauggugcaagguccaguccaa

SEQ ID NO: 353436 - RNA, 22 nt, Human
caggaaaggaagcauucaggga

SEQ ID NO: 353437 - RNA, 21 nt, Human
caggaaaggagguuccagccc

SEQ ID NO: 353438 - RNA, 18 nt, Human
caggaaaggauugaugcc

SEQ ID NO: 353439 - RNA, 32 nt, Human
caggaaaggcucaagugauccuccuguaucac

SEQ ID NO: 353440 - RNA, 22 nt, Human
caggaaagggaacauucucggc

SEQ ID NO: 353441 - RNA, 32 nt, Human
caggaaagggcugaggcaggugguagggcugg

SEQ ID NO: 353442 - RNA, 21 nt, Human
caggaaaguggucuccagccc

SEQ ID NO: 353443 - RNA, 32 nt, Human
caggaaaguuccaggcuucagcucccagaaac

SEQ ID NO: 353444 - RNA, 32 nt, Human
caggaaaguugacugcugacugauugggaaag

SEQ ID NO: 353445 - RNA, 32 nt, Human
caggaaauagccaaagcuuuaaucuagccuaa

SEQ ID NO: 353446 - RNA, 32 nt, Human
caggaaauagcgcaggacaucacaaggaccaa

SEQ ID NO: 353447 - RNA, 32 nt, Human
caggaaauauccauccaugaauuaugccagca

SEQ ID NO: 353448 - RNA, 32 nt, Human
caggaaaucaagaugaaaaaucccagaaaaua

SEQ ID NO: 353449 - RNA, 32 nt, Human
caggaaaucuggguugguuccagugggaaaua

SEQ ID NO: 353450 - RNA, 22 nt, Human
caggaaaugcugcauuucuggc

SEQ ID NO: 353451 - RNA, 19 nt, Human
caggaaauggcagagccag

SEQ ID NO: 353452 - RNA, 22 nt, Human
caggaaauuagcuuuccagccc

SEQ ID NO: 353453 - RNA, 32 nt, Human
caggaacaccugcuacugcacacuccaaacca

SEQ ID NO: 353454 - RNA, 32 nt, Human
caggaacacgggagcuucugaagagcugaaca

SEQ ID NO: 353455 - RNA, 32 nt, Human
caggaacagacacacuccauguuugucccaca

SEQ ID NO: 353456 - RNA, 32 nt, Human
caggaacagcagagguggaggcaagcagugac

SEQ ID NO: 353457 - RNA, 32 nt, Human
caggaacagcauggaggaaaccgcccccauga

SEQ ID NO: 353458 - RNA, 32 nt, Human
caggaacagccccuuuccugugccccacuucu

SEQ ID NO: 353459 - RNA, 32 nt, Human
caggaacagccccuuuccugugccccacuugu

SEQ ID NO: 353460 - RNA, 32 nt, Human
caggaacaggcaguggcugugaaugguuucau

SEQ ID NO: 353461 - RNA, 32 nt, Human
caggaacaggguucugcccucccagagccucc

SEQ ID NO: 353462 - RNA, 32 nt, Human
caggaacaggucucaggauggagagaagcaua

SEQ ID NO: 353463 - RNA, 19 nt, Human
caggaacaucccugagaaa

SEQ ID NO: 353464 - RNA, 21 nt, Human
caggaaccacccccaccccca

SEQ ID NO: 353465 - RNA, 32 nt, Human
caggaaccaccugagcccacagauccuguggg

SEQ ID NO: 353466 - RNA, 20 nt, Human
caggaaccaggcuuagagga

SEQ ID NO: 353467 - RNA, 32 nt, Human
caggaaccaggcuuugcugggugcugcccaac

SEQ ID NO: 353468 - RNA, 32 nt, Human
caggaacccacccucuccacacccagccuguc

SEQ ID NO: 353469 - RNA, 32 nt, Human
caggaacccacugaaagccauaucccauuaaa

SEQ ID NO: 353470 - RNA, 32 nt, Human
caggaacccagaaacauauauuucauuuccac

SEQ ID NO: 353471 - RNA, 21 nt, Human
caggaacccaguggccaggga

SEQ ID NO: 353472 - RNA, 19 nt, Human
caggaaccccacccccagg

SEQ ID NO: 353473 - RNA, 21 nt, Human
caggaaccccagacccagggg

SEQ ID NO: 353474 - RNA, 32 nt, Human
caggaacccgaggggacaccagcucugcacaa

SEQ ID NO: 353475 - RNA, 22 nt, Human
caggaacccuccucgccugggg

SEQ ID NO: 353476 - RNA, 32 nt, Human
caggaacccuggagguugagguugcagugagc

SEQ ID NO: 353477 - RNA, 32 nt, Human
caggaacccuggucaggugagguaagagacug

SEQ ID NO: 353478 - RNA, 21 nt, Human
caggaacccuguacuccgggg

SEQ ID NO: 353479 - RNA, 24 nt, Human
caggaaccgcagggcgcucgggga

SEQ ID NO: 353480 - RNA, 19 nt, Human
caggaaccggggagccagg

SEQ ID NO: 353481 - RNA, 20 nt, Human
caggaaccucaugucgggga

SEQ ID NO: 353482 - RNA, 24 nt, Human
caggaaccucgugggcuccaggga

SEQ ID NO: 353483 - RNA, 20 nt, Human
caggaaccugcuccaggugg

SEQ ID NO: 353484 - RNA, 32 nt, Human
caggaaccuguggacuaggggugcagggacuu

SEQ ID NO: 353485 - RNA, 21 nt, Human
caggaaccuucgcagcccagg

SEQ ID NO: 353486 - RNA, 32 nt, Human
caggaacgagauggcgguucuccggaggcuga

SEQ ID NO: 353487 - RNA, 32 nt, Human
caggaacgagguggagagcaagacugacagag

SEQ ID NO: 353488 - RNA, 32 nt, Human
caggaacgccucaucucagcagccugggcucg

SEQ ID NO: 353489 - RNA, 32 nt, Human
caggaacggcugggacaguguccuaguggugg

SEQ ID NO: 353490 - RNA, 32 nt, Human
caggaacgugggcucuagacugugcauucagg

SEQ ID NO: 353491 - RNA, 32 nt, Human
caggaacuaucuaugguuaagacaagguggug

SEQ ID NO: 353492 - RNA, 21 nt, Human
caggaacucaggauccggggg

SEQ ID NO: 353493 - RNA, 22 nt, Human
caggaacucaggcuucagguga

SEQ ID NO: 353494 - RNA, 22 nt, Human
caggaacuccccaccccaggga

SEQ ID NO: 353495 - RNA, 22 nt, Human
caggaacuccucgguccagaga

SEQ ID NO: 353496 - RNA, 22 nt, Human
caggaacucgcggucggccggg

SEQ ID NO: 353497 - RNA, 32 nt, Human
caggaacucucaggacugcuccugagaaugcc

SEQ ID NO: 353498 - RNA, 32 nt, Human
caggaacugcauaaagguucuugaauucugca

SEQ ID NO: 353499 - RNA, 32 nt, Human
caggaacugcaugugucuucaugaccacuuuc

SEQ ID NO: 353500 - RNA, 32 nt, Human
caggaacugccuugguuuccccuuuuauuuuc

SEQ ID NO: 353501 - RNA, 32 nt, Human
caggaacugcugccacaaccucaggcugggca

SEQ ID NO: 353502 - RNA, 18 nt, Human
caggaacugcugccugag

SEQ ID NO: 353503 - RNA, 32 nt, Human
caggaacuggcuaugagcagaagguucgggcc

SEQ ID NO: 353504 - RNA, 32 nt, Human
caggaacuugagugacauugaccucauggcac

SEQ ID NO: 353505 - RNA, 32 nt, Human
caggaacuugcauaucuagagacagagacuga

SEQ ID NO: 353506 - RNA, 32 nt, Human
caggaacuuucgucucugccucucguggacug

SEQ ID NO: 353507 - RNA, 32 nt, Human
caggaagaaauguucaaacuuagacaaggaca

SEQ ID NO: 353508 - RNA, 21 nt, Human
caggaagaagcugaaucccug

SEQ ID NO: 353509 - RNA, 32 nt, Human
caggaagaaggaagcggcgccgccaucgccuc

SEQ ID NO: 353510 - RNA, 32 nt, Human
caggaagaaguacacauuuccacgaaugguuu

SEQ ID NO: 353511 - RNA, 18 nt, Human
caggaagaauugcuugaa

SEQ ID NO: 353512 - RNA, 32 nt, Human
caggaagacaagcuaugucugcuccaggcauc

SEQ ID NO: 353513 - RNA, 19 nt, Human
caggaagacaccccggccc

SEQ ID NO: 353514 - RNA, 22 nt, Human
caggaagacagucuuagcacug

SEQ ID NO: 353515 - RNA, 32 nt, Human
caggaagaccaagaagaaaaaccaccaucgug

SEQ ID NO: 353516 - RNA, 32 nt, Human
caggaagacugugaaaucuucaugcccaagga

SEQ ID NO: 353517 - RNA, 23 nt, Human
caggaagacuuggccaggccgug

SEQ ID NO: 353518 - RNA, 32 nt, Human
caggaagagaaaaugggcuaguggaagcccag

SEQ ID NO: 353519 - RNA, 32 nt, Human
caggaagagaagucugguuuguucaggaacau

SEQ ID NO: 353520 - RNA, 32 nt, Human
caggaagagaugaaaccaggaggcaggagaau

SEQ ID NO: 353521 - RNA, 32 nt, Human
caggaagagccagcaagagcaaggcaugggag

SEQ ID NO: 353522 - RNA, 32 nt, Human
caggaagagccccagccauggaacaccagcuc

SEQ ID NO: 353523 - RNA, 21 nt, Human
caggaagagcccucggcccug

SEQ ID NO: 353524 - RNA, 32 nt, Human
caggaagagcuuccccacucccaucccccaaa

SEQ ID NO: 353525 - RNA, 32 nt, Human
caggaagaggagaacugaagaguagaaguucc

SEQ ID NO: 353526 - RNA, 21 nt, Human
caggaagaggagccaggcccu

SEQ ID NO: 353527 - RNA, 32 nt, Human
caggaagauaaguguucguucuuuucugaaaa

SEQ ID NO: 353528 - RNA, 23 nt, Human
caggaagauacaucuugaugcca

SEQ ID NO: 353529 - RNA, 20 nt, Human
caggaagaucaccugagccc

SEQ ID NO: 353530 - RNA, 23 nt, Human
caggaagaucaccugagcccagg

SEQ ID NO: 353531 - RNA, 32 nt, Human
caggaagaucccuggagcucaggaguucaaga

SEQ ID NO: 353532 - RNA, 23 nt, Human
caggaagaucuacaagagcaagc

SEQ ID NO: 353533 - RNA, 32 nt, Human
caggaagauggcacacagccacaggugaaugg

SEQ ID NO: 353534 - RNA, 22 nt, Human
caggaagauggcuugaacccug

SEQ ID NO: 353535 - RNA, 32 nt, Human
caggaagaugugaaaauccccagcacucaucc

SEQ ID NO: 353536 - RNA, 32 nt, Human
caggaagauuccagagcacgcuguggcugaca

SEQ ID NO: 353537 - RNA, 19 nt, Human
caggaagauugcuucagcc

SEQ ID NO: 353538 - RNA, 21 nt, Human
caggaagauugcuugaacuca

SEQ ID NO: 353539 - RNA, 20 nt, Human
caggaagauugcuugaggcu

SEQ ID NO: 353540 - RNA, 32 nt, Human
caggaagcaagcggagguugcagugaguugag

SEQ ID NO: 353541 - RNA, 32 nt, Human
caggaagcaagugcuuuuccugccggucugca

SEQ ID NO: 353542 - RNA, 32 nt, Human
caggaagcagcacagacacagcauagcaggag

SEQ ID NO: 353543 - RNA, 32 nt, Human
caggaagcaggcucacaagagccagacaggcu

SEQ ID NO: 353544 - RNA, 32 nt, Human
caggaagcauggcaacaucaguuucuggggag

SEQ ID NO: 353545 - RNA, 32 nt, Human
caggaagccagcccgcaccccaacccccacca

SEQ ID NO: 353546 - RNA, 32 nt, Human
caggaagccaggcuggaggaagaggcgacaaa

SEQ ID NO: 353547 - RNA, 32 nt, Human
caggaagcccaggagccucacuggggcagaca

SEQ ID NO: 353548 - RNA, 32 nt, Human
caggaagcccugcugggcuagccugaggccua

SEQ ID NO: 353549 - RNA, 32 nt, Human
caggaagccggucaucacccagccucugagag

SEQ ID NO: 353550 - RNA, 20 nt, Human
caggaagccucguccaguga

SEQ ID NO: 353551 - RNA, 32 nt, Human
caggaagccugaggccacagcccagagcagcc

SEQ ID NO: 353552 - RNA, 23 nt, Human
caggaagccugcggaucugggaa

SEQ ID NO: 353553 - RNA, 32 nt, Human
caggaagcggggcagggaaggcuuccugaagc

SEQ ID NO: 353554 - RNA, 32 nt, Human
caggaagcgguggcucaugccuguaaucccag

SEQ ID NO: 353555 - RNA, 32 nt, Human
caggaagcuaugagggacccugugaguagcca

SEQ ID NO: 353556 - RNA, 32 nt, Human
caggaagcuauuggcuuccccuugucuguggu

SEQ ID NO: 353557 - RNA, 32 nt, Human
caggaagcucaucagaacaccucuugucccuu

SEQ ID NO: 353558 - RNA, 32 nt, Human
caggaagcuccagggcuggagcaccucugaga

SEQ ID NO: 353559 - RNA, 20 nt, Human
caggaagcugccaucaggga

SEQ ID NO: 353560 - RNA, 32 nt, Human
caggaagcugccgcaacguccagaccuggguc

SEQ ID NO: 353561 - RNA, 32 nt, Human
caggaagcuguggcaggagcaucuacacagcu

SEQ ID NO: 353562 - RNA, 32 nt, Human
caggaagcuuggagaggugugagagagacagg

SEQ ID NO: 353563 - RNA, 32 nt, Human
caggaagcuugguuccuguuguuccuggcaac

SEQ ID NO: 353564 - RNA, 32 nt, Human
caggaagcuugucacuggaagaucuuaaggua

SEQ ID NO: 353565 - RNA, 32 nt, Human
caggaaggaacacagggcuugcaagaucacgg

SEQ ID NO: 353566 - RNA, 32 nt, Human
caggaaggaagcuguugcuuucuuugagguga

SEQ ID NO: 353567 - RNA, 32 nt, Human
caggaaggaaguggggcccaagcaggcaauga

SEQ ID NO: 353568 - RNA, 32 nt, Human
caggaaggagagaagcagaaacaggaggacau

SEQ ID NO: 353569 - RNA, 32 nt, Human
caggaaggagagaggaagaggagcagaagggg

SEQ ID NO: 353570 - RNA, 32 nt, Human
caggaaggagcgaguaggagagagggagcgag

SEQ ID NO: 353571 - RNA, 19 nt, Human
caggaaggagcugccugga

SEQ ID NO: 353572 - RNA, 22 nt, Human
caggaaggagcugccuggaccc

SEQ ID NO: 353573 - RNA, 32 nt, Human
caggaaggaggaggggaagcaguggaugugga

SEQ ID NO: 353574 - RNA, 32 nt, Human
caggaaggaggcagagcuguccgugggaggug

SEQ ID NO: 353575 - RNA, 32 nt, Human
caggaaggaggggccccaggaggaugaaggga

SEQ ID NO: 353576 - RNA, 32 nt, Human
caggaaggaggucauggguucauuucauuuuu

SEQ ID NO: 353577 - RNA, 32 nt, Human
caggaaggagugggggacagggcuagaagcug

SEQ ID NO: 353578 - RNA, 32 nt, Human
caggaaggauccugccuugauuuuacuucaga

SEQ ID NO: 353579 - RNA, 32 nt, Human
caggaaggauggggugugccucaguuguuucc

SEQ ID NO: 353580 - RNA, 21 nt, Human
caggaaggcagcccaaucccu

SEQ ID NO: 353581 - RNA, 32 nt, Human
caggaaggcaggagacaggagacgggaccucu

SEQ ID NO: 353582 - RNA, 32 nt, Human
caggaaggcccaggcugggcaggcaauaccug

SEQ ID NO: 353583 - RNA, 32 nt, Human
caggaaggcggaggacgcaggagccaagagca

SEQ ID NO: 353584 - RNA, 32 nt, Human
caggaaggcugagaggagagagacuccagcug

SEQ ID NO: 353585 - RNA, 32 nt, Human
caggaaggcugaggcaggagaaucgcuugaac

SEQ ID NO: 353586 - RNA, 32 nt, Human
caggaaggcugaggcggcagaaucacuugaac

SEQ ID NO: 353587 - RNA, 32 nt, Human
caggaaggcugcagaaaguccuaggcucagau

SEQ ID NO: 353588 - RNA, 32 nt, Human
caggaagggcaggaaggagagccugcugcaug

SEQ ID NO: 353589 - RNA, 19 nt, Human
caggaagggcccugaggaa

SEQ ID NO: 353590 - RNA, 32 nt, Human
caggaagggcccuggccucuaaacuggcucga

SEQ ID NO: 353591 - RNA, 32 nt, Human
caggaagggcuggcaucggguuccuggcacag

SEQ ID NO: 353592 - RNA, 32 nt, Human
caggaaggggagugagaaagaggcugaaauua

SEQ ID NO: 353593 - RNA, 32 nt, Human
caggaaggggaguucuggguggaggaggagga

SEQ ID NO: 353594 - RNA, 32 nt, Human
caggaaggggcucccaagagcuccugguggug

SEQ ID NO: 353595 - RNA, 32 nt, Human
caggaagggggaaggaaggagggaauuucaca

SEQ ID NO: 353596 - RNA, 32 nt, Human
caggaagggggccuggaagaccaccugccccg

SEQ ID NO: 353597 - RNA, 32 nt, Human
caggaagggguuuuaaaauacuuccucugggc

SEQ ID NO: 353598 - RNA, 19 nt, Human
caggaaggguguuugcgca

SEQ ID NO: 353599 - RNA, 32 nt, Human
caggaagguagagagagaaaaagggagggaag

SEQ ID NO: 353600 - RNA, 30 nt, Human
caggaagguaguaacuuagaaagacuuacc

SEQ ID NO: 353601 - RNA, 32 nt, Human
caggaaggucucaaucuccugaccucgugaau

SEQ ID NO: 353602 - RNA, 24 nt, Human
caggaaggucugauuugcaggauu

SEQ ID NO: 353603 - RNA, 32 nt, Human
caggaagguggcccugaagaugcaccgaagac

SEQ ID NO: 353604 - RNA, 22 nt, Human
caggaagguggggaugggccgg

SEQ ID NO: 353605 - RNA, 32 nt, Human
caggaagguggugcugcaaaaccagauggccu

SEQ ID NO: 353606 - RNA, 32 nt, Human
caggaaguaaaguaggaacuguugugugagcg

SEQ ID NO: 353607 - RNA, 32 nt, Human
caggaagucaagaagcaguagagcccuauuua

SEQ ID NO: 353608 - RNA, 26 nt, Human
caggaagucacaguggugcccaggga

SEQ ID NO: 353609 - RNA, 24 nt, Human
caggaagucaccugccugaugcca

SEQ ID NO: 353610 - RNA, 32 nt, Human
caggaagucaccuguaccuggaugccaguacu

SEQ ID NO: 353611 - RNA, 32 nt, Human
caggaagucauggacacaguuauauugaaaga

SEQ ID NO: 353612 - RNA, 32 nt, Human
caggaagucauugucauucaggacacgggcuu

SEQ ID NO: 353613 - RNA, 20 nt, Human
caggaaguccccaugauguc

SEQ ID NO: 353614 - RNA, 25 nt, Human
caggaagugauuuucugccugagcu

SEQ ID NO: 353615 - RNA, 20 nt, Human
caggaagugcauucucuggu

SEQ ID NO: 353616 - RNA, 32 nt, Human
caggaagugcuagaaaaucacuuuaaggagga

SEQ ID NO: 353617 - RNA, 24 nt, Human
caggaaguggaggagccagaggug

SEQ ID NO: 353618 - RNA, 32 nt, Human
caggaaguggcagcauucugggccaagagaca

SEQ ID NO: 353619 - RNA, 21 nt, Human
caggaaguggucuuggugcca

SEQ ID NO: 353620 - RNA, 32 nt, Human
caggaaguggugguagagauggccucagaguc

SEQ ID NO: 353621 - RNA, 32 nt, Human
caggaagugucaggaagacgccuugcagaacu

SEQ ID NO: 353622 - RNA, 32 nt, Human
caggaaguucugccuuuucuuuucuuucggug

SEQ ID NO: 353623 - RNA, 32 nt, Human
caggaaguuuagggcaaggauuuguccuggag

SEQ ID NO: 353624 - RNA, 32 nt, Human
caggaaguuucuaggucuuucuagaacagcua

SEQ ID NO: 353625 - RNA, 32 nt, Human
caggaaguuugaaauagugacauaucauccac

SEQ ID NO: 353626 - RNA, 32 nt, Human
caggaauaaagaggaaguaacagugaaugcaa

SEQ ID NO: 353627 - RNA, 32 nt, Human
caggaauaaagugaauuggaagacagaaauaa

SEQ ID NO: 353628 - RNA, 32 nt, Human
caggaauaaccaggaaguuugcacauguucag

SEQ ID NO: 353629 - RNA, 32 nt, Human
caggaauagcuaaugacacagaaguagaucaa

SEQ ID NO: 353630 - RNA, 32 nt, Human
caggaauccagggauggagaacuggggagccu

SEQ ID NO: 353631 - RNA, 32 nt, Human
caggaauccagguaguggaggaugaucucaga

SEQ ID NO: 353632 - RNA, 32 nt, Human
caggaauccgggcauauuuugaggucauucca

SEQ ID NO: 353633 - RNA, 32 nt, Human
caggaaucucaggaugaaucagucuagaucga

SEQ ID NO: 353634 - RNA, 32 nt, Human
caggaaucugcacugggucucagugaugaacg

SEQ ID NO: 353635 - RNA, 32 nt, Human
caggaaucuuugucucuaucugugacacgcuc

SEQ ID NO: 353636 - RNA, 32 nt, Human
caggaaugaaucugcuacaauuccaccucauu

SEQ ID NO: 353637 - RNA, 32 nt, Human
caggaaugaguaucuaauagcuuuuguagaac

SEQ ID NO: 353638 - RNA, 20 nt, Human
caggaaugagucccuagggg

SEQ ID NO: 353639 - RNA, 20 nt, Human
caggaaugccacuccagggg

SEQ ID NO: 353640 - RNA, 30 nt, Human
caggaaugcccgagaucuggcaccugagca

SEQ ID NO: 353641 - RNA, 32 nt, Human
caggaaugccugagaugucuggcuauuccucg

SEQ ID NO: 353642 - RNA, 25 nt, Human
caggaaugcugccuuccuucagccc

SEQ ID NO: 353643 - RNA, 32 nt, Human
caggaaugcugugugcuuguuccaaaugagca

SEQ ID NO: 353644 - RNA, 30 nt, Human
caggaauggccgcagagguggcccugagug

SEQ ID NO: 353645 - RNA, 32 nt, Human
caggaauggggaaaugugacaccaccauccug

SEQ ID NO: 353646 - RNA, 32 nt, Human
caggaauggugagaugaacaugcaaguggaag

SEQ ID NO: 353647 - RNA, 23 nt, Human
caggaaugguuuaucugaugcca

SEQ ID NO: 353648 - RNA, 32 nt, Human
caggaaugugcuggcacugaugacacaguaau

SEQ ID NO: 353649 - RNA, 21 nt, Human
caggaauuaaauaguuuggaa

SEQ ID NO: 353650 - RNA, 31 nt, Human
caggaauuagucaauacauguugaaauguuu

SEQ ID NO: 353651 - RNA, 20 nt, Human
caggaauucaacaccagccu

SEQ ID NO: 353652 - RNA, 32 nt, Human
caggaauucacaacuagccugggaaacccagg

SEQ ID NO: 353653 - RNA, 30 nt, Human
caggaauucagcaauaaaugaaacaagacc

SEQ ID NO: 353654 - RNA, 32 nt, Human
caggaauucuauuuucgggagaugucuauugc

SEQ ID NO: 353655 - RNA, 32 nt, Human
caggaauucuggagaccuguguaaaagcagac

SEQ ID NO: 353656 - RNA, 32 nt, Human
caggaauuucuucagccucuguaaguggccuu

SEQ ID NO: 353657 - RNA, 32 nt, Human
caggaauuugagaguucacagaaggaucgugu

SEQ ID NO: 353658 - RNA, 32 nt, Human
caggacaaaccuggaugccaccuggagcugcu

SEQ ID NO: 353659 - RNA, 32 nt, Human
caggacaaacuagacggccguagaaaagauuu

SEQ ID NO: 353660 - RNA, 21 nt, Human
caggacaaagagaaaccugag

SEQ ID NO: 353661 - RNA, 32 nt, Human
caggacaaagggagggagcaagcccuacucgg

SEQ ID NO: 353662 - RNA, 21 nt, Human
caggacaacacuucuacugaa

SEQ ID NO: 353663 - RNA, 22 nt, Human
caggacaacuggccugccugag

SEQ ID NO: 353664 - RNA, 17 nt, Human
caggacaagccaccuga

SEQ ID NO: 353665 - RNA, 18 nt, Human
caggacaagcugacugaa

SEQ ID NO: 353666 - RNA, 24 nt, Human
caggacaaggaggccucccuggga

SEQ ID NO: 353667 - RNA, 32 nt, Human
caggacaauuucucccccuccaggggcuccag

SEQ ID NO: 353668 - RNA, 32 nt, Human
caggacacaagucuccaaagugccugugaggg

SEQ ID NO: 353669 - RNA, 32 nt, Human
caggacacagagugggagggagacugaugcag

SEQ ID NO: 353670 - RNA, 32 nt, Human
caggacacagcaggcuggaguugguguuagau

SEQ ID NO: 353671 - RNA, 24 nt, Human
caggacacagucuagagucuagua

SEQ ID NO: 353672 - RNA, 32 nt, Human
caggacacauccucaaauccugccagcauuug

SEQ ID NO: 353673 - RNA, 32 nt, Human
caggacaccagccuggugcccauccucccgac

SEQ ID NO: 353674 - RNA, 32 nt, Human
caggacacucaagcucuggcagaggaaggcca

SEQ ID NO: 353675 - RNA, 32 nt, Human
caggacacugaggagcucugaacccagcccac

SEQ ID NO: 353676 - RNA, 26 nt, Human
caggacacugccuuggguggaccagg

SEQ ID NO: 353677 - RNA, 22 nt, Human
caggacacugccuuugcugccu

SEQ ID NO: 353678 - RNA, 32 nt, Human
caggacacuuccugugugccugcaguugucag

SEQ ID NO: 353679 - RNA, 32 nt, Human
caggacacuuccuguuuacaggagacuauaaa

SEQ ID NO: 353680 - RNA, 25 nt, Human
caggacacuugaucccaaaaccccu

SEQ ID NO: 353681 - RNA, 32 nt, Human
caggacagaacaguguuuaauguaaaguuugu

SEQ ID NO: 353682 - RNA, 32 nt, Human
caggacagaagcaacaaggacaguaacacaca

SEQ ID NO: 353683 - RNA, 32 nt, Human
caggacagacggcguggggagcacagaggagg

SEQ ID NO: 353684 - RNA, 32 nt, Human
caggacagagagugcacaaacuacccagcaca

SEQ ID NO: 353685 - RNA, 32 nt, Human
caggacagagcagccaaugaaaacggccgccu

SEQ ID NO: 353686 - RNA, 32 nt, Human
caggacagaggcaggucaggaggcagacacgc

SEQ ID NO: 353687 - RNA, 32 nt, Human
caggacagagguggggaaguuguccugaggaa

SEQ ID NO: 353688 - RNA, 24 nt, Human
caggacagaucacuugaggucagg

SEQ ID NO: 353689 - RNA, 32 nt, Human
caggacagaugaggcuuuguguccuuaugaga

SEQ ID NO: 353690 - RNA, 32 nt, Human
caggacagccuggcacagaggcagagucuaga

SEQ ID NO: 353691 - RNA, 21 nt, Human
caggacagccuuccuccugaa

SEQ ID NO: 353692 - RNA, 17 nt, Human
caggacagcuuccagcc

SEQ ID NO: 353693 - RNA, 32 nt, Human
caggacagcuucgggaguugagugucaagccc

SEQ ID NO: 353694 - RNA, 32 nt, Human
caggacaggagagaacuguucagugugauaca

SEQ ID NO: 353695 - RNA, 32 nt, Human
caggacaggcucuggagggaaaagccagagag

SEQ ID NO: 353696 - RNA, 19 nt, Human
caggacaggcuggcaaggg

SEQ ID NO: 353697 - RNA, 32 nt, Human
caggacagggaagggagcaggagccugcaguc

SEQ ID NO: 353698 - RNA, 32 nt, Human
caggacagggccugggaagugagugaugcaau

SEQ ID NO: 353699 - RNA, 32 nt, Human
caggacagggcuagcagaugaagagaggagga

SEQ ID NO: 353700 - RNA, 32 nt, Human
caggacaggguagcuguuuggcccagcccaga

SEQ ID NO: 353701 - RNA, 32 nt, Human
caggacaguaaaggagaugcugugcugccuac

SEQ ID NO: 353702 - RNA, 32 nt, Human
caggacaguccacccgcccuguuggcacacuc

SEQ ID NO: 353703 - RNA, 32 nt, Human
caggacaguggcagaggcugauggaggaggga

SEQ ID NO: 353704 - RNA, 32 nt, Human
caggacaguggugguuucagacuccucuaggu

SEQ ID NO: 353705 - RNA, 23 nt, Human
caggacaguguccccccgaguga

SEQ ID NO: 353706 - RNA, 31 nt, Human
caggacauauuuucuuuacuguaaaugacca

SEQ ID NO: 353707 - RNA, 20 nt, Human
caggacauccacccugagaa

SEQ ID NO: 353708 - RNA, 32 nt, Human
caggacaugauggcucacaccuguaaucccag

SEQ ID NO: 353709 - RNA, 32 nt, Human
caggacaugccguggcccacacaugcccuucu

SEQ ID NO: 353710 - RNA, 32 nt, Human
caggacauggcaggcacaggcgcugcuuuguc

SEQ ID NO: 353711 - RNA, 32 nt, Human
caggacaugguggcucauguacgccuguaguc

SEQ ID NO: 353712 - RNA, 32 nt, Human
caggacauuguaucugcucuucccucuguaag

SEQ ID NO: 353713 - RNA, 21 nt, Human
caggaccaaagggugcaguga

SEQ ID NO: 353714 - RNA, 32 nt, Human
caggaccaaguccccagaauucucuuguuuuu

SEQ ID NO: 353715 - RNA, 32 nt, Human
caggaccaaugccugcaaaccuaggagagagg

SEQ ID NO: 353716 - RNA, 32 nt, Human
caggaccacagccuggugaguccccgggcagc

SEQ ID NO: 353717 - RNA, 32 nt, Human
caggaccacugcauuuaccagccugauacugc

SEQ ID NO: 353718 - RNA, 32 nt, Human
caggaccacuggcugccaacuccugccgcccu

SEQ ID NO: 353719 - RNA, 32 nt, Human
caggaccagacaccuucauccuguccuugaag

SEQ ID NO: 353720 - RNA, 32 nt, Human
caggaccagaugauaccaugaagagaaguuua

SEQ ID NO: 353721 - RNA, 32 nt, Human
caggaccagcaguucugcaggggcgugcuggg

SEQ ID NO: 353722 - RNA, 32 nt, Human
caggaccagccagaccagcagagcagggagcc

SEQ ID NO: 353723 - RNA, 32 nt, Human
caggaccagccuggccagcauggugaaacccc

SEQ ID NO: 353724 - RNA, 32 nt, Human
caggaccaggauucagcagaguccuccuauuu

SEQ ID NO: 353725 - RNA, 20 nt, Human
caggaccaggccuccucuuc

SEQ ID NO: 353726 - RNA, 19 nt, Human
caggaccagggcgcaccgg

SEQ ID NO: 353727 - RNA, 32 nt, Human
caggaccagggucguugacagcagguucugca

SEQ ID NO: 353728 - RNA, 32 nt, Human
caggaccaguggaugaaaggcaagguaaagag

SEQ ID NO: 353729 - RNA, 32 nt, Human
caggaccaugggccugugcuguuuacagaacc

SEQ ID NO: 353730 - RNA, 32 nt, Human
caggaccauucaggcuguugacaagucaacuc

SEQ ID NO: 353731 - RNA, 32 nt, Human
caggaccauugacaccagaaauggaggcacgg

SEQ ID NO: 353732 - RNA, 32 nt, Human
caggaccauugucccaaagucuagagucuuua

SEQ ID NO: 353733 - RNA, 32 nt, Human
caggacccaagcccuggcuggacucagcacag

SEQ ID NO: 353734 - RNA, 32 nt, Human
caggacccaagugugaacaacacucagcccgc

SEQ ID NO: 353735 - RNA, 32 nt, Human
caggacccaccacuggaagcaggauggagcug

SEQ ID NO: 353736 - RNA, 32 nt, Human
caggacccaccgcagcccccugggcagucucc

SEQ ID NO: 353737 - RNA, 32 nt, Human
caggacccacgcagccacccagccucagcacu

SEQ ID NO: 353738 - RNA, 32 nt, Human
caggacccagaacauucauccguaaauggaau

SEQ ID NO: 353739 - RNA, 32 nt, Human
caggacccagagcuguuccugcuuugaguuuc

SEQ ID NO: 353740 - RNA, 32 nt, Human
caggacccaggccgcagagggagcaggaagag

SEQ ID NO: 353741 - RNA, 20 nt, Human
caggacccauccucuugggu

SEQ ID NO: 353742 - RNA, 32 nt, Human
caggaccccaccacugcacuccagccuggaug

SEQ ID NO: 353743 - RNA, 32 nt, Human
caggaccccaccugacaggcucugguccaaga

SEQ ID NO: 353744 - RNA, 32 nt, Human
caggacccccuuccccuacccccuccucucug

SEQ ID NO: 353745 - RNA, 32 nt, Human
caggaccccggagaguccuggcaugguaucuc

SEQ ID NO: 353746 - RNA, 18 nt, Human
caggaccccuuccugcca

SEQ ID NO: 353747 - RNA, 21 nt, Human
caggacccgagccuccagccu

SEQ ID NO: 353748 - RNA, 21 nt, Human
caggacccggccgccagccuc

SEQ ID NO: 353749 - RNA, 32 nt, Human
caggacccugcagccacccgacaucuauagca

SEQ ID NO: 353750 - RNA, 32 nt, Human
caggacccuggaccagggcggugcagggcgca

SEQ ID NO: 353751 - RNA, 32 nt, Human
caggaccgaccucccuugccaugauaaccacc

SEQ ID NO: 353752 - RNA, 32 nt, Human
caggaccgagcggggagggaaagggaaaacgg

SEQ ID NO: 353753 - RNA, 32 nt, Human
caggaccuacaaccacacugaaggcuccagug

SEQ ID NO: 353754 - RNA, 32 nt, Human
caggaccuagagaugugccuggaaccacuccu

SEQ ID NO: 353755 - RNA, 32 nt, Human
caggaccucacagaaacaagggcuggguugag

SEQ ID NO: 353756 - RNA, 32 nt, Human
caggaccucacuuccuccucugccccugcccc

SEQ ID NO: 353757 - RNA, 32 nt, Human
caggaccuccauucugucaugacugacaccau

SEQ ID NO: 353758 - RNA, 22 nt, Human
caggaccucccagccacugccu

SEQ ID NO: 353759 - RNA, 32 nt, Human
caggaccuccucucuggcaguaucauggccac

SEQ ID NO: 353760 - RNA, 32 nt, Human
caggaccuccuggacguaagggugugaaagga

SEQ ID NO: 353761 - RNA, 32 nt, Human
caggaccucuccuugcuacucuucccaaaguc

SEQ ID NO: 353762 - RNA, 20 nt, Human
caggaccugauggcuauaga

SEQ ID NO: 353763 - RNA, 32 nt, Human
caggaccugcagcccucacgggggcuggggau

SEQ ID NO: 353764 - RNA, 32 nt, Human
caggaccugccugaccugccagugaugccaag

SEQ ID NO: 353765 - RNA, 32 nt, Human
caggaccugccuggagguucucccugggggug

SEQ ID NO: 353766 - RNA, 32 nt, Human
caggaccugccuguagcccacucugcucgccu

SEQ ID NO: 353767 - RNA, 23 nt, Human
caggaccugccuuaacugcuccu

SEQ ID NO: 353768 - RNA, 21 nt, Human
caggaccugcuccugccugaa

SEQ ID NO: 353769 - RNA, 19 nt, Human
caggaccugcuucgcugcc

SEQ ID NO: 353770 - RNA, 18 nt, Human
caggaccuggaguuauca

SEQ ID NO: 353771 - RNA, 24 nt, Human
caggaccuggaugacacccgccuc

SEQ ID NO: 353772 - RNA, 21 nt, Human
caggaccuggcccuucugccu

SEQ ID NO: 353773 - RNA, 32 nt, Human
caggaccugggcaaagugcagccgugcacccu

SEQ ID NO: 353774 - RNA, 32 nt, Human
caggaccugggcccgguucagcuccccacaag

SEQ ID NO: 353775 - RNA, 32 nt, Human
caggaccugggcuggccucuccaccuccccua

SEQ ID NO: 353776 - RNA, 32 nt, Human
caggaccuggggacagaaguagagaaaacacu

SEQ ID NO: 353777 - RNA, 32 nt, Human
caggaccuugccucgaauugucuuccaguauu

SEQ ID NO: 353778 - RNA, 32 nt, Human
caggacgaacaauauccagauccagagccggg

SEQ ID NO: 353779 - RNA, 32 nt, Human
caggacgaccugggaaggucacccccaucgcc

SEQ ID NO: 353780 - RNA, 32 nt, Human
caggacgagcuacugcuuuggagcgaggguuu

SEQ ID NO: 353781 - RNA, 32 nt, Human
caggacgaugcaagauuucaucacacuacuca

SEQ ID NO: 353782 - RNA, 19 nt, Human
caggacgcccgccggaccc

SEQ ID NO: 353783 - RNA, 32 nt, Human
caggacgccuggucugccuuguggguccugga

SEQ ID NO: 353784 - RNA, 32 nt, Human
caggacgcgucugggcuccccuaggcaaaggu

SEQ ID NO: 353785 - RNA, 18 nt, Human
caggacggaucuccugca

SEQ ID NO: 353786 - RNA, 32 nt, Human
caggacggcaggggcacugugaggcuuuucuu

SEQ ID NO: 353787 - RNA, 32 nt, Human
caggacgggacagcccgacuccauccucccac

SEQ ID NO: 353788 - RNA, 32 nt, Human
caggacgggcagggcuuccaggagagcucaag

SEQ ID NO: 353789 - RNA, 32 nt, Human
caggacgguagaaauuuucugcaagaaagaau

SEQ ID NO: 353790 - RNA, 32 nt, Human
caggacgugaucugaaaacauguagagaagau

SEQ ID NO: 353791 - RNA, 32 nt, Human
caggacguggcagcugguuggacgaggggagc

SEQ ID NO: 353792 - RNA, 32 nt, Human
caggacguuuacugcugcuuggggccagggca

SEQ ID NO: 353793 - RNA, 32 nt, Human
caggacuaccauugaccucagagcuguacccc

SEQ ID NO: 353794 - RNA, 32 nt, Human
caggacuagagagcgagccgcaaggaagucgg

SEQ ID NO: 353795 - RNA, 32 nt, Human
caggacuaucuauaauucacauaggagagaca

SEQ ID NO: 353796 - RNA, 32 nt, Human
caggacuauucuguaagaguccagagcccacc

SEQ ID NO: 353797 - RNA, 32 nt, Human
caggacucaccaucucugccucccaugaggcu

SEQ ID NO: 353798 - RNA, 32 nt, Human
caggacucacuggauagauguuauucaacucc

SEQ ID NO: 353799 - RNA, 32 nt, Human
caggacucacuggauagauguuauucgacuac

SEQ ID NO: 353800 - RNA, 32 nt, Human
caggacucagggacucaggccagucacccugu

SEQ ID NO: 353801 - RNA, 19 nt, Human
caggacucauccuaagaag

SEQ ID NO: 353802 - RNA, 32 nt, Human
caggacucaucucccuuccuucucaggggguc

SEQ ID NO: 353803 - RNA, 21 nt, Human
caggacuccacugaugagaga

SEQ ID NO: 353804 - RNA, 21 nt, Human
caggacuccagaggcuggaaa

SEQ ID NO: 353805 - RNA, 18 nt, Human
caggacuccagaugagga

SEQ ID NO: 353806 - RNA, 32 nt, Human
caggacuccagccuaugcagagcccagagugg

SEQ ID NO: 353807 - RNA, 32 nt, Human
caggacuccagccuggccgccggcgcccgcag

SEQ ID NO: 353808 - RNA, 32 nt, Human
caggacuccagcgucaggauguugccacuugg

SEQ ID NO: 353809 - RNA, 21 nt, Human
caggacuccaggcgagggaag

SEQ ID NO: 353810 - RNA, 22 nt, Human
caggacuccaguggaagugaaa

SEQ ID NO: 353811 - RNA, 32 nt, Human
caggacucccacuauugccucugugauuggcc

SEQ ID NO: 353812 - RNA, 19 nt, Human
caggacucccaggcagaaa

SEQ ID NO: 353813 - RNA, 32 nt, Human
caggacucccauccucacccugacuuagacug

SEQ ID NO: 353814 - RNA, 32 nt, Human
caggacuccugggacaucccaugugugacccc

SEQ ID NO: 353815 - RNA, 21 nt, Human
caggacuccugggccuaagaa

SEQ ID NO: 353816 - RNA, 24 nt, Human
caggacuccugggucccugggaaa

SEQ ID NO: 353817 - RNA, 25 nt, Human
caggacucgagcgauccucccgccu

SEQ ID NO: 353818 - RNA, 32 nt, Human
caggacucgagcgauccucccgccucagccuc

SEQ ID NO: 353819 - RNA, 32 nt, Human
caggacucgauuuuagcuaaugcgcuguguca

SEQ ID NO: 353820 - RNA, 32 nt, Human
caggacucgcugccuuucuuucccgucagaaa

SEQ ID NO: 353821 - RNA, 32 nt, Human
caggacucggccaccugcccuuccugcaccga

SEQ ID NO: 353822 - RNA, 23 nt, Human
caggacucguucuacugccugga

SEQ ID NO: 353823 - RNA, 23 nt, Human
caggacucucccuacugccugag

SEQ ID NO: 353824 - RNA, 32 nt, Human
caggacucucuggccuucuguggccugcaaug

SEQ ID NO: 353825 - RNA, 32 nt, Human
caggacucugagccauucucuccccuccucug

SEQ ID NO: 353826 - RNA, 32 nt, Human
caggacucugcucuccugcggccaugggccag

SEQ ID NO: 353827 - RNA, 32 nt, Human
caggacucuggcuucucuccucagacuucuau

SEQ ID NO: 353828 - RNA, 32 nt, Human
caggacucuuccccaucaucccuuccauugcc

SEQ ID NO: 353829 - RNA, 32 nt, Human
caggacugaauggcagagcuagcuuugcagga

SEQ ID NO: 353830 - RNA, 19 nt, Human
caggacugaccauggcucc

SEQ ID NO: 353831 - RNA, 32 nt, Human
caggacugacucuccaccauaaaacuggaagc

SEQ ID NO: 353832 - RNA, 32 nt, Human
caggacugagccagccucaggccagggcggga

SEQ ID NO: 353833 - RNA, 32 nt, Human
caggacugagccuggagagagaaguugcuuga

SEQ ID NO: 353834 - RNA, 23 nt, Human
caggacugaggccagcccugggg

SEQ ID NO: 353835 - RNA, 32 nt, Human
caggacugaucugccauuuucaccucuaaauc

SEQ ID NO: 353836 - RNA, 32 nt, Human
caggacugcaccuuagggcaguguccgucagu

SEQ ID NO: 353837 - RNA, 32 nt, Human
caggacugcacgguuuaacacagcagaguaca

SEQ ID NO: 353838 - RNA, 32 nt, Human
caggacugcacucucuucucggcugcacuaaa

SEQ ID NO: 353839 - RNA, 20 nt, Human
caggacugcagagucugauc

SEQ ID NO: 353840 - RNA, 32 nt, Human
caggacugcagcuccagccucuucaggcccag

SEQ ID NO: 353841 - RNA, 32 nt, Human
caggacugccugggcccugcuaggccugcuca

SEQ ID NO: 353842 - RNA, 18 nt, Human
caggacugcuccugagaa

SEQ ID NO: 353843 - RNA, 32 nt, Human
caggacugcugaccccaggccuggugauucug

SEQ ID NO: 353844 - RNA, 32 nt, Human
caggacugcuucugaaugcugcuacuugauuu

SEQ ID NO: 353845 - RNA, 32 nt, Human
caggacuggaagggaccugcagccugcagacc

SEQ ID NO: 353846 - RNA, 32 nt, Human
caggacuggagaggaggaggggguccccuaug

SEQ ID NO: 353847 - RNA, 24 nt, Human
caggacuggaucccauugccugga

SEQ ID NO: 353848 - RNA, 32 nt, Human
caggacuggcucccccaucugcuccaagggag

SEQ ID NO: 353849 - RNA, 32 nt, Human
caggacugggaaacuguguugaagcuccugac

SEQ ID NO: 353850 - RNA, 32 nt, Human
caggacugggcccugauugauaacaccucagc

SEQ ID NO: 353851 - RNA, 32 nt, Human
caggacugggucagugauggcaacaggauggc

SEQ ID NO: 353852 - RNA, 32 nt, Human
caggacugucacacaaggcuugagaagccccc

SEQ ID NO: 353853 - RNA, 32 nt, Human
caggacugugaagaaagucauaguagcagguu

SEQ ID NO: 353854 - RNA, 32 nt, Human
caggacugugacacugcacuccagccugggca

SEQ ID NO: 353855 - RNA, 32 nt, Human
caggacugugcuugguacuugaucucaugcga

SEQ ID NO: 353856 - RNA, 32 nt, Human
caggacugugugugaauguguauguauacuua

SEQ ID NO: 353857 - RNA, 32 nt, Human
caggacuguugaugaaagggacagauugagga

SEQ ID NO: 353858 - RNA, 32 nt, Human
caggacuguuguacuagauguucuuaggaaau

SEQ ID NO: 353859 - RNA, 32 nt, Human
caggacuuaaaaccagagccugcccacauccc

SEQ ID NO: 353860 - RNA, 32 nt, Human
caggacuucaagaccagccuaggcaacauggu

SEQ ID NO: 353861 - RNA, 32 nt, Human
caggacuucccaggaccccuuuugucucuggg

SEQ ID NO: 353862 - RNA, 32 nt, Human
caggacuuccucccugccucccugcaccucug

SEQ ID NO: 353863 - RNA, 32 nt, Human
caggacuucgaaccucgcccccugcacgaccc

SEQ ID NO: 353864 - RNA, 32 nt, Human
caggacuucuaagaaaggccuggugcaggcgg

SEQ ID NO: 353865 - RNA, 21 nt, Human
caggacuucucuccugaagaa

SEQ ID NO: 353866 - RNA, 32 nt, Human
caggacuucugggcauggcagucucaaaaaug

SEQ ID NO: 353867 - RNA, 24 nt, Human
caggacuugagaacaccugugccu

SEQ ID NO: 353868 - RNA, 32 nt, Human
caggacuugcacacagggaggcuguagccagg

SEQ ID NO: 353869 - RNA, 32 nt, Human
caggacuuggccucacccucuggcugaggagc

SEQ ID NO: 353870 - RNA, 32 nt, Human
caggacuugggaaacagucacugugaaaugcg

SEQ ID NO: 353871 - RNA, 32 nt, Human
caggacuugggaagcagucacugugaaaugcg

SEQ ID NO: 353872 - RNA, 32 nt, Human
caggacuuguauuagcagguucuggcuagaga

SEQ ID NO: 353873 - RNA, 32 nt, Human
caggacuuugcaagagauggagacagguuagg

SEQ ID NO: 353874 - RNA, 32 nt, Human
caggacuuugggaggccaaggcgggcagauca

SEQ ID NO: 353875 - RNA, 32 nt, Human
caggacuuugggaggccaaggucagcagauca

SEQ ID NO: 353876 - RNA, 32 nt, Human
caggacuuugggaggcugaggaaagcagauca

SEQ ID NO: 353877 - RNA, 32 nt, Human
caggagaaaaaccauaugaauguaaugaacgu

SEQ ID NO: 353878 - RNA, 32 nt, Human
caggagaaaaaccuuaugaauguaaugaaugu

SEQ ID NO: 353879 - RNA, 32 nt, Human
caggagaaaaccuggagcuacaguguccccca

SEQ ID NO: 353880 - RNA, 32 nt, Human
caggagaaaccagcuaagaccugcaggcugca

SEQ ID NO: 353881 - RNA, 19 nt, Human
caggagaaacugggccagg

SEQ ID NO: 353882 - RNA, 32 nt, Human
caggagaaaggccuuauggugcagugaauaug

SEQ ID NO: 353883 - RNA, 32 nt, Human
caggagaaauuguagugaugaaaugugcaguc

SEQ ID NO: 353884 - RNA, 32 nt, Human
caggagaaccggggcuggaggagcggcaagag

SEQ ID NO: 353885 - RNA, 32 nt, Human
caggagaaccuacagauuggaagcagcccaca

SEQ ID NO: 353886 - RNA, 21 nt, Human
caggagaacugaggcaugaaa

SEQ ID NO: 353887 - RNA, 32 nt, Human
caggagaacugauucuguggauggaugugauu

SEQ ID NO: 353888 - RNA, 32 nt, Human
caggagaacuggggcuggucucuugucagaua

SEQ ID NO: 353889 - RNA, 32 nt, Human
caggagaagacugugaggccaccauuugggcc

SEQ ID NO: 353890 - RNA, 22 nt, Human
caggagaagcacccccagggca

SEQ ID NO: 353891 - RNA, 32 nt, Human
caggagaagcagaggaagaggcuuccaucccu

SEQ ID NO: 353892 - RNA, 19 nt, Human
caggagaagcaggcgccag

SEQ ID NO: 353893 - RNA, 19 nt, Human
caggagaagcugggccagg

SEQ ID NO: 353894 - RNA, 32 nt, Human
caggagaagggcccagacacucccuccaguga

SEQ ID NO: 353895 - RNA, 32 nt, Human
caggagaagggggcaucacagagcugaugguc

SEQ ID NO: 353896 - RNA, 32 nt, Human
caggagaagggugggaacccgggaggcagagc

SEQ ID NO: 353897 - RNA, 32 nt, Human
caggagaagguaacauuggaguccugguuuga

SEQ ID NO: 353898 - RNA, 32 nt, Human
caggagaagguggaagagaaagggugggcgug

SEQ ID NO: 353899 - RNA, 32 nt, Human
caggagaagugaagauguaacauguuaucugu

SEQ ID NO: 353900 - RNA, 32 nt, Human
caggagaaguugaggggagcaugcuucccugc

SEQ ID NO: 353901 - RNA, 32 nt, Human
caggagaaucacaucaaccugggaggcggagg

SEQ ID NO: 353902 - RNA, 32 nt, Human
caggagaaucacuugaaccugggagacagagg

SEQ ID NO: 353903 - RNA, 32 nt, Human
caggagaaucacuugaccucaggaggcggagg

SEQ ID NO: 353904 - RNA, 32 nt, Human
caggagaaucacuuggaccugggaggcagagg

SEQ ID NO: 353905 - RNA, 32 nt, Human
caggagaaucacuuguaccugggaagcgcagg

SEQ ID NO: 353906 - RNA, 24 nt, Human
caggagaaucagagguugcaguga

SEQ ID NO: 353907 - RNA, 18 nt, Human
caggagaaucgcuugaac

SEQ ID NO: 353908 - RNA, 32 nt, Human
caggagaaucgcuugaaccugggaagccgaag

SEQ ID NO: 353909 - RNA, 32 nt, Human
caggagaaucgcuugaacugaggcagaggcua

SEQ ID NO: 353910 - RNA, 23 nt, Human
caggagaaugagacuccagcaca

SEQ ID NO: 353911 - RNA, 32 nt, Human
caggagaauggugcggagcuugcagugagccg

SEQ ID NO: 353912 - RNA, 21 nt, Human
caggagaauuaggagagagug

SEQ ID NO: 353913 - RNA, 20 nt, Human
caggagaauugcuugaaacc

SEQ ID NO: 353914 - RNA, 21 nt, Human
caggagaauugcuugaacaca

SEQ ID NO: 353915 - RNA, 19 nt, Human
caggagaauugcuugaacc

SEQ ID NO: 353916 - RNA, 20 nt, Human
caggagaauugcuugaacca

SEQ ID NO: 353917 - RNA, 20 nt, Human
caggagaauugcuugaaccc

SEQ ID NO: 353918 - RNA, 21 nt, Human
caggagaauugcuugaaccca

SEQ ID NO: 353919 - RNA, 20 nt, Human
caggagaauugcuugaaccg

SEQ ID NO: 353920 - RNA, 21 nt, Human
caggagaauugcuugaacuca

SEQ ID NO: 353921 - RNA, 20 nt, Human
caggagaauugcuugaaucc

SEQ ID NO: 353922 - RNA, 21 nt, Human
caggagaauugcuugaaucca

SEQ ID NO: 353923 - RNA, 20 nt, Human
caggagaauugcuugaccca

SEQ ID NO: 353924 - RNA, 19 nt, Human
caggagaauugcuugagcc

SEQ ID NO: 353925 - RNA, 21 nt, Human
caggagaauugcuugagucca

SEQ ID NO: 353926 - RNA, 32 nt, Human
caggagaauugggugacugcaguuuauggugc

SEQ ID NO: 353927 - RNA, 20 nt, Human
caggagacaaaagagcagug

SEQ ID NO: 353928 - RNA, 32 nt, Human
caggagaccagccugggcaacauagcaaaacc

SEQ ID NO: 353929 - RNA, 32 nt, Human
caggagaccagcugccuuugagcagggagucu

SEQ ID NO: 353930 - RNA, 32 nt, Human
caggagaccagcugcucuagaagagccuggac

SEQ ID NO: 353931 - RNA, 32 nt, Human
caggagaccauagacagacugaccucacagcu

SEQ ID NO: 353932 - RNA, 32 nt, Human
caggagacccagaccuagaacuacccagagca

SEQ ID NO: 353933 - RNA, 32 nt, Human
caggagaccgaugccauuucuuuuccucauaa

SEQ ID NO: 353934 - RNA, 32 nt, Human
caggagaccgugcaggcucugaagggagcucc

SEQ ID NO: 353935 - RNA, 20 nt, Human
caggagaccuggagcugagg

SEQ ID NO: 353936 - RNA, 32 nt, Human
caggagacgcagugucagagcguguggguggc

SEQ ID NO: 353937 - RNA, 22 nt, Human
caggagacggagguuacaguga

SEQ ID NO: 353938 - RNA, 22 nt, Human
caggagacggagguugcuguga

SEQ ID NO: 353939 - RNA, 32 nt, Human
caggagacgggacacgccacacccagcaggca

SEQ ID NO: 353940 - RNA, 21 nt, Human
caggagacggggccccugccu

SEQ ID NO: 353941 - RNA, 32 nt, Human
caggagacguggcuguccucagccuggcagug

SEQ ID NO: 353942 - RNA, 32 nt, Human
caggagacguuggcuugggccugcuguguugc

SEQ ID NO: 353943 - RNA, 32 nt, Human
caggagagaaaccauaugaauguaaugaaugu

SEQ ID NO: 353944 - RNA, 32 nt, Human
caggagagaagaaaggaaggaagaaaaggaua

SEQ ID NO: 353945 - RNA, 32 nt, Human
caggagagaggacccauuagcuggcagaccca

SEQ ID NO: 353946 - RNA, 23 nt, Human
caggagagaggcugcccaacgca

SEQ ID NO: 353947 - RNA, 32 nt, Human
caggagagauggcugaaaaggugaucaucuug

SEQ ID NO: 353948 - RNA, 32 nt, Human
caggagagauucaacagcauuaccucagcuua

SEQ ID NO: 353949 - RNA, 32 nt, Human
caggagagccagccauugucuccaguacuugc

SEQ ID NO: 353950 - RNA, 32 nt, Human
caggagagccaggggaaaagugccucauaguu

SEQ ID NO: 353951 - RNA, 21 nt, Human
caggagagccagggguccagu

SEQ ID NO: 353952 - RNA, 32 nt, Human
caggagagccugagggcugaggcccagcguga

SEQ ID NO: 353953 - RNA, 18 nt, Human
caggagagccugggccag

SEQ ID NO: 353954 - RNA, 32 nt, Human
caggagagcguccggauucccugcucuagguc

SEQ ID NO: 353955 - RNA, 32 nt, Human
caggagaggaagagauggugccuacaaccuga

SEQ ID NO: 353956 - RNA, 32 nt, Human
caggagaggaagcaccauuagaacaacuccau

SEQ ID NO: 353957 - RNA, 32 nt, Human
caggagaggaaggagcggcgggcagguggccc

SEQ ID NO: 353958 - RNA, 32 nt, Human
caggagaggagaaauaucucauacaagugaaa

SEQ ID NO: 353959 - RNA, 22 nt, Human
caggagaggauaucccagcaaa

SEQ ID NO: 353960 - RNA, 32 nt, Human
caggagaggcagcagaggggucaggggagguc

SEQ ID NO: 353961 - RNA, 32 nt, Human
caggagaggcggcccugguggggaagaggcca

SEQ ID NO: 353962 - RNA, 32 nt, Human
caggagaggcugcuggagagggagaggcugcu

SEQ ID NO: 353963 - RNA, 32 nt, Human
caggagagggacaauggaagcugccccgucca

SEQ ID NO: 353964 - RNA, 32 nt, Human
caggagagggaggcuuccugacugacacaggc

SEQ ID NO: 353965 - RNA, 32 nt, Human
caggagagggauauggagagcaggugguggaa

SEQ ID NO: 353966 - RNA, 32 nt, Human
caggagagggcaaaaagccaagaguaacccca

SEQ ID NO: 353967 - RNA, 23 nt, Human
caggagagggcuggguggggcag

SEQ ID NO: 353968 - RNA, 32 nt, Human
caggagaggggcauuuggaggcucccucccug

SEQ ID NO: 353969 - RNA, 22 nt, Human
caggagaggguuccuucagccc

SEQ ID NO: 353970 - RNA, 29 nt, Human
caggagaguaugugugugcgugcuggggg

SEQ ID NO: 353971 - RNA, 32 nt, Human
caggagagucacuugaaccugggaagcagaag

SEQ ID NO: 353972 - RNA, 32 nt, Human
caggagagugaagaaauuggccacagaagagc

SEQ ID NO: 353973 - RNA, 32 nt, Human
caggagaguggaggcugcaggaagaggcgggu

SEQ ID NO: 353974 - RNA, 32 nt, Human
caggagaguuggguuuucagggcagagauggg

SEQ ID NO: 353975 - RNA, 32 nt, Human
caggagaguuuucaaccuuggaaauguaagug

SEQ ID NO: 353976 - RNA, 32 nt, Human
caggagauaaagccuaggcaaagcuuuaaacc

SEQ ID NO: 353977 - RNA, 32 nt, Human
caggagauagugagcagcucccagggagcuag

SEQ ID NO: 353978 - RNA, 32 nt, Human
caggagaucaugagauuucaucacucaggaug

SEQ ID NO: 353979 - RNA, 32 nt, Human
caggagauccuaauaugaaagaaaaauggauc

SEQ ID NO: 353980 - RNA, 22 nt, Human
caggagauggagguuucaguga

SEQ ID NO: 353981 - RNA, 32 nt, Human
caggagaugggacuucagggagaccuggcuug

SEQ ID NO: 353982 - RNA, 32 nt, Human
caggagaugggaggggagagaccagcucucca

SEQ ID NO: 353983 - RNA, 32 nt, Human
caggagaugggggcgggggcagcugugucauc

SEQ ID NO: 353984 - RNA, 32 nt, Human
caggagaugguccaugagagaggcagaaggau

SEQ ID NO: 353985 - RNA, 32 nt, Human
caggagauugagaccuuccuggcuaacauggu

SEQ ID NO: 353986 - RNA, 32 nt, Human
caggagauugagaucaugaggucaggagauug

SEQ ID NO: 353987 - RNA, 32 nt, Human
caggagauuuugaggcccugagguuuuaggug

SEQ ID NO: 353988 - RNA, 19 nt, Human
caggagcaaaacuauguca

SEQ ID NO: 353989 - RNA, 21 nt, Human
caggagcaaagcugccaggcu

SEQ ID NO: 353990 - RNA, 21 nt, Human
caggagcaagggaaggcgggc

SEQ ID NO: 353991 - RNA, 32 nt, Human
caggagcaauccagggccauacagcuaugaag

SEQ ID NO: 353992 - RNA, 32 nt, Human
caggagcacaucagggagcugggaaacacagu

SEQ ID NO: 353993 - RNA, 32 nt, Human
caggagcacccaggcuugggcagcaaucucug

SEQ ID NO: 353994 - RNA, 21 nt, Human
caggagcaccggcagcaccag

SEQ ID NO: 353995 - RNA, 32 nt, Human
caggagcaccggcugccccucuggguggcacu

SEQ ID NO: 353996 - RNA, 32 nt, Human
caggagcacggcucuguccccagccugggaaa

SEQ ID NO: 353997 - RNA, 32 nt, Human
caggagcacugaaccugcccucccaggugcaa

SEQ ID NO: 353998 - RNA, 22 nt, Human
caggagcacugcacagcaguug

SEQ ID NO: 353999 - RNA, 32 nt, Human
caggagcagaaacaggucuguuguuucugaag

SEQ ID NO: 354000 - RNA, 24 nt, Human
caggagcagaagacuggauggcug

SEQ ID NO: 354001 - RNA, 32 nt, Human
caggagcagaggugccccagagugcuucacag

SEQ ID NO: 354002 - RNA, 32 nt, Human
caggagcagaguuaaagguaauaaaagcaaca

SEQ ID NO: 354003 - RNA, 32 nt, Human
caggagcagcaacccugagucaauaaggagca

SEQ ID NO: 354004 - RNA, 22 nt, Human
caggagcagcaccccccgggga

SEQ ID NO: 354005 - RNA, 32 nt, Human
caggagcagccagcagugcauucaccccacuu

SEQ ID NO: 354006 - RNA, 32 nt, Human
caggagcagccuguuuacaucugccgcggcca

SEQ ID NO: 354007 - RNA, 32 nt, Human
caggagcagcgugcaggagcaaggcugcccug

SEQ ID NO: 354008 - RNA, 32 nt, Human
caggagcagcuauuuucacucaguaucaaaga

SEQ ID NO: 354009 - RNA, 20 nt, Human
caggagcaggaagggccagg

SEQ ID NO: 354010 - RNA, 21 nt, Human
caggagcaggaugagaggcug

SEQ ID NO: 354011 - RNA, 20 nt, Human
caggagcagggaagagcagu

SEQ ID NO: 354012 - RNA, 21 nt, Human
caggagcagggcagcuggcug

SEQ ID NO: 354013 - RNA, 22 nt, Human
caggagcagggcgagggcgccu

SEQ ID NO: 354014 - RNA, 20 nt, Human
caggagcagggcugggguca

SEQ ID NO: 354015 - RNA, 23 nt, Human
caggagcagggcugugcugccug

SEQ ID NO: 354016 - RNA, 22 nt, Human
caggagcagggcuugcccaggc

SEQ ID NO: 354017 - RNA, 32 nt, Human
caggagcaggggagacagggcuccagggauga

SEQ ID NO: 354018 - RNA, 32 nt, Human
caggagcagggugguggcuggggcgauggugg

SEQ ID NO: 354019 - RNA, 20 nt, Human
caggagcagguuugaggggc

SEQ ID NO: 354020 - RNA, 32 nt, Human
caggagcagucgccuuucccacccacagcgcu

SEQ ID NO: 354021 - RNA, 32 nt, Human
caggagcaguggugcugucagcgcggccgucg

SEQ ID NO: 354022 - RNA, 32 nt, Human
caggagcaucaggcugaagugaagggcaugug

SEQ ID NO: 354023 - RNA, 32 nt, Human
caggagcaucuucuuggcagccaggcugggcc

SEQ ID NO: 354024 - RNA, 32 nt, Human
caggagcaugaagaggaugguucagagacaga

SEQ ID NO: 354025 - RNA, 32 nt, Human
caggagcauggacugaaggcgcccucgcccca

SEQ ID NO: 354026 - RNA, 32 nt, Human
caggagcaugggcaucagcuaccucacgggaa

SEQ ID NO: 354027 - RNA, 32 nt, Human
caggagccaagaggaacaggaaaacaaauggc

SEQ ID NO: 354028 - RNA, 32 nt, Human
caggagccaaggaagguggguggcuuuuggaa

SEQ ID NO: 354029 - RNA, 32 nt, Human
caggagccaagugcuuuuggauggugagggug

SEQ ID NO: 354030 - RNA, 23 nt, Human
caggagccaauggggucacggug

SEQ ID NO: 354031 - RNA, 32 nt, Human
caggagccaccagagccuuccucucuuuguac

SEQ ID NO: 354032 - RNA, 32 nt, Human
caggagccaccagcaaagcgcagaaaggguuc

SEQ ID NO: 354033 - RNA, 32 nt, Human
caggagccaccugcuccacucauccacaaagg

SEQ ID NO: 354034 - RNA, 23 nt, Human
caggagccacggguggggccagg

SEQ ID NO: 354035 - RNA, 32 nt, Human
caggagccacugcacuccagccugggugacag

SEQ ID NO: 354036 - RNA, 22 nt, Human
caggagccagagacugcaguga

SEQ ID NO: 354037 - RNA, 32 nt, Human
caggagccagcagaggaagaacgagauggcag

SEQ ID NO: 354038 - RNA, 24 nt, Human
caggagccagcagggcgggccagg

SEQ ID NO: 354039 - RNA, 32 nt, Human
caggagccagccacuggcuggacagggaagaa

SEQ ID NO: 354040 - RNA, 22 nt, Human
caggagccagccccggacccug

SEQ ID NO: 354041 - RNA, 32 nt, Human
caggagccaggaacaagcaggagcggugcuca

SEQ ID NO: 354042 - RNA, 32 nt, Human
caggagccaggcuuccccucagcugggugaag

SEQ ID NO: 354043 - RNA, 31 nt, Human
caggagccaggucuggagcaucagugugagg

SEQ ID NO: 354044 - RNA, 32 nt, Human
caggagccagugacacaguggugcagagaaua

SEQ ID NO: 354045 - RNA, 24 nt, Human
caggagccaguuuguugcucaggg

SEQ ID NO: 354046 - RNA, 32 nt, Human
caggagcccaaguuguucuggccacaccuucu

SEQ ID NO: 354047 - RNA, 32 nt, Human
caggagcccacaggaccuggagcucuggaagc

SEQ ID NO: 354048 - RNA, 18 nt, Human
caggagcccacggugggg

SEQ ID NO: 354049 - RNA, 20 nt, Human
caggagcccagaccguggga

SEQ ID NO: 354050 - RNA, 32 nt, Human
caggagcccagccagcugcgccugcgcugcag

SEQ ID NO: 354051 - RNA, 32 nt, Human
caggagcccagccugugggggcaguucacauc

SEQ ID NO: 354052 - RNA, 20 nt, Human
caggagcccagcgcgucagg

SEQ ID NO: 354053 - RNA, 32 nt, Human
caggagcccaggaguuugagguuggccuggac

SEQ ID NO: 354054 - RNA, 23 nt, Human
caggagcccagggcgcccuggga

SEQ ID NO: 354055 - RNA, 21 nt, Human
caggagcccaggggaugggaa

SEQ ID NO: 354056 - RNA, 32 nt, Human
caggagcccaugcccacggcugugcuggaaaa

SEQ ID NO: 354057 - RNA, 32 nt, Human
caggagccccacugcuuccagccucuggugcc

SEQ ID NO: 354058 - RNA, 32 nt, Human
caggagccccagccagcccuucccaggccagc

SEQ ID NO: 354059 - RNA, 32 nt, Human
caggagccccaucaaggaaggacggggauaga

SEQ ID NO: 354060 - RNA, 32 nt, Human
caggagcccccaaggaguuggaagagacggag

SEQ ID NO: 354061 - RNA, 24 nt, Human
caggagccccgagaccugcaggga

SEQ ID NO: 354062 - RNA, 21 nt, Human
caggagccccggaggcccagg

SEQ ID NO: 354063 - RNA, 23 nt, Human
caggagccccugagcaguggcug

SEQ ID NO: 354064 - RNA, 32 nt, Human
caggagccccugugaggcccaggaugaaggaa

SEQ ID NO: 354065 - RNA, 32 nt, Human
caggagcccgcuuuguauuagcagguuugcau

SEQ ID NO: 354066 - RNA, 32 nt, Human
caggagcccgggaggcggaggcgggaggcggc

SEQ ID NO: 354067 - RNA, 32 nt, Human
caggagcccgggagggaggggugugcaggagc

SEQ ID NO: 354068 - RNA, 21 nt, Human
caggagcccggugcuagggga

SEQ ID NO: 354069 - RNA, 22 nt, Human
caggagcccguccagccagggg

SEQ ID NO: 354070 - RNA, 24 nt, Human
caggagcccugagaccugcagggg

SEQ ID NO: 354071 - RNA, 32 nt, Human
caggagcccugagugcucacagccgccucuga

SEQ ID NO: 354072 - RNA, 20 nt, Human
caggagcccugauccggggg

SEQ ID NO: 354073 - RNA, 22 nt, Human
caggagcccugcugcccagggg

SEQ ID NO: 354074 - RNA, 32 nt, Human
caggagcccuuagcccugagguuuccauuccc

SEQ ID NO: 354075 - RNA, 32 nt, Human
caggagccgaaagauagucuugaagucauuca

SEQ ID NO: 354076 - RNA, 20 nt, Human
caggagccgaagcccagggg

SEQ ID NO: 354077 - RNA, 24 nt, Human
caggagccgagcccagcccggggg

SEQ ID NO: 354078 - RNA, 21 nt, Human
caggagccgcacggccaggga

SEQ ID NO: 354079 - RNA, 24 nt, Human
caggagccgccgccggcucgggga

SEQ ID NO: 354080 - RNA, 21 nt, Human
caggagccgggcauucagaga

SEQ ID NO: 354081 - RNA, 19 nt, Human
caggagccggggcagcggc

SEQ ID NO: 354082 - RNA, 32 nt, Human
caggagccuagaggaggaaaaaggcuggugga

SEQ ID NO: 354083 - RNA, 19 nt, Human
caggagccuaggcuagggg

SEQ ID NO: 354084 - RNA, 32 nt, Human
caggagccuauccugaauuuuguaaaauaucc

SEQ ID NO: 354085 - RNA, 32 nt, Human
caggagccucauccucccucacccucaccugg

SEQ ID NO: 354086 - RNA, 32 nt, Human
caggagccuggacccagcugugcagcuccuug

SEQ ID NO: 354087 - RNA, 20 nt, Human
caggagccuggccgcgggga

SEQ ID NO: 354088 - RNA, 19 nt, Human
caggagccuggccugggga

SEQ ID NO: 354089 - RNA, 32 nt, Human
caggagccugggaaagaggcccucgccaggug

SEQ ID NO: 354090 - RNA, 18 nt, Human
caggagccuggggcaggg

SEQ ID NO: 354091 - RNA, 21 nt, Human
caggagccuggggccugugga

SEQ ID NO: 354092 - RNA, 32 nt, Human
caggagccuguaauccuagcuacucaggaggc

SEQ ID NO: 354093 - RNA, 32 nt, Human
caggagccuguuucuaaagaaacccaugcugu

SEQ ID NO: 354094 - RNA, 17 nt, Human
caggagccuuccucucc

SEQ ID NO: 354095 - RNA, 32 nt, Human
caggagccuuuguucuuugauccugccgugag

SEQ ID NO: 354096 - RNA, 32 nt, Human
caggagcgaacaggaacaggaaaacaaauggc

SEQ ID NO: 354097 - RNA, 24 nt, Human
caggagcgcaagauagauuuggaa

SEQ ID NO: 354098 - RNA, 21 nt, Human
caggagcgcucgugcuuggaa

SEQ ID NO: 354099 - RNA, 20 nt, Human
caggagcgcugccccaggga

SEQ ID NO: 354100 - RNA, 21 nt, Human
caggagcggcagcagagacug

SEQ ID NO: 354101 - RNA, 24 nt, Human
caggagcggcggcagcagcgacug

SEQ ID NO: 354102 - RNA, 32 nt, Human
caggagcggcggcagcagcgacugggggcggc

SEQ ID NO: 354103 - RNA, 25 nt, Human
caggagcggcugcggaaggcggccg

SEQ ID NO: 354104 - RNA, 32 nt, Human
caggagcgggcagaagggagagagggaggggc

SEQ ID NO: 354105 - RNA, 20 nt, Human
caggagcggggcacacgggg

SEQ ID NO: 354106 - RNA, 21 nt, Human
caggagcgggggcggcggggg

SEQ ID NO: 354107 - RNA, 22 nt, Human
caggagcgggggcggcgggggg

SEQ ID NO: 354108 - RNA, 32 nt, Human
caggagcgugaaagcaucuuugcucaacuccu

SEQ ID NO: 354109 - RNA, 32 nt, Human
caggagcgugagccacuucugcaguccaagcu

SEQ ID NO: 354110 - RNA, 32 nt, Human
caggagcuaacaggaaaaagaaaaucaauggc

SEQ ID NO: 354111 - RNA, 32 nt, Human
caggagcuaguuuuaccagcauccugcuccac

SEQ ID NO: 354112 - RNA, 32 nt, Human
caggagcuaugggagcaaggagagggagcucu

SEQ ID NO: 354113 - RNA, 32 nt, Human
caggagcucaagucccaccugggcaacauagu

SEQ ID NO: 354114 - RNA, 21 nt, Human
caggagcucagcagaccagug

SEQ ID NO: 354115 - RNA, 32 nt, Human
caggagcucagcguucacgggcaucuugccau

SEQ ID NO: 354116 - RNA, 32 nt, Human
caggagcucgagccagccuggccaacauggca

SEQ ID NO: 354117 - RNA, 32 nt, Human
caggagcucgcuuugaccccuuuggacccauu

SEQ ID NO: 354118 - RNA, 32 nt, Human
caggagcucugacuaagguugacauaauaguc

SEQ ID NO: 354119 - RNA, 21 nt, Human
caggagcugagcagcggggga

SEQ ID NO: 354120 - RNA, 32 nt, Human
caggagcugaggcagaagaaccccuugaaccc

SEQ ID NO: 354121 - RNA, 19 nt, Human
caggagcugaggccggaga

SEQ ID NO: 354122 - RNA, 32 nt, Human
caggagcugaugcuguaguuugcagauagaau

SEQ ID NO: 354123 - RNA, 23 nt, Human
caggagcugauguugccaaggga

SEQ ID NO: 354124 - RNA, 28 nt, Human
caggagcugauucgagcuggcagagcug

SEQ ID NO: 354125 - RNA, 32 nt, Human
caggagcugccuggugucugcuguaaauguuu

SEQ ID NO: 354126 - RNA, 32 nt, Human
caggagcugcugcugcaguugcagaaggauaa

SEQ ID NO: 354127 - RNA, 32 nt, Human
caggagcugcuugcugagguguaaagggucuu

SEQ ID NO: 354128 - RNA, 32 nt, Human
caggagcugcuuggagaugcugcuguggccac

SEQ ID NO: 354129 - RNA, 19 nt, Human
caggagcuggcugauguca

SEQ ID NO: 354130 - RNA, 32 nt, Human
caggagcugggaagaaaggaagaggaggaagg

SEQ ID NO: 354131 - RNA, 19 nt, Human
caggagcugggaguugaga

SEQ ID NO: 354132 - RNA, 32 nt, Human
caggagcugggcccccucacgccugccuuccu

SEQ ID NO: 354133 - RNA, 32 nt, Human
caggagcugggggagagcuggagggcccuggg

SEQ ID NO: 354134 - RNA, 32 nt, Human
caggagcugggggagaggacucuccccuguga

SEQ ID NO: 354135 - RNA, 19 nt, Human
caggagcugggggucagag

SEQ ID NO: 354136 - RNA, 22 nt, Human
caggagcugguaugugaugcca

SEQ ID NO: 354137 - RNA, 32 nt, Human
caggagcugucaccaaggaaacgcuaccucuc

SEQ ID NO: 354138 - RNA, 19 nt, Human
caggagcuguggcagcggc

SEQ ID NO: 354139 - RNA, 21 nt, Human
caggagcuucugaacaugaag

SEQ ID NO: 354140 - RNA, 32 nt, Human
caggagcuuucuggauagaggcagcagcgugu

SEQ ID NO: 354141 - RNA, 32 nt, Human
caggaggaaacaccuccagcccgcgaccuccu

SEQ ID NO: 354142 - RNA, 32 nt, Human
caggaggaaaugcaaccagucagggcccagaa

SEQ ID NO: 354143 - RNA, 32 nt, Human
caggaggaacaaaaacaggcacugaguuaaaa

SEQ ID NO: 354144 - RNA, 19 nt, Human
caggaggaacagcaugcca

SEQ ID NO: 354145 - RNA, 32 nt, Human
caggaggaacagcugggcaaugcgggaggcag

SEQ ID NO: 354146 - RNA, 27 nt, Human
caggaggaagacagccaccagcggcug

SEQ ID NO: 354147 - RNA, 18 nt, Human
caggaggaagagaugcca

SEQ ID NO: 354148 - RNA, 32 nt, Human
caggaggaaggauggggcaagagcagacaaac

SEQ ID NO: 354149 - RNA, 32 nt, Human
caggaggaaggcagcuggugucucagcagaug

SEQ ID NO: 354150 - RNA, 20 nt, Human
caggaggaaggugugaugcc

SEQ ID NO: 354151 - RNA, 32 nt, Human
caggaggaaguggcuucugaagagcacauuug

SEQ ID NO: 354152 - RNA, 20 nt, Human
caggaggaaugucugauacc

SEQ ID NO: 354153 - RNA, 32 nt, Human
caggaggacaccagauacagacuucagccccu

SEQ ID NO: 354154 - RNA, 32 nt, Human
caggaggacagaggggcuggucucaggugugg

SEQ ID NO: 354155 - RNA, 20 nt, Human
caggaggacaggaugagcca

SEQ ID NO: 354156 - RNA, 24 nt, Human
caggaggacagucgggugauggug

SEQ ID NO: 354157 - RNA, 32 nt, Human
caggaggacaugcagguggaauuugugcaagc

SEQ ID NO: 354158 - RNA, 19 nt, Human
caggaggacaugggccugg

SEQ ID NO: 354159 - RNA, 22 nt, Human
caggaggacccucaguucagug

SEQ ID NO: 354160 - RNA, 18 nt, Human
caggaggacccucugcua

SEQ ID NO: 354161 - RNA, 19 nt, Human
caggaggaccgcuugagcc

SEQ ID NO: 354162 - RNA, 21 nt, Human
caggaggaccgcuugagucca

SEQ ID NO: 354163 - RNA, 17 nt, Human
caggaggaccugaccca

SEQ ID NO: 354164 - RNA, 32 nt, Human
caggaggacuaggaggaggaggaggagccguc

SEQ ID NO: 354165 - RNA, 19 nt, Human
caggaggacugcuugagcc

SEQ ID NO: 354166 - RNA, 19 nt, Human
caggaggacugcuugagcu

SEQ ID NO: 354167 - RNA, 18 nt, Human
caggaggacuuaaugcua

SEQ ID NO: 354168 - RNA, 18 nt, Human
caggaggacuuaauggca

SEQ ID NO: 354169 - RNA, 32 nt, Human
caggaggacuuccugcguccauggaagggauc

SEQ ID NO: 354170 - RNA, 21 nt, Human
caggaggacuuggcgcugcca

SEQ ID NO: 354171 - RNA, 32 nt, Human
caggaggagaaggaggaggagcaggaggugga

SEQ ID NO: 354172 - RNA, 32 nt, Human
caggaggagacaaauugcucacggucaugcca

SEQ ID NO: 354173 - RNA, 32 nt, Human
caggaggagacccugaaggaugcaguugagaa

SEQ ID NO: 354174 - RNA, 32 nt, Human
caggaggagagaagaauuccagugagcagcag

SEQ ID NO: 354175 - RNA, 32 nt, Human
caggaggagagaaggaaggagaggugaucucc

SEQ ID NO: 354176 - RNA, 32 nt, Human
caggaggagagggaaguaguggcagcagccca

SEQ ID NO: 354177 - RNA, 32 nt, Human
caggaggagcaccgggcuugggcuuccucuga

SEQ ID NO: 354178 - RNA, 25 nt, Human
caggaggagcagcacccgagcccug

SEQ ID NO: 354179 - RNA, 18 nt, Human
caggaggagccucuggga

SEQ ID NO: 354180 - RNA, 20 nt, Human
caggaggagcugcagcgcca

SEQ ID NO: 354181 - RNA, 20 nt, Human
caggaggagcugcggcgcca

SEQ ID NO: 354182 - RNA, 32 nt, Human
caggaggaggagauaccaggaggcagggaugc

SEQ ID NO: 354183 - RNA, 19 nt, Human
caggaggaggagauggcca

SEQ ID NO: 354184 - RNA, 32 nt, Human
caggaggaggaggaggaggaggaggagagcgc

SEQ ID NO: 354185 - RNA, 21 nt, Human
caggaggaggaggucgcagug

SEQ ID NO: 354186 - RNA, 18 nt, Human
caggaggaggaugagcca

SEQ ID NO: 354187 - RNA, 18 nt, Human
caggaggaggcauugcca

SEQ ID NO: 354188 - RNA, 32 nt, Human
caggaggagguagagagagggcagccggagca

SEQ ID NO: 354189 - RNA, 32 nt, Human
caggaggagguggaacugauguaggggguggc

SEQ ID NO: 354190 - RNA, 32 nt, Human
caggaggagguggagaucgcagugagcugaga

SEQ ID NO: 354191 - RNA, 32 nt, Human
caggaggagguuugagcugagcucaggcacag

SEQ ID NO: 354192 - RNA, 23 nt, Human
caggaggagugggacagacagca

SEQ ID NO: 354193 - RNA, 32 nt, Human
caggaggaguggucuggggcccagggauacug

SEQ ID NO: 354194 - RNA, 23 nt, Human
caggaggaguugggucaccagua

SEQ ID NO: 354195 - RNA, 32 nt, Human
caggaggauaccgcaucaccaccagcagcucu

SEQ ID NO: 354196 - RNA, 21 nt, Human
caggaggauagcuugaggcca

SEQ ID NO: 354197 - RNA, 32 nt, Human
caggaggaucaauuaaggccaggaguucaacc

SEQ ID NO: 354198 - RNA, 21 nt, Human
caggaggaucaccugagguca

SEQ ID NO: 354199 - RNA, 19 nt, Human
caggaggaucacgugagcc

SEQ ID NO: 354200 - RNA, 21 nt, Human
caggaggaucacucaaggcca

SEQ ID NO: 354201 - RNA, 21 nt, Human
caggaggaucacuggaggcca

SEQ ID NO: 354202 - RNA, 21 nt, Human
caggaggaucacuuaaggcca

SEQ ID NO: 354203 - RNA, 21 nt, Human
caggaggaucacuucaggcca

SEQ ID NO: 354204 - RNA, 19 nt, Human
caggaggaucacuugaacc

SEQ ID NO: 354205 - RNA, 21 nt, Human
caggaggaucacuugaaccca

SEQ ID NO: 354206 - RNA, 21 nt, Human
caggaggaucacuugagacca

SEQ ID NO: 354207 - RNA, 19 nt, Human
caggaggaucacuugagcc

SEQ ID NO: 354208 - RNA, 20 nt, Human
caggaggaucacuugagcca

SEQ ID NO: 354209 - RNA, 19 nt, Human
caggaggaucacuugagcu

SEQ ID NO: 354210 - RNA, 21 nt, Human
caggaggaucacuugaggcca

SEQ ID NO: 354211 - RNA, 23 nt, Human
caggaggaucacuugaggccagg

SEQ ID NO: 354212 - RNA, 32 nt, Human
caggaggaucacuugaggccagugagcuguga

SEQ ID NO: 354213 - RNA, 21 nt, Human
caggaggaucacuugaggcua

SEQ ID NO: 354214 - RNA, 21 nt, Human
caggaggaucacuugagguca

SEQ ID NO: 354215 - RNA, 19 nt, Human
caggaggaucacuugaguc

SEQ ID NO: 354216 - RNA, 21 nt, Human
caggaggaucacuugagucca

SEQ ID NO: 354217 - RNA, 32 nt, Human
caggaggaucacuugaguccaggaguuugaaa

SEQ ID NO: 354218 - RNA, 21 nt, Human
caggaggaucacuuggagcca

SEQ ID NO: 354219 - RNA, 19 nt, Human
caggaggaucacuugggcc

SEQ ID NO: 354220 - RNA, 32 nt, Human
caggaggaucacuuuaguucaggaguuugaaa

SEQ ID NO: 354221 - RNA, 19 nt, Human
caggaggaucgccugagcc

SEQ ID NO: 354222 - RNA, 19 nt, Human
caggaggaucgcuggagcc

SEQ ID NO: 354223 - RNA, 18 nt, Human
caggaggaucgcuugaac

SEQ ID NO: 354224 - RNA, 19 nt, Human
caggaggaucgcuugaacc

SEQ ID NO: 354225 - RNA, 20 nt, Human
caggaggaucgcuugaaccc

SEQ ID NO: 354226 - RNA, 21 nt, Human
caggaggaucgcuugaaccca

SEQ ID NO: 354227 - RNA, 21 nt, Human
caggaggaucgcuugagacca

SEQ ID NO: 354228 - RNA, 19 nt, Human
caggaggaucgcuugagcc

SEQ ID NO: 354229 - RNA, 21 nt, Human
caggaggaucgcuugaggcca

SEQ ID NO: 354230 - RNA, 20 nt, Human
caggaggaucgcuugagugu

SEQ ID NO: 354231 - RNA, 19 nt, Human
caggaggaucgcuugugcc

SEQ ID NO: 354232 - RNA, 21 nt, Human
caggaggaucguuugaggcca

SEQ ID NO: 354233 - RNA, 32 nt, Human
caggaggaucucuugagcccaggauuuugaau

SEQ ID NO: 354234 - RNA, 32 nt, Human
caggaggaugcaauuguugaaagcuuugaaau

SEQ ID NO: 354235 - RNA, 32 nt, Human
caggaggaugcaccaaguugcucacaguggau

SEQ ID NO: 354236 - RNA, 32 nt, Human
caggaggaugcuccagcuccuggugcugaaga

SEQ ID NO: 354237 - RNA, 24 nt, Human
caggaggaugcuggcggcacagug

SEQ ID NO: 354238 - RNA, 32 nt, Human
caggaggaugcuggcggcacagugagugaggc

SEQ ID NO: 354239 - RNA, 19 nt, Human
caggaggauggcaguacca

SEQ ID NO: 354240 - RNA, 32 nt, Human
caggaggaugggcucugggaagaaggagugaa

SEQ ID NO: 354241 - RNA, 21 nt, Human
caggaggauuacuugaggcca

SEQ ID NO: 354242 - RNA, 19 nt, Human
caggaggauugccugagcc

SEQ ID NO: 354243 - RNA, 21 nt, Human
caggaggauugccugaggcca

SEQ ID NO: 354244 - RNA, 19 nt, Human
caggaggauugcucgaacc

SEQ ID NO: 354245 - RNA, 19 nt, Human
caggaggauugcuggagcc

SEQ ID NO: 354246 - RNA, 20 nt, Human
caggaggauugcugucagcc

SEQ ID NO: 354247 - RNA, 19 nt, Human
caggaggauugcuuaagcc

SEQ ID NO: 354248 - RNA, 21 nt, Human
caggaggauugcuugaauuca

SEQ ID NO: 354249 - RNA, 20 nt, Human
caggaggauugcuugagacc

SEQ ID NO: 354250 - RNA, 18 nt, Human
caggaggauugcuugagc

SEQ ID NO: 354251 - RNA, 19 nt, Human
caggaggauugcuugagcc

SEQ ID NO: 354252 - RNA, 19 nt, Human
caggaggauugcuugagcu

SEQ ID NO: 354253 - RNA, 19 nt, Human
caggaggauugcuugaggc

SEQ ID NO: 354254 - RNA, 20 nt, Human
caggaggauugcuugaggcc

SEQ ID NO: 354255 - RNA, 21 nt, Human
caggaggauugcuugaggcca

SEQ ID NO: 354256 - RNA, 21 nt, Human
caggaggauugcuugagguca

SEQ ID NO: 354257 - RNA, 20 nt, Human
caggaggauugcuugagguu

SEQ ID NO: 354258 - RNA, 19 nt, Human
caggaggauugcuugaguc

SEQ ID NO: 354259 - RNA, 21 nt, Human
caggaggauugcuugagucca

SEQ ID NO: 354260 - RNA, 17 nt, Human
caggaggauugggagcc

SEQ ID NO: 354261 - RNA, 21 nt, Human
caggaggauuguuugaggcca

SEQ ID NO: 354262 - RNA, 23 nt, Human
caggaggauuugaaggcacaaug

SEQ ID NO: 354263 - RNA, 22 nt, Human
caggaggcacgcacccagagaa

SEQ ID NO: 354264 - RNA, 32 nt, Human
caggaggcacuuggcccagucugaccuggugu

SEQ ID NO: 354265 - RNA, 23 nt, Human
caggaggcagaaacaccagccuc

SEQ ID NO: 354266 - RNA, 31 nt, Human
caggaggcagacacugcccagaugcucggug

SEQ ID NO: 354267 - RNA, 32 nt, Human
caggaggcagacuugcagagcuuguuuuguuu

SEQ ID NO: 354268 - RNA, 32 nt, Human
caggaggcagagaagagggcgcuggguuggac

SEQ ID NO: 354269 - RNA, 20 nt, Human
caggaggcagagauugcggu

SEQ ID NO: 354270 - RNA, 26 nt, Human
caggaggcagagccggcucaccuccu

SEQ ID NO: 354271 - RNA, 32 nt, Human
caggaggcagaggcccuccccauccgcauuau

SEQ ID NO: 354272 - RNA, 21 nt, Human
caggaggcagaggucgcagug

SEQ ID NO: 354273 - RNA, 21 nt, Human
caggaggcagagguuacagua

SEQ ID NO: 354274 - RNA, 21 nt, Human
caggaggcagagguuacagug

SEQ ID NO: 354275 - RNA, 22 nt, Human
caggaggcagagguugcaauga

SEQ ID NO: 354276 - RNA, 22 nt, Human
caggaggcagagguugcagcga

SEQ ID NO: 354277 - RNA, 22 nt, Human
caggaggcagagguugcaguga

SEQ ID NO: 354278 - RNA, 23 nt, Human
caggaggcagagguugcagugag

SEQ ID NO: 354279 - RNA, 20 nt, Human
caggaggcagagguuggggu

SEQ ID NO: 354280 - RNA, 32 nt, Human
caggaggcagcccaggcggagcgggaggagcu

SEQ ID NO: 354281 - RNA, 20 nt, Human
caggaggcagccuugagaaa

SEQ ID NO: 354282 - RNA, 28 nt, Human
caggaggcaggugcugcccgucugcaac

SEQ ID NO: 354283 - RNA, 32 nt, Human
caggaggcaugugaguuuggauggggaggcaa

SEQ ID NO: 354284 - RNA, 32 nt, Human
caggaggccaagcagaggcuccccucaugaag

SEQ ID NO: 354285 - RNA, 20 nt, Human
caggaggccaccccugagaa

SEQ ID NO: 354286 - RNA, 21 nt, Human
caggaggccaccccugagaaa

SEQ ID NO: 354287 - RNA, 21 nt, Human
caggaggccagagcgguuuga

SEQ ID NO: 354288 - RNA, 32 nt, Human
caggaggccagagugagggguccguucugucc

SEQ ID NO: 354289 - RNA, 24 nt, Human
caggaggccaggggaaaaaccccu

SEQ ID NO: 354290 - RNA, 32 nt, Human
caggaggccccaggcugagagccagaugccuc

SEQ ID NO: 354291 - RNA, 32 nt, Human
caggaggccccagggaacggacagcccgaccu

SEQ ID NO: 354292 - RNA, 32 nt, Human
caggaggccccauuuccuacugcagcggggca

SEQ ID NO: 354293 - RNA, 32 nt, Human
caggaggccccugcugcucucaugcccgaaua

SEQ ID NO: 354294 - RNA, 21 nt, Human
caggaggcccguccucggggg

SEQ ID NO: 354295 - RNA, 18 nt, Human
caggaggcccugguguca

SEQ ID NO: 354296 - RNA, 23 nt, Human
caggaggccggauauucugagaa

SEQ ID NO: 354297 - RNA, 32 nt, Human
caggaggccgggagacagggacuggugagaau

SEQ ID NO: 354298 - RNA, 32 nt, Human
caggaggccucaccauacucccuuucagggcc

SEQ ID NO: 354299 - RNA, 22 nt, Human
caggaggcggaaguugcgguga

SEQ ID NO: 354300 - RNA, 32 nt, Human
caggaggcggagcuggcagugagcugagauca

SEQ ID NO: 354301 - RNA, 32 nt, Human
caggaggcggaggcagaggcugcagugaccca

SEQ ID NO: 354302 - RNA, 22 nt, Human
caggaggcggagguugcagcga

SEQ ID NO: 354303 - RNA, 22 nt, Human
caggaggcggagguugcaguga

SEQ ID NO: 354304 - RNA, 22 nt, Human
caggaggcggaguuugcaguga

SEQ ID NO: 354305 - RNA, 32 nt, Human
caggaggcggccgccuccgcccucucugcugc

SEQ ID NO: 354306 - RNA, 32 nt, Human
caggaggcgguuguguucgaggauguggcugu

SEQ ID NO: 354307 - RNA, 32 nt, Human
caggaggcucccucugcugacccccugcagcc

SEQ ID NO: 354308 - RNA, 32 nt, Human
caggaggcucugguccugcaggccuggucuug

SEQ ID NO: 354309 - RNA, 32 nt, Human
caggaggcugaaggaggggagaacaaaauugu

SEQ ID NO: 354310 - RNA, 32 nt, Human
caggaggcugagaaggaggaggggcucccuga

SEQ ID NO: 354311 - RNA, 32 nt, Human
caggaggcugaggcacgagaauuccaugaacc

SEQ ID NO: 354312 - RNA, 32 nt, Human
caggaggcugaggcaggagaagggugggaacc

SEQ ID NO: 354313 - RNA, 32 nt, Human
caggaggcugaggcaggagaauuacuuuaacc

SEQ ID NO: 354314 - RNA, 32 nt, Human
caggaggcugaggcaggagaauucuuuuaacc

SEQ ID NO: 354315 - RNA, 32 nt, Human
caggaggcugaggcaggagaauuguuugaacc

SEQ ID NO: 354316 - RNA, 22 nt, Human
caggaggcugaggcugcaguga

SEQ ID NO: 354317 - RNA, 32 nt, Human
caggaggcugaggcuggugugagggaaagggg

SEQ ID NO: 354318 - RNA, 32 nt, Human
caggaggcuggggagccccaggaagccaggga

SEQ ID NO: 354319 - RNA, 32 nt, Human
caggaggcuguggugggaggauugcuuaagcc

SEQ ID NO: 354320 - RNA, 32 nt, Human
caggaggcuguuccaggaguccugcccagcag

SEQ ID NO: 354321 - RNA, 32 nt, Human
caggagggaagaucaguggagccuucuuucug

SEQ ID NO: 354322 - RNA, 32 nt, Human
caggagggaaggcaggaagugggaccacgagg

SEQ ID NO: 354323 - RNA, 20 nt, Human
caggagggaagggugggcca

SEQ ID NO: 354324 - RNA, 24 nt, Human
caggagggaaugggccuggugcca

SEQ ID NO: 354325 - RNA, 32 nt, Human
caggagggacagugccuggagccugggccagg

SEQ ID NO: 354326 - RNA, 20 nt, Human
caggagggacccuugauaca

SEQ ID NO: 354327 - RNA, 32 nt, Human
caggagggagagaagaaaacuuccaguacccg

SEQ ID NO: 354328 - RNA, 32 nt, Human
caggagggagagaagagacgcagaaggagagc

SEQ ID NO: 354329 - RNA, 22 nt, Human
caggagggagagagaggcagug

SEQ ID NO: 354330 - RNA, 32 nt, Human
caggagggagagagguggacaggcagagucug

SEQ ID NO: 354331 - RNA, 19 nt, Human
caggagggagagauugagg

SEQ ID NO: 354332 - RNA, 32 nt, Human
caggagggagcuaggacauagcucgacuggcu

SEQ ID NO: 354333 - RNA, 32 nt, Human
caggagggagcuugaggacacuguggugagug

SEQ ID NO: 354334 - RNA, 32 nt, Human
caggagggaggcugcuguguggggaagcacag

SEQ ID NO: 354335 - RNA, 32 nt, Human
caggagggauaguggccugggagccagcucug

SEQ ID NO: 354336 - RNA, 32 nt, Human
caggagggcacggugggugagccauucucgcc

SEQ ID NO: 354337 - RNA, 32 nt, Human
caggagggcagcaccugcuggggacgguggcc

SEQ ID NO: 354338 - RNA, 32 nt, Human
caggagggcagccuccagcccugagugaccau

SEQ ID NO: 354339 - RNA, 32 nt, Human
caggagggcaggcugagguggggaaggaggga

SEQ ID NO: 354340 - RNA, 22 nt, Human
caggagggcauuggcagcagcu

SEQ ID NO: 354341 - RNA, 23 nt, Human
caggagggccgaggcgggccugg

SEQ ID NO: 354342 - RNA, 31 nt, Human
caggagggccuagaagggaaagacugugcgu

SEQ ID NO: 354343 - RNA, 32 nt, Human
caggagggccuccccuuccccucucccucaga

SEQ ID NO: 354344 - RNA, 18 nt, Human
caggagggccugauccca

SEQ ID NO: 354345 - RNA, 32 nt, Human
caggagggccugaucccaggagacaccagggc

SEQ ID NO: 354346 - RNA, 32 nt, Human
caggagggcuccaaggaguuugcaaaccuaga

SEQ ID NO: 354347 - RNA, 32 nt, Human
caggagggcugaaggcaggggccacucacagg

SEQ ID NO: 354348 - RNA, 18 nt, Human
caggagggcuggaugcca

SEQ ID NO: 354349 - RNA, 32 nt, Human
caggaggggagaagagaguaggaaaaaggagg

SEQ ID NO: 354350 - RNA, 32 nt, Human
caggaggggagcgggcccaggagccaggcuca

SEQ ID NO: 354351 - RNA, 23 nt, Human
caggaggggaugaggucagggua

SEQ ID NO: 354352 - RNA, 32 nt, Human
caggaggggccaggccucuaggaggacuggca

SEQ ID NO: 354353 - RNA, 32 nt, Human
caggaggggcccugcccaugcccacacuacag

SEQ ID NO: 354354 - RNA, 32 nt, Human
caggaggggccucuuguuucucagcccccgca

SEQ ID NO: 354355 - RNA, 18 nt, Human
caggaggggcucgaccca

SEQ ID NO: 354356 - RNA, 32 nt, Human
caggaggggcuguccaaucacauucaggcaug

SEQ ID NO: 354357 - RNA, 32 nt, Human
caggagggguccccagaccacccuggggcuga

SEQ ID NO: 354358 - RNA, 32 nt, Human
caggagggguggaggggccacccugggcuuug

SEQ ID NO: 354359 - RNA, 21 nt, Human
caggagggguggcugaaacca

SEQ ID NO: 354360 - RNA, 32 nt, Human
caggagggguggcugaaaccaccauccugggc

SEQ ID NO: 354361 - RNA, 20 nt, Human
caggagggucacuugaugcc

SEQ ID NO: 354362 - RNA, 21 nt, Human
caggaggguccugcugagccc

SEQ ID NO: 354363 - RNA, 24 nt, Human
caggaggguccuggggugggccag

SEQ ID NO: 354364 - RNA, 23 nt, Human
caggagggucucuccuccagccc

SEQ ID NO: 354365 - RNA, 32 nt, Human
caggagggugaugggagcucuccaauuuaguu

SEQ ID NO: 354366 - RNA, 19 nt, Human
caggagggugcuggcgcca

SEQ ID NO: 354367 - RNA, 32 nt, Human
caggagggugggaccaagggugcugcuggacc

SEQ ID NO: 354368 - RNA, 22 nt, Human
caggagguagagauugcaauga

SEQ ID NO: 354369 - RNA, 32 nt, Human
caggaggucagccuggccaauauggugaaacc

SEQ ID NO: 354370 - RNA, 32 nt, Human
caggaggucaggucaaggcugcagugagccau

SEQ ID NO: 354371 - RNA, 32 nt, Human
caggagguccuccucaaucucccaagcccaca

SEQ ID NO: 354372 - RNA, 24 nt, Human
caggaggucgaccccaaagccccu

SEQ ID NO: 354373 - RNA, 32 nt, Human
caggaggucgggaaaggcaguccugguagagg

SEQ ID NO: 354374 - RNA, 32 nt, Human
caggaggucuugagccacagagcuggcuccag

SEQ ID NO: 354375 - RNA, 20 nt, Human
caggaggucuugcccaggga

SEQ ID NO: 354376 - RNA, 32 nt, Human
caggaggucuuucugcuccaucguccccaagg

SEQ ID NO: 354377 - RNA, 22 nt, Human
caggaggugacugggaaggaga

SEQ ID NO: 354378 - RNA, 32 nt, Human
caggaggugaggagguuucgacauggcggugc

SEQ ID NO: 354379 - RNA, 21 nt, Human
caggagguggacacccagcca

SEQ ID NO: 354380 - RNA, 21 nt, Human
caggagguggagguuacagug

SEQ ID NO: 354381 - RNA, 22 nt, Human
caggagguggagguugcaguga

SEQ ID NO: 354382 - RNA, 32 nt, Human
caggaggugggcucagggcucuccagagcacu

SEQ ID NO: 354383 - RNA, 31 nt, Human
caggaggugguggaaacggggugaacuccgu

SEQ ID NO: 354384 - RNA, 32 nt, Human
caggagguggugucaagagaggccauggccug

SEQ ID NO: 354385 - RNA, 22 nt, Human
caggagguugaggcugcaguga

SEQ ID NO: 354386 - RNA, 32 nt, Human
caggaguaauuaaguauuacugcccagaagag

SEQ ID NO: 354387 - RNA, 32 nt, Human
caggaguacugcagggacagccccagagaggc

SEQ ID NO: 354388 - RNA, 32 nt, Human
caggaguagcuguauuugagguuuccuucacu

SEQ ID NO: 354389 - RNA, 32 nt, Human
caggaguagggaggacaucgacgaugugcccg

SEQ ID NO: 354390 - RNA, 32 nt, Human
caggagucagaggcuggagugcaauggcguga

SEQ ID NO: 354391 - RNA, 32 nt, Human
caggagucagccaccaagugucuccacaucgg

SEQ ID NO: 354392 - RNA, 32 nt, Human
caggaguccaaccugggcaacauggugaaacc

SEQ ID NO: 354393 - RNA, 32 nt, Human
caggaguccagcccagcacccaucugagucca

SEQ ID NO: 354394 - RNA, 32 nt, Human
caggaguccagccguccagccucgggguguag

SEQ ID NO: 354395 - RNA, 32 nt, Human
caggaguccagccugggcaaaauagcgagaga

SEQ ID NO: 354396 - RNA, 32 nt, Human
caggaguccagcggagaagggaagaggaggug

SEQ ID NO: 354397 - RNA, 21 nt, Human
caggagucccaucaccaggga

SEQ ID NO: 354398 - RNA, 32 nt, Human
caggaguccgagcccugcuccuugugggcgcu

SEQ ID NO: 354399 - RNA, 32 nt, Human
caggagucuacacugcagccucaggcacugug

SEQ ID NO: 354400 - RNA, 23 nt, Human
caggagucuccuccucacccgca

SEQ ID NO: 354401 - RNA, 32 nt, Human
caggagucugagacaagccuaggcaacaaaac

SEQ ID NO: 354402 - RNA, 32 nt, Human
caggagucugcacucuucagucuuugcaggca

SEQ ID NO: 354403 - RNA, 32 nt, Human
caggagucugccaggagccaggagcgccuaca

SEQ ID NO: 354404 - RNA, 25 nt, Human
caggagucugggaccccuccuggga

SEQ ID NO: 354405 - RNA, 32 nt, Human
caggagucuugagaccagccugggcaacaggc

SEQ ID NO: 354406 - RNA, 32 nt, Human
caggagucuugccauguugcccaggcugaucu

SEQ ID NO: 354407 - RNA, 32 nt, Human
caggagucuuugucccugcucagcccggaggc

SEQ ID NO: 354408 - RNA, 32 nt, Human
caggagugaacaggaacaggaaaacaaauggc

SEQ ID NO: 354409 - RNA, 32 nt, Human
caggagugaacccagaggcacguaugaaugaa

SEQ ID NO: 354410 - RNA, 32 nt, Human
caggagugaccaggacacuaccuccuagaagu

SEQ ID NO: 354411 - RNA, 32 nt, Human
caggagugagccaccacaccuggccacucgca

SEQ ID NO: 354412 - RNA, 32 nt, Human
caggagugagccaccgugcccggccuaaguag

SEQ ID NO: 354413 - RNA, 32 nt, Human
caggagugagccacugcgcccugccuggaacu

SEQ ID NO: 354414 - RNA, 19 nt, Human
caggagugagggcugggga

SEQ ID NO: 354415 - RNA, 32 nt, Human
caggagugcaagaccauccagggcaacauaac

SEQ ID NO: 354416 - RNA, 32 nt, Human
caggagugcuacucugugauaggcugcacuca

SEQ ID NO: 354417 - RNA, 18 nt, Human
caggagugggaguuggag

SEQ ID NO: 354418 - RNA, 32 nt, Human
caggagugggucuggucucaucagggagggca

SEQ ID NO: 354419 - RNA, 32 nt, Human
caggagugggugaggauggcagagggacacag

SEQ ID NO: 354420 - RNA, 31 nt, Human
caggaguggguggagaguggagugugcuggg

SEQ ID NO: 354421 - RNA, 32 nt, Human
caggagugggugggacacagagacccccgugc

SEQ ID NO: 354422 - RNA, 31 nt, Human
caggaguggguggggagugggggugggggua

SEQ ID NO: 354423 - RNA, 32 nt, Human
caggaguggucagaccuagaacaagagcccuu

SEQ ID NO: 354424 - RNA, 29 nt, Human
caggagugguggugugugccugugguccc

SEQ ID NO: 354425 - RNA, 32 nt, Human
caggaguuaagaccagccugggcaacauggca

SEQ ID NO: 354426 - RNA, 32 nt, Human
caggaguuaagggcuugggucugggguuuaag

SEQ ID NO: 354427 - RNA, 31 nt, Human
caggaguuauaucagcacccucaguccuauc

SEQ ID NO: 354428 - RNA, 32 nt, Human
caggaguucaaaaccaaccuggucuacauggu

SEQ ID NO: 354429 - RNA, 20 nt, Human
caggaguucaacaccagccu

SEQ ID NO: 354430 - RNA, 32 nt, Human
caggaguucaacuggccaacacagugaggcuu

SEQ ID NO: 354431 - RNA, 32 nt, Human
caggaguucaagaccagcugaccaacacggug

SEQ ID NO: 354432 - RNA, 22 nt, Human
caggaguucaaggcugcagaga

SEQ ID NO: 354433 - RNA, 22 nt, Human
caggaguucaaggcuucaguga

SEQ ID NO: 354434 - RNA, 31 nt, Human
caggaguucaauaaaugucuguugaugacug

SEQ ID NO: 354435 - RNA, 22 nt, Human
caggaguucccaccucaugggg

SEQ ID NO: 354436 - RNA, 32 nt, Human
caggaguucgaaccagccuggccaacauggug

SEQ ID NO: 354437 - RNA, 32 nt, Human
caggaguucgagaccaaccgaccaacauggug

SEQ ID NO: 354438 - RNA, 32 nt, Human
caggaguucgagccagccugaccaacaugaug

SEQ ID NO: 354439 - RNA, 32 nt, Human
caggaguugagaccagccuggccaacauggug

SEQ ID NO: 354440 - RNA, 32 nt, Human
caggaguugcguguguuuuucuuaauugaaag

SEQ ID NO: 354441 - RNA, 22 nt, Human
caggaguuggaggauacaguga

SEQ ID NO: 354442 - RNA, 20 nt, Human
caggaguuggaggcugcagu

SEQ ID NO: 354443 - RNA, 32 nt, Human
caggaguuggaggcugcaguaagccaugauua

SEQ ID NO: 354444 - RNA, 32 nt, Human
caggaguuggcuuugugaaacugaggcaggau

SEQ ID NO: 354445 - RNA, 32 nt, Human
caggaguugugagcccucuagggcaggguggg

SEQ ID NO: 354446 - RNA, 32 nt, Human
caggaguuugagaccagccuagacaacauggu

SEQ ID NO: 354447 - RNA, 32 nt, Human
caggaguuugagaccagccuagccaacaugcu

SEQ ID NO: 354448 - RNA, 32 nt, Human
caggaguuugagaccagccuagccaacauggu

SEQ ID NO: 354449 - RNA, 32 nt, Human
caggaguuugagaccagccuaggcaacacagu

SEQ ID NO: 354450 - RNA, 32 nt, Human
caggaguuugagaccagccuaggcaacauagc

SEQ ID NO: 354451 - RNA, 32 nt, Human
caggaguuugagaccagccuagucaacaugag

SEQ ID NO: 354452 - RNA, 32 nt, Human
caggaguuugagaccaggcuaggcaacauggc

SEQ ID NO: 354453 - RNA, 32 nt, Human
caggaguuugagacuagccuaggcaacacagu

SEQ ID NO: 354454 - RNA, 32 nt, Human
caggaguuugagccagccuggccaacauggug

SEQ ID NO: 354455 - RNA, 32 nt, Human
caggaguuugaggaugcagugagcuaugguca

SEQ ID NO: 354456 - RNA, 32 nt, Human
caggaguuugaggccagcuagagugacauagc

SEQ ID NO: 354457 - RNA, 32 nt, Human
caggaguuugcaggccagacugcaguggccug

SEQ ID NO: 354458 - RNA, 32 nt, Human
caggaguuuggaccagccugggcaacauaaga

SEQ ID NO: 354459 - RNA, 32 nt, Human
caggaguuuggaccagccugggcaacauggug

SEQ ID NO: 354460 - RNA, 32 nt, Human
caggaguuuuauguguuuaauagaugaauuua

SEQ ID NO: 354461 - RNA, 32 nt, Human
caggaguuuugagaccagccugggcaacauca

SEQ ID NO: 354462 - RNA, 32 nt, Human
caggauaaaucagccuuugugauguacugugu

SEQ ID NO: 354463 - RNA, 32 nt, Human
caggauaacaucacgagugcccggcugcugca

SEQ ID NO: 354464 - RNA, 32 nt, Human
caggauaagauguucaucaccgggaaccaaau

SEQ ID NO: 354465 - RNA, 32 nt, Human
caggauaagccucaggcccugggaaaccuccc

SEQ ID NO: 354466 - RNA, 32 nt, Human
caggauaaguagaagagugucugagcugugag

SEQ ID NO: 354467 - RNA, 22 nt, Human
caggauaaucuauucucuagcu

SEQ ID NO: 354468 - RNA, 32 nt, Human
caggauacaugcuggcgcugaagugcaggcag

SEQ ID NO: 354469 - RNA, 32 nt, Human
caggauaccacucugucacugugugacccuca

SEQ ID NO: 354470 - RNA, 32 nt, Human
caggauacuuuguggaaaguguuaaauaaagu

SEQ ID NO: 354471 - RNA, 32 nt, Human
caggauagaaggagguuucugaggcugacaga

SEQ ID NO: 354472 - RNA, 32 nt, Human
caggauagaauauucuggacuuaaacauuacu

SEQ ID NO: 354473 - RNA, 32 nt, Human
caggauagacucguuuaaaaacaaguauauua

SEQ ID NO: 354474 - RNA, 32 nt, Human
caggauagauguagccuauagaugugucauuu

SEQ ID NO: 354475 - RNA, 32 nt, Human
caggauagcccuuccuccucugggggccuggg

SEQ ID NO: 354476 - RNA, 32 nt, Human
caggauaggaauaggccaagugcugagaagau

SEQ ID NO: 354477 - RNA, 32 nt, Human
caggauaguugcacugagcacugugaggcccc

SEQ ID NO: 354478 - RNA, 32 nt, Human
caggauaucacagagaaggcaaguuugaauuc

SEQ ID NO: 354479 - RNA, 32 nt, Human
caggauauuguugaagccuccuggaauguuug

SEQ ID NO: 354480 - RNA, 28 nt, Human
caggaucaauguggugccucauccaggg

SEQ ID NO: 354481 - RNA, 32 nt, Human
caggaucacaccaggccgcgccuggccugcuu

SEQ ID NO: 354482 - RNA, 32 nt, Human
caggaucacaccauugcuguccagccugggug

SEQ ID NO: 354483 - RNA, 31 nt, Human
caggaucacagcuuacugcagccuugaccuc

SEQ ID NO: 354484 - RNA, 19 nt, Human
caggaucacauugcaaagc

SEQ ID NO: 354485 - RNA, 32 nt, Human
caggaucaccccaggucugucucauugcauau

SEQ ID NO: 354486 - RNA, 32 nt, Human
caggaucagaaaacaggaagguccaugcccag

SEQ ID NO: 354487 - RNA, 32 nt, Human
caggaucagaaagaagaaggagucaaagagug

SEQ ID NO: 354488 - RNA, 32 nt, Human
caggaucagacccagaggcagcugguuggggu

SEQ ID NO: 354489 - RNA, 32 nt, Human
caggaucagcagagcaggcaggcagaguggag

SEQ ID NO: 354490 - RNA, 32 nt, Human
caggaucaucaaaaugucauuaggcaguauaa

SEQ ID NO: 354491 - RNA, 32 nt, Human
caggaucaugccacugcacuccagcuugggcg

SEQ ID NO: 354492 - RNA, 32 nt, Human
caggaucauuucucuuucuucagggccagaca

SEQ ID NO: 354493 - RNA, 32 nt, Human
caggauccaaguuuaaaaagaaaugguguaaa

SEQ ID NO: 354494 - RNA, 32 nt, Human
caggauccaugggagcauucucaaaggcuuua

SEQ ID NO: 354495 - RNA, 32 nt, Human
caggauccugaagcccaugcaggcucugaacc

SEQ ID NO: 354496 - RNA, 32 nt, Human
caggauccuguuucuaaagaaacccaugcugu

SEQ ID NO: 354497 - RNA, 32 nt, Human
caggauccuuuggauuaauccucugccaccuc

SEQ ID NO: 354498 - RNA, 32 nt, Human
caggauccuuuucuaaauugaauguacuuuug

SEQ ID NO: 354499 - RNA, 32 nt, Human
caggaucgcgccauugcacuccagccugggca

SEQ ID NO: 354500 - RNA, 32 nt, Human
caggaucgcuugagcccaggaggucagggcug

SEQ ID NO: 354501 - RNA, 32 nt, Human
caggaucuaguuucuuucucucuacucuggcu

SEQ ID NO: 354502 - RNA, 32 nt, Human
caggaucucagcauugcacaaugccucaugga

SEQ ID NO: 354503 - RNA, 32 nt, Human
caggaucucaggcuggagugcaguggcacaau

SEQ ID NO: 354504 - RNA, 25 nt, Human
caggaucuccacagaccucggccuc

SEQ ID NO: 354505 - RNA, 32 nt, Human
caggaucuccccaagguggcagaaggaggccu

SEQ ID NO: 354506 - RNA, 32 nt, Human
caggaucucccccuucccagucgugacaacca

SEQ ID NO: 354507 - RNA, 18 nt, Human
caggaucucgcucuguca

SEQ ID NO: 354508 - RNA, 32 nt, Human
caggaucugacccgggaggaggccgcacccgc

SEQ ID NO: 354509 - RNA, 32 nt, Human
caggaucugcuucccuucucuccaggaccugc

SEQ ID NO: 354510 - RNA, 32 nt, Human
caggaucuggaaaaccucugcagccaccaaca

SEQ ID NO: 354511 - RNA, 32 nt, Human
caggaucugugucaaaagagcuucucuccaga

SEQ ID NO: 354512 - RNA, 32 nt, Human
caggaucuuccagcaccccaugccuggcccug

SEQ ID NO: 354513 - RNA, 32 nt, Human
caggaucuucugccuccgccagccugugagcu

SEQ ID NO: 354514 - RNA, 32 nt, Human
caggaucuugcucucuugcccagacuggaaua

SEQ ID NO: 354515 - RNA, 32 nt, Human
caggaugaaaauaaggaggaguugucagacaa

SEQ ID NO: 354516 - RNA, 32 nt, Human
caggaugaaagcccaagucaucaggguggcac

SEQ ID NO: 354517 - RNA, 32 nt, Human
caggaugaaaugaaguuugaggugagaagcau

SEQ ID NO: 354518 - RNA, 29 nt, Human
caggaugaacccuccuucggggccaagag

SEQ ID NO: 354519 - RNA, 27 nt, Human
caggaugaagaacaggcauugcaagga

SEQ ID NO: 354520 - RNA, 32 nt, Human
caggaugaagacaugagagaaaguuucaagau

SEQ ID NO: 354521 - RNA, 32 nt, Human
caggaugaagcgugagaucaccacgcugguga

SEQ ID NO: 354522 - RNA, 32 nt, Human
caggaugaaggagccagucgaagauccuguuc

SEQ ID NO: 354523 - RNA, 29 nt, Human
caggaugaccaccacccucgugucugcca

SEQ ID NO: 354524 - RNA, 32 nt, Human
caggaugacggucccugagcugcggaaauccc

SEQ ID NO: 354525 - RNA, 32 nt, Human
caggaugagagaaggggaaccagaagcuccgg

SEQ ID NO: 354526 - RNA, 32 nt, Human
caggaugagcacugcagugucgugacccuugg

SEQ ID NO: 354527 - RNA, 19 nt, Human
caggaugagccuccagcuc

SEQ ID NO: 354528 - RNA, 32 nt, Human
caggaugaggaagagaagaaaugaggagccug

SEQ ID NO: 354529 - RNA, 32 nt, Human
caggaugaggauguuguguggauagauuacua

SEQ ID NO: 354530 - RNA, 29 nt, Human
caggaugaggcgugcaggccugggugaag

SEQ ID NO: 354531 - RNA, 29 nt, Human
caggaugaggcugcuguguggccuguggc

SEQ ID NO: 354532 - RNA, 31 nt, Human
caggaugagggaaaagaaaaagauugagaga

SEQ ID NO: 354533 - RNA, 32 nt, Human
caggaugaggggcagaggaaacacuuuccacc

SEQ ID NO: 354534 - RNA, 32 nt, Human
caggaugaugauaaagccagaggcucuucaga

SEQ ID NO: 354535 - RNA, 21 nt, Human
caggaugauggcacugagaaa

SEQ ID NO: 354536 - RNA, 18 nt, Human
caggaugaugggcugcca

SEQ ID NO: 354537 - RNA, 22 nt, Human
caggaugauuacaugggccagg

SEQ ID NO: 354538 - RNA, 29 nt, Human
caggaugccaucaacuaacagagcaggca

SEQ ID NO: 354539 - RNA, 32 nt, Human
caggaugccguugguggcauuuacgugcuuua

SEQ ID NO: 354540 - RNA, 31 nt, Human
caggaugccuccugcugcccuguguccaucc

SEQ ID NO: 354541 - RNA, 32 nt, Human
caggaugccucucucacacuuguauucucgac

SEQ ID NO: 354542 - RNA, 32 nt, Human
caggaugccugggucucuucccguaacugucu

SEQ ID NO: 354543 - RNA, 32 nt, Human
caggaugcugggacugugcaaggagguaggac

SEQ ID NO: 354544 - RNA, 32 nt, Human
caggaugcuguugcuguaggacgccugcugcc

SEQ ID NO: 354545 - RNA, 29 nt, Human
caggaugcuuguucucuuucuccugggca

SEQ ID NO: 354546 - RNA, 32 nt, Human
caggauggaaacagucaggcacugacuggggu

SEQ ID NO: 354547 - RNA, 32 nt, Human
caggauggagaugagagagggugagagaugga

SEQ ID NO: 354548 - RNA, 29 nt, Human
caggauggagcggggcgcaggagccaagc

SEQ ID NO: 354549 - RNA, 22 nt, Human
caggauggagggaccacaggga

SEQ ID NO: 354550 - RNA, 32 nt, Human
caggauggagggcugcagaacuggcucaggaa

SEQ ID NO: 354551 - RNA, 32 nt, Human
caggauggagugaagaccuggagaggaggggc

SEQ ID NO: 354552 - RNA, 32 nt, Human
caggauggaguuucgcucugucgccaggcugg

SEQ ID NO: 354553 - RNA, 32 nt, Human
caggauggcagagagccagggcagagagagac

SEQ ID NO: 354554 - RNA, 32 nt, Human
caggauggcaggccgggcugggcucagccaag

SEQ ID NO: 354555 - RNA, 32 nt, Human
caggauggcaggggccucaucuguccuguucc

SEQ ID NO: 354556 - RNA, 32 nt, Human
caggauggcaggggccucaucugucuuguucc

SEQ ID NO: 354557 - RNA, 32 nt, Human
caggauggcccagucccuggcuccacugauca

SEQ ID NO: 354558 - RNA, 32 nt, Human
caggauggccucaagugcccagcccuccugga

SEQ ID NO: 354559 - RNA, 32 nt, Human
caggauggccuccaccuccugacuucaugauc

SEQ ID NO: 354560 - RNA, 32 nt, Human
caggauggcugcagugccagccuggggcagca

SEQ ID NO: 354561 - RNA, 19 nt, Human
caggaugggagcugcugaa

SEQ ID NO: 354562 - RNA, 32 nt, Human
caggaugggagcuuccugcugaucaucgagug

SEQ ID NO: 354563 - RNA, 32 nt, Human
caggaugggcaggagagcagagccgcggaguc

SEQ ID NO: 354564 - RNA, 32 nt, Human
caggaugggcagugauggagaaucacuguuga

SEQ ID NO: 354565 - RNA, 32 nt, Human
caggaugggcugcagguugcagucagggcuug

SEQ ID NO: 354566 - RNA, 32 nt, Human
caggauggggaugggaaagaaggugugcguuc

SEQ ID NO: 354567 - RNA, 25 nt, Human
caggauggggccguggugggccagg

SEQ ID NO: 354568 - RNA, 32 nt, Human
caggaugggguaggccuugugcucugagcaac

SEQ ID NO: 354569 - RNA, 29 nt, Human
caggaugggguuuguuaaaguuguuaaga

SEQ ID NO: 354570 - RNA, 32 nt, Human
caggauggguguguucauggguaaccaccccc

SEQ ID NO: 354571 - RNA, 32 nt, Human
caggauggucucaaacuccugaccucgugauc

SEQ ID NO: 354572 - RNA, 32 nt, Human
caggauggucucaaacuuguaaccucaaguga

SEQ ID NO: 354573 - RNA, 32 nt, Human
caggauggucucaauauccugaguucaugauc

SEQ ID NO: 354574 - RNA, 32 nt, Human
caggauggucucaaucuccuaaccuugagauc

SEQ ID NO: 354575 - RNA, 32 nt, Human
caggauggucucaaucuccugaccucauauuc

SEQ ID NO: 354576 - RNA, 32 nt, Human
caggauggucucaaucuccugaccucaugauc

SEQ ID NO: 354577 - RNA, 32 nt, Human
caggauggucucaaucuccugaccucgugauc

SEQ ID NO: 354578 - RNA, 32 nt, Human
caggauggucucaaucuccugacuucaugauc

SEQ ID NO: 354579 - RNA, 32 nt, Human
caggauggucucaaucucuugaccucauuauc

SEQ ID NO: 354580 - RNA, 32 nt, Human
caggauggucuugaucuccugaucucaugauc

SEQ ID NO: 354581 - RNA, 32 nt, Human
caggauggugucugugcacgugacuauuagag

SEQ ID NO: 354582 - RNA, 32 nt, Human
caggauggugugguagagggucccaggagggc

SEQ ID NO: 354583 - RNA, 32 nt, Human
caggaugguuccuucuggaaugucuauucccc

SEQ ID NO: 354584 - RNA, 32 nt, Human
caggaugucacuucuaaguuuaggcuauaaac

SEQ ID NO: 354585 - RNA, 32 nt, Human
caggaugucauuuucaaaaugcgggaugguac

SEQ ID NO: 354586 - RNA, 32 nt, Human
caggauguccccaaauuaagauacuacagauu

SEQ ID NO: 354587 - RNA, 32 nt, Human
caggauguccugcugcuggggucugggcagcg

SEQ ID NO: 354588 - RNA, 29 nt, Human
caggaugucgaugacagacuugcugaacg

SEQ ID NO: 354589 - RNA, 32 nt, Human
caggaugucuucacgcugagccccagccccca

SEQ ID NO: 354590 - RNA, 32 nt, Human
caggaugugagggcccgcaggagccgagucag

SEQ ID NO: 354591 - RNA, 32 nt, Human
caggauguggcacaugacagugccugaagggc

SEQ ID NO: 354592 - RNA, 32 nt, Human
caggauguguucagcauaucugugccacacag

SEQ ID NO: 354593 - RNA, 32 nt, Human
caggauguuccuucguuguuuccaugaguauu

SEQ ID NO: 354594 - RNA, 22 nt, Human
caggauguugcugccugcagaa

SEQ ID NO: 354595 - RNA, 20 nt, Human
caggauguuuguugccagaa

SEQ ID NO: 354596 - RNA, 31 nt, Human
caggauuacaaaggaaucaggauuuagccuc

SEQ ID NO: 354597 - RNA, 32 nt, Human
caggauuagacagucaaggaguggcuuacuac

SEQ ID NO: 354598 - RNA, 32 nt, Human
caggauuauaguuaacacugaaugaaggccuu

SEQ ID NO: 354599 - RNA, 32 nt, Human
caggauucaaaaccagccuggccaacauagug

SEQ ID NO: 354600 - RNA, 32 nt, Human
caggauucaagcaguucuccugccucagucuc

SEQ ID NO: 354601 - RNA, 25 nt, Human
caggauucaagcgauuccccugccu

SEQ ID NO: 354602 - RNA, 32 nt, Human
caggauucacauagaagaaaguuacauuacac

SEQ ID NO: 354603 - RNA, 32 nt, Human
caggauuccaauaauuaagaauacuucauaca

SEQ ID NO: 354604 - RNA, 32 nt, Human
caggauuccacagcccaaauggcgggacaguc

SEQ ID NO: 354605 - RNA, 32 nt, Human
caggauuccacagcccaaauggcgggacaguu

SEQ ID NO: 354606 - RNA, 19 nt, Human
caggauuccuuacuauuga

SEQ ID NO: 354607 - RNA, 32 nt, Human
caggauuccuuuccucaccauucuccuaugug

SEQ ID NO: 354608 - RNA, 32 nt, Human
caggauucuagguggagguugugcauguuguc

SEQ ID NO: 354609 - RNA, 32 nt, Human
caggauucugcagcuccuuuugugccaagccc

SEQ ID NO: 354610 - RNA, 32 nt, Human
caggauucuggcccagggcgccuccucccgac

SEQ ID NO: 354611 - RNA, 32 nt, Human
caggauucugggaggcuucaguuaccgcuggc

SEQ ID NO: 354612 - RNA, 32 nt, Human
caggauucuggguuuggaacucuagaaucaau

SEQ ID NO: 354613 - RNA, 32 nt, Human
caggauucuuucuccccacccguggcucugca

SEQ ID NO: 354614 - RNA, 32 nt, Human
caggauugagcugcgggguagcucccacagaa

SEQ ID NO: 354615 - RNA, 32 nt, Human
caggauugccacuccuguuucagaggaagcag

SEQ ID NO: 354616 - RNA, 32 nt, Human
caggauugcgccaccacacuccagccugggca

SEQ ID NO: 354617 - RNA, 32 nt, Human
caggauugcgccacugcaccccagcccgggug

SEQ ID NO: 354618 - RNA, 32 nt, Human
caggauugcuugagcccaggaguuugagccuu

SEQ ID NO: 354619 - RNA, 32 nt, Human
caggauuguaaguuuccugaggccuccccagu

SEQ ID NO: 354620 - RNA, 32 nt, Human
caggauugugccacuacacuccagccuggccg

SEQ ID NO: 354621 - RNA, 32 nt, Human
caggauugugccacugcacucaagccugggug

SEQ ID NO: 354622 - RNA, 32 nt, Human
caggauugugccauugcacuccagccugggca

SEQ ID NO: 354623 - RNA, 32 nt, Human
caggauuuacaaaggaucugggagcuguccag

SEQ ID NO: 354624 - RNA, 32 nt, Human
caggauuuauaaagcaaauuacuccaagguuu

SEQ ID NO: 354625 - RNA, 32 nt, Human
caggauuucauuuugcccugucuucacauuuc

SEQ ID NO: 354626 - RNA, 32 nt, Human
caggauuucugguggaagagacaggaaggccu

SEQ ID NO: 354627 - RNA, 24 nt, Human
caggauuugacucugggcaugaaa

SEQ ID NO: 354628 - RNA, 32 nt, Human
caggauuugaggaggagaagggaggagguggg

SEQ ID NO: 354629 - RNA, 32 nt, Human
caggauuuggagaaguggagagaaggucugau

SEQ ID NO: 354630 - RNA, 32 nt, Human
caggcaaaaagcaggcuaggugaccuugggac

SEQ ID NO: 354631 - RNA, 32 nt, Human
caggcaaagaggagaaaggagcauguaaggug

SEQ ID NO: 354632 - RNA, 32 nt, Human
caggcaaaggaggaggcacagauggaggugga

SEQ ID NO: 354633 - RNA, 32 nt, Human
caggcaaauguucauuucuccugguaccugua

SEQ ID NO: 354634 - RNA, 19 nt, Human
caggcaaauucagaugcug

SEQ ID NO: 354635 - RNA, 32 nt, Human
caggcaaauuugaaaauauacacauugagaau

SEQ ID NO: 354636 - RNA, 32 nt, Human
caggcaacacagcaagaccccaucucuauaaa

SEQ ID NO: 354637 - RNA, 32 nt, Human
caggcaacagggugaccagcuguccugguuuc

SEQ ID NO: 354638 - RNA, 32 nt, Human
caggcaacauagccuggaaaccugacuuuuaa

SEQ ID NO: 354639 - RNA, 32 nt, Human
caggcaacauggcaaaaccccgucucuacaaa

SEQ ID NO: 354640 - RNA, 32 nt, Human
caggcaacauggugaaaccccaucucuacaaa

SEQ ID NO: 354641 - RNA, 32 nt, Human
caggcaacucacugucuggcagucccagccuc

SEQ ID NO: 354642 - RNA, 27 nt, Human
caggcaacuucugcuagaacucuagcu

SEQ ID NO: 354643 - RNA, 32 nt, Human
caggcaagacauggucucuucucaggugaaug

SEQ ID NO: 354644 - RNA, 17 nt, Human
caggcaagaccaaucaa

SEQ ID NO: 354645 - RNA, 32 nt, Human
caggcaagacuugcuucagccccagguguggu

SEQ ID NO: 354646 - RNA, 24 nt, Human
caggcaagcaaaagauuguccccu

SEQ ID NO: 354647 - RNA, 21 nt, Human
caggcaagcagacagcucccc

SEQ ID NO: 354648 - RNA, 18 nt, Human
caggcaagcagcaccucc

SEQ ID NO: 354649 - RNA, 32 nt, Human
caggcaagcagccugcaccacccugccacugg

SEQ ID NO: 354650 - RNA, 32 nt, Human
caggcaagcccuucuuccuccagccugaguuc

SEQ ID NO: 354651 - RNA, 32 nt, Human
caggcaagcugcacacaucaagcgaaacgccu

SEQ ID NO: 354652 - RNA, 32 nt, Human
caggcaaggaagcacaagcugaucaagaugug

SEQ ID NO: 354653 - RNA, 32 nt, Human
caggcaaggagagcaggagccagcgugagacu

SEQ ID NO: 354654 - RNA, 32 nt, Human
caggcaaggaggaggagucagaugaggcccug

SEQ ID NO: 354655 - RNA, 32 nt, Human
caggcaaggauuccggagagaggaucaggugu

SEQ ID NO: 354656 - RNA, 32 nt, Human
caggcaaggcagcaggcaaggagcagagaugg

SEQ ID NO: 354657 - RNA, 32 nt, Human
caggcaaggcccugaaggcugaaggagaaaug

SEQ ID NO: 354658 - RNA, 32 nt, Human
caggcaaucaaagguaacaaacguucauugca

SEQ ID NO: 354659 - RNA, 32 nt, Human
caggcaaucuucagcggugauccagaggagau

SEQ ID NO: 354660 - RNA, 32 nt, Human
caggcaauggguggaaaucaggggaacguuuc

SEQ ID NO: 354661 - RNA, 32 nt, Human
caggcaauucuccugccccagccuccugauua

SEQ ID NO: 354662 - RNA, 32 nt, Human
caggcaauuucaccaccaaaugccaagaaaag

SEQ ID NO: 354663 - RNA, 32 nt, Human
caggcacaaccuaggauccuuugcuaccaguu

SEQ ID NO: 354664 - RNA, 32 nt, Human
caggcacaagccaccaugccuggcuaaaauuc

SEQ ID NO: 354665 - RNA, 32 nt, Human
caggcacacacauguaugcacacacacaugca

SEQ ID NO: 354666 - RNA, 32 nt, Human
caggcacacacauuuuucuacccuucuucuga

SEQ ID NO: 354667 - RNA, 32 nt, Human
caggcacacagcaaagggacugaacugacccc

SEQ ID NO: 354668 - RNA, 32 nt, Human
caggcacacaugcaugcacacauacacaugca

SEQ ID NO: 354669 - RNA, 21 nt, Human
caggcacacgcaccugcucuc

SEQ ID NO: 354670 - RNA, 32 nt, Human
caggcacacgccaccacacccaacuaauuuuu

SEQ ID NO: 354671 - RNA, 32 nt, Human
caggcacacuccucaucaauucucaggcugca

SEQ ID NO: 354672 - RNA, 32 nt, Human
caggcacacuucugagguacgguaucucucuc

SEQ ID NO: 354673 - RNA, 32 nt, Human
caggcacacuuggggccuugagcuccagggag

SEQ ID NO: 354674 - RNA, 21 nt, Human
caggcacagaccagggcucca

SEQ ID NO: 354675 - RNA, 32 nt, Human
caggcacagacccugauaguggguuuggguca

SEQ ID NO: 354676 - RNA, 32 nt, Human
caggcacagagcaaagggcugagagaagggag

SEQ ID NO: 354677 - RNA, 32 nt, Human
caggcacagaugagagacagaggcagagaagu

SEQ ID NO: 354678 - RNA, 32 nt, Human
caggcacagauggggccuugaaacgcuuuguc

SEQ ID NO: 354679 - RNA, 32 nt, Human
caggcacagauuuggagcuggugacaguucug

SEQ ID NO: 354680 - RNA, 32 nt, Human
caggcacagcaccuccagaacagugccccgga

SEQ ID NO: 354681 - RNA, 32 nt, Human
caggcacagcagaggugagagugggaggaggg

SEQ ID NO: 354682 - RNA, 32 nt, Human
caggcacaggcagaagagacauuagagcuuug

SEQ ID NO: 354683 - RNA, 32 nt, Human
caggcacaggcagugaggccgaggccaauagc

SEQ ID NO: 354684 - RNA, 21 nt, Human
caggcacagguccccagauga

SEQ ID NO: 354685 - RNA, 21 nt, Human
caggcacagucgcaaccuggc

SEQ ID NO: 354686 - RNA, 32 nt, Human
caggcacagugacugcagcucacguccagcca

SEQ ID NO: 354687 - RNA, 32 nt, Human
caggcacaguggggguggugaggaccugauag

SEQ ID NO: 354688 - RNA, 32 nt, Human
caggcacaucuguccuacagcuggcagagaca

SEQ ID NO: 354689 - RNA, 32 nt, Human
caggcacaucuugcuccagacucuccagcacc

SEQ ID NO: 354690 - RNA, 32 nt, Human
caggcacaugccaccauacgcagcuaauuugu

SEQ ID NO: 354691 - RNA, 32 nt, Human
caggcacaugccacuacacccagcuaacuuuu

SEQ ID NO: 354692 - RNA, 32 nt, Human
caggcacauguagcuacucaggaggcugagac

SEQ ID NO: 354693 - RNA, 32 nt, Human
caggcaccaacagugagcccacgaggaugguc

SEQ ID NO: 354694 - RNA, 32 nt, Human
caggcaccaagaggcggggguggagcagggag

SEQ ID NO: 354695 - RNA, 32 nt, Human
caggcaccaccacaccuggcuuuagaguucac

SEQ ID NO: 354696 - RNA, 32 nt, Human
caggcaccagccaccaugccuggcuaauuuuu

SEQ ID NO: 354697 - RNA, 32 nt, Human
caggcaccaggacuagggcuggagugaggggg

SEQ ID NO: 354698 - RNA, 32 nt, Human
caggcaccagugccaccuaccaagcugugaaa

SEQ ID NO: 354699 - RNA, 32 nt, Human
caggcaccagugccgcugcgcgggagcuaggg

SEQ ID NO: 354700 - RNA, 18 nt, Human
caggcacccaccaccacg

SEQ ID NO: 354701 - RNA, 32 nt, Human
caggcacccacgcccucuccacccucugauuc

SEQ ID NO: 354702 - RNA, 32 nt, Human
caggcacccacugacuccagccucauggaacc

SEQ ID NO: 354703 - RNA, 32 nt, Human
caggcacccagcuuugucuguggguuaguauu

SEQ ID NO: 354704 - RNA, 32 nt, Human
caggcacccggcagguaaaucacaaagcaaac

SEQ ID NO: 354705 - RNA, 32 nt, Human
caggcacccggccuuucuuucucccucuugca

SEQ ID NO: 354706 - RNA, 32 nt, Human
caggcacccugaccagcagagauugcugcaga

SEQ ID NO: 354707 - RNA, 32 nt, Human
caggcacccuggcagguucucagagccugccu

SEQ ID NO: 354708 - RNA, 32 nt, Human
caggcaccucgagggcuauucuccuggguucc

SEQ ID NO: 354709 - RNA, 32 nt, Human
caggcaccugggagccgaggcccugugaccag

SEQ ID NO: 354710 - RNA, 32 nt, Human
caggcaccuguaaucccagccaccugggaggc

SEQ ID NO: 354711 - RNA, 32 nt, Human
caggcaccuguaaucccagcuacucaggaagc

SEQ ID NO: 354712 - RNA, 32 nt, Human
caggcaccuguaaucccagcuacucaggaggc

SEQ ID NO: 354713 - RNA, 32 nt, Human
caggcaccuguaaucccagcuacucgggaggc

SEQ ID NO: 354714 - RNA, 32 nt, Human
caggcaccuguaaucccagcuacuugggagac

SEQ ID NO: 354715 - RNA, 32 nt, Human
caggcaccuguaaucccagcuacuugggaggc

SEQ ID NO: 354716 - RNA, 32 nt, Human
caggcaccuguaaucccaguuacuugggaggc

SEQ ID NO: 354717 - RNA, 32 nt, Human
caggcacgagccaccacacccagcuaauuuuu

SEQ ID NO: 354718 - RNA, 32 nt, Human
caggcacgagccaccaugcccagcuaauuuuc

SEQ ID NO: 354719 - RNA, 32 nt, Human
caggcacgagccacugugccuggccucaacug

SEQ ID NO: 354720 - RNA, 32 nt, Human
caggcacgcacaugugugcacgcacacauaca

SEQ ID NO: 354721 - RNA, 32 nt, Human
caggcacgccuguaaucccagcacuuugggag

SEQ ID NO: 354722 - RNA, 18 nt, Human
caggcacgcgccaccacg

SEQ ID NO: 354723 - RNA, 32 nt, Human
caggcacggauaacagcaaauggaauucugua

SEQ ID NO: 354724 - RNA, 32 nt, Human
caggcacggcugguggugugcagugaacagca

SEQ ID NO: 354725 - RNA, 32 nt, Human
caggcacgggccaccagcccagcuaauuuuug

SEQ ID NO: 354726 - RNA, 32 nt, Human
caggcacggugcugucugcauauugccaggug

SEQ ID NO: 354727 - RNA, 32 nt, Human
caggcacgugggaccucagcguguggagccac

SEQ ID NO: 354728 - RNA, 18 nt, Human
caggcacuauugccugga

SEQ ID NO: 354729 - RNA, 32 nt, Human
caggcacuccacugcuuggcaggaauucugca

SEQ ID NO: 354730 - RNA, 32 nt, Human
caggcacucccagagcagccauggaaggagcu

SEQ ID NO: 354731 - RNA, 32 nt, Human
caggcacugagccucucaggacaaugaccugg

SEQ ID NO: 354732 - RNA, 32 nt, Human
caggcacugaugcuagagggugaugacccugc

SEQ ID NO: 354733 - RNA, 32 nt, Human
caggcacugccaggaagccccagcugccccug

SEQ ID NO: 354734 - RNA, 32 nt, Human
caggcacugcccugggcuccagggacacauca

SEQ ID NO: 354735 - RNA, 32 nt, Human
caggcacugcccuguggucuuccccagguuga

SEQ ID NO: 354736 - RNA, 32 nt, Human
caggcacugcugcuucccagcuguguggccuc

SEQ ID NO: 354737 - RNA, 32 nt, Human
caggcacuggcagugggaagaggcagacgacu

SEQ ID NO: 354738 - RNA, 22 nt, Human
caggcacuggcauagcacggua

SEQ ID NO: 354739 - RNA, 32 nt, Human
caggcacugggagcuagaggagucucaagcuc

SEQ ID NO: 354740 - RNA, 32 nt, Human
caggcacugucuaaagccccaggcuggguuag

SEQ ID NO: 354741 - RNA, 32 nt, Human
caggcacuucaagccucaauaggaccaaggug

SEQ ID NO: 354742 - RNA, 32 nt, Human
caggcacuucagaaaggggagagaaagaaguc

SEQ ID NO: 354743 - RNA, 32 nt, Human
cagggucucaacucuguuacccaggcuggagu

SEQ ID NO: 354744 - RNA, 18 nt, Human
cagggucucacacuguca

SEQ ID NO: 354745 - RNA, 32 nt, Human
cagggucucaccauguugcccagccuggucuc

SEQ ID NO: 354746 - RNA, 32 nt, Human
cagggucucaccauguuguccagccuggucuc

SEQ ID NO: 354747 - RNA, 18 nt, Human
cagggucucacuauguca

SEQ ID NO: 354748 - RNA, 18 nt, Human
cagggucucacucuguca

SEQ ID NO: 354749 - RNA, 18 nt, Human
cagggucucacucuguua

SEQ ID NO: 354750 - RNA, 32 nt, Human
cagggucuccuuucuuucucacuucugucuug

SEQ ID NO: 354751 - RNA, 18 nt, Human
cagggucucgcucuguca

SEQ ID NO: 354752 - RNA, 32 nt, Human
cagggucucuucggagacccaggauuuagggu

SEQ ID NO: 354753 - RNA, 32 nt, Human
cagggucugaacugccuccauccuagggcaac

SEQ ID NO: 354754 - RNA, 32 nt, Human
cagggucugaggcugcagccccaguucgccau

SEQ ID NO: 354755 - RNA, 32 nt, Human
cagggucugagugcaaguucauguguggaaau

SEQ ID NO: 354756 - RNA, 32 nt, Human
cagggucugaguucuguggacccacuuguggg

SEQ ID NO: 354757 - RNA, 32 nt, Human
cagggucugcacucuaacccuaggcaucacau

SEQ ID NO: 354758 - RNA, 32 nt, Human
cagggucugccccucccaccccucucugcccu

SEQ ID NO: 354759 - RNA, 32 nt, Human
cagggucugcucuccucugaugguccaggcgg

SEQ ID NO: 354760 - RNA, 32 nt, Human
cagggucuggagaacccagaggcagcuccucc

SEQ ID NO: 354761 - RNA, 32 nt, Human
cagggucuggauguauuuacccaacucugauc

SEQ ID NO: 354762 - RNA, 32 nt, Human
cagggucuguuucuccccugcugugcggcuug

SEQ ID NO: 354763 - RNA, 32 nt, Human
cagggucuuugccucuaucugugguuuggcau

SEQ ID NO: 354764 - RNA, 24 nt, Human
cagggugaaaccccaucucuacua

SEQ ID NO: 354765 - RNA, 24 nt, Human
cagggugaaaccccgucucuacua

SEQ ID NO: 354766 - RNA, 32 nt, Human
cagggugaacaugccagcuaaugggacaucac

SEQ ID NO: 354767 - RNA, 32 nt, Human
cagggugaagaaaaagaagaagaugaagaaga

SEQ ID NO: 354768 - RNA, 32 nt, Human
cagggugacuggggucccaugacagcugcugu

SEQ ID NO: 354769 - RNA, 32 nt, Human
cagggugagacaaaugcucuguugaagccaug

SEQ ID NO: 354770 - RNA, 22 nt, Human
cagggugagacugcucccagug

SEQ ID NO: 354771 - RNA, 32 nt, Human
cagggugagcaucuccucuccacaccugccug

SEQ ID NO: 354772 - RNA, 32 nt, Human
cagggugagccccaaaauugggguucagcgug

SEQ ID NO: 354773 - RNA, 21 nt, Human
cagggugagcuggagcggcug

SEQ ID NO: 354774 - RNA, 32 nt, Human
cagggugaggcccaagccuggagcuuacccag

SEQ ID NO: 354775 - RNA, 32 nt, Human
cagggugagggaggggccccaggagaggccca

SEQ ID NO: 354776 - RNA, 32 nt, Human
cagggugagggcagaguguggugacagccgaa

SEQ ID NO: 354777 - RNA, 32 nt, Human
cagggugagggccaccuccacacccacccccu

SEQ ID NO: 354778 - RNA, 21 nt, Human
cagggugagggcccugaggaa

SEQ ID NO: 354779 - RNA, 32 nt, Human
cagggugagucuccuuccagugccccaguuuc

SEQ ID NO: 354780 - RNA, 32 nt, Human
cagggugauaaugucaauuggcagccaguugu

SEQ ID NO: 354781 - RNA, 32 nt, Human
cagggugcaauggcucaugccuauaaucccag

SEQ ID NO: 354782 - RNA, 32 nt, Human
cagggugcacacaagcaggugcagugcuguca

SEQ ID NO: 354783 - RNA, 32 nt, Human
cagggugcacaugcugcgaggucuccauccuc

SEQ ID NO: 354784 - RNA, 17 nt, Human
cagggugcagggcucag

SEQ ID NO: 354785 - RNA, 32 nt, Human
cagggugcagugaacucaguucuuggcccuug

SEQ ID NO: 354786 - RNA, 32 nt, Human
cagggugccacuaacccagcagguguggcagg

SEQ ID NO: 354787 - RNA, 21 nt, Human
cagggugccccuguccagccc

SEQ ID NO: 354788 - RNA, 32 nt, Human
cagggugcgguggcucacgccuguaaucccag

SEQ ID NO: 354789 - RNA, 32 nt, Human
cagggugcgguggcucaugccuauaauccuaa

SEQ ID NO: 354790 - RNA, 32 nt, Human
cagggugcuauugugaggccaucucugagcag

SEQ ID NO: 354791 - RNA, 32 nt, Human
cagggugcucacuggcaccccaucuuccugug

SEQ ID NO: 354792 - RNA, 32 nt, Human
cagggugcugacugucaagcauccccuguccc

SEQ ID NO: 354793 - RNA, 32 nt, Human
cagggugcugggauggcuauauuaggcauguu

SEQ ID NO: 354794 - RNA, 23 nt, Human
cagggugcugggauuacaggcau

SEQ ID NO: 354795 - RNA, 32 nt, Human
cagggugcugguucacucugcccagcccugaa

SEQ ID NO: 354796 - RNA, 32 nt, Human
caggguggagagaagcagggaccauugucuuc

SEQ ID NO: 354797 - RNA, 32 nt, Human
caggguggaggacagguuuggcccagaaagac

SEQ ID NO: 354798 - RNA, 32 nt, Human
caggguggagugagcccauggugggcaguggg

SEQ ID NO: 354799 - RNA, 32 nt, Human
caggguggcacgugccuguaauuccagcuacu

SEQ ID NO: 354800 - RNA, 32 nt, Human
caggguggcagccccggagccggggaauguga

SEQ ID NO: 354801 - RNA, 32 nt, Human
caggguggcaggacugggagaaucucugaggc

SEQ ID NO: 354802 - RNA, 21 nt, Human
caggguggccagcaguggcug

SEQ ID NO: 354803 - RNA, 32 nt, Human
caggguggcccacaccuguuccuagcagggcg

SEQ ID NO: 354804 - RNA, 32 nt, Human
caggguggccugcagcccagagccccaguccc

SEQ ID NO: 354805 - RNA, 19 nt, Human
caggguggccugugaccug

SEQ ID NO: 354806 - RNA, 32 nt, Human
caggguggcgacauggagagagggaagcucaa

SEQ ID NO: 354807 - RNA, 32 nt, Human
caggguggcgcacuacuauaaucccagcugcu

SEQ ID NO: 354808 - RNA, 32 nt, Human
caggguggcucacaccuguaaucccugcacuu

SEQ ID NO: 354809 - RNA, 32 nt, Human
cagggugggagcagggaaagaaaaggaaaaua

SEQ ID NO: 354810 - RNA, 32 nt, Human
cagggugggaggaucguuugagcccaggaguu

SEQ ID NO: 354811 - RNA, 32 nt, Human
cagggugggaggauggguggucagguaagaca

SEQ ID NO: 354812 - RNA, 32 nt, Human
caggguggggaacaagaucgccucccagggcc

SEQ ID NO: 354813 - RNA, 23 nt, Human
caggguggggagagcgggccagg

SEQ ID NO: 354814 - RNA, 32 nt, Human
caggguggggagguggcagcugccugcccugc

SEQ ID NO: 354815 - RNA, 32 nt, Human
caggguggggcugaggaacugacguggagcgg

SEQ ID NO: 354816 - RNA, 21 nt, Human
cagggugggggaagggccagg

SEQ ID NO: 354817 - RNA, 32 nt, Human
cagggugggggucauucagccuccacuguguc

SEQ ID NO: 354818 - RNA, 32 nt, Human
caggguggggucaggaaucugcauuuuaacua

SEQ ID NO: 354819 - RNA, 32 nt, Human
cagggugggugagcucucaggccgagagccuu

SEQ ID NO: 354820 - RNA, 32 nt, Human
cagggugggugaggaagugcacagggguccag

SEQ ID NO: 354821 - RNA, 32 nt, Human
cagggugggugaggugcagaugaccaggagug

SEQ ID NO: 354822 - RNA, 32 nt, Human
caggguggguuuucucacugaagagagaaagc

SEQ ID NO: 354823 - RNA, 32 nt, Human
cagggugguccagccuaggugacagggugguc

SEQ ID NO: 354824 - RNA, 32 nt, Human
caggguggucucaaacuccugaccugaggcga

SEQ ID NO: 354825 - RNA, 32 nt, Human
caggguggucucaaacuccugggcucaagcga

SEQ ID NO: 354826 - RNA, 32 nt, Human
caggguggucucaaacuccugggcucaaguga

SEQ ID NO: 354827 - RNA, 32 nt, Human
caggguggucucaaacuccugugcucaaguga

SEQ ID NO: 354828 - RNA, 32 nt, Human
cagggugguggggacuccugagcccagccugg

SEQ ID NO: 354829 - RNA, 32 nt, Human
caggguguacacacaagaaggugggcugggca

SEQ ID NO: 354830 - RNA, 32 nt, Human
caggguguaguggcucaugacuguaaucccag

SEQ ID NO: 354831 - RNA, 32 nt, Human
caggguguccccagccaucaggagacuugagu

SEQ ID NO: 354832 - RNA, 32 nt, Human
cagggugucuggggcaggaggaggccaacuca

SEQ ID NO: 354833 - RNA, 32 nt, Human
cagggugucugucagugggccucaugguaaga

SEQ ID NO: 354834 - RNA, 32 nt, Human
cagggugucuguguccgagccacagccagagu

SEQ ID NO: 354835 - RNA, 21 nt, Human
cagggugucuuccuucagccc

SEQ ID NO: 354836 - RNA, 32 nt, Human
cagggugugcaggaguggcaggaugguugcau

SEQ ID NO: 354837 - RNA, 32 nt, Human
cagggugugcaggggcagagaaggaagggacc

SEQ ID NO: 354838 - RNA, 32 nt, Human
cagggugugccgggccaagauacucacaggcu

SEQ ID NO: 354839 - RNA, 32 nt, Human
cagggugugcucggugggcagugugggacugg

SEQ ID NO: 354840 - RNA, 32 nt, Human
cagggugugguagcucaagccuguaaucccag

SEQ ID NO: 354841 - RNA, 32 nt, Human
cagggugugguggcuuaugccuguaauccuag

SEQ ID NO: 354842 - RNA, 32 nt, Human
cagggugugguggugcaugccuguaaucccag

SEQ ID NO: 354843 - RNA, 32 nt, Human
caggguguguuggcacacgccuguaauaccag

SEQ ID NO: 354844 - RNA, 32 nt, Human
caggguguugagccacucugacucagccaaua

SEQ ID NO: 354845 - RNA, 32 nt, Human
caggguuaaguucaguaagaaaugcuguagcu

SEQ ID NO: 354846 - RNA, 32 nt, Human
caggguuaugucgaggaagggaagaaagaaac

SEQ ID NO: 354847 - RNA, 32 nt, Human
caggguucaagcaauucuccugccucagccuu

SEQ ID NO: 354848 - RNA, 32 nt, Human
caggguucaagcaauucuccugccucagucuc

SEQ ID NO: 354849 - RNA, 32 nt, Human
caggguucaagcgaugcuccuaccucagccuc

SEQ ID NO: 354850 - RNA, 32 nt, Human
caggguucaagugauucucccaccucagccuc

SEQ ID NO: 354851 - RNA, 32 nt, Human
caggguucaaucgauucuccugccucacccuc

SEQ ID NO: 354852 - RNA, 32 nt, Human
caggguucaccaggaugagagaggagagagga

SEQ ID NO: 354853 - RNA, 32 nt, Human
caggguucaccaggauguaagaggagagagga

SEQ ID NO: 354854 - RNA, 32 nt, Human
caggguucaguccacguuguguuuucacaccu

SEQ ID NO: 354855 - RNA, 20 nt, Human
caggguuccccacaguuuca

SEQ ID NO: 354856 - RNA, 32 nt, Human
caggguucccgguggugugcugugaagauguc

SEQ ID NO: 354857 - RNA, 32 nt, Human
caggguucgggcaauucuccugccuuagccuc

SEQ ID NO: 354858 - RNA, 32 nt, Human
caggguucuccccucuggagucugaccaauua

SEQ ID NO: 354859 - RNA, 32 nt, Human
caggguucuccucuucucucacaggcggcucg

SEQ ID NO: 354860 - RNA, 32 nt, Human
caggguugagaggagccacuagcaccauccca

SEQ ID NO: 354861 - RNA, 32 nt, Human
caggguugcagugacaguaagcugaauagcuc

SEQ ID NO: 354862 - RNA, 32 nt, Human
caggguugcccaggguggagugcaguggcagg

SEQ ID NO: 354863 - RNA, 32 nt, Human
caggguugccuagcccuguacaauguaauuua

SEQ ID NO: 354864 - RNA, 32 nt, Human
caggguugcuaaucagauaccugcugucacca

SEQ ID NO: 354865 - RNA, 32 nt, Human
caggguugcuggguacagaagccagacuucuu

SEQ ID NO: 354866 - RNA, 20 nt, Human
caggguugcugugcuggcca

SEQ ID NO: 354867 - RNA, 32 nt, Human
caggguuggacccccugagauccagcccuacu

SEQ ID NO: 354868 - RNA, 32 nt, Human
caggguuggggaggggcacagggagguggugg

SEQ ID NO: 354869 - RNA, 32 nt, Human
caggguuggggauaaggucacagaucaacagg

SEQ ID NO: 354870 - RNA, 32 nt, Human
caggguugugcugacacgccugccuguccacc

SEQ ID NO: 354871 - RNA, 32 nt, Human
caggguuguugagugaggggagcgugggaugg

SEQ ID NO: 354872 - RNA, 24 nt, Human
caggguuucaccauuuuggccagg

SEQ ID NO: 354873 - RNA, 16 nt, Human
caggguuuccguggcc

SEQ ID NO: 354874 - RNA, 23 nt, Human
caggguuucuccauuuuggccag

SEQ ID NO: 354875 - RNA, 25 nt, Human
caggguuugaagaaaaggaggggga

SEQ ID NO: 354876 - RNA, 32 nt, Human
caggguuugagaccagccuggccaacauggcg

SEQ ID NO: 354877 - RNA, 32 nt, Human
caggguuugccaggcuaagcagcaaugccagg

SEQ ID NO: 354878 - RNA, 32 nt, Human
caggguuuuugaaggaguggauuuucuuuguu

SEQ ID NO: 354879 - RNA, 32 nt, Human
cagguaaaccaggagacacagaagacguacca

SEQ ID NO: 354880 - RNA, 21 nt, Human
cagguaaaugugaguuaaaua

SEQ ID NO: 354881 - RNA, 32 nt, Human
cagguaaauucucucacuugugaaugggagaa

SEQ ID NO: 354882 - RNA, 32 nt, Human
cagguaacaugagaagggcugaucaggagaug

SEQ ID NO: 354883 - RNA, 32 nt, Human
cagguaaccaacaagaaaugcaagccgucgac

SEQ ID NO: 354884 - RNA, 32 nt, Human
cagguaaccaggauggcuaacaggcuuugaua

SEQ ID NO: 354885 - RNA, 32 nt, Human
cagguaaccuggacaaaccaggaagcaccaaa

SEQ ID NO: 354886 - RNA, 32 nt, Human
cagguaagcaaacucagcauuaaggauguagu

SEQ ID NO: 354887 - RNA, 32 nt, Human
cagguaagccauuccuggauaccugacccuug

SEQ ID NO: 354888 - RNA, 31 nt, Human
cagguaaggguggaacaggagggguggggag

SEQ ID NO: 354889 - RNA, 32 nt, Human
cagguaaggguggaacaggagggguggggagg

SEQ ID NO: 354890 - RNA, 32 nt, Human
cagguaauccugcuguucgaugaagcaguucc

SEQ ID NO: 354891 - RNA, 32 nt, Human
cagguacaaauguacacaucaaaaugcccaua

SEQ ID NO: 354892 - RNA, 19 nt, Human
cagguacacauuguuccug

SEQ ID NO: 354893 - RNA, 32 nt, Human
cagguacaggacuggucuaagcugcucaagau

SEQ ID NO: 354894 - RNA, 32 nt, Human
cagguacauaucacgcgcacagccuggcagcc

SEQ ID NO: 354895 - RNA, 32 nt, Human
cagguaccaugcggacgcgcgagcccggcgag

SEQ ID NO: 354896 - RNA, 32 nt, Human
cagguacccacugucugucuaccuucccacug

SEQ ID NO: 354897 - RNA, 32 nt, Human
cagguacccagguaugccgcagagccaggcac

SEQ ID NO: 354898 - RNA, 32 nt, Human
cagguacccugccuccauuuugguuaccaucc

SEQ ID NO: 354899 - RNA, 32 nt, Human
cagguaccuauuauuguucccuggugaaacug

SEQ ID NO: 354900 - RNA, 32 nt, Human
cagguaccuccaggaacauuuugguuuuggcc

SEQ ID NO: 354901 - RNA, 32 nt, Human
cagguacguguagucccugcuacucaggaggc

SEQ ID NO: 354902 - RNA, 32 nt, Human
cagguacuacaucaaccaaaagaggaaauacu

SEQ ID NO: 354903 - RNA, 32 nt, Human
cagguacugccugggccucugaggcaguccca

SEQ ID NO: 354904 - RNA, 32 nt, Human
cagguacuggaggaagagagaagaggcaugac

SEQ ID NO: 354905 - RNA, 32 nt, Human
cagguacugugguaugcuuagcauuuucuaag

SEQ ID NO: 354906 - RNA, 32 nt, Human
cagguacuucucucuccuuccuccuucuccuc

SEQ ID NO: 354907 - RNA, 32 nt, Human
cagguacuugggaggcugaggugggaggauua

SEQ ID NO: 354908 - RNA, 32 nt, Human
cagguacuuuaucccagaacauccaagcugga

SEQ ID NO: 354909 - RNA, 32 nt, Human
cagguagaaaaauguaauguagcuuuuuccac

SEQ ID NO: 354910 - RNA, 32 nt, Human
cagguagaauauguggcacuagcaccgacaaa

SEQ ID NO: 354911 - RNA, 32 nt, Human
cagguagacaagcuccagcagagaguggccag

SEQ ID NO: 354912 - RNA, 32 nt, Human
cagguagagacaacauccugugacugccaggc

SEQ ID NO: 354913 - RNA, 32 nt, Human
cagguagagcaguucugaccgagaggauagac

SEQ ID NO: 354914 - RNA, 30 nt, Human
cagguagagcaucaccagcuccuguggccu

SEQ ID NO: 354915 - RNA, 21 nt, Human
cagguagaucacaaggucagg

SEQ ID NO: 354916 - RNA, 21 nt, Human
cagguagaucacgaggucagg

SEQ ID NO: 354917 - RNA, 32 nt, Human
cagguagaucacugcauccgguuccuccucuu

SEQ ID NO: 354918 - RNA, 23 nt, Human
cagguagaucacuugagaucagg

SEQ ID NO: 354919 - RNA, 32 nt, Human
cagguagauggaagcugcaucugcccacgaug

SEQ ID NO: 354920 - RNA, 19 nt, Human
cagguagauucugccugaa

SEQ ID NO: 354921 - RNA, 32 nt, Human
cagguagauuguagcccaggaguuugagaaca

SEQ ID NO: 354922 - RNA, 32 nt, Human
cagguagcaaagugacgccgagggccugagug

SEQ ID NO: 354923 - RNA, 32 nt, Human
cagguagcacgccugcuggcagagguaccugg

SEQ ID NO: 354924 - RNA, 20 nt, Human
cagguagcagccgcaagggg

SEQ ID NO: 354925 - RNA, 32 nt, Human
cagguagcccaggguguuguggguggcagcac

SEQ ID NO: 354926 - RNA, 32 nt, Human
cagguagcuagaaaccaucugggcuugacaaa

SEQ ID NO: 354927 - RNA, 32 nt, Human
cagguagcucaaaccucucuguccucaguuuc

SEQ ID NO: 354928 - RNA, 22 nt, Human
cagguagcugggauuacaggca

SEQ ID NO: 354929 - RNA, 23 nt, Human
cagguagcugggauuacaggcau

SEQ ID NO: 354930 - RNA, 32 nt, Human
cagguagcuugcgugggccaggagaaggugau

SEQ ID NO: 354931 - RNA, 32 nt, Human
cagguaggaaacacuuguaguugggggugggg

SEQ ID NO: 354932 - RNA, 32 nt, Human
cagguaggaaaucaccuuugacuuagcuucca

SEQ ID NO: 354933 - RNA, 32 nt, Human
cagguaggagaaggagacgaagaugcuuuagg

SEQ ID NO: 354934 - RNA, 32 nt, Human
cagguaggcuuggaggaccaagcccuggauga

SEQ ID NO: 354935 - RNA, 32 nt, Human
cagguagggaaaaaguuggucuaauugaagau

SEQ ID NO: 354936 - RNA, 32 nt, Human
cagguagggaaaggggacuugugguaguggac

SEQ ID NO: 354937 - RNA, 32 nt, Human
cagguagggggagaggaggaguuaagggcucc

SEQ ID NO: 354938 - RNA, 32 nt, Human
cagguaguaagaagauuucaaauucacauuag

SEQ ID NO: 354939 - RNA, 32 nt, Human
cagguagucuggguuggaggaggcagagccau

SEQ ID NO: 354940 - RNA, 32 nt, Human
cagguagugaguagcugguacuacaggugugu

SEQ ID NO: 354941 - RNA, 32 nt, Human
cagguauaaagaaauggaauguagacaauaug

SEQ ID NO: 354942 - RNA, 32 nt, Human
cagguauagcugacaucuccucuaucacauua

SEQ ID NO: 354943 - RNA, 32 nt, Human
cagguaucuccugacagagguacuuaacaaug

SEQ ID NO: 354944 - RNA, 32 nt, Human
cagguaucugcuggccgcugacugaccagguc

SEQ ID NO: 354945 - RNA, 32 nt, Human
cagguaucuugcucucuaggccugugugugug

SEQ ID NO: 354946 - RNA, 32 nt, Human
cagguaugagccacaacgcccagccaucauuu

SEQ ID NO: 354947 - RNA, 32 nt, Human
cagguaugagccaccacacccagcccaacuca

SEQ ID NO: 354948 - RNA, 32 nt, Human
cagguaugagccaccacgcccggucagaagcu

SEQ ID NO: 354949 - RNA, 32 nt, Human
cagguaugagccaccaugccuggccccagccc

SEQ ID NO: 354950 - RNA, 32 nt, Human
cagguaugagccaccgcaccuggcccuugggc

SEQ ID NO: 354951 - RNA, 32 nt, Human
cagguaugagccacugcgcccggccaguuacu

SEQ ID NO: 354952 - RNA, 32 nt, Human
cagguaugaguggcagagggagcagucccauc

SEQ ID NO: 354953 - RNA, 32 nt, Human
cagguaugcaccacagcuccaggccaaccuuu

SEQ ID NO: 354954 - RNA, 32 nt, Human
cagguaugcaccaccacaccuggcuaauuuug

SEQ ID NO: 354955 - RNA, 32 nt, Human
cagguaugcaccaccacgcccggcuaauuuug

SEQ ID NO: 354956 - RNA, 32 nt, Human
cagguaugcaccaccauaccuggcugauuuuu

SEQ ID NO: 354957 - RNA, 32 nt, Human
cagguaugcaccaccaugccuggcuaauuuuu

SEQ ID NO: 354958 - RNA, 24 nt, Human
cagguaugccucaccaauuugccc

SEQ ID NO: 354959 - RNA, 32 nt, Human
cagguauucauuuugccuaauuucaccucaag

SEQ ID NO: 354960 - RNA, 32 nt, Human
cagguauucuauguggcaacccuagguagggg

SEQ ID NO: 354961 - RNA, 32 nt, Human
cagguauucuggacuguguuuuagaucaccug

SEQ ID NO: 354962 - RNA, 32 nt, Human
cagguauugggagacccacagcuaagacaccg

SEQ ID NO: 354963 - RNA, 32 nt, Human
cagguauuguacucgggaggcugaggugggag

SEQ ID NO: 354964 - RNA, 32 nt, Human
cagguauuuugcaaaaacacugccucauagcu

SEQ ID NO: 354965 - RNA, 32 nt, Human
caggucaaagaauucgccuuugccgcuaccgc

SEQ ID NO: 354966 - RNA, 20 nt, Human
caggucaacacugcacucca

SEQ ID NO: 354967 - RNA, 32 nt, Human
caggucaacacugcacuccagccugggcgaca

SEQ ID NO: 354968 - RNA, 32 nt, Human
caggucaacaucagcacccaagagcuuuggga

SEQ ID NO: 354969 - RNA, 32 nt, Human
caggucaacgugaccaaccuuccuugcuuaca

SEQ ID NO: 354970 - RNA, 23 nt, Human
caggucaacuggagucccuggug

SEQ ID NO: 354971 - RNA, 32 nt, Human
caggucaaggaaggcauccuguggaaguaaca

SEQ ID NO: 354972 - RNA, 32 nt, Human
caggucaaggaccuggcuucugggacccaggg

SEQ ID NO: 354973 - RNA, 19 nt, Human
caggucaaggcugcagcga

SEQ ID NO: 354974 - RNA, 32 nt, Human
caggucaaucagcaaggacccaucucugcccu

SEQ ID NO: 354975 - RNA, 32 nt, Human
caggucaaugcacagacccaggaagagacuga

SEQ ID NO: 354976 - RNA, 32 nt, Human
caggucacaaacuccaaucuuuguuuggguag

SEQ ID NO: 354977 - RNA, 32 nt, Human
caggucacaccaguccuucuguccucacacug

SEQ ID NO: 354978 - RNA, 22 nt, Human
caggucacagauccccuuuccc

SEQ ID NO: 354979 - RNA, 32 nt, Human
caggucacagcucauuguccaucaggaaauuc

SEQ ID NO: 354980 - RNA, 32 nt, Human
caggucaccgagguaggacagcaaauuaaaac

SEQ ID NO: 354981 - RNA, 32 nt, Human
caggucacuaucugccucccacccugggggca

SEQ ID NO: 354982 - RNA, 32 nt, Human
caggucacugcaaccucugccucccagguuca

SEQ ID NO: 354983 - RNA, 32 nt, Human
caggucacugcaaccucugccuccuggguuca

SEQ ID NO: 354984 - RNA, 32 nt, Human
caggucacuguuccacccaccugggcacagca

SEQ ID NO: 354985 - RNA, 32 nt, Human
caggucacuuccuccaugaagagaccaguuuc

SEQ ID NO: 354986 - RNA, 32 nt, Human
caggucacuuccuuuucacucaguuuaaauug

SEQ ID NO: 354987 - RNA, 32 nt, Human
caggucacuuuauucuguaacucuccauucac

SEQ ID NO: 354988 - RNA, 32 nt, Human
caggucagaaaaacccuacaaauguaaggaau

SEQ ID NO: 354989 - RNA, 32 nt, Human
caggucagaagcgaauacucugccauuaucuc

SEQ ID NO: 354990 - RNA, 19 nt, Human
caggucagacccaguccug

SEQ ID NO: 354991 - RNA, 32 nt, Human
caggucagaggcagcuuccagccugggggcug

SEQ ID NO: 354992 - RNA, 18 nt, Human
caggucagcccugugucu

SEQ ID NO: 354993 - RNA, 32 nt, Human
caggucagccucccgccucuccuccugcugaa

SEQ ID NO: 354994 - RNA, 32 nt, Human
caggucagccuccuccgggccucuccccacuc

SEQ ID NO: 354995 - RNA, 32 nt, Human
caggucagcucaggcuggagcaggcauaugag

SEQ ID NO: 354996 - RNA, 32 nt, Human
caggucagcucaggcuggagcagguauaugag

SEQ ID NO: 354997 - RNA, 32 nt, Human
caggucagcucugcaaggggcuugucucugug

SEQ ID NO: 354998 - RNA, 32 nt, Human
caggucaggaaccugggugcagcuucaugggg

SEQ ID NO: 354999 - RNA, 32 nt, Human
caggucaggaccaggacccagggagaggcugu

SEQ ID NO: 355000 - RNA, 32 nt, Human
caggucaggaggugccguccaggugugcggcg

SEQ ID NO: 355001 - RNA, 32 nt, Human
caggucaggaguuugagaccagccuggccaac

SEQ ID NO: 355002 - RNA, 32 nt, Human
caggucaggugcuuguucuguccucuugccuu

SEQ ID NO: 355003 - RNA, 31 nt, Human
caggucagugucucugggcuuugugcaagcu

SEQ ID NO: 355004 - RNA, 32 nt, Human
caggucaguuuaugaaacagaaaaguaggaau

SEQ ID NO: 355005 - RNA, 32 nt, Human
caggucaguuucuucuuuuaauucaucauuga

SEQ ID NO: 355006 - RNA, 32 nt, Human
caggucaucccucccuucuucucucuccuuug

SEQ ID NO: 355007 - RNA, 24 nt, Human
caggucaucugcugggaucuaguu

SEQ ID NO: 355008 - RNA, 32 nt, Human
caggucaugcaaauuuaagaaaaggcuaaaag

SEQ ID NO: 355009 - RNA, 32 nt, Human
caggucauggcacguuuaacaaaaagacgaca

SEQ ID NO: 355010 - RNA, 32 nt, Human
caggucauuaggauuugggaggcuguauuucu

SEQ ID NO: 355011 - RNA, 22 nt, Human
caggucauucuuuuacuaggcu

SEQ ID NO: 355012 - RNA, 32 nt, Human
caggucauugcacucaagccugggcaauaaga

SEQ ID NO: 355013 - RNA, 32 nt, Human
caggucauuucuccucucucagacucagugga

SEQ ID NO: 355014 - RNA, 32 nt, Human
cagguccaaaggcucuuuccagauggagaaga

SEQ ID NO: 355015 - RNA, 32 nt, Human
cagguccaaauacugaaugucuccuuuacuuu

SEQ ID NO: 355016 - RNA, 32 nt, Human
cagguccaacuuggcccugacuccugcggggg

SEQ ID NO: 355017 - RNA, 24 nt, Human
cagguccaagcgauucucuugccu

SEQ ID NO: 355018 - RNA, 32 nt, Human
cagguccacagaacuacugcagcccagaggac

SEQ ID NO: 355019 - RNA, 32 nt, Human
cagguccacagagagggagagcagagaaagaa

SEQ ID NO: 355020 - RNA, 32 nt, Human
cagguccacugggugaggagagaugugugggc

SEQ ID NO: 355021 - RNA, 32 nt, Human
cagguccagauuccacgagagccuucugggcu

SEQ ID NO: 355022 - RNA, 32 nt, Human
cagguccagcacuugggagcugacugugcugg

SEQ ID NO: 355023 - RNA, 32 nt, Human
cagguccagccuugccagucucagccuccggu

SEQ ID NO: 355024 - RNA, 20 nt, Human
cagguccagcuccucccuca

SEQ ID NO: 355025 - RNA, 20 nt, Human
cagguccaggggaguccagu

SEQ ID NO: 355026 - RNA, 32 nt, Human
cagguccagugcuugguccugcucuggucacu

SEQ ID NO: 355027 - RNA, 32 nt, Human
caggucccaacacuuugggcugggguuggcca

SEQ ID NO: 355028 - RNA, 23 nt, Human
caggucccacgccaggccagcag

SEQ ID NO: 355029 - RNA, 32 nt, Human
caggucccaggggagagguuggggcuggcagg

SEQ ID NO: 355030 - RNA, 32 nt, Human
caggucccauugagugguuuuccucuuggcag

SEQ ID NO: 355031 - RNA, 32 nt, Human
cagguccccaaagcccuucuuuucccaucacu

SEQ ID NO: 355032 - RNA, 32 nt, Human
cagguccccaagucccuucacaggguccccac

SEQ ID NO: 355033 - RNA, 32 nt, Human
cagguccccacucuccccugugaagccaaccc

SEQ ID NO: 355034 - RNA, 25 nt, Human
cagguccccagaugagaagucugcu

SEQ ID NO: 355035 - RNA, 32 nt, Human
cagguccccugccucugggcacccuuugggcc

SEQ ID NO: 355036 - RNA, 32 nt, Human
caggucccgaguaagucagguuuucuucaccc

SEQ ID NO: 355037 - RNA, 32 nt, Human
caggucccggaggucucagacccgcaggccug

SEQ ID NO: 355038 - RNA, 32 nt, Human
caggucccggcccugggugcucagccagcucg

SEQ ID NO: 355039 - RNA, 23 nt, Human
caggucccucaguucucacgccu

SEQ ID NO: 355040 - RNA, 32 nt, Human
caggucccuccacccccauucugagucucugu

SEQ ID NO: 355041 - RNA, 21 nt, Human
caggucccucuuagaccagcu

SEQ ID NO: 355042 - RNA, 19 nt, Human
caggucccugccacucagu

SEQ ID NO: 355043 - RNA, 22 nt, Human
caggucccugccuccuaccacu

SEQ ID NO: 355044 - RNA, 22 nt, Human
caggucccugcuggaagcggcu

SEQ ID NO: 355045 - RNA, 23 nt, Human
caggucccugcuggaagcggcug

SEQ ID NO: 355046 - RNA, 32 nt, Human
caggucccuggagcgggugacacaccugagau

SEQ ID NO: 355047 - RNA, 32 nt, Human
caggucccugugcgcaugcacauggagggguc

SEQ ID NO: 355048 - RNA, 21 nt, Human
caggucccuucaucuuccaua

SEQ ID NO: 355049 - RNA, 32 nt, Human
cagguccuaagcugcugcuugugcgcgacugc

SEQ ID NO: 355050 - RNA, 28 nt, Human
cagguccucaauaaauacucgcuggauc

SEQ ID NO: 355051 - RNA, 23 nt, Human
cagguccucagucggucccaguu

SEQ ID NO: 355052 - RNA, 32 nt, Human
cagguccucaugucucaaccacaucuacucug

SEQ ID NO: 355053 - RNA, 32 nt, Human
cagguccuccgugaucaggucucugcucuucu

SEQ ID NO: 355054 - RNA, 32 nt, Human
cagguccuccuccucacucagcccugccgcug

SEQ ID NO: 355055 - RNA, 32 nt, Human
cagguccuccuccuccuccuucuccucuucuu

SEQ ID NO: 355056 - RNA, 32 nt, Human
cagguccuccuuggugccucgcaggcagauga

SEQ ID NO: 355057 - RNA, 32 nt, Human
cagguccucuccccucauuuccaucucccagc

SEQ ID NO: 355058 - RNA, 32 nt, Human
cagguccugaaaucagccuuguggagccugug

SEQ ID NO: 355059 - RNA, 32 nt, Human
cagguccugacucugcagagggaagaggcaga

SEQ ID NO: 355060 - RNA, 32 nt, Human
cagguccugaggcacgugaauggccaggauca

SEQ ID NO: 355061 - RNA, 32 nt, Human
cagguccugcagcugcuuguuagcuuuuugag

SEQ ID NO: 355062 - RNA, 32 nt, Human
cagguccugcagcuugugcucugcccagcagu

SEQ ID NO: 355063 - RNA, 32 nt, Human
cagguccugcugccucccuuucauacaauggc

SEQ ID NO: 355064 - RNA, 32 nt, Human
cagguccuggcugagcgggcucugaguucugu

SEQ ID NO: 355065 - RNA, 32 nt, Human
cagguccugggagaggacagaaaacaacugga

SEQ ID NO: 355066 - RNA, 32 nt, Human
cagguccugggccugcuucccugcggguucug

SEQ ID NO: 355067 - RNA, 32 nt, Human
cagguccugggugagggugggagauuuagaca

SEQ ID NO: 355068 - RNA, 32 nt, Human
cagguccugugagcccugccuucauguuuggc

SEQ ID NO: 355069 - RNA, 32 nt, Human
cagguccuucagagcaauucagugccagacau

SEQ ID NO: 355070 - RNA, 32 nt, Human
cagguccuucagucuccgcucgucucaccgua

SEQ ID NO: 355071 - RNA, 32 nt, Human
cagguccuuuagucuguuguucuugaaaacua

SEQ ID NO: 355072 - RNA, 18 nt, Human
cagguccuuugcuuacca

SEQ ID NO: 355073 - RNA, 32 nt, Human
caggucgcuggugacagggccaggguuaugca

SEQ ID NO: 355074 - RNA, 32 nt, Human
caggucggaagaggcaggggaaggcuccaggc

SEQ ID NO: 355075 - RNA, 32 nt, Human
caggucggaaguagugugaggcucgugggcgg

SEQ ID NO: 355076 - RNA, 23 nt, Human
caggucggagcugggugggccgg

SEQ ID NO: 355077 - RNA, 32 nt, Human
caggucggcauaggugcccacagagcagacug

SEQ ID NO: 355078 - RNA, 21 nt, Human
caggucggcggacgggccagg

SEQ ID NO: 355079 - RNA, 22 nt, Human
caggucgggggagcacaggcca

SEQ ID NO: 355080 - RNA, 18 nt, Human
caggucggugagaggaca

SEQ ID NO: 355081 - RNA, 32 nt, Human
caggucgucugacuucucgugccauuuucaau

SEQ ID NO: 355082 - RNA, 32 nt, Human
caggucgugauggcucacgccuguaaucccag

SEQ ID NO: 355083 - RNA, 32 nt, Human
caggucguggcagagaaaaccagcugagacag

SEQ ID NO: 355084 - RNA, 21 nt, Human
caggucguuggagacugaaga

SEQ ID NO: 355085 - RNA, 32 nt, Human
caggucuaagaggagaggcagagccagugugc

SEQ ID NO: 355086 - RNA, 32 nt, Human
caggucuaccagccacagucucugcacguuuc

SEQ ID NO: 355087 - RNA, 19 nt, Human
caggucuagggguugggga

SEQ ID NO: 355088 - RNA, 19 nt, Human
caggucuauucucaucuua

SEQ ID NO: 355089 - RNA, 20 nt, Human
caggucucagcauuucaucu

SEQ ID NO: 355090 - RNA, 32 nt, Human
caggucucagcccugguccaguguguccaugg

SEQ ID NO: 355091 - RNA, 24 nt, Human
caggucucaggcuagaauccagcu

SEQ ID NO: 355092 - RNA, 31 nt, Human
caggucucaggcuagaauccagcucacuguc

SEQ ID NO: 355093 - RNA, 32 nt, Human
caggucucaggguccagugucauuugaggaug

SEQ ID NO: 355094 - RNA, 19 nt, Human
caggucucauacucacuua

SEQ ID NO: 355095 - RNA, 24 nt, Human
caggucuccaaggcaagcccagcu

SEQ ID NO: 355096 - RNA, 32 nt, Human
caggucuccagaggcuuguggaagagaagcag

SEQ ID NO: 355097 - RNA, 20 nt, Human
caggucuccagucaguccag

SEQ ID NO: 355098 - RNA, 32 nt, Human
caggucucccacccauuccuggcucccaccag

SEQ ID NO: 355099 - RNA, 32 nt, Human
caggucuccccugacgcccacacccaccacca

SEQ ID NO: 355100 - RNA, 32 nt, Human
caggucucccggaaguggccgguccagagcug

SEQ ID NO: 355101 - RNA, 32 nt, Human
caggucucccugggacaaaaucaaggcgcuug

SEQ ID NO: 355102 - RNA, 32 nt, Human
caggucucccugucccaggaggcuugugccaa

SEQ ID NO: 355103 - RNA, 32 nt, Human
caggucucccuuucauugaacauguuagaguu

SEQ ID NO: 355104 - RNA, 21 nt, Human
caggucuccgccuccucugcu

SEQ ID NO: 355105 - RNA, 32 nt, Human
caggucucgggccucaggucucgggccucaga

SEQ ID NO: 355106 - RNA, 21 nt, Human
caggucucuacaaacauuuua

SEQ ID NO: 355107 - RNA, 22 nt, Human
caggucucuacugccucacuug

SEQ ID NO: 355108 - RNA, 18 nt, Human
caggucucuagcaccgcu

SEQ ID NO: 355109 - RNA, 32 nt, Human
caggucucuaggggugagauacguacauuacc

SEQ ID NO: 355110 - RNA, 32 nt, Human
caggucucucaccucucugaccucagcuuccu

SEQ ID NO: 355111 - RNA, 24 nt, Human
caggucucucccagggcucguuuu

SEQ ID NO: 355112 - RNA, 21 nt, Human
caggucucuccgcuccucuug

SEQ ID NO: 355113 - RNA, 32 nt, Human
caggucucugagcggccccugauguuccuguu

SEQ ID NO: 355114 - RNA, 22 nt, Human
caggucucugagcucagucuua

SEQ ID NO: 355115 - RNA, 21 nt, Human
caggucucugggguugucuua

SEQ ID NO: 355116 - RNA, 22 nt, Human
caggucucuguacaggccaguu

SEQ ID NO: 355117 - RNA, 32 nt, Human
caggucucuucuccagccuccaccugccuguc

SEQ ID NO: 355118 - RNA, 32 nt, Human
caggucugcagaaccauagcuuccacgcaccu

SEQ ID NO: 355119 - RNA, 32 nt, Human
caggucugcagagcaaaggcaggucuggaggg

SEQ ID NO: 355120 - RNA, 32 nt, Human
caggucugcaguccuggugaggggacaucacg

SEQ ID NO: 355121 - RNA, 20 nt, Human
caggucugcccuuuaucuug

SEQ ID NO: 355122 - RNA, 32 nt, Human
caggucugcggggacugaggcauggcagggaa

SEQ ID NO: 355123 - RNA, 32 nt, Human
caggucuggcuuggucaguuucuuagguaugg

SEQ ID NO: 355124 - RNA, 32 nt, Human
caggucugggccacuuucauccccauuucaag

SEQ ID NO: 355125 - RNA, 32 nt, Human
caggucugggccagaugcugggcaggaaaccc

SEQ ID NO: 355126 - RNA, 23 nt, Human
caggucuggugggcggggccagg

SEQ ID NO: 355127 - RNA, 32 nt, Human
caggucugucccggcuggagaacagcguccac

SEQ ID NO: 355128 - RNA, 32 nt, Human
caggucugucggcaguuccucagucuguaaaa

SEQ ID NO: 355129 - RNA, 32 nt, Human
caggucuguggggcaagaggcugcaauauucc

SEQ ID NO: 355130 - RNA, 32 nt, Human
caggucugugggguccagccuggcaaaagcaa

SEQ ID NO: 355131 - RNA, 32 nt, Human
caggucuguguggacguggaggaagcaggcau

SEQ ID NO: 355132 - RNA, 23 nt, Human
caggucuuaccgagaauucagcu

SEQ ID NO: 355133 - RNA, 32 nt, Human
caggucuucccaaggauuuuaguauuugcauu

SEQ ID NO: 355134 - RNA, 32 nt, Human
caggucuucccucaaucuaccucuuuccacau

SEQ ID NO: 355135 - RNA, 32 nt, Human
caggucuucuggggaccccagaggugucugug

SEQ ID NO: 355136 - RNA, 20 nt, Human
caggucuugagagguccagc

SEQ ID NO: 355137 - RNA, 32 nt, Human
caggucuuggagcugagccucucaccuguacu

SEQ ID NO: 355138 - RNA, 32 nt, Human
caggucuuguguuacuccuccuccuuucuaag

SEQ ID NO: 355139 - RNA, 22 nt, Human
caggucuuuagccuccaccuug

SEQ ID NO: 355140 - RNA, 22 nt, Human
caggucuuugaagaagccaguu

SEQ ID NO: 355141 - RNA, 21 nt, Human
caggucuuugcauuccuuuua

SEQ ID NO: 355142 - RNA, 32 nt, Human
caggugaacuugagggcgaggagcagcgcgca

SEQ ID NO: 355143 - RNA, 32 nt, Human
caggugaagaccacucugauagaggcuccagg

SEQ ID NO: 355144 - RNA, 32 nt, Human
caggugaagagcaaccacaaguuuaaugaaga

SEQ ID NO: 355145 - RNA, 32 nt, Human
caggugaaggugucugcagcacacacagugag

SEQ ID NO: 355146 - RNA, 32 nt, Human
caggugaauccagcagcuccagagagacagcg

SEQ ID NO: 355147 - RNA, 32 nt, Human
caggugacacuggaggaaugaagaauaggcac

SEQ ID NO: 355148 - RNA, 32 nt, Human
caggugacagugcccaccacaggccaaauaac

SEQ ID NO: 355149 - RNA, 32 nt, Human
caggugaccagaaugaggcacaugacaguggu

SEQ ID NO: 355150 - RNA, 32 nt, Human
caggugacccacccgccucggccucucaaaau

SEQ ID NO: 355151 - RNA, 31 nt, Human
caggugacgggagaggagguuggagguguag

SEQ ID NO: 355152 - RNA, 32 nt, Human
caggugacuuccaaagaaugagucagguggca

SEQ ID NO: 355153 - RNA, 32 nt, Human
caggugagaaaacaggcuaauaacuuccauga

SEQ ID NO: 355154 - RNA, 32 nt, Human
caggugagagugaccugcagucucacucaucc

SEQ ID NO: 355155 - RNA, 21 nt, Human
caggugagauaaugggccagg

SEQ ID NO: 355156 - RNA, 32 nt, Human
caggugagcaccacuguaccuggcuagcuacu

SEQ ID NO: 355157 - RNA, 32 nt, Human
caggugagccugggagccugacagggccagug

SEQ ID NO: 355158 - RNA, 32 nt, Human
caggugagcugcugugaaggacucauucuugg

SEQ ID NO: 355159 - RNA, 32 nt, Human
caggugagcuggggaaggaagugagcauggcc

SEQ ID NO: 355160 - RNA, 32 nt, Human
caggugagcuguggaggugggguccuuggaag

SEQ ID NO: 355161 - RNA, 32 nt, Human
caggugaggaaggguuuaaccucacuggaagg

SEQ ID NO: 355162 - RNA, 32 nt, Human
caggugagggcaagaugaaggcuuccaggcag

SEQ ID NO: 355163 - RNA, 32 nt, Human
caggugagggcaggggacaaggugcagcugag

SEQ ID NO: 355164 - RNA, 32 nt, Human
caggugagggucugagacuagagcauccaggg

SEQ ID NO: 355165 - RNA, 24 nt, Human
caggugagguggcucaccccugua

SEQ ID NO: 355166 - RNA, 32 nt, Human
caggugaguaacaccaguaccaccugccgggu

SEQ ID NO: 355167 - RNA, 25 nt, Human
caggugaguccuagagcuacagggg

SEQ ID NO: 355168 - RNA, 32 nt, Human
caggugaguggaggcaggagccacgggugggg

SEQ ID NO: 355169 - RNA, 32 nt, Human
caggugauacuauuucaugaaggugguaccaa

SEQ ID NO: 355170 - RNA, 32 nt, Human
caggugauccacccaccucagccuccaaaagu

SEQ ID NO: 355171 - RNA, 32 nt, Human
caggugauccacccaccucagccuccgaaagu

SEQ ID NO: 355172 - RNA, 32 nt, Human
caggugauccacccaccucugccuccaaagug

SEQ ID NO: 355173 - RNA, 32 nt, Human
caggugauccacccgccucggccuccgaaagu

SEQ ID NO: 355174 - RNA, 32 nt, Human
caggugaucccaagaccugcagcuucagcauc

SEQ ID NO: 355175 - RNA, 32 nt, Human
caggugaugccauuacagaaccaaaucauggc

SEQ ID NO: 355176 - RNA, 32 nt, Human
caggugaugccauuacagaaccaaaucguggc

SEQ ID NO: 355177 - RNA, 32 nt, Human
caggugauguccuaggugcugcagugaacaga

SEQ ID NO: 355178 - RNA, 32 nt, Human
caggugaugugcugggagugugggcggccucc

SEQ ID NO: 355179 - RNA, 32 nt, Human
caggugauguuaagucacaaggugcugcuuuu

SEQ ID NO: 355180 - RNA, 32 nt, Human
caggugauucagauuuggacagccugagccag

SEQ ID NO: 355181 - RNA, 32 nt, Human
caggugcaacacucaagucuauugaauaaugu

SEQ ID NO: 355182 - RNA, 32 nt, Human
caggugcaauucuucuuggucucagcuccaau

SEQ ID NO: 355183 - RNA, 32 nt, Human
caggugcacaugcuuccagaugccacauguga

SEQ ID NO: 355184 - RNA, 32 nt, Human
caggugcaccacugccgucauuucagcuucug

SEQ ID NO: 355185 - RNA, 18 nt, Human
caggugcacgccaccacg

SEQ ID NO: 355186 - RNA, 32 nt, Human
caggugcacuccucagaccugugcacaggaag

SEQ ID NO: 355187 - RNA, 32 nt, Human
caggugcagagccucaacuaccccagauggua

SEQ ID NO: 355188 - RNA, 32 nt, Human
caggugcagccuggcuucugucuguaucucag

SEQ ID NO: 355189 - RNA, 32 nt, Human
caggugcagccuguccucuccuuccccugacc

SEQ ID NO: 355190 - RNA, 32 nt, Human
caggugcaggggaccccuggaaagugggggcu

SEQ ID NO: 355191 - RNA, 32 nt, Human
caggugcaggucuuugccgguuaaguaaggga

SEQ ID NO: 355192 - RNA, 32 nt, Human
caggugcagguguuagugcaggaccggaaggg

SEQ ID NO: 355193 - RNA, 32 nt, Human
caggugcagguucuuagcaccuccgcagccgc

SEQ ID NO: 355194 - RNA, 32 nt, Human
caggugcagguuucccagcagcucaggcaaga

SEQ ID NO: 355195 - RNA, 32 nt, Human
caggugcaugcacuaccaugcccagcuuucuc

SEQ ID NO: 355196 - RNA, 32 nt, Human
caggugcaugccaccacgccugacuaauuuuu

SEQ ID NO: 355197 - RNA, 32 nt, Human
caggugcaugccaccacugccuggcuaauuuu

SEQ ID NO: 355198 - RNA, 32 nt, Human
caggugcaugguuacagccacagggaggcaug

SEQ ID NO: 355199 - RNA, 32 nt, Human
caggugccaccagggagggguggaggggcuuu

SEQ ID NO: 355200 - RNA, 32 nt, Human
caggugccagcacaugcugggcuucguucgcu

SEQ ID NO: 355201 - RNA, 32 nt, Human
caggugccagccaccaugcccagcuaauuugu

SEQ ID NO: 355202 - RNA, 18 nt, Human
caggugcccaccaccacg

SEQ ID NO: 355203 - RNA, 32 nt, Human
caggugcccaccggccucggccuggaugggca

SEQ ID NO: 355204 - RNA, 32 nt, Human
caggugcccagaggaagcuuggaggcugcuac

SEQ ID NO: 355205 - RNA, 32 nt, Human
caggugcccagcuauaccugugccucggcuuu

SEQ ID NO: 355206 - RNA, 32 nt, Human
caggugccccagcugcuucgggcugccgagga

SEQ ID NO: 355207 - RNA, 32 nt, Human
caggugcccgccaccacacccaacuaauuuuu

SEQ ID NO: 355208 - RNA, 32 nt, Human
caggugcccucacuuacugccugggccccugc

SEQ ID NO: 355209 - RNA, 32 nt, Human
caggugcccucaucguggucugugccaugucc

SEQ ID NO: 355210 - RNA, 32 nt, Human
caggugcccuggagggaaggggaagccugugg

SEQ ID NO: 355211 - RNA, 32 nt, Human
caggugccuaaccugggaccuguggucaugug

SEQ ID NO: 355212 - RNA, 32 nt, Human
caggugccucaagagaaggcaaccuugacucu

SEQ ID NO: 355213 - RNA, 32 nt, Human
caggugccucuguggucucuucucauccucac

SEQ ID NO: 355214 - RNA, 32 nt, Human
caggugccugcauuuccagccucguggcucac

SEQ ID NO: 355215 - RNA, 32 nt, Human
caggugccugggagggcugcugcagugggguc

SEQ ID NO: 355216 - RNA, 32 nt, Human
caggugccuguaaucccagcacuuugggaagc

SEQ ID NO: 355217 - RNA, 32 nt, Human
caggugccuguaaucccagcuacuggggaaag

SEQ ID NO: 355218 - RNA, 32 nt, Human
caggugccuguaaucccagcuacuugggaggc

SEQ ID NO: 355219 - RNA, 32 nt, Human
caggugccuguaauccuagcuacuuggcaggc

SEQ ID NO: 355220 - RNA, 21 nt, Human
caggugccugugcugaugcca

SEQ ID NO: 355221 - RNA, 29 nt, Human
caggugccuguggcugugccugggagugg

SEQ ID NO: 355222 - RNA, 32 nt, Human
caggugccuuaaaaaguauuccaaguuuacuc

SEQ ID NO: 355223 - RNA, 32 nt, Human
caggugccuucccagacacuggcguuacugcu

SEQ ID NO: 355224 - RNA, 32 nt, Human
caggugccuugaacgcagcccaucuucauguc

SEQ ID NO: 355225 - RNA, 18 nt, Human
caggugcgcgccaccacg

SEQ ID NO: 355226 - RNA, 23 nt, Human
caggugcgggcaggugggccugg

SEQ ID NO: 355227 - RNA, 32 nt, Human
caggugcgggggcagagggugacuuaccaaga

SEQ ID NO: 355228 - RNA, 32 nt, Human
caggugcggugacucaugccuguaaucccugc

SEQ ID NO: 355229 - RNA, 32 nt, Human
caggugcuaagauguugagugguggggcugga

SEQ ID NO: 355230 - RNA, 32 nt, Human
caggugcuagaaacuuuaugucaaaguggcca

SEQ ID NO: 355231 - RNA, 32 nt, Human
caggugcuaggugccaggguugcaguucacgu

SEQ ID NO: 355232 - RNA, 31 nt, Human
caggugcucaauaaacacuuguagagcagau

SEQ ID NO: 355233 - RNA, 32 nt, Human
caggugcucaccagcuccugugcucucgaccu

SEQ ID NO: 355234 - RNA, 32 nt, Human
caggugcucagcucugcagggugggggcaauu

SEQ ID NO: 355235 - RNA, 32 nt, Human
caggugcuccaaccaccuuauuuccuuguuuu

SEQ ID NO: 355236 - RNA, 16 nt, Human
caggugcuccaccacg

SEQ ID NO: 355237 - RNA, 32 nt, Human
caggugcuccaggcugugaucugcacccucug

SEQ ID NO: 355238 - RNA, 32 nt, Human
caggugcucggguguggagcuggagccaugug

SEQ ID NO: 355239 - RNA, 32 nt, Human
caggugcucugugagaagugcaagagcacgcu

SEQ ID NO: 355240 - RNA, 32 nt, Human
caggugcugaaccaacaucaucaguuucuauu

SEQ ID NO: 355241 - RNA, 32 nt, Human
caggugcugaagauaaggaaacccgggaccuc

SEQ ID NO: 355242 - RNA, 32 nt, Human
caggugcugacucccgcacucccuggcauuuu

SEQ ID NO: 355243 - RNA, 32 nt, Human
caggugcugcagcuccaccucagagggcacug

SEQ ID NO: 355244 - RNA, 32 nt, Human
caggugcugcugagagccaacagccauucagc

SEQ ID NO: 355245 - RNA, 32 nt, Human
caggugcuggagcacugggcucccgggcccca

SEQ ID NO: 355246 - RNA, 32 nt, Human
caggugcuggaggccguggcagcggagggugg

SEQ ID NO: 355247 - RNA, 32 nt, Human
caggugcugucacggcuuccugccuucguaua

SEQ ID NO: 355248 - RNA, 32 nt, Human
caggugcuuaaagggacauuguaggagguacu

SEQ ID NO: 355249 - RNA, 18 nt, Human
caggugcuucaccgcaga

SEQ ID NO: 355250 - RNA, 32 nt, Human
caggugcuuguaaucccagcuacuugggaggc

SEQ ID NO: 355251 - RNA, 32 nt, Human
cagguggaaauaaacaacaacuuuauuaaaac

SEQ ID NO: 355252 - RNA, 31 nt, Human
cagguggaaguggaaagaagccuguggagcu

SEQ ID NO: 355253 - RNA, 32 nt, Human
cagguggaaugucagaagacugagaacauugu

SEQ ID NO: 355254 - RNA, 32 nt, Human
cagguggacaaggaugucagugugaagaugga

SEQ ID NO: 355255 - RNA, 19 nt, Human
cagguggacagggcuucuu

SEQ ID NO: 355256 - RNA, 32 nt, Human
cagguggacgaggaugucagugugaagaugga

SEQ ID NO: 355257 - RNA, 32 nt, Human
cagguggacuccagggcaccggcuuuauuucu

SEQ ID NO: 355258 - RNA, 32 nt, Human
cagguggagacccugagaaggacccugggagc

SEQ ID NO: 355259 - RNA, 32 nt, Human
cagguggagagggcgggcaggggagagaccca

SEQ ID NO: 355260 - RNA, 32 nt, Human
cagguggagauccaaguggaggugggagcgga

SEQ ID NO: 355261 - RNA, 32 nt, Human
cagguggagauggaaggagaaacagcauccgg

SEQ ID NO: 355262 - RNA, 24 nt, Human
cagguggagccaggugucugaaaa

SEQ ID NO: 355263 - RNA, 32 nt, Human
cagguggagccccggcuccugagcaagcagau

SEQ ID NO: 355264 - RNA, 32 nt, Human
cagguggaggcagagauuagagaggggcuguc

SEQ ID NO: 355265 - RNA, 32 nt, Human
cagguggaggcggcggcggcagaggaguggga

SEQ ID NO: 355266 - RNA, 32 nt, Human
cagguggaggugcggcuucagugcgccuuggc

SEQ ID NO: 355267 - RNA, 32 nt, Human
cagguggaggugguugugggugcaggugugug

SEQ ID NO: 355268 - RNA, 21 nt, Human
cagguggagugggugggcagg

SEQ ID NO: 355269 - RNA, 21 nt, Human
cagguggaucacaaggucagg

SEQ ID NO: 355270 - RNA, 20 nt, Human
cagguggaucaccugagguc

SEQ ID NO: 355271 - RNA, 23 nt, Human
cagguggaucaccugaggucagg

SEQ ID NO: 355272 - RNA, 23 nt, Human
cagguggaucaccugagguuagg

SEQ ID NO: 355273 - RNA, 21 nt, Human
cagguggaucacgaggccagg

SEQ ID NO: 355274 - RNA, 32 nt, Human
cagguggaucacgaggccaggagaucgagacc

SEQ ID NO: 355275 - RNA, 21 nt, Human
cagguggaucacgaggucagg

SEQ ID NO: 355276 - RNA, 32 nt, Human
cagguggaucacgaggucaggagacagagacc

SEQ ID NO: 355277 - RNA, 32 nt, Human
cagguggaucacuggagugcaggaguucaaga

SEQ ID NO: 355278 - RNA, 32 nt, Human
cagguggaugagcucaguccugggcuuucggu

SEQ ID NO: 355279 - RNA, 32 nt, Human
cagguggaugaggaugucagugugaagaugga

SEQ ID NO: 355280 - RNA, 32 nt, Human
cagguggauugaugagacuccuccaguggacc

SEQ ID NO: 355281 - RNA, 20 nt, Human
cagguggauugcuugagcca

SEQ ID NO: 355282 - RNA, 32 nt, Human
cagguggcaccacugccgucauuucagcuucu

SEQ ID NO: 355283 - RNA, 32 nt, Human
cagguggcaccacugccuucauuucagcuucc

SEQ ID NO: 355284 - RNA, 22 nt, Human
cagguggcaccugcagcggcug

SEQ ID NO: 355285 - RNA, 20 nt, Human
cagguggcagcaggcagcag

SEQ ID NO: 355286 - RNA, 32 nt, Human
cagguggcaggcaggggugaccugcuggcccu

SEQ ID NO: 355287 - RNA, 32 nt, Human
cagguggccuccaggaggcagcugggaaaagg

SEQ ID NO: 355288 - RNA, 32 nt, Human
cagguggccugggagguggcccccucgaggau

SEQ ID NO: 355289 - RNA, 23 nt, Human
cagguggcggagguugcagugag

SEQ ID NO: 355290 - RNA, 32 nt, Human
cagguggcgggagccgccacacccagccuggu

SEQ ID NO: 355291 - RNA, 18 nt, Human
cagguggcguuccagccc

SEQ ID NO: 355292 - RNA, 32 nt, Human
cagguggcuccggucggagguggagaacuugg

SEQ ID NO: 355293 - RNA, 32 nt, Human
cagguggcugccugagccccagaggcacccug

SEQ ID NO: 355294 - RNA, 32 nt, Human
cagguggcuggacugagugucccccaggccca

SEQ ID NO: 355295 - RNA, 18 nt, Human
cagguggcuggagcugaa

SEQ ID NO: 355296 - RNA, 32 nt, Human
caggugggaagugggagccggagcggcagcug

SEQ ID NO: 355297 - RNA, 32 nt, Human
caggugggaauugagggugagggguuugggga

SEQ ID NO: 355298 - RNA, 32 nt, Human
caggugggagccaccgcacccagccugcaggu

SEQ ID NO: 355299 - RNA, 32 nt, Human
caggugggagccacugcacccggccugaauga

SEQ ID NO: 355300 - RNA, 32 nt, Human
caggugggaggcacagauuguccgugggaggg

SEQ ID NO: 355301 - RNA, 32 nt, Human
caggugggaggugugguugcaggugcgggcug

SEQ ID NO: 355302 - RNA, 32 nt, Human
caggugggcacuggagcaugcagaggagguga

SEQ ID NO: 355303 - RNA, 25 nt, Human
caggugggcagaucacgaggucagg

SEQ ID NO: 355304 - RNA, 32 nt, Human
caggugggcaggagacaggggcuuggaggagg

SEQ ID NO: 355305 - RNA, 31 nt, Human
caggugggccucucuaggaucagugucccac

SEQ ID NO: 355306 - RNA, 32 nt, Human
caggugggcugaggggcagggagccggcugug

SEQ ID NO: 355307 - RNA, 32 nt, Human
caggugggcuggaggggacaagcccuaucccu

SEQ ID NO: 355308 - RNA, 32 nt, Human
cagguggggaccccgcuccccaacaccugucu

SEQ ID NO: 355309 - RNA, 23 nt, Human
cagguggggcagccugaacccug

SEQ ID NO: 355310 - RNA, 32 nt, Human
cagguggggcaggaaugguauggggaaguaga

SEQ ID NO: 355311 - RNA, 32 nt, Human
cagguggggcuggccucagggccacggcaucu

SEQ ID NO: 355312 - RNA, 32 nt, Human
caggugggguacucgggaagcuggagcgggcc

SEQ ID NO: 355313 - RNA, 32 nt, Human
cagguggguggaggggagacgcucaggaggug

SEQ ID NO: 355314 - RNA, 32 nt, Human
cagguggguggggcacaugggacagggcuacc

SEQ ID NO: 355315 - RNA, 18 nt, Human
caggugguacagagccag

SEQ ID NO: 355316 - RNA, 32 nt, Human
caggugguacagccgugcacaccagugucgug

SEQ ID NO: 355317 - RNA, 32 nt, Human
cagguggucccuccagcccugguuaggcacug

SEQ ID NO: 355318 - RNA, 19 nt, Human
cagguggugaccaugggaa

SEQ ID NO: 355319 - RNA, 32 nt, Human
cagguggugagcugcuggugggugaggguguc

SEQ ID NO: 355320 - RNA, 32 nt, Human
cagguggugagcugguggcucucuggugagcu

SEQ ID NO: 355321 - RNA, 32 nt, Human
cagguggugagguugagguuuggggcuuggua

SEQ ID NO: 355322 - RNA, 32 nt, Human
cagguggugcucuucauagugaugucauuaga

SEQ ID NO: 355323 - RNA, 32 nt, Human
cagguggugcuuggaagagaugaaagaucuuc

SEQ ID NO: 355324 - RNA, 32 nt, Human
cagguggugggaccgcuaguuuugaagaagcc

SEQ ID NO: 355325 - RNA, 19 nt, Human
caggugguugcccccuccc

SEQ ID NO: 355326 - RNA, 32 nt, Human
caggugguugugguguagacugugucaggccu

SEQ ID NO: 355327 - RNA, 22 nt, Human
cagguguacagcugcugucccu

SEQ ID NO: 355328 - RNA, 32 nt, Human
cagguguagcauguccugcuuccguuuuucau

SEQ ID NO: 355329 - RNA, 32 nt, Human
cagguguagggaccccuugaggggccaagcug

SEQ ID NO: 355330 - RNA, 32 nt, Human
cagguguagggagugaagaagcaaaaagagga

SEQ ID NO: 355331 - RNA, 32 nt, Human
cagguguauaaauaucuaaaauacauauugaa

SEQ ID NO: 355332 - RNA, 32 nt, Human
cagguguaucagaagauucuggguuugcaguc

SEQ ID NO: 355333 - RNA, 32 nt, Human
cagguguauuccccucuacuugcccaugugcu

SEQ ID NO: 355334 - RNA, 32 nt, Human
caggugucacugaugcuacagaacagcucugc

SEQ ID NO: 355335 - RNA, 32 nt, Human
caggugucauuuaucuaugaccaauaggaaga

SEQ ID NO: 355336 - RNA, 19 nt, Human
caggugucccacagcaaca

SEQ ID NO: 355337 - RNA, 32 nt, Human
cagguguccugaggcucccugcacugccacag

SEQ ID NO: 355338 - RNA, 32 nt, Human
caggugucucacuguguuguccaggcuggucu

SEQ ID NO: 355339 - RNA, 32 nt, Human
caggugucucuaaggccagggcucaggggaaa

SEQ ID NO: 355340 - RNA, 32 nt, Human
caggugucucuagcacaggacuuggcaccaag

SEQ ID NO: 355341 - RNA, 32 nt, Human
caggugucugcuggcuuccugcucucccugcu

SEQ ID NO: 355342 - RNA, 32 nt, Human
caggugugaacaagcaugucucuacgaaugaa

SEQ ID NO: 355343 - RNA, 32 nt, Human
caggugugacaccuucagcaggucucagggaa

SEQ ID NO: 355344 - RNA, 32 nt, Human
caggugugagccacagcaccuggccaaccaac

SEQ ID NO: 355345 - RNA, 32 nt, Human
caggugugagccacagcgccuggcccagugua

SEQ ID NO: 355346 - RNA, 32 nt, Human
caggugugagccacagugccuggcccauucuu

SEQ ID NO: 355347 - RNA, 32 nt, Human
caggugugagccaccacaccaggccagagcua

SEQ ID NO: 355348 - RNA, 32 nt, Human
caggugugagccaccacacccagccaacauuu

SEQ ID NO: 355349 - RNA, 32 nt, Human
caggugugagccaccacacccagccaauuagg

SEQ ID NO: 355350 - RNA, 32 nt, Human
caggugugagccaccacacccagccaugaauc

SEQ ID NO: 355351 - RNA, 32 nt, Human
caggugugagccaccacacccagcccaggcuc

SEQ ID NO: 355352 - RNA, 32 nt, Human
caggugugagccaccacacccagccucuguag

SEQ ID NO: 355353 - RNA, 32 nt, Human
caggugugagccaccacacccggccaaccaaa

SEQ ID NO: 355354 - RNA, 32 nt, Human
caggugugagccaccacaccugcccccgcccc

SEQ ID NO: 355355 - RNA, 32 nt, Human
caggugugagccaccacaccuggccaagaaua

SEQ ID NO: 355356 - RNA, 32 nt, Human
caggugugagccaccacaccuggcccauaguu

SEQ ID NO: 355357 - RNA, 32 nt, Human
caggugugagccaccacaccuggccccaaaua

SEQ ID NO: 355358 - RNA, 32 nt, Human
caggugugagccaccacaccuggcuaauuuuu

SEQ ID NO: 355359 - RNA, 32 nt, Human
caggugugagccaccacacugggccaaugcuu

SEQ ID NO: 355360 - RNA, 32 nt, Human
caggugugagccaccacacuuggccaguauau

SEQ ID NO: 355361 - RNA, 32 nt, Human
caggugugagccaccacagccagccaguauga

SEQ ID NO: 355362 - RNA, 32 nt, Human
caggugugagccaccacagccagccuaaaaau

SEQ ID NO: 355363 - RNA, 32 nt, Human
caggugugagccaccacauccagccuaacuua

SEQ ID NO: 355364 - RNA, 32 nt, Human
caggugugagccaccacgaucagccucuagug

SEQ ID NO: 355365 - RNA, 32 nt, Human
caggugugagccaccacgccagccugacgaug

SEQ ID NO: 355366 - RNA, 32 nt, Human
caggugugagccaccacgcccagccaugaaga

SEQ ID NO: 355367 - RNA, 32 nt, Human
caggugugagccaccacgcccagccuagaaau

SEQ ID NO: 355368 - RNA, 32 nt, Human
caggugugagccaccacgcccagccuguggcc

SEQ ID NO: 355369 - RNA, 32 nt, Human
caggugugagccaccacgcccggccaaggcag

SEQ ID NO: 355370 - RNA, 32 nt, Human
caggugugagccaccacgcccggccgauuugg

SEQ ID NO: 355371 - RNA, 32 nt, Human
caggugugagccaccacgccuggacuauaaaa

SEQ ID NO: 355372 - RNA, 32 nt, Human
caggugugagccaccacgccuggcuaauuuug

SEQ ID NO: 355373 - RNA, 32 nt, Human
caggugugagccaccacgccugggcccaugaa

SEQ ID NO: 355374 - RNA, 32 nt, Human
caggugugagccaccacguccggccaauuuuu

SEQ ID NO: 355375 - RNA, 32 nt, Human
caggugugagccaccacucccagccugauuua

SEQ ID NO: 355376 - RNA, 32 nt, Human
caggugugagccaccaggcccagccuauaucu

SEQ ID NO: 355377 - RNA, 32 nt, Human
caggugugagccaccaggcucagcccccuaag

SEQ ID NO: 355378 - RNA, 32 nt, Human
caggugugagccaccauaccuggccaauuuuu

SEQ ID NO: 355379 - RNA, 32 nt, Human
caggugugagccaccaugccaggcccucuuaa

SEQ ID NO: 355380 - RNA, 32 nt, Human
caggugugagccaccaugcccaacacccacug

SEQ ID NO: 355381 - RNA, 32 nt, Human
caggugugagccaccaugcccagcccaaaaau

SEQ ID NO: 355382 - RNA, 32 nt, Human
caggugugagccaccaugcccagccucuucaa

SEQ ID NO: 355383 - RNA, 32 nt, Human
caggugugagccaccaugcccagccugaauga

SEQ ID NO: 355384 - RNA, 32 nt, Human
caggugugagccaccaugcccagccuguuccu

SEQ ID NO: 355385 - RNA, 32 nt, Human
caggugugagccaccaugcccggccuucuccu

SEQ ID NO: 355386 - RNA, 32 nt, Human
caggugugagccaccaugcccggccuuguuau

SEQ ID NO: 355387 - RNA, 32 nt, Human
caggugugagccaccaugcccggcuaauuuuu

SEQ ID NO: 355388 - RNA, 32 nt, Human
caggugugagccaccaugccuggccccaugaa

SEQ ID NO: 355389 - RNA, 32 nt, Human
caggugugagccaccaugccuggccgugguuu

SEQ ID NO: 355390 - RNA, 32 nt, Human
caggugugagccaccaugccuggccuaaacua

SEQ ID NO: 355391 - RNA, 32 nt, Human
caggugugagccaccaugccuggccugcuuug

SEQ ID NO: 355392 - RNA, 32 nt, Human
caggugugagccaccaugccuggcucuggaaa

SEQ ID NO: 355393 - RNA, 32 nt, Human
caggugugagccaccaugccugggcuaaacuc

SEQ ID NO: 355394 - RNA, 32 nt, Human
caggugugagccaccaugccuggucacccugc

SEQ ID NO: 355395 - RNA, 32 nt, Human
caggugugagccaccaugcucugccaauuauu

SEQ ID NO: 355396 - RNA, 32 nt, Human
caggugugagccaccaugucuggccuugauuc

SEQ ID NO: 355397 - RNA, 32 nt, Human
caggugugagccacccugcccagccgucaaaa

SEQ ID NO: 355398 - RNA, 32 nt, Human
caggugugagccaccgcacccagccuauguuc

SEQ ID NO: 355399 - RNA, 32 nt, Human
caggugugagccaccgcacccagccucaauuu

SEQ ID NO: 355400 - RNA, 32 nt, Human
caggugugagccaccgcacccggccaacuuuc

SEQ ID NO: 355401 - RNA, 32 nt, Human
caggugugagccaccgcacccggcuggccaau

SEQ ID NO: 355402 - RNA, 32 nt, Human
caggugugagccaccgcacccugccaaguuau

SEQ ID NO: 355403 - RNA, 32 nt, Human
caggugugagccaccgcaccuggccagaagcc

SEQ ID NO: 355404 - RNA, 32 nt, Human
caggugugagccaccgcaccuggccagaccgc

SEQ ID NO: 355405 - RNA, 32 nt, Human
caggugugagccaccgcaccuggccugcuuuu

SEQ ID NO: 355406 - RNA, 32 nt, Human
caggugugagccaccgcgcccagccaagaaua

SEQ ID NO: 355407 - RNA, 32 nt, Human
caggugugagccaccgcgcccagccaccuuuc

SEQ ID NO: 355408 - RNA, 32 nt, Human
caggugugagccaccgcgcccggccgagaaug

SEQ ID NO: 355409 - RNA, 32 nt, Human
caggugugagccaccgcgccugaccaacuuua

SEQ ID NO: 355410 - RNA, 32 nt, Human
caggugugagccaccgcgccuggcccucaaga

SEQ ID NO: 355411 - RNA, 32 nt, Human
caggugugagccaccgcgccuggcccuguauu

SEQ ID NO: 355412 - RNA, 32 nt, Human
caggugugagccaccgcgccuggccuauuauu

SEQ ID NO: 355413 - RNA, 32 nt, Human
caggugugagccaccgcgccuggccugggcug

SEQ ID NO: 355414 - RNA, 32 nt, Human
caggugugagccaccgcgcucggccagagcuc

SEQ ID NO: 355415 - RNA, 32 nt, Human
caggugugagccaccgcguccagccagcuuua

SEQ ID NO: 355416 - RNA, 32 nt, Human
caggugugagccaccgugaccagccaaugugc

SEQ ID NO: 355417 - RNA, 32 nt, Human
caggugugagccaccgugcacggccggccuga

SEQ ID NO: 355418 - RNA, 32 nt, Human
caggugugagccaccgugcccagccuauacuu

SEQ ID NO: 355419 - RNA, 32 nt, Human
caggugugagccaccgugcccaggcccucagu

SEQ ID NO: 355420 - RNA, 32 nt, Human
caggugugagccaccgugcccggccaaguaaa

SEQ ID NO: 355421 - RNA, 32 nt, Human
caggugugagccaccgugcccggccaccagaa

SEQ ID NO: 355422 - RNA, 32 nt, Human
caggugugagccaccgugcccggcccagauag

SEQ ID NO: 355423 - RNA, 32 nt, Human
caggugugagccaccgugcccggcccauucua

SEQ ID NO: 355424 - RNA, 32 nt, Human
caggugugagccaccgugcccggccucuuuuu

SEQ ID NO: 355425 - RNA, 32 nt, Human
caggugugagccaccgugccuggccaauucca

SEQ ID NO: 355426 - RNA, 32 nt, Human
caggugugagccaccgugccuggccagugugu

SEQ ID NO: 355427 - RNA, 32 nt, Human
caggugugagccaccgugccuggccgaggcuc

SEQ ID NO: 355428 - RNA, 32 nt, Human
caggugugagccacggcacccugccgaaucuu

SEQ ID NO: 355429 - RNA, 32 nt, Human
caggugugagccacggcaccuggccagaacuc

SEQ ID NO: 355430 - RNA, 32 nt, Human
caggugugagccacuauacccgaccagaucaa

SEQ ID NO: 355431 - RNA, 32 nt, Human
caggugugagccacuaugccuggccuucccua

SEQ ID NO: 355432 - RNA, 32 nt, Human
caggugugagccacucugccuggccuaccacu

SEQ ID NO: 355433 - RNA, 32 nt, Human
caggugugagccacugagcccagccauuuagg

SEQ ID NO: 355434 - RNA, 32 nt, Human
caggugugagccacugagcccggccacagugc

SEQ ID NO: 355435 - RNA, 32 nt, Human
caggugugagccacugcaacuggcuauauuaa

SEQ ID NO: 355436 - RNA, 32 nt, Human
caggugugagccacugcacccacccaagacaa

SEQ ID NO: 355437 - RNA, 32 nt, Human
caggugugagccacugcacccagccuaccuug

SEQ ID NO: 355438 - RNA, 32 nt, Human
caggugugagccacugcacccagccugugaug

SEQ ID NO: 355439 - RNA, 32 nt, Human
caggugugagccacugcacccagcugagagug

SEQ ID NO: 355440 - RNA, 32 nt, Human
caggugugagccacugcacccggccaacuauc

SEQ ID NO: 355441 - RNA, 32 nt, Human
caggugugagccacugcacccggccacaagau

SEQ ID NO: 355442 - RNA, 32 nt, Human
caggugugagccacugcacccggccugaaauu

SEQ ID NO: 355443 - RNA, 32 nt, Human
caggugugagccacugcaccucgccagauguc

SEQ ID NO: 355444 - RNA, 32 nt, Human
caggugugagccacugcaccuggccaugguua

SEQ ID NO: 355445 - RNA, 32 nt, Human
caggugugagccacugcaccuggccuccuuaa

SEQ ID NO: 355446 - RNA, 32 nt, Human
caggugugagccacugcaccuggcucuaauag

SEQ ID NO: 355447 - RNA, 32 nt, Human
caggugugagccacugcacguggccuaaaagu

SEQ ID NO: 355448 - RNA, 32 nt, Human
caggugugagccacugcgcccagccagcacau

SEQ ID NO: 355449 - RNA, 32 nt, Human
caggugugagccacugcgcccagccuauacau

SEQ ID NO: 355450 - RNA, 32 nt, Human
caggugugagccacugcgcccagccugaauca

SEQ ID NO: 355451 - RNA, 32 nt, Human
caggugugagccacugcgcccagucaugccca

SEQ ID NO: 355452 - RNA, 32 nt, Human
caggugugagccacugcgcccggccaugccug

SEQ ID NO: 355453 - RNA, 32 nt, Human
caggugugagccacugcgccuggccuaaacaa

SEQ ID NO: 355454 - RNA, 32 nt, Human
caggugugagccacugcgccuggccuguugcu

SEQ ID NO: 355455 - RNA, 32 nt, Human
caggugugagccacugugcccagccuaauugc

SEQ ID NO: 355456 - RNA, 32 nt, Human
caggugugagccacugugcccagccucuucuc

SEQ ID NO: 355457 - RNA, 32 nt, Human
caggugugagccacugugcccagccucuuuug

SEQ ID NO: 355458 - RNA, 32 nt, Human
caggugugagccacugugcccggccaaaagaa

SEQ ID NO: 355459 - RNA, 32 nt, Human
caggugugagccacugugccuaccagcuuuua

SEQ ID NO: 355460 - RNA, 32 nt, Human
caggugugagccacugugccuagccuauaaug

SEQ ID NO: 355461 - RNA, 32 nt, Human
caggugugagccacugugccuggccuccggug

SEQ ID NO: 355462 - RNA, 32 nt, Human
caggugugagccacugugccuggccugauuac

SEQ ID NO: 355463 - RNA, 32 nt, Human
caggugugagccacugugccuggccuucuagu

SEQ ID NO: 355464 - RNA, 32 nt, Human
caggugugagccacugugccuggcuggcagag

SEQ ID NO: 355465 - RNA, 32 nt, Human
caggugugagccacugugcucggccuaccuuu

SEQ ID NO: 355466 - RNA, 32 nt, Human
caggugugagccacuguguccagccuguaacu

SEQ ID NO: 355467 - RNA, 32 nt, Human
caggugugagccacugugucuagccaaguuuc

SEQ ID NO: 355468 - RNA, 32 nt, Human
caggugugagccacuucacccagccacauuua

SEQ ID NO: 355469 - RNA, 32 nt, Human
caggugugagccaucacacucggccaaagcua

SEQ ID NO: 355470 - RNA, 32 nt, Human
caggugugagccaucacgcucggccaagaguu

SEQ ID NO: 355471 - RNA, 32 nt, Human
caggugugagccaucgcgcccggccaacuuuu

SEQ ID NO: 355472 - RNA, 32 nt, Human
caggugugagccaucgcgccuggccaggaccu

SEQ ID NO: 355473 - RNA, 32 nt, Human
caggugugagccauugugccuggccaaguuua

SEQ ID NO: 355474 - RNA, 32 nt, Human
caggugugaggacaagaaugcaaauggcucuu

SEQ ID NO: 355475 - RNA, 32 nt, Human
caggugugaguccucuguuugcacuggacaua

SEQ ID NO: 355476 - RNA, 32 nt, Human
caggugugaugggcacaguacgcagagcaagc

SEQ ID NO: 355477 - RNA, 32 nt, Human
caggugugcaccaccacaccaggcuaauuuuu

SEQ ID NO: 355478 - RNA, 32 nt, Human
caggugugcaccaccacacccggcuaauuuuu

SEQ ID NO: 355479 - RNA, 32 nt, Human
caggugugcaccaccacaccuggcuaauucuu

SEQ ID NO: 355480 - RNA, 18 nt, Human
caggugugcaccaccacg

SEQ ID NO: 355481 - RNA, 32 nt, Human
caggugugcaccaccacgcccggcuaacuuuu

SEQ ID NO: 355482 - RNA, 32 nt, Human
caggugugcaccaccacgcccggcuaauuuuu

SEQ ID NO: 355483 - RNA, 32 nt, Human
caggugugcaccaccacgccuggcuaaauuuu

SEQ ID NO: 355484 - RNA, 18 nt, Human
caggugugcaccaccaug

SEQ ID NO: 355485 - RNA, 32 nt, Human
caggugugcaccaccauuccuggcuaauuuuu

SEQ ID NO: 355486 - RNA, 18 nt, Human
caggugugcaccaccgcg

SEQ ID NO: 355487 - RNA, 32 nt, Human
caggugugcaccaccgcgccuggcuaauuuug

SEQ ID NO: 355488 - RNA, 32 nt, Human
caggugugcaccacuaugccuggcuaauuuug

SEQ ID NO: 355489 - RNA, 32 nt, Human
caggugugcaccacugcgucuggcuagcuaau

SEQ ID NO: 355490 - RNA, 32 nt, Human
caggugugcagaccgcucucucugccuuccuu

SEQ ID NO: 355491 - RNA, 32 nt, Human
caggugugccugacauuugcaaaagauauucc

SEQ ID NO: 355492 - RNA, 32 nt, Human
caggugugccuguugcuuucuuccugcauagu

SEQ ID NO: 355493 - RNA, 18 nt, Human
caggugugcgccaccacg

SEQ ID NO: 355494 - RNA, 32 nt, Human
caggugugcuguuugcccagaagccugugguc

SEQ ID NO: 355495 - RNA, 32 nt, Human
cagguguggaugugggguuauguggucaugcu

SEQ ID NO: 355496 - RNA, 32 nt, Human
caggugugggagccaccaugccugacccacac

SEQ ID NO: 355497 - RNA, 32 nt, Human
caggugugggaggcugcccgcuguagugcuca

SEQ ID NO: 355498 - RNA, 19 nt, Human
cagguguggugacgggggg

SEQ ID NO: 355499 - RNA, 29 nt, Human
caggugugguggcgugugccugugguccc

SEQ ID NO: 355500 - RNA, 24 nt, Human
caggugugguggcuuaccccugua

SEQ ID NO: 355501 - RNA, 32 nt, Human
caggugugugcccccaccacagcucuaugacu

SEQ ID NO: 355502 - RNA, 32 nt, Human
cagguguguggaggggaugggaguguuagcuc

SEQ ID NO: 355503 - RNA, 32 nt, Human
caggugugugggcuccuuuaggcagguuacag

SEQ ID NO: 355504 - RNA, 32 nt, Human
cagguguuagccacugcgccugccugauguug

SEQ ID NO: 355505 - RNA, 32 nt, Human
cagguguuauagaagccagaagagaaacugug

SEQ ID NO: 355506 - RNA, 31 nt, Human
cagguguucaauaaauaauuuuugaauaaau

SEQ ID NO: 355507 - RNA, 32 nt, Human
cagguguuccgacgcgaggacucucucccacc

SEQ ID NO: 355508 - RNA, 22 nt, Human
cagguguucuacacucaucuua

SEQ ID NO: 355509 - RNA, 32 nt, Human
cagguguucuuagaacucuguaaagagcaggc

SEQ ID NO: 355510 - RNA, 32 nt, Human
cagguguugaaggagcuuagguuuuagaggca

SEQ ID NO: 355511 - RNA, 32 nt, Human
cagguguugacuccagcuccagcuucagcucc

SEQ ID NO: 355512 - RNA, 32 nt, Human
cagguguuuccguaccacagcaggagcagggc

SEQ ID NO: 355513 - RNA, 22 nt, Human
cagguuaaaaauucuccugccu

SEQ ID NO: 355514 - RNA, 32 nt, Human
cagguuaacaagaggcauuugugcacacacac

SEQ ID NO: 355515 - RNA, 32 nt, Human
cagguuacagugagcaaagauugugccacuac

SEQ ID NO: 355516 - RNA, 32 nt, Human
cagguuacagugagccaagaucgugccacugc

SEQ ID NO: 355517 - RNA, 32 nt, Human
cagguuaccaggaagcagcuugcuguucaugu

SEQ ID NO: 355518 - RNA, 32 nt, Human
cagguuacccagcaaaugaauacgcuuauagg

SEQ ID NO: 355519 - RNA, 32 nt, Human
cagguuaccuccgaaacugagaucuccuagcc

SEQ ID NO: 355520 - RNA, 32 nt, Human
cagguuaccugggccccaccaggucaucagga

SEQ ID NO: 355521 - RNA, 21 nt, Human
cagguuagacccugggcccug

SEQ ID NO: 355522 - RNA, 32 nt, Human
cagguuagggagcagugaaagugaggagggaa

SEQ ID NO: 355523 - RNA, 32 nt, Human
cagguuagggcgagcgcuaccucuccagccuc

SEQ ID NO: 355524 - RNA, 22 nt, Human
cagguuaucugcuucugucccu

SEQ ID NO: 355525 - RNA, 24 nt, Human
cagguucaaacgauucucuugccu

SEQ ID NO: 355526 - RNA, 32 nt, Human
cagguucaagagauccucccaccucagcuucc

SEQ ID NO: 355527 - RNA, 24 nt, Human
cagguucaagagauucuccugccu

SEQ ID NO: 355528 - RNA, 24 nt, Human
cagguucaagagauucuccugucu

SEQ ID NO: 355529 - RNA, 24 nt, Human
cagguucaagagauucuucugccu

SEQ ID NO: 355530 - RNA, 24 nt, Human
cagguucaagagauuuuccugccu

SEQ ID NO: 355531 - RNA, 24 nt, Human
cagguucaagcaauuauccugccu

SEQ ID NO: 355532 - RNA, 23 nt, Human
cagguucaagcaauuaucugccu

SEQ ID NO: 355533 - RNA, 24 nt, Human
cagguucaagcaauucucccaccu

SEQ ID NO: 355534 - RNA, 32 nt, Human
cagguucaagcaauucucccaccucagccucc

SEQ ID NO: 355535 - RNA, 24 nt, Human
cagguucaagcaauucuccugccu

SEQ ID NO: 355536 - RNA, 24 nt, Human
cagguucaagcaauucuccugucu

SEQ ID NO: 355537 - RNA, 24 nt, Human
cagguucaagcaauucuccuguuu

SEQ ID NO: 355538 - RNA, 24 nt, Human
cagguucaagcaauucucguuguc

SEQ ID NO: 355539 - RNA, 23 nt, Human
cagguucaagcaauucucugucu

SEQ ID NO: 355540 - RNA, 24 nt, Human
cagguucaagcaauucucuugccu

SEQ ID NO: 355541 - RNA, 24 nt, Human
cagguucaagcaauucuucugccu

SEQ ID NO: 355542 - RNA, 24 nt, Human
cagguucaagcaauuguccugccu

SEQ ID NO: 355543 - RNA, 24 nt, Human
cagguucaagcaauuuuccugcuu

SEQ ID NO: 355544 - RNA, 24 nt, Human
cagguucaagcaauuuucgugccu

SEQ ID NO: 355545 - RNA, 24 nt, Human
cagguucaagcacuucucguaccu

SEQ ID NO: 355546 - RNA, 31 nt, Human
cagguucaagcaguucuccuaccucagccuc

SEQ ID NO: 355547 - RNA, 24 nt, Human
cagguucaagcaguucuccugccu

SEQ ID NO: 355548 - RNA, 24 nt, Human
cagguucaagcaguucuccugucu

SEQ ID NO: 355549 - RNA, 24 nt, Human
cagguucaagcauuucuccugccu

SEQ ID NO: 355550 - RNA, 24 nt, Human
cagguucaagccauucucaugccu

SEQ ID NO: 355551 - RNA, 24 nt, Human
cagguucaagcgacucuccugccu

SEQ ID NO: 355552 - RNA, 24 nt, Human
cagguucaagcgagucuccugccu

SEQ ID NO: 355553 - RNA, 23 nt, Human
cagguucaagcgaucaugugccu

SEQ ID NO: 355554 - RNA, 24 nt, Human
cagguucaagcgauuccccugccu

SEQ ID NO: 355555 - RNA, 19 nt, Human
cagguucaagcgauuccuu

SEQ ID NO: 355556 - RNA, 24 nt, Human
cagguucaagcgauucucaugccu

SEQ ID NO: 355557 - RNA, 24 nt, Human
cagguucaagcgauucucccgccu

SEQ ID NO: 355558 - RNA, 24 nt, Human
cagguucaagcgauucuccugacu

SEQ ID NO: 355559 - RNA, 32 nt, Human
cagguucaagcgauucuccugcagccucccga

SEQ ID NO: 355560 - RNA, 24 nt, Human
cagguucaagcgauucuccugccu

SEQ ID NO: 355561 - RNA, 24 nt, Human
cagguucaagcgauucuccugcuu

SEQ ID NO: 355562 - RNA, 22 nt, Human
cagguucaagcgauucuccugu

SEQ ID NO: 355563 - RNA, 24 nt, Human
cagguucaagcgauucucgugccu

SEQ ID NO: 355564 - RNA, 24 nt, Human
cagguucaagcgauucucguggcu

SEQ ID NO: 355565 - RNA, 24 nt, Human
cagguucaagcgauucucucacuu

SEQ ID NO: 355566 - RNA, 24 nt, Human
cagguucaagcgauucucuugccu

SEQ ID NO: 355567 - RNA, 24 nt, Human
cagguucaagcgauucuuaugccu

SEQ ID NO: 355568 - RNA, 24 nt, Human
cagguucaagcgauucuucugccu

SEQ ID NO: 355569 - RNA, 24 nt, Human
cagguucaagcgauuuuccugccu

SEQ ID NO: 355570 - RNA, 24 nt, Human
cagguucaagcuauucuacugccu

SEQ ID NO: 355571 - RNA, 24 nt, Human
cagguucaagcuauucucaugccu

SEQ ID NO: 355572 - RNA, 24 nt, Human
cagguucaagcuauucuccugccu

SEQ ID NO: 355573 - RNA, 23 nt, Human
cagguucaaggauucuccugccu

SEQ ID NO: 355574 - RNA, 24 nt, Human
cagguucaaguaauucuccugccu

SEQ ID NO: 355575 - RNA, 24 nt, Human
cagguucaaguaguucuccugccu

SEQ ID NO: 355576 - RNA, 24 nt, Human
cagguucaagugagucucaugccu

SEQ ID NO: 355577 - RNA, 24 nt, Human
cagguucaagugagucucgugccu

SEQ ID NO: 355578 - RNA, 24 nt, Human
cagguucaagugauccuccugccu

SEQ ID NO: 355579 - RNA, 24 nt, Human
cagguucaagugauucucaugccu

SEQ ID NO: 355580 - RNA, 24 nt, Human
cagguucaagugauucucccaccu

SEQ ID NO: 355581 - RNA, 24 nt, Human
cagguucaagugauucuccucccu

SEQ ID NO: 355582 - RNA, 24 nt, Human
cagguucaagugauucuccugccu

SEQ ID NO: 355583 - RNA, 24 nt, Human
cagguucaagugauucuccugcuu

SEQ ID NO: 355584 - RNA, 24 nt, Human
cagguucaagugauucuccugucu

SEQ ID NO: 355585 - RNA, 24 nt, Human
cagguucaagugauucucguaccu

SEQ ID NO: 355586 - RNA, 24 nt, Human
cagguucaagugauucucuugccu

SEQ ID NO: 355587 - RNA, 24 nt, Human
cagguucaagugauucuucugccu

SEQ ID NO: 355588 - RNA, 24 nt, Human
cagguucaagugcuucuccagccu

SEQ ID NO: 355589 - RNA, 24 nt, Human
cagguucaagugcuucuccugccu

SEQ ID NO: 355590 - RNA, 24 nt, Human
cagguucaagugguucuccuuccu

SEQ ID NO: 355591 - RNA, 24 nt, Human
cagguucaaucgguuuuccugccu

SEQ ID NO: 355592 - RNA, 24 nt, Human
cagguucaauugauucuccugccu

SEQ ID NO: 355593 - RNA, 24 nt, Human
cagguucacaccauucucccgccu

SEQ ID NO: 355594 - RNA, 32 nt, Human
cagguucacaccauucucccgccucagccuuc

SEQ ID NO: 355595 - RNA, 24 nt, Human
cagguucacaccauucuccugccu

SEQ ID NO: 355596 - RNA, 32 nt, Human
cagguucacaccauucuccugccucaaccucc

SEQ ID NO: 355597 - RNA, 32 nt, Human
cagguucacaccauucuccugccucagccucc

SEQ ID NO: 355598 - RNA, 32 nt, Human
cagguucacaccauucuccugccucagcuucc

SEQ ID NO: 355599 - RNA, 32 nt, Human
cagguucacaccauucucuugccucagccuuc

SEQ ID NO: 355600 - RNA, 22 nt, Human
cagguucaccuggccacaggug

SEQ ID NO: 355601 - RNA, 24 nt, Human
cagguucacgccauccuccugccu

SEQ ID NO: 355602 - RNA, 24 nt, Human
cagguucacgccauucucccgccu

SEQ ID NO: 355603 - RNA, 24 nt, Human
cagguucacgccauucuccugccu

SEQ ID NO: 355604 - RNA, 24 nt, Human
cagguucacgccauucuccuggcu

SEQ ID NO: 355605 - RNA, 24 nt, Human
cagguucacgccauuguccugccu

SEQ ID NO: 355606 - RNA, 32 nt, Human
cagguucagaacuuggcugguggacagcggcc

SEQ ID NO: 355607 - RNA, 24 nt, Human
cagguucaggcgauucccgugccu

SEQ ID NO: 355608 - RNA, 24 nt, Human
cagguucaggcgauucuccugccu

SEQ ID NO: 355609 - RNA, 23 nt, Human
cagguucaggcuauucuccugcu

SEQ ID NO: 355610 - RNA, 24 nt, Human
cagguucaggugauucuccugccu

SEQ ID NO: 355611 - RNA, 32 nt, Human
cagguucauagagaugaauuuucugagaaaca

SEQ ID NO: 355612 - RNA, 32 nt, Human
cagguucaucacaaaccugguaccuguugcuu

SEQ ID NO: 355613 - RNA, 32 nt, Human
cagguucaucagaagaaagaaaggacaaaaug

SEQ ID NO: 355614 - RNA, 23 nt, Human
cagguucaugccauucuccugcc

SEQ ID NO: 355615 - RNA, 32 nt, Human
cagguucaugccauucuccugccccagcuucc

SEQ ID NO: 355616 - RNA, 24 nt, Human
cagguucaugccauucuccugccu

SEQ ID NO: 355617 - RNA, 32 nt, Human
cagguucaugccauucuccugccucagccucc

SEQ ID NO: 355618 - RNA, 24 nt, Human
cagguucaugccauucuccugcuu

SEQ ID NO: 355619 - RNA, 32 nt, Human
cagguucaugccauucuccugcuucagccucc

SEQ ID NO: 355620 - RNA, 24 nt, Human
cagguucaugcgauucuccugccu

SEQ ID NO: 355621 - RNA, 24 nt, Human
cagguucaugucauucuccugccu

SEQ ID NO: 355622 - RNA, 32 nt, Human
cagguuccaagaaacacauacgcagccaugca

SEQ ID NO: 355623 - RNA, 24 nt, Human
cagguuccagcaauucuccugccu

SEQ ID NO: 355624 - RNA, 32 nt, Human
cagguuccagcggcuccauugaagagccacag

SEQ ID NO: 355625 - RNA, 32 nt, Human
cagguuccaguaguucauucuaaugccuagau

SEQ ID NO: 355626 - RNA, 32 nt, Human
cagguucccaagacuucaguccuggucugcuc

SEQ ID NO: 355627 - RNA, 21 nt, Human
cagguuccccaugggccagcu

SEQ ID NO: 355628 - RNA, 32 nt, Human
cagguucccccacuaccucucccucagaucca

SEQ ID NO: 355629 - RNA, 32 nt, Human
cagguuccccuucacugugcucucugcuaucu

SEQ ID NO: 355630 - RNA, 32 nt, Human
cagguucccgagagcucaggaacauggagcug

SEQ ID NO: 355631 - RNA, 32 nt, Human
cagguuccuccccucaccccauauuccaucac

SEQ ID NO: 355632 - RNA, 32 nt, Human
cagguuccucggccugccccaggagggcccug

SEQ ID NO: 355633 - RNA, 32 nt, Human
cagguuccugcucugccuucagacuucggcuu

SEQ ID NO: 355634 - RNA, 32 nt, Human
cagguuccuggaccagcccagcugcccccaaa

SEQ ID NO: 355635 - RNA, 23 nt, Human
cagguuccuguaacucccugccu

SEQ ID NO: 355636 - RNA, 32 nt, Human
cagguuccuugcauuugcugccuggaugugca

SEQ ID NO: 355637 - RNA, 24 nt, Human
cagguucgggcgagucuccugccu

SEQ ID NO: 355638 - RNA, 32 nt, Human
cagguucuccacugacucauucauuccuucac

SEQ ID NO: 355639 - RNA, 32 nt, Human
cagguucuccccuugagcuccugcucccccau

SEQ ID NO: 355640 - RNA, 22 nt, Human
cagguucuggcuccuuccagcc

SEQ ID NO: 355641 - RNA, 32 nt, Human
cagguucuuagcacauccucuguucucuaccu

SEQ ID NO: 355642 - RNA, 32 nt, Human
cagguucuuccuagcucggggcuuuuaaauuu

SEQ ID NO: 355643 - RNA, 32 nt, Human
cagguucuugcucucccaggcuggagugcagu

SEQ ID NO: 355644 - RNA, 32 nt, Human
cagguucuuggggguagccaaaaugagguucu

SEQ ID NO: 355645 - RNA, 32 nt, Human
cagguugaagaccuaaccagggccagaaguag

SEQ ID NO: 355646 - RNA, 24 nt, Human
cagguugaagcgauucuccugccu

SEQ ID NO: 355647 - RNA, 32 nt, Human
cagguugaaucuuccaauuugagaacccaugu

SEQ ID NO: 355648 - RNA, 24 nt, Human
cagguugacaccauucuccugccu

SEQ ID NO: 355649 - RNA, 32 nt, Human
cagguugacaccauucuccugccucacccucc

SEQ ID NO: 355650 - RNA, 32 nt, Human
cagguugacgagacgaggcucuucugaccguc

SEQ ID NO: 355651 - RNA, 19 nt, Human
cagguugaggcugcaguga

SEQ ID NO: 355652 - RNA, 32 nt, Human
cagguugaggggauuacuugagcccagaaguu

SEQ ID NO: 355653 - RNA, 32 nt, Human
cagguugaggucugguaacagaaugccaggaa

SEQ ID NO: 355654 - RNA, 32 nt, Human
cagguugcagggaggcggagguugcagugagc

SEQ ID NO: 355655 - RNA, 32 nt, Human
cagguugcagugagccaagaucgugccauugc

SEQ ID NO: 355656 - RNA, 32 nt, Human
cagguugcagugagccaagauuguaccacugc

SEQ ID NO: 355657 - RNA, 32 nt, Human
cagguugcagugagccaagauugugccacugu

SEQ ID NO: 355658 - RNA, 32 nt, Human
cagguugcagugagccaagauugugccccugc

SEQ ID NO: 355659 - RNA, 32 nt, Human
cagguugcagugagccaggauugugccacuac

SEQ ID NO: 355660 - RNA, 32 nt, Human
cagguugcagugagccgagaucaugccacugc

SEQ ID NO: 355661 - RNA, 32 nt, Human
cagguugcagugagccgagauugcgccacugc

SEQ ID NO: 355662 - RNA, 32 nt, Human
cagguugcagugagcugagaucaugccauugc

SEQ ID NO: 355663 - RNA, 32 nt, Human
cagguugcagugagcugagaucgugccacugc

SEQ ID NO: 355664 - RNA, 32 nt, Human
cagguugccaggaggaggcgggagcggggagg

SEQ ID NO: 355665 - RNA, 22 nt, Human
cagguugcccgaugcccuguug

SEQ ID NO: 355666 - RNA, 21 nt, Human
cagguugccugggccacggug

SEQ ID NO: 355667 - RNA, 22 nt, Human
cagguugcuacaaacccuugug

SEQ ID NO: 355668 - RNA, 32 nt, Human
cagguugcuaggacaguaacccugccacacac

SEQ ID NO: 355669 - RNA, 32 nt, Human
cagguugcugcagcucugccuucuccaugggg

SEQ ID NO: 355670 - RNA, 22 nt, Human
cagguugcugggcuggccuugg

SEQ ID NO: 355671 - RNA, 32 nt, Human
cagguuggaaagacuuccugaagaaaucagug

SEQ ID NO: 355672 - RNA, 32 nt, Human
cagguuggacggaguuucaccauguuggccag

SEQ ID NO: 355673 - RNA, 32 nt, Human
cagguuggaggcacaggcagcagcaagaaugg

SEQ ID NO: 355674 - RNA, 32 nt, Human
cagguuggaggcagaggagccgauggcuggag

SEQ ID NO: 355675 - RNA, 32 nt, Human
cagguuggagugacuggugggccuagaucacu

SEQ ID NO: 355676 - RNA, 32 nt, Human
cagguuggccaacauggugagaccccaucucu

SEQ ID NO: 355677 - RNA, 32 nt, Human
cagguuggccaagagcagcuuagaggaucucc

SEQ ID NO: 355678 - RNA, 32 nt, Human
cagguuggcgcuuagagaagccuuggaaucag

SEQ ID NO: 355679 - RNA, 32 nt, Human
cagguuggcgggggccuguaauccuagcuacu

SEQ ID NO: 355680 - RNA, 32 nt, Human
cagguugggacauuuagacaagagugaaucac

SEQ ID NO: 355681 - RNA, 32 nt, Human
cagguugggaggacucacucugugcuccccga

SEQ ID NO: 355682 - RNA, 32 nt, Human
cagguugggaggccaaggugggaggauugcuu

SEQ ID NO: 355683 - RNA, 21 nt, Human
cagguugggcaacagagcaag

SEQ ID NO: 355684 - RNA, 21 nt, Human
cagguugggcaucugggcccu

SEQ ID NO: 355685 - RNA, 22 nt, Human
cagguugggcuacagagugaga

SEQ ID NO: 355686 - RNA, 32 nt, Human
cagguuggggauggggacauggagaggaaggg

SEQ ID NO: 355687 - RNA, 32 nt, Human
cagguuggggauucuuucucucuucucccaac

SEQ ID NO: 355688 - RNA, 20 nt, Human
cagguugggggaggcccugg

SEQ ID NO: 355689 - RNA, 32 nt, Human
cagguuggguaacccucccuguucaucccaug

SEQ ID NO: 355690 - RNA, 32 nt, Human
cagguuggguuugccaaacgccuaauuaccag

SEQ ID NO: 355691 - RNA, 32 nt, Human
cagguuggucucaaacuccugagcucaagcaa

SEQ ID NO: 355692 - RNA, 32 nt, Human
cagguuggucucaaacuccugagcucaagcag

SEQ ID NO: 355693 - RNA, 32 nt, Human
cagguuggucucaaacuccuggacucaaguga

SEQ ID NO: 355694 - RNA, 32 nt, Human
cagguuggucucaaacuccuggguucaagcag

SEQ ID NO: 355695 - RNA, 32 nt, Human
cagguuggucucaaacugcugccucagccucc

SEQ ID NO: 355696 - RNA, 32 nt, Human
cagguuggucucaagcuccugaccucagauga

SEQ ID NO: 355697 - RNA, 32 nt, Human
cagguuggucucgaacuccugaucucaugauc

SEQ ID NO: 355698 - RNA, 32 nt, Human
cagguuggugugagccugggcccggcccacuc

SEQ ID NO: 355699 - RNA, 32 nt, Human
cagguuguagcaaccucuucauuccagagcua

SEQ ID NO: 355700 - RNA, 32 nt, Human
cagguugucauuugcucaaaucacacagcaaa

SEQ ID NO: 355701 - RNA, 32 nt, Human
cagguugucucgaacuccuggucucaagcgau

SEQ ID NO: 355702 - RNA, 32 nt, Human
cagguugucugcuccccugauucauugaggau

SEQ ID NO: 355703 - RNA, 32 nt, Human
cagguugugagccaguggcuugagugaauguu

SEQ ID NO: 355704 - RNA, 32 nt, Human
cagguuguggagguggccaugacagugguggc

SEQ ID NO: 355705 - RNA, 32 nt, Human
cagguuguucacuugcugaggugcaaaaauuc

SEQ ID NO: 355706 - RNA, 32 nt, Human
cagguuguuucccaggcuggggugggggccug

SEQ ID NO: 355707 - RNA, 32 nt, Human
cagguuuaagcaauccucccaccucagccccc

SEQ ID NO: 355708 - RNA, 24 nt, Human
cagguuuaagcaauucuccugcuu

SEQ ID NO: 355709 - RNA, 24 nt, Human
cagguuuaagcgauucucaugccu

SEQ ID NO: 355710 - RNA, 24 nt, Human
cagguuuaagcgauucucuugccu

SEQ ID NO: 355711 - RNA, 24 nt, Human
cagguuuaagcgauucuucugccu

SEQ ID NO: 355712 - RNA, 24 nt, Human
cagguuuaagcuauucuccugccu

SEQ ID NO: 355713 - RNA, 32 nt, Human
cagguuuacaccacugcacuccagucuggaug

SEQ ID NO: 355714 - RNA, 32 nt, Human
cagguuucaagcccaccuccccaaaaccguuu

SEQ ID NO: 355715 - RNA, 32 nt, Human
cagguuucaagugauucuccugccucagccuc

SEQ ID NO: 355716 - RNA, 32 nt, Human
cagguuucacagugucaugggguuugggcauu

SEQ ID NO: 355717 - RNA, 32 nt, Human
cagguuuccagccuggaaccuuuggcucaggc

SEQ ID NO: 355718 - RNA, 32 nt, Human
cagguuuccaggagaugguagacauugggacc

SEQ ID NO: 355719 - RNA, 19 nt, Human
cagguuuccccacucaucu

SEQ ID NO: 355720 - RNA, 32 nt, Human
cagguuuccuggugaguuccaagccuuuggaa

SEQ ID NO: 355721 - RNA, 32 nt, Human
cagguuucucuuuagcccucuuccugcacuug

SEQ ID NO: 355722 - RNA, 32 nt, Human
cagguuugagccaccgugccuggccuaaguuu

SEQ ID NO: 355723 - RNA, 32 nt, Human
cagguuugaggaugcuggggagagggggaggg

SEQ ID NO: 355724 - RNA, 32 nt, Human
cagguuugcaccaccaugcccggcuaauuuuu

SEQ ID NO: 355725 - RNA, 32 nt, Human
cagguuugcauucaugaagcuuucauucauuc

SEQ ID NO: 355726 - RNA, 32 nt, Human
cagguuugcucccccucuacccuuucccccac

SEQ ID NO: 355727 - RNA, 32 nt, Human
cagguuuggggguggguaggaggcaggacugc

SEQ ID NO: 355728 - RNA, 32 nt, Human
cagguuuguauauaaaaugaaaagcuauacua

SEQ ID NO: 355729 - RNA, 20 nt, Human
cagguuuuaaaggaagccaa

SEQ ID NO: 355730 - RNA, 32 nt, Human
cagguuuucaaaccagcccugguguagcagac

SEQ ID NO: 355731 - RNA, 26 nt, Human
cagguuuucaagcaauucuccugccu

SEQ ID NO: 355732 - RNA, 32 nt, Human
cagguuuucauuaucaggucacugugaaaucu

SEQ ID NO: 355733 - RNA, 32 nt, Human
cagguuuuguuuuccuccuuuaccucauguuu

SEQ ID NO: 355734 - RNA, 20 nt, Human
cagguuuuuaguauuuacuu

SEQ ID NO: 355735 - RNA, 24 nt, Human
cagguuuuugcccaagucucagcu

SEQ ID NO: 355736 - RNA, 32 nt, Human
cagguuuuuggugccauuuacccuucauagga

SEQ ID NO: 355737 - RNA, 32 nt, Human
caguaaaaauaggccuuuccacaaucuucuac

SEQ ID NO: 355738 - RNA, 32 nt, Human
caguaaaagugggacuguuucacuggagucag

SEQ ID NO: 355739 - RNA, 32 nt, Human
caguaaaauacaugauacaaggaacucaaaag

SEQ ID NO: 355740 - RNA, 32 nt, Human
caguaaaaucuuaaaugauuuuugccacuggu

SEQ ID NO: 355741 - RNA, 32 nt, Human
caguaaaaugccuggggucccugcugccucuc

SEQ ID NO: 355742 - RNA, 19 nt, Human
caguaaaauuuaaauggug

SEQ ID NO: 355743 - RNA, 22 nt, Human
caguaaacaaaaccaaaccuca

SEQ ID NO: 355744 - RNA, 32 nt, Human
caguaaacaaauaaguuccugucccaugacca

SEQ ID NO: 355745 - RNA, 32 nt, Human
caguaaacaaauucuuucacaagguacaaaau

SEQ ID NO: 355746 - RNA, 21 nt, Human
caguaaacaagcaauacauca

SEQ ID NO: 355747 - RNA, 24 nt, Human
caguaaacaagguuaccuaccuca

SEQ ID NO: 355748 - RNA, 32 nt, Human
caguaaacacaaauauuucuucaaggggugau

SEQ ID NO: 355749 - RNA, 18 nt, Human
caguaaacagacuguaga

SEQ ID NO: 355750 - RNA, 32 nt, Human
caguaaaccugacagaguucaacacugcccac

SEQ ID NO: 355751 - RNA, 24 nt, Human
caguaaacucuguguguuuaggga

SEQ ID NO: 355752 - RNA, 32 nt, Human
caguaaacugaagacaagaacucuucccccaa

SEQ ID NO: 355753 - RNA, 32 nt, Human
caguaaacugauuucccauguccuacuaagcu

SEQ ID NO: 355754 - RNA, 32 nt, Human
caguaaagaacaguuuuuauuguuuuguaagu

SEQ ID NO: 355755 - RNA, 32 nt, Human
caguaaagacauuugaagagcugcggcuaaag

SEQ ID NO: 355756 - RNA, 32 nt, Human
caguaaagaccauuuaguccucaccuucuguu

SEQ ID NO: 355757 - RNA, 32 nt, Human
caguaaagagcgugccuggacccugggaggug

SEQ ID NO: 355758 - RNA, 32 nt, Human
caguaaagcggaggcagcgggggaagauggcg

SEQ ID NO: 355759 - RNA, 31 nt, Human
caguaaaggggccagucuucacuggcagugg

SEQ ID NO: 355760 - RNA, 32 nt, Human
caguaaagguguuccuuccuggcagcguaugc

SEQ ID NO: 355761 - RNA, 24 nt, Human
caguaaauaaaacauuucgcaaaa

SEQ ID NO: 355762 - RNA, 23 nt, Human
caguaaauacaugcuuaacaaaa

SEQ ID NO: 355763 - RNA, 32 nt, Human
caguaaauaucuuucuuacaguccaguagcuu

SEQ ID NO: 355764 - RNA, 31 nt, Human
caguaacaaguguucacaaggauauggagaa

SEQ ID NO: 355765 - RNA, 31 nt, Human
caguaacaaguguuggcauuaucaguugaac

SEQ ID NO: 355766 - RNA, 21 nt, Human
caguaacacucacuucucuca

SEQ ID NO: 355767 - RNA, 32 nt, Human
caguaacacugcacuccucaaaaaguggcggu

SEQ ID NO: 355768 - RNA, 32 nt, Human
caguaacaggggaaaaguucaagaauacagac

SEQ ID NO: 355769 - RNA, 32 nt, Human
caguaacauaacaacaagcauaggucuuauca

SEQ ID NO: 355770 - RNA, 32 nt, Human
caguaacaucaucugaaucaucaguauugucu

SEQ ID NO: 355771 - RNA, 32 nt, Human
caguaacccugccccuuucuuaccucacaggg

SEQ ID NO: 355772 - RNA, 32 nt, Human
caguaaccuagaguuacagcacuugcuccuua

SEQ ID NO: 355773 - RNA, 32 nt, Human
caguaacgcgggccacggaaagguaugauaua

SEQ ID NO: 355774 - RNA, 32 nt, Human
caguaacgcuacaaccauugcaaaucauugga

SEQ ID NO: 355775 - RNA, 32 nt, Human
caguaacucaaauggccucugugucauauguc

SEQ ID NO: 355776 - RNA, 24 nt, Human
caguaacucacgccuguaauccca

SEQ ID NO: 355777 - RNA, 32 nt, Human
caguaacuccuguguguuuugauuagugagau

SEQ ID NO: 355778 - RNA, 32 nt, Human
caguaacucucugaagcauuuugagguaaggg

SEQ ID NO: 355779 - RNA, 32 nt, Human
caguaacugggcucaggagcucugagguggca

SEQ ID NO: 355780 - RNA, 17 nt, Human
caguaacuucauggcug

SEQ ID NO: 355781 - RNA, 32 nt, Human
caguaacuucauggcugaggugaggacaugcu

SEQ ID NO: 355782 - RNA, 32 nt, Human
caguaacuugaaaauucaaaagggacauuugg

SEQ ID NO: 355783 - RNA, 32 nt, Human
caguaacuugauauucacaugaccuacaggau

SEQ ID NO: 355784 - RNA, 32 nt, Human
caguaagaagagcuuggaaaaugcagaaaguu

SEQ ID NO: 355785 - RNA, 22 nt, Human
caguaagacuuucaggcacuuc

SEQ ID NO: 355786 - RNA, 32 nt, Human
caguaagagaaaaggguccccaagaugggaag

SEQ ID NO: 355787 - RNA, 32 nt, Human
caguaagagcaccccaucaucucuccauuucu

SEQ ID NO: 355788 - RNA, 32 nt, Human
caguaagagggaggggaggaggcaggagggcg

SEQ ID NO: 355789 - RNA, 20 nt, Human
caguaagaucuuuugcaaaa

SEQ ID NO: 355790 - RNA, 22 nt, Human
caguaagcaccaccuacucuca

SEQ ID NO: 355791 - RNA, 32 nt, Human
caguaagcagaggucgugccacugcaugccag

SEQ ID NO: 355792 - RNA, 32 nt, Human
caguaagcauccauuccauugauauucgcuaa

SEQ ID NO: 355793 - RNA, 32 nt, Human
caguaagcccagggauguggcagcugcagcgg

SEQ ID NO: 355794 - RNA, 32 nt, Human
caguaagcccugcccuugccccugugcucaag

SEQ ID NO: 355795 - RNA, 32 nt, Human
caguaagccuugcagcuugagcugaaagaugc

SEQ ID NO: 355796 - RNA, 32 nt, Human
caguaagcgccaugaguauucuucccauaacu

SEQ ID NO: 355797 - RNA, 32 nt, Human
caguaagggcaggguguuccuuccagggaacu

SEQ ID NO: 355798 - RNA, 23 nt, Human
caguaagguguaauuacagaauu

SEQ ID NO: 355799 - RNA, 21 nt, Human
caguaaguaccaacuaccuca

SEQ ID NO: 355800 - RNA, 32 nt, Human
caguaaguaucuggaggaagaaaacaggugaa

SEQ ID NO: 355801 - RNA, 32 nt, Human
caguaagucaaagacuggaauuugaaccccaa

SEQ ID NO: 355802 - RNA, 32 nt, Human
caguaaguccugggccggggccgcaucugccu

SEQ ID NO: 355803 - RNA, 32 nt, Human
caguaagucugugucuuccucacugaacccug

SEQ ID NO: 355804 - RNA, 32 nt, Human
caguaaguuguuccaaaugauccugaagaaau

SEQ ID NO: 355805 - RNA, 32 nt, Human
caguaaugaaaccagggucccaaccaagaaau

SEQ ID NO: 355806 - RNA, 32 nt, Human
caguaaugacucucugacccucuggaaauaug

SEQ ID NO: 355807 - RNA, 32 nt, Human
caguaaugagccuggaagguagagauggagag

SEQ ID NO: 355808 - RNA, 32 nt, Human
caguaaugaugcauaauuagaaaaugagguau

SEQ ID NO: 355809 - RNA, 32 nt, Human
caguaauggauccccggccucagucccuacuc

SEQ ID NO: 355810 - RNA, 32 nt, Human
caguaaugucccugccucuucucccaaucaag

SEQ ID NO: 355811 - RNA, 32 nt, Human
caguaauuagggaaaucccacagaugaaaaau

SEQ ID NO: 355812 - RNA, 32 nt, Human
caguaauuauucugcauucacaauuagugacu

SEQ ID NO: 355813 - RNA, 32 nt, Human
caguaauugcaacugcucacaugagucaaaau

SEQ ID NO: 355814 - RNA, 32 nt, Human
caguaauugcagccucccuuaggaggcugagg

SEQ ID NO: 355815 - RNA, 32 nt, Human
caguaauuuaacaucacuacaaaaagaaggag

SEQ ID NO: 355816 - RNA, 32 nt, Human
caguaauuuggguuagccuaccuucauuaauu

SEQ ID NO: 355817 - RNA, 32 nt, Human
caguacaaaaacacuggcacuugaauguugaa

SEQ ID NO: 355818 - RNA, 19 nt, Human
caguacaaaauaggcacuc

SEQ ID NO: 355819 - RNA, 32 nt, Human
caguacaaagaaaaggggguggagacccugca

SEQ ID NO: 355820 - RNA, 32 nt, Human
caguacaaaguggcagaaccacauuuuguucc

SEQ ID NO: 355821 - RNA, 32 nt, Human
caguacaaucagucguucacauaccacuaacu

SEQ ID NO: 355822 - RNA, 32 nt, Human
caguacaauuucagcauaucucuggcucaggg

SEQ ID NO: 355823 - RNA, 32 nt, Human
caguacacagaauuaaagugggggagauggca

SEQ ID NO: 355824 - RNA, 32 nt, Human
caguacacagccccaaaacagccuaagaaagg

SEQ ID NO: 355825 - RNA, 32 nt, Human
caguacaccagcagaggaaacuuauaaccucg

SEQ ID NO: 355826 - RNA, 32 nt, Human
caguacagaucguuucucaucucuagugccuc

SEQ ID NO: 355827 - RNA, 32 nt, Human
caguacagaugggguuucaccauauugggcag

SEQ ID NO: 355828 - RNA, 32 nt, Human
caguacagccuccuuggcaccugcugccaccu

SEQ ID NO: 355829 - RNA, 32 nt, Human
caguacaguauuuacugucaaugcaaaagaau

SEQ ID NO: 355830 - RNA, 32 nt, Human
caguacaucaaaaucauugcagaguauuagaa

SEQ ID NO: 355831 - RNA, 32 nt, Human
caguacaucaaaggaauggaugguggacccua

SEQ ID NO: 355832 - RNA, 18 nt, Human
caguacaugaacuauaga

SEQ ID NO: 355833 - RNA, 32 nt, Human
caguacauggaaauauagaagaugcugugacu

SEQ ID NO: 355834 - RNA, 32 nt, Human
caguacaugggaaaggaggcaugccucugaua

SEQ ID NO: 355835 - RNA, 32 nt, Human
caguacaugggugagagagguuaagcugaugg

SEQ ID NO: 355836 - RNA, 32 nt, Human
caguacauuaccagcugugauucuccacugaa

SEQ ID NO: 355837 - RNA, 32 nt, Human
caguacauucagagaacuagauaaaagauaua

SEQ ID NO: 355838 - RNA, 32 nt, Human
caguacauugcauguaguuaagccacauuuua

SEQ ID NO: 355839 - RNA, 32 nt, Human
caguacauuugcaccguguccuagagagccuc

SEQ ID NO: 355840 - RNA, 21 nt, Human
caguaccaccaaaagaugaag

SEQ ID NO: 355841 - RNA, 32 nt, Human
caguaccacugccaccaugcugcucacuuaug

SEQ ID NO: 355842 - RNA, 32 nt, Human
caguaccauggagcaacugacaacccucccac

SEQ ID NO: 355843 - RNA, 32 nt, Human
caguacccagaacagccaguuuuacugugauu

SEQ ID NO: 355844 - RNA, 32 nt, Human
caguacccagggccucuucagcucuuuguagg

SEQ ID NO: 355845 - RNA, 32 nt, Human
caguacccccuccagccccacaccugggccuc

SEQ ID NO: 355846 - RNA, 32 nt, Human
caguacccugcucccccuuucccauaauucau

SEQ ID NO: 355847 - RNA, 32 nt, Human
caguaccggcgggacacagcaggcuggaagau

SEQ ID NO: 355848 - RNA, 32 nt, Human
caguaccucccgcucuccaccgccugcagcag

SEQ ID NO: 355849 - RNA, 32 nt, Human
caguaccucccuaaagcauuuugagguagggg

SEQ ID NO: 355850 - RNA, 32 nt, Human
caguaccucuuccugaaucugguacccaucug

SEQ ID NO: 355851 - RNA, 32 nt, Human
caguaccugagcacugcugcuacuucuucccc

SEQ ID NO: 355852 - RNA, 32 nt, Human
caguaccugucuguuuccuguccuccuuccag

SEQ ID NO: 355853 - RNA, 32 nt, Human
caguaccuugggaggccaaggugggcagaucg

SEQ ID NO: 355854 - RNA, 32 nt, Human
caguacgcccggcgccuggccuccaggcccgu

SEQ ID NO: 355855 - RNA, 32 nt, Human
caguacuaccaccaccaccaacaacaucaaca

SEQ ID NO: 355856 - RNA, 32 nt, Human
caguacuaggagcauugguugcaguggaggag

SEQ ID NO: 355857 - RNA, 32 nt, Human
caguacucaacuggacaucacagcagaaugaa

SEQ ID NO: 355858 - RNA, 32 nt, Human
caguacucacccagggacuccaguucacaggc

SEQ ID NO: 355859 - RNA, 32 nt, Human
caguacucgggaagccaugcaggaugaagaug

SEQ ID NO: 355860 - RNA, 32 nt, Human
caguacucucagucccuccggggcagcucuuc

SEQ ID NO: 355861 - RNA, 32 nt, Human
caguacucuccucugaguucaaucaucuugca

SEQ ID NO: 355862 - RNA, 32 nt, Human
caguacucuguggcuuucugcaaucacgugcg

SEQ ID NO: 355863 - RNA, 32 nt, Human
caguacugaaucaggaccucacucagaaagac

SEQ ID NO: 355864 - RNA, 32 nt, Human
caguacuggccgcggcgcgguggcggcggcug

SEQ ID NO: 355865 - RNA, 32 nt, Human
caguacuggcucugggacaggugagcaguggg

SEQ ID NO: 355866 - RNA, 32 nt, Human
caguacugucauggagcagagcaggcaguggg

SEQ ID NO: 355867 - RNA, 32 nt, Human
caguacugucuaggcuguugcaauauauucuc

SEQ ID NO: 355868 - RNA, 32 nt, Human
caguacugucuaggcuguugcaauauguucuc

SEQ ID NO: 355869 - RNA, 32 nt, Human
caguacuguguucuucagcuagaggcagcuuu

SEQ ID NO: 355870 - RNA, 32 nt, Human
caguacuuaccuccuuagagucauugugaagg

SEQ ID NO: 355871 - RNA, 32 nt, Human
caguacuucgccugacaguuguccugggacug

SEQ ID NO: 355872 - RNA, 32 nt, Human
caguacuuugggaggccaaggcaagcagauca

SEQ ID NO: 355873 - RNA, 32 nt, Human
caguacuuugggaggccaaggcgggcagauca

SEQ ID NO: 355874 - RNA, 32 nt, Human
caguacuuugggaggccgaggugggcggauca

SEQ ID NO: 355875 - RNA, 32 nt, Human
caguacuuugggaggcugaggugggcaaauca

SEQ ID NO: 355876 - RNA, 32 nt, Human
caguagaaacgggauuucaccacguuggccag

SEQ ID NO: 355877 - RNA, 32 nt, Human
caguagaaacgggguuucaccauguuggccag

SEQ ID NO: 355878 - RNA, 32 nt, Human
caguagaaaggcucaaguugcaccaggcagac

SEQ ID NO: 355879 - RNA, 32 nt, Human
caguagaaagugucacagcuagguccauucau

SEQ ID NO: 355880 - RNA, 32 nt, Human
caguagaauaaaaucuuaaagcacucauaaua

SEQ ID NO: 355881 - RNA, 32 nt, Human
caguagaaucuucuaccucauaacuuccuucc

SEQ ID NO: 355882 - RNA, 32 nt, Human
caguagaauggacccuuccuccaccucaguuc

SEQ ID NO: 355883 - RNA, 23 nt, Human
caguagacuguauggucuuucaa

SEQ ID NO: 355884 - RNA, 32 nt, Human
caguagagacaagguuucaccauguuagccag

SEQ ID NO: 355885 - RNA, 32 nt, Human
caguagagacagggucucaccauguuagccag

SEQ ID NO: 355886 - RNA, 32 nt, Human
caguagagacaggguuucaccaucuuggccug

SEQ ID NO: 355887 - RNA, 32 nt, Human
caguagagacaggguuucaccauguuggccag

SEQ ID NO: 355888 - RNA, 32 nt, Human
caguagagacaggguuucgccauguugcccag

SEQ ID NO: 355889 - RNA, 32 nt, Human
caguagagaccggguuuugccauguuggccag

SEQ ID NO: 355890 - RNA, 32 nt, Human
caguagagacgagguuuugccauguuggccag

SEQ ID NO: 355891 - RNA, 32 nt, Human
caguagagacgggguuucaccauguucgccag

SEQ ID NO: 355892 - RNA, 32 nt, Human
caguagagacgggguuucaccauguuggccag

SEQ ID NO: 355893 - RNA, 32 nt, Human
caguagagacgggguuucaccguguuagccag

SEQ ID NO: 355894 - RNA, 32 nt, Human
caguagagacgggguuucacuauguuggccag

SEQ ID NO: 355895 - RNA, 32 nt, Human
caguagagacgggguuucacuguguuagccag

SEQ ID NO: 355896 - RNA, 32 nt, Human
caguagagacgggguuuccccauguugguuag

SEQ ID NO: 355897 - RNA, 32 nt, Human
caguagagacgggguuucgccacauuggccgu

SEQ ID NO: 355898 - RNA, 32 nt, Human
caguagagacgggguuucgccauguuggcuag

SEQ ID NO: 355899 - RNA, 32 nt, Human
caguagagaugggauuucacuguguuggccaa

SEQ ID NO: 355900 - RNA, 32 nt, Human
caguagagauggggucucacuauguugcccag

SEQ ID NO: 355901 - RNA, 32 nt, Human
caguagagaugggguuucaccauguuagccag

SEQ ID NO: 355902 - RNA, 32 nt, Human
caguagagaugggguuuccccauguuggccag

SEQ ID NO: 355903 - RNA, 32 nt, Human
caguagagaugggguuugaccauguuggccag

SEQ ID NO: 355904 - RNA, 32 nt, Human
caguagagauggguuucaccauguuggccaau

SEQ ID NO: 355905 - RNA, 32 nt, Human
caguagagauggguuucaccauguuggccagg

SEQ ID NO: 355906 - RNA, 32 nt, Human
caguagagcacaugaucagccacagcugugca

SEQ ID NO: 355907 - RNA, 18 nt, Human
caguagagcagcagcaca

SEQ ID NO: 355908 - RNA, 32 nt, Human
caguagagcgaaaugcuagacauggagaaucu

SEQ ID NO: 355909 - RNA, 32 nt, Human
caguagaggaaccauccauaugcugagcuucu

SEQ ID NO: 355910 - RNA, 32 nt, Human
caguagcaaaacacagaggucuggcaugaagg

SEQ ID NO: 355911 - RNA, 32 nt, Human
caguagcaaauucacuaaacuuuuguguucag

SEQ ID NO: 355912 - RNA, 32 nt, Human
caguagcaacagcagcaaguugccaccaguuu

SEQ ID NO: 355913 - RNA, 32 nt, Human
caguagcacaaaagagaugacauuuaccuagc

SEQ ID NO: 355914 - RNA, 32 nt, Human
caguagcaccugcuggacagggcugggcggca

SEQ ID NO: 355915 - RNA, 32 nt, Human
caguagcagaaucaucuuccacaacaaggaau

SEQ ID NO: 355916 - RNA, 32 nt, Human
caguagcagcagcaugcaccaaaagagaaugg

SEQ ID NO: 355917 - RNA, 24 nt, Human
caguagcaguugccuguaaucuca

SEQ ID NO: 355918 - RNA, 32 nt, Human
caguagccaagaagauggcauagcauaagaau

SEQ ID NO: 355919 - RNA, 32 nt, Human
caguagccaccaggggucucuguuuccauuac

SEQ ID NO: 355920 - RNA, 32 nt, Human
caguagccacuugucaucuauuuucugauuau

SEQ ID NO: 355921 - RNA, 32 nt, Human
caguagcccacucugaccaccaccuccuagcu

SEQ ID NO: 355922 - RNA, 32 nt, Human
caguagccccgauggaagcagugagaaugaac

SEQ ID NO: 355923 - RNA, 32 nt, Human
caguagcccuccacuucuccagccucucagcc

SEQ ID NO: 355924 - RNA, 32 nt, Human
caguagccgguuaucuagaccaguaaguggag

SEQ ID NO: 355925 - RNA, 32 nt, Human
caguagccuuuacugaaugugugucuugagag

SEQ ID NO: 355926 - RNA, 32 nt, Human
caguagcgugaucauagcuuacugcagccucg

SEQ ID NO: 355927 - RNA, 32 nt, Human
caguagcuaaaauguugagauuagagguacuu

SEQ ID NO: 355928 - RNA, 32 nt, Human
caguagcuacgguucccugccuaggagcuggg

SEQ ID NO: 355929 - RNA, 25 nt, Human
caguagcucacacccuguaauccca

SEQ ID NO: 355930 - RNA, 24 nt, Human
caguagcucacaccuauaauccua

SEQ ID NO: 355931 - RNA, 24 nt, Human
caguagcucacaccuguaauccua

SEQ ID NO: 355932 - RNA, 23 nt, Human
caguagcucacaccuguaguccc

SEQ ID NO: 355933 - RNA, 24 nt, Human
caguagcucacgccuguaauccca

SEQ ID NO: 355934 - RNA, 24 nt, Human
caguagcucaugccuauaauaccc

SEQ ID NO: 355935 - RNA, 21 nt, Human
caguagcucaugccuguaauc

SEQ ID NO: 355936 - RNA, 23 nt, Human
caguagcucaugccuguaauccc

SEQ ID NO: 355937 - RNA, 24 nt, Human
caguagcucaugccuguaauccca

SEQ ID NO: 355938 - RNA, 20 nt, Human
caguagcuccagcagcagca

SEQ ID NO: 355939 - RNA, 32 nt, Human
caguagcucugaacaagaguccagccaacccu

SEQ ID NO: 355940 - RNA, 32 nt, Human
caguagcugagauugcaggcacaugccaccac

SEQ ID NO: 355941 - RNA, 32 nt, Human
caguagcugcuuucugagcuacucaacaagga

SEQ ID NO: 355942 - RNA, 32 nt, Human
caguagcugggggagcagcugagggaaaggga

SEQ ID NO: 355943 - RNA, 32 nt, Human
caguagcuggucagggcugaguacaguccugg

SEQ ID NO: 355944 - RNA, 24 nt, Human
caguagcuuauaccuguaauccua

SEQ ID NO: 355945 - RNA, 32 nt, Human
caguaggaaauguucaucuguuacauggaaaa

SEQ ID NO: 355946 - RNA, 32 nt, Human
caguaggaacaagcuggcuucugugauuaggu

SEQ ID NO: 355947 - RNA, 32 nt, Human
caguaggaagaaaccaggacagcaguggaaga

SEQ ID NO: 355948 - RNA, 32 nt, Human
caguaggaaugugaagccagagguuucggauu

SEQ ID NO: 355949 - RNA, 32 nt, Human
caguaggagagugaguuuuggggccagacacg

SEQ ID NO: 355950 - RNA, 32 nt, Human
caguaggagcagaaaaguuacuggggaguaca

SEQ ID NO: 355951 - RNA, 32 nt, Human
caguaggagcagcagguguuggcagcagagaa

SEQ ID NO: 355952 - RNA, 32 nt, Human
caguaggaggggcaggaggccgacacaccuga

SEQ ID NO: 355953 - RNA, 18 nt, Human
caguaggaucacggcuca

SEQ ID NO: 355954 - RNA, 18 nt, Human
caguaggcacuugguggc

SEQ ID NO: 355955 - RNA, 32 nt, Human
caguaggcagcucccaagaugggugaaaggaa

SEQ ID NO: 355956 - RNA, 32 nt, Human
caguaggccagccuguucucugccauucccua

SEQ ID NO: 355957 - RNA, 32 nt, Human
caguaggccauagaauuggcuacugccauaca

SEQ ID NO: 355958 - RNA, 32 nt, Human
caguaggcccagcgcugcugugucucgucaga

SEQ ID NO: 355959 - RNA, 32 nt, Human
caguaggccuggggaccaggcuugggucugga

SEQ ID NO: 355960 - RNA, 32 nt, Human
caguaggcggcgcgggaggaaaagaggauuga

SEQ ID NO: 355961 - RNA, 31 nt, Human
caguaggcuccugaagagugaucucaacuuu

SEQ ID NO: 355962 - RNA, 32 nt, Human
caguaggcuggagcugauuguuaaauucucag

SEQ ID NO: 355963 - RNA, 32 nt, Human
caguagggacagucaguacaguacaggaaggg

SEQ ID NO: 355964 - RNA, 32 nt, Human
caguagggacgggguuacaccauguuggccag

SEQ ID NO: 355965 - RNA, 32 nt, Human
caguagggacgggguuucaccguguuagccag

SEQ ID NO: 355966 - RNA, 32 nt, Human
caguagggaggcagaguaucuugguggggagg

SEQ ID NO: 355967 - RNA, 21 nt, Human
caguagggcagaaacuugaaa

SEQ ID NO: 355968 - RNA, 32 nt, Human
caguaggggaagcaaggugaccgcaagggggu

SEQ ID NO: 355969 - RNA, 32 nt, Human
caguaggguaguuucagguggggaggaugaca

SEQ ID NO: 355970 - RNA, 32 nt, Human
caguagguaaaggggccaaggagagacugcua

SEQ ID NO: 355971 - RNA, 32 nt, Human
caguaggugcuggacaucgacagcugccugga

SEQ ID NO: 355972 - RNA, 22 nt, Human
caguaggugucccccaccccca

SEQ ID NO: 355973 - RNA, 32 nt, Human
caguagguuacaaaugaagaguccaccaguau

SEQ ID NO: 355974 - RNA, 24 nt, Human
caguaguauccgccuguaguccca

SEQ ID NO: 355975 - RNA, 32 nt, Human
caguagucagcguuaagccugucuggaucaau

SEQ ID NO: 355976 - RNA, 32 nt, Human
caguagugugagccaagcgcagccugccaggc

SEQ ID NO: 355977 - RNA, 32 nt, Human
caguaguuaaugaauuguggcaggacugaguc

SEQ ID NO: 355978 - RNA, 32 nt, Human
caguaguuagcccagguguggggaacgagagu

SEQ ID NO: 355979 - RNA, 19 nt, Human
caguaguucagugagaaug

SEQ ID NO: 355980 - RNA, 20 nt, Human
caguaguucucaaacacucc

SEQ ID NO: 355981 - RNA, 32 nt, Human
caguaguucuccuugcugaauaguauuccauu

SEQ ID NO: 355982 - RNA, 24 nt, Human
caguaguuuacgccuguaauccca

SEQ ID NO: 355983 - RNA, 32 nt, Human
caguaguuuauuuggcguuuggcuccaggaug

SEQ ID NO: 355984 - RNA, 32 nt, Human
caguaguuucacccauuugcauggaaaaauuu

SEQ ID NO: 355985 - RNA, 32 nt, Human
caguauaaaaacacuggcacuugaauguugaa

SEQ ID NO: 355986 - RNA, 32 nt, Human
caguauaacuaaacaugauauaugagcuuuug

SEQ ID NO: 355987 - RNA, 32 nt, Human
caguauacaagcuuuuguguauaaauguuuua

SEQ ID NO: 355988 - RNA, 32 nt, Human
caguauagaguccauauacaaagaaguuacag

SEQ ID NO: 355989 - RNA, 30 nt, Human
caguauagcuugcaauuaagaccuagauca

SEQ ID NO: 355990 - RNA, 32 nt, Human
caguauaggagagagagcaaggauugagucug

SEQ ID NO: 355991 - RNA, 32 nt, Human
caguauaguguaugaauugcugugcugcaaag

SEQ ID NO: 355992 - RNA, 32 nt, Human
caguauauacaucaccucucacccucaccugc

SEQ ID NO: 355993 - RNA, 32 nt, Human
caguauauagaccuaccauuaguagaaaugau

SEQ ID NO: 355994 - RNA, 32 nt, Human
caguauauuuuaaauuaagaaaagugaacuau

SEQ ID NO: 355995 - RNA, 32 nt, Human
caguaucaaggcugacuuguguucauguggag

SEQ ID NO: 355996 - RNA, 32 nt, Human
caguaucacacguggaaccgcagacagggccc

SEQ ID NO: 355997 - RNA, 32 nt, Human
caguaucaccugcugggcauuaaggcaagugg

SEQ ID NO: 355998 - RNA, 22 nt, Human
caguaucacuaaucaucaggga

SEQ ID NO: 355999 - RNA, 32 nt, Human
caguaucacugccugucucugccaccaaacua

SEQ ID NO: 356000 - RNA, 32 nt, Human
caguaucagcaucaucugggaacuugucacag

SEQ ID NO: 356001 - RNA, 32 nt, Human
caguaucagcaugagcccuggggagcuccaag

SEQ ID NO: 356002 - RNA, 32 nt, Human
caguaucaggaauugggaucgcuagaguguuu

SEQ ID NO: 356003 - RNA, 32 nt, Human
caguaucauccagcaaagaaguucaagauuca

SEQ ID NO: 356004 - RNA, 32 nt, Human
caguaucauucauucucucuccccucacuggu

SEQ ID NO: 356005 - RNA, 32 nt, Human
caguauccagaccaaauguuggaaagucuuau

SEQ ID NO: 356006 - RNA, 32 nt, Human
caguauccauuacuuguguuugcucacaacag

SEQ ID NO: 356007 - RNA, 32 nt, Human
caguaucccacacacacuggugcccagagccg

SEQ ID NO: 356008 - RNA, 32 nt, Human
caguauccuauucucccuuucuccccucacaa

SEQ ID NO: 356009 - RNA, 32 nt, Human
caguauccuuggaguguugcugaagauggagu

SEQ ID NO: 356010 - RNA, 32 nt, Human
caguaucggcaaccuccugggcuuccuagagg

SEQ ID NO: 356011 - RNA, 31 nt, Human
caguaucuagucaggggaaaagacugcauuu

SEQ ID NO: 356012 - RNA, 32 nt, Human
caguaucuccccagacuuccuggucauuuucu

SEQ ID NO: 356013 - RNA, 32 nt, Human
caguaucucugccuucucuccauuguuagccu

SEQ ID NO: 356014 - RNA, 32 nt, Human
caguaucuuuaagauugcuagggaaaagggcc

SEQ ID NO: 356015 - RNA, 32 nt, Human
caguaugaauggaaagaauccaaguugaaguu

SEQ ID NO: 356016 - RNA, 32 nt, Human
caguaugagcugggugucacuuggcucugaac

SEQ ID NO: 356017 - RNA, 32 nt, Human
caguaugaggugaacccacggaccacagagau

SEQ ID NO: 356018 - RNA, 32 nt, Human
caguaugaggugagucacaaagugcccaacau

SEQ ID NO: 356019 - RNA, 32 nt, Human
caguaugcaaagcaaucuuuuauacaauaauu

SEQ ID NO: 356020 - RNA, 29 nt, Human
caguaugcaaauuagguuuuucugccaag

SEQ ID NO: 356021 - RNA, 32 nt, Human
caguaugcaaguuauucuugcaccacaugcuc

SEQ ID NO: 356022 - RNA, 32 nt, Human
caguaugcagguaggccuaaugggggaagaug

SEQ ID NO: 356023 - RNA, 32 nt, Human
caguaugccaaguggauuccagccucauggcc

SEQ ID NO: 356024 - RNA, 32 nt, Human
caguaugcuagaauuuugaggcucccuucuga

SEQ ID NO: 356025 - RNA, 32 nt, Human
caguauggccaacaugguaagacccugucucu

SEQ ID NO: 356026 - RNA, 32 nt, Human
caguauggcuaaauccauuuauuccaaaauca

SEQ ID NO: 356027 - RNA, 22 nt, Human
caguaugggugacagagugaga

SEQ ID NO: 356028 - RNA, 22 nt, Human
caguaugucacucccacuccca

SEQ ID NO: 356029 - RNA, 32 nt, Human
caguauguccuaugcaaugucauucacacaca

SEQ ID NO: 356030 - RNA, 32 nt, Human
caguaugugaccauuugauaccuacuguuuuc

SEQ ID NO: 356031 - RNA, 32 nt, Human
caguauguugggcauuaagaauccaaagauua

SEQ ID NO: 356032 - RNA, 32 nt, Human
caguauuaucauuuugaagucuguaaauugug

SEQ ID NO: 356033 - RNA, 32 nt, Human
caguauuaucucugcuuucagaaguagacaua

SEQ ID NO: 356034 - RNA, 32 nt, Human
caguauucaagugccuugaacaguguccccuc

SEQ ID NO: 356035 - RNA, 32 nt, Human
caguauucacaucugcuaagugaucauuuucu

SEQ ID NO: 356036 - RNA, 19 nt, Human
caguauucguuacauagua

SEQ ID NO: 356037 - RNA, 32 nt, Human
caguauucucagagccugagaguuguuacagu

SEQ ID NO: 356038 - RNA, 32 nt, Human
caguauugagaaacgcagccugccagggaauc

SEQ ID NO: 356039 - RNA, 32 nt, Human
caguauugcucacccagugcccucuccccuca

SEQ ID NO: 356040 - RNA, 32 nt, Human
caguauuggagguggagccuagugggagguga

SEQ ID NO: 356041 - RNA, 32 nt, Human
caguauuggaguuuuguucuuuauugcucccu

SEQ ID NO: 356042 - RNA, 32 nt, Human
caguauuguccucaccaaccccagcuguggcc

SEQ ID NO: 356043 - RNA, 27 nt, Human
caguauuguggaggaaaugcugugaaa

SEQ ID NO: 356044 - RNA, 32 nt, Human
caguauuguguaguuuagacagaucaccugag

SEQ ID NO: 356045 - RNA, 32 nt, Human
caguauuguuuucuuauaugugcaaugaagug

SEQ ID NO: 356046 - RNA, 32 nt, Human
caguauuuaagugcccauaaggcagcaugaaa

SEQ ID NO: 356047 - RNA, 32 nt, Human
caguauuuagagcugcuguagcuguuccuuca

SEQ ID NO: 356048 - RNA, 19 nt, Human
caguauuucucagcuguga

SEQ ID NO: 356049 - RNA, 31 nt, Human
caguauuucuuuguuauacauuuaaagauuu

SEQ ID NO: 356050 - RNA, 32 nt, Human
caguauuugaagugugagggcuuuguguauag

SEQ ID NO: 356051 - RNA, 32 nt, Human
caguauuugcagaagggcaaagcugcuuaaga

SEQ ID NO: 356052 - RNA, 32 nt, Human
caguauuugggcagaugcuauggguuacaguu

SEQ ID NO: 356053 - RNA, 32 nt, Human
caguauuuguaagcauuucagcagaacaauaa

SEQ ID NO: 356054 - RNA, 32 nt, Human
caguauuuuaaaagcucaaaguagaagaggag

SEQ ID NO: 356055 - RNA, 32 nt, Human
caguauuuucacaagcuacaaaaacauccaaa

SEQ ID NO: 356056 - RNA, 23 nt, Human
caguauuuucucuacuucucuca

SEQ ID NO: 356057 - RNA, 32 nt, Human
caguauuuugcacuugauuacauauccuucac

SEQ ID NO: 356058 - RNA, 32 nt, Human
cagucaaccagcuguggcuuccugugccuaga

SEQ ID NO: 356059 - RNA, 32 nt, Human
cagucaacccccauaaccuggggauugggcag

SEQ ID NO: 356060 - RNA, 32 nt, Human
cagucaagaaaaugagauguuuuccaucagag

SEQ ID NO: 356061 - RNA, 32 nt, Human
cagucaagaugggcggaaacuccacaucggca

SEQ ID NO: 356062 - RNA, 32 nt, Human
cagucaaggacaaaccucccaccucacagaca

SEQ ID NO: 356063 - RNA, 32 nt, Human
cagucaaggcuucucaauuuguacuuuccagg

SEQ ID NO: 356064 - RNA, 32 nt, Human
cagucaaggugacgcauccuugccgggccagc

SEQ ID NO: 356065 - RNA, 32 nt, Human
cagucaagguggggucccaggagcagcuguga

SEQ ID NO: 356066 - RNA, 32 nt, Human
cagucaauaaugccacuuuagacaaaaaucag

SEQ ID NO: 356067 - RNA, 32 nt, Human
cagucaaugccacucuccacaacaacaaugaa

SEQ ID NO: 356068 - RNA, 32 nt, Human
cagucacaaguguggcuggugucauucugggu

SEQ ID NO: 356069 - RNA, 16 nt, Human
cagucacaaugagaug

SEQ ID NO: 356070 - RNA, 32 nt, Human
cagucacacaaagcuacccaucugccagauca

SEQ ID NO: 356071 - RNA, 32 nt, Human
cagucacacagcccugcuuggccagcacugcc

SEQ ID NO: 356072 - RNA, 31 nt, Human
cagucacacagcuaauauaugccagagccca

SEQ ID NO: 356073 - RNA, 32 nt, Human
cagucacacagcuuccaggcacugggaguggu

SEQ ID NO: 356074 - RNA, 32 nt, Human
cagucacaccccugcacuccagccugggugac

SEQ ID NO: 356075 - RNA, 32 nt, Human
cagucacaggcagaagaaggaaacuggacucu

SEQ ID NO: 356076 - RNA, 32 nt, Human
cagucacaggcaggggccuugaggaugauuuc

SEQ ID NO: 356077 - RNA, 32 nt, Human
cagucacagucacacacacauauguauuacuu

SEQ ID NO: 356078 - RNA, 32 nt, Human
cagucacaucacugcacccguccuguguccuc

SEQ ID NO: 356079 - RNA, 32 nt, Human
cagucacauuucagccacugcucugagaauuu

SEQ ID NO: 356080 - RNA, 32 nt, Human
cagucaccaaccuccucugcccucggggcagc

SEQ ID NO: 356081 - RNA, 32 nt, Human
cagucaccacauccuucugccuggguggccuc

SEQ ID NO: 356082 - RNA, 32 nt, Human
cagucaccauagcaacacucugagauggcagg

SEQ ID NO: 356083 - RNA, 32 nt, Human
cagucacccaaccagagccucugaggauggcc

SEQ ID NO: 356084 - RNA, 32 nt, Human
cagucacccacugucagcccccaucugacaag

SEQ ID NO: 356085 - RNA, 32 nt, Human
cagucacccugccucaguuaucaacacacacc

SEQ ID NO: 356086 - RNA, 32 nt, Human
cagucacccuugcuaaaaaccuggcaaugcaa

SEQ ID NO: 356087 - RNA, 18 nt, Human
cagucaccucuucugcca

SEQ ID NO: 356088 - RNA, 32 nt, Human
cagucaccugaacaaggaaacuugucacaagu

SEQ ID NO: 356089 - RNA, 32 nt, Human
cagucaccuguaaucccagcuacuugggaggc

SEQ ID NO: 356090 - RNA, 32 nt, Human
cagucaccuguggcagaggugugcagaggcag

SEQ ID NO: 356091 - RNA, 18 nt, Human
cagucaccuuuggccuca

SEQ ID NO: 356092 - RNA, 32 nt, Human
cagucacgccacugcauucuauccugggcaac

SEQ ID NO: 356093 - RNA, 32 nt, Human
cagucacugcaaucucuuuaccaccuccccac

SEQ ID NO: 356094 - RNA, 32 nt, Human
cagucacugcauucuuagguauuccaaaccaa

SEQ ID NO: 356095 - RNA, 32 nt, Human
cagucacugccugggccgugcgcugcagcucg

SEQ ID NO: 356096 - RNA, 32 nt, Human
cagucacugccugggcugugugguucugggcc

SEQ ID NO: 356097 - RNA, 32 nt, Human
cagucacugggcagccacauagcagcugcagg

SEQ ID NO: 356098 - RNA, 32 nt, Human
cagucacugugcaauaugcccccuggguccca

SEQ ID NO: 356099 - RNA, 32 nt, Human
cagucagaacagcagccucuacacauguuguc

SEQ ID NO: 356100 - RNA, 32 nt, Human
cagucagacgcugcaggcaccacuaucaccag

SEQ ID NO: 356101 - RNA, 32 nt, Human
cagucagagagggaguggcagaugacacugcu

SEQ ID NO: 356102 - RNA, 32 nt, Human
cagucagagggcccucagucaccccgccccau

SEQ ID NO: 356103 - RNA, 32 nt, Human
cagucagauguucuucuccuucagcuucggcu

SEQ ID NO: 356104 - RNA, 32 nt, Human
cagucagauuauccucaguuucagauacuuca

SEQ ID NO: 356105 - RNA, 32 nt, Human
cagucagauuccaggcuggagugugauucugu

SEQ ID NO: 356106 - RNA, 32 nt, Human
cagucagcaaggaagccgggugucgcucacac

SEQ ID NO: 356107 - RNA, 32 nt, Human
cagucagcaauauguauccuuucucucaagcu

SEQ ID NO: 356108 - RNA, 32 nt, Human
cagucagcacuuccuguccccugcagaggcuc

SEQ ID NO: 356109 - RNA, 23 nt, Human
cagucagcagccucaucugcaga

SEQ ID NO: 356110 - RNA, 32 nt, Human
cagucagcaguuucugggcacuucucucagua

SEQ ID NO: 356111 - RNA, 32 nt, Human
cagucagcaugaauccaguccagauauuucac

SEQ ID NO: 356112 - RNA, 32 nt, Human
cagucagcauugcaccugcuauggagaagggu

SEQ ID NO: 356113 - RNA, 32 nt, Human
cagucagccgacugcccugucuugccucaaau

SEQ ID NO: 356114 - RNA, 32 nt, Human
cagucagccuugcuuggaauucuggcagguuc

SEQ ID NO: 356115 - RNA, 32 nt, Human
cagucagcucuauccugaaagcauugucccaa

SEQ ID NO: 356116 - RNA, 32 nt, Human
cagucagcuucauggcagaauguggccauuug

SEQ ID NO: 356117 - RNA, 32 nt, Human
cagucagcuugggucccuaucucuggccagag

SEQ ID NO: 356118 - RNA, 32 nt, Human
cagucaggacucaguaagugucgggagaacac

SEQ ID NO: 356119 - RNA, 32 nt, Human
cagucaggaggcacucuauuaagcugagggca

SEQ ID NO: 356120 - RNA, 32 nt, Human
cagucaggauaucaguccgugccaccaggccc

SEQ ID NO: 356121 - RNA, 32 nt, Human
cagucaggcagggagcccuucuccccacagag

SEQ ID NO: 356122 - RNA, 32 nt, Human
cagucaggccccagagagggcaggacaagccu

SEQ ID NO: 356123 - RNA, 32 nt, Human
cagucaggccugaggacaaggugagcucgcug

SEQ ID NO: 356124 - RNA, 32 nt, Human
cagucaggcgggcuugccauguucugugaauc

SEQ ID NO: 356125 - RNA, 21 nt, Human
cagucagggacacucagaaga

SEQ ID NO: 356126 - RNA, 17 nt, Human
cagucagggacuggaga

SEQ ID NO: 356127 - RNA, 20 nt, Human
cagucagggcauccuccgca

SEQ ID NO: 356128 - RNA, 23 nt, Human
cagucagggccaagagagcagug

SEQ ID NO: 356129 - RNA, 32 nt, Human
cagucagggccaggaggaacacgugaaggaga

SEQ ID NO: 356130 - RNA, 32 nt, Human
cagucagggccuaggaugggccugugucacca

SEQ ID NO: 356131 - RNA, 32 nt, Human
cagucaguauuacccugugaagccccuucccu

SEQ ID NO: 356132 - RNA, 32 nt, Human
cagucagucaguccccagcaauggcggacgga

SEQ ID NO: 356133 - RNA, 32 nt, Human
cagucagucucucccuggcucucccuccaucc

SEQ ID NO: 356134 - RNA, 32 nt, Human
cagucagugaugacucaucuuagaaguauuuu

SEQ ID NO: 356135 - RNA, 32 nt, Human
cagucagugcaagagaaaagaaagcacagaaa

SEQ ID NO: 356136 - RNA, 32 nt, Human
cagucagugcuggagaaaucuugaauagcuua

SEQ ID NO: 356137 - RNA, 32 nt, Human
cagucaguuguguuuggacaagugcaacaguc

SEQ ID NO: 356138 - RNA, 32 nt, Human
cagucauaaaguugacuuucagcacaaaagau

SEQ ID NO: 356139 - RNA, 32 nt, Human
cagucauauaaaugcuuacagacugaaaaaug

SEQ ID NO: 356140 - RNA, 32 nt, Human
cagucaucacauaagaacagcuaccuucucca

SEQ ID NO: 356141 - RNA, 32 nt, Human
cagucaucauggguguuuuugucaacugcuug

SEQ ID NO: 356142 - RNA, 32 nt, Human
cagucaucccaggcgcaggucucaaggcggcu

SEQ ID NO: 356143 - RNA, 32 nt, Human
cagucaucccuuaagacacacuggaaaucaca

SEQ ID NO: 356144 - RNA, 32 nt, Human
cagucaucucaaauggcaaaggcuggagagcu

SEQ ID NO: 356145 - RNA, 32 nt, Human
cagucaucucuagcccccaaaucaucucuuca

SEQ ID NO: 356146 - RNA, 32 nt, Human
cagucaucugacccagcuccacccucggcacc

SEQ ID NO: 356147 - RNA, 18 nt, Human
cagucaucuucugcucca

SEQ ID NO: 356148 - RNA, 32 nt, Human
cagucaugacuuagugucauugccugccuauu

SEQ ID NO: 356149 - RNA, 32 nt, Human
cagucaugagccaccaugcccagccuaccaua

SEQ ID NO: 356150 - RNA, 32 nt, Human
cagucaugagccaccaugcccagccuauuuau

SEQ ID NO: 356151 - RNA, 32 nt, Human
cagucaugagccaccgugcccagccuaauucc

SEQ ID NO: 356152 - RNA, 32 nt, Human
cagucaugaucgggugggggacaugugggcug

SEQ ID NO: 356153 - RNA, 32 nt, Human
cagucaugcagucugggaguggggaagugauc

SEQ ID NO: 356154 - RNA, 30 nt, Human
cagucauggcggagcuggaggcuguggccg

SEQ ID NO: 356155 - RNA, 32 nt, Human
cagucauuacaaaggccaccaucacaggaucg

SEQ ID NO: 356156 - RNA, 32 nt, Human
cagucauuacagaaaaagcaaauauucccuca

SEQ ID NO: 356157 - RNA, 31 nt, Human
cagucauucaauaaacacuguuugagcaccu

SEQ ID NO: 356158 - RNA, 19 nt, Human
cagucauucuggcaugaaa

SEQ ID NO: 356159 - RNA, 32 nt, Human
cagucauugcauuuuucccugccuauaccugu

SEQ ID NO: 356160 - RNA, 32 nt, Human
cagucauuuaguagaauagaaaagcaacauag

SEQ ID NO: 356161 - RNA, 32 nt, Human
cagucauuucugaaucuuuccacauuauauua

SEQ ID NO: 356162 - RNA, 31 nt, Human
cagucauuuggguuggagaugccuaaaaccc

SEQ ID NO: 356163 - RNA, 32 nt, Human
cagucauuuucuuuauuggugacuccucuccc

SEQ ID NO: 356164 - RNA, 32 nt, Human
cagucauuuuuguuucuaccucccagaucgga

SEQ ID NO: 356165 - RNA, 23 nt, Human
caguccaaaacaaguuacagcug

SEQ ID NO: 356166 - RNA, 32 nt, Human
caguccaaaccugcaccauccaucauuaugua

SEQ ID NO: 356167 - RNA, 32 nt, Human
caguccaaacuguucugagaaggugaacuguu

SEQ ID NO: 356168 - RNA, 32 nt, Human
caguccaaaugacuguauaggaggcccuuauu

SEQ ID NO: 356169 - RNA, 32 nt, Human
caguccaacauccuuuucuccaucagcaacua

SEQ ID NO: 356170 - RNA, 19 nt, Human
caguccaagccugcugcug

SEQ ID NO: 356171 - RNA, 32 nt, Human
caguccaagucuucucaagauccgagucuacc

SEQ ID NO: 356172 - RNA, 32 nt, Human
caguccacaaagugcugggauuacagguguga

SEQ ID NO: 356173 - RNA, 32 nt, Human
caguccacaacaaaggcacuggauucugaaug

SEQ ID NO: 356174 - RNA, 32 nt, Human
caguccacaggcauggaagcugugaggggaca

SEQ ID NO: 356175 - RNA, 32 nt, Human
caguccacccacccucucucugaucucccccu

SEQ ID NO: 356176 - RNA, 32 nt, Human
caguccacccccuccgccuccuggccuccacc

SEQ ID NO: 356177 - RNA, 32 nt, Human
caguccacuagaacauucugaaagugauacuc

SEQ ID NO: 356178 - RNA, 32 nt, Human
caguccacugcaaccucugcccucccggguuu

SEQ ID NO: 356179 - RNA, 32 nt, Human
caguccagaaggcaauuggccacuccuaaugu

SEQ ID NO: 356180 - RNA, 32 nt, Human
caguccagaguugggcaccacaccggccagca

SEQ ID NO: 356181 - RNA, 32 nt, Human
caguccagccaccagcuccacgcacagcgagg

SEQ ID NO: 356182 - RNA, 32 nt, Human
caguccagccuccgucuucugguccacucugc

SEQ ID NO: 356183 - RNA, 32 nt, Human
caguccagccuggaugacagagugagacucca

SEQ ID NO: 356184 - RNA, 19 nt, Human
caguccagccugggcaaca

SEQ ID NO: 356185 - RNA, 32 nt, Human
caguccagccugggcaacaagagcgaaacuca

SEQ ID NO: 356186 - RNA, 32 nt, Human
caguccagccugggcgacagagcgagacuccg

SEQ ID NO: 356187 - RNA, 32 nt, Human
caguccagccugggcgacagagcgagacucug

SEQ ID NO: 356188 - RNA, 32 nt, Human
caguccagccugggcgacagagugagacccca

SEQ ID NO: 356189 - RNA, 32 nt, Human
caguccagccugggcgacagagugagacuccu

SEQ ID NO: 356190 - RNA, 32 nt, Human
caguccagccugggcuacagagugagacugca

SEQ ID NO: 356191 - RNA, 32 nt, Human
caguccagccugggugacagagcaagaccugu

SEQ ID NO: 356192 - RNA, 32 nt, Human
caguccagccugggugacagagccagacacug

SEQ ID NO: 356193 - RNA, 32 nt, Human
caguccagcuauuguccccacacugcaaaauc

SEQ ID NO: 356194 - RNA, 21 nt, Human
caguccaggcuggaguucagu

SEQ ID NO: 356195 - RNA, 22 nt, Human
caguccaggcuggaguucagug

SEQ ID NO: 356196 - RNA, 32 nt, Human
caguccaggcugguccuuugagcgcagcucaa

SEQ ID NO: 356197 - RNA, 32 nt, Human
caguccaggggcuccaagaccaacaggagcau

SEQ ID NO: 356198 - RNA, 32 nt, Human
caguccagugaugugggaaguuaccuuuuaua

SEQ ID NO: 356199 - RNA, 32 nt, Human
caguccaucagggacuuccugcagagcgacga

SEQ ID NO: 356200 - RNA, 32 nt, Human
caguccaucucgagagaaagggagugguugaa

SEQ ID NO: 356201 - RNA, 32 nt, Human
caguccaugcagcuguucuugccaucaaugaa

SEQ ID NO: 356202 - RNA, 30 nt, Human
caguccauuuugaaucaagaaagacucauu

SEQ ID NO: 356203 - RNA, 32 nt, Human
cagucccaaacacgccagagugcaaugcccuc

SEQ ID NO: 356204 - RNA, 31 nt, Human
cagucccaaagagucaguauugggugguaac

SEQ ID NO: 356205 - RNA, 32 nt, Human
cagucccaaauccaguccucuggcccuugccu

SEQ ID NO: 356206 - RNA, 32 nt, Human
cagucccaacgucugccucacagcagauucuu

SEQ ID NO: 356207 - RNA, 32 nt, Human
cagucccaagcccuagcccuaggggguucucc

SEQ ID NO: 356208 - RNA, 32 nt, Human
cagucccacuuccuggauaauucucuacccuc

SEQ ID NO: 356209 - RNA, 21 nt, Human
cagucccagaggcaguggggg

SEQ ID NO: 356210 - RNA, 32 nt, Human
cagucccagcaacaugggaggcugaacaggag

SEQ ID NO: 356211 - RNA, 32 nt, Human
cagucccagcaagcaacauucaucgggcacag

SEQ ID NO: 356212 - RNA, 32 nt, Human
cagucccagcacagugggacaaaaagaauuua

SEQ ID NO: 356213 - RNA, 32 nt, Human
cagucccagcccuucuuugcagcugggccucu

SEQ ID NO: 356214 - RNA, 32 nt, Human
cagucccagcuaccugggaggcugagucagga

SEQ ID NO: 356215 - RNA, 32 nt, Human
cagucccagcuacucaggaggcugaggcagga

SEQ ID NO: 356216 - RNA, 32 nt, Human
cagucccagcuacucgggaggcugaggcagga

SEQ ID NO: 356217 - RNA, 32 nt, Human
cagucccagcuacuugggaggcugaggcagga

SEQ ID NO: 356218 - RNA, 32 nt, Human
cagucccagcuauucaggaggcugaggcaaca

SEQ ID NO: 356219 - RNA, 32 nt, Human
cagucccaggagcuggaagcgaaccacagugu

SEQ ID NO: 356220 - RNA, 32 nt, Human
cagucccaggauuaggguuuucuguuccccuu

SEQ ID NO: 356221 - RNA, 19 nt, Human
cagucccagggcacugggg

SEQ ID NO: 356222 - RNA, 20 nt, Human
cagucccagggcacugggga

SEQ ID NO: 356223 - RNA, 32 nt, Human
cagucccaggggacaggagagaaaucuguaaa

SEQ ID NO: 356224 - RNA, 16 nt, Human
cagucccagugagaug

SEQ ID NO: 356225 - RNA, 32 nt, Human
cagucccaguuaccugggaggcugaggcagga

SEQ ID NO: 356226 - RNA, 32 nt, Human
cagucccaguuacuugggaggcugaggcagga

SEQ ID NO: 356227 - RNA, 32 nt, Human
caguccccacucccagugguuuuccucacuca

SEQ ID NO: 356228 - RNA, 32 nt, Human
caguccccacugcacccccuccagaggcgacu

SEQ ID NO: 356229 - RNA, 32 nt, Human
caguccccagcaagugcccagcagguaccugu

SEQ ID NO: 356230 - RNA, 32 nt, Human
caguccccagcaauggcggacggaggugagcg

SEQ ID NO: 356231 - RNA, 32 nt, Human
caguccccagcaccugccuuucucacuacuuc

SEQ ID NO: 356232 - RNA, 32 nt, Human
caguccccagcccucuggguuggccugcuguc

SEQ ID NO: 356233 - RNA, 32 nt, Human
caguccccaggacagggucaccaccuuucucu

SEQ ID NO: 356234 - RNA, 32 nt, Human
caguccccagggccuuuggagggaaggguugg

SEQ ID NO: 356235 - RNA, 32 nt, Human
cagucccccaaagucuuaacucuuuucagcau

SEQ ID NO: 356236 - RNA, 32 nt, Human
cagucccccaugggaacccugccaggucccuc

SEQ ID NO: 356237 - RNA, 32 nt, Human
cagucccccucacaaaccaccccacagaucca

SEQ ID NO: 356238 - RNA, 32 nt, Human
cagucccccuccacauguauccacaucugagc

SEQ ID NO: 356239 - RNA, 32 nt, Human
cagucccccugccccagggcucccggcuaugg

SEQ ID NO: 356240 - RNA, 32 nt, Human
cagucccccugcgacucccuguuuccugggcu

SEQ ID NO: 356241 - RNA, 32 nt, Human
caguccccuccugugcuggcagcuuugcccac

SEQ ID NO: 356242 - RNA, 32 nt, Human
caguccccugcaccccuuccugggacacuaug

SEQ ID NO: 356243 - RNA, 32 nt, Human
caguccccugcagcgucccgucuggcuguuga

SEQ ID NO: 356244 - RNA, 32 nt, Human
caguccccugcagguggcagcccucuuuucug

SEQ ID NO: 356245 - RNA, 32 nt, Human
caguccccuugaacuucugcccucuguucagg

SEQ ID NO: 356246 - RNA, 32 nt, Human
cagucccgcccugucaaggaaauuuaaaagaa

SEQ ID NO: 356247 - RNA, 32 nt, Human
cagucccuaagaggaaugccugcuggcuauug

SEQ ID NO: 356248 - RNA, 32 nt, Human
cagucccuauuaugcaaaaugugaauuuaauu

SEQ ID NO: 356249 - RNA, 20 nt, Human
cagucccucagcuucaccca

SEQ ID NO: 356250 - RNA, 32 nt, Human
cagucccuccacugugaacaagcuuuugcagc

SEQ ID NO: 356251 - RNA, 32 nt, Human
cagucccucccaggaaccuguuggagaggcag

SEQ ID NO: 356252 - RNA, 32 nt, Human
cagucccucccauggaugacucaggccuccca

SEQ ID NO: 356253 - RNA, 32 nt, Human
cagucccuccccagcccagcagucccuccagg

SEQ ID NO: 356254 - RNA, 21 nt, Human
cagucccucccucaagacuaa

SEQ ID NO: 356255 - RNA, 32 nt, Human
cagucccucuucuccccaggaccccagggcca

SEQ ID NO: 356256 - RNA, 32 nt, Human
cagucccugcagcuccacaaacugacccaucc

SEQ ID NO: 356257 - RNA, 32 nt, Human
cagucccugcaggucccucacccuccgggcug

SEQ ID NO: 356258 - RNA, 32 nt, Human
cagucccugccuggccgaccacuguggccugc

SEQ ID NO: 356259 - RNA, 32 nt, Human
cagucccugccugucugccagccugcagcucu

SEQ ID NO: 356260 - RNA, 32 nt, Human
cagucccugcugggcugccucagucuucagug

SEQ ID NO: 356261 - RNA, 27 nt, Human
cagucccuggccguccuccagcaccuu

SEQ ID NO: 356262 - RNA, 32 nt, Human
cagucccugggucgggcggauccucccagagg

SEQ ID NO: 356263 - RNA, 21 nt, Human
cagucccuuucugucccagcu

SEQ ID NO: 356264 - RNA, 32 nt, Human
caguccgcugcucgcccgcccugggugcgaga

SEQ ID NO: 356265 - RNA, 32 nt, Human
caguccggaguuuuggcuccucuccuuuccuc

SEQ ID NO: 356266 - RNA, 32 nt, Human
caguccggccugggcgacagagcgagacuccg

SEQ ID NO: 356267 - RNA, 32 nt, Human
caguccggccugggugaaagagcgagacuccg

SEQ ID NO: 356268 - RNA, 32 nt, Human
caguccggucaacguggugaaaccccaucucu

SEQ ID NO: 356269 - RNA, 32 nt, Human
caguccguccaugcucuguggcauuuugcuag

SEQ ID NO: 356270 - RNA, 32 nt, Human
caguccuaacagggugagaaagcacaagaggg

SEQ ID NO: 356271 - RNA, 32 nt, Human
caguccuaacccuacccagccugcugccucag

SEQ ID NO: 356272 - RNA, 32 nt, Human
caguccuacauuucugaauugacuucuagcac

SEQ ID NO: 356273 - RNA, 32 nt, Human
caguccuagggcucggacuccccagccuuucc

SEQ ID NO: 356274 - RNA, 32 nt, Human
caguccucaaagcuuuuugaaaaccaacacca

SEQ ID NO: 356275 - RNA, 32 nt, Human
caguccucaaauaaauaaugucuugauuuuau

SEQ ID NO: 356276 - RNA, 19 nt, Human
caguccucaccacagucca

SEQ ID NO: 356277 - RNA, 32 nt, Human
caguccucacgugggacccucccaccauggca

SEQ ID NO: 356278 - RNA, 32 nt, Human
caguccucagccaccuucuccacggcagcgac

SEQ ID NO: 356279 - RNA, 32 nt, Human
caguccucaggcccuucucuggcugcagagcc

SEQ ID NO: 356280 - RNA, 32 nt, Human
caguccucaggguuugugccucucgcucggac

SEQ ID NO: 356281 - RNA, 32 nt, Human
caguccucauuugccuucccuaccucuuccuc

SEQ ID NO: 356282 - RNA, 32 nt, Human
caguccuccacacccaaacuguuucugauugg

SEQ ID NO: 356283 - RNA, 32 nt, Human
caguccuccaguguuuuagacgcccagcugca

SEQ ID NO: 356284 - RNA, 32 nt, Human
caguccucccaccucagccuccuggguagcug

SEQ ID NO: 356285 - RNA, 32 nt, Human
caguccucccugucccaugccugcuggcucug

SEQ ID NO: 356286 - RNA, 32 nt, Human
caguccuccgaggacaucugggcugcgugcug

SEQ ID NO: 356287 - RNA, 32 nt, Human
caguccuccugccucagccuccuaaagugccg

SEQ ID NO: 356288 - RNA, 32 nt, Human
caguccucuccugcugucacagcugccaucca

SEQ ID NO: 356289 - RNA, 32 nt, Human
caguccucucugccuccuccuggcugaagcug

SEQ ID NO: 356290 - RNA, 32 nt, Human
caguccucuugaggcacucaagccugagagga

SEQ ID NO: 356291 - RNA, 32 nt, Human
caguccucuugcagccugguguucuuacauuu

SEQ ID NO: 356292 - RNA, 32 nt, Human
caguccucuuugcguggaaucagaccucuuuu

SEQ ID NO: 356293 - RNA, 32 nt, Human
caguccugaguaggaguccaggacucccacug

SEQ ID NO: 356294 - RNA, 32 nt, Human
caguccugauuucuagauuucaccuccccucc

SEQ ID NO: 356295 - RNA, 32 nt, Human
caguccugcccucccuccuuccuugguucacc

SEQ ID NO: 356296 - RNA, 32 nt, Human
caguccugcuauuuuccuccucuuguuacaag

SEQ ID NO: 356297 - RNA, 32 nt, Human
caguccugcugagccaaaggcuuugucauucc

SEQ ID NO: 356298 - RNA, 32 nt, Human
caguccugcuucuuccagagaaauaaaguuag

SEQ ID NO: 356299 - RNA, 32 nt, Human
caguccuggcugcuuuggcuccaccuucuucc

SEQ ID NO: 356300 - RNA, 32 nt, Human
caguccugggagacccauguaaauaccagacu

SEQ ID NO: 356301 - RNA, 32 nt, Human
caguccugggcccugggccuuggcugcuguca

SEQ ID NO: 356302 - RNA, 21 nt, Human
caguccugggcucgcggcugg

SEQ ID NO: 356303 - RNA, 32 nt, Human
caguccugucucaaacuccagaccucggguga

SEQ ID NO: 356304 - RNA, 32 nt, Human
caguccugucuggguuagggucuuccacauuu

SEQ ID NO: 356305 - RNA, 19 nt, Human
caguccuguggucuccgca

SEQ ID NO: 356306 - RNA, 32 nt, Human
caguccuguguaggagaggaaagggaaucaaa

SEQ ID NO: 356307 - RNA, 22 nt, Human
caguccuuaaugucaccaugcu

SEQ ID NO: 356308 - RNA, 32 nt, Human
caguccuuauuaucccagcuugcugaggggca

SEQ ID NO: 356309 - RNA, 31 nt, Human
caguccuucaauaaaaagcugcuuauugaaa

SEQ ID NO: 356310 - RNA, 32 nt, Human
caguccuucccaaggucuccuaucauaaauag

SEQ ID NO: 356311 - RNA, 32 nt, Human
caguccuuccucguugaguggccagugcccug

SEQ ID NO: 356312 - RNA, 32 nt, Human
caguccuuccuuuugacccaccccaggaagau

SEQ ID NO: 356313 - RNA, 32 nt, Human
caguccuugaaggugaaguuguguguuacuag

SEQ ID NO: 356314 - RNA, 32 nt, Human
caguccuugcaguauuaaaaacuggcaacaau

SEQ ID NO: 356315 - RNA, 32 nt, Human
caguccuuguaucugcucaccuauuccaaacu

SEQ ID NO: 356316 - RNA, 32 nt, Human
caguccuugugcagcaccaggaagaaaccgac

SEQ ID NO: 356317 - RNA, 32 nt, Human
caguccuuucuuagggaaaugacagggcaaag

SEQ ID NO: 356318 - RNA, 32 nt, Human
cagucgacuucaugagcuucauuuggauuucu

SEQ ID NO: 356319 - RNA, 32 nt, Human
cagucgagacgggguuuccccauguuggucag

SEQ ID NO: 356320 - RNA, 32 nt, Human
cagucgagccugggcgacacaaagagaccacc

SEQ ID NO: 356321 - RNA, 32 nt, Human
cagucgaggauuccucaaguaccauuugcuag

SEQ ID NO: 356322 - RNA, 32 nt, Human
cagucgaggcccugcuccgggagcucaucuug

SEQ ID NO: 356323 - RNA, 32 nt, Human
cagucgaguccauauguccacccauugauuuu

SEQ ID NO: 356324 - RNA, 19 nt, Human
cagucgcaaccuggcccgg

SEQ ID NO: 356325 - RNA, 32 nt, Human
cagucgcaccagccuccaggagcacugggcca

SEQ ID NO: 356326 - RNA, 32 nt, Human
cagucgcccaggcuggagugcagcagcacagu

SEQ ID NO: 356327 - RNA, 32 nt, Human
cagucgcccaggcuggagugcaguggcaugau

SEQ ID NO: 356328 - RNA, 32 nt, Human
cagucgcccugcagccucacacagauccugca

SEQ ID NO: 356329 - RNA, 32 nt, Human
cagucgccucaguacuuuuucuuucuggauuu

SEQ ID NO: 356330 - RNA, 32 nt, Human
cagucgccugggaagcuccaguuuccccaugg

SEQ ID NO: 356331 - RNA, 32 nt, Human
cagucgcguuggcugcugcgaucggccggcgg

SEQ ID NO: 356332 - RNA, 24 nt, Human
cagucgcucacaccuguaaucuca

SEQ ID NO: 356333 - RNA, 32 nt, Human
cagucgcucaggcuggagugcaaugguggggu

SEQ ID NO: 356334 - RNA, 32 nt, Human
cagucgcucaggcuggagugcaguggcgcgau

SEQ ID NO: 356335 - RNA, 32 nt, Human
cagucgcuccagccggggcugcagguggcccg

SEQ ID NO: 356336 - RNA, 32 nt, Human
cagucgcuccaggcccccucacccucaaagug

SEQ ID NO: 356337 - RNA, 32 nt, Human
cagucggaccccuuccucacacuggccccuau

SEQ ID NO: 356338 - RNA, 32 nt, Human
cagucggcaggcagcauggggaagggagggaa

SEQ ID NO: 356339 - RNA, 18 nt, Human
cagucggcauugccugaa

SEQ ID NO: 356340 - RNA, 32 nt, Human
cagucggccugggaaguucacugccccaacuc

SEQ ID NO: 356341 - RNA, 32 nt, Human
cagucgggagaagggagggagagaauuuuauu

SEQ ID NO: 356342 - RNA, 32 nt, Human
cagucgggaggcgaaggcaggagauggcuuga

SEQ ID NO: 356343 - RNA, 32 nt, Human
cagucgggagggagggagcgagcaggcgaagc

SEQ ID NO: 356344 - RNA, 32 nt, Human
cagucgggcgagucgacgcgugaacagauaga

SEQ ID NO: 356345 - RNA, 32 nt, Human
cagucgggcuccaggcuccuccugggucugag

SEQ ID NO: 356346 - RNA, 32 nt, Human
cagucggggcaggccaggggaggggugaagug

SEQ ID NO: 356347 - RNA, 32 nt, Human
cagucggggguauuuaaaaaggacugaacaga

SEQ ID NO: 356348 - RNA, 32 nt, Human
cagucgguagagagcaucaacauauauugugg

SEQ ID NO: 356349 - RNA, 32 nt, Human
cagucgguccacccuugacugcucuuggcuug

SEQ ID NO: 356350 - RNA, 21 nt, Human
cagucggucuuccuccggccc

SEQ ID NO: 356351 - RNA, 23 nt, Human
cagucgucaagccuguaauccca

SEQ ID NO: 356352 - RNA, 23 nt, Human
cagucgucacgccuguaauccca

SEQ ID NO: 356353 - RNA, 23 nt, Human
cagucguccagcaugcucugccc

SEQ ID NO: 356354 - RNA, 32 nt, Human
cagucgucucccuauuacugucaggagugggg

SEQ ID NO: 356355 - RNA, 32 nt, Human
cagucgugagccacuguaccccgccuaaaacu

SEQ ID NO: 356356 - RNA, 32 nt, Human
cagucguggcccggggaucauuccaagucuau

SEQ ID NO: 356357 - RNA, 20 nt, Human
cagucguguccauccuccau

SEQ ID NO: 356358 - RNA, 32 nt, Human
cagucgugugcuggagugagugcugcagaacc

SEQ ID NO: 356359 - RNA, 32 nt, Human
cagucuaacagcuuaccaguugagaacgauau

SEQ ID NO: 356360 - RNA, 32 nt, Human
cagucuaaggaagaagggcaagcccugggacc

SEQ ID NO: 356361 - RNA, 32 nt, Human
cagucuaagugggaaugggaaagaccaccuug

SEQ ID NO: 356362 - RNA, 32 nt, Human
cagucuaauuugaggcugggugcaguggcuca

SEQ ID NO: 356363 - RNA, 32 nt, Human
cagucuaccuccuauucgucugaucuugcuua

SEQ ID NO: 356364 - RNA, 32 nt, Human
cagucuaccugcacucggagccccggcccaau

SEQ ID NO: 356365 - RNA, 22 nt, Human
cagucuaccugcucuguccucu

SEQ ID NO: 356366 - RNA, 32 nt, Human
cagucuagaaacucuucagucacucauaaaau

SEQ ID NO: 356367 - RNA, 32 nt, Human
cagucuagaauccauaaugcucccuacaucuc

SEQ ID NO: 356368 - RNA, 32 nt, Human
cagucuagccugggcaacagagcgagacucug

SEQ ID NO: 356369 - RNA, 32 nt, Human
cagucuagcucugacuuaggucaggggccugu

SEQ ID NO: 356370 - RNA, 32 nt, Human
cagucuaggaggaggaggagguagggugugaa

SEQ ID NO: 356371 - RNA, 32 nt, Human
cagucuaggcugacacauccuacccgaggaca

SEQ ID NO: 356372 - RNA, 32 nt, Human
cagucucaaaauuuccuacaccugccaguucu

SEQ ID NO: 356373 - RNA, 32 nt, Human
cagucucacagaggaagggcagguguccuacg

SEQ ID NO: 356374 - RNA, 32 nt, Human
cagucucaccaacauggagaaaccccgucucc

SEQ ID NO: 356375 - RNA, 32 nt, Human
cagucucaccuucuccccacccuaccucaccu

SEQ ID NO: 356376 - RNA, 23 nt, Human
cagucucacucugucaccaggcu

SEQ ID NO: 356377 - RNA, 32 nt, Human
cagucucacugcacaccacugccucaugcuuc

SEQ ID NO: 356378 - RNA, 32 nt, Human
cagucucacugcagucuuauuuccaaguaaga

SEQ ID NO: 356379 - RNA, 19 nt, Human
cagucucagacugcagcug

SEQ ID NO: 356380 - RNA, 32 nt, Human
cagucucagcaugguuuggagcugaagcuuug

SEQ ID NO: 356381 - RNA, 32 nt, Human
cagucucagcuacucgggaggcugaggcagga

SEQ ID NO: 356382 - RNA, 32 nt, Human
cagucucauauguaucccagcacauguaauuu

SEQ ID NO: 356383 - RNA, 32 nt, Human
cagucucauccagcagguuggguucuagggcu

SEQ ID NO: 356384 - RNA, 20 nt, Human
cagucucauccaucucuaua

SEQ ID NO: 356385 - RNA, 32 nt, Human
cagucucaucuaugucauauuuugccacugcc

SEQ ID NO: 356386 - RNA, 32 nt, Human
cagucuccacaccucuaaucaugugcuccucu

SEQ ID NO: 356387 - RNA, 32 nt, Human
cagucuccaccaggaaccucuucagaaagugu

SEQ ID NO: 356388 - RNA, 20 nt, Human
cagucuccaggaccuccaca

SEQ ID NO: 356389 - RNA, 32 nt, Human
cagucuccaggcgagagagggggccagagugc

SEQ ID NO: 356390 - RNA, 32 nt, Human
cagucuccaguucuccaguguucacaggugag

SEQ ID NO: 356391 - RNA, 32 nt, Human
cagucucccaccccggccccaggcuggaagcc

SEQ ID NO: 356392 - RNA, 32 nt, Human
cagucucccccugcagccuccuguacccgccu

SEQ ID NO: 356393 - RNA, 25 nt, Human
cagucucccgacuucucgucaggcu

SEQ ID NO: 356394 - RNA, 32 nt, Human
cagucuccuaguuuuauuauucucaccuuccg

SEQ ID NO: 356395 - RNA, 32 nt, Human
cagucuccuccaccacucucuaaccugagagc

SEQ ID NO: 356396 - RNA, 32 nt, Human
cagucuccuccccuuaagucauuuccaccauc

SEQ ID NO: 356397 - RNA, 32 nt, Human
cagucuccucggagggagucugaagaugcuua

SEQ ID NO: 356398 - RNA, 22 nt, Human
cagucuccucuguugccaggcu

SEQ ID NO: 356399 - RNA, 32 nt, Human
cagucuccugaaagcugggaugacaggcacau

SEQ ID NO: 356400 - RNA, 32 nt, Human
cagucuccugcagguuucugugccccuguggu

SEQ ID NO: 356401 - RNA, 32 nt, Human
cagucuccugccgccccucccccaggcauggc

SEQ ID NO: 356402 - RNA, 32 nt, Human
cagucuccuggcuuccagcccaggacucugca

SEQ ID NO: 356403 - RNA, 32 nt, Human
cagucuccugguagcugggauuacaggcaugc

SEQ ID NO: 356404 - RNA, 32 nt, Human
cagucucgccccucaggugcugaucccagugg

SEQ ID NO: 356405 - RNA, 32 nt, Human
cagucucgcuuggcucucaugacugugguggu

SEQ ID NO: 356406 - RNA, 30 nt, Human
cagucucgggaucucagggcacaauggcug

SEQ ID NO: 356407 - RNA, 20 nt, Human
cagucucguuccuuuucaca

SEQ ID NO: 356408 - RNA, 32 nt, Human
cagucucuaauucccuucccuucucguuaaga

SEQ ID NO: 356409 - RNA, 32 nt, Human
cagucucucucccagguauuccucucacuagg

SEQ ID NO: 356410 - RNA, 32 nt, Human
cagucucucugccucugccugccuccuggucc

SEQ ID NO: 356411 - RNA, 32 nt, Human
cagucucugcagaguuaccaggaaucuuuccu

SEQ ID NO: 356412 - RNA, 20 nt, Human
cagucucugccaucuuccau

SEQ ID NO: 356413 - RNA, 32 nt, Human
cagucucugcuucuaaaaacuucuaugucuag

SEQ ID NO: 356414 - RNA, 32 nt, Human
cagucucuggaagggcugguucaaggcuguuu

SEQ ID NO: 356415 - RNA, 32 nt, Human
cagucucuuacccaggcuagggugcaguggug

SEQ ID NO: 356416 - RNA, 32 nt, Human
cagucucuucuccuuccccugccugcaacagg

SEQ ID NO: 356417 - RNA, 32 nt, Human
cagucucuucucucccacacccugcccuccuu

SEQ ID NO: 356418 - RNA, 32 nt, Human
cagucucuuguccuggacccuguagggugcca

SEQ ID NO: 356419 - RNA, 17 nt, Human
cagucucuuucucuaua

SEQ ID NO: 356420 - RNA, 32 nt, Human
cagucucuuuggucaguaacaagugcaaugga

SEQ ID NO: 356421 - RNA, 21 nt, Human
cagucugaaaacucuuccaca

SEQ ID NO: 356422 - RNA, 32 nt, Human
cagucugaaaucuacaagaacagagaauucuu

SEQ ID NO: 356423 - RNA, 32 nt, Human
cagucugaacaguggcagcagagagcagucag

SEQ ID NO: 356424 - RNA, 32 nt, Human
cagucugaauccaggucgugggggcugucaua

SEQ ID NO: 356425 - RNA, 32 nt, Human
cagucugaccaacacggagaaaccccaucucu

SEQ ID NO: 356426 - RNA, 32 nt, Human
cagucugaccaacauggagaaaccccaucucu

SEQ ID NO: 356427 - RNA, 32 nt, Human
cagucugaccaacauggagaaacccugucucu

SEQ ID NO: 356428 - RNA, 32 nt, Human
cagucugaccaacguggagaaaccccgucuuu

SEQ ID NO: 356429 - RNA, 32 nt, Human
cagucugacuuccccgcauuccaggcuccucc

SEQ ID NO: 356430 - RNA, 21 nt, Human
cagucugagcaacagaacgag

SEQ ID NO: 356431 - RNA, 32 nt, Human
cagucugagcaacauggugagagcucaucucu

SEQ ID NO: 356432 - RNA, 20 nt, Human
cagucugagcagacacaggc

SEQ ID NO: 356433 - RNA, 32 nt, Human
cagucugagcaggccaggggcugacagcuaau

SEQ ID NO: 356434 - RNA, 32 nt, Human
cagucugagcuucuaccgagucuucccccacc

SEQ ID NO: 356435 - RNA, 32 nt, Human
cagucugcaagccugcucacccacugcuucug

SEQ ID NO: 356436 - RNA, 32 nt, Human
cagucugcaauaaaagcacuuccuaacucugg

SEQ ID NO: 356437 - RNA, 32 nt, Human
cagucugcacccaagagguggaagaggacggg

SEQ ID NO: 356438 - RNA, 32 nt, Human
cagucugcagcuuccugaguccuguucugaaa

SEQ ID NO: 356439 - RNA, 23 nt, Human
cagucugcccuugucacuggucu

SEQ ID NO: 356440 - RNA, 21 nt, Human
cagucugccuggaggccaggg

SEQ ID NO: 356441 - RNA, 32 nt, Human
cagucugcgauuggaaauuuccagccacuuua

SEQ ID NO: 356442 - RNA, 24 nt, Human
cagucugcggugacgaggacucca

SEQ ID NO: 356443 - RNA, 21 nt, Human
cagucugcguuucaucgggcu

SEQ ID NO: 356444 - RNA, 32 nt, Human
cagucugcucaaggucacgcagcuggugacug

SEQ ID NO: 356445 - RNA, 32 nt, Human
cagucugcucaagugucaccuuauuugcaagg

SEQ ID NO: 356446 - RNA, 20 nt, Human
cagucugcugcaucuucuac

SEQ ID NO: 356447 - RNA, 32 nt, Human
cagucugcugggacaugcacauaucagggguu

SEQ ID NO: 356448 - RNA, 32 nt, Human
cagucuggacaacauggggagaccccaucucu

SEQ ID NO: 356449 - RNA, 22 nt, Human
cagucuggaccacagagugaga

SEQ ID NO: 356450 - RNA, 22 nt, Human
cagucuggacgacagagugaga

SEQ ID NO: 356451 - RNA, 32 nt, Human
cagucuggacuuauacagggaggccagaaggg

SEQ ID NO: 356452 - RNA, 32 nt, Human
cagucuggagccagacggggaagggagcaaau

SEQ ID NO: 356453 - RNA, 32 nt, Human
cagucuggagguccccaaggacaucggcaugu

SEQ ID NO: 356454 - RNA, 18 nt, Human
cagucuggauccuuccau

SEQ ID NO: 356455 - RNA, 22 nt, Human
cagucuggaugacagagagaga

SEQ ID NO: 356456 - RNA, 19 nt, Human
cagucuggaugcaguggug

SEQ ID NO: 356457 - RNA, 20 nt, Human
cagucuggcaacagagcaag

SEQ ID NO: 356458 - RNA, 32 nt, Human
cagucuggcagcccggagccuuccgcgguccc

SEQ ID NO: 356459 - RNA, 32 nt, Human
cagucuggccaacaugacgaaaccccgucucu

SEQ ID NO: 356460 - RNA, 32 nt, Human
cagucuggccaacauggcgaaaccccgucucu

SEQ ID NO: 356461 - RNA, 32 nt, Human
cagucuggccaacauggcgaaaccucaucucu

SEQ ID NO: 356462 - RNA, 32 nt, Human
cagucuggccaacauggcgaaaccucauuucu

SEQ ID NO: 356463 - RNA, 32 nt, Human
cagucuggccaacauggggaaaccccgucucu

SEQ ID NO: 356464 - RNA, 32 nt, Human
cagucuggccaacauggugaaaccccaucucu

SEQ ID NO: 356465 - RNA, 32 nt, Human
cagucuggccaacauggugaaaugccgucucu

SEQ ID NO: 356466 - RNA, 32 nt, Human
cagucuggccaaccuggugaaaccccaucucu

SEQ ID NO: 356467 - RNA, 32 nt, Human
cagucuggccaauauggagaaaccuugucucu

SEQ ID NO: 356468 - RNA, 32 nt, Human
cagucuggccaauauggugaaaccccgucucu

SEQ ID NO: 356469 - RNA, 32 nt, Human
cagucuggccaaugugaugaaaccccgucucu

SEQ ID NO: 356470 - RNA, 32 nt, Human
cagucuggccacugucaaggcagggaaggggc

SEQ ID NO: 356471 - RNA, 32 nt, Human
cagucuggccagcuccagggacagaguggccc

SEQ ID NO: 356472 - RNA, 32 nt, Human
cagucuggccugggcgacagagcgagacuccg

SEQ ID NO: 356473 - RNA, 32 nt, Human
cagucuggccugggcgacagagcgagacucug

SEQ ID NO: 356474 - RNA, 32 nt, Human
cagucuggcgggaguccaggaggcagcagcuc

SEQ ID NO: 356475 - RNA, 22 nt, Human
cagucugggacaacagagcaag

SEQ ID NO: 356476 - RNA, 32 nt, Human
cagucugggacaggcacagugggagcugccac

SEQ ID NO: 356477 - RNA, 32 nt, Human
cagucugggauccugaguguccuguggguuca

SEQ ID NO: 356478 - RNA, 32 nt, Human
cagucugggcaacaaaaaugaaacuccgucuc

SEQ ID NO: 356479 - RNA, 32 nt, Human
cagucugggcaacacgaugaaaccccaucucu

SEQ ID NO: 356480 - RNA, 21 nt, Human
cagucugggcaacagagcaag

SEQ ID NO: 356481 - RNA, 21 nt, Human
cagucugggcaacagagcgag

SEQ ID NO: 356482 - RNA, 22 nt, Human
cagucugggcaacagagcgaga

SEQ ID NO: 356483 - RNA, 22 nt, Human
cagucugggcaacagagugaga

SEQ ID NO: 356484 - RNA, 21 nt, Human
cagucugggcaacagugcaag

SEQ ID NO: 356485 - RNA, 32 nt, Human
cagucugggcaacauggugaaaccccaucucu

SEQ ID NO: 356486 - RNA, 32 nt, Human
cagucugggcaacauggugagaccccaucucu

SEQ ID NO: 356487 - RNA, 32 nt, Human
cagucugggcaaccccagcaaugaaaaggggu

SEQ ID NO: 356488 - RNA, 21 nt, Human
cagucugggcgacagagcaag

SEQ ID NO: 356489 - RNA, 22 nt, Human
cagucugggcgacagagcaaga

SEQ ID NO: 356490 - RNA, 22 nt, Human
cagucugggcgacagagcgaga

SEQ ID NO: 356491 - RNA, 22 nt, Human
cagucugggcgacagagugaga

SEQ ID NO: 356492 - RNA, 32 nt, Human
cagucugggcugggagcccacaccccacucac

SEQ ID NO: 356493 - RNA, 32 nt, Human
cagucuggggagagcauggggaucauuucuau

SEQ ID NO: 356494 - RNA, 22 nt, Human
cagucuggguaacagagcgaga

SEQ ID NO: 356495 - RNA, 22 nt, Human
cagucugggugaaagagcgaga

SEQ ID NO: 356496 - RNA, 22 nt, Human
cagucugggugacagagagaga

SEQ ID NO: 356497 - RNA, 22 nt, Human
cagucugggugacagagugaga

SEQ ID NO: 356498 - RNA, 22 nt, Human
cagucugggugacagcgugaga

SEQ ID NO: 356499 - RNA, 32 nt, Human
cagucuggguggauggaaguggcuguccccuu

SEQ ID NO: 356500 - RNA, 22 nt, Human
cagucugggugucagaaugaga

SEQ ID NO: 356501 - RNA, 32 nt, Human
cagucuggucucaaacucccaaccucagguga

SEQ ID NO: 356502 - RNA, 32 nt, Human
cagucuggucucaaacucccgaccucagguga

SEQ ID NO: 356503 - RNA, 32 nt, Human
cagucuggucucaaacuccugaccucaaggau

SEQ ID NO: 356504 - RNA, 32 nt, Human
cagucugguguguguggugggcacacauagaa

SEQ ID NO: 356505 - RNA, 22 nt, Human
cagucugguugacagagugaga

SEQ ID NO: 356506 - RNA, 19 nt, Human
cagucugguuuuggucugg

SEQ ID NO: 356507 - RNA, 32 nt, Human
cagucuguaaaacccgagccugggagaggggc

SEQ ID NO: 356508 - RNA, 32 nt, Human
cagucuguaacuuuccacucuuccuguagucc

SEQ ID NO: 356509 - RNA, 32 nt, Human
cagucugucaccaggcuggagugcaguggcau

SEQ ID NO: 356510 - RNA, 32 nt, Human
cagucugucacccaggcuggagugcaguggcg

SEQ ID NO: 356511 - RNA, 32 nt, Human
cagucugucacccagguuggagugcaguggcg

SEQ ID NO: 356512 - RNA, 32 nt, Human
cagucugucauugucagggaccagggcaaaac

SEQ ID NO: 356513 - RNA, 32 nt, Human
cagucuguccugcuguugguaccuggccuagc

SEQ ID NO: 356514 - RNA, 32 nt, Human
cagucugucuccgggccagggucagggacccu

SEQ ID NO: 356515 - RNA, 32 nt, Human
cagucugucuccucgcugccucccgaggccug

SEQ ID NO: 356516 - RNA, 32 nt, Human
cagucugugaaacccuuagagaugggcugaaa

SEQ ID NO: 356517 - RNA, 25 nt, Human
cagucugugcuccugggcuacaagg

SEQ ID NO: 356518 - RNA, 29 nt, Human
cagucugugcugugugucugggccugucu

SEQ ID NO: 356519 - RNA, 32 nt, Human
cagucuguguuucagcccuggaauugccacau

SEQ ID NO: 356520 - RNA, 22 nt, Human
cagucuguguuugaccuucaca

SEQ ID NO: 356521 - RNA, 32 nt, Human
cagucuguguuuucucuaaaauaaucugaguu

SEQ ID NO: 356522 - RNA, 32 nt, Human
cagucuguuacagguugacacauugcuugacc

SEQ ID NO: 356523 - RNA, 32 nt, Human
cagucuguucacuccauuuucauuugaccagu

SEQ ID NO: 356524 - RNA, 32 nt, Human
cagucuguugcccaggcuggagugcaguggcg

SEQ ID NO: 356525 - RNA, 32 nt, Human
cagucuguuggcagacuggagugcaaucaugg

SEQ ID NO: 356526 - RNA, 32 nt, Human
cagucuguuucccaggcuggaguguagugaua

SEQ ID NO: 356527 - RNA, 32 nt, Human
cagucuuaaagaagaagaaaaugguaccgccg

SEQ ID NO: 356528 - RNA, 32 nt, Human
cagucuuacagaggcuggagcggugagaauga

SEQ ID NO: 356529 - RNA, 32 nt, Human
cagucuucaaagaaaacaaggugaagaccuau

SEQ ID NO: 356530 - RNA, 32 nt, Human
cagucuucagcccccuggaaggaggccauagu

SEQ ID NO: 356531 - RNA, 32 nt, Human
cagucuucauuuuacauacacacacauauuuu

SEQ ID NO: 356532 - RNA, 32 nt, Human
cagucuucauuuugcagaggugagguaagacu

SEQ ID NO: 356533 - RNA, 32 nt, Human
cagucuucccaggaaggugaccugccugacca

SEQ ID NO: 356534 - RNA, 32 nt, Human
cagucuuccuaccugagggguucagaggcugc

SEQ ID NO: 356535 - RNA, 32 nt, Human
cagucuuccugccucgggcucccaacaugcug

SEQ ID NO: 356536 - RNA, 32 nt, Human
cagucuucucaaggagcaauaaucuuggcuca

SEQ ID NO: 356537 - RNA, 32 nt, Human
cagucuucucauucuccuuuacucaggugggg

SEQ ID NO: 356538 - RNA, 32 nt, Human
cagucuucuccagguguccccucccacgagcg

SEQ ID NO: 356539 - RNA, 32 nt, Human
cagucuucuccuuuaugauauccuggcaugca

SEQ ID NO: 356540 - RNA, 32 nt, Human
cagucuugcaaauggagaaccugcucucuggg

SEQ ID NO: 356541 - RNA, 23 nt, Human
cagucuugcucugucaucaggcu

SEQ ID NO: 356542 - RNA, 32 nt, Human
cagucuugcuuauucuucuccugggcuucuug

SEQ ID NO: 356543 - RNA, 32 nt, Human
cagucuuggagcuccuagcuggugauacggag

SEQ ID NO: 356544 - RNA, 29 nt, Human
cagucuuggcugcugcuuaccccuagccu

SEQ ID NO: 356545 - RNA, 30 nt, Human
cagucuugggaucucagggcacaauggcug

SEQ ID NO: 356546 - RNA, 32 nt, Human
cagucuugggcaacugagaaauccuuauuuca

SEQ ID NO: 356547 - RNA, 32 nt, Human
cagucuugucauugccagcuguguugguagug

SEQ ID NO: 356548 - RNA, 32 nt, Human
cagucuugucucaaacuccugggcucaagcga

SEQ ID NO: 356549 - RNA, 32 nt, Human
cagucuuguuacuauccuauugcacauuagag

SEQ ID NO: 356550 - RNA, 32 nt, Human
cagucuuuacuuuuccagccaaauccaguagc

SEQ ID NO: 356551 - RNA, 32 nt, Human
cagucuuucaugguggaagugacacaucuggu

SEQ ID NO: 356552 - RNA, 32 nt, Human
cagucuuuggcagaggauacauugggcuguau

SEQ ID NO: 356553 - RNA, 32 nt, Human
cagucuuugugaaaugaaauaacaugcuucau

SEQ ID NO: 356554 - RNA, 32 nt, Human
cagucuuuguuaauguugaaucaggauuugag

SEQ ID NO: 356555 - RNA, 19 nt, Human
cagucuuuuauucuuuaua

SEQ ID NO: 356556 - RNA, 32 nt, Human
cagugaaaaugguucaucugcacugggguccu

SEQ ID NO: 356557 - RNA, 32 nt, Human
cagugaaagagaagcacacaggcuccaugagc

SEQ ID NO: 356558 - RNA, 32 nt, Human
cagugaaagagcaaaucauuauguuguucuug

SEQ ID NO: 356559 - RNA, 32 nt, Human
cagugaaagcagcuugggauguuggagcuaau

SEQ ID NO: 356560 - RNA, 32 nt, Human
cagugaaaugagaaagaauucacugggaguuu

SEQ ID NO: 356561 - RNA, 32 nt, Human
cagugaacacugucugaauuaaacaaaaagcu

SEQ ID NO: 356562 - RNA, 32 nt, Human
cagugaacagaagagacaaaauauccuuguuc

SEQ ID NO: 356563 - RNA, 32 nt, Human
cagugaaccaugauagcaccacugcaguccag

SEQ ID NO: 356564 - RNA, 32 nt, Human
cagugaaccuuaauucuuucuggcuucacagu

SEQ ID NO: 356565 - RNA, 32 nt, Human
cagugaagaaguuucagugacuuucaaaacca

SEQ ID NO: 356566 - RNA, 18 nt, Human
cagugaagacaggugcuc

SEQ ID NO: 356567 - RNA, 32 nt, Human
cagugaagacaguaacuuggaacugaccacgg

SEQ ID NO: 356568 - RNA, 32 nt, Human
cagugaagcacuacaggaggcaacuguggcau

SEQ ID NO: 356569 - RNA, 32 nt, Human
cagugaagcuguugguugaaucauaauuaaug

SEQ ID NO: 356570 - RNA, 32 nt, Human
cagugaaggaagagaaggccagcagaucagug

SEQ ID NO: 356571 - RNA, 32 nt, Human
cagugaaggcacaaccaacagcugcuccccgg

SEQ ID NO: 356572 - RNA, 32 nt, Human
cagugaaggcauaaugggcuguggagaccuuc

SEQ ID NO: 356573 - RNA, 32 nt, Human
cagugaaggccgugccuggaagugggcccugc

SEQ ID NO: 356574 - RNA, 32 nt, Human
cagugaaggcucggggcugcaggcuggagugc

SEQ ID NO: 356575 - RNA, 32 nt, Human
cagugaagguaccuagggcucuugggagcucu

SEQ ID NO: 356576 - RNA, 32 nt, Human
cagugaaggucaggccagggucucagccuccc

SEQ ID NO: 356577 - RNA, 32 nt, Human
cagugaagguuuguauuauagagcagaccaug

SEQ ID NO: 356578 - RNA, 32 nt, Human
cagugaaguauaaucagcacuuugccaugcuc

SEQ ID NO: 356579 - RNA, 32 nt, Human
cagugaagucaauuuucuuguuguggucuaua

SEQ ID NO: 356580 - RNA, 32 nt, Human
cagugaagucguccuccucccuucccuggaua

SEQ ID NO: 356581 - RNA, 32 nt, Human
cagugaaguguguugcuucugucacuuuauau

SEQ ID NO: 356582 - RNA, 32 nt, Human
cagugaauaggaccaccucugccugcagauuu

SEQ ID NO: 356583 - RNA, 32 nt, Human
cagugaauaugugguuucucuuacgucaucca

SEQ ID NO: 356584 - RNA, 32 nt, Human
cagugaaucaccaaggaaacaugaggccuauu

SEQ ID NO: 356585 - RNA, 32 nt, Human
cagugaaucccaaagcccugcagguucuguug

SEQ ID NO: 356586 - RNA, 32 nt, Human
cagugaaucuccaccugucuucuccagggagc

SEQ ID NO: 356587 - RNA, 32 nt, Human
cagugaaucugucuucugucucugucccuuuc

SEQ ID NO: 356588 - RNA, 32 nt, Human
cagugaaugcuccuuccauuccuguacucggg

SEQ ID NO: 356589 - RNA, 32 nt, Human
cagugaauguucuggcuuacucugccucacuu

SEQ ID NO: 356590 - RNA, 32 nt, Human
cagugaauuuggaauggaaggccagguuucua

SEQ ID NO: 356591 - RNA, 31 nt, Human
cagugacaaguguucggagggcagcagagag

SEQ ID NO: 356592 - RNA, 32 nt, Human
cagugacacacguguuagauuuugcuauaguc

SEQ ID NO: 356593 - RNA, 32 nt, Human
cagugacaccacuguccucaucuggagccuga

SEQ ID NO: 356594 - RNA, 32 nt, Human
cagugacagcacaaagagucccccacaggaag

SEQ ID NO: 356595 - RNA, 32 nt, Human
cagugacaggcagcagccaccaggacugugau

SEQ ID NO: 356596 - RNA, 32 nt, Human
cagugacauuccaugagacaagcaguccugug

SEQ ID NO: 356597 - RNA, 22 nt, Human
cagugacauuucuguaguccca

SEQ ID NO: 356598 - RNA, 32 nt, Human
cagugaccacuuccuguaaguaaagaaaauau

SEQ ID NO: 356599 - RNA, 32 nt, Human
cagugaccagccaccaggugugccaucgugga

SEQ ID NO: 356600 - RNA, 32 nt, Human
cagugacccaggagucugggccagcccaccgc

SEQ ID NO: 356601 - RNA, 32 nt, Human
cagugaccccagagacagagccaggacaggag

SEQ ID NO: 356602 - RNA, 32 nt, Human
cagugacccugccugcgcuccacacucgcucc

SEQ ID NO: 356603 - RNA, 32 nt, Human
cagugaccuccaccaccuuggggugggaagag

SEQ ID NO: 356604 - RNA, 32 nt, Human
cagugaccucuccaggcacagcuccuguccca

SEQ ID NO: 356605 - RNA, 32 nt, Human
cagugaccugccucugcacacagccagaaugu

SEQ ID NO: 356606 - RNA, 32 nt, Human
cagugaccuggaguugaggcucagggagagau

SEQ ID NO: 356607 - RNA, 32 nt, Human
cagugaccugggaugcagcccucaggcugggc

SEQ ID NO: 356608 - RNA, 32 nt, Human
cagugacgacaucacagcucacugcagccuca

SEQ ID NO: 356609 - RNA, 32 nt, Human
cagugacgcaccugcuacuucccuucacagac

SEQ ID NO: 356610 - RNA, 32 nt, Human
cagugacgcccacacacgugcuggugucccgg

SEQ ID NO: 356611 - RNA, 32 nt, Human
cagugacgcguucuagcagacacugacugcgc

SEQ ID NO: 356612 - RNA, 32 nt, Human
cagugacgcuguuccggccucagucacacuga

SEQ ID NO: 356613 - RNA, 32 nt, Human
cagugacuauuuuucucuguagagagccuccc

SEQ ID NO: 356614 - RNA, 21 nt, Human
cagugacucacaccuguaauc

SEQ ID NO: 356615 - RNA, 24 nt, Human
cagugacucacaccuguaaucuca

SEQ ID NO: 356616 - RNA, 22 nt, Human
cagugacucacaucuguaaucc

SEQ ID NO: 356617 - RNA, 24 nt, Human
cagugacucacgccuguaacccca

SEQ ID NO: 356618 - RNA, 21 nt, Human
cagugacucacgccuguaauc

SEQ ID NO: 356619 - RNA, 24 nt, Human
cagugacucacgccuguaauccca

SEQ ID NO: 356620 - RNA, 32 nt, Human
cagugacucagaacuucugccucuaagcugcu

SEQ ID NO: 356621 - RNA, 24 nt, Human
cagugacucaugccuacaauccca

SEQ ID NO: 356622 - RNA, 21 nt, Human
cagugacucaugccuguaauc

SEQ ID NO: 356623 - RNA, 24 nt, Human
cagugacucaugccuguaauccca

SEQ ID NO: 356624 - RNA, 32 nt, Human
cagugacucuuuuucuacaacugccuugucag

SEQ ID NO: 356625 - RNA, 32 nt, Human
cagugacugauaaacaaaaaugaagcuaaaau

SEQ ID NO: 356626 - RNA, 32 nt, Human
cagugacugcaaccaguaccuaugggucacag

SEQ ID NO: 356627 - RNA, 32 nt, Human
cagugacugcuggucuauccucuaggggguga

SEQ ID NO: 356628 - RNA, 24 nt, Human
cagugacuuacgccuguaaucuca

SEQ ID NO: 356629 - RNA, 32 nt, Human
cagugacuucccauuauaguuuuuggaucuuu

SEQ ID NO: 356630 - RNA, 32 nt, Human
cagugacuugggaggcugggaugggaggaucu

SEQ ID NO: 356631 - RNA, 32 nt, Human
cagugagaacucuguauccaucagagaauaug

SEQ ID NO: 356632 - RNA, 32 nt, Human
cagugagaaggcaaagagagaggcagaagaga

SEQ ID NO: 356633 - RNA, 32 nt, Human
cagugagacauuuuugaauuguauuuauuugg

SEQ ID NO: 356634 - RNA, 25 nt, Human
cagugagaccugucuaccucccaca

SEQ ID NO: 356635 - RNA, 20 nt, Human
cagugagacuggggccacua

SEQ ID NO: 356636 - RNA, 32 nt, Human
cagugagagaaaagggggagaaggauuggagc

SEQ ID NO: 356637 - RNA, 22 nt, Human
cagugagagaaaugccuaugaa

SEQ ID NO: 356638 - RNA, 32 nt, Human
cagugagagaucacaaagcggccaggcaggug

SEQ ID NO: 356639 - RNA, 21 nt, Human
cagugagauguagccuggccc

SEQ ID NO: 356640 - RNA, 32 nt, Human
cagugagcaagaaaguuguucgaguggaugaa

SEQ ID NO: 356641 - RNA, 32 nt, Human
cagugagcacaccuaccagacacucuucuucu

SEQ ID NO: 356642 - RNA, 32 nt, Human
cagugagcaccgcccucugccgccagucgugg

SEQ ID NO: 356643 - RNA, 31 nt, Human
cagugagcagaguaaagaaaagacuuccugc

SEQ ID NO: 356644 - RNA, 32 nt, Human
cagugagcagccccagccagcucuucaaggcc

SEQ ID NO: 356645 - RNA, 32 nt, Human
cagugagccacggcacuccacccugggcaaca

SEQ ID NO: 356646 - RNA, 32 nt, Human
cagugagccacugcacuccagccugaugacag

SEQ ID NO: 356647 - RNA, 32 nt, Human
cagugagccagcccccaccuuccaggcgccuu

SEQ ID NO: 356648 - RNA, 32 nt, Human
cagugagcccccuccccuccggcuacccccag

SEQ ID NO: 356649 - RNA, 32 nt, Human
cagugagcccugauugugccagugcacuccag

SEQ ID NO: 356650 - RNA, 32 nt, Human
cagugagccgagauagugccacugugcuccag

SEQ ID NO: 356651 - RNA, 32 nt, Human
cagugagccgaguucguggucacugcacucca

SEQ ID NO: 356652 - RNA, 32 nt, Human
cagugagccuagauagcgccacugcacugcac

SEQ ID NO: 356653 - RNA, 32 nt, Human
cagugagcuaugaacaccacugcacuccaccu

SEQ ID NO: 356654 - RNA, 32 nt, Human
cagugagcuaugaccauaccagugcauuccag

SEQ ID NO: 356655 - RNA, 32 nt, Human
cagugagcucacugugacccauccuuacucua

SEQ ID NO: 356656 - RNA, 21 nt, Human
cagugagcucaggugucucaa

SEQ ID NO: 356657 - RNA, 32 nt, Human
cagugagcucugauuaugccagugcauuccag

SEQ ID NO: 356658 - RNA, 32 nt, Human
cagugaggaagggagaggccagcugcacuccu

SEQ ID NO: 356659 - RNA, 32 nt, Human
cagugaggacccuucugcaucuucccaugaca

SEQ ID NO: 356660 - RNA, 32 nt, Human
cagugaggacggggcccaggaggucaggagag

SEQ ID NO: 356661 - RNA, 32 nt, Human
cagugaggacugcgagggucuccuggggacag

SEQ ID NO: 356662 - RNA, 32 nt, Human
cagugaggagcagaagcagcugaugcuguacu

SEQ ID NO: 356663 - RNA, 32 nt, Human
cagugaggagcagcagagucugauacuagguc

SEQ ID NO: 356664 - RNA, 32 nt, Human
cagugaggagcaggccagagcugccuuggcau

SEQ ID NO: 356665 - RNA, 32 nt, Human
cagugaggagccgaggaaggaggcucugggag

SEQ ID NO: 356666 - RNA, 32 nt, Human
cagugaggaggcggacagcaucaccuugggcc

SEQ ID NO: 356667 - RNA, 32 nt, Human
cagugaggagggcuggacaagaauccauuccu

SEQ ID NO: 356668 - RNA, 32 nt, Human
cagugaggcaacacccaggcgggcagagaagg

SEQ ID NO: 356669 - RNA, 32 nt, Human
cagugagggaaaugggaacauaccaggccgag

SEQ ID NO: 356670 - RNA, 32 nt, Human
cagugagggaagcacugaagagcgccagucga

SEQ ID NO: 356671 - RNA, 32 nt, Human
cagugagggagacagccccaacccuuuucucc

SEQ ID NO: 356672 - RNA, 32 nt, Human
cagugagggagauagagaggguuggcggccaa

SEQ ID NO: 356673 - RNA, 32 nt, Human
cagugagggagcaagggagagcaggggaggug

SEQ ID NO: 356674 - RNA, 32 nt, Human
cagugagggaggcgucaagucuucucaagucu

SEQ ID NO: 356675 - RNA, 32 nt, Human
cagugagggagguggacggugccagcugaggc

SEQ ID NO: 356676 - RNA, 32 nt, Human
cagugagggcugggcccacagagaugcaugcg

SEQ ID NO: 356677 - RNA, 32 nt, Human
cagugagggcugguaccacccacuccuggguc

SEQ ID NO: 356678 - RNA, 32 nt, Human
cagugagggugaggagaggggaucuggggacu

SEQ ID NO: 356679 - RNA, 32 nt, Human
cagugagggugucaucagggaggaccugaugu

SEQ ID NO: 356680 - RNA, 32 nt, Human
cagugagguccaggcugcacuaagccaagauc

SEQ ID NO: 356681 - RNA, 32 nt, Human
cagugaggugaaugaagagaguggggaucucc

SEQ ID NO: 356682 - RNA, 32 nt, Human
cagugaggugccccugccuggagcacaggguc

SEQ ID NO: 356683 - RNA, 32 nt, Human
cagugaguaucugccagcaucuaccaagaaga

SEQ ID NO: 356684 - RNA, 25 nt, Human
cagugagucccuggagggaacauuc

SEQ ID NO: 356685 - RNA, 32 nt, Human
cagugagucucugacuucccaccaacagcuaa

SEQ ID NO: 356686 - RNA, 32 nt, Human
cagugagucugucagcgcagguuuaguuuacu

SEQ ID NO: 356687 - RNA, 20 nt, Human
cagugaguggcagagcaaga

SEQ ID NO: 356688 - RNA, 32 nt, Human
cagugaguggcaggggcaggagaggggagaac

SEQ ID NO: 356689 - RNA, 32 nt, Human
cagugauaaaaugaucagccaugugaagauuc

SEQ ID NO: 356690 - RNA, 32 nt, Human
cagugauagggggcuggcugggucaggaaugg

SEQ ID NO: 356691 - RNA, 31 nt, Human
cagugauauggagaauuggccaacaccaagu

SEQ ID NO: 356692 - RNA, 32 nt, Human
cagugaucaaggcuaauuggaaaagaguuauc

SEQ ID NO: 356693 - RNA, 32 nt, Human
cagugaucacauaacgaugacagcuauggggc

SEQ ID NO: 356694 - RNA, 32 nt, Human
cagugaucagcugugccucucugccuguuggu

SEQ ID NO: 356695 - RNA, 32 nt, Human
cagugaucagugauaucaaacaucaggaauca

SEQ ID NO: 356696 - RNA, 32 nt, Human
cagugaucccaaucugucuguggcugaaaaag

SEQ ID NO: 356697 - RNA, 32 nt, Human
cagugauccucugcaucucugccuacaagggc

SEQ ID NO: 356698 - RNA, 32 nt, Human
cagugauccuggagaggaaacuggggaggggg

SEQ ID NO: 356699 - RNA, 32 nt, Human
cagugaucuggaccaggaagacggauugcugc

SEQ ID NO: 356700 - RNA, 32 nt, Human
cagugaucuuaccagccagcuguccucagcgc

SEQ ID NO: 356701 - RNA, 23 nt, Human
cagugaugaggaaagcugugaaa

SEQ ID NO: 356702 - RNA, 32 nt, Human
cagugaugccaccuccaagcuuguccuaggug

SEQ ID NO: 356703 - RNA, 18 nt, Human
cagugaugcugcacagua

SEQ ID NO: 356704 - RNA, 32 nt, Human
cagugauggaauaucaugaaugugagucauua

SEQ ID NO: 356705 - RNA, 32 nt, Human
cagugauggacucugugacauggucagguuga

SEQ ID NO: 356706 - RNA, 32 nt, Human
cagugauggagaagccaccagaggcuccuugc

SEQ ID NO: 356707 - RNA, 32 nt, Human
cagugauggcagacaagauggcugucugguuu

SEQ ID NO: 356708 - RNA, 32 nt, Human
cagugaugucaguucggcccagcuggagguac

SEQ ID NO: 356709 - RNA, 32 nt, Human
cagugaugucaguucggcccagcuggagguau

SEQ ID NO: 356710 - RNA, 32 nt, Human
cagugauguuaacugaccuggcacuuccucaa

SEQ ID NO: 356711 - RNA, 23 nt, Human
cagugauguuuuucaggcccucc

SEQ ID NO: 356712 - RNA, 32 nt, Human
cagugauucaauaucacaaaaggcauugacgu

SEQ ID NO: 356713 - RNA, 32 nt, Human
cagugauuccaaacucucacugugccuucaca

SEQ ID NO: 356714 - RNA, 32 nt, Human
cagugauucucgugccucagccuccugaguag

SEQ ID NO: 356715 - RNA, 32 nt, Human
cagugauucugcagagccugagcugcugcugu

SEQ ID NO: 356716 - RNA, 32 nt, Human
cagugauugaaggguccuaaaagggaaaauau

SEQ ID NO: 356717 - RNA, 18 nt, Human
cagugauuuaaaccagua

SEQ ID NO: 356718 - RNA, 32 nt, Human
cagugauuucccuccuguaucuguagccucug

SEQ ID NO: 356719 - RNA, 32 nt, Human
cagugauuucucaaacuacagcucacaccaag

SEQ ID NO: 356720 - RNA, 32 nt, Human
cagugcaaaagagggccuucaccagaacccaa

SEQ ID NO: 356721 - RNA, 32 nt, Human
cagugcaaagccgcccccagagcccagguguc

SEQ ID NO: 356722 - RNA, 20 nt, Human
cagugcaaauccuccugccc

SEQ ID NO: 356723 - RNA, 32 nt, Human
cagugcaagaucugggcucuagugggaaaccu

SEQ ID NO: 356724 - RNA, 32 nt, Human
cagugcaagccccagagacuguuguagguugc

SEQ ID NO: 356725 - RNA, 32 nt, Human
cagugcaauuaggccagaaaggaucuuguucg

SEQ ID NO: 356726 - RNA, 21 nt, Human
cagugcacaccuguaauccca

SEQ ID NO: 356727 - RNA, 32 nt, Human
cagugcacaggacggccccacagcagaccagc

SEQ ID NO: 356728 - RNA, 21 nt, Human
cagugcacaggcuagccugga

SEQ ID NO: 356729 - RNA, 32 nt, Human
cagugcacaggcuggucuucuaucaguaccug

SEQ ID NO: 356730 - RNA, 32 nt, Human
cagugcacauaaggagcaccaacggaccuauc

SEQ ID NO: 356731 - RNA, 17 nt, Human
cagugcaccaugggaug

SEQ ID NO: 356732 - RNA, 32 nt, Human
cagugcacccuuguuacuugggagagguggua

SEQ ID NO: 356733 - RNA, 20 nt, Human
cagugcacgccuguaauccc

SEQ ID NO: 356734 - RNA, 32 nt, Human
cagugcacucagaacuucacuguaccugggau

SEQ ID NO: 356735 - RNA, 21 nt, Human
cagugcacuccagccugggca

SEQ ID NO: 356736 - RNA, 32 nt, Human
cagugcagaccggaaagugaagagucagaacu

SEQ ID NO: 356737 - RNA, 32 nt, Human
cagugcagagacugcuagccugggcacacaca

SEQ ID NO: 356738 - RNA, 21 nt, Human
cagugcagagagagcccagga

SEQ ID NO: 356739 - RNA, 32 nt, Human
cagugcagagcccacugcaacugcuaggacug

SEQ ID NO: 356740 - RNA, 32 nt, Human
cagugcagaucuggagaggagcuggcccggaa

SEQ ID NO: 356741 - RNA, 32 nt, Human
cagugcagccccggcgcggagcagggagccuc

SEQ ID NO: 356742 - RNA, 32 nt, Human
cagugcagccuccauaaccaugacauucccgc

SEQ ID NO: 356743 - RNA, 32 nt, Human
cagugcagccucgacuuccugggauccagcga

SEQ ID NO: 356744 - RNA, 32 nt, Human
cagugcagcugcagaagagaaaugggauuggc

SEQ ID NO: 356745 - RNA, 32 nt, Human
cagugcaggcagaucccugaaggucagcacuc

SEQ ID NO: 356746 - RNA, 32 nt, Human
cagugcaggccugcuggucgugcuguguggcc

SEQ ID NO: 356747 - RNA, 18 nt, Human
cagugcaggcgcgacggg

SEQ ID NO: 356748 - RNA, 32 nt, Human
cagugcaggggauggcccugcugcugcuuccg

SEQ ID NO: 356749 - RNA, 32 nt, Human
cagugcaguagcugcuggaggcuggggaggcc

SEQ ID NO: 356750 - RNA, 32 nt, Human
cagugcagucaaggccaaccuaggcagcagcc

SEQ ID NO: 356751 - RNA, 32 nt, Human
cagugcagugacacagaugagaagcugugagu

SEQ ID NO: 356752 - RNA, 32 nt, Human
cagugcaguggugccaucucagcucacugcaa

SEQ ID NO: 356753 - RNA, 32 nt, Human
cagugcauaaaguccaagggggccaagggcca

SEQ ID NO: 356754 - RNA, 32 nt, Human
cagugcauccccaaucccaccaucuuaccugg

SEQ ID NO: 356755 - RNA, 32 nt, Human
cagugcauccccacgaccccugccucgagggc

SEQ ID NO: 356756 - RNA, 32 nt, Human
cagugcaucuccucuggcuuucuuugacugaa

SEQ ID NO: 356757 - RNA, 32 nt, Human
cagugcaugcacuccagccugggcaacagaca

SEQ ID NO: 356758 - RNA, 32 nt, Human
cagugcauggccaaggaacaagcacaguccac

SEQ ID NO: 356759 - RNA, 31 nt, Human
cagugcauguggagcacagagaucagagcuu

SEQ ID NO: 356760 - RNA, 32 nt, Human
cagugcauuauguacacaggucaaccauggua

SEQ ID NO: 356761 - RNA, 32 nt, Human
cagugccaacacucaagacugugaguagagca

SEQ ID NO: 356762 - RNA, 32 nt, Human
cagugccaagaugaccuguugugucauauaau

SEQ ID NO: 356763 - RNA, 32 nt, Human
cagugccaauuaggagagugggaagaaaggag

SEQ ID NO: 356764 - RNA, 32 nt, Human
cagugccacauuugaccaugagcaccacacca

SEQ ID NO: 356765 - RNA, 32 nt, Human
cagugccaccgccaccacaccccagaucccac

SEQ ID NO: 356766 - RNA, 32 nt, Human
cagugccaccguacucuagccugggcgacaga

SEQ ID NO: 356767 - RNA, 32 nt, Human
cagugccacugcaauccagccugggcaacaga

SEQ ID NO: 356768 - RNA, 18 nt, Human
cagugccagaucguggua

SEQ ID NO: 356769 - RNA, 32 nt, Human
cagugccaggaggaagaaggaaggagucccuu

SEQ ID NO: 356770 - RNA, 32 nt, Human
cagugccaggcuccaggcgucgccaaggcagg

SEQ ID NO: 356771 - RNA, 32 nt, Human
cagugccaggcuggaggcggcagcgguuggag

SEQ ID NO: 356772 - RNA, 32 nt, Human
cagugccagggcacucuuccuccagcugggau

SEQ ID NO: 356773 - RNA, 32 nt, Human
cagugccaguagggcaggcaggaaugcagcag

SEQ ID NO: 356774 - RNA, 32 nt, Human
cagugccauagccuuaccgcagccugcgcggg

SEQ ID NO: 356775 - RNA, 32 nt, Human
cagugccauaguugacuuuuacauuccauagg

SEQ ID NO: 356776 - RNA, 32 nt, Human
cagugccaucacccucacccaagugauguggu

SEQ ID NO: 356777 - RNA, 32 nt, Human
cagugccauguugaugugccucucaguuuuau

SEQ ID NO: 356778 - RNA, 32 nt, Human
cagugccauugcacuccagccugcacaacaag

SEQ ID NO: 356779 - RNA, 32 nt, Human
cagugcccaaauucuggagggggccgaggugg

SEQ ID NO: 356780 - RNA, 32 nt, Human
cagugcccagagcaugcagggaacccucgugc

SEQ ID NO: 356781 - RNA, 32 nt, Human
cagugcccagcacauaggagaugcucaguaaa

SEQ ID NO: 356782 - RNA, 32 nt, Human
cagugcccagcacuuuguagucucaucccaga

SEQ ID NO: 356783 - RNA, 32 nt, Human
cagugcccaucuuccaggacuaccuuauuuuc

SEQ ID NO: 356784 - RNA, 32 nt, Human
cagugcccaucuucguucgucuccuugccugu

SEQ ID NO: 356785 - RNA, 32 nt, Human
cagugcccaucuugccagcagugcccgccccc

SEQ ID NO: 356786 - RNA, 32 nt, Human
cagugcccauuuuucauccagggagaaccucg

SEQ ID NO: 356787 - RNA, 32 nt, Human
cagugccccacaccuggaacagccuggaggag

SEQ ID NO: 356788 - RNA, 32 nt, Human
cagugccccaggaagaggaaguggcagggucu

SEQ ID NO: 356789 - RNA, 32 nt, Human
cagugccccaucuaaauaaaauacugcuuuug

SEQ ID NO: 356790 - RNA, 32 nt, Human
cagugcccccuccaaggcugugcagugucuug

SEQ ID NO: 356791 - RNA, 32 nt, Human
cagugccccucaggucaaaccaagccaagagc

SEQ ID NO: 356792 - RNA, 32 nt, Human
cagugccccuccaguucaguugucuauguauu

SEQ ID NO: 356793 - RNA, 32 nt, Human
cagugcccgaggccaggaaggccgggccgugg

SEQ ID NO: 356794 - RNA, 32 nt, Human
cagugcccgcugggcccagccuggggacaggg

SEQ ID NO: 356795 - RNA, 32 nt, Human
cagugcccggcgcugauuggaaaacggguggc

SEQ ID NO: 356796 - RNA, 32 nt, Human
cagugcccuccccacagcacuaccucaccccg

SEQ ID NO: 356797 - RNA, 32 nt, Human
cagugcccuccuucccugucucugccucuccc

SEQ ID NO: 356798 - RNA, 32 nt, Human
cagugcccucuucccuuccugcacugaggaga

SEQ ID NO: 356799 - RNA, 32 nt, Human
cagugcccugcucucccguucgccucuuucug

SEQ ID NO: 356800 - RNA, 32 nt, Human
cagugcccuggaguccuaucugaucuccgggu

SEQ ID NO: 356801 - RNA, 32 nt, Human
cagugcccuuccuccuccuccuccucugccgc

SEQ ID NO: 356802 - RNA, 32 nt, Human
cagugccgaccuguuaaggccgucgagagcau

SEQ ID NO: 356803 - RNA, 32 nt, Human
cagugccgaguccuugucccuaccuccagcuu

SEQ ID NO: 356804 - RNA, 21 nt, Human
cagugccgccggccucaagau

SEQ ID NO: 356805 - RNA, 32 nt, Human
cagugccggcaggugggagggcugagguggca

SEQ ID NO: 356806 - RNA, 32 nt, Human
cagugccggguccucccucccuuccuggcuug

SEQ ID NO: 356807 - RNA, 32 nt, Human
cagugccguugccuuuucuucauuagagacac

SEQ ID NO: 356808 - RNA, 22 nt, Human
cagugccuagaauauuauauga

SEQ ID NO: 356809 - RNA, 22 nt, Human
cagugccuagaauuucuacgga

SEQ ID NO: 356810 - RNA, 32 nt, Human
cagugccuagugcugcucauuauguguucauu

SEQ ID NO: 356811 - RNA, 32 nt, Human
cagugccucacaccaugccuggcccuuaagaa

SEQ ID NO: 356812 - RNA, 32 nt, Human
cagugccucaguuuccccaucuguaaaaugag

SEQ ID NO: 356813 - RNA, 21 nt, Human
cagugccucaugccuauaauc

SEQ ID NO: 356814 - RNA, 24 nt, Human
cagugccucaugccuauaauccca

SEQ ID NO: 356815 - RNA, 32 nt, Human
cagugccuccagccacacccccugccuucccc

SEQ ID NO: 356816 - RNA, 32 nt, Human
cagugccuccccucaacuuuccugugggugcc

SEQ ID NO: 356817 - RNA, 23 nt, Human
cagugccugagaaagaacauuga

SEQ ID NO: 356818 - RNA, 32 nt, Human
cagugccugcagcuuuccaccgugccuggagc

SEQ ID NO: 356819 - RNA, 22 nt, Human
cagugccugccuucucuagcgg

SEQ ID NO: 356820 - RNA, 32 nt, Human
cagugccugcugugugcugauacuguucugug

SEQ ID NO: 356821 - RNA, 32 nt, Human
cagugccuggaaggcaggugugcccgucagcg

SEQ ID NO: 356822 - RNA, 21 nt, Human
cagugccuggauagacacuga

SEQ ID NO: 356823 - RNA, 32 nt, Human
cagugccuguaaucccagcuauuugggaggcu

SEQ ID NO: 356824 - RNA, 32 nt, Human
cagugccuguagucccagcugcucgggaggcu

SEQ ID NO: 356825 - RNA, 18 nt, Human
cagugccugucaccucuu

SEQ ID NO: 356826 - RNA, 32 nt, Human
cagugccugugguuguuucuccagagucaaaa

SEQ ID NO: 356827 - RNA, 32 nt, Human
cagugccuucuuucagcucacaggauaucggc

SEQ ID NO: 356828 - RNA, 32 nt, Human
cagugccuuuuguucuggaggagaggaccccc

SEQ ID NO: 356829 - RNA, 32 nt, Human
cagugcgaaccuuugggcucuccagguccgag

SEQ ID NO: 356830 - RNA, 32 nt, Human
cagugcgagugguuggccuugcucugguccgg

SEQ ID NO: 356831 - RNA, 32 nt, Human
cagugcgcugcucuccagcccgcuugaacgcu

SEQ ID NO: 356832 - RNA, 32 nt, Human
cagugcggacggggacccucugggauucugcu

SEQ ID NO: 356833 - RNA, 32 nt, Human
cagugcggucacauacuuccagaagagcggac

SEQ ID NO: 356834 - RNA, 32 nt, Human
cagugcgugccggggugucaggcugcagguau

SEQ ID NO: 356835 - RNA, 32 nt, Human
cagugcuaacacagcucagcccugcucagugc

SEQ ID NO: 356836 - RNA, 32 nt, Human
cagugcuaacugacugccucuccagguucgga

SEQ ID NO: 356837 - RNA, 31 nt, Human
cagugcuacagcuagaaugaagcacaucaac

SEQ ID NO: 356838 - RNA, 32 nt, Human
cagugcuaggguauugagucaggcagcuggag

SEQ ID NO: 356839 - RNA, 32 nt, Human
cagugcuaguucugacccaaccacagaggaug

SEQ ID NO: 356840 - RNA, 32 nt, Human
cagugcuaucccggcauccugauggcuccgac

SEQ ID NO: 356841 - RNA, 32 nt, Human
cagugcuauccucuuggacuucccagccuuca

SEQ ID NO: 356842 - RNA, 31 nt, Human
cagugcucaauaaaugcuucgaggcugauga

SEQ ID NO: 356843 - RNA, 23 nt, Human
cagugcucacgccuguaauacca

SEQ ID NO: 356844 - RNA, 31 nt, Human
cagugcucacucaauguguuuaggcagauuc

SEQ ID NO: 356845 - RNA, 32 nt, Human
cagugcucagagaagcaaaccucuguacucuc

SEQ ID NO: 356846 - RNA, 32 nt, Human
cagugcucagguuugcaucauaagugagcuau

SEQ ID NO: 356847 - RNA, 32 nt, Human
cagugcuccaggcacccagcuuugucuguggg

SEQ ID NO: 356848 - RNA, 32 nt, Human
cagugcuccagugccaucuggugcuucguggc

SEQ ID NO: 356849 - RNA, 32 nt, Human
cagugcuccagugguacagaagugagacauaa

SEQ ID NO: 356850 - RNA, 32 nt, Human
cagugcucccuuccucuccucuccuucuagug

SEQ ID NO: 356851 - RNA, 32 nt, Human
cagugcuccugacuccucacagcucuguuccu

SEQ ID NO: 356852 - RNA, 32 nt, Human
cagugcucgguuguuuacaaucaguggggaaa

SEQ ID NO: 356853 - RNA, 32 nt, Human
cagugcucucagggagggugcaccaggccugc

SEQ ID NO: 356854 - RNA, 32 nt, Human
cagugcucuccaggcuuccucucuuugugauu

SEQ ID NO: 356855 - RNA, 32 nt, Human
cagugcucucgaggagggugcaccagggcugc

SEQ ID NO: 356856 - RNA, 32 nt, Human
cagugcucucggggagggugcaccaggcccac

SEQ ID NO: 356857 - RNA, 32 nt, Human
cagugcucucggggagggugcaccaggcccgc

SEQ ID NO: 356858 - RNA, 32 nt, Human
cagugcucugcagaagccucucccccucacag

SEQ ID NO: 356859 - RNA, 32 nt, Human
cagugcucugcucucacccugcccaagacuca

SEQ ID NO: 356860 - RNA, 32 nt, Human
cagugcucuggcuggcugucucucccuuucuc

SEQ ID NO: 356861 - RNA, 32 nt, Human
cagugcucugggggagggugcaccaggccugc

SEQ ID NO: 356862 - RNA, 32 nt, Human
cagugcucuguaaauaguuguuuuaauuuagc

SEQ ID NO: 356863 - RNA, 32 nt, Human
cagugcucuguggggccucgcuggcccauguc

SEQ ID NO: 356864 - RNA, 32 nt, Human
cagugcugacaugccagcccccugccaccuca

SEQ ID NO: 356865 - RNA, 32 nt, Human
cagugcugacaugccagcccccugccaccucg

SEQ ID NO: 356866 - RNA, 32 nt, Human
cagugcugagauuacaggugggagccacugca

SEQ ID NO: 356867 - RNA, 32 nt, Human
cagugcugagggcugggaugcucugugacccc

SEQ ID NO: 356868 - RNA, 22 nt, Human
cagugcugcacuccuccugccc

SEQ ID NO: 356869 - RNA, 32 nt, Human
cagugcugcagaacggacuugggagcccuccu

SEQ ID NO: 356870 - RNA, 32 nt, Human
cagugcugcagccggcucaccucucuccgcuu

SEQ ID NO: 356871 - RNA, 32 nt, Human
cagugcugcccaggaccuggaccgaauggggg

SEQ ID NO: 356872 - RNA, 32 nt, Human
cagugcugcuuugggacauauacuugaccuag

SEQ ID NO: 356873 - RNA, 32 nt, Human
cagugcugggagagaggggagaugugggcagg

SEQ ID NO: 356874 - RNA, 32 nt, Human
cagugcugggauuacaggagugagccaccaug

SEQ ID NO: 356875 - RNA, 32 nt, Human
cagugcugggauuacaggcaugagccaccgcg

SEQ ID NO: 356876 - RNA, 32 nt, Human
cagugcugggauuacaggcaugggccaccacg

SEQ ID NO: 356877 - RNA, 32 nt, Human
cagugcugggauuacaggccugagccaccgug

SEQ ID NO: 356878 - RNA, 32 nt, Human
cagugcugggauuacaggcgugagccaccaug

SEQ ID NO: 356879 - RNA, 32 nt, Human
cagugcugggauuacaggcgugagccaccgca

SEQ ID NO: 356880 - RNA, 32 nt, Human
cagugcugggauuacaggcgugagccaccgcg

SEQ ID NO: 356881 - RNA, 32 nt, Human
cagugcugggcaguacuccccuaggcagaucc

SEQ ID NO: 356882 - RNA, 32 nt, Human
cagugcugggcugugggccggggaggaaggcg

SEQ ID NO: 356883 - RNA, 31 nt, Human
cagugcuggguggagagagccagaaaacaga

SEQ ID NO: 356884 - RNA, 32 nt, Human
cagugcugucccacuccucaagucuggaagcg

SEQ ID NO: 356885 - RNA, 32 nt, Human
cagugcuguucugagagcuuggaggaggcacc

SEQ ID NO: 356886 - RNA, 32 nt, Human
cagugcuguuguccuuggccugcagcaggagg

SEQ ID NO: 356887 - RNA, 32 nt, Human
cagugcuuauuucucagcuuuuucuuucuuaa

SEQ ID NO: 356888 - RNA, 20 nt, Human
cagugcuucccuugguguca

SEQ ID NO: 356889 - RNA, 32 nt, Human
cagugcuuuccguggcacugcauacaaucuga

SEQ ID NO: 356890 - RNA, 32 nt, Human
cagugcuuuggauucuuccucccaggccuacc

SEQ ID NO: 356891 - RNA, 32 nt, Human
cagugcuuugggaggcugaggugggaggauug

SEQ ID NO: 356892 - RNA, 32 nt, Human
cagugcuuugguaugggagguguuagaaaacu

SEQ ID NO: 356893 - RNA, 23 nt, Human
cagugcuuuuaaaaaguguuuaa

SEQ ID NO: 356894 - RNA, 32 nt, Human
cagugcuuuuggggagggugcaccagggccac

SEQ ID NO: 356895 - RNA, 32 nt, Human
caguggaacaaagauugagaaccacaauagca

SEQ ID NO: 356896 - RNA, 32 nt, Human
caguggaacagucuucccauuuacaggucuuc

SEQ ID NO: 356897 - RNA, 32 nt, Human
caguggaagaacugggaaggaggaagccccuc

SEQ ID NO: 356898 - RNA, 32 nt, Human
caguggaagaugaccucuaguuucuuggcuca

SEQ ID NO: 356899 - RNA, 32 nt, Human
caguggaagcaagagguuggggugauguggcc

SEQ ID NO: 356900 - RNA, 32 nt, Human
caguggaagcauuuucaaaagcaaagauaauu

SEQ ID NO: 356901 - RNA, 32 nt, Human
caguggaaguucuucaagaggaaaggcgcccc

SEQ ID NO: 356902 - RNA, 32 nt, Human
caguggaauguguaagcuagcuaauucuuguu

SEQ ID NO: 356903 - RNA, 32 nt, Human
caguggacagaagggauuauccucagccaguc

SEQ ID NO: 356904 - RNA, 32 nt, Human
caguggacauagaagagaagggugugaggcug

SEQ ID NO: 356905 - RNA, 32 nt, Human
caguggagaggaagagggagugaggcccugug

SEQ ID NO: 356906 - RNA, 32 nt, Human
caguggagaggcaggaggacaggcugggggcc

SEQ ID NO: 356907 - RNA, 31 nt, Human
caguggagauugagagaaaagguugaaaaug

SEQ ID NO: 356908 - RNA, 32 nt, Human
caguggagcagaaccucuccugccucgggagu

SEQ ID NO: 356909 - RNA, 32 nt, Human
caguggagcgcuggucugugcuaacaucuuca

SEQ ID NO: 356910 - RNA, 32 nt, Human
caguggaggaaagagcuagaugaacagguugc

SEQ ID NO: 356911 - RNA, 32 nt, Human
caguggaggaaggcagggaucccacuacgagc

SEQ ID NO: 356912 - RNA, 32 nt, Human
caguggaggagagagccagaguggauacuauu

SEQ ID NO: 356913 - RNA, 32 nt, Human
caguggaggccucccuuccuucucacagcauc

SEQ ID NO: 356914 - RNA, 32 nt, Human
caguggagggguggaguugaugaaaggagagg

SEQ ID NO: 356915 - RNA, 32 nt, Human
caguggaggucugagagcagagccacagcauc

SEQ ID NO: 356916 - RNA, 32 nt, Human
caguggagguucugagacuggauucagucuug

SEQ ID NO: 356917 - RNA, 32 nt, Human
caguggaguaccauggaggucacugcaauggu

SEQ ID NO: 356918 - RNA, 32 nt, Human
caguggagugauauuuauguauuauuuuuacu

SEQ ID NO: 356919 - RNA, 32 nt, Human
caguggaguucccaggccuuguuugcaggaag

SEQ ID NO: 356920 - RNA, 32 nt, Human
caguggaguuugaggacaugcaauaguaauuu

SEQ ID NO: 356921 - RNA, 32 nt, Human
caguggauaaagcucaaagcaaacaacaguaa

SEQ ID NO: 356922 - RNA, 24 nt, Human
caguggaucacgccuguaauccca

SEQ ID NO: 356923 - RNA, 24 nt, Human
caguggaucgcaccuguaauccca

SEQ ID NO: 356924 - RNA, 32 nt, Human
caguggaucuaaacauuacggcaauuuuagga

SEQ ID NO: 356925 - RNA, 32 nt, Human
caguggaugcugcugggccucugccuuguccu

SEQ ID NO: 356926 - RNA, 32 nt, Human
caguggaugugagcuucugaaggcaggaauug

SEQ ID NO: 356927 - RNA, 24 nt, Human
caguggcacacaccuguaguccca

SEQ ID NO: 356928 - RNA, 32 nt, Human
caguggcacaccaccagugaggcacauguugc

SEQ ID NO: 356929 - RNA, 24 nt, Human
caguggcacacgccuguaauccca

SEQ ID NO: 356930 - RNA, 24 nt, Human
caguggcacacggcuguaauccca

SEQ ID NO: 356931 - RNA, 32 nt, Human
caguggcacagagcuaauccugccuggggguu

SEQ ID NO: 356932 - RNA, 21 nt, Human
caguggcacaugccuguaauc

SEQ ID NO: 356933 - RNA, 24 nt, Human
caguggcacaugccuguaauccca

SEQ ID NO: 356934 - RNA, 24 nt, Human
caguggcacgcgccuguaauccca

SEQ ID NO: 356935 - RNA, 32 nt, Human
caguggcagagcuggucugugaugaaccaagc

SEQ ID NO: 356936 - RNA, 32 nt, Human
caguggcagaggagauggagacaggaaacggg

SEQ ID NO: 356937 - RNA, 18 nt, Human
caguggcagcagguggug

SEQ ID NO: 356938 - RNA, 32 nt, Human
caguggcagcccacccaccucugcucucuggc

SEQ ID NO: 356939 - RNA, 32 nt, Human
caguggcagccugccuaagacugucuuaccuu

SEQ ID NO: 356940 - RNA, 32 nt, Human
caguggcagcuggugacacuaacgauugcuac

SEQ ID NO: 356941 - RNA, 32 nt, Human
caguggcaggagccuuacuuuugucacagccu

SEQ ID NO: 356942 - RNA, 32 nt, Human
caguggcaggugugacgggcggccagguuacu

SEQ ID NO: 356943 - RNA, 32 nt, Human
caguggcaugaacaggcccagcuuugacuuga

SEQ ID NO: 356944 - RNA, 32 nt, Human
caguggcaugaucucagcucacugaagccucg

SEQ ID NO: 356945 - RNA, 32 nt, Human
caguggcaugaucuuggcucacugaaaccucu

SEQ ID NO: 356946 - RNA, 24 nt, Human
caguggcaugcgccugugauccca

SEQ ID NO: 356947 - RNA, 32 nt, Human
caguggcauggagcuuugaaagacgaguaggu

SEQ ID NO: 356948 - RNA, 24 nt, Human
caguggcaugugcuuguaauccca

SEQ ID NO: 356949 - RNA, 32 nt, Human
caguggccaaacaaccgugcucagccuguuuc

SEQ ID NO: 356950 - RNA, 19 nt, Human
caguggccacaacagcaca

SEQ ID NO: 356951 - RNA, 31 nt, Human
caguggccacaucaggagguugcagguuaac

SEQ ID NO: 356952 - RNA, 32 nt, Human
caguggccacaucaggagguugcagguuaacc

SEQ ID NO: 356953 - RNA, 31 nt, Human
caguggccacaucaggagguugcagguugac

SEQ ID NO: 356954 - RNA, 32 nt, Human
caguggccacaucaggagguugcagguugacc

SEQ ID NO: 356955 - RNA, 31 nt, Human
caguggccacgucaggagguugcagguugac

SEQ ID NO: 356956 - RNA, 32 nt, Human
caguggccacgucaggagguugcagguugacc

SEQ ID NO: 356957 - RNA, 22 nt, Human
caguggccacuguggcuggcca

SEQ ID NO: 356958 - RNA, 32 nt, Human
caguggccagaaacccuucacacucacacauc

SEQ ID NO: 356959 - RNA, 32 nt, Human
caguggccagagguauuggagacacaaacccu

SEQ ID NO: 356960 - RNA, 32 nt, Human
caguggccagugccacacagcuccuccaugcc

SEQ ID NO: 356961 - RNA, 32 nt, Human
caguggccauggaccugcagggcacagagcac

SEQ ID NO: 356962 - RNA, 24 nt, Human
caguggcccacagcuguaauccca

SEQ ID NO: 356963 - RNA, 24 nt, Human
caguggcccacgccuguaauccca

SEQ ID NO: 356964 - RNA, 32 nt, Human
caguggcccacugugccuggcccaaauaagca

SEQ ID NO: 356965 - RNA, 32 nt, Human
caguggcccaggaagugugcugggcagccugu

SEQ ID NO: 356966 - RNA, 32 nt, Human
caguggcccaggggagguugagugggcaucuu

SEQ ID NO: 356967 - RNA, 24 nt, Human
caguggcccaugccuauaauccca

SEQ ID NO: 356968 - RNA, 21 nt, Human
caguggcccaugccuguaauc

SEQ ID NO: 356969 - RNA, 24 nt, Human
caguggcccaugccuguaauccca

SEQ ID NO: 356970 - RNA, 32 nt, Human
caguggcccaugugacuguggcauuuucggca

SEQ ID NO: 356971 - RNA, 32 nt, Human
caguggccccaggaguguggagaguuccauga

SEQ ID NO: 356972 - RNA, 32 nt, Human
caguggccccggaaggugaauggccugcucuc

SEQ ID NO: 356973 - RNA, 32 nt, Human
caguggcccgggccaguucaggccgccucccc

SEQ ID NO: 356974 - RNA, 32 nt, Human
caguggcccuacccagccuggccagcagacac

SEQ ID NO: 356975 - RNA, 32 nt, Human
caguggcccuccagucagguucuguggguuug

SEQ ID NO: 356976 - RNA, 32 nt, Human
caguggcccugagacccuagcucugcucucgg

SEQ ID NO: 356977 - RNA, 32 nt, Human
caguggcccugcacucaagcuccgcaauaauc

SEQ ID NO: 356978 - RNA, 32 nt, Human
caguggccgaggcuggagcggcaggcggaucg

SEQ ID NO: 356979 - RNA, 24 nt, Human
caguggccgcagcagcgcgccggg

SEQ ID NO: 356980 - RNA, 23 nt, Human
caguggccggacacccccuggga

SEQ ID NO: 356981 - RNA, 25 nt, Human
caguggccucacgccuguaauccca

SEQ ID NO: 356982 - RNA, 25 nt, Human
caguggccucaugccuauaauccca

SEQ ID NO: 356983 - RNA, 32 nt, Human
caguggccuccaggggacuuggcggguccccu

SEQ ID NO: 356984 - RNA, 19 nt, Human
caguggccucuuucagccc

SEQ ID NO: 356985 - RNA, 32 nt, Human
caguggccugaugacacuccugucuuucuggg

SEQ ID NO: 356986 - RNA, 32 nt, Human
caguggccuuccucccuuccuuucacagccgg

SEQ ID NO: 356987 - RNA, 24 nt, Human
caguggccuugguccuuaauccca

SEQ ID NO: 356988 - RNA, 21 nt, Human
caguggccuugucaccaagcu

SEQ ID NO: 356989 - RNA, 32 nt, Human
caguggccuuucucugcucccucucaggguac

SEQ ID NO: 356990 - RNA, 32 nt, Human
caguggccuuucugcuuagcugggccagcucc

SEQ ID NO: 356991 - RNA, 32 nt, Human
caguggccuuuucucccccucaccuucuaagg

SEQ ID NO: 356992 - RNA, 21 nt, Human
caguggcgcacaccuguaauc

SEQ ID NO: 356993 - RNA, 24 nt, Human
caguggcgcacaccuguaauccca

SEQ ID NO: 356994 - RNA, 21 nt, Human
caguggcgcaugccuguaauc

SEQ ID NO: 356995 - RNA, 24 nt, Human
caguggcgcaugccuguaauccca

SEQ ID NO: 356996 - RNA, 32 nt, Human
caguggcggcgucagcgaacacuggacaguaa

SEQ ID NO: 356997 - RNA, 24 nt, Human
caguggcgggcgccuguaguccca

SEQ ID NO: 356998 - RNA, 32 nt, Human
caguggcgugaucccagcuauauuggaaaaga

SEQ ID NO: 356999 - RNA, 24 nt, Human
caguggcgugcgccuguaguccca

SEQ ID NO: 357000 - RNA, 24 nt, Human
caguggcuaaagccuguaauccca

SEQ ID NO: 357001 - RNA, 32 nt, Human
caguggcuaaggaggaaaggggagggcagagg

SEQ ID NO: 357002 - RNA, 32 nt, Human
caguggcuacagugucacaggugguggggacc

SEQ ID NO: 357003 - RNA, 16 nt, Human
caguggcuaugagaug

SEQ ID NO: 357004 - RNA, 24 nt, Human
caguggcucaagccuguaauccca

SEQ ID NO: 357005 - RNA, 24 nt, Human
caguggcucaagccugucauccca

SEQ ID NO: 357006 - RNA, 24 nt, Human
caguggcucacacauguaauccca

SEQ ID NO: 357007 - RNA, 24 nt, Human
caguggcucacacccauaauccca

SEQ ID NO: 357008 - RNA, 24 nt, Human
caguggcucacaccgguaauccca

SEQ ID NO: 357009 - RNA, 22 nt, Human
caguggcucacaccuaauccca

SEQ ID NO: 357010 - RNA, 24 nt, Human
caguggcucacaccuauaauccca

SEQ ID NO: 357011 - RNA, 32 nt, Human
caguggcucacaccuauaaucccaacacuuug

SEQ ID NO: 357012 - RNA, 32 nt, Human
caguggcucacaccuauaaucccagccaagau

SEQ ID NO: 357013 - RNA, 24 nt, Human
caguggcucacaccuauaguccca

SEQ ID NO: 357014 - RNA, 24 nt, Human
caguggcucacaccucuaauccca

SEQ ID NO: 357015 - RNA, 21 nt, Human
caguggcucacaccugcaauc

SEQ ID NO: 357016 - RNA, 24 nt, Human
caguggcucacaccugcaauccca

SEQ ID NO: 357017 - RNA, 24 nt, Human
caguggcucacaccuggaauccca

SEQ ID NO: 357018 - RNA, 22 nt, Human
caguggcucacaccuguaaccc

SEQ ID NO: 357019 - RNA, 24 nt, Human
caguggcucacaccuguaauacca

SEQ ID NO: 357020 - RNA, 21 nt, Human
caguggcucacaccuguaauc

SEQ ID NO: 357021 - RNA, 24 nt, Human
caguggcucacaccuguaauccca

SEQ ID NO: 357022 - RNA, 24 nt, Human
caguggcucacaccuguaauccua

SEQ ID NO: 357023 - RNA, 32 nt, Human
caguggcucacaccuguaauccugcacuuugg

SEQ ID NO: 357024 - RNA, 24 nt, Human
caguggcucacaccuguaaucuca

SEQ ID NO: 357025 - RNA, 32 nt, Human
caguggcucacaccuguaaucugagcauucug

SEQ ID NO: 357026 - RNA, 24 nt, Human
caguggcucacaccuguaguccca

SEQ ID NO: 357027 - RNA, 24 nt, Human
caguggcucacaccuguauuccca

SEQ ID NO: 357028 - RNA, 32 nt, Human
caguggcucacaccuguauucccaacacuuuu

SEQ ID NO: 357029 - RNA, 23 nt, Human
caguggcucacaccugugauccc

SEQ ID NO: 357030 - RNA, 24 nt, Human
caguggcucacaccugugauccca

SEQ ID NO: 357031 - RNA, 24 nt, Human
caguggcucacaccuguggaaucc

SEQ ID NO: 357032 - RNA, 32 nt, Human
caguggcucacaccuguggaaucccagcacuu

SEQ ID NO: 357033 - RNA, 25 nt, Human
caguggcucacaccuuguaauccca

SEQ ID NO: 357034 - RNA, 24 nt, Human
caguggcucacaccuuuaauccca

SEQ ID NO: 357035 - RNA, 24 nt, Human
caguggcucacaccuuuaauccua

SEQ ID NO: 357036 - RNA, 23 nt, Human
caguggcucacacuguaaugcca

SEQ ID NO: 357037 - RNA, 21 nt, Human
caguggcucacacuuauccua

SEQ ID NO: 357038 - RNA, 21 nt, Human
caguggcucacacuuguaacc

SEQ ID NO: 357039 - RNA, 24 nt, Human
caguggcucacacuuguaauccca

SEQ ID NO: 357040 - RNA, 24 nt, Human
caguggcucacaucuguaacccca

SEQ ID NO: 357041 - RNA, 24 nt, Human
caguggcucacaucuguaaucuca

SEQ ID NO: 357042 - RNA, 24 nt, Human
caguggcucacauucguaauccca

SEQ ID NO: 357043 - RNA, 24 nt, Human
caguggcucaccccuguaauccca

SEQ ID NO: 357044 - RNA, 24 nt, Human
caguggcucaccccuguaaucuca

SEQ ID NO: 357045 - RNA, 24 nt, Human
caguggcucaccucuguaauccca

SEQ ID NO: 357046 - RNA, 22 nt, Human
caguggcucaccuguaauccca

SEQ ID NO: 357047 - RNA, 21 nt, Human
caguggcucacgacuguaauu

SEQ ID NO: 357048 - RNA, 24 nt, Human
caguggcucacgacuguaauucca

SEQ ID NO: 357049 - RNA, 24 nt, Human
caguggcucacgccacuaauccca

SEQ ID NO: 357050 - RNA, 21 nt, Human
caguggcucacgccaguaauc

SEQ ID NO: 357051 - RNA, 24 nt, Human
caguggcucacgccaguaauccca

SEQ ID NO: 357052 - RNA, 21 nt, Human
caguggcucacgccuauaauc

SEQ ID NO: 357053 - RNA, 24 nt, Human
caguggcucacgccuauaauccca

SEQ ID NO: 357054 - RNA, 24 nt, Human
caguggcucacgccuauaaucuca

SEQ ID NO: 357055 - RNA, 24 nt, Human
caguggcucacgccuaugauccca

SEQ ID NO: 357056 - RNA, 24 nt, Human
caguggcucacgccuguaacccca

SEQ ID NO: 357057 - RNA, 20 nt, Human
caguggcucacgccuguaau

SEQ ID NO: 357058 - RNA, 24 nt, Human
caguggcucacgccuguaauacca

SEQ ID NO: 357059 - RNA, 21 nt, Human
caguggcucacgccuguaauc

SEQ ID NO: 357060 - RNA, 22 nt, Human
caguggcucacgccuguaaucc

SEQ ID NO: 357061 - RNA, 23 nt, Human
caguggcucacgccuguaauccc

SEQ ID NO: 357062 - RNA, 24 nt, Human
caguggcucacgccuguaauccca

SEQ ID NO: 357063 - RNA, 24 nt, Human
caguggcucacgccuguaauccua

SEQ ID NO: 357064 - RNA, 24 nt, Human
caguggcucacgccuguaauucca

SEQ ID NO: 357065 - RNA, 21 nt, Human
caguggcucacgccuguaguc

SEQ ID NO: 357066 - RNA, 24 nt, Human
caguggcucacgccuguaguccca

SEQ ID NO: 357067 - RNA, 24 nt, Human
caguggcucacgccuguuauccca

SEQ ID NO: 357068 - RNA, 24 nt, Human
caguggcucacgcuuacaguccca

SEQ ID NO: 357069 - RNA, 24 nt, Human
caguggcucacgcuuauaauccca

SEQ ID NO: 357070 - RNA, 21 nt, Human
caguggcucacgcuuguaauc

SEQ ID NO: 357071 - RNA, 24 nt, Human
caguggcucacgcuuguaauccca

SEQ ID NO: 357072 - RNA, 24 nt, Human
caguggcucacgcuuguaaucgca

SEQ ID NO: 357073 - RNA, 24 nt, Human
caguggcucacguauguaauccca

SEQ ID NO: 357074 - RNA, 24 nt, Human
caguggcucacgucuguaauccca

SEQ ID NO: 357075 - RNA, 24 nt, Human
caguggcucacuacucuaauucca

SEQ ID NO: 357076 - RNA, 22 nt, Human
caguggcucacuccuguaaucc

SEQ ID NO: 357077 - RNA, 24 nt, Human
caguggcucacuccuguaauccca

SEQ ID NO: 357078 - RNA, 24 nt, Human
caguggcucacuccuguaauccua

SEQ ID NO: 357079 - RNA, 24 nt, Human
caguggcucacuccuguaguccca

SEQ ID NO: 357080 - RNA, 24 nt, Human
caguggcucaggccuguaauccca

SEQ ID NO: 357081 - RNA, 20 nt, Human
caguggcucauaccuguaau

SEQ ID NO: 357082 - RNA, 21 nt, Human
caguggcucauaccuguaauc

SEQ ID NO: 357083 - RNA, 24 nt, Human
caguggcucauaccuguaauccca

SEQ ID NO: 357084 - RNA, 32 nt, Human
caguggcucauaccuguaaucccagcacuuug

SEQ ID NO: 357085 - RNA, 24 nt, Human
caguggcucauaccuguaaugcca

SEQ ID NO: 357086 - RNA, 32 nt, Human
caguggcucauaccuguaaugccagcacuuug

SEQ ID NO: 357087 - RNA, 24 nt, Human
caguggcucauaccuuuaauccca

SEQ ID NO: 357088 - RNA, 21 nt, Human
caguggcucaucccuguaauu

SEQ ID NO: 357089 - RNA, 24 nt, Human
caguggcucaucccuguaauucca

SEQ ID NO: 357090 - RNA, 24 nt, Human
caguggcucaugccagcaauccua

SEQ ID NO: 357091 - RNA, 24 nt, Human
caguggcucaugccaguuauccca

SEQ ID NO: 357092 - RNA, 24 nt, Human
caguggcucaugcccauaauccca

SEQ ID NO: 357093 - RNA, 24 nt, Human
caguggcucaugcccguaauccca

SEQ ID NO: 357094 - RNA, 21 nt, Human
caguggcucaugcccguaauu

SEQ ID NO: 357095 - RNA, 23 nt, Human
caguggcucaugcccguaauucu

SEQ ID NO: 357096 - RNA, 23 nt, Human
caguggcucaugcccguaauuuc

SEQ ID NO: 357097 - RNA, 21 nt, Human
caguggcucaugccgauaauc

SEQ ID NO: 357098 - RNA, 24 nt, Human
caguggcucaugccgauaauccca

SEQ ID NO: 357099 - RNA, 21 nt, Human
caguggcucaugccuauaauc

SEQ ID NO: 357100 - RNA, 23 nt, Human
caguggcucaugccuauaauccc

SEQ ID NO: 357101 - RNA, 24 nt, Human
caguggcucaugccuauaauccca

SEQ ID NO: 357102 - RNA, 24 nt, Human
caguggcucaugccuauaauccua

SEQ ID NO: 357103 - RNA, 24 nt, Human
caguggcucaugccuauaaucuca

SEQ ID NO: 357104 - RNA, 24 nt, Human
caguggcucaugccuauaaucuua

SEQ ID NO: 357105 - RNA, 21 nt, Human
caguggcucaugccuauaauu

SEQ ID NO: 357106 - RNA, 28 nt, Human
caguggcucaugccuauaauuaauccca

SEQ ID NO: 357107 - RNA, 24 nt, Human
caguggcucaugccuauaauucca

SEQ ID NO: 357108 - RNA, 23 nt, Human
caguggcucaugccuauauuccc

SEQ ID NO: 357109 - RNA, 21 nt, Human
caguggcucaugccugaaauc

SEQ ID NO: 357110 - RNA, 24 nt, Human
caguggcucaugccugaaauccua

SEQ ID NO: 357111 - RNA, 24 nt, Human
caguggcucaugccuggaauccca

SEQ ID NO: 357112 - RNA, 24 nt, Human
caguggcucaugccuguaacccca

SEQ ID NO: 357113 - RNA, 24 nt, Human
caguggcucaugccuguaagccca

SEQ ID NO: 357114 - RNA, 21 nt, Human
caguggcucaugccuguaauc

SEQ ID NO: 357115 - RNA, 22 nt, Human
caguggcucaugccuguaaucc

SEQ ID NO: 357116 - RNA, 24 nt, Human
caguggcucaugccuguaauccca

SEQ ID NO: 357117 - RNA, 24 nt, Human
caguggcucaugccuguaauccua

SEQ ID NO: 357118 - RNA, 24 nt, Human
caguggcucaugccuguaaucgua

SEQ ID NO: 357119 - RNA, 24 nt, Human
caguggcucaugccuguaaucuca

SEQ ID NO: 357120 - RNA, 24 nt, Human
caguggcucaugccuguaaucuua

SEQ ID NO: 357121 - RNA, 21 nt, Human
caguggcucaugccuguaauu

SEQ ID NO: 357122 - RNA, 23 nt, Human
caguggcucaugccuguaauucc

SEQ ID NO: 357123 - RNA, 24 nt, Human
caguggcucaugccuguaauucca

SEQ ID NO: 357124 - RNA, 32 nt, Human
caguggcucaugccuguaauuccaaugugaua

SEQ ID NO: 357125 - RNA, 21 nt, Human
caguggcucaugccuguaguc

SEQ ID NO: 357126 - RNA, 24 nt, Human
caguggcucaugccuguaguccca

SEQ ID NO: 357127 - RNA, 24 nt, Human
caguggcucaugccuguauuccca

SEQ ID NO: 357128 - RNA, 24 nt, Human
caguggcucaugccuguauucuca

SEQ ID NO: 357129 - RNA, 21 nt, Human
caguggcucaugccugugguc

SEQ ID NO: 357130 - RNA, 24 nt, Human
caguggcucaugccugugguccca

SEQ ID NO: 357131 - RNA, 24 nt, Human
caguggcucaugcuuguaauccca

SEQ ID NO: 357132 - RNA, 24 nt, Human
caguggcucaugcuuguaauccua

SEQ ID NO: 357133 - RNA, 21 nt, Human
caguggcucaugucugcaauc

SEQ ID NO: 357134 - RNA, 24 nt, Human
caguggcucaugucugcaauccca

SEQ ID NO: 357135 - RNA, 24 nt, Human
caguggcucauguguguaauccca

SEQ ID NO: 357136 - RNA, 24 nt, Human
caguggcucauuccuguaauccca

SEQ ID NO: 357137 - RNA, 24 nt, Human
caguggcucccaccuauaauccua

SEQ ID NO: 357138 - RNA, 24 nt, Human
caguggcucccaccuguaaucuca

SEQ ID NO: 357139 - RNA, 21 nt, Human
caguggcucccgccuguaauc

SEQ ID NO: 357140 - RNA, 24 nt, Human
caguggcucccgccuguaauccca

SEQ ID NO: 357141 - RNA, 32 nt, Human
caguggcuccgccgcauccucacacugacggg

SEQ ID NO: 357142 - RNA, 20 nt, Human
caguggcuccuauaauccca

SEQ ID NO: 357143 - RNA, 22 nt, Human
caguggcuccucaagccugccu

SEQ ID NO: 357144 - RNA, 22 nt, Human
caguggcucgccuguaauccca

SEQ ID NO: 357145 - RNA, 24 nt, Human
caguggcucgcgccuguaauccca

SEQ ID NO: 357146 - RNA, 24 nt, Human
caguggcucuugccuguaauccca

SEQ ID NO: 357147 - RNA, 21 nt, Human
caguggcucuugucuguaauc

SEQ ID NO: 357148 - RNA, 24 nt, Human
caguggcucuugucuguaauccca

SEQ ID NO: 357149 - RNA, 32 nt, Human
caguggcugaaauccagcauuuuuacauagga

SEQ ID NO: 357150 - RNA, 32 nt, Human
caguggcugaagagccagccucgguggcccag

SEQ ID NO: 357151 - RNA, 32 nt, Human
caguggcugagaauuggauaaagucuugggaa

SEQ ID NO: 357152 - RNA, 32 nt, Human
caguggcugagcucugagaaggcuccaucucc

SEQ ID NO: 357153 - RNA, 24 nt, Human
caguggcugaugccuguaauccca

SEQ ID NO: 357154 - RNA, 32 nt, Human
caguggcugcagcucugaccgucccgccagca

SEQ ID NO: 357155 - RNA, 32 nt, Human
caguggcugcaggcugcccccugccggccaca

SEQ ID NO: 357156 - RNA, 32 nt, Human
caguggcuggagagaagcagaucugugcaacg

SEQ ID NO: 357157 - RNA, 32 nt, Human
caguggcuggggcuggaacagagcagccggcc

SEQ ID NO: 357158 - RNA, 20 nt, Human
caguggcuggggguuaggga

SEQ ID NO: 357159 - RNA, 32 nt, Human
caguggcuguaaucccagcacuuugggaggcc

SEQ ID NO: 357160 - RNA, 24 nt, Human
caguggcuuacaccuguaacccca

SEQ ID NO: 357161 - RNA, 21 nt, Human
caguggcuuacaccuguaauc

SEQ ID NO: 357162 - RNA, 24 nt, Human
caguggcuuacaccuguaauccca

SEQ ID NO: 357163 - RNA, 21 nt, Human
caguggcuuacgccuguaauc

SEQ ID NO: 357164 - RNA, 24 nt, Human
caguggcuuacgccuguaauccca

SEQ ID NO: 357165 - RNA, 24 nt, Human
caguggcuuaugcuuguaauccca

SEQ ID NO: 357166 - RNA, 21 nt, Human
caguggcuuauuccuguaauc

SEQ ID NO: 357167 - RNA, 24 nt, Human
caguggcuuauuccuguaauccca

SEQ ID NO: 357168 - RNA, 32 nt, Human
caguggcuuccagcagaguugccugggauuuc

SEQ ID NO: 357169 - RNA, 32 nt, Human
caguggcuuccucuggggugucaccaagcaag

SEQ ID NO: 357170 - RNA, 21 nt, Human
caguggcuugcaccuguaauc

SEQ ID NO: 357171 - RNA, 24 nt, Human
caguggcuugcaccuguaauccca

SEQ ID NO: 357172 - RNA, 32 nt, Human
caguggcuuggcugacauugccucuuuguccu

SEQ ID NO: 357173 - RNA, 32 nt, Human
caguggcuugggcuggagucacgggggcgguc

SEQ ID NO: 357174 - RNA, 21 nt, Human
caguggcuugugccuguaauc

SEQ ID NO: 357175 - RNA, 24 nt, Human
caguggcuugugccuguaauccca

SEQ ID NO: 357176 - RNA, 24 nt, Human
caguggcuuguuccuguaguccca

SEQ ID NO: 357177 - RNA, 31 nt, Human
caguggcuuuucuugacuugccaaaucagug

SEQ ID NO: 357178 - RNA, 21 nt, Human
caguggcuuuugccuguaauc

SEQ ID NO: 357179 - RNA, 24 nt, Human
caguggcuuuugccuguaauccca

SEQ ID NO: 357180 - RNA, 32 nt, Human
cagugggaaauugcagucucagaggaaggccc

SEQ ID NO: 357181 - RNA, 32 nt, Human
cagugggaacaaggucaagguccuuuugaaac

SEQ ID NO: 357182 - RNA, 32 nt, Human
cagugggacaaacuccagcacagaagccugcg

SEQ ID NO: 357183 - RNA, 32 nt, Human
cagugggacccauucagaguuuacagaugcuu

SEQ ID NO: 357184 - RNA, 32 nt, Human
cagugggacugcuuccuugacgccuuagcuug

SEQ ID NO: 357185 - RNA, 32 nt, Human
cagugggagaccgaggugggcagaucacuuga

SEQ ID NO: 357186 - RNA, 21 nt, Human
cagugggagagaugguggaag

SEQ ID NO: 357187 - RNA, 32 nt, Human
cagugggagaggggacacgcagggccuggcug

SEQ ID NO: 357188 - RNA, 32 nt, Human
cagugggagcacggcccagcuggauuuuggac

SEQ ID NO: 357189 - RNA, 32 nt, Human
cagugggagccaccuccagcugaaugcccagg

SEQ ID NO: 357190 - RNA, 32 nt, Human
cagugggaggggcaggcugacaucuguguuuc

SEQ ID NO: 357191 - RNA, 32 nt, Human
cagugggaggguaccagcagaaagguuaguau

SEQ ID NO: 357192 - RNA, 32 nt, Human
cagugggagucagcacgaucgccacgcccuca

SEQ ID NO: 357193 - RNA, 22 nt, Human
cagugggaguuccuuccagccc

SEQ ID NO: 357194 - RNA, 32 nt, Human
cagugggcaaaucuauugucuuuauuucucau

SEQ ID NO: 357195 - RNA, 32 nt, Human
cagugggcacaucgagagcaaacacaucggag

SEQ ID NO: 357196 - RNA, 32 nt, Human
cagugggcaccaggaccacggagcucagggug

SEQ ID NO: 357197 - RNA, 32 nt, Human
cagugggcagccuaggagugccaagccaugac

SEQ ID NO: 357198 - RNA, 32 nt, Human
cagugggcaggaagaaagagugaggcaaagug

SEQ ID NO: 357199 - RNA, 32 nt, Human
cagugggcagggaagacauaacagauggaagc

SEQ ID NO: 357200 - RNA, 32 nt, Human
cagugggcagggaauccuggagcacuuguucc

SEQ ID NO: 357201 - RNA, 19 nt, Human
cagugggcaggggaccagg

SEQ ID NO: 357202 - RNA, 32 nt, Human
cagugggcaggguauguagcugcuccaagaug

SEQ ID NO: 357203 - RNA, 32 nt, Human
cagugggccccgcugcagcuguguguccuucu

SEQ ID NO: 357204 - RNA, 32 nt, Human
cagugggccugggacaguggcugcucuugacu

SEQ ID NO: 357205 - RNA, 21 nt, Human
cagugggcgccuguaauccca

SEQ ID NO: 357206 - RNA, 32 nt, Human
cagugggcucaauccuccacuacaggucccgg

SEQ ID NO: 357207 - RNA, 19 nt, Human
cagugggcuccuuccagcc

SEQ ID NO: 357208 - RNA, 32 nt, Human
cagugggcuuauuccuccagcuggcuucccac

SEQ ID NO: 357209 - RNA, 32 nt, Human
cagugggcuuguuugcagacugggugaggugg

SEQ ID NO: 357210 - RNA, 32 nt, Human
caguggggaaggcagaggaguaacugugggga

SEQ ID NO: 357211 - RNA, 32 nt, Human
caguggggacacuccucccuccccagugagca

SEQ ID NO: 357212 - RNA, 32 nt, Human
caguggggagaggcccagggacuggggcugga

SEQ ID NO: 357213 - RNA, 32 nt, Human
caguggggagccugggcucugagauucccucc

SEQ ID NO: 357214 - RNA, 32 nt, Human
caguggggcaaggagaaaggagaggugacugc

SEQ ID NO: 357215 - RNA, 32 nt, Human
caguggggcagaggcaguaccugggcaagcug

SEQ ID NO: 357216 - RNA, 32 nt, Human
caguggggcagccccguaccacagccugcccu

SEQ ID NO: 357217 - RNA, 32 nt, Human
caguggggccagacuggcuccuggagcugaca

SEQ ID NO: 357218 - RNA, 32 nt, Human
caguggggcugcagaggcuggggugagccaca

SEQ ID NO: 357219 - RNA, 32 nt, Human
cagugggggaccccucuucuccaaccacucag

SEQ ID NO: 357220 - RNA, 32 nt, Human
cagugggggucagccaggagcccagggaguca

SEQ ID NO: 357221 - RNA, 32 nt, Human
cagugggggugagcgggcacaggcugagaacu

SEQ ID NO: 357222 - RNA, 32 nt, Human
cagugggggugucuguggagugcaugacucag

SEQ ID NO: 357223 - RNA, 32 nt, Human
cagugggguggagggggcagggcguggugagg

SEQ ID NO: 357224 - RNA, 32 nt, Human
cagugggucauggguaguaccagccucaaauu

SEQ ID NO: 357225 - RNA, 32 nt, Human
cagugggucuccugcccccgacuccaacuccc

SEQ ID NO: 357226 - RNA, 32 nt, Human
cagugggucugacuugaggucugugaugugac

SEQ ID NO: 357227 - RNA, 32 nt, Human
cagugggucugucacccucucuccuugaagca

SEQ ID NO: 357228 - RNA, 32 nt, Human
cagugggugaaacugacuuucuuuugguuggg

SEQ ID NO: 357229 - RNA, 32 nt, Human
cagugggugagcugggcugggcuggcuggcau

SEQ ID NO: 357230 - RNA, 32 nt, Human
cagugggugcagacagcccugccuugaggaug

SEQ ID NO: 357231 - RNA, 32 nt, Human
caguggguggagugccagggaggaggaggcac

SEQ ID NO: 357232 - RNA, 32 nt, Human
cagugggugggcagagguuuagaaaggugguu

SEQ ID NO: 357233 - RNA, 32 nt, Human
caguggguggguggggugggguggggcaagug

SEQ ID NO: 357234 - RNA, 32 nt, Human
caguggguggucaggggccugacugaugccca

SEQ ID NO: 357235 - RNA, 32 nt, Human
caguggguuaacaucaguuuuguuuacucauc

SEQ ID NO: 357236 - RNA, 32 nt, Human
caguggguuauaugucucagcccaaguccuug

SEQ ID NO: 357237 - RNA, 32 nt, Human
cagugguaagggagaggggacaccuggccagg

SEQ ID NO: 357238 - RNA, 24 nt, Human
cagugguacaugccuauaguccca

SEQ ID NO: 357239 - RNA, 21 nt, Human
cagugguacaugccuguaauc

SEQ ID NO: 357240 - RNA, 24 nt, Human
cagugguacaugccuguaauccca

SEQ ID NO: 357241 - RNA, 18 nt, Human
cagugguaccaugagaug

SEQ ID NO: 357242 - RNA, 32 nt, Human
cagugguagggagacagccaggagcgguuuuc

SEQ ID NO: 357243 - RNA, 23 nt, Human
cagugguagguugggaaggagau

SEQ ID NO: 357244 - RNA, 32 nt, Human
cagugguagucaggccagugauagugagggac

SEQ ID NO: 357245 - RNA, 32 nt, Human
cagugguauacugaacaccugccccacaaaga

SEQ ID NO: 357246 - RNA, 24 nt, Human
cagugguauauaccuguaguccca

SEQ ID NO: 357247 - RNA, 32 nt, Human
cagugguaugaucaugagcucacugcagccuu

SEQ ID NO: 357248 - RNA, 32 nt, Human
cagugguaugaucucaccuuacugcaaccacc

SEQ ID NO: 357249 - RNA, 32 nt, Human
cagugguaugaucucagcuuacugcaaccucu

SEQ ID NO: 357250 - RNA, 32 nt, Human
caguggucacuguggcacccaggugugggccu

SEQ ID NO: 357251 - RNA, 32 nt, Human
caguggucaugggaaggagcgaaggaaccauc

SEQ ID NO: 357252 - RNA, 32 nt, Human
caguggucauucuuuggccucuccuuggcuuu

SEQ ID NO: 357253 - RNA, 32 nt, Human
caguggucuaauucaacucugugucccagcac

SEQ ID NO: 357254 - RNA, 32 nt, Human
caguggucuuagagagaaggggagacuagaga

SEQ ID NO: 357255 - RNA, 32 nt, Human
caguggugacagcugaggccaugugaguagga

SEQ ID NO: 357256 - RNA, 32 nt, Human
caguggugacauccuucagucccucacaucuc

SEQ ID NO: 357257 - RNA, 32 nt, Human
caguggugagagcucaccacugagcuuccugg

SEQ ID NO: 357258 - RNA, 32 nt, Human
caguggugcaaacacagcucucuccacaaccu

SEQ ID NO: 357259 - RNA, 32 nt, Human
caguggugcaaucacagcucacugcagccucg

SEQ ID NO: 357260 - RNA, 32 nt, Human
caguggugcaaucacagcucacugcagccuug

SEQ ID NO: 357261 - RNA, 32 nt, Human
caguggugcaauccucaacucacugcaaccuc

SEQ ID NO: 357262 - RNA, 24 nt, Human
caguggugcaugccuguaguccca

SEQ ID NO: 357263 - RNA, 32 nt, Human
caguggugcccagggaugugucagcccccagc

SEQ ID NO: 357264 - RNA, 32 nt, Human
caguggugccuguaaucccagcaguuugggag

SEQ ID NO: 357265 - RNA, 26 nt, Human
caguggugcgcaugccuguaguccca

SEQ ID NO: 357266 - RNA, 32 nt, Human
cagugguggaaggcacaccauggcuuccucug

SEQ ID NO: 357267 - RNA, 32 nt, Human
cagugguggcaacuaugccuugccuucuggag

SEQ ID NO: 357268 - RNA, 32 nt, Human
cagugguggccuuccaagaggccaggcaugga

SEQ ID NO: 357269 - RNA, 32 nt, Human
caguggugggaagcuucccaggagaguccuca

SEQ ID NO: 357270 - RNA, 32 nt, Human
caguggugggcccugagcccucagguccccag

SEQ ID NO: 357271 - RNA, 19 nt, Human
cagugguggguggggcagg

SEQ ID NO: 357272 - RNA, 32 nt, Human
caguggugguauccaccacugaggugugcaaa

SEQ ID NO: 357273 - RNA, 32 nt, Human
cagugguguaugauugaaaauuucauucucug

SEQ ID NO: 357274 - RNA, 32 nt, Human
caguggugugaucacagcucacugcagccuca

SEQ ID NO: 357275 - RNA, 32 nt, Human
caguggugugaucacagcucacugcagccucg

SEQ ID NO: 357276 - RNA, 32 nt, Human
caguggugugcugguaaaauguuuaacaacca

SEQ ID NO: 357277 - RNA, 32 nt, Human
caguggugugguuccucgugcaacaaauauga

SEQ ID NO: 357278 - RNA, 32 nt, Human
cagugguguugcagcccccagauguguggcca

SEQ ID NO: 357279 - RNA, 32 nt, Human
cagugguuaccagugaggcaauacuuauuauc

SEQ ID NO: 357280 - RNA, 32 nt, Human
cagugguuacccacgaagcaguacuuauuauc

SEQ ID NO: 357281 - RNA, 32 nt, Human
cagugguuacccacgaggcaguacuuauccau

SEQ ID NO: 357282 - RNA, 32 nt, Human
cauccugcacacggggccgcugggcaggugcc

SEQ ID NO: 357283 - RNA, 19 nt, Human
cauccugcaccugccacua

SEQ ID NO: 357284 - RNA, 32 nt, Human
cauccugcaccuguccaccccaccccaacacc

SEQ ID NO: 357285 - RNA, 22 nt, Human
cauccugcagcuuauuggcuua

SEQ ID NO: 357286 - RNA, 32 nt, Human
cauccugcaguugggccagcugucgcaucuca

SEQ ID NO: 357287 - RNA, 32 nt, Human
cauccugccaccccuagccuugcuggggacgu

SEQ ID NO: 357288 - RNA, 32 nt, Human
cauccugccagcccuggacacaacacccaaca

SEQ ID NO: 357289 - RNA, 32 nt, Human
cauccugcccaacauggugaaaccccguuucu

SEQ ID NO: 357290 - RNA, 19 nt, Human
cauccugcccaggaucucc

SEQ ID NO: 357291 - RNA, 32 nt, Human
cauccugccccuggcugugcucuacaccuuag

SEQ ID NO: 357292 - RNA, 32 nt, Human
cauccugcccucuggcugccucccagcugggc

SEQ ID NO: 357293 - RNA, 32 nt, Human
cauccugcccuugccauccucccaucgaugug

SEQ ID NO: 357294 - RNA, 32 nt, Human
cauccugcggagugaccaggaggaggcugagg

SEQ ID NO: 357295 - RNA, 32 nt, Human
cauccugcugagugcccuguguguaaguccua

SEQ ID NO: 357296 - RNA, 31 nt, Human
cauccugcugcaggugggccugagucgcaga

SEQ ID NO: 357297 - RNA, 32 nt, Human
cauccugcugggagcacgauuccggguguuuc

SEQ ID NO: 357298 - RNA, 32 nt, Human
cauccugcuugcucccugacucccagggcccc

SEQ ID NO: 357299 - RNA, 19 nt, Human
cauccuggaaauuaccuga

SEQ ID NO: 357300 - RNA, 23 nt, Human
cauccuggaaucaaucacacuga

SEQ ID NO: 357301 - RNA, 32 nt, Human
cauccuggacaacaggagugaaacuccgucuc

SEQ ID NO: 357302 - RNA, 32 nt, Human
cauccuggacugggagguggaggcagagcccc

SEQ ID NO: 357303 - RNA, 32 nt, Human
cauccuggagacaagguuggggagacaaacag

SEQ ID NO: 357304 - RNA, 32 nt, Human
cauccuggagcagcaccucacccucacuugcc

SEQ ID NO: 357305 - RNA, 32 nt, Human
cauccuggagcagcacugcacccucacuagcc

SEQ ID NO: 357306 - RNA, 32 nt, Human
cauccuggaggugaagguugcagugagccaag

SEQ ID NO: 357307 - RNA, 32 nt, Human
cauccuggauaacacggagaaaccccggcgga

SEQ ID NO: 357308 - RNA, 32 nt, Human
cauccuggcaaacauggugaaaccccaucucu

SEQ ID NO: 357309 - RNA, 32 nt, Human
cauccuggcaugaccugcaacuccagguggug

SEQ ID NO: 357310 - RNA, 32 nt, Human
cauccuggccaacacagugaaaccccaucugu

SEQ ID NO: 357311 - RNA, 32 nt, Human
cauccuggccaacacagugaaaccccaugucu

SEQ ID NO: 357312 - RNA, 32 nt, Human
cauccuggccaacacggugaaaccccaucucu

SEQ ID NO: 357313 - RNA, 32 nt, Human
cauccuggccaacacggugaaaccccgucucu

SEQ ID NO: 357314 - RNA, 32 nt, Human
cauccuggccaacauagugaaaccccgucuga

SEQ ID NO: 357315 - RNA, 32 nt, Human
cauccuggccaacaucgugaaaccccaucucu

SEQ ID NO: 357316 - RNA, 32 nt, Human
cauccuggccaacaugaugaaaccccgucucu

SEQ ID NO: 357317 - RNA, 32 nt, Human
cauccuggccaacaugaugaaacccuaucucu

SEQ ID NO: 357318 - RNA, 32 nt, Human
cauccuggccaacauggcaaaacccccaucuc

SEQ ID NO: 357319 - RNA, 32 nt, Human
cauccuggccaacauggcgaaaccccgucucu

SEQ ID NO: 357320 - RNA, 32 nt, Human
cauccuggccaacauggggaaacuccgucucu

SEQ ID NO: 357321 - RNA, 32 nt, Human
cauccuggccaacauggugaaaccacauuucu

SEQ ID NO: 357322 - RNA, 32 nt, Human
cauccuggccaacauggugaaacccagucucu

SEQ ID NO: 357323 - RNA, 32 nt, Human
cauccuggccaacauggugaaaccccacgucu

SEQ ID NO: 357324 - RNA, 32 nt, Human
cauccuggccaacauggugaaaccccaucucu

SEQ ID NO: 357325 - RNA, 32 nt, Human
cauccuggccaacauggugaaaccccaucugu

SEQ ID NO: 357326 - RNA, 32 nt, Human
cauccuggccaacauggugaaaccccaugucu

SEQ ID NO: 357327 - RNA, 32 nt, Human
cauccuggccaacauggugaaaccccauuucu

SEQ ID NO: 357328 - RNA, 32 nt, Human
cauccuggccaacauggugaaaccccgucucc

SEQ ID NO: 357329 - RNA, 32 nt, Human
cauccuggccaacauggugaaaccccgucucu

SEQ ID NO: 357330 - RNA, 32 nt, Human
cauccuggccaacauggugaaaccccgucugu

SEQ ID NO: 357331 - RNA, 32 nt, Human
cauccuggccaacauggugaaacccugucucu

SEQ ID NO: 357332 - RNA, 32 nt, Human
cauccuggccaacauggugaaacccugucugu

SEQ ID NO: 357333 - RNA, 32 nt, Human
cauccuggccaacauggugaaaccucaucucu

SEQ ID NO: 357334 - RNA, 32 nt, Human
cauccuggccaacauggugaaaccucgucucu

SEQ ID NO: 357335 - RNA, 32 nt, Human
cauccuggccaacauggugaaaccugucucua

SEQ ID NO: 357336 - RNA, 32 nt, Human
cauccuggccaacauggugaaaccuugucuac

SEQ ID NO: 357337 - RNA, 32 nt, Human
cauccuggccaacauggugaaacgccaucucu

SEQ ID NO: 357338 - RNA, 32 nt, Human
cauccuggccaacauggugaacaccguccccc

SEQ ID NO: 357339 - RNA, 32 nt, Human
cauccuggccaacauggugacaccccgucucu

SEQ ID NO: 357340 - RNA, 32 nt, Human
cauccuggccaacauuguaaaaccccaucucu

SEQ ID NO: 357341 - RNA, 32 nt, Human
cauccuggccaacguggugaaaccccaucucu

SEQ ID NO: 357342 - RNA, 32 nt, Human
cauccuggccaacguggugaaaccccgucucu

SEQ ID NO: 357343 - RNA, 32 nt, Human
cauccuggccgugcucagucaucugccagcug

SEQ ID NO: 357344 - RNA, 32 nt, Human
cauccuggcgaacauggugaaaccccaucucu

SEQ ID NO: 357345 - RNA, 32 nt, Human
cauccuggcgcccauuuugcaggucaguugcu

SEQ ID NO: 357346 - RNA, 32 nt, Human
cauccuggcuaacaaggugaaaccccgucucu

SEQ ID NO: 357347 - RNA, 32 nt, Human
cauccuggcuaacacagugaaaccccaucucu

SEQ ID NO: 357348 - RNA, 32 nt, Human
cauccuggcuaacacgaugaaaccccgucucu

SEQ ID NO: 357349 - RNA, 32 nt, Human
cauccuggcuaacacggcgaaaccccgucucu

SEQ ID NO: 357350 - RNA, 32 nt, Human
cauccuggcuaacacgguaaaaccccaucucu

SEQ ID NO: 357351 - RNA, 22 nt, Human
cauccuggcuaacacggugaaa

SEQ ID NO: 357352 - RNA, 32 nt, Human
cauccuggcuaacacggugaaaccccaccucu

SEQ ID NO: 357353 - RNA, 32 nt, Human
cauccuggcuaacacggugaaaccccaucucc

SEQ ID NO: 357354 - RNA, 32 nt, Human
cauccuggcuaacacggugaaaccccaucucu

SEQ ID NO: 357355 - RNA, 32 nt, Human
cauccuggcuaacacggugaaaccccauuucc

SEQ ID NO: 357356 - RNA, 32 nt, Human
cauccuggcuaacacggugaaaccccgucucu

SEQ ID NO: 357357 - RNA, 32 nt, Human
cauccuggcuaacacggugaaaccccgucuuu

SEQ ID NO: 357358 - RNA, 32 nt, Human
cauccuggcuaacacggugaaaccccuuaucu

SEQ ID NO: 357359 - RNA, 32 nt, Human
cauccuggcuaacagggugaaaccccaucgcu

SEQ ID NO: 357360 - RNA, 32 nt, Human
cauccuggcuaacauggugaaaccccaucucc

SEQ ID NO: 357361 - RNA, 32 nt, Human
cauccuggcuaacauggugaaaccccaucucu

SEQ ID NO: 357362 - RNA, 32 nt, Human
cauccuggcuaacauggugaaaccccaugucu

SEQ ID NO: 357363 - RNA, 32 nt, Human
cauccuggcuaacauggugaaacccccgucuc

SEQ ID NO: 357364 - RNA, 32 nt, Human
cauccuggcuaacauggugaaacccccguuuc

SEQ ID NO: 357365 - RNA, 32 nt, Human
cauccuggcuaacauggugaaaccccgccucu

SEQ ID NO: 357366 - RNA, 32 nt, Human
cauccuggcuaacauggugaaaccccgucucu

SEQ ID NO: 357367 - RNA, 32 nt, Human
cauccuggcuaacauggugaaaccccgucugu

SEQ ID NO: 357368 - RNA, 32 nt, Human
cauccuggcuaacguggugaaaccccaucucu

SEQ ID NO: 357369 - RNA, 32 nt, Human
cauccuggcuaacguggugaaaccccgucccu

SEQ ID NO: 357370 - RNA, 32 nt, Human
cauccuggcuaacuuggugaaaccccgucucu

SEQ ID NO: 357371 - RNA, 32 nt, Human
cauccuggcuaauacagugaaaccccaugucu

SEQ ID NO: 357372 - RNA, 32 nt, Human
cauccuggcuaauguggugaaaccccgucucu

SEQ ID NO: 357373 - RNA, 32 nt, Human
cauccuggcuaccagauggaaccuucucuucu

SEQ ID NO: 357374 - RNA, 32 nt, Human
cauccuggcuagcauggugaaaccccgucucu

SEQ ID NO: 357375 - RNA, 32 nt, Human
cauccuggcucauacggugaaaccccaucucc

SEQ ID NO: 357376 - RNA, 32 nt, Human
cauccuggcucugucauuuacuuacagaaaug

SEQ ID NO: 357377 - RNA, 32 nt, Human
cauccugggaaacuggguaguucaucugacca

SEQ ID NO: 357378 - RNA, 32 nt, Human
cauccugggcaacauggcgaaacccuaucucu

SEQ ID NO: 357379 - RNA, 32 nt, Human
cauccugggcaauauggcaaaaccccaucuuu

SEQ ID NO: 357380 - RNA, 32 nt, Human
cauccugggcugggcugccuucuucuacaguu

SEQ ID NO: 357381 - RNA, 32 nt, Human
cauccugggcugugcugaggcagugcugucuc

SEQ ID NO: 357382 - RNA, 32 nt, Human
cauccugggcuuuuccuacugugucuuguuac

SEQ ID NO: 357383 - RNA, 31 nt, Human
cauccuggggucgcugggccugcuugugucc

SEQ ID NO: 357384 - RNA, 32 nt, Human
cauccugggugcccagggcagagcaggcuuug

SEQ ID NO: 357385 - RNA, 32 nt, Human
cauccugggugggacagagcaggacaaugcaa

SEQ ID NO: 357386 - RNA, 32 nt, Human
cauccuggguuauuuuacaaacucauggauag

SEQ ID NO: 357387 - RNA, 32 nt, Human
cauccuggucccacuccugcagcugcuggugc

SEQ ID NO: 357388 - RNA, 20 nt, Human
cauccugguggccagcccac

SEQ ID NO: 357389 - RNA, 32 nt, Human
cauccugguguuacugaaaaacaggugugauc

SEQ ID NO: 357390 - RNA, 32 nt, Human
cauccugguuaacacggugaaaccccgacucu

SEQ ID NO: 357391 - RNA, 32 nt, Human
cauccugguuccacucuggccugggccugagg

SEQ ID NO: 357392 - RNA, 32 nt, Human
cauccuguaggacccaguggaaccugacagag

SEQ ID NO: 357393 - RNA, 32 nt, Human
cauccugucagcacagucuucucugaagugcu

SEQ ID NO: 357394 - RNA, 26 nt, Human
cauccugucccacccugcccacuuca

SEQ ID NO: 357395 - RNA, 18 nt, Human
cauccugucccucccuca

SEQ ID NO: 357396 - RNA, 32 nt, Human
cauccugucuaacacggugaaaccccaucucu

SEQ ID NO: 357397 - RNA, 32 nt, Human
cauccugucuucuucugugcugccugguuuga

SEQ ID NO: 357398 - RNA, 32 nt, Human
cauccugugcagcugacacacagcuaaggagc

SEQ ID NO: 357399 - RNA, 32 nt, Human
cauccugugcaguuuacaacaaaaggaagcga

SEQ ID NO: 357400 - RNA, 32 nt, Human
cauccugugccucaccacagcuugcuuagagc

SEQ ID NO: 357401 - RNA, 32 nt, Human
cauccuguggagcccacuccuggcagacgccg

SEQ ID NO: 357402 - RNA, 32 nt, Human
cauccuguggaggccaggcucagagccacccc

SEQ ID NO: 357403 - RNA, 32 nt, Human
cauccuguggugagcuagcggauucccugcuu

SEQ ID NO: 357404 - RNA, 21 nt, Human
cauccuguguacccuugucaa

SEQ ID NO: 357405 - RNA, 23 nt, Human
cauccuguguccugggacugagg

SEQ ID NO: 357406 - RNA, 32 nt, Human
cauccuguuccuuggauuggacuucacuaagc

SEQ ID NO: 357407 - RNA, 32 nt, Human
cauccuuacaaaccacagcaugcccggcuccu

SEQ ID NO: 357408 - RNA, 32 nt, Human
cauccuuaccaccacaccacacgcacacucca

SEQ ID NO: 357409 - RNA, 32 nt, Human
cauccuuacuaaaaauacaaaaauuagccagg

SEQ ID NO: 357410 - RNA, 32 nt, Human
cauccuuagacaccugcucuguaacugucuuu

SEQ ID NO: 357411 - RNA, 32 nt, Human
cauccuuaggauaaauccuacuuuuuaaugug

SEQ ID NO: 357412 - RNA, 19 nt, Human
cauccuuauuucccugcca

SEQ ID NO: 357413 - RNA, 32 nt, Human
cauccuucaauccagucaagcugacacucagc

SEQ ID NO: 357414 - RNA, 32 nt, Human
cauccuucccacucugucgagccugggggcug

SEQ ID NO: 357415 - RNA, 18 nt, Human
cauccuuccccagcacca

SEQ ID NO: 357416 - RNA, 32 nt, Human
cauccuuccugaccaccugacugcggaaacau

SEQ ID NO: 357417 - RNA, 32 nt, Human
cauccuuccugccuccugccccaaaccccggg

SEQ ID NO: 357418 - RNA, 32 nt, Human
cauccuucucauuuucuuuugcugcugccaug

SEQ ID NO: 357419 - RNA, 32 nt, Human
cauccuucugggcccagcuaggagaaugaagu

SEQ ID NO: 357420 - RNA, 32 nt, Human
cauccuugaaauauaaaugaaaggaagggaag

SEQ ID NO: 357421 - RNA, 32 nt, Human
cauccuugccaagccuccaccacuaggucagu

SEQ ID NO: 357422 - RNA, 32 nt, Human
cauccuugcccagccgguguggugcuugugug

SEQ ID NO: 357423 - RNA, 32 nt, Human
cauccuugccuguagcccguagucacuugugc

SEQ ID NO: 357424 - RNA, 18 nt, Human
cauccuuggaccuucaca

SEQ ID NO: 357425 - RNA, 18 nt, Human
cauccuuggagucuccuc

SEQ ID NO: 357426 - RNA, 32 nt, Human
cauccuuggcugcuugcagggccacuguccag

SEQ ID NO: 357427 - RNA, 32 nt, Human
cauccuuguuuucccuccauccuucuuuccuu

SEQ ID NO: 357428 - RNA, 18 nt, Human
cauccuuuauucucuaua

SEQ ID NO: 357429 - RNA, 32 nt, Human
cauccuuuccccaucccugccuccugccccug

SEQ ID NO: 357430 - RNA, 32 nt, Human
cauccuuucccccuaaugaccgaggccagcaa

SEQ ID NO: 357431 - RNA, 32 nt, Human
cauccuuucuacugcuuuugaggcccucccuc

SEQ ID NO: 357432 - RNA, 32 nt, Human
cauccuuucucucgccccuccuacccgcagcu

SEQ ID NO: 357433 - RNA, 32 nt, Human
cauccuuucugccucgccaaggucucuuauac

SEQ ID NO: 357434 - RNA, 32 nt, Human
cauccuuucugucagcauggaucaagccccua

SEQ ID NO: 357435 - RNA, 32 nt, Human
cauccuuucuucucagucccuaccuacuguuu

SEQ ID NO: 357436 - RNA, 32 nt, Human
cauccuuugcuuccuuccuuccuuccuucuuc

SEQ ID NO: 357437 - RNA, 32 nt, Human
cauccuuugguccaaagcaucuggaagaggaa

SEQ ID NO: 357438 - RNA, 32 nt, Human
caucgaacaucaaccaaugucauggcacagca

SEQ ID NO: 357439 - RNA, 32 nt, Human
caucgaagccccguggggccuccagagaccac

SEQ ID NO: 357440 - RNA, 32 nt, Human
caucgaagccucagagagugggagacuguccc

SEQ ID NO: 357441 - RNA, 32 nt, Human
caucgaauacuaccuuugugugccucagggcc

SEQ ID NO: 357442 - RNA, 32 nt, Human
caucgacagcacaccgugccgacagugguaag

SEQ ID NO: 357443 - RNA, 32 nt, Human
caucgacauaccaacuacaggccagguggacc

SEQ ID NO: 357444 - RNA, 32 nt, Human
caucgaccacauccccagcccuggggacuuau

SEQ ID NO: 357445 - RNA, 32 nt, Human
caucgaccaccagacacuaacaacccucuccc

SEQ ID NO: 357446 - RNA, 32 nt, Human
caucgagaaucugguugcuuucuuggagacca

SEQ ID NO: 357447 - RNA, 32 nt, Human
caucgagcugcuggaucccacagccagccggc

SEQ ID NO: 357448 - RNA, 32 nt, Human
caucgaggagggagggcagacggaggcccgag

SEQ ID NO: 357449 - RNA, 32 nt, Human
caucgaggccacacucagcacuccaggauccc

SEQ ID NO: 357450 - RNA, 32 nt, Human
caucgaggugaccugggcugagucccgggagu

SEQ ID NO: 357451 - RNA, 32 nt, Human
caucgagugacacugggccauccaggcggcuc

SEQ ID NO: 357452 - RNA, 32 nt, Human
caucgauauacauuuauuuacacucuugauuc

SEQ ID NO: 357453 - RNA, 32 nt, Human
caucgaugcugccccgggcuaccuggcugcuc

SEQ ID NO: 357454 - RNA, 32 nt, Human
caucgauucagaaaucauauaauagcuggugg

SEQ ID NO: 357455 - RNA, 32 nt, Human
caucgauuucaccaagcgugggcugcucuucu

SEQ ID NO: 357456 - RNA, 32 nt, Human
caucgcaccaauauugcagacuuggaaggaag

SEQ ID NO: 357457 - RNA, 32 nt, Human
caucgcaccugagguggucaugugggggcgca

SEQ ID NO: 357458 - RNA, 32 nt, Human
caucgcacuccagacuacagccugggugacag

SEQ ID NO: 357459 - RNA, 21 nt, Human
caucgcacuccagccugggca

SEQ ID NO: 357460 - RNA, 28 nt, Human
caucgccaaaggauggaaguaauuugaa

SEQ ID NO: 357461 - RNA, 32 nt, Human
caucgccaaccugggugucauuucucagaacu

SEQ ID NO: 357462 - RNA, 32 nt, Human
caucgccaagcccccacccuaggaaauggguc

SEQ ID NO: 357463 - RNA, 15 nt, Human
caucgccacccagaa

SEQ ID NO: 357464 - RNA, 32 nt, Human
caucgccauccagccucgaagccaacaggacu

SEQ ID NO: 357465 - RNA, 32 nt, Human
caucgccgcacacccacccuccugcucauggg

SEQ ID NO: 357466 - RNA, 32 nt, Human
caucgccgcggggcggaggcgacagugucuag

SEQ ID NO: 357467 - RNA, 32 nt, Human
caucgccugcucccuccacacggcccuugggg

SEQ ID NO: 357468 - RNA, 32 nt, Human
caucgccuucccugccucuccaggacagagca

SEQ ID NO: 357469 - RNA, 32 nt, Human
caucgccuucugguuguugaagacagcacaga

SEQ ID NO: 357470 - RNA, 32 nt, Human
caucgccuuugagcuccugggcaagaacaccu

SEQ ID NO: 357471 - RNA, 32 nt, Human
caucgcgcacacuguauguacauacuggcaac

SEQ ID NO: 357472 - RNA, 32 nt, Human
caucgcgccacugcacuccagccugggcgaca

SEQ ID NO: 357473 - RNA, 32 nt, Human
caucgcgccacugcacucuagccugggugaca

SEQ ID NO: 357474 - RNA, 32 nt, Human
caucgcgccacugcacuucagccuggacaaca

SEQ ID NO: 357475 - RNA, 32 nt, Human
caucgcgccauugcacuccagccugggugacg

SEQ ID NO: 357476 - RNA, 19 nt, Human
caucgcggccuggccgggg

SEQ ID NO: 357477 - RNA, 32 nt, Human
caucgcuacuaaaaaugcaaaaauuagcuggg

SEQ ID NO: 357478 - RNA, 32 nt, Human
caucgcugagagcccccgccuccugagacugg

SEQ ID NO: 357479 - RNA, 32 nt, Human
caucgcugcaaaggaaagaacaaccuuaaaac

SEQ ID NO: 357480 - RNA, 32 nt, Human
caucgcugccuucugcaccuuccucgugcugg

SEQ ID NO: 357481 - RNA, 18 nt, Human
caucgcugcggcuggcca

SEQ ID NO: 357482 - RNA, 32 nt, Human
caucgcuggcuuuuccccuuguguucugagaa

SEQ ID NO: 357483 - RNA, 32 nt, Human
caucgcugggaugggccuggccuaaggcaucc

SEQ ID NO: 357484 - RNA, 32 nt, Human
caucgcuuaccuuggaaaggugggaagcuggc

SEQ ID NO: 357485 - RNA, 32 nt, Human
caucgcuucccaggaagacuuguugcagguag

SEQ ID NO: 357486 - RNA, 32 nt, Human
caucggaaaggaugccugguuugcuuuuaugu

SEQ ID NO: 357487 - RNA, 32 nt, Human
caucggaaauacugcuucucccaccccauccc

SEQ ID NO: 357488 - RNA, 32 nt, Human
caucggaaucacccgaucacagacgaguggcc

SEQ ID NO: 357489 - RNA, 32 nt, Human
caucggacccaggaggggacugguugguguau

SEQ ID NO: 357490 - RNA, 32 nt, Human
caucggaggugccgcagaggaggcaggaaaga

SEQ ID NO: 357491 - RNA, 32 nt, Human
caucggaggugggcgggguugcagugacuggu

SEQ ID NO: 357492 - RNA, 32 nt, Human
caucggcagagccuugagaaguuucauuccuu

SEQ ID NO: 357493 - RNA, 32 nt, Human
caucggcaucccggggagggcccgggagccuc

SEQ ID NO: 357494 - RNA, 32 nt, Human
caucggcgcgcugcccacaccuccaggcgacc

SEQ ID NO: 357495 - RNA, 32 nt, Human
caucggcuacagaaacagccuaaguuuacagg

SEQ ID NO: 357496 - RNA, 32 nt, Human
caucggcuugcccaggcuccagccucuccaag

SEQ ID NO: 357497 - RNA, 32 nt, Human
caucgggaugguggaggcugugaaggccguga

SEQ ID NO: 357498 - RNA, 32 nt, Human
caucggggaggggugcuccugaggccaggcau

SEQ ID NO: 357499 - RNA, 32 nt, Human
caucggggcugugcuggggcuuggggagggga

SEQ ID NO: 357500 - RNA, 32 nt, Human
caucggucauggucucgucccauuccacacca

SEQ ID NO: 357501 - RNA, 32 nt, Human
caucggucauuuugaaguagguguuugaugcc

SEQ ID NO: 357502 - RNA, 32 nt, Human
caucggugccuccccgaccuugcugacuaggc

SEQ ID NO: 357503 - RNA, 32 nt, Human
caucgguugcccaaggcuguaaguagugaugg

SEQ ID NO: 357504 - RNA, 18 nt, Human
caucguacaccagcacca

SEQ ID NO: 357505 - RNA, 32 nt, Human
caucguaccacugcacuccagccuggaugaca

SEQ ID NO: 357506 - RNA, 32 nt, Human
caucguacuccaggauaagaaacaguaacaug

SEQ ID NO: 357507 - RNA, 32 nt, Human
caucguagacuucauaguggagagaacccuua

SEQ ID NO: 357508 - RNA, 31 nt, Human
caucgucacagcugagaacgaggugggcucc

SEQ ID NO: 357509 - RNA, 31 nt, Human
caucgucacagcuggaacgaggugggcuccg

SEQ ID NO: 357510 - RNA, 32 nt, Human
caucgucauccuggagcuucaauggggccuug

SEQ ID NO: 357511 - RNA, 32 nt, Human
caucgucaugugaucaucaccuaagaacuaga

SEQ ID NO: 357512 - RNA, 32 nt, Human
caucguccaguucugaccauggacucgcagcc

SEQ ID NO: 357513 - RNA, 32 nt, Human
caucguccgccucagccagaaccuucuggucc

SEQ ID NO: 357514 - RNA, 25 nt, Human
caucguccgugaguuuuccaagcug

SEQ ID NO: 357515 - RNA, 32 nt, Human
caucgucuccauuucagaagaagaaccaaaac

SEQ ID NO: 357516 - RNA, 32 nt, Human
caucgucucugccacuccugacccagcccuga

SEQ ID NO: 357517 - RNA, 32 nt, Human
caucgucugcuauucauguguugaguuuuaua

SEQ ID NO: 357518 - RNA, 24 nt, Human
caucgugaaaccccaucucuacua

SEQ ID NO: 357519 - RNA, 32 nt, Human
caucgugcaucacucucccuucugccuccuuc

SEQ ID NO: 357520 - RNA, 21 nt, Human
caucgugccagagccuggggc

SEQ ID NO: 357521 - RNA, 32 nt, Human
caucgugcccagcuaauuuuuauauuuuuagu

SEQ ID NO: 357522 - RNA, 32 nt, Human
caucgugccuggcuaguuuuuguguuuuuagu

SEQ ID NO: 357523 - RNA, 32 nt, Human
caucgugcucaucgacagcacaccgugccgac

SEQ ID NO: 357524 - RNA, 32 nt, Human
caucguggagcugugguggggccugcagucau

SEQ ID NO: 357525 - RNA, 32 nt, Human
caucguggcugcagagugccaggaccaccggc

SEQ ID NO: 357526 - RNA, 32 nt, Human
caucgugggaaaggugguaaaggaggaugaug

SEQ ID NO: 357527 - RNA, 32 nt, Human
caucgugggcuggaaagggccccugguggucu

SEQ ID NO: 357528 - RNA, 32 nt, Human
caucguggugggugccuguaaucccagcuauu

SEQ ID NO: 357529 - RNA, 32 nt, Human
caucgugucucaucuugcuguuaucucuagcu

SEQ ID NO: 357530 - RNA, 32 nt, Human
caucgugugcagggcuuccggcggcguggggg

SEQ ID NO: 357531 - RNA, 32 nt, Human
caucgugugccaccccugccccuccccgaucc

SEQ ID NO: 357532 - RNA, 32 nt, Human
caucguguuccucacaaacuggagucuccacc

SEQ ID NO: 357533 - RNA, 32 nt, Human
caucguuaugaaaauauugcuaugagauaaua

SEQ ID NO: 357534 - RNA, 32 nt, Human
caucguucacagacuucuaggucuguaagcuc

SEQ ID NO: 357535 - RNA, 32 nt, Human
caucguucauaccuugcaguucaucagugaac

SEQ ID NO: 357536 - RNA, 32 nt, Human
caucguucggggcgcaguccucuccccggcug

SEQ ID NO: 357537 - RNA, 32 nt, Human
caucguugcuaucaccaguaccucucagcuua

SEQ ID NO: 357538 - RNA, 32 nt, Human
caucguuuacucugugauguaugagcacucua

SEQ ID NO: 357539 - RNA, 32 nt, Human
caucguuucucaggaaguucaccagaagcuau

SEQ ID NO: 357540 - RNA, 32 nt, Human
caucguuugcauccugcacaggcacaagcggc

SEQ ID NO: 357541 - RNA, 32 nt, Human
caucguuuuccugccuugaccccaccaucauc

SEQ ID NO: 357542 - RNA, 32 nt, Human
caucuaaaaagcaauacucugauaauuuggau

SEQ ID NO: 357543 - RNA, 32 nt, Human
caucuaaagagcccucugggccuguguugcug

SEQ ID NO: 357544 - RNA, 32 nt, Human
caucuaaagcaugaaaccuagcuccucuacac

SEQ ID NO: 357545 - RNA, 22 nt, Human
caucuaaaggcuuagagaguua

SEQ ID NO: 357546 - RNA, 32 nt, Human
caucuaagaaaauuuacuguaacuucuuaauc

SEQ ID NO: 357547 - RNA, 24 nt, Human
caucuaagcauuccacacugcagg

SEQ ID NO: 357548 - RNA, 32 nt, Human
caucuaagcccugacccuagccagggacuccc

SEQ ID NO: 357549 - RNA, 32 nt, Human
caucuaaggcaaaacuggcacauuuguucugc

SEQ ID NO: 357550 - RNA, 32 nt, Human
caucuaaguguguacacacaugguguacaccc

SEQ ID NO: 357551 - RNA, 32 nt, Human
caucuaaucgagaccuuuaauuuuucggggag

SEQ ID NO: 357552 - RNA, 32 nt, Human
caucuacacccccaagcacacacacauggucc

SEQ ID NO: 357553 - RNA, 32 nt, Human
caucuacacuaaaaauacaaaaaguuagacag

SEQ ID NO: 357554 - RNA, 32 nt, Human
caucuacagccaccugccugcuccuaugugcc

SEQ ID NO: 357555 - RNA, 32 nt, Human
caucuacagccuuuggaaacauggacaaauuu

SEQ ID NO: 357556 - RNA, 32 nt, Human
caucuacagugugccaagcacaugguucaucu

SEQ ID NO: 357557 - RNA, 32 nt, Human
caucuacaguugugccauuccccagccacugc

SEQ ID NO: 357558 - RNA, 32 nt, Human
caucuacaucucuauacuguacacucacccau

SEQ ID NO: 357559 - RNA, 32 nt, Human
caucuacaucuggcaaaagccaaagguuugga

SEQ ID NO: 357560 - RNA, 24 nt, Human
caucuacauuuuugggacucggga

SEQ ID NO: 357561 - RNA, 32 nt, Human
caucuaccaggguauucucucccaccucuuuc

SEQ ID NO: 357562 - RNA, 32 nt, Human
caucuacccaggcuggggcuucugggacaggc

SEQ ID NO: 357563 - RNA, 32 nt, Human
caucuaccgagccaggacacccccuauuauca

SEQ ID NO: 357564 - RNA, 24 nt, Human
caucuacuaagaaauucagcaccu

SEQ ID NO: 357565 - RNA, 32 nt, Human
caucuacuccacuguucagacaccuccuaacc

SEQ ID NO: 357566 - RNA, 32 nt, Human
caucuacugcgugcccuugccaaacagcugug

SEQ ID NO: 357567 - RNA, 32 nt, Human
caucuagaaacauuacaccacacacaccguca

SEQ ID NO: 357568 - RNA, 32 nt, Human
caucuagaaacucaagucugggcugcuuaucu

SEQ ID NO: 357569 - RNA, 32 nt, Human
caucuagaauaaaccaggccucuggcuaccac

SEQ ID NO: 357570 - RNA, 32 nt, Human
caucuagaucgucguggcgaagccgacucucc

SEQ ID NO: 357571 - RNA, 32 nt, Human
caucuagauggaagcuggggcuuccuuccuuu

SEQ ID NO: 357572 - RNA, 32 nt, Human
caucuagcaccuucucuaccucccagggucuu

SEQ ID NO: 357573 - RNA, 32 nt, Human
caucuagcaggaaaggagagggagcuuucccc

SEQ ID NO: 357574 - RNA, 32 nt, Human
caucuagccaccccagccuggccacgcagcca

SEQ ID NO: 357575 - RNA, 28 nt, Human
caucuagcgggugcugccugcaucucuu

SEQ ID NO: 357576 - RNA, 32 nt, Human
caucuagcuagcaauugcgaccuuaauuuaac

SEQ ID NO: 357577 - RNA, 32 nt, Human
caucuaggagaggggagggcagagggggugag

SEQ ID NO: 357578 - RNA, 32 nt, Human
caucuaggccaacguggugaaaccccgucacu

SEQ ID NO: 357579 - RNA, 32 nt, Human
caucuaggcccagcugaacccagguuaggggc

SEQ ID NO: 357580 - RNA, 20 nt, Human
caucuaggcuaggugcagug

SEQ ID NO: 357581 - RNA, 21 nt, Human
caucuaggcuggagugcaaug

SEQ ID NO: 357582 - RNA, 21 nt, Human
caucuaggcuggagugcagug

SEQ ID NO: 357583 - RNA, 32 nt, Human
caucuaguugcaggaaaacaagcugagugagg

SEQ ID NO: 357584 - RNA, 32 nt, Human
caucuauaaagugacaguaaccccuaccucac

SEQ ID NO: 357585 - RNA, 23 nt, Human
caucuauacacccuguaugucca

SEQ ID NO: 357586 - RNA, 32 nt, Human
caucuauacagaaaauacaaaaauuagccagg

SEQ ID NO: 357587 - RNA, 32 nt, Human
caucuauacccaaggaguccugugauuugagc

SEQ ID NO: 357588 - RNA, 32 nt, Human
caucuauagagaucuacuuuucuccuaugucu

SEQ ID NO: 357589 - RNA, 21 nt, Human
caucuauaggcaagaaguguu

SEQ ID NO: 357590 - RNA, 32 nt, Human
caucuauagggagggcugggggcgggaaaaga

SEQ ID NO: 357591 - RNA, 32 nt, Human
caucuauauuaaaaauaacaaaaauuagccag

SEQ ID NO: 357592 - RNA, 32 nt, Human
caucuauauuagcaacagauucucagaguaaa

SEQ ID NO: 357593 - RNA, 32 nt, Human
caucuaucaagcaacacagccccuuaucccag

SEQ ID NO: 357594 - RNA, 32 nt, Human
caucuaucacuauccugguggaacugguggga

SEQ ID NO: 357595 - RNA, 32 nt, Human
caucuaugcucuugguuggugcuggcugggau

SEQ ID NO: 357596 - RNA, 32 nt, Human
caucuauggagagaggagagaugcuacccgga

SEQ ID NO: 357597 - RNA, 32 nt, Human
caucuauguacagagccuugcagagaaacaca

SEQ ID NO: 357598 - RNA, 32 nt, Human
caucuauuguaacauuuaccugagaugaucau

SEQ ID NO: 357599 - RNA, 32 nt, Human
caucuauugucaaguaagaggguggguuccaa

SEQ ID NO: 357600 - RNA, 32 nt, Human
caucuauuguuuuguuugccagaaagugcacc

SEQ ID NO: 357601 - RNA, 32 nt, Human
caucucaaaggcagagcccugccugaaggagg

SEQ ID NO: 357602 - RNA, 32 nt, Human
caucucaacacacauccccacccuguguacac

SEQ ID NO: 357603 - RNA, 32 nt, Human
caucucaacuaaaaauacaaaaauuagccagg

SEQ ID NO: 357604 - RNA, 32 nt, Human
caucucaacuaaaaauauaaaaauuagccagg

SEQ ID NO: 357605 - RNA, 31 nt, Human
caucucaaggaauucagcuguugaaaucauu

SEQ ID NO: 357606 - RNA, 32 nt, Human
caucucaagggaaaauggaggcuccagcagca

SEQ ID NO: 357607 - RNA, 32 nt, Human
caucucaauaaaagccaggaacagagaagaga

SEQ ID NO: 357608 - RNA, 32 nt, Human
caucucaauuggcuuugaagugcaaugggaga

SEQ ID NO: 357609 - RNA, 32 nt, Human
caucucacaguaccucacaggucucuuccccc

SEQ ID NO: 357610 - RNA, 32 nt, Human
caucucaccauccuguauucuucaaccaguga

SEQ ID NO: 357611 - RNA, 32 nt, Human
caucucacccccagcacacgcagggacuacua

SEQ ID NO: 357612 - RNA, 32 nt, Human
caucucacuacuguucuucuacacauuacugu

SEQ ID NO: 357613 - RNA, 32 nt, Human
caucucacucacacacacaggcauccauacac

SEQ ID NO: 357614 - RNA, 32 nt, Human
caucucacugcaaccuccaccucccagguuca

SEQ ID NO: 357615 - RNA, 32 nt, Human
caucucacugggucuagucucaucucagacaa

SEQ ID NO: 357616 - RNA, 32 nt, Human
caucucagccuccagguccucuccuuuggggc

SEQ ID NO: 357617 - RNA, 32 nt, Human
caucucagccuccugaguagcugggaugacag

SEQ ID NO: 357618 - RNA, 32 nt, Human
caucucagccuccugaguagcugggauuacag

SEQ ID NO: 357619 - RNA, 32 nt, Human
caucucagccuccugaguagcuuggauuacag

SEQ ID NO: 357620 - RNA, 32 nt, Human
caucucagccuguaagcaaagcaggaaaccuu

SEQ ID NO: 357621 - RNA, 32 nt, Human
caucucagcuacucaggaggcugaggcaggag

SEQ ID NO: 357622 - RNA, 32 nt, Human
caucucagcuccugaaaaaugccucauuaccu

SEQ ID NO: 357623 - RNA, 32 nt, Human
caucucagcuuccugaggagcugggauuauag

SEQ ID NO: 357624 - RNA, 32 nt, Human
caucucaggaagcacuggacacagugauucug

SEQ ID NO: 357625 - RNA, 32 nt, Human
caucucaggccucccucaaccccaccacuucu

SEQ ID NO: 357626 - RNA, 32 nt, Human
caucucaggccuggcuggcucuucugugcuuu

SEQ ID NO: 357627 - RNA, 25 nt, Human
caucucagguaauuuaugaaaucua

SEQ ID NO: 357628 - RNA, 32 nt, Human
caucucaguauauguagggaccccaaaugacc

SEQ ID NO: 357629 - RNA, 32 nt, Human
caucucagucccccucccaacccuccauaugg

SEQ ID NO: 357630 - RNA, 32 nt, Human
caucucagucucugaguuucaucaugaagaca

SEQ ID NO: 357631 - RNA, 32 nt, Human
caucucaguuaggagauagaagaagauugggc

SEQ ID NO: 357632 - RNA, 32 nt, Human
caucucauaaacaaaaaggaagaggaaagaau

SEQ ID NO: 357633 - RNA, 32 nt, Human
caucucaucacuggaagaaaggagacuucagc

SEQ ID NO: 357634 - RNA, 32 nt, Human
caucucauccagagauauaguauucacauuuu

SEQ ID NO: 357635 - RNA, 21 nt, Human
caucucaugccccuggcuggg

SEQ ID NO: 357636 - RNA, 22 nt, Human
caucucaugcucuguggcucca

SEQ ID NO: 357637 - RNA, 32 nt, Human
caucucauuauugccagcauuauuagauguua

SEQ ID NO: 357638 - RNA, 32 nt, Human
caucucauuguagcuucaaccuccugagcuca

SEQ ID NO: 357639 - RNA, 32 nt, Human
caucuccaagccucugcuccccuucccaccac

SEQ ID NO: 357640 - RNA, 32 nt, Human
caucuccaaggccugcgggaaaaacuugccuu

SEQ ID NO: 357641 - RNA, 32 nt, Human
caucuccaaucagcugcuuugaccuccagggu

SEQ ID NO: 357642 - RNA, 18 nt, Human
caucuccaccugccacca

SEQ ID NO: 357643 - RNA, 32 nt, Human
caucuccacgcccccggaugugcucaguguag

SEQ ID NO: 357644 - RNA, 32 nt, Human
caucuccacuaaaaauacaaaaauuaguuggg

SEQ ID NO: 357645 - RNA, 32 nt, Human
caucuccacuaaaaauagaaaaauuagccggg

SEQ ID NO: 357646 - RNA, 32 nt, Human
caucuccacuaaaaauauaaaaauuagccagg

SEQ ID NO: 357647 - RNA, 32 nt, Human
caucuccacuaaaaguacaaaaauuagcuggg

SEQ ID NO: 357648 - RNA, 23 nt, Human
caucuccacucuccuucuccaga

SEQ ID NO: 357649 - RNA, 32 nt, Human
caucuccagaaguuuuccaucuucccaaauuc

SEQ ID NO: 357650 - RNA, 32 nt, Human
caucuccagcacugaggcaccucugacucaca

SEQ ID NO: 357651 - RNA, 32 nt, Human
caucuccagcuccagccugcuggggccugugc

SEQ ID NO: 357652 - RNA, 32 nt, Human
caucuccaggacagcaagagugaucccugccu

SEQ ID NO: 357653 - RNA, 32 nt, Human
caucuccaggaggcagguagagcaguucugac

SEQ ID NO: 357654 - RNA, 32 nt, Human
caucuccaggcacccccaaaaacagcaaauua

SEQ ID NO: 357655 - RNA, 32 nt, Human
caucuccaggccccaaauggucuccggucggu

SEQ ID NO: 357656 - RNA, 32 nt, Human
caucuccagggcuggaugccaugguaaggauc

SEQ ID NO: 357657 - RNA, 32 nt, Human
caucuccaggguggaaaacuuggagggccccu

SEQ ID NO: 357658 - RNA, 32 nt, Human
caucuccauaaggagccaucaggcugucauua

SEQ ID NO: 357659 - RNA, 32 nt, Human
caucuccaucauuacuggcuuaguuuugcuuu

SEQ ID NO: 357660 - RNA, 32 nt, Human
caucuccauccuccucaagcugccugugcacc

SEQ ID NO: 357661 - RNA, 32 nt, Human
caucuccauggagcuccugcuggagggcccug

SEQ ID NO: 357662 - RNA, 32 nt, Human
caucuccauuagggcugaaaagaaugaccuac

SEQ ID NO: 357663 - RNA, 32 nt, Human
caucuccauuuucugaccucuggacuaacugg

SEQ ID NO: 357664 - RNA, 32 nt, Human
caucucccaaagugcugggaugacaggcguga

SEQ ID NO: 357665 - RNA, 32 nt, Human
caucucccaaagugcugggauuacaggcguga

SEQ ID NO: 357666 - RNA, 32 nt, Human
caucucccaaguggccacauacagcaacccac

SEQ ID NO: 357667 - RNA, 32 nt, Human
caucucccaaguuggauggcagcacgaucugg

SEQ ID NO: 357668 - RNA, 32 nt, Human
caucucccaauggaggggagguugcaggggag

SEQ ID NO: 357669 - RNA, 22 nt, Human
caucucccagcccaccagcccu

SEQ ID NO: 357670 - RNA, 32 nt, Human
caucucccaggaaauguccuucucuggcgucu

SEQ ID NO: 357671 - RNA, 32 nt, Human
caucucccaggccccaggggagaaagaggagu

SEQ ID NO: 357672 - RNA, 32 nt, Human
caucucccaucaccaccucuaggacucggggg

SEQ ID NO: 357673 - RNA, 32 nt, Human
caucuccccuuuccucuccacgucccgccccc

SEQ ID NO: 357674 - RNA, 32 nt, Human
caucucccgcuucccuuccauuuccuuucuag

SEQ ID NO: 357675 - RNA, 26 nt, Human
caucucccucuccuugcuggcuccau

SEQ ID NO: 357676 - RNA, 32 nt, Human
caucucccucuucuccccuccuuucacaccga

SEQ ID NO: 357677 - RNA, 32 nt, Human
caucucccugcaaccuccgccuccuggguuga

SEQ ID NO: 357678 - RNA, 32 nt, Human
caucucccugcucgucugccuuugaucugcau

SEQ ID NO: 357679 - RNA, 21 nt, Human
caucucccuguggacuuggga

SEQ ID NO: 357680 - RNA, 32 nt, Human
caucucccuugacugcagagcagguuccucca

SEQ ID NO: 357681 - RNA, 32 nt, Human
caucuccgcgagacagagggauaaagugaaga

SEQ ID NO: 357682 - RNA, 32 nt, Human
caucuccgcuaaaaaugcaaaaauuagccagg

SEQ ID NO: 357683 - RNA, 32 nt, Human
caucuccguguuucucuuuguggggcucaaaa

SEQ ID NO: 357684 - RNA, 32 nt, Human
caucuccuacagcccccugccugauccccugc

SEQ ID NO: 357685 - RNA, 32 nt, Human
caucuccuagauggacuuccugguuuucucuu

SEQ ID NO: 357686 - RNA, 32 nt, Human
caucuccuagcuauuucuuuugcccagcaggg

SEQ ID NO: 357687 - RNA, 32 nt, Human
caucuccucacuuuucagacugaggccuuuuu

SEQ ID NO: 357688 - RNA, 21 nt, Human
caucuccuccaaccagcaucu

SEQ ID NO: 357689 - RNA, 32 nt, Human
caucuccuccacuuggaugaugcucuagccuc

SEQ ID NO: 357690 - RNA, 32 nt, Human
caucuccuccuccuucuucugcucccgauucu

SEQ ID NO: 357691 - RNA, 23 nt, Human
caucuccuccugagucccagggc

SEQ ID NO: 357692 - RNA, 32 nt, Human
caucuccucgccugcucccugccuccuuuuca

SEQ ID NO: 357693 - RNA, 32 nt, Human
caucuccucgucuugacuguuuucccuacuug

SEQ ID NO: 357694 - RNA, 20 nt, Human
caucuccugagggaucccag

SEQ ID NO: 357695 - RNA, 32 nt, Human
caucuccugaugcugauuuuugaucuuuuguu

SEQ ID NO: 357696 - RNA, 32 nt, Human
caucuccugcauggcauggcuuagcacaccug

SEQ ID NO: 357697 - RNA, 23 nt, Human
caucuccugccuuccuccugggc

SEQ ID NO: 357698 - RNA, 32 nt, Human
caucuccuggaagggaugcuuuuuagcugagc

SEQ ID NO: 357699 - RNA, 22 nt, Human
caucuccuggacccuccagggc

SEQ ID NO: 357700 - RNA, 32 nt, Human
caucuccuugacuuuccagucaugccuccuaa

SEQ ID NO: 357701 - RNA, 21 nt, Human
caucuccuugcagcuguugga

SEQ ID NO: 357702 - RNA, 19 nt, Human
caucuccuuuuccaucuua

SEQ ID NO: 357703 - RNA, 32 nt, Human
caucucgaaaucugaacccaugguugugaucc

SEQ ID NO: 357704 - RNA, 25 nt, Human
caucucgaguagcugggauuacagg

SEQ ID NO: 357705 - RNA, 32 nt, Human
caucucgaguagcugggauuacaggcaugcac

SEQ ID NO: 357706 - RNA, 32 nt, Human
caucucgcccacccuggagagugcagagcuau

SEQ ID NO: 357707 - RNA, 32 nt, Human
caucucgcccaggagccggagcagcggcacug

SEQ ID NO: 357708 - RNA, 32 nt, Human
caucucgcggauggggucugcagccgccaauc

SEQ ID NO: 357709 - RNA, 32 nt, Human
caucucggagcaucccggaggaaaucugcaga

SEQ ID NO: 357710 - RNA, 32 nt, Human
caucucggcagagcugaacuguggcagaggug

SEQ ID NO: 357711 - RNA, 21 nt, Human
caucucggcaggaucuccugg

SEQ ID NO: 357712 - RNA, 32 nt, Human
caucucggcucacugcaaccuccgccucccag

SEQ ID NO: 357713 - RNA, 32 nt, Human
caucucggcucauuguaaccuccgucucccag

SEQ ID NO: 357714 - RNA, 32 nt, Human
caucucgggguguguuuuggaggcaggcggga

SEQ ID NO: 357715 - RNA, 21 nt, Human
caucucggucuccugaguagc

SEQ ID NO: 357716 - RNA, 16 nt, Human
caucucggucuucagc

SEQ ID NO: 357717 - RNA, 32 nt, Human
caucucggucuucagcucacaccagccuugag

SEQ ID NO: 357718 - RNA, 32 nt, Human
caucucguguugugugcacugugauauaaugg

SEQ ID NO: 357719 - RNA, 32 nt, Human
caucucguucacagcacccacccucuuaccug

SEQ ID NO: 357720 - RNA, 32 nt, Human
caucucuaauaaaaauacaaaacuuagcuggg

SEQ ID NO: 357721 - RNA, 32 nt, Human
caucucuacaaaaagcauaaaaauuagccaag

SEQ ID NO: 357722 - RNA, 32 nt, Human
caucucuacaaaaaguacaaaaauuagccggg

SEQ ID NO: 357723 - RNA, 32 nt, Human
caucucuacaaaauauacaaaaauuagccagg

SEQ ID NO: 357724 - RNA, 32 nt, Human
caucucuacaaaauauacaaaauauuagccag

SEQ ID NO: 357725 - RNA, 32 nt, Human
caucucuacagaaacuaccaaaauuagccagg

SEQ ID NO: 357726 - RNA, 32 nt, Human
caucucuaccaaaaauacaaaaauuaaccaug

SEQ ID NO: 357727 - RNA, 32 nt, Human
caucucuaccaaaaauacaaaaauuagccaga

SEQ ID NO: 357728 - RNA, 32 nt, Human
caucucuaccaaaaauacaaaaauuagcuggg

SEQ ID NO: 357729 - RNA, 32 nt, Human
caucucuaccaaaaauacaaaaauucaccagg

SEQ ID NO: 357730 - RNA, 32 nt, Human
caucucuaccucugacacagacugccugccuu

SEQ ID NO: 357731 - RNA, 32 nt, Human
caucucuacgaaaaauacaaaaauuaacuggg

SEQ ID NO: 357732 - RNA, 32 nt, Human
caucucuacgaaaaauacaaaaauuagccaag

SEQ ID NO: 357733 - RNA, 32 nt, Human
caucucuacgaaaaauacaaaaauuagcuggg

SEQ ID NO: 357734 - RNA, 32 nt, Human
caucucuacgaaaaauacaaaauuagccagau

SEQ ID NO: 357735 - RNA, 32 nt, Human
caucucuacgaaaaauacaaaauuuagccggg

SEQ ID NO: 357736 - RNA, 32 nt, Human
caucucuacgaaaauuacaaaaauuagcuggc

SEQ ID NO: 357737 - RNA, 32 nt, Human
caucucuacuaaaaacacaaaaauuagcuagg

SEQ ID NO: 357738 - RNA, 32 nt, Human
caucucuacuaaaaacacaaauuagccaggcg

SEQ ID NO: 357739 - RNA, 32 nt, Human
caucucuacuaaaaacgcaaaauuagccgggc

SEQ ID NO: 357740 - RNA, 32 nt, Human
caucucuacuaaaaaguacaaaaauuagcugg

SEQ ID NO: 357741 - RNA, 32 nt, Human
caucucuacuaaaaauaaaauuagccaggcgu

SEQ ID NO: 357742 - RNA, 32 nt, Human
caucucuacuaaaaauaaaauuagccaugcgu

SEQ ID NO: 357743 - RNA, 23 nt, Human
caucucuacuaaaaauacaaaaa

SEQ ID NO: 357744 - RNA, 32 nt, Human
caucucuacuaaaaauacaaaaacuagccagg

SEQ ID NO: 357745 - RNA, 32 nt, Human
caucucuacuaaaaauacaaaaacuagcgggc

SEQ ID NO: 357746 - RNA, 32 nt, Human
caucucuacuaaaaauacaaaaaguuagcugg

SEQ ID NO: 357747 - RNA, 32 nt, Human
caucucuacuaaaaauacaaaaaucagccggg

SEQ ID NO: 357748 - RNA, 32 nt, Human
caucucuacuaaaaauacaaaaaugagcuagg

SEQ ID NO: 357749 - RNA, 32 nt, Human
caucucuacuaaaaauacaaaaaugagcuggg

SEQ ID NO: 357750 - RNA, 32 nt, Human
caucucuacuaaaaauacaaaaauuaacagca

SEQ ID NO: 357751 - RNA, 32 nt, Human
caucucuacuaaaaauacaaaaauuaaccagg

SEQ ID NO: 357752 - RNA, 32 nt, Human
caucucuacuaaaaauacaaaaauuaacuggg

SEQ ID NO: 357753 - RNA, 32 nt, Human
caucucuacuaaaaauacaaaaauuaccuggg

SEQ ID NO: 357754 - RNA, 32 nt, Human
caucucuacuaaaaauacaaaaauuagcaggg

SEQ ID NO: 357755 - RNA, 32 nt, Human
caucucuacuaaaaauacaaaaauuagccaag

SEQ ID NO: 357756 - RNA, 32 nt, Human
caucucuacuaaaaauacaaaaauuagccagg

SEQ ID NO: 357757 - RNA, 32 nt, Human
caucucuacuaaaaauacaaaaauuagccaug

SEQ ID NO: 357758 - RNA, 32 nt, Human
caucucuacuaaaaauacaaaaauuagccgga

SEQ ID NO: 357759 - RNA, 32 nt, Human
caucucuacuaaaaauacaaaaauuagccggg

SEQ ID NO: 357760 - RNA, 32 nt, Human
caucucuacuaaaaauacaaaaauuagccggu

SEQ ID NO: 357761 - RNA, 32 nt, Human
caucucuacuaaaaauacaaaaauuagccgug

SEQ ID NO: 357762 - RNA, 32 nt, Human
caucucuacuaaaaauacaaaaauuagcuagg

SEQ ID NO: 357763 - RNA, 32 nt, Human
caucucuacuaaaaauacaaaaauuagcugag

SEQ ID NO: 357764 - RNA, 32 nt, Human
caucucuacuaaaaauacaaaaauuagcugga

SEQ ID NO: 357765 - RNA, 32 nt, Human
caucucuacuaaaaauacaaaaauuagcuggg

SEQ ID NO: 357766 - RNA, 32 nt, Human
caucucuacuaaaaauacaaaaauuagcugug

SEQ ID NO: 357767 - RNA, 32 nt, Human
caucucuacuaaaaauacaaaaauuagcuugg

SEQ ID NO: 357768 - RNA, 32 nt, Human
caucucuacuaaaaauacaaaaauuaggcaug

SEQ ID NO: 357769 - RNA, 32 nt, Human
caucucuacuaaaaauacaaaaauuaggccag

SEQ ID NO: 357770 - RNA, 32 nt, Human
caucucuacuaaaaauacaaaaauuaggccgg

SEQ ID NO: 357771 - RNA, 32 nt, Human
caucucuacuaaaaauacaaaaauuaguuggg

SEQ ID NO: 357772 - RNA, 32 nt, Human
caucucuacuaaaaauacaaaaauuaucuggg

SEQ ID NO: 357773 - RNA, 32 nt, Human
caucucuacuaaaaauacaaaaauucaccagg

SEQ ID NO: 357774 - RNA, 32 nt, Human
caucucuacuaaaaauacaaaaauuggcuggg

SEQ ID NO: 357775 - RNA, 32 nt, Human
caucucuacuaaaaauacaaaaauuugcuggg

SEQ ID NO: 357776 - RNA, 32 nt, Human
caucucuacuaaaaauacaaaacauuagccgg

SEQ ID NO: 357777 - RNA, 32 nt, Human
caucucuacuaaaaauacaaaacuagccaggc

SEQ ID NO: 357778 - RNA, 32 nt, Human
caucucuacuaaaaauacaaaacuagccgggu

SEQ ID NO: 357779 - RNA, 32 nt, Human
caucucuacuaaaaauacaaaacuuagccagg

SEQ ID NO: 357780 - RNA, 32 nt, Human
caucucuacuaaaaauacaaaaguuagcuggg

SEQ ID NO: 357781 - RNA, 32 nt, Human
caucucuacuaaaaauacaaaauccaggcgug

SEQ ID NO: 357782 - RNA, 32 nt, Human
caucucuacuaaaaauacaaaauuaccugggc

SEQ ID NO: 357783 - RNA, 32 nt, Human
caucucuacuaaaaauacaaaauuagcagggc

SEQ ID NO: 357784 - RNA, 32 nt, Human
caucucuacuaaaaauacaaaauuagccaggc

SEQ ID NO: 357785 - RNA, 32 nt, Human
caucucuacuaaaaauacaaaauuagccaggu

SEQ ID NO: 357786 - RNA, 32 nt, Human
caucucuacuaaaaauacaaaauuagccgggc

SEQ ID NO: 357787 - RNA, 32 nt, Human
caucucuacuaaaaauacaaaauuagccgggu

SEQ ID NO: 357788 - RNA, 32 nt, Human
caucucuacuaaaaauacaaaauuagccucgc

SEQ ID NO: 357789 - RNA, 32 nt, Human
caucucuacuaaaaauacaaaauuagcugggc

SEQ ID NO: 357790 - RNA, 32 nt, Human
caucucuacuaaaaauacaaaauuagcugggu

SEQ ID NO: 357791 - RNA, 32 nt, Human
caucucuacuaaaaauacaaaauuggccgggc

SEQ ID NO: 357792 - RNA, 32 nt, Human
caucucuacuaaaaauacaaacaauuaacuga

SEQ ID NO: 357793 - RNA, 32 nt, Human
caucucuacuaaaaauacaaacauuagccagg

SEQ ID NO: 357794 - RNA, 32 nt, Human
caucucuacuaaaaauacaaacuuggcugggc

SEQ ID NO: 357795 - RNA, 32 nt, Human
caucucuacuaaaaauacaaaguuaaccgggu

SEQ ID NO: 357796 - RNA, 32 nt, Human
caucucuacuaaaaauacaaauauuagcugga

SEQ ID NO: 357797 - RNA, 32 nt, Human
caucucuacuaaaaauacaacaaaguuagccg

SEQ ID NO: 357798 - RNA, 32 nt, Human
caucucuacuaaaaauacaagaauuagcuggg

SEQ ID NO: 357799 - RNA, 32 nt, Human
caucucuacuaaaaauacaaggauuagcuggg

SEQ ID NO: 357800 - RNA, 32 nt, Human
caucucuacuaaaaauacaauaaauuagcugg

SEQ ID NO: 357801 - RNA, 32 nt, Human
caucucuacuaaaaauacaauaauuagcuggg

SEQ ID NO: 357802 - RNA, 32 nt, Human
caucucuacuaaaaauacaauauuagccgggc

SEQ ID NO: 357803 - RNA, 32 nt, Human
caucucuacuaaaaauacacaaaauuagcugg

SEQ ID NO: 357804 - RNA, 32 nt, Human
caucucuacuaaaaauacacaaauuagcuagg

SEQ ID NO: 357805 - RNA, 32 nt, Human
caucucuacuaaaaauacagaaauuagccggg

SEQ ID NO: 357806 - RNA, 32 nt, Human
caucucuacuaaaaauacagaaauuagccggu

SEQ ID NO: 357807 - RNA, 32 nt, Human
caucucuacuaaaaauacagaaauuagcuggg

SEQ ID NO: 357808 - RNA, 32 nt, Human
caucucuacuaaaaauacagaaauuauccagg

SEQ ID NO: 357809 - RNA, 32 nt, Human
caucucuacuaaaaauacagaaauucacaggg

SEQ ID NO: 357810 - RNA, 32 nt, Human
caucucuacuaaaaauacagcaaauuagcugg

SEQ ID NO: 357811 - RNA, 32 nt, Human
caucucuacuaaaaauaccaaaaauuagccga

SEQ ID NO: 357812 - RNA, 32 nt, Human
caucucuacuaaaaauaccaaaaugagccagg

SEQ ID NO: 357813 - RNA, 32 nt, Human
caucucuacuaaaaauaccaaaauuagccagg

SEQ ID NO: 357814 - RNA, 32 nt, Human
caucucuacuaaaaauaccaaaauuagccggg

SEQ ID NO: 357815 - RNA, 32 nt, Human
caucucuacuaaaaauaccaaauuagccaggc

SEQ ID NO: 357816 - RNA, 32 nt, Human
caucucuacuaaaaauacgaaaauuagcuggg

SEQ ID NO: 357817 - RNA, 32 nt, Human
caucucuacuaaaaauacgaaacauuagccag

SEQ ID NO: 357818 - RNA, 32 nt, Human
caucucuacuaaaaauacgaaacuagccgggc

SEQ ID NO: 357819 - RNA, 32 nt, Human
caucucuacuaaaaauacgaaacuaggccggg

SEQ ID NO: 357820 - RNA, 32 nt, Human
caucucuacuaaaaauacgaaauuagccaggu

SEQ ID NO: 357821 - RNA, 32 nt, Human
caucucuacuaaaaauagaaaaaucagcuggg

SEQ ID NO: 357822 - RNA, 32 nt, Human
caucucuacuaaaaauagaaaaauuagccagg

SEQ ID NO: 357823 - RNA, 32 nt, Human
caucucuacuaaaaauagaaaaauuagcuggg

SEQ ID NO: 357824 - RNA, 32 nt, Human
caucucuacuaaaaauagaaaaauuggcuaga

SEQ ID NO: 357825 - RNA, 32 nt, Human
caucucuacuaaaaauagaaacaaauuuagcc

SEQ ID NO: 357826 - RNA, 32 nt, Human
caucucuacuaaaaauagaaaccuuagccagg

SEQ ID NO: 357827 - RNA, 32 nt, Human
caucucuacuaaaaauauaaaaaguagccagg

SEQ ID NO: 357828 - RNA, 32 nt, Human
caucucuacuaaaaauauaaaaaucagccggg

SEQ ID NO: 357829 - RNA, 32 nt, Human
caucucuacuaaaaauauaaaaauuagccagg

SEQ ID NO: 357830 - RNA, 32 nt, Human
caucucuacuaaaaauauaaaaauuagccggg

SEQ ID NO: 357831 - RNA, 32 nt, Human
caucucuacuaaaaauauaaaauuagccaggc

SEQ ID NO: 357832 - RNA, 32 nt, Human
caucucuacuaaaaauaucaaaauuagcuggg

SEQ ID NO: 357833 - RNA, 32 nt, Human
caucucuacuaaaaauaugaaaaucagcuggg

SEQ ID NO: 357834 - RNA, 32 nt, Human
caucucuacuaaaaaugcaaaaaguuagccag

SEQ ID NO: 357835 - RNA, 32 nt, Human
caucucuacuaaaaaugcaaaaauuagccggg

SEQ ID NO: 357836 - RNA, 32 nt, Human
caucucuacuaaaaaugcaaacauuagcuggg

SEQ ID NO: 357837 - RNA, 32 nt, Human
caucucuacuaaaaaugcggaagaguuagcca

SEQ ID NO: 357838 - RNA, 32 nt, Human
caucucuacuaaaacaaaaauuagccaggcau

SEQ ID NO: 357839 - RNA, 32 nt, Human
caucucuacuaaaacauacaaaaauuagccgg

SEQ ID NO: 357840 - RNA, 32 nt, Human
caucucuacuaaaacuacaaaacuuagccggg

SEQ ID NO: 357841 - RNA, 32 nt, Human
caucucuacuaaaaguacaaaaauuagccagg

SEQ ID NO: 357842 - RNA, 32 nt, Human
caucucuacuaaaaguacaaaaauuagcuggg

SEQ ID NO: 357843 - RNA, 32 nt, Human
caucucuacuaaaaguacaaauauuagccgac

SEQ ID NO: 357844 - RNA, 32 nt, Human
caucucuacuaaaauacaaaaaguuagcuggg

SEQ ID NO: 357845 - RNA, 32 nt, Human
caucucuacuaaaauacaaaaauuagccgggc

SEQ ID NO: 357846 - RNA, 32 nt, Human
caucucuacuaaaauacaaaaauuagcugggu

SEQ ID NO: 357847 - RNA, 32 nt, Human
caucucuacuaaaauacaaaauuagccaggcg

SEQ ID NO: 357848 - RNA, 32 nt, Human
caucucuacuaaaauauaaaaauuagccgggu

SEQ ID NO: 357849 - RNA, 32 nt, Human
caucucuacuaaaauuacaaaaauuagccggg

SEQ ID NO: 357850 - RNA, 32 nt, Human
caucucuacuaaacauacaaaauuagcugggc

SEQ ID NO: 357851 - RNA, 32 nt, Human
caucucuacuaaacaugcaaaaauuaccuggg

SEQ ID NO: 357852 - RNA, 32 nt, Human
caucucuacuaaagauacaaaaagauuagcug

SEQ ID NO: 357853 - RNA, 32 nt, Human
caucucuacuaaagauacaaaaauuugcugag

SEQ ID NO: 357854 - RNA, 32 nt, Human
caucucuacuaaagauauaaaaauuagccggg

SEQ ID NO: 357855 - RNA, 32 nt, Human
caucucuacuaaagaugcaaggauuggccggg

SEQ ID NO: 357856 - RNA, 32 nt, Human
caucucuacuaaauacaaaaauuagcugggcg

SEQ ID NO: 357857 - RNA, 32 nt, Human
caucucuacuaaauacagaaaauuagccaggc

SEQ ID NO: 357858 - RNA, 32 nt, Human
caucucuacuaagaauacaaaaauuagccggg

SEQ ID NO: 357859 - RNA, 32 nt, Human
caucucuacuaauaauacaaaaauuagccagg

SEQ ID NO: 357860 - RNA, 32 nt, Human
caucucuacuagaaauacaaaacaauuagcug

SEQ ID NO: 357861 - RNA, 32 nt, Human
caucucuacuauaaauacaaaaauuagccagg

SEQ ID NO: 357862 - RNA, 32 nt, Human
caucucuacugaaaauacaaaaaguuagccgg

SEQ ID NO: 357863 - RNA, 32 nt, Human
caucucuacugaaaauacaaaaauuagccagg

SEQ ID NO: 357864 - RNA, 32 nt, Human
caucucuacugaaaauacaaaaauuagcuggg

SEQ ID NO: 357865 - RNA, 32 nt, Human
caucucuacugaaaauacaaaaauuaggcaua

SEQ ID NO: 357866 - RNA, 32 nt, Human
caucucuacugaaaauacagaauuagccaggc

SEQ ID NO: 357867 - RNA, 32 nt, Human
caucucuacugaaaauacagaauuggccgggu

SEQ ID NO: 357868 - RNA, 32 nt, Human
caucucuacugaaaguacaaaaauuagcuggg

SEQ ID NO: 357869 - RNA, 32 nt, Human
caucucuacuucucugaggacaauuaggguau

SEQ ID NO: 357870 - RNA, 32 nt, Human
caucucuaggaccggaacuaccuucucuucug

SEQ ID NO: 357871 - RNA, 32 nt, Human
caucucuaggguagccaugcagaggagggcuu

SEQ ID NO: 357872 - RNA, 32 nt, Human
caucucuaguaaaaauacaaaaauuagcucag

SEQ ID NO: 357873 - RNA, 32 nt, Human
caucucuaguaaaaauacaaaaauuagcuggg

SEQ ID NO: 357874 - RNA, 32 nt, Human
caucucuauuaaaaauacaaaaauuagccagg

SEQ ID NO: 357875 - RNA, 32 nt, Human
caucucuauuaaaaauacaaaaauuagccgga

SEQ ID NO: 357876 - RNA, 32 nt, Human
caucucuauuaaaaauacaaaaauuagccggg

SEQ ID NO: 357877 - RNA, 32 nt, Human
caucucuauuaaaaauacaaaaauuagcuggg

SEQ ID NO: 357878 - RNA, 32 nt, Human
caucucuauuaaaaauuaaacagccaauuagu

SEQ ID NO: 357879 - RNA, 32 nt, Human
caucucuauuaaaaauuuuacaaaaauuagcu

SEQ ID NO: 357880 - RNA, 32 nt, Human
caucucuauuaaagauacaaaauuagccaggc

SEQ ID NO: 357881 - RNA, 32 nt, Human
caucucucagaguguugggauuacagccauga

SEQ ID NO: 357882 - RNA, 32 nt, Human
caucucucagggcccacccaggaaaauggauu

SEQ ID NO: 357883 - RNA, 32 nt, Human
caucucucauaggugcaaccugagaguggggg

SEQ ID NO: 357884 - RNA, 32 nt, Human
caucucuccaccuuguuuuucuucuauucuug

SEQ ID NO: 357885 - RNA, 32 nt, Human
caucucuccagccagccacugccuucuuugua

SEQ ID NO: 357886 - RNA, 32 nt, Human
caucucuccagcccaggccccugggcaucuca

SEQ ID NO: 357887 - RNA, 32 nt, Human
caucucuccaucuacaaaguugcaguauuaug

SEQ ID NO: 357888 - RNA, 32 nt, Human
caucucuccauucgugagcuccuugaaggcag

SEQ ID NO: 357889 - RNA, 32 nt, Human
caucucucccacaggacacuccuugcgaccuc

SEQ ID NO: 357890 - RNA, 32 nt, Human
caucucuccccucccuaugccuugcaggucgc

SEQ ID NO: 357891 - RNA, 32 nt, Human
caucucucccgaaaauacaaaauuagccaggc

SEQ ID NO: 357892 - RNA, 28 nt, Human
caucucucccuuccugccucauuucauc

SEQ ID NO: 357893 - RNA, 32 nt, Human
caucucucuccauaucaaucuggaccaucucu

SEQ ID NO: 357894 - RNA, 32 nt, Human
caucucucucuuugccucauagauuuagcuau

SEQ ID NO: 357895 - RNA, 32 nt, Human
caucucucugcagugcccuccucgccugugca

SEQ ID NO: 357896 - RNA, 23 nt, Human
caucucucuuaagccaggcaccu

SEQ ID NO: 357897 - RNA, 32 nt, Human
caucucucuuccagagagaggcagcauuggcc

SEQ ID NO: 357898 - RNA, 32 nt, Human
caucucugauccucuaaucugccucugaaccc

SEQ ID NO: 357899 - RNA, 32 nt, Human
caucucugcaacuccuuccucccugggccucc

SEQ ID NO: 357900 - RNA, 32 nt, Human
caucucugcacccacaggcucaacaucacaug

SEQ ID NO: 357901 - RNA, 32 nt, Human
caucucugcaccuuccaggcucugaacuuuga

SEQ ID NO: 357902 - RNA, 32 nt, Human
caucucugccaaaaauacaaaaguuagccggg

SEQ ID NO: 357903 - RNA, 32 nt, Human
caucucugccugccuucccucuugccuggaaa

SEQ ID NO: 357904 - RNA, 32 nt, Human
caucucugcuaaaaauacaaaaacuagccagg

SEQ ID NO: 357905 - RNA, 32 nt, Human
caucucugcuaaaaauacaaaaauuagccggg

SEQ ID NO: 357906 - RNA, 32 nt, Human
caucucugcuaaaaauacaaaaauuagcuggg

SEQ ID NO: 357907 - RNA, 32 nt, Human
caucucugcuaaaaauaccaaaauuacccggg

SEQ ID NO: 357908 - RNA, 32 nt, Human
caucucugcucccuguggcaucuugcuguguc

SEQ ID NO: 357909 - RNA, 23 nt, Human
caucucugcuucuccccagagga

SEQ ID NO: 357910 - RNA, 32 nt, Human
caucucuggagugugugggggucugggaggca

SEQ ID NO: 357911 - RNA, 19 nt, Human
caucucugggcaagcggcg

SEQ ID NO: 357912 - RNA, 32 nt, Human
caucucugggcucagcaccugaggcggguuuc

SEQ ID NO: 357913 - RNA, 32 nt, Human
caucucugggcugucuggggcgguggagcaag

SEQ ID NO: 357914 - RNA, 20 nt, Human
caucucugguuuuaaguagc

SEQ ID NO: 357915 - RNA, 32 nt, Human
caucucuguacugucugcccucuugggggaug

SEQ ID NO: 357916 - RNA, 21 nt, Human
caucucuguuggucccaggga

SEQ ID NO: 357917 - RNA, 32 nt, Human
caucucuuaaagaaaaaguuagccagguguga

SEQ ID NO: 357918 - RNA, 32 nt, Human
caucucuuauagauuaacuuccuuccaaaaug

SEQ ID NO: 357919 - RNA, 32 nt, Human
caucucuucacugggcuccaccugcucacccg

SEQ ID NO: 357920 - RNA, 32 nt, Human
caucucuucauacuagcucacacuaugcauug

SEQ ID NO: 357921 - RNA, 32 nt, Human
caucucuucccuccaucuccuuguacccucug

SEQ ID NO: 357922 - RNA, 32 nt, Human
caucucuuccuauauuuggugggguggguggg

SEQ ID NO: 357923 - RNA, 32 nt, Human
caucucuucuaaaaauacaaaaauuacccagg

SEQ ID NO: 357924 - RNA, 32 nt, Human
caucucuucuaaaaauacaaaaauuagcuggu

SEQ ID NO: 357925 - RNA, 32 nt, Human
caucucuucuaaaaauacaaacauuagccggg

SEQ ID NO: 357926 - RNA, 32 nt, Human
caucucuucucaugaaggcuacacucaaauua

SEQ ID NO: 357927 - RNA, 32 nt, Human
caucucuugaagccaaacuccaccuucugugc

SEQ ID NO: 357928 - RNA, 32 nt, Human
caucucuuggugguaccaucagaaaugucuuc

SEQ ID NO: 357929 - RNA, 32 nt, Human
caucucuuguuccccucaucccugccaccagu

SEQ ID NO: 357930 - RNA, 32 nt, Human
caucucuuuaguucuuccuccugguuccucuu

SEQ ID NO: 357931 - RNA, 32 nt, Human
caucucuuucucaauggaucuaauguuuuaau

SEQ ID NO: 357932 - RNA, 32 nt, Human
caucucuuugcugcuacuguuuugccauccuu

SEQ ID NO: 357933 - RNA, 32 nt, Human
caucucuuuucccagcuccgcaccuuuguccg

SEQ ID NO: 357934 - RNA, 32 nt, Human
caucucuuuucccuucuuuccuccugguuccg

SEQ ID NO: 357935 - RNA, 32 nt, Human
caucugaacccaggagacagguugcagugagc

SEQ ID NO: 357936 - RNA, 32 nt, Human
caucugaacugaucccaggugaacgguuuauu

SEQ ID NO: 357937 - RNA, 32 nt, Human
caucugaaggggccauuucuccugguuacccu

SEQ ID NO: 357938 - RNA, 32 nt, Human
caucugaagucaagauuuccagccuuuugaau

SEQ ID NO: 357939 - RNA, 32 nt, Human
caucugacauagccuucuguguuuccaaagaa

SEQ ID NO: 357940 - RNA, 32 nt, Human
caucugaccaaagagguguggucgaggcuccu

SEQ ID NO: 357941 - RNA, 32 nt, Human
caucugaccaaaggacgaaugagggagacguu

SEQ ID NO: 357942 - RNA, 32 nt, Human
caucugaccaucugugacuauaaagcuguuau

SEQ ID NO: 357943 - RNA, 32 nt, Human
caucugaccuggcagcccauguauuccgguca

SEQ ID NO: 357944 - RNA, 32 nt, Human
caucugacugguuuccccauguccucccauuc

SEQ ID NO: 357945 - RNA, 24 nt, Human
caucugacuucaauauuugccaaa

SEQ ID NO: 357946 - RNA, 32 nt, Human
caucugagaccaccucauccuggacuucauua

SEQ ID NO: 357947 - RNA, 32 nt, Human
caucugagaccagccaguagucacagaacugc

SEQ ID NO: 357948 - RNA, 32 nt, Human
caucugagaugggguccuguuguuuauuauca

SEQ ID NO: 357949 - RNA, 32 nt, Human
caucugagccagauguugagggcugaguggga

SEQ ID NO: 357950 - RNA, 32 nt, Human
caucugagccucaggagguugaggcugcagug

SEQ ID NO: 357951 - RNA, 32 nt, Human
caucugaggaaagcuggagggaagagaaaccc

SEQ ID NO: 357952 - RNA, 32 nt, Human
caucugaggaacuggaauaaagaugaggggcc

SEQ ID NO: 357953 - RNA, 32 nt, Human
caucugaggaagcagaacagggacagacuuga

SEQ ID NO: 357954 - RNA, 32 nt, Human
caucugaggcccuucccaggaagacauggccu

SEQ ID NO: 357955 - RNA, 32 nt, Human
caucugagggguccuugaggccaguggaucug

SEQ ID NO: 357956 - RNA, 19 nt, Human
caucugaguccuugucaga

SEQ ID NO: 357957 - RNA, 32 nt, Human
caucugaguguuggguacaaagcugcuccgua

SEQ ID NO: 357958 - RNA, 32 nt, Human
caucugauagaauccccugaaagcaguagcca

SEQ ID NO: 357959 - RNA, 32 nt, Human
caucugauagaggcuuguaagagcagauugac

SEQ ID NO: 357960 - RNA, 32 nt, Human
caucugaucaagaauggagaaucucaguccua

SEQ ID NO: 357961 - RNA, 32 nt, Human
caucugaugccaccacggucccuccuucccuu

SEQ ID NO: 357962 - RNA, 32 nt, Human
caucugcaaaacuguuacaaaggugagcuuga

SEQ ID NO: 357963 - RNA, 21 nt, Human
caucugcaaacgcuuugccaa

SEQ ID NO: 357964 - RNA, 32 nt, Human
caucugcaacuugcacagcucagcaccaggag

SEQ ID NO: 357965 - RNA, 32 nt, Human
caucugcaauaaacgacagccucggcugccuc

SEQ ID NO: 357966 - RNA, 32 nt, Human
caucugcacaacacaaaccaaagcccccuuuc

SEQ ID NO: 357967 - RNA, 32 nt, Human
caucugcacacaccuccgagacaguccagugu

SEQ ID NO: 357968 - RNA, 32 nt, Human
caucugcacagucagcuagaacaagaauuccu

SEQ ID NO: 357969 - RNA, 19 nt, Human
caucugcacccccucccca

SEQ ID NO: 357970 - RNA, 22 nt, Human
caucugcaccugcacucccaaa

SEQ ID NO: 357971 - RNA, 25 nt, Human
caucugcaccugcccuuuuuucaua

SEQ ID NO: 357972 - RNA, 32 nt, Human
caucugcagccucugccuccagcccggcagcu

SEQ ID NO: 357973 - RNA, 32 nt, Human
caucugcaggaaagagaugcagcaugcuccuc

SEQ ID NO: 357974 - RNA, 25 nt, Human
caucugcauaugcguauuugccaaa

SEQ ID NO: 357975 - RNA, 32 nt, Human
caucugcauccagggcuggaggaccgauguac

SEQ ID NO: 357976 - RNA, 32 nt, Human
caucugcaugucuacucagcauuugauuaaca

SEQ ID NO: 357977 - RNA, 32 nt, Human
caucugccagccugaacaugaacacaggcaaa

SEQ ID NO: 357978 - RNA, 32 nt, Human
caucugccaucuuucaugaguguuucccaugg

SEQ ID NO: 357979 - RNA, 32 nt, Human
caucugccaugcuggcaucucuauaagggcuc

SEQ ID NO: 357980 - RNA, 24 nt, Human
caucugccauuuuccucauuuaaa

SEQ ID NO: 357981 - RNA, 32 nt, Human
caucugcccacaccugucccccuuccccaacc

SEQ ID NO: 357982 - RNA, 32 nt, Human
caucugcccagccucugaguuuucuguucuau

SEQ ID NO: 357983 - RNA, 32 nt, Human
caucugcccaggggugcccccuccucucccau

SEQ ID NO: 357984 - RNA, 32 nt, Human
caucugccccaccauccauccuggugaaacca

SEQ ID NO: 357985 - RNA, 32 nt, Human
caucugccccacccugggccacugccugcucc

SEQ ID NO: 357986 - RNA, 32 nt, Human
caucugccccggaagagaccaaguaccaaacu

SEQ ID NO: 357987 - RNA, 32 nt, Human
caucugcccuccccaaacaucucccucccuac

SEQ ID NO: 357988 - RNA, 32 nt, Human
caucugcccugacugaauguguucugucacuc

SEQ ID NO: 357989 - RNA, 30 nt, Human
caucugcccuucuuguugcuccugucaugu

SEQ ID NO: 357990 - RNA, 32 nt, Human
caucugccucaguucugauuaacugguaauug

SEQ ID NO: 357991 - RNA, 32 nt, Human
caucugccuccaggaccauucaggcuguugac

SEQ ID NO: 357992 - RNA, 21 nt, Human
caucugccuccucuucucuaa

SEQ ID NO: 357993 - RNA, 32 nt, Human
caucugccucuuuucucuccccagccugcccu

SEQ ID NO: 357994 - RNA, 32 nt, Human
caucugccugcauugccaucuccuuggcuugu

SEQ ID NO: 357995 - RNA, 32 nt, Human
caucugccuggaagaccugggcuucucaggcu

SEQ ID NO: 357996 - RNA, 32 nt, Human
caucugccugggaguccuccugggccugccac

SEQ ID NO: 357997 - RNA, 32 nt, Human
caucugccugggaucaucaagcccuagaagcu

SEQ ID NO: 357998 - RNA, 32 nt, Human
caucugccuuaaauuuccucuguuuuucacau

SEQ ID NO: 357999 - RNA, 32 nt, Human
caucugccuugcccccagcaguacaguccuuc

SEQ ID NO: 358000 - RNA, 32 nt, Human
caucugccuuucuggacuuucugcuaugaacu

SEQ ID NO: 358001 - RNA, 32 nt, Human
caucugccuuucuuucccccagcccccacccg

SEQ ID NO: 358002 - RNA, 32 nt, Human
caucugcuaagugaucauuuucugccauacca

SEQ ID NO: 358003 - RNA, 32 nt, Human
caucugcuacauauauaaauagacuugcaguu

SEQ ID NO: 358004 - RNA, 32 nt, Human
caucugcucacugcccgcauucuccuggcaga

SEQ ID NO: 358005 - RNA, 32 nt, Human
caucugcuccuuuccuccccugccucaucagc

SEQ ID NO: 358006 - RNA, 21 nt, Human
caucugcucucuggccaacgg

SEQ ID NO: 358007 - RNA, 32 nt, Human
caucugcucugcagggucccucaggcucccua

SEQ ID NO: 358008 - RNA, 32 nt, Human
caucugcugcccauggaugcucuggcugagcu

SEQ ID NO: 358009 - RNA, 32 nt, Human
caucugcugcucccuuuuccacuuuucuaugu

SEQ ID NO: 358010 - RNA, 32 nt, Human
caucugcugcuggccucggugggcucugacug

SEQ ID NO: 358011 - RNA, 32 nt, Human
caucugcuggcacuccagccgcgugcaggugu

SEQ ID NO: 358012 - RNA, 32 nt, Human
caucugcuggguauccaauccuucccuuaucu

SEQ ID NO: 358013 - RNA, 32 nt, Human
caucugcuguauccucucccauggagacaaag

SEQ ID NO: 358014 - RNA, 32 nt, Human
caucugcuuccagaugagccagugccucgcau

SEQ ID NO: 358015 - RNA, 32 nt, Human
caucugcuugggaggcugagguugcaggaucg

SEQ ID NO: 358016 - RNA, 32 nt, Human
caucugcuuuggggaccuagaccucagguggu

SEQ ID NO: 358017 - RNA, 32 nt, Human
caucuggaagugaggguaggagcuggguugga

SEQ ID NO: 358018 - RNA, 32 nt, Human
caucuggacaaaugccaccacagcaggugggg

SEQ ID NO: 358019 - RNA, 32 nt, Human
caucuggacuuagaugggagggcauagcagau

SEQ ID NO: 358020 - RNA, 32 nt, Human
caucuggagagggagagggccuggguaggagc

SEQ ID NO: 358021 - RNA, 32 nt, Human
caucuggagcacggcuggccacggucagcccu

SEQ ID NO: 358022 - RNA, 32 nt, Human
caucuggaggagagagucggagagcagaaacc

SEQ ID NO: 358023 - RNA, 32 nt, Human
caucuggaggccugaguaaggaguggcucagc

SEQ ID NO: 358024 - RNA, 32 nt, Human
caucuggaggcuggagcagggucacccacgga

SEQ ID NO: 358025 - RNA, 32 nt, Human
caucuggaggguccaugagauggggcccucac

SEQ ID NO: 358026 - RNA, 32 nt, Human
caucuggaguagcugggacuacaggucagucc

SEQ ID NO: 358027 - RNA, 32 nt, Human
caucuggauaucaagguggaaauggcccauuu

SEQ ID NO: 358028 - RNA, 32 nt, Human
caucuggauaucuugaugcacugccuguuugu

SEQ ID NO: 358029 - RNA, 32 nt, Human
caucuggauggaggcagcaugcgccugggcug

SEQ ID NO: 358030 - RNA, 32 nt, Human
caucuggauuuucucagaugugagaagcuggu

SEQ ID NO: 358031 - RNA, 31 nt, Human
caucuggcacaauaaacauucucuguuuugu

SEQ ID NO: 358032 - RNA, 32 nt, Human
caucuggcagaagaaauuucuaagcagcaaag

SEQ ID NO: 358033 - RNA, 32 nt, Human
caucuggcagcacauugagaucggcuaugucc

SEQ ID NO: 358034 - RNA, 32 nt, Human
caucuggcaggcagcaagaccagcgccugcca

SEQ ID NO: 358035 - RNA, 32 nt, Human
caucuggcaggugcccuugaugcuauagcgcc

SEQ ID NO: 358036 - RNA, 32 nt, Human
caucuggcagugagacugaggaugaggacagc

SEQ ID NO: 358037 - RNA, 32 nt, Human
caucuggccccuggcccaucucuucugugccu

SEQ ID NO: 358038 - RNA, 32 nt, Human
caucuggccuggcugggaggcuugggggcagg

SEQ ID NO: 358039 - RNA, 32 nt, Human
caucuggccuucauccuucucccuuuauuguc

SEQ ID NO: 358040 - RNA, 32 nt, Human
caucuggcggacuccucuuccucucucuucuc

SEQ ID NO: 358041 - RNA, 32 nt, Human
caucugggaaaaggaaggaaauugcaggaggc

SEQ ID NO: 358042 - RNA, 32 nt, Human
caucugggaaggcacagcuggcugcagggaac

SEQ ID NO: 358043 - RNA, 32 nt, Human
caucugggaggaauucaccccagaggaaggga

SEQ ID NO: 358044 - RNA, 32 nt, Human
caucugggcauuguaggggugcagugguaugu

SEQ ID NO: 358045 - RNA, 32 nt, Human
caucugggccuuuguaugagcugcauugcccu

SEQ ID NO: 358046 - RNA, 32 nt, Human
caucugggcgccgggacgcugcagugaucccc

SEQ ID NO: 358047 - RNA, 32 nt, Human
caucugggcugugaugggcagcucccacucuu

SEQ ID NO: 358048 - RNA, 32 nt, Human
caucugggcuucagauccugacucccuucugu

SEQ ID NO: 358049 - RNA, 32 nt, Human
caucugggcuucucuuccccagcuuuuugccu

SEQ ID NO: 358050 - RNA, 32 nt, Human
caucugguagggagggagguauaguuggggga

SEQ ID NO: 358051 - RNA, 22 nt, Human
caucuggugacccuggcaggga

SEQ ID NO: 358052 - RNA, 32 nt, Human
caucuggugugggcgcacucuacagugacuuc

SEQ ID NO: 358053 - RNA, 32 nt, Human
caucugguugguggaaaacuaggugaagugcu

SEQ ID NO: 358054 - RNA, 32 nt, Human
caucugguuuggagcuagaguugcuuccuggu

SEQ ID NO: 358055 - RNA, 19 nt, Human
caucuguaaucccagcacu

SEQ ID NO: 358056 - RNA, 20 nt, Human
caucuguaaucccagcacuu

SEQ ID NO: 358057 - RNA, 22 nt, Human
caucuguaaucccagcuacuca

SEQ ID NO: 358058 - RNA, 32 nt, Human
caucuguaaugggggaauuaccuacacaccug

SEQ ID NO: 358059 - RNA, 32 nt, Human
caucuguaaugugccagcauugugcccaggcu

SEQ ID NO: 358060 - RNA, 24 nt, Human
caucuguacacacccccaucccca

SEQ ID NO: 358061 - RNA, 32 nt, Human
caucuguacuaaaaauacaaaaauuagccaga

SEQ ID NO: 358062 - RNA, 32 nt, Human
caucuguacuaaaaauacaaaaauuagcugag

SEQ ID NO: 358063 - RNA, 32 nt, Human
caucuguacuaaaaauacaaaaauuugccugg

SEQ ID NO: 358064 - RNA, 32 nt, Human
caucuguacuaaaaauacaaaauuagcugggu

SEQ ID NO: 358065 - RNA, 32 nt, Human
caucuguacuaaaaauacaagauuaccugggc

SEQ ID NO: 358066 - RNA, 32 nt, Human
caucuguacugaaaauacaaaaauuaggcaug

SEQ ID NO: 358067 - RNA, 32 nt, Human
caucuguacuguagcacuggccucugugccac

SEQ ID NO: 358068 - RNA, 32 nt, Human
caucuguagacaggcucacaugcaccaggaac

SEQ ID NO: 358069 - RNA, 32 nt, Human
caucuguagaggaagagcaguguuagaguuaa

SEQ ID NO: 358070 - RNA, 32 nt, Human
caucuguagaggaagagcaguguuaggaguua

SEQ ID NO: 358071 - RNA, 32 nt, Human
caucuguagcaagauggcugagaaauacagga

SEQ ID NO: 358072 - RNA, 32 nt, Human
caucuguauccuuguugaaauuauaugccucc

SEQ ID NO: 358073 - RNA, 32 nt, Human
caucugucaaaaguucacaaugccauacaggc

SEQ ID NO: 358074 - RNA, 32 nt, Human
caucugucacccaggcuggagugcaauggcau

SEQ ID NO: 358075 - RNA, 32 nt, Human
caucugucacccaggcuggagugcaguagugc

SEQ ID NO: 358076 - RNA, 32 nt, Human
caucugucacccaggcuggugugcaggggugc

SEQ ID NO: 358077 - RNA, 31 nt, Human
caucugucacugaaggagguggagcucccac

SEQ ID NO: 358078 - RNA, 32 nt, Human
caucugucauuuucauuucacaggguucacag

SEQ ID NO: 358079 - RNA, 32 nt, Human
caucuguccucaccaccuggcacagucucuca

SEQ ID NO: 358080 - RNA, 32 nt, Human
caucugucuacaacccuuaggauuaaguguuc

SEQ ID NO: 358081 - RNA, 32 nt, Human
caucugucucacccucuccuguuguauccagc

SEQ ID NO: 358082 - RNA, 32 nt, Human
caucugucuccuggcccuggcccaucugccuc

SEQ ID NO: 358083 - RNA, 32 nt, Human
caucugucuuaacuacuccuucccagguaaau

SEQ ID NO: 358084 - RNA, 32 nt, Human
caucugucuuggucacagagcugggugcugcc

SEQ ID NO: 358085 - RNA, 32 nt, Human
caucugugaacugcuuucugcuauauagaacu

SEQ ID NO: 358086 - RNA, 31 nt, Human
caucugugaagagucucagccaugacuuuga

SEQ ID NO: 358087 - RNA, 32 nt, Human
caucugugaaguuucugucauucguccagauc

SEQ ID NO: 358088 - RNA, 32 nt, Human
caucugugacuacuaaggaaaccuauuucuuu

SEQ ID NO: 358089 - RNA, 32 nt, Human
caucugugaggugacucgugaaaguaggugau

SEQ ID NO: 358090 - RNA, 32 nt, Human
caucugugauggcaaacaaaggcuccuugggc

SEQ ID NO: 358091 - RNA, 32 nt, Human
caucuguggaaauguguauccuucauggaauc

SEQ ID NO: 358092 - RNA, 32 nt, Human
caucugugggauaucucaucagccucgaugac

SEQ ID NO: 358093 - RNA, 18 nt, Human
caucugugggcuggccgg

SEQ ID NO: 358094 - RNA, 31 nt, Human
caucugugggugggccguggguagagggacc

SEQ ID NO: 358095 - RNA, 32 nt, Human
caucuguggucugcucugcucucacccuguuu

SEQ ID NO: 358096 - RNA, 32 nt, Human
caucugugguuucugcucaccagaccucucuu

SEQ ID NO: 358097 - RNA, 32 nt, Human
caucugugucugcuguauuauaaacagauaag

SEQ ID NO: 358098 - RNA, 32 nt, Human
caucuguuaccuccaacuugucagucaugauc

SEQ ID NO: 358099 - RNA, 32 nt, Human
caucuguugaugaacauauuucuaagagucau

SEQ ID NO: 358100 - RNA, 32 nt, Human
caucuguuucuucuccuccuuucucucccucu

SEQ ID NO: 358101 - RNA, 32 nt, Human
caucuguuuuccucuuuuccucuccucugacu

SEQ ID NO: 358102 - RNA, 32 nt, Human
caucuuaacaugguucgagccaucacuagaag

SEQ ID NO: 358103 - RNA, 32 nt, Human
caucuuaacugcacagauaccaucuucucggc

SEQ ID NO: 358104 - RNA, 32 nt, Human
caucuuaagcaacccccugccccaagagugag

SEQ ID NO: 358105 - RNA, 32 nt, Human
caucuuaauuaaccuuuuaauuuucacaauug

SEQ ID NO: 358106 - RNA, 32 nt, Human
caucuuaauuuccaaggaaacuauauuucuua

SEQ ID NO: 358107 - RNA, 32 nt, Human
caucuuacaauguuguugggaaggcuccaggg

SEQ ID NO: 358108 - RNA, 32 nt, Human
caucuuacacuauccauccucagagaagcugu

SEQ ID NO: 358109 - RNA, 32 nt, Human
caucuuacccuaccaucuccccaucuucaccc

SEQ ID NO: 358110 - RNA, 32 nt, Human
caucuuaccuguaauccuagcacuuugagacc

SEQ ID NO: 358111 - RNA, 32 nt, Human
caucuuagccuggcuccucuucugucucuagg

SEQ ID NO: 358112 - RNA, 23 nt, Human
caucuuagcuuagcaccaaccaa

SEQ ID NO: 358113 - RNA, 31 nt, Human
caucuuaggcacuuuuuaacauucucaauca

SEQ ID NO: 358114 - RNA, 32 nt, Human
caucuuagguauuccugcuccccugaagaaug

SEQ ID NO: 358115 - RNA, 32 nt, Human
caucuuauaguaaaccaaaagauuagcaauaa

SEQ ID NO: 358116 - RNA, 32 nt, Human
caucuuauccuauccucuaccacucucccaca

SEQ ID NO: 358117 - RNA, 32 nt, Human
caucuuaugugggacaggcuugggugugagac

SEQ ID NO: 358118 - RNA, 32 nt, Human
caucuucaaaaaggaaagauuuggaauuuuag

SEQ ID NO: 358119 - RNA, 32 nt, Human
caucuucaacucgucaguccagcaagaucauc

SEQ ID NO: 358120 - RNA, 32 nt, Human
caucuucaagcugggugcaguggcucacgccu

SEQ ID NO: 358121 - RNA, 32 nt, Human
caucuucaaggcaugaaauagcuuaaagagca

SEQ ID NO: 358122 - RNA, 32 nt, Human
caucuucaauaugccuggagucgucuguccaa

SEQ ID NO: 358123 - RNA, 32 nt, Human
caucuucacaccagcccauccugcccuuuaga

SEQ ID NO: 358124 - RNA, 32 nt, Human
caucuucacccacuucugggaggcuuucaggg

SEQ ID NO: 358125 - RNA, 32 nt, Human
caucuucacccagguguccaggcaauggagga

SEQ ID NO: 358126 - RNA, 32 nt, Human
caucuucacuaaaaauacaaaacuuagcuggu

SEQ ID NO: 358127 - RNA, 32 nt, Human
caucuucagccaaacaucuagucuuccauaga

SEQ ID NO: 358128 - RNA, 32 nt, Human
caucuucagcuuacaagaucuacaaugcagcu

SEQ ID NO: 358129 - RNA, 32 nt, Human
caucuucaggacucgugccuucugcuguucuc

SEQ ID NO: 358130 - RNA, 32 nt, Human
caucuucaggagacucaggaauggagcgguac

SEQ ID NO: 358131 - RNA, 32 nt, Human
caucuucaggcagagcuguggcacagaccccc

SEQ ID NO: 358132 - RNA, 32 nt, Human
caucuucaguuaggccugacaccaagaaacaa

SEQ ID NO: 358133 - RNA, 23 nt, Human
caucuucaucaccaccaucauca

SEQ ID NO: 358134 - RNA, 22 nt, Human
caucuucauccccuuccuuuaa

SEQ ID NO: 358135 - RNA, 32 nt, Human
caucuucaugguccuagaaggaucccaggagg

SEQ ID NO: 358136 - RNA, 25 nt, Human
caucuuccacgucaucuucacacca

SEQ ID NO: 358137 - RNA, 32 nt, Human
caucuuccagagccuuuaugagucacuucucu

SEQ ID NO: 358138 - RNA, 32 nt, Human
caucuuccagccuuggcacagaacugauggca

SEQ ID NO: 358139 - RNA, 32 nt, Human
caucuuccaggauggcagcaauggcgcugugc

SEQ ID NO: 358140 - RNA, 32 nt, Human
caucuuccccacacacaaucauucauaucuac

SEQ ID NO: 358141 - RNA, 32 nt, Human
caucuuccccacacauaaucauucauaucuac

SEQ ID NO: 358142 - RNA, 32 nt, Human
caucuucccccugggauauaagaugaucuagc

SEQ ID NO: 358143 - RNA, 32 nt, Human
caucuuccccuccaagggggcagaaauuccac

SEQ ID NO: 358144 - RNA, 32 nt, Human
caucuuccccugggaauccugagguuuaucug

SEQ ID NO: 358145 - RNA, 21 nt, Human
caucuucccugcgccaucuuu

SEQ ID NO: 358146 - RNA, 32 nt, Human
caucuucccugggaagucuuucuggccaaguc

SEQ ID NO: 358147 - RNA, 32 nt, Human
caucuuccggcccucugauuggccggcucgca

SEQ ID NO: 358148 - RNA, 32 nt, Human
caucuuccgggcugggagggaggcgggaccgg

SEQ ID NO: 358149 - RNA, 32 nt, Human
caucuuccucaaugccugugcuguauguauau

SEQ ID NO: 358150 - RNA, 32 nt, Human
caucuuccucccaacuggaggccucugagccu

SEQ ID NO: 358151 - RNA, 32 nt, Human
caucuuccuccccacaacugugcucaggcugg

SEQ ID NO: 358152 - RNA, 32 nt, Human
caucuuccuccucggcuguggucuggaugcug

SEQ ID NO: 358153 - RNA, 32 nt, Human
caucuuccugaccccuccuucucccucuccug

SEQ ID NO: 358154 - RNA, 32 nt, Human
caucuuccugcaggcccuuccucugccugcug

SEQ ID NO: 358155 - RNA, 32 nt, Human
caucuuccuggaggaaccuccuggggcucugg

SEQ ID NO: 358156 - RNA, 32 nt, Human
caucuuccuggcugcucagaaggaggcagauu

SEQ ID NO: 358157 - RNA, 32 nt, Human
caucuuccuuucucccucacccacacacuggg

SEQ ID NO: 358158 - RNA, 22 nt, Human
caucuucuacccugcuaccuca

SEQ ID NO: 358159 - RNA, 32 nt, Human
caucuucuagcagcuggcugugccucugggag

SEQ ID NO: 358160 - RNA, 32 nt, Human
caucuucucacagauuaagggcuaagggcaaa

SEQ ID NO: 358161 - RNA, 32 nt, Human
caucuucucacucccuucuccuugauaacagc

SEQ ID NO: 358162 - RNA, 32 nt, Human
caucuucucccaggauccauggguccagugcu

SEQ ID NO: 358163 - RNA, 32 nt, Human
caucuucucccuuuuugcacguuuugcuuggc

SEQ ID NO: 358164 - RNA, 32 nt, Human
caucuucuccuggccaaggcucugaccaugcu

SEQ ID NO: 358165 - RNA, 32 nt, Human
caucuucucgggcuucagcccagucccagcug

SEQ ID NO: 358166 - RNA, 32 nt, Human
caucuucucucaucugaucacuucauguuuug

SEQ ID NO: 358167 - RNA, 32 nt, Human
caucuucucuuccucuuccccaccguccucuc

SEQ ID NO: 358168 - RNA, 32 nt, Human
caucuucucuuuuuccagaauuuggaagcuag

SEQ ID NO: 358169 - RNA, 32 nt, Human
caucuucugccucccuuccuacuccuuuuggu

SEQ ID NO: 358170 - RNA, 32 nt, Human
caucuucugcuccuaccuucuccucugucuuc

SEQ ID NO: 358171 - RNA, 21 nt, Human
caucuucugcugggacugaag

SEQ ID NO: 358172 - RNA, 32 nt, Human
caucuucuguacgaccucacacagccucugca

SEQ ID NO: 358173 - RNA, 32 nt, Human
caucuucuguggaaggugggagccaacacccu

SEQ ID NO: 358174 - RNA, 32 nt, Human
caucuucuugugagcccugggcuuaggaguca

SEQ ID NO: 358175 - RNA, 32 nt, Human
caucuucuuucacuauagugggagagauuugg

SEQ ID NO: 358176 - RNA, 32 nt, Human
caucuucuuuuccaguagaaaauaguuuguga

SEQ ID NO: 358177 - RNA, 32 nt, Human
caucuugaaacccccauucuguuuccagccca

SEQ ID NO: 358178 - RNA, 32 nt, Human
caucuugacacauauauacacccaugaaauca

SEQ ID NO: 358179 - RNA, 32 nt, Human
caucuugacugaaaauuccaccccacacccac

SEQ ID NO: 358180 - RNA, 32 nt, Human
caucuugacuucugccccacaucugcuuuuug

SEQ ID NO: 358181 - RNA, 32 nt, Human
caucuugagaagcaggcggguugggugggagg

SEQ ID NO: 358182 - RNA, 32 nt, Human
caucuugagccccgccuuuuacuucggcccgc

SEQ ID NO: 358183 - RNA, 32 nt, Human
caucuugaugcaugaguucccagauacccucu

SEQ ID NO: 358184 - RNA, 32 nt, Human
caucuugcagaacuucugcuggagucgaaauc

SEQ ID NO: 358185 - RNA, 32 nt, Human
caucuugcagcagcaccgcacccucacuagcc

SEQ ID NO: 358186 - RNA, 32 nt, Human
caucuugcaguggcuuggcugacauugccucu

SEQ ID NO: 358187 - RNA, 16 nt, Human
caucuugccaccagaa

SEQ ID NO: 358188 - RNA, 32 nt, Human
caucuugcuaugucguccaggcuggucuugaa

SEQ ID NO: 358189 - RNA, 32 nt, Human
caucuugcucacugcuauauucucauugcuga

SEQ ID NO: 358190 - RNA, 32 nt, Human
caucuugcugagucaucaucaucaucaucauc

SEQ ID NO: 358191 - RNA, 32 nt, Human
caucuuggaaaagagaaaaacaauggaguuac

SEQ ID NO: 358192 - RNA, 31 nt, Human
caucuuggaaaaggaacucuugguucgauac

SEQ ID NO: 358193 - RNA, 32 nt, Human
caucuuggaaagcagaggugucccugcaggau

SEQ ID NO: 358194 - RNA, 32 nt, Human
caucuuggagcuuuuucaaaagcggggcuuca

SEQ ID NO: 358195 - RNA, 32 nt, Human
caucuuggauucaauccaaggugcuuuagcua

SEQ ID NO: 358196 - RNA, 32 nt, Human
caucuuggccaacauggugaaacccugucucu

SEQ ID NO: 358197 - RNA, 32 nt, Human
caucuuggccgcugccccagaaccuuggaaac

SEQ ID NO: 358198 - RNA, 32 nt, Human
caucuuggcuaaaucacuuggucuuucugcau

SEQ ID NO: 358199 - RNA, 32 nt, Human
caucuuggcuaacaaggugaaaccccgucucu

SEQ ID NO: 358200 - RNA, 32 nt, Human
caucuuggcuaacagggugaaaccccgucucu

SEQ ID NO: 358201 - RNA, 32 nt, Human
caucuuggcuaauauggugaaaccccaucucu

SEQ ID NO: 358202 - RNA, 23 nt, Human
caucuuggcucacaccuguaguc

SEQ ID NO: 358203 - RNA, 24 nt, Human
caucuuggcucacaccuguagucc

SEQ ID NO: 358204 - RNA, 32 nt, Human
caucuuggcucacaccuguagucccagcuacu

SEQ ID NO: 358205 - RNA, 32 nt, Human
caucuuggcucacugcaccuccaccuuccggg

SEQ ID NO: 358206 - RNA, 20 nt, Human
caucuuggcuggagugagug

SEQ ID NO: 358207 - RNA, 32 nt, Human
caucuugggaaaagaauggccacuucuugggg

SEQ ID NO: 358208 - RNA, 32 nt, Human
caucuugggccuggaggucagcuuuggagccc

SEQ ID NO: 358209 - RNA, 32 nt, Human
caucuuggggaccuacaagggccuggacucag

SEQ ID NO: 358210 - RNA, 21 nt, Human
caucuugguacccuugucaaa

SEQ ID NO: 358211 - RNA, 32 nt, Human
caucuugguagaaaaugggacuuauuccuuga

SEQ ID NO: 358212 - RNA, 32 nt, Human
caucuugguucugccauccucuugccuuccua

SEQ ID NO: 358213 - RNA, 32 nt, Human
caucuuguaagacacauaaugaggucccucua

SEQ ID NO: 358214 - RNA, 32 nt, Human
caucuugucaaucaguugcuucaugcccaggg

SEQ ID NO: 358215 - RNA, 32 nt, Human
caucuugucuuccuccccuuccuccuccagag

SEQ ID NO: 358216 - RNA, 32 nt, Human
caucuugugacccaguuaaguggauacauaag

SEQ ID NO: 358217 - RNA, 32 nt, Human
caucuuguuccugccuugagguuaccagguag

SEQ ID NO: 358218 - RNA, 31 nt, Human
caucuuguugucucugggguguggugucaca

SEQ ID NO: 358219 - RNA, 32 nt, Human
caucuuuaaacagcucaggaagaaauagcuua

SEQ ID NO: 358220 - RNA, 32 nt, Human
caucuuuaccaaaaauacaaaaauuagccagg

SEQ ID NO: 358221 - RNA, 32 nt, Human
caucuuuacuaaaaauacaaaaauuagccagg

SEQ ID NO: 358222 - RNA, 32 nt, Human
caucuuuacuaaaaauacaaaaauuagccggg

SEQ ID NO: 358223 - RNA, 32 nt, Human
caucuuuacugaaaauacaaaauaauuagccg

SEQ ID NO: 358224 - RNA, 32 nt, Human
caucuuuauauacuuuccuuacaaacccagug

SEQ ID NO: 358225 - RNA, 32 nt, Human
caucuuuauccaggucuuacccagucaggcua

SEQ ID NO: 358226 - RNA, 32 nt, Human
caucuuucacugggaggcaaauauguuuuuca

SEQ ID NO: 358227 - RNA, 32 nt, Human
caucuuucagccccacuggucuuuucaugcuc

SEQ ID NO: 358228 - RNA, 32 nt, Human
caucuuuccagccucagucggacgggcgcgga

SEQ ID NO: 358229 - RNA, 32 nt, Human
caucuuuccaggaagucaggauggagucagaa

SEQ ID NO: 358230 - RNA, 32 nt, Human
caucuuuccaguccuuggucaguuugguugug

SEQ ID NO: 358231 - RNA, 32 nt, Human
caucuuucccacccucuugguugccgcuggcc

SEQ ID NO: 358232 - RNA, 32 nt, Human
caucuuucccagagugccucagaccuuauugc

SEQ ID NO: 358233 - RNA, 32 nt, Human
caucuuucccucccaucucugccaucugucug

SEQ ID NO: 358234 - RNA, 17 nt, Human
caucuuuccuugucgaa

SEQ ID NO: 358235 - RNA, 20 nt, Human
caucuuucgggcugccgagg

SEQ ID NO: 358236 - RNA, 32 nt, Human
caucuuucucuugccgcgugcugguguuggag

SEQ ID NO: 358237 - RNA, 32 nt, Human
caucuuucuucuaugcagaacaaaaagcugca

SEQ ID NO: 358238 - RNA, 32 nt, Human
caucuuugaaagcaucuucuacaagcagaagu

SEQ ID NO: 358239 - RNA, 32 nt, Human
caucuuugaucaguggguguaucuguaaugaa

SEQ ID NO: 358240 - RNA, 32 nt, Human
caucuuugccaacauggugaaacuccaucucu

SEQ ID NO: 358241 - RNA, 32 nt, Human
caucuuugccuuucuugucguugauuuuugcc

SEQ ID NO: 358242 - RNA, 32 nt, Human
caucuuugcuggaggagccccaugacucccug

SEQ ID NO: 358243 - RNA, 32 nt, Human
caucuuuggaaaugaugagauuauuuccugug

SEQ ID NO: 358244 - RNA, 32 nt, Human
caucuuuggccugcuggugccagcaggggaca

SEQ ID NO: 358245 - RNA, 32 nt, Human
caucuuugggaaagcuuacuguuuuugauaaa

SEQ ID NO: 358246 - RNA, 32 nt, Human
caucuuugugcaaaugcacucauguuugugca

SEQ ID NO: 358247 - RNA, 32 nt, Human
caucuuugugccuguacuuaugcagcuuucua

SEQ ID NO: 358248 - RNA, 32 nt, Human
caucuuuguuggcgaucugagugcaguguggc

SEQ ID NO: 358249 - RNA, 32 nt, Human
caucuuuguuucugcugcaucuuugcaggaag

SEQ ID NO: 358250 - RNA, 32 nt, Human
caucuuuuccagguagaagguggagaaaucug

SEQ ID NO: 358251 - RNA, 32 nt, Human
caucuuuucccucccucucucuuucagcaggg

SEQ ID NO: 358252 - RNA, 32 nt, Human
caucuuuucucaugaaaguaaaaagaaccaag

SEQ ID NO: 358253 - RNA, 32 nt, Human
caucuuuucucccauuccuccuucuuuauaua

SEQ ID NO: 358254 - RNA, 32 nt, Human
caucuuuucucucucugacgcauacaauggaa

SEQ ID NO: 358255 - RNA, 32 nt, Human
caucuuuugaucuuuuaguuuuucccucagug

SEQ ID NO: 358256 - RNA, 32 nt, Human
caucuuuuuaaccucuguucaggaaguccuua

SEQ ID NO: 358257 - RNA, 19 nt, Human
caucuuuuucaauuucuga

SEQ ID NO: 358258 - RNA, 32 nt, Human
caucuuuuucaguaauuguaaagugauuuauu

SEQ ID NO: 358259 - RNA, 19 nt, Human
caucuuuuuccaagcagug

SEQ ID NO: 358260 - RNA, 32 nt, Human
caucuuuuucucuguaaugguggagaggcugc

SEQ ID NO: 358261 - RNA, 32 nt, Human
caucuuuuucugucuguuuugucugcuuucuu

SEQ ID NO: 358262 - RNA, 32 nt, Human
caucuuuuugcugagaguucugagcucuguac

SEQ ID NO: 358263 - RNA, 32 nt, Human
caugaaaaaucaugggccagagccucggcccu

SEQ ID NO: 358264 - RNA, 32 nt, Human
caugaaaacugcacuuuauugcaaguuagugu

SEQ ID NO: 358265 - RNA, 23 nt, Human
caugaaaaggaggccacaggaga

SEQ ID NO: 358266 - RNA, 32 nt, Human
caugaaaauuagaaaaugaauguaaugaaauu

SEQ ID NO: 358267 - RNA, 32 nt, Human
caugaaacacccuguugaucccuucccaggcu

SEQ ID NO: 358268 - RNA, 22 nt, Human
caugaaacaccuggcugugaaa

SEQ ID NO: 358269 - RNA, 32 nt, Human
caugaaacagcaggcuacaaaaccacugcaug

SEQ ID NO: 358270 - RNA, 24 nt, Human
caugaaaccacaacgaggauuucu

SEQ ID NO: 358271 - RNA, 23 nt, Human
caugaaaccaucaucagagucac

SEQ ID NO: 358272 - RNA, 32 nt, Human
caugaaacugagacucagucucccagggguaa

SEQ ID NO: 358273 - RNA, 32 nt, Human
caugaaacugauuguaaagcuuuuugacaacu

SEQ ID NO: 358274 - RNA, 32 nt, Human
caugaaacuguacauacugcagugugaauuuu

SEQ ID NO: 358275 - RNA, 32 nt, Human
caugaaacuuggguuaauuuugcucagaguau

SEQ ID NO: 358276 - RNA, 32 nt, Human
caugaaagaacuuuucaccuuccuucaugauu

SEQ ID NO: 358277 - RNA, 32 nt, Human
caugaaagaaugacccuggugagugcucuaag

SEQ ID NO: 358278 - RNA, 32 nt, Human
caugaaagagaauguucacaacacugaaaaua

SEQ ID NO: 358279 - RNA, 32 nt, Human
caugaaaggaggaagagagaaaaucggaucca

SEQ ID NO: 358280 - RNA, 32 nt, Human
caugaaagucacauccuucuccugccucuguc

SEQ ID NO: 358281 - RNA, 32 nt, Human
caugaaaguccuguuagguauccagaguucua

SEQ ID NO: 358282 - RNA, 32 nt, Human
caugaaauacugugccuggccuggggaccagg

SEQ ID NO: 358283 - RNA, 32 nt, Human
caugaaauaucacugacacuccagacuaaagc

SEQ ID NO: 358284 - RNA, 32 nt, Human
caugaaauggcuguuuuccaauggaggaacag

SEQ ID NO: 358285 - RNA, 32 nt, Human
caugaaauggguuucuggaggaaagaucagca

SEQ ID NO: 358286 - RNA, 32 nt, Human
caugaaauugcguucuuccugcauugaaauaa

SEQ ID NO: 358287 - RNA, 32 nt, Human
caugaacaaucuccccuaccuccugggacucu

SEQ ID NO: 358288 - RNA, 32 nt, Human
caugaacacagaauaguaccuuacauuugcua

SEQ ID NO: 358289 - RNA, 32 nt, Human
caugaacacagccugucugugcucagacauag

SEQ ID NO: 358290 - RNA, 32 nt, Human
caugaacacaugcacaugugcacacacaagua

SEQ ID NO: 358291 - RNA, 32 nt, Human
caugaacacccacuguaccgggccggacaccu

SEQ ID NO: 358292 - RNA, 32 nt, Human
caugaacagaacuuacgguaacaggcacggcu

SEQ ID NO: 358293 - RNA, 32 nt, Human
caugaacaguggccuggcuggcguggcagggc

SEQ ID NO: 358294 - RNA, 32 nt, Human
caugaacaugggggccagagagcagauggacu

SEQ ID NO: 358295 - RNA, 32 nt, Human
caugaacauguugagugagcaugcuggagaau

SEQ ID NO: 358296 - RNA, 32 nt, Human
caugaaccaggccaaagcggagcggagcgggg

SEQ ID NO: 358297 - RNA, 32 nt, Human
caugaacccaggaggcagagcuugcagugagc

SEQ ID NO: 358298 - RNA, 32 nt, Human
caugaacccaggaggcagagcuuguagugagc

SEQ ID NO: 358299 - RNA, 32 nt, Human
caugaacccaggaggcagagguugcagugagc

SEQ ID NO: 358300 - RNA, 32 nt, Human
caugaacccaggaggcggagcuugcagugagc

SEQ ID NO: 358301 - RNA, 32 nt, Human
caugaacccaggagguugaagcugcggugggc

SEQ ID NO: 358302 - RNA, 32 nt, Human
caugaacccaggaguuggagcuugcagugagc

SEQ ID NO: 358303 - RNA, 32 nt, Human
caugaacccaggaugcggagguugcagugagc

SEQ ID NO: 358304 - RNA, 32 nt, Human
caugaaccccaggcuggagugcaguggcucaa

SEQ ID NO: 358305 - RNA, 32 nt, Human
caugaaccccuuuucuccagaaaagcugcuuc

SEQ ID NO: 358306 - RNA, 32 nt, Human
caugaacccggaaggcagagcuugcagugagc

SEQ ID NO: 358307 - RNA, 32 nt, Human
caugaacccgggaggaggagcuugcagugagc

SEQ ID NO: 358308 - RNA, 32 nt, Human
caugaacccgggaggaggaggaggagguugca

SEQ ID NO: 358309 - RNA, 32 nt, Human
caugaacccgggaggcagagcuugcagugagc

SEQ ID NO: 358310 - RNA, 32 nt, Human
caugaacccgggaggcagagguugcagugagc

SEQ ID NO: 358311 - RNA, 32 nt, Human
caugaacccgggaggcggaacuugcggugagc

SEQ ID NO: 358312 - RNA, 32 nt, Human
caugaacccgggaggcggagcuugcagugagc

SEQ ID NO: 358313 - RNA, 32 nt, Human
caugaacccgggaggcggagguugcagucagc

SEQ ID NO: 358314 - RNA, 32 nt, Human
caugaacccgggaggcggaucuugcauugagc

SEQ ID NO: 358315 - RNA, 32 nt, Human
caugaacccgggagguagagcuugcagugaac

SEQ ID NO: 358316 - RNA, 32 nt, Human
caugaacccgggaggugcagguugcagugagc

SEQ ID NO: 358317 - RNA, 32 nt, Human
caugaacccgggagguggaacuugcagugagc

SEQ ID NO: 358318 - RNA, 32 nt, Human
caugaacccgggagguggagcuugcagugagc

SEQ ID NO: 358319 - RNA, 32 nt, Human
caugaacccgggagguggagcuugcagugggu

SEQ ID NO: 358320 - RNA, 32 nt, Human
caugaacccgggagguggagguugcagggagc

SEQ ID NO: 358321 - RNA, 32 nt, Human
caugaacccgguagguggagguugcagugagc

SEQ ID NO: 358322 - RNA, 32 nt, Human
caugaacccuggggacucacuccaacuuggua

SEQ ID NO: 358323 - RNA, 32 nt, Human
caugaaccuaaguggcagagguugcagugagc

SEQ ID NO: 358324 - RNA, 32 nt, Human
caugaaccuccagcaaauagcaaguccaggaa

SEQ ID NO: 358325 - RNA, 32 nt, Human
caugaaccuggaagguggagcuugcagugagc

SEQ ID NO: 358326 - RNA, 32 nt, Human
caugaaccugggaggcagagcuugcagugagc

SEQ ID NO: 358327 - RNA, 32 nt, Human
caugaaccugggaggcagagcuugcagugagu

SEQ ID NO: 358328 - RNA, 32 nt, Human
caugaaccugggaggcagagcuugcagugauu

SEQ ID NO: 358329 - RNA, 32 nt, Human
caugaaccugggaggcggagcuugcaguaagc

SEQ ID NO: 358330 - RNA, 32 nt, Human
caugaaccugggaggcggagcuugcagugagc

SEQ ID NO: 358331 - RNA, 32 nt, Human
caugaaccugggaggucaagauugcagugagc

SEQ ID NO: 358332 - RNA, 32 nt, Human
caugaaccugggagguggagcaugcagccagc

SEQ ID NO: 358333 - RNA, 32 nt, Human
caugaaccugggagguggagguugcagugagc

SEQ ID NO: 358334 - RNA, 22 nt, Human
caugaaccuugaacaucaaaua

SEQ ID NO: 358335 - RNA, 18 nt, Human
caugaacguaugauguuc

SEQ ID NO: 358336 - RNA, 32 nt, Human
caugaacuagcaaccccaccuuccaccauggu

SEQ ID NO: 358337 - RNA, 22 nt, Human
caugaacucaaguacccggaca

SEQ ID NO: 358338 - RNA, 32 nt, Human
caugaacugauaguuaggcaaacaaaugguug

SEQ ID NO: 358339 - RNA, 32 nt, Human
caugaacuucaaauaaauaaaaacuaugguau

SEQ ID NO: 358340 - RNA, 32 nt, Human
caugaacuugcaaucauggacagcaacaauuu

SEQ ID NO: 358341 - RNA, 20 nt, Human
caugaagaagaagggaccuc

SEQ ID NO: 358342 - RNA, 32 nt, Human
caugaagacaaucaccugccucaccuucuagg

SEQ ID NO: 358343 - RNA, 32 nt, Human
caugaagacgucacugaccaucuucucugguu

SEQ ID NO: 358344 - RNA, 32 nt, Human
caugaagagaagcaauuuuggggaaggguuug

SEQ ID NO: 358345 - RNA, 32 nt, Human
caugaagagcagaugaccaccaugcucugugu

SEQ ID NO: 358346 - RNA, 32 nt, Human
caugaagagcuacuccucugacaguuucaugu

SEQ ID NO: 358347 - RNA, 32 nt, Human
caugaagagcucuucaugcauucuuugcaaag

SEQ ID NO: 358348 - RNA, 32 nt, Human
caugaagcaaaucuuuuguugcuaccccauug

SEQ ID NO: 358349 - RNA, 32 nt, Human
caugaagcaagaaacagugcagggugcccagu

SEQ ID NO: 358350 - RNA, 32 nt, Human
caugaagcacacacagacuuuugaaagcaagg

SEQ ID NO: 358351 - RNA, 26 nt, Human
caugaagcagcuuggugagacugaga

SEQ ID NO: 358352 - RNA, 32 nt, Human
caugaagcauuggcucagaaguagagggagaa

SEQ ID NO: 358353 - RNA, 32 nt, Human
caugaagccagccccugcagugccguccaccc

SEQ ID NO: 358354 - RNA, 32 nt, Human
caugaagccaggaguucgagaccagccugacc

SEQ ID NO: 358355 - RNA, 32 nt, Human
caugaagccagugcacgccagccugggcgaca

SEQ ID NO: 358356 - RNA, 32 nt, Human
caugaagccccuggcauuugcuggggaaggga

SEQ ID NO: 358357 - RNA, 32 nt, Human
caugaagcgguucaccccacaguacaaaggua

SEQ ID NO: 358358 - RNA, 32 nt, Human
caugaagcuuucugaaugagaagucugauuuu

SEQ ID NO: 358359 - RNA, 32 nt, Human
caugaaggaauaggcaggacuuaacuuggggu

SEQ ID NO: 358360 - RNA, 32 nt, Human
caugaaggacagugauguggggaggccguggg

SEQ ID NO: 358361 - RNA, 26 nt, Human
caugaaggacuucucagaugucaucc

SEQ ID NO: 358362 - RNA, 32 nt, Human
caugaaggagaagggcaagagauccucugaac

SEQ ID NO: 358363 - RNA, 32 nt, Human
caugaaggagaagggcaagaggucuucugaac

SEQ ID NO: 358364 - RNA, 32 nt, Human
caugaaggaugcaggcuuccaggccuggcuuc

SEQ ID NO: 358365 - RNA, 26 nt, Human
caugaaggcaagggguugguggaucg

SEQ ID NO: 358366 - RNA, 32 nt, Human
caugaaggcagagucgagacuguggauucugg

SEQ ID NO: 358367 - RNA, 32 nt, Human
caugaaggcguguuugauuacuccaggcuucu

SEQ ID NO: 358368 - RNA, 32 nt, Human
caugaaggcuggcgcccguaaucccagcuacu

SEQ ID NO: 358369 - RNA, 32 nt, Human
caugaaggcugugugcagugcaaggcuguacc

SEQ ID NO: 358370 - RNA, 21 nt, Human
caugaaguaaaaggggccuca

SEQ ID NO: 358371 - RNA, 32 nt, Human
caugaaguaagauuacagcagagcagaaguug

SEQ ID NO: 358372 - RNA, 32 nt, Human
caugaagucucuuccuuucugggcuuuguuag

SEQ ID NO: 358373 - RNA, 32 nt, Human
caugaagucugaccaacauggagaaacccugu

SEQ ID NO: 358374 - RNA, 32 nt, Human
caugaaguuguugccaguuucuguauuacaac

SEQ ID NO: 358375 - RNA, 32 nt, Human
caugaaguuguugccaguuucuguauuauaac

SEQ ID NO: 358376 - RNA, 32 nt, Human
caugaaguuuagcuuagagaagaaaagaauaa

SEQ ID NO: 358377 - RNA, 32 nt, Human
caugaaguuucugcugaugggaggagucaguu

SEQ ID NO: 358378 - RNA, 20 nt, Human
caugaaguuugccuguucua

SEQ ID NO: 358379 - RNA, 32 nt, Human
caugaauacuccugaggguucacaaacgagcc

SEQ ID NO: 358380 - RNA, 32 nt, Human
caugaaucaagcaauccagccucaugggaagu

SEQ ID NO: 358381 - RNA, 32 nt, Human
caugaauccaggaggcagagcuugcagugagc

SEQ ID NO: 358382 - RNA, 32 nt, Human
caugaauccaggagguggagguugcagugagc

SEQ ID NO: 358383 - RNA, 32 nt, Human
caugaaucuuugcucccuuccacauuauggau

SEQ ID NO: 358384 - RNA, 32 nt, Human
caugaaugaaacugaugguucaauuucagaag

SEQ ID NO: 358385 - RNA, 32 nt, Human
caugaaugaagauagguuguaaacugaaugcu

SEQ ID NO: 358386 - RNA, 32 nt, Human
caugaaugcaaaccccuccagcccaucagacg

SEQ ID NO: 358387 - RNA, 32 nt, Human
caugaaugccccacugcacuccagccugggcg

SEQ ID NO: 358388 - RNA, 32 nt, Human
caugaauggagagagacagagaggaagugcag

SEQ ID NO: 358389 - RNA, 32 nt, Human
caugaaugggcaagaacuuauuugcaauguuu

SEQ ID NO: 358390 - RNA, 32 nt, Human
caugaaugguugaaugugaacaugacaguaaa

SEQ ID NO: 358391 - RNA, 32 nt, Human
caugaauguacaaguuuagcaaacuuccuccu

SEQ ID NO: 358392 - RNA, 32 nt, Human
caugaaugucagagacauugacuggaggccuu

SEQ ID NO: 358393 - RNA, 32 nt, Human
caugaaugugaggaggguggaaagcauuucgg

SEQ ID NO: 358394 - RNA, 32 nt, Human
caugaaugugagucauuauguagcugucguac

SEQ ID NO: 358395 - RNA, 24 nt, Human
caugacaaaaccccgucucuacua

SEQ ID NO: 358396 - RNA, 22 nt, Human
caugacaaaacccugucucuac

SEQ ID NO: 358397 - RNA, 32 nt, Human
caugacaaacccacacuggcauuggauaaauc

SEQ ID NO: 358398 - RNA, 20 nt, Human
caugacaaccacacuccacu

SEQ ID NO: 358399 - RNA, 32 nt, Human
caugacaaucaccuucagaaucaugucgaucc

SEQ ID NO: 358400 - RNA, 32 nt, Human
caugacaccaacaucugcucagcuucugguga

SEQ ID NO: 358401 - RNA, 32 nt, Human
caugacaccgacagcugcccagccuguucaca

SEQ ID NO: 358402 - RNA, 32 nt, Human
caugacacgggcugacacagucucauaucccc

SEQ ID NO: 358403 - RNA, 32 nt, Human
caugacacugcacuccagccugggcaacagag

SEQ ID NO: 358404 - RNA, 32 nt, Human
caugacacugcacuccagccugggugauagag

SEQ ID NO: 358405 - RNA, 32 nt, Human
caugacacugcacuccagccuuggcaacaaag

SEQ ID NO: 358406 - RNA, 32 nt, Human
caugacacugcacuccagccuuggcaacagag

SEQ ID NO: 358407 - RNA, 32 nt, Human
caugacacugcccuccagccuggacaacagau

SEQ ID NO: 358408 - RNA, 32 nt, Human
caugacacuuccuugcuuuggccagaagccau

SEQ ID NO: 358409 - RNA, 32 nt, Human
caugacagaacagcacauccuggccagcaccc

SEQ ID NO: 358410 - RNA, 24 nt, Human
caugacagcaugugccuguaauuc

SEQ ID NO: 358411 - RNA, 32 nt, Human
caugacagcccuggaucuauccaccuccccau

SEQ ID NO: 358412 - RNA, 32 nt, Human
caugacagccuccaccccacaacccaaaaggu

SEQ ID NO: 358413 - RNA, 32 nt, Human
caugacagcggcaaucuuuucuuuggucaaag

SEQ ID NO: 358414 - RNA, 32 nt, Human
caugacaguucccagauguauuucaagccuuu

SEQ ID NO: 358415 - RNA, 32 nt, Human
caugacauacugaagcuccagccagggggaug

SEQ ID NO: 358416 - RNA, 32 nt, Human
caugacaucaccgucacucugccuaaaagcac

SEQ ID NO: 358417 - RNA, 32 nt, Human
caugacaucacuggggaaggagugggacauca

SEQ ID NO: 358418 - RNA, 32 nt, Human
caugacaugcugucuguaagcccuuugucuug

SEQ ID NO: 358419 - RNA, 20 nt, Human
caugacauugaaucacauga

SEQ ID NO: 358420 - RNA, 32 nt, Human
caugacauuggagcaccuuccucuccagccag

SEQ ID NO: 358421 - RNA, 32 nt, Human
caugacauuuccaacacugugugaauuaucua

SEQ ID NO: 358422 - RNA, 32 nt, Human
caugaccaaaaaccaaaagugcauucaaccuu

SEQ ID NO: 358423 - RNA, 32 nt, Human
caugaccaaauuugaccugcccuuguuuaugg

SEQ ID NO: 358424 - RNA, 32 nt, Human
caugaccaggagaggguuaaugagagccaaga

SEQ ID NO: 358425 - RNA, 32 nt, Human
caugaccaggcucugggcaaggcuccucacag

SEQ ID NO: 358426 - RNA, 32 nt, Human
caugaccauuggggcaccuguugcccacaggg

SEQ ID NO: 358427 - RNA, 32 nt, Human
caugacccagccucacagacccucucaggccu

SEQ ID NO: 358428 - RNA, 18 nt, Human
caugacccaggcuggcca

SEQ ID NO: 358429 - RNA, 32 nt, Human
caugacccaucuucuaccaggcagaucuuuau

SEQ ID NO: 358430 - RNA, 32 nt, Human
caugaccccaaaccaccaucucuuuacuguac

SEQ ID NO: 358431 - RNA, 32 nt, Human
caugaccccucagauccacacaaagccuucug

SEQ ID NO: 358432 - RNA, 32 nt, Human
caugacccggguggcgggacaagacuugcuuc

SEQ ID NO: 358433 - RNA, 15 nt, Human
caugacccucaggug

SEQ ID NO: 358434 - RNA, 32 nt, Human
caugacccuccaccugcacccagaccucuggg

SEQ ID NO: 358435 - RNA, 32 nt, Human
caugacccucugcugucucucccuguucagcu

SEQ ID NO: 358436 - RNA, 32 nt, Human
caugacccuucuccaguugucuuguucccaua

SEQ ID NO: 358437 - RNA, 32 nt, Human
caugacccuuucuccuucaugccaggcuccua

SEQ ID NO: 358438 - RNA, 32 nt, Human
caugaccgcacggcggccuggccaacacugac

SEQ ID NO: 358439 - RNA, 32 nt, Human
caugaccuacuucaaaccccuacugaccuggc

SEQ ID NO: 358440 - RNA, 32 nt, Human
caugaccucuucaugaagaaccauaauugcuu

SEQ ID NO: 358441 - RNA, 32 nt, Human
caugaccugcaggcaucuuuacugcagcucug

SEQ ID NO: 358442 - RNA, 32 nt, Human
caugaccugccaccucugcuuccacaccggag

SEQ ID NO: 358443 - RNA, 32 nt, Human
caugaccugggcaaucugcaugugaugccaac

SEQ ID NO: 358444 - RNA, 32 nt, Human
caugaccuuauccuuccucuccuuccuuguua

SEQ ID NO: 358445 - RNA, 32 nt, Human
caugaccuucaccucuggagaguagggucuau

SEQ ID NO: 358446 - RNA, 32 nt, Human
caugaccuuccuccuccucuucacuuggccag

SEQ ID NO: 358447 - RNA, 32 nt, Human
caugaccuugggcacaugagaucauguccucc

SEQ ID NO: 358448 - RNA, 32 nt, Human
caugaccuugugggagaugccauacagaggcu

SEQ ID NO: 358449 - RNA, 22 nt, Human
caugacgaaaccccaucuccac

SEQ ID NO: 358450 - RNA, 24 nt, Human
caugacgaaaccccaucucuacua

SEQ ID NO: 358451 - RNA, 24 nt, Human
caugacgaaacccggucucuacua

SEQ ID NO: 358452 - RNA, 32 nt, Human
caugacgccuggcuaauuuuugcauuuuuagu

SEQ ID NO: 358453 - RNA, 32 nt, Human
caugacgcgugccauuuagagcucucagagca

SEQ ID NO: 358454 - RNA, 32 nt, Human
caugacggagcaugacacagcacuuuugggca

SEQ ID NO: 358455 - RNA, 32 nt, Human
caugacggaggccagagguaggaaaagcaaga

SEQ ID NO: 358456 - RNA, 24 nt, Human
caugacggcucaugccuguaaucc

SEQ ID NO: 358457 - RNA, 32 nt, Human
caugacggcucaugccuguaaucccagcacuu

SEQ ID NO: 358458 - RNA, 32 nt, Human
caugacggugccacugcacuccagcuugggug

SEQ ID NO: 358459 - RNA, 32 nt, Human
caugacuaaugagagacuugcagcuuggauac

SEQ ID NO: 358460 - RNA, 32 nt, Human
caugacuauuuaaagccaggggauuaucuuuc

SEQ ID NO: 358461 - RNA, 32 nt, Human
caugacucacugcagccucaaacuccuggguu

SEQ ID NO: 358462 - RNA, 32 nt, Human
caugacucagccuguuccaugaaggcagagcc

SEQ ID NO: 358463 - RNA, 32 nt, Human
caugacucaucacugcuuccaugcccugggcu

SEQ ID NO: 358464 - RNA, 32 nt, Human
caugacucauuucuguuucauuuuucagcgga

SEQ ID NO: 358465 - RNA, 32 nt, Human
caugacuccaggcugugccucucuccauguuu

SEQ ID NO: 358466 - RNA, 32 nt, Human
caugacucccacugcugccucuccugggcaug

SEQ ID NO: 358467 - RNA, 32 nt, Human
caugacucccuaaugccuucccaaccucgugg

SEQ ID NO: 358468 - RNA, 32 nt, Human
caugacuccuccugaagcuuauugaacaucuc

SEQ ID NO: 358469 - RNA, 32 nt, Human
caugacugaacauuaagguuagggacucugau

SEQ ID NO: 358470 - RNA, 26 nt, Human
caugacugacuggguguuccccaagc

SEQ ID NO: 358471 - RNA, 32 nt, Human
caugacugacuucacaugcucagcuuucucag

SEQ ID NO: 358472 - RNA, 32 nt, Human
caugacugagucaccuccaggagcucaccuga

SEQ ID NO: 358473 - RNA, 32 nt, Human
caugacugcaaguuuccugaggccuccccagc

SEQ ID NO: 358474 - RNA, 32 nt, Human
caugacugcagccuugaacuccugggcuuaag

SEQ ID NO: 358475 - RNA, 21 nt, Human
caugacugcccuugacaugau

SEQ ID NO: 358476 - RNA, 20 nt, Human
caugacugcuuccgcugcca

SEQ ID NO: 358477 - RNA, 32 nt, Human
caugacuguaaguuuccugaggccuccccagc

SEQ ID NO: 358478 - RNA, 32 nt, Human
caugacugugccacugcaccucuagucugggu

SEQ ID NO: 358479 - RNA, 32 nt, Human
caugacugugcugugaggaaggcguuccuguu

SEQ ID NO: 358480 - RNA, 32 nt, Human
caugacuguggccugaguuccccagccccucu

SEQ ID NO: 358481 - RNA, 32 nt, Human
caugacuucccuuguaaacagaagcaacagaa

SEQ ID NO: 358482 - RNA, 32 nt, Human
caugacuugcagcugucuccuggauuguguca

SEQ ID NO: 358483 - RNA, 21 nt, Human
caugacuuggaacugaacuaa

SEQ ID NO: 358484 - RNA, 32 nt, Human
caugacuuuuugacacacuugccaugacgugu

SEQ ID NO: 358485 - RNA, 32 nt, Human
caugagaaaccagcucgaccggagggccagaa

SEQ ID NO: 358486 - RNA, 19 nt, Human
caugagaaaccauagcaga

SEQ ID NO: 358487 - RNA, 32 nt, Human
caugagaagagcuuggauacagugaguuugca

SEQ ID NO: 358488 - RNA, 32 nt, Human
caugagaaggaacuuccagguguuacuguaau

SEQ ID NO: 358489 - RNA, 32 nt, Human
caugagaaucacuugaaccugggaagcagagg

SEQ ID NO: 358490 - RNA, 32 nt, Human
caugagaaucacuugaaccugggagacagagg

SEQ ID NO: 358491 - RNA, 32 nt, Human
caugagaaugaauguugucgggaccugcuugg

SEQ ID NO: 358492 - RNA, 32 nt, Human
caugagaaugcacacaaaacugaacauuuucu

SEQ ID NO: 358493 - RNA, 20 nt, Human
caugagaauugcuugaacca

SEQ ID NO: 358494 - RNA, 32 nt, Human
caugagacaacuggaaauauaacucugacugg

SEQ ID NO: 358495 - RNA, 32 nt, Human
caugagacaccaaagaaaagaggacucuauac

SEQ ID NO: 358496 - RNA, 32 nt, Human
caugagaccccaccucccucccugccugccag

SEQ ID NO: 358497 - RNA, 32 nt, Human
caugagacccuccugaccacguggaagauugu

SEQ ID NO: 358498 - RNA, 32 nt, Human
caugagaccgaggaucucguucguugaucgau

SEQ ID NO: 358499 - RNA, 22 nt, Human
caugagacuccuuguggccuca

SEQ ID NO: 358500 - RNA, 19 nt, Human
caugagacugcagagcaga

SEQ ID NO: 358501 - RNA, 32 nt, Human
caugagagacucuacaaaccugaaagauguga

SEQ ID NO: 358502 - RNA, 32 nt, Human
caugagagcugaugguuuaguuccagucugau

SEQ ID NO: 358503 - RNA, 32 nt, Human
caugagaggggaggcaaagaagaaaaggacac

SEQ ID NO: 358504 - RNA, 32 nt, Human
caugagaggugccaguuauagguggaugugcc

SEQ ID NO: 358505 - RNA, 24 nt, Human
caugagaguagagggcacuggguc

SEQ ID NO: 358506 - RNA, 32 nt, Human
caugagaguccaggcugucugagucagcacag

SEQ ID NO: 358507 - RNA, 32 nt, Human
caugagauagaggcacccacuaccugcggggc

SEQ ID NO: 358508 - RNA, 32 nt, Human
caugagaucuuuuugcuaagcuggcagaaaga

SEQ ID NO: 358509 - RNA, 32 nt, Human
caugagaugauggcuguauuuaucuguuuauu

SEQ ID NO: 358510 - RNA, 32 nt, Human
caugagauucugcuuugggcuucacuucuuug

SEQ ID NO: 358511 - RNA, 32 nt, Human
caugagauuuggaggaggucaaacaaacuaaa

SEQ ID NO: 358512 - RNA, 24 nt, Human
caugagcacugagcugacuauuga

SEQ ID NO: 358513 - RNA, 32 nt, Human
caugagcagaugaaauagaagcauuaaauauu

SEQ ID NO: 358514 - RNA, 32 nt, Human
caugagcaugaagcccaguggcaccaaauggc

SEQ ID NO: 358515 - RNA, 22 nt, Human
caugagcauguuaaauagagcu

SEQ ID NO: 358516 - RNA, 32 nt, Human
caugagccaauucugucacaguccgaaauaga

SEQ ID NO: 358517 - RNA, 32 nt, Human
caugagccaccacaucuggccuaggaccuuaa

SEQ ID NO: 358518 - RNA, 32 nt, Human
caugagccaccgcacccagccugguuauugga

SEQ ID NO: 358519 - RNA, 32 nt, Human
caugagccacgcgcccagccuagacuagcauu

SEQ ID NO: 358520 - RNA, 32 nt, Human
caugagccacugcaccagccccaggggucuaa

SEQ ID NO: 358521 - RNA, 32 nt, Human
caugagccacugcacccaaccccuggaaaacu

SEQ ID NO: 358522 - RNA, 32 nt, Human
caugagccacugcacccagccaagugaucauu

SEQ ID NO: 358523 - RNA, 32 nt, Human
caugagccacugcacccagccgauaggaaguu

SEQ ID NO: 358524 - RNA, 32 nt, Human
caugagccacugcacccagccuuggcgggcau

SEQ ID NO: 358525 - RNA, 32 nt, Human
caugagccacugcacccggcccugagaauaua

SEQ ID NO: 358526 - RNA, 32 nt, Human
caugagccacugcacccggccgguggaaagca

SEQ ID NO: 358527 - RNA, 32 nt, Human
caugagccacugcaccugaccugcugaauugu

SEQ ID NO: 358528 - RNA, 32 nt, Human
caugagccacugcaccuggccuaggacuggug

SEQ ID NO: 358529 - RNA, 32 nt, Human
caugagccacugcacucaaccuuaagaccuac

SEQ ID NO: 358530 - RNA, 32 nt, Human
caugagccacugcgccagccuaaaguguguuc

SEQ ID NO: 358531 - RNA, 32 nt, Human
caugagccacugcgcccggccccuggagcaag

SEQ ID NO: 358532 - RNA, 32 nt, Human
caugagccacugcgcccggccugggucuccgu

SEQ ID NO: 358533 - RNA, 32 nt, Human
caugagccacugcgccuggccggacaauaaug

SEQ ID NO: 358534 - RNA, 32 nt, Human
caugagccacugcgccuggccucagaaugcau

SEQ ID NO: 358535 - RNA, 32 nt, Human
caugagccacugugccuggccugagggcuggu

SEQ ID NO: 358536 - RNA, 32 nt, Human
caugagccagagggaggaaguugaaaggauac

SEQ ID NO: 358537 - RNA, 32 nt, Human
caugagccauugcaccuggccaagaagagaca

SEQ ID NO: 358538 - RNA, 32 nt, Human
caugagcccagccagagccuccacugggcacu

SEQ ID NO: 358539 - RNA, 32 nt, Human
caugagcccaggagcccuauagauaaguggca

SEQ ID NO: 358540 - RNA, 32 nt, Human
caugagcccaggagguugaggcugcagugagg

SEQ ID NO: 358541 - RNA, 32 nt, Human
caugagcccaggaguucaaguucagccagagc

SEQ ID NO: 358542 - RNA, 32 nt, Human
caugagcccaggaguucgagaccaacuugggc

SEQ ID NO: 358543 - RNA, 32 nt, Human
caugagcccgggaggcggagauugcggugagc

SEQ ID NO: 358544 - RNA, 32 nt, Human
caugagcccuuuuucuccaguaguacaggcuu

SEQ ID NO: 358545 - RNA, 32 nt, Human
caugagccuaucucaugacuggcccuuucuaa

SEQ ID NO: 358546 - RNA, 32 nt, Human
caugagccucugccuggccccugcugcugucc

SEQ ID NO: 358547 - RNA, 32 nt, Human
caugagcuagguggaguaacugguuuuucuug

SEQ ID NO: 358548 - RNA, 32 nt, Human
caugagcucugacuucuuggugccagguuggu

SEQ ID NO: 358549 - RNA, 32 nt, Human
caugagcugagucucugccucugccucucccu

SEQ ID NO: 358550 - RNA, 32 nt, Human
caugagcugcgccucugugcucgccugccccc

SEQ ID NO: 358551 - RNA, 32 nt, Human
caugagcugcucaucacaguucuuuccucuuu

SEQ ID NO: 358552 - RNA, 32 nt, Human
caugagcugcucauuacaguucuuuccucuuu

SEQ ID NO: 358553 - RNA, 32 nt, Human
caugagcugcugccacuccagcaagggaaaua

SEQ ID NO: 358554 - RNA, 32 nt, Human
caugagcuggaaaaucucucuuagagaguugg

SEQ ID NO: 358555 - RNA, 32 nt, Human
caugagcuucagagucaaacagauguuggaga

SEQ ID NO: 358556 - RNA, 19 nt, Human
caugagcuucuccuguucu

SEQ ID NO: 358557 - RNA, 32 nt, Human
caugaggaaauguugaaccuaaagaagcuucu

SEQ ID NO: 358558 - RNA, 32 nt, Human
caugaggaaauguuguguucagaaaugaauaa

SEQ ID NO: 358559 - RNA, 20 nt, Human
caugaggaagucacagcaga

SEQ ID NO: 358560 - RNA, 32 nt, Human
caugaggagagauucaacuuacauggugagga

SEQ ID NO: 358561 - RNA, 32 nt, Human
caugaggaguggguggccuccucuccaucccc

SEQ ID NO: 358562 - RNA, 32 nt, Human
caugaggcacagccaagccaagcgcucauguu

SEQ ID NO: 358563 - RNA, 32 nt, Human
caugaggcacagccaagccaagugcucaugag

SEQ ID NO: 358564 - RNA, 32 nt, Human
caugaggcaccaaccucuccccgcagggcaaa

SEQ ID NO: 358565 - RNA, 32 nt, Human
caugaggcaccacugcacucuagccugggcaa

SEQ ID NO: 358566 - RNA, 32 nt, Human
caugaggcacccuggggaggacucaggacgag

SEQ ID NO: 358567 - RNA, 32 nt, Human
caugaggcaccuuugcuuucugcccagagugg

SEQ ID NO: 358568 - RNA, 26 nt, Human
caugaggcagaggccaccaucuacca

SEQ ID NO: 358569 - RNA, 32 nt, Human
caugaggccaggaguucaagaccagccuggcc

SEQ ID NO: 358570 - RNA, 32 nt, Human
caugaggcccacgccacccaaaccuuucacuu

SEQ ID NO: 358571 - RNA, 32 nt, Human
caugaggcuaaauauuuugaugaccaaguuuu

SEQ ID NO: 358572 - RNA, 32 nt, Human
caugaggcucagaugcuguugaagaaauaaau

SEQ ID NO: 358573 - RNA, 32 nt, Human
caugaggcucuaaggggacaugaguaaagcau

SEQ ID NO: 358574 - RNA, 32 nt, Human
caugagggacacucagcauucuuuucauagau

SEQ ID NO: 358575 - RNA, 32 nt, Human
caugagggagagaaaagaaugaggcuuaggac

SEQ ID NO: 358576 - RNA, 32 nt, Human
caugagggaggaaauuuuggaggcagaagcuc

SEQ ID NO: 358577 - RNA, 32 nt, Human
caugagggagggagggaggagggagaaaaaca

SEQ ID NO: 358578 - RNA, 32 nt, Human
caugagggcucacaccuguagucccagagcuu

SEQ ID NO: 358579 - RNA, 32 nt, Human
caugaggggaaagggagaagggugguaaauau

SEQ ID NO: 358580 - RNA, 32 nt, Human
caugaggggaagguauuuaauguguauuuuaa

SEQ ID NO: 358581 - RNA, 32 nt, Human
caugaggggagaggagacggaggggaguagag

SEQ ID NO: 358582 - RNA, 32 nt, Human
caugaggggauucccuuccuucuguugcuggu

SEQ ID NO: 358583 - RNA, 32 nt, Human
caugaggggcacauagggauccccuacaccgc

SEQ ID NO: 358584 - RNA, 32 nt, Human
caugaggguacacaccuguagucccagcuacu

SEQ ID NO: 358585 - RNA, 32 nt, Human
caugaggguuccaagugugcugaagaggacag

SEQ ID NO: 358586 - RNA, 32 nt, Human
caugagguacccuuugugucaccagcucaagc

SEQ ID NO: 358587 - RNA, 32 nt, Human
caugagguagguaggggucaggauguggacag

SEQ ID NO: 358588 - RNA, 20 nt, Human
caugaggucaagacuggguc

SEQ ID NO: 358589 - RNA, 32 nt, Human
caugaggucagcaguugagaccagccugaaca

SEQ ID NO: 358590 - RNA, 32 nt, Human
caugagguggagcagugaccagguggagcagu

SEQ ID NO: 358591 - RNA, 32 nt, Human
caugaggugucuuugcagaacaauaaauggca

SEQ ID NO: 358592 - RNA, 32 nt, Human
caugagguuagguggagugugcagggagguag

SEQ ID NO: 358593 - RNA, 22 nt, Human
caugagguucuguauucaguca

SEQ ID NO: 358594 - RNA, 32 nt, Human
caugagguuucaucauguuggccaggccgguc

SEQ ID NO: 358595 - RNA, 32 nt, Human
caugaguaaagaaaauguggauugaaguauag

SEQ ID NO: 358596 - RNA, 32 nt, Human
caugaguaacgugucugcucagacucugcuga

SEQ ID NO: 358597 - RNA, 24 nt, Human
caugaguaccacccugccugccuc

SEQ ID NO: 358598 - RNA, 32 nt, Human
caugaguacucuccugagcuauccucagccag

SEQ ID NO: 358599 - RNA, 32 nt, Human
caugaguagcaucagccagaacaugagaggga

SEQ ID NO: 358600 - RNA, 26 nt, Human
caugaguagggaggagaaacagaagc

SEQ ID NO: 358601 - RNA, 32 nt, Human
caugaguaugccgcugcacuccagccuggggg

SEQ ID NO: 358602 - RNA, 32 nt, Human
caugagucaaugcagccuccagccucgaccuc

SEQ ID NO: 358603 - RNA, 32 nt, Human
caugagucacucugaagccacucugaaaucac

SEQ ID NO: 358604 - RNA, 32 nt, Human
caugagucagaggcaccaccccucaccccagc

SEQ ID NO: 358605 - RNA, 32 nt, Human
caugaguccaggaguucgagaccagccuaggc

SEQ ID NO: 358606 - RNA, 17 nt, Human
caugagucccugcacug

SEQ ID NO: 358607 - RNA, 32 nt, Human
caugaguccucucacuuaaucucuccaauuua

SEQ ID NO: 358608 - RNA, 19 nt, Human
caugaguccugcagugcua

SEQ ID NO: 358609 - RNA, 17 nt, Human
caugagucggcugucua

SEQ ID NO: 358610 - RNA, 18 nt, Human
caugagucuaagguucug

SEQ ID NO: 358611 - RNA, 19 nt, Human
caugagucucuccucccua

SEQ ID NO: 358612 - RNA, 17 nt, Human
caugagucugauguucu

SEQ ID NO: 358613 - RNA, 18 nt, Human
caugagucugcugugcua

SEQ ID NO: 358614 - RNA, 18 nt, Human
caugagucuuaauguucu

SEQ ID NO: 358615 - RNA, 32 nt, Human
caugagucuuccagagaacacuguuuuauauu

SEQ ID NO: 358616 - RNA, 32 nt, Human
caugagugagccaccagcucuccacguucccc

SEQ ID NO: 358617 - RNA, 19 nt, Human
caugagugaucuuguucua

SEQ ID NO: 358618 - RNA, 32 nt, Human
caugagugcaauauuucauucccggugguugu

SEQ ID NO: 358619 - RNA, 32 nt, Human
caugagugcacaaucccugaacucacugucuu

SEQ ID NO: 358620 - RNA, 32 nt, Human
caugaguguaaugaaaucucaccagaaguguc

SEQ ID NO: 358621 - RNA, 32 nt, Human
caugaguguguaugugcuaacauguaggcugg

SEQ ID NO: 358622 - RNA, 32 nt, Human
caugaguuaaggaaagucaaaaaugaaaauau

SEQ ID NO: 358623 - RNA, 32 nt, Human
caugaguuaaugagugauuagaguacuaugag

SEQ ID NO: 358624 - RNA, 32 nt, Human
caugaguucacugcauucucccuuccccgccc

SEQ ID NO: 358625 - RNA, 32 nt, Human
caugaguucccccaacuggagugcagacaaga

SEQ ID NO: 358626 - RNA, 32 nt, Human
caugaguucugccucugugcccuugcuggccg

SEQ ID NO: 358627 - RNA, 32 nt, Human
caugaguugggggucgggugggggagggaaag

SEQ ID NO: 358628 - RNA, 32 nt, Human
caugaguuuuucagauggccacggugagggcu

SEQ ID NO: 358629 - RNA, 24 nt, Human
caugauaaaacaccaucucuacua

SEQ ID NO: 358630 - RNA, 21 nt, Human
caugauaacaagcugacacau

SEQ ID NO: 358631 - RNA, 24 nt, Human
caugauaacacaucccuguagucc

SEQ ID NO: 358632 - RNA, 32 nt, Human
caugauaagaggaggaagacauaaaguugggg

SEQ ID NO: 358633 - RNA, 32 nt, Human
caugauaagcagauugaauacaacaccagcag

SEQ ID NO: 358634 - RNA, 32 nt, Human
caugauacaguaauuuguuuacagaauccaaa

SEQ ID NO: 358635 - RNA, 32 nt, Human
caugauacaucuuuucucagugaacauaaaac

SEQ ID NO: 358636 - RNA, 32 nt, Human
caugauaccaggcccaggagaucaguaauuac

SEQ ID NO: 358637 - RNA, 32 nt, Human
caugauaccugcccaauuaagcagaaacacgu

SEQ ID NO: 358638 - RNA, 32 nt, Human
caugauagcaccacugcacuccagccugggug

SEQ ID NO: 358639 - RNA, 32 nt, Human
caugauagcaccacugcaguccagccugggcg

SEQ ID NO: 358640 - RNA, 32 nt, Human
caugauaggaagcauagcaaucuacccaggaa

SEQ ID NO: 358641 - RNA, 32 nt, Human
caugauauuuugcuuugauguguuucuacaug

SEQ ID NO: 358642 - RNA, 32 nt, Human
caugaucaaagucacucaacagaaagagacca

SEQ ID NO: 358643 - RNA, 32 nt, Human
caugaucacaccaccucacuccagccugggca

SEQ ID NO: 358644 - RNA, 32 nt, Human
caugaucacaccacugcaccccagccugggug

SEQ ID NO: 358645 - RNA, 32 nt, Human
caugaucacaccacugcacucuagccugggca

SEQ ID NO: 358646 - RNA, 32 nt, Human
caugaucacgauccugcacuccagccugggca

SEQ ID NO: 358647 - RNA, 23 nt, Human
caugaucagccuccagccauaca

SEQ ID NO: 358648 - RNA, 32 nt, Human
caugaucaguguaugcgaaaagguuuuuagga

SEQ ID NO: 358649 - RNA, 32 nt, Human
caugaucauaccacugcacuccagccugggug

SEQ ID NO: 358650 - RNA, 32 nt, Human
caugaucaugccacugcacuccagccugggca

SEQ ID NO: 358651 - RNA, 32 nt, Human
caugaucaugccacugcacuccagucuggaug

SEQ ID NO: 358652 - RNA, 32 nt, Human
caugaucaugccacugcacuccauccugggug

SEQ ID NO: 358653 - RNA, 32 nt, Human
caugaucaugccacugcacuccuccgugggug

SEQ ID NO: 358654 - RNA, 32 nt, Human
caugaucaugccacugcacucugggcugggua

SEQ ID NO: 358655 - RNA, 32 nt, Human
caugaucaugccacugcauuccagccugggca

SEQ ID NO: 358656 - RNA, 32 nt, Human
caugaucaugccacuguacugcagacugagug

SEQ ID NO: 358657 - RNA, 32 nt, Human
caugauccagucugugacuaccagccaaccug

SEQ ID NO: 358658 - RNA, 32 nt, Human
caugaucccaggaguuuaagaccagccugggc

SEQ ID NO: 358659 - RNA, 32 nt, Human
caugaucccaggcuggaggaagcagcaggcua

SEQ ID NO: 358660 - RNA, 32 nt, Human
caugauccuaccacugcacuucagccuaggug

SEQ ID NO: 358661 - RNA, 32 nt, Human
caugauccuccccucccugagauguuccuccu

SEQ ID NO: 358662 - RNA, 32 nt, Human
caugauccuugcuucccuuuccagucacccuu

SEQ ID NO: 358663 - RNA, 32 nt, Human
caugaucgagccacugcacuccagccugggca

SEQ ID NO: 358664 - RNA, 32 nt, Human
caugaucgaguuacugcacuccagccugggug

SEQ ID NO: 358665 - RNA, 32 nt, Human
caugaucgcaccacugcacuccagccuaggcg

SEQ ID NO: 358666 - RNA, 32 nt, Human
caugaucgcaccacugcacucuagccugggug

SEQ ID NO: 358667 - RNA, 32 nt, Human
caugaucgcaccauugcacuccagccugagug

SEQ ID NO: 358668 - RNA, 32 nt, Human
caugaucgcgacacugcacuccagccugggug

SEQ ID NO: 358669 - RNA, 32 nt, Human
caugaucgcgccacugcacuccagcccgggug

SEQ ID NO: 358670 - RNA, 32 nt, Human
caugaucgugccacuacacuccagccugggug

SEQ ID NO: 358671 - RNA, 32 nt, Human
caugaucucaccaugcacuccagccuagacaa

SEQ ID NO: 358672 - RNA, 32 nt, Human
caugaucucaccgauggcucacugugaccucc

SEQ ID NO: 358673 - RNA, 32 nt, Human
caugaucucacugcaaccuccaucuccugucu

SEQ ID NO: 358674 - RNA, 32 nt, Human
caugaucucagcuccgccuccuggguucacgu

SEQ ID NO: 358675 - RNA, 19 nt, Human
caugaucucagcucgcugc

SEQ ID NO: 358676 - RNA, 23 nt, Human
caugaucucagugaaucucacca

SEQ ID NO: 358677 - RNA, 20 nt, Human
caugaucucggcucgcuaca

SEQ ID NO: 358678 - RNA, 19 nt, Human
caugaucucggcucgcugc

SEQ ID NO: 358679 - RNA, 32 nt, Human
caugaucugacuuuaauugugugucuucuauu

SEQ ID NO: 358680 - RNA, 32 nt, Human
caugaucugcaaucucugccucccagguucaa

SEQ ID NO: 358681 - RNA, 32 nt, Human
caugaucuguacuuccacgugacugggugcug

SEQ ID NO: 358682 - RNA, 32 nt, Human
caugaucuucaagcagggaagccccagugagu

SEQ ID NO: 358683 - RNA, 22 nt, Human
caugaucuucugggacucacca

SEQ ID NO: 358684 - RNA, 32 nt, Human
caugaucuuggcugacugcaaucugugccucc

SEQ ID NO: 358685 - RNA, 24 nt, Human
caugaugaaacccagucucuacua

SEQ ID NO: 358686 - RNA, 19 nt, Human
caugaugaaaccccaucuc

SEQ ID NO: 358687 - RNA, 24 nt, Human
caugaugaaaccccaucuccacug

SEQ ID NO: 358688 - RNA, 22 nt, Human
caugaugaaaccccgucucuac

SEQ ID NO: 358689 - RNA, 24 nt, Human
caugaugaaaccccgucucuacua

SEQ ID NO: 358690 - RNA, 24 nt, Human
caugaugaaaccccguuucuacua

SEQ ID NO: 358691 - RNA, 24 nt, Human
caugaugaaacccuaucucuacua

SEQ ID NO: 358692 - RNA, 22 nt, Human
caugaugaaacccugucuacua

SEQ ID NO: 358693 - RNA, 21 nt, Human
caugaugaaacccugucucua

SEQ ID NO: 358694 - RNA, 22 nt, Human
caugaugaaacccugucucuac

SEQ ID NO: 358695 - RNA, 24 nt, Human
caugaugaaacccugucucuacua

SEQ ID NO: 358696 - RNA, 22 nt, Human
caugaugaaacccuugucucua

SEQ ID NO: 358697 - RNA, 24 nt, Human
caugaugaaaccuugucucuacua

SEQ ID NO: 358698 - RNA, 24 nt, Human
caugaugaaacuccgucucuacua

SEQ ID NO: 358699 - RNA, 24 nt, Human
caugaugaaaugccaucuccacua

SEQ ID NO: 358700 - RNA, 32 nt, Human
caugaugaacccagcagcuucuaguucauccc

SEQ ID NO: 358701 - RNA, 32 nt, Human
caugaugacgggugccuguaaucccagcuacu

SEQ ID NO: 358702 - RNA, 32 nt, Human
caugaugagauggaaaccaaaagggagucucc

SEQ ID NO: 358703 - RNA, 32 nt, Human
caugaugaugggccccuguaaucccagcuacu

SEQ ID NO: 358704 - RNA, 32 nt, Human
caugaugcagugagucuccugccaucuaagcu

SEQ ID NO: 358705 - RNA, 32 nt, Human
caugaugccaggcuaauuuuuguauuuuuauu

SEQ ID NO: 358706 - RNA, 32 nt, Human
caugaugcgugcacacgcgcuuggggguuggc

SEQ ID NO: 358707 - RNA, 32 nt, Human
caugauggaaaaaucauaguagauggaaauau

SEQ ID NO: 358708 - RNA, 32 nt, Human
caugauggagaaauagcacucuagccuuaguc

SEQ ID NO: 358709 - RNA, 24 nt, Human
caugauggagggugccuuuagucc

SEQ ID NO: 358710 - RNA, 32 nt, Human
caugauggagugaugcccugcccugcuucccc

SEQ ID NO: 358711 - RNA, 32 nt, Human
caugauggauuuggaaacuuacuggcuagcua

SEQ ID NO: 358712 - RNA, 23 nt, Human
caugauggcacacaccuguaauc

SEQ ID NO: 358713 - RNA, 24 nt, Human
caugauggcacacaccuguaaucu

SEQ ID NO: 358714 - RNA, 32 nt, Human
caugauggcacacaccuguaaucucaguuacu

SEQ ID NO: 358715 - RNA, 24 nt, Human
caugauggcacacaccuguagucc

SEQ ID NO: 358716 - RNA, 32 nt, Human
caugauggcacacaccuguaguccgagccacu

SEQ ID NO: 358717 - RNA, 24 nt, Human
caugauggcacaugccuguaaucc

SEQ ID NO: 358718 - RNA, 32 nt, Human
caugauggcacaugccuguaaucccagauacu

SEQ ID NO: 358719 - RNA, 24 nt, Human
caugauggcacaugccuguaaucu

SEQ ID NO: 358720 - RNA, 32 nt, Human
caugauggcacaugccuguaaucucagcgacu

SEQ ID NO: 358721 - RNA, 32 nt, Human
caugauggcaccacugcacuccagccugggca

SEQ ID NO: 358722 - RNA, 24 nt, Human
caugauggcacgcaccugcagucc

SEQ ID NO: 358723 - RNA, 32 nt, Human
caugauggcaggcaccuguaaucccagcuacu

SEQ ID NO: 358724 - RNA, 24 nt, Human
caugauggcaggcgccuguagucc

SEQ ID NO: 358725 - RNA, 22 nt, Human
caugauggccacaggucagucc

SEQ ID NO: 358726 - RNA, 24 nt, Human
caugauggcccauacuuguaaucc

SEQ ID NO: 358727 - RNA, 32 nt, Human
caugauggcccauacuuguaaucccagcuauu

SEQ ID NO: 358728 - RNA, 32 nt, Human
caugauggccccagccuguaaucccagugauu

SEQ ID NO: 358729 - RNA, 24 nt, Human
caugauggccggugccuguaaucc

SEQ ID NO: 358730 - RNA, 24 nt, Human
caugauggcgagugucuguaaucc

SEQ ID NO: 358731 - RNA, 32 nt, Human
caugauggcgagugucuguaaucccagcuacu

SEQ ID NO: 358732 - RNA, 24 nt, Human
caugauggcgcaugccuauaaucc

SEQ ID NO: 358733 - RNA, 32 nt, Human
caugauggcgcaugccuauaaucccagcuacu

SEQ ID NO: 358734 - RNA, 32 nt, Human
caugauggcgcgugccuguaaucccagcuacu

SEQ ID NO: 358735 - RNA, 24 nt, Human
caugauggcgggugccuguaaucc

SEQ ID NO: 358736 - RNA, 32 nt, Human
caugauggcgggugccuguaaucccagcuacu

SEQ ID NO: 358737 - RNA, 24 nt, Human
caugauggcgugugccuguagucc

SEQ ID NO: 358738 - RNA, 23 nt, Human
caugauggcucacaccuguaauc

SEQ ID NO: 358739 - RNA, 24 nt, Human
caugauggcucacaccuguaaucc

SEQ ID NO: 358740 - RNA, 32 nt, Human
caugauggcucacaccuguaaucccagcuacu

SEQ ID NO: 358741 - RNA, 32 nt, Human
caugauggcucacuccuguaaucccaacacuu

SEQ ID NO: 358742 - RNA, 20 nt, Human
caugauggcucaugccugua

SEQ ID NO: 358743 - RNA, 32 nt, Human
caugauggcucaugccuguaaugccagcacuu

SEQ ID NO: 358744 - RNA, 32 nt, Human
caugaugggacuuauucuguagcuaaucugau

SEQ ID NO: 358745 - RNA, 32 nt, Human
caugaugggcaggugagggcaggauggagacc

SEQ ID NO: 358746 - RNA, 32 nt, Human
caugaugggcuaacacccaucucuacuaaaaa

SEQ ID NO: 358747 - RNA, 32 nt, Human
caugauggggagugagcagcaggaaggggcuc

SEQ ID NO: 358748 - RNA, 24 nt, Human
caugauggggugugccuguagucc

SEQ ID NO: 358749 - RNA, 24 nt, Human
caugauggugagcgccugcagucc

SEQ ID NO: 358750 - RNA, 23 nt, Human
caugauggugcacaccuguggcc

SEQ ID NO: 358751 - RNA, 32 nt, Human
caugauggugcacaccuguggccccagcuucu

SEQ ID NO: 358752 - RNA, 32 nt, Human
caugauggugcacgccuguaaucucagcuacu

SEQ ID NO: 358753 - RNA, 24 nt, Human
caugauggugcaugccuauaaucc

SEQ ID NO: 358754 - RNA, 24 nt, Human
caugauggugcaugccuauagucc

SEQ ID NO: 358755 - RNA, 24 nt, Human
caugauggugcaugccuguagucu

SEQ ID NO: 358756 - RNA, 32 nt, Human
caugauggugccacugcacuccagccuggggg

SEQ ID NO: 358757 - RNA, 24 nt, Human
caugauggugggcaccuguaaucc

SEQ ID NO: 358758 - RNA, 32 nt, Human
caugauggugggcaccuguaaucccagcuacu

SEQ ID NO: 358759 - RNA, 24 nt, Human
caugauggugguggccuguaaucc

SEQ ID NO: 358760 - RNA, 32 nt, Human
caugauggugguggccuguaaucccagcuacu

SEQ ID NO: 358761 - RNA, 24 nt, Human
caugauggugugcaccuguagucc

SEQ ID NO: 358762 - RNA, 32 nt, Human
caugauggugugcaccuguagucccagcuacu

SEQ ID NO: 358763 - RNA, 32 nt, Human
caugauggugugugcuuguaaucccagcuacu

SEQ ID NO: 358764 - RNA, 32 nt, Human
caugauguaaaaauuugcuuuaaaccauucau

SEQ ID NO: 358765 - RNA, 32 nt, Human
caugaugucagaggccagaguuuggugggggc

SEQ ID NO: 358766 - RNA, 19 nt, Human
caugaugucggcucacugc

SEQ ID NO: 358767 - RNA, 32 nt, Human
caugaugucugcccuccaccucucuggcaaug

SEQ ID NO: 358768 - RNA, 32 nt, Human
caugaugucuuuccuuucaccuccugcguugu

SEQ ID NO: 358769 - RNA, 31 nt, Human
caugaugugacaaucucgaucgaucauggac

SEQ ID NO: 358770 - RNA, 32 nt, Human
caugaugugagcaucuccuccuuaucccucga

SEQ ID NO: 358771 - RNA, 32 nt, Human
caugauguugugaccgcacagcacuuugcguc

SEQ ID NO: 358772 - RNA, 32 nt, Human
caugauguuugaagcuuacuuccaaaugguuc

SEQ ID NO: 358773 - RNA, 32 nt, Human
caugauuaaugccaccccugccucaaugaacc

SEQ ID NO: 358774 - RNA, 32 nt, Human
caugauuacgccacugcauuguagccugggca

SEQ ID NO: 358775 - RNA, 32 nt, Human
caugauuacuccacugcacuccagccugggca

SEQ ID NO: 358776 - RNA, 32 nt, Human
caugauuaugcugcugcacuccagccuggaca

SEQ ID NO: 358777 - RNA, 32 nt, Human
caugauucacauguggcaucagucccaucagc

SEQ ID NO: 358778 - RNA, 32 nt, Human
caugauuccuacauagaggcucugcuggucaa

SEQ ID NO: 358779 - RNA, 32 nt, Human
caugauuccucuggacugcacacagcacccac

SEQ ID NO: 358780 - RNA, 32 nt, Human
caugauuccuuuaacaacauguuuccagcauu

SEQ ID NO: 358781 - RNA, 32 nt, Human
caugauucuaaguuuccugaggccuccccaga

SEQ ID NO: 358782 - RNA, 32 nt, Human
caugauucucucuugaugaagaaaugacauau

SEQ ID NO: 358783 - RNA, 32 nt, Human
caugauugcaccacugcacuccagccuggaaa

SEQ ID NO: 358784 - RNA, 32 nt, Human
caugauugcaccacugcacuccagccugggca

SEQ ID NO: 358785 - RNA, 32 nt, Human
caugauugcaccacugcacuccagccugggug

SEQ ID NO: 358786 - RNA, 32 nt, Human
caugauugcaccacugcacuccagucugguug

SEQ ID NO: 358787 - RNA, 32 nt, Human
caugauugcaccacugcacucuaacuugggca

SEQ ID NO: 358788 - RNA, 32 nt, Human
caugauugcaccacuguacuccagccugggca

SEQ ID NO: 358789 - RNA, 32 nt, Human
caugauugcaccccugcacuccagccugggug

SEQ ID NO: 358790 - RNA, 32 nt, Human
caugauugcacuccaaccugggcgacagagac

SEQ ID NO: 358791 - RNA, 32 nt, Human
caugauugcacugucgcacuccagccuggaug

SEQ ID NO: 358792 - RNA, 32 nt, Human
caugauugccuccccuugcagcuuucccuacu

SEQ ID NO: 358793 - RNA, 24 nt, Human
caugauugcgcaugccuguaaucc

SEQ ID NO: 358794 - RNA, 32 nt, Human
caugauugcgccacugcacuccagccugggca

SEQ ID NO: 358795 - RNA, 32 nt, Human
caugauuggaaguuuccugaggccuccccagc

SEQ ID NO: 358796 - RNA, 32 nt, Human
caugauuguaaguguccugaggccucccagcc

SEQ ID NO: 358797 - RNA, 32 nt, Human
caugauuguaaguuuccugaggccucccaguc

SEQ ID NO: 358798 - RNA, 32 nt, Human
caugauuguaaguuuccugaggccuccccaga

SEQ ID NO: 358799 - RNA, 32 nt, Human
caugauuguaaguuuccugaggccuccccagc

SEQ ID NO: 358800 - RNA, 32 nt, Human
caugauuguaaguuuccugaggccuccccagu

SEQ ID NO: 358801 - RNA, 32 nt, Human
caugauuguaaguuuccugaggccucccccgc

SEQ ID NO: 358802 - RNA, 32 nt, Human
caugauuguaaguuuccugaggccuccccugc

SEQ ID NO: 358803 - RNA, 32 nt, Human
caugauuguaaguuuccugaggccucccuaga

SEQ ID NO: 358804 - RNA, 32 nt, Human
caugauuguaaguuuccugaggccucccuagc

SEQ ID NO: 358805 - RNA, 32 nt, Human
caugauuguaccugucucuuccuggguaaagg

SEQ ID NO: 358806 - RNA, 32 nt, Human
caugauuguaugacugcacuccagccugggug

SEQ ID NO: 358807 - RNA, 32 nt, Human
caugauugucaguuuccugaggccucccagcc

SEQ ID NO: 358808 - RNA, 32 nt, Human
caugauugucauuccacuccagguccuggcaa

SEQ ID NO: 358809 - RNA, 32 nt, Human
caugauugugccacugcacuccagccuuggca

SEQ ID NO: 358810 - RNA, 32 nt, Human
caugauugugccacugcacuccagcuugguga

SEQ ID NO: 358811 - RNA, 32 nt, Human
caugauugugccacugcacuccagucuggaca

SEQ ID NO: 358812 - RNA, 32 nt, Human
caugauugugcuacugcacuccaaucuggcaa

SEQ ID NO: 358813 - RNA, 18 nt, Human
caugauuuacagcuguga

SEQ ID NO: 358814 - RNA, 32 nt, Human
caugauuucccaccugcccuccaagaaaaugg

SEQ ID NO: 358815 - RNA, 32 nt, Human
caugauuucccacugcacuccagccugaguga

SEQ ID NO: 358816 - RNA, 32 nt, Human
caugauuucuuccuccucuucagugugguaga

SEQ ID NO: 358817 - RNA, 32 nt, Human
caugauuugccuuuuuguguuugcuuuuguuu

SEQ ID NO: 358818 - RNA, 32 nt, Human
caugauuuggggaaaggagcaagucagaauag

SEQ ID NO: 358819 - RNA, 32 nt, Human
caugauuugucuccagaacggcagcaggaaag

SEQ ID NO: 358820 - RNA, 32 nt, Human
caugauuuuaaguuuccugaggccuccccagc

SEQ ID NO: 358821 - RNA, 32 nt, Human
caugauuuuaaguuuccugaggccuccccagu

SEQ ID NO: 358822 - RNA, 32 nt, Human
caugauuuuggugucaucaccucccaagaccc

SEQ ID NO: 358823 - RNA, 32 nt, Human
caugcaaaaagucacacuagaggaaugccaua

SEQ ID NO: 358824 - RNA, 23 nt, Human
caugcaaaaccccgucuccacua

SEQ ID NO: 358825 - RNA, 32 nt, Human
caugcaaaauucuuuaucauacucaaucauuu

SEQ ID NO: 358826 - RNA, 32 nt, Human
caugcaaacuguuccuguuuacauaccuucuc

SEQ ID NO: 358827 - RNA, 32 nt, Human
caugcaaagauccuaggagacaguccccauag

SEQ ID NO: 358828 - RNA, 32 nt, Human
caugcaaaguuaaaagcacauugugccuccuu

SEQ ID NO: 358829 - RNA, 32 nt, Human
caugcaaauacugaagcacuaaacaaggaggg

SEQ ID NO: 358830 - RNA, 32 nt, Human
caugcaaaucacccccgggagugcagcugggc

SEQ ID NO: 358831 - RNA, 32 nt, Human
caugcaaauuugcuaaucagagcccagagcug

SEQ ID NO: 358832 - RNA, 32 nt, Human
caugcaacagccgcccccgcaggcagggggcu

SEQ ID NO: 358833 - RNA, 18 nt, Human
caugcaacaggcccagug

SEQ ID NO: 358834 - RNA, 19 nt, Human
caugcaacaggcccagugg

SEQ ID NO: 358835 - RNA, 32 nt, Human
caugcaaccauuccucacgccaccgccacauc

SEQ ID NO: 358836 - RNA, 32 nt, Human
caugcaacccccaagggcugcagguuggacaa

SEQ ID NO: 358837 - RNA, 20 nt, Human
caugcaagaaguacugccaa

SEQ ID NO: 358838 - RNA, 32 nt, Human
caugcaagacaacauagccacagguggggauu

SEQ ID NO: 358839 - RNA, 31 nt, Human
caugcaagacuucucugucaggguugcuccu

SEQ ID NO: 358840 - RNA, 32 nt, Human
caugcaagccucugccuuuccuucugcuccag

SEQ ID NO: 358841 - RNA, 32 nt, Human
caugcaagccugggcaauagagcgagacuccg

SEQ ID NO: 358842 - RNA, 32 nt, Human
caugcaaggccuucucugggugacagugacga

SEQ ID NO: 358843 - RNA, 32 nt, Human
caugcaagggucaggucuccagcagacccuga

SEQ ID NO: 358844 - RNA, 32 nt, Human
caugcaagucaugggucacaccugacaaaugg

SEQ ID NO: 358845 - RNA, 32 nt, Human
caugcaaguuaggaauaugaagaaccacaaag

SEQ ID NO: 358846 - RNA, 32 nt, Human
caugcaauagacuugcucggagcccagcacuc

SEQ ID NO: 358847 - RNA, 32 nt, Human
caugcaaucugggggagucaccucucagcucu

SEQ ID NO: 358848 - RNA, 32 nt, Human
caugcaaugugcugccuucuguuguggauuuc

SEQ ID NO: 358849 - RNA, 32 nt, Human
caugcaauugcacuccagccugggcaacaaga

SEQ ID NO: 358850 - RNA, 32 nt, Human
caugcacacaaaauuagcugggcaugguggcc

SEQ ID NO: 358851 - RNA, 32 nt, Human
caugcacacacaugcacacauacacgcacaug

SEQ ID NO: 358852 - RNA, 32 nt, Human
caugcacacacccuccuuccccuagcaaaacg

SEQ ID NO: 358853 - RNA, 32 nt, Human
caugcacacacgcacacaugcacacacacgca

SEQ ID NO: 358854 - RNA, 32 nt, Human
caugcacacacguguacaccacaaacgagcuc

SEQ ID NO: 358855 - RNA, 32 nt, Human
caugcacacacguguagcucacacacaguaua

SEQ ID NO: 358856 - RNA, 32 nt, Human
caugcacacagcacaauucagaaauacccagg

SEQ ID NO: 358857 - RNA, 32 nt, Human
caugcacacaugcaugcacacucacauacacu

SEQ ID NO: 358858 - RNA, 32 nt, Human
caugcacacaugcaugcacacucauacacuca

SEQ ID NO: 358859 - RNA, 20 nt, Human
caugcacacgcauguaugua

SEQ ID NO: 358860 - RNA, 32 nt, Human
caugcacacugacucugaacugggugaacucu

SEQ ID NO: 358861 - RNA, 20 nt, Human
caugcacagugccuggggcg

SEQ ID NO: 358862 - RNA, 32 nt, Human
caugcacagugcugcagaaacuggacaguucc

SEQ ID NO: 358863 - RNA, 32 nt, Human
caugcacauagacacacacaugaacacacuga

SEQ ID NO: 358864 - RNA, 32 nt, Human
caugcacauaugugccuuggguguauguaacu

SEQ ID NO: 358865 - RNA, 32 nt, Human
caugcacaucuguagccccagccauccuugug

SEQ ID NO: 358866 - RNA, 32 nt, Human
caugcacaugauuuuaaagguucugacaacug

SEQ ID NO: 358867 - RNA, 32 nt, Human
caugcacaugcugucuggcccuggggaucuuc

SEQ ID NO: 358868 - RNA, 32 nt, Human
caugcacccacugccagcugagagcugcuucc

SEQ ID NO: 358869 - RNA, 32 nt, Human
caugcacccccacaguacccaggcugggucug

SEQ ID NO: 358870 - RNA, 32 nt, Human
caugcacccugcucccuucugccagccugcau

SEQ ID NO: 358871 - RNA, 32 nt, Human
caugcaccuguaaucccagcuacuugggaggc

SEQ ID NO: 358872 - RNA, 32 nt, Human
caugcacgcacacacacauauggggaccugcg

SEQ ID NO: 358873 - RNA, 32 nt, Human
caugcacgcuugcacacaugcacacagaccac

SEQ ID NO: 358874 - RNA, 32 nt, Human
caugcacggcuccacagcaggugguggggagc

SEQ ID NO: 358875 - RNA, 32 nt, Human
caugcacgugcacacacauacacacacaucca

SEQ ID NO: 358876 - RNA, 22 nt, Human
caugcacguucccccugggcca

SEQ ID NO: 358877 - RNA, 32 nt, Human
caugcacucacacccacgcaggcacucacauu

SEQ ID NO: 358878 - RNA, 32 nt, Human
caugcacuccuucuccccaaggccagggcaga

SEQ ID NO: 358879 - RNA, 32 nt, Human
caugcacugugaacuucuguggcuucaguucu

SEQ ID NO: 358880 - RNA, 32 nt, Human
caugcacuuggguuuuaaucagcaguucccua

SEQ ID NO: 358881 - RNA, 32 nt, Human
caugcacuuuacuguuucuagucucaaaaugu

SEQ ID NO: 358882 - RNA, 32 nt, Human
caugcagaccucaaggaggcucccuagcaaca

SEQ ID NO: 358883 - RNA, 32 nt, Human
caugcagagaagcagagaagaagaaaggagcu

SEQ ID NO: 358884 - RNA, 32 nt, Human
caugcagagaggaggagguggagcaggagugg

SEQ ID NO: 358885 - RNA, 32 nt, Human
caugcagagaggaggaguuggaggaagauugu

SEQ ID NO: 358886 - RNA, 32 nt, Human
caugcagagaggaggggugagagggcacggcu

SEQ ID NO: 358887 - RNA, 32 nt, Human
caugcagagcgaagccaccaagacuuuaugcg

SEQ ID NO: 358888 - RNA, 32 nt, Human
caugcagaggugcucuccuccuuucucagcca

SEQ ID NO: 358889 - RNA, 32 nt, Human
caugcagagugacugaaacacaauucauuucu

SEQ ID NO: 358890 - RNA, 32 nt, Human
caugcagaguucagccuacauguucauugagg

SEQ ID NO: 358891 - RNA, 32 nt, Human
caugcagauguaggggcucugaugggggcugu

SEQ ID NO: 358892 - RNA, 32 nt, Human
caugcagcagacugggcucgccacuuucuugc

SEQ ID NO: 358893 - RNA, 26 nt, Human
caugcagcagcagccucugcccgggc

SEQ ID NO: 358894 - RNA, 32 nt, Human
caugcagcaguuagaguggggcugacucuuag

SEQ ID NO: 358895 - RNA, 26 nt, Human
caugcagcauuuuccaccugccccga

SEQ ID NO: 358896 - RNA, 32 nt, Human
caugcagccacuuaggacaaaucugcaaagca

SEQ ID NO: 358897 - RNA, 32 nt, Human
caugcagcccacagaagcagagcccauggagc

SEQ ID NO: 358898 - RNA, 32 nt, Human
caugcagccccuccucaacaagcagagugaug

SEQ ID NO: 358899 - RNA, 32 nt, Human
caugcagccccuucccuucccuucccuucccu

SEQ ID NO: 358900 - RNA, 32 nt, Human
caugcagcccucuccucgagcacgucacacac

SEQ ID NO: 358901 - RNA, 32 nt, Human
caugcagcuucaccccucacaaagccaugcac

SEQ ID NO: 358902 - RNA, 32 nt, Human
caugcagcuucccuacauuacacacacucagg

SEQ ID NO: 358903 - RNA, 32 nt, Human
caugcaggagguggaggaauuaagugaaacag

SEQ ID NO: 358904 - RNA, 32 nt, Human
caugcaggcagaagcaguugguggugucuggu

SEQ ID NO: 358905 - RNA, 32 nt, Human
caugcaggcccuuugaagccucagcuacccac

SEQ ID NO: 358906 - RNA, 26 nt, Human
caugcaggccgaaggccagggcacag

SEQ ID NO: 358907 - RNA, 32 nt, Human
caugcaggcucaacauaacauaagcuagaaaa

SEQ ID NO: 358908 - RNA, 32 nt, Human
caugcaggcugguggugauggguucugugugg

SEQ ID NO: 358909 - RNA, 32 nt, Human
caugcagggcacugucgugagcacaccagugg

SEQ ID NO: 358910 - RNA, 32 nt, Human
caugcagggcgcagacugccacucuguuccca

SEQ ID NO: 358911 - RNA, 32 nt, Human
caugcagggggaaaguugauuaauuuuugucc

SEQ ID NO: 358912 - RNA, 32 nt, Human
caugcagggggugggagcagggucacaaaagu

SEQ ID NO: 358913 - RNA, 32 nt, Human
caugcagggugagggaaaggguagaggucuuu

SEQ ID NO: 358914 - RNA, 32 nt, Human
caugcaggucauguuucaaaucaaggcugaaa

SEQ ID NO: 358915 - RNA, 19 nt, Human
caugcagucuccugucuca

SEQ ID NO: 358916 - RNA, 32 nt, Human
caugcagucuucccucagccuccugaguagcu

SEQ ID NO: 358917 - RNA, 20 nt, Human
caugcagugccggcugccaa

SEQ ID NO: 358918 - RNA, 32 nt, Human
caugcaguggcggcuacugggcccugcccagc

SEQ ID NO: 358919 - RNA, 17 nt, Human
caugcagugugcugcca

SEQ ID NO: 358920 - RNA, 32 nt, Human
caugcaguuaaaaagucaacaaaaugaauuuc

SEQ ID NO: 358921 - RNA, 32 nt, Human
caugcaguuaaacucauugucuguuuggaaga

SEQ ID NO: 358922 - RNA, 32 nt, Human
caugcauacacacagacauacacaugcacuca

SEQ ID NO: 358923 - RNA, 32 nt, Human
caugcauauagacagagcaugcagugaagagu

SEQ ID NO: 358924 - RNA, 32 nt, Human
caugcauauuuggaauuguuauacuuuguugc

SEQ ID NO: 358925 - RNA, 32 nt, Human
caugcauauuugugaagaaacacccuuguuug

SEQ ID NO: 358926 - RNA, 32 nt, Human
caugcaucacagacuguauuugauugauucga

SEQ ID NO: 358927 - RNA, 32 nt, Human
caugcaucacucucccuucugccuccuucaac

SEQ ID NO: 358928 - RNA, 32 nt, Human
caugcaucagcccaagauccuuuacuuagaag

SEQ ID NO: 358929 - RNA, 32 nt, Human
caugcaucagcucuuucaacauuuacagcauc

SEQ ID NO: 358930 - RNA, 32 nt, Human
caugcaucaugccucaccuaaggaaacauaaa

SEQ ID NO: 358931 - RNA, 32 nt, Human
caugcaucuagggcggagaggcugcacuugug

SEQ ID NO: 358932 - RNA, 32 nt, Human
caugcaucuguaacccagcuauucaagaggcu

SEQ ID NO: 358933 - RNA, 32 nt, Human
caugcaucuguaacuugcuuuucccguguaag

SEQ ID NO: 358934 - RNA, 32 nt, Human
caugcaugacaaacacagauugggggcgaagg

SEQ ID NO: 358935 - RNA, 28 nt, Human
caugcaugacagagugagacccugucuc

SEQ ID NO: 358936 - RNA, 32 nt, Human
caugcaugcaaauguccacugcagcacuauuc

SEQ ID NO: 358937 - RNA, 32 nt, Human
caugcaugcacacacaugcacacauacacgca

SEQ ID NO: 358938 - RNA, 32 nt, Human
caugcaugcacacauacauacauauguauaca

SEQ ID NO: 358939 - RNA, 32 nt, Human
caugcaugcacacucacauacacucacucgug

SEQ ID NO: 358940 - RNA, 32 nt, Human
caugcaugcaugcacacacgagcauacuugua

SEQ ID NO: 358941 - RNA, 32 nt, Human
caugcaugcaugcacacgugcgugcguguuug

SEQ ID NO: 358942 - RNA, 32 nt, Human
caugcaugcauucauccgugacacaugaguac

SEQ ID NO: 358943 - RNA, 32 nt, Human
caugcauguaguuccagcuacucaggaggcug

SEQ ID NO: 358944 - RNA, 29 nt, Human
caugcauguauguaggugccuggggagug

SEQ ID NO: 358945 - RNA, 32 nt, Human
caugcauguggauagacccccacgggccgugg

SEQ ID NO: 358946 - RNA, 32 nt, Human
caugcauguguguguacacguguauaggugua

SEQ ID NO: 358947 - RNA, 32 nt, Human
caugcauguugcuaucaggauguugauucauu

SEQ ID NO: 358948 - RNA, 32 nt, Human
caugcauuacacacaugcacacacauaugcac

SEQ ID NO: 358949 - RNA, 32 nt, Human
caugcauucacacacacauauguacaugcaca

SEQ ID NO: 358950 - RNA, 19 nt, Human
caugcauugcacgcugcca

SEQ ID NO: 358951 - RNA, 32 nt, Human
caugcauugcucaaagcuggcuuuucacauua

SEQ ID NO: 358952 - RNA, 20 nt, Human
caugcauuguuaaucaucca

SEQ ID NO: 358953 - RNA, 32 nt, Human
caugcauuugcuuaccuaaaauuuaaguuuca

SEQ ID NO: 358954 - RNA, 21 nt, Human
caugccaaacugacuguuuua

SEQ ID NO: 358955 - RNA, 32 nt, Human
caugccaaagaaugaggcuggagacagguagc

SEQ ID NO: 358956 - RNA, 32 nt, Human
caugccaaagugcugcuaugggcugcuuugug

SEQ ID NO: 358957 - RNA, 20 nt, Human
caugccaacugugcuguguc

SEQ ID NO: 358958 - RNA, 32 nt, Human
caugccaagcagagacugggauuagggguucu

SEQ ID NO: 358959 - RNA, 32 nt, Human
caugccaagcugagcaugcugcuccaaauaaa

SEQ ID NO: 358960 - RNA, 32 nt, Human
caugccaaggcgggaggugaggcugcacuucg

SEQ ID NO: 358961 - RNA, 32 nt, Human
caugccaagguaagagagagccuggaccacuc

SEQ ID NO: 358962 - RNA, 32 nt, Human
caugccaaugcacuccagucugggcaacagag

SEQ ID NO: 358963 - RNA, 32 nt, Human
caugccaauguauuccagucugggugacagag

SEQ ID NO: 358964 - RNA, 32 nt, Human
caugccaaugugccaggcaccauauuuauucu

SEQ ID NO: 358965 - RNA, 32 nt, Human
caugccacaacuccucaggacacaugugggcc

SEQ ID NO: 358966 - RNA, 32 nt, Human
caugccacaacuccucaggacacauguguggg

SEQ ID NO: 358967 - RNA, 32 nt, Human
caugccacaccguacuccagccugggcgacau

SEQ ID NO: 358968 - RNA, 32 nt, Human
caugccacaggguuuggcugggaccagugaaa

SEQ ID NO: 358969 - RNA, 32 nt, Human
caugccacaucacuccaaccugggcaacagaa

SEQ ID NO: 358970 - RNA, 32 nt, Human
caugccacaucacuccagccugggcaacagaa

SEQ ID NO: 358971 - RNA, 32 nt, Human
caugccacaucucaccuguccccaccagugcc

SEQ ID NO: 358972 - RNA, 32 nt, Human
caugccaccaugccuggcuaaucuuuugcagc

SEQ ID NO: 358973 - RNA, 32 nt, Human
caugccaccauggcuggcuaauuuuuguauuu

SEQ ID NO: 358974 - RNA, 32 nt, Human
caugccacccaccccagucgggucucacuuuc

SEQ ID NO: 358975 - RNA, 32 nt, Human
caugccaccgcacuccagccugggcaacagag

SEQ ID NO: 358976 - RNA, 32 nt, Human
caugccaccgcacuucagccugggugacagag

SEQ ID NO: 358977 - RNA, 32 nt, Human
caugccaccgcacuuccagccugggugacaga

SEQ ID NO: 358978 - RNA, 32 nt, Human
caugccaccgcccuggccacccugcggcagug

SEQ ID NO: 358979 - RNA, 32 nt, Human
caugccaccggcuucucugauucuccagcuug

SEQ ID NO: 358980 - RNA, 32 nt, Human
caugccacuacacuccagccuggcgacagagc

SEQ ID NO: 358981 - RNA, 32 nt, Human
caugccacuauacuccagccugggcaacaaag

SEQ ID NO: 358982 - RNA, 32 nt, Human
caugccacuccacuccagucugggcgacagag

SEQ ID NO: 358983 - RNA, 32 nt, Human
caugccacugaacuccagccugggcaacagag

SEQ ID NO: 358984 - RNA, 32 nt, Human
caugccacugaacuccagccugggcaacaggu

SEQ ID NO: 358985 - RNA, 32 nt, Human
caugccacugaacuccagccugggugacagag

SEQ ID NO: 358986 - RNA, 32 nt, Human
caugccacugcaaucuagccugggugacagag

SEQ ID NO: 358987 - RNA, 32 nt, Human
caugccacugcacccaucuugggcaacagaau

SEQ ID NO: 358988 - RNA, 32 nt, Human
caugccacugcaccccagccugggcaacagag

SEQ ID NO: 358989 - RNA, 32 nt, Human
caugccacugcacccuagcuuggguggcaaag

SEQ ID NO: 358990 - RNA, 32 nt, Human
caugccacugcacccuagcuuggguggcagag

SEQ ID NO: 358991 - RNA, 32 nt, Human
caugccacugcaccuggcuaauuuuuauauuu

SEQ ID NO: 358992 - RNA, 32 nt, Human
caugccacugcacuagagccugggcaacagac

SEQ ID NO: 358993 - RNA, 32 nt, Human
caugccacugcacucaaaccuggcggacagag

SEQ ID NO: 358994 - RNA, 32 nt, Human
caugccacugcacuccaaccugggcaacagaa

SEQ ID NO: 358995 - RNA, 32 nt, Human
caugccacugcacuccaaccugggcagcagag

SEQ ID NO: 358996 - RNA, 32 nt, Human
caugccacugcacuccaaccugggcgacagag

SEQ ID NO: 358997 - RNA, 32 nt, Human
caugccacugcacuccaaccugggugacagag

SEQ ID NO: 358998 - RNA, 32 nt, Human
caugccacugcacuccacucugggcaacagaa

SEQ ID NO: 358999 - RNA, 32 nt, Human
caugccacugcacuccagcaugcaugacagag

SEQ ID NO: 359000 - RNA, 32 nt, Human
caugccacugcacuccagcaugggugauggag

SEQ ID NO: 359001 - RNA, 32 nt, Human
caugccacugcacuccagcccaggugacagag

SEQ ID NO: 359002 - RNA, 32 nt, Human
caugccacugcacuccagccuaugugacuagu

SEQ ID NO: 359003 - RNA, 32 nt, Human
caugccacugcacuccagccugagugacagag

SEQ ID NO: 359004 - RNA, 32 nt, Human
caugccacugcacuccagccuggacaacagag

SEQ ID NO: 359005 - RNA, 32 nt, Human
caugccacugcacuccagccuggaugacagag

SEQ ID NO: 359006 - RNA, 32 nt, Human
caugccacugcacuccagccuggaugacagcg

SEQ ID NO: 359007 - RNA, 32 nt, Human
caugccacugcacuccagccuggccugggcaa

SEQ ID NO: 359008 - RNA, 32 nt, Human
caugccacugcacuccagccugggagacagag

SEQ ID NO: 359009 - RNA, 32 nt, Human
caugccacugcacuccagccugggcaacaaaa

SEQ ID NO: 359010 - RNA, 32 nt, Human
caugccacugcacuccagccugggcaacaaag

SEQ ID NO: 359011 - RNA, 32 nt, Human
caugccacugcacuccagccugggcaacaaga

SEQ ID NO: 359012 - RNA, 32 nt, Human
caugccacugcacuccagccugggcaacaagu

SEQ ID NO: 359013 - RNA, 32 nt, Human
caugccacugcacuccagccugggcaacacag

SEQ ID NO: 359014 - RNA, 32 nt, Human
caugccacugcacuccagccugggcaacagag

SEQ ID NO: 359015 - RNA, 32 nt, Human
caugccacugcacuccagccugggcaacagca

SEQ ID NO: 359016 - RNA, 32 nt, Human
caugccacugcacuccagccugggcaaccagg

SEQ ID NO: 359017 - RNA, 32 nt, Human
caugccacugcacuccagccugggcaauggag

SEQ ID NO: 359018 - RNA, 32 nt, Human
caugccacugcacuccagccugggcagcagag

SEQ ID NO: 359019 - RNA, 32 nt, Human
caugccacugcacuccagccugggcaugagac

SEQ ID NO: 359020 - RNA, 32 nt, Human
caugccacugcacuccagccugggccagaaug

SEQ ID NO: 359021 - RNA, 32 nt, Human
caugccacugcacuccagccugggcgacagag

SEQ ID NO: 359022 - RNA, 32 nt, Human
caugccacugcacuccagccugggcgacggag

SEQ ID NO: 359023 - RNA, 32 nt, Human
caugccacugcacuccagccugggcgauggag

SEQ ID NO: 359024 - RNA, 32 nt, Human
caugccacugcacuccagccugggcggcagag

SEQ ID NO: 359025 - RNA, 32 nt, Human
caugccacugcacuccagccuggggcugacag

SEQ ID NO: 359026 - RNA, 26 nt, Human
caugccacugcacuccagccugggug

SEQ ID NO: 359027 - RNA, 32 nt, Human
caugccacugcacuccagccugggugacagaa

SEQ ID NO: 359028 - RNA, 32 nt, Human
caugccacugcacuccagccugggugacagag

SEQ ID NO: 359029 - RNA, 32 nt, Human
caugccacugcacuccagcuugggcgacagag

SEQ ID NO: 359030 - RNA, 32 nt, Human
caugccacugcacuccagcuugggugagagug

SEQ ID NO: 359031 - RNA, 32 nt, Human
caugccacugcacuccagucuggaugacagag

SEQ ID NO: 359032 - RNA, 32 nt, Human
caugccacugcacuccagucugggugacagca

SEQ ID NO: 359033 - RNA, 32 nt, Human
caugccacugcacuccauccugggcaacaaga

SEQ ID NO: 359034 - RNA, 32 nt, Human
caugccacugcacuccauccugggugacagca

SEQ ID NO: 359035 - RNA, 32 nt, Human
caugccacugcacuccggccuaggugacagag

SEQ ID NO: 359036 - RNA, 32 nt, Human
caugccacugcacuccggccugggugacaaag

SEQ ID NO: 359037 - RNA, 32 nt, Human
caugccacugcacuccuccgugggugacagag

SEQ ID NO: 359038 - RNA, 32 nt, Human
caugccacugcacuccugccugggugacaaag

SEQ ID NO: 359039 - RNA, 32 nt, Human
caugccacugcacucuagccuaggcuacagag

SEQ ID NO: 359040 - RNA, 32 nt, Human
caugccacugcacucuagccugggugacagag

SEQ ID NO: 359041 - RNA, 32 nt, Human
caugccacugcacucugggcuggguaacagag

SEQ ID NO: 359042 - RNA, 32 nt, Human
caugccacugcacugcacuccagccuggguga

SEQ ID NO: 359043 - RNA, 32 nt, Human
caugccacugcacugcagcccgggcgacagag

SEQ ID NO: 359044 - RNA, 32 nt, Human
caugccacugcacugcagccugggcgacagag

SEQ ID NO: 359045 - RNA, 32 nt, Human
caugccacugcacugggcaacagagcaaaacu

SEQ ID NO: 359046 - RNA, 32 nt, Human
caugccacugcacuuccagccugggugacaca

SEQ ID NO: 359047 - RNA, 32 nt, Human
caugccacugcacuuccagccugggugacaga

SEQ ID NO: 359048 - RNA, 32 nt, Human
caugccacugcacuuuagccugggcaacagau

SEQ ID NO: 359049 - RNA, 32 nt, Human
caugccacugcacuuuagccugggugacagag

SEQ ID NO: 359050 - RNA, 32 nt, Human
caugccacugcaugccagccugggcaacagaa

SEQ ID NO: 359051 - RNA, 32 nt, Human
caugccacugcauuccagccugggcaacagag

SEQ ID NO: 359052 - RNA, 32 nt, Human
caugccacugcauuccagccugggcgacagag

SEQ ID NO: 359053 - RNA, 32 nt, Human
caugccacugcauuccagccugugugauggag

SEQ ID NO: 359054 - RNA, 32 nt, Human
caugccacugcauucuagccugggcaacagag

SEQ ID NO: 359055 - RNA, 32 nt, Human
caugccacugccuugcucugggccuguggugc

SEQ ID NO: 359056 - RNA, 32 nt, Human
caugccacuggaagggaaguggguguccaugg

SEQ ID NO: 359057 - RNA, 32 nt, Human
caugccacuggacuccagccugggugaaagag

SEQ ID NO: 359058 - RNA, 32 nt, Human
caugccacuguacuccagccuaggugacagag

SEQ ID NO: 359059 - RNA, 32 nt, Human
caugccacuguacuccagccugagcuacagag

SEQ ID NO: 359060 - RNA, 32 nt, Human
caugccacuguacuccagccugggcgacagca

SEQ ID NO: 359061 - RNA, 32 nt, Human
caugccacuguacuccagccugggugacagag

SEQ ID NO: 359062 - RNA, 32 nt, Human
caugccacuugcaugcuggagggagucuuuuu

SEQ ID NO: 359063 - RNA, 17 nt, Human
caugccacuuugcuguc

SEQ ID NO: 359064 - RNA, 32 nt, Human
caugccagaagaaauugaacaugugagccugg

SEQ ID NO: 359065 - RNA, 32 nt, Human
caugccagacuguaaucccagguauucacugc

SEQ ID NO: 359066 - RNA, 32 nt, Human
caugccagagccaaagcuggagcccagaccgu

SEQ ID NO: 359067 - RNA, 32 nt, Human
caugccagagggcucgaugacuugucucugca

SEQ ID NO: 359068 - RNA, 32 nt, Human
caugccagcccaugccagcuccuggguccugg

SEQ ID NO: 359069 - RNA, 32 nt, Human
caugccagccugggcaacagaacaggacucgg

SEQ ID NO: 359070 - RNA, 32 nt, Human
caugccagccugggugacaaagcgagacuccg

SEQ ID NO: 359071 - RNA, 32 nt, Human
caugccagcgccaacaggaggcugucuggaca

SEQ ID NO: 359072 - RNA, 32 nt, Human
caugccagcgucaacaggaggcugucuggaca

SEQ ID NO: 359073 - RNA, 32 nt, Human
caugccagcuacuuccuccuccccacuugucc

SEQ ID NO: 359074 - RNA, 23 nt, Human
caugccagcugggcaugacccca

SEQ ID NO: 359075 - RNA, 32 nt, Human
caugccaggacagcugugagaccaggaaucag

SEQ ID NO: 359076 - RNA, 32 nt, Human
caugccaggacuugugcacaucuuuuuggagc

SEQ ID NO: 359077 - RNA, 19 nt, Human
caugccaguaauuccagcu

SEQ ID NO: 359078 - RNA, 32 nt, Human
caugccagugcacuccagccugggcaacagag

SEQ ID NO: 359079 - RNA, 32 nt, Human
caugccauaaugaacagggaccaaggagaagg

SEQ ID NO: 359080 - RNA, 32 nt, Human
caugccauaccacuugucagggcacaggggac

SEQ ID NO: 359081 - RNA, 32 nt, Human
caugccauacccacugccccagaccagugcag

SEQ ID NO: 359082 - RNA, 32 nt, Human
caugccauagcuugugcuaucuguaaauauga

SEQ ID NO: 359083 - RNA, 20 nt, Human
caugccaucugccugccuua

SEQ ID NO: 359084 - RNA, 32 nt, Human
caugccaucugggacaggccaugugggagacc

SEQ ID NO: 359085 - RNA, 32 nt, Human
caugccauggcacuccauccugggugacaaag

SEQ ID NO: 359086 - RNA, 32 nt, Human
caugccauggcacuccguccugggugacaaag

SEQ ID NO: 359087 - RNA, 32 nt, Human
caugccauggcagucuagccugggcaacagag

SEQ ID NO: 359088 - RNA, 32 nt, Human
caugccauuacacuccagccugggcgacagaa

SEQ ID NO: 359089 - RNA, 32 nt, Human
caugccauuacuccagccugggugacauaggg

SEQ ID NO: 359090 - RNA, 32 nt, Human
caugccauuauacuccagccugggugacagaa

SEQ ID NO: 359091 - RNA, 32 nt, Human
caugccauucuccugccucacccucccgagua

SEQ ID NO: 359092 - RNA, 18 nt, Human
caugccauucuccugucu

SEQ ID NO: 359093 - RNA, 32 nt, Human
caugccauucugccucagccuccugaguagcu

SEQ ID NO: 359094 - RNA, 32 nt, Human
caugccauugcacagcagccugggugacagag

SEQ ID NO: 359095 - RNA, 32 nt, Human
caugccauugcacuccaaccugggugacagag

SEQ ID NO: 359096 - RNA, 32 nt, Human
caugccauugcacuccagcccagguaacagag

SEQ ID NO: 359097 - RNA, 32 nt, Human
caugccauugcacuccagcccggguuacagug

SEQ ID NO: 359098 - RNA, 32 nt, Human
caugccauugcacuccagccuaggcaacaaga

SEQ ID NO: 359099 - RNA, 32 nt, Human
caugccauugcacuccagccugagugacaaga

SEQ ID NO: 359100 - RNA, 32 nt, Human
caugccauugcacuccagccuggacaacagag

SEQ ID NO: 359101 - RNA, 32 nt, Human
caugccauugcacuccagccugggcaacaaga

SEQ ID NO: 359102 - RNA, 32 nt, Human
caugccauugcacuccagccugggcaacagag

SEQ ID NO: 359103 - RNA, 32 nt, Human
caugccauugcacuccagccugggcaacgaga

SEQ ID NO: 359104 - RNA, 32 nt, Human
caugccauugcacuccagccugggcgacaaga

SEQ ID NO: 359105 - RNA, 32 nt, Human
caugccauugcacuccagccugggcgacagag

SEQ ID NO: 359106 - RNA, 32 nt, Human
caugccauugcacuccagccugggugacaaga

SEQ ID NO: 359107 - RNA, 32 nt, Human
caugccauugcacuccagccugggugacaagg

SEQ ID NO: 359108 - RNA, 32 nt, Human
caugccauugcacuccagccugggugacagag

SEQ ID NO: 359109 - RNA, 32 nt, Human
caugccauugcacuccagccugggugauaaga

SEQ ID NO: 359110 - RNA, 32 nt, Human
caugccauugcacuccagcuugggugacagag

SEQ ID NO: 359111 - RNA, 32 nt, Human
caugccauugcacuccagucugggcgacagga

SEQ ID NO: 359112 - RNA, 32 nt, Human
caugccauugcacuccgacucugggcaacaga

SEQ ID NO: 359113 - RNA, 32 nt, Human
caugccauugcacucgagccugggcaacaaga

SEQ ID NO: 359114 - RNA, 32 nt, Human
caugccauugcacucuagccuagcaacaagag

SEQ ID NO: 359115 - RNA, 26 nt, Human
caugccauugcacucuagccugggug

SEQ ID NO: 359116 - RNA, 32 nt, Human
caugccauugcacugcaccugggcaacaagag

SEQ ID NO: 359117 - RNA, 32 nt, Human
caugccauugcauuccagccuaggcaacacga

SEQ ID NO: 359118 - RNA, 32 nt, Human
caugccauugcauuccagccuuggcgacagag

SEQ ID NO: 359119 - RNA, 32 nt, Human
caugccauugcccacagagcucggugacccua

SEQ ID NO: 359120 - RNA, 32 nt, Human
caugccauuggacuccagccugggcaaaaagg

SEQ ID NO: 359121 - RNA, 32 nt, Human
caugccauuguacuccagccugggcaacaaga

SEQ ID NO: 359122 - RNA, 26 nt, Human
caugcccaagagaaaggcugaagggg

SEQ ID NO: 359123 - RNA, 32 nt, Human
caugcccaagggaggaagcagagggaggcaga

SEQ ID NO: 359124 - RNA, 32 nt, Human
caugcccaaggugugcccuccgucuggaaugc

SEQ ID NO: 359125 - RNA, 21 nt, Human
caugcccaaguaccacgcagu

SEQ ID NO: 359126 - RNA, 20 nt, Human
caugcccacccccugaggaa

SEQ ID NO: 359127 - RNA, 32 nt, Human
caugcccacugcagcccuccagccucuggucc

SEQ ID NO: 359128 - RNA, 18 nt, Human
caugcccagccccuccca

SEQ ID NO: 359129 - RNA, 32 nt, Human
caugcccagcuucugucauaugaaugagauau

SEQ ID NO: 359130 - RNA, 23 nt, Human
caugcccaggagaccacauaguc

SEQ ID NO: 359131 - RNA, 32 nt, Human
caugcccaggagacugguuucccggugacaca

SEQ ID NO: 359132 - RNA, 32 nt, Human
caugcccaggcagaagguggggaggauucugu

SEQ ID NO: 359133 - RNA, 26 nt, Human
caugcccaggcagagugacaggagag

SEQ ID NO: 359134 - RNA, 32 nt, Human
caugcccaggguggccguggaagggacgguuu

SEQ ID NO: 359135 - RNA, 22 nt, Human
caugcccaggucuccugccuca

SEQ ID NO: 359136 - RNA, 32 nt, Human
caugcccaggugucugucucuggcugagguuu

SEQ ID NO: 359137 - RNA, 32 nt, Human
caugcccaugccaccuaugccacagugccuaa

SEQ ID NO: 359138 - RNA, 32 nt, Human
caugcccauuagcagaggcugcugcugaugug

SEQ ID NO: 359139 - RNA, 32 nt, Human
caugcccauucacuacagccuggaugacaagc

SEQ ID NO: 359140 - RNA, 32 nt, Human
caugccccaacaagaggaagacugucuggcuc

SEQ ID NO: 359141 - RNA, 32 nt, Human
caugccccaccuacucuuucauccccucugcc

SEQ ID NO: 359142 - RNA, 32 nt, Human
caugccccaccuuugcuuccucccucucuccu

SEQ ID NO: 359143 - RNA, 32 nt, Human
caugcccccucagugaggaucuucauguaccu

SEQ ID NO: 359144 - RNA, 32 nt, Human
caugcccccugccccucugcccagaugcuuca

SEQ ID NO: 359145 - RNA, 32 nt, Human
caugcccccugugccagugcucugccugugug

SEQ ID NO: 359146 - RNA, 32 nt, Human
caugccccggacugcauugaagccaggcugcc

SEQ ID NO: 359147 - RNA, 32 nt, Human
caugccccgggaaacagucuuucuucagaauu

SEQ ID NO: 359148 - RNA, 32 nt, Human
caugccccugcagggccccggccugucuauga

SEQ ID NO: 359149 - RNA, 32 nt, Human
caugccccugcauuccagccuaggcgacagag

SEQ ID NO: 359150 - RNA, 32 nt, Human
caugccccugcuagcguauuacuguucuguga

SEQ ID NO: 359151 - RNA, 32 nt, Human
caugccccuguacuccagccugggugacagag

SEQ ID NO: 359152 - RNA, 32 nt, Human
caugccccuugguggagaugaaugggagugga

SEQ ID NO: 359153 - RNA, 17 nt, Human
caugcccgccccuccca

SEQ ID NO: 359154 - RNA, 32 nt, Human
caugcccgcgcuccuccgcagccugggguacg

SEQ ID NO: 359155 - RNA, 32 nt, Human
caugcccggucaccaugggggucagguuauuu

SEQ ID NO: 359156 - RNA, 17 nt, Human
caugcccggugcugucu

SEQ ID NO: 359157 - RNA, 19 nt, Human
caugcccguccccuguucu

SEQ ID NO: 359158 - RNA, 32 nt, Human
caugcccuagccccaggucuagccgggcccau

SEQ ID NO: 359159 - RNA, 32 nt, Human
caugcccucaccccacuucuuugcuaccuagc

SEQ ID NO: 359160 - RNA, 32 nt, Human
caugcccucagccugccucacugcugggccag

SEQ ID NO: 359161 - RNA, 32 nt, Human
caugcccuccccagccucucccagcacaagug

SEQ ID NO: 359162 - RNA, 32 nt, Human
caugcccuccuaugagaaucuaaugccgccgc

SEQ ID NO: 359163 - RNA, 24 nt, Human
caugcccuccugcuccccccaccc

SEQ ID NO: 359164 - RNA, 32 nt, Human
caugcccucggucucuugccucggcaccuggg

SEQ ID NO: 359165 - RNA, 32 nt, Human
caugcccucuuccuccucuuuccuggaagaag

SEQ ID NO: 359166 - RNA, 32 nt, Human
caugcccuggaccagccgcccagaucaugccg

SEQ ID NO: 359167 - RNA, 32 nt, Human
caugcccuguaauccuagaacuuugggaggcu

SEQ ID NO: 359168 - RNA, 32 nt, Human
caugcccuguaauccuagcacuuugggagggu

SEQ ID NO: 359169 - RNA, 17 nt, Human
caugcccuuccuuucua

SEQ ID NO: 359170 - RNA, 32 nt, Human
caugccgagucgcggcccugcucagccggaag

SEQ ID NO: 359171 - RNA, 26 nt, Human
caugccgcugacugguguagagcccg

SEQ ID NO: 359172 - RNA, 32 nt, Human
caugccgcugcacuccagccugggagacugca

SEQ ID NO: 359173 - RNA, 26 nt, Human
caugccgcugcauuccagccugggug

SEQ ID NO: 359174 - RNA, 32 nt, Human
caugccggagaaagacgccgauccucagauga

SEQ ID NO: 359175 - RNA, 32 nt, Human
caugccguacaggguagcaccuccucaccugc

SEQ ID NO: 359176 - RNA, 32 nt, Human
caugccguuguacuccagcuugggcaacagag

SEQ ID NO: 359177 - RNA, 32 nt, Human
caugccuacugcacuccagccugggcaacaaa

SEQ ID NO: 359178 - RNA, 32 nt, Human
caugccuagguacacauguacaugcacuacag

SEQ ID NO: 359179 - RNA, 23 nt, Human
caugccuauaaucccaauacuuu

SEQ ID NO: 359180 - RNA, 19 nt, Human
caugccuauaaucccagca

SEQ ID NO: 359181 - RNA, 23 nt, Human
caugccuauaaucccagcacuuu

SEQ ID NO: 359182 - RNA, 32 nt, Human
caugccuauaaucccagcacuuuuggaggcug

SEQ ID NO: 359183 - RNA, 32 nt, Human
caugccuauaaucccagcuacuugggaggcua

SEQ ID NO: 359184 - RNA, 32 nt, Human
caugccuauaaucccagcuacuugggaggcug

SEQ ID NO: 359185 - RNA, 22 nt, Human
caugccuauaaucccggcuacu

SEQ ID NO: 359186 - RNA, 32 nt, Human
caugccuauaauuaaucccaguacuuugggag

SEQ ID NO: 359187 - RNA, 32 nt, Human
caugccuauaguaguucuagcacuuugagagg

SEQ ID NO: 359188 - RNA, 32 nt, Human
caugccuauagucccagcacuuugggaggcca

SEQ ID NO: 359189 - RNA, 32 nt, Human
caugccuauagucccagcuacuugggagguug

SEQ ID NO: 359190 - RNA, 32 nt, Human
caugccuauagucccagcuacuugggggccug

SEQ ID NO: 359191 - RNA, 22 nt, Human
caugccuaugcagccacacagu

SEQ ID NO: 359192 - RNA, 32 nt, Human
caugccuauugacagauaaacauguaucugua

SEQ ID NO: 359193 - RNA, 32 nt, Human
caugccucacugcagccucgaccucccugggc

SEQ ID NO: 359194 - RNA, 32 nt, Human
caugccucacugcagccucggcuuccugggcu

SEQ ID NO: 359195 - RNA, 32 nt, Human
caugccucagccacgccccuccggccucagcu

SEQ ID NO: 359196 - RNA, 32 nt, Human
caugccucauguccaaagaggucucagaccuu

SEQ ID NO: 359197 - RNA, 32 nt, Human
caugccucccagagugcugggauuacaggcgu

SEQ ID NO: 359198 - RNA, 32 nt, Human
caugccuccuaagagaggagugcauugcuuua

SEQ ID NO: 359199 - RNA, 32 nt, Human
caugccuccugccuccugggcuauuccucucc

SEQ ID NO: 359200 - RNA, 32 nt, Human
caugccucuaaucccagcuacucaggaggcua

SEQ ID NO: 359201 - RNA, 32 nt, Human
caugccucuaguccuagcuacucgggaggcug

SEQ ID NO: 359202 - RNA, 32 nt, Human
caugccucuaucucagaacccugcauccugcg

SEQ ID NO: 359203 - RNA, 26 nt, Human
caugccucuccuccucuugcugcucc

SEQ ID NO: 359204 - RNA, 32 nt, Human
caugccucucuacuccagccugggcaauaggg

SEQ ID NO: 359205 - RNA, 22 nt, Human
caugccucugaugagaacacuu

SEQ ID NO: 359206 - RNA, 32 nt, Human
caugccucugcagggaaucacacaccuuuuga

SEQ ID NO: 359207 - RNA, 32 nt, Human
caugccucugcauuccagccuuggugacagag

SEQ ID NO: 359208 - RNA, 32 nt, Human
caugccucuucuuccuccuuucuuuccccauc

SEQ ID NO: 359209 - RNA, 32 nt, Human
caugccucuugguggccuucucaggcccugcu

SEQ ID NO: 359210 - RNA, 21 nt, Human
caugccugacccacacacuuu

SEQ ID NO: 359211 - RNA, 32 nt, Human
caugccugcaaucccagcuacucagaggcuaa

SEQ ID NO: 359212 - RNA, 32 nt, Human
caugccugcaaucccagcuacuugagaggcug

SEQ ID NO: 359213 - RNA, 32 nt, Human
caugccugcaaucccagcuacuuggaaggcug

SEQ ID NO: 359214 - RNA, 32 nt, Human
caugccugcacucagacacauauccacacaga

SEQ ID NO: 359215 - RNA, 32 nt, Human
caugccugcagacuuuucccugggcuuguuuu

SEQ ID NO: 359216 - RNA, 32 nt, Human
caugccugcagucccagcuauucaggaggcug

SEQ ID NO: 359217 - RNA, 32 nt, Human
caugccugccuguaaucccagcacugugggag

SEQ ID NO: 359218 - RNA, 32 nt, Human
caugccugcggcucccccugugcugggcucug

SEQ ID NO: 359219 - RNA, 32 nt, Human
caugccugcugcaacggagacugggcccaacc

SEQ ID NO: 359220 - RNA, 32 nt, Human
caugccugcuuugguucccagugagcauugua

SEQ ID NO: 359221 - RNA, 32 nt, Human
caugccuggaaucccagcuacuugagaggcug

SEQ ID NO: 359222 - RNA, 32 nt, Human
caugccuggacaaggggaaugcaguggugccu

SEQ ID NO: 359223 - RNA, 32 nt, Human
caugccuggagucccagcuacucgggaggcug

SEQ ID NO: 359224 - RNA, 32 nt, Human
caugccugggaaaggccagcacuucauggacc

SEQ ID NO: 359225 - RNA, 32 nt, Human
caugccugggagggagaauaagaguaagugaa

SEQ ID NO: 359226 - RNA, 32 nt, Human
caugccugggcaacauaaugagacaggucucu

SEQ ID NO: 359227 - RNA, 32 nt, Human
caugccuggucucauggagauucaaagguguu

SEQ ID NO: 359228 - RNA, 32 nt, Human
caugccuguaaacccagcacuuugggaggcug

SEQ ID NO: 359229 - RNA, 32 nt, Human
caugccuguaaacccagcuauucaggaggcug

SEQ ID NO: 359230 - RNA, 32 nt, Human
caugccuguaaacccagggcuuuagaaggcug

SEQ ID NO: 359231 - RNA, 23 nt, Human
caugccuguaaauccagcacuuu

SEQ ID NO: 359232 - RNA, 32 nt, Human
caugccuguaaaucccagcacuuugguagccu

SEQ ID NO: 359233 - RNA, 32 nt, Human
caugccuguaaccccagcuacucgggaagcug

SEQ ID NO: 359234 - RNA, 32 nt, Human
caugccuguaagcccagcuauucgggaggcug

SEQ ID NO: 359235 - RNA, 32 nt, Human
caugccuguaaucaaucccagcacuuugggag

SEQ ID NO: 359236 - RNA, 23 nt, Human
caugccuguaaucccagaacuuu

SEQ ID NO: 359237 - RNA, 18 nt, Human
caugccuguaaucccagc

SEQ ID NO: 359238 - RNA, 23 nt, Human
caugccuguaaucccagcacuuu

SEQ ID NO: 359239 - RNA, 23 nt, Human
caugccuguaaucccagcauuuu

SEQ ID NO: 359240 - RNA, 19 nt, Human
caugccuguaaucccagcu

SEQ ID NO: 359241 - RNA, 32 nt, Human
caugccuguaaucccagcuacacuggaggcug

SEQ ID NO: 359242 - RNA, 32 nt, Human
caugccuguaaucccagcuacaugggaggcug

SEQ ID NO: 359243 - RNA, 32 nt, Human
caugccuguaaucccagcuacuagagaggcug

SEQ ID NO: 359244 - RNA, 32 nt, Human
caugccuguaaucccagcuacuagggaggcug

SEQ ID NO: 359245 - RNA, 32 nt, Human
caugccuguaaucccagcuacucggaaguuug

SEQ ID NO: 359246 - RNA, 32 nt, Human
caugccuguaaucccagcuacucgggaggcug

SEQ ID NO: 359247 - RNA, 32 nt, Human
caugccuguaaucccagcuacucgggaggcuu

SEQ ID NO: 359248 - RNA, 32 nt, Human
caugccuguaaucccagcuacucgggagguug

SEQ ID NO: 359249 - RNA, 32 nt, Human
caugccuguaaucccagcuacucuggaggcug

SEQ ID NO: 359250 - RNA, 32 nt, Human
caugccuguaaucccagcuacugggaaggcug

SEQ ID NO: 359251 - RNA, 32 nt, Human
caugccuguaaucccagcuacuuaggaggcug

SEQ ID NO: 359252 - RNA, 32 nt, Human
caugccuguaaucccagcuacuuggaaggcug

SEQ ID NO: 359253 - RNA, 32 nt, Human
caugccuguaaucccagcuacuugggagacug

SEQ ID NO: 359254 - RNA, 32 nt, Human
caugccuguaaucccagcuacuugggagccug

SEQ ID NO: 359255 - RNA, 32 nt, Human
caugccuguaaucccagcuacuugggaggccg

SEQ ID NO: 359256 - RNA, 32 nt, Human
caugccuguaaucccagcuacuugggaggcua

SEQ ID NO: 359257 - RNA, 32 nt, Human
caugccuguaaucccagcuacuugggaggcug

SEQ ID NO: 359258 - RNA, 32 nt, Human
caugccuguaaucccagcuauuagggaggcug

SEQ ID NO: 359259 - RNA, 32 nt, Human
caugccuguaaucccagcuauucggaaggcug

SEQ ID NO: 359260 - RNA, 32 nt, Human
caugccuguaaucccagcuauucgggaggcug

SEQ ID NO: 359261 - RNA, 32 nt, Human
caugccuguaaucccagcugcuggagaggcug

SEQ ID NO: 359262 - RNA, 32 nt, Human
caugccuguaaucccagcugcuugggaggcug

SEQ ID NO: 359263 - RNA, 32 nt, Human
caugccuguaaucccagcuucuugggaggcca

SEQ ID NO: 359264 - RNA, 21 nt, Human
caugccuguaaucucagcacu

SEQ ID NO: 359265 - RNA, 32 nt, Human
caugccuguaaucucggaaggcugaggcagga

SEQ ID NO: 359266 - RNA, 32 nt, Human
caugccuguaaugccagcacuuugccaaggug

SEQ ID NO: 359267 - RNA, 18 nt, Human
caugccuguaauuccagc

SEQ ID NO: 359268 - RNA, 19 nt, Human
caugccuguaauuccagcu

SEQ ID NO: 359269 - RNA, 32 nt, Human
caugccuguaguaaucccagcacuuuuggagg

SEQ ID NO: 359270 - RNA, 32 nt, Human
caugccuguagucccaccuacuugggaggcug

SEQ ID NO: 359271 - RNA, 32 nt, Human
caugccuguagucccacuuacuugggaggccg

SEQ ID NO: 359272 - RNA, 32 nt, Human
caugccuguagucccagauacuugggaguggg

SEQ ID NO: 359273 - RNA, 32 nt, Human
caugccuguagucccagcacucgggaaggccg

SEQ ID NO: 359274 - RNA, 32 nt, Human
caugccuguagucccagcacuuugggagacug

SEQ ID NO: 359275 - RNA, 32 nt, Human
caugccuguagucccagcacuuugggaggccg

SEQ ID NO: 359276 - RNA, 32 nt, Human
caugccuguagucccagcuaacugggaggcug

SEQ ID NO: 359277 - RNA, 32 nt, Human
caugccuguagucccagcuaccugggaggcug

SEQ ID NO: 359278 - RNA, 32 nt, Human
caugccuguagucccagcuacgugggaggcug

SEQ ID NO: 359279 - RNA, 32 nt, Human
caugccuguagucccagcuacucaggaggcuc

SEQ ID NO: 359280 - RNA, 32 nt, Human
caugccuguagucccagcuacucaggaggcug

SEQ ID NO: 359281 - RNA, 32 nt, Human
caugccuguagucccagcuacucgggaggccg

SEQ ID NO: 359282 - RNA, 32 nt, Human
caugccuguagucccagcuacucgggaggcug

SEQ ID NO: 359283 - RNA, 32 nt, Human
caugccuguagucccagcuacucuggaggcug

SEQ ID NO: 359284 - RNA, 32 nt, Human
caugccuguagucccagcuacuggggaggcug

SEQ ID NO: 359285 - RNA, 32 nt, Human
caugccuguagucccagcuacuugagaggcug

SEQ ID NO: 359286 - RNA, 32 nt, Human
caugccuguagucccagcuacuugggaagcug

SEQ ID NO: 359287 - RNA, 32 nt, Human
caugccuguagucccagcuacuugggaggaaa

SEQ ID NO: 359288 - RNA, 32 nt, Human
caugccuguagucccagcuacuugggaggcug

SEQ ID NO: 359289 - RNA, 32 nt, Human
caugccuguagucccagcuacuugggaugccg

SEQ ID NO: 359290 - RNA, 32 nt, Human
caugccuguagucccagcuauucaggaggcug

SEQ ID NO: 359291 - RNA, 32 nt, Human
caugccuguagucccagcuauucgggaggcug

SEQ ID NO: 359292 - RNA, 32 nt, Human
caugccuguagucccagcuauucuggaggcug

SEQ ID NO: 359293 - RNA, 32 nt, Human
caugccuguagucccagcugcucaggaggcug

SEQ ID NO: 359294 - RNA, 32 nt, Human
caugccuguagucccagcuucucaggaggcug

SEQ ID NO: 359295 - RNA, 32 nt, Human
caugccuguaguccuagcuauuugggaggcug

SEQ ID NO: 359296 - RNA, 19 nt, Human
caugccuguaguuccagcu

SEQ ID NO: 359297 - RNA, 32 nt, Human
caugccuguaguuccagcuacucaggaggcag

SEQ ID NO: 359298 - RNA, 32 nt, Human
caugccuguaguuccagcuacucaggaggcua

SEQ ID NO: 359299 - RNA, 32 nt, Human
caugccuguaguuccagcuacucaggaggcug

SEQ ID NO: 359300 - RNA, 32 nt, Human
caugccuguauaaucccagcacuuugggaggc

SEQ ID NO: 359301 - RNA, 32 nt, Human
caugccuguauucccagcugcuugggaggcug

SEQ ID NO: 359302 - RNA, 32 nt, Human
caugccugucaucccagcuacuugggaggcug

SEQ ID NO: 359303 - RNA, 32 nt, Human
caugccuguccucugccuuaucuugccccucu

SEQ ID NO: 359304 - RNA, 32 nt, Human
caugccugugaucccagcuacuugagaggcug

SEQ ID NO: 359305 - RNA, 32 nt, Human
caugccuguggccccagccacucugaacgcug

SEQ ID NO: 359306 - RNA, 32 nt, Human
caugccuguggucccagcacuuugggaggcca

SEQ ID NO: 359307 - RNA, 32 nt, Human
caugccuguggucccagcacuuugggaggcug

SEQ ID NO: 359308 - RNA, 32 nt, Human
caugccuguggucccagcgcuuugggaggccg

SEQ ID NO: 359309 - RNA, 32 nt, Human
caugccuguggucccagcuacucaggaggcug

SEQ ID NO: 359310 - RNA, 32 nt, Human
caugccuguggucccagcuacuugagaggcug

SEQ ID NO: 359311 - RNA, 32 nt, Human
caugccuguggucccagcuacuugggaggcua

SEQ ID NO: 359312 - RNA, 32 nt, Human
caugccuguggucccagcuucuugggaggcug

SEQ ID NO: 359313 - RNA, 32 nt, Human
caugccuguggucucagcuauucaggaggcug

SEQ ID NO: 359314 - RNA, 23 nt, Human
caugccuguguuacagcagcucc

SEQ ID NO: 359315 - RNA, 32 nt, Human
caugccuguguucccagcuacuugggaggcua

SEQ ID NO: 359316 - RNA, 32 nt, Human
caugccuguguucccagcuauucaggaggcug

SEQ ID NO: 359317 - RNA, 32 nt, Human
caugccuguguucucccccggggccacuuaga

SEQ ID NO: 359318 - RNA, 22 nt, Human
caugccuguuaucccagcacuu

SEQ ID NO: 359319 - RNA, 32 nt, Human
caugccuguugucccagcugcuugggaggcug

SEQ ID NO: 359320 - RNA, 31 nt, Human
caugccuuacuccaggugccuguguuuggcc

SEQ ID NO: 359321 - RNA, 32 nt, Human
caugccuuagaggauuguagcauuuuauuuuc

SEQ ID NO: 359322 - RNA, 32 nt, Human
caugccuucaagagaaggacugaagaucauug

SEQ ID NO: 359323 - RNA, 32 nt, Human
caugccuuccaaauuguggguggcucuguggg

SEQ ID NO: 359324 - RNA, 32 nt, Human
caugccuuccccaaagucccccaaacucuuau

SEQ ID NO: 359325 - RNA, 32 nt, Human
caugccuuccccacccuccagcuccucuugga

SEQ ID NO: 359326 - RNA, 32 nt, Human
caugccuuccuuucuccuugggugaugugcaa

SEQ ID NO: 359327 - RNA, 31 nt, Human
caugccuuccuuuucugacuuaguagauuga

SEQ ID NO: 359328 - RNA, 32 nt, Human
caugccuugcuguccccuccccugagccaggu

SEQ ID NO: 359329 - RNA, 32 nt, Human
caugccuuggaaagacuuaaguaaugcaaaag

SEQ ID NO: 359330 - RNA, 32 nt, Human
caugccuuggcacaucauggucaaacugcuaa

SEQ ID NO: 359331 - RNA, 32 nt, Human
caugccuuuaaucucagcuauucuggaggcuu

SEQ ID NO: 359332 - RNA, 32 nt, Human
caugccuuuagucccagcuacucuggaggcug

SEQ ID NO: 359333 - RNA, 19 nt, Human
caugccuuucaagcauuuu

SEQ ID NO: 359334 - RNA, 32 nt, Human
caugccuuucccccucuucauccugaucccgu

SEQ ID NO: 359335 - RNA, 32 nt, Human
caugccuuuuaaacccagcuacugaggaggcu

SEQ ID NO: 359336 - RNA, 32 nt, Human
caugcgaaggacagccugcagugaccagagag

SEQ ID NO: 359337 - RNA, 32 nt, Human
caugcgaccugcccaaucaagcagaaacacgu

SEQ ID NO: 359338 - RNA, 32 nt, Human
caugcgaccugcccagucaagcagaaacaggu

SEQ ID NO: 359339 - RNA, 32 nt, Human
caugcgacugcacuccagccugggugacugag

SEQ ID NO: 359340 - RNA, 32 nt, Human
caugcgaggccaccguggugaccucauucaug

SEQ ID NO: 359341 - RNA, 23 nt, Human
caugcgaguagcugggacuacag

SEQ ID NO: 359342 - RNA, 32 nt, Human
caugcgcacacacacuugcauucaugaaucug

SEQ ID NO: 359343 - RNA, 32 nt, Human
caugcgccggaaggagcuucaggugagcacug

SEQ ID NO: 359344 - RNA, 32 nt, Human
caugcgccuggaaggccacccugcugcacagc

SEQ ID NO: 359345 - RNA, 32 nt, Human
caugcgccuguaaucccagcuacuucggaggu

SEQ ID NO: 359346 - RNA, 32 nt, Human
caugcgccuguaauccuagcuauucuggaggc

SEQ ID NO: 359347 - RNA, 32 nt, Human
caugcgccuucauuucgucagcccgcuguugc

SEQ ID NO: 359348 - RNA, 32 nt, Human
caugcgcgcucucucaugcacacgcacgcaug

SEQ ID NO: 359349 - RNA, 32 nt, Human
caugcgcugcguuccuccuccagaucgacccc

SEQ ID NO: 359350 - RNA, 32 nt, Human
caugcgcugcuguccgcgccccucuguccugc

SEQ ID NO: 359351 - RNA, 32 nt, Human
caugcggcauggccccagccaugaaggaacuu

SEQ ID NO: 359352 - RNA, 32 nt, Human
caugcggccacuggucggugcugccugguccu

SEQ ID NO: 359353 - RNA, 26 nt, Human
caugcggcucuggaguugggugcugc

SEQ ID NO: 359354 - RNA, 32 nt, Human
caugcgggagagagaaugagccagagggacac

SEQ ID NO: 359355 - RNA, 32 nt, Human
caugcgggaggcggaggggugggaccgggugg

SEQ ID NO: 359356 - RNA, 32 nt, Human
caugcgggcugggaaccgccucaccuccaggg

SEQ ID NO: 359357 - RNA, 32 nt, Human
caugcgggcuuccuccugguguggaagagcuc

SEQ ID NO: 359358 - RNA, 32 nt, Human
caugcgguagaugcccaccuccuccaugccuc

SEQ ID NO: 359359 - RNA, 32 nt, Human
caugcguauagacauacauacauguacaccau

SEQ ID NO: 359360 - RNA, 32 nt, Human
caugcguccuaccugugaacucugggaagcag

SEQ ID NO: 359361 - RNA, 32 nt, Human
caugcgucuaauagugaggagaacaaaauaag

SEQ ID NO: 359362 - RNA, 32 nt, Human
caugcgucuguaacaucuuucuuaccaagugu

SEQ ID NO: 359363 - RNA, 32 nt, Human
caugcgugagccacugcgcccugccuguuugu

SEQ ID NO: 359364 - RNA, 32 nt, Human
caugcguggcaccauuuccugcgaacacccgu

SEQ ID NO: 359365 - RNA, 32 nt, Human
caugcguggccugcagaguccauuccaucaug

SEQ ID NO: 359366 - RNA, 26 nt, Human
caugcguuuaaauucuauuauauaaa

SEQ ID NO: 359367 - RNA, 24 nt, Human
caugcuaaaacccagucucuacua

SEQ ID NO: 359368 - RNA, 23 nt, Human
caugcuaaaagauggacucucca

SEQ ID NO: 359369 - RNA, 24 nt, Human
caugcuaaaauccccucucuacua

SEQ ID NO: 359370 - RNA, 32 nt, Human
caugcuaaacaagacaugaaauucagaaaggu

SEQ ID NO: 359371 - RNA, 32 nt, Human
caugcuaaaggcaggccaaggacuuacacauc

SEQ ID NO: 359372 - RNA, 32 nt, Human
caugcuaaauuguccugcuguagaguuacuau

SEQ ID NO: 359373 - RNA, 32 nt, Human
caugcuaaccuguaaucccagcuacuugggag

SEQ ID NO: 359374 - RNA, 21 nt, Human
caugcuaacuggacuauagca

SEQ ID NO: 359375 - RNA, 32 nt, Human
caugcuaaugaguuagucuggaaaaauaaagu

SEQ ID NO: 359376 - RNA, 32 nt, Human
caugcuaaugauguaacuccucucuuuaucau

SEQ ID NO: 359377 - RNA, 32 nt, Human
caugcuacagcaguuuacgagacccuggugca

SEQ ID NO: 359378 - RNA, 32 nt, Human
caugcuaccagcaucccagggucuccagccua

SEQ ID NO: 359379 - RNA, 32 nt, Human
caugcuaccuaaucucuuugugccucaauuuc

SEQ ID NO: 359380 - RNA, 32 nt, Human
caugcuacugcacuccagccuaggugacagag

SEQ ID NO: 359381 - RNA, 32 nt, Human
caugcuacugcacuccagccugggagacagag

SEQ ID NO: 359382 - RNA, 32 nt, Human
caugcuacugcacuccagccugggcgacagag

SEQ ID NO: 359383 - RNA, 32 nt, Human
caugcuacugcacuccagccugggugacagag

SEQ ID NO: 359384 - RNA, 32 nt, Human
caugcuacugcacuccagcuuagguggcaaag

SEQ ID NO: 359385 - RNA, 32 nt, Human
caugcuacugcacucuagccugagcgacagag

SEQ ID NO: 359386 - RNA, 32 nt, Human
caugcuacugcaugccagccugggugacaaag

SEQ ID NO: 359387 - RNA, 32 nt, Human
caugcuacuguuccacauuuguuuucacagca

SEQ ID NO: 359388 - RNA, 32 nt, Human
caugcuacuuaauaucucugugccucaguucc

SEQ ID NO: 359389 - RNA, 32 nt, Human
caugcuagugcgcuccagccugggcaacagag

SEQ ID NO: 359390 - RNA, 32 nt, Human
caugcuaguugagacuuuucaaauggauuuuu

SEQ ID NO: 359391 - RNA, 32 nt, Human
caugcuauugugauauuuuagcacuuugguag

SEQ ID NO: 359392 - RNA, 32 nt, Human
caugcucaaccuaggcagggcggggcaggagg

SEQ ID NO: 359393 - RNA, 32 nt, Human
caugcucacaccacugcacuccagccugggug

SEQ ID NO: 359394 - RNA, 32 nt, Human
caugcucaccaaggaacucuacuucagucaau

SEQ ID NO: 359395 - RNA, 32 nt, Human
caugcucacugccagcuccuguccugaguacu

SEQ ID NO: 359396 - RNA, 32 nt, Human
caugcucagaugucauaaguggcagcuaucuu

SEQ ID NO: 359397 - RNA, 32 nt, Human
caugcuccaaguccagcaaccugcacuccagc

SEQ ID NO: 359398 - RNA, 32 nt, Human
caugcuccagggucaggcggagcugcugagug

SEQ ID NO: 359399 - RNA, 32 nt, Human
caugcucccuccaggcuugcggggagaacuuc

SEQ ID NO: 359400 - RNA, 32 nt, Human
caugcucccugcccucuccacagugcugcucc

SEQ ID NO: 359401 - RNA, 32 nt, Human
caugcucccugcggcccugcccucccgcccag

SEQ ID NO: 359402 - RNA, 32 nt, Human
caugcuccucaccuguauuuuguaaucagaaa

SEQ ID NO: 359403 - RNA, 32 nt, Human
caugcuccuccuccauuuuacccccuacccau

SEQ ID NO: 359404 - RNA, 32 nt, Human
caugcuccuugccucugcucugugcacucacg

SEQ ID NO: 359405 - RNA, 32 nt, Human
caugcucuacaaaaauuaggucacuugcccag

SEQ ID NO: 359406 - RNA, 32 nt, Human
caugcucuagacaccaccucgcuggagaagcu

SEQ ID NO: 359407 - RNA, 32 nt, Human
caugcucuccccaggguggggcuauggaaucc

SEQ ID NO: 359408 - RNA, 26 nt, Human
caugcucuccucucuugacaaagaga

SEQ ID NO: 359409 - RNA, 32 nt, Human
caugcucucuauagaggaggauggucaucgug

SEQ ID NO: 359410 - RNA, 32 nt, Human
caugcucucucccaaacacugcuuucagugca

SEQ ID NO: 359411 - RNA, 32 nt, Human
caugcucucucccuuguuuccuuaagagcuca

SEQ ID NO: 359412 - RNA, 32 nt, Human
caugcucucuuucuuuucucugucuacuccuu

SEQ ID NO: 359413 - RNA, 32 nt, Human
caugcucugaaauccuauauaaaagaguuuaa

SEQ ID NO: 359414 - RNA, 32 nt, Human
caugcucugacuuucucucucuuucgauucuu

SEQ ID NO: 359415 - RNA, 32 nt, Human
caugcucugagaugcuauaaauggagcaaaca

SEQ ID NO: 359416 - RNA, 32 nt, Human
caugcucugcucucuucaaccagaccucuaca

SEQ ID NO: 359417 - RNA, 32 nt, Human
caugcucuggggacaggaggggaaggcaacau

SEQ ID NO: 359418 - RNA, 32 nt, Human
caugcucugucgcccaggcuggagugcagugg

SEQ ID NO: 359419 - RNA, 32 nt, Human
caugcucugugcaaugaagucugcaggccuga

SEQ ID NO: 359420 - RNA, 20 nt, Human
caugcucuucaccuguucua

SEQ ID NO: 359421 - RNA, 32 nt, Human
caugcucuucccacccuccacccaccagagug

SEQ ID NO: 359422 - RNA, 32 nt, Human
caugcugaaccccuucaucugcagccugagaa

SEQ ID NO: 359423 - RNA, 24 nt, Human
caugcugacauucaucaccgcaaa

SEQ ID NO: 359424 - RNA, 32 nt, Human
caugcugacugugaugagaaauugcagcaccu

SEQ ID NO: 359425 - RNA, 32 nt, Human
caugcugagcaugcucacaaagaaggcucguc

SEQ ID NO: 359426 - RNA, 32 nt, Human
caugcugagcccccuccuuggcugaagcccga

SEQ ID NO: 359427 - RNA, 32 nt, Human
caugcugagcgacagcccuggggucaugugcc

SEQ ID NO: 359428 - RNA, 32 nt, Human
caugcugauguucacaaggcacacagcauuuc

SEQ ID NO: 359429 - RNA, 32 nt, Human
caugcugcacagaaacugguauaacaugccuu

SEQ ID NO: 359430 - RNA, 21 nt, Human
caugcugcaccaggagcagag

SEQ ID NO: 359431 - RNA, 31 nt, Human
caugcugcacuucuccacugucggagcacgu

SEQ ID NO: 359432 - RNA, 32 nt, Human
caugcugcaugcucuggggucccuccagguga

SEQ ID NO: 359433 - RNA, 32 nt, Human
caugcugccagauagauagaaaaagaagcaug

SEQ ID NO: 359434 - RNA, 32 nt, Human
caugcugcccguaagagucacaaccugugugu

SEQ ID NO: 359435 - RNA, 31 nt, Human
caugcugccuucucugggcucacgacuguuc

SEQ ID NO: 359436 - RNA, 32 nt, Human
caugcugcuauugucaucuuccuugaauucuu

SEQ ID NO: 359437 - RNA, 32 nt, Human
caugcugcugcccaggcuggagugcaguggug

SEQ ID NO: 359438 - RNA, 32 nt, Human
caugcugcuguccagugagcagccgggccaga

SEQ ID NO: 359439 - RNA, 32 nt, Human
caugcugcuguuggcuccaucucuccacacug

SEQ ID NO: 359440 - RNA, 32 nt, Human
caugcugcuuccucucgaugccaagccagacc

SEQ ID NO: 359441 - RNA, 22 nt, Human
caugcugcuucugucugucuua

SEQ ID NO: 359442 - RNA, 32 nt, Human
caugcuggacccaagcucagcucagcguccgg

SEQ ID NO: 359443 - RNA, 18 nt, Human
caugcuggagagaaaccu

SEQ ID NO: 359444 - RNA, 32 nt, Human
caugcuggcauuacagguaugagccaccgcgc

SEQ ID NO: 359445 - RNA, 32 nt, Human
caugcuggccaacguggugaaaccccgucucu

SEQ ID NO: 359446 - RNA, 32 nt, Human
caugcuggcuaacauggugaaaccccaucucu

SEQ ID NO: 359447 - RNA, 32 nt, Human
caugcuggcuaacauggugaaaccccgucucu

SEQ ID NO: 359448 - RNA, 24 nt, Human
caugcuggcucaugccuguaaucc

SEQ ID NO: 359449 - RNA, 32 nt, Human
caugcuggcucaugccuguaaucccagcacuu

SEQ ID NO: 359450 - RNA, 18 nt, Human
caugcuggcucgcuccca

SEQ ID NO: 359451 - RNA, 32 nt, Human
caugcuggcuuaugacuguaaucccagcagga

SEQ ID NO: 359452 - RNA, 32 nt, Human
caugcugggagccacagauauccagagccagc

SEQ ID NO: 359453 - RNA, 32 nt, Human
caugcugggaugagcgacugccuagcaagcaa

SEQ ID NO: 359454 - RNA, 32 nt, Human
caugcugggauuauagacauuagccaccaugc

SEQ ID NO: 359455 - RNA, 32 nt, Human
caugcugggcaggcuugggggugacaugggcc

SEQ ID NO: 359456 - RNA, 26 nt, Human
caugcugggcucucccugccuucugu

SEQ ID NO: 359457 - RNA, 32 nt, Human
caugcugggucucuuccacagacuuuaagcuc

SEQ ID NO: 359458 - RNA, 32 nt, Human
caugcuggucauuuacccucagaaagacucuc

SEQ ID NO: 359459 - RNA, 32 nt, Human
caugcuggucucaaacuccugaccucguguga

SEQ ID NO: 359460 - RNA, 32 nt, Human
caugcuggucucaaacuccugggcucaagcaa

SEQ ID NO: 359461 - RNA, 32 nt, Human
caugcuggugauuuucuguaaucccaguaauc

SEQ ID NO: 359462 - RNA, 32 nt, Human
caugcuggugcacaccuguaaucccagcuacu

SEQ ID NO: 359463 - RNA, 18 nt, Human
caugcuggugugcugcac

SEQ ID NO: 359464 - RNA, 32 nt, Human
caugcuguaaaucuuuacaaaauaucauuuga

SEQ ID NO: 359465 - RNA, 21 nt, Human
caugcuguaaucccaucacuu

SEQ ID NO: 359466 - RNA, 32 nt, Human
caugcugucauuuaucugaagguuguggcuga

SEQ ID NO: 359467 - RNA, 32 nt, Human
caugcugucuucauguggagcccucaccacaa

SEQ ID NO: 359468 - RNA, 32 nt, Human
caugcugugacccguuucaggcugcccaggcu

SEQ ID NO: 359469 - RNA, 32 nt, Human
caugcugugccaucaugugugcagccugccag

SEQ ID NO: 359470 - RNA, 32 nt, Human
caugcuguggaagcucugccuuuuugacuuca

SEQ ID NO: 359471 - RNA, 32 nt, Human
caugcuguggaagcucugccuuuuugacuucc

SEQ ID NO: 359472 - RNA, 32 nt, Human
caugcuguguuggaggaggaaguggcucuccu

SEQ ID NO: 359473 - RNA, 32 nt, Human
caugcuguugcccaggcuggagugcaguggug

SEQ ID NO: 359474 - RNA, 32 nt, Human
caugcuguugcccaggcuggagugcagugucc

SEQ ID NO: 359475 - RNA, 24 nt, Human
caugcuguugcugcuacugucuua

SEQ ID NO: 359476 - RNA, 32 nt, Human
caugcuguugcugcuacugucuuacuauuaua

SEQ ID NO: 359477 - RNA, 32 nt, Human
caugcuguuucccuuaacccugccuacacuuu

SEQ ID NO: 359478 - RNA, 32 nt, Human
caugcuucagccccucuguaggaaugagacca

SEQ ID NO: 359479 - RNA, 32 nt, Human
caugcuucauggucacacauacaggcacaaaa

SEQ ID NO: 359480 - RNA, 32 nt, Human
caugcuucauuucuuccacuucuccagaaaau

SEQ ID NO: 359481 - RNA, 32 nt, Human
caugcuucauuuucacaucucucugcacaauu

SEQ ID NO: 359482 - RNA, 32 nt, Human
caugcuuccagggagaggcagggcagccaggg

SEQ ID NO: 359483 - RNA, 32 nt, Human
caugcuucccuccuggugggcccuaggaugga

SEQ ID NO: 359484 - RNA, 32 nt, Human
caugcuuccuuuagcugcugugagaauuuguc

SEQ ID NO: 359485 - RNA, 32 nt, Human
caugcuucguagagggccaggagcagcagguc

SEQ ID NO: 359486 - RNA, 19 nt, Human
caugcuucuaaauggagcu

SEQ ID NO: 359487 - RNA, 32 nt, Human
caugcuucucaccaaauuuuuguugucauuga

SEQ ID NO: 359488 - RNA, 32 nt, Human
caugcuucuccucccuauuauuucuggcuuga

SEQ ID NO: 359489 - RNA, 32 nt, Human
caugcuucugcaagcuuuacaggaagcauugc

SEQ ID NO: 359490 - RNA, 32 nt, Human
caugcuucuuuccaacacguguucacaaucuc

SEQ ID NO: 359491 - RNA, 32 nt, Human
caugcuucuuucuccaccugaggucuuggucu

SEQ ID NO: 359492 - RNA, 32 nt, Human
caugcuugagggcuggagccgccugccgucag

SEQ ID NO: 359493 - RNA, 32 nt, Human
caugcuugcccucccccuccccuacccccauc

SEQ ID NO: 359494 - RNA, 32 nt, Human
caugcuuggaagccacuagccagcaagcauua

SEQ ID NO: 359495 - RNA, 32 nt, Human
caugcuuggcccucucuccucaaaagggcaau

SEQ ID NO: 359496 - RNA, 32 nt, Human
caugcuuggguguaacaggucuccucuuaaaa

SEQ ID NO: 359497 - RNA, 32 nt, Human
caugcuuguaaucccagcuacuugggaggcug

SEQ ID NO: 359498 - RNA, 32 nt, Human
caugcuuguagucccagcuacuugggaggcug

SEQ ID NO: 359499 - RNA, 32 nt, Human
caugcuuguggucccagcuacuuugggagguu

SEQ ID NO: 359500 - RNA, 32 nt, Human
caugcuuucaaaagcuaaucugccuguugaug

SEQ ID NO: 359501 - RNA, 22 nt, Human
caugcuuucuuagccacgcagc

SEQ ID NO: 359502 - RNA, 32 nt, Human
caugcuuugagcucagcagcagucuucauaaa

SEQ ID NO: 359503 - RNA, 32 nt, Human
caugcuuugagguuuggggugcucaggcuggg

SEQ ID NO: 359504 - RNA, 32 nt, Human
caugcuuugcuuaauguacuccaggcuucuuc

SEQ ID NO: 359505 - RNA, 31 nt, Human
caugcuuuuaaaugucucaugccaaggcacu

SEQ ID NO: 359506 - RNA, 32 nt, Human
caugcuuuugcagcuuuucacaguuuauuugc

SEQ ID NO: 359507 - RNA, 24 nt, Human
cauggaaaaaccccaucucuacua

SEQ ID NO: 359508 - RNA, 32 nt, Human
cauggaaagccucuaauuuuguuuauuuggga

SEQ ID NO: 359509 - RNA, 32 nt, Human
cauggaaauagaaugaauagaggggcauucac

SEQ ID NO: 359510 - RNA, 32 nt, Human
cauggaacagcaucuccccugggcuugcuccu

SEQ ID NO: 359511 - RNA, 32 nt, Human
cauggaacaguguggcucuucugagcuuacgu

SEQ ID NO: 359512 - RNA, 32 nt, Human
cauggaacccuccaucagauuuggaagaaagu

SEQ ID NO: 359513 - RNA, 32 nt, Human
cauggaacccuuguuuaucgccaugcaaauua

SEQ ID NO: 359514 - RNA, 32 nt, Human
cauggaaccuaccacacccacuucuccaacuu

SEQ ID NO: 359515 - RNA, 32 nt, Human
cauggaacucacaccucuagccccagcuacuc

SEQ ID NO: 359516 - RNA, 32 nt, Human
cauggaacucagguuuccuauuuggaaacuag

SEQ ID NO: 359517 - RNA, 32 nt, Human
cauggaacuuacacaaaaggcuuuucaugugc

SEQ ID NO: 359518 - RNA, 32 nt, Human
cauggaagaagagggggagagaguuacagguu

SEQ ID NO: 359519 - RNA, 32 nt, Human
cauggaagacaggaagaaaggaagagagggaa

SEQ ID NO: 359520 - RNA, 32 nt, Human
cauggaagcacaguagaucugcagaguguuuu

SEQ ID NO: 359521 - RNA, 32 nt, Human
cauggaagcacaugccuauaaucccagcacuu

SEQ ID NO: 359522 - RNA, 32 nt, Human
cauggaagccacguuccagaaguuuccaugcu

SEQ ID NO: 359523 - RNA, 32 nt, Human
cauggaagccauccugaaacucuuuggagaau

SEQ ID NO: 359524 - RNA, 26 nt, Human
cauggaagccccggagggcggcggag

SEQ ID NO: 359525 - RNA, 32 nt, Human
cauggaagccugggucacagaggcagguacca

SEQ ID NO: 359526 - RNA, 32 nt, Human
cauggaaggagaagauaaugaagaggaaguug

SEQ ID NO: 359527 - RNA, 32 nt, Human
cauggaaggcuggcuggaauggcacugauaac

SEQ ID NO: 359528 - RNA, 32 nt, Human
cauggaagucuuaaacagaaacuguuacuguc

SEQ ID NO: 359529 - RNA, 31 nt, Human
cauggaagugagaggugaagccagcuggucu

SEQ ID NO: 359530 - RNA, 32 nt, Human
cauggaagugaguuauaaugaggcagaaacaa

SEQ ID NO: 359531 - RNA, 32 nt, Human
cauggaaguggaggggacagggugugagcugg

SEQ ID NO: 359532 - RNA, 32 nt, Human
cauggaauaagaaaguauacuuauggacaaaa

SEQ ID NO: 359533 - RNA, 32 nt, Human
cauggaaucacugcaaaucuaucugcucuuca

SEQ ID NO: 359534 - RNA, 22 nt, Human
cauggaaucaggccacagcagg

SEQ ID NO: 359535 - RNA, 32 nt, Human
cauggaauccauuuugucaugauguauuuuua

SEQ ID NO: 359536 - RNA, 32 nt, Human
cauggaaucuuugaacaucccaccucaaaacu

SEQ ID NO: 359537 - RNA, 32 nt, Human
cauggaaugccuagugcuaagugcaguguccu

SEQ ID NO: 359538 - RNA, 32 nt, Human
cauggaauuggaacuccuauuccuugcuuaga

SEQ ID NO: 359539 - RNA, 32 nt, Human
cauggacacagccccaggaugugcagggugag

SEQ ID NO: 359540 - RNA, 32 nt, Human
cauggacacaguuucucucagugggacuauuc

SEQ ID NO: 359541 - RNA, 32 nt, Human
cauggacacauccugaagucagcccaggcgcc

SEQ ID NO: 359542 - RNA, 32 nt, Human
cauggacaccgacacaggcacauguacaugca

SEQ ID NO: 359543 - RNA, 32 nt, Human
cauggacaccugcucaccccugccucaucugu

SEQ ID NO: 359544 - RNA, 21 nt, Human
cauggacacugcaugcaugua

SEQ ID NO: 359545 - RNA, 32 nt, Human
cauggacagcgugucugcuccgggucucuacc

SEQ ID NO: 359546 - RNA, 32 nt, Human
cauggacaucaucugugaggcucugucccaga

SEQ ID NO: 359547 - RNA, 21 nt, Human
cauggaccacagaacagcaga

SEQ ID NO: 359548 - RNA, 32 nt, Human
cauggaccacaguaacauggacugcuucaucu

SEQ ID NO: 359549 - RNA, 32 nt, Human
cauggaccacagugccagauccucaucacgcc

SEQ ID NO: 359550 - RNA, 32 nt, Human
cauggaccacaguggcaucacagcuggcaucu

SEQ ID NO: 359551 - RNA, 32 nt, Human
cauggaccaccugaagagcaaguacccacagc

SEQ ID NO: 359552 - RNA, 32 nt, Human
cauggaccauagauugcugucccccucgacgg

SEQ ID NO: 359553 - RNA, 32 nt, Human
cauggacccaacugggccccagaagagccaca

SEQ ID NO: 359554 - RNA, 32 nt, Human
cauggacccauccuggaaucagaaucaggccc

SEQ ID NO: 359555 - RNA, 18 nt, Human
cauggacccaucgcugcc

SEQ ID NO: 359556 - RNA, 17 nt, Human
cauggaccccgcuguca

SEQ ID NO: 359557 - RNA, 32 nt, Human
cauggacccgagagccaaauguaacagcagga

SEQ ID NO: 359558 - RNA, 32 nt, Human
cauggacccgagaggcgacgacacgagugaau

SEQ ID NO: 359559 - RNA, 19 nt, Human
cauggacccuccucugcca

SEQ ID NO: 359560 - RNA, 32 nt, Human
cauggacccuggagccagccacugaccccgcc

SEQ ID NO: 359561 - RNA, 32 nt, Human
cauggacccuuuucuucacugugugaucccaa

SEQ ID NO: 359562 - RNA, 32 nt, Human
cauggaccugcacuuggccucuucgggaagau

SEQ ID NO: 359563 - RNA, 32 nt, Human
cauggaccugggaggcggagcuugcagugagc

SEQ ID NO: 359564 - RNA, 32 nt, Human
cauggacuauggacucuuucaaagggaucuga

SEQ ID NO: 359565 - RNA, 32 nt, Human
cauggacucaggacucaggucucccauagcug

SEQ ID NO: 359566 - RNA, 32 nt, Human
cauggacuccauuugaacaagauacuuaauuc

SEQ ID NO: 359567 - RNA, 32 nt, Human
cauggacucccagacugcaggggagcacuugg

SEQ ID NO: 359568 - RNA, 32 nt, Human
cauggacucuuuucugucuccugggucccugc

SEQ ID NO: 359569 - RNA, 32 nt, Human
cauggacugaacacuugcugggcuccaacccu

SEQ ID NO: 359570 - RNA, 21 nt, Human
cauggacugagucacagcaga

SEQ ID NO: 359571 - RNA, 32 nt, Human
cauggacugaguguuugagaugugccaggcuc

SEQ ID NO: 359572 - RNA, 32 nt, Human
cauggacugugagacuacucccuccuguuccu

SEQ ID NO: 359573 - RNA, 32 nt, Human
cauggacuguugcugcucccuguuccauaugc

SEQ ID NO: 359574 - RNA, 32 nt, Human
cauggacuucaggcuguuaguggcaguacuga

SEQ ID NO: 359575 - RNA, 32 nt, Human
cauggagaaacacacccgcgcacacagcugcu

SEQ ID NO: 359576 - RNA, 24 nt, Human
cauggagaaacauuuccccccauu

SEQ ID NO: 359577 - RNA, 24 nt, Human
cauggagaaaccccaucucuacua

SEQ ID NO: 359578 - RNA, 24 nt, Human
cauggagaaacccugucuccacua

SEQ ID NO: 359579 - RNA, 23 nt, Human
cauggagaaccccaucucuacua

SEQ ID NO: 359580 - RNA, 32 nt, Human
cauggagagagcauguguucucugauugugag

SEQ ID NO: 359581 - RNA, 32 nt, Human
cauggagagggcugugugucugggacuucucg

SEQ ID NO: 359582 - RNA, 17 nt, Human
cauggagagugcugcca

SEQ ID NO: 359583 - RNA, 32 nt, Human
cauggagcacagccaggguggggaggggagca

SEQ ID NO: 359584 - RNA, 32 nt, Human
cauggagcagagccacagaagcucacauguaa

SEQ ID NO: 359585 - RNA, 32 nt, Human
cauggagcagaggagccucucaccuccugucc

SEQ ID NO: 359586 - RNA, 26 nt, Human
cauggagcagccgccggcgccuaaga

SEQ ID NO: 359587 - RNA, 32 nt, Human
cauggagcccugcgaccucccugcccugccgc

SEQ ID NO: 359588 - RNA, 18 nt, Human
cauggagccgccgcugcc

SEQ ID NO: 359589 - RNA, 32 nt, Human
cauggagccggggagagcggggaagucucugc

SEQ ID NO: 359590 - RNA, 32 nt, Human
cauggagccuccagucuagcugccucuugugc

SEQ ID NO: 359591 - RNA, 18 nt, Human
cauggagcgcggcccugg

SEQ ID NO: 359592 - RNA, 26 nt, Human
cauggagcuguuccucgcgggccgcc

SEQ ID NO: 359593 - RNA, 32 nt, Human
cauggaggaaaacuaguguuucugcuacugcu

SEQ ID NO: 359594 - RNA, 20 nt, Human
cauggaggaaacgcagcaga

SEQ ID NO: 359595 - RNA, 32 nt, Human
cauggaggaaggugagcucucugggccugaga

SEQ ID NO: 359596 - RNA, 32 nt, Human
cauggaggaggcggaggccgcggcgagccggg

SEQ ID NO: 359597 - RNA, 32 nt, Human
cauggaggcaguaggacaaggugcaggcaggc

SEQ ID NO: 359598 - RNA, 32 nt, Human
cauggaggccuuugcgcagagagcagagagga

SEQ ID NO: 359599 - RNA, 32 nt, Human
cauggaggcgaaucuguugugggugaagcaga

SEQ ID NO: 359600 - RNA, 32 nt, Human
cauggaggcucacaccuguaaucccaacacuu

SEQ ID NO: 359601 - RNA, 24 nt, Human
cauggaggcucaugccuguaaucc

SEQ ID NO: 359602 - RNA, 32 nt, Human
cauggaggcucaugccuguaauccuagcagcu

SEQ ID NO: 359603 - RNA, 32 nt, Human
cauggaggcugcagccuuaggagagcucugag

SEQ ID NO: 359604 - RNA, 32 nt, Human
cauggagggagcuggggagagugaaggaguca

SEQ ID NO: 359605 - RNA, 32 nt, Human
cauggagggaggcagaagagccagggugguua

SEQ ID NO: 359606 - RNA, 32 nt, Human
cauggagggaggcggcggcggcggcggcggcg

SEQ ID NO: 359607 - RNA, 32 nt, Human
cauggagggagggagagggggcguguugaaca

SEQ ID NO: 359608 - RNA, 32 nt, Human
cauggagggauuauggucugaaguaaccagca

SEQ ID NO: 359609 - RNA, 32 nt, Human
cauggagggauuuggagcaggagagugaaaug

SEQ ID NO: 359610 - RNA, 32 nt, Human
cauggagggcaggccaggauggagcccagggu

SEQ ID NO: 359611 - RNA, 32 nt, Human
cauggagggcaggguauccauucuuuaccaug

SEQ ID NO: 359612 - RNA, 32 nt, Human
cauggaggggaaggugccacccgccuuggcug

SEQ ID NO: 359613 - RNA, 32 nt, Human
cauggaggggguacaggaagagacugacacaa

SEQ ID NO: 359614 - RNA, 32 nt, Human
cauggagggguggucagaggcgggcgggacca

SEQ ID NO: 359615 - RNA, 32 nt, Human
cauggagggugaggcugggugucuggaagcau

SEQ ID NO: 359616 - RNA, 32 nt, Human
cauggagguuagauugggaggaaagcuuaaaa

SEQ ID NO: 359617 - RNA, 32 nt, Human
cauggaguagagcccgagauccuggccacuau

SEQ ID NO: 359618 - RNA, 32 nt, Human
cauggaguccaaguaaugaauuuauagaggaa

SEQ ID NO: 359619 - RNA, 32 nt, Human
cauggaguccacauggccugucuaggccugau

SEQ ID NO: 359620 - RNA, 32 nt, Human
cauggagucuggagcaggagcagcuguugugc

SEQ ID NO: 359621 - RNA, 32 nt, Human
cauggaguuuggggucaucagauguggcuuua

SEQ ID NO: 359622 - RNA, 32 nt, Human
cauggauaacuauccaauugggaccaaugcca

SEQ ID NO: 359623 - RNA, 18 nt, Human
cauggauaauagugcuaa

SEQ ID NO: 359624 - RNA, 32 nt, Human
cauggauacgcuugugaucaagggccuggucu

SEQ ID NO: 359625 - RNA, 32 nt, Human
cauggauacggggucccgggaggcagccuuca

SEQ ID NO: 359626 - RNA, 32 nt, Human
cauggauacucaggaaggaacacacacccauu

SEQ ID NO: 359627 - RNA, 32 nt, Human
cauggauagucuuuaaucucugaucuuuuugg

SEQ ID NO: 359628 - RNA, 32 nt, Human
cauggauauacaacagaaaacacuuugaguug

SEQ ID NO: 359629 - RNA, 20 nt, Human
cauggauauuucugcugcca

SEQ ID NO: 359630 - RNA, 32 nt, Human
cauggaucagggcucacaccuggcccaucugg

SEQ ID NO: 359631 - RNA, 32 nt, Human
cauggauccuuucucagaaaaauaacuguaaa

SEQ ID NO: 359632 - RNA, 32 nt, Human
cauggaugaaguuucgcugggugcucgugacu

SEQ ID NO: 359633 - RNA, 32 nt, Human
cauggaugcucucuuucuggaagcuguggccu

SEQ ID NO: 359634 - RNA, 32 nt, Human
cauggauggacaagggcuuuuggccacaggug

SEQ ID NO: 359635 - RNA, 30 nt, Human
cauggauggaggaggaagagauaaggacgu

SEQ ID NO: 359636 - RNA, 32 nt, Human
cauggauggcaggggcagagugcagguggaga

SEQ ID NO: 359637 - RNA, 32 nt, Human
cauggauggugggaaauuaaugagcacaugua

SEQ ID NO: 359638 - RNA, 32 nt, Human
cauggauguagugcuuuuuagaggagccacug

SEQ ID NO: 359639 - RNA, 32 nt, Human
cauggauguggacaccauggagggggaagugg

SEQ ID NO: 359640 - RNA, 32 nt, Human
cauggauuaggaguaaagaaagaggcaggcgc

SEQ ID NO: 359641 - RNA, 32 nt, Human
cauggauucccaagaugugagcuuuuuacaua

SEQ ID NO: 359642 - RNA, 32 nt, Human
cauggauuccugauaucugaugagagguucau

SEQ ID NO: 359643 - RNA, 32 nt, Human
cauggauuguguauuuugacuuuuauuuuaua

SEQ ID NO: 359644 - RNA, 32 nt, Human
cauggauuguuccuccacaugcugcaaacaca

SEQ ID NO: 359645 - RNA, 32 nt, Human
cauggauuugcggccagcucuccuggggguag

SEQ ID NO: 359646 - RNA, 24 nt, Human
cauggcaaaaccacaucucuacua

SEQ ID NO: 359647 - RNA, 32 nt, Human
cauggcaaaaccagcuuaggaccucugcugua

SEQ ID NO: 359648 - RNA, 22 nt, Human
cauggcaaaaccaucucuacua

SEQ ID NO: 359649 - RNA, 24 nt, Human
cauggcaaaaccccaacucuacua

SEQ ID NO: 359650 - RNA, 22 nt, Human
cauggcaaaaccccaucucuac

SEQ ID NO: 359651 - RNA, 24 nt, Human
cauggcaaaaccccaucucuacua

SEQ ID NO: 359652 - RNA, 24 nt, Human
cauggcaaaaccccaucucugcua

SEQ ID NO: 359653 - RNA, 24 nt, Human
cauggcaaaaccccaucuuuacua

SEQ ID NO: 359654 - RNA, 24 nt, Human
cauggcaaaaccccgucucuacua

SEQ ID NO: 359655 - RNA, 24 nt, Human
cauggcaaaaccccuucucuacua

SEQ ID NO: 359656 - RNA, 22 nt, Human
cauggcaaaacccuaucucuac

SEQ ID NO: 359657 - RNA, 24 nt, Human
cauggcaaaacccuaucucuacua

SEQ ID NO: 359658 - RNA, 22 nt, Human
cauggcaaaacccugucuacua

SEQ ID NO: 359659 - RNA, 21 nt, Human
cauggcaaaacccugucucua

SEQ ID NO: 359660 - RNA, 24 nt, Human
cauggcaaaacccugucucuacua

SEQ ID NO: 359661 - RNA, 24 nt, Human
cauggcaaaaccucgucucuacua

SEQ ID NO: 359662 - RNA, 24 nt, Human
cauggcaaaagcccaucucuacua

SEQ ID NO: 359663 - RNA, 24 nt, Human
cauggcaaaaucccaucucuacua

SEQ ID NO: 359664 - RNA, 32 nt, Human
cauggcaacuggagaaaaugggaggaaagaca

SEQ ID NO: 359665 - RNA, 24 nt, Human
cauggcaagaccccaucucuacua

SEQ ID NO: 359666 - RNA, 32 nt, Human
cauggcaagagagaaagaaagagaaaguacuc

SEQ ID NO: 359667 - RNA, 24 nt, Human
cauggcaauacccuaucucuacua

SEQ ID NO: 359668 - RNA, 32 nt, Human
cauggcacaggggacugcaguggugugcuuug

SEQ ID NO: 359669 - RNA, 32 nt, Human
cauggcacaucucagcuccucauugagggaua

SEQ ID NO: 359670 - RNA, 32 nt, Human
cauggcacccagcuaauuuuguauuuuuagua

SEQ ID NO: 359671 - RNA, 32 nt, Human
cauggcacucacuccagccugggcaacaagag

SEQ ID NO: 359672 - RNA, 32 nt, Human
cauggcacugacaaugggcacugauuugauac

SEQ ID NO: 359673 - RNA, 32 nt, Human
cauggcacugagacuuuggaaguggccuugcc

SEQ ID NO: 359674 - RNA, 32 nt, Human
cauggcacugcacuccagccugggcaacagag

SEQ ID NO: 359675 - RNA, 32 nt, Human
cauggcacuggcagggggcauggaggagaaag

SEQ ID NO: 359676 - RNA, 32 nt, Human
cauggcacuggguggggcugggggauauucuc

SEQ ID NO: 359677 - RNA, 32 nt, Human
cauggcacuuggaagaaaaagacccacugaau

SEQ ID NO: 359678 - RNA, 32 nt, Human
cauggcagacagcgggcuggugaacaggaaga

SEQ ID NO: 359679 - RNA, 22 nt, Human
cauggcagacuagggcugcacc

SEQ ID NO: 359680 - RNA, 32 nt, Human
cauggcagacuuugaaguugcguuucaucuua

SEQ ID NO: 359681 - RNA, 32 nt, Human
cauggcagaguuguuuugcccaccugugaaaa

SEQ ID NO: 359682 - RNA, 21 nt, Human
cauggcagaguuuugugggaa

SEQ ID NO: 359683 - RNA, 32 nt, Human
cauggcagauuuccagccuggugaugcuguac

SEQ ID NO: 359684 - RNA, 32 nt, Human
cauggcagccuacauggcauuacuugugacca

SEQ ID NO: 359685 - RNA, 32 nt, Human
cauggcagcugguugcuccauuugagagacac

SEQ ID NO: 359686 - RNA, 32 nt, Human
cauggcaggaaggaagaccagaucuguaugau

SEQ ID NO: 359687 - RNA, 32 nt, Human
cauggcaggauguucuggcacagcagacugga

SEQ ID NO: 359688 - RNA, 32 nt, Human
cauggcagucaccauugucuugacuugggaaa

SEQ ID NO: 359689 - RNA, 32 nt, Human
cauggcagucauuccuggaaggggcaggaccu

SEQ ID NO: 359690 - RNA, 32 nt, Human
cauggcagucguggcccggggaucauuccaag

SEQ ID NO: 359691 - RNA, 32 nt, Human
cauggcagugcaucugccacaguggcugggca

SEQ ID NO: 359692 - RNA, 17 nt, Human
cauggcaguuggcucca

SEQ ID NO: 359693 - RNA, 32 nt, Human
cauggcaucauugcauuccagccugggcaaca

SEQ ID NO: 359694 - RNA, 32 nt, Human
cauggcaucucuaaugaaaacagguucuagaa

SEQ ID NO: 359695 - RNA, 32 nt, Human
cauggcauguguggcccugucugcuuauccuu

SEQ ID NO: 359696 - RNA, 32 nt, Human
cauggcauguuuuguuacagguuguagaguau

SEQ ID NO: 359697 - RNA, 32 nt, Human
cauggcauuauagccuuugaagaaaggccagu

SEQ ID NO: 359698 - RNA, 16 nt, Human
cauggcauugcugcca

SEQ ID NO: 359699 - RNA, 32 nt, Human
cauggcauugggggacaacaggauucucuguc

SEQ ID NO: 359700 - RNA, 32 nt, Human
cauggcauugguaugaaggccauuuagcugcc

SEQ ID NO: 359701 - RNA, 17 nt, Human
cauggccaaaucgguca

SEQ ID NO: 359702 - RNA, 19 nt, Human
cauggccaaggcccugcca

SEQ ID NO: 359703 - RNA, 19 nt, Human
cauggccaagguccagcca

SEQ ID NO: 359704 - RNA, 32 nt, Human
cauggccaauccagugggugcaucccuggaca

SEQ ID NO: 359705 - RNA, 18 nt, Human
cauggccaauuuguuaca

SEQ ID NO: 359706 - RNA, 32 nt, Human
cauggccacaaaccauucagaucagccacuug

SEQ ID NO: 359707 - RNA, 19 nt, Human
cauggccacaagucugcua

SEQ ID NO: 359708 - RNA, 32 nt, Human
cauggccacagccaccuccacccccaagaaac

SEQ ID NO: 359709 - RNA, 32 nt, Human
cauggccacagcucaggcugggcuguggugcc

SEQ ID NO: 359710 - RNA, 32 nt, Human
cauggccacagcugagugccccagggagggca

SEQ ID NO: 359711 - RNA, 32 nt, Human
cauggccacauccugaauguugacaauacccu

SEQ ID NO: 359712 - RNA, 32 nt, Human
cauggccacaugggucacgccuggugccuuca

SEQ ID NO: 359713 - RNA, 18 nt, Human
cauggccaccccgugcca

SEQ ID NO: 359714 - RNA, 23 nt, Human
cauggccaccccucaccugugga

SEQ ID NO: 359715 - RNA, 32 nt, Human
cauggccacgcaccuucucucaggccuucggg

SEQ ID NO: 359716 - RNA, 20 nt, Human
cauggccacucaaccuguca

SEQ ID NO: 359717 - RNA, 17 nt, Human
cauggccacucccugcc

SEQ ID NO: 359718 - RNA, 32 nt, Human
cauggccacucccugcccccagccuggcugga

SEQ ID NO: 359719 - RNA, 32 nt, Human
cauggccacucccugcccccagccuggcuuga

SEQ ID NO: 359720 - RNA, 19 nt, Human
cauggccacugcuucacca

SEQ ID NO: 359721 - RNA, 17 nt, Human
cauggccacuggcucca

SEQ ID NO: 359722 - RNA, 18 nt, Human
cauggccagaaacgugcc

SEQ ID NO: 359723 - RNA, 18 nt, Human
cauggccagacugugcca

SEQ ID NO: 359724 - RNA, 32 nt, Human
cauggccagagaacaggagcggaacauugccu

SEQ ID NO: 359725 - RNA, 32 nt, Human
cauggccagagcuucucccaggcacagguguu

SEQ ID NO: 359726 - RNA, 17 nt, Human
cauggccagcacugccg

SEQ ID NO: 359727 - RNA, 16 nt, Human
cauggccagcccugcc

SEQ ID NO: 359728 - RNA, 16 nt, Human
cauggccagccgagcc

SEQ ID NO: 359729 - RNA, 26 nt, Human
cauggccagcguccacgagagccucu

SEQ ID NO: 359730 - RNA, 16 nt, Human
cauggccagcugacca

SEQ ID NO: 359731 - RNA, 17 nt, Human
cauggccagcuucaguc

SEQ ID NO: 359732 - RNA, 18 nt, Human
cauggccagcuuccuucc

SEQ ID NO: 359733 - RNA, 19 nt, Human
cauggccaggacacugcca

SEQ ID NO: 359734 - RNA, 19 nt, Human
cauggccaggagggcucca

SEQ ID NO: 359735 - RNA, 17 nt, Human
cauggccaggcuggcca

SEQ ID NO: 359736 - RNA, 19 nt, Human
cauggccaggggccuguca

SEQ ID NO: 359737 - RNA, 18 nt, Human
cauggccaggucugguca

SEQ ID NO: 359738 - RNA, 16 nt, Human
cauggccagguggcca

SEQ ID NO: 359739 - RNA, 16 nt, Human
cauggccagguggcua

SEQ ID NO: 359740 - RNA, 19 nt, Human
cauggccagguggcugcca

SEQ ID NO: 359741 - RNA, 16 nt, Human
cauggccagguuacca

SEQ ID NO: 359742 - RNA, 16 nt, Human
cauggccagguuggcc

SEQ ID NO: 359743 - RNA, 18 nt, Human
cauggccaguaguuggca

SEQ ID NO: 359744 - RNA, 18 nt, Human
cauggccagugcuuucca

SEQ ID NO: 359745 - RNA, 19 nt, Human
cauggccaguggccaugcc

SEQ ID NO: 359746 - RNA, 19 nt, Human
cauggccaguguguggcca

SEQ ID NO: 359747 - RNA, 16 nt, Human
cauggccaguguuuca

SEQ ID NO: 359748 - RNA, 18 nt, Human
cauggccaguugguguca

SEQ ID NO: 359749 - RNA, 17 nt, Human
cauggccaguuuuggcc

SEQ ID NO: 359750 - RNA, 32 nt, Human
cauggccaucgcugccccuuguugacaccucc

SEQ ID NO: 359751 - RNA, 17 nt, Human
cauggccaucguggcua

SEQ ID NO: 359752 - RNA, 18 nt, Human
cauggccaucuagcccca

SEQ ID NO: 359753 - RNA, 32 nt, Human
cauggccaucucccccucccuuuuuccuucuc

SEQ ID NO: 359754 - RNA, 32 nt, Human
cauggccauggagcuucaaggaaagaaacccc

SEQ ID NO: 359755 - RNA, 17 nt, Human
cauggccaugucuugcc

SEQ ID NO: 359756 - RNA, 17 nt, Human
cauggccauugucccca

SEQ ID NO: 359757 - RNA, 17 nt, Human
cauggccauuuccugcc

SEQ ID NO: 359758 - RNA, 32 nt, Human
cauggcccacccaggccuggagcugggaugca

SEQ ID NO: 359759 - RNA, 32 nt, Human
cauggcccagcaccugguguuugccaacugca

SEQ ID NO: 359760 - RNA, 22 nt, Human
cauggcccagcagcacacugug

SEQ ID NO: 359761 - RNA, 32 nt, Human
cauggccccagccaaugcauggaggcgaggca

SEQ ID NO: 359762 - RNA, 32 nt, Human
cauggccccagguggcgaguucagggaggccu

SEQ ID NO: 359763 - RNA, 32 nt, Human
cauggccccgccuaggccaucugggugcuggg

SEQ ID NO: 359764 - RNA, 32 nt, Human
cauggccccggagccccauccugggccugccc

SEQ ID NO: 359765 - RNA, 32 nt, Human
cauggccccugccucuucaggcucuccaggcu

SEQ ID NO: 359766 - RNA, 32 nt, Human
cauggccccugccuuaggccuaccugaucaaa

SEQ ID NO: 359767 - RNA, 32 nt, Human
cauggccccuucagacugcucccuucaccuuu

SEQ ID NO: 359768 - RNA, 32 nt, Human
cauggcccugaauccuccucugcuccagggcu

SEQ ID NO: 359769 - RNA, 28 nt, Human
cauggcccuggccauugauguguauggg

SEQ ID NO: 359770 - RNA, 32 nt, Human
cauggcccuguuuucugcuaaaaccagauuuu

SEQ ID NO: 359771 - RNA, 16 nt, Human
cauggccgaucuucca

SEQ ID NO: 359772 - RNA, 19 nt, Human
cauggccgcgcgcgcucca

SEQ ID NO: 359773 - RNA, 23 nt, Human
cauggccgcggcaugagcgugga

SEQ ID NO: 359774 - RNA, 16 nt, Human
cauggccgcugccgcc

SEQ ID NO: 359775 - RNA, 16 nt, Human
cauggccggucagcca

SEQ ID NO: 359776 - RNA, 18 nt, Human
cauggccgugaggcugcc

SEQ ID NO: 359777 - RNA, 21 nt, Human
cauggccgugcguccgcagga

SEQ ID NO: 359778 - RNA, 20 nt, Human
cauggccuaccuugcugcca

SEQ ID NO: 359779 - RNA, 32 nt, Human
cauggccucccaggggugcuggggaugcaucc

SEQ ID NO: 359780 - RNA, 31 nt, Human
cauggccuccucucugggcaguguugcugca

SEQ ID NO: 359781 - RNA, 21 nt, Human
cauggccugagugcgcagggg

SEQ ID NO: 359782 - RNA, 32 nt, Human
cauuucucacuggagcugcuucaaaaucagug

SEQ ID NO: 359783 - RNA, 32 nt, Human
cauuucucaguggcuucuccauccucauuugc

SEQ ID NO: 359784 - RNA, 32 nt, Human
cauuucuccacagggcagucugaagauggcca

SEQ ID NO: 359785 - RNA, 32 nt, Human
cauuucuccuuucacagaacugcccagguguu

SEQ ID NO: 359786 - RNA, 32 nt, Human
cauuucucuaagugggcugcugugaaguuuua

SEQ ID NO: 359787 - RNA, 32 nt, Human
cauuucucucaccucucaucuuuggaacggga

SEQ ID NO: 359788 - RNA, 32 nt, Human
cauuucucuccucuccuccuucugcuuaauuu

SEQ ID NO: 359789 - RNA, 32 nt, Human
cauuucucuccucucuaauuuuccugucaguu

SEQ ID NO: 359790 - RNA, 32 nt, Human
cauuucucuccucugccaaaucuacuuagccc

SEQ ID NO: 359791 - RNA, 32 nt, Human
cauuucucuggauggagacugugaacaucuga

SEQ ID NO: 359792 - RNA, 18 nt, Human
cauuucucuucugcccca

SEQ ID NO: 359793 - RNA, 32 nt, Human
cauuucucuuucuccagagcuccuauagggca

SEQ ID NO: 359794 - RNA, 32 nt, Human
cauuucugaccaggcugguggccugaguacau

SEQ ID NO: 359795 - RNA, 32 nt, Human
cauuucugaugauuugcuggagugcuggcucc

SEQ ID NO: 359796 - RNA, 19 nt, Human
cauuucugcaaguuaggua

SEQ ID NO: 359797 - RNA, 32 nt, Human
cauuucugcaccuuuggggucaugcuuuguag

SEQ ID NO: 359798 - RNA, 32 nt, Human
cauuucugcaccuuugggucaugcuuuguagc

SEQ ID NO: 359799 - RNA, 32 nt, Human
cauuucugcagccagugucuccugggugccuu

SEQ ID NO: 359800 - RNA, 32 nt, Human
cauuucugcccuuuagaauggcuugucccauc

SEQ ID NO: 359801 - RNA, 32 nt, Human
cauuucugccuuucuacacauuuacuucuugu

SEQ ID NO: 359802 - RNA, 32 nt, Human
cauuucugcucuuccaaagcuccugcgucugu

SEQ ID NO: 359803 - RNA, 21 nt, Human
cauuucugcugcaaaccuggu

SEQ ID NO: 359804 - RNA, 32 nt, Human
cauuucuggaaauggcuuuuauccaggaauua

SEQ ID NO: 359805 - RNA, 32 nt, Human
cauuucuggagcaggagguugucaggacaaca

SEQ ID NO: 359806 - RNA, 32 nt, Human
cauuucuggcugcuuuuuguuuuucauuuucu

SEQ ID NO: 359807 - RNA, 32 nt, Human
cauuucugggcccagccacaggacguccgaug

SEQ ID NO: 359808 - RNA, 32 nt, Human
cauuucugucuccuguuucuccacuuccuucu

SEQ ID NO: 359809 - RNA, 32 nt, Human
cauuucugugucagggcagggccaggaggaaa

SEQ ID NO: 359810 - RNA, 32 nt, Human
cauuucuguguuuauaaaugcauuaucucuga

SEQ ID NO: 359811 - RNA, 20 nt, Human
cauuucuguuuacuauggua

SEQ ID NO: 359812 - RNA, 32 nt, Human
cauuucuuacaguuauggaggcugagaagucc

SEQ ID NO: 359813 - RNA, 32 nt, Human
cauuucuuaccucccuccaggaacagugggca

SEQ ID NO: 359814 - RNA, 32 nt, Human
cauuucuucacucguuuagaguucggggcucu

SEQ ID NO: 359815 - RNA, 32 nt, Human
cauuucuucacugcaauugccauuugccuuuu

SEQ ID NO: 359816 - RNA, 20 nt, Human
cauuucuucagcagcccauu

SEQ ID NO: 359817 - RNA, 32 nt, Human
cauuucuucaguuaaagccuucagagacacac

SEQ ID NO: 359818 - RNA, 32 nt, Human
cauuucuuccauaugaagaaacaccaaacuau

SEQ ID NO: 359819 - RNA, 32 nt, Human
cauuucuucucucuggccucacguuguuucug

SEQ ID NO: 359820 - RNA, 32 nt, Human
cauuucuucugcggaaccuccaccccuccagu

SEQ ID NO: 359821 - RNA, 32 nt, Human
cauuucuucuggaagguggagcuuuacccaaa

SEQ ID NO: 359822 - RNA, 32 nt, Human
cauuucuuggacauauaccauuggacaugucu

SEQ ID NO: 359823 - RNA, 32 nt, Human
cauuucuugggagggcuuagagcuggauaaua

SEQ ID NO: 359824 - RNA, 32 nt, Human
cauuucuugguaucucucagcuuuuccucuug

SEQ ID NO: 359825 - RNA, 32 nt, Human
cauuugaaaggcugcugaaugugguaccagug

SEQ ID NO: 359826 - RNA, 32 nt, Human
cauuugaaaguagucagagagaaauggaagga

SEQ ID NO: 359827 - RNA, 32 nt, Human
cauuugaaggaguuaauuaaaagagagccaau

SEQ ID NO: 359828 - RNA, 22 nt, Human
cauuugaauaacccaguuuaaa

SEQ ID NO: 359829 - RNA, 32 nt, Human
cauuugaauauagguuguuuguuuuguuuugu

SEQ ID NO: 359830 - RNA, 32 nt, Human
cauuugaauggacaccucuaggaacaaugaua

SEQ ID NO: 359831 - RNA, 32 nt, Human
cauuugacacauaaaaguaauuaauugcugga

SEQ ID NO: 359832 - RNA, 32 nt, Human
cauuugaccccagaaggcuguugcagguccag

SEQ ID NO: 359833 - RNA, 32 nt, Human
cauuugagaagcuguggcugagcgcccacuag

SEQ ID NO: 359834 - RNA, 32 nt, Human
cauuugagaaguauuuccauccagugcuacuu

SEQ ID NO: 359835 - RNA, 32 nt, Human
cauuugagaugggguuuuaccauguuacccag

SEQ ID NO: 359836 - RNA, 32 nt, Human
cauuugagauguuugggauuaagccauacaau

SEQ ID NO: 359837 - RNA, 32 nt, Human
cauuugagccaggagguugagguugcagugag

SEQ ID NO: 359838 - RNA, 32 nt, Human
cauuugagcccagagguagaggcugcagugag

SEQ ID NO: 359839 - RNA, 32 nt, Human
cauuugagccugggaauuugagcccagcuuga

SEQ ID NO: 359840 - RNA, 32 nt, Human
cauuugaggaacaggacgucagcuuggcccuu

SEQ ID NO: 359841 - RNA, 32 nt, Human
cauuugaggauccuuccuaucucuccauggga

SEQ ID NO: 359842 - RNA, 32 nt, Human
cauuugauugcucugcaguugggaacggugau

SEQ ID NO: 359843 - RNA, 32 nt, Human
cauuugcaaagggagagaggggcaagcaugau

SEQ ID NO: 359844 - RNA, 32 nt, Human
cauuugcaaauacauuuaaaugaucucauggu

SEQ ID NO: 359845 - RNA, 32 nt, Human
cauuugcaagcuucaaucucuggaccaucugg

SEQ ID NO: 359846 - RNA, 32 nt, Human
cauuugcacagggggagaccuuacagccuacg

SEQ ID NO: 359847 - RNA, 32 nt, Human
cauuugcacugagaccccugccagagaggaga

SEQ ID NO: 359848 - RNA, 32 nt, Human
cauuugcagcagagggaggaagcagagaauga

SEQ ID NO: 359849 - RNA, 32 nt, Human
cauuugcaggaaaagugcagacucugaguguu

SEQ ID NO: 359850 - RNA, 32 nt, Human
cauuugcaguuaauuagcacaugugaggguua

SEQ ID NO: 359851 - RNA, 32 nt, Human
cauuugcauaagauuaggguaaggugaccagc

SEQ ID NO: 359852 - RNA, 32 nt, Human
cauuugcauaauccacacagucacccugguuu

SEQ ID NO: 359853 - RNA, 32 nt, Human
cauuugcaucugaauccugcugugucuucucu

SEQ ID NO: 359854 - RNA, 32 nt, Human
cauuugccaagucucccaauauccaauuuuaa

SEQ ID NO: 359855 - RNA, 16 nt, Human
cauuugccacccagga

SEQ ID NO: 359856 - RNA, 32 nt, Human
cauuugcccuggacaggagcaggaggaagucc

SEQ ID NO: 359857 - RNA, 32 nt, Human
cauuugccucaugccagcaccuuugaaccggu

SEQ ID NO: 359858 - RNA, 32 nt, Human
cauuugccucccccucuucagcccuggccuag

SEQ ID NO: 359859 - RNA, 32 nt, Human
cauuugccuugcuuuuuaaaugacuuuguuuu

SEQ ID NO: 359860 - RNA, 32 nt, Human
cauuugccuuucuccccagagagcuugaccaa

SEQ ID NO: 359861 - RNA, 32 nt, Human
cauuugcucucacagcagaugacagggugauu

SEQ ID NO: 359862 - RNA, 32 nt, Human
cauuugcugaagauggugucaagugaaccuag

SEQ ID NO: 359863 - RNA, 32 nt, Human
cauuugcugagucugcagaauggaaugcagcu

SEQ ID NO: 359864 - RNA, 32 nt, Human
cauuugcugccucuuggucaucaggagcugcc

SEQ ID NO: 359865 - RNA, 32 nt, Human
cauuugcugcgugagaaaaagcugggcucccu

SEQ ID NO: 359866 - RNA, 32 nt, Human
cauuugcugcuuccugucucugccauucuuuu

SEQ ID NO: 359867 - RNA, 32 nt, Human
cauuugcuguagaaagaugagaaaacuuaagc

SEQ ID NO: 359868 - RNA, 32 nt, Human
cauuugcuguguagcugggacaguuacauuuc

SEQ ID NO: 359869 - RNA, 31 nt, Human
cauuugcuuaguaaaugccuguugaugguuu

SEQ ID NO: 359870 - RNA, 32 nt, Human
cauuugcuucauuuauuuauugcuuuugccca

SEQ ID NO: 359871 - RNA, 32 nt, Human
cauuugcuucucugcugaccuugccaaguugu

SEQ ID NO: 359872 - RNA, 32 nt, Human
cauuugcuucucuguauaaucuugucaaugaa

SEQ ID NO: 359873 - RNA, 32 nt, Human
cauuugcuuggaaaaagaaaugcugaaagcca

SEQ ID NO: 359874 - RNA, 32 nt, Human
cauuugcuuuuguaauucuuaaugagcaauau

SEQ ID NO: 359875 - RNA, 32 nt, Human
cauuuggaaccagggggaaccaggaaggggcu

SEQ ID NO: 359876 - RNA, 22 nt, Human
cauuuggaaccucugacuccau

SEQ ID NO: 359877 - RNA, 32 nt, Human
cauuuggacaccgagacacagacaagaagacg

SEQ ID NO: 359878 - RNA, 32 nt, Human
cauuuggaccccugccuuuucauugcccgaaa

SEQ ID NO: 359879 - RNA, 32 nt, Human
cauuuggacuacaagaagagcuuccuuuaaag

SEQ ID NO: 359880 - RNA, 32 nt, Human
cauuuggacugauucccaguccaagugucuac

SEQ ID NO: 359881 - RNA, 32 nt, Human
cauuuggagguucuugcucaaguaccaacucu

SEQ ID NO: 359882 - RNA, 32 nt, Human
cauuuggauaaauaaaaacaaacaaaugcuuc

SEQ ID NO: 359883 - RNA, 23 nt, Human
cauuuggaugaccucaguuuaaa

SEQ ID NO: 359884 - RNA, 32 nt, Human
cauuuggauggguguggagccagucuccaaga

SEQ ID NO: 359885 - RNA, 32 nt, Human
cauuuggcaagcacuuaucauacacuguaaag

SEQ ID NO: 359886 - RNA, 32 nt, Human
cauuuggcacuagcuugagcccaacucuggcu

SEQ ID NO: 359887 - RNA, 32 nt, Human
cauuuggcauggccagacucugaccccacugc

SEQ ID NO: 359888 - RNA, 32 nt, Human
cauuuggcccugggcucaggggaccagguggg

SEQ ID NO: 359889 - RNA, 23 nt, Human
cauuuggccgggauuacaggugu

SEQ ID NO: 359890 - RNA, 32 nt, Human
cauuuggccucaaugugaaauuaaaguagaaa

SEQ ID NO: 359891 - RNA, 32 nt, Human
cauuuggcucuuccuguuucuagggguuaucu

SEQ ID NO: 359892 - RNA, 32 nt, Human
cauuuggcuggcucuuucuuuguucagaccuc

SEQ ID NO: 359893 - RNA, 32 nt, Human
cauuuggcuuucccaccuaaaccuucuugcuc

SEQ ID NO: 359894 - RNA, 32 nt, Human
cauuuggcuuuuaaaggggaacucagcucuga

SEQ ID NO: 359895 - RNA, 32 nt, Human
cauuugggaaauucagcuuuugcagaagcagu

SEQ ID NO: 359896 - RNA, 32 nt, Human
cauuugggaggguggagggaggcaguguccuu

SEQ ID NO: 359897 - RNA, 32 nt, Human
cauuugggcaaaaauugagccucacaauaaac

SEQ ID NO: 359898 - RNA, 32 nt, Human
cauuugggcugaugcagcagauccagggaaug

SEQ ID NO: 359899 - RNA, 32 nt, Human
cauuuggggaggaagcauguguucugugaggu

SEQ ID NO: 359900 - RNA, 32 nt, Human
cauuuggggaucuggugggcagucgaaccaug

SEQ ID NO: 359901 - RNA, 32 nt, Human
cauuugggggcuccaggacuacaguagaaaag

SEQ ID NO: 359902 - RNA, 32 nt, Human
cauuuggugaccuaccccauauccaauauuuc
